United States Patent 8,178,503 (RIBONUCLEIC ACID INTERFERENCE MOLECULES AND BINDING SITES DERIVED BY ANALYZING INTERGENIC AND INTRONIC REGIONS OF GENOMES) - sequence listing, part 2

SEQ ID NO: 43510 - DNA, 16 bp, H. sapiens
agtgagactctgtctt

SEQ ID NO: 43511 - DNA, 16 bp, H. sapiens
agtgagactgcatctc

SEQ ID NO: 43512 - DNA, 16 bp, H. sapiens
agtgagactgtgcctc

SEQ ID NO: 43513 - DNA, 16 bp, H. sapiens
agtgagactgtgtctc

SEQ ID NO: 43514 - DNA, 16 bp, H. sapiens
agtgagactttgtctc

SEQ ID NO: 43515 - DNA, 16 bp, H. sapiens
agtgagactttgtctt

SEQ ID NO: 43516 - DNA, 16 bp, H. sapiens
agtgagagactgtctc

SEQ ID NO: 43517 - DNA, 16 bp, H. sapiens
agtgagagaggaagca

SEQ ID NO: 43518 - DNA, 16 bp, H. sapiens
agtgagagatgtgcaa

SEQ ID NO: 43519 - DNA, 16 bp, H. sapiens
agtgagagcctgtctc

SEQ ID NO: 43520 - DNA, 16 bp, H. sapiens
agtgagagctgaatga

SEQ ID NO: 43521 - DNA, 16 bp, H. sapiens
agtgagagtctgtctc

SEQ ID NO: 43522 - DNA, 16 bp, H. sapiens
agtgagagtgagagag

SEQ ID NO: 43523 - DNA, 16 bp, H. sapiens
agtgagagttcctgtt

SEQ ID NO: 43524 - DNA, 16 bp, H. sapiens
agtgagatcccatctc

SEQ ID NO: 43525 - DNA, 16 bp, H. sapiens
agtgagatcccgtctc

SEQ ID NO: 43526 - DNA, 16 bp, H. sapiens
agtgagatcccttctc

SEQ ID NO: 43527 - DNA, 16 bp, H. sapiens
agtgagatcctatctc

SEQ ID NO: 43528 - DNA, 16 bp, H. sapiens
agtgagatcctgtctc

SEQ ID NO: 43529 - DNA, 16 bp, H. sapiens
agtgagatctcatctc

SEQ ID NO: 43530 - DNA, 16 bp, H. sapiens
agtgagatcttgtctc

SEQ ID NO: 43531 - DNA, 16 bp, H. sapiens
agtgagattctgtcta

SEQ ID NO: 43532 - DNA, 16 bp, H. sapiens
agtgagattctgtctc

SEQ ID NO: 43533 - DNA, 16 bp, H. sapiens
agtgagatttaaaaaa

SEQ ID NO: 43534 - DNA, 19 bp, H. sapiens
agtgagcaagaagtagcaa

SEQ ID NO: 43535 - DNA, 16 bp, H. sapiens
agtgagcacgtgctgt

SEQ ID NO: 43536 - DNA, 16 bp, H. sapiens
agtgagcagtgagtga

SEQ ID NO: 43537 - DNA, 16 bp, H. sapiens
agtgagccaaaattgt

SEQ ID NO: 43538 - DNA, 16 bp, H. sapiens
agtgagccaaggccat

SEQ ID NO: 43539 - DNA, 16 bp, H. sapiens
agtgagccaaggttac

SEQ ID NO: 43540 - DNA, 16 bp, H. sapiens
agtgagccaccgcgcc

SEQ ID NO: 43541 - DNA, 16 bp, H. sapiens
agtgagccatcttgaa

SEQ ID NO: 43542 - DNA, 16 bp, H. sapiens
agtgagccatcttgga

SEQ ID NO: 43543 - DNA, 16 bp, H. sapiens
agtgagccatgactgt

SEQ ID NO: 43544 - DNA, 31 bp, H. sapiens
agtgagccatgatcatgccactgcactccag

SEQ ID NO: 43545 - DNA, 16 bp, H. sapiens
agtgagccatgatctc

SEQ ID NO: 43546 - DNA, 16 bp, H. sapiens
agtgagccctgattgc

SEQ ID NO: 43547 - DNA, 16 bp, H. sapiens
agtgagccgtgatcac

SEQ ID NO: 43548 - DNA, 16 bp, H. sapiens
agtgagctatgatcac

SEQ ID NO: 43549 - DNA, 16 bp, H. sapiens
agtgagctatgatcat

SEQ ID NO: 43550 - DNA, 16 bp, H. sapiens
agtgagctattatcat

SEQ ID NO: 43551 - DNA, 16 bp, H. sapiens
agtgagctctgatctc

SEQ ID NO: 43552 - DNA, 16 bp, H. sapiens
agtgagctgaagccac

SEQ ID NO: 43553 - DNA, 16 bp, H. sapiens
agtgagctgagtttgc

SEQ ID NO: 43554 - DNA, 16 bp, H. sapiens
agtgagctgcctgcct

SEQ ID NO: 43555 - DNA, 16 bp, H. sapiens
agtgagctgtgatctc

SEQ ID NO: 43556 - DNA, 16 bp, H. sapiens
agtgagctgtgggaca

SEQ ID NO: 43557 - DNA, 16 bp, H. sapiens
agtgaggaaggtatgt

SEQ ID NO: 43558 - DNA, 16 bp, H. sapiens
agtgaggacactgagg

SEQ ID NO: 43559 - DNA, 16 bp, H. sapiens
agtgaggagactgagg

SEQ ID NO: 43560 - DNA, 16 bp, H. sapiens
agtgaggatgtggaga

SEQ ID NO: 43561 - DNA, 16 bp, H. sapiens
agtgaggcaagattgc

SEQ ID NO: 43562 - DNA, 16 bp, H. sapiens
agtgaggcaatgcctc

SEQ ID NO: 43563 - DNA, 16 bp, H. sapiens
agtgaggcaggaaaat

SEQ ID NO: 43564 - DNA, 16 bp, H. sapiens
agtgaggctttgtctc

SEQ ID NO: 43565 - DNA, 16 bp, H. sapiens
agtgagggctctgagg

SEQ ID NO: 43566 - DNA, 16 bp, H. sapiens
agtgagggctgtgagg

SEQ ID NO: 43567 - DNA, 16 bp, H. sapiens
agtgaggggtgtgtga

SEQ ID NO: 43568 - DNA, 16 bp, H. sapiens
agtgagtcaggatcac

SEQ ID NO: 43569 - DNA, 16 bp, H. sapiens
agtgagtctccatctc

SEQ ID NO: 43570 - DNA, 16 bp, H. sapiens
agtgagtgaattcttg

SEQ ID NO: 43571 - DNA, 16 bp, H. sapiens
agtgagtgaattttca

SEQ ID NO: 43572 - DNA, 16 bp, H. sapiens
agtgagtgagttctaa

SEQ ID NO: 43573 - DNA, 16 bp, H. sapiens
agtgagtgagttctct

SEQ ID NO: 43574 - DNA, 16 bp, H. sapiens
agtgagtggagattgt

SEQ ID NO: 43575 - DNA, 16 bp, H. sapiens
agtgagttctcagaag

SEQ ID NO: 43576 - DNA, 16 bp, H. sapiens
agtgagttcttgctct

SEQ ID NO: 43577 - DNA, 16 bp, H. sapiens
agtgagtttttaaaaa

SEQ ID NO: 43578 - DNA, 17 bp, H. sapiens
agtgataatgagcattt

SEQ ID NO: 43579 - DNA, 16 bp, H. sapiens
agtgatagactggatt

SEQ ID NO: 43580 - DNA, 16 bp, H. sapiens
agtgatcatcagagaa

SEQ ID NO: 43581 - DNA, 16 bp, H. sapiens
agtgatcatttaaaaa

SEQ ID NO: 43582 - DNA, 16 bp, H. sapiens
agtgatccaaccacct

SEQ ID NO: 43583 - DNA, 16 bp, H. sapiens
agtgatccacccacat

SEQ ID NO: 43584 - DNA, 16 bp, H. sapiens
agtgatccacccgtct

SEQ ID NO: 43585 - DNA, 16 bp, H. sapiens
agtgatccaccctcct

SEQ ID NO: 43586 - DNA, 16 bp, H. sapiens
agtgatccaccctctt

SEQ ID NO: 43587 - DNA, 16 bp, H. sapiens
agtgatccacttgctt

SEQ ID NO: 43588 - DNA, 26 bp, H. sapiens
agtgatccgcccaccttggcctccca

SEQ ID NO: 43589 - DNA, 18 bp, H. sapiens
agtgatccgcctgcctcg

SEQ ID NO: 43590 - DNA, 16 bp, H. sapiens
agtgatcctcccacca

SEQ ID NO: 43591 - DNA, 16 bp, H. sapiens
agtgatcctccttcct

SEQ ID NO: 43592 - DNA, 16 bp, H. sapiens
agtgatcctctcatct

SEQ ID NO: 43593 - DNA, 16 bp, H. sapiens
agtgatcgacctgcct

SEQ ID NO: 43594 - DNA, 16 bp, H. sapiens
agtgatctacccacct

SEQ ID NO: 43595 - DNA, 16 bp, H. sapiens
agtgatctccccacct

SEQ ID NO: 43596 - DNA, 16 bp, H. sapiens
agtgatcttccagcct

SEQ ID NO: 43597 - DNA, 16 bp, H. sapiens
agtgatcttgggcaag

SEQ ID NO: 43598 - DNA, 16 bp, H. sapiens
agtgatgagattgctg

SEQ ID NO: 43599 - DNA, 16 bp, H. sapiens
agtgatgaggtcttgc

SEQ ID NO: 43600 - DNA, 16 bp, H. sapiens
agtgatgatgagcatg

SEQ ID NO: 43601 - DNA, 16 bp, H. sapiens
agtgatgatgaggttt

SEQ ID NO: 43602 - DNA, 16 bp, H. sapiens
agtgatgatgatgata

SEQ ID NO: 43603 - DNA, 16 bp, H. sapiens
agtgatgatggtggtg

SEQ ID NO: 43604 - DNA, 16 bp, H. sapiens
agtgatgcaataaaca

SEQ ID NO: 43605 - DNA, 16 bp, H. sapiens
agtgatgcagtcttgg

SEQ ID NO: 43606 - DNA, 16 bp, H. sapiens
agtgatgctgggaaaa

SEQ ID NO: 43607 - DNA, 16 bp, H. sapiens
agtgatggaagacaaa

SEQ ID NO: 43608 - DNA, 16 bp, H. sapiens
agtgatggagaaataa

SEQ ID NO: 43609 - DNA, 16 bp, H. sapiens
agtgatgggcgcctgt

SEQ ID NO: 43610 - DNA, 16 bp, H. sapiens
agtgatggtgatggtg

SEQ ID NO: 43611 - DNA, 16 bp, H. sapiens
agtgatggtggccaca

SEQ ID NO: 43612 - DNA, 16 bp, H. sapiens
agtgatgtcatcatcc

SEQ ID NO: 43613 - DNA, 16 bp, H. sapiens
agtgatgtctcctctt

SEQ ID NO: 43614 - DNA, 16 bp, H. sapiens
agtgatgtcttttttt

SEQ ID NO: 43615 - DNA, 16 bp, H. sapiens
agtgatgtggccacaa

SEQ ID NO: 43616 - DNA, 16 bp, H. sapiens
agtgatgtttcaatac

SEQ ID NO: 43617 - DNA, 16 bp, H. sapiens
agtgatgttttaaaaa

SEQ ID NO: 43618 - DNA, 16 bp, H. sapiens
agtgattcctgcctca

SEQ ID NO: 43619 - DNA, 16 bp, H. sapiens
agtgattctgttgcct

SEQ ID NO: 43620 - DNA, 16 bp, H. sapiens
agtgatttattaagga

SEQ ID NO: 43621 - DNA, 16 bp, H. sapiens
agtgatttctcacaag

SEQ ID NO: 43622 - DNA, 16 bp, H. sapiens
agtgatttctctgatg

SEQ ID NO: 43623 - DNA, 16 bp, H. sapiens
agtgatttgcctgagg

SEQ ID NO: 43624 - DNA, 16 bp, H. sapiens
agtgatttgtagattt

SEQ ID NO: 43625 - DNA, 16 bp, H. sapiens
agtgatttgtagtttt

SEQ ID NO: 43626 - DNA, 16 bp, H. sapiens
agtgattttaaaaaga

SEQ ID NO: 43627 - DNA, 16 bp, H. sapiens
agtgattttaattatg

SEQ ID NO: 43628 - DNA, 16 bp, H. sapiens
agtgatttttaaaaat

SEQ ID NO: 43629 - DNA, 16 bp, H. sapiens
agtgatttttaaatat

SEQ ID NO: 43630 - DNA, 16 bp, H. sapiens
agtgatttttgatgtt

SEQ ID NO: 43631 - DNA, 16 bp, H. sapiens
agtgatttttttcctt

SEQ ID NO: 43632 - DNA, 16 bp, H. sapiens
agtgcaaaagtaattg

SEQ ID NO: 43633 - DNA, 16 bp, H. sapiens
agtgcaaaataaaaat

SEQ ID NO: 43634 - DNA, 16 bp, H. sapiens
agtgcaaaggcatgat

SEQ ID NO: 43635 - DNA, 16 bp, H. sapiens
agtgcaatgatgcagt

SEQ ID NO: 43636 - DNA, 16 bp, H. sapiens
agtgcaatggcacggt

SEQ ID NO: 43637 - DNA, 16 bp, H. sapiens
agtgcaatggcacgtt

SEQ ID NO: 43638 - DNA, 17 bp, H. sapiens
agtgcaatggcatgatc

SEQ ID NO: 43639 - DNA, 18 bp, H. sapiens
agtgcaatggcgcaatcc

SEQ ID NO: 43640 - DNA, 19 bp, H. sapiens
agtgcaatggtgtgatctt

SEQ ID NO: 43641 - DNA, 16 bp, H. sapiens
agtgcacaaaagtcaa

SEQ ID NO: 43642 - DNA, 16 bp, H. sapiens
agtgcacaaatcttaa

SEQ ID NO: 43643 - DNA, 16 bp, H. sapiens
agtgcacagtggtctg

SEQ ID NO: 43644 - DNA, 16 bp, H. sapiens
agtgcaccaccatgcc

SEQ ID NO: 43645 - DNA, 16 bp, H. sapiens
agtgcaccgagtgtga

SEQ ID NO: 43646 - DNA, 16 bp, H. sapiens
agtgcacctgtaatcc

SEQ ID NO: 43647 - DNA, 16 bp, H. sapiens
agtgcactgcagcctg

SEQ ID NO: 43648 - DNA, 16 bp, H. sapiens
agtgcacttaaaaaaa

SEQ ID NO: 43649 - DNA, 16 bp, H. sapiens
agtgcagagaagaaaa

SEQ ID NO: 43650 - DNA, 16 bp, H. sapiens
agtgcagatatctctt

SEQ ID NO: 43651 - DNA, 16 bp, H. sapiens
agtgcagccaccttca

SEQ ID NO: 43652 - DNA, 16 bp, H. sapiens
agtgcagccactgtgg

SEQ ID NO: 43653 - DNA, 16 bp, H. sapiens
agtgcagcctggcatt

SEQ ID NO: 43654 - DNA, 16 bp, H. sapiens
agtgcagccttgaact

SEQ ID NO: 43655 - DNA, 16 bp, H. sapiens
agtgcagggtctgaaa

SEQ ID NO: 43656 - DNA, 16 bp, H. sapiens
agtgcagtaacatgct

SEQ ID NO: 43657 - DNA, 18 bp, H. sapiens
agtgcagtagcacaatct

SEQ ID NO: 43658 - DNA, 16 bp, H. sapiens
agtgcagtagtgtgat

SEQ ID NO: 43659 - DNA, 16 bp, H. sapiens
agtgcagtagtgtggt

SEQ ID NO: 43660 - DNA, 16 bp, H. sapiens
agtgcagtgatgcaat

SEQ ID NO: 43661 - DNA, 17 bp, H. sapiens
agtgcagtggcaggatc

SEQ ID NO: 43662 - DNA, 16 bp, H. sapiens
agtgcagtggcccaac

SEQ ID NO: 43663 - DNA, 16 bp, H. sapiens
agtgcagtggcccaat

SEQ ID NO: 43664 - DNA, 19 bp, H. sapiens
agtgcagtggcgtgatctc

SEQ ID NO: 43665 - DNA, 16 bp, H. sapiens
agtgcagtggctggag

SEQ ID NO: 43666 - DNA, 19 bp, H. sapiens
agtgcagtggtacgatctc

SEQ ID NO: 43667 - DNA, 16 bp, H. sapiens
agtgcagtggtgagat

SEQ ID NO: 43668 - DNA, 16 bp, H. sapiens
agtgcagtggtgcaac

SEQ ID NO: 43669 - DNA, 16 bp, H. sapiens
agtgcagtggtgcaat

SEQ ID NO: 43670 - DNA, 17 bp, H. sapiens
agtgcagtggtgcaatt

SEQ ID NO: 43671 - DNA, 16 bp, H. sapiens
agtgcagtggtgccat

SEQ ID NO: 43672 - DNA, 19 bp, H. sapiens
agtgcagtggtgtgatctt

SEQ ID NO: 43673 - DNA, 16 bp, H. sapiens
agtgcagttgcacagt

SEQ ID NO: 43674 - DNA, 16 bp, H. sapiens
agtgcagttgtgcaat

SEQ ID NO: 43675 - DNA, 16 bp, H. sapiens
agtgcatgagctcagt

SEQ ID NO: 43676 - DNA, 16 bp, H. sapiens
agtgcatgtaaaagtt

SEQ ID NO: 43677 - DNA, 16 bp, H. sapiens
agtgcattccagcctg

SEQ ID NO: 43678 - DNA, 16 bp, H. sapiens
agtgccaagcaaaagg

SEQ ID NO: 43679 - DNA, 16 bp, H. sapiens
agtgccaaggctgaga

SEQ ID NO: 43680 - DNA, 16 bp, H. sapiens
agtgccaatttactga

SEQ ID NO: 43681 - DNA, 16 bp, H. sapiens
agtgccacaataaata

SEQ ID NO: 43682 - DNA, 19 bp, H. sapiens
agtgccaccacgcctggct

SEQ ID NO: 43683 - DNA, 16 bp, H. sapiens
agtgccaggaatacag

SEQ ID NO: 43684 - DNA, 16 bp, H. sapiens
agtgccaggcacacag

SEQ ID NO: 43685 - DNA, 16 bp, H. sapiens
agtgccatcatggctc

SEQ ID NO: 43686 - DNA, 16 bp, H. sapiens
agtgccatggcatgat

SEQ ID NO: 43687 - DNA, 16 bp, H. sapiens
agtgccatggctcatg

SEQ ID NO: 43688 - DNA, 16 bp, H. sapiens
agtgccatttgttgaa

SEQ ID NO: 43689 - DNA, 16 bp, H. sapiens
agtgcccagagtgcag

SEQ ID NO: 43690 - DNA, 16 bp, H. sapiens
agtgcccagatatttg

SEQ ID NO: 43691 - DNA, 16 bp, H. sapiens
agtgcccagcacaaag

SEQ ID NO: 43692 - DNA, 16 bp, H. sapiens
agtgcccagcacatag

SEQ ID NO: 43693 - DNA, 16 bp, H. sapiens
agtgcccaggacagcc

SEQ ID NO: 43694 - DNA, 16 bp, H. sapiens
agtgcccaggctcagc

SEQ ID NO: 43695 - DNA, 16 bp, H. sapiens
agtgcccatcaacaga

SEQ ID NO: 43696 - DNA, 17 bp, H. sapiens
agtgccccactcctggt

SEQ ID NO: 43697 - DNA, 16 bp, H. sapiens
agtgccctgcatccca

SEQ ID NO: 43698 - DNA, 16 bp, H. sapiens
agtgccctgtttgacc

SEQ ID NO: 43699 - DNA, 16 bp, H. sapiens
agtgcccttataagag

SEQ ID NO: 43700 - DNA, 16 bp, H. sapiens
agtgccgtggcatgat

SEQ ID NO: 43701 - DNA, 17 bp, H. sapiens
agtgcctacagggctct

SEQ ID NO: 43702 - DNA, 16 bp, H. sapiens
agtgcctaccatgtgc

SEQ ID NO: 43703 - DNA, 16 bp, H. sapiens
agtgcctactgtatgc

SEQ ID NO: 43704 - DNA, 19 bp, H. sapiens
agtgcctcacacctgtaat

SEQ ID NO: 43705 - DNA, 16 bp, H. sapiens
agtgcctcacgcctgt

SEQ ID NO: 43706 - DNA, 16 bp, H. sapiens
agtgcctcagtgggga

SEQ ID NO: 43707 - DNA, 16 bp, H. sapiens
agtgcctcttctccaa

SEQ ID NO: 43708 - DNA, 16 bp, H. sapiens
agtgcctgacacagaa

SEQ ID NO: 43709 - DNA, 16 bp, H. sapiens
agtgcctgcaccattt

SEQ ID NO: 43710 - DNA, 16 bp, H. sapiens
agtgcctggcacacaa

SEQ ID NO: 43711 - DNA, 16 bp, H. sapiens
agtgcctggcacagtg

SEQ ID NO: 43712 - DNA, 16 bp, H. sapiens
agtgcctggcatatag

SEQ ID NO: 43713 - DNA, 16 bp, H. sapiens
agtgcctggcatgtag

SEQ ID NO: 43714 - DNA, 16 bp, H. sapiens
agtgcctggcccagag

SEQ ID NO: 43715 - DNA, 16 bp, H. sapiens
agtgcctggctcacag

SEQ ID NO: 43716 - DNA, 16 bp, H. sapiens
agtgcctggctcatgg

SEQ ID NO: 43717 - DNA, 16 bp, H. sapiens
agtgcctgggctcagc

SEQ ID NO: 43718 - DNA, 16 bp, H. sapiens
agtgcctggtacatag

SEQ ID NO: 43719 - DNA, 16 bp, H. sapiens
agtgcctggtatgtag

SEQ ID NO: 43720 - DNA, 16 bp, H. sapiens
agtgccttttgcctcc

SEQ ID NO: 43721 - DNA, 17 bp, H. sapiens
agtgcggtggcgtgatc

SEQ ID NO: 43722 - DNA, 17 bp, H. sapiens
agtgcggtggtgcaatc

SEQ ID NO: 43723 - DNA, 16 bp, H. sapiens
agtgcggtggtgcgat

SEQ ID NO: 43724 - DNA, 18 bp, H. sapiens
agtgcggtggtgtgatct

SEQ ID NO: 43725 - DNA, 16 bp, H. sapiens
agtgctaaaactggga

SEQ ID NO: 43726 - DNA, 16 bp, H. sapiens
agtgctaagattacaa

SEQ ID NO: 43727 - DNA, 16 bp, H. sapiens
agtgctacaaattttc

SEQ ID NO: 43728 - DNA, 17 bp, H. sapiens
agtgctactgcactcca

SEQ ID NO: 43729 - DNA, 16 bp, H. sapiens
agtgctaggcacatag

SEQ ID NO: 43730 - DNA, 16 bp, H. sapiens
agtgctatgaagaaaa

SEQ ID NO: 43731 - DNA, 16 bp, H. sapiens
agtgctatttttaaaa

SEQ ID NO: 43732 - DNA, 16 bp, H. sapiens
agtgctcaataaatat

SEQ ID NO: 43733 - DNA, 18 bp, H. sapiens
agtgctcagctggcagaa

SEQ ID NO: 43734 - DNA, 16 bp, H. sapiens
agtgctcatgcctgta

SEQ ID NO: 43735 - DNA, 16 bp, H. sapiens
agtgctccaatgaaca

SEQ ID NO: 43736 - DNA, 16 bp, H. sapiens
agtgctctgtaaaatg

SEQ ID NO: 43737 - DNA, 16 bp, H. sapiens
agtgctctgtaaatgt

SEQ ID NO: 43738 - DNA, 16 bp, H. sapiens
agtgctgaaagagaag

SEQ ID NO: 43739 - DNA, 16 bp, H. sapiens
agtgctgaagctgaga

SEQ ID NO: 43740 - DNA, 16 bp, H. sapiens
agtgctgagaggaaaa

SEQ ID NO: 43741 - DNA, 16 bp, H. sapiens
agtgctgagcaaagtg

SEQ ID NO: 43742 - DNA, 16 bp, H. sapiens
agtgctgagttgtatg

SEQ ID NO: 43743 - DNA, 16 bp, H. sapiens
agtgctgcaataaaca

SEQ ID NO: 43744 - DNA, 16 bp, H. sapiens
agtgctgcaataaact

SEQ ID NO: 43745 - DNA, 16 bp, H. sapiens
agtgctgcaatgaaca

SEQ ID NO: 43746 - DNA, 16 bp, H. sapiens
agtgctgctatgaata

SEQ ID NO: 43747 - DNA, 16 bp, H. sapiens
agtgctgctgctgctg

SEQ ID NO: 43748 - DNA, 16 bp, H. sapiens
agtgctggcatgacag

SEQ ID NO: 43749 - DNA, 16 bp, H. sapiens
agtgctggcattgcag

SEQ ID NO: 43750 - DNA, 16 bp, H. sapiens
agtgctgggagagtct

SEQ ID NO: 43751 - DNA, 16 bp, H. sapiens
agtgctgggatgatag

SEQ ID NO: 43752 - DNA, 28 bp, H. sapiens
agtgctgggattacaggcctgagccact

SEQ ID NO: 43753 - DNA, 16 bp, H. sapiens
agtgctgtccaacaga

SEQ ID NO: 43754 - DNA, 16 bp, H. sapiens
agtgctgtgatctcgg

SEQ ID NO: 43755 - DNA, 16 bp, H. sapiens
agtgctgttggccatg

SEQ ID NO: 43756 - DNA, 16 bp, H. sapiens
agtgcttactatatgc

SEQ ID NO: 43757 - DNA, 16 bp, H. sapiens
agtgcttactatgtac

SEQ ID NO: 43758 - DNA, 16 bp, H. sapiens
agtgcttagagaccta

SEQ ID NO: 43759 - DNA, 16 bp, H. sapiens
agtgcttattatgtgc

SEQ ID NO: 43760 - DNA, 16 bp, H. sapiens
agtgcttcctgcagga

SEQ ID NO: 43761 - DNA, 16 bp, H. sapiens
agtgcttggcacatag

SEQ ID NO: 43762 - DNA, 16 bp, H. sapiens
agtgcttggcatacag

SEQ ID NO: 43763 - DNA, 16 bp, H. sapiens
agtgctttaaaaaatt

SEQ ID NO: 43764 - DNA, 16 bp, H. sapiens
agtgctttataaatat

SEQ ID NO: 43765 - DNA, 16 bp, H. sapiens
agtgctttggaaggct

SEQ ID NO: 43766 - DNA, 16 bp, H. sapiens
agtgctttgggaagct

SEQ ID NO: 43767 - DNA, 16 bp, H. sapiens
agtggaaaaattgtct

SEQ ID NO: 43768 - DNA, 16 bp, H. sapiens
agtggaaaattccaca

SEQ ID NO: 43769 - DNA, 16 bp, H. sapiens
agtggaaaatttcaca

SEQ ID NO: 43770 - DNA, 16 bp, H. sapiens
agtggaaagagcactg

SEQ ID NO: 43771 - DNA, 16 bp, H. sapiens
agtggaaatccctgat

SEQ ID NO: 43772 - DNA, 16 bp, H. sapiens
agtggaactgcccttg

SEQ ID NO: 43773 - DNA, 16 bp, H. sapiens
agtggaagaaaagatc

SEQ ID NO: 43774 - DNA, 16 bp, H. sapiens
agtggaagaagccaga

SEQ ID NO: 43775 - DNA, 16 bp, H. sapiens
agtggaagacagtgat

SEQ ID NO: 43776 - DNA, 16 bp, H. sapiens
agtggaagagaaaatg

SEQ ID NO: 43777 - DNA, 16 bp, H. sapiens
agtggaagagggaggc

SEQ ID NO: 43778 - DNA, 16 bp, H. sapiens
agtggaagcagcatga

SEQ ID NO: 43779 - DNA, 16 bp, H. sapiens
agtggaatcatgtagt

SEQ ID NO: 43780 - DNA, 16 bp, H. sapiens
agtggaattactaggt

SEQ ID NO: 43781 - DNA, 16 bp, H. sapiens
agtggaattgctggat

SEQ ID NO: 43782 - DNA, 16 bp, H. sapiens
agtggactggagtgga

SEQ ID NO: 43783 - DNA, 16 bp, H. sapiens
agtggagaaacctggc

SEQ ID NO: 43784 - DNA, 16 bp, H. sapiens
agtggagaaggggttt

SEQ ID NO: 43785 - DNA, 16 bp, H. sapiens
agtggagagagacaga

SEQ ID NO: 43786 - DNA, 16 bp, H. sapiens
agtggagcctacagag

SEQ ID NO: 43787 - DNA, 16 bp, H. sapiens
agtggagctctgagaa

SEQ ID NO: 43788 - DNA, 16 bp, H. sapiens
agtggagctgtcagaa

SEQ ID NO: 43789 - DNA, 16 bp, H. sapiens
agtggaggaagtaact

SEQ ID NO: 43790 - DNA, 16 bp, H. sapiens
agtggaggctgcaatg

SEQ ID NO: 43791 - DNA, 16 bp, H. sapiens
agtggaggttgaagtg

SEQ ID NO: 43792 - DNA, 16 bp, H. sapiens
agtggagtgagtggag

SEQ ID NO: 43793 - DNA, 16 bp, H. sapiens
agtggagtgatcatgg

SEQ ID NO: 43794 - DNA, 16 bp, H. sapiens
agtggagtgatctctg

SEQ ID NO: 43795 - DNA, 16 bp, H. sapiens
agtggagtggagtgga

SEQ ID NO: 43796 - DNA, 16 bp, H. sapiens
agtggagttgatggca

SEQ ID NO: 43797 - DNA, 16 bp, H. sapiens
agtggatagaaaatta

SEQ ID NO: 43798 - DNA, 16 bp, H. sapiens
agtggatcaagaagaa

SEQ ID NO: 43799 - DNA, 16 bp, H. sapiens
agtggatcaccataaa

SEQ ID NO: 43800 - DNA, 16 bp, H. sapiens
agtggatcacgaagtc

SEQ ID NO: 43801 - DNA, 16 bp, H. sapiens
agtggatctcatgaag

SEQ ID NO: 43802 - DNA, 16 bp, H. sapiens
agtggatgcctgaaac

SEQ ID NO: 43803 - DNA, 16 bp, H. sapiens
agtggatggcaaagtg

SEQ ID NO: 43804 - DNA, 16 bp, H. sapiens
agtggatgtggagaaa

SEQ ID NO: 43805 - DNA, 16 bp, H. sapiens
agtggattacctgagg

SEQ ID NO: 43806 - DNA, 16 bp, H. sapiens
agtggattatcataaa

SEQ ID NO: 43807 - DNA, 16 bp, H. sapiens
agtggattcaaagatt

SEQ ID NO: 43808 - DNA, 16 bp, H. sapiens
agtggattggagtgga

SEQ ID NO: 43809 - DNA, 16 bp, H. sapiens
agtggattgggagagg

SEQ ID NO: 43810 - DNA, 16 bp, H. sapiens
agtggatttttgtata

SEQ ID NO: 43811 - DNA, 16 bp, H. sapiens
agtggcaaagctggaa

SEQ ID NO: 43812 - DNA, 16 bp, H. sapiens
agtggcaagagatgag

SEQ ID NO: 43813 - DNA, 16 bp, H. sapiens
agtggcacaaacttgg

SEQ ID NO: 43814 - DNA, 16 bp, H. sapiens
agtggcacagccagga

SEQ ID NO: 43815 - DNA, 16 bp, H. sapiens
agtggcaccatcaggg

SEQ ID NO: 43816 - DNA, 16 bp, H. sapiens
agtggcaccatctcca

SEQ ID NO: 43817 - DNA, 16 bp, H. sapiens
agtggcacgcacctgt

SEQ ID NO: 43818 - DNA, 16 bp, H. sapiens
agtggcactatctagg

SEQ ID NO: 43819 - DNA, 16 bp, H. sapiens
agtggcagaactggga

SEQ ID NO: 43820 - DNA, 16 bp, H. sapiens
agtggcagaatcagaa

SEQ ID NO: 43821 - DNA, 16 bp, H. sapiens
agtggcagagcaagac

SEQ ID NO: 43822 - DNA, 16 bp, H. sapiens
agtggcagagccagca

SEQ ID NO: 43823 - DNA, 16 bp, H. sapiens
agtggcagagccagga

SEQ ID NO: 43824 - DNA, 16 bp, H. sapiens
agtggcagagccaggg

SEQ ID NO: 43825 - DNA, 16 bp, H. sapiens
agtggcagagctagga

SEQ ID NO: 43826 - DNA, 16 bp, H. sapiens
agtggcagaggcagga

SEQ ID NO: 43827 - DNA, 16 bp, H. sapiens
agtggcagatctggga

SEQ ID NO: 43828 - DNA, 16 bp, H. sapiens
agtggcagcagcagtg

SEQ ID NO: 43829 - DNA, 16 bp, H. sapiens
agtggcagccgctgca

SEQ ID NO: 43830 - DNA, 16 bp, H. sapiens
agtggcaggatctctg

SEQ ID NO: 43831 - DNA, 16 bp, H. sapiens
agtggcaggctgaagg

SEQ ID NO: 43832 - DNA, 16 bp, H. sapiens
agtggcagggctgggg

SEQ ID NO: 43833 - DNA, 16 bp, H. sapiens
agtggcatgaccacag

SEQ ID NO: 43834 - DNA, 16 bp, H. sapiens
agtggcatgaccacgg

SEQ ID NO: 43835 - DNA, 16 bp, H. sapiens
agtggccaatgggaaa

SEQ ID NO: 43836 - DNA, 16 bp, H. sapiens
agtggcccccttctca

SEQ ID NO: 43837 - DNA, 16 bp, H. sapiens
agtggccctcttctca

SEQ ID NO: 43838 - DNA, 16 bp, H. sapiens
agtggcgccatctggg

SEQ ID NO: 43839 - DNA, 16 bp, H. sapiens
agtggcgcctgcctgt

SEQ ID NO: 43840 - DNA, 16 bp, H. sapiens
agtggctaaaattaaa

SEQ ID NO: 43841 - DNA, 16 bp, H. sapiens
agtggctaccatattg

SEQ ID NO: 43842 - DNA, 16 bp, H. sapiens
agtggctactgtactg

SEQ ID NO: 43843 - DNA, 16 bp, H. sapiens
agtggctcaagcttgt

SEQ ID NO: 43844 - DNA, 19 bp, H. sapiens
agtggctcacacctgtaat

SEQ ID NO: 43845 - DNA, 18 bp, H. sapiens
agtggctcacacttgtaa

SEQ ID NO: 43846 - DNA, 16 bp, H. sapiens
agtggctcaggcctgg

SEQ ID NO: 43847 - DNA, 19 bp, H. sapiens
agtggctcaggcctgtaat

SEQ ID NO: 43848 - DNA, 19 bp, H. sapiens
agtggctcatgcctgtaat

SEQ ID NO: 43849 - DNA, 19 bp, H. sapiens
agtggctcatgtctgtaat

SEQ ID NO: 43850 - DNA, 16 bp, H. sapiens
agtggctccatcttgg

SEQ ID NO: 43851 - DNA, 16 bp, H. sapiens
agtggctgcaccactt

SEQ ID NO: 43852 - DNA, 16 bp, H. sapiens
agtggctgctctgctg

SEQ ID NO: 43853 - DNA, 16 bp, H. sapiens
agtggctggagtggag

SEQ ID NO: 43854 - DNA, 16 bp, H. sapiens
agtggctggatctcag

SEQ ID NO: 43855 - DNA, 16 bp, H. sapiens
agtggctgggactata

SEQ ID NO: 43856 - DNA, 16 bp, H. sapiens
agtggctgggattaca

SEQ ID NO: 43857 - DNA, 16 bp, H. sapiens
agtggctggtaacagt

SEQ ID NO: 43858 - DNA, 16 bp, H. sapiens
agtggctgttcagcag

SEQ ID NO: 43859 - DNA, 16 bp, H. sapiens
agtggcttaaaatgac

SEQ ID NO: 43860 - DNA, 16 bp, H. sapiens
agtggcttaaacaaga

SEQ ID NO: 43861 - DNA, 16 bp, H. sapiens
agtggcttaaagcaac

SEQ ID NO: 43862 - DNA, 16 bp, H. sapiens
agtggcttaaataata

SEQ ID NO: 43863 - DNA, 16 bp, H. sapiens
agtggcttagctgggt

SEQ ID NO: 43864 - DNA, 16 bp, H. sapiens
agtggcttcaagaggt

SEQ ID NO: 43865 - DNA, 16 bp, H. sapiens
agtggcttgaacctgg

SEQ ID NO: 43866 - DNA, 16 bp, H. sapiens
agtgggaacacagcca

SEQ ID NO: 43867 - DNA, 16 bp, H. sapiens
agtgggaagactgctt

SEQ ID NO: 43868 - DNA, 16 bp, H. sapiens
agtgggaagccactgg

SEQ ID NO: 43869 - DNA, 16 bp, H. sapiens
agtgggaaggggagct

SEQ ID NO: 43870 - DNA, 16 bp, H. sapiens
agtgggaccctgtctc

SEQ ID NO: 43871 - DNA, 16 bp, H. sapiens
agtgggacctggtggg

SEQ ID NO: 43872 - DNA, 16 bp, H. sapiens
agtgggactctgtctc

SEQ ID NO: 43873 - DNA, 16 bp, H. sapiens
agtgggactgctggat

SEQ ID NO: 43874 - DNA, 16 bp, H. sapiens
agtgggacttcatctc

SEQ ID NO: 43875 - DNA, 16 bp, H. sapiens
agtgggacttgctgct

SEQ ID NO: 43876 - DNA, 16 bp, H. sapiens
agtgggagatatacct

SEQ ID NO: 43877 - DNA, 16 bp, H. sapiens
agtgggagcaggcact

SEQ ID NO: 43878 - DNA, 16 bp, H. sapiens
agtgggaggactgctt

SEQ ID NO: 43879 - DNA, 16 bp, H. sapiens
agtgggaggatcactt

SEQ ID NO: 43880 - DNA, 16 bp, H. sapiens
agtgggagtgtaaatt

SEQ ID NO: 43881 - DNA, 16 bp, H. sapiens
agtgggattgctagat

SEQ ID NO: 43882 - DNA, 16 bp, H. sapiens
agtgggattgctggat

SEQ ID NO: 43883 - DNA, 16 bp, H. sapiens
agtgggattgctggct

SEQ ID NO: 43884 - DNA, 16 bp, H. sapiens
agtgggcaaaggagat

SEQ ID NO: 43885 - DNA, 16 bp, H. sapiens
agtgggcaatggacat

SEQ ID NO: 43886 - DNA, 16 bp, H. sapiens
agtgggccaggcgtgg

SEQ ID NO: 43887 - DNA, 16 bp, H. sapiens
agtgggcctggaagag

SEQ ID NO: 43888 - DNA, 16 bp, H. sapiens
agtgggctcctctctg

SEQ ID NO: 43889 - DNA, 16 bp, H. sapiens
agtgggctgggtgcag

SEQ ID NO: 43890 - DNA, 16 bp, H. sapiens
agtgggctgggtgtgg

SEQ ID NO: 43891 - DNA, 16 bp, H. sapiens
agtggggaagacagac

SEQ ID NO: 43892 - DNA, 16 bp, H. sapiens
agtggggacacagcca

SEQ ID NO: 43893 - DNA, 16 bp, H. sapiens
agtggggagacagaca

SEQ ID NO: 43894 - DNA, 18 bp, H. sapiens
agtggggatccatactgg

SEQ ID NO: 43895 - DNA, 16 bp, H. sapiens
agtggggcaggcagct

SEQ ID NO: 43896 - DNA, 16 bp, H. sapiens
agtggggcctggggag

SEQ ID NO: 43897 - DNA, 16 bp, H. sapiens
agtgggggcttccagg

SEQ ID NO: 43898 - DNA, 16 bp, H. sapiens
agtggggtactgctat

SEQ ID NO: 43899 - DNA, 16 bp, H. sapiens
agtgggtagctccttt

SEQ ID NO: 43900 - DNA, 16 bp, H. sapiens
agtgggtgccacaatc

SEQ ID NO: 43901 - DNA, 16 bp, H. sapiens
agtgggtgcctgtagt

SEQ ID NO: 43902 - DNA, 16 bp, H. sapiens
agtgggtggatgggca

SEQ ID NO: 43903 - DNA, 16 bp, H. sapiens
agtggtaaagtgttgg

SEQ ID NO: 43904 - DNA, 16 bp, H. sapiens
agtggtagaaccagga

SEQ ID NO: 43905 - DNA, 16 bp, H. sapiens
agtggtataaaaacag

SEQ ID NO: 43906 - DNA, 16 bp, H. sapiens
agtggtatgaccttgg

SEQ ID NO: 43907 - DNA, 16 bp, H. sapiens
agtggtatgatctggg

SEQ ID NO: 43908 - DNA, 16 bp, H. sapiens
agtggtatgtgcctgt

SEQ ID NO: 43909 - DNA, 16 bp, H. sapiens
agtggtcaaaaagaaa

SEQ ID NO: 43910 - DNA, 16 bp, H. sapiens
agtggtgaacaagaca

SEQ ID NO: 43911 - DNA, 16 bp, H. sapiens
agtggtgatggctgca

SEQ ID NO: 43912 - DNA, 16 bp, H. sapiens
agtggtgatggttgca

SEQ ID NO: 43913 - DNA, 16 bp, H. sapiens
agtggtgcaagctcag

SEQ ID NO: 43914 - DNA, 16 bp, H. sapiens
agtggtgccatctctg

SEQ ID NO: 43915 - DNA, 16 bp, H. sapiens
agtggtgcctgcatat

SEQ ID NO: 43916 - DNA, 16 bp, H. sapiens
agtggtgctagaggaa

SEQ ID NO: 43917 - DNA, 16 bp, H. sapiens
agtggtgctgggagaa

SEQ ID NO: 43918 - DNA, 16 bp, H. sapiens
agtggtggaagtagct

SEQ ID NO: 43919 - DNA, 16 bp, H. sapiens
agtggtggagctggga

SEQ ID NO: 43920 - DNA, 16 bp, H. sapiens
agtggtggcacatgcc

SEQ ID NO: 43921 - DNA, 16 bp, H. sapiens
agtggtggcaggctgg

SEQ ID NO: 43922 - DNA, 16 bp, H. sapiens
agtggtggcatgcacc

SEQ ID NO: 43923 - DNA, 17 bp, H. sapiens
agtggtggctcatacct

SEQ ID NO: 43924 - DNA, 17 bp, H. sapiens
agtggtggctcatgcct

SEQ ID NO: 43925 - DNA, 16 bp, H. sapiens
agtggtggctgtagaa

SEQ ID NO: 43926 - DNA, 16 bp, H. sapiens
agtggtgggatctcag

SEQ ID NO: 43927 - DNA, 16 bp, H. sapiens
agtggtgggattacaa

SEQ ID NO: 43928 - DNA, 16 bp, H. sapiens
agtggtggtgggctgg

SEQ ID NO: 43929 - DNA, 16 bp, H. sapiens
agtggtgtcatctcag

SEQ ID NO: 43930 - DNA, 18 bp, H. sapiens
agtggtgtgatctcagct

SEQ ID NO: 43931 - DNA, 16 bp, H. sapiens
agtggtgtgatgatag

SEQ ID NO: 43932 - DNA, 16 bp, H. sapiens
agtggtgtgcatctgt

SEQ ID NO: 43933 - DNA, 16 bp, H. sapiens
agtggtgtgctggtaa

SEQ ID NO: 43934 - DNA, 16 bp, H. sapiens
agtggtgtgtgcttgt

SEQ ID NO: 43935 - DNA, 19 bp, H. sapiens
agtggttcacgcctgtaat

SEQ ID NO: 43936 - DNA, 19 bp, H. sapiens
agtggttcatgcctataat

SEQ ID NO: 43937 - DNA, 16 bp, H. sapiens
agtggttctcaaactt

SEQ ID NO: 43938 - DNA, 16 bp, H. sapiens
agtggttctcaaagtg

SEQ ID NO: 43939 - DNA, 16 bp, H. sapiens
agtggttctcagcctt

SEQ ID NO: 43940 - DNA, 16 bp, H. sapiens
agtggttctccatgag

SEQ ID NO: 43941 - DNA, 16 bp, H. sapiens
agtggttctcccagca

SEQ ID NO: 43942 - DNA, 16 bp, H. sapiens
agtggttctctcagca

SEQ ID NO: 43943 - DNA, 16 bp, H. sapiens
agtggttgcagtgagc

SEQ ID NO: 43944 - DNA, 16 bp, H. sapiens
agtggttgccagaagt

SEQ ID NO: 43945 - DNA, 16 bp, H. sapiens
agtggttggtaccagt

SEQ ID NO: 43946 - DNA, 16 bp, H. sapiens
agtggtttctagttct

SEQ ID NO: 43947 - DNA, 25 bp, H. sapiens
agtggtttgtagttctccttgaaga

SEQ ID NO: 43948 - DNA, 16 bp, H. sapiens
agtggttttaaaacat

SEQ ID NO: 43949 - DNA, 16 bp, H. sapiens
agtggttttcaaactt

SEQ ID NO: 43950 - DNA, 16 bp, H. sapiens
agtggttttctttttc

SEQ ID NO: 43951 - DNA, 16 bp, H. sapiens
agtggttttgagtgaa

SEQ ID NO: 43952 - DNA, 16 bp, H. sapiens
agtgtaaacaaagcct

SEQ ID NO: 43953 - DNA, 16 bp, H. sapiens
agtgtaaatgtaactt

SEQ ID NO: 43954 - DNA, 16 bp, H. sapiens
agtgtaaccatcaccc

SEQ ID NO: 43955 - DNA, 16 bp, H. sapiens
agtgtaattagcatat

SEQ ID NO: 43956 - DNA, 16 bp, H. sapiens
agtgtacacacacaca

SEQ ID NO: 43957 - DNA, 16 bp, H. sapiens
agtgtacagtaatgtt

SEQ ID NO: 43958 - DNA, 16 bp, H. sapiens
agtgtagaagcattcc

SEQ ID NO: 43959 - DNA, 16 bp, H. sapiens
agtgtataaatatttt

SEQ ID NO: 43960 - DNA, 19 bp, H. sapiens
agtgtataagaatgcttgt

SEQ ID NO: 43961 - DNA, 16 bp, H. sapiens
agtgtataagcatccc

SEQ ID NO: 43962 - DNA, 16 bp, H. sapiens
agtgtatattttcaaa

SEQ ID NO: 43963 - DNA, 16 bp, H. sapiens
agtgtatgaaaagatg

SEQ ID NO: 43964 - DNA, 16 bp, H. sapiens
agtgtatgagtgtgtg

SEQ ID NO: 43965 - DNA, 16 bp, H. sapiens
agtgtatgcatgtgtg

SEQ ID NO: 43966 - DNA, 16 bp, H. sapiens
agtgtatgtgtctttt

SEQ ID NO: 43967 - DNA, 16 bp, H. sapiens
agtgtattttctgtgt

SEQ ID NO: 43968 - DNA, 16 bp, H. sapiens
agtgtattttgcattt

SEQ ID NO: 43969 - DNA, 16 bp, H. sapiens
agtgtcaaatgcattt

SEQ ID NO: 43970 - DNA, 16 bp, H. sapiens
agtgtcactctgttgc

SEQ ID NO: 43971 - DNA, 16 bp, H. sapiens
agtgtcactggtctgt

SEQ ID NO: 43972 - DNA, 16 bp, H. sapiens
agtgtcagagctggga

SEQ ID NO: 43973 - DNA, 16 bp, H. sapiens
agtgtcagcatcacct

SEQ ID NO: 43974 - DNA, 16 bp, H. sapiens
agtgtcatcagttaag

SEQ ID NO: 43975 - DNA, 16 bp, H. sapiens
agtgtccagcaacaga

SEQ ID NO: 43976 - DNA, 16 bp, H. sapiens
agtgtccatcagtaga

SEQ ID NO: 43977 - DNA, 16 bp, H. sapiens
agtgtctactatatgc

SEQ ID NO: 43978 - DNA, 16 bp, H. sapiens
agtgtctgacacatag

SEQ ID NO: 43979 - DNA, 16 bp, H. sapiens
agtgtctgttcatgta

SEQ ID NO: 43980 - DNA, 16 bp, H. sapiens
agtgtcttactctgtt

SEQ ID NO: 43981 - DNA, 16 bp, H. sapiens
agtgtcttagtccatt

SEQ ID NO: 43982 - DNA, 16 bp, H. sapiens
agtgtcttgaacttga

SEQ ID NO: 43983 - DNA, 16 bp, H. sapiens
agtgtcttttgcagag

SEQ ID NO: 43984 - DNA, 16 bp, H. sapiens
agtgtgaagagggaaa

SEQ ID NO: 43985 - DNA, 16 bp, H. sapiens
agtgtgacagcctttt

SEQ ID NO: 43986 - DNA, 16 bp, H. sapiens
agtgtgaccaaaactt

SEQ ID NO: 43987 - DNA, 16 bp, H. sapiens
agtgtgagaacagact

SEQ ID NO: 43988 - DNA, 16 bp, H. sapiens
agtgtgagaagggact

SEQ ID NO: 43989 - DNA, 16 bp, H. sapiens
agtgtgagagagaaaa

SEQ ID NO: 43990 - DNA, 16 bp, H. sapiens
agtgtgagatcaaact

SEQ ID NO: 43991 - DNA, 16 bp, H. sapiens
agtgtgagccaccttg

SEQ ID NO: 43992 - DNA, 16 bp, H. sapiens
agtgtgagtgagtgtg

SEQ ID NO: 43993 - DNA, 16 bp, H. sapiens
agtgtgagtgtgcatg

SEQ ID NO: 43994 - DNA, 16 bp, H. sapiens
agtgtgagtgtgtgtg

SEQ ID NO: 43995 - DNA, 17 bp, H. sapiens
agtgtgatctcagctca

SEQ ID NO: 43996 - DNA, 17 bp, H. sapiens
agtgtgatgaggtgctg

SEQ ID NO: 43997 - DNA, 21 bp, H. sapiens
agtgtgcaaataggtgtgggt

SEQ ID NO: 43998 - DNA, 16 bp, H. sapiens
agtgtgcactgtaccc

SEQ ID NO: 43999 - DNA, 16 bp, H. sapiens
agtgtgcagtggtgca

SEQ ID NO: 44000 - DNA, 16 bp, H. sapiens
agtgtgcatgcgtgtg

SEQ ID NO: 44001 - DNA, 16 bp, H. sapiens
agtgtgcatgtgtctt

SEQ ID NO: 44002 - DNA, 16 bp, H. sapiens
agtgtgcatgtgtgtg

SEQ ID NO: 44003 - DNA, 16 bp, H. sapiens
agtgtgcgtgtgtgtg

SEQ ID NO: 44004 - DNA, 16 bp, H. sapiens
agtgtgctatgatcat

SEQ ID NO: 44005 - DNA, 16 bp, H. sapiens
agtgtgctgtgttcag

SEQ ID NO: 44006 - DNA, 16 bp, H. sapiens
agtgtggaagacagtg

SEQ ID NO: 44007 - DNA, 16 bp, H. sapiens
agtgtggaaggggacc

SEQ ID NO: 44008 - DNA, 16 bp, H. sapiens
agtgtggaatctgaaa

SEQ ID NO: 44009 - DNA, 16 bp, H. sapiens
agtgtggagagggact

SEQ ID NO: 44010 - DNA, 16 bp, H. sapiens
agtgtggaggggaaat

SEQ ID NO: 44011 - DNA, 16 bp, H. sapiens
agtgtggcaagacctt

SEQ ID NO: 44012 - DNA, 16 bp, H. sapiens
agtgtggcagtttctt

SEQ ID NO: 44013 - DNA, 16 bp, H. sapiens
agtgtggctgcagcag

SEQ ID NO: 44014 - DNA, 16 bp, H. sapiens
agtgtggctgtgttcc

SEQ ID NO: 44015 - DNA, 16 bp, H. sapiens
agtgtggggcccacca

SEQ ID NO: 44016 - DNA, 16 bp, H. sapiens
agtgtggggcccgcca

SEQ ID NO: 44017 - DNA, 16 bp, H. sapiens
agtgtggtatatttgt

SEQ ID NO: 44018 - DNA, 18 bp, H. sapiens
agtgtggtggcacaatct

SEQ ID NO: 44019 - DNA, 16 bp, H. sapiens
agtgtggtggcacaca

SEQ ID NO: 44020 - DNA, 17 bp, H. sapiens
agtgtggtggcaggtgc

SEQ ID NO: 44021 - DNA, 16 bp, H. sapiens
agtgtggtggcatatg

SEQ ID NO: 44022 - DNA, 16 bp, H. sapiens
agtgtggtggcatgcg

SEQ ID NO: 44023 - DNA, 16 bp, H. sapiens
agtgtggtggctcatg

SEQ ID NO: 44024 - DNA, 16 bp, H. sapiens
agtgtggtggtgtgat

SEQ ID NO: 44025 - DNA, 16 bp, H. sapiens
agtgtggtggtgtgca

SEQ ID NO: 44026 - DNA, 16 bp, H. sapiens
agtgtgtatgtatgtg

SEQ ID NO: 44027 - DNA, 16 bp, H. sapiens
agtgtgtattgttccc

SEQ ID NO: 44028 - DNA, 16 bp, H. sapiens
agtgtgtgcgtgcatg

SEQ ID NO: 44029 - DNA, 16 bp, H. sapiens
agtgtgtgctgattgg

SEQ ID NO: 44030 - DNA, 16 bp, H. sapiens
agtgtgtgtatgtata

SEQ ID NO: 44031 - DNA, 16 bp, H. sapiens
agtgtgtgtatgtgag

SEQ ID NO: 44032 - DNA, 16 bp, H. sapiens
agtgtgtgtatgtgtg

SEQ ID NO: 44033 - DNA, 16 bp, H. sapiens
agtgtgtgtgaatgtg

SEQ ID NO: 44034 - DNA, 17 bp, H. sapiens
agtgtgtgtgcacatgt

SEQ ID NO: 44035 - DNA, 16 bp, H. sapiens
agtgtgtgtgcatgtg

SEQ ID NO: 44036 - DNA, 16 bp, H. sapiens
agtgtgtgtgcgtgtg

SEQ ID NO: 44037 - DNA, 16 bp, H. sapiens
agtgtgtgtgtgagca

SEQ ID NO: 44038 - DNA, 16 bp, H. sapiens
agtgtgtgtgtgccct

SEQ ID NO: 44039 - DNA, 16 bp, H. sapiens
agtgtgtgtgtgtctg

SEQ ID NO: 44040 - DNA, 16 bp, H. sapiens
agtgtgtgtgtgtgag

SEQ ID NO: 44041 - DNA, 16 bp, H. sapiens
agtgtgttctcacact

SEQ ID NO: 44042 - DNA, 16 bp, H. sapiens
agtgtgttgaagagat

SEQ ID NO: 44043 - DNA, 16 bp, H. sapiens
agtgtgttggctttct

SEQ ID NO: 44044 - DNA, 16 bp, H. sapiens
agtgttaactcatttc

SEQ ID NO: 44045 - DNA, 16 bp, H. sapiens
agtgttacaagatttt

SEQ ID NO: 44046 - DNA, 16 bp, H. sapiens
agtgttagaaggaaaa

SEQ ID NO: 44047 - DNA, 16 bp, H. sapiens
agtgttagctattatt

SEQ ID NO: 44048 - DNA, 16 bp, H. sapiens
agtgttatttcattgt

SEQ ID NO: 44049 - DNA, 16 bp, H. sapiens
agtgttcaagaccagc

SEQ ID NO: 44050 - DNA, 16 bp, H. sapiens
agtgttcataaataaa

SEQ ID NO: 44051 - DNA, 16 bp, H. sapiens
agtgttccacctgcct

SEQ ID NO: 44052 - DNA, 16 bp, H. sapiens
agtgttcctaagtgca

SEQ ID NO: 44053 - DNA, 16 bp, H. sapiens
agtgttcctttaactg

SEQ ID NO: 44054 - DNA, 16 bp, H. sapiens
agtgttctcactgttc

SEQ ID NO: 44055 - DNA, 16 bp, H. sapiens
agtgttggaggtgagg

SEQ ID NO: 44056 - DNA, 16 bp, H. sapiens
agtgttggccaggctg

SEQ ID NO: 44057 - DNA, 17 bp, H. sapiens
agtgttggctggggtga

SEQ ID NO: 44058 - DNA, 16 bp, H. sapiens
agtgttgggagacaga

SEQ ID NO: 44059 - DNA, 16 bp, H. sapiens
agtgttgggattacaa

SEQ ID NO: 44060 - DNA, 16 bp, H. sapiens
agtgttgggattgtag

SEQ ID NO: 44061 - DNA, 16 bp, H. sapiens
agtgttggtggaaatg

SEQ ID NO: 44062 - DNA, 16 bp, H. sapiens
agtgttgtgatcatgg

SEQ ID NO: 44063 - DNA, 16 bp, H. sapiens
agtgtttaatccattt

SEQ ID NO: 44064 - DNA, 16 bp, H. sapiens
agtgtttacatcagat

SEQ ID NO: 44065 - DNA, 16 bp, H. sapiens
agtgtttactatatgc

SEQ ID NO: 44066 - DNA, 16 bp, H. sapiens
agtgtttagaaatgct

SEQ ID NO: 44067 - DNA, 16 bp, H. sapiens
agtgtttataaagtct

SEQ ID NO: 44068 - DNA, 16 bp, H. sapiens
agtgtttattaaataa

SEQ ID NO: 44069 - DNA, 16 bp, H. sapiens
agtgtttcacaactgc

SEQ ID NO: 44070 - DNA, 16 bp, H. sapiens
agtgtttcctcctctt

SEQ ID NO: 44071 - DNA, 16 bp, H. sapiens
agtgtttctcaaacat

SEQ ID NO: 44072 - DNA, 16 bp, H. sapiens
agtgtttctcaaagta

SEQ ID NO: 44073 - DNA, 16 bp, H. sapiens
agtgtttctcccactt

SEQ ID NO: 44074 - DNA, 16 bp, H. sapiens
agtgtttctcccagca

SEQ ID NO: 44075 - DNA, 16 bp, H. sapiens
agtgtttgagaccagc

SEQ ID NO: 44076 - DNA, 16 bp, H. sapiens
agtgtttgatataatt

SEQ ID NO: 44077 - DNA, 16 bp, H. sapiens
agtgtttggagatttt

SEQ ID NO: 44078 - DNA, 16 bp, H. sapiens
agtgtttggtttttct

SEQ ID NO: 44079 - DNA, 16 bp, H. sapiens
agtgttttaaaaaata

SEQ ID NO: 44080 - DNA, 16 bp, H. sapiens
agtgttttaagaaagt

SEQ ID NO: 44081 - DNA, 16 bp, H. sapiens
agtgttttacagtttt

SEQ ID NO: 44082 - DNA, 16 bp, H. sapiens
agtgttttgtagattt

SEQ ID NO: 44083 - DNA, 16 bp, H. sapiens
agtgtttttacctttc

SEQ ID NO: 44084 - DNA, 16 bp, H. sapiens
agtgttttttagtata

SEQ ID NO: 44085 - DNA, 16 bp, H. sapiens
agttaaaatgattttt

SEQ ID NO: 44086 - DNA, 16 bp, H. sapiens
agttaaaatgccacaa

SEQ ID NO: 44087 - DNA, 16 bp, H. sapiens
agttaaaattttcttt

SEQ ID NO: 44088 - DNA, 16 bp, H. sapiens
agttaaacttttgttt

SEQ ID NO: 44089 - DNA, 16 bp, H. sapiens
agttaaataaattatg

SEQ ID NO: 44090 - DNA, 16 bp, H. sapiens
agttaaatgaatgaat

SEQ ID NO: 44091 - DNA, 16 bp, H. sapiens
agttaaatgtgaattt

SEQ ID NO: 44092 - DNA, 16 bp, H. sapiens
agttaaatttaaaagt

SEQ ID NO: 44093 - DNA, 16 bp, H. sapiens
agttaacataattttt

SEQ ID NO: 44094 - DNA, 16 bp, H. sapiens
agttaacatttgttga

SEQ ID NO: 44095 - DNA, 16 bp, H. sapiens
agttaactgtgaaaca

SEQ ID NO: 44096 - DNA, 16 bp, H. sapiens
agttaagacttcaaca

SEQ ID NO: 44097 - DNA, 18 bp, H. sapiens
agttaagagcaatgtttt

SEQ ID NO: 44098 - DNA, 16 bp, H. sapiens
agttaaggaaacaaaa

SEQ ID NO: 44099 - DNA, 16 bp, H. sapiens
agttaagttttgggga

SEQ ID NO: 44100 - DNA, 16 bp, H. sapiens
agttaatagtaatgta

SEQ ID NO: 44101 - DNA, 16 bp, H. sapiens
agttaatatatgtaaa

SEQ ID NO: 44102 - DNA, 16 bp, H. sapiens
agttaatattttcttt

SEQ ID NO: 44103 - DNA, 16 bp, H. sapiens
agttaatatttttctt

SEQ ID NO: 44104 - DNA, 16 bp, H. sapiens
agttaatcacttatgt

SEQ ID NO: 44105 - DNA, 16 bp, H. sapiens
agttaatcctctcaaa

SEQ ID NO: 44106 - DNA, 17 bp, H. sapiens
agttaatgagtgcagca

SEQ ID NO: 44107 - DNA, 22 bp, H. sapiens
agttaatgggtgcagcacacca

SEQ ID NO: 44108 - DNA, 16 bp, H. sapiens
agttaattagttaatt

SEQ ID NO: 44109 - DNA, 16 bp, H. sapiens
agttaattcatgattt

SEQ ID NO: 44110 - DNA, 16 bp, H. sapiens
agttaattcatgtaaa

SEQ ID NO: 44111 - DNA, 16 bp, H. sapiens
agttaattcttgtata

SEQ ID NO: 44112 - DNA, 16 bp, H. sapiens
agttaatttataaaga

SEQ ID NO: 44113 - DNA, 16 bp, H. sapiens
agttacaaaaatagta

SEQ ID NO: 44114 - DNA, 16 bp, H. sapiens
agttacaaaaggaaaa

SEQ ID NO: 44115 - DNA, 16 bp, H. sapiens
agttacacaagatgaa

SEQ ID NO: 44116 - DNA, 16 bp, H. sapiens
agttacaccattggct

SEQ ID NO: 44117 - DNA, 16 bp, H. sapiens
agttacaggatgagat

SEQ ID NO: 44118 - DNA, 16 bp, H. sapiens
agttacatgaataagt

SEQ ID NO: 44119 - DNA, 16 bp, H. sapiens
agttaccacacctggc

SEQ ID NO: 44120 - DNA, 16 bp, H. sapiens
agttacctaacttctc

SEQ ID NO: 44121 - DNA, 16 bp, H. sapiens
agttacctttgtgtgt

SEQ ID NO: 44122 - DNA, 16 bp, H. sapiens
agttactgggattaca

SEQ ID NO: 44123 - DNA, 16 bp, H. sapiens
agttactgtagccttg

SEQ ID NO: 44124 - DNA, 16 bp, H. sapiens
agttacttaacctctt

SEQ ID NO: 44125 - DNA, 16 bp, H. sapiens
agttacttcactcaga

SEQ ID NO: 44126 - DNA, 16 bp, H. sapiens
agttagaaaagacaaa

SEQ ID NO: 44127 - DNA, 16 bp, H. sapiens
agttagaatttttaaa

SEQ ID NO: 44128 - DNA, 16 bp, H. sapiens
agttagagtccagcct

SEQ ID NO: 44129 - DNA, 17 bp, H. sapiens
agttagatgtacttctt

SEQ ID NO: 44130 - DNA, 16 bp, H. sapiens
agttagcaagtgatga

SEQ ID NO: 44131 - DNA, 16 bp, H. sapiens
agttagccaagcatgg

SEQ ID NO: 44132 - DNA, 16 bp, H. sapiens
agttagccaggcctgg

SEQ ID NO: 44133 - DNA, 16 bp, H. sapiens
agttagctgggcttgg

SEQ ID NO: 44134 - DNA, 16 bp, H. sapiens
agttagggaggaattc

SEQ ID NO: 44135 - DNA, 16 bp, H. sapiens
agttagggtggggcag

SEQ ID NO: 44136 - DNA, 16 bp, H. sapiens
agttaggtcttcttat

SEQ ID NO: 44137 - DNA, 16 bp, H. sapiens
agttagttacttcctg

SEQ ID NO: 44138 - DNA, 16 bp, H. sapiens
agttagttagttagtt

SEQ ID NO: 44139 - DNA, 17 bp, H. sapiens
agttagttcttcttgtt

SEQ ID NO: 44140 - DNA, 16 bp, H. sapiens
agttatagggaatagt

SEQ ID NO: 44141 - DNA, 16 bp, H. sapiens
agttatatatacacat

SEQ ID NO: 44142 - DNA, 16 bp, H. sapiens
agttatatttgtataa

SEQ ID NO: 44143 - DNA, 16 bp, H. sapiens
agttatcaagacagtg

SEQ ID NO: 44144 - DNA, 16 bp, H. sapiens
agttatcaaggaaatg

SEQ ID NO: 44145 - DNA, 16 bp, H. sapiens
agttatcatatgatcc

SEQ ID NO: 44146 - DNA, 16 bp, H. sapiens
agttatccagttttcc

SEQ ID NO: 44147 - DNA, 16 bp, H. sapiens
agttatctaatttgtt

SEQ ID NO: 44148 - DNA, 16 bp, H. sapiens
agttatctattgctat

SEQ ID NO: 44149 - DNA, 16 bp, H. sapiens
agttatgcatcactta

SEQ ID NO: 44150 - DNA, 16 bp, H. sapiens
agttatggcaaacaga

SEQ ID NO: 44151 - DNA, 16 bp, H. sapiens
agttatggctggtgga

SEQ ID NO: 44152 - DNA, 16 bp, H. sapiens
agttatgttttataaa

SEQ ID NO: 44153 - DNA, 16 bp, H. sapiens
agttattcatttaacc

SEQ ID NO: 44154 - DNA, 16 bp, H. sapiens
agttattcatttgtaa

SEQ ID NO: 44155 - DNA, 16 bp, H. sapiens
agttatttagaaatat

SEQ ID NO: 44156 - DNA, 16 bp, H. sapiens
agttatttcttgcttt

SEQ ID NO: 44157 - DNA, 16 bp, H. sapiens
agttatttgcataagt

SEQ ID NO: 44158 - DNA, 16 bp, H. sapiens
agttattttaaaatct

SEQ ID NO: 44159 - DNA, 16 bp, H. sapiens
agttattttaaaatga

SEQ ID NO: 44160 - DNA, 16 bp, H. sapiens
agttattttgcagaat

SEQ ID NO: 44161 - DNA, 16 bp, H. sapiens
agttatttttgaatgt

SEQ ID NO: 44162 - DNA, 16 bp, H. sapiens
agttcaaaaccagccc

SEQ ID NO: 44163 - DNA, 16 bp, H. sapiens
agttcaaacccattgc

SEQ ID NO: 44164 - DNA, 16 bp, H. sapiens
agttcaacaccagcct

SEQ ID NO: 44165 - DNA, 16 bp, H. sapiens
agttcaagaacagcat

SEQ ID NO: 44166 - DNA, 16 bp, H. sapiens
agttcaagaccaacgt

SEQ ID NO: 44167 - DNA, 17 bp, H. sapiens
agttcaagaccagcctc

SEQ ID NO: 44168 - DNA, 18 bp, H. sapiens
agttcaagaccagcctga

SEQ ID NO: 44169 - DNA, 19 bp, H. sapiens
agttcaagaccagcctgac

SEQ ID NO: 44170 - DNA, 17 bp, H. sapiens
agttcaagaccagcctt

SEQ ID NO: 44171 - DNA, 16 bp, H. sapiens
agttcaagaccagtct

SEQ ID NO: 44172 - DNA, 16 bp, H. sapiens
agttcaagactagcct

SEQ ID NO: 44173 - DNA, 16 bp, H. sapiens
agttcaagagcagcct

SEQ ID NO: 44174 - DNA, 16 bp, H. sapiens
agttcaagaggagcct

SEQ ID NO: 44175 - DNA, 16 bp, H. sapiens
agttcaagatcaaggc

SEQ ID NO: 44176 - DNA, 16 bp, H. sapiens
agttcaagatcagcct

SEQ ID NO: 44177 - DNA, 16 bp, H. sapiens
agttcaagatgaaatt

SEQ ID NO: 44178 - DNA, 16 bp, H. sapiens
agttcaagatgagcct

SEQ ID NO: 44179 - DNA, 16 bp, H. sapiens
agttcaaggccaccct

SEQ ID NO: 44180 - DNA, 16 bp, H. sapiens
agttcaaggccagcct

SEQ ID NO: 44181 - DNA, 16 bp, H. sapiens
agttcaatggtgcaat

SEQ ID NO: 44182 - DNA, 16 bp, H. sapiens
agttcaattattttaa

SEQ ID NO: 44183 - DNA, 16 bp, H. sapiens
agttcaccaattcaaa

SEQ ID NO: 44184 - DNA, 16 bp, H. sapiens
agttcaccagcaatgg

SEQ ID NO: 44185 - DNA, 16 bp, H. sapiens
agttcacccatttaaa

SEQ ID NO: 44186 - DNA, 16 bp, H. sapiens
agttcactaatctttt

SEQ ID NO: 44187 - DNA, 16 bp, H. sapiens
agttcactgattcttc

SEQ ID NO: 44188 - DNA, 16 bp, H. sapiens
agttcactgcagcctc

SEQ ID NO: 44189 - DNA, 16 bp, H. sapiens
agttcactgtaacctc

SEQ ID NO: 44190 - DNA, 16 bp, H. sapiens
agttcacttcaacctc

SEQ ID NO: 44191 - DNA, 16 bp, H. sapiens
agttcagagaaaaaag

SEQ ID NO: 44192 - DNA, 16 bp, H. sapiens
agttcagcaaacattt

SEQ ID NO: 44193 - DNA, 16 bp, H. sapiens
agttcagcatggctgt

SEQ ID NO: 44194 - DNA, 16 bp, H. sapiens
agttcagccacagtgg

SEQ ID NO: 44195 - DNA, 16 bp, H. sapiens
agttcagcccataaca

SEQ ID NO: 44196 - DNA, 16 bp, H. sapiens
agttcaggagatggag

SEQ ID NO: 44197 - DNA, 16 bp, H. sapiens
agttcaggagtacaag

SEQ ID NO: 44198 - DNA, 16 bp, H. sapiens
agttcaggcaattctc

SEQ ID NO: 44199 - DNA, 16 bp, H. sapiens
agttcagggccagggc

SEQ ID NO: 44200 - DNA, 16 bp, H. sapiens
agttcagtggcaagat

SEQ ID NO: 44201 - DNA, 16 bp, H. sapiens
agttcagtggtgtgat

SEQ ID NO: 44202 - DNA, 16 bp, H. sapiens
agttcagtggttttca

SEQ ID NO: 44203 - DNA, 16 bp, H. sapiens
agttcagtgtggctgg

SEQ ID NO: 44204 - DNA, 16 bp, H. sapiens
agttcagtgttaatga

SEQ ID NO: 44205 - DNA, 16 bp, H. sapiens
agttcagtgtttcttt

SEQ ID NO: 44206 - DNA, 16 bp, H. sapiens
agttcagtttgggaca

SEQ ID NO: 44207 - DNA, 16 bp, H. sapiens
agttcatacttaataa

SEQ ID NO: 44208 - DNA, 16 bp, H. sapiens
agttcatccactgtgg

SEQ ID NO: 44209 - DNA, 25 bp, H. sapiens
agttcatgtcctttgtagggacatg

SEQ ID NO: 44210 - DNA, 16 bp, H. sapiens
agttcatgtgttggaa

SEQ ID NO: 44211 - DNA, 16 bp, H. sapiens
agttcattaattttca

SEQ ID NO: 44212 - DNA, 16 bp, H. sapiens
agttcattattttaaa

SEQ ID NO: 44213 - DNA, 16 bp, H. sapiens
agttcattcatgattt

SEQ ID NO: 44214 - DNA, 16 bp, H. sapiens
agttcattcattttca

SEQ ID NO: 44215 - DNA, 16 bp, H. sapiens
agttcattcatttttt

SEQ ID NO: 44216 - DNA, 16 bp, H. sapiens
agttcattctcacact

SEQ ID NO: 44217 - DNA, 16 bp, H. sapiens
agttcatttattttta

SEQ ID NO: 44218 - DNA, 16 bp, H. sapiens
agttcatttcctttgt

SEQ ID NO: 44219 - DNA, 16 bp, H. sapiens
agttcatttgtgattt

SEQ ID NO: 44220 - DNA, 16 bp, H. sapiens
agttccaaaacatttt

SEQ ID NO: 44221 - DNA, 16 bp, H. sapiens
agttccaaagccactt

SEQ ID NO: 44222 - DNA, 16 bp, H. sapiens
agttccaaagctgaag

SEQ ID NO: 44223 - DNA, 16 bp, H. sapiens
agttccaacaaaaggt

SEQ ID NO: 44224 - DNA, 16 bp, H. sapiens
agttccaagtctttgc

SEQ ID NO: 44225 - DNA, 16 bp, H. sapiens
agttccacgtgtctgg

SEQ ID NO: 44226 - DNA, 16 bp, H. sapiens
agttccagaaggagga

SEQ ID NO: 44227 - DNA, 16 bp, H. sapiens
agttccagaccaacct

SEQ ID NO: 44228 - DNA, 16 bp, H. sapiens
agttccagaccaccct

SEQ ID NO: 44229 - DNA, 16 bp, H. sapiens
agttccagaccagcct

SEQ ID NO: 44230 - DNA, 16 bp, H. sapiens
agttccagagggaaga

SEQ ID NO: 44231 - DNA, 16 bp, H. sapiens
agttccagatctttcc

SEQ ID NO: 44232 - DNA, 16 bp, H. sapiens
agttccaggaattttt

SEQ ID NO: 44233 - DNA, 16 bp, H. sapiens
agttccagtcctgaat

SEQ ID NO: 44234 - DNA, 16 bp, H. sapiens
agttccagttactcca

SEQ ID NO: 44235 - DNA, 16 bp, H. sapiens
agttccagtttcttca

SEQ ID NO: 44236 - DNA, 16 bp, H. sapiens
agttcccacttatgag

SEQ ID NO: 44237 - DNA, 16 bp, H. sapiens
agttcccaggggatgc

SEQ ID NO: 44238 - DNA, 16 bp, H. sapiens
agttccccatctccat

SEQ ID NO: 44239 - DNA, 16 bp, H. sapiens
agttccggaggctggg

SEQ ID NO: 44240 - DNA, 16 bp, H. sapiens
agttcctcaaaaactt

SEQ ID NO: 44241 - DNA, 16 bp, H. sapiens
agttcctcactagcaa

SEQ ID NO: 44242 - DNA, 16 bp, H. sapiens
agttcctgccttaact

SEQ ID NO: 44243 - DNA, 16 bp, H. sapiens
agttcctggcacagag

SEQ ID NO: 44244 - DNA, 16 bp, H. sapiens
agttcctggcacatgg

SEQ ID NO: 44245 - DNA, 16 bp, H. sapiens
agttcctgggtgggga

SEQ ID NO: 44246 - DNA, 16 bp, H. sapiens
agttcctgttgcttca

SEQ ID NO: 44247 - DNA, 16 bp, H. sapiens
agttccttgagggcag

SEQ ID NO: 44248 - DNA, 16 bp, H. sapiens
agttccttttttctct

SEQ ID NO: 44249 - DNA, 16 bp, H. sapiens
agttcgaaaccagctt

SEQ ID NO: 44250 - DNA, 17 bp, H. sapiens
agttcgagaccagcctg

SEQ ID NO: 44251 - DNA, 16 bp, H. sapiens
agttcgagaccaggct

SEQ ID NO: 44252 - DNA, 16 bp, H. sapiens
agttcgagaccagtgt

SEQ ID NO: 44253 - DNA, 16 bp, H. sapiens
agttcgagacgagcct

SEQ ID NO: 44254 - DNA, 17 bp, H. sapiens
agttcgagactagcctg

SEQ ID NO: 44255 - DNA, 16 bp, H. sapiens
agttcgagatcagccc

SEQ ID NO: 44256 - DNA, 19 bp, H. sapiens
agttcgagatcagcctggg

SEQ ID NO: 44257 - DNA, 16 bp, H. sapiens
agttctaaaattcttt

SEQ ID NO: 44258 - DNA, 16 bp, H. sapiens
agttctaaaattgaat

SEQ ID NO: 44259 - DNA, 16 bp, H. sapiens
agttctagaacagcct

SEQ ID NO: 44260 - DNA, 16 bp, H. sapiens
agttctagactagcct

SEQ ID NO: 44261 - DNA, 16 bp, H. sapiens
agttctagccacagca

SEQ ID NO: 44262 - DNA, 16 bp, H. sapiens
agttctattagttttt

SEQ ID NO: 44263 - DNA, 16 bp, H. sapiens
agttctcaagaggaat

SEQ ID NO: 44264 - DNA, 16 bp, H. sapiens
agttctcacaagatct

SEQ ID NO: 44265 - DNA, 16 bp, H. sapiens
agttctcacgagattt

SEQ ID NO: 44266 - DNA, 16 bp, H. sapiens
agttctcatcatttag

SEQ ID NO: 44267 - DNA, 16 bp, H. sapiens
agttctcatgagaact

SEQ ID NO: 44268 - DNA, 16 bp, H. sapiens
agttctcatgcctcag

SEQ ID NO: 44269 - DNA, 16 bp, H. sapiens
agttctcattgttcaa

SEQ ID NO: 44270 - DNA, 16 bp, H. sapiens
agttctccaacatcac

SEQ ID NO: 44271 - DNA, 16 bp, H. sapiens
agttctccaggtcccc

SEQ ID NO: 44272 - DNA, 16 bp, H. sapiens
agttctcccagataat

SEQ ID NO: 44273 - DNA, 16 bp, H. sapiens
agttctcctcagcaaa

SEQ ID NO: 44274 - DNA, 16 bp, H. sapiens
agttctccttcaagag

SEQ ID NO: 44275 - DNA, 16 bp, H. sapiens
agttctcgcgagatct

SEQ ID NO: 44276 - DNA, 16 bp, H. sapiens
agttctctcttctgtt

SEQ ID NO: 44277 - DNA, 16 bp, H. sapiens
agttctctggtgtctc

SEQ ID NO: 44278 - DNA, 16 bp, H. sapiens
agttctctgtgtgtgt

SEQ ID NO: 44279 - DNA, 16 bp, H. sapiens
agttctgaaggtcaga

SEQ ID NO: 44280 - DNA, 16 bp, H. sapiens
agttctgacactgtct

SEQ ID NO: 44281 - DNA, 16 bp, H. sapiens
agttctgcaagctcca

SEQ ID NO: 44282 - DNA, 16 bp, H. sapiens
agttctgcccactggg

SEQ ID NO: 44283 - DNA, 16 bp, H. sapiens
agttctgcctcctggg

SEQ ID NO: 44284 - DNA, 16 bp, H. sapiens
agttctgctgcctcag

SEQ ID NO: 44285 - DNA, 16 bp, H. sapiens
agttctgcttttagtt

SEQ ID NO: 44286 - DNA, 16 bp, H. sapiens
agttctggaagccaga

SEQ ID NO: 44287 - DNA, 16 bp, H. sapiens
agttctggaagctaga

SEQ ID NO: 44288 - DNA, 16 bp, H. sapiens
agttctggaagctggg

SEQ ID NO: 44289 - DNA, 16 bp, H. sapiens
agttctggagactgga

SEQ ID NO: 44290 - DNA, 16 bp, H. sapiens
agttctggagcctgga

SEQ ID NO: 44291 - DNA, 16 bp, H. sapiens
agttctggaggctggt

SEQ ID NO: 44292 - DNA, 16 bp, H. sapiens
agttctggcattacag

SEQ ID NO: 44293 - DNA, 16 bp, H. sapiens
agttctggctgggcac

SEQ ID NO: 44294 - DNA, 16 bp, H. sapiens
agttctgggatatgtg

SEQ ID NO: 44295 - DNA, 16 bp, H. sapiens
agttctgggattccag

SEQ ID NO: 44296 - DNA, 16 bp, H. sapiens
agttctgggctgggca

SEQ ID NO: 44297 - DNA, 16 bp, H. sapiens
agttctggggtacacg

SEQ ID NO: 44298 - DNA, 16 bp, H. sapiens
agttctggttcctttt

SEQ ID NO: 44299 - DNA, 16 bp, H. sapiens
agttctgtagatgttt

SEQ ID NO: 44300 - DNA, 16 bp, H. sapiens
agttctgtctcactgg

SEQ ID NO: 44301 - DNA, 16 bp, H. sapiens
agttctgtgaagaatt

SEQ ID NO: 44302 - DNA, 16 bp, H. sapiens
agttctgtggaaaaag

SEQ ID NO: 44303 - DNA, 16 bp, H. sapiens
agttctgttcatgtga

SEQ ID NO: 44304 - DNA, 16 bp, H. sapiens
agttctgttctatttt

SEQ ID NO: 44305 - DNA, 16 bp, H. sapiens
agttctgttctttttg

SEQ ID NO: 44306 - DNA, 16 bp, H. sapiens
agttctgttgattttt

SEQ ID NO: 44307 - DNA, 16 bp, H. sapiens
agttctgtttttaatt

SEQ ID NO: 44308 - DNA, 16 bp, H. sapiens
agttcttaaaattttg

SEQ ID NO: 44309 - DNA, 16 bp, H. sapiens
agttcttaaaattttt

SEQ ID NO: 44310 - DNA, 16 bp, H. sapiens
agttcttcatgatgaa

SEQ ID NO: 44311 - DNA, 16 bp, H. sapiens
agttcttgatttcatt

SEQ ID NO: 44312 - DNA, 16 bp, H. sapiens
agttcttgctctcatg

SEQ ID NO: 44313 - DNA, 16 bp, H. sapiens
agttcttgctctgtca

SEQ ID NO: 44314 - DNA, 16 bp, H. sapiens
agttcttggagcaaaa

SEQ ID NO: 44315 - DNA, 16 bp, H. sapiens
agttctttaagaaatc

SEQ ID NO: 44316 - DNA, 16 bp, H. sapiens
agttctttaaggaatc

SEQ ID NO: 44317 - DNA, 16 bp, H. sapiens
agttctttaattgtga

SEQ ID NO: 44318 - DNA, 16 bp, H. sapiens
agttctttattggtga

SEQ ID NO: 44319 - DNA, 16 bp, H. sapiens
agttctttatttgatt

SEQ ID NO: 44320 - DNA, 16 bp, H. sapiens
agttctttctaattct

SEQ ID NO: 44321 - DNA, 16 bp, H. sapiens
agttctttgaaattaa

SEQ ID NO: 44322 - DNA, 16 bp, H. sapiens
agttctttgaggaatc

SEQ ID NO: 44323 - DNA, 16 bp, H. sapiens
agttctttgcccattt

SEQ ID NO: 44324 - DNA, 16 bp, H. sapiens
agttctttgtatgttt

SEQ ID NO: 44325 - DNA, 16 bp, H. sapiens
agttcttttggataaa

SEQ ID NO: 44326 - DNA, 16 bp, H. sapiens
agttctttttttccat

SEQ ID NO: 44327 - DNA, 16 bp, H. sapiens
agttgaaaaatcttaa

SEQ ID NO: 44328 - DNA, 16 bp, H. sapiens
agttgaaaagtacaat

SEQ ID NO: 44329 - DNA, 16 bp, H. sapiens
agttgaaagcatttcc

SEQ ID NO: 44330 - DNA, 17 bp, H. sapiens
agttgaacaatgagaat

SEQ ID NO: 44331 - DNA, 16 bp, H. sapiens
agttgaactcatagaa

SEQ ID NO: 44332 - DNA, 16 bp, H. sapiens
agttgaagacaagcct

SEQ ID NO: 44333 - DNA, 16 bp, H. sapiens
agttgaagaccagact

SEQ ID NO: 44334 - DNA, 16 bp, H. sapiens
agttgaatggtaattc

SEQ ID NO: 44335 - DNA, 16 bp, H. sapiens
agttgaattcacagaa

SEQ ID NO: 44336 - DNA, 16 bp, H. sapiens
agttgaatttctgaat

SEQ ID NO: 44337 - DNA, 16 bp, H. sapiens
agttgacacataaaac

SEQ ID NO: 44338 - DNA, 16 bp, H. sapiens
agttgacagaggaaga

SEQ ID NO: 44339 - DNA, 16 bp, H. sapiens
agttgacagtattaac

SEQ ID NO: 44340 - DNA, 16 bp, H. sapiens
agttgacccttgaaca

SEQ ID NO: 44341 - DNA, 16 bp, H. sapiens
agttgagaaaactgaa

SEQ ID NO: 44342 - DNA, 16 bp, H. sapiens
agttgagaatcactgc

SEQ ID NO: 44343 - DNA, 16 bp, H. sapiens
agttgagacaggattt

SEQ ID NO: 44344 - DNA, 16 bp, H. sapiens
agttgagcagctttga

SEQ ID NO: 44345 - DNA, 16 bp, H. sapiens
agttgaggcccagaga

SEQ ID NO: 44346 - DNA, 16 bp, H. sapiens
agttgagttttgtata

SEQ ID NO: 44347 - DNA, 16 bp, H. sapiens
agttgatcaaatcggc

SEQ ID NO: 44348 - DNA, 16 bp, H. sapiens
agttgatcctcccacc

SEQ ID NO: 44349 - DNA, 16 bp, H. sapiens
agttgatccttgaaca

SEQ ID NO: 44350 - DNA, 16 bp, H. sapiens
agttgatgcaatttct

SEQ ID NO: 44351 - DNA, 16 bp, H. sapiens
agttgatgcagcttct

SEQ ID NO: 44352 - DNA, 16 bp, H. sapiens
agttgatttttaaaaa

SEQ ID NO: 44353 - DNA, 16 bp, H. sapiens
agttgatttttgtatg

SEQ ID NO: 44354 - DNA, 16 bp, H. sapiens
agttgattttttgaaa

SEQ ID NO: 44355 - DNA, 16 bp, H. sapiens
agttgcaaagttgctt

SEQ ID NO: 44356 - DNA, 16 bp, H. sapiens
agttgcacaaccatca

SEQ ID NO: 44357 - DNA, 16 bp, H. sapiens
agttgcagcaagttat

SEQ ID NO: 44358 - DNA, 16 bp, H. sapiens
agttgcagctactcag

SEQ ID NO: 44359 - DNA, 16 bp, H. sapiens
agttgcaggaaaacaa

SEQ ID NO: 44360 - DNA, 16 bp, H. sapiens
agttgcagtgaactga

SEQ ID NO: 44361 - DNA, 16 bp, H. sapiens
agttgccagataaaat

SEQ ID NO: 44362 - DNA, 16 bp, H. sapiens
agttgccttcagctca

SEQ ID NO: 44363 - DNA, 16 bp, H. sapiens
agttgctcaagccaaa

SEQ ID NO: 44364 - DNA, 16 bp, H. sapiens
agttgctcatttactt

SEQ ID NO: 44365 - DNA, 16 bp, H. sapiens
agttgctctgggtgaa

SEQ ID NO: 44366 - DNA, 16 bp, H. sapiens
agttgctcttctagag

SEQ ID NO: 44367 - DNA, 16 bp, H. sapiens
agttgctggagaggat

SEQ ID NO: 44368 - DNA, 16 bp, H. sapiens
agttgctgggatcaca

SEQ ID NO: 44369 - DNA, 16 bp, H. sapiens
agttgctgggattaca

SEQ ID NO: 44370 - DNA, 16 bp, H. sapiens
agttgctgtgggtgag

SEQ ID NO: 44371 - DNA, 16 bp, H. sapiens
agttgcttgaacttgg

SEQ ID NO: 44372 - DNA, 16 bp, H. sapiens
agttgcttgtagattc

SEQ ID NO: 44373 - DNA, 16 bp, H. sapiens
agttgcttttggcatt

SEQ ID NO: 44374 - DNA, 16 bp, H. sapiens
agttggaaagaatgaa

SEQ ID NO: 44375 - DNA, 16 bp, H. sapiens
agttggaagaaaaatg

SEQ ID NO: 44376 - DNA, 16 bp, H. sapiens
agttggaagccatcat

SEQ ID NO: 44377 - DNA, 16 bp, H. sapiens
agttggagaaactgag

SEQ ID NO: 44378 - DNA, 16 bp, H. sapiens
agttggagatcagcct

SEQ ID NO: 44379 - DNA, 16 bp, H. sapiens
agttggaggctgcagt

SEQ ID NO: 44380 - DNA, 16 bp, H. sapiens
agttggattgtttgta

SEQ ID NO: 44381 - DNA, 16 bp, H. sapiens
agttggccctctgtat

SEQ ID NO: 44382 - DNA, 16 bp, H. sapiens
agttggccgggcacgg

SEQ ID NO: 44383 - DNA, 16 bp, H. sapiens
agttggctcatgcctg

SEQ ID NO: 44384 - DNA, 16 bp, H. sapiens
agttgggaaaaactga

SEQ ID NO: 44385 - DNA, 16 bp, H. sapiens
agttgggactacaagc

SEQ ID NO: 44386 - DNA, 16 bp, H. sapiens
agttgggactacaggt

SEQ ID NO: 44387 - DNA, 16 bp, H. sapiens
agttggggagatggga

SEQ ID NO: 44388 - DNA, 16 bp, H. sapiens
agttggggaggagtcc

SEQ ID NO: 44389 - DNA, 16 bp, H. sapiens
agttggtgttggagaa

SEQ ID NO: 44390 - DNA, 16 bp, H. sapiens
agttggttttttgaaa

SEQ ID NO: 44391 - DNA, 16 bp, H. sapiens
agttgtacaatgtgtt

SEQ ID NO: 44392 - DNA, 16 bp, H. sapiens
agttgtacactttaaa

SEQ ID NO: 44393 - DNA, 16 bp, H. sapiens
agttgtattagtctgt

SEQ ID NO: 44394 - DNA, 16 bp, H. sapiens
agttgtcctgcctttc

SEQ ID NO: 44395 - DNA, 16 bp, H. sapiens
agttgtctacagtatt

SEQ ID NO: 44396 - DNA, 16 bp, H. sapiens
agttgtgaaaccatca

SEQ ID NO: 44397 - DNA, 16 bp, H. sapiens
agttgtgagccaccgc

SEQ ID NO: 44398 - DNA, 16 bp, H. sapiens
agttgtgaggattaaa

SEQ ID NO: 44399 - DNA, 16 bp, H. sapiens
agttgtgcagtgcaca

SEQ ID NO: 44400 - DNA, 16 bp, H. sapiens
agttgtggagaaaaag

SEQ ID NO: 44401 - DNA, 16 bp, H. sapiens
agttgtgtgaccctgg

SEQ ID NO: 44402 - DNA, 16 bp, H. sapiens
agttgtgtgaccttgg

SEQ ID NO: 44403 - DNA, 16 bp, H. sapiens
agttgtgtgactttgg

SEQ ID NO: 44404 - DNA, 16 bp, H. sapiens
agttgtgtgcatgctc

SEQ ID NO: 44405 - DNA, 16 bp, H. sapiens
agttgttaaattggtg

SEQ ID NO: 44406 - DNA, 16 bp, H. sapiens
agttgttctgcttctg

SEQ ID NO: 44407 - DNA, 16 bp, H. sapiens
agttgttgaaagggtg

SEQ ID NO: 44408 - DNA, 16 bp, H. sapiens
agttgttgagaggatt

SEQ ID NO: 44409 - DNA, 16 bp, H. sapiens
agttgttggagttcct

SEQ ID NO: 44410 - DNA, 16 bp, H. sapiens
agttgtttccaggttt

SEQ ID NO: 44411 - DNA, 16 bp, H. sapiens
agttgtttgagcttct

SEQ ID NO: 44412 - DNA, 16 bp, H. sapiens
agttgttttcaaaata

SEQ ID NO: 44413 - DNA, 16 bp, H. sapiens
agttgttttctttcag

SEQ ID NO: 44414 - DNA, 16 bp, H. sapiens
agttgttttgcatttg

SEQ ID NO: 44415 - DNA, 16 bp, H. sapiens
agttgtttttcttaaa

SEQ ID NO: 44416 - DNA, 16 bp, H. sapiens
agttgttttttgaaaa

SEQ ID NO: 44417 - DNA, 16 bp, H. sapiens
agtttaaaaagacaaa

SEQ ID NO: 44418 - DNA, 16 bp, H. sapiens
agtttaaaaataagtt

SEQ ID NO: 44419 - DNA, 16 bp, H. sapiens
agtttaaaacaaagat

SEQ ID NO: 44420 - DNA, 16 bp, H. sapiens
agtttaaaacaacaac

SEQ ID NO: 44421 - DNA, 16 bp, H. sapiens
agtttaaaacatttaa

SEQ ID NO: 44422 - DNA, 16 bp, H. sapiens
agtttaaaatacattt

SEQ ID NO: 44423 - DNA, 16 bp, H. sapiens
agtttaaaatagattg

SEQ ID NO: 44424 - DNA, 16 bp, H. sapiens
agtttaaaatcttaaa

SEQ ID NO: 44425 - DNA, 16 bp, H. sapiens
agtttaaaatgtttaa

SEQ ID NO: 44426 - DNA, 16 bp, H. sapiens
agtttaaagagaaagg

SEQ ID NO: 44427 - DNA, 16 bp, H. sapiens
agtttaactttaaaac

SEQ ID NO: 44428 - DNA, 16 bp, H. sapiens
agtttaagtcccattt

SEQ ID NO: 44429 - DNA, 16 bp, H. sapiens
agtttaataggcaaga

SEQ ID NO: 44430 - DNA, 16 bp, H. sapiens
agtttaattagatttc

SEQ ID NO: 44431 - DNA, 16 bp, H. sapiens
agtttacaaagcattt

SEQ ID NO: 44432 - DNA, 16 bp, H. sapiens
agtttacaaagtactt

SEQ ID NO: 44433 - DNA, 16 bp, H. sapiens
agtttacacacacaca

SEQ ID NO: 44434 - DNA, 16 bp, H. sapiens
agtttacaccaaacca

SEQ ID NO: 44435 - DNA, 16 bp, H. sapiens
agtttacagaaaaaag

SEQ ID NO: 44436 - DNA, 16 bp, H. sapiens
agtttacagtcccacc

SEQ ID NO: 44437 - DNA, 16 bp, H. sapiens
agtttactttaaaaat

SEQ ID NO: 44438 - DNA, 16 bp, H. sapiens
agtttagatgaggtca

SEQ ID NO: 44439 - DNA, 16 bp, H. sapiens
agtttataaaacaatt

SEQ ID NO: 44440 - DNA, 16 bp, H. sapiens
agtttataatttaatg

SEQ ID NO: 44441 - DNA, 16 bp, H. sapiens
agtttatattttcaaa

SEQ ID NO: 44442 - DNA, 17 bp, H. sapiens
agtttatctaaagacct

SEQ ID NO: 44443 - DNA, 16 bp, H. sapiens
agtttatctatgtaac

SEQ ID NO: 44444 - DNA, 16 bp, H. sapiens
agtttatgaatttgta

SEQ ID NO: 44445 - DNA, 16 bp, H. sapiens
agtttatgaccagcct

SEQ ID NO: 44446 - DNA, 16 bp, H. sapiens
agtttattaacatgtg

SEQ ID NO: 44447 - DNA, 16 bp, H. sapiens
agtttattcaaagaga

SEQ ID NO: 44448 - DNA, 16 bp, H. sapiens
agtttattccttcaga

SEQ ID NO: 44449 - DNA, 16 bp, H. sapiens
agtttattccttctga

SEQ ID NO: 44450 - DNA, 16 bp, H. sapiens
agtttattgagaattt

SEQ ID NO: 44451 - DNA, 16 bp, H. sapiens
agtttatttaaaagtt

SEQ ID NO: 44452 - DNA, 16 bp, H. sapiens
agtttatttaaccatt

SEQ ID NO: 44453 - DNA, 16 bp, H. sapiens
agtttatttatccatt

SEQ ID NO: 44454 - DNA, 16 bp, H. sapiens
agtttatttcatttat

SEQ ID NO: 44455 - DNA, 16 bp, H. sapiens
agtttatttccagttt

SEQ ID NO: 44456 - DNA, 16 bp, H. sapiens
agtttatttctctctc

SEQ ID NO: 44457 - DNA, 16 bp, H. sapiens
agtttattttgcattt

SEQ ID NO: 44458 - DNA, 16 bp, H. sapiens
agtttattttggtgca

SEQ ID NO: 44459 - DNA, 16 bp, H. sapiens
agtttatttttctctc

SEQ ID NO: 44460 - DNA, 16 bp, H. sapiens
agtttatttttgtaca

SEQ ID NO: 44461 - DNA, 16 bp, H. sapiens
agtttcaaagctgctt

SEQ ID NO: 44462 - DNA, 16 bp, H. sapiens
agtttcaataaattta

SEQ ID NO: 44463 - DNA, 23 bp, H. sapiens
agtttcaccatgttggccaggct

SEQ ID NO: 44464 - DNA, 19 bp, H. sapiens
agtttcaccatgttggtca

SEQ ID NO: 44465 - DNA, 16 bp, H. sapiens
agtttcactaccctaa

SEQ ID NO: 44466 - DNA, 16 bp, H. sapiens
agtttcactctgttgc

SEQ ID NO: 44467 - DNA, 16 bp, H. sapiens
agtttcactcttattg

SEQ ID NO: 44468 - DNA, 16 bp, H. sapiens
agtttcactcttgctg

SEQ ID NO: 44469 - DNA, 16 bp, H. sapiens
agtttcactcttgtgg

SEQ ID NO: 44470 - DNA, 16 bp, H. sapiens
agtttcactcttgttg

SEQ ID NO: 44471 - DNA, 16 bp, H. sapiens
agtttcacttttgtca

SEQ ID NO: 44472 - DNA, 16 bp, H. sapiens
agtttcacttttgttg

SEQ ID NO: 44473 - DNA, 16 bp, H. sapiens
agtttcagaaggaata

SEQ ID NO: 44474 - DNA, 16 bp, H. sapiens
agtttcagacaagcct

SEQ ID NO: 44475 - DNA, 16 bp, H. sapiens
agtttcagaccaccct

SEQ ID NO: 44476 - DNA, 16 bp, H. sapiens
agtttcagagcaggaa

SEQ ID NO: 44477 - DNA, 16 bp, H. sapiens
agtttcagatggaatg

SEQ ID NO: 44478 - DNA, 16 bp, H. sapiens
agtttcagattttgaa

SEQ ID NO: 44479 - DNA, 16 bp, H. sapiens
agtttcagcaggaatg

SEQ ID NO: 44480 - DNA, 16 bp, H. sapiens
agtttcagctttcttc

SEQ ID NO: 44481 - DNA, 16 bp, H. sapiens
agtttcaggaggattg

SEQ ID NO: 44482 - DNA, 16 bp, H. sapiens
agtttcaggttttttc

SEQ ID NO: 44483 - DNA, 16 bp, H. sapiens
agtttcagttttgcaa

SEQ ID NO: 44484 - DNA, 16 bp, H. sapiens
agtttcatccatgttg

SEQ ID NO: 44485 - DNA, 16 bp, H. sapiens
agtttcatcctgaaac

SEQ ID NO: 44486 - DNA, 16 bp, H. sapiens
agtttcattctcctgc

SEQ ID NO: 44487 - DNA, 16 bp, H. sapiens
agtttcattcttgtta

SEQ ID NO: 44488 - DNA, 16 bp, H. sapiens
agtttcattctttttg

SEQ ID NO: 44489 - DNA, 16 bp, H. sapiens
agtttcatttcttctt

SEQ ID NO: 44490 - DNA, 16 bp, H. sapiens
agtttcatttgttatt

SEQ ID NO: 44491 - DNA, 16 bp, H. sapiens
agtttccaagaaccta

SEQ ID NO: 44492 - DNA, 16 bp, H. sapiens
agtttccatgtagtgg

SEQ ID NO: 44493 - DNA, 16 bp, H. sapiens
agtttcccataatttt

SEQ ID NO: 44494 - DNA, 16 bp, H. sapiens
agtttccccacctgtg

SEQ ID NO: 44495 - DNA, 16 bp, H. sapiens
agtttccccacttgta

SEQ ID NO: 44496 - DNA, 16 bp, H. sapiens
agtttccccatctgtg

SEQ ID NO: 44497 - DNA, 16 bp, H. sapiens
agtttccccttctgta

SEQ ID NO: 44498 - DNA, 16 bp, H. sapiens
agtttccctctgtcac

SEQ ID NO: 44499 - DNA, 16 bp, H. sapiens
agtttccctcttgctg

SEQ ID NO: 44500 - DNA, 16 bp, H. sapiens
agtttccctcttgttg

SEQ ID NO: 44501 - DNA, 16 bp, H. sapiens
agtttcccttttgttg

SEQ ID NO: 44502 - DNA, 16 bp, H. sapiens
agtttcctcaactgtg

SEQ ID NO: 44503 - DNA, 16 bp, H. sapiens
agtttcctcatctttt

SEQ ID NO: 44504 - DNA, 16 bp, H. sapiens
agtttcctgatgcctc

SEQ ID NO: 44505 - DNA, 16 bp, H. sapiens
agtttcctggaagaca

SEQ ID NO: 44506 - DNA, 16 bp, H. sapiens
agtttcctggacagaa

SEQ ID NO: 44507 - DNA, 16 bp, H. sapiens
agtttcctgtggctgc

SEQ ID NO: 44508 - DNA, 16 bp, H. sapiens
agtttccttatcactt

SEQ ID NO: 44509 - DNA, 16 bp, H. sapiens
agtttccttatcagta

SEQ ID NO: 44510 - DNA, 16 bp, H. sapiens
agtttccttatctgta

SEQ ID NO: 44511 - DNA, 16 bp, H. sapiens
agtttccttctgttcc

SEQ ID NO: 44512 - DNA, 16 bp, H. sapiens
agtttccttttctcca

SEQ ID NO: 44513 - DNA, 16 bp, H. sapiens
agtttcgctctcattg

SEQ ID NO: 44514 - DNA, 16 bp, H. sapiens
agtttcgctctcgttg

SEQ ID NO: 44515 - DNA, 16 bp, H. sapiens
agtttcgctcttgttg

SEQ ID NO: 44516 - DNA, 16 bp, H. sapiens
agtttcgcttttgttg

SEQ ID NO: 44517 - DNA, 16 bp, H. sapiens
agtttcggttttctgc

SEQ ID NO: 44518 - DNA, 16 bp, H. sapiens
agtttctaagaaagct

SEQ ID NO: 44519 - DNA, 16 bp, H. sapiens
agtttctacacagcaa

SEQ ID NO: 44520 - DNA, 16 bp, H. sapiens
agtttctatagggaac

SEQ ID NO: 44521 - DNA, 16 bp, H. sapiens
agtttctatttttcta

SEQ ID NO: 44522 - DNA, 16 bp, H. sapiens
agtttctcagaatttt

SEQ ID NO: 44523 - DNA, 16 bp, H. sapiens
agtttctcatctgtaa

SEQ ID NO: 44524 - DNA, 16 bp, H. sapiens
agtttctcattcagta

SEQ ID NO: 44525 - DNA, 16 bp, H. sapiens
agtttctccaacacca

SEQ ID NO: 44526 - DNA, 16 bp, H. sapiens
agtttctccccagaaa

SEQ ID NO: 44527 - DNA, 16 bp, H. sapiens
agtttctctcttgtca

SEQ ID NO: 44528 - DNA, 16 bp, H. sapiens
agtttctctcttgttg

SEQ ID NO: 44529 - DNA, 16 bp, H. sapiens
agtttctcttgagggc

SEQ ID NO: 44530 - DNA, 16 bp, H. sapiens
agtttctgataacttt

SEQ ID NO: 44531 - DNA, 16 bp, H. sapiens
agtttctgattcacta

SEQ ID NO: 44532 - DNA, 16 bp, H. sapiens
agtttctgattcagaa

SEQ ID NO: 44533 - DNA, 16 bp, H. sapiens
agtttctgattcagga

SEQ ID NO: 44534 - DNA, 16 bp, H. sapiens
agtttctgcacaacaa

SEQ ID NO: 44535 - DNA, 16 bp, H. sapiens
agtttctgcacagcca

SEQ ID NO: 44536 - DNA, 16 bp, H. sapiens
agtttctggtttttct

SEQ ID NO: 44537 - DNA, 16 bp, H. sapiens
agtttctgtttctgat

SEQ ID NO: 44538 - DNA, 16 bp, H. sapiens
agtttcttaaaaatta

SEQ ID NO: 44539 - DNA, 16 bp, H. sapiens
agtttcttcagctgtg

SEQ ID NO: 44540 - DNA, 16 bp, H. sapiens
agtttcttcctggcat

SEQ ID NO: 44541 - DNA, 16 bp, H. sapiens
agtttcttgagggcag

SEQ ID NO: 44542 - DNA, 16 bp, H. sapiens
agtttctttaaaaaaa

SEQ ID NO: 44543 - DNA, 16 bp, H. sapiens
agtttctttcttctgc

SEQ ID NO: 44544 - DNA, 16 bp, H. sapiens
agtttctttctttcat

SEQ ID NO: 44545 - DNA, 16 bp, H. sapiens
agtttctttgaaaata

SEQ ID NO: 44546 - DNA, 16 bp, H. sapiens
agtttcttttcatttc

SEQ ID NO: 44547 - DNA, 16 bp, H. sapiens
agtttcttttgggggt

SEQ ID NO: 44548 - DNA, 16 bp, H. sapiens
agtttcttttgttgta

SEQ ID NO: 44549 - DNA, 16 bp, H. sapiens
agtttctttttataaa

SEQ ID NO: 44550 - DNA, 16 bp, H. sapiens
agtttctttttttaaa

SEQ ID NO: 44551 - DNA, 16 bp, H. sapiens
agtttgaaaaacattg

SEQ ID NO: 44552 - DNA, 16 bp, H. sapiens
agtttgaaaaccactg

SEQ ID NO: 44553 - DNA, 16 bp, H. sapiens
agtttgaaaaccattg

SEQ ID NO: 44554 - DNA, 16 bp, H. sapiens
agtttgaaaatatttt

SEQ ID NO: 44555 - DNA, 16 bp, H. sapiens
agtttgaaagttgttg

SEQ ID NO: 44556 - DNA, 16 bp, H. sapiens
agtttgaaatctggta

SEQ ID NO: 44557 - DNA, 16 bp, H. sapiens
agtttgaaattatttc

SEQ ID NO: 44558 - DNA, 16 bp, H. sapiens
agtttgaagagacaaa

SEQ ID NO: 44559 - DNA, 16 bp, H. sapiens
agtttgaagatatttt

SEQ ID NO: 44560 - DNA, 16 bp, H. sapiens
agtttgaatttcagat

SEQ ID NO: 44561 - DNA, 16 bp, H. sapiens
agtttgagaaataaag

SEQ ID NO: 44562 - DNA, 16 bp, H. sapiens
agtttgagaactgctg

SEQ ID NO: 44563 - DNA, 16 bp, H. sapiens
agtttgagaagatgaa

SEQ ID NO: 44564 - DNA, 16 bp, H. sapiens
agtttgagaagcactg

SEQ ID NO: 44565 - DNA, 16 bp, H. sapiens
agtttgagaagcagtg

SEQ ID NO: 44566 - DNA, 18 bp, H. sapiens
agtttgagaccagcctga

SEQ ID NO: 44567 - DNA, 16 bp, H. sapiens
agtttgagacccactg

SEQ ID NO: 44568 - DNA, 16 bp, H. sapiens
agtttgagcctggcca

SEQ ID NO: 44569 - DNA, 16 bp, H. sapiens
agtttgaggccagcat

SEQ ID NO: 44570 - DNA, 16 bp, H. sapiens
agtttgaggccaggag

SEQ ID NO: 44571 - DNA, 16 bp, H. sapiens
agtttgaggccggcct

SEQ ID NO: 44572 - DNA, 16 bp, H. sapiens
agtttgaggcttcagt

SEQ ID NO: 44573 - DNA, 16 bp, H. sapiens
agtttgaggtgtgaca

SEQ ID NO: 44574 - DNA, 16 bp, H. sapiens
agtttgagttcattgt

SEQ ID NO: 44575 - DNA, 16 bp, H. sapiens
agtttgatagaagaaa

SEQ ID NO: 44576 - DNA, 16 bp, H. sapiens
agtttgatatttatct

SEQ ID NO: 44577 - DNA, 16 bp, H. sapiens
agtttgattatgatgt

SEQ ID NO: 44578 - DNA, 16 bp, H. sapiens
agtttgattgcttcta

SEQ ID NO: 44579 - DNA, 16 bp, H. sapiens
agtttgatttcattgt

SEQ ID NO: 44580 - DNA, 16 bp, H. sapiens
agtttgcaaaaataaa

SEQ ID NO: 44581 - DNA, 16 bp, H. sapiens
agtttgcaaacactct

SEQ ID NO: 44582 - DNA, 16 bp, H. sapiens
agtttgcaaatatttt

SEQ ID NO: 44583 - DNA, 16 bp, H. sapiens
agtttgccaacctctg

SEQ ID NO: 44584 - DNA, 16 bp, H. sapiens
agtttgccagcccctg

SEQ ID NO: 44585 - DNA, 16 bp, H. sapiens
agtttgccattctgtg

SEQ ID NO: 44586 - DNA, 23 bp, H. sapiens
agtttgctcagaatgatggtttc

SEQ ID NO: 44587 - DNA, 16 bp, H. sapiens
agtttgctgaaaataa

SEQ ID NO: 44588 - DNA, 16 bp, H. sapiens
agtttgctgacccctg

SEQ ID NO: 44589 - DNA, 16 bp, H. sapiens
agtttgctgagaacga

SEQ ID NO: 44590 - DNA, 16 bp, H. sapiens
agtttgctgatccctg

SEQ ID NO: 44591 - DNA, 16 bp, H. sapiens
agtttggaaaaacttt

SEQ ID NO: 44592 - DNA, 16 bp, H. sapiens
agtttggaaaacactg

SEQ ID NO: 44593 - DNA, 16 bp, H. sapiens
agtttggaaaatctgc

SEQ ID NO: 44594 - DNA, 16 bp, H. sapiens
agtttggaaatattct

SEQ ID NO: 44595 - DNA, 16 bp, H. sapiens
agtttggaaatgctgt

SEQ ID NO: 44596 - DNA, 16 bp, H. sapiens
agtttggaaatttctt

SEQ ID NO: 44597 - DNA, 16 bp, H. sapiens
agtttggaagatttgc

SEQ ID NO: 44598 - DNA, 16 bp, H. sapiens
agtttggaagtatttt

SEQ ID NO: 44599 - DNA, 16 bp, H. sapiens
agtttggacatatgca

SEQ ID NO: 44600 - DNA, 16 bp, H. sapiens
agtttggactacaggt

SEQ ID NO: 44601 - DNA, 16 bp, H. sapiens
agtttggagatttctc

SEQ ID NO: 44602 - DNA, 16 bp, H. sapiens
agtttggatttttttc

SEQ ID NO: 44603 - DNA, 16 bp, H. sapiens
agtttggcagtttctt

SEQ ID NO: 44604 - DNA, 16 bp, H. sapiens
agtttggctgtgtccc

SEQ ID NO: 44605 - DNA, 16 bp, H. sapiens
agtttggcttttttca

SEQ ID NO: 44606 - DNA, 16 bp, H. sapiens
agtttgggaaatgctg

SEQ ID NO: 44607 - DNA, 16 bp, H. sapiens
agtttgggaactgctg

SEQ ID NO: 44608 - DNA, 16 bp, H. sapiens
agtttgggaggattcc

SEQ ID NO: 44609 - DNA, 18 bp, H. sapiens
agtttgggaggctgaggc

SEQ ID NO: 44610 - DNA, 16 bp, H. sapiens
agtttgggatccacag

SEQ ID NO: 44611 - DNA, 16 bp, H. sapiens
agtttgggatgatgaa

SEQ ID NO: 44612 - DNA, 16 bp, H. sapiens
agtttgggcaacatgg

SEQ ID NO: 44613 - DNA, 16 bp, H. sapiens
agtttgggggaaaaaa

SEQ ID NO: 44614 - DNA, 16 bp, H. sapiens
agtttggtctcagact

SEQ ID NO: 44615 - DNA, 16 bp, H. sapiens
agtttgtaattctgtg

SEQ ID NO: 44616 - DNA, 16 bp, H. sapiens
agtttgtattttctag

SEQ ID NO: 44617 - DNA, 16 bp, H. sapiens
agtttgtcaatttttt

SEQ ID NO: 44618 - DNA, 16 bp, H. sapiens
agtttgtgaagaattg

SEQ ID NO: 44619 - DNA, 16 bp, H. sapiens
agtttgtgaatatttt

SEQ ID NO: 44620 - DNA, 16 bp, H. sapiens
agtttgtgattttaag

SEQ ID NO: 44621 - DNA, 16 bp, H. sapiens
agtttgtgcaggaaaa

SEQ ID NO: 44622 - DNA, 16 bp, H. sapiens
agtttgtgcaggggaa

SEQ ID NO: 44623 - DNA, 16 bp, H. sapiens
agtttgtggtaacttg

SEQ ID NO: 44624 - DNA, 16 bp, H. sapiens
agtttgtgtgtgtaga

SEQ ID NO: 44625 - DNA, 16 bp, H. sapiens
agtttgtgtttttcaa

SEQ ID NO: 44626 - DNA, 16 bp, H. sapiens
agtttgtgtttttcta

SEQ ID NO: 44627 - DNA, 16 bp, H. sapiens
agtttgttcctgattt

SEQ ID NO: 44628 - DNA, 16 bp, H. sapiens
agtttgttcttgcttt

SEQ ID NO: 44629 - DNA, 16 bp, H. sapiens
agtttgtttcttcaga

SEQ ID NO: 44630 - DNA, 16 bp, H. sapiens
agtttgttttcctgca

SEQ ID NO: 44631 - DNA, 16 bp, H. sapiens
agttttaaaaagttaa

SEQ ID NO: 44632 - DNA, 16 bp, H. sapiens
agttttaaaaatagtt

SEQ ID NO: 44633 - DNA, 16 bp, H. sapiens
agttttaaaaatcatt

SEQ ID NO: 44634 - DNA, 16 bp, H. sapiens
agttttaaaacataat

SEQ ID NO: 44635 - DNA, 16 bp, H. sapiens
agttttaaaactggga

SEQ ID NO: 44636 - DNA, 16 bp, H. sapiens
agttttaaaataaatg

SEQ ID NO: 44637 - DNA, 16 bp, H. sapiens
agttttaaaatgttaa

SEQ ID NO: 44638 - DNA, 16 bp, H. sapiens
agttttaaaatttcat

SEQ ID NO: 44639 - DNA, 16 bp, H. sapiens
agttttaaagaaattt

SEQ ID NO: 44640 - DNA, 16 bp, H. sapiens
agttttaaatcctcct

SEQ ID NO: 44641 - DNA, 16 bp, H. sapiens
agttttaaatgtatat

SEQ ID NO: 44642 - DNA, 16 bp, H. sapiens
agttttaacaaatgtg

SEQ ID NO: 44643 - DNA, 16 bp, H. sapiens
agttttaacatatgaa

SEQ ID NO: 44644 - DNA, 16 bp, H. sapiens
agttttaagatttaat

SEQ ID NO: 44645 - DNA, 16 bp, H. sapiens
agttttaatttcatat

SEQ ID NO: 44646 - DNA, 16 bp, H. sapiens
agttttaatttttcat

SEQ ID NO: 44647 - DNA, 16 bp, H. sapiens
agttttacaaaataat

SEQ ID NO: 44648 - DNA, 16 bp, H. sapiens
agttttacaaaatgaa

SEQ ID NO: 44649 - DNA, 16 bp, H. sapiens
agttttacatttaaat

SEQ ID NO: 44650 - DNA, 16 bp, H. sapiens
agttttactcttgttg

SEQ ID NO: 44651 - DNA, 16 bp, H. sapiens
agttttacttcctcct

SEQ ID NO: 44652 - DNA, 16 bp, H. sapiens
agttttagaaaatatt

SEQ ID NO: 44653 - DNA, 16 bp, H. sapiens
agttttagaaggaatg

SEQ ID NO: 44654 - DNA, 16 bp, H. sapiens
agttttagaatagttt

SEQ ID NO: 44655 - DNA, 16 bp, H. sapiens
agttttagcttttata

SEQ ID NO: 44656 - DNA, 16 bp, H. sapiens
agttttatagctttat

SEQ ID NO: 44657 - DNA, 16 bp, H. sapiens
agttttatagtttgag

SEQ ID NO: 44658 - DNA, 16 bp, H. sapiens
agttttatatatgtaa

SEQ ID NO: 44659 - DNA, 16 bp, H. sapiens
agttttatgttttctc

SEQ ID NO: 44660 - DNA, 16 bp, H. sapiens
agttttattccattat

SEQ ID NO: 44661 - DNA, 16 bp, H. sapiens
agttttatttcttaaa

SEQ ID NO: 44662 - DNA, 16 bp, H. sapiens
agttttattttactgt

SEQ ID NO: 44663 - DNA, 16 bp, H. sapiens
agttttattttgaaaa

SEQ ID NO: 44664 - DNA, 16 bp, H. sapiens
agttttattttgcatt

SEQ ID NO: 44665 - DNA, 16 bp, H. sapiens
agttttatttttcaaa

SEQ ID NO: 44666 - DNA, 16 bp, H. sapiens
agttttcaaaaagaat

SEQ ID NO: 44667 - DNA, 16 bp, H. sapiens
agttttcaaaaatatt

SEQ ID NO: 44668 - DNA, 16 bp, H. sapiens
agttttcaaaattcct

SEQ ID NO: 44669 - DNA, 16 bp, H. sapiens
agttttcaaattttgt

SEQ ID NO: 44670 - DNA, 16 bp, H. sapiens
agttttcaacaaaaaa

SEQ ID NO: 44671 - DNA, 16 bp, H. sapiens
agttttcagagtacaa

SEQ ID NO: 44672 - DNA, 16 bp, H. sapiens
agttttcagccctctg

SEQ ID NO: 44673 - DNA, 16 bp, H. sapiens
agttttcagctcattt

SEQ ID NO: 44674 - DNA, 16 bp, H. sapiens
agttttcagctctttt

SEQ ID NO: 44675 - DNA, 16 bp, H. sapiens
agttttcagtacagta

SEQ ID NO: 44676 - DNA, 16 bp, H. sapiens
agttttcatcctggga

SEQ ID NO: 44677 - DNA, 16 bp, H. sapiens
agttttcatttacatt

SEQ ID NO: 44678 - DNA, 16 bp, H. sapiens
agttttccaaaattct

SEQ ID NO: 44679 - DNA, 16 bp, H. sapiens
agttttccaaactttt

SEQ ID NO: 44680 - DNA, 16 bp, H. sapiens
agttttccaaatcttt

SEQ ID NO: 44681 - DNA, 16 bp, H. sapiens
agttttccaattcatg

SEQ ID NO: 44682 - DNA, 16 bp, H. sapiens
agttttccacatatgg

SEQ ID NO: 44683 - DNA, 16 bp, H. sapiens
agttttccagaggcta

SEQ ID NO: 44684 - DNA, 16 bp, H. sapiens
agttttccagttttcc

SEQ ID NO: 44685 - DNA, 17 bp, H. sapiens
agttttccatggtgtat

SEQ ID NO: 44686 - DNA, 16 bp, H. sapiens
agttttccattcctga

SEQ ID NO: 44687 - DNA, 16 bp, H. sapiens
agttttcccagcaaca

SEQ ID NO: 44688 - DNA, 16 bp, H. sapiens
agttttcctcatctgt

SEQ ID NO: 44689 - DNA, 16 bp, H. sapiens
agttttcctttttctg

SEQ ID NO: 44690 - DNA, 16 bp, H. sapiens
agttttctaaatatat

SEQ ID NO: 44691 - DNA, 16 bp, H. sapiens
agttttctaaattatg

SEQ ID NO: 44692 - DNA, 16 bp, H. sapiens
agttttctaattttct

SEQ ID NO: 44693 - DNA, 16 bp, H. sapiens
agttttctatttttag

SEQ ID NO: 44694 - DNA, 16 bp, H. sapiens
agttttctctttgctt

SEQ ID NO: 44695 - DNA, 16 bp, H. sapiens
agttttctgaggcctc

SEQ ID NO: 44696 - DNA, 16 bp, H. sapiens
agttttctgccttgat

SEQ ID NO: 44697 - DNA, 16 bp, H. sapiens
agttttcttaaatatt

SEQ ID NO: 44698 - DNA, 16 bp, H. sapiens
agttttcttataatgt

SEQ ID NO: 44699 - DNA, 16 bp, H. sapiens
agttttcttttatctg

SEQ ID NO: 44700 - DNA, 16 bp, H. sapiens
agttttcttttcatgt

SEQ ID NO: 44701 - DNA, 16 bp, H. sapiens
agttttgaaaaagaaa

SEQ ID NO: 44702 - DNA, 16 bp, H. sapiens
agttttgaaaaataat

SEQ ID NO: 44703 - DNA, 16 bp, H. sapiens
agttttgaaaacattt

SEQ ID NO: 44704 - DNA, 16 bp, H. sapiens
agttttgaaacacttt

SEQ ID NO: 44705 - DNA, 16 bp, H. sapiens
agttttgaatgagttt

SEQ ID NO: 44706 - DNA, 16 bp, H. sapiens
agttttgaatgatttt

SEQ ID NO: 44707 - DNA, 16 bp, H. sapiens
agttttgcacttgttg

SEQ ID NO: 44708 - DNA, 16 bp, H. sapiens
agttttgcattttata

SEQ ID NO: 44709 - DNA, 16 bp, H. sapiens
agttttgcatttttat

SEQ ID NO: 44710 - DNA, 16 bp, H. sapiens
agttttgcccattcag

SEQ ID NO: 44711 - DNA, 16 bp, H. sapiens
agttttgccttttcaa

SEQ ID NO: 44712 - DNA, 16 bp, H. sapiens
agttttgccttttcca

SEQ ID NO: 44713 - DNA, 16 bp, H. sapiens
agttttgctcttattg

SEQ ID NO: 44714 - DNA, 16 bp, H. sapiens
agttttgctcttgtca

SEQ ID NO: 44715 - DNA, 16 bp, H. sapiens
agttttgctcttgtta

SEQ ID NO: 44716 - DNA, 16 bp, H. sapiens
agttttgctcttgttg

SEQ ID NO: 44717 - DNA, 16 bp, H. sapiens
agttttgctcttttcg

SEQ ID NO: 44718 - DNA, 16 bp, H. sapiens
agttttgctctttttg

SEQ ID NO: 44719 - DNA, 16 bp, H. sapiens
agttttgctgttgttt

SEQ ID NO: 44720 - DNA, 16 bp, H. sapiens
agttttgctttaaaat

SEQ ID NO: 44721 - DNA, 16 bp, H. sapiens
agttttgcttttaaaa

SEQ ID NO: 44722 - DNA, 16 bp, H. sapiens
agttttgctttttaaa

SEQ ID NO: 44723 - DNA, 16 bp, H. sapiens
agttttgctttttgga

SEQ ID NO: 44724 - DNA, 16 bp, H. sapiens
agttttggaaatagat

SEQ ID NO: 44725 - DNA, 16 bp, H. sapiens
agttttggaagatgaa

SEQ ID NO: 44726 - DNA, 16 bp, H. sapiens
agttttggaattacag

SEQ ID NO: 44727 - DNA, 16 bp, H. sapiens
agttttggaggtcaga

SEQ ID NO: 44728 - DNA, 16 bp, H. sapiens
agttttggatctttcc

SEQ ID NO: 44729 - DNA, 16 bp, H. sapiens
agttttggattttaaa

SEQ ID NO: 44730 - DNA, 16 bp, H. sapiens
agttttggccaatcaa

SEQ ID NO: 44731 - DNA, 16 bp, H. sapiens
agttttggggtcattt

SEQ ID NO: 44732 - DNA, 16 bp, H. sapiens
agttttgggttaaatg

SEQ ID NO: 44733 - DNA, 16 bp, H. sapiens
agttttggtgtggatg

SEQ ID NO: 44734 - DNA, 16 bp, H. sapiens
agttttgtagtatatt

SEQ ID NO: 44735 - DNA, 16 bp, H. sapiens
agttttgtagttttct

SEQ ID NO: 44736 - DNA, 16 bp, H. sapiens
agttttgtcttttcta

SEQ ID NO: 44737 - DNA, 16 bp, H. sapiens
agttttgtgcttcaaa

SEQ ID NO: 44738 - DNA, 16 bp, H. sapiens
agttttgtgcttgaaa

SEQ ID NO: 44739 - DNA, 16 bp, H. sapiens
agttttgttacatgaa

SEQ ID NO: 44740 - DNA, 16 bp, H. sapiens
agtttttaaaaagaat

SEQ ID NO: 44741 - DNA, 16 bp, H. sapiens
agtttttaaaaagtta

SEQ ID NO: 44742 - DNA, 16 bp, H. sapiens
agtttttaaaaatctt

SEQ ID NO: 44743 - DNA, 16 bp, H. sapiens
agtttttaaaaatgta

SEQ ID NO: 44744 - DNA, 16 bp, H. sapiens
agtttttaaaaattag

SEQ ID NO: 44745 - DNA, 16 bp, H. sapiens
agtttttaaaaattct

SEQ ID NO: 44746 - DNA, 16 bp, H. sapiens
agtttttaaacactct

SEQ ID NO: 44747 - DNA, 16 bp, H. sapiens
agtttttaaacagaaa

SEQ ID NO: 44748 - DNA, 16 bp, H. sapiens
agtttttaaatcctga

SEQ ID NO: 44749 - DNA, 16 bp, H. sapiens
agtttttaaatgaaat

SEQ ID NO: 44750 - DNA, 16 bp, H. sapiens
agtttttaaatttcta

SEQ ID NO: 44751 - DNA, 16 bp, H. sapiens
agtttttaaggaaaaa

SEQ ID NO: 44752 - DNA, 16 bp, H. sapiens
agtttttaatcacaaa

SEQ ID NO: 44753 - DNA, 16 bp, H. sapiens
agtttttaatgattgc

SEQ ID NO: 44754 - DNA, 16 bp, H. sapiens
agtttttacaaattga

SEQ ID NO: 44755 - DNA, 16 bp, H. sapiens
agtttttacattttat

SEQ ID NO: 44756 - DNA, 16 bp, H. sapiens
agtttttactttatgt

SEQ ID NO: 44757 - DNA, 16 bp, H. sapiens
agtttttagaagaaaa

SEQ ID NO: 44758 - DNA, 16 bp, H. sapiens
agtttttatagagatg

SEQ ID NO: 44759 - DNA, 16 bp, H. sapiens
agtttttatatgaata

SEQ ID NO: 44760 - DNA, 16 bp, H. sapiens
agtttttatgataaaa

SEQ ID NO: 44761 - DNA, 16 bp, H. sapiens
agtttttatgtgagga

SEQ ID NO: 44762 - DNA, 16 bp, H. sapiens
agtttttattagaaaa

SEQ ID NO: 44763 - DNA, 16 bp, H. sapiens
agtttttcatatacct

SEQ ID NO: 44764 - DNA, 16 bp, H. sapiens
agtttttcatatatat

SEQ ID NO: 44765 - DNA, 16 bp, H. sapiens
agtttttcattattat

SEQ ID NO: 44766 - DNA, 16 bp, H. sapiens
agtttttcccattcag

SEQ ID NO: 44767 - DNA, 16 bp, H. sapiens
agtttttctaattctg

SEQ ID NO: 44768 - DNA, 16 bp, H. sapiens
agtttttctgctcttt

SEQ ID NO: 44769 - DNA, 16 bp, H. sapiens
agtttttcttctctgt

SEQ ID NO: 44770 - DNA, 16 bp, H. sapiens
agtttttcttctttag

SEQ ID NO: 44771 - DNA, 16 bp, H. sapiens
agtttttcttgtagag

SEQ ID NO: 44772 - DNA, 16 bp, H. sapiens
agtttttctttagaaa

SEQ ID NO: 44773 - DNA, 16 bp, H. sapiens
agtttttctttttaaa

SEQ ID NO: 44774 - DNA, 16 bp, H. sapiens
agtttttgaaaaagaa

SEQ ID NO: 44775 - DNA, 16 bp, H. sapiens
agtttttgaaaattat

SEQ ID NO: 44776 - DNA, 16 bp, H. sapiens
agtttttgacttgaag

SEQ ID NO: 44777 - DNA, 16 bp, H. sapiens
agtttttgcattttta

SEQ ID NO: 44778 - DNA, 16 bp, H. sapiens
agtttttgctattgta

SEQ ID NO: 44779 - DNA, 16 bp, H. sapiens
agtttttgctcttaag

SEQ ID NO: 44780 - DNA, 16 bp, H. sapiens
agtttttgcttcatgt

SEQ ID NO: 44781 - DNA, 16 bp, H. sapiens
agtttttgcttttctg

SEQ ID NO: 44782 - DNA, 16 bp, H. sapiens
agtttttggtggagtc

SEQ ID NO: 44783 - DNA, 16 bp, H. sapiens
agtttttgtaaataaa

SEQ ID NO: 44784 - DNA, 16 bp, H. sapiens
agtttttgtcctggga

SEQ ID NO: 44785 - DNA, 16 bp, H. sapiens
agttttttaaaaaaac

SEQ ID NO: 44786 - DNA, 16 bp, H. sapiens
agttttttaaaaagtt

SEQ ID NO: 44787 - DNA, 16 bp, H. sapiens
agttttttaaaagtaa

SEQ ID NO: 44788 - DNA, 16 bp, H. sapiens
agttttttaatcctca

SEQ ID NO: 44789 - DNA, 16 bp, H. sapiens
agttttttcatctgtg

SEQ ID NO: 44790 - DNA, 16 bp, H. sapiens
agttttttcctaatgt

SEQ ID NO: 44791 - DNA, 16 bp, H. sapiens
agttttttgaggaaac

SEQ ID NO: 44792 - DNA, 16 bp, H. sapiens
agttttttgaggaagc

SEQ ID NO: 44793 - DNA, 16 bp, H. sapiens
agttttttgagggacc

SEQ ID NO: 44794 - DNA, 16 bp, H. sapiens
agtttttttaaaaatg

SEQ ID NO: 44795 - DNA, 16 bp, H. sapiens
agtttttttaatctat

SEQ ID NO: 44796 - DNA, 16 bp, H. sapiens
agtttttttcataccc

SEQ ID NO: 44797 - DNA, 16 bp, H. sapiens
agtttttttccagttc

SEQ ID NO: 44798 - DNA, 16 bp, H. sapiens
agtttttttctgaata

SEQ ID NO: 44799 - DNA, 16 bp, H. sapiens
agttttttttaaaaag

SEQ ID NO: 44800 - DNA, 16 bp, H. sapiens
agttttttttccttca

SEQ ID NO: 44801 - DNA, 16 bp, H. sapiens
agtttttttttccccc

SEQ ID NO: 44802 - DNA, 16 bp, H. sapiens
ataaaaaaaatacctg

SEQ ID NO: 44803 - DNA, 16 bp, H. sapiens
ataaaaaaaatgctca

SEQ ID NO: 44804 - DNA, 16 bp, H. sapiens
ataaaaaaatgctcaa

SEQ ID NO: 44805 - DNA, 16 bp, H. sapiens
ataaaaaaattatctg

SEQ ID NO: 44806 - DNA, 16 bp, H. sapiens
ataaaaaagatgagtt

SEQ ID NO: 44807 - DNA, 16 bp, H. sapiens
ataaaaaatgcaaatg

SEQ ID NO: 44808 - DNA, 21 bp, H. sapiens
ataaaaaattagccaggcatg

SEQ ID NO: 44809 - DNA, 19 bp, H. sapiens
ataaaaaattagctgggtg

SEQ ID NO: 44810 - DNA, 16 bp, H. sapiens
ataaaaaatttcagtt

SEQ ID NO: 44811 - DNA, 16 bp, H. sapiens
ataaaaacaaatttgt

SEQ ID NO: 44812 - DNA, 16 bp, H. sapiens
ataaaaacaatgctta

SEQ ID NO: 44813 - DNA, 16 bp, H. sapiens
ataaaaacaattgaac

SEQ ID NO: 44814 - DNA, 16 bp, H. sapiens
ataaaaacacttgaaa

SEQ ID NO: 44815 - DNA, 16 bp, H. sapiens
ataaaaacagttttac

SEQ ID NO: 44816 - DNA, 16 bp, H. sapiens
ataaaaacatgtttat

SEQ ID NO: 44817 - DNA, 16 bp, H. sapiens
ataaaaacattcattt

SEQ ID NO: 44818 - DNA, 16 bp, H. sapiens
ataaaaacatttcatt

SEQ ID NO: 44819 - DNA, 16 bp, H. sapiens
ataaaaacatttgtaa

SEQ ID NO: 44820 - DNA, 16 bp, H. sapiens
ataaaaacattttcag

SEQ ID NO: 44821 - DNA, 16 bp, H. sapiens
ataaaaacattttgaa

SEQ ID NO: 44822 - DNA, 16 bp, H. sapiens
ataaaaaccctgaaag

SEQ ID NO: 44823 - DNA, 16 bp, H. sapiens
ataaaaactcagcaaa

SEQ ID NO: 44824 - DNA, 16 bp, H. sapiens
ataaaaactctcagta

SEQ ID NO: 44825 - DNA, 16 bp, H. sapiens
ataaaaactgtaagaa

SEQ ID NO: 44826 - DNA, 16 bp, H. sapiens
ataaaaacttgaaaat

SEQ ID NO: 44827 - DNA, 16 bp, H. sapiens
ataaaaacttgtacac

SEQ ID NO: 44828 - DNA, 16 bp, H. sapiens
ataaaaactttgaaaa

SEQ ID NO: 44829 - DNA, 16 bp, H. sapiens
ataaaaagaaaatctt

SEQ ID NO: 44830 - DNA, 16 bp, H. sapiens
ataaaaagatgagttc

SEQ ID NO: 44831 - DNA, 16 bp, H. sapiens
ataaaaagcaactcct

SEQ ID NO: 44832 - DNA, 16 bp, H. sapiens
ataaaaagctttcttt

SEQ ID NO: 44833 - DNA, 16 bp, H. sapiens
ataaaaagtcaggaaa

SEQ ID NO: 44834 - DNA, 16 bp, H. sapiens
ataaaaagtttcccag

SEQ ID NO: 44835 - DNA, 16 bp, H. sapiens
ataaaaataaaaggct

SEQ ID NO: 44836 - DNA, 16 bp, H. sapiens
ataaaaataaaatctg

SEQ ID NO: 44837 - DNA, 16 bp, H. sapiens
ataaaaataaagctgt

SEQ ID NO: 44838 - DNA, 16 bp, H. sapiens
ataaaaataaagtcat

SEQ ID NO: 44839 - DNA, 16 bp, H. sapiens
ataaaaataaatcagt

SEQ ID NO: 44840 - DNA, 16 bp, H. sapiens
ataaaaatacttttct

SEQ ID NO: 44841 - DNA, 16 bp, H. sapiens
ataaaaatagagtttt

SEQ ID NO: 44842 - DNA, 16 bp, H. sapiens
ataaaaatagttttga

SEQ ID NO: 44843 - DNA, 16 bp, H. sapiens
ataaaaatatacttga

SEQ ID NO: 44844 - DNA, 16 bp, H. sapiens
ataaaaatatagtcaa

SEQ ID NO: 44845 - DNA, 16 bp, H. sapiens
ataaaaatcaatgaat

SEQ ID NO: 44846 - DNA, 16 bp, H. sapiens
ataaaaatcagaaatt

SEQ ID NO: 44847 - DNA, 16 bp, H. sapiens
ataaaaatcagaatag

SEQ ID NO: 44848 - DNA, 16 bp, H. sapiens
ataaaaatcatgtgat

SEQ ID NO: 44849 - DNA, 16 bp, H. sapiens
ataaaaatccatgctt

SEQ ID NO: 44850 - DNA, 16 bp, H. sapiens
ataaaaatcccagaag

SEQ ID NO: 44851 - DNA, 16 bp, H. sapiens
ataaaaatcctgaaag

SEQ ID NO: 44852 - DNA, 16 bp, H. sapiens
ataaaaatgaaattca

SEQ ID NO: 44853 - DNA, 16 bp, H. sapiens
ataaaaatgacaatga

SEQ ID NO: 44854 - DNA, 16 bp, H. sapiens
ataaaaatgcaaatta

SEQ ID NO: 44855 - DNA, 16 bp, H. sapiens
ataaaaatgcacagaa

SEQ ID NO: 44856 - DNA, 16 bp, H. sapiens
ataaaaatgcatttat

SEQ ID NO: 44857 - DNA, 16 bp, H. sapiens
ataaaaatgctataaa

SEQ ID NO: 44858 - DNA, 16 bp, H. sapiens
ataaaaatggagacat

SEQ ID NO: 44859 - DNA, 16 bp, H. sapiens
ataaaaatggattttt

SEQ ID NO: 44860 - DNA, 16 bp, H. sapiens
ataaaaatggcatttt

SEQ ID NO: 44861 - DNA, 17 bp, H. sapiens
ataaaaatgggcaacca

SEQ ID NO: 44862 - DNA, 16 bp, H. sapiens
ataaaaatgtaaacat

SEQ ID NO: 44863 - DNA, 16 bp, H. sapiens
ataaaaatgtattcaa

SEQ ID NO: 44864 - DNA, 16 bp, H. sapiens
ataaaaatgtcttcag

SEQ ID NO: 44865 - DNA, 16 bp, H. sapiens
ataaaaatgtgttcaa

SEQ ID NO: 44866 - DNA, 16 bp, H. sapiens
ataaaaatgttaacaa

SEQ ID NO: 44867 - DNA, 16 bp, H. sapiens
ataaaaatgttcatat

SEQ ID NO: 44868 - DNA, 16 bp, H. sapiens
ataaaaatgttctaaa

SEQ ID NO: 44869 - DNA, 16 bp, H. sapiens
ataaaaatgtttccaa

SEQ ID NO: 44870 - DNA, 16 bp, H. sapiens
ataaaaattagctagg

SEQ ID NO: 44871 - DNA, 16 bp, H. sapiens
ataaaaattagctggg

SEQ ID NO: 44872 - DNA, 16 bp, H. sapiens
ataaaaattccagaaa

SEQ ID NO: 44873 - DNA, 16 bp, H. sapiens
ataaaaattgccaaaa

SEQ ID NO: 44874 - DNA, 16 bp, H. sapiens
ataaaaattggctggg

SEQ ID NO: 44875 - DNA, 16 bp, H. sapiens
ataaaaattttctcaa

SEQ ID NO: 44876 - DNA, 16 bp, H. sapiens
ataaaacaaatgttaa

SEQ ID NO: 44877 - DNA, 16 bp, H. sapiens
ataaaacaaccatttt

SEQ ID NO: 44878 - DNA, 16 bp, H. sapiens
ataaaacaattgtaaa

SEQ ID NO: 44879 - DNA, 16 bp, H. sapiens
ataaaacaccaaaagc

SEQ ID NO: 44880 - DNA, 16 bp, H. sapiens
ataaaacacttaagaa

SEQ ID NO: 44881 - DNA, 16 bp, H. sapiens
ataaaacagattttaa

SEQ ID NO: 44882 - DNA, 16 bp, H. sapiens
ataaaacaggaataat

SEQ ID NO: 44883 - DNA, 16 bp, H. sapiens
ataaaacaggctttaa

SEQ ID NO: 44884 - DNA, 16 bp, H. sapiens
ataaaacagtatttta

SEQ ID NO: 44885 - DNA, 16 bp, H. sapiens
ataaaacatatggaaa

SEQ ID NO: 44886 - DNA, 16 bp, H. sapiens
ataaaacatctagaaa

SEQ ID NO: 44887 - DNA, 16 bp, H. sapiens
ataaaacatttgtatt

SEQ ID NO: 44888 - DNA, 16 bp, H. sapiens
ataaaacattttagaa

SEQ ID NO: 44889 - DNA, 16 bp, H. sapiens
ataaaacattttcttt

SEQ ID NO: 44890 - DNA, 16 bp, H. sapiens
ataaaaccaccagatc

SEQ ID NO: 44891 - DNA, 16 bp, H. sapiens
ataaaacccaaaggga

SEQ ID NO: 44892 - DNA, 16 bp, H. sapiens
ataaaaccccttgtgg

SEQ ID NO: 44893 - DNA, 16 bp, H. sapiens
ataaaaccctggaaga

SEQ ID NO: 44894 - DNA, 16 bp, H. sapiens
ataaaacctacaaaga

SEQ ID NO: 44895 - DNA, 16 bp, H. sapiens
ataaaactagttttta

SEQ ID NO: 44896 - DNA, 16 bp, H. sapiens
ataaaactctgatgaa

SEQ ID NO: 44897 - DNA, 16 bp, H. sapiens
ataaaactggaaatca

SEQ ID NO: 44898 - DNA, 16 bp, H. sapiens
ataaaactgtgaaaaa

SEQ ID NO: 44899 - DNA, 16 bp, H. sapiens
ataaaactgttctaaa

SEQ ID NO: 44900 - DNA, 16 bp, H. sapiens
ataaaactgtttttaa

SEQ ID NO: 44901 - DNA, 16 bp, H. sapiens
ataaaacttccctcca

SEQ ID NO: 44902 - DNA, 16 bp, H. sapiens
ataaaacttgaaaaat

SEQ ID NO: 44903 - DNA, 16 bp, H. sapiens
ataaaacttgaaaata

SEQ ID NO: 44904 - DNA, 16 bp, H. sapiens
ataaaactttaatgga

SEQ ID NO: 44905 - DNA, 16 bp, H. sapiens
ataaaagaaaatcttg

SEQ ID NO: 44906 - DNA, 16 bp, H. sapiens
ataaaagaaaatcttt

SEQ ID NO: 44907 - DNA, 16 bp, H. sapiens
ataaaagaaaatgtgg

SEQ ID NO: 44908 - DNA, 16 bp, H. sapiens
ataaaagaaacatttt

SEQ ID NO: 44909 - DNA, 16 bp, H. sapiens
ataaaagaaggaatct

SEQ ID NO: 44910 - DNA, 16 bp, H. sapiens
ataaaagacaacatat

SEQ ID NO: 44911 - DNA, 16 bp, H. sapiens
ataaaagaggcctcag

SEQ ID NO: 44912 - DNA, 16 bp, H. sapiens
ataaaagaggcttcat

SEQ ID NO: 44913 - DNA, 16 bp, H. sapiens
ataaaagatcattttt

SEQ ID NO: 44914 - DNA, 16 bp, H. sapiens
ataaaagatgctcaat

SEQ ID NO: 44915 - DNA, 16 bp, H. sapiens
ataaaagcaaaaattg

SEQ ID NO: 44916 - DNA, 16 bp, H. sapiens
ataaaagcaattttaa

SEQ ID NO: 44917 - DNA, 16 bp, H. sapiens
ataaaagcaggcagaa

SEQ ID NO: 44918 - DNA, 16 bp, H. sapiens
ataaaagcattataaa

SEQ ID NO: 44919 - DNA, 16 bp, H. sapiens
ataaaagccaattaga

SEQ ID NO: 44920 - DNA, 16 bp, H. sapiens
ataaaagccatatata

SEQ ID NO: 44921 - DNA, 16 bp, H. sapiens
ataaaagctattttaa

SEQ ID NO: 44922 - DNA, 16 bp, H. sapiens
ataaaagctcagaaaa

SEQ ID NO: 44923 - DNA, 16 bp, H. sapiens
ataaaagcttgaaaaa

SEQ ID NO: 44924 - DNA, 16 bp, H. sapiens
ataaaaggaaattttt

SEQ ID NO: 44925 - DNA, 16 bp, H. sapiens
ataaaaggatatttat

SEQ ID NO: 44926 - DNA, 16 bp, H. sapiens
ataaaaggatgaattt

SEQ ID NO: 44927 - DNA, 16 bp, H. sapiens
ataaaaggatttattt

SEQ ID NO: 44928 - DNA, 16 bp, H. sapiens
ataaaagggcaacatg

SEQ ID NO: 44929 - DNA, 16 bp, H. sapiens
ataaaagtaaccattt

SEQ ID NO: 44930 - DNA, 16 bp, H. sapiens
ataaaagtagaaatca

SEQ ID NO: 44931 - DNA, 16 bp, H. sapiens
ataaaagtagacacat

SEQ ID NO: 44932 - DNA, 16 bp, H. sapiens
ataaaagtattcattt

SEQ ID NO: 44933 - DNA, 16 bp, H. sapiens
ataaaagtggtgaaag

SEQ ID NO: 44934 - DNA, 16 bp, H. sapiens
ataaaagttacatttt

SEQ ID NO: 44935 - DNA, 16 bp, H. sapiens
ataaaagttatgtgaa

SEQ ID NO: 44936 - DNA, 16 bp, H. sapiens
ataaaagttctgaaaa

SEQ ID NO: 44937 - DNA, 16 bp, H. sapiens
ataaaagttgctgtct

SEQ ID NO: 44938 - DNA, 16 bp, H. sapiens
ataaaagtttggaaaa

SEQ ID NO: 44939 - DNA, 16 bp, H. sapiens
ataaaagtttggaaag

SEQ ID NO: 44940 - DNA, 16 bp, H. sapiens
ataaaagtttgttaaa

SEQ ID NO: 44941 - DNA, 16 bp, H. sapiens
ataaaataaaatgctg

SEQ ID NO: 44942 - DNA, 16 bp, H. sapiens
ataaaataaaattagc

SEQ ID NO: 44943 - DNA, 16 bp, H. sapiens
ataaaataaatctctt

SEQ ID NO: 44944 - DNA, 16 bp, H. sapiens
ataaaataaatgcaat

SEQ ID NO: 44945 - DNA, 16 bp, H. sapiens
ataaaataaatgcaga

SEQ ID NO: 44946 - DNA, 16 bp, H. sapiens
ataaaataactgaaat

SEQ ID NO: 44947 - DNA, 16 bp, H. sapiens
ataaaataagtctcaa

SEQ ID NO: 44948 - DNA, 16 bp, H. sapiens
ataaaataatgcattt

SEQ ID NO: 44949 - DNA, 16 bp, H. sapiens
ataaaataatgccaaa

SEQ ID NO: 44950 - DNA, 16 bp, H. sapiens
ataaaataattcatgt

SEQ ID NO: 44951 - DNA, 16 bp, H. sapiens
ataaaataatttgtac

SEQ ID NO: 44952 - DNA, 16 bp, H. sapiens
ataaaatacaaatgtt

SEQ ID NO: 44953 - DNA, 16 bp, H. sapiens
ataaaatacaatgaat

SEQ ID NO: 44954 - DNA, 16 bp, H. sapiens
ataaaatacacatttt

SEQ ID NO: 44955 - DNA, 16 bp, H. sapiens
ataaaatacatcttta

SEQ ID NO: 44956 - DNA, 16 bp, H. sapiens
ataaaatacattcttt

SEQ ID NO: 44957 - DNA, 16 bp, H. sapiens
ataaaatactagtaaa

SEQ ID NO: 44958 - DNA, 16 bp, H. sapiens
ataaaatactctttat

SEQ ID NO: 44959 - DNA, 16 bp, H. sapiens
ataaaatacttaagaa

SEQ ID NO: 44960 - DNA, 16 bp, H. sapiens
ataaaatacttatgaa

SEQ ID NO: 44961 - DNA, 16 bp, H. sapiens
ataaaatactttggaa

SEQ ID NO: 44962 - DNA, 16 bp, H. sapiens
ataaaatagatttcaa

SEQ ID NO: 44963 - DNA, 16 bp, H. sapiens
ataaaatagcattttt

SEQ ID NO: 44964 - DNA, 16 bp, H. sapiens
ataaaatatacttttc

SEQ ID NO: 44965 - DNA, 16 bp, H. sapiens
ataaaatatatgcaaa

SEQ ID NO: 44966 - DNA, 16 bp, H. sapiens
ataaaatatatgttga

SEQ ID NO: 44967 - DNA, 16 bp, H. sapiens
ataaaatatatttgga

SEQ ID NO: 44968 - DNA, 16 bp, H. sapiens
ataaaatatccttttt

SEQ ID NO: 44969 - DNA, 16 bp, H. sapiens
ataaaatatggtaaca

SEQ ID NO: 44970 - DNA, 16 bp, H. sapiens
ataaaatatgtaaact

SEQ ID NO: 44971 - DNA, 16 bp, H. sapiens
ataaaatattatgcaa

SEQ ID NO: 44972 - DNA, 16 bp, H. sapiens
ataaaatattgcatat

SEQ ID NO: 44973 - DNA, 16 bp, H. sapiens
ataaaatattggcaaa

SEQ ID NO: 44974 - DNA, 16 bp, H. sapiens
ataaaatatttaggta

SEQ ID NO: 44975 - DNA, 16 bp, H. sapiens
ataaaatatttcttct

SEQ ID NO: 44976 - DNA, 16 bp, H. sapiens
ataaaatatttggaga

SEQ ID NO: 44977 - DNA, 16 bp, H. sapiens
ataaaatatttttcca

SEQ ID NO: 44978 - DNA, 16 bp, H. sapiens
ataaaatcattttgaa

SEQ ID NO: 44979 - DNA, 16 bp, H. sapiens
ataaaatccaatttat

SEQ ID NO: 44980 - DNA, 16 bp, H. sapiens
ataaaatcctaagccc

SEQ ID NO: 44981 - DNA, 16 bp, H. sapiens
ataaaatctagaagaa

SEQ ID NO: 44982 - DNA, 16 bp, H. sapiens
ataaaatctgaacaga

SEQ ID NO: 44983 - DNA, 16 bp, H. sapiens
ataaaatctgaataaa

SEQ ID NO: 44984 - DNA, 16 bp, H. sapiens
ataaaatctgaatttt

SEQ ID NO: 44985 - DNA, 16 bp, H. sapiens
ataaaatctggaagaa

SEQ ID NO: 44986 - DNA, 16 bp, H. sapiens
ataaaatcttaaaagc

SEQ ID NO: 44987 - DNA, 16 bp, H. sapiens
ataaaatcttcacaat

SEQ ID NO: 44988 - DNA, 16 bp, H. sapiens
ataaaatctttaacat

SEQ ID NO: 44989 - DNA, 16 bp, H. sapiens
ataaaatctttgtcca

SEQ ID NO: 44990 - DNA, 16 bp, H. sapiens
ataaaatgaatacaat

SEQ ID NO: 44991 - DNA, 16 bp, H. sapiens
ataaaatgacatagaa

SEQ ID NO: 44992 - DNA, 16 bp, H. sapiens
ataaaatgacttattt

SEQ ID NO: 44993 - DNA, 16 bp, H. sapiens
ataaaatgagtgaaat

SEQ ID NO: 44994 - DNA, 16 bp, H. sapiens
ataaaatgagttagtg

SEQ ID NO: 44995 - DNA, 16 bp, H. sapiens
ataaaatgcaatagaa

SEQ ID NO: 44996 - DNA, 16 bp, H. sapiens
ataaaatgcatattga

SEQ ID NO: 44997 - DNA, 16 bp, H. sapiens
ataaaatgcctggcac

SEQ ID NO: 44998 - DNA, 16 bp, H. sapiens
ataaaatggaatattt

SEQ ID NO: 44999 - DNA, 16 bp, H. sapiens
ataaaatggaatggaa

SEQ ID NO: 45000 - DNA, 16 bp, H. sapiens
ataaaatggacaaatt

SEQ ID NO: 45001 - DNA, 16 bp, H. sapiens
ataaaatggggtagta

SEQ ID NO: 45002 - DNA, 16 bp, H. sapiens
ataaaatgtaaacaca

SEQ ID NO: 45003 - DNA, 16 bp, H. sapiens
ataaaatgtattactt

SEQ ID NO: 45004 - DNA, 16 bp, H. sapiens
ataaaatgtatttact

SEQ ID NO: 45005 - DNA, 16 bp, H. sapiens
ataaaatgtcataaaa

SEQ ID NO: 45006 - DNA, 16 bp, H. sapiens
ataaaatgtccaaaat

SEQ ID NO: 45007 - DNA, 16 bp, H. sapiens
ataaaatgtctttctt

SEQ ID NO: 45008 - DNA, 16 bp, H. sapiens
ataaaatgtgatatat

SEQ ID NO: 45009 - DNA, 16 bp, H. sapiens
ataaaatgtgattttt

SEQ ID NO: 45010 - DNA, 16 bp, H. sapiens
ataaaatgtgtaatga

SEQ ID NO: 45011 - DNA, 16 bp, H. sapiens
ataaaatgttaacaat

SEQ ID NO: 45012 - DNA, 16 bp, H. sapiens
ataaaatgttaacatt

SEQ ID NO: 45013 - DNA, 16 bp, H. sapiens
ataaaatgttacattt

SEQ ID NO: 45014 - DNA, 16 bp, H. sapiens
ataaaatgttattaag

SEQ ID NO: 45015 - DNA, 16 bp, H. sapiens
ataaaatgttgaatta

SEQ ID NO: 45016 - DNA, 16 bp, H. sapiens
ataaaatgtttacaaa

SEQ ID NO: 45017 - DNA, 16 bp, H. sapiens
ataaaatgtttcattt

SEQ ID NO: 45018 - DNA, 16 bp, H. sapiens
ataaaatgtttctctt

SEQ ID NO: 45019 - DNA, 16 bp, H. sapiens
ataaaattaaacacct

SEQ ID NO: 45020 - DNA, 16 bp, H. sapiens
ataaaattaaatgcct

SEQ ID NO: 45021 - DNA, 16 bp, H. sapiens
ataaaattaactatag

SEQ ID NO: 45022 - DNA, 16 bp, H. sapiens
ataaaattaccttcaa

SEQ ID NO: 45023 - DNA, 16 bp, H. sapiens
ataaaattaccttcag

SEQ ID NO: 45024 - DNA, 16 bp, H. sapiens
ataaaattagaaatca

SEQ ID NO: 45025 - DNA, 16 bp, H. sapiens
ataaaattattccttt

SEQ ID NO: 45026 - DNA, 16 bp, H. sapiens
ataaaattatttctgt

SEQ ID NO: 45027 - DNA, 16 bp, H. sapiens
ataaaattatttggaa

SEQ ID NO: 45028 - DNA, 16 bp, H. sapiens
ataaaattcaacatcc

SEQ ID NO: 45029 - DNA, 16 bp, H. sapiens
ataaaattcactattt

SEQ ID NO: 45030 - DNA, 16 bp, H. sapiens
ataaaattcactcatt

SEQ ID NO: 45031 - DNA, 16 bp, H. sapiens
ataaaattcagacaaa

SEQ ID NO: 45032 - DNA, 16 bp, H. sapiens
ataaaattcagctgtg

SEQ ID NO: 45033 - DNA, 16 bp, H. sapiens
ataaaattcattttct

SEQ ID NO: 45034 - DNA, 16 bp, H. sapiens
ataaaattctagaaat

SEQ ID NO: 45035 - DNA, 16 bp, H. sapiens
ataaaattctgtattt

SEQ ID NO: 45036 - DNA, 16 bp, H. sapiens
ataaaattgaaataca

SEQ ID NO: 45037 - DNA, 16 bp, H. sapiens
ataaaattgggaaaat

SEQ ID NO: 45038 - DNA, 16 bp, H. sapiens
ataaaatttaaaactg

SEQ ID NO: 45039 - DNA, 16 bp, H. sapiens
ataaaatttaagcttt

SEQ ID NO: 45040 - DNA, 16 bp, H. sapiens
ataaaatttcagaaag

SEQ ID NO: 45041 - DNA, 16 bp, H. sapiens
ataaaatttcatcttt

SEQ ID NO: 45042 - DNA, 16 bp, H. sapiens
ataaaatttcccattt

SEQ ID NO: 45043 - DNA, 16 bp, H. sapiens
ataaaatttgccattt

SEQ ID NO: 45044 - DNA, 16 bp, H. sapiens
ataaaatttggaaaga

SEQ ID NO: 45045 - DNA, 16 bp, H. sapiens
ataaaattttgtcatt

SEQ ID NO: 45046 - DNA, 16 bp, H. sapiens
ataaaatttttcagaa

SEQ ID NO: 45047 - DNA, 16 bp, H. sapiens
ataaacaaaaactgtt

SEQ ID NO: 45048 - DNA, 16 bp, H. sapiens
ataaacaaaatgttat

SEQ ID NO: 45049 - DNA, 16 bp, H. sapiens
ataaacaaagtggcca

SEQ ID NO: 45050 - DNA, 16 bp, H. sapiens
ataaacaaataaatgg

SEQ ID NO: 45051 - DNA, 16 bp, H. sapiens
ataaacaaatgtttat

SEQ ID NO: 45052 - DNA, 16 bp, H. sapiens
ataaacaaattcagaa

SEQ ID NO: 45053 - DNA, 16 bp, H. sapiens
ataaacaacagaaatg

SEQ ID NO: 45054 - DNA, 16 bp, H. sapiens
ataaacaacatatttt

SEQ ID NO: 45055 - DNA, 16 bp, H. sapiens
ataaacacaattagaa

SEQ ID NO: 45056 - DNA, 16 bp, H. sapiens
ataaacacattttatt

SEQ ID NO: 45057 - DNA, 16 bp, H. sapiens
ataaacactgcacact

SEQ ID NO: 45058 - DNA, 16 bp, H. sapiens
ataaacactggggatt

SEQ ID NO: 45059 - DNA, 16 bp, H. sapiens
ataaacacttattttt

SEQ ID NO: 45060 - DNA, 16 bp, H. sapiens
ataaacagaaatatat

SEQ ID NO: 45061 - DNA, 16 bp, H. sapiens
ataaacagaacaaatg

SEQ ID NO: 45062 - DNA, 16 bp, H. sapiens
ataaacagtaatattt

SEQ ID NO: 45063 - DNA, 16 bp, H. sapiens
ataaacatacacatgc

SEQ ID NO: 45064 - DNA, 16 bp, H. sapiens
ataaacatatgatttt

SEQ ID NO: 45065 - DNA, 16 bp, H. sapiens
ataaacatgagaacaa

SEQ ID NO: 45066 - DNA, 16 bp, H. sapiens
ataaacatggaaacaa

SEQ ID NO: 45067 - DNA, 16 bp, H. sapiens
ataaacatgggaatgc

SEQ ID NO: 45068 - DNA, 16 bp, H. sapiens
ataaacatgtaaaaat

SEQ ID NO: 45069 - DNA, 16 bp, H. sapiens
ataaacatgtattaat

SEQ ID NO: 45070 - DNA, 16 bp, H. sapiens
ataaacatgtgtgcat

SEQ ID NO: 45071 - DNA, 16 bp, H. sapiens
ataaacatgttttcat

SEQ ID NO: 45072 - DNA, 16 bp, H. sapiens
ataaacattcatgtac

SEQ ID NO: 45073 - DNA, 16 bp, H. sapiens
ataaacattcatttca

SEQ ID NO: 45074 - DNA, 16 bp, H. sapiens
ataaacattccttttt

SEQ ID NO: 45075 - DNA, 16 bp, H. sapiens
ataaacatttacatta

SEQ ID NO: 45076 - DNA, 16 bp, H. sapiens
ataaacatttgccaaa

SEQ ID NO: 45077 - DNA, 16 bp, H. sapiens
ataaacattttaatga

SEQ ID NO: 45078 - DNA, 16 bp, H. sapiens
ataaacattttataac

SEQ ID NO: 45079 - DNA, 16 bp, H. sapiens
ataaacatttttatgt

SEQ ID NO: 45080 - DNA, 16 bp, H. sapiens
ataaaccaggcatggt

SEQ ID NO: 45081 - DNA, 16 bp, H. sapiens
ataaaccatggaatac

SEQ ID NO: 45082 - DNA, 16 bp, H. sapiens
ataaacccagtttcag

SEQ ID NO: 45083 - DNA, 16 bp, H. sapiens
ataaacctctttaaaa

SEQ ID NO: 45084 - DNA, 16 bp, H. sapiens
ataaaccttgaaaaca

SEQ ID NO: 45085 - DNA, 16 bp, H. sapiens
ataaacctttaatttt

SEQ ID NO: 45086 - DNA, 28 bp, H. sapiens
ataaactaaagagcttctgcacagcaaa

SEQ ID NO: 45087 - DNA, 16 bp, H. sapiens
ataaactaatatatgt

SEQ ID NO: 45088 - DNA, 16 bp, H. sapiens
ataaactacattttaa

SEQ ID NO: 45089 - DNA, 16 bp, H. sapiens
ataaactatgtatttt

SEQ ID NO: 45090 - DNA, 16 bp, H. sapiens
ataaactcccctttat

SEQ ID NO: 45091 - DNA, 16 bp, H. sapiens
ataaactcctgacctc

SEQ ID NO: 45092 - DNA, 16 bp, H. sapiens
ataaactcttaaattt

SEQ ID NO: 45093 - DNA, 16 bp, H. sapiens
ataaactgaatgtttg

SEQ ID NO: 45094 - DNA, 16 bp, H. sapiens
ataaactgatttattt

SEQ ID NO: 45095 - DNA, 16 bp, H. sapiens
ataaactggactacat

SEQ ID NO: 45096 - DNA, 16 bp, H. sapiens
ataaactggctcattt

SEQ ID NO: 45097 - DNA, 16 bp, H. sapiens
ataaactgggtggctt

SEQ ID NO: 45098 - DNA, 16 bp, H. sapiens
ataaactgtaatattt

SEQ ID NO: 45099 - DNA, 16 bp, H. sapiens
ataaacttaacaaaga

SEQ ID NO: 45100 - DNA, 16 bp, H. sapiens
ataaacttgaaaataa

SEQ ID NO: 45101 - DNA, 16 bp, H. sapiens
ataaacttgaaaatat

SEQ ID NO: 45102 - DNA, 16 bp, H. sapiens
ataaacttggaggaca

SEQ ID NO: 45103 - DNA, 16 bp, H. sapiens
ataaacttgtttgtgg

SEQ ID NO: 45104 - DNA, 16 bp, H. sapiens
ataaactttagaatca

SEQ ID NO: 45105 - DNA, 16 bp, H. sapiens
ataaactttatttttg

SEQ ID NO: 45106 - DNA, 16 bp, H. sapiens
ataaactttcctcttg

SEQ ID NO: 45107 - DNA, 16 bp, H. sapiens
ataaactttggggact

SEQ ID NO: 45108 - DNA, 16 bp, H. sapiens
ataaacttttattgtg

SEQ ID NO: 45109 - DNA, 16 bp, H. sapiens
ataaacttttcatttc

SEQ ID NO: 45110 - DNA, 16 bp, H. sapiens
ataaacttttctctta

SEQ ID NO: 45111 - DNA, 16 bp, H. sapiens
ataaacttttgttttt

SEQ ID NO: 45112 - DNA, 16 bp, H. sapiens
ataaagaaaaaggttt

SEQ ID NO: 45113 - DNA, 16 bp, H. sapiens
ataaagaaaacacagt

SEQ ID NO: 45114 - DNA, 16 bp, H. sapiens
ataaagaaaacacatt

SEQ ID NO: 45115 - DNA, 16 bp, H. sapiens
ataaagaaaacattta

SEQ ID NO: 45116 - DNA, 16 bp, H. sapiens
ataaagaaaacttttt

SEQ ID NO: 45117 - DNA, 16 bp, H. sapiens
ataaagaaaataactt

SEQ ID NO: 45118 - DNA, 16 bp, H. sapiens
ataaagaaaatgtggt

SEQ ID NO: 45119 - DNA, 16 bp, H. sapiens
ataaagaaacagattt

SEQ ID NO: 45120 - DNA, 16 bp, H. sapiens
ataaagaaatgaggtt

SEQ ID NO: 45121 - DNA, 16 bp, H. sapiens
ataaagaaatgctgga

SEQ ID NO: 45122 - DNA, 16 bp, H. sapiens
ataaagaaatgggcaa

SEQ ID NO: 45123 - DNA, 16 bp, H. sapiens
ataaagaaatgtctga

SEQ ID NO: 45124 - DNA, 16 bp, H. sapiens
ataaagaaattatctg

SEQ ID NO: 45125 - DNA, 16 bp, H. sapiens
ataaagaacaaaattt

SEQ ID NO: 45126 - DNA, 16 bp, H. sapiens
ataaagaacatttcca

SEQ ID NO: 45127 - DNA, 16 bp, H. sapiens
ataaagaactctcaaa

SEQ ID NO: 45128 - DNA, 16 bp, H. sapiens
ataaagaagactggaa

SEQ ID NO: 45129 - DNA, 16 bp, H. sapiens
ataaagaattcaaaag

SEQ ID NO: 45130 - DNA, 16 bp, H. sapiens
ataaagacaaagagat

SEQ ID NO: 45131 - DNA, 16 bp, H. sapiens
ataaagacacattcac

SEQ ID NO: 45132 - DNA, 16 bp, H. sapiens
ataaagacatacttga

SEQ ID NO: 45133 - DNA, 16 bp, H. sapiens
ataaagacatatccaa

SEQ ID NO: 45134 - DNA, 16 bp, H. sapiens
ataaagacatgcacac

SEQ ID NO: 45135 - DNA, 16 bp, H. sapiens
ataaagacatttaaaa

SEQ ID NO: 45136 - DNA, 16 bp, H. sapiens
ataaagacattttaaa

SEQ ID NO: 45137 - DNA, 16 bp, H. sapiens
ataaagacattttcat

SEQ ID NO: 45138 - DNA, 16 bp, H. sapiens
ataaagacattttctt

SEQ ID NO: 45139 - DNA, 16 bp, H. sapiens
ataaagactttaaaaa

SEQ ID NO: 45140 - DNA, 16 bp, H. sapiens
ataaagagtaattact

SEQ ID NO: 45141 - DNA, 16 bp, H. sapiens
ataaagagttaatatc

SEQ ID NO: 45142 - DNA, 16 bp, H. sapiens
ataaagatactccttg

SEQ ID NO: 45143 - DNA, 16 bp, H. sapiens
ataaagatattcaaat

SEQ ID NO: 45144 - DNA, 16 bp, H. sapiens
ataaagatcagagaag

SEQ ID NO: 45145 - DNA, 16 bp, H. sapiens
ataaagatgagaacaa

SEQ ID NO: 45146 - DNA, 16 bp, H. sapiens
ataaagatgcagtatt

SEQ ID NO: 45147 - DNA, 16 bp, H. sapiens
ataaagatgtattttt

SEQ ID NO: 45148 - DNA, 16 bp, H. sapiens
ataaagatgttctctg

SEQ ID NO: 45149 - DNA, 16 bp, H. sapiens
ataaagatgttctttt

SEQ ID NO: 45150 - DNA, 16 bp, H. sapiens
ataaagatttattgga

SEQ ID NO: 45151 - DNA, 16 bp, H. sapiens
ataaagatttatttct

SEQ ID NO: 45152 - DNA, 16 bp, H. sapiens
ataaagattttcttct

SEQ ID NO: 45153 - DNA, 16 bp, H. sapiens
ataaagcaaaaattga

SEQ ID NO: 45154 - DNA, 16 bp, H. sapiens
ataaagcaaacattga

SEQ ID NO: 45155 - DNA, 16 bp, H. sapiens
ataaagcaaatgaata

SEQ ID NO: 45156 - DNA, 16 bp, H. sapiens
ataaagcatataaaat

SEQ ID NO: 45157 - DNA, 16 bp, H. sapiens
ataaagccaaatgctt

SEQ ID NO: 45158 - DNA, 16 bp, H. sapiens
ataaagctacaataat

SEQ ID NO: 45159 - DNA, 16 bp, H. sapiens
ataaagctacagttat

SEQ ID NO: 45160 - DNA, 16 bp, H. sapiens
ataaagctgaaaaaca

SEQ ID NO: 45161 - DNA, 16 bp, H. sapiens
ataaagctggaaaaag

SEQ ID NO: 45162 - DNA, 16 bp, H. sapiens
ataaagctgttaagaa

SEQ ID NO: 45163 - DNA, 16 bp, H. sapiens
ataaagctgttaccaa

SEQ ID NO: 45164 - DNA, 16 bp, H. sapiens
ataaagctgttattta

SEQ ID NO: 45165 - DNA, 16 bp, H. sapiens
ataaagctgttttgct

SEQ ID NO: 45166 - DNA, 16 bp, H. sapiens
ataaaggaaagacatt

SEQ ID NO: 45167 - DNA, 16 bp, H. sapiens
ataaaggaaagagctt

SEQ ID NO: 45168 - DNA, 16 bp, H. sapiens
ataaaggaatgaggtt

SEQ ID NO: 45169 - DNA, 16 bp, H. sapiens
ataaaggacagttccc

SEQ ID NO: 45170 - DNA, 16 bp, H. sapiens
ataaaggggaatttcc

SEQ ID NO: 45171 - DNA, 16 bp, H. sapiens
ataaagtatttgtctt

SEQ ID NO: 45172 - DNA, 16 bp, H. sapiens
ataaagtattttcttt

SEQ ID NO: 45173 - DNA, 16 bp, H. sapiens
ataaagtatttttaag

SEQ ID NO: 45174 - DNA, 16 bp, H. sapiens
ataaagtcttattttt

SEQ ID NO: 45175 - DNA, 16 bp, H. sapiens
ataaagtgcttagaat

SEQ ID NO: 45176 - DNA, 16 bp, H. sapiens
ataaagtgtttataaa

SEQ ID NO: 45177 - DNA, 16 bp, H. sapiens
ataaagttatagtaat

SEQ ID NO: 45178 - DNA, 16 bp, H. sapiens
ataaagttgaatttat

SEQ ID NO: 45179 - DNA, 16 bp, H. sapiens
ataaagtttattttct

SEQ ID NO: 45180 - DNA, 16 bp, H. sapiens
ataaagttttaaaaac

SEQ ID NO: 45181 - DNA, 16 bp, H. sapiens
ataaagtttttaaaag

SEQ ID NO: 45182 - DNA, 16 bp, H. sapiens
ataaataaaaacactg

SEQ ID NO: 45183 - DNA, 16 bp, H. sapiens
ataaataaaactgaat

SEQ ID NO: 45184 - DNA, 16 bp, H. sapiens
ataaataaaagcattt

SEQ ID NO: 45185 - DNA, 16 bp, H. sapiens
ataaataaaaggcata

SEQ ID NO: 45186 - DNA, 16 bp, H. sapiens
ataaataaaagttctt

SEQ ID NO: 45187 - DNA, 16 bp, H. sapiens
ataaataaaattgaca

SEQ ID NO: 45188 - DNA, 16 bp, H. sapiens
ataaataaagtttcag

SEQ ID NO: 45189 - DNA, 16 bp, H. sapiens
ataaataaataaagct

SEQ ID NO: 45190 - DNA, 16 bp, H. sapiens
ataaataaataaggca

SEQ ID NO: 45191 - DNA, 16 bp, H. sapiens
ataaataaatacagtt

SEQ ID NO: 45192 - DNA, 16 bp, H. sapiens
ataaataaatatctga

SEQ ID NO: 45193 - DNA, 16 bp, H. sapiens
ataaataaatgaatgg

SEQ ID NO: 45194 - DNA, 16 bp, H. sapiens
ataaataaatggtggt

SEQ ID NO: 45195 - DNA, 16 bp, H. sapiens
ataaataaatgtgtta

SEQ ID NO: 45196 - DNA, 16 bp, H. sapiens
ataaataaattctttg

SEQ ID NO: 45197 - DNA, 16 bp, H. sapiens
ataaataagattgttt

SEQ ID NO: 45198 - DNA, 16 bp, H. sapiens
ataaataatgaggagc

SEQ ID NO: 45199 - DNA, 16 bp, H. sapiens
ataaatacagatattt

SEQ ID NO: 45200 - DNA, 16 bp, H. sapiens
ataaatacataaatgt

SEQ ID NO: 45201 - DNA, 16 bp, H. sapiens
ataaatacatagaaat

SEQ ID NO: 45202 - DNA, 16 bp, H. sapiens
ataaatacatagataa

SEQ ID NO: 45203 - DNA, 16 bp, H. sapiens
ataaatacatgcatac

SEQ ID NO: 45204 - DNA, 16 bp, H. sapiens
ataaatacatgtataa

SEQ ID NO: 45205 - DNA, 16 bp, H. sapiens
ataaatacatgtatat

SEQ ID NO: 45206 - DNA, 16 bp, H. sapiens
ataaatacattggaaa

SEQ ID NO: 45207 - DNA, 16 bp, H. sapiens
ataaatacatttttgt

SEQ ID NO: 45208 - DNA, 16 bp, H. sapiens
ataaatacgtatttat

SEQ ID NO: 45209 - DNA, 16 bp, H. sapiens
ataaatactggaaaga

SEQ ID NO: 45210 - DNA, 16 bp, H. sapiens
ataaatacttcagtat

SEQ ID NO: 45211 - DNA, 16 bp, H. sapiens
ataaatagctcatatt

SEQ ID NO: 45212 - DNA, 16 bp, H. sapiens
ataaatagctcctatt

SEQ ID NO: 45213 - DNA, 16 bp, H. sapiens
ataaatagttttcaaa

SEQ ID NO: 45214 - DNA, 16 bp, H. sapiens
ataaatatacagtata

SEQ ID NO: 45215 - DNA, 16 bp, H. sapiens
ataaatatacgtatat

SEQ ID NO: 45216 - DNA, 16 bp, H. sapiens
ataaatatatatatcc

SEQ ID NO: 45217 - DNA, 16 bp, H. sapiens
ataaatatatgcaatt

SEQ ID NO: 45218 - DNA, 16 bp, H. sapiens
ataaatatatgtactt

SEQ ID NO: 45219 - DNA, 16 bp, H. sapiens
ataaatatatgttgta

SEQ ID NO: 45220 - DNA, 16 bp, H. sapiens
ataaatatcagagaag

SEQ ID NO: 45221 - DNA, 16 bp, H. sapiens
ataaatatctagaaat

SEQ ID NO: 45222 - DNA, 16 bp, H. sapiens
ataaatatctgttgaa

SEQ ID NO: 45223 - DNA, 16 bp, H. sapiens
ataaatatgatacacc

SEQ ID NO: 45224 - DNA, 16 bp, H. sapiens
ataaatatgcaaattt

SEQ ID NO: 45225 - DNA, 16 bp, H. sapiens
ataaatatgtaaacat

SEQ ID NO: 45226 - DNA, 16 bp, H. sapiens
ataaatatgtacaaat

SEQ ID NO: 45227 - DNA, 16 bp, H. sapiens
ataaatatgtacatat

SEQ ID NO: 45228 - DNA, 16 bp, H. sapiens
ataaatatgtatgtat

SEQ ID NO: 45229 - DNA, 16 bp, H. sapiens
ataaatatgtattcat

SEQ ID NO: 45230 - DNA, 16 bp, H. sapiens
ataaatatgtggaaat

SEQ ID NO: 45231 - DNA, 16 bp, H. sapiens
ataaatatgtgtaata

SEQ ID NO: 45232 - DNA, 16 bp, H. sapiens
ataaatatgtttatgt

SEQ ID NO: 45233 - DNA, 16 bp, H. sapiens
ataaatattagctgct

SEQ ID NO: 45234 - DNA, 16 bp, H. sapiens
ataaatattcatcttt

SEQ ID NO: 45235 - DNA, 16 bp, H. sapiens
ataaatattgcatgtt

SEQ ID NO: 45236 - DNA, 16 bp, H. sapiens
ataaatatttaaactg

SEQ ID NO: 45237 - DNA, 16 bp, H. sapiens
ataaatatttacatgt

SEQ ID NO: 45238 - DNA, 16 bp, H. sapiens
ataaatatttatcaag

SEQ ID NO: 45239 - DNA, 16 bp, H. sapiens
ataaatatttattcac

SEQ ID NO: 45240 - DNA, 16 bp, H. sapiens
ataaatatttctaaca

SEQ ID NO: 45241 - DNA, 16 bp, H. sapiens
ataaatatttgacaaa

SEQ ID NO: 45242 - DNA, 16 bp, H. sapiens
ataaatatttgtcgaa

SEQ ID NO: 45243 - DNA, 16 bp, H. sapiens
ataaatattttaggct

SEQ ID NO: 45244 - DNA, 16 bp, H. sapiens
ataaatattttcaaca

SEQ ID NO: 45245 - DNA, 16 bp, H. sapiens
ataaatatttttgaag

SEQ ID NO: 45246 - DNA, 16 bp, H. sapiens
ataaatatttttgaca

SEQ ID NO: 45247 - DNA, 16 bp, H. sapiens
ataaatcaagaaaatt

SEQ ID NO: 45248 - DNA, 16 bp, H. sapiens
ataaatcaagaaagca

SEQ ID NO: 45249 - DNA, 16 bp, H. sapiens
ataaatcacacttttt

SEQ ID NO: 45250 - DNA, 16 bp, H. sapiens
ataaatcacattttta

SEQ ID NO: 45251 - DNA, 16 bp, H. sapiens
ataaatcacccagtct

SEQ ID NO: 45252 - DNA, 16 bp, H. sapiens
ataaatcactttttaa

SEQ ID NO: 45253 - DNA, 16 bp, H. sapiens
ataaatcagtatataa

SEQ ID NO: 45254 - DNA, 16 bp, H. sapiens
ataaatcattcattca

SEQ ID NO: 45255 - DNA, 16 bp, H. sapiens
ataaatcattctacca

SEQ ID NO: 45256 - DNA, 16 bp, H. sapiens
ataaatcattcttcta

SEQ ID NO: 45257 - DNA, 16 bp, H. sapiens
ataaatcattttgaaa

SEQ ID NO: 45258 - DNA, 16 bp, H. sapiens
ataaatccaaatactt

SEQ ID NO: 45259 - DNA, 16 bp, H. sapiens
ataaatccatgaaaat

SEQ ID NO: 45260 - DNA, 16 bp, H. sapiens
ataaatccatttttat

SEQ ID NO: 45261 - DNA, 16 bp, H. sapiens
ataaatcccaaaatat

SEQ ID NO: 45262 - DNA, 16 bp, H. sapiens
ataaatcccactttgt

SEQ ID NO: 45263 - DNA, 16 bp, H. sapiens
ataaatcctgtgaagt

SEQ ID NO: 45264 - DNA, 16 bp, H. sapiens
ataaatctagaaagaa

SEQ ID NO: 45265 - DNA, 16 bp, H. sapiens
ataaatcttgaaaaca

SEQ ID NO: 45266 - DNA, 16 bp, H. sapiens
ataaatctttgttttt

SEQ ID NO: 45267 - DNA, 16 bp, H. sapiens
ataaatgaaaaacagt

SEQ ID NO: 45268 - DNA, 16 bp, H. sapiens
ataaatgaaaaacatt

SEQ ID NO: 45269 - DNA, 16 bp, H. sapiens
ataaatgaaatcatat

SEQ ID NO: 45270 - DNA, 16 bp, H. sapiens
ataaatgaaattcatt

SEQ ID NO: 45271 - DNA, 16 bp, H. sapiens
ataaatgaacaaatgt

SEQ ID NO: 45272 - DNA, 16 bp, H. sapiens
ataaatgaacatttaa

SEQ ID NO: 45273 - DNA, 16 bp, H. sapiens
ataaatgaacttttca

SEQ ID NO: 45274 - DNA, 16 bp, H. sapiens
ataaatgaatgaaaac

SEQ ID NO: 45275 - DNA, 16 bp, H. sapiens
ataaatgaatgaacca

SEQ ID NO: 45276 - DNA, 16 bp, H. sapiens
ataaatgactcttatt

SEQ ID NO: 45277 - DNA, 16 bp, H. sapiens
ataaatgacttcaata

SEQ ID NO: 45278 - DNA, 16 bp, H. sapiens
ataaatgacttttaaa

SEQ ID NO: 45279 - DNA, 16 bp, H. sapiens
ataaatgcaattaaaa

SEQ ID NO: 45280 - DNA, 16 bp, H. sapiens
ataaatgcagaaaatg

SEQ ID NO: 45281 - DNA, 16 bp, H. sapiens
ataaatgcatattatt

SEQ ID NO: 45282 - DNA, 16 bp, H. sapiens
ataaatgcatatttat

SEQ ID NO: 45283 - DNA, 16 bp, H. sapiens
ataaatgcattaaata

SEQ ID NO: 45284 - DNA, 16 bp, H. sapiens
ataaatgcattatttt

SEQ ID NO: 45285 - DNA, 16 bp, H. sapiens
ataaatgcctggagtg

SEQ ID NO: 45286 - DNA, 16 bp, H. sapiens
ataaatgctaaaggaa

SEQ ID NO: 45287 - DNA, 16 bp, H. sapiens
ataaatgctgaaaaaa

SEQ ID NO: 45288 - DNA, 16 bp, H. sapiens
ataaatgctgtgaaga

SEQ ID NO: 45289 - DNA, 16 bp, H. sapiens
ataaatgctgtgtgtg

SEQ ID NO: 45290 - DNA, 16 bp, H. sapiens
ataaatgcttaataaa

SEQ ID NO: 45291 - DNA, 16 bp, H. sapiens
ataaatggaaaaacat

SEQ ID NO: 45292 - DNA, 16 bp, H. sapiens
ataaatggaaagacac

SEQ ID NO: 45293 - DNA, 16 bp, H. sapiens
ataaatggaaagatac

SEQ ID NO: 45294 - DNA, 16 bp, H. sapiens
ataaatggaaatgtat

SEQ ID NO: 45295 - DNA, 16 bp, H. sapiens
ataaatggaataaaca

SEQ ID NO: 45296 - DNA, 16 bp, H. sapiens
ataaatggaatcacat

SEQ ID NO: 45297 - DNA, 16 bp, H. sapiens
ataaatggacagatgg

SEQ ID NO: 45298 - DNA, 16 bp, H. sapiens
ataaatggagaaacaa

SEQ ID NO: 45299 - DNA, 16 bp, H. sapiens
ataaatggattttaaa

SEQ ID NO: 45300 - DNA, 16 bp, H. sapiens
ataaatggcagagcca

SEQ ID NO: 45301 - DNA, 16 bp, H. sapiens
ataaatggctgttatt

SEQ ID NO: 45302 - DNA, 16 bp, H. sapiens
ataaatggtatttatt

SEQ ID NO: 45303 - DNA, 16 bp, H. sapiens
ataaatggtgccggga

SEQ ID NO: 45304 - DNA, 16 bp, H. sapiens
ataaatggtgctgcga

SEQ ID NO: 45305 - DNA, 16 bp, H. sapiens
ataaatggtgctgggg

SEQ ID NO: 45306 - DNA, 16 bp, H. sapiens
ataaatggtgctggta

SEQ ID NO: 45307 - DNA, 16 bp, H. sapiens
ataaatgtaaaataca

SEQ ID NO: 45308 - DNA, 33 bp, H. sapiens
ataaatgtaatccagcatataaacagaaccaac

SEQ ID NO: 45309 - DNA, 16 bp, H. sapiens
ataaatgtacattaaa

SEQ ID NO: 45310 - DNA, 16 bp, H. sapiens
ataaatgtagatttat

SEQ ID NO: 45311 - DNA, 16 bp, H. sapiens
ataaatgtataaatgt

SEQ ID NO: 45312 - DNA, 16 bp, H. sapiens
ataaatgtatacaatt

SEQ ID NO: 45313 - DNA, 16 bp, H. sapiens
ataaatgtatatgtat

SEQ ID NO: 45314 - DNA, 16 bp, H. sapiens
ataaatgtatgtttat

SEQ ID NO: 45315 - DNA, 16 bp, H. sapiens
ataaatgtatttatgt

SEQ ID NO: 45316 - DNA, 16 bp, H. sapiens
ataaatgtatttgaaa

SEQ ID NO: 45317 - DNA, 16 bp, H. sapiens
ataaatgtattttgaa

SEQ ID NO: 45318 - DNA, 16 bp, H. sapiens
ataaatgtcaaataaa

SEQ ID NO: 45319 - DNA, 16 bp, H. sapiens
ataaatgtcaaatgaa

SEQ ID NO: 45320 - DNA, 16 bp, H. sapiens
ataaatgtccatgaaa

SEQ ID NO: 45321 - DNA, 16 bp, H. sapiens
ataaatgtctattatt

SEQ ID NO: 45322 - DNA, 16 bp, H. sapiens
ataaatgtcttgagaa

SEQ ID NO: 45323 - DNA, 16 bp, H. sapiens
ataaatgtggaaaata

SEQ ID NO: 45324 - DNA, 16 bp, H. sapiens
ataaatgtgtatatat

SEQ ID NO: 45325 - DNA, 16 bp, H. sapiens
ataaatgtgtgaattt

SEQ ID NO: 45326 - DNA, 16 bp, H. sapiens
ataaatgtgtgtatat

SEQ ID NO: 45327 - DNA, 16 bp, H. sapiens
ataaatgtgtttgtgt

SEQ ID NO: 45328 - DNA, 16 bp, H. sapiens
ataaatgttaattacc

SEQ ID NO: 45329 - DNA, 16 bp, H. sapiens
ataaatgttagtttcc

SEQ ID NO: 45330 - DNA, 16 bp, H. sapiens
ataaatgttcattaaa

SEQ ID NO: 45331 - DNA, 16 bp, H. sapiens
ataaatgttcatttta

SEQ ID NO: 45332 - DNA, 16 bp, H. sapiens
ataaatgttgctgctg

SEQ ID NO: 45333 - DNA, 16 bp, H. sapiens
ataaatgttgtttata

SEQ ID NO: 45334 - DNA, 16 bp, H. sapiens
ataaatgtttgaaatt

SEQ ID NO: 45335 - DNA, 16 bp, H. sapiens
ataaatgtttgctgct

SEQ ID NO: 45336 - DNA, 16 bp, H. sapiens
ataaatgtttgttgaa

SEQ ID NO: 45337 - DNA, 16 bp, H. sapiens
ataaatgttttcattt

SEQ ID NO: 45338 - DNA, 16 bp, H. sapiens
ataaattacactttat

SEQ ID NO: 45339 - DNA, 16 bp, H. sapiens
ataaattaccaatatc

SEQ ID NO: 45340 - DNA, 16 bp, H. sapiens
ataaattacccagtct

SEQ ID NO: 45341 - DNA, 16 bp, H. sapiens
ataaattacccagttt

SEQ ID NO: 45342 - DNA, 16 bp, H. sapiens
ataaattactcagttt

SEQ ID NO: 45343 - DNA, 16 bp, H. sapiens
ataaattactgttgtt

SEQ ID NO: 45344 - DNA, 16 bp, H. sapiens
ataaattacttagtct

SEQ ID NO: 45345 - DNA, 16 bp, H. sapiens
ataaattactttcctt

SEQ ID NO: 45346 - DNA, 16 bp, H. sapiens
ataaattagaaaactt

SEQ ID NO: 45347 - DNA, 16 bp, H. sapiens
ataaattagcaagaaa

SEQ ID NO: 45348 - DNA, 16 bp, H. sapiens
ataaattaggtatgga

SEQ ID NO: 45349 - DNA, 16 bp, H. sapiens
ataaattatacctcaa

SEQ ID NO: 45350 - DNA, 16 bp, H. sapiens
ataaattatggtaaat

SEQ ID NO: 45351 - DNA, 16 bp, H. sapiens
ataaattattaactgt

SEQ ID NO: 45352 - DNA, 16 bp, H. sapiens
ataaattattcagttt

SEQ ID NO: 45353 - DNA, 16 bp, H. sapiens
ataaattcaaattaga

SEQ ID NO: 45354 - DNA, 16 bp, H. sapiens
ataaattcagaaaagt

SEQ ID NO: 45355 - DNA, 16 bp, H. sapiens
ataaattccatatttt

SEQ ID NO: 45356 - DNA, 16 bp, H. sapiens
ataaattcccagaagt

SEQ ID NO: 45357 - DNA, 16 bp, H. sapiens
ataaattcctggaaat

SEQ ID NO: 45358 - DNA, 16 bp, H. sapiens
ataaattctctcattt

SEQ ID NO: 45359 - DNA, 16 bp, H. sapiens
ataaattctgatttaa

SEQ ID NO: 45360 - DNA, 16 bp, H. sapiens
ataaattgaattatac

SEQ ID NO: 45361 - DNA, 16 bp, H. sapiens
ataaattgcaagaaaa

SEQ ID NO: 45362 - DNA, 16 bp, H. sapiens
ataaattgcttttggc

SEQ ID NO: 45363 - DNA, 16 bp, H. sapiens
ataaattgctttttaa

SEQ ID NO: 45364 - DNA, 16 bp, H. sapiens
ataaattggaagaatt

SEQ ID NO: 45365 - DNA, 16 bp, H. sapiens
ataaattgtgttatat

SEQ ID NO: 45366 - DNA, 16 bp, H. sapiens
ataaattgttctacta

SEQ ID NO: 45367 - DNA, 16 bp, H. sapiens
ataaatttaaagaaac

SEQ ID NO: 45368 - DNA, 16 bp, H. sapiens
ataaatttaacaaaga

SEQ ID NO: 45369 - DNA, 16 bp, H. sapiens
ataaatttaacaactt

SEQ ID NO: 45370 - DNA, 16 bp, H. sapiens
ataaatttcctttctt

SEQ ID NO: 45371 - DNA, 16 bp, H. sapiens
ataaatttctgctttt

SEQ ID NO: 45372 - DNA, 16 bp, H. sapiens
ataaatttctgtcttt

SEQ ID NO: 45373 - DNA, 16 bp, H. sapiens
ataaatttctgttgct

SEQ ID NO: 45374 - DNA, 16 bp, H. sapiens
ataaatttgacaaatt

SEQ ID NO: 45375 - DNA, 16 bp, H. sapiens
ataaatttgacttcat

SEQ ID NO: 45376 - DNA, 16 bp, H. sapiens
ataaatttgggaagaa

SEQ ID NO: 45377 - DNA, 16 bp, H. sapiens
ataaatttggggaaaa

SEQ ID NO: 45378 - DNA, 16 bp, H. sapiens
ataaatttgtgctgtt

SEQ ID NO: 45379 - DNA, 16 bp, H. sapiens
ataaatttgtggaaat

SEQ ID NO: 45380 - DNA, 16 bp, H. sapiens
ataaattttaagaaac

SEQ ID NO: 45381 - DNA, 16 bp, H. sapiens
ataaattttagaacaa

SEQ ID NO: 45382 - DNA, 16 bp, H. sapiens
ataaattttagaatca

SEQ ID NO: 45383 - DNA, 16 bp, H. sapiens
ataaattttagcaagt

SEQ ID NO: 45384 - DNA, 16 bp, H. sapiens
ataaattttatatgca

SEQ ID NO: 45385 - DNA, 16 bp, H. sapiens
ataaattttgacaaat

SEQ ID NO: 45386 - DNA, 16 bp, H. sapiens
ataaattttgttgaat

SEQ ID NO: 45387 - DNA, 16 bp, H. sapiens
ataaatttttctgtaa

SEQ ID NO: 45388 - DNA, 16 bp, H. sapiens
ataacaaaaacagcat

SEQ ID NO: 45389 - DNA, 16 bp, H. sapiens
ataacaaaataccaga

SEQ ID NO: 45390 - DNA, 16 bp, H. sapiens
ataacaaaatacctta

SEQ ID NO: 45391 - DNA, 16 bp, H. sapiens
ataacaaaatgccaca

SEQ ID NO: 45392 - DNA, 16 bp, H. sapiens
ataacaaaatgcctta

SEQ ID NO: 45393 - DNA, 16 bp, H. sapiens
ataacaacagcaacaa

SEQ ID NO: 45394 - DNA, 16 bp, H. sapiens
ataacaacttctgaaa

SEQ ID NO: 45395 - DNA, 16 bp, H. sapiens
ataacaacttgaacat

SEQ ID NO: 45396 - DNA, 16 bp, H. sapiens
ataacaagctccaaaa

SEQ ID NO: 45397 - DNA, 16 bp, H. sapiens
ataacaaggcagcatt

SEQ ID NO: 45398 - DNA, 16 bp, H. sapiens
ataacaagtgttggaa

SEQ ID NO: 45399 - DNA, 16 bp, H. sapiens
ataacaatattaatct

SEQ ID NO: 45400 - DNA, 16 bp, H. sapiens
ataacaatgtcttctt

SEQ ID NO: 45401 - DNA, 16 bp, H. sapiens
ataacaatgtttcagt

SEQ ID NO: 45402 - DNA, 16 bp, H. sapiens
ataacaattctgaaat

SEQ ID NO: 45403 - DNA, 16 bp, H. sapiens
ataacaatttcttttc

SEQ ID NO: 45404 - DNA, 16 bp, H. sapiens
ataacacaggaacaga

SEQ ID NO: 45405 - DNA, 16 bp, H. sapiens
ataacacatttattta

SEQ ID NO: 45406 - DNA, 16 bp, H. sapiens
ataacacattttttaa

SEQ ID NO: 45407 - DNA, 16 bp, H. sapiens
ataacagaaaataatt

SEQ ID NO: 45408 - DNA, 16 bp, H. sapiens
ataacagaaaattatt

SEQ ID NO: 45409 - DNA, 16 bp, H. sapiens
ataacagaatatctga

SEQ ID NO: 45410 - DNA, 16 bp, H. sapiens
ataacagatttttttt

SEQ ID NO: 45411 - DNA, 16 bp, H. sapiens
ataacagcaattgttc

SEQ ID NO: 45412 - DNA, 16 bp, H. sapiens
ataacagcacagccag

SEQ ID NO: 45413 - DNA, 16 bp, H. sapiens
ataacagcagaataca

SEQ ID NO: 45414 - DNA, 16 bp, H. sapiens
ataacagcatggggga

SEQ ID NO: 45415 - DNA, 16 bp, H. sapiens
ataacagcattattca

SEQ ID NO: 45416 - DNA, 16 bp, H. sapiens
ataacaggtgctggag

SEQ ID NO: 45417 - DNA, 16 bp, H. sapiens
ataacaggttatttta

SEQ ID NO: 45418 - DNA, 16 bp, H. sapiens
ataacatagagaagga

SEQ ID NO: 45419 - DNA, 16 bp, H. sapiens
ataacatattttgttt

SEQ ID NO: 45420 - DNA, 16 bp, H. sapiens
ataacatcatgttgta

SEQ ID NO: 45421 - DNA, 16 bp, H. sapiens
ataacatctccaacca

SEQ ID NO: 45422 - DNA, 16 bp, H. sapiens
ataacattaaaaatgt

SEQ ID NO: 45423 - DNA, 16 bp, H. sapiens
ataacattcaaactga

SEQ ID NO: 45424 - DNA, 16 bp, H. sapiens
ataacatttacattgt

SEQ ID NO: 45425 - DNA, 16 bp, H. sapiens
ataacatttattttga

SEQ ID NO: 45426 - DNA, 16 bp, H. sapiens
ataacatttcattgta

SEQ ID NO: 45427 - DNA, 16 bp, H. sapiens
ataacatttcttcttt

SEQ ID NO: 45428 - DNA, 16 bp, H. sapiens
ataacatttgaatttt

SEQ ID NO: 45429 - DNA, 16 bp, H. sapiens
ataacattttggatat

SEQ ID NO: 45430 - DNA, 16 bp, H. sapiens
ataacattttgtttat

SEQ ID NO: 45431 - DNA, 16 bp, H. sapiens
ataaccaaggaactca

SEQ ID NO: 45432 - DNA, 16 bp, H. sapiens
ataaccactgcttcca

SEQ ID NO: 45433 - DNA, 16 bp, H. sapiens
ataaccagaatatata

SEQ ID NO: 45434 - DNA, 16 bp, H. sapiens
ataaccagtttttcca

SEQ ID NO: 45435 - DNA, 16 bp, H. sapiens
ataaccattgaagttt

SEQ ID NO: 45436 - DNA, 16 bp, H. sapiens
ataaccatttatttta

SEQ ID NO: 45437 - DNA, 16 bp, H. sapiens
ataaccattttaagaa

SEQ ID NO: 45438 - DNA, 16 bp, H. sapiens
ataacccagttaaaaa

SEQ ID NO: 45439 - DNA, 16 bp, H. sapiens
ataaccctggggaagg

SEQ ID NO: 45440 - DNA, 16 bp, H. sapiens
ataacctcagcacttt

SEQ ID NO: 45441 - DNA, 16 bp, H. sapiens
ataacctctctgtgcc

SEQ ID NO: 45442 - DNA, 16 bp, H. sapiens
ataacctctgcctccc

SEQ ID NO: 45443 - DNA, 16 bp, H. sapiens
ataacctgcacattgt

SEQ ID NO: 45444 - DNA, 16 bp, H. sapiens
ataaccttgggcaagt

SEQ ID NO: 45445 - DNA, 16 bp, H. sapiens
ataactaaaaatgttt

SEQ ID NO: 45446 - DNA, 16 bp, H. sapiens
ataactactttgatat

SEQ ID NO: 45447 - DNA, 16 bp, H. sapiens
ataactatgtgaggta

SEQ ID NO: 45448 - DNA, 16 bp, H. sapiens
ataactcaggaatgga

SEQ ID NO: 45449 - DNA, 16 bp, H. sapiens
ataactctagtatgaa

SEQ ID NO: 45450 - DNA, 16 bp, H. sapiens
ataactgaaaatgtgg

SEQ ID NO: 45451 - DNA, 16 bp, H. sapiens
ataactgaaactgggt

SEQ ID NO: 45452 - DNA, 16 bp, H. sapiens
ataactgaaattttat

SEQ ID NO: 45453 - DNA, 16 bp, H. sapiens
ataactgactccatct

SEQ ID NO: 45454 - DNA, 16 bp, H. sapiens
ataactgagaaaatta

SEQ ID NO: 45455 - DNA, 16 bp, H. sapiens
ataactgatgaaggtg

SEQ ID NO: 45456 - DNA, 16 bp, H. sapiens
ataactggaagtaaaa

SEQ ID NO: 45457 - DNA, 16 bp, H. sapiens
ataactggtagctata

SEQ ID NO: 45458 - DNA, 16 bp, H. sapiens
ataactgtgattaata

SEQ ID NO: 45459 - DNA, 16 bp, H. sapiens
ataactgttctcattt

SEQ ID NO: 45460 - DNA, 16 bp, H. sapiens
ataacttaaaactttt

SEQ ID NO: 45461 - DNA, 16 bp, H. sapiens
ataacttattttaaga

SEQ ID NO: 45462 - DNA, 16 bp, H. sapiens
ataacttgatttaaaa

SEQ ID NO: 45463 - DNA, 16 bp, H. sapiens
ataactttaaaaagaa

SEQ ID NO: 45464 - DNA, 16 bp, H. sapiens
ataactttaaatgatg

SEQ ID NO: 45465 - DNA, 16 bp, H. sapiens
ataactttgaaaaaga

SEQ ID NO: 45466 - DNA, 16 bp, H. sapiens
ataactttgttttatg

SEQ ID NO: 45467 - DNA, 16 bp, H. sapiens
ataactttttgttttc

SEQ ID NO: 45468 - DNA, 16 bp, H. sapiens
ataactttttttgaaa

SEQ ID NO: 45469 - DNA, 16 bp, H. sapiens
ataagaaaaatgtggt

SEQ ID NO: 45470 - DNA, 16 bp, H. sapiens
ataagaaaatgaacat

SEQ ID NO: 45471 - DNA, 16 bp, H. sapiens
ataagaaaattcatac

SEQ ID NO: 45472 - DNA, 16 bp, H. sapiens
ataagaaaattgaggt

SEQ ID NO: 45473 - DNA, 16 bp, H. sapiens
ataagaaatatttctt

SEQ ID NO: 45474 - DNA, 16 bp, H. sapiens
ataagaaatgaatttt

SEQ ID NO: 45475 - DNA, 16 bp, H. sapiens
ataagaaatgtgaaag

SEQ ID NO: 45476 - DNA, 16 bp, H. sapiens
ataagaacagcatggg

SEQ ID NO: 45477 - DNA, 16 bp, H. sapiens
ataagaagcaacttct

SEQ ID NO: 45478 - DNA, 16 bp, H. sapiens
ataagaagctcaaata

SEQ ID NO: 45479 - DNA, 16 bp, H. sapiens
ataagaatgtggattt

SEQ ID NO: 45480 - DNA, 16 bp, H. sapiens
ataagaattgcttgaa

SEQ ID NO: 45481 - DNA, 16 bp, H. sapiens
ataagaatttttcagc

SEQ ID NO: 45482 - DNA, 16 bp, H. sapiens
ataagacaacaatgaa

SEQ ID NO: 45483 - DNA, 16 bp, H. sapiens
ataagacacttagatt

SEQ ID NO: 45484 - DNA, 16 bp, H. sapiens
ataagacaggcacaga

SEQ ID NO: 45485 - DNA, 16 bp, H. sapiens
ataagacattaatatt

SEQ ID NO: 45486 - DNA, 16 bp, H. sapiens
ataagacattctggaa

SEQ ID NO: 45487 - DNA, 16 bp, H. sapiens
ataagactttttaaag

SEQ ID NO: 45488 - DNA, 16 bp, H. sapiens
ataagagaattttttt

SEQ ID NO: 45489 - DNA, 16 bp, H. sapiens
ataagagctaaaacca

SEQ ID NO: 45490 - DNA, 19 bp, H. sapiens
ataagagctgtctatgaca

SEQ ID NO: 45491 - DNA, 16 bp, H. sapiens
ataagaggttggggtg

SEQ ID NO: 45492 - DNA, 16 bp, H. sapiens
ataagagtagtttaca

SEQ ID NO: 45493 - DNA, 16 bp, H. sapiens
ataagataatatatgt

SEQ ID NO: 45494 - DNA, 16 bp, H. sapiens
ataagatcatgccatc

SEQ ID NO: 45495 - DNA, 16 bp, H. sapiens
ataagatgttttatat

SEQ ID NO: 45496 - DNA, 16 bp, H. sapiens
ataagatgttttatgt

SEQ ID NO: 45497 - DNA, 16 bp, H. sapiens
ataagatttgggtggg

SEQ ID NO: 45498 - DNA, 16 bp, H. sapiens
ataagcaaaatcagaa

SEQ ID NO: 45499 - DNA, 16 bp, H. sapiens
ataagcaaactgtggt

SEQ ID NO: 45500 - DNA, 16 bp, H. sapiens
ataagcaaattcagca

SEQ ID NO: 45501 - DNA, 17 bp, H. sapiens
ataagcaacttcaccaa

SEQ ID NO: 45502 - DNA, 16 bp, H. sapiens
ataagcaacttggaaa

SEQ ID NO: 45503 - DNA, 16 bp, H. sapiens
ataagcagacacttct

SEQ ID NO: 45504 - DNA, 16 bp, H. sapiens
ataagcagacagaaaa

SEQ ID NO: 45505 - DNA, 16 bp, H. sapiens
ataagcagagcacaga

SEQ ID NO: 45506 - DNA, 16 bp, H. sapiens
ataagcaggagttgaa

SEQ ID NO: 45507 - DNA, 16 bp, H. sapiens
ataagcataataataa

SEQ ID NO: 45508 - DNA, 16 bp, H. sapiens
ataagcatttaaaata

SEQ ID NO: 45509 - DNA, 16 bp, H. sapiens
ataagcatttctaatg

SEQ ID NO: 45510 - DNA, 16 bp, H. sapiens
ataagccacagcaccc

SEQ ID NO: 45511 - DNA, 16 bp, H. sapiens
ataagccagacataga

SEQ ID NO: 45512 - DNA, 16 bp, H. sapiens
ataagccaggctcaga

SEQ ID NO: 45513 - DNA, 16 bp, H. sapiens
ataagctatttgatgt

SEQ ID NO: 45514 - DNA, 16 bp, H. sapiens
ataagctgggcatggt

SEQ ID NO: 45515 - DNA, 16 bp, H. sapiens
ataagcttttttaaaa

SEQ ID NO: 45516 - DNA, 16 bp, H. sapiens
ataaggaaaaacagag

SEQ ID NO: 45517 - DNA, 16 bp, H. sapiens
ataaggaaaactaaca

SEQ ID NO: 45518 - DNA, 16 bp, H. sapiens
ataaggaaaatgcaaa

SEQ ID NO: 45519 - DNA, 16 bp, H. sapiens
ataaggaaaccaagac

SEQ ID NO: 45520 - DNA, 16 bp, H. sapiens
ataaggaaagaaaact

SEQ ID NO: 45521 - DNA, 16 bp, H. sapiens
ataaggaacttgaaca

SEQ ID NO: 45522 - DNA, 16 bp, H. sapiens
ataaggaagaggaaca

SEQ ID NO: 45523 - DNA, 16 bp, H. sapiens
ataaggaggagtttcc

SEQ ID NO: 45524 - DNA, 16 bp, H. sapiens
ataaggctcactagcc

SEQ ID NO: 45525 - DNA, 16 bp, H. sapiens
ataagggaataaaagc

SEQ ID NO: 45526 - DNA, 16 bp, H. sapiens
ataagggagaacatgc

SEQ ID NO: 45527 - DNA, 16 bp, H. sapiens
ataagggcattaattc

SEQ ID NO: 45528 - DNA, 16 bp, H. sapiens
ataaggggttggggtg

SEQ ID NO: 45529 - DNA, 16 bp, H. sapiens
ataaggtataaagaag

SEQ ID NO: 45530 - DNA, 16 bp, H. sapiens
ataaggtgtaagcaag

SEQ ID NO: 45531 - DNA, 16 bp, H. sapiens
ataagtacatttatat

SEQ ID NO: 45532 - DNA, 16 bp, H. sapiens
ataagtatatacaatt

SEQ ID NO: 45533 - DNA, 16 bp, H. sapiens
ataagtccagtgtgtt

SEQ ID NO: 45534 - DNA, 16 bp, H. sapiens
ataagtctcaggagat

SEQ ID NO: 45535 - DNA, 16 bp, H. sapiens
ataagtgaaaacatgt

SEQ ID NO: 45536 - DNA, 16 bp, H. sapiens
ataagtgaaataaatg

SEQ ID NO: 45537 - DNA, 16 bp, H. sapiens
ataagtgaatcatggg

SEQ ID NO: 45538 - DNA, 16 bp, H. sapiens
ataagtggatggatgg

SEQ ID NO: 45539 - DNA, 16 bp, H. sapiens
ataagtgtttattaaa

SEQ ID NO: 45540 - DNA, 16 bp, H. sapiens
ataagttgaaaatgca

SEQ ID NO: 45541 - DNA, 16 bp, H. sapiens
ataagttgcaaatatt

SEQ ID NO: 45542 - DNA, 16 bp, H. sapiens
ataagttgctgcattt

SEQ ID NO: 45543 - DNA, 16 bp, H. sapiens
ataataaaaactgtaa

SEQ ID NO: 45544 - DNA, 16 bp, H. sapiens
ataataaaaatgaact

SEQ ID NO: 45545 - DNA, 16 bp, H. sapiens
ataataaaaatgatca

SEQ ID NO: 45546 - DNA, 16 bp, H. sapiens
ataataaaactgtaat

SEQ ID NO: 45547 - DNA, 16 bp, H. sapiens
ataataaaacttgaaa

SEQ ID NO: 45548 - DNA, 16 bp, H. sapiens
ataataaaagcaggaa

SEQ ID NO: 45549 - DNA, 16 bp, H. sapiens
ataataaaagcttttt

SEQ ID NO: 45550 - DNA, 16 bp, H. sapiens
ataataaaatacttag

SEQ ID NO: 45551 - DNA, 16 bp, H. sapiens
ataataaaatgcattt

SEQ ID NO: 45552 - DNA, 16 bp, H. sapiens
ataataaaatgctttt

SEQ ID NO: 45553 - DNA, 16 bp, H. sapiens
ataataaactgaaaat

SEQ ID NO: 45554 - DNA, 16 bp, H. sapiens
ataataaactgtctct

SEQ ID NO: 45555 - DNA, 16 bp, H. sapiens
ataataaaggaatttt

SEQ ID NO: 45556 - DNA, 16 bp, H. sapiens
ataataaatatatgca

SEQ ID NO: 45557 - DNA, 16 bp, H. sapiens
ataataaatctctttt

SEQ ID NO: 45558 - DNA, 16 bp, H. sapiens
ataataaatgtaaaac

SEQ ID NO: 45559 - DNA, 16 bp, H. sapiens
ataataaatgtgtgtt

SEQ ID NO: 45560 - DNA, 16 bp, H. sapiens
ataataaatgtgtttt

SEQ ID NO: 45561 - DNA, 16 bp, H. sapiens
ataataaatgtttgtt

SEQ ID NO: 45562 - DNA, 16 bp, H. sapiens
ataataacaaatgttg

SEQ ID NO: 45563 - DNA, 16 bp, H. sapiens
ataataacagtaccta

SEQ ID NO: 45564 - DNA, 16 bp, H. sapiens
ataataactgctttaa

SEQ ID NO: 45565 - DNA, 16 bp, H. sapiens
ataataagcatttttt

SEQ ID NO: 45566 - DNA, 16 bp, H. sapiens
ataataataaaatcag

SEQ ID NO: 45567 - DNA, 16 bp, H. sapiens
ataataataaagacat

SEQ ID NO: 45568 - DNA, 16 bp, H. sapiens
ataataataatggcag

SEQ ID NO: 45569 - DNA, 16 bp, H. sapiens
ataataataattgctt

SEQ ID NO: 45570 - DNA, 16 bp, H. sapiens
ataataatacctacct

SEQ ID NO: 45571 - DNA, 16 bp, H. sapiens
ataataatacctatct

SEQ ID NO: 45572 - DNA, 16 bp, H. sapiens
ataataatacctccct

SEQ ID NO: 45573 - DNA, 16 bp, H. sapiens
ataataatagaaatca

SEQ ID NO: 45574 - DNA, 16 bp, H. sapiens
ataataatagcaaaca

SEQ ID NO: 45575 - DNA, 16 bp, H. sapiens
ataataatagtacata

SEQ ID NO: 45576 - DNA, 16 bp, H. sapiens
ataataatagtactta

SEQ ID NO: 45577 - DNA, 16 bp, H. sapiens
ataataatagttaaca

SEQ ID NO: 45578 - DNA, 16 bp, H. sapiens
ataataatatactgta

SEQ ID NO: 45579 - DNA, 16 bp, H. sapiens
ataataatcattctga

SEQ ID NO: 45580 - DNA, 16 bp, H. sapiens
ataataatctccaatt

SEQ ID NO: 45581 - DNA, 16 bp, H. sapiens
ataataatgacattaa

SEQ ID NO: 45582 - DNA, 16 bp, H. sapiens
ataataattacatcat

SEQ ID NO: 45583 - DNA, 16 bp, H. sapiens
ataataatttaactgt

SEQ ID NO: 45584 - DNA, 16 bp, H. sapiens
ataatacaaatgaaat

SEQ ID NO: 45585 - DNA, 16 bp, H. sapiens
ataatacagagaaatc

SEQ ID NO: 45586 - DNA, 16 bp, H. sapiens
ataatacatatatgta

SEQ ID NO: 45587 - DNA, 16 bp, H. sapiens
ataatacatttttcat

SEQ ID NO: 45588 - DNA, 16 bp, H. sapiens
ataataccaagtgttg

SEQ ID NO: 45589 - DNA, 16 bp, H. sapiens
ataatacctacctcat

SEQ ID NO: 45590 - DNA, 16 bp, H. sapiens
ataatactgctataaa

SEQ ID NO: 45591 - DNA, 16 bp, H. sapiens
ataatagaaaatgttt

SEQ ID NO: 45592 - DNA, 16 bp, H. sapiens
ataatagacttttttt

SEQ ID NO: 45593 - DNA, 16 bp, H. sapiens
ataatagcaaacattt

SEQ ID NO: 45594 - DNA, 16 bp, H. sapiens
ataatagcaataataa

SEQ ID NO: 45595 - DNA, 16 bp, H. sapiens
ataatagctataattt

SEQ ID NO: 45596 - DNA, 16 bp, H. sapiens
ataataggcactcaat

SEQ ID NO: 45597 - DNA, 16 bp, H. sapiens
ataataggccacaaaa

SEQ ID NO: 45598 - DNA, 16 bp, H. sapiens
ataataggccaggtgt

SEQ ID NO: 45599 - DNA, 16 bp, H. sapiens
ataatatacatgtgta

SEQ ID NO: 45600 - DNA, 16 bp, H. sapiens
ataatatagatacaca

SEQ ID NO: 45601 - DNA, 16 bp, H. sapiens
ataatatatagtatac

SEQ ID NO: 45602 - DNA, 16 bp, H. sapiens
ataatatatatactgt

SEQ ID NO: 45603 - DNA, 16 bp, H. sapiens
ataatatatgtaaagt

SEQ ID NO: 45604 - DNA, 16 bp, H. sapiens
ataatatcaagtgttt

SEQ ID NO: 45605 - DNA, 16 bp, H. sapiens
ataatatctttgtttt

SEQ ID NO: 45606 - DNA, 16 bp, H. sapiens
ataatatggtttggct

SEQ ID NO: 45607 - DNA, 16 bp, H. sapiens
ataatatgtcattttt

SEQ ID NO: 45608 - DNA, 16 bp, H. sapiens
ataatattacattgta

SEQ ID NO: 45609 - DNA, 16 bp, H. sapiens
ataatattatctacct

SEQ ID NO: 45610 - DNA, 16 bp, H. sapiens
ataatattcaaaatgt

SEQ ID NO: 45611 - DNA, 16 bp, H. sapiens
ataatattccatgttg

SEQ ID NO: 45612 - DNA, 16 bp, H. sapiens
ataatattcctttata

SEQ ID NO: 45613 - DNA, 16 bp, H. sapiens
ataatattctatggta

SEQ ID NO: 45614 - DNA, 16 bp, H. sapiens
ataatattctgcagag

SEQ ID NO: 45615 - DNA, 16 bp, H. sapiens
ataatattgaagatat

SEQ ID NO: 45616 - DNA, 16 bp, H. sapiens
ataatattgagtcttc

SEQ ID NO: 45617 - DNA, 16 bp, H. sapiens
ataatattgttaagat

SEQ ID NO: 45618 - DNA, 16 bp, H. sapiens
ataatatttcactgtg

SEQ ID NO: 45619 - DNA, 16 bp, H. sapiens
ataatatttcattgtg

SEQ ID NO: 45620 - DNA, 16 bp, H. sapiens
ataatatttctgaaaa

SEQ ID NO: 45621 - DNA, 16 bp, H. sapiens
ataatattttaaagga

SEQ ID NO: 45622 - DNA, 16 bp, H. sapiens
ataatattttcaaagt

SEQ ID NO: 45623 - DNA, 16 bp, H. sapiens
ataatattttcatttg

SEQ ID NO: 45624 - DNA, 16 bp, H. sapiens
ataatcaaatgaaaat

SEQ ID NO: 45625 - DNA, 16 bp, H. sapiens
ataatcaagaaagtac

SEQ ID NO: 45626 - DNA, 16 bp, H. sapiens
ataatcaatattgtga

SEQ ID NO: 45627 - DNA, 16 bp, H. sapiens
ataatcacacacacac

SEQ ID NO: 45628 - DNA, 16 bp, H. sapiens
ataatcagttttattt

SEQ ID NO: 45629 - DNA, 16 bp, H. sapiens
ataatcatcatcataa

SEQ ID NO: 45630 - DNA, 16 bp, H. sapiens
ataatcatggcggaag

SEQ ID NO: 45631 - DNA, 16 bp, H. sapiens
ataatcatggtggaag

SEQ ID NO: 45632 - DNA, 16 bp, H. sapiens
ataatcatgtattttt

SEQ ID NO: 45633 - DNA, 16 bp, H. sapiens
ataatcatgtgctttt

SEQ ID NO: 45634 - DNA, 16 bp, H. sapiens
ataatcatttggtttt

SEQ ID NO: 45635 - DNA, 26 bp, H. sapiens
ataatccagcatataaacagaaccaa

SEQ ID NO: 45636 - DNA, 16 bp, H. sapiens
ataatccagctacttg

SEQ ID NO: 45637 - DNA, 16 bp, H. sapiens
ataatccatgaaagaa

SEQ ID NO: 45638 - DNA, 16 bp, H. sapiens
ataatcccagaacttt

SEQ ID NO: 45639 - DNA, 16 bp, H. sapiens
ataatcccagcactct

SEQ ID NO: 45640 - DNA, 16 bp, H. sapiens
ataatcccagctactc

SEQ ID NO: 45641 - DNA, 18 bp, H. sapiens
ataatcccagctacttga

SEQ ID NO: 45642 - DNA, 19 bp, H. sapiens
ataatcccagtactttgga

SEQ ID NO: 45643 - DNA, 16 bp, H. sapiens
ataatcccatcacttt

SEQ ID NO: 45644 - DNA, 16 bp, H. sapiens
ataatcccattttaca

SEQ ID NO: 45645 - DNA, 16 bp, H. sapiens
ataatccccacgtgtc

SEQ ID NO: 45646 - DNA, 16 bp, H. sapiens
ataatccccatgtgtg

SEQ ID NO: 45647 - DNA, 16 bp, H. sapiens
ataatcctcctgggaa

SEQ ID NO: 45648 - DNA, 16 bp, H. sapiens
ataatccttatgccaa

SEQ ID NO: 45649 - DNA, 16 bp, H. sapiens
ataatctcaacacttt

SEQ ID NO: 45650 - DNA, 16 bp, H. sapiens
ataatctcagtgcttt

SEQ ID NO: 45651 - DNA, 16 bp, H. sapiens
ataatctccccatttc

SEQ ID NO: 45652 - DNA, 16 bp, H. sapiens
ataatctccttatttt

SEQ ID NO: 45653 - DNA, 16 bp, H. sapiens
ataatctcctttgact

SEQ ID NO: 45654 - DNA, 16 bp, H. sapiens
ataatctcctttgatt

SEQ ID NO: 45655 - DNA, 16 bp, H. sapiens
ataatctgatttaaaa

SEQ ID NO: 45656 - DNA, 16 bp, H. sapiens
ataatcttaaaaaaga

SEQ ID NO: 45657 - DNA, 16 bp, H. sapiens
ataatcttatgaaacc

SEQ ID NO: 45658 - DNA, 16 bp, H. sapiens
ataatcttttaagaaa

SEQ ID NO: 45659 - DNA, 16 bp, H. sapiens
ataatgaaaaactgaa

SEQ ID NO: 45660 - DNA, 16 bp, H. sapiens
ataatgaaaatgacaa

SEQ ID NO: 45661 - DNA, 16 bp, H. sapiens
ataatgaaaatgttct

SEQ ID NO: 45662 - DNA, 16 bp, H. sapiens
ataatgaaactaaggc

SEQ ID NO: 45663 - DNA, 16 bp, H. sapiens
ataatgaaataattct

SEQ ID NO: 45664 - DNA, 16 bp, H. sapiens
ataatgaaatagttat

SEQ ID NO: 45665 - DNA, 16 bp, H. sapiens
ataatgaaatcaattt

SEQ ID NO: 45666 - DNA, 16 bp, H. sapiens
ataatgaactacctga

SEQ ID NO: 45667 - DNA, 16 bp, H. sapiens
ataatgaagtccagaa

SEQ ID NO: 45668 - DNA, 16 bp, H. sapiens
ataatgaatatatttg

SEQ ID NO: 45669 - DNA, 16 bp, H. sapiens
ataatgacaagaagaa

SEQ ID NO: 45670 - DNA, 16 bp, H. sapiens
ataatgactttctttt

SEQ ID NO: 45671 - DNA, 16 bp, H. sapiens
ataatgagaaagttag

SEQ ID NO: 45672 - DNA, 16 bp, H. sapiens
ataatgagcagtgagg

SEQ ID NO: 45673 - DNA, 16 bp, H. sapiens
ataatgagcatttttt

SEQ ID NO: 45674 - DNA, 16 bp, H. sapiens
ataatgaggatcaact

SEQ ID NO: 45675 - DNA, 16 bp, H. sapiens
ataatgaggatgaaga

SEQ ID NO: 45676 - DNA, 16 bp, H. sapiens
ataatgagtttttaaa

SEQ ID NO: 45677 - DNA, 16 bp, H. sapiens
ataatgataaaatcag

SEQ ID NO: 45678 - DNA, 16 bp, H. sapiens
ataatgataaagaagt

SEQ ID NO: 45679 - DNA, 16 bp, H. sapiens
ataatgataaagtgtt

SEQ ID NO: 45680 - DNA, 16 bp, H. sapiens
ataatgatacctacct

SEQ ID NO: 45681 - DNA, 16 bp, H. sapiens
ataatgatcaaatcag

SEQ ID NO: 45682 - DNA, 16 bp, H. sapiens
ataatgatcagatcag

SEQ ID NO: 45683 - DNA, 16 bp, H. sapiens
ataatgatgaaaatga

SEQ ID NO: 45684 - DNA, 16 bp, H. sapiens
ataatgatgaagatga

SEQ ID NO: 45685 - DNA, 16 bp, H. sapiens
ataatgatgatgaaaa

SEQ ID NO: 45686 - DNA, 16 bp, H. sapiens
ataatgatgatgatga

SEQ ID NO: 45687 - DNA, 16 bp, H. sapiens
ataatgcaaaaataat

SEQ ID NO: 45688 - DNA, 16 bp, H. sapiens
ataatgcaacaataaa

SEQ ID NO: 45689 - DNA, 16 bp, H. sapiens
ataatgcattatatat

SEQ ID NO: 45690 - DNA, 16 bp, H. sapiens
ataatgccacagtaaa

SEQ ID NO: 45691 - DNA, 16 bp, H. sapiens
ataatgccatattttt

SEQ ID NO: 45692 - DNA, 16 bp, H. sapiens
ataatgctataatgaa

SEQ ID NO: 45693 - DNA, 16 bp, H. sapiens
ataatgctgcaattaa

SEQ ID NO: 45694 - DNA, 16 bp, H. sapiens
ataatgctgcatatct

SEQ ID NO: 45695 - DNA, 16 bp, H. sapiens
ataatgctgccatgaa

SEQ ID NO: 45696 - DNA, 16 bp, H. sapiens
ataatgctgctaggaa

SEQ ID NO: 45697 - DNA, 16 bp, H. sapiens
ataatgctgctgtgga

SEQ ID NO: 45698 - DNA, 16 bp, H. sapiens
ataatggaaataattt

SEQ ID NO: 45699 - DNA, 16 bp, H. sapiens
ataatggaatgattta

SEQ ID NO: 45700 - DNA, 16 bp, H. sapiens
ataatggagtactatt

SEQ ID NO: 45701 - DNA, 16 bp, H. sapiens
ataatggcctccagct

SEQ ID NO: 45702 - DNA, 16 bp, H. sapiens
ataatggctgaaaaca

SEQ ID NO: 45703 - DNA, 16 bp, H. sapiens
ataatggcttccagct

SEQ ID NO: 45704 - DNA, 16 bp, H. sapiens
ataatgggagaattta

SEQ ID NO: 45705 - DNA, 16 bp, H. sapiens
ataatggtgatggttg

SEQ ID NO: 45706 - DNA, 16 bp, H. sapiens
ataatggtggaaatat

SEQ ID NO: 45707 - DNA, 16 bp, H. sapiens
ataatgtacatattta

SEQ ID NO: 45708 - DNA, 16 bp, H. sapiens
ataatgtatatacatt

SEQ ID NO: 45709 - DNA, 16 bp, H. sapiens
ataatgtatattttac

SEQ ID NO: 45710 - DNA, 16 bp, H. sapiens
ataatgtattcatatt

SEQ ID NO: 45711 - DNA, 16 bp, H. sapiens
ataatgtatttaacca

SEQ ID NO: 45712 - DNA, 16 bp, H. sapiens
ataatgtatttgaaaa

SEQ ID NO: 45713 - DNA, 16 bp, H. sapiens
ataatgtcttccaggc

SEQ ID NO: 45714 - DNA, 16 bp, H. sapiens
ataatgtctttaaaaa

SEQ ID NO: 45715 - DNA, 16 bp, H. sapiens
ataatgtggtttttgt

SEQ ID NO: 45716 - DNA, 16 bp, H. sapiens
ataatgtgtacatttt

SEQ ID NO: 45717 - DNA, 16 bp, H. sapiens
ataatgtgtctttttt

SEQ ID NO: 45718 - DNA, 16 bp, H. sapiens
ataatgttagctgtga

SEQ ID NO: 45719 - DNA, 16 bp, H. sapiens
ataatgttcactattt

SEQ ID NO: 45720 - DNA, 16 bp, H. sapiens
ataatgttcatatttt

SEQ ID NO: 45721 - DNA, 16 bp, H. sapiens
ataatgttgaatgaaa

SEQ ID NO: 45722 - DNA, 16 bp, H. sapiens
ataatgttgagcaaaa

SEQ ID NO: 45723 - DNA, 16 bp, H. sapiens
ataatgtttctaaaat

SEQ ID NO: 45724 - DNA, 16 bp, H. sapiens
ataatgttttagtata

SEQ ID NO: 45725 - DNA, 16 bp, H. sapiens
ataatgttttcttaaa

SEQ ID NO: 45726 - DNA, 16 bp, H. sapiens
ataattaaaagggaag

SEQ ID NO: 45727 - DNA, 16 bp, H. sapiens
ataattaacatcttaa

SEQ ID NO: 45728 - DNA, 16 bp, H. sapiens
ataattaatttggaaa

SEQ ID NO: 45729 - DNA, 16 bp, H. sapiens
ataattacacatattt

SEQ ID NO: 45730 - DNA, 16 bp, H. sapiens
ataattaccattttaa

SEQ ID NO: 45731 - DNA, 16 bp, H. sapiens
ataattagccctagac

SEQ ID NO: 45732 - DNA, 16 bp, H. sapiens
ataattatgatgatga

SEQ ID NO: 45733 - DNA, 16 bp, H. sapiens
ataattattatttcca

SEQ ID NO: 45734 - DNA, 16 bp, H. sapiens
ataattatttcaaatg

SEQ ID NO: 45735 - DNA, 16 bp, H. sapiens
ataattattttgagat

SEQ ID NO: 45736 - DNA, 16 bp, H. sapiens
ataattatttttcaca

SEQ ID NO: 45737 - DNA, 16 bp, H. sapiens
ataattcaaatatttg

SEQ ID NO: 45738 - DNA, 16 bp, H. sapiens
ataattcactttttaa

SEQ ID NO: 45739 - DNA, 16 bp, H. sapiens
ataattcagtcatctc

SEQ ID NO: 45740 - DNA, 16 bp, H. sapiens
ataattcagttttaaa

SEQ ID NO: 45741 - DNA, 16 bp, H. sapiens
ataattcatataccat

SEQ ID NO: 45742 - DNA, 16 bp, H. sapiens
ataattcccacatgct

SEQ ID NO: 45743 - DNA, 16 bp, H. sapiens
ataattctaaaagaaa

SEQ ID NO: 45744 - DNA, 16 bp, H. sapiens
ataattctaaatgttt

SEQ ID NO: 45745 - DNA, 16 bp, H. sapiens
ataattctgaaaaaaa

SEQ ID NO: 45746 - DNA, 16 bp, H. sapiens
ataattctggagaaaa

SEQ ID NO: 45747 - DNA, 16 bp, H. sapiens
ataattcttattttgt

SEQ ID NO: 45748 - DNA, 16 bp, H. sapiens
ataattctttgttatg

SEQ ID NO: 45749 - DNA, 16 bp, H. sapiens
ataattgacaaaactt

SEQ ID NO: 45750 - DNA, 16 bp, H. sapiens
ataattgacaaataaa

SEQ ID NO: 45751 - DNA, 16 bp, H. sapiens
ataattgatatgattt

SEQ ID NO: 45752 - DNA, 16 bp, H. sapiens
ataattgcattttaaa

SEQ ID NO: 45753 - DNA, 16 bp, H. sapiens
ataattgccaaaaagt

SEQ ID NO: 45754 - DNA, 16 bp, H. sapiens
ataattgccacaaaaa

SEQ ID NO: 45755 - DNA, 16 bp, H. sapiens
ataattgccattctga

SEQ ID NO: 45756 - DNA, 16 bp, H. sapiens
ataattgctttctttg

SEQ ID NO: 45757 - DNA, 16 bp, H. sapiens
ataattggaagtaaat

SEQ ID NO: 45758 - DNA, 16 bp, H. sapiens
ataattggaattatac

SEQ ID NO: 45759 - DNA, 16 bp, H. sapiens
ataattggattgtctg

SEQ ID NO: 45760 - DNA, 16 bp, H. sapiens
ataattggtgatgttg

SEQ ID NO: 45761 - DNA, 16 bp, H. sapiens
ataattgtacatattt

SEQ ID NO: 45762 - DNA, 16 bp, H. sapiens
ataattgtacgtattt

SEQ ID NO: 45763 - DNA, 16 bp, H. sapiens
ataattgtcattattt

SEQ ID NO: 45764 - DNA, 16 bp, H. sapiens
ataattgtggatattt

SEQ ID NO: 45765 - DNA, 16 bp, H. sapiens
ataattgtgtgtgtgt

SEQ ID NO: 45766 - DNA, 16 bp, H. sapiens
ataattgttttcttca

SEQ ID NO: 45767 - DNA, 16 bp, H. sapiens
ataatttaaagagttt

SEQ ID NO: 45768 - DNA, 16 bp, H. sapiens
ataatttacatgcaat

SEQ ID NO: 45769 - DNA, 16 bp, H. sapiens
ataatttagaaacaaa

SEQ ID NO: 45770 - DNA, 16 bp, H. sapiens
ataatttattcaacaa

SEQ ID NO: 45771 - DNA, 16 bp, H. sapiens
ataatttattgcattt

SEQ ID NO: 45772 - DNA, 16 bp, H. sapiens
ataatttatttaactg

SEQ ID NO: 45773 - DNA, 16 bp, H. sapiens
ataatttcacatattt

SEQ ID NO: 45774 - DNA, 16 bp, H. sapiens
ataatttcagcaattt

SEQ ID NO: 45775 - DNA, 16 bp, H. sapiens
ataatttcagttttct

SEQ ID NO: 45776 - DNA, 16 bp, H. sapiens
ataatttccaaatatt

SEQ ID NO: 45777 - DNA, 16 bp, H. sapiens
ataatttctgagattt

SEQ ID NO: 45778 - DNA, 16 bp, H. sapiens
ataatttctgttgttt

SEQ ID NO: 45779 - DNA, 16 bp, H. sapiens
ataatttcttcattga

SEQ ID NO: 45780 - DNA, 16 bp, H. sapiens
ataatttgaaaagaag

SEQ ID NO: 45781 - DNA, 16 bp, H. sapiens
ataatttgagtcttct

SEQ ID NO: 45782 - DNA, 16 bp, H. sapiens
ataatttgattgcact

SEQ ID NO: 45783 - DNA, 16 bp, H. sapiens
ataatttgattttgga

SEQ ID NO: 45784 - DNA, 16 bp, H. sapiens
ataatttgcccaagtt

SEQ ID NO: 45785 - DNA, 16 bp, H. sapiens
ataatttgcctatttt

SEQ ID NO: 45786 - DNA, 16 bp, H. sapiens
ataatttgctcaaagt

SEQ ID NO: 45787 - DNA, 16 bp, H. sapiens
ataatttggccaaacc

SEQ ID NO: 45788 - DNA, 16 bp, H. sapiens
ataatttgttacacag

SEQ ID NO: 45789 - DNA, 16 bp, H. sapiens
ataattttaaaaagac

SEQ ID NO: 45790 - DNA, 16 bp, H. sapiens
ataattttaaaatgca

SEQ ID NO: 45791 - DNA, 16 bp, H. sapiens
ataattttaaccattt

SEQ ID NO: 45792 - DNA, 16 bp, H. sapiens
ataattttagaaatca

SEQ ID NO: 45793 - DNA, 16 bp, H. sapiens
ataattttaggtttac

SEQ ID NO: 45794 - DNA, 16 bp, H. sapiens
ataattttcaaaaatg

SEQ ID NO: 45795 - DNA, 16 bp, H. sapiens
ataattttcacaaaat

SEQ ID NO: 45796 - DNA, 16 bp, H. sapiens
ataattttcattttgt

SEQ ID NO: 45797 - DNA, 16 bp, H. sapiens
ataattttctgaaaaa

SEQ ID NO: 45798 - DNA, 16 bp, H. sapiens
ataattttgctatttt

SEQ ID NO: 45799 - DNA, 16 bp, H. sapiens
ataattttggaacata

SEQ ID NO: 45800 - DNA, 16 bp, H. sapiens
ataattttggaataca

SEQ ID NO: 45801 - DNA, 16 bp, H. sapiens
ataattttgtctcttt

SEQ ID NO: 45802 - DNA, 16 bp, H. sapiens
ataatttttaaagctg

SEQ ID NO: 45803 - DNA, 16 bp, H. sapiens
ataatttttaaagtgt

SEQ ID NO: 45804 - DNA, 16 bp, H. sapiens
ataatttttaagagaa

SEQ ID NO: 45805 - DNA, 16 bp, H. sapiens
ataatttttacatgaa

SEQ ID NO: 45806 - DNA, 16 bp, H. sapiens
ataatttttatcagtt

SEQ ID NO: 45807 - DNA, 16 bp, H. sapiens
ataatttttcaaatgt

SEQ ID NO: 45808 - DNA, 16 bp, H. sapiens
ataatttttcaactct

SEQ ID NO: 45809 - DNA, 16 bp, H. sapiens
ataatttttcattttg

SEQ ID NO: 45810 - DNA, 16 bp, H. sapiens
ataatttttgaaaaga

SEQ ID NO: 45811 - DNA, 16 bp, H. sapiens
ataatttttgcccaaa

SEQ ID NO: 45812 - DNA, 16 bp, H. sapiens
ataatttttggttgaa

SEQ ID NO: 45813 - DNA, 16 bp, H. sapiens
ataatttttgtatctt

SEQ ID NO: 45814 - DNA, 16 bp, H. sapiens
ataatttttgttaaag

SEQ ID NO: 45815 - DNA, 16 bp, H. sapiens
ataatttttttctgca

SEQ ID NO: 45816 - DNA, 16 bp, H. sapiens
atacaaaaaaaatttg

SEQ ID NO: 45817 - DNA, 16 bp, H. sapiens
atacaaaaaaagccag

SEQ ID NO: 45818 - DNA, 16 bp, H. sapiens
atacaaaaatcagcta

SEQ ID NO: 45819 - DNA, 16 bp, H. sapiens
atacaaaaattacccg

SEQ ID NO: 45820 - DNA, 21 bp, H. sapiens
atacaaaaattagccgggtgg

SEQ ID NO: 45821 - DNA, 16 bp, H. sapiens
atacaaaaattagctc

SEQ ID NO: 45822 - DNA, 16 bp, H. sapiens
atacaaaaattggtca

SEQ ID NO: 45823 - DNA, 16 bp, H. sapiens
atacaaaactcagtag

SEQ ID NO: 45824 - DNA, 16 bp, H. sapiens
atacaaaagcaatgtg

SEQ ID NO: 45825 - DNA, 16 bp, H. sapiens
atacaaaatcaatctg

SEQ ID NO: 45826 - DNA, 16 bp, H. sapiens
atacaaaatggactaa

SEQ ID NO: 45827 - DNA, 16 bp, H. sapiens
atacaaaattaaccag

SEQ ID NO: 45828 - DNA, 16 bp, H. sapiens
atacaaacattagctg

SEQ ID NO: 45829 - DNA, 23 bp, H. sapiens
atacaaactaccatcacagaata

SEQ ID NO: 45830 - DNA, 16 bp, H. sapiens
atacaaagaaacagga

SEQ ID NO: 45831 - DNA, 16 bp, H. sapiens
atacaaagaaatcata

SEQ ID NO: 45832 - DNA, 25 bp, H. sapiens
atacaaagagacttagactcccaca

SEQ ID NO: 45833 - DNA, 16 bp, H. sapiens
atacaaagatggttca

SEQ ID NO: 45834 - DNA, 16 bp, H. sapiens
atacaaagattttttt

SEQ ID NO: 45835 - DNA, 16 bp, H. sapiens
atacaaagtatatata

SEQ ID NO: 45836 - DNA, 16 bp, H. sapiens
atacaaagttttaaaa

SEQ ID NO: 45837 - DNA, 16 bp, H. sapiens
atacaaatatacacat

SEQ ID NO: 45838 - DNA, 16 bp, H. sapiens
atacaaatatatcttt

SEQ ID NO: 45839 - DNA, 16 bp, H. sapiens
atacaaatatatgcat

SEQ ID NO: 45840 - DNA, 16 bp, H. sapiens
atacaaatcaatcaat

SEQ ID NO: 45841 - DNA, 16 bp, H. sapiens
atacaaatggcaaaca

SEQ ID NO: 45842 - DNA, 16 bp, H. sapiens
atacaaatgtaaataa

SEQ ID NO: 45843 - DNA, 16 bp, H. sapiens
atacaaattaaaagca

SEQ ID NO: 45844 - DNA, 16 bp, H. sapiens
atacaaattagaaaat

SEQ ID NO: 45845 - DNA, 16 bp, H. sapiens
atacaaattttgtttt

SEQ ID NO: 45846 - DNA, 16 bp, H. sapiens
atacaacacactgatg

SEQ ID NO: 45847 - DNA, 21 bp, H. sapiens
atacaacacatgtttttgtga

SEQ ID NO: 45848 - DNA, 16 bp, H. sapiens
atacaacatgatcaag

SEQ ID NO: 45849 - DNA, 16 bp, H. sapiens
atacaactcaccatca

SEQ ID NO: 45850 - DNA, 16 bp, H. sapiens
atacaactgattttta

SEQ ID NO: 45851 - DNA, 41 bp, H. sapiens
atacaacttacaagggatgtgaaggacctcttcaaggagaa

SEQ ID NO: 45852 - DNA, 16 bp, H. sapiens
atacaagaatgttcat

SEQ ID NO: 45853 - DNA, 16 bp, H. sapiens
atacaagatgaacctg

SEQ ID NO: 45854 - DNA, 16 bp, H. sapiens
atacaagatgagcctg

SEQ ID NO: 45855 - DNA, 16 bp, H. sapiens
atacaagcaaactgaa

SEQ ID NO: 45856 - DNA, 16 bp, H. sapiens
atacaaggaactcaaa

SEQ ID NO: 45857 - DNA, 16 bp, H. sapiens
atacaagtatctgttt

SEQ ID NO: 45858 - DNA, 16 bp, H. sapiens
atacaagtgaaatcat

SEQ ID NO: 45859 - DNA, 16 bp, H. sapiens
atacaagtggtcaaca

SEQ ID NO: 45860 - DNA, 16 bp, H. sapiens
atacaataaaagccat

SEQ ID NO: 45861 - DNA, 16 bp, H. sapiens
atacaatatttgtttt

SEQ ID NO: 45862 - DNA, 16 bp, H. sapiens
atacaatcttatattt

SEQ ID NO: 45863 - DNA, 16 bp, H. sapiens
atacaatgcaaatgct

SEQ ID NO: 45864 - DNA, 16 bp, H. sapiens
atacaatggaatacca

SEQ ID NO: 45865 - DNA, 16 bp, H. sapiens
atacaatggactttag

SEQ ID NO: 45866 - DNA, 16 bp, H. sapiens
atacaatggagtatta

SEQ ID NO: 45867 - DNA, 16 bp, H. sapiens
atacaatggtgagaca

SEQ ID NO: 45868 - DNA, 16 bp, H. sapiens
atacaatgtaagtgct

SEQ ID NO: 45869 - DNA, 16 bp, H. sapiens
atacaattaaccattt

SEQ ID NO: 45870 - DNA, 16 bp, H. sapiens
atacaattcaagttga

SEQ ID NO: 45871 - DNA, 16 bp, H. sapiens
atacaattctaaaatt

SEQ ID NO: 45872 - DNA, 16 bp, H. sapiens
atacaattgaaagctt

SEQ ID NO: 45873 - DNA, 16 bp, H. sapiens
atacaattttaaaact

SEQ ID NO: 45874 - DNA, 16 bp, H. sapiens
atacaattttatttgt

SEQ ID NO: 45875 - DNA, 16 bp, H. sapiens
atacacaaaatgtggt

SEQ ID NO: 45876 - DNA, 16 bp, H. sapiens
atacacaaattagctg

SEQ ID NO: 45877 - DNA, 16 bp, H. sapiens
atacacaagagaaatg

SEQ ID NO: 45878 - DNA, 16 bp, H. sapiens
atacacaatattttat

SEQ ID NO: 45879 - DNA, 16 bp, H. sapiens
atacacaatggagtat

SEQ ID NO: 45880 - DNA, 16 bp, H. sapiens
atacacaatttatttt

SEQ ID NO: 45881 - DNA, 16 bp, H. sapiens
atacacacaaacatat

SEQ ID NO: 45882 - DNA, 16 bp, H. sapiens
atacacacacacgcac

SEQ ID NO: 45883 - DNA, 16 bp, H. sapiens
atacacacacagatgc

SEQ ID NO: 45884 - DNA, 16 bp, H. sapiens
atacacacacatatgt

SEQ ID NO: 45885 - DNA, 16 bp, H. sapiens
atacacacacatattt

SEQ ID NO: 45886 - DNA, 16 bp, H. sapiens
atacacacacattcac

SEQ ID NO: 45887 - DNA, 16 bp, H. sapiens
atacacacaccataca

SEQ ID NO: 45888 - DNA, 16 bp, H. sapiens
atacacacacgtgtgt

SEQ ID NO: 45889 - DNA, 16 bp, H. sapiens
atacacacactcatgc

SEQ ID NO: 45890 - DNA, 16 bp, H. sapiens
atacacacatatatac

SEQ ID NO: 45891 - DNA, 16 bp, H. sapiens
atacacacatatgtgt

SEQ ID NO: 45892 - DNA, 16 bp, H. sapiens
atacacacatattcat

SEQ ID NO: 45893 - DNA, 16 bp, H. sapiens
atacacacatatttta

SEQ ID NO: 45894 - DNA, 16 bp, H. sapiens
atacacacatctacac

SEQ ID NO: 45895 - DNA, 16 bp, H. sapiens
atacacacatgtgtgt

SEQ ID NO: 45896 - DNA, 16 bp, H. sapiens
atacacagaaatacac

SEQ ID NO: 45897 - DNA, 16 bp, H. sapiens
atacacagatacatag

SEQ ID NO: 45898 - DNA, 16 bp, H. sapiens
atacacataatatatg

SEQ ID NO: 45899 - DNA, 16 bp, H. sapiens
atacacatacacacac

SEQ ID NO: 45900 - DNA, 16 bp, H. sapiens
atacacatacacacca

SEQ ID NO: 45901 - DNA, 16 bp, H. sapiens
atacacatacatacac

SEQ ID NO: 45902 - DNA, 16 bp, H. sapiens
atacacatagcctgaa

SEQ ID NO: 45903 - DNA, 16 bp, H. sapiens
atacacatatatatac

SEQ ID NO: 45904 - DNA, 16 bp, H. sapiens
atacacatatatatga

SEQ ID NO: 45905 - DNA, 16 bp, H. sapiens
atacacatatgtatat

SEQ ID NO: 45906 - DNA, 16 bp, H. sapiens
atacacatatttattt

SEQ ID NO: 45907 - DNA, 16 bp, H. sapiens
atacacatgtgcacac

SEQ ID NO: 45908 - DNA, 16 bp, H. sapiens
atacacatgtgtatat

SEQ ID NO: 45909 - DNA, 16 bp, H. sapiens
atacacattctgttca

SEQ ID NO: 45910 - DNA, 16 bp, H. sapiens
atacacatttttctaa

SEQ ID NO: 45911 - DNA, 16 bp, H. sapiens
atacaccaaaaataga

SEQ ID NO: 45912 - DNA, 16 bp, H. sapiens
atacaccagcaatgaa

SEQ ID NO: 45913 - DNA, 16 bp, H. sapiens
atacacccaaaggatt

SEQ ID NO: 45914 - DNA, 16 bp, H. sapiens
atacacctgccttggc

SEQ ID NO: 45915 - DNA, 16 bp, H. sapiens
atacactatggaacac

SEQ ID NO: 45916 - DNA, 16 bp, H. sapiens
atacacttgcaatgaa

SEQ ID NO: 45917 - DNA, 16 bp, H. sapiens
atacacttgccatggt

SEQ ID NO: 45918 - DNA, 16 bp, H. sapiens
atacagaaaaatatta

SEQ ID NO: 45919 - DNA, 16 bp, H. sapiens
atacagaaaagtacac

SEQ ID NO: 45920 - DNA, 16 bp, H. sapiens
atacagaaaagttgaa

SEQ ID NO: 45921 - DNA, 16 bp, H. sapiens
atacagaaaataatca

SEQ ID NO: 45922 - DNA, 16 bp, H. sapiens
atacagaaaattttaa

SEQ ID NO: 45923 - DNA, 16 bp, H. sapiens
atacagaaatcaaatc

SEQ ID NO: 45924 - DNA, 16 bp, H. sapiens
atacagaagaaaatat

SEQ ID NO: 45925 - DNA, 16 bp, H. sapiens
atacagaagaatataa

SEQ ID NO: 45926 - DNA, 16 bp, H. sapiens
atacagaatagtttca

SEQ ID NO: 45927 - DNA, 16 bp, H. sapiens
atacagaattttaaat

SEQ ID NO: 45928 - DNA, 16 bp, H. sapiens
atacagacacacacac

SEQ ID NO: 45929 - DNA, 16 bp, H. sapiens
atacagacagaaaaat

SEQ ID NO: 45930 - DNA, 16 bp, H. sapiens
atacagaccagtggaa

SEQ ID NO: 45931 - DNA, 16 bp, H. sapiens
atacagagaaaagaga

SEQ ID NO: 45932 - DNA, 16 bp, H. sapiens
atacagagaaactgga

SEQ ID NO: 45933 - DNA, 17 bp, H. sapiens
atacagagaagtgctta

SEQ ID NO: 45934 - DNA, 16 bp, H. sapiens
atacagagataaaaat

SEQ ID NO: 45935 - DNA, 16 bp, H. sapiens
atacagagggccaact

SEQ ID NO: 45936 - DNA, 16 bp, H. sapiens
atacagagggccgact

SEQ ID NO: 45937 - DNA, 16 bp, H. sapiens
atacagagggctgact

SEQ ID NO: 45938 - DNA, 16 bp, H. sapiens
atacagagttgtgtta

SEQ ID NO: 45939 - DNA, 16 bp, H. sapiens
atacagatatatttat

SEQ ID NO: 45940 - DNA, 16 bp, H. sapiens
atacagatgaagcttc

SEQ ID NO: 45941 - DNA, 16 bp, H. sapiens
atacagatgcttctca

SEQ ID NO: 45942 - DNA, 16 bp, H. sapiens
atacagatttttttgt

SEQ ID NO: 45943 - DNA, 16 bp, H. sapiens
atacagcaaaggaaac

SEQ ID NO: 45944 - DNA, 16 bp, H. sapiens
atacagcatggtgact

SEQ ID NO: 45945 - DNA, 16 bp, H. sapiens
atacagccttttcaga

SEQ ID NO: 45946 - DNA, 16 bp, H. sapiens
atacagctatttaaaa

SEQ ID NO: 45947 - DNA, 16 bp, H. sapiens
atacagcttttttttt

SEQ ID NO: 45948 - DNA, 16 bp, H. sapiens
atacaggagaatcact

SEQ ID NO: 45949 - DNA, 16 bp, H. sapiens
atacaggaggatgtgt

SEQ ID NO: 45950 - DNA, 16 bp, H. sapiens
atacaggcatacctcg

SEQ ID NO: 45951 - DNA, 16 bp, H. sapiens
atacagggagaagaca

SEQ ID NO: 45952 - DNA, 16 bp, H. sapiens
atacaggtcataaaga

SEQ ID NO: 45953 - DNA, 16 bp, H. sapiens
atacaggtgtatcatt

SEQ ID NO: 45954 - DNA, 16 bp, H. sapiens
atacagtaaagttgca

SEQ ID NO: 45955 - DNA, 16 bp, H. sapiens
atacagtaaatttgta

SEQ ID NO: 45956 - DNA, 17 bp, H. sapiens
atacagtaaccaaaaca

SEQ ID NO: 45957 - DNA, 16 bp, H. sapiens
atacagtataatatat

SEQ ID NO: 45958 - DNA, 16 bp, H. sapiens
atacagtcaagataca

SEQ ID NO: 45959 - DNA, 16 bp, H. sapiens
atacagtcacattgag

SEQ ID NO: 45960 - DNA, 16 bp, H. sapiens
atacagtcacattggg

SEQ ID NO: 45961 - DNA, 16 bp, H. sapiens
atacagtcagccctct

SEQ ID NO: 45962 - DNA, 16 bp, H. sapiens
atacagtcatcccttg

SEQ ID NO: 45963 - DNA, 16 bp, H. sapiens
atacagtgagaaggtg

SEQ ID NO: 45964 - DNA, 16 bp, H. sapiens
atacagtggcacaatc

SEQ ID NO: 45965 - DNA, 16 bp, H. sapiens
atacagtgggtgtaca

SEQ ID NO: 45966 - DNA, 16 bp, H. sapiens
atacagtggtgagcaa

SEQ ID NO: 45967 - DNA, 16 bp, H. sapiens
atacagtgtttgtcct

SEQ ID NO: 45968 - DNA, 16 bp, H. sapiens
atacagttagatagaa

SEQ ID NO: 45969 - DNA, 16 bp, H. sapiens
atacagttatatataa

SEQ ID NO: 45970 - DNA, 16 bp, H. sapiens
atacagttcagtggca

SEQ ID NO: 45971 - DNA, 16 bp, H. sapiens
atacagtttttatttt

SEQ ID NO: 45972 - DNA, 16 bp, H. sapiens
atacataaatatgtat

SEQ ID NO: 45973 - DNA, 16 bp, H. sapiens
atacataaatgaataa

SEQ ID NO: 45974 - DNA, 16 bp, H. sapiens
atacataatacacaca

SEQ ID NO: 45975 - DNA, 16 bp, H. sapiens
atacataatacatgta

SEQ ID NO: 45976 - DNA, 16 bp, H. sapiens
atacataatatatact

SEQ ID NO: 45977 - DNA, 16 bp, H. sapiens
atacatacaaaagaat

SEQ ID NO: 45978 - DNA, 16 bp, H. sapiens
atacatacacatatat

SEQ ID NO: 45979 - DNA, 16 bp, H. sapiens
atacatacacatatgt

SEQ ID NO: 45980 - DNA, 16 bp, H. sapiens
atacatacatacatac

SEQ ID NO: 45981 - DNA, 16 bp, H. sapiens
atacatacatacatag

SEQ ID NO: 45982 - DNA, 16 bp, H. sapiens
atacatacatacatca

SEQ ID NO: 45983 - DNA, 16 bp, H. sapiens
atacatacatagtata

SEQ ID NO: 45984 - DNA, 16 bp, H. sapiens
atacatacatatatac

SEQ ID NO: 45985 - DNA, 16 bp, H. sapiens
atacatacatatgtat

SEQ ID NO: 45986 - DNA, 16 bp, H. sapiens
atacatacatattcat

SEQ ID NO: 45987 - DNA, 16 bp, H. sapiens
atacatactatatata

SEQ ID NO: 45988 - DNA, 16 bp, H. sapiens
atacatagaaataaat

SEQ ID NO: 45989 - DNA, 16 bp, H. sapiens
atacatagaatgtata

SEQ ID NO: 45990 - DNA, 16 bp, H. sapiens
atacataggtgtatat

SEQ ID NO: 45991 - DNA, 16 bp, H. sapiens
atacatataatggaat

SEQ ID NO: 45992 - DNA, 16 bp, H. sapiens
atacatatacacatat

SEQ ID NO: 45993 - DNA, 16 bp, H. sapiens
atacatatacatgcat

SEQ ID NO: 45994 - DNA, 16 bp, H. sapiens
atacatatagatagat

SEQ ID NO: 45995 - DNA, 16 bp, H. sapiens
atacatatataaaaga

SEQ ID NO: 45996 - DNA, 18 bp, H. sapiens
atacatatatacacatat

SEQ ID NO: 45997 - DNA, 16 bp, H. sapiens
atacatatatacatgt

SEQ ID NO: 45998 - DNA, 16 bp, H. sapiens
atacatatatactatg

SEQ ID NO: 45999 - DNA, 18 bp, H. sapiens
atacatatatatacacac

SEQ ID NO: 46000 - DNA, 16 bp, H. sapiens
atacatatatctgtat

SEQ ID NO: 46001 - DNA, 16 bp, H. sapiens
atacatatatgataca

SEQ ID NO: 46002 - DNA, 16 bp, H. sapiens
atacatatatggattt

SEQ ID NO: 46003 - DNA, 16 bp, H. sapiens
atacatatattcattt

SEQ ID NO: 46004 - DNA, 16 bp, H. sapiens
atacatatcacatata

SEQ ID NO: 46005 - DNA, 16 bp, H. sapiens
atacatatctatatat

SEQ ID NO: 46006 - DNA, 16 bp, H. sapiens
atacatatgaaagaaa

SEQ ID NO: 46007 - DNA, 16 bp, H. sapiens
atacatatgagaatat

SEQ ID NO: 46008 - DNA, 16 bp, H. sapiens
atacatatgcacatat

SEQ ID NO: 46009 - DNA, 16 bp, H. sapiens
atacatatgtacataa

SEQ ID NO: 46010 - DNA, 16 bp, H. sapiens
atacatatgtacatat

SEQ ID NO: 46011 - DNA, 16 bp, H. sapiens
atacatatgtatacat

SEQ ID NO: 46012 - DNA, 16 bp, H. sapiens
atacatatgtgaatat

SEQ ID NO: 46013 - DNA, 16 bp, H. sapiens
atacatatgtgtgtat

SEQ ID NO: 46014 - DNA, 16 bp, H. sapiens
atacatatgttaatta

SEQ ID NO: 46015 - DNA, 16 bp, H. sapiens
atacatattcaacagg

SEQ ID NO: 46016 - DNA, 16 bp, H. sapiens
atacatattgttaaat

SEQ ID NO: 46017 - DNA, 16 bp, H. sapiens
atacatatttacataa

SEQ ID NO: 46018 - DNA, 16 bp, H. sapiens
atacatatttatatag

SEQ ID NO: 46019 - DNA, 16 bp, H. sapiens
atacatatttgtatat

SEQ ID NO: 46020 - DNA, 16 bp, H. sapiens
atacatattttgtaaa

SEQ ID NO: 46021 - DNA, 16 bp, H. sapiens
atacatccattccaaa

SEQ ID NO: 46022 - DNA, 17 bp, H. sapiens
atacatcctcctcagct

SEQ ID NO: 46023 - DNA, 16 bp, H. sapiens
atacatctacaaccat

SEQ ID NO: 46024 - DNA, 16 bp, H. sapiens
atacatctatatataa

SEQ ID NO: 46025 - DNA, 16 bp, H. sapiens
atacatcttattgaat

SEQ ID NO: 46026 - DNA, 16 bp, H. sapiens
atacatgaaagaaaat

SEQ ID NO: 46027 - DNA, 16 bp, H. sapiens
atacatgaatgttcat

SEQ ID NO: 46028 - DNA, 16 bp, H. sapiens
atacatgcacatgcac

SEQ ID NO: 46029 - DNA, 16 bp, H. sapiens
atacatgcatataatg

SEQ ID NO: 46030 - DNA, 16 bp, H. sapiens
atacatgctacaacat

SEQ ID NO: 46031 - DNA, 16 bp, H. sapiens
atacatggaaagtaaa

SEQ ID NO: 46032 - DNA, 16 bp, H. sapiens
atacatggaagctaaa

SEQ ID NO: 46033 - DNA, 16 bp, H. sapiens
atacatggcttgcaaa

SEQ ID NO: 46034 - DNA, 16 bp, H. sapiens
atacatgtaaaacata

SEQ ID NO: 46035 - DNA, 16 bp, H. sapiens
atacatgtaagatgta

SEQ ID NO: 46036 - DNA, 16 bp, H. sapiens
atacatgtaatatgta

SEQ ID NO: 46037 - DNA, 16 bp, H. sapiens
atacatgtataatttt

SEQ ID NO: 46038 - DNA, 16 bp, H. sapiens
atacatgtatatatgt

SEQ ID NO: 46039 - DNA, 16 bp, H. sapiens
atacatgtatattttt

SEQ ID NO: 46040 - DNA, 16 bp, H. sapiens
atacatgtatgtatat

SEQ ID NO: 46041 - DNA, 16 bp, H. sapiens
atacatgtctagatgt

SEQ ID NO: 46042 - DNA, 16 bp, H. sapiens
atacatgtgataattt

SEQ ID NO: 46043 - DNA, 16 bp, H. sapiens
atacatgtgatatata

SEQ ID NO: 46044 - DNA, 16 bp, H. sapiens
atacatgtgcaagtgt

SEQ ID NO: 46045 - DNA, 16 bp, H. sapiens
atacatgtgcaatgct

SEQ ID NO: 46046 - DNA, 16 bp, H. sapiens
atacatgtgcatattt

SEQ ID NO: 46047 - DNA, 16 bp, H. sapiens
atacatgtggctaaca

SEQ ID NO: 46048 - DNA, 16 bp, H. sapiens
atacatgtgtttatat

SEQ ID NO: 46049 - DNA, 16 bp, H. sapiens
atacatgttttatata

SEQ ID NO: 46050 - DNA, 16 bp, H. sapiens
atacattaaaaatgta

SEQ ID NO: 46051 - DNA, 16 bp, H. sapiens
atacattaaattgtat

SEQ ID NO: 46052 - DNA, 16 bp, H. sapiens
atacattatctcactt

SEQ ID NO: 46053 - DNA, 16 bp, H. sapiens
atacattattttattg

SEQ ID NO: 46054 - DNA, 16 bp, H. sapiens
atacattcacatggtt

SEQ ID NO: 46055 - DNA, 16 bp, H. sapiens
atacattccaagaccc

SEQ ID NO: 46056 - DNA, 16 bp, H. sapiens
atacattctaaaatat

SEQ ID NO: 46057 - DNA, 18 bp, H. sapiens
atacattctcccaagact

SEQ ID NO: 46058 - DNA, 16 bp, H. sapiens
atacattcttttcagc

SEQ ID NO: 46059 - DNA, 16 bp, H. sapiens
atacattgtacccatt

SEQ ID NO: 46060 - DNA, 16 bp, H. sapiens
atacattgtgaaatat

SEQ ID NO: 46061 - DNA, 16 bp, H. sapiens
atacattgttgaattc

SEQ ID NO: 46062 - DNA, 16 bp, H. sapiens
atacatttaaaattgt

SEQ ID NO: 46063 - DNA, 16 bp, H. sapiens
atacatttaaagtgct

SEQ ID NO: 46064 - DNA, 16 bp, H. sapiens
atacatttacatttat

SEQ ID NO: 46065 - DNA, 16 bp, H. sapiens
atacatttagaatata

SEQ ID NO: 46066 - DNA, 16 bp, H. sapiens
atacatttataatgtt

SEQ ID NO: 46067 - DNA, 16 bp, H. sapiens
atacatttcaatccct

SEQ ID NO: 46068 - DNA, 16 bp, H. sapiens
atacatttcataaggc

SEQ ID NO: 46069 - DNA, 16 bp, H. sapiens
atacatttccctctta

SEQ ID NO: 46070 - DNA, 16 bp, H. sapiens
atacatttctgttcat

SEQ ID NO: 46071 - DNA, 16 bp, H. sapiens
atacatttgaaaactt

SEQ ID NO: 46072 - DNA, 16 bp, H. sapiens
atacatttgaaaatat

SEQ ID NO: 46073 - DNA, 16 bp, H. sapiens
atacatttgatttttt

SEQ ID NO: 46074 - DNA, 16 bp, H. sapiens
atacattttaaaggta

SEQ ID NO: 46075 - DNA, 16 bp, H. sapiens
atacattttaagacaa

SEQ ID NO: 46076 - DNA, 16 bp, H. sapiens
atacattttagaaaca

SEQ ID NO: 46077 - DNA, 16 bp, H. sapiens
atacattttagttatt

SEQ ID NO: 46078 - DNA, 16 bp, H. sapiens
atacattttcagaaat

SEQ ID NO: 46079 - DNA, 16 bp, H. sapiens
atacattttctgaaaa

SEQ ID NO: 46080 - DNA, 16 bp, H. sapiens
atacattttcttaaaa

SEQ ID NO: 46081 - DNA, 16 bp, H. sapiens
atacattttgaaatta

SEQ ID NO: 46082 - DNA, 16 bp, H. sapiens
atacattttgatattt

SEQ ID NO: 46083 - DNA, 16 bp, H. sapiens
atacattttgtttgtt

SEQ ID NO: 46084 - DNA, 16 bp, H. sapiens
atacatttttaaaaag

SEQ ID NO: 46085 - DNA, 16 bp, H. sapiens
atacatttttattgta

SEQ ID NO: 46086 - DNA, 16 bp, H. sapiens
atacatttttatttgt

SEQ ID NO: 46087 - DNA, 16 bp, H. sapiens
atacatttttgtaaat

SEQ ID NO: 46088 - DNA, 16 bp, H. sapiens
atacattttttaaatg

SEQ ID NO: 46089 - DNA, 16 bp, H. sapiens
atacatttttttcaaa

SEQ ID NO: 46090 - DNA, 16 bp, H. sapiens
atacatttttttccca

SEQ ID NO: 46091 - DNA, 16 bp, H. sapiens
atacatttttttctgt

SEQ ID NO: 46092 - DNA, 16 bp, H. sapiens
ataccaaaaccaggaa

SEQ ID NO: 46093 - DNA, 16 bp, H. sapiens
ataccaaaacctgaca

SEQ ID NO: 46094 - DNA, 16 bp, H. sapiens
ataccaaaatcagaaa

SEQ ID NO: 46095 - DNA, 16 bp, H. sapiens
ataccaaaatcagcca

SEQ ID NO: 46096 - DNA, 16 bp, H. sapiens
ataccaaagccaggca

SEQ ID NO: 46097 - DNA, 16 bp, H. sapiens
ataccaaaggatgact

SEQ ID NO: 46098 - DNA, 16 bp, H. sapiens
ataccaagggacaact

SEQ ID NO: 46099 - DNA, 16 bp, H. sapiens
ataccacagtcaaacc

SEQ ID NO: 46100 - DNA, 16 bp, H. sapiens
ataccacagtttgttc

SEQ ID NO: 46101 - DNA, 16 bp, H. sapiens
ataccacattttcttc

SEQ ID NO: 46102 - DNA, 16 bp, H. sapiens
ataccaccatgcctgg

SEQ ID NO: 46103 - DNA, 16 bp, H. sapiens
ataccactgaattgta

SEQ ID NO: 46104 - DNA, 16 bp, H. sapiens
ataccactgcactctg

SEQ ID NO: 46105 - DNA, 16 bp, H. sapiens
ataccactgccctcca

SEQ ID NO: 46106 - DNA, 16 bp, H. sapiens
ataccagaggctgggc

SEQ ID NO: 46107 - DNA, 16 bp, H. sapiens
ataccagcacctgctt

SEQ ID NO: 46108 - DNA, 16 bp, H. sapiens
ataccagcctggccaa

SEQ ID NO: 46109 - DNA, 16 bp, H. sapiens
ataccaggaaagccaa

SEQ ID NO: 46110 - DNA, 16 bp, H. sapiens
ataccatcactttggg

SEQ ID NO: 46111 - DNA, 16 bp, H. sapiens
ataccatcctggccaa

SEQ ID NO: 46112 - DNA, 16 bp, H. sapiens
ataccatgttttgttt

SEQ ID NO: 46113 - DNA, 16 bp, H. sapiens
ataccattatcatacc

SEQ ID NO: 46114 - DNA, 16 bp, H. sapiens
ataccatttacaattg

SEQ ID NO: 46115 - DNA, 16 bp, H. sapiens
ataccatttattaaat

SEQ ID NO: 46116 - DNA, 16 bp, H. sapiens
ataccattttgtattc

SEQ ID NO: 46117 - DNA, 16 bp, H. sapiens
ataccatttttacttg

SEQ ID NO: 46118 - DNA, 16 bp, H. sapiens
atacccaaaagaaatg

SEQ ID NO: 46119 - DNA, 19 bp, H. sapiens
atacccaaaggattacaaa

SEQ ID NO: 46120 - DNA, 16 bp, H. sapiens
atacccagaagtgaaa

SEQ ID NO: 46121 - DNA, 16 bp, H. sapiens
atacccagccaatttt

SEQ ID NO: 46122 - DNA, 16 bp, H. sapiens
atacccagctaatttt

SEQ ID NO: 46123 - DNA, 16 bp, H. sapiens
atacccagttaatttt

SEQ ID NO: 46124 - DNA, 16 bp, H. sapiens
atacccattaaacaac

SEQ ID NO: 46125 - DNA, 16 bp, H. sapiens
ataccccaaagtatgg

SEQ ID NO: 46126 - DNA, 16 bp, H. sapiens
ataccctctctcacca

SEQ ID NO: 46127 - DNA, 16 bp, H. sapiens
ataccctgtatttctt

SEQ ID NO: 46128 - DNA, 16 bp, H. sapiens
atacccttcaaacatg

SEQ ID NO: 46129 - DNA, 16 bp, H. sapiens
atacccttttcaacaa

SEQ ID NO: 46130 - DNA, 16 bp, H. sapiens
atacctaaagtaaatg

SEQ ID NO: 46131 - DNA, 16 bp, H. sapiens
atacctaaccaaggac

SEQ ID NO: 46132 - DNA, 16 bp, H. sapiens
atacctaatggtgaaa

SEQ ID NO: 46133 - DNA, 16 bp, H. sapiens
atacctactgtgtgcc

SEQ ID NO: 46134 - DNA, 16 bp, H. sapiens
atacctaggaatgcag

SEQ ID NO: 46135 - DNA, 16 bp, H. sapiens
atacctaggctatatg

SEQ ID NO: 46136 - DNA, 16 bp, H. sapiens
atacctatatatgtat

SEQ ID NO: 46137 - DNA, 16 bp, H. sapiens
atacctatgtaccaaa

SEQ ID NO: 46138 - DNA, 16 bp, H. sapiens
atacctcaataaaatt

SEQ ID NO: 46139 - DNA, 16 bp, H. sapiens
atacctcaataaagat

SEQ ID NO: 46140 - DNA, 16 bp, H. sapiens
atacctcattttattt

SEQ ID NO: 46141 - DNA, 16 bp, H. sapiens
atacctccaaactcat

SEQ ID NO: 46142 - DNA, 16 bp, H. sapiens
atacctcctgaaagac

SEQ ID NO: 46143 - DNA, 16 bp, H. sapiens
atacctgactaatttt

SEQ ID NO: 46144 - DNA, 16 bp, H. sapiens
atacctgatgatctgt

SEQ ID NO: 46145 - DNA, 17 bp, H. sapiens
atacctgcactttggga

SEQ ID NO: 46146 - DNA, 16 bp, H. sapiens
atacctggctaatttt

SEQ ID NO: 46147 - DNA, 16 bp, H. sapiens
atacctgtaatcccaa

SEQ ID NO: 46148 - DNA, 16 bp, H. sapiens
ataccttaatttaaaa

SEQ ID NO: 46149 - DNA, 17 bp, H. sapiens
ataccttcttctcagca

SEQ ID NO: 46150 - DNA, 16 bp, H. sapiens
ataccttgaatatatt

SEQ ID NO: 46151 - DNA, 16 bp, H. sapiens
atacctttattttgag

SEQ ID NO: 46152 - DNA, 16 bp, H. sapiens
atacgcacccaataca

SEQ ID NO: 46153 - DNA, 16 bp, H. sapiens
atacgtatatattttt

SEQ ID NO: 46154 - DNA, 16 bp, H. sapiens
atacgtcttctgaaat

SEQ ID NO: 46155 - DNA, 16 bp, H. sapiens
atacgtgtatatatgt

SEQ ID NO: 46156 - DNA, 17 bp, H. sapiens
atacgtgtgcatgtgtc

SEQ ID NO: 46157 - DNA, 16 bp, H. sapiens
atacgtgtgtatatat

SEQ ID NO: 46158 - DNA, 17 bp, H. sapiens
atactaaatgggcaaaa

SEQ ID NO: 46159 - DNA, 16 bp, H. sapiens
atactaattttctttc

SEQ ID NO: 46160 - DNA, 16 bp, H. sapiens
atactacaaaaacagt

SEQ ID NO: 46161 - DNA, 16 bp, H. sapiens
atactacaacatgaat

SEQ ID NO: 46162 - DNA, 16 bp, H. sapiens
atactacacaagaaga

SEQ ID NO: 46163 - DNA, 16 bp, H. sapiens
atactacattttaaaa

SEQ ID NO: 46164 - DNA, 16 bp, H. sapiens
atactacccaaagcaa

SEQ ID NO: 46165 - DNA, 16 bp, H. sapiens
atactactcagtcata

SEQ ID NO: 46166 - DNA, 16 bp, H. sapiens
atactactttttaaaa

SEQ ID NO: 46167 - DNA, 16 bp, H. sapiens
atactagaagaaaacc

SEQ ID NO: 46168 - DNA, 16 bp, H. sapiens
atactagaagaaaatc

SEQ ID NO: 46169 - DNA, 16 bp, H. sapiens
atactaggaagaaact

SEQ ID NO: 46170 - DNA, 16 bp, H. sapiens
atactaggtgctcaat

SEQ ID NO: 46171 - DNA, 16 bp, H. sapiens
atactatatatatttg

SEQ ID NO: 46172 - DNA, 16 bp, H. sapiens
atactatatatgatat

SEQ ID NO: 46173 - DNA, 16 bp, H. sapiens
atactatgaacaattt

SEQ ID NO: 46174 - DNA, 16 bp, H. sapiens
atactattttccaaaa

SEQ ID NO: 46175 - DNA, 16 bp, H. sapiens
atactcaaaagaaaat

SEQ ID NO: 46176 - DNA, 16 bp, H. sapiens
atactcaataaatatt

SEQ ID NO: 46177 - DNA, 16 bp, H. sapiens
atactcaggaggctga

SEQ ID NO: 46178 - DNA, 23 bp, H. sapiens
atactcagtacctgttttaagaa

SEQ ID NO: 46179 - DNA, 16 bp, H. sapiens
atactccagcctggga

SEQ ID NO: 46180 - DNA, 16 bp, H. sapiens
atactccagcctggtg

SEQ ID NO: 46181 - DNA, 16 bp, H. sapiens
atactcccaccagcag

SEQ ID NO: 46182 - DNA, 16 bp, H. sapiens
atactctaagattgac

SEQ ID NO: 46183 - DNA, 16 bp, H. sapiens
atactctagcctgggc

SEQ ID NO: 46184 - DNA, 16 bp, H. sapiens
atactcttcaagaaga

SEQ ID NO: 46185 - DNA, 16 bp, H. sapiens
atactgaaagtgaaaa

SEQ ID NO: 46186 - DNA, 16 bp, H. sapiens
atactgaaatactgaa

SEQ ID NO: 46187 - DNA, 16 bp, H. sapiens
atactgaaattatttt

SEQ ID NO: 46188 - DNA, 16 bp, H. sapiens
atactgaaattgttta

SEQ ID NO: 46189 - DNA, 16 bp, H. sapiens
atactgaacatctttt

SEQ ID NO: 46190 - DNA, 16 bp, H. sapiens
atactgaaggggaaaa

SEQ ID NO: 46191 - DNA, 16 bp, H. sapiens
atactgaataggcaaa

SEQ ID NO: 46192 - DNA, 16 bp, H. sapiens
atactgaatgagcaaa

SEQ ID NO: 46193 - DNA, 16 bp, H. sapiens
atactgaatgcagaaa

SEQ ID NO: 46194 - DNA, 16 bp, H. sapiens
atactgaatgggaaaa

SEQ ID NO: 46195 - DNA, 16 bp, H. sapiens
atactgaatggggaaa

SEQ ID NO: 46196 - DNA, 16 bp, H. sapiens
atactgaatttttttt

SEQ ID NO: 46197 - DNA, 16 bp, H. sapiens
atactgactgggcaaa

SEQ ID NO: 46198 - DNA, 16 bp, H. sapiens
atactgactggtgtga

SEQ ID NO: 46199 - DNA, 16 bp, H. sapiens
atactgagattttttt

SEQ ID NO: 46200 - DNA, 16 bp, H. sapiens
atactgagtgggcaaa

SEQ ID NO: 46201 - DNA, 16 bp, H. sapiens
atactgataaaaataa

SEQ ID NO: 46202 - DNA, 16 bp, H. sapiens
atactgatattttaaa

SEQ ID NO: 46203 - DNA, 16 bp, H. sapiens
atactgatgggtcttg

SEQ ID NO: 46204 - DNA, 16 bp, H. sapiens
atactgatttaatttc

SEQ ID NO: 46205 - DNA, 16 bp, H. sapiens
atactgcatattctca

SEQ ID NO: 46206 - DNA, 16 bp, H. sapiens
atactgcatgatatca

SEQ ID NO: 46207 - DNA, 16 bp, H. sapiens
atactgcattttctca

SEQ ID NO: 46208 - DNA, 16 bp, H. sapiens
atactgcccaaagcaa

SEQ ID NO: 46209 - DNA, 16 bp, H. sapiens
atactgcccaaagcat

SEQ ID NO: 46210 - DNA, 16 bp, H. sapiens
atactgcccagacccc

SEQ ID NO: 46211 - DNA, 16 bp, H. sapiens
atactgctctgttact

SEQ ID NO: 46212 - DNA, 16 bp, H. sapiens
atactggaaaactgaa

SEQ ID NO: 46213 - DNA, 16 bp, H. sapiens
atactggaaataaaat

SEQ ID NO: 46214 - DNA, 16 bp, H. sapiens
atactggcaccatgct

SEQ ID NO: 46215 - DNA, 16 bp, H. sapiens
atactggccaggtgca

SEQ ID NO: 46216 - DNA, 16 bp, H. sapiens
atactgtaataaaagt

SEQ ID NO: 46217 - DNA, 16 bp, H. sapiens
atactgtaataattta

SEQ ID NO: 46218 - DNA, 16 bp, H. sapiens
atactgtaatggtgga

SEQ ID NO: 46219 - DNA, 16 bp, H. sapiens
atactgtacataaaat

SEQ ID NO: 46220 - DNA, 16 bp, H. sapiens
atactgtatgttctta

SEQ ID NO: 46221 - DNA, 16 bp, H. sapiens
atactgtatttataaa

SEQ ID NO: 46222 - DNA, 16 bp, H. sapiens
atactgtatttgtttt

SEQ ID NO: 46223 - DNA, 16 bp, H. sapiens
atactgtattttgttt

SEQ ID NO: 46224 - DNA, 16 bp, H. sapiens
atactgtatttttaaa

SEQ ID NO: 46225 - DNA, 16 bp, H. sapiens
atactgtattttttat

SEQ ID NO: 46226 - DNA, 16 bp, H. sapiens
atactgtcatttgcag

SEQ ID NO: 46227 - DNA, 16 bp, H. sapiens
atactgtgaacatttt

SEQ ID NO: 46228 - DNA, 16 bp, H. sapiens
atactgtgtttttaaa

SEQ ID NO: 46229 - DNA, 16 bp, H. sapiens
atactgttttccacag

SEQ ID NO: 46230 - DNA, 16 bp, H. sapiens
atactgttttctaaaa

SEQ ID NO: 46231 - DNA, 16 bp, H. sapiens
atactgttttctatag

SEQ ID NO: 46232 - DNA, 16 bp, H. sapiens
atactgttttttaaaa

SEQ ID NO: 46233 - DNA, 16 bp, H. sapiens
atacttaaaaatgaaa

SEQ ID NO: 46234 - DNA, 16 bp, H. sapiens
atacttaaatacattt

SEQ ID NO: 46235 - DNA, 16 bp, H. sapiens
atacttaacagtgaaa

SEQ ID NO: 46236 - DNA, 16 bp, H. sapiens
atacttaacatttatt

SEQ ID NO: 46237 - DNA, 16 bp, H. sapiens
atacttaccaagcaaa

SEQ ID NO: 46238 - DNA, 16 bp, H. sapiens
atacttaggagtggaa

SEQ ID NO: 46239 - DNA, 16 bp, H. sapiens
atacttatatatacac

SEQ ID NO: 46240 - DNA, 16 bp, H. sapiens
atacttattcacattt

SEQ ID NO: 46241 - DNA, 16 bp, H. sapiens
atacttattttctgtt

SEQ ID NO: 46242 - DNA, 16 bp, H. sapiens
atacttcaaaatattt

SEQ ID NO: 46243 - DNA, 16 bp, H. sapiens
atacttcaaattttga

SEQ ID NO: 46244 - DNA, 16 bp, H. sapiens
atacttcaatgtaata

SEQ ID NO: 46245 - DNA, 16 bp, H. sapiens
atacttcatataagtg

SEQ ID NO: 46246 - DNA, 16 bp, H. sapiens
atacttcccaaagcaa

SEQ ID NO: 46247 - DNA, 16 bp, H. sapiens
atacttcccaattcat

SEQ ID NO: 46248 - DNA, 16 bp, H. sapiens
atacttctaaataact

SEQ ID NO: 46249 - DNA, 16 bp, H. sapiens
atacttcttgagaaga

SEQ ID NO: 46250 - DNA, 16 bp, H. sapiens
atacttgcacatgcac

SEQ ID NO: 46251 - DNA, 16 bp, H. sapiens
atacttgtgtatgctt

SEQ ID NO: 46252 - DNA, 16 bp, H. sapiens
atacttgttgaattaa

SEQ ID NO: 46253 - DNA, 16 bp, H. sapiens
atacttgttttttaaa

SEQ ID NO: 46254 - DNA, 16 bp, H. sapiens
atactttaagattttt

SEQ ID NO: 46255 - DNA, 16 bp, H. sapiens
atactttaatttctag

SEQ ID NO: 46256 - DNA, 16 bp, H. sapiens
atactttattgctgaa

SEQ ID NO: 46257 - DNA, 16 bp, H. sapiens
atactttcaatataaa

SEQ ID NO: 46258 - DNA, 16 bp, H. sapiens
atactttgatttcctt

SEQ ID NO: 46259 - DNA, 16 bp, H. sapiens
atactttgcatctttc

SEQ ID NO: 46260 - DNA, 16 bp, H. sapiens
atactttgggcagtat

SEQ ID NO: 46261 - DNA, 16 bp, H. sapiens
atactttgtaaaattt

SEQ ID NO: 46262 - DNA, 16 bp, H. sapiens
atactttgtaaatatt

SEQ ID NO: 46263 - DNA, 16 bp, H. sapiens
atactttgtaattttt

SEQ ID NO: 46264 - DNA, 16 bp, H. sapiens
atactttgtataattt

SEQ ID NO: 46265 - DNA, 16 bp, H. sapiens
atactttgttagattt

SEQ ID NO: 46266 - DNA, 16 bp, H. sapiens
atactttgttttctaa

SEQ ID NO: 46267 - DNA, 16 bp, H. sapiens
atacttttaaaagcat

SEQ ID NO: 46268 - DNA, 16 bp, H. sapiens
atacttttaccacttg

SEQ ID NO: 46269 - DNA, 17 bp, H. sapiens
atacttttagaggccct

SEQ ID NO: 46270 - DNA, 16 bp, H. sapiens
atacttttccatttat

SEQ ID NO: 46271 - DNA, 16 bp, H. sapiens
atacttttgtaacaaa

SEQ ID NO: 46272 - DNA, 16 bp, H. sapiens
atactttttctatgtt

SEQ ID NO: 46273 - DNA, 16 bp, H. sapiens
atactttttctgcatc

SEQ ID NO: 46274 - DNA, 16 bp, H. sapiens
atacttttttctagtt

SEQ ID NO: 46275 - DNA, 16 bp, H. sapiens
atacttttttgaaaaa

SEQ ID NO: 46276 - DNA, 16 bp, H. sapiens
atagaaaaattagcct

SEQ ID NO: 46277 - DNA, 16 bp, H. sapiens
atagaaaaatttcaaa

SEQ ID NO: 46278 - DNA, 16 bp, H. sapiens
atagaaaaccctaaat

SEQ ID NO: 46279 - DNA, 16 bp, H. sapiens
atagaaaactaatata

SEQ ID NO: 46280 - DNA, 16 bp, H. sapiens
atagaaaagaaaagcc

SEQ ID NO: 46281 - DNA, 16 bp, H. sapiens
atagaaaagaaaatcc

SEQ ID NO: 46282 - DNA, 16 bp, H. sapiens
atagaaaagcaattca

SEQ ID NO: 46283 - DNA, 16 bp, H. sapiens
atagaaaataaacttt

SEQ ID NO: 46284 - DNA, 16 bp, H. sapiens
atagaaaataattttg

SEQ ID NO: 46285 - DNA, 16 bp, H. sapiens
atagaaaatagattag

SEQ ID NO: 46286 - DNA, 16 bp, H. sapiens
atagaaaatagtttta

SEQ ID NO: 46287 - DNA, 16 bp, H. sapiens
atagaaaatatcagca

SEQ ID NO: 46288 - DNA, 16 bp, H. sapiens
atagaaaatatcttca

SEQ ID NO: 46289 - DNA, 16 bp, H. sapiens
atagaaaatctattta

SEQ ID NO: 46290 - DNA, 16 bp, H. sapiens
atagaaaatgtacagt

SEQ ID NO: 46291 - DNA, 16 bp, H. sapiens
atagaaaattaataca

SEQ ID NO: 46292 - DNA, 16 bp, H. sapiens
atagaaaatttcaaac

SEQ ID NO: 46293 - DNA, 16 bp, H. sapiens
atagaaaatttggaaa

SEQ ID NO: 46294 - DNA, 16 bp, H. sapiens
atagaaacacctggat

SEQ ID NO: 46295 - DNA, 16 bp, H. sapiens
atagaaacagtagaat

SEQ ID NO: 46296 - DNA, 16 bp, H. sapiens
atagaaaccaaaagag

SEQ ID NO: 46297 - DNA, 16 bp, H. sapiens
atagaaacttttaaaa

SEQ ID NO: 46298 - DNA, 16 bp, H. sapiens
atagaaagacaaatat

SEQ ID NO: 46299 - DNA, 16 bp, H. sapiens
atagaaaggaacaaga

SEQ ID NO: 46300 - DNA, 16 bp, H. sapiens
atagaaataaacattt

SEQ ID NO: 46301 - DNA, 16 bp, H. sapiens
atagaaatacatattt

SEQ ID NO: 46302 - DNA, 16 bp, H. sapiens
atagaaatatgtatat

SEQ ID NO: 46303 - DNA, 16 bp, H. sapiens
atagaaatgaggtctc

SEQ ID NO: 46304 - DNA, 16 bp, H. sapiens
atagaaatgataaatg

SEQ ID NO: 46305 - DNA, 16 bp, H. sapiens
atagaaatggaatcat

SEQ ID NO: 46306 - DNA, 16 bp, H. sapiens
atagaaatgttttata

SEQ ID NO: 46307 - DNA, 16 bp, H. sapiens
atagaaattatacaaa

SEQ ID NO: 46308 - DNA, 16 bp, H. sapiens
atagaaattctgaaat

SEQ ID NO: 46309 - DNA, 16 bp, H. sapiens
atagaaattctgaaca

SEQ ID NO: 46310 - DNA, 16 bp, H. sapiens
atagaacaagaccctg

SEQ ID NO: 46311 - DNA, 16 bp, H. sapiens
atagaaccaacccaaa

SEQ ID NO: 46312 - DNA, 16 bp, H. sapiens
atagaactatatatat

SEQ ID NO: 46313 - DNA, 16 bp, H. sapiens
atagaactttctgtga

SEQ ID NO: 46314 - DNA, 16 bp, H. sapiens
atagaagaaatagctg

SEQ ID NO: 46315 - DNA, 16 bp, H. sapiens
atagaagaactcaaca

SEQ ID NO: 46316 - DNA, 16 bp, H. sapiens
atagaagaagaaactg

SEQ ID NO: 46317 - DNA, 16 bp, H. sapiens
atagaagatcaagcca

SEQ ID NO: 46318 - DNA, 16 bp, H. sapiens
atagaagatgctcagt

SEQ ID NO: 46319 - DNA, 16 bp, H. sapiens
atagaagcagaaaata

SEQ ID NO: 46320 - DNA, 16 bp, H. sapiens
atagaagcttttaata

SEQ ID NO: 46321 - DNA, 16 bp, H. sapiens
atagaagtgagatcat

SEQ ID NO: 46322 - DNA, 16 bp, H. sapiens
atagaatatcagaaga

SEQ ID NO: 46323 - DNA, 16 bp, H. sapiens
atagaatatggcagaa

SEQ ID NO: 46324 - DNA, 16 bp, H. sapiens
atagaatattaaggat

SEQ ID NO: 46325 - DNA, 16 bp, H. sapiens
atagaatattatttgg

SEQ ID NO: 46326 - DNA, 16 bp, H. sapiens
atagaatcatatcatc

SEQ ID NO: 46327 - DNA, 16 bp, H. sapiens
atagaatctttctttc

SEQ ID NO: 46328 - DNA, 16 bp, H. sapiens
atagaatggcagaatg

SEQ ID NO: 46329 - DNA, 16 bp, H. sapiens
atagaatgtgacagaa

SEQ ID NO: 46330 - DNA, 16 bp, H. sapiens
atagaattcagaatat

SEQ ID NO: 46331 - DNA, 16 bp, H. sapiens
atagaattgaacaagt

SEQ ID NO: 46332 - DNA, 16 bp, H. sapiens
atagacaaatgaaaca

SEQ ID NO: 46333 - DNA, 16 bp, H. sapiens
atagacaatacataaa

SEQ ID NO: 46334 - DNA, 16 bp, H. sapiens
atagacactggagact

SEQ ID NO: 46335 - DNA, 16 bp, H. sapiens
atagacagcctttctg

SEQ ID NO: 46336 - DNA, 16 bp, H. sapiens
atagacatatatgtgt

SEQ ID NO: 46337 - DNA, 16 bp, H. sapiens
atagacatgattatat

SEQ ID NO: 46338 - DNA, 16 bp, H. sapiens
atagacatgcgccacc

SEQ ID NO: 46339 - DNA, 16 bp, H. sapiens
atagacatgtacagaa

SEQ ID NO: 46340 - DNA, 16 bp, H. sapiens
atagacatttatcaaa

SEQ ID NO: 46341 - DNA, 16 bp, H. sapiens
atagaccactggaaca

SEQ ID NO: 46342 - DNA, 16 bp, H. sapiens
atagaccatatgatag

SEQ ID NO: 46343 - DNA, 16 bp, H. sapiens
atagaccgctagccag

SEQ ID NO: 46344 - DNA, 16 bp, H. sapiens
atagactatatatagt

SEQ ID NO: 46345 - DNA, 16 bp, H. sapiens
atagactcaaagtaaa

SEQ ID NO: 46346 - DNA, 16 bp, H. sapiens
atagactgaaagaaaa

SEQ ID NO: 46347 - DNA, 16 bp, H. sapiens
atagactggaaaaaga

SEQ ID NO: 46348 - DNA, 16 bp, H. sapiens
atagactggataaaga

SEQ ID NO: 46349 - DNA, 16 bp, H. sapiens
atagactggccagaac

SEQ ID NO: 46350 - DNA, 16 bp, H. sapiens
atagactttataaaca

SEQ ID NO: 46351 - DNA, 16 bp, H. sapiens
atagactttggggact

SEQ ID NO: 46352 - DNA, 16 bp, H. sapiens
atagactttgtttttt

SEQ ID NO: 46353 - DNA, 16 bp, H. sapiens
atagagaaatacaatt

SEQ ID NO: 46354 - DNA, 16 bp, H. sapiens
atagagaaatatattt

SEQ ID NO: 46355 - DNA, 16 bp, H. sapiens
atagagaaatatttat

SEQ ID NO: 46356 - DNA, 16 bp, H. sapiens
atagagaacatttcca

SEQ ID NO: 46357 - DNA, 16 bp, H. sapiens
atagagaatagaatga

SEQ ID NO: 46358 - DNA, 16 bp, H. sapiens
atagagaatgcagaaa

SEQ ID NO: 46359 - DNA, 16 bp, H. sapiens
atagagacacaaaaat

SEQ ID NO: 46360 - DNA, 16 bp, H. sapiens
atagagacagaaaaca

SEQ ID NO: 46361 - DNA, 16 bp, H. sapiens
atagagacagggtttc

SEQ ID NO: 46362 - DNA, 17 bp, H. sapiens
atagagacagggtttca

SEQ ID NO: 46363 - DNA, 16 bp, H. sapiens
atagagaccagactgt

SEQ ID NO: 46364 - DNA, 16 bp, H. sapiens
atagagacgaggtttc

SEQ ID NO: 46365 - DNA, 16 bp, H. sapiens
atagagacggggtttt

SEQ ID NO: 46366 - DNA, 16 bp, H. sapiens
atagagagatgataga

SEQ ID NO: 46367 - DNA, 16 bp, H. sapiens
atagagagggggtttc

SEQ ID NO: 46368 - DNA, 16 bp, H. sapiens
atagagatagaaagca

SEQ ID NO: 46369 - DNA, 16 bp, H. sapiens
atagagatagatgata

SEQ ID NO: 46370 - DNA, 16 bp, H. sapiens
atagagatgggatctc

SEQ ID NO: 46371 - DNA, 16 bp, H. sapiens
atagagatggggtttc

SEQ ID NO: 46372 - DNA, 27 bp, H. sapiens
atagagatggggtttcaccatgttggc

SEQ ID NO: 46373 - DNA, 16 bp, H. sapiens
atagagcaagacccca

SEQ ID NO: 46374 - DNA, 16 bp, H. sapiens
atagagcaagactgtc

SEQ ID NO: 46375 - DNA, 16 bp, H. sapiens
atagagcattaaacca

SEQ ID NO: 46376 - DNA, 16 bp, H. sapiens
atagagctgaaaaaaa

SEQ ID NO: 46377 - DNA, 16 bp, H. sapiens
atagaggtggggtctc

SEQ ID NO: 46378 - DNA, 16 bp, H. sapiens
atagagtccagaaaca

SEQ ID NO: 46379 - DNA, 16 bp, H. sapiens
atagagttaaaccttt

SEQ ID NO: 46380 - DNA, 16 bp, H. sapiens
atagataaatggaaca

SEQ ID NO: 46381 - DNA, 16 bp, H. sapiens
atagataacattttta

SEQ ID NO: 46382 - DNA, 16 bp, H. sapiens
atagatacagaaaaat

SEQ ID NO: 46383 - DNA, 16 bp, H. sapiens
atagatagatagatat

SEQ ID NO: 46384 - DNA, 16 bp, H. sapiens
atagataggtagatag

SEQ ID NO: 46385 - DNA, 16 bp, H. sapiens
atagataggtagatat

SEQ ID NO: 46386 - DNA, 16 bp, H. sapiens
atagatatatatatgc

SEQ ID NO: 46387 - DNA, 16 bp, H. sapiens
atagatcaaagaatga

SEQ ID NO: 46388 - DNA, 19 bp, H. sapiens
atagatcaatggaacagaa

SEQ ID NO: 46389 - DNA, 16 bp, H. sapiens
atagatcaatggaata

SEQ ID NO: 46390 - DNA, 16 bp, H. sapiens
atagatgaaccttgaa

SEQ ID NO: 46391 - DNA, 16 bp, H. sapiens
atagatgaagaaaatg

SEQ ID NO: 46392 - DNA, 16 bp, H. sapiens
atagatgaggaagctg

SEQ ID NO: 46393 - DNA, 16 bp, H. sapiens
atagatgcaacaaaaa

SEQ ID NO: 46394 - DNA, 16 bp, H. sapiens
atagatgctgaaaagg

SEQ ID NO: 46395 - DNA, 16 bp, H. sapiens
atagatggtgccttct

SEQ ID NO: 46396 - DNA, 16 bp, H. sapiens
atagatgttgaatttt

SEQ ID NO: 46397 - DNA, 16 bp, H. sapiens
atagattgcaaaattt

SEQ ID NO: 46398 - DNA, 16 bp, H. sapiens
atagattgcaaatatt

SEQ ID NO: 46399 - DNA, 16 bp, H. sapiens
atagattgctttgagt

SEQ ID NO: 46400 - DNA, 16 bp, H. sapiens
atagattggataaaga

SEQ ID NO: 46401 - DNA, 16 bp, H. sapiens
atagattgggagaaaa

SEQ ID NO: 46402 - DNA, 16 bp, H. sapiens
atagatttaatgcaat

SEQ ID NO: 46403 - DNA, 16 bp, H. sapiens
atagatttcttttaaa

SEQ ID NO: 46404 - DNA, 16 bp, H. sapiens
atagatttgtcttttc

SEQ ID NO: 46405 - DNA, 16 bp, H. sapiens
atagattttaaacatt

SEQ ID NO: 46406 - DNA, 16 bp, H. sapiens
atagattttaagacaa

SEQ ID NO: 46407 - DNA, 16 bp, H. sapiens
atagatttttaaaact

SEQ ID NO: 46408 - DNA, 16 bp, H. sapiens
atagatttttctttaa

SEQ ID NO: 46409 - DNA, 16 bp, H. sapiens
atagcaaaatgacaga

SEQ ID NO: 46410 - DNA, 16 bp, H. sapiens
atagcaaagaataatt

SEQ ID NO: 46411 - DNA, 16 bp, H. sapiens
atagcaaaggcttgga

SEQ ID NO: 46412 - DNA, 16 bp, H. sapiens
atagcaacaaaaaatg

SEQ ID NO: 46413 - DNA, 16 bp, H. sapiens
atagcaagacccccac

SEQ ID NO: 46414 - DNA, 16 bp, H. sapiens
atagcaagactccacc

SEQ ID NO: 46415 - DNA, 16 bp, H. sapiens
atagcaatgagaatga

SEQ ID NO: 46416 - DNA, 16 bp, H. sapiens
atagcaatttgacatt

SEQ ID NO: 46417 - DNA, 16 bp, H. sapiens
atagcacaggaaagac

SEQ ID NO: 46418 - DNA, 16 bp, H. sapiens
atagcagattagacat

SEQ ID NO: 46419 - DNA, 16 bp, H. sapiens
atagcagcaataaaaa

SEQ ID NO: 46420 - DNA, 16 bp, H. sapiens
atagcagcaatattca

SEQ ID NO: 46421 - DNA, 16 bp, H. sapiens
atagcagctgtaccat

SEQ ID NO: 46422 - DNA, 16 bp, H. sapiens
atagcagctttattca

SEQ ID NO: 46423 - DNA, 16 bp, H. sapiens
atagcagtacaatttg

SEQ ID NO: 46424 - DNA, 16 bp, H. sapiens
atagcagtggttctca

SEQ ID NO: 46425 - DNA, 16 bp, H. sapiens
atagcatattttaaaa

SEQ ID NO: 46426 - DNA, 16 bp, H. sapiens
atagcatgggaaaaac

SEQ ID NO: 46427 - DNA, 16 bp, H. sapiens
atagcatggtttactg

SEQ ID NO: 46428 - DNA, 16 bp, H. sapiens
atagcattaaatgcct

SEQ ID NO: 46429 - DNA, 16 bp, H. sapiens
atagcattataatttt

SEQ ID NO: 46430 - DNA, 16 bp, H. sapiens
atagcattttaaattt

SEQ ID NO: 46431 - DNA, 16 bp, H. sapiens
atagccaggcatggtg

SEQ ID NO: 46432 - DNA, 17 bp, H. sapiens
atagccaggcgtggtgg

SEQ ID NO: 46433 - DNA, 16 bp, H. sapiens
atagccagtttatcta

SEQ ID NO: 46434 - DNA, 16 bp, H. sapiens
atagccatacaatgga

SEQ ID NO: 46435 - DNA, 16 bp, H. sapiens
atagccatactgccca

SEQ ID NO: 46436 - DNA, 16 bp, H. sapiens
atagccctaaatgcct

SEQ ID NO: 46437 - DNA, 16 bp, H. sapiens
atagcccttattattt

SEQ ID NO: 46438 - DNA, 16 bp, H. sapiens
atagcctaagtgtgta

SEQ ID NO: 46439 - DNA, 16 bp, H. sapiens
atagcctccagctcca

SEQ ID NO: 46440 - DNA, 16 bp, H. sapiens
atagcctgagcccagg

SEQ ID NO: 46441 - DNA, 16 bp, H. sapiens
atagcctgctgttgac

SEQ ID NO: 46442 - DNA, 16 bp, H. sapiens
atagccttttcagata

SEQ ID NO: 46443 - DNA, 16 bp, H. sapiens
atagctaacatttatt

SEQ ID NO: 46444 - DNA, 16 bp, H. sapiens
atagctacaaataaaa

SEQ ID NO: 46445 - DNA, 16 bp, H. sapiens
atagctaggactacag

SEQ ID NO: 46446 - DNA, 18 bp, H. sapiens
atagctaggattacaggt

SEQ ID NO: 46447 - DNA, 16 bp, H. sapiens
atagctattaaaataa

SEQ ID NO: 46448 - DNA, 16 bp, H. sapiens
atagctcactgcagct

SEQ ID NO: 46449 - DNA, 18 bp, H. sapiens
atagctcactgtagcctt

SEQ ID NO: 46450 - DNA, 16 bp, H. sapiens
atagctcattcctttt

SEQ ID NO: 46451 - DNA, 16 bp, H. sapiens
atagctgaagaaactg

SEQ ID NO: 46452 - DNA, 16 bp, H. sapiens
atagctgaatcaacca

SEQ ID NO: 46453 - DNA, 16 bp, H. sapiens
atagctgagactacaa

SEQ ID NO: 46454 - DNA, 16 bp, H. sapiens
atagctgcaaaaaaaa

SEQ ID NO: 46455 - DNA, 16 bp, H. sapiens
atagctgcaaaaaaat

SEQ ID NO: 46456 - DNA, 16 bp, H. sapiens
atagctggagctggag

SEQ ID NO: 46457 - DNA, 16 bp, H. sapiens
atagctggcattacag

SEQ ID NO: 46458 - DNA, 18 bp, H. sapiens
atagctgggaccacaggc

SEQ ID NO: 46459 - DNA, 16 bp, H. sapiens
atagctgggactacaa

SEQ ID NO: 46460 - DNA, 16 bp, H. sapiens
atagctgggactacag

SEQ ID NO: 46461 - DNA, 16 bp, H. sapiens
atagctgggactatag

SEQ ID NO: 46462 - DNA, 18 bp, H. sapiens
atagctgggactgcaggc

SEQ ID NO: 46463 - DNA, 16 bp, H. sapiens
atagctgggattacac

SEQ ID NO: 46464 - DNA, 16 bp, H. sapiens
atagctgggattacag

SEQ ID NO: 46465 - DNA, 16 bp, H. sapiens
atagctgggattatag

SEQ ID NO: 46466 - DNA, 16 bp, H. sapiens
atagctgggcatggtg

SEQ ID NO: 46467 - DNA, 16 bp, H. sapiens
atagctgggggtggtg

SEQ ID NO: 46468 - DNA, 18 bp, H. sapiens
atagctgggtgtggtggc

SEQ ID NO: 46469 - DNA, 16 bp, H. sapiens
atagctgtaaacttcc

SEQ ID NO: 46470 - DNA, 16 bp, H. sapiens
atagctgtgtgtgtgt

SEQ ID NO: 46471 - DNA, 16 bp, H. sapiens
atagcttaaaagaaaa

SEQ ID NO: 46472 - DNA, 16 bp, H. sapiens
atagcttatctttaca

SEQ ID NO: 46473 - DNA, 16 bp, H. sapiens
atagcttgaaccctgg

SEQ ID NO: 46474 - DNA, 16 bp, H. sapiens
atagcttgatgaattt

SEQ ID NO: 46475 - DNA, 16 bp, H. sapiens
atagctttaaaaaaaa

SEQ ID NO: 46476 - DNA, 16 bp, H. sapiens
atagctttaaaaaata

SEQ ID NO: 46477 - DNA, 16 bp, H. sapiens
atagctttaaaatata

SEQ ID NO: 46478 - DNA, 16 bp, H. sapiens
atagctttatttgtaa

SEQ ID NO: 46479 - DNA, 16 bp, H. sapiens
atagcttttggtgttt

SEQ ID NO: 46480 - DNA, 16 bp, H. sapiens
ataggaaaaaaatcag

SEQ ID NO: 46481 - DNA, 16 bp, H. sapiens
ataggaaaatgtgaga

SEQ ID NO: 46482 - DNA, 16 bp, H. sapiens
ataggaaatgggagaa

SEQ ID NO: 46483 - DNA, 16 bp, H. sapiens
ataggaaattatttta

SEQ ID NO: 46484 - DNA, 16 bp, H. sapiens
ataggaacagcttcag

SEQ ID NO: 46485 - DNA, 16 bp, H. sapiens
ataggaatagaggaag

SEQ ID NO: 46486 - DNA, 16 bp, H. sapiens
ataggagaaaaatttt

SEQ ID NO: 46487 - DNA, 16 bp, H. sapiens
ataggagaatatattt

SEQ ID NO: 46488 - DNA, 17 bp, H. sapiens
ataggagaattgcttga

SEQ ID NO: 46489 - DNA, 17 bp, H. sapiens
ataggagcagctccagt

SEQ ID NO: 46490 - DNA, 16 bp, H. sapiens
ataggagtaaatcttc

SEQ ID NO: 46491 - DNA, 16 bp, H. sapiens
ataggatatttacata

SEQ ID NO: 46492 - DNA, 16 bp, H. sapiens
ataggatattttaaat

SEQ ID NO: 46493 - DNA, 16 bp, H. sapiens
ataggattacttttag

SEQ ID NO: 46494 - DNA, 16 bp, H. sapiens
ataggatttttaaaat

SEQ ID NO: 46495 - DNA, 16 bp, H. sapiens
ataggcaattcacaga

SEQ ID NO: 46496 - DNA, 16 bp, H. sapiens
ataggcacccactacc

SEQ ID NO: 46497 - DNA, 16 bp, H. sapiens
ataggcactcaataaa

SEQ ID NO: 46498 - DNA, 16 bp, H. sapiens
ataggcaggcaccacc

SEQ ID NO: 46499 - DNA, 16 bp, H. sapiens
ataggcagtttttcag

SEQ ID NO: 46500 - DNA, 16 bp, H. sapiens
ataggcatctcaaact

SEQ ID NO: 46501 - DNA, 16 bp, H. sapiens
ataggcatgagccaac

SEQ ID NO: 46502 - DNA, 17 bp, H. sapiens
ataggcatgtgccacca

SEQ ID NO: 46503 - DNA, 16 bp, H. sapiens
ataggccgggcacagt

SEQ ID NO: 46504 - DNA, 16 bp, H. sapiens
ataggccgtctgcaag

SEQ ID NO: 46505 - DNA, 16 bp, H. sapiens
ataggctcaaaacaaa

SEQ ID NO: 46506 - DNA, 16 bp, H. sapiens
ataggctcaaaataaa

SEQ ID NO: 46507 - DNA, 16 bp, H. sapiens
ataggcttaaaataaa

SEQ ID NO: 46508 - DNA, 16 bp, H. sapiens
atagggaaactgaggc

SEQ ID NO: 46509 - DNA, 16 bp, H. sapiens
atagggattatattga

SEQ ID NO: 46510 - DNA, 16 bp, H. sapiens
atagggcagaggaagc

SEQ ID NO: 46511 - DNA, 16 bp, H. sapiens
atagggccaggcacag

SEQ ID NO: 46512 - DNA, 16 bp, H. sapiens
atagggtgtcactctg

SEQ ID NO: 46513 - DNA, 16 bp, H. sapiens
atagggtttcaccagg

SEQ ID NO: 46514 - DNA, 16 bp, H. sapiens
ataggtactcttttgt

SEQ ID NO: 46515 - DNA, 16 bp, H. sapiens
ataggtagattttaaa

SEQ ID NO: 46516 - DNA, 16 bp, H. sapiens
ataggtaggtaagaga

SEQ ID NO: 46517 - DNA, 16 bp, H. sapiens
ataggtatatatgtgt

SEQ ID NO: 46518 - DNA, 17 bp, H. sapiens
ataggtgcaggaaacca

SEQ ID NO: 46519 - DNA, 16 bp, H. sapiens
ataggtgctcagtaaa

SEQ ID NO: 46520 - DNA, 16 bp, H. sapiens
ataggtgcttaataaa

SEQ ID NO: 46521 - DNA, 16 bp, H. sapiens
ataggttggaattgaa

SEQ ID NO: 46522 - DNA, 21 bp, H. sapiens
ataggttgggctagttaactg

SEQ ID NO: 46523 - DNA, 16 bp, H. sapiens
ataggtttgaactgca

SEQ ID NO: 46524 - DNA, 16 bp, H. sapiens
ataggttttgggggaa

SEQ ID NO: 46525 - DNA, 16 bp, H. sapiens
ataggtttttggggaa

SEQ ID NO: 46526 - DNA, 16 bp, H. sapiens
ataggtttttggggga

SEQ ID NO: 46527 - DNA, 16 bp, H. sapiens
atagtaaataatttag

SEQ ID NO: 46528 - DNA, 16 bp, H. sapiens
atagtaaatgtatata

SEQ ID NO: 46529 - DNA, 16 bp, H. sapiens
atagtaactcatttaa

SEQ ID NO: 46530 - DNA, 16 bp, H. sapiens
atagtaagtgctcaat

SEQ ID NO: 46531 - DNA, 16 bp, H. sapiens
atagtaatcaaaacat

SEQ ID NO: 46532 - DNA, 16 bp, H. sapiens
atagtactgaatccta

SEQ ID NO: 46533 - DNA, 16 bp, H. sapiens
atagtagatatatata

SEQ ID NO: 46534 - DNA, 16 bp, H. sapiens
atagtagatgctcagt

SEQ ID NO: 46535 - DNA, 16 bp, H. sapiens
atagtagctatcctaa

SEQ ID NO: 46536 - DNA, 16 bp, H. sapiens
atagtagctgtactaa

SEQ ID NO: 46537 - DNA, 16 bp, H. sapiens
atagtaggcactcaac

SEQ ID NO: 46538 - DNA, 16 bp, H. sapiens
atagtattcccttatt

SEQ ID NO: 46539 - DNA, 16 bp, H. sapiens
atagtattcctttata

SEQ ID NO: 46540 - DNA, 16 bp, H. sapiens
atagtcatatatatat

SEQ ID NO: 46541 - DNA, 16 bp, H. sapiens
atagtcccagctacac

SEQ ID NO: 46542 - DNA, 16 bp, H. sapiens
atagtcccagctaccc

SEQ ID NO: 46543 - DNA, 16 bp, H. sapiens
atagtcccagctgctt

SEQ ID NO: 46544 - DNA, 16 bp, H. sapiens
atagtcccagttactc

SEQ ID NO: 46545 - DNA, 16 bp, H. sapiens
atagtccttggcatga

SEQ ID NO: 46546 - DNA, 16 bp, H. sapiens
atagtgaaacaccgtc

SEQ ID NO: 46547 - DNA, 16 bp, H. sapiens
atagtgaaacactgtc

SEQ ID NO: 46548 - DNA, 16 bp, H. sapiens
atagtgaaacctcatc

SEQ ID NO: 46549 - DNA, 16 bp, H. sapiens
atagtgaaagcctgtc

SEQ ID NO: 46550 - DNA, 16 bp, H. sapiens
atagtgaaatattttt

SEQ ID NO: 46551 - DNA, 16 bp, H. sapiens
atagtgaaatgattac

SEQ ID NO: 46552 - DNA, 16 bp, H. sapiens
atagtgaacaatctga

SEQ ID NO: 46553 - DNA, 16 bp, H. sapiens
atagtgaaggaggcaa

SEQ ID NO: 46554 - DNA, 16 bp, H. sapiens
atagtgaatatatttt

SEQ ID NO: 46555 - DNA, 16 bp, H. sapiens
atagtgaatgggagtt

SEQ ID NO: 46556 - DNA, 16 bp, H. sapiens
atagtgacttccttct

SEQ ID NO: 46557 - DNA, 16 bp, H. sapiens
atagtgactttttaaa

SEQ ID NO: 46558 - DNA, 16 bp, H. sapiens
atagtgagaccccata

SEQ ID NO: 46559 - DNA, 16 bp, H. sapiens
atagtgagccatgatt

SEQ ID NO: 46560 - DNA, 17 bp, H. sapiens
atagtgagggaggttgg

SEQ ID NO: 46561 - DNA, 16 bp, H. sapiens
atagtgatgatgaaga

SEQ ID NO: 46562 - DNA, 16 bp, H. sapiens
atagtgcaatcaaact

SEQ ID NO: 46563 - DNA, 16 bp, H. sapiens
atagtgcctggcacat

SEQ ID NO: 46564 - DNA, 16 bp, H. sapiens
atagtgcctggtacat

SEQ ID NO: 46565 - DNA, 16 bp, H. sapiens
atagtgctctttaaaa

SEQ ID NO: 46566 - DNA, 16 bp, H. sapiens
atagtgctgctatgaa

SEQ ID NO: 46567 - DNA, 16 bp, H. sapiens
atagtggaaccccgtc

SEQ ID NO: 46568 - DNA, 16 bp, H. sapiens
atagtggaaggggaag

SEQ ID NO: 46569 - DNA, 16 bp, H. sapiens
atagtggcaggaggca

SEQ ID NO: 46570 - DNA, 16 bp, H. sapiens
atagtggctcaagcct

SEQ ID NO: 46571 - DNA, 16 bp, H. sapiens
atagtggctcacacct

SEQ ID NO: 46572 - DNA, 16 bp, H. sapiens
atagtggcttatgcct

SEQ ID NO: 46573 - DNA, 16 bp, H. sapiens
atagtggcttccagct

SEQ ID NO: 46574 - DNA, 16 bp, H. sapiens
atagtggttgtaccaa

SEQ ID NO: 46575 - DNA, 16 bp, H. sapiens
atagtgtattatatat

SEQ ID NO: 46576 - DNA, 16 bp, H. sapiens
atagtgtgtgtatata

SEQ ID NO: 46577 - DNA, 16 bp, H. sapiens
atagttatcttttctt

SEQ ID NO: 46578 - DNA, 16 bp, H. sapiens
atagttatcttttttg

SEQ ID NO: 46579 - DNA, 16 bp, H. sapiens
atagttccagctactc

SEQ ID NO: 46580 - DNA, 16 bp, H. sapiens
atagttcccagtctac

SEQ ID NO: 46581 - DNA, 16 bp, H. sapiens
atagttcccataatcc

SEQ ID NO: 46582 - DNA, 16 bp, H. sapiens
atagttctggaggtta

SEQ ID NO: 46583 - DNA, 16 bp, H. sapiens
atagttgaaataattt

SEQ ID NO: 46584 - DNA, 16 bp, H. sapiens
atagttgttttaaaat

SEQ ID NO: 46585 - DNA, 16 bp, H. sapiens
atagtttaagttcatt

SEQ ID NO: 46586 - DNA, 16 bp, H. sapiens
atagtttacagagaat

SEQ ID NO: 46587 - DNA, 20 bp, H. sapiens
atagtttactgagaatgatg

SEQ ID NO: 46588 - DNA, 16 bp, H. sapiens
atagtttatatttctg

SEQ ID NO: 46589 - DNA, 16 bp, H. sapiens
atagtttattgagaat

SEQ ID NO: 46590 - DNA, 16 bp, H. sapiens
atagtttattgttagt

SEQ ID NO: 46591 - DNA, 16 bp, H. sapiens
atagtttcaaaatatt

SEQ ID NO: 46592 - DNA, 16 bp, H. sapiens
atagtttcaagtctta

SEQ ID NO: 46593 - DNA, 16 bp, H. sapiens
atagtttgaaatcaga

SEQ ID NO: 46594 - DNA, 16 bp, H. sapiens
atagtttgaataattt

SEQ ID NO: 46595 - DNA, 16 bp, H. sapiens
atagtttgccaactcc

SEQ ID NO: 46596 - DNA, 16 bp, H. sapiens
atagtttggttctgtg

SEQ ID NO: 46597 - DNA, 16 bp, H. sapiens
atagttttactttctt

SEQ ID NO: 46598 - DNA, 16 bp, H. sapiens
atagttttatatatag

SEQ ID NO: 46599 - DNA, 16 bp, H. sapiens
atagttttcaatgtat

SEQ ID NO: 46600 - DNA, 16 bp, H. sapiens
atagttttcagtgtgc

SEQ ID NO: 46601 - DNA, 16 bp, H. sapiens
atagttttcattttct

SEQ ID NO: 46602 - DNA, 16 bp, H. sapiens
atagtttttccttttc

SEQ ID NO: 46603 - DNA, 16 bp, H. sapiens
atagtttttctccttt

SEQ ID NO: 46604 - DNA, 16 bp, H. sapiens
atataaaaaaagctca

SEQ ID NO: 46605 - DNA, 16 bp, H. sapiens
atataaaaacttttct

SEQ ID NO: 46606 - DNA, 16 bp, H. sapiens
atataaaaagttatgt

SEQ ID NO: 46607 - DNA, 16 bp, H. sapiens
atataaaaatggattt

SEQ ID NO: 46608 - DNA, 16 bp, H. sapiens
atataaaaatgtgctc

SEQ ID NO: 46609 - DNA, 16 bp, H. sapiens
atataaaagcaaatat

SEQ ID NO: 46610 - DNA, 16 bp, H. sapiens
atataaaatatgtaca

SEQ ID NO: 46611 - DNA, 16 bp, H. sapiens
atataaaatcagaaat

SEQ ID NO: 46612 - DNA, 16 bp, H. sapiens
atataaaatgggaaat

SEQ ID NO: 46613 - DNA, 16 bp, H. sapiens
atataaaatggtattt

SEQ ID NO: 46614 - DNA, 16 bp, H. sapiens
atataaaatgtattca

SEQ ID NO: 46615 - DNA, 16 bp, H. sapiens
atataaaatttcagaa

SEQ ID NO: 46616 - DNA, 16 bp, H. sapiens
atataaacaaatggaa

SEQ ID NO: 46617 - DNA, 16 bp, H. sapiens
atataaacatcacaca

SEQ ID NO: 46618 - DNA, 16 bp, H. sapiens
atataaaccccagacc

SEQ ID NO: 46619 - DNA, 16 bp, H. sapiens
atataaacttatttct

SEQ ID NO: 46620 - DNA, 16 bp, H. sapiens
atataaagaactatta

SEQ ID NO: 46621 - DNA, 16 bp, H. sapiens
atataaagaactctca

SEQ ID NO: 46622 - DNA, 16 bp, H. sapiens
atataaagatgtttat

SEQ ID NO: 46623 - DNA, 16 bp, H. sapiens
atataaagatttcttt

SEQ ID NO: 46624 - DNA, 16 bp, H. sapiens
atataaagcaaaaact

SEQ ID NO: 46625 - DNA, 16 bp, H. sapiens
atataaagcacttaaa

SEQ ID NO: 46626 - DNA, 16 bp, H. sapiens
atataaagtgtatata

SEQ ID NO: 46627 - DNA, 16 bp, H. sapiens
atataaataaatgtgt

SEQ ID NO: 46628 - DNA, 16 bp, H. sapiens
atataaatacacacat

SEQ ID NO: 46629 - DNA, 16 bp, H. sapiens
atataaatatatgcat

SEQ ID NO: 46630 - DNA, 16 bp, H. sapiens
atataaatatgtacat

SEQ ID NO: 46631 - DNA, 18 bp, H. sapiens
atataaatcatgctgcta

SEQ ID NO: 46632 - DNA, 16 bp, H. sapiens
atataaatgaaatcat

SEQ ID NO: 46633 - DNA, 16 bp, H. sapiens
atataaatgaatttca

SEQ ID NO: 46634 - DNA, 16 bp, H. sapiens
atataaatgattgaat

SEQ ID NO: 46635 - DNA, 16 bp, H. sapiens
atataaatgcatatgt

SEQ ID NO: 46636 - DNA, 16 bp, H. sapiens
atataaatgctattta

SEQ ID NO: 46637 - DNA, 16 bp, H. sapiens
atataaatggaatcat

SEQ ID NO: 46638 - DNA, 16 bp, H. sapiens
atataaatggaattat

SEQ ID NO: 46639 - DNA, 16 bp, H. sapiens
atataaatggtattgt

SEQ ID NO: 46640 - DNA, 16 bp, H. sapiens
atataaatgtaaacaa

SEQ ID NO: 46641 - DNA, 16 bp, H. sapiens
atataaatgtaaacat

SEQ ID NO: 46642 - DNA, 16 bp, H. sapiens
atataaatgtatgtgt

SEQ ID NO: 46643 - DNA, 16 bp, H. sapiens
atataaatgtgaattt

SEQ ID NO: 46644 - DNA, 16 bp, H. sapiens
atataaatgtgtgtgt

SEQ ID NO: 46645 - DNA, 16 bp, H. sapiens
atataaattgtgtata

SEQ ID NO: 46646 - DNA, 16 bp, H. sapiens
atataaatttcagttt

SEQ ID NO: 46647 - DNA, 16 bp, H. sapiens
atataacatactatat

SEQ ID NO: 46648 - DNA, 16 bp, H. sapiens
atataaccagtaatga

SEQ ID NO: 46649 - DNA, 16 bp, H. sapiens
atataacctatacaca

SEQ ID NO: 46650 - DNA, 16 bp, H. sapiens
atataagccaggcatg

SEQ ID NO: 46651 - DNA, 16 bp, H. sapiens
atataaggagctcaag

SEQ ID NO: 46652 - DNA, 16 bp, H. sapiens
atataagtaaaatcat

SEQ ID NO: 46653 - DNA, 16 bp, H. sapiens
atataagtgaaatcat

SEQ ID NO: 46654 - DNA, 16 bp, H. sapiens
atataagtggaatcat

SEQ ID NO: 46655 - DNA, 16 bp, H. sapiens
atataataaatgtaca

SEQ ID NO: 46656 - DNA, 16 bp, H. sapiens
atataataaatgtgtg

SEQ ID NO: 46657 - DNA, 16 bp, H. sapiens
atataatatatatgca

SEQ ID NO: 46658 - DNA, 16 bp, H. sapiens
atataatccacataaa

SEQ ID NO: 46659 - DNA, 16 bp, H. sapiens
atataatcctatatat

SEQ ID NO: 46660 - DNA, 16 bp, H. sapiens
atataatcttacattt

SEQ ID NO: 46661 - DNA, 16 bp, H. sapiens
atataatgaacttctt

SEQ ID NO: 46662 - DNA, 16 bp, H. sapiens
atataatgtacaacat

SEQ ID NO: 46663 - DNA, 16 bp, H. sapiens
atataatgtacatatt

SEQ ID NO: 46664 - DNA, 16 bp, H. sapiens
atataatgtataacat

SEQ ID NO: 46665 - DNA, 16 bp, H. sapiens
atataatgtctttttt

SEQ ID NO: 46666 - DNA, 16 bp, H. sapiens
atataatgttactgct

SEQ ID NO: 46667 - DNA, 16 bp, H. sapiens
atataatgttcttttt

SEQ ID NO: 46668 - DNA, 16 bp, H. sapiens
atataattaaaagcaa

SEQ ID NO: 46669 - DNA, 16 bp, H. sapiens
atataattatttccat

SEQ ID NO: 46670 - DNA, 16 bp, H. sapiens
atataattcaagaaaa

SEQ ID NO: 46671 - DNA, 16 bp, H. sapiens
atataattcaatggtt

SEQ ID NO: 46672 - DNA, 16 bp, H. sapiens
atataattggattaat

SEQ ID NO: 46673 - DNA, 16 bp, H. sapiens
atataatttcatctgt

SEQ ID NO: 46674 - DNA, 16 bp, H. sapiens
atataatttggatatt

SEQ ID NO: 46675 - DNA, 16 bp, H. sapiens
atataattttcacatg

SEQ ID NO: 46676 - DNA, 16 bp, H. sapiens
atataattttgctttt

SEQ ID NO: 46677 - DNA, 21 bp, H. sapiens
atatacaaaaattagctgggc

SEQ ID NO: 46678 - DNA, 16 bp, H. sapiens
atatacaaaatacatg

SEQ ID NO: 46679 - DNA, 16 bp, H. sapiens
atatacaaagaaaatg

SEQ ID NO: 46680 - DNA, 16 bp, H. sapiens
atatacaaagaattct

SEQ ID NO: 46681 - DNA, 16 bp, H. sapiens
atatacaaatagcaaa

SEQ ID NO: 46682 - DNA, 16 bp, H. sapiens
atatacaatatactat

SEQ ID NO: 46683 - DNA, 17 bp, H. sapiens
atatacacacacacacg

SEQ ID NO: 46684 - DNA, 16 bp, H. sapiens
atatacacacacatat

SEQ ID NO: 46685 - DNA, 16 bp, H. sapiens
atatacacacacgtat

SEQ ID NO: 46686 - DNA, 16 bp, H. sapiens
atatacacacacttac

SEQ ID NO: 46687 - DNA, 16 bp, H. sapiens
atatacacacactttt

SEQ ID NO: 46688 - DNA, 16 bp, H. sapiens
atatacacacattgta

SEQ ID NO: 46689 - DNA, 16 bp, H. sapiens
atatacacacatttta

SEQ ID NO: 46690 - DNA, 16 bp, H. sapiens
atatacacacattttt

SEQ ID NO: 46691 - DNA, 16 bp, H. sapiens
atatacacagacatat

SEQ ID NO: 46692 - DNA, 16 bp, H. sapiens
atatacacatatatca

SEQ ID NO: 46693 - DNA, 16 bp, H. sapiens
atatacacatatgtac

SEQ ID NO: 46694 - DNA, 16 bp, H. sapiens
atatacacatgtatat

SEQ ID NO: 46695 - DNA, 16 bp, H. sapiens
atatacacattatatt

SEQ ID NO: 46696 - DNA, 16 bp, H. sapiens
atatacacatttgtgt

SEQ ID NO: 46697 - DNA, 16 bp, H. sapiens
atatacacattttaaa

SEQ ID NO: 46698 - DNA, 19 bp, H. sapiens
atatacaccatggaatact

SEQ ID NO: 46699 - DNA, 16 bp, H. sapiens
atatacagaacatttc

SEQ ID NO: 46700 - DNA, 16 bp, H. sapiens
atatacagatggtaaa

SEQ ID NO: 46701 - DNA, 16 bp, H. sapiens
atatacagattatata

SEQ ID NO: 46702 - DNA, 16 bp, H. sapiens
atatacataattatgt

SEQ ID NO: 46703 - DNA, 16 bp, H. sapiens
atatacatacacacac

SEQ ID NO: 46704 - DNA, 16 bp, H. sapiens
atatacatacatacag

SEQ ID NO: 46705 - DNA, 16 bp, H. sapiens
atatacatatacatat

SEQ ID NO: 46706 - DNA, 16 bp, H. sapiens
atatacatatatactt

SEQ ID NO: 46707 - DNA, 16 bp, H. sapiens
atatacatatatagat

SEQ ID NO: 46708 - DNA, 16 bp, H. sapiens
atatacatatatgtgt

SEQ ID NO: 46709 - DNA, 16 bp, H. sapiens
atatacatatgtatat

SEQ ID NO: 46710 - DNA, 16 bp, H. sapiens
atatacatcacagaat

SEQ ID NO: 46711 - DNA, 16 bp, H. sapiens
atatacatctgtgtat

SEQ ID NO: 46712 - DNA, 16 bp, H. sapiens
atatacatgcacatat

SEQ ID NO: 46713 - DNA, 16 bp, H. sapiens
atatacatgcatgcac

SEQ ID NO: 46714 - DNA, 16 bp, H. sapiens
atatacatgtaatata

SEQ ID NO: 46715 - DNA, 16 bp, H. sapiens
atatacatgtacatat

SEQ ID NO: 46716 - DNA, 16 bp, H. sapiens
atatacatgtatatat

SEQ ID NO: 46717 - DNA, 16 bp, H. sapiens
atatacatgtgcacat

SEQ ID NO: 46718 - DNA, 16 bp, H. sapiens
atatacatttatttac

SEQ ID NO: 46719 - DNA, 16 bp, H. sapiens
atatacatttgtattt

SEQ ID NO: 46720 - DNA, 16 bp, H. sapiens
atatacatttgtgtat

SEQ ID NO: 46721 - DNA, 16 bp, H. sapiens
atataccacaaccaag

SEQ ID NO: 46722 - DNA, 16 bp, H. sapiens
atataccatatttcat

SEQ ID NO: 46723 - DNA, 16 bp, H. sapiens
atatacccaaaagaat

SEQ ID NO: 46724 - DNA, 16 bp, H. sapiens
atatacccaaagcaat

SEQ ID NO: 46725 - DNA, 16 bp, H. sapiens
atataccctttaccca

SEQ ID NO: 46726 - DNA, 16 bp, H. sapiens
atatacctaaagaaat

SEQ ID NO: 46727 - DNA, 16 bp, H. sapiens
atatacctatataata

SEQ ID NO: 46728 - DNA, 16 bp, H. sapiens
atatacctatatatgt

SEQ ID NO: 46729 - DNA, 16 bp, H. sapiens
atatacctgtatatgt

SEQ ID NO: 46730 - DNA, 16 bp, H. sapiens
atatacgcatatatat

SEQ ID NO: 46731 - DNA, 16 bp, H. sapiens
atatacgtatatacac

SEQ ID NO: 46732 - DNA, 16 bp, H. sapiens
atatacgtgtgcatgt

SEQ ID NO: 46733 - DNA, 16 bp, H. sapiens
atatactaaatgccac

SEQ ID NO: 46734 - DNA, 16 bp, H. sapiens
atatactaaatgtata

SEQ ID NO: 46735 - DNA, 16 bp, H. sapiens
atatactatatacatt

SEQ ID NO: 46736 - DNA, 16 bp, H. sapiens
atatactatatgatat

SEQ ID NO: 46737 - DNA, 16 bp, H. sapiens
atatactatatgtaat

SEQ ID NO: 46738 - DNA, 16 bp, H. sapiens
atatactatgtatttt

SEQ ID NO: 46739 - DNA, 16 bp, H. sapiens
atatactatgtttttc

SEQ ID NO: 46740 - DNA, 16 bp, H. sapiens
atatactcagtaatga

SEQ ID NO: 46741 - DNA, 16 bp, H. sapiens
atatactgaaatatgt

SEQ ID NO: 46742 - DNA, 16 bp, H. sapiens
atatactgaaatattt

SEQ ID NO: 46743 - DNA, 16 bp, H. sapiens
atatactgctggtggg

SEQ ID NO: 46744 - DNA, 16 bp, H. sapiens
atatactgtaatatat

SEQ ID NO: 46745 - DNA, 16 bp, H. sapiens
atatactgtatatata

SEQ ID NO: 46746 - DNA, 16 bp, H. sapiens
atatactgtatgattt

SEQ ID NO: 46747 - DNA, 16 bp, H. sapiens
atatacttaaaaatgg

SEQ ID NO: 46748 - DNA, 16 bp, H. sapiens
atatacttgtatctat

SEQ ID NO: 46749 - DNA, 16 bp, H. sapiens
atatacttgtttgcca

SEQ ID NO: 46750 - DNA, 16 bp, H. sapiens
atatagaaaaatacat

SEQ ID NO: 46751 - DNA, 16 bp, H. sapiens
atatagaaaatacata

SEQ ID NO: 46752 - DNA, 16 bp, H. sapiens
atatagaaaatcctaa

SEQ ID NO: 46753 - DNA, 16 bp, H. sapiens
atatagaaacattttt

SEQ ID NO: 46754 - DNA, 16 bp, H. sapiens
atatagaaatacaatt

SEQ ID NO: 46755 - DNA, 16 bp, H. sapiens
atatagaacaatggaa

SEQ ID NO: 46756 - DNA, 16 bp, H. sapiens
atatagacacatacac

SEQ ID NO: 46757 - DNA, 16 bp, H. sapiens
atatagaccaattgaa

SEQ ID NO: 46758 - DNA, 16 bp, H. sapiens
atatagagaaaaatgt

SEQ ID NO: 46759 - DNA, 16 bp, H. sapiens
atatagagatatatat

SEQ ID NO: 46760 - DNA, 16 bp, H. sapiens
atatagagatatatgt

SEQ ID NO: 46761 - DNA, 16 bp, H. sapiens
atatagatatatgtaa

SEQ ID NO: 46762 - DNA, 16 bp, H. sapiens
atatagatcagtggaa

SEQ ID NO: 46763 - DNA, 16 bp, H. sapiens
atatagatgatagata

SEQ ID NO: 46764 - DNA, 16 bp, H. sapiens
atatagcagtgaacaa

SEQ ID NO: 46765 - DNA, 16 bp, H. sapiens
atatagcatataaata

SEQ ID NO: 46766 - DNA, 16 bp, H. sapiens
atatagcatttttaaa

SEQ ID NO: 46767 - DNA, 16 bp, H. sapiens
atatagccaagaaaat

SEQ ID NO: 46768 - DNA, 16 bp, H. sapiens
atatagcctgggtgtg

SEQ ID NO: 46769 - DNA, 16 bp, H. sapiens
atatagctatatataa

SEQ ID NO: 46770 - DNA, 16 bp, H. sapiens
atatagctttattttt

SEQ ID NO: 46771 - DNA, 16 bp, H. sapiens
atataggaagtatata

SEQ ID NO: 46772 - DNA, 16 bp, H. sapiens
atataggtaccacatt

SEQ ID NO: 46773 - DNA, 16 bp, H. sapiens
atataggtatatagat

SEQ ID NO: 46774 - DNA, 16 bp, H. sapiens
atataggtattattat

SEQ ID NO: 46775 - DNA, 16 bp, H. sapiens
atatagtagatgctca

SEQ ID NO: 46776 - DNA, 16 bp, H. sapiens
atatagtctttttcag

SEQ ID NO: 46777 - DNA, 21 bp, H. sapiens
atatagtgaaaccctgtctct

SEQ ID NO: 46778 - DNA, 16 bp, H. sapiens
atatagtgtgtgtgtg

SEQ ID NO: 46779 - DNA, 16 bp, H. sapiens
atatagtttcaaataa

SEQ ID NO: 46780 - DNA, 16 bp, H. sapiens
atatagttttcaaaat

SEQ ID NO: 46781 - DNA, 16 bp, H. sapiens
atatataaaataggtg

SEQ ID NO: 46782 - DNA, 16 bp, H. sapiens
atatataaaatggaga

SEQ ID NO: 46783 - DNA, 16 bp, H. sapiens
atatataaaatgtgtg

SEQ ID NO: 46784 - DNA, 16 bp, H. sapiens
atatataaacatagaa

SEQ ID NO: 46785 - DNA, 16 bp, H. sapiens
atatataaagacatat

SEQ ID NO: 46786 - DNA, 16 bp, H. sapiens
atatataaagtacata

SEQ ID NO: 46787 - DNA, 16 bp, H. sapiens
atatataaagtttctt

SEQ ID NO: 46788 - DNA, 16 bp, H. sapiens
atatataaatatatgc

SEQ ID NO: 46789 - DNA, 16 bp, H. sapiens
atatataaatggtata

SEQ ID NO: 46790 - DNA, 16 bp, H. sapiens
atatataagatgtata

SEQ ID NO: 46791 - DNA, 16 bp, H. sapiens
atatataatatatcca

SEQ ID NO: 46792 - DNA, 16 bp, H. sapiens
atatataatcctatat

SEQ ID NO: 46793 - DNA, 16 bp, H. sapiens
atatataatttaccat

SEQ ID NO: 46794 - DNA, 16 bp, H. sapiens
atatatacaatgtaat

SEQ ID NO: 46795 - DNA, 16 bp, H. sapiens
atatatacaatgttta

SEQ ID NO: 46796 - DNA, 16 bp, H. sapiens
atatatacacacacag

SEQ ID NO: 46797 - DNA, 16 bp, H. sapiens
atatatacacacatat

SEQ ID NO: 46798 - DNA, 16 bp, H. sapiens
atatatacacacattg

SEQ ID NO: 46799 - DNA, 16 bp, H. sapiens
atatatacacacccaa

SEQ ID NO: 46800 - DNA, 16 bp, H. sapiens
atatatacacattaga

SEQ ID NO: 46801 - DNA, 16 bp, H. sapiens
atatatacacatttgt

SEQ ID NO: 46802 - DNA, 16 bp, H. sapiens
atatatacagatacat

SEQ ID NO: 46803 - DNA, 16 bp, H. sapiens
atatatacaggatata

SEQ ID NO: 46804 - DNA, 16 bp, H. sapiens
atatatacagtatata

SEQ ID NO: 46805 - DNA, 16 bp, H. sapiens
atatatacataaatgt

SEQ ID NO: 46806 - DNA, 16 bp, H. sapiens
atatatacatagttta

SEQ ID NO: 46807 - DNA, 16 bp, H. sapiens
atatatacatagtttt

SEQ ID NO: 46808 - DNA, 16 bp, H. sapiens
atatatacatatatgt

SEQ ID NO: 46809 - DNA, 16 bp, H. sapiens
atatatacatatgtaa

SEQ ID NO: 46810 - DNA, 16 bp, H. sapiens
atatatacatctatat

SEQ ID NO: 46811 - DNA, 16 bp, H. sapiens
atatatacatgtatac

SEQ ID NO: 46812 - DNA, 16 bp, H. sapiens
atatatacatgtgttt

SEQ ID NO: 46813 - DNA, 16 bp, H. sapiens
atatatacatttctct

SEQ ID NO: 46814 - DNA, 16 bp, H. sapiens
atatatacattttact

SEQ ID NO: 46815 - DNA, 16 bp, H. sapiens
atatataccattttta

SEQ ID NO: 46816 - DNA, 16 bp, H. sapiens
atatataccttataca

SEQ ID NO: 46817 - DNA, 16 bp, H. sapiens
atatatacgtgtgtat

SEQ ID NO: 46818 - DNA, 16 bp, H. sapiens
atatatactcatatat

SEQ ID NO: 46819 - DNA, 16 bp, H. sapiens
atatatactgaaaata

SEQ ID NO: 46820 - DNA, 16 bp, H. sapiens
atatatactgtatata

SEQ ID NO: 46821 - DNA, 16 bp, H. sapiens
atatatactgtgaaat

SEQ ID NO: 46822 - DNA, 16 bp, H. sapiens
atatatacttatatgt

SEQ ID NO: 46823 - DNA, 16 bp, H. sapiens
atatatagaaacatat

SEQ ID NO: 46824 - DNA, 16 bp, H. sapiens
atatatagagagagag

SEQ ID NO: 46825 - DNA, 16 bp, H. sapiens
atatatagagagatat

SEQ ID NO: 46826 - DNA, 16 bp, H. sapiens
atatatagatagatat

SEQ ID NO: 46827 - DNA, 16 bp, H. sapiens
atatatagatggaaaa

SEQ ID NO: 46828 - DNA, 16 bp, H. sapiens
atatatagcatattat

SEQ ID NO: 46829 - DNA, 16 bp, H. sapiens
atatataggatatata

SEQ ID NO: 46830 - DNA, 19 bp, H. sapiens
atatatatacacatatatg

SEQ ID NO: 46831 - DNA, 16 bp, H. sapiens
atatatatacccacat

SEQ ID NO: 46832 - DNA, 16 bp, H. sapiens
atatatatactatgtt

SEQ ID NO: 46833 - DNA, 16 bp, H. sapiens
atatatatagacacac

SEQ ID NO: 46834 - DNA, 16 bp, H. sapiens
atatatatataattcc

SEQ ID NO: 46835 - DNA, 16 bp, H. sapiens
atatatatatagacac

SEQ ID NO: 46836 - DNA, 16 bp, H. sapiens
atatatatatagtggt

SEQ ID NO: 46837 - DNA, 16 bp, H. sapiens
atatatatatatgcac

SEQ ID NO: 46838 - DNA, 16 bp, H. sapiens
atatatatatatgcag

SEQ ID NO: 46839 - DNA, 16 bp, H. sapiens
atatatatatatgctc

SEQ ID NO: 46840 - DNA, 16 bp, H. sapiens
atatatatatatgctt

SEQ ID NO: 46841 - DNA, 16 bp, H. sapiens
atatatatatatgtgc

SEQ ID NO: 46842 - DNA, 16 bp, H. sapiens
atatatatatctctct

SEQ ID NO: 46843 - DNA, 16 bp, H. sapiens
atatatatatctgaaa

SEQ ID NO: 46844 - DNA, 16 bp, H. sapiens
atatatatatgaagag

SEQ ID NO: 46845 - DNA, 16 bp, H. sapiens
atatatatatggattt

SEQ ID NO: 46846 - DNA, 16 bp, H. sapiens
atatatatatgtatga

SEQ ID NO: 46847 - DNA, 16 bp, H. sapiens
atatatatatgtgtgt

SEQ ID NO: 46848 - DNA, 16 bp, H. sapiens
atatatatattcccat

SEQ ID NO: 46849 - DNA, 16 bp, H. sapiens
atatatatattcttcc

SEQ ID NO: 46850 - DNA, 16 bp, H. sapiens
atatatatattcttgt

SEQ ID NO: 46851 - DNA, 16 bp, H. sapiens
atatatatccatatat

SEQ ID NO: 46852 - DNA, 16 bp, H. sapiens
atatatatctatctat

SEQ ID NO: 46853 - DNA, 16 bp, H. sapiens
atatatatctatctta

SEQ ID NO: 46854 - DNA, 16 bp, H. sapiens
atatatatctccattt

SEQ ID NO: 46855 - DNA, 16 bp, H. sapiens
atatatatctgataaa

SEQ ID NO: 46856 - DNA, 16 bp, H. sapiens
atatatatcttatatg

SEQ ID NO: 46857 - DNA, 16 bp, H. sapiens
atatatatgacatttt

SEQ ID NO: 46858 - DNA, 16 bp, H. sapiens
atatatatgatatcat

SEQ ID NO: 46859 - DNA, 16 bp, H. sapiens
atatatatgcaatgaa

SEQ ID NO: 46860 - DNA, 16 bp, H. sapiens
atatatatgcatgcat

SEQ ID NO: 46861 - DNA, 16 bp, H. sapiens
atatatatgcatgtgt

SEQ ID NO: 46862 - DNA, 16 bp, H. sapiens
atatatatgctatttt

SEQ ID NO: 46863 - DNA, 16 bp, H. sapiens
atatatatgctcccaa

SEQ ID NO: 46864 - DNA, 16 bp, H. sapiens
atatatatggttatat

SEQ ID NO: 46865 - DNA, 16 bp, H. sapiens
atatatatgtaggata

SEQ ID NO: 46866 - DNA, 16 bp, H. sapiens
atatatatgtatagac

SEQ ID NO: 46867 - DNA, 16 bp, H. sapiens
atatatatgtatctat

SEQ ID NO: 46868 - DNA, 16 bp, H. sapiens
atatatatgtatgtgt

SEQ ID NO: 46869 - DNA, 16 bp, H. sapiens
atatatatgtcaatat

SEQ ID NO: 46870 - DNA, 16 bp, H. sapiens
atatatatgtctgtat

SEQ ID NO: 46871 - DNA, 16 bp, H. sapiens
atatatatgtctttta

SEQ ID NO: 46872 - DNA, 16 bp, H. sapiens
atatatatgtggaata

SEQ ID NO: 46873 - DNA, 16 bp, H. sapiens
atatatatgtgtatgt

SEQ ID NO: 46874 - DNA, 16 bp, H. sapiens
atatatatgtgtctgt

SEQ ID NO: 46875 - DNA, 16 bp, H. sapiens
atatatatgttaacta

SEQ ID NO: 46876 - DNA, 16 bp, H. sapiens
atatatatgttacata

SEQ ID NO: 46877 - DNA, 16 bp, H. sapiens
atatatatgttgatat

SEQ ID NO: 46878 - DNA, 16 bp, H. sapiens
atatatatgtttctgt

SEQ ID NO: 46879 - DNA, 16 bp, H. sapiens
atatatattagatgta

SEQ ID NO: 46880 - DNA, 16 bp, H. sapiens
atatatattcacacat

SEQ ID NO: 46881 - DNA, 16 bp, H. sapiens
atatatattcagaata

SEQ ID NO: 46882 - DNA, 16 bp, H. sapiens
atatatatttactgaa

SEQ ID NO: 46883 - DNA, 16 bp, H. sapiens
atatatatttccaaat

SEQ ID NO: 46884 - DNA, 16 bp, H. sapiens
atatatatttctagaa

SEQ ID NO: 46885 - DNA, 16 bp, H. sapiens
atatatatttggaata

SEQ ID NO: 46886 - DNA, 16 bp, H. sapiens
atatatatttgtactt

SEQ ID NO: 46887 - DNA, 16 bp, H. sapiens
atatatatttgtagaa

SEQ ID NO: 46888 - DNA, 16 bp, H. sapiens
atatatatttgtgtgt

SEQ ID NO: 46889 - DNA, 16 bp, H. sapiens
atatatattttgcata

SEQ ID NO: 46890 - DNA, 16 bp, H. sapiens
atatatatttttgggg

SEQ ID NO: 46891 - DNA, 16 bp, H. sapiens
atatatcaaatcatca

SEQ ID NO: 46892 - DNA, 16 bp, H. sapiens
atatatccaaaaggaa

SEQ ID NO: 46893 - DNA, 16 bp, H. sapiens
atatatccaaaggaac

SEQ ID NO: 46894 - DNA, 16 bp, H. sapiens
atatatccacgtaaca

SEQ ID NO: 46895 - DNA, 16 bp, H. sapiens
atatatccagaagaaa

SEQ ID NO: 46896 - DNA, 16 bp, H. sapiens
atatatccagtaatag

SEQ ID NO: 46897 - DNA, 16 bp, H. sapiens
atatatccatctgaca

SEQ ID NO: 46898 - DNA, 16 bp, H. sapiens
atatatcctatatata

SEQ ID NO: 46899 - DNA, 16 bp, H. sapiens
atatatcctatatatt

SEQ ID NO: 46900 - DNA, 16 bp, H. sapiens
atatatctagaaaacc

SEQ ID NO: 46901 - DNA, 17 bp, H. sapiens
atatatctagaaaaccc

SEQ ID NO: 46902 - DNA, 16 bp, H. sapiens
atatatctatctgtat

SEQ ID NO: 46903 - DNA, 16 bp, H. sapiens
atatatctctatctct

SEQ ID NO: 46904 - DNA, 16 bp, H. sapiens
atatatctgtatattt

SEQ ID NO: 46905 - DNA, 16 bp, H. sapiens
atatatcttacatata

SEQ ID NO: 46906 - DNA, 16 bp, H. sapiens
atatatgaaaacaata

SEQ ID NO: 46907 - DNA, 16 bp, H. sapiens
atatatgaaacataaa

SEQ ID NO: 46908 - DNA, 16 bp, H. sapiens
atatatgaaatgtata

SEQ ID NO: 46909 - DNA, 16 bp, H. sapiens
atatatgaatgaatat

SEQ ID NO: 46910 - DNA, 16 bp, H. sapiens
atatatgaatgaatga

SEQ ID NO: 46911 - DNA, 16 bp, H. sapiens
atatatgacatatttt

SEQ ID NO: 46912 - DNA, 16 bp, H. sapiens
atatatgacattttct

SEQ ID NO: 46913 - DNA, 16 bp, H. sapiens
atatatgatatatatg

SEQ ID NO: 46914 - DNA, 16 bp, H. sapiens
atatatgatgtatatt

SEQ ID NO: 46915 - DNA, 16 bp, H. sapiens
atatatgattttcaaa

SEQ ID NO: 46916 - DNA, 16 bp, H. sapiens
atatatgattttcttt

SEQ ID NO: 46917 - DNA, 16 bp, H. sapiens
atatatgcaaataaat

SEQ ID NO: 46918 - DNA, 16 bp, H. sapiens
atatatgcaaatataa

SEQ ID NO: 46919 - DNA, 16 bp, H. sapiens
atatatgcaatatata

SEQ ID NO: 46920 - DNA, 16 bp, H. sapiens
atatatgcaatatatt

SEQ ID NO: 46921 - DNA, 16 bp, H. sapiens
atatatgcacaaaata

SEQ ID NO: 46922 - DNA, 16 bp, H. sapiens
atatatgcacatgcat

SEQ ID NO: 46923 - DNA, 16 bp, H. sapiens
atatatgcagccaaca

SEQ ID NO: 46924 - DNA, 16 bp, H. sapiens
atatatgcatgggttt

SEQ ID NO: 46925 - DNA, 16 bp, H. sapiens
atatatgcatgtatat

SEQ ID NO: 46926 - DNA, 16 bp, H. sapiens
atatatgcatgtgtgt

SEQ ID NO: 46927 - DNA, 16 bp, H. sapiens
atatatgctatatatt

SEQ ID NO: 46928 - DNA, 16 bp, H. sapiens
atatatgctttctttt

SEQ ID NO: 46929 - DNA, 16 bp, H. sapiens
atatatggactttatt

SEQ ID NO: 46930 - DNA, 16 bp, H. sapiens
atatatgggaaaatat

SEQ ID NO: 46931 - DNA, 16 bp, H. sapiens
atatatggtactcttt

SEQ ID NO: 46932 - DNA, 16 bp, H. sapiens
atatatggtatatata

SEQ ID NO: 46933 - DNA, 16 bp, H. sapiens
atatatgtaaaaatct

SEQ ID NO: 46934 - DNA, 16 bp, H. sapiens
atatatgtaaaacata

SEQ ID NO: 46935 - DNA, 16 bp, H. sapiens
atatatgtaaaatgtt

SEQ ID NO: 46936 - DNA, 16 bp, H. sapiens
atatatgtaacttttt

SEQ ID NO: 46937 - DNA, 16 bp, H. sapiens
atatatgtaatataca

SEQ ID NO: 46938 - DNA, 16 bp, H. sapiens
atatatgtacataaat

SEQ ID NO: 46939 - DNA, 16 bp, H. sapiens
atatatgtacatacat

SEQ ID NO: 46940 - DNA, 16 bp, H. sapiens
atatatgtataaatgt

SEQ ID NO: 46941 - DNA, 16 bp, H. sapiens
atatatgtatacattt

SEQ ID NO: 46942 - DNA, 16 bp, H. sapiens
atatatgtatataaag

SEQ ID NO: 46943 - DNA, 16 bp, H. sapiens
atatatgtatatacac

SEQ ID NO: 46944 - DNA, 16 bp, H. sapiens
atatatgtatatagat

SEQ ID NO: 46945 - DNA, 16 bp, H. sapiens
atatatgtatatatga

SEQ ID NO: 46946 - DNA, 16 bp, H. sapiens
atatatgtatatatgg

SEQ ID NO: 46947 - DNA, 16 bp, H. sapiens
atatatgtatatccca

SEQ ID NO: 46948 - DNA, 16 bp, H. sapiens
atatatgtatatgtgt

SEQ ID NO: 46949 - DNA, 16 bp, H. sapiens
atatatgtatgtacat

SEQ ID NO: 46950 - DNA, 16 bp, H. sapiens
atatatgtatgtatct

SEQ ID NO: 46951 - DNA, 16 bp, H. sapiens
atatatgtatgtatgc

SEQ ID NO: 46952 - DNA, 16 bp, H. sapiens
atatatgtatgtatta

SEQ ID NO: 46953 - DNA, 16 bp, H. sapiens
atatatgtgcatgtat

SEQ ID NO: 46954 - DNA, 16 bp, H. sapiens
atatatgtgcttcttt

SEQ ID NO: 46955 - DNA, 16 bp, H. sapiens
atatatgtgtatatat

SEQ ID NO: 46956 - DNA, 16 bp, H. sapiens
atatatgtgtatatgt

SEQ ID NO: 46957 - DNA, 16 bp, H. sapiens
atatatgtgtgcatgt

SEQ ID NO: 46958 - DNA, 16 bp, H. sapiens
atatatgtgtgtatac

SEQ ID NO: 46959 - DNA, 16 bp, H. sapiens
atatatgtgtgtatct

SEQ ID NO: 46960 - DNA, 16 bp, H. sapiens
atatatgtgtgtgcgt

SEQ ID NO: 46961 - DNA, 17 bp, H. sapiens
atatatgtgtgtgtatg

SEQ ID NO: 46962 - DNA, 16 bp, H. sapiens
atatatgtgtgtttat

SEQ ID NO: 46963 - DNA, 16 bp, H. sapiens
atatatgttgattgat

SEQ ID NO: 46964 - DNA, 16 bp, H. sapiens
atatatgtttcatttt

SEQ ID NO: 46965 - DNA, 16 bp, H. sapiens
atatatgtttgtgtat

SEQ ID NO: 46966 - DNA, 16 bp, H. sapiens
atatatgttttgaaaa

SEQ ID NO: 46967 - DNA, 16 bp, H. sapiens
atatattaatatatgc

SEQ ID NO: 46968 - DNA, 16 bp, H. sapiens
atatattacaaagtta

SEQ ID NO: 46969 - DNA, 16 bp, H. sapiens
atatattacatattca

SEQ ID NO: 46970 - DNA, 16 bp, H. sapiens
atatattatatgcaat

SEQ ID NO: 46971 - DNA, 16 bp, H. sapiens
atatattatggatata

SEQ ID NO: 46972 - DNA, 16 bp, H. sapiens
atatattatgtacata

SEQ ID NO: 46973 - DNA, 16 bp, H. sapiens
atatattattgcattt

SEQ ID NO: 46974 - DNA, 16 bp, H. sapiens
atatattcaaagtgta

SEQ ID NO: 46975 - DNA, 16 bp, H. sapiens
atatattcaaatacat

SEQ ID NO: 46976 - DNA, 16 bp, H. sapiens
atatattcaaatatgt

SEQ ID NO: 46977 - DNA, 16 bp, H. sapiens
atatattcaagaaata

SEQ ID NO: 46978 - DNA, 16 bp, H. sapiens
atatattcaaggtgta

SEQ ID NO: 46979 - DNA, 16 bp, H. sapiens
atatattcatgtaata

SEQ ID NO: 46980 - DNA, 16 bp, H. sapiens
atatattccatgtata

SEQ ID NO: 46981 - DNA, 16 bp, H. sapiens
atatattcctttaaaa

SEQ ID NO: 46982 - DNA, 16 bp, H. sapiens
atatattctggttgtt

SEQ ID NO: 46983 - DNA, 16 bp, H. sapiens
atatattgacatatat

SEQ ID NO: 46984 - DNA, 16 bp, H. sapiens
atatattgataaaagg

SEQ ID NO: 46985 - DNA, 16 bp, H. sapiens
atatattgttttcatt

SEQ ID NO: 46986 - DNA, 16 bp, H. sapiens
atatatttaaagtgct

SEQ ID NO: 46987 - DNA, 16 bp, H. sapiens
atatatttaaagtgta

SEQ ID NO: 46988 - DNA, 16 bp, H. sapiens
atatatttaaatccat

SEQ ID NO: 46989 - DNA, 16 bp, H. sapiens
atatatttaaatttgc

SEQ ID NO: 46990 - DNA, 16 bp, H. sapiens
atatatttacatgtaa

SEQ ID NO: 46991 - DNA, 16 bp, H. sapiens
atatatttatgaagta

SEQ ID NO: 46992 - DNA, 16 bp, H. sapiens
atatatttatgggaca

SEQ ID NO: 46993 - DNA, 16 bp, H. sapiens
atatatttcaagacaa

SEQ ID NO: 46994 - DNA, 16 bp, H. sapiens
atatatttcatgttca

SEQ ID NO: 46995 - DNA, 16 bp, H. sapiens
atatatttctaaaaca

SEQ ID NO: 46996 - DNA, 16 bp, H. sapiens
atatatttctatgtgt

SEQ ID NO: 46997 - DNA, 16 bp, H. sapiens
atatatttctctaggt

SEQ ID NO: 46998 - DNA, 16 bp, H. sapiens
atatatttctgaatat

SEQ ID NO: 46999 - DNA, 16 bp, H. sapiens
atatatttgaaaacca

SEQ ID NO: 47000 - DNA, 16 bp, H. sapiens
atatatttgaaatttg

SEQ ID NO: 47001 - DNA, 16 bp, H. sapiens
atatatttgaatgcat

SEQ ID NO: 47002 - DNA, 16 bp, H. sapiens
atatatttgaatgtat

SEQ ID NO: 47003 - DNA, 16 bp, H. sapiens
atatatttgacatttt

SEQ ID NO: 47004 - DNA, 16 bp, H. sapiens
atatatttgagatata

SEQ ID NO: 47005 - DNA, 16 bp, H. sapiens
atatatttgcattttt

SEQ ID NO: 47006 - DNA, 16 bp, H. sapiens
atatatttgggtcttg

SEQ ID NO: 47007 - DNA, 16 bp, H. sapiens
atatatttgtaaaaga

SEQ ID NO: 47008 - DNA, 16 bp, H. sapiens
atatatttgtgtacat

SEQ ID NO: 47009 - DNA, 16 bp, H. sapiens
atatatttgtgtgtgt

SEQ ID NO: 47010 - DNA, 16 bp, H. sapiens
atatattttaaaagga

SEQ ID NO: 47011 - DNA, 16 bp, H. sapiens
atatattttaacacaa

SEQ ID NO: 47012 - DNA, 16 bp, H. sapiens
atatattttaagtgat

SEQ ID NO: 47013 - DNA, 16 bp, H. sapiens
atatattttagacatt

SEQ ID NO: 47014 - DNA, 16 bp, H. sapiens
atatattttcaaaaga

SEQ ID NO: 47015 - DNA, 16 bp, H. sapiens
atatattttcaaaagt

SEQ ID NO: 47016 - DNA, 16 bp, H. sapiens
atatattttctaaaac

SEQ ID NO: 47017 - DNA, 16 bp, H. sapiens
atatattttgaatgta

SEQ ID NO: 47018 - DNA, 16 bp, H. sapiens
atatattttgcaaaat

SEQ ID NO: 47019 - DNA, 16 bp, H. sapiens
atatattttggaggta

SEQ ID NO: 47020 - DNA, 16 bp, H. sapiens
atatattttgggtatt

SEQ ID NO: 47021 - DNA, 16 bp, H. sapiens
atatattttgtcattt

SEQ ID NO: 47022 - DNA, 16 bp, H. sapiens
atatatttttacatgt

SEQ ID NO: 47023 - DNA, 16 bp, H. sapiens
atatatttttaccaca

SEQ ID NO: 47024 - DNA, 16 bp, H. sapiens
atatatttttaggata

SEQ ID NO: 47025 - DNA, 16 bp, H. sapiens
atatatttttcaaaga

SEQ ID NO: 47026 - DNA, 16 bp, H. sapiens
atatatttttctatgt

SEQ ID NO: 47027 - DNA, 16 bp, H. sapiens
atatatttttgagaaa

SEQ ID NO: 47028 - DNA, 16 bp, H. sapiens
atatatttttgcattt

SEQ ID NO: 47029 - DNA, 16 bp, H. sapiens
atatatttttgtacat

SEQ ID NO: 47030 - DNA, 16 bp, H. sapiens
atatattttttggtag

SEQ ID NO: 47031 - DNA, 16 bp, H. sapiens
atatcaaaaagatatc

SEQ ID NO: 47032 - DNA, 16 bp, H. sapiens
atatcaaagagaaaat

SEQ ID NO: 47033 - DNA, 16 bp, H. sapiens
atatcaacaaagagaa

SEQ ID NO: 47034 - DNA, 16 bp, H. sapiens
atatcaacagaataaa

SEQ ID NO: 47035 - DNA, 16 bp, H. sapiens
atatcaagctgaaaat

SEQ ID NO: 47036 - DNA, 16 bp, H. sapiens
atatcaaggacttgag

SEQ ID NO: 47037 - DNA, 16 bp, H. sapiens
atatcaagtattttct

SEQ ID NO: 47038 - DNA, 16 bp, H. sapiens
atatcaatgaaatcat

SEQ ID NO: 47039 - DNA, 16 bp, H. sapiens
atatcaatgaataaaa

SEQ ID NO: 47040 - DNA, 16 bp, H. sapiens
atatcaatgtaaggac

SEQ ID NO: 47041 - DNA, 16 bp, H. sapiens
atatcacaccaaaagc

SEQ ID NO: 47042 - DNA, 16 bp, H. sapiens
atatcacaggaagaaa

SEQ ID NO: 47043 - DNA, 16 bp, H. sapiens
atatcaccaaagaaaa

SEQ ID NO: 47044 - DNA, 16 bp, H. sapiens
atatcacctgaggtca

SEQ ID NO: 47045 - DNA, 16 bp, H. sapiens
atatcactgaaagaag

SEQ ID NO: 47046 - DNA, 16 bp, H. sapiens
atatcacttttaaaat

SEQ ID NO: 47047 - DNA, 16 bp, H. sapiens
atatcagaaatatata

SEQ ID NO: 47048 - DNA, 16 bp, H. sapiens
atatcagaatttaaaa

SEQ ID NO: 47049 - DNA, 16 bp, H. sapiens
atatcagataaaacaa

SEQ ID NO: 47050 - DNA, 16 bp, H. sapiens
atatcagggtaatgct

SEQ ID NO: 47051 - DNA, 16 bp, H. sapiens
atatcagtgagaatat

SEQ ID NO: 47052 - DNA, 16 bp, H. sapiens
atatcataatatcaca

SEQ ID NO: 47053 - DNA, 16 bp, H. sapiens
atatcataatttgttt

SEQ ID NO: 47054 - DNA, 16 bp, H. sapiens
atatcatagttgtaca

SEQ ID NO: 47055 - DNA, 16 bp, H. sapiens
atatcatatgtattat

SEQ ID NO: 47056 - DNA, 16 bp, H. sapiens
atatcatcaagaaata

SEQ ID NO: 47057 - DNA, 16 bp, H. sapiens
atatcatccaggagaa

SEQ ID NO: 47058 - DNA, 16 bp, H. sapiens
atatcatctgcaaaca

SEQ ID NO: 47059 - DNA, 16 bp, H. sapiens
atatcattaacatttt

SEQ ID NO: 47060 - DNA, 16 bp, H. sapiens
atatcattcactaaaa

SEQ ID NO: 47061 - DNA, 16 bp, H. sapiens
atatcattcatgagaa

SEQ ID NO: 47062 - DNA, 16 bp, H. sapiens
atatcattctgccccg

SEQ ID NO: 47063 - DNA, 16 bp, H. sapiens
atatcattgatatttt

SEQ ID NO: 47064 - DNA, 16 bp, H. sapiens
atatcattgtcttcca

SEQ ID NO: 47065 - DNA, 16 bp, H. sapiens
atatccaatgaaaata

SEQ ID NO: 47066 - DNA, 16 bp, H. sapiens
atatccacaccaacat

SEQ ID NO: 47067 - DNA, 16 bp, H. sapiens
atatccacatgcagag

SEQ ID NO: 47068 - DNA, 16 bp, H. sapiens
atatccagaaaaatta

SEQ ID NO: 47069 - DNA, 16 bp, H. sapiens
atatccagaaggggag

SEQ ID NO: 47070 - DNA, 16 bp, H. sapiens
atatccagctaatttt

SEQ ID NO: 47071 - DNA, 16 bp, H. sapiens
atatccaggtttccca

SEQ ID NO: 47072 - DNA, 16 bp, H. sapiens
atatccagttgtttca

SEQ ID NO: 47073 - DNA, 16 bp, H. sapiens
atatccagtttctcca

SEQ ID NO: 47074 - DNA, 16 bp, H. sapiens
atatccatacaacaga

SEQ ID NO: 47075 - DNA, 16 bp, H. sapiens
atatccatacaatgga

SEQ ID NO: 47076 - DNA, 16 bp, H. sapiens
atatccatccattcat

SEQ ID NO: 47077 - DNA, 16 bp, H. sapiens
atatccatgtaacaaa

SEQ ID NO: 47078 - DNA, 16 bp, H. sapiens
atatccatgtggaaaa

SEQ ID NO: 47079 - DNA, 16 bp, H. sapiens
atatccctgataaata

SEQ ID NO: 47080 - DNA, 16 bp, H. sapiens
atatccctgatgagca

SEQ ID NO: 47081 - DNA, 16 bp, H. sapiens
atatcctattgattct

SEQ ID NO: 47082 - DNA, 16 bp, H. sapiens
atatcctcttcaaggg

SEQ ID NO: 47083 - DNA, 16 bp, H. sapiens
atatcctctttgtcat

SEQ ID NO: 47084 - DNA, 16 bp, H. sapiens
atatcctgccctttcc

SEQ ID NO: 47085 - DNA, 16 bp, H. sapiens
atatcctggatgaaca

SEQ ID NO: 47086 - DNA, 16 bp, H. sapiens
atatccttaacaaaat

SEQ ID NO: 47087 - DNA, 16 bp, H. sapiens
atatctagttttccca

SEQ ID NO: 47088 - DNA, 16 bp, H. sapiens
atatctagtttttcca

SEQ ID NO: 47089 - DNA, 16 bp, H. sapiens
atatctatatagatgt

SEQ ID NO: 47090 - DNA, 16 bp, H. sapiens
atatctatatatatga

SEQ ID NO: 47091 - DNA, 16 bp, H. sapiens
atatctatatatctgt

SEQ ID NO: 47092 - DNA, 16 bp, H. sapiens
atatctatatatgtat

SEQ ID NO: 47093 - DNA, 16 bp, H. sapiens
atatctatatctatat

SEQ ID NO: 47094 - DNA, 16 bp, H. sapiens
atatctatatctctat

SEQ ID NO: 47095 - DNA, 16 bp, H. sapiens
atatctatctatctgt

SEQ ID NO: 47096 - DNA, 16 bp, H. sapiens
atatctatgtatacat

SEQ ID NO: 47097 - DNA, 16 bp, H. sapiens
atatctatgtatgtat

SEQ ID NO: 47098 - DNA, 16 bp, H. sapiens
atatctatgtctatat

SEQ ID NO: 47099 - DNA, 16 bp, H. sapiens
atatctattaaagaaa

SEQ ID NO: 47100 - DNA, 16 bp, H. sapiens
atatctcaaaatagta

SEQ ID NO: 47101 - DNA, 16 bp, H. sapiens
atatctcattatgatt

SEQ ID NO: 47102 - DNA, 16 bp, H. sapiens
atatctcatttttaaa

SEQ ID NO: 47103 - DNA, 16 bp, H. sapiens
atatctccccatttcc

SEQ ID NO: 47104 - DNA, 16 bp, H. sapiens
atatctgaaaatgaaa

SEQ ID NO: 47105 - DNA, 16 bp, H. sapiens
atatctgcaaagacct

SEQ ID NO: 47106 - DNA, 16 bp, H. sapiens
atatctgcactcccac

SEQ ID NO: 47107 - DNA, 16 bp, H. sapiens
atatctgccttcattt

SEQ ID NO: 47108 - DNA, 16 bp, H. sapiens
atatctggttttccca

SEQ ID NO: 47109 - DNA, 16 bp, H. sapiens
atatctgtaaaatgga

SEQ ID NO: 47110 - DNA, 16 bp, H. sapiens
atatctgtaatatata

SEQ ID NO: 47111 - DNA, 16 bp, H. sapiens
atatctgtatatatat

SEQ ID NO: 47112 - DNA, 16 bp, H. sapiens
atatctgtatatatct

SEQ ID NO: 47113 - DNA, 16 bp, H. sapiens
atatctgtatatattt

SEQ ID NO: 47114 - DNA, 16 bp, H. sapiens
atatctgtgaagaatg

SEQ ID NO: 47115 - DNA, 16 bp, H. sapiens
atatctgtgggttctg

SEQ ID NO: 47116 - DNA, 16 bp, H. sapiens
atatctgtgtgctcca

SEQ ID NO: 47117 - DNA, 16 bp, H. sapiens
atatctgttaattttc

SEQ ID NO: 47118 - DNA, 16 bp, H. sapiens
atatctgttttggtat

SEQ ID NO: 47119 - DNA, 16 bp, H. sapiens
atatcttatgtaattt

SEQ ID NO: 47120 - DNA, 16 bp, H. sapiens
atatcttcaaaaatat

SEQ ID NO: 47121 - DNA, 16 bp, H. sapiens
atatcttcagaaaaaa

SEQ ID NO: 47122 - DNA, 16 bp, H. sapiens
atatcttccatttctt

SEQ ID NO: 47123 - DNA, 16 bp, H. sapiens
atatcttctcagacca

SEQ ID NO: 47124 - DNA, 16 bp, H. sapiens
atatcttctcttgaga

SEQ ID NO: 47125 - DNA, 16 bp, H. sapiens
atatcttctgtttcat

SEQ ID NO: 47126 - DNA, 16 bp, H. sapiens
atatcttgaaaagttg

SEQ ID NO: 47127 - DNA, 16 bp, H. sapiens
atatcttggatattgt

SEQ ID NO: 47128 - DNA, 16 bp, H. sapiens
atatcttggttgtttc

SEQ ID NO: 47129 - DNA, 16 bp, H. sapiens
atatcttgtgagaact

SEQ ID NO: 47130 - DNA, 16 bp, H. sapiens
atatctttaagaaaaa

SEQ ID NO: 47131 - DNA, 16 bp, H. sapiens
atatctttctctatgt

SEQ ID NO: 47132 - DNA, 16 bp, H. sapiens
atatctttgctattat

SEQ ID NO: 47133 - DNA, 16 bp, H. sapiens
atatctttgtaatttt

SEQ ID NO: 47134 - DNA, 16 bp, H. sapiens
atatctttgtgaattt

SEQ ID NO: 47135 - DNA, 16 bp, H. sapiens
atatctttgttaaatt

SEQ ID NO: 47136 - DNA, 16 bp, H. sapiens
atatgaaaaaaatact

SEQ ID NO: 47137 - DNA, 16 bp, H. sapiens
atatgaaaaaatactt

SEQ ID NO: 47138 - DNA, 16 bp, H. sapiens
atatgaaaaaatgctc

SEQ ID NO: 47139 - DNA, 16 bp, H. sapiens
atatgaaaaacaatta

SEQ ID NO: 47140 - DNA, 16 bp, H. sapiens
atatgaaaactttttt

SEQ ID NO: 47141 - DNA, 16 bp, H. sapiens
atatgaaaagaagctc

SEQ ID NO: 47142 - DNA, 16 bp, H. sapiens
atatgaaaatatgttt

SEQ ID NO: 47143 - DNA, 16 bp, H. sapiens
atatgaaaatcaataa

SEQ ID NO: 47144 - DNA, 16 bp, H. sapiens
atatgaaaatgaattt

SEQ ID NO: 47145 - DNA, 16 bp, H. sapiens
atatgaaaattcattt

SEQ ID NO: 47146 - DNA, 16 bp, H. sapiens
atatgaaacaaatgaa

SEQ ID NO: 47147 - DNA, 16 bp, H. sapiens
atatgaaacatttttt

SEQ ID NO: 47148 - DNA, 16 bp, H. sapiens
atatgaaataaaatct

SEQ ID NO: 47149 - DNA, 16 bp, H. sapiens
atatgaaatatgcatt

SEQ ID NO: 47150 - DNA, 16 bp, H. sapiens
atatgaaatggtgttt

SEQ ID NO: 47151 - DNA, 16 bp, H. sapiens
atatgaaatttggggg

SEQ ID NO: 47152 - DNA, 16 bp, H. sapiens
atatgaacacaaagaa

SEQ ID NO: 47153 - DNA, 21 bp, H. sapiens
atatgaacagacacttctcaa

SEQ ID NO: 47154 - DNA, 16 bp, H. sapiens
atatgaagaaaattca

SEQ ID NO: 47155 - DNA, 16 bp, H. sapiens
atatgaagaaactgaa

SEQ ID NO: 47156 - DNA, 16 bp, H. sapiens
atatgaagaaactgag

SEQ ID NO: 47157 - DNA, 16 bp, H. sapiens
atatgaagaaattgaa

SEQ ID NO: 47158 - DNA, 16 bp, H. sapiens
atatgaagtatctaaa

SEQ ID NO: 47159 - DNA, 16 bp, H. sapiens
atatgaagtcaataaa

SEQ ID NO: 47160 - DNA, 16 bp, H. sapiens
atatgaatataaaaca

SEQ ID NO: 47161 - DNA, 16 bp, H. sapiens
atatgaatggaatcat

SEQ ID NO: 47162 - DNA, 16 bp, H. sapiens
atatgaatggaattat

SEQ ID NO: 47163 - DNA, 16 bp, H. sapiens
atatgaatggctaata

SEQ ID NO: 47164 - DNA, 16 bp, H. sapiens
atatgaatgtaaatat

SEQ ID NO: 47165 - DNA, 16 bp, H. sapiens
atatgaatttcaaaaa

SEQ ID NO: 47166 - DNA, 16 bp, H. sapiens
atatgaattttatgat

SEQ ID NO: 47167 - DNA, 16 bp, H. sapiens
atatgaattttggaga

SEQ ID NO: 47168 - DNA, 16 bp, H. sapiens
atatgacaaaatgctc

SEQ ID NO: 47169 - DNA, 16 bp, H. sapiens
atatgacaagcccaca

SEQ ID NO: 47170 - DNA, 16 bp, H. sapiens
atatgacaattttaaa

SEQ ID NO: 47171 - DNA, 16 bp, H. sapiens
atatgacattctgtaa

SEQ ID NO: 47172 - DNA, 16 bp, H. sapiens
atatgacccagaaatt

SEQ ID NO: 47173 - DNA, 16 bp, H. sapiens
atatgacccagccatt

SEQ ID NO: 47174 - DNA, 16 bp, H. sapiens
atatgactagccagtt

SEQ ID NO: 47175 - DNA, 16 bp, H. sapiens
atatgactgtatttgg

SEQ ID NO: 47176 - DNA, 16 bp, H. sapiens
atatgagagaaaatat

SEQ ID NO: 47177 - DNA, 16 bp, H. sapiens
atatgagatatatatc

SEQ ID NO: 47178 - DNA, 16 bp, H. sapiens
atatgaggggacttca

SEQ ID NO: 47179 - DNA, 16 bp, H. sapiens
atatgagtaagttctt

SEQ ID NO: 47180 - DNA, 16 bp, H. sapiens
atatgagtgagaatat

SEQ ID NO: 47181 - DNA, 16 bp, H. sapiens
atatgataaaatgttt

SEQ ID NO: 47182 - DNA, 16 bp, H. sapiens
atatgataccaaaagt

SEQ ID NO: 47183 - DNA, 16 bp, H. sapiens
atatgatagatatata

SEQ ID NO: 47184 - DNA, 16 bp, H. sapiens
atatgatatatatatg

SEQ ID NO: 47185 - DNA, 16 bp, H. sapiens
atatgatcatcccaat

SEQ ID NO: 47186 - DNA, 16 bp, H. sapiens
atatgatcatgtgatt

SEQ ID NO: 47187 - DNA, 16 bp, H. sapiens
atatgatcatttaaaa

SEQ ID NO: 47188 - DNA, 16 bp, H. sapiens
atatgatcattttaat

SEQ ID NO: 47189 - DNA, 16 bp, H. sapiens
atatgatgaaaatatt

SEQ ID NO: 47190 - DNA, 16 bp, H. sapiens
atatgatggactttgg

SEQ ID NO: 47191 - DNA, 16 bp, H. sapiens
atatgattatatatca

SEQ ID NO: 47192 - DNA, 16 bp, H. sapiens
atatgattctatttat

SEQ ID NO: 47193 - DNA, 16 bp, H. sapiens
atatgatttccaaata

SEQ ID NO: 47194 - DNA, 16 bp, H. sapiens
atatgatttgcaaatg

SEQ ID NO: 47195 - DNA, 16 bp, H. sapiens
atatgatttgtaaata

SEQ ID NO: 47196 - DNA, 16 bp, H. sapiens
atatgcaaaaaaatta

SEQ ID NO: 47197 - DNA, 16 bp, H. sapiens
atatgcaaaaattaaa

SEQ ID NO: 47198 - DNA, 16 bp, H. sapiens
atatgcaaaagaataa

SEQ ID NO: 47199 - DNA, 16 bp, H. sapiens
atatgcaaataaataa

SEQ ID NO: 47200 - DNA, 16 bp, H. sapiens
atatgcaaatatatat

SEQ ID NO: 47201 - DNA, 16 bp, H. sapiens
atatgcaaatatttat

SEQ ID NO: 47202 - DNA, 16 bp, H. sapiens
atatgcaaatcgataa

SEQ ID NO: 47203 - DNA, 16 bp, H. sapiens
atatgcaaatttttaa

SEQ ID NO: 47204 - DNA, 16 bp, H. sapiens
atatgcaagatgaaca

SEQ ID NO: 47205 - DNA, 16 bp, H. sapiens
atatgcaataaaataa

SEQ ID NO: 47206 - DNA, 16 bp, H. sapiens
atatgcaatataaaat

SEQ ID NO: 47207 - DNA, 16 bp, H. sapiens
atatgcaattatatat

SEQ ID NO: 47208 - DNA, 16 bp, H. sapiens
atatgcacatacatgt

SEQ ID NO: 47209 - DNA, 16 bp, H. sapiens
atatgcacatatttat

SEQ ID NO: 47210 - DNA, 16 bp, H. sapiens
atatgcacatgtatgt

SEQ ID NO: 47211 - DNA, 45 bp, H. sapiens
atatgcacccaatacaggagcaccaagattcataaagcaagtcct

SEQ ID NO: 47212 - DNA, 22 bp, H. sapiens
atatgcacctaatacaggagca

SEQ ID NO: 47213 - DNA, 16 bp, H. sapiens
atatgcacttaagttt

SEQ ID NO: 47214 - DNA, 16 bp, H. sapiens
atatgcagaagaagaa

SEQ ID NO: 47215 - DNA, 16 bp, H. sapiens
atatgcagcctttcct

SEQ ID NO: 47216 - DNA, 16 bp, H. sapiens
atatgcataaaataaa

SEQ ID NO: 47217 - DNA, 16 bp, H. sapiens
atatgcataattttaa

SEQ ID NO: 47218 - DNA, 16 bp, H. sapiens
atatgcatacatgtat

SEQ ID NO: 47219 - DNA, 16 bp, H. sapiens
atatgcatatacatgt

SEQ ID NO: 47220 - DNA, 16 bp, H. sapiens
atatgcatatataatt

SEQ ID NO: 47221 - DNA, 16 bp, H. sapiens
atatgcatatatatct

SEQ ID NO: 47222 - DNA, 16 bp, H. sapiens
atatgcatatctatat

SEQ ID NO: 47223 - DNA, 16 bp, H. sapiens
atatgcatatgtatat

SEQ ID NO: 47224 - DNA, 16 bp, H. sapiens
atatgcatatgtatgt

SEQ ID NO: 47225 - DNA, 16 bp, H. sapiens
atatgcatatttgttt

SEQ ID NO: 47226 - DNA, 16 bp, H. sapiens
atatgcatctttaaaa

SEQ ID NO: 47227 - DNA, 16 bp, H. sapiens
atatgcatgcatgtgt

SEQ ID NO: 47228 - DNA, 16 bp, H. sapiens
atatgcatgtatatat

SEQ ID NO: 47229 - DNA, 16 bp, H. sapiens
atatgcatgtatcaaa

SEQ ID NO: 47230 - DNA, 16 bp, H. sapiens
atatgcatgtatgtat

SEQ ID NO: 47231 - DNA, 16 bp, H. sapiens
atatgcatgtgtttgt

SEQ ID NO: 47232 - DNA, 16 bp, H. sapiens
atatgcattcttttca

SEQ ID NO: 47233 - DNA, 16 bp, H. sapiens
atatgcatttaagttt

SEQ ID NO: 47234 - DNA, 16 bp, H. sapiens
atatgcatttatctca

SEQ ID NO: 47235 - DNA, 16 bp, H. sapiens
atatgcatttatttct

SEQ ID NO: 47236 - DNA, 16 bp, H. sapiens
atatgcatttgtaaat

SEQ ID NO: 47237 - DNA, 16 bp, H. sapiens
atatgcatttttaaat

SEQ ID NO: 47238 - DNA, 16 bp, H. sapiens
atatgccaaagaaata

SEQ ID NO: 47239 - DNA, 16 bp, H. sapiens
atatgccaggcactgg

SEQ ID NO: 47240 - DNA, 16 bp, H. sapiens
atatgccatatatatg

SEQ ID NO: 47241 - DNA, 16 bp, H. sapiens
atatgctaaacaaggg

SEQ ID NO: 47242 - DNA, 16 bp, H. sapiens
atatgctaaataattt

SEQ ID NO: 47243 - DNA, 16 bp, H. sapiens
atatgctaagtgaaat

SEQ ID NO: 47244 - DNA, 16 bp, H. sapiens
atatgctataaaatat

SEQ ID NO: 47245 - DNA, 16 bp, H. sapiens
atatgctatattttaa

SEQ ID NO: 47246 - DNA, 16 bp, H. sapiens
atatgctattttttaa

SEQ ID NO: 47247 - DNA, 16 bp, H. sapiens
atatgctgatgactcc

SEQ ID NO: 47248 - DNA, 16 bp, H. sapiens
atatgctgccttcaag

SEQ ID NO: 47249 - DNA, 16 bp, H. sapiens
atatgctgctggattt

SEQ ID NO: 47250 - DNA, 16 bp, H. sapiens
atatgctgtattttat

SEQ ID NO: 47251 - DNA, 16 bp, H. sapiens
atatgctgtattttca

SEQ ID NO: 47252 - DNA, 16 bp, H. sapiens
atatgctgttgatttg

SEQ ID NO: 47253 - DNA, 16 bp, H. sapiens
atatgctttttgatgt

SEQ ID NO: 47254 - DNA, 16 bp, H. sapiens
atatggaaaataatgt

SEQ ID NO: 47255 - DNA, 16 bp, H. sapiens
atatggaaaatctctg

SEQ ID NO: 47256 - DNA, 16 bp, H. sapiens
atatggaaagaaaaca

SEQ ID NO: 47257 - DNA, 16 bp, H. sapiens
atatggaaatgcaaat

SEQ ID NO: 47258 - DNA, 16 bp, H. sapiens
atatggaaattaaaca

SEQ ID NO: 47259 - DNA, 16 bp, H. sapiens
atatggaagcaacttt

SEQ ID NO: 47260 - DNA, 16 bp, H. sapiens
atatggaattatataa

SEQ ID NO: 47261 - DNA, 16 bp, H. sapiens
atatggaccaatggaa

SEQ ID NO: 47262 - DNA, 16 bp, H. sapiens
atatggactctttttt

SEQ ID NO: 47263 - DNA, 16 bp, H. sapiens
atatggagaaaaggga

SEQ ID NO: 47264 - DNA, 16 bp, H. sapiens
atatggagggctgact

SEQ ID NO: 47265 - DNA, 16 bp, H. sapiens
atatggatatccagtt

SEQ ID NO: 47266 - DNA, 16 bp, H. sapiens
atatggcaaaactcca

SEQ ID NO: 47267 - DNA, 16 bp, H. sapiens
atatggcaccattcct

SEQ ID NO: 47268 - DNA, 16 bp, H. sapiens
atatggcagaagtgac

SEQ ID NO: 47269 - DNA, 16 bp, H. sapiens
atatggccagagcagg

SEQ ID NO: 47270 - DNA, 16 bp, H. sapiens
atatggctagccagct

SEQ ID NO: 47271 - DNA, 16 bp, H. sapiens
atatgggttctttttt

SEQ ID NO: 47272 - DNA, 16 bp, H. sapiens
atatggtaaaatgtag

SEQ ID NO: 47273 - DNA, 16 bp, H. sapiens
atatggtctaaaaaga

SEQ ID NO: 47274 - DNA, 16 bp, H. sapiens
atatggtgccactgca

SEQ ID NO: 47275 - DNA, 16 bp, H. sapiens
atatggttatttgcat

SEQ ID NO: 47276 - DNA, 16 bp, H. sapiens
atatggttcaacctaa

SEQ ID NO: 47277 - DNA, 16 bp, H. sapiens
atatggtttacatttt

SEQ ID NO: 47278 - DNA, 16 bp, H. sapiens
atatggtttagctgtg

SEQ ID NO: 47279 - DNA, 16 bp, H. sapiens
atatggtttcaccatg

SEQ ID NO: 47280 - DNA, 16 bp, H. sapiens
atatggtttctactga

SEQ ID NO: 47281 - DNA, 17 bp, H. sapiens
atatggtttgcctgtgt

SEQ ID NO: 47282 - DNA, 16 bp, H. sapiens
atatggtttggctctg

SEQ ID NO: 47283 - DNA, 16 bp, H. sapiens
atatggttttatttct

SEQ ID NO: 47284 - DNA, 16 bp, H. sapiens
atatggttttcctttt

SEQ ID NO: 47285 - DNA, 16 bp, H. sapiens
atatgtaaaaatgtat

SEQ ID NO: 47286 - DNA, 16 bp, H. sapiens
atatgtaaaacatttt

SEQ ID NO: 47287 - DNA, 16 bp, H. sapiens
atatgtaaagcactta

SEQ ID NO: 47288 - DNA, 16 bp, H. sapiens
atatgtaaatgcatat

SEQ ID NO: 47289 - DNA, 16 bp, H. sapiens
atatgtaacaaacctt

SEQ ID NO: 47290 - DNA, 16 bp, H. sapiens
atatgtaatatagtat

SEQ ID NO: 47291 - DNA, 16 bp, H. sapiens
atatgtaatatatatg

SEQ ID NO: 47292 - DNA, 16 bp, H. sapiens
atatgtaatatatgca

SEQ ID NO: 47293 - DNA, 16 bp, H. sapiens
atatgtaattcatata

SEQ ID NO: 47294 - DNA, 16 bp, H. sapiens
atatgtacaaatacat

SEQ ID NO: 47295 - DNA, 16 bp, H. sapiens
atatgtacacatatat

SEQ ID NO: 47296 - DNA, 16 bp, H. sapiens
atatgtacacatttct

SEQ ID NO: 47297 - DNA, 16 bp, H. sapiens
atatgtacagtttatt

SEQ ID NO: 47298 - DNA, 16 bp, H. sapiens
atatgtacatatataa

SEQ ID NO: 47299 - DNA, 16 bp, H. sapiens
atatgtacatatgtgt

SEQ ID NO: 47300 - DNA, 16 bp, H. sapiens
atatgtacattgtttt

SEQ ID NO: 47301 - DNA, 16 bp, H. sapiens
atatgtacatttatat

SEQ ID NO: 47302 - DNA, 16 bp, H. sapiens
atatgtacatttttaa

SEQ ID NO: 47303 - DNA, 16 bp, H. sapiens
atatgtaccatacttt

SEQ ID NO: 47304 - DNA, 16 bp, H. sapiens
atatgtaccctctgaa

SEQ ID NO: 47305 - DNA, 16 bp, H. sapiens
atatgtaccgtatttt

SEQ ID NO: 47306 - DNA, 16 bp, H. sapiens
atatgtactttaaagt

SEQ ID NO: 47307 - DNA, 16 bp, H. sapiens
atatgtagatatattt

SEQ ID NO: 47308 - DNA, 16 bp, H. sapiens
atatgtagggaaaaga

SEQ ID NO: 47309 - DNA, 16 bp, H. sapiens
atatgtagttggaaaa

SEQ ID NO: 47310 - DNA, 16 bp, H. sapiens
atatgtataaatatgt

SEQ ID NO: 47311 - DNA, 16 bp, H. sapiens
atatgtatacacatac

SEQ ID NO: 47312 - DNA, 16 bp, H. sapiens
atatgtatacagatat

SEQ ID NO: 47313 - DNA, 16 bp, H. sapiens
atatgtatacatatta

SEQ ID NO: 47314 - DNA, 16 bp, H. sapiens
atatgtatacatgtat

SEQ ID NO: 47315 - DNA, 16 bp, H. sapiens
atatgtatactttttt

SEQ ID NO: 47316 - DNA, 16 bp, H. sapiens
atatgtatagaatata

SEQ ID NO: 47317 - DNA, 16 bp, H. sapiens
atatgtatataataca

SEQ ID NO: 47318 - DNA, 16 bp, H. sapiens
atatgtatatacaaaa

SEQ ID NO: 47319 - DNA, 16 bp, H. sapiens
atatgtatatatacag

SEQ ID NO: 47320 - DNA, 16 bp, H. sapiens
atatgtatatatggaa

SEQ ID NO: 47321 - DNA, 16 bp, H. sapiens
atatgtatatatgtaa

SEQ ID NO: 47322 - DNA, 16 bp, H. sapiens
atatgtatatatgtgt

SEQ ID NO: 47323 - DNA, 16 bp, H. sapiens
atatgtatatattatg

SEQ ID NO: 47324 - DNA, 16 bp, H. sapiens
atatgtatatcaaaat

SEQ ID NO: 47325 - DNA, 16 bp, H. sapiens
atatgtatatgtacat

SEQ ID NO: 47326 - DNA, 16 bp, H. sapiens
atatgtatatgtgtat

SEQ ID NO: 47327 - DNA, 16 bp, H. sapiens
atatgtatatgtgtgt

SEQ ID NO: 47328 - DNA, 16 bp, H. sapiens
atatgtatatttacat

SEQ ID NO: 47329 - DNA, 16 bp, H. sapiens
atatgtatattttacc

SEQ ID NO: 47330 - DNA, 16 bp, H. sapiens
atatgtatcataaaat

SEQ ID NO: 47331 - DNA, 16 bp, H. sapiens
atatgtatcatatgta

SEQ ID NO: 47332 - DNA, 16 bp, H. sapiens
atatgtatctatacat

SEQ ID NO: 47333 - DNA, 16 bp, H. sapiens
atatgtatcttatata

SEQ ID NO: 47334 - DNA, 16 bp, H. sapiens
atatgtatggatatat

SEQ ID NO: 47335 - DNA, 16 bp, H. sapiens
atatgtatgtaaaaat

SEQ ID NO: 47336 - DNA, 16 bp, H. sapiens
atatgtatgtaataca

SEQ ID NO: 47337 - DNA, 16 bp, H. sapiens
atatgtatgtaatatg

SEQ ID NO: 47338 - DNA, 16 bp, H. sapiens
atatgtatgtatgtgt

SEQ ID NO: 47339 - DNA, 16 bp, H. sapiens
atatgtatgtgtatat

SEQ ID NO: 47340 - DNA, 16 bp, H. sapiens
atatgtatgtgtatgt

SEQ ID NO: 47341 - DNA, 16 bp, H. sapiens
atatgtatgtgtctat

SEQ ID NO: 47342 - DNA, 16 bp, H. sapiens
atatgtatgtgtgtat

SEQ ID NO: 47343 - DNA, 16 bp, H. sapiens
atatgtatgtgtgtgt

SEQ ID NO: 47344 - DNA, 16 bp, H. sapiens
atatgtatgttatata

SEQ ID NO: 47345 - DNA, 16 bp, H. sapiens
atatgtattatacact

SEQ ID NO: 47346 - DNA, 16 bp, H. sapiens
atatgtattatacatt

SEQ ID NO: 47347 - DNA, 16 bp, H. sapiens
atatgtattatatatg

SEQ ID NO: 47348 - DNA, 16 bp, H. sapiens
atatgtattgattgat

SEQ ID NO: 47349 - DNA, 16 bp, H. sapiens
atatgtatttaggata

SEQ ID NO: 47350 - DNA, 16 bp, H. sapiens
atatgtatttcttaaa

SEQ ID NO: 47351 - DNA, 16 bp, H. sapiens
atatgtatttgtaaat

SEQ ID NO: 47352 - DNA, 16 bp, H. sapiens
atatgtattttaaaga

SEQ ID NO: 47353 - DNA, 16 bp, H. sapiens
atatgtattttaactt

SEQ ID NO: 47354 - DNA, 16 bp, H. sapiens
atatgtattttcaaaa

SEQ ID NO: 47355 - DNA, 16 bp, H. sapiens
atatgtattttgccac

SEQ ID NO: 47356 - DNA, 16 bp, H. sapiens
atatgtattttttcta

SEQ ID NO: 47357 - DNA, 16 bp, H. sapiens
atatgtcaaaaggaca

SEQ ID NO: 47358 - DNA, 16 bp, H. sapiens
atatgtcattaagaaa

SEQ ID NO: 47359 - DNA, 16 bp, H. sapiens
atatgtcctgagaaat

SEQ ID NO: 47360 - DNA, 16 bp, H. sapiens
atatgtctatatatat

SEQ ID NO: 47361 - DNA, 16 bp, H. sapiens
atatgtctatatattt

SEQ ID NO: 47362 - DNA, 16 bp, H. sapiens
atatgtctatccttat

SEQ ID NO: 47363 - DNA, 16 bp, H. sapiens
atatgtctttataata

SEQ ID NO: 47364 - DNA, 16 bp, H. sapiens
atatgtcttttgaaaa

SEQ ID NO: 47365 - DNA, 16 bp, H. sapiens
atatgtgaaaaaaatg

SEQ ID NO: 47366 - DNA, 16 bp, H. sapiens
atatgtgaaattttaa

SEQ ID NO: 47367 - DNA, 16 bp, H. sapiens
atatgtgaattacatc

SEQ ID NO: 47368 - DNA, 16 bp, H. sapiens
atatgtgacatttcag

SEQ ID NO: 47369 - DNA, 16 bp, H. sapiens
atatgtgagatcatgc

SEQ ID NO: 47370 - DNA, 16 bp, H. sapiens
atatgtgaggcaaaaa

SEQ ID NO: 47371 - DNA, 16 bp, H. sapiens
atatgtgagtgtgtgt

SEQ ID NO: 47372 - DNA, 17 bp, H. sapiens
atatgtgatgtcacccc

SEQ ID NO: 47373 - DNA, 16 bp, H. sapiens
atatgtgcacatatat

SEQ ID NO: 47374 - DNA, 16 bp, H. sapiens
atatgtgcatatttat

SEQ ID NO: 47375 - DNA, 16 bp, H. sapiens
atatgtgcatgtacat

SEQ ID NO: 47376 - DNA, 16 bp, H. sapiens
atatgtgcatgtgtct

SEQ ID NO: 47377 - DNA, 16 bp, H. sapiens
atatgtgcatttttct

SEQ ID NO: 47378 - DNA, 16 bp, H. sapiens
atatgtgctgccgaag

SEQ ID NO: 47379 - DNA, 16 bp, H. sapiens
atatgtggaatttaaa

SEQ ID NO: 47380 - DNA, 16 bp, H. sapiens
atatgtggattcatct

SEQ ID NO: 47381 - DNA, 16 bp, H. sapiens
atatgtggcatatata

SEQ ID NO: 47382 - DNA, 16 bp, H. sapiens
atatgtgggaaagttt

SEQ ID NO: 47383 - DNA, 16 bp, H. sapiens
atatgtgggagctaag

SEQ ID NO: 47384 - DNA, 16 bp, H. sapiens
atatgtgtaaaaatat

SEQ ID NO: 47385 - DNA, 16 bp, H. sapiens
atatgtgtaaatatat

SEQ ID NO: 47386 - DNA, 16 bp, H. sapiens
atatgtgtacacatat

SEQ ID NO: 47387 - DNA, 16 bp, H. sapiens
atatgtgtacattgtg

SEQ ID NO: 47388 - DNA, 16 bp, H. sapiens
atatgtgtatatatat

SEQ ID NO: 47389 - DNA, 16 bp, H. sapiens
atatgtgtatctatat

SEQ ID NO: 47390 - DNA, 16 bp, H. sapiens
atatgtgtatgtgtgg

SEQ ID NO: 47391 - DNA, 16 bp, H. sapiens
atatgtgtatgtgtgt

SEQ ID NO: 47392 - DNA, 16 bp, H. sapiens
atatgtgtattgtata

SEQ ID NO: 47393 - DNA, 16 bp, H. sapiens
atatgtgtctttatag

SEQ ID NO: 47394 - DNA, 16 bp, H. sapiens
atatgtgtgcatatat

SEQ ID NO: 47395 - DNA, 16 bp, H. sapiens
atatgtgtgcatgtgt

SEQ ID NO: 47396 - DNA, 16 bp, H. sapiens
atatgtgtgtatacac

SEQ ID NO: 47397 - DNA, 16 bp, H. sapiens
atatgtgtgtatatac

SEQ ID NO: 47398 - DNA, 16 bp, H. sapiens
atatgtgtgtatatat

SEQ ID NO: 47399 - DNA, 16 bp, H. sapiens
atatgtgtgtatatgt

SEQ ID NO: 47400 - DNA, 16 bp, H. sapiens
atatgtgtgtatattt

SEQ ID NO: 47401 - DNA, 16 bp, H. sapiens
atatgtgtgtatctat

SEQ ID NO: 47402 - DNA, 16 bp, H. sapiens
atatgtgtgtatgtct

SEQ ID NO: 47403 - DNA, 16 bp, H. sapiens
atatgtgtgtgcatgt

SEQ ID NO: 47404 - DNA, 16 bp, H. sapiens
atatgtgtgtgtaaaa

SEQ ID NO: 47405 - DNA, 16 bp, H. sapiens
atatgtgttcatgtgt

SEQ ID NO: 47406 - DNA, 16 bp, H. sapiens
atatgtgttttacaaa

SEQ ID NO: 47407 - DNA, 16 bp, H. sapiens
atatgttaaaaatatg

SEQ ID NO: 47408 - DNA, 16 bp, H. sapiens
atatgttaattacttt

SEQ ID NO: 47409 - DNA, 16 bp, H. sapiens
atatgttcaaagaaat

SEQ ID NO: 47410 - DNA, 16 bp, H. sapiens
atatgttcaaagagct

SEQ ID NO: 47411 - DNA, 16 bp, H. sapiens
atatgttcatatatat

SEQ ID NO: 47412 - DNA, 16 bp, H. sapiens
atatgttccaagaccc

SEQ ID NO: 47413 - DNA, 16 bp, H. sapiens
atatgttctaagaccc

SEQ ID NO: 47414 - DNA, 16 bp, H. sapiens
atatgttgaaaaatat

SEQ ID NO: 47415 - DNA, 16 bp, H. sapiens
atatgttgaaaccctg

SEQ ID NO: 47416 - DNA, 16 bp, H. sapiens
atatgttgaaactcta

SEQ ID NO: 47417 - DNA, 16 bp, H. sapiens
atatgttgaatcatcc

SEQ ID NO: 47418 - DNA, 16 bp, H. sapiens
atatgttgcctccaaa

SEQ ID NO: 47419 - DNA, 16 bp, H. sapiens
atatgttgtaaatatt

SEQ ID NO: 47420 - DNA, 16 bp, H. sapiens
atatgttgtatataat

SEQ ID NO: 47421 - DNA, 16 bp, H. sapiens
atatgtttaataaatg

SEQ ID NO: 47422 - DNA, 16 bp, H. sapiens
atatgtttatataaca

SEQ ID NO: 47423 - DNA, 16 bp, H. sapiens
atatgtttatatctat

SEQ ID NO: 47424 - DNA, 16 bp, H. sapiens
atatgtttatgtgtgt

SEQ ID NO: 47425 - DNA, 16 bp, H. sapiens
atatgtttatttttca

SEQ ID NO: 47426 - DNA, 16 bp, H. sapiens
atatgtttcatttgtt

SEQ ID NO: 47427 - DNA, 16 bp, H. sapiens
atatgtttctaaaaat

SEQ ID NO: 47428 - DNA, 16 bp, H. sapiens
atatgtttgaaatatt

SEQ ID NO: 47429 - DNA, 16 bp, H. sapiens
atatgtttgaaattat

SEQ ID NO: 47430 - DNA, 16 bp, H. sapiens
atatgtttgcatgtgt

SEQ ID NO: 47431 - DNA, 16 bp, H. sapiens
atatgtttggatttat

SEQ ID NO: 47432 - DNA, 16 bp, H. sapiens
atatgtttgtatatgt

SEQ ID NO: 47433 - DNA, 16 bp, H. sapiens
atatgttttcacttct

SEQ ID NO: 47434 - DNA, 16 bp, H. sapiens
atatgtttttaaaatg

SEQ ID NO: 47435 - DNA, 16 bp, H. sapiens
atatgtttttaaatct

SEQ ID NO: 47436 - DNA, 16 bp, H. sapiens
atatgtttttgtaaaa

SEQ ID NO: 47437 - DNA, 16 bp, H. sapiens
atattaaaaacatgaa

SEQ ID NO: 47438 - DNA, 16 bp, H. sapiens
atattaaaaaccactg

SEQ ID NO: 47439 - DNA, 16 bp, H. sapiens
atattaaaagctgaaa

SEQ ID NO: 47440 - DNA, 16 bp, H. sapiens
atattaaagattattc

SEQ ID NO: 47441 - DNA, 16 bp, H. sapiens
atattaaagcaaaaat

SEQ ID NO: 47442 - DNA, 16 bp, H. sapiens
atattaaaggctctga

SEQ ID NO: 47443 - DNA, 16 bp, H. sapiens
atattaaatacatgtt

SEQ ID NO: 47444 - DNA, 16 bp, H. sapiens
atattaaatatgcatt

SEQ ID NO: 47445 - DNA, 16 bp, H. sapiens
atattaaatatgtgaa

SEQ ID NO: 47446 - DNA, 16 bp, H. sapiens
atattaacaaatctga

SEQ ID NO: 47447 - DNA, 16 bp, H. sapiens
atattaacaaatgtga

SEQ ID NO: 47448 - DNA, 16 bp, H. sapiens
atattaaccaggagaa

SEQ ID NO: 47449 - DNA, 16 bp, H. sapiens
atattaaccttgtatc

SEQ ID NO: 47450 - DNA, 16 bp, H. sapiens
atattaagagctattt

SEQ ID NO: 47451 - DNA, 16 bp, H. sapiens
atattaagtgttctca

SEQ ID NO: 47452 - DNA, 16 bp, H. sapiens
atattaatacatgaaa

SEQ ID NO: 47453 - DNA, 16 bp, H. sapiens
atattaatgaatgtga

SEQ ID NO: 47454 - DNA, 16 bp, H. sapiens
atattaatgtcttatt

SEQ ID NO: 47455 - DNA, 16 bp, H. sapiens
atattaattcttttga

SEQ ID NO: 47456 - DNA, 16 bp, H. sapiens
atattaatttcctttc

SEQ ID NO: 47457 - DNA, 16 bp, H. sapiens
atattacagaaatatt

SEQ ID NO: 47458 - DNA, 16 bp, H. sapiens
atattacatatacaca

SEQ ID NO: 47459 - DNA, 16 bp, H. sapiens
atattacatatgtatt

SEQ ID NO: 47460 - DNA, 16 bp, H. sapiens
atattacatgtatttt

SEQ ID NO: 47461 - DNA, 16 bp, H. sapiens
atattaccaaggcttt

SEQ ID NO: 47462 - DNA, 16 bp, H. sapiens
atattaccttcatttt

SEQ ID NO: 47463 - DNA, 16 bp, H. sapiens
atattaccttttccac

SEQ ID NO: 47464 - DNA, 16 bp, H. sapiens
atattactgaaagaaa

SEQ ID NO: 47465 - DNA, 16 bp, H. sapiens
atattagacaaaatag

SEQ ID NO: 47466 - DNA, 16 bp, H. sapiens
atattagacaaagtag

SEQ ID NO: 47467 - DNA, 16 bp, H. sapiens
atattagagagagaga

SEQ ID NO: 47468 - DNA, 16 bp, H. sapiens
atattagcaaatattt

SEQ ID NO: 47469 - DNA, 16 bp, H. sapiens
atattaggaaatattt

SEQ ID NO: 47470 - DNA, 16 bp, H. sapiens
atattagttcattttc

SEQ ID NO: 47471 - DNA, 16 bp, H. sapiens
atattataatactgta

SEQ ID NO: 47472 - DNA, 16 bp, H. sapiens
atattatacatacaca

SEQ ID NO: 47473 - DNA, 16 bp, H. sapiens
atattatacatgtaat

SEQ ID NO: 47474 - DNA, 16 bp, H. sapiens
atattatacatgtatt

SEQ ID NO: 47475 - DNA, 16 bp, H. sapiens
atattatactacagtt

SEQ ID NO: 47476 - DNA, 16 bp, H. sapiens
atattatacttaatgg

SEQ ID NO: 47477 - DNA, 16 bp, H. sapiens
atattatatatacaca

SEQ ID NO: 47478 - DNA, 16 bp, H. sapiens
atattatatgattcca

SEQ ID NO: 47479 - DNA, 16 bp, H. sapiens
atattatatgcattat

SEQ ID NO: 47480 - DNA, 16 bp, H. sapiens
atattatattcaaact

SEQ ID NO: 47481 - DNA, 16 bp, H. sapiens
atattatccaagagaa

SEQ ID NO: 47482 - DNA, 18 bp, H. sapiens
atattatccaggagaaca

SEQ ID NO: 47483 - DNA, 16 bp, H. sapiens
atattatccaggagac

SEQ ID NO: 47484 - DNA, 16 bp, H. sapiens
atattatccccatttt

SEQ ID NO: 47485 - DNA, 16 bp, H. sapiens
atattatccctaatac

SEQ ID NO: 47486 - DNA, 16 bp, H. sapiens
atattatctccatttt

SEQ ID NO: 47487 - DNA, 16 bp, H. sapiens
atattatctgcaaata

SEQ ID NO: 47488 - DNA, 16 bp, H. sapiens
atattatggttattaa

SEQ ID NO: 47489 - DNA, 16 bp, H. sapiens
atattatgtacattat

SEQ ID NO: 47490 - DNA, 16 bp, H. sapiens
atattattcagtctta

SEQ ID NO: 47491 - DNA, 16 bp, H. sapiens
atattattcagtttta

SEQ ID NO: 47492 - DNA, 16 bp, H. sapiens
atattattccattcca

SEQ ID NO: 47493 - DNA, 16 bp, H. sapiens
atattatttaatcctc

SEQ ID NO: 47494 - DNA, 16 bp, H. sapiens
atattatttgcaaata

SEQ ID NO: 47495 - DNA, 16 bp, H. sapiens
atattatttgtaatct

SEQ ID NO: 47496 - DNA, 16 bp, H. sapiens
atattattttgcttta

SEQ ID NO: 47497 - DNA, 16 bp, H. sapiens
atattcaaaagaaata

SEQ ID NO: 47498 - DNA, 16 bp, H. sapiens
atattcaaaataagaa

SEQ ID NO: 47499 - DNA, 16 bp, H. sapiens
atattcaaaatgtcta

SEQ ID NO: 47500 - DNA, 16 bp, H. sapiens
atattcaaagaaagaa

SEQ ID NO: 47501 - DNA, 16 bp, H. sapiens
atattcaaagtgttga

SEQ ID NO: 47502 - DNA, 16 bp, H. sapiens
atattcaaatggaaaa

SEQ ID NO: 47503 - DNA, 16 bp, H. sapiens
atattcaacatagtac

SEQ ID NO: 47504 - DNA, 16 bp, H. sapiens
atattcaacctgtatt

SEQ ID NO: 47505 - DNA, 16 bp, H. sapiens
atattcaagaagctca

SEQ ID NO: 47506 - DNA, 16 bp, H. sapiens
atattcaagtctttaa

SEQ ID NO: 47507 - DNA, 16 bp, H. sapiens
atattcacaaaatttt

SEQ ID NO: 47508 - DNA, 16 bp, H. sapiens
atattcacaaagttat

SEQ ID NO: 47509 - DNA, 16 bp, H. sapiens
atattcacaatgttgt

SEQ ID NO: 47510 - DNA, 16 bp, H. sapiens
atattcacacaaaaat

SEQ ID NO: 47511 - DNA, 16 bp, H. sapiens
atattcacagagttgt

SEQ ID NO: 47512 - DNA, 16 bp, H. sapiens
atattcacattgttgt

SEQ ID NO: 47513 - DNA, 16 bp, H. sapiens
atattcacattgtttt

SEQ ID NO: 47514 - DNA, 16 bp, H. sapiens
atattcaccatggaat

SEQ ID NO: 47515 - DNA, 16 bp, H. sapiens
atattcaccattatag

SEQ ID NO: 47516 - DNA, 16 bp, H. sapiens
atattcactttttaaa

SEQ ID NO: 47517 - DNA, 16 bp, H. sapiens
atattcagaaaaatga

SEQ ID NO: 47518 - DNA, 16 bp, H. sapiens
atattcagaaaaatgt

SEQ ID NO: 47519 - DNA, 16 bp, H. sapiens
atattcagaaaataat

SEQ ID NO: 47520 - DNA, 16 bp, H. sapiens
atattcagaaaatgaa

SEQ ID NO: 47521 - DNA, 16 bp, H. sapiens
atattcagaatctaaa

SEQ ID NO: 47522 - DNA, 16 bp, H. sapiens
atattcaggaagaaaa

SEQ ID NO: 47523 - DNA, 16 bp, H. sapiens
atattcaggacttgaa

SEQ ID NO: 47524 - DNA, 16 bp, H. sapiens
atattcagtaaaccac

SEQ ID NO: 47525 - DNA, 16 bp, H. sapiens
atattcataaaatgga

SEQ ID NO: 47526 - DNA, 16 bp, H. sapiens
atattcatataaacat

SEQ ID NO: 47527 - DNA, 16 bp, H. sapiens
atattcatatattcat

SEQ ID NO: 47528 - DNA, 16 bp, H. sapiens
atattcatattcatat

SEQ ID NO: 47529 - DNA, 16 bp, H. sapiens
atattcatcagaaata

SEQ ID NO: 47530 - DNA, 16 bp, H. sapiens
atattcatgtacaaat

SEQ ID NO: 47531 - DNA, 16 bp, H. sapiens
atattcattttcttga

SEQ ID NO: 47532 - DNA, 16 bp, H. sapiens
atattccaaaattcaa

SEQ ID NO: 47533 - DNA, 16 bp, H. sapiens
atattccactgtatgt

SEQ ID NO: 47534 - DNA, 16 bp, H. sapiens
atattccagaaaaaaa

SEQ ID NO: 47535 - DNA, 16 bp, H. sapiens
atattccaggaaaaaa

SEQ ID NO: 47536 - DNA, 16 bp, H. sapiens
atattccatgctcatg

SEQ ID NO: 47537 - DNA, 16 bp, H. sapiens
atattccattttcatg

SEQ ID NO: 47538 - DNA, 16 bp, H. sapiens
atattccctttttcac

SEQ ID NO: 47539 - DNA, 16 bp, H. sapiens
atattcctccatctct

SEQ ID NO: 47540 - DNA, 16 bp, H. sapiens
atattccttcatccct

SEQ ID NO: 47541 - DNA, 16 bp, H. sapiens
atattcctttgagtat

SEQ ID NO: 47542 - DNA, 16 bp, H. sapiens
atattctaaaagaaaa

SEQ ID NO: 47543 - DNA, 16 bp, H. sapiens
atattctaaatcatct

SEQ ID NO: 47544 - DNA, 16 bp, H. sapiens
atattctacagttgtt

SEQ ID NO: 47545 - DNA, 16 bp, H. sapiens
atattctagggaaatg

SEQ ID NO: 47546 - DNA, 16 bp, H. sapiens
atattctatatcttga

SEQ ID NO: 47547 - DNA, 16 bp, H. sapiens
atattctatattttga

SEQ ID NO: 47548 - DNA, 16 bp, H. sapiens
atattctcatttctct

SEQ ID NO: 47549 - DNA, 16 bp, H. sapiens
atattctgaaataata

SEQ ID NO: 47550 - DNA, 16 bp, H. sapiens
atattctgaagaaaat

SEQ ID NO: 47551 - DNA, 16 bp, H. sapiens
atattctgaagtattt

SEQ ID NO: 47552 - DNA, 16 bp, H. sapiens
atattctgaatataag

SEQ ID NO: 47553 - DNA, 16 bp, H. sapiens
atattctgaatcacaa

SEQ ID NO: 47554 - DNA, 16 bp, H. sapiens
atattctgaatttttt

SEQ ID NO: 47555 - DNA, 16 bp, H. sapiens
atattctgattttatt

SEQ ID NO: 47556 - DNA, 16 bp, H. sapiens
atattctgcagttctt

SEQ ID NO: 47557 - DNA, 16 bp, H. sapiens
atattctgcagttgtt

SEQ ID NO: 47558 - DNA, 16 bp, H. sapiens
atattctggaaaatat

SEQ ID NO: 47559 - DNA, 16 bp, H. sapiens
atattctggaaattaa

SEQ ID NO: 47560 - DNA, 16 bp, H. sapiens
atattctgtaaatatt

SEQ ID NO: 47561 - DNA, 16 bp, H. sapiens
atattctgtaaatgtc

SEQ ID NO: 47562 - DNA, 16 bp, H. sapiens
atattctgtgggtttt

SEQ ID NO: 47563 - DNA, 16 bp, H. sapiens
atattctgttgctgtt

SEQ ID NO: 47564 - DNA, 16 bp, H. sapiens
atattctgttgttgtt

SEQ ID NO: 47565 - DNA, 16 bp, H. sapiens
atattctgtttattaa

SEQ ID NO: 47566 - DNA, 16 bp, H. sapiens
atattcttacaataaa

SEQ ID NO: 47567 - DNA, 16 bp, H. sapiens
atattcttacttataa

SEQ ID NO: 47568 - DNA, 16 bp, H. sapiens
atattcttatatatgt

SEQ ID NO: 47569 - DNA, 16 bp, H. sapiens
atattcttccatccct

SEQ ID NO: 47570 - DNA, 16 bp, H. sapiens
atattcttcctaatat

SEQ ID NO: 47571 - DNA, 16 bp, H. sapiens
atattcttctttgata

SEQ ID NO: 47572 - DNA, 16 bp, H. sapiens
atattcttgccaaaaa

SEQ ID NO: 47573 - DNA, 16 bp, H. sapiens
atattctttaaaaaac

SEQ ID NO: 47574 - DNA, 16 bp, H. sapiens
atattctttgtgtgtg

SEQ ID NO: 47575 - DNA, 16 bp, H. sapiens
atattcttttgaaaat

SEQ ID NO: 47576 - DNA, 16 bp, H. sapiens
atattgaaaaacagaa

SEQ ID NO: 47577 - DNA, 16 bp, H. sapiens
atattgaaaaactgaa

SEQ ID NO: 47578 - DNA, 16 bp, H. sapiens
atattgaaagagaaga

SEQ ID NO: 47579 - DNA, 16 bp, H. sapiens
atattgaacatttttc

SEQ ID NO: 47580 - DNA, 16 bp, H. sapiens
atattgaacatttttt

SEQ ID NO: 47581 - DNA, 17 bp, H. sapiens
atattgaagccctcaaa

SEQ ID NO: 47582 - DNA, 16 bp, H. sapiens
atattgaaggagaaaa

SEQ ID NO: 47583 - DNA, 16 bp, H. sapiens
atattgaatcttccaa

SEQ ID NO: 47584 - DNA, 16 bp, H. sapiens
atattgacctgtagtt

SEQ ID NO: 47585 - DNA, 16 bp, H. sapiens
atattgagcttttttt

SEQ ID NO: 47586 - DNA, 16 bp, H. sapiens
atattgatacaaaaat

SEQ ID NO: 47587 - DNA, 16 bp, H. sapiens
atattgatatagatat

SEQ ID NO: 47588 - DNA, 16 bp, H. sapiens
atattgatatagtttg

SEQ ID NO: 47589 - DNA, 16 bp, H. sapiens
atattgatgatgatga

SEQ ID NO: 47590 - DNA, 16 bp, H. sapiens
atattgattattctaa

SEQ ID NO: 47591 - DNA, 16 bp, H. sapiens
atattgattcttccta

SEQ ID NO: 47592 - DNA, 16 bp, H. sapiens
atattgattgattgat

SEQ ID NO: 47593 - DNA, 16 bp, H. sapiens
atattgatttcattgt

SEQ ID NO: 47594 - DNA, 16 bp, H. sapiens
atattgattttgaaat

SEQ ID NO: 47595 - DNA, 16 bp, H. sapiens
atattgcaaaatattt

SEQ ID NO: 47596 - DNA, 16 bp, H. sapiens
atattgcaataaaatg

SEQ ID NO: 47597 - DNA, 16 bp, H. sapiens
atattgcatagtgatg

SEQ ID NO: 47598 - DNA, 16 bp, H. sapiens
atattgcattaaaaat

SEQ ID NO: 47599 - DNA, 16 bp, H. sapiens
atattgcattatatat

SEQ ID NO: 47600 - DNA, 16 bp, H. sapiens
atattgccaaattatt

SEQ ID NO: 47601 - DNA, 16 bp, H. sapiens
atattgcccaggctga

SEQ ID NO: 47602 - DNA, 16 bp, H. sapiens
atattgctgaacagca

SEQ ID NO: 47603 - DNA, 16 bp, H. sapiens
atattgctggatttga

SEQ ID NO: 47604 - DNA, 16 bp, H. sapiens
atattggaaaattttt

SEQ ID NO: 47605 - DNA, 16 bp, H. sapiens
atattggacctcttcc

SEQ ID NO: 47606 - DNA, 16 bp, H. sapiens
atattggattccagaa

SEQ ID NO: 47607 - DNA, 18 bp, H. sapiens
atattggcctgaaatttt

SEQ ID NO: 47608 - DNA, 16 bp, H. sapiens
atattgggagaattac

SEQ ID NO: 47609 - DNA, 16 bp, H. sapiens
atattggtcaggctgc

SEQ ID NO: 47610 - DNA, 16 bp, H. sapiens
atattgtaatggtgga

SEQ ID NO: 47611 - DNA, 16 bp, H. sapiens
atattgtacatatttt

SEQ ID NO: 47612 - DNA, 16 bp, H. sapiens
atattgtcagtgaaga

SEQ ID NO: 47613 - DNA, 16 bp, H. sapiens
atattgtcctgtagtt

SEQ ID NO: 47614 - DNA, 16 bp, H. sapiens
atattgtctacttttt

SEQ ID NO: 47615 - DNA, 16 bp, H. sapiens
atattgtgaaaggaaa

SEQ ID NO: 47616 - DNA, 16 bp, H. sapiens
atattgttaaaatgat

SEQ ID NO: 47617 - DNA, 16 bp, H. sapiens
atattgttgaataaat

SEQ ID NO: 47618 - DNA, 16 bp, H. sapiens
atattgttgattcatt

SEQ ID NO: 47619 - DNA, 16 bp, H. sapiens
atattgttgcatatat

SEQ ID NO: 47620 - DNA, 16 bp, H. sapiens
atattgttgcatgtat

SEQ ID NO: 47621 - DNA, 16 bp, H. sapiens
atattgtttacatttt

SEQ ID NO: 47622 - DNA, 16 bp, H. sapiens
atatttaaaaactgtt

SEQ ID NO: 47623 - DNA, 16 bp, H. sapiens
atatttaaaaattctg

SEQ ID NO: 47624 - DNA, 16 bp, H. sapiens
atatttaaaagacaaa

SEQ ID NO: 47625 - DNA, 16 bp, H. sapiens
atatttaaaagatgtt

SEQ ID NO: 47626 - DNA, 16 bp, H. sapiens
atatttaaaatgcttt

SEQ ID NO: 47627 - DNA, 16 bp, H. sapiens
atatttaaagcaaata

SEQ ID NO: 47628 - DNA, 16 bp, H. sapiens
atatttaaagcaataa

SEQ ID NO: 47629 - DNA, 16 bp, H. sapiens
atatttaaatatgtga

SEQ ID NO: 47630 - DNA, 16 bp, H. sapiens
atatttaacacatttt

SEQ ID NO: 47631 - DNA, 16 bp, H. sapiens
atatttaacattttgt

SEQ ID NO: 47632 - DNA, 16 bp, H. sapiens
atatttaagactttaa

SEQ ID NO: 47633 - DNA, 16 bp, H. sapiens
atatttaagggaaaat

SEQ ID NO: 47634 - DNA, 16 bp, H. sapiens
atatttaagttgtttc

SEQ ID NO: 47635 - DNA, 16 bp, H. sapiens
atatttaataatgctt

SEQ ID NO: 47636 - DNA, 16 bp, H. sapiens
atatttaatatatgtg

SEQ ID NO: 47637 - DNA, 16 bp, H. sapiens
atatttaatgaataca

SEQ ID NO: 47638 - DNA, 16 bp, H. sapiens
atatttaattctctct

SEQ ID NO: 47639 - DNA, 16 bp, H. sapiens
atatttaattttgtca

SEQ ID NO: 47640 - DNA, 16 bp, H. sapiens
atatttacaaaaagaa

SEQ ID NO: 47641 - DNA, 16 bp, H. sapiens
atatttacaaactacc

SEQ ID NO: 47642 - DNA, 16 bp, H. sapiens
atatttacaaagaaaa

SEQ ID NO: 47643 - DNA, 16 bp, H. sapiens
atatttacaaagaatt

SEQ ID NO: 47644 - DNA, 16 bp, H. sapiens
atatttacagaaaaat

SEQ ID NO: 47645 - DNA, 16 bp, H. sapiens
atatttacagaaaatt

SEQ ID NO: 47646 - DNA, 16 bp, H. sapiens
atatttacagaagaaa

SEQ ID NO: 47647 - DNA, 16 bp, H. sapiens
atatttacagtatata

SEQ ID NO: 47648 - DNA, 16 bp, H. sapiens
atatttacatacaaat

SEQ ID NO: 47649 - DNA, 16 bp, H. sapiens
atatttacatagatat

SEQ ID NO: 47650 - DNA, 16 bp, H. sapiens
atatttacatattgat

SEQ ID NO: 47651 - DNA, 16 bp, H. sapiens
atatttacatctttaa

SEQ ID NO: 47652 - DNA, 16 bp, H. sapiens
atatttaccaaaatat

SEQ ID NO: 47653 - DNA, 16 bp, H. sapiens
atatttaccatttctg

SEQ ID NO: 47654 - DNA, 16 bp, H. sapiens
atatttactgtttatt

SEQ ID NO: 47655 - DNA, 25 bp, H. sapiens
atatttaggatagttagctcttctt

SEQ ID NO: 47656 - DNA, 16 bp, H. sapiens
atatttagtagaaatg

SEQ ID NO: 47657 - DNA, 16 bp, H. sapiens
atatttatagcagtgt

SEQ ID NO: 47658 - DNA, 16 bp, H. sapiens
atatttataggaatat

SEQ ID NO: 47659 - DNA, 16 bp, H. sapiens
atatttatagttttct

SEQ ID NO: 47660 - DNA, 16 bp, H. sapiens
atatttatatctttgt

SEQ ID NO: 47661 - DNA, 16 bp, H. sapiens
atatttatatgtatac

SEQ ID NO: 47662 - DNA, 16 bp, H. sapiens
atatttatctcttcct

SEQ ID NO: 47663 - DNA, 16 bp, H. sapiens
atatttatgaaaaaca

SEQ ID NO: 47664 - DNA, 16 bp, H. sapiens
atatttatgaaacatt

SEQ ID NO: 47665 - DNA, 16 bp, H. sapiens
atatttatgaaatgaa

SEQ ID NO: 47666 - DNA, 16 bp, H. sapiens
atatttatgagaaata

SEQ ID NO: 47667 - DNA, 16 bp, H. sapiens
atatttatggaatata

SEQ ID NO: 47668 - DNA, 16 bp, H. sapiens
atatttatggagtaca

SEQ ID NO: 47669 - DNA, 16 bp, H. sapiens
atatttatggggtaca

SEQ ID NO: 47670 - DNA, 16 bp, H. sapiens
atatttatgtacacat

SEQ ID NO: 47671 - DNA, 16 bp, H. sapiens
atatttatgtacatat

SEQ ID NO: 47672 - DNA, 16 bp, H. sapiens
atatttatgtatttct

SEQ ID NO: 47673 - DNA, 16 bp, H. sapiens
atatttatgtgtacat

SEQ ID NO: 47674 - DNA, 16 bp, H. sapiens
atatttatgtgtgtgt

SEQ ID NO: 47675 - DNA, 16 bp, H. sapiens
atatttattaaacacc

SEQ ID NO: 47676 - DNA, 16 bp, H. sapiens
atatttattctgagcc

SEQ ID NO: 47677 - DNA, 16 bp, H. sapiens
atatttattgaaaacc

SEQ ID NO: 47678 - DNA, 16 bp, H. sapiens
atatttattgacttgt

SEQ ID NO: 47679 - DNA, 16 bp, H. sapiens
atatttattgagaaaa

SEQ ID NO: 47680 - DNA, 16 bp, H. sapiens
atatttattgagaacc

SEQ ID NO: 47681 - DNA, 16 bp, H. sapiens
atatttattgagtgcc

SEQ ID NO: 47682 - DNA, 16 bp, H. sapiens
atatttattgagtggc

SEQ ID NO: 47683 - DNA, 16 bp, H. sapiens
atatttattgctttat

SEQ ID NO: 47684 - DNA, 16 bp, H. sapiens
atatttattgggcatc

SEQ ID NO: 47685 - DNA, 16 bp, H. sapiens
atatttattgtgcatt

SEQ ID NO: 47686 - DNA, 16 bp, H. sapiens
atatttatttctgtgt

SEQ ID NO: 47687 - DNA, 16 bp, H. sapiens
atatttatttgtagaa

SEQ ID NO: 47688 - DNA, 16 bp, H. sapiens
atatttattttctcac

SEQ ID NO: 47689 - DNA, 16 bp, H. sapiens
atatttcaaaaagtat

SEQ ID NO: 47690 - DNA, 16 bp, H. sapiens
atatttcaaaacaaca

SEQ ID NO: 47691 - DNA, 16 bp, H. sapiens
atatttcaaaacatca

SEQ ID NO: 47692 - DNA, 16 bp, H. sapiens
atatttcaaaacatgt

SEQ ID NO: 47693 - DNA, 16 bp, H. sapiens
atatttcaaaatatgt

SEQ ID NO: 47694 - DNA, 16 bp, H. sapiens
atatttcaaaatggtt

SEQ ID NO: 47695 - DNA, 16 bp, H. sapiens
atatttcaaacatttt

SEQ ID NO: 47696 - DNA, 16 bp, H. sapiens
atatttcaaactgttt

SEQ ID NO: 47697 - DNA, 16 bp, H. sapiens
atatttcaaatataga

SEQ ID NO: 47698 - DNA, 16 bp, H. sapiens
atatttcaagaatata

SEQ ID NO: 47699 - DNA, 16 bp, H. sapiens
atatttcaagtgctca

SEQ ID NO: 47700 - DNA, 16 bp, H. sapiens
atatttcacaattaaa

SEQ ID NO: 47701 - DNA, 16 bp, H. sapiens
atatttcacatgaaaa

SEQ ID NO: 47702 - DNA, 16 bp, H. sapiens
atatttcagaaaatgt

SEQ ID NO: 47703 - DNA, 16 bp, H. sapiens
atatttcagaaataca

SEQ ID NO: 47704 - DNA, 16 bp, H. sapiens
atatttcatatatatg

SEQ ID NO: 47705 - DNA, 16 bp, H. sapiens
atatttcatcaaatct

SEQ ID NO: 47706 - DNA, 16 bp, H. sapiens
atatttcatcccttat

SEQ ID NO: 47707 - DNA, 16 bp, H. sapiens
atatttcatgaaatta

SEQ ID NO: 47708 - DNA, 16 bp, H. sapiens
atatttcatgtatttt

SEQ ID NO: 47709 - DNA, 16 bp, H. sapiens
atatttcattttctgt

SEQ ID NO: 47710 - DNA, 16 bp, H. sapiens
atatttcattttgaaa

SEQ ID NO: 47711 - DNA, 16 bp, H. sapiens
atatttccatgtattt

SEQ ID NO: 47712 - DNA, 16 bp, H. sapiens
atatttccattaaaaa

SEQ ID NO: 47713 - DNA, 16 bp, H. sapiens
atatttcctaggtttt

SEQ ID NO: 47714 - DNA, 16 bp, H. sapiens
atatttcctttcactt

SEQ ID NO: 47715 - DNA, 16 bp, H. sapiens
atatttctaaaattca

SEQ ID NO: 47716 - DNA, 16 bp, H. sapiens
atatttctaaatgttt

SEQ ID NO: 47717 - DNA, 16 bp, H. sapiens
atatttctattttgaa

SEQ ID NO: 47718 - DNA, 16 bp, H. sapiens
atatttctcaaaataa

SEQ ID NO: 47719 - DNA, 16 bp, H. sapiens
atatttctcaaagaac

SEQ ID NO: 47720 - DNA, 16 bp, H. sapiens
atatttctccaaagaa

SEQ ID NO: 47721 - DNA, 16 bp, H. sapiens
atatttctccagagaa

SEQ ID NO: 47722 - DNA, 19 bp, H. sapiens
atatttctcccatttgctt

SEQ ID NO: 47723 - DNA, 16 bp, H. sapiens
atatttctctgatgat

SEQ ID NO: 47724 - DNA, 16 bp, H. sapiens
atatttctgaaataat

SEQ ID NO: 47725 - DNA, 16 bp, H. sapiens
atatttctgaataaat

SEQ ID NO: 47726 - DNA, 16 bp, H. sapiens
atatttctgcatttta

SEQ ID NO: 47727 - DNA, 16 bp, H. sapiens
atatttctgtatattt

SEQ ID NO: 47728 - DNA, 16 bp, H. sapiens
atatttctgtatttat

SEQ ID NO: 47729 - DNA, 16 bp, H. sapiens
atatttctgtgtgtgt

SEQ ID NO: 47730 - DNA, 16 bp, H. sapiens
atatttcttaaaagaa

SEQ ID NO: 47731 - DNA, 16 bp, H. sapiens
atatttcttaaatgaa

SEQ ID NO: 47732 - DNA, 16 bp, H. sapiens
atatttcttagtattt

SEQ ID NO: 47733 - DNA, 16 bp, H. sapiens
atatttcttcttaaaa

SEQ ID NO: 47734 - DNA, 16 bp, H. sapiens
atatttcttgaaaata

SEQ ID NO: 47735 - DNA, 16 bp, H. sapiens
atatttcttgaagact

SEQ ID NO: 47736 - DNA, 16 bp, H. sapiens
atatttcttgatattt

SEQ ID NO: 47737 - DNA, 16 bp, H. sapiens
atatttctttaaaatg

SEQ ID NO: 47738 - DNA, 16 bp, H. sapiens
atatttctttacaaaa

SEQ ID NO: 47739 - DNA, 16 bp, H. sapiens
atatttctttgtatat

SEQ ID NO: 47740 - DNA, 16 bp, H. sapiens
atatttctttgttgat

SEQ ID NO: 47741 - DNA, 16 bp, H. sapiens
atatttgaaaaaggaa

SEQ ID NO: 47742 - DNA, 16 bp, H. sapiens
atatttgaaaacaaaa

SEQ ID NO: 47743 - DNA, 16 bp, H. sapiens
atatttgaaaacaact

SEQ ID NO: 47744 - DNA, 16 bp, H. sapiens
atatttgaaaactatt

SEQ ID NO: 47745 - DNA, 16 bp, H. sapiens
atatttgaaaagaaga

SEQ ID NO: 47746 - DNA, 16 bp, H. sapiens
atatttgaaaagtttt

SEQ ID NO: 47747 - DNA, 16 bp, H. sapiens
atatttgaaaattgta

SEQ ID NO: 47748 - DNA, 16 bp, H. sapiens
atatttgaaatgtaaa

SEQ ID NO: 47749 - DNA, 16 bp, H. sapiens
atatttgaacaaaaat

SEQ ID NO: 47750 - DNA, 16 bp, H. sapiens
atatttgaagaataat

SEQ ID NO: 47751 - DNA, 16 bp, H. sapiens
atatttgaagacattt

SEQ ID NO: 47752 - DNA, 16 bp, H. sapiens
atatttgaagagaaaa

SEQ ID NO: 47753 - DNA, 16 bp, H. sapiens
atatttgaagagattt

SEQ ID NO: 47754 - DNA, 16 bp, H. sapiens
atatttgaagattaaa

SEQ ID NO: 47755 - DNA, 16 bp, H. sapiens
atatttgaagcacttt

SEQ ID NO: 47756 - DNA, 16 bp, H. sapiens
atatttgaatttcata

SEQ ID NO: 47757 - DNA, 16 bp, H. sapiens
atatttgaatttttca

SEQ ID NO: 47758 - DNA, 16 bp, H. sapiens
atatttgacttaaaaa

SEQ ID NO: 47759 - DNA, 16 bp, H. sapiens
atatttgagtttcttt

SEQ ID NO: 47760 - DNA, 16 bp, H. sapiens
atatttgatcattttt

SEQ ID NO: 47761 - DNA, 16 bp, H. sapiens
atatttgatttaagca

SEQ ID NO: 47762 - DNA, 16 bp, H. sapiens
atatttgatttttcac

SEQ ID NO: 47763 - DNA, 16 bp, H. sapiens
atatttgcaaatcact

SEQ ID NO: 47764 - DNA, 16 bp, H. sapiens
atatttgcaatacata

SEQ ID NO: 47765 - DNA, 16 bp, H. sapiens
atatttgcaatttttt

SEQ ID NO: 47766 - DNA, 16 bp, H. sapiens
atatttgcataaataa

SEQ ID NO: 47767 - DNA, 16 bp, H. sapiens
atatttgcataactaa

SEQ ID NO: 47768 - DNA, 16 bp, H. sapiens
atatttgcatatacat

SEQ ID NO: 47769 - DNA, 16 bp, H. sapiens
atatttgcatatgtgt

SEQ ID NO: 47770 - DNA, 16 bp, H. sapiens
atatttgcatatttat

SEQ ID NO: 47771 - DNA, 16 bp, H. sapiens
atatttgcattaaaaa

SEQ ID NO: 47772 - DNA, 16 bp, H. sapiens
atatttgcatttgaaa

SEQ ID NO: 47773 - DNA, 16 bp, H. sapiens
atatttgccaattttt

SEQ ID NO: 47774 - DNA, 16 bp, H. sapiens
atatttgccattttaa

SEQ ID NO: 47775 - DNA, 16 bp, H. sapiens
atatttgcctttctgt

SEQ ID NO: 47776 - DNA, 16 bp, H. sapiens
atatttgctattttaa

SEQ ID NO: 47777 - DNA, 16 bp, H. sapiens
atatttgctcaataaa

SEQ ID NO: 47778 - DNA, 16 bp, H. sapiens
atatttgctctatata

SEQ ID NO: 47779 - DNA, 16 bp, H. sapiens
atatttgcttaaaaat

SEQ ID NO: 47780 - DNA, 16 bp, H. sapiens
atatttgctttaaaaa

SEQ ID NO: 47781 - DNA, 16 bp, H. sapiens
atatttgctttataaa

SEQ ID NO: 47782 - DNA, 16 bp, H. sapiens
atatttgcttttatat

SEQ ID NO: 47783 - DNA, 16 bp, H. sapiens
atatttgcttttccac

SEQ ID NO: 47784 - DNA, 16 bp, H. sapiens
atatttgcttttctgc

SEQ ID NO: 47785 - DNA, 16 bp, H. sapiens
atatttgctttttctc

SEQ ID NO: 47786 - DNA, 16 bp, H. sapiens
atatttggaaaacaaa

SEQ ID NO: 47787 - DNA, 16 bp, H. sapiens
atatttggaaaagaaa

SEQ ID NO: 47788 - DNA, 16 bp, H. sapiens
atatttggaaaatgta

SEQ ID NO: 47789 - DNA, 16 bp, H. sapiens
atatttggaaactaaa

SEQ ID NO: 47790 - DNA, 16 bp, H. sapiens
atatttggaagctcaa

SEQ ID NO: 47791 - DNA, 16 bp, H. sapiens
atatttggccattttt

SEQ ID NO: 47792 - DNA, 16 bp, H. sapiens
atatttggctaatttt

SEQ ID NO: 47793 - DNA, 16 bp, H. sapiens
atatttgggatatttt

SEQ ID NO: 47794 - DNA, 16 bp, H. sapiens
atatttgggggaaaaa

SEQ ID NO: 47795 - DNA, 16 bp, H. sapiens
atatttgggggatttt

SEQ ID NO: 47796 - DNA, 16 bp, H. sapiens
atatttggttcccttt

SEQ ID NO: 47797 - DNA, 16 bp, H. sapiens
atatttgtaattttct

SEQ ID NO: 47798 - DNA, 16 bp, H. sapiens
atatttgtacaccaat

SEQ ID NO: 47799 - DNA, 16 bp, H. sapiens
atatttgtacatattt

SEQ ID NO: 47800 - DNA, 16 bp, H. sapiens
atatttgtatatacac

SEQ ID NO: 47801 - DNA, 16 bp, H. sapiens
atatttgtattttcag

SEQ ID NO: 47802 - DNA, 16 bp, H. sapiens
atatttgtcaaataaa

SEQ ID NO: 47803 - DNA, 16 bp, H. sapiens
atatttgtcattttct

SEQ ID NO: 47804 - DNA, 16 bp, H. sapiens
atatttgtctctctct

SEQ ID NO: 47805 - DNA, 16 bp, H. sapiens
atatttgtctctctgt

SEQ ID NO: 47806 - DNA, 16 bp, H. sapiens
atatttgtgaaaaaat

SEQ ID NO: 47807 - DNA, 16 bp, H. sapiens
atatttgtgaacattt

SEQ ID NO: 47808 - DNA, 16 bp, H. sapiens
atatttgtgaatttcc

SEQ ID NO: 47809 - DNA, 16 bp, H. sapiens
atatttgtggaattaa

SEQ ID NO: 47810 - DNA, 16 bp, H. sapiens
atatttgtgtaaatat

SEQ ID NO: 47811 - DNA, 16 bp, H. sapiens
atatttgttacataaa

SEQ ID NO: 47812 - DNA, 16 bp, H. sapiens
atatttgttagccatt

SEQ ID NO: 47813 - DNA, 16 bp, H. sapiens
atatttgttcatttat

SEQ ID NO: 47814 - DNA, 16 bp, H. sapiens
atatttgttgactaaa

SEQ ID NO: 47815 - DNA, 16 bp, H. sapiens
atatttgttgtataaa

SEQ ID NO: 47816 - DNA, 16 bp, H. sapiens
atatttgtttagtgaa

SEQ ID NO: 47817 - DNA, 16 bp, H. sapiens
atatttgtttcctatt

SEQ ID NO: 47818 - DNA, 16 bp, H. sapiens
atatttgtttgcattt

SEQ ID NO: 47819 - DNA, 16 bp, H. sapiens
atatttgttttacaaa

SEQ ID NO: 47820 - DNA, 16 bp, H. sapiens
atatttgttttggtac

SEQ ID NO: 47821 - DNA, 16 bp, H. sapiens
atattttaaaaatcag

SEQ ID NO: 47822 - DNA, 16 bp, H. sapiens
atattttaaaaatgct

SEQ ID NO: 47823 - DNA, 16 bp, H. sapiens
atattttaaaagctga

SEQ ID NO: 47824 - DNA, 16 bp, H. sapiens
atattttaaaatagct

SEQ ID NO: 47825 - DNA, 16 bp, H. sapiens
atattttaaaatctac

SEQ ID NO: 47826 - DNA, 16 bp, H. sapiens
atattttaaaatgaga

SEQ ID NO: 47827 - DNA, 16 bp, H. sapiens
atattttaaagcaaaa

SEQ ID NO: 47828 - DNA, 16 bp, H. sapiens
atattttaaagcaata

SEQ ID NO: 47829 - DNA, 16 bp, H. sapiens
atattttaaagcacat

SEQ ID NO: 47830 - DNA, 16 bp, H. sapiens
atattttaaagctaaa

SEQ ID NO: 47831 - DNA, 16 bp, H. sapiens
atattttaaatatcca

SEQ ID NO: 47832 - DNA, 16 bp, H. sapiens
atattttaaatcacat

SEQ ID NO: 47833 - DNA, 16 bp, H. sapiens
atattttaaatgagat

SEQ ID NO: 47834 - DNA, 16 bp, H. sapiens
atattttaaatggcaa

SEQ ID NO: 47835 - DNA, 16 bp, H. sapiens
atattttaaattctca

SEQ ID NO: 47836 - DNA, 16 bp, H. sapiens
atattttaacagtttt

SEQ ID NO: 47837 - DNA, 16 bp, H. sapiens
atattttaacatctct

SEQ ID NO: 47838 - DNA, 16 bp, H. sapiens
atattttaagcatttt

SEQ ID NO: 47839 - DNA, 16 bp, H. sapiens
atattttaaggagaaa

SEQ ID NO: 47840 - DNA, 16 bp, H. sapiens
atattttaaggtaaaa

SEQ ID NO: 47841 - DNA, 16 bp, H. sapiens
atattttaagtgtata

SEQ ID NO: 47842 - DNA, 16 bp, H. sapiens
atattttaatatgctt

SEQ ID NO: 47843 - DNA, 16 bp, H. sapiens
atattttaatattcac

SEQ ID NO: 47844 - DNA, 16 bp, H. sapiens
atattttaatgcattt

SEQ ID NO: 47845 - DNA, 16 bp, H. sapiens
atattttaatgtgctt

SEQ ID NO: 47846 - DNA, 16 bp, H. sapiens
atattttacagaaata

SEQ ID NO: 47847 - DNA, 16 bp, H. sapiens
atattttacatttagt

SEQ ID NO: 47848 - DNA, 16 bp, H. sapiens
atattttacatttctg

SEQ ID NO: 47849 - DNA, 16 bp, H. sapiens
atattttacatttgaa

SEQ ID NO: 47850 - DNA, 16 bp, H. sapiens
atattttaccaaaaat

SEQ ID NO: 47851 - DNA, 16 bp, H. sapiens
atattttaccacaaaa

SEQ ID NO: 47852 - DNA, 16 bp, H. sapiens
atattttaccccaaaa

SEQ ID NO: 47853 - DNA, 16 bp, H. sapiens
atattttacctcattt

SEQ ID NO: 47854 - DNA, 16 bp, H. sapiens
atattttactgtaatt

SEQ ID NO: 47855 - DNA, 16 bp, H. sapiens
atattttacttctttg

SEQ ID NO: 47856 - DNA, 16 bp, H. sapiens
atattttactttagaa

SEQ ID NO: 47857 - DNA, 16 bp, H. sapiens
atattttagaaagttt

SEQ ID NO: 47858 - DNA, 16 bp, H. sapiens
atattttagaaatgga

SEQ ID NO: 47859 - DNA, 16 bp, H. sapiens
atattttagagaagaa

SEQ ID NO: 47860 - DNA, 16 bp, H. sapiens
atattttagcatttta

SEQ ID NO: 47861 - DNA, 16 bp, H. sapiens
atattttagcttcttt

SEQ ID NO: 47862 - DNA, 16 bp, H. sapiens
atattttaggaagaaa

SEQ ID NO: 47863 - DNA, 16 bp, H. sapiens
atattttaggcttttc

SEQ ID NO: 47864 - DNA, 16 bp, H. sapiens
atattttaggcttttt

SEQ ID NO: 47865 - DNA, 16 bp, H. sapiens
atattttatgtccttt

SEQ ID NO: 47866 - DNA, 16 bp, H. sapiens
atattttatttctgta

SEQ ID NO: 47867 - DNA, 16 bp, H. sapiens
atattttcaaagaaac

SEQ ID NO: 47868 - DNA, 16 bp, H. sapiens
atattttcaaagaaat

SEQ ID NO: 47869 - DNA, 16 bp, H. sapiens
atattttcaaatgtat

SEQ ID NO: 47870 - DNA, 16 bp, H. sapiens
atattttcaaatgttt

SEQ ID NO: 47871 - DNA, 16 bp, H. sapiens
atattttcaccagata

SEQ ID NO: 47872 - DNA, 16 bp, H. sapiens
atattttcactcattt

SEQ ID NO: 47873 - DNA, 16 bp, H. sapiens
atattttcagaagaaa

SEQ ID NO: 47874 - DNA, 16 bp, H. sapiens
atattttcaggaaaaa

SEQ ID NO: 47875 - DNA, 16 bp, H. sapiens
atattttcaggatttt

SEQ ID NO: 47876 - DNA, 16 bp, H. sapiens
atattttcagtagaga

SEQ ID NO: 47877 - DNA, 16 bp, H. sapiens
atattttcatatgttt

SEQ ID NO: 47878 - DNA, 16 bp, H. sapiens
atattttcatccattt

SEQ ID NO: 47879 - DNA, 16 bp, H. sapiens
atattttcatctgttt

SEQ ID NO: 47880 - DNA, 16 bp, H. sapiens
atattttcatgacttt

SEQ ID NO: 47881 - DNA, 16 bp, H. sapiens
atattttcatgtgatt

SEQ ID NO: 47882 - DNA, 16 bp, H. sapiens
atattttcatttatgt

SEQ ID NO: 47883 - DNA, 16 bp, H. sapiens
atattttcatttgtat

SEQ ID NO: 47884 - DNA, 16 bp, H. sapiens
atattttccaaatatt

SEQ ID NO: 47885 - DNA, 16 bp, H. sapiens
atattttccaaattat

SEQ ID NO: 47886 - DNA, 16 bp, H. sapiens
atattttccaagtaat

SEQ ID NO: 47887 - DNA, 16 bp, H. sapiens
atattttccatgaaaa

SEQ ID NO: 47888 - DNA, 16 bp, H. sapiens
atattttccctcattt

SEQ ID NO: 47889 - DNA, 16 bp, H. sapiens
atattttcctgaattt

SEQ ID NO: 47890 - DNA, 16 bp, H. sapiens
atattttcctttatgt

SEQ ID NO: 47891 - DNA, 16 bp, H. sapiens
atattttctacctctt

SEQ ID NO: 47892 - DNA, 16 bp, H. sapiens
atattttctagaaaat

SEQ ID NO: 47893 - DNA, 16 bp, H. sapiens
atattttctagttatt

SEQ ID NO: 47894 - DNA, 16 bp, H. sapiens
atattttctatattgt

SEQ ID NO: 47895 - DNA, 16 bp, H. sapiens
atattttctattatgt

SEQ ID NO: 47896 - DNA, 16 bp, H. sapiens
atattttctcagtttt

SEQ ID NO: 47897 - DNA, 16 bp, H. sapiens
atattttctcccactt

SEQ ID NO: 47898 - DNA, 16 bp, H. sapiens
atattttctcccattc

SEQ ID NO: 47899 - DNA, 16 bp, H. sapiens
atattttctctcattc

SEQ ID NO: 47900 - DNA, 16 bp, H. sapiens
atattttctgaaaata

SEQ ID NO: 47901 - DNA, 16 bp, H. sapiens
atattttctgatttcc

SEQ ID NO: 47902 - DNA, 16 bp, H. sapiens
atattttctgcctttt

SEQ ID NO: 47903 - DNA, 16 bp, H. sapiens
atattttctggatttt

SEQ ID NO: 47904 - DNA, 16 bp, H. sapiens
atattttctgtaaata

SEQ ID NO: 47905 - DNA, 16 bp, H. sapiens
atattttcttattgaa

SEQ ID NO: 47906 - DNA, 16 bp, H. sapiens
atattttcttcatgaa

SEQ ID NO: 47907 - DNA, 16 bp, H. sapiens
atattttcttccactt

SEQ ID NO: 47908 - DNA, 16 bp, H. sapiens
atattttcttccattc

SEQ ID NO: 47909 - DNA, 16 bp, H. sapiens
atattttcttctaaaa

SEQ ID NO: 47910 - DNA, 16 bp, H. sapiens
atattttcttcttgaa

SEQ ID NO: 47911 - DNA, 16 bp, H. sapiens
atattttctttaatga

SEQ ID NO: 47912 - DNA, 16 bp, H. sapiens
atattttctttcctca

SEQ ID NO: 47913 - DNA, 16 bp, H. sapiens
atattttctttgaaaa

SEQ ID NO: 47914 - DNA, 16 bp, H. sapiens
atattttctttgaaga

SEQ ID NO: 47915 - DNA, 16 bp, H. sapiens
atattttcttttgtaa

SEQ ID NO: 47916 - DNA, 16 bp, H. sapiens
atattttgaaaaacaa

SEQ ID NO: 47917 - DNA, 16 bp, H. sapiens
atattttgaaaacatt

SEQ ID NO: 47918 - DNA, 16 bp, H. sapiens
atattttgaaacattt

SEQ ID NO: 47919 - DNA, 16 bp, H. sapiens
atattttgaaagaatt

SEQ ID NO: 47920 - DNA, 16 bp, H. sapiens
atattttgaaatggaa

SEQ ID NO: 47921 - DNA, 16 bp, H. sapiens
atattttgaaatggtc

SEQ ID NO: 47922 - DNA, 16 bp, H. sapiens
atattttgaagaaata

SEQ ID NO: 47923 - DNA, 16 bp, H. sapiens
atattttgaagtcttt

SEQ ID NO: 47924 - DNA, 16 bp, H. sapiens
atattttgaagttaaa

SEQ ID NO: 47925 - DNA, 16 bp, H. sapiens
atattttgaatattag

SEQ ID NO: 47926 - DNA, 16 bp, H. sapiens
atattttgacatatat

SEQ ID NO: 47927 - DNA, 16 bp, H. sapiens
atattttgagttaaaa

SEQ ID NO: 47928 - DNA, 16 bp, H. sapiens
atattttgagttgatt

SEQ ID NO: 47929 - DNA, 16 bp, H. sapiens
atattttgatgtatgt

SEQ ID NO: 47930 - DNA, 16 bp, H. sapiens
atattttgcaaatttt

SEQ ID NO: 47931 - DNA, 16 bp, H. sapiens
atattttgccaaaaaa

SEQ ID NO: 47932 - DNA, 16 bp, H. sapiens
atattttgccaacttt

SEQ ID NO: 47933 - DNA, 16 bp, H. sapiens
atattttgcctatttt

SEQ ID NO: 47934 - DNA, 16 bp, H. sapiens
atattttgctgtattt

SEQ ID NO: 47935 - DNA, 16 bp, H. sapiens
atattttgcttcattt

SEQ ID NO: 47936 - DNA, 16 bp, H. sapiens
atattttggaaacaaa

SEQ ID NO: 47937 - DNA, 16 bp, H. sapiens
atattttggaagaaat

SEQ ID NO: 47938 - DNA, 16 bp, H. sapiens
atattttggatacatt

SEQ ID NO: 47939 - DNA, 16 bp, H. sapiens
atattttggatttcct

SEQ ID NO: 47940 - DNA, 16 bp, H. sapiens
atattttgggccagat

SEQ ID NO: 47941 - DNA, 16 bp, H. sapiens
atattttgggggtgtt

SEQ ID NO: 47942 - DNA, 16 bp, H. sapiens
atattttggggtgaaa

SEQ ID NO: 47943 - DNA, 16 bp, H. sapiens
atattttgggtatatt

SEQ ID NO: 47944 - DNA, 16 bp, H. sapiens
atattttgtcccattt

SEQ ID NO: 47945 - DNA, 16 bp, H. sapiens
atattttgtgaataaa

SEQ ID NO: 47946 - DNA, 16 bp, H. sapiens
atattttgtgcttcct

SEQ ID NO: 47947 - DNA, 16 bp, H. sapiens
atattttgtgtacttt

SEQ ID NO: 47948 - DNA, 16 bp, H. sapiens
atattttgttacaaaa

SEQ ID NO: 47949 - DNA, 16 bp, H. sapiens
atattttgtttagaaa

SEQ ID NO: 47950 - DNA, 16 bp, H. sapiens
atatttttaaaaactc

SEQ ID NO: 47951 - DNA, 16 bp, H. sapiens
atatttttaaagaagt

SEQ ID NO: 47952 - DNA, 16 bp, H. sapiens
atatttttaaagatct

SEQ ID NO: 47953 - DNA, 16 bp, H. sapiens
atatttttaaatcagg

SEQ ID NO: 47954 - DNA, 16 bp, H. sapiens
atatttttaaatgaca

SEQ ID NO: 47955 - DNA, 16 bp, H. sapiens
atatttttaaatgcag

SEQ ID NO: 47956 - DNA, 16 bp, H. sapiens
atatttttaactgaaa

SEQ ID NO: 47957 - DNA, 16 bp, H. sapiens
atatttttaagatgtc

SEQ ID NO: 47958 - DNA, 16 bp, H. sapiens
atatttttaaggaaaa

SEQ ID NO: 47959 - DNA, 16 bp, H. sapiens
atatttttaagtcatt

SEQ ID NO: 47960 - DNA, 16 bp, H. sapiens
atatttttaatagaga

SEQ ID NO: 47961 - DNA, 16 bp, H. sapiens
atatttttagaagaga

SEQ ID NO: 47962 - DNA, 16 bp, H. sapiens
atatttttagtaaaga

SEQ ID NO: 47963 - DNA, 16 bp, H. sapiens
atatttttagtacaga

SEQ ID NO: 47964 - DNA, 16 bp, H. sapiens
atatttttagtagaca

SEQ ID NO: 47965 - DNA, 16 bp, H. sapiens
atatttttagtagaga

SEQ ID NO: 47966 - DNA, 16 bp, H. sapiens
atatttttagtggaga

SEQ ID NO: 47967 - DNA, 16 bp, H. sapiens
atatttttatgttcat

SEQ ID NO: 47968 - DNA, 16 bp, H. sapiens
atatttttcaaaaagt

SEQ ID NO: 47969 - DNA, 16 bp, H. sapiens
atatttttcaaactgt

SEQ ID NO: 47970 - DNA, 16 bp, H. sapiens
atatttttcaaagaaa

SEQ ID NO: 47971 - DNA, 16 bp, H. sapiens
atatttttcaaatgtt

SEQ ID NO: 47972 - DNA, 16 bp, H. sapiens
atatttttcacaaaat

SEQ ID NO: 47973 - DNA, 16 bp, H. sapiens
atatttttcacaatta

SEQ ID NO: 47974 - DNA, 16 bp, H. sapiens
atatttttcaggaaga

SEQ ID NO: 47975 - DNA, 16 bp, H. sapiens
atatttttcccacttt

SEQ ID NO: 47976 - DNA, 16 bp, H. sapiens
atatttttctagaaaa

SEQ ID NO: 47977 - DNA, 16 bp, H. sapiens
atatttttctcttatg

SEQ ID NO: 47978 - DNA, 16 bp, H. sapiens
atatttttctgaaaag

SEQ ID NO: 47979 - DNA, 16 bp, H. sapiens
atatttttctgagttt

SEQ ID NO: 47980 - DNA, 16 bp, H. sapiens
atatttttcttcagat

SEQ ID NO: 47981 - DNA, 16 bp, H. sapiens
atatttttcttcttgc

SEQ ID NO: 47982 - DNA, 16 bp, H. sapiens
atatttttctttagaa

SEQ ID NO: 47983 - DNA, 16 bp, H. sapiens
atatttttgaaacaaa

SEQ ID NO: 47984 - DNA, 16 bp, H. sapiens
atatttttgaaagcat

SEQ ID NO: 47985 - DNA, 16 bp, H. sapiens
atatttttgaatttct

SEQ ID NO: 47986 - DNA, 16 bp, H. sapiens
atatttttgcagttgt

SEQ ID NO: 47987 - DNA, 16 bp, H. sapiens
atatttttgctttaat

SEQ ID NO: 47988 - DNA, 16 bp, H. sapiens
atatttttgctttcat

SEQ ID NO: 47989 - DNA, 16 bp, H. sapiens
atatttttggaaaaaa

SEQ ID NO: 47990 - DNA, 16 bp, H. sapiens
atatttttggaaaata

SEQ ID NO: 47991 - DNA, 16 bp, H. sapiens
atatttttggaaaatt

SEQ ID NO: 47992 - DNA, 16 bp, H. sapiens
atatttttggaatgaa

SEQ ID NO: 47993 - DNA, 16 bp, H. sapiens
atatttttggagattt

SEQ ID NO: 47994 - DNA, 16 bp, H. sapiens
atatttttggtagaga

SEQ ID NO: 47995 - DNA, 16 bp, H. sapiens
atatttttgtaaagat

SEQ ID NO: 47996 - DNA, 16 bp, H. sapiens
atatttttgtatcata

SEQ ID NO: 47997 - DNA, 16 bp, H. sapiens
atatttttgtattcct

SEQ ID NO: 47998 - DNA, 16 bp, H. sapiens
atatttttgtctaaaa

SEQ ID NO: 47999 - DNA, 16 bp, H. sapiens
atatttttgtttccca

SEQ ID NO: 48000 - DNA, 16 bp, H. sapiens
atattttttaaaggaa

SEQ ID NO: 48001 - DNA, 16 bp, H. sapiens
atattttttaagtgga

SEQ ID NO: 48002 - DNA, 16 bp, H. sapiens
atattttttagagatg

SEQ ID NO: 48003 - DNA, 16 bp, H. sapiens
atattttttagttcat

SEQ ID NO: 48004 - DNA, 16 bp, H. sapiens
atattttttcatatgt

SEQ ID NO: 48005 - DNA, 16 bp, H. sapiens
atattttttcattgat

SEQ ID NO: 48006 - DNA, 16 bp, H. sapiens
atattttttccagaaa

SEQ ID NO: 48007 - DNA, 16 bp, H. sapiens
atattttttctcaaaa

SEQ ID NO: 48008 - DNA, 16 bp, H. sapiens
atattttttctctcca

SEQ ID NO: 48009 - DNA, 16 bp, H. sapiens
atattttttctgaata

SEQ ID NO: 48010 - DNA, 16 bp, H. sapiens
atattttttgacatat

SEQ ID NO: 48011 - DNA, 16 bp, H. sapiens
atattttttgagatga

SEQ ID NO: 48012 - DNA, 16 bp, H. sapiens
atattttttggggggg

SEQ ID NO: 48013 - DNA, 16 bp, H. sapiens
atatttttttaaactg

SEQ ID NO: 48014 - DNA, 16 bp, H. sapiens
atatttttttgtagag

SEQ ID NO: 48015 - DNA, 16 bp, H. sapiens
atcaaaaaaaagtttc

SEQ ID NO: 48016 - DNA, 16 bp, H. sapiens
atcaaaaaatggcaaa

SEQ ID NO: 48017 - DNA, 16 bp, H. sapiens
atcaaaaaattctttg

SEQ ID NO: 48018 - DNA, 16 bp, H. sapiens
atcaaaaagaaatgct

SEQ ID NO: 48019 - DNA, 16 bp, H. sapiens
atcaaaaagataattc

SEQ ID NO: 48020 - DNA, 20 bp, H. sapiens
atcaaaaagcttatccaaca

SEQ ID NO: 48021 - DNA, 16 bp, H. sapiens
atcaaaaagtctgaaa

SEQ ID NO: 48022 - DNA, 16 bp, H. sapiens
atcaaaaagtgggata

SEQ ID NO: 48023 - DNA, 16 bp, H. sapiens
atcaaaaagtttgaaa

SEQ ID NO: 48024 - DNA, 16 bp, H. sapiens
atcaaaaatgttttta

SEQ ID NO: 48025 - DNA, 16 bp, H. sapiens
atcaaaaattggcaaa

SEQ ID NO: 48026 - DNA, 16 bp, H. sapiens
atcaaaacaaggaaag

SEQ ID NO: 48027 - DNA, 16 bp, H. sapiens
atcaaaacagacatat

SEQ ID NO: 48028 - DNA, 16 bp, H. sapiens
atcaaaacagcatggt

SEQ ID NO: 48029 - DNA, 16 bp, H. sapiens
atcaaaacatcatgta

SEQ ID NO: 48030 - DNA, 16 bp, H. sapiens
atcaaaacatcatgtc

SEQ ID NO: 48031 - DNA, 16 bp, H. sapiens
atcaaaacatctaatg

SEQ ID NO: 48032 - DNA, 16 bp, H. sapiens
atcaaaaccacactga

SEQ ID NO: 48033 - DNA, 16 bp, H. sapiens
atcaaaactacaagga

SEQ ID NO: 48034 - DNA, 16 bp, H. sapiens
atcaaaacttatcaaa

SEQ ID NO: 48035 - DNA, 16 bp, H. sapiens
atcaaaagaaaattta

SEQ ID NO: 48036 - DNA, 16 bp, H. sapiens
atcaaaagaaagcttt

SEQ ID NO: 48037 - DNA, 16 bp, H. sapiens
atcaaaagaaaggatt

SEQ ID NO: 48038 - DNA, 16 bp, H. sapiens
atcaaaagaaaggttt

SEQ ID NO: 48039 - DNA, 16 bp, H. sapiens
atcaaaagaaagttag

SEQ ID NO: 48040 - DNA, 16 bp, H. sapiens
atcaaaagaaagttca

SEQ ID NO: 48041 - DNA, 16 bp, H. sapiens
atcaaaagaatatttt

SEQ ID NO: 48042 - DNA, 16 bp, H. sapiens
atcaaaagcaagttat

SEQ ID NO: 48043 - DNA, 16 bp, H. sapiens
atcaaaagcctttttt

SEQ ID NO: 48044 - DNA, 16 bp, H. sapiens
atcaaaaggaagattc

SEQ ID NO: 48045 - DNA, 16 bp, H. sapiens
atcaaaataccaaaga

SEQ ID NO: 48046 - DNA, 16 bp, H. sapiens
atcaaaatattttatc

SEQ ID NO: 48047 - DNA, 16 bp, H. sapiens
atcaaaatcaagaaat

SEQ ID NO: 48048 - DNA, 16 bp, H. sapiens
atcaaaatcacctgga

SEQ ID NO: 48049 - DNA, 16 bp, H. sapiens
atcaaaatgaaaaact

SEQ ID NO: 48050 - DNA, 16 bp, H. sapiens
atcaaaatgaaacaag

SEQ ID NO: 48051 - DNA, 16 bp, H. sapiens
atcaaaatgtatttat

SEQ ID NO: 48052 - DNA, 16 bp, H. sapiens
atcaaaatgtcacatt

SEQ ID NO: 48053 - DNA, 16 bp, H. sapiens
atcaaaatgtgtggga

SEQ ID NO: 48054 - DNA, 16 bp, H. sapiens
atcaaaatgttatttt

SEQ ID NO: 48055 - DNA, 16 bp, H. sapiens
atcaaaattgattaaa

SEQ ID NO: 48056 - DNA, 16 bp, H. sapiens
atcaaaatttaaatct

SEQ ID NO: 48057 - DNA, 16 bp, H. sapiens
atcaaaatttgggaaa

SEQ ID NO: 48058 - DNA, 16 bp, H. sapiens
atcaaaattttaagaa

SEQ ID NO: 48059 - DNA, 16 bp, H. sapiens
atcaaacaaccccatc

SEQ ID NO: 48060 - DNA, 16 bp, H. sapiens
atcaaaccagccacag

SEQ ID NO: 48061 - DNA, 16 bp, H. sapiens
atcaaacctgaggagg

SEQ ID NO: 48062 - DNA, 16 bp, H. sapiens
atcaaacggaatggaa

SEQ ID NO: 48063 - DNA, 16 bp, H. sapiens
atcaaactaccaatga

SEQ ID NO: 48064 - DNA, 19 bp, H. sapiens
atcaaactactccaagcta

SEQ ID NO: 48065 - DNA, 16 bp, H. sapiens
atcaaagaaaggttca

SEQ ID NO: 48066 - DNA, 16 bp, H. sapiens
atcaaagaaatcacaa

SEQ ID NO: 48067 - DNA, 16 bp, H. sapiens
atcaaagaagaaatga

SEQ ID NO: 48068 - DNA, 16 bp, H. sapiens
atcaaagaagaggaaa

SEQ ID NO: 48069 - DNA, 16 bp, H. sapiens
atcaaaggcctaaatg

SEQ ID NO: 48070 - DNA, 16 bp, H. sapiens
atcaaagtgatatctg

SEQ ID NO: 48071 - DNA, 16 bp, H. sapiens
atcaaagtgtcagcag

SEQ ID NO: 48072 - DNA, 16 bp, H. sapiens
atcaaataaaaatgga

SEQ ID NO: 48073 - DNA, 16 bp, H. sapiens
atcaaataatctgatt

SEQ ID NO: 48074 - DNA, 16 bp, H. sapiens
atcaaatacattttaa

SEQ ID NO: 48075 - DNA, 16 bp, H. sapiens
atcaaatactaagtct

SEQ ID NO: 48076 - DNA, 16 bp, H. sapiens
atcaaatactgcatgt

SEQ ID NO: 48077 - DNA, 16 bp, H. sapiens
atcaaatagatgtaat

SEQ ID NO: 48078 - DNA, 16 bp, H. sapiens
atcaaatatatttctt

SEQ ID NO: 48079 - DNA, 16 bp, H. sapiens
atcaaatatttactga

SEQ ID NO: 48080 - DNA, 16 bp, H. sapiens
atcaaatcaaaatgga

SEQ ID NO: 48081 - DNA, 16 bp, H. sapiens
atcaaatcaagatgga

SEQ ID NO: 48082 - DNA, 16 bp, H. sapiens
atcaaatcagaactca

SEQ ID NO: 48083 - DNA, 16 bp, H. sapiens
atcaaatcagggtaat

SEQ ID NO: 48084 - DNA, 16 bp, H. sapiens
atcaaatccaaaggaa

SEQ ID NO: 48085 - DNA, 16 bp, H. sapiens
atcaaatgaaaggttc

SEQ ID NO: 48086 - DNA, 16 bp, H. sapiens
atcaaatgaaatgaaa

SEQ ID NO: 48087 - DNA, 16 bp, H. sapiens
atcaaatgaatgaatg

SEQ ID NO: 48088 - DNA, 16 bp, H. sapiens
atcaaatgaattaata

SEQ ID NO: 48089 - DNA, 16 bp, H. sapiens
atcaaatgagataaca

SEQ ID NO: 48090 - DNA, 16 bp, H. sapiens
atcaaatggaaaaaat

SEQ ID NO: 48091 - DNA, 16 bp, H. sapiens
atcaaatggaatggca

SEQ ID NO: 48092 - DNA, 19 bp, H. sapiens
atcaaattactctgagcta

SEQ ID NO: 48093 - DNA, 16 bp, H. sapiens
atcaaattagaattca

SEQ ID NO: 48094 - DNA, 16 bp, H. sapiens
atcaaattctttttca

SEQ ID NO: 48095 - DNA, 16 bp, H. sapiens
atcaaattgctaaaaa

SEQ ID NO: 48096 - DNA, 16 bp, H. sapiens
atcaaattgcttaaaa

SEQ ID NO: 48097 - DNA, 16 bp, H. sapiens
atcaaattgtacactt

SEQ ID NO: 48098 - DNA, 16 bp, H. sapiens
atcaaattgttttatt

SEQ ID NO: 48099 - DNA, 16 bp, H. sapiens
atcaaattttatttca

SEQ ID NO: 48100 - DNA, 16 bp, H. sapiens
atcaacaaaaagcaca

SEQ ID NO: 48101 - DNA, 16 bp, H. sapiens
atcaacaaaagtgata

SEQ ID NO: 48102 - DNA, 16 bp, H. sapiens
atcaacaaagaaatat

SEQ ID NO: 48103 - DNA, 16 bp, H. sapiens
atcaacaacagcaaaa

SEQ ID NO: 48104 - DNA, 16 bp, H. sapiens
atcaacaagacagaaa

SEQ ID NO: 48105 - DNA, 16 bp, H. sapiens
atcaacaagacagaag

SEQ ID NO: 48106 - DNA, 16 bp, H. sapiens
atcaacaaggcagaaa

SEQ ID NO: 48107 - DNA, 16 bp, H. sapiens
atcaacaataaggctg

SEQ ID NO: 48108 - DNA, 16 bp, H. sapiens
atcaacacaattgata

SEQ ID NO: 48109 - DNA, 16 bp, H. sapiens
atcaacaccatcacca

SEQ ID NO: 48110 - DNA, 16 bp, H. sapiens
atcaacactatgaaga

SEQ ID NO: 48111 - DNA, 16 bp, H. sapiens
atcaacagaagaataa

SEQ ID NO: 48112 - DNA, 16 bp, H. sapiens
atcaacagactaaaga

SEQ ID NO: 48113 - DNA, 16 bp, H. sapiens
atcaacagagttaaca

SEQ ID NO: 48114 - DNA, 16 bp, H. sapiens
atcaacagatgaattg

SEQ ID NO: 48115 - DNA, 16 bp, H. sapiens
atcaacagatgcagaa

SEQ ID NO: 48116 - DNA, 16 bp, H. sapiens
atcaacaggctaaaaa

SEQ ID NO: 48117 - DNA, 16 bp, H. sapiens
atcaacagttcattcc

SEQ ID NO: 48118 - DNA, 16 bp, H. sapiens
atcaacatagaaaaat

SEQ ID NO: 48119 - DNA, 16 bp, H. sapiens
atcaacatatgtaaga

SEQ ID NO: 48120 - DNA, 16 bp, H. sapiens
atcaacatcaaagcaa

SEQ ID NO: 48121 - DNA, 16 bp, H. sapiens
atcaacatcatcatca

SEQ ID NO: 48122 - DNA, 16 bp, H. sapiens
atcaacatttattgaa

SEQ ID NO: 48123 - DNA, 16 bp, H. sapiens
atcaaccaaaaaaagt

SEQ ID NO: 48124 - DNA, 16 bp, H. sapiens
atcaacccatcatcta

SEQ ID NO: 48125 - DNA, 16 bp, H. sapiens
atcaacctgtcatcta

SEQ ID NO: 48126 - DNA, 16 bp, H. sapiens
atcaactaaaaatgaa

SEQ ID NO: 48127 - DNA, 16 bp, H. sapiens
atcaactaacaagcaa

SEQ ID NO: 48128 - DNA, 16 bp, H. sapiens
atcaactagaagaaag

SEQ ID NO: 48129 - DNA, 20 bp, H. sapiens
atcaactgaggtcaggagtt

SEQ ID NO: 48130 - DNA, 24 bp, H. sapiens
atcaactggaagaaagggtatcag

SEQ ID NO: 48131 - DNA, 16 bp, H. sapiens
atcaactgtttatgtt

SEQ ID NO: 48132 - DNA, 17 bp, H. sapiens
atcaacttaaggagatt

SEQ ID NO: 48133 - DNA, 16 bp, H. sapiens
atcaacttggctaggc

SEQ ID NO: 48134 - DNA, 16 bp, H. sapiens
atcaacttggcttcat

SEQ ID NO: 48135 - DNA, 16 bp, H. sapiens
atcaacttttttagct

SEQ ID NO: 48136 - DNA, 16 bp, H. sapiens
atcaagaaaaaattac

SEQ ID NO: 48137 - DNA, 16 bp, H. sapiens
atcaagaaactgaaaa

SEQ ID NO: 48138 - DNA, 16 bp, H. sapiens
atcaagaaatagaaca

SEQ ID NO: 48139 - DNA, 16 bp, H. sapiens
atcaagaacaaaccaa

SEQ ID NO: 48140 - DNA, 16 bp, H. sapiens
atcaagaacacagtcc

SEQ ID NO: 48141 - DNA, 16 bp, H. sapiens
atcaagaagaaattct

SEQ ID NO: 48142 - DNA, 16 bp, H. sapiens
atcaagaagatataaa

SEQ ID NO: 48143 - DNA, 16 bp, H. sapiens
atcaagaaggtgaaaa

SEQ ID NO: 48144 - DNA, 16 bp, H. sapiens
atcaagaccatctggc

SEQ ID NO: 48145 - DNA, 31 bp, H. sapiens
atcaagacccatcagtgtgctgtattcagga

SEQ ID NO: 48146 - DNA, 16 bp, H. sapiens
atcaagactccatctc

SEQ ID NO: 48147 - DNA, 16 bp, H. sapiens
atcaagagcagcctgg

SEQ ID NO: 48148 - DNA, 16 bp, H. sapiens
atcaagagcatcctgg

SEQ ID NO: 48149 - DNA, 16 bp, H. sapiens
atcaagagccttaaaa

SEQ ID NO: 48150 - DNA, 16 bp, H. sapiens
atcaagagcttcaaca

SEQ ID NO: 48151 - DNA, 16 bp, H. sapiens
atcaagaggtcaagag

SEQ ID NO: 48152 - DNA, 16 bp, H. sapiens
atcaagatcctgaagc

SEQ ID NO: 48153 - DNA, 16 bp, H. sapiens
atcaagattgaaccat

SEQ ID NO: 48154 - DNA, 16 bp, H. sapiens
atcaagcagaaggaag

SEQ ID NO: 48155 - DNA, 16 bp, H. sapiens
atcaagcaggagaaag

SEQ ID NO: 48156 - DNA, 16 bp, H. sapiens
atcaagcatcttctct

SEQ ID NO: 48157 - DNA, 16 bp, H. sapiens
atcaagcattttctct

SEQ ID NO: 48158 - DNA, 16 bp, H. sapiens
atcaagccaagtataa

SEQ ID NO: 48159 - DNA, 20 bp, H. sapiens
atcaagctaccattgacttt

SEQ ID NO: 48160 - DNA, 16 bp, H. sapiens
atcaagctgttggcag

SEQ ID NO: 48161 - DNA, 16 bp, H. sapiens
atcaaggaaaacttcc

SEQ ID NO: 48162 - DNA, 16 bp, H. sapiens
atcaaggaaatgaaaa

SEQ ID NO: 48163 - DNA, 16 bp, H. sapiens
atcaaggaaatgcaaa

SEQ ID NO: 48164 - DNA, 16 bp, H. sapiens
atcaaggaaggcttcc

SEQ ID NO: 48165 - DNA, 16 bp, H. sapiens
atcaaggaagtgaaaa

SEQ ID NO: 48166 - DNA, 16 bp, H. sapiens
atcaaggactcaaaag

SEQ ID NO: 48167 - DNA, 16 bp, H. sapiens
atcaaggaggtgaaag

SEQ ID NO: 48168 - DNA, 16 bp, H. sapiens
atcaaggatattggtg

SEQ ID NO: 48169 - DNA, 16 bp, H. sapiens
atcaaggatgcagtga

SEQ ID NO: 48170 - DNA, 16 bp, H. sapiens
atcaaggatgtggaca

SEQ ID NO: 48171 - DNA, 16 bp, H. sapiens
atcaaggcagaaatca

SEQ ID NO: 48172 - DNA, 16 bp, H. sapiens
atcaaggcagaaggtg

SEQ ID NO: 48173 - DNA, 16 bp, H. sapiens
atcaaggcagacctgg

SEQ ID NO: 48174 - DNA, 16 bp, H. sapiens
atcaaggctctggcag

SEQ ID NO: 48175 - DNA, 17 bp, H. sapiens
atcaaggctgcagtgaa

SEQ ID NO: 48176 - DNA, 16 bp, H. sapiens
atcaaggggaagaaag

SEQ ID NO: 48177 - DNA, 16 bp, H. sapiens
atcaagggtacatact

SEQ ID NO: 48178 - DNA, 16 bp, H. sapiens
atcaaggtattagcag

SEQ ID NO: 48179 - DNA, 16 bp, H. sapiens
atcaaggtgccaggag

SEQ ID NO: 48180 - DNA, 16 bp, H. sapiens
atcaaggtgctggaag

SEQ ID NO: 48181 - DNA, 16 bp, H. sapiens
atcaaggtggcagcag

SEQ ID NO: 48182 - DNA, 16 bp, H. sapiens
atcaaggtggtggcag

SEQ ID NO: 48183 - DNA, 16 bp, H. sapiens
atcaaggtggtggttg

SEQ ID NO: 48184 - DNA, 16 bp, H. sapiens
atcaaggtgtcagcag

SEQ ID NO: 48185 - DNA, 16 bp, H. sapiens
atcaaggtgtgggcag

SEQ ID NO: 48186 - DNA, 16 bp, H. sapiens
atcaaggtgttggcat

SEQ ID NO: 48187 - DNA, 16 bp, H. sapiens
atcaagtcggcttcat

SEQ ID NO: 48188 - DNA, 16 bp, H. sapiens
atcaagtgacctgaaa

SEQ ID NO: 48189 - DNA, 16 bp, H. sapiens
atcaagtggaaattct

SEQ ID NO: 48190 - DNA, 16 bp, H. sapiens
atcaagtggaagaaaa

SEQ ID NO: 48191 - DNA, 16 bp, H. sapiens
atcaagtggacctgat

SEQ ID NO: 48192 - DNA, 16 bp, H. sapiens
atcaagtggaggaaag

SEQ ID NO: 48193 - DNA, 17 bp, H. sapiens
atcaagtgggcttcatc

SEQ ID NO: 48194 - DNA, 16 bp, H. sapiens
atcaagttaattaaca

SEQ ID NO: 48195 - DNA, 16 bp, H. sapiens
atcaagttgggaagaa

SEQ ID NO: 48196 - DNA, 16 bp, H. sapiens
atcaataaaactgaca

SEQ ID NO: 48197 - DNA, 16 bp, H. sapiens
atcaataaacatgaca

SEQ ID NO: 48198 - DNA, 16 bp, H. sapiens
atcaataaatttgaaa

SEQ ID NO: 48199 - DNA, 16 bp, H. sapiens
atcaataagaaaaagg

SEQ ID NO: 48200 - DNA, 16 bp, H. sapiens
atcaatacacacacac

SEQ ID NO: 48201 - DNA, 16 bp, H. sapiens
atcaatacctagtttt

SEQ ID NO: 48202 - DNA, 16 bp, H. sapiens
atcaatatgaaaaaga

SEQ ID NO: 48203 - DNA, 16 bp, H. sapiens
atcaatatgcaaaaat

SEQ ID NO: 48204 - DNA, 16 bp, H. sapiens
atcaatatttttcaaa

SEQ ID NO: 48205 - DNA, 16 bp, H. sapiens
atcaatcaataaatga

SEQ ID NO: 48206 - DNA, 16 bp, H. sapiens
atcaatcagaagaaag

SEQ ID NO: 48207 - DNA, 16 bp, H. sapiens
atcaatcttttccttt

SEQ ID NO: 48208 - DNA, 16 bp, H. sapiens
atcaatgaaacagaag

SEQ ID NO: 48209 - DNA, 16 bp, H. sapiens
atcaatgaaacataaa

SEQ ID NO: 48210 - DNA, 16 bp, H. sapiens
atcaatgaaatgaaaa

SEQ ID NO: 48211 - DNA, 16 bp, H. sapiens
atcaatgaaattgata

SEQ ID NO: 48212 - DNA, 16 bp, H. sapiens
atcaatgacattaagt

SEQ ID NO: 48213 - DNA, 16 bp, H. sapiens
atcaatgagatagaaa

SEQ ID NO: 48214 - DNA, 16 bp, H. sapiens
atcaatgcaacaagaa

SEQ ID NO: 48215 - DNA, 16 bp, H. sapiens
atcaatggaacataac

SEQ ID NO: 48216 - DNA, 16 bp, H. sapiens
atcaatggacatttgg

SEQ ID NO: 48217 - DNA, 16 bp, H. sapiens
atcaatggatgaatga

SEQ ID NO: 48218 - DNA, 16 bp, H. sapiens
atcaatgggcatttgg

SEQ ID NO: 48219 - DNA, 16 bp, H. sapiens
atcaatgtatttctta

SEQ ID NO: 48220 - DNA, 16 bp, H. sapiens
atcaatgtcatgaaaa

SEQ ID NO: 48221 - DNA, 16 bp, H. sapiens
atcaatgtgaaaatcc

SEQ ID NO: 48222 - DNA, 16 bp, H. sapiens
atcaatgttcatcatg

SEQ ID NO: 48223 - DNA, 16 bp, H. sapiens
atcaatgttttttaaa

SEQ ID NO: 48224 - DNA, 16 bp, H. sapiens
atcaattgactttgtg

SEQ ID NO: 48225 - DNA, 16 bp, H. sapiens
atcaattgtaacaaat

SEQ ID NO: 48226 - DNA, 16 bp, H. sapiens
atcaatttgaagagaa

SEQ ID NO: 48227 - DNA, 16 bp, H. sapiens
atcaatttggggagta

SEQ ID NO: 48228 - DNA, 16 bp, H. sapiens
atcaattttgttgatt

SEQ ID NO: 48229 - DNA, 16 bp, H. sapiens
atcacaaagctgtttc

SEQ ID NO: 48230 - DNA, 16 bp, H. sapiens
atcacaaatcagtttc

SEQ ID NO: 48231 - DNA, 16 bp, H. sapiens
atcacaaattagtttc

SEQ ID NO: 48232 - DNA, 16 bp, H. sapiens
atcacaactcactgca

SEQ ID NO: 48233 - DNA, 16 bp, H. sapiens
atcacaactccttgcc

SEQ ID NO: 48234 - DNA, 16 bp, H. sapiens
atcacaagatgaagtc

SEQ ID NO: 48235 - DNA, 16 bp, H. sapiens
atcacaagctcaggag

SEQ ID NO: 48236 - DNA, 16 bp, H. sapiens
atcacaagggcaggag

SEQ ID NO: 48237 - DNA, 16 bp, H. sapiens
atcacaaggtcaggac

SEQ ID NO: 48238 - DNA, 16 bp, H. sapiens
atcacaaggtcctaca

SEQ ID NO: 48239 - DNA, 16 bp, H. sapiens
atcacaaggttaagag

SEQ ID NO: 48240 - DNA, 16 bp, H. sapiens
atcacaaggttaggag

SEQ ID NO: 48241 - DNA, 16 bp, H. sapiens
atcacaataaagcaag

SEQ ID NO: 48242 - DNA, 16 bp, H. sapiens
atcacaatggaataaa

SEQ ID NO: 48243 - DNA, 16 bp, H. sapiens
atcacaatgtcaggag

SEQ ID NO: 48244 - DNA, 16 bp, H. sapiens
atcacaattctaaata

SEQ ID NO: 48245 - DNA, 16 bp, H. sapiens
atcacacagagttaaa

SEQ ID NO: 48246 - DNA, 16 bp, H. sapiens
atcacacaggctggag

SEQ ID NO: 48247 - DNA, 16 bp, H. sapiens
atcacacataacaata

SEQ ID NO: 48248 - DNA, 21 bp, H. sapiens
atcacacataacaatattaac

SEQ ID NO: 48249 - DNA, 16 bp, H. sapiens
atcacaccactgcact

SEQ ID NO: 48250 - DNA, 21 bp, H. sapiens
atcacaccactgcactccagt

SEQ ID NO: 48251 - DNA, 16 bp, H. sapiens
atcacaccatcgcact

SEQ ID NO: 48252 - DNA, 16 bp, H. sapiens
atcacaccattgcacg

SEQ ID NO: 48253 - DNA, 17 bp, H. sapiens
atcacacccagctaatt

SEQ ID NO: 48254 - DNA, 19 bp, H. sapiens
atcacactctggggactgt

SEQ ID NO: 48255 - DNA, 17 bp, H. sapiens
atcacactggtccatta

SEQ ID NO: 48256 - DNA, 16 bp, H. sapiens
atcacactgtggtttt

SEQ ID NO: 48257 - DNA, 16 bp, H. sapiens
atcacactttgtttat

SEQ ID NO: 48258 - DNA, 16 bp, H. sapiens
atcacagaaggtggac

SEQ ID NO: 48259 - DNA, 16 bp, H. sapiens
atcacagaagtgatgt

SEQ ID NO: 48260 - DNA, 16 bp, H. sapiens
atcacagacctggagg

SEQ ID NO: 48261 - DNA, 16 bp, H. sapiens
atcacagagaatgggg

SEQ ID NO: 48262 - DNA, 16 bp, H. sapiens
atcacagagctcttca

SEQ ID NO: 48263 - DNA, 16 bp, H. sapiens
atcacagaggggtgta

SEQ ID NO: 48264 - DNA, 16 bp, H. sapiens
atcacagatcactgca

SEQ ID NO: 48265 - DNA, 17 bp, H. sapiens
atcacagcactttagga

SEQ ID NO: 48266 - DNA, 16 bp, H. sapiens
atcacagccaccacca

SEQ ID NO: 48267 - DNA, 16 bp, H. sapiens
atcacagctcaatgca

SEQ ID NO: 48268 - DNA, 16 bp, H. sapiens
atcacagctcactgca

SEQ ID NO: 48269 - DNA, 16 bp, H. sapiens
atcacagctcattgca

SEQ ID NO: 48270 - DNA, 16 bp, H. sapiens
atcacagcttactgca

SEQ ID NO: 48271 - DNA, 16 bp, H. sapiens
atcacaggatcaaatt

SEQ ID NO: 48272 - DNA, 16 bp, H. sapiens
atcacaggcatgagct

SEQ ID NO: 48273 - DNA, 17 bp, H. sapiens
atcacaggcatgtgcca

SEQ ID NO: 48274 - DNA, 16 bp, H. sapiens
atcacaggcccagaag

SEQ ID NO: 48275 - DNA, 16 bp, H. sapiens
atcacaggggaagaga

SEQ ID NO: 48276 - DNA, 16 bp, H. sapiens
atcacagtgctattca

SEQ ID NO: 48277 - DNA, 16 bp, H. sapiens
atcacatagcagtttc

SEQ ID NO: 48278 - DNA, 16 bp, H. sapiens
atcacatcatcaccat

SEQ ID NO: 48279 - DNA, 16 bp, H. sapiens
atcacatcatgaagaa

SEQ ID NO: 48280 - DNA, 17 bp, H. sapiens
atcacatgaggccagga

SEQ ID NO: 48281 - DNA, 20 bp, H. sapiens
atcacatgaggtcaggagtt

SEQ ID NO: 48282 - DNA, 16 bp, H. sapiens
atcacatggcaaaagc

SEQ ID NO: 48283 - DNA, 16 bp, H. sapiens
atcacatgttctcact

SEQ ID NO: 48284 - DNA, 17 bp, H. sapiens
atcacattacctgactt

SEQ ID NO: 48285 - DNA, 16 bp, H. sapiens
atcacatttacaaaat

SEQ ID NO: 48286 - DNA, 16 bp, H. sapiens
atcacattttatttct

SEQ ID NO: 48287 - DNA, 16 bp, H. sapiens
atcaccaaaatcaaga

SEQ ID NO: 48288 - DNA, 16 bp, H. sapiens
atcaccaagcctggct

SEQ ID NO: 48289 - DNA, 21 bp, H. sapiens
atcaccaatcattctatatga

SEQ ID NO: 48290 - DNA, 16 bp, H. sapiens
atcaccacaaagatct

SEQ ID NO: 48291 - DNA, 16 bp, H. sapiens
atcaccaccaccatta

SEQ ID NO: 48292 - DNA, 16 bp, H. sapiens
atcaccaccatcacta

SEQ ID NO: 48293 - DNA, 16 bp, H. sapiens
atcaccaccatcatca

SEQ ID NO: 48294 - DNA, 16 bp, H. sapiens
atcaccaccatgacca

SEQ ID NO: 48295 - DNA, 16 bp, H. sapiens
atcaccaccattacca

SEQ ID NO: 48296 - DNA, 16 bp, H. sapiens
atcaccactaccacca

SEQ ID NO: 48297 - DNA, 16 bp, H. sapiens
atcaccactgccacca

SEQ ID NO: 48298 - DNA, 20 bp, H. sapiens
atcaccagaggtcaggagtt

SEQ ID NO: 48299 - DNA, 16 bp, H. sapiens
atcaccagcaccacca

SEQ ID NO: 48300 - DNA, 16 bp, H. sapiens
atcaccagcatcatca

SEQ ID NO: 48301 - DNA, 16 bp, H. sapiens
atcaccagtggccaat

SEQ ID NO: 48302 - DNA, 16 bp, H. sapiens
atcaccagtgttggag

SEQ ID NO: 48303 - DNA, 16 bp, H. sapiens
atcaccatcaacacca

SEQ ID NO: 48304 - DNA, 16 bp, H. sapiens
atcaccatcaccaaca

SEQ ID NO: 48305 - DNA, 16 bp, H. sapiens
atcaccatcaccatca

SEQ ID NO: 48306 - DNA, 16 bp, H. sapiens
atcaccatcaccgtca

SEQ ID NO: 48307 - DNA, 16 bp, H. sapiens
atcaccatcaccttca

SEQ ID NO: 48308 - DNA, 16 bp, H. sapiens
atcaccatcactgtca

SEQ ID NO: 48309 - DNA, 16 bp, H. sapiens
atcaccatcatcactg

SEQ ID NO: 48310 - DNA, 16 bp, H. sapiens
atcaccatcatcctca

SEQ ID NO: 48311 - DNA, 16 bp, H. sapiens
atcaccatcatcttca

SEQ ID NO: 48312 - DNA, 16 bp, H. sapiens
atcaccatgcccacct

SEQ ID NO: 48313 - DNA, 16 bp, H. sapiens
atcaccatgcctagct

SEQ ID NO: 48314 - DNA, 16 bp, H. sapiens
atcaccattaaaagaa

SEQ ID NO: 48315 - DNA, 16 bp, H. sapiens
atcacccacctcagcc

SEQ ID NO: 48316 - DNA, 16 bp, H. sapiens
atcacccaccttctgc

SEQ ID NO: 48317 - DNA, 16 bp, H. sapiens
atcacccagactggag

SEQ ID NO: 48318 - DNA, 16 bp, H. sapiens
atcacccaggagcttg

SEQ ID NO: 48319 - DNA, 16 bp, H. sapiens
atcacccaggctgaag

SEQ ID NO: 48320 - DNA, 16 bp, H. sapiens
atcacccagtctggag

SEQ ID NO: 48321 - DNA, 16 bp, H. sapiens
atcaccccagccaaca

SEQ ID NO: 48322 - DNA, 16 bp, H. sapiens
atcaccctaatatcaa

SEQ ID NO: 48323 - DNA, 16 bp, H. sapiens
atcaccctggctaaca

SEQ ID NO: 48324 - DNA, 21 bp, H. sapiens
atcaccgatcccacagaaata

SEQ ID NO: 48325 - DNA, 16 bp, H. sapiens
atcacctaaggccagg

SEQ ID NO: 48326 - DNA, 16 bp, H. sapiens
atcacctatgtattaa

SEQ ID NO: 48327 - DNA, 16 bp, H. sapiens
atcacctcaaacattt

SEQ ID NO: 48328 - DNA, 16 bp, H. sapiens
atcacctcacatagtt

SEQ ID NO: 48329 - DNA, 16 bp, H. sapiens
atcacctcacatgctt

SEQ ID NO: 48330 - DNA, 16 bp, H. sapiens
atcacctcagacattt

SEQ ID NO: 48331 - DNA, 16 bp, H. sapiens
atcacctcaggccagg

SEQ ID NO: 48332 - DNA, 16 bp, H. sapiens
atcacctccaccatca

SEQ ID NO: 48333 - DNA, 16 bp, H. sapiens
atcacctcctccaaga

SEQ ID NO: 48334 - DNA, 16 bp, H. sapiens
atcacctcttaaaggc

SEQ ID NO: 48335 - DNA, 20 bp, H. sapiens
atcacctgaagtcaggagtt

SEQ ID NO: 48336 - DNA, 16 bp, H. sapiens
atcacctgagaaacct

SEQ ID NO: 48337 - DNA, 20 bp, H. sapiens
atcacctgagatcaggagtt

SEQ ID NO: 48338 - DNA, 20 bp, H. sapiens
atcacctgagatcgggagtt

SEQ ID NO: 48339 - DNA, 16 bp, H. sapiens
atcacctgagcagtgt

SEQ ID NO: 48340 - DNA, 16 bp, H. sapiens
atcacctgagcccaga

SEQ ID NO: 48341 - DNA, 16 bp, H. sapiens
atcacctgagcccagg

SEQ ID NO: 48342 - DNA, 17 bp, H. sapiens
atcacctgagcccagga

SEQ ID NO: 48343 - DNA, 16 bp, H. sapiens
atcacctgagccctgg

SEQ ID NO: 48344 - DNA, 16 bp, H. sapiens
atcacctgagcttggg

SEQ ID NO: 48345 - DNA, 20 bp, H. sapiens
atcacctgaggacaggagtt

SEQ ID NO: 48346 - DNA, 20 bp, H. sapiens
atcacctgaggtcaagagtt

SEQ ID NO: 48347 - DNA, 16 bp, H. sapiens
atcacctgaggtcaga

SEQ ID NO: 48348 - DNA, 20 bp, H. sapiens
atcacctgaggtcagaagtt

SEQ ID NO: 48349 - DNA, 20 bp, H. sapiens
atcacctgaggtcaggaatt

SEQ ID NO: 48350 - DNA, 20 bp, H. sapiens
atcacctgaggtcaggactt

SEQ ID NO: 48351 - DNA, 19 bp, H. sapiens
atcacctgaggtcaggaga

SEQ ID NO: 48352 - DNA, 20 bp, H. sapiens
atcacctgaggtcaggagtt

SEQ ID NO: 48353 - DNA, 18 bp, H. sapiens
atcacctgaggtcaggat

SEQ ID NO: 48354 - DNA, 17 bp, H. sapiens
atcacctgaggtcaggg

SEQ ID NO: 48355 - DNA, 16 bp, H. sapiens
atcacctgaggtcagt

SEQ ID NO: 48356 - DNA, 20 bp, H. sapiens
atcacctgaggtcgggagtt

SEQ ID NO: 48357 - DNA, 20 bp, H. sapiens
atcacctgaggtctggagtt

SEQ ID NO: 48358 - DNA, 20 bp, H. sapiens
atcacctgaggttaggagtt

SEQ ID NO: 48359 - DNA, 20 bp, H. sapiens
atcacctgaggttgggagtt

SEQ ID NO: 48360 - DNA, 16 bp, H. sapiens
atcacctgagtccaag

SEQ ID NO: 48361 - DNA, 20 bp, H. sapiens
atcacctgatgtcaggagtt

SEQ ID NO: 48362 - DNA, 21 bp, H. sapiens
atcacctgatgtcaggggttc

SEQ ID NO: 48363 - DNA, 16 bp, H. sapiens
atcacctggaggactt

SEQ ID NO: 48364 - DNA, 16 bp, H. sapiens
atcacctggagggctt

SEQ ID NO: 48365 - DNA, 16 bp, H. sapiens
atcacctgggaacatg

SEQ ID NO: 48366 - DNA, 16 bp, H. sapiens
atcacctgggaagctt

SEQ ID NO: 48367 - DNA, 16 bp, H. sapiens
atcacctgtcaggagt

SEQ ID NO: 48368 - DNA, 16 bp, H. sapiens
atcacctgtggtcagg

SEQ ID NO: 48369 - DNA, 16 bp, H. sapiens
atcaccttaaatattt

SEQ ID NO: 48370 - DNA, 16 bp, H. sapiens
atcaccttttctttat

SEQ ID NO: 48371 - DNA, 16 bp, H. sapiens
atcacgacatcaggag

SEQ ID NO: 48372 - DNA, 16 bp, H. sapiens
atcacgaggtctggag

SEQ ID NO: 48373 - DNA, 17 bp, H. sapiens
atcacgccactgcactt

SEQ ID NO: 48374 - DNA, 16 bp, H. sapiens
atcacgccactgctct

SEQ ID NO: 48375 - DNA, 16 bp, H. sapiens
atcacgcccagctaat

SEQ ID NO: 48376 - DNA, 19 bp, H. sapiens
atcacgcccagctaatttt

SEQ ID NO: 48377 - DNA, 17 bp, H. sapiens
atcacgcctggctaatt

SEQ ID NO: 48378 - DNA, 18 bp, H. sapiens
atcacgctgcctgacttc

SEQ ID NO: 48379 - DNA, 16 bp, H. sapiens
atcacggctcacagca

SEQ ID NO: 48380 - DNA, 16 bp, H. sapiens
atcacggctcactgca

SEQ ID NO: 48381 - DNA, 16 bp, H. sapiens
atcacggctcactgta

SEQ ID NO: 48382 - DNA, 16 bp, H. sapiens
atcacgtaaacagaac

SEQ ID NO: 48383 - DNA, 16 bp, H. sapiens
atcactaaggaaaact

SEQ ID NO: 48384 - DNA, 16 bp, H. sapiens
atcactaatcatcaga

SEQ ID NO: 48385 - DNA, 16 bp, H. sapiens
atcactacaaagagaa

SEQ ID NO: 48386 - DNA, 16 bp, H. sapiens
atcactaggtcaggag

SEQ ID NO: 48387 - DNA, 16 bp, H. sapiens
atcactagtggcactt

SEQ ID NO: 48388 - DNA, 16 bp, H. sapiens
atcactatcaccacca

SEQ ID NO: 48389 - DNA, 16 bp, H. sapiens
atcactatcaccatca

SEQ ID NO: 48390 - DNA, 16 bp, H. sapiens
atcactatcatcatca

SEQ ID NO: 48391 - DNA, 16 bp, H. sapiens
atcactatgcctggct

SEQ ID NO: 48392 - DNA, 16 bp, H. sapiens
atcactattgtgaaaa

SEQ ID NO: 48393 - DNA, 16 bp, H. sapiens
atcactcaaatagtga

SEQ ID NO: 48394 - DNA, 16 bp, H. sapiens
atcactcaaggtcagg

SEQ ID NO: 48395 - DNA, 16 bp, H. sapiens
atcactccagtctctg

SEQ ID NO: 48396 - DNA, 16 bp, H. sapiens
atcactcgagcccagg

SEQ ID NO: 48397 - DNA, 16 bp, H. sapiens
atcactctgtgattct

SEQ ID NO: 48398 - DNA, 16 bp, H. sapiens
atcactgaaagaaatt

SEQ ID NO: 48399 - DNA, 16 bp, H. sapiens
atcactgaagattcct

SEQ ID NO: 48400 - DNA, 20 bp, H. sapiens
atcactgatcccacagaaat

SEQ ID NO: 48401 - DNA, 16 bp, H. sapiens
atcactgcagaaagtt

SEQ ID NO: 48402 - DNA, 16 bp, H. sapiens
atcactgctcactgca

SEQ ID NO: 48403 - DNA, 16 bp, H. sapiens
atcactgctgattatt

SEQ ID NO: 48404 - DNA, 17 bp, H. sapiens
atcactggaacccggga

SEQ ID NO: 48405 - DNA, 16 bp, H. sapiens
atcactggaaggccca

SEQ ID NO: 48406 - DNA, 16 bp, H. sapiens
atcactgtactccagc

SEQ ID NO: 48407 - DNA, 16 bp, H. sapiens
atcactgtcaccatca

SEQ ID NO: 48408 - DNA, 16 bp, H. sapiens
atcactgtcattatca

SEQ ID NO: 48409 - DNA, 16 bp, H. sapiens
atcactgtgctctccc

SEQ ID NO: 48410 - DNA, 16 bp, H. sapiens
atcactgtggctgctg

SEQ ID NO: 48411 - DNA, 17 bp, H. sapiens
atcacttaaacccagga

SEQ ID NO: 48412 - DNA, 16 bp, H. sapiens
atcacttaaacctgga

SEQ ID NO: 48413 - DNA, 17 bp, H. sapiens
atcacttaagcccagga

SEQ ID NO: 48414 - DNA, 16 bp, H. sapiens
atcacttcaatctctg

SEQ ID NO: 48415 - DNA, 16 bp, H. sapiens
atcacttccctccctt

SEQ ID NO: 48416 - DNA, 16 bp, H. sapiens
atcacttcttttgtga

SEQ ID NO: 48417 - DNA, 16 bp, H. sapiens
atcacttgaacatgga

SEQ ID NO: 48418 - DNA, 16 bp, H. sapiens
atcacttgaaccaagg

SEQ ID NO: 48419 - DNA, 17 bp, H. sapiens
atcacttgaaccaggag

SEQ ID NO: 48420 - DNA, 16 bp, H. sapiens
atcacttgaaccccag

SEQ ID NO: 48421 - DNA, 16 bp, H. sapiens
atcacttgaaccgagg

SEQ ID NO: 48422 - DNA, 18 bp, H. sapiens
atcacttgaacctgggac

SEQ ID NO: 48423 - DNA, 21 bp, H. sapiens
atcacttgaacctgggagaca

SEQ ID NO: 48424 - DNA, 18 bp, H. sapiens
atcacttgaactcaggaa

SEQ ID NO: 48425 - DNA, 16 bp, H. sapiens
atcacttgagaccagt

SEQ ID NO: 48426 - DNA, 17 bp, H. sapiens
atcacttgagatcagga

SEQ ID NO: 48427 - DNA, 16 bp, H. sapiens
atcacttgagcacagg

SEQ ID NO: 48428 - DNA, 16 bp, H. sapiens
atcacttgagcccaat

SEQ ID NO: 48429 - DNA, 16 bp, H. sapiens
atcacttgagccccaa

SEQ ID NO: 48430 - DNA, 16 bp, H. sapiens
atcacttgagccccag

SEQ ID NO: 48431 - DNA, 17 bp, H. sapiens
atcacttgagcccggga

SEQ ID NO: 48432 - DNA, 16 bp, H. sapiens
atcacttgagcctagg

SEQ ID NO: 48433 - DNA, 16 bp, H. sapiens
atcacttgagcctgag

SEQ ID NO: 48434 - DNA, 17 bp, H. sapiens
atcacttgaggccagga

SEQ ID NO: 48435 - DNA, 16 bp, H. sapiens
atcacttgaggctgag

SEQ ID NO: 48436 - DNA, 20 bp, H. sapiens
atcacttgaggtcaggagtc

SEQ ID NO: 48437 - DNA, 17 bp, H. sapiens
atcacttgaggtcaggc

SEQ ID NO: 48438 - DNA, 17 bp, H. sapiens
atcacttgatatcagga

SEQ ID NO: 48439 - DNA, 18 bp, H. sapiens
atcacttgcggtcaggag

SEQ ID NO: 48440 - DNA, 16 bp, H. sapiens
atcacttgggcccaga

SEQ ID NO: 48441 - DNA, 16 bp, H. sapiens
atcacttggtcaggag

SEQ ID NO: 48442 - DNA, 16 bp, H. sapiens
atcactttgggaggcc

SEQ ID NO: 48443 - DNA, 16 bp, H. sapiens
atcagaaaaatattaa

SEQ ID NO: 48444 - DNA, 16 bp, H. sapiens
atcagaaaacctttga

SEQ ID NO: 48445 - DNA, 16 bp, H. sapiens
atcagaaaataaaatt

SEQ ID NO: 48446 - DNA, 16 bp, H. sapiens
atcagaaaccaccaac

SEQ ID NO: 48447 - DNA, 16 bp, H. sapiens
atcagaaacctgcatt

SEQ ID NO: 48448 - DNA, 16 bp, H. sapiens
atcagaaagaaaagga

SEQ ID NO: 48449 - DNA, 16 bp, H. sapiens
atcagaaagaaagaga

SEQ ID NO: 48450 - DNA, 16 bp, H. sapiens
atcagaaagaaattga

SEQ ID NO: 48451 - DNA, 16 bp, H. sapiens
atcagaaagcagtttc

SEQ ID NO: 48452 - DNA, 16 bp, H. sapiens
atcagaaatattaaaa

SEQ ID NO: 48453 - DNA, 16 bp, H. sapiens
atcagaaatgaaagag

SEQ ID NO: 48454 - DNA, 16 bp, H. sapiens
atcagaaatgacaaat

SEQ ID NO: 48455 - DNA, 16 bp, H. sapiens
atcagaaatgataaaa

SEQ ID NO: 48456 - DNA, 16 bp, H. sapiens
atcagaaatgcaaatt

SEQ ID NO: 48457 - DNA, 16 bp, H. sapiens
atcagaacatcacatt

SEQ ID NO: 48458 - DNA, 16 bp, H. sapiens
atcagaaccaggaaat

SEQ ID NO: 48459 - DNA, 16 bp, H. sapiens
atcagaagacctgggt

SEQ ID NO: 48460 - DNA, 16 bp, H. sapiens
atcagaagtgtttcag

SEQ ID NO: 48461 - DNA, 16 bp, H. sapiens
atcagaagttcaagac

SEQ ID NO: 48462 - DNA, 16 bp, H. sapiens
atcagaatcacctgga

SEQ ID NO: 48463 - DNA, 16 bp, H. sapiens
atcagaatcacttgga

SEQ ID NO: 48464 - DNA, 16 bp, H. sapiens
atcagaatcatctggg

SEQ ID NO: 48465 - DNA, 16 bp, H. sapiens
atcagaatgtgcagct

SEQ ID NO: 48466 - DNA, 16 bp, H. sapiens
atcagaattatagaag

SEQ ID NO: 48467 - DNA, 16 bp, H. sapiens
atcagaattttttaaa

SEQ ID NO: 48468 - DNA, 16 bp, H. sapiens
atcagacaaacccaaa

SEQ ID NO: 48469 - DNA, 16 bp, H. sapiens
atcagacaccaatgga

SEQ ID NO: 48470 - DNA, 30 bp, H. sapiens
atcagacactaaccccaaatgagagaagtg

SEQ ID NO: 48471 - DNA, 17 bp, H. sapiens
atcagaccaacagcaga

SEQ ID NO: 48472 - DNA, 16 bp, H. sapiens
atcagactggcaaaaa

SEQ ID NO: 48473 - DNA, 17 bp, H. sapiens
atcagagaaatgcaaat

SEQ ID NO: 48474 - DNA, 16 bp, H. sapiens
atcagagaagacacaa

SEQ ID NO: 48475 - DNA, 16 bp, H. sapiens
atcagagaagagaaaa

SEQ ID NO: 48476 - DNA, 16 bp, H. sapiens
atcagagaagagaaag

SEQ ID NO: 48477 - DNA, 20 bp, H. sapiens
atcagagaatactgtaaaca

SEQ ID NO: 48478 - DNA, 16 bp, H. sapiens
atcagagaatattata

SEQ ID NO: 48479 - DNA, 16 bp, H. sapiens
atcagagactcaaaag

SEQ ID NO: 48480 - DNA, 16 bp, H. sapiens
atcagagcaaaactaa

SEQ ID NO: 48481 - DNA, 16 bp, H. sapiens
atcagagcaatgcaaa

SEQ ID NO: 48482 - DNA, 16 bp, H. sapiens
atcagagcagaaatga

SEQ ID NO: 48483 - DNA, 19 bp, H. sapiens
atcagagcagaactgaaga

SEQ ID NO: 48484 - DNA, 20 bp, H. sapiens
atcagagcagaactgaagga

SEQ ID NO: 48485 - DNA, 16 bp, H. sapiens
atcagagctatttatg

SEQ ID NO: 48486 - DNA, 16 bp, H. sapiens
atcagagctcactgca

SEQ ID NO: 48487 - DNA, 16 bp, H. sapiens
atcagagctcttttat

SEQ ID NO: 48488 - DNA, 16 bp, H. sapiens
atcagaggcccagagg

SEQ ID NO: 48489 - DNA, 16 bp, H. sapiens
atcagataaataaata

SEQ ID NO: 48490 - DNA, 16 bp, H. sapiens
atcagatatgtatttt

SEQ ID NO: 48491 - DNA, 16 bp, H. sapiens
atcagatctcatgaga

SEQ ID NO: 48492 - DNA, 16 bp, H. sapiens
atcagatcttgtgaga

SEQ ID NO: 48493 - DNA, 16 bp, H. sapiens
atcagatgtcctgagt

SEQ ID NO: 48494 - DNA, 16 bp, H. sapiens
atcagattaacagtgg

SEQ ID NO: 48495 - DNA, 20 bp, H. sapiens
atcagattagcccctgagag

SEQ ID NO: 48496 - DNA, 16 bp, H. sapiens
atcagattattagttt

SEQ ID NO: 48497 - DNA, 16 bp, H. sapiens
atcagattcatcaaat

SEQ ID NO: 48498 - DNA, 16 bp, H. sapiens
atcagatttcctgaga

SEQ ID NO: 48499 - DNA, 16 bp, H. sapiens
atcagattttgtgaga

SEQ ID NO: 48500 - DNA, 16 bp, H. sapiens
atcagattttttaaaa

SEQ ID NO: 48501 - DNA, 16 bp, H. sapiens
atcagcaaacaaggat

SEQ ID NO: 48502 - DNA, 16 bp, H. sapiens
atcagcaataaggttg

SEQ ID NO: 48503 - DNA, 16 bp, H. sapiens
atcagcaccatcacca

SEQ ID NO: 48504 - DNA, 16 bp, H. sapiens
atcagcaccatttttc

SEQ ID NO: 48505 - DNA, 18 bp, H. sapiens
atcagcactctgtaaaac

SEQ ID NO: 48506 - DNA, 16 bp, H. sapiens
atcagcagcagcatca

SEQ ID NO: 48507 - DNA, 16 bp, H. sapiens
atcagcagtggaggct

SEQ ID NO: 48508 - DNA, 16 bp, H. sapiens
atcagcagtggtggct

SEQ ID NO: 48509 - DNA, 16 bp, H. sapiens
atcagcagttttcttt

SEQ ID NO: 48510 - DNA, 16 bp, H. sapiens
atcagcatcagcatca

SEQ ID NO: 48511 - DNA, 16 bp, H. sapiens
atcagcatcatctggg

SEQ ID NO: 48512 - DNA, 17 bp, H. sapiens
atcagcatgacctggat

SEQ ID NO: 48513 - DNA, 16 bp, H. sapiens
atcagcatgttggtca

SEQ ID NO: 48514 - DNA, 16 bp, H. sapiens
atcagcatttcccaaa

SEQ ID NO: 48515 - DNA, 16 bp, H. sapiens
atcagcatttgctgct

SEQ ID NO: 48516 - DNA, 16 bp, H. sapiens
atcagcattttgatca

SEQ ID NO: 48517 - DNA, 16 bp, H. sapiens
atcagccagacgtggt

SEQ ID NO: 48518 - DNA, 16 bp, H. sapiens
atcagccaggcacaga

SEQ ID NO: 48519 - DNA, 16 bp, H. sapiens
atcagccaggtgaggt

SEQ ID NO: 48520 - DNA, 16 bp, H. sapiens
atcagcccaccttggc

SEQ ID NO: 48521 - DNA, 16 bp, H. sapiens
atcagcccatctcagc

SEQ ID NO: 48522 - DNA, 16 bp, H. sapiens
atcagccccccgcctg

SEQ ID NO: 48523 - DNA, 17 bp, H. sapiens
atcagcctcccaagtag

SEQ ID NO: 48524 - DNA, 17 bp, H. sapiens
atcagcctgcctcggcc

SEQ ID NO: 48525 - DNA, 16 bp, H. sapiens
atcagcctggcatggt

SEQ ID NO: 48526 - DNA, 19 bp, H. sapiens
atcagcctggccaacatga

SEQ ID NO: 48527 - DNA, 16 bp, H. sapiens
atcagcctggccaacg

SEQ ID NO: 48528 - DNA, 16 bp, H. sapiens
atcagcctggccatca

SEQ ID NO: 48529 - DNA, 16 bp, H. sapiens
atcagcctggtgtggt

SEQ ID NO: 48530 - DNA, 16 bp, H. sapiens
atcagcgtgacctgga

SEQ ID NO: 48531 - DNA, 16 bp, H. sapiens
atcagctcagccacag

SEQ ID NO: 48532 - DNA, 16 bp, H. sapiens
atcagctctctgcaaa

SEQ ID NO: 48533 - DNA, 16 bp, H. sapiens
atcagctgatggacat

SEQ ID NO: 48534 - DNA, 16 bp, H. sapiens
atcagctggaggagct

SEQ ID NO: 48535 - DNA, 16 bp, H. sapiens
atcagctggcttgctg

SEQ ID NO: 48536 - DNA, 16 bp, H. sapiens
atcagcttaaggagac

SEQ ID NO: 48537 - DNA, 16 bp, H. sapiens
atcaggaaaaatagct

SEQ ID NO: 48538 - DNA, 16 bp, H. sapiens
atcaggaaaagaaaga

SEQ ID NO: 48539 - DNA, 16 bp, H. sapiens
atcaggaaaatgcaaa

SEQ ID NO: 48540 - DNA, 16 bp, H. sapiens
atcaggaaagaagaaa

SEQ ID NO: 48541 - DNA, 16 bp, H. sapiens
atcaggaaagagaaag

SEQ ID NO: 48542 - DNA, 16 bp, H. sapiens
atcaggaacaaaataa

SEQ ID NO: 48543 - DNA, 16 bp, H. sapiens
atcaggaacaaagcaa

SEQ ID NO: 48544 - DNA, 16 bp, H. sapiens
atcaggaagaaaagct

SEQ ID NO: 48545 - DNA, 16 bp, H. sapiens
atcaggaagaaatgga

SEQ ID NO: 48546 - DNA, 16 bp, H. sapiens
atcaggaagaagagct

SEQ ID NO: 48547 - DNA, 16 bp, H. sapiens
atcaggaagaaggcaa

SEQ ID NO: 48548 - DNA, 16 bp, H. sapiens
atcaggaagttctttg

SEQ ID NO: 48549 - DNA, 16 bp, H. sapiens
atcaggacccctttcc

SEQ ID NO: 48550 - DNA, 16 bp, H. sapiens
atcaggagaacagcaa

SEQ ID NO: 48551 - DNA, 16 bp, H. sapiens
atcaggatacaaaatc

SEQ ID NO: 48552 - DNA, 19 bp, H. sapiens
atcaggcagcaacatttgc

SEQ ID NO: 48553 - DNA, 16 bp, H. sapiens
atcaggcagcccccag

SEQ ID NO: 48554 - DNA, 16 bp, H. sapiens
atcaggcagcctcctg

SEQ ID NO: 48555 - DNA, 17 bp, H. sapiens
atcaggcattagttaga

SEQ ID NO: 48556 - DNA, 16 bp, H. sapiens
atcaggcatttccagc

SEQ ID NO: 48557 - DNA, 16 bp, H. sapiens
atcaggccgggcacag

SEQ ID NO: 48558 - DNA, 16 bp, H. sapiens
atcagggaaagcttcc

SEQ ID NO: 48559 - DNA, 16 bp, H. sapiens
atcagggaaatgcata

SEQ ID NO: 48560 - DNA, 16 bp, H. sapiens
atcagggaaattaaaa

SEQ ID NO: 48561 - DNA, 16 bp, H. sapiens
atcagggaaattcaaa

SEQ ID NO: 48562 - DNA, 16 bp, H. sapiens
atcagggaagcagata

SEQ ID NO: 48563 - DNA, 16 bp, H. sapiens
atcagggaggtggagg

SEQ ID NO: 48564 - DNA, 16 bp, H. sapiens
atcagggcaatgctgg

SEQ ID NO: 48565 - DNA, 16 bp, H. sapiens
atcagggctcactgca

SEQ ID NO: 48566 - DNA, 16 bp, H. sapiens
atcaggggctgaagtg

SEQ ID NO: 48567 - DNA, 16 bp, H. sapiens
atcaggtcatttaaga

SEQ ID NO: 48568 - DNA, 16 bp, H. sapiens
atcaggtgatccaccc

SEQ ID NO: 48569 - DNA, 16 bp, H. sapiens
atcaggtggcagaaaa

SEQ ID NO: 48570 - DNA, 16 bp, H. sapiens
atcagtaaaatgaaaa

SEQ ID NO: 48571 - DNA, 16 bp, H. sapiens
atcagtaacagaaaaa

SEQ ID NO: 48572 - DNA, 16 bp, H. sapiens
atcagtaagaaaaaga

SEQ ID NO: 48573 - DNA, 16 bp, H. sapiens
atcagtaatgaaaaaa

SEQ ID NO: 48574 - DNA, 16 bp, H. sapiens
atcagtactttttttt

SEQ ID NO: 48575 - DNA, 16 bp, H. sapiens
atcagtagactgggag

SEQ ID NO: 48576 - DNA, 16 bp, H. sapiens
atcagtatatggaaga

SEQ ID NO: 48577 - DNA, 16 bp, H. sapiens
atcagtatattaaaga

SEQ ID NO: 48578 - DNA, 16 bp, H. sapiens
atcagtatcacctggg

SEQ ID NO: 48579 - DNA, 16 bp, H. sapiens
atcagtatgacctgga

SEQ ID NO: 48580 - DNA, 16 bp, H. sapiens
atcagtattttttaaa

SEQ ID NO: 48581 - DNA, 16 bp, H. sapiens
atcagtcaatacatgt

SEQ ID NO: 48582 - DNA, 16 bp, H. sapiens
atcagtcaatcagtca

SEQ ID NO: 48583 - DNA, 16 bp, H. sapiens
atcagtcaggcccgcc

SEQ ID NO: 48584 - DNA, 16 bp, H. sapiens
atcagtctcagcaaac

SEQ ID NO: 48585 - DNA, 16 bp, H. sapiens
atcagtctccctgaag

SEQ ID NO: 48586 - DNA, 16 bp, H. sapiens
atcagtctttttcttt

SEQ ID NO: 48587 - DNA, 16 bp, H. sapiens
atcagtgaagaaaaaa

SEQ ID NO: 48588 - DNA, 16 bp, H. sapiens
atcagtgaaggagaaa

SEQ ID NO: 48589 - DNA, 16 bp, H. sapiens
atcagtgaataaaaca

SEQ ID NO: 48590 - DNA, 16 bp, H. sapiens
atcagtgatctttgat

SEQ ID NO: 48591 - DNA, 16 bp, H. sapiens
atcagtgatgatgagc

SEQ ID NO: 48592 - DNA, 16 bp, H. sapiens
atcagtgattgccagg

SEQ ID NO: 48593 - DNA, 17 bp, H. sapiens
atcagtgctctgtaaaa

SEQ ID NO: 48594 - DNA, 16 bp, H. sapiens
atcagtgcttttcaaa

SEQ ID NO: 48595 - DNA, 16 bp, H. sapiens
atcagtggagccttct

SEQ ID NO: 48596 - DNA, 16 bp, H. sapiens
atcagtgtaaaagtgt

SEQ ID NO: 48597 - DNA, 17 bp, H. sapiens
atcagtgtccaatatat

SEQ ID NO: 48598 - DNA, 16 bp, H. sapiens
atcagtgtgaaaacag

SEQ ID NO: 48599 - DNA, 16 bp, H. sapiens
atcagtgttttccaaa

SEQ ID NO: 48600 - DNA, 16 bp, H. sapiens
atcagttaaagcagga

SEQ ID NO: 48601 - DNA, 18 bp, H. sapiens
atcagttaaggcaggaac

SEQ ID NO: 48602 - DNA, 16 bp, H. sapiens
atcagttattttttga

SEQ ID NO: 48603 - DNA, 16 bp, H. sapiens
atcagttcaagaagtt

SEQ ID NO: 48604 - DNA, 16 bp, H. sapiens
atcagttctgcagcag

SEQ ID NO: 48605 - DNA, 16 bp, H. sapiens
atcagttgaggtcagg

SEQ ID NO: 48606 - DNA, 16 bp, H. sapiens
atcagttggtggatat

SEQ ID NO: 48607 - DNA, 16 bp, H. sapiens
atcagttgtatttcta

SEQ ID NO: 48608 - DNA, 16 bp, H. sapiens
atcagtttggggagaa

SEQ ID NO: 48609 - DNA, 16 bp, H. sapiens
atcagttttctttttc

SEQ ID NO: 48610 - DNA, 16 bp, H. sapiens
atcagtttttcctttt

SEQ ID NO: 48611 - DNA, 16 bp, H. sapiens
atcagtttttttaaaa

SEQ ID NO: 48612 - DNA, 16 bp, H. sapiens
atcataaaagaatgtt

SEQ ID NO: 48613 - DNA, 16 bp, H. sapiens
atcataaagtcaaaaa

SEQ ID NO: 48614 - DNA, 16 bp, H. sapiens
atcataaagttgaaaa

SEQ ID NO: 48615 - DNA, 16 bp, H. sapiens
atcataaggtcaagag

SEQ ID NO: 48616 - DNA, 16 bp, H. sapiens
atcataagtcaaaaat

SEQ ID NO: 48617 - DNA, 16 bp, H. sapiens
atcataagttgaaaat

SEQ ID NO: 48618 - DNA, 16 bp, H. sapiens
atcatacaatatgtag

SEQ ID NO: 48619 - DNA, 16 bp, H. sapiens
atcatacacacacaca

SEQ ID NO: 48620 - DNA, 16 bp, H. sapiens
atcataccactgtact

SEQ ID NO: 48621 - DNA, 20 bp, H. sapiens
atcataccgaatgggcaaaa

SEQ ID NO: 48622 - DNA, 28 bp, H. sapiens
atcatactgaatgggcaaaaactggaaa

SEQ ID NO: 48623 - DNA, 20 bp, H. sapiens
atcatactgaatgtgcaaaa

SEQ ID NO: 48624 - DNA, 16 bp, H. sapiens
atcatagaaataaaga

SEQ ID NO: 48625 - DNA, 16 bp, H. sapiens
atcatagattttttta

SEQ ID NO: 48626 - DNA, 16 bp, H. sapiens
atcatagctcactaca

SEQ ID NO: 48627 - DNA, 16 bp, H. sapiens
atcatagctcactata

SEQ ID NO: 48628 - DNA, 16 bp, H. sapiens
atcatagctcactgta

SEQ ID NO: 48629 - DNA, 16 bp, H. sapiens
atcatagctcattgca

SEQ ID NO: 48630 - DNA, 16 bp, H. sapiens
atcatagctcattgta

SEQ ID NO: 48631 - DNA, 16 bp, H. sapiens
atcatagcttactgca

SEQ ID NO: 48632 - DNA, 16 bp, H. sapiens
atcatagcttgctgca

SEQ ID NO: 48633 - DNA, 16 bp, H. sapiens
atcatagttcactgca

SEQ ID NO: 48634 - DNA, 16 bp, H. sapiens
atcatataaatgaaat

SEQ ID NO: 48635 - DNA, 16 bp, H. sapiens
atcatatagcctccag

SEQ ID NO: 48636 - DNA, 16 bp, H. sapiens
atcatatatatgcata

SEQ ID NO: 48637 - DNA, 16 bp, H. sapiens
atcatatatatgtgta

SEQ ID NO: 48638 - DNA, 16 bp, H. sapiens
atcatatatgatatat

SEQ ID NO: 48639 - DNA, 16 bp, H. sapiens
atcatatcatctgaaa

SEQ ID NO: 48640 - DNA, 16 bp, H. sapiens
atcatatggtatttgt

SEQ ID NO: 48641 - DNA, 16 bp, H. sapiens
atcatattcaatggtg

SEQ ID NO: 48642 - DNA, 16 bp, H. sapiens
atcatcaaaggccaaa

SEQ ID NO: 48643 - DNA, 16 bp, H. sapiens
atcatcaacatcaaca

SEQ ID NO: 48644 - DNA, 16 bp, H. sapiens
atcatcaatggatgct

SEQ ID NO: 48645 - DNA, 16 bp, H. sapiens
atcatcacaatcatca

SEQ ID NO: 48646 - DNA, 16 bp, H. sapiens
atcatcaccaacatca

SEQ ID NO: 48647 - DNA, 16 bp, H. sapiens
atcatcaccaccacca

SEQ ID NO: 48648 - DNA, 16 bp, H. sapiens
atcatcaccatcacca

SEQ ID NO: 48649 - DNA, 16 bp, H. sapiens
atcatcaccatcaccg

SEQ ID NO: 48650 - DNA, 16 bp, H. sapiens
atcatcaccatcctca

SEQ ID NO: 48651 - DNA, 16 bp, H. sapiens
atcatcaccttcacca

SEQ ID NO: 48652 - DNA, 16 bp, H. sapiens
atcatcactgtcatca

SEQ ID NO: 48653 - DNA, 16 bp, H. sapiens
atcatcagattcttca

SEQ ID NO: 48654 - DNA, 16 bp, H. sapiens
atcatcagcagcagca

SEQ ID NO: 48655 - DNA, 16 bp, H. sapiens
atcatcaggcattagt

SEQ ID NO: 48656 - DNA, 16 bp, H. sapiens
atcatcatcaacatca

SEQ ID NO: 48657 - DNA, 16 bp, H. sapiens
atcatcatcaccacca

SEQ ID NO: 48658 - DNA, 16 bp, H. sapiens
atcatcatcatcatca

SEQ ID NO: 48659 - DNA, 16 bp, H. sapiens
atcatcatcatcccca

SEQ ID NO: 48660 - DNA, 16 bp, H. sapiens
atcatcatcatcctca

SEQ ID NO: 48661 - DNA, 16 bp, H. sapiens
atcatcatcatcgtca

SEQ ID NO: 48662 - DNA, 16 bp, H. sapiens
atcatcatcatctcca

SEQ ID NO: 48663 - DNA, 16 bp, H. sapiens
atcatcatcatcttca

SEQ ID NO: 48664 - DNA, 16 bp, H. sapiens
atcatcatcattatta

SEQ ID NO: 48665 - DNA, 16 bp, H. sapiens
atcatcatcattttct

SEQ ID NO: 48666 - DNA, 16 bp, H. sapiens
atcatcatcctcacca

SEQ ID NO: 48667 - DNA, 16 bp, H. sapiens
atcatcatcgtcatca

SEQ ID NO: 48668 - DNA, 16 bp, H. sapiens
atcatcatcttcatca

SEQ ID NO: 48669 - DNA, 16 bp, H. sapiens
atcatcccactctctc

SEQ ID NO: 48670 - DNA, 17 bp, H. sapiens
atcatcccagctacttg

SEQ ID NO: 48671 - DNA, 16 bp, H. sapiens
atcatccccacttccc

SEQ ID NO: 48672 - DNA, 16 bp, H. sapiens
atcatcctcatcctca

SEQ ID NO: 48673 - DNA, 16 bp, H. sapiens
atcatccttctactct

SEQ ID NO: 48674 - DNA, 16 bp, H. sapiens
atcatctcaacagaca

SEQ ID NO: 48675 - DNA, 16 bp, H. sapiens
atcatctcaatagaca

SEQ ID NO: 48676 - DNA, 16 bp, H. sapiens
atcatctccatttcac

SEQ ID NO: 48677 - DNA, 16 bp, H. sapiens
atcatctcctttgcag

SEQ ID NO: 48678 - DNA, 16 bp, H. sapiens
atcatctgaaggtaaa

SEQ ID NO: 48679 - DNA, 20 bp, H. sapiens
atcatctgaagtcaggagtt

SEQ ID NO: 48680 - DNA, 16 bp, H. sapiens
atcatctgaatcatca

SEQ ID NO: 48681 - DNA, 16 bp, H. sapiens
atcatctgagccttca

SEQ ID NO: 48682 - DNA, 20 bp, H. sapiens
atcatctgaggtcaggagtt

SEQ ID NO: 48683 - DNA, 16 bp, H. sapiens
atcatctgtctgaaat

SEQ ID NO: 48684 - DNA, 16 bp, H. sapiens
atcatctgtgaaccag

SEQ ID NO: 48685 - DNA, 16 bp, H. sapiens
atcatcttcacactga

SEQ ID NO: 48686 - DNA, 16 bp, H. sapiens
atcatcttcatcatca

SEQ ID NO: 48687 - DNA, 16 bp, H. sapiens
atcatcttgggggtta

SEQ ID NO: 48688 - DNA, 16 bp, H. sapiens
atcatgaaaaagtttg

SEQ ID NO: 48689 - DNA, 16 bp, H. sapiens
atcatgaaaatgaaaa

SEQ ID NO: 48690 - DNA, 16 bp, H. sapiens
atcatgaagaaatgtt

SEQ ID NO: 48691 - DNA, 16 bp, H. sapiens
atcatgaagggatatt

SEQ ID NO: 48692 - DNA, 16 bp, H. sapiens
atcatgaagtctttgc

SEQ ID NO: 48693 - DNA, 16 bp, H. sapiens
atcatgaagttctcat

SEQ ID NO: 48694 - DNA, 16 bp, H. sapiens
atcatgaatgttctta

SEQ ID NO: 48695 - DNA, 16 bp, H. sapiens
atcatgaccatcctgg

SEQ ID NO: 48696 - DNA, 16 bp, H. sapiens
atcatgactggctaat

SEQ ID NO: 48697 - DNA, 16 bp, H. sapiens
atcatgagaaaaacaa

SEQ ID NO: 48698 - DNA, 16 bp, H. sapiens
atcatgagggttctgc

SEQ ID NO: 48699 - DNA, 16 bp, H. sapiens
atcatgatgatgataa

SEQ ID NO: 48700 - DNA, 16 bp, H. sapiens
atcatgatggaaggtg

SEQ ID NO: 48701 - DNA, 16 bp, H. sapiens
atcatgcaatatttgt

SEQ ID NO: 48702 - DNA, 16 bp, H. sapiens
atcatgcagtgtttgt

SEQ ID NO: 48703 - DNA, 16 bp, H. sapiens
atcatgccactacact

SEQ ID NO: 48704 - DNA, 18 bp, H. sapiens
atcatgccactgcactct

SEQ ID NO: 48705 - DNA, 16 bp, H. sapiens
atcatgccactgccct

SEQ ID NO: 48706 - DNA, 18 bp, H. sapiens
atcatgccaggctaattt

SEQ ID NO: 48707 - DNA, 16 bp, H. sapiens
atcatgccatggcact

SEQ ID NO: 48708 - DNA, 19 bp, H. sapiens
atcatgccattgcactccg

SEQ ID NO: 48709 - DNA, 16 bp, H. sapiens
atcatgcccagccaac

SEQ ID NO: 48710 - DNA, 19 bp, H. sapiens
atcatgcccagctaatttt

SEQ ID NO: 48711 - DNA, 16 bp, H. sapiens
atcatgctcactgcag

SEQ ID NO: 48712 - DNA, 16 bp, H. sapiens
atcatgctgttttgat

SEQ ID NO: 48713 - DNA, 16 bp, H. sapiens
atcatgctgttttgct

SEQ ID NO: 48714 - DNA, 16 bp, H. sapiens
atcatggaacttctca

SEQ ID NO: 48715 - DNA, 16 bp, H. sapiens
atcatggaagaggtgg

SEQ ID NO: 48716 - DNA, 16 bp, H. sapiens
atcatggaatactgtg

SEQ ID NO: 48717 - DNA, 16 bp, H. sapiens
atcatggagaatgagg

SEQ ID NO: 48718 - DNA, 16 bp, H. sapiens
atcatggcagaagaag

SEQ ID NO: 48719 - DNA, 16 bp, H. sapiens
atcatggcagaaggag

SEQ ID NO: 48720 - DNA, 16 bp, H. sapiens
atcatggctcaccgca

SEQ ID NO: 48721 - DNA, 16 bp, H. sapiens
atcatggctcattgca

SEQ ID NO: 48722 - DNA, 16 bp, H. sapiens
atcatgggaacagcaa

SEQ ID NO: 48723 - DNA, 16 bp, H. sapiens
atcatgggggtggttc

SEQ ID NO: 48724 - DNA, 16 bp, H. sapiens
atcatgggggtggttt

SEQ ID NO: 48725 - DNA, 16 bp, H. sapiens
atcatggggtcaggag

SEQ ID NO: 48726 - DNA, 16 bp, H. sapiens
atcatgggtgtggttt

SEQ ID NO: 48727 - DNA, 16 bp, H. sapiens
atcatggtggagaagc

SEQ ID NO: 48728 - DNA, 16 bp, H. sapiens
atcatggtggataagg

SEQ ID NO: 48729 - DNA, 16 bp, H. sapiens
atcatggtgtataatt

SEQ ID NO: 48730 - DNA, 16 bp, H. sapiens
atcatggttcactgca

SEQ ID NO: 48731 - DNA, 16 bp, H. sapiens
atcatgtaattttttt

SEQ ID NO: 48732 - DNA, 16 bp, H. sapiens
atcatgtatttgataa

SEQ ID NO: 48733 - DNA, 16 bp, H. sapiens
atcatgtcactgcact

SEQ ID NO: 48734 - DNA, 16 bp, H. sapiens
atcatgtcctttgcag

SEQ ID NO: 48735 - DNA, 16 bp, H. sapiens
atcatgtccttttcag

SEQ ID NO: 48736 - DNA, 16 bp, H. sapiens
atcatgtctgcaactt

SEQ ID NO: 48737 - DNA, 16 bp, H. sapiens
atcatgtgagaactca

SEQ ID NO: 48738 - DNA, 16 bp, H. sapiens
atcatgtgatctgcaa

SEQ ID NO: 48739 - DNA, 16 bp, H. sapiens
atcatgtgcctggaaa

SEQ ID NO: 48740 - DNA, 16 bp, H. sapiens
atcatgtggtcaagag

SEQ ID NO: 48741 - DNA, 16 bp, H. sapiens
atcatgttatttttct

SEQ ID NO: 48742 - DNA, 16 bp, H. sapiens
atcatgtttttttcct

SEQ ID NO: 48743 - DNA, 16 bp, H. sapiens
atcattaaaaaggaaa

SEQ ID NO: 48744 - DNA, 16 bp, H. sapiens
atcattaaaaagtcaa

SEQ ID NO: 48745 - DNA, 36 bp, H. sapiens
atcattaaaaagtcaggaaacaacaggtgctggaaa

SEQ ID NO: 48746 - DNA, 25 bp, H. sapiens
atcattaaaaagtcaggaagcaaca

SEQ ID NO: 48747 - DNA, 16 bp, H. sapiens
atcattaaaatgtcaa

SEQ ID NO: 48748 - DNA, 16 bp, H. sapiens
atcattaaatatgatg

SEQ ID NO: 48749 - DNA, 23 bp, H. sapiens
atcattaagaagtcaggaaacaa

SEQ ID NO: 48750 - DNA, 16 bp, H. sapiens
atcattacacaatata

SEQ ID NO: 48751 - DNA, 16 bp, H. sapiens
atcattacagaaatgc

SEQ ID NO: 48752 - DNA, 16 bp, H. sapiens
atcattatataatgcc

SEQ ID NO: 48753 - DNA, 16 bp, H. sapiens
atcattatcattattg

SEQ ID NO: 48754 - DNA, 16 bp, H. sapiens
atcattatgcattgta

SEQ ID NO: 48755 - DNA, 16 bp, H. sapiens
atcattattaaaaagt

SEQ ID NO: 48756 - DNA, 16 bp, H. sapiens
atcattattttttgag

SEQ ID NO: 48757 - DNA, 16 bp, H. sapiens
atcattcagaaaaaaa

SEQ ID NO: 48758 - DNA, 16 bp, H. sapiens
atcattcatatgttca

SEQ ID NO: 48759 - DNA, 16 bp, H. sapiens
atcattcattcattca

SEQ ID NO: 48760 - DNA, 16 bp, H. sapiens
atcattcatttactca

SEQ ID NO: 48761 - DNA, 16 bp, H. sapiens
atcattccaaaaagaa

SEQ ID NO: 48762 - DNA, 16 bp, H. sapiens
atcattctacaaaaaa

SEQ ID NO: 48763 - DNA, 16 bp, H. sapiens
atcattctgcccctgg

SEQ ID NO: 48764 - DNA, 26 bp, H. sapiens
atcattgaaaagtcaggaaacaacag

SEQ ID NO: 48765 - DNA, 16 bp, H. sapiens
atcattgaaagaaatt

SEQ ID NO: 48766 - DNA, 16 bp, H. sapiens
atcattgagcccagga

SEQ ID NO: 48767 - DNA, 16 bp, H. sapiens
atcattgattttattt

SEQ ID NO: 48768 - DNA, 16 bp, H. sapiens
atcattgctttgtttt

SEQ ID NO: 48769 - DNA, 16 bp, H. sapiens
atcattggatttaggg

SEQ ID NO: 48770 - DNA, 16 bp, H. sapiens
atcattgtcatcacca

SEQ ID NO: 48771 - DNA, 16 bp, H. sapiens
atcattgtggaaggca

SEQ ID NO: 48772 - DNA, 16 bp, H. sapiens
atcattgttattttaa

SEQ ID NO: 48773 - DNA, 16 bp, H. sapiens
atcatttaaaaatcat

SEQ ID NO: 48774 - DNA, 16 bp, H. sapiens
atcatttaaaacattt

SEQ ID NO: 48775 - DNA, 16 bp, H. sapiens
atcatttaagcctggg

SEQ ID NO: 48776 - DNA, 16 bp, H. sapiens
atcatttataatcctt

SEQ ID NO: 48777 - DNA, 16 bp, H. sapiens
atcatttatttaaaag

SEQ ID NO: 48778 - DNA, 16 bp, H. sapiens
atcatttatttgtgtt

SEQ ID NO: 48779 - DNA, 16 bp, H. sapiens
atcatttatttttatg

SEQ ID NO: 48780 - DNA, 16 bp, H. sapiens
atcatttcaaaaatgt

SEQ ID NO: 48781 - DNA, 16 bp, H. sapiens
atcatttcattatttc

SEQ ID NO: 48782 - DNA, 16 bp, H. sapiens
atcatttccagttttt

SEQ ID NO: 48783 - DNA, 16 bp, H. sapiens
atcatttccctttccc

SEQ ID NO: 48784 - DNA, 16 bp, H. sapiens
atcatttgaagtcagg

SEQ ID NO: 48785 - DNA, 16 bp, H. sapiens
atcatttgagcccaga

SEQ ID NO: 48786 - DNA, 16 bp, H. sapiens
atcatttgaggtcaag

SEQ ID NO: 48787 - DNA, 16 bp, H. sapiens
atcatttgtttattca

SEQ ID NO: 48788 - DNA, 16 bp, H. sapiens
atcattttaaaaaatg

SEQ ID NO: 48789 - DNA, 16 bp, H. sapiens
atcattttaattgatg

SEQ ID NO: 48790 - DNA, 16 bp, H. sapiens
atcattttacaaatga

SEQ ID NO: 48791 - DNA, 16 bp, H. sapiens
atcattttagatttat

SEQ ID NO: 48792 - DNA, 16 bp, H. sapiens
atcattttatattccc

SEQ ID NO: 48793 - DNA, 16 bp, H. sapiens
atcattttcatcatca

SEQ ID NO: 48794 - DNA, 16 bp, H. sapiens
atcattttcccattgc

SEQ ID NO: 48795 - DNA, 16 bp, H. sapiens
atcattttctattgtg

SEQ ID NO: 48796 - DNA, 16 bp, H. sapiens
atcattttgcattcct

SEQ ID NO: 48797 - DNA, 16 bp, H. sapiens
atcattttgcccctgg

SEQ ID NO: 48798 - DNA, 16 bp, H. sapiens
atcatttttattgtgt

SEQ ID NO: 48799 - DNA, 16 bp, H. sapiens
atcatttttcatagaa

SEQ ID NO: 48800 - DNA, 16 bp, H. sapiens
atcatttttgttttaa

SEQ ID NO: 48801 - DNA, 16 bp, H. sapiens
atcattttttaaatga

SEQ ID NO: 48802 - DNA, 16 bp, H. sapiens
atcattttttattgaa

SEQ ID NO: 48803 - DNA, 16 bp, H. sapiens
atccaaaaagctccta

SEQ ID NO: 48804 - DNA, 16 bp, H. sapiens
atccaaaaatcagaaa

SEQ ID NO: 48805 - DNA, 16 bp, H. sapiens
atccaaaaatctgaaa

SEQ ID NO: 48806 - DNA, 16 bp, H. sapiens
atccaaaaatgtggaa

SEQ ID NO: 48807 - DNA, 16 bp, H. sapiens
atccaaaagaagtgaa

SEQ ID NO: 48808 - DNA, 16 bp, H. sapiens
atccaaaagacaggca

SEQ ID NO: 48809 - DNA, 16 bp, H. sapiens
atccaaaagaccacca

SEQ ID NO: 48810 - DNA, 16 bp, H. sapiens
atccaaaagatttgaa

SEQ ID NO: 48811 - DNA, 16 bp, H. sapiens
atccaaaagtgaaatt

SEQ ID NO: 48812 - DNA, 16 bp, H. sapiens
atccaaaatatgtaaa

SEQ ID NO: 48813 - DNA, 16 bp, H. sapiens
atccaaaatatttaag

SEQ ID NO: 48814 - DNA, 16 bp, H. sapiens
atccaaaatatttttt

SEQ ID NO: 48815 - DNA, 16 bp, H. sapiens
atccaaaatgctccaa

SEQ ID NO: 48816 - DNA, 16 bp, H. sapiens
atccaaaatgtcaata

SEQ ID NO: 48817 - DNA, 17 bp, H. sapiens
atccaaaccaagaagaa

SEQ ID NO: 48818 - DNA, 16 bp, H. sapiens
atccaaagaaaagttt

SEQ ID NO: 48819 - DNA, 16 bp, H. sapiens
atccaaagaaaggaaa

SEQ ID NO: 48820 - DNA, 16 bp, H. sapiens
atccaaaggaatgttc

SEQ ID NO: 48821 - DNA, 16 bp, H. sapiens
atccaaaggtcagcaa

SEQ ID NO: 48822 - DNA, 16 bp, H. sapiens
atccaaaggtcatcag

SEQ ID NO: 48823 - DNA, 16 bp, H. sapiens
atccaaatacaagaag

SEQ ID NO: 48824 - DNA, 16 bp, H. sapiens
atccaaatgaataaaa

SEQ ID NO: 48825 - DNA, 16 bp, H. sapiens
atccaaattagaaaga

SEQ ID NO: 48826 - DNA, 16 bp, H. sapiens
atccaaattagtaaag

SEQ ID NO: 48827 - DNA, 16 bp, H. sapiens
atccaacaaacattta

SEQ ID NO: 48828 - DNA, 16 bp, H. sapiens
atccaacaaatgttta

SEQ ID NO: 48829 - DNA, 16 bp, H. sapiens
atccaacagaaataca

SEQ ID NO: 48830 - DNA, 16 bp, H. sapiens
atccaactaatttttt

SEQ ID NO: 48831 - DNA, 16 bp, H. sapiens
atccaagaagagaaaa

SEQ ID NO: 48832 - DNA, 16 bp, H. sapiens
atccaagctggagtgc

SEQ ID NO: 48833 - DNA, 30 bp, H. sapiens
atccaatacaggagcacccagattcataaa

SEQ ID NO: 48834 - DNA, 16 bp, H. sapiens
atccaatccactgagg

SEQ ID NO: 48835 - DNA, 16 bp, H. sapiens
atccaatgcaaagaag

SEQ ID NO: 48836 - DNA, 16 bp, H. sapiens
atccaatgcaaggaag

SEQ ID NO: 48837 - DNA, 16 bp, H. sapiens
atccaatttacatttt

SEQ ID NO: 48838 - DNA, 16 bp, H. sapiens
atccacaactatctga

SEQ ID NO: 48839 - DNA, 16 bp, H. sapiens
atccacaatctacaaa

SEQ ID NO: 48840 - DNA, 16 bp, H. sapiens
atccacacacatacat

SEQ ID NO: 48841 - DNA, 16 bp, H. sapiens
atccacacatcacaaa

SEQ ID NO: 48842 - DNA, 16 bp, H. sapiens
atccacacatcataaa

SEQ ID NO: 48843 - DNA, 16 bp, H. sapiens
atccacagaggcagaa

SEQ ID NO: 48844 - DNA, 17 bp, H. sapiens
atccacaggcagacagc

SEQ ID NO: 48845 - DNA, 16 bp, H. sapiens
atccacagttggttga

SEQ ID NO: 48846 - DNA, 16 bp, H. sapiens
atccacataaaaactt

SEQ ID NO: 48847 - DNA, 17 bp, H. sapiens
atccaccatggtcaagt

SEQ ID NO: 48848 - DNA, 16 bp, H. sapiens
atccaccattgctgag

SEQ ID NO: 48849 - DNA, 16 bp, H. sapiens
atccacccacatcagc

SEQ ID NO: 48850 - DNA, 16 bp, H. sapiens
atccacccaccacagc

SEQ ID NO: 48851 - DNA, 16 bp, H. sapiens
atccacccacccattt

SEQ ID NO: 48852 - DNA, 16 bp, H. sapiens
atccacccacctaggc

SEQ ID NO: 48853 - DNA, 24 bp, H. sapiens
atccacccacctaggcctcccaaa

SEQ ID NO: 48854 - DNA, 18 bp, H. sapiens
atccacccacctcagtct

SEQ ID NO: 48855 - DNA, 16 bp, H. sapiens
atccacccacctcggg

SEQ ID NO: 48856 - DNA, 19 bp, H. sapiens
atccacccaccttggcctc

SEQ ID NO: 48857 - DNA, 17 bp, H. sapiens
atccacccaccttggcg

SEQ ID NO: 48858 - DNA, 16 bp, H. sapiens
atccacccaccttggt

SEQ ID NO: 48859 - DNA, 17 bp, H. sapiens
atccacccacttcagcc

SEQ ID NO: 48860 - DNA, 16 bp, H. sapiens
atccacccactttggt

SEQ ID NO: 48861 - DNA, 18 bp, H. sapiens
atccacccatctcggcct

SEQ ID NO: 48862 - DNA, 16 bp, H. sapiens
atccacccattcatcc

SEQ ID NO: 48863 - DNA, 16 bp, H. sapiens
atccacccgcctcaga

SEQ ID NO: 48864 - DNA, 16 bp, H. sapiens
atccacccgcctcagt

SEQ ID NO: 48865 - DNA, 16 bp, H. sapiens
atccacccgcctcggt

SEQ ID NO: 48866 - DNA, 16 bp, H. sapiens
atccacccgcctgggt

SEQ ID NO: 48867 - DNA, 16 bp, H. sapiens
atccacccgccttgcc

SEQ ID NO: 48868 - DNA, 16 bp, H. sapiens
atccacccgtcttggc

SEQ ID NO: 48869 - DNA, 16 bp, H. sapiens
atccaccctcagcctc

SEQ ID NO: 48870 - DNA, 17 bp, H. sapiens
atccaccggcctcggcc

SEQ ID NO: 48871 - DNA, 16 bp, H. sapiens
atccacctacctaggc

SEQ ID NO: 48872 - DNA, 17 bp, H. sapiens
atccacctacctcggcc

SEQ ID NO: 48873 - DNA, 16 bp, H. sapiens
atccacctcccttggc

SEQ ID NO: 48874 - DNA, 16 bp, H. sapiens
atccacctgcccctgc

SEQ ID NO: 48875 - DNA, 16 bp, H. sapiens
atccacctgccctggc

SEQ ID NO: 48876 - DNA, 20 bp, H. sapiens
atccacctgcctcagcctct

SEQ ID NO: 48877 - DNA, 17 bp, H. sapiens
atccacctgcctcagct

SEQ ID NO: 48878 - DNA, 17 bp, H. sapiens
atccacctgcctcggcc

SEQ ID NO: 48879 - DNA, 16 bp, H. sapiens
atccacctgccttagc

SEQ ID NO: 48880 - DNA, 16 bp, H. sapiens
atccacctgccttggt

SEQ ID NO: 48881 - DNA, 17 bp, H. sapiens
atccacctgtctcagcc

SEQ ID NO: 48882 - DNA, 16 bp, H. sapiens
atccacctgtcttggc

SEQ ID NO: 48883 - DNA, 16 bp, H. sapiens
atccacgcacctcagc

SEQ ID NO: 48884 - DNA, 39 bp, H. sapiens
atccacgcaggcgtttccccttacctgcaccgagcctcc

SEQ ID NO: 48885 - DNA, 16 bp, H. sapiens
atccactatgatcaag

SEQ ID NO: 48886 - DNA, 16 bp, H. sapiens
atccactcacctcggc

SEQ ID NO: 48887 - DNA, 16 bp, H. sapiens
atccactcactcaccc

SEQ ID NO: 48888 - DNA, 16 bp, H. sapiens
atccactcatccacct

SEQ ID NO: 48889 - DNA, 17 bp, H. sapiens
atccactggccttggcc

SEQ ID NO: 48890 - DNA, 16 bp, H. sapiens
atccacttccacttaa

SEQ ID NO: 48891 - DNA, 16 bp, H. sapiens
atccacttccatttaa

SEQ ID NO: 48892 - DNA, 16 bp, H. sapiens
atccagaaaaataaca

SEQ ID NO: 48893 - DNA, 16 bp, H. sapiens
atccagaaactacaag

SEQ ID NO: 48894 - DNA, 16 bp, H. sapiens
atccagaagaattgaa

SEQ ID NO: 48895 - DNA, 16 bp, H. sapiens
atccagaatatagaaa

SEQ ID NO: 48896 - DNA, 16 bp, H. sapiens
atccagagtaagtgtc

SEQ ID NO: 48897 - DNA, 16 bp, H. sapiens
atccagagttgctaca

SEQ ID NO: 48898 - DNA, 16 bp, H. sapiens
atccagatacaagaaa

SEQ ID NO: 48899 - DNA, 16 bp, H. sapiens
atccagatcacaggag

SEQ ID NO: 48900 - DNA, 16 bp, H. sapiens
atccagcaaaggtcta

SEQ ID NO: 48901 - DNA, 16 bp, H. sapiens
atccagcaatcatgct

SEQ ID NO: 48902 - DNA, 16 bp, H. sapiens
atccagcagaagaaaa

SEQ ID NO: 48903 - DNA, 33 bp, H. sapiens
atccagcagcacatcaaaaagcttatccaccag

SEQ ID NO: 48904 - DNA, 16 bp, H. sapiens
atccagcagtcccact

SEQ ID NO: 48905 - DNA, 16 bp, H. sapiens
atccagcagtgcatca

SEQ ID NO: 48906 - DNA, 16 bp, H. sapiens
atccagcatgagagaa

SEQ ID NO: 48907 - DNA, 16 bp, H. sapiens
atccagccatgcctga

SEQ ID NO: 48908 - DNA, 16 bp, H. sapiens
atccagcccacactca

SEQ ID NO: 48909 - DNA, 17 bp, H. sapiens
atccagcctgggcgaca

SEQ ID NO: 48910 - DNA, 16 bp, H. sapiens
atccagctactcggga

SEQ ID NO: 48911 - DNA, 16 bp, H. sapiens
atccagcttctatgca

SEQ ID NO: 48912 - DNA, 16 bp, H. sapiens
atccagcttgagttaa

SEQ ID NO: 48913 - DNA, 16 bp, H. sapiens
atccaggaaaacagga

SEQ ID NO: 48914 - DNA, 16 bp, H. sapiens
atccaggaaatacaga

SEQ ID NO: 48915 - DNA, 16 bp, H. sapiens
atccaggaaatgaagg

SEQ ID NO: 48916 - DNA, 16 bp, H. sapiens
atccaggaacagaaaa

SEQ ID NO: 48917 - DNA, 16 bp, H. sapiens
atccaggaagaatgaa

SEQ ID NO: 48918 - DNA, 16 bp, H. sapiens
atccaggacatgctga

SEQ ID NO: 48919 - DNA, 16 bp, H. sapiens
atccaggaccagacag

SEQ ID NO: 48920 - DNA, 20 bp, H. sapiens
atccaggagaacttccccaa

SEQ ID NO: 48921 - DNA, 16 bp, H. sapiens
atccaggagaagttcc

SEQ ID NO: 48922 - DNA, 16 bp, H. sapiens
atccaggagataatca

SEQ ID NO: 48923 - DNA, 16 bp, H. sapiens
atccaggaggcagagg

SEQ ID NO: 48924 - DNA, 16 bp, H. sapiens
atccaggaggccgagg

SEQ ID NO: 48925 - DNA, 16 bp, H. sapiens
atccaggagggagagg

SEQ ID NO: 48926 - DNA, 16 bp, H. sapiens
atccaggagggggagg

SEQ ID NO: 48927 - DNA, 16 bp, H. sapiens
atccaggaggtgaggg

SEQ ID NO: 48928 - DNA, 16 bp, H. sapiens
atccaggaggtggagg

SEQ ID NO: 48929 - DNA, 16 bp, H. sapiens
atccaggaggtggagt

SEQ ID NO: 48930 - DNA, 16 bp, H. sapiens
atccaggagtcagagg

SEQ ID NO: 48931 - DNA, 16 bp, H. sapiens
atccaggagttcaagg

SEQ ID NO: 48932 - DNA, 16 bp, H. sapiens
atccaggataatctct

SEQ ID NO: 48933 - DNA, 16 bp, H. sapiens
atccaggatccaatca

SEQ ID NO: 48934 - DNA, 18 bp, H. sapiens
atccaggccatcaccaat

SEQ ID NO: 48935 - DNA, 16 bp, H. sapiens
atccaggctatcattg

SEQ ID NO: 48936 - DNA, 16 bp, H. sapiens
atccaggctgagatgg

SEQ ID NO: 48937 - DNA, 16 bp, H. sapiens
atccagggagccaagc

SEQ ID NO: 48938 - DNA, 16 bp, H. sapiens
atccaggtgctggttt

SEQ ID NO: 48939 - DNA, 16 bp, H. sapiens
atccaggtgtggtggc

SEQ ID NO: 48940 - DNA, 16 bp, H. sapiens
atccaggttatgctga

SEQ ID NO: 48941 - DNA, 16 bp, H. sapiens
atccagtccatcactg

SEQ ID NO: 48942 - DNA, 16 bp, H. sapiens
atccagtctatcattg

SEQ ID NO: 48943 - DNA, 16 bp, H. sapiens
atccagtctgtggtat

SEQ ID NO: 48944 - DNA, 16 bp, H. sapiens
atccagtgaaaatatt

SEQ ID NO: 48945 - DNA, 16 bp, H. sapiens
atccagtgaatttttt

SEQ ID NO: 48946 - DNA, 16 bp, H. sapiens
atccagtgaggcaccc

SEQ ID NO: 48947 - DNA, 16 bp, H. sapiens
atccagtgtatcattg

SEQ ID NO: 48948 - DNA, 16 bp, H. sapiens
atccagttccttcaaa

SEQ ID NO: 48949 - DNA, 16 bp, H. sapiens
atccagttgtcccaga

SEQ ID NO: 48950 - DNA, 16 bp, H. sapiens
atccagtttcaatttt

SEQ ID NO: 48951 - DNA, 16 bp, H. sapiens
atccagtttctgtttt

SEQ ID NO: 48952 - DNA, 16 bp, H. sapiens
atccagttttattttt

SEQ ID NO: 48953 - DNA, 16 bp, H. sapiens
atccatacaatggaat

SEQ ID NO: 48954 - DNA, 16 bp, H. sapiens
atccatactgatataa

SEQ ID NO: 48955 - DNA, 16 bp, H. sapiens
atccatagaaaaagag

SEQ ID NO: 48956 - DNA, 16 bp, H. sapiens
atccatatacatatat

SEQ ID NO: 48957 - DNA, 16 bp, H. sapiens
atccatatatcctctt

SEQ ID NO: 48958 - DNA, 16 bp, H. sapiens
atccatatccctacaa

SEQ ID NO: 48959 - DNA, 16 bp, H. sapiens
atccatatgcaaaaat

SEQ ID NO: 48960 - DNA, 16 bp, H. sapiens
atccatcaatcaatca

SEQ ID NO: 48961 - DNA, 16 bp, H. sapiens
atccatcagaggaatt

SEQ ID NO: 48962 - DNA, 16 bp, H. sapiens
atccatccatccaacc

SEQ ID NO: 48963 - DNA, 16 bp, H. sapiens
atccatccatctctcc

SEQ ID NO: 48964 - DNA, 16 bp, H. sapiens
atccatccatgtccct

SEQ ID NO: 48965 - DNA, 16 bp, H. sapiens
atccatcccctcaaac

SEQ ID NO: 48966 - DNA, 17 bp, H. sapiens
atccatccgcctcagcc

SEQ ID NO: 48967 - DNA, 16 bp, H. sapiens
atccatccttcctcca

SEQ ID NO: 48968 - DNA, 16 bp, H. sapiens
atccatctctctctct

SEQ ID NO: 48969 - DNA, 16 bp, H. sapiens
atccatctgagaaagg

SEQ ID NO: 48970 - DNA, 18 bp, H. sapiens
atccatctgcctcagcct

SEQ ID NO: 48971 - DNA, 16 bp, H. sapiens
atccatctggtctggg

SEQ ID NO: 48972 - DNA, 16 bp, H. sapiens
atccatcttgctgcaa

SEQ ID NO: 48973 - DNA, 16 bp, H. sapiens
atccatgaaaataaaa

SEQ ID NO: 48974 - DNA, 16 bp, H. sapiens
atccatgaaaatgaaa

SEQ ID NO: 48975 - DNA, 16 bp, H. sapiens
atccatgaatgcagaa

SEQ ID NO: 48976 - DNA, 16 bp, H. sapiens
atccatgagcatggga

SEQ ID NO: 48977 - DNA, 16 bp, H. sapiens
atccatgagcattgga

SEQ ID NO: 48978 - DNA, 16 bp, H. sapiens
atccatggattttggt

SEQ ID NO: 48979 - DNA, 16 bp, H. sapiens
atccatgggatgcaag

SEQ ID NO: 48980 - DNA, 16 bp, H. sapiens
atccatgggggtcctg

SEQ ID NO: 48981 - DNA, 16 bp, H. sapiens
atccatgtaaccaaaa

SEQ ID NO: 48982 - DNA, 17 bp, H. sapiens
atccatgtccctgaaaa

SEQ ID NO: 48983 - DNA, 16 bp, H. sapiens
atccatgtgaaaatcc

SEQ ID NO: 48984 - DNA, 16 bp, H. sapiens
atccatgtggtaatgg

SEQ ID NO: 48985 - DNA, 16 bp, H. sapiens
atccatgtgtctgttt

SEQ ID NO: 48986 - DNA, 16 bp, H. sapiens
atccattatagccatc

SEQ ID NO: 48987 - DNA, 16 bp, H. sapiens
atccattcatccttcc

SEQ ID NO: 48988 - DNA, 16 bp, H. sapiens
atccattcatctgtca

SEQ ID NO: 48989 - DNA, 16 bp, H. sapiens
atccattcatgataaa

SEQ ID NO: 48990 - DNA, 16 bp, H. sapiens
atccattcattcattc

SEQ ID NO: 48991 - DNA, 16 bp, H. sapiens
atccattctgtcattc

SEQ ID NO: 48992 - DNA, 16 bp, H. sapiens
atccattgagcccagg

SEQ ID NO: 48993 - DNA, 16 bp, H. sapiens
atccatttagttttat

SEQ ID NO: 48994 - DNA, 16 bp, H. sapiens
atccatttccttgcct

SEQ ID NO: 48995 - DNA, 16 bp, H. sapiens
atccatttcttttaga

SEQ ID NO: 48996 - DNA, 16 bp, H. sapiens
atccatttgtttcttt

SEQ ID NO: 48997 - DNA, 27 bp, H. sapiens
atcccaaactttgcagtattagccaag

SEQ ID NO: 48998 - DNA, 16 bp, H. sapiens
atcccaaagaaataaa

SEQ ID NO: 48999 - DNA, 16 bp, H. sapiens
atcccaaagtgctgga

SEQ ID NO: 49000 - DNA, 16 bp, H. sapiens
atcccaaatacttggg

SEQ ID NO: 49001 - DNA, 16 bp, H. sapiens
atcccaaatcagatag

SEQ ID NO: 49002 - DNA, 16 bp, H. sapiens
atcccaaatctgaaaa

SEQ ID NO: 49003 - DNA, 16 bp, H. sapiens
atcccaacaacagcaa

SEQ ID NO: 49004 - DNA, 16 bp, H. sapiens
atcccaacactttaga

SEQ ID NO: 49005 - DNA, 16 bp, H. sapiens
atcccaacattttgga

SEQ ID NO: 49006 - DNA, 16 bp, H. sapiens
atcccaacctcaggtg

SEQ ID NO: 49007 - DNA, 16 bp, H. sapiens
atcccaaccttcagca

SEQ ID NO: 49008 - DNA, 18 bp, H. sapiens
atcccaaggcagaggaat

SEQ ID NO: 49009 - DNA, 16 bp, H. sapiens
atcccaaggctttggg

SEQ ID NO: 49010 - DNA, 16 bp, H. sapiens
atcccaagtacctggg

SEQ ID NO: 49011 - DNA, 16 bp, H. sapiens
atcccaattactctga

SEQ ID NO: 49012 - DNA, 34 bp, H. sapiens
atcccacagaaatacaaactaccatcagagaata

SEQ ID NO: 49013 - DNA, 16 bp, H. sapiens
atcccacataaataca

SEQ ID NO: 49014 - DNA, 16 bp, H. sapiens
atcccacccatgaggg

SEQ ID NO: 49015 - DNA, 16 bp, H. sapiens
atcccacctcagcctc

SEQ ID NO: 49016 - DNA, 16 bp, H. sapiens
atcccacctctgcctc

SEQ ID NO: 49017 - DNA, 16 bp, H. sapiens
atcccaccttggcctc

SEQ ID NO: 49018 - DNA, 16 bp, H. sapiens
atcccactcatgaggg

SEQ ID NO: 49019 - DNA, 16 bp, H. sapiens
atcccagacctttggg

SEQ ID NO: 49020 - DNA, 16 bp, H. sapiens
atcccagaggtctgtg

SEQ ID NO: 49021 - DNA, 16 bp, H. sapiens
atcccagcacattgag

SEQ ID NO: 49022 - DNA, 16 bp, H. sapiens
atcccagcaccattta

SEQ ID NO: 49023 - DNA, 16 bp, H. sapiens
atcccagcacctggga

SEQ ID NO: 49024 - DNA, 16 bp, H. sapiens
atcccagcacttcaga

SEQ ID NO: 49025 - DNA, 16 bp, H. sapiens
atcccagcacttgtgg

SEQ ID NO: 49026 - DNA, 16 bp, H. sapiens
atcccagcagtttgtg

SEQ ID NO: 49027 - DNA, 16 bp, H. sapiens
atcccagcatttggga

SEQ ID NO: 49028 - DNA, 16 bp, H. sapiens
atcccagcctcctgag

SEQ ID NO: 49029 - DNA, 16 bp, H. sapiens
atcccagcctctcttc

SEQ ID NO: 49030 - DNA, 16 bp, H. sapiens
atcccagcctgggtga

SEQ ID NO: 49031 - DNA, 16 bp, H. sapiens
atcccagctactccag

SEQ ID NO: 49032 - DNA, 16 bp, H. sapiens
atcccagctactgcag

SEQ ID NO: 49033 - DNA, 24 bp, H. sapiens
atcccagctacttgggaggctgaa

SEQ ID NO: 49034 - DNA, 16 bp, H. sapiens
atcccagctcactgca

SEQ ID NO: 49035 - DNA, 16 bp, H. sapiens
atcccagctccagagc

SEQ ID NO: 49036 - DNA, 16 bp, H. sapiens
atcccagctctgcccc

SEQ ID NO: 49037 - DNA, 16 bp, H. sapiens
atcccagctctgctgc

SEQ ID NO: 49038 - DNA, 16 bp, H. sapiens
atcccagctctgtcat

SEQ ID NO: 49039 - DNA, 16 bp, H. sapiens
atcccagctctttgag

SEQ ID NO: 49040 - DNA, 16 bp, H. sapiens
atcccagctgcctggg

SEQ ID NO: 49041 - DNA, 16 bp, H. sapiens
atcccagctgctgagg

SEQ ID NO: 49042 - DNA, 16 bp, H. sapiens
atcccaggaagcagag

SEQ ID NO: 49043 - DNA, 16 bp, H. sapiens
atcccaggaatacaag

SEQ ID NO: 49044 - DNA, 16 bp, H. sapiens
atcccaggacttttgg

SEQ ID NO: 49045 - DNA, 16 bp, H. sapiens
atcccaggagtttcag

SEQ ID NO: 49046 - DNA, 16 bp, H. sapiens
atcccaggattaaaac

SEQ ID NO: 49047 - DNA, 16 bp, H. sapiens
atcccaggcagaggaa

SEQ ID NO: 49048 - DNA, 16 bp, H. sapiens
atcccaggcagaggga

SEQ ID NO: 49049 - DNA, 16 bp, H. sapiens
atcccagggatggagc

SEQ ID NO: 49050 - DNA, 16 bp, H. sapiens
atcccagtgcttcagg

SEQ ID NO: 49051 - DNA, 16 bp, H. sapiens
atcccagttctgccac

SEQ ID NO: 49052 - DNA, 16 bp, H. sapiens
atcccataaatatata

SEQ ID NO: 49053 - DNA, 16 bp, H. sapiens
atcccatggacattaa

SEQ ID NO: 49054 - DNA, 17 bp, H. sapiens
atcccattactaggtat

SEQ ID NO: 49055 - DNA, 17 bp, H. sapiens
atcccattactgggtag

SEQ ID NO: 49056 - DNA, 26 bp, H. sapiens
atcccattactgggtatatacccaaa

SEQ ID NO: 49057 - DNA, 20 bp, H. sapiens
atcccattactgggtgtata

SEQ ID NO: 49058 - DNA, 16 bp, H. sapiens
atcccattggccagaa

SEQ ID NO: 49059 - DNA, 16 bp, H. sapiens
atcccatttctaaaaa

SEQ ID NO: 49060 - DNA, 16 bp, H. sapiens
atcccatttgccaatt

SEQ ID NO: 49061 - DNA, 16 bp, H. sapiens
atcccatttgcctatt

SEQ ID NO: 49062 - DNA, 16 bp, H. sapiens
atcccattttaaagat

SEQ ID NO: 49063 - DNA, 16 bp, H. sapiens
atcccattttctcctg

SEQ ID NO: 49064 - DNA, 16 bp, H. sapiens
atccccaaaattaagg

SEQ ID NO: 49065 - DNA, 16 bp, H. sapiens
atccccaaacctaaaa

SEQ ID NO: 49066 - DNA, 16 bp, H. sapiens
atccccaaatccaaaa

SEQ ID NO: 49067 - DNA, 16 bp, H. sapiens
atccccaaatctgaaa

SEQ ID NO: 49068 - DNA, 16 bp, H. sapiens
atccccaatgttggtg

SEQ ID NO: 49069 - DNA, 16 bp, H. sapiens
atccccaggctggagt

SEQ ID NO: 49070 - DNA, 16 bp, H. sapiens
atccccaggtgtcaag

SEQ ID NO: 49071 - DNA, 16 bp, H. sapiens
atccccagtgtgatga

SEQ ID NO: 49072 - DNA, 18 bp, H. sapiens
atccccatcaagctacca

SEQ ID NO: 49073 - DNA, 17 bp, H. sapiens
atccccatcaagctact

SEQ ID NO: 49074 - DNA, 18 bp, H. sapiens
atccccatcaagctgcca

SEQ ID NO: 49075 - DNA, 16 bp, H. sapiens
atccccatctctaaaa

SEQ ID NO: 49076 - DNA, 18 bp, H. sapiens
atccccatgaagctacca

SEQ ID NO: 49077 - DNA, 16 bp, H. sapiens
atccccatttaacaga

SEQ ID NO: 49078 - DNA, 16 bp, H. sapiens
atccccattttataga

SEQ ID NO: 49079 - DNA, 16 bp, H. sapiens
atcccccgaccccttg

SEQ ID NO: 49080 - DNA, 16 bp, H. sapiens
atcccccgcctcggcc

SEQ ID NO: 49081 - DNA, 16 bp, H. sapiens
atccccctgcctcagt

SEQ ID NO: 49082 - DNA, 16 bp, H. sapiens
atccccctgtctcagc

SEQ ID NO: 49083 - DNA, 16 bp, H. sapiens
atcccctcaagcattt

SEQ ID NO: 49084 - DNA, 16 bp, H. sapiens
atcccctctctgctga

SEQ ID NO: 49085 - DNA, 16 bp, H. sapiens
atcccctttggcaaca

SEQ ID NO: 49086 - DNA, 16 bp, H. sapiens
atcccggtactttggg

SEQ ID NO: 49087 - DNA, 16 bp, H. sapiens
atccctaatccaaaaa

SEQ ID NO: 49088 - DNA, 16 bp, H. sapiens
atccctacctttcacc

SEQ ID NO: 49089 - DNA, 16 bp, H. sapiens
atccctagagcagggg

SEQ ID NO: 49090 - DNA, 16 bp, H. sapiens
atccctcatgaatggg

SEQ ID NO: 49091 - DNA, 16 bp, H. sapiens
atccctccagggatgc

SEQ ID NO: 49092 - DNA, 16 bp, H. sapiens
atccctgagctcatcc

SEQ ID NO: 49093 - DNA, 16 bp, H. sapiens
atccctgcactctcag

SEQ ID NO: 49094 - DNA, 16 bp, H. sapiens
atccctgccctcaagg

SEQ ID NO: 49095 - DNA, 16 bp, H. sapiens
atccctgccttcaagg

SEQ ID NO: 49096 - DNA, 16 bp, H. sapiens
atccctgccttcatgg

SEQ ID NO: 49097 - DNA, 16 bp, H. sapiens
atccctggaatgcaag

SEQ ID NO: 49098 - DNA, 16 bp, H. sapiens
atccctggatccctgg

SEQ ID NO: 49099 - DNA, 16 bp, H. sapiens
atccctggcctcaagt

SEQ ID NO: 49100 - DNA, 16 bp, H. sapiens
atccctggcctctacc

SEQ ID NO: 49101 - DNA, 16 bp, H. sapiens
atccctgggatgcaaa

SEQ ID NO: 49102 - DNA, 17 bp, H. sapiens
atccctgggatgcaagt

SEQ ID NO: 49103 - DNA, 16 bp, H. sapiens
atccctgggatgtgag

SEQ ID NO: 49104 - DNA, 16 bp, H. sapiens
atccctgtaattccag

SEQ ID NO: 49105 - DNA, 16 bp, H. sapiens
atcccttacccaaaat

SEQ ID NO: 49106 - DNA, 16 bp, H. sapiens
atcccttccccattgc

SEQ ID NO: 49107 - DNA, 16 bp, H. sapiens
atcccttcctcacacc

SEQ ID NO: 49108 - DNA, 16 bp, H. sapiens
atcccttcctctacat

SEQ ID NO: 49109 - DNA, 16 bp, H. sapiens
atcccttgtaagttgt

SEQ ID NO: 49110 - DNA, 17 bp, H. sapiens
atccgcccacctcgacc

SEQ ID NO: 49111 - DNA, 22 bp, H. sapiens
atccgcccaccttggcctccca

SEQ ID NO: 49112 - DNA, 17 bp, H. sapiens
atccgcccatctcagcc

SEQ ID NO: 49113 - DNA, 17 bp, H. sapiens
atccgcccgcctcagct

SEQ ID NO: 49114 - DNA, 16 bp, H. sapiens
atccgcctgccccagc

SEQ ID NO: 49115 - DNA, 16 bp, H. sapiens
atccgcctggctcagc

SEQ ID NO: 49116 - DNA, 16 bp, H. sapiens
atccgctcacctcagc

SEQ ID NO: 49117 - DNA, 17 bp, H. sapiens
atccgctcacctcggcc

SEQ ID NO: 49118 - DNA, 17 bp, H. sapiens
atccgctcaccttggcc

SEQ ID NO: 49119 - DNA, 16 bp, H. sapiens
atccgggaagtggagg

SEQ ID NO: 49120 - DNA, 16 bp, H. sapiens
atccgggaggcggagc

SEQ ID NO: 49121 - DNA, 16 bp, H. sapiens
atccgggaggtgaagg

SEQ ID NO: 49122 - DNA, 16 bp, H. sapiens
atccgtccaccttggc

SEQ ID NO: 49123 - DNA, 16 bp, H. sapiens
atcctaaaatgtatat

SEQ ID NO: 49124 - DNA, 16 bp, H. sapiens
atcctaaaattcctat

SEQ ID NO: 49125 - DNA, 16 bp, H. sapiens
atcctaaataaatatg

SEQ ID NO: 49126 - DNA, 16 bp, H. sapiens
atcctaaatattttat

SEQ ID NO: 49127 - DNA, 16 bp, H. sapiens
atcctaaatttatatg

SEQ ID NO: 49128 - DNA, 16 bp, H. sapiens
atcctaaattttatat

SEQ ID NO: 49129 - DNA, 16 bp, H. sapiens
atcctaatgagtatga

SEQ ID NO: 49130 - DNA, 16 bp, H. sapiens
atcctacaatgcacag

SEQ ID NO: 49131 - DNA, 16 bp, H. sapiens
atcctacagaaataca

SEQ ID NO: 49132 - DNA, 16 bp, H. sapiens
atcctacagtgcacag

SEQ ID NO: 49133 - DNA, 16 bp, H. sapiens
atcctagaaaagaggc

SEQ ID NO: 49134 - DNA, 16 bp, H. sapiens
atcctagccaacactt

SEQ ID NO: 49135 - DNA, 16 bp, H. sapiens
atcctaggaataaagc

SEQ ID NO: 49136 - DNA, 16 bp, H. sapiens
atcctaggagaaaacc

SEQ ID NO: 49137 - DNA, 16 bp, H. sapiens
atcctattgtttctgt

SEQ ID NO: 49138 - DNA, 16 bp, H. sapiens
atcctatttccaaata

SEQ ID NO: 49139 - DNA, 16 bp, H. sapiens
atcctcaaaacaatcc

SEQ ID NO: 49140 - DNA, 16 bp, H. sapiens
atcctcacaacagccc

SEQ ID NO: 49141 - DNA, 16 bp, H. sapiens
atcctcacaaccacct

SEQ ID NO: 49142 - DNA, 16 bp, H. sapiens
atcctcacatgacaga

SEQ ID NO: 49143 - DNA, 16 bp, H. sapiens
atcctcaccagcatcc

SEQ ID NO: 49144 - DNA, 16 bp, H. sapiens
atcctcaccagcattt

SEQ ID NO: 49145 - DNA, 16 bp, H. sapiens
atcctcagactttgct

SEQ ID NO: 49146 - DNA, 16 bp, H. sapiens
atcctcagatgctcaa

SEQ ID NO: 49147 - DNA, 16 bp, H. sapiens
atcctcagcaaactaa

SEQ ID NO: 49148 - DNA, 16 bp, H. sapiens
atcctcatcaacactt

SEQ ID NO: 49149 - DNA, 16 bp, H. sapiens
atcctcatcatcttca

SEQ ID NO: 49150 - DNA, 16 bp, H. sapiens
atcctcatcctcatcc

SEQ ID NO: 49151 - DNA, 16 bp, H. sapiens
atcctcattttaaaaa

SEQ ID NO: 49152 - DNA, 16 bp, H. sapiens
atcctcatttttcaga

SEQ ID NO: 49153 - DNA, 16 bp, H. sapiens
atcctccaacctcagc

SEQ ID NO: 49154 - DNA, 16 bp, H. sapiens
atcctccaacctcagt

SEQ ID NO: 49155 - DNA, 16 bp, H. sapiens
atcctccagccccagc

SEQ ID NO: 49156 - DNA, 16 bp, H. sapiens
atcctcccaaagtgct

SEQ ID NO: 49157 - DNA, 16 bp, H. sapiens
atcctcccacctcagc

SEQ ID NO: 49158 - DNA, 16 bp, H. sapiens
atcctcccacctcgac

SEQ ID NO: 49159 - DNA, 16 bp, H. sapiens
atcctcccacctcggc

SEQ ID NO: 49160 - DNA, 16 bp, H. sapiens
atcctcccaccttagc

SEQ ID NO: 49161 - DNA, 16 bp, H. sapiens
atcctcccaccttggc

SEQ ID NO: 49162 - DNA, 16 bp, H. sapiens
atcctcccacctttgc

SEQ ID NO: 49163 - DNA, 16 bp, H. sapiens
atcctcccatctaagc

SEQ ID NO: 49164 - DNA, 16 bp, H. sapiens
atcctcccatctcagc

SEQ ID NO: 49165 - DNA, 16 bp, H. sapiens
atcctcccatcttggt

SEQ ID NO: 49166 - DNA, 16 bp, H. sapiens
atcctccccaccttgg

SEQ ID NO: 49167 - DNA, 16 bp, H. sapiens
atcctccccagcatct

SEQ ID NO: 49168 - DNA, 16 bp, H. sapiens
atcctcccccatcagc

SEQ ID NO: 49169 - DNA, 16 bp, H. sapiens
atcctcccgcctcagc

SEQ ID NO: 49170 - DNA, 16 bp, H. sapiens
atcctccggcctcagc

SEQ ID NO: 49171 - DNA, 16 bp, H. sapiens
atcctcctacctcagc

SEQ ID NO: 49172 - DNA, 16 bp, H. sapiens
atcctcctcagcttac

SEQ ID NO: 49173 - DNA, 16 bp, H. sapiens
atcctcctcctgcctc

SEQ ID NO: 49174 - DNA, 16 bp, H. sapiens
atcctcctgcccagcc

SEQ ID NO: 49175 - DNA, 16 bp, H. sapiens
atcctcctgcctcagc

SEQ ID NO: 49176 - DNA, 16 bp, H. sapiens
atcctcctgcctcagg

SEQ ID NO: 49177 - DNA, 16 bp, H. sapiens
atcctcctgcctccct

SEQ ID NO: 49178 - DNA, 16 bp, H. sapiens
atcctcctgcctctgc

SEQ ID NO: 49179 - DNA, 16 bp, H. sapiens
atcctcctgccttagc

SEQ ID NO: 49180 - DNA, 16 bp, H. sapiens
atcctcctgccttggc

SEQ ID NO: 49181 - DNA, 16 bp, H. sapiens
atcctcctgctccagc

SEQ ID NO: 49182 - DNA, 16 bp, H. sapiens
atcctcctggctcagc

SEQ ID NO: 49183 - DNA, 16 bp, H. sapiens
atcctcctgtctcacc

SEQ ID NO: 49184 - DNA, 16 bp, H. sapiens
atcctcctgtctcagc

SEQ ID NO: 49185 - DNA, 16 bp, H. sapiens
atcctccttcctgggc

SEQ ID NO: 49186 - DNA, 16 bp, H. sapiens
atcctccttggcctcc

SEQ ID NO: 49187 - DNA, 16 bp, H. sapiens
atcctctacagcatct

SEQ ID NO: 49188 - DNA, 16 bp, H. sapiens
atcctctcacttcagc

SEQ ID NO: 49189 - DNA, 16 bp, H. sapiens
atcctctccagaatct

SEQ ID NO: 49190 - DNA, 16 bp, H. sapiens
atcctctcccctcagc

SEQ ID NO: 49191 - DNA, 16 bp, H. sapiens
atcctctccctgctcc

SEQ ID NO: 49192 - DNA, 16 bp, H. sapiens
atcctctctcctcagc

SEQ ID NO: 49193 - DNA, 16 bp, H. sapiens
atcctctgaaatttag

SEQ ID NO: 49194 - DNA, 16 bp, H. sapiens
atcctctgagcccagg

SEQ ID NO: 49195 - DNA, 16 bp, H. sapiens
atcctctgcttcctgg

SEQ ID NO: 49196 - DNA, 16 bp, H. sapiens
atcctctgtccagttc

SEQ ID NO: 49197 - DNA, 16 bp, H. sapiens
atcctcttgcctcagc

SEQ ID NO: 49198 - DNA, 16 bp, H. sapiens
atcctcttgtatactt

SEQ ID NO: 49199 - DNA, 16 bp, H. sapiens
atcctcttgtctcagc

SEQ ID NO: 49200 - DNA, 16 bp, H. sapiens
atcctgaaatatattt

SEQ ID NO: 49201 - DNA, 16 bp, H. sapiens
atcctgaaattcatat

SEQ ID NO: 49202 - DNA, 16 bp, H. sapiens
atcctgaaattttgct

SEQ ID NO: 49203 - DNA, 16 bp, H. sapiens
atcctgaagacaaagc

SEQ ID NO: 49204 - DNA, 16 bp, H. sapiens
atcctgaagcagctgg

SEQ ID NO: 49205 - DNA, 17 bp, H. sapiens
atcctgaaggaatggtc

SEQ ID NO: 49206 - DNA, 16 bp, H. sapiens
atcctgaagtgttttc

SEQ ID NO: 49207 - DNA, 16 bp, H. sapiens
atcctgacaaaaacaa

SEQ ID NO: 49208 - DNA, 16 bp, H. sapiens
atcctgaccttgtgat

SEQ ID NO: 49209 - DNA, 16 bp, H. sapiens
atcctgacttcaagtg

SEQ ID NO: 49210 - DNA, 16 bp, H. sapiens
atcctgagagcgctcc

SEQ ID NO: 49211 - DNA, 16 bp, H. sapiens
atcctgagataaggag

SEQ ID NO: 49212 - DNA, 16 bp, H. sapiens
atcctgagcaaaagaa

SEQ ID NO: 49213 - DNA, 16 bp, H. sapiens
atcctgagtgtgtctg

SEQ ID NO: 49214 - DNA, 16 bp, H. sapiens
atcctgagtttctgtg

SEQ ID NO: 49215 - DNA, 16 bp, H. sapiens
atcctgcaaaatctaa

SEQ ID NO: 49216 - DNA, 16 bp, H. sapiens
atcctgcacacgtacc

SEQ ID NO: 49217 - DNA, 16 bp, H. sapiens
atcctgcaccagcaac

SEQ ID NO: 49218 - DNA, 18 bp, H. sapiens
atcctgcagagtgttttc

SEQ ID NO: 49219 - DNA, 16 bp, H. sapiens
atcctgccactgctct

SEQ ID NO: 49220 - DNA, 16 bp, H. sapiens
atcctgcctcactgca

SEQ ID NO: 49221 - DNA, 16 bp, H. sapiens
atcctgcctcagactc

SEQ ID NO: 49222 - DNA, 16 bp, H. sapiens
atcctgcctcagcctc

SEQ ID NO: 49223 - DNA, 16 bp, H. sapiens
atcctgcctcagcttc

SEQ ID NO: 49224 - DNA, 16 bp, H. sapiens
atcctgcctcaggctc

SEQ ID NO: 49225 - DNA, 16 bp, H. sapiens
atcctgcctctaccac

SEQ ID NO: 49226 - DNA, 16 bp, H. sapiens
atcctgccttagcctc

SEQ ID NO: 49227 - DNA, 16 bp, H. sapiens
atcctgctgggatttt

SEQ ID NO: 49228 - DNA, 16 bp, H. sapiens
atcctgctttgttcca

SEQ ID NO: 49229 - DNA, 16 bp, H. sapiens
atcctggaacagaaaa

SEQ ID NO: 49230 - DNA, 16 bp, H. sapiens
atcctggaactttaaa

SEQ ID NO: 49231 - DNA, 16 bp, H. sapiens
atcctggagaaacaga

SEQ ID NO: 49232 - DNA, 16 bp, H. sapiens
atcctggagacatttt

SEQ ID NO: 49233 - DNA, 16 bp, H. sapiens
atcctggaggctggaa

SEQ ID NO: 49234 - DNA, 16 bp, H. sapiens
atcctggatattagac

SEQ ID NO: 49235 - DNA, 16 bp, H. sapiens
atcctggccaacattg

SEQ ID NO: 49236 - DNA, 16 bp, H. sapiens
atcctggccaagatgg

SEQ ID NO: 49237 - DNA, 16 bp, H. sapiens
atcctggcccactgca

SEQ ID NO: 49238 - DNA, 16 bp, H. sapiens
atcctggctaacaaga

SEQ ID NO: 49239 - DNA, 16 bp, H. sapiens
atcctggctactctgg

SEQ ID NO: 49240 - DNA, 16 bp, H. sapiens
atcctggctccatcac

SEQ ID NO: 49241 - DNA, 18 bp, H. sapiens
atcctgggctcaagtgat

SEQ ID NO: 49242 - DNA, 16 bp, H. sapiens
atcctgggggaggagg

SEQ ID NO: 49243 - DNA, 16 bp, H. sapiens
atcctgggttcaagtg

SEQ ID NO: 49244 - DNA, 16 bp, H. sapiens
atcctggtgaaacccc

SEQ ID NO: 49245 - DNA, 16 bp, H. sapiens
atcctggtgaacatgg

SEQ ID NO: 49246 - DNA, 16 bp, H. sapiens
atcctgtccagcatct

SEQ ID NO: 49247 - DNA, 16 bp, H. sapiens
atcctgtccctcctcc

SEQ ID NO: 49248 - DNA, 16 bp, H. sapiens
atcctgtctcaaaaaa

SEQ ID NO: 49249 - DNA, 16 bp, H. sapiens
atcctgtctcataaaa

SEQ ID NO: 49250 - DNA, 16 bp, H. sapiens
atcctgtctctaagaa

SEQ ID NO: 49251 - DNA, 16 bp, H. sapiens
atcctgtgaccttgct

SEQ ID NO: 49252 - DNA, 17 bp, H. sapiens
atcctgtgacttagaat

SEQ ID NO: 49253 - DNA, 16 bp, H. sapiens
atcctgtgtgtgtgtg

SEQ ID NO: 49254 - DNA, 16 bp, H. sapiens
atcctgtgttcatgga

SEQ ID NO: 49255 - DNA, 16 bp, H. sapiens
atcctgttcaagttaa

SEQ ID NO: 49256 - DNA, 16 bp, H. sapiens
atcctgtttcattggt

SEQ ID NO: 49257 - DNA, 16 bp, H. sapiens
atcctgtttctaccaa

SEQ ID NO: 49258 - DNA, 16 bp, H. sapiens
atcctgtttctcatca

SEQ ID NO: 49259 - DNA, 16 bp, H. sapiens
atccttaaaaatgaaa

SEQ ID NO: 49260 - DNA, 16 bp, H. sapiens
atccttatgacctcat

SEQ ID NO: 49261 - DNA, 16 bp, H. sapiens
atccttcaaatatgaa

SEQ ID NO: 49262 - DNA, 16 bp, H. sapiens
atccttcaataggtga

SEQ ID NO: 49263 - DNA, 16 bp, H. sapiens
atccttcaccagcaac

SEQ ID NO: 49264 - DNA, 16 bp, H. sapiens
atccttccacctcagc

SEQ ID NO: 49265 - DNA, 16 bp, H. sapiens
atccttccaccttagc

SEQ ID NO: 49266 - DNA, 16 bp, H. sapiens
atccttccagactttc

SEQ ID NO: 49267 - DNA, 16 bp, H. sapiens
atccttccatcttggc

SEQ ID NO: 49268 - DNA, 16 bp, H. sapiens
atccttccccatcatc

SEQ ID NO: 49269 - DNA, 16 bp, H. sapiens
atccttctcaacacag

SEQ ID NO: 49270 - DNA, 16 bp, H. sapiens
atccttctgcctcagc

SEQ ID NO: 49271 - DNA, 16 bp, H. sapiens
atccttctgcctcagt

SEQ ID NO: 49272 - DNA, 16 bp, H. sapiens
atccttctgcctgggc

SEQ ID NO: 49273 - DNA, 16 bp, H. sapiens
atccttgactcctctt

SEQ ID NO: 49274 - DNA, 16 bp, H. sapiens
atccttgcattccagg

SEQ ID NO: 49275 - DNA, 16 bp, H. sapiens
atccttgccagcactt

SEQ ID NO: 49276 - DNA, 16 bp, H. sapiens
atccttggggtgttgc

SEQ ID NO: 49277 - DNA, 16 bp, H. sapiens
atccttgtttgcaaat

SEQ ID NO: 49278 - DNA, 16 bp, H. sapiens
atcctttaaaaattct

SEQ ID NO: 49279 - DNA, 16 bp, H. sapiens
atcctttcaaaaaaac

SEQ ID NO: 49280 - DNA, 16 bp, H. sapiens
atcctttcaccttggc

SEQ ID NO: 49281 - DNA, 16 bp, H. sapiens
atcctttccagcatct

SEQ ID NO: 49282 - DNA, 16 bp, H. sapiens
atcctttccttgtatt

SEQ ID NO: 49283 - DNA, 16 bp, H. sapiens
atcctttgatggacac

SEQ ID NO: 49284 - DNA, 16 bp, H. sapiens
atcctttgcatttctg

SEQ ID NO: 49285 - DNA, 16 bp, H. sapiens
atcctttgtattacaa

SEQ ID NO: 49286 - DNA, 16 bp, H. sapiens
atccttttaaaatgaa

SEQ ID NO: 49287 - DNA, 16 bp, H. sapiens
atccttttcagacaaa

SEQ ID NO: 49288 - DNA, 16 bp, H. sapiens
atccttttcagacaag

SEQ ID NO: 49289 - DNA, 16 bp, H. sapiens
atcctttttatatgtt

SEQ ID NO: 49290 - DNA, 20 bp, H. sapiens
atcgagaccatcccggctaa

SEQ ID NO: 49291 - DNA, 35 bp, H. sapiens
atcgagaccatcccggctaaaacggtgaaaccccg

SEQ ID NO: 49292 - DNA, 16 bp, H. sapiens
atcgagaccatcctgt

SEQ ID NO: 49293 - DNA, 17 bp, H. sapiens
atcgagaccgtcctggc

SEQ ID NO: 49294 - DNA, 16 bp, H. sapiens
atcgagagcatcctgg

SEQ ID NO: 49295 - DNA, 16 bp, H. sapiens
atcgaggccatcctgg

SEQ ID NO: 49296 - DNA, 16 bp, H. sapiens
atcgaggtgggtggat

SEQ ID NO: 49297 - DNA, 16 bp, H. sapiens
atcgcacactggggcc

SEQ ID NO: 49298 - DNA, 19 bp, H. sapiens
atcgcaccactgcactcca

SEQ ID NO: 49299 - DNA, 22 bp, H. sapiens
atcgcaccactgcactccagct

SEQ ID NO: 49300 - DNA, 16 bp, H. sapiens
atcgcatccctggagg

SEQ ID NO: 49301 - DNA, 17 bp, H. sapiens
atcgcccaggctggagc

SEQ ID NO: 49302 - DNA, 17 bp, H. sapiens
atcgcctgaggccagga

SEQ ID NO: 49303 - DNA, 16 bp, H. sapiens
atcgctactaaaaata

SEQ ID NO: 49304 - DNA, 16 bp, H. sapiens
atcgcttcagcccggg

SEQ ID NO: 49305 - DNA, 16 bp, H. sapiens
atcgcttgagcccaag

SEQ ID NO: 49306 - DNA, 16 bp, H. sapiens
atcgcttgagcccagc

SEQ ID NO: 49307 - DNA, 16 bp, H. sapiens
atcgcttgagccctgg

SEQ ID NO: 49308 - DNA, 16 bp, H. sapiens
atcgcttgaggccaga

SEQ ID NO: 49309 - DNA, 17 bp, H. sapiens
atcgcttgagtccagga

SEQ ID NO: 49310 - DNA, 16 bp, H. sapiens
atcgcttgggcctggg

SEQ ID NO: 49311 - DNA, 16 bp, H. sapiens
atcggccaggcacagt

SEQ ID NO: 49312 - DNA, 16 bp, H. sapiens
atcggcccacctcagc

SEQ ID NO: 49313 - DNA, 16 bp, H. sapiens
atcgggcagcccccag

SEQ ID NO: 49314 - DNA, 16 bp, H. sapiens
atcgtgaccatcctgg

SEQ ID NO: 49315 - DNA, 16 bp, H. sapiens
atcgtgccactgcaca

SEQ ID NO: 49316 - DNA, 17 bp, H. sapiens
atcgtgccactgcagtc

SEQ ID NO: 49317 - DNA, 16 bp, H. sapiens
atcgtgccactgccct

SEQ ID NO: 49318 - DNA, 16 bp, H. sapiens
atcgtggtgcacacct

SEQ ID NO: 49319 - DNA, 16 bp, H. sapiens
atcgtggttcactgca

SEQ ID NO: 49320 - DNA, 16 bp, H. sapiens
atctaaaaaatacctt

SEQ ID NO: 49321 - DNA, 16 bp, H. sapiens
atctaaaaatcagaaa

SEQ ID NO: 49322 - DNA, 16 bp, H. sapiens
atctaaaataaaggtt

SEQ ID NO: 49323 - DNA, 16 bp, H. sapiens
atctaaaataaatgaa

SEQ ID NO: 49324 - DNA, 16 bp, H. sapiens
atctaaacacagaaaa

SEQ ID NO: 49325 - DNA, 16 bp, H. sapiens
atctaaacatagaaaa

SEQ ID NO: 49326 - DNA, 16 bp, H. sapiens
atctaaatagatattt

SEQ ID NO: 49327 - DNA, 16 bp, H. sapiens
atctaacagagttaaa

SEQ ID NO: 49328 - DNA, 16 bp, H. sapiens
atctaagaaaatatgt

SEQ ID NO: 49329 - DNA, 16 bp, H. sapiens
atctaagaaagtcaaa

SEQ ID NO: 49330 - DNA, 16 bp, H. sapiens
atctaagcaaaaagaa

SEQ ID NO: 49331 - DNA, 16 bp, H. sapiens
atctaagggatccaga

SEQ ID NO: 49332 - DNA, 16 bp, H. sapiens
atctaataaagttgaa

SEQ ID NO: 49333 - DNA, 16 bp, H. sapiens
atctaataaatgaatt

SEQ ID NO: 49334 - DNA, 16 bp, H. sapiens
atctaatcagctgcca

SEQ ID NO: 49335 - DNA, 16 bp, H. sapiens
atctaatcttcaacaa

SEQ ID NO: 49336 - DNA, 16 bp, H. sapiens
atctaattacctccca

SEQ ID NO: 49337 - DNA, 16 bp, H. sapiens
atctaatttattggca

SEQ ID NO: 49338 - DNA, 16 bp, H. sapiens
atctacaaaatacctt

SEQ ID NO: 49339 - DNA, 16 bp, H. sapiens
atctacaaattcagtg

SEQ ID NO: 49340 - DNA, 16 bp, H. sapiens
atctacaagccaagga

SEQ ID NO: 49341 - DNA, 16 bp, H. sapiens
atctacaaggagctta

SEQ ID NO: 49342 - DNA, 16 bp, H. sapiens
atctacacaaagaaat

SEQ ID NO: 49343 - DNA, 16 bp, H. sapiens
atctacagagacaaaa

SEQ ID NO: 49344 - DNA, 16 bp, H. sapiens
atctacagagatagaa

SEQ ID NO: 49345 - DNA, 16 bp, H. sapiens
atctacaggaaaaagt

SEQ ID NO: 49346 - DNA, 16 bp, H. sapiens
atctacatctatatct

SEQ ID NO: 49347 - DNA, 16 bp, H. sapiens
atctacatctgtatct

SEQ ID NO: 49348 - DNA, 16 bp, H. sapiens
atctacccaccttggc

SEQ ID NO: 49349 - DNA, 16 bp, H. sapiens
atctacccagaggaaa

SEQ ID NO: 49350 - DNA, 17 bp, H. sapiens
atctacccgcctcggcc

SEQ ID NO: 49351 - DNA, 16 bp, H. sapiens
atctacctatgacctg

SEQ ID NO: 49352 - DNA, 17 bp, H. sapiens
atctacctgcctcggcc

SEQ ID NO: 49353 - DNA, 16 bp, H. sapiens
atctactatgtgccag

SEQ ID NO: 49354 - DNA, 16 bp, H. sapiens
atctactctcttagca

SEQ ID NO: 49355 - DNA, 16 bp, H. sapiens
atctactttaggtatt

SEQ ID NO: 49356 - DNA, 16 bp, H. sapiens
atctagaactttcata

SEQ ID NO: 49357 - DNA, 16 bp, H. sapiens
atctagaagtgaaatt

SEQ ID NO: 49358 - DNA, 16 bp, H. sapiens
atctagaattgtaatc

SEQ ID NO: 49359 - DNA, 16 bp, H. sapiens
atctagaatttatttt

SEQ ID NO: 49360 - DNA, 16 bp, H. sapiens
atctagagacattttt

SEQ ID NO: 49361 - DNA, 16 bp, H. sapiens
atctaggtggaggttt

SEQ ID NO: 49362 - DNA, 16 bp, H. sapiens
atctaggtttgtgtaa

SEQ ID NO: 49363 - DNA, 16 bp, H. sapiens
atctagtctactgttg

SEQ ID NO: 49364 - DNA, 16 bp, H. sapiens
atctagtttcaggaaa

SEQ ID NO: 49365 - DNA, 16 bp, H. sapiens
atctagtttttaaaat

SEQ ID NO: 49366 - DNA, 16 bp, H. sapiens
atctataaaaggaaaa

SEQ ID NO: 49367 - DNA, 16 bp, H. sapiens
atctataaaatagaaa

SEQ ID NO: 49368 - DNA, 16 bp, H. sapiens
atctataaatcatttt

SEQ ID NO: 49369 - DNA, 16 bp, H. sapiens
atctataaggaactta

SEQ ID NO: 49370 - DNA, 16 bp, H. sapiens
atctatacattacctt

SEQ ID NO: 49371 - DNA, 16 bp, H. sapiens
atctatagatttcttt

SEQ ID NO: 49372 - DNA, 16 bp, H. sapiens
atctatagtgacagaa

SEQ ID NO: 49373 - DNA, 16 bp, H. sapiens
atctatatacatatac

SEQ ID NO: 49374 - DNA, 16 bp, H. sapiens
atctatatagatgtat

SEQ ID NO: 49375 - DNA, 16 bp, H. sapiens
atctatatatagagat

SEQ ID NO: 49376 - DNA, 16 bp, H. sapiens
atctatatctgtatct

SEQ ID NO: 49377 - DNA, 16 bp, H. sapiens
atctatatgctgaaaa

SEQ ID NO: 49378 - DNA, 16 bp, H. sapiens
atctatatgtgtgtat

SEQ ID NO: 49379 - DNA, 16 bp, H. sapiens
atctatattgaaaatc

SEQ ID NO: 49380 - DNA, 16 bp, H. sapiens
atctatcaatctatct

SEQ ID NO: 49381 - DNA, 16 bp, H. sapiens
atctatccatctctct

SEQ ID NO: 49382 - DNA, 16 bp, H. sapiens
atctatctaaatatat

SEQ ID NO: 49383 - DNA, 16 bp, H. sapiens
atctatctagatatct

SEQ ID NO: 49384 - DNA, 16 bp, H. sapiens
atctatctatatctat

SEQ ID NO: 49385 - DNA, 16 bp, H. sapiens
atctatctatatgtat

SEQ ID NO: 49386 - DNA, 16 bp, H. sapiens
atctatctatctgtct

SEQ ID NO: 49387 - DNA, 16 bp, H. sapiens
atctatgacaaagcca

SEQ ID NO: 49388 - DNA, 22 bp, H. sapiens
atctatgaccttacccccaacc

SEQ ID NO: 49389 - DNA, 16 bp, H. sapiens
atctatgatatatatg

SEQ ID NO: 49390 - DNA, 16 bp, H. sapiens
atctatgcagcaaacc

SEQ ID NO: 49391 - DNA, 16 bp, H. sapiens
atctatgccaacatct

SEQ ID NO: 49392 - DNA, 16 bp, H. sapiens
atctatggaaataaaa

SEQ ID NO: 49393 - DNA, 16 bp, H. sapiens
atctatgtaaccaaaa

SEQ ID NO: 49394 - DNA, 16 bp, H. sapiens
atctatgtacatatat

SEQ ID NO: 49395 - DNA, 16 bp, H. sapiens
atctatgtatttattt

SEQ ID NO: 49396 - DNA, 16 bp, H. sapiens
atctatgtctatatat

SEQ ID NO: 49397 - DNA, 16 bp, H. sapiens
atctatgtctatgtct

SEQ ID NO: 49398 - DNA, 16 bp, H. sapiens
atctatgttcattaga

SEQ ID NO: 49399 - DNA, 16 bp, H. sapiens
atctattcaaacagct

SEQ ID NO: 49400 - DNA, 16 bp, H. sapiens
atctattcatgaagga

SEQ ID NO: 49401 - DNA, 16 bp, H. sapiens
atctattctgttccat

SEQ ID NO: 49402 - DNA, 16 bp, H. sapiens
atctattgaaggacat

SEQ ID NO: 49403 - DNA, 16 bp, H. sapiens
atctattgatggacac

SEQ ID NO: 49404 - DNA, 16 bp, H. sapiens
atctatttggggatct

SEQ ID NO: 49405 - DNA, 16 bp, H. sapiens
atctatttgtctgtct

SEQ ID NO: 49406 - DNA, 16 bp, H. sapiens
atctatttgtctgttc

SEQ ID NO: 49407 - DNA, 16 bp, H. sapiens
atctattttgtcttat

SEQ ID NO: 49408 - DNA, 16 bp, H. sapiens
atctatttttataaag

SEQ ID NO: 49409 - DNA, 16 bp, H. sapiens
atctcaaaaaaaaagt

SEQ ID NO: 49410 - DNA, 16 bp, H. sapiens
atctcaaaaaaaagga

SEQ ID NO: 49411 - DNA, 16 bp, H. sapiens
atctcaaaagaagaca

SEQ ID NO: 49412 - DNA, 16 bp, H. sapiens
atctcaaagaaagaaa

SEQ ID NO: 49413 - DNA, 16 bp, H. sapiens
atctcaaatcaacacc

SEQ ID NO: 49414 - DNA, 16 bp, H. sapiens
atctcaaattgtaatt

SEQ ID NO: 49415 - DNA, 16 bp, H. sapiens
atctcaagaaaaaata

SEQ ID NO: 49416 - DNA, 16 bp, H. sapiens
atctcaagaaaaataa

SEQ ID NO: 49417 - DNA, 16 bp, H. sapiens
atctcaagaaaataaa

SEQ ID NO: 49418 - DNA, 16 bp, H. sapiens
atctcaagaagaaaaa

SEQ ID NO: 49419 - DNA, 16 bp, H. sapiens
atctcaaggaactaga

SEQ ID NO: 49420 - DNA, 16 bp, H. sapiens
atctcaataaaacttt

SEQ ID NO: 49421 - DNA, 16 bp, H. sapiens
atctcaataaagttat

SEQ ID NO: 49422 - DNA, 20 bp, H. sapiens
atctcaatagatgcagaaaa

SEQ ID NO: 49423 - DNA, 32 bp, H. sapiens
atctcacaaagggctaatatccagaatctaca

SEQ ID NO: 49424 - DNA, 16 bp, H. sapiens
atctcacacttgttag

SEQ ID NO: 49425 - DNA, 16 bp, H. sapiens
atctcacagaattgaa

SEQ ID NO: 49426 - DNA, 16 bp, H. sapiens
atctcacagagttaaa

SEQ ID NO: 49427 - DNA, 16 bp, H. sapiens
atctcacagatgagga

SEQ ID NO: 49428 - DNA, 16 bp, H. sapiens
atctcaccttactgca

SEQ ID NO: 49429 - DNA, 16 bp, H. sapiens
atctcactatgttgcc

SEQ ID NO: 49430 - DNA, 16 bp, H. sapiens
atctcactctgtcact

SEQ ID NO: 49431 - DNA, 16 bp, H. sapiens
atctcactggggactg

SEQ ID NO: 49432 - DNA, 16 bp, H. sapiens
atctcactgtggtctt

SEQ ID NO: 49433 - DNA, 16 bp, H. sapiens
atctcacttaaatgtg

SEQ ID NO: 49434 - DNA, 16 bp, H. sapiens
atctcacttaattctc

SEQ ID NO: 49435 - DNA, 16 bp, H. sapiens
atctcactttttaaaa

SEQ ID NO: 49436 - DNA, 16 bp, H. sapiens
atctcagaaaataaat

SEQ ID NO: 49437 - DNA, 16 bp, H. sapiens
atctcagaaaccacca

SEQ ID NO: 49438 - DNA, 16 bp, H. sapiens
atctcagaacttaaaa

SEQ ID NO: 49439 - DNA, 16 bp, H. sapiens
atctcagactactgtg

SEQ ID NO: 49440 - DNA, 16 bp, H. sapiens
atctcagagcctgaag

SEQ ID NO: 49441 - DNA, 16 bp, H. sapiens
atctcagagtttgaag

SEQ ID NO: 49442 - DNA, 16 bp, H. sapiens
atctcagatcactgca

SEQ ID NO: 49443 - DNA, 16 bp, H. sapiens
atctcagcaagaggaa

SEQ ID NO: 49444 - DNA, 16 bp, H. sapiens
atctcagcaatgtttt

SEQ ID NO: 49445 - DNA, 17 bp, H. sapiens
atctcagcacttcagga

SEQ ID NO: 49446 - DNA, 19 bp, H. sapiens
atctcagcactttgggaga

SEQ ID NO: 49447 - DNA, 16 bp, H. sapiens
atctcagcccaccgca

SEQ ID NO: 49448 - DNA, 16 bp, H. sapiens
atctcagctcacagca

SEQ ID NO: 49449 - DNA, 21 bp, H. sapiens
atctcagctcaccacaacctc

SEQ ID NO: 49450 - DNA, 16 bp, H. sapiens
atctcagctcaccgca

SEQ ID NO: 49451 - DNA, 16 bp, H. sapiens
atctcagctcactcta

SEQ ID NO: 49452 - DNA, 16 bp, H. sapiens
atctcagctcactgca

SEQ ID NO: 49453 - DNA, 16 bp, H. sapiens
atctcagctcactgcc

SEQ ID NO: 49454 - DNA, 16 bp, H. sapiens
atctcagctcactgga

SEQ ID NO: 49455 - DNA, 16 bp, H. sapiens
atctcagctcagtgca

SEQ ID NO: 49456 - DNA, 16 bp, H. sapiens
atctcagctcattcca

SEQ ID NO: 49457 - DNA, 16 bp, H. sapiens
atctcagctcattgca

SEQ ID NO: 49458 - DNA, 16 bp, H. sapiens
atctcagctcgctgca

SEQ ID NO: 49459 - DNA, 16 bp, H. sapiens
atctcagctctctgca

SEQ ID NO: 49460 - DNA, 16 bp, H. sapiens
atctcagctgactgca

SEQ ID NO: 49461 - DNA, 16 bp, H. sapiens
atctcagcttactgca

SEQ ID NO: 49462 - DNA, 16 bp, H. sapiens
atctcagcttgctgca

SEQ ID NO: 49463 - DNA, 16 bp, H. sapiens
atctcagctttcaaaa

SEQ ID NO: 49464 - DNA, 16 bp, H. sapiens
atctcaggtcactgca

SEQ ID NO: 49465 - DNA, 16 bp, H. sapiens
atctcagttaatcctc

SEQ ID NO: 49466 - DNA, 16 bp, H. sapiens
atctcagttcactgca

SEQ ID NO: 49467 - DNA, 16 bp, H. sapiens
atctcagttcagtgca

SEQ ID NO: 49468 - DNA, 16 bp, H. sapiens
atctcagttttttaaa

SEQ ID NO: 49469 - DNA, 16 bp, H. sapiens
atctcataggattgtt

SEQ ID NO: 49470 - DNA, 16 bp, H. sapiens
atctcatagggttgtt

SEQ ID NO: 49471 - DNA, 16 bp, H. sapiens
atctcatcacctttgc

SEQ ID NO: 49472 - DNA, 16 bp, H. sapiens
atctcatcatgatttt

SEQ ID NO: 49473 - DNA, 16 bp, H. sapiens
atctcatctaatcctc

SEQ ID NO: 49474 - DNA, 16 bp, H. sapiens
atctcatctgaaaaat

SEQ ID NO: 49475 - DNA, 16 bp, H. sapiens
atctcatgtgacttat

SEQ ID NO: 49476 - DNA, 16 bp, H. sapiens
atctcattcaatcctc

SEQ ID NO: 49477 - DNA, 16 bp, H. sapiens
atctcattctgtcatc

SEQ ID NO: 49478 - DNA, 16 bp, H. sapiens
atctcattgctgtttt

SEQ ID NO: 49479 - DNA, 16 bp, H. sapiens
atctcattggccagaa

SEQ ID NO: 49480 - DNA, 16 bp, H. sapiens
atctcattgtgatttt

SEQ ID NO: 49481 - DNA, 16 bp, H. sapiens
atctcattgtttaaaa

SEQ ID NO: 49482 - DNA, 16 bp, H. sapiens
atctcatttaaataaa

SEQ ID NO: 49483 - DNA, 16 bp, H. sapiens
atctcatttcaatttc

SEQ ID NO: 49484 - DNA, 16 bp, H. sapiens
atctcatttgatcctt

SEQ ID NO: 49485 - DNA, 16 bp, H. sapiens
atctcattttggattt

SEQ ID NO: 49486 - DNA, 16 bp, H. sapiens
atctcattttggttta

SEQ ID NO: 49487 - DNA, 16 bp, H. sapiens
atctcattttgtcttt

SEQ ID NO: 49488 - DNA, 16 bp, H. sapiens
atctcattttttaggt

SEQ ID NO: 49489 - DNA, 16 bp, H. sapiens
atctccaaagaaaaaa

SEQ ID NO: 49490 - DNA, 16 bp, H. sapiens
atctccaaatacagtc

SEQ ID NO: 49491 - DNA, 16 bp, H. sapiens
atctccaagcctcagt

SEQ ID NO: 49492 - DNA, 21 bp, H. sapiens
atctccactcactgcaagctc

SEQ ID NO: 49493 - DNA, 16 bp, H. sapiens
atctccagaacatttt

SEQ ID NO: 49494 - DNA, 16 bp, H. sapiens
atctccagaactcttt

SEQ ID NO: 49495 - DNA, 16 bp, H. sapiens
atctccagaacttttt

SEQ ID NO: 49496 - DNA, 16 bp, H. sapiens
atctccagcctgccag

SEQ ID NO: 49497 - DNA, 16 bp, H. sapiens
atctccaggaaaaaaa

SEQ ID NO: 49498 - DNA, 16 bp, H. sapiens
atctccagggcagggt

SEQ ID NO: 49499 - DNA, 16 bp, H. sapiens
atctccaggtagacag

SEQ ID NO: 49500 - DNA, 16 bp, H. sapiens
atctccagttttgcct

SEQ ID NO: 49501 - DNA, 18 bp, H. sapiens
atctccatcaagctacca

SEQ ID NO: 49502 - DNA, 16 bp, H. sapiens
atctccatcagagacc

SEQ ID NO: 49503 - DNA, 16 bp, H. sapiens
atctccatcatcacca

SEQ ID NO: 49504 - DNA, 16 bp, H. sapiens
atctccatttctctgc

SEQ ID NO: 49505 - DNA, 16 bp, H. sapiens
atctccatttttagca

SEQ ID NO: 49506 - DNA, 16 bp, H. sapiens
atctcccaacctcagg

SEQ ID NO: 49507 - DNA, 16 bp, H. sapiens
atctcccaggctcaag

SEQ ID NO: 49508 - DNA, 16 bp, H. sapiens
atctcccaggttcaag

SEQ ID NO: 49509 - DNA, 16 bp, H. sapiens
atctcccctcctcaca

SEQ ID NO: 49510 - DNA, 16 bp, H. sapiens
atctcccctgcccaga

SEQ ID NO: 49511 - DNA, 16 bp, H. sapiens
atctcccgggttcaaa

SEQ ID NO: 49512 - DNA, 17 bp, H. sapiens
atctccgctcactacaa

SEQ ID NO: 49513 - DNA, 16 bp, H. sapiens
atctccgctcactgca

SEQ ID NO: 49514 - DNA, 16 bp, H. sapiens
atctcctaggctcaag

SEQ ID NO: 49515 - DNA, 16 bp, H. sapiens
atctcctcatttcctc

SEQ ID NO: 49516 - DNA, 16 bp, H. sapiens
atctcctcctcctggg

SEQ ID NO: 49517 - DNA, 16 bp, H. sapiens
atctcctctttttata

SEQ ID NO: 49518 - DNA, 16 bp, H. sapiens
atctcctgaacctggg

SEQ ID NO: 49519 - DNA, 16 bp, H. sapiens
atctcctgaacttgtg

SEQ ID NO: 49520 - DNA, 16 bp, H. sapiens
atctcctgaagctgat

SEQ ID NO: 49521 - DNA, 17 bp, H. sapiens
atctcctgacattgtga

SEQ ID NO: 49522 - DNA, 16 bp, H. sapiens
atctcctgacctcaag

SEQ ID NO: 49523 - DNA, 18 bp, H. sapiens
atctcctgacctcacgat

SEQ ID NO: 49524 - DNA, 17 bp, H. sapiens
atctcctgacctcatga

SEQ ID NO: 49525 - DNA, 19 bp, H. sapiens
atctcctgacctggtgatc

SEQ ID NO: 49526 - DNA, 16 bp, H. sapiens
atctcctgaccttgtc

SEQ ID NO: 49527 - DNA, 17 bp, H. sapiens
atctcctgaccttgtga

SEQ ID NO: 49528 - DNA, 16 bp, H. sapiens
atctcctgagaactcc

SEQ ID NO: 49529 - DNA, 19 bp, H. sapiens
atctcctgagctcgtgatc

SEQ ID NO: 49530 - DNA, 18 bp, H. sapiens
atctcctgcctcagcctc

SEQ ID NO: 49531 - DNA, 16 bp, H. sapiens
atctcctggccttgtg

SEQ ID NO: 49532 - DNA, 16 bp, H. sapiens
atctcctgggatcaag

SEQ ID NO: 49533 - DNA, 16 bp, H. sapiens
atctcctgggctcaag

SEQ ID NO: 49534 - DNA, 16 bp, H. sapiens
atctcctggtctgctg

SEQ ID NO: 49535 - DNA, 16 bp, H. sapiens
atctcctgtttctttt

SEQ ID NO: 49536 - DNA, 16 bp, H. sapiens
atctccttggtgatga

SEQ ID NO: 49537 - DNA, 16 bp, H. sapiens
atctcctttgactcca

SEQ ID NO: 49538 - DNA, 16 bp, H. sapiens
atctcctttgatttca

SEQ ID NO: 49539 - DNA, 16 bp, H. sapiens
atctcgacctcccaaa

SEQ ID NO: 49540 - DNA, 16 bp, H. sapiens
atctcgactcactgca

SEQ ID NO: 49541 - DNA, 16 bp, H. sapiens
atctcgagtcactgca

SEQ ID NO: 49542 - DNA, 16 bp, H. sapiens
atctcgcctcactgca

SEQ ID NO: 49543 - DNA, 16 bp, H. sapiens
atctcgctctgtcacc

SEQ ID NO: 49544 - DNA, 16 bp, H. sapiens
atctcgctctgttgcc

SEQ ID NO: 49545 - DNA, 16 bp, H. sapiens
atctcggacttccagc

SEQ ID NO: 49546 - DNA, 16 bp, H. sapiens
atctcggctcaccaaa

SEQ ID NO: 49547 - DNA, 16 bp, H. sapiens
atctcggctcactcca

SEQ ID NO: 49548 - DNA, 16 bp, H. sapiens
atctcggctcactgaa

SEQ ID NO: 49549 - DNA, 18 bp, H. sapiens
atctcggctcactgtaag

SEQ ID NO: 49550 - DNA, 16 bp, H. sapiens
atctcggctcacttca

SEQ ID NO: 49551 - DNA, 16 bp, H. sapiens
atctcggctcgctgca

SEQ ID NO: 49552 - DNA, 16 bp, H. sapiens
atctcggctctctgca

SEQ ID NO: 49553 - DNA, 16 bp, H. sapiens
atctcggcttactgca

SEQ ID NO: 49554 - DNA, 19 bp, H. sapiens
atctcggcttactgcaact

SEQ ID NO: 49555 - DNA, 16 bp, H. sapiens
atctcggttcactgca

SEQ ID NO: 49556 - DNA, 16 bp, H. sapiens
atctctaaaaaagaaa

SEQ ID NO: 49557 - DNA, 16 bp, H. sapiens
atctctaaaatttaaa

SEQ ID NO: 49558 - DNA, 16 bp, H. sapiens
atctctaatgaaaata

SEQ ID NO: 49559 - DNA, 16 bp, H. sapiens
atctctaatttttaaa

SEQ ID NO: 49560 - DNA, 16 bp, H. sapiens
atctctacaaaagatt

SEQ ID NO: 49561 - DNA, 18 bp, H. sapiens
atctctacaaataattta

SEQ ID NO: 49562 - DNA, 16 bp, H. sapiens
atctctacaaattttt

SEQ ID NO: 49563 - DNA, 16 bp, H. sapiens
atctctacaacaagaa

SEQ ID NO: 49564 - DNA, 16 bp, H. sapiens
atctctacaaggagaa

SEQ ID NO: 49565 - DNA, 19 bp, H. sapiens
atctctaccaaaaatacag

SEQ ID NO: 49566 - DNA, 17 bp, H. sapiens
atctctaccaaaaatag

SEQ ID NO: 49567 - DNA, 17 bp, H. sapiens
atctctactaaaaaaat

SEQ ID NO: 49568 - DNA, 16 bp, H. sapiens
atctctactaaaaatt

SEQ ID NO: 49569 - DNA, 16 bp, H. sapiens
atctctagattactta

SEQ ID NO: 49570 - DNA, 16 bp, H. sapiens
atctctagattattta

SEQ ID NO: 49571 - DNA, 16 bp, H. sapiens
atctctagattgctta

SEQ ID NO: 49572 - DNA, 16 bp, H. sapiens
atctctataaaacatt

SEQ ID NO: 49573 - DNA, 16 bp, H. sapiens
atctctcacacacaca

SEQ ID NO: 49574 - DNA, 16 bp, H. sapiens
atctctcacctggatt

SEQ ID NO: 49575 - DNA, 16 bp, H. sapiens
atctctcatttctttg

SEQ ID NO: 49576 - DNA, 16 bp, H. sapiens
atctctccaaaaataa

SEQ ID NO: 49577 - DNA, 16 bp, H. sapiens
atctctcctgctttct

SEQ ID NO: 49578 - DNA, 16 bp, H. sapiens
atctctccttctgcct

SEQ ID NO: 49579 - DNA, 16 bp, H. sapiens
atctctctaaaataat

SEQ ID NO: 49580 - DNA, 16 bp, H. sapiens
atctctctaagcttca

SEQ ID NO: 49581 - DNA, 16 bp, H. sapiens
atctctctcaaggtca

SEQ ID NO: 49582 - DNA, 16 bp, H. sapiens
atctctctcaagttcg

SEQ ID NO: 49583 - DNA, 16 bp, H. sapiens
atctctctcaatttca

SEQ ID NO: 49584 - DNA, 16 bp, H. sapiens
atctctctcatgttca

SEQ ID NO: 49585 - DNA, 16 bp, H. sapiens
atctctctctccatct

SEQ ID NO: 49586 - DNA, 16 bp, H. sapiens
atctctctgacctcat

SEQ ID NO: 49587 - DNA, 16 bp, H. sapiens
atctctctgtctctgt

SEQ ID NO: 49588 - DNA, 16 bp, H. sapiens
atctctctttaaaaaa

SEQ ID NO: 49589 - DNA, 16 bp, H. sapiens
atctctctttgcagat

SEQ ID NO: 49590 - DNA, 16 bp, H. sapiens
atctctgaagaatatt

SEQ ID NO: 49591 - DNA, 16 bp, H. sapiens
atctctgaattttttt

SEQ ID NO: 49592 - DNA, 16 bp, H. sapiens
atctctgagatgcagc

SEQ ID NO: 49593 - DNA, 16 bp, H. sapiens
atctctgataaatatt

SEQ ID NO: 49594 - DNA, 16 bp, H. sapiens
atctctgattttactt

SEQ ID NO: 49595 - DNA, 16 bp, H. sapiens
atctctgcaaggagaa

SEQ ID NO: 49596 - DNA, 16 bp, H. sapiens
atctctgcatgagcag

SEQ ID NO: 49597 - DNA, 16 bp, H. sapiens
atctctgccccctggg

SEQ ID NO: 49598 - DNA, 16 bp, H. sapiens
atctctgcctcccagg

SEQ ID NO: 49599 - DNA, 16 bp, H. sapiens
atctctgcctcccatg

SEQ ID NO: 49600 - DNA, 16 bp, H. sapiens
atctctgcctcccggt

SEQ ID NO: 49601 - DNA, 16 bp, H. sapiens
atctctgcctctctct

SEQ ID NO: 49602 - DNA, 16 bp, H. sapiens
atctctgcctctgcct

SEQ ID NO: 49603 - DNA, 16 bp, H. sapiens
atctctgccttccagg

SEQ ID NO: 49604 - DNA, 16 bp, H. sapiens
atctctgctcaccaca

SEQ ID NO: 49605 - DNA, 16 bp, H. sapiens
atctctgctcacctca

SEQ ID NO: 49606 - DNA, 16 bp, H. sapiens
atctctgctcactgca

SEQ ID NO: 49607 - DNA, 16 bp, H. sapiens
atctctgctcattgca

SEQ ID NO: 49608 - DNA, 16 bp, H. sapiens
atctctggaacacatt

SEQ ID NO: 49609 - DNA, 16 bp, H. sapiens
atctctgggaaaaaaa

SEQ ID NO: 49610 - DNA, 16 bp, H. sapiens
atctctgggtgctggg

SEQ ID NO: 49611 - DNA, 16 bp, H. sapiens
atctctgtcaggtttt

SEQ ID NO: 49612 - DNA, 16 bp, H. sapiens
atctctgtcctcatgg

SEQ ID NO: 49613 - DNA, 16 bp, H. sapiens
atctctgtgacacagc

SEQ ID NO: 49614 - DNA, 16 bp, H. sapiens
atctctgtgcctcagt

SEQ ID NO: 49615 - DNA, 16 bp, H. sapiens
atctctgttcactgca

SEQ ID NO: 49616 - DNA, 16 bp, H. sapiens
atctctgttctgttcc

SEQ ID NO: 49617 - DNA, 16 bp, H. sapiens
atctctgtttcttcag

SEQ ID NO: 49618 - DNA, 16 bp, H. sapiens
atctctgttttcattt

SEQ ID NO: 49619 - DNA, 16 bp, H. sapiens
atctcttcaatatacc

SEQ ID NO: 49620 - DNA, 16 bp, H. sapiens
atctcttctgaaaaca

SEQ ID NO: 49621 - DNA, 16 bp, H. sapiens
atctcttgagccccag

SEQ ID NO: 49622 - DNA, 16 bp, H. sapiens
atctcttgagctcagg

SEQ ID NO: 49623 - DNA, 16 bp, H. sapiens
atctcttgaggccaga

SEQ ID NO: 49624 - DNA, 16 bp, H. sapiens
atctcttgggcccagg

SEQ ID NO: 49625 - DNA, 16 bp, H. sapiens
atctcttgttgaattg

SEQ ID NO: 49626 - DNA, 16 bp, H. sapiens
atctctttaaaagata

SEQ ID NO: 49627 - DNA, 16 bp, H. sapiens
atctctttaatgtctg

SEQ ID NO: 49628 - DNA, 16 bp, H. sapiens
atctctttacctcgtg

SEQ ID NO: 49629 - DNA, 16 bp, H. sapiens
atctctttatgttaaa

SEQ ID NO: 49630 - DNA, 16 bp, H. sapiens
atctctttcatttctg

SEQ ID NO: 49631 - DNA, 16 bp, H. sapiens
atctctttgctattgt

SEQ ID NO: 49632 - DNA, 16 bp, H. sapiens
atctcttttaaaatat

SEQ ID NO: 49633 - DNA, 16 bp, H. sapiens
atctcttttctttgta

SEQ ID NO: 49634 - DNA, 16 bp, H. sapiens
atctctttttaaaaaa

SEQ ID NO: 49635 - DNA, 16 bp, H. sapiens
atctctttttgtagaa

SEQ ID NO: 49636 - DNA, 16 bp, H. sapiens
atctgaaaaatgagaa

SEQ ID NO: 49637 - DNA, 16 bp, H. sapiens
atctgaaaatgaagaa

SEQ ID NO: 49638 - DNA, 16 bp, H. sapiens
atctgaaacaaacaaa

SEQ ID NO: 49639 - DNA, 16 bp, H. sapiens
atctgaaagacaaaac

SEQ ID NO: 49640 - DNA, 16 bp, H. sapiens
atctgaaataaaaata

SEQ ID NO: 49641 - DNA, 16 bp, H. sapiens
atctgaaataataaaa

SEQ ID NO: 49642 - DNA, 16 bp, H. sapiens
atctgaaatagtcaaa

SEQ ID NO: 49643 - DNA, 16 bp, H. sapiens
atctgaaatataaaat

SEQ ID NO: 49644 - DNA, 16 bp, H. sapiens
atctgaaatcagaaat

SEQ ID NO: 49645 - DNA, 16 bp, H. sapiens
atctgaaattcacatt

SEQ ID NO: 49646 - DNA, 16 bp, H. sapiens
atctgaaattttaaaa

SEQ ID NO: 49647 - DNA, 16 bp, H. sapiens
atctgaaattttattt

SEQ ID NO: 49648 - DNA, 16 bp, H. sapiens
atctgaaatttttttt

SEQ ID NO: 49649 - DNA, 16 bp, H. sapiens
atctgaagattatgtg

SEQ ID NO: 49650 - DNA, 16 bp, H. sapiens
atctgaaggaaaaaaa

SEQ ID NO: 49651 - DNA, 16 bp, H. sapiens
atctgaataaatattt

SEQ ID NO: 49652 - DNA, 16 bp, H. sapiens
atctgaatacatattt

SEQ ID NO: 49653 - DNA, 16 bp, H. sapiens
atctgaattattttat

SEQ ID NO: 49654 - DNA, 16 bp, H. sapiens
atctgaatttttaaaa

SEQ ID NO: 49655 - DNA, 16 bp, H. sapiens
atctgacaaaattcaa

SEQ ID NO: 49656 - DNA, 17 bp, H. sapiens
atctgacaaagcctttt

SEQ ID NO: 49657 - DNA, 16 bp, H. sapiens
atctgacaaaggactc

SEQ ID NO: 49658 - DNA, 33 bp, H. sapiens
atctgacaaagggctaatatccagaatctacaa

SEQ ID NO: 49659 - DNA, 16 bp, H. sapiens
atctgacaaagtacta

SEQ ID NO: 49660 - DNA, 16 bp, H. sapiens
atctgacaatctctgc

SEQ ID NO: 49661 - DNA, 16 bp, H. sapiens
atctgacctttctctc

SEQ ID NO: 49662 - DNA, 16 bp, H. sapiens
atctgactggtgtcct

SEQ ID NO: 49663 - DNA, 16 bp, H. sapiens
atctgactgtattttt

SEQ ID NO: 49664 - DNA, 16 bp, H. sapiens
atctgagaaatggctt

SEQ ID NO: 49665 - DNA, 16 bp, H. sapiens
atctgagctcactgca

SEQ ID NO: 49666 - DNA, 16 bp, H. sapiens
atctgaggtggaagag

SEQ ID NO: 49667 - DNA, 16 bp, H. sapiens
atctgaggtggagctg

SEQ ID NO: 49668 - DNA, 16 bp, H. sapiens
atctgataaggatcta

SEQ ID NO: 49669 - DNA, 18 bp, H. sapiens
atctgatatggtttggct

SEQ ID NO: 49670 - DNA, 16 bp, H. sapiens
atctgatccccagtgt

SEQ ID NO: 49671 - DNA, 16 bp, H. sapiens
atctgatctgtgacaa

SEQ ID NO: 49672 - DNA, 22 bp, H. sapiens
atctgatctttgacaaacctga

SEQ ID NO: 49673 - DNA, 19 bp, H. sapiens
atctgatctttgacaaact

SEQ ID NO: 49674 - DNA, 16 bp, H. sapiens
atctgatgaaagtgat

SEQ ID NO: 49675 - DNA, 16 bp, H. sapiens
atctgatgactatatg

SEQ ID NO: 49676 - DNA, 16 bp, H. sapiens
atctgattgtggtttt

SEQ ID NO: 49677 - DNA, 16 bp, H. sapiens
atctgattgtttaaaa

SEQ ID NO: 49678 - DNA, 16 bp, H. sapiens
atctgatttaaaaata

SEQ ID NO: 49679 - DNA, 16 bp, H. sapiens
atctgatttatatttt

SEQ ID NO: 49680 - DNA, 16 bp, H. sapiens
atctgattttaaaaat

SEQ ID NO: 49681 - DNA, 16 bp, H. sapiens
atctgatttttaaatg

SEQ ID NO: 49682 - DNA, 16 bp, H. sapiens
atctgatttttgacaa

SEQ ID NO: 49683 - DNA, 16 bp, H. sapiens
atctgcaaaataaaga

SEQ ID NO: 49684 - DNA, 16 bp, H. sapiens
atctgcaaaatgaagg

SEQ ID NO: 49685 - DNA, 16 bp, H. sapiens
atctgcaaaatggaaa

SEQ ID NO: 49686 - DNA, 16 bp, H. sapiens
atctgcaaaatggaga

SEQ ID NO: 49687 - DNA, 16 bp, H. sapiens
atctgcaaaatgggaa

SEQ ID NO: 49688 - DNA, 16 bp, H. sapiens
atctgcaaaatgggga

SEQ ID NO: 49689 - DNA, 16 bp, H. sapiens
atctgcaaaggccctt

SEQ ID NO: 49690 - DNA, 16 bp, H. sapiens
atctgcaaagtctttt

SEQ ID NO: 49691 - DNA, 16 bp, H. sapiens
atctgcaaagtgcaat

SEQ ID NO: 49692 - DNA, 16 bp, H. sapiens
atctgcaaatcctgcc

SEQ ID NO: 49693 - DNA, 16 bp, H. sapiens
atctgcaagaaaaaaa

SEQ ID NO: 49694 - DNA, 16 bp, H. sapiens
atctgcaagtgggtat

SEQ ID NO: 49695 - DNA, 16 bp, H. sapiens
atctgcaattggacat

SEQ ID NO: 49696 - DNA, 16 bp, H. sapiens
atctgcactgccatgt

SEQ ID NO: 49697 - DNA, 16 bp, H. sapiens
atctgcagatgcagaa

SEQ ID NO: 49698 - DNA, 16 bp, H. sapiens
atctgcagcttttcca

SEQ ID NO: 49699 - DNA, 16 bp, H. sapiens
atctgcagtttaacaa

SEQ ID NO: 49700 - DNA, 16 bp, H. sapiens
atctgcatcttaacaa

SEQ ID NO: 49701 - DNA, 16 bp, H. sapiens
atctgcatttaaaaaa

SEQ ID NO: 49702 - DNA, 16 bp, H. sapiens
atctgcatttctaaaa

SEQ ID NO: 49703 - DNA, 16 bp, H. sapiens
atctgcattttagaaa

SEQ ID NO: 49704 - DNA, 16 bp, H. sapiens
atctgccacagctgct

SEQ ID NO: 49705 - DNA, 16 bp, H. sapiens
atctgccaccttggcc

SEQ ID NO: 49706 - DNA, 19 bp, H. sapiens
atctgccagcctcagcctc

SEQ ID NO: 49707 - DNA, 16 bp, H. sapiens
atctgccatcttggaa

SEQ ID NO: 49708 - DNA, 16 bp, H. sapiens
atctgccatgatcaag

SEQ ID NO: 49709 - DNA, 16 bp, H. sapiens
atctgcccaaggtcac

SEQ ID NO: 49710 - DNA, 16 bp, H. sapiens
atctgcccacctcaac

SEQ ID NO: 49711 - DNA, 16 bp, H. sapiens
atctgcccacctcacc

SEQ ID NO: 49712 - DNA, 19 bp, H. sapiens
atctgcccacctcagcctc

SEQ ID NO: 49713 - DNA, 17 bp, H. sapiens
atctgcccaccttggct

SEQ ID NO: 49714 - DNA, 17 bp, H. sapiens
atctgcccacttcggcc

SEQ ID NO: 49715 - DNA, 16 bp, H. sapiens
atctgcccatctcagc

SEQ ID NO: 49716 - DNA, 18 bp, H. sapiens
atctgcccatcttggcct

SEQ ID NO: 49717 - DNA, 16 bp, H. sapiens
atctgcccccatgacc

SEQ ID NO: 49718 - DNA, 17 bp, H. sapiens
atctgcccgcctcagcc

SEQ ID NO: 49719 - DNA, 17 bp, H. sapiens
atctgcccgcctcggct

SEQ ID NO: 49720 - DNA, 16 bp, H. sapiens
atctgccctcaatgtg

SEQ ID NO: 49721 - DNA, 17 bp, H. sapiens
atctgcctaccttggcc

SEQ ID NO: 49722 - DNA, 16 bp, H. sapiens
atctgcctgcatcggc

SEQ ID NO: 49723 - DNA, 16 bp, H. sapiens
atctgcctgccccagc

SEQ ID NO: 49724 - DNA, 16 bp, H. sapiens
atctgcctgcctcagc

SEQ ID NO: 49725 - DNA, 20 bp, H. sapiens
atctgcctgcctcagcctct

SEQ ID NO: 49726 - DNA, 16 bp, H. sapiens
atctgcctgcctccgc

SEQ ID NO: 49727 - DNA, 16 bp, H. sapiens
atctgcctgcctcggg

SEQ ID NO: 49728 - DNA, 16 bp, H. sapiens
atctgcctgcctctgc

SEQ ID NO: 49729 - DNA, 19 bp, H. sapiens
atctgcctgccttggcctc

SEQ ID NO: 49730 - DNA, 16 bp, H. sapiens
atctgcctgccttggt

SEQ ID NO: 49731 - DNA, 16 bp, H. sapiens
atctgcctgggcatgg

SEQ ID NO: 49732 - DNA, 20 bp, H. sapiens
atctgcctgtctcggcctcc

SEQ ID NO: 49733 - DNA, 16 bp, H. sapiens
atctgctatacaacat

SEQ ID NO: 49734 - DNA, 16 bp, H. sapiens
atctgctcacctcagc

SEQ ID NO: 49735 - DNA, 16 bp, H. sapiens
atctgctcagagtgtg

SEQ ID NO: 49736 - DNA, 16 bp, H. sapiens
atctgctccagtgtct

SEQ ID NO: 49737 - DNA, 16 bp, H. sapiens
atctgctcctggggag

SEQ ID NO: 49738 - DNA, 16 bp, H. sapiens
atctgctctcctcagc

SEQ ID NO: 49739 - DNA, 16 bp, H. sapiens
atctgctctgcctgtg

SEQ ID NO: 49740 - DNA, 29 bp, H. sapiens
atctgctgaccttccctccactattgtcc

SEQ ID NO: 49741 - DNA, 16 bp, H. sapiens
atctgctggagccttg

SEQ ID NO: 49742 - DNA, 16 bp, H. sapiens
atctgctggcctcggc

SEQ ID NO: 49743 - DNA, 16 bp, H. sapiens
atctgctggccttggc

SEQ ID NO: 49744 - DNA, 16 bp, H. sapiens
atctgctggtaccttg

SEQ ID NO: 49745 - DNA, 16 bp, H. sapiens
atctgcttcagcctcc

SEQ ID NO: 49746 - DNA, 16 bp, H. sapiens
atctgcttcattcttt

SEQ ID NO: 49747 - DNA, 16 bp, H. sapiens
atctgcttccctgact

SEQ ID NO: 49748 - DNA, 16 bp, H. sapiens
atctgctttattcaaa

SEQ ID NO: 49749 - DNA, 16 bp, H. sapiens
atctgctttctgcctc

SEQ ID NO: 49750 - DNA, 16 bp, H. sapiens
atctgctttctgtctc

SEQ ID NO: 49751 - DNA, 16 bp, H. sapiens
atctggaaaatgggca

SEQ ID NO: 49752 - DNA, 16 bp, H. sapiens
atctggagaacattat

SEQ ID NO: 49753 - DNA, 16 bp, H. sapiens
atctggagatatttcc

SEQ ID NO: 49754 - DNA, 16 bp, H. sapiens
atctggagtcaaagga

SEQ ID NO: 49755 - DNA, 16 bp, H. sapiens
atctggatttgaattc

SEQ ID NO: 49756 - DNA, 16 bp, H. sapiens
atctggccactgggcc

SEQ ID NO: 49757 - DNA, 16 bp, H. sapiens
atctggcccagatact

SEQ ID NO: 49758 - DNA, 16 bp, H. sapiens
atctggccctacccac

SEQ ID NO: 49759 - DNA, 16 bp, H. sapiens
atctggccctggactt

SEQ ID NO: 49760 - DNA, 16 bp, H. sapiens
atctggccctttgcag

SEQ ID NO: 49761 - DNA, 16 bp, H. sapiens
atctggcctacatgca

SEQ ID NO: 49762 - DNA, 16 bp, H. sapiens
atctggctaattttta

SEQ ID NO: 49763 - DNA, 16 bp, H. sapiens
atctggctgattttta

SEQ ID NO: 49764 - DNA, 16 bp, H. sapiens
atctggctgggcacag

SEQ ID NO: 49765 - DNA, 16 bp, H. sapiens
atctggctttatttct

SEQ ID NO: 49766 - DNA, 16 bp, H. sapiens
atctgggaaagtcttt

SEQ ID NO: 49767 - DNA, 16 bp, H. sapiens
atctgggaccacaggc

SEQ ID NO: 49768 - DNA, 16 bp, H. sapiens
atctgggactacaagc

SEQ ID NO: 49769 - DNA, 16 bp, H. sapiens
atctgggagaagaaat

SEQ ID NO: 49770 - DNA, 16 bp, H. sapiens
atctgggagctcctgt

SEQ ID NO: 49771 - DNA, 16 bp, H. sapiens
atctgggaggcagaga

SEQ ID NO: 49772 - DNA, 16 bp, H. sapiens
atctgggcatgctcag

SEQ ID NO: 49773 - DNA, 16 bp, H. sapiens
atctggggaaaaaaaa

SEQ ID NO: 49774 - DNA, 16 bp, H. sapiens
atctggggaaaatatt

SEQ ID NO: 49775 - DNA, 16 bp, H. sapiens
atctgggtgacagagc

SEQ ID NO: 49776 - DNA, 16 bp, H. sapiens
atctgggttggttcca

SEQ ID NO: 49777 - DNA, 16 bp, H. sapiens
atctggttatttaaaa

SEQ ID NO: 49778 - DNA, 16 bp, H. sapiens
atctggttgtttaaaa

SEQ ID NO: 49779 - DNA, 16 bp, H. sapiens
atctgtaaaaatgggg

SEQ ID NO: 49780 - DNA, 16 bp, H. sapiens
atctgtaaaaggaaaa

SEQ ID NO: 49781 - DNA, 16 bp, H. sapiens
atctgtaaaataaaaa

SEQ ID NO: 49782 - DNA, 16 bp, H. sapiens
atctgtaaaatgaagg

SEQ ID NO: 49783 - DNA, 16 bp, H. sapiens
atctgtaaaatgggga

SEQ ID NO: 49784 - DNA, 16 bp, H. sapiens
atctgtaaattatttt

SEQ ID NO: 49785 - DNA, 16 bp, H. sapiens
atctgtaatcccaact

SEQ ID NO: 49786 - DNA, 16 bp, H. sapiens
atctgtaattttcttt

SEQ ID NO: 49787 - DNA, 16 bp, H. sapiens
atctgtacaagaaacc

SEQ ID NO: 49788 - DNA, 16 bp, H. sapiens
atctgtacaatggaat

SEQ ID NO: 49789 - DNA, 16 bp, H. sapiens
atctgtactaaacata

SEQ ID NO: 49790 - DNA, 16 bp, H. sapiens
atctgtactaagaaaa

SEQ ID NO: 49791 - DNA, 16 bp, H. sapiens
atctgtacttttaaaa

SEQ ID NO: 49792 - DNA, 17 bp, H. sapiens
atctgtagtcccagctc

SEQ ID NO: 49793 - DNA, 16 bp, H. sapiens
atctgtatatatacat

SEQ ID NO: 49794 - DNA, 16 bp, H. sapiens
atctgtatattgcttt

SEQ ID NO: 49795 - DNA, 16 bp, H. sapiens
atctgtatgccttttc

SEQ ID NO: 49796 - DNA, 16 bp, H. sapiens
atctgtattagtctgt

SEQ ID NO: 49797 - DNA, 16 bp, H. sapiens
atctgtatttagattt

SEQ ID NO: 49798 - DNA, 16 bp, H. sapiens
atctgtcaatgaacat

SEQ ID NO: 49799 - DNA, 16 bp, H. sapiens
atctgtcactttctcc

SEQ ID NO: 49800 - DNA, 16 bp, H. sapiens
atctgtccacctcggc

SEQ ID NO: 49801 - DNA, 16 bp, H. sapiens
atctgtctccctgtgc

SEQ ID NO: 49802 - DNA, 16 bp, H. sapiens
atctgtctgcagaaac

SEQ ID NO: 49803 - DNA, 16 bp, H. sapiens
atctgtctgcctgtct

SEQ ID NO: 49804 - DNA, 16 bp, H. sapiens
atctgtctttttgatt

SEQ ID NO: 49805 - DNA, 16 bp, H. sapiens
atctgtgaaacaggaa

SEQ ID NO: 49806 - DNA, 16 bp, H. sapiens
atctgtgaaaccatca

SEQ ID NO: 49807 - DNA, 16 bp, H. sapiens
atctgtgaaatgggag

SEQ ID NO: 49808 - DNA, 16 bp, H. sapiens
atctgtgaataatgag

SEQ ID NO: 49809 - DNA, 16 bp, H. sapiens
atctgtgatttaaaaa

SEQ ID NO: 49810 - DNA, 21 bp, H. sapiens
atctgtgcagggggaagcata

SEQ ID NO: 49811 - DNA, 16 bp, H. sapiens
atctgtgtcctcaccc

SEQ ID NO: 49812 - DNA, 16 bp, H. sapiens
atctgtgtctttatat

SEQ ID NO: 49813 - DNA, 16 bp, H. sapiens
atctgtgtggtcctgg

SEQ ID NO: 49814 - DNA, 16 bp, H. sapiens
atctgtgtgtatgtgt

SEQ ID NO: 49815 - DNA, 16 bp, H. sapiens
atctgtgtgtgcgtgt

SEQ ID NO: 49816 - DNA, 16 bp, H. sapiens
atctgtgtgtgtatgt

SEQ ID NO: 49817 - DNA, 16 bp, H. sapiens
atctgtgtgtgtctgt

SEQ ID NO: 49818 - DNA, 16 bp, H. sapiens
atctgtgtgtttgtgt

SEQ ID NO: 49819 - DNA, 16 bp, H. sapiens
atctgtgtttttaaaa

SEQ ID NO: 49820 - DNA, 16 bp, H. sapiens
atctgtgtttttatat

SEQ ID NO: 49821 - DNA, 16 bp, H. sapiens
atctgttaaaattttt

SEQ ID NO: 49822 - DNA, 16 bp, H. sapiens
atctgttagaactaat

SEQ ID NO: 49823 - DNA, 16 bp, H. sapiens
atctgttcatgttttt

SEQ ID NO: 49824 - DNA, 16 bp, H. sapiens
atctgttcttttttga

SEQ ID NO: 49825 - DNA, 16 bp, H. sapiens
atctgttgatggacac

SEQ ID NO: 49826 - DNA, 16 bp, H. sapiens
atctgttggaagaaat

SEQ ID NO: 49827 - DNA, 16 bp, H. sapiens
atctgttgtttcctaa

SEQ ID NO: 49828 - DNA, 16 bp, H. sapiens
atctgttgtttcttaa

SEQ ID NO: 49829 - DNA, 16 bp, H. sapiens
atctgttgttttttga

SEQ ID NO: 49830 - DNA, 16 bp, H. sapiens
atctgtttactctgct

SEQ ID NO: 49831 - DNA, 16 bp, H. sapiens
atctgtttatccattc

SEQ ID NO: 49832 - DNA, 16 bp, H. sapiens
atctgtttatccattt

SEQ ID NO: 49833 - DNA, 16 bp, H. sapiens
atctgtttccttctct

SEQ ID NO: 49834 - DNA, 16 bp, H. sapiens
atctgtttctaatttt

SEQ ID NO: 49835 - DNA, 16 bp, H. sapiens
atctgtttctttgcct

SEQ ID NO: 49836 - DNA, 16 bp, H. sapiens
atctgtttgctgatga

SEQ ID NO: 49837 - DNA, 16 bp, H. sapiens
atcttaaaacaaaatg

SEQ ID NO: 49838 - DNA, 16 bp, H. sapiens
atcttaaaatatatgt

SEQ ID NO: 49839 - DNA, 16 bp, H. sapiens
atcttaaagaactaga

SEQ ID NO: 49840 - DNA, 16 bp, H. sapiens
atcttaaatttcatat

SEQ ID NO: 49841 - DNA, 16 bp, H. sapiens
atcttaagattttttt

SEQ ID NO: 49842 - DNA, 16 bp, H. sapiens
atcttaagtgttctta

SEQ ID NO: 49843 - DNA, 16 bp, H. sapiens
atcttaagttttacaa

SEQ ID NO: 49844 - DNA, 16 bp, H. sapiens
atcttaataccaaaac

SEQ ID NO: 49845 - DNA, 18 bp, H. sapiens
atcttacaaatcaccact

SEQ ID NO: 49846 - DNA, 16 bp, H. sapiens
atcttacataaccata

SEQ ID NO: 49847 - DNA, 16 bp, H. sapiens
atcttacatggcaaca

SEQ ID NO: 49848 - DNA, 16 bp, H. sapiens
atcttacattttaaaa

SEQ ID NO: 49849 - DNA, 16 bp, H. sapiens
atcttacccaaattcc

SEQ ID NO: 49850 - DNA, 16 bp, H. sapiens
atcttagattttaaaa

SEQ ID NO: 49851 - DNA, 29 bp, H. sapiens
atcttagtcaagtaaatgatagaatgaca

SEQ ID NO: 49852 - DNA, 16 bp, H. sapiens
atcttagtgggtgtga

SEQ ID NO: 49853 - DNA, 16 bp, H. sapiens
atcttagttcactgca

SEQ ID NO: 49854 - DNA, 16 bp, H. sapiens
atcttataaaaagaaa

SEQ ID NO: 49855 - DNA, 19 bp, H. sapiens
atcttataaaatggcccca

SEQ ID NO: 49856 - DNA, 16 bp, H. sapiens
atcttatgttgaaatg

SEQ ID NO: 49857 - DNA, 16 bp, H. sapiens
atcttatttggaaatg

SEQ ID NO: 49858 - DNA, 16 bp, H. sapiens
atcttcaaaatatttt

SEQ ID NO: 49859 - DNA, 16 bp, H. sapiens
atcttcaagccaagga

SEQ ID NO: 49860 - DNA, 16 bp, H. sapiens
atcttcacatttcaaa

SEQ ID NO: 49861 - DNA, 16 bp, H. sapiens
atcttcagaacatttt

SEQ ID NO: 49862 - DNA, 16 bp, H. sapiens
atcttcagacaaaaac

SEQ ID NO: 49863 - DNA, 16 bp, H. sapiens
atcttcagagaaaaat

SEQ ID NO: 49864 - DNA, 16 bp, H. sapiens
atcttcagattcaatg

SEQ ID NO: 49865 - DNA, 16 bp, H. sapiens
atcttcagctcactgc

SEQ ID NO: 49866 - DNA, 16 bp, H. sapiens
atcttcagtaattttt

SEQ ID NO: 49867 - DNA, 16 bp, H. sapiens
atcttcagtgatccac

SEQ ID NO: 49868 - DNA, 16 bp, H. sapiens
atcttcataagctgag

SEQ ID NO: 49869 - DNA, 16 bp, H. sapiens
atcttcatcatcacca

SEQ ID NO: 49870 - DNA, 16 bp, H. sapiens
atcttcatcatgaaat

SEQ ID NO: 49871 - DNA, 16 bp, H. sapiens
atcttcatcttcatca

SEQ ID NO: 49872 - DNA, 16 bp, H. sapiens
atcttcatgttcctgg

SEQ ID NO: 49873 - DNA, 16 bp, H. sapiens
atcttcattatttcct

SEQ ID NO: 49874 - DNA, 16 bp, H. sapiens
atcttcattttacagg

SEQ ID NO: 49875 - DNA, 16 bp, H. sapiens
atcttcatttttaaaa

SEQ ID NO: 49876 - DNA, 16 bp, H. sapiens
atcttccagagttttt

SEQ ID NO: 49877 - DNA, 16 bp, H. sapiens
atcttccagcctcagc

SEQ ID NO: 49878 - DNA, 16 bp, H. sapiens
atcttccagccttggc

SEQ ID NO: 49879 - DNA, 16 bp, H. sapiens
atcttccaggtggcca

SEQ ID NO: 49880 - DNA, 16 bp, H. sapiens
atcttccagtcctcca

SEQ ID NO: 49881 - DNA, 16 bp, H. sapiens
atcttcccaccacagc

SEQ ID NO: 49882 - DNA, 16 bp, H. sapiens
atcttcccactgcact

SEQ ID NO: 49883 - DNA, 16 bp, H. sapiens
atcttcccactttggc

SEQ ID NO: 49884 - DNA, 16 bp, H. sapiens
atcttcccatttcctc

SEQ ID NO: 49885 - DNA, 16 bp, H. sapiens
atcttcccctggagtt

SEQ ID NO: 49886 - DNA, 16 bp, H. sapiens
atcttccctacccaga

SEQ ID NO: 49887 - DNA, 16 bp, H. sapiens
atcttccctctgacag

SEQ ID NO: 49888 - DNA, 16 bp, H. sapiens
atcttcctaaaatgca

SEQ ID NO: 49889 - DNA, 16 bp, H. sapiens
atcttcctgatgaatt

SEQ ID NO: 49890 - DNA, 16 bp, H. sapiens
atcttcctgccttggc

SEQ ID NO: 49891 - DNA, 16 bp, H. sapiens
atcttcctgttttctg

SEQ ID NO: 49892 - DNA, 16 bp, H. sapiens
atcttctagaagaaaa

SEQ ID NO: 49893 - DNA, 16 bp, H. sapiens
atcttctatttcttca

SEQ ID NO: 49894 - DNA, 16 bp, H. sapiens
atcttctcagaccaca

SEQ ID NO: 49895 - DNA, 16 bp, H. sapiens
atcttctcatcaaagc

SEQ ID NO: 49896 - DNA, 16 bp, H. sapiens
atcttctcccactctg

SEQ ID NO: 49897 - DNA, 16 bp, H. sapiens
atcttctcctgccttt

SEQ ID NO: 49898 - DNA, 16 bp, H. sapiens
atcttctgatttttca

SEQ ID NO: 49899 - DNA, 16 bp, H. sapiens
atcttctggaattttt

SEQ ID NO: 49900 - DNA, 16 bp, H. sapiens
atcttctgggctcaag

SEQ ID NO: 49901 - DNA, 16 bp, H. sapiens
atcttcttgatgctga

SEQ ID NO: 49902 - DNA, 16 bp, H. sapiens
atcttctttgaagaaa

SEQ ID NO: 49903 - DNA, 16 bp, H. sapiens
atcttctttgatgaga

SEQ ID NO: 49904 - DNA, 16 bp, H. sapiens
atcttctttggtgagg

SEQ ID NO: 49905 - DNA, 16 bp, H. sapiens
atcttcttttctaata

SEQ ID NO: 49906 - DNA, 16 bp, H. sapiens
atcttcttttgaaaaa

SEQ ID NO: 49907 - DNA, 16 bp, H. sapiens
atcttgaaaaagaaaa

SEQ ID NO: 49908 - DNA, 16 bp, H. sapiens
atcttgaaaaataaaa

SEQ ID NO: 49909 - DNA, 16 bp, H. sapiens
atcttgaaaaggaaaa

SEQ ID NO: 49910 - DNA, 16 bp, H. sapiens
atcttgaaattatttt

SEQ ID NO: 49911 - DNA, 16 bp, H. sapiens
atcttgaaattctcaa

SEQ ID NO: 49912 - DNA, 16 bp, H. sapiens
atcttgaaccttccag

SEQ ID NO: 49913 - DNA, 16 bp, H. sapiens
atcttgaaggatgagt

SEQ ID NO: 49914 - DNA, 17 bp, H. sapiens
atcttgaattgtagttt

SEQ ID NO: 49915 - DNA, 16 bp, H. sapiens
atcttgaatttctttg

SEQ ID NO: 49916 - DNA, 16 bp, H. sapiens
atcttgagaaaaatga

SEQ ID NO: 49917 - DNA, 16 bp, H. sapiens
atcttgagaaagaaaa

SEQ ID NO: 49918 - DNA, 16 bp, H. sapiens
atcttgagttaaaaga

SEQ ID NO: 49919 - DNA, 16 bp, H. sapiens
atcttgagttattttt

SEQ ID NO: 49920 - DNA, 16 bp, H. sapiens
atcttgagttgtagct

SEQ ID NO: 49921 - DNA, 16 bp, H. sapiens
atcttgattattgtga

SEQ ID NO: 49922 - DNA, 16 bp, H. sapiens
atcttgattgcttcca

SEQ ID NO: 49923 - DNA, 16 bp, H. sapiens
atcttgattgtggtgg

SEQ ID NO: 49924 - DNA, 16 bp, H. sapiens
atcttgcaaatatttt

SEQ ID NO: 49925 - DNA, 17 bp, H. sapiens
atcttgcaactgcaaaa

SEQ ID NO: 49926 - DNA, 16 bp, H. sapiens
atcttgcataactata

SEQ ID NO: 49927 - DNA, 16 bp, H. sapiens
atcttgccatttgtga

SEQ ID NO: 49928 - DNA, 16 bp, H. sapiens
atcttgcctcactgca

SEQ ID NO: 49929 - DNA, 16 bp, H. sapiens
atcttgcctcagcctc

SEQ ID NO: 49930 - DNA, 16 bp, H. sapiens
atcttgcctttccctt

SEQ ID NO: 49931 - DNA, 16 bp, H. sapiens
atcttgctactgctca

SEQ ID NO: 49932 - DNA, 16 bp, H. sapiens
atcttgctctgtcacc

SEQ ID NO: 49933 - DNA, 16 bp, H. sapiens
atcttgctgctgctga

SEQ ID NO: 49934 - DNA, 16 bp, H. sapiens
atcttgctgtggtttt

SEQ ID NO: 49935 - DNA, 16 bp, H. sapiens
atcttgcttcactgca

SEQ ID NO: 49936 - DNA, 16 bp, H. sapiens
atcttgcttctaacct

SEQ ID NO: 49937 - DNA, 16 bp, H. sapiens
atcttgcttttaaaaa

SEQ ID NO: 49938 - DNA, 16 bp, H. sapiens
atcttggaacagaaaa

SEQ ID NO: 49939 - DNA, 16 bp, H. sapiens
atcttggaagcagagg

SEQ ID NO: 49940 - DNA, 16 bp, H. sapiens
atcttggacaaatcac

SEQ ID NO: 49941 - DNA, 16 bp, H. sapiens
atcttggactctccag

SEQ ID NO: 49942 - DNA, 16 bp, H. sapiens
atcttggagaaattca

SEQ ID NO: 49943 - DNA, 16 bp, H. sapiens
atcttggctattggga

SEQ ID NO: 49944 - DNA, 16 bp, H. sapiens
atcttggctattgtga

SEQ ID NO: 49945 - DNA, 16 bp, H. sapiens
atcttggctcacggca

SEQ ID NO: 49946 - DNA, 16 bp, H. sapiens
atcttggctcactcca

SEQ ID NO: 49947 - DNA, 16 bp, H. sapiens
atcttggctcactgga

SEQ ID NO: 49948 - DNA, 16 bp, H. sapiens
atcttggctcactgta

SEQ ID NO: 49949 - DNA, 16 bp, H. sapiens
atcttggctcattgca

SEQ ID NO: 49950 - DNA, 16 bp, H. sapiens
atcttggctcctccaa

SEQ ID NO: 49951 - DNA, 16 bp, H. sapiens
atcttggctcctcccc

SEQ ID NO: 49952 - DNA, 16 bp, H. sapiens
atcttggctgactgca

SEQ ID NO: 49953 - DNA, 16 bp, H. sapiens
atcttggctttctgca

SEQ ID NO: 49954 - DNA, 16 bp, H. sapiens
atcttggctttgccac

SEQ ID NO: 49955 - DNA, 16 bp, H. sapiens
atcttggggggaaaaa

SEQ ID NO: 49956 - DNA, 16 bp, H. sapiens
atcttgggtatgtctt

SEQ ID NO: 49957 - DNA, 16 bp, H. sapiens
atcttgggtcactgca

SEQ ID NO: 49958 - DNA, 16 bp, H. sapiens
atcttgggttactgca

SEQ ID NO: 49959 - DNA, 16 bp, H. sapiens
atcttggtctgtcacc

SEQ ID NO: 49960 - DNA, 16 bp, H. sapiens
atcttggttatttctt

SEQ ID NO: 49961 - DNA, 16 bp, H. sapiens
atcttggtttcttcca

SEQ ID NO: 49962 - DNA, 16 bp, H. sapiens
atcttgtatatatttt

SEQ ID NO: 49963 - DNA, 16 bp, H. sapiens
atcttgtattttccct

SEQ ID NO: 49964 - DNA, 16 bp, H. sapiens
atcttgtcaaaatgca

SEQ ID NO: 49965 - DNA, 16 bp, H. sapiens
atcttgttttatgtcc

SEQ ID NO: 49966 - DNA, 16 bp, H. sapiens
atctttaaaaaataga

SEQ ID NO: 49967 - DNA, 16 bp, H. sapiens
atctttaaaaatgaat

SEQ ID NO: 49968 - DNA, 16 bp, H. sapiens
atctttaaaatgggaa

SEQ ID NO: 49969 - DNA, 16 bp, H. sapiens
atctttaaatccacct

SEQ ID NO: 49970 - DNA, 16 bp, H. sapiens
atctttaaatttgttt

SEQ ID NO: 49971 - DNA, 16 bp, H. sapiens
atctttaaccaggccc

SEQ ID NO: 49972 - DNA, 16 bp, H. sapiens
atctttaagaaaatat

SEQ ID NO: 49973 - DNA, 16 bp, H. sapiens
atctttaataaagctg

SEQ ID NO: 49974 - DNA, 16 bp, H. sapiens
atctttacagcagcat

SEQ ID NO: 49975 - DNA, 16 bp, H. sapiens
atctttactaaaaatg

SEQ ID NO: 49976 - DNA, 16 bp, H. sapiens
atctttagaaaacccc

SEQ ID NO: 49977 - DNA, 16 bp, H. sapiens
atctttatagcagtgc

SEQ ID NO: 49978 - DNA, 16 bp, H. sapiens
atctttatgcacataa

SEQ ID NO: 49979 - DNA, 16 bp, H. sapiens
atctttattcattgta

SEQ ID NO: 49980 - DNA, 16 bp, H. sapiens
atctttcaaaagcaaa

SEQ ID NO: 49981 - DNA, 16 bp, H. sapiens
atctttcaaaagtgaa

SEQ ID NO: 49982 - DNA, 16 bp, H. sapiens
atctttcagaaataaa

SEQ ID NO: 49983 - DNA, 16 bp, H. sapiens
atctttcatgaaagga

SEQ ID NO: 49984 - DNA, 16 bp, H. sapiens
atctttcattaaaaaa

SEQ ID NO: 49985 - DNA, 16 bp, H. sapiens
atctttccatttcagt

SEQ ID NO: 49986 - DNA, 16 bp, H. sapiens
atctttcccactttct

SEQ ID NO: 49987 - DNA, 16 bp, H. sapiens
atctttcctgttttct

SEQ ID NO: 49988 - DNA, 16 bp, H. sapiens
atctttctaaaataca

SEQ ID NO: 49989 - DNA, 16 bp, H. sapiens
atctttctaaaatgca

SEQ ID NO: 49990 - DNA, 16 bp, H. sapiens
atctttctactttcta

SEQ ID NO: 49991 - DNA, 16 bp, H. sapiens
atctttctgacttttt

SEQ ID NO: 49992 - DNA, 16 bp, H. sapiens
atctttctgcagaaac

SEQ ID NO: 49993 - DNA, 16 bp, H. sapiens
atctttctgtgcctgg

SEQ ID NO: 49994 - DNA, 16 bp, H. sapiens
atctttcttaaatata

SEQ ID NO: 49995 - DNA, 16 bp, H. sapiens
atctttgacaaaaaca

SEQ ID NO: 49996 - DNA, 16 bp, H. sapiens
atctttgatgctgatg

SEQ ID NO: 49997 - DNA, 16 bp, H. sapiens
atctttgccaacattt

SEQ ID NO: 49998 - DNA, 16 bp, H. sapiens
atctttgccagttcct

SEQ ID NO: 49999 - DNA, 16 bp, H. sapiens
atctttgccagtttct

SEQ ID NO: 50000 - DNA, 16 bp, H. sapiens
atctttgcctgtgcct

SEQ ID NO: 50001 - DNA, 16 bp, H. sapiens
atctttgctaaaaata

SEQ ID NO: 50002 - DNA, 16 bp, H. sapiens
atctttgctaattttc

SEQ ID NO: 50003 - DNA, 16 bp, H. sapiens
atctttgctattgtaa

SEQ ID NO: 50004 - DNA, 16 bp, H. sapiens
atctttgctattgtga

SEQ ID NO: 50005 - DNA, 16 bp, H. sapiens
atctttgctggcaggg

SEQ ID NO: 50006 - DNA, 16 bp, H. sapiens
atctttgctgtttcac

SEQ ID NO: 50007 - DNA, 16 bp, H. sapiens
atctttgcttactgca

SEQ ID NO: 50008 - DNA, 16 bp, H. sapiens
atctttggggttttct

SEQ ID NO: 50009 - DNA, 16 bp, H. sapiens
atctttgtaaagaatt

SEQ ID NO: 50010 - DNA, 16 bp, H. sapiens
atctttgtagctatct

SEQ ID NO: 50011 - DNA, 16 bp, H. sapiens
atctttgtcatgaaat

SEQ ID NO: 50012 - DNA, 16 bp, H. sapiens
atctttgtggctttct

SEQ ID NO: 50013 - DNA, 16 bp, H. sapiens
atctttgtggtttttg

SEQ ID NO: 50014 - DNA, 16 bp, H. sapiens
atctttgttgttgttg

SEQ ID NO: 50015 - DNA, 16 bp, H. sapiens
atctttgtttaaacta

SEQ ID NO: 50016 - DNA, 16 bp, H. sapiens
atcttttaaaaaatct

SEQ ID NO: 50017 - DNA, 16 bp, H. sapiens
atcttttaaatacatt

SEQ ID NO: 50018 - DNA, 16 bp, H. sapiens
atcttttaaatgttta

SEQ ID NO: 50019 - DNA, 16 bp, H. sapiens
atcttttatatttctg

SEQ ID NO: 50020 - DNA, 16 bp, H. sapiens
atcttttcataagctt

SEQ ID NO: 50021 - DNA, 16 bp, H. sapiens
atcttttcatatacct

SEQ ID NO: 50022 - DNA, 16 bp, H. sapiens
atcttttcatctcatt

SEQ ID NO: 50023 - DNA, 16 bp, H. sapiens
atcttttcatgatttt

SEQ ID NO: 50024 - DNA, 16 bp, H. sapiens
atcttttcatgtgcct

SEQ ID NO: 50025 - DNA, 16 bp, H. sapiens
atcttttcatgtgctt

SEQ ID NO: 50026 - DNA, 16 bp, H. sapiens
atcttttctccactga

SEQ ID NO: 50027 - DNA, 16 bp, H. sapiens
atcttttcttctgctt

SEQ ID NO: 50028 - DNA, 16 bp, H. sapiens
atcttttgaaaatgtt

SEQ ID NO: 50029 - DNA, 16 bp, H. sapiens
atcttttgaaataatc

SEQ ID NO: 50030 - DNA, 16 bp, H. sapiens
atcttttgagacttat

SEQ ID NO: 50031 - DNA, 16 bp, H. sapiens
atcttttgcctttttg

SEQ ID NO: 50032 - DNA, 16 bp, H. sapiens
atcttttgtatttcag

SEQ ID NO: 50033 - DNA, 16 bp, H. sapiens
atcttttgttagattt

SEQ ID NO: 50034 - DNA, 16 bp, H. sapiens
atctttttaaaaggta

SEQ ID NO: 50035 - DNA, 16 bp, H. sapiens
atctttttaaagattt

SEQ ID NO: 50036 - DNA, 16 bp, H. sapiens
atctttttactttgca

SEQ ID NO: 50037 - DNA, 16 bp, H. sapiens
atctttttcagacaag

SEQ ID NO: 50038 - DNA, 16 bp, H. sapiens
atctttttgtgactgg

SEQ ID NO: 50039 - DNA, 16 bp, H. sapiens
atctttttgtgataaa

SEQ ID NO: 50040 - DNA, 16 bp, H. sapiens
atctttttgtgtatat

SEQ ID NO: 50041 - DNA, 16 bp, H. sapiens
atcttttttgtgtgtg

SEQ ID NO: 50042 - DNA, 16 bp, H. sapiens
atcttttttttgagat

SEQ ID NO: 50043 - DNA, 16 bp, H. sapiens
atgaaaaaaagctaat

SEQ ID NO: 50044 - DNA, 16 bp, H. sapiens
atgaaaaaaaggctca

SEQ ID NO: 50045 - DNA, 16 bp, H. sapiens
atgaaaaaaatcaagg

SEQ ID NO: 50046 - DNA, 16 bp, H. sapiens
atgaaaaaaatctcat

SEQ ID NO: 50047 - DNA, 16 bp, H. sapiens
atgaaaaaaatgcatt

SEQ ID NO: 50048 - DNA, 16 bp, H. sapiens
atgaaaaaacactcaa

SEQ ID NO: 50049 - DNA, 16 bp, H. sapiens
atgaaaaaacatttca

SEQ ID NO: 50050 - DNA, 16 bp, H. sapiens
atgaaaaaagagacat

SEQ ID NO: 50051 - DNA, 16 bp, H. sapiens
atgaaaaaatactgaa

SEQ ID NO: 50052 - DNA, 16 bp, H. sapiens
atgaaaaaatgttcaa

SEQ ID NO: 50053 - DNA, 16 bp, H. sapiens
atgaaaaaattcagaa

SEQ ID NO: 50054 - DNA, 16 bp, H. sapiens
atgaaaaacagaatgg

SEQ ID NO: 50055 - DNA, 16 bp, H. sapiens
atgaaaaacagctcaa

SEQ ID NO: 50056 - DNA, 16 bp, H. sapiens
atgaaaaaccattcaa

SEQ ID NO: 50057 - DNA, 16 bp, H. sapiens
atgaaaaactacctat

SEQ ID NO: 50058 - DNA, 16 bp, H. sapiens
atgaaaaactggaaac

SEQ ID NO: 50059 - DNA, 16 bp, H. sapiens
atgaaaaacttctgga

SEQ ID NO: 50060 - DNA, 16 bp, H. sapiens
atgaaaaagaaatcag

SEQ ID NO: 50061 - DNA, 16 bp, H. sapiens
atgaaaaagaactaat

SEQ ID NO: 50062 - DNA, 16 bp, H. sapiens
atgaaaaagaagacat

SEQ ID NO: 50063 - DNA, 16 bp, H. sapiens
atgaaaaagagaatgt

SEQ ID NO: 50064 - DNA, 16 bp, H. sapiens
atgaaaaagataatac

SEQ ID NO: 50065 - DNA, 16 bp, H. sapiens
atgaaaaagatactta

SEQ ID NO: 50066 - DNA, 16 bp, H. sapiens
atgaaaaagcaaagga

SEQ ID NO: 50067 - DNA, 16 bp, H. sapiens
atgaaaaagctagaaa

SEQ ID NO: 50068 - DNA, 16 bp, H. sapiens
atgaaaaagcttgaaa

SEQ ID NO: 50069 - DNA, 16 bp, H. sapiens
atgaaaaagtcaagaa

SEQ ID NO: 50070 - DNA, 16 bp, H. sapiens
atgaaaaagtcctgga

SEQ ID NO: 50071 - DNA, 16 bp, H. sapiens
atgaaaaagtgctcaa

SEQ ID NO: 50072 - DNA, 16 bp, H. sapiens
atgaaaaagtgctcat

SEQ ID NO: 50073 - DNA, 16 bp, H. sapiens
atgaaaaagttctgga

SEQ ID NO: 50074 - DNA, 16 bp, H. sapiens
atgaaaaataatttgt

SEQ ID NO: 50075 - DNA, 16 bp, H. sapiens
atgaaaaatatgcaaa

SEQ ID NO: 50076 - DNA, 16 bp, H. sapiens
atgaaaaatgagatga

SEQ ID NO: 50077 - DNA, 16 bp, H. sapiens
atgaaaaatggaaaac

SEQ ID NO: 50078 - DNA, 16 bp, H. sapiens
atgaaaaatgtgtttt

SEQ ID NO: 50079 - DNA, 16 bp, H. sapiens
atgaaaacaaaacttt

SEQ ID NO: 50080 - DNA, 16 bp, H. sapiens
atgaaaacaaaattat

SEQ ID NO: 50081 - DNA, 16 bp, H. sapiens
atgaaaacaaagacat

SEQ ID NO: 50082 - DNA, 16 bp, H. sapiens
atgaaaacaaatgaga

SEQ ID NO: 50083 - DNA, 16 bp, H. sapiens
atgaaaacaaatttct

SEQ ID NO: 50084 - DNA, 16 bp, H. sapiens
atgaaaacaacatgaa

SEQ ID NO: 50085 - DNA, 16 bp, H. sapiens
atgaaaacaagacaga

SEQ ID NO: 50086 - DNA, 16 bp, H. sapiens
atgaaaacaagctcaa

SEQ ID NO: 50087 - DNA, 16 bp, H. sapiens
atgaaaacaatgaaat

SEQ ID NO: 50088 - DNA, 16 bp, H. sapiens
atgaaaacaatgtttt

SEQ ID NO: 50089 - DNA, 16 bp, H. sapiens
atgaaaacagattctt

SEQ ID NO: 50090 - DNA, 16 bp, H. sapiens
atgaaaacataaaatt

SEQ ID NO: 50091 - DNA, 16 bp, H. sapiens
atgaaaacatcaaaag

SEQ ID NO: 50092 - DNA, 16 bp, H. sapiens
atgaaaacatgtgaaa

SEQ ID NO: 50093 - DNA, 16 bp, H. sapiens
atgaaaacatttcatt

SEQ ID NO: 50094 - DNA, 16 bp, H. sapiens
atgaaaacattttcat

SEQ ID NO: 50095 - DNA, 16 bp, H. sapiens
atgaaaacattttcta

SEQ ID NO: 50096 - DNA, 16 bp, H. sapiens
atgaaaaccacagtga

SEQ ID NO: 50097 - DNA, 16 bp, H. sapiens
atgaaaaccagaaaga

SEQ ID NO: 50098 - DNA, 16 bp, H. sapiens
atgaaaaccatatgat

SEQ ID NO: 50099 - DNA, 16 bp, H. sapiens
atgaaaacccctgcgg

SEQ ID NO: 50100 - DNA, 16 bp, H. sapiens
atgaaaacctttatga

SEQ ID NO: 50101 - DNA, 16 bp, H. sapiens
atgaaaactaaaattt

SEQ ID NO: 50102 - DNA, 16 bp, H. sapiens
atgaaaactatgaaaa

SEQ ID NO: 50103 - DNA, 16 bp, H. sapiens
atgaaaactggtaata

SEQ ID NO: 50104 - DNA, 16 bp, H. sapiens
atgaaaacttatattt

SEQ ID NO: 50105 - DNA, 16 bp, H. sapiens
atgaaaactttttaat

SEQ ID NO: 50106 - DNA, 16 bp, H. sapiens
atgaaaagaaaatgtg

SEQ ID NO: 50107 - DNA, 16 bp, H. sapiens
atgaaaagaaattcaa

SEQ ID NO: 50108 - DNA, 16 bp, H. sapiens
atgaaaagaagtttaa

SEQ ID NO: 50109 - DNA, 16 bp, H. sapiens
atgaaaagacaaagga

SEQ ID NO: 50110 - DNA, 16 bp, H. sapiens
atgaaaagacaaggaa

SEQ ID NO: 50111 - DNA, 16 bp, H. sapiens
atgaaaagacatttca

SEQ ID NO: 50112 - DNA, 16 bp, H. sapiens
atgaaaagaggtttaa

SEQ ID NO: 50113 - DNA, 16 bp, H. sapiens
atgaaaagatactgaa

SEQ ID NO: 50114 - DNA, 16 bp, H. sapiens
atgaaaagatgtccaa

SEQ ID NO: 50115 - DNA, 16 bp, H. sapiens
atgaaaagatgttgaa

SEQ ID NO: 50116 - DNA, 16 bp, H. sapiens
atgaaaagatgtttaa

SEQ ID NO: 50117 - DNA, 16 bp, H. sapiens
atgaaaaggaaaattt

SEQ ID NO: 50118 - DNA, 16 bp, H. sapiens
atgaaaaggaaggaac

SEQ ID NO: 50119 - DNA, 16 bp, H. sapiens
atgaaaaggaaggctt

SEQ ID NO: 50120 - DNA, 16 bp, H. sapiens
atgaaaaggacacttg

SEQ ID NO: 50121 - DNA, 16 bp, H. sapiens
atgaaaaggagaaatt

SEQ ID NO: 50122 - DNA, 16 bp, H. sapiens
atgaaaaggtgcttaa

SEQ ID NO: 50123 - DNA, 16 bp, H. sapiens
atgaaaagttctgtaa

SEQ ID NO: 50124 - DNA, 16 bp, H. sapiens
atgaaaagtttttaaa

SEQ ID NO: 50125 - DNA, 16 bp, H. sapiens
atgaaaataaatgaca

SEQ ID NO: 50126 - DNA, 16 bp, H. sapiens
atgaaaataacatttt

SEQ ID NO: 50127 - DNA, 16 bp, H. sapiens
atgaaaataatgtttt

SEQ ID NO: 50128 - DNA, 16 bp, H. sapiens
atgaaaataattcaaa

SEQ ID NO: 50129 - DNA, 16 bp, H. sapiens
atgaaaatacaactta

SEQ ID NO: 50130 - DNA, 16 bp, H. sapiens
atgaaaatacaagcca

SEQ ID NO: 50131 - DNA, 16 bp, H. sapiens
atgaaaatatatactt

SEQ ID NO: 50132 - DNA, 16 bp, H. sapiens
atgaaaatatattcaa

SEQ ID NO: 50133 - DNA, 16 bp, H. sapiens
atgaaaatattctgaa

SEQ ID NO: 50134 - DNA, 16 bp, H. sapiens
atgaaaatcaatgcaa

SEQ ID NO: 50135 - DNA, 16 bp, H. sapiens
atgaaaatcctagaag

SEQ ID NO: 50136 - DNA, 16 bp, H. sapiens
atgaaaatctaaaaat

SEQ ID NO: 50137 - DNA, 16 bp, H. sapiens
atgaaaatgaaaactg

SEQ ID NO: 50138 - DNA, 16 bp, H. sapiens
atgaaaatgaaaatca

SEQ ID NO: 50139 - DNA, 16 bp, H. sapiens
atgaaaatgaaacaat

SEQ ID NO: 50140 - DNA, 16 bp, H. sapiens
atgaaaatgaaacaca

SEQ ID NO: 50141 - DNA, 16 bp, H. sapiens
atgaaaatgaaagcaa

SEQ ID NO: 50142 - DNA, 16 bp, H. sapiens
atgaaaatgaaatgtg

SEQ ID NO: 50143 - DNA, 16 bp, H. sapiens
atgaaaatgaagacaa

SEQ ID NO: 50144 - DNA, 16 bp, H. sapiens
atgaaaatgaagatac

SEQ ID NO: 50145 - DNA, 16 bp, H. sapiens
atgaaaatgatgatga

SEQ ID NO: 50146 - DNA, 16 bp, H. sapiens
atgaaaatgattttta

SEQ ID NO: 50147 - DNA, 16 bp, H. sapiens
atgaaaatgcaaagga

SEQ ID NO: 50148 - DNA, 16 bp, H. sapiens
atgaaaatgcaaatca

SEQ ID NO: 50149 - DNA, 16 bp, H. sapiens
atgaaaatgccaaaag

SEQ ID NO: 50150 - DNA, 16 bp, H. sapiens
atgaaaatgctttgta

SEQ ID NO: 50151 - DNA, 16 bp, H. sapiens
atgaaaatggaaaaac

SEQ ID NO: 50152 - DNA, 16 bp, H. sapiens
atgaaaatggaaacaa

SEQ ID NO: 50153 - DNA, 16 bp, H. sapiens
atgaaaatggaaattt

SEQ ID NO: 50154 - DNA, 16 bp, H. sapiens
atgaaaatggagacat

SEQ ID NO: 50155 - DNA, 16 bp, H. sapiens
atgaaaatggcatttt

SEQ ID NO: 50156 - DNA, 16 bp, H. sapiens
atgaaaatggtcatac

SEQ ID NO: 50157 - DNA, 16 bp, H. sapiens
atgaaaatgtacaaat

SEQ ID NO: 50158 - DNA, 16 bp, H. sapiens
atgaaaatgtgctcaa

SEQ ID NO: 50159 - DNA, 16 bp, H. sapiens
atgaaaatgttagaaa

SEQ ID NO: 50160 - DNA, 16 bp, H. sapiens
atgaaaatgttcaaaa

SEQ ID NO: 50161 - DNA, 16 bp, H. sapiens
atgaaaatgttttcaa

SEQ ID NO: 50162 - DNA, 16 bp, H. sapiens
atgaaaatgttttgaa

SEQ ID NO: 50163 - DNA, 16 bp, H. sapiens
atgaaaattacttaaa

SEQ ID NO: 50164 - DNA, 16 bp, H. sapiens
atgaaaattcaaagaa

SEQ ID NO: 50165 - DNA, 16 bp, H. sapiens
atgaaaattgtgtact

SEQ ID NO: 50166 - DNA, 16 bp, H. sapiens
atgaaaatttacattt

SEQ ID NO: 50167 - DNA, 16 bp, H. sapiens
atgaaaatttctccaa

SEQ ID NO: 50168 - DNA, 16 bp, H. sapiens
atgaaaattttatgaa

SEQ ID NO: 50169 - DNA, 16 bp, H. sapiens
atgaaacaaaaaactg

SEQ ID NO: 50170 - DNA, 16 bp, H. sapiens
atgaaacaaaaaatgt

SEQ ID NO: 50171 - DNA, 16 bp, H. sapiens
atgaaacaaaaatact

SEQ ID NO: 50172 - DNA, 16 bp, H. sapiens
atgaaacaaaaatgga

SEQ ID NO: 50173 - DNA, 16 bp, H. sapiens
atgaaacaaaagagga

SEQ ID NO: 50174 - DNA, 16 bp, H. sapiens
atgaaacaaagtttat

SEQ ID NO: 50175 - DNA, 16 bp, H. sapiens
atgaaacaaccagaaa

SEQ ID NO: 50176 - DNA, 16 bp, H. sapiens
atgaaacaagcaaaga

SEQ ID NO: 50177 - DNA, 16 bp, H. sapiens
atgaaacaatacattt

SEQ ID NO: 50178 - DNA, 16 bp, H. sapiens
atgaaacaatgttttt

SEQ ID NO: 50179 - DNA, 16 bp, H. sapiens
atgaaacactgctgaa

SEQ ID NO: 50180 - DNA, 16 bp, H. sapiens
atgaaacagataattt

SEQ ID NO: 50181 - DNA, 16 bp, H. sapiens
atgaaacatattttaa

SEQ ID NO: 50182 - DNA, 16 bp, H. sapiens
atgaaacattctccag

SEQ ID NO: 50183 - DNA, 16 bp, H. sapiens
atgaaacatttaccaa

SEQ ID NO: 50184 - DNA, 16 bp, H. sapiens
atgaaaccaaaaagag

SEQ ID NO: 50185 - DNA, 16 bp, H. sapiens
atgaaaccaggaagaa

SEQ ID NO: 50186 - DNA, 16 bp, H. sapiens
atgaaaccagttcctg

SEQ ID NO: 50187 - DNA, 16 bp, H. sapiens
atgaaaccataaaaga

SEQ ID NO: 50188 - DNA, 16 bp, H. sapiens
atgaaaccccaataaa

SEQ ID NO: 50189 - DNA, 19 bp, H. sapiens
atgaaaccccatctctacc

SEQ ID NO: 50190 - DNA, 24 bp, H. sapiens
atgaaaccccatctctactaaaat

SEQ ID NO: 50191 - DNA, 19 bp, H. sapiens
atgaaaccccgtctctacc

SEQ ID NO: 50192 - DNA, 16 bp, H. sapiens
atgaaactagaaatca

SEQ ID NO: 50193 - DNA, 16 bp, H. sapiens
atgaaactcaaaaaca

SEQ ID NO: 50194 - DNA, 16 bp, H. sapiens
atgaaactggaaacta

SEQ ID NO: 50195 - DNA, 16 bp, H. sapiens
atgaaactggaagaca

SEQ ID NO: 50196 - DNA, 16 bp, H. sapiens
atgaaactggactctt

SEQ ID NO: 50197 - DNA, 16 bp, H. sapiens
atgaaacttgagaaca

SEQ ID NO: 50198 - DNA, 16 bp, H. sapiens
atgaaactttatttat

SEQ ID NO: 50199 - DNA, 16 bp, H. sapiens
atgaaagaaaaaactg

SEQ ID NO: 50200 - DNA, 16 bp, H. sapiens
atgaaagaaaacattt

SEQ ID NO: 50201 - DNA, 16 bp, H. sapiens
atgaaagaaaactttt

SEQ ID NO: 50202 - DNA, 16 bp, H. sapiens
atgaaagaaaatacat

SEQ ID NO: 50203 - DNA, 16 bp, H. sapiens
atgaaagaaatacaca

SEQ ID NO: 50204 - DNA, 16 bp, H. sapiens
atgaaagaaatgcaaa

SEQ ID NO: 50205 - DNA, 16 bp, H. sapiens
atgaaagaacacatca

SEQ ID NO: 50206 - DNA, 16 bp, H. sapiens
atgaaagaagccaatc

SEQ ID NO: 50207 - DNA, 16 bp, H. sapiens
atgaaagacaaggaaa

SEQ ID NO: 50208 - DNA, 16 bp, H. sapiens
atgaaagacaattttt

SEQ ID NO: 50209 - DNA, 16 bp, H. sapiens
atgaaagagcctaaac

SEQ ID NO: 50210 - DNA, 16 bp, H. sapiens
atgaaagatttcagaa

SEQ ID NO: 50211 - DNA, 16 bp, H. sapiens
atgaaagcagagactg

SEQ ID NO: 50212 - DNA, 16 bp, H. sapiens
atgaaagcagggactt

SEQ ID NO: 50213 - DNA, 16 bp, H. sapiens
atgaaagccagaagac

SEQ ID NO: 50214 - DNA, 16 bp, H. sapiens
atgaaaggaaaaacat

SEQ ID NO: 50215 - DNA, 16 bp, H. sapiens
atgaaaggatcaaatt

SEQ ID NO: 50216 - DNA, 16 bp, H. sapiens
atgaaaggatgtttaa

SEQ ID NO: 50217 - DNA, 16 bp, H. sapiens
atgaaagtgagaactc

SEQ ID NO: 50218 - DNA, 16 bp, H. sapiens
atgaaataaaaatgca

SEQ ID NO: 50219 - DNA, 16 bp, H. sapiens
atgaaataaaacattt

SEQ ID NO: 50220 - DNA, 16 bp, H. sapiens
atgaaataaaactaca

SEQ ID NO: 50221 - DNA, 16 bp, H. sapiens
atgaaataaaatgtgt

SEQ ID NO: 50222 - DNA, 16 bp, H. sapiens
atgaaataaatcaaat

SEQ ID NO: 50223 - DNA, 16 bp, H. sapiens
atgaaataatgaattt

SEQ ID NO: 50224 - DNA, 16 bp, H. sapiens
atgaaataatttttct

SEQ ID NO: 50225 - DNA, 16 bp, H. sapiens
atgaaatacaatttaa

SEQ ID NO: 50226 - DNA, 16 bp, H. sapiens
atgaaatacgccctgg

SEQ ID NO: 50227 - DNA, 16 bp, H. sapiens
atgaaatactttaaaa

SEQ ID NO: 50228 - DNA, 16 bp, H. sapiens
atgaaatatcattttc

SEQ ID NO: 50229 - DNA, 16 bp, H. sapiens
atgaaatatgtattta

SEQ ID NO: 50230 - DNA, 16 bp, H. sapiens
atgaaatatttcaaaa

SEQ ID NO: 50231 - DNA, 16 bp, H. sapiens
atgaaatcaaaatgga

SEQ ID NO: 50232 - DNA, 16 bp, H. sapiens
atgaaatcaaggttta

SEQ ID NO: 50233 - DNA, 16 bp, H. sapiens
atgaaatcacaaaaga

SEQ ID NO: 50234 - DNA, 16 bp, H. sapiens
atgaaatcatgttttt

SEQ ID NO: 50235 - DNA, 16 bp, H. sapiens
atgaaatcatttttta

SEQ ID NO: 50236 - DNA, 16 bp, H. sapiens
atgaaatcccaagatg

SEQ ID NO: 50237 - DNA, 17 bp, H. sapiens
atgaaatcccatctcta

SEQ ID NO: 50238 - DNA, 16 bp, H. sapiens
atgaaatcctgtctct

SEQ ID NO: 50239 - DNA, 16 bp, H. sapiens
atgaaatcttgtgcca

SEQ ID NO: 50240 - DNA, 16 bp, H. sapiens
atgaaatctttaaaat

SEQ ID NO: 50241 - DNA, 16 bp, H. sapiens
atgaaatcttttccca

SEQ ID NO: 50242 - DNA, 16 bp, H. sapiens
atgaaatgaaatagtg

SEQ ID NO: 50243 - DNA, 16 bp, H. sapiens
atgaaatgaaatattt

SEQ ID NO: 50244 - DNA, 16 bp, H. sapiens
atgaaatgaagaaaac

SEQ ID NO: 50245 - DNA, 16 bp, H. sapiens
atgaaatgatatttaa

SEQ ID NO: 50246 - DNA, 16 bp, H. sapiens
atgaaatgctgtctct

SEQ ID NO: 50247 - DNA, 16 bp, H. sapiens
atgaaatgctttttca

SEQ ID NO: 50248 - DNA, 16 bp, H. sapiens
atgaaatggaaatgaa

SEQ ID NO: 50249 - DNA, 16 bp, H. sapiens
atgaaatggatgaatt

SEQ ID NO: 50250 - DNA, 16 bp, H. sapiens
atgaaatggtgaaatg

SEQ ID NO: 50251 - DNA, 16 bp, H. sapiens
atgaaatgtacagaat

SEQ ID NO: 50252 - DNA, 16 bp, H. sapiens
atgaaatgtattattt

SEQ ID NO: 50253 - DNA, 16 bp, H. sapiens
atgaaatgtgaaataa

SEQ ID NO: 50254 - DNA, 16 bp, H. sapiens
atgaaatgtgaaatta

SEQ ID NO: 50255 - DNA, 16 bp, H. sapiens
atgaaatgttctggaa

SEQ ID NO: 50256 - DNA, 16 bp, H. sapiens
atgaaattaaaagttg

SEQ ID NO: 50257 - DNA, 16 bp, H. sapiens
atgaaattaaactaga

SEQ ID NO: 50258 - DNA, 16 bp, H. sapiens
atgaaattaagacaga

SEQ ID NO: 50259 - DNA, 16 bp, H. sapiens
atgaaattaaggtaga

SEQ ID NO: 50260 - DNA, 16 bp, H. sapiens
atgaaattatttctct

SEQ ID NO: 50261 - DNA, 16 bp, H. sapiens
atgaaattcaaaatat

SEQ ID NO: 50262 - DNA, 16 bp, H. sapiens
atgaaattcaaagaaa

SEQ ID NO: 50263 - DNA, 16 bp, H. sapiens
atgaaattcaaattta

SEQ ID NO: 50264 - DNA, 16 bp, H. sapiens
atgaaattctaaaaaa

SEQ ID NO: 50265 - DNA, 16 bp, H. sapiens
atgaaattctggaaaa

SEQ ID NO: 50266 - DNA, 16 bp, H. sapiens
atgaaattcttgaagt

SEQ ID NO: 50267 - DNA, 16 bp, H. sapiens
atgaaattgaagagga

SEQ ID NO: 50268 - DNA, 16 bp, H. sapiens
atgaaattgccatttt

SEQ ID NO: 50269 - DNA, 16 bp, H. sapiens
atgaaattgtgaagaa

SEQ ID NO: 50270 - DNA, 16 bp, H. sapiens
atgaaatttaaagtat

SEQ ID NO: 50271 - DNA, 16 bp, H. sapiens
atgaaatttaaagtca

SEQ ID NO: 50272 - DNA, 16 bp, H. sapiens
atgaaatttgtgtttt

SEQ ID NO: 50273 - DNA, 16 bp, H. sapiens
atgaaattttaaaaca

SEQ ID NO: 50274 - DNA, 16 bp, H. sapiens
atgaacaaaattattt

SEQ ID NO: 50275 - DNA, 16 bp, H. sapiens
atgaacaaatacattt

SEQ ID NO: 50276 - DNA, 16 bp, H. sapiens
atgaacaaatgaatga

SEQ ID NO: 50277 - DNA, 16 bp, H. sapiens
atgaacaaattcagta

SEQ ID NO: 50278 - DNA, 16 bp, H. sapiens
atgaacaaattgtggt

SEQ ID NO: 50279 - DNA, 16 bp, H. sapiens
atgaacaagtctagag

SEQ ID NO: 50280 - DNA, 16 bp, H. sapiens
atgaacaatttgaaaa

SEQ ID NO: 50281 - DNA, 16 bp, H. sapiens
atgaacacaatgcagc

SEQ ID NO: 50282 - DNA, 16 bp, H. sapiens
atgaacacagagaggg

SEQ ID NO: 50283 - DNA, 16 bp, H. sapiens
atgaacacttttcaaa

SEQ ID NO: 50284 - DNA, 16 bp, H. sapiens
atgaacagaatataca

SEQ ID NO: 50285 - DNA, 29 bp, H. sapiens
atgaacagacacttctcaaaagaagacat

SEQ ID NO: 50286 - DNA, 18 bp, H. sapiens
atgaacagacacttctcg

SEQ ID NO: 50287 - DNA, 16 bp, H. sapiens
atgaacagatattttt

SEQ ID NO: 50288 - DNA, 16 bp, H. sapiens
atgaacaggcaaccta

SEQ ID NO: 50289 - DNA, 16 bp, H. sapiens
atgaacatacacatac

SEQ ID NO: 50290 - DNA, 16 bp, H. sapiens
atgaacatatgctttt

SEQ ID NO: 50291 - DNA, 18 bp, H. sapiens
atgaacatcaatgtgaaa

SEQ ID NO: 50292 - DNA, 16 bp, H. sapiens
atgaacatctgtgtac

SEQ ID NO: 50293 - DNA, 16 bp, H. sapiens
atgaacatgaatgcaa

SEQ ID NO: 50294 - DNA, 16 bp, H. sapiens
atgaacatgcaagtgc

SEQ ID NO: 50295 - DNA, 16 bp, H. sapiens
atgaacatgccagaag

SEQ ID NO: 50296 - DNA, 16 bp, H. sapiens
atgaacatggcagtgc

SEQ ID NO: 50297 - DNA, 16 bp, H. sapiens
atgaacatttatttct

SEQ ID NO: 50298 - DNA, 16 bp, H. sapiens
atgaacattttaattt

SEQ ID NO: 50299 - DNA, 16 bp, H. sapiens
atgaaccaatattaat

SEQ ID NO: 50300 - DNA, 16 bp, H. sapiens
atgaaccaccacgccc

SEQ ID NO: 50301 - DNA, 16 bp, H. sapiens
atgaaccagaaaacag

SEQ ID NO: 50302 - DNA, 16 bp, H. sapiens
atgaaccaggaaatgg

SEQ ID NO: 50303 - DNA, 16 bp, H. sapiens
atgaaccaggaagcag

SEQ ID NO: 50304 - DNA, 16 bp, H. sapiens
atgaaccagggaggcg

SEQ ID NO: 50305 - DNA, 16 bp, H. sapiens
atgaaccattttaaag

SEQ ID NO: 50306 - DNA, 16 bp, H. sapiens
atgaacctgaaggata

SEQ ID NO: 50307 - DNA, 16 bp, H. sapiens
atgaacctgagaggcg

SEQ ID NO: 50308 - DNA, 16 bp, H. sapiens
atgaacctggccaaca

SEQ ID NO: 50309 - DNA, 16 bp, H. sapiens
atgaaccttgatgaca

SEQ ID NO: 50310 - DNA, 16 bp, H. sapiens
atgaactaaataaaag

SEQ ID NO: 50311 - DNA, 16 bp, H. sapiens
atgaactaatcatttt

SEQ ID NO: 50312 - DNA, 16 bp, H. sapiens
atgaactatctgaaaa

SEQ ID NO: 50313 - DNA, 16 bp, H. sapiens
atgaactcatcctatt

SEQ ID NO: 50314 - DNA, 16 bp, H. sapiens
atgaacttcaaaaaca

SEQ ID NO: 50315 - DNA, 16 bp, H. sapiens
atgaacttggaagaca

SEQ ID NO: 50316 - DNA, 16 bp, H. sapiens
atgaactttaaaaaat

SEQ ID NO: 50317 - DNA, 16 bp, H. sapiens
atgaactttaaagaag

SEQ ID NO: 50318 - DNA, 16 bp, H. sapiens
atgaactttgaaaaaa

SEQ ID NO: 50319 - DNA, 16 bp, H. sapiens
atgaacttttttcttt

SEQ ID NO: 50320 - DNA, 16 bp, H. sapiens
atgaagaaaaaaattc

SEQ ID NO: 50321 - DNA, 16 bp, H. sapiens
atgaagaaaaaactga

SEQ ID NO: 50322 - DNA, 16 bp, H. sapiens
atgaagaaaaacagtg

SEQ ID NO: 50323 - DNA, 16 bp, H. sapiens
atgaagaaaaacattt

SEQ ID NO: 50324 - DNA, 16 bp, H. sapiens
atgaagaaaaatacag

SEQ ID NO: 50325 - DNA, 16 bp, H. sapiens
atgaagaaaacattga

SEQ ID NO: 50326 - DNA, 16 bp, H. sapiens
atgaagaaaactacaa

SEQ ID NO: 50327 - DNA, 16 bp, H. sapiens
atgaagaaaactgaaa

SEQ ID NO: 50328 - DNA, 16 bp, H. sapiens
atgaagaaaagcaaag

SEQ ID NO: 50329 - DNA, 16 bp, H. sapiens
atgaagaaaaggcctt

SEQ ID NO: 50330 - DNA, 16 bp, H. sapiens
atgaagaaaagttgaa

SEQ ID NO: 50331 - DNA, 16 bp, H. sapiens
atgaagaaaatatatg

SEQ ID NO: 50332 - DNA, 16 bp, H. sapiens
atgaagaaaatgaagc

SEQ ID NO: 50333 - DNA, 16 bp, H. sapiens
atgaagaaaatgaggc

SEQ ID NO: 50334 - DNA, 16 bp, H. sapiens
atgaagaaaatgttaa

SEQ ID NO: 50335 - DNA, 16 bp, H. sapiens
atgaagaaacacctga

SEQ ID NO: 50336 - DNA, 16 bp, H. sapiens
atgaagaaacagagaa

SEQ ID NO: 50337 - DNA, 16 bp, H. sapiens
atgaagaaaccaagac

SEQ ID NO: 50338 - DNA, 16 bp, H. sapiens
atgaagaaactaaaac

SEQ ID NO: 50339 - DNA, 16 bp, H. sapiens
atgaagaaactgaagc

SEQ ID NO: 50340 - DNA, 16 bp, H. sapiens
atgaagaaactgaggc

SEQ ID NO: 50341 - DNA, 16 bp, H. sapiens
atgaagaaagaggttt

SEQ ID NO: 50342 - DNA, 16 bp, H. sapiens
atgaagaaagtgaggc

SEQ ID NO: 50343 - DNA, 16 bp, H. sapiens
atgaagaaataaccat

SEQ ID NO: 50344 - DNA, 16 bp, H. sapiens
atgaagaaatactcaa

SEQ ID NO: 50345 - DNA, 16 bp, H. sapiens
atgaagaaatgcctga

SEQ ID NO: 50346 - DNA, 16 bp, H. sapiens
atgaagaaatggaaat

SEQ ID NO: 50347 - DNA, 16 bp, H. sapiens
atgaagaaatgttgaa

SEQ ID NO: 50348 - DNA, 16 bp, H. sapiens
atgaagaaattaatga

SEQ ID NO: 50349 - DNA, 16 bp, H. sapiens
atgaagaaattgaagt

SEQ ID NO: 50350 - DNA, 16 bp, H. sapiens
atgaagaaattgaggc

SEQ ID NO: 50351 - DNA, 16 bp, H. sapiens
atgaagaactacctga

SEQ ID NO: 50352 - DNA, 16 bp, H. sapiens
atgaagaactttatga

SEQ ID NO: 50353 - DNA, 16 bp, H. sapiens
atgaagaactttctca

SEQ ID NO: 50354 - DNA, 16 bp, H. sapiens
atgaagaagaaaacat

SEQ ID NO: 50355 - DNA, 16 bp, H. sapiens
atgaagaagacagaaa

SEQ ID NO: 50356 - DNA, 16 bp, H. sapiens
atgaagaagagctggt

SEQ ID NO: 50357 - DNA, 16 bp, H. sapiens
atgaagaagaggatga

SEQ ID NO: 50358 - DNA, 16 bp, H. sapiens
atgaagaagctgaagc

SEQ ID NO: 50359 - DNA, 16 bp, H. sapiens
atgaagaagtaaaact

SEQ ID NO: 50360 - DNA, 16 bp, H. sapiens
atgaagaagtcaaatt

SEQ ID NO: 50361 - DNA, 16 bp, H. sapiens
atgaagaatatcattg

SEQ ID NO: 50362 - DNA, 16 bp, H. sapiens
atgaagaatttcaaga

SEQ ID NO: 50363 - DNA, 16 bp, H. sapiens
atgaagaattttattt

SEQ ID NO: 50364 - DNA, 16 bp, H. sapiens
atgaagacaaagacaa

SEQ ID NO: 50365 - DNA, 16 bp, H. sapiens
atgaagacaaggatga

SEQ ID NO: 50366 - DNA, 16 bp, H. sapiens
atgaagacacagggag

SEQ ID NO: 50367 - DNA, 16 bp, H. sapiens
atgaagacagaaaata

SEQ ID NO: 50368 - DNA, 16 bp, H. sapiens
atgaagacagaaagta

SEQ ID NO: 50369 - DNA, 16 bp, H. sapiens
atgaagacatagaaaa

SEQ ID NO: 50370 - DNA, 16 bp, H. sapiens
atgaagacattaagaa

SEQ ID NO: 50371 - DNA, 16 bp, H. sapiens
atgaagacccaaagat

SEQ ID NO: 50372 - DNA, 16 bp, H. sapiens
atgaagactacaataa

SEQ ID NO: 50373 - DNA, 16 bp, H. sapiens
atgaagactatagtta

SEQ ID NO: 50374 - DNA, 16 bp, H. sapiens
atgaagacttcattgg

SEQ ID NO: 50375 - DNA, 16 bp, H. sapiens
atgaagacttggccca

SEQ ID NO: 50376 - DNA, 16 bp, H. sapiens
atgaagacttttatga

SEQ ID NO: 50377 - DNA, 16 bp, H. sapiens
atgaagagaaacattt

SEQ ID NO: 50378 - DNA, 16 bp, H. sapiens
atgaagagatatttca

SEQ ID NO: 50379 - DNA, 16 bp, H. sapiens
atgaagagatttatta

SEQ ID NO: 50380 - DNA, 16 bp, H. sapiens
atgaagagcatttttt

SEQ ID NO: 50381 - DNA, 16 bp, H. sapiens
atgaagaggatatttc

SEQ ID NO: 50382 - DNA, 16 bp, H. sapiens
atgaagaggcatgaag

SEQ ID NO: 50383 - DNA, 16 bp, H. sapiens
atgaagaggtgttgaa

SEQ ID NO: 50384 - DNA, 16 bp, H. sapiens
atgaagatcattgaga

SEQ ID NO: 50385 - DNA, 16 bp, H. sapiens
atgaagatgaaaatat

SEQ ID NO: 50386 - DNA, 16 bp, H. sapiens
atgaagatgaaaatga

SEQ ID NO: 50387 - DNA, 16 bp, H. sapiens
atgaagatgagaaact

SEQ ID NO: 50388 - DNA, 16 bp, H. sapiens
atgaagatgatgataa

SEQ ID NO: 50389 - DNA, 16 bp, H. sapiens
atgaagatgatggtga

SEQ ID NO: 50390 - DNA, 16 bp, H. sapiens
atgaagatgctgtgaa

SEQ ID NO: 50391 - DNA, 16 bp, H. sapiens
atgaagatggcttctt

SEQ ID NO: 50392 - DNA, 16 bp, H. sapiens
atgaagatttcatgga

SEQ ID NO: 50393 - DNA, 18 bp, H. sapiens
atgaagatttcatggaca

SEQ ID NO: 50394 - DNA, 16 bp, H. sapiens
atgaagattttttaaa

SEQ ID NO: 50395 - DNA, 16 bp, H. sapiens
atgaagatttttttcc

SEQ ID NO: 50396 - DNA, 16 bp, H. sapiens
atgaagcaaaaacaga

SEQ ID NO: 50397 - DNA, 16 bp, H. sapiens
atgaagcaacaaaaga

SEQ ID NO: 50398 - DNA, 16 bp, H. sapiens
atgaagcagaagaaag

SEQ ID NO: 50399 - DNA, 17 bp, H. sapiens
atgaagcagttacagaa

SEQ ID NO: 50400 - DNA, 16 bp, H. sapiens
atgaagccagaagcca

SEQ ID NO: 50401 - DNA, 16 bp, H. sapiens
atgaagccctgggctt

SEQ ID NO: 50402 - DNA, 18 bp, H. sapiens
atgaagcgatgttgaatt

SEQ ID NO: 50403 - DNA, 16 bp, H. sapiens
atgaagctaaaataaa

SEQ ID NO: 50404 - DNA, 16 bp, H. sapiens
atgaagctcagagagg

SEQ ID NO: 50405 - DNA, 16 bp, H. sapiens
atgaagctggaaagca

SEQ ID NO: 50406 - DNA, 17 bp, H. sapiens
atgaagctggaagccat

SEQ ID NO: 50407 - DNA, 16 bp, H. sapiens
atgaagctggaagcta

SEQ ID NO: 50408 - DNA, 16 bp, H. sapiens
atgaagctggagacca

SEQ ID NO: 50409 - DNA, 16 bp, H. sapiens
atgaagctgtggaccc

SEQ ID NO: 50410 - DNA, 16 bp, H. sapiens
atgaagcttcactggc

SEQ ID NO: 50411 - DNA, 16 bp, H. sapiens
atgaagcttttcccct

SEQ ID NO: 50412 - DNA, 16 bp, H. sapiens
atgaagcttttttttt

SEQ ID NO: 50413 - DNA, 16 bp, H. sapiens
atgaaggaaaaaacat

SEQ ID NO: 50414 - DNA, 16 bp, H. sapiens
atgaaggaaaaatgtt

SEQ ID NO: 50415 - DNA, 16 bp, H. sapiens
atgaaggaaaagcaaa

SEQ ID NO: 50416 - DNA, 16 bp, H. sapiens
atgaaggaaaatatgt

SEQ ID NO: 50417 - DNA, 16 bp, H. sapiens
atgaaggacaaaaacc

SEQ ID NO: 50418 - DNA, 16 bp, H. sapiens
atgaaggagaaacaaa

SEQ ID NO: 50419 - DNA, 16 bp, H. sapiens
atgaaggaggaacttc

SEQ ID NO: 50420 - DNA, 16 bp, H. sapiens
atgaaggatattggtc

SEQ ID NO: 50421 - DNA, 16 bp, H. sapiens
atgaaggcaccagcag

SEQ ID NO: 50422 - DNA, 16 bp, H. sapiens
atgaaggcagaaatga

SEQ ID NO: 50423 - DNA, 16 bp, H. sapiens
atgaaggccttttaaa

SEQ ID NO: 50424 - DNA, 16 bp, H. sapiens
atgaaggctctgctct

SEQ ID NO: 50425 - DNA, 16 bp, H. sapiens
atgaagggacattttg

SEQ ID NO: 50426 - DNA, 16 bp, H. sapiens
atgaaggggaatatca

SEQ ID NO: 50427 - DNA, 16 bp, H. sapiens
atgaaggggaggccag

SEQ ID NO: 50428 - DNA, 16 bp, H. sapiens
atgaagggtttttttt

SEQ ID NO: 50429 - DNA, 16 bp, H. sapiens
atgaaggtgccagcag

SEQ ID NO: 50430 - DNA, 16 bp, H. sapiens
atgaaggtgcttttct

SEQ ID NO: 50431 - DNA, 16 bp, H. sapiens
atgaaggtgttttttg

SEQ ID NO: 50432 - DNA, 16 bp, H. sapiens
atgaaggttaaataaa

SEQ ID NO: 50433 - DNA, 16 bp, H. sapiens
atgaagtaacagaaga

SEQ ID NO: 50434 - DNA, 16 bp, H. sapiens
atgaagtactgatgca

SEQ ID NO: 50435 - DNA, 16 bp, H. sapiens
atgaagtcaaatttat

SEQ ID NO: 50436 - DNA, 16 bp, H. sapiens
atgaagtccaatttat

SEQ ID NO: 50437 - DNA, 16 bp, H. sapiens
atgaagtctcactgtg

SEQ ID NO: 50438 - DNA, 17 bp, H. sapiens
atgaagtcttgctgtgt

SEQ ID NO: 50439 - DNA, 16 bp, H. sapiens
atgaagtggaagaaag

SEQ ID NO: 50440 - DNA, 16 bp, H. sapiens
atgaagtgtttggttt

SEQ ID NO: 50441 - DNA, 16 bp, H. sapiens
atgaagttattttaaa

SEQ ID NO: 50442 - DNA, 16 bp, H. sapiens
atgaagttcaagaaca

SEQ ID NO: 50443 - DNA, 16 bp, H. sapiens
atgaagttggaagcca

SEQ ID NO: 50444 - DNA, 16 bp, H. sapiens
atgaagtttaagaaaa

SEQ ID NO: 50445 - DNA, 16 bp, H. sapiens
atgaagttttaaaaca

SEQ ID NO: 50446 - DNA, 16 bp, H. sapiens
atgaagttttcctttt

SEQ ID NO: 50447 - DNA, 16 bp, H. sapiens
atgaagtttttaaaaa

SEQ ID NO: 50448 - DNA, 16 bp, H. sapiens
atgaagtttttttaaa

SEQ ID NO: 50449 - DNA, 16 bp, H. sapiens
atgaataaaaatacat

SEQ ID NO: 50450 - DNA, 16 bp, H. sapiens
atgaataaaacagaag

SEQ ID NO: 50451 - DNA, 16 bp, H. sapiens
atgaataaacaaaatg

SEQ ID NO: 50452 - DNA, 16 bp, H. sapiens
atgaataaacaaacta

SEQ ID NO: 50453 - DNA, 16 bp, H. sapiens
atgaataaataaagca

SEQ ID NO: 50454 - DNA, 16 bp, H. sapiens
atgaataaatctcaaa

SEQ ID NO: 50455 - DNA, 16 bp, H. sapiens
atgaataaatcttaaa

SEQ ID NO: 50456 - DNA, 16 bp, H. sapiens
atgaataaatgaatga

SEQ ID NO: 50457 - DNA, 16 bp, H. sapiens
atgaataaatgagtga

SEQ ID NO: 50458 - DNA, 16 bp, H. sapiens
atgaataacatttaaa

SEQ ID NO: 50459 - DNA, 16 bp, H. sapiens
atgaataatatcacaa

SEQ ID NO: 50460 - DNA, 16 bp, H. sapiens
atgaataattttgcta

SEQ ID NO: 50461 - DNA, 16 bp, H. sapiens
atgaatacagaaaatg

SEQ ID NO: 50462 - DNA, 16 bp, H. sapiens
atgaatacataaaatt

SEQ ID NO: 50463 - DNA, 16 bp, H. sapiens
atgaatacattttctt

SEQ ID NO: 50464 - DNA, 16 bp, H. sapiens
atgaatacatttttag

SEQ ID NO: 50465 - DNA, 16 bp, H. sapiens
atgaatactaaaggac

SEQ ID NO: 50466 - DNA, 16 bp, H. sapiens
atgaatagaaatttat

SEQ ID NO: 50467 - DNA, 16 bp, H. sapiens
atgaatagaatagtac

SEQ ID NO: 50468 - DNA, 16 bp, H. sapiens
atgaatagaccacatt

SEQ ID NO: 50469 - DNA, 16 bp, H. sapiens
atgaatagattaatgc

SEQ ID NO: 50470 - DNA, 16 bp, H. sapiens
atgaatataccacagt

SEQ ID NO: 50471 - DNA, 16 bp, H. sapiens
atgaatataccatatt

SEQ ID NO: 50472 - DNA, 16 bp, H. sapiens
atgaatatataaacaa

SEQ ID NO: 50473 - DNA, 16 bp, H. sapiens
atgaatatatatacat

SEQ ID NO: 50474 - DNA, 16 bp, H. sapiens
atgaatatatgaaaga

SEQ ID NO: 50475 - DNA, 16 bp, H. sapiens
atgaatatatttttag

SEQ ID NO: 50476 - DNA, 16 bp, H. sapiens
atgaatatcaagcaga

SEQ ID NO: 50477 - DNA, 16 bp, H. sapiens
atgaatatcattaaaa

SEQ ID NO: 50478 - DNA, 16 bp, H. sapiens
atgaatatgaatatga

SEQ ID NO: 50479 - DNA, 16 bp, H. sapiens
atgaatatggaatatc

SEQ ID NO: 50480 - DNA, 16 bp, H. sapiens
atgaatatgtgtgtgt

SEQ ID NO: 50481 - DNA, 16 bp, H. sapiens
atgaatatgttacctt

SEQ ID NO: 50482 - DNA, 16 bp, H. sapiens
atgaatattcatgaaa

SEQ ID NO: 50483 - DNA, 16 bp, H. sapiens
atgaatatttaaaatg

SEQ ID NO: 50484 - DNA, 16 bp, H. sapiens
atgaatatttcatttt

SEQ ID NO: 50485 - DNA, 16 bp, H. sapiens
atgaatattttacttt

SEQ ID NO: 50486 - DNA, 16 bp, H. sapiens
atgaatattttcatat

SEQ ID NO: 50487 - DNA, 16 bp, H. sapiens
atgaatcacatttttt

SEQ ID NO: 50488 - DNA, 16 bp, H. sapiens
atgaatcacgaggtca

SEQ ID NO: 50489 - DNA, 16 bp, H. sapiens
atgaatccacacataa

SEQ ID NO: 50490 - DNA, 16 bp, H. sapiens
atgaatccaggaggtg

SEQ ID NO: 50491 - DNA, 16 bp, H. sapiens
atgaatccatacatca

SEQ ID NO: 50492 - DNA, 16 bp, H. sapiens
atgaatccatctggtc

SEQ ID NO: 50493 - DNA, 16 bp, H. sapiens
atgaatcctggctatg

SEQ ID NO: 50494 - DNA, 16 bp, H. sapiens
atgaatctcaaaaaca

SEQ ID NO: 50495 - DNA, 16 bp, H. sapiens
atgaatctttttcttt

SEQ ID NO: 50496 - DNA, 16 bp, H. sapiens
atgaatgaaataattt

SEQ ID NO: 50497 - DNA, 16 bp, H. sapiens
atgaatgaacaaagaa

SEQ ID NO: 50498 - DNA, 16 bp, H. sapiens
atgaatgaagaaaatg

SEQ ID NO: 50499 - DNA, 16 bp, H. sapiens
atgaatgaataaaagt

SEQ ID NO: 50500 - DNA, 16 bp, H. sapiens
atgaatgaatacattg

SEQ ID NO: 50501 - DNA, 16 bp, H. sapiens
atgaatgaatcagaaa

SEQ ID NO: 50502 - DNA, 16 bp, H. sapiens
atgaatgaatctcaaa

SEQ ID NO: 50503 - DNA, 16 bp, H. sapiens
atgaatgaatgaatgg

SEQ ID NO: 50504 - DNA, 16 bp, H. sapiens
atgaatgaatgagagt

SEQ ID NO: 50505 - DNA, 16 bp, H. sapiens
atgaatgaatgcattt

SEQ ID NO: 50506 - DNA, 16 bp, H. sapiens
atgaatgagaaaacaa

SEQ ID NO: 50507 - DNA, 16 bp, H. sapiens
atgaatgagaaaatga

SEQ ID NO: 50508 - DNA, 16 bp, H. sapiens
atgaatgatagactgg

SEQ ID NO: 50509 - DNA, 16 bp, H. sapiens
atgaatgatctcattt

SEQ ID NO: 50510 - DNA, 16 bp, H. sapiens
atgaatgcacatatca

SEQ ID NO: 50511 - DNA, 16 bp, H. sapiens
atgaatgcaggaggaa

SEQ ID NO: 50512 - DNA, 16 bp, H. sapiens
atgaatgcataaaata

SEQ ID NO: 50513 - DNA, 16 bp, H. sapiens
atgaatgcataaaatg

SEQ ID NO: 50514 - DNA, 16 bp, H. sapiens
atgaatgcatacatca

SEQ ID NO: 50515 - DNA, 16 bp, H. sapiens
atgaatgcatggatgg

SEQ ID NO: 50516 - DNA, 16 bp, H. sapiens
atgaatggaattagtg

SEQ ID NO: 50517 - DNA, 16 bp, H. sapiens
atgaatggacaaatga

SEQ ID NO: 50518 - DNA, 16 bp, H. sapiens
atgaatggacagatgg

SEQ ID NO: 50519 - DNA, 16 bp, H. sapiens
atgaatggagcttaca

SEQ ID NO: 50520 - DNA, 16 bp, H. sapiens
atgaatggatgaagaa

SEQ ID NO: 50521 - DNA, 16 bp, H. sapiens
atgaatggatgaatga

SEQ ID NO: 50522 - DNA, 16 bp, H. sapiens
atgaatggcaaagaaa

SEQ ID NO: 50523 - DNA, 16 bp, H. sapiens
atgaatggcttggcac

SEQ ID NO: 50524 - DNA, 16 bp, H. sapiens
atgaatgggatgagtg

SEQ ID NO: 50525 - DNA, 16 bp, H. sapiens
atgaatgggtggatga

SEQ ID NO: 50526 - DNA, 16 bp, H. sapiens
atgaatgtaagtttcc

SEQ ID NO: 50527 - DNA, 16 bp, H. sapiens
atgaatgtaatgaatg

SEQ ID NO: 50528 - DNA, 16 bp, H. sapiens
atgaatgtgaaggcct

SEQ ID NO: 50529 - DNA, 16 bp, H. sapiens
atgaatgtttgttaaa

SEQ ID NO: 50530 - DNA, 16 bp, H. sapiens
atgaattaaagaatga

SEQ ID NO: 50531 - DNA, 16 bp, H. sapiens
atgaattaagacttta

SEQ ID NO: 50532 - DNA, 16 bp, H. sapiens
atgaattaataaacat

SEQ ID NO: 50533 - DNA, 16 bp, H. sapiens
atgaattaataaatgt

SEQ ID NO: 50534 - DNA, 16 bp, H. sapiens
atgaattacatctcaa

SEQ ID NO: 50535 - DNA, 16 bp, H. sapiens
atgaattactttttct

SEQ ID NO: 50536 - DNA, 16 bp, H. sapiens
atgaattagaaattat

SEQ ID NO: 50537 - DNA, 16 bp, H. sapiens
atgaattatatctcaa

SEQ ID NO: 50538 - DNA, 16 bp, H. sapiens
atgaattcaacaaagt

SEQ ID NO: 50539 - DNA, 16 bp, H. sapiens
atgaattcagtaaact

SEQ ID NO: 50540 - DNA, 16 bp, H. sapiens
atgaattcatagggaa

SEQ ID NO: 50541 - DNA, 16 bp, H. sapiens
atgaattcattcaaca

SEQ ID NO: 50542 - DNA, 16 bp, H. sapiens
atgaattcattctttt

SEQ ID NO: 50543 - DNA, 16 bp, H. sapiens
atgaattctttgccca

SEQ ID NO: 50544 - DNA, 16 bp, H. sapiens
atgaattcttttttat

SEQ ID NO: 50545 - DNA, 16 bp, H. sapiens
atgaattggaagaatt

SEQ ID NO: 50546 - DNA, 16 bp, H. sapiens
atgaattgggcagcac

SEQ ID NO: 50547 - DNA, 16 bp, H. sapiens
atgaattgttctttgc

SEQ ID NO: 50548 - DNA, 16 bp, H. sapiens
atgaatttaaaaatgt

SEQ ID NO: 50549 - DNA, 16 bp, H. sapiens
atgaatttcaggattt

SEQ ID NO: 50550 - DNA, 16 bp, H. sapiens
atgaatttcatttatt

SEQ ID NO: 50551 - DNA, 16 bp, H. sapiens
atgaatttgaagacat

SEQ ID NO: 50552 - DNA, 16 bp, H. sapiens
atgaatttggaaatat

SEQ ID NO: 50553 - DNA, 16 bp, H. sapiens
atgaatttgggggtga

SEQ ID NO: 50554 - DNA, 16 bp, H. sapiens
atgaattttaaaatct

SEQ ID NO: 50555 - DNA, 16 bp, H. sapiens
atgaattttaaagtat

SEQ ID NO: 50556 - DNA, 16 bp, H. sapiens
atgaattttaccattc

SEQ ID NO: 50557 - DNA, 16 bp, H. sapiens
atgaattttagaatag

SEQ ID NO: 50558 - DNA, 16 bp, H. sapiens
atgaattttaggactg

SEQ ID NO: 50559 - DNA, 16 bp, H. sapiens
atgaattttcatattt

SEQ ID NO: 50560 - DNA, 16 bp, H. sapiens
atgaattttccagttt

SEQ ID NO: 50561 - DNA, 16 bp, H. sapiens
atgaattttcttttct

SEQ ID NO: 50562 - DNA, 16 bp, H. sapiens
atgaatttttacaaat

SEQ ID NO: 50563 - DNA, 16 bp, H. sapiens
atgaatttttacattt

SEQ ID NO: 50564 - DNA, 16 bp, H. sapiens
atgaattttttatttc

SEQ ID NO: 50565 - DNA, 16 bp, H. sapiens
atgacaaaaaccacac

SEQ ID NO: 50566 - DNA, 16 bp, H. sapiens
atgacaaaaagtttta

SEQ ID NO: 50567 - DNA, 16 bp, H. sapiens
atgacaaaaatatttt

SEQ ID NO: 50568 - DNA, 16 bp, H. sapiens
atgacaaaaccctgtc

SEQ ID NO: 50569 - DNA, 16 bp, H. sapiens
atgacaaaattatgga

SEQ ID NO: 50570 - DNA, 16 bp, H. sapiens
atgacaaaattgaggc

SEQ ID NO: 50571 - DNA, 16 bp, H. sapiens
atgacaaagaggatat

SEQ ID NO: 50572 - DNA, 16 bp, H. sapiens
atgacaaagatgacaa

SEQ ID NO: 50573 - DNA, 16 bp, H. sapiens
atgacaaagatgatga

SEQ ID NO: 50574 - DNA, 16 bp, H. sapiens
atgacaaagggaacat

SEQ ID NO: 50575 - DNA, 16 bp, H. sapiens
atgacaaaggggtcaa

SEQ ID NO: 50576 - DNA, 16 bp, H. sapiens
atgacaaatatatata

SEQ ID NO: 50577 - DNA, 16 bp, H. sapiens
atgacaacaaagaatt

SEQ ID NO: 50578 - DNA, 16 bp, H. sapiens
atgacaacaacaacaa

SEQ ID NO: 50579 - DNA, 16 bp, H. sapiens
atgacaacatggatga

SEQ ID NO: 50580 - DNA, 16 bp, H. sapiens
atgacaaggatgaaga

SEQ ID NO: 50581 - DNA, 16 bp, H. sapiens
atgacaatacagttat

SEQ ID NO: 50582 - DNA, 16 bp, H. sapiens
atgacaatagtgacac

SEQ ID NO: 50583 - DNA, 16 bp, H. sapiens
atgacaatgaaaatga

SEQ ID NO: 50584 - DNA, 16 bp, H. sapiens
atgacaatgataatga

SEQ ID NO: 50585 - DNA, 16 bp, H. sapiens
atgacaatgatgatga

SEQ ID NO: 50586 - DNA, 16 bp, H. sapiens
atgacacaaatggaaa

SEQ ID NO: 50587 - DNA, 16 bp, H. sapiens
atgacacactggggcc

SEQ ID NO: 50588 - DNA, 16 bp, H. sapiens
atgacacagccctcag

SEQ ID NO: 50589 - DNA, 16 bp, H. sapiens
atgacacatgtatacc

SEQ ID NO: 50590 - DNA, 16 bp, H. sapiens
atgacaccaaaagcat

SEQ ID NO: 50591 - DNA, 16 bp, H. sapiens
atgacagaaagaaaag

SEQ ID NO: 50592 - DNA, 16 bp, H. sapiens
atgacagaaatataat

SEQ ID NO: 50593 - DNA, 16 bp, H. sapiens
atgacagcatcaaatt

SEQ ID NO: 50594 - DNA, 16 bp, H. sapiens
atgacagcattattca

SEQ ID NO: 50595 - DNA, 30 bp, H. sapiens
atgacaggatcaaattcacacataacaata

SEQ ID NO: 50596 - DNA, 34 bp, H. sapiens
atgacaggatcaaattcacacataacaatattaa

SEQ ID NO: 50597 - DNA, 16 bp, H. sapiens
atgacagtgatgatga

SEQ ID NO: 50598 - DNA, 16 bp, H. sapiens
atgacagtgatggtga

SEQ ID NO: 50599 - DNA, 16 bp, H. sapiens
atgacagtgtgagact

SEQ ID NO: 50600 - DNA, 16 bp, H. sapiens
atgacagttttttttt

SEQ ID NO: 50601 - DNA, 16 bp, H. sapiens
atgacataaaatttac

SEQ ID NO: 50602 - DNA, 16 bp, H. sapiens
atgacatcaaaggcac

SEQ ID NO: 50603 - DNA, 16 bp, H. sapiens
atgacatgatctcggc

SEQ ID NO: 50604 - DNA, 16 bp, H. sapiens
atgacatgatgttata

SEQ ID NO: 50605 - DNA, 16 bp, H. sapiens
atgacatggtgaaaat

SEQ ID NO: 50606 - DNA, 16 bp, H. sapiens
atgacatgtgggaatt

SEQ ID NO: 50607 - DNA, 16 bp, H. sapiens
atgacattaaaaaaat

SEQ ID NO: 50608 - DNA, 16 bp, H. sapiens
atgacattctgaaaag

SEQ ID NO: 50609 - DNA, 16 bp, H. sapiens
atgacattctggaaaa

SEQ ID NO: 50610 - DNA, 16 bp, H. sapiens
atgacattgataattt

SEQ ID NO: 50611 - DNA, 16 bp, H. sapiens
atgacatttaaaaaaa

SEQ ID NO: 50612 - DNA, 16 bp, H. sapiens
atgacatttaaaaata

SEQ ID NO: 50613 - DNA, 16 bp, H. sapiens
atgacatttgcagcaa

SEQ ID NO: 50614 - DNA, 16 bp, H. sapiens
atgacattttagatac

SEQ ID NO: 50615 - DNA, 16 bp, H. sapiens
atgacattttcatttt

SEQ ID NO: 50616 - DNA, 16 bp, H. sapiens
atgacatttttaaaag

SEQ ID NO: 50617 - DNA, 16 bp, H. sapiens
atgacatttttatatt

SEQ ID NO: 50618 - DNA, 16 bp, H. sapiens
atgaccaagtgggttt

SEQ ID NO: 50619 - DNA, 16 bp, H. sapiens
atgaccaatatggtga

SEQ ID NO: 50620 - DNA, 16 bp, H. sapiens
atgaccagcctgggca

SEQ ID NO: 50621 - DNA, 16 bp, H. sapiens
atgaccagctcagtgg

SEQ ID NO: 50622 - DNA, 16 bp, H. sapiens
atgaccagtgatgagg

SEQ ID NO: 50623 - DNA, 16 bp, H. sapiens
atgaccatcttctccc

SEQ ID NO: 50624 - DNA, 16 bp, H. sapiens
atgacccaaaagttac

SEQ ID NO: 50625 - DNA, 16 bp, H. sapiens
atgacccacacacctc

SEQ ID NO: 50626 - DNA, 16 bp, H. sapiens
atgaccggctaatttt

SEQ ID NO: 50627 - DNA, 16 bp, H. sapiens
atgacctaatcacctc

SEQ ID NO: 50628 - DNA, 16 bp, H. sapiens
atgacctcatttaacc

SEQ ID NO: 50629 - DNA, 16 bp, H. sapiens
atgacctgaaactgga

SEQ ID NO: 50630 - DNA, 16 bp, H. sapiens
atgacctgcctgcaga

SEQ ID NO: 50631 - DNA, 16 bp, H. sapiens
atgacctgcttcaagg

SEQ ID NO: 50632 - DNA, 16 bp, H. sapiens
atgacctggaagccct

SEQ ID NO: 50633 - DNA, 16 bp, H. sapiens
atgacctggaaggccc

SEQ ID NO: 50634 - DNA, 17 bp, H. sapiens
atgacctgttctgtgga

SEQ ID NO: 50635 - DNA, 16 bp, H. sapiens
atgaccttgggcaagt

SEQ ID NO: 50636 - DNA, 16 bp, H. sapiens
atgacgaaacctcgtc

SEQ ID NO: 50637 - DNA, 16 bp, H. sapiens
atgacgatgatgatga

SEQ ID NO: 50638 - DNA, 16 bp, H. sapiens
atgactacagtcaata

SEQ ID NO: 50639 - DNA, 16 bp, H. sapiens
atgactatttttccct

SEQ ID NO: 50640 - DNA, 16 bp, H. sapiens
atgactcagtttcttc

SEQ ID NO: 50641 - DNA, 16 bp, H. sapiens
atgactgaactgaaaa

SEQ ID NO: 50642 - DNA, 16 bp, H. sapiens
atgactgcaagatttt

SEQ ID NO: 50643 - DNA, 16 bp, H. sapiens
atgactgcatagtatt

SEQ ID NO: 50644 - DNA, 16 bp, H. sapiens
atgactgccccactgg

SEQ ID NO: 50645 - DNA, 16 bp, H. sapiens
atgactggagctggag

SEQ ID NO: 50646 - DNA, 16 bp, H. sapiens
atgactggcatcctta

SEQ ID NO: 50647 - DNA, 16 bp, H. sapiens
atgactgtaaatttcc

SEQ ID NO: 50648 - DNA, 16 bp, H. sapiens
atgactgtaattccag

SEQ ID NO: 50649 - DNA, 16 bp, H. sapiens
atgactgtattctctc

SEQ ID NO: 50650 - DNA, 16 bp, H. sapiens
atgactgtgaggcctc

SEQ ID NO: 50651 - DNA, 16 bp, H. sapiens
atgacttcattttttt

SEQ ID NO: 50652 - DNA, 16 bp, H. sapiens
atgacttccagctcca

SEQ ID NO: 50653 - DNA, 16 bp, H. sapiens
atgactttatttttgt

SEQ ID NO: 50654 - DNA, 16 bp, H. sapiens
atgactttcttcccag

SEQ ID NO: 50655 - DNA, 16 bp, H. sapiens
atgactttgaggggtt

SEQ ID NO: 50656 - DNA, 18 bp, H. sapiens
atgactttgatgagctga

SEQ ID NO: 50657 - DNA, 16 bp, H. sapiens
atgactttgatgagtt

SEQ ID NO: 50658 - DNA, 16 bp, H. sapiens
atgactttggacaagt

SEQ ID NO: 50659 - DNA, 16 bp, H. sapiens
atgacttttagtaaat

SEQ ID NO: 50660 - DNA, 16 bp, H. sapiens
atgagaaaaacaagtt

SEQ ID NO: 50661 - DNA, 16 bp, H. sapiens
atgagaaaaataaagc

SEQ ID NO: 50662 - DNA, 16 bp, H. sapiens
atgagaaaaatatcaa

SEQ ID NO: 50663 - DNA, 16 bp, H. sapiens
atgagaaaacagagtc

SEQ ID NO: 50664 - DNA, 16 bp, H. sapiens
atgagaaaacaggctt

SEQ ID NO: 50665 - DNA, 16 bp, H. sapiens
atgagaaaacatcaaa

SEQ ID NO: 50666 - DNA, 16 bp, H. sapiens
atgagaaaaccaagat

SEQ ID NO: 50667 - DNA, 16 bp, H. sapiens
atgagaaaactgaggt

SEQ ID NO: 50668 - DNA, 16 bp, H. sapiens
atgagaaaagtgaggc

SEQ ID NO: 50669 - DNA, 16 bp, H. sapiens
atgagaaaatatatgt

SEQ ID NO: 50670 - DNA, 16 bp, H. sapiens
atgagaaaatcctcaa

SEQ ID NO: 50671 - DNA, 16 bp, H. sapiens
atgagaaaatgcaaaa

SEQ ID NO: 50672 - DNA, 16 bp, H. sapiens
atgagaaaatgctcaa

SEQ ID NO: 50673 - DNA, 16 bp, H. sapiens
atgagaaaatgctcat

SEQ ID NO: 50674 - DNA, 16 bp, H. sapiens
atgagaaaatggagac

SEQ ID NO: 50675 - DNA, 16 bp, H. sapiens
atgagaaaattatatt

SEQ ID NO: 50676 - DNA, 16 bp, H. sapiens
atgagaaaattgaagt

SEQ ID NO: 50677 - DNA, 16 bp, H. sapiens
atgagaaacatttaca

SEQ ID NO: 50678 - DNA, 16 bp, H. sapiens
atgagaaactatatgc

SEQ ID NO: 50679 - DNA, 16 bp, H. sapiens
atgagaaactgaggca

SEQ ID NO: 50680 - DNA, 16 bp, H. sapiens
atgagaaagaaaacat

SEQ ID NO: 50681 - DNA, 16 bp, H. sapiens
atgagaaagaaatttt

SEQ ID NO: 50682 - DNA, 16 bp, H. sapiens
atgagaaagaaccagc

SEQ ID NO: 50683 - DNA, 16 bp, H. sapiens
atgagaaagctgagac

SEQ ID NO: 50684 - DNA, 16 bp, H. sapiens
atgagaaaggagacat

SEQ ID NO: 50685 - DNA, 16 bp, H. sapiens
atgagaaagttctgga

SEQ ID NO: 50686 - DNA, 16 bp, H. sapiens
atgagaaataaaatct

SEQ ID NO: 50687 - DNA, 16 bp, H. sapiens
atgagaacacaaaggc

SEQ ID NO: 50688 - DNA, 16 bp, H. sapiens
atgagaacacagcaag

SEQ ID NO: 50689 - DNA, 16 bp, H. sapiens
atgagaacattttaaa

SEQ ID NO: 50690 - DNA, 16 bp, H. sapiens
atgagaacccactcac

SEQ ID NO: 50691 - DNA, 16 bp, H. sapiens
atgagaactacaaacc

SEQ ID NO: 50692 - DNA, 16 bp, H. sapiens
atgagaactacatgat

SEQ ID NO: 50693 - DNA, 16 bp, H. sapiens
atgagaagatgttcaa

SEQ ID NO: 50694 - DNA, 16 bp, H. sapiens
atgagaagccactgga

SEQ ID NO: 50695 - DNA, 16 bp, H. sapiens
atgagaataaagatac

SEQ ID NO: 50696 - DNA, 16 bp, H. sapiens
atgagaatgagaatga

SEQ ID NO: 50697 - DNA, 16 bp, H. sapiens
atgagaatggagccct

SEQ ID NO: 50698 - DNA, 16 bp, H. sapiens
atgagaatgtggattt

SEQ ID NO: 50699 - DNA, 16 bp, H. sapiens
atgagaatgttttaaa

SEQ ID NO: 50700 - DNA, 16 bp, H. sapiens
atgagaattaaatgat

SEQ ID NO: 50701 - DNA, 16 bp, H. sapiens
atgagaattataaaac

SEQ ID NO: 50702 - DNA, 16 bp, H. sapiens
atgagaattattttaa

SEQ ID NO: 50703 - DNA, 16 bp, H. sapiens
atgagaattcctgaca

SEQ ID NO: 50704 - DNA, 16 bp, H. sapiens
atgagaattgctttaa

SEQ ID NO: 50705 - DNA, 16 bp, H. sapiens
atgagaatttaaaatt

SEQ ID NO: 50706 - DNA, 16 bp, H. sapiens
atgagacaaagagaaa

SEQ ID NO: 50707 - DNA, 16 bp, H. sapiens
atgagacagagtttcg

SEQ ID NO: 50708 - DNA, 16 bp, H. sapiens
atgagacatcaatcaa

SEQ ID NO: 50709 - DNA, 18 bp, H. sapiens
atgagacatggagtcaaa

SEQ ID NO: 50710 - DNA, 16 bp, H. sapiens
atgagaccaccatcat

SEQ ID NO: 50711 - DNA, 16 bp, H. sapiens
atgagaccagcctggg

SEQ ID NO: 50712 - DNA, 16 bp, H. sapiens
atgagaccatgtctca

SEQ ID NO: 50713 - DNA, 18 bp, H. sapiens
atgagaccccatctctac

SEQ ID NO: 50714 - DNA, 16 bp, H. sapiens
atgagaccctgtgtca

SEQ ID NO: 50715 - DNA, 16 bp, H. sapiens
atgagacctggagtca

SEQ ID NO: 50716 - DNA, 16 bp, H. sapiens
atgagactagcatggg

SEQ ID NO: 50717 - DNA, 16 bp, H. sapiens
atgagactccatctca

SEQ ID NO: 50718 - DNA, 16 bp, H. sapiens
atgagagaaaactttt

SEQ ID NO: 50719 - DNA, 16 bp, H. sapiens
atgagagaaaatatct

SEQ ID NO: 50720 - DNA, 16 bp, H. sapiens
atgagagaaagtattt

SEQ ID NO: 50721 - DNA, 16 bp, H. sapiens
atgagagaaattgaag

SEQ ID NO: 50722 - DNA, 16 bp, H. sapiens
atgagagaatacattt

SEQ ID NO: 50723 - DNA, 16 bp, H. sapiens
atgagagagacagaga

SEQ ID NO: 50724 - DNA, 23 bp, H. sapiens
atgagagagtgtagaaataaaga

SEQ ID NO: 50725 - DNA, 16 bp, H. sapiens
atgagagcagaaataa

SEQ ID NO: 50726 - DNA, 16 bp, H. sapiens
atgagagtgagtgagt

SEQ ID NO: 50727 - DNA, 16 bp, H. sapiens
atgagagttccagttg

SEQ ID NO: 50728 - DNA, 16 bp, H. sapiens
atgagataatggatgt

SEQ ID NO: 50729 - DNA, 16 bp, H. sapiens
atgagataatgtcctt

SEQ ID NO: 50730 - DNA, 16 bp, H. sapiens
atgagatactttgata

SEQ ID NO: 50731 - DNA, 16 bp, H. sapiens
atgagatagacagcaa

SEQ ID NO: 50732 - DNA, 16 bp, H. sapiens
atgagatataatctca

SEQ ID NO: 50733 - DNA, 16 bp, H. sapiens
atgagatatcatctca

SEQ ID NO: 50734 - DNA, 16 bp, H. sapiens
atgagatatcttggga

SEQ ID NO: 50735 - DNA, 16 bp, H. sapiens
atgagatattactaca

SEQ ID NO: 50736 - DNA, 16 bp, H. sapiens
atgagatcactgggtc

SEQ ID NO: 50737 - DNA, 16 bp, H. sapiens
atgagatcccatctca

SEQ ID NO: 50738 - DNA, 16 bp, H. sapiens
atgagatctggctgtt

SEQ ID NO: 50739 - DNA, 16 bp, H. sapiens
atgagatcttggctca

SEQ ID NO: 50740 - DNA, 16 bp, H. sapiens
atgagatctttttttt

SEQ ID NO: 50741 - DNA, 16 bp, H. sapiens
atgagatgatgtatgt

SEQ ID NO: 50742 - DNA, 16 bp, H. sapiens
atgagatggtatctca

SEQ ID NO: 50743 - DNA, 16 bp, H. sapiens
atgagatgtccacaca

SEQ ID NO: 50744 - DNA, 16 bp, H. sapiens
atgagatgttttgata

SEQ ID NO: 50745 - DNA, 16 bp, H. sapiens
atgagattgaagccat

SEQ ID NO: 50746 - DNA, 16 bp, H. sapiens
atgagatttgggcagg

SEQ ID NO: 50747 - DNA, 16 bp, H. sapiens
atgagatttggtggag

SEQ ID NO: 50748 - DNA, 16 bp, H. sapiens
atgagattttaaaaga

SEQ ID NO: 50749 - DNA, 16 bp, H. sapiens
atgagcaaaataaaca

SEQ ID NO: 50750 - DNA, 16 bp, H. sapiens
atgagcaaagaaatga

SEQ ID NO: 50751 - DNA, 16 bp, H. sapiens
atgagcaactacatgc

SEQ ID NO: 50752 - DNA, 16 bp, H. sapiens
atgagcaagaaataaa

SEQ ID NO: 50753 - DNA, 16 bp, H. sapiens
atgagcacacacacac

SEQ ID NO: 50754 - DNA, 16 bp, H. sapiens
atgagcagcagcaaga

SEQ ID NO: 50755 - DNA, 17 bp, H. sapiens
atgagcagtgatgatga

SEQ ID NO: 50756 - DNA, 16 bp, H. sapiens
atgagcatgagcccat

SEQ ID NO: 50757 - DNA, 16 bp, H. sapiens
atgagccaccacgcca

SEQ ID NO: 50758 - DNA, 17 bp, H. sapiens
atgagccaccacgcccg

SEQ ID NO: 50759 - DNA, 21 bp, H. sapiens
atgagccaccacgcctggcca

SEQ ID NO: 50760 - DNA, 16 bp, H. sapiens
atgagccaccatgcca

SEQ ID NO: 50761 - DNA, 17 bp, H. sapiens
atgagccaccatgccca

SEQ ID NO: 50762 - DNA, 20 bp, H. sapiens
atgagccaccatgcccagcc

SEQ ID NO: 50763 - DNA, 19 bp, H. sapiens
atgagccaccatgcccagt

SEQ ID NO: 50764 - DNA, 17 bp, H. sapiens
atgagccaccatgcccg

SEQ ID NO: 50765 - DNA, 16 bp, H. sapiens
atgagccaccatgcct

SEQ ID NO: 50766 - DNA, 21 bp, H. sapiens
atgagccaccgcgcctggccc

SEQ ID NO: 50767 - DNA, 21 bp, H. sapiens
atgagccaccgtgcctggcct

SEQ ID NO: 50768 - DNA, 21 bp, H. sapiens
atgagccactgcacctggcca

SEQ ID NO: 50769 - DNA, 16 bp, H. sapiens
atgagccactgcatcc

SEQ ID NO: 50770 - DNA, 19 bp, H. sapiens
atgagccactgtgcccagc

SEQ ID NO: 50771 - DNA, 16 bp, H. sapiens
atgagccaggcctggt

SEQ ID NO: 50772 - DNA, 16 bp, H. sapiens
atgagcccactgctgc

SEQ ID NO: 50773 - DNA, 19 bp, H. sapiens
atgagccgagatggcgcca

SEQ ID NO: 50774 - DNA, 19 bp, H. sapiens
atgagccgagattgcgcca

SEQ ID NO: 50775 - DNA, 17 bp, H. sapiens
atgagccgggcatggtg

SEQ ID NO: 50776 - DNA, 16 bp, H. sapiens
atgagcctggaggaca

SEQ ID NO: 50777 - DNA, 16 bp, H. sapiens
atgagctccttgaggg

SEQ ID NO: 50778 - DNA, 19 bp, H. sapiens
atgagctgagattgtgcca

SEQ ID NO: 50779 - DNA, 16 bp, H. sapiens
atgagctgcaacactc

SEQ ID NO: 50780 - DNA, 16 bp, H. sapiens
atgagctgctgcacct

SEQ ID NO: 50781 - DNA, 16 bp, H. sapiens
atgagctgttccagta

SEQ ID NO: 50782 - DNA, 16 bp, H. sapiens
atgagcttaaaaaaaa

SEQ ID NO: 50783 - DNA, 16 bp, H. sapiens
atgagcttttaaaaat

SEQ ID NO: 50784 - DNA, 16 bp, H. sapiens
atgaggaaaaaacagc

SEQ ID NO: 50785 - DNA, 16 bp, H. sapiens
atgaggaaaaaccagc

SEQ ID NO: 50786 - DNA, 16 bp, H. sapiens
atgaggaaaatgaagc

SEQ ID NO: 50787 - DNA, 16 bp, H. sapiens
atgaggaaacaaagac

SEQ ID NO: 50788 - DNA, 16 bp, H. sapiens
atgaggaaacaaaggc

SEQ ID NO: 50789 - DNA, 16 bp, H. sapiens
atgaggaaacagagac

SEQ ID NO: 50790 - DNA, 16 bp, H. sapiens
atgaggaaacagaggc

SEQ ID NO: 50791 - DNA, 16 bp, H. sapiens
atgaggaaacatcaga

SEQ ID NO: 50792 - DNA, 16 bp, H. sapiens
atgaggaaaccagggc

SEQ ID NO: 50793 - DNA, 16 bp, H. sapiens
atgaggaaacccaggc

SEQ ID NO: 50794 - DNA, 16 bp, H. sapiens
atgaggaaacggaggc

SEQ ID NO: 50795 - DNA, 16 bp, H. sapiens
atgaggaaactaaggt

SEQ ID NO: 50796 - DNA, 16 bp, H. sapiens
atgaggaaactcaggc

SEQ ID NO: 50797 - DNA, 16 bp, H. sapiens
atgaggaaactgaaaa

SEQ ID NO: 50798 - DNA, 16 bp, H. sapiens
atgaggaaactgaaat

SEQ ID NO: 50799 - DNA, 16 bp, H. sapiens
atgaggaaactgaaga

SEQ ID NO: 50800 - DNA, 16 bp, H. sapiens
atgaggaaactgaatc

SEQ ID NO: 50801 - DNA, 16 bp, H. sapiens
atgaggaaactgagcc

SEQ ID NO: 50802 - DNA, 16 bp, H. sapiens
atgaggaaactgaggt

SEQ ID NO: 50803 - DNA, 16 bp, H. sapiens
atgaggaaactgcagc

SEQ ID NO: 50804 - DNA, 16 bp, H. sapiens
atgaggaaaggattcc

SEQ ID NO: 50805 - DNA, 16 bp, H. sapiens
atgaggaacctgaagc

SEQ ID NO: 50806 - DNA, 16 bp, H. sapiens
atgaggaagatgaaga

SEQ ID NO: 50807 - DNA, 16 bp, H. sapiens
atgaggaagatgaggc

SEQ ID NO: 50808 - DNA, 16 bp, H. sapiens
atgaggaagctgaggc

SEQ ID NO: 50809 - DNA, 16 bp, H. sapiens
atgaggaagctggggc

SEQ ID NO: 50810 - DNA, 16 bp, H. sapiens
atgaggaatttttaaa

SEQ ID NO: 50811 - DNA, 16 bp, H. sapiens
atgaggacaaatacct

SEQ ID NO: 50812 - DNA, 16 bp, H. sapiens
atgaggacattgaggc

SEQ ID NO: 50813 - DNA, 16 bp, H. sapiens
atgaggaccctgggcc

SEQ ID NO: 50814 - DNA, 16 bp, H. sapiens
atgaggagaaaaatca

SEQ ID NO: 50815 - DNA, 16 bp, H. sapiens
atgaggagattgtgtc

SEQ ID NO: 50816 - DNA, 16 bp, H. sapiens
atgaggagctgaatgt

SEQ ID NO: 50817 - DNA, 16 bp, H. sapiens
atgaggaggcatctgg

SEQ ID NO: 50818 - DNA, 16 bp, H. sapiens
atgaggagttcaagac

SEQ ID NO: 50819 - DNA, 16 bp, H. sapiens
atgaggataatgataa

SEQ ID NO: 50820 - DNA, 16 bp, H. sapiens
atgaggatgaagacct

SEQ ID NO: 50821 - DNA, 16 bp, H. sapiens
atgaggatgatgatgg

SEQ ID NO: 50822 - DNA, 16 bp, H. sapiens
atgaggatgatggtga

SEQ ID NO: 50823 - DNA, 16 bp, H. sapiens
atgaggatgcagagaa

SEQ ID NO: 50824 - DNA, 16 bp, H. sapiens
atgaggatgctgaggc

SEQ ID NO: 50825 - DNA, 16 bp, H. sapiens
atgaggattaaatgaa

SEQ ID NO: 50826 - DNA, 16 bp, H. sapiens
atgaggcaaaaagaaa

SEQ ID NO: 50827 - DNA, 16 bp, H. sapiens
atgaggcaaaactttg

SEQ ID NO: 50828 - DNA, 16 bp, H. sapiens
atgaggcaggagaatg

SEQ ID NO: 50829 - DNA, 16 bp, H. sapiens
atgaggcaggagaatt

SEQ ID NO: 50830 - DNA, 31 bp, H. sapiens
atgaggccagcatcatcctgataccaaagcc

SEQ ID NO: 50831 - DNA, 16 bp, H. sapiens
atgaggccagcatcgt

SEQ ID NO: 50832 - DNA, 22 bp, H. sapiens
atgaggccagcgtcatcctgat

SEQ ID NO: 50833 - DNA, 16 bp, H. sapiens
atgaggccaggcacgg

SEQ ID NO: 50834 - DNA, 16 bp, H. sapiens
atgaggccattggtgc

SEQ ID NO: 50835 - DNA, 16 bp, H. sapiens
atgaggcccacacaca

SEQ ID NO: 50836 - DNA, 16 bp, H. sapiens
atgaggcccatccaca

SEQ ID NO: 50837 - DNA, 17 bp, H. sapiens
atgaggctgggtgcagt

SEQ ID NO: 50838 - DNA, 16 bp, H. sapiens
atgaggcttcaccatg

SEQ ID NO: 50839 - DNA, 16 bp, H. sapiens
atgagggaaatacaaa

SEQ ID NO: 50840 - DNA, 16 bp, H. sapiens
atgagggaactgaggt

SEQ ID NO: 50841 - DNA, 16 bp, H. sapiens
atgagggcagggccct

SEQ ID NO: 50842 - DNA, 16 bp, H. sapiens
atgagggccccgcccc

SEQ ID NO: 50843 - DNA, 16 bp, H. sapiens
atgagggccctgcccc

SEQ ID NO: 50844 - DNA, 16 bp, H. sapiens
atgaggggtgcagggg

SEQ ID NO: 50845 - DNA, 16 bp, H. sapiens
atgagggtcttcaagg

SEQ ID NO: 50846 - DNA, 16 bp, H. sapiens
atgagggttccaattt

SEQ ID NO: 50847 - DNA, 16 bp, H. sapiens
atgaggtagataatat

SEQ ID NO: 50848 - DNA, 16 bp, H. sapiens
atgaggtcactggggt

SEQ ID NO: 50849 - DNA, 16 bp, H. sapiens
atgaggtcagagaagt

SEQ ID NO: 50850 - DNA, 16 bp, H. sapiens
atgaggtctccatctt

SEQ ID NO: 50851 - DNA, 16 bp, H. sapiens
atgaggtcttgctgtg

SEQ ID NO: 50852 - DNA, 16 bp, H. sapiens
atgaggtgactcttgg

SEQ ID NO: 50853 - DNA, 16 bp, H. sapiens
atgaggtgtgtctgac

SEQ ID NO: 50854 - DNA, 16 bp, H. sapiens
atgaggtgtgtgtgtg

SEQ ID NO: 50855 - DNA, 16 bp, H. sapiens
atgaggtttaagggaa

SEQ ID NO: 50856 - DNA, 16 bp, H. sapiens
atgaggtttcatcatg

SEQ ID NO: 50857 - DNA, 16 bp, H. sapiens
atgaggtttgagtggg

SEQ ID NO: 50858 - DNA, 16 bp, H. sapiens
atgaggtttttgtcat

SEQ ID NO: 50859 - DNA, 16 bp, H. sapiens
atgaggtttttttaaa

SEQ ID NO: 50860 - DNA, 16 bp, H. sapiens
atgagtaaactgaagc

SEQ ID NO: 50861 - DNA, 16 bp, H. sapiens
atgagtaaactgagac

SEQ ID NO: 50862 - DNA, 16 bp, H. sapiens
atgagtaagaacatac

SEQ ID NO: 50863 - DNA, 16 bp, H. sapiens
atgagtagaatcaata

SEQ ID NO: 50864 - DNA, 16 bp, H. sapiens
atgagtaggagtttgc

SEQ ID NO: 50865 - DNA, 16 bp, H. sapiens
atgagtgaaaatgaaa

SEQ ID NO: 50866 - DNA, 16 bp, H. sapiens
atgagtgaatgaatga

SEQ ID NO: 50867 - DNA, 16 bp, H. sapiens
atgagtgagaacatct

SEQ ID NO: 50868 - DNA, 16 bp, H. sapiens
atgagtgagaagatgc

SEQ ID NO: 50869 - DNA, 16 bp, H. sapiens
atgagtgagagagaga

SEQ ID NO: 50870 - DNA, 16 bp, H. sapiens
atgagtgagtgaatgg

SEQ ID NO: 50871 - DNA, 16 bp, H. sapiens
atgagtggaaaaacaa

SEQ ID NO: 50872 - DNA, 16 bp, H. sapiens
atgagtgtattagtct

SEQ ID NO: 50873 - DNA, 16 bp, H. sapiens
atgagtgtggctgtgt

SEQ ID NO: 50874 - DNA, 16 bp, H. sapiens
atgagttaatatgtat

SEQ ID NO: 50875 - DNA, 16 bp, H. sapiens
atgagttcaacaccaa

SEQ ID NO: 50876 - DNA, 16 bp, H. sapiens
atgagttcaagaccaa

SEQ ID NO: 50877 - DNA, 18 bp, H. sapiens
atgagttcatgtcctctg

SEQ ID NO: 50878 - DNA, 18 bp, H. sapiens
atgagttcatgtcctttg

SEQ ID NO: 50879 - DNA, 16 bp, H. sapiens
atgagttcatgtgctt

SEQ ID NO: 50880 - DNA, 17 bp, H. sapiens
atgagttcatgttcttt

SEQ ID NO: 50881 - DNA, 18 bp, H. sapiens
atgagttcctgtcctttg

SEQ ID NO: 50882 - DNA, 16 bp, H. sapiens
atgagttctcatcatt

SEQ ID NO: 50883 - DNA, 16 bp, H. sapiens
atgagttggtcaccct

SEQ ID NO: 50884 - DNA, 16 bp, H. sapiens
atgagtttacctgtat

SEQ ID NO: 50885 - DNA, 16 bp, H. sapiens
atgagtttatttttgc

SEQ ID NO: 50886 - DNA, 16 bp, H. sapiens
atgagtttcttttctt

SEQ ID NO: 50887 - DNA, 16 bp, H. sapiens
atgagtttggagataa

SEQ ID NO: 50888 - DNA, 16 bp, H. sapiens
atgagttttccaggaa

SEQ ID NO: 50889 - DNA, 16 bp, H. sapiens
atgagttttggagggg

SEQ ID NO: 50890 - DNA, 16 bp, H. sapiens
atgagttttgggtggg

SEQ ID NO: 50891 - DNA, 16 bp, H. sapiens
atgagtttttaaaaaa

SEQ ID NO: 50892 - DNA, 16 bp, H. sapiens
atgagtttttgccatg

SEQ ID NO: 50893 - DNA, 16 bp, H. sapiens
atgataaaaaccctca

SEQ ID NO: 50894 - DNA, 16 bp, H. sapiens
atgataaaaactagaa

SEQ ID NO: 50895 - DNA, 16 bp, H. sapiens
atgataaaaactctca

SEQ ID NO: 50896 - DNA, 16 bp, H. sapiens
atgataaaaagcttca

SEQ ID NO: 50897 - DNA, 16 bp, H. sapiens
atgataaaaatattct

SEQ ID NO: 50898 - DNA, 16 bp, H. sapiens
atgataaaatgtttaa

SEQ ID NO: 50899 - DNA, 16 bp, H. sapiens
atgataaacacaaaat

SEQ ID NO: 50900 - DNA, 16 bp, H. sapiens
atgataaatatttcaa

SEQ ID NO: 50901 - DNA, 16 bp, H. sapiens
atgataaatattttag

SEQ ID NO: 50902 - DNA, 16 bp, H. sapiens
atgataaatgtttaaa

SEQ ID NO: 50903 - DNA, 16 bp, H. sapiens
atgataaatttgtgtt

SEQ ID NO: 50904 - DNA, 16 bp, H. sapiens
atgataacatcaaaaa

SEQ ID NO: 50905 - DNA, 16 bp, H. sapiens
atgataactaacattt

SEQ ID NO: 50906 - DNA, 16 bp, H. sapiens
atgataagcttttttt

SEQ ID NO: 50907 - DNA, 16 bp, H. sapiens
atgataataaatttgt

SEQ ID NO: 50908 - DNA, 16 bp, H. sapiens
atgataatgaaaatgt

SEQ ID NO: 50909 - DNA, 16 bp, H. sapiens
atgataatgatgaaga

SEQ ID NO: 50910 - DNA, 16 bp, H. sapiens
atgataatgatgatgg

SEQ ID NO: 50911 - DNA, 16 bp, H. sapiens
atgataatgtgatttt

SEQ ID NO: 50912 - DNA, 16 bp, H. sapiens
atgatacaacggactt

SEQ ID NO: 50913 - DNA, 16 bp, H. sapiens
atgatactagctgtgg

SEQ ID NO: 50914 - DNA, 16 bp, H. sapiens
atgatactggtacaaa

SEQ ID NO: 50915 - DNA, 16 bp, H. sapiens
atgatagacactgggg

SEQ ID NO: 50916 - DNA, 16 bp, H. sapiens
atgatagccattttaa

SEQ ID NO: 50917 - DNA, 16 bp, H. sapiens
atgatagctcactgca

SEQ ID NO: 50918 - DNA, 16 bp, H. sapiens
atgatataaggaaggg

SEQ ID NO: 50919 - DNA, 16 bp, H. sapiens
atgatatatattacat

SEQ ID NO: 50920 - DNA, 16 bp, H. sapiens
atgatatcaacttttt

SEQ ID NO: 50921 - DNA, 16 bp, H. sapiens
atgatattaagcatct

SEQ ID NO: 50922 - DNA, 16 bp, H. sapiens
atgatattagctggtt

SEQ ID NO: 50923 - DNA, 16 bp, H. sapiens
atgatattcttcatag

SEQ ID NO: 50924 - DNA, 16 bp, H. sapiens
atgatattgatgatga

SEQ ID NO: 50925 - DNA, 16 bp, H. sapiens
atgatattgtctgtgg

SEQ ID NO: 50926 - DNA, 16 bp, H. sapiens
atgatattttcaattt

SEQ ID NO: 50927 - DNA, 16 bp, H. sapiens
atgatattttgaaata

SEQ ID NO: 50928 - DNA, 16 bp, H. sapiens
atgatattttgttaca

SEQ ID NO: 50929 - DNA, 16 bp, H. sapiens
atgatcaagtgggttt

SEQ ID NO: 50930 - DNA, 16 bp, H. sapiens
atgatcaataaatact

SEQ ID NO: 50931 - DNA, 18 bp, H. sapiens
atgatcacaccactgcat

SEQ ID NO: 50932 - DNA, 16 bp, H. sapiens
atgatcacgccactgc

SEQ ID NO: 50933 - DNA, 16 bp, H. sapiens
atgatcactgatgttg

SEQ ID NO: 50934 - DNA, 16 bp, H. sapiens
atgatcagagatgttg

SEQ ID NO: 50935 - DNA, 16 bp, H. sapiens
atgatcagatttgtat

SEQ ID NO: 50936 - DNA, 16 bp, H. sapiens
atgatcagtgttgttg

SEQ ID NO: 50937 - DNA, 18 bp, H. sapiens
atgatcatagctcactgt

SEQ ID NO: 50938 - DNA, 16 bp, H. sapiens
atgatcatagttcact

SEQ ID NO: 50939 - DNA, 16 bp, H. sapiens
atgatcatatcaatag

SEQ ID NO: 50940 - DNA, 16 bp, H. sapiens
atgatcatatcaattg

SEQ ID NO: 50941 - DNA, 16 bp, H. sapiens
atgatcatatcatcag

SEQ ID NO: 50942 - DNA, 16 bp, H. sapiens
atgatcatcaccatca

SEQ ID NO: 50943 - DNA, 18 bp, H. sapiens
atgatcatggctcactgt

SEQ ID NO: 50944 - DNA, 16 bp, H. sapiens
atgatcatggtggaag

SEQ ID NO: 50945 - DNA, 16 bp, H. sapiens
atgatcatggttcact

SEQ ID NO: 50946 - DNA, 16 bp, H. sapiens
atgatcatgtggtttt

SEQ ID NO: 50947 - DNA, 16 bp, H. sapiens
atgatcattttaatgt

SEQ ID NO: 50948 - DNA, 16 bp, H. sapiens
atgatccaaacacttc

SEQ ID NO: 50949 - DNA, 16 bp, H. sapiens
atgatccaatcacatc

SEQ ID NO: 50950 - DNA, 16 bp, H. sapiens
atgatccacccacctc

SEQ ID NO: 50951 - DNA, 16 bp, H. sapiens
atgatccacccgcctc

SEQ ID NO: 50952 - DNA, 20 bp, H. sapiens
atgatccacccgcctcagcc

SEQ ID NO: 50953 - DNA, 16 bp, H. sapiens
atgatccacctgcctc

SEQ ID NO: 50954 - DNA, 20 bp, H. sapiens
atgatccacctgccttggcc

SEQ ID NO: 50955 - DNA, 16 bp, H. sapiens
atgatccagaaattcc

SEQ ID NO: 50956 - DNA, 16 bp, H. sapiens
atgatcccaccactgc

SEQ ID NO: 50957 - DNA, 16 bp, H. sapiens
atgatcccatttttgt

SEQ ID NO: 50958 - DNA, 20 bp, H. sapiens
atgatccgcccgcctcagcc

SEQ ID NO: 50959 - DNA, 16 bp, H. sapiens
atgatcctctcacctc

SEQ ID NO: 50960 - DNA, 16 bp, H. sapiens
atgatcctgtacatgc

SEQ ID NO: 50961 - DNA, 16 bp, H. sapiens
atgatctcactcattt

SEQ ID NO: 50962 - DNA, 16 bp, H. sapiens
atgatctctattttaa

SEQ ID NO: 50963 - DNA, 16 bp, H. sapiens
atgatctgcccacctc

SEQ ID NO: 50964 - DNA, 16 bp, H. sapiens
atgatctgcctgcttt

SEQ ID NO: 50965 - DNA, 16 bp, H. sapiens
atgatcttcaacaagg

SEQ ID NO: 50966 - DNA, 16 bp, H. sapiens
atgatcttcagttcca

SEQ ID NO: 50967 - DNA, 16 bp, H. sapiens
atgatcttgggcaagt

SEQ ID NO: 50968 - DNA, 16 bp, H. sapiens
atgatcttgttctttt

SEQ ID NO: 50969 - DNA, 16 bp, H. sapiens
atgatctttgataaga

SEQ ID NO: 50970 - DNA, 16 bp, H. sapiens
atgatgaaaaactgaa

SEQ ID NO: 50971 - DNA, 16 bp, H. sapiens
atgatgaaaactctca

SEQ ID NO: 50972 - DNA, 16 bp, H. sapiens
atgatgaaaatgatga

SEQ ID NO: 50973 - DNA, 16 bp, H. sapiens
atgatgaaaatgccaa

SEQ ID NO: 50974 - DNA, 16 bp, H. sapiens
atgatgaaaatgttct

SEQ ID NO: 50975 - DNA, 16 bp, H. sapiens
atgatgaaaattattt

SEQ ID NO: 50976 - DNA, 16 bp, H. sapiens
atgatgaaaccctctc

SEQ ID NO: 50977 - DNA, 16 bp, H. sapiens
atgatgaaacctcatc

SEQ ID NO: 50978 - DNA, 16 bp, H. sapiens
atgatgaaagactgaa

SEQ ID NO: 50979 - DNA, 16 bp, H. sapiens
atgatgaaatactact

SEQ ID NO: 50980 - DNA, 16 bp, H. sapiens
atgatgaaatagaaag

SEQ ID NO: 50981 - DNA, 16 bp, H. sapiens
atgatgaaatattatg

SEQ ID NO: 50982 - DNA, 16 bp, H. sapiens
atgatgaaatgaagaa

SEQ ID NO: 50983 - DNA, 16 bp, H. sapiens
atgatgaaatgaatga

SEQ ID NO: 50984 - DNA, 17 bp, H. sapiens
atgatgaaattgccaaa

SEQ ID NO: 50985 - DNA, 16 bp, H. sapiens
atgatgaacatctttt

SEQ ID NO: 50986 - DNA, 16 bp, H. sapiens
atgatgaagaaaaatg

SEQ ID NO: 50987 - DNA, 16 bp, H. sapiens
atgatgaagaaactga

SEQ ID NO: 50988 - DNA, 16 bp, H. sapiens
atgatgaagatgaaga

SEQ ID NO: 50989 - DNA, 16 bp, H. sapiens
atgatgaagatgacaa

SEQ ID NO: 50990 - DNA, 16 bp, H. sapiens
atgatgaagatgataa

SEQ ID NO: 50991 - DNA, 16 bp, H. sapiens
atgatgaattacattt

SEQ ID NO: 50992 - DNA, 16 bp, H. sapiens
atgatgaatttattta

SEQ ID NO: 50993 - DNA, 16 bp, H. sapiens
atgatgaatttgaaat

SEQ ID NO: 50994 - DNA, 16 bp, H. sapiens
atgatgacaatgacaa

SEQ ID NO: 50995 - DNA, 16 bp, H. sapiens
atgatgacaatgataa

SEQ ID NO: 50996 - DNA, 17 bp, H. sapiens
atgatgacaggatcaaa

SEQ ID NO: 50997 - DNA, 16 bp, H. sapiens
atgatgacttccagct

SEQ ID NO: 50998 - DNA, 16 bp, H. sapiens
atgatgacttccagtt

SEQ ID NO: 50999 - DNA, 16 bp, H. sapiens
atgatgagaagacatg

SEQ ID NO: 51000 - DNA, 16 bp, H. sapiens
atgatgagaatgaaga

SEQ ID NO: 51001 - DNA, 16 bp, H. sapiens
atgatgagaatgatga

SEQ ID NO: 51002 - DNA, 16 bp, H. sapiens
atgatgagcatttttc

SEQ ID NO: 51003 - DNA, 16 bp, H. sapiens
atgatgaggataaaga

SEQ ID NO: 51004 - DNA, 16 bp, H. sapiens
atgatgaggatgaaga

SEQ ID NO: 51005 - DNA, 16 bp, H. sapiens
atgatgaggatttttt

SEQ ID NO: 51006 - DNA, 16 bp, H. sapiens
atgatgaggtcaagag

SEQ ID NO: 51007 - DNA, 16 bp, H. sapiens
atgatgagttactggg

SEQ ID NO: 51008 - DNA, 16 bp, H. sapiens
atgatgataaatattt

SEQ ID NO: 51009 - DNA, 16 bp, H. sapiens
atgatgataatgacaa

SEQ ID NO: 51010 - DNA, 16 bp, H. sapiens
atgatgataatgataa

SEQ ID NO: 51011 - DNA, 16 bp, H. sapiens
atgatgataattataa

SEQ ID NO: 51012 - DNA, 16 bp, H. sapiens
atgatgatgaagaaga

SEQ ID NO: 51013 - DNA, 16 bp, H. sapiens
atgatgatgacaacaa

SEQ ID NO: 51014 - DNA, 16 bp, H. sapiens
atgatgatgacagtaa

SEQ ID NO: 51015 - DNA, 16 bp, H. sapiens
atgatgatgacgacga

SEQ ID NO: 51016 - DNA, 16 bp, H. sapiens
atgatgatgacggtga

SEQ ID NO: 51017 - DNA, 16 bp, H. sapiens
atgatgatgaggagga

SEQ ID NO: 51018 - DNA, 16 bp, H. sapiens
atgatgatgataaata

SEQ ID NO: 51019 - DNA, 16 bp, H. sapiens
atgatgatgataatga

SEQ ID NO: 51020 - DNA, 16 bp, H. sapiens
atgatgatgatatttt

SEQ ID NO: 51021 - DNA, 16 bp, H. sapiens
atgatgatgatgaagt

SEQ ID NO: 51022 - DNA, 16 bp, H. sapiens
atgatgatgatgacta

SEQ ID NO: 51023 - DNA, 16 bp, H. sapiens
atgatgatgatgactt

SEQ ID NO: 51024 - DNA, 16 bp, H. sapiens
atgatgatgatgagga

SEQ ID NO: 51025 - DNA, 16 bp, H. sapiens
atgatgatgatgatga

SEQ ID NO: 51026 - DNA, 16 bp, H. sapiens
atgatgatgatgatta

SEQ ID NO: 51027 - DNA, 16 bp, H. sapiens
atgatgatgatgttga

SEQ ID NO: 51028 - DNA, 16 bp, H. sapiens
atgatgatgcatgcct

SEQ ID NO: 51029 - DNA, 16 bp, H. sapiens
atgatgatggaaggca

SEQ ID NO: 51030 - DNA, 16 bp, H. sapiens
atgatgatggtgaaga

SEQ ID NO: 51031 - DNA, 16 bp, H. sapiens
atgatgatggtgatga

SEQ ID NO: 51032 - DNA, 16 bp, H. sapiens
atgatgatggtgttga

SEQ ID NO: 51033 - DNA, 16 bp, H. sapiens
atgatgattatgataa

SEQ ID NO: 51034 - DNA, 16 bp, H. sapiens
atgatgcaaagatgaa

SEQ ID NO: 51035 - DNA, 16 bp, H. sapiens
atgatgcagcagaggc

SEQ ID NO: 51036 - DNA, 16 bp, H. sapiens
atgatgcctccacctt

SEQ ID NO: 51037 - DNA, 16 bp, H. sapiens
atgatgctgctgtgaa

SEQ ID NO: 51038 - DNA, 34 bp, H. sapiens
atgatgctggcctcataaaatgagttagggagga

SEQ ID NO: 51039 - DNA, 16 bp, H. sapiens
atgatgctggggaaac

SEQ ID NO: 51040 - DNA, 16 bp, H. sapiens
atgatggaaaggaaat

SEQ ID NO: 51041 - DNA, 16 bp, H. sapiens
atgatggaaatatttt

SEQ ID NO: 51042 - DNA, 16 bp, H. sapiens
atgatggaaatgctct

SEQ ID NO: 51043 - DNA, 16 bp, H. sapiens
atgatggagaaggatg

SEQ ID NO: 51044 - DNA, 16 bp, H. sapiens
atgatggagccactgc

SEQ ID NO: 51045 - DNA, 16 bp, H. sapiens
atgatggcagtggtgg

SEQ ID NO: 51046 - DNA, 16 bp, H. sapiens
atgatggccaggctgg

SEQ ID NO: 51047 - DNA, 16 bp, H. sapiens
atgatggcgccactgc

SEQ ID NO: 51048 - DNA, 16 bp, H. sapiens
atgatggcgggcgcct

SEQ ID NO: 51049 - DNA, 16 bp, H. sapiens
atgatggcgtgtgcct

SEQ ID NO: 51050 - DNA, 16 bp, H. sapiens
atgatggctcatgcct

SEQ ID NO: 51051 - DNA, 16 bp, H. sapiens
atgatggggatgatga

SEQ ID NO: 51052 - DNA, 16 bp, H. sapiens
atgatggtaatgataa

SEQ ID NO: 51053 - DNA, 16 bp, H. sapiens
atgatggtctccagct

SEQ ID NO: 51054 - DNA, 16 bp, H. sapiens
atgatggtgacaatga

SEQ ID NO: 51055 - DNA, 16 bp, H. sapiens
atgatggtgatgataa

SEQ ID NO: 51056 - DNA, 16 bp, H. sapiens
atgatggtgatggggt

SEQ ID NO: 51057 - DNA, 16 bp, H. sapiens
atgatggtggataagg

SEQ ID NO: 51058 - DNA, 16 bp, H. sapiens
atgatggttgcacaac

SEQ ID NO: 51059 - DNA, 16 bp, H. sapiens
atgatgtaaatatttt

SEQ ID NO: 51060 - DNA, 16 bp, H. sapiens
atgatgtcagaaaacc

SEQ ID NO: 51061 - DNA, 16 bp, H. sapiens
atgatgtcttgctctg

SEQ ID NO: 51062 - DNA, 16 bp, H. sapiens
atgatgtgaatggcat

SEQ ID NO: 51063 - DNA, 16 bp, H. sapiens
atgatgtggaacatct

SEQ ID NO: 51064 - DNA, 16 bp, H. sapiens
atgatgtggacaatga

SEQ ID NO: 51065 - DNA, 16 bp, H. sapiens
atgatgtgtgtgtatg

SEQ ID NO: 51066 - DNA, 16 bp, H. sapiens
atgatgttagctgtgg

SEQ ID NO: 51067 - DNA, 16 bp, H. sapiens
atgatgttgaacattt

SEQ ID NO: 51068 - DNA, 16 bp, H. sapiens
atgatgttgaagatga

SEQ ID NO: 51069 - DNA, 16 bp, H. sapiens
atgatgttgaccatct

SEQ ID NO: 51070 - DNA, 16 bp, H. sapiens
atgatgttgatgatga

SEQ ID NO: 51071 - DNA, 16 bp, H. sapiens
atgatgtttgcttttc

SEQ ID NO: 51072 - DNA, 16 bp, H. sapiens
atgatgtttttgaggt

SEQ ID NO: 51073 - DNA, 16 bp, H. sapiens
atgattatgaataaag

SEQ ID NO: 51074 - DNA, 16 bp, H. sapiens
atgattatttttctaa

SEQ ID NO: 51075 - DNA, 16 bp, H. sapiens
atgattcaattttctc

SEQ ID NO: 51076 - DNA, 16 bp, H. sapiens
atgattcacccacctc

SEQ ID NO: 51077 - DNA, 16 bp, H. sapiens
atgattcacctgcctc

SEQ ID NO: 51078 - DNA, 16 bp, H. sapiens
atgattcaggaaaaaa

SEQ ID NO: 51079 - DNA, 16 bp, H. sapiens
atgattcagttgtctc

SEQ ID NO: 51080 - DNA, 16 bp, H. sapiens
atgattcattcattca

SEQ ID NO: 51081 - DNA, 16 bp, H. sapiens
atgattcattttgaaa

SEQ ID NO: 51082 - DNA, 16 bp, H. sapiens
atgattccacttatgt

SEQ ID NO: 51083 - DNA, 16 bp, H. sapiens
atgattccattccatt

SEQ ID NO: 51084 - DNA, 16 bp, H. sapiens
atgattccatttatat

SEQ ID NO: 51085 - DNA, 16 bp, H. sapiens
atgattccatttgtgt

SEQ ID NO: 51086 - DNA, 16 bp, H. sapiens
atgattcctgccctca

SEQ ID NO: 51087 - DNA, 16 bp, H. sapiens
atgattctaaaataaa

SEQ ID NO: 51088 - DNA, 16 bp, H. sapiens
atgattctcagcaaac

SEQ ID NO: 51089 - DNA, 16 bp, H. sapiens
atgattctcctgcccc

SEQ ID NO: 51090 - DNA, 16 bp, H. sapiens
atgattggattaaaaa

SEQ ID NO: 51091 - DNA, 16 bp, H. sapiens
atgattgtaagtttcc

SEQ ID NO: 51092 - DNA, 16 bp, H. sapiens
atgattgtagatttcc

SEQ ID NO: 51093 - DNA, 16 bp, H. sapiens
atgattgtattttgaa

SEQ ID NO: 51094 - DNA, 16 bp, H. sapiens
atgattgtcctgcctc

SEQ ID NO: 51095 - DNA, 16 bp, H. sapiens
atgattgtgaggcccc

SEQ ID NO: 51096 - DNA, 16 bp, H. sapiens
atgattgtgcctctgc

SEQ ID NO: 51097 - DNA, 16 bp, H. sapiens
atgattgtgctactgc

SEQ ID NO: 51098 - DNA, 16 bp, H. sapiens
atgattgtgctgctgc

SEQ ID NO: 51099 - DNA, 16 bp, H. sapiens
atgattgttaagtttc

SEQ ID NO: 51100 - DNA, 16 bp, H. sapiens
atgattgttgttttaa

SEQ ID NO: 51101 - DNA, 16 bp, H. sapiens
atgatttaaagtattt

SEQ ID NO: 51102 - DNA, 16 bp, H. sapiens
atgatttaatatatgt

SEQ ID NO: 51103 - DNA, 16 bp, H. sapiens
atgatttaatcaacca

SEQ ID NO: 51104 - DNA, 16 bp, H. sapiens
atgatttagaaaacta

SEQ ID NO: 51105 - DNA, 16 bp, H. sapiens
atgatttagaaatatt

SEQ ID NO: 51106 - DNA, 16 bp, H. sapiens
atgatttagctcccac

SEQ ID NO: 51107 - DNA, 16 bp, H. sapiens
atgatttagggtatct

SEQ ID NO: 51108 - DNA, 17 bp, H. sapiens
atgatttatattccttt

SEQ ID NO: 51109 - DNA, 16 bp, H. sapiens
atgatttatatttctc

SEQ ID NO: 51110 - DNA, 16 bp, H. sapiens
atgatttcattttctt

SEQ ID NO: 51111 - DNA, 16 bp, H. sapiens
atgatttcattttgtt

SEQ ID NO: 51112 - DNA, 16 bp, H. sapiens
atgatttccagcttca

SEQ ID NO: 51113 - DNA, 16 bp, H. sapiens
atgatttccattcttc

SEQ ID NO: 51114 - DNA, 16 bp, H. sapiens
atgatttccttctttt

SEQ ID NO: 51115 - DNA, 16 bp, H. sapiens
atgatttcctttcttt

SEQ ID NO: 51116 - DNA, 16 bp, H. sapiens
atgatttctatttatt

SEQ ID NO: 51117 - DNA, 16 bp, H. sapiens
atgatttctttgagca

SEQ ID NO: 51118 - DNA, 16 bp, H. sapiens
atgatttgcctgcctt

SEQ ID NO: 51119 - DNA, 16 bp, H. sapiens
atgatttgctgcttag

SEQ ID NO: 51120 - DNA, 16 bp, H. sapiens
atgatttgtgtgtgtg

SEQ ID NO: 51121 - DNA, 16 bp, H. sapiens
atgattttaagaaaat

SEQ ID NO: 51122 - DNA, 16 bp, H. sapiens
atgattttaggaaatt

SEQ ID NO: 51123 - DNA, 16 bp, H. sapiens
atgattttatatttgg

SEQ ID NO: 51124 - DNA, 16 bp, H. sapiens
atgattttcatatttt

SEQ ID NO: 51125 - DNA, 16 bp, H. sapiens
atgattttcattttat

SEQ ID NO: 51126 - DNA, 16 bp, H. sapiens
atgattttccttcttt

SEQ ID NO: 51127 - DNA, 16 bp, H. sapiens
atgattttctctttat

SEQ ID NO: 51128 - DNA, 16 bp, H. sapiens
atgattttgatgatga

SEQ ID NO: 51129 - DNA, 16 bp, H. sapiens
atgattttgcttttta

SEQ ID NO: 51130 - DNA, 16 bp, H. sapiens
atgattttggggctgc

SEQ ID NO: 51131 - DNA, 16 bp, H. sapiens
atgatttttaaaagca

SEQ ID NO: 51132 - DNA, 16 bp, H. sapiens
atgatttttattctct

SEQ ID NO: 51133 - DNA, 16 bp, H. sapiens
atgatttttctccttt

SEQ ID NO: 51134 - DNA, 16 bp, H. sapiens
atgatttttcttttca

SEQ ID NO: 51135 - DNA, 16 bp, H. sapiens
atgcaaaaaaatttta

SEQ ID NO: 51136 - DNA, 16 bp, H. sapiens
atgcaaaaacattcca

SEQ ID NO: 51137 - DNA, 16 bp, H. sapiens
atgcaaaaatattcaa

SEQ ID NO: 51138 - DNA, 16 bp, H. sapiens
atgcaaaacaactgaa

SEQ ID NO: 51139 - DNA, 16 bp, H. sapiens
atgcaaaagaattgaa

SEQ ID NO: 51140 - DNA, 16 bp, H. sapiens
atgcaaaaggaaagaa

SEQ ID NO: 51141 - DNA, 16 bp, H. sapiens
atgcaaaataatacag

SEQ ID NO: 51142 - DNA, 16 bp, H. sapiens
atgcaaaatattgatc

SEQ ID NO: 51143 - DNA, 16 bp, H. sapiens
atgcaaaatccaaaat

SEQ ID NO: 51144 - DNA, 16 bp, H. sapiens
atgcaaaatgaaaatg

SEQ ID NO: 51145 - DNA, 16 bp, H. sapiens
atgcaaaatgaaataa

SEQ ID NO: 51146 - DNA, 16 bp, H. sapiens
atgcaaaatggtatag

SEQ ID NO: 51147 - DNA, 16 bp, H. sapiens
atgcaaaattatatat

SEQ ID NO: 51148 - DNA, 16 bp, H. sapiens
atgcaaacacaccaca

SEQ ID NO: 51149 - DNA, 16 bp, H. sapiens
atgcaaacagaaacca

SEQ ID NO: 51150 - DNA, 16 bp, H. sapiens
atgcaaagaaggaaaa

SEQ ID NO: 51151 - DNA, 16 bp, H. sapiens
atgcaaagagaagaaa

SEQ ID NO: 51152 - DNA, 16 bp, H. sapiens
atgcaaaggccctgag

SEQ ID NO: 51153 - DNA, 16 bp, H. sapiens
atgcaaagtattgatt

SEQ ID NO: 51154 - DNA, 16 bp, H. sapiens
atgcaaagtatttttc

SEQ ID NO: 51155 - DNA, 16 bp, H. sapiens
atgcaaataaataaat

SEQ ID NO: 51156 - DNA, 16 bp, H. sapiens
atgcaaataccatgcc

SEQ ID NO: 51157 - DNA, 16 bp, H. sapiens
atgcaaatactccaaa

SEQ ID NO: 51158 - DNA, 16 bp, H. sapiens
atgcaaatattagaaa

SEQ ID NO: 51159 - DNA, 16 bp, H. sapiens
atgcaaatattccaaa

SEQ ID NO: 51160 - DNA, 16 bp, H. sapiens
atgcaaatattgaaaa

SEQ ID NO: 51161 - DNA, 16 bp, H. sapiens
atgcaaatcaataaat

SEQ ID NO: 51162 - DNA, 16 bp, H. sapiens
atgcaaatgaaaaaca

SEQ ID NO: 51163 - DNA, 16 bp, H. sapiens
atgcaaatgaaaagca

SEQ ID NO: 51164 - DNA, 16 bp, H. sapiens
atgcaaatgaactaga

SEQ ID NO: 51165 - DNA, 16 bp, H. sapiens
atgcaaatgcaggcca

SEQ ID NO: 51166 - DNA, 16 bp, H. sapiens
atgcaaattaaaacta

SEQ ID NO: 51167 - DNA, 16 bp, H. sapiens
atgcaacaaaagcagt

SEQ ID NO: 51168 - DNA, 16 bp, H. sapiens
atgcaacaaatattta

SEQ ID NO: 51169 - DNA, 16 bp, H. sapiens
atgcaacagaaaagaa

SEQ ID NO: 51170 - DNA, 16 bp, H. sapiens
atgcaacagaaacaaa

SEQ ID NO: 51171 - DNA, 16 bp, H. sapiens
atgcaaccaccaccac

SEQ ID NO: 51172 - DNA, 16 bp, H. sapiens
atgcaaccatcaccac

SEQ ID NO: 51173 - DNA, 16 bp, H. sapiens
atgcaaccatgcccag

SEQ ID NO: 51174 - DNA, 16 bp, H. sapiens
atgcaagaaaaaaatg

SEQ ID NO: 51175 - DNA, 16 bp, H. sapiens
atgcaagaagagaaaa

SEQ ID NO: 51176 - DNA, 17 bp, H. sapiens
atgcaagactggttcaa

SEQ ID NO: 51177 - DNA, 16 bp, H. sapiens
atgcaagatgttaata

SEQ ID NO: 51178 - DNA, 16 bp, H. sapiens
atgcaaggatggaaga

SEQ ID NO: 51179 - DNA, 16 bp, H. sapiens
atgcaaggcttgttca

SEQ ID NO: 51180 - DNA, 16 bp, H. sapiens
atgcaaggttggttaa

SEQ ID NO: 51181 - DNA, 16 bp, H. sapiens
atgcaaggttggttca

SEQ ID NO: 51182 - DNA, 16 bp, H. sapiens
atgcaagtaaataaat

SEQ ID NO: 51183 - DNA, 16 bp, H. sapiens
atgcaagtgatgggga

SEQ ID NO: 51184 - DNA, 16 bp, H. sapiens
atgcaataaaatatga

SEQ ID NO: 51185 - DNA, 16 bp, H. sapiens
atgcaatattttaaat

SEQ ID NO: 51186 - DNA, 16 bp, H. sapiens
atgcaatcaactggaa

SEQ ID NO: 51187 - DNA, 16 bp, H. sapiens
atgcaatgcctatcaa

SEQ ID NO: 51188 - DNA, 16 bp, H. sapiens
atgcaatggaaaagaa

SEQ ID NO: 51189 - DNA, 16 bp, H. sapiens
atgcaatggaatacta

SEQ ID NO: 51190 - DNA, 17 bp, H. sapiens
atgcaatggcgtgatct

SEQ ID NO: 51191 - DNA, 16 bp, H. sapiens
atgcaatgtgtaatga

SEQ ID NO: 51192 - DNA, 16 bp, H. sapiens
atgcaattctcatcaa

SEQ ID NO: 51193 - DNA, 16 bp, H. sapiens
atgcacaaaaatcact

SEQ ID NO: 51194 - DNA, 16 bp, H. sapiens
atgcacaaaaggcctt

SEQ ID NO: 51195 - DNA, 16 bp, H. sapiens
atgcacaaagatgttc

SEQ ID NO: 51196 - DNA, 19 bp, H. sapiens
atgcacaagcttcagtagc

SEQ ID NO: 51197 - DNA, 16 bp, H. sapiens
atgcacacacacaaat

SEQ ID NO: 51198 - DNA, 18 bp, H. sapiens
atgcacacacacacacat

SEQ ID NO: 51199 - DNA, 16 bp, H. sapiens
atgcacacacatatat

SEQ ID NO: 51200 - DNA, 16 bp, H. sapiens
atgcacacacatgtgt

SEQ ID NO: 51201 - DNA, 16 bp, H. sapiens
atgcacacacgtgcac

SEQ ID NO: 51202 - DNA, 16 bp, H. sapiens
atgcacacagatgttt

SEQ ID NO: 51203 - DNA, 16 bp, H. sapiens
atgcacacatacacag

SEQ ID NO: 51204 - DNA, 16 bp, H. sapiens
atgcacacatatacat

SEQ ID NO: 51205 - DNA, 16 bp, H. sapiens
atgcacacatgtgcac

SEQ ID NO: 51206 - DNA, 16 bp, H. sapiens
atgcacacattacaaa

SEQ ID NO: 51207 - DNA, 16 bp, H. sapiens
atgcacacccagctga

SEQ ID NO: 51208 - DNA, 16 bp, H. sapiens
atgcacacgtgcacac

SEQ ID NO: 51209 - DNA, 16 bp, H. sapiens
atgcacactcacacac

SEQ ID NO: 51210 - DNA, 16 bp, H. sapiens
atgcacagacatacac

SEQ ID NO: 51211 - DNA, 16 bp, H. sapiens
atgcacagcctcccca

SEQ ID NO: 51212 - DNA, 16 bp, H. sapiens
atgcacagtttgaaaa

SEQ ID NO: 51213 - DNA, 16 bp, H. sapiens
atgcacatacacacat

SEQ ID NO: 51214 - DNA, 16 bp, H. sapiens
atgcacatacacatgt

SEQ ID NO: 51215 - DNA, 16 bp, H. sapiens
atgcacatacatgttt

SEQ ID NO: 51216 - DNA, 16 bp, H. sapiens
atgcacatgtacatat

SEQ ID NO: 51217 - DNA, 16 bp, H. sapiens
atgcaccaccacacca

SEQ ID NO: 51218 - DNA, 16 bp, H. sapiens
atgcaccaccacaccc

SEQ ID NO: 51219 - DNA, 16 bp, H. sapiens
atgcacccaacagtgg

SEQ ID NO: 51220 - DNA, 40 bp, H. sapiens
atgcacccaatacaggagcacccagattcataaagcaagt

SEQ ID NO: 51221 - DNA, 16 bp, H. sapiens
atgcacccaccttggc

SEQ ID NO: 51222 - DNA, 16 bp, H. sapiens
atgcacccctgaacct

SEQ ID NO: 51223 - DNA, 17 bp, H. sapiens
atgcacccggtacctca

SEQ ID NO: 51224 - DNA, 17 bp, H. sapiens
atgcacctggaaaagct

SEQ ID NO: 51225 - DNA, 16 bp, H. sapiens
atgcacgcacacgcac

SEQ ID NO: 51226 - DNA, 16 bp, H. sapiens
atgcacgtgtgtgtgt

SEQ ID NO: 51227 - DNA, 16 bp, H. sapiens
atgcacttaaaaatgg

SEQ ID NO: 51228 - DNA, 16 bp, H. sapiens
atgcacttgagcaggg

SEQ ID NO: 51229 - DNA, 16 bp, H. sapiens
atgcactttatttctt

SEQ ID NO: 51230 - DNA, 16 bp, H. sapiens
atgcagaaaaactgaa

SEQ ID NO: 51231 - DNA, 16 bp, H. sapiens
atgcagaaaaaggcat

SEQ ID NO: 51232 - DNA, 16 bp, H. sapiens
atgcagaaaaatgaaa

SEQ ID NO: 51233 - DNA, 16 bp, H. sapiens
atgcagaaaacagaaa

SEQ ID NO: 51234 - DNA, 16 bp, H. sapiens
atgcagaaaagtcttt

SEQ ID NO: 51235 - DNA, 16 bp, H. sapiens
atgcagaaaatgcttt

SEQ ID NO: 51236 - DNA, 16 bp, H. sapiens
atgcagaaaattgaaa

SEQ ID NO: 51237 - DNA, 16 bp, H. sapiens
atgcagaaacatgaaa

SEQ ID NO: 51238 - DNA, 16 bp, H. sapiens
atgcagaaacctcagg

SEQ ID NO: 51239 - DNA, 16 bp, H. sapiens
atgcagaaactgaggc

SEQ ID NO: 51240 - DNA, 16 bp, H. sapiens
atgcagaaagatgaaa

SEQ ID NO: 51241 - DNA, 16 bp, H. sapiens
atgcagaaataaaata

SEQ ID NO: 51242 - DNA, 16 bp, H. sapiens
atgcagaaataatggc

SEQ ID NO: 51243 - DNA, 16 bp, H. sapiens
atgcagaaatagaaaa

SEQ ID NO: 51244 - DNA, 16 bp, H. sapiens
atgcagaaatttgcat

SEQ ID NO: 51245 - DNA, 16 bp, H. sapiens
atgcagaaccatgagt

SEQ ID NO: 51246 - DNA, 16 bp, H. sapiens
atgcagaacctgcaga

SEQ ID NO: 51247 - DNA, 16 bp, H. sapiens
atgcagaagaagcatt

SEQ ID NO: 51248 - DNA, 16 bp, H. sapiens
atgcagaagaaggaaa

SEQ ID NO: 51249 - DNA, 16 bp, H. sapiens
atgcagaagaatgaaa

SEQ ID NO: 51250 - DNA, 16 bp, H. sapiens
atgcagaagacagatg

SEQ ID NO: 51251 - DNA, 16 bp, H. sapiens
atgcagaagattttta

SEQ ID NO: 51252 - DNA, 16 bp, H. sapiens
atgcagaagcctcagt

SEQ ID NO: 51253 - DNA, 16 bp, H. sapiens
atgcagaagggaaatg

SEQ ID NO: 51254 - DNA, 16 bp, H. sapiens
atgcagaaggtgggtg

SEQ ID NO: 51255 - DNA, 16 bp, H. sapiens
atgcagaatacacatt

SEQ ID NO: 51256 - DNA, 16 bp, H. sapiens
atgcagaatttcaggc

SEQ ID NO: 51257 - DNA, 16 bp, H. sapiens
atgcagacataaaaat

SEQ ID NO: 51258 - DNA, 16 bp, H. sapiens
atgcagagaaaagaga

SEQ ID NO: 51259 - DNA, 16 bp, H. sapiens
atgcagagaaagcatt

SEQ ID NO: 51260 - DNA, 16 bp, H. sapiens
atgcagagaaatggaa

SEQ ID NO: 51261 - DNA, 16 bp, H. sapiens
atgcagagaaggcctt

SEQ ID NO: 51262 - DNA, 16 bp, H. sapiens
atgcagaggttgtggt

SEQ ID NO: 51263 - DNA, 16 bp, H. sapiens
atgcagatattccaaa

SEQ ID NO: 51264 - DNA, 16 bp, H. sapiens
atgcagatcaactatt

SEQ ID NO: 51265 - DNA, 16 bp, H. sapiens
atgcagattcctgggc

SEQ ID NO: 51266 - DNA, 16 bp, H. sapiens
atgcagattttaaaat

SEQ ID NO: 51267 - DNA, 16 bp, H. sapiens
atgcagattttctttt

SEQ ID NO: 51268 - DNA, 16 bp, H. sapiens
atgcagcaaacttcat

SEQ ID NO: 51269 - DNA, 16 bp, H. sapiens
atgcagcaatcccact

SEQ ID NO: 51270 - DNA, 16 bp, H. sapiens
atgcagcaggtgctca

SEQ ID NO: 51271 - DNA, 16 bp, H. sapiens
atgcagccaagaaaca

SEQ ID NO: 51272 - DNA, 16 bp, H. sapiens
atgcagccaagctctt

SEQ ID NO: 51273 - DNA, 16 bp, H. sapiens
atgcagccagcaaaca

SEQ ID NO: 51274 - DNA, 16 bp, H. sapiens
atgcagccagcagaca

SEQ ID NO: 51275 - DNA, 16 bp, H. sapiens
atgcagccaggaggaa

SEQ ID NO: 51276 - DNA, 16 bp, H. sapiens
atgcagccataaaagg

SEQ ID NO: 51277 - DNA, 16 bp, H. sapiens
atgcagccattgactt

SEQ ID NO: 51278 - DNA, 16 bp, H. sapiens
atgcagccgtaaaaaa

SEQ ID NO: 51279 - DNA, 16 bp, H. sapiens
atgcagcctctgcctc

SEQ ID NO: 51280 - DNA, 16 bp, H. sapiens
atgcagctacaagcca

SEQ ID NO: 51281 - DNA, 16 bp, H. sapiens
atgcagctattttcat

SEQ ID NO: 51282 - DNA, 16 bp, H. sapiens
atgcagctgaaaaaca

SEQ ID NO: 51283 - DNA, 16 bp, H. sapiens
atgcagctgaaggcca

SEQ ID NO: 51284 - DNA, 16 bp, H. sapiens
atgcagctgcaagcca

SEQ ID NO: 51285 - DNA, 16 bp, H. sapiens
atgcagctgctgtgga

SEQ ID NO: 51286 - DNA, 16 bp, H. sapiens
atgcagctggagatct

SEQ ID NO: 51287 - DNA, 16 bp, H. sapiens
atgcagctggaggcca

SEQ ID NO: 51288 - DNA, 16 bp, H. sapiens
atgcagctgggcatgg

SEQ ID NO: 51289 - DNA, 16 bp, H. sapiens
atgcaggaatggttta

SEQ ID NO: 51290 - DNA, 16 bp, H. sapiens
atgcaggagctggttt

SEQ ID NO: 51291 - DNA, 16 bp, H. sapiens
atgcaggaggctgaag

SEQ ID NO: 51292 - DNA, 16 bp, H. sapiens
atgcaggaggctgaga

SEQ ID NO: 51293 - DNA, 16 bp, H. sapiens
atgcaggaggtggagg

SEQ ID NO: 51294 - DNA, 16 bp, H. sapiens
atgcaggcaacagaca

SEQ ID NO: 51295 - DNA, 16 bp, H. sapiens
atgcaggctggagtgc

SEQ ID NO: 51296 - DNA, 16 bp, H. sapiens
atgcaggggaaactgc

SEQ ID NO: 51297 - DNA, 16 bp, H. sapiens
atgcagtaaatattta

SEQ ID NO: 51298 - DNA, 16 bp, H. sapiens
atgcagtaagtgctca

SEQ ID NO: 51299 - DNA, 16 bp, H. sapiens
atgcagtactattcag

SEQ ID NO: 51300 - DNA, 16 bp, H. sapiens
atgcagtagctcacac

SEQ ID NO: 51301 - DNA, 16 bp, H. sapiens
atgcagtccatcactg

SEQ ID NO: 51302 - DNA, 16 bp, H. sapiens
atgcagtctatcactg

SEQ ID NO: 51303 - DNA, 18 bp, H. sapiens
atgcagtcttgcaagcct

SEQ ID NO: 51304 - DNA, 16 bp, H. sapiens
atgcagtgagccaaga

SEQ ID NO: 51305 - DNA, 16 bp, H. sapiens
atgcagtgagccgaga

SEQ ID NO: 51306 - DNA, 16 bp, H. sapiens
atgcagtgatgcaatc

SEQ ID NO: 51307 - DNA, 17 bp, H. sapiens
atgcagtggcatgatct

SEQ ID NO: 51308 - DNA, 18 bp, H. sapiens
atgcagtggcatgatctt

SEQ ID NO: 51309 - DNA, 18 bp, H. sapiens
atgcagtggcgtgatctt

SEQ ID NO: 51310 - DNA, 16 bp, H. sapiens
atgcagtttcttcata

SEQ ID NO: 51311 - DNA, 16 bp, H. sapiens
atgcagtttctttttt

SEQ ID NO: 51312 - DNA, 16 bp, H. sapiens
atgcagttttcttttt

SEQ ID NO: 51313 - DNA, 16 bp, H. sapiens
atgcagtttttaaaaa

SEQ ID NO: 51314 - DNA, 16 bp, H. sapiens
atgcataaaaattaaa

SEQ ID NO: 51315 - DNA, 16 bp, H. sapiens
atgcataaaatgaaat

SEQ ID NO: 51316 - DNA, 16 bp, H. sapiens
atgcatatacatacat

SEQ ID NO: 51317 - DNA, 16 bp, H. sapiens
atgcatatacatgtgt

SEQ ID NO: 51318 - DNA, 16 bp, H. sapiens
atgcatatatacatat

SEQ ID NO: 51319 - DNA, 16 bp, H. sapiens
atgcatatcctcctgt

SEQ ID NO: 51320 - DNA, 16 bp, H. sapiens
atgcatatgtaaatta

SEQ ID NO: 51321 - DNA, 16 bp, H. sapiens
atgcatatttaaaaat

SEQ ID NO: 51322 - DNA, 16 bp, H. sapiens
atgcatattttaatat

SEQ ID NO: 51323 - DNA, 16 bp, H. sapiens
atgcatatttttattt

SEQ ID NO: 51324 - DNA, 16 bp, H. sapiens
atgcatatttttttaa

SEQ ID NO: 51325 - DNA, 16 bp, H. sapiens
atgcatcaccacaccc

SEQ ID NO: 51326 - DNA, 16 bp, H. sapiens
atgcatccaaatagga

SEQ ID NO: 51327 - DNA, 16 bp, H. sapiens
atgcatctgtaattcc

SEQ ID NO: 51328 - DNA, 16 bp, H. sapiens
atgcatctttaactta

SEQ ID NO: 51329 - DNA, 16 bp, H. sapiens
atgcatgaatttattt

SEQ ID NO: 51330 - DNA, 16 bp, H. sapiens
atgcatgattttgtaa

SEQ ID NO: 51331 - DNA, 16 bp, H. sapiens
atgcatgcaacaaaat

SEQ ID NO: 51332 - DNA, 16 bp, H. sapiens
atgcatgcatatacat

SEQ ID NO: 51333 - DNA, 16 bp, H. sapiens
atgcatgcatgtgtgt

SEQ ID NO: 51334 - DNA, 16 bp, H. sapiens
atgcatgcatttattt

SEQ ID NO: 51335 - DNA, 16 bp, H. sapiens
atgcatggattttttt

SEQ ID NO: 51336 - DNA, 16 bp, H. sapiens
atgcatggctaatttt

SEQ ID NO: 51337 - DNA, 16 bp, H. sapiens
atgcatgggtagatgg

SEQ ID NO: 51338 - DNA, 16 bp, H. sapiens
atgcatgtaatcccaa

SEQ ID NO: 51339 - DNA, 16 bp, H. sapiens
atgcatgtattttaaa

SEQ ID NO: 51340 - DNA, 16 bp, H. sapiens
atgcatgtgcctttat

SEQ ID NO: 51341 - DNA, 16 bp, H. sapiens
atgcatgtgtatacac

SEQ ID NO: 51342 - DNA, 16 bp, H. sapiens
atgcatgtgtatgtat

SEQ ID NO: 51343 - DNA, 16 bp, H. sapiens
atgcatgtgtatgtgt

SEQ ID NO: 51344 - DNA, 17 bp, H. sapiens
atgcatgtgtctgtgtg

SEQ ID NO: 51345 - DNA, 16 bp, H. sapiens
atgcatgtgtgtatgt

SEQ ID NO: 51346 - DNA, 16 bp, H. sapiens
atgcatgttcattgca

SEQ ID NO: 51347 - DNA, 16 bp, H. sapiens
atgcatgttgaaattt

SEQ ID NO: 51348 - DNA, 16 bp, H. sapiens
atgcatgtttataaca

SEQ ID NO: 51349 - DNA, 16 bp, H. sapiens
atgcatgttttcattt

SEQ ID NO: 51350 - DNA, 16 bp, H. sapiens
atgcattcatttattc

SEQ ID NO: 51351 - DNA, 16 bp, H. sapiens
atgcattcatttcttt

SEQ ID NO: 51352 - DNA, 16 bp, H. sapiens
atgcattgctggtggg

SEQ ID NO: 51353 - DNA, 16 bp, H. sapiens
atgcattgtttggttt

SEQ ID NO: 51354 - DNA, 16 bp, H. sapiens
atgcatttaaaaaaat

SEQ ID NO: 51355 - DNA, 16 bp, H. sapiens
atgcatttaaaaataa

SEQ ID NO: 51356 - DNA, 16 bp, H. sapiens
atgcatttaacaaata

SEQ ID NO: 51357 - DNA, 16 bp, H. sapiens
atgcatttataatttt

SEQ ID NO: 51358 - DNA, 16 bp, H. sapiens
atgcatttatcaaaac

SEQ ID NO: 51359 - DNA, 16 bp, H. sapiens
atgcatttattcattc

SEQ ID NO: 51360 - DNA, 16 bp, H. sapiens
atgcatttatttaaaa

SEQ ID NO: 51361 - DNA, 16 bp, H. sapiens
atgcatttattttaaa

SEQ ID NO: 51362 - DNA, 16 bp, H. sapiens
atgcatttatttttat

SEQ ID NO: 51363 - DNA, 16 bp, H. sapiens
atgcatttctttttct

SEQ ID NO: 51364 - DNA, 16 bp, H. sapiens
atgcatttgaaaatat

SEQ ID NO: 51365 - DNA, 16 bp, H. sapiens
atgcatttgtaatttt

SEQ ID NO: 51366 - DNA, 16 bp, H. sapiens
atgcatttgtttcttt

SEQ ID NO: 51367 - DNA, 16 bp, H. sapiens
atgcatttgtttttat

SEQ ID NO: 51368 - DNA, 16 bp, H. sapiens
atgcattttaaaactt

SEQ ID NO: 51369 - DNA, 16 bp, H. sapiens
atgcattttgattttt

SEQ ID NO: 51370 - DNA, 16 bp, H. sapiens
atgcatttttaaaatt

SEQ ID NO: 51371 - DNA, 16 bp, H. sapiens
atgcatttttcaaaac

SEQ ID NO: 51372 - DNA, 16 bp, H. sapiens
atgcattttttaaaat

SEQ ID NO: 51373 - DNA, 16 bp, H. sapiens
atgcattttttcttct

SEQ ID NO: 51374 - DNA, 16 bp, H. sapiens
atgccaaaatcctcaa

SEQ ID NO: 51375 - DNA, 16 bp, H. sapiens
atgccaaatctactct

SEQ ID NO: 51376 - DNA, 16 bp, H. sapiens
atgccaacaaactgga

SEQ ID NO: 51377 - DNA, 16 bp, H. sapiens
atgccaagctaatttt

SEQ ID NO: 51378 - DNA, 16 bp, H. sapiens
atgccaaggtgggcag

SEQ ID NO: 51379 - DNA, 16 bp, H. sapiens
atgccaagtgaaataa

SEQ ID NO: 51380 - DNA, 16 bp, H. sapiens
atgccaagtgtgtggt

SEQ ID NO: 51381 - DNA, 16 bp, H. sapiens
atgccaatcagaatgg

SEQ ID NO: 51382 - DNA, 16 bp, H. sapiens
atgccacattttattt

SEQ ID NO: 51383 - DNA, 16 bp, H. sapiens
atgccacatttttttt

SEQ ID NO: 51384 - DNA, 16 bp, H. sapiens
atgccaccacacccag

SEQ ID NO: 51385 - DNA, 16 bp, H. sapiens
atgccaccacactggg

SEQ ID NO: 51386 - DNA, 16 bp, H. sapiens
atgccaccacagccag

SEQ ID NO: 51387 - DNA, 16 bp, H. sapiens
atgccaccaccaccac

SEQ ID NO: 51388 - DNA, 16 bp, H. sapiens
atgccaccacccccag

SEQ ID NO: 51389 - DNA, 24 bp, H. sapiens
atgccaccacgcccggctaatttt

SEQ ID NO: 51390 - DNA, 18 bp, H. sapiens
atgccaccacgcctggct

SEQ ID NO: 51391 - DNA, 16 bp, H. sapiens
atgccaccatccccag

SEQ ID NO: 51392 - DNA, 16 bp, H. sapiens
atgccaccatgcatgg

SEQ ID NO: 51393 - DNA, 18 bp, H. sapiens
atgccaccatgcccggct

SEQ ID NO: 51394 - DNA, 16 bp, H. sapiens
atgccaccctctacct

SEQ ID NO: 51395 - DNA, 16 bp, H. sapiens
atgccaccctgcccag

SEQ ID NO: 51396 - DNA, 21 bp, H. sapiens
atgccactgcactccagccta

SEQ ID NO: 51397 - DNA, 16 bp, H. sapiens
atgccagaaaaaaata

SEQ ID NO: 51398 - DNA, 16 bp, H. sapiens
atgccagaaggaagaa

SEQ ID NO: 51399 - DNA, 16 bp, H. sapiens
atgccagcacttcctt

SEQ ID NO: 51400 - DNA, 16 bp, H. sapiens
atgccagcatcatgct

SEQ ID NO: 51401 - DNA, 16 bp, H. sapiens
atgccagccctgagat

SEQ ID NO: 51402 - DNA, 16 bp, H. sapiens
atgccagcgccatgct

SEQ ID NO: 51403 - DNA, 16 bp, H. sapiens
atgccaggcactgttt

SEQ ID NO: 51404 - DNA, 16 bp, H. sapiens
atgccaggccctgtgc

SEQ ID NO: 51405 - DNA, 16 bp, H. sapiens
atgccaggctaatttt

SEQ ID NO: 51406 - DNA, 16 bp, H. sapiens
atgccagtagcacact

SEQ ID NO: 51407 - DNA, 16 bp, H. sapiens
atgccagtattatgct

SEQ ID NO: 51408 - DNA, 16 bp, H. sapiens
atgccagtgccatgct

SEQ ID NO: 51409 - DNA, 16 bp, H. sapiens
atgccatattttgggg

SEQ ID NO: 51410 - DNA, 16 bp, H. sapiens
atgccatcaagaaagt

SEQ ID NO: 51411 - DNA, 16 bp, H. sapiens
atgccatcacatctgg

SEQ ID NO: 51412 - DNA, 23 bp, H. sapiens
atgccatcaccctcacagagccc

SEQ ID NO: 51413 - DNA, 16 bp, H. sapiens
atgccatctctattaa

SEQ ID NO: 51414 - DNA, 16 bp, H. sapiens
atgccatggtctcagt

SEQ ID NO: 51415 - DNA, 28 bp, H. sapiens
atgccatgtcaaatttgttctctatctt

SEQ ID NO: 51416 - DNA, 16 bp, H. sapiens
atgccattaagaacat

SEQ ID NO: 51417 - DNA, 16 bp, H. sapiens
atgccattatcacagg

SEQ ID NO: 51418 - DNA, 16 bp, H. sapiens
atgccattattttgtt

SEQ ID NO: 51419 - DNA, 16 bp, H. sapiens
atgccattcctatcaa

SEQ ID NO: 51420 - DNA, 16 bp, H. sapiens
atgccattctggaaaa

SEQ ID NO: 51421 - DNA, 16 bp, H. sapiens
atgccatttatttatt

SEQ ID NO: 51422 - DNA, 16 bp, H. sapiens
atgccattttacattt

SEQ ID NO: 51423 - DNA, 16 bp, H. sapiens
atgcccaaaagaaagg

SEQ ID NO: 51424 - DNA, 16 bp, H. sapiens
atgcccaactaatttt

SEQ ID NO: 51425 - DNA, 16 bp, H. sapiens
atgcccaacttgccaa

SEQ ID NO: 51426 - DNA, 16 bp, H. sapiens
atgcccacctaatttt

SEQ ID NO: 51427 - DNA, 35 bp, H. sapiens
atgcccacgttgcccaggccttcacagacccccaa

SEQ ID NO: 51428 - DNA, 16 bp, H. sapiens
atgcccactgtcacca

SEQ ID NO: 51429 - DNA, 16 bp, H. sapiens
atgcccacttaatttt

SEQ ID NO: 51430 - DNA, 16 bp, H. sapiens
atgcccagaagagaaa

SEQ ID NO: 51431 - DNA, 16 bp, H. sapiens
atgcccagacttcagg

SEQ ID NO: 51432 - DNA, 16 bp, H. sapiens
atgcccagataatttt

SEQ ID NO: 51433 - DNA, 16 bp, H. sapiens
atgcccagcacatttt

SEQ ID NO: 51434 - DNA, 16 bp, H. sapiens
atgcccagccagcttt

SEQ ID NO: 51435 - DNA, 16 bp, H. sapiens
atgcccagccctcatt

SEQ ID NO: 51436 - DNA, 16 bp, H. sapiens
atgcccagcctgaaat

SEQ ID NO: 51437 - DNA, 16 bp, H. sapiens
atgcccagctaattaa

SEQ ID NO: 51438 - DNA, 18 bp, H. sapiens
atgcccagctaatttttc

SEQ ID NO: 51439 - DNA, 16 bp, H. sapiens
atgcccagctactttt

SEQ ID NO: 51440 - DNA, 16 bp, H. sapiens
atgcccaggctggtct

SEQ ID NO: 51441 - DNA, 16 bp, H. sapiens
atgcccattttaaaga

SEQ ID NO: 51442 - DNA, 16 bp, H. sapiens
atgccccaccctgctt

SEQ ID NO: 51443 - DNA, 16 bp, H. sapiens
atgccccacctccaac

SEQ ID NO: 51444 - DNA, 16 bp, H. sapiens
atgccccagtgtgtga

SEQ ID NO: 51445 - DNA, 16 bp, H. sapiens
atgcccccatgcctgg

SEQ ID NO: 51446 - DNA, 16 bp, H. sapiens
atgcccctcccccagc

SEQ ID NO: 51447 - DNA, 16 bp, H. sapiens
atgcccgccaccacac

SEQ ID NO: 51448 - DNA, 16 bp, H. sapiens
atgcccggataatttt

SEQ ID NO: 51449 - DNA, 21 bp, H. sapiens
atgccctactcttgtttacac

SEQ ID NO: 51450 - DNA, 16 bp, H. sapiens
atgccctccagttcca

SEQ ID NO: 51451 - DNA, 16 bp, H. sapiens
atgccctccctcacca

SEQ ID NO: 51452 - DNA, 16 bp, H. sapiens
atgccctctctcagca

SEQ ID NO: 51453 - DNA, 16 bp, H. sapiens
atgccctctctcatca

SEQ ID NO: 51454 - DNA, 16 bp, H. sapiens
atgccctctttcacca

SEQ ID NO: 51455 - DNA, 16 bp, H. sapiens
atgccctgagccctgg

SEQ ID NO: 51456 - DNA, 16 bp, H. sapiens
atgccctgccctgctt

SEQ ID NO: 51457 - DNA, 16 bp, H. sapiens
atgccctgctaatttt

SEQ ID NO: 51458 - DNA, 16 bp, H. sapiens
atgccctggagacact

SEQ ID NO: 51459 - DNA, 16 bp, H. sapiens
atgcccttctcctgcc

SEQ ID NO: 51460 - DNA, 16 bp, H. sapiens
atgcccttctttgtat

SEQ ID NO: 51461 - DNA, 16 bp, H. sapiens
atgcccttttcttttt

SEQ ID NO: 51462 - DNA, 16 bp, H. sapiens
atgccgactcaggaca

SEQ ID NO: 51463 - DNA, 16 bp, H. sapiens
atgccgctgcactcta

SEQ ID NO: 51464 - DNA, 16 bp, H. sapiens
atgccgggcgtggtgg

SEQ ID NO: 51465 - DNA, 16 bp, H. sapiens
atgccgggctaatttt

SEQ ID NO: 51466 - DNA, 16 bp, H. sapiens
atgccgtgtttggttt

SEQ ID NO: 51467 - DNA, 16 bp, H. sapiens
atgcctaattttttaa

SEQ ID NO: 51468 - DNA, 16 bp, H. sapiens
atgcctacaccaaaaa

SEQ ID NO: 51469 - DNA, 16 bp, H. sapiens
atgcctacatgaaaaa

SEQ ID NO: 51470 - DNA, 16 bp, H. sapiens
atgcctagctaatttt

SEQ ID NO: 51471 - DNA, 16 bp, H. sapiens
atgcctaggaataaat

SEQ ID NO: 51472 - DNA, 16 bp, H. sapiens
atgcctataatcccaa

SEQ ID NO: 51473 - DNA, 16 bp, H. sapiens
atgcctataatctgag

SEQ ID NO: 51474 - DNA, 16 bp, H. sapiens
atgcctcaataaacat

SEQ ID NO: 51475 - DNA, 16 bp, H. sapiens
atgcctcagccacttg

SEQ ID NO: 51476 - DNA, 16 bp, H. sapiens
atgcctcatcctccca

SEQ ID NO: 51477 - DNA, 16 bp, H. sapiens
atgcctccaggtttat

SEQ ID NO: 51478 - DNA, 16 bp, H. sapiens
atgcctccccctttta

SEQ ID NO: 51479 - DNA, 16 bp, H. sapiens
atgcctcctcctccag

SEQ ID NO: 51480 - DNA, 16 bp, H. sapiens
atgcctcggcctcctg

SEQ ID NO: 51481 - DNA, 16 bp, H. sapiens
atgcctctaatcacag

SEQ ID NO: 51482 - DNA, 16 bp, H. sapiens
atgcctctccttttta

SEQ ID NO: 51483 - DNA, 16 bp, H. sapiens
atgcctctgctgatct

SEQ ID NO: 51484 - DNA, 16 bp, H. sapiens
atgcctctggttttgt

SEQ ID NO: 51485 - DNA, 16 bp, H. sapiens
atgcctgaaactgcag

SEQ ID NO: 51486 - DNA, 16 bp, H. sapiens
atgcctgagcccagga

SEQ ID NO: 51487 - DNA, 16 bp, H. sapiens
atgcctgatgtccagg

SEQ ID NO: 51488 - DNA, 16 bp, H. sapiens
atgcctgcagtcccag

SEQ ID NO: 51489 - DNA, 16 bp, H. sapiens
atgcctggaattccag

SEQ ID NO: 51490 - DNA, 16 bp, H. sapiens
atgcctggcacacagt

SEQ ID NO: 51491 - DNA, 16 bp, H. sapiens
atgcctggcacatagc

SEQ ID NO: 51492 - DNA, 16 bp, H. sapiens
atgcctggccaaaaac

SEQ ID NO: 51493 - DNA, 16 bp, H. sapiens
atgcctggccctctct

SEQ ID NO: 51494 - DNA, 16 bp, H. sapiens
atgcctggctaacttc

SEQ ID NO: 51495 - DNA, 16 bp, H. sapiens
atgcctggctaatttt

SEQ ID NO: 51496 - DNA, 16 bp, H. sapiens
atgcctggctattttt

SEQ ID NO: 51497 - DNA, 16 bp, H. sapiens
atgcctggctcagcag

SEQ ID NO: 51498 - DNA, 16 bp, H. sapiens
atgcctggctcagtgg

SEQ ID NO: 51499 - DNA, 16 bp, H. sapiens
atgcctggcttcaaag

SEQ ID NO: 51500 - DNA, 16 bp, H. sapiens
atgcctggctttaaag

SEQ ID NO: 51501 - DNA, 16 bp, H. sapiens
atgcctgtaatcttag

SEQ ID NO: 51502 - DNA, 16 bp, H. sapiens
atgcctgtaattacag

SEQ ID NO: 51503 - DNA, 16 bp, H. sapiens
atgcctgtagtcacag

SEQ ID NO: 51504 - DNA, 16 bp, H. sapiens
atgcctgtgaactgaa

SEQ ID NO: 51505 - DNA, 16 bp, H. sapiens
atgcctgtgcccccat

SEQ ID NO: 51506 - DNA, 16 bp, H. sapiens
atgcctgtggtcccag

SEQ ID NO: 51507 - DNA, 16 bp, H. sapiens
atgcctgtggtcctag

SEQ ID NO: 51508 - DNA, 16 bp, H. sapiens
atgccttatgtctccc

SEQ ID NO: 51509 - DNA, 16 bp, H. sapiens
atgccttcatcaagaa

SEQ ID NO: 51510 - DNA, 16 bp, H. sapiens
atgccttccctacagt

SEQ ID NO: 51511 - DNA, 16 bp, H. sapiens
atgccttcctaacagt

SEQ ID NO: 51512 - DNA, 16 bp, H. sapiens
atgccttcctggaggt

SEQ ID NO: 51513 - DNA, 16 bp, H. sapiens
atgccttggtttcctc

SEQ ID NO: 51514 - DNA, 16 bp, H. sapiens
atgccttgtaattttt

SEQ ID NO: 51515 - DNA, 16 bp, H. sapiens
atgccttgtatttctt

SEQ ID NO: 51516 - DNA, 16 bp, H. sapiens
atgcctttaatttctt

SEQ ID NO: 51517 - DNA, 16 bp, H. sapiens
atgcctttcttatagc

SEQ ID NO: 51518 - DNA, 16 bp, H. sapiens
atgccttttatttctt

SEQ ID NO: 51519 - DNA, 16 bp, H. sapiens
atgcgccagcacgccc

SEQ ID NO: 51520 - DNA, 16 bp, H. sapiens
atgcgcctgtagtccc

SEQ ID NO: 51521 - DNA, 16 bp, H. sapiens
atgcgcgcgcgcgcgc

SEQ ID NO: 51522 - DNA, 16 bp, H. sapiens
atgcggagaaaaggga

SEQ ID NO: 51523 - DNA, 16 bp, H. sapiens
atgcgggaggcagagg

SEQ ID NO: 51524 - DNA, 16 bp, H. sapiens
atgcgggaggctgagg

SEQ ID NO: 51525 - DNA, 16 bp, H. sapiens
atgcggtggtgtgatc

SEQ ID NO: 51526 - DNA, 16 bp, H. sapiens
atgctaaaaaataatg

SEQ ID NO: 51527 - DNA, 16 bp, H. sapiens
atgctaaataaatatt

SEQ ID NO: 51528 - DNA, 16 bp, H. sapiens
atgctaaataaattat

SEQ ID NO: 51529 - DNA, 16 bp, H. sapiens
atgctaaatgtgacat

SEQ ID NO: 51530 - DNA, 16 bp, H. sapiens
atgctaaattaaataa

SEQ ID NO: 51531 - DNA, 16 bp, H. sapiens
atgctaacattaatca

SEQ ID NO: 51532 - DNA, 16 bp, H. sapiens
atgctaagtgaaaaaa

SEQ ID NO: 51533 - DNA, 16 bp, H. sapiens
atgctaagtgaaataa

SEQ ID NO: 51534 - DNA, 17 bp, H. sapiens
atgctaatctcctttgg

SEQ ID NO: 51535 - DNA, 16 bp, H. sapiens
atgctaattattatta

SEQ ID NO: 51536 - DNA, 16 bp, H. sapiens
atgctaatttaaaaat

SEQ ID NO: 51537 - DNA, 16 bp, H. sapiens
atgctacaaatggaaa

SEQ ID NO: 51538 - DNA, 16 bp, H. sapiens
atgctacaaggctaca

SEQ ID NO: 51539 - DNA, 16 bp, H. sapiens
atgctacagatttttg

SEQ ID NO: 51540 - DNA, 16 bp, H. sapiens
atgctacagggaaatc

SEQ ID NO: 51541 - DNA, 16 bp, H. sapiens
atgctaccacgcccag

SEQ ID NO: 51542 - DNA, 16 bp, H. sapiens
atgctaccatgcccag

SEQ ID NO: 51543 - DNA, 16 bp, H. sapiens
atgctaccatgcctgg

SEQ ID NO: 51544 - DNA, 16 bp, H. sapiens
atgctactgagttttg

SEQ ID NO: 51545 - DNA, 16 bp, H. sapiens
atgctatattttcttt

SEQ ID NO: 51546 - DNA, 16 bp, H. sapiens
atgctattatgaacat

SEQ ID NO: 51547 - DNA, 16 bp, H. sapiens
atgctattctcatcaa

SEQ ID NO: 51548 - DNA, 16 bp, H. sapiens
atgctattgtgaatgg

SEQ ID NO: 51549 - DNA, 16 bp, H. sapiens
atgctatttccatcaa

SEQ ID NO: 51550 - DNA, 16 bp, H. sapiens
atgctatttctttctg

SEQ ID NO: 51551 - DNA, 16 bp, H. sapiens
atgctattttttaaat

SEQ ID NO: 51552 - DNA, 16 bp, H. sapiens
atgctcaacatcattg

SEQ ID NO: 51553 - DNA, 16 bp, H. sapiens
atgctcaaggaaataa

SEQ ID NO: 51554 - DNA, 16 bp, H. sapiens
atgctcaataaataat

SEQ ID NO: 51555 - DNA, 16 bp, H. sapiens
atgctcaataaatatc

SEQ ID NO: 51556 - DNA, 16 bp, H. sapiens
atgctcaataaatatt

SEQ ID NO: 51557 - DNA, 16 bp, H. sapiens
atgctcaataaatgtt

SEQ ID NO: 51558 - DNA, 17 bp, H. sapiens
atgctcagctaattttg

SEQ ID NO: 51559 - DNA, 16 bp, H. sapiens
atgctcagtaaatgtt

SEQ ID NO: 51560 - DNA, 16 bp, H. sapiens
atgctcatcatcaccg

SEQ ID NO: 51561 - DNA, 16 bp, H. sapiens
atgctcatcatcattg

SEQ ID NO: 51562 - DNA, 16 bp, H. sapiens
atgctcatcttcactg

SEQ ID NO: 51563 - DNA, 16 bp, H. sapiens
atgctccaggcactgt

SEQ ID NO: 51564 - DNA, 16 bp, H. sapiens
atgctccaggttcatc

SEQ ID NO: 51565 - DNA, 16 bp, H. sapiens
atgctccatcaaaaga

SEQ ID NO: 51566 - DNA, 16 bp, H. sapiens
atgctcccagcttttg

SEQ ID NO: 51567 - DNA, 16 bp, H. sapiens
atgctccctctggagg

SEQ ID NO: 51568 - DNA, 16 bp, H. sapiens
atgctctccctcccct

SEQ ID NO: 51569 - DNA, 16 bp, H. sapiens
atgctctgatctttat

SEQ ID NO: 51570 - DNA, 16 bp, H. sapiens
atgctgaaaaagtatt

SEQ ID NO: 51571 - DNA, 16 bp, H. sapiens
atgctgaaaatgatga

SEQ ID NO: 51572 - DNA, 16 bp, H. sapiens
atgctgaactgtgagt

SEQ ID NO: 51573 - DNA, 16 bp, H. sapiens
atgctgaaggagcaga

SEQ ID NO: 51574 - DNA, 16 bp, H. sapiens
atgctgaatgaaaaaa

SEQ ID NO: 51575 - DNA, 16 bp, H. sapiens
atgctgaattacattt

SEQ ID NO: 51576 - DNA, 16 bp, H. sapiens
atgctgagatttgggg

SEQ ID NO: 51577 - DNA, 16 bp, H. sapiens
atgctgagctgcctgg

SEQ ID NO: 51578 - DNA, 16 bp, H. sapiens
atgctgaggctgctgg

SEQ ID NO: 51579 - DNA, 16 bp, H. sapiens
atgctgagggattttg

SEQ ID NO: 51580 - DNA, 16 bp, H. sapiens
atgctgaggtttggag

SEQ ID NO: 51581 - DNA, 16 bp, H. sapiens
atgctgatagtgatgt

SEQ ID NO: 51582 - DNA, 16 bp, H. sapiens
atgctgatatgaacat

SEQ ID NO: 51583 - DNA, 16 bp, H. sapiens
atgctgatgaagatgt

SEQ ID NO: 51584 - DNA, 16 bp, H. sapiens
atgctgatgctgctgg

SEQ ID NO: 51585 - DNA, 16 bp, H. sapiens
atgctgatggctgctg

SEQ ID NO: 51586 - DNA, 16 bp, H. sapiens
atgctgattttctttt

SEQ ID NO: 51587 - DNA, 16 bp, H. sapiens
atgctgcaaattttcc

SEQ ID NO: 51588 - DNA, 16 bp, H. sapiens
atgctgcaatgaacct

SEQ ID NO: 51589 - DNA, 16 bp, H. sapiens
atgctgcagtaacaaa

SEQ ID NO: 51590 - DNA, 16 bp, H. sapiens
atgctgcagtcttgag

SEQ ID NO: 51591 - DNA, 16 bp, H. sapiens
atgctgccacaagcca

SEQ ID NO: 51592 - DNA, 16 bp, H. sapiens
atgctgccaggcctgg

SEQ ID NO: 51593 - DNA, 16 bp, H. sapiens
atgctgccagtctgtt

SEQ ID NO: 51594 - DNA, 16 bp, H. sapiens
atgctgccatgcctgg

SEQ ID NO: 51595 - DNA, 16 bp, H. sapiens
atgctgcctgctgtgc

SEQ ID NO: 51596 - DNA, 16 bp, H. sapiens
atgctgctatgaacat

SEQ ID NO: 51597 - DNA, 16 bp, H. sapiens
atgctgctgaggatgt

SEQ ID NO: 51598 - DNA, 16 bp, H. sapiens
atgctgctgataaaaa

SEQ ID NO: 51599 - DNA, 16 bp, H. sapiens
atgctgctgctcatct

SEQ ID NO: 51600 - DNA, 16 bp, H. sapiens
atgctgctgctctgcc

SEQ ID NO: 51601 - DNA, 17 bp, H. sapiens
atgctgctgctgctggt

SEQ ID NO: 51602 - DNA, 16 bp, H. sapiens
atgctgctggtctggg

SEQ ID NO: 51603 - DNA, 16 bp, H. sapiens
atgctgctgtgaacat

SEQ ID NO: 51604 - DNA, 16 bp, H. sapiens
atgctgctgtgctgca

SEQ ID NO: 51605 - DNA, 16 bp, H. sapiens
atgctggacaagaacc

SEQ ID NO: 51606 - DNA, 16 bp, H. sapiens
atgctggacaagagct

SEQ ID NO: 51607 - DNA, 16 bp, H. sapiens
atgctggagaggaagt

SEQ ID NO: 51608 - DNA, 16 bp, H. sapiens
atgctggagcttctgg

SEQ ID NO: 51609 - DNA, 16 bp, H. sapiens
atgctggatatcagac

SEQ ID NO: 51610 - DNA, 16 bp, H. sapiens
atgctggcacatgcct

SEQ ID NO: 51611 - DNA, 16 bp, H. sapiens
atgctggcaccatgct

SEQ ID NO: 51612 - DNA, 16 bp, H. sapiens
atgctggcacctggag

SEQ ID NO: 51613 - DNA, 16 bp, H. sapiens
atgctggccagcctgg

SEQ ID NO: 51614 - DNA, 16 bp, H. sapiens
atgctggccaggctgt

SEQ ID NO: 51615 - DNA, 17 bp, H. sapiens
atgctggctaacacggt

SEQ ID NO: 51616 - DNA, 21 bp, H. sapiens
atgctgggattacaggcgtga

SEQ ID NO: 51617 - DNA, 16 bp, H. sapiens
atgctgggcacggtgg

SEQ ID NO: 51618 - DNA, 16 bp, H. sapiens
atgctggggtctggag

SEQ ID NO: 51619 - DNA, 16 bp, H. sapiens
atgctggggtgcagtg

SEQ ID NO: 51620 - DNA, 16 bp, H. sapiens
atgctgggtgcagtgg

SEQ ID NO: 51621 - DNA, 16 bp, H. sapiens
atgctggtgcacacct

SEQ ID NO: 51622 - DNA, 16 bp, H. sapiens
atgctggtgtaaacaa

SEQ ID NO: 51623 - DNA, 16 bp, H. sapiens
atgctggtgtggatgt

SEQ ID NO: 51624 - DNA, 16 bp, H. sapiens
atgctgtatgatttca

SEQ ID NO: 51625 - DNA, 16 bp, H. sapiens
atgctgtatttatttt

SEQ ID NO: 51626 - DNA, 16 bp, H. sapiens
atgctgtattttaaaa

SEQ ID NO: 51627 - DNA, 16 bp, H. sapiens
atgctgtatttttact

SEQ ID NO: 51628 - DNA, 16 bp, H. sapiens
atgctgtccttgtgat

SEQ ID NO: 51629 - DNA, 16 bp, H. sapiens
atgctgtgaagaaaaa

SEQ ID NO: 51630 - DNA, 16 bp, H. sapiens
atgctgtgaagaagcc

SEQ ID NO: 51631 - DNA, 16 bp, H. sapiens
atgctgtggtttgaat

SEQ ID NO: 51632 - DNA, 16 bp, H. sapiens
atgctgtgtgacttcc

SEQ ID NO: 51633 - DNA, 16 bp, H. sapiens
atgctgtgtgcagtct

SEQ ID NO: 51634 - DNA, 16 bp, H. sapiens
atgctgtgtggaatac

SEQ ID NO: 51635 - DNA, 16 bp, H. sapiens
atgctgttcttttgat

SEQ ID NO: 51636 - DNA, 16 bp, H. sapiens
atgctgttgggaaaac

SEQ ID NO: 51637 - DNA, 16 bp, H. sapiens
atgctgtttatatttt

SEQ ID NO: 51638 - DNA, 16 bp, H. sapiens
atgctgtttatttatt

SEQ ID NO: 51639 - DNA, 16 bp, H. sapiens
atgctgtttggagcct

SEQ ID NO: 51640 - DNA, 16 bp, H. sapiens
atgctgttttcatgat

SEQ ID NO: 51641 - DNA, 17 bp, H. sapiens
atgctgttttggtgact

SEQ ID NO: 51642 - DNA, 16 bp, H. sapiens
atgctgttttgtttac

SEQ ID NO: 51643 - DNA, 16 bp, H. sapiens
atgctgtttttgttat

SEQ ID NO: 51644 - DNA, 16 bp, H. sapiens
atgcttaaaatgaatg

SEQ ID NO: 51645 - DNA, 16 bp, H. sapiens
atgcttaataaactcc

SEQ ID NO: 51646 - DNA, 16 bp, H. sapiens
atgcttatgtataagt

SEQ ID NO: 51647 - DNA, 16 bp, H. sapiens
atgcttatgttagaaa

SEQ ID NO: 51648 - DNA, 16 bp, H. sapiens
atgcttattgtaaaaa

SEQ ID NO: 51649 - DNA, 16 bp, H. sapiens
atgcttatttcacatt

SEQ ID NO: 51650 - DNA, 16 bp, H. sapiens
atgcttcaaaaataaa

SEQ ID NO: 51651 - DNA, 16 bp, H. sapiens
atgcttcaaagaaaat

SEQ ID NO: 51652 - DNA, 16 bp, H. sapiens
atgcttcagtttcctc

SEQ ID NO: 51653 - DNA, 16 bp, H. sapiens
atgcttcagtttcctt

SEQ ID NO: 51654 - DNA, 16 bp, H. sapiens
atgcttccaactttgt

SEQ ID NO: 51655 - DNA, 16 bp, H. sapiens
atgcttccaggtttgt

SEQ ID NO: 51656 - DNA, 16 bp, H. sapiens
atgcttcccagcctct

SEQ ID NO: 51657 - DNA, 16 bp, H. sapiens
atgcttcctgtccttg

SEQ ID NO: 51658 - DNA, 16 bp, H. sapiens
atgcttccttttcttt

SEQ ID NO: 51659 - DNA, 16 bp, H. sapiens
atgcttctgataaaga

SEQ ID NO: 51660 - DNA, 16 bp, H. sapiens
atgcttctttaaaaaa

SEQ ID NO: 51661 - DNA, 16 bp, H. sapiens
atgcttgaaaaaaaaa

SEQ ID NO: 51662 - DNA, 16 bp, H. sapiens
atgcttggctaatttt

SEQ ID NO: 51663 - DNA, 16 bp, H. sapiens
atgcttgttggccacg

SEQ ID NO: 51664 - DNA, 16 bp, H. sapiens
atgcttgttttgaaaa

SEQ ID NO: 51665 - DNA, 16 bp, H. sapiens
atgctttaaaaaaaaa

SEQ ID NO: 51666 - DNA, 16 bp, H. sapiens
atgctttaaggaagtt

SEQ ID NO: 51667 - DNA, 16 bp, H. sapiens
atgctttaaggtcata

SEQ ID NO: 51668 - DNA, 16 bp, H. sapiens
atgctttcatttttat

SEQ ID NO: 51669 - DNA, 16 bp, H. sapiens
atgctttccctccccc

SEQ ID NO: 51670 - DNA, 16 bp, H. sapiens
atgctttcttcatttt

SEQ ID NO: 51671 - DNA, 16 bp, H. sapiens
atgctttctttagcat

SEQ ID NO: 51672 - DNA, 16 bp, H. sapiens
atgctttcttttctct

SEQ ID NO: 51673 - DNA, 16 bp, H. sapiens
atgctttgaaaatatt

SEQ ID NO: 51674 - DNA, 16 bp, H. sapiens
atgctttgaatttctg

SEQ ID NO: 51675 - DNA, 16 bp, H. sapiens
atgctttgattccttt

SEQ ID NO: 51676 - DNA, 16 bp, H. sapiens
atgcttttatataaaa

SEQ ID NO: 51677 - DNA, 16 bp, H. sapiens
atgcttttctcatggt

SEQ ID NO: 51678 - DNA, 16 bp, H. sapiens
atgcttttctcttgct

SEQ ID NO: 51679 - DNA, 16 bp, H. sapiens
atgcttttgaaattca

SEQ ID NO: 51680 - DNA, 16 bp, H. sapiens
atgcttttgaaatttt

SEQ ID NO: 51681 - DNA, 16 bp, H. sapiens
atgcttttgataaaat

SEQ ID NO: 51682 - DNA, 16 bp, H. sapiens
atgctttttaaaaaat

SEQ ID NO: 51683 - DNA, 16 bp, H. sapiens
atgctttttaaaaatt

SEQ ID NO: 51684 - DNA, 16 bp, H. sapiens
atgcttttttaaaaaa

SEQ ID NO: 51685 - DNA, 16 bp, H. sapiens
atgcttttttctgcat

SEQ ID NO: 51686 - DNA, 16 bp, H. sapiens
atgctttttttccccc

SEQ ID NO: 51687 - DNA, 16 bp, H. sapiens
atgctttttttgcatc

SEQ ID NO: 51688 - DNA, 16 bp, H. sapiens
atggaaaaaagatatt

SEQ ID NO: 51689 - DNA, 16 bp, H. sapiens
atggaaaaacaaattc

SEQ ID NO: 51690 - DNA, 16 bp, H. sapiens
atggaaaaacaaattt

SEQ ID NO: 51691 - DNA, 16 bp, H. sapiens
atggaaaaactgaata

SEQ ID NO: 51692 - DNA, 16 bp, H. sapiens
atggaaaaagcatggt

SEQ ID NO: 51693 - DNA, 16 bp, H. sapiens
atggaaaaagtggaca

SEQ ID NO: 51694 - DNA, 16 bp, H. sapiens
atggaaaaatatatgt

SEQ ID NO: 51695 - DNA, 16 bp, H. sapiens
atggaaaaatattaca

SEQ ID NO: 51696 - DNA, 16 bp, H. sapiens
atggaaaaatcaagaa

SEQ ID NO: 51697 - DNA, 16 bp, H. sapiens
atggaaaaattcaaag

SEQ ID NO: 51698 - DNA, 16 bp, H. sapiens
atggaaaaattccttg

SEQ ID NO: 51699 - DNA, 16 bp, H. sapiens
atggaaaacaaaatga

SEQ ID NO: 51700 - DNA, 16 bp, H. sapiens
atggaaaacagatcag

SEQ ID NO: 51701 - DNA, 16 bp, H. sapiens
atggaaaacagattag

SEQ ID NO: 51702 - DNA, 16 bp, H. sapiens
atggaaaacatttaaa

SEQ ID NO: 51703 - DNA, 16 bp, H. sapiens
atggaaaaccaaaaat

SEQ ID NO: 51704 - DNA, 16 bp, H. sapiens
atggaaaaccaagcat

SEQ ID NO: 51705 - DNA, 16 bp, H. sapiens
atggaaaactacaaca

SEQ ID NO: 51706 - DNA, 16 bp, H. sapiens
atggaaaactgtggag

SEQ ID NO: 51707 - DNA, 16 bp, H. sapiens
atggaaaagaaaatct

SEQ ID NO: 51708 - DNA, 16 bp, H. sapiens
atggaaaagaacaaag

SEQ ID NO: 51709 - DNA, 16 bp, H. sapiens
atggaaaagaactgaa

SEQ ID NO: 51710 - DNA, 16 bp, H. sapiens
atggaaaagcaaaata

SEQ ID NO: 51711 - DNA, 16 bp, H. sapiens
atggaaaagcaaagaa

SEQ ID NO: 51712 - DNA, 16 bp, H. sapiens
atggaaaagctacagg

SEQ ID NO: 51713 - DNA, 16 bp, H. sapiens
atggaaaaggaaatat

SEQ ID NO: 51714 - DNA, 16 bp, H. sapiens
atggaaaatacatttt

SEQ ID NO: 51715 - DNA, 16 bp, H. sapiens
atggaaaatcaaacat

SEQ ID NO: 51716 - DNA, 16 bp, H. sapiens
atggaaaatgaaatga

SEQ ID NO: 51717 - DNA, 16 bp, H. sapiens
atggaaaatgtgtatt

SEQ ID NO: 51718 - DNA, 16 bp, H. sapiens
atggaaaattatttaa

SEQ ID NO: 51719 - DNA, 16 bp, H. sapiens
atggaaaattatttta

SEQ ID NO: 51720 - DNA, 16 bp, H. sapiens
atggaaacaatagata

SEQ ID NO: 51721 - DNA, 16 bp, H. sapiens
atggaaacaatcaaca

SEQ ID NO: 51722 - DNA, 16 bp, H. sapiens
atggaaacatctggat

SEQ ID NO: 51723 - DNA, 16 bp, H. sapiens
atggaaaccaaaagca

SEQ ID NO: 51724 - DNA, 16 bp, H. sapiens
atggaaaccttacagg

SEQ ID NO: 51725 - DNA, 16 bp, H. sapiens
atggaaactcctggat

SEQ ID NO: 51726 - DNA, 16 bp, H. sapiens
atggaaactgaacagc

SEQ ID NO: 51727 - DNA, 16 bp, H. sapiens
atggaaagaaaatttg

SEQ ID NO: 51728 - DNA, 16 bp, H. sapiens
atggaaagaagaaaca

SEQ ID NO: 51729 - DNA, 16 bp, H. sapiens
atggaaagatactcca

SEQ ID NO: 51730 - DNA, 16 bp, H. sapiens
atggaaaggaaaaacc

SEQ ID NO: 51731 - DNA, 16 bp, H. sapiens
atggaaaggaagaacc

SEQ ID NO: 51732 - DNA, 16 bp, H. sapiens
atggaaaggcaaagaa

SEQ ID NO: 51733 - DNA, 16 bp, H. sapiens
atggaaagttttaata

SEQ ID NO: 51734 - DNA, 16 bp, H. sapiens
atggaaagtttttcca

SEQ ID NO: 51735 - DNA, 16 bp, H. sapiens
atggaaataaaacatt

SEQ ID NO: 51736 - DNA, 16 bp, H. sapiens
atggaaataaaagttt

SEQ ID NO: 51737 - DNA, 16 bp, H. sapiens
atggaaataaaatgca

SEQ ID NO: 51738 - DNA, 16 bp, H. sapiens
atggaaataaatgtga

SEQ ID NO: 51739 - DNA, 16 bp, H. sapiens
atggaaataacattta

SEQ ID NO: 51740 - DNA, 16 bp, H. sapiens
atggaaataacctaag

SEQ ID NO: 51741 - DNA, 16 bp, H. sapiens
atggaaatacaaagga

SEQ ID NO: 51742 - DNA, 16 bp, H. sapiens
atggaaatacagaaat

SEQ ID NO: 51743 - DNA, 16 bp, H. sapiens
atggaaatatttaatt

SEQ ID NO: 51744 - DNA, 16 bp, H. sapiens
atggaaatatttttaa

SEQ ID NO: 51745 - DNA, 16 bp, H. sapiens
atggaaatcaaagaaa

SEQ ID NO: 51746 - DNA, 16 bp, H. sapiens
atggaaatcaataaat

SEQ ID NO: 51747 - DNA, 16 bp, H. sapiens
atggaaatcagaaaat

SEQ ID NO: 51748 - DNA, 16 bp, H. sapiens
atggaaatgaaaacca

SEQ ID NO: 51749 - DNA, 16 bp, H. sapiens
atggaaatgaaaatta

SEQ ID NO: 51750 - DNA, 16 bp, H. sapiens
atggaaatgaaagaat

SEQ ID NO: 51751 - DNA, 16 bp, H. sapiens
atggaaatgaaatgaa

SEQ ID NO: 51752 - DNA, 16 bp, H. sapiens
atggaaatgagaaact

SEQ ID NO: 51753 - DNA, 16 bp, H. sapiens
atggaaatgcttctac

SEQ ID NO: 51754 - DNA, 16 bp, H. sapiens
atggaaatggaaacca

SEQ ID NO: 51755 - DNA, 16 bp, H. sapiens
atggaaatggaaagga

SEQ ID NO: 51756 - DNA, 16 bp, H. sapiens
atggaaatggaaataa

SEQ ID NO: 51757 - DNA, 16 bp, H. sapiens
atggaaattattttat

SEQ ID NO: 51758 - DNA, 16 bp, H. sapiens
atggaaattcctggat

SEQ ID NO: 51759 - DNA, 16 bp, H. sapiens
atggaaatttaaattt

SEQ ID NO: 51760 - DNA, 16 bp, H. sapiens
atggaaatttatattt

SEQ ID NO: 51761 - DNA, 16 bp, H. sapiens
atggaaattttctaaa

SEQ ID NO: 51762 - DNA, 16 bp, H. sapiens
atggaacaaaaaagag

SEQ ID NO: 51763 - DNA, 16 bp, H. sapiens
atggaacagaacggag

SEQ ID NO: 51764 - DNA, 16 bp, H. sapiens
atggaacaggatagaa

SEQ ID NO: 51765 - DNA, 18 bp, H. sapiens
atggaaccaaaaaagagc

SEQ ID NO: 51766 - DNA, 16 bp, H. sapiens
atggaaccacaaaaga

SEQ ID NO: 51767 - DNA, 16 bp, H. sapiens
atggaaccacaaaagg

SEQ ID NO: 51768 - DNA, 16 bp, H. sapiens
atggaaccacaaaagt

SEQ ID NO: 51769 - DNA, 16 bp, H. sapiens
atggaaccagaaaaga

SEQ ID NO: 51770 - DNA, 16 bp, H. sapiens
atggaacggaatagag

SEQ ID NO: 51771 - DNA, 20 bp, H. sapiens
atggaacgtatctcaaaata

SEQ ID NO: 51772 - DNA, 16 bp, H. sapiens
atggaactaaaaaaga

SEQ ID NO: 51773 - DNA, 16 bp, H. sapiens
atggaactcctgggct

SEQ ID NO: 51774 - DNA, 16 bp, H. sapiens
atggaactgaaaaatt

SEQ ID NO: 51775 - DNA, 16 bp, H. sapiens
atggaactgaaaacca

SEQ ID NO: 51776 - DNA, 16 bp, H. sapiens
atggaactggagaaca

SEQ ID NO: 51777 - DNA, 16 bp, H. sapiens
atggaactggagacca

SEQ ID NO: 51778 - DNA, 16 bp, H. sapiens
atggaacttctcagcc

SEQ ID NO: 51779 - DNA, 16 bp, H. sapiens
atggaactttttaaaa

SEQ ID NO: 51780 - DNA, 16 bp, H. sapiens
atggaagaaaattcca

SEQ ID NO: 51781 - DNA, 16 bp, H. sapiens
atggaagaaatgactg

SEQ ID NO: 51782 - DNA, 16 bp, H. sapiens
atggaagaaattgaag

SEQ ID NO: 51783 - DNA, 16 bp, H. sapiens
atggaagaagatattt

SEQ ID NO: 51784 - DNA, 16 bp, H. sapiens
atggaagaagattcca

SEQ ID NO: 51785 - DNA, 16 bp, H. sapiens
atggaagaagctggaa

SEQ ID NO: 51786 - DNA, 16 bp, H. sapiens
atggaagaatatattt

SEQ ID NO: 51787 - DNA, 16 bp, H. sapiens
atggaagaatgttcca

SEQ ID NO: 51788 - DNA, 16 bp, H. sapiens
atggaagaccattttt

SEQ ID NO: 51789 - DNA, 16 bp, H. sapiens
atggaagactttttat

SEQ ID NO: 51790 - DNA, 16 bp, H. sapiens
atggaagccagaagac

SEQ ID NO: 51791 - DNA, 16 bp, H. sapiens
atggaagctgctaagg

SEQ ID NO: 51792 - DNA, 16 bp, H. sapiens
atggaaggggctgctg

SEQ ID NO: 51793 - DNA, 16 bp, H. sapiens
atggaagtggaagtgg

SEQ ID NO: 51794 - DNA, 16 bp, H. sapiens
atggaagttcttcaaa

SEQ ID NO: 51795 - DNA, 16 bp, H. sapiens
atggaataatagacat

SEQ ID NO: 51796 - DNA, 16 bp, H. sapiens
atggaatacaatgcag

SEQ ID NO: 51797 - DNA, 16 bp, H. sapiens
atggaatactgtgcag

SEQ ID NO: 51798 - DNA, 16 bp, H. sapiens
atggaatataattgag

SEQ ID NO: 51799 - DNA, 16 bp, H. sapiens
atggaatatatatgta

SEQ ID NO: 51800 - DNA, 16 bp, H. sapiens
atggaatatcattttt

SEQ ID NO: 51801 - DNA, 16 bp, H. sapiens
atggaatatgtttcca

SEQ ID NO: 51802 - DNA, 16 bp, H. sapiens
atggaatattatataa

SEQ ID NO: 51803 - DNA, 16 bp, H. sapiens
atggaatcaacccaaa

SEQ ID NO: 51804 - DNA, 16 bp, H. sapiens
atggaatcaacccagg

SEQ ID NO: 51805 - DNA, 16 bp, H. sapiens
atggaatcagtaataa

SEQ ID NO: 51806 - DNA, 16 bp, H. sapiens
atggaatcatgtcatc

SEQ ID NO: 51807 - DNA, 16 bp, H. sapiens
atggaatgaaactaga

SEQ ID NO: 51808 - DNA, 16 bp, H. sapiens
atggaatgaatatatt

SEQ ID NO: 51809 - DNA, 28 bp, H. sapiens
atggaatgattgggccattattaaagca

SEQ ID NO: 51810 - DNA, 16 bp, H. sapiens
atggaatggaatcgaa

SEQ ID NO: 51811 - DNA, 16 bp, H. sapiens
atggaatggaatggaa

SEQ ID NO: 51812 - DNA, 16 bp, H. sapiens
atggaatggatttgaa

SEQ ID NO: 51813 - DNA, 16 bp, H. sapiens
atggaatgggaaggaa

SEQ ID NO: 51814 - DNA, 16 bp, H. sapiens
atggaatgtttctcca

SEQ ID NO: 51815 - DNA, 16 bp, H. sapiens
atggaatgttttacca

SEQ ID NO: 51816 - DNA, 16 bp, H. sapiens
atggaattaaactaga

SEQ ID NO: 51817 - DNA, 16 bp, H. sapiens
atggaattgaaaggaa

SEQ ID NO: 51818 - DNA, 16 bp, H. sapiens
atggaattggaggtca

SEQ ID NO: 51819 - DNA, 16 bp, H. sapiens
atggaattgttgttgt

SEQ ID NO: 51820 - DNA, 16 bp, H. sapiens
atggaattgttttctt

SEQ ID NO: 51821 - DNA, 16 bp, H. sapiens
atggaatttcaccatg

SEQ ID NO: 51822 - DNA, 16 bp, H. sapiens
atggaatttttaaaaa

SEQ ID NO: 51823 - DNA, 16 bp, H. sapiens
atggaatttttttctt

SEQ ID NO: 51824 - DNA, 16 bp, H. sapiens
atggaattttttttca

SEQ ID NO: 51825 - DNA, 16 bp, H. sapiens
atggaattttttttcc

SEQ ID NO: 51826 - DNA, 16 bp, H. sapiens
atggacaaaatatttg

SEQ ID NO: 51827 - DNA, 16 bp, H. sapiens
atggacaaataaaaat

SEQ ID NO: 51828 - DNA, 16 bp, H. sapiens
atggacaaatggatgg

SEQ ID NO: 51829 - DNA, 16 bp, H. sapiens
atggacacaaagaaga

SEQ ID NO: 51830 - DNA, 16 bp, H. sapiens
atggacacagactcag

SEQ ID NO: 51831 - DNA, 16 bp, H. sapiens
atggacacagagaagg

SEQ ID NO: 51832 - DNA, 16 bp, H. sapiens
atggacacatcattat

SEQ ID NO: 51833 - DNA, 16 bp, H. sapiens
atggacacatggaggg

SEQ ID NO: 51834 - DNA, 16 bp, H. sapiens
atggacaccctaacat

SEQ ID NO: 51835 - DNA, 16 bp, H. sapiens
atggacactgacattt

SEQ ID NO: 51836 - DNA, 16 bp, H. sapiens
atggacacttacattg

SEQ ID NO: 51837 - DNA, 16 bp, H. sapiens
atggacacttaggttg

SEQ ID NO: 51838 - DNA, 16 bp, H. sapiens
atggacacttgggtta

SEQ ID NO: 51839 - DNA, 16 bp, H. sapiens
atggacagaaaatgga

SEQ ID NO: 51840 - DNA, 16 bp, H. sapiens
atggacagacagacag

SEQ ID NO: 51841 - DNA, 16 bp, H. sapiens
atggacagactgcttc

SEQ ID NO: 51842 - DNA, 16 bp, H. sapiens
atggacagagggaggg

SEQ ID NO: 51843 - DNA, 16 bp, H. sapiens
atggacagatgaatgg

SEQ ID NO: 51844 - DNA, 16 bp, H. sapiens
atggacaggaggcagg

SEQ ID NO: 51845 - DNA, 16 bp, H. sapiens
atggacagtgatgatg

SEQ ID NO: 51846 - DNA, 16 bp, H. sapiens
atggacatgaatggaa

SEQ ID NO: 51847 - DNA, 16 bp, H. sapiens
atggacatggatggag

SEQ ID NO: 51848 - DNA, 16 bp, H. sapiens
atggacatttaggttg

SEQ ID NO: 51849 - DNA, 23 bp, H. sapiens
atggacatttatcagttcccaaa

SEQ ID NO: 51850 - DNA, 16 bp, H. sapiens
atggacatttgggatg

SEQ ID NO: 51851 - DNA, 16 bp, H. sapiens
atggacatttggtttg

SEQ ID NO: 51852 - DNA, 16 bp, H. sapiens
atggacattttaataa

SEQ ID NO: 51853 - DNA, 16 bp, H. sapiens
atggacattttttttt

SEQ ID NO: 51854 - DNA, 16 bp, H. sapiens
atggaccatgtgctgc

SEQ ID NO: 51855 - DNA, 16 bp, H. sapiens
atggacctctctgagt

SEQ ID NO: 51856 - DNA, 16 bp, H. sapiens
atggacctctggaatc

SEQ ID NO: 51857 - DNA, 16 bp, H. sapiens
atggactctttttttt

SEQ ID NO: 51858 - DNA, 16 bp, H. sapiens
atggacttcctcctca

SEQ ID NO: 51859 - DNA, 16 bp, H. sapiens
atggactttggggact

SEQ ID NO: 51860 - DNA, 16 bp, H. sapiens
atggagaaaaacaaag

SEQ ID NO: 51861 - DNA, 16 bp, H. sapiens
atggagaaaagggaat

SEQ ID NO: 51862 - DNA, 16 bp, H. sapiens
atggagaaaagtttgg

SEQ ID NO: 51863 - DNA, 16 bp, H. sapiens
atggagaaaataaaac

SEQ ID NO: 51864 - DNA, 16 bp, H. sapiens
atggagaaacagaaaa

SEQ ID NO: 51865 - DNA, 16 bp, H. sapiens
atggagaaacctcatc

SEQ ID NO: 51866 - DNA, 16 bp, H. sapiens
atggagaaagatattc

SEQ ID NO: 51867 - DNA, 16 bp, H. sapiens
atggagaaattaagaa

SEQ ID NO: 51868 - DNA, 16 bp, H. sapiens
atggagaaattaagat

SEQ ID NO: 51869 - DNA, 16 bp, H. sapiens
atggagaacactttgg

SEQ ID NO: 51870 - DNA, 16 bp, H. sapiens
atggagaagctgcagt

SEQ ID NO: 51871 - DNA, 16 bp, H. sapiens
atggagaatgaatttg

SEQ ID NO: 51872 - DNA, 16 bp, H. sapiens
atggagacagagactg

SEQ ID NO: 51873 - DNA, 16 bp, H. sapiens
atggagactatcctgg

SEQ ID NO: 51874 - DNA, 16 bp, H. sapiens
atggagacttggaagg

SEQ ID NO: 51875 - DNA, 16 bp, H. sapiens
atggagagaaatggaa

SEQ ID NO: 51876 - DNA, 16 bp, H. sapiens
atggagaggaatgaaa

SEQ ID NO: 51877 - DNA, 16 bp, H. sapiens
atggagaggaatggaa

SEQ ID NO: 51878 - DNA, 16 bp, H. sapiens
atggagagtgactgct

SEQ ID NO: 51879 - DNA, 16 bp, H. sapiens
atggagagtttgcaaa

SEQ ID NO: 51880 - DNA, 16 bp, H. sapiens
atggagataataatac

SEQ ID NO: 51881 - DNA, 16 bp, H. sapiens
atggagatagcattga

SEQ ID NO: 51882 - DNA, 16 bp, H. sapiens
atggagatattttaaa

SEQ ID NO: 51883 - DNA, 16 bp, H. sapiens
atggagatggagatga

SEQ ID NO: 51884 - DNA, 16 bp, H. sapiens
atggagcagaaaacca

SEQ ID NO: 51885 - DNA, 16 bp, H. sapiens
atggagcagagagggc

SEQ ID NO: 51886 - DNA, 16 bp, H. sapiens
atggagccagcaggag

SEQ ID NO: 51887 - DNA, 16 bp, H. sapiens
atggagcccaccacag

SEQ ID NO: 51888 - DNA, 16 bp, H. sapiens
atggagctgccatttt

SEQ ID NO: 51889 - DNA, 16 bp, H. sapiens
atggagctggaaaaca

SEQ ID NO: 51890 - DNA, 16 bp, H. sapiens
atggagctggaagctg

SEQ ID NO: 51891 - DNA, 16 bp, H. sapiens
atggagctggaggcca

SEQ ID NO: 51892 - DNA, 16 bp, H. sapiens
atggagcttagtttgg

SEQ ID NO: 51893 - DNA, 16 bp, H. sapiens
atggaggaaaccaccc

SEQ ID NO: 51894 - DNA, 16 bp, H. sapiens
atggaggaactttaaa

SEQ ID NO: 51895 - DNA, 16 bp, H. sapiens
atggaggaagatgaag

SEQ ID NO: 51896 - DNA, 16 bp, H. sapiens
atggaggaaggccact

SEQ ID NO: 51897 - DNA, 16 bp, H. sapiens
atggaggacaggagag

SEQ ID NO: 51898 - DNA, 16 bp, H. sapiens
atggaggcagacaaga

SEQ ID NO: 51899 - DNA, 16 bp, H. sapiens
atggaggcagatctct

SEQ ID NO: 51900 - DNA, 16 bp, H. sapiens
atggaggcagttttcc

SEQ ID NO: 51901 - DNA, 16 bp, H. sapiens
atggaggccagaagac

SEQ ID NO: 51902 - DNA, 16 bp, H. sapiens
atggaggctgagaagt

SEQ ID NO: 51903 - DNA, 16 bp, H. sapiens
atggaggctgaggcag

SEQ ID NO: 51904 - DNA, 16 bp, H. sapiens
atggaggctgcaatga

SEQ ID NO: 51905 - DNA, 16 bp, H. sapiens
atggaggcttcagtga

SEQ ID NO: 51906 - DNA, 16 bp, H. sapiens
atggaggggacagagg

SEQ ID NO: 51907 - DNA, 16 bp, H. sapiens
atggaggtgaaagatc

SEQ ID NO: 51908 - DNA, 16 bp, H. sapiens
atggaggttacacatg

SEQ ID NO: 51909 - DNA, 16 bp, H. sapiens
atggaggtttgttaca

SEQ ID NO: 51910 - DNA, 16 bp, H. sapiens
atggagtacagtggca

SEQ ID NO: 51911 - DNA, 16 bp, H. sapiens
atggagtatttgtctt

SEQ ID NO: 51912 - DNA, 16 bp, H. sapiens
atggagtcacccatgc

SEQ ID NO: 51913 - DNA, 16 bp, H. sapiens
atggagtctcccactg

SEQ ID NO: 51914 - DNA, 17 bp, H. sapiens
atggagtctccctctgt

SEQ ID NO: 51915 - DNA, 16 bp, H. sapiens
atggagtctcgctctc

SEQ ID NO: 51916 - DNA, 16 bp, H. sapiens
atggagtcttgccatg

SEQ ID NO: 51917 - DNA, 16 bp, H. sapiens
atggagtcttgctata

SEQ ID NO: 51918 - DNA, 16 bp, H. sapiens
atggagtcttgctctt

SEQ ID NO: 51919 - DNA, 16 bp, H. sapiens
atggagtcttgttttg

SEQ ID NO: 51920 - DNA, 16 bp, H. sapiens
atggagtctttctctg

SEQ ID NO: 51921 - DNA, 16 bp, H. sapiens
atggagtctttttttt

SEQ ID NO: 51922 - DNA, 16 bp, H. sapiens
atggagtgcaatggtg

SEQ ID NO: 51923 - DNA, 16 bp, H. sapiens
atggagtgctgctgtg

SEQ ID NO: 51924 - DNA, 16 bp, H. sapiens
atggagtgggcaagtt

SEQ ID NO: 51925 - DNA, 16 bp, H. sapiens
atggagtgttctataa

SEQ ID NO: 51926 - DNA, 16 bp, H. sapiens
atggagttccactctt

SEQ ID NO: 51927 - DNA, 16 bp, H. sapiens
atggagttggaagcca

SEQ ID NO: 51928 - DNA, 16 bp, H. sapiens
atggagtttcacaatg

SEQ ID NO: 51929 - DNA, 16 bp, H. sapiens
atggagtttcactatt

SEQ ID NO: 51930 - DNA, 16 bp, H. sapiens
atggagtttcactctg

SEQ ID NO: 51931 - DNA, 16 bp, H. sapiens
atggagtttcctcaaa

SEQ ID NO: 51932 - DNA, 16 bp, H. sapiens
atggagtttgcagtga

SEQ ID NO: 51933 - DNA, 16 bp, H. sapiens
atggagttttgttctt

SEQ ID NO: 51934 - DNA, 16 bp, H. sapiens
atggagtttttgcatg

SEQ ID NO: 51935 - DNA, 16 bp, H. sapiens
atggataaaaattcac

SEQ ID NO: 51936 - DNA, 16 bp, H. sapiens
atggataaagaaaaca

SEQ ID NO: 51937 - DNA, 16 bp, H. sapiens
atggataaagaaaatc

SEQ ID NO: 51938 - DNA, 16 bp, H. sapiens
atggataaagaaattg

SEQ ID NO: 51939 - DNA, 16 bp, H. sapiens
atggataaatggatga

SEQ ID NO: 51940 - DNA, 17 bp, H. sapiens
atggataaattcctgga

SEQ ID NO: 51941 - DNA, 25 bp, H. sapiens
atggataaattccttgacacataca

SEQ ID NO: 51942 - DNA, 16 bp, H. sapiens
atggataaggaaattg

SEQ ID NO: 51943 - DNA, 16 bp, H. sapiens
atggatacagctggaa

SEQ ID NO: 51944 - DNA, 16 bp, H. sapiens
atggatacataaaatg

SEQ ID NO: 51945 - DNA, 16 bp, H. sapiens
atggatacatttttct

SEQ ID NO: 51946 - DNA, 16 bp, H. sapiens
atggatacttgggttg

SEQ ID NO: 51947 - DNA, 16 bp, H. sapiens
atggatagaatcaata

SEQ ID NO: 51948 - DNA, 16 bp, H. sapiens
atggataggaagaatt

SEQ ID NO: 51949 - DNA, 16 bp, H. sapiens
atggatatatatgtgt

SEQ ID NO: 51950 - DNA, 16 bp, H. sapiens
atggatatatgtatat

SEQ ID NO: 51951 - DNA, 16 bp, H. sapiens
atggatatatgttttt

SEQ ID NO: 51952 - DNA, 16 bp, H. sapiens
atggatatattaatta

SEQ ID NO: 51953 - DNA, 16 bp, H. sapiens
atggatatattgtgtg

SEQ ID NO: 51954 - DNA, 16 bp, H. sapiens
atggatattcaatttt

SEQ ID NO: 51955 - DNA, 16 bp, H. sapiens
atggatattggcctga

SEQ ID NO: 51956 - DNA, 16 bp, H. sapiens
atggatcaaagatcta

SEQ ID NO: 51957 - DNA, 16 bp, H. sapiens
atggatcaatctcaaa

SEQ ID NO: 51958 - DNA, 16 bp, H. sapiens
atggatcacgaggtca

SEQ ID NO: 51959 - DNA, 16 bp, H. sapiens
atggatcccaggtctt

SEQ ID NO: 51960 - DNA, 18 bp, H. sapiens
atggatgaagctggaaat

SEQ ID NO: 51961 - DNA, 16 bp, H. sapiens
atggatgaagttggaa

SEQ ID NO: 51962 - DNA, 16 bp, H. sapiens
atggatgaataaatgt

SEQ ID NO: 51963 - DNA, 16 bp, H. sapiens
atggatgaattgacag

SEQ ID NO: 51964 - DNA, 16 bp, H. sapiens
atggatgaattgtgta

SEQ ID NO: 51965 - DNA, 16 bp, H. sapiens
atggatgaatttggaa

SEQ ID NO: 51966 - DNA, 16 bp, H. sapiens
atggatgacacaaaca

SEQ ID NO: 51967 - DNA, 16 bp, H. sapiens
atggatgagaaaacag

SEQ ID NO: 51968 - DNA, 16 bp, H. sapiens
atggatgaggaaactg

SEQ ID NO: 51969 - DNA, 16 bp, H. sapiens
atggatgaggagactg

SEQ ID NO: 51970 - DNA, 16 bp, H. sapiens
atggatgagtggatga

SEQ ID NO: 51971 - DNA, 16 bp, H. sapiens
atggatgatgatgatg

SEQ ID NO: 51972 - DNA, 16 bp, H. sapiens
atggatgcacaactct

SEQ ID NO: 51973 - DNA, 16 bp, H. sapiens
atggatgcagaaaagg

SEQ ID NO: 51974 - DNA, 16 bp, H. sapiens
atggatgcagctggaa

SEQ ID NO: 51975 - DNA, 16 bp, H. sapiens
atggatgcatgaatgg

SEQ ID NO: 51976 - DNA, 16 bp, H. sapiens
atggatggaaatggag

SEQ ID NO: 51977 - DNA, 16 bp, H. sapiens
atggatggaattggaa

SEQ ID NO: 51978 - DNA, 16 bp, H. sapiens
atggatggacgaatgg

SEQ ID NO: 51979 - DNA, 16 bp, H. sapiens
atggatggagctggaa

SEQ ID NO: 51980 - DNA, 16 bp, H. sapiens
atggatggataggtag

SEQ ID NO: 51981 - DNA, 16 bp, H. sapiens
atggatggatcacttg

SEQ ID NO: 51982 - DNA, 16 bp, H. sapiens
atggatggatgaagga

SEQ ID NO: 51983 - DNA, 16 bp, H. sapiens
atggatggatgcacag

SEQ ID NO: 51984 - DNA, 16 bp, H. sapiens
atggatggatggaaaa

SEQ ID NO: 51985 - DNA, 16 bp, H. sapiens
atggatggatggagaa

SEQ ID NO: 51986 - DNA, 16 bp, H. sapiens
atggatggatggctgg

SEQ ID NO: 51987 - DNA, 16 bp, H. sapiens
atggatggggctggag

SEQ ID NO: 51988 - DNA, 16 bp, H. sapiens
atggatggtagttttg

SEQ ID NO: 51989 - DNA, 16 bp, H. sapiens
atggatggtgatgatg

SEQ ID NO: 51990 - DNA, 16 bp, H. sapiens
atggatggtggagatg

SEQ ID NO: 51991 - DNA, 16 bp, H. sapiens
atggatggtggtgaca

SEQ ID NO: 51992 - DNA, 16 bp, H. sapiens
atggattaaaaatgtg

SEQ ID NO: 51993 - DNA, 16 bp, H. sapiens
atggattaaagactta

SEQ ID NO: 51994 - DNA, 16 bp, H. sapiens
atggattaatggatta

SEQ ID NO: 51995 - DNA, 16 bp, H. sapiens
atggattcaaaggaga

SEQ ID NO: 51996 - DNA, 16 bp, H. sapiens
atggattcaaatggaa

SEQ ID NO: 51997 - DNA, 16 bp, H. sapiens
atggattccaaggaat

SEQ ID NO: 51998 - DNA, 16 bp, H. sapiens
atggatttgggcaaag

SEQ ID NO: 51999 - DNA, 16 bp, H. sapiens
atggatttggtaatga

SEQ ID NO: 52000 - DNA, 16 bp, H. sapiens
atggatttgtctattc

SEQ ID NO: 52001 - DNA, 16 bp, H. sapiens
atggattttatttctc

SEQ ID NO: 52002 - DNA, 16 bp, H. sapiens
atggattttgaatttt

SEQ ID NO: 52003 - DNA, 16 bp, H. sapiens
atggatttttaaaaat

SEQ ID NO: 52004 - DNA, 16 bp, H. sapiens
atggatttttaaaatt

SEQ ID NO: 52005 - DNA, 16 bp, H. sapiens
atggatttttaaataa

SEQ ID NO: 52006 - DNA, 16 bp, H. sapiens
atggattttttttcaa

SEQ ID NO: 52007 - DNA, 16 bp, H. sapiens
atggcaaaaaagtgaa

SEQ ID NO: 52008 - DNA, 16 bp, H. sapiens
atggcaaaaaccacaa

SEQ ID NO: 52009 - DNA, 16 bp, H. sapiens
atggcaaaaatcacaa

SEQ ID NO: 52010 - DNA, 16 bp, H. sapiens
atggcaaaacctcatc

SEQ ID NO: 52011 - DNA, 17 bp, H. sapiens
atggcaaagaagttaaa

SEQ ID NO: 52012 - DNA, 16 bp, H. sapiens
atggcaaagacttgga

SEQ ID NO: 52013 - DNA, 16 bp, H. sapiens
atggcaaattttatgt

SEQ ID NO: 52014 - DNA, 16 bp, H. sapiens
atggcaaatttttaaa

SEQ ID NO: 52015 - DNA, 16 bp, H. sapiens
atggcaacacctggaa

SEQ ID NO: 52016 - DNA, 16 bp, H. sapiens
atggcaacatcaggaa

SEQ ID NO: 52017 - DNA, 16 bp, H. sapiens
atggcaagagagaaag

SEQ ID NO: 52018 - DNA, 16 bp, H. sapiens
atggcaaggaactgag

SEQ ID NO: 52019 - DNA, 17 bp, H. sapiens
atggcaataaaagccaa

SEQ ID NO: 52020 - DNA, 16 bp, H. sapiens
atggcaatgatgatga

SEQ ID NO: 52021 - DNA, 16 bp, H. sapiens
atggcacacacctgtg

SEQ ID NO: 52022 - DNA, 16 bp, H. sapiens
atggcacagccacttt

SEQ ID NO: 52023 - DNA, 22 bp, H. sapiens
atggcacatatacaccatggaa

SEQ ID NO: 52024 - DNA, 27 bp, H. sapiens
atggcacatatacaccatggaatacta

SEQ ID NO: 52025 - DNA, 16 bp, H. sapiens
atggcaccaaaaaaga

SEQ ID NO: 52026 - DNA, 16 bp, H. sapiens
atggcaccactacact

SEQ ID NO: 52027 - DNA, 16 bp, H. sapiens
atggcacctctgcact

SEQ ID NO: 52028 - DNA, 16 bp, H. sapiens
atggcacctgtatacc

SEQ ID NO: 52029 - DNA, 16 bp, H. sapiens
atggcagaaaaggaag

SEQ ID NO: 52030 - DNA, 16 bp, H. sapiens
atggcagaagacaaaa

SEQ ID NO: 52031 - DNA, 16 bp, H. sapiens
atggcagaagaggaag

SEQ ID NO: 52032 - DNA, 16 bp, H. sapiens
atggcagaagcagagg

SEQ ID NO: 52033 - DNA, 16 bp, H. sapiens
atggcagaaggtgaag

SEQ ID NO: 52034 - DNA, 16 bp, H. sapiens
atggcagaagtggaag

SEQ ID NO: 52035 - DNA, 16 bp, H. sapiens
atggcagaattttctt

SEQ ID NO: 52036 - DNA, 16 bp, H. sapiens
atggcagagaccaaga

SEQ ID NO: 52037 - DNA, 16 bp, H. sapiens
atggcagagccaggac

SEQ ID NO: 52038 - DNA, 16 bp, H. sapiens
atggcagaggtgatgg

SEQ ID NO: 52039 - DNA, 16 bp, H. sapiens
atggcagaggtggaag

SEQ ID NO: 52040 - DNA, 16 bp, H. sapiens
atggcagagtcagggc

SEQ ID NO: 52041 - DNA, 16 bp, H. sapiens
atggcagcagaagaga

SEQ ID NO: 52042 - DNA, 16 bp, H. sapiens
atggcagcagacaaga

SEQ ID NO: 52043 - DNA, 16 bp, H. sapiens
atggcagcaggaggca

SEQ ID NO: 52044 - DNA, 16 bp, H. sapiens
atggcagccaccagcc

SEQ ID NO: 52045 - DNA, 16 bp, H. sapiens
atggcagccattgtta

SEQ ID NO: 52046 - DNA, 16 bp, H. sapiens
atggcagcccctctca

SEQ ID NO: 52047 - DNA, 16 bp, H. sapiens
atggcagcctctccca

SEQ ID NO: 52048 - DNA, 16 bp, H. sapiens
atggcaggaaggagaa

SEQ ID NO: 52049 - DNA, 16 bp, H. sapiens
atggcaggagtaaatc

SEQ ID NO: 52050 - DNA, 16 bp, H. sapiens
atggcaggagtaggag

SEQ ID NO: 52051 - DNA, 16 bp, H. sapiens
atggcagggctgggat

SEQ ID NO: 52052 - DNA, 16 bp, H. sapiens
atggcaggggcagggg

SEQ ID NO: 52053 - DNA, 16 bp, H. sapiens
atggcagtgagccaag

SEQ ID NO: 52054 - DNA, 16 bp, H. sapiens
atggcagtggtggtgg

SEQ ID NO: 52055 - DNA, 16 bp, H. sapiens
atggcagttcctcaaa

SEQ ID NO: 52056 - DNA, 16 bp, H. sapiens
atggcatctctggacc

SEQ ID NO: 52057 - DNA, 16 bp, H. sapiens
atggcatcttcaatgg

SEQ ID NO: 52058 - DNA, 16 bp, H. sapiens
atggcatgaacccaag

SEQ ID NO: 52059 - DNA, 16 bp, H. sapiens
atggcattaatttatt

SEQ ID NO: 52060 - DNA, 16 bp, H. sapiens
atggcattatcttgtg

SEQ ID NO: 52061 - DNA, 16 bp, H. sapiens
atggcattattttaaa

SEQ ID NO: 52062 - DNA, 16 bp, H. sapiens
atggcattcattaaaa

SEQ ID NO: 52063 - DNA, 16 bp, H. sapiens
atggccaacaggtata

SEQ ID NO: 52064 - DNA, 18 bp, H. sapiens
atggccaacatggtgaaa

SEQ ID NO: 52065 - DNA, 16 bp, H. sapiens
atggccaagaagcaca

SEQ ID NO: 52066 - DNA, 18 bp, H. sapiens
atggccaagatggtgaaa

SEQ ID NO: 52067 - DNA, 16 bp, H. sapiens
atggccaatcttgttt

SEQ ID NO: 52068 - DNA, 16 bp, H. sapiens
atggccaatgagcaca

SEQ ID NO: 52069 - DNA, 16 bp, H. sapiens
atggccacactgccca

SEQ ID NO: 52070 - DNA, 16 bp, H. sapiens
atggccagaataaaag

SEQ ID NO: 52071 - DNA, 16 bp, H. sapiens
atggccagagcaggaa

SEQ ID NO: 52072 - DNA, 17 bp, H. sapiens
atggccaggcatggtga

SEQ ID NO: 52073 - DNA, 16 bp, H. sapiens
atggccaggcgcagtg

SEQ ID NO: 52074 - DNA, 16 bp, H. sapiens
atggccaggctgtgaa

SEQ ID NO: 52075 - DNA, 16 bp, H. sapiens
atggccagggaggcct

SEQ ID NO: 52076 - DNA, 16 bp, H. sapiens
atggccagggcaggag

SEQ ID NO: 52077 - DNA, 16 bp, H. sapiens
atggccaggtacggtg

SEQ ID NO: 52078 - DNA, 16 bp, H. sapiens
atggccataatgccca

SEQ ID NO: 52079 - DNA, 17 bp, H. sapiens
atggccatactacccaa

SEQ ID NO: 52080 - DNA, 16 bp, H. sapiens
atggccatctacaagc

SEQ ID NO: 52081 - DNA, 16 bp, H. sapiens
atggccatctgcaagc

SEQ ID NO: 52082 - DNA, 16 bp, H. sapiens
atggccatgtgaagat

SEQ ID NO: 52083 - DNA, 16 bp, H. sapiens
atggccatttaaacaa

SEQ ID NO: 52084 - DNA, 16 bp, H. sapiens
atggcccacaaagcct

SEQ ID NO: 52085 - DNA, 16 bp, H. sapiens
atggcccactgcagcc

SEQ ID NO: 52086 - DNA, 16 bp, H. sapiens
atggcccttgcagtga

SEQ ID NO: 52087 - DNA, 16 bp, H. sapiens
atggccgagcacagtg

SEQ ID NO: 52088 - DNA, 16 bp, H. sapiens
atggccgggcgcagtg

SEQ ID NO: 52089 - DNA, 16 bp, H. sapiens
atggcctacaaagcct

SEQ ID NO: 52090 - DNA, 16 bp, H. sapiens
atggcctccagctgca

SEQ ID NO: 52091 - DNA, 16 bp, H. sapiens
atggcctctagctcca

SEQ ID NO: 52092 - DNA, 16 bp, H. sapiens
atggcctctggctcca

SEQ ID NO: 52093 - DNA, 16 bp, H. sapiens
atggcctgaagtgcag

SEQ ID NO: 52094 - DNA, 16 bp, H. sapiens
atggcctgagcctggg

SEQ ID NO: 52095 - DNA, 16 bp, H. sapiens
atggcctggatgtggt

SEQ ID NO: 52096 - DNA, 16 bp, H. sapiens
atggcctttattatat

SEQ ID NO: 52097 - DNA, 16 bp, H. sapiens
atggcgctactgcact

SEQ ID NO: 52098 - DNA, 16 bp, H. sapiens
atggcgctggcatctg

SEQ ID NO: 52099 - DNA, 16 bp, H. sapiens
atggcggaaagcaaag

SEQ ID NO: 52100 - DNA, 16 bp, H. sapiens
atggcggaaggagaag

SEQ ID NO: 52101 - DNA, 16 bp, H. sapiens
atggcggagcaggaga

SEQ ID NO: 52102 - DNA, 18 bp, H. sapiens
atggcgtgaacccaggag

SEQ ID NO: 52103 - DNA, 18 bp, H. sapiens
atggcgtgaaccgaggag

SEQ ID NO: 52104 - DNA, 16 bp, H. sapiens
atggcgtgaacctggg

SEQ ID NO: 52105 - DNA, 19 bp, H. sapiens
atggcgtgatcttggctca

SEQ ID NO: 52106 - DNA, 16 bp, H. sapiens
atggctaaaataagaa

SEQ ID NO: 52107 - DNA, 16 bp, H. sapiens
atggctaataatgttg

SEQ ID NO: 52108 - DNA, 16 bp, H. sapiens
atggctacaataaaaa

SEQ ID NO: 52109 - DNA, 16 bp, H. sapiens
atggctatcataaaaa

SEQ ID NO: 52110 - DNA, 16 bp, H. sapiens
atggctatcatcaaaa

SEQ ID NO: 52111 - DNA, 16 bp, H. sapiens
atggctattataaaaa

SEQ ID NO: 52112 - DNA, 16 bp, H. sapiens
atggctattttcaaaa

SEQ ID NO: 52113 - DNA, 16 bp, H. sapiens
atggctatttttattt

SEQ ID NO: 52114 - DNA, 18 bp, H. sapiens
atggctcacgcctgtaat

SEQ ID NO: 52115 - DNA, 16 bp, H. sapiens
atggctcactgtagcc

SEQ ID NO: 52116 - DNA, 19 bp, H. sapiens
atggctcatgcctataatt

SEQ ID NO: 52117 - DNA, 17 bp, H. sapiens
atggctcatgcctgtaa

SEQ ID NO: 52118 - DNA, 16 bp, H. sapiens
atggctcatgccttta

SEQ ID NO: 52119 - DNA, 16 bp, H. sapiens
atggctcatggggata

SEQ ID NO: 52120 - DNA, 16 bp, H. sapiens
atggctccatctcggc

SEQ ID NO: 52121 - DNA, 16 bp, H. sapiens
atggctccctattgcc

SEQ ID NO: 52122 - DNA, 16 bp, H. sapiens
atggctccttcctcca

SEQ ID NO: 52123 - DNA, 16 bp, H. sapiens
atggctctctgcagcc

SEQ ID NO: 52124 - DNA, 16 bp, H. sapiens
atggctctggaggctg

SEQ ID NO: 52125 - DNA, 16 bp, H. sapiens
atggctctgtgtgtgt

SEQ ID NO: 52126 - DNA, 16 bp, H. sapiens
atggctgaaggtgaag

SEQ ID NO: 52127 - DNA, 16 bp, H. sapiens
atggctgagctggtac

SEQ ID NO: 52128 - DNA, 16 bp, H. sapiens
atggctgcaccatttt

SEQ ID NO: 52129 - DNA, 16 bp, H. sapiens
atggctgctgactgac

SEQ ID NO: 52130 - DNA, 16 bp, H. sapiens
atggctgctgtaacaa

SEQ ID NO: 52131 - DNA, 16 bp, H. sapiens
atggctggatcacatg

SEQ ID NO: 52132 - DNA, 16 bp, H. sapiens
atggctggatccagga

SEQ ID NO: 52133 - DNA, 16 bp, H. sapiens
atggctggctaatttt

SEQ ID NO: 52134 - DNA, 16 bp, H. sapiens
atggctgggcagctgc

SEQ ID NO: 52135 - DNA, 16 bp, H. sapiens
atggctggggaggtct

SEQ ID NO: 52136 - DNA, 16 bp, H. sapiens
atggctggggatctgg

SEQ ID NO: 52137 - DNA, 16 bp, H. sapiens
atggctggtatcatca

SEQ ID NO: 52138 - DNA, 16 bp, H. sapiens
atggctgtaatcccag

SEQ ID NO: 52139 - DNA, 16 bp, H. sapiens
atggctgtgtattatt

SEQ ID NO: 52140 - DNA, 16 bp, H. sapiens
atggcttaaacaacag

SEQ ID NO: 52141 - DNA, 16 bp, H. sapiens
atggcttcaaagagaa

SEQ ID NO: 52142 - DNA, 16 bp, H. sapiens
atggcttcaagctcca

SEQ ID NO: 52143 - DNA, 16 bp, H. sapiens
atggcttcagcagtgt

SEQ ID NO: 52144 - DNA, 16 bp, H. sapiens
atggcttcatagctca

SEQ ID NO: 52145 - DNA, 16 bp, H. sapiens
atggcttccaactcca

SEQ ID NO: 52146 - DNA, 16 bp, H. sapiens
atggcttccagtttca

SEQ ID NO: 52147 - DNA, 16 bp, H. sapiens
atggcttccatttggc

SEQ ID NO: 52148 - DNA, 16 bp, H. sapiens
atggcttccggcttca

SEQ ID NO: 52149 - DNA, 16 bp, H. sapiens
atggcttctagcttca

SEQ ID NO: 52150 - DNA, 16 bp, H. sapiens
atggcttctggatttt

SEQ ID NO: 52151 - DNA, 16 bp, H. sapiens
atggcttttattacct

SEQ ID NO: 52152 - DNA, 16 bp, H. sapiens
atggcttttgtttctt

SEQ ID NO: 52153 - DNA, 16 bp, H. sapiens
atgggaaaaaaacaga

SEQ ID NO: 52154 - DNA, 16 bp, H. sapiens
atgggaaaaaaatcag

SEQ ID NO: 52155 - DNA, 16 bp, H. sapiens
atgggaaaaaatactt

SEQ ID NO: 52156 - DNA, 16 bp, H. sapiens
atgggaaaaaatgttt

SEQ ID NO: 52157 - DNA, 16 bp, H. sapiens
atgggaaaaactggaa

SEQ ID NO: 52158 - DNA, 16 bp, H. sapiens
atgggaaaaatagaca

SEQ ID NO: 52159 - DNA, 16 bp, H. sapiens
atgggaaaaatatttg

SEQ ID NO: 52160 - DNA, 16 bp, H. sapiens
atgggaaaacattcca

SEQ ID NO: 52161 - DNA, 16 bp, H. sapiens
atgggaaaagaacagt

SEQ ID NO: 52162 - DNA, 16 bp, H. sapiens
atgggaaaataaatta

SEQ ID NO: 52163 - DNA, 16 bp, H. sapiens
atgggaaaattttttt

SEQ ID NO: 52164 - DNA, 16 bp, H. sapiens
atgggaacatggatgg

SEQ ID NO: 52165 - DNA, 16 bp, H. sapiens
atgggaactcactcac

SEQ ID NO: 52166 - DNA, 16 bp, H. sapiens
atgggaagatgtgcat

SEQ ID NO: 52167 - DNA, 16 bp, H. sapiens
atgggaagcattgtca

SEQ ID NO: 52168 - DNA, 16 bp, H. sapiens
atgggaagcccatcag

SEQ ID NO: 52169 - DNA, 16 bp, H. sapiens
atgggaagctgtggtg

SEQ ID NO: 52170 - DNA, 16 bp, H. sapiens
atgggaataataatga

SEQ ID NO: 52171 - DNA, 16 bp, H. sapiens
atgggaatatcttaaa

SEQ ID NO: 52172 - DNA, 16 bp, H. sapiens
atgggaattttaaaaa

SEQ ID NO: 52173 - DNA, 16 bp, H. sapiens
atgggaccatctagtt

SEQ ID NO: 52174 - DNA, 24 bp, H. sapiens
atgggactgggcgctgtggagcag

SEQ ID NO: 52175 - DNA, 16 bp, H. sapiens
atgggactgtttgttt

SEQ ID NO: 52176 - DNA, 16 bp, H. sapiens
atgggactttggactt

SEQ ID NO: 52177 - DNA, 16 bp, H. sapiens
atgggagaaaataatt

SEQ ID NO: 52178 - DNA, 16 bp, H. sapiens
atgggagaaagtgaca

SEQ ID NO: 52179 - DNA, 16 bp, H. sapiens
atgggagaaatttttg

SEQ ID NO: 52180 - DNA, 16 bp, H. sapiens
atgggagagacagaca

SEQ ID NO: 52181 - DNA, 16 bp, H. sapiens
atgggagatacaattc

SEQ ID NO: 52182 - DNA, 16 bp, H. sapiens
atgggaggacagcttg

SEQ ID NO: 52183 - DNA, 23 bp, H. sapiens
atgggaggatcacttgaggccag

SEQ ID NO: 52184 - DNA, 16 bp, H. sapiens
atgggaggattacctg

SEQ ID NO: 52185 - DNA, 16 bp, H. sapiens
atgggaggcaggacta

SEQ ID NO: 52186 - DNA, 16 bp, H. sapiens
atgggaggctgaggcg

SEQ ID NO: 52187 - DNA, 16 bp, H. sapiens
atgggagggacccagt

SEQ ID NO: 52188 - DNA, 16 bp, H. sapiens
atgggaggggacccaa

SEQ ID NO: 52189 - DNA, 16 bp, H. sapiens
atgggagtgaaaccct

SEQ ID NO: 52190 - DNA, 16 bp, H. sapiens
atgggatactttaaca

SEQ ID NO: 52191 - DNA, 16 bp, H. sapiens
atgggatccaggccag

SEQ ID NO: 52192 - DNA, 16 bp, H. sapiens
atgggatctcactctg

SEQ ID NO: 52193 - DNA, 16 bp, H. sapiens
atgggatggcatcctg

SEQ ID NO: 52194 - DNA, 16 bp, H. sapiens
atgggattagggccct

SEQ ID NO: 52195 - DNA, 16 bp, H. sapiens
atgggattgctgtgtc

SEQ ID NO: 52196 - DNA, 16 bp, H. sapiens
atgggatttaaaaaaa

SEQ ID NO: 52197 - DNA, 16 bp, H. sapiens
atgggatttctccatg

SEQ ID NO: 52198 - DNA, 16 bp, H. sapiens
atgggatttctgggtc

SEQ ID NO: 52199 - DNA, 16 bp, H. sapiens
atgggatttttaaaaa

SEQ ID NO: 52200 - DNA, 16 bp, H. sapiens
atgggcaagaccaccc

SEQ ID NO: 52201 - DNA, 16 bp, H. sapiens
atgggcaaggacttga

SEQ ID NO: 52202 - DNA, 16 bp, H. sapiens
atgggcacagagaggg

SEQ ID NO: 52203 - DNA, 16 bp, H. sapiens
atgggcagcacagcag

SEQ ID NO: 52204 - DNA, 16 bp, H. sapiens
atgggcagccaggcag

SEQ ID NO: 52205 - DNA, 16 bp, H. sapiens
atgggcatgcatacaa

SEQ ID NO: 52206 - DNA, 16 bp, H. sapiens
atgggcatttgggttg

SEQ ID NO: 52207 - DNA, 16 bp, H. sapiens
atgggccaggctggtc

SEQ ID NO: 52208 - DNA, 16 bp, H. sapiens
atgggccagggccagg

SEQ ID NO: 52209 - DNA, 16 bp, H. sapiens
atgggcctcatccaat

SEQ ID NO: 52210 - DNA, 16 bp, H. sapiens
atgggccttgggctct

SEQ ID NO: 52211 - DNA, 16 bp, H. sapiens
atgggcgaggacttca

SEQ ID NO: 52212 - DNA, 16 bp, H. sapiens
atgggctacagaatga

SEQ ID NO: 52213 - DNA, 16 bp, H. sapiens
atgggctcagaaatgt

SEQ ID NO: 52214 - DNA, 16 bp, H. sapiens
atgggctctggagcca

SEQ ID NO: 52215 - DNA, 16 bp, H. sapiens
atgggctgctcaactg

SEQ ID NO: 52216 - DNA, 16 bp, H. sapiens
atgggctgggcccagg

SEQ ID NO: 52217 - DNA, 16 bp, H. sapiens
atgggctgtagaatgg

SEQ ID NO: 52218 - DNA, 16 bp, H. sapiens
atgggcttaaaaaatg

SEQ ID NO: 52219 - DNA, 16 bp, H. sapiens
atgggctttagttaat

SEQ ID NO: 52220 - DNA, 16 bp, H. sapiens
atggggaaaaaaatca

SEQ ID NO: 52221 - DNA, 17 bp, H. sapiens
atggggaaaaaacagag

SEQ ID NO: 52222 - DNA, 16 bp, H. sapiens
atggggaaaaaatgta

SEQ ID NO: 52223 - DNA, 16 bp, H. sapiens
atggggaaaagctgaa

SEQ ID NO: 52224 - DNA, 16 bp, H. sapiens
atggggaaaatctgaa

SEQ ID NO: 52225 - DNA, 16 bp, H. sapiens
atggggaaaatgcctt

SEQ ID NO: 52226 - DNA, 16 bp, H. sapiens
atggggaaacagaggc

SEQ ID NO: 52227 - DNA, 16 bp, H. sapiens
atggggaaaccgaggc

SEQ ID NO: 52228 - DNA, 16 bp, H. sapiens
atggggaaactgagac

SEQ ID NO: 52229 - DNA, 17 bp, H. sapiens
atggggaaactgaggca

SEQ ID NO: 52230 - DNA, 16 bp, H. sapiens
atggggaaactgaggt

SEQ ID NO: 52231 - DNA, 16 bp, H. sapiens
atggggaaagacttca

SEQ ID NO: 52232 - DNA, 16 bp, H. sapiens
atggggaaaggagtcc

SEQ ID NO: 52233 - DNA, 22 bp, H. sapiens
atggggaaaggattccctatta

SEQ ID NO: 52234 - DNA, 16 bp, H. sapiens
atggggaaatggaggc

SEQ ID NO: 52235 - DNA, 16 bp, H. sapiens
atggggaagctgaggc

SEQ ID NO: 52236 - DNA, 16 bp, H. sapiens
atggggacgtggagaa

SEQ ID NO: 52237 - DNA, 16 bp, H. sapiens
atggggacttggagaa

SEQ ID NO: 52238 - DNA, 23 bp, H. sapiens
atggggagaaaccagagcagaaa

SEQ ID NO: 52239 - DNA, 16 bp, H. sapiens
atggggagactgaggc

SEQ ID NO: 52240 - DNA, 16 bp, H. sapiens
atggggagctctggag

SEQ ID NO: 52241 - DNA, 16 bp, H. sapiens
atggggatggtggtga

SEQ ID NO: 52242 - DNA, 16 bp, H. sapiens
atggggattattacaa

SEQ ID NO: 52243 - DNA, 16 bp, H. sapiens
atggggcagagcctgg

SEQ ID NO: 52244 - DNA, 16 bp, H. sapiens
atggggcagggcaggg

SEQ ID NO: 52245 - DNA, 16 bp, H. sapiens
atggggcctcactctg

SEQ ID NO: 52246 - DNA, 16 bp, H. sapiens
atggggcctttgggag

SEQ ID NO: 52247 - DNA, 16 bp, H. sapiens
atggggctggaggcca

SEQ ID NO: 52248 - DNA, 16 bp, H. sapiens
atggggcttcaccatc

SEQ ID NO: 52249 - DNA, 16 bp, H. sapiens
atgggggcaggtcttt

SEQ ID NO: 52250 - DNA, 16 bp, H. sapiens
atgggggcagtctccc

SEQ ID NO: 52251 - DNA, 16 bp, H. sapiens
atgggggccccaccct

SEQ ID NO: 52252 - DNA, 16 bp, H. sapiens
atgggggcgggttttt

SEQ ID NO: 52253 - DNA, 16 bp, H. sapiens
atgggggtggcttcta

SEQ ID NO: 52254 - DNA, 17 bp, H. sapiens
atgggggtgggcacctg

SEQ ID NO: 52255 - DNA, 16 bp, H. sapiens
atgggggtgggggctc

SEQ ID NO: 52256 - DNA, 16 bp, H. sapiens
atgggggtggtttcct

SEQ ID NO: 52257 - DNA, 16 bp, H. sapiens
atggggtcttgctatg

SEQ ID NO: 52258 - DNA, 16 bp, H. sapiens
atggggtttcaccaca

SEQ ID NO: 52259 - DNA, 16 bp, H. sapiens
atggggtttcaccata

SEQ ID NO: 52260 - DNA, 20 bp, H. sapiens
atggggtttcaccatgttga

SEQ ID NO: 52261 - DNA, 25 bp, H. sapiens
atggggtttcaccatgttggccagc

SEQ ID NO: 52262 - DNA, 25 bp, H. sapiens
atggggtttcaccatgttggccagt

SEQ ID NO: 52263 - DNA, 16 bp, H. sapiens
atggggtttcgtcatg

SEQ ID NO: 52264 - DNA, 16 bp, H. sapiens
atggggtttctccaag

SEQ ID NO: 52265 - DNA, 16 bp, H. sapiens
atggggtttctccatg

SEQ ID NO: 52266 - DNA, 16 bp, H. sapiens
atggggtttcttcatg

SEQ ID NO: 52267 - DNA, 16 bp, H. sapiens
atggggtttcttttgg

SEQ ID NO: 52268 - DNA, 16 bp, H. sapiens
atggggttttaccgtg

SEQ ID NO: 52269 - DNA, 16 bp, H. sapiens
atggggttttcaaaat

SEQ ID NO: 52270 - DNA, 16 bp, H. sapiens
atggggttttcccatg

SEQ ID NO: 52271 - DNA, 16 bp, H. sapiens
atgggtactcaaagta

SEQ ID NO: 52272 - DNA, 16 bp, H. sapiens
atgggtcaattcagca

SEQ ID NO: 52273 - DNA, 16 bp, H. sapiens
atgggtcagggagggg

SEQ ID NO: 52274 - DNA, 17 bp, H. sapiens
atgggtgaaattggaaa

SEQ ID NO: 52275 - DNA, 16 bp, H. sapiens
atgggtgaattttata

SEQ ID NO: 52276 - DNA, 16 bp, H. sapiens
atgggtgaggaaaaga

SEQ ID NO: 52277 - DNA, 16 bp, H. sapiens
atgggtggagctggag

SEQ ID NO: 52278 - DNA, 16 bp, H. sapiens
atgggtgggcccagaa

SEQ ID NO: 52279 - DNA, 16 bp, H. sapiens
atgggtggtgatggat

SEQ ID NO: 52280 - DNA, 16 bp, H. sapiens
atgggttacatttatt

SEQ ID NO: 52281 - DNA, 16 bp, H. sapiens
atgggttataaatacc

SEQ ID NO: 52282 - DNA, 16 bp, H. sapiens
atgggttctcactatg

SEQ ID NO: 52283 - DNA, 16 bp, H. sapiens
atgggttgacgggtgc

SEQ ID NO: 52284 - DNA, 16 bp, H. sapiens
atgggtttattattgt

SEQ ID NO: 52285 - DNA, 16 bp, H. sapiens
atgggttttaacaaat

SEQ ID NO: 52286 - DNA, 16 bp, H. sapiens
atgggttttatttaat

SEQ ID NO: 52287 - DNA, 16 bp, H. sapiens
atggtaaaaacaaaca

SEQ ID NO: 52288 - DNA, 16 bp, H. sapiens
atggtaaaatatatat

SEQ ID NO: 52289 - DNA, 16 bp, H. sapiens
atggtaaaattggttt

SEQ ID NO: 52290 - DNA, 16 bp, H. sapiens
atggtaaagaccatcg

SEQ ID NO: 52291 - DNA, 16 bp, H. sapiens
atggtaaaggccattc

SEQ ID NO: 52292 - DNA, 16 bp, H. sapiens
atggtaaatatataca

SEQ ID NO: 52293 - DNA, 16 bp, H. sapiens
atggtaaatgaacact

SEQ ID NO: 52294 - DNA, 16 bp, H. sapiens
atggtaaattttatat

SEQ ID NO: 52295 - DNA, 16 bp, H. sapiens
atggtaagaatgaatc

SEQ ID NO: 52296 - DNA, 16 bp, H. sapiens
atggtaattttaacaa

SEQ ID NO: 52297 - DNA, 16 bp, H. sapiens
atggtacaggcagagc

SEQ ID NO: 52298 - DNA, 16 bp, H. sapiens
atggtacatatatacc

SEQ ID NO: 52299 - DNA, 16 bp, H. sapiens
atggtacatgtgcagg

SEQ ID NO: 52300 - DNA, 16 bp, H. sapiens
atggtagaaatagcaa

SEQ ID NO: 52301 - DNA, 16 bp, H. sapiens
atggtagagagcagtc

SEQ ID NO: 52302 - DNA, 16 bp, H. sapiens
atggtagctgtatttt

SEQ ID NO: 52303 - DNA, 16 bp, H. sapiens
atggtagttctttttt

SEQ ID NO: 52304 - DNA, 16 bp, H. sapiens
atggtatagcctacca

SEQ ID NO: 52305 - DNA, 16 bp, H. sapiens
atggtatatctttctt

SEQ ID NO: 52306 - DNA, 17 bp, H. sapiens
atggtattacctagatt

SEQ ID NO: 52307 - DNA, 16 bp, H. sapiens
atggtattgctgggtt

SEQ ID NO: 52308 - DNA, 16 bp, H. sapiens
atggtatttaaaatat

SEQ ID NO: 52309 - DNA, 16 bp, H. sapiens
atggtatttcccaggt

SEQ ID NO: 52310 - DNA, 16 bp, H. sapiens
atggtcaaaaaggaaa

SEQ ID NO: 52311 - DNA, 16 bp, H. sapiens
atggtcaccattctaa

SEQ ID NO: 52312 - DNA, 16 bp, H. sapiens
atggtcaggctggtct

SEQ ID NO: 52313 - DNA, 16 bp, H. sapiens
atggtcccagctacta

SEQ ID NO: 52314 - DNA, 16 bp, H. sapiens
atggtctaaaaaaggg

SEQ ID NO: 52315 - DNA, 18 bp, H. sapiens
atggtctcaaactcctgg

SEQ ID NO: 52316 - DNA, 16 bp, H. sapiens
atggtctccctctccc

SEQ ID NO: 52317 - DNA, 16 bp, H. sapiens
atggtctctgtctcct

SEQ ID NO: 52318 - DNA, 16 bp, H. sapiens
atggtcttgctcaatt

SEQ ID NO: 52319 - DNA, 16 bp, H. sapiens
atggtcttgggcagct

SEQ ID NO: 52320 - DNA, 16 bp, H. sapiens
atggtcttgttctctt

SEQ ID NO: 52321 - DNA, 16 bp, H. sapiens
atggtctttattgtgt

SEQ ID NO: 52322 - DNA, 16 bp, H. sapiens
atggtcttttaaaaac

SEQ ID NO: 52323 - DNA, 16 bp, H. sapiens
atggtgaaaaagtaaa

SEQ ID NO: 52324 - DNA, 16 bp, H. sapiens
atggtgaaaaatcaaa

SEQ ID NO: 52325 - DNA, 17 bp, H. sapiens
atggtgaaaccccacct

SEQ ID NO: 52326 - DNA, 30 bp, H. sapiens
atggtgaaaccccatctctactaaaaatag

SEQ ID NO: 52327 - DNA, 18 bp, H. sapiens
atggtgaaaccccgtctt

SEQ ID NO: 52328 - DNA, 20 bp, H. sapiens
atggtgaaaccctatctcta

SEQ ID NO: 52329 - DNA, 16 bp, H. sapiens
atggtgaaacctccgt

SEQ ID NO: 52330 - DNA, 16 bp, H. sapiens
atggtgaaacctcctc

SEQ ID NO: 52331 - DNA, 16 bp, H. sapiens
atggtgaaacctgttt

SEQ ID NO: 52332 - DNA, 20 bp, H. sapiens
atggtgaaactccgtctcta

SEQ ID NO: 52333 - DNA, 16 bp, H. sapiens
atggtgaaactcctgt

SEQ ID NO: 52334 - DNA, 16 bp, H. sapiens
atggtgaaactccttc

SEQ ID NO: 52335 - DNA, 16 bp, H. sapiens
atggtgaaactgtctc

SEQ ID NO: 52336 - DNA, 16 bp, H. sapiens
atggtgaaagtccgtc

SEQ ID NO: 52337 - DNA, 16 bp, H. sapiens
atggtgaaatccagtc

SEQ ID NO: 52338 - DNA, 16 bp, H. sapiens
atggtgaaatcctatc

SEQ ID NO: 52339 - DNA, 16 bp, H. sapiens
atggtgaactgtgagt

SEQ ID NO: 52340 - DNA, 16 bp, H. sapiens
atggtgaatccccgtc

SEQ ID NO: 52341 - DNA, 16 bp, H. sapiens
atggtgaattacactg

SEQ ID NO: 52342 - DNA, 16 bp, H. sapiens
atggtgacaactttta

SEQ ID NO: 52343 - DNA, 16 bp, H. sapiens
atggtgagacccctgt

SEQ ID NO: 52344 - DNA, 16 bp, H. sapiens
atggtgagtgttacag

SEQ ID NO: 52345 - DNA, 16 bp, H. sapiens
atggtgatgatgacag

SEQ ID NO: 52346 - DNA, 16 bp, H. sapiens
atggtgatgatgagga

SEQ ID NO: 52347 - DNA, 16 bp, H. sapiens
atggtgatgatgataa

SEQ ID NO: 52348 - DNA, 16 bp, H. sapiens
atggtgatgatggttg

SEQ ID NO: 52349 - DNA, 16 bp, H. sapiens
atggtgatggcagtgg

SEQ ID NO: 52350 - DNA, 16 bp, H. sapiens
atggtgatggtgaagg

SEQ ID NO: 52351 - DNA, 16 bp, H. sapiens
atggtgatggtgatgg

SEQ ID NO: 52352 - DNA, 16 bp, H. sapiens
atggtgatggttacat

SEQ ID NO: 52353 - DNA, 19 bp, H. sapiens
atggtgcaatcttggctca

SEQ ID NO: 52354 - DNA, 16 bp, H. sapiens
atggtgcacacctgta

SEQ ID NO: 52355 - DNA, 16 bp, H. sapiens
atggtgcagtcacttt

SEQ ID NO: 52356 - DNA, 16 bp, H. sapiens
atggtgccaatgcact

SEQ ID NO: 52357 - DNA, 16 bp, H. sapiens
atggtgccactgcacc

SEQ ID NO: 52358 - DNA, 16 bp, H. sapiens
atggtgccactgctct

SEQ ID NO: 52359 - DNA, 16 bp, H. sapiens
atggtgcccactcaga

SEQ ID NO: 52360 - DNA, 16 bp, H. sapiens
atggtgcccaggctag

SEQ ID NO: 52361 - DNA, 16 bp, H. sapiens
atggtgcctggcatat

SEQ ID NO: 52362 - DNA, 16 bp, H. sapiens
atggtgctaaaccatt

SEQ ID NO: 52363 - DNA, 17 bp, H. sapiens
atggtgctatcttggct

SEQ ID NO: 52364 - DNA, 16 bp, H. sapiens
atggtgctgaaaaaaa

SEQ ID NO: 52365 - DNA, 16 bp, H. sapiens
atggtgctgaaccatt

SEQ ID NO: 52366 - DNA, 16 bp, H. sapiens
atggtggaaaagcaaa

SEQ ID NO: 52367 - DNA, 16 bp, H. sapiens
atggtggaaaaggaaa

SEQ ID NO: 52368 - DNA, 16 bp, H. sapiens
atggtggaaagagaag

SEQ ID NO: 52369 - DNA, 16 bp, H. sapiens
atggtggaaagcaaag

SEQ ID NO: 52370 - DNA, 16 bp, H. sapiens
atggtggaagataaag

SEQ ID NO: 52371 - DNA, 16 bp, H. sapiens
atggtggaagatgaaa

SEQ ID NO: 52372 - DNA, 16 bp, H. sapiens
atggtggaaggagaag

SEQ ID NO: 52373 - DNA, 16 bp, H. sapiens
atggtggaaggagcaa

SEQ ID NO: 52374 - DNA, 16 bp, H. sapiens
atggtggaaggcaaaa

SEQ ID NO: 52375 - DNA, 16 bp, H. sapiens
atggtggcaaacgcct

SEQ ID NO: 52376 - DNA, 16 bp, H. sapiens
atggtggcacacctgt

SEQ ID NO: 52377 - DNA, 16 bp, H. sapiens
atggtggcacatgtgt

SEQ ID NO: 52378 - DNA, 16 bp, H. sapiens
atggtggcacattcct

SEQ ID NO: 52379 - DNA, 16 bp, H. sapiens
atggtggcacctgcct

SEQ ID NO: 52380 - DNA, 16 bp, H. sapiens
atggtggcagaagaga

SEQ ID NO: 52381 - DNA, 16 bp, H. sapiens
atggtggcaggcactt

SEQ ID NO: 52382 - DNA, 16 bp, H. sapiens
atggtggcagtcaaga

SEQ ID NO: 52383 - DNA, 16 bp, H. sapiens
atggtggcagtcacct

SEQ ID NO: 52384 - DNA, 16 bp, H. sapiens
atggtggcagtggtgg

SEQ ID NO: 52385 - DNA, 16 bp, H. sapiens
atggtggcatggacct

SEQ ID NO: 52386 - DNA, 16 bp, H. sapiens
atggtggcgcacctgt

SEQ ID NO: 52387 - DNA, 18 bp, H. sapiens
atggtggctcacacctgc

SEQ ID NO: 52388 - DNA, 16 bp, H. sapiens
atggtggctcatgtct

SEQ ID NO: 52389 - DNA, 16 bp, H. sapiens
atggtggctgccaggg

SEQ ID NO: 52390 - DNA, 16 bp, H. sapiens
atggtggctggtgcct

SEQ ID NO: 52391 - DNA, 16 bp, H. sapiens
atggtggctgtcttct

SEQ ID NO: 52392 - DNA, 16 bp, H. sapiens
atggtgggacttctca

SEQ ID NO: 52393 - DNA, 16 bp, H. sapiens
atggtgggaggcaaga

SEQ ID NO: 52394 - DNA, 16 bp, H. sapiens
atggtggtgagcactt

SEQ ID NO: 52395 - DNA, 16 bp, H. sapiens
atggtggtgatagtga

SEQ ID NO: 52396 - DNA, 16 bp, H. sapiens
atggtggtgatagtgg

SEQ ID NO: 52397 - DNA, 16 bp, H. sapiens
atggtggtgatgactg

SEQ ID NO: 52398 - DNA, 16 bp, H. sapiens
atggtggtgcacacct

SEQ ID NO: 52399 - DNA, 21 bp, H. sapiens
atggtggtgcacacctgtaat

SEQ ID NO: 52400 - DNA, 16 bp, H. sapiens
atggtggtgcaggcct

SEQ ID NO: 52401 - DNA, 17 bp, H. sapiens
atggtggtgcgtgccta

SEQ ID NO: 52402 - DNA, 16 bp, H. sapiens
atggtggtggtatttt

SEQ ID NO: 52403 - DNA, 16 bp, H. sapiens
atggtggtgtccacct

SEQ ID NO: 52404 - DNA, 16 bp, H. sapiens
atggtggtgtgtactt

SEQ ID NO: 52405 - DNA, 17 bp, H. sapiens
atggtggtgtgtgccta

SEQ ID NO: 52406 - DNA, 16 bp, H. sapiens
atggtggttaccagga

SEQ ID NO: 52407 - DNA, 16 bp, H. sapiens
atggtggttgtcaggg

SEQ ID NO: 52408 - DNA, 17 bp, H. sapiens
atggtggttttgtcgaa

SEQ ID NO: 52409 - DNA, 16 bp, H. sapiens
atggtgtaaatacttc

SEQ ID NO: 52410 - DNA, 16 bp, H. sapiens
atggtgtcaaaggaga

SEQ ID NO: 52411 - DNA, 16 bp, H. sapiens
atggtgtcttattgtg

SEQ ID NO: 52412 - DNA, 16 bp, H. sapiens
atggtgtgaactcggg

SEQ ID NO: 52413 - DNA, 16 bp, H. sapiens
atggtgtgatctttgc

SEQ ID NO: 52414 - DNA, 17 bp, H. sapiens
atggtgtggtcttggct

SEQ ID NO: 52415 - DNA, 16 bp, H. sapiens
atggtgttagaaatca

SEQ ID NO: 52416 - DNA, 16 bp, H. sapiens
atggtgttggggaaac

SEQ ID NO: 52417 - DNA, 16 bp, H. sapiens
atggtgtttccccatg

SEQ ID NO: 52418 - DNA, 16 bp, H. sapiens
atggttaaaattgtaa

SEQ ID NO: 52419 - DNA, 16 bp, H. sapiens
atggttaaatctagct

SEQ ID NO: 52420 - DNA, 16 bp, H. sapiens
atggttaatttcatgt

SEQ ID NO: 52421 - DNA, 16 bp, H. sapiens
atggttataatcaaaa

SEQ ID NO: 52422 - DNA, 16 bp, H. sapiens
atggttataattaaaa

SEQ ID NO: 52423 - DNA, 16 bp, H. sapiens
atggttcactgcagct

SEQ ID NO: 52424 - DNA, 16 bp, H. sapiens
atggttgaactcattt

SEQ ID NO: 52425 - DNA, 16 bp, H. sapiens
atggttgaagctggaa

SEQ ID NO: 52426 - DNA, 16 bp, H. sapiens
atggttgcacagcagt

SEQ ID NO: 52427 - DNA, 16 bp, H. sapiens
atggttgccaggggct

SEQ ID NO: 52428 - DNA, 16 bp, H. sapiens
atggttgtgaggatta

SEQ ID NO: 52429 - DNA, 16 bp, H. sapiens
atggtttaaaacaaca

SEQ ID NO: 52430 - DNA, 16 bp, H. sapiens
atggtttcagaaggaa

SEQ ID NO: 52431 - DNA, 16 bp, H. sapiens
atggtttcataagggg

SEQ ID NO: 52432 - DNA, 16 bp, H. sapiens
atggtttccagcctca

SEQ ID NO: 52433 - DNA, 16 bp, H. sapiens
atggtttccagctcca

SEQ ID NO: 52434 - DNA, 16 bp, H. sapiens
atggtttccattttca

SEQ ID NO: 52435 - DNA, 16 bp, H. sapiens
atggtttcgccatgtt

SEQ ID NO: 52436 - DNA, 16 bp, H. sapiens
atggtttctaatggtt

SEQ ID NO: 52437 - DNA, 16 bp, H. sapiens
atggtttgaatgcttg

SEQ ID NO: 52438 - DNA, 16 bp, H. sapiens
atggtttgctcagaat

SEQ ID NO: 52439 - DNA, 16 bp, H. sapiens
atggtttggtgctgtc

SEQ ID NO: 52440 - DNA, 16 bp, H. sapiens
atggttttaagtctaa

SEQ ID NO: 52441 - DNA, 16 bp, H. sapiens
atggttttacaagggg

SEQ ID NO: 52442 - DNA, 16 bp, H. sapiens
atggttttctaaatat

SEQ ID NO: 52443 - DNA, 16 bp, H. sapiens
atggttttgaaaaatg

SEQ ID NO: 52444 - DNA, 16 bp, H. sapiens
atggtttttaaaatgg

SEQ ID NO: 52445 - DNA, 16 bp, H. sapiens
atggtttttacatttt

SEQ ID NO: 52446 - DNA, 16 bp, H. sapiens
atgtaaaaaaatcagt

SEQ ID NO: 52447 - DNA, 16 bp, H. sapiens
atgtaaaaatacataa

SEQ ID NO: 52448 - DNA, 16 bp, H. sapiens
atgtaaaaatgaagat

SEQ ID NO: 52449 - DNA, 16 bp, H. sapiens
atgtaaaaatgtgaaa

SEQ ID NO: 52450 - DNA, 16 bp, H. sapiens
atgtaaaaatgtttct

SEQ ID NO: 52451 - DNA, 16 bp, H. sapiens
atgtaaaacacaaaat

SEQ ID NO: 52452 - DNA, 16 bp, H. sapiens
atgtaaaacccaaaac

SEQ ID NO: 52453 - DNA, 16 bp, H. sapiens
atgtaaaagccaaaac

SEQ ID NO: 52454 - DNA, 16 bp, H. sapiens
atgtaaaataattcat

SEQ ID NO: 52455 - DNA, 16 bp, H. sapiens
atgtaaaatagtatag

SEQ ID NO: 52456 - DNA, 16 bp, H. sapiens
atgtaaaatatgtttt

SEQ ID NO: 52457 - DNA, 16 bp, H. sapiens
atgtaaaatcattttt

SEQ ID NO: 52458 - DNA, 16 bp, H. sapiens
atgtaaaatggaaata

SEQ ID NO: 52459 - DNA, 16 bp, H. sapiens
atgtaaaatggtgcag

SEQ ID NO: 52460 - DNA, 16 bp, H. sapiens
atgtaaaatgtaaatg

SEQ ID NO: 52461 - DNA, 16 bp, H. sapiens
atgtaaaatgtacatt

SEQ ID NO: 52462 - DNA, 16 bp, H. sapiens
atgtaaaatgtgaaac

SEQ ID NO: 52463 - DNA, 16 bp, H. sapiens
atgtaaaatgtggatt

SEQ ID NO: 52464 - DNA, 16 bp, H. sapiens
atgtaaacagattaaa

SEQ ID NO: 52465 - DNA, 16 bp, H. sapiens
atgtaaacatggaaaa

SEQ ID NO: 52466 - DNA, 16 bp, H. sapiens
atgtaaagaaaatgtt

SEQ ID NO: 52467 - DNA, 16 bp, H. sapiens
atgtaaagaaactgaa

SEQ ID NO: 52468 - DNA, 16 bp, H. sapiens
atgtaaagcccaaaac

SEQ ID NO: 52469 - DNA, 16 bp, H. sapiens
atgtaaataaatacat

SEQ ID NO: 52470 - DNA, 16 bp, H. sapiens
atgtaaataatgtttt

SEQ ID NO: 52471 - DNA, 16 bp, H. sapiens
atgtaaatacatggaa

SEQ ID NO: 52472 - DNA, 16 bp, H. sapiens
atgtaaatacttttta

SEQ ID NO: 52473 - DNA, 16 bp, H. sapiens
atgtaaatagttgtta

SEQ ID NO: 52474 - DNA, 16 bp, H. sapiens
atgtaaatatacataa

SEQ ID NO: 52475 - DNA, 16 bp, H. sapiens
atgtaaatatatgtaa

SEQ ID NO: 52476 - DNA, 16 bp, H. sapiens
atgtaaatatcttgtt

SEQ ID NO: 52477 - DNA, 16 bp, H. sapiens
atgtaaatattctaaa

SEQ ID NO: 52478 - DNA, 16 bp, H. sapiens
atgtaaatcaaagcca

SEQ ID NO: 52479 - DNA, 16 bp, H. sapiens
atgtaaatgatgggtt

SEQ ID NO: 52480 - DNA, 16 bp, H. sapiens
atgtaaatggaaccat

SEQ ID NO: 52481 - DNA, 16 bp, H. sapiens
atgtaaatggaattat

SEQ ID NO: 52482 - DNA, 16 bp, H. sapiens
atgtaaatggaccaaa

SEQ ID NO: 52483 - DNA, 16 bp, H. sapiens
atgtaaatggtagttt

SEQ ID NO: 52484 - DNA, 16 bp, H. sapiens
atgtaaatgtaaatgt

SEQ ID NO: 52485 - DNA, 16 bp, H. sapiens
atgtaaatgtgcacaa

SEQ ID NO: 52486 - DNA, 16 bp, H. sapiens
atgtaaattagtccag

SEQ ID NO: 52487 - DNA, 16 bp, H. sapiens
atgtaaatttatttct

SEQ ID NO: 52488 - DNA, 16 bp, H. sapiens
atgtaacaaaacatca

SEQ ID NO: 52489 - DNA, 16 bp, H. sapiens
atgtaacaaaactgca

SEQ ID NO: 52490 - DNA, 16 bp, H. sapiens
atgtaacaaaccagca

SEQ ID NO: 52491 - DNA, 16 bp, H. sapiens
atgtaacaaacctgca

SEQ ID NO: 52492 - DNA, 16 bp, H. sapiens
atgtaacaaacttaca

SEQ ID NO: 52493 - DNA, 16 bp, H. sapiens
atgtaacaattatata

SEQ ID NO: 52494 - DNA, 16 bp, H. sapiens
atgtaacattttatat

SEQ ID NO: 52495 - DNA, 16 bp, H. sapiens
atgtaacattttgaaa

SEQ ID NO: 52496 - DNA, 16 bp, H. sapiens
atgtaaccctgaactt

SEQ ID NO: 52497 - DNA, 16 bp, H. sapiens
atgtaactatttttaa

SEQ ID NO: 52498 - DNA, 16 bp, H. sapiens
atgtaacttctttttt

SEQ ID NO: 52499 - DNA, 16 bp, H. sapiens
atgtaactttaaattt

SEQ ID NO: 52500 - DNA, 16 bp, H. sapiens
atgtaagaaaacattt

SEQ ID NO: 52501 - DNA, 16 bp, H. sapiens
atgtaagaaaactgca

SEQ ID NO: 52502 - DNA, 16 bp, H. sapiens
atgtaagaaaatattt

SEQ ID NO: 52503 - DNA, 16 bp, H. sapiens
atgtaagaaacctgca

SEQ ID NO: 52504 - DNA, 16 bp, H. sapiens
atgtaagatgtgactt

SEQ ID NO: 52505 - DNA, 16 bp, H. sapiens
atgtaagctctttgag

SEQ ID NO: 52506 - DNA, 16 bp, H. sapiens
atgtaaggacacagct

SEQ ID NO: 52507 - DNA, 16 bp, H. sapiens
atgtaatatttacata

SEQ ID NO: 52508 - DNA, 16 bp, H. sapiens
atgtaatattttacat

SEQ ID NO: 52509 - DNA, 16 bp, H. sapiens
atgtaatattttcaaa

SEQ ID NO: 52510 - DNA, 16 bp, H. sapiens
atgtaatattttgaaa

SEQ ID NO: 52511 - DNA, 16 bp, H. sapiens
atgtaatattttgata

SEQ ID NO: 52512 - DNA, 16 bp, H. sapiens
atgtaatcaatatttt

SEQ ID NO: 52513 - DNA, 16 bp, H. sapiens
atgtaatcccagctac

SEQ ID NO: 52514 - DNA, 16 bp, H. sapiens
atgtaatcctcccacc

SEQ ID NO: 52515 - DNA, 16 bp, H. sapiens
atgtaatctgcaaata

SEQ ID NO: 52516 - DNA, 16 bp, H. sapiens
atgtaatggattatgt

SEQ ID NO: 52517 - DNA, 16 bp, H. sapiens
atgtaatgtatagtga

SEQ ID NO: 52518 - DNA, 16 bp, H. sapiens
atgtaatgtattatat

SEQ ID NO: 52519 - DNA, 16 bp, H. sapiens
atgtaatgtggtatcc

SEQ ID NO: 52520 - DNA, 16 bp, H. sapiens
atgtaattgttttaaa

SEQ ID NO: 52521 - DNA, 16 bp, H. sapiens
atgtaatttctaaaca

SEQ ID NO: 52522 - DNA, 16 bp, H. sapiens
atgtaattttacattt

SEQ ID NO: 52523 - DNA, 16 bp, H. sapiens
atgtaattttgaaata

SEQ ID NO: 52524 - DNA, 16 bp, H. sapiens
atgtaattttgtcttt

SEQ ID NO: 52525 - DNA, 16 bp, H. sapiens
atgtacaaatatatgt

SEQ ID NO: 52526 - DNA, 16 bp, H. sapiens
atgtacaaggatgttt

SEQ ID NO: 52527 - DNA, 16 bp, H. sapiens
atgtacaattattatt

SEQ ID NO: 52528 - DNA, 16 bp, H. sapiens
atgtacacacacacaa

SEQ ID NO: 52529 - DNA, 16 bp, H. sapiens
atgtacacatacatac

SEQ ID NO: 52530 - DNA, 16 bp, H. sapiens
atgtacaccatgaaat

SEQ ID NO: 52531 - DNA, 16 bp, H. sapiens
atgtacagaaatcaca

SEQ ID NO: 52532 - DNA, 16 bp, H. sapiens
atgtacagaaatcaga

SEQ ID NO: 52533 - DNA, 16 bp, H. sapiens
atgtacagaactctcc

SEQ ID NO: 52534 - DNA, 16 bp, H. sapiens
atgtacagagggaaga

SEQ ID NO: 52535 - DNA, 16 bp, H. sapiens
atgtacagcatgatga

SEQ ID NO: 52536 - DNA, 16 bp, H. sapiens
atgtacatatgcatat

SEQ ID NO: 52537 - DNA, 16 bp, H. sapiens
atgtacatatttatgg

SEQ ID NO: 52538 - DNA, 16 bp, H. sapiens
atgtacatgtatatgt

SEQ ID NO: 52539 - DNA, 16 bp, H. sapiens
atgtacatgtatttta

SEQ ID NO: 52540 - DNA, 16 bp, H. sapiens
atgtacattaattttg

SEQ ID NO: 52541 - DNA, 16 bp, H. sapiens
atgtacattatatatt

SEQ ID NO: 52542 - DNA, 16 bp, H. sapiens
atgtacattcttctca

SEQ ID NO: 52543 - DNA, 16 bp, H. sapiens
atgtacatttatgtat

SEQ ID NO: 52544 - DNA, 16 bp, H. sapiens
atgtacattttacatg

SEQ ID NO: 52545 - DNA, 16 bp, H. sapiens
atgtaccacatcttct

SEQ ID NO: 52546 - DNA, 16 bp, H. sapiens
atgtaccacatttgct

SEQ ID NO: 52547 - DNA, 16 bp, H. sapiens
atgtaccacattttgt

SEQ ID NO: 52548 - DNA, 16 bp, H. sapiens
atgtaccatatttttt

SEQ ID NO: 52549 - DNA, 16 bp, H. sapiens
atgtaccccttgaacc

SEQ ID NO: 52550 - DNA, 16 bp, H. sapiens
atgtactaaaagccac

SEQ ID NO: 52551 - DNA, 16 bp, H. sapiens
atgtactcccaaaata

SEQ ID NO: 52552 - DNA, 16 bp, H. sapiens
atgtactgaatgccac

SEQ ID NO: 52553 - DNA, 16 bp, H. sapiens
atgtagaaaaagcatt

SEQ ID NO: 52554 - DNA, 16 bp, H. sapiens
atgtagaaaacaaaat

SEQ ID NO: 52555 - DNA, 16 bp, H. sapiens
atgtagaaaatctcaa

SEQ ID NO: 52556 - DNA, 16 bp, H. sapiens
atgtagaaagctggaa

SEQ ID NO: 52557 - DNA, 16 bp, H. sapiens
atgtagacatctttgg

SEQ ID NO: 52558 - DNA, 16 bp, H. sapiens
atgtagagaaacagga

SEQ ID NO: 52559 - DNA, 16 bp, H. sapiens
atgtagataatgggtt

SEQ ID NO: 52560 - DNA, 16 bp, H. sapiens
atgtagcatttacatt

SEQ ID NO: 52561 - DNA, 16 bp, H. sapiens
atgtagccaaatacca

SEQ ID NO: 52562 - DNA, 16 bp, H. sapiens
atgtagccattccaca

SEQ ID NO: 52563 - DNA, 16 bp, H. sapiens
atgtagctaacctgca

SEQ ID NO: 52564 - DNA, 16 bp, H. sapiens
atgtagctattaaaat

SEQ ID NO: 52565 - DNA, 17 bp, H. sapiens
atgtagctgggactaca

SEQ ID NO: 52566 - DNA, 16 bp, H. sapiens
atgtagctttaaaaaa

SEQ ID NO: 52567 - DNA, 16 bp, H. sapiens
atgtaggctttttcta

SEQ ID NO: 52568 - DNA, 19 bp, H. sapiens
atgtagggacatggatgaa

SEQ ID NO: 52569 - DNA, 16 bp, H. sapiens
atgtaggtatttattg

SEQ ID NO: 52570 - DNA, 16 bp, H. sapiens
atgtagtcaaaggaga

SEQ ID NO: 52571 - DNA, 16 bp, H. sapiens
atgtagtcccagctac

SEQ ID NO: 52572 - DNA, 16 bp, H. sapiens
atgtagtcccagttac

SEQ ID NO: 52573 - DNA, 16 bp, H. sapiens
atgtagttgaatttat

SEQ ID NO: 52574 - DNA, 16 bp, H. sapiens
atgtataaaaatgcct

SEQ ID NO: 52575 - DNA, 16 bp, H. sapiens
atgtataaaatacata

SEQ ID NO: 52576 - DNA, 16 bp, H. sapiens
atgtataaaatcatat

SEQ ID NO: 52577 - DNA, 16 bp, H. sapiens
atgtataaagaactcc

SEQ ID NO: 52578 - DNA, 16 bp, H. sapiens
atgtataaatgtatat

SEQ ID NO: 52579 - DNA, 16 bp, H. sapiens
atgtataaatgtattt

SEQ ID NO: 52580 - DNA, 16 bp, H. sapiens
atgtataacaaaacca

SEQ ID NO: 52581 - DNA, 16 bp, H. sapiens
atgtataactttttaa

SEQ ID NO: 52582 - DNA, 16 bp, H. sapiens
atgtataagaatgctt

SEQ ID NO: 52583 - DNA, 16 bp, H. sapiens
atgtataagtttttgt

SEQ ID NO: 52584 - DNA, 16 bp, H. sapiens
atgtataatatataca

SEQ ID NO: 52585 - DNA, 16 bp, H. sapiens
atgtatacaaataaaa

SEQ ID NO: 52586 - DNA, 16 bp, H. sapiens
atgtatacaaatatat

SEQ ID NO: 52587 - DNA, 16 bp, H. sapiens
atgtatacaaatattt

SEQ ID NO: 52588 - DNA, 16 bp, H. sapiens
atgtatacacacatgt

SEQ ID NO: 52589 - DNA, 16 bp, H. sapiens
atgtatacacatatgt

SEQ ID NO: 52590 - DNA, 16 bp, H. sapiens
atgtatacacatgtaa

SEQ ID NO: 52591 - DNA, 16 bp, H. sapiens
atgtatacacatgtat

SEQ ID NO: 52592 - DNA, 16 bp, H. sapiens
atgtatacactgggaa

SEQ ID NO: 52593 - DNA, 16 bp, H. sapiens
atgtatacatatacac

SEQ ID NO: 52594 - DNA, 16 bp, H. sapiens
atgtatacatgcaggt

SEQ ID NO: 52595 - DNA, 16 bp, H. sapiens
atgtatacatgtgtat

SEQ ID NO: 52596 - DNA, 16 bp, H. sapiens
atgtatactttatata

SEQ ID NO: 52597 - DNA, 16 bp, H. sapiens
atgtatataaaatgtg

SEQ ID NO: 52598 - DNA, 16 bp, H. sapiens
atgtatataagatata

SEQ ID NO: 52599 - DNA, 16 bp, H. sapiens
atgtatatacaaatgt

SEQ ID NO: 52600 - DNA, 16 bp, H. sapiens
atgtatatacatttat

SEQ ID NO: 52601 - DNA, 16 bp, H. sapiens
atgtatatataaagca

SEQ ID NO: 52602 - DNA, 18 bp, H. sapiens
atgtatatatacatatac

SEQ ID NO: 52603 - DNA, 16 bp, H. sapiens
atgtatatatatcatt

SEQ ID NO: 52604 - DNA, 17 bp, H. sapiens
atgtatatatatgtatg

SEQ ID NO: 52605 - DNA, 16 bp, H. sapiens
atgtatatatgtatag

SEQ ID NO: 52606 - DNA, 16 bp, H. sapiens
atgtatatattctttt

SEQ ID NO: 52607 - DNA, 16 bp, H. sapiens
atgtatatattgtgaa

SEQ ID NO: 52608 - DNA, 16 bp, H. sapiens
atgtatatatttcttt

SEQ ID NO: 52609 - DNA, 16 bp, H. sapiens
atgtatatatttgaga

SEQ ID NO: 52610 - DNA, 16 bp, H. sapiens
atgtatatattttctt

SEQ ID NO: 52611 - DNA, 16 bp, H. sapiens
atgtatatcaaaacat

SEQ ID NO: 52612 - DNA, 16 bp, H. sapiens
atgtatatcaaaatat

SEQ ID NO: 52613 - DNA, 16 bp, H. sapiens
atgtatatgaaaatgc

SEQ ID NO: 52614 - DNA, 16 bp, H. sapiens
atgtatatgaaatgtc

SEQ ID NO: 52615 - DNA, 16 bp, H. sapiens
atgtatatgcatatgt

SEQ ID NO: 52616 - DNA, 16 bp, H. sapiens
atgtatatgcatgtat

SEQ ID NO: 52617 - DNA, 16 bp, H. sapiens
atgtatatgtacacac

SEQ ID NO: 52618 - DNA, 16 bp, H. sapiens
atgtatatgtatacat

SEQ ID NO: 52619 - DNA, 16 bp, H. sapiens
atgtatatgtatatgt

SEQ ID NO: 52620 - DNA, 16 bp, H. sapiens
atgtatatgtatgaat

SEQ ID NO: 52621 - DNA, 16 bp, H. sapiens
atgtatatgtatgcat

SEQ ID NO: 52622 - DNA, 16 bp, H. sapiens
atgtatatgtgtgtga

SEQ ID NO: 52623 - DNA, 16 bp, H. sapiens
atgtatattacatata

SEQ ID NO: 52624 - DNA, 16 bp, H. sapiens
atgtatattctaaata

SEQ ID NO: 52625 - DNA, 16 bp, H. sapiens
atgtatattgcaaatt

SEQ ID NO: 52626 - DNA, 16 bp, H. sapiens
atgtatatttcttatt

SEQ ID NO: 52627 - DNA, 16 bp, H. sapiens
atgtatatttgtacat

SEQ ID NO: 52628 - DNA, 16 bp, H. sapiens
atgtatattttaaatg

SEQ ID NO: 52629 - DNA, 16 bp, H. sapiens
atgtatattttaatga

SEQ ID NO: 52630 - DNA, 16 bp, H. sapiens
atgtatattttaccaa

SEQ ID NO: 52631 - DNA, 16 bp, H. sapiens
atgtatcaaaatttat

SEQ ID NO: 52632 - DNA, 16 bp, H. sapiens
atgtatcaattaaaaa

SEQ ID NO: 52633 - DNA, 16 bp, H. sapiens
atgtatcacattttct

SEQ ID NO: 52634 - DNA, 16 bp, H. sapiens
atgtatcagaatttct

SEQ ID NO: 52635 - DNA, 16 bp, H. sapiens
atgtatcattcttttt

SEQ ID NO: 52636 - DNA, 16 bp, H. sapiens
atgtatccaaaggaat

SEQ ID NO: 52637 - DNA, 16 bp, H. sapiens
atgtatccaccattat

SEQ ID NO: 52638 - DNA, 16 bp, H. sapiens
atgtatcccagaattt

SEQ ID NO: 52639 - DNA, 16 bp, H. sapiens
atgtatctataaatat

SEQ ID NO: 52640 - DNA, 16 bp, H. sapiens
atgtatctatttttgt

SEQ ID NO: 52641 - DNA, 16 bp, H. sapiens
atgtatctcctaatgc

SEQ ID NO: 52642 - DNA, 16 bp, H. sapiens
atgtatctgttaagtc

SEQ ID NO: 52643 - DNA, 16 bp, H. sapiens
atgtatctttatagta

SEQ ID NO: 52644 - DNA, 16 bp, H. sapiens
atgtatcttttaaatt

SEQ ID NO: 52645 - DNA, 16 bp, H. sapiens
atgtatgaatgtatat

SEQ ID NO: 52646 - DNA, 16 bp, H. sapiens
atgtatgattattatg

SEQ ID NO: 52647 - DNA, 16 bp, H. sapiens
atgtatgcatatatat

SEQ ID NO: 52648 - DNA, 16 bp, H. sapiens
atgtatgcatatgtat

SEQ ID NO: 52649 - DNA, 16 bp, H. sapiens
atgtatgcattcacct

SEQ ID NO: 52650 - DNA, 16 bp, H. sapiens
atgtatgcatttatat

SEQ ID NO: 52651 - DNA, 16 bp, H. sapiens
atgtatggatttatat

SEQ ID NO: 52652 - DNA, 16 bp, H. sapiens
atgtatgtaaatatat

SEQ ID NO: 52653 - DNA, 16 bp, H. sapiens
atgtatgtacatattt

SEQ ID NO: 52654 - DNA, 16 bp, H. sapiens
atgtatgtatacatgt

SEQ ID NO: 52655 - DNA, 17 bp, H. sapiens
atgtatgtatatatatg

SEQ ID NO: 52656 - DNA, 16 bp, H. sapiens
atgtatgtatgcatgt

SEQ ID NO: 52657 - DNA, 16 bp, H. sapiens
atgtatgtatgtaata

SEQ ID NO: 52658 - DNA, 16 bp, H. sapiens
atgtatgtatgtataa

SEQ ID NO: 52659 - DNA, 16 bp, H. sapiens
atgtatgtatgttcat

SEQ ID NO: 52660 - DNA, 16 bp, H. sapiens
atgtatgtatttaaaa

SEQ ID NO: 52661 - DNA, 16 bp, H. sapiens
atgtatgtatttgaga

SEQ ID NO: 52662 - DNA, 16 bp, H. sapiens
atgtatgtctgctttt

SEQ ID NO: 52663 - DNA, 16 bp, H. sapiens
atgtatgtgcatgcat

SEQ ID NO: 52664 - DNA, 17 bp, H. sapiens
atgtatgtgtatatatg

SEQ ID NO: 52665 - DNA, 16 bp, H. sapiens
atgtatgtgtgcgtgt

SEQ ID NO: 52666 - DNA, 16 bp, H. sapiens
atgtatgtgtgtatat

SEQ ID NO: 52667 - DNA, 16 bp, H. sapiens
atgtatgtgtgtattt

SEQ ID NO: 52668 - DNA, 16 bp, H. sapiens
atgtatgtgtgtctat

SEQ ID NO: 52669 - DNA, 17 bp, H. sapiens
atgtatgtgtgtgtgta

SEQ ID NO: 52670 - DNA, 16 bp, H. sapiens
atgtatgtgtgtttct

SEQ ID NO: 52671 - DNA, 16 bp, H. sapiens
atgtatgtgttcatgt

SEQ ID NO: 52672 - DNA, 16 bp, H. sapiens
atgtatgtttatagca

SEQ ID NO: 52673 - DNA, 16 bp, H. sapiens
atgtattaatatatgt

SEQ ID NO: 52674 - DNA, 16 bp, H. sapiens
atgtattacattttaa

SEQ ID NO: 52675 - DNA, 16 bp, H. sapiens
atgtattactttattt

SEQ ID NO: 52676 - DNA, 16 bp, H. sapiens
atgtattatattacat

SEQ ID NO: 52677 - DNA, 16 bp, H. sapiens
atgtattatgtaaata

SEQ ID NO: 52678 - DNA, 16 bp, H. sapiens
atgtattcaataaata

SEQ ID NO: 52679 - DNA, 16 bp, H. sapiens
atgtattcataataat

SEQ ID NO: 52680 - DNA, 16 bp, H. sapiens
atgtattcatacatac

SEQ ID NO: 52681 - DNA, 16 bp, H. sapiens
atgtattcattcactt

SEQ ID NO: 52682 - DNA, 16 bp, H. sapiens
atgtattcctttatag

SEQ ID NO: 52683 - DNA, 16 bp, H. sapiens
atgtattgaagagact

SEQ ID NO: 52684 - DNA, 16 bp, H. sapiens
atgtattgagtgccta

SEQ ID NO: 52685 - DNA, 16 bp, H. sapiens
atgtattgctggattt

SEQ ID NO: 52686 - DNA, 16 bp, H. sapiens
atgtatttaaaattct

SEQ ID NO: 52687 - DNA, 16 bp, H. sapiens
atgtatttacttattt

SEQ ID NO: 52688 - DNA, 16 bp, H. sapiens
atgtatttatgtgtat

SEQ ID NO: 52689 - DNA, 16 bp, H. sapiens
atgtatttatttttgc

SEQ ID NO: 52690 - DNA, 16 bp, H. sapiens
atgtatttcatcttca

SEQ ID NO: 52691 - DNA, 16 bp, H. sapiens
atgtatttctgtattt

SEQ ID NO: 52692 - DNA, 16 bp, H. sapiens
atgtatttctgtgtgt

SEQ ID NO: 52693 - DNA, 16 bp, H. sapiens
atgtatttgattgata

SEQ ID NO: 52694 - DNA, 16 bp, H. sapiens
atgtatttgcatatgt

SEQ ID NO: 52695 - DNA, 16 bp, H. sapiens
atgtatttgcatgttt

SEQ ID NO: 52696 - DNA, 16 bp, H. sapiens
atgtatttgtaaaata

SEQ ID NO: 52697 - DNA, 16 bp, H. sapiens
atgtatttgtatgtgt

SEQ ID NO: 52698 - DNA, 16 bp, H. sapiens
atgtatttgttggcca

SEQ ID NO: 52699 - DNA, 16 bp, H. sapiens
atgtattttaaaagtt

SEQ ID NO: 52700 - DNA, 16 bp, H. sapiens
atgtattttacatttt

SEQ ID NO: 52701 - DNA, 16 bp, H. sapiens
atgtattttattttca

SEQ ID NO: 52702 - DNA, 16 bp, H. sapiens
atgtattttcaaatag

SEQ ID NO: 52703 - DNA, 16 bp, H. sapiens
atgtattttccttcct

SEQ ID NO: 52704 - DNA, 16 bp, H. sapiens
atgtattttctctttc

SEQ ID NO: 52705 - DNA, 16 bp, H. sapiens
atgtattttctgttga

SEQ ID NO: 52706 - DNA, 16 bp, H. sapiens
atgtatttttctatat

SEQ ID NO: 52707 - DNA, 16 bp, H. sapiens
atgtatttttctatgt

SEQ ID NO: 52708 - DNA, 16 bp, H. sapiens
atgtattttttcctaa

SEQ ID NO: 52709 - DNA, 16 bp, H. sapiens
atgtatttttttcatg

SEQ ID NO: 52710 - DNA, 16 bp, H. sapiens
atgtcaaagaagaaat

SEQ ID NO: 52711 - DNA, 16 bp, H. sapiens
atgtcaaagagacaca

SEQ ID NO: 52712 - DNA, 16 bp, H. sapiens
atgtcaaattttaatc

SEQ ID NO: 52713 - DNA, 16 bp, H. sapiens
atgtcaacaaaatgaa

SEQ ID NO: 52714 - DNA, 16 bp, H. sapiens
atgtcaatggcagttt

SEQ ID NO: 52715 - DNA, 16 bp, H. sapiens
atgtcacaaaataatt

SEQ ID NO: 52716 - DNA, 16 bp, H. sapiens
atgtcacacactgggg

SEQ ID NO: 52717 - DNA, 16 bp, H. sapiens
atgtcacagcactcca

SEQ ID NO: 52718 - DNA, 16 bp, H. sapiens
atgtcacaggggtttg

SEQ ID NO: 52719 - DNA, 16 bp, H. sapiens
atgtcacatttagcat

SEQ ID NO: 52720 - DNA, 16 bp, H. sapiens
atgtcaccacacctgg

SEQ ID NO: 52721 - DNA, 16 bp, H. sapiens
atgtcaccatgcccag

SEQ ID NO: 52722 - DNA, 16 bp, H. sapiens
atgtcacctcctcaga

SEQ ID NO: 52723 - DNA, 16 bp, H. sapiens
atgtcactctgtcacc

SEQ ID NO: 52724 - DNA, 16 bp, H. sapiens
atgtcactgcactcca

SEQ ID NO: 52725 - DNA, 16 bp, H. sapiens
atgtcactgtggtcct

SEQ ID NO: 52726 - DNA, 16 bp, H. sapiens
atgtcacttctgagat

SEQ ID NO: 52727 - DNA, 16 bp, H. sapiens
atgtcactttcctttt

SEQ ID NO: 52728 - DNA, 16 bp, H. sapiens
atgtcactttcttttt

SEQ ID NO: 52729 - DNA, 16 bp, H. sapiens
atgtcagaaggcaaag

SEQ ID NO: 52730 - DNA, 16 bp, H. sapiens
atgtcagaatttcctt

SEQ ID NO: 52731 - DNA, 16 bp, H. sapiens
atgtcagagctggaag

SEQ ID NO: 52732 - DNA, 16 bp, H. sapiens
atgtcagaggtcttca

SEQ ID NO: 52733 - DNA, 16 bp, H. sapiens
atgtcagatggtgata

SEQ ID NO: 52734 - DNA, 16 bp, H. sapiens
atgtcagattcaccaa

SEQ ID NO: 52735 - DNA, 16 bp, H. sapiens
atgtcagatttttttt

SEQ ID NO: 52736 - DNA, 16 bp, H. sapiens
atgtcagcactcaaaa

SEQ ID NO: 52737 - DNA, 16 bp, H. sapiens
atgtcagtaccatgct

SEQ ID NO: 52738 - DNA, 16 bp, H. sapiens
atgtcatccaggagct

SEQ ID NO: 52739 - DNA, 16 bp, H. sapiens
atgtcatcctgtgact

SEQ ID NO: 52740 - DNA, 16 bp, H. sapiens
atgtcatctgcaaata

SEQ ID NO: 52741 - DNA, 16 bp, H. sapiens
atgtcatctgtgaata

SEQ ID NO: 52742 - DNA, 16 bp, H. sapiens
atgtcatgggggtttg

SEQ ID NO: 52743 - DNA, 16 bp, H. sapiens
atgtcattaaaattaa

SEQ ID NO: 52744 - DNA, 16 bp, H. sapiens
atgtcattaaacattt

SEQ ID NO: 52745 - DNA, 16 bp, H. sapiens
atgtcattgaaatttt

SEQ ID NO: 52746 - DNA, 16 bp, H. sapiens
atgtcattgctattgt

SEQ ID NO: 52747 - DNA, 16 bp, H. sapiens
atgtcattggtacttt

SEQ ID NO: 52748 - DNA, 16 bp, H. sapiens
atgtcatttaaatttt

SEQ ID NO: 52749 - DNA, 16 bp, H. sapiens
atgtcattttccttct

SEQ ID NO: 52750 - DNA, 16 bp, H. sapiens
atgtcatttttttcct

SEQ ID NO: 52751 - DNA, 16 bp, H. sapiens
atgtccaagagcagga

SEQ ID NO: 52752 - DNA, 16 bp, H. sapiens
atgtccacatcctaat

SEQ ID NO: 52753 - DNA, 16 bp, H. sapiens
atgtccagaagaggca

SEQ ID NO: 52754 - DNA, 16 bp, H. sapiens
atgtccagaatgggca

SEQ ID NO: 52755 - DNA, 16 bp, H. sapiens
atgtccagaatgttat

SEQ ID NO: 52756 - DNA, 16 bp, H. sapiens
atgtccagctaatttt

SEQ ID NO: 52757 - DNA, 16 bp, H. sapiens
atgtccagctgcctct

SEQ ID NO: 52758 - DNA, 17 bp, H. sapiens
atgtccatgtgttctca

SEQ ID NO: 52759 - DNA, 16 bp, H. sapiens
atgtccattctcacca

SEQ ID NO: 52760 - DNA, 16 bp, H. sapiens
atgtccattgcccact

SEQ ID NO: 52761 - DNA, 16 bp, H. sapiens
atgtcccagcttgaag

SEQ ID NO: 52762 - DNA, 16 bp, H. sapiens
atgtccccattccaag

SEQ ID NO: 52763 - DNA, 16 bp, H. sapiens
atgtcccttttctttt

SEQ ID NO: 52764 - DNA, 16 bp, H. sapiens
atgtccggagtttgtt

SEQ ID NO: 52765 - DNA, 16 bp, H. sapiens
atgtcctaaagcattt

SEQ ID NO: 52766 - DNA, 16 bp, H. sapiens
atgtcctcaaggttta

SEQ ID NO: 52767 - DNA, 16 bp, H. sapiens
atgtcctcaccaacac

SEQ ID NO: 52768 - DNA, 16 bp, H. sapiens
atgtcctcacttataa

SEQ ID NO: 52769 - DNA, 16 bp, H. sapiens
atgtcctccagtttca

SEQ ID NO: 52770 - DNA, 16 bp, H. sapiens
atgtcctgacctcgtg

SEQ ID NO: 52771 - DNA, 16 bp, H. sapiens
atgtcctgcccagaga

SEQ ID NO: 52772 - DNA, 16 bp, H. sapiens
atgtccttctttgtcc

SEQ ID NO: 52773 - DNA, 16 bp, H. sapiens
atgtcctttccagcaa

SEQ ID NO: 52774 - DNA, 16 bp, H. sapiens
atgtcctttgtcttcc

SEQ ID NO: 52775 - DNA, 16 bp, H. sapiens
atgtccttttctggtt

SEQ ID NO: 52776 - DNA, 16 bp, H. sapiens
atgtctacatatatat

SEQ ID NO: 52777 - DNA, 16 bp, H. sapiens
atgtctacatgtgcca

SEQ ID NO: 52778 - DNA, 26 bp, H. sapiens
atgtctacttctttctacacagacac

SEQ ID NO: 52779 - DNA, 16 bp, H. sapiens
atgtctagagacattt

SEQ ID NO: 52780 - DNA, 16 bp, H. sapiens
atgtctagattactta

SEQ ID NO: 52781 - DNA, 16 bp, H. sapiens
atgtctatatatgtat

SEQ ID NO: 52782 - DNA, 16 bp, H. sapiens
atgtctatattatata

SEQ ID NO: 52783 - DNA, 16 bp, H. sapiens
atgtctattaaagaaa

SEQ ID NO: 52784 - DNA, 16 bp, H. sapiens
atgtctatttttaaaa

SEQ ID NO: 52785 - DNA, 16 bp, H. sapiens
atgtctccagacactg

SEQ ID NO: 52786 - DNA, 16 bp, H. sapiens
atgtctccagacatgg

SEQ ID NO: 52787 - DNA, 16 bp, H. sapiens
atgtctccagacattt

SEQ ID NO: 52788 - DNA, 16 bp, H. sapiens
atgtctcccctggaca

SEQ ID NO: 52789 - DNA, 16 bp, H. sapiens
atgtctctgcaaaaga

SEQ ID NO: 52790 - DNA, 16 bp, H. sapiens
atgtctcttaagtctc

SEQ ID NO: 52791 - DNA, 16 bp, H. sapiens
atgtctcttcctcttc

SEQ ID NO: 52792 - DNA, 16 bp, H. sapiens
atgtctgcctcccagg

SEQ ID NO: 52793 - DNA, 16 bp, H. sapiens
atgtctggagacagtt

SEQ ID NO: 52794 - DNA, 16 bp, H. sapiens
atgtctggagacatat

SEQ ID NO: 52795 - DNA, 16 bp, H. sapiens
atgtctggagacatgt

SEQ ID NO: 52796 - DNA, 16 bp, H. sapiens
atgtctggttttccat

SEQ ID NO: 52797 - DNA, 16 bp, H. sapiens
atgtctgtgtatgtgt

SEQ ID NO: 52798 - DNA, 16 bp, H. sapiens
atgtctgtgtcctaat

SEQ ID NO: 52799 - DNA, 16 bp, H. sapiens
atgtctgtgtgtatgt

SEQ ID NO: 52800 - DNA, 16 bp, H. sapiens
atgtctgtgtgtgtgt

SEQ ID NO: 52801 - DNA, 16 bp, H. sapiens
atgtctgtgttccaaa

SEQ ID NO: 52802 - DNA, 16 bp, H. sapiens
atgtcttaatattttt

SEQ ID NO: 52803 - DNA, 16 bp, H. sapiens
atgtcttcaaattcat

SEQ ID NO: 52804 - DNA, 16 bp, H. sapiens
atgtcttcaacaaaga

SEQ ID NO: 52805 - DNA, 16 bp, H. sapiens
atgtcttcactgctga

SEQ ID NO: 52806 - DNA, 16 bp, H. sapiens
atgtcttcagctttgt

SEQ ID NO: 52807 - DNA, 16 bp, H. sapiens
atgtcttcatctataa

SEQ ID NO: 52808 - DNA, 16 bp, H. sapiens
atgtcttcatttattt

SEQ ID NO: 52809 - DNA, 16 bp, H. sapiens
atgtcttcattttatt

SEQ ID NO: 52810 - DNA, 16 bp, H. sapiens
atgtcttccaagttca

SEQ ID NO: 52811 - DNA, 16 bp, H. sapiens
atgtcttctcacaaga

SEQ ID NO: 52812 - DNA, 16 bp, H. sapiens
atgtcttcttcctcat

SEQ ID NO: 52813 - DNA, 16 bp, H. sapiens
atgtcttctttgagaa

SEQ ID NO: 52814 - DNA, 16 bp, H. sapiens
atgtcttcttttcctt

SEQ ID NO: 52815 - DNA, 16 bp, H. sapiens
atgtcttcttttgaaa

SEQ ID NO: 52816 - DNA, 29 bp, H. sapiens
atgtcttcttttgagaagtgtctgttcat

SEQ ID NO: 52817 - DNA, 16 bp, H. sapiens
atgtcttgaaaagtta

SEQ ID NO: 52818 - DNA, 16 bp, H. sapiens
atgtctttaaaaattt

SEQ ID NO: 52819 - DNA, 16 bp, H. sapiens
atgtctttaacagcac

SEQ ID NO: 52820 - DNA, 16 bp, H. sapiens
atgtctttgctattgt

SEQ ID NO: 52821 - DNA, 16 bp, H. sapiens
atgtctttggtatttt

SEQ ID NO: 52822 - DNA, 16 bp, H. sapiens
atgtcttttacagcaa

SEQ ID NO: 52823 - DNA, 16 bp, H. sapiens
atgtcttttatagcaa

SEQ ID NO: 52824 - DNA, 16 bp, H. sapiens
atgtcttttctgtttg

SEQ ID NO: 52825 - DNA, 16 bp, H. sapiens
atgtctttttaaaaat

SEQ ID NO: 52826 - DNA, 16 bp, H. sapiens
atgtctttttcaggga

SEQ ID NO: 52827 - DNA, 16 bp, H. sapiens
atgtcttttttaaaaa

SEQ ID NO: 52828 - DNA, 16 bp, H. sapiens
atgtgaaaaaaaatgt

SEQ ID NO: 52829 - DNA, 16 bp, H. sapiens
atgtgaaaaagacaca

SEQ ID NO: 52830 - DNA, 16 bp, H. sapiens
atgtgaaaaggagaga

SEQ ID NO: 52831 - DNA, 16 bp, H. sapiens
atgtgaaaatcttcaa

SEQ ID NO: 52832 - DNA, 16 bp, H. sapiens
atgtgaaaattatttt

SEQ ID NO: 52833 - DNA, 16 bp, H. sapiens
atgtgaaaccctgtct

SEQ ID NO: 52834 - DNA, 16 bp, H. sapiens
atgtgaaagaaatgaa

SEQ ID NO: 52835 - DNA, 16 bp, H. sapiens
atgtgaaataatttta

SEQ ID NO: 52836 - DNA, 16 bp, H. sapiens
atgtgaaatatttaga

SEQ ID NO: 52837 - DNA, 16 bp, H. sapiens
atgtgaaatattttat

SEQ ID NO: 52838 - DNA, 16 bp, H. sapiens
atgtgaaattttgtta

SEQ ID NO: 52839 - DNA, 16 bp, H. sapiens
atgtgaactgtcttca

SEQ ID NO: 52840 - DNA, 16 bp, H. sapiens
atgtgaactttttttt

SEQ ID NO: 52841 - DNA, 16 bp, H. sapiens
atgtgaagaaggtcct

SEQ ID NO: 52842 - DNA, 16 bp, H. sapiens
atgtgaagaatgtcat

SEQ ID NO: 52843 - DNA, 16 bp, H. sapiens
atgtgaagacacaaga

SEQ ID NO: 52844 - DNA, 16 bp, H. sapiens
atgtgaagacacagga

SEQ ID NO: 52845 - DNA, 16 bp, H. sapiens
atgtgaagacagaggc

SEQ ID NO: 52846 - DNA, 16 bp, H. sapiens
atgtgaagacagaggt

SEQ ID NO: 52847 - DNA, 16 bp, H. sapiens
atgtgaagatatttgc

SEQ ID NO: 52848 - DNA, 16 bp, H. sapiens
atgtgaagatatttgt

SEQ ID NO: 52849 - DNA, 16 bp, H. sapiens
atgtgaagattaaatg

SEQ ID NO: 52850 - DNA, 16 bp, H. sapiens
atgtgaagatttttaa

SEQ ID NO: 52851 - DNA, 16 bp, H. sapiens
atgtgaaggagctctt

SEQ ID NO: 52852 - DNA, 16 bp, H. sapiens
atgtgaagtagcaaaa

SEQ ID NO: 52853 - DNA, 16 bp, H. sapiens
atgtgaagttttgtta

SEQ ID NO: 52854 - DNA, 16 bp, H. sapiens
atgtgaatatacttaa

SEQ ID NO: 52855 - DNA, 16 bp, H. sapiens
atgtgaatgacctctt

SEQ ID NO: 52856 - DNA, 16 bp, H. sapiens
atgtgaatgtacttaa

SEQ ID NO: 52857 - DNA, 16 bp, H. sapiens
atgtgaatgttcattg

SEQ ID NO: 52858 - DNA, 16 bp, H. sapiens
atgtgaatttaaaaat

SEQ ID NO: 52859 - DNA, 16 bp, H. sapiens
atgtgaattttaaaat

SEQ ID NO: 52860 - DNA, 16 bp, H. sapiens
atgtgaatttttaaat

SEQ ID NO: 52861 - DNA, 16 bp, H. sapiens
atgtgacaaaattcaa

SEQ ID NO: 52862 - DNA, 16 bp, H. sapiens
atgtgacaaagaagaa

SEQ ID NO: 52863 - DNA, 16 bp, H. sapiens
atgtgacaatgagaag

SEQ ID NO: 52864 - DNA, 16 bp, H. sapiens
atgtgacagtctgaaa

SEQ ID NO: 52865 - DNA, 16 bp, H. sapiens
atgtgacatgcctgct

SEQ ID NO: 52866 - DNA, 16 bp, H. sapiens
atgtgaccttggccaa

SEQ ID NO: 52867 - DNA, 16 bp, H. sapiens
atgtgacttctgaggc

SEQ ID NO: 52868 - DNA, 16 bp, H. sapiens
atgtgagaaaacattt

SEQ ID NO: 52869 - DNA, 16 bp, H. sapiens
atgtgagacacctgct

SEQ ID NO: 52870 - DNA, 16 bp, H. sapiens
atgtgagagagagaga

SEQ ID NO: 52871 - DNA, 16 bp, H. sapiens
atgtgagatatggagt

SEQ ID NO: 52872 - DNA, 16 bp, H. sapiens
atgtgagatgggtgtc

SEQ ID NO: 52873 - DNA, 16 bp, H. sapiens
atgtgagatgttttga

SEQ ID NO: 52874 - DNA, 16 bp, H. sapiens
atgtgaggaaatgaga

SEQ ID NO: 52875 - DNA, 16 bp, H. sapiens
atgtgagggacagaca

SEQ ID NO: 52876 - DNA, 16 bp, H. sapiens
atgtgagtggaagtga

SEQ ID NO: 52877 - DNA, 16 bp, H. sapiens
atgtgagtgggcatca

SEQ ID NO: 52878 - DNA, 16 bp, H. sapiens
atgtgagtgtgtatgt

SEQ ID NO: 52879 - DNA, 16 bp, H. sapiens
atgtgagtgtgtgtga

SEQ ID NO: 52880 - DNA, 16 bp, H. sapiens
atgtgataaatcacat

SEQ ID NO: 52881 - DNA, 16 bp, H. sapiens
atgtgataaatcatat

SEQ ID NO: 52882 - DNA, 16 bp, H. sapiens
atgtgatatatacaaa

SEQ ID NO: 52883 - DNA, 16 bp, H. sapiens
atgtgatatatcacat

SEQ ID NO: 52884 - DNA, 16 bp, H. sapiens
atgtgatctctgtaca

SEQ ID NO: 52885 - DNA, 16 bp, H. sapiens
atgtgatctctttgca

SEQ ID NO: 52886 - DNA, 16 bp, H. sapiens
atgtgatcttggctca

SEQ ID NO: 52887 - DNA, 16 bp, H. sapiens
atgtgatcttgggcaa

SEQ ID NO: 52888 - DNA, 16 bp, H. sapiens
atgtgatgaaaatggc

SEQ ID NO: 52889 - DNA, 16 bp, H. sapiens
atgtgatgccctctgc

SEQ ID NO: 52890 - DNA, 16 bp, H. sapiens
atgtgatgctgtttga

SEQ ID NO: 52891 - DNA, 16 bp, H. sapiens
atgtgatggcacatgc

SEQ ID NO: 52892 - DNA, 16 bp, H. sapiens
atgtgatgtctggagc

SEQ ID NO: 52893 - DNA, 16 bp, H. sapiens
atgtgatgtgtgtggt

SEQ ID NO: 52894 - DNA, 16 bp, H. sapiens
atgtgatgtgtgtgtg

SEQ ID NO: 52895 - DNA, 16 bp, H. sapiens
atgtgatgttttgata

SEQ ID NO: 52896 - DNA, 16 bp, H. sapiens
atgtgattaaagttaa

SEQ ID NO: 52897 - DNA, 16 bp, H. sapiens
atgtgattatggaagc

SEQ ID NO: 52898 - DNA, 16 bp, H. sapiens
atgtgattattaatat

SEQ ID NO: 52899 - DNA, 16 bp, H. sapiens
atgtgattccatttgt

SEQ ID NO: 52900 - DNA, 16 bp, H. sapiens
atgtgattctgcaggt

SEQ ID NO: 52901 - DNA, 16 bp, H. sapiens
atgtgattttaaaatg

SEQ ID NO: 52902 - DNA, 16 bp, H. sapiens
atgtgattttcaaata

SEQ ID NO: 52903 - DNA, 16 bp, H. sapiens
atgtgattttcctctt

SEQ ID NO: 52904 - DNA, 16 bp, H. sapiens
atgtgcaaaaactgga

SEQ ID NO: 52905 - DNA, 16 bp, H. sapiens
atgtgcaaaatcacaa

SEQ ID NO: 52906 - DNA, 16 bp, H. sapiens
atgtgcaaaggcccag

SEQ ID NO: 52907 - DNA, 16 bp, H. sapiens
atgtgcaaaggccctg

SEQ ID NO: 52908 - DNA, 16 bp, H. sapiens
atgtgcaatctaaaaa

SEQ ID NO: 52909 - DNA, 16 bp, H. sapiens
atgtgcacatacacac

SEQ ID NO: 52910 - DNA, 16 bp, H. sapiens
atgtgcacatgtgtgt

SEQ ID NO: 52911 - DNA, 16 bp, H. sapiens
atgtgcacccagagga

SEQ ID NO: 52912 - DNA, 16 bp, H. sapiens
atgtgcacgtgtgtgt

SEQ ID NO: 52913 - DNA, 16 bp, H. sapiens
atgtgcagaagaataa

SEQ ID NO: 52914 - DNA, 16 bp, H. sapiens
atgtgcagaaggtgca

SEQ ID NO: 52915 - DNA, 16 bp, H. sapiens
atgtgcagaataggca

SEQ ID NO: 52916 - DNA, 16 bp, H. sapiens
atgtgcagattttttt

SEQ ID NO: 52917 - DNA, 16 bp, H. sapiens
atgtgcaggtttgata

SEQ ID NO: 52918 - DNA, 16 bp, H. sapiens
atgtgcaggtttgttg

SEQ ID NO: 52919 - DNA, 16 bp, H. sapiens
atgtgcagtgctttga

SEQ ID NO: 52920 - DNA, 16 bp, H. sapiens
atgtgcatatatcttt

SEQ ID NO: 52921 - DNA, 16 bp, H. sapiens
atgtgcatatatttat

SEQ ID NO: 52922 - DNA, 16 bp, H. sapiens
atgtgcatgtatcttt

SEQ ID NO: 52923 - DNA, 16 bp, H. sapiens
atgtgcatgtatgtgt

SEQ ID NO: 52924 - DNA, 16 bp, H. sapiens
atgtgcatgtgtgtgt

SEQ ID NO: 52925 - DNA, 17 bp, H. sapiens
atgtgcatgtgtgtgtg

SEQ ID NO: 52926 - DNA, 16 bp, H. sapiens
atgtgcattttaaatg

SEQ ID NO: 52927 - DNA, 16 bp, H. sapiens
atgtgccaagcactgt

SEQ ID NO: 52928 - DNA, 16 bp, H. sapiens
atgtgccaagcattgt

SEQ ID NO: 52929 - DNA, 16 bp, H. sapiens
atgtgccacaacaccc

SEQ ID NO: 52930 - DNA, 16 bp, H. sapiens
atgtgccacacacttt

SEQ ID NO: 52931 - DNA, 17 bp, H. sapiens
atgtgccaccacaccca

SEQ ID NO: 52932 - DNA, 16 bp, H. sapiens
atgtgccaccacacct

SEQ ID NO: 52933 - DNA, 16 bp, H. sapiens
atgtgccaccagacct

SEQ ID NO: 52934 - DNA, 16 bp, H. sapiens
atgtgccaccatggct

SEQ ID NO: 52935 - DNA, 17 bp, H. sapiens
atgtgccaggcacagtt

SEQ ID NO: 52936 - DNA, 16 bp, H. sapiens
atgtgccaggcactct

SEQ ID NO: 52937 - DNA, 16 bp, H. sapiens
atgtgccaggcactga

SEQ ID NO: 52938 - DNA, 16 bp, H. sapiens
atgtgccaggcactgc

SEQ ID NO: 52939 - DNA, 16 bp, H. sapiens
atgtgccaggcagtgg

SEQ ID NO: 52940 - DNA, 16 bp, H. sapiens
atgtgccatgcactgt

SEQ ID NO: 52941 - DNA, 16 bp, H. sapiens
atgtgccatgtgggtg

SEQ ID NO: 52942 - DNA, 16 bp, H. sapiens
atgtgcccgcctcagc

SEQ ID NO: 52943 - DNA, 16 bp, H. sapiens
atgtgcccgccttggc

SEQ ID NO: 52944 - DNA, 16 bp, H. sapiens
atgtgcctgtaatctt

SEQ ID NO: 52945 - DNA, 17 bp, H. sapiens
atgtgcctttcaccttc

SEQ ID NO: 52946 - DNA, 16 bp, H. sapiens
atgtgcctttcacttt

SEQ ID NO: 52947 - DNA, 16 bp, H. sapiens
atgtgcgtgcatgtgt

SEQ ID NO: 52948 - DNA, 16 bp, H. sapiens
atgtgcgtgcgtgtgt

SEQ ID NO: 52949 - DNA, 16 bp, H. sapiens
atgtgctcattggcca

SEQ ID NO: 52950 - DNA, 16 bp, H. sapiens
atgtgctgaagagaag

SEQ ID NO: 52951 - DNA, 16 bp, H. sapiens
atgtgctgctggactc

SEQ ID NO: 52952 - DNA, 16 bp, H. sapiens
atgtgctggacactgt

SEQ ID NO: 52953 - DNA, 16 bp, H. sapiens
atgtgctgggtgtggt

SEQ ID NO: 52954 - DNA, 16 bp, H. sapiens
atgtgcttgcttctcc

SEQ ID NO: 52955 - DNA, 16 bp, H. sapiens
atgtgctttaaaaaaa

SEQ ID NO: 52956 - DNA, 16 bp, H. sapiens
atgtgctttaaaatat

SEQ ID NO: 52957 - DNA, 16 bp, H. sapiens
atgtgctttgaagatg

SEQ ID NO: 52958 - DNA, 16 bp, H. sapiens
atgtgcttttaaaaat

SEQ ID NO: 52959 - DNA, 16 bp, H. sapiens
atgtggaaaaagcttt

SEQ ID NO: 52960 - DNA, 16 bp, H. sapiens
atgtggaaaatatatt

SEQ ID NO: 52961 - DNA, 16 bp, H. sapiens
atgtggaaactgaggc

SEQ ID NO: 52962 - DNA, 16 bp, H. sapiens
atgtggaaataaaaat

SEQ ID NO: 52963 - DNA, 16 bp, H. sapiens
atgtggaaattatggg

SEQ ID NO: 52964 - DNA, 16 bp, H. sapiens
atgtggaaatttaaaa

SEQ ID NO: 52965 - DNA, 16 bp, H. sapiens
atgtggaacctgcaga

SEQ ID NO: 52966 - DNA, 16 bp, H. sapiens
atgtggaagaaaaagc

SEQ ID NO: 52967 - DNA, 16 bp, H. sapiens
atgtggaagaaacttt

SEQ ID NO: 52968 - DNA, 16 bp, H. sapiens
atgtggaagtagcttt

SEQ ID NO: 52969 - DNA, 16 bp, H. sapiens
atgtggaagtggaaga

SEQ ID NO: 52970 - DNA, 16 bp, H. sapiens
atgtggacacagccaa

SEQ ID NO: 52971 - DNA, 16 bp, H. sapiens
atgtggacatatgttt

SEQ ID NO: 52972 - DNA, 16 bp, H. sapiens
atgtggacatccagtt

SEQ ID NO: 52973 - DNA, 16 bp, H. sapiens
atgtggagaaaaagga

SEQ ID NO: 52974 - DNA, 16 bp, H. sapiens
atgtggagaaaaggaa

SEQ ID NO: 52975 - DNA, 16 bp, H. sapiens
atgtggagaaactaga

SEQ ID NO: 52976 - DNA, 16 bp, H. sapiens
atgtggagaaactgaa

SEQ ID NO: 52977 - DNA, 16 bp, H. sapiens
atgtggagaaactgga

SEQ ID NO: 52978 - DNA, 16 bp, H. sapiens
atgtggagaaagtgga

SEQ ID NO: 52979 - DNA, 16 bp, H. sapiens
atgtggagaaattaga

SEQ ID NO: 52980 - DNA, 16 bp, H. sapiens
atgtggagaagctgga

SEQ ID NO: 52981 - DNA, 16 bp, H. sapiens
atgtggagcaaatgga

SEQ ID NO: 52982 - DNA, 16 bp, H. sapiens
atgtggagcaaccaga

SEQ ID NO: 52983 - DNA, 16 bp, H. sapiens
atgtggagcaactgga

SEQ ID NO: 52984 - DNA, 16 bp, H. sapiens
atgtggaggtggaaga

SEQ ID NO: 52985 - DNA, 16 bp, H. sapiens
atgtggatatcctgtt

SEQ ID NO: 52986 - DNA, 16 bp, H. sapiens
atgtggatgaacctca

SEQ ID NO: 52987 - DNA, 16 bp, H. sapiens
atgtggatgcccttta

SEQ ID NO: 52988 - DNA, 16 bp, H. sapiens
atgtggatggtctgct

SEQ ID NO: 52989 - DNA, 16 bp, H. sapiens
atgtggatttttaaaa

SEQ ID NO: 52990 - DNA, 16 bp, H. sapiens
atgtggatttttttca

SEQ ID NO: 52991 - DNA, 16 bp, H. sapiens
atgtggcacatatata

SEQ ID NO: 52992 - DNA, 16 bp, H. sapiens
atgtggcagagccagg

SEQ ID NO: 52993 - DNA, 16 bp, H. sapiens
atgtggcagagctggg

SEQ ID NO: 52994 - DNA, 16 bp, H. sapiens
atgtggcagctgcagc

SEQ ID NO: 52995 - DNA, 16 bp, H. sapiens
atgtggccaataaaca

SEQ ID NO: 52996 - DNA, 16 bp, H. sapiens
atgtggccacaagcca

SEQ ID NO: 52997 - DNA, 16 bp, H. sapiens
atgtggcccagagaag

SEQ ID NO: 52998 - DNA, 17 bp, H. sapiens
atgtggcccctgctgct

SEQ ID NO: 52999 - DNA, 16 bp, H. sapiens
atgtggcctttcctct

SEQ ID NO: 53000 - DNA, 16 bp, H. sapiens
atgtggccttttgtga

SEQ ID NO: 53001 - DNA, 16 bp, H. sapiens
atgtggctcacacctg

SEQ ID NO: 53002 - DNA, 16 bp, H. sapiens
atgtggctcaggctgg

SEQ ID NO: 53003 - DNA, 16 bp, H. sapiens
atgtggctgtgctgga

SEQ ID NO: 53004 - DNA, 16 bp, H. sapiens
atgtggctgttggcag

SEQ ID NO: 53005 - DNA, 16 bp, H. sapiens
atgtggcttgtctttt

SEQ ID NO: 53006 - DNA, 16 bp, H. sapiens
atgtggctttatttct

SEQ ID NO: 53007 - DNA, 16 bp, H. sapiens
atgtggcttttgtttt

SEQ ID NO: 53008 - DNA, 16 bp, H. sapiens
atgtgggaattgtgga

SEQ ID NO: 53009 - DNA, 16 bp, H. sapiens
atgtgggaggcagagg

SEQ ID NO: 53010 - DNA, 16 bp, H. sapiens
atgtgggaggctgagg

SEQ ID NO: 53011 - DNA, 16 bp, H. sapiens
atgtgggcacagcctc

SEQ ID NO: 53012 - DNA, 16 bp, H. sapiens
atgtgggcagagcctt

SEQ ID NO: 53013 - DNA, 16 bp, H. sapiens
atgtgggcattcatct

SEQ ID NO: 53014 - DNA, 16 bp, H. sapiens
atgtgggccaggatgg

SEQ ID NO: 53015 - DNA, 16 bp, H. sapiens
atgtgggccaggtgca

SEQ ID NO: 53016 - DNA, 16 bp, H. sapiens
atgtgggctgtttttt

SEQ ID NO: 53017 - DNA, 16 bp, H. sapiens
atgtggggaaaagaga

SEQ ID NO: 53018 - DNA, 16 bp, H. sapiens
atgtggtattttgtta

SEQ ID NO: 53019 - DNA, 16 bp, H. sapiens
atgtggtcaacaagca

SEQ ID NO: 53020 - DNA, 16 bp, H. sapiens
atgtggtccctgccct

SEQ ID NO: 53021 - DNA, 16 bp, H. sapiens
atgtggtgacacatgc

SEQ ID NO: 53022 - DNA, 16 bp, H. sapiens
atgtggtggaaacagc

SEQ ID NO: 53023 - DNA, 18 bp, H. sapiens
atgtggtggcacatgcct

SEQ ID NO: 53024 - DNA, 18 bp, H. sapiens
atgtggtggcacgtgcct

SEQ ID NO: 53025 - DNA, 16 bp, H. sapiens
atgtggtggcaggtgc

SEQ ID NO: 53026 - DNA, 16 bp, H. sapiens
atgtggtggctcatgc

SEQ ID NO: 53027 - DNA, 16 bp, H. sapiens
atgtggtggtgggcgc

SEQ ID NO: 53028 - DNA, 16 bp, H. sapiens
atgtggtggtgtgcac

SEQ ID NO: 53029 - DNA, 16 bp, H. sapiens
atgtggtgtatcacat

SEQ ID NO: 53030 - DNA, 16 bp, H. sapiens
atgtggtgtttgcttt

SEQ ID NO: 53031 - DNA, 16 bp, H. sapiens
atgtggttagccaatt

SEQ ID NO: 53032 - DNA, 16 bp, H. sapiens
atgtggtttatcacat

SEQ ID NO: 53033 - DNA, 16 bp, H. sapiens
atgtggtttctgtctt

SEQ ID NO: 53034 - DNA, 16 bp, H. sapiens
atgtggttttaaaaat

SEQ ID NO: 53035 - DNA, 16 bp, H. sapiens
atgtggtttttgcttt

SEQ ID NO: 53036 - DNA, 16 bp, H. sapiens
atgtgtaaatatttta

SEQ ID NO: 53037 - DNA, 16 bp, H. sapiens
atgtgtacacccatgt

SEQ ID NO: 53038 - DNA, 16 bp, H. sapiens
atgtgtacatacatgt

SEQ ID NO: 53039 - DNA, 16 bp, H. sapiens
atgtgtacatatatat

SEQ ID NO: 53040 - DNA, 16 bp, H. sapiens
atgtgtacatatgtaa

SEQ ID NO: 53041 - DNA, 16 bp, H. sapiens
atgtgtacatatttat

SEQ ID NO: 53042 - DNA, 16 bp, H. sapiens
atgtgtacatttttaa

SEQ ID NO: 53043 - DNA, 16 bp, H. sapiens
atgtgtaccaccatgc

SEQ ID NO: 53044 - DNA, 16 bp, H. sapiens
atgtgtacgtgtgtgt

SEQ ID NO: 53045 - DNA, 16 bp, H. sapiens
atgtgtagattcatgt

SEQ ID NO: 53046 - DNA, 16 bp, H. sapiens
atgtgtagtattttat

SEQ ID NO: 53047 - DNA, 16 bp, H. sapiens
atgtgtatacacacac

SEQ ID NO: 53048 - DNA, 16 bp, H. sapiens
atgtgtatatatatga

SEQ ID NO: 53049 - DNA, 16 bp, H. sapiens
atgtgtatatatatgc

SEQ ID NO: 53050 - DNA, 17 bp, H. sapiens
atgtgtatatatatgtg

SEQ ID NO: 53051 - DNA, 16 bp, H. sapiens
atgtgtatatatatta

SEQ ID NO: 53052 - DNA, 16 bp, H. sapiens
atgtgtatatattata

SEQ ID NO: 53053 - DNA, 16 bp, H. sapiens
atgtgtatatatttgt

SEQ ID NO: 53054 - DNA, 16 bp, H. sapiens
atgtgtatatgtacat

SEQ ID NO: 53055 - DNA, 16 bp, H. sapiens
atgtgtatatgtatag

SEQ ID NO: 53056 - DNA, 16 bp, H. sapiens
atgtgtatatgtatat

SEQ ID NO: 53057 - DNA, 16 bp, H. sapiens
atgtgtatatttgtgt

SEQ ID NO: 53058 - DNA, 16 bp, H. sapiens
atgtgtatgcatatat

SEQ ID NO: 53059 - DNA, 16 bp, H. sapiens
atgtgtatgcatgtat

SEQ ID NO: 53060 - DNA, 16 bp, H. sapiens
atgtgtatgcctgtgt

SEQ ID NO: 53061 - DNA, 16 bp, H. sapiens
atgtgtatgggcaaaa

SEQ ID NO: 53062 - DNA, 16 bp, H. sapiens
atgtgtatgtatatag

SEQ ID NO: 53063 - DNA, 16 bp, H. sapiens
atgtgtatgtatgtgc

SEQ ID NO: 53064 - DNA, 16 bp, H. sapiens
atgtgtatgtatttct

SEQ ID NO: 53065 - DNA, 16 bp, H. sapiens
atgtgtatgtgcatgc

SEQ ID NO: 53066 - DNA, 16 bp, H. sapiens
atgtgtatgtgtacat

SEQ ID NO: 53067 - DNA, 17 bp, H. sapiens
atgtgtatgtgtatgta

SEQ ID NO: 53068 - DNA, 17 bp, H. sapiens
atgtgtatgtgtgtata

SEQ ID NO: 53069 - DNA, 16 bp, H. sapiens
atgtgtattctgttga

SEQ ID NO: 53070 - DNA, 16 bp, H. sapiens
atgtgtattgtatata

SEQ ID NO: 53071 - DNA, 16 bp, H. sapiens
atgtgtatttttaaaa

SEQ ID NO: 53072 - DNA, 16 bp, H. sapiens
atgtgtcaacttgtct

SEQ ID NO: 53073 - DNA, 16 bp, H. sapiens
atgtgtcaatttggct

SEQ ID NO: 53074 - DNA, 16 bp, H. sapiens
atgtgtcagaatttca

SEQ ID NO: 53075 - DNA, 16 bp, H. sapiens
atgtgtcaggcacagt

SEQ ID NO: 53076 - DNA, 16 bp, H. sapiens
atgtgtccagaaatgt

SEQ ID NO: 53077 - DNA, 16 bp, H. sapiens
atgtgtccctcaaaat

SEQ ID NO: 53078 - DNA, 16 bp, H. sapiens
atgtgtcctttttcat

SEQ ID NO: 53079 - DNA, 16 bp, H. sapiens
atgtgtctgtctttgt

SEQ ID NO: 53080 - DNA, 16 bp, H. sapiens
atgtgtctgtgtatat

SEQ ID NO: 53081 - DNA, 16 bp, H. sapiens
atgtgtctgtgtgtct

SEQ ID NO: 53082 - DNA, 16 bp, H. sapiens
atgtgtcttggggttc

SEQ ID NO: 53083 - DNA, 16 bp, H. sapiens
atgtgtctttatggaa

SEQ ID NO: 53084 - DNA, 16 bp, H. sapiens
atgtgtgaatttaatc

SEQ ID NO: 53085 - DNA, 16 bp, H. sapiens
atgtgtgacaggggtg

SEQ ID NO: 53086 - DNA, 16 bp, H. sapiens
atgtgtgacattattt

SEQ ID NO: 53087 - DNA, 16 bp, H. sapiens
atgtgtgaccatgagg

SEQ ID NO: 53088 - DNA, 16 bp, H. sapiens
atgtgtgagaacatgc

SEQ ID NO: 53089 - DNA, 16 bp, H. sapiens
atgtgtgagagagaaa

SEQ ID NO: 53090 - DNA, 16 bp, H. sapiens
atgtgtgaggtgtgtg

SEQ ID NO: 53091 - DNA, 16 bp, H. sapiens
atgtgtgagtgcatgt

SEQ ID NO: 53092 - DNA, 16 bp, H. sapiens
atgtgtgagtgtgtga

SEQ ID NO: 53093 - DNA, 16 bp, H. sapiens
atgtgtgatgtgtgtg

SEQ ID NO: 53094 - DNA, 16 bp, H. sapiens
atgtgtgcatatgcat

SEQ ID NO: 53095 - DNA, 16 bp, H. sapiens
atgtgtgcatgtgagt

SEQ ID NO: 53096 - DNA, 16 bp, H. sapiens
atgtgtgcatttgtgt

SEQ ID NO: 53097 - DNA, 16 bp, H. sapiens
atgtgtgcctgtgtgt

SEQ ID NO: 53098 - DNA, 16 bp, H. sapiens
atgtgtgccttcatct

SEQ ID NO: 53099 - DNA, 16 bp, H. sapiens
atgtgtggcccaaaac

SEQ ID NO: 53100 - DNA, 16 bp, H. sapiens
atgtgtgtaatctcag

SEQ ID NO: 53101 - DNA, 18 bp, H. sapiens
atgtgtgtatatatatat

SEQ ID NO: 53102 - DNA, 16 bp, H. sapiens
atgtgtgtatatgtgt

SEQ ID NO: 53103 - DNA, 16 bp, H. sapiens
atgtgtgtatatttac

SEQ ID NO: 53104 - DNA, 16 bp, H. sapiens
atgtgtgtatctgtgt

SEQ ID NO: 53105 - DNA, 16 bp, H. sapiens
atgtgtgtctgtatgt

SEQ ID NO: 53106 - DNA, 16 bp, H. sapiens
atgtgtgtctgtgtgt

SEQ ID NO: 53107 - DNA, 16 bp, H. sapiens
atgtgtgtgagtgtga

SEQ ID NO: 53108 - DNA, 16 bp, H. sapiens
atgtgtgtgagtgtgt

SEQ ID NO: 53109 - DNA, 16 bp, H. sapiens
atgtgtgtgatgtgtg

SEQ ID NO: 53110 - DNA, 16 bp, H. sapiens
atgtgtgtgcaagtgt

SEQ ID NO: 53111 - DNA, 16 bp, H. sapiens
atgtgtgtgcataaat

SEQ ID NO: 53112 - DNA, 16 bp, H. sapiens
atgtgtgtgcatatat

SEQ ID NO: 53113 - DNA, 16 bp, H. sapiens
atgtgtgtgcatttct

SEQ ID NO: 53114 - DNA, 16 bp, H. sapiens
atgtgtgtgcctgcat

SEQ ID NO: 53115 - DNA, 16 bp, H. sapiens
atgtgtgtgcctgtgt

SEQ ID NO: 53116 - DNA, 18 bp, H. sapiens
atgtgtgtgcgtgtgcat

SEQ ID NO: 53117 - DNA, 16 bp, H. sapiens
atgtgtgtggtatgtg

SEQ ID NO: 53118 - DNA, 16 bp, H. sapiens
atgtgtgtgtatatat

SEQ ID NO: 53119 - DNA, 16 bp, H. sapiens
atgtgtgtgtatatgt

SEQ ID NO: 53120 - DNA, 16 bp, H. sapiens
atgtgtgtgtctttaa

SEQ ID NO: 53121 - DNA, 16 bp, H. sapiens
atgtgtgtgtgaatgt

SEQ ID NO: 53122 - DNA, 16 bp, H. sapiens
atgtgtgtgtgagtgt

SEQ ID NO: 53123 - DNA, 16 bp, H. sapiens
atgtgtgtgtgatgtg

SEQ ID NO: 53124 - DNA, 16 bp, H. sapiens
atgtgtgtgtgcatgt

SEQ ID NO: 53125 - DNA, 16 bp, H. sapiens
atgtgtgtgtgcctgt

SEQ ID NO: 53126 - DNA, 16 bp, H. sapiens
atgtgtgtgtgtaaaa

SEQ ID NO: 53127 - DNA, 16 bp, H. sapiens
atgtgtgtgtgtgaga

SEQ ID NO: 53128 - DNA, 16 bp, H. sapiens
atgtgtgtgtgtgtat

SEQ ID NO: 53129 - DNA, 16 bp, H. sapiens
atgtgtgtgtgtgtct

SEQ ID NO: 53130 - DNA, 16 bp, H. sapiens
atgtgtgtgtgtgtgc

SEQ ID NO: 53131 - DNA, 16 bp, H. sapiens
atgtgtgttatgaccc

SEQ ID NO: 53132 - DNA, 16 bp, H. sapiens
atgtgtgtttgtctgt

SEQ ID NO: 53133 - DNA, 16 bp, H. sapiens
atgtgtgtttttaaaa

SEQ ID NO: 53134 - DNA, 16 bp, H. sapiens
atgtgttaattcattt

SEQ ID NO: 53135 - DNA, 16 bp, H. sapiens
atgtgttcatttattt

SEQ ID NO: 53136 - DNA, 16 bp, H. sapiens
atgtgttcattttatt

SEQ ID NO: 53137 - DNA, 16 bp, H. sapiens
atgtgttcccaaatat

SEQ ID NO: 53138 - DNA, 16 bp, H. sapiens
atgtgttctcattttt

SEQ ID NO: 53139 - DNA, 16 bp, H. sapiens
atgtgttcttattgtt

SEQ ID NO: 53140 - DNA, 16 bp, H. sapiens
atgtgttctttcattt

SEQ ID NO: 53141 - DNA, 16 bp, H. sapiens
atgtgttgaaccaacc

SEQ ID NO: 53142 - DNA, 16 bp, H. sapiens
atgtgttgtcattgtt

SEQ ID NO: 53143 - DNA, 16 bp, H. sapiens
atgtgtttaatattcc

SEQ ID NO: 53144 - DNA, 16 bp, H. sapiens
atgtgtttccatttgt

SEQ ID NO: 53145 - DNA, 16 bp, H. sapiens
atgtgtttcctgaata

SEQ ID NO: 53146 - DNA, 16 bp, H. sapiens
atgtgtttctgtttgt

SEQ ID NO: 53147 - DNA, 16 bp, H. sapiens
atgtgtttgtcaaaac

SEQ ID NO: 53148 - DNA, 16 bp, H. sapiens
atgtgtttgtgtgtct

SEQ ID NO: 53149 - DNA, 16 bp, H. sapiens
atgtgttttaaaatgt

SEQ ID NO: 53150 - DNA, 16 bp, H. sapiens
atgtgttttagaaata

SEQ ID NO: 53151 - DNA, 16 bp, H. sapiens
atgtgttttataaata

SEQ ID NO: 53152 - DNA, 16 bp, H. sapiens
atgtgttttatttcat

SEQ ID NO: 53153 - DNA, 16 bp, H. sapiens
atgtgttttcatcatt

SEQ ID NO: 53154 - DNA, 16 bp, H. sapiens
atgtgttttcattgtt

SEQ ID NO: 53155 - DNA, 16 bp, H. sapiens
atgtgttttcatttct

SEQ ID NO: 53156 - DNA, 16 bp, H. sapiens
atgtgttttccaaact

SEQ ID NO: 53157 - DNA, 16 bp, H. sapiens
atgtgttttctttctc

SEQ ID NO: 53158 - DNA, 16 bp, H. sapiens
atgtgtttttatgaag

SEQ ID NO: 53159 - DNA, 16 bp, H. sapiens
atgttaaaaaatcctt

SEQ ID NO: 53160 - DNA, 16 bp, H. sapiens
atgttaaaatgttaat

SEQ ID NO: 53161 - DNA, 16 bp, H. sapiens
atgttaaaattcatat

SEQ ID NO: 53162 - DNA, 16 bp, H. sapiens
atgttaaataaatgtt

SEQ ID NO: 53163 - DNA, 16 bp, H. sapiens
atgttaaatacatttt

SEQ ID NO: 53164 - DNA, 16 bp, H. sapiens
atgttaaatgacaaaa

SEQ ID NO: 53165 - DNA, 16 bp, H. sapiens
atgttaaattatatgg

SEQ ID NO: 53166 - DNA, 16 bp, H. sapiens
atgttaaattgttgta

SEQ ID NO: 53167 - DNA, 16 bp, H. sapiens
atgttaacaaatttta

SEQ ID NO: 53168 - DNA, 16 bp, H. sapiens
atgttaacattttaat

SEQ ID NO: 53169 - DNA, 16 bp, H. sapiens
atgttaactagcttga

SEQ ID NO: 53170 - DNA, 16 bp, H. sapiens
atgttaactattatta

SEQ ID NO: 53171 - DNA, 16 bp, H. sapiens
atgttaactcttttct

SEQ ID NO: 53172 - DNA, 16 bp, H. sapiens
atgttaactgacttaa

SEQ ID NO: 53173 - DNA, 16 bp, H. sapiens
atgttaaggcagccag

SEQ ID NO: 53174 - DNA, 16 bp, H. sapiens
atgttaagtaaaacaa

SEQ ID NO: 53175 - DNA, 16 bp, H. sapiens
atgttaagtaatttgc

SEQ ID NO: 53176 - DNA, 16 bp, H. sapiens
atgttaagtattctta

SEQ ID NO: 53177 - DNA, 16 bp, H. sapiens
atgttaataaacttgt

SEQ ID NO: 53178 - DNA, 16 bp, H. sapiens
atgttaatccccaaga

SEQ ID NO: 53179 - DNA, 16 bp, H. sapiens
atgttaatctgcttca

SEQ ID NO: 53180 - DNA, 16 bp, H. sapiens
atgttaatgaatcaac

SEQ ID NO: 53181 - DNA, 16 bp, H. sapiens
atgttaattctgtttt

SEQ ID NO: 53182 - DNA, 16 bp, H. sapiens
atgttaatttgctcaa

SEQ ID NO: 53183 - DNA, 16 bp, H. sapiens
atgttaatttgtttca

SEQ ID NO: 53184 - DNA, 16 bp, H. sapiens
atgttacaaaagaaaa

SEQ ID NO: 53185 - DNA, 24 bp, H. sapiens
atgttacagtgctgcagagatttt

SEQ ID NO: 53186 - DNA, 16 bp, H. sapiens
atgttacatattatat

SEQ ID NO: 53187 - DNA, 16 bp, H. sapiens
atgttacatgttttta

SEQ ID NO: 53188 - DNA, 16 bp, H. sapiens
atgttacatttctttt

SEQ ID NO: 53189 - DNA, 16 bp, H. sapiens
atgttacatttgtaaa

SEQ ID NO: 53190 - DNA, 16 bp, H. sapiens
atgttacccaggctgg

SEQ ID NO: 53191 - DNA, 16 bp, H. sapiens
atgttacctgttttaa

SEQ ID NO: 53192 - DNA, 16 bp, H. sapiens
atgttactattattat

SEQ ID NO: 53193 - DNA, 16 bp, H. sapiens
atgttactgcactgaa

SEQ ID NO: 53194 - DNA, 16 bp, H. sapiens
atgttagccaggctga

SEQ ID NO: 53195 - DNA, 16 bp, H. sapiens
atgttagctgggctgg

SEQ ID NO: 53196 - DNA, 16 bp, H. sapiens
atgttagggtattgat

SEQ ID NO: 53197 - DNA, 16 bp, H. sapiens
atgttataaaaatgta

SEQ ID NO: 53198 - DNA, 16 bp, H. sapiens
atgttataacatggat

SEQ ID NO: 53199 - DNA, 16 bp, H. sapiens
atgttatatatacatg

SEQ ID NO: 53200 - DNA, 16 bp, H. sapiens
atgttatatatatgta

SEQ ID NO: 53201 - DNA, 16 bp, H. sapiens
atgttatcaaacagca

SEQ ID NO: 53202 - DNA, 16 bp, H. sapiens
atgttatctatagatt

SEQ ID NO: 53203 - DNA, 16 bp, H. sapiens
atgttatctccatttt

SEQ ID NO: 53204 - DNA, 16 bp, H. sapiens
atgttatgtgcatttt

SEQ ID NO: 53205 - DNA, 16 bp, H. sapiens
atgttatgtgtgttct

SEQ ID NO: 53206 - DNA, 16 bp, H. sapiens
atgttatgttttcatt

SEQ ID NO: 53207 - DNA, 16 bp, H. sapiens
atgttattaaattcat

SEQ ID NO: 53208 - DNA, 16 bp, H. sapiens
atgttattaatttcta

SEQ ID NO: 53209 - DNA, 16 bp, H. sapiens
atgttattggaatttt

SEQ ID NO: 53210 - DNA, 16 bp, H. sapiens
atgttatttacaaaaa

SEQ ID NO: 53211 - DNA, 16 bp, H. sapiens
atgttatttgcctttt

SEQ ID NO: 53212 - DNA, 16 bp, H. sapiens
atgttatttggaaata

SEQ ID NO: 53213 - DNA, 16 bp, H. sapiens
atgttcaaagttccac

SEQ ID NO: 53214 - DNA, 16 bp, H. sapiens
atgttcaacctgtatt

SEQ ID NO: 53215 - DNA, 16 bp, H. sapiens
atgttcaagcaattct

SEQ ID NO: 53216 - DNA, 16 bp, H. sapiens
atgttcaattctttgc

SEQ ID NO: 53217 - DNA, 16 bp, H. sapiens
atgttcacaaatatca

SEQ ID NO: 53218 - DNA, 16 bp, H. sapiens
atgttcacattttaaa

SEQ ID NO: 53219 - DNA, 16 bp, H. sapiens
atgttcaccatccaaa

SEQ ID NO: 53220 - DNA, 16 bp, H. sapiens
atgttcactttggggt

SEQ ID NO: 53221 - DNA, 16 bp, H. sapiens
atgttcatagcagcat

SEQ ID NO: 53222 - DNA, 16 bp, H. sapiens
atgttcatattttaat

SEQ ID NO: 53223 - DNA, 16 bp, H. sapiens
atgttcatcacagtgt

SEQ ID NO: 53224 - DNA, 16 bp, H. sapiens
atgttcatcaggaata

SEQ ID NO: 53225 - DNA, 16 bp, H. sapiens
atgttcatgaatatca

SEQ ID NO: 53226 - DNA, 16 bp, H. sapiens
atgttcatgacagcat

SEQ ID NO: 53227 - DNA, 16 bp, H. sapiens
atgttcattacagaaa

SEQ ID NO: 53228 - DNA, 16 bp, H. sapiens
atgttcattttaaaaa

SEQ ID NO: 53229 - DNA, 16 bp, H. sapiens
atgttcatttttaaag

SEQ ID NO: 53230 - DNA, 16 bp, H. sapiens
atgttcatttttctct

SEQ ID NO: 53231 - DNA, 16 bp, H. sapiens
atgttccaattaaaag

SEQ ID NO: 53232 - DNA, 16 bp, H. sapiens
atgttccagacactgt

SEQ ID NO: 53233 - DNA, 16 bp, H. sapiens
atgttccagattaaag

SEQ ID NO: 53234 - DNA, 16 bp, H. sapiens
atgttccaggtactgt

SEQ ID NO: 53235 - DNA, 17 bp, H. sapiens
atgttccatcctgtaca

SEQ ID NO: 53236 - DNA, 16 bp, H. sapiens
atgttcccattcctgt

SEQ ID NO: 53237 - DNA, 16 bp, H. sapiens
atgttcccctcctgtg

SEQ ID NO: 53238 - DNA, 16 bp, H. sapiens
atgttcctatttttat

SEQ ID NO: 53239 - DNA, 16 bp, H. sapiens
atgttcctcctggctg

SEQ ID NO: 53240 - DNA, 16 bp, H. sapiens
atgttcctctttgtct

SEQ ID NO: 53241 - DNA, 16 bp, H. sapiens
atgttcctgtctgaca

SEQ ID NO: 53242 - DNA, 17 bp, H. sapiens
atgttccttgggctggt

SEQ ID NO: 53243 - DNA, 16 bp, H. sapiens
atgttccttgtgaatt

SEQ ID NO: 53244 - DNA, 16 bp, H. sapiens
atgttcctttactctt

SEQ ID NO: 53245 - DNA, 16 bp, H. sapiens
atgttctaataaaact

SEQ ID NO: 53246 - DNA, 16 bp, H. sapiens
atgttctattttttaa

SEQ ID NO: 53247 - DNA, 16 bp, H. sapiens
atgttctcactcatac

SEQ ID NO: 53248 - DNA, 16 bp, H. sapiens
atgttctcactcatca

SEQ ID NO: 53249 - DNA, 16 bp, H. sapiens
atgttctcatttattt

SEQ ID NO: 53250 - DNA, 16 bp, H. sapiens
atgttctccaggttca

SEQ ID NO: 53251 - DNA, 16 bp, H. sapiens
atgttctgcttcctct

SEQ ID NO: 53252 - DNA, 16 bp, H. sapiens
atgttctggaatccta

SEQ ID NO: 53253 - DNA, 16 bp, H. sapiens
atgttctgtatcttaa

SEQ ID NO: 53254 - DNA, 16 bp, H. sapiens
atgttcttacttaaaa

SEQ ID NO: 53255 - DNA, 16 bp, H. sapiens
atgttcttattttaaa

SEQ ID NO: 53256 - DNA, 16 bp, H. sapiens
atgttcttctcagcac

SEQ ID NO: 53257 - DNA, 16 bp, H. sapiens
atgttcttctgcctgc

SEQ ID NO: 53258 - DNA, 16 bp, H. sapiens
atgttcttggaaactt

SEQ ID NO: 53259 - DNA, 16 bp, H. sapiens
atgttctttgaaaaca

SEQ ID NO: 53260 - DNA, 16 bp, H. sapiens
atgttgaaaactcaga

SEQ ID NO: 53261 - DNA, 16 bp, H. sapiens
atgttgaaaccccatc

SEQ ID NO: 53262 - DNA, 16 bp, H. sapiens
atgttgaaaggaaaaa

SEQ ID NO: 53263 - DNA, 16 bp, H. sapiens
atgttgaaatgtaatc

SEQ ID NO: 53264 - DNA, 16 bp, H. sapiens
atgttgaaatgtgatt

SEQ ID NO: 53265 - DNA, 16 bp, H. sapiens
atgttgaacatttttt

SEQ ID NO: 53266 - DNA, 16 bp, H. sapiens
atgttgaacttttttt

SEQ ID NO: 53267 - DNA, 16 bp, H. sapiens
atgttgaagccccaac

SEQ ID NO: 53268 - DNA, 16 bp, H. sapiens
atgttgaagccctaaa

SEQ ID NO: 53269 - DNA, 16 bp, H. sapiens
atgttgaagtcctaat

SEQ ID NO: 53270 - DNA, 16 bp, H. sapiens
atgttgaataaaagtg

SEQ ID NO: 53271 - DNA, 16 bp, H. sapiens
atgttgaatattatca

SEQ ID NO: 53272 - DNA, 16 bp, H. sapiens
atgttgaatattttct

SEQ ID NO: 53273 - DNA, 16 bp, H. sapiens
atgttgaccagtctgg

SEQ ID NO: 53274 - DNA, 16 bp, H. sapiens
atgttgagcaaaataa

SEQ ID NO: 53275 - DNA, 16 bp, H. sapiens
atgttgagcatctttt

SEQ ID NO: 53276 - DNA, 16 bp, H. sapiens
atgttgagcattcttt

SEQ ID NO: 53277 - DNA, 16 bp, H. sapiens
atgttgagctattttt

SEQ ID NO: 53278 - DNA, 16 bp, H. sapiens
atgttgaggaaaaaaa

SEQ ID NO: 53279 - DNA, 16 bp, H. sapiens
atgttgatcatgctgg

SEQ ID NO: 53280 - DNA, 16 bp, H. sapiens
atgttgatgagaaaaa

SEQ ID NO: 53281 - DNA, 16 bp, H. sapiens
atgttgatgatatttt

SEQ ID NO: 53282 - DNA, 16 bp, H. sapiens
atgttgattttgcatc

SEQ ID NO: 53283 - DNA, 16 bp, H. sapiens
atgttgcagcttcttt

SEQ ID NO: 53284 - DNA, 16 bp, H. sapiens
atgttgcaggaagtca

SEQ ID NO: 53285 - DNA, 16 bp, H. sapiens
atgttgcattttcatt

SEQ ID NO: 53286 - DNA, 16 bp, H. sapiens
atgttgcattttccaa

SEQ ID NO: 53287 - DNA, 16 bp, H. sapiens
atgttgccaaattgct

SEQ ID NO: 53288 - DNA, 16 bp, H. sapiens
atgttgccaaggctgg

SEQ ID NO: 53289 - DNA, 16 bp, H. sapiens
atgttgccacaaatga

SEQ ID NO: 53290 - DNA, 16 bp, H. sapiens
atgttgccaggctggt

SEQ ID NO: 53291 - DNA, 16 bp, H. sapiens
atgttgccagtctctt

SEQ ID NO: 53292 - DNA, 16 bp, H. sapiens
atgttgcccagaatgg

SEQ ID NO: 53293 - DNA, 16 bp, H. sapiens
atgttgcccagactgt

SEQ ID NO: 53294 - DNA, 16 bp, H. sapiens
atgttgcccaggcagg

SEQ ID NO: 53295 - DNA, 16 bp, H. sapiens
atgttgcccaggctct

SEQ ID NO: 53296 - DNA, 17 bp, H. sapiens
atgttgcccaggctgga

SEQ ID NO: 53297 - DNA, 16 bp, H. sapiens
atgttgcccaggcttg

SEQ ID NO: 53298 - DNA, 16 bp, H. sapiens
atgttgcccaggcttt

SEQ ID NO: 53299 - DNA, 16 bp, H. sapiens
atgttgcctaggctgg

SEQ ID NO: 53300 - DNA, 16 bp, H. sapiens
atgttgcctggactgg

SEQ ID NO: 53301 - DNA, 16 bp, H. sapiens
atgttgcctgttcctt

SEQ ID NO: 53302 - DNA, 16 bp, H. sapiens
atgttgctcagggtgg

SEQ ID NO: 53303 - DNA, 16 bp, H. sapiens
atgttgctgaagctgg

SEQ ID NO: 53304 - DNA, 16 bp, H. sapiens
atgttgctgtttccag

SEQ ID NO: 53305 - DNA, 16 bp, H. sapiens
atgttgcttccacatt

SEQ ID NO: 53306 - DNA, 16 bp, H. sapiens
atgttgcttttaaaat

SEQ ID NO: 53307 - DNA, 16 bp, H. sapiens
atgttggaagaaaaca

SEQ ID NO: 53308 - DNA, 16 bp, H. sapiens
atgttggatgcatata

SEQ ID NO: 53309 - DNA, 17 bp, H. sapiens
atgttggccagactggt

SEQ ID NO: 53310 - DNA, 18 bp, H. sapiens
atgttggccaggctgatt

SEQ ID NO: 53311 - DNA, 16 bp, H. sapiens
atgttggccaggtctc

SEQ ID NO: 53312 - DNA, 16 bp, H. sapiens
atgttggcccaggctg

SEQ ID NO: 53313 - DNA, 16 bp, H. sapiens
atgttggcctgtcttt

SEQ ID NO: 53314 - DNA, 16 bp, H. sapiens
atgttggctatgagtt

SEQ ID NO: 53315 - DNA, 16 bp, H. sapiens
atgttggctgtgggct

SEQ ID NO: 53316 - DNA, 16 bp, H. sapiens
atgttggggaagggac

SEQ ID NO: 53317 - DNA, 16 bp, H. sapiens
atgttggtgaccttca

SEQ ID NO: 53318 - DNA, 16 bp, H. sapiens
atgttggtggaaatgt

SEQ ID NO: 53319 - DNA, 16 bp, H. sapiens
atgttggtgtcctgca

SEQ ID NO: 53320 - DNA, 16 bp, H. sapiens
atgttggttttgtatc

SEQ ID NO: 53321 - DNA, 16 bp, H. sapiens
atgttgtacacagtaa

SEQ ID NO: 53322 - DNA, 16 bp, H. sapiens
atgttgtacagtagat

SEQ ID NO: 53323 - DNA, 16 bp, H. sapiens
atgttgtataaatgga

SEQ ID NO: 53324 - DNA, 16 bp, H. sapiens
atgttgtatatataca

SEQ ID NO: 53325 - DNA, 16 bp, H. sapiens
atgttgtatcttcatt

SEQ ID NO: 53326 - DNA, 16 bp, H. sapiens
atgttgtatgattcca

SEQ ID NO: 53327 - DNA, 16 bp, H. sapiens
atgttgtatttaaaaa

SEQ ID NO: 53328 - DNA, 16 bp, H. sapiens
atgttgtcacttattt

SEQ ID NO: 53329 - DNA, 16 bp, H. sapiens
atgttgtccagactga

SEQ ID NO: 53330 - DNA, 16 bp, H. sapiens
atgttgtgaaaattaa

SEQ ID NO: 53331 - DNA, 16 bp, H. sapiens
atgttgtgatctcagc

SEQ ID NO: 53332 - DNA, 16 bp, H. sapiens
atgttgtgggagaaac

SEQ ID NO: 53333 - DNA, 16 bp, H. sapiens
atgttgtgggagggag

SEQ ID NO: 53334 - DNA, 16 bp, H. sapiens
atgttgtgtttctgtt

SEQ ID NO: 53335 - DNA, 16 bp, H. sapiens
atgttgttgcaaagga

SEQ ID NO: 53336 - DNA, 16 bp, H. sapiens
atgttgttgcaaatgt

SEQ ID NO: 53337 - DNA, 16 bp, H. sapiens
atgtttaaaaacattt

SEQ ID NO: 53338 - DNA, 16 bp, H. sapiens
atgtttaaaaagaaag

SEQ ID NO: 53339 - DNA, 16 bp, H. sapiens
atgtttaaaatggtaa

SEQ ID NO: 53340 - DNA, 16 bp, H. sapiens
atgtttaaaatgtttg

SEQ ID NO: 53341 - DNA, 16 bp, H. sapiens
atgtttaaaattatgt

SEQ ID NO: 53342 - DNA, 16 bp, H. sapiens
atgtttaaacatttta

SEQ ID NO: 53343 - DNA, 16 bp, H. sapiens
atgtttaaattcacct

SEQ ID NO: 53344 - DNA, 16 bp, H. sapiens
atgtttaaattttcat

SEQ ID NO: 53345 - DNA, 16 bp, H. sapiens
atgtttaaatttttct

SEQ ID NO: 53346 - DNA, 16 bp, H. sapiens
atgtttaacattttaa

SEQ ID NO: 53347 - DNA, 16 bp, H. sapiens
atgtttaacattttca

SEQ ID NO: 53348 - DNA, 16 bp, H. sapiens
atgtttaactgtttga

SEQ ID NO: 53349 - DNA, 16 bp, H. sapiens
atgtttaacttttaaa

SEQ ID NO: 53350 - DNA, 16 bp, H. sapiens
atgtttaagaaaatat

SEQ ID NO: 53351 - DNA, 16 bp, H. sapiens
atgtttaagtctttga

SEQ ID NO: 53352 - DNA, 16 bp, H. sapiens
atgtttaattttgtca

SEQ ID NO: 53353 - DNA, 16 bp, H. sapiens
atgtttacaaggaatt

SEQ ID NO: 53354 - DNA, 16 bp, H. sapiens
atgtttacagcagttt

SEQ ID NO: 53355 - DNA, 16 bp, H. sapiens
atgtttacataaaatt

SEQ ID NO: 53356 - DNA, 16 bp, H. sapiens
atgtttacatataata

SEQ ID NO: 53357 - DNA, 16 bp, H. sapiens
atgtttacattaaaaa

SEQ ID NO: 53358 - DNA, 16 bp, H. sapiens
atgtttagaaacacaa

SEQ ID NO: 53359 - DNA, 16 bp, H. sapiens
atgtttagcagtatcc

SEQ ID NO: 53360 - DNA, 16 bp, H. sapiens
atgtttagtgaaataa

SEQ ID NO: 53361 - DNA, 16 bp, H. sapiens
atgtttagttctttga

SEQ ID NO: 53362 - DNA, 16 bp, H. sapiens
atgtttagttttctaa

SEQ ID NO: 53363 - DNA, 16 bp, H. sapiens
atgtttataaagaaat

SEQ ID NO: 53364 - DNA, 16 bp, H. sapiens
atgtttatacactgct

SEQ ID NO: 53365 - DNA, 16 bp, H. sapiens
atgtttataccacatt

SEQ ID NO: 53366 - DNA, 16 bp, H. sapiens
atgtttatatataaac

SEQ ID NO: 53367 - DNA, 16 bp, H. sapiens
atgtttatgaaaaata

SEQ ID NO: 53368 - DNA, 16 bp, H. sapiens
atgtttatgtatataa

SEQ ID NO: 53369 - DNA, 16 bp, H. sapiens
atgtttatgtcccccc

SEQ ID NO: 53370 - DNA, 16 bp, H. sapiens
atgtttattaaacact

SEQ ID NO: 53371 - DNA, 16 bp, H. sapiens
atgtttattctgcagc

SEQ ID NO: 53372 - DNA, 16 bp, H. sapiens
atgtttattgaacaaa

SEQ ID NO: 53373 - DNA, 16 bp, H. sapiens
atgtttattgatcatt

SEQ ID NO: 53374 - DNA, 16 bp, H. sapiens
atgtttatttagaaac

SEQ ID NO: 53375 - DNA, 16 bp, H. sapiens
atgtttattttaacat

SEQ ID NO: 53376 - DNA, 16 bp, H. sapiens
atgtttattttccatt

SEQ ID NO: 53377 - DNA, 16 bp, H. sapiens
atgtttcaataaattt

SEQ ID NO: 53378 - DNA, 16 bp, H. sapiens
atgtttcataatttaa

SEQ ID NO: 53379 - DNA, 16 bp, H. sapiens
atgtttcatgtctccc

SEQ ID NO: 53380 - DNA, 16 bp, H. sapiens
atgtttcatgtgcaga

SEQ ID NO: 53381 - DNA, 16 bp, H. sapiens
atgtttccagcttttg

SEQ ID NO: 53382 - DNA, 16 bp, H. sapiens
atgtttccaggatttg

SEQ ID NO: 53383 - DNA, 16 bp, H. sapiens
atgtttcctgtataat

SEQ ID NO: 53384 - DNA, 16 bp, H. sapiens
atgtttccttgctttt

SEQ ID NO: 53385 - DNA, 16 bp, H. sapiens
atgtttccttttttaa

SEQ ID NO: 53386 - DNA, 16 bp, H. sapiens
atgtttctaagaattt

SEQ ID NO: 53387 - DNA, 16 bp, H. sapiens
atgtttctaattttaa

SEQ ID NO: 53388 - DNA, 16 bp, H. sapiens
atgtttctatatattt

SEQ ID NO: 53389 - DNA, 16 bp, H. sapiens
atgtttctattatata

SEQ ID NO: 53390 - DNA, 16 bp, H. sapiens
atgtttctctctctct

SEQ ID NO: 53391 - DNA, 16 bp, H. sapiens
atgtttctgaaaatgt

SEQ ID NO: 53392 - DNA, 16 bp, H. sapiens
atgtttctgaagaaaa

SEQ ID NO: 53393 - DNA, 16 bp, H. sapiens
atgtttctgcaaagaa

SEQ ID NO: 53394 - DNA, 16 bp, H. sapiens
atgtttctgtgagctc

SEQ ID NO: 53395 - DNA, 16 bp, H. sapiens
atgtttctgttgttta

SEQ ID NO: 53396 - DNA, 16 bp, H. sapiens
atgtttctgtttctat

SEQ ID NO: 53397 - DNA, 16 bp, H. sapiens
atgtttctttttcaaa

SEQ ID NO: 53398 - DNA, 16 bp, H. sapiens
atgtttcttttttaaa

SEQ ID NO: 53399 - DNA, 16 bp, H. sapiens
atgtttgaaaacaaaa

SEQ ID NO: 53400 - DNA, 16 bp, H. sapiens
atgtttgagatggagt

SEQ ID NO: 53401 - DNA, 16 bp, H. sapiens
atgtttgataaatgtt

SEQ ID NO: 53402 - DNA, 16 bp, H. sapiens
atgtttgatatatgta

SEQ ID NO: 53403 - DNA, 16 bp, H. sapiens
atgtttgatatgattt

SEQ ID NO: 53404 - DNA, 16 bp, H. sapiens
atgtttgatcattttt

SEQ ID NO: 53405 - DNA, 16 bp, H. sapiens
atgtttgcaaaccata

SEQ ID NO: 53406 - DNA, 16 bp, H. sapiens
atgtttgcaaatattt

SEQ ID NO: 53407 - DNA, 16 bp, H. sapiens
atgtttgcagatgaca

SEQ ID NO: 53408 - DNA, 18 bp, H. sapiens
atgtttgcagtaatgctg

SEQ ID NO: 53409 - DNA, 16 bp, H. sapiens
atgtttgcatttttta

SEQ ID NO: 53410 - DNA, 16 bp, H. sapiens
atgtttgccagactgg

SEQ ID NO: 53411 - DNA, 16 bp, H. sapiens
atgtttgcccagacca

SEQ ID NO: 53412 - DNA, 16 bp, H. sapiens
atgtttgcctgtcttg

SEQ ID NO: 53413 - DNA, 16 bp, H. sapiens
atgtttgctgaatgac

SEQ ID NO: 53414 - DNA, 16 bp, H. sapiens
atgtttgctggttatt

SEQ ID NO: 53415 - DNA, 16 bp, H. sapiens
atgtttgcttctcctt

SEQ ID NO: 53416 - DNA, 16 bp, H. sapiens
atgtttggaaaaacct

SEQ ID NO: 53417 - DNA, 16 bp, H. sapiens
atgtttggagacattt

SEQ ID NO: 53418 - DNA, 16 bp, H. sapiens
atgtttggttacatga

SEQ ID NO: 53419 - DNA, 16 bp, H. sapiens
atgtttgtaaaaatat

SEQ ID NO: 53420 - DNA, 16 bp, H. sapiens
atgtttgtgaattttc

SEQ ID NO: 53421 - DNA, 16 bp, H. sapiens
atgtttgtgccactgc

SEQ ID NO: 53422 - DNA, 16 bp, H. sapiens
atgtttgtgtcccccc

SEQ ID NO: 53423 - DNA, 16 bp, H. sapiens
atgtttgttaaatgaa

SEQ ID NO: 53424 - DNA, 16 bp, H. sapiens
atgtttgttgactgaa

SEQ ID NO: 53425 - DNA, 16 bp, H. sapiens
atgtttgttttaagct

SEQ ID NO: 53426 - DNA, 16 bp, H. sapiens
atgtttgttttcaaaa

SEQ ID NO: 53427 - DNA, 16 bp, H. sapiens
atgttttaaaaagata

SEQ ID NO: 53428 - DNA, 16 bp, H. sapiens
atgttttaaaaatgtt

SEQ ID NO: 53429 - DNA, 16 bp, H. sapiens
atgttttaaaacataa

SEQ ID NO: 53430 - DNA, 16 bp, H. sapiens
atgttttaaaagtttg

SEQ ID NO: 53431 - DNA, 16 bp, H. sapiens
atgttttaaaatctat

SEQ ID NO: 53432 - DNA, 16 bp, H. sapiens
atgttttaaaattgat

SEQ ID NO: 53433 - DNA, 16 bp, H. sapiens
atgttttaaactttta

SEQ ID NO: 53434 - DNA, 16 bp, H. sapiens
atgttttaacccaatg

SEQ ID NO: 53435 - DNA, 16 bp, H. sapiens
atgttttaagttaaaa

SEQ ID NO: 53436 - DNA, 16 bp, H. sapiens
atgttttacatgtatt

SEQ ID NO: 53437 - DNA, 16 bp, H. sapiens
atgttttacatttagg

SEQ ID NO: 53438 - DNA, 16 bp, H. sapiens
atgttttagaaattat

SEQ ID NO: 53439 - DNA, 16 bp, H. sapiens
atgttttataaaagaa

SEQ ID NO: 53440 - DNA, 16 bp, H. sapiens
atgttttataacatat

SEQ ID NO: 53441 - DNA, 16 bp, H. sapiens
atgttttatcatggtt

SEQ ID NO: 53442 - DNA, 16 bp, H. sapiens
atgttttatctttaaa

SEQ ID NO: 53443 - DNA, 16 bp, H. sapiens
atgttttatgaaaaaa

SEQ ID NO: 53444 - DNA, 16 bp, H. sapiens
atgttttatgaaaata

SEQ ID NO: 53445 - DNA, 16 bp, H. sapiens
atgttttatgtaaaat

SEQ ID NO: 53446 - DNA, 16 bp, H. sapiens
atgttttatgtgcact

SEQ ID NO: 53447 - DNA, 16 bp, H. sapiens
atgttttattacattt

SEQ ID NO: 53448 - DNA, 16 bp, H. sapiens
atgttttcaaataaat

SEQ ID NO: 53449 - DNA, 16 bp, H. sapiens
atgttttcaaatttct

SEQ ID NO: 53450 - DNA, 16 bp, H. sapiens
atgttttcaacttctt

SEQ ID NO: 53451 - DNA, 16 bp, H. sapiens
atgttttcaataaata

SEQ ID NO: 53452 - DNA, 16 bp, H. sapiens
atgttttcacttaaaa

SEQ ID NO: 53453 - DNA, 16 bp, H. sapiens
atgttttcagagggcc

SEQ ID NO: 53454 - DNA, 16 bp, H. sapiens
atgttttcatgatttt

SEQ ID NO: 53455 - DNA, 16 bp, H. sapiens
atgttttcatgtgttt

SEQ ID NO: 53456 - DNA, 16 bp, H. sapiens
atgttttcatgttgtt

SEQ ID NO: 53457 - DNA, 16 bp, H. sapiens
atgttttcatgtttat

SEQ ID NO: 53458 - DNA, 16 bp, H. sapiens
atgttttcatttatct

SEQ ID NO: 53459 - DNA, 16 bp, H. sapiens
atgttttccaaagcag

SEQ ID NO: 53460 - DNA, 16 bp, H. sapiens
atgttttccaggttgc

SEQ ID NO: 53461 - DNA, 16 bp, H. sapiens
atgttttcctctaaga

SEQ ID NO: 53462 - DNA, 16 bp, H. sapiens
atgttttcctctgttt

SEQ ID NO: 53463 - DNA, 16 bp, H. sapiens
atgttttcctctttca

SEQ ID NO: 53464 - DNA, 16 bp, H. sapiens
atgttttcctggatgg

SEQ ID NO: 53465 - DNA, 16 bp, H. sapiens
atgttttccttgttcc

SEQ ID NO: 53466 - DNA, 16 bp, H. sapiens
atgttttcctttgaga

SEQ ID NO: 53467 - DNA, 16 bp, H. sapiens
atgttttctaaaatga

SEQ ID NO: 53468 - DNA, 16 bp, H. sapiens
atgttttctacatttt

SEQ ID NO: 53469 - DNA, 16 bp, H. sapiens
atgttttctcatgatt

SEQ ID NO: 53470 - DNA, 16 bp, H. sapiens
atgttttctcccattc

SEQ ID NO: 53471 - DNA, 16 bp, H. sapiens
atgttttctgaatgaa

SEQ ID NO: 53472 - DNA, 16 bp, H. sapiens
atgttttctgtatata

SEQ ID NO: 53473 - DNA, 16 bp, H. sapiens
atgttttcttaaaatt

SEQ ID NO: 53474 - DNA, 16 bp, H. sapiens
atgttttcttccttct

SEQ ID NO: 53475 - DNA, 16 bp, H. sapiens
atgttttcttctagta

SEQ ID NO: 53476 - DNA, 16 bp, H. sapiens
atgttttctttaaaaa

SEQ ID NO: 53477 - DNA, 16 bp, H. sapiens
atgttttcttttgaga

SEQ ID NO: 53478 - DNA, 16 bp, H. sapiens
atgttttgaaaataat

SEQ ID NO: 53479 - DNA, 16 bp, H. sapiens
atgttttgaaatacat

SEQ ID NO: 53480 - DNA, 16 bp, H. sapiens
atgttttgaaatgtga

SEQ ID NO: 53481 - DNA, 16 bp, H. sapiens
atgttttgaaattata

SEQ ID NO: 53482 - DNA, 16 bp, H. sapiens
atgttttgagacagag

SEQ ID NO: 53483 - DNA, 16 bp, H. sapiens
atgttttgatatacat

SEQ ID NO: 53484 - DNA, 16 bp, H. sapiens
atgttttgatatgtat

SEQ ID NO: 53485 - DNA, 16 bp, H. sapiens
atgttttggtcaacaa

SEQ ID NO: 53486 - DNA, 16 bp, H. sapiens
atgttttggtcaatga

SEQ ID NO: 53487 - DNA, 16 bp, H. sapiens
atgttttggtttccca

SEQ ID NO: 53488 - DNA, 16 bp, H. sapiens
atgttttgtgtatata

SEQ ID NO: 53489 - DNA, 16 bp, H. sapiens
atgttttgttgcttag

SEQ ID NO: 53490 - DNA, 16 bp, H. sapiens
atgtttttaaaactta

SEQ ID NO: 53491 - DNA, 16 bp, H. sapiens
atgtttttaaaagcat

SEQ ID NO: 53492 - DNA, 16 bp, H. sapiens
atgtttttaaaagtta

SEQ ID NO: 53493 - DNA, 16 bp, H. sapiens
atgtttttaaaatgta

SEQ ID NO: 53494 - DNA, 16 bp, H. sapiens
atgtttttaaagaaaa

SEQ ID NO: 53495 - DNA, 16 bp, H. sapiens
atgtttttaaggttca

SEQ ID NO: 53496 - DNA, 16 bp, H. sapiens
atgtttttaatggcat

SEQ ID NO: 53497 - DNA, 16 bp, H. sapiens
atgtttttacagtggc

SEQ ID NO: 53498 - DNA, 16 bp, H. sapiens
atgtttttagtagaga

SEQ ID NO: 53499 - DNA, 16 bp, H. sapiens
atgtttttatatgctt

SEQ ID NO: 53500 - DNA, 16 bp, H. sapiens
atgtttttcaaatttc

SEQ ID NO: 53501 - DNA, 16 bp, H. sapiens
atgtttttctgtgtgt

SEQ ID NO: 53502 - DNA, 16 bp, H. sapiens
atgtttttgaaaaaaa

SEQ ID NO: 53503 - DNA, 16 bp, H. sapiens
atgtttttgaaaagaa

SEQ ID NO: 53504 - DNA, 16 bp, H. sapiens
atgtttttgaatgaat

SEQ ID NO: 53505 - DNA, 16 bp, H. sapiens
atgtttttgagattta

SEQ ID NO: 53506 - DNA, 16 bp, H. sapiens
atgtttttgcatattt

SEQ ID NO: 53507 - DNA, 16 bp, H. sapiens
atgtttttgtaaatga

SEQ ID NO: 53508 - DNA, 16 bp, H. sapiens
atgtttttgtacagct

SEQ ID NO: 53509 - DNA, 16 bp, H. sapiens
atgtttttgtacccat

SEQ ID NO: 53510 - DNA, 16 bp, H. sapiens
atgtttttgtgttact

SEQ ID NO: 53511 - DNA, 16 bp, H. sapiens
atgttttttaaaacat

SEQ ID NO: 53512 - DNA, 16 bp, H. sapiens
attaaaaaatgctcaa

SEQ ID NO: 53513 - DNA, 16 bp, H. sapiens
attaaaaacaatgaag

SEQ ID NO: 53514 - DNA, 16 bp, H. sapiens
attaaaaacagaagga

SEQ ID NO: 53515 - DNA, 16 bp, H. sapiens
attaaaaacagtgaaa

SEQ ID NO: 53516 - DNA, 16 bp, H. sapiens
attaaaaaccactgaa

SEQ ID NO: 53517 - DNA, 16 bp, H. sapiens
attaaaaactgcaaaa

SEQ ID NO: 53518 - DNA, 16 bp, H. sapiens
attaaaaacttttgct

SEQ ID NO: 53519 - DNA, 16 bp, H. sapiens
attaaaaagaaatctg

SEQ ID NO: 53520 - DNA, 16 bp, H. sapiens
attaaaaagattgaca

SEQ ID NO: 53521 - DNA, 16 bp, H. sapiens
attaaaaagcaagcaa

SEQ ID NO: 53522 - DNA, 16 bp, H. sapiens
attaaaaagctttttt

SEQ ID NO: 53523 - DNA, 16 bp, H. sapiens
attaaaaaggaaattg

SEQ ID NO: 53524 - DNA, 16 bp, H. sapiens
attaaaaagtcagaaa

SEQ ID NO: 53525 - DNA, 16 bp, H. sapiens
attaaaaagtccagaa

SEQ ID NO: 53526 - DNA, 16 bp, H. sapiens
attaaaaataaagctt

SEQ ID NO: 53527 - DNA, 16 bp, H. sapiens
attaaaaatagtacta

SEQ ID NO: 53528 - DNA, 16 bp, H. sapiens
attaaaaatgagattt

SEQ ID NO: 53529 - DNA, 16 bp, H. sapiens
attaaaaatgcacaca

SEQ ID NO: 53530 - DNA, 16 bp, H. sapiens
attaaaaatgcatata

SEQ ID NO: 53531 - DNA, 16 bp, H. sapiens
attaaaaatggcaaaa

SEQ ID NO: 53532 - DNA, 16 bp, H. sapiens
attaaaaatgttcttt

SEQ ID NO: 53533 - DNA, 16 bp, H. sapiens
attaaaaatgttttga

SEQ ID NO: 53534 - DNA, 16 bp, H. sapiens
attaaaaattagcaaa

SEQ ID NO: 53535 - DNA, 16 bp, H. sapiens
attaaaaattagccag

SEQ ID NO: 53536 - DNA, 16 bp, H. sapiens
attaaaaattaggcaa

SEQ ID NO: 53537 - DNA, 16 bp, H. sapiens
attaaaaattccattt

SEQ ID NO: 53538 - DNA, 16 bp, H. sapiens
attaaaaattgtgttt

SEQ ID NO: 53539 - DNA, 16 bp, H. sapiens
attaaaacaaaaatgt

SEQ ID NO: 53540 - DNA, 16 bp, H. sapiens
attaaaacaatttctt

SEQ ID NO: 53541 - DNA, 16 bp, H. sapiens
attaaaacagaaattt

SEQ ID NO: 53542 - DNA, 16 bp, H. sapiens
attaaaacagataatg

SEQ ID NO: 53543 - DNA, 16 bp, H. sapiens
attaaaacatttcttt

SEQ ID NO: 53544 - DNA, 16 bp, H. sapiens
attaaaacattttaag

SEQ ID NO: 53545 - DNA, 16 bp, H. sapiens
attaaaaccacaatga

SEQ ID NO: 53546 - DNA, 16 bp, H. sapiens
attaaaactaagtaaa

SEQ ID NO: 53547 - DNA, 16 bp, H. sapiens
attaaaactgaaaatg

SEQ ID NO: 53548 - DNA, 16 bp, H. sapiens
attaaaactgattttt

SEQ ID NO: 53549 - DNA, 16 bp, H. sapiens
attaaaagaaagctct

SEQ ID NO: 53550 - DNA, 16 bp, H. sapiens
attaaaagaaattcaa

SEQ ID NO: 53551 - DNA, 16 bp, H. sapiens
attaaaagaatcaata

SEQ ID NO: 53552 - DNA, 16 bp, H. sapiens
attaaaagactgaaaa

SEQ ID NO: 53553 - DNA, 16 bp, H. sapiens
attaaaagatgctcaa

SEQ ID NO: 53554 - DNA, 16 bp, H. sapiens
attaaaagatttcaaa

SEQ ID NO: 53555 - DNA, 16 bp, H. sapiens
attaaaagccttaaaa

SEQ ID NO: 53556 - DNA, 16 bp, H. sapiens
attaaaagctgaaaga

SEQ ID NO: 53557 - DNA, 16 bp, H. sapiens
attaaaagcttttatt

SEQ ID NO: 53558 - DNA, 16 bp, H. sapiens
attaaaaggcaaagat

SEQ ID NO: 53559 - DNA, 16 bp, H. sapiens
attaaaagtaaatgga

SEQ ID NO: 53560 - DNA, 16 bp, H. sapiens
attaaaataaaatgct

SEQ ID NO: 53561 - DNA, 16 bp, H. sapiens
attaaaatacaaagtt

SEQ ID NO: 53562 - DNA, 16 bp, H. sapiens
attaaaatacacacat

SEQ ID NO: 53563 - DNA, 16 bp, H. sapiens
attaaaatactgtttt

SEQ ID NO: 53564 - DNA, 16 bp, H. sapiens
attaaaatatgcattt

SEQ ID NO: 53565 - DNA, 16 bp, H. sapiens
attaaaatattagcca

SEQ ID NO: 53566 - DNA, 16 bp, H. sapiens
attaaaatcagcaaaa

SEQ ID NO: 53567 - DNA, 16 bp, H. sapiens
attaaaatgaaaatac

SEQ ID NO: 53568 - DNA, 16 bp, H. sapiens
attaaaatgacaatat

SEQ ID NO: 53569 - DNA, 16 bp, H. sapiens
attaaaatgacaattt

SEQ ID NO: 53570 - DNA, 16 bp, H. sapiens
attaaaatgacagtaa

SEQ ID NO: 53571 - DNA, 16 bp, H. sapiens
attaaaatgatcaaaa

SEQ ID NO: 53572 - DNA, 16 bp, H. sapiens
attaaaatgatcatat

SEQ ID NO: 53573 - DNA, 16 bp, H. sapiens
attaaaatgcatattt

SEQ ID NO: 53574 - DNA, 16 bp, H. sapiens
attaaaatggctttta

SEQ ID NO: 53575 - DNA, 16 bp, H. sapiens
attaaaatgtaagatg

SEQ ID NO: 53576 - DNA, 16 bp, H. sapiens
attaaaatgtacaaaa

SEQ ID NO: 53577 - DNA, 16 bp, H. sapiens
attaaaatgtgtattt

SEQ ID NO: 53578 - DNA, 16 bp, H. sapiens
attaaaatgttacttt

SEQ ID NO: 53579 - DNA, 16 bp, H. sapiens
attaaaatgttcaaaa

SEQ ID NO: 53580 - DNA, 16 bp, H. sapiens
attaaaatgttctgaa

SEQ ID NO: 53581 - DNA, 16 bp, H. sapiens
attaaaatgtttacaa

SEQ ID NO: 53582 - DNA, 16 bp, H. sapiens
attaaaatgtttatct

SEQ ID NO: 53583 - DNA, 16 bp, H. sapiens
attaaaatgttttctt

SEQ ID NO: 53584 - DNA, 16 bp, H. sapiens
attaaaattacattga

SEQ ID NO: 53585 - DNA, 16 bp, H. sapiens
attaaaattagcttta

SEQ ID NO: 53586 - DNA, 16 bp, H. sapiens
attaaaattgcattaa

SEQ ID NO: 53587 - DNA, 16 bp, H. sapiens
attaaaattgtctttt

SEQ ID NO: 53588 - DNA, 16 bp, H. sapiens
attaaacaaatgaatg

SEQ ID NO: 53589 - DNA, 16 bp, H. sapiens
attaaacaactcccca

SEQ ID NO: 53590 - DNA, 16 bp, H. sapiens
attaaacactgtataa

SEQ ID NO: 53591 - DNA, 16 bp, H. sapiens
attaaacacttaaaca

SEQ ID NO: 53592 - DNA, 16 bp, H. sapiens
attaaacagcttctgc

SEQ ID NO: 53593 - DNA, 16 bp, H. sapiens
attaaacaggaagaaa

SEQ ID NO: 53594 - DNA, 16 bp, H. sapiens
attaaacatgttttta

SEQ ID NO: 53595 - DNA, 16 bp, H. sapiens
attaaacatttctatt

SEQ ID NO: 53596 - DNA, 16 bp, H. sapiens
attaaacatttttaag

SEQ ID NO: 53597 - DNA, 16 bp, H. sapiens
attaaacatttttgaa

SEQ ID NO: 53598 - DNA, 16 bp, H. sapiens
attaaaccatccttgc

SEQ ID NO: 53599 - DNA, 16 bp, H. sapiens
attaaacctctttccc

SEQ ID NO: 53600 - DNA, 16 bp, H. sapiens
attaaacctctttttc

SEQ ID NO: 53601 - DNA, 34 bp, H. sapiens
attaaactaaagagcttctgcacagcaaaagaaa

SEQ ID NO: 53602 - DNA, 16 bp, H. sapiens
attaaactctttctct

SEQ ID NO: 53603 - DNA, 16 bp, H. sapiens
attaaactgatttaat

SEQ ID NO: 53604 - DNA, 16 bp, H. sapiens
attaaactggaagtta

SEQ ID NO: 53605 - DNA, 16 bp, H. sapiens
attaaacttccactct

SEQ ID NO: 53606 - DNA, 16 bp, H. sapiens
attaaacttcttttct

SEQ ID NO: 53607 - DNA, 16 bp, H. sapiens
attaaacttgttttct

SEQ ID NO: 53608 - DNA, 16 bp, H. sapiens
attaaactttatcatg

SEQ ID NO: 53609 - DNA, 16 bp, H. sapiens
attaaactttattgta

SEQ ID NO: 53610 - DNA, 16 bp, H. sapiens
attaaagaaaggcaaa

SEQ ID NO: 53611 - DNA, 16 bp, H. sapiens
attaaagaaatacatt

SEQ ID NO: 53612 - DNA, 16 bp, H. sapiens
attaaagaaatgcaaa

SEQ ID NO: 53613 - DNA, 16 bp, H. sapiens
attaaagacaaatcat

SEQ ID NO: 53614 - DNA, 17 bp, H. sapiens
attaaagacttaaatga

SEQ ID NO: 53615 - DNA, 16 bp, H. sapiens
attaaagacttaatgt

SEQ ID NO: 53616 - DNA, 16 bp, H. sapiens
attaaagagtgctatg

SEQ ID NO: 53617 - DNA, 16 bp, H. sapiens
attaaagagtttctgc

SEQ ID NO: 53618 - DNA, 16 bp, H. sapiens
attaaagatctaaata

SEQ ID NO: 53619 - DNA, 16 bp, H. sapiens
attaaagatttcaatg

SEQ ID NO: 53620 - DNA, 16 bp, H. sapiens
attaaagatttttctt

SEQ ID NO: 53621 - DNA, 16 bp, H. sapiens
attaaagcagaaatta

SEQ ID NO: 53622 - DNA, 16 bp, H. sapiens
attaaaggaactagag

SEQ ID NO: 53623 - DNA, 16 bp, H. sapiens
attaaaggtttaaaac

SEQ ID NO: 53624 - DNA, 16 bp, H. sapiens
attaaagttaatttca

SEQ ID NO: 53625 - DNA, 16 bp, H. sapiens
attaaagtttgagaag

SEQ ID NO: 53626 - DNA, 16 bp, H. sapiens
attaaataaagctaat

SEQ ID NO: 53627 - DNA, 16 bp, H. sapiens
attaaataatgcattt

SEQ ID NO: 53628 - DNA, 16 bp, H. sapiens
attaaatacacacaca

SEQ ID NO: 53629 - DNA, 16 bp, H. sapiens
attaaatatttcagaa

SEQ ID NO: 53630 - DNA, 16 bp, H. sapiens
attaaatatttgtgaa

SEQ ID NO: 53631 - DNA, 16 bp, H. sapiens
attaaatcagtttaat

SEQ ID NO: 53632 - DNA, 16 bp, H. sapiens
attaaatcctcacaac

SEQ ID NO: 53633 - DNA, 16 bp, H. sapiens
attaaatgaaaacaca

SEQ ID NO: 53634 - DNA, 16 bp, H. sapiens
attaaatgaatcaata

SEQ ID NO: 53635 - DNA, 16 bp, H. sapiens
attaaatgacatttta

SEQ ID NO: 53636 - DNA, 16 bp, H. sapiens
attaaatgacttttta

SEQ ID NO: 53637 - DNA, 16 bp, H. sapiens
attaaatgagaagatg

SEQ ID NO: 53638 - DNA, 16 bp, H. sapiens
attaaatgagataaca

SEQ ID NO: 53639 - DNA, 16 bp, H. sapiens
attaaatgaggtaatg

SEQ ID NO: 53640 - DNA, 16 bp, H. sapiens
attaaatgagttaata

SEQ ID NO: 53641 - DNA, 16 bp, H. sapiens
attaaatgagtttata

SEQ ID NO: 53642 - DNA, 16 bp, H. sapiens
attaaatgcattttaa

SEQ ID NO: 53643 - DNA, 16 bp, H. sapiens
attaaatgtgtatata

SEQ ID NO: 53644 - DNA, 16 bp, H. sapiens
attaaatgttaaagct

SEQ ID NO: 53645 - DNA, 16 bp, H. sapiens
attaaatgtttcattt

SEQ ID NO: 53646 - DNA, 16 bp, H. sapiens
attaaattaaagagct

SEQ ID NO: 53647 - DNA, 16 bp, H. sapiens
attaaattattacagt

SEQ ID NO: 53648 - DNA, 16 bp, H. sapiens
attaaatttcaatatg

SEQ ID NO: 53649 - DNA, 16 bp, H. sapiens
attaacaaaatgttta

SEQ ID NO: 53650 - DNA, 16 bp, H. sapiens
attaacaacagatttc

SEQ ID NO: 53651 - DNA, 16 bp, H. sapiens
attaacaatatgacag

SEQ ID NO: 53652 - DNA, 16 bp, H. sapiens
attaacacacattttg

SEQ ID NO: 53653 - DNA, 16 bp, H. sapiens
attaacagcagaaaca

SEQ ID NO: 53654 - DNA, 16 bp, H. sapiens
attaacagcatctcaa

SEQ ID NO: 53655 - DNA, 16 bp, H. sapiens
attaacagcatctcag

SEQ ID NO: 53656 - DNA, 16 bp, H. sapiens
attaacagtataaatt

SEQ ID NO: 53657 - DNA, 16 bp, H. sapiens
attaacatatacatta

SEQ ID NO: 53658 - DNA, 16 bp, H. sapiens
attaacatatttttgt

SEQ ID NO: 53659 - DNA, 16 bp, H. sapiens
attaacatttaaatca

SEQ ID NO: 53660 - DNA, 16 bp, H. sapiens
attaacattttccatt

SEQ ID NO: 53661 - DNA, 16 bp, H. sapiens
attaaccaaagtccat

SEQ ID NO: 53662 - DNA, 16 bp, H. sapiens
attaaccacttatcag

SEQ ID NO: 53663 - DNA, 16 bp, H. sapiens
attaaccaggcatggt

SEQ ID NO: 53664 - DNA, 16 bp, H. sapiens
attaacccaaaagtcc

SEQ ID NO: 53665 - DNA, 16 bp, H. sapiens
attaactaaaaatgga

SEQ ID NO: 53666 - DNA, 28 bp, H. sapiens
attaactaaaagtatcccttatgggaaa

SEQ ID NO: 53667 - DNA, 16 bp, H. sapiens
attaactagatacaga

SEQ ID NO: 53668 - DNA, 16 bp, H. sapiens
attaactcaaaagttc

SEQ ID NO: 53669 - DNA, 16 bp, H. sapiens
attaactcatttaatc

SEQ ID NO: 53670 - DNA, 16 bp, H. sapiens
attaactgaagatgga

SEQ ID NO: 53671 - DNA, 16 bp, H. sapiens
attaactgattttttt

SEQ ID NO: 53672 - DNA, 16 bp, H. sapiens
attaacttgttattta

SEQ ID NO: 53673 - DNA, 16 bp, H. sapiens
attaacttgtttttta

SEQ ID NO: 53674 - DNA, 16 bp, H. sapiens
attaactttttcaaaa

SEQ ID NO: 53675 - DNA, 16 bp, H. sapiens
attaagaaaattaatc

SEQ ID NO: 53676 - DNA, 16 bp, H. sapiens
attaagaaactggcaa

SEQ ID NO: 53677 - DNA, 16 bp, H. sapiens
attaagaaacttaaaa

SEQ ID NO: 53678 - DNA, 16 bp, H. sapiens
attaagaaacttgctc

SEQ ID NO: 53679 - DNA, 16 bp, H. sapiens
attaagaagtgggcaa

SEQ ID NO: 53680 - DNA, 16 bp, H. sapiens
attaagacattttatt

SEQ ID NO: 53681 - DNA, 16 bp, H. sapiens
attaagagtccagaaa

SEQ ID NO: 53682 - DNA, 16 bp, H. sapiens
attaagatacagaata

SEQ ID NO: 53683 - DNA, 16 bp, H. sapiens
attaagcaaaaggaaa

SEQ ID NO: 53684 - DNA, 16 bp, H. sapiens
attaagcaaatgaaaa

SEQ ID NO: 53685 - DNA, 16 bp, H. sapiens
attaagcatttattat

SEQ ID NO: 53686 - DNA, 16 bp, H. sapiens
attaagctaccattga

SEQ ID NO: 53687 - DNA, 16 bp, H. sapiens
attaaggaatcagaga

SEQ ID NO: 53688 - DNA, 16 bp, H. sapiens
attaaggacttaaata

SEQ ID NO: 53689 - DNA, 16 bp, H. sapiens
attaaggaggaaaaat

SEQ ID NO: 53690 - DNA, 16 bp, H. sapiens
attaaggattttgaaa

SEQ ID NO: 53691 - DNA, 22 bp, H. sapiens
attaagggcagccagagagaaa

SEQ ID NO: 53692 - DNA, 16 bp, H. sapiens
attaagtaaatggatg

SEQ ID NO: 53693 - DNA, 16 bp, H. sapiens
attaagtagaagtgga

SEQ ID NO: 53694 - DNA, 16 bp, H. sapiens
attaagtgaaaaaagt

SEQ ID NO: 53695 - DNA, 16 bp, H. sapiens
attaagttaaagatct

SEQ ID NO: 53696 - DNA, 16 bp, H. sapiens
attaagttaatcttca

SEQ ID NO: 53697 - DNA, 16 bp, H. sapiens
attaagtttatcttca

SEQ ID NO: 53698 - DNA, 16 bp, H. sapiens
attaataaaatgggaa

SEQ ID NO: 53699 - DNA, 16 bp, H. sapiens
attaataaatgcatat

SEQ ID NO: 53700 - DNA, 16 bp, H. sapiens
attaataacatgaaaa

SEQ ID NO: 53701 - DNA, 16 bp, H. sapiens
attaataatttcaaga

SEQ ID NO: 53702 - DNA, 16 bp, H. sapiens
attaatagatctgaag

SEQ ID NO: 53703 - DNA, 16 bp, H. sapiens
attaatagatgcagaa

SEQ ID NO: 53704 - DNA, 16 bp, H. sapiens
attaatatccaaatat

SEQ ID NO: 53705 - DNA, 16 bp, H. sapiens
attaatattcagaata

SEQ ID NO: 53706 - DNA, 16 bp, H. sapiens
attaatatttgctgaa

SEQ ID NO: 53707 - DNA, 16 bp, H. sapiens
attaatcaatgagtgg

SEQ ID NO: 53708 - DNA, 16 bp, H. sapiens
attaatcaattcatga

SEQ ID NO: 53709 - DNA, 16 bp, H. sapiens
attaatcatcaaggaa

SEQ ID NO: 53710 - DNA, 16 bp, H. sapiens
attaatcatcagagaa

SEQ ID NO: 53711 - DNA, 16 bp, H. sapiens
attaatcattaaggaa

SEQ ID NO: 53712 - DNA, 16 bp, H. sapiens
attaatccacacatca

SEQ ID NO: 53713 - DNA, 16 bp, H. sapiens
attaatccattcatga

SEQ ID NO: 53714 - DNA, 16 bp, H. sapiens
attaatgaagaaaaca

SEQ ID NO: 53715 - DNA, 16 bp, H. sapiens
attaatgagatatttt

SEQ ID NO: 53716 - DNA, 16 bp, H. sapiens
attaatgatgttgaat

SEQ ID NO: 53717 - DNA, 16 bp, H. sapiens
attaatgcaaaaatcc

SEQ ID NO: 53718 - DNA, 16 bp, H. sapiens
attaatgcaaattaaa

SEQ ID NO: 53719 - DNA, 16 bp, H. sapiens
attaatgcagtaacag

SEQ ID NO: 53720 - DNA, 16 bp, H. sapiens
attaatggacacttag

SEQ ID NO: 53721 - DNA, 16 bp, H. sapiens
attaatgggaaaaata

SEQ ID NO: 53722 - DNA, 16 bp, H. sapiens
attaatgtattcatta

SEQ ID NO: 53723 - DNA, 16 bp, H. sapiens
attaatgtattcattt

SEQ ID NO: 53724 - DNA, 16 bp, H. sapiens
attaatgtttgttaaa

SEQ ID NO: 53725 - DNA, 16 bp, H. sapiens
attaattagcttgatt

SEQ ID NO: 53726 - DNA, 16 bp, H. sapiens
attaattcaagaaata

SEQ ID NO: 53727 - DNA, 16 bp, H. sapiens
attaattcactcagga

SEQ ID NO: 53728 - DNA, 16 bp, H. sapiens
attaattcatcaaata

SEQ ID NO: 53729 - DNA, 16 bp, H. sapiens
attaattcctttaaaa

SEQ ID NO: 53730 - DNA, 16 bp, H. sapiens
attaattctttaaatg

SEQ ID NO: 53731 - DNA, 16 bp, H. sapiens
attaattggaattctt

SEQ ID NO: 53732 - DNA, 16 bp, H. sapiens
attaatttatttgaga

SEQ ID NO: 53733 - DNA, 16 bp, H. sapiens
attaatttcacctatt

SEQ ID NO: 53734 - DNA, 16 bp, H. sapiens
attaatttctcaaaat

SEQ ID NO: 53735 - DNA, 16 bp, H. sapiens
attaatttgaaagcct

SEQ ID NO: 53736 - DNA, 16 bp, H. sapiens
attaatttgctagaat

SEQ ID NO: 53737 - DNA, 16 bp, H. sapiens
attaattttgaaaatg

SEQ ID NO: 53738 - DNA, 16 bp, H. sapiens
attaattttggaagaa

SEQ ID NO: 53739 - DNA, 16 bp, H. sapiens
attacaaaacagaaat

SEQ ID NO: 53740 - DNA, 16 bp, H. sapiens
attacaaaatacattt

SEQ ID NO: 53741 - DNA, 16 bp, H. sapiens
attacaaaggaggaaa

SEQ ID NO: 53742 - DNA, 16 bp, H. sapiens
attacaaaggggaaaa

SEQ ID NO: 53743 - DNA, 16 bp, H. sapiens
attacaaagtgaaaga

SEQ ID NO: 53744 - DNA, 16 bp, H. sapiens
attacaaataaagcca

SEQ ID NO: 53745 - DNA, 16 bp, H. sapiens
attacaaataatactg

SEQ ID NO: 53746 - DNA, 16 bp, H. sapiens
attacaaatgaagctg

SEQ ID NO: 53747 - DNA, 16 bp, H. sapiens
attacaaatgtatttt

SEQ ID NO: 53748 - DNA, 16 bp, H. sapiens
attacaacaaatttag

SEQ ID NO: 53749 - DNA, 16 bp, H. sapiens
attacaagaaaggaaa

SEQ ID NO: 53750 - DNA, 17 bp, H. sapiens
attacaagcgtgaacca

SEQ ID NO: 53751 - DNA, 20 bp, H. sapiens
attacaagcgtgagccacca

SEQ ID NO: 53752 - DNA, 16 bp, H. sapiens
attacaaggtcaggag

SEQ ID NO: 53753 - DNA, 19 bp, H. sapiens
attacaagtgtgagccact

SEQ ID NO: 53754 - DNA, 16 bp, H. sapiens
attacaatggctaaaa

SEQ ID NO: 53755 - DNA, 16 bp, H. sapiens
attacaatgtgtggag

SEQ ID NO: 53756 - DNA, 16 bp, H. sapiens
attacacatatatttt

SEQ ID NO: 53757 - DNA, 16 bp, H. sapiens
attacacatgtataca

SEQ ID NO: 53758 - DNA, 16 bp, H. sapiens
attacacattttaaaa

SEQ ID NO: 53759 - DNA, 16 bp, H. sapiens
attacagaaatggaga

SEQ ID NO: 53760 - DNA, 16 bp, H. sapiens
attacagaagaaaata

SEQ ID NO: 53761 - DNA, 16 bp, H. sapiens
attacagaatattgtt

SEQ ID NO: 53762 - DNA, 16 bp, H. sapiens
attacagaatattttt

SEQ ID NO: 53763 - DNA, 20 bp, H. sapiens
attacagacatgagccaccg

SEQ ID NO: 53764 - DNA, 20 bp, H. sapiens
attacagacgtgagccaccg

SEQ ID NO: 53765 - DNA, 17 bp, H. sapiens
attacagatgtgagcca

SEQ ID NO: 53766 - DNA, 19 bp, H. sapiens
attacagatgtgagccact

SEQ ID NO: 53767 - DNA, 16 bp, H. sapiens
attacagattattttt

SEQ ID NO: 53768 - DNA, 16 bp, H. sapiens
attacagattcaattt

SEQ ID NO: 53769 - DNA, 16 bp, H. sapiens
attacaggcaagaacc

SEQ ID NO: 53770 - DNA, 16 bp, H. sapiens
attacaggcaagagcc

SEQ ID NO: 53771 - DNA, 16 bp, H. sapiens
attacaggcacccacc

SEQ ID NO: 53772 - DNA, 17 bp, H. sapiens
attacaggcagccacca

SEQ ID NO: 53773 - DNA, 20 bp, H. sapiens
attacaggcatgagccacca

SEQ ID NO: 53774 - DNA, 20 bp, H. sapiens
attacaggcatgagccaccc

SEQ ID NO: 53775 - DNA, 19 bp, H. sapiens
attacaggcatgagccact

SEQ ID NO: 53776 - DNA, 18 bp, H. sapiens
attacaggcatgagccat

SEQ ID NO: 53777 - DNA, 17 bp, H. sapiens
attacaggcatgagccg

SEQ ID NO: 53778 - DNA, 17 bp, H. sapiens
attacaggcatgagcct

SEQ ID NO: 53779 - DNA, 19 bp, H. sapiens
attacaggcatgagctacc

SEQ ID NO: 53780 - DNA, 17 bp, H. sapiens
attacaggcatgagctg

SEQ ID NO: 53781 - DNA, 17 bp, H. sapiens
attacaggcatgctcca

SEQ ID NO: 53782 - DNA, 17 bp, H. sapiens
attacaggcattagcca

SEQ ID NO: 53783 - DNA, 16 bp, H. sapiens
attacaggcctatgcc

SEQ ID NO: 53784 - DNA, 20 bp, H. sapiens
attacaggcctgagccaccg

SEQ ID NO: 53785 - DNA, 17 bp, H. sapiens
attacaggcgagagcca

SEQ ID NO: 53786 - DNA, 19 bp, H. sapiens
attacaggcgtgaaccact

SEQ ID NO: 53787 - DNA, 17 bp, H. sapiens
attacaggcgtgaccca

SEQ ID NO: 53788 - DNA, 20 bp, H. sapiens
attacaggcgtgagccacct

SEQ ID NO: 53789 - DNA, 18 bp, H. sapiens
attacaggcgtgagccat

SEQ ID NO: 53790 - DNA, 20 bp, H. sapiens
attacaggcgtgagccatcc

SEQ ID NO: 53791 - DNA, 20 bp, H. sapiens
attacaggcgtgagccattg

SEQ ID NO: 53792 - DNA, 18 bp, H. sapiens
attacaggcgtgagctat

SEQ ID NO: 53793 - DNA, 16 bp, H. sapiens
attacaggctcacacc

SEQ ID NO: 53794 - DNA, 17 bp, H. sapiens
attacaggggtgagcca

SEQ ID NO: 53795 - DNA, 16 bp, H. sapiens
attacagggtcctgag

SEQ ID NO: 53796 - DNA, 17 bp, H. sapiens
attacaggtgcctacca

SEQ ID NO: 53797 - DNA, 16 bp, H. sapiens
attacaggtgcctgct

SEQ ID NO: 53798 - DNA, 20 bp, H. sapiens
attacaggtgtaagccacca

SEQ ID NO: 53799 - DNA, 16 bp, H. sapiens
attacaggtgtgagca

SEQ ID NO: 53800 - DNA, 17 bp, H. sapiens
attacaggtgtgagcct

SEQ ID NO: 53801 - DNA, 16 bp, H. sapiens
attacagtatattatt

SEQ ID NO: 53802 - DNA, 16 bp, H. sapiens
attacagtatttttaa

SEQ ID NO: 53803 - DNA, 16 bp, H. sapiens
attacataaaaatgaa

SEQ ID NO: 53804 - DNA, 16 bp, H. sapiens
attacataatgacaaa

SEQ ID NO: 53805 - DNA, 16 bp, H. sapiens
attacatatatgtaat

SEQ ID NO: 53806 - DNA, 16 bp, H. sapiens
attacatgaaaatttt

SEQ ID NO: 53807 - DNA, 16 bp, H. sapiens
attacatgcacctgcc

SEQ ID NO: 53808 - DNA, 16 bp, H. sapiens
attacatgtaaattaa

SEQ ID NO: 53809 - DNA, 16 bp, H. sapiens
attacatttacaaaga

SEQ ID NO: 53810 - DNA, 16 bp, H. sapiens
attacatttacaatag

SEQ ID NO: 53811 - DNA, 16 bp, H. sapiens
attacatttctttaaa

SEQ ID NO: 53812 - DNA, 16 bp, H. sapiens
attacattttattttg

SEQ ID NO: 53813 - DNA, 16 bp, H. sapiens
attacattttctgttt

SEQ ID NO: 53814 - DNA, 16 bp, H. sapiens
attaccaaaataattt

SEQ ID NO: 53815 - DNA, 16 bp, H. sapiens
attaccaaatccatta

SEQ ID NO: 53816 - DNA, 16 bp, H. sapiens
attaccacaaaattag

SEQ ID NO: 53817 - DNA, 16 bp, H. sapiens
attaccacctgagctc

SEQ ID NO: 53818 - DNA, 16 bp, H. sapiens
attaccagaggctgag

SEQ ID NO: 53819 - DNA, 16 bp, H. sapiens
attaccagtttattat

SEQ ID NO: 53820 - DNA, 16 bp, H. sapiens
attaccatatgatcta

SEQ ID NO: 53821 - DNA, 16 bp, H. sapiens
attaccatatggccca

SEQ ID NO: 53822 - DNA, 16 bp, H. sapiens
attaccatttgttgaa

SEQ ID NO: 53823 - DNA, 16 bp, H. sapiens
attacccagatttgat

SEQ ID NO: 53824 - DNA, 16 bp, H. sapiens
attacccaggctcagg

SEQ ID NO: 53825 - DNA, 16 bp, H. sapiens
attaccctgatctgat

SEQ ID NO: 53826 - DNA, 16 bp, H. sapiens
attaccctgatttggt

SEQ ID NO: 53827 - DNA, 16 bp, H. sapiens
attacctcacatactt

SEQ ID NO: 53828 - DNA, 16 bp, H. sapiens
attacctctgtaaaga

SEQ ID NO: 53829 - DNA, 16 bp, H. sapiens
attacctcttaaaggc

SEQ ID NO: 53830 - DNA, 16 bp, H. sapiens
attacctgacttcaaa

SEQ ID NO: 53831 - DNA, 20 bp, H. sapiens
attacctgaggtcaggagtt

SEQ ID NO: 53832 - DNA, 18 bp, H. sapiens
attacctgctccaccctg

SEQ ID NO: 53833 - DNA, 16 bp, H. sapiens
attaccttgtgaagca

SEQ ID NO: 53834 - DNA, 16 bp, H. sapiens
attacctttctaaaat

SEQ ID NO: 53835 - DNA, 16 bp, H. sapiens
attacctttttgatgt

SEQ ID NO: 53836 - DNA, 16 bp, H. sapiens
attacgaggtcaggag

SEQ ID NO: 53837 - DNA, 16 bp, H. sapiens
attactagattttttt

SEQ ID NO: 53838 - DNA, 16 bp, H. sapiens
attactattatttgta

SEQ ID NO: 53839 - DNA, 16 bp, H. sapiens
attactattattttag

SEQ ID NO: 53840 - DNA, 16 bp, H. sapiens
attactcagtctaagg

SEQ ID NO: 53841 - DNA, 16 bp, H. sapiens
attactccagcctggg

SEQ ID NO: 53842 - DNA, 16 bp, H. sapiens
attactcccaatatag

SEQ ID NO: 53843 - DNA, 16 bp, H. sapiens
attactgaactgtaca

SEQ ID NO: 53844 - DNA, 16 bp, H. sapiens
attactgaagaaagaa

SEQ ID NO: 53845 - DNA, 16 bp, H. sapiens
attactgaatatttta

SEQ ID NO: 53846 - DNA, 16 bp, H. sapiens
attactgagagaaatt

SEQ ID NO: 53847 - DNA, 16 bp, H. sapiens
attactgattcaattt

SEQ ID NO: 53848 - DNA, 16 bp, H. sapiens
attactgatttaattt

SEQ ID NO: 53849 - DNA, 16 bp, H. sapiens
attactgccttctttt

SEQ ID NO: 53850 - DNA, 16 bp, H. sapiens
attactggcacctgcc

SEQ ID NO: 53851 - DNA, 17 bp, H. sapiens
attactggcatgagcca

SEQ ID NO: 53852 - DNA, 17 bp, H. sapiens
attactggtgtgagcca

SEQ ID NO: 53853 - DNA, 16 bp, H. sapiens
attactggttatatac

SEQ ID NO: 53854 - DNA, 16 bp, H. sapiens
attactgtagctttct

SEQ ID NO: 53855 - DNA, 16 bp, H. sapiens
attactgtatactact

SEQ ID NO: 53856 - DNA, 16 bp, H. sapiens
attactgtattttaaa

SEQ ID NO: 53857 - DNA, 16 bp, H. sapiens
attactgtgttgctgt

SEQ ID NO: 53858 - DNA, 16 bp, H. sapiens
attacttaaacccagg

SEQ ID NO: 53859 - DNA, 17 bp, H. sapiens
attacttaaacctggga

SEQ ID NO: 53860 - DNA, 16 bp, H. sapiens
attacttcagccattg

SEQ ID NO: 53861 - DNA, 16 bp, H. sapiens
attacttctgaaaact

SEQ ID NO: 53862 - DNA, 16 bp, H. sapiens
attacttgagcttggg

SEQ ID NO: 53863 - DNA, 16 bp, H. sapiens
attacttgatttttaa

SEQ ID NO: 53864 - DNA, 16 bp, H. sapiens
attacttggaaaatat

SEQ ID NO: 53865 - DNA, 16 bp, H. sapiens
attacttgttattggt

SEQ ID NO: 53866 - DNA, 16 bp, H. sapiens
attacttttctggttc

SEQ ID NO: 53867 - DNA, 16 bp, H. sapiens
attacttttgcaccaa

SEQ ID NO: 53868 - DNA, 16 bp, H. sapiens
attactttttaaatgt

SEQ ID NO: 53869 - DNA, 16 bp, H. sapiens
attagaaaaaactatc

SEQ ID NO: 53870 - DNA, 16 bp, H. sapiens
attagaaaacaaaact

SEQ ID NO: 53871 - DNA, 16 bp, H. sapiens
attagaaaacaaagca

SEQ ID NO: 53872 - DNA, 16 bp, H. sapiens
attagaaaactgaagc

SEQ ID NO: 53873 - DNA, 16 bp, H. sapiens
attagaaaatgtattt

SEQ ID NO: 53874 - DNA, 16 bp, H. sapiens
attagaaaatgttttg

SEQ ID NO: 53875 - DNA, 16 bp, H. sapiens
attagaaacaaatttt

SEQ ID NO: 53876 - DNA, 16 bp, H. sapiens
attagaaactgaattt

SEQ ID NO: 53877 - DNA, 16 bp, H. sapiens
attagaaagtatattt

SEQ ID NO: 53878 - DNA, 16 bp, H. sapiens
attagaaatcaggatt

SEQ ID NO: 53879 - DNA, 16 bp, H. sapiens
attagaaattaaaaca

SEQ ID NO: 53880 - DNA, 16 bp, H. sapiens
attagaaattaataac

SEQ ID NO: 53881 - DNA, 16 bp, H. sapiens
attagaagaaatatct

SEQ ID NO: 53882 - DNA, 16 bp, H. sapiens
attagaagaatcaata

SEQ ID NO: 53883 - DNA, 17 bp, H. sapiens
attagaagcagtatgga

SEQ ID NO: 53884 - DNA, 16 bp, H. sapiens
attagaatagctaaaa

SEQ ID NO: 53885 - DNA, 16 bp, H. sapiens
attagaatatcaccat

SEQ ID NO: 53886 - DNA, 16 bp, H. sapiens
attagaatcatctggg

SEQ ID NO: 53887 - DNA, 16 bp, H. sapiens
attagaattacctggg

SEQ ID NO: 53888 - DNA, 16 bp, H. sapiens
attagaattgcttgaa

SEQ ID NO: 53889 - DNA, 24 bp, H. sapiens
attagaatttggtctggaaatcaa

SEQ ID NO: 53890 - DNA, 16 bp, H. sapiens
attagacaaaatattt

SEQ ID NO: 53891 - DNA, 16 bp, H. sapiens
attagacaaaattatt

SEQ ID NO: 53892 - DNA, 16 bp, H. sapiens
attagacagatcaaag

SEQ ID NO: 53893 - DNA, 16 bp, H. sapiens
attagacccaaaaatg

SEQ ID NO: 53894 - DNA, 16 bp, H. sapiens
attagagaaatgcaaa

SEQ ID NO: 53895 - DNA, 16 bp, H. sapiens
attagagaaatggagg

SEQ ID NO: 53896 - DNA, 16 bp, H. sapiens
attagagaatgcaaat

SEQ ID NO: 53897 - DNA, 16 bp, H. sapiens
attagagaccattatt

SEQ ID NO: 53898 - DNA, 16 bp, H. sapiens
attagagatgctcaac

SEQ ID NO: 53899 - DNA, 16 bp, H. sapiens
attagagatgtgagcc

SEQ ID NO: 53900 - DNA, 16 bp, H. sapiens
attagagatttttaaa

SEQ ID NO: 53901 - DNA, 16 bp, H. sapiens
attagaggaatgagcc

SEQ ID NO: 53902 - DNA, 17 bp, H. sapiens
attagaggcgtgagcca

SEQ ID NO: 53903 - DNA, 16 bp, H. sapiens
attagagtcctgcctt

SEQ ID NO: 53904 - DNA, 16 bp, H. sapiens
attagatgagtgtggt

SEQ ID NO: 53905 - DNA, 16 bp, H. sapiens
attagatttgcatttt

SEQ ID NO: 53906 - DNA, 16 bp, H. sapiens
attagcaaattaaatc

SEQ ID NO: 53907 - DNA, 16 bp, H. sapiens
attagcaattttcaaa

SEQ ID NO: 53908 - DNA, 16 bp, H. sapiens
attagcagagtgagaa

SEQ ID NO: 53909 - DNA, 16 bp, H. sapiens
attagcatttgtttta

SEQ ID NO: 53910 - DNA, 16 bp, H. sapiens
attagcatttttattt

SEQ ID NO: 53911 - DNA, 16 bp, H. sapiens
attagcatttttcttt

SEQ ID NO: 53912 - DNA, 16 bp, H. sapiens
attagccaagaatttt

SEQ ID NO: 53913 - DNA, 16 bp, H. sapiens
attagccaagctggtc

SEQ ID NO: 53914 - DNA, 16 bp, H. sapiens
attagccagacatgat

SEQ ID NO: 53915 - DNA, 16 bp, H. sapiens
attagccagacatggt

SEQ ID NO: 53916 - DNA, 16 bp, H. sapiens
attagccagacgtggt

SEQ ID NO: 53917 - DNA, 16 bp, H. sapiens
attagccagcgtggtg

SEQ ID NO: 53918 - DNA, 16 bp, H. sapiens
attagccagctgtagt

SEQ ID NO: 53919 - DNA, 16 bp, H. sapiens
attagccaggagttgt

SEQ ID NO: 53920 - DNA, 17 bp, H. sapiens
attagccaggatggtct

SEQ ID NO: 53921 - DNA, 16 bp, H. sapiens
attagccaggcatcat

SEQ ID NO: 53922 - DNA, 16 bp, H. sapiens
attagccaggcatgag

SEQ ID NO: 53923 - DNA, 16 bp, H. sapiens
attagccaggcatgct

SEQ ID NO: 53924 - DNA, 16 bp, H. sapiens
attagccaggcctggt

SEQ ID NO: 53925 - DNA, 16 bp, H. sapiens
attagccaggcggggt

SEQ ID NO: 53926 - DNA, 17 bp, H. sapiens
attagccaggcgtagtg

SEQ ID NO: 53927 - DNA, 17 bp, H. sapiens
attagccaggcgtggtc

SEQ ID NO: 53928 - DNA, 16 bp, H. sapiens
attagccaggtggtgg

SEQ ID NO: 53929 - DNA, 16 bp, H. sapiens
attagccaggtgtgat

SEQ ID NO: 53930 - DNA, 16 bp, H. sapiens
attagccaggtgtgga

SEQ ID NO: 53931 - DNA, 17 bp, H. sapiens
attagcccggcatggtg

SEQ ID NO: 53932 - DNA, 17 bp, H. sapiens
attagcccggcgtggtg

SEQ ID NO: 53933 - DNA, 16 bp, H. sapiens
attagcccggtgtggt

SEQ ID NO: 53934 - DNA, 17 bp, H. sapiens
attagccgagcgtagtg

SEQ ID NO: 53935 - DNA, 16 bp, H. sapiens
attagccggacatggt

SEQ ID NO: 53936 - DNA, 16 bp, H. sapiens
attagccggacgtggt

SEQ ID NO: 53937 - DNA, 17 bp, H. sapiens
attagccgggagtggtg

SEQ ID NO: 53938 - DNA, 17 bp, H. sapiens
attagccgggcatggtg

SEQ ID NO: 53939 - DNA, 16 bp, H. sapiens
attagccgggcgtaat

SEQ ID NO: 53940 - DNA, 17 bp, H. sapiens
attagccgggcgtgatg

SEQ ID NO: 53941 - DNA, 16 bp, H. sapiens
attagccgggcgtgct

SEQ ID NO: 53942 - DNA, 16 bp, H. sapiens
attagccgggcgtggc

SEQ ID NO: 53943 - DNA, 18 bp, H. sapiens
attagccgggcgtggtga

SEQ ID NO: 53944 - DNA, 18 bp, H. sapiens
attagccgggcgtggtgc

SEQ ID NO: 53945 - DNA, 18 bp, H. sapiens
attagccgggcgtggtgt

SEQ ID NO: 53946 - DNA, 16 bp, H. sapiens
attagccgggggtggt

SEQ ID NO: 53947 - DNA, 16 bp, H. sapiens
attagccgggtgtcgt

SEQ ID NO: 53948 - DNA, 17 bp, H. sapiens
attagcctggcgtggtg

SEQ ID NO: 53949 - DNA, 16 bp, H. sapiens
attagcctgggtaaca

SEQ ID NO: 53950 - DNA, 16 bp, H. sapiens
attagcctggtttggt

SEQ ID NO: 53951 - DNA, 16 bp, H. sapiens
attagcgaggtgtggt

SEQ ID NO: 53952 - DNA, 16 bp, H. sapiens
attagctgagcatgtt

SEQ ID NO: 53953 - DNA, 16 bp, H. sapiens
attagctggacgtggt

SEQ ID NO: 53954 - DNA, 16 bp, H. sapiens
attagctggacgtgtt

SEQ ID NO: 53955 - DNA, 16 bp, H. sapiens
attagctggcatggtg

SEQ ID NO: 53956 - DNA, 16 bp, H. sapiens
attagctgggaccaca

SEQ ID NO: 53957 - DNA, 16 bp, H. sapiens
attagctgggagtagt

SEQ ID NO: 53958 - DNA, 16 bp, H. sapiens
attagctgggcatgat

SEQ ID NO: 53959 - DNA, 16 bp, H. sapiens
attagctgggcatggg

SEQ ID NO: 53960 - DNA, 17 bp, H. sapiens
attagctgggcatggtt

SEQ ID NO: 53961 - DNA, 16 bp, H. sapiens
attagctgggcctgtt

SEQ ID NO: 53962 - DNA, 16 bp, H. sapiens
attagctgggcgtagt

SEQ ID NO: 53963 - DNA, 17 bp, H. sapiens
attagctgggcgtcatg

SEQ ID NO: 53964 - DNA, 16 bp, H. sapiens
attagctgggcgtgat

SEQ ID NO: 53965 - DNA, 17 bp, H. sapiens
attagctgggcgtggta

SEQ ID NO: 53966 - DNA, 16 bp, H. sapiens
attagctgggcgtgtt

SEQ ID NO: 53967 - DNA, 16 bp, H. sapiens
attagctgggtgtggg

SEQ ID NO: 53968 - DNA, 16 bp, H. sapiens
attagctgtgtgacct

SEQ ID NO: 53969 - DNA, 16 bp, H. sapiens
attagctgtgtgtagt

SEQ ID NO: 53970 - DNA, 16 bp, H. sapiens
attagctgtgtgtgat

SEQ ID NO: 53971 - DNA, 16 bp, H. sapiens
attagcttggcatggt

SEQ ID NO: 53972 - DNA, 16 bp, H. sapiens
attaggaaaatggaaa

SEQ ID NO: 53973 - DNA, 16 bp, H. sapiens
attaggaatgctcaac

SEQ ID NO: 53974 - DNA, 16 bp, H. sapiens
attaggacaaatactt

SEQ ID NO: 53975 - DNA, 18 bp, H. sapiens
attaggacaaggaaattc

SEQ ID NO: 53976 - DNA, 16 bp, H. sapiens
attaggagatatacca

SEQ ID NO: 53977 - DNA, 16 bp, H. sapiens
attaggcaagagaaaa

SEQ ID NO: 53978 - DNA, 16 bp, H. sapiens
attaggcatttctcct

SEQ ID NO: 53979 - DNA, 17 bp, H. sapiens
attaggctgccttcagc

SEQ ID NO: 53980 - DNA, 16 bp, H. sapiens
attagggaggattccc

SEQ ID NO: 53981 - DNA, 17 bp, H. sapiens
attagggagtttcaaaa

SEQ ID NO: 53982 - DNA, 16 bp, H. sapiens
attaggtattataaat

SEQ ID NO: 53983 - DNA, 16 bp, H. sapiens
attaggtcatgaggga

SEQ ID NO: 53984 - DNA, 16 bp, H. sapiens
attaggtcatgagggt

SEQ ID NO: 53985 - DNA, 16 bp, H. sapiens
attaggttaatttata

SEQ ID NO: 53986 - DNA, 16 bp, H. sapiens
attaggtttcaacata

SEQ ID NO: 53987 - DNA, 16 bp, H. sapiens
attaggttttcaacat

SEQ ID NO: 53988 - DNA, 16 bp, H. sapiens
attagtaaaagaggaa

SEQ ID NO: 53989 - DNA, 16 bp, H. sapiens
attagtaatattgagc

SEQ ID NO: 53990 - DNA, 16 bp, H. sapiens
attagtaattagtaat

SEQ ID NO: 53991 - DNA, 16 bp, H. sapiens
attagtattattagta

SEQ ID NO: 53992 - DNA, 16 bp, H. sapiens
attagtattttcattt

SEQ ID NO: 53993 - DNA, 16 bp, H. sapiens
attagtcatttaaaaa

SEQ ID NO: 53994 - DNA, 16 bp, H. sapiens
attagtccatttccat

SEQ ID NO: 53995 - DNA, 16 bp, H. sapiens
attagtctcttctcac

SEQ ID NO: 53996 - DNA, 16 bp, H. sapiens
attagtgaaggagaaa

SEQ ID NO: 53997 - DNA, 16 bp, H. sapiens
attagtgatgatgagc

SEQ ID NO: 53998 - DNA, 16 bp, H. sapiens
attagtgcccttataa

SEQ ID NO: 53999 - DNA, 16 bp, H. sapiens
attagtgcccttatat

SEQ ID NO: 54000 - DNA, 16 bp, H. sapiens
attagtgcctttataa

SEQ ID NO: 54001 - DNA, 16 bp, H. sapiens
attagtggttgcctaa

SEQ ID NO: 54002 - DNA, 16 bp, H. sapiens
attagtgtccttatga

SEQ ID NO: 54003 - DNA, 16 bp, H. sapiens
attagttcagctactg

SEQ ID NO: 54004 - DNA, 16 bp, H. sapiens
attagttcccatttgt

SEQ ID NO: 54005 - DNA, 16 bp, H. sapiens
attagttcttcaaatg

SEQ ID NO: 54006 - DNA, 16 bp, H. sapiens
attagttgggcatggc

SEQ ID NO: 54007 - DNA, 17 bp, H. sapiens
attagttgggcgtggtg

SEQ ID NO: 54008 - DNA, 16 bp, H. sapiens
attagttggtgcagtt

SEQ ID NO: 54009 - DNA, 16 bp, H. sapiens
attagtttgctaagga

SEQ ID NO: 54010 - DNA, 16 bp, H. sapiens
attagttttctattgt

SEQ ID NO: 54011 - DNA, 16 bp, H. sapiens
attagttttctgttgc

SEQ ID NO: 54012 - DNA, 16 bp, H. sapiens
attagttttgaaatgt

SEQ ID NO: 54013 - DNA, 16 bp, H. sapiens
attataaaacacacat

SEQ ID NO: 54014 - DNA, 16 bp, H. sapiens
attataaaactgtaaa

SEQ ID NO: 54015 - DNA, 16 bp, H. sapiens
attataaaagtaatgc

SEQ ID NO: 54016 - DNA, 16 bp, H. sapiens
attataaaagtcattt

SEQ ID NO: 54017 - DNA, 16 bp, H. sapiens
attataaaattagcca

SEQ ID NO: 54018 - DNA, 16 bp, H. sapiens
attataaaattcacat

SEQ ID NO: 54019 - DNA, 16 bp, H. sapiens
attataaagaccatca

SEQ ID NO: 54020 - DNA, 16 bp, H. sapiens
attataaataacattg

SEQ ID NO: 54021 - DNA, 16 bp, H. sapiens
attataaccacaatga

SEQ ID NO: 54022 - DNA, 16 bp, H. sapiens
attataatcctcattt

SEQ ID NO: 54023 - DNA, 16 bp, H. sapiens
attataatgaaaacaa

SEQ ID NO: 54024 - DNA, 16 bp, H. sapiens
attataatgatgatga

SEQ ID NO: 54025 - DNA, 16 bp, H. sapiens
attataatttcaacat

SEQ ID NO: 54026 - DNA, 16 bp, H. sapiens
attatacaccatggcc

SEQ ID NO: 54027 - DNA, 16 bp, H. sapiens
attatacatttcaaaa

SEQ ID NO: 54028 - DNA, 16 bp, H. sapiens
attatacctcaagaaa

SEQ ID NO: 54029 - DNA, 16 bp, H. sapiens
attatacttaagttct

SEQ ID NO: 54030 - DNA, 16 bp, H. sapiens
attatagaaaatttag

SEQ ID NO: 54031 - DNA, 16 bp, H. sapiens
attatagccattctag

SEQ ID NO: 54032 - DNA, 16 bp, H. sapiens
attatagctcactgta

SEQ ID NO: 54033 - DNA, 17 bp, H. sapiens
attataggcacacgcca

SEQ ID NO: 54034 - DNA, 19 bp, H. sapiens
attataggcatgagccatg

SEQ ID NO: 54035 - DNA, 17 bp, H. sapiens
attataggcctgagcca

SEQ ID NO: 54036 - DNA, 17 bp, H. sapiens
attataggcgtgaacca

SEQ ID NO: 54037 - DNA, 17 bp, H. sapiens
attataggcgtgagccc

SEQ ID NO: 54038 - DNA, 21 bp, H. sapiens
attataggtgtgagccaccgt

SEQ ID NO: 54039 - DNA, 16 bp, H. sapiens
attatagttgtatata

SEQ ID NO: 54040 - DNA, 16 bp, H. sapiens
attatataatgataac

SEQ ID NO: 54041 - DNA, 16 bp, H. sapiens
attatataatggtaaa

SEQ ID NO: 54042 - DNA, 16 bp, H. sapiens
attatatactatgtat

SEQ ID NO: 54043 - DNA, 16 bp, H. sapiens
attatatagctatata

SEQ ID NO: 54044 - DNA, 16 bp, H. sapiens
attatatagtatgtat

SEQ ID NO: 54045 - DNA, 16 bp, H. sapiens
attatatatacactat

SEQ ID NO: 54046 - DNA, 16 bp, H. sapiens
attatatatatggata

SEQ ID NO: 54047 - DNA, 16 bp, H. sapiens
attatatatcatgtat

SEQ ID NO: 54048 - DNA, 16 bp, H. sapiens
attatatatgacatat

SEQ ID NO: 54049 - DNA, 16 bp, H. sapiens
attatatatgttatac

SEQ ID NO: 54050 - DNA, 16 bp, H. sapiens
attatatatttcaaga

SEQ ID NO: 54051 - DNA, 16 bp, H. sapiens
attatatcaaatgctt

SEQ ID NO: 54052 - DNA, 16 bp, H. sapiens
attatatccctcacct

SEQ ID NO: 54053 - DNA, 16 bp, H. sapiens
attatatcctcttgct

SEQ ID NO: 54054 - DNA, 16 bp, H. sapiens
attatatgaaaaatac

SEQ ID NO: 54055 - DNA, 16 bp, H. sapiens
attatatgcaaatact

SEQ ID NO: 54056 - DNA, 16 bp, H. sapiens
attatatgcatgtatt

SEQ ID NO: 54057 - DNA, 16 bp, H. sapiens
attatatgtacatatt

SEQ ID NO: 54058 - DNA, 16 bp, H. sapiens
attatattaacagaat

SEQ ID NO: 54059 - DNA, 16 bp, H. sapiens
attatattgattcttc

SEQ ID NO: 54060 - DNA, 16 bp, H. sapiens
attatattgctgtcta

SEQ ID NO: 54061 - DNA, 16 bp, H. sapiens
attatatttccttttg

SEQ ID NO: 54062 - DNA, 16 bp, H. sapiens
attatattttccaaag

SEQ ID NO: 54063 - DNA, 16 bp, H. sapiens
attatattttctgatt

SEQ ID NO: 54064 - DNA, 16 bp, H. sapiens
attatcaaaagaagat

SEQ ID NO: 54065 - DNA, 16 bp, H. sapiens
attatcaaaagtcaaa

SEQ ID NO: 54066 - DNA, 16 bp, H. sapiens
attatcaaaatgtttt

SEQ ID NO: 54067 - DNA, 16 bp, H. sapiens
attatcaaagaagaaa

SEQ ID NO: 54068 - DNA, 16 bp, H. sapiens
attatcacaaacttag

SEQ ID NO: 54069 - DNA, 16 bp, H. sapiens
attatcaccatcacca

SEQ ID NO: 54070 - DNA, 16 bp, H. sapiens
attatcacctgagctc

SEQ ID NO: 54071 - DNA, 16 bp, H. sapiens
attatcactaatcatc

SEQ ID NO: 54072 - DNA, 16 bp, H. sapiens
attatcactttgaata

SEQ ID NO: 54073 - DNA, 16 bp, H. sapiens
attatcagaaataaag

SEQ ID NO: 54074 - DNA, 16 bp, H. sapiens
attatcagattttttt

SEQ ID NO: 54075 - DNA, 16 bp, H. sapiens
attatcagcttaaaat

SEQ ID NO: 54076 - DNA, 16 bp, H. sapiens
attatcagttttattt

SEQ ID NO: 54077 - DNA, 16 bp, H. sapiens
attatcatcaccacca

SEQ ID NO: 54078 - DNA, 16 bp, H. sapiens
attatcatcatcatca

SEQ ID NO: 54079 - DNA, 16 bp, H. sapiens
attatccagccccaaa

SEQ ID NO: 54080 - DNA, 17 bp, H. sapiens
attatccaggacaactt

SEQ ID NO: 54081 - DNA, 16 bp, H. sapiens
attatccaggataatc

SEQ ID NO: 54082 - DNA, 16 bp, H. sapiens
attatccaggcatggt

SEQ ID NO: 54083 - DNA, 16 bp, H. sapiens
attatccccatttcat

SEQ ID NO: 54084 - DNA, 16 bp, H. sapiens
attatccctttaaata

SEQ ID NO: 54085 - DNA, 17 bp, H. sapiens
attatcctgcctcagcc

SEQ ID NO: 54086 - DNA, 16 bp, H. sapiens
attatccttatcaaac

SEQ ID NO: 54087 - DNA, 16 bp, H. sapiens
attatcctttgaattt

SEQ ID NO: 54088 - DNA, 16 bp, H. sapiens
attatctcatttaatc

SEQ ID NO: 54089 - DNA, 16 bp, H. sapiens
attatctgaaaaaaaa

SEQ ID NO: 54090 - DNA, 16 bp, H. sapiens
attatctggcccaaat

SEQ ID NO: 54091 - DNA, 16 bp, H. sapiens
attatctgttttaata

SEQ ID NO: 54092 - DNA, 16 bp, H. sapiens
attatcttccatgaaa

SEQ ID NO: 54093 - DNA, 16 bp, H. sapiens
attatcttcttttcaa

SEQ ID NO: 54094 - DNA, 16 bp, H. sapiens
attatctttaaaagtt

SEQ ID NO: 54095 - DNA, 16 bp, H. sapiens
attatctttattgatt

SEQ ID NO: 54096 - DNA, 16 bp, H. sapiens
attatgaaaaagacaa

SEQ ID NO: 54097 - DNA, 16 bp, H. sapiens
attatgaaaataattc

SEQ ID NO: 54098 - DNA, 16 bp, H. sapiens
attatgaaaatgttaa

SEQ ID NO: 54099 - DNA, 16 bp, H. sapiens
attatgaaaatttcca

SEQ ID NO: 54100 - DNA, 16 bp, H. sapiens
attatgaaattatgaa

SEQ ID NO: 54101 - DNA, 16 bp, H. sapiens
attatgaaattcttgt

SEQ ID NO: 54102 - DNA, 16 bp, H. sapiens
attatgaacaactaca

SEQ ID NO: 54103 - DNA, 16 bp, H. sapiens
attatgaacaattcta

SEQ ID NO: 54104 - DNA, 16 bp, H. sapiens
attatgaagattttct

SEQ ID NO: 54105 - DNA, 16 bp, H. sapiens
attatgaaggaaaaga

SEQ ID NO: 54106 - DNA, 16 bp, H. sapiens
attatgaagtatttca

SEQ ID NO: 54107 - DNA, 16 bp, H. sapiens
attatgaataaaattg

SEQ ID NO: 54108 - DNA, 16 bp, H. sapiens
attatgaataatgcta

SEQ ID NO: 54109 - DNA, 16 bp, H. sapiens
attatgaatatgtggt

SEQ ID NO: 54110 - DNA, 17 bp, H. sapiens
attatgacatagattct

SEQ ID NO: 54111 - DNA, 16 bp, H. sapiens
attatgatatattcat

SEQ ID NO: 54112 - DNA, 16 bp, H. sapiens
attatgatggtagctg

SEQ ID NO: 54113 - DNA, 16 bp, H. sapiens
attatgatgttagctg

SEQ ID NO: 54114 - DNA, 16 bp, H. sapiens
attatgcaaaataata

SEQ ID NO: 54115 - DNA, 16 bp, H. sapiens
attatgcaaagaaaaa

SEQ ID NO: 54116 - DNA, 16 bp, H. sapiens
attatgcattcatctc

SEQ ID NO: 54117 - DNA, 16 bp, H. sapiens
attatgctaagttaaa

SEQ ID NO: 54118 - DNA, 16 bp, H. sapiens
attatgctacatgaaa

SEQ ID NO: 54119 - DNA, 16 bp, H. sapiens
attatgctgattggac

SEQ ID NO: 54120 - DNA, 16 bp, H. sapiens
attatggaaaacacta

SEQ ID NO: 54121 - DNA, 16 bp, H. sapiens
attatggccattcttg

SEQ ID NO: 54122 - DNA, 16 bp, H. sapiens
attatggctgcttctg

SEQ ID NO: 54123 - DNA, 16 bp, H. sapiens
attatgggaagtacaa

SEQ ID NO: 54124 - DNA, 16 bp, H. sapiens
attatgggacctacaa

SEQ ID NO: 54125 - DNA, 16 bp, H. sapiens
attatggtagctatgc

SEQ ID NO: 54126 - DNA, 16 bp, H. sapiens
attatgtaaaacattt

SEQ ID NO: 54127 - DNA, 16 bp, H. sapiens
attatgtacaatacat

SEQ ID NO: 54128 - DNA, 16 bp, H. sapiens
attatgtacagtacat

SEQ ID NO: 54129 - DNA, 16 bp, H. sapiens
attatgtatattttac

SEQ ID NO: 54130 - DNA, 16 bp, H. sapiens
attatgtcttttgtgg

SEQ ID NO: 54131 - DNA, 16 bp, H. sapiens
attatgtgaaaaatat

SEQ ID NO: 54132 - DNA, 16 bp, H. sapiens
attatgtgacaaagaa

SEQ ID NO: 54133 - DNA, 16 bp, H. sapiens
attatgtgccaggcat

SEQ ID NO: 54134 - DNA, 16 bp, H. sapiens
attatgtggcacatga

SEQ ID NO: 54135 - DNA, 16 bp, H. sapiens
attatgttaaaaacaa

SEQ ID NO: 54136 - DNA, 16 bp, H. sapiens
attatgttaagagaaa

SEQ ID NO: 54137 - DNA, 16 bp, H. sapiens
attatgttaagtgaaa

SEQ ID NO: 54138 - DNA, 16 bp, H. sapiens
attatgttacataaaa

SEQ ID NO: 54139 - DNA, 16 bp, H. sapiens
attatgtttaaatgat

SEQ ID NO: 54140 - DNA, 16 bp, H. sapiens
attatgtttattgtct

SEQ ID NO: 54141 - DNA, 16 bp, H. sapiens
attatgtttgtgagat

SEQ ID NO: 54142 - DNA, 16 bp, H. sapiens
attatgttttctaaaa

SEQ ID NO: 54143 - DNA, 16 bp, H. sapiens
attatgtttttaaaga

SEQ ID NO: 54144 - DNA, 16 bp, H. sapiens
attatgtttttcaaaa

SEQ ID NO: 54145 - DNA, 16 bp, H. sapiens
attatgtttttgagat

SEQ ID NO: 54146 - DNA, 16 bp, H. sapiens
attattaaaaagtcaa

SEQ ID NO: 54147 - DNA, 16 bp, H. sapiens
attattaaagtcaaaa

SEQ ID NO: 54148 - DNA, 16 bp, H. sapiens
attattaacatcttat

SEQ ID NO: 54149 - DNA, 16 bp, H. sapiens
attattagaaaacatt

SEQ ID NO: 54150 - DNA, 16 bp, H. sapiens
attattataaagcaaa

SEQ ID NO: 54151 - DNA, 16 bp, H. sapiens
attattatgtcttctt

SEQ ID NO: 54152 - DNA, 16 bp, H. sapiens
attattatgtgtcaat

SEQ ID NO: 54153 - DNA, 16 bp, H. sapiens
attattatgttagctg

SEQ ID NO: 54154 - DNA, 16 bp, H. sapiens
attattattaactcta

SEQ ID NO: 54155 - DNA, 16 bp, H. sapiens
attattattaagatgg

SEQ ID NO: 54156 - DNA, 16 bp, H. sapiens
attattattagagata

SEQ ID NO: 54157 - DNA, 16 bp, H. sapiens
attattattatgaaga

SEQ ID NO: 54158 - DNA, 16 bp, H. sapiens
attattattcctgttt

SEQ ID NO: 54159 - DNA, 16 bp, H. sapiens
attattattcttttga

SEQ ID NO: 54160 - DNA, 16 bp, H. sapiens
attattatttatgtct

SEQ ID NO: 54161 - DNA, 16 bp, H. sapiens
attattattttgcatt

SEQ ID NO: 54162 - DNA, 16 bp, H. sapiens
attattatttttcagt

SEQ ID NO: 54163 - DNA, 16 bp, H. sapiens
attattatttttgagg

SEQ ID NO: 54164 - DNA, 16 bp, H. sapiens
attattcaaagtgaag

SEQ ID NO: 54165 - DNA, 16 bp, H. sapiens
attattcaggtgatgg

SEQ ID NO: 54166 - DNA, 16 bp, H. sapiens
attattcattcttaaa

SEQ ID NO: 54167 - DNA, 16 bp, H. sapiens
attattccactctcta

SEQ ID NO: 54168 - DNA, 16 bp, H. sapiens
attattccatttgtat

SEQ ID NO: 54169 - DNA, 16 bp, H. sapiens
attattctgttttcac

SEQ ID NO: 54170 - DNA, 16 bp, H. sapiens
attattgattcattaa

SEQ ID NO: 54171 - DNA, 16 bp, H. sapiens
attattgcatttaatt

SEQ ID NO: 54172 - DNA, 16 bp, H. sapiens
attattggcattcctg

SEQ ID NO: 54173 - DNA, 16 bp, H. sapiens
attattggtgtatatg

SEQ ID NO: 54174 - DNA, 16 bp, H. sapiens
attattgtattggagt

SEQ ID NO: 54175 - DNA, 16 bp, H. sapiens
attattgtcattattt

SEQ ID NO: 54176 - DNA, 16 bp, H. sapiens
attattgtctgtcttt

SEQ ID NO: 54177 - DNA, 16 bp, H. sapiens
attattgtgaaaatta

SEQ ID NO: 54178 - DNA, 16 bp, H. sapiens
attattgtgaggcctc

SEQ ID NO: 54179 - DNA, 16 bp, H. sapiens
attattgtgtgggatt

SEQ ID NO: 54180 - DNA, 16 bp, H. sapiens
attattgttaactata

SEQ ID NO: 54181 - DNA, 16 bp, H. sapiens
attattgttgctatta

SEQ ID NO: 54182 - DNA, 16 bp, H. sapiens
attattgtttttcaaa

SEQ ID NO: 54183 - DNA, 16 bp, H. sapiens
attatttaaaaatcag

SEQ ID NO: 54184 - DNA, 16 bp, H. sapiens
attatttaaaatcatc

SEQ ID NO: 54185 - DNA, 16 bp, H. sapiens
attatttaacattgtt

SEQ ID NO: 54186 - DNA, 16 bp, H. sapiens
attatttacccagaag

SEQ ID NO: 54187 - DNA, 16 bp, H. sapiens
attatttagaaaacaa

SEQ ID NO: 54188 - DNA, 16 bp, H. sapiens
attatttagaaatgaa

SEQ ID NO: 54189 - DNA, 16 bp, H. sapiens
attatttagccacaaa

SEQ ID NO: 54190 - DNA, 16 bp, H. sapiens
attatttaggaaataa

SEQ ID NO: 54191 - DNA, 16 bp, H. sapiens
attatttaggtgcacc

SEQ ID NO: 54192 - DNA, 16 bp, H. sapiens
attatttatgaagaaa

SEQ ID NO: 54193 - DNA, 16 bp, H. sapiens
attatttatgcctccc

SEQ ID NO: 54194 - DNA, 16 bp, H. sapiens
attatttcaaaaatgt

SEQ ID NO: 54195 - DNA, 16 bp, H. sapiens
attatttcaacttttc

SEQ ID NO: 54196 - DNA, 16 bp, H. sapiens
attatttcagaaaaat

SEQ ID NO: 54197 - DNA, 16 bp, H. sapiens
attatttcatatgctt

SEQ ID NO: 54198 - DNA, 16 bp, H. sapiens
attatttcatcaacca

SEQ ID NO: 54199 - DNA, 16 bp, H. sapiens
attatttcatcaccag

SEQ ID NO: 54200 - DNA, 16 bp, H. sapiens
attatttcattaccca

SEQ ID NO: 54201 - DNA, 16 bp, H. sapiens
attatttcattatgta

SEQ ID NO: 54202 - DNA, 16 bp, H. sapiens
attatttcatttgaaa

SEQ ID NO: 54203 - DNA, 16 bp, H. sapiens
attatttccaaaaata

SEQ ID NO: 54204 - DNA, 16 bp, H. sapiens
attatttccaaatatt

SEQ ID NO: 54205 - DNA, 16 bp, H. sapiens
attatttccagttttt

SEQ ID NO: 54206 - DNA, 16 bp, H. sapiens
attatttccatctttg

SEQ ID NO: 54207 - DNA, 16 bp, H. sapiens
attatttctaacactt

SEQ ID NO: 54208 - DNA, 16 bp, H. sapiens
attatttctcaaataa

SEQ ID NO: 54209 - DNA, 16 bp, H. sapiens
attatttctcatgttt

SEQ ID NO: 54210 - DNA, 16 bp, H. sapiens
attatttctgaaaaat

SEQ ID NO: 54211 - DNA, 16 bp, H. sapiens
attatttctgaagcct

SEQ ID NO: 54212 - DNA, 16 bp, H. sapiens
attatttctgaattat

SEQ ID NO: 54213 - DNA, 16 bp, H. sapiens
attatttctgattatt

SEQ ID NO: 54214 - DNA, 16 bp, H. sapiens
attatttctgttttac

SEQ ID NO: 54215 - DNA, 16 bp, H. sapiens
attatttcttcaaaat

SEQ ID NO: 54216 - DNA, 16 bp, H. sapiens
attatttcttcaaata

SEQ ID NO: 54217 - DNA, 16 bp, H. sapiens
attatttcttcaagta

SEQ ID NO: 54218 - DNA, 16 bp, H. sapiens
attatttctttgaaat

SEQ ID NO: 54219 - DNA, 16 bp, H. sapiens
attatttgaacatatt

SEQ ID NO: 54220 - DNA, 16 bp, H. sapiens
attatttgatagcaca

SEQ ID NO: 54221 - DNA, 16 bp, H. sapiens
attatttggaggagaa

SEQ ID NO: 54222 - DNA, 16 bp, H. sapiens
attatttggggaaaaa

SEQ ID NO: 54223 - DNA, 16 bp, H. sapiens
attatttgtaacacaa

SEQ ID NO: 54224 - DNA, 16 bp, H. sapiens
attatttgttcaaaat

SEQ ID NO: 54225 - DNA, 16 bp, H. sapiens
attattttaaaaagtg

SEQ ID NO: 54226 - DNA, 16 bp, H. sapiens
attattttaaaggaaa

SEQ ID NO: 54227 - DNA, 16 bp, H. sapiens
attattttaagcaaat

SEQ ID NO: 54228 - DNA, 16 bp, H. sapiens
attattttaagccact

SEQ ID NO: 54229 - DNA, 16 bp, H. sapiens
attattttaatgttct

SEQ ID NO: 54230 - DNA, 16 bp, H. sapiens
attattttacagaaaa

SEQ ID NO: 54231 - DNA, 16 bp, H. sapiens
attattttatatccaa

SEQ ID NO: 54232 - DNA, 16 bp, H. sapiens
attattttatattctg

SEQ ID NO: 54233 - DNA, 16 bp, H. sapiens
attattttattgctgt

SEQ ID NO: 54234 - DNA, 16 bp, H. sapiens
attattttcaaaacaa

SEQ ID NO: 54235 - DNA, 16 bp, H. sapiens
attattttcaaaatga

SEQ ID NO: 54236 - DNA, 16 bp, H. sapiens
attattttcaaacatt

SEQ ID NO: 54237 - DNA, 16 bp, H. sapiens
attattttcaagtatt

SEQ ID NO: 54238 - DNA, 16 bp, H. sapiens
attattttcagtattt

SEQ ID NO: 54239 - DNA, 16 bp, H. sapiens
attattttcatgttat

SEQ ID NO: 54240 - DNA, 16 bp, H. sapiens
attattttccaaagtg

SEQ ID NO: 54241 - DNA, 16 bp, H. sapiens
attattttccattttg

SEQ ID NO: 54242 - DNA, 16 bp, H. sapiens
attattttccccatct

SEQ ID NO: 54243 - DNA, 16 bp, H. sapiens
attattttctaaagtt

SEQ ID NO: 54244 - DNA, 16 bp, H. sapiens
attattttctgcattt

SEQ ID NO: 54245 - DNA, 16 bp, H. sapiens
attattttctttgaat

SEQ ID NO: 54246 - DNA, 16 bp, H. sapiens
attattttgaagaata

SEQ ID NO: 54247 - DNA, 16 bp, H. sapiens
attattttgaataaac

SEQ ID NO: 54248 - DNA, 16 bp, H. sapiens
attattttgaattctt

SEQ ID NO: 54249 - DNA, 16 bp, H. sapiens
attattttgagataga

SEQ ID NO: 54250 - DNA, 16 bp, H. sapiens
attattttgaggaaaa

SEQ ID NO: 54251 - DNA, 16 bp, H. sapiens
attattttgaggcaga

SEQ ID NO: 54252 - DNA, 16 bp, H. sapiens
attattttggctattt

SEQ ID NO: 54253 - DNA, 16 bp, H. sapiens
attatttttaaaagct

SEQ ID NO: 54254 - DNA, 16 bp, H. sapiens
attatttttaatgact

SEQ ID NO: 54255 - DNA, 16 bp, H. sapiens
attatttttacaatga

SEQ ID NO: 54256 - DNA, 16 bp, H. sapiens
attatttttactgatt

SEQ ID NO: 54257 - DNA, 16 bp, H. sapiens
attatttttatcattg

SEQ ID NO: 54258 - DNA, 16 bp, H. sapiens
attatttttatgactt

SEQ ID NO: 54259 - DNA, 16 bp, H. sapiens
attatttttgagactg

SEQ ID NO: 54260 - DNA, 16 bp, H. sapiens
attatttttggaaaaa

SEQ ID NO: 54261 - DNA, 16 bp, H. sapiens
attattttttcaatgt

SEQ ID NO: 54262 - DNA, 16 bp, H. sapiens
attattttttcctcaa

SEQ ID NO: 54263 - DNA, 18 bp, H. sapiens
attattttttgagacagg

SEQ ID NO: 54264 - DNA, 16 bp, H. sapiens
attcaaaaatgaataa

SEQ ID NO: 54265 - DNA, 16 bp, H. sapiens
attcaaaacaattgaa

SEQ ID NO: 54266 - DNA, 16 bp, H. sapiens
attcaaaacctagcag

SEQ ID NO: 54267 - DNA, 16 bp, H. sapiens
attcaaaactttttga

SEQ ID NO: 54268 - DNA, 16 bp, H. sapiens
attcaaaagacaaaca

SEQ ID NO: 54269 - DNA, 16 bp, H. sapiens
attcaaaagacaggca

SEQ ID NO: 54270 - DNA, 18 bp, H. sapiens
attcaaaagctagcggaa

SEQ ID NO: 54271 - DNA, 16 bp, H. sapiens
attcaaaatagtattg

SEQ ID NO: 54272 - DNA, 16 bp, H. sapiens
attcaaaatatggatt

SEQ ID NO: 54273 - DNA, 16 bp, H. sapiens
attcaaaatgctccaa

SEQ ID NO: 54274 - DNA, 16 bp, H. sapiens
attcaaaatggattat

SEQ ID NO: 54275 - DNA, 16 bp, H. sapiens
attcaaaatgtataaa

SEQ ID NO: 54276 - DNA, 16 bp, H. sapiens
attcaaaattaccctg

SEQ ID NO: 54277 - DNA, 16 bp, H. sapiens
attcaaacaaatattt

SEQ ID NO: 54278 - DNA, 16 bp, H. sapiens
attcaaacatttattg

SEQ ID NO: 54279 - DNA, 16 bp, H. sapiens
attcaaacattttaaa

SEQ ID NO: 54280 - DNA, 16 bp, H. sapiens
attcaaacattttatt

SEQ ID NO: 54281 - DNA, 16 bp, H. sapiens
attcaaacttcagaaa

SEQ ID NO: 54282 - DNA, 16 bp, H. sapiens
attcaaagaaatattt

SEQ ID NO: 54283 - DNA, 16 bp, H. sapiens
attcaaagaattggta

SEQ ID NO: 54284 - DNA, 16 bp, H. sapiens
attcaaagatttcctg

SEQ ID NO: 54285 - DNA, 16 bp, H. sapiens
attcaaagctgtcctg

SEQ ID NO: 54286 - DNA, 16 bp, H. sapiens
attcaaaggaaaagaa

SEQ ID NO: 54287 - DNA, 16 bp, H. sapiens
attcaaagtatatttt

SEQ ID NO: 54288 - DNA, 16 bp, H. sapiens
attcaaagtttaaaaa

SEQ ID NO: 54289 - DNA, 16 bp, H. sapiens
attcaaataaaatctt

SEQ ID NO: 54290 - DNA, 16 bp, H. sapiens
attcaaatgctagcag

SEQ ID NO: 54291 - DNA, 16 bp, H. sapiens
attcaaattatttccc

SEQ ID NO: 54292 - DNA, 16 bp, H. sapiens
attcaaattcaggact

SEQ ID NO: 54293 - DNA, 16 bp, H. sapiens
attcaaattcatgaaa

SEQ ID NO: 54294 - DNA, 16 bp, H. sapiens
attcaaatttaactgg

SEQ ID NO: 54295 - DNA, 16 bp, H. sapiens
attcaaatttcagtgt

SEQ ID NO: 54296 - DNA, 16 bp, H. sapiens
attcaacaaaaatgta

SEQ ID NO: 54297 - DNA, 16 bp, H. sapiens
attcaacaaacactta

SEQ ID NO: 54298 - DNA, 16 bp, H. sapiens
attcaacaaagtattg

SEQ ID NO: 54299 - DNA, 16 bp, H. sapiens
attcaacaaatatgta

SEQ ID NO: 54300 - DNA, 16 bp, H. sapiens
attcaacaaatattta

SEQ ID NO: 54301 - DNA, 16 bp, H. sapiens
attcaacaaatatttg

SEQ ID NO: 54302 - DNA, 16 bp, H. sapiens
attcaacaaatgtttg

SEQ ID NO: 54303 - DNA, 16 bp, H. sapiens
attcaacaatatttat

SEQ ID NO: 54304 - DNA, 16 bp, H. sapiens
attcaacacattttta

SEQ ID NO: 54305 - DNA, 16 bp, H. sapiens
attcaacacttcatta

SEQ ID NO: 54306 - DNA, 16 bp, H. sapiens
attcaacagatattta

SEQ ID NO: 54307 - DNA, 17 bp, H. sapiens
attcaacagtccttcat

SEQ ID NO: 54308 - DNA, 16 bp, H. sapiens
attcaacagtgcatgg

SEQ ID NO: 54309 - DNA, 17 bp, H. sapiens
attcaaccattgtggaa

SEQ ID NO: 54310 - DNA, 16 bp, H. sapiens
attcaactcccactta

SEQ ID NO: 54311 - DNA, 16 bp, H. sapiens
attcaactctcagagt

SEQ ID NO: 54312 - DNA, 16 bp, H. sapiens
attcaactgtgaatct

SEQ ID NO: 54313 - DNA, 16 bp, H. sapiens
attcaactgttgatgg

SEQ ID NO: 54314 - DNA, 16 bp, H. sapiens
attcaagaaattctcc

SEQ ID NO: 54315 - DNA, 16 bp, H. sapiens
attcaagaagaagcag

SEQ ID NO: 54316 - DNA, 17 bp, H. sapiens
attcaagaccagcctga

SEQ ID NO: 54317 - DNA, 16 bp, H. sapiens
attcaagactgtcttt

SEQ ID NO: 54318 - DNA, 16 bp, H. sapiens
attcaagagatattta

SEQ ID NO: 54319 - DNA, 16 bp, H. sapiens
attcaagatagtattg

SEQ ID NO: 54320 - DNA, 16 bp, H. sapiens
attcaagatggattca

SEQ ID NO: 54321 - DNA, 16 bp, H. sapiens
attcaagatgtgacct

SEQ ID NO: 54322 - DNA, 16 bp, H. sapiens
attcaagattaatatt

SEQ ID NO: 54323 - DNA, 16 bp, H. sapiens
attcaagattttaaaa

SEQ ID NO: 54324 - DNA, 16 bp, H. sapiens
attcaagcccaggtct

SEQ ID NO: 54325 - DNA, 16 bp, H. sapiens
attcaaggacctgctg

SEQ ID NO: 54326 - DNA, 16 bp, H. sapiens
attcaaggagagggga

SEQ ID NO: 54327 - DNA, 16 bp, H. sapiens
attcaagtcctggctc

SEQ ID NO: 54328 - DNA, 16 bp, H. sapiens
attcaataaatactta

SEQ ID NO: 54329 - DNA, 16 bp, H. sapiens
attcaataaatattgg

SEQ ID NO: 54330 - DNA, 16 bp, H. sapiens
attcaatagagaaaga

SEQ ID NO: 54331 - DNA, 16 bp, H. sapiens
attcaatatgactggt

SEQ ID NO: 54332 - DNA, 16 bp, H. sapiens
attcaatatttgttga

SEQ ID NO: 54333 - DNA, 16 bp, H. sapiens
attcaatattttgatg

SEQ ID NO: 54334 - DNA, 16 bp, H. sapiens
attcaatctgttgtga

SEQ ID NO: 54335 - DNA, 16 bp, H. sapiens
attcaatgataaaata

SEQ ID NO: 54336 - DNA, 16 bp, H. sapiens
attcaatgatttttta

SEQ ID NO: 54337 - DNA, 16 bp, H. sapiens
attcaatgcagtctct

SEQ ID NO: 54338 - DNA, 16 bp, H. sapiens
attcaatgccatccca

SEQ ID NO: 54339 - DNA, 31 bp, H. sapiens
attcaatgccatccccatcaagctaccaata

SEQ ID NO: 54340 - DNA, 16 bp, H. sapiens
attcaatgtatttttt

SEQ ID NO: 54341 - DNA, 16 bp, H. sapiens
attcaattaatttttg

SEQ ID NO: 54342 - DNA, 16 bp, H. sapiens
attcaattcagcaaat

SEQ ID NO: 54343 - DNA, 16 bp, H. sapiens
attcaatttttaatgt

SEQ ID NO: 54344 - DNA, 16 bp, H. sapiens
attcacaatagcatca

SEQ ID NO: 54345 - DNA, 16 bp, H. sapiens
attcacaattgccata

SEQ ID NO: 54346 - DNA, 16 bp, H. sapiens
attcacaattgctaaa

SEQ ID NO: 54347 - DNA, 18 bp, H. sapiens
attcacaattgctacaaa

SEQ ID NO: 54348 - DNA, 16 bp, H. sapiens
attcacacactccctc

SEQ ID NO: 54349 - DNA, 16 bp, H. sapiens
attcacacccttgtgt

SEQ ID NO: 54350 - DNA, 16 bp, H. sapiens
attcacactgttgtgc

SEQ ID NO: 54351 - DNA, 16 bp, H. sapiens
attcacagaagcagag

SEQ ID NO: 54352 - DNA, 16 bp, H. sapiens
attcacagaattggaa

SEQ ID NO: 54353 - DNA, 16 bp, H. sapiens
attcacagctgagttc

SEQ ID NO: 54354 - DNA, 16 bp, H. sapiens
attcacaggcaaattc

SEQ ID NO: 54355 - DNA, 16 bp, H. sapiens
attcacagtagccaca

SEQ ID NO: 54356 - DNA, 16 bp, H. sapiens
attcacatgcagtttt

SEQ ID NO: 54357 - DNA, 16 bp, H. sapiens
attcacatggttcaaa

SEQ ID NO: 54358 - DNA, 16 bp, H. sapiens
attcacatttaaataa

SEQ ID NO: 54359 - DNA, 16 bp, H. sapiens
attcaccaagacagac

SEQ ID NO: 54360 - DNA, 16 bp, H. sapiens
attcaccaccacaaga

SEQ ID NO: 54361 - DNA, 16 bp, H. sapiens
attcaccactgctaac

SEQ ID NO: 54362 - DNA, 16 bp, H. sapiens
attcaccatgaccaag

SEQ ID NO: 54363 - DNA, 16 bp, H. sapiens
attcaccattaccaag

SEQ ID NO: 54364 - DNA, 16 bp, H. sapiens
attcaccattttaaag

SEQ ID NO: 54365 - DNA, 16 bp, H. sapiens
attcacccaacaaata

SEQ ID NO: 54366 - DNA, 16 bp, H. sapiens
attcacccacctcagc

SEQ ID NO: 54367 - DNA, 17 bp, H. sapiens
attcacccaccttagcc

SEQ ID NO: 54368 - DNA, 16 bp, H. sapiens
attcacccactgaagg

SEQ ID NO: 54369 - DNA, 16 bp, H. sapiens
attcacccattttaaa

SEQ ID NO: 54370 - DNA, 16 bp, H. sapiens
attcacctgcctcagc

SEQ ID NO: 54371 - DNA, 17 bp, H. sapiens
attcacctgcctcggcc

SEQ ID NO: 54372 - DNA, 16 bp, H. sapiens
attcacctgttgatga

SEQ ID NO: 54373 - DNA, 16 bp, H. sapiens
attcactcaacaagta

SEQ ID NO: 54374 - DNA, 16 bp, H. sapiens
attcactcaacactca

SEQ ID NO: 54375 - DNA, 16 bp, H. sapiens
attcactcattcattc

SEQ ID NO: 54376 - DNA, 16 bp, H. sapiens
attcactgagcactta

SEQ ID NO: 54377 - DNA, 16 bp, H. sapiens
attcactgagtgccta

SEQ ID NO: 54378 - DNA, 16 bp, H. sapiens
attcacttaacaaaca

SEQ ID NO: 54379 - DNA, 16 bp, H. sapiens
attcacttccagaaca

SEQ ID NO: 54380 - DNA, 16 bp, H. sapiens
attcacttgacaaata

SEQ ID NO: 54381 - DNA, 16 bp, H. sapiens
attcactttttaaaaa

SEQ ID NO: 54382 - DNA, 16 bp, H. sapiens
attcactttttcacca

SEQ ID NO: 54383 - DNA, 16 bp, H. sapiens
attcagaaaacattta

SEQ ID NO: 54384 - DNA, 16 bp, H. sapiens
attcagaaaagaaaat

SEQ ID NO: 54385 - DNA, 16 bp, H. sapiens
attcagaaaatgcaga

SEQ ID NO: 54386 - DNA, 16 bp, H. sapiens
attcagaaaatggaat

SEQ ID NO: 54387 - DNA, 16 bp, H. sapiens
attcagaaaatgtaaa

SEQ ID NO: 54388 - DNA, 16 bp, H. sapiens
attcagaaaattttaa

SEQ ID NO: 54389 - DNA, 16 bp, H. sapiens
attcagaaaattttca

SEQ ID NO: 54390 - DNA, 16 bp, H. sapiens
attcagaaacatttat

SEQ ID NO: 54391 - DNA, 16 bp, H. sapiens
attcagaaataaaatt

SEQ ID NO: 54392 - DNA, 16 bp, H. sapiens
attcagaaatggaaaa

SEQ ID NO: 54393 - DNA, 16 bp, H. sapiens
attcagaaattcaact

SEQ ID NO: 54394 - DNA, 16 bp, H. sapiens
attcagaagaaataaa

SEQ ID NO: 54395 - DNA, 16 bp, H. sapiens
attcagaagaataaaa

SEQ ID NO: 54396 - DNA, 16 bp, H. sapiens
attcagaataaaattt

SEQ ID NO: 54397 - DNA, 16 bp, H. sapiens
attcagaatatgaata

SEQ ID NO: 54398 - DNA, 16 bp, H. sapiens
attcagaatctataag

SEQ ID NO: 54399 - DNA, 16 bp, H. sapiens
attcagaattttattt

SEQ ID NO: 54400 - DNA, 16 bp, H. sapiens
attcagaccctcgtag

SEQ ID NO: 54401 - DNA, 16 bp, H. sapiens
attcagagaaaaggga

SEQ ID NO: 54402 - DNA, 16 bp, H. sapiens
attcagagaaacttct

SEQ ID NO: 54403 - DNA, 16 bp, H. sapiens
attcagagacagaaaa

SEQ ID NO: 54404 - DNA, 16 bp, H. sapiens
attcagagattcttta

SEQ ID NO: 54405 - DNA, 16 bp, H. sapiens
attcagagctgaataa

SEQ ID NO: 54406 - DNA, 16 bp, H. sapiens
attcagaggaagaaaa

SEQ ID NO: 54407 - DNA, 16 bp, H. sapiens
attcagagggaaaaaa

SEQ ID NO: 54408 - DNA, 16 bp, H. sapiens
attcagatttatttat

SEQ ID NO: 54409 - DNA, 16 bp, H. sapiens
attcagattttatttt

SEQ ID NO: 54410 - DNA, 16 bp, H. sapiens
attcagatttttaaaa

SEQ ID NO: 54411 - DNA, 16 bp, H. sapiens
attcagatttttaatt

SEQ ID NO: 54412 - DNA, 16 bp, H. sapiens
attcagcaaacattta

SEQ ID NO: 54413 - DNA, 16 bp, H. sapiens
attcagcaaataaaaa

SEQ ID NO: 54414 - DNA, 16 bp, H. sapiens
attcagcaaatattta

SEQ ID NO: 54415 - DNA, 16 bp, H. sapiens
attcagcaaatggtgc

SEQ ID NO: 54416 - DNA, 17 bp, H. sapiens
attcagcaacccttcat

SEQ ID NO: 54417 - DNA, 16 bp, H. sapiens
attcagcaattttttt

SEQ ID NO: 54418 - DNA, 16 bp, H. sapiens
attcagcagcatatca

SEQ ID NO: 54419 - DNA, 16 bp, H. sapiens
attcagcaggttggaa

SEQ ID NO: 54420 - DNA, 16 bp, H. sapiens
attcagcatagtcctg

SEQ ID NO: 54421 - DNA, 16 bp, H. sapiens
attcagcatttaaaaa

SEQ ID NO: 54422 - DNA, 16 bp, H. sapiens
attcagcctctttttt

SEQ ID NO: 54423 - DNA, 16 bp, H. sapiens
attcagctgtgaatcc

SEQ ID NO: 54424 - DNA, 16 bp, H. sapiens
attcagctgtgaattc

SEQ ID NO: 54425 - DNA, 16 bp, H. sapiens
attcagctttttaaaa

SEQ ID NO: 54426 - DNA, 16 bp, H. sapiens
attcaggaaaaacaga

SEQ ID NO: 54427 - DNA, 19 bp, H. sapiens
attcaggaaacacagagaa

SEQ ID NO: 54428 - DNA, 16 bp, H. sapiens
attcaggaaatacaaa

SEQ ID NO: 54429 - DNA, 19 bp, H. sapiens
attcaggaaatacagagaa

SEQ ID NO: 54430 - DNA, 16 bp, H. sapiens
attcaggaaatatgga

SEQ ID NO: 54431 - DNA, 19 bp, H. sapiens
attcaggaaatccagagaa

SEQ ID NO: 54432 - DNA, 16 bp, H. sapiens
attcaggaaatgcaaa

SEQ ID NO: 54433 - DNA, 16 bp, H. sapiens
attcaggaaattcaga

SEQ ID NO: 54434 - DNA, 16 bp, H. sapiens
attcaggaaatttgta

SEQ ID NO: 54435 - DNA, 16 bp, H. sapiens
attcaggaagctgagg

SEQ ID NO: 54436 - DNA, 16 bp, H. sapiens
attcaggacaaaggca

SEQ ID NO: 54437 - DNA, 17 bp, H. sapiens
attcaggacataggcaa

SEQ ID NO: 54438 - DNA, 16 bp, H. sapiens
attcaggacattggca

SEQ ID NO: 54439 - DNA, 16 bp, H. sapiens
attcaggaccagcctg

SEQ ID NO: 54440 - DNA, 16 bp, H. sapiens
attcaggagaacttcc

SEQ ID NO: 54441 - DNA, 16 bp, H. sapiens
attcaggagacccagc

SEQ ID NO: 54442 - DNA, 16 bp, H. sapiens
attcaggagcatgtta

SEQ ID NO: 54443 - DNA, 16 bp, H. sapiens
attcaggaggctaagg

SEQ ID NO: 54444 - DNA, 16 bp, H. sapiens
attcaggaggctgaaa

SEQ ID NO: 54445 - DNA, 16 bp, H. sapiens
attcaggaggctgagc

SEQ ID NO: 54446 - DNA, 16 bp, H. sapiens
attcaggagttcaaga

SEQ ID NO: 54447 - DNA, 16 bp, H. sapiens
attcaggataatctcc

SEQ ID NO: 54448 - DNA, 16 bp, H. sapiens
attcaggatctttttt

SEQ ID NO: 54449 - DNA, 16 bp, H. sapiens
attcaggctgtttttt

SEQ ID NO: 54450 - DNA, 16 bp, H. sapiens
attcaggctttttttt

SEQ ID NO: 54451 - DNA, 23 bp, H. sapiens
attcagggcataggcatgggcaa

SEQ ID NO: 54452 - DNA, 16 bp, H. sapiens
attcagggtttttttt

SEQ ID NO: 54453 - DNA, 16 bp, H. sapiens
attcaggtgatggtta

SEQ ID NO: 54454 - DNA, 16 bp, H. sapiens
attcagtaaagttgca

SEQ ID NO: 54455 - DNA, 16 bp, H. sapiens
attcagtaaatgttaa

SEQ ID NO: 54456 - DNA, 16 bp, H. sapiens
attcagtaagatgtta

SEQ ID NO: 54457 - DNA, 16 bp, H. sapiens
attcagtaatacatta

SEQ ID NO: 54458 - DNA, 16 bp, H. sapiens
attcagtacagtaaca

SEQ ID NO: 54459 - DNA, 16 bp, H. sapiens
attcagtatgataatg

SEQ ID NO: 54460 - DNA, 16 bp, H. sapiens
attcagtattttcttt

SEQ ID NO: 54461 - DNA, 16 bp, H. sapiens
attcagtcattcattt

SEQ ID NO: 54462 - DNA, 16 bp, H. sapiens
attcagtctcaaaaaa

SEQ ID NO: 54463 - DNA, 16 bp, H. sapiens
attcagtcttttatca

SEQ ID NO: 54464 - DNA, 16 bp, H. sapiens
attcagtgaatattta

SEQ ID NO: 54465 - DNA, 16 bp, H. sapiens
attcagtgataaaaag

SEQ ID NO: 54466 - DNA, 16 bp, H. sapiens
attcagtgatgtccac

SEQ ID NO: 54467 - DNA, 16 bp, H. sapiens
attcagtgatttttaa

SEQ ID NO: 54468 - DNA, 16 bp, H. sapiens
attcagtgggggaaaa

SEQ ID NO: 54469 - DNA, 16 bp, H. sapiens
attcagttaaaatgaa

SEQ ID NO: 54470 - DNA, 16 bp, H. sapiens
attcagttattttaaa

SEQ ID NO: 54471 - DNA, 16 bp, H. sapiens
attcagtttctcagtc

SEQ ID NO: 54472 - DNA, 16 bp, H. sapiens
attcagtttgaagaat

SEQ ID NO: 54473 - DNA, 16 bp, H. sapiens
attcagtttgctacta

SEQ ID NO: 54474 - DNA, 16 bp, H. sapiens
attcagtttgttagta

SEQ ID NO: 54475 - DNA, 16 bp, H. sapiens
attcagttttggaact

SEQ ID NO: 54476 - DNA, 16 bp, H. sapiens
attcagtttttaaaaa

SEQ ID NO: 54477 - DNA, 16 bp, H. sapiens
attcataaaatgaaat

SEQ ID NO: 54478 - DNA, 16 bp, H. sapiens
attcataacagaacaa

SEQ ID NO: 54479 - DNA, 16 bp, H. sapiens
attcataagaaatatt

SEQ ID NO: 54480 - DNA, 16 bp, H. sapiens
attcataagggatctg

SEQ ID NO: 54481 - DNA, 16 bp, H. sapiens
attcataagttttaaa

SEQ ID NO: 54482 - DNA, 16 bp, H. sapiens
attcataatagccaaa

SEQ ID NO: 54483 - DNA, 16 bp, H. sapiens
attcatacaacagaat

SEQ ID NO: 54484 - DNA, 16 bp, H. sapiens
attcatacattgaaac

SEQ ID NO: 54485 - DNA, 16 bp, H. sapiens
attcatactttttaaa

SEQ ID NO: 54486 - DNA, 16 bp, H. sapiens
attcatagaaaaataa

SEQ ID NO: 54487 - DNA, 16 bp, H. sapiens
attcatagacacagaa

SEQ ID NO: 54488 - DNA, 16 bp, H. sapiens
attcatatatattcat

SEQ ID NO: 54489 - DNA, 16 bp, H. sapiens
attcatatgaaaatgt

SEQ ID NO: 54490 - DNA, 16 bp, H. sapiens
attcatatggaactga

SEQ ID NO: 54491 - DNA, 16 bp, H. sapiens
attcatatgtaacaaa

SEQ ID NO: 54492 - DNA, 16 bp, H. sapiens
attcatatgttgaaac

SEQ ID NO: 54493 - DNA, 16 bp, H. sapiens
attcatatttcaaaat

SEQ ID NO: 54494 - DNA, 16 bp, H. sapiens
attcatattttgaaat

SEQ ID NO: 54495 - DNA, 16 bp, H. sapiens
attcatcaaatattta

SEQ ID NO: 54496 - DNA, 16 bp, H. sapiens
attcatcaagctgtac

SEQ ID NO: 54497 - DNA, 16 bp, H. sapiens
attcatcaatttaaaa

SEQ ID NO: 54498 - DNA, 16 bp, H. sapiens
attcatcacaaaaata

SEQ ID NO: 54499 - DNA, 16 bp, H. sapiens
attcatcaccaccagg

SEQ ID NO: 54500 - DNA, 16 bp, H. sapiens
attcatcagagaaatg

SEQ ID NO: 54501 - DNA, 16 bp, H. sapiens
attcatcagatattta

SEQ ID NO: 54502 - DNA, 16 bp, H. sapiens
attcatcagttgatgg

SEQ ID NO: 54503 - DNA, 16 bp, H. sapiens
attcatcattttaaaa

SEQ ID NO: 54504 - DNA, 16 bp, H. sapiens
attcatccatttattt

SEQ ID NO: 54505 - DNA, 16 bp, H. sapiens
attcatccttcaaaac

SEQ ID NO: 54506 - DNA, 16 bp, H. sapiens
attcatccttcaagac

SEQ ID NO: 54507 - DNA, 16 bp, H. sapiens
attcatcctttaaaaa

SEQ ID NO: 54508 - DNA, 16 bp, H. sapiens
attcatctattaaaaa

SEQ ID NO: 54509 - DNA, 16 bp, H. sapiens
attcatctcagagtta

SEQ ID NO: 54510 - DNA, 16 bp, H. sapiens
attcatctctgtattc

SEQ ID NO: 54511 - DNA, 16 bp, H. sapiens
attcatctgacaaaga

SEQ ID NO: 54512 - DNA, 16 bp, H. sapiens
attcatgaaaatataa

SEQ ID NO: 54513 - DNA, 16 bp, H. sapiens
attcatgagagatcca

SEQ ID NO: 54514 - DNA, 16 bp, H. sapiens
attcatgagaggaggt

SEQ ID NO: 54515 - DNA, 16 bp, H. sapiens
attcatgaggaatctg

SEQ ID NO: 54516 - DNA, 16 bp, H. sapiens
attcatgatacagatt

SEQ ID NO: 54517 - DNA, 16 bp, H. sapiens
attcatgatgagattt

SEQ ID NO: 54518 - DNA, 16 bp, H. sapiens
attcatgcaaaaaaaa

SEQ ID NO: 54519 - DNA, 16 bp, H. sapiens
attcatgcagagccag

SEQ ID NO: 54520 - DNA, 16 bp, H. sapiens
attcatggaaaaaaat

SEQ ID NO: 54521 - DNA, 16 bp, H. sapiens
attcatgggaggagat

SEQ ID NO: 54522 - DNA, 16 bp, H. sapiens
attcatgggaggaggt

SEQ ID NO: 54523 - DNA, 16 bp, H. sapiens
attcatgtaacaaaac

SEQ ID NO: 54524 - DNA, 16 bp, H. sapiens
attcatgtacaatttt

SEQ ID NO: 54525 - DNA, 16 bp, H. sapiens
attcatgtattattta

SEQ ID NO: 54526 - DNA, 16 bp, H. sapiens
attcatgtatttttct

SEQ ID NO: 54527 - DNA, 16 bp, H. sapiens
attcatgtcccaggca

SEQ ID NO: 54528 - DNA, 16 bp, H. sapiens
attcatgtcttttgct

SEQ ID NO: 54529 - DNA, 16 bp, H. sapiens
attcatgtgtgtgtgt

SEQ ID NO: 54530 - DNA, 16 bp, H. sapiens
attcatgttatttatt

SEQ ID NO: 54531 - DNA, 16 bp, H. sapiens
attcatgttgctgcag

SEQ ID NO: 54532 - DNA, 16 bp, H. sapiens
attcatgttttaaaaa

SEQ ID NO: 54533 - DNA, 16 bp, H. sapiens
attcatgttttcaaaa

SEQ ID NO: 54534 - DNA, 16 bp, H. sapiens
attcatgttttccttt

SEQ ID NO: 54535 - DNA, 16 bp, H. sapiens
attcatgtttttaaaa

SEQ ID NO: 54536 - DNA, 16 bp, H. sapiens
attcatgtttttataa

SEQ ID NO: 54537 - DNA, 16 bp, H. sapiens
attcattaaaagaaaa

SEQ ID NO: 54538 - DNA, 16 bp, H. sapiens
attcattaaagaaaaa

SEQ ID NO: 54539 - DNA, 16 bp, H. sapiens
attcattaaagttgca

SEQ ID NO: 54540 - DNA, 16 bp, H. sapiens
attcattaacattgaa

SEQ ID NO: 54541 - DNA, 16 bp, H. sapiens
attcattaattcagtc

SEQ ID NO: 54542 - DNA, 16 bp, H. sapiens
attcattatttttcca

SEQ ID NO: 54543 - DNA, 16 bp, H. sapiens
attcattcaacaaaat

SEQ ID NO: 54544 - DNA, 16 bp, H. sapiens
attcattcaacaagca

SEQ ID NO: 54545 - DNA, 16 bp, H. sapiens
attcattcaacacaca

SEQ ID NO: 54546 - DNA, 16 bp, H. sapiens
attcattcaacttttg

SEQ ID NO: 54547 - DNA, 16 bp, H. sapiens
attcattcaataaata

SEQ ID NO: 54548 - DNA, 16 bp, H. sapiens
attcattcacttaaaa

SEQ ID NO: 54549 - DNA, 16 bp, H. sapiens
attcattcagcaaaca

SEQ ID NO: 54550 - DNA, 16 bp, H. sapiens
attcattcagcaaata

SEQ ID NO: 54551 - DNA, 16 bp, H. sapiens
attcattcatcaaata

SEQ ID NO: 54552 - DNA, 16 bp, H. sapiens
attcattcatccattc

SEQ ID NO: 54553 - DNA, 16 bp, H. sapiens
attcattcattagttg

SEQ ID NO: 54554 - DNA, 16 bp, H. sapiens
attcattcattatttc

SEQ ID NO: 54555 - DNA, 16 bp, H. sapiens
attcattcattcaata

SEQ ID NO: 54556 - DNA, 16 bp, H. sapiens
attcattcattcagaa

SEQ ID NO: 54557 - DNA, 16 bp, H. sapiens
attcattcattcagtg

SEQ ID NO: 54558 - DNA, 16 bp, H. sapiens
attcattcattcatgt

SEQ ID NO: 54559 - DNA, 16 bp, H. sapiens
attcattcattcattt

SEQ ID NO: 54560 - DNA, 16 bp, H. sapiens
attcattcattccaca

SEQ ID NO: 54561 - DNA, 16 bp, H. sapiens
attcattcattccatg

SEQ ID NO: 54562 - DNA, 16 bp, H. sapiens
attcattcatttaaaa

SEQ ID NO: 54563 - DNA, 16 bp, H. sapiens
attcattcatttcatt

SEQ ID NO: 54564 - DNA, 16 bp, H. sapiens
attcattcatttgcat

SEQ ID NO: 54565 - DNA, 16 bp, H. sapiens
attcattccttcatct

SEQ ID NO: 54566 - DNA, 16 bp, H. sapiens
attcattctctcattt

SEQ ID NO: 54567 - DNA, 16 bp, H. sapiens
attcattctctgtcca

SEQ ID NO: 54568 - DNA, 16 bp, H. sapiens
attcattctgtatttt

SEQ ID NO: 54569 - DNA, 16 bp, H. sapiens
attcattgaaaacatt

SEQ ID NO: 54570 - DNA, 16 bp, H. sapiens
attcattgactgatgg

SEQ ID NO: 54571 - DNA, 16 bp, H. sapiens
attcattgagcaccta

SEQ ID NO: 54572 - DNA, 16 bp, H. sapiens
attcattgagcactta

SEQ ID NO: 54573 - DNA, 16 bp, H. sapiens
attcattgagtttttg

SEQ ID NO: 54574 - DNA, 16 bp, H. sapiens
attcattgatttattt

SEQ ID NO: 54575 - DNA, 16 bp, H. sapiens
attcattgcagcacta

SEQ ID NO: 54576 - DNA, 16 bp, H. sapiens
attcatttaaaacatt

SEQ ID NO: 54577 - DNA, 16 bp, H. sapiens
attcatttaaatgaat

SEQ ID NO: 54578 - DNA, 16 bp, H. sapiens
attcatttaatcaaca

SEQ ID NO: 54579 - DNA, 16 bp, H. sapiens
attcatttaattttcc

SEQ ID NO: 54580 - DNA, 16 bp, H. sapiens
attcatttacattcaa

SEQ ID NO: 54581 - DNA, 16 bp, H. sapiens
attcatttattcagca

SEQ ID NO: 54582 - DNA, 16 bp, H. sapiens
attcatttattcattg

SEQ ID NO: 54583 - DNA, 16 bp, H. sapiens
attcatttatttgaca

SEQ ID NO: 54584 - DNA, 16 bp, H. sapiens
attcatttatttgaga

SEQ ID NO: 54585 - DNA, 16 bp, H. sapiens
attcatttcaaattat

SEQ ID NO: 54586 - DNA, 16 bp, H. sapiens
attcatttcctcattc

SEQ ID NO: 54587 - DNA, 16 bp, H. sapiens
attcatttcttcaaca

SEQ ID NO: 54588 - DNA, 16 bp, H. sapiens
attcatttgattattt

SEQ ID NO: 54589 - DNA, 16 bp, H. sapiens
attcatttgttaaaaa

SEQ ID NO: 54590 - DNA, 16 bp, H. sapiens
attcattttaacaaat

SEQ ID NO: 54591 - DNA, 16 bp, H. sapiens
attcattttaagtttt

SEQ ID NO: 54592 - DNA, 16 bp, H. sapiens
attcattttatcttca

SEQ ID NO: 54593 - DNA, 16 bp, H. sapiens
attcattttgaattga

SEQ ID NO: 54594 - DNA, 16 bp, H. sapiens
attcattttgttttca

SEQ ID NO: 54595 - DNA, 16 bp, H. sapiens
attcatttttctcaaa

SEQ ID NO: 54596 - DNA, 16 bp, H. sapiens
attcattttttcaaaa

SEQ ID NO: 54597 - DNA, 16 bp, H. sapiens
attccaaaaaattggc

SEQ ID NO: 54598 - DNA, 16 bp, H. sapiens
attccaaaaatctgaa

SEQ ID NO: 54599 - DNA, 16 bp, H. sapiens
attccaaaacattttt

SEQ ID NO: 54600 - DNA, 16 bp, H. sapiens
attccaaaagaagagt

SEQ ID NO: 54601 - DNA, 16 bp, H. sapiens
attccaaaatccaaaa

SEQ ID NO: 54602 - DNA, 16 bp, H. sapiens
attccaaaattccaaa

SEQ ID NO: 54603 - DNA, 16 bp, H. sapiens
attccaaaatttatat

SEQ ID NO: 54604 - DNA, 16 bp, H. sapiens
attccaaagggaagaa

SEQ ID NO: 54605 - DNA, 17 bp, H. sapiens
attccaaatgggagaaa

SEQ ID NO: 54606 - DNA, 16 bp, H. sapiens
attccaaattaaaaca

SEQ ID NO: 54607 - DNA, 16 bp, H. sapiens
attccaacatgagatt

SEQ ID NO: 54608 - DNA, 16 bp, H. sapiens
attccaagggcttaga

SEQ ID NO: 54609 - DNA, 16 bp, H. sapiens
attccaagtccaaagt

SEQ ID NO: 54610 - DNA, 16 bp, H. sapiens
attccaataaaatttt

SEQ ID NO: 54611 - DNA, 16 bp, H. sapiens
attccacaagacagag

SEQ ID NO: 54612 - DNA, 16 bp, H. sapiens
attccacactcatgga

SEQ ID NO: 54613 - DNA, 16 bp, H. sapiens
attccacatatgaatg

SEQ ID NO: 54614 - DNA, 16 bp, H. sapiens
attccacatgtaagtg

SEQ ID NO: 54615 - DNA, 16 bp, H. sapiens
attccaccaaatattt

SEQ ID NO: 54616 - DNA, 16 bp, H. sapiens
attccacctcaaaaaa

SEQ ID NO: 54617 - DNA, 16 bp, H. sapiens
attccactggtctatg

SEQ ID NO: 54618 - DNA, 16 bp, H. sapiens
attccactgtgtatat

SEQ ID NO: 54619 - DNA, 16 bp, H. sapiens
attccacttcttcctg

SEQ ID NO: 54620 - DNA, 16 bp, H. sapiens
attccacttgttcatt

SEQ ID NO: 54621 - DNA, 16 bp, H. sapiens
attccagaaaaaaata

SEQ ID NO: 54622 - DNA, 16 bp, H. sapiens
attccagaagaaaaaa

SEQ ID NO: 54623 - DNA, 16 bp, H. sapiens
attccagaagaagaca

SEQ ID NO: 54624 - DNA, 16 bp, H. sapiens
attccagaaggaaaag

SEQ ID NO: 54625 - DNA, 16 bp, H. sapiens
attccagacattgtat

SEQ ID NO: 54626 - DNA, 16 bp, H. sapiens
attccagagcactgct

SEQ ID NO: 54627 - DNA, 16 bp, H. sapiens
attccagaggcctgtg

SEQ ID NO: 54628 - DNA, 16 bp, H. sapiens
attccagccactcggg

SEQ ID NO: 54629 - DNA, 16 bp, H. sapiens
attccagcctgactct

SEQ ID NO: 54630 - DNA, 16 bp, H. sapiens
attccagcctgggtta

SEQ ID NO: 54631 - DNA, 16 bp, H. sapiens
attccagcctgtgtga

SEQ ID NO: 54632 - DNA, 16 bp, H. sapiens
attccagcttgggcaa

SEQ ID NO: 54633 - DNA, 16 bp, H. sapiens
attccagctttttttt

SEQ ID NO: 54634 - DNA, 16 bp, H. sapiens
attccaggaatgaagc

SEQ ID NO: 54635 - DNA, 16 bp, H. sapiens
attccaggcacccacc

SEQ ID NO: 54636 - DNA, 16 bp, H. sapiens
attccagggatgcaaa

SEQ ID NO: 54637 - DNA, 16 bp, H. sapiens
attccaggtgtgagcc

SEQ ID NO: 54638 - DNA, 16 bp, H. sapiens
attccagtacacagtg

SEQ ID NO: 54639 - DNA, 16 bp, H. sapiens
attccagtctgggtga

SEQ ID NO: 54640 - DNA, 16 bp, H. sapiens
attccagtgcattcca

SEQ ID NO: 54641 - DNA, 16 bp, H. sapiens
attccagtggttctca

SEQ ID NO: 54642 - DNA, 16 bp, H. sapiens
attccataaacattta

SEQ ID NO: 54643 - DNA, 16 bp, H. sapiens
attccatatctttgtt

SEQ ID NO: 54644 - DNA, 16 bp, H. sapiens
attccatatttttgct

SEQ ID NO: 54645 - DNA, 16 bp, H. sapiens
attccatcatacatat

SEQ ID NO: 54646 - DNA, 16 bp, H. sapiens
attccatcctcatgaa

SEQ ID NO: 54647 - DNA, 16 bp, H. sapiens
attccatctcaaaaaa

SEQ ID NO: 54648 - DNA, 16 bp, H. sapiens
attccatctcaaaaca

SEQ ID NO: 54649 - DNA, 16 bp, H. sapiens
attccatcttaaaaaa

SEQ ID NO: 54650 - DNA, 16 bp, H. sapiens
attccatgacatatat

SEQ ID NO: 54651 - DNA, 16 bp, H. sapiens
attccatgatgcatat

SEQ ID NO: 54652 - DNA, 16 bp, H. sapiens
attccatgccagtgga

SEQ ID NO: 54653 - DNA, 16 bp, H. sapiens
attccatgccattcca

SEQ ID NO: 54654 - DNA, 16 bp, H. sapiens
attccatgtgtttgct

SEQ ID NO: 54655 - DNA, 16 bp, H. sapiens
attccatgttcatgga

SEQ ID NO: 54656 - DNA, 16 bp, H. sapiens
attccattcacaattg

SEQ ID NO: 54657 - DNA, 16 bp, H. sapiens
attccattcatgaagg

SEQ ID NO: 54658 - DNA, 16 bp, H. sapiens
attccattgaatggat

SEQ ID NO: 54659 - DNA, 16 bp, H. sapiens
attccattgtacagat

SEQ ID NO: 54660 - DNA, 16 bp, H. sapiens
attccattgtatggat

SEQ ID NO: 54661 - DNA, 16 bp, H. sapiens
attccattgtgttcag

SEQ ID NO: 54662 - DNA, 16 bp, H. sapiens
attccatttataaaaa

SEQ ID NO: 54663 - DNA, 16 bp, H. sapiens
attccatttcaagaaa

SEQ ID NO: 54664 - DNA, 16 bp, H. sapiens
attccatttgttaatt

SEQ ID NO: 54665 - DNA, 16 bp, H. sapiens
attccatttgtttatt

SEQ ID NO: 54666 - DNA, 16 bp, H. sapiens
attccattttaaaagt

SEQ ID NO: 54667 - DNA, 16 bp, H. sapiens
attccattttatgact

SEQ ID NO: 54668 - DNA, 16 bp, H. sapiens
attccattttcttctg

SEQ ID NO: 54669 - DNA, 16 bp, H. sapiens
attccattttgttcca

SEQ ID NO: 54670 - DNA, 16 bp, H. sapiens
attccatttttaagaa

SEQ ID NO: 54671 - DNA, 16 bp, H. sapiens
attcccaaggtctggg

SEQ ID NO: 54672 - DNA, 16 bp, H. sapiens
attcccacatgtcatg

SEQ ID NO: 54673 - DNA, 16 bp, H. sapiens
attcccaccagccatg

SEQ ID NO: 54674 - DNA, 16 bp, H. sapiens
attcccagaacctgtg

SEQ ID NO: 54675 - DNA, 16 bp, H. sapiens
attcccagcgctttgg

SEQ ID NO: 54676 - DNA, 16 bp, H. sapiens
attcccagctaatttt

SEQ ID NO: 54677 - DNA, 16 bp, H. sapiens
attcccagctgctcag

SEQ ID NO: 54678 - DNA, 16 bp, H. sapiens
attcccagtgctggag

SEQ ID NO: 54679 - DNA, 16 bp, H. sapiens
attcccatcagcaaca

SEQ ID NO: 54680 - DNA, 16 bp, H. sapiens
attcccatgtgctgtg

SEQ ID NO: 54681 - DNA, 16 bp, H. sapiens
attcccattcccattc

SEQ ID NO: 54682 - DNA, 16 bp, H. sapiens
attcccattgttggag

SEQ ID NO: 54683 - DNA, 16 bp, H. sapiens
attcccatttataaaa

SEQ ID NO: 54684 - DNA, 16 bp, H. sapiens
attcccatttcacaga

SEQ ID NO: 54685 - DNA, 16 bp, H. sapiens
attcccattttagaga

SEQ ID NO: 54686 - DNA, 16 bp, H. sapiens
attcccattttgcaaa

SEQ ID NO: 54687 - DNA, 25 bp, H. sapiens
attccccacaggccagcaggcagtt

SEQ ID NO: 54688 - DNA, 16 bp, H. sapiens
attcccggctaatttt

SEQ ID NO: 54689 - DNA, 16 bp, H. sapiens
attccctagttaataa

SEQ ID NO: 54690 - DNA, 16 bp, H. sapiens
attccctatattaaat

SEQ ID NO: 54691 - DNA, 16 bp, H. sapiens
attccctatttaagaa

SEQ ID NO: 54692 - DNA, 44 bp, H. sapiens
attccctatttaataaatggtgctgggaaaactggctagccata

SEQ ID NO: 54693 - DNA, 16 bp, H. sapiens
attccctcctcctcaa

SEQ ID NO: 54694 - DNA, 16 bp, H. sapiens
attcccttcatcattt

SEQ ID NO: 54695 - DNA, 16 bp, H. sapiens
attcccttctcctgcc

SEQ ID NO: 54696 - DNA, 16 bp, H. sapiens
attcccttctcttcaa

SEQ ID NO: 54697 - DNA, 16 bp, H. sapiens
attcccttggtggcaa

SEQ ID NO: 54698 - DNA, 16 bp, H. sapiens
attccctttaaaaact

SEQ ID NO: 54699 - DNA, 16 bp, H. sapiens
attccctttcctagcc

SEQ ID NO: 54700 - DNA, 16 bp, H. sapiens
attccctttgaaaacc

SEQ ID NO: 54701 - DNA, 16 bp, H. sapiens
attccgaggacaggcc

SEQ ID NO: 54702 - DNA, 16 bp, H. sapiens
attccgtgtctttgct

SEQ ID NO: 54703 - DNA, 16 bp, H. sapiens
attcctaagtatttta

SEQ ID NO: 54704 - DNA, 16 bp, H. sapiens
attcctaagtattttt

SEQ ID NO: 54705 - DNA, 16 bp, H. sapiens
attcctaatttcttct

SEQ ID NO: 54706 - DNA, 16 bp, H. sapiens
attcctactcatcctt

SEQ ID NO: 54707 - DNA, 16 bp, H. sapiens
attcctagatatttta

SEQ ID NO: 54708 - DNA, 16 bp, H. sapiens
attcctagtttgctaa

SEQ ID NO: 54709 - DNA, 18 bp, H. sapiens
attcctcaagaatctaga

SEQ ID NO: 54710 - DNA, 18 bp, H. sapiens
attcctcaaggatctaaa

SEQ ID NO: 54711 - DNA, 19 bp, H. sapiens
attcctcaaggatctagaa

SEQ ID NO: 54712 - DNA, 16 bp, H. sapiens
attcctcacagaatta

SEQ ID NO: 54713 - DNA, 21 bp, H. sapiens
attcctcagggatctagaact

SEQ ID NO: 54714 - DNA, 21 bp, H. sapiens
attcctcagggatctagaagt

SEQ ID NO: 54715 - DNA, 16 bp, H. sapiens
attcctcatgaatggt

SEQ ID NO: 54716 - DNA, 17 bp, H. sapiens
attcctcgacacataca

SEQ ID NO: 54717 - DNA, 16 bp, H. sapiens
attcctgacccacaga

SEQ ID NO: 54718 - DNA, 17 bp, H. sapiens
attcctgagttacttca

SEQ ID NO: 54719 - DNA, 16 bp, H. sapiens
attcctgatgttggta

SEQ ID NO: 54720 - DNA, 16 bp, H. sapiens
attcctgcattagttt

SEQ ID NO: 54721 - DNA, 16 bp, H. sapiens
attcctgcttgctttt

SEQ ID NO: 54722 - DNA, 17 bp, H. sapiens
attcctggaaaaataca

SEQ ID NO: 54723 - DNA, 16 bp, H. sapiens
attcctggaaaattca

SEQ ID NO: 54724 - DNA, 16 bp, H. sapiens
attcctggaataaacc

SEQ ID NO: 54725 - DNA, 16 bp, H. sapiens
attcctggctaatttt

SEQ ID NO: 54726 - DNA, 16 bp, H. sapiens
attcctgggataaatt

SEQ ID NO: 54727 - DNA, 16 bp, H. sapiens
attcctgggatgcaag

SEQ ID NO: 54728 - DNA, 16 bp, H. sapiens
attcctgggctccacc

SEQ ID NO: 54729 - DNA, 16 bp, H. sapiens
attcctgggggaaaaa

SEQ ID NO: 54730 - DNA, 16 bp, H. sapiens
attcctgggttacttc

SEQ ID NO: 54731 - DNA, 16 bp, H. sapiens
attcctgggttcaaat

SEQ ID NO: 54732 - DNA, 16 bp, H. sapiens
attcctgtcttcctct

SEQ ID NO: 54733 - DNA, 16 bp, H. sapiens
attcctgttgtttata

SEQ ID NO: 54734 - DNA, 16 bp, H. sapiens
attcctgttttacaga

SEQ ID NO: 54735 - DNA, 16 bp, H. sapiens
attcctgtttttaaaa

SEQ ID NO: 54736 - DNA, 16 bp, H. sapiens
attccttaaaattttc

SEQ ID NO: 54737 - DNA, 16 bp, H. sapiens
attccttacaggaaac

SEQ ID NO: 54738 - DNA, 16 bp, H. sapiens
attccttataataaac

SEQ ID NO: 54739 - DNA, 16 bp, H. sapiens
attccttcagcaaaca

SEQ ID NO: 54740 - DNA, 16 bp, H. sapiens
attccttcattttcag

SEQ ID NO: 54741 - DNA, 16 bp, H. sapiens
attccttcctcacagt

SEQ ID NO: 54742 - DNA, 16 bp, H. sapiens
attccttctaactgaa

SEQ ID NO: 54743 - DNA, 16 bp, H. sapiens
attccttctagttttt

SEQ ID NO: 54744 - DNA, 34 bp, H. sapiens
attccttctgaaactattccaatcaacagaaaaa

SEQ ID NO: 54745 - DNA, 16 bp, H. sapiens
attccttctgaaagta

SEQ ID NO: 54746 - DNA, 16 bp, H. sapiens
attccttcttatggct

SEQ ID NO: 54747 - DNA, 16 bp, H. sapiens
attccttcttgctcag

SEQ ID NO: 54748 - DNA, 16 bp, H. sapiens
attccttgcaataaat

SEQ ID NO: 54749 - DNA, 16 bp, H. sapiens
attccttggctcatgg

SEQ ID NO: 54750 - DNA, 16 bp, H. sapiens
attccttggctcctgg

SEQ ID NO: 54751 - DNA, 16 bp, H. sapiens
attccttggttataaa

SEQ ID NO: 54752 - DNA, 16 bp, H. sapiens
attccttggtttttgt

SEQ ID NO: 54753 - DNA, 16 bp, H. sapiens
attcctttaaaaacta

SEQ ID NO: 54754 - DNA, 16 bp, H. sapiens
attcctttaaatgaat

SEQ ID NO: 54755 - DNA, 16 bp, H. sapiens
attcctttataacaat

SEQ ID NO: 54756 - DNA, 16 bp, H. sapiens
attcctttattttcaa

SEQ ID NO: 54757 - DNA, 16 bp, H. sapiens
attcctttccctttag

SEQ ID NO: 54758 - DNA, 16 bp, H. sapiens
attcctttgggtattt

SEQ ID NO: 54759 - DNA, 16 bp, H. sapiens
attccttttaaaaatt

SEQ ID NO: 54760 - DNA, 16 bp, H. sapiens
attccttttatataaa

SEQ ID NO: 54761 - DNA, 16 bp, H. sapiens
attccttttcatgact

SEQ ID NO: 54762 - DNA, 16 bp, H. sapiens
attcctttttaaagct

SEQ ID NO: 54763 - DNA, 16 bp, H. sapiens
attccttttttgtgtg

SEQ ID NO: 54764 - DNA, 16 bp, H. sapiens
attcgcccaccttggc

SEQ ID NO: 54765 - DNA, 16 bp, H. sapiens
attcggttgtgaatcc

SEQ ID NO: 54766 - DNA, 16 bp, H. sapiens
attctaaaagataagt

SEQ ID NO: 54767 - DNA, 16 bp, H. sapiens
attctaaaatccaaaa

SEQ ID NO: 54768 - DNA, 16 bp, H. sapiens
attctaaaattcaaat

SEQ ID NO: 54769 - DNA, 16 bp, H. sapiens
attctaaaattcattt

SEQ ID NO: 54770 - DNA, 16 bp, H. sapiens
attctaaaatttgttt

SEQ ID NO: 54771 - DNA, 16 bp, H. sapiens
attctaaataaatgtt

SEQ ID NO: 54772 - DNA, 16 bp, H. sapiens
attctaaatattttgt

SEQ ID NO: 54773 - DNA, 16 bp, H. sapiens
attctaaatctgaaaa

SEQ ID NO: 54774 - DNA, 16 bp, H. sapiens
attctaaggaaataat

SEQ ID NO: 54775 - DNA, 17 bp, H. sapiens
attctaagtcacaggat

SEQ ID NO: 54776 - DNA, 16 bp, H. sapiens
attctaatggaagaga

SEQ ID NO: 54777 - DNA, 16 bp, H. sapiens
attctacaaaatacct

SEQ ID NO: 54778 - DNA, 16 bp, H. sapiens
attctacaaaatagaa

SEQ ID NO: 54779 - DNA, 16 bp, H. sapiens
attctacaaaatcagt

SEQ ID NO: 54780 - DNA, 16 bp, H. sapiens
attctacagaaagagt

SEQ ID NO: 54781 - DNA, 16 bp, H. sapiens
attctacagaagtaaa

SEQ ID NO: 54782 - DNA, 16 bp, H. sapiens
attctacattacggtg

SEQ ID NO: 54783 - DNA, 16 bp, H. sapiens
attctactgaaattat

SEQ ID NO: 54784 - DNA, 16 bp, H. sapiens
attctactgcctcagc

SEQ ID NO: 54785 - DNA, 16 bp, H. sapiens
attctactgtctcagc

SEQ ID NO: 54786 - DNA, 16 bp, H. sapiens
attctacttctaagaa

SEQ ID NO: 54787 - DNA, 16 bp, H. sapiens
attctacttttcttga

SEQ ID NO: 54788 - DNA, 16 bp, H. sapiens
attctagaaattaaaa

SEQ ID NO: 54789 - DNA, 16 bp, H. sapiens
attctagaagaaatgg

SEQ ID NO: 54790 - DNA, 16 bp, H. sapiens
attctagaatattttt

SEQ ID NO: 54791 - DNA, 16 bp, H. sapiens
attctagaatcaggca

SEQ ID NO: 54792 - DNA, 16 bp, H. sapiens
attctagagttgaaaa

SEQ ID NO: 54793 - DNA, 16 bp, H. sapiens
attctagatatttctt

SEQ ID NO: 54794 - DNA, 16 bp, H. sapiens
attctagcctaggtga

SEQ ID NO: 54795 - DNA, 16 bp, H. sapiens
attctaggttgaaaat

SEQ ID NO: 54796 - DNA, 16 bp, H. sapiens
attctagtcagaccag

SEQ ID NO: 54797 - DNA, 16 bp, H. sapiens
attctagtgcctcagc

SEQ ID NO: 54798 - DNA, 16 bp, H. sapiens
attctataaaacattt

SEQ ID NO: 54799 - DNA, 16 bp, H. sapiens
attctatctcaataaa

SEQ ID NO: 54800 - DNA, 16 bp, H. sapiens
attctattaatgtgat

SEQ ID NO: 54801 - DNA, 16 bp, H. sapiens
attctatttatttggg

SEQ ID NO: 54802 - DNA, 16 bp, H. sapiens
attctatttgttagaa

SEQ ID NO: 54803 - DNA, 16 bp, H. sapiens
attctattttcaaata

SEQ ID NO: 54804 - DNA, 16 bp, H. sapiens
attctattttcagaaa

SEQ ID NO: 54805 - DNA, 16 bp, H. sapiens
attctattttgattta

SEQ ID NO: 54806 - DNA, 16 bp, H. sapiens
attctattttgtttaa

SEQ ID NO: 54807 - DNA, 16 bp, H. sapiens
attctatttttatgaa

SEQ ID NO: 54808 - DNA, 16 bp, H. sapiens
attctcaaaatacatt

SEQ ID NO: 54809 - DNA, 16 bp, H. sapiens
attctcaaatatgaaa

SEQ ID NO: 54810 - DNA, 16 bp, H. sapiens
attctcaaatatttat

SEQ ID NO: 54811 - DNA, 16 bp, H. sapiens
attctcaagcctcagc

SEQ ID NO: 54812 - DNA, 16 bp, H. sapiens
attctcaatttttaaa

SEQ ID NO: 54813 - DNA, 16 bp, H. sapiens
attctcagaagaaaaa

SEQ ID NO: 54814 - DNA, 16 bp, H. sapiens
attctcagcttacaaa

SEQ ID NO: 54815 - DNA, 16 bp, H. sapiens
attctcagcttacgaa

SEQ ID NO: 54816 - DNA, 16 bp, H. sapiens
attctcaggcctcagc

SEQ ID NO: 54817 - DNA, 16 bp, H. sapiens
attctcaggtctggag

SEQ ID NO: 54818 - DNA, 17 bp, H. sapiens
attctcatcatttagct

SEQ ID NO: 54819 - DNA, 16 bp, H. sapiens
attctcatgcatcagc

SEQ ID NO: 54820 - DNA, 16 bp, H. sapiens
attctcatgcctcagc

SEQ ID NO: 54821 - DNA, 17 bp, H. sapiens
attctcatgccttagcc

SEQ ID NO: 54822 - DNA, 16 bp, H. sapiens
attctcatggctcagc

SEQ ID NO: 54823 - DNA, 18 bp, H. sapiens
attctcatgtctcagcct

SEQ ID NO: 54824 - DNA, 16 bp, H. sapiens
attctcattattcaca

SEQ ID NO: 54825 - DNA, 16 bp, H. sapiens
attctcattcctcagc

SEQ ID NO: 54826 - DNA, 16 bp, H. sapiens
attctcattgctgtat

SEQ ID NO: 54827 - DNA, 16 bp, H. sapiens
attctcattttacaga

SEQ ID NO: 54828 - DNA, 16 bp, H. sapiens
attctcattttatgaa

SEQ ID NO: 54829 - DNA, 16 bp, H. sapiens
attctcattttgcaaa

SEQ ID NO: 54830 - DNA, 16 bp, H. sapiens
attctccaaagcagtg

SEQ ID NO: 54831 - DNA, 16 bp, H. sapiens
attctccaagattcat

SEQ ID NO: 54832 - DNA, 16 bp, H. sapiens
attctccaagcccagg

SEQ ID NO: 54833 - DNA, 16 bp, H. sapiens
attctccaagtttgaa

SEQ ID NO: 54834 - DNA, 16 bp, H. sapiens
attctccacacagcag

SEQ ID NO: 54835 - DNA, 16 bp, H. sapiens
attctccaggacagat

SEQ ID NO: 54836 - DNA, 16 bp, H. sapiens
attctccagtctcagc

SEQ ID NO: 54837 - DNA, 16 bp, H. sapiens
attctccattctcaac

SEQ ID NO: 54838 - DNA, 16 bp, H. sapiens
attctcccacagccct

SEQ ID NO: 54839 - DNA, 16 bp, H. sapiens
attctcccacctcaac

SEQ ID NO: 54840 - DNA, 16 bp, H. sapiens
attctcccacctcagc

SEQ ID NO: 54841 - DNA, 16 bp, H. sapiens
attctcccacctcagg

SEQ ID NO: 54842 - DNA, 16 bp, H. sapiens
attctcccacttcagt

SEQ ID NO: 54843 - DNA, 16 bp, H. sapiens
attctcccatctcagc

SEQ ID NO: 54844 - DNA, 16 bp, H. sapiens
attctccccacctcag

SEQ ID NO: 54845 - DNA, 16 bp, H. sapiens
attctcccctggagcc

SEQ ID NO: 54846 - DNA, 18 bp, H. sapiens
attctcccgcctcagcct

SEQ ID NO: 54847 - DNA, 16 bp, H. sapiens
attctcccgcctcagg

SEQ ID NO: 54848 - DNA, 16 bp, H. sapiens
attctcccggctcagc

SEQ ID NO: 54849 - DNA, 16 bp, H. sapiens
attctccctcctcggc

SEQ ID NO: 54850 - DNA, 16 bp, H. sapiens
attctcctacatgtgg

SEQ ID NO: 54851 - DNA, 16 bp, H. sapiens
attctcctcctgcctc

SEQ ID NO: 54852 - DNA, 16 bp, H. sapiens
attctcctgcattagc

SEQ ID NO: 54853 - DNA, 16 bp, H. sapiens
attctcctgccctggc

SEQ ID NO: 54854 - DNA, 16 bp, H. sapiens
attctcctgcctcaga

SEQ ID NO: 54855 - DNA, 17 bp, H. sapiens
attctcctgcctcagca

SEQ ID NO: 54856 - DNA, 17 bp, H. sapiens
attctcctgcctcagcc

SEQ ID NO: 54857 - DNA, 18 bp, H. sapiens
attctcctgcctcagccg

SEQ ID NO: 54858 - DNA, 19 bp, H. sapiens
attctcctgcctcagcctc

SEQ ID NO: 54859 - DNA, 19 bp, H. sapiens
attctcctgcctcagcctg

SEQ ID NO: 54860 - DNA, 17 bp, H. sapiens
attctcctgcctcagct

SEQ ID NO: 54861 - DNA, 16 bp, H. sapiens
attctcctgcctcagg

SEQ ID NO: 54862 - DNA, 18 bp, H. sapiens
attctcctgcctcggcct

SEQ ID NO: 54863 - DNA, 22 bp, H. sapiens
attctcctgcctgagcctccca

SEQ ID NO: 54864 - DNA, 18 bp, H. sapiens
attctcctgcttcagcct

SEQ ID NO: 54865 - DNA, 17 bp, H. sapiens
attctcctgcttcagcg

SEQ ID NO: 54866 - DNA, 19 bp, H. sapiens
attctcctggctcagcctc

SEQ ID NO: 54867 - DNA, 16 bp, H. sapiens
attctcctgtcacagc

SEQ ID NO: 54868 - DNA, 17 bp, H. sapiens
attctcctgtctcagct

SEQ ID NO: 54869 - DNA, 16 bp, H. sapiens
attctcgggcctcagc

SEQ ID NO: 54870 - DNA, 16 bp, H. sapiens
attctcgtgcctcaac

SEQ ID NO: 54871 - DNA, 16 bp, H. sapiens
attctcgtgcctcagc

SEQ ID NO: 54872 - DNA, 19 bp, H. sapiens
attctcgtgcctcggcctc

SEQ ID NO: 54873 - DNA, 16 bp, H. sapiens
attctcgtgcttcagc

SEQ ID NO: 54874 - DNA, 16 bp, H. sapiens
attctctacttctatg

SEQ ID NO: 54875 - DNA, 16 bp, H. sapiens
attctctcagcatttt

SEQ ID NO: 54876 - DNA, 16 bp, H. sapiens
attctctccagcatct

SEQ ID NO: 54877 - DNA, 16 bp, H. sapiens
attctctcctggcctg

SEQ ID NO: 54878 - DNA, 16 bp, H. sapiens
attctctctcctgcct

SEQ ID NO: 54879 - DNA, 16 bp, H. sapiens
attctctctgtgtgtg

SEQ ID NO: 54880 - DNA, 16 bp, H. sapiens
attctctctttgtcct

SEQ ID NO: 54881 - DNA, 16 bp, H. sapiens
attctctgaccacagt

SEQ ID NO: 54882 - DNA, 16 bp, H. sapiens
attctctgctcactgc

SEQ ID NO: 54883 - DNA, 16 bp, H. sapiens
attctctgtgcctcag

SEQ ID NO: 54884 - DNA, 16 bp, H. sapiens
attctcttctggcctg

SEQ ID NO: 54885 - DNA, 16 bp, H. sapiens
attctcttgaaaaaaa

SEQ ID NO: 54886 - DNA, 16 bp, H. sapiens
attctcttgcttcagc

SEQ ID NO: 54887 - DNA, 18 bp, H. sapiens
attctcttgcttcagcct

SEQ ID NO: 54888 - DNA, 16 bp, H. sapiens
attctcttggcaagaa

SEQ ID NO: 54889 - DNA, 16 bp, H. sapiens
attctcttgtctcagc

SEQ ID NO: 54890 - DNA, 16 bp, H. sapiens
attctctttatgtggt

SEQ ID NO: 54891 - DNA, 17 bp, H. sapiens
attctctttgaaaactg

SEQ ID NO: 54892 - DNA, 16 bp, H. sapiens
attctctttgaagaaa

SEQ ID NO: 54893 - DNA, 16 bp, H. sapiens
attctctttgcctcag

SEQ ID NO: 54894 - DNA, 16 bp, H. sapiens
attctctttgccttca

SEQ ID NO: 54895 - DNA, 16 bp, H. sapiens
attctctttgcctttg

SEQ ID NO: 54896 - DNA, 16 bp, H. sapiens
attctctttggagcaa

SEQ ID NO: 54897 - DNA, 18 bp, H. sapiens
attctctttgtagtaatt

SEQ ID NO: 54898 - DNA, 16 bp, H. sapiens
attctgaaaaagaaaa

SEQ ID NO: 54899 - DNA, 16 bp, H. sapiens
attctgaaaaataaag

SEQ ID NO: 54900 - DNA, 16 bp, H. sapiens
attctgaaaaatagaa

SEQ ID NO: 54901 - DNA, 16 bp, H. sapiens
attctgaaataattta

SEQ ID NO: 54902 - DNA, 16 bp, H. sapiens
attctgaaataatttc

SEQ ID NO: 54903 - DNA, 16 bp, H. sapiens
attctgaaataatttt

SEQ ID NO: 54904 - DNA, 16 bp, H. sapiens
attctgaaatatttgt

SEQ ID NO: 54905 - DNA, 16 bp, H. sapiens
attctgaaatgaaaaa

SEQ ID NO: 54906 - DNA, 16 bp, H. sapiens
attctgaaattcttaa

SEQ ID NO: 54907 - DNA, 16 bp, H. sapiens
attctgaaatttttct

SEQ ID NO: 54908 - DNA, 16 bp, H. sapiens
attctgaacattttat

SEQ ID NO: 54909 - DNA, 16 bp, H. sapiens
attctgaagaaataaa

SEQ ID NO: 54910 - DNA, 16 bp, H. sapiens
attctgaagatatttt

SEQ ID NO: 54911 - DNA, 16 bp, H. sapiens
attctgaatataaaat

SEQ ID NO: 54912 - DNA, 16 bp, H. sapiens
attctgaatatttcat

SEQ ID NO: 54913 - DNA, 16 bp, H. sapiens
attctgaatatttttt

SEQ ID NO: 54914 - DNA, 16 bp, H. sapiens
attctgaatggtgtga

SEQ ID NO: 54915 - DNA, 16 bp, H. sapiens
attctgaatgtatttt

SEQ ID NO: 54916 - DNA, 16 bp, H. sapiens
attctgaattccattt

SEQ ID NO: 54917 - DNA, 16 bp, H. sapiens
attctgaattctctgt

SEQ ID NO: 54918 - DNA, 16 bp, H. sapiens
attctgacaaacttct

SEQ ID NO: 54919 - DNA, 16 bp, H. sapiens
attctgactgctgtga

SEQ ID NO: 54920 - DNA, 16 bp, H. sapiens
attctgagaaatgcat

SEQ ID NO: 54921 - DNA, 16 bp, H. sapiens
attctgaggttctgag

SEQ ID NO: 54922 - DNA, 16 bp, H. sapiens
attctgataaaagaaa

SEQ ID NO: 54923 - DNA, 16 bp, H. sapiens
attctgattcagaagg

SEQ ID NO: 54924 - DNA, 16 bp, H. sapiens
attctgattggtgtga

SEQ ID NO: 54925 - DNA, 16 bp, H. sapiens
attctgatttaattgg

SEQ ID NO: 54926 - DNA, 16 bp, H. sapiens
attctgcaagtggaca

SEQ ID NO: 54927 - DNA, 16 bp, H. sapiens
attctgcagaaggagt

SEQ ID NO: 54928 - DNA, 16 bp, H. sapiens
attctgcagatgagaa

SEQ ID NO: 54929 - DNA, 16 bp, H. sapiens
attctgcagcctcagc

SEQ ID NO: 54930 - DNA, 16 bp, H. sapiens
attctgcagctgttag

SEQ ID NO: 54931 - DNA, 16 bp, H. sapiens
attctgcatattagac

SEQ ID NO: 54932 - DNA, 16 bp, H. sapiens
attctgcattgaaaat

SEQ ID NO: 54933 - DNA, 16 bp, H. sapiens
attctgcccctggacc

SEQ ID NO: 54934 - DNA, 16 bp, H. sapiens
attctgcctaccacag

SEQ ID NO: 54935 - DNA, 16 bp, H. sapiens
attctgctgcccaggc

SEQ ID NO: 54936 - DNA, 16 bp, H. sapiens
attctgctgttgttag

SEQ ID NO: 54937 - DNA, 16 bp, H. sapiens
attctgctgttgttga

SEQ ID NO: 54938 - DNA, 16 bp, H. sapiens
attctgctttctgtct

SEQ ID NO: 54939 - DNA, 16 bp, H. sapiens
attctgctttctgttt

SEQ ID NO: 54940 - DNA, 16 bp, H. sapiens
attctgcttttgttgg

SEQ ID NO: 54941 - DNA, 16 bp, H. sapiens
attctggaaaacagtt

SEQ ID NO: 54942 - DNA, 16 bp, H. sapiens
attctggaactgaaga

SEQ ID NO: 54943 - DNA, 16 bp, H. sapiens
attctggaagctgaga

SEQ ID NO: 54944 - DNA, 17 bp, H. sapiens
attctggacataggaat

SEQ ID NO: 54945 - DNA, 16 bp, H. sapiens
attctggagctgaaat

SEQ ID NO: 54946 - DNA, 16 bp, H. sapiens
attctggagctggaaa

SEQ ID NO: 54947 - DNA, 16 bp, H. sapiens
attctggaggctggaa

SEQ ID NO: 54948 - DNA, 16 bp, H. sapiens
attctggatatatttt

SEQ ID NO: 54949 - DNA, 16 bp, H. sapiens
attctggatattagtc

SEQ ID NO: 54950 - DNA, 16 bp, H. sapiens
attctggccaacatgg

SEQ ID NO: 54951 - DNA, 16 bp, H. sapiens
attctggctattaacc

SEQ ID NO: 54952 - DNA, 16 bp, H. sapiens
attctggctgcactgg

SEQ ID NO: 54953 - DNA, 16 bp, H. sapiens
attctggcttttgttg

SEQ ID NO: 54954 - DNA, 16 bp, H. sapiens
attctgggattacagg

SEQ ID NO: 54955 - DNA, 16 bp, H. sapiens
attctggggaaaaaaa

SEQ ID NO: 54956 - DNA, 16 bp, H. sapiens
attctgggggaaaaaa

SEQ ID NO: 54957 - DNA, 16 bp, H. sapiens
attctggtcaacatgg

SEQ ID NO: 54958 - DNA, 16 bp, H. sapiens
attctggtctcctaca

SEQ ID NO: 54959 - DNA, 16 bp, H. sapiens
attctggtgatagtga

SEQ ID NO: 54960 - DNA, 16 bp, H. sapiens
attctgtactcttggc

SEQ ID NO: 54961 - DNA, 16 bp, H. sapiens
attctgtatatatata

SEQ ID NO: 54962 - DNA, 16 bp, H. sapiens
attctgtatgcctttg

SEQ ID NO: 54963 - DNA, 16 bp, H. sapiens
attctgtattttttaa

SEQ ID NO: 54964 - DNA, 16 bp, H. sapiens
attctgtcagtgtttg

SEQ ID NO: 54965 - DNA, 16 bp, H. sapiens
attctgtcatttgtaa

SEQ ID NO: 54966 - DNA, 16 bp, H. sapiens
attctgtccctggtcc

SEQ ID NO: 54967 - DNA, 16 bp, H. sapiens
attctgtctaaaaaaa

SEQ ID NO: 54968 - DNA, 16 bp, H. sapiens
attctgtgaagaatga

SEQ ID NO: 54969 - DNA, 16 bp, H. sapiens
attctgtgaatggata

SEQ ID NO: 54970 - DNA, 16 bp, H. sapiens
attctgtgagtccatg

SEQ ID NO: 54971 - DNA, 16 bp, H. sapiens
attctgtgattctgtg

SEQ ID NO: 54972 - DNA, 16 bp, H. sapiens
attctgtgtttaactt

SEQ ID NO: 54973 - DNA, 16 bp, H. sapiens
attctgtgtttttctg

SEQ ID NO: 54974 - DNA, 16 bp, H. sapiens
attctgttaaatattt

SEQ ID NO: 54975 - DNA, 16 bp, H. sapiens
attctgttaatgtaat

SEQ ID NO: 54976 - DNA, 16 bp, H. sapiens
attctgttacagcagc

SEQ ID NO: 54977 - DNA, 16 bp, H. sapiens
attctgttatttgcaa

SEQ ID NO: 54978 - DNA, 16 bp, H. sapiens
attctgttatttttgg

SEQ ID NO: 54979 - DNA, 16 bp, H. sapiens
attctgttgcctcagc

SEQ ID NO: 54980 - DNA, 16 bp, H. sapiens
attctgtttaaatttt

SEQ ID NO: 54981 - DNA, 16 bp, H. sapiens
attctgttttatttaa

SEQ ID NO: 54982 - DNA, 16 bp, H. sapiens
attctgtttttaaaaa

SEQ ID NO: 54983 - DNA, 16 bp, H. sapiens
attctgtttttagtag

SEQ ID NO: 54984 - DNA, 16 bp, H. sapiens
attctgtttttcacat

SEQ ID NO: 54985 - DNA, 16 bp, H. sapiens
attctgttttttaaaa

SEQ ID NO: 54986 - DNA, 16 bp, H. sapiens
attctgttttttaaat

SEQ ID NO: 54987 - DNA, 16 bp, H. sapiens
attcttaaaaagaaaa

SEQ ID NO: 54988 - DNA, 16 bp, H. sapiens
attcttaaaaattgaa

SEQ ID NO: 54989 - DNA, 16 bp, H. sapiens
attcttaagtgtttta

SEQ ID NO: 54990 - DNA, 16 bp, H. sapiens
attcttaatcacatct

SEQ ID NO: 54991 - DNA, 16 bp, H. sapiens
attcttacagaaaaga

SEQ ID NO: 54992 - DNA, 16 bp, H. sapiens
attcttaccagcagtg

SEQ ID NO: 54993 - DNA, 16 bp, H. sapiens
attcttagctcacagg

SEQ ID NO: 54994 - DNA, 16 bp, H. sapiens
attcttatactttaag

SEQ ID NO: 54995 - DNA, 16 bp, H. sapiens
attcttattttataag

SEQ ID NO: 54996 - DNA, 16 bp, H. sapiens
attcttcaaagaaata

SEQ ID NO: 54997 - DNA, 16 bp, H. sapiens
attcttcaaagaacta

SEQ ID NO: 54998 - DNA, 16 bp, H. sapiens
attcttcaaggtcaaa

SEQ ID NO: 54999 - DNA, 16 bp, H. sapiens
attcttcacagaaaaa

SEQ ID NO: 55000 - DNA, 16 bp, H. sapiens
attcttcagttgttgg

SEQ ID NO: 55001 - DNA, 16 bp, H. sapiens
attcttcatctctgtt

SEQ ID NO: 55002 - DNA, 16 bp, H. sapiens
attcttcatgaaaaca

SEQ ID NO: 55003 - DNA, 16 bp, H. sapiens
attcttccaaatattt

SEQ ID NO: 55004 - DNA, 16 bp, H. sapiens
attcttccaatctgtg

SEQ ID NO: 55005 - DNA, 16 bp, H. sapiens
attcttccatttgttt

SEQ ID NO: 55006 - DNA, 16 bp, H. sapiens
attcttcctaaccatg

SEQ ID NO: 55007 - DNA, 16 bp, H. sapiens
attcttctaaactttt

SEQ ID NO: 55008 - DNA, 16 bp, H. sapiens
attcttctcagcacca

SEQ ID NO: 55009 - DNA, 16 bp, H. sapiens
attcttctcagcacct

SEQ ID NO: 55010 - DNA, 16 bp, H. sapiens
attcttctcatcacca

SEQ ID NO: 55011 - DNA, 16 bp, H. sapiens
attcttctccttgctg

SEQ ID NO: 55012 - DNA, 16 bp, H. sapiens
attcttctctgatctt

SEQ ID NO: 55013 - DNA, 16 bp, H. sapiens
attcttctgcctcaac

SEQ ID NO: 55014 - DNA, 16 bp, H. sapiens
attcttctgccttggc

SEQ ID NO: 55015 - DNA, 16 bp, H. sapiens
attcttctggacattg

SEQ ID NO: 55016 - DNA, 16 bp, H. sapiens
attcttctgtatattt

SEQ ID NO: 55017 - DNA, 16 bp, H. sapiens
attcttcttcagcttc

SEQ ID NO: 55018 - DNA, 16 bp, H. sapiens
attcttcttctccctg

SEQ ID NO: 55019 - DNA, 16 bp, H. sapiens
attcttcttggcttct

SEQ ID NO: 55020 - DNA, 16 bp, H. sapiens
attcttgaaaattgct

SEQ ID NO: 55021 - DNA, 16 bp, H. sapiens
attcttgaatattttt

SEQ ID NO: 55022 - DNA, 16 bp, H. sapiens
attcttgcatccctgg

SEQ ID NO: 55023 - DNA, 16 bp, H. sapiens
attcttgccaagagaa

SEQ ID NO: 55024 - DNA, 16 bp, H. sapiens
attcttgctgtacttt

SEQ ID NO: 55025 - DNA, 16 bp, H. sapiens
attcttggtgcctttg

SEQ ID NO: 55026 - DNA, 16 bp, H. sapiens
attcttgtctgcatgt

SEQ ID NO: 55027 - DNA, 16 bp, H. sapiens
attcttgtgcctcagc

SEQ ID NO: 55028 - DNA, 16 bp, H. sapiens
attcttgtgcttcagc

SEQ ID NO: 55029 - DNA, 16 bp, H. sapiens
attctttaaagaaaga

SEQ ID NO: 55030 - DNA, 16 bp, H. sapiens
attctttaaatttctg

SEQ ID NO: 55031 - DNA, 16 bp, H. sapiens
attctttacatgtttt

SEQ ID NO: 55032 - DNA, 16 bp, H. sapiens
attctttagaattttt

SEQ ID NO: 55033 - DNA, 16 bp, H. sapiens
attctttcaaactatt

SEQ ID NO: 55034 - DNA, 16 bp, H. sapiens
attctttcaactttta

SEQ ID NO: 55035 - DNA, 16 bp, H. sapiens
attctttcaataaata

SEQ ID NO: 55036 - DNA, 16 bp, H. sapiens
attctttcacccaggc

SEQ ID NO: 55037 - DNA, 16 bp, H. sapiens
attctttcagattttc

SEQ ID NO: 55038 - DNA, 16 bp, H. sapiens
attctttcagcagtgt

SEQ ID NO: 55039 - DNA, 16 bp, H. sapiens
attctttcagttgtga

SEQ ID NO: 55040 - DNA, 16 bp, H. sapiens
attctttcagtttttg

SEQ ID NO: 55041 - DNA, 16 bp, H. sapiens
attctttccagttttt

SEQ ID NO: 55042 - DNA, 16 bp, H. sapiens
attctttcctctgtct

SEQ ID NO: 55043 - DNA, 16 bp, H. sapiens
attctttctctgtgtt

SEQ ID NO: 55044 - DNA, 16 bp, H. sapiens
attctttcttctgcct

SEQ ID NO: 55045 - DNA, 16 bp, H. sapiens
attctttctttcaaca

SEQ ID NO: 55046 - DNA, 16 bp, H. sapiens
attctttgaaaaaaaa

SEQ ID NO: 55047 - DNA, 16 bp, H. sapiens
attctttgaaaaatga

SEQ ID NO: 55048 - DNA, 16 bp, H. sapiens
attctttgaaaacaaa

SEQ ID NO: 55049 - DNA, 16 bp, H. sapiens
attctttgaaatattt

SEQ ID NO: 55050 - DNA, 16 bp, H. sapiens
attctttgaaatggaa

SEQ ID NO: 55051 - DNA, 16 bp, H. sapiens
attctttgaacatatt

SEQ ID NO: 55052 - DNA, 16 bp, H. sapiens
attctttgaagaatgt

SEQ ID NO: 55053 - DNA, 16 bp, H. sapiens
attctttgaagacaaa

SEQ ID NO: 55054 - DNA, 16 bp, H. sapiens
attctttgagattttc

SEQ ID NO: 55055 - DNA, 16 bp, H. sapiens
attctttgcaataaat

SEQ ID NO: 55056 - DNA, 16 bp, H. sapiens
attctttgtccatttt

SEQ ID NO: 55057 - DNA, 16 bp, H. sapiens
attctttgtgatgatg

SEQ ID NO: 55058 - DNA, 16 bp, H. sapiens
attctttgtgtgtgtg

SEQ ID NO: 55059 - DNA, 16 bp, H. sapiens
attctttgttctaaat

SEQ ID NO: 55060 - DNA, 16 bp, H. sapiens
attcttttacatattg

SEQ ID NO: 55061 - DNA, 16 bp, H. sapiens
attcttttcaaaatgt

SEQ ID NO: 55062 - DNA, 16 bp, H. sapiens
attcttttcccattga

SEQ ID NO: 55063 - DNA, 16 bp, H. sapiens
attcttttcttcagca

SEQ ID NO: 55064 - DNA, 16 bp, H. sapiens
attcttttgaaaaaaa

SEQ ID NO: 55065 - DNA, 16 bp, H. sapiens
attcttttgaatttct

SEQ ID NO: 55066 - DNA, 16 bp, H. sapiens
attcttttgcctcagc

SEQ ID NO: 55067 - DNA, 16 bp, H. sapiens
attcttttggcagaat

SEQ ID NO: 55068 - DNA, 16 bp, H. sapiens
attcttttgtatatgg

SEQ ID NO: 55069 - DNA, 16 bp, H. sapiens
attctttttaaagtat

SEQ ID NO: 55070 - DNA, 16 bp, H. sapiens
attctttttaaatgaa

SEQ ID NO: 55071 - DNA, 16 bp, H. sapiens
attctttttctgaaaa

SEQ ID NO: 55072 - DNA, 16 bp, H. sapiens
attctttttgtgtgtg

SEQ ID NO: 55073 - DNA, 16 bp, H. sapiens
attcttttttaagtga

SEQ ID NO: 55074 - DNA, 16 bp, H. sapiens
attcttttttatggtg

SEQ ID NO: 55075 - DNA, 16 bp, H. sapiens
attgaaaaagagggac

SEQ ID NO: 55076 - DNA, 16 bp, H. sapiens
attgaaaacctggaaa

SEQ ID NO: 55077 - DNA, 16 bp, H. sapiens
attgaaaagatagttt

SEQ ID NO: 55078 - DNA, 16 bp, H. sapiens
attgaaaaggaggaag

SEQ ID NO: 55079 - DNA, 16 bp, H. sapiens
attgaaaatattcaaa

SEQ ID NO: 55080 - DNA, 16 bp, H. sapiens
attgaaaatattgtaa

SEQ ID NO: 55081 - DNA, 16 bp, H. sapiens
attgaaaattcttttc

SEQ ID NO: 55082 - DNA, 16 bp, H. sapiens
attgaaacagaaaata

SEQ ID NO: 55083 - DNA, 16 bp, H. sapiens
attgaaacaggaagaa

SEQ ID NO: 55084 - DNA, 16 bp, H. sapiens
attgaaacataaaatt

SEQ ID NO: 55085 - DNA, 17 bp, H. sapiens
attgaaactggacccct

SEQ ID NO: 55086 - DNA, 16 bp, H. sapiens
attgaaactgtaaatt

SEQ ID NO: 55087 - DNA, 16 bp, H. sapiens
attgaaacttcaacca

SEQ ID NO: 55088 - DNA, 16 bp, H. sapiens
attgaaaggagaaagt

SEQ ID NO: 55089 - DNA, 16 bp, H. sapiens
attgaaataaaaaact

SEQ ID NO: 55090 - DNA, 16 bp, H. sapiens
attgaaatgaatgaaa

SEQ ID NO: 55091 - DNA, 16 bp, H. sapiens
attgaaatgatatttt

SEQ ID NO: 55092 - DNA, 16 bp, H. sapiens
attgaaatgtttaaaa

SEQ ID NO: 55093 - DNA, 16 bp, H. sapiens
attgaaattatacaga

SEQ ID NO: 55094 - DNA, 16 bp, H. sapiens
attgaacactagaact

SEQ ID NO: 55095 - DNA, 16 bp, H. sapiens
attgaacacttaaaat

SEQ ID NO: 55096 - DNA, 16 bp, H. sapiens
attgaacccaggaggc

SEQ ID NO: 55097 - DNA, 16 bp, H. sapiens
attgaacctgggaggc

SEQ ID NO: 55098 - DNA, 16 bp, H. sapiens
attgaacctgggaggt

SEQ ID NO: 55099 - DNA, 16 bp, H. sapiens
attgaactcctgacct

SEQ ID NO: 55100 - DNA, 16 bp, H. sapiens
attgaactgagctctg

SEQ ID NO: 55101 - DNA, 16 bp, H. sapiens
attgaagaaatgcaaa

SEQ ID NO: 55102 - DNA, 16 bp, H. sapiens
attgaagaagaaacaa

SEQ ID NO: 55103 - DNA, 16 bp, H. sapiens
attgaagaagacacac

SEQ ID NO: 55104 - DNA, 16 bp, H. sapiens
attgaagaggactgat

SEQ ID NO: 55105 - DNA, 16 bp, H. sapiens
attgaagaggaggaaa

SEQ ID NO: 55106 - DNA, 16 bp, H. sapiens
attgaaggaacatatc

SEQ ID NO: 55107 - DNA, 16 bp, H. sapiens
attgaaggacattcta

SEQ ID NO: 55108 - DNA, 16 bp, H. sapiens
attgaaggagaaaaac

SEQ ID NO: 55109 - DNA, 16 bp, H. sapiens
attgaaggcacccctc

SEQ ID NO: 55110 - DNA, 16 bp, H. sapiens
attgaataatttctat

SEQ ID NO: 55111 - DNA, 16 bp, H. sapiens
attgaatcacgggggc

SEQ ID NO: 55112 - DNA, 16 bp, H. sapiens
attgaatcagaaactc

SEQ ID NO: 55113 - DNA, 16 bp, H. sapiens
attgaatcaggaagaa

SEQ ID NO: 55114 - DNA, 16 bp, H. sapiens
attgaatcagtaataa

SEQ ID NO: 55115 - DNA, 16 bp, H. sapiens
attgaatccctgaata

SEQ ID NO: 55116 - DNA, 16 bp, H. sapiens
attgaatctacaaatt

SEQ ID NO: 55117 - DNA, 16 bp, H. sapiens
attgaatctgtacatc

SEQ ID NO: 55118 - DNA, 16 bp, H. sapiens
attgaatgggaaaaag

SEQ ID NO: 55119 - DNA, 16 bp, H. sapiens
attgaattattcattt

SEQ ID NO: 55120 - DNA, 16 bp, H. sapiens
attgaattcaacagca

SEQ ID NO: 55121 - DNA, 16 bp, H. sapiens
attgaattcatggaga

SEQ ID NO: 55122 - DNA, 16 bp, H. sapiens
attgaattcttcagct

SEQ ID NO: 55123 - DNA, 16 bp, H. sapiens
attgaattgtacattt

SEQ ID NO: 55124 - DNA, 16 bp, H. sapiens
attgaatttatagatt

SEQ ID NO: 55125 - DNA, 16 bp, H. sapiens
attgaatttgtaggtt

SEQ ID NO: 55126 - DNA, 16 bp, H. sapiens
attgaattttaaaatg

SEQ ID NO: 55127 - DNA, 16 bp, H. sapiens
attgaattttcatttt

SEQ ID NO: 55128 - DNA, 16 bp, H. sapiens
attgaattttgttgaa

SEQ ID NO: 55129 - DNA, 16 bp, H. sapiens
attgacaaaaacaagc

SEQ ID NO: 55130 - DNA, 16 bp, H. sapiens
attgacaaagaagttt

SEQ ID NO: 55131 - DNA, 16 bp, H. sapiens
attgacacaataaaaa

SEQ ID NO: 55132 - DNA, 16 bp, H. sapiens
attgacacatcattat

SEQ ID NO: 55133 - DNA, 16 bp, H. sapiens
attgacagaagtagga

SEQ ID NO: 55134 - DNA, 16 bp, H. sapiens
attgacagagcaggag

SEQ ID NO: 55135 - DNA, 16 bp, H. sapiens
attgacattgtggact

SEQ ID NO: 55136 - DNA, 16 bp, H. sapiens
attgacatttataaaa

SEQ ID NO: 55137 - DNA, 16 bp, H. sapiens
attgacatttctccaa

SEQ ID NO: 55138 - DNA, 16 bp, H. sapiens
attgacatttttgaag

SEQ ID NO: 55139 - DNA, 16 bp, H. sapiens
attgaccatcagagaa

SEQ ID NO: 55140 - DNA, 16 bp, H. sapiens
attgaccatttgtatg

SEQ ID NO: 55141 - DNA, 16 bp, H. sapiens
attgactggaagcctt

SEQ ID NO: 55142 - DNA, 16 bp, H. sapiens
attgacttcttttcct

SEQ ID NO: 55143 - DNA, 16 bp, H. sapiens
attgacttggcaaatg

SEQ ID NO: 55144 - DNA, 16 bp, H. sapiens
attgacttggccatgc

SEQ ID NO: 55145 - DNA, 16 bp, H. sapiens
attgagaaaaaaatgt

SEQ ID NO: 55146 - DNA, 16 bp, H. sapiens
attgagaaaatatatt

SEQ ID NO: 55147 - DNA, 16 bp, H. sapiens
attgagaaataattca

SEQ ID NO: 55148 - DNA, 16 bp, H. sapiens
attgagaaccactgtt

SEQ ID NO: 55149 - DNA, 16 bp, H. sapiens
attgagaacctactat

SEQ ID NO: 55150 - DNA, 16 bp, H. sapiens
attgagaacctgtctt

SEQ ID NO: 55151 - DNA, 16 bp, H. sapiens
attgagaatgatgatt

SEQ ID NO: 55152 - DNA, 16 bp, H. sapiens
attgagaccattctgg

SEQ ID NO: 55153 - DNA, 16 bp, H. sapiens
attgagaccctgtctc

SEQ ID NO: 55154 - DNA, 16 bp, H. sapiens
attgagatatagttca

SEQ ID NO: 55155 - DNA, 16 bp, H. sapiens
attgagatattcatgt

SEQ ID NO: 55156 - DNA, 16 bp, H. sapiens
attgagatgaaattca

SEQ ID NO: 55157 - DNA, 16 bp, H. sapiens
attgagatgtaattca

SEQ ID NO: 55158 - DNA, 16 bp, H. sapiens
attgagcaacagaaca

SEQ ID NO: 55159 - DNA, 16 bp, H. sapiens
attgagcacttactgt

SEQ ID NO: 55160 - DNA, 16 bp, H. sapiens
attgagcacttgctgt

SEQ ID NO: 55161 - DNA, 16 bp, H. sapiens
attgagcatttgaaat

SEQ ID NO: 55162 - DNA, 16 bp, H. sapiens
attgagcattttggaa

SEQ ID NO: 55163 - DNA, 16 bp, H. sapiens
attgagctttttaaaa

SEQ ID NO: 55164 - DNA, 16 bp, H. sapiens
attgaggaccccaaag

SEQ ID NO: 55165 - DNA, 16 bp, H. sapiens
attgaggaggagggat

SEQ ID NO: 55166 - DNA, 16 bp, H. sapiens
attgaggagttttgca

SEQ ID NO: 55167 - DNA, 16 bp, H. sapiens
attgaggccaggagtt

SEQ ID NO: 55168 - DNA, 16 bp, H. sapiens
attgaggtcaggagtt

SEQ ID NO: 55169 - DNA, 16 bp, H. sapiens
attgaggtccagagag

SEQ ID NO: 55170 - DNA, 16 bp, H. sapiens
attgaggtgggaggat

SEQ ID NO: 55171 - DNA, 16 bp, H. sapiens
attgagtcacagttct

SEQ ID NO: 55172 - DNA, 16 bp, H. sapiens
attgagtcttcttatc

SEQ ID NO: 55173 - DNA, 17 bp, H. sapiens
attgagtcttgctctgt

SEQ ID NO: 55174 - DNA, 16 bp, H. sapiens
attgataaatcaagaa

SEQ ID NO: 55175 - DNA, 16 bp, H. sapiens
attgataattcttggg

SEQ ID NO: 55176 - DNA, 16 bp, H. sapiens
attgataggcatttgg

SEQ ID NO: 55177 - DNA, 17 bp, H. sapiens
attgatatggtttggat

SEQ ID NO: 55178 - DNA, 16 bp, H. sapiens
attgatatgttaatta

SEQ ID NO: 55179 - DNA, 16 bp, H. sapiens
attgatattcttcaca

SEQ ID NO: 55180 - DNA, 16 bp, H. sapiens
attgatcatcagagaa

SEQ ID NO: 55181 - DNA, 16 bp, H. sapiens
attgatcccaggtctt

SEQ ID NO: 55182 - DNA, 16 bp, H. sapiens
attgatctatatctct

SEQ ID NO: 55183 - DNA, 16 bp, H. sapiens
attgatctgggtggtg

SEQ ID NO: 55184 - DNA, 16 bp, H. sapiens
attgatcttttcttct

SEQ ID NO: 55185 - DNA, 16 bp, H. sapiens
attgatcttttgtgtt

SEQ ID NO: 55186 - DNA, 16 bp, H. sapiens
attgatgaaagaagtt

SEQ ID NO: 55187 - DNA, 16 bp, H. sapiens
attgatgaaatcattg

SEQ ID NO: 55188 - DNA, 16 bp, H. sapiens
attgatgaaattcaaa

SEQ ID NO: 55189 - DNA, 16 bp, H. sapiens
attgatgaagaaattg

SEQ ID NO: 55190 - DNA, 16 bp, H. sapiens
attgatgaaggaaatt

SEQ ID NO: 55191 - DNA, 16 bp, H. sapiens
attgatgactttttaa

SEQ ID NO: 55192 - DNA, 16 bp, H. sapiens
attgatgagaaaaata

SEQ ID NO: 55193 - DNA, 16 bp, H. sapiens
attgatgatgatgata

SEQ ID NO: 55194 - DNA, 16 bp, H. sapiens
attgatgctgggtggg

SEQ ID NO: 55195 - DNA, 16 bp, H. sapiens
attgatggacagttgg

SEQ ID NO: 55196 - DNA, 16 bp, H. sapiens
attgatgtgcaaaaat

SEQ ID NO: 55197 - DNA, 16 bp, H. sapiens
attgatgttcatcaga

SEQ ID NO: 55198 - DNA, 16 bp, H. sapiens
attgattaaatgaatg

SEQ ID NO: 55199 - DNA, 16 bp, H. sapiens
attgattaaattattg

SEQ ID NO: 55200 - DNA, 16 bp, H. sapiens
attgattcaaatgcta

SEQ ID NO: 55201 - DNA, 16 bp, H. sapiens
attgattcaatttcct

SEQ ID NO: 55202 - DNA, 16 bp, H. sapiens
attgattcattaattg

SEQ ID NO: 55203 - DNA, 16 bp, H. sapiens
attgattgattttctt

SEQ ID NO: 55204 - DNA, 16 bp, H. sapiens
attgattgtatcttga

SEQ ID NO: 55205 - DNA, 16 bp, H. sapiens
attgatttaaaaaaac

SEQ ID NO: 55206 - DNA, 16 bp, H. sapiens
attgatttctaatttt

SEQ ID NO: 55207 - DNA, 16 bp, H. sapiens
attgatttctgctttt

SEQ ID NO: 55208 - DNA, 16 bp, H. sapiens
attgatttctgttcta

SEQ ID NO: 55209 - DNA, 16 bp, H. sapiens
attgatttctttatta

SEQ ID NO: 55210 - DNA, 16 bp, H. sapiens
attgattttaaaatgt

SEQ ID NO: 55211 - DNA, 16 bp, H. sapiens
attgattttctacaaa

SEQ ID NO: 55212 - DNA, 16 bp, H. sapiens
attgattttcttatgt

SEQ ID NO: 55213 - DNA, 16 bp, H. sapiens
attgattttgtttcct

SEQ ID NO: 55214 - DNA, 16 bp, H. sapiens
attgatttttccattt

SEQ ID NO: 55215 - DNA, 16 bp, H. sapiens
attgatttttctataa

SEQ ID NO: 55216 - DNA, 16 bp, H. sapiens
attgatttttttccca

SEQ ID NO: 55217 - DNA, 16 bp, H. sapiens
attgatttttttcctc

SEQ ID NO: 55218 - DNA, 16 bp, H. sapiens
attgatttttttgaag

SEQ ID NO: 55219 - DNA, 16 bp, H. sapiens
attgcaaaaagcaaaa

SEQ ID NO: 55220 - DNA, 16 bp, H. sapiens
attgcaaaataaaaat

SEQ ID NO: 55221 - DNA, 16 bp, H. sapiens
attgcaaaggaagaag

SEQ ID NO: 55222 - DNA, 16 bp, H. sapiens
attgcaaatgagattg

SEQ ID NO: 55223 - DNA, 16 bp, H. sapiens
attgcaaatttcctga

SEQ ID NO: 55224 - DNA, 16 bp, H. sapiens
attgcaacagagaaag

SEQ ID NO: 55225 - DNA, 16 bp, H. sapiens
attgcaacattattta

SEQ ID NO: 55226 - DNA, 16 bp, H. sapiens
attgcaacctctgcct

SEQ ID NO: 55227 - DNA, 16 bp, H. sapiens
attgcaacctttgcct

SEQ ID NO: 55228 - DNA, 16 bp, H. sapiens
attgcaagaccccatc

SEQ ID NO: 55229 - DNA, 16 bp, H. sapiens
attgcaatagagaaag

SEQ ID NO: 55230 - DNA, 35 bp, H. sapiens
attgcaatcctagtctctgataaaacagactttaa

SEQ ID NO: 55231 - DNA, 16 bp, H. sapiens
attgcacatgagatgg

SEQ ID NO: 55232 - DNA, 16 bp, H. sapiens
attgcaccacagcact

SEQ ID NO: 55233 - DNA, 16 bp, H. sapiens
attgcaccactgctct

SEQ ID NO: 55234 - DNA, 16 bp, H. sapiens
attgcaccactgtgct

SEQ ID NO: 55235 - DNA, 16 bp, H. sapiens
attgcactactgcact

SEQ ID NO: 55236 - DNA, 18 bp, H. sapiens
attgcactccagcctcgg

SEQ ID NO: 55237 - DNA, 16 bp, H. sapiens
attgcactccaggcta

SEQ ID NO: 55238 - DNA, 16 bp, H. sapiens
attgcactgcagtctg

SEQ ID NO: 55239 - DNA, 16 bp, H. sapiens
attgcactgtgctctg

SEQ ID NO: 55240 - DNA, 16 bp, H. sapiens
attgcagcattattaa

SEQ ID NO: 55241 - DNA, 16 bp, H. sapiens
attgcagcctctgcct

SEQ ID NO: 55242 - DNA, 16 bp, H. sapiens
attgcagccttgacct

SEQ ID NO: 55243 - DNA, 16 bp, H. sapiens
attgcagctttattca

SEQ ID NO: 55244 - DNA, 16 bp, H. sapiens
attgcaggactattca

SEQ ID NO: 55245 - DNA, 16 bp, H. sapiens
attgcagtcagccaag

SEQ ID NO: 55246 - DNA, 16 bp, H. sapiens
attgcagtgatctgga

SEQ ID NO: 55247 - DNA, 16 bp, H. sapiens
attgcagtgattatgg

SEQ ID NO: 55248 - DNA, 16 bp, H. sapiens
attgcagttttcattt

SEQ ID NO: 55249 - DNA, 16 bp, H. sapiens
attgcatattttaaat

SEQ ID NO: 55250 - DNA, 16 bp, H. sapiens
attgcatccagcctgg

SEQ ID NO: 55251 - DNA, 16 bp, H. sapiens
attgcatctttatttt

SEQ ID NO: 55252 - DNA, 16 bp, H. sapiens
attgcattactttcca

SEQ ID NO: 55253 - DNA, 16 bp, H. sapiens
attgcattatttttct

SEQ ID NO: 55254 - DNA, 16 bp, H. sapiens
attgcattgaatatat

SEQ ID NO: 55255 - DNA, 16 bp, H. sapiens
attgcattgaatttat

SEQ ID NO: 55256 - DNA, 16 bp, H. sapiens
attgcatttaatttat

SEQ ID NO: 55257 - DNA, 16 bp, H. sapiens
attgcatttattttct

SEQ ID NO: 55258 - DNA, 16 bp, H. sapiens
attgcatttctaaaaa

SEQ ID NO: 55259 - DNA, 16 bp, H. sapiens
attgcatttcttttgg

SEQ ID NO: 55260 - DNA, 16 bp, H. sapiens
attgcatttgcatttg

SEQ ID NO: 55261 - DNA, 16 bp, H. sapiens
attgcatttgcttttg

SEQ ID NO: 55262 - DNA, 16 bp, H. sapiens
attgcattttcctttt

SEQ ID NO: 55263 - DNA, 16 bp, H. sapiens
attgcatttttaaaaa

SEQ ID NO: 55264 - DNA, 16 bp, H. sapiens
attgccaaatccaatg

SEQ ID NO: 55265 - DNA, 16 bp, H. sapiens
attgccaaattgctct

SEQ ID NO: 55266 - DNA, 16 bp, H. sapiens
attgccaagtaatatt

SEQ ID NO: 55267 - DNA, 16 bp, H. sapiens
attgccacaaccaccc

SEQ ID NO: 55268 - DNA, 16 bp, H. sapiens
attgccaccatcatca

SEQ ID NO: 55269 - DNA, 16 bp, H. sapiens
attgccagataaaata

SEQ ID NO: 55270 - DNA, 16 bp, H. sapiens
attgccagctcacagg

SEQ ID NO: 55271 - DNA, 16 bp, H. sapiens
attgccagtgggaatg

SEQ ID NO: 55272 - DNA, 16 bp, H. sapiens
attgccatactgcttt

SEQ ID NO: 55273 - DNA, 16 bp, H. sapiens
attgccatgaattaag

SEQ ID NO: 55274 - DNA, 16 bp, H. sapiens
attgcccagcctggag

SEQ ID NO: 55275 - DNA, 17 bp, H. sapiens
attgcccaggctgttct

SEQ ID NO: 55276 - DNA, 16 bp, H. sapiens
attgcccagggatgag

SEQ ID NO: 55277 - DNA, 16 bp, H. sapiens
attgcccagtctcagt

SEQ ID NO: 55278 - DNA, 18 bp, H. sapiens
attgccctggccagaact

SEQ ID NO: 55279 - DNA, 16 bp, H. sapiens
attgccctggccagga

SEQ ID NO: 55280 - DNA, 17 bp, H. sapiens
attgcctaggttttctt

SEQ ID NO: 55281 - DNA, 16 bp, H. sapiens
attgcctatattttct

SEQ ID NO: 55282 - DNA, 16 bp, H. sapiens
attgcctcccaccagg

SEQ ID NO: 55283 - DNA, 16 bp, H. sapiens
attgcctgaggttggg

SEQ ID NO: 55284 - DNA, 16 bp, H. sapiens
attgcctgggctcagg

SEQ ID NO: 55285 - DNA, 16 bp, H. sapiens
attgcctgtttttctc

SEQ ID NO: 55286 - DNA, 16 bp, H. sapiens
attgccttatttttaa

SEQ ID NO: 55287 - DNA, 16 bp, H. sapiens
attgccttttaaaaaa

SEQ ID NO: 55288 - DNA, 16 bp, H. sapiens
attgccttttcactct

SEQ ID NO: 55289 - DNA, 16 bp, H. sapiens
attgcggctcactgca

SEQ ID NO: 55290 - DNA, 16 bp, H. sapiens
attgctaaatgtaata

SEQ ID NO: 55291 - DNA, 16 bp, H. sapiens
attgctaaattctttt

SEQ ID NO: 55292 - DNA, 16 bp, H. sapiens
attgctaagtgaaaaa

SEQ ID NO: 55293 - DNA, 16 bp, H. sapiens
attgctacaaagggaa

SEQ ID NO: 55294 - DNA, 16 bp, H. sapiens
attgctagaacctggg

SEQ ID NO: 55295 - DNA, 16 bp, H. sapiens
attgctaggttgaatg

SEQ ID NO: 55296 - DNA, 16 bp, H. sapiens
attgctataaagaaat

SEQ ID NO: 55297 - DNA, 16 bp, H. sapiens
attgctatattttctt

SEQ ID NO: 55298 - DNA, 16 bp, H. sapiens
attgctatgaagaact

SEQ ID NO: 55299 - DNA, 16 bp, H. sapiens
attgctattattatta

SEQ ID NO: 55300 - DNA, 16 bp, H. sapiens
attgctatttttttaa

SEQ ID NO: 55301 - DNA, 16 bp, H. sapiens
attgctcaataaatgt

SEQ ID NO: 55302 - DNA, 16 bp, H. sapiens
attgctcactgcagcc

SEQ ID NO: 55303 - DNA, 16 bp, H. sapiens
attgctcatttctttt

SEQ ID NO: 55304 - DNA, 16 bp, H. sapiens
attgctcccaggctac

SEQ ID NO: 55305 - DNA, 17 bp, H. sapiens
attgctcctaactccac

SEQ ID NO: 55306 - DNA, 17 bp, H. sapiens
attgctcgagcccagga

SEQ ID NO: 55307 - DNA, 16 bp, H. sapiens
attgctctagctggga

SEQ ID NO: 55308 - DNA, 16 bp, H. sapiens
attgctgaataatttt

SEQ ID NO: 55309 - DNA, 16 bp, H. sapiens
attgctgaatactatt

SEQ ID NO: 55310 - DNA, 16 bp, H. sapiens
attgctgaattatttt

SEQ ID NO: 55311 - DNA, 16 bp, H. sapiens
attgctgagcagtatt

SEQ ID NO: 55312 - DNA, 16 bp, H. sapiens
attgctgagtagaatt

SEQ ID NO: 55313 - DNA, 16 bp, H. sapiens
attgctgagttgaatg

SEQ ID NO: 55314 - DNA, 16 bp, H. sapiens
attgctgatgaagttt

SEQ ID NO: 55315 - DNA, 16 bp, H. sapiens
attgctgatgtggaga

SEQ ID NO: 55316 - DNA, 16 bp, H. sapiens
attgctgcataacaaa

SEQ ID NO: 55317 - DNA, 16 bp, H. sapiens
attgctgctgggaatg

SEQ ID NO: 55318 - DNA, 16 bp, H. sapiens
attgctgctgtaataa

SEQ ID NO: 55319 - DNA, 16 bp, H. sapiens
attgctggattatatg

SEQ ID NO: 55320 - DNA, 16 bp, H. sapiens
attgctggattgtatg

SEQ ID NO: 55321 - DNA, 16 bp, H. sapiens
attgctgggccatatg

SEQ ID NO: 55322 - DNA, 16 bp, H. sapiens
attgctggggaggcct

SEQ ID NO: 55323 - DNA, 16 bp, H. sapiens
attgctgggtatatac

SEQ ID NO: 55324 - DNA, 16 bp, H. sapiens
attgctgggttgaatg

SEQ ID NO: 55325 - DNA, 16 bp, H. sapiens
attgctggtgagaatg

SEQ ID NO: 55326 - DNA, 16 bp, H. sapiens
attgctgtgtaatatt

SEQ ID NO: 55327 - DNA, 16 bp, H. sapiens
attgcttaaaaaaaaa

SEQ ID NO: 55328 - DNA, 16 bp, H. sapiens
attgcttaacaacagg

SEQ ID NO: 55329 - DNA, 16 bp, H. sapiens
attgcttaagcccaga

SEQ ID NO: 55330 - DNA, 16 bp, H. sapiens
attgcttaattctgat

SEQ ID NO: 55331 - DNA, 16 bp, H. sapiens
attgcttataatagca

SEQ ID NO: 55332 - DNA, 16 bp, H. sapiens
attgcttcagcccaag

SEQ ID NO: 55333 - DNA, 16 bp, H. sapiens
attgcttgaacctggc

SEQ ID NO: 55334 - DNA, 16 bp, H. sapiens
attgcttgaagccaga

SEQ ID NO: 55335 - DNA, 16 bp, H. sapiens
attgcttgagcccagc

SEQ ID NO: 55336 - DNA, 17 bp, H. sapiens
attgcttgagcccaggc

SEQ ID NO: 55337 - DNA, 16 bp, H. sapiens
attgcttgagcctgca

SEQ ID NO: 55338 - DNA, 19 bp, H. sapiens
attgcttgagcctgggaga

SEQ ID NO: 55339 - DNA, 16 bp, H. sapiens
attgcttgaggccaag

SEQ ID NO: 55340 - DNA, 16 bp, H. sapiens
attgcttgagtccagc

SEQ ID NO: 55341 - DNA, 17 bp, H. sapiens
attgcttgagtctggga

SEQ ID NO: 55342 - DNA, 17 bp, H. sapiens
attgcttggacctggga

SEQ ID NO: 55343 - DNA, 16 bp, H. sapiens
attgcttgtgctcagg

SEQ ID NO: 55344 - DNA, 16 bp, H. sapiens
attgcttgtttttctc

SEQ ID NO: 55345 - DNA, 16 bp, H. sapiens
attgctttattatatt

SEQ ID NO: 55346 - DNA, 16 bp, H. sapiens
attgctttatttttaa

SEQ ID NO: 55347 - DNA, 16 bp, H. sapiens
attgctttcttcattt

SEQ ID NO: 55348 - DNA, 16 bp, H. sapiens
attgctttctttttaa

SEQ ID NO: 55349 - DNA, 16 bp, H. sapiens
attgctttggctattt

SEQ ID NO: 55350 - DNA, 16 bp, H. sapiens
attgctttgggtaata

SEQ ID NO: 55351 - DNA, 16 bp, H. sapiens
attgctttggtgtttt

SEQ ID NO: 55352 - DNA, 16 bp, H. sapiens
attgctttgtaatttt

SEQ ID NO: 55353 - DNA, 16 bp, H. sapiens
attgctttgtgatgtg

SEQ ID NO: 55354 - DNA, 16 bp, H. sapiens
attgcttttaaaaaaa

SEQ ID NO: 55355 - DNA, 16 bp, H. sapiens
attgcttttctaattt

SEQ ID NO: 55356 - DNA, 16 bp, H. sapiens
attgcttttctgtatt

SEQ ID NO: 55357 - DNA, 16 bp, H. sapiens
attgcttttgaagtct

SEQ ID NO: 55358 - DNA, 16 bp, H. sapiens
attgcttttgctgcat

SEQ ID NO: 55359 - DNA, 16 bp, H. sapiens
attgcttttggaagta

SEQ ID NO: 55360 - DNA, 16 bp, H. sapiens
attgcttttggtggta

SEQ ID NO: 55361 - DNA, 16 bp, H. sapiens
attgctttttaatatt

SEQ ID NO: 55362 - DNA, 16 bp, H. sapiens
attgctttttcacttt

SEQ ID NO: 55363 - DNA, 16 bp, H. sapiens
attgctttttctaatt

SEQ ID NO: 55364 - DNA, 16 bp, H. sapiens
attgctttttctcctt

SEQ ID NO: 55365 - DNA, 16 bp, H. sapiens
attggaaaaaagacaa

SEQ ID NO: 55366 - DNA, 24 bp, H. sapiens
attggaaaacactctgcaggatat

SEQ ID NO: 55367 - DNA, 16 bp, H. sapiens
attggaaaaccaaaaa

SEQ ID NO: 55368 - DNA, 16 bp, H. sapiens
attggaaaactttttt

SEQ ID NO: 55369 - DNA, 16 bp, H. sapiens
attggaaaagtgtggt

SEQ ID NO: 55370 - DNA, 16 bp, H. sapiens
attggaaaatatttga

SEQ ID NO: 55371 - DNA, 16 bp, H. sapiens
attggaaagatgatga

SEQ ID NO: 55372 - DNA, 29 bp, H. sapiens
attggaaatcatcattcttagtaaactat

SEQ ID NO: 55373 - DNA, 16 bp, H. sapiens
attggaacatttcaga

SEQ ID NO: 55374 - DNA, 16 bp, H. sapiens
attggaagaagaatta

SEQ ID NO: 55375 - DNA, 16 bp, H. sapiens
attggaagcttcctga

SEQ ID NO: 55376 - DNA, 16 bp, H. sapiens
attggaagtaatatga

SEQ ID NO: 55377 - DNA, 16 bp, H. sapiens
attggaatttctggcc

SEQ ID NO: 55378 - DNA, 16 bp, H. sapiens
attggacaacacagat

SEQ ID NO: 55379 - DNA, 16 bp, H. sapiens
attggactatgtgtct

SEQ ID NO: 55380 - DNA, 16 bp, H. sapiens
attggagaaattggtt

SEQ ID NO: 55381 - DNA, 16 bp, H. sapiens
attggagaccagcctg

SEQ ID NO: 55382 - DNA, 16 bp, H. sapiens
attggagagaaaaaca

SEQ ID NO: 55383 - DNA, 16 bp, H. sapiens
attggagatcacattt

SEQ ID NO: 55384 - DNA, 16 bp, H. sapiens
attggagcatttaacc

SEQ ID NO: 55385 - DNA, 17 bp, H. sapiens
attggagtgcagtggca

SEQ ID NO: 55386 - DNA, 17 bp, H. sapiens
attggagtgcagtggtg

SEQ ID NO: 55387 - DNA, 16 bp, H. sapiens
attggataaaattcaa

SEQ ID NO: 55388 - DNA, 16 bp, H. sapiens
attggataaagagtca

SEQ ID NO: 55389 - DNA, 16 bp, H. sapiens
attggatcatggggga

SEQ ID NO: 55390 - DNA, 16 bp, H. sapiens
attggcaaaagaattc

SEQ ID NO: 55391 - DNA, 16 bp, H. sapiens
attggcaaatattttc

SEQ ID NO: 55392 - DNA, 16 bp, H. sapiens
attggcacaggatcat

SEQ ID NO: 55393 - DNA, 16 bp, H. sapiens
attggccagaactggt

SEQ ID NO: 55394 - DNA, 16 bp, H. sapiens
attggccatcagagaa

SEQ ID NO: 55395 - DNA, 16 bp, H. sapiens
attggccatgctggtc

SEQ ID NO: 55396 - DNA, 16 bp, H. sapiens
attggcctgtagttta

SEQ ID NO: 55397 - DNA, 16 bp, H. sapiens
attggctaaccatatg

SEQ ID NO: 55398 - DNA, 16 bp, H. sapiens
attggctatggatttg

SEQ ID NO: 55399 - DNA, 16 bp, H. sapiens
attggctcatgtaact

SEQ ID NO: 55400 - DNA, 16 bp, H. sapiens
attggctgggcagggt

SEQ ID NO: 55401 - DNA, 16 bp, H. sapiens
attggctgggtgtggt

SEQ ID NO: 55402 - DNA, 16 bp, H. sapiens
attggctgtgggtgtg

SEQ ID NO: 55403 - DNA, 16 bp, H. sapiens
attggctgtgggtttt

SEQ ID NO: 55404 - DNA, 16 bp, H. sapiens
attggctgtgtgactt

SEQ ID NO: 55405 - DNA, 16 bp, H. sapiens
attggcttacatgatt

SEQ ID NO: 55406 - DNA, 16 bp, H. sapiens
attggcttatagtttt

SEQ ID NO: 55407 - DNA, 16 bp, H. sapiens
attggctttctgagtt

SEQ ID NO: 55408 - DNA, 16 bp, H. sapiens
attggctttgctggaa

SEQ ID NO: 55409 - DNA, 16 bp, H. sapiens
attggctttggcaaag

SEQ ID NO: 55410 - DNA, 16 bp, H. sapiens
attggctttgggttgc

SEQ ID NO: 55411 - DNA, 16 bp, H. sapiens
attgggaaaactggat

SEQ ID NO: 55412 - DNA, 16 bp, H. sapiens
attgggaagaaataaa

SEQ ID NO: 55413 - DNA, 16 bp, H. sapiens
attgggaagaagggtg

SEQ ID NO: 55414 - DNA, 16 bp, H. sapiens
attgggaattatattt

SEQ ID NO: 55415 - DNA, 16 bp, H. sapiens
attgggatgatgctgg

SEQ ID NO: 55416 - DNA, 16 bp, H. sapiens
attgggattttaaaaa

SEQ ID NO: 55417 - DNA, 16 bp, H. sapiens
attgggccgggcacgg

SEQ ID NO: 55418 - DNA, 16 bp, H. sapiens
attggggaaatttgaa

SEQ ID NO: 55419 - DNA, 16 bp, H. sapiens
attggggctgggcatg

SEQ ID NO: 55420 - DNA, 16 bp, H. sapiens
attgggggaaaatatt

SEQ ID NO: 55421 - DNA, 16 bp, H. sapiens
attggggttggttcca

SEQ ID NO: 55422 - DNA, 16 bp, H. sapiens
attgggtaaatacagc

SEQ ID NO: 55423 - DNA, 16 bp, H. sapiens
attgggtaataaaatg

SEQ ID NO: 55424 - DNA, 16 bp, H. sapiens
attgggttgattccat

SEQ ID NO: 55425 - DNA, 16 bp, H. sapiens
attgggttgttttctt

SEQ ID NO: 55426 - DNA, 16 bp, H. sapiens
attggtaagctattga

SEQ ID NO: 55427 - DNA, 16 bp, H. sapiens
attggtatcttgatgg

SEQ ID NO: 55428 - DNA, 16 bp, H. sapiens
attggtatttgttctt

SEQ ID NO: 55429 - DNA, 16 bp, H. sapiens
attggtcatttgaaaa

SEQ ID NO: 55430 - DNA, 16 bp, H. sapiens
attggtccattttaga

SEQ ID NO: 55431 - DNA, 16 bp, H. sapiens
attggtctatatattt

SEQ ID NO: 55432 - DNA, 16 bp, H. sapiens
attggtctattcaaag

SEQ ID NO: 55433 - DNA, 18 bp, H. sapiens
attggtgcgtttttacag

SEQ ID NO: 55434 - DNA, 16 bp, H. sapiens
attggtggacatttgg

SEQ ID NO: 55435 - DNA, 16 bp, H. sapiens
attggtgggcatttgg

SEQ ID NO: 55436 - DNA, 16 bp, H. sapiens
attggtggttgccagg

SEQ ID NO: 55437 - DNA, 20 bp, H. sapiens
attggtgtacctgaaaatga

SEQ ID NO: 55438 - DNA, 16 bp, H. sapiens
attggtgtgctgtatt

SEQ ID NO: 55439 - DNA, 16 bp, H. sapiens
attggtgtgttttaca

SEQ ID NO: 55440 - DNA, 16 bp, H. sapiens
attggttctgtttgtg

SEQ ID NO: 55441 - DNA, 16 bp, H. sapiens
attggtttaataataa

SEQ ID NO: 55442 - DNA, 16 bp, H. sapiens
attggtttaatgaaaa

SEQ ID NO: 55443 - DNA, 16 bp, H. sapiens
attggtttcattatac

SEQ ID NO: 55444 - DNA, 16 bp, H. sapiens
attggtttgcctggaa

SEQ ID NO: 55445 - DNA, 16 bp, H. sapiens
attggttttgaaatgt

SEQ ID NO: 55446 - DNA, 16 bp, H. sapiens
attggtttttagtata

SEQ ID NO: 55447 - DNA, 16 bp, H. sapiens
attgtaaaaaatgtac

SEQ ID NO: 55448 - DNA, 16 bp, H. sapiens
attgtaaaaacaaaca

SEQ ID NO: 55449 - DNA, 16 bp, H. sapiens
attgtaaaataaatgt

SEQ ID NO: 55450 - DNA, 16 bp, H. sapiens
attgtaaaatacatat

SEQ ID NO: 55451 - DNA, 16 bp, H. sapiens
attgtaaaatgtgtgt

SEQ ID NO: 55452 - DNA, 16 bp, H. sapiens
attgtaaacttttttt

SEQ ID NO: 55453 - DNA, 16 bp, H. sapiens
attgtaaagattttct

SEQ ID NO: 55454 - DNA, 16 bp, H. sapiens
attgtaaaggccatcg

SEQ ID NO: 55455 - DNA, 16 bp, H. sapiens
attgtaaataatgcta

SEQ ID NO: 55456 - DNA, 16 bp, H. sapiens
attgtaaatagtattt

SEQ ID NO: 55457 - DNA, 16 bp, H. sapiens
attgtaaatatttctt

SEQ ID NO: 55458 - DNA, 16 bp, H. sapiens
attgtaaatcattcta

SEQ ID NO: 55459 - DNA, 16 bp, H. sapiens
attgtaaatgcactaa

SEQ ID NO: 55460 - DNA, 16 bp, H. sapiens
attgtaaatggcattg

SEQ ID NO: 55461 - DNA, 16 bp, H. sapiens
attgtaaatgtttctt

SEQ ID NO: 55462 - DNA, 16 bp, H. sapiens
attgtaacaaaaacaa

SEQ ID NO: 55463 - DNA, 16 bp, H. sapiens
attgtaagtatcctga

SEQ ID NO: 55464 - DNA, 16 bp, H. sapiens
attgtaagtgaagtaa

SEQ ID NO: 55465 - DNA, 16 bp, H. sapiens
attgtaagttacctga

SEQ ID NO: 55466 - DNA, 16 bp, H. sapiens
attgtaagttccctga

SEQ ID NO: 55467 - DNA, 16 bp, H. sapiens
attgtaagttgaaaat

SEQ ID NO: 55468 - DNA, 16 bp, H. sapiens
attgtaattacttttt

SEQ ID NO: 55469 - DNA, 16 bp, H. sapiens
attgtaatttctaatc

SEQ ID NO: 55470 - DNA, 16 bp, H. sapiens
attgtacactttattt

SEQ ID NO: 55471 - DNA, 16 bp, H. sapiens
attgtacatatttttg

SEQ ID NO: 55472 - DNA, 16 bp, H. sapiens
attgtacattctaaaa

SEQ ID NO: 55473 - DNA, 16 bp, H. sapiens
attgtacattctatgg

SEQ ID NO: 55474 - DNA, 16 bp, H. sapiens
attgtacatttagaaa

SEQ ID NO: 55475 - DNA, 16 bp, H. sapiens
attgtactaagtgaaa

SEQ ID NO: 55476 - DNA, 16 bp, H. sapiens
attgtacttatttatt

SEQ ID NO: 55477 - DNA, 16 bp, H. sapiens
attgtacttttaaaaa

SEQ ID NO: 55478 - DNA, 16 bp, H. sapiens
attgtacttttaaaat

SEQ ID NO: 55479 - DNA, 16 bp, H. sapiens
attgtagatttttaaa

SEQ ID NO: 55480 - DNA, 16 bp, H. sapiens
attgtaggcatgaacc

SEQ ID NO: 55481 - DNA, 16 bp, H. sapiens
attgtaggcatgagcc

SEQ ID NO: 55482 - DNA, 16 bp, H. sapiens
attgtagggttattag

SEQ ID NO: 55483 - DNA, 16 bp, H. sapiens
attgtagtatattttg

SEQ ID NO: 55484 - DNA, 16 bp, H. sapiens
attgtatacatatatt

SEQ ID NO: 55485 - DNA, 16 bp, H. sapiens
attgtatacatgtatt

SEQ ID NO: 55486 - DNA, 17 bp, H. sapiens
attgtatacctagaaaa

SEQ ID NO: 55487 - DNA, 16 bp, H. sapiens
attgtatagctgtaca

SEQ ID NO: 55488 - DNA, 16 bp, H. sapiens
attgtatagtggtgaa

SEQ ID NO: 55489 - DNA, 16 bp, H. sapiens
attgtatataatgtat

SEQ ID NO: 55490 - DNA, 16 bp, H. sapiens
attgtatattacaatg

SEQ ID NO: 55491 - DNA, 16 bp, H. sapiens
attgtatatttagaaa

SEQ ID NO: 55492 - DNA, 16 bp, H. sapiens
attgtatatttcaaaa

SEQ ID NO: 55493 - DNA, 16 bp, H. sapiens
attgtatatttgaaaa

SEQ ID NO: 55494 - DNA, 16 bp, H. sapiens
attgtattaggtatta

SEQ ID NO: 55495 - DNA, 16 bp, H. sapiens
attgtattccatggtg

SEQ ID NO: 55496 - DNA, 16 bp, H. sapiens
attgtattcttgaaaa

SEQ ID NO: 55497 - DNA, 16 bp, H. sapiens
attgtattgaaggatg

SEQ ID NO: 55498 - DNA, 16 bp, H. sapiens
attgtattgtactgta

SEQ ID NO: 55499 - DNA, 16 bp, H. sapiens
attgtatttaggaagt

SEQ ID NO: 55500 - DNA, 16 bp, H. sapiens
attgtatttatataca

SEQ ID NO: 55501 - DNA, 16 bp, H. sapiens
attgtatttatatgaa

SEQ ID NO: 55502 - DNA, 16 bp, H. sapiens
attgtatttggtatta

SEQ ID NO: 55503 - DNA, 16 bp, H. sapiens
attgtattttatatac

SEQ ID NO: 55504 - DNA, 16 bp, H. sapiens
attgtatttttagaaa

SEQ ID NO: 55505 - DNA, 16 bp, H. sapiens
attgtatttttgaaaa

SEQ ID NO: 55506 - DNA, 16 bp, H. sapiens
attgtcaatgaacagt

SEQ ID NO: 55507 - DNA, 16 bp, H. sapiens
attgtcagtcttttta

SEQ ID NO: 55508 - DNA, 16 bp, H. sapiens
attgtccaaaacaaag

SEQ ID NO: 55509 - DNA, 16 bp, H. sapiens
attgtccatgaaaatt

SEQ ID NO: 55510 - DNA, 16 bp, H. sapiens
attgtccatttgtata

SEQ ID NO: 55511 - DNA, 16 bp, H. sapiens
attgtcccattttaca

SEQ ID NO: 55512 - DNA, 16 bp, H. sapiens
attgtccccataaact

SEQ ID NO: 55513 - DNA, 16 bp, H. sapiens
attgtctatttctcct

SEQ ID NO: 55514 - DNA, 16 bp, H. sapiens
attgtctctacaaaaa

SEQ ID NO: 55515 - DNA, 16 bp, H. sapiens
attgtctcttcaaata

SEQ ID NO: 55516 - DNA, 16 bp, H. sapiens
attgtctcttcatttt

SEQ ID NO: 55517 - DNA, 16 bp, H. sapiens
attgtcttaaatattt

SEQ ID NO: 55518 - DNA, 16 bp, H. sapiens
attgtcttagctattc

SEQ ID NO: 55519 - DNA, 16 bp, H. sapiens
attgtcttcatttatt

SEQ ID NO: 55520 - DNA, 16 bp, H. sapiens
attgtcttccataatg

SEQ ID NO: 55521 - DNA, 16 bp, H. sapiens
attgtcttctgtgaaa

SEQ ID NO: 55522 - DNA, 16 bp, H. sapiens
attgtcttcttgattt

SEQ ID NO: 55523 - DNA, 16 bp, H. sapiens
attgtcttggctattc

SEQ ID NO: 55524 - DNA, 16 bp, H. sapiens
attgtcttggttatta

SEQ ID NO: 55525 - DNA, 31 bp, H. sapiens
attgtcttgtgaccctgacacatccccctct

SEQ ID NO: 55526 - DNA, 16 bp, H. sapiens
attgtcttttaaaata

SEQ ID NO: 55527 - DNA, 16 bp, H. sapiens
attgtgaaaaacagtg

SEQ ID NO: 55528 - DNA, 16 bp, H. sapiens
attgtgaaaggaaaat

SEQ ID NO: 55529 - DNA, 16 bp, H. sapiens
attgtgaaatatttta

SEQ ID NO: 55530 - DNA, 16 bp, H. sapiens
attgtgaaattattaa

SEQ ID NO: 55531 - DNA, 16 bp, H. sapiens
attgtgaaattattac

SEQ ID NO: 55532 - DNA, 16 bp, H. sapiens
attgtgaacttttgct

SEQ ID NO: 55533 - DNA, 21 bp, H. sapiens
attgtgaagatttcatggaca

SEQ ID NO: 55534 - DNA, 16 bp, H. sapiens
attgtgaagattttat

SEQ ID NO: 55535 - DNA, 16 bp, H. sapiens
attgtgaatactgcta

SEQ ID NO: 55536 - DNA, 16 bp, H. sapiens
attgtgaatgcaaagg

SEQ ID NO: 55537 - DNA, 16 bp, H. sapiens
attgtgaatgtaatta

SEQ ID NO: 55538 - DNA, 16 bp, H. sapiens
attgtgacatatccct

SEQ ID NO: 55539 - DNA, 16 bp, H. sapiens
attgtgagaattaagt

SEQ ID NO: 55540 - DNA, 16 bp, H. sapiens
attgtgaggatgaagt

SEQ ID NO: 55541 - DNA, 16 bp, H. sapiens
attgtgagtccattaa

SEQ ID NO: 55542 - DNA, 16 bp, H. sapiens
attgtgagtgggagtt

SEQ ID NO: 55543 - DNA, 16 bp, H. sapiens
attgtgatgatggtgg

SEQ ID NO: 55544 - DNA, 16 bp, H. sapiens
attgtgatggttaata

SEQ ID NO: 55545 - DNA, 16 bp, H. sapiens
attgtgatttataata

SEQ ID NO: 55546 - DNA, 16 bp, H. sapiens
attgtgattttaaaat

SEQ ID NO: 55547 - DNA, 16 bp, H. sapiens
attgtgcagcacctct

SEQ ID NO: 55548 - DNA, 16 bp, H. sapiens
attgtgccactaaact

SEQ ID NO: 55549 - DNA, 17 bp, H. sapiens
attgtgccactgcactg

SEQ ID NO: 55550 - DNA, 16 bp, H. sapiens
attgtgccattgtact

SEQ ID NO: 55551 - DNA, 16 bp, H. sapiens
attgtgcttcacttta

SEQ ID NO: 55552 - DNA, 16 bp, H. sapiens
attgtgcttttgattt

SEQ ID NO: 55553 - DNA, 16 bp, H. sapiens
attgtggaaaaacaaa

SEQ ID NO: 55554 - DNA, 16 bp, H. sapiens
attgtggaaatcagtg

SEQ ID NO: 55555 - DNA, 16 bp, H. sapiens
attgtggaagatagta

SEQ ID NO: 55556 - DNA, 16 bp, H. sapiens
attgtggaagatggtg

SEQ ID NO: 55557 - DNA, 16 bp, H. sapiens
attgtggagaccaagg

SEQ ID NO: 55558 - DNA, 16 bp, H. sapiens
attgtggcaggccagg

SEQ ID NO: 55559 - DNA, 16 bp, H. sapiens
attgtgggactttacc

SEQ ID NO: 55560 - DNA, 16 bp, H. sapiens
attgtggggatgttag

SEQ ID NO: 55561 - DNA, 16 bp, H. sapiens
attgtggtaaaataca

SEQ ID NO: 55562 - DNA, 16 bp, H. sapiens
attgtggtaaaatata

SEQ ID NO: 55563 - DNA, 17 bp, H. sapiens
attgtggtgagccaaga

SEQ ID NO: 55564 - DNA, 16 bp, H. sapiens
attgtggtgaggatta

SEQ ID NO: 55565 - DNA, 16 bp, H. sapiens
attgtggtttctgcca

SEQ ID NO: 55566 - DNA, 16 bp, H. sapiens
attgtgtagtggtgaa

SEQ ID NO: 55567 - DNA, 16 bp, H. sapiens
attgtgtatatattcc

SEQ ID NO: 55568 - DNA, 16 bp, H. sapiens
attgtgtccggaattg

SEQ ID NO: 55569 - DNA, 16 bp, H. sapiens
attgtgtctttgttct

SEQ ID NO: 55570 - DNA, 16 bp, H. sapiens
attgtgtgaacatcat

SEQ ID NO: 55571 - DNA, 16 bp, H. sapiens
attgtgtgaccttggg

SEQ ID NO: 55572 - DNA, 16 bp, H. sapiens
attgtgtgagccaatt

SEQ ID NO: 55573 - DNA, 16 bp, H. sapiens
attgtgtgcctggaaa

SEQ ID NO: 55574 - DNA, 16 bp, H. sapiens
attgtgtgctttattt

SEQ ID NO: 55575 - DNA, 16 bp, H. sapiens
attgtgtgtatgtgtg

SEQ ID NO: 55576 - DNA, 16 bp, H. sapiens
attgtgtgtgcatgca

SEQ ID NO: 55577 - DNA, 16 bp, H. sapiens
attgtgtgtgtatata

SEQ ID NO: 55578 - DNA, 16 bp, H. sapiens
attgtgtgtgtgcgtg

SEQ ID NO: 55579 - DNA, 16 bp, H. sapiens
attgtgtgttaatatt

SEQ ID NO: 55580 - DNA, 16 bp, H. sapiens
attgtgttccttttta

SEQ ID NO: 55581 - DNA, 16 bp, H. sapiens
attgtgtttatttgaa

SEQ ID NO: 55582 - DNA, 16 bp, H. sapiens
attgttaaaatgcaga

SEQ ID NO: 55583 - DNA, 16 bp, H. sapiens
attgttaaagaaaaga

SEQ ID NO: 55584 - DNA, 16 bp, H. sapiens
attgttaacttgagat

SEQ ID NO: 55585 - DNA, 16 bp, H. sapiens
attgttaatttgagat

SEQ ID NO: 55586 - DNA, 16 bp, H. sapiens
attgttattaatatcc

SEQ ID NO: 55587 - DNA, 16 bp, H. sapiens
attgttattgactaca

SEQ ID NO: 55588 - DNA, 16 bp, H. sapiens
attgttcattgttaat

SEQ ID NO: 55589 - DNA, 16 bp, H. sapiens
attgttcccttctttg

SEQ ID NO: 55590 - DNA, 16 bp, H. sapiens
attgttctggaatcct

SEQ ID NO: 55591 - DNA, 16 bp, H. sapiens
attgttcttttttaaa

SEQ ID NO: 55592 - DNA, 16 bp, H. sapiens
attgttgctgttattt

SEQ ID NO: 55593 - DNA, 16 bp, H. sapiens
attgttgggaaggcat

SEQ ID NO: 55594 - DNA, 16 bp, H. sapiens
attgttggtgaggatg

SEQ ID NO: 55595 - DNA, 16 bp, H. sapiens
attgttgtaattgttc

SEQ ID NO: 55596 - DNA, 16 bp, H. sapiens
attgtttataaaacaa

SEQ ID NO: 55597 - DNA, 16 bp, H. sapiens
attgtttcaaaataaa

SEQ ID NO: 55598 - DNA, 16 bp, H. sapiens
attgtttcatatgttt

SEQ ID NO: 55599 - DNA, 16 bp, H. sapiens
attgtttcatgtattt

SEQ ID NO: 55600 - DNA, 16 bp, H. sapiens
attgtttcattattta

SEQ ID NO: 55601 - DNA, 16 bp, H. sapiens
attgtttctacttttg

SEQ ID NO: 55602 - DNA, 16 bp, H. sapiens
attgtttcttcattct

SEQ ID NO: 55603 - DNA, 16 bp, H. sapiens
attgtttctttaaatt

SEQ ID NO: 55604 - DNA, 16 bp, H. sapiens
attgtttgaaaatatt

SEQ ID NO: 55605 - DNA, 16 bp, H. sapiens
attgtttgagcccggg

SEQ ID NO: 55606 - DNA, 16 bp, H. sapiens
attgtttgtaaaacat

SEQ ID NO: 55607 - DNA, 16 bp, H. sapiens
attgttttacttttaa

SEQ ID NO: 55608 - DNA, 16 bp, H. sapiens
attgttttagggcacc

SEQ ID NO: 55609 - DNA, 16 bp, H. sapiens
attgttttatggctga

SEQ ID NO: 55610 - DNA, 16 bp, H. sapiens
attgttttcaacaatg

SEQ ID NO: 55611 - DNA, 16 bp, H. sapiens
attgttttcaatattt

SEQ ID NO: 55612 - DNA, 16 bp, H. sapiens
attgttttcagtgttt

SEQ ID NO: 55613 - DNA, 16 bp, H. sapiens
attgttttcataaaaa

SEQ ID NO: 55614 - DNA, 16 bp, H. sapiens
attgttttccacaatg

SEQ ID NO: 55615 - DNA, 16 bp, H. sapiens
attgttttcttaactt

SEQ ID NO: 55616 - DNA, 16 bp, H. sapiens
attgttttctttaaat

SEQ ID NO: 55617 - DNA, 16 bp, H. sapiens
attgttttgaaaaaat

SEQ ID NO: 55618 - DNA, 16 bp, H. sapiens
attgttttgaaaaata

SEQ ID NO: 55619 - DNA, 16 bp, H. sapiens
attgttttgaaagaaa

SEQ ID NO: 55620 - DNA, 16 bp, H. sapiens
attgttttgaaataaa

SEQ ID NO: 55621 - DNA, 16 bp, H. sapiens
attgttttgaaatgtg

SEQ ID NO: 55622 - DNA, 16 bp, H. sapiens
attgttttgccttttc

SEQ ID NO: 55623 - DNA, 16 bp, H. sapiens
attgtttttagagaca

SEQ ID NO: 55624 - DNA, 16 bp, H. sapiens
attgtttttcagaatt

SEQ ID NO: 55625 - DNA, 16 bp, H. sapiens
attgtttttgaaaaca

SEQ ID NO: 55626 - DNA, 16 bp, H. sapiens
atttaaaaaaaagtct

SEQ ID NO: 55627 - DNA, 16 bp, H. sapiens
atttaaaaaaatcagt

SEQ ID NO: 55628 - DNA, 16 bp, H. sapiens
atttaaaaaactcatt

SEQ ID NO: 55629 - DNA, 16 bp, H. sapiens
atttaaaaaactgtaa

SEQ ID NO: 55630 - DNA, 16 bp, H. sapiens
atttaaaaaagcaaag

SEQ ID NO: 55631 - DNA, 16 bp, H. sapiens
atttaaaaaatactgt

SEQ ID NO: 55632 - DNA, 16 bp, H. sapiens
atttaaaaacagaaag

SEQ ID NO: 55633 - DNA, 16 bp, H. sapiens
atttaaaaacatttga

SEQ ID NO: 55634 - DNA, 16 bp, H. sapiens
atttaaaaagaaaact

SEQ ID NO: 55635 - DNA, 16 bp, H. sapiens
atttaaaaagacaaag

SEQ ID NO: 55636 - DNA, 16 bp, H. sapiens
atttaaaaagacagaa

SEQ ID NO: 55637 - DNA, 16 bp, H. sapiens
atttaaaaagactttt

SEQ ID NO: 55638 - DNA, 16 bp, H. sapiens
atttaaaaaggacaaa

SEQ ID NO: 55639 - DNA, 16 bp, H. sapiens
atttaaaaagtgtttt

SEQ ID NO: 55640 - DNA, 16 bp, H. sapiens
atttaaaaataagcaa

SEQ ID NO: 55641 - DNA, 16 bp, H. sapiens
atttaaaaatacagtt

SEQ ID NO: 55642 - DNA, 16 bp, H. sapiens
atttaaaaatagcatt

SEQ ID NO: 55643 - DNA, 16 bp, H. sapiens
atttaaaaatcaagtt

SEQ ID NO: 55644 - DNA, 16 bp, H. sapiens
atttaaaaatcacatt

SEQ ID NO: 55645 - DNA, 16 bp, H. sapiens
atttaaaaatcagtaa

SEQ ID NO: 55646 - DNA, 16 bp, H. sapiens
atttaaaaatcatcat

SEQ ID NO: 55647 - DNA, 16 bp, H. sapiens
atttaaaaatctgaat

SEQ ID NO: 55648 - DNA, 16 bp, H. sapiens
atttaaaaatctgttt

SEQ ID NO: 55649 - DNA, 16 bp, H. sapiens
atttaaaaatgagatt

SEQ ID NO: 55650 - DNA, 16 bp, H. sapiens
atttaaaaatgcagaa

SEQ ID NO: 55651 - DNA, 16 bp, H. sapiens
atttaaaaatgcatgt

SEQ ID NO: 55652 - DNA, 16 bp, H. sapiens
atttaaaaatgtgcaa

SEQ ID NO: 55653 - DNA, 16 bp, H. sapiens
atttaaaaattacttg

SEQ ID NO: 55654 - DNA, 16 bp, H. sapiens
atttaaaaattagctt

SEQ ID NO: 55655 - DNA, 16 bp, H. sapiens
atttaaaacaaagcaa

SEQ ID NO: 55656 - DNA, 16 bp, H. sapiens
atttaaaacacacaca

SEQ ID NO: 55657 - DNA, 16 bp, H. sapiens
atttaaaacatctttt

SEQ ID NO: 55658 - DNA, 16 bp, H. sapiens
atttaaaacatgaatt

SEQ ID NO: 55659 - DNA, 16 bp, H. sapiens
atttaaaactgaaaaa

SEQ ID NO: 55660 - DNA, 16 bp, H. sapiens
atttaaaactgttttt

SEQ ID NO: 55661 - DNA, 16 bp, H. sapiens
atttaaaacttctgta

SEQ ID NO: 55662 - DNA, 16 bp, H. sapiens
atttaaaacttttttg

SEQ ID NO: 55663 - DNA, 16 bp, H. sapiens
atttaaaagaacatta

SEQ ID NO: 55664 - DNA, 16 bp, H. sapiens
atttaaaagatgtttt

SEQ ID NO: 55665 - DNA, 16 bp, H. sapiens
atttaaaagcagaaaa

SEQ ID NO: 55666 - DNA, 16 bp, H. sapiens
atttaaaagccaaaaa

SEQ ID NO: 55667 - DNA, 16 bp, H. sapiens
atttaaaagggaaata

SEQ ID NO: 55668 - DNA, 16 bp, H. sapiens
atttaaaagttcattt

SEQ ID NO: 55669 - DNA, 16 bp, H. sapiens
atttaaaataaatgca

SEQ ID NO: 55670 - DNA, 16 bp, H. sapiens
atttaaaataatctga

SEQ ID NO: 55671 - DNA, 16 bp, H. sapiens
atttaaaatacagaaa

SEQ ID NO: 55672 - DNA, 16 bp, H. sapiens
atttaaaatactgtat

SEQ ID NO: 55673 - DNA, 16 bp, H. sapiens
atttaaaatagcaaag

SEQ ID NO: 55674 - DNA, 16 bp, H. sapiens
atttaaaatagcatca

SEQ ID NO: 55675 - DNA, 16 bp, H. sapiens
atttaaaatatcttga

SEQ ID NO: 55676 - DNA, 16 bp, H. sapiens
atttaaaatattgtgt

SEQ ID NO: 55677 - DNA, 16 bp, H. sapiens
atttaaaatatttccc

SEQ ID NO: 55678 - DNA, 16 bp, H. sapiens
atttaaaatatttctc

SEQ ID NO: 55679 - DNA, 16 bp, H. sapiens
atttaaaatgagagac

SEQ ID NO: 55680 - DNA, 16 bp, H. sapiens
atttaaaatgcaaatt

SEQ ID NO: 55681 - DNA, 16 bp, H. sapiens
atttaaaatgctactt

SEQ ID NO: 55682 - DNA, 16 bp, H. sapiens
atttaaaatgcttatt

SEQ ID NO: 55683 - DNA, 16 bp, H. sapiens
atttaaaatggaattt

SEQ ID NO: 55684 - DNA, 16 bp, H. sapiens
atttaaaatggtgaat

SEQ ID NO: 55685 - DNA, 16 bp, H. sapiens
atttaaaatgtacatt

SEQ ID NO: 55686 - DNA, 16 bp, H. sapiens
atttaaaatgttgata

SEQ ID NO: 55687 - DNA, 16 bp, H. sapiens
atttaaaattgcaact

SEQ ID NO: 55688 - DNA, 16 bp, H. sapiens
atttaaaattttccat

SEQ ID NO: 55689 - DNA, 16 bp, H. sapiens
atttaaaattttctag

SEQ ID NO: 55690 - DNA, 16 bp, H. sapiens
atttaaacaaatgaaa

SEQ ID NO: 55691 - DNA, 16 bp, H. sapiens
atttaaacatatgaat

SEQ ID NO: 55692 - DNA, 16 bp, H. sapiens
atttaaacattcattt

SEQ ID NO: 55693 - DNA, 16 bp, H. sapiens
atttaaacctaaatat

SEQ ID NO: 55694 - DNA, 16 bp, H. sapiens
atttaaacctgggagg

SEQ ID NO: 55695 - DNA, 16 bp, H. sapiens
atttaaagaagaatga

SEQ ID NO: 55696 - DNA, 16 bp, H. sapiens
atttaaagacattttt

SEQ ID NO: 55697 - DNA, 16 bp, H. sapiens
atttaaagagataatg

SEQ ID NO: 55698 - DNA, 16 bp, H. sapiens
atttaaagagatattt

SEQ ID NO: 55699 - DNA, 16 bp, H. sapiens
atttaaagatttaaag

SEQ ID NO: 55700 - DNA, 16 bp, H. sapiens
atttaaagcaaatttt

SEQ ID NO: 55701 - DNA, 16 bp, H. sapiens
atttaaagcttatttt

SEQ ID NO: 55702 - DNA, 16 bp, H. sapiens
atttaaagctttaaaa

SEQ ID NO: 55703 - DNA, 16 bp, H. sapiens
atttaaaggggaaagg

SEQ ID NO: 55704 - DNA, 16 bp, H. sapiens
atttaaagtatacttt

SEQ ID NO: 55705 - DNA, 16 bp, H. sapiens
atttaaagtgaatttc

SEQ ID NO: 55706 - DNA, 16 bp, H. sapiens
atttaaagtgctgaag

SEQ ID NO: 55707 - DNA, 16 bp, H. sapiens
atttaaagtgtataat

SEQ ID NO: 55708 - DNA, 16 bp, H. sapiens
atttaaagttgatatt

SEQ ID NO: 55709 - DNA, 16 bp, H. sapiens
atttaaataaatgtca

SEQ ID NO: 55710 - DNA, 16 bp, H. sapiens
atttaaatagcattat

SEQ ID NO: 55711 - DNA, 16 bp, H. sapiens
atttaaatagcttttt

SEQ ID NO: 55712 - DNA, 16 bp, H. sapiens
atttaaatgattcttt

SEQ ID NO: 55713 - DNA, 16 bp, H. sapiens
atttaaatgcaaattt

SEQ ID NO: 55714 - DNA, 16 bp, H. sapiens
atttaaatggattaaa

SEQ ID NO: 55715 - DNA, 16 bp, H. sapiens
atttaaatgtcaatct

SEQ ID NO: 55716 - DNA, 16 bp, H. sapiens
atttaaatgttgaaat

SEQ ID NO: 55717 - DNA, 16 bp, H. sapiens
atttaaatgttttctt

SEQ ID NO: 55718 - DNA, 16 bp, H. sapiens
atttaaattgtttcca

SEQ ID NO: 55719 - DNA, 16 bp, H. sapiens
atttaacaaaatatgt

SEQ ID NO: 55720 - DNA, 16 bp, H. sapiens
atttaacaaaatccag

SEQ ID NO: 55721 - DNA, 16 bp, H. sapiens
atttaacaaacactta

SEQ ID NO: 55722 - DNA, 16 bp, H. sapiens
atttaacaaatacatt

SEQ ID NO: 55723 - DNA, 16 bp, H. sapiens
atttaacaaatgctta

SEQ ID NO: 55724 - DNA, 16 bp, H. sapiens
atttaacagatgaaaa

SEQ ID NO: 55725 - DNA, 16 bp, H. sapiens
atttaacagttattta

SEQ ID NO: 55726 - DNA, 16 bp, H. sapiens
atttaacatacacaag

SEQ ID NO: 55727 - DNA, 16 bp, H. sapiens
atttaacccagccatc

SEQ ID NO: 55728 - DNA, 16 bp, H. sapiens
atttaacccttagtgg

SEQ ID NO: 55729 - DNA, 16 bp, H. sapiens
atttaactgtacattt

SEQ ID NO: 55730 - DNA, 16 bp, H. sapiens
atttaagaaaacattt

SEQ ID NO: 55731 - DNA, 16 bp, H. sapiens
atttaagaaatacatt

SEQ ID NO: 55732 - DNA, 16 bp, H. sapiens
atttaagaaatattca

SEQ ID NO: 55733 - DNA, 16 bp, H. sapiens
atttaagaaatcattt

SEQ ID NO: 55734 - DNA, 16 bp, H. sapiens
atttaagaaatgtttt

SEQ ID NO: 55735 - DNA, 16 bp, H. sapiens
atttaagaatgaagaa

SEQ ID NO: 55736 - DNA, 16 bp, H. sapiens
atttaagaatgttgaa

SEQ ID NO: 55737 - DNA, 16 bp, H. sapiens
atttaagagtttaaaa

SEQ ID NO: 55738 - DNA, 16 bp, H. sapiens
atttaagatttttctt

SEQ ID NO: 55739 - DNA, 16 bp, H. sapiens
atttaagggggaaaaa

SEQ ID NO: 55740 - DNA, 16 bp, H. sapiens
atttaagtctttaaaa

SEQ ID NO: 55741 - DNA, 16 bp, H. sapiens
atttaagtctttgatc

SEQ ID NO: 55742 - DNA, 16 bp, H. sapiens
atttaataaaatgcat

SEQ ID NO: 55743 - DNA, 16 bp, H. sapiens
atttaataaacatgta

SEQ ID NO: 55744 - DNA, 16 bp, H. sapiens
atttaataaatggtat

SEQ ID NO: 55745 - DNA, 16 bp, H. sapiens
atttaataaatggttc

SEQ ID NO: 55746 - DNA, 16 bp, H. sapiens
atttaataatgaaact

SEQ ID NO: 55747 - DNA, 16 bp, H. sapiens
atttaatagatgagga

SEQ ID NO: 55748 - DNA, 16 bp, H. sapiens
atttaataggtacaga

SEQ ID NO: 55749 - DNA, 16 bp, H. sapiens
atttaatagtcaaact

SEQ ID NO: 55750 - DNA, 16 bp, H. sapiens
atttaatattcattca

SEQ ID NO: 55751 - DNA, 16 bp, H. sapiens
atttaatatttactga

SEQ ID NO: 55752 - DNA, 16 bp, H. sapiens
atttaatcaaagtttt

SEQ ID NO: 55753 - DNA, 16 bp, H. sapiens
atttaatcaatcatgt

SEQ ID NO: 55754 - DNA, 16 bp, H. sapiens
atttaatccaaagaag

SEQ ID NO: 55755 - DNA, 16 bp, H. sapiens
atttaatcctcacaac

SEQ ID NO: 55756 - DNA, 16 bp, H. sapiens
atttaatcctcacaag

SEQ ID NO: 55757 - DNA, 16 bp, H. sapiens
atttaatcctcataat

SEQ ID NO: 55758 - DNA, 16 bp, H. sapiens
atttaatccttaaaat

SEQ ID NO: 55759 - DNA, 16 bp, H. sapiens
atttaatcttcataat

SEQ ID NO: 55760 - DNA, 16 bp, H. sapiens
atttaatctttacaat

SEQ ID NO: 55761 - DNA, 16 bp, H. sapiens
atttaatgaaaaacat

SEQ ID NO: 55762 - DNA, 16 bp, H. sapiens
atttaatgactgtcct

SEQ ID NO: 55763 - DNA, 16 bp, H. sapiens
atttaatgagcattta

SEQ ID NO: 55764 - DNA, 16 bp, H. sapiens
atttaatgcattttaa

SEQ ID NO: 55765 - DNA, 16 bp, H. sapiens
atttaatgctttttaa

SEQ ID NO: 55766 - DNA, 16 bp, H. sapiens
atttaatggattcaca

SEQ ID NO: 55767 - DNA, 16 bp, H. sapiens
atttaatgtaaatgaa

SEQ ID NO: 55768 - DNA, 16 bp, H. sapiens
atttaatgtcttctct

SEQ ID NO: 55769 - DNA, 16 bp, H. sapiens
atttaatgttttcatt

SEQ ID NO: 55770 - DNA, 16 bp, H. sapiens
atttaattctcataac

SEQ ID NO: 55771 - DNA, 16 bp, H. sapiens
atttaattctgctctg

SEQ ID NO: 55772 - DNA, 16 bp, H. sapiens
atttaatttcattatg

SEQ ID NO: 55773 - DNA, 16 bp, H. sapiens
atttaatttccaaata

SEQ ID NO: 55774 - DNA, 16 bp, H. sapiens
atttaatttggctaaa

SEQ ID NO: 55775 - DNA, 16 bp, H. sapiens
atttaattttagccat

SEQ ID NO: 55776 - DNA, 16 bp, H. sapiens
atttaattttcaaatg

SEQ ID NO: 55777 - DNA, 16 bp, H. sapiens
atttaattttcacaac

SEQ ID NO: 55778 - DNA, 16 bp, H. sapiens
atttaattttgtattc

SEQ ID NO: 55779 - DNA, 16 bp, H. sapiens
atttacaaaaacaagt

SEQ ID NO: 55780 - DNA, 16 bp, H. sapiens
atttacaaaaatgtaa

SEQ ID NO: 55781 - DNA, 16 bp, H. sapiens
atttacaaaaggaaga

SEQ ID NO: 55782 - DNA, 16 bp, H. sapiens
atttacaaagggaaaa

SEQ ID NO: 55783 - DNA, 16 bp, H. sapiens
atttacaaatgtaaaa

SEQ ID NO: 55784 - DNA, 16 bp, H. sapiens
atttacaaatgtttta

SEQ ID NO: 55785 - DNA, 16 bp, H. sapiens
atttacaacagcaaag

SEQ ID NO: 55786 - DNA, 16 bp, H. sapiens
atttacaaccaactga

SEQ ID NO: 55787 - DNA, 16 bp, H. sapiens
atttacaagaaaaaca

SEQ ID NO: 55788 - DNA, 16 bp, H. sapiens
atttacaagaaagaaa

SEQ ID NO: 55789 - DNA, 16 bp, H. sapiens
atttacaagaacaaaa

SEQ ID NO: 55790 - DNA, 16 bp, H. sapiens
atttacaagaagaaaa

SEQ ID NO: 55791 - DNA, 16 bp, H. sapiens
atttacaagccaagga

SEQ ID NO: 55792 - DNA, 16 bp, H. sapiens
atttacaagtaaaaaa

SEQ ID NO: 55793 - DNA, 16 bp, H. sapiens
atttacaagttaattt

SEQ ID NO: 55794 - DNA, 16 bp, H. sapiens
atttacaagtttattt

SEQ ID NO: 55795 - DNA, 16 bp, H. sapiens
atttacaatagccaga

SEQ ID NO: 55796 - DNA, 21 bp, H. sapiens
atttacaatcctttagctaga

SEQ ID NO: 55797 - DNA, 16 bp, H. sapiens
atttacaatttcaaaa

SEQ ID NO: 55798 - DNA, 16 bp, H. sapiens
atttacacacaataaa

SEQ ID NO: 55799 - DNA, 16 bp, H. sapiens
atttacactcctacca

SEQ ID NO: 55800 - DNA, 16 bp, H. sapiens
atttacagaaaaatta

SEQ ID NO: 55801 - DNA, 16 bp, H. sapiens
atttacagaaacattt

SEQ ID NO: 55802 - DNA, 16 bp, H. sapiens
atttacagaagaagaa

SEQ ID NO: 55803 - DNA, 16 bp, H. sapiens
atttacagaagagaaa

SEQ ID NO: 55804 - DNA, 16 bp, H. sapiens
atttacagacaagcaa

SEQ ID NO: 55805 - DNA, 16 bp, H. sapiens
atttacagattcaaag

SEQ ID NO: 55806 - DNA, 16 bp, H. sapiens
atttacagatttaaaa

SEQ ID NO: 55807 - DNA, 16 bp, H. sapiens
atttacagatttaatg

SEQ ID NO: 55808 - DNA, 16 bp, H. sapiens
atttacagtttaaaaa

SEQ ID NO: 55809 - DNA, 16 bp, H. sapiens
atttacataccataaa

SEQ ID NO: 55810 - DNA, 16 bp, H. sapiens
atttacatagcattta

SEQ ID NO: 55811 - DNA, 16 bp, H. sapiens
atttacatagggtgta

SEQ ID NO: 55812 - DNA, 16 bp, H. sapiens
atttacatattacata

SEQ ID NO: 55813 - DNA, 16 bp, H. sapiens
atttacatgttttaaa

SEQ ID NO: 55814 - DNA, 16 bp, H. sapiens
atttacattaaatgtt

SEQ ID NO: 55815 - DNA, 16 bp, H. sapiens
atttacattcccatta

SEQ ID NO: 55816 - DNA, 16 bp, H. sapiens
atttacattgccatgg

SEQ ID NO: 55817 - DNA, 16 bp, H. sapiens
atttacatttacaaaa

SEQ ID NO: 55818 - DNA, 16 bp, H. sapiens
atttacatttacatat

SEQ ID NO: 55819 - DNA, 16 bp, H. sapiens
atttacatttagggtt

SEQ ID NO: 55820 - DNA, 16 bp, H. sapiens
atttacatttctatca

SEQ ID NO: 55821 - DNA, 16 bp, H. sapiens
atttacattttaagtt

SEQ ID NO: 55822 - DNA, 16 bp, H. sapiens
atttacattttcacta

SEQ ID NO: 55823 - DNA, 16 bp, H. sapiens
atttacattttccaaa

SEQ ID NO: 55824 - DNA, 16 bp, H. sapiens
atttacattttcctta

SEQ ID NO: 55825 - DNA, 16 bp, H. sapiens
atttaccaaaaattta

SEQ ID NO: 55826 - DNA, 16 bp, H. sapiens
atttaccagcacatca

SEQ ID NO: 55827 - DNA, 16 bp, H. sapiens
atttaccagggtgggg

SEQ ID NO: 55828 - DNA, 16 bp, H. sapiens
atttaccagtttttaa

SEQ ID NO: 55829 - DNA, 16 bp, H. sapiens
atttaccatatgaccc

SEQ ID NO: 55830 - DNA, 16 bp, H. sapiens
atttaccattttaaac

SEQ ID NO: 55831 - DNA, 16 bp, H. sapiens
atttacccaaaggagc

SEQ ID NO: 55832 - DNA, 16 bp, H. sapiens
atttacccacctcggc

SEQ ID NO: 55833 - DNA, 16 bp, H. sapiens
atttaccctaaaactt

SEQ ID NO: 55834 - DNA, 16 bp, H. sapiens
atttacctgtttttct

SEQ ID NO: 55835 - DNA, 16 bp, H. sapiens
atttacctttttaaaa

SEQ ID NO: 55836 - DNA, 16 bp, H. sapiens
atttactacctggccc

SEQ ID NO: 55837 - DNA, 16 bp, H. sapiens
atttactactttaaaa

SEQ ID NO: 55838 - DNA, 16 bp, H. sapiens
atttactatgtgccag

SEQ ID NO: 55839 - DNA, 16 bp, H. sapiens
atttactatgtttatt

SEQ ID NO: 55840 - DNA, 16 bp, H. sapiens
atttactcactatcat

SEQ ID NO: 55841 - DNA, 16 bp, H. sapiens
atttactctgttgata

SEQ ID NO: 55842 - DNA, 16 bp, H. sapiens
atttactcttaataaa

SEQ ID NO: 55843 - DNA, 16 bp, H. sapiens
atttactgaatactgt

SEQ ID NO: 55844 - DNA, 16 bp, H. sapiens
atttactgagcatcta

SEQ ID NO: 55845 - DNA, 16 bp, H. sapiens
atttactgagtgccag

SEQ ID NO: 55846 - DNA, 16 bp, H. sapiens
atttactgagtgccta

SEQ ID NO: 55847 - DNA, 16 bp, H. sapiens
atttactgagtgtcta

SEQ ID NO: 55848 - DNA, 16 bp, H. sapiens
atttactgattttaaa

SEQ ID NO: 55849 - DNA, 16 bp, H. sapiens
atttactgtatattta

SEQ ID NO: 55850 - DNA, 16 bp, H. sapiens
atttactgtattattc

SEQ ID NO: 55851 - DNA, 16 bp, H. sapiens
atttacttggtgtaca

SEQ ID NO: 55852 - DNA, 16 bp, H. sapiens
atttacttgtttttaa

SEQ ID NO: 55853 - DNA, 16 bp, H. sapiens
atttactttaaaagaa

SEQ ID NO: 55854 - DNA, 16 bp, H. sapiens
atttactttgaaaaat

SEQ ID NO: 55855 - DNA, 16 bp, H. sapiens
atttacttttgtaaat

SEQ ID NO: 55856 - DNA, 16 bp, H. sapiens
atttagaaaaacaaat

SEQ ID NO: 55857 - DNA, 16 bp, H. sapiens
atttagaaaaagaaca

SEQ ID NO: 55858 - DNA, 16 bp, H. sapiens
atttagaaaatacaga

SEQ ID NO: 55859 - DNA, 16 bp, H. sapiens
atttagaaaatatact

SEQ ID NO: 55860 - DNA, 16 bp, H. sapiens
atttagaaaatgttca

SEQ ID NO: 55861 - DNA, 16 bp, H. sapiens
atttagaaaccaagat

SEQ ID NO: 55862 - DNA, 16 bp, H. sapiens
atttagaaactaaaat

SEQ ID NO: 55863 - DNA, 16 bp, H. sapiens
atttagaaactatttt

SEQ ID NO: 55864 - DNA, 16 bp, H. sapiens
atttagaaagatattt

SEQ ID NO: 55865 - DNA, 16 bp, H. sapiens
atttagaaagtttctt

SEQ ID NO: 55866 - DNA, 16 bp, H. sapiens
atttagaaatcatttt

SEQ ID NO: 55867 - DNA, 16 bp, H. sapiens
atttagaaatttctgt

SEQ ID NO: 55868 - DNA, 16 bp, H. sapiens
atttagaactcctttt

SEQ ID NO: 55869 - DNA, 16 bp, H. sapiens
atttagaagaaatgaa

SEQ ID NO: 55870 - DNA, 16 bp, H. sapiens
atttagaataatgttt

SEQ ID NO: 55871 - DNA, 16 bp, H. sapiens
atttagaatattacat

SEQ ID NO: 55872 - DNA, 16 bp, H. sapiens
atttagaatcagaaaa

SEQ ID NO: 55873 - DNA, 16 bp, H. sapiens
atttagaatgttacat

SEQ ID NO: 55874 - DNA, 16 bp, H. sapiens
atttagaatttagaat

SEQ ID NO: 55875 - DNA, 16 bp, H. sapiens
atttagactttttaaa

SEQ ID NO: 55876 - DNA, 16 bp, H. sapiens
atttagaggaagaaaa

SEQ ID NO: 55877 - DNA, 16 bp, H. sapiens
atttagagggtacaag

SEQ ID NO: 55878 - DNA, 16 bp, H. sapiens
atttagaggtttattt

SEQ ID NO: 55879 - DNA, 16 bp, H. sapiens
atttagagtttaaaaa

SEQ ID NO: 55880 - DNA, 16 bp, H. sapiens
atttagcaaaatattt

SEQ ID NO: 55881 - DNA, 16 bp, H. sapiens
atttagcaaataaaaa

SEQ ID NO: 55882 - DNA, 16 bp, H. sapiens
atttagcaatttaaaa

SEQ ID NO: 55883 - DNA, 16 bp, H. sapiens
atttagcagtttaaaa

SEQ ID NO: 55884 - DNA, 16 bp, H. sapiens
atttagctaataaaaa

SEQ ID NO: 55885 - DNA, 16 bp, H. sapiens
atttagcttccattta

SEQ ID NO: 55886 - DNA, 16 bp, H. sapiens
atttagctttaaaaaa

SEQ ID NO: 55887 - DNA, 16 bp, H. sapiens
atttagcttttaaaaa

SEQ ID NO: 55888 - DNA, 16 bp, H. sapiens
atttaggaaaacaaaa

SEQ ID NO: 55889 - DNA, 16 bp, H. sapiens
atttaggaagtaaaat

SEQ ID NO: 55890 - DNA, 16 bp, H. sapiens
atttaggaataaatat

SEQ ID NO: 55891 - DNA, 16 bp, H. sapiens
atttaggaattttaaa

SEQ ID NO: 55892 - DNA, 16 bp, H. sapiens
atttaggagaaaatat

SEQ ID NO: 55893 - DNA, 16 bp, H. sapiens
atttaggatatctggc

SEQ ID NO: 55894 - DNA, 16 bp, H. sapiens
atttaggtataattga

SEQ ID NO: 55895 - DNA, 16 bp, H. sapiens
atttaggttgtttcta

SEQ ID NO: 55896 - DNA, 16 bp, H. sapiens
atttaggttttaaaat

SEQ ID NO: 55897 - DNA, 20 bp, H. sapiens
atttagtagagacagggttt

SEQ ID NO: 55898 - DNA, 16 bp, H. sapiens
atttagtcattcattt

SEQ ID NO: 55899 - DNA, 16 bp, H. sapiens
atttagtgagcactta

SEQ ID NO: 55900 - DNA, 16 bp, H. sapiens
atttagtgcaataaat

SEQ ID NO: 55901 - DNA, 16 bp, H. sapiens
atttagtggcataaaa

SEQ ID NO: 55902 - DNA, 16 bp, H. sapiens
atttagtggcttaaaa

SEQ ID NO: 55903 - DNA, 16 bp, H. sapiens
atttagttacctccca

SEQ ID NO: 55904 - DNA, 16 bp, H. sapiens
atttagttcagtgttt

SEQ ID NO: 55905 - DNA, 16 bp, H. sapiens
atttagttcatttgtt

SEQ ID NO: 55906 - DNA, 16 bp, H. sapiens
atttagttctcacaat

SEQ ID NO: 55907 - DNA, 16 bp, H. sapiens
atttagttttataaga

SEQ ID NO: 55908 - DNA, 16 bp, H. sapiens
atttataaaaacagat

SEQ ID NO: 55909 - DNA, 16 bp, H. sapiens
atttataaaaccatca

SEQ ID NO: 55910 - DNA, 16 bp, H. sapiens
atttataaacaaaaga

SEQ ID NO: 55911 - DNA, 16 bp, H. sapiens
atttataaacatagaa

SEQ ID NO: 55912 - DNA, 16 bp, H. sapiens
atttataaagaaagag

SEQ ID NO: 55913 - DNA, 16 bp, H. sapiens
atttataaagaacata

SEQ ID NO: 55914 - DNA, 16 bp, H. sapiens
atttataaagagaaga

SEQ ID NO: 55915 - DNA, 16 bp, H. sapiens
atttataaatatgctt

SEQ ID NO: 55916 - DNA, 16 bp, H. sapiens
atttataaatcaccca

SEQ ID NO: 55917 - DNA, 16 bp, H. sapiens
atttataaatttggaa

SEQ ID NO: 55918 - DNA, 16 bp, H. sapiens
atttataatagctttt

SEQ ID NO: 55919 - DNA, 16 bp, H. sapiens
atttataatgaacaga

SEQ ID NO: 55920 - DNA, 16 bp, H. sapiens
atttataattgcaaaa

SEQ ID NO: 55921 - DNA, 16 bp, H. sapiens
atttataatttgcttt

SEQ ID NO: 55922 - DNA, 16 bp, H. sapiens
atttatacacatacat

SEQ ID NO: 55923 - DNA, 16 bp, H. sapiens
atttatacattttcct

SEQ ID NO: 55924 - DNA, 16 bp, H. sapiens
atttatagaaaaactg

SEQ ID NO: 55925 - DNA, 16 bp, H. sapiens
atttatagaaatcaga

SEQ ID NO: 55926 - DNA, 16 bp, H. sapiens
atttatagagaaaaag

SEQ ID NO: 55927 - DNA, 16 bp, H. sapiens
atttatagattcattt

SEQ ID NO: 55928 - DNA, 16 bp, H. sapiens
atttatagcacaaaat

SEQ ID NO: 55929 - DNA, 16 bp, H. sapiens
atttatagcatttttt

SEQ ID NO: 55930 - DNA, 16 bp, H. sapiens
atttatagtcctttga

SEQ ID NO: 55931 - DNA, 16 bp, H. sapiens
atttatataggaaaga

SEQ ID NO: 55932 - DNA, 16 bp, H. sapiens
atttatatatgttgaa

SEQ ID NO: 55933 - DNA, 16 bp, H. sapiens
atttatatcagaaaaa

SEQ ID NO: 55934 - DNA, 16 bp, H. sapiens
atttatatgaaatatc

SEQ ID NO: 55935 - DNA, 16 bp, H. sapiens
atttatatgaaattct

SEQ ID NO: 55936 - DNA, 16 bp, H. sapiens
atttatatgaagtcca

SEQ ID NO: 55937 - DNA, 16 bp, H. sapiens
atttatatggaaacac

SEQ ID NO: 55938 - DNA, 16 bp, H. sapiens
atttatattactttgg

SEQ ID NO: 55939 - DNA, 16 bp, H. sapiens
atttatattcagtgtt

SEQ ID NO: 55940 - DNA, 16 bp, H. sapiens
atttatatttaaaagg

SEQ ID NO: 55941 - DNA, 16 bp, H. sapiens
atttatatttacatgt

SEQ ID NO: 55942 - DNA, 16 bp, H. sapiens
atttatatttggcttt

SEQ ID NO: 55943 - DNA, 16 bp, H. sapiens
atttatattttctgga

SEQ ID NO: 55944 - DNA, 16 bp, H. sapiens
atttatcaaaaaagaa

SEQ ID NO: 55945 - DNA, 16 bp, H. sapiens
atttatcaaaactcat

SEQ ID NO: 55946 - DNA, 16 bp, H. sapiens
atttatcaaaatgtat

SEQ ID NO: 55947 - DNA, 16 bp, H. sapiens
atttatcaaattgtat

SEQ ID NO: 55948 - DNA, 16 bp, H. sapiens
atttatcaagcattta

SEQ ID NO: 55949 - DNA, 18 bp, H. sapiens
atttatcaattttggctt

SEQ ID NO: 55950 - DNA, 16 bp, H. sapiens
atttatcaatttttcc

SEQ ID NO: 55951 - DNA, 16 bp, H. sapiens
atttatcacagagaaa

SEQ ID NO: 55952 - DNA, 16 bp, H. sapiens
atttatcacctgctaa

SEQ ID NO: 55953 - DNA, 16 bp, H. sapiens
atttatcagttctaat

SEQ ID NO: 55954 - DNA, 16 bp, H. sapiens
atttatcatttatttg

SEQ ID NO: 55955 - DNA, 16 bp, H. sapiens
atttatcatttctttg

SEQ ID NO: 55956 - DNA, 16 bp, H. sapiens
atttatccagttcttc

SEQ ID NO: 55957 - DNA, 16 bp, H. sapiens
atttatccatttatct

SEQ ID NO: 55958 - DNA, 16 bp, H. sapiens
atttatccatttcttg

SEQ ID NO: 55959 - DNA, 16 bp, H. sapiens
atttatccctgagatg

SEQ ID NO: 55960 - DNA, 16 bp, H. sapiens
atttatcctttgcatt

SEQ ID NO: 55961 - DNA, 16 bp, H. sapiens
atttatctaaaaatgt

SEQ ID NO: 55962 - DNA, 16 bp, H. sapiens
atttatctattcattc

SEQ ID NO: 55963 - DNA, 16 bp, H. sapiens
atttatctatttgtat

SEQ ID NO: 55964 - DNA, 16 bp, H. sapiens
atttatctctgggatg

SEQ ID NO: 55965 - DNA, 16 bp, H. sapiens
atttatctcttttgta

SEQ ID NO: 55966 - DNA, 16 bp, H. sapiens
atttatctgataaatt

SEQ ID NO: 55967 - DNA, 16 bp, H. sapiens
atttatctgtaaatat

SEQ ID NO: 55968 - DNA, 16 bp, H. sapiens
atttatcttaaagaaa

SEQ ID NO: 55969 - DNA, 16 bp, H. sapiens
atttatctttgtaaat

SEQ ID NO: 55970 - DNA, 16 bp, H. sapiens
atttatctttgtatat

SEQ ID NO: 55971 - DNA, 16 bp, H. sapiens
atttatctttgtattc

SEQ ID NO: 55972 - DNA, 16 bp, H. sapiens
atttatctttgtttcc

SEQ ID NO: 55973 - DNA, 16 bp, H. sapiens
atttatgaaaaatcca

SEQ ID NO: 55974 - DNA, 16 bp, H. sapiens
atttatgaaacataaa

SEQ ID NO: 55975 - DNA, 16 bp, H. sapiens
atttatgaaataaatg

SEQ ID NO: 55976 - DNA, 16 bp, H. sapiens
atttatgaagaaaaga

SEQ ID NO: 55977 - DNA, 16 bp, H. sapiens
atttatgaagaagaga

SEQ ID NO: 55978 - DNA, 16 bp, H. sapiens
atttatgaattttcca

SEQ ID NO: 55979 - DNA, 16 bp, H. sapiens
atttatgaattttctt

SEQ ID NO: 55980 - DNA, 16 bp, H. sapiens
atttatgactttgcct

SEQ ID NO: 55981 - DNA, 16 bp, H. sapiens
atttatgcaaaaatat

SEQ ID NO: 55982 - DNA, 16 bp, H. sapiens
atttatgcaaattaaa

SEQ ID NO: 55983 - DNA, 16 bp, H. sapiens
atttatgcaacaaata

SEQ ID NO: 55984 - DNA, 16 bp, H. sapiens
atttatgcatttattt

SEQ ID NO: 55985 - DNA, 16 bp, H. sapiens
atttatgcatttcttt

SEQ ID NO: 55986 - DNA, 16 bp, H. sapiens
atttatgctgccaaaa

SEQ ID NO: 55987 - DNA, 16 bp, H. sapiens
atttatgctttgtgtt

SEQ ID NO: 55988 - DNA, 16 bp, H. sapiens
atttatggaaaaatgt

SEQ ID NO: 55989 - DNA, 16 bp, H. sapiens
atttatggagagaaaa

SEQ ID NO: 55990 - DNA, 16 bp, H. sapiens
atttatggatgaggaa

SEQ ID NO: 55991 - DNA, 16 bp, H. sapiens
atttatgtaaaaatgt

SEQ ID NO: 55992 - DNA, 16 bp, H. sapiens
atttatgtgaaaaatg

SEQ ID NO: 55993 - DNA, 16 bp, H. sapiens
atttatgtgggtctat

SEQ ID NO: 55994 - DNA, 16 bp, H. sapiens
atttatgtgtatatgt

SEQ ID NO: 55995 - DNA, 16 bp, H. sapiens
atttatgtgttcattt

SEQ ID NO: 55996 - DNA, 16 bp, H. sapiens
atttatgtttaattct

SEQ ID NO: 55997 - DNA, 16 bp, H. sapiens
atttatgtttttgaga

SEQ ID NO: 55998 - DNA, 16 bp, H. sapiens
atttattaaaaatgga

SEQ ID NO: 55999 - DNA, 16 bp, H. sapiens
atttattaaacaacta

SEQ ID NO: 56000 - DNA, 16 bp, H. sapiens
atttattaaatagaga

SEQ ID NO: 56001 - DNA, 16 bp, H. sapiens
atttattaaatgcatt

SEQ ID NO: 56002 - DNA, 16 bp, H. sapiens
atttattaacagcaaa

SEQ ID NO: 56003 - DNA, 16 bp, H. sapiens
atttattaacattgaa

SEQ ID NO: 56004 - DNA, 16 bp, H. sapiens
atttattaagcaccta

SEQ ID NO: 56005 - DNA, 16 bp, H. sapiens
atttattaagcacctg

SEQ ID NO: 56006 - DNA, 16 bp, H. sapiens
atttattaagcattta

SEQ ID NO: 56007 - DNA, 16 bp, H. sapiens
atttattaagtaccta

SEQ ID NO: 56008 - DNA, 16 bp, H. sapiens
atttattaagtgaaaa

SEQ ID NO: 56009 - DNA, 16 bp, H. sapiens
atttattacacagcaa

SEQ ID NO: 56010 - DNA, 16 bp, H. sapiens
atttattagagaaagt

SEQ ID NO: 56011 - DNA, 16 bp, H. sapiens
atttattatgctttaa

SEQ ID NO: 56012 - DNA, 16 bp, H. sapiens
atttattcaaacattt

SEQ ID NO: 56013 - DNA, 16 bp, H. sapiens
atttattcaaaggaaa

SEQ ID NO: 56014 - DNA, 16 bp, H. sapiens
atttattcaacagaca

SEQ ID NO: 56015 - DNA, 16 bp, H. sapiens
atttattcaacattca

SEQ ID NO: 56016 - DNA, 16 bp, H. sapiens
atttattcaagaaaag

SEQ ID NO: 56017 - DNA, 16 bp, H. sapiens
atttattcaagagaaa

SEQ ID NO: 56018 - DNA, 16 bp, H. sapiens
atttattcaataaaca

SEQ ID NO: 56019 - DNA, 16 bp, H. sapiens
atttattcacatatat

SEQ ID NO: 56020 - DNA, 16 bp, H. sapiens
atttattcaggaaaaa

SEQ ID NO: 56021 - DNA, 16 bp, H. sapiens
atttattcattcaaca

SEQ ID NO: 56022 - DNA, 16 bp, H. sapiens
atttattcattcacct

SEQ ID NO: 56023 - DNA, 16 bp, H. sapiens
atttattcattcagtg

SEQ ID NO: 56024 - DNA, 16 bp, H. sapiens
atttattcatttaaca

SEQ ID NO: 56025 - DNA, 16 bp, H. sapiens
atttattccaaaattg

SEQ ID NO: 56026 - DNA, 16 bp, H. sapiens
atttattccagttttc

SEQ ID NO: 56027 - DNA, 16 bp, H. sapiens
atttattcctaaaata

SEQ ID NO: 56028 - DNA, 16 bp, H. sapiens
atttattctgcatttt

SEQ ID NO: 56029 - DNA, 16 bp, H. sapiens
atttattctttaacaa

SEQ ID NO: 56030 - DNA, 16 bp, H. sapiens
atttattgaaaaacat

SEQ ID NO: 56031 - DNA, 16 bp, H. sapiens
atttattgaaaaggct

SEQ ID NO: 56032 - DNA, 16 bp, H. sapiens
atttattgaaaagggt

SEQ ID NO: 56033 - DNA, 16 bp, H. sapiens
atttattgaaagctta

SEQ ID NO: 56034 - DNA, 16 bp, H. sapiens
atttattgaaatgaaa

SEQ ID NO: 56035 - DNA, 16 bp, H. sapiens
atttattgaacaaatg

SEQ ID NO: 56036 - DNA, 16 bp, H. sapiens
atttattgaagaaact

SEQ ID NO: 56037 - DNA, 16 bp, H. sapiens
atttattgaagaggct

SEQ ID NO: 56038 - DNA, 16 bp, H. sapiens
atttattgaaggaaaa

SEQ ID NO: 56039 - DNA, 16 bp, H. sapiens
atttattgaatacatt

SEQ ID NO: 56040 - DNA, 16 bp, H. sapiens
atttattgaataccta

SEQ ID NO: 56041 - DNA, 16 bp, H. sapiens
atttattgaatgaaag

SEQ ID NO: 56042 - DNA, 16 bp, H. sapiens
atttattgaatgaatt

SEQ ID NO: 56043 - DNA, 16 bp, H. sapiens
atttattgaatgccta

SEQ ID NO: 56044 - DNA, 16 bp, H. sapiens
atttattgaattccta

SEQ ID NO: 56045 - DNA, 16 bp, H. sapiens
atttattgacatattt

SEQ ID NO: 56046 - DNA, 16 bp, H. sapiens
atttattgaccactta

SEQ ID NO: 56047 - DNA, 16 bp, H. sapiens
atttattgagaaaata

SEQ ID NO: 56048 - DNA, 16 bp, H. sapiens
atttattgagcaccta

SEQ ID NO: 56049 - DNA, 16 bp, H. sapiens
atttattgagcacctt

SEQ ID NO: 56050 - DNA, 16 bp, H. sapiens
atttattgagcacttg

SEQ ID NO: 56051 - DNA, 16 bp, H. sapiens
atttattgagcatcta

SEQ ID NO: 56052 - DNA, 16 bp, H. sapiens
atttattgagggccta

SEQ ID NO: 56053 - DNA, 16 bp, H. sapiens
atttattgagtaccca

SEQ ID NO: 56054 - DNA, 16 bp, H. sapiens
atttattgagtgccaa

SEQ ID NO: 56055 - DNA, 16 bp, H. sapiens
atttattgagtgccca

SEQ ID NO: 56056 - DNA, 16 bp, H. sapiens
atttattgagtgctta

SEQ ID NO: 56057 - DNA, 16 bp, H. sapiens
atttattgagtgtctt

SEQ ID NO: 56058 - DNA, 16 bp, H. sapiens
atttattgagttctta

SEQ ID NO: 56059 - DNA, 16 bp, H. sapiens
atttattgatcatcta

SEQ ID NO: 56060 - DNA, 16 bp, H. sapiens
atttattgatgagact

SEQ ID NO: 56061 - DNA, 16 bp, H. sapiens
atttattgcaaagagc

SEQ ID NO: 56062 - DNA, 16 bp, H. sapiens
atttattgcagcacta

SEQ ID NO: 56063 - DNA, 16 bp, H. sapiens
atttattgcagtacta

SEQ ID NO: 56064 - DNA, 16 bp, H. sapiens
atttattgcagtcttc

SEQ ID NO: 56065 - DNA, 16 bp, H. sapiens
atttattgcatattta

SEQ ID NO: 56066 - DNA, 16 bp, H. sapiens
atttattgcatgctta

SEQ ID NO: 56067 - DNA, 16 bp, H. sapiens
atttattgcggcacta

SEQ ID NO: 56068 - DNA, 16 bp, H. sapiens
atttattggacaccta

SEQ ID NO: 56069 - DNA, 16 bp, H. sapiens
atttattggatgaata

SEQ ID NO: 56070 - DNA, 16 bp, H. sapiens
atttattggctatttg

SEQ ID NO: 56071 - DNA, 16 bp, H. sapiens
atttattgtacaacat

SEQ ID NO: 56072 - DNA, 16 bp, H. sapiens
atttattgtacatttt

SEQ ID NO: 56073 - DNA, 16 bp, H. sapiens
atttattgtgtatttc

SEQ ID NO: 56074 - DNA, 16 bp, H. sapiens
atttatttaaaaaagg

SEQ ID NO: 56075 - DNA, 16 bp, H. sapiens
atttatttaaaagatc

SEQ ID NO: 56076 - DNA, 16 bp, H. sapiens
atttatttaaatgtct

SEQ ID NO: 56077 - DNA, 16 bp, H. sapiens
atttatttaacaaaga

SEQ ID NO: 56078 - DNA, 16 bp, H. sapiens
atttatttaacatgta

SEQ ID NO: 56079 - DNA, 16 bp, H. sapiens
atttatttagactttt

SEQ ID NO: 56080 - DNA, 16 bp, H. sapiens
atttatttagatcttc

SEQ ID NO: 56081 - DNA, 16 bp, H. sapiens
atttatttagatcttt

SEQ ID NO: 56082 - DNA, 16 bp, H. sapiens
atttatttagctattt

SEQ ID NO: 56083 - DNA, 16 bp, H. sapiens
atttatttagctcttt

SEQ ID NO: 56084 - DNA, 16 bp, H. sapiens
atttatttagtacttt

SEQ ID NO: 56085 - DNA, 16 bp, H. sapiens
atttatttatacatgt

SEQ ID NO: 56086 - DNA, 16 bp, H. sapiens
atttatttatatgaga

SEQ ID NO: 56087 - DNA, 16 bp, H. sapiens
atttatttatgaagaa

SEQ ID NO: 56088 - DNA, 16 bp, H. sapiens
atttatttatgtcaat

SEQ ID NO: 56089 - DNA, 16 bp, H. sapiens
atttatttattcagca

SEQ ID NO: 56090 - DNA, 16 bp, H. sapiens
atttatttattgagca

SEQ ID NO: 56091 - DNA, 16 bp, H. sapiens
atttatttatttggag

SEQ ID NO: 56092 - DNA, 16 bp, H. sapiens
atttatttcaaaacat

SEQ ID NO: 56093 - DNA, 16 bp, H. sapiens
atttatttcactttca

SEQ ID NO: 56094 - DNA, 16 bp, H. sapiens
atttatttcagagaaa

SEQ ID NO: 56095 - DNA, 16 bp, H. sapiens
atttatttcaggacaa

SEQ ID NO: 56096 - DNA, 16 bp, H. sapiens
atttatttcatcttcc

SEQ ID NO: 56097 - DNA, 16 bp, H. sapiens
atttatttccacacag

SEQ ID NO: 56098 - DNA, 16 bp, H. sapiens
atttatttccagaaaa

SEQ ID NO: 56099 - DNA, 16 bp, H. sapiens
atttatttccctttca

SEQ ID NO: 56100 - DNA, 16 bp, H. sapiens
atttatttctagaaaa

SEQ ID NO: 56101 - DNA, 16 bp, H. sapiens
atttatttctgaataa

SEQ ID NO: 56102 - DNA, 16 bp, H. sapiens
atttatttctgtatgt

SEQ ID NO: 56103 - DNA, 16 bp, H. sapiens
atttatttctgttaaa

SEQ ID NO: 56104 - DNA, 16 bp, H. sapiens
atttatttcttttgga

SEQ ID NO: 56105 - DNA, 16 bp, H. sapiens
atttatttgaaaaaca

SEQ ID NO: 56106 - DNA, 16 bp, H. sapiens
atttatttgaaaagga

SEQ ID NO: 56107 - DNA, 16 bp, H. sapiens
atttatttgaaataga

SEQ ID NO: 56108 - DNA, 16 bp, H. sapiens
atttatttgaaattct

SEQ ID NO: 56109 - DNA, 16 bp, H. sapiens
atttatttgaatactt

SEQ ID NO: 56110 - DNA, 16 bp, H. sapiens
atttatttgacatttt

SEQ ID NO: 56111 - DNA, 16 bp, H. sapiens
atttatttgagatgga

SEQ ID NO: 56112 - DNA, 16 bp, H. sapiens
atttatttgcctttat

SEQ ID NO: 56113 - DNA, 16 bp, H. sapiens
atttatttgggagaaa

SEQ ID NO: 56114 - DNA, 16 bp, H. sapiens
atttatttgggaggtg

SEQ ID NO: 56115 - DNA, 16 bp, H. sapiens
atttatttggggaaaa

SEQ ID NO: 56116 - DNA, 16 bp, H. sapiens
atttatttgtatttca

SEQ ID NO: 56117 - DNA, 16 bp, H. sapiens
atttatttgtgtcttc

SEQ ID NO: 56118 - DNA, 16 bp, H. sapiens
atttattttcaccctt

SEQ ID NO: 56119 - DNA, 16 bp, H. sapiens
atttattttcagcttt

SEQ ID NO: 56120 - DNA, 16 bp, H. sapiens
atttattttcatggct

SEQ ID NO: 56121 - DNA, 16 bp, H. sapiens
atttattttcctacag

SEQ ID NO: 56122 - DNA, 16 bp, H. sapiens
atttattttcctgtct

SEQ ID NO: 56123 - DNA, 16 bp, H. sapiens
atttattttctacaaa

SEQ ID NO: 56124 - DNA, 16 bp, H. sapiens
atttattttctgaaga

SEQ ID NO: 56125 - DNA, 16 bp, H. sapiens
atttattttgagacac

SEQ ID NO: 56126 - DNA, 16 bp, H. sapiens
atttattttgcagaaa

SEQ ID NO: 56127 - DNA, 16 bp, H. sapiens
atttattttgcataat

SEQ ID NO: 56128 - DNA, 16 bp, H. sapiens
atttattttgcatatt

SEQ ID NO: 56129 - DNA, 16 bp, H. sapiens
atttattttggaaata

SEQ ID NO: 56130 - DNA, 16 bp, H. sapiens
atttattttgtaaaca

SEQ ID NO: 56131 - DNA, 16 bp, H. sapiens
atttatttttaaatgc

SEQ ID NO: 56132 - DNA, 16 bp, H. sapiens
atttatttttagcact

SEQ ID NO: 56133 - DNA, 16 bp, H. sapiens
atttatttttaggaaa

SEQ ID NO: 56134 - DNA, 16 bp, H. sapiens
atttatttttatgtca

SEQ ID NO: 56135 - DNA, 16 bp, H. sapiens
atttatttttcaaatg

SEQ ID NO: 56136 - DNA, 16 bp, H. sapiens
atttatttttcaacaa

SEQ ID NO: 56137 - DNA, 16 bp, H. sapiens
atttatttttcagttc

SEQ ID NO: 56138 - DNA, 16 bp, H. sapiens
atttatttttcataga

SEQ ID NO: 56139 - DNA, 16 bp, H. sapiens
atttatttttccaaag

SEQ ID NO: 56140 - DNA, 16 bp, H. sapiens
atttatttttccattg

SEQ ID NO: 56141 - DNA, 16 bp, H. sapiens
atttatttttcccagt

SEQ ID NO: 56142 - DNA, 16 bp, H. sapiens
atttatttttcccata

SEQ ID NO: 56143 - DNA, 16 bp, H. sapiens
atttatttttctgaaa

SEQ ID NO: 56144 - DNA, 16 bp, H. sapiens
atttatttttgaaaca

SEQ ID NO: 56145 - DNA, 16 bp, H. sapiens
atttatttttgaagaa

SEQ ID NO: 56146 - DNA, 16 bp, H. sapiens
atttattttttcaaga

SEQ ID NO: 56147 - DNA, 16 bp, H. sapiens
atttattttttgaaac

SEQ ID NO: 56148 - DNA, 16 bp, H. sapiens
atttattttttgagac

SEQ ID NO: 56149 - DNA, 16 bp, H. sapiens
atttattttttgctga

SEQ ID NO: 56150 - DNA, 16 bp, H. sapiens
atttcaaaaaagaaat

SEQ ID NO: 56151 - DNA, 16 bp, H. sapiens
atttcaaaaaagaaga

SEQ ID NO: 56152 - DNA, 16 bp, H. sapiens
atttcaaaaactgaaa

SEQ ID NO: 56153 - DNA, 16 bp, H. sapiens
atttcaaaaagaagaa

SEQ ID NO: 56154 - DNA, 16 bp, H. sapiens
atttcaaaacacatta

SEQ ID NO: 56155 - DNA, 16 bp, H. sapiens
atttcaaaacacattt

SEQ ID NO: 56156 - DNA, 16 bp, H. sapiens
atttcaaaacagaaat

SEQ ID NO: 56157 - DNA, 16 bp, H. sapiens
atttcaaaacatttaa

SEQ ID NO: 56158 - DNA, 16 bp, H. sapiens
atttcaaaactaatca

SEQ ID NO: 56159 - DNA, 16 bp, H. sapiens
atttcaaaagaaaatt

SEQ ID NO: 56160 - DNA, 16 bp, H. sapiens
atttcaaaagaaataa

SEQ ID NO: 56161 - DNA, 16 bp, H. sapiens
atttcaaaagaggaaa

SEQ ID NO: 56162 - DNA, 16 bp, H. sapiens
atttcaaaaggaaaaa

SEQ ID NO: 56163 - DNA, 16 bp, H. sapiens
atttcaaaataaagtt

SEQ ID NO: 56164 - DNA, 16 bp, H. sapiens
atttcaaaatacatta

SEQ ID NO: 56165 - DNA, 16 bp, H. sapiens
atttcaaaatcaaatt

SEQ ID NO: 56166 - DNA, 16 bp, H. sapiens
atttcaaaatgtgaaa

SEQ ID NO: 56167 - DNA, 16 bp, H. sapiens
atttcaaaatgtttgt

SEQ ID NO: 56168 - DNA, 16 bp, H. sapiens
atttcaaaattaatgt

SEQ ID NO: 56169 - DNA, 16 bp, H. sapiens
atttcaaaattatgtt

SEQ ID NO: 56170 - DNA, 16 bp, H. sapiens
atttcaaaattcattt

SEQ ID NO: 56171 - DNA, 16 bp, H. sapiens
atttcaaaattgctaa

SEQ ID NO: 56172 - DNA, 16 bp, H. sapiens
atttcaaaattttgtt

SEQ ID NO: 56173 - DNA, 16 bp, H. sapiens
atttcaaacaaaagaa

SEQ ID NO: 56174 - DNA, 16 bp, H. sapiens
atttcaaacaatagaa

SEQ ID NO: 56175 - DNA, 16 bp, H. sapiens
atttcaaacagaagaa

SEQ ID NO: 56176 - DNA, 16 bp, H. sapiens
atttcaaacattattt

SEQ ID NO: 56177 - DNA, 16 bp, H. sapiens
atttcaaagaaaaatg

SEQ ID NO: 56178 - DNA, 16 bp, H. sapiens
atttcaaagaacagaa

SEQ ID NO: 56179 - DNA, 16 bp, H. sapiens
atttcaaagaatttta

SEQ ID NO: 56180 - DNA, 16 bp, H. sapiens
atttcaaagacttggt

SEQ ID NO: 56181 - DNA, 16 bp, H. sapiens
atttcaaagataaaat

SEQ ID NO: 56182 - DNA, 16 bp, H. sapiens
atttcaaaggtatttt

SEQ ID NO: 56183 - DNA, 16 bp, H. sapiens
atttcaaagtctttca

SEQ ID NO: 56184 - DNA, 16 bp, H. sapiens
atttcaaataacctgt

SEQ ID NO: 56185 - DNA, 16 bp, H. sapiens
atttcaaataagaaat

SEQ ID NO: 56186 - DNA, 16 bp, H. sapiens
atttcaaatatatttg

SEQ ID NO: 56187 - DNA, 16 bp, H. sapiens
atttcaaatatgtttt

SEQ ID NO: 56188 - DNA, 16 bp, H. sapiens
atttcaaatattctca

SEQ ID NO: 56189 - DNA, 16 bp, H. sapiens
atttcaaatatttaca

SEQ ID NO: 56190 - DNA, 16 bp, H. sapiens
atttcaaatgaatgaa

SEQ ID NO: 56191 - DNA, 16 bp, H. sapiens
atttcaaatgtaaaaa

SEQ ID NO: 56192 - DNA, 16 bp, H. sapiens
atttcaaatgtttatt

SEQ ID NO: 56193 - DNA, 16 bp, H. sapiens
atttcaaatgttttgt

SEQ ID NO: 56194 - DNA, 16 bp, H. sapiens
atttcaaattagaaaa

SEQ ID NO: 56195 - DNA, 16 bp, H. sapiens
atttcaaattttcaga

SEQ ID NO: 56196 - DNA, 16 bp, H. sapiens
atttcaacagatattt

SEQ ID NO: 56197 - DNA, 16 bp, H. sapiens
atttcaacttctattt

SEQ ID NO: 56198 - DNA, 16 bp, H. sapiens
atttcaactttttaaa

SEQ ID NO: 56199 - DNA, 16 bp, H. sapiens
atttcaagaaaacaaa

SEQ ID NO: 56200 - DNA, 16 bp, H. sapiens
atttcaagaaagaaaa

SEQ ID NO: 56201 - DNA, 16 bp, H. sapiens
atttcaagaacagcct

SEQ ID NO: 56202 - DNA, 16 bp, H. sapiens
atttcaagaaggaaaa

SEQ ID NO: 56203 - DNA, 16 bp, H. sapiens
atttcaagaatattat

SEQ ID NO: 56204 - DNA, 16 bp, H. sapiens
atttcaagaatgttaa

SEQ ID NO: 56205 - DNA, 16 bp, H. sapiens
atttcaagaatgttat

SEQ ID NO: 56206 - DNA, 16 bp, H. sapiens
atttcaagaattatta

SEQ ID NO: 56207 - DNA, 16 bp, H. sapiens
atttcaagaccaaaac

SEQ ID NO: 56208 - DNA, 16 bp, H. sapiens
atttcaagatgaaatt

SEQ ID NO: 56209 - DNA, 16 bp, H. sapiens
atttcaaggataaaga

SEQ ID NO: 56210 - DNA, 16 bp, H. sapiens
atttcaaggggaaaaa

SEQ ID NO: 56211 - DNA, 16 bp, H. sapiens
atttcaagttaaaaat

SEQ ID NO: 56212 - DNA, 16 bp, H. sapiens
atttcaagttgatttt

SEQ ID NO: 56213 - DNA, 16 bp, H. sapiens
atttcaatattttgaa

SEQ ID NO: 56214 - DNA, 16 bp, H. sapiens
atttcaatctctttgt

SEQ ID NO: 56215 - DNA, 16 bp, H. sapiens
atttcaatcttttaaa

SEQ ID NO: 56216 - DNA, 16 bp, H. sapiens
atttcaatgaaaatat

SEQ ID NO: 56217 - DNA, 16 bp, H. sapiens
atttcaattattgtat

SEQ ID NO: 56218 - DNA, 16 bp, H. sapiens
atttcaatttccaatt

SEQ ID NO: 56219 - DNA, 16 bp, H. sapiens
atttcacaaaatgaaa

SEQ ID NO: 56220 - DNA, 16 bp, H. sapiens
atttcacaaaattatt

SEQ ID NO: 56221 - DNA, 16 bp, H. sapiens
atttcacaaaattcaa

SEQ ID NO: 56222 - DNA, 16 bp, H. sapiens
atttcacaaatgaaaa

SEQ ID NO: 56223 - DNA, 16 bp, H. sapiens
atttcacaaatgagga

SEQ ID NO: 56224 - DNA, 16 bp, H. sapiens
atttcacaatgtatat

SEQ ID NO: 56225 - DNA, 16 bp, H. sapiens
atttcacagaaaaaaa

SEQ ID NO: 56226 - DNA, 16 bp, H. sapiens
atttcacagaaaagaa

SEQ ID NO: 56227 - DNA, 16 bp, H. sapiens
atttcacagaaaataa

SEQ ID NO: 56228 - DNA, 16 bp, H. sapiens
atttcacagaggaaga

SEQ ID NO: 56229 - DNA, 16 bp, H. sapiens
atttcacagatgaagg

SEQ ID NO: 56230 - DNA, 16 bp, H. sapiens
atttcacagatgagaa

SEQ ID NO: 56231 - DNA, 16 bp, H. sapiens
atttcacatacattat

SEQ ID NO: 56232 - DNA, 16 bp, H. sapiens
atttcacattgtatgc

SEQ ID NO: 56233 - DNA, 16 bp, H. sapiens
atttcaccaaaaaaga

SEQ ID NO: 56234 - DNA, 22 bp, H. sapiens
atttcaccatgttggccaggcc

SEQ ID NO: 56235 - DNA, 31 bp, H. sapiens
atttcactccatccttggctaccttcccctt

SEQ ID NO: 56236 - DNA, 16 bp, H. sapiens
atttcactcttttctg

SEQ ID NO: 56237 - DNA, 16 bp, H. sapiens
atttcactgaagaaaa

SEQ ID NO: 56238 - DNA, 16 bp, H. sapiens
atttcacttagaaaaa

SEQ ID NO: 56239 - DNA, 16 bp, H. sapiens
atttcacttatatgtg

SEQ ID NO: 56240 - DNA, 16 bp, H. sapiens
atttcacttcacataa

SEQ ID NO: 56241 - DNA, 16 bp, H. sapiens
atttcacttcatttta

SEQ ID NO: 56242 - DNA, 16 bp, H. sapiens
atttcactttctaatt

SEQ ID NO: 56243 - DNA, 16 bp, H. sapiens
atttcacttttaaaaa

SEQ ID NO: 56244 - DNA, 16 bp, H. sapiens
atttcagaaaaaaata

SEQ ID NO: 56245 - DNA, 16 bp, H. sapiens
atttcagaaaaaaatt

SEQ ID NO: 56246 - DNA, 16 bp, H. sapiens
atttcagaaaaataat

SEQ ID NO: 56247 - DNA, 16 bp, H. sapiens
atttcagaaaaatatt

SEQ ID NO: 56248 - DNA, 16 bp, H. sapiens
atttcagaaaaattaa

SEQ ID NO: 56249 - DNA, 16 bp, H. sapiens
atttcagaaaataaaa

SEQ ID NO: 56250 - DNA, 16 bp, H. sapiens
atttcagaaaatcaaa

SEQ ID NO: 56251 - DNA, 16 bp, H. sapiens
atttcagaaaattaaa

SEQ ID NO: 56252 - DNA, 16 bp, H. sapiens
atttcagaaagaaaaa

SEQ ID NO: 56253 - DNA, 16 bp, H. sapiens
atttcagaaagaaaga

SEQ ID NO: 56254 - DNA, 16 bp, H. sapiens
atttcagaaagaaata

SEQ ID NO: 56255 - DNA, 16 bp, H. sapiens
atttcagaaagaaatt

SEQ ID NO: 56256 - DNA, 16 bp, H. sapiens
atttcagaaagagaaa

SEQ ID NO: 56257 - DNA, 16 bp, H. sapiens
atttcagaaataaaat

SEQ ID NO: 56258 - DNA, 16 bp, H. sapiens
atttcagaaatgattt

SEQ ID NO: 56259 - DNA, 16 bp, H. sapiens
atttcagaagaaaatt

SEQ ID NO: 56260 - DNA, 16 bp, H. sapiens
atttcagaagaagaaa

SEQ ID NO: 56261 - DNA, 16 bp, H. sapiens
atttcagaagttgtat

SEQ ID NO: 56262 - DNA, 16 bp, H. sapiens
atttcagaagttttca

SEQ ID NO: 56263 - DNA, 16 bp, H. sapiens
atttcagaataaaaag

SEQ ID NO: 56264 - DNA, 16 bp, H. sapiens
atttcagaatttaaaa

SEQ ID NO: 56265 - DNA, 16 bp, H. sapiens
atttcagaattttaaa

SEQ ID NO: 56266 - DNA, 16 bp, H. sapiens
atttcagacttgccag

SEQ ID NO: 56267 - DNA, 16 bp, H. sapiens
atttcagagaagaaaa

SEQ ID NO: 56268 - DNA, 16 bp, H. sapiens
atttcagagaaggaaa

SEQ ID NO: 56269 - DNA, 16 bp, H. sapiens
atttcagagacagaaa

SEQ ID NO: 56270 - DNA, 16 bp, H. sapiens
atttcagagagaaaaa

SEQ ID NO: 56271 - DNA, 16 bp, H. sapiens
atttcagagatgaaaa

SEQ ID NO: 56272 - DNA, 22 bp, H. sapiens
atttcagaggatgtatggaaac

SEQ ID NO: 56273 - DNA, 16 bp, H. sapiens
atttcagaggatgtgt

SEQ ID NO: 56274 - DNA, 16 bp, H. sapiens
atttcagataaaaata

SEQ ID NO: 56275 - DNA, 16 bp, H. sapiens
atttcagataaacaac

SEQ ID NO: 56276 - DNA, 16 bp, H. sapiens
atttcagatatatttt

SEQ ID NO: 56277 - DNA, 16 bp, H. sapiens
atttcagatgttttca

SEQ ID NO: 56278 - DNA, 16 bp, H. sapiens
atttcagatttgtttt

SEQ ID NO: 56279 - DNA, 16 bp, H. sapiens
atttcagattttattt

SEQ ID NO: 56280 - DNA, 16 bp, H. sapiens
atttcagattttggaa

SEQ ID NO: 56281 - DNA, 16 bp, H. sapiens
atttcagcaaacattt

SEQ ID NO: 56282 - DNA, 29 bp, H. sapiens
atttcagccatgaatcaggcataaatatt

SEQ ID NO: 56283 - DNA, 16 bp, H. sapiens
atttcagcctcccgag

SEQ ID NO: 56284 - DNA, 16 bp, H. sapiens
atttcagcctgggcga

SEQ ID NO: 56285 - DNA, 16 bp, H. sapiens
atttcagctcactgca

SEQ ID NO: 56286 - DNA, 16 bp, H. sapiens
atttcaggaaaaaata

SEQ ID NO: 56287 - DNA, 16 bp, H. sapiens
atttcaggaaaatttt

SEQ ID NO: 56288 - DNA, 16 bp, H. sapiens
atttcaggaaacaaaa

SEQ ID NO: 56289 - DNA, 16 bp, H. sapiens
atttcaggaaataata

SEQ ID NO: 56290 - DNA, 16 bp, H. sapiens
atttcaggacaagaat

SEQ ID NO: 56291 - DNA, 16 bp, H. sapiens
atttcaggacacaaaa

SEQ ID NO: 56292 - DNA, 17 bp, H. sapiens
atttcaggcataagcca

SEQ ID NO: 56293 - DNA, 16 bp, H. sapiens
atttcaggtcactgca

SEQ ID NO: 56294 - DNA, 16 bp, H. sapiens
atttcagtaacatttt

SEQ ID NO: 56295 - DNA, 16 bp, H. sapiens
atttcagtattttaaa

SEQ ID NO: 56296 - DNA, 16 bp, H. sapiens
atttcagttagatggg

SEQ ID NO: 56297 - DNA, 16 bp, H. sapiens
atttcagttattgtat

SEQ ID NO: 56298 - DNA, 16 bp, H. sapiens
atttcagtttgatttt

SEQ ID NO: 56299 - DNA, 16 bp, H. sapiens
atttcagttttcattt

SEQ ID NO: 56300 - DNA, 16 bp, H. sapiens
atttcagttttccttt

SEQ ID NO: 56301 - DNA, 16 bp, H. sapiens
atttcagtttttctga

SEQ ID NO: 56302 - DNA, 16 bp, H. sapiens
atttcatacaaatttt

SEQ ID NO: 56303 - DNA, 16 bp, H. sapiens
atttcatacacacaca

SEQ ID NO: 56304 - DNA, 16 bp, H. sapiens
atttcatatgattttc

SEQ ID NO: 56305 - DNA, 16 bp, H. sapiens
atttcatatgcatttt

SEQ ID NO: 56306 - DNA, 17 bp, H. sapiens
atttcatatggagccaa

SEQ ID NO: 56307 - DNA, 16 bp, H. sapiens
atttcatatgtaaata

SEQ ID NO: 56308 - DNA, 16 bp, H. sapiens
atttcatattaaaatg

SEQ ID NO: 56309 - DNA, 16 bp, H. sapiens
atttcatatttgtatt

SEQ ID NO: 56310 - DNA, 16 bp, H. sapiens
atttcatcacccagtt

SEQ ID NO: 56311 - DNA, 16 bp, H. sapiens
atttcatcactgtgca

SEQ ID NO: 56312 - DNA, 16 bp, H. sapiens
atttcatcatccaggt

SEQ ID NO: 56313 - DNA, 16 bp, H. sapiens
atttcatcatgcaggt

SEQ ID NO: 56314 - DNA, 16 bp, H. sapiens
atttcatccaaaaaca

SEQ ID NO: 56315 - DNA, 16 bp, H. sapiens
atttcatcctttcatc

SEQ ID NO: 56316 - DNA, 16 bp, H. sapiens
atttcatctatttctg

SEQ ID NO: 56317 - DNA, 16 bp, H. sapiens
atttcatctcatttta

SEQ ID NO: 56318 - DNA, 16 bp, H. sapiens
atttcatctgtatttt

SEQ ID NO: 56319 - DNA, 16 bp, H. sapiens
atttcatcttgaattt

SEQ ID NO: 56320 - DNA, 16 bp, H. sapiens
atttcatgaaaaaata

SEQ ID NO: 56321 - DNA, 16 bp, H. sapiens
atttcatgaaaagaaa

SEQ ID NO: 56322 - DNA, 16 bp, H. sapiens
atttcatgaaacaaat

SEQ ID NO: 56323 - DNA, 16 bp, H. sapiens
atttcatgagaaaaat

SEQ ID NO: 56324 - DNA, 16 bp, H. sapiens
atttcatggaaataaa

SEQ ID NO: 56325 - DNA, 16 bp, H. sapiens
atttcatgtaaatttt

SEQ ID NO: 56326 - DNA, 16 bp, H. sapiens
atttcatgtatttatt

SEQ ID NO: 56327 - DNA, 16 bp, H. sapiens
atttcatgtcaaattg

SEQ ID NO: 56328 - DNA, 16 bp, H. sapiens
atttcatgttatatat

SEQ ID NO: 56329 - DNA, 16 bp, H. sapiens
atttcatgttattttc

SEQ ID NO: 56330 - DNA, 16 bp, H. sapiens
atttcatgtttaaaaa

SEQ ID NO: 56331 - DNA, 16 bp, H. sapiens
atttcatgttttaaat

SEQ ID NO: 56332 - DNA, 16 bp, H. sapiens
atttcatgtttttaat

SEQ ID NO: 56333 - DNA, 16 bp, H. sapiens
atttcattaaagaaaa

SEQ ID NO: 56334 - DNA, 16 bp, H. sapiens
atttcattaaatctat

SEQ ID NO: 56335 - DNA, 16 bp, H. sapiens
atttcattaatttgaa

SEQ ID NO: 56336 - DNA, 16 bp, H. sapiens
atttcattacttaaaa

SEQ ID NO: 56337 - DNA, 16 bp, H. sapiens
atttcattcaacagct

SEQ ID NO: 56338 - DNA, 16 bp, H. sapiens
atttcattcagttttt

SEQ ID NO: 56339 - DNA, 16 bp, H. sapiens
atttcattcatttctg

SEQ ID NO: 56340 - DNA, 16 bp, H. sapiens
atttcattccattctt

SEQ ID NO: 56341 - DNA, 16 bp, H. sapiens
atttcattcctctgca

SEQ ID NO: 56342 - DNA, 16 bp, H. sapiens
atttcattctatttca

SEQ ID NO: 56343 - DNA, 16 bp, H. sapiens
atttcattcttttgaa

SEQ ID NO: 56344 - DNA, 16 bp, H. sapiens
atttcattgagatttt

SEQ ID NO: 56345 - DNA, 16 bp, H. sapiens
atttcattgaggtttt

SEQ ID NO: 56346 - DNA, 16 bp, H. sapiens
atttcattgagttgat

SEQ ID NO: 56347 - DNA, 16 bp, H. sapiens
atttcattgattcttt

SEQ ID NO: 56348 - DNA, 16 bp, H. sapiens
atttcattgtatgaat

SEQ ID NO: 56349 - DNA, 16 bp, H. sapiens
atttcattgttgtctt

SEQ ID NO: 56350 - DNA, 16 bp, H. sapiens
atttcatttaaatctc

SEQ ID NO: 56351 - DNA, 16 bp, H. sapiens
atttcatttaattctg

SEQ ID NO: 56352 - DNA, 16 bp, H. sapiens
atttcatttagcacaa

SEQ ID NO: 56353 - DNA, 16 bp, H. sapiens
atttcatttataatag

SEQ ID NO: 56354 - DNA, 16 bp, H. sapiens
atttcatttcatctaa

SEQ ID NO: 56355 - DNA, 16 bp, H. sapiens
atttcatttggaattt

SEQ ID NO: 56356 - DNA, 16 bp, H. sapiens
atttcattttaaattg

SEQ ID NO: 56357 - DNA, 16 bp, H. sapiens
atttcattttatgaat

SEQ ID NO: 56358 - DNA, 16 bp, H. sapiens
atttcattttccttca

SEQ ID NO: 56359 - DNA, 16 bp, H. sapiens
atttcatttttagatt

SEQ ID NO: 56360 - DNA, 16 bp, H. sapiens
atttcatttttctaca

SEQ ID NO: 56361 - DNA, 16 bp, H. sapiens
atttcatttttgtaaa

SEQ ID NO: 56362 - DNA, 16 bp, H. sapiens
atttccaaaaatgaaa

SEQ ID NO: 56363 - DNA, 16 bp, H. sapiens
atttccaaaacaaaac

SEQ ID NO: 56364 - DNA, 16 bp, H. sapiens
atttccaaaatatgta

SEQ ID NO: 56365 - DNA, 16 bp, H. sapiens
atttccaaaatatttt

SEQ ID NO: 56366 - DNA, 16 bp, H. sapiens
atttccaaagaagaaa

SEQ ID NO: 56367 - DNA, 16 bp, H. sapiens
atttccaaagaataaa

SEQ ID NO: 56368 - DNA, 16 bp, H. sapiens
atttccaaaggaaaaa

SEQ ID NO: 56369 - DNA, 16 bp, H. sapiens
atttccaaataaaaca

SEQ ID NO: 56370 - DNA, 16 bp, H. sapiens
atttccaaatgtcccc

SEQ ID NO: 56371 - DNA, 16 bp, H. sapiens
atttccaaattataaa

SEQ ID NO: 56372 - DNA, 16 bp, H. sapiens
atttccaaattcattt

SEQ ID NO: 56373 - DNA, 16 bp, H. sapiens
atttccaagaaaaata

SEQ ID NO: 56374 - DNA, 16 bp, H. sapiens
atttccaagaacctat

SEQ ID NO: 56375 - DNA, 16 bp, H. sapiens
atttccaagcaaagtg

SEQ ID NO: 56376 - DNA, 16 bp, H. sapiens
atttccaatttaaaaa

SEQ ID NO: 56377 - DNA, 16 bp, H. sapiens
atttccaatttcttta

SEQ ID NO: 56378 - DNA, 16 bp, H. sapiens
atttccaatttttaaa

SEQ ID NO: 56379 - DNA, 16 bp, H. sapiens
atttccacaattcttc

SEQ ID NO: 56380 - DNA, 16 bp, H. sapiens
atttccacagaaaaac

SEQ ID NO: 56381 - DNA, 16 bp, H. sapiens
atttccacataaattt

SEQ ID NO: 56382 - DNA, 16 bp, H. sapiens
atttccacatctataa

SEQ ID NO: 56383 - DNA, 16 bp, H. sapiens
atttccacatgcagaa

SEQ ID NO: 56384 - DNA, 16 bp, H. sapiens
atttccaccaacattg

SEQ ID NO: 56385 - DNA, 16 bp, H. sapiens
atttccaccagcaaca

SEQ ID NO: 56386 - DNA, 16 bp, H. sapiens
atttccagaaaagaaa

SEQ ID NO: 56387 - DNA, 16 bp, H. sapiens
atttccagaaataaaa

SEQ ID NO: 56388 - DNA, 16 bp, H. sapiens
atttccagaactcttt

SEQ ID NO: 56389 - DNA, 16 bp, H. sapiens
atttccagaacttttt

SEQ ID NO: 56390 - DNA, 16 bp, H. sapiens
atttccagaagaaaaa

SEQ ID NO: 56391 - DNA, 16 bp, H. sapiens
atttccagaatatttt

SEQ ID NO: 56392 - DNA, 16 bp, H. sapiens
atttccagataaacaa

SEQ ID NO: 56393 - DNA, 16 bp, H. sapiens
atttccagatgaattt

SEQ ID NO: 56394 - DNA, 16 bp, H. sapiens
atttccagctgaggta

SEQ ID NO: 56395 - DNA, 16 bp, H. sapiens
atttccagttaatttt

SEQ ID NO: 56396 - DNA, 16 bp, H. sapiens
atttccagtttctctt

SEQ ID NO: 56397 - DNA, 16 bp, H. sapiens
atttccagtttttaaa

SEQ ID NO: 56398 - DNA, 16 bp, H. sapiens
atttccagtttttgct

SEQ ID NO: 56399 - DNA, 16 bp, H. sapiens
atttccataaagaaaa

SEQ ID NO: 56400 - DNA, 16 bp, H. sapiens
atttccatatttaaaa

SEQ ID NO: 56401 - DNA, 16 bp, H. sapiens
atttccatcaacaatg

SEQ ID NO: 56402 - DNA, 16 bp, H. sapiens
atttccatcaccctaa

SEQ ID NO: 56403 - DNA, 16 bp, H. sapiens
atttccatcatcccca

SEQ ID NO: 56404 - DNA, 16 bp, H. sapiens
atttccatcatcttct

SEQ ID NO: 56405 - DNA, 16 bp, H. sapiens
atttccatgatgacta

SEQ ID NO: 56406 - DNA, 16 bp, H. sapiens
atttccatgtcttctt

SEQ ID NO: 56407 - DNA, 16 bp, H. sapiens
atttccattaaaatta

SEQ ID NO: 56408 - DNA, 16 bp, H. sapiens
atttccattcttctgc

SEQ ID NO: 56409 - DNA, 16 bp, H. sapiens
atttccatttataaaa

SEQ ID NO: 56410 - DNA, 16 bp, H. sapiens
atttccatttatttca

SEQ ID NO: 56411 - DNA, 16 bp, H. sapiens
atttccatttcctcat

SEQ ID NO: 56412 - DNA, 16 bp, H. sapiens
atttccatttggttat

SEQ ID NO: 56413 - DNA, 16 bp, H. sapiens
atttccattttagaaa

SEQ ID NO: 56414 - DNA, 16 bp, H. sapiens
atttccattttccaaa

SEQ ID NO: 56415 - DNA, 16 bp, H. sapiens
atttccattttgaaag

SEQ ID NO: 56416 - DNA, 16 bp, H. sapiens
atttccattttgaaga

SEQ ID NO: 56417 - DNA, 16 bp, H. sapiens
atttccatttttaaaa

SEQ ID NO: 56418 - DNA, 16 bp, H. sapiens
atttcccaaatttctt

SEQ ID NO: 56419 - DNA, 16 bp, H. sapiens
atttcccagttccaaa

SEQ ID NO: 56420 - DNA, 16 bp, H. sapiens
atttcccccaaattaa

SEQ ID NO: 56421 - DNA, 16 bp, H. sapiens
atttccccctttctgt

SEQ ID NO: 56422 - DNA, 16 bp, H. sapiens
atttcccctatatttt

SEQ ID NO: 56423 - DNA, 16 bp, H. sapiens
atttccctgatgacca

SEQ ID NO: 56424 - DNA, 16 bp, H. sapiens
atttcccttgtaattt

SEQ ID NO: 56425 - DNA, 16 bp, H. sapiens
atttcctaattgcaag

SEQ ID NO: 56426 - DNA, 16 bp, H. sapiens
atttcctaatttcaaa

SEQ ID NO: 56427 - DNA, 16 bp, H. sapiens
atttcctaattttgat

SEQ ID NO: 56428 - DNA, 16 bp, H. sapiens
atttcctattgctgct

SEQ ID NO: 56429 - DNA, 16 bp, H. sapiens
atttcctattttaaaa

SEQ ID NO: 56430 - DNA, 16 bp, H. sapiens
atttcctcaaatatgt

SEQ ID NO: 56431 - DNA, 16 bp, H. sapiens
atttcctcagcttttg

SEQ ID NO: 56432 - DNA, 16 bp, H. sapiens
atttcctcatctgtaa

SEQ ID NO: 56433 - DNA, 16 bp, H. sapiens
atttcctcattggtaa

SEQ ID NO: 56434 - DNA, 16 bp, H. sapiens
atttcctcatttctaa

SEQ ID NO: 56435 - DNA, 16 bp, H. sapiens
atttcctctaggcttt

SEQ ID NO: 56436 - DNA, 16 bp, H. sapiens
atttcctctaggtttt

SEQ ID NO: 56437 - DNA, 16 bp, H. sapiens
atttcctcttaaaaag

SEQ ID NO: 56438 - DNA, 16 bp, H. sapiens
atttcctgaaaataaa

SEQ ID NO: 56439 - DNA, 16 bp, H. sapiens
atttcctgaattttaa

SEQ ID NO: 56440 - DNA, 16 bp, H. sapiens
atttcctgagcatcta

SEQ ID NO: 56441 - DNA, 16 bp, H. sapiens
atttcctgatgattag

SEQ ID NO: 56442 - DNA, 16 bp, H. sapiens
atttcctgggctcaag

SEQ ID NO: 56443 - DNA, 16 bp, H. sapiens
atttcctgtacagcct

SEQ ID NO: 56444 - DNA, 16 bp, H. sapiens
atttccttaagcagtg

SEQ ID NO: 56445 - DNA, 16 bp, H. sapiens
atttccttatatgtga

SEQ ID NO: 56446 - DNA, 16 bp, H. sapiens
atttccttcagcaatg

SEQ ID NO: 56447 - DNA, 16 bp, H. sapiens
atttccttcagttctc

SEQ ID NO: 56448 - DNA, 16 bp, H. sapiens
atttccttccttttgg

SEQ ID NO: 56449 - DNA, 16 bp, H. sapiens
atttccttctgtttta

SEQ ID NO: 56450 - DNA, 16 bp, H. sapiens
atttccttcttccctg

SEQ ID NO: 56451 - DNA, 16 bp, H. sapiens
atttccttctttccaa

SEQ ID NO: 56452 - DNA, 16 bp, H. sapiens
atttccttgatatttt

SEQ ID NO: 56453 - DNA, 16 bp, H. sapiens
atttccttgtgagcaa

SEQ ID NO: 56454 - DNA, 16 bp, H. sapiens
atttcctttaaaaata

SEQ ID NO: 56455 - DNA, 16 bp, H. sapiens
atttcctttattaaaa

SEQ ID NO: 56456 - DNA, 16 bp, H. sapiens
atttcctttctgaaat

SEQ ID NO: 56457 - DNA, 16 bp, H. sapiens
atttcctttgagaact

SEQ ID NO: 56458 - DNA, 16 bp, H. sapiens
atttcctttgcatttt

SEQ ID NO: 56459 - DNA, 16 bp, H. sapiens
atttcctttgctgtgt

SEQ ID NO: 56460 - DNA, 16 bp, H. sapiens
atttccttttcacatt

SEQ ID NO: 56461 - DNA, 16 bp, H. sapiens
atttccttttctaaaa

SEQ ID NO: 56462 - DNA, 16 bp, H. sapiens
atttccttttctaaat

SEQ ID NO: 56463 - DNA, 16 bp, H. sapiens
atttccttttcttgcc

SEQ ID NO: 56464 - DNA, 16 bp, H. sapiens
atttcctttttagaaa

SEQ ID NO: 56465 - DNA, 21 bp, H. sapiens
atttcgctcttgttgcccagg

SEQ ID NO: 56466 - DNA, 16 bp, H. sapiens
atttcgggaggccaag

SEQ ID NO: 56467 - DNA, 16 bp, H. sapiens
atttctaaaacatatt

SEQ ID NO: 56468 - DNA, 16 bp, H. sapiens
atttctaaaagaaata

SEQ ID NO: 56469 - DNA, 16 bp, H. sapiens
atttctaaaatgcctt

SEQ ID NO: 56470 - DNA, 16 bp, H. sapiens
atttctaaagtaaaat

SEQ ID NO: 56471 - DNA, 16 bp, H. sapiens
atttctaaataaaagt

SEQ ID NO: 56472 - DNA, 16 bp, H. sapiens
atttctaaatgatttt

SEQ ID NO: 56473 - DNA, 16 bp, H. sapiens
atttctaaatgtaata

SEQ ID NO: 56474 - DNA, 16 bp, H. sapiens
atttctaagaaagaaa

SEQ ID NO: 56475 - DNA, 16 bp, H. sapiens
atttctaagaatttat

SEQ ID NO: 56476 - DNA, 16 bp, H. sapiens
atttctaagcaacaaa

SEQ ID NO: 56477 - DNA, 16 bp, H. sapiens
atttctaaggaaaata

SEQ ID NO: 56478 - DNA, 16 bp, H. sapiens
atttctaagtatttta

SEQ ID NO: 56479 - DNA, 16 bp, H. sapiens
atttctaatcttgtag

SEQ ID NO: 56480 - DNA, 16 bp, H. sapiens
atttctacaaaggaaa

SEQ ID NO: 56481 - DNA, 16 bp, H. sapiens
atttctacaaataaat

SEQ ID NO: 56482 - DNA, 16 bp, H. sapiens
atttctacaatgaaaa

SEQ ID NO: 56483 - DNA, 16 bp, H. sapiens
atttctacacacacac

SEQ ID NO: 56484 - DNA, 16 bp, H. sapiens
atttctacagaaaaat

SEQ ID NO: 56485 - DNA, 16 bp, H. sapiens
atttctagaaacagaa

SEQ ID NO: 56486 - DNA, 16 bp, H. sapiens
atttctagaatatttt

SEQ ID NO: 56487 - DNA, 16 bp, H. sapiens
atttctagacacatcc

SEQ ID NO: 56488 - DNA, 16 bp, H. sapiens
atttctagagatgaaa

SEQ ID NO: 56489 - DNA, 16 bp, H. sapiens
atttctagctttattt

SEQ ID NO: 56490 - DNA, 16 bp, H. sapiens
atttctaggtatagaa

SEQ ID NO: 56491 - DNA, 16 bp, H. sapiens
atttctaggtattttt

SEQ ID NO: 56492 - DNA, 16 bp, H. sapiens
atttctagtaaaaata

SEQ ID NO: 56493 - DNA, 16 bp, H. sapiens
atttctagttactaga

SEQ ID NO: 56494 - DNA, 16 bp, H. sapiens
atttctataaaagaaa

SEQ ID NO: 56495 - DNA, 16 bp, H. sapiens
atttctataaatgttt

SEQ ID NO: 56496 - DNA, 16 bp, H. sapiens
atttctatagattttt

SEQ ID NO: 56497 - DNA, 16 bp, H. sapiens
atttctatatactaac

SEQ ID NO: 56498 - DNA, 16 bp, H. sapiens
atttctatatgttgaa

SEQ ID NO: 56499 - DNA, 16 bp, H. sapiens
atttctatcaccccag

SEQ ID NO: 56500 - DNA, 16 bp, H. sapiens
atttctatgaagaaat

SEQ ID NO: 56501 - DNA, 16 bp, H. sapiens
atttctatgtgtgtgt

SEQ ID NO: 56502 - DNA, 16 bp, H. sapiens
atttctatgtgtttgt

SEQ ID NO: 56503 - DNA, 16 bp, H. sapiens
atttctatgttgaaat

SEQ ID NO: 56504 - DNA, 16 bp, H. sapiens
atttctatgtttttaa

SEQ ID NO: 56505 - DNA, 16 bp, H. sapiens
atttctattcaacatt

SEQ ID NO: 56506 - DNA, 16 bp, H. sapiens
atttctattgctttaa

SEQ ID NO: 56507 - DNA, 16 bp, H. sapiens
atttctattttaaagt

SEQ ID NO: 56508 - DNA, 16 bp, H. sapiens
atttctattttgcaaa

SEQ ID NO: 56509 - DNA, 16 bp, H. sapiens
atttctcaaaaattaa

SEQ ID NO: 56510 - DNA, 16 bp, H. sapiens
atttctcaaaaggaga

SEQ ID NO: 56511 - DNA, 16 bp, H. sapiens
atttctcaaaatattt

SEQ ID NO: 56512 - DNA, 16 bp, H. sapiens
atttctcaaaatgaaa

SEQ ID NO: 56513 - DNA, 16 bp, H. sapiens
atttctcaagaaattt

SEQ ID NO: 56514 - DNA, 16 bp, H. sapiens
atttctcaaggatcta

SEQ ID NO: 56515 - DNA, 16 bp, H. sapiens
atttctcaatttcaaa

SEQ ID NO: 56516 - DNA, 16 bp, H. sapiens
atttctcacagctctg

SEQ ID NO: 56517 - DNA, 16 bp, H. sapiens
atttctcaccaggcct

SEQ ID NO: 56518 - DNA, 16 bp, H. sapiens
atttctcagaacattt

SEQ ID NO: 56519 - DNA, 16 bp, H. sapiens
atttctcagaagaaga

SEQ ID NO: 56520 - DNA, 16 bp, H. sapiens
atttctcagaatgtat

SEQ ID NO: 56521 - DNA, 16 bp, H. sapiens
atttctcaggtgttct

SEQ ID NO: 56522 - DNA, 16 bp, H. sapiens
atttctcagtttcttt

SEQ ID NO: 56523 - DNA, 16 bp, H. sapiens
atttctcatattaaaa

SEQ ID NO: 56524 - DNA, 16 bp, H. sapiens
atttctcatcttctgc

SEQ ID NO: 56525 - DNA, 16 bp, H. sapiens
atttctccaaaaatga

SEQ ID NO: 56526 - DNA, 16 bp, H. sapiens
atttctccaagaaaaa

SEQ ID NO: 56527 - DNA, 16 bp, H. sapiens
atttctccaagaaaga

SEQ ID NO: 56528 - DNA, 16 bp, H. sapiens
atttctccactgcact

SEQ ID NO: 56529 - DNA, 16 bp, H. sapiens
atttctccagctttgt

SEQ ID NO: 56530 - DNA, 16 bp, H. sapiens
atttctccagtttttt

SEQ ID NO: 56531 - DNA, 16 bp, H. sapiens
atttctcccaagaaga

SEQ ID NO: 56532 - DNA, 16 bp, H. sapiens
atttctcccacctcct

SEQ ID NO: 56533 - DNA, 16 bp, H. sapiens
atttctccccaccagc

SEQ ID NO: 56534 - DNA, 16 bp, H. sapiens
atttctccctgccttt

SEQ ID NO: 56535 - DNA, 16 bp, H. sapiens
atttctcccttctctg

SEQ ID NO: 56536 - DNA, 16 bp, H. sapiens
atttctcctatctagc

SEQ ID NO: 56537 - DNA, 16 bp, H. sapiens
atttctcctccacact

SEQ ID NO: 56538 - DNA, 16 bp, H. sapiens
atttctccttccactt

SEQ ID NO: 56539 - DNA, 16 bp, H. sapiens
atttctccttcctgcc

SEQ ID NO: 56540 - DNA, 16 bp, H. sapiens
atttctccttgcagtt

SEQ ID NO: 56541 - DNA, 16 bp, H. sapiens
atttctcctttgcttg

SEQ ID NO: 56542 - DNA, 16 bp, H. sapiens
atttctcctttttaaa

SEQ ID NO: 56543 - DNA, 16 bp, H. sapiens
atttctctaaagaaga

SEQ ID NO: 56544 - DNA, 16 bp, H. sapiens
atttctctaatggcta

SEQ ID NO: 56545 - DNA, 16 bp, H. sapiens
atttctctctctgtgt

SEQ ID NO: 56546 - DNA, 16 bp, H. sapiens
atttctctgataattt

SEQ ID NO: 56547 - DNA, 16 bp, H. sapiens
atttctctgatgattt

SEQ ID NO: 56548 - DNA, 16 bp, H. sapiens
atttctctgcctcctg

SEQ ID NO: 56549 - DNA, 16 bp, H. sapiens
atttctctgcctcttg

SEQ ID NO: 56550 - DNA, 16 bp, H. sapiens
atttctcttcagaaaa

SEQ ID NO: 56551 - DNA, 16 bp, H. sapiens
atttctcttcctttgg

SEQ ID NO: 56552 - DNA, 16 bp, H. sapiens
atttctcttctgattt

SEQ ID NO: 56553 - DNA, 16 bp, H. sapiens
atttctcttctgtgaa

SEQ ID NO: 56554 - DNA, 16 bp, H. sapiens
atttctcttggttaaa

SEQ ID NO: 56555 - DNA, 16 bp, H. sapiens
atttctcttgtgattt

SEQ ID NO: 56556 - DNA, 16 bp, H. sapiens
atttctctttcaaaaa

SEQ ID NO: 56557 - DNA, 16 bp, H. sapiens
atttctgaaaaccaaa

SEQ ID NO: 56558 - DNA, 16 bp, H. sapiens
atttctgaaaatgaga

SEQ ID NO: 56559 - DNA, 16 bp, H. sapiens
atttctgaaaatttaa

SEQ ID NO: 56560 - DNA, 16 bp, H. sapiens
atttctgaaagtaaaa

SEQ ID NO: 56561 - DNA, 16 bp, H. sapiens
atttctgaaatatttt

SEQ ID NO: 56562 - DNA, 16 bp, H. sapiens
atttctgaagaaaaga

SEQ ID NO: 56563 - DNA, 16 bp, H. sapiens
atttctgaagaacagt

SEQ ID NO: 56564 - DNA, 16 bp, H. sapiens
atttctgaagatattt

SEQ ID NO: 56565 - DNA, 16 bp, H. sapiens
atttctgacatttatt

SEQ ID NO: 56566 - DNA, 16 bp, H. sapiens
atttctgagattttgt

SEQ ID NO: 56567 - DNA, 16 bp, H. sapiens
atttctgaggcctttg

SEQ ID NO: 56568 - DNA, 16 bp, H. sapiens
atttctgagttctcaa

SEQ ID NO: 56569 - DNA, 16 bp, H. sapiens
atttctgatcttattt

SEQ ID NO: 56570 - DNA, 16 bp, H. sapiens
atttctgatgaaaata

SEQ ID NO: 56571 - DNA, 16 bp, H. sapiens
atttctgatgcctctg

SEQ ID NO: 56572 - DNA, 16 bp, H. sapiens
atttctgatgcttttt

SEQ ID NO: 56573 - DNA, 16 bp, H. sapiens
atttctgcagccaact

SEQ ID NO: 56574 - DNA, 16 bp, H. sapiens
atttctgcatctatgt

SEQ ID NO: 56575 - DNA, 16 bp, H. sapiens
atttctgcatttattt

SEQ ID NO: 56576 - DNA, 18 bp, H. sapiens
atttctgcatttccaact

SEQ ID NO: 56577 - DNA, 16 bp, H. sapiens
atttctgcatttcttt

SEQ ID NO: 56578 - DNA, 16 bp, H. sapiens
atttctgccacattct

SEQ ID NO: 56579 - DNA, 16 bp, H. sapiens
atttctgcctcaattt

SEQ ID NO: 56580 - DNA, 16 bp, H. sapiens
atttctgccttaactt

SEQ ID NO: 56581 - DNA, 16 bp, H. sapiens
atttctgctgagaaat

SEQ ID NO: 56582 - DNA, 16 bp, H. sapiens
atttctgctgttttaa

SEQ ID NO: 56583 - DNA, 16 bp, H. sapiens
atttctgcttcctttt

SEQ ID NO: 56584 - DNA, 16 bp, H. sapiens
atttctggaaaaaaaa

SEQ ID NO: 56585 - DNA, 16 bp, H. sapiens
atttctggaaacatac

SEQ ID NO: 56586 - DNA, 16 bp, H. sapiens
atttctggaaatgaaa

SEQ ID NO: 56587 - DNA, 16 bp, H. sapiens
atttctggaaattttt

SEQ ID NO: 56588 - DNA, 16 bp, H. sapiens
atttctggacctaccc

SEQ ID NO: 56589 - DNA, 16 bp, H. sapiens
atttctggactctcag

SEQ ID NO: 56590 - DNA, 16 bp, H. sapiens
atttctggactcttta

SEQ ID NO: 56591 - DNA, 16 bp, H. sapiens
atttctggaggaaaat

SEQ ID NO: 56592 - DNA, 16 bp, H. sapiens
atttctggattctcta

SEQ ID NO: 56593 - DNA, 16 bp, H. sapiens
atttctggcttctctc

SEQ ID NO: 56594 - DNA, 16 bp, H. sapiens
atttctggcttctctt

SEQ ID NO: 56595 - DNA, 16 bp, H. sapiens
atttctggcttttaaa

SEQ ID NO: 56596 - DNA, 16 bp, H. sapiens
atttctgggctctctg

SEQ ID NO: 56597 - DNA, 16 bp, H. sapiens
atttctgggttttaaa

SEQ ID NO: 56598 - DNA, 16 bp, H. sapiens
atttctgtaaaataaa

SEQ ID NO: 56599 - DNA, 16 bp, H. sapiens
atttctgtaatcccag

SEQ ID NO: 56600 - DNA, 16 bp, H. sapiens
atttctgtaatgatta

SEQ ID NO: 56601 - DNA, 16 bp, H. sapiens
atttctgtatttatct

SEQ ID NO: 56602 - DNA, 16 bp, H. sapiens
atttctgtcattttta

SEQ ID NO: 56603 - DNA, 16 bp, H. sapiens
atttctgtctctatgg

SEQ ID NO: 56604 - DNA, 16 bp, H. sapiens
atttctgtctttttaa

SEQ ID NO: 56605 - DNA, 16 bp, H. sapiens
atttctgtgaagaatg

SEQ ID NO: 56606 - DNA, 16 bp, H. sapiens
atttctgtgacatttt

SEQ ID NO: 56607 - DNA, 16 bp, H. sapiens
atttctgtgccatttt

SEQ ID NO: 56608 - DNA, 16 bp, H. sapiens
atttctgtgttgaaat

SEQ ID NO: 56609 - DNA, 16 bp, H. sapiens
atttctgttaaaataa

SEQ ID NO: 56610 - DNA, 16 bp, H. sapiens
atttctgttaacattt

SEQ ID NO: 56611 - DNA, 16 bp, H. sapiens
atttctgttaatattt

SEQ ID NO: 56612 - DNA, 16 bp, H. sapiens
atttctgttataaatt

SEQ ID NO: 56613 - DNA, 16 bp, H. sapiens
atttctgttcttaaaa

SEQ ID NO: 56614 - DNA, 16 bp, H. sapiens
atttctgttgctttaa

SEQ ID NO: 56615 - DNA, 16 bp, H. sapiens
atttctgttggacagt

SEQ ID NO: 56616 - DNA, 16 bp, H. sapiens
atttctgttgttataa

SEQ ID NO: 56617 - DNA, 16 bp, H. sapiens
atttctgttgttgttg

SEQ ID NO: 56618 - DNA, 16 bp, H. sapiens
atttctgttgtttgta

SEQ ID NO: 56619 - DNA, 16 bp, H. sapiens
atttctgttgttttaa

SEQ ID NO: 56620 - DNA, 16 bp, H. sapiens
atttctgtttcacttt

SEQ ID NO: 56621 - DNA, 16 bp, H. sapiens
atttctgtttctccac

SEQ ID NO: 56622 - DNA, 16 bp, H. sapiens
atttctgttttaaaat

SEQ ID NO: 56623 - DNA, 16 bp, H. sapiens
atttctgttttaaata

SEQ ID NO: 56624 - DNA, 16 bp, H. sapiens
atttctgttttcatct

SEQ ID NO: 56625 - DNA, 16 bp, H. sapiens
atttctgtttttaaaa

SEQ ID NO: 56626 - DNA, 16 bp, H. sapiens
atttctgttttttaaa

SEQ ID NO: 56627 - DNA, 16 bp, H. sapiens
atttctgttttttaag

SEQ ID NO: 56628 - DNA, 16 bp, H. sapiens
atttcttaaaatgaaa

SEQ ID NO: 56629 - DNA, 16 bp, H. sapiens
atttcttaaaatgttt

SEQ ID NO: 56630 - DNA, 16 bp, H. sapiens
atttcttaaaattaga

SEQ ID NO: 56631 - DNA, 16 bp, H. sapiens
atttcttaaaggaaaa

SEQ ID NO: 56632 - DNA, 16 bp, H. sapiens
atttcttaaataaaac

SEQ ID NO: 56633 - DNA, 16 bp, H. sapiens
atttcttaaatatgtt

SEQ ID NO: 56634 - DNA, 16 bp, H. sapiens
atttcttaaatgaata

SEQ ID NO: 56635 - DNA, 16 bp, H. sapiens
atttcttaagaaaata

SEQ ID NO: 56636 - DNA, 18 bp, H. sapiens
atttcttacgcctgtctt

SEQ ID NO: 56637 - DNA, 16 bp, H. sapiens
atttcttacttttcaa

SEQ ID NO: 56638 - DNA, 16 bp, H. sapiens
atttcttagcagaaac

SEQ ID NO: 56639 - DNA, 16 bp, H. sapiens
atttcttagtgtttta

SEQ ID NO: 56640 - DNA, 16 bp, H. sapiens
atttcttatgtcttcc

SEQ ID NO: 56641 - DNA, 16 bp, H. sapiens
atttcttattttccaa

SEQ ID NO: 56642 - DNA, 16 bp, H. sapiens
atttcttcaaaaattt

SEQ ID NO: 56643 - DNA, 16 bp, H. sapiens
atttcttcaaagaaga

SEQ ID NO: 56644 - DNA, 16 bp, H. sapiens
atttcttcaaataaaa

SEQ ID NO: 56645 - DNA, 16 bp, H. sapiens
atttcttcaaataaat

SEQ ID NO: 56646 - DNA, 16 bp, H. sapiens
atttcttcaaataagc

SEQ ID NO: 56647 - DNA, 16 bp, H. sapiens
atttcttcaacatttt

SEQ ID NO: 56648 - DNA, 16 bp, H. sapiens
atttcttcaactttat

SEQ ID NO: 56649 - DNA, 16 bp, H. sapiens
atttcttcaagttttt

SEQ ID NO: 56650 - DNA, 16 bp, H. sapiens
atttcttcacaatttt

SEQ ID NO: 56651 - DNA, 16 bp, H. sapiens
atttcttcagatattt

SEQ ID NO: 56652 - DNA, 16 bp, H. sapiens
atttcttcagattttt

SEQ ID NO: 56653 - DNA, 16 bp, H. sapiens
atttcttcagtatttt

SEQ ID NO: 56654 - DNA, 16 bp, H. sapiens
atttcttcatctctaa

SEQ ID NO: 56655 - DNA, 16 bp, H. sapiens
atttcttcatgttaaa

SEQ ID NO: 56656 - DNA, 16 bp, H. sapiens
atttcttcattaaaat

SEQ ID NO: 56657 - DNA, 16 bp, H. sapiens
atttcttcattagttt

SEQ ID NO: 56658 - DNA, 16 bp, H. sapiens
atttcttcattgattt

SEQ ID NO: 56659 - DNA, 16 bp, H. sapiens
atttcttcattgtttc

SEQ ID NO: 56660 - DNA, 16 bp, H. sapiens
atttcttccaacagat

SEQ ID NO: 56661 - DNA, 16 bp, H. sapiens
atttcttccaccaaat

SEQ ID NO: 56662 - DNA, 16 bp, H. sapiens
atttcttccagaaata

SEQ ID NO: 56663 - DNA, 16 bp, H. sapiens
atttcttcctcaattt

SEQ ID NO: 56664 - DNA, 16 bp, H. sapiens
atttcttcctctgtaa

SEQ ID NO: 56665 - DNA, 16 bp, H. sapiens
atttcttcctgagtca

SEQ ID NO: 56666 - DNA, 16 bp, H. sapiens
atttcttcctgtttca

SEQ ID NO: 56667 - DNA, 16 bp, H. sapiens
atttcttccttcctga

SEQ ID NO: 56668 - DNA, 16 bp, H. sapiens
atttcttctaggtttt

SEQ ID NO: 56669 - DNA, 16 bp, H. sapiens
atttcttctagtattt

SEQ ID NO: 56670 - DNA, 16 bp, H. sapiens
atttcttctatttctg

SEQ ID NO: 56671 - DNA, 16 bp, H. sapiens
atttcttctcatcatt

SEQ ID NO: 56672 - DNA, 16 bp, H. sapiens
atttcttctttaaatg

SEQ ID NO: 56673 - DNA, 16 bp, H. sapiens
atttcttctttgctta

SEQ ID NO: 56674 - DNA, 16 bp, H. sapiens
atttcttgaaaaaata

SEQ ID NO: 56675 - DNA, 16 bp, H. sapiens
atttcttgaaatgaaa

SEQ ID NO: 56676 - DNA, 16 bp, H. sapiens
atttcttgaagatttt

SEQ ID NO: 56677 - DNA, 16 bp, H. sapiens
atttcttgaagccagg

SEQ ID NO: 56678 - DNA, 16 bp, H. sapiens
atttcttgataatatg

SEQ ID NO: 56679 - DNA, 16 bp, H. sapiens
atttcttgcctggatt

SEQ ID NO: 56680 - DNA, 16 bp, H. sapiens
atttcttggaggctgt

SEQ ID NO: 56681 - DNA, 16 bp, H. sapiens
atttcttgggggcttt

SEQ ID NO: 56682 - DNA, 16 bp, H. sapiens
atttcttgttcttgtc

SEQ ID NO: 56683 - DNA, 16 bp, H. sapiens
atttcttgttttaaaa

SEQ ID NO: 56684 - DNA, 16 bp, H. sapiens
atttctttaaaagaat

SEQ ID NO: 56685 - DNA, 16 bp, H. sapiens
atttctttaaaagata

SEQ ID NO: 56686 - DNA, 16 bp, H. sapiens
atttctttaaaagcca

SEQ ID NO: 56687 - DNA, 16 bp, H. sapiens
atttctttaaagaaat

SEQ ID NO: 56688 - DNA, 16 bp, H. sapiens
atttctttacagtttt

SEQ ID NO: 56689 - DNA, 16 bp, H. sapiens
atttctttaggaaaaa

SEQ ID NO: 56690 - DNA, 16 bp, H. sapiens
atttctttatagcaat

SEQ ID NO: 56691 - DNA, 16 bp, H. sapiens
atttctttatagcact

SEQ ID NO: 56692 - DNA, 16 bp, H. sapiens
atttctttatagtaac

SEQ ID NO: 56693 - DNA, 16 bp, H. sapiens
atttctttatgaatat

SEQ ID NO: 56694 - DNA, 16 bp, H. sapiens
atttctttatggttca

SEQ ID NO: 56695 - DNA, 16 bp, H. sapiens
atttctttatgttggt

SEQ ID NO: 56696 - DNA, 16 bp, H. sapiens
atttctttattgatat

SEQ ID NO: 56697 - DNA, 16 bp, H. sapiens
atttctttcaaaatat

SEQ ID NO: 56698 - DNA, 16 bp, H. sapiens
atttctttcaatgatg

SEQ ID NO: 56699 - DNA, 16 bp, H. sapiens
atttctttcaccagag

SEQ ID NO: 56700 - DNA, 17 bp, H. sapiens
atttctttcagcagtgt

SEQ ID NO: 56701 - DNA, 16 bp, H. sapiens
atttctttcagctttt

SEQ ID NO: 56702 - DNA, 16 bp, H. sapiens
atttctttcatcagaa

SEQ ID NO: 56703 - DNA, 16 bp, H. sapiens
atttctttcatcagag

SEQ ID NO: 56704 - DNA, 16 bp, H. sapiens
atttctttcatcattg

SEQ ID NO: 56705 - DNA, 16 bp, H. sapiens
atttctttccaatctt

SEQ ID NO: 56706 - DNA, 16 bp, H. sapiens
atttctttcctctgct

SEQ ID NO: 56707 - DNA, 16 bp, H. sapiens
atttctttccttccca

SEQ ID NO: 56708 - DNA, 16 bp, H. sapiens
atttctttctcacatt

SEQ ID NO: 56709 - DNA, 16 bp, H. sapiens
atttctttctcagcta

SEQ ID NO: 56710 - DNA, 16 bp, H. sapiens
atttctttctctgctt

SEQ ID NO: 56711 - DNA, 16 bp, H. sapiens
atttctttgaaataaa

SEQ ID NO: 56712 - DNA, 16 bp, H. sapiens
atttctttgaagtttt

SEQ ID NO: 56713 - DNA, 16 bp, H. sapiens
atttctttgaatactt

SEQ ID NO: 56714 - DNA, 16 bp, H. sapiens
atttctttgagcactg

SEQ ID NO: 56715 - DNA, 16 bp, H. sapiens
atttctttgataattt

SEQ ID NO: 56716 - DNA, 16 bp, H. sapiens
atttctttggaatttt

SEQ ID NO: 56717 - DNA, 16 bp, H. sapiens
atttctttgggatttt

SEQ ID NO: 56718 - DNA, 16 bp, H. sapiens
atttctttgggtattt

SEQ ID NO: 56719 - DNA, 16 bp, H. sapiens
atttctttgtgattta

SEQ ID NO: 56720 - DNA, 16 bp, H. sapiens
atttctttgttttcaa

SEQ ID NO: 56721 - DNA, 16 bp, H. sapiens
atttcttttaaagttt

SEQ ID NO: 56722 - DNA, 16 bp, H. sapiens
atttcttttaatgact

SEQ ID NO: 56723 - DNA, 16 bp, H. sapiens
atttcttttagagatg

SEQ ID NO: 56724 - DNA, 16 bp, H. sapiens
atttcttttcctctgc

SEQ ID NO: 56725 - DNA, 16 bp, H. sapiens
atttcttttgcaattt

SEQ ID NO: 56726 - DNA, 16 bp, H. sapiens
atttcttttggaaaaa

SEQ ID NO: 56727 - DNA, 16 bp, H. sapiens
atttcttttgttaaat

SEQ ID NO: 56728 - DNA, 16 bp, H. sapiens
atttctttttagtaat

SEQ ID NO: 56729 - DNA, 16 bp, H. sapiens
atttctttttctgaga

SEQ ID NO: 56730 - DNA, 16 bp, H. sapiens
atttcttttttaagat

SEQ ID NO: 56731 - DNA, 16 bp, H. sapiens
atttgaaaaaaataca

SEQ ID NO: 56732 - DNA, 16 bp, H. sapiens
atttgaaaaaaatcaa

SEQ ID NO: 56733 - DNA, 16 bp, H. sapiens
atttgaaaaaaatgct

SEQ ID NO: 56734 - DNA, 16 bp, H. sapiens
atttgaaaaacacttt

SEQ ID NO: 56735 - DNA, 16 bp, H. sapiens
atttgaaaaatacttt

SEQ ID NO: 56736 - DNA, 16 bp, H. sapiens
atttgaaaaatgaaga

SEQ ID NO: 56737 - DNA, 16 bp, H. sapiens
atttgaaaaccactga

SEQ ID NO: 56738 - DNA, 16 bp, H. sapiens
atttgaaaactgaaaa

SEQ ID NO: 56739 - DNA, 16 bp, H. sapiens
atttgaaaagaatatt

SEQ ID NO: 56740 - DNA, 16 bp, H. sapiens
atttgaaaaggaaatt

SEQ ID NO: 56741 - DNA, 16 bp, H. sapiens
atttgaaaaggaagaa

SEQ ID NO: 56742 - DNA, 16 bp, H. sapiens
atttgaaaaggtattt

SEQ ID NO: 56743 - DNA, 16 bp, H. sapiens
atttgaaaatcaaatt

SEQ ID NO: 56744 - DNA, 16 bp, H. sapiens
atttgaaaatgtattt

SEQ ID NO: 56745 - DNA, 16 bp, H. sapiens
atttgaaaattcattt

SEQ ID NO: 56746 - DNA, 16 bp, H. sapiens
atttgaaaatttcttt

SEQ ID NO: 56747 - DNA, 16 bp, H. sapiens
atttgaaaatttgaaa

SEQ ID NO: 56748 - DNA, 16 bp, H. sapiens
atttgaaacaaaagaa

SEQ ID NO: 56749 - DNA, 16 bp, H. sapiens
atttgaaacattttct

SEQ ID NO: 56750 - DNA, 16 bp, H. sapiens
atttgaaagaaaaact

SEQ ID NO: 56751 - DNA, 16 bp, H. sapiens
atttgaaagaaaacaa

SEQ ID NO: 56752 - DNA, 16 bp, H. sapiens
atttgaaagaaaagga

SEQ ID NO: 56753 - DNA, 16 bp, H. sapiens
atttgaaagaaatgat

SEQ ID NO: 56754 - DNA, 16 bp, H. sapiens
atttgaaagaaattat

SEQ ID NO: 56755 - DNA, 16 bp, H. sapiens
atttgaaagatattta

SEQ ID NO: 56756 - DNA, 16 bp, H. sapiens
atttgaaaggacttgg

SEQ ID NO: 56757 - DNA, 16 bp, H. sapiens
atttgaaagtaatatt

SEQ ID NO: 56758 - DNA, 16 bp, H. sapiens
atttgaaataaaactt

SEQ ID NO: 56759 - DNA, 16 bp, H. sapiens
atttgaaatatttcat

SEQ ID NO: 56760 - DNA, 16 bp, H. sapiens
atttgaaatcatttta

SEQ ID NO: 56761 - DNA, 16 bp, H. sapiens
atttgaaatgaaaatt

SEQ ID NO: 56762 - DNA, 16 bp, H. sapiens
atttgaaatgaaatga

SEQ ID NO: 56763 - DNA, 16 bp, H. sapiens
atttgaaatgtataaa

SEQ ID NO: 56764 - DNA, 16 bp, H. sapiens
atttgaaatgtatatt

SEQ ID NO: 56765 - DNA, 16 bp, H. sapiens
atttgaaatgtcattt

SEQ ID NO: 56766 - DNA, 16 bp, H. sapiens
atttgaaattaaaagt

SEQ ID NO: 56767 - DNA, 16 bp, H. sapiens
atttgaaattatacat

SEQ ID NO: 56768 - DNA, 16 bp, H. sapiens
atttgaaatttcaaaa

SEQ ID NO: 56769 - DNA, 16 bp, H. sapiens
atttgaaatttctaaa

SEQ ID NO: 56770 - DNA, 16 bp, H. sapiens
atttgaaatttgaaat

SEQ ID NO: 56771 - DNA, 16 bp, H. sapiens
atttgaacatttattt

SEQ ID NO: 56772 - DNA, 16 bp, H. sapiens
atttgaactcaggcag

SEQ ID NO: 56773 - DNA, 16 bp, H. sapiens
atttgaagaaaaatgt

SEQ ID NO: 56774 - DNA, 16 bp, H. sapiens
atttgaagaaataaag

SEQ ID NO: 56775 - DNA, 16 bp, H. sapiens
atttgaagaaatcatg

SEQ ID NO: 56776 - DNA, 16 bp, H. sapiens
atttgaagaataattt

SEQ ID NO: 56777 - DNA, 16 bp, H. sapiens
atttgaagaattaatg

SEQ ID NO: 56778 - DNA, 16 bp, H. sapiens
atttgaagacaaaaaa

SEQ ID NO: 56779 - DNA, 16 bp, H. sapiens
atttgaagagataatt

SEQ ID NO: 56780 - DNA, 16 bp, H. sapiens
atttgaagagatttat

SEQ ID NO: 56781 - DNA, 16 bp, H. sapiens
atttgaagataatttt

SEQ ID NO: 56782 - DNA, 16 bp, H. sapiens
atttgaagatattaaa

SEQ ID NO: 56783 - DNA, 16 bp, H. sapiens
atttgaagatatttct

SEQ ID NO: 56784 - DNA, 16 bp, H. sapiens
atttgaagatgaggaa

SEQ ID NO: 56785 - DNA, 16 bp, H. sapiens
atttgaagatgctaca

SEQ ID NO: 56786 - DNA, 16 bp, H. sapiens
atttgaaggagaaaat

SEQ ID NO: 56787 - DNA, 16 bp, H. sapiens
atttgaagtaattatt

SEQ ID NO: 56788 - DNA, 16 bp, H. sapiens
atttgaagtcaagagt

SEQ ID NO: 56789 - DNA, 16 bp, H. sapiens
atttgaagtcagaaaa

SEQ ID NO: 56790 - DNA, 16 bp, H. sapiens
atttgaagtctttcta

SEQ ID NO: 56791 - DNA, 16 bp, H. sapiens
atttgaataaaatctt

SEQ ID NO: 56792 - DNA, 16 bp, H. sapiens
atttgaatagccctat

SEQ ID NO: 56793 - DNA, 16 bp, H. sapiens
atttgaatatgttgaa

SEQ ID NO: 56794 - DNA, 16 bp, H. sapiens
atttgaatatttcaaa

SEQ ID NO: 56795 - DNA, 16 bp, H. sapiens
atttgaatattttgaa

SEQ ID NO: 56796 - DNA, 16 bp, H. sapiens
atttgaatatttttca

SEQ ID NO: 56797 - DNA, 16 bp, H. sapiens
atttgaatccaggcag

SEQ ID NO: 56798 - DNA, 16 bp, H. sapiens
atttgaatcttctctt

SEQ ID NO: 56799 - DNA, 16 bp, H. sapiens
atttgaatcttctttt

SEQ ID NO: 56800 - DNA, 16 bp, H. sapiens
atttgaatgccattta

SEQ ID NO: 56801 - DNA, 16 bp, H. sapiens
atttgaattaaatgaa

SEQ ID NO: 56802 - DNA, 16 bp, H. sapiens
atttgaattattttct

SEQ ID NO: 56803 - DNA, 16 bp, H. sapiens
atttgaatttatttca

SEQ ID NO: 56804 - DNA, 16 bp, H. sapiens
atttgaatttccctga

SEQ ID NO: 56805 - DNA, 16 bp, H. sapiens
atttgaatttgaaaaa

SEQ ID NO: 56806 - DNA, 16 bp, H. sapiens
atttgaattttggggg

SEQ ID NO: 56807 - DNA, 16 bp, H. sapiens
atttgaattttttcct

SEQ ID NO: 56808 - DNA, 16 bp, H. sapiens
atttgacaaaaattca

SEQ ID NO: 56809 - DNA, 16 bp, H. sapiens
atttgacaaaatctaa

SEQ ID NO: 56810 - DNA, 16 bp, H. sapiens
atttgacaaagaaaaa

SEQ ID NO: 56811 - DNA, 16 bp, H. sapiens
atttgacagataaaga

SEQ ID NO: 56812 - DNA, 16 bp, H. sapiens
atttgacatcctctct

SEQ ID NO: 56813 - DNA, 16 bp, H. sapiens
atttgacattctggaa

SEQ ID NO: 56814 - DNA, 16 bp, H. sapiens
atttgacccagcaacc

SEQ ID NO: 56815 - DNA, 16 bp, H. sapiens
atttgactactccagg

SEQ ID NO: 56816 - DNA, 16 bp, H. sapiens
atttgactatattaaa

SEQ ID NO: 56817 - DNA, 16 bp, H. sapiens
atttgacttattttta

SEQ ID NO: 56818 - DNA, 16 bp, H. sapiens
atttgacttcttcctg

SEQ ID NO: 56819 - DNA, 16 bp, H. sapiens
atttgactttctgtct

SEQ ID NO: 56820 - DNA, 16 bp, H. sapiens
atttgagaaaaatatt

SEQ ID NO: 56821 - DNA, 16 bp, H. sapiens
atttgagaaaataaga

SEQ ID NO: 56822 - DNA, 16 bp, H. sapiens
atttgagaaattattt

SEQ ID NO: 56823 - DNA, 16 bp, H. sapiens
atttgagaataagaaa

SEQ ID NO: 56824 - DNA, 18 bp, H. sapiens
atttgagaccagcctggt

SEQ ID NO: 56825 - DNA, 16 bp, H. sapiens
atttgagactgagctc

SEQ ID NO: 56826 - DNA, 16 bp, H. sapiens
atttgagagtaaattg

SEQ ID NO: 56827 - DNA, 16 bp, H. sapiens
atttgagcaattttct

SEQ ID NO: 56828 - DNA, 16 bp, H. sapiens
atttgagcatttcctc

SEQ ID NO: 56829 - DNA, 16 bp, H. sapiens
atttgaggagagttta

SEQ ID NO: 56830 - DNA, 16 bp, H. sapiens
atttgaggggaaaaaa

SEQ ID NO: 56831 - DNA, 16 bp, H. sapiens
atttgaggtcttttgt

SEQ ID NO: 56832 - DNA, 16 bp, H. sapiens
atttgaggtgaatcca

SEQ ID NO: 56833 - DNA, 16 bp, H. sapiens
atttgagtagatattt

SEQ ID NO: 56834 - DNA, 16 bp, H. sapiens
atttgagtcaattcca

SEQ ID NO: 56835 - DNA, 16 bp, H. sapiens
atttgagtctttttct

SEQ ID NO: 56836 - DNA, 16 bp, H. sapiens
atttgagtggtttcca

SEQ ID NO: 56837 - DNA, 16 bp, H. sapiens
atttgataaaaattgt

SEQ ID NO: 56838 - DNA, 16 bp, H. sapiens
atttgataaaactcaa

SEQ ID NO: 56839 - DNA, 16 bp, H. sapiens
atttgataaaattcaa

SEQ ID NO: 56840 - DNA, 16 bp, H. sapiens
atttgataaacaaatt

SEQ ID NO: 56841 - DNA, 16 bp, H. sapiens
atttgataaaggactg

SEQ ID NO: 56842 - DNA, 16 bp, H. sapiens
atttgataatgataaa

SEQ ID NO: 56843 - DNA, 16 bp, H. sapiens
atttgatagatgagga

SEQ ID NO: 56844 - DNA, 16 bp, H. sapiens
atttgatatttcaata

SEQ ID NO: 56845 - DNA, 16 bp, H. sapiens
atttgatcttcacaac

SEQ ID NO: 56846 - DNA, 16 bp, H. sapiens
atttgatcttccatca

SEQ ID NO: 56847 - DNA, 16 bp, H. sapiens
atttgatctttttaaa

SEQ ID NO: 56848 - DNA, 16 bp, H. sapiens
atttgatgatgaaatg

SEQ ID NO: 56849 - DNA, 16 bp, H. sapiens
atttgatgatgatgat

SEQ ID NO: 56850 - DNA, 16 bp, H. sapiens
atttgatggaaaaaaa

SEQ ID NO: 56851 - DNA, 16 bp, H. sapiens
atttgatggcttaaaa

SEQ ID NO: 56852 - DNA, 16 bp, H. sapiens
atttgatgtattcaat

SEQ ID NO: 56853 - DNA, 16 bp, H. sapiens
atttgattatatgaat

SEQ ID NO: 56854 - DNA, 16 bp, H. sapiens
atttgattatttcatt

SEQ ID NO: 56855 - DNA, 16 bp, H. sapiens
atttgattctaaaatt

SEQ ID NO: 56856 - DNA, 16 bp, H. sapiens
atttgattctctttgt

SEQ ID NO: 56857 - DNA, 16 bp, H. sapiens
atttgattgcactgtt

SEQ ID NO: 56858 - DNA, 16 bp, H. sapiens
atttgatttccatttt

SEQ ID NO: 56859 - DNA, 16 bp, H. sapiens
atttgatttcctgttt

SEQ ID NO: 56860 - DNA, 16 bp, H. sapiens
atttgatttggggaag

SEQ ID NO: 56861 - DNA, 16 bp, H. sapiens
atttgattttaaagaa

SEQ ID NO: 56862 - DNA, 16 bp, H. sapiens
atttgattttcaacaa

SEQ ID NO: 56863 - DNA, 16 bp, H. sapiens
atttgattttcatttc

SEQ ID NO: 56864 - DNA, 16 bp, H. sapiens
atttgattttgaaaag

SEQ ID NO: 56865 - DNA, 16 bp, H. sapiens
atttgatttttacaaa

SEQ ID NO: 56866 - DNA, 16 bp, H. sapiens
atttgatttttcaaaa

SEQ ID NO: 56867 - DNA, 16 bp, H. sapiens
atttgatttttttcaa

SEQ ID NO: 56868 - DNA, 16 bp, H. sapiens
atttgcaaaaagaaaa

SEQ ID NO: 56869 - DNA, 16 bp, H. sapiens
atttgcaaaaattaaa

SEQ ID NO: 56870 - DNA, 16 bp, H. sapiens
atttgcaaaaattatt

SEQ ID NO: 56871 - DNA, 16 bp, H. sapiens
atttgcaaaacacaca

SEQ ID NO: 56872 - DNA, 16 bp, H. sapiens
atttgcaaaagatgta

SEQ ID NO: 56873 - DNA, 16 bp, H. sapiens
atttgcaaatacattt

SEQ ID NO: 56874 - DNA, 16 bp, H. sapiens
atttgcaaatattttc

SEQ ID NO: 56875 - DNA, 16 bp, H. sapiens
atttgcaaatcattca

SEQ ID NO: 56876 - DNA, 16 bp, H. sapiens
atttgcaaatgtttta

SEQ ID NO: 56877 - DNA, 16 bp, H. sapiens
atttgcaattgcaaat

SEQ ID NO: 56878 - DNA, 16 bp, H. sapiens
atttgcagaaacatgg

SEQ ID NO: 56879 - DNA, 16 bp, H. sapiens
atttgcagcaacataa

SEQ ID NO: 56880 - DNA, 16 bp, H. sapiens
atttgcagcatgagaa

SEQ ID NO: 56881 - DNA, 16 bp, H. sapiens
atttgcataagtaatg

SEQ ID NO: 56882 - DNA, 16 bp, H. sapiens
atttgcataataagat

SEQ ID NO: 56883 - DNA, 16 bp, H. sapiens
atttgcatatattgaa

SEQ ID NO: 56884 - DNA, 16 bp, H. sapiens
atttgcatattgattt

SEQ ID NO: 56885 - DNA, 16 bp, H. sapiens
atttgcatatttattt

SEQ ID NO: 56886 - DNA, 16 bp, H. sapiens
atttgcattaaaaaga

SEQ ID NO: 56887 - DNA, 16 bp, H. sapiens
atttgcattgtttaaa

SEQ ID NO: 56888 - DNA, 16 bp, H. sapiens
atttgcattgttttaa

SEQ ID NO: 56889 - DNA, 16 bp, H. sapiens
atttgcatttacaata

SEQ ID NO: 56890 - DNA, 16 bp, H. sapiens
atttgcatttccatta

SEQ ID NO: 56891 - DNA, 16 bp, H. sapiens
atttgcatttccttca

SEQ ID NO: 56892 - DNA, 16 bp, H. sapiens
atttgcatttctaaca

SEQ ID NO: 56893 - DNA, 16 bp, H. sapiens
atttgcatttgaaaaa

SEQ ID NO: 56894 - DNA, 16 bp, H. sapiens
atttgcatttgaaaat

SEQ ID NO: 56895 - DNA, 16 bp, H. sapiens
atttgcattttaaaag

SEQ ID NO: 56896 - DNA, 16 bp, H. sapiens
atttgcattttacaga

SEQ ID NO: 56897 - DNA, 16 bp, H. sapiens
atttgcattttactga

SEQ ID NO: 56898 - DNA, 16 bp, H. sapiens
atttgcattttactta

SEQ ID NO: 56899 - DNA, 16 bp, H. sapiens
atttgcattttacttt

SEQ ID NO: 56900 - DNA, 16 bp, H. sapiens
atttgcattttattat

SEQ ID NO: 56901 - DNA, 16 bp, H. sapiens
atttgcatttttaaaa

SEQ ID NO: 56902 - DNA, 16 bp, H. sapiens
atttgcatttttctca

SEQ ID NO: 56903 - DNA, 16 bp, H. sapiens
atttgccattttaatt

SEQ ID NO: 56904 - DNA, 16 bp, H. sapiens
atttgcccaagtcaca

SEQ ID NO: 56905 - DNA, 16 bp, H. sapiens
atttgcccaatgtcac

SEQ ID NO: 56906 - DNA, 17 bp, H. sapiens
atttgcccacctcggcc

SEQ ID NO: 56907 - DNA, 16 bp, H. sapiens
atttgcctattctaga

SEQ ID NO: 56908 - DNA, 16 bp, H. sapiens
atttgcctattctgga

SEQ ID NO: 56909 - DNA, 16 bp, H. sapiens
atttgcctgatttctt

SEQ ID NO: 56910 - DNA, 16 bp, H. sapiens
atttgcctgcctcagc

SEQ ID NO: 56911 - DNA, 17 bp, H. sapiens
atttgcctgccttggcc

SEQ ID NO: 56912 - DNA, 16 bp, H. sapiens
atttgccttcccacaa

SEQ ID NO: 56913 - DNA, 16 bp, H. sapiens
atttgccttttataaa

SEQ ID NO: 56914 - DNA, 16 bp, H. sapiens
atttgcctttttctct

SEQ ID NO: 56915 - DNA, 16 bp, H. sapiens
atttgctaaaattaaa

SEQ ID NO: 56916 - DNA, 16 bp, H. sapiens
atttgctaatttaaaa

SEQ ID NO: 56917 - DNA, 16 bp, H. sapiens
atttgctaatttattt

SEQ ID NO: 56918 - DNA, 16 bp, H. sapiens
atttgctacaacatgg

SEQ ID NO: 56919 - DNA, 16 bp, H. sapiens
atttgctatggtctga

SEQ ID NO: 56920 - DNA, 16 bp, H. sapiens
atttgctattgtaaat

SEQ ID NO: 56921 - DNA, 16 bp, H. sapiens
atttgctcctgaatga

SEQ ID NO: 56922 - DNA, 16 bp, H. sapiens
atttgctcttctgcag

SEQ ID NO: 56923 - DNA, 16 bp, H. sapiens
atttgctcttttcaca

SEQ ID NO: 56924 - DNA, 16 bp, H. sapiens
atttgctgaagttgct

SEQ ID NO: 56925 - DNA, 16 bp, H. sapiens
atttgctgaattaaaa

SEQ ID NO: 56926 - DNA, 16 bp, H. sapiens
atttgctgaattcatt

SEQ ID NO: 56927 - DNA, 16 bp, H. sapiens
atttgctgagtaccta

SEQ ID NO: 56928 - DNA, 16 bp, H. sapiens
atttgctgtgaaccta

SEQ ID NO: 56929 - DNA, 16 bp, H. sapiens
atttgctgttctgtaa

SEQ ID NO: 56930 - DNA, 16 bp, H. sapiens
atttgcttaggaaaat

SEQ ID NO: 56931 - DNA, 16 bp, H. sapiens
atttgcttatgtattt

SEQ ID NO: 56932 - DNA, 16 bp, H. sapiens
atttgcttcatttatt

SEQ ID NO: 56933 - DNA, 16 bp, H. sapiens
atttgcttcattttct

SEQ ID NO: 56934 - DNA, 16 bp, H. sapiens
atttgctttatatatc

SEQ ID NO: 56935 - DNA, 16 bp, H. sapiens
atttgcttttctattc

SEQ ID NO: 56936 - DNA, 19 bp, H. sapiens
atttgcttttgaaagaaga

SEQ ID NO: 56937 - DNA, 16 bp, H. sapiens
atttggaaaaaaattt

SEQ ID NO: 56938 - DNA, 16 bp, H. sapiens
atttggaaaaacctaa

SEQ ID NO: 56939 - DNA, 16 bp, H. sapiens
atttggaaaaacctga

SEQ ID NO: 56940 - DNA, 16 bp, H. sapiens
atttggaaaaagaaat

SEQ ID NO: 56941 - DNA, 16 bp, H. sapiens
atttggaaaaataatt

SEQ ID NO: 56942 - DNA, 16 bp, H. sapiens
atttggaaaacaaaac

SEQ ID NO: 56943 - DNA, 16 bp, H. sapiens
atttggaaaacaaaga

SEQ ID NO: 56944 - DNA, 16 bp, H. sapiens
atttggaaaacagaaa

SEQ ID NO: 56945 - DNA, 16 bp, H. sapiens
atttggaaaacattta

SEQ ID NO: 56946 - DNA, 16 bp, H. sapiens
atttggaaaacctaaa

SEQ ID NO: 56947 - DNA, 16 bp, H. sapiens
atttggaaaaggaaag

SEQ ID NO: 56948 - DNA, 16 bp, H. sapiens
atttggaaaatacaga

SEQ ID NO: 56949 - DNA, 16 bp, H. sapiens
atttggaaaatataga

SEQ ID NO: 56950 - DNA, 16 bp, H. sapiens
atttggaaaatattga

SEQ ID NO: 56951 - DNA, 16 bp, H. sapiens
atttggaaaatgcaga

SEQ ID NO: 56952 - DNA, 16 bp, H. sapiens
atttggaaaatgtgat

SEQ ID NO: 56953 - DNA, 16 bp, H. sapiens
atttggaaactaaaca

SEQ ID NO: 56954 - DNA, 16 bp, H. sapiens
atttggaaactatgca

SEQ ID NO: 56955 - DNA, 16 bp, H. sapiens
atttggaaagaaaaca

SEQ ID NO: 56956 - DNA, 16 bp, H. sapiens
atttggaaagaatttg

SEQ ID NO: 56957 - DNA, 16 bp, H. sapiens
atttggaaaggacaaa

SEQ ID NO: 56958 - DNA, 16 bp, H. sapiens
atttggaaataaaatt

SEQ ID NO: 56959 - DNA, 16 bp, H. sapiens
atttggaaataggatc

SEQ ID NO: 56960 - DNA, 16 bp, H. sapiens
atttggaaatatgaaa

SEQ ID NO: 56961 - DNA, 16 bp, H. sapiens
atttggaaatgaaaat

SEQ ID NO: 56962 - DNA, 16 bp, H. sapiens
atttggaaatgttttc

SEQ ID NO: 56963 - DNA, 16 bp, H. sapiens
atttggaaattaaaca

SEQ ID NO: 56964 - DNA, 16 bp, H. sapiens
atttggaagaaaaaga

SEQ ID NO: 56965 - DNA, 16 bp, H. sapiens
atttggaagagaagag

SEQ ID NO: 56966 - DNA, 16 bp, H. sapiens
atttggaagcaacgta

SEQ ID NO: 56967 - DNA, 16 bp, H. sapiens
atttggaataatttta

SEQ ID NO: 56968 - DNA, 17 bp, H. sapiens
atttggaatggctgtat

SEQ ID NO: 56969 - DNA, 16 bp, H. sapiens
atttggaattattctg

SEQ ID NO: 56970 - DNA, 16 bp, H. sapiens
atttggaattcttctg

SEQ ID NO: 56971 - DNA, 16 bp, H. sapiens
atttggaatttaaaaa

SEQ ID NO: 56972 - DNA, 16 bp, H. sapiens
atttggaatttatcct

SEQ ID NO: 56973 - DNA, 16 bp, H. sapiens
atttggaccactttga

SEQ ID NO: 56974 - DNA, 16 bp, H. sapiens
atttggagaaaattaa

SEQ ID NO: 56975 - DNA, 16 bp, H. sapiens
atttggagaagaggca

SEQ ID NO: 56976 - DNA, 16 bp, H. sapiens
atttggagaatatttt

SEQ ID NO: 56977 - DNA, 16 bp, H. sapiens
atttggagatggggcc

SEQ ID NO: 56978 - DNA, 16 bp, H. sapiens
atttggagcacattga

SEQ ID NO: 56979 - DNA, 16 bp, H. sapiens
atttggaggaaaaaaa

SEQ ID NO: 56980 - DNA, 16 bp, H. sapiens
atttggaggaaagaga

SEQ ID NO: 56981 - DNA, 16 bp, H. sapiens
atttggaggggaaaaa

SEQ ID NO: 56982 - DNA, 16 bp, H. sapiens
atttggaggggacaaa

SEQ ID NO: 56983 - DNA, 16 bp, H. sapiens
atttggagtgcaaatt

SEQ ID NO: 56984 - DNA, 18 bp, H. sapiens
atttggataccatcaaga

SEQ ID NO: 56985 - DNA, 16 bp, H. sapiens
atttggatctcagctt

SEQ ID NO: 56986 - DNA, 16 bp, H. sapiens
atttggattcccttta

SEQ ID NO: 56987 - DNA, 16 bp, H. sapiens
atttggcaacatctgg

SEQ ID NO: 56988 - DNA, 16 bp, H. sapiens
atttggcagtctgtgt

SEQ ID NO: 56989 - DNA, 16 bp, H. sapiens
atttggctcttagctt

SEQ ID NO: 56990 - DNA, 16 bp, H. sapiens
atttggctcttggttt

SEQ ID NO: 56991 - DNA, 16 bp, H. sapiens
atttggctttatttct

SEQ ID NO: 56992 - DNA, 16 bp, H. sapiens
atttggctttcagctt

SEQ ID NO: 56993 - DNA, 16 bp, H. sapiens
atttggctttctgtct

SEQ ID NO: 56994 - DNA, 16 bp, H. sapiens
atttgggaaaaaaaga

SEQ ID NO: 56995 - DNA, 16 bp, H. sapiens
atttgggaaaaaaata

SEQ ID NO: 56996 - DNA, 16 bp, H. sapiens
atttgggaaagaaaaa

SEQ ID NO: 56997 - DNA, 16 bp, H. sapiens
atttgggaagaattga

SEQ ID NO: 56998 - DNA, 16 bp, H. sapiens
atttgggagaaaatat

SEQ ID NO: 56999 - DNA, 16 bp, H. sapiens
atttgggagaggccag

SEQ ID NO: 57000 - DNA, 16 bp, H. sapiens
atttgggagcacactg

SEQ ID NO: 57001 - DNA, 16 bp, H. sapiens
atttgggaggcagagg

SEQ ID NO: 57002 - DNA, 21 bp, H. sapiens
atttgggaggccaaggtggga

SEQ ID NO: 57003 - DNA, 16 bp, H. sapiens
atttgggaggccgagg

SEQ ID NO: 57004 - DNA, 16 bp, H. sapiens
atttgggaggcctagg

SEQ ID NO: 57005 - DNA, 16 bp, H. sapiens
atttgggaggctgagg

SEQ ID NO: 57006 - DNA, 16 bp, H. sapiens
atttgggatatatttt

SEQ ID NO: 57007 - DNA, 16 bp, H. sapiens
atttgggatgatgaaa

SEQ ID NO: 57008 - DNA, 16 bp, H. sapiens
atttgggattatggca

SEQ ID NO: 57009 - DNA, 16 bp, H. sapiens
atttgggctctctttt

SEQ ID NO: 57010 - DNA, 16 bp, H. sapiens
atttgggctgggctca

SEQ ID NO: 57011 - DNA, 16 bp, H. sapiens
atttgggctggtttca

SEQ ID NO: 57012 - DNA, 16 bp, H. sapiens
atttggggaaaaaaaa

SEQ ID NO: 57013 - DNA, 16 bp, H. sapiens
atttggggaaaaaaag

SEQ ID NO: 57014 - DNA, 16 bp, H. sapiens
atttggggaaataaat

SEQ ID NO: 57015 - DNA, 16 bp, H. sapiens
atttggggaatttttt

SEQ ID NO: 57016 - DNA, 16 bp, H. sapiens
atttggggaggacaca

SEQ ID NO: 57017 - DNA, 16 bp, H. sapiens
atttgggggaagaaaa

SEQ ID NO: 57018 - DNA, 16 bp, H. sapiens
atttgggggatatttt

SEQ ID NO: 57019 - DNA, 16 bp, H. sapiens
atttgggggccattat

SEQ ID NO: 57020 - DNA, 16 bp, H. sapiens
atttggggtggggaca

SEQ ID NO: 57021 - DNA, 16 bp, H. sapiens
atttgggtcccatccc

SEQ ID NO: 57022 - DNA, 16 bp, H. sapiens
atttgggtgggagtgt

SEQ ID NO: 57023 - DNA, 16 bp, H. sapiens
atttgggttatttcca

SEQ ID NO: 57024 - DNA, 16 bp, H. sapiens
atttgggttcattcca

SEQ ID NO: 57025 - DNA, 16 bp, H. sapiens
atttgggttgcttcca

SEQ ID NO: 57026 - DNA, 16 bp, H. sapiens
atttgggttgtgtcca

SEQ ID NO: 57027 - DNA, 16 bp, H. sapiens
atttgggttgtttata

SEQ ID NO: 57028 - DNA, 16 bp, H. sapiens
atttgggtttttaaaa

SEQ ID NO: 57029 - DNA, 16 bp, H. sapiens
atttggtgaaagaaat

SEQ ID NO: 57030 - DNA, 16 bp, H. sapiens
atttggtgaaagacat

SEQ ID NO: 57031 - DNA, 16 bp, H. sapiens
atttggtggcttaaaa

SEQ ID NO: 57032 - DNA, 16 bp, H. sapiens
atttggtggtttaaaa

SEQ ID NO: 57033 - DNA, 16 bp, H. sapiens
atttggtttgcttcca

SEQ ID NO: 57034 - DNA, 16 bp, H. sapiens
atttggttttctgtct

SEQ ID NO: 57035 - DNA, 16 bp, H. sapiens
atttgtaaaaatcaca

SEQ ID NO: 57036 - DNA, 16 bp, H. sapiens
atttgtaaaataaatg

SEQ ID NO: 57037 - DNA, 16 bp, H. sapiens
atttgtaaaatattga

SEQ ID NO: 57038 - DNA, 16 bp, H. sapiens
atttgtaaaatgaaga

SEQ ID NO: 57039 - DNA, 16 bp, H. sapiens
atttgtaaaatgagga

SEQ ID NO: 57040 - DNA, 16 bp, H. sapiens
atttgtaaaatgtgaa

SEQ ID NO: 57041 - DNA, 16 bp, H. sapiens
atttgtaaactgtcac

SEQ ID NO: 57042 - DNA, 16 bp, H. sapiens
atttgtaaagaaagaa

SEQ ID NO: 57043 - DNA, 16 bp, H. sapiens
atttgtaaagtgaaga

SEQ ID NO: 57044 - DNA, 16 bp, H. sapiens
atttgtaaatactttt

SEQ ID NO: 57045 - DNA, 16 bp, H. sapiens
atttgtaaatcatatt

SEQ ID NO: 57046 - DNA, 16 bp, H. sapiens
atttgtaaatgtgttt

SEQ ID NO: 57047 - DNA, 16 bp, H. sapiens
atttgtaacaggacac

SEQ ID NO: 57048 - DNA, 16 bp, H. sapiens
atttgtaagaattctt

SEQ ID NO: 57049 - DNA, 16 bp, H. sapiens
atttgtaagtcttctt

SEQ ID NO: 57050 - DNA, 16 bp, H. sapiens
atttgtaatagctaaa

SEQ ID NO: 57051 - DNA, 16 bp, H. sapiens
atttgtaatagtgaaa

SEQ ID NO: 57052 - DNA, 16 bp, H. sapiens
atttgtaatttcattt

SEQ ID NO: 57053 - DNA, 16 bp, H. sapiens
atttgtaatttgtaaa

SEQ ID NO: 57054 - DNA, 16 bp, H. sapiens
atttgtacaaatgtat

SEQ ID NO: 57055 - DNA, 16 bp, H. sapiens
atttgtacacaaatgt

SEQ ID NO: 57056 - DNA, 16 bp, H. sapiens
atttgtacatattttt

SEQ ID NO: 57057 - DNA, 16 bp, H. sapiens
atttgtacattttctt

SEQ ID NO: 57058 - DNA, 16 bp, H. sapiens
atttgtagaaataatt

SEQ ID NO: 57059 - DNA, 16 bp, H. sapiens
atttgtagagacagaa

SEQ ID NO: 57060 - DNA, 16 bp, H. sapiens
atttgtagctgaaata

SEQ ID NO: 57061 - DNA, 16 bp, H. sapiens
atttgtagtaatttgt

SEQ ID NO: 57062 - DNA, 16 bp, H. sapiens
atttgtagtgtttgcc

SEQ ID NO: 57063 - DNA, 16 bp, H. sapiens
atttgtagtttaaaaa

SEQ ID NO: 57064 - DNA, 16 bp, H. sapiens
atttgtatatacacac

SEQ ID NO: 57065 - DNA, 16 bp, H. sapiens
atttgtatatgttgaa

SEQ ID NO: 57066 - DNA, 16 bp, H. sapiens
atttgtatcttcttca

SEQ ID NO: 57067 - DNA, 16 bp, H. sapiens
atttgtatcttttaaa

SEQ ID NO: 57068 - DNA, 16 bp, H. sapiens
atttgtatgtcatttt

SEQ ID NO: 57069 - DNA, 16 bp, H. sapiens
atttgtattcaaaata

SEQ ID NO: 57070 - DNA, 16 bp, H. sapiens
atttgtattgtttcca

SEQ ID NO: 57071 - DNA, 16 bp, H. sapiens
atttgtatttccctca

SEQ ID NO: 57072 - DNA, 16 bp, H. sapiens
atttgtattttctcat

SEQ ID NO: 57073 - DNA, 16 bp, H. sapiens
atttgtatttttacat

SEQ ID NO: 57074 - DNA, 16 bp, H. sapiens
atttgtcaaaactcag

SEQ ID NO: 57075 - DNA, 16 bp, H. sapiens
atttgtcaaaattcat

SEQ ID NO: 57076 - DNA, 16 bp, H. sapiens
atttgtcaaatatttt

SEQ ID NO: 57077 - DNA, 16 bp, H. sapiens
atttgtcaaattttgc

SEQ ID NO: 57078 - DNA, 16 bp, H. sapiens
atttgtcaacttttgt

SEQ ID NO: 57079 - DNA, 16 bp, H. sapiens
atttgtcaatgaaaaa

SEQ ID NO: 57080 - DNA, 16 bp, H. sapiens
atttgtcaattaaaaa

SEQ ID NO: 57081 - DNA, 16 bp, H. sapiens
atttgtcaccaccaga

SEQ ID NO: 57082 - DNA, 16 bp, H. sapiens
atttgtcagcctcttt

SEQ ID NO: 57083 - DNA, 16 bp, H. sapiens
atttgtcatattttct

SEQ ID NO: 57084 - DNA, 16 bp, H. sapiens
atttgtcattcattca

SEQ ID NO: 57085 - DNA, 16 bp, H. sapiens
atttgtcattttaacc

SEQ ID NO: 57086 - DNA, 16 bp, H. sapiens
atttgtcatttttaaa

SEQ ID NO: 57087 - DNA, 16 bp, H. sapiens
atttgtcattttttaa

SEQ ID NO: 57088 - DNA, 16 bp, H. sapiens
atttgtccatttaatc

SEQ ID NO: 57089 - DNA, 16 bp, H. sapiens
atttgtccatttcttt

SEQ ID NO: 57090 - DNA, 16 bp, H. sapiens
atttgtctaaaattct

SEQ ID NO: 57091 - DNA, 16 bp, H. sapiens
atttgtctatatttgt

SEQ ID NO: 57092 - DNA, 16 bp, H. sapiens
atttgtctattattgg

SEQ ID NO: 57093 - DNA, 16 bp, H. sapiens
atttgtctttctgttc

SEQ ID NO: 57094 - DNA, 16 bp, H. sapiens
atttgtcttttctgga

SEQ ID NO: 57095 - DNA, 16 bp, H. sapiens
atttgtctttttgtga

SEQ ID NO: 57096 - DNA, 16 bp, H. sapiens
atttgtcttttttaaa

SEQ ID NO: 57097 - DNA, 16 bp, H. sapiens
atttgtgaaaattaaa

SEQ ID NO: 57098 - DNA, 16 bp, H. sapiens
atttgtgaaattttaa

SEQ ID NO: 57099 - DNA, 16 bp, H. sapiens
atttgtgaactgtcat

SEQ ID NO: 57100 - DNA, 16 bp, H. sapiens
atttgtgaataaaatt

SEQ ID NO: 57101 - DNA, 16 bp, H. sapiens
atttgtgaatgttgaa

SEQ ID NO: 57102 - DNA, 16 bp, H. sapiens
atttgtgattttaaaa

SEQ ID NO: 57103 - DNA, 16 bp, H. sapiens
atttgtgcagcagcaa

SEQ ID NO: 57104 - DNA, 16 bp, H. sapiens
atttgtgcattttact

SEQ ID NO: 57105 - DNA, 16 bp, H. sapiens
atttgtgcattttatt

SEQ ID NO: 57106 - DNA, 16 bp, H. sapiens
atttgtggaaaagact

SEQ ID NO: 57107 - DNA, 16 bp, H. sapiens
atttgtggaatgaatg

SEQ ID NO: 57108 - DNA, 16 bp, H. sapiens
atttgtggggaaaaaa

SEQ ID NO: 57109 - DNA, 16 bp, H. sapiens
atttgtggttttaaaa

SEQ ID NO: 57110 - DNA, 16 bp, H. sapiens
atttgtgtaaaaatat

SEQ ID NO: 57111 - DNA, 16 bp, H. sapiens
atttgtgtacaaattt

SEQ ID NO: 57112 - DNA, 16 bp, H. sapiens
atttgtgtacaagttt

SEQ ID NO: 57113 - DNA, 16 bp, H. sapiens
atttgtgtatatgtat

SEQ ID NO: 57114 - DNA, 16 bp, H. sapiens
atttgtgtatctaaat

SEQ ID NO: 57115 - DNA, 16 bp, H. sapiens
atttgtgtgtgtctgt

SEQ ID NO: 57116 - DNA, 16 bp, H. sapiens
atttgtgttggaccac

SEQ ID NO: 57117 - DNA, 16 bp, H. sapiens
atttgtgttgttttca

SEQ ID NO: 57118 - DNA, 16 bp, H. sapiens
atttgtgtttcagaaa

SEQ ID NO: 57119 - DNA, 16 bp, H. sapiens
atttgtgtttctaaac

SEQ ID NO: 57120 - DNA, 16 bp, H. sapiens
atttgtgtttctctga

SEQ ID NO: 57121 - DNA, 16 bp, H. sapiens
atttgtgttttgaaaa

SEQ ID NO: 57122 - DNA, 16 bp, H. sapiens
atttgtgtttttaaca

SEQ ID NO: 57123 - DNA, 16 bp, H. sapiens
atttgttaaaacttgt

SEQ ID NO: 57124 - DNA, 16 bp, H. sapiens
atttgttaaacatttt

SEQ ID NO: 57125 - DNA, 16 bp, H. sapiens
atttgttaaagaaaat

SEQ ID NO: 57126 - DNA, 16 bp, H. sapiens
atttgttaagcaccta

SEQ ID NO: 57127 - DNA, 16 bp, H. sapiens
atttgttaatatttct

SEQ ID NO: 57128 - DNA, 16 bp, H. sapiens
atttgttacagcagca

SEQ ID NO: 57129 - DNA, 16 bp, H. sapiens
atttgttcaaaagact

SEQ ID NO: 57130 - DNA, 16 bp, H. sapiens
atttgttcaaaataat

SEQ ID NO: 57131 - DNA, 16 bp, H. sapiens
atttgttcaagaaata

SEQ ID NO: 57132 - DNA, 16 bp, H. sapiens
atttgttcatttaaaa

SEQ ID NO: 57133 - DNA, 16 bp, H. sapiens
atttgttcattttgaa

SEQ ID NO: 57134 - DNA, 16 bp, H. sapiens
atttgttgaaaaataa

SEQ ID NO: 57135 - DNA, 16 bp, H. sapiens
atttgttgaaaatact

SEQ ID NO: 57136 - DNA, 16 bp, H. sapiens
atttgttgaagtccta

SEQ ID NO: 57137 - DNA, 16 bp, H. sapiens
atttgttgaatgagtt

SEQ ID NO: 57138 - DNA, 16 bp, H. sapiens
atttgttgaatgttta

SEQ ID NO: 57139 - DNA, 16 bp, H. sapiens
atttgttgagcaccta

SEQ ID NO: 57140 - DNA, 16 bp, H. sapiens
atttgttgagcactta

SEQ ID NO: 57141 - DNA, 16 bp, H. sapiens
atttgttgagtgccta

SEQ ID NO: 57142 - DNA, 16 bp, H. sapiens
atttgttgattaaaaa

SEQ ID NO: 57143 - DNA, 16 bp, H. sapiens
atttgttgcatgaatg

SEQ ID NO: 57144 - DNA, 16 bp, H. sapiens
atttgttgcatttgtt

SEQ ID NO: 57145 - DNA, 16 bp, H. sapiens
atttgttggtggcatt

SEQ ID NO: 57146 - DNA, 16 bp, H. sapiens
atttgttgtcttctgc

SEQ ID NO: 57147 - DNA, 16 bp, H. sapiens
atttgtttaaaaagta

SEQ ID NO: 57148 - DNA, 16 bp, H. sapiens
atttgtttaaaaatgt

SEQ ID NO: 57149 - DNA, 16 bp, H. sapiens
atttgtttaaagaaat

SEQ ID NO: 57150 - DNA, 16 bp, H. sapiens
atttgtttaaatgtct

SEQ ID NO: 57151 - DNA, 16 bp, H. sapiens
atttgtttaataaatg

SEQ ID NO: 57152 - DNA, 16 bp, H. sapiens
atttgtttaatcctca

SEQ ID NO: 57153 - DNA, 16 bp, H. sapiens
atttgtttaatgaatg

SEQ ID NO: 57154 - DNA, 16 bp, H. sapiens
atttgtttaatgtctt

SEQ ID NO: 57155 - DNA, 16 bp, H. sapiens
atttgtttacttttgc

SEQ ID NO: 57156 - DNA, 16 bp, H. sapiens
atttgtttatatttac

SEQ ID NO: 57157 - DNA, 16 bp, H. sapiens
atttgtttatttcatc

SEQ ID NO: 57158 - DNA, 16 bp, H. sapiens
atttgtttcaagactt

SEQ ID NO: 57159 - DNA, 16 bp, H. sapiens
atttgtttcaagattt

SEQ ID NO: 57160 - DNA, 16 bp, H. sapiens
atttgtttcatatata

SEQ ID NO: 57161 - DNA, 16 bp, H. sapiens
atttgtttccttttgg

SEQ ID NO: 57162 - DNA, 16 bp, H. sapiens
atttgtttctctctgc

SEQ ID NO: 57163 - DNA, 16 bp, H. sapiens
atttgtttcttacagt

SEQ ID NO: 57164 - DNA, 16 bp, H. sapiens
atttgtttgagacaga

SEQ ID NO: 57165 - DNA, 16 bp, H. sapiens
atttgtttggaaaaaa

SEQ ID NO: 57166 - DNA, 16 bp, H. sapiens
atttgttttaaaaaag

SEQ ID NO: 57167 - DNA, 16 bp, H. sapiens
atttgttttaaaagat

SEQ ID NO: 57168 - DNA, 16 bp, H. sapiens
atttgttttattatac

SEQ ID NO: 57169 - DNA, 16 bp, H. sapiens
atttgttttcaaataa

SEQ ID NO: 57170 - DNA, 16 bp, H. sapiens
atttgttttcaatttg

SEQ ID NO: 57171 - DNA, 16 bp, H. sapiens
atttgttttcacactg

SEQ ID NO: 57172 - DNA, 16 bp, H. sapiens
atttgttttcttgctg

SEQ ID NO: 57173 - DNA, 16 bp, H. sapiens
atttgttttgaaatgt

SEQ ID NO: 57174 - DNA, 16 bp, H. sapiens
atttgtttttaagaga

SEQ ID NO: 57175 - DNA, 16 bp, H. sapiens
atttgtttttcagttc

SEQ ID NO: 57176 - DNA, 16 bp, H. sapiens
atttgtttttctgaaa

SEQ ID NO: 57177 - DNA, 16 bp, H. sapiens
attttaaaaaacaaga

SEQ ID NO: 57178 - DNA, 16 bp, H. sapiens
attttaaaaaacagtt

SEQ ID NO: 57179 - DNA, 16 bp, H. sapiens
attttaaaaaaccatt

SEQ ID NO: 57180 - DNA, 16 bp, H. sapiens
attttaaaaaagcaaa

SEQ ID NO: 57181 - DNA, 16 bp, H. sapiens
attttaaaaaatcagt

SEQ ID NO: 57182 - DNA, 16 bp, H. sapiens
attttaaaaaatcctt

SEQ ID NO: 57183 - DNA, 16 bp, H. sapiens
attttaaaaaattgac

SEQ ID NO: 57184 - DNA, 16 bp, H. sapiens
attttaaaaacagaat

SEQ ID NO: 57185 - DNA, 16 bp, H. sapiens
attttaaaaacatgta

SEQ ID NO: 57186 - DNA, 16 bp, H. sapiens
attttaaaaaccacca

SEQ ID NO: 57187 - DNA, 16 bp, H. sapiens
attttaaaaacctgtt

SEQ ID NO: 57188 - DNA, 16 bp, H. sapiens
attttaaaaactgggt

SEQ ID NO: 57189 - DNA, 16 bp, H. sapiens
attttaaaaagaaaca

SEQ ID NO: 57190 - DNA, 16 bp, H. sapiens
attttaaaaagaagca

SEQ ID NO: 57191 - DNA, 16 bp, H. sapiens
attttaaaaagcaaat

SEQ ID NO: 57192 - DNA, 16 bp, H. sapiens
attttaaaaagcattt

SEQ ID NO: 57193 - DNA, 16 bp, H. sapiens
attttaaaaagtcaca

SEQ ID NO: 57194 - DNA, 16 bp, H. sapiens
attttaaaaagtgata

SEQ ID NO: 57195 - DNA, 16 bp, H. sapiens
attttaaaaatcattg

SEQ ID NO: 57196 - DNA, 16 bp, H. sapiens
attttaaaaatggaat

SEQ ID NO: 57197 - DNA, 16 bp, H. sapiens
attttaaaaattgctt

SEQ ID NO: 57198 - DNA, 16 bp, H. sapiens
attttaaaaattggat

SEQ ID NO: 57199 - DNA, 16 bp, H. sapiens
attttaaaacaaaatg

SEQ ID NO: 57200 - DNA, 16 bp, H. sapiens
attttaaaacaaggaa

SEQ ID NO: 57201 - DNA, 16 bp, H. sapiens
attttaaaacagaaaa

SEQ ID NO: 57202 - DNA, 16 bp, H. sapiens
attttaaaacaggttt

SEQ ID NO: 57203 - DNA, 16 bp, H. sapiens
attttaaaacagttaa

SEQ ID NO: 57204 - DNA, 16 bp, H. sapiens
attttaaaactctatt

SEQ ID NO: 57205 - DNA, 16 bp, H. sapiens
attttaaaactgaaaa

SEQ ID NO: 57206 - DNA, 16 bp, H. sapiens
attttaaaacttaaca

SEQ ID NO: 57207 - DNA, 16 bp, H. sapiens
attttaaaacttcaaa

SEQ ID NO: 57208 - DNA, 16 bp, H. sapiens
attttaaaagaaatgt

SEQ ID NO: 57209 - DNA, 16 bp, H. sapiens
attttaaaagaacatt

SEQ ID NO: 57210 - DNA, 16 bp, H. sapiens
attttaaaagagagaa

SEQ ID NO: 57211 - DNA, 16 bp, H. sapiens
attttaaaagatgcaa

SEQ ID NO: 57212 - DNA, 16 bp, H. sapiens
attttaaaagatttca

SEQ ID NO: 57213 - DNA, 16 bp, H. sapiens
attttaaaagcaatat

SEQ ID NO: 57214 - DNA, 16 bp, H. sapiens
attttaaaagcaatta

SEQ ID NO: 57215 - DNA, 16 bp, H. sapiens
attttaaaagcagttt

SEQ ID NO: 57216 - DNA, 16 bp, H. sapiens
attttaaaagcatata

SEQ ID NO: 57217 - DNA, 16 bp, H. sapiens
attttaaaagccaaaa

SEQ ID NO: 57218 - DNA, 16 bp, H. sapiens
attttaaaagctataa

SEQ ID NO: 57219 - DNA, 16 bp, H. sapiens
attttaaaagctgttt

SEQ ID NO: 57220 - DNA, 16 bp, H. sapiens
attttaaaaggatata

SEQ ID NO: 57221 - DNA, 16 bp, H. sapiens
attttaaaaggatgaa

SEQ ID NO: 57222 - DNA, 16 bp, H. sapiens
attttaaaaggggaaa

SEQ ID NO: 57223 - DNA, 16 bp, H. sapiens
attttaaaaggttaaa

SEQ ID NO: 57224 - DNA, 16 bp, H. sapiens
attttaaaagtagttt

SEQ ID NO: 57225 - DNA, 16 bp, H. sapiens
attttaaaagttatgt

SEQ ID NO: 57226 - DNA, 16 bp, H. sapiens
attttaaaagtttaca

SEQ ID NO: 57227 - DNA, 16 bp, H. sapiens
attttaaaataaagca

SEQ ID NO: 57228 - DNA, 16 bp, H. sapiens
attttaaaatatcagt

SEQ ID NO: 57229 - DNA, 16 bp, H. sapiens
attttaaaatatcctt

SEQ ID NO: 57230 - DNA, 16 bp, H. sapiens
attttaaaatatctag

SEQ ID NO: 57231 - DNA, 16 bp, H. sapiens
attttaaaatatgcaa

SEQ ID NO: 57232 - DNA, 16 bp, H. sapiens
attttaaaatctacaa

SEQ ID NO: 57233 - DNA, 16 bp, H. sapiens
attttaaaatctacct

SEQ ID NO: 57234 - DNA, 16 bp, H. sapiens
attttaaaatgcatat

SEQ ID NO: 57235 - DNA, 16 bp, H. sapiens
attttaaaatgctttt

SEQ ID NO: 57236 - DNA, 16 bp, H. sapiens
attttaaaatggaata

SEQ ID NO: 57237 - DNA, 16 bp, H. sapiens
attttaaaatgtagaa

SEQ ID NO: 57238 - DNA, 16 bp, H. sapiens
attttaaaatgttcat

SEQ ID NO: 57239 - DNA, 16 bp, H. sapiens
attttaaaattcagaa

SEQ ID NO: 57240 - DNA, 16 bp, H. sapiens
attttaaaattcatgt

SEQ ID NO: 57241 - DNA, 16 bp, H. sapiens
attttaaaattctgta

SEQ ID NO: 57242 - DNA, 16 bp, H. sapiens
attttaaaattctgtg

SEQ ID NO: 57243 - DNA, 16 bp, H. sapiens
attttaaaattgaaca

SEQ ID NO: 57244 - DNA, 16 bp, H. sapiens
attttaaaattggatt

SEQ ID NO: 57245 - DNA, 16 bp, H. sapiens
attttaaaattgtctt

SEQ ID NO: 57246 - DNA, 16 bp, H. sapiens
attttaaaatttccaa

SEQ ID NO: 57247 - DNA, 16 bp, H. sapiens
attttaaaattttgct

SEQ ID NO: 57248 - DNA, 16 bp, H. sapiens
attttaaacaaattgt

SEQ ID NO: 57249 - DNA, 16 bp, H. sapiens
attttaaacaattgtt

SEQ ID NO: 57250 - DNA, 16 bp, H. sapiens
attttaaacagcattt

SEQ ID NO: 57251 - DNA, 16 bp, H. sapiens
attttaaacataaaga

SEQ ID NO: 57252 - DNA, 16 bp, H. sapiens
attttaaacatggaaa

SEQ ID NO: 57253 - DNA, 16 bp, H. sapiens
attttaaacattctta

SEQ ID NO: 57254 - DNA, 16 bp, H. sapiens
attttaaacccactgt

SEQ ID NO: 57255 - DNA, 16 bp, H. sapiens
attttaaagaaaaaca

SEQ ID NO: 57256 - DNA, 16 bp, H. sapiens
attttaaagaaattga

SEQ ID NO: 57257 - DNA, 16 bp, H. sapiens
attttaaagaactcaa

SEQ ID NO: 57258 - DNA, 16 bp, H. sapiens
attttaaagaacttaa

SEQ ID NO: 57259 - DNA, 16 bp, H. sapiens
attttaaagaataaca

SEQ ID NO: 57260 - DNA, 16 bp, H. sapiens
attttaaagacaaaca

SEQ ID NO: 57261 - DNA, 16 bp, H. sapiens
attttaaagagacagt

SEQ ID NO: 57262 - DNA, 16 bp, H. sapiens
attttaaagataatgt

SEQ ID NO: 57263 - DNA, 16 bp, H. sapiens
attttaaagatctatt

SEQ ID NO: 57264 - DNA, 16 bp, H. sapiens
attttaaagatgaaca

SEQ ID NO: 57265 - DNA, 16 bp, H. sapiens
attttaaagatgtgga

SEQ ID NO: 57266 - DNA, 16 bp, H. sapiens
attttaaagcaaaaat

SEQ ID NO: 57267 - DNA, 16 bp, H. sapiens
attttaaagcacaaaa

SEQ ID NO: 57268 - DNA, 16 bp, H. sapiens
attttaaagcagccat

SEQ ID NO: 57269 - DNA, 16 bp, H. sapiens
attttaaagcatttta

SEQ ID NO: 57270 - DNA, 16 bp, H. sapiens
attttaaagctgggca

SEQ ID NO: 57271 - DNA, 16 bp, H. sapiens
attttaaagtaaacat

SEQ ID NO: 57272 - DNA, 16 bp, H. sapiens
attttaaagtacacaa

SEQ ID NO: 57273 - DNA, 16 bp, H. sapiens
attttaaagtactttt

SEQ ID NO: 57274 - DNA, 16 bp, H. sapiens
attttaaagtctttgt

SEQ ID NO: 57275 - DNA, 16 bp, H. sapiens
attttaaagtgctttt

SEQ ID NO: 57276 - DNA, 16 bp, H. sapiens
attttaaagttgaaaa

SEQ ID NO: 57277 - DNA, 16 bp, H. sapiens
attttaaagttggaaa

SEQ ID NO: 57278 - DNA, 16 bp, H. sapiens
attttaaataaagaca

SEQ ID NO: 57279 - DNA, 16 bp, H. sapiens
attttaaatactgttt

SEQ ID NO: 57280 - DNA, 16 bp, H. sapiens
attttaaatatcagaa

SEQ ID NO: 57281 - DNA, 16 bp, H. sapiens
attttaaatatgaaga

SEQ ID NO: 57282 - DNA, 16 bp, H. sapiens
attttaaatatgttct

SEQ ID NO: 57283 - DNA, 16 bp, H. sapiens
attttaaatcccattt

SEQ ID NO: 57284 - DNA, 16 bp, H. sapiens
attttaaatgaaaaca

SEQ ID NO: 57285 - DNA, 16 bp, H. sapiens
attttaaatgaaatga

SEQ ID NO: 57286 - DNA, 16 bp, H. sapiens
attttaaatgcatttt

SEQ ID NO: 57287 - DNA, 16 bp, H. sapiens
attttaaatgctttct

SEQ ID NO: 57288 - DNA, 16 bp, H. sapiens
attttaaatgcttttt

SEQ ID NO: 57289 - DNA, 16 bp, H. sapiens
attttaaatggaaaat

SEQ ID NO: 57290 - DNA, 16 bp, H. sapiens
attttaaatggtatta

SEQ ID NO: 57291 - DNA, 16 bp, H. sapiens
attttaaatgtaactt

SEQ ID NO: 57292 - DNA, 16 bp, H. sapiens
attttaaatgtgtaca

SEQ ID NO: 57293 - DNA, 16 bp, H. sapiens
attttaaatgttcaca

SEQ ID NO: 57294 - DNA, 16 bp, H. sapiens
attttaaatgttctca

SEQ ID NO: 57295 - DNA, 16 bp, H. sapiens
attttaaatgttcttt

SEQ ID NO: 57296 - DNA, 16 bp, H. sapiens
attttaaattcacaat

SEQ ID NO: 57297 - DNA, 16 bp, H. sapiens
attttaaattctggga

SEQ ID NO: 57298 - DNA, 16 bp, H. sapiens
attttaaattctgttt

SEQ ID NO: 57299 - DNA, 16 bp, H. sapiens
attttaaattcttgtt

SEQ ID NO: 57300 - DNA, 16 bp, H. sapiens
attttaaatttactga

SEQ ID NO: 57301 - DNA, 16 bp, H. sapiens
attttaacaaatgtac

SEQ ID NO: 57302 - DNA, 16 bp, H. sapiens
attttaacaagccctc

SEQ ID NO: 57303 - DNA, 16 bp, H. sapiens
attttaacaatgttaa

SEQ ID NO: 57304 - DNA, 16 bp, H. sapiens
attttaacaccaaaaa

SEQ ID NO: 57305 - DNA, 16 bp, H. sapiens
attttaactgaagaaa

SEQ ID NO: 57306 - DNA, 16 bp, H. sapiens
attttaactgcttcag

SEQ ID NO: 57307 - DNA, 16 bp, H. sapiens
attttaactggagtaa

SEQ ID NO: 57308 - DNA, 16 bp, H. sapiens
attttaactggggtga

SEQ ID NO: 57309 - DNA, 16 bp, H. sapiens
attttaactttaatgt

SEQ ID NO: 57310 - DNA, 16 bp, H. sapiens
attttaactttggaaa

SEQ ID NO: 57311 - DNA, 16 bp, H. sapiens
attttaacttttttga

SEQ ID NO: 57312 - DNA, 16 bp, H. sapiens
attttaagaaaaacaa

SEQ ID NO: 57313 - DNA, 16 bp, H. sapiens
attttaagaaaaagag

SEQ ID NO: 57314 - DNA, 16 bp, H. sapiens
attttaagaaaagcaa

SEQ ID NO: 57315 - DNA, 16 bp, H. sapiens
attttaagaaagtttt

SEQ ID NO: 57316 - DNA, 16 bp, H. sapiens
attttaagaaatgttt

SEQ ID NO: 57317 - DNA, 16 bp, H. sapiens
attttaagaagagatg

SEQ ID NO: 57318 - DNA, 16 bp, H. sapiens
attttaagaagcaaaa

SEQ ID NO: 57319 - DNA, 16 bp, H. sapiens
attttaagaaggaaaa

SEQ ID NO: 57320 - DNA, 16 bp, H. sapiens
attttaagacattttt

SEQ ID NO: 57321 - DNA, 16 bp, H. sapiens
attttaagacttatta

SEQ ID NO: 57322 - DNA, 16 bp, H. sapiens
attttaagatgaattt

SEQ ID NO: 57323 - DNA, 16 bp, H. sapiens
attttaagatgaggaa

SEQ ID NO: 57324 - DNA, 16 bp, H. sapiens
attttaagatggagtc

SEQ ID NO: 57325 - DNA, 16 bp, H. sapiens
attttaagattttctt

SEQ ID NO: 57326 - DNA, 16 bp, H. sapiens
attttaaggaatttta

SEQ ID NO: 57327 - DNA, 16 bp, H. sapiens
attttaaggattttct

SEQ ID NO: 57328 - DNA, 16 bp, H. sapiens
attttaagtacatttt

SEQ ID NO: 57329 - DNA, 16 bp, H. sapiens
attttaagtcttaaaa

SEQ ID NO: 57330 - DNA, 16 bp, H. sapiens
attttaagtggatttt

SEQ ID NO: 57331 - DNA, 16 bp, H. sapiens
attttaagtttctaaa

SEQ ID NO: 57332 - DNA, 16 bp, H. sapiens
attttaagtttgaaaa

SEQ ID NO: 57333 - DNA, 16 bp, H. sapiens
attttaataaacagaa

SEQ ID NO: 57334 - DNA, 16 bp, H. sapiens
attttaatagagattg

SEQ ID NO: 57335 - DNA, 16 bp, H. sapiens
attttaatagtgatat

SEQ ID NO: 57336 - DNA, 16 bp, H. sapiens
attttaatataccaaa

SEQ ID NO: 57337 - DNA, 16 bp, H. sapiens
attttaatatgctttt

SEQ ID NO: 57338 - DNA, 16 bp, H. sapiens
attttaatatttctga

SEQ ID NO: 57339 - DNA, 16 bp, H. sapiens
attttaatctctgtta

SEQ ID NO: 57340 - DNA, 16 bp, H. sapiens
attttaatctctttga

SEQ ID NO: 57341 - DNA, 16 bp, H. sapiens
attttaatgaaaatca

SEQ ID NO: 57342 - DNA, 16 bp, H. sapiens
attttaatgaaaatct

SEQ ID NO: 57343 - DNA, 16 bp, H. sapiens
attttaatgaaacttt

SEQ ID NO: 57344 - DNA, 16 bp, H. sapiens
attttaatgaggaaaa

SEQ ID NO: 57345 - DNA, 16 bp, H. sapiens
attttaatgataatga

SEQ ID NO: 57346 - DNA, 16 bp, H. sapiens
attttaatgatttttc

SEQ ID NO: 57347 - DNA, 16 bp, H. sapiens
attttaatgcaaaata

SEQ ID NO: 57348 - DNA, 16 bp, H. sapiens
attttaatgcacattt

SEQ ID NO: 57349 - DNA, 16 bp, H. sapiens
attttaatgctatttt

SEQ ID NO: 57350 - DNA, 16 bp, H. sapiens
attttaatggaaaata

SEQ ID NO: 57351 - DNA, 16 bp, H. sapiens
attttaatggaattta

SEQ ID NO: 57352 - DNA, 16 bp, H. sapiens
attttaatgggaaaat

SEQ ID NO: 57353 - DNA, 16 bp, H. sapiens
attttaatgtaagaaa

SEQ ID NO: 57354 - DNA, 16 bp, H. sapiens
attttaatgtacatat

SEQ ID NO: 57355 - DNA, 16 bp, H. sapiens
attttaatgtctttat

SEQ ID NO: 57356 - DNA, 16 bp, H. sapiens
attttaatgtctttct

SEQ ID NO: 57357 - DNA, 16 bp, H. sapiens
attttaatgtgtacaa

SEQ ID NO: 57358 - DNA, 16 bp, H. sapiens
attttaatgttatttc

SEQ ID NO: 57359 - DNA, 16 bp, H. sapiens
attttaatgttttcat

SEQ ID NO: 57360 - DNA, 16 bp, H. sapiens
attttaattcaaaaga

SEQ ID NO: 57361 - DNA, 16 bp, H. sapiens
attttaattctcaaaa

SEQ ID NO: 57362 - DNA, 16 bp, H. sapiens
attttaattgaaaaca

SEQ ID NO: 57363 - DNA, 16 bp, H. sapiens
attttaattgaagaaa

SEQ ID NO: 57364 - DNA, 16 bp, H. sapiens
attttaattgcaaaaa

SEQ ID NO: 57365 - DNA, 16 bp, H. sapiens
attttaattgtgaaat

SEQ ID NO: 57366 - DNA, 16 bp, H. sapiens
attttaattgtttcat

SEQ ID NO: 57367 - DNA, 16 bp, H. sapiens
attttaatttctgatt

SEQ ID NO: 57368 - DNA, 16 bp, H. sapiens
attttaattttagaga

SEQ ID NO: 57369 - DNA, 16 bp, H. sapiens
attttaattttgcatt

SEQ ID NO: 57370 - DNA, 16 bp, H. sapiens
attttaattttgctat

SEQ ID NO: 57371 - DNA, 16 bp, H. sapiens
attttacaaaagagga

SEQ ID NO: 57372 - DNA, 16 bp, H. sapiens
attttacaaagaaaaa

SEQ ID NO: 57373 - DNA, 16 bp, H. sapiens
attttacaaagatttt

SEQ ID NO: 57374 - DNA, 16 bp, H. sapiens
attttacaaataatga

SEQ ID NO: 57375 - DNA, 16 bp, H. sapiens
attttacaaataggaa

SEQ ID NO: 57376 - DNA, 16 bp, H. sapiens
attttacaaatgagca

SEQ ID NO: 57377 - DNA, 16 bp, H. sapiens
attttacaaatgtaaa

SEQ ID NO: 57378 - DNA, 16 bp, H. sapiens
attttacaagaaaaat

SEQ ID NO: 57379 - DNA, 16 bp, H. sapiens
attttacaagaaaatg

SEQ ID NO: 57380 - DNA, 16 bp, H. sapiens
attttacaagtgagaa

SEQ ID NO: 57381 - DNA, 16 bp, H. sapiens
attttacaataagaaa

SEQ ID NO: 57382 - DNA, 16 bp, H. sapiens
attttacagaaaataa

SEQ ID NO: 57383 - DNA, 16 bp, H. sapiens
attttacagaagaaaa

SEQ ID NO: 57384 - DNA, 16 bp, H. sapiens
attttacagaattaaa

SEQ ID NO: 57385 - DNA, 16 bp, H. sapiens
attttacagagtactg

SEQ ID NO: 57386 - DNA, 16 bp, H. sapiens
attttacagagtttaa

SEQ ID NO: 57387 - DNA, 16 bp, H. sapiens
attttacagatataga

SEQ ID NO: 57388 - DNA, 16 bp, H. sapiens
attttacagatgaaaa

SEQ ID NO: 57389 - DNA, 16 bp, H. sapiens
attttacagatgaagg

SEQ ID NO: 57390 - DNA, 16 bp, H. sapiens
attttacagatttaaa

SEQ ID NO: 57391 - DNA, 16 bp, H. sapiens
attttacaggcgagga

SEQ ID NO: 57392 - DNA, 16 bp, H. sapiens
attttacaggcttgta

SEQ ID NO: 57393 - DNA, 16 bp, H. sapiens
attttacagggaaaaa

SEQ ID NO: 57394 - DNA, 16 bp, H. sapiens
attttacaggtgaggg

SEQ ID NO: 57395 - DNA, 16 bp, H. sapiens
attttacatatgaaaa

SEQ ID NO: 57396 - DNA, 16 bp, H. sapiens
attttacatgaaaatt

SEQ ID NO: 57397 - DNA, 16 bp, H. sapiens
attttacatgcatttt

SEQ ID NO: 57398 - DNA, 16 bp, H. sapiens
attttacatgtaaata

SEQ ID NO: 57399 - DNA, 16 bp, H. sapiens
attttacatgtatttt

SEQ ID NO: 57400 - DNA, 16 bp, H. sapiens
attttacattcccatt

SEQ ID NO: 57401 - DNA, 16 bp, H. sapiens
attttacattgtattt

SEQ ID NO: 57402 - DNA, 16 bp, H. sapiens
attttacatttatctg

SEQ ID NO: 57403 - DNA, 16 bp, H. sapiens
attttacatttctacc

SEQ ID NO: 57404 - DNA, 16 bp, H. sapiens
attttaccaaacattt

SEQ ID NO: 57405 - DNA, 16 bp, H. sapiens
attttaccaacaattt

SEQ ID NO: 57406 - DNA, 16 bp, H. sapiens
attttaccaagacttt

SEQ ID NO: 57407 - DNA, 16 bp, H. sapiens
attttaccaaggtttt

SEQ ID NO: 57408 - DNA, 16 bp, H. sapiens
attttaccaatattaa

SEQ ID NO: 57409 - DNA, 16 bp, H. sapiens
attttaccactttaaa

SEQ ID NO: 57410 - DNA, 16 bp, H. sapiens
attttaccattttaaa

SEQ ID NO: 57411 - DNA, 16 bp, H. sapiens
attttacccagttcct

SEQ ID NO: 57412 - DNA, 16 bp, H. sapiens
attttacccattttaa

SEQ ID NO: 57413 - DNA, 16 bp, H. sapiens
attttaccttcattat

SEQ ID NO: 57414 - DNA, 16 bp, H. sapiens
attttacctttaaaaa

SEQ ID NO: 57415 - DNA, 16 bp, H. sapiens
attttaccttttaaaa

SEQ ID NO: 57416 - DNA, 16 bp, H. sapiens
attttactaaagaaga

SEQ ID NO: 57417 - DNA, 16 bp, H. sapiens
attttactaatgagaa

SEQ ID NO: 57418 - DNA, 16 bp, H. sapiens
attttactacataaaa

SEQ ID NO: 57419 - DNA, 16 bp, H. sapiens
attttactatatgtaa

SEQ ID NO: 57420 - DNA, 16 bp, H. sapiens
attttactccagcctg

SEQ ID NO: 57421 - DNA, 16 bp, H. sapiens
attttactctttaaaa

SEQ ID NO: 57422 - DNA, 16 bp, H. sapiens
attttactgaaaaaaa

SEQ ID NO: 57423 - DNA, 16 bp, H. sapiens
attttactgaaataaa

SEQ ID NO: 57424 - DNA, 16 bp, H. sapiens
attttactgaattaat

SEQ ID NO: 57425 - DNA, 16 bp, H. sapiens
attttactgatataaa

SEQ ID NO: 57426 - DNA, 16 bp, H. sapiens
attttactgtatttaa

SEQ ID NO: 57427 - DNA, 16 bp, H. sapiens
attttactgtttaaaa

SEQ ID NO: 57428 - DNA, 16 bp, H. sapiens
attttacttaggataa

SEQ ID NO: 57429 - DNA, 16 bp, H. sapiens
attttacttatttgct

SEQ ID NO: 57430 - DNA, 16 bp, H. sapiens
attttactttgtaatt

SEQ ID NO: 57431 - DNA, 16 bp, H. sapiens
attttacttttagaaa

SEQ ID NO: 57432 - DNA, 16 bp, H. sapiens
attttacttttgaaat

SEQ ID NO: 57433 - DNA, 16 bp, H. sapiens
attttacttttgtaaa

SEQ ID NO: 57434 - DNA, 16 bp, H. sapiens
attttagaaaaacaaa

SEQ ID NO: 57435 - DNA, 16 bp, H. sapiens
attttagaaaaacatt

SEQ ID NO: 57436 - DNA, 16 bp, H. sapiens
attttagaaaaatcac

SEQ ID NO: 57437 - DNA, 16 bp, H. sapiens
attttagaaaagcttt

SEQ ID NO: 57438 - DNA, 16 bp, H. sapiens
attttagaaaatactg

SEQ ID NO: 57439 - DNA, 16 bp, H. sapiens
attttagaaaatcaaa

SEQ ID NO: 57440 - DNA, 16 bp, H. sapiens
attttagaaagagaaa

SEQ ID NO: 57441 - DNA, 16 bp, H. sapiens
attttagaaagtttat

SEQ ID NO: 57442 - DNA, 16 bp, H. sapiens
attttagaaataagat

SEQ ID NO: 57443 - DNA, 16 bp, H. sapiens
attttagaaatacatt

SEQ ID NO: 57444 - DNA, 16 bp, H. sapiens
attttagaaattcttt

SEQ ID NO: 57445 - DNA, 16 bp, H. sapiens
attttagaacaatttt

SEQ ID NO: 57446 - DNA, 16 bp, H. sapiens
attttagaataaaatg

SEQ ID NO: 57447 - DNA, 16 bp, H. sapiens
attttagaataagtat

SEQ ID NO: 57448 - DNA, 16 bp, H. sapiens
attttagaatcagaaa

SEQ ID NO: 57449 - DNA, 16 bp, H. sapiens
attttagaattgaaaa

SEQ ID NO: 57450 - DNA, 16 bp, H. sapiens
attttagaatttgaat

SEQ ID NO: 57451 - DNA, 16 bp, H. sapiens
attttagaattttcta

SEQ ID NO: 57452 - DNA, 16 bp, H. sapiens
attttagacatatttt

SEQ ID NO: 57453 - DNA, 16 bp, H. sapiens
attttagacttgccag

SEQ ID NO: 57454 - DNA, 16 bp, H. sapiens
attttagagaaaacaa

SEQ ID NO: 57455 - DNA, 16 bp, H. sapiens
attttagagaaaagaa

SEQ ID NO: 57456 - DNA, 16 bp, H. sapiens
attttagagaaaagat

SEQ ID NO: 57457 - DNA, 16 bp, H. sapiens
attttagagatgagaa

SEQ ID NO: 57458 - DNA, 16 bp, H. sapiens
attttagagctggaag

SEQ ID NO: 57459 - DNA, 16 bp, H. sapiens
attttagcaaatgctt

SEQ ID NO: 57460 - DNA, 16 bp, H. sapiens
attttagcaattttaa

SEQ ID NO: 57461 - DNA, 16 bp, H. sapiens
attttagcactgaata

SEQ ID NO: 57462 - DNA, 16 bp, H. sapiens
attttagccattctaa

SEQ ID NO: 57463 - DNA, 16 bp, H. sapiens
attttagccattctag

SEQ ID NO: 57464 - DNA, 16 bp, H. sapiens
attttagcctaatttg

SEQ ID NO: 57465 - DNA, 16 bp, H. sapiens
attttaggatattttc

SEQ ID NO: 57466 - DNA, 16 bp, H. sapiens
attttaggatttcttt

SEQ ID NO: 57467 - DNA, 16 bp, H. sapiens
attttagggaaaaaaa

SEQ ID NO: 57468 - DNA, 16 bp, H. sapiens
attttagtagaaacgg

SEQ ID NO: 57469 - DNA, 16 bp, H. sapiens
attttagtagaattca

SEQ ID NO: 57470 - DNA, 16 bp, H. sapiens
attttagtagagatgg

SEQ ID NO: 57471 - DNA, 16 bp, H. sapiens
attttagtcaaaaaat

SEQ ID NO: 57472 - DNA, 16 bp, H. sapiens
attttagtgaactaaa

SEQ ID NO: 57473 - DNA, 16 bp, H. sapiens
attttagtgctataaa

SEQ ID NO: 57474 - DNA, 16 bp, H. sapiens
attttagttatgtctt

SEQ ID NO: 57475 - DNA, 16 bp, H. sapiens
attttagttcactaaa

SEQ ID NO: 57476 - DNA, 16 bp, H. sapiens
attttagttttctcat

SEQ ID NO: 57477 - DNA, 16 bp, H. sapiens
attttataaaaggaga

SEQ ID NO: 57478 - DNA, 16 bp, H. sapiens
attttataaaatacct

SEQ ID NO: 57479 - DNA, 16 bp, H. sapiens
attttataaacaaaga

SEQ ID NO: 57480 - DNA, 16 bp, H. sapiens
attttataaacactgt

SEQ ID NO: 57481 - DNA, 16 bp, H. sapiens
attttataaagatgaa

SEQ ID NO: 57482 - DNA, 16 bp, H. sapiens
attttataaatgtctt

SEQ ID NO: 57483 - DNA, 16 bp, H. sapiens
attttataatgatgaa

SEQ ID NO: 57484 - DNA, 16 bp, H. sapiens
attttataattgagaa

SEQ ID NO: 57485 - DNA, 16 bp, H. sapiens
attttatacaaatgta

SEQ ID NO: 57486 - DNA, 16 bp, H. sapiens
attttatacaattttg

SEQ ID NO: 57487 - DNA, 16 bp, H. sapiens
attttatacataaaga

SEQ ID NO: 57488 - DNA, 16 bp, H. sapiens
attttatacatacaca

SEQ ID NO: 57489 - DNA, 16 bp, H. sapiens
attttatacttgaaaa

SEQ ID NO: 57490 - DNA, 16 bp, H. sapiens
attttatagacattta

SEQ ID NO: 57491 - DNA, 16 bp, H. sapiens
attttatagagaagaa

SEQ ID NO: 57492 - DNA, 16 bp, H. sapiens
attttatagataaaga

SEQ ID NO: 57493 - DNA, 16 bp, H. sapiens
attttatagcatttat

SEQ ID NO: 57494 - DNA, 16 bp, H. sapiens
attttatagctggaga

SEQ ID NO: 57495 - DNA, 16 bp, H. sapiens
attttatagttttggg

SEQ ID NO: 57496 - DNA, 16 bp, H. sapiens
attttatatacatgta

SEQ ID NO: 57497 - DNA, 16 bp, H. sapiens
attttatatagcattt

SEQ ID NO: 57498 - DNA, 16 bp, H. sapiens
attttatatccagaaa

SEQ ID NO: 57499 - DNA, 16 bp, H. sapiens
attttatatgaagata

SEQ ID NO: 57500 - DNA, 16 bp, H. sapiens
attttatatgattcca

SEQ ID NO: 57501 - DNA, 16 bp, H. sapiens
attttatatgcatata

SEQ ID NO: 57502 - DNA, 16 bp, H. sapiens
attttatatgtagaaa

SEQ ID NO: 57503 - DNA, 16 bp, H. sapiens
attttatatgtgaaga

SEQ ID NO: 57504 - DNA, 16 bp, H. sapiens
attttatattaatgga

SEQ ID NO: 57505 - DNA, 16 bp, H. sapiens
attttatattctgaaa

SEQ ID NO: 57506 - DNA, 16 bp, H. sapiens
attttatattctgtgt

SEQ ID NO: 57507 - DNA, 16 bp, H. sapiens
attttatatttatgca

SEQ ID NO: 57508 - DNA, 16 bp, H. sapiens
attttatatttcagat

SEQ ID NO: 57509 - DNA, 16 bp, H. sapiens
attttatatttgacaa

SEQ ID NO: 57510 - DNA, 16 bp, H. sapiens
attttatatttgagtg

SEQ ID NO: 57511 - DNA, 16 bp, H. sapiens
attttatcaaaatgaa

SEQ ID NO: 57512 - DNA, 16 bp, H. sapiens
attttatcaaatgtgt

SEQ ID NO: 57513 - DNA, 16 bp, H. sapiens
attttatcaatgagga

SEQ ID NO: 57514 - DNA, 16 bp, H. sapiens
attttatcacattttc

SEQ ID NO: 57515 - DNA, 16 bp, H. sapiens
attttatcacccaggc

SEQ ID NO: 57516 - DNA, 16 bp, H. sapiens
attttatcagaaataa

SEQ ID NO: 57517 - DNA, 16 bp, H. sapiens
attttatcagatgttt

SEQ ID NO: 57518 - DNA, 16 bp, H. sapiens
attttatcagcaaggt

SEQ ID NO: 57519 - DNA, 16 bp, H. sapiens
attttatcagcatttt

SEQ ID NO: 57520 - DNA, 16 bp, H. sapiens
attttatcaggaaaaa

SEQ ID NO: 57521 - DNA, 16 bp, H. sapiens
attttatcattatgta

SEQ ID NO: 57522 - DNA, 16 bp, H. sapiens
attttatcatttgtaa

SEQ ID NO: 57523 - DNA, 16 bp, H. sapiens
attttatcctctttga

SEQ ID NO: 57524 - DNA, 16 bp, H. sapiens
attttatctgatattt

SEQ ID NO: 57525 - DNA, 16 bp, H. sapiens
attttatcttcaaaaa

SEQ ID NO: 57526 - DNA, 16 bp, H. sapiens
attttatcttctagaa

SEQ ID NO: 57527 - DNA, 16 bp, H. sapiens
attttatcttgaaaaa

SEQ ID NO: 57528 - DNA, 16 bp, H. sapiens
attttatcttgtcatt

SEQ ID NO: 57529 - DNA, 16 bp, H. sapiens
attttatcttttgaaa

SEQ ID NO: 57530 - DNA, 16 bp, H. sapiens
attttatgaaaaaatg

SEQ ID NO: 57531 - DNA, 16 bp, H. sapiens
attttatgaaaatgga

SEQ ID NO: 57532 - DNA, 16 bp, H. sapiens
attttatgaagataat

SEQ ID NO: 57533 - DNA, 16 bp, H. sapiens
attttatgacaagaat

SEQ ID NO: 57534 - DNA, 16 bp, H. sapiens
attttatgactttatt

SEQ ID NO: 57535 - DNA, 16 bp, H. sapiens
attttatgattcattt

SEQ ID NO: 57536 - DNA, 16 bp, H. sapiens
attttatgcaaatata

SEQ ID NO: 57537 - DNA, 16 bp, H. sapiens
attttatgcaatattt

SEQ ID NO: 57538 - DNA, 16 bp, H. sapiens
attttatgcatgtatc

SEQ ID NO: 57539 - DNA, 16 bp, H. sapiens
attttatgcatttata

SEQ ID NO: 57540 - DNA, 16 bp, H. sapiens
attttatgctaaaaat

SEQ ID NO: 57541 - DNA, 16 bp, H. sapiens
attttatgcttaaaaa

SEQ ID NO: 57542 - DNA, 16 bp, H. sapiens
attttatggaaaataa

SEQ ID NO: 57543 - DNA, 16 bp, H. sapiens
attttatggaagagaa

SEQ ID NO: 57544 - DNA, 16 bp, H. sapiens
attttatggacaagaa

SEQ ID NO: 57545 - DNA, 16 bp, H. sapiens
attttatggaggaaga

SEQ ID NO: 57546 - DNA, 16 bp, H. sapiens
attttatggatgaaga

SEQ ID NO: 57547 - DNA, 16 bp, H. sapiens
attttatggatgagga

SEQ ID NO: 57548 - DNA, 16 bp, H. sapiens
attttatggttaaaaa

SEQ ID NO: 57549 - DNA, 16 bp, H. sapiens
attttatgtaagcatt

SEQ ID NO: 57550 - DNA, 16 bp, H. sapiens
attttatgtaatgtaa

SEQ ID NO: 57551 - DNA, 16 bp, H. sapiens
attttatgtaattttc

SEQ ID NO: 57552 - DNA, 16 bp, H. sapiens
attttatgtatcacta

SEQ ID NO: 57553 - DNA, 16 bp, H. sapiens
attttatgtcatgtat

SEQ ID NO: 57554 - DNA, 16 bp, H. sapiens
attttatgtctacttt

SEQ ID NO: 57555 - DNA, 16 bp, H. sapiens
attttatgtgtcaaat

SEQ ID NO: 57556 - DNA, 16 bp, H. sapiens
attttatgtgtgaaaa

SEQ ID NO: 57557 - DNA, 16 bp, H. sapiens
attttatgtgtgtgta

SEQ ID NO: 57558 - DNA, 16 bp, H. sapiens
attttatgttatgtgg

SEQ ID NO: 57559 - DNA, 16 bp, H. sapiens
attttatgtttttcaa

SEQ ID NO: 57560 - DNA, 16 bp, H. sapiens
attttattaaaaagca

SEQ ID NO: 57561 - DNA, 16 bp, H. sapiens
attttattaaaatgca

SEQ ID NO: 57562 - DNA, 16 bp, H. sapiens
attttattaaatgcat

SEQ ID NO: 57563 - DNA, 16 bp, H. sapiens
attttattaagagaaa

SEQ ID NO: 57564 - DNA, 16 bp, H. sapiens
attttattacagaaat

SEQ ID NO: 57565 - DNA, 16 bp, H. sapiens
attttattatggcagc

SEQ ID NO: 57566 - DNA, 16 bp, H. sapiens
attttattcacatgaa

SEQ ID NO: 57567 - DNA, 16 bp, H. sapiens
attttattcacatttc

SEQ ID NO: 57568 - DNA, 16 bp, H. sapiens
attttattcatctctg

SEQ ID NO: 57569 - DNA, 16 bp, H. sapiens
attttattcattagaa

SEQ ID NO: 57570 - DNA, 16 bp, H. sapiens
attttattcatttgga

SEQ ID NO: 57571 - DNA, 16 bp, H. sapiens
attttattcccaaata

SEQ ID NO: 57572 - DNA, 16 bp, H. sapiens
attttattccctttga

SEQ ID NO: 57573 - DNA, 16 bp, H. sapiens
attttattcttagaaa

SEQ ID NO: 57574 - DNA, 16 bp, H. sapiens
attttattgaaacata

SEQ ID NO: 57575 - DNA, 16 bp, H. sapiens
attttattgaaagact

SEQ ID NO: 57576 - DNA, 16 bp, H. sapiens
attttattgagtgatg

SEQ ID NO: 57577 - DNA, 16 bp, H. sapiens
attttattgcatatta

SEQ ID NO: 57578 - DNA, 16 bp, H. sapiens
attttattggcatttt

SEQ ID NO: 57579 - DNA, 16 bp, H. sapiens
attttattgtgaaaaa

SEQ ID NO: 57580 - DNA, 16 bp, H. sapiens
attttattgtgtttca

SEQ ID NO: 57581 - DNA, 16 bp, H. sapiens
attttattgtttacat

SEQ ID NO: 57582 - DNA, 16 bp, H. sapiens
attttatttaagaatg

SEQ ID NO: 57583 - DNA, 16 bp, H. sapiens
attttatttacaatag

SEQ ID NO: 57584 - DNA, 16 bp, H. sapiens
attttatttaccaaaa

SEQ ID NO: 57585 - DNA, 16 bp, H. sapiens
attttatttagcattt

SEQ ID NO: 57586 - DNA, 16 bp, H. sapiens
attttatttatagcta

SEQ ID NO: 57587 - DNA, 16 bp, H. sapiens
attttatttatgaaag

SEQ ID NO: 57588 - DNA, 16 bp, H. sapiens
attttatttcagaatt

SEQ ID NO: 57589 - DNA, 16 bp, H. sapiens
attttatttcagattt

SEQ ID NO: 57590 - DNA, 16 bp, H. sapiens
attttatttcctaaaa

SEQ ID NO: 57591 - DNA, 16 bp, H. sapiens
attttatttctgaatt

SEQ ID NO: 57592 - DNA, 16 bp, H. sapiens
attttatttgaacaaa

SEQ ID NO: 57593 - DNA, 16 bp, H. sapiens
attttatttgcaaaat

SEQ ID NO: 57594 - DNA, 16 bp, H. sapiens
attttatttggagaaa

SEQ ID NO: 57595 - DNA, 16 bp, H. sapiens
attttatttggcattt

SEQ ID NO: 57596 - DNA, 16 bp, H. sapiens
attttatttgtagcta

SEQ ID NO: 57597 - DNA, 16 bp, H. sapiens
attttattttaatcag

SEQ ID NO: 57598 - DNA, 16 bp, H. sapiens
attttattttactgaa

SEQ ID NO: 57599 - DNA, 16 bp, H. sapiens
attttattttcaagat

SEQ ID NO: 57600 - DNA, 16 bp, H. sapiens
attttattttcagaat

SEQ ID NO: 57601 - DNA, 16 bp, H. sapiens
attttattttgcatat

SEQ ID NO: 57602 - DNA, 16 bp, H. sapiens
attttattttgctaaa

SEQ ID NO: 57603 - DNA, 16 bp, H. sapiens
attttatttttaagca

SEQ ID NO: 57604 - DNA, 16 bp, H. sapiens
attttatttttacaga

SEQ ID NO: 57605 - DNA, 16 bp, H. sapiens
attttatttttcaaag

SEQ ID NO: 57606 - DNA, 16 bp, H. sapiens
attttatttttgaaac

SEQ ID NO: 57607 - DNA, 16 bp, H. sapiens
attttcaaaaacagtt

SEQ ID NO: 57608 - DNA, 16 bp, H. sapiens
attttcaaaaaccttt

SEQ ID NO: 57609 - DNA, 16 bp, H. sapiens
attttcaaaaagataa

SEQ ID NO: 57610 - DNA, 16 bp, H. sapiens
attttcaaaaatcatt

SEQ ID NO: 57611 - DNA, 16 bp, H. sapiens
attttcaaaaatgaaa

SEQ ID NO: 57612 - DNA, 16 bp, H. sapiens
attttcaaaaattctg

SEQ ID NO: 57613 - DNA, 16 bp, H. sapiens
attttcaaaaattgtt

SEQ ID NO: 57614 - DNA, 16 bp, H. sapiens
attttcaaaacatcat

SEQ ID NO: 57615 - DNA, 16 bp, H. sapiens
attttcaaaacattta

SEQ ID NO: 57616 - DNA, 16 bp, H. sapiens
attttcaaaactttct

SEQ ID NO: 57617 - DNA, 16 bp, H. sapiens
attttcaaaagaagat

SEQ ID NO: 57618 - DNA, 16 bp, H. sapiens
attttcaaaagataaa

SEQ ID NO: 57619 - DNA, 16 bp, H. sapiens
attttcaaaagtcaaa

SEQ ID NO: 57620 - DNA, 16 bp, H. sapiens
attttcaaaatattga

SEQ ID NO: 57621 - DNA, 16 bp, H. sapiens
attttcaaaatggaaa

SEQ ID NO: 57622 - DNA, 16 bp, H. sapiens
attttcaaaattgatt

SEQ ID NO: 57623 - DNA, 16 bp, H. sapiens
attttcaaacaaacaa

SEQ ID NO: 57624 - DNA, 16 bp, H. sapiens
attttcaaacattaaa

SEQ ID NO: 57625 - DNA, 16 bp, H. sapiens
attttcaaactgaaaa

SEQ ID NO: 57626 - DNA, 16 bp, H. sapiens
attttcaaagaaaaca

SEQ ID NO: 57627 - DNA, 16 bp, H. sapiens
attttcaaagaaaata

SEQ ID NO: 57628 - DNA, 16 bp, H. sapiens
attttcaaagaagttc

SEQ ID NO: 57629 - DNA, 16 bp, H. sapiens
attttcaaagttattt

SEQ ID NO: 57630 - DNA, 16 bp, H. sapiens
attttcaaataaaatg

SEQ ID NO: 57631 - DNA, 16 bp, H. sapiens
attttcaaataaccaa

SEQ ID NO: 57632 - DNA, 16 bp, H. sapiens
attttcaaataagttt

SEQ ID NO: 57633 - DNA, 16 bp, H. sapiens
attttcaaatatatga

SEQ ID NO: 57634 - DNA, 16 bp, H. sapiens
attttcaaatatatgt

SEQ ID NO: 57635 - DNA, 16 bp, H. sapiens
attttcaaatgatttt

SEQ ID NO: 57636 - DNA, 16 bp, H. sapiens
attttcaaatgcaaat

SEQ ID NO: 57637 - DNA, 16 bp, H. sapiens
attttcaaattgaatt

SEQ ID NO: 57638 - DNA, 16 bp, H. sapiens
attttcaacaagagtg

SEQ ID NO: 57639 - DNA, 16 bp, H. sapiens
attttcaacaatttta

SEQ ID NO: 57640 - DNA, 16 bp, H. sapiens
attttcaacacagaat

SEQ ID NO: 57641 - DNA, 20 bp, H. sapiens
attttcaacccagaatttcc

SEQ ID NO: 57642 - DNA, 16 bp, H. sapiens
attttcaagaaaaaaa

SEQ ID NO: 57643 - DNA, 16 bp, H. sapiens
attttcaagaaaaaat

SEQ ID NO: 57644 - DNA, 16 bp, H. sapiens
attttcaagaatacaa

SEQ ID NO: 57645 - DNA, 16 bp, H. sapiens
attttcaagacatttt

SEQ ID NO: 57646 - DNA, 16 bp, H. sapiens
attttcaagatttttt

SEQ ID NO: 57647 - DNA, 16 bp, H. sapiens
attttcaagctgctga

SEQ ID NO: 57648 - DNA, 16 bp, H. sapiens
attttcaataaaatgt

SEQ ID NO: 57649 - DNA, 16 bp, H. sapiens
attttcaataaagatg

SEQ ID NO: 57650 - DNA, 16 bp, H. sapiens
attttcaatgatattt

SEQ ID NO: 57651 - DNA, 16 bp, H. sapiens
attttcaatgtttatt

SEQ ID NO: 57652 - DNA, 16 bp, H. sapiens
attttcaatgttttta

SEQ ID NO: 57653 - DNA, 16 bp, H. sapiens
attttcacaaactgaa

SEQ ID NO: 57654 - DNA, 16 bp, H. sapiens
attttcacacaaaaac

SEQ ID NO: 57655 - DNA, 16 bp, H. sapiens
attttcacagtattga

SEQ ID NO: 57656 - DNA, 16 bp, H. sapiens
attttcacattaaaat

SEQ ID NO: 57657 - DNA, 16 bp, H. sapiens
attttcacattcattt

SEQ ID NO: 57658 - DNA, 16 bp, H. sapiens
attttcacatttaaat

SEQ ID NO: 57659 - DNA, 16 bp, H. sapiens
attttcacattttcaa

SEQ ID NO: 57660 - DNA, 16 bp, H. sapiens
attttcaccaaaaaaa

SEQ ID NO: 57661 - DNA, 16 bp, H. sapiens
attttcaccaacactt

SEQ ID NO: 57662 - DNA, 16 bp, H. sapiens
attttcactaaaatat

SEQ ID NO: 57663 - DNA, 16 bp, H. sapiens
attttcactcttgtca

SEQ ID NO: 57664 - DNA, 16 bp, H. sapiens
attttcactgaaaata

SEQ ID NO: 57665 - DNA, 16 bp, H. sapiens
attttcactggataca

SEQ ID NO: 57666 - DNA, 16 bp, H. sapiens
attttcactttaaaaa

SEQ ID NO: 57667 - DNA, 16 bp, H. sapiens
attttcagaaaaaaaa

SEQ ID NO: 57668 - DNA, 16 bp, H. sapiens
attttcagaaaaatgt

SEQ ID NO: 57669 - DNA, 16 bp, H. sapiens
attttcagaaaacaga

SEQ ID NO: 57670 - DNA, 16 bp, H. sapiens
attttcagaaagaaaa

SEQ ID NO: 57671 - DNA, 16 bp, H. sapiens
attttcagaaagcaaa

SEQ ID NO: 57672 - DNA, 16 bp, H. sapiens
attttcagaaattatt

SEQ ID NO: 57673 - DNA, 16 bp, H. sapiens
attttcagaaatttaa

SEQ ID NO: 57674 - DNA, 16 bp, H. sapiens
attttcagaagaaata

SEQ ID NO: 57675 - DNA, 16 bp, H. sapiens
attttcagaagaggaa

SEQ ID NO: 57676 - DNA, 16 bp, H. sapiens
attttcagaatggaaa

SEQ ID NO: 57677 - DNA, 16 bp, H. sapiens
attttcagaatggtaa

SEQ ID NO: 57678 - DNA, 16 bp, H. sapiens
attttcagacaaaaaa

SEQ ID NO: 57679 - DNA, 16 bp, H. sapiens
attttcagaccacagt

SEQ ID NO: 57680 - DNA, 16 bp, H. sapiens
attttcagaggaaaaa

SEQ ID NO: 57681 - DNA, 16 bp, H. sapiens
attttcagatatgttc

SEQ ID NO: 57682 - DNA, 16 bp, H. sapiens
attttcagatattttc

SEQ ID NO: 57683 - DNA, 16 bp, H. sapiens
attttcagatgaagaa

SEQ ID NO: 57684 - DNA, 16 bp, H. sapiens
attttcagatgaggaa

SEQ ID NO: 57685 - DNA, 16 bp, H. sapiens
attttcagatttggga

SEQ ID NO: 57686 - DNA, 16 bp, H. sapiens
attttcagattttgga

SEQ ID NO: 57687 - DNA, 16 bp, H. sapiens
attttcagcagagacg

SEQ ID NO: 57688 - DNA, 16 bp, H. sapiens
attttcagccaggtgc

SEQ ID NO: 57689 - DNA, 16 bp, H. sapiens
attttcagctattatt

SEQ ID NO: 57690 - DNA, 16 bp, H. sapiens
attttcagcttctctg

SEQ ID NO: 57691 - DNA, 16 bp, H. sapiens
attttcagctttaaaa

SEQ ID NO: 57692 - DNA, 16 bp, H. sapiens
attttcagctttgtgg

SEQ ID NO: 57693 - DNA, 16 bp, H. sapiens
attttcagcttttctc

SEQ ID NO: 57694 - DNA, 16 bp, H. sapiens
attttcaggaagaaaa

SEQ ID NO: 57695 - DNA, 16 bp, H. sapiens
attttcaggaatttat

SEQ ID NO: 57696 - DNA, 16 bp, H. sapiens
attttcaggattttga

SEQ ID NO: 57697 - DNA, 16 bp, H. sapiens
attttcaggattttta

SEQ ID NO: 57698 - DNA, 16 bp, H. sapiens
attttcaggccgggcg

SEQ ID NO: 57699 - DNA, 16 bp, H. sapiens
attttcagggaaacag

SEQ ID NO: 57700 - DNA, 17 bp, H. sapiens
attttcagggaacaagg

SEQ ID NO: 57701 - DNA, 16 bp, H. sapiens
attttcaggggaaaaa

SEQ ID NO: 57702 - DNA, 16 bp, H. sapiens
attttcagtaaaatta

SEQ ID NO: 57703 - DNA, 16 bp, H. sapiens
attttcagtaaataaa

SEQ ID NO: 57704 - DNA, 16 bp, H. sapiens
attttcagtattttat

SEQ ID NO: 57705 - DNA, 16 bp, H. sapiens
attttcagtgaaataa

SEQ ID NO: 57706 - DNA, 16 bp, H. sapiens
attttcagttatcttt

SEQ ID NO: 57707 - DNA, 16 bp, H. sapiens
attttcagttatttat

SEQ ID NO: 57708 - DNA, 16 bp, H. sapiens
attttcagttgatttt

SEQ ID NO: 57709 - DNA, 16 bp, H. sapiens
attttcagttgtattt

SEQ ID NO: 57710 - DNA, 16 bp, H. sapiens
attttcagtttctatt

SEQ ID NO: 57711 - DNA, 16 bp, H. sapiens
attttcagtttgttct

SEQ ID NO: 57712 - DNA, 16 bp, H. sapiens
attttcagttttcatt

SEQ ID NO: 57713 - DNA, 16 bp, H. sapiens
attttcagtttttaaa

SEQ ID NO: 57714 - DNA, 16 bp, H. sapiens
attttcagtttttact

SEQ ID NO: 57715 - DNA, 16 bp, H. sapiens
attttcataaaagaaa

SEQ ID NO: 57716 - DNA, 16 bp, H. sapiens
attttcataaagtgaa

SEQ ID NO: 57717 - DNA, 16 bp, H. sapiens
attttcataagtaaaa

SEQ ID NO: 57718 - DNA, 16 bp, H. sapiens
attttcataagtaaca

SEQ ID NO: 57719 - DNA, 16 bp, H. sapiens
attttcataattctca

SEQ ID NO: 57720 - DNA, 16 bp, H. sapiens
attttcataattgttt

SEQ ID NO: 57721 - DNA, 16 bp, H. sapiens
attttcatactgctga

SEQ ID NO: 57722 - DNA, 16 bp, H. sapiens
attttcatatatctgt

SEQ ID NO: 57723 - DNA, 16 bp, H. sapiens
attttcatcaggaata

SEQ ID NO: 57724 - DNA, 16 bp, H. sapiens
attttcatcatcccaa

SEQ ID NO: 57725 - DNA, 16 bp, H. sapiens
attttcatctataaaa

SEQ ID NO: 57726 - DNA, 16 bp, H. sapiens
attttcatgcctcagc

SEQ ID NO: 57727 - DNA, 16 bp, H. sapiens
attttcatgctgctaa

SEQ ID NO: 57728 - DNA, 16 bp, H. sapiens
attttcatgcttttta

SEQ ID NO: 57729 - DNA, 16 bp, H. sapiens
attttcatggttttga

SEQ ID NO: 57730 - DNA, 16 bp, H. sapiens
attttcatgtgcttat

SEQ ID NO: 57731 - DNA, 16 bp, H. sapiens
attttcattagtttca

SEQ ID NO: 57732 - DNA, 16 bp, H. sapiens
attttcattcccacca

SEQ ID NO: 57733 - DNA, 16 bp, H. sapiens
attttcattgtgattt

SEQ ID NO: 57734 - DNA, 16 bp, H. sapiens
attttcatttagttaa

SEQ ID NO: 57735 - DNA, 16 bp, H. sapiens
attttcatttcagaaa

SEQ ID NO: 57736 - DNA, 16 bp, H. sapiens
attttcatttctaaca

SEQ ID NO: 57737 - DNA, 16 bp, H. sapiens
attttcatttctgtct

SEQ ID NO: 57738 - DNA, 16 bp, H. sapiens
attttcatttgaaatt

SEQ ID NO: 57739 - DNA, 16 bp, H. sapiens
attttcatttgagttt

SEQ ID NO: 57740 - DNA, 16 bp, H. sapiens
attttcattttacagt

SEQ ID NO: 57741 - DNA, 16 bp, H. sapiens
attttcattttagaaa

SEQ ID NO: 57742 - DNA, 16 bp, H. sapiens
attttcattttcatgt

SEQ ID NO: 57743 - DNA, 16 bp, H. sapiens
attttcattttcctaa

SEQ ID NO: 57744 - DNA, 16 bp, H. sapiens
attttcatttttgaaa

SEQ ID NO: 57745 - DNA, 16 bp, H. sapiens
attttccaaaaatgaa

SEQ ID NO: 57746 - DNA, 16 bp, H. sapiens
attttccaaaaatgtt

SEQ ID NO: 57747 - DNA, 16 bp, H. sapiens
attttccaaaatgaat

SEQ ID NO: 57748 - DNA, 16 bp, H. sapiens
attttccaaaattttg

SEQ ID NO: 57749 - DNA, 16 bp, H. sapiens
attttccaaaccaaaa

SEQ ID NO: 57750 - DNA, 16 bp, H. sapiens
attttccaaagagaaa

SEQ ID NO: 57751 - DNA, 16 bp, H. sapiens
attttccaaagtagtt

SEQ ID NO: 57752 - DNA, 16 bp, H. sapiens
attttccaaatcttta

SEQ ID NO: 57753 - DNA, 16 bp, H. sapiens
attttccaaatgtttt

SEQ ID NO: 57754 - DNA, 16 bp, H. sapiens
attttccaaattgttt

SEQ ID NO: 57755 - DNA, 16 bp, H. sapiens
attttccaacagcatg

SEQ ID NO: 57756 - DNA, 16 bp, H. sapiens
attttccacaataaaa

SEQ ID NO: 57757 - DNA, 16 bp, H. sapiens
attttccacaatttca

SEQ ID NO: 57758 - DNA, 16 bp, H. sapiens
attttccacattttct

SEQ ID NO: 57759 - DNA, 16 bp, H. sapiens
attttccagaaataaa

SEQ ID NO: 57760 - DNA, 16 bp, H. sapiens
attttccaggctggtc

SEQ ID NO: 57761 - DNA, 16 bp, H. sapiens
attttccagtttattg

SEQ ID NO: 57762 - DNA, 16 bp, H. sapiens
attttccagtttattt

SEQ ID NO: 57763 - DNA, 16 bp, H. sapiens
attttccataataaaa

SEQ ID NO: 57764 - DNA, 16 bp, H. sapiens
attttccatattaaaa

SEQ ID NO: 57765 - DNA, 16 bp, H. sapiens
attttccatttgcttt

SEQ ID NO: 57766 - DNA, 16 bp, H. sapiens
attttcccaacacaaa

SEQ ID NO: 57767 - DNA, 16 bp, H. sapiens
attttcccaatattga

SEQ ID NO: 57768 - DNA, 16 bp, H. sapiens
attttcccatctgtaa

SEQ ID NO: 57769 - DNA, 16 bp, H. sapiens
attttcccatttatta

SEQ ID NO: 57770 - DNA, 16 bp, H. sapiens
attttcccatttctgt

SEQ ID NO: 57771 - DNA, 16 bp, H. sapiens
attttcccattttaca

SEQ ID NO: 57772 - DNA, 16 bp, H. sapiens
attttcccatttttaa

SEQ ID NO: 57773 - DNA, 16 bp, H. sapiens
attttcccccacaaag

SEQ ID NO: 57774 - DNA, 16 bp, H. sapiens
attttcctaaaaataa

SEQ ID NO: 57775 - DNA, 29 bp, H. sapiens
attttcctcatccccagtctcaaggggaa

SEQ ID NO: 57776 - DNA, 16 bp, H. sapiens
attttcctcatttaaa

SEQ ID NO: 57777 - DNA, 16 bp, H. sapiens
attttcctctatgttt

SEQ ID NO: 57778 - DNA, 16 bp, H. sapiens
attttcctctgaattt

SEQ ID NO: 57779 - DNA, 16 bp, H. sapiens
attttcctctgcttag

SEQ ID NO: 57780 - DNA, 16 bp, H. sapiens
attttcctgattcttt

SEQ ID NO: 57781 - DNA, 16 bp, H. sapiens
attttcctgcctcagc

SEQ ID NO: 57782 - DNA, 16 bp, H. sapiens
attttcctgcttaaaa

SEQ ID NO: 57783 - DNA, 16 bp, H. sapiens
attttcctggaaaatt

SEQ ID NO: 57784 - DNA, 16 bp, H. sapiens
attttcctgtaaacct

SEQ ID NO: 57785 - DNA, 16 bp, H. sapiens
attttcctgtcctctt

SEQ ID NO: 57786 - DNA, 16 bp, H. sapiens
attttcctgtctcctg

SEQ ID NO: 57787 - DNA, 16 bp, H. sapiens
attttcctgtcttctc

SEQ ID NO: 57788 - DNA, 16 bp, H. sapiens
attttcctgtttcagc

SEQ ID NO: 57789 - DNA, 16 bp, H. sapiens
attttccttaaaaaat

SEQ ID NO: 57790 - DNA, 16 bp, H. sapiens
attttccttagaattt

SEQ ID NO: 57791 - DNA, 16 bp, H. sapiens
attttccttatccaat

SEQ ID NO: 57792 - DNA, 16 bp, H. sapiens
attttccttcaaaaaa

SEQ ID NO: 57793 - DNA, 16 bp, H. sapiens
attttccttgagaaaa

SEQ ID NO: 57794 - DNA, 16 bp, H. sapiens
attttcctttaatgtt

SEQ ID NO: 57795 - DNA, 16 bp, H. sapiens
attttcctttagaaaa

SEQ ID NO: 57796 - DNA, 16 bp, H. sapiens
attttcctttcacatt

SEQ ID NO: 57797 - DNA, 16 bp, H. sapiens
attttcctttctctgt

SEQ ID NO: 57798 - DNA, 16 bp, H. sapiens
attttcctttctgtct

SEQ ID NO: 57799 - DNA, 16 bp, H. sapiens
attttcctttgaagaa

SEQ ID NO: 57800 - DNA, 16 bp, H. sapiens
attttcctttgagaaa

SEQ ID NO: 57801 - DNA, 16 bp, H. sapiens
attttcctttggaaaa

SEQ ID NO: 57802 - DNA, 16 bp, H. sapiens
attttcctttggatac

SEQ ID NO: 57803 - DNA, 16 bp, H. sapiens
attttcctttgtgtat

SEQ ID NO: 57804 - DNA, 16 bp, H. sapiens
attttcctttgtttca

SEQ ID NO: 57805 - DNA, 16 bp, H. sapiens
attttccttttaaaaa

SEQ ID NO: 57806 - DNA, 16 bp, H. sapiens
attttccttttagaaa

SEQ ID NO: 57807 - DNA, 16 bp, H. sapiens
attttccttttcctgt

SEQ ID NO: 57808 - DNA, 16 bp, H. sapiens
attttctaaaaatatg

SEQ ID NO: 57809 - DNA, 16 bp, H. sapiens
attttctaaaagttaa

SEQ ID NO: 57810 - DNA, 16 bp, H. sapiens
attttctaaaattaca

SEQ ID NO: 57811 - DNA, 16 bp, H. sapiens
attttctaaaattcca

SEQ ID NO: 57812 - DNA, 16 bp, H. sapiens
attttctaaaccaaaa

SEQ ID NO: 57813 - DNA, 16 bp, H. sapiens
attttctaaagaattt

SEQ ID NO: 57814 - DNA, 16 bp, H. sapiens
attttctaaatatgtt

SEQ ID NO: 57815 - DNA, 16 bp, H. sapiens
attttctaaatgacaa

SEQ ID NO: 57816 - DNA, 16 bp, H. sapiens
attttctaaatgtttg

SEQ ID NO: 57817 - DNA, 16 bp, H. sapiens
attttctaacacattt

SEQ ID NO: 57818 - DNA, 16 bp, H. sapiens
attttctaatttgtat

SEQ ID NO: 57819 - DNA, 16 bp, H. sapiens
attttctacatagaaa

SEQ ID NO: 57820 - DNA, 16 bp, H. sapiens
attttctacatagata

SEQ ID NO: 57821 - DNA, 16 bp, H. sapiens
attttctacataggca

SEQ ID NO: 57822 - DNA, 16 bp, H. sapiens
attttctacatttaaa

SEQ ID NO: 57823 - DNA, 16 bp, H. sapiens
attttctagaaataaa

SEQ ID NO: 57824 - DNA, 16 bp, H. sapiens
attttctaggatttga

SEQ ID NO: 57825 - DNA, 16 bp, H. sapiens
attttctaggttgcct

SEQ ID NO: 57826 - DNA, 16 bp, H. sapiens
attttctagtttgtgc

SEQ ID NO: 57827 - DNA, 16 bp, H. sapiens
attttctatatccagt

SEQ ID NO: 57828 - DNA, 16 bp, H. sapiens
attttctatccttaga

SEQ ID NO: 57829 - DNA, 16 bp, H. sapiens
attttctatgtagaca

SEQ ID NO: 57830 - DNA, 16 bp, H. sapiens
attttctattgtgtct

SEQ ID NO: 57831 - DNA, 16 bp, H. sapiens
attttctcaaaaataa

SEQ ID NO: 57832 - DNA, 16 bp, H. sapiens
attttctcaaaatatt

SEQ ID NO: 57833 - DNA, 16 bp, H. sapiens
attttctcaaataaaa

SEQ ID NO: 57834 - DNA, 16 bp, H. sapiens
attttctcacagttat

SEQ ID NO: 57835 - DNA, 16 bp, H. sapiens
attttctcacctataa

SEQ ID NO: 57836 - DNA, 16 bp, H. sapiens
attttctcactgttaa

SEQ ID NO: 57837 - DNA, 16 bp, H. sapiens
attttctcagtgaagt

SEQ ID NO: 57838 - DNA, 16 bp, H. sapiens
attttctcatctaaaa

SEQ ID NO: 57839 - DNA, 16 bp, H. sapiens
attttctcatttttag

SEQ ID NO: 57840 - DNA, 16 bp, H. sapiens
attttctccataaatt

SEQ ID NO: 57841 - DNA, 16 bp, H. sapiens
attttctccattgtct

SEQ ID NO: 57842 - DNA, 16 bp, H. sapiens
attttctcccactttg

SEQ ID NO: 57843 - DNA, 16 bp, H. sapiens
attttctcccagtgtg

SEQ ID NO: 57844 - DNA, 16 bp, H. sapiens
attttctcccattgtg

SEQ ID NO: 57845 - DNA, 16 bp, H. sapiens
attttctcctgccctt

SEQ ID NO: 57846 - DNA, 16 bp, H. sapiens
attttctctaaaataa

SEQ ID NO: 57847 - DNA, 16 bp, H. sapiens
attttctctcttgtct

SEQ ID NO: 57848 - DNA, 16 bp, H. sapiens
attttctctgcctttt

SEQ ID NO: 57849 - DNA, 16 bp, H. sapiens
attttctctgtgcttt

SEQ ID NO: 57850 - DNA, 16 bp, H. sapiens
attttctcttagaaaa

SEQ ID NO: 57851 - DNA, 16 bp, H. sapiens
attttctcttcagttt

SEQ ID NO: 57852 - DNA, 16 bp, H. sapiens
attttctcttccaaaa

SEQ ID NO: 57853 - DNA, 16 bp, H. sapiens
attttctcttctagct

SEQ ID NO: 57854 - DNA, 16 bp, H. sapiens
attttctctttccttg

SEQ ID NO: 57855 - DNA, 16 bp, H. sapiens
attttctcttttatga

SEQ ID NO: 57856 - DNA, 16 bp, H. sapiens
attttctcttttgaaa

SEQ ID NO: 57857 - DNA, 16 bp, H. sapiens
attttctcttttgaga

SEQ ID NO: 57858 - DNA, 16 bp, H. sapiens
attttctctttttcag

SEQ ID NO: 57859 - DNA, 16 bp, H. sapiens
attttctgaaaaaatt

SEQ ID NO: 57860 - DNA, 16 bp, H. sapiens
attttctgaaatgaaa

SEQ ID NO: 57861 - DNA, 16 bp, H. sapiens
attttctgaagaaaat

SEQ ID NO: 57862 - DNA, 16 bp, H. sapiens
attttctgaagaattt

SEQ ID NO: 57863 - DNA, 16 bp, H. sapiens
attttctgaagagaaa

SEQ ID NO: 57864 - DNA, 16 bp, H. sapiens
attttctgaatgtttt

SEQ ID NO: 57865 - DNA, 16 bp, H. sapiens
attttctgagcttcag

SEQ ID NO: 57866 - DNA, 16 bp, H. sapiens
attttctgatatattt

SEQ ID NO: 57867 - DNA, 16 bp, H. sapiens
attttctgatgattag

SEQ ID NO: 57868 - DNA, 16 bp, H. sapiens
attttctgatttctgt

SEQ ID NO: 57869 - DNA, 16 bp, H. sapiens
attttctgattttaaa

SEQ ID NO: 57870 - DNA, 16 bp, H. sapiens
attttctgcctcagcc

SEQ ID NO: 57871 - DNA, 16 bp, H. sapiens
attttctgcttagaaa

SEQ ID NO: 57872 - DNA, 16 bp, H. sapiens
attttctgcttcttta

SEQ ID NO: 57873 - DNA, 16 bp, H. sapiens
attttctggatattaa

SEQ ID NO: 57874 - DNA, 16 bp, H. sapiens
attttctgggagaaat

SEQ ID NO: 57875 - DNA, 16 bp, H. sapiens
attttctgggtatttt

SEQ ID NO: 57876 - DNA, 16 bp, H. sapiens
attttctgggttcaca

SEQ ID NO: 57877 - DNA, 16 bp, H. sapiens
attttctgtaaatgaa

SEQ ID NO: 57878 - DNA, 16 bp, H. sapiens
attttctgtactttta

SEQ ID NO: 57879 - DNA, 16 bp, H. sapiens
attttctgtatttcat

SEQ ID NO: 57880 - DNA, 16 bp, H. sapiens
attttctgtcatttaa

SEQ ID NO: 57881 - DNA, 16 bp, H. sapiens
attttctgtctagttt

SEQ ID NO: 57882 - DNA, 16 bp, H. sapiens
attttctgtctggaag

SEQ ID NO: 57883 - DNA, 16 bp, H. sapiens
attttctgtcttcaaa

SEQ ID NO: 57884 - DNA, 16 bp, H. sapiens
attttctgtgaaatat

SEQ ID NO: 57885 - DNA, 16 bp, H. sapiens
attttctgtgatgatg

SEQ ID NO: 57886 - DNA, 16 bp, H. sapiens
attttctgtgcctcag

SEQ ID NO: 57887 - DNA, 16 bp, H. sapiens
attttctgttttaaag

SEQ ID NO: 57888 - DNA, 16 bp, H. sapiens
attttctgttttataa

SEQ ID NO: 57889 - DNA, 16 bp, H. sapiens
attttcttaaaaaatg

SEQ ID NO: 57890 - DNA, 16 bp, H. sapiens
attttcttaaaacatt

SEQ ID NO: 57891 - DNA, 16 bp, H. sapiens
attttcttaaaatcat

SEQ ID NO: 57892 - DNA, 16 bp, H. sapiens
attttcttaagaattt

SEQ ID NO: 57893 - DNA, 16 bp, H. sapiens
attttcttacagttct

SEQ ID NO: 57894 - DNA, 16 bp, H. sapiens
attttcttactgttat

SEQ ID NO: 57895 - DNA, 16 bp, H. sapiens
attttcttactgttga

SEQ ID NO: 57896 - DNA, 16 bp, H. sapiens
attttcttagaaaata

SEQ ID NO: 57897 - DNA, 16 bp, H. sapiens
attttcttatgaaaat

SEQ ID NO: 57898 - DNA, 16 bp, H. sapiens
attttcttatgttgaa

SEQ ID NO: 57899 - DNA, 16 bp, H. sapiens
attttcttattgttga

SEQ ID NO: 57900 - DNA, 16 bp, H. sapiens
attttcttcaaaagaa

SEQ ID NO: 57901 - DNA, 16 bp, H. sapiens
attttcttcaagtatt

SEQ ID NO: 57902 - DNA, 16 bp, H. sapiens
attttcttcagatatt

SEQ ID NO: 57903 - DNA, 16 bp, H. sapiens
attttcttcagcacca

SEQ ID NO: 57904 - DNA, 16 bp, H. sapiens
attttcttcatgtact

SEQ ID NO: 57905 - DNA, 16 bp, H. sapiens
attttcttcattctgt

SEQ ID NO: 57906 - DNA, 16 bp, H. sapiens
attttcttccaaaatg

SEQ ID NO: 57907 - DNA, 16 bp, H. sapiens
attttcttccatttgt

SEQ ID NO: 57908 - DNA, 16 bp, H. sapiens
attttcttctagaagt

SEQ ID NO: 57909 - DNA, 16 bp, H. sapiens
attttcttctcacatt

SEQ ID NO: 57910 - DNA, 16 bp, H. sapiens
attttcttctccaaaa

SEQ ID NO: 57911 - DNA, 16 bp, H. sapiens
attttcttctgcattt

SEQ ID NO: 57912 - DNA, 16 bp, H. sapiens
attttcttctggaaaa

SEQ ID NO: 57913 - DNA, 16 bp, H. sapiens
attttcttctgtgtat

SEQ ID NO: 57914 - DNA, 16 bp, H. sapiens
attttcttctttcctg

SEQ ID NO: 57915 - DNA, 16 bp, H. sapiens
attttcttctttgtaa

SEQ ID NO: 57916 - DNA, 16 bp, H. sapiens
attttcttcttttcag

SEQ ID NO: 57917 - DNA, 16 bp, H. sapiens
attttcttgaaaaaat

SEQ ID NO: 57918 - DNA, 16 bp, H. sapiens
attttcttgaaacaaa

SEQ ID NO: 57919 - DNA, 16 bp, H. sapiens
attttcttgaagattt

SEQ ID NO: 57920 - DNA, 16 bp, H. sapiens
attttcttgaattatt

SEQ ID NO: 57921 - DNA, 16 bp, H. sapiens
attttcttggatattt

SEQ ID NO: 57922 - DNA, 16 bp, H. sapiens
attttctttaaaaaga

SEQ ID NO: 57923 - DNA, 16 bp, H. sapiens
attttctttaaccagt

SEQ ID NO: 57924 - DNA, 16 bp, H. sapiens
attttctttatctgta

SEQ ID NO: 57925 - DNA, 16 bp, H. sapiens
attttctttatgaaaa

SEQ ID NO: 57926 - DNA, 16 bp, H. sapiens
attttctttatttgaa

SEQ ID NO: 57927 - DNA, 16 bp, H. sapiens
attttctttcaactat

SEQ ID NO: 57928 - DNA, 16 bp, H. sapiens
attttctttcagcact

SEQ ID NO: 57929 - DNA, 16 bp, H. sapiens
attttctttcaggaat

SEQ ID NO: 57930 - DNA, 16 bp, H. sapiens
attttctttcattctg

SEQ ID NO: 57931 - DNA, 16 bp, H. sapiens
attttctttccattgt

SEQ ID NO: 57932 - DNA, 16 bp, H. sapiens
attttctttctaaaaa

SEQ ID NO: 57933 - DNA, 16 bp, H. sapiens
attttctttctctgaa

SEQ ID NO: 57934 - DNA, 16 bp, H. sapiens
attttctttgaaaatt

SEQ ID NO: 57935 - DNA, 16 bp, H. sapiens
attttctttgccttct

SEQ ID NO: 57936 - DNA, 16 bp, H. sapiens
attttctttgctctga

SEQ ID NO: 57937 - DNA, 16 bp, H. sapiens
attttctttgctttaa

SEQ ID NO: 57938 - DNA, 16 bp, H. sapiens
attttctttggaaatt

SEQ ID NO: 57939 - DNA, 16 bp, H. sapiens
attttctttgtgaaat

SEQ ID NO: 57940 - DNA, 16 bp, H. sapiens
attttctttgtgaatt

SEQ ID NO: 57941 - DNA, 16 bp, H. sapiens
attttcttttaaagtt

SEQ ID NO: 57942 - DNA, 16 bp, H. sapiens
attttcttttagaatt

SEQ ID NO: 57943 - DNA, 16 bp, H. sapiens
attttcttttccaaca

SEQ ID NO: 57944 - DNA, 16 bp, H. sapiens
attttcttttctgtga

SEQ ID NO: 57945 - DNA, 16 bp, H. sapiens
attttcttttgattga

SEQ ID NO: 57946 - DNA, 16 bp, H. sapiens
attttctttttagaaa

SEQ ID NO: 57947 - DNA, 16 bp, H. sapiens
attttctttttccagt

SEQ ID NO: 57948 - DNA, 16 bp, H. sapiens
attttgaaaaaacaaa

SEQ ID NO: 57949 - DNA, 16 bp, H. sapiens
attttgaaaaaagttt

SEQ ID NO: 57950 - DNA, 16 bp, H. sapiens
attttgaaaaacacaa

SEQ ID NO: 57951 - DNA, 16 bp, H. sapiens
attttgaaaaagaaga

SEQ ID NO: 57952 - DNA, 16 bp, H. sapiens
attttgaaaaatatag

SEQ ID NO: 57953 - DNA, 16 bp, H. sapiens
attttgaaaaatgtaa

SEQ ID NO: 57954 - DNA, 16 bp, H. sapiens
attttgaaaaatgttt

SEQ ID NO: 57955 - DNA, 16 bp, H. sapiens
attttgaaaacagcaa

SEQ ID NO: 57956 - DNA, 16 bp, H. sapiens
attttgaaaactgtat

SEQ ID NO: 57957 - DNA, 16 bp, H. sapiens
attttgaaaactttta

SEQ ID NO: 57958 - DNA, 16 bp, H. sapiens
attttgaaaataatct

SEQ ID NO: 57959 - DNA, 16 bp, H. sapiens
attttgaaaatgagaa

SEQ ID NO: 57960 - DNA, 16 bp, H. sapiens
attttgaaaatggaaa

SEQ ID NO: 57961 - DNA, 16 bp, H. sapiens
attttgaaaattaatc

SEQ ID NO: 57962 - DNA, 16 bp, H. sapiens
attttgaaacaaacaa

SEQ ID NO: 57963 - DNA, 16 bp, H. sapiens
attttgaaactgaagt

SEQ ID NO: 57964 - DNA, 16 bp, H. sapiens
attttgaaactgtttt

SEQ ID NO: 57965 - DNA, 16 bp, H. sapiens
attttgaaactttaag

SEQ ID NO: 57966 - DNA, 16 bp, H. sapiens
attttgaaagaaatct

SEQ ID NO: 57967 - DNA, 16 bp, H. sapiens
attttgaaagaagaaa

SEQ ID NO: 57968 - DNA, 16 bp, H. sapiens
attttgaaagacaaaa

SEQ ID NO: 57969 - DNA, 16 bp, H. sapiens
attttgaaagacattt

SEQ ID NO: 57970 - DNA, 16 bp, H. sapiens
attttgaaagagaaaa

SEQ ID NO: 57971 - DNA, 16 bp, H. sapiens
attttgaaagattaaa

SEQ ID NO: 57972 - DNA, 16 bp, H. sapiens
attttgaaagcaaaaa

SEQ ID NO: 57973 - DNA, 16 bp, H. sapiens
attttgaaagcaagaa

SEQ ID NO: 57974 - DNA, 16 bp, H. sapiens
attttgaaaggaatcc

SEQ ID NO: 57975 - DNA, 16 bp, H. sapiens
attttgaaaggaatct

SEQ ID NO: 57976 - DNA, 16 bp, H. sapiens
attttgaaagtgtttt

SEQ ID NO: 57977 - DNA, 16 bp, H. sapiens
attttgaaataaaatg

SEQ ID NO: 57978 - DNA, 16 bp, H. sapiens
attttgaaataatcat

SEQ ID NO: 57979 - DNA, 16 bp, H. sapiens
attttgaaataatgta

SEQ ID NO: 57980 - DNA, 16 bp, H. sapiens
attttgaaatatcaaa

SEQ ID NO: 57981 - DNA, 16 bp, H. sapiens
attttgaaatatgcaa

SEQ ID NO: 57982 - DNA, 16 bp, H. sapiens
attttgaaatcaaaat

SEQ ID NO: 57983 - DNA, 16 bp, H. sapiens
attttgaaatggaaaa

SEQ ID NO: 57984 - DNA, 16 bp, H. sapiens
attttgaaatgtaaaa

SEQ ID NO: 57985 - DNA, 16 bp, H. sapiens
attttgaaatgtacaa

SEQ ID NO: 57986 - DNA, 16 bp, H. sapiens
attttgaaatgtttca

SEQ ID NO: 57987 - DNA, 16 bp, H. sapiens
attttgaaatgttttc

SEQ ID NO: 57988 - DNA, 16 bp, H. sapiens
attttgaaattcactg

SEQ ID NO: 57989 - DNA, 16 bp, H. sapiens
attttgaaattgtaaa

SEQ ID NO: 57990 - DNA, 16 bp, H. sapiens
attttgaaatttcaaa

SEQ ID NO: 57991 - DNA, 16 bp, H. sapiens
attttgaacacatttt

SEQ ID NO: 57992 - DNA, 16 bp, H. sapiens
attttgaactttccag

SEQ ID NO: 57993 - DNA, 16 bp, H. sapiens
attttgaactttttaa

SEQ ID NO: 57994 - DNA, 16 bp, H. sapiens
attttgaagacagaaa

SEQ ID NO: 57995 - DNA, 16 bp, H. sapiens
attttgaagacatttt

SEQ ID NO: 57996 - DNA, 16 bp, H. sapiens
attttgaagatgaaaa

SEQ ID NO: 57997 - DNA, 16 bp, H. sapiens
attttgaagatgaaat

SEQ ID NO: 57998 - DNA, 16 bp, H. sapiens
attttgaagatgtttt

SEQ ID NO: 57999 - DNA, 16 bp, H. sapiens
attttgaagatttctt

SEQ ID NO: 58000 - DNA, 16 bp, H. sapiens
attttgaaggaagaaa

SEQ ID NO: 58001 - DNA, 16 bp, H. sapiens
attttgaagtaaatcc

SEQ ID NO: 58002 - DNA, 16 bp, H. sapiens
attttgaagtagtttt

SEQ ID NO: 58003 - DNA, 16 bp, H. sapiens
attttgaagtcagaaa

SEQ ID NO: 58004 - DNA, 16 bp, H. sapiens
attttgaagtttaaaa

SEQ ID NO: 58005 - DNA, 16 bp, H. sapiens
attttgaagttttctt

SEQ ID NO: 58006 - DNA, 16 bp, H. sapiens
attttgaatattccca

SEQ ID NO: 58007 - DNA, 16 bp, H. sapiens
attttgaatctatttt

SEQ ID NO: 58008 - DNA, 16 bp, H. sapiens
attttgaatgttatca

SEQ ID NO: 58009 - DNA, 16 bp, H. sapiens
attttgaattactttt

SEQ ID NO: 58010 - DNA, 16 bp, H. sapiens
attttgaattctctga

SEQ ID NO: 58011 - DNA, 16 bp, H. sapiens
attttgacaaaatttt

SEQ ID NO: 58012 - DNA, 16 bp, H. sapiens
attttgacatatgttc

SEQ ID NO: 58013 - DNA, 16 bp, H. sapiens
attttgacatttaaaa

SEQ ID NO: 58014 - DNA, 16 bp, H. sapiens
attttgacattttctt

SEQ ID NO: 58015 - DNA, 16 bp, H. sapiens
attttgaccttgaaga

SEQ ID NO: 58016 - DNA, 16 bp, H. sapiens
attttgactatatttt

SEQ ID NO: 58017 - DNA, 16 bp, H. sapiens
attttgactggaattg

SEQ ID NO: 58018 - DNA, 16 bp, H. sapiens
attttgactttaaaaa

SEQ ID NO: 58019 - DNA, 16 bp, H. sapiens
attttgagaaatgaaa

SEQ ID NO: 58020 - DNA, 16 bp, H. sapiens
attttgagaaccactg

SEQ ID NO: 58021 - DNA, 16 bp, H. sapiens
attttgagaagcactg

SEQ ID NO: 58022 - DNA, 16 bp, H. sapiens
attttgagataattgt

SEQ ID NO: 58023 - DNA, 16 bp, H. sapiens
attttgagcctaagtg

SEQ ID NO: 58024 - DNA, 16 bp, H. sapiens
attttgaggaagtcca

SEQ ID NO: 58025 - DNA, 16 bp, H. sapiens
attttgataaaattca

SEQ ID NO: 58026 - DNA, 16 bp, H. sapiens
attttgataatcattt

SEQ ID NO: 58027 - DNA, 16 bp, H. sapiens
attttgatacaggcat

SEQ ID NO: 58028 - DNA, 16 bp, H. sapiens
attttgatacatgtat

SEQ ID NO: 58029 - DNA, 16 bp, H. sapiens
attttgatagatactg

SEQ ID NO: 58030 - DNA, 16 bp, H. sapiens
attttgatatattgtg

SEQ ID NO: 58031 - DNA, 16 bp, H. sapiens
attttgatatattttc

SEQ ID NO: 58032 - DNA, 16 bp, H. sapiens
attttgatatttcatt

SEQ ID NO: 58033 - DNA, 16 bp, H. sapiens
attttgatcttttcct

SEQ ID NO: 58034 - DNA, 16 bp, H. sapiens
attttgatgaagaaaa

SEQ ID NO: 58035 - DNA, 16 bp, H. sapiens
attttgatgaagttca

SEQ ID NO: 58036 - DNA, 16 bp, H. sapiens
attttgatgattttga

SEQ ID NO: 58037 - DNA, 16 bp, H. sapiens
attttgatgcccttta

SEQ ID NO: 58038 - DNA, 16 bp, H. sapiens
attttgatggaaattg

SEQ ID NO: 58039 - DNA, 16 bp, H. sapiens
attttgatgtttcctt

SEQ ID NO: 58040 - DNA, 16 bp, H. sapiens
attttgattggaattg

SEQ ID NO: 58041 - DNA, 16 bp, H. sapiens
attttgatttcttaaa

SEQ ID NO: 58042 - DNA, 16 bp, H. sapiens
attttgattttcaagt

SEQ ID NO: 58043 - DNA, 16 bp, H. sapiens
attttgcaaaacaaaa

SEQ ID NO: 58044 - DNA, 16 bp, H. sapiens
attttgcaaaagaaaa

SEQ ID NO: 58045 - DNA, 16 bp, H. sapiens
attttgcaaaagaaga

SEQ ID NO: 58046 - DNA, 16 bp, H. sapiens
attttgcaaaggagga

SEQ ID NO: 58047 - DNA, 16 bp, H. sapiens
attttgcaaatataaa

SEQ ID NO: 58048 - DNA, 16 bp, H. sapiens
attttgcaaatattat

SEQ ID NO: 58049 - DNA, 16 bp, H. sapiens
attttgcaaatgaaaa

SEQ ID NO: 58050 - DNA, 16 bp, H. sapiens
attttgcaaatgaaga

SEQ ID NO: 58051 - DNA, 16 bp, H. sapiens
attttgcaattctcta

SEQ ID NO: 58052 - DNA, 16 bp, H. sapiens
attttgcagaaaagaa

SEQ ID NO: 58053 - DNA, 16 bp, H. sapiens
attttgcagataaaga

SEQ ID NO: 58054 - DNA, 16 bp, H. sapiens
attttgcagatgaggt

SEQ ID NO: 58055 - DNA, 16 bp, H. sapiens
attttgcagctgagaa

SEQ ID NO: 58056 - DNA, 16 bp, H. sapiens
attttgcagttgagga

SEQ ID NO: 58057 - DNA, 16 bp, H. sapiens
attttgcagttttagt

SEQ ID NO: 58058 - DNA, 16 bp, H. sapiens
attttgcatacaattt

SEQ ID NO: 58059 - DNA, 16 bp, H. sapiens
attttgcatatgaaaa

SEQ ID NO: 58060 - DNA, 16 bp, H. sapiens
attttgcatctatttt

SEQ ID NO: 58061 - DNA, 16 bp, H. sapiens
attttgcatgttttca

SEQ ID NO: 58062 - DNA, 16 bp, H. sapiens
attttgcattcatttt

SEQ ID NO: 58063 - DNA, 16 bp, H. sapiens
attttgcatttaaaat

SEQ ID NO: 58064 - DNA, 16 bp, H. sapiens
attttgcattttaaac

SEQ ID NO: 58065 - DNA, 16 bp, H. sapiens
attttgcatttttgta

SEQ ID NO: 58066 - DNA, 16 bp, H. sapiens
attttgccaaagaaaa

SEQ ID NO: 58067 - DNA, 16 bp, H. sapiens
attttgccaaagaagt

SEQ ID NO: 58068 - DNA, 16 bp, H. sapiens
attttgccaacatttt

SEQ ID NO: 58069 - DNA, 16 bp, H. sapiens
attttgccaccaccag

SEQ ID NO: 58070 - DNA, 16 bp, H. sapiens
attttgccaggctggt

SEQ ID NO: 58071 - DNA, 16 bp, H. sapiens
attttgccattttaca

SEQ ID NO: 58072 - DNA, 16 bp, H. sapiens
attttgcccatgtttt

SEQ ID NO: 58073 - DNA, 16 bp, H. sapiens
attttgcccctgccct

SEQ ID NO: 58074 - DNA, 16 bp, H. sapiens
attttgccctttagtt

SEQ ID NO: 58075 - DNA, 16 bp, H. sapiens
attttgcctaccacaa

SEQ ID NO: 58076 - DNA, 16 bp, H. sapiens
attttgcctcagcttc

SEQ ID NO: 58077 - DNA, 16 bp, H. sapiens
attttgcctgttttct

SEQ ID NO: 58078 - DNA, 16 bp, H. sapiens
attttgccttcatttt

SEQ ID NO: 58079 - DNA, 16 bp, H. sapiens
attttgctaaaaataa

SEQ ID NO: 58080 - DNA, 16 bp, H. sapiens
attttgctaagtgaaa

SEQ ID NO: 58081 - DNA, 16 bp, H. sapiens
attttgctacattttt

SEQ ID NO: 58082 - DNA, 16 bp, H. sapiens
attttgctattgtaaa

SEQ ID NO: 58083 - DNA, 16 bp, H. sapiens
attttgctcatctttt

SEQ ID NO: 58084 - DNA, 16 bp, H. sapiens
attttgctcattttta

SEQ ID NO: 58085 - DNA, 16 bp, H. sapiens
attttgctcttgtcac

SEQ ID NO: 58086 - DNA, 16 bp, H. sapiens
attttgctctttagtt

SEQ ID NO: 58087 - DNA, 16 bp, H. sapiens
attttgctgaggattt

SEQ ID NO: 58088 - DNA, 16 bp, H. sapiens
attttgctgaggtttt

SEQ ID NO: 58089 - DNA, 16 bp, H. sapiens
attttgctgattatat

SEQ ID NO: 58090 - DNA, 16 bp, H. sapiens
attttgctgattgttt

SEQ ID NO: 58091 - DNA, 16 bp, H. sapiens
attttgctgattttta

SEQ ID NO: 58092 - DNA, 16 bp, H. sapiens
attttgctgcaaatga

SEQ ID NO: 58093 - DNA, 16 bp, H. sapiens
attttgctgcagaaat

SEQ ID NO: 58094 - DNA, 16 bp, H. sapiens
attttgctgtacaact

SEQ ID NO: 58095 - DNA, 16 bp, H. sapiens
attttgctgtttttaa

SEQ ID NO: 58096 - DNA, 16 bp, H. sapiens
attttgcttagaaatt

SEQ ID NO: 58097 - DNA, 16 bp, H. sapiens
attttgctttggaaaa

SEQ ID NO: 58098 - DNA, 16 bp, H. sapiens
attttgcttttaaaat

SEQ ID NO: 58099 - DNA, 16 bp, H. sapiens
attttgcttttgaaaa

SEQ ID NO: 58100 - DNA, 16 bp, H. sapiens
attttgcttttgtaaa

SEQ ID NO: 58101 - DNA, 16 bp, H. sapiens
attttggaaaaattta

SEQ ID NO: 58102 - DNA, 16 bp, H. sapiens
attttggaaaatggtt

SEQ ID NO: 58103 - DNA, 16 bp, H. sapiens
attttggaaaattgtt

SEQ ID NO: 58104 - DNA, 16 bp, H. sapiens
attttggaaaatttct

SEQ ID NO: 58105 - DNA, 16 bp, H. sapiens
attttggaaactatat

SEQ ID NO: 58106 - DNA, 16 bp, H. sapiens
attttggaaagaaaga

SEQ ID NO: 58107 - DNA, 16 bp, H. sapiens
attttggaaagttttt

SEQ ID NO: 58108 - DNA, 16 bp, H. sapiens
attttggaaatactgg

SEQ ID NO: 58109 - DNA, 16 bp, H. sapiens
attttggaaatcattt

SEQ ID NO: 58110 - DNA, 16 bp, H. sapiens
attttggaaatgagaa

SEQ ID NO: 58111 - DNA, 16 bp, H. sapiens
attttggaaatgcaaa

SEQ ID NO: 58112 - DNA, 16 bp, H. sapiens
attttggaaattataa

SEQ ID NO: 58113 - DNA, 16 bp, H. sapiens
attttggaaattctca

SEQ ID NO: 58114 - DNA, 16 bp, H. sapiens
attttggaactctgga

SEQ ID NO: 58115 - DNA, 16 bp, H. sapiens
attttggaactggaag

SEQ ID NO: 58116 - DNA, 16 bp, H. sapiens
attttggaactgggta

SEQ ID NO: 58117 - DNA, 16 bp, H. sapiens
attttggaactttaag

SEQ ID NO: 58118 - DNA, 16 bp, H. sapiens
attttggaagatattt

SEQ ID NO: 58119 - DNA, 16 bp, H. sapiens
attttggaagttatga

SEQ ID NO: 58120 - DNA, 16 bp, H. sapiens
attttggaagttttca

SEQ ID NO: 58121 - DNA, 16 bp, H. sapiens
attttggaataaatat

SEQ ID NO: 58122 - DNA, 16 bp, H. sapiens
attttggaatatctgc

SEQ ID NO: 58123 - DNA, 16 bp, H. sapiens
attttggaatatttga

SEQ ID NO: 58124 - DNA, 16 bp, H. sapiens
attttggaattttcca

SEQ ID NO: 58125 - DNA, 16 bp, H. sapiens
attttggaccaatatc

SEQ ID NO: 58126 - DNA, 16 bp, H. sapiens
attttggacctttaag

SEQ ID NO: 58127 - DNA, 16 bp, H. sapiens
attttggagaaaaaca

SEQ ID NO: 58128 - DNA, 16 bp, H. sapiens
attttggagaaacaca

SEQ ID NO: 58129 - DNA, 16 bp, H. sapiens
attttggagatgagga

SEQ ID NO: 58130 - DNA, 16 bp, H. sapiens
attttggagcacttca

SEQ ID NO: 58131 - DNA, 16 bp, H. sapiens
attttggagcttgaag

SEQ ID NO: 58132 - DNA, 16 bp, H. sapiens
attttggagctttaag

SEQ ID NO: 58133 - DNA, 16 bp, H. sapiens
attttggataacaatc

SEQ ID NO: 58134 - DNA, 16 bp, H. sapiens
attttggataagggat

SEQ ID NO: 58135 - DNA, 16 bp, H. sapiens
attttggatatttcct

SEQ ID NO: 58136 - DNA, 16 bp, H. sapiens
attttggatttcagat

SEQ ID NO: 58137 - DNA, 16 bp, H. sapiens
attttggattttgaat

SEQ ID NO: 58138 - DNA, 16 bp, H. sapiens
attttggcaattacaa

SEQ ID NO: 58139 - DNA, 16 bp, H. sapiens
attttggcatatttcc

SEQ ID NO: 58140 - DNA, 16 bp, H. sapiens
attttggcatttattt

SEQ ID NO: 58141 - DNA, 16 bp, H. sapiens
attttggcatttttct

SEQ ID NO: 58142 - DNA, 16 bp, H. sapiens
attttggccatgctgg

SEQ ID NO: 58143 - DNA, 16 bp, H. sapiens
attttggccattttaa

SEQ ID NO: 58144 - DNA, 16 bp, H. sapiens
attttggcttcatttt

SEQ ID NO: 58145 - DNA, 16 bp, H. sapiens
attttggctttggttg

SEQ ID NO: 58146 - DNA, 16 bp, H. sapiens
attttgggaaatgcca

SEQ ID NO: 58147 - DNA, 16 bp, H. sapiens
attttgggagtccaag

SEQ ID NO: 58148 - DNA, 20 bp, H. sapiens
attttgggcaaagccattca

SEQ ID NO: 58149 - DNA, 16 bp, H. sapiens
attttgggggaaaaaa

SEQ ID NO: 58150 - DNA, 16 bp, H. sapiens
attttgggggaacagg

SEQ ID NO: 58151 - DNA, 16 bp, H. sapiens
attttgggtatctttt

SEQ ID NO: 58152 - DNA, 16 bp, H. sapiens
attttggtatcagagt

SEQ ID NO: 58153 - DNA, 16 bp, H. sapiens
attttggtcaaagcca

SEQ ID NO: 58154 - DNA, 16 bp, H. sapiens
attttggtggtggtta

SEQ ID NO: 58155 - DNA, 16 bp, H. sapiens
attttggttattgtga

SEQ ID NO: 58156 - DNA, 16 bp, H. sapiens
attttggttatttcct

SEQ ID NO: 58157 - DNA, 16 bp, H. sapiens
attttggtttcattga

SEQ ID NO: 58158 - DNA, 16 bp, H. sapiens
attttgtaaaactaaa

SEQ ID NO: 58159 - DNA, 16 bp, H. sapiens
attttgtaaaatgtaa

SEQ ID NO: 58160 - DNA, 16 bp, H. sapiens
attttgtaaaatgtta

SEQ ID NO: 58161 - DNA, 16 bp, H. sapiens
attttgtaacttaaaa

SEQ ID NO: 58162 - DNA, 16 bp, H. sapiens
attttgtaataaaatg

SEQ ID NO: 58163 - DNA, 16 bp, H. sapiens
attttgtaatgaaaat

SEQ ID NO: 58164 - DNA, 16 bp, H. sapiens
attttgtacattatat

SEQ ID NO: 58165 - DNA, 16 bp, H. sapiens
attttgtacatttaaa

SEQ ID NO: 58166 - DNA, 16 bp, H. sapiens
attttgtaccttttga

SEQ ID NO: 58167 - DNA, 21 bp, H. sapiens
attttgtagagatggggtctc

SEQ ID NO: 58168 - DNA, 16 bp, H. sapiens
attttgtagatgaaaa

SEQ ID NO: 58169 - DNA, 16 bp, H. sapiens
attttgtataaatgaa

SEQ ID NO: 58170 - DNA, 16 bp, H. sapiens
attttgtatacagaat

SEQ ID NO: 58171 - DNA, 16 bp, H. sapiens
attttgtatactgcaa

SEQ ID NO: 58172 - DNA, 16 bp, H. sapiens
attttgtatatggcaa

SEQ ID NO: 58173 - DNA, 16 bp, H. sapiens
attttgtatcctaaaa

SEQ ID NO: 58174 - DNA, 16 bp, H. sapiens
attttgtatcctgaaa

SEQ ID NO: 58175 - DNA, 16 bp, H. sapiens
attttgtatccttaga

SEQ ID NO: 58176 - DNA, 16 bp, H. sapiens
attttgtatccttcaa

SEQ ID NO: 58177 - DNA, 16 bp, H. sapiens
attttgtatcttgtaa

SEQ ID NO: 58178 - DNA, 16 bp, H. sapiens
attttgtatcttttaa

SEQ ID NO: 58179 - DNA, 16 bp, H. sapiens
attttgtatttcattc

SEQ ID NO: 58180 - DNA, 16 bp, H. sapiens
attttgtattttcata

SEQ ID NO: 58181 - DNA, 16 bp, H. sapiens
attttgtcaaatggtt

SEQ ID NO: 58182 - DNA, 16 bp, H. sapiens
attttgtcaaatttat

SEQ ID NO: 58183 - DNA, 16 bp, H. sapiens
attttgtcactgaggt

SEQ ID NO: 58184 - DNA, 16 bp, H. sapiens
attttgtcagattttt

SEQ ID NO: 58185 - DNA, 16 bp, H. sapiens
attttgtcatccaggt

SEQ ID NO: 58186 - DNA, 16 bp, H. sapiens
attttgtcatctataa

SEQ ID NO: 58187 - DNA, 16 bp, H. sapiens
attttgtccacttttt

SEQ ID NO: 58188 - DNA, 19 bp, H. sapiens
attttgtccctgccctaga

SEQ ID NO: 58189 - DNA, 16 bp, H. sapiens
attttgtctatttcat

SEQ ID NO: 58190 - DNA, 16 bp, H. sapiens
attttgtctgaaatta

SEQ ID NO: 58191 - DNA, 16 bp, H. sapiens
attttgtctgaatttt

SEQ ID NO: 58192 - DNA, 16 bp, H. sapiens
attttgtcttctgaaa

SEQ ID NO: 58193 - DNA, 16 bp, H. sapiens
attttgtctttctgtg

SEQ ID NO: 58194 - DNA, 16 bp, H. sapiens
attttgtcttttgata

SEQ ID NO: 58195 - DNA, 16 bp, H. sapiens
attttgtgaaaaataa

SEQ ID NO: 58196 - DNA, 16 bp, H. sapiens
attttgtgaaaattta

SEQ ID NO: 58197 - DNA, 16 bp, H. sapiens
attttgtgaagaaaat

SEQ ID NO: 58198 - DNA, 16 bp, H. sapiens
attttgtgaagaaagt

SEQ ID NO: 58199 - DNA, 16 bp, H. sapiens
attttgtgaataaatt

SEQ ID NO: 58200 - DNA, 16 bp, H. sapiens
attttgtgacttttta

SEQ ID NO: 58201 - DNA, 16 bp, H. sapiens
attttgtgattaaaaa

SEQ ID NO: 58202 - DNA, 16 bp, H. sapiens
attttgtgcaatattt

SEQ ID NO: 58203 - DNA, 16 bp, H. sapiens
attttgtgcatgaaat

SEQ ID NO: 58204 - DNA, 16 bp, H. sapiens
attttgtggaaaaaaa

SEQ ID NO: 58205 - DNA, 16 bp, H. sapiens
attttgtggagaattt

SEQ ID NO: 58206 - DNA, 16 bp, H. sapiens
attttgtggaggattt

SEQ ID NO: 58207 - DNA, 16 bp, H. sapiens
attttgtggcctatca

SEQ ID NO: 58208 - DNA, 16 bp, H. sapiens
attttgtggctggttt

SEQ ID NO: 58209 - DNA, 16 bp, H. sapiens
attttgtgggtacata

SEQ ID NO: 58210 - DNA, 16 bp, H. sapiens
attttgtggtaatttg

SEQ ID NO: 58211 - DNA, 16 bp, H. sapiens
attttgtgtacatttt

SEQ ID NO: 58212 - DNA, 16 bp, H. sapiens
attttgtgtatccatt

SEQ ID NO: 58213 - DNA, 16 bp, H. sapiens
attttgtgtcttttaa

SEQ ID NO: 58214 - DNA, 16 bp, H. sapiens
attttgtgtcttttga

SEQ ID NO: 58215 - DNA, 16 bp, H. sapiens
attttgtgtggacata

SEQ ID NO: 58216 - DNA, 16 bp, H. sapiens
attttgtgttttagaa

SEQ ID NO: 58217 - DNA, 16 bp, H. sapiens
attttgtgttttcaaa

SEQ ID NO: 58218 - DNA, 16 bp, H. sapiens
attttgttaaagcagc

SEQ ID NO: 58219 - DNA, 16 bp, H. sapiens
attttgttaaatgaaa

SEQ ID NO: 58220 - DNA, 16 bp, H. sapiens
attttgttaatcattt

SEQ ID NO: 58221 - DNA, 16 bp, H. sapiens
attttgttacagcagc

SEQ ID NO: 58222 - DNA, 16 bp, H. sapiens
attttgttacatttat

SEQ ID NO: 58223 - DNA, 16 bp, H. sapiens
attttgttagaaaaat

SEQ ID NO: 58224 - DNA, 16 bp, H. sapiens
attttgttatagcagc

SEQ ID NO: 58225 - DNA, 16 bp, H. sapiens
attttgttattccttg

SEQ ID NO: 58226 - DNA, 16 bp, H. sapiens
attttgttcactgata

SEQ ID NO: 58227 - DNA, 16 bp, H. sapiens
attttgttcactgcta

SEQ ID NO: 58228 - DNA, 16 bp, H. sapiens
attttgttcagttttg

SEQ ID NO: 58229 - DNA, 16 bp, H. sapiens
attttgttcatctatt

SEQ ID NO: 58230 - DNA, 16 bp, H. sapiens
attttgttcatttaaa

SEQ ID NO: 58231 - DNA, 16 bp, H. sapiens
attttgttccagcaaa

SEQ ID NO: 58232 - DNA, 16 bp, H. sapiens
attttgttccattcat

SEQ ID NO: 58233 - DNA, 16 bp, H. sapiens
attttgttccttttca

SEQ ID NO: 58234 - DNA, 16 bp, H. sapiens
attttgttgaaaaatt

SEQ ID NO: 58235 - DNA, 16 bp, H. sapiens
attttgttgaaataaa

SEQ ID NO: 58236 - DNA, 16 bp, H. sapiens
attttgttgagacaga

SEQ ID NO: 58237 - DNA, 16 bp, H. sapiens
attttgttgagagttt

SEQ ID NO: 58238 - DNA, 16 bp, H. sapiens
attttgttgattgtct

SEQ ID NO: 58239 - DNA, 16 bp, H. sapiens
attttgtttaaaatga

SEQ ID NO: 58240 - DNA, 16 bp, H. sapiens
attttgtttaaccatt

SEQ ID NO: 58241 - DNA, 16 bp, H. sapiens
attttgtttacaaata

SEQ ID NO: 58242 - DNA, 16 bp, H. sapiens
attttgtttacccatt

SEQ ID NO: 58243 - DNA, 16 bp, H. sapiens
attttgtttcaaaatg

SEQ ID NO: 58244 - DNA, 16 bp, H. sapiens
attttgtttcaatatt

SEQ ID NO: 58245 - DNA, 16 bp, H. sapiens
attttgtttcagagtt

SEQ ID NO: 58246 - DNA, 16 bp, H. sapiens
attttgtttcatttaa

SEQ ID NO: 58247 - DNA, 16 bp, H. sapiens
attttgtttcatttcc

SEQ ID NO: 58248 - DNA, 16 bp, H. sapiens
attttgtttcctttgg

SEQ ID NO: 58249 - DNA, 16 bp, H. sapiens
attttgtttctaaaat

SEQ ID NO: 58250 - DNA, 16 bp, H. sapiens
attttgtttctaaata

SEQ ID NO: 58251 - DNA, 16 bp, H. sapiens
attttgtttcttaaaa

SEQ ID NO: 58252 - DNA, 16 bp, H. sapiens
attttgtttctttgaa

SEQ ID NO: 58253 - DNA, 16 bp, H. sapiens
attttgtttgtccatt

SEQ ID NO: 58254 - DNA, 16 bp, H. sapiens
attttgttttcaaaag

SEQ ID NO: 58255 - DNA, 16 bp, H. sapiens
attttgttttcaaaat

SEQ ID NO: 58256 - DNA, 16 bp, H. sapiens
attttgttttctaaaa

SEQ ID NO: 58257 - DNA, 16 bp, H. sapiens
attttgttttctgaaa

SEQ ID NO: 58258 - DNA, 16 bp, H. sapiens
attttgttttgagaca

SEQ ID NO: 58259 - DNA, 16 bp, H. sapiens
attttgtttttagaga

SEQ ID NO: 58260 - DNA, 16 bp, H. sapiens
attttgttttttcaaa

SEQ ID NO: 58261 - DNA, 16 bp, H. sapiens
atttttaaaaaacact

SEQ ID NO: 58262 - DNA, 16 bp, H. sapiens
atttttaaaaaaccat

SEQ ID NO: 58263 - DNA, 16 bp, H. sapiens
atttttaaaaaatcca

SEQ ID NO: 58264 - DNA, 16 bp, H. sapiens
atttttaaaaaatgtc

SEQ ID NO: 58265 - DNA, 16 bp, H. sapiens
atttttaaaaaccaga

SEQ ID NO: 58266 - DNA, 16 bp, H. sapiens
atttttaaaaactttc

SEQ ID NO: 58267 - DNA, 16 bp, H. sapiens
atttttaaaaagaagt

SEQ ID NO: 58268 - DNA, 16 bp, H. sapiens
atttttaaaaagacaa

SEQ ID NO: 58269 - DNA, 16 bp, H. sapiens
atttttaaaaagagag

SEQ ID NO: 58270 - DNA, 16 bp, H. sapiens
atttttaaaaagagca

SEQ ID NO: 58271 - DNA, 16 bp, H. sapiens
atttttaaaaagcatt

SEQ ID NO: 58272 - DNA, 16 bp, H. sapiens
atttttaaaaaggata

SEQ ID NO: 58273 - DNA, 16 bp, H. sapiens
atttttaaaaagtaga

SEQ ID NO: 58274 - DNA, 16 bp, H. sapiens
atttttaaaaagtcat

SEQ ID NO: 58275 - DNA, 16 bp, H. sapiens
atttttaaaaagtgtg

SEQ ID NO: 58276 - DNA, 16 bp, H. sapiens
atttttaaaaagtgtt

SEQ ID NO: 58277 - DNA, 16 bp, H. sapiens
atttttaaaaatacct

SEQ ID NO: 58278 - DNA, 16 bp, H. sapiens
atttttaaaaatcaac

SEQ ID NO: 58279 - DNA, 16 bp, H. sapiens
atttttaaaaatcaga

SEQ ID NO: 58280 - DNA, 16 bp, H. sapiens
atttttaaaaatcagt

SEQ ID NO: 58281 - DNA, 16 bp, H. sapiens
atttttaaaaatgtct

SEQ ID NO: 58282 - DNA, 16 bp, H. sapiens
atttttaaaaatgtga

SEQ ID NO: 58283 - DNA, 16 bp, H. sapiens
atttttaaaacaagtt

SEQ ID NO: 58284 - DNA, 16 bp, H. sapiens
atttttaaaacagttt

SEQ ID NO: 58285 - DNA, 16 bp, H. sapiens
atttttaaaacctaaa

SEQ ID NO: 58286 - DNA, 16 bp, H. sapiens
atttttaaaactacat

SEQ ID NO: 58287 - DNA, 16 bp, H. sapiens
atttttaaaactcaaa

SEQ ID NO: 58288 - DNA, 16 bp, H. sapiens
atttttaaaactcccc

SEQ ID NO: 58289 - DNA, 16 bp, H. sapiens
atttttaaaactctgt

SEQ ID NO: 58290 - DNA, 16 bp, H. sapiens
atttttaaaacttcaa

SEQ ID NO: 58291 - DNA, 16 bp, H. sapiens
atttttaaaagccaaa

SEQ ID NO: 58292 - DNA, 16 bp, H. sapiens
atttttaaaagccaga

SEQ ID NO: 58293 - DNA, 16 bp, H. sapiens
atttttaaaagccttt

SEQ ID NO: 58294 - DNA, 16 bp, H. sapiens
atttttaaaagctata

SEQ ID NO: 58295 - DNA, 16 bp, H. sapiens
atttttaaaagggaaa

SEQ ID NO: 58296 - DNA, 16 bp, H. sapiens
atttttaaaataggga

SEQ ID NO: 58297 - DNA, 16 bp, H. sapiens
atttttaaaatagtgt

SEQ ID NO: 58298 - DNA, 16 bp, H. sapiens
atttttaaaatccaaa

SEQ ID NO: 58299 - DNA, 16 bp, H. sapiens
atttttaaaatgacta

SEQ ID NO: 58300 - DNA, 16 bp, H. sapiens
atttttaaaatgcttt

SEQ ID NO: 58301 - DNA, 16 bp, H. sapiens
atttttaaaatgtaca

SEQ ID NO: 58302 - DNA, 16 bp, H. sapiens
atttttaaaatgtgaa

SEQ ID NO: 58303 - DNA, 16 bp, H. sapiens
atttttaaacacacac

SEQ ID NO: 58304 - DNA, 16 bp, H. sapiens
atttttaaacattttg

SEQ ID NO: 58305 - DNA, 16 bp, H. sapiens
atttttaaaccaaata

SEQ ID NO: 58306 - DNA, 16 bp, H. sapiens
atttttaaactggaaa

SEQ ID NO: 58307 - DNA, 16 bp, H. sapiens
atttttaaactgtaaa

SEQ ID NO: 58308 - DNA, 16 bp, H. sapiens
atttttaaagaaattc

SEQ ID NO: 58309 - DNA, 16 bp, H. sapiens
atttttaaagaacaaa

SEQ ID NO: 58310 - DNA, 16 bp, H. sapiens
atttttaaagaactct

SEQ ID NO: 58311 - DNA, 16 bp, H. sapiens
atttttaaagaagaat

SEQ ID NO: 58312 - DNA, 16 bp, H. sapiens
atttttaaagaatcaa

SEQ ID NO: 58313 - DNA, 16 bp, H. sapiens
atttttaaagaattag

SEQ ID NO: 58314 - DNA, 16 bp, H. sapiens
atttttaaagagattt

SEQ ID NO: 58315 - DNA, 16 bp, H. sapiens
atttttaaagagtaaa

SEQ ID NO: 58316 - DNA, 16 bp, H. sapiens
atttttaaagagttgt

SEQ ID NO: 58317 - DNA, 16 bp, H. sapiens
atttttaaagatgaaa

SEQ ID NO: 58318 - DNA, 16 bp, H. sapiens
atttttaaagatgaga

SEQ ID NO: 58319 - DNA, 16 bp, H. sapiens
atttttaaagatttag

SEQ ID NO: 58320 - DNA, 16 bp, H. sapiens
atttttaaagctcttt

SEQ ID NO: 58321 - DNA, 16 bp, H. sapiens
atttttaaagcttttg

SEQ ID NO: 58322 - DNA, 16 bp, H. sapiens
atttttaaaggaagat

SEQ ID NO: 58323 - DNA, 16 bp, H. sapiens
atttttaaaggaattt

SEQ ID NO: 58324 - DNA, 16 bp, H. sapiens
atttttaaaggacaaa

SEQ ID NO: 58325 - DNA, 16 bp, H. sapiens
atttttaaaggcaaaa

SEQ ID NO: 58326 - DNA, 16 bp, H. sapiens
atttttaaaggcatta

SEQ ID NO: 58327 - DNA, 16 bp, H. sapiens
atttttaaaggctgaa

SEQ ID NO: 58328 - DNA, 16 bp, H. sapiens
atttttaaaggtgaaa

SEQ ID NO: 58329 - DNA, 16 bp, H. sapiens
atttttaaagtaaaca

SEQ ID NO: 58330 - DNA, 16 bp, H. sapiens
atttttaaagtctctt

SEQ ID NO: 58331 - DNA, 16 bp, H. sapiens
atttttaaagttactt

SEQ ID NO: 58332 - DNA, 16 bp, H. sapiens
atttttaaatagtgaa

SEQ ID NO: 58333 - DNA, 16 bp, H. sapiens
atttttaaatatactg

SEQ ID NO: 58334 - DNA, 16 bp, H. sapiens
atttttaaatattctg

SEQ ID NO: 58335 - DNA, 16 bp, H. sapiens
atttttaaatcttcct

SEQ ID NO: 58336 - DNA, 16 bp, H. sapiens
atttttaaatgattgg

SEQ ID NO: 58337 - DNA, 16 bp, H. sapiens
atttttaaatggctaa

SEQ ID NO: 58338 - DNA, 16 bp, H. sapiens
atttttaaatggtaaa

SEQ ID NO: 58339 - DNA, 16 bp, H. sapiens
atttttaaatgtgtgt

SEQ ID NO: 58340 - DNA, 16 bp, H. sapiens
atttttaaatgttcat

SEQ ID NO: 58341 - DNA, 16 bp, H. sapiens
atttttaacaaaagta

SEQ ID NO: 58342 - DNA, 16 bp, H. sapiens
atttttaacagaaaag

SEQ ID NO: 58343 - DNA, 16 bp, H. sapiens
atttttaacagagaag

SEQ ID NO: 58344 - DNA, 16 bp, H. sapiens
atttttaacccaaaat

SEQ ID NO: 58345 - DNA, 16 bp, H. sapiens
atttttaacttgaaaa

SEQ ID NO: 58346 - DNA, 16 bp, H. sapiens
atttttaactttatga

SEQ ID NO: 58347 - DNA, 16 bp, H. sapiens
atttttaactttgtat

SEQ ID NO: 58348 - DNA, 16 bp, H. sapiens
atttttaagaaatcat

SEQ ID NO: 58349 - DNA, 16 bp, H. sapiens
atttttaagaactttt

SEQ ID NO: 58350 - DNA, 16 bp, H. sapiens
atttttaagagaaatt

SEQ ID NO: 58351 - DNA, 16 bp, H. sapiens
atttttaagagaatta

SEQ ID NO: 58352 - DNA, 16 bp, H. sapiens
atttttaagcaaaaga

SEQ ID NO: 58353 - DNA, 16 bp, H. sapiens
atttttaagtacacaa

SEQ ID NO: 58354 - DNA, 16 bp, H. sapiens
atttttaagtacattt

SEQ ID NO: 58355 - DNA, 16 bp, H. sapiens
atttttaagtgaaaaa

SEQ ID NO: 58356 - DNA, 16 bp, H. sapiens
atttttaagtgaaaat

SEQ ID NO: 58357 - DNA, 16 bp, H. sapiens
atttttaagtgataaa

SEQ ID NO: 58358 - DNA, 16 bp, H. sapiens
atttttaataaacaca

SEQ ID NO: 58359 - DNA, 16 bp, H. sapiens
atttttaataatctgt

SEQ ID NO: 58360 - DNA, 16 bp, H. sapiens
atttttaatagctgta

SEQ ID NO: 58361 - DNA, 16 bp, H. sapiens
atttttaatgaaagaa

SEQ ID NO: 58362 - DNA, 16 bp, H. sapiens
atttttaatgaacatt

SEQ ID NO: 58363 - DNA, 16 bp, H. sapiens
atttttaatgaataca

SEQ ID NO: 58364 - DNA, 16 bp, H. sapiens
atttttaatgatttct

SEQ ID NO: 58365 - DNA, 16 bp, H. sapiens
atttttaatggaaaga

SEQ ID NO: 58366 - DNA, 16 bp, H. sapiens
atttttaatggacaca

SEQ ID NO: 58367 - DNA, 16 bp, H. sapiens
atttttaatgggaaaa

SEQ ID NO: 58368 - DNA, 16 bp, H. sapiens
atttttaatgtaaaca

SEQ ID NO: 58369 - DNA, 16 bp, H. sapiens
atttttaattgacaaa

SEQ ID NO: 58370 - DNA, 16 bp, H. sapiens
atttttaatttctgaa

SEQ ID NO: 58371 - DNA, 16 bp, H. sapiens
atttttaatttgcatt

SEQ ID NO: 58372 - DNA, 16 bp, H. sapiens
atttttacaaaaacat

SEQ ID NO: 58373 - DNA, 16 bp, H. sapiens
atttttacaaagaaaa

SEQ ID NO: 58374 - DNA, 16 bp, H. sapiens
atttttacaaagattt

SEQ ID NO: 58375 - DNA, 16 bp, H. sapiens
atttttacaaatgtgt

SEQ ID NO: 58376 - DNA, 16 bp, H. sapiens
atttttacaatattga

SEQ ID NO: 58377 - DNA, 16 bp, H. sapiens
atttttacacaaaata

SEQ ID NO: 58378 - DNA, 16 bp, H. sapiens
atttttacacatatat

SEQ ID NO: 58379 - DNA, 16 bp, H. sapiens
atttttacaccaaata

SEQ ID NO: 58380 - DNA, 16 bp, H. sapiens
atttttacagatattt

SEQ ID NO: 58381 - DNA, 16 bp, H. sapiens
atttttacatgttaat

SEQ ID NO: 58382 - DNA, 16 bp, H. sapiens
atttttacatttatgt

SEQ ID NO: 58383 - DNA, 16 bp, H. sapiens
atttttactatacctt

SEQ ID NO: 58384 - DNA, 16 bp, H. sapiens
atttttacttggaaaa

SEQ ID NO: 58385 - DNA, 16 bp, H. sapiens
atttttactttagaaa

SEQ ID NO: 58386 - DNA, 16 bp, H. sapiens
atttttagaaaagaca

SEQ ID NO: 58387 - DNA, 16 bp, H. sapiens
atttttagaaaatcat

SEQ ID NO: 58388 - DNA, 16 bp, H. sapiens
atttttagaaacaaaa

SEQ ID NO: 58389 - DNA, 16 bp, H. sapiens
atttttagaaagtatt

SEQ ID NO: 58390 - DNA, 16 bp, H. sapiens
atttttagaaataaga

SEQ ID NO: 58391 - DNA, 16 bp, H. sapiens
atttttagaaatcaat

SEQ ID NO: 58392 - DNA, 16 bp, H. sapiens
atttttagaaatgtta

SEQ ID NO: 58393 - DNA, 16 bp, H. sapiens
atttttagaagaattt

SEQ ID NO: 58394 - DNA, 16 bp, H. sapiens
atttttagaaggaaaa

SEQ ID NO: 58395 - DNA, 16 bp, H. sapiens
atttttagacattttt

SEQ ID NO: 58396 - DNA, 16 bp, H. sapiens
atttttagaccaatat

SEQ ID NO: 58397 - DNA, 16 bp, H. sapiens
atttttagagacaagg

SEQ ID NO: 58398 - DNA, 16 bp, H. sapiens
atttttagagtaaaaa

SEQ ID NO: 58399 - DNA, 16 bp, H. sapiens
atttttagatactttt

SEQ ID NO: 58400 - DNA, 16 bp, H. sapiens
atttttagatatttct

SEQ ID NO: 58401 - DNA, 16 bp, H. sapiens
atttttagatgaagaa

SEQ ID NO: 58402 - DNA, 16 bp, H. sapiens
atttttagatgagatt

SEQ ID NO: 58403 - DNA, 16 bp, H. sapiens
atttttagcaaattta

SEQ ID NO: 58404 - DNA, 16 bp, H. sapiens
atttttagcatatttt

SEQ ID NO: 58405 - DNA, 16 bp, H. sapiens
atttttagcattaaaa

SEQ ID NO: 58406 - DNA, 16 bp, H. sapiens
atttttagctttatgc

SEQ ID NO: 58407 - DNA, 16 bp, H. sapiens
atttttaggctgggcg

SEQ ID NO: 58408 - DNA, 16 bp, H. sapiens
atttttaggggaaaaa

SEQ ID NO: 58409 - DNA, 16 bp, H. sapiens
atttttaggtaaagtt

SEQ ID NO: 58410 - DNA, 16 bp, H. sapiens
atttttagtaaagaag

SEQ ID NO: 58411 - DNA, 24 bp, H. sapiens
atttttagtagagacagggtttcg

SEQ ID NO: 58412 - DNA, 32 bp, H. sapiens
atttttagtagagacggggtttcaccatgtta

SEQ ID NO: 58413 - DNA, 16 bp, H. sapiens
atttttagtaggcaca

SEQ ID NO: 58414 - DNA, 16 bp, H. sapiens
atttttagtagtgaaa

SEQ ID NO: 58415 - DNA, 16 bp, H. sapiens
atttttagtgaaaaat

SEQ ID NO: 58416 - DNA, 16 bp, H. sapiens
atttttagtggaaatg

SEQ ID NO: 58417 - DNA, 16 bp, H. sapiens
atttttagtggagttg

SEQ ID NO: 58418 - DNA, 16 bp, H. sapiens
atttttagttctttga

SEQ ID NO: 58419 - DNA, 16 bp, H. sapiens
atttttataaaacaag

SEQ ID NO: 58420 - DNA, 16 bp, H. sapiens
atttttataaaactca

SEQ ID NO: 58421 - DNA, 16 bp, H. sapiens
atttttataaagatgg

SEQ ID NO: 58422 - DNA, 16 bp, H. sapiens
atttttataagagaaa

SEQ ID NO: 58423 - DNA, 16 bp, H. sapiens
atttttatacagaaaa

SEQ ID NO: 58424 - DNA, 16 bp, H. sapiens
atttttatacatgttt

SEQ ID NO: 58425 - DNA, 16 bp, H. sapiens
atttttatacttttag

SEQ ID NO: 58426 - DNA, 16 bp, H. sapiens
atttttatagaagaaa

SEQ ID NO: 58427 - DNA, 16 bp, H. sapiens
atttttatagagatgg

SEQ ID NO: 58428 - DNA, 16 bp, H. sapiens
atttttatagcattta

SEQ ID NO: 58429 - DNA, 16 bp, H. sapiens
atttttatagcatttt

SEQ ID NO: 58430 - DNA, 16 bp, H. sapiens
atttttataggaattg

SEQ ID NO: 58431 - DNA, 16 bp, H. sapiens
atttttatagtcattt

SEQ ID NO: 58432 - DNA, 16 bp, H. sapiens
atttttatataccaat

SEQ ID NO: 58433 - DNA, 16 bp, H. sapiens
atttttatatgccaat

SEQ ID NO: 58434 - DNA, 16 bp, H. sapiens
atttttatcaaatgtt

SEQ ID NO: 58435 - DNA, 16 bp, H. sapiens
atttttatcacctcaa

SEQ ID NO: 58436 - DNA, 16 bp, H. sapiens
atttttatcatgaatt

SEQ ID NO: 58437 - DNA, 16 bp, H. sapiens
atttttatccaaaata

SEQ ID NO: 58438 - DNA, 16 bp, H. sapiens
atttttatccagtttt

SEQ ID NO: 58439 - DNA, 16 bp, H. sapiens
atttttatcttagaaa

SEQ ID NO: 58440 - DNA, 16 bp, H. sapiens
atttttatgaaaagta

SEQ ID NO: 58441 - DNA, 16 bp, H. sapiens
atttttatgaaagaaa

SEQ ID NO: 58442 - DNA, 16 bp, H. sapiens
atttttatgaacattt

SEQ ID NO: 58443 - DNA, 16 bp, H. sapiens
atttttatgactatat

SEQ ID NO: 58444 - DNA, 16 bp, H. sapiens
atttttatgatgatga

SEQ ID NO: 58445 - DNA, 16 bp, H. sapiens
atttttatgcataaaa

SEQ ID NO: 58446 - DNA, 16 bp, H. sapiens
atttttatggctgtat

SEQ ID NO: 58447 - DNA, 16 bp, H. sapiens
atttttatggttactt

SEQ ID NO: 58448 - DNA, 16 bp, H. sapiens
atttttatgtcaaaat

SEQ ID NO: 58449 - DNA, 16 bp, H. sapiens
atttttatgtgaaaat

SEQ ID NO: 58450 - DNA, 16 bp, H. sapiens
atttttattaaagaca

SEQ ID NO: 58451 - DNA, 16 bp, H. sapiens
atttttattactcaaa

SEQ ID NO: 58452 - DNA, 16 bp, H. sapiens
atttttattagcaaaa

SEQ ID NO: 58453 - DNA, 16 bp, H. sapiens
atttttattagcattt

SEQ ID NO: 58454 - DNA, 16 bp, H. sapiens
atttttattagctaaa

SEQ ID NO: 58455 - DNA, 16 bp, H. sapiens
atttttattatgcatt

SEQ ID NO: 58456 - DNA, 16 bp, H. sapiens
atttttatttcagatt

SEQ ID NO: 58457 - DNA, 16 bp, H. sapiens
atttttatttctagaa

SEQ ID NO: 58458 - DNA, 16 bp, H. sapiens
atttttatttctgcct

SEQ ID NO: 58459 - DNA, 16 bp, H. sapiens
atttttatttgaaaga

SEQ ID NO: 58460 - DNA, 16 bp, H. sapiens
atttttatttgcaaaa

SEQ ID NO: 58461 - DNA, 16 bp, H. sapiens
atttttatttgcactt

SEQ ID NO: 58462 - DNA, 16 bp, H. sapiens
atttttcaaaaaatgt

SEQ ID NO: 58463 - DNA, 16 bp, H. sapiens
atttttcaaaagacaa

SEQ ID NO: 58464 - DNA, 16 bp, H. sapiens
atttttcaaaagcaga

SEQ ID NO: 58465 - DNA, 16 bp, H. sapiens
atttttcaaaatattg

SEQ ID NO: 58466 - DNA, 16 bp, H. sapiens
atttttcaaaatgttt

SEQ ID NO: 58467 - DNA, 16 bp, H. sapiens
atttttcaaagaaaaa

SEQ ID NO: 58468 - DNA, 16 bp, H. sapiens
atttttcaaagaaaat

SEQ ID NO: 58469 - DNA, 16 bp, H. sapiens
atttttcaaagatttt

SEQ ID NO: 58470 - DNA, 16 bp, H. sapiens
atttttcaaataaaca

SEQ ID NO: 58471 - DNA, 16 bp, H. sapiens
atttttcaaatgagaa

SEQ ID NO: 58472 - DNA, 16 bp, H. sapiens
atttttcaaattacat

SEQ ID NO: 58473 - DNA, 16 bp, H. sapiens
atttttcaacaaatat

SEQ ID NO: 58474 - DNA, 16 bp, H. sapiens
atttttcaacatttaa

SEQ ID NO: 58475 - DNA, 16 bp, H. sapiens
atttttcaactttatg

SEQ ID NO: 58476 - DNA, 16 bp, H. sapiens
atttttcaagaaaaaa

SEQ ID NO: 58477 - DNA, 16 bp, H. sapiens
atttttcaagagaagc

SEQ ID NO: 58478 - DNA, 16 bp, H. sapiens
atttttcaaggaactt

SEQ ID NO: 58479 - DNA, 16 bp, H. sapiens
atttttcaagttttct

SEQ ID NO: 58480 - DNA, 16 bp, H. sapiens
atttttcaatgttatt

SEQ ID NO: 58481 - DNA, 16 bp, H. sapiens
atttttcaattccaga

SEQ ID NO: 58482 - DNA, 16 bp, H. sapiens
atttttcacatttttg

SEQ ID NO: 58483 - DNA, 16 bp, H. sapiens
atttttcaccaaaaaa

SEQ ID NO: 58484 - DNA, 16 bp, H. sapiens
atttttcactgctctg

SEQ ID NO: 58485 - DNA, 16 bp, H. sapiens
atttttcagaaatgaa

SEQ ID NO: 58486 - DNA, 16 bp, H. sapiens
atttttcagaaattat

SEQ ID NO: 58487 - DNA, 16 bp, H. sapiens
atttttcagaaggaaa

SEQ ID NO: 58488 - DNA, 16 bp, H. sapiens
atttttcagaattttt

SEQ ID NO: 58489 - DNA, 16 bp, H. sapiens
atttttcagacaaaaa

SEQ ID NO: 58490 - DNA, 16 bp, H. sapiens
atttttcagataagga

SEQ ID NO: 58491 - DNA, 16 bp, H. sapiens
atttttcagatatttt

SEQ ID NO: 58492 - DNA, 16 bp, H. sapiens
atttttcagatgaaga

SEQ ID NO: 58493 - DNA, 16 bp, H. sapiens
atttttcagatgatga

SEQ ID NO: 58494 - DNA, 16 bp, H. sapiens
atttttcagatggaaa

SEQ ID NO: 58495 - DNA, 16 bp, H. sapiens
atttttcagatgtttt

SEQ ID NO: 58496 - DNA, 16 bp, H. sapiens
atttttcagattaaaa

SEQ ID NO: 58497 - DNA, 16 bp, H. sapiens
atttttcagattgttt

SEQ ID NO: 58498 - DNA, 16 bp, H. sapiens
atttttcagcttttct

SEQ ID NO: 58499 - DNA, 16 bp, H. sapiens
atttttcagtgaaaaa

SEQ ID NO: 58500 - DNA, 16 bp, H. sapiens
atttttcagtgtttct

SEQ ID NO: 58501 - DNA, 16 bp, H. sapiens
atttttcagtttcctt

SEQ ID NO: 58502 - DNA, 16 bp, H. sapiens
atttttcataaaatgt

SEQ ID NO: 58503 - DNA, 16 bp, H. sapiens
atttttcataaagaca

SEQ ID NO: 58504 - DNA, 16 bp, H. sapiens
atttttcatagagatg

SEQ ID NO: 58505 - DNA, 16 bp, H. sapiens
atttttcatagtttta

SEQ ID NO: 58506 - DNA, 16 bp, H. sapiens
atttttcatcaatgtt

SEQ ID NO: 58507 - DNA, 16 bp, H. sapiens
atttttcatcagaaac

SEQ ID NO: 58508 - DNA, 16 bp, H. sapiens
atttttcatctatgtt

SEQ ID NO: 58509 - DNA, 16 bp, H. sapiens
atttttcatcttcaaa

SEQ ID NO: 58510 - DNA, 16 bp, H. sapiens
atttttcatgttaatt

SEQ ID NO: 58511 - DNA, 16 bp, H. sapiens
atttttcattaaacat

SEQ ID NO: 58512 - DNA, 16 bp, H. sapiens
atttttcattagaaaa

SEQ ID NO: 58513 - DNA, 16 bp, H. sapiens
atttttcattgtcaca

SEQ ID NO: 58514 - DNA, 16 bp, H. sapiens
atttttcatttcagtt

SEQ ID NO: 58515 - DNA, 16 bp, H. sapiens
atttttcatttgaaat

SEQ ID NO: 58516 - DNA, 16 bp, H. sapiens
atttttccaaaaaaga

SEQ ID NO: 58517 - DNA, 16 bp, H. sapiens
atttttccaaaaagaa

SEQ ID NO: 58518 - DNA, 16 bp, H. sapiens
atttttccaaagaaga

SEQ ID NO: 58519 - DNA, 16 bp, H. sapiens
atttttccaagagaaa

SEQ ID NO: 58520 - DNA, 16 bp, H. sapiens
atttttccaggaatgt

SEQ ID NO: 58521 - DNA, 16 bp, H. sapiens
atttttccatataaat

SEQ ID NO: 58522 - DNA, 16 bp, H. sapiens
atttttccatatgctt

SEQ ID NO: 58523 - DNA, 16 bp, H. sapiens
atttttccatcttttg

SEQ ID NO: 58524 - DNA, 16 bp, H. sapiens
atttttccatggacag

SEQ ID NO: 58525 - DNA, 16 bp, H. sapiens
atttttccattaaaaa

SEQ ID NO: 58526 - DNA, 16 bp, H. sapiens
atttttccatttaaaa

SEQ ID NO: 58527 - DNA, 16 bp, H. sapiens
atttttccattttaga

SEQ ID NO: 58528 - DNA, 16 bp, H. sapiens
atttttcccatctgta

SEQ ID NO: 58529 - DNA, 16 bp, H. sapiens
atttttccccttaaaa

SEQ ID NO: 58530 - DNA, 16 bp, H. sapiens
atttttcctctttaaa

SEQ ID NO: 58531 - DNA, 16 bp, H. sapiens
atttttcctgctttct

SEQ ID NO: 58532 - DNA, 16 bp, H. sapiens
atttttcctgttgatt

SEQ ID NO: 58533 - DNA, 16 bp, H. sapiens
atttttcctgttttaa

SEQ ID NO: 58534 - DNA, 16 bp, H. sapiens
atttttccttaaaata

SEQ ID NO: 58535 - DNA, 16 bp, H. sapiens
atttttccttcctctg

SEQ ID NO: 58536 - DNA, 16 bp, H. sapiens
atttttcctttctaaa

SEQ ID NO: 58537 - DNA, 16 bp, H. sapiens
atttttctaaaagttt

SEQ ID NO: 58538 - DNA, 16 bp, H. sapiens
atttttctaaaataca

SEQ ID NO: 58539 - DNA, 16 bp, H. sapiens
atttttctaaagaaaa

SEQ ID NO: 58540 - DNA, 20 bp, H. sapiens
atttttctaacctgcctcca

SEQ ID NO: 58541 - DNA, 16 bp, H. sapiens
atttttctaagagaaa

SEQ ID NO: 58542 - DNA, 16 bp, H. sapiens
atttttctaagccaat

SEQ ID NO: 58543 - DNA, 16 bp, H. sapiens
atttttctaagtattt

SEQ ID NO: 58544 - DNA, 16 bp, H. sapiens
atttttctaagtgttt

SEQ ID NO: 58545 - DNA, 16 bp, H. sapiens
atttttctactttaca

SEQ ID NO: 58546 - DNA, 16 bp, H. sapiens
atttttctagaaaata

SEQ ID NO: 58547 - DNA, 16 bp, H. sapiens
atttttctaggaaaaa

SEQ ID NO: 58548 - DNA, 16 bp, H. sapiens
atttttctagtagaga

SEQ ID NO: 58549 - DNA, 16 bp, H. sapiens
atttttctattagatt

SEQ ID NO: 58550 - DNA, 16 bp, H. sapiens
atttttctcaaaatat

SEQ ID NO: 58551 - DNA, 16 bp, H. sapiens
atttttctcaaagaaa

SEQ ID NO: 58552 - DNA, 16 bp, H. sapiens
atttttctcagatatt

SEQ ID NO: 58553 - DNA, 16 bp, H. sapiens
atttttctcatataaa

SEQ ID NO: 58554 - DNA, 16 bp, H. sapiens
atttttctcatctgta

SEQ ID NO: 58555 - DNA, 16 bp, H. sapiens
atttttctccataaat

SEQ ID NO: 58556 - DNA, 16 bp, H. sapiens
atttttctcccaaaat

SEQ ID NO: 58557 - DNA, 16 bp, H. sapiens
atttttctctcaaatt

SEQ ID NO: 58558 - DNA, 16 bp, H. sapiens
atttttctctgaaatt

SEQ ID NO: 58559 - DNA, 16 bp, H. sapiens
atttttctcttaaaaa

SEQ ID NO: 58560 - DNA, 16 bp, H. sapiens
atttttctctttcagt

SEQ ID NO: 58561 - DNA, 16 bp, H. sapiens
atttttctctttgcat

SEQ ID NO: 58562 - DNA, 16 bp, H. sapiens
atttttctgaaatatt

SEQ ID NO: 58563 - DNA, 16 bp, H. sapiens
atttttctgacaaaat

SEQ ID NO: 58564 - DNA, 16 bp, H. sapiens
atttttctgcctttta

SEQ ID NO: 58565 - DNA, 16 bp, H. sapiens
atttttctgtaatatt

SEQ ID NO: 58566 - DNA, 16 bp, H. sapiens
atttttctgtatatat

SEQ ID NO: 58567 - DNA, 16 bp, H. sapiens
atttttctgtatctat

SEQ ID NO: 58568 - DNA, 16 bp, H. sapiens
atttttctgtcattta

SEQ ID NO: 58569 - DNA, 16 bp, H. sapiens
atttttctgtgtgtgt

SEQ ID NO: 58570 - DNA, 16 bp, H. sapiens
atttttctgttcaaaa

SEQ ID NO: 58571 - DNA, 16 bp, H. sapiens
atttttctgttcttca

SEQ ID NO: 58572 - DNA, 16 bp, H. sapiens
atttttctgttttgca

SEQ ID NO: 58573 - DNA, 16 bp, H. sapiens
atttttcttaagaaat

SEQ ID NO: 58574 - DNA, 16 bp, H. sapiens
atttttcttaatagaa

SEQ ID NO: 58575 - DNA, 16 bp, H. sapiens
atttttcttagagaca

SEQ ID NO: 58576 - DNA, 16 bp, H. sapiens
atttttcttcataaca

SEQ ID NO: 58577 - DNA, 16 bp, H. sapiens
atttttcttctgtgaa

SEQ ID NO: 58578 - DNA, 16 bp, H. sapiens
atttttcttgaacttt

SEQ ID NO: 58579 - DNA, 16 bp, H. sapiens
atttttcttggaaaaa

SEQ ID NO: 58580 - DNA, 16 bp, H. sapiens
atttttctttaaatga

SEQ ID NO: 58581 - DNA, 16 bp, H. sapiens
atttttctttaaatgt

SEQ ID NO: 58582 - DNA, 16 bp, H. sapiens
atttttctttaacaaa

SEQ ID NO: 58583 - DNA, 16 bp, H. sapiens
atttttctttaatgaa

SEQ ID NO: 58584 - DNA, 16 bp, H. sapiens
atttttctttacaaaa

SEQ ID NO: 58585 - DNA, 16 bp, H. sapiens
atttttctttccatca

SEQ ID NO: 58586 - DNA, 16 bp, H. sapiens
atttttctttcctcaa

SEQ ID NO: 58587 - DNA, 16 bp, H. sapiens
atttttctttctccaa

SEQ ID NO: 58588 - DNA, 16 bp, H. sapiens
atttttgaaaaaagtt

SEQ ID NO: 58589 - DNA, 16 bp, H. sapiens
atttttgaaaaacaaa

SEQ ID NO: 58590 - DNA, 16 bp, H. sapiens
atttttgaaaaataca

SEQ ID NO: 58591 - DNA, 16 bp, H. sapiens
atttttgaaaaatatg

SEQ ID NO: 58592 - DNA, 16 bp, H. sapiens
atttttgaaaaatgta

SEQ ID NO: 58593 - DNA, 16 bp, H. sapiens
atttttgaaaacattt

SEQ ID NO: 58594 - DNA, 16 bp, H. sapiens
atttttgaaaaggaaa

SEQ ID NO: 58595 - DNA, 16 bp, H. sapiens
atttttgaaaatgaaa

SEQ ID NO: 58596 - DNA, 16 bp, H. sapiens
atttttgaaaattgat

SEQ ID NO: 58597 - DNA, 16 bp, H. sapiens
atttttgaaatgataa

SEQ ID NO: 58598 - DNA, 16 bp, H. sapiens
atttttgaaatggaat

SEQ ID NO: 58599 - DNA, 16 bp, H. sapiens
atttttgaagaaaaag

SEQ ID NO: 58600 - DNA, 16 bp, H. sapiens
atttttgaatgaaaaa

SEQ ID NO: 58601 - DNA, 16 bp, H. sapiens
atttttgaatgagaaa

SEQ ID NO: 58602 - DNA, 16 bp, H. sapiens
atttttgacaagaatg

SEQ ID NO: 58603 - DNA, 16 bp, H. sapiens
atttttgacacatttt

SEQ ID NO: 58604 - DNA, 16 bp, H. sapiens
atttttgacagtttga

SEQ ID NO: 58605 - DNA, 16 bp, H. sapiens
atttttgacttaatga

SEQ ID NO: 58606 - DNA, 16 bp, H. sapiens
atttttgacttacaat

SEQ ID NO: 58607 - DNA, 16 bp, H. sapiens
atttttgagaaaagaa

SEQ ID NO: 58608 - DNA, 16 bp, H. sapiens
atttttgagacagaat

SEQ ID NO: 58609 - DNA, 16 bp, H. sapiens
atttttgagacagggt

SEQ ID NO: 58610 - DNA, 16 bp, H. sapiens
atttttgagactgagt

SEQ ID NO: 58611 - DNA, 18 bp, H. sapiens
atttttgagatggagtct

SEQ ID NO: 58612 - DNA, 22 bp, H. sapiens
atttttgagatggagtttcact

SEQ ID NO: 58613 - DNA, 16 bp, H. sapiens
atttttgagtcagggt

SEQ ID NO: 58614 - DNA, 16 bp, H. sapiens
atttttgatgcatttt

SEQ ID NO: 58615 - DNA, 16 bp, H. sapiens
atttttgcaaaagaaa

SEQ ID NO: 58616 - DNA, 16 bp, H. sapiens
atttttgcaaagatgg

SEQ ID NO: 58617 - DNA, 16 bp, H. sapiens
atttttgcaattaaaa

SEQ ID NO: 58618 - DNA, 17 bp, H. sapiens
atttttgcacactgatt

SEQ ID NO: 58619 - DNA, 16 bp, H. sapiens
atttttgcatatggtg

SEQ ID NO: 58620 - DNA, 16 bp, H. sapiens
atttttgcatcaacat

SEQ ID NO: 58621 - DNA, 16 bp, H. sapiens
atttttgcatgttgat

SEQ ID NO: 58622 - DNA, 16 bp, H. sapiens
atttttgcatgtttag

SEQ ID NO: 58623 - DNA, 16 bp, H. sapiens
atttttgcatttatgt

SEQ ID NO: 58624 - DNA, 16 bp, H. sapiens
atttttgccagcattt

SEQ ID NO: 58625 - DNA, 16 bp, H. sapiens
atttttgccatcttta

SEQ ID NO: 58626 - DNA, 16 bp, H. sapiens
atttttgccattttaa

SEQ ID NO: 58627 - DNA, 16 bp, H. sapiens
atttttgccttcattt

SEQ ID NO: 58628 - DNA, 16 bp, H. sapiens
atttttgctatttaaa

SEQ ID NO: 58629 - DNA, 16 bp, H. sapiens
atttttgctattttaa

SEQ ID NO: 58630 - DNA, 16 bp, H. sapiens
atttttgctccagaat

SEQ ID NO: 58631 - DNA, 16 bp, H. sapiens
atttttgcttcatata

SEQ ID NO: 58632 - DNA, 16 bp, H. sapiens
atttttgctttcattg

SEQ ID NO: 58633 - DNA, 16 bp, H. sapiens
atttttggaaaattct

SEQ ID NO: 58634 - DNA, 16 bp, H. sapiens
atttttggaaatatta

SEQ ID NO: 58635 - DNA, 16 bp, H. sapiens
atttttggaagatttt

SEQ ID NO: 58636 - DNA, 16 bp, H. sapiens
atttttggagaaatga

SEQ ID NO: 58637 - DNA, 16 bp, H. sapiens
atttttggaggaaaaa

SEQ ID NO: 58638 - DNA, 16 bp, H. sapiens
atttttggcatttatt

SEQ ID NO: 58639 - DNA, 16 bp, H. sapiens
atttttggctgggcgc

SEQ ID NO: 58640 - DNA, 16 bp, H. sapiens
atttttgggaatagtt

SEQ ID NO: 58641 - DNA, 16 bp, H. sapiens
atttttggggaaaaaa

SEQ ID NO: 58642 - DNA, 16 bp, H. sapiens
atttttggtaaagatg

SEQ ID NO: 58643 - DNA, 16 bp, H. sapiens
atttttgtaaaaaaca

SEQ ID NO: 58644 - DNA, 16 bp, H. sapiens
atttttgtaaggaaaa

SEQ ID NO: 58645 - DNA, 16 bp, H. sapiens
atttttgtaagtcaaa

SEQ ID NO: 58646 - DNA, 16 bp, H. sapiens
atttttgtaattactt

SEQ ID NO: 58647 - DNA, 16 bp, H. sapiens
atttttgtacatattt

SEQ ID NO: 58648 - DNA, 16 bp, H. sapiens
atttttgtacattgtg

SEQ ID NO: 58649 - DNA, 16 bp, H. sapiens
atttttgtacatttat

SEQ ID NO: 58650 - DNA, 16 bp, H. sapiens
atttttgtacattttg

SEQ ID NO: 58651 - DNA, 16 bp, H. sapiens
atttttgtacttttaa

SEQ ID NO: 58652 - DNA, 16 bp, H. sapiens
atttttgtagaaaaat

SEQ ID NO: 58653 - DNA, 16 bp, H. sapiens
atttttgtagaaattg

SEQ ID NO: 58654 - DNA, 16 bp, H. sapiens
atttttgtagacagag

SEQ ID NO: 58655 - DNA, 16 bp, H. sapiens
atttttgtagagacaa

SEQ ID NO: 58656 - DNA, 16 bp, H. sapiens
atttttgtagagactg

SEQ ID NO: 58657 - DNA, 16 bp, H. sapiens
atttttgtatatagtg

SEQ ID NO: 58658 - DNA, 16 bp, H. sapiens
atttttgtatatggaa

SEQ ID NO: 58659 - DNA, 16 bp, H. sapiens
atttttgtatatggtg

SEQ ID NO: 58660 - DNA, 16 bp, H. sapiens
atttttgtatcctgca

SEQ ID NO: 58661 - DNA, 16 bp, H. sapiens
atttttgtatgtggca

SEQ ID NO: 58662 - DNA, 16 bp, H. sapiens
atttttgtattgttac

SEQ ID NO: 58663 - DNA, 16 bp, H. sapiens
atttttgtatttcact

SEQ ID NO: 58664 - DNA, 16 bp, H. sapiens
atttttgtcaaatttt

SEQ ID NO: 58665 - DNA, 16 bp, H. sapiens
atttttgtcattaaaa

SEQ ID NO: 58666 - DNA, 16 bp, H. sapiens
atttttgtcattgatt

SEQ ID NO: 58667 - DNA, 16 bp, H. sapiens
atttttgtctactttg

SEQ ID NO: 58668 - DNA, 16 bp, H. sapiens
atttttgtctatggtg

SEQ ID NO: 58669 - DNA, 16 bp, H. sapiens
atttttgtcttaaaaa

SEQ ID NO: 58670 - DNA, 16 bp, H. sapiens
atttttgtgaaaatta

SEQ ID NO: 58671 - DNA, 16 bp, H. sapiens
atttttgtgacagagt

SEQ ID NO: 58672 - DNA, 16 bp, H. sapiens
atttttgtggctgcat

SEQ ID NO: 58673 - DNA, 16 bp, H. sapiens
atttttgtgtatgatg

SEQ ID NO: 58674 - DNA, 16 bp, H. sapiens
atttttgtgtgcattt

SEQ ID NO: 58675 - DNA, 16 bp, H. sapiens
atttttgtgtgtacat

SEQ ID NO: 58676 - DNA, 16 bp, H. sapiens
atttttgtgtgttgaa

SEQ ID NO: 58677 - DNA, 16 bp, H. sapiens
atttttgttacattat

SEQ ID NO: 58678 - DNA, 16 bp, H. sapiens
atttttgttatagcag

SEQ ID NO: 58679 - DNA, 16 bp, H. sapiens
atttttgttcaataaa

SEQ ID NO: 58680 - DNA, 16 bp, H. sapiens
atttttgttgaaaaat

SEQ ID NO: 58681 - DNA, 16 bp, H. sapiens
atttttgttgcttata

SEQ ID NO: 58682 - DNA, 16 bp, H. sapiens
atttttgttgtcattg

SEQ ID NO: 58683 - DNA, 16 bp, H. sapiens
atttttgtttagaaaa

SEQ ID NO: 58684 - DNA, 16 bp, H. sapiens
atttttgtttgagaaa

SEQ ID NO: 58685 - DNA, 16 bp, H. sapiens
atttttgttttaaact

SEQ ID NO: 58686 - DNA, 16 bp, H. sapiens
atttttgttttcaaaa

SEQ ID NO: 58687 - DNA, 16 bp, H. sapiens
atttttgttttccact

SEQ ID NO: 58688 - DNA, 16 bp, H. sapiens
atttttgttttcctaa

SEQ ID NO: 58689 - DNA, 16 bp, H. sapiens
attttttaaaaaactg

SEQ ID NO: 58690 - DNA, 16 bp, H. sapiens
attttttaaaaaagca

SEQ ID NO: 58691 - DNA, 16 bp, H. sapiens
attttttaaaaaccaa

SEQ ID NO: 58692 - DNA, 16 bp, H. sapiens
attttttaaaaagaag

SEQ ID NO: 58693 - DNA, 16 bp, H. sapiens
attttttaaaaagaga

SEQ ID NO: 58694 - DNA, 16 bp, H. sapiens
attttttaaaaagcaa

SEQ ID NO: 58695 - DNA, 16 bp, H. sapiens
attttttaaaaatcca

SEQ ID NO: 58696 - DNA, 16 bp, H. sapiens
attttttaaaaatgca

SEQ ID NO: 58697 - DNA, 16 bp, H. sapiens
attttttaaaaatgga

SEQ ID NO: 58698 - DNA, 16 bp, H. sapiens
attttttaaaaattgg

SEQ ID NO: 58699 - DNA, 16 bp, H. sapiens
attttttaaaaccatg

SEQ ID NO: 58700 - DNA, 16 bp, H. sapiens
attttttaaaactgaa

SEQ ID NO: 58701 - DNA, 16 bp, H. sapiens
attttttaaaagagaa

SEQ ID NO: 58702 - DNA, 16 bp, H. sapiens
attttttaaaaggatt

SEQ ID NO: 58703 - DNA, 16 bp, H. sapiens
attttttaaaagtcaa

SEQ ID NO: 58704 - DNA, 16 bp, H. sapiens
attttttaaaagtcat

SEQ ID NO: 58705 - DNA, 16 bp, H. sapiens
attttttaaaatcaca

SEQ ID NO: 58706 - DNA, 16 bp, H. sapiens
attttttaaaatcctc

SEQ ID NO: 58707 - DNA, 16 bp, H. sapiens
attttttaaaatctca

SEQ ID NO: 58708 - DNA, 16 bp, H. sapiens
attttttaaaatctgt

SEQ ID NO: 58709 - DNA, 16 bp, H. sapiens
attttttaaaatgcca

SEQ ID NO: 58710 - DNA, 16 bp, H. sapiens
attttttaaaatgtca

SEQ ID NO: 58711 - DNA, 16 bp, H. sapiens
attttttaaaatgtct

SEQ ID NO: 58712 - DNA, 16 bp, H. sapiens
attttttaaaattcca

SEQ ID NO: 58713 - DNA, 16 bp, H. sapiens
attttttaaactatgt

SEQ ID NO: 58714 - DNA, 16 bp, H. sapiens
attttttaaagagaca

SEQ ID NO: 58715 - DNA, 16 bp, H. sapiens
attttttaaagcaaaa

SEQ ID NO: 58716 - DNA, 16 bp, H. sapiens
attttttaaagcagaa

SEQ ID NO: 58717 - DNA, 16 bp, H. sapiens
attttttaaagctttt

SEQ ID NO: 58718 - DNA, 16 bp, H. sapiens
attttttaaatagaga

SEQ ID NO: 58719 - DNA, 16 bp, H. sapiens
attttttaaatagcta

SEQ ID NO: 58720 - DNA, 16 bp, H. sapiens
attttttaaatgcctt

SEQ ID NO: 58721 - DNA, 16 bp, H. sapiens
attttttaaatgcttt

SEQ ID NO: 58722 - DNA, 16 bp, H. sapiens
attttttaaatggaca

SEQ ID NO: 58723 - DNA, 16 bp, H. sapiens
attttttaaatgtaca

SEQ ID NO: 58724 - DNA, 16 bp, H. sapiens
attttttaaatgtcag

SEQ ID NO: 58725 - DNA, 16 bp, H. sapiens
attttttaaatgtcta

SEQ ID NO: 58726 - DNA, 16 bp, H. sapiens
attttttaaattgaca

SEQ ID NO: 58727 - DNA, 16 bp, H. sapiens
attttttaaatttctg

SEQ ID NO: 58728 - DNA, 16 bp, H. sapiens
attttttaactgaaaa

SEQ ID NO: 58729 - DNA, 16 bp, H. sapiens
attttttaagaaaaca

SEQ ID NO: 58730 - DNA, 16 bp, H. sapiens
attttttaagagacag

SEQ ID NO: 58731 - DNA, 16 bp, H. sapiens
attttttaagtatttc

SEQ ID NO: 58732 - DNA, 16 bp, H. sapiens
attttttaagtgaaaa

SEQ ID NO: 58733 - DNA, 16 bp, H. sapiens
attttttaatcaggtt

SEQ ID NO: 58734 - DNA, 16 bp, H. sapiens
attttttaatctcaaa

SEQ ID NO: 58735 - DNA, 16 bp, H. sapiens
attttttaatgaaact

SEQ ID NO: 58736 - DNA, 16 bp, H. sapiens
attttttaatgatcac

SEQ ID NO: 58737 - DNA, 16 bp, H. sapiens
attttttaatgcaaaa

SEQ ID NO: 58738 - DNA, 16 bp, H. sapiens
attttttaatgttcaa

SEQ ID NO: 58739 - DNA, 16 bp, H. sapiens
attttttacagttctg

SEQ ID NO: 58740 - DNA, 16 bp, H. sapiens
attttttacttacaaa

SEQ ID NO: 58741 - DNA, 16 bp, H. sapiens
attttttactttagaa

SEQ ID NO: 58742 - DNA, 16 bp, H. sapiens
attttttagaaagtaa

SEQ ID NO: 58743 - DNA, 16 bp, H. sapiens
attttttagaagaaaa

SEQ ID NO: 58744 - DNA, 16 bp, H. sapiens
attttttagagataga

SEQ ID NO: 58745 - DNA, 16 bp, H. sapiens
attttttatagcagcc

SEQ ID NO: 58746 - DNA, 16 bp, H. sapiens
attttttatcagaaaa

SEQ ID NO: 58747 - DNA, 16 bp, H. sapiens
attttttatctcaaaa

SEQ ID NO: 58748 - DNA, 16 bp, H. sapiens
attttttatgcattta

SEQ ID NO: 58749 - DNA, 16 bp, H. sapiens
attttttatggtgaaa

SEQ ID NO: 58750 - DNA, 16 bp, H. sapiens
attttttattcatgta

SEQ ID NO: 58751 - DNA, 16 bp, H. sapiens
attttttattctgtaa

SEQ ID NO: 58752 - DNA, 16 bp, H. sapiens
attttttcaaaaatcc

SEQ ID NO: 58753 - DNA, 16 bp, H. sapiens
attttttcaaaacaaa

SEQ ID NO: 58754 - DNA, 16 bp, H. sapiens
attttttcaaaagaag

SEQ ID NO: 58755 - DNA, 16 bp, H. sapiens
attttttcaaagaatt

SEQ ID NO: 58756 - DNA, 16 bp, H. sapiens
attttttcacagaatt

SEQ ID NO: 58757 - DNA, 16 bp, H. sapiens
attttttcagaaagaa

SEQ ID NO: 58758 - DNA, 16 bp, H. sapiens
attttttcagattttg

SEQ ID NO: 58759 - DNA, 16 bp, H. sapiens
attttttcatatgtat

SEQ ID NO: 58760 - DNA, 16 bp, H. sapiens
attttttccatttgat

SEQ ID NO: 58761 - DNA, 16 bp, H. sapiens
attttttcccaaagaa

SEQ ID NO: 58762 - DNA, 16 bp, H. sapiens
attttttcccatttgg

SEQ ID NO: 58763 - DNA, 16 bp, H. sapiens
attttttcccccaaaa

SEQ ID NO: 58764 - DNA, 16 bp, H. sapiens
attttttcccctttgt

SEQ ID NO: 58765 - DNA, 16 bp, H. sapiens
attttttccccttttg

SEQ ID NO: 58766 - DNA, 16 bp, H. sapiens
attttttcctgaaaat

SEQ ID NO: 58767 - DNA, 16 bp, H. sapiens
attttttccttctaaa

SEQ ID NO: 58768 - DNA, 16 bp, H. sapiens
attttttccttttggc

SEQ ID NO: 58769 - DNA, 16 bp, H. sapiens
attttttctaactggg

SEQ ID NO: 58770 - DNA, 16 bp, H. sapiens
attttttctaagaaat

SEQ ID NO: 58771 - DNA, 16 bp, H. sapiens
attttttctagagaca

SEQ ID NO: 58772 - DNA, 16 bp, H. sapiens
attttttctgaatatt

SEQ ID NO: 58773 - DNA, 16 bp, H. sapiens
attttttctggaaaaa

SEQ ID NO: 58774 - DNA, 16 bp, H. sapiens
attttttcttaaagaa

SEQ ID NO: 58775 - DNA, 16 bp, H. sapiens
attttttcttgtaaat

SEQ ID NO: 58776 - DNA, 16 bp, H. sapiens
attttttcttttgaaa

SEQ ID NO: 58777 - DNA, 16 bp, H. sapiens
attttttgaaaaatct

SEQ ID NO: 58778 - DNA, 16 bp, H. sapiens
attttttgaagaaatt

SEQ ID NO: 58779 - DNA, 16 bp, H. sapiens
attttttgaagagact

SEQ ID NO: 58780 - DNA, 16 bp, H. sapiens
attttttgacacagag

SEQ ID NO: 58781 - DNA, 16 bp, H. sapiens
attttttgagaaatca

SEQ ID NO: 58782 - DNA, 27 bp, H. sapiens
attttttgagatggagtctcgctctgt

SEQ ID NO: 58783 - DNA, 16 bp, H. sapiens
attttttgaggaaact

SEQ ID NO: 58784 - DNA, 16 bp, H. sapiens
attttttgaggaaatt

SEQ ID NO: 58785 - DNA, 16 bp, H. sapiens
attttttgatacattt

SEQ ID NO: 58786 - DNA, 16 bp, H. sapiens
attttttgcagaggtg

SEQ ID NO: 58787 - DNA, 16 bp, H. sapiens
attttttgcattaatt

SEQ ID NO: 58788 - DNA, 16 bp, H. sapiens
attttttggaaaaatt

SEQ ID NO: 58789 - DNA, 16 bp, H. sapiens
attttttggaataaaa

SEQ ID NO: 58790 - DNA, 16 bp, H. sapiens
attttttggaggcttt

SEQ ID NO: 58791 - DNA, 16 bp, H. sapiens
attttttggggaaaaa

SEQ ID NO: 58792 - DNA, 16 bp, H. sapiens
attttttgtttcccag

SEQ ID NO: 58793 - DNA, 16 bp, H. sapiens
atttttttaaaagcct

SEQ ID NO: 58794 - DNA, 16 bp, H. sapiens
atttttttaaaaggca

SEQ ID NO: 58795 - DNA, 16 bp, H. sapiens
atttttttaaactgaa

SEQ ID NO: 58796 - DNA, 16 bp, H. sapiens
atttttttaaagaagt

SEQ ID NO: 58797 - DNA, 16 bp, H. sapiens
atttttttaaagagca

SEQ ID NO: 58798 - DNA, 16 bp, H. sapiens
atttttttaaatgtct

SEQ ID NO: 58799 - DNA, 16 bp, H. sapiens
atttttttaagaagaa

SEQ ID NO: 58800 - DNA, 16 bp, H. sapiens
atttttttaagagaag

SEQ ID NO: 58801 - DNA, 16 bp, H. sapiens
atttttttaagcaaat

SEQ ID NO: 58802 - DNA, 16 bp, H. sapiens
atttttttaagccact

SEQ ID NO: 58803 - DNA, 16 bp, H. sapiens
atttttttaagggaag

SEQ ID NO: 58804 - DNA, 16 bp, H. sapiens
atttttttaagttact

SEQ ID NO: 58805 - DNA, 17 bp, H. sapiens
atttttttagtagagac

SEQ ID NO: 58806 - DNA, 16 bp, H. sapiens
atttttttatcctgca

SEQ ID NO: 58807 - DNA, 16 bp, H. sapiens
atttttttcaaagaaa

SEQ ID NO: 58808 - DNA, 16 bp, H. sapiens
atttttttcaaatgat

SEQ ID NO: 58809 - DNA, 16 bp, H. sapiens
atttttttcaagacaa

SEQ ID NO: 58810 - DNA, 16 bp, H. sapiens
atttttttcaaggaaa

SEQ ID NO: 58811 - DNA, 16 bp, H. sapiens
atttttttcaagttat

SEQ ID NO: 58812 - DNA, 16 bp, H. sapiens
atttttttcaagttct

SEQ ID NO: 58813 - DNA, 16 bp, H. sapiens
atttttttcagaaatt

SEQ ID NO: 58814 - DNA, 16 bp, H. sapiens
atttttttcaggaaaa

SEQ ID NO: 58815 - DNA, 16 bp, H. sapiens
atttttttcagtgctt

SEQ ID NO: 58816 - DNA, 16 bp, H. sapiens
atttttttcagttgaa

SEQ ID NO: 58817 - DNA, 16 bp, H. sapiens
atttttttcccaagaa

SEQ ID NO: 58818 - DNA, 16 bp, H. sapiens
atttttttccccacaa

SEQ ID NO: 58819 - DNA, 16 bp, H. sapiens
atttttttcccctaaa

SEQ ID NO: 58820 - DNA, 16 bp, H. sapiens
atttttttcctaaaaa

SEQ ID NO: 58821 - DNA, 16 bp, H. sapiens
atttttttcctagaaa

SEQ ID NO: 58822 - DNA, 16 bp, H. sapiens
atttttttcctttgaa

SEQ ID NO: 58823 - DNA, 16 bp, H. sapiens
atttttttctaagaaa

SEQ ID NO: 58824 - DNA, 16 bp, H. sapiens
atttttttctaagagt

SEQ ID NO: 58825 - DNA, 16 bp, H. sapiens
atttttttctaagtat

SEQ ID NO: 58826 - DNA, 16 bp, H. sapiens
atttttttctaggaaa

SEQ ID NO: 58827 - DNA, 16 bp, H. sapiens
atttttttctatgaaa

SEQ ID NO: 58828 - DNA, 16 bp, H. sapiens
atttttttctcagatt

SEQ ID NO: 58829 - DNA, 16 bp, H. sapiens
atttttttctcataga

SEQ ID NO: 58830 - DNA, 16 bp, H. sapiens
atttttttctccaaag

SEQ ID NO: 58831 - DNA, 16 bp, H. sapiens
atttttttctgaatgt

SEQ ID NO: 58832 - DNA, 16 bp, H. sapiens
atttttttcttaagat

SEQ ID NO: 58833 - DNA, 16 bp, H. sapiens
atttttttcttagaaa

SEQ ID NO: 58834 - DNA, 16 bp, H. sapiens
atttttttcttccaca

SEQ ID NO: 58835 - DNA, 16 bp, H. sapiens
atttttttcttgagat

SEQ ID NO: 58836 - DNA, 16 bp, H. sapiens
atttttttgaaaatga

SEQ ID NO: 58837 - DNA, 16 bp, H. sapiens
atttttttgaagaaat

SEQ ID NO: 58838 - DNA, 16 bp, H. sapiens
atttttttgagaagga

SEQ ID NO: 58839 - DNA, 20 bp, H. sapiens
atttttttgagacagagtct

SEQ ID NO: 58840 - DNA, 16 bp, H. sapiens
atttttttgagacagg

SEQ ID NO: 58841 - DNA, 16 bp, H. sapiens
atttttttgagacagt

SEQ ID NO: 58842 - DNA, 25 bp, H. sapiens
atttttttgagatggagtcttgctc

SEQ ID NO: 58843 - DNA, 16 bp, H. sapiens
atttttttgctttcca

SEQ ID NO: 58844 - DNA, 16 bp, H. sapiens
atttttttgtagagag

SEQ ID NO: 58845 - DNA, 16 bp, H. sapiens
attttttttaaaacag

SEQ ID NO: 58846 - DNA, 16 bp, H. sapiens
attttttttaaaagga

SEQ ID NO: 58847 - DNA, 16 bp, H. sapiens
attttttttaaagctc

SEQ ID NO: 58848 - DNA, 16 bp, H. sapiens
attttttttaaccaaa

SEQ ID NO: 58849 - DNA, 16 bp, H. sapiens
attttttttagaaaca

SEQ ID NO: 58850 - DNA, 16 bp, H. sapiens
attttttttagaggtg

SEQ ID NO: 58851 - DNA, 17 bp, H. sapiens
attttttttagtagaga

SEQ ID NO: 58852 - DNA, 16 bp, H. sapiens
attttttttcaaaaag

SEQ ID NO: 58853 - DNA, 16 bp, H. sapiens
attttttttccaactg

SEQ ID NO: 58854 - DNA, 16 bp, H. sapiens
attttttttctgtaaa

SEQ ID NO: 58855 - DNA, 16 bp, H. sapiens
attttttttcttagaa

SEQ ID NO: 58856 - DNA, 16 bp, H. sapiens
attttttttggaagag

SEQ ID NO: 58857 - DNA, 16 bp, H. sapiens
attttttttgtagaga

SEQ ID NO: 58858 - DNA, 16 bp, H. sapiens
atttttttttaagaac

SEQ ID NO: 58859 - DNA, 16 bp, H. sapiens
atttttttttaagaca

SEQ ID NO: 58860 - DNA, 16 bp, H. sapiens
atttttttttaagtac

SEQ ID NO: 58861 - DNA, 16 bp, H. sapiens
atttttttttagacag

SEQ ID NO: 58862 - DNA, 16 bp, H. sapiens
atttttttttcaaagt

SEQ ID NO: 58863 - DNA, 18 bp, H. sapiens
atttttttttgagacagg

SEQ ID NO: 58864 - DNA, 16 bp, H. sapiens
attttttttttaagac

SEQ ID NO: 58865 - DNA, 17 bp, H. sapiens
attttttttttgagacg

SEQ ID NO: 58866 - DNA, 16 bp, H. sapiens
caaaaaaaaatgttga

SEQ ID NO: 58867 - DNA, 16 bp, H. sapiens
caaaaaaaccctgaaa

SEQ ID NO: 58868 - DNA, 16 bp, H. sapiens
caaaaaaacctttcaa

SEQ ID NO: 58869 - DNA, 16 bp, H. sapiens
caaaaaaactgaagag

SEQ ID NO: 58870 - DNA, 16 bp, H. sapiens
caaaaaaagagcctga

SEQ ID NO: 58871 - DNA, 16 bp, H. sapiens
caaaaaaagttttaaa

SEQ ID NO: 58872 - DNA, 16 bp, H. sapiens
caaaaaaattgaagag

SEQ ID NO: 58873 - DNA, 16 bp, H. sapiens
caaaaaaattgtgtga

SEQ ID NO: 58874 - DNA, 16 bp, H. sapiens
caaaaaaccaactttt

SEQ ID NO: 58875 - DNA, 16 bp, H. sapiens
caaaaaactctgtctc

SEQ ID NO: 58876 - DNA, 16 bp, H. sapiens
caaaaaagagcatgca

SEQ ID NO: 58877 - DNA, 16 bp, H. sapiens
caaaaaagagcctgtg

SEQ ID NO: 58878 - DNA, 16 bp, H. sapiens
caaaaaagccttcaaa

SEQ ID NO: 58879 - DNA, 16 bp, H. sapiens
caaaaaaggagaattt

SEQ ID NO: 58880 - DNA, 16 bp, H. sapiens
caaaaaatatatagat

SEQ ID NO: 58881 - DNA, 16 bp, H. sapiens
caaaaaatatgtaatt

SEQ ID NO: 58882 - DNA, 16 bp, H. sapiens
caaaaaatgtccagga

SEQ ID NO: 58883 - DNA, 16 bp, H. sapiens
caaaaaatgtgttttt

SEQ ID NO: 58884 - DNA, 16 bp, H. sapiens
caaaaaatgttttaaa

SEQ ID NO: 58885 - DNA, 16 bp, H. sapiens
caaaaaattatctgga

SEQ ID NO: 58886 - DNA, 16 bp, H. sapiens
caaaaacaaaacctgt

SEQ ID NO: 58887 - DNA, 16 bp, H. sapiens
caaaaacaaaaccttt

SEQ ID NO: 58888 - DNA, 16 bp, H. sapiens
caaaaacaagttgacc

SEQ ID NO: 58889 - DNA, 16 bp, H. sapiens
caaaaacaattgcaac

SEQ ID NO: 58890 - DNA, 16 bp, H. sapiens
caaaaacactgtttcc

SEQ ID NO: 58891 - DNA, 16 bp, H. sapiens
caaaaacagatatata

SEQ ID NO: 58892 - DNA, 16 bp, H. sapiens
caaaaacagcccagga

SEQ ID NO: 58893 - DNA, 16 bp, H. sapiens
caaaaacaggcagtgg

SEQ ID NO: 58894 - DNA, 16 bp, H. sapiens
caaaaacagtttttct

SEQ ID NO: 58895 - DNA, 16 bp, H. sapiens
caaaaacatggaaatt

SEQ ID NO: 58896 - DNA, 16 bp, H. sapiens
caaaaacattccaaat

SEQ ID NO: 58897 - DNA, 16 bp, H. sapiens
caaaaacattttttaa

SEQ ID NO: 58898 - DNA, 16 bp, H. sapiens
caaaaaccacatgata

SEQ ID NO: 58899 - DNA, 16 bp, H. sapiens
caaaaaccacatgatc

SEQ ID NO: 58900 - DNA, 16 bp, H. sapiens
caaaaaccagccaggc

SEQ ID NO: 58901 - DNA, 16 bp, H. sapiens
caaaaactctacactt

SEQ ID NO: 58902 - DNA, 16 bp, H. sapiens
caaaaactgaagatat

SEQ ID NO: 58903 - DNA, 16 bp, H. sapiens
caaaaactgatggaac

SEQ ID NO: 58904 - DNA, 16 bp, H. sapiens
caaaaactgcaagcat

SEQ ID NO: 58905 - DNA, 16 bp, H. sapiens
caaaaactggaagaat

SEQ ID NO: 58906 - DNA, 16 bp, H. sapiens
caaaaactggaggcat

SEQ ID NO: 58907 - DNA, 16 bp, H. sapiens
caaaaactgtaaaaag

SEQ ID NO: 58908 - DNA, 16 bp, H. sapiens
caaaaacttgaaaata

SEQ ID NO: 58909 - DNA, 16 bp, H. sapiens
caaaaagaacagagct

SEQ ID NO: 58910 - DNA, 16 bp, H. sapiens
caaaaagaaccctcaa

SEQ ID NO: 58911 - DNA, 16 bp, H. sapiens
caaaaagaagacatac

SEQ ID NO: 58912 - DNA, 16 bp, H. sapiens
caaaaagaataaagct

SEQ ID NO: 58913 - DNA, 16 bp, H. sapiens
caaaaagaattttaaa

SEQ ID NO: 58914 - DNA, 16 bp, H. sapiens
caaaaagactggcagc

SEQ ID NO: 58915 - DNA, 16 bp, H. sapiens
caaaaagagcaaaact

SEQ ID NO: 58916 - DNA, 16 bp, H. sapiens
caaaaagataatgcac

SEQ ID NO: 58917 - DNA, 16 bp, H. sapiens
caaaaagatggggaaa

SEQ ID NO: 58918 - DNA, 16 bp, H. sapiens
caaaaagattataact

SEQ ID NO: 58919 - DNA, 16 bp, H. sapiens
caaaaagatttgaaaa

SEQ ID NO: 58920 - DNA, 16 bp, H. sapiens
caaaaagcaaataatt

SEQ ID NO: 58921 - DNA, 16 bp, H. sapiens
caaaaagcagcccaag

SEQ ID NO: 58922 - DNA, 16 bp, H. sapiens
caaaaagcatgtgaaa

SEQ ID NO: 58923 - DNA, 16 bp, H. sapiens
caaaaagctattagaa

SEQ ID NO: 58924 - DNA, 16 bp, H. sapiens
caaaaaggaatgaatt

SEQ ID NO: 58925 - DNA, 16 bp, H. sapiens
caaaaaggacattcac

SEQ ID NO: 58926 - DNA, 16 bp, H. sapiens
caaaaagtagaaagat

SEQ ID NO: 58927 - DNA, 16 bp, H. sapiens
caaaaagtatttttaa

SEQ ID NO: 58928 - DNA, 16 bp, H. sapiens
caaaaagtgggcagag

SEQ ID NO: 58929 - DNA, 16 bp, H. sapiens
caaaaagtgtctgaga

SEQ ID NO: 58930 - DNA, 16 bp, H. sapiens
caaaaagttcctcatc

SEQ ID NO: 58931 - DNA, 16 bp, H. sapiens
caaaaagttgcctttt

SEQ ID NO: 58932 - DNA, 16 bp, H. sapiens
caaaaagtttcagaat

SEQ ID NO: 58933 - DNA, 16 bp, H. sapiens
caaaaagtttgaaaac

SEQ ID NO: 58934 - DNA, 16 bp, H. sapiens
caaaaagtttgagaac

SEQ ID NO: 58935 - DNA, 16 bp, H. sapiens
caaaaagttttagatt

SEQ ID NO: 58936 - DNA, 16 bp, H. sapiens
caaaaagttttggatt

SEQ ID NO: 58937 - DNA, 16 bp, H. sapiens
caaaaagttttttaaa

SEQ ID NO: 58938 - DNA, 16 bp, H. sapiens
caaaaataaaatgttt

SEQ ID NO: 58939 - DNA, 16 bp, H. sapiens
caaaaataaaatttga

SEQ ID NO: 58940 - DNA, 16 bp, H. sapiens
caaaaataaatgaatg

SEQ ID NO: 58941 - DNA, 16 bp, H. sapiens
caaaaatacagtattc

SEQ ID NO: 58942 - DNA, 16 bp, H. sapiens
caaaaatatattttga

SEQ ID NO: 58943 - DNA, 16 bp, H. sapiens
caaaaatatctttttt

SEQ ID NO: 58944 - DNA, 16 bp, H. sapiens
caaaaatatgttaaaa

SEQ ID NO: 58945 - DNA, 16 bp, H. sapiens
caaaaatatgtttaaa

SEQ ID NO: 58946 - DNA, 16 bp, H. sapiens
caaaaatattaaatgg

SEQ ID NO: 58947 - DNA, 16 bp, H. sapiens
caaaaatattacaaga

SEQ ID NO: 58948 - DNA, 16 bp, H. sapiens
caaaaatattgaattt

SEQ ID NO: 58949 - DNA, 16 bp, H. sapiens
caaaaatattgtaaaa

SEQ ID NO: 58950 - DNA, 16 bp, H. sapiens
caaaaatattttccta

SEQ ID NO: 58951 - DNA, 16 bp, H. sapiens
caaaaatattttcctt

SEQ ID NO: 58952 - DNA, 16 bp, H. sapiens
caaaaatattttgcaa

SEQ ID NO: 58953 - DNA, 16 bp, H. sapiens
caaaaatcaagaaatt

SEQ ID NO: 58954 - DNA, 16 bp, H. sapiens
caaaaatcaatagctt

SEQ ID NO: 58955 - DNA, 18 bp, H. sapiens
caaaaatcacaagcattc

SEQ ID NO: 58956 - DNA, 16 bp, H. sapiens
caaaaatcacccaggc

SEQ ID NO: 58957 - DNA, 16 bp, H. sapiens
caaaaatcactagcat

SEQ ID NO: 58958 - DNA, 16 bp, H. sapiens
caaaaatcagcatttc

SEQ ID NO: 58959 - DNA, 16 bp, H. sapiens
caaaaatcattaagaa

SEQ ID NO: 58960 - DNA, 16 bp, H. sapiens
caaaaatccaagtcca

SEQ ID NO: 58961 - DNA, 16 bp, H. sapiens
caaaaatccacagtcc

SEQ ID NO: 58962 - DNA, 16 bp, H. sapiens
caaaaatctcagaatt

SEQ ID NO: 58963 - DNA, 16 bp, H. sapiens
caaaaatctcatcttg

SEQ ID NO: 58964 - DNA, 16 bp, H. sapiens
caaaaatctgtacaca

SEQ ID NO: 58965 - DNA, 16 bp, H. sapiens
caaaaatctgttcttt

SEQ ID NO: 58966 - DNA, 16 bp, H. sapiens
caaaaatcttcagtaa

SEQ ID NO: 58967 - DNA, 16 bp, H. sapiens
caaaaatgaattcaag

SEQ ID NO: 58968 - DNA, 16 bp, H. sapiens
caaaaatgacaaatat

SEQ ID NO: 58969 - DNA, 16 bp, H. sapiens
caaaaatgagctgagc

SEQ ID NO: 58970 - DNA, 16 bp, H. sapiens
caaaaatgcaaattaa

SEQ ID NO: 58971 - DNA, 16 bp, H. sapiens
caaaaatgcccacttt

SEQ ID NO: 58972 - DNA, 16 bp, H. sapiens
caaaaatgggcaaaat

SEQ ID NO: 58973 - DNA, 16 bp, H. sapiens
caaaaatgtaaatata

SEQ ID NO: 58974 - DNA, 16 bp, H. sapiens
caaaaatgtatttcaa

SEQ ID NO: 58975 - DNA, 16 bp, H. sapiens
caaaaatgtccccaga

SEQ ID NO: 58976 - DNA, 16 bp, H. sapiens
caaaaatgtctccaaa

SEQ ID NO: 58977 - DNA, 16 bp, H. sapiens
caaaaatgtcttcaga

SEQ ID NO: 58978 - DNA, 16 bp, H. sapiens
caaaaatgtctttttt

SEQ ID NO: 58979 - DNA, 16 bp, H. sapiens
caaaaatgtgattttt

SEQ ID NO: 58980 - DNA, 16 bp, H. sapiens
caaaaatgtgttgatt

SEQ ID NO: 58981 - DNA, 16 bp, H. sapiens
caaaaatgttgcagga

SEQ ID NO: 58982 - DNA, 16 bp, H. sapiens
caaaaatgtttactat

SEQ ID NO: 58983 - DNA, 16 bp, H. sapiens
caaaaatgtttgaaga

SEQ ID NO: 58984 - DNA, 16 bp, H. sapiens
caaaaatgtttttaaa

SEQ ID NO: 58985 - DNA, 16 bp, H. sapiens
caaaaattaactgggc

SEQ ID NO: 58986 - DNA, 16 bp, H. sapiens
caaaaattacctaggc

SEQ ID NO: 58987 - DNA, 16 bp, H. sapiens
caaaaattacctgggc

SEQ ID NO: 58988 - DNA, 17 bp, H. sapiens
caaaaattagccagatg

SEQ ID NO: 58989 - DNA, 16 bp, H. sapiens
caaaaattaggcaggt

SEQ ID NO: 58990 - DNA, 16 bp, H. sapiens
caaaaattatccagac

SEQ ID NO: 58991 - DNA, 16 bp, H. sapiens
caaaaattccattttt

SEQ ID NO: 58992 - DNA, 16 bp, H. sapiens
caaaaattctcagtaa

SEQ ID NO: 58993 - DNA, 16 bp, H. sapiens
caaaaattgaaaaatg

SEQ ID NO: 58994 - DNA, 16 bp, H. sapiens
caaaaattgacaagtg

SEQ ID NO: 58995 - DNA, 16 bp, H. sapiens
caaaaattgctgggca

SEQ ID NO: 58996 - DNA, 16 bp, H. sapiens
caaaaattggaagcaa

SEQ ID NO: 58997 - DNA, 16 bp, H. sapiens
caaaaattgggctaag

SEQ ID NO: 58998 - DNA, 16 bp, H. sapiens
caaaaattgttaaaat

SEQ ID NO: 58999 - DNA, 16 bp, H. sapiens
caaaaatttattcaag

SEQ ID NO: 59000 - DNA, 16 bp, H. sapiens
caaaaatttcagaaaa

SEQ ID NO: 59001 - DNA, 16 bp, H. sapiens
caaaaatttgtacatg

SEQ ID NO: 59002 - DNA, 16 bp, H. sapiens
caaaaattttccaaat

SEQ ID NO: 59003 - DNA, 16 bp, H. sapiens
caaaacaaaaacctga

SEQ ID NO: 59004 - DNA, 16 bp, H. sapiens
caaaacaaaaactgga

SEQ ID NO: 59005 - DNA, 16 bp, H. sapiens
caaaacaaaaatgcag

SEQ ID NO: 59006 - DNA, 16 bp, H. sapiens
caaaacaaagaacggg

SEQ ID NO: 59007 - DNA, 16 bp, H. sapiens
caaaacaaatctgaaa

SEQ ID NO: 59008 - DNA, 16 bp, H. sapiens
caaaacaaatgtttaa

SEQ ID NO: 59009 - DNA, 16 bp, H. sapiens
caaaacaagtctttaa

SEQ ID NO: 59010 - DNA, 16 bp, H. sapiens
caaaacaagttttaaa

SEQ ID NO: 59011 - DNA, 16 bp, H. sapiens
caaaacaatgctgaaa

SEQ ID NO: 59012 - DNA, 16 bp, H. sapiens
caaaacaattttttaa

SEQ ID NO: 59013 - DNA, 16 bp, H. sapiens
caaaacacaatgagat

SEQ ID NO: 59014 - DNA, 16 bp, H. sapiens
caaaacacacacatgc

SEQ ID NO: 59015 - DNA, 16 bp, H. sapiens
caaaacacagctgaaa

SEQ ID NO: 59016 - DNA, 16 bp, H. sapiens
caaaacactgctcaac

SEQ ID NO: 59017 - DNA, 16 bp, H. sapiens
caaaacactttcataa

SEQ ID NO: 59018 - DNA, 16 bp, H. sapiens
caaaacagacaaaatc

SEQ ID NO: 59019 - DNA, 16 bp, H. sapiens
caaaacagagcctgaa

SEQ ID NO: 59020 - DNA, 16 bp, H. sapiens
caaaacagattttaag

SEQ ID NO: 59021 - DNA, 16 bp, H. sapiens
caaaacagcatggtat

SEQ ID NO: 59022 - DNA, 16 bp, H. sapiens
caaaacaggcaaaact

SEQ ID NO: 59023 - DNA, 16 bp, H. sapiens
caaaacagtatggcac

SEQ ID NO: 59024 - DNA, 16 bp, H. sapiens
caaaacagtatttcca

SEQ ID NO: 59025 - DNA, 16 bp, H. sapiens
caaaacagtctttaaa

SEQ ID NO: 59026 - DNA, 16 bp, H. sapiens
caaaacatgtttttaa

SEQ ID NO: 59027 - DNA, 16 bp, H. sapiens
caaaacatgttttttt

SEQ ID NO: 59028 - DNA, 16 bp, H. sapiens
caaaacattctccttt

SEQ ID NO: 59029 - DNA, 16 bp, H. sapiens
caaaacattgctgaaa

SEQ ID NO: 59030 - DNA, 16 bp, H. sapiens
caaaacattgttatgt

SEQ ID NO: 59031 - DNA, 16 bp, H. sapiens
caaaacatttttatca

SEQ ID NO: 59032 - DNA, 16 bp, H. sapiens
caaaaccaacaagttt

SEQ ID NO: 59033 - DNA, 16 bp, H. sapiens
caaaaccacaatgaaa

SEQ ID NO: 59034 - DNA, 16 bp, H. sapiens
caaaaccacagtgagg

SEQ ID NO: 59035 - DNA, 16 bp, H. sapiens
caaaaccacatctgta

SEQ ID NO: 59036 - DNA, 16 bp, H. sapiens
caaaaccaccatcgtc

SEQ ID NO: 59037 - DNA, 16 bp, H. sapiens
caaaaccaccctgggc

SEQ ID NO: 59038 - DNA, 16 bp, H. sapiens
caaaaccagacaagga

SEQ ID NO: 59039 - DNA, 16 bp, H. sapiens
caaaaccagccttggc

SEQ ID NO: 59040 - DNA, 16 bp, H. sapiens
caaaaccagggaagct

SEQ ID NO: 59041 - DNA, 22 bp, H. sapiens
caaaaccatatccaggccatca

SEQ ID NO: 59042 - DNA, 16 bp, H. sapiens
caaaaccattttgaaa

SEQ ID NO: 59043 - DNA, 16 bp, H. sapiens
caaaacccactgttct

SEQ ID NO: 59044 - DNA, 16 bp, H. sapiens
caaaaccccatctctt

SEQ ID NO: 59045 - DNA, 16 bp, H. sapiens
caaaaccccatctgta

SEQ ID NO: 59046 - DNA, 16 bp, H. sapiens
caaaaccctatctcaa

SEQ ID NO: 59047 - DNA, 16 bp, H. sapiens
caaaacctcatcccta

SEQ ID NO: 59048 - DNA, 16 bp, H. sapiens
caaaacctctgggata

SEQ ID NO: 59049 - DNA, 16 bp, H. sapiens
caaaacctggaaacaa

SEQ ID NO: 59050 - DNA, 16 bp, H. sapiens
caaaaccttgaaatac

SEQ ID NO: 59051 - DNA, 16 bp, H. sapiens
caaaacgctgggatta

SEQ ID NO: 59052 - DNA, 16 bp, H. sapiens
caaaactaagaaatta

SEQ ID NO: 59053 - DNA, 16 bp, H. sapiens
caaaactacacaatta

SEQ ID NO: 59054 - DNA, 16 bp, H. sapiens
caaaactacatggaaa

SEQ ID NO: 59055 - DNA, 16 bp, H. sapiens
caaaactaggaaagga

SEQ ID NO: 59056 - DNA, 16 bp, H. sapiens
caaaactatagtgaca

SEQ ID NO: 59057 - DNA, 16 bp, H. sapiens
caaaactatttattga

SEQ ID NO: 59058 - DNA, 16 bp, H. sapiens
caaaactatttcaaaa

SEQ ID NO: 59059 - DNA, 16 bp, H. sapiens
caaaactattttttta

SEQ ID NO: 59060 - DNA, 16 bp, H. sapiens
caaaactcactcaaga

SEQ ID NO: 59061 - DNA, 16 bp, H. sapiens
caaaactcatgtggaa

SEQ ID NO: 59062 - DNA, 16 bp, H. sapiens
caaaactccatatcaa

SEQ ID NO: 59063 - DNA, 16 bp, H. sapiens
caaaactctgctcaaa

SEQ ID NO: 59064 - DNA, 16 bp, H. sapiens
caaaactctgtctcag

SEQ ID NO: 59065 - DNA, 16 bp, H. sapiens
caaaactgaagaaatt

SEQ ID NO: 59066 - DNA, 16 bp, H. sapiens
caaaactgaaggagat

SEQ ID NO: 59067 - DNA, 16 bp, H. sapiens
caaaactgagcagaag

SEQ ID NO: 59068 - DNA, 16 bp, H. sapiens
caaaactgatagactg

SEQ ID NO: 59069 - DNA, 16 bp, H. sapiens
caaaactgatttaaaa

SEQ ID NO: 59070 - DNA, 16 bp, H. sapiens
caaaactgcaaaacta

SEQ ID NO: 59071 - DNA, 16 bp, H. sapiens
caaaactgtttttaaa

SEQ ID NO: 59072 - DNA, 16 bp, H. sapiens
caaaacttaaaagcaa

SEQ ID NO: 59073 - DNA, 16 bp, H. sapiens
caaaacttttttaaaa

SEQ ID NO: 59074 - DNA, 16 bp, H. sapiens
caaaacttttttttaa

SEQ ID NO: 59075 - DNA, 16 bp, H. sapiens
caaaagaaaaaggttt

SEQ ID NO: 59076 - DNA, 16 bp, H. sapiens
caaaagaaaaatggat

SEQ ID NO: 59077 - DNA, 16 bp, H. sapiens
caaaagaaaacattta

SEQ ID NO: 59078 - DNA, 16 bp, H. sapiens
caaaagaaaagaagtc

SEQ ID NO: 59079 - DNA, 16 bp, H. sapiens
caaaagaaaagattca

SEQ ID NO: 59080 - DNA, 16 bp, H. sapiens
caaaagaaaatgaatt

SEQ ID NO: 59081 - DNA, 16 bp, H. sapiens
caaaagaaaatgagga

SEQ ID NO: 59082 - DNA, 16 bp, H. sapiens
caaaagaaaatgttat

SEQ ID NO: 59083 - DNA, 16 bp, H. sapiens
caaaagaaaatttcaa

SEQ ID NO: 59084 - DNA, 16 bp, H. sapiens
caaaagaaactatcaa

SEQ ID NO: 59085 - DNA, 16 bp, H. sapiens
caaaagaaactatgaa

SEQ ID NO: 59086 - DNA, 16 bp, H. sapiens
caaaagaaagaatttg

SEQ ID NO: 59087 - DNA, 16 bp, H. sapiens
caaaagaaagatgttt

SEQ ID NO: 59088 - DNA, 16 bp, H. sapiens
caaaagaaagctgaag

SEQ ID NO: 59089 - DNA, 16 bp, H. sapiens
caaaagaaagtggttt

SEQ ID NO: 59090 - DNA, 16 bp, H. sapiens
caaaagaaatacctaa

SEQ ID NO: 59091 - DNA, 16 bp, H. sapiens
caaaagaaatattttt

SEQ ID NO: 59092 - DNA, 16 bp, H. sapiens
caaaagaaatcagaga

SEQ ID NO: 59093 - DNA, 16 bp, H. sapiens
caaaagaaattaattt

SEQ ID NO: 59094 - DNA, 16 bp, H. sapiens
caaaagaaattttttt

SEQ ID NO: 59095 - DNA, 16 bp, H. sapiens
caaaagaacaaagcta

SEQ ID NO: 59096 - DNA, 16 bp, H. sapiens
caaaagaacacataca

SEQ ID NO: 59097 - DNA, 16 bp, H. sapiens
caaaagaacacattta

SEQ ID NO: 59098 - DNA, 16 bp, H. sapiens
caaaagaactacttga

SEQ ID NO: 59099 - DNA, 16 bp, H. sapiens
caaaagaagacacatg

SEQ ID NO: 59100 - DNA, 16 bp, H. sapiens
caaaagaagacatgca

SEQ ID NO: 59101 - DNA, 16 bp, H. sapiens
caaaagaagacctaca

SEQ ID NO: 59102 - DNA, 16 bp, H. sapiens
caaaagaagatatcca

SEQ ID NO: 59103 - DNA, 16 bp, H. sapiens
caaaagaataacattt

SEQ ID NO: 59104 - DNA, 16 bp, H. sapiens
caaaagaatatatata

SEQ ID NO: 59105 - DNA, 16 bp, H. sapiens
caaaagaatgaaattg

SEQ ID NO: 59106 - DNA, 16 bp, H. sapiens
caaaagaatgaatttg

SEQ ID NO: 59107 - DNA, 16 bp, H. sapiens
caaaagaatggctact

SEQ ID NO: 59108 - DNA, 16 bp, H. sapiens
caaaagaattaaaagc

SEQ ID NO: 59109 - DNA, 16 bp, H. sapiens
caaaagaattcaaagc

SEQ ID NO: 59110 - DNA, 16 bp, H. sapiens
caaaagaattgaaaat

SEQ ID NO: 59111 - DNA, 16 bp, H. sapiens
caaaagaattgaaatc

SEQ ID NO: 59112 - DNA, 16 bp, H. sapiens
caaaagacaactgaaa

SEQ ID NO: 59113 - DNA, 16 bp, H. sapiens
caaaagacataatttt

SEQ ID NO: 59114 - DNA, 16 bp, H. sapiens
caaaagacttgaacag

SEQ ID NO: 59115 - DNA, 16 bp, H. sapiens
caaaagagaaatttta

SEQ ID NO: 59116 - DNA, 16 bp, H. sapiens
caaaagagagcagagg

SEQ ID NO: 59117 - DNA, 16 bp, H. sapiens
caaaagaggaaataca

SEQ ID NO: 59118 - DNA, 16 bp, H. sapiens
caaaagagtgaaaaga

SEQ ID NO: 59119 - DNA, 16 bp, H. sapiens
caaaagatataaacag

SEQ ID NO: 59120 - DNA, 16 bp, H. sapiens
caaaagatcaacaaag

SEQ ID NO: 59121 - DNA, 16 bp, H. sapiens
caaaagatgaagagaa

SEQ ID NO: 59122 - DNA, 16 bp, H. sapiens
caaaagatgcagaaaa

SEQ ID NO: 59123 - DNA, 16 bp, H. sapiens
caaaagattaatgaaa

SEQ ID NO: 59124 - DNA, 16 bp, H. sapiens
caaaagcaaaacattt

SEQ ID NO: 59125 - DNA, 16 bp, H. sapiens
caaaagcaagaaatgg

SEQ ID NO: 59126 - DNA, 16 bp, H. sapiens
caaaagcaatgctaag

SEQ ID NO: 59127 - DNA, 16 bp, H. sapiens
caaaagcaattcaatg

SEQ ID NO: 59128 - DNA, 16 bp, H. sapiens
caaaagcaatttaatg

SEQ ID NO: 59129 - DNA, 16 bp, H. sapiens
caaaagcaatttttaa

SEQ ID NO: 59130 - DNA, 16 bp, H. sapiens
caaaagcagaaactcc

SEQ ID NO: 59131 - DNA, 16 bp, H. sapiens
caaaagcagaagctgc

SEQ ID NO: 59132 - DNA, 16 bp, H. sapiens
caaaagcagggaagcc

SEQ ID NO: 59133 - DNA, 16 bp, H. sapiens
caaaagcataattcat

SEQ ID NO: 59134 - DNA, 16 bp, H. sapiens
caaaagcattaaaaat

SEQ ID NO: 59135 - DNA, 16 bp, H. sapiens
caaaagcatttaaaaa

SEQ ID NO: 59136 - DNA, 16 bp, H. sapiens
caaaagccaaaatgga

SEQ ID NO: 59137 - DNA, 16 bp, H. sapiens
caaaagccaagacagg

SEQ ID NO: 59138 - DNA, 16 bp, H. sapiens
caaaagcccaactggt

SEQ ID NO: 59139 - DNA, 16 bp, H. sapiens
caaaagcccatttaaa

SEQ ID NO: 59140 - DNA, 16 bp, H. sapiens
caaaagcctcagaacc

SEQ ID NO: 59141 - DNA, 16 bp, H. sapiens
caaaagcctttttttt

SEQ ID NO: 59142 - DNA, 16 bp, H. sapiens
caaaagctagaaataa

SEQ ID NO: 59143 - DNA, 16 bp, H. sapiens
caaaagctagaaatga

SEQ ID NO: 59144 - DNA, 16 bp, H. sapiens
caaaagctagcagaga

SEQ ID NO: 59145 - DNA, 16 bp, H. sapiens
caaaagctgagagagt

SEQ ID NO: 59146 - DNA, 16 bp, H. sapiens
caaaagctttttaaaa

SEQ ID NO: 59147 - DNA, 16 bp, H. sapiens
caaaaggaaaaacatt

SEQ ID NO: 59148 - DNA, 16 bp, H. sapiens
caaaaggaaaacattt

SEQ ID NO: 59149 - DNA, 16 bp, H. sapiens
caaaaggaaaatatca

SEQ ID NO: 59150 - DNA, 16 bp, H. sapiens
caaaaggaaatgaaat

SEQ ID NO: 59151 - DNA, 16 bp, H. sapiens
caaaaggaacaaagcc

SEQ ID NO: 59152 - DNA, 16 bp, H. sapiens
caaaaggaagagtcag

SEQ ID NO: 59153 - DNA, 16 bp, H. sapiens
caaaaggaagattttt

SEQ ID NO: 59154 - DNA, 16 bp, H. sapiens
caaaaggaatcatcat

SEQ ID NO: 59155 - DNA, 16 bp, H. sapiens
caaaaggacacagaag

SEQ ID NO: 59156 - DNA, 16 bp, H. sapiens
caaaaggattttaaaa

SEQ ID NO: 59157 - DNA, 16 bp, H. sapiens
caaaaggatttttaaa

SEQ ID NO: 59158 - DNA, 16 bp, H. sapiens
caaaaggcagaggaag

SEQ ID NO: 59159 - DNA, 16 bp, H. sapiens
caaaaggcatgtctta

SEQ ID NO: 59160 - DNA, 16 bp, H. sapiens
caaaagggactttaca

SEQ ID NO: 59161 - DNA, 16 bp, H. sapiens
caaaagggagaaattg

SEQ ID NO: 59162 - DNA, 16 bp, H. sapiens
caaaaggtagaaatga

SEQ ID NO: 59163 - DNA, 16 bp, H. sapiens
caaaagtaaaatatat

SEQ ID NO: 59164 - DNA, 16 bp, H. sapiens
caaaagtaaatgcaac

SEQ ID NO: 59165 - DNA, 16 bp, H. sapiens
caaaagtagagaaaat

SEQ ID NO: 59166 - DNA, 16 bp, H. sapiens
caaaagtcagctgggc

SEQ ID NO: 59167 - DNA, 16 bp, H. sapiens
caaaagtgagcagaag

SEQ ID NO: 59168 - DNA, 16 bp, H. sapiens
caaaagtgattttttt

SEQ ID NO: 59169 - DNA, 16 bp, H. sapiens
caaaagttgaaagcat

SEQ ID NO: 59170 - DNA, 16 bp, H. sapiens
caaaagttgacaaatg

SEQ ID NO: 59171 - DNA, 16 bp, H. sapiens
caaaagtttattttct

SEQ ID NO: 59172 - DNA, 16 bp, H. sapiens
caaaagtttcctcctg

SEQ ID NO: 59173 - DNA, 16 bp, H. sapiens
caaaagtttccttgtg

SEQ ID NO: 59174 - DNA, 16 bp, H. sapiens
caaaagtttggaaaat

SEQ ID NO: 59175 - DNA, 16 bp, H. sapiens
caaaagttttcaattt

SEQ ID NO: 59176 - DNA, 16 bp, H. sapiens
caaaagttttcatttt

SEQ ID NO: 59177 - DNA, 16 bp, H. sapiens
caaaataaaaagcttc

SEQ ID NO: 59178 - DNA, 16 bp, H. sapiens
caaaataaaaagtttt

SEQ ID NO: 59179 - DNA, 16 bp, H. sapiens
caaaataaaacatgtt

SEQ ID NO: 59180 - DNA, 16 bp, H. sapiens
caaaataaaagatttt

SEQ ID NO: 59181 - DNA, 16 bp, H. sapiens
caaaataaaagttttt

SEQ ID NO: 59182 - DNA, 16 bp, H. sapiens
caaaataaacctgtct

SEQ ID NO: 59183 - DNA, 16 bp, H. sapiens
caaaataaactaagac

SEQ ID NO: 59184 - DNA, 16 bp, H. sapiens
caaaataaactgtcaa

SEQ ID NO: 59185 - DNA, 16 bp, H. sapiens
caaaataaagatattt

SEQ ID NO: 59186 - DNA, 16 bp, H. sapiens
caaaataaagccaaat

SEQ ID NO: 59187 - DNA, 16 bp, H. sapiens
caaaataaatattctt

SEQ ID NO: 59188 - DNA, 16 bp, H. sapiens
caaaataaattgtttt

SEQ ID NO: 59189 - DNA, 16 bp, H. sapiens
caaaataaccagcgaa

SEQ ID NO: 59190 - DNA, 16 bp, H. sapiens
caaaataagttgaaaa

SEQ ID NO: 59191 - DNA, 16 bp, H. sapiens
caaaataataatgagg

SEQ ID NO: 59192 - DNA, 16 bp, H. sapiens
caaaataatactgaaa

SEQ ID NO: 59193 - DNA, 16 bp, H. sapiens
caaaataatattgaaa

SEQ ID NO: 59194 - DNA, 16 bp, H. sapiens
caaaataatattttca

SEQ ID NO: 59195 - DNA, 16 bp, H. sapiens
caaaataatctgtata

SEQ ID NO: 59196 - DNA, 16 bp, H. sapiens
caaaataatctttatg

SEQ ID NO: 59197 - DNA, 16 bp, H. sapiens
caaaataatggcattt

SEQ ID NO: 59198 - DNA, 16 bp, H. sapiens
caaaataatgtatttt

SEQ ID NO: 59199 - DNA, 16 bp, H. sapiens
caaaataatgttttaa

SEQ ID NO: 59200 - DNA, 16 bp, H. sapiens
caaaataattcttttt

SEQ ID NO: 59201 - DNA, 16 bp, H. sapiens
caaaatacacattctt

SEQ ID NO: 59202 - DNA, 16 bp, H. sapiens
caaaatacatgaagta

SEQ ID NO: 59203 - DNA, 16 bp, H. sapiens
caaaatacatttttaa

SEQ ID NO: 59204 - DNA, 16 bp, H. sapiens
caaaataccaatgata

SEQ ID NO: 59205 - DNA, 16 bp, H. sapiens
caaaatactatcaaat

SEQ ID NO: 59206 - DNA, 16 bp, H. sapiens
caaaatacttaggaat

SEQ ID NO: 59207 - DNA, 16 bp, H. sapiens
caaaatagaattcaag

SEQ ID NO: 59208 - DNA, 16 bp, H. sapiens
caaaatagcaagaaga

SEQ ID NO: 59209 - DNA, 16 bp, H. sapiens
caaaatagccaaagct

SEQ ID NO: 59210 - DNA, 16 bp, H. sapiens
caaaataggcctcaaa

SEQ ID NO: 59211 - DNA, 16 bp, H. sapiens
caaaatagttgataaa

SEQ ID NO: 59212 - DNA, 16 bp, H. sapiens
caaaatataaagacca

SEQ ID NO: 59213 - DNA, 16 bp, H. sapiens
caaaatatactacaga

SEQ ID NO: 59214 - DNA, 16 bp, H. sapiens
caaaatatataatggt

SEQ ID NO: 59215 - DNA, 16 bp, H. sapiens
caaaatatatgagaaa

SEQ ID NO: 59216 - DNA, 16 bp, H. sapiens
caaaatatattagaaa

SEQ ID NO: 59217 - DNA, 16 bp, H. sapiens
caaaatatattaggaa

SEQ ID NO: 59218 - DNA, 16 bp, H. sapiens
caaaatatctcctatt

SEQ ID NO: 59219 - DNA, 16 bp, H. sapiens
caaaatatctgaaaca

SEQ ID NO: 59220 - DNA, 16 bp, H. sapiens
caaaatatctgaatag

SEQ ID NO: 59221 - DNA, 16 bp, H. sapiens
caaaatatgaaatatt

SEQ ID NO: 59222 - DNA, 16 bp, H. sapiens
caaaatatgtaagaaa

SEQ ID NO: 59223 - DNA, 16 bp, H. sapiens
caaaatattaaaaatg

SEQ ID NO: 59224 - DNA, 16 bp, H. sapiens
caaaatattagcaaat

SEQ ID NO: 59225 - DNA, 16 bp, H. sapiens
caaaatattgaaagaa

SEQ ID NO: 59226 - DNA, 16 bp, H. sapiens
caaaatatttaaaatg

SEQ ID NO: 59227 - DNA, 16 bp, H. sapiens
caaaatattttgtaaa

SEQ ID NO: 59228 - DNA, 16 bp, H. sapiens
caaaatatttttacat

SEQ ID NO: 59229 - DNA, 16 bp, H. sapiens
caaaatatttttcatt

SEQ ID NO: 59230 - DNA, 16 bp, H. sapiens
caaaatcaaaatttca

SEQ ID NO: 59231 - DNA, 16 bp, H. sapiens
caaaatcaaagccaaa

SEQ ID NO: 59232 - DNA, 17 bp, H. sapiens
caaaatcaacatgcaaa

SEQ ID NO: 59233 - DNA, 16 bp, H. sapiens
caaaatcaactttttc

SEQ ID NO: 59234 - DNA, 16 bp, H. sapiens
caaaatcaagatgtca

SEQ ID NO: 59235 - DNA, 16 bp, H. sapiens
caaaatcactaagcca

SEQ ID NO: 59236 - DNA, 16 bp, H. sapiens
caaaatcagaaatgaa

SEQ ID NO: 59237 - DNA, 16 bp, H. sapiens
caaaatcagctgggcg

SEQ ID NO: 59238 - DNA, 16 bp, H. sapiens
caaaatcatctctctc

SEQ ID NO: 59239 - DNA, 16 bp, H. sapiens
caaaatcatctggcaa

SEQ ID NO: 59240 - DNA, 16 bp, H. sapiens
caaaatcatttttctt

SEQ ID NO: 59241 - DNA, 16 bp, H. sapiens
caaaatccacagatgc

SEQ ID NO: 59242 - DNA, 16 bp, H. sapiens
caaaatccagaacact

SEQ ID NO: 59243 - DNA, 16 bp, H. sapiens
caaaatccatgttgaa

SEQ ID NO: 59244 - DNA, 16 bp, H. sapiens
caaaatctatgagata

SEQ ID NO: 59245 - DNA, 16 bp, H. sapiens
caaaatctcaaaagta

SEQ ID NO: 59246 - DNA, 16 bp, H. sapiens
caaaatctcagtgact

SEQ ID NO: 59247 - DNA, 16 bp, H. sapiens
caaaatctcatcttga

SEQ ID NO: 59248 - DNA, 21 bp, H. sapiens
caaaatctcctcaagctgata

SEQ ID NO: 59249 - DNA, 16 bp, H. sapiens
caaaatctcctttgac

SEQ ID NO: 59250 - DNA, 16 bp, H. sapiens
caaaatctctgagcat

SEQ ID NO: 59251 - DNA, 16 bp, H. sapiens
caaaatctgaaaaaat

SEQ ID NO: 59252 - DNA, 16 bp, H. sapiens
caaaatctgaaacttt

SEQ ID NO: 59253 - DNA, 16 bp, H. sapiens
caaaatctgaaatgct

SEQ ID NO: 59254 - DNA, 16 bp, H. sapiens
caaaatctttcttcag

SEQ ID NO: 59255 - DNA, 16 bp, H. sapiens
caaaatgaaaatatgg

SEQ ID NO: 59256 - DNA, 16 bp, H. sapiens
caaaatgaaaatattt

SEQ ID NO: 59257 - DNA, 16 bp, H. sapiens
caaaatgaaaatgtag

SEQ ID NO: 59258 - DNA, 16 bp, H. sapiens
caaaatgaaaggaaat

SEQ ID NO: 59259 - DNA, 16 bp, H. sapiens
caaaatgaaatatttt

SEQ ID NO: 59260 - DNA, 16 bp, H. sapiens
caaaatgaaatgtgaa

SEQ ID NO: 59261 - DNA, 16 bp, H. sapiens
caaaatgaacatacaa

SEQ ID NO: 59262 - DNA, 16 bp, H. sapiens
caaaatgaagacattt

SEQ ID NO: 59263 - DNA, 16 bp, H. sapiens
caaaatgaaggaagaa

SEQ ID NO: 59264 - DNA, 16 bp, H. sapiens
caaaatgaatgcaaaa

SEQ ID NO: 59265 - DNA, 16 bp, H. sapiens
caaaatgaattttttt

SEQ ID NO: 59266 - DNA, 16 bp, H. sapiens
caaaatgacaaaatca

SEQ ID NO: 59267 - DNA, 16 bp, H. sapiens
caaaatgagaataata

SEQ ID NO: 59268 - DNA, 16 bp, H. sapiens
caaaatgattataaaa

SEQ ID NO: 59269 - DNA, 16 bp, H. sapiens
caaaatgatttccttt

SEQ ID NO: 59270 - DNA, 16 bp, H. sapiens
caaaatgattttaaaa

SEQ ID NO: 59271 - DNA, 16 bp, H. sapiens
caaaatgattttgaaa

SEQ ID NO: 59272 - DNA, 16 bp, H. sapiens
caaaatgatttttaat

SEQ ID NO: 59273 - DNA, 16 bp, H. sapiens
caaaatgcaaatgcaa

SEQ ID NO: 59274 - DNA, 16 bp, H. sapiens
caaaatgcacaaagca

SEQ ID NO: 59275 - DNA, 16 bp, H. sapiens
caaaatgcatgtgttg

SEQ ID NO: 59276 - DNA, 16 bp, H. sapiens
caaaatgcattcattt

SEQ ID NO: 59277 - DNA, 16 bp, H. sapiens
caaaatgccacagact

SEQ ID NO: 59278 - DNA, 16 bp, H. sapiens
caaaatgctccagtga

SEQ ID NO: 59279 - DNA, 16 bp, H. sapiens
caaaatgctgagatta

SEQ ID NO: 59280 - DNA, 16 bp, H. sapiens
caaaatgctgataatg

SEQ ID NO: 59281 - DNA, 16 bp, H. sapiens
caaaatgctggaatta

SEQ ID NO: 59282 - DNA, 16 bp, H. sapiens
caaaatgctgggactg

SEQ ID NO: 59283 - DNA, 16 bp, H. sapiens
caaaatgctgggattt

SEQ ID NO: 59284 - DNA, 16 bp, H. sapiens
caaaatgctttcatat

SEQ ID NO: 59285 - DNA, 16 bp, H. sapiens
caaaatgcttttaaaa

SEQ ID NO: 59286 - DNA, 16 bp, H. sapiens
caaaatggaatatttt

SEQ ID NO: 59287 - DNA, 16 bp, H. sapiens
caaaatggacctaaca

SEQ ID NO: 59288 - DNA, 16 bp, H. sapiens
caaaatggatcaagga

SEQ ID NO: 59289 - DNA, 16 bp, H. sapiens
caaaatggattaaaca

SEQ ID NO: 59290 - DNA, 16 bp, H. sapiens
caaaatggatttaaaa

SEQ ID NO: 59291 - DNA, 16 bp, H. sapiens
caaaatggcggctcca

SEQ ID NO: 59292 - DNA, 16 bp, H. sapiens
caaaatggctgctgca

SEQ ID NO: 59293 - DNA, 16 bp, H. sapiens
caaaatggcttaaaga

SEQ ID NO: 59294 - DNA, 16 bp, H. sapiens
caaaatgggagaaaac

SEQ ID NO: 59295 - DNA, 16 bp, H. sapiens
caaaatgggcataata

SEQ ID NO: 59296 - DNA, 16 bp, H. sapiens
caaaatgggtggatca

SEQ ID NO: 59297 - DNA, 16 bp, H. sapiens
caaaatggtgattttt

SEQ ID NO: 59298 - DNA, 16 bp, H. sapiens
caaaatggttaagatg

SEQ ID NO: 59299 - DNA, 16 bp, H. sapiens
caaaatgtaaaatgcc

SEQ ID NO: 59300 - DNA, 16 bp, H. sapiens
caaaatgtagggatta

SEQ ID NO: 59301 - DNA, 16 bp, H. sapiens
caaaatgtataaggaa

SEQ ID NO: 59302 - DNA, 16 bp, H. sapiens
caaaatgtcaacaaat

SEQ ID NO: 59303 - DNA, 16 bp, H. sapiens
caaaatgtctccagac

SEQ ID NO: 59304 - DNA, 16 bp, H. sapiens
caaaatgtgaacattt

SEQ ID NO: 59305 - DNA, 16 bp, H. sapiens
caaaatgtgttttaaa

SEQ ID NO: 59306 - DNA, 16 bp, H. sapiens
caaaatgttaacaact

SEQ ID NO: 59307 - DNA, 16 bp, H. sapiens
caaaatgttaacagtg

SEQ ID NO: 59308 - DNA, 16 bp, H. sapiens
caaaatgttgaaagaa

SEQ ID NO: 59309 - DNA, 16 bp, H. sapiens
caaaatgttgctgaaa

SEQ ID NO: 59310 - DNA, 16 bp, H. sapiens
caaaatgttttaaaat

SEQ ID NO: 59311 - DNA, 16 bp, H. sapiens
caaaatgttttcaagg

SEQ ID NO: 59312 - DNA, 16 bp, H. sapiens
caaaatgttttccaaa

SEQ ID NO: 59313 - DNA, 16 bp, H. sapiens
caaaatgttttggatt

SEQ ID NO: 59314 - DNA, 16 bp, H. sapiens
caaaattaaaagagca

SEQ ID NO: 59315 - DNA, 16 bp, H. sapiens
caaaattaaacatttt

SEQ ID NO: 59316 - DNA, 16 bp, H. sapiens
caaaattaagtatttt

SEQ ID NO: 59317 - DNA, 16 bp, H. sapiens
caaaattaattttagt

SEQ ID NO: 59318 - DNA, 16 bp, H. sapiens
caaaattacctgggtg

SEQ ID NO: 59319 - DNA, 16 bp, H. sapiens
caaaattagccagcca

SEQ ID NO: 59320 - DNA, 16 bp, H. sapiens
caaaattagccagcgt

SEQ ID NO: 59321 - DNA, 16 bp, H. sapiens
caaaattagctaggca

SEQ ID NO: 59322 - DNA, 16 bp, H. sapiens
caaaattagttttaaa

SEQ ID NO: 59323 - DNA, 16 bp, H. sapiens
caaaattatagagaca

SEQ ID NO: 59324 - DNA, 16 bp, H. sapiens
caaaattatcctttaa

SEQ ID NO: 59325 - DNA, 16 bp, H. sapiens
caaaattatctttcaa

SEQ ID NO: 59326 - DNA, 16 bp, H. sapiens
caaaattatgaaaata

SEQ ID NO: 59327 - DNA, 16 bp, H. sapiens
caaaattattttcaaa

SEQ ID NO: 59328 - DNA, 16 bp, H. sapiens
caaaattattttcagt

SEQ ID NO: 59329 - DNA, 16 bp, H. sapiens
caaaattcatagaact

SEQ ID NO: 59330 - DNA, 16 bp, H. sapiens
caaaattcatatggaa

SEQ ID NO: 59331 - DNA, 16 bp, H. sapiens
caaaattcatctgttg

SEQ ID NO: 59332 - DNA, 16 bp, H. sapiens
caaaattcatgtgttg

SEQ ID NO: 59333 - DNA, 16 bp, H. sapiens
caaaattcctaaaaat

SEQ ID NO: 59334 - DNA, 16 bp, H. sapiens
caaaattcctgtgttg

SEQ ID NO: 59335 - DNA, 16 bp, H. sapiens
caaaattgaatttttt

SEQ ID NO: 59336 - DNA, 16 bp, H. sapiens
caaaattgaccacaaa

SEQ ID NO: 59337 - DNA, 16 bp, H. sapiens
caaaattgcccctggt

SEQ ID NO: 59338 - DNA, 16 bp, H. sapiens
caaaattggagaaact

SEQ ID NO: 59339 - DNA, 16 bp, H. sapiens
caaaattgttttaaaa

SEQ ID NO: 59340 - DNA, 16 bp, H. sapiens
caaaattgttttggtt

SEQ ID NO: 59341 - DNA, 16 bp, H. sapiens
caaaatttaaattttg

SEQ ID NO: 59342 - DNA, 16 bp, H. sapiens
caaaatttaccatttt

SEQ ID NO: 59343 - DNA, 16 bp, H. sapiens
caaaatttcacaaatc

SEQ ID NO: 59344 - DNA, 16 bp, H. sapiens
caaaatttcccctttt

SEQ ID NO: 59345 - DNA, 16 bp, H. sapiens
caaaatttggaatcaa

SEQ ID NO: 59346 - DNA, 16 bp, H. sapiens
caaaatttgtatgttg

SEQ ID NO: 59347 - DNA, 16 bp, H. sapiens
caaaatttgtttttgt

SEQ ID NO: 59348 - DNA, 16 bp, H. sapiens
caaaattttaaacttt

SEQ ID NO: 59349 - DNA, 16 bp, H. sapiens
caaaattttgctttcc

SEQ ID NO: 59350 - DNA, 16 bp, H. sapiens
caaacaaaaaaatgtt

SEQ ID NO: 59351 - DNA, 16 bp, H. sapiens
caaacaaaaaacagtt

SEQ ID NO: 59352 - DNA, 16 bp, H. sapiens
caaacaaaaaagctga

SEQ ID NO: 59353 - DNA, 16 bp, H. sapiens
caaacaaaaaatctct

SEQ ID NO: 59354 - DNA, 16 bp, H. sapiens
caaacaaaaagaagtg

SEQ ID NO: 59355 - DNA, 16 bp, H. sapiens
caaacaaaaatagttt

SEQ ID NO: 59356 - DNA, 16 bp, H. sapiens
caaacaaaaatgcatt

SEQ ID NO: 59357 - DNA, 16 bp, H. sapiens
caaacaaaagttgagg

SEQ ID NO: 59358 - DNA, 16 bp, H. sapiens
caaacaaacaaaactg

SEQ ID NO: 59359 - DNA, 16 bp, H. sapiens
caaacaaacaaaatgt

SEQ ID NO: 59360 - DNA, 16 bp, H. sapiens
caaacaaacagaaatt

SEQ ID NO: 59361 - DNA, 16 bp, H. sapiens
caaacaaatgctgaaa

SEQ ID NO: 59362 - DNA, 16 bp, H. sapiens
caaacaaatggaagag

SEQ ID NO: 59363 - DNA, 16 bp, H. sapiens
caaacaaccccatgaa

SEQ ID NO: 59364 - DNA, 16 bp, H. sapiens
caaacaactccatcaa

SEQ ID NO: 59365 - DNA, 16 bp, H. sapiens
caaacaactggaaaaa

SEQ ID NO: 59366 - DNA, 16 bp, H. sapiens
caaacaactggaagaa

SEQ ID NO: 59367 - DNA, 16 bp, H. sapiens
caaacaacttcagcaa

SEQ ID NO: 59368 - DNA, 16 bp, H. sapiens
caaacaattagaaaat

SEQ ID NO: 59369 - DNA, 16 bp, H. sapiens
caaacacacacaaatg

SEQ ID NO: 59370 - DNA, 16 bp, H. sapiens
caaacacacacactct

SEQ ID NO: 59371 - DNA, 16 bp, H. sapiens
caaacacacacatgca

SEQ ID NO: 59372 - DNA, 16 bp, H. sapiens
caaacacagtggctta

SEQ ID NO: 59373 - DNA, 25 bp, H. sapiens
caaacacatccgaacatcagaagga

SEQ ID NO: 59374 - DNA, 16 bp, H. sapiens
caaacacatttatttt

SEQ ID NO: 59375 - DNA, 16 bp, H. sapiens
caaacaccagtctaga

SEQ ID NO: 59376 - DNA, 16 bp, H. sapiens
caaacactagaactca

SEQ ID NO: 59377 - DNA, 16 bp, H. sapiens
caaacactagtctaga

SEQ ID NO: 59378 - DNA, 16 bp, H. sapiens
caaacactgatggaat

SEQ ID NO: 59379 - DNA, 16 bp, H. sapiens
caaacactgcagaagg

SEQ ID NO: 59380 - DNA, 16 bp, H. sapiens
caaacactgtggaagg

SEQ ID NO: 59381 - DNA, 16 bp, H. sapiens
caaacactgtgtcatt

SEQ ID NO: 59382 - DNA, 16 bp, H. sapiens
caaacactgtttttgt

SEQ ID NO: 59383 - DNA, 16 bp, H. sapiens
caaacactttggaaaa

SEQ ID NO: 59384 - DNA, 16 bp, H. sapiens
caaacacttttaaaac

SEQ ID NO: 59385 - DNA, 16 bp, H. sapiens
caaacagaaactttgt

SEQ ID NO: 59386 - DNA, 16 bp, H. sapiens
caaacagaattttaaa

SEQ ID NO: 59387 - DNA, 16 bp, H. sapiens
caaacagagagccaca

SEQ ID NO: 59388 - DNA, 16 bp, H. sapiens
caaacagattaagaca

SEQ ID NO: 59389 - DNA, 16 bp, H. sapiens
caaacagatttacaag

SEQ ID NO: 59390 - DNA, 16 bp, H. sapiens
caaacagcaaatattt

SEQ ID NO: 59391 - DNA, 16 bp, H. sapiens
caaacagcagcagcag

SEQ ID NO: 59392 - DNA, 16 bp, H. sapiens
caaacagctgcctctg

SEQ ID NO: 59393 - DNA, 16 bp, H. sapiens
caaacagggaccattt

SEQ ID NO: 59394 - DNA, 16 bp, H. sapiens
caaacaggggtggtgt

SEQ ID NO: 59395 - DNA, 16 bp, H. sapiens
caaacagggtctagag

SEQ ID NO: 59396 - DNA, 16 bp, H. sapiens
caaacagggtctgcag

SEQ ID NO: 59397 - DNA, 16 bp, H. sapiens
caaacagggtctggaa

SEQ ID NO: 59398 - DNA, 16 bp, H. sapiens
caaacagttccaacct

SEQ ID NO: 59399 - DNA, 16 bp, H. sapiens
caaacataatgttgaa

SEQ ID NO: 59400 - DNA, 16 bp, H. sapiens
caaacataatttttaa

SEQ ID NO: 59401 - DNA, 16 bp, H. sapiens
caaacatatgcacaca

SEQ ID NO: 59402 - DNA, 16 bp, H. sapiens
caaacatcagactcca

SEQ ID NO: 59403 - DNA, 16 bp, H. sapiens
caaacatcatactgaa

SEQ ID NO: 59404 - DNA, 16 bp, H. sapiens
caaacatcatatttaa

SEQ ID NO: 59405 - DNA, 16 bp, H. sapiens
caaacatgcatatgta

SEQ ID NO: 59406 - DNA, 16 bp, H. sapiens
caaacatggcaaaatc

SEQ ID NO: 59407 - DNA, 16 bp, H. sapiens
caaacatgtacacaca

SEQ ID NO: 59408 - DNA, 16 bp, H. sapiens
caaacattaattgagc

SEQ ID NO: 59409 - DNA, 16 bp, H. sapiens
caaacattagccaggt

SEQ ID NO: 59410 - DNA, 16 bp, H. sapiens
caaacattcagacaat

SEQ ID NO: 59411 - DNA, 16 bp, H. sapiens
caaacattctcaacaa

SEQ ID NO: 59412 - DNA, 16 bp, H. sapiens
caaacatttattattt

SEQ ID NO: 59413 - DNA, 16 bp, H. sapiens
caaacattttataaat

SEQ ID NO: 59414 - DNA, 16 bp, H. sapiens
caaacattttcctttt

SEQ ID NO: 59415 - DNA, 16 bp, H. sapiens
caaacattttttttaa

SEQ ID NO: 59416 - DNA, 16 bp, H. sapiens
caaaccaaatccaaag

SEQ ID NO: 59417 - DNA, 16 bp, H. sapiens
caaaccaacagccaat

SEQ ID NO: 59418 - DNA, 16 bp, H. sapiens
caaaccaagaagaaat

SEQ ID NO: 59419 - DNA, 16 bp, H. sapiens
caaaccaagatgaaat

SEQ ID NO: 59420 - DNA, 16 bp, H. sapiens
caaaccacaatggcac

SEQ ID NO: 59421 - DNA, 16 bp, H. sapiens
caaaccacagagtggg

SEQ ID NO: 59422 - DNA, 16 bp, H. sapiens
caaaccaccagaagcc

SEQ ID NO: 59423 - DNA, 16 bp, H. sapiens
caaaccactgcactcc

SEQ ID NO: 59424 - DNA, 16 bp, H. sapiens
caaaccaggaagaagt

SEQ ID NO: 59425 - DNA, 16 bp, H. sapiens
caaaccaggaagaggg

SEQ ID NO: 59426 - DNA, 16 bp, H. sapiens
caaaccatatcagata

SEQ ID NO: 59427 - DNA, 16 bp, H. sapiens
caaaccatatcagtgc

SEQ ID NO: 59428 - DNA, 16 bp, H. sapiens
caaaccatatcataaa

SEQ ID NO: 59429 - DNA, 16 bp, H. sapiens
caaaccatcctttgct

SEQ ID NO: 59430 - DNA, 16 bp, H. sapiens
caaacccaaggtcatc

SEQ ID NO: 59431 - DNA, 16 bp, H. sapiens
caaacccacagaatgc

SEQ ID NO: 59432 - DNA, 16 bp, H. sapiens
caaacccagcactttg

SEQ ID NO: 59433 - DNA, 16 bp, H. sapiens
caaacccaggtctgtg

SEQ ID NO: 59434 - DNA, 16 bp, H. sapiens
caaacccctgacctca

SEQ ID NO: 59435 - DNA, 16 bp, H. sapiens
caaacccctgacctta

SEQ ID NO: 59436 - DNA, 16 bp, H. sapiens
caaacccctgacttca

SEQ ID NO: 59437 - DNA, 16 bp, H. sapiens
caaacccctggcattt

SEQ ID NO: 59438 - DNA, 22 bp, H. sapiens
caaaccctagaagaaaacctag

SEQ ID NO: 59439 - DNA, 16 bp, H. sapiens
caaaccctggctcctc

SEQ ID NO: 59440 - DNA, 16 bp, H. sapiens
caaacctagagaaaca

SEQ ID NO: 59441 - DNA, 16 bp, H. sapiens
caaacctagagaaaga

SEQ ID NO: 59442 - DNA, 16 bp, H. sapiens
caaacctcagcaacat

SEQ ID NO: 59443 - DNA, 16 bp, H. sapiens
caaacctcatctctac

SEQ ID NO: 59444 - DNA, 16 bp, H. sapiens
caaacctctgcctgga

SEQ ID NO: 59445 - DNA, 16 bp, H. sapiens
caaacctgagaaaagc

SEQ ID NO: 59446 - DNA, 16 bp, H. sapiens
caaacctgcacatcca

SEQ ID NO: 59447 - DNA, 16 bp, H. sapiens
caaactaacaggaaca

SEQ ID NO: 59448 - DNA, 16 bp, H. sapiens
caaactaagcttcaca

SEQ ID NO: 59449 - DNA, 16 bp, H. sapiens
caaactacagcctgca

SEQ ID NO: 59450 - DNA, 16 bp, H. sapiens
caaactactgaatgaa

SEQ ID NO: 59451 - DNA, 16 bp, H. sapiens
caaactatactgcagg

SEQ ID NO: 59452 - DNA, 16 bp, H. sapiens
caaactattgatacac

SEQ ID NO: 59453 - DNA, 16 bp, H. sapiens
caaactattgatacat

SEQ ID NO: 59454 - DNA, 16 bp, H. sapiens
caaactatttttcttt

SEQ ID NO: 59455 - DNA, 16 bp, H. sapiens
caaactcaagcaatcc

SEQ ID NO: 59456 - DNA, 16 bp, H. sapiens
caaactcattttatga

SEQ ID NO: 59457 - DNA, 16 bp, H. sapiens
caaactccaccttctg

SEQ ID NO: 59458 - DNA, 16 bp, H. sapiens
caaactccagacctca

SEQ ID NO: 59459 - DNA, 16 bp, H. sapiens
caaactccatctccca

SEQ ID NO: 59460 - DNA, 16 bp, H. sapiens
caaactcctaggctca

SEQ ID NO: 59461 - DNA, 16 bp, H. sapiens
caaactcctgacttct

SEQ ID NO: 59462 - DNA, 16 bp, H. sapiens
caaactcctggccttc

SEQ ID NO: 59463 - DNA, 16 bp, H. sapiens
caaactcctgtgttca

SEQ ID NO: 59464 - DNA, 16 bp, H. sapiens
caaactctgcttccca

SEQ ID NO: 59465 - DNA, 16 bp, H. sapiens
caaactctgcttcctg

SEQ ID NO: 59466 - DNA, 16 bp, H. sapiens
caaactcttgacttca

SEQ ID NO: 59467 - DNA, 16 bp, H. sapiens
caaactcttgagctca

SEQ ID NO: 59468 - DNA, 16 bp, H. sapiens
caaactgaaactctat

SEQ ID NO: 59469 - DNA, 16 bp, H. sapiens
caaactgaaatgcaaa

SEQ ID NO: 59470 - DNA, 16 bp, H. sapiens
caaactgaatccagca

SEQ ID NO: 59471 - DNA, 16 bp, H. sapiens
caaactgaatccatca

SEQ ID NO: 59472 - DNA, 16 bp, H. sapiens
caaactgaattcagca

SEQ ID NO: 59473 - DNA, 16 bp, H. sapiens
caaactgctcattcaa

SEQ ID NO: 59474 - DNA, 16 bp, H. sapiens
caaactggaaaaatat

SEQ ID NO: 59475 - DNA, 16 bp, H. sapiens
caaactggaaacaatc

SEQ ID NO: 59476 - DNA, 16 bp, H. sapiens
caaactgtaaaaatcc

SEQ ID NO: 59477 - DNA, 16 bp, H. sapiens
caaactgtatcattct

SEQ ID NO: 59478 - DNA, 16 bp, H. sapiens
caaactgttcctgttt

SEQ ID NO: 59479 - DNA, 16 bp, H. sapiens
caaactgtttcccaaa

SEQ ID NO: 59480 - DNA, 16 bp, H. sapiens
caaactgttttccaaa

SEQ ID NO: 59481 - DNA, 16 bp, H. sapiens
caaactgttttccaca

SEQ ID NO: 59482 - DNA, 16 bp, H. sapiens
caaacttaaaaacatt

SEQ ID NO: 59483 - DNA, 16 bp, H. sapiens
caaacttcaattcttg

SEQ ID NO: 59484 - DNA, 16 bp, H. sapiens
caaacttcgcctcctg

SEQ ID NO: 59485 - DNA, 16 bp, H. sapiens
caaacttctaagctca

SEQ ID NO: 59486 - DNA, 17 bp, H. sapiens
caaacttctgacctcat

SEQ ID NO: 59487 - DNA, 16 bp, H. sapiens
caaacttggcctccca

SEQ ID NO: 59488 - DNA, 16 bp, H. sapiens
caaactttaaaaagaa

SEQ ID NO: 59489 - DNA, 16 bp, H. sapiens
caaactttaaaatttt

SEQ ID NO: 59490 - DNA, 16 bp, H. sapiens
caaactttaattttaa

SEQ ID NO: 59491 - DNA, 16 bp, H. sapiens
caaactttctatgatg

SEQ ID NO: 59492 - DNA, 16 bp, H. sapiens
caaactttgcctcccg

SEQ ID NO: 59493 - DNA, 16 bp, H. sapiens
caaacttttcattatt

SEQ ID NO: 59494 - DNA, 16 bp, H. sapiens
caaacttttggcctca

SEQ ID NO: 59495 - DNA, 16 bp, H. sapiens
caaactttttatgtaa

SEQ ID NO: 59496 - DNA, 16 bp, H. sapiens
caaactttttctgtga

SEQ ID NO: 59497 - DNA, 16 bp, H. sapiens
caaactttttctgtta

SEQ ID NO: 59498 - DNA, 16 bp, H. sapiens
caaactttttgaagtc

SEQ ID NO: 59499 - DNA, 16 bp, H. sapiens
caaactttttgtattt

SEQ ID NO: 59500 - DNA, 16 bp, H. sapiens
caaactttttttgtaa

SEQ ID NO: 59501 - DNA, 16 bp, H. sapiens
caaagaaaacaatcag

SEQ ID NO: 59502 - DNA, 16 bp, H. sapiens
caaagaaaactatgaa

SEQ ID NO: 59503 - DNA, 16 bp, H. sapiens
caaagaaaacttcagg

SEQ ID NO: 59504 - DNA, 16 bp, H. sapiens
caaagaaaagaatctt

SEQ ID NO: 59505 - DNA, 16 bp, H. sapiens
caaagaaaagctgagg

SEQ ID NO: 59506 - DNA, 16 bp, H. sapiens
caaagaaaatacattt

SEQ ID NO: 59507 - DNA, 16 bp, H. sapiens
caaagaaaatatttta

SEQ ID NO: 59508 - DNA, 16 bp, H. sapiens
caaagaaaatcccagg

SEQ ID NO: 59509 - DNA, 16 bp, H. sapiens
caaagaaaatgaaatg

SEQ ID NO: 59510 - DNA, 16 bp, H. sapiens
caaagaaaattcagaa

SEQ ID NO: 59511 - DNA, 16 bp, H. sapiens
caaagaaaattttaaa

SEQ ID NO: 59512 - DNA, 16 bp, H. sapiens
caaagaaacaactttt

SEQ ID NO: 59513 - DNA, 16 bp, H. sapiens
caaagaaacactggac

SEQ ID NO: 59514 - DNA, 16 bp, H. sapiens
caaagaaacatgtttt

SEQ ID NO: 59515 - DNA, 16 bp, H. sapiens
caaagaaatatgtttt

SEQ ID NO: 59516 - DNA, 16 bp, H. sapiens
caaagaaatcagagga

SEQ ID NO: 59517 - DNA, 16 bp, H. sapiens
caaagaaatcagaggt

SEQ ID NO: 59518 - DNA, 16 bp, H. sapiens
caaagaaatctgaaat

SEQ ID NO: 59519 - DNA, 16 bp, H. sapiens
caaagaaatgacaagt

SEQ ID NO: 59520 - DNA, 16 bp, H. sapiens
caaagaaatgataagt

SEQ ID NO: 59521 - DNA, 16 bp, H. sapiens
caaagaaatgctgaga

SEQ ID NO: 59522 - DNA, 16 bp, H. sapiens
caaagaaatggaaatt

SEQ ID NO: 59523 - DNA, 16 bp, H. sapiens
caaagaaattgaagat

SEQ ID NO: 59524 - DNA, 16 bp, H. sapiens
caaagaacacctggaa

SEQ ID NO: 59525 - DNA, 16 bp, H. sapiens
caaagaactctgaaaa

SEQ ID NO: 59526 - DNA, 16 bp, H. sapiens
caaagaactgaaaata

SEQ ID NO: 59527 - DNA, 16 bp, H. sapiens
caaagaactgaaagca

SEQ ID NO: 59528 - DNA, 16 bp, H. sapiens
caaagaacttcttaat

SEQ ID NO: 59529 - DNA, 16 bp, H. sapiens
caaagaactttctgag

SEQ ID NO: 59530 - DNA, 16 bp, H. sapiens
caaagaacttttaaaa

SEQ ID NO: 59531 - DNA, 16 bp, H. sapiens
caaagaacttttgttt

SEQ ID NO: 59532 - DNA, 16 bp, H. sapiens
caaagaagaaagaatt

SEQ ID NO: 59533 - DNA, 16 bp, H. sapiens
caaagaagaaattgaa

SEQ ID NO: 59534 - DNA, 16 bp, H. sapiens
caaagaagaaatttca

SEQ ID NO: 59535 - DNA, 16 bp, H. sapiens
caaagaagaattggtg

SEQ ID NO: 59536 - DNA, 16 bp, H. sapiens
caaagaagacatatga

SEQ ID NO: 59537 - DNA, 16 bp, H. sapiens
caaagaagataaatgg

SEQ ID NO: 59538 - DNA, 16 bp, H. sapiens
caaagaagccaagaac

SEQ ID NO: 59539 - DNA, 16 bp, H. sapiens
caaagaaggacaattt

SEQ ID NO: 59540 - DNA, 16 bp, H. sapiens
caaagaaggcaatcag

SEQ ID NO: 59541 - DNA, 16 bp, H. sapiens
caaagaagggccagat

SEQ ID NO: 59542 - DNA, 16 bp, H. sapiens
caaagaagtaaaagat

SEQ ID NO: 59543 - DNA, 16 bp, H. sapiens
caaagaagttaaaaac

SEQ ID NO: 59544 - DNA, 16 bp, H. sapiens
caaagaatacaaaatt

SEQ ID NO: 59545 - DNA, 16 bp, H. sapiens
caaagaatactataaa

SEQ ID NO: 59546 - DNA, 16 bp, H. sapiens
caaagaatataaatat

SEQ ID NO: 59547 - DNA, 16 bp, H. sapiens
caaagaatcaatatgt

SEQ ID NO: 59548 - DNA, 16 bp, H. sapiens
caaagaatcaggaaaa

SEQ ID NO: 59549 - DNA, 16 bp, H. sapiens
caaagaatgagccaga

SEQ ID NO: 59550 - DNA, 16 bp, H. sapiens
caaagaatgcagtttc

SEQ ID NO: 59551 - DNA, 16 bp, H. sapiens
caaagaattatctagc

SEQ ID NO: 59552 - DNA, 16 bp, H. sapiens
caaagaattcttaaaa

SEQ ID NO: 59553 - DNA, 16 bp, H. sapiens
caaagaattcttagac

SEQ ID NO: 59554 - DNA, 16 bp, H. sapiens
caaagaatttaaacaa

SEQ ID NO: 59555 - DNA, 16 bp, H. sapiens
caaagaattttaaaaa

SEQ ID NO: 59556 - DNA, 16 bp, H. sapiens
caaagaattttttttt

SEQ ID NO: 59557 - DNA, 16 bp, H. sapiens
caaagacaaatttaaa

SEQ ID NO: 59558 - DNA, 22 bp, H. sapiens
caaagacacaacatatcagaat

SEQ ID NO: 59559 - DNA, 16 bp, H. sapiens
caaagacacatgaaaa

SEQ ID NO: 59560 - DNA, 16 bp, H. sapiens
caaagacagaatcaac

SEQ ID NO: 59561 - DNA, 16 bp, H. sapiens
caaagacagcaccaag

SEQ ID NO: 59562 - DNA, 16 bp, H. sapiens
caaagacaggcagccc

SEQ ID NO: 59563 - DNA, 16 bp, H. sapiens
caaagacagtgtttcc

SEQ ID NO: 59564 - DNA, 16 bp, H. sapiens
caaagacatgaaacca

SEQ ID NO: 59565 - DNA, 16 bp, H. sapiens
caaagacatggaatta

SEQ ID NO: 59566 - DNA, 16 bp, H. sapiens
caaagaccctatttcc

SEQ ID NO: 59567 - DNA, 16 bp, H. sapiens
caaagacttcatgatc

SEQ ID NO: 59568 - DNA, 18 bp, H. sapiens
caaagacttggaaccaaa

SEQ ID NO: 59569 - DNA, 16 bp, H. sapiens
caaagacttggagcca

SEQ ID NO: 59570 - DNA, 16 bp, H. sapiens
caaagactttaaaaaa

SEQ ID NO: 59571 - DNA, 16 bp, H. sapiens
caaagactttatgacc

SEQ ID NO: 59572 - DNA, 16 bp, H. sapiens
caaagagaaaactgaa

SEQ ID NO: 59573 - DNA, 16 bp, H. sapiens
caaagagaaattctgt

SEQ ID NO: 59574 - DNA, 16 bp, H. sapiens
caaagagaactacaaa

SEQ ID NO: 59575 - DNA, 16 bp, H. sapiens
caaagagaataaaatg

SEQ ID NO: 59576 - DNA, 16 bp, H. sapiens
caaagagaataaagta

SEQ ID NO: 59577 - DNA, 16 bp, H. sapiens
caaagagaataacata

SEQ ID NO: 59578 - DNA, 16 bp, H. sapiens
caaagagaataatata

SEQ ID NO: 59579 - DNA, 16 bp, H. sapiens
caaagagagagccaaa

SEQ ID NO: 59580 - DNA, 16 bp, H. sapiens
caaagagagagccccg

SEQ ID NO: 59581 - DNA, 16 bp, H. sapiens
caaagagataaagaga

SEQ ID NO: 59582 - DNA, 16 bp, H. sapiens
caaagagataaagcaa

SEQ ID NO: 59583 - DNA, 16 bp, H. sapiens
caaagagatatttaca

SEQ ID NO: 59584 - DNA, 16 bp, H. sapiens
caaagagatatttgaa

SEQ ID NO: 59585 - DNA, 16 bp, H. sapiens
caaagagatttctgca

SEQ ID NO: 59586 - DNA, 16 bp, H. sapiens
caaagagcagagttgg

SEQ ID NO: 59587 - DNA, 16 bp, H. sapiens
caaagagcttaaaaca

SEQ ID NO: 59588 - DNA, 16 bp, H. sapiens
caaagaggagctgata

SEQ ID NO: 59589 - DNA, 16 bp, H. sapiens
caaagaggagctggca

SEQ ID NO: 59590 - DNA, 16 bp, H. sapiens
caaagaggagctggtg

SEQ ID NO: 59591 - DNA, 16 bp, H. sapiens
caaagaggcaagggaa

SEQ ID NO: 59592 - DNA, 16 bp, H. sapiens
caaagaggcattcctt

SEQ ID NO: 59593 - DNA, 16 bp, H. sapiens
caaagaggtgaaaaat

SEQ ID NO: 59594 - DNA, 16 bp, H. sapiens
caaagagtctgctttg

SEQ ID NO: 59595 - DNA, 16 bp, H. sapiens
caaagagttattagca

SEQ ID NO: 59596 - DNA, 16 bp, H. sapiens
caaagatattcaggat

SEQ ID NO: 59597 - DNA, 16 bp, H. sapiens
caaagatattcctcaa

SEQ ID NO: 59598 - DNA, 16 bp, H. sapiens
caaagatattgaaata

SEQ ID NO: 59599 - DNA, 16 bp, H. sapiens
caaagatcattcaaga

SEQ ID NO: 59600 - DNA, 16 bp, H. sapiens
caaagatccaaagaga

SEQ ID NO: 59601 - DNA, 16 bp, H. sapiens
caaagatgaagagaaa

SEQ ID NO: 59602 - DNA, 16 bp, H. sapiens
caaagatgacacaaac

SEQ ID NO: 59603 - DNA, 16 bp, H. sapiens
caaagatgattttgag

SEQ ID NO: 59604 - DNA, 16 bp, H. sapiens
caaagatgcagagaaa

SEQ ID NO: 59605 - DNA, 16 bp, H. sapiens
caaagatgccaagaac

SEQ ID NO: 59606 - DNA, 16 bp, H. sapiens
caaagatgcccatgcc

SEQ ID NO: 59607 - DNA, 16 bp, H. sapiens
caaagatggagagaaa

SEQ ID NO: 59608 - DNA, 16 bp, H. sapiens
caaagatgggaagaaa

SEQ ID NO: 59609 - DNA, 16 bp, H. sapiens
caaagatgtaaataaa

SEQ ID NO: 59610 - DNA, 16 bp, H. sapiens
caaagatgtccacatc

SEQ ID NO: 59611 - DNA, 16 bp, H. sapiens
caaagatgtgaagaaa

SEQ ID NO: 59612 - DNA, 16 bp, H. sapiens
caaagatgttaagtga

SEQ ID NO: 59613 - DNA, 16 bp, H. sapiens
caaagattcaacttct

SEQ ID NO: 59614 - DNA, 16 bp, H. sapiens
caaagattgctacctg

SEQ ID NO: 59615 - DNA, 16 bp, H. sapiens
caaagatttaatgaca

SEQ ID NO: 59616 - DNA, 16 bp, H. sapiens
caaagatttatttctc

SEQ ID NO: 59617 - DNA, 16 bp, H. sapiens
caaagatttctgaaat

SEQ ID NO: 59618 - DNA, 16 bp, H. sapiens
caaagatttgaaagca

SEQ ID NO: 59619 - DNA, 16 bp, H. sapiens
caaagatttggaacca

SEQ ID NO: 59620 - DNA, 16 bp, H. sapiens
caaagattttatgact

SEQ ID NO: 59621 - DNA, 16 bp, H. sapiens
caaagcaaaaatggaa

SEQ ID NO: 59622 - DNA, 16 bp, H. sapiens
caaagcaaaaccctgt

SEQ ID NO: 59623 - DNA, 16 bp, H. sapiens
caaagcaaaatcagca

SEQ ID NO: 59624 - DNA, 16 bp, H. sapiens
caaagcaaatcacatg

SEQ ID NO: 59625 - DNA, 16 bp, H. sapiens
caaagcaagactctct

SEQ ID NO: 59626 - DNA, 16 bp, H. sapiens
caaagcaagatgctgt

SEQ ID NO: 59627 - DNA, 16 bp, H. sapiens
caaagcaagtcacaca

SEQ ID NO: 59628 - DNA, 16 bp, H. sapiens
caaagcaatctataaa

SEQ ID NO: 59629 - DNA, 16 bp, H. sapiens
caaagcaatgggatta

SEQ ID NO: 59630 - DNA, 16 bp, H. sapiens
caaagcaatttacata

SEQ ID NO: 59631 - DNA, 16 bp, H. sapiens
caaagcacaataaaac

SEQ ID NO: 59632 - DNA, 16 bp, H. sapiens
caaagcactgggatta

SEQ ID NO: 59633 - DNA, 16 bp, H. sapiens
caaagcacttcccaaa

SEQ ID NO: 59634 - DNA, 16 bp, H. sapiens
caaagcactttctcag

SEQ ID NO: 59635 - DNA, 16 bp, H. sapiens
caaagcagccaggaag

SEQ ID NO: 59636 - DNA, 16 bp, H. sapiens
caaagcagccagggaa

SEQ ID NO: 59637 - DNA, 16 bp, H. sapiens
caaagcaggactctgt

SEQ ID NO: 59638 - DNA, 16 bp, H. sapiens
caaagcaggaggatcg

SEQ ID NO: 59639 - DNA, 16 bp, H. sapiens
caaagcaggtggaaga

SEQ ID NO: 59640 - DNA, 16 bp, H. sapiens
caaagccacaatgaaa

SEQ ID NO: 59641 - DNA, 16 bp, H. sapiens
caaagccacagggcag

SEQ ID NO: 59642 - DNA, 16 bp, H. sapiens
caaagccagacaaaga

SEQ ID NO: 59643 - DNA, 16 bp, H. sapiens
caaagccagaccctgt

SEQ ID NO: 59644 - DNA, 16 bp, H. sapiens
caaagccagactccat

SEQ ID NO: 59645 - DNA, 16 bp, H. sapiens
caaagccagagaaaga

SEQ ID NO: 59646 - DNA, 16 bp, H. sapiens
caaagccagcaacagc

SEQ ID NO: 59647 - DNA, 16 bp, H. sapiens
caaagccagcaacagt

SEQ ID NO: 59648 - DNA, 16 bp, H. sapiens
caaagccagccaggcc

SEQ ID NO: 59649 - DNA, 16 bp, H. sapiens
caaagccaggcaaaga

SEQ ID NO: 59650 - DNA, 16 bp, H. sapiens
caaagccatcaaaaag

SEQ ID NO: 59651 - DNA, 16 bp, H. sapiens
caaagccatcctggac

SEQ ID NO: 59652 - DNA, 16 bp, H. sapiens
caaagccattcaacaa

SEQ ID NO: 59653 - DNA, 16 bp, H. sapiens
caaagccattcatgag

SEQ ID NO: 59654 - DNA, 16 bp, H. sapiens
caaagccctaggaaag

SEQ ID NO: 59655 - DNA, 16 bp, H. sapiens
caaagccctgggctca

SEQ ID NO: 59656 - DNA, 16 bp, H. sapiens
caaagcctaatccaga

SEQ ID NO: 59657 - DNA, 16 bp, H. sapiens
caaagcctccaagaac

SEQ ID NO: 59658 - DNA, 16 bp, H. sapiens
caaagcctccttcaca

SEQ ID NO: 59659 - DNA, 16 bp, H. sapiens
caaagcctctgggaag

SEQ ID NO: 59660 - DNA, 16 bp, H. sapiens
caaagcctggcacaca

SEQ ID NO: 59661 - DNA, 16 bp, H. sapiens
caaagcctggcacaga

SEQ ID NO: 59662 - DNA, 16 bp, H. sapiens
caaagctataataaaa

SEQ ID NO: 59663 - DNA, 16 bp, H. sapiens
caaagctatttttttt

SEQ ID NO: 59664 - DNA, 16 bp, H. sapiens
caaagctcagttggaa

SEQ ID NO: 59665 - DNA, 16 bp, H. sapiens
caaagctgaaactgga

SEQ ID NO: 59666 - DNA, 16 bp, H. sapiens
caaagctgaaggcatc

SEQ ID NO: 59667 - DNA, 16 bp, H. sapiens
caaagctgcctggaag

SEQ ID NO: 59668 - DNA, 16 bp, H. sapiens
caaagctgcctttgct

SEQ ID NO: 59669 - DNA, 16 bp, H. sapiens
caaagctggagctatt

SEQ ID NO: 59670 - DNA, 16 bp, H. sapiens
caaagctggagggaga

SEQ ID NO: 59671 - DNA, 16 bp, H. sapiens
caaagcttcaaaggat

SEQ ID NO: 59672 - DNA, 16 bp, H. sapiens
caaagcttccacagca

SEQ ID NO: 59673 - DNA, 16 bp, H. sapiens
caaagcttccacagcc

SEQ ID NO: 59674 - DNA, 16 bp, H. sapiens
caaaggaaaacaaatc

SEQ ID NO: 59675 - DNA, 16 bp, H. sapiens
caaaggaaaagaaatc

SEQ ID NO: 59676 - DNA, 16 bp, H. sapiens
caaaggaaaagaaatt

SEQ ID NO: 59677 - DNA, 16 bp, H. sapiens
caaaggaaaatagatc

SEQ ID NO: 59678 - DNA, 16 bp, H. sapiens
caaaggaaacaatcca

SEQ ID NO: 59679 - DNA, 16 bp, H. sapiens
caaaggaaacaattga

SEQ ID NO: 59680 - DNA, 16 bp, H. sapiens
caaaggaaataaaatc

SEQ ID NO: 59681 - DNA, 16 bp, H. sapiens
caaaggaaatgaagtc

SEQ ID NO: 59682 - DNA, 16 bp, H. sapiens
caaaggaaatgcttat

SEQ ID NO: 59683 - DNA, 16 bp, H. sapiens
caaaggaaatgttcat

SEQ ID NO: 59684 - DNA, 16 bp, H. sapiens
caaaggaaatgttctt

SEQ ID NO: 59685 - DNA, 16 bp, H. sapiens
caaaggaactgaatag

SEQ ID NO: 59686 - DNA, 16 bp, H. sapiens
caaaggaagacagtaa

SEQ ID NO: 59687 - DNA, 16 bp, H. sapiens
caaaggaatagaaatt

SEQ ID NO: 59688 - DNA, 16 bp, H. sapiens
caaaggaatctgtgtc

SEQ ID NO: 59689 - DNA, 16 bp, H. sapiens
caaaggaatgattcat

SEQ ID NO: 59690 - DNA, 16 bp, H. sapiens
caaaggacacaatctc

SEQ ID NO: 59691 - DNA, 16 bp, H. sapiens
caaaggacagacagaa

SEQ ID NO: 59692 - DNA, 18 bp, H. sapiens
caaaggacatgaactcat

SEQ ID NO: 59693 - DNA, 16 bp, H. sapiens
caaaggacatgagtag

SEQ ID NO: 59694 - DNA, 16 bp, H. sapiens
caaaggacatgatttc

SEQ ID NO: 59695 - DNA, 16 bp, H. sapiens
caaaggacattatttc

SEQ ID NO: 59696 - DNA, 16 bp, H. sapiens
caaaggacctgaataa

SEQ ID NO: 59697 - DNA, 16 bp, H. sapiens
caaaggacgtgatctc

SEQ ID NO: 59698 - DNA, 16 bp, H. sapiens
caaaggagaaaataat

SEQ ID NO: 59699 - DNA, 16 bp, H. sapiens
caaaggagaaacaggc

SEQ ID NO: 59700 - DNA, 16 bp, H. sapiens
caaaggagaagcaggt

SEQ ID NO: 59701 - DNA, 16 bp, H. sapiens
caaaggagacagtaaa

SEQ ID NO: 59702 - DNA, 16 bp, H. sapiens
caaaggagatgaaatc

SEQ ID NO: 59703 - DNA, 16 bp, H. sapiens
caaaggagattttttt

SEQ ID NO: 59704 - DNA, 16 bp, H. sapiens
caaaggagttagaaag

SEQ ID NO: 59705 - DNA, 16 bp, H. sapiens
caaaggatacaaacag

SEQ ID NO: 59706 - DNA, 20 bp, H. sapiens
caaaggatcacaactcctcg

SEQ ID NO: 59707 - DNA, 19 bp, H. sapiens
caaaggatcacaactcctt

SEQ ID NO: 59708 - DNA, 16 bp, H. sapiens
caaaggatcctctcac

SEQ ID NO: 59709 - DNA, 16 bp, H. sapiens
caaaggatctgagtag

SEQ ID NO: 59710 - DNA, 16 bp, H. sapiens
caaaggcaaaattaga

SEQ ID NO: 59711 - DNA, 16 bp, H. sapiens
caaaggcaaattaaaa

SEQ ID NO: 59712 - DNA, 16 bp, H. sapiens
caaaggcacagagatg

SEQ ID NO: 59713 - DNA, 16 bp, H. sapiens
caaaggcacagaggtg

SEQ ID NO: 59714 - DNA, 17 bp, H. sapiens
caaaggcaccagggccc

SEQ ID NO: 59715 - DNA, 16 bp, H. sapiens
caaaggcagggccagg

SEQ ID NO: 59716 - DNA, 16 bp, H. sapiens
caaaggccctgaagca

SEQ ID NO: 59717 - DNA, 16 bp, H. sapiens
caaaggccctgaggct

SEQ ID NO: 59718 - DNA, 16 bp, H. sapiens
caaaggccctggggcc

SEQ ID NO: 59719 - DNA, 16 bp, H. sapiens
caaaggccctgtggca

SEQ ID NO: 59720 - DNA, 16 bp, H. sapiens
caaaggccctgtggcc

SEQ ID NO: 59721 - DNA, 16 bp, H. sapiens
caaaggccgggcgcgg

SEQ ID NO: 59722 - DNA, 16 bp, H. sapiens
caaaggcctcaccttc

SEQ ID NO: 59723 - DNA, 16 bp, H. sapiens
caaaggcctgagaacc

SEQ ID NO: 59724 - DNA, 16 bp, H. sapiens
caaaggctctgagaag

SEQ ID NO: 59725 - DNA, 16 bp, H. sapiens
caaaggctgaagaacc

SEQ ID NO: 59726 - DNA, 16 bp, H. sapiens
caaaggctgaggagtg

SEQ ID NO: 59727 - DNA, 16 bp, H. sapiens
caaaggctgggtgcag

SEQ ID NO: 59728 - DNA, 16 bp, H. sapiens
caaaggcttcacctcc

SEQ ID NO: 59729 - DNA, 16 bp, H. sapiens
caaagggaaatgaaaa

SEQ ID NO: 59730 - DNA, 26 bp, H. sapiens
caaagggaagcccatcagactaacag

SEQ ID NO: 59731 - DNA, 16 bp, H. sapiens
caaagggaaggcttcc

SEQ ID NO: 59732 - DNA, 16 bp, H. sapiens
caaagggaataaaata

SEQ ID NO: 59733 - DNA, 16 bp, H. sapiens
caaagggaatgcttcc

SEQ ID NO: 59734 - DNA, 16 bp, H. sapiens
caaagggagaccttgt

SEQ ID NO: 59735 - DNA, 16 bp, H. sapiens
caaagggagactctgt

SEQ ID NO: 59736 - DNA, 16 bp, H. sapiens
caaagggatatttctg

SEQ ID NO: 59737 - DNA, 16 bp, H. sapiens
caaagggcatccaaat

SEQ ID NO: 59738 - DNA, 16 bp, H. sapiens
caaagggctgggatta

SEQ ID NO: 59739 - DNA, 16 bp, H. sapiens
caaaggggaaaaataa

SEQ ID NO: 59740 - DNA, 16 bp, H. sapiens
caaaggggaaacaagg

SEQ ID NO: 59741 - DNA, 16 bp, H. sapiens
caaaggggaagcaggc

SEQ ID NO: 59742 - DNA, 16 bp, H. sapiens
caaaggtcagttcctg

SEQ ID NO: 59743 - DNA, 16 bp, H. sapiens
caaaggtgacattaca

SEQ ID NO: 59744 - DNA, 16 bp, H. sapiens
caaaggtgccaagaac

SEQ ID NO: 59745 - DNA, 16 bp, H. sapiens
caaaggtgccaataac

SEQ ID NO: 59746 - DNA, 16 bp, H. sapiens
caaaggtgggtggatc

SEQ ID NO: 59747 - DNA, 16 bp, H. sapiens
caaaggtttcatgatg

SEQ ID NO: 59748 - DNA, 16 bp, H. sapiens
caaaggttttaaatgt

SEQ ID NO: 59749 - DNA, 16 bp, H. sapiens
caaagtacaataaagc

SEQ ID NO: 59750 - DNA, 16 bp, H. sapiens
caaagtacagctcagg

SEQ ID NO: 59751 - DNA, 16 bp, H. sapiens
caaagtactgggaata

SEQ ID NO: 59752 - DNA, 16 bp, H. sapiens
caaagtactgtgatta

SEQ ID NO: 59753 - DNA, 16 bp, H. sapiens
caaagtagacaaatgg

SEQ ID NO: 59754 - DNA, 16 bp, H. sapiens
caaagtatacaaagaa

SEQ ID NO: 59755 - DNA, 16 bp, H. sapiens
caaagtatcatctgag

SEQ ID NO: 59756 - DNA, 16 bp, H. sapiens
caaagtattcaagagg

SEQ ID NO: 59757 - DNA, 16 bp, H. sapiens
caaagtattgagatta

SEQ ID NO: 59758 - DNA, 16 bp, H. sapiens
caaagtattgggatta

SEQ ID NO: 59759 - DNA, 16 bp, H. sapiens
caaagtattttccaaa

SEQ ID NO: 59760 - DNA, 16 bp, H. sapiens
caaagtatttttaaaa

SEQ ID NO: 59761 - DNA, 16 bp, H. sapiens
caaagtcaaaatgaaa

SEQ ID NO: 59762 - DNA, 16 bp, H. sapiens
caaagtcaacatatga

SEQ ID NO: 59763 - DNA, 16 bp, H. sapiens
caaagtcacccagctg

SEQ ID NO: 59764 - DNA, 16 bp, H. sapiens
caaagtcaggaaacaa

SEQ ID NO: 59765 - DNA, 16 bp, H. sapiens
caaagtcaggaagtgg

SEQ ID NO: 59766 - DNA, 16 bp, H. sapiens
caaagtccacagttta

SEQ ID NO: 59767 - DNA, 16 bp, H. sapiens
caaagtccctgccctc

SEQ ID NO: 59768 - DNA, 16 bp, H. sapiens
caaagtgaaagaagcc

SEQ ID NO: 59769 - DNA, 16 bp, H. sapiens
caaagtgaagcagcaa

SEQ ID NO: 59770 - DNA, 19 bp, H. sapiens
caaagtgactctgaagaag

SEQ ID NO: 59771 - DNA, 16 bp, H. sapiens
caaagtgagacattgt

SEQ ID NO: 59772 - DNA, 16 bp, H. sapiens
caaagtgagacctgtc

SEQ ID NO: 59773 - DNA, 16 bp, H. sapiens
caaagtgatagaatta

SEQ ID NO: 59774 - DNA, 16 bp, H. sapiens
caaagtgccgggatca

SEQ ID NO: 59775 - DNA, 16 bp, H. sapiens
caaagtgctaggattg

SEQ ID NO: 59776 - DNA, 16 bp, H. sapiens
caaagtgctgagataa

SEQ ID NO: 59777 - DNA, 16 bp, H. sapiens
caaagtgctgatatta

SEQ ID NO: 59778 - DNA, 16 bp, H. sapiens
caaagtgctggaattg

SEQ ID NO: 59779 - DNA, 16 bp, H. sapiens
caaagtgctggtatta

SEQ ID NO: 59780 - DNA, 16 bp, H. sapiens
caaagtgcttggatga

SEQ ID NO: 59781 - DNA, 16 bp, H. sapiens
caaagtgggagaatca

SEQ ID NO: 59782 - DNA, 16 bp, H. sapiens
caaagtgttaggatta

SEQ ID NO: 59783 - DNA, 16 bp, H. sapiens
caaagtgttgagatca

SEQ ID NO: 59784 - DNA, 16 bp, H. sapiens
caaagtgttgagatta

SEQ ID NO: 59785 - DNA, 16 bp, H. sapiens
caaagtgttgctctgt

SEQ ID NO: 59786 - DNA, 16 bp, H. sapiens
caaagtgttggaatta

SEQ ID NO: 59787 - DNA, 16 bp, H. sapiens
caaagtgttgggatca

SEQ ID NO: 59788 - DNA, 16 bp, H. sapiens
caaagtgttgggattt

SEQ ID NO: 59789 - DNA, 16 bp, H. sapiens
caaagttaaactataa

SEQ ID NO: 59790 - DNA, 16 bp, H. sapiens
caaagttctccagaag

SEQ ID NO: 59791 - DNA, 16 bp, H. sapiens
caaagttcttagcttc

SEQ ID NO: 59792 - DNA, 16 bp, H. sapiens
caaagttgattttttt

SEQ ID NO: 59793 - DNA, 16 bp, H. sapiens
caaagttggaagactt

SEQ ID NO: 59794 - DNA, 16 bp, H. sapiens
caaagtttaccttata

SEQ ID NO: 59795 - DNA, 16 bp, H. sapiens
caaagttttgggatta

SEQ ID NO: 59796 - DNA, 16 bp, H. sapiens
caaagtttttgtttgt

SEQ ID NO: 59797 - DNA, 16 bp, H. sapiens
caaataaaaagttttt

SEQ ID NO: 59798 - DNA, 16 bp, H. sapiens
caaataaaagccaatt

SEQ ID NO: 59799 - DNA, 16 bp, H. sapiens
caaataaaagtaaatg

SEQ ID NO: 59800 - DNA, 16 bp, H. sapiens
caaataaacacagtca

SEQ ID NO: 59801 - DNA, 16 bp, H. sapiens
caaataaacagaacca

SEQ ID NO: 59802 - DNA, 16 bp, H. sapiens
caaataaacagcctaa

SEQ ID NO: 59803 - DNA, 16 bp, H. sapiens
caaataaacatatgaa

SEQ ID NO: 59804 - DNA, 16 bp, H. sapiens
caaataaaccccaaag

SEQ ID NO: 59805 - DNA, 16 bp, H. sapiens
caaataaactctttaa

SEQ ID NO: 59806 - DNA, 16 bp, H. sapiens
caaataaagtcacatt

SEQ ID NO: 59807 - DNA, 16 bp, H. sapiens
caaataaagtcatatt

SEQ ID NO: 59808 - DNA, 16 bp, H. sapiens
caaataaagttttatt

SEQ ID NO: 59809 - DNA, 16 bp, H. sapiens
caaataaatatatgta

SEQ ID NO: 59810 - DNA, 16 bp, H. sapiens
caaataaatatgtatt

SEQ ID NO: 59811 - DNA, 16 bp, H. sapiens
caaataaatatttgtt

SEQ ID NO: 59812 - DNA, 16 bp, H. sapiens
caaataaatcagagat

SEQ ID NO: 59813 - DNA, 16 bp, H. sapiens
caaataaatgagaaca

SEQ ID NO: 59814 - DNA, 16 bp, H. sapiens
caaataaatgcaggaa

SEQ ID NO: 59815 - DNA, 16 bp, H. sapiens
caaataaatggaaata

SEQ ID NO: 59816 - DNA, 16 bp, H. sapiens
caaataaatggagtct

SEQ ID NO: 59817 - DNA, 16 bp, H. sapiens
caaataacagaaattt

SEQ ID NO: 59818 - DNA, 16 bp, H. sapiens
caaataacagaatttt

SEQ ID NO: 59819 - DNA, 16 bp, H. sapiens
caaataagcatattaa

SEQ ID NO: 59820 - DNA, 16 bp, H. sapiens
caaataaggaaattga

SEQ ID NO: 59821 - DNA, 16 bp, H. sapiens
caaataagggcacatt

SEQ ID NO: 59822 - DNA, 16 bp, H. sapiens
caaataaggtaacatt

SEQ ID NO: 59823 - DNA, 16 bp, H. sapiens
caaataataaaatgta

SEQ ID NO: 59824 - DNA, 16 bp, H. sapiens
caaataatactcttat

SEQ ID NO: 59825 - DNA, 16 bp, H. sapiens
caaataatgacaattt

SEQ ID NO: 59826 - DNA, 16 bp, H. sapiens
caaataatgctgcagt

SEQ ID NO: 59827 - DNA, 16 bp, H. sapiens
caaataatgttttaaa

SEQ ID NO: 59828 - DNA, 16 bp, H. sapiens
caaataattggaagta

SEQ ID NO: 59829 - DNA, 16 bp, H. sapiens
caaataatttatgtag

SEQ ID NO: 59830 - DNA, 16 bp, H. sapiens
caaatacaaattgtat

SEQ ID NO: 59831 - DNA, 16 bp, H. sapiens
caaatacacacatttt

SEQ ID NO: 59832 - DNA, 16 bp, H. sapiens
caaatacaccatggaa

SEQ ID NO: 59833 - DNA, 16 bp, H. sapiens
caaatacactagaaaa

SEQ ID NO: 59834 - DNA, 16 bp, H. sapiens
caaatacaggagcacc

SEQ ID NO: 59835 - DNA, 16 bp, H. sapiens
caaatacatatttata

SEQ ID NO: 59836 - DNA, 16 bp, H. sapiens
caaataccacctgctc

SEQ ID NO: 59837 - DNA, 16 bp, H. sapiens
caaataccatcacatt

SEQ ID NO: 59838 - DNA, 16 bp, H. sapiens
caaatacttctttttt

SEQ ID NO: 59839 - DNA, 16 bp, H. sapiens
caaatagaatggactc

SEQ ID NO: 59840 - DNA, 16 bp, H. sapiens
caaatagagataattt

SEQ ID NO: 59841 - DNA, 16 bp, H. sapiens
caaatagatgaatgga

SEQ ID NO: 59842 - DNA, 16 bp, H. sapiens
caaatagccaaatcaa

SEQ ID NO: 59843 - DNA, 16 bp, H. sapiens
caaatagccaaggcaa

SEQ ID NO: 59844 - DNA, 16 bp, H. sapiens
caaatagcccaattaa

SEQ ID NO: 59845 - DNA, 16 bp, H. sapiens
caaatagcctatcttc

SEQ ID NO: 59846 - DNA, 16 bp, H. sapiens
caaatagctgggactg

SEQ ID NO: 59847 - DNA, 16 bp, H. sapiens
caaatagctgggatca

SEQ ID NO: 59848 - DNA, 16 bp, H. sapiens
caaatagctggggcta

SEQ ID NO: 59849 - DNA, 16 bp, H. sapiens
caaataggagaaattg

SEQ ID NO: 59850 - DNA, 16 bp, H. sapiens
caaatagtagttctgt

SEQ ID NO: 59851 - DNA, 16 bp, H. sapiens
caaatagttatctttt

SEQ ID NO: 59852 - DNA, 16 bp, H. sapiens
caaatataagtgagat

SEQ ID NO: 59853 - DNA, 16 bp, H. sapiens
caaatatatattttca

SEQ ID NO: 59854 - DNA, 16 bp, H. sapiens
caaatatatgaaaaga

SEQ ID NO: 59855 - DNA, 16 bp, H. sapiens
caaatatattctccta

SEQ ID NO: 59856 - DNA, 16 bp, H. sapiens
caaatatattgaaaat

SEQ ID NO: 59857 - DNA, 16 bp, H. sapiens
caaatatattttccaa

SEQ ID NO: 59858 - DNA, 16 bp, H. sapiens
caaatatattttgatt

SEQ ID NO: 59859 - DNA, 16 bp, H. sapiens
caaatatcaagcaaaa

SEQ ID NO: 59860 - DNA, 16 bp, H. sapiens
caaatatccacttcca

SEQ ID NO: 59861 - DNA, 16 bp, H. sapiens
caaatatccattttca

SEQ ID NO: 59862 - DNA, 16 bp, H. sapiens
caaatatccttgaaaa

SEQ ID NO: 59863 - DNA, 16 bp, H. sapiens
caaatatctctttgag

SEQ ID NO: 59864 - DNA, 16 bp, H. sapiens
caaatatgaattattt

SEQ ID NO: 59865 - DNA, 16 bp, H. sapiens
caaatatgtaaagaaa

SEQ ID NO: 59866 - DNA, 16 bp, H. sapiens
caaatatgtaaagcaa

SEQ ID NO: 59867 - DNA, 16 bp, H. sapiens
caaatattaatagatc

SEQ ID NO: 59868 - DNA, 16 bp, H. sapiens
caaatattccaggata

SEQ ID NO: 59869 - DNA, 16 bp, H. sapiens
caaatattcctttgca

SEQ ID NO: 59870 - DNA, 16 bp, H. sapiens
caaatatttaaaagaa

SEQ ID NO: 59871 - DNA, 16 bp, H. sapiens
caaatatttacatatt

SEQ ID NO: 59872 - DNA, 16 bp, H. sapiens
caaatatttacatttt

SEQ ID NO: 59873 - DNA, 16 bp, H. sapiens
caaatatttactgagt

SEQ ID NO: 59874 - DNA, 16 bp, H. sapiens
caaatatttatgaaca

SEQ ID NO: 59875 - DNA, 16 bp, H. sapiens
caaatatttcaaaatc

SEQ ID NO: 59876 - DNA, 16 bp, H. sapiens
caaatatttctcccat

SEQ ID NO: 59877 - DNA, 16 bp, H. sapiens
caaatatttgaatttt

SEQ ID NO: 59878 - DNA, 16 bp, H. sapiens
caaatatttggggatt

SEQ ID NO: 59879 - DNA, 16 bp, H. sapiens
caaatatttgtatatt

SEQ ID NO: 59880 - DNA, 16 bp, H. sapiens
caaatatttgttgagt

SEQ ID NO: 59881 - DNA, 16 bp, H. sapiens
caaatattttccatct

SEQ ID NO: 59882 - DNA, 16 bp, H. sapiens
caaatattttctttca

SEQ ID NO: 59883 - DNA, 16 bp, H. sapiens
caaatattttgaaatt

SEQ ID NO: 59884 - DNA, 16 bp, H. sapiens
caaatattttgtctca

SEQ ID NO: 59885 - DNA, 16 bp, H. sapiens
caaatatttttctccc

SEQ ID NO: 59886 - DNA, 16 bp, H. sapiens
caaatattttttccca

SEQ ID NO: 59887 - DNA, 16 bp, H. sapiens
caaatattttttgagt

SEQ ID NO: 59888 - DNA, 16 bp, H. sapiens
caaatcaaaccacagt

SEQ ID NO: 59889 - DNA, 16 bp, H. sapiens
caaatcaagaccacaa

SEQ ID NO: 59890 - DNA, 16 bp, H. sapiens
caaatcaagaccacag

SEQ ID NO: 59891 - DNA, 16 bp, H. sapiens
caaatcaattttattt

SEQ ID NO: 59892 - DNA, 16 bp, H. sapiens
caaatcacatcttgaa

SEQ ID NO: 59893 - DNA, 16 bp, H. sapiens
caaatcaccacaaact

SEQ ID NO: 59894 - DNA, 16 bp, H. sapiens
caaatcaccatggtac

SEQ ID NO: 59895 - DNA, 16 bp, H. sapiens
caaatcagcttcatcc

SEQ ID NO: 59896 - DNA, 16 bp, H. sapiens
caaatcaggaacaaac

SEQ ID NO: 59897 - DNA, 16 bp, H. sapiens
caaatcaggaagaaaa

SEQ ID NO: 59898 - DNA, 46 bp, H. sapiens
caaatcatgagtgaactcccattcacaattgcttcaaagagaatac

SEQ ID NO: 59899 - DNA, 27 bp, H. sapiens
caaatcatgagtgaactcccattcact

SEQ ID NO: 59900 - DNA, 16 bp, H. sapiens
caaatcatgagtgagc

SEQ ID NO: 59901 - DNA, 16 bp, H. sapiens
caaatccacctgtttc

SEQ ID NO: 59902 - DNA, 16 bp, H. sapiens
caaatccagaagcaca

SEQ ID NO: 59903 - DNA, 16 bp, H. sapiens
caaatccagcagaaga

SEQ ID NO: 59904 - DNA, 16 bp, H. sapiens
caaatcccagctctac

SEQ ID NO: 59905 - DNA, 16 bp, H. sapiens
caaatccctgctttca

SEQ ID NO: 59906 - DNA, 16 bp, H. sapiens
caaatcctattgtgaa

SEQ ID NO: 59907 - DNA, 16 bp, H. sapiens
caaatcctcaccaaca

SEQ ID NO: 59908 - DNA, 16 bp, H. sapiens
caaatcctggctccat

SEQ ID NO: 59909 - DNA, 16 bp, H. sapiens
caaatccttgtctcag

SEQ ID NO: 59910 - DNA, 16 bp, H. sapiens
caaatctatgtttgat

SEQ ID NO: 59911 - DNA, 16 bp, H. sapiens
caaatctcaagtcctc

SEQ ID NO: 59912 - DNA, 16 bp, H. sapiens
caaatctcacattgaa

SEQ ID NO: 59913 - DNA, 16 bp, H. sapiens
caaatctcacgttgaa

SEQ ID NO: 59914 - DNA, 16 bp, H. sapiens
caaatctcaggtcctc

SEQ ID NO: 59915 - DNA, 16 bp, H. sapiens
caaatctcatctggaa

SEQ ID NO: 59916 - DNA, 16 bp, H. sapiens
caaatctcctgtcaaa

SEQ ID NO: 59917 - DNA, 16 bp, H. sapiens
caaatctgctggtgcc

SEQ ID NO: 59918 - DNA, 16 bp, H. sapiens
caaatctgtctcccca

SEQ ID NO: 59919 - DNA, 16 bp, H. sapiens
caaatcttaacttgaa

SEQ ID NO: 59920 - DNA, 16 bp, H. sapiens
caaatctttactttta

SEQ ID NO: 59921 - DNA, 16 bp, H. sapiens
caaatgaaaaataatg

SEQ ID NO: 59922 - DNA, 16 bp, H. sapiens
caaatgaaaattttaa

SEQ ID NO: 59923 - DNA, 16 bp, H. sapiens
caaatgaaaggaaatc

SEQ ID NO: 59924 - DNA, 16 bp, H. sapiens
caaatgaaataatgaa

SEQ ID NO: 59925 - DNA, 16 bp, H. sapiens
caaatgaacacttgca

SEQ ID NO: 59926 - DNA, 16 bp, H. sapiens
caaatgaagaaataga

SEQ ID NO: 59927 - DNA, 16 bp, H. sapiens
caaatgaagaaattga

SEQ ID NO: 59928 - DNA, 16 bp, H. sapiens
caaatgaagcttcata

SEQ ID NO: 59929 - DNA, 16 bp, H. sapiens
caaatgaatttcatgt

SEQ ID NO: 59930 - DNA, 16 bp, H. sapiens
caaatgaattttttaa

SEQ ID NO: 59931 - DNA, 16 bp, H. sapiens
caaatgaatttttttt

SEQ ID NO: 59932 - DNA, 16 bp, H. sapiens
caaatgacagaatctc

SEQ ID NO: 59933 - DNA, 16 bp, H. sapiens
caaatgacagaatttc

SEQ ID NO: 59934 - DNA, 16 bp, H. sapiens
caaatgacagaatttt

SEQ ID NO: 59935 - DNA, 16 bp, H. sapiens
caaatgacatgatctt

SEQ ID NO: 59936 - DNA, 16 bp, H. sapiens
caaatgacattatttt

SEQ ID NO: 59937 - DNA, 16 bp, H. sapiens
caaatgaccacaacac

SEQ ID NO: 59938 - DNA, 16 bp, H. sapiens
caaatgaccacactag

SEQ ID NO: 59939 - DNA, 16 bp, H. sapiens
caaatgacttttaaaa

SEQ ID NO: 59940 - DNA, 16 bp, H. sapiens
caaatgagaaaaatga

SEQ ID NO: 59941 - DNA, 16 bp, H. sapiens
caaatgagaaaagcaa

SEQ ID NO: 59942 - DNA, 16 bp, H. sapiens
caaatgagaaaattga

SEQ ID NO: 59943 - DNA, 16 bp, H. sapiens
caaatgagaacatgtg

SEQ ID NO: 59944 - DNA, 16 bp, H. sapiens
caaatgagaagaatgt

SEQ ID NO: 59945 - DNA, 16 bp, H. sapiens
caaatgagatcatttt

SEQ ID NO: 59946 - DNA, 16 bp, H. sapiens
caaatgagattatttt

SEQ ID NO: 59947 - DNA, 16 bp, H. sapiens
caaatgaggaaatgca

SEQ ID NO: 59948 - DNA, 16 bp, H. sapiens
caaatgaggaagctga

SEQ ID NO: 59949 - DNA, 16 bp, H. sapiens
caaatgagtgtgtgtg

SEQ ID NO: 59950 - DNA, 16 bp, H. sapiens
caaatgataagaaagt

SEQ ID NO: 59951 - DNA, 16 bp, H. sapiens
caaatgataatggaag

SEQ ID NO: 59952 - DNA, 16 bp, H. sapiens
caaatgattctccttc

SEQ ID NO: 59953 - DNA, 16 bp, H. sapiens
caaatgattggatgag

SEQ ID NO: 59954 - DNA, 16 bp, H. sapiens
caaatgatttttctgt

SEQ ID NO: 59955 - DNA, 16 bp, H. sapiens
caaatgattttttttt

SEQ ID NO: 59956 - DNA, 16 bp, H. sapiens
caaatgcaatgaaaac

SEQ ID NO: 59957 - DNA, 16 bp, H. sapiens
caaatgcaatggcaac

SEQ ID NO: 59958 - DNA, 16 bp, H. sapiens
caaatgcaattttaaa

SEQ ID NO: 59959 - DNA, 16 bp, H. sapiens
caaatgcaggtttctg

SEQ ID NO: 59960 - DNA, 16 bp, H. sapiens
caaatgcattacctca

SEQ ID NO: 59961 - DNA, 16 bp, H. sapiens
caaatgcattttattt

SEQ ID NO: 59962 - DNA, 16 bp, H. sapiens
caaatgccacctcttc

SEQ ID NO: 59963 - DNA, 16 bp, H. sapiens
caaatgcccatcagct

SEQ ID NO: 59964 - DNA, 16 bp, H. sapiens
caaatgcctttttctc

SEQ ID NO: 59965 - DNA, 16 bp, H. sapiens
caaatgctatttctgc

SEQ ID NO: 59966 - DNA, 16 bp, H. sapiens
caaatgctgaaagatt

SEQ ID NO: 59967 - DNA, 16 bp, H. sapiens
caaatgctgagagact

SEQ ID NO: 59968 - DNA, 16 bp, H. sapiens
caaatgctgatgagaa

SEQ ID NO: 59969 - DNA, 16 bp, H. sapiens
caaatgctttttttgt

SEQ ID NO: 59970 - DNA, 16 bp, H. sapiens
caaatggaaaagcatc

SEQ ID NO: 59971 - DNA, 16 bp, H. sapiens
caaatggaaacatatc

SEQ ID NO: 59972 - DNA, 16 bp, H. sapiens
caaatggaaagtaaaa

SEQ ID NO: 59973 - DNA, 16 bp, H. sapiens
caaatggaaatacatc

SEQ ID NO: 59974 - DNA, 16 bp, H. sapiens
caaatggaagaaattg

SEQ ID NO: 59975 - DNA, 16 bp, H. sapiens
caaatggaagaatatt

SEQ ID NO: 59976 - DNA, 16 bp, H. sapiens
caaatggaatggaatg

SEQ ID NO: 59977 - DNA, 16 bp, H. sapiens
caaatggactaagaca

SEQ ID NO: 59978 - DNA, 16 bp, H. sapiens
caaatggagatttgga

SEQ ID NO: 59979 - DNA, 16 bp, H. sapiens
caaatggagccacaga

SEQ ID NO: 59980 - DNA, 16 bp, H. sapiens
caaatgggaaaaattg

SEQ ID NO: 59981 - DNA, 16 bp, H. sapiens
caaatgggaaaagaag

SEQ ID NO: 59982 - DNA, 16 bp, H. sapiens
caaatgggaaacaaaa

SEQ ID NO: 59983 - DNA, 16 bp, H. sapiens
caaatgggagaacatt

SEQ ID NO: 59984 - DNA, 16 bp, H. sapiens
caaatgggattagtgc

SEQ ID NO: 59985 - DNA, 16 bp, H. sapiens
caaatggtatttctgc

SEQ ID NO: 59986 - DNA, 17 bp, H. sapiens
caaatggtatttctggt

SEQ ID NO: 59987 - DNA, 18 bp, H. sapiens
caaatggtgctgggaaaa

SEQ ID NO: 59988 - DNA, 16 bp, H. sapiens
caaatgtaaaagaata

SEQ ID NO: 59989 - DNA, 16 bp, H. sapiens
caaatgtaaaagatca

SEQ ID NO: 59990 - DNA, 16 bp, H. sapiens
caaatgtaaaatgaca

SEQ ID NO: 59991 - DNA, 16 bp, H. sapiens
caaatgtaaagaatgt

SEQ ID NO: 59992 - DNA, 16 bp, H. sapiens
caaatgtataatgaca

SEQ ID NO: 59993 - DNA, 16 bp, H. sapiens
caaatgtattatttat

SEQ ID NO: 59994 - DNA, 16 bp, H. sapiens
caaatgtattattttg

SEQ ID NO: 59995 - DNA, 16 bp, H. sapiens
caaatgtatttatttt

SEQ ID NO: 59996 - DNA, 16 bp, H. sapiens
caaatgtatttctata

SEQ ID NO: 59997 - DNA, 16 bp, H. sapiens
caaatgtatttttaaa

SEQ ID NO: 59998 - DNA, 16 bp, H. sapiens
caaatgtccaccaact

SEQ ID NO: 59999 - DNA, 16 bp, H. sapiens
caaatgtcctctgggg

SEQ ID NO: 60000 - DNA, 16 bp, H. sapiens
caaatgtctatcaact

SEQ ID NO: 60001 - DNA, 16 bp, H. sapiens
caaatgtctgggcacc

SEQ ID NO: 60002 - DNA, 16 bp, H. sapiens
caaatgtggaaactga

SEQ ID NO: 60003 - DNA, 16 bp, H. sapiens
caaatgtgtatgtgtg

SEQ ID NO: 60004 - DNA, 16 bp, H. sapiens
caaatgtgtgggtttt

SEQ ID NO: 60005 - DNA, 16 bp, H. sapiens
caaatgttaatctttt

SEQ ID NO: 60006 - DNA, 16 bp, H. sapiens
caaatgttattttaaa

SEQ ID NO: 60007 - DNA, 16 bp, H. sapiens
caaatgttatttttaa

SEQ ID NO: 60008 - DNA, 16 bp, H. sapiens
caaatgttcaaaaata

SEQ ID NO: 60009 - DNA, 16 bp, H. sapiens
caaatgtttattgagc

SEQ ID NO: 60010 - DNA, 16 bp, H. sapiens
caaatgtttgttgagt

SEQ ID NO: 60011 - DNA, 16 bp, H. sapiens
caaatgttttcattat

SEQ ID NO: 60012 - DNA, 16 bp, H. sapiens
caaatgttttcttaaa

SEQ ID NO: 60013 - DNA, 16 bp, H. sapiens
caaatgtttttatttt

SEQ ID NO: 60014 - DNA, 16 bp, H. sapiens
caaattaaaacatttt

SEQ ID NO: 60015 - DNA, 16 bp, H. sapiens
caaattaaacccaaag

SEQ ID NO: 60016 - DNA, 16 bp, H. sapiens
caaattaaagtaacaa

SEQ ID NO: 60017 - DNA, 26 bp, H. sapiens
caaattaatgatcttagacaaactgt

SEQ ID NO: 60018 - DNA, 16 bp, H. sapiens
caaattaccaatgcca

SEQ ID NO: 60019 - DNA, 16 bp, H. sapiens
caaattacctaggctg

SEQ ID NO: 60020 - DNA, 16 bp, H. sapiens
caaattactaaaatca

SEQ ID NO: 60021 - DNA, 16 bp, H. sapiens
caaattactgataaat

SEQ ID NO: 60022 - DNA, 16 bp, H. sapiens
caaattacttttaaaa

SEQ ID NO: 60023 - DNA, 16 bp, H. sapiens
caaattagctgggcat

SEQ ID NO: 60024 - DNA, 16 bp, H. sapiens
caaattatatgaatgt

SEQ ID NO: 60025 - DNA, 16 bp, H. sapiens
caaattatccttattt

SEQ ID NO: 60026 - DNA, 16 bp, H. sapiens
caaattattatttgtt

SEQ ID NO: 60027 - DNA, 16 bp, H. sapiens
caaattatttctaaat

SEQ ID NO: 60028 - DNA, 16 bp, H. sapiens
caaattattttctaaa

SEQ ID NO: 60029 - DNA, 16 bp, H. sapiens
caaattcaatttcttt

SEQ ID NO: 60030 - DNA, 16 bp, H. sapiens
caaattcacaaataac

SEQ ID NO: 60031 - DNA, 16 bp, H. sapiens
caaattcagtaaattt

SEQ ID NO: 60032 - DNA, 16 bp, H. sapiens
caaattcatagagaca

SEQ ID NO: 60033 - DNA, 16 bp, H. sapiens
caaattcatgttaaaa

SEQ ID NO: 60034 - DNA, 16 bp, H. sapiens
caaattcctgggatta

SEQ ID NO: 60035 - DNA, 16 bp, H. sapiens
caaattcctgggctcg

SEQ ID NO: 60036 - DNA, 16 bp, H. sapiens
caaattctaccagaga

SEQ ID NO: 60037 - DNA, 16 bp, H. sapiens
caaattctgccagagg

SEQ ID NO: 60038 - DNA, 16 bp, H. sapiens
caaattctggttctgc

SEQ ID NO: 60039 - DNA, 16 bp, H. sapiens
caaattctgttttgtt

SEQ ID NO: 60040 - DNA, 16 bp, H. sapiens
caaattcttgggctca

SEQ ID NO: 60041 - DNA, 16 bp, H. sapiens
caaattctttgacact

SEQ ID NO: 60042 - DNA, 16 bp, H. sapiens
caaattgctttccaaa

SEQ ID NO: 60043 - DNA, 16 bp, H. sapiens
caaattgcttttcaaa

SEQ ID NO: 60044 - DNA, 16 bp, H. sapiens
caaattggaaaagaga

SEQ ID NO: 60045 - DNA, 16 bp, H. sapiens
caaattgtattttaaa

SEQ ID NO: 60046 - DNA, 16 bp, H. sapiens
caaattgtttatttct

SEQ ID NO: 60047 - DNA, 16 bp, H. sapiens
caaattgttttttctt

SEQ ID NO: 60048 - DNA, 16 bp, H. sapiens
caaatttacaagagaa

SEQ ID NO: 60049 - DNA, 16 bp, H. sapiens
caaatttaggaaatac

SEQ ID NO: 60050 - DNA, 16 bp, H. sapiens
caaatttatatgttaa

SEQ ID NO: 60051 - DNA, 16 bp, H. sapiens
caaatttcagacttgc

SEQ ID NO: 60052 - DNA, 16 bp, H. sapiens
caaatttcagtggctt

SEQ ID NO: 60053 - DNA, 16 bp, H. sapiens
caaatttccacaaact

SEQ ID NO: 60054 - DNA, 16 bp, H. sapiens
caaatttctgcaactg

SEQ ID NO: 60055 - DNA, 16 bp, H. sapiens
caaatttctgggctca

SEQ ID NO: 60056 - DNA, 16 bp, H. sapiens
caaatttctgttgttt

SEQ ID NO: 60057 - DNA, 16 bp, H. sapiens
caaatttgaaaaatgt

SEQ ID NO: 60058 - DNA, 16 bp, H. sapiens
caaatttgaaaacaaa

SEQ ID NO: 60059 - DNA, 16 bp, H. sapiens
caaatttgcaagaaaa

SEQ ID NO: 60060 - DNA, 16 bp, H. sapiens
caaatttggaaaaaat

SEQ ID NO: 60061 - DNA, 16 bp, H. sapiens
caaatttgtgaaaatt

SEQ ID NO: 60062 - DNA, 16 bp, H. sapiens
caaatttgtgttgggc

SEQ ID NO: 60063 - DNA, 16 bp, H. sapiens
caaatttgtttttaaa

SEQ ID NO: 60064 - DNA, 16 bp, H. sapiens
caaatttgttttttaa

SEQ ID NO: 60065 - DNA, 16 bp, H. sapiens
caaattttaaaaagga

SEQ ID NO: 60066 - DNA, 16 bp, H. sapiens
caaattttaaattttc

SEQ ID NO: 60067 - DNA, 16 bp, H. sapiens
caaattttaaggaaaa

SEQ ID NO: 60068 - DNA, 16 bp, H. sapiens
caaattttactaaaat

SEQ ID NO: 60069 - DNA, 16 bp, H. sapiens
caaattttcatttctt

SEQ ID NO: 60070 - DNA, 16 bp, H. sapiens
caaattttcctgtctt

SEQ ID NO: 60071 - DNA, 16 bp, H. sapiens
caaattttctacaatg

SEQ ID NO: 60072 - DNA, 16 bp, H. sapiens
caaattttctatttct

SEQ ID NO: 60073 - DNA, 16 bp, H. sapiens
caaattttgaaatttt

SEQ ID NO: 60074 - DNA, 16 bp, H. sapiens
caaattttggtatttt

SEQ ID NO: 60075 - DNA, 16 bp, H. sapiens
caaatttttaaaactt

SEQ ID NO: 60076 - DNA, 16 bp, H. sapiens
caaatttttaagaaaa

SEQ ID NO: 60077 - DNA, 16 bp, H. sapiens
caaatttttatttgtt

SEQ ID NO: 60078 - DNA, 16 bp, H. sapiens
caaatttttcttctgc

SEQ ID NO: 60079 - DNA, 16 bp, H. sapiens
caacaaaaaactacag

SEQ ID NO: 60080 - DNA, 16 bp, H. sapiens
caacaaaaagaatttt

SEQ ID NO: 60081 - DNA, 16 bp, H. sapiens
caacaaaaatttattg

SEQ ID NO: 60082 - DNA, 16 bp, H. sapiens
caacaaaaccccatga

SEQ ID NO: 60083 - DNA, 16 bp, H. sapiens
caacaaaactaaaagt

SEQ ID NO: 60084 - DNA, 16 bp, H. sapiens
caacaaaagcaataat

SEQ ID NO: 60085 - DNA, 16 bp, H. sapiens
caacaaaagcagaaat

SEQ ID NO: 60086 - DNA, 16 bp, H. sapiens
caacaaaagtcaaaat

SEQ ID NO: 60087 - DNA, 16 bp, H. sapiens
caacaaaatgaaaagg

SEQ ID NO: 60088 - DNA, 16 bp, H. sapiens
caacaaaatgagaccc

SEQ ID NO: 60089 - DNA, 16 bp, H. sapiens
caacaaaatggatgaa

SEQ ID NO: 60090 - DNA, 16 bp, H. sapiens
caacaaaattaaggca

SEQ ID NO: 60091 - DNA, 16 bp, H. sapiens
caacaaaccaacatgg

SEQ ID NO: 60092 - DNA, 16 bp, H. sapiens
caacaaactagaaata

SEQ ID NO: 60093 - DNA, 16 bp, H. sapiens
caacaaagagcacaat

SEQ ID NO: 60094 - DNA, 16 bp, H. sapiens
caacaaagatatgaaa

SEQ ID NO: 60095 - DNA, 16 bp, H. sapiens
caacaaagatcacagg

SEQ ID NO: 60096 - DNA, 16 bp, H. sapiens
caacaaagatgaaagt

SEQ ID NO: 60097 - DNA, 16 bp, H. sapiens
caacaaagatgccaag

SEQ ID NO: 60098 - DNA, 16 bp, H. sapiens
caacaaagattttttt

SEQ ID NO: 60099 - DNA, 16 bp, H. sapiens
caacaaagctagactc

SEQ ID NO: 60100 - DNA, 16 bp, H. sapiens
caacaaagctgttaaa

SEQ ID NO: 60101 - DNA, 16 bp, H. sapiens
caacaaaggattcaga

SEQ ID NO: 60102 - DNA, 16 bp, H. sapiens
caacaaaggcttcaaa

SEQ ID NO: 60103 - DNA, 16 bp, H. sapiens
caacaaagtaaaaccc

SEQ ID NO: 60104 - DNA, 16 bp, H. sapiens
caacaaagtaaacaga

SEQ ID NO: 60105 - DNA, 16 bp, H. sapiens
caacaaagtaaagaga

SEQ ID NO: 60106 - DNA, 16 bp, H. sapiens
caacaaagtgaagaga

SEQ ID NO: 60107 - DNA, 16 bp, H. sapiens
caacaaagtgagacct

SEQ ID NO: 60108 - DNA, 16 bp, H. sapiens
caacaaagtgggaccc

SEQ ID NO: 60109 - DNA, 16 bp, H. sapiens
caacaaatattgactg

SEQ ID NO: 60110 - DNA, 16 bp, H. sapiens
caacaaatattttttg

SEQ ID NO: 60111 - DNA, 16 bp, H. sapiens
caacaaatgttgctgg

SEQ ID NO: 60112 - DNA, 16 bp, H. sapiens
caacaacaaaaaatgt

SEQ ID NO: 60113 - DNA, 16 bp, H. sapiens
caacaacaaaaagcct

SEQ ID NO: 60114 - DNA, 16 bp, H. sapiens
caacaacaaaaaggat

SEQ ID NO: 60115 - DNA, 16 bp, H. sapiens
caacaacaaaaattct

SEQ ID NO: 60116 - DNA, 16 bp, H. sapiens
caacaacaaaacattt

SEQ ID NO: 60117 - DNA, 16 bp, H. sapiens
caacaacaaaagaact

SEQ ID NO: 60118 - DNA, 16 bp, H. sapiens
caacaacaaaagtgaa

SEQ ID NO: 60119 - DNA, 16 bp, H. sapiens
caacaacaaaccctgg

SEQ ID NO: 60120 - DNA, 16 bp, H. sapiens
caacaacagattttca

SEQ ID NO: 60121 - DNA, 16 bp, H. sapiens
caacaacagcaaaact

SEQ ID NO: 60122 - DNA, 16 bp, H. sapiens
caacaaccctgtgagg

SEQ ID NO: 60123 - DNA, 21 bp, H. sapiens
caacaacctctttggactcag

SEQ ID NO: 60124 - DNA, 16 bp, H. sapiens
caacaacttagataaa

SEQ ID NO: 60125 - DNA, 16 bp, H. sapiens
caacaagaacaaaact

SEQ ID NO: 60126 - DNA, 16 bp, H. sapiens
caacaagaacgaaact

SEQ ID NO: 60127 - DNA, 16 bp, H. sapiens
caacaagaagatatta

SEQ ID NO: 60128 - DNA, 16 bp, H. sapiens
caacaagaatgaaatt

SEQ ID NO: 60129 - DNA, 16 bp, H. sapiens
caacaagaccaaaact

SEQ ID NO: 60130 - DNA, 16 bp, H. sapiens
caacaagagcaaaaat

SEQ ID NO: 60131 - DNA, 16 bp, H. sapiens
caacaagagcaaaact

SEQ ID NO: 60132 - DNA, 16 bp, H. sapiens
caacaagagcaaaagt

SEQ ID NO: 60133 - DNA, 16 bp, H. sapiens
caacaagagcaaaatt

SEQ ID NO: 60134 - DNA, 16 bp, H. sapiens
caacaagagccaaact

SEQ ID NO: 60135 - DNA, 16 bp, H. sapiens
caacaagagcgaaact

SEQ ID NO: 60136 - DNA, 16 bp, H. sapiens
caacaagaggaaaact

SEQ ID NO: 60137 - DNA, 16 bp, H. sapiens
caacaagagggaaact

SEQ ID NO: 60138 - DNA, 16 bp, H. sapiens
caacaagagtaaaact

SEQ ID NO: 60139 - DNA, 16 bp, H. sapiens
caacaagagtgaaacg

SEQ ID NO: 60140 - DNA, 16 bp, H. sapiens
caacaagagtgaaact

SEQ ID NO: 60141 - DNA, 16 bp, H. sapiens
caacaagagtgaaatg

SEQ ID NO: 60142 - DNA, 16 bp, H. sapiens
caacaagagtgaaatt

SEQ ID NO: 60143 - DNA, 16 bp, H. sapiens
caacaagagtgacctc

SEQ ID NO: 60144 - DNA, 16 bp, H. sapiens
caacaagctaaagaag

SEQ ID NO: 60145 - DNA, 16 bp, H. sapiens
caacaaggagaaaccc

SEQ ID NO: 60146 - DNA, 16 bp, H. sapiens
caacaagggtaccaag

SEQ ID NO: 60147 - DNA, 16 bp, H. sapiens
caacaagttcttcatc

SEQ ID NO: 60148 - DNA, 16 bp, H. sapiens
caacaataacagcaaa

SEQ ID NO: 60149 - DNA, 16 bp, H. sapiens
caacaataatagtaat

SEQ ID NO: 60150 - DNA, 16 bp, H. sapiens
caacaatatgaatata

SEQ ID NO: 60151 - DNA, 16 bp, H. sapiens
caacaatcacaagcat

SEQ ID NO: 60152 - DNA, 16 bp, H. sapiens
caacaatcccatttct

SEQ ID NO: 60153 - DNA, 16 bp, H. sapiens
caacaatgcattaaaa

SEQ ID NO: 60154 - DNA, 16 bp, H. sapiens
caacaatggggagcac

SEQ ID NO: 60155 - DNA, 16 bp, H. sapiens
caacaatgtggagaaa

SEQ ID NO: 60156 - DNA, 16 bp, H. sapiens
caacaatttattgtat

SEQ ID NO: 60157 - DNA, 16 bp, H. sapiens
caacacaaagaaatga

SEQ ID NO: 60158 - DNA, 16 bp, H. sapiens
caacacaatattgaag

SEQ ID NO: 60159 - DNA, 16 bp, H. sapiens
caacacacatatacac

SEQ ID NO: 60160 - DNA, 16 bp, H. sapiens
caacacaggagaaaga

SEQ ID NO: 60161 - DNA, 16 bp, H. sapiens
caacacagggagactc

SEQ ID NO: 60162 - DNA, 16 bp, H. sapiens
caacacagtgagaccc

SEQ ID NO: 60163 - DNA, 16 bp, H. sapiens
caacaccaagagtgag

SEQ ID NO: 60164 - DNA, 16 bp, H. sapiens
caacaccaagccattc

SEQ ID NO: 60165 - DNA, 16 bp, H. sapiens
caacaccagcccatga

SEQ ID NO: 60166 - DNA, 16 bp, H. sapiens
caacaccatcatcatc

SEQ ID NO: 60167 - DNA, 16 bp, H. sapiens
caacaccatccaggaa

SEQ ID NO: 60168 - DNA, 16 bp, H. sapiens
caacacccctttccag

SEQ ID NO: 60169 - DNA, 16 bp, H. sapiens
caacacgctgaaaccc

SEQ ID NO: 60170 - DNA, 16 bp, H. sapiens
caacactgctctccag

SEQ ID NO: 60171 - DNA, 16 bp, H. sapiens
caacactgttgcattg

SEQ ID NO: 60172 - DNA, 16 bp, H. sapiens
caacacttattttctg

SEQ ID NO: 60173 - DNA, 16 bp, H. sapiens
caacacttgtcatttt

SEQ ID NO: 60174 - DNA, 16 bp, H. sapiens
caacacttgttatctt

SEQ ID NO: 60175 - DNA, 16 bp, H. sapiens
caacactttaggaggc

SEQ ID NO: 60176 - DNA, 16 bp, H. sapiens
caacactttgagaggc

SEQ ID NO: 60177 - DNA, 16 bp, H. sapiens
caacagaaaatggaca

SEQ ID NO: 60178 - DNA, 16 bp, H. sapiens
caacagaaatgcattt

SEQ ID NO: 60179 - DNA, 16 bp, H. sapiens
caacagaacaagactc

SEQ ID NO: 60180 - DNA, 16 bp, H. sapiens
caacagaacaagattc

SEQ ID NO: 60181 - DNA, 16 bp, H. sapiens
caacagaaggagactc

SEQ ID NO: 60182 - DNA, 16 bp, H. sapiens
caacagaatacacatt

SEQ ID NO: 60183 - DNA, 16 bp, H. sapiens
caacagaatatacatt

SEQ ID NO: 60184 - DNA, 16 bp, H. sapiens
caacagacaaatgaaa

SEQ ID NO: 60185 - DNA, 16 bp, H. sapiens
caacagacactgagga

SEQ ID NO: 60186 - DNA, 16 bp, H. sapiens
caacagacactgggaa

SEQ ID NO: 60187 - DNA, 16 bp, H. sapiens
caacagacatttattt

SEQ ID NO: 60188 - DNA, 16 bp, H. sapiens
caacagagaccatatg

SEQ ID NO: 60189 - DNA, 16 bp, H. sapiens
caacagagactctgtc

SEQ ID NO: 60190 - DNA, 16 bp, H. sapiens
caacagagagaaaccc

SEQ ID NO: 60191 - DNA, 16 bp, H. sapiens
caacagagcaaacaga

SEQ ID NO: 60192 - DNA, 16 bp, H. sapiens
caacagagcaagactt

SEQ ID NO: 60193 - DNA, 16 bp, H. sapiens
caacagagcaagatcc

SEQ ID NO: 60194 - DNA, 16 bp, H. sapiens
caacagagcaagattt

SEQ ID NO: 60195 - DNA, 16 bp, H. sapiens
caacagagcaaggctc

SEQ ID NO: 60196 - DNA, 16 bp, H. sapiens
caacagagccaatcaa

SEQ ID NO: 60197 - DNA, 16 bp, H. sapiens
caacagagcgagacac

SEQ ID NO: 60198 - DNA, 17 bp, H. sapiens
caacagagcgagacccc

SEQ ID NO: 60199 - DNA, 16 bp, H. sapiens
caacagagcgagacta

SEQ ID NO: 60200 - DNA, 17 bp, H. sapiens
caacagagcgagactcg

SEQ ID NO: 60201 - DNA, 16 bp, H. sapiens
caacagagcgagactg

SEQ ID NO: 60202 - DNA, 16 bp, H. sapiens
caacagagctgcaaaa

SEQ ID NO: 60203 - DNA, 16 bp, H. sapiens
caacagaggagactcc

SEQ ID NO: 60204 - DNA, 16 bp, H. sapiens
caacagaggcagagat

SEQ ID NO: 60205 - DNA, 16 bp, H. sapiens
caacagagtaagaccc

SEQ ID NO: 60206 - DNA, 16 bp, H. sapiens
caacagagtaagatcc

SEQ ID NO: 60207 - DNA, 16 bp, H. sapiens
caacagagtgagaatc

SEQ ID NO: 60208 - DNA, 16 bp, H. sapiens
caacagagtgagacct

SEQ ID NO: 60209 - DNA, 16 bp, H. sapiens
caacagatgaacggat

SEQ ID NO: 60210 - DNA, 16 bp, H. sapiens
caacagatgctggtga

SEQ ID NO: 60211 - DNA, 16 bp, H. sapiens
caacagatgtttgtga

SEQ ID NO: 60212 - DNA, 16 bp, H. sapiens
caacagcaaaataaat

SEQ ID NO: 60213 - DNA, 16 bp, H. sapiens
caacagcaacagcatc

SEQ ID NO: 60214 - DNA, 16 bp, H. sapiens
caacagcacataaaaa

SEQ ID NO: 60215 - DNA, 16 bp, H. sapiens
caacagcacattgaaa

SEQ ID NO: 60216 - DNA, 16 bp, H. sapiens
caacagcagcaacaat

SEQ ID NO: 60217 - DNA, 16 bp, H. sapiens
caacagcagcagaata

SEQ ID NO: 60218 - DNA, 16 bp, H. sapiens
caacagcagcagcagt

SEQ ID NO: 60219 - DNA, 16 bp, H. sapiens
caacagcagcagcatc

SEQ ID NO: 60220 - DNA, 16 bp, H. sapiens
caacagcatacaaggg

SEQ ID NO: 60221 - DNA, 16 bp, H. sapiens
caacagcatcaacaaa

SEQ ID NO: 60222 - DNA, 16 bp, H. sapiens
caacagcatcacctgg

SEQ ID NO: 60223 - DNA, 16 bp, H. sapiens
caacagcatcccaagg

SEQ ID NO: 60224 - DNA, 16 bp, H. sapiens
caacagccaagccaag

SEQ ID NO: 60225 - DNA, 16 bp, H. sapiens
caacagcttgcaccat

SEQ ID NO: 60226 - DNA, 16 bp, H. sapiens
caacaggaaacagatg

SEQ ID NO: 60227 - DNA, 16 bp, H. sapiens
caacaggacccagtgt

SEQ ID NO: 60228 - DNA, 16 bp, H. sapiens
caacaggatatacatt

SEQ ID NO: 60229 - DNA, 16 bp, H. sapiens
caacaggatgaaaccc

SEQ ID NO: 60230 - DNA, 16 bp, H. sapiens
caacaggctgaggtgg

SEQ ID NO: 60231 - DNA, 16 bp, H. sapiens
caacaggctgggtgca

SEQ ID NO: 60232 - DNA, 16 bp, H. sapiens
caacaggtaatttttc

SEQ ID NO: 60233 - DNA, 16 bp, H. sapiens
caacaggtatgtgaaa

SEQ ID NO: 60234 - DNA, 16 bp, H. sapiens
caacaggtgctagaga

SEQ ID NO: 60235 - DNA, 16 bp, H. sapiens
caacaggtttttctta

SEQ ID NO: 60236 - DNA, 16 bp, H. sapiens
caacagtctctcagac

SEQ ID NO: 60237 - DNA, 16 bp, H. sapiens
caacagtgaaaaactg

SEQ ID NO: 60238 - DNA, 16 bp, H. sapiens
caacagtgaccaagct

SEQ ID NO: 60239 - DNA, 16 bp, H. sapiens
caacagtgcctttttt

SEQ ID NO: 60240 - DNA, 16 bp, H. sapiens
caacagtggaaaagca

SEQ ID NO: 60241 - DNA, 16 bp, H. sapiens
caacagtgggcccagg

SEQ ID NO: 60242 - DNA, 16 bp, H. sapiens
caacagtgtaaaagaa

SEQ ID NO: 60243 - DNA, 16 bp, H. sapiens
caacagtgtacaagag

SEQ ID NO: 60244 - DNA, 16 bp, H. sapiens
caacagtgtgaatgta

SEQ ID NO: 60245 - DNA, 16 bp, H. sapiens
caacagtgtgagactc

SEQ ID NO: 60246 - DNA, 16 bp, H. sapiens
caacataagcaaaaat

SEQ ID NO: 60247 - DNA, 16 bp, H. sapiens
caacataatttttaaa

SEQ ID NO: 60248 - DNA, 16 bp, H. sapiens
caacatacccaaatca

SEQ ID NO: 60249 - DNA, 16 bp, H. sapiens
caacatagaactggaa

SEQ ID NO: 60250 - DNA, 16 bp, H. sapiens
caacatagagctcagg

SEQ ID NO: 60251 - DNA, 16 bp, H. sapiens
caacatagcaaaaacc

SEQ ID NO: 60252 - DNA, 16 bp, H. sapiens
caacatagcaagactt

SEQ ID NO: 60253 - DNA, 17 bp, H. sapiens
caacatagcgagaccct

SEQ ID NO: 60254 - DNA, 16 bp, H. sapiens
caacatagctagactc

SEQ ID NO: 60255 - DNA, 16 bp, H. sapiens
caacatagtaaagatg

SEQ ID NO: 60256 - DNA, 17 bp, H. sapiens
caacatagtgaaaccct

SEQ ID NO: 60257 - DNA, 16 bp, H. sapiens
caacatagtgagaccc

SEQ ID NO: 60258 - DNA, 16 bp, H. sapiens
caacatagtgagactt

SEQ ID NO: 60259 - DNA, 16 bp, H. sapiens
caacatagtgagtccc

SEQ ID NO: 60260 - DNA, 16 bp, H. sapiens
caacatataaatttga

SEQ ID NO: 60261 - DNA, 16 bp, H. sapiens
caacatataaattttt

SEQ ID NO: 60262 - DNA, 16 bp, H. sapiens
caacatatacattttg

SEQ ID NO: 60263 - DNA, 16 bp, H. sapiens
caacatatgaatttta

SEQ ID NO: 60264 - DNA, 16 bp, H. sapiens
caacatatgggaatta

SEQ ID NO: 60265 - DNA, 16 bp, H. sapiens
caacatatgtaaaatg

SEQ ID NO: 60266 - DNA, 16 bp, H. sapiens
caacatatgtaaatca

SEQ ID NO: 60267 - DNA, 16 bp, H. sapiens
caacatcaacatcaac

SEQ ID NO: 60268 - DNA, 16 bp, H. sapiens
caacatcactaatgat

SEQ ID NO: 60269 - DNA, 16 bp, H. sapiens
caacatcactgaccat

SEQ ID NO: 60270 - DNA, 16 bp, H. sapiens
caacatcagcatcacc

SEQ ID NO: 60271 - DNA, 16 bp, H. sapiens
caacatcagcctggcc

SEQ ID NO: 60272 - DNA, 16 bp, H. sapiens
caacatcaggaagtta

SEQ ID NO: 60273 - DNA, 16 bp, H. sapiens
caacatcatcaatcat

SEQ ID NO: 60274 - DNA, 16 bp, H. sapiens
caacatcatgagaccc

SEQ ID NO: 60275 - DNA, 16 bp, H. sapiens
caacatcattgatcat

SEQ ID NO: 60276 - DNA, 16 bp, H. sapiens
caacatcatttttcat

SEQ ID NO: 60277 - DNA, 16 bp, H. sapiens
caacatcctttttttt

SEQ ID NO: 60278 - DNA, 16 bp, H. sapiens
caacatctacctccca

SEQ ID NO: 60279 - DNA, 16 bp, H. sapiens
caacatctattattat

SEQ ID NO: 60280 - DNA, 16 bp, H. sapiens
caacatctgcctccct

SEQ ID NO: 60281 - DNA, 16 bp, H. sapiens
caacatctgcttctgg

SEQ ID NO: 60282 - DNA, 16 bp, H. sapiens
caacatctgttatttt

SEQ ID NO: 60283 - DNA, 16 bp, H. sapiens
caacatcttccctttc

SEQ ID NO: 60284 - DNA, 16 bp, H. sapiens
caacatgaagaaaccc

SEQ ID NO: 60285 - DNA, 16 bp, H. sapiens
caacatgaatgaatct

SEQ ID NO: 60286 - DNA, 16 bp, H. sapiens
caacatgaattttgaa

SEQ ID NO: 60287 - DNA, 16 bp, H. sapiens
caacatgagatctggg

SEQ ID NO: 60288 - DNA, 16 bp, H. sapiens
caacatgataaaaccc

SEQ ID NO: 60289 - DNA, 16 bp, H. sapiens
caacatgatatttggg

SEQ ID NO: 60290 - DNA, 16 bp, H. sapiens
caacatgatgttttga

SEQ ID NO: 60291 - DNA, 16 bp, H. sapiens
caacatgctaaaaccc

SEQ ID NO: 60292 - DNA, 16 bp, H. sapiens
caacatggaaaaaccc

SEQ ID NO: 60293 - DNA, 16 bp, H. sapiens
caacatggaaaaatcc

SEQ ID NO: 60294 - DNA, 16 bp, H. sapiens
caacatggacaacatg

SEQ ID NO: 60295 - DNA, 16 bp, H. sapiens
caacatggataaatat

SEQ ID NO: 60296 - DNA, 16 bp, H. sapiens
caacatggatgagcct

SEQ ID NO: 60297 - DNA, 16 bp, H. sapiens
caacatggatgcaact

SEQ ID NO: 60298 - DNA, 16 bp, H. sapiens
caacatggcaaaaccc

SEQ ID NO: 60299 - DNA, 16 bp, H. sapiens
caacatggcaggaccc

SEQ ID NO: 60300 - DNA, 16 bp, H. sapiens
caacatggcgaaaccc

SEQ ID NO: 60301 - DNA, 16 bp, H. sapiens
caacatgggagaaaga

SEQ ID NO: 60302 - DNA, 16 bp, H. sapiens
caacatgggtgaacct

SEQ ID NO: 60303 - DNA, 16 bp, H. sapiens
caacatggtaaaaccc

SEQ ID NO: 60304 - DNA, 16 bp, H. sapiens
caacatggtcaaacct

SEQ ID NO: 60305 - DNA, 16 bp, H. sapiens
caacatggtgaaacct

SEQ ID NO: 60306 - DNA, 16 bp, H. sapiens
caacatggtgaaatcc

SEQ ID NO: 60307 - DNA, 16 bp, H. sapiens
caacattattcacaat

SEQ ID NO: 60308 - DNA, 16 bp, H. sapiens
caacattcccttaagc

SEQ ID NO: 60309 - DNA, 16 bp, H. sapiens
caacattccttcatga

SEQ ID NO: 60310 - DNA, 18 bp, H. sapiens
caacattgagcactgagt

SEQ ID NO: 60311 - DNA, 16 bp, H. sapiens
caacattgatggaact

SEQ ID NO: 60312 - DNA, 16 bp, H. sapiens
caacattggaccaaat

SEQ ID NO: 60313 - DNA, 16 bp, H. sapiens
caacatttatttattg

SEQ ID NO: 60314 - DNA, 16 bp, H. sapiens
caacatttgggcagga

SEQ ID NO: 60315 - DNA, 16 bp, H. sapiens
caacattttaaaatta

SEQ ID NO: 60316 - DNA, 16 bp, H. sapiens
caacattttaaacaaa

SEQ ID NO: 60317 - DNA, 16 bp, H. sapiens
caacattttaagaaaa

SEQ ID NO: 60318 - DNA, 16 bp, H. sapiens
caacattttacattcc

SEQ ID NO: 60319 - DNA, 16 bp, H. sapiens
caacattttcatcaac

SEQ ID NO: 60320 - DNA, 16 bp, H. sapiens
caacattttctctttt

SEQ ID NO: 60321 - DNA, 16 bp, H. sapiens
caacattttcttttct

SEQ ID NO: 60322 - DNA, 16 bp, H. sapiens
caacatttttcaaaat

SEQ ID NO: 60323 - DNA, 16 bp, H. sapiens
caaccaaaaaaaagtc

SEQ ID NO: 60324 - DNA, 16 bp, H. sapiens
caaccaaccatccatc

SEQ ID NO: 60325 - DNA, 16 bp, H. sapiens
caaccaactgccaatc

SEQ ID NO: 60326 - DNA, 16 bp, H. sapiens
caaccaatcagactga

SEQ ID NO: 60327 - DNA, 16 bp, H. sapiens
caaccaatcagcattc

SEQ ID NO: 60328 - DNA, 16 bp, H. sapiens
caaccacagatcaaaa

SEQ ID NO: 60329 - DNA, 16 bp, H. sapiens
caaccaccacatgttc

SEQ ID NO: 60330 - DNA, 16 bp, H. sapiens
caaccaccattttatt

SEQ ID NO: 60331 - DNA, 16 bp, H. sapiens
caaccacctcagcctc

SEQ ID NO: 60332 - DNA, 19 bp, H. sapiens
caaccacgcccggctaatt

SEQ ID NO: 60333 - DNA, 16 bp, H. sapiens
caaccactatggaaga

SEQ ID NO: 60334 - DNA, 16 bp, H. sapiens
caaccactctcttgga

SEQ ID NO: 60335 - DNA, 16 bp, H. sapiens
caaccactgatctgct

SEQ ID NO: 60336 - DNA, 16 bp, H. sapiens
caaccactgtctccca

SEQ ID NO: 60337 - DNA, 16 bp, H. sapiens
caaccagaaaacaata

SEQ ID NO: 60338 - DNA, 16 bp, H. sapiens
caaccagagcaaaact

SEQ ID NO: 60339 - DNA, 16 bp, H. sapiens
caaccagaggctgaag

SEQ ID NO: 60340 - DNA, 16 bp, H. sapiens
caaccagatcttgtga

SEQ ID NO: 60341 - DNA, 16 bp, H. sapiens
caaccagcagccctca

SEQ ID NO: 60342 - DNA, 16 bp, H. sapiens
caaccagttctcctgc

SEQ ID NO: 60343 - DNA, 16 bp, H. sapiens
caaccagttctgtgat

SEQ ID NO: 60344 - DNA, 16 bp, H. sapiens
caaccagtttgaagac

SEQ ID NO: 60345 - DNA, 16 bp, H. sapiens
caaccatcactgccat

SEQ ID NO: 60346 - DNA, 16 bp, H. sapiens
caaccatctcatcttc

SEQ ID NO: 60347 - DNA, 16 bp, H. sapiens
caaccatggatcaaaa

SEQ ID NO: 60348 - DNA, 16 bp, H. sapiens
caaccatgtgattaga

SEQ ID NO: 60349 - DNA, 16 bp, H. sapiens
caaccattgtggaaga

SEQ ID NO: 60350 - DNA, 16 bp, H. sapiens
caaccatttaaaaatg

SEQ ID NO: 60351 - DNA, 16 bp, H. sapiens
caacccaaagccaatc

SEQ ID NO: 60352 - DNA, 16 bp, H. sapiens
caacccaaatgtctat

SEQ ID NO: 60353 - DNA, 16 bp, H. sapiens
caacccagcaattcca

SEQ ID NO: 60354 - DNA, 16 bp, H. sapiens
caacccaggatttcat

SEQ ID NO: 60355 - DNA, 16 bp, H. sapiens
caacccatcatctaga

SEQ ID NO: 60356 - DNA, 16 bp, H. sapiens
caaccccaaggcacat

SEQ ID NO: 60357 - DNA, 16 bp, H. sapiens
caaccccagcctcctg

SEQ ID NO: 60358 - DNA, 16 bp, H. sapiens
caacccccacctccag

SEQ ID NO: 60359 - DNA, 16 bp, H. sapiens
caacccccgcctcctg

SEQ ID NO: 60360 - DNA, 16 bp, H. sapiens
caacccctactatgcc

SEQ ID NO: 60361 - DNA, 16 bp, H. sapiens
caaccctatgaagtaa

SEQ ID NO: 60362 - DNA, 16 bp, H. sapiens
caaccctctgcctccc

SEQ ID NO: 60363 - DNA, 16 bp, H. sapiens
caaccctgtgagatag

SEQ ID NO: 60364 - DNA, 16 bp, H. sapiens
caaccctttgggaggc

SEQ ID NO: 60365 - DNA, 16 bp, H. sapiens
caaccgcctgaccatc

SEQ ID NO: 60366 - DNA, 16 bp, H. sapiens
caacctaaatgcccat

SEQ ID NO: 60367 - DNA, 16 bp, H. sapiens
caacctaaatgtccat

SEQ ID NO: 60368 - DNA, 16 bp, H. sapiens
caacctaagtgtccat

SEQ ID NO: 60369 - DNA, 16 bp, H. sapiens
caacctacaaagattg

SEQ ID NO: 60370 - DNA, 16 bp, H. sapiens
caacctacagaatgag

SEQ ID NO: 60371 - DNA, 16 bp, H. sapiens
caacctagaattctgt

SEQ ID NO: 60372 - DNA, 16 bp, H. sapiens
caacctcaagtgattc

SEQ ID NO: 60373 - DNA, 16 bp, H. sapiens
caacctcacaggctca

SEQ ID NO: 60374 - DNA, 16 bp, H. sapiens
caacctcaccaacatt

SEQ ID NO: 60375 - DNA, 16 bp, H. sapiens
caacctcaccagcaac

SEQ ID NO: 60376 - DNA, 16 bp, H. sapiens
caacctcaccctcctg

SEQ ID NO: 60377 - DNA, 16 bp, H. sapiens
caacctcagcctccag

SEQ ID NO: 60378 - DNA, 16 bp, H. sapiens
caacctcagcctccta

SEQ ID NO: 60379 - DNA, 16 bp, H. sapiens
caacctcagcctcctg

SEQ ID NO: 60380 - DNA, 16 bp, H. sapiens
caacctcagccttcca

SEQ ID NO: 60381 - DNA, 16 bp, H. sapiens
caacctcagccttctg

SEQ ID NO: 60382 - DNA, 16 bp, H. sapiens
caacctcagcttcctg

SEQ ID NO: 60383 - DNA, 16 bp, H. sapiens
caacctcaggtgaccc

SEQ ID NO: 60384 - DNA, 16 bp, H. sapiens
caacctcatctgcacc

SEQ ID NO: 60385 - DNA, 16 bp, H. sapiens
caacctcattttaact

SEQ ID NO: 60386 - DNA, 16 bp, H. sapiens
caacctccaccacctg

SEQ ID NO: 60387 - DNA, 17 bp, H. sapiens
caacctccacctcgcgg

SEQ ID NO: 60388 - DNA, 16 bp, H. sapiens
caacctccacgtcctg

SEQ ID NO: 60389 - DNA, 16 bp, H. sapiens
caacctccagaactat

SEQ ID NO: 60390 - DNA, 16 bp, H. sapiens
caacctccagagtagc

SEQ ID NO: 60391 - DNA, 16 bp, H. sapiens
caacctcccaaagtat

SEQ ID NO: 60392 - DNA, 16 bp, H. sapiens
caacctcccaaggctc

SEQ ID NO: 60393 - DNA, 16 bp, H. sapiens
caacctcccaggctcc

SEQ ID NO: 60394 - DNA, 16 bp, H. sapiens
caacctccctgggctc

SEQ ID NO: 60395 - DNA, 16 bp, H. sapiens
caacctccgccccctg

SEQ ID NO: 60396 - DNA, 16 bp, H. sapiens
caacctccgcctgcct

SEQ ID NO: 60397 - DNA, 16 bp, H. sapiens
caacctcctactcctg

SEQ ID NO: 60398 - DNA, 16 bp, H. sapiens
caacctcctcttccca

SEQ ID NO: 60399 - DNA, 16 bp, H. sapiens
caacctcctgagctca

SEQ ID NO: 60400 - DNA, 16 bp, H. sapiens
caacctcctggcttca

SEQ ID NO: 60401 - DNA, 16 bp, H. sapiens
caacctcctgggctca

SEQ ID NO: 60402 - DNA, 16 bp, H. sapiens
caacctcctgggctct

SEQ ID NO: 60403 - DNA, 16 bp, H. sapiens
caacctcctgggcttc

SEQ ID NO: 60404 - DNA, 16 bp, H. sapiens
caacctcctggggctc

SEQ ID NO: 60405 - DNA, 16 bp, H. sapiens
caacctccttggctca

SEQ ID NO: 60406 - DNA, 16 bp, H. sapiens
caacctcggcctcctg

SEQ ID NO: 60407 - DNA, 16 bp, H. sapiens
caacctctacctccct

SEQ ID NO: 60408 - DNA, 16 bp, H. sapiens
caacctctacttcctg

SEQ ID NO: 60409 - DNA, 16 bp, H. sapiens
caacctctccttcctg

SEQ ID NO: 60410 - DNA, 16 bp, H. sapiens
caacctctctctccca

SEQ ID NO: 60411 - DNA, 16 bp, H. sapiens
caacctctgccccttg

SEQ ID NO: 60412 - DNA, 16 bp, H. sapiens
caacctctgcctcaag

SEQ ID NO: 60413 - DNA, 16 bp, H. sapiens
caacctctgcctcatg

SEQ ID NO: 60414 - DNA, 16 bp, H. sapiens
caacctctgcctccta

SEQ ID NO: 60415 - DNA, 16 bp, H. sapiens
caacctctgcctcctc

SEQ ID NO: 60416 - DNA, 16 bp, H. sapiens
caacctctgcctgtca

SEQ ID NO: 60417 - DNA, 16 bp, H. sapiens
caacctctgctccctg

SEQ ID NO: 60418 - DNA, 16 bp, H. sapiens
caacctctgcttcctg

SEQ ID NO: 60419 - DNA, 16 bp, H. sapiens
caacctctggctccca

SEQ ID NO: 60420 - DNA, 16 bp, H. sapiens
caacctctgtggaaaa

SEQ ID NO: 60421 - DNA, 16 bp, H. sapiens
caacctcttcctcctg

SEQ ID NO: 60422 - DNA, 16 bp, H. sapiens
caacctcttcttcctg

SEQ ID NO: 60423 - DNA, 16 bp, H. sapiens
caacctgagtgacaga

SEQ ID NO: 60424 - DNA, 16 bp, H. sapiens
caacctgcctcagcct

SEQ ID NO: 60425 - DNA, 16 bp, H. sapiens
caacctgcctcccatt

SEQ ID NO: 60426 - DNA, 16 bp, H. sapiens
caacctggacctcctg

SEQ ID NO: 60427 - DNA, 16 bp, H. sapiens
caacctggcaacatag

SEQ ID NO: 60428 - DNA, 16 bp, H. sapiens
caacctggccaacata

SEQ ID NO: 60429 - DNA, 16 bp, H. sapiens
caacctggccaacctg

SEQ ID NO: 60430 - DNA, 16 bp, H. sapiens
caacctgggaaacaca

SEQ ID NO: 60431 - DNA, 16 bp, H. sapiens
caacctgggcaacaca

SEQ ID NO: 60432 - DNA, 16 bp, H. sapiens
caacctgggcaacatg

SEQ ID NO: 60433 - DNA, 16 bp, H. sapiens
caacctgggctacaga

SEQ ID NO: 60434 - DNA, 16 bp, H. sapiens
caacctgggggacaag

SEQ ID NO: 60435 - DNA, 16 bp, H. sapiens
caacctgggtgacaag

SEQ ID NO: 60436 - DNA, 16 bp, H. sapiens
caacctgtcatttaca

SEQ ID NO: 60437 - DNA, 16 bp, H. sapiens
caacctgtggcccatg

SEQ ID NO: 60438 - DNA, 16 bp, H. sapiens
caacctgttttatcag

SEQ ID NO: 60439 - DNA, 16 bp, H. sapiens
caaccttactgaattt

SEQ ID NO: 60440 - DNA, 16 bp, H. sapiens
caaccttcacttcctg

SEQ ID NO: 60441 - DNA, 16 bp, H. sapiens
caaccttgacctcctg

SEQ ID NO: 60442 - DNA, 16 bp, H. sapiens
caaccttggcctccca

SEQ ID NO: 60443 - DNA, 16 bp, H. sapiens
caaccttggtgacaga

SEQ ID NO: 60444 - DNA, 16 bp, H. sapiens
caacctttctctctgg

SEQ ID NO: 60445 - DNA, 16 bp, H. sapiens
caacctttttggcatc

SEQ ID NO: 60446 - DNA, 16 bp, H. sapiens
caacgagagtgaaact

SEQ ID NO: 60447 - DNA, 16 bp, H. sapiens
caacgagcgaaactcc

SEQ ID NO: 60448 - DNA, 16 bp, H. sapiens
caacgctttgggaggc

SEQ ID NO: 60449 - DNA, 16 bp, H. sapiens
caacggcctttccagg

SEQ ID NO: 60450 - DNA, 16 bp, H. sapiens
caacggggtgaaaccc

SEQ ID NO: 60451 - DNA, 16 bp, H. sapiens
caacgtctgcctcctg

SEQ ID NO: 60452 - DNA, 18 bp, H. sapiens
caactaataaggaccccc

SEQ ID NO: 60453 - DNA, 16 bp, H. sapiens
caactaatttcttttt

SEQ ID NO: 60454 - DNA, 24 bp, H. sapiens
caactacacacatcactgaaacaa

SEQ ID NO: 60455 - DNA, 17 bp, H. sapiens
caactacagcaaagtct

SEQ ID NO: 60456 - DNA, 43 bp, H. sapiens
caactacatggaaactgaacaacctgctcctgaatgactactg

SEQ ID NO: 60457 - DNA, 16 bp, H. sapiens
caactaccattctatt

SEQ ID NO: 60458 - DNA, 16 bp, H. sapiens
caactactagggagac

SEQ ID NO: 60459 - DNA, 16 bp, H. sapiens
caactacttgggagga

SEQ ID NO: 60460 - DNA, 16 bp, H. sapiens
caactataaaaaggaa

SEQ ID NO: 60461 - DNA, 19 bp, H. sapiens
caactatactacaaggcta

SEQ ID NO: 60462 - DNA, 16 bp, H. sapiens
caactattattatatt

SEQ ID NO: 60463 - DNA, 16 bp, H. sapiens
caactattattattcc

SEQ ID NO: 60464 - DNA, 16 bp, H. sapiens
caactattatttgtca

SEQ ID NO: 60465 - DNA, 16 bp, H. sapiens
caactattattttaga

SEQ ID NO: 60466 - DNA, 16 bp, H. sapiens
caactattttttaaat

SEQ ID NO: 60467 - DNA, 16 bp, H. sapiens
caactcaaaatggatt

SEQ ID NO: 60468 - DNA, 16 bp, H. sapiens
caactcactgcagcct

SEQ ID NO: 60469 - DNA, 20 bp, H. sapiens
caactcagcattcacctact

SEQ ID NO: 60470 - DNA, 16 bp, H. sapiens
caactcagcttcctga

SEQ ID NO: 60471 - DNA, 16 bp, H. sapiens
caactcatcccagttt

SEQ ID NO: 60472 - DNA, 16 bp, H. sapiens
caactcattttatgaa

SEQ ID NO: 60473 - DNA, 16 bp, H. sapiens
caactccaaaaggaac

SEQ ID NO: 60474 - DNA, 16 bp, H. sapiens
caactccaccaatacc

SEQ ID NO: 60475 - DNA, 19 bp, H. sapiens
caactccaccaatgaccag

SEQ ID NO: 60476 - DNA, 16 bp, H. sapiens
caactccagcctgggc

SEQ ID NO: 60477 - DNA, 23 bp, H. sapiens
caactccatggaaactgaacaac

SEQ ID NO: 60478 - DNA, 16 bp, H. sapiens
caactcccacttagga

SEQ ID NO: 60479 - DNA, 16 bp, H. sapiens
caactcctgcctccca

SEQ ID NO: 60480 - DNA, 16 bp, H. sapiens
caactcggtgtctgag

SEQ ID NO: 60481 - DNA, 16 bp, H. sapiens
caactctgccattgta

SEQ ID NO: 60482 - DNA, 16 bp, H. sapiens
caactctgtctcaaaa

SEQ ID NO: 60483 - DNA, 16 bp, H. sapiens
caactctttttaaaaa

SEQ ID NO: 60484 - DNA, 16 bp, H. sapiens
caactgaaaatgtctc

SEQ ID NO: 60485 - DNA, 16 bp, H. sapiens
caactgaaatttattt

SEQ ID NO: 60486 - DNA, 16 bp, H. sapiens
caactgaagaactgaa

SEQ ID NO: 60487 - DNA, 16 bp, H. sapiens
caactgaagctgctgg

SEQ ID NO: 60488 - DNA, 16 bp, H. sapiens
caactgactttttttt

SEQ ID NO: 60489 - DNA, 16 bp, H. sapiens
caactgaggtaccagg

SEQ ID NO: 60490 - DNA, 16 bp, H. sapiens
caactgaggtaccctg

SEQ ID NO: 60491 - DNA, 16 bp, H. sapiens
caactgatgagtggat

SEQ ID NO: 60492 - DNA, 16 bp, H. sapiens
caactgcaccccagcc

SEQ ID NO: 60493 - DNA, 16 bp, H. sapiens
caactgccacttatga

SEQ ID NO: 60494 - DNA, 16 bp, H. sapiens
caactggaaaacaaaa

SEQ ID NO: 60495 - DNA, 16 bp, H. sapiens
caactggaactctcat

SEQ ID NO: 60496 - DNA, 16 bp, H. sapiens
caactggggaaggatc

SEQ ID NO: 60497 - DNA, 16 bp, H. sapiens
caactgtaaaataaaa

SEQ ID NO: 60498 - DNA, 16 bp, H. sapiens
caactgtgaggaaaca

SEQ ID NO: 60499 - DNA, 16 bp, H. sapiens
caactgtggctaaaag

SEQ ID NO: 60500 - DNA, 16 bp, H. sapiens
caactgtttttttgtt

SEQ ID NO: 60501 - DNA, 16 bp, H. sapiens
caacttaaaagggatg

SEQ ID NO: 60502 - DNA, 16 bp, H. sapiens
caacttaaaatgttta

SEQ ID NO: 60503 - DNA, 16 bp, H. sapiens
caacttacaaaggatg

SEQ ID NO: 60504 - DNA, 16 bp, H. sapiens
caacttacaagggaca

SEQ ID NO: 60505 - DNA, 16 bp, H. sapiens
caacttacaagggttg

SEQ ID NO: 60506 - DNA, 16 bp, H. sapiens
caacttatacaaaaat

SEQ ID NO: 60507 - DNA, 16 bp, H. sapiens
caacttatttttgttt

SEQ ID NO: 60508 - DNA, 16 bp, H. sapiens
caacttcaccagcatc

SEQ ID NO: 60509 - DNA, 16 bp, H. sapiens
caacttcagaacttgt

SEQ ID NO: 60510 - DNA, 16 bp, H. sapiens
caacttcagagcctgt

SEQ ID NO: 60511 - DNA, 32 bp, H. sapiens
caacttcagcaaagtctcaggatacaaaatca

SEQ ID NO: 60512 - DNA, 16 bp, H. sapiens
caacttcatcaaagtc

SEQ ID NO: 60513 - DNA, 16 bp, H. sapiens
caacttccacctccag

SEQ ID NO: 60514 - DNA, 16 bp, H. sapiens
caacttccacctccca

SEQ ID NO: 60515 - DNA, 16 bp, H. sapiens
caacttccaggggaag

SEQ ID NO: 60516 - DNA, 16 bp, H. sapiens
caacttccccctcctg

SEQ ID NO: 60517 - DNA, 16 bp, H. sapiens
caacttcctgggctca

SEQ ID NO: 60518 - DNA, 16 bp, H. sapiens
caacttctggactcaa

SEQ ID NO: 60519 - DNA, 16 bp, H. sapiens
caacttcttcctgatt

SEQ ID NO: 60520 - DNA, 16 bp, H. sapiens
caacttcttcttcttc

SEQ ID NO: 60521 - DNA, 16 bp, H. sapiens
caacttctttcatcag

SEQ ID NO: 60522 - DNA, 16 bp, H. sapiens
caacttctttttgttt

SEQ ID NO: 60523 - DNA, 16 bp, H. sapiens
caacttgaacccatac

SEQ ID NO: 60524 - DNA, 16 bp, H. sapiens
caacttgctgaaggct

SEQ ID NO: 60525 - DNA, 16 bp, H. sapiens
caacttgctgtgtgac

SEQ ID NO: 60526 - DNA, 16 bp, H. sapiens
caacttgggcaacaaa

SEQ ID NO: 60527 - DNA, 16 bp, H. sapiens
caacttgttttatcag

SEQ ID NO: 60528 - DNA, 16 bp, H. sapiens
caactttattctttct

SEQ ID NO: 60529 - DNA, 16 bp, H. sapiens
caactttgctccaaaa

SEQ ID NO: 60530 - DNA, 16 bp, H. sapiens
caactttgtgtgtgtg

SEQ ID NO: 60531 - DNA, 16 bp, H. sapiens
caacttttaaaatatt

SEQ ID NO: 60532 - DNA, 16 bp, H. sapiens
caacttttattataga

SEQ ID NO: 60533 - DNA, 16 bp, H. sapiens
caacttttcttcattc

SEQ ID NO: 60534 - DNA, 16 bp, H. sapiens
caacttttgtttttgt

SEQ ID NO: 60535 - DNA, 16 bp, H. sapiens
caactttttattttga

SEQ ID NO: 60536 - DNA, 16 bp, H. sapiens
caagaaaaaaatgtta

SEQ ID NO: 60537 - DNA, 16 bp, H. sapiens
caagaaaagccaaaat

SEQ ID NO: 60538 - DNA, 16 bp, H. sapiens
caagaaaataatccca

SEQ ID NO: 60539 - DNA, 16 bp, H. sapiens
caagaaaatgaaatta

SEQ ID NO: 60540 - DNA, 16 bp, H. sapiens
caagaaaatgctgagg

SEQ ID NO: 60541 - DNA, 16 bp, H. sapiens
caagaaaatggggaaa

SEQ ID NO: 60542 - DNA, 16 bp, H. sapiens
caagaaacaacagata

SEQ ID NO: 60543 - DNA, 16 bp, H. sapiens
caagaaacacacttta

SEQ ID NO: 60544 - DNA, 16 bp, H. sapiens
caagaaacacatgaaa

SEQ ID NO: 60545 - DNA, 16 bp, H. sapiens
caagaaaccactttat

SEQ ID NO: 60546 - DNA, 16 bp, H. sapiens
caagaaactcaaagaa

SEQ ID NO: 60547 - DNA, 16 bp, H. sapiens
caagaaactcacctca

SEQ ID NO: 60548 - DNA, 16 bp, H. sapiens
caagaaactgcctttc

SEQ ID NO: 60549 - DNA, 16 bp, H. sapiens
caagaaactggaaaaa

SEQ ID NO: 60550 - DNA, 16 bp, H. sapiens
caagaaagaatgagag

SEQ ID NO: 60551 - DNA, 16 bp, H. sapiens
caagaaagaattcagg

SEQ ID NO: 60552 - DNA, 16 bp, H. sapiens
caagaaagaatttgag

SEQ ID NO: 60553 - DNA, 16 bp, H. sapiens
caagaaagcaagaggg

SEQ ID NO: 60554 - DNA, 16 bp, H. sapiens
caagaaaggaaaatga

SEQ ID NO: 60555 - DNA, 16 bp, H. sapiens
caagaaaggaaatgta

SEQ ID NO: 60556 - DNA, 16 bp, H. sapiens
caagaaataatgaaat

SEQ ID NO: 60557 - DNA, 16 bp, H. sapiens
caagaaataattcagg

SEQ ID NO: 60558 - DNA, 16 bp, H. sapiens
caagaaatacagagaa

SEQ ID NO: 60559 - DNA, 16 bp, H. sapiens
caagaaatacattaaa

SEQ ID NO: 60560 - DNA, 16 bp, H. sapiens
caagaaatagaaaatc

SEQ ID NO: 60561 - DNA, 16 bp, H. sapiens
caagaaatattttatt

SEQ ID NO: 60562 - DNA, 16 bp, H. sapiens
caagaaatcaggagag

SEQ ID NO: 60563 - DNA, 16 bp, H. sapiens
caagaaatcctgaact

SEQ ID NO: 60564 - DNA, 16 bp, H. sapiens
caagaaatcttgcaat

SEQ ID NO: 60565 - DNA, 16 bp, H. sapiens
caagaaatgcagagaa

SEQ ID NO: 60566 - DNA, 16 bp, H. sapiens
caagaaatggaatcaa

SEQ ID NO: 60567 - DNA, 16 bp, H. sapiens
caagaaatggagaaag

SEQ ID NO: 60568 - DNA, 16 bp, H. sapiens
caagaaatggataaat

SEQ ID NO: 60569 - DNA, 16 bp, H. sapiens
caagaaatgttcaaag

SEQ ID NO: 60570 - DNA, 16 bp, H. sapiens
caagaaattagctggg

SEQ ID NO: 60571 - DNA, 16 bp, H. sapiens
caagaacaacctggcc

SEQ ID NO: 60572 - DNA, 16 bp, H. sapiens
caagaacaattttttt

SEQ ID NO: 60573 - DNA, 16 bp, H. sapiens
caagaacacacaatgg

SEQ ID NO: 60574 - DNA, 16 bp, H. sapiens
caagaacacacactgg

SEQ ID NO: 60575 - DNA, 16 bp, H. sapiens
caagaacacacattgg

SEQ ID NO: 60576 - DNA, 16 bp, H. sapiens
caagaacagaatgggg

SEQ ID NO: 60577 - DNA, 16 bp, H. sapiens
caagaacagcaaggga

SEQ ID NO: 60578 - DNA, 16 bp, H. sapiens
caagaacatacaatag

SEQ ID NO: 60579 - DNA, 16 bp, H. sapiens
caagaacatacaatga

SEQ ID NO: 60580 - DNA, 16 bp, H. sapiens
caagaacatccaggaa

SEQ ID NO: 60581 - DNA, 16 bp, H. sapiens
caagaacatcctggcc

SEQ ID NO: 60582 - DNA, 16 bp, H. sapiens
caagaaccaggagcac

SEQ ID NO: 60583 - DNA, 16 bp, H. sapiens
caagaacctggacacc

SEQ ID NO: 60584 - DNA, 16 bp, H. sapiens
caagaacctggacact

SEQ ID NO: 60585 - DNA, 16 bp, H. sapiens
caagaacctggacatc

SEQ ID NO: 60586 - DNA, 16 bp, H. sapiens
caagaactacatgaag

SEQ ID NO: 60587 - DNA, 17 bp, H. sapiens
caagaactacgtgaaga

SEQ ID NO: 60588 - DNA, 16 bp, H. sapiens
caagaactacgtgacg

SEQ ID NO: 60589 - DNA, 16 bp, H. sapiens
caagaactacgtgatg

SEQ ID NO: 60590 - DNA, 16 bp, H. sapiens
caagaactctcattca

SEQ ID NO: 60591 - DNA, 16 bp, H. sapiens
caagaactttcccttt

SEQ ID NO: 60592 - DNA, 16 bp, H. sapiens
caagaacttttctttt

SEQ ID NO: 60593 - DNA, 16 bp, H. sapiens
caagaagaaaaatatg

SEQ ID NO: 60594 - DNA, 16 bp, H. sapiens
caagaagaaaggaatt

SEQ ID NO: 60595 - DNA, 16 bp, H. sapiens
caagaagaaatagata

SEQ ID NO: 60596 - DNA, 16 bp, H. sapiens
caagaagaaatccaaa

SEQ ID NO: 60597 - DNA, 16 bp, H. sapiens
caagaagaaatttaaa

SEQ ID NO: 60598 - DNA, 16 bp, H. sapiens
caagaagaactacaaa

SEQ ID NO: 60599 - DNA, 16 bp, H. sapiens
caagaagaacttgttt

SEQ ID NO: 60600 - DNA, 16 bp, H. sapiens
caagaagaatgaggat

SEQ ID NO: 60601 - DNA, 16 bp, H. sapiens
caagaagaattttaaa

SEQ ID NO: 60602 - DNA, 16 bp, H. sapiens
caagaagacagaaaat

SEQ ID NO: 60603 - DNA, 16 bp, H. sapiens
caagaagagagaaatt

SEQ ID NO: 60604 - DNA, 16 bp, H. sapiens
caagaagagagtgggg

SEQ ID NO: 60605 - DNA, 16 bp, H. sapiens
caagaagagatttggg

SEQ ID NO: 60606 - DNA, 16 bp, H. sapiens
caagaagagcgaaact

SEQ ID NO: 60607 - DNA, 16 bp, H. sapiens
caagaagagctaccta

SEQ ID NO: 60608 - DNA, 16 bp, H. sapiens
caagaagatataacaa

SEQ ID NO: 60609 - DNA, 17 bp, H. sapiens
caagaagattgtttcca

SEQ ID NO: 60610 - DNA, 16 bp, H. sapiens
caagaagcacatgaaa

SEQ ID NO: 60611 - DNA, 16 bp, H. sapiens
caagaagcagaaaaat

SEQ ID NO: 60612 - DNA, 16 bp, H. sapiens
caagaagcagatgctg

SEQ ID NO: 60613 - DNA, 16 bp, H. sapiens
caagaagctcaaagaa

SEQ ID NO: 60614 - DNA, 16 bp, H. sapiens
caagaagctgagcaaa

SEQ ID NO: 60615 - DNA, 16 bp, H. sapiens
caagaagctggaatta

SEQ ID NO: 60616 - DNA, 16 bp, H. sapiens
caagaagctggtggag

SEQ ID NO: 60617 - DNA, 16 bp, H. sapiens
caagaaggaaactcca

SEQ ID NO: 60618 - DNA, 16 bp, H. sapiens
caagaaggaaatgaaa

SEQ ID NO: 60619 - DNA, 16 bp, H. sapiens
caagaaggcaatctca

SEQ ID NO: 60620 - DNA, 16 bp, H. sapiens
caagaaggcccttgcc

SEQ ID NO: 60621 - DNA, 16 bp, H. sapiens
caagaaggcggccatc

SEQ ID NO: 60622 - DNA, 16 bp, H. sapiens
caagaaggttaaaaat

SEQ ID NO: 60623 - DNA, 16 bp, H. sapiens
caagaagtagaaacaa

SEQ ID NO: 60624 - DNA, 16 bp, H. sapiens
caagaagtggaaacaa

SEQ ID NO: 60625 - DNA, 16 bp, H. sapiens
caagaagtgggcaaag

SEQ ID NO: 60626 - DNA, 16 bp, H. sapiens
caagaagtgtgaaaaa

SEQ ID NO: 60627 - DNA, 16 bp, H. sapiens
caagaagttcaacaaa

SEQ ID NO: 60628 - DNA, 16 bp, H. sapiens
caagaagttgcaaaaa

SEQ ID NO: 60629 - DNA, 16 bp, H. sapiens
caagaagttttgcaaa

SEQ ID NO: 60630 - DNA, 16 bp, H. sapiens
caagaagtttttaaaa

SEQ ID NO: 60631 - DNA, 16 bp, H. sapiens
caagaataattatttt

SEQ ID NO: 60632 - DNA, 16 bp, H. sapiens
caagaatacagaaaat

SEQ ID NO: 60633 - DNA, 16 bp, H. sapiens
caagaatattcatagc

SEQ ID NO: 60634 - DNA, 16 bp, H. sapiens
caagaatccaaaagct

SEQ ID NO: 60635 - DNA, 16 bp, H. sapiens
caagaatctacaatga

SEQ ID NO: 60636 - DNA, 16 bp, H. sapiens
caagaatgcaatccta

SEQ ID NO: 60637 - DNA, 16 bp, H. sapiens
caagaatgcaccactg

SEQ ID NO: 60638 - DNA, 16 bp, H. sapiens
caagaatgcagagaaa

SEQ ID NO: 60639 - DNA, 16 bp, H. sapiens
caagaatgtgaagaaa

SEQ ID NO: 60640 - DNA, 16 bp, H. sapiens
caagaatgtggaggaa

SEQ ID NO: 60641 - DNA, 16 bp, H. sapiens
caagaattttccaaaa

SEQ ID NO: 60642 - DNA, 16 bp, H. sapiens
caagaatttttttttt

SEQ ID NO: 60643 - DNA, 16 bp, H. sapiens
caagacaaggacgccc

SEQ ID NO: 60644 - DNA, 16 bp, H. sapiens
caagacaatcttgaaa

SEQ ID NO: 60645 - DNA, 16 bp, H. sapiens
caagacaatgaagaaa

SEQ ID NO: 60646 - DNA, 16 bp, H. sapiens
caagacaatggagaaa

SEQ ID NO: 60647 - DNA, 16 bp, H. sapiens
caagacaattcttcca

SEQ ID NO: 60648 - DNA, 16 bp, H. sapiens
caagacacaaaattgt

SEQ ID NO: 60649 - DNA, 16 bp, H. sapiens
caagacacccagccag

SEQ ID NO: 60650 - DNA, 16 bp, H. sapiens
caagacagaccacatt

SEQ ID NO: 60651 - DNA, 16 bp, H. sapiens
caagacagaggaattg

SEQ ID NO: 60652 - DNA, 16 bp, H. sapiens
caagacagctattttg

SEQ ID NO: 60653 - DNA, 16 bp, H. sapiens
caagacaggccaacat

SEQ ID NO: 60654 - DNA, 16 bp, H. sapiens
caagaccaacatggtg

SEQ ID NO: 60655 - DNA, 16 bp, H. sapiens
caagaccaacctgatc

SEQ ID NO: 60656 - DNA, 16 bp, H. sapiens
caagaccaacctgggc

SEQ ID NO: 60657 - DNA, 16 bp, H. sapiens
caagaccacaccattg

SEQ ID NO: 60658 - DNA, 16 bp, H. sapiens
caagaccagaccagcc

SEQ ID NO: 60659 - DNA, 16 bp, H. sapiens
caagaccagcagaaga

SEQ ID NO: 60660 - DNA, 16 bp, H. sapiens
caagaccagcatgggt

SEQ ID NO: 60661 - DNA, 16 bp, H. sapiens
caagaccagccgggcc

SEQ ID NO: 60662 - DNA, 16 bp, H. sapiens
caagaccagcctgatg

SEQ ID NO: 60663 - DNA, 16 bp, H. sapiens
caagaccagcctggtc

SEQ ID NO: 60664 - DNA, 16 bp, H. sapiens
caagaccagcctggtg

SEQ ID NO: 60665 - DNA, 17 bp, H. sapiens
caagaccagtctgtgca

SEQ ID NO: 60666 - DNA, 16 bp, H. sapiens
caagaccatcaaggtg

SEQ ID NO: 60667 - DNA, 16 bp, H. sapiens
caagaccatccagaaa

SEQ ID NO: 60668 - DNA, 16 bp, H. sapiens
caagaccatcctgccc

SEQ ID NO: 60669 - DNA, 18 bp, H. sapiens
caagaccatcctggctaa

SEQ ID NO: 60670 - DNA, 16 bp, H. sapiens
caagaccatgggaacc

SEQ ID NO: 60671 - DNA, 16 bp, H. sapiens
caagacccagcctggg

SEQ ID NO: 60672 - DNA, 16 bp, H. sapiens
caagaccccagaagca

SEQ ID NO: 60673 - DNA, 16 bp, H. sapiens
caagacccccagggga

SEQ ID NO: 60674 - DNA, 16 bp, H. sapiens
caagacccccgtctct

SEQ ID NO: 60675 - DNA, 16 bp, H. sapiens
caagaccccgtctcag

SEQ ID NO: 60676 - DNA, 16 bp, H. sapiens
caagaccctatttcca

SEQ ID NO: 60677 - DNA, 16 bp, H. sapiens
caagaccctcatctct

SEQ ID NO: 60678 - DNA, 16 bp, H. sapiens
caagaccctgaaaaaa

SEQ ID NO: 60679 - DNA, 16 bp, H. sapiens
caagaccctgcctctg

SEQ ID NO: 60680 - DNA, 16 bp, H. sapiens
caagaccctgcctctt

SEQ ID NO: 60681 - DNA, 16 bp, H. sapiens
caagaccctgtctata

SEQ ID NO: 60682 - DNA, 16 bp, H. sapiens
caagaccctgtctcca

SEQ ID NO: 60683 - DNA, 16 bp, H. sapiens
caagaccctgtctcga

SEQ ID NO: 60684 - DNA, 16 bp, H. sapiens
caagacctcatctcta

SEQ ID NO: 60685 - DNA, 16 bp, H. sapiens
caagacctcatctctt

SEQ ID NO: 60686 - DNA, 16 bp, H. sapiens
caagacctgcctgacc

SEQ ID NO: 60687 - DNA, 16 bp, H. sapiens
caagactaggaagaaa

SEQ ID NO: 60688 - DNA, 16 bp, H. sapiens
caagactctcaaaaaa

SEQ ID NO: 60689 - DNA, 16 bp, H. sapiens
caagactctgccttaa

SEQ ID NO: 60690 - DNA, 16 bp, H. sapiens
caagactctttcaaaa

SEQ ID NO: 60691 - DNA, 20 bp, H. sapiens
caagactgtctcaaaaaaaa

SEQ ID NO: 60692 - DNA, 16 bp, H. sapiens
caagacttcatcttaa

SEQ ID NO: 60693 - DNA, 16 bp, H. sapiens
caagagaaaaatgaag

SEQ ID NO: 60694 - DNA, 16 bp, H. sapiens
caagagaaaaatgact

SEQ ID NO: 60695 - DNA, 16 bp, H. sapiens
caagagaaaataagca

SEQ ID NO: 60696 - DNA, 16 bp, H. sapiens
caagagaaactaccat

SEQ ID NO: 60697 - DNA, 16 bp, H. sapiens
caagagaaagcagagc

SEQ ID NO: 60698 - DNA, 16 bp, H. sapiens
caagagaaatgaaaat

SEQ ID NO: 60699 - DNA, 16 bp, H. sapiens
caagagaaatgagaac

SEQ ID NO: 60700 - DNA, 16 bp, H. sapiens
caagagaactgaaaat

SEQ ID NO: 60701 - DNA, 16 bp, H. sapiens
caagagaagcaagagc

SEQ ID NO: 60702 - DNA, 16 bp, H. sapiens
caagagaatgaaataa

SEQ ID NO: 60703 - DNA, 16 bp, H. sapiens
caagagaattaaggag

SEQ ID NO: 60704 - DNA, 16 bp, H. sapiens
caagagacacatctca

SEQ ID NO: 60705 - DNA, 16 bp, H. sapiens
caagagaccctgtctc

SEQ ID NO: 60706 - DNA, 16 bp, H. sapiens
caagagactcacttca

SEQ ID NO: 60707 - DNA, 16 bp, H. sapiens
caagagactgaaggca

SEQ ID NO: 60708 - DNA, 16 bp, H. sapiens
caagagagaaattctg

SEQ ID NO: 60709 - DNA, 16 bp, H. sapiens
caagagagaatgagag

SEQ ID NO: 60710 - DNA, 16 bp, H. sapiens
caagagagagaggtgg

SEQ ID NO: 60711 - DNA, 16 bp, H. sapiens
caagagagatgaaaac

SEQ ID NO: 60712 - DNA, 16 bp, H. sapiens
caagagagcaagaccc

SEQ ID NO: 60713 - DNA, 16 bp, H. sapiens
caagagatggagacaa

SEQ ID NO: 60714 - DNA, 16 bp, H. sapiens
caagagatgggctccc

SEQ ID NO: 60715 - DNA, 16 bp, H. sapiens
caagagattctcctgt

SEQ ID NO: 60716 - DNA, 16 bp, H. sapiens
caagagcaagagagag

SEQ ID NO: 60717 - DNA, 16 bp, H. sapiens
caagagcaggagcaag

SEQ ID NO: 60718 - DNA, 16 bp, H. sapiens
caagagcatcctggct

SEQ ID NO: 60719 - DNA, 16 bp, H. sapiens
caagagccaagtcctg

SEQ ID NO: 60720 - DNA, 16 bp, H. sapiens
caagaggaaaatatca

SEQ ID NO: 60721 - DNA, 16 bp, H. sapiens
caagaggattgcctga

SEQ ID NO: 60722 - DNA, 16 bp, H. sapiens
caagaggcagagccag

SEQ ID NO: 60723 - DNA, 16 bp, H. sapiens
caagaggcagaggtgg

SEQ ID NO: 60724 - DNA, 16 bp, H. sapiens
caagaggcccagcttt

SEQ ID NO: 60725 - DNA, 16 bp, H. sapiens
caagaggctgaggaag

SEQ ID NO: 60726 - DNA, 16 bp, H. sapiens
caagaggtagaagcaa

SEQ ID NO: 60727 - DNA, 16 bp, H. sapiens
caagaggtcaaggctg

SEQ ID NO: 60728 - DNA, 16 bp, H. sapiens
caagaggtctagcttt

SEQ ID NO: 60729 - DNA, 16 bp, H. sapiens
caagaggtggaggagc

SEQ ID NO: 60730 - DNA, 16 bp, H. sapiens
caagagtcaactgtat

SEQ ID NO: 60731 - DNA, 16 bp, H. sapiens
caagagtccatctcaa

SEQ ID NO: 60732 - DNA, 16 bp, H. sapiens
caagagtgacctttat

SEQ ID NO: 60733 - DNA, 16 bp, H. sapiens
caagagtgagactctg

SEQ ID NO: 60734 - DNA, 16 bp, H. sapiens
caagagtgagatcctg

SEQ ID NO: 60735 - DNA, 16 bp, H. sapiens
caagagtgcagtggtg

SEQ ID NO: 60736 - DNA, 16 bp, H. sapiens
caagagtggaagcaga

SEQ ID NO: 60737 - DNA, 16 bp, H. sapiens
caagagttcaggacca

SEQ ID NO: 60738 - DNA, 16 bp, H. sapiens
caagataaatttattt

SEQ ID NO: 60739 - DNA, 16 bp, H. sapiens
caagataattcaatgg

SEQ ID NO: 60740 - DNA, 16 bp, H. sapiens
caagataatttataga

SEQ ID NO: 60741 - DNA, 16 bp, H. sapiens
caagatacaaaattaa

SEQ ID NO: 60742 - DNA, 16 bp, H. sapiens
caagatacaatggagg

SEQ ID NO: 60743 - DNA, 16 bp, H. sapiens
caagatagagaacatt

SEQ ID NO: 60744 - DNA, 16 bp, H. sapiens
caagatatggaaacag

SEQ ID NO: 60745 - DNA, 16 bp, H. sapiens
caagatatttttcaga

SEQ ID NO: 60746 - DNA, 16 bp, H. sapiens
caagatcaaatccaca

SEQ ID NO: 60747 - DNA, 16 bp, H. sapiens
caagatcaaggtgtct

SEQ ID NO: 60748 - DNA, 16 bp, H. sapiens
caagatcacacagctg

SEQ ID NO: 60749 - DNA, 16 bp, H. sapiens
caagatcacaccagtg

SEQ ID NO: 60750 - DNA, 16 bp, H. sapiens
caagatcaggagtttg

SEQ ID NO: 60751 - DNA, 16 bp, H. sapiens
caagatcatcctggct

SEQ ID NO: 60752 - DNA, 16 bp, H. sapiens
caagatcatgaaagac

SEQ ID NO: 60753 - DNA, 16 bp, H. sapiens
caagatcccatctctt

SEQ ID NO: 60754 - DNA, 16 bp, H. sapiens
caagatcctgcctcta

SEQ ID NO: 60755 - DNA, 16 bp, H. sapiens
caagatcgcaccaatg

SEQ ID NO: 60756 - DNA, 16 bp, H. sapiens
caagatctggaagcaa

SEQ ID NO: 60757 - DNA, 16 bp, H. sapiens
caagatctggtcattt

SEQ ID NO: 60758 - DNA, 16 bp, H. sapiens
caagatcttggctcat

SEQ ID NO: 60759 - DNA, 16 bp, H. sapiens
caagatgaaaagaatt

SEQ ID NO: 60760 - DNA, 16 bp, H. sapiens
caagatgaagaaaata

SEQ ID NO: 60761 - DNA, 16 bp, H. sapiens
caagatgaagagagtt

SEQ ID NO: 60762 - DNA, 16 bp, H. sapiens
caagatgagatatggg

SEQ ID NO: 60763 - DNA, 16 bp, H. sapiens
caagatgagatctggg

SEQ ID NO: 60764 - DNA, 16 bp, H. sapiens
caagatgatctccttt

SEQ ID NO: 60765 - DNA, 16 bp, H. sapiens
caagatgccagcagat

SEQ ID NO: 60766 - DNA, 16 bp, H. sapiens
caagatgccatctcaa

SEQ ID NO: 60767 - DNA, 16 bp, H. sapiens
caagatgcccagttaa

SEQ ID NO: 60768 - DNA, 16 bp, H. sapiens
caagatggccaaatag

SEQ ID NO: 60769 - DNA, 16 bp, H. sapiens
caagatggccaagtag

SEQ ID NO: 60770 - DNA, 16 bp, H. sapiens
caagatggccgaatag

SEQ ID NO: 60771 - DNA, 16 bp, H. sapiens
caagatggctgcagca

SEQ ID NO: 60772 - DNA, 16 bp, H. sapiens
caagatgggaggattg

SEQ ID NO: 60773 - DNA, 17 bp, H. sapiens
caagatggtgaaactcc

SEQ ID NO: 60774 - DNA, 16 bp, H. sapiens
caagatggtgatgaaa

SEQ ID NO: 60775 - DNA, 16 bp, H. sapiens
caagatgtcagctggg

SEQ ID NO: 60776 - DNA, 16 bp, H. sapiens
caagatgtccttcagt

SEQ ID NO: 60777 - DNA, 16 bp, H. sapiens
caagatgtggagatgg

SEQ ID NO: 60778 - DNA, 16 bp, H. sapiens
caagattaaccaaaaa

SEQ ID NO: 60779 - DNA, 16 bp, H. sapiens
caagattcaaacccag

SEQ ID NO: 60780 - DNA, 16 bp, H. sapiens
caagattcaaattcag

SEQ ID NO: 60781 - DNA, 16 bp, H. sapiens
caagattcaattatct

SEQ ID NO: 60782 - DNA, 16 bp, H. sapiens
caagattgaaccagaa

SEQ ID NO: 60783 - DNA, 16 bp, H. sapiens
caagattgggcagctg

SEQ ID NO: 60784 - DNA, 16 bp, H. sapiens
caagattgtgccagtg

SEQ ID NO: 60785 - DNA, 16 bp, H. sapiens
caagattgtgctgctg

SEQ ID NO: 60786 - DNA, 16 bp, H. sapiens
caagatttcaagacca

SEQ ID NO: 60787 - DNA, 16 bp, H. sapiens
caagatttcatttttt

SEQ ID NO: 60788 - DNA, 16 bp, H. sapiens
caagatttgaacccag

SEQ ID NO: 60789 - DNA, 16 bp, H. sapiens
caagatttgggaagtt

SEQ ID NO: 60790 - DNA, 16 bp, H. sapiens
caagattttgttcttt

SEQ ID NO: 60791 - DNA, 16 bp, H. sapiens
caagatttttagcttc

SEQ ID NO: 60792 - DNA, 16 bp, H. sapiens
caagattttttctttg

SEQ ID NO: 60793 - DNA, 16 bp, H. sapiens
caagcaaaaaacaatc

SEQ ID NO: 60794 - DNA, 17 bp, H. sapiens
caagcaaatggaaaaca

SEQ ID NO: 60795 - DNA, 16 bp, H. sapiens
caagcaaatggaaagc

SEQ ID NO: 60796 - DNA, 16 bp, H. sapiens
caagcaacagggaaag

SEQ ID NO: 60797 - DNA, 16 bp, H. sapiens
caagcaacttcagcaa

SEQ ID NO: 60798 - DNA, 16 bp, H. sapiens
caagcaacttgcccaa

SEQ ID NO: 60799 - DNA, 16 bp, H. sapiens
caagcaacttggaaaa

SEQ ID NO: 60800 - DNA, 16 bp, H. sapiens
caagcaagactctgtc

SEQ ID NO: 60801 - DNA, 16 bp, H. sapiens
caagcaagtaataaag

SEQ ID NO: 60802 - DNA, 16 bp, H. sapiens
caagcaatcttccttc

SEQ ID NO: 60803 - DNA, 19 bp, H. sapiens
caagcaatggcaacaaaag

SEQ ID NO: 60804 - DNA, 16 bp, H. sapiens
caagcaattctcctga

SEQ ID NO: 60805 - DNA, 16 bp, H. sapiens
caagcacaagccacca

SEQ ID NO: 60806 - DNA, 16 bp, H. sapiens
caagcacacacacatg

SEQ ID NO: 60807 - DNA, 16 bp, H. sapiens
caagcacacacagaac

SEQ ID NO: 60808 - DNA, 16 bp, H. sapiens
caagcacacacatgca

SEQ ID NO: 60809 - DNA, 16 bp, H. sapiens
caagcacaggagcttc

SEQ ID NO: 60810 - DNA, 16 bp, H. sapiens
caagcacctgccacca

SEQ ID NO: 60811 - DNA, 16 bp, H. sapiens
caagcactgcaatacc

SEQ ID NO: 60812 - DNA, 16 bp, H. sapiens
caagcactgcatgttc

SEQ ID NO: 60813 - DNA, 16 bp, H. sapiens
caagcactgtgctgag

SEQ ID NO: 60814 - DNA, 16 bp, H. sapiens
caagcacttgccacca

SEQ ID NO: 60815 - DNA, 16 bp, H. sapiens
caagcagaaggagttt

SEQ ID NO: 60816 - DNA, 16 bp, H. sapiens
caagcagagagagaga

SEQ ID NO: 60817 - DNA, 16 bp, H. sapiens
caagcagagggagctg

SEQ ID NO: 60818 - DNA, 16 bp, H. sapiens
caagcagcaggaccta

SEQ ID NO: 60819 - DNA, 16 bp, H. sapiens
caagcagccaatattt

SEQ ID NO: 60820 - DNA, 16 bp, H. sapiens
caagcaggaaaacagg

SEQ ID NO: 60821 - DNA, 16 bp, H. sapiens
caagcaggagccctgc

SEQ ID NO: 60822 - DNA, 16 bp, H. sapiens
caagcaggagtgcaat

SEQ ID NO: 60823 - DNA, 16 bp, H. sapiens
caagcaggcaggcagg

SEQ ID NO: 60824 - DNA, 16 bp, H. sapiens
caagcaggtgggcagg

SEQ ID NO: 60825 - DNA, 16 bp, H. sapiens
caagcagtccttccat

SEQ ID NO: 60826 - DNA, 16 bp, H. sapiens
caagcagttcttttca

SEQ ID NO: 60827 - DNA, 16 bp, H. sapiens
caagcagttgggacta

SEQ ID NO: 60828 - DNA, 16 bp, H. sapiens
caagcataattgttaa

SEQ ID NO: 60829 - DNA, 16 bp, H. sapiens
caagcatcaacaccat

SEQ ID NO: 60830 - DNA, 16 bp, H. sapiens
caagcatctcaacaac

SEQ ID NO: 60831 - DNA, 16 bp, H. sapiens
caagcatcttctctgg

SEQ ID NO: 60832 - DNA, 16 bp, H. sapiens
caagcatggcaccagc

SEQ ID NO: 60833 - DNA, 16 bp, H. sapiens
caagcatgtggagaaa

SEQ ID NO: 60834 - DNA, 16 bp, H. sapiens
caagcatttactgagc

SEQ ID NO: 60835 - DNA, 16 bp, H. sapiens
caagcatttatacttt

SEQ ID NO: 60836 - DNA, 16 bp, H. sapiens
caagcattttagataa

SEQ ID NO: 60837 - DNA, 16 bp, H. sapiens
caagcattttggataa

SEQ ID NO: 60838 - DNA, 16 bp, H. sapiens
caagccaagatcatgc

SEQ ID NO: 60839 - DNA, 16 bp, H. sapiens
caagccaaggaaagcc

SEQ ID NO: 60840 - DNA, 16 bp, H. sapiens
caagccaagtcccttc

SEQ ID NO: 60841 - DNA, 16 bp, H. sapiens
caagccacagagagag

SEQ ID NO: 60842 - DNA, 16 bp, H. sapiens
caagccaccaatgact

SEQ ID NO: 60843 - DNA, 16 bp, H. sapiens
caagccacccaagcca

SEQ ID NO: 60844 - DNA, 16 bp, H. sapiens
caagccaccctcctgc

SEQ ID NO: 60845 - DNA, 16 bp, H. sapiens
caagccactagcccac

SEQ ID NO: 60846 - DNA, 16 bp, H. sapiens
caagccagcagcagca

SEQ ID NO: 60847 - DNA, 16 bp, H. sapiens
caagccagcctggcca

SEQ ID NO: 60848 - DNA, 16 bp, H. sapiens
caagccaggcacagtg

SEQ ID NO: 60849 - DNA, 16 bp, H. sapiens
caagccaggcagatca

SEQ ID NO: 60850 - DNA, 23 bp, H. sapiens
caagccatcacagctgatatctc

SEQ ID NO: 60851 - DNA, 16 bp, H. sapiens
caagccatcctctggc

SEQ ID NO: 60852 - DNA, 16 bp, H. sapiens
caagccatctgcccat

SEQ ID NO: 60853 - DNA, 16 bp, H. sapiens
caagccatctgcctgc

SEQ ID NO: 60854 - DNA, 16 bp, H. sapiens
caagccattcatgaag

SEQ ID NO: 60855 - DNA, 16 bp, H. sapiens
caagccattctccagc

SEQ ID NO: 60856 - DNA, 16 bp, H. sapiens
caagcccagcctgagc

SEQ ID NO: 60857 - DNA, 16 bp, H. sapiens
caagccctgcctcctg

SEQ ID NO: 60858 - DNA, 16 bp, H. sapiens
caagccctgcctctgg

SEQ ID NO: 60859 - DNA, 16 bp, H. sapiens
caagcctactctggac

SEQ ID NO: 60860 - DNA, 16 bp, H. sapiens
caagcctaggcaacaa

SEQ ID NO: 60861 - DNA, 16 bp, H. sapiens
caagcctcaagccttg

SEQ ID NO: 60862 - DNA, 16 bp, H. sapiens
caagcctcaattcttg

SEQ ID NO: 60863 - DNA, 16 bp, H. sapiens
caagcctcagcctccc

SEQ ID NO: 60864 - DNA, 16 bp, H. sapiens
caagcctctggtcaca

SEQ ID NO: 60865 - DNA, 16 bp, H. sapiens
caagcctgctgcagaa

SEQ ID NO: 60866 - DNA, 16 bp, H. sapiens
caagcctgggcaaaaa

SEQ ID NO: 60867 - DNA, 16 bp, H. sapiens
caagcctgggccacag

SEQ ID NO: 60868 - DNA, 16 bp, H. sapiens
caagcctttaatccca

SEQ ID NO: 60869 - DNA, 16 bp, H. sapiens
caagcgagtctcctgt

SEQ ID NO: 60870 - DNA, 16 bp, H. sapiens
caagcgattcacccac

SEQ ID NO: 60871 - DNA, 16 bp, H. sapiens
caagcgcagtggctca

SEQ ID NO: 60872 - DNA, 16 bp, H. sapiens
caagcgccaccacgcc

SEQ ID NO: 60873 - DNA, 16 bp, H. sapiens
caagcgtgagccaccg

SEQ ID NO: 60874 - DNA, 16 bp, H. sapiens
caagcgtgagccactg

SEQ ID NO: 60875 - DNA, 16 bp, H. sapiens
caagctaaggaaagaa

SEQ ID NO: 60876 - DNA, 16 bp, H. sapiens
caagctagaaggaatt

SEQ ID NO: 60877 - DNA, 16 bp, H. sapiens
caagctagataaagaa

SEQ ID NO: 60878 - DNA, 16 bp, H. sapiens
caagctcagcctcctg

SEQ ID NO: 60879 - DNA, 16 bp, H. sapiens
caagctccaccttcca

SEQ ID NO: 60880 - DNA, 16 bp, H. sapiens
caagctccagcatccc

SEQ ID NO: 60881 - DNA, 16 bp, H. sapiens
caagctccagtgtccc

SEQ ID NO: 60882 - DNA, 18 bp, H. sapiens
caagctccgcctcctgga

SEQ ID NO: 60883 - DNA, 16 bp, H. sapiens
caagctccgccttctg

SEQ ID NO: 60884 - DNA, 16 bp, H. sapiens
caagctcctgagctca

SEQ ID NO: 60885 - DNA, 16 bp, H. sapiens
caagctcctggcctca

SEQ ID NO: 60886 - DNA, 16 bp, H. sapiens
caagctctgcctcacg

SEQ ID NO: 60887 - DNA, 16 bp, H. sapiens
caagctctgcctcctt

SEQ ID NO: 60888 - DNA, 16 bp, H. sapiens
caagctctgcctgcca

SEQ ID NO: 60889 - DNA, 16 bp, H. sapiens
caagctctgtgctggg

SEQ ID NO: 60890 - DNA, 16 bp, H. sapiens
caagctctttctcatg

SEQ ID NO: 60891 - DNA, 16 bp, H. sapiens
caagctctttgctaag

SEQ ID NO: 60892 - DNA, 16 bp, H. sapiens
caagctgaaatgcagt

SEQ ID NO: 60893 - DNA, 16 bp, H. sapiens
caagctgagaaacaaa

SEQ ID NO: 60894 - DNA, 16 bp, H. sapiens
caagctgaggagcagg

SEQ ID NO: 60895 - DNA, 16 bp, H. sapiens
caagctgctcaatcaa

SEQ ID NO: 60896 - DNA, 16 bp, H. sapiens
caagctgctgctgctg

SEQ ID NO: 60897 - DNA, 16 bp, H. sapiens
caagctgctggtggat

SEQ ID NO: 60898 - DNA, 16 bp, H. sapiens
caagctggagaaccag

SEQ ID NO: 60899 - DNA, 16 bp, H. sapiens
caagctggagaatcag

SEQ ID NO: 60900 - DNA, 16 bp, H. sapiens
caagctggagacacag

SEQ ID NO: 60901 - DNA, 16 bp, H. sapiens
caagctggagaccctg

SEQ ID NO: 60902 - DNA, 16 bp, H. sapiens
caagctggaggcccag

SEQ ID NO: 60903 - DNA, 16 bp, H. sapiens
caagctggagtgcagg

SEQ ID NO: 60904 - DNA, 16 bp, H. sapiens
caagctggccttgaac

SEQ ID NO: 60905 - DNA, 16 bp, H. sapiens
caagctggcttctgtg

SEQ ID NO: 60906 - DNA, 16 bp, H. sapiens
caagctggttttgaac

SEQ ID NO: 60907 - DNA, 16 bp, H. sapiens
caagctgtacaagaag

SEQ ID NO: 60908 - DNA, 16 bp, H. sapiens
caagctgtggtgggct

SEQ ID NO: 60909 - DNA, 16 bp, H. sapiens
caagcttaacttttcc

SEQ ID NO: 60910 - DNA, 16 bp, H. sapiens
caagcttcagtttcct

SEQ ID NO: 60911 - DNA, 16 bp, H. sapiens
caagcttgtccaaccc

SEQ ID NO: 60912 - DNA, 16 bp, H. sapiens
caagcttgtccaactc

SEQ ID NO: 60913 - DNA, 16 bp, H. sapiens
caagcttgtcttgaac

SEQ ID NO: 60914 - DNA, 16 bp, H. sapiens
caagctttggcagctt

SEQ ID NO: 60915 - DNA, 16 bp, H. sapiens
caaggaaaaaatgtta

SEQ ID NO: 60916 - DNA, 16 bp, H. sapiens
caaggaaaactacaaa

SEQ ID NO: 60917 - DNA, 16 bp, H. sapiens
caaggaaaatctgaga

SEQ ID NO: 60918 - DNA, 16 bp, H. sapiens
caaggaaaatgaaaac

SEQ ID NO: 60919 - DNA, 16 bp, H. sapiens
caaggaaaatgaagaa

SEQ ID NO: 60920 - DNA, 16 bp, H. sapiens
caaggaaacaaaggct

SEQ ID NO: 60921 - DNA, 16 bp, H. sapiens
caaggaaaccatggag

SEQ ID NO: 60922 - DNA, 17 bp, H. sapiens
caaggaaactgaggccc

SEQ ID NO: 60923 - DNA, 16 bp, H. sapiens
caaggaaaggaaataa

SEQ ID NO: 60924 - DNA, 16 bp, H. sapiens
caaggaaagtctgaaa

SEQ ID NO: 60925 - DNA, 16 bp, H. sapiens
caaggaaataaaaatt

SEQ ID NO: 60926 - DNA, 16 bp, H. sapiens
caaggaaataacttct

SEQ ID NO: 60927 - DNA, 16 bp, H. sapiens
caaggaaatagaaaat

SEQ ID NO: 60928 - DNA, 16 bp, H. sapiens
caaggaaatatatttt

SEQ ID NO: 60929 - DNA, 16 bp, H. sapiens
caaggaaatcatggag

SEQ ID NO: 60930 - DNA, 16 bp, H. sapiens
caaggaacaccaagaa

SEQ ID NO: 60931 - DNA, 16 bp, H. sapiens
caaggaacagcaagga

SEQ ID NO: 60932 - DNA, 16 bp, H. sapiens
caaggaactagagaag

SEQ ID NO: 60933 - DNA, 16 bp, H. sapiens
caaggaagctaagaat

SEQ ID NO: 60934 - DNA, 16 bp, H. sapiens
caaggaaggcttcctg

SEQ ID NO: 60935 - DNA, 16 bp, H. sapiens
caaggaagtgaaaaat

SEQ ID NO: 60936 - DNA, 16 bp, H. sapiens
caaggaataattttga

SEQ ID NO: 60937 - DNA, 16 bp, H. sapiens
caaggaatgcctggag

SEQ ID NO: 60938 - DNA, 16 bp, H. sapiens
caaggaatggaatctt

SEQ ID NO: 60939 - DNA, 16 bp, H. sapiens
caaggaatgtggacag

SEQ ID NO: 60940 - DNA, 16 bp, H. sapiens
caaggaatgtgggcag

SEQ ID NO: 60941 - DNA, 16 bp, H. sapiens
caaggaatttttttaa

SEQ ID NO: 60942 - DNA, 16 bp, H. sapiens
caaggacaacggcctc

SEQ ID NO: 60943 - DNA, 17 bp, H. sapiens
caaggacaagccatagt

SEQ ID NO: 60944 - DNA, 16 bp, H. sapiens
caaggacacagagaag

SEQ ID NO: 60945 - DNA, 16 bp, H. sapiens
caaggacaggagaaga

SEQ ID NO: 60946 - DNA, 16 bp, H. sapiens
caaggaccctcacaga

SEQ ID NO: 60947 - DNA, 16 bp, H. sapiens
caaggactctcacaga

SEQ ID NO: 60948 - DNA, 16 bp, H. sapiens
caaggactgcaattcc

SEQ ID NO: 60949 - DNA, 16 bp, H. sapiens
caaggacttcaggtct

SEQ ID NO: 60950 - DNA, 16 bp, H. sapiens
caaggacttccagtac

SEQ ID NO: 60951 - DNA, 16 bp, H. sapiens
caaggacttcctgtct

SEQ ID NO: 60952 - DNA, 16 bp, H. sapiens
caaggacttcgtgact

SEQ ID NO: 60953 - DNA, 16 bp, H. sapiens
caaggagaactataaa

SEQ ID NO: 60954 - DNA, 16 bp, H. sapiens
caaggagaactatgaa

SEQ ID NO: 60955 - DNA, 16 bp, H. sapiens
caaggagaactgcaaa

SEQ ID NO: 60956 - DNA, 16 bp, H. sapiens
caaggagaaggaattt

SEQ ID NO: 60957 - DNA, 16 bp, H. sapiens
caaggagaattacaaa

SEQ ID NO: 60958 - DNA, 16 bp, H. sapiens
caaggagacctacaaa

SEQ ID NO: 60959 - DNA, 16 bp, H. sapiens
caaggagagaaaacca

SEQ ID NO: 60960 - DNA, 16 bp, H. sapiens
caaggagatctacaaa

SEQ ID NO: 60961 - DNA, 16 bp, H. sapiens
caaggagatggatttg

SEQ ID NO: 60962 - DNA, 16 bp, H. sapiens
caaggaggaactggca

SEQ ID NO: 60963 - DNA, 16 bp, H. sapiens
caaggaggagaaagat

SEQ ID NO: 60964 - DNA, 16 bp, H. sapiens
caaggaggagcaggtc

SEQ ID NO: 60965 - DNA, 16 bp, H. sapiens
caaggaggagctggtg

SEQ ID NO: 60966 - DNA, 16 bp, H. sapiens
caaggaggcaggagag

SEQ ID NO: 60967 - DNA, 16 bp, H. sapiens
caaggaggccagcctg

SEQ ID NO: 60968 - DNA, 16 bp, H. sapiens
caaggaggccagtatg

SEQ ID NO: 60969 - DNA, 16 bp, H. sapiens
caaggaggcctgactg

SEQ ID NO: 60970 - DNA, 16 bp, H. sapiens
caaggaggcctgccag

SEQ ID NO: 60971 - DNA, 16 bp, H. sapiens
caaggaggcctgcctg

SEQ ID NO: 60972 - DNA, 16 bp, H. sapiens
caaggagggggtcatg

SEQ ID NO: 60973 - DNA, 16 bp, H. sapiens
caaggaggtgacacct

SEQ ID NO: 60974 - DNA, 16 bp, H. sapiens
caaggaggtggaggct

SEQ ID NO: 60975 - DNA, 16 bp, H. sapiens
caaggagttaatatcc

SEQ ID NO: 60976 - DNA, 16 bp, H. sapiens
caaggagttcaaggct

SEQ ID NO: 60977 - DNA, 16 bp, H. sapiens
caaggagttggagacc

SEQ ID NO: 60978 - DNA, 16 bp, H. sapiens
caaggagtttacagtc

SEQ ID NO: 60979 - DNA, 16 bp, H. sapiens
caaggataaagaaaag

SEQ ID NO: 60980 - DNA, 16 bp, H. sapiens
caaggataactacaaa

SEQ ID NO: 60981 - DNA, 16 bp, H. sapiens
caaggatacacaggaa

SEQ ID NO: 60982 - DNA, 16 bp, H. sapiens
caaggatatccaagaa

SEQ ID NO: 60983 - DNA, 16 bp, H. sapiens
caaggatatgaacaga

SEQ ID NO: 60984 - DNA, 16 bp, H. sapiens
caaggatcacttgagc

SEQ ID NO: 60985 - DNA, 16 bp, H. sapiens
caaggatgcagagaaa

SEQ ID NO: 60986 - DNA, 16 bp, H. sapiens
caaggatggaaaacca

SEQ ID NO: 60987 - DNA, 16 bp, H. sapiens
caaggatggggaaaaa

SEQ ID NO: 60988 - DNA, 16 bp, H. sapiens
caaggatggttcaaca

SEQ ID NO: 60989 - DNA, 16 bp, H. sapiens
caaggatgtccactct

SEQ ID NO: 60990 - DNA, 16 bp, H. sapiens
caaggatgtgaaacaa

SEQ ID NO: 60991 - DNA, 16 bp, H. sapiens
caaggatgtgaagaaa

SEQ ID NO: 60992 - DNA, 16 bp, H. sapiens
caaggcaaagcagctt

SEQ ID NO: 60993 - DNA, 16 bp, H. sapiens
caaggcaagacccttc

SEQ ID NO: 60994 - DNA, 16 bp, H. sapiens
caaggcaagaggatcg

SEQ ID NO: 60995 - DNA, 16 bp, H. sapiens
caaggcaagtcccttc

SEQ ID NO: 60996 - DNA, 16 bp, H. sapiens
caaggcaagtcccttt

SEQ ID NO: 60997 - DNA, 16 bp, H. sapiens
caaggcaatcctaagc

SEQ ID NO: 60998 - DNA, 16 bp, H. sapiens
caaggcaatggggaaa

SEQ ID NO: 60999 - DNA, 16 bp, H. sapiens
caaggcaatgtacttc

SEQ ID NO: 61000 - DNA, 16 bp, H. sapiens
caaggcagaaaatcaa

SEQ ID NO: 61001 - DNA, 37 bp, H. sapiens
caaggcagaagaatttttcttagtacagaacaaaatg

SEQ ID NO: 61002 - DNA, 16 bp, H. sapiens
caaggcagaagccaca

SEQ ID NO: 61003 - DNA, 16 bp, H. sapiens
caaggcaggaagatgg

SEQ ID NO: 61004 - DNA, 16 bp, H. sapiens
caaggcaggaggactg

SEQ ID NO: 61005 - DNA, 16 bp, H. sapiens
caaggcaggcacatca

SEQ ID NO: 61006 - DNA, 16 bp, H. sapiens
caaggcaggcatcccc

SEQ ID NO: 61007 - DNA, 16 bp, H. sapiens
caaggcagggccagag

SEQ ID NO: 61008 - DNA, 16 bp, H. sapiens
caaggcagggccaggg

SEQ ID NO: 61009 - DNA, 16 bp, H. sapiens
caaggcaggtgaatca

SEQ ID NO: 61010 - DNA, 23 bp, H. sapiens
caaggcaggtggatcacttgagg

SEQ ID NO: 61011 - DNA, 16 bp, H. sapiens
caaggccaaaggcctg

SEQ ID NO: 61012 - DNA, 16 bp, H. sapiens
caaggccagagtgcag

SEQ ID NO: 61013 - DNA, 16 bp, H. sapiens
caaggccaggagttca

SEQ ID NO: 61014 - DNA, 17 bp, H. sapiens
caaggccaggtgtggtg

SEQ ID NO: 61015 - DNA, 16 bp, H. sapiens
caaggccatcaagcta

SEQ ID NO: 61016 - DNA, 16 bp, H. sapiens
caaggccatgggagtc

SEQ ID NO: 61017 - DNA, 16 bp, H. sapiens
caaggccccacctcca

SEQ ID NO: 61018 - DNA, 16 bp, H. sapiens
caaggccctgtctcta

SEQ ID NO: 61019 - DNA, 16 bp, H. sapiens
caaggcctatgtccag

SEQ ID NO: 61020 - DNA, 16 bp, H. sapiens
caaggccttgggcatc

SEQ ID NO: 61021 - DNA, 16 bp, H. sapiens
caaggcgagcagatca

SEQ ID NO: 61022 - DNA, 16 bp, H. sapiens
caaggctacagtaagc

SEQ ID NO: 61023 - DNA, 16 bp, H. sapiens
caaggctactatgaat

SEQ ID NO: 61024 - DNA, 16 bp, H. sapiens
caaggctatggtgagc

SEQ ID NO: 61025 - DNA, 16 bp, H. sapiens
caaggctcagctcagg

SEQ ID NO: 61026 - DNA, 16 bp, H. sapiens
caaggctctcagctct

SEQ ID NO: 61027 - DNA, 16 bp, H. sapiens
caaggctctgagaagg

SEQ ID NO: 61028 - DNA, 16 bp, H. sapiens
caaggctctgggagga

SEQ ID NO: 61029 - DNA, 16 bp, H. sapiens
caaggctcttcaacac

SEQ ID NO: 61030 - DNA, 16 bp, H. sapiens
caaggctgaggcagga

SEQ ID NO: 61031 - DNA, 16 bp, H. sapiens
caaggctgcaatgggc

SEQ ID NO: 61032 - DNA, 16 bp, H. sapiens
caaggctgcagagagc

SEQ ID NO: 61033 - DNA, 16 bp, H. sapiens
caaggctgcagtgagc

SEQ ID NO: 61034 - DNA, 16 bp, H. sapiens
caaggctgcagtgagt

SEQ ID NO: 61035 - DNA, 16 bp, H. sapiens
caaggctgcagtgggc

SEQ ID NO: 61036 - DNA, 16 bp, H. sapiens
caaggctggagagcag

SEQ ID NO: 61037 - DNA, 16 bp, H. sapiens
caaggctggagtgcag

SEQ ID NO: 61038 - DNA, 16 bp, H. sapiens
caaggctggatcaaca

SEQ ID NO: 61039 - DNA, 16 bp, H. sapiens
caaggctgggaagaaa

SEQ ID NO: 61040 - DNA, 16 bp, H. sapiens
caaggctggtgaatca

SEQ ID NO: 61041 - DNA, 16 bp, H. sapiens
caaggctggtttcttc

SEQ ID NO: 61042 - DNA, 16 bp, H. sapiens
caaggctgtgcagggc

SEQ ID NO: 61043 - DNA, 16 bp, H. sapiens
caaggctgtggctgga

SEQ ID NO: 61044 - DNA, 16 bp, H. sapiens
caaggctgtgtgtgtg

SEQ ID NO: 61045 - DNA, 16 bp, H. sapiens
caaggcttgggtcttg

SEQ ID NO: 61046 - DNA, 16 bp, H. sapiens
caagggaaagacctgc

SEQ ID NO: 61047 - DNA, 16 bp, H. sapiens
caagggaaatgaaatc

SEQ ID NO: 61048 - DNA, 18 bp, H. sapiens
caagggaacaaaactgga

SEQ ID NO: 61049 - DNA, 16 bp, H. sapiens
caagggaagtgaagga

SEQ ID NO: 61050 - DNA, 16 bp, H. sapiens
caagggaatctgggaa

SEQ ID NO: 61051 - DNA, 16 bp, H. sapiens
caagggaattatgctg

SEQ ID NO: 61052 - DNA, 16 bp, H. sapiens
caagggacatacctta

SEQ ID NO: 61053 - DNA, 16 bp, H. sapiens
caagggacccagaata

SEQ ID NO: 61054 - DNA, 16 bp, H. sapiens
caagggagctgagagg

SEQ ID NO: 61055 - DNA, 16 bp, H. sapiens
caagggagtctgggaa

SEQ ID NO: 61056 - DNA, 16 bp, H. sapiens
caagggatcgagacca

SEQ ID NO: 61057 - DNA, 16 bp, H. sapiens
caagggatctgcccac

SEQ ID NO: 61058 - DNA, 16 bp, H. sapiens
caagggattggttcca

SEQ ID NO: 61059 - DNA, 16 bp, H. sapiens
caagggcacagaactg

SEQ ID NO: 61060 - DNA, 16 bp, H. sapiens
caagggcaggagaaga

SEQ ID NO: 61061 - DNA, 16 bp, H. sapiens
caagggccgggcatgg

SEQ ID NO: 61062 - DNA, 16 bp, H. sapiens
caagggctgaggaatg

SEQ ID NO: 61063 - DNA, 16 bp, H. sapiens
caagggctgccagcat

SEQ ID NO: 61064 - DNA, 16 bp, H. sapiens
caagggctgctggttg

SEQ ID NO: 61065 - DNA, 16 bp, H. sapiens
caaggggaaggagagc

SEQ ID NO: 61066 - DNA, 16 bp, H. sapiens
caaggggacttcaaaa

SEQ ID NO: 61067 - DNA, 24 bp, H. sapiens
caaggggtcagggagttccctttc

SEQ ID NO: 61068 - DNA, 16 bp, H. sapiens
caagggtcaactgtac

SEQ ID NO: 61069 - DNA, 16 bp, H. sapiens
caagggtcaactgtat

SEQ ID NO: 61070 - DNA, 16 bp, H. sapiens
caagggtcttttgctt

SEQ ID NO: 61071 - DNA, 16 bp, H. sapiens
caagggttccagtttc

SEQ ID NO: 61072 - DNA, 16 bp, H. sapiens
caaggtaaagatgaaa

SEQ ID NO: 61073 - DNA, 16 bp, H. sapiens
caaggtcaaacagctg

SEQ ID NO: 61074 - DNA, 16 bp, H. sapiens
caaggtcaagagttcg

SEQ ID NO: 61075 - DNA, 16 bp, H. sapiens
caaggtcaaggtgctg

SEQ ID NO: 61076 - DNA, 16 bp, H. sapiens
caaggtcacacagctg

SEQ ID NO: 61077 - DNA, 16 bp, H. sapiens
caaggtcacacagtga

SEQ ID NO: 61078 - DNA, 16 bp, H. sapiens
caaggtcacaccactg

SEQ ID NO: 61079 - DNA, 16 bp, H. sapiens
caaggtcaggagaccg

SEQ ID NO: 61080 - DNA, 16 bp, H. sapiens
caaggtcatgaaagac

SEQ ID NO: 61081 - DNA, 16 bp, H. sapiens
caaggtcatgcagctg

SEQ ID NO: 61082 - DNA, 16 bp, H. sapiens
caaggtccagccgttc

SEQ ID NO: 61083 - DNA, 16 bp, H. sapiens
caaggtctcatctgag

SEQ ID NO: 61084 - DNA, 16 bp, H. sapiens
caaggtctcgctctgt

SEQ ID NO: 61085 - DNA, 16 bp, H. sapiens
caaggtctcttaagtc

SEQ ID NO: 61086 - DNA, 16 bp, H. sapiens
caaggtcttactctgt

SEQ ID NO: 61087 - DNA, 16 bp, H. sapiens
caaggtcttgttctgt

SEQ ID NO: 61088 - DNA, 16 bp, H. sapiens
caaggtgagtgaatca

SEQ ID NO: 61089 - DNA, 16 bp, H. sapiens
caaggtgatggcatta

SEQ ID NO: 61090 - DNA, 16 bp, H. sapiens
caaggtgctggaatta

SEQ ID NO: 61091 - DNA, 16 bp, H. sapiens
caaggtgctggcagag

SEQ ID NO: 61092 - DNA, 16 bp, H. sapiens
caaggtggatagatca

SEQ ID NO: 61093 - DNA, 16 bp, H. sapiens
caaggtgggatgatca

SEQ ID NO: 61094 - DNA, 17 bp, H. sapiens
caaggtgggtagatcac

SEQ ID NO: 61095 - DNA, 17 bp, H. sapiens
caaggtgggtcgatcac

SEQ ID NO: 61096 - DNA, 19 bp, H. sapiens
caaggtgggtggatcatct

SEQ ID NO: 61097 - DNA, 16 bp, H. sapiens
caaggtgggtggatcg

SEQ ID NO: 61098 - DNA, 16 bp, H. sapiens
caaggtggtgggcgcc

SEQ ID NO: 61099 - DNA, 16 bp, H. sapiens
caaggtgtgggcagag

SEQ ID NO: 61100 - DNA, 16 bp, H. sapiens
caaggtgttggcagag

SEQ ID NO: 61101 - DNA, 16 bp, H. sapiens
caaggtgttgggatta

SEQ ID NO: 61102 - DNA, 16 bp, H. sapiens
caaggttacagtgaac

SEQ ID NO: 61103 - DNA, 16 bp, H. sapiens
caaggttctcagcttc

SEQ ID NO: 61104 - DNA, 16 bp, H. sapiens
caaggttctttaacac

SEQ ID NO: 61105 - DNA, 16 bp, H. sapiens
caaggttgaaatggag

SEQ ID NO: 61106 - DNA, 16 bp, H. sapiens
caaggttgaggagaaa

SEQ ID NO: 61107 - DNA, 16 bp, H. sapiens
caaggttggtttcttc

SEQ ID NO: 61108 - DNA, 19 bp, H. sapiens
caaggtttcaccatgttgg

SEQ ID NO: 61109 - DNA, 16 bp, H. sapiens
caaggttttattaaaa

SEQ ID NO: 61110 - DNA, 16 bp, H. sapiens
caaggttttgtttgtt

SEQ ID NO: 61111 - DNA, 16 bp, H. sapiens
caaggtttttatcttc

SEQ ID NO: 61112 - DNA, 16 bp, H. sapiens
caagtaaaaatttaaa

SEQ ID NO: 61113 - DNA, 16 bp, H. sapiens
caagtaactcttattt

SEQ ID NO: 61114 - DNA, 16 bp, H. sapiens
caagtaactgggacta

SEQ ID NO: 61115 - DNA, 16 bp, H. sapiens
caagtaagaaaactga

SEQ ID NO: 61116 - DNA, 16 bp, H. sapiens
caagtaatcctcccac

SEQ ID NO: 61117 - DNA, 16 bp, H. sapiens
caagtaattttttgta

SEQ ID NO: 61118 - DNA, 16 bp, H. sapiens
caagtacaagaaggct

SEQ ID NO: 61119 - DNA, 16 bp, H. sapiens
caagtaccacttttct

SEQ ID NO: 61120 - DNA, 16 bp, H. sapiens
caagtacctggaacta

SEQ ID NO: 61121 - DNA, 16 bp, H. sapiens
caagtactgcatgttc

SEQ ID NO: 61122 - DNA, 16 bp, H. sapiens
caagtagcctgtcttc

SEQ ID NO: 61123 - DNA, 16 bp, H. sapiens
caagtagctaggatta

SEQ ID NO: 61124 - DNA, 16 bp, H. sapiens
caagtagctgggacag

SEQ ID NO: 61125 - DNA, 16 bp, H. sapiens
caagtagctgggagga

SEQ ID NO: 61126 - DNA, 16 bp, H. sapiens
caagtaggaaagatat

SEQ ID NO: 61127 - DNA, 16 bp, H. sapiens
caagtagggaagatat

SEQ ID NO: 61128 - DNA, 16 bp, H. sapiens
caagtagttggaacca

SEQ ID NO: 61129 - DNA, 16 bp, H. sapiens
caagtagtttttggtt

SEQ ID NO: 61130 - DNA, 16 bp, H. sapiens
caagtataatttaaaa

SEQ ID NO: 61131 - DNA, 16 bp, H. sapiens
caagtatatggaaaaa

SEQ ID NO: 61132 - DNA, 16 bp, H. sapiens
caagtatctgggatca

SEQ ID NO: 61133 - DNA, 16 bp, H. sapiens
caagtatctttttcat

SEQ ID NO: 61134 - DNA, 16 bp, H. sapiens
caagtattccaaaatc

SEQ ID NO: 61135 - DNA, 16 bp, H. sapiens
caagtatttaaaaata

SEQ ID NO: 61136 - DNA, 16 bp, H. sapiens
caagtatttactgaat

SEQ ID NO: 61137 - DNA, 16 bp, H. sapiens
caagtatttattgagg

SEQ ID NO: 61138 - DNA, 16 bp, H. sapiens
caagtatttctttttt

SEQ ID NO: 61139 - DNA, 16 bp, H. sapiens
caagtattttcttcca

SEQ ID NO: 61140 - DNA, 16 bp, H. sapiens
caagtattttttctga

SEQ ID NO: 61141 - DNA, 16 bp, H. sapiens
caagtcacagactggg

SEQ ID NO: 61142 - DNA, 16 bp, H. sapiens
caagtcacatgaccaa

SEQ ID NO: 61143 - DNA, 16 bp, H. sapiens
caagtcaccatgcctg

SEQ ID NO: 61144 - DNA, 16 bp, H. sapiens
caagtcaggaggattg

SEQ ID NO: 61145 - DNA, 16 bp, H. sapiens
caagtcattctcctgc

SEQ ID NO: 61146 - DNA, 16 bp, H. sapiens
caagtcatttaacttc

SEQ ID NO: 61147 - DNA, 16 bp, H. sapiens
caagtccaaaacctag

SEQ ID NO: 61148 - DNA, 16 bp, H. sapiens
caagtccaaagtctca

SEQ ID NO: 61149 - DNA, 16 bp, H. sapiens
caagtccaaagtttca

SEQ ID NO: 61150 - DNA, 16 bp, H. sapiens
caagtccagcctgggc

SEQ ID NO: 61151 - DNA, 16 bp, H. sapiens
caagtcccaagactgc

SEQ ID NO: 61152 - DNA, 16 bp, H. sapiens
caagtccccagagtcc

SEQ ID NO: 61153 - DNA, 16 bp, H. sapiens
caagtcctgctgatct

SEQ ID NO: 61154 - DNA, 16 bp, H. sapiens
caagtcctgcttttct

SEQ ID NO: 61155 - DNA, 16 bp, H. sapiens
caagtccttgctttca

SEQ ID NO: 61156 - DNA, 16 bp, H. sapiens
caagtcctttatcaaa

SEQ ID NO: 61157 - DNA, 16 bp, H. sapiens
caagtcctttccacct

SEQ ID NO: 61158 - DNA, 16 bp, H. sapiens
caagtctcagttttct

SEQ ID NO: 61159 - DNA, 16 bp, H. sapiens
caagtctccaggaagt

SEQ ID NO: 61160 - DNA, 16 bp, H. sapiens
caagtctcctgcctca

SEQ ID NO: 61161 - DNA, 16 bp, H. sapiens
caagtctttagacaaa

SEQ ID NO: 61162 - DNA, 16 bp, H. sapiens
caagtctttgctactg

SEQ ID NO: 61163 - DNA, 16 bp, H. sapiens
caagtctttttctttt

SEQ ID NO: 61164 - DNA, 16 bp, H. sapiens
caagtgaaagaaagga

SEQ ID NO: 61165 - DNA, 16 bp, H. sapiens
caagtgaaagaaataa

SEQ ID NO: 61166 - DNA, 16 bp, H. sapiens
caagtgaaaggaggag

SEQ ID NO: 61167 - DNA, 16 bp, H. sapiens
caagtgaacagaaaaa

SEQ ID NO: 61168 - DNA, 16 bp, H. sapiens
caagtgaaggagaaat

SEQ ID NO: 61169 - DNA, 16 bp, H. sapiens
caagtgacagaaaacc

SEQ ID NO: 61170 - DNA, 16 bp, H. sapiens
caagtgacttgtccaa

SEQ ID NO: 61171 - DNA, 16 bp, H. sapiens
caagtgatactcccac

SEQ ID NO: 61172 - DNA, 16 bp, H. sapiens
caagtgatacttctgc

SEQ ID NO: 61173 - DNA, 16 bp, H. sapiens
caagtgatcaagtgat

SEQ ID NO: 61174 - DNA, 16 bp, H. sapiens
caagtgatccacctgc

SEQ ID NO: 61175 - DNA, 16 bp, H. sapiens
caagtgatcctcacat

SEQ ID NO: 61176 - DNA, 16 bp, H. sapiens
caagtgattctgatgc

SEQ ID NO: 61177 - DNA, 16 bp, H. sapiens
caagtgattcttcttc

SEQ ID NO: 61178 - DNA, 16 bp, H. sapiens
caagtgattttttttt

SEQ ID NO: 61179 - DNA, 16 bp, H. sapiens
caagtgcaaaggccct

SEQ ID NO: 61180 - DNA, 16 bp, H. sapiens
caagtgcaagccacca

SEQ ID NO: 61181 - DNA, 16 bp, H. sapiens
caagtgcaattttgtt

SEQ ID NO: 61182 - DNA, 16 bp, H. sapiens
caagtgcacatcacca

SEQ ID NO: 61183 - DNA, 16 bp, H. sapiens
caagtgcagtggctca

SEQ ID NO: 61184 - DNA, 16 bp, H. sapiens
caagtgcatgccacca

SEQ ID NO: 61185 - DNA, 16 bp, H. sapiens
caagtgctatgaagaa

SEQ ID NO: 61186 - DNA, 17 bp, H. sapiens
caagtgctgccaaagtg

SEQ ID NO: 61187 - DNA, 16 bp, H. sapiens
caagtgctttgggagg

SEQ ID NO: 61188 - DNA, 16 bp, H. sapiens
caagtgcttttcctgc

SEQ ID NO: 61189 - DNA, 16 bp, H. sapiens
caagtggaagaaagag

SEQ ID NO: 61190 - DNA, 16 bp, H. sapiens
caagtggcagagctgg

SEQ ID NO: 61191 - DNA, 16 bp, H. sapiens
caagtggccaatggga

SEQ ID NO: 61192 - DNA, 16 bp, H. sapiens
caagtggctggacatc

SEQ ID NO: 61193 - DNA, 16 bp, H. sapiens
caagtgggcatgtgtt

SEQ ID NO: 61194 - DNA, 16 bp, H. sapiens
caagtggttatttgga

SEQ ID NO: 61195 - DNA, 16 bp, H. sapiens
caagtgtaagccactg

SEQ ID NO: 61196 - DNA, 16 bp, H. sapiens
caagtgtgagccaccg

SEQ ID NO: 61197 - DNA, 16 bp, H. sapiens
caagtgtgagccactg

SEQ ID NO: 61198 - DNA, 16 bp, H. sapiens
caagtgtgaggcactg

SEQ ID NO: 61199 - DNA, 16 bp, H. sapiens
caagtgtgagtcaccg

SEQ ID NO: 61200 - DNA, 16 bp, H. sapiens
caagtgtgggccactg

SEQ ID NO: 61201 - DNA, 16 bp, H. sapiens
caagtgtggggtctgg

SEQ ID NO: 61202 - DNA, 16 bp, H. sapiens
caagtgtggtggcagg

SEQ ID NO: 61203 - DNA, 16 bp, H. sapiens
caagtgtgtgctcacc

SEQ ID NO: 61204 - DNA, 16 bp, H. sapiens
caagtgtgtgtatgtg

SEQ ID NO: 61205 - DNA, 16 bp, H. sapiens
caagtgttaccatggc

SEQ ID NO: 61206 - DNA, 16 bp, H. sapiens
caagtgttcctcctgc

SEQ ID NO: 61207 - DNA, 16 bp, H. sapiens
caagtgttgatgagaa

SEQ ID NO: 61208 - DNA, 16 bp, H. sapiens
caagtgtttattgagt

SEQ ID NO: 61209 - DNA, 16 bp, H. sapiens
caagtgtttctcctgc

SEQ ID NO: 61210 - DNA, 16 bp, H. sapiens
caagttaataaatgtg

SEQ ID NO: 61211 - DNA, 16 bp, H. sapiens
caagttatccagaaaa

SEQ ID NO: 61212 - DNA, 16 bp, H. sapiens
caagttatttaacatc

SEQ ID NO: 61213 - DNA, 16 bp, H. sapiens
caagttatttactttc

SEQ ID NO: 61214 - DNA, 16 bp, H. sapiens
caagttattttgtgaa

SEQ ID NO: 61215 - DNA, 16 bp, H. sapiens
caagttcacaccactg

SEQ ID NO: 61216 - DNA, 16 bp, H. sapiens
caagttccacctcctg

SEQ ID NO: 61217 - DNA, 19 bp, H. sapiens
caagttctagggtacatgt

SEQ ID NO: 61218 - DNA, 16 bp, H. sapiens
caagttctccaggtga

SEQ ID NO: 61219 - DNA, 16 bp, H. sapiens
caagttcttcagcttt

SEQ ID NO: 61220 - DNA, 16 bp, H. sapiens
caagttgaaaaacact

SEQ ID NO: 61221 - DNA, 16 bp, H. sapiens
caagttgacttcatcc

SEQ ID NO: 61222 - DNA, 16 bp, H. sapiens
caagttgagatttgag

SEQ ID NO: 61223 - DNA, 16 bp, H. sapiens
caagttggaaaacagt

SEQ ID NO: 61224 - DNA, 16 bp, H. sapiens
caagttggattaaaaa

SEQ ID NO: 61225 - DNA, 16 bp, H. sapiens
caagttgggcatcact

SEQ ID NO: 61226 - DNA, 16 bp, H. sapiens
caagtttaaaaagaaa

SEQ ID NO: 61227 - DNA, 16 bp, H. sapiens
caagtttaaagagaag

SEQ ID NO: 61228 - DNA, 16 bp, H. sapiens
caagtttactaagaaa

SEQ ID NO: 61229 - DNA, 16 bp, H. sapiens
caagtttattttttaa

SEQ ID NO: 61230 - DNA, 16 bp, H. sapiens
caagtttcagctttct

SEQ ID NO: 61231 - DNA, 16 bp, H. sapiens
caagtttccaggtgat

SEQ ID NO: 61232 - DNA, 16 bp, H. sapiens
caagtttgcagagaaa

SEQ ID NO: 61233 - DNA, 16 bp, H. sapiens
caagttttattttaag

SEQ ID NO: 61234 - DNA, 16 bp, H. sapiens
caagttttggtatcag

SEQ ID NO: 61235 - DNA, 16 bp, H. sapiens
caagttttggtgagga

SEQ ID NO: 61236 - DNA, 16 bp, H. sapiens
caagttttgtattttt

SEQ ID NO: 61237 - DNA, 16 bp, H. sapiens
caagtttttagacaaa

SEQ ID NO: 61238 - DNA, 16 bp, H. sapiens
caataaaaaccctaga

SEQ ID NO: 61239 - DNA, 16 bp, H. sapiens
caataaaaaggaatta

SEQ ID NO: 61240 - DNA, 16 bp, H. sapiens
caataaaaatagaagt

SEQ ID NO: 61241 - DNA, 16 bp, H. sapiens
caataaaaatccattt

SEQ ID NO: 61242 - DNA, 16 bp, H. sapiens
caataaaaatgattta

SEQ ID NO: 61243 - DNA, 16 bp, H. sapiens
caataaaaatgtttaa

SEQ ID NO: 61244 - DNA, 16 bp, H. sapiens
caataaaactctttct

SEQ ID NO: 61245 - DNA, 16 bp, H. sapiens
caataaaacttttttt

SEQ ID NO: 61246 - DNA, 16 bp, H. sapiens
caataaaagcccagga

SEQ ID NO: 61247 - DNA, 16 bp, H. sapiens
caataaaaggaaccag

SEQ ID NO: 61248 - DNA, 16 bp, H. sapiens
caataaaaggaatgaa

SEQ ID NO: 61249 - DNA, 16 bp, H. sapiens
caataaaatactattc

SEQ ID NO: 61250 - DNA, 16 bp, H. sapiens
caataaaatattagaa

SEQ ID NO: 61251 - DNA, 16 bp, H. sapiens
caataaaatattgtta

SEQ ID NO: 61252 - DNA, 16 bp, H. sapiens
caataaaatccaggct

SEQ ID NO: 61253 - DNA, 16 bp, H. sapiens
caataaaatcctctgc

SEQ ID NO: 61254 - DNA, 16 bp, H. sapiens
caataaaatgaaatga

SEQ ID NO: 61255 - DNA, 16 bp, H. sapiens
caataaaatgttatat

SEQ ID NO: 61256 - DNA, 16 bp, H. sapiens
caataaaatgttatta

SEQ ID NO: 61257 - DNA, 16 bp, H. sapiens
caataaaattttaaag

SEQ ID NO: 61258 - DNA, 16 bp, H. sapiens
caataaacatgcaagt

SEQ ID NO: 61259 - DNA, 16 bp, H. sapiens
caataaacatggaaag

SEQ ID NO: 61260 - DNA, 16 bp, H. sapiens
caataaacatgtaaaa

SEQ ID NO: 61261 - DNA, 16 bp, H. sapiens
caataaacatttgttg

SEQ ID NO: 61262 - DNA, 16 bp, H. sapiens
caataaacattttatt

SEQ ID NO: 61263 - DNA, 16 bp, H. sapiens
caataaacatttttta

SEQ ID NO: 61264 - DNA, 16 bp, H. sapiens
caataaaccaaatgtg

SEQ ID NO: 61265 - DNA, 16 bp, H. sapiens
caataaaccaggtatt

SEQ ID NO: 61266 - DNA, 16 bp, H. sapiens
caataaacttttattt

SEQ ID NO: 61267 - DNA, 16 bp, H. sapiens
caataaagaaaatgtg

SEQ ID NO: 61268 - DNA, 16 bp, H. sapiens
caataaagaccatata

SEQ ID NO: 61269 - DNA, 16 bp, H. sapiens
caataaagattttttt

SEQ ID NO: 61270 - DNA, 16 bp, H. sapiens
caataaagctgctaaa

SEQ ID NO: 61271 - DNA, 16 bp, H. sapiens
caataaagctgttatt

SEQ ID NO: 61272 - DNA, 16 bp, H. sapiens
caataaagtatatttt

SEQ ID NO: 61273 - DNA, 16 bp, H. sapiens
caataaagtattttta

SEQ ID NO: 61274 - DNA, 16 bp, H. sapiens
caataaagtatttttt

SEQ ID NO: 61275 - DNA, 16 bp, H. sapiens
caataaagttattttt

SEQ ID NO: 61276 - DNA, 16 bp, H. sapiens
caataaagttgtaaaa

SEQ ID NO: 61277 - DNA, 16 bp, H. sapiens
caataaagtttgagaa

SEQ ID NO: 61278 - DNA, 16 bp, H. sapiens
caataaagtttgtttt

SEQ ID NO: 61279 - DNA, 16 bp, H. sapiens
caataaagtttttaaa

SEQ ID NO: 61280 - DNA, 16 bp, H. sapiens
caataaatacgaaggg

SEQ ID NO: 61281 - DNA, 16 bp, H. sapiens
caataaatatcttttt

SEQ ID NO: 61282 - DNA, 16 bp, H. sapiens
caataaatattaactg

SEQ ID NO: 61283 - DNA, 16 bp, H. sapiens
caataaatattcatca

SEQ ID NO: 61284 - DNA, 16 bp, H. sapiens
caataaatattggctg

SEQ ID NO: 61285 - DNA, 16 bp, H. sapiens
caataaatattggttg

SEQ ID NO: 61286 - DNA, 16 bp, H. sapiens
caataaatatttattg

SEQ ID NO: 61287 - DNA, 16 bp, H. sapiens
caataaatatttgttc

SEQ ID NO: 61288 - DNA, 16 bp, H. sapiens
caataaatgcaaacaa

SEQ ID NO: 61289 - DNA, 16 bp, H. sapiens
caataaatgcagaaaa

SEQ ID NO: 61290 - DNA, 16 bp, H. sapiens
caataaatgtaataca

SEQ ID NO: 61291 - DNA, 16 bp, H. sapiens
caataaatgtggaaaa

SEQ ID NO: 61292 - DNA, 16 bp, H. sapiens
caataaatgttaaaga

SEQ ID NO: 61293 - DNA, 16 bp, H. sapiens
caataaatgttagcca

SEQ ID NO: 61294 - DNA, 16 bp, H. sapiens
caataaatgttgattg

SEQ ID NO: 61295 - DNA, 16 bp, H. sapiens
caataaatgtttgtgg

SEQ ID NO: 61296 - DNA, 16 bp, H. sapiens
caataaatgtttgtta

SEQ ID NO: 61297 - DNA, 16 bp, H. sapiens
caataaattaggcatt

SEQ ID NO: 61298 - DNA, 16 bp, H. sapiens
caataacaaaaacagc

SEQ ID NO: 61299 - DNA, 16 bp, H. sapiens
caataaccttgatgaa

SEQ ID NO: 61300 - DNA, 16 bp, H. sapiens
caataagaaattaata

SEQ ID NO: 61301 - DNA, 16 bp, H. sapiens
caataagaacaaaact

SEQ ID NO: 61302 - DNA, 16 bp, H. sapiens
caataagagcaaaact

SEQ ID NO: 61303 - DNA, 16 bp, H. sapiens
caataagagcgaaact

SEQ ID NO: 61304 - DNA, 16 bp, H. sapiens
caataaggaacttaaa

SEQ ID NO: 61305 - DNA, 16 bp, H. sapiens
caataaggacatgaaa

SEQ ID NO: 61306 - DNA, 16 bp, H. sapiens
caataataaaatgaca

SEQ ID NO: 61307 - DNA, 16 bp, H. sapiens
caataatcccagctac

SEQ ID NO: 61308 - DNA, 28 bp, H. sapiens
caataatgggagactttaacaccccact

SEQ ID NO: 61309 - DNA, 16 bp, H. sapiens
caataattcataggtt

SEQ ID NO: 61310 - DNA, 16 bp, H. sapiens
caataattgtacatat

SEQ ID NO: 61311 - DNA, 16 bp, H. sapiens
caataattttgatttg

SEQ ID NO: 61312 - DNA, 16 bp, H. sapiens
caatacagtgaaaccc

SEQ ID NO: 61313 - DNA, 16 bp, H. sapiens
caatacatagaaatga

SEQ ID NO: 61314 - DNA, 16 bp, H. sapiens
caatacatggaggtta

SEQ ID NO: 61315 - DNA, 16 bp, H. sapiens
caatacattttattat

SEQ ID NO: 61316 - DNA, 16 bp, H. sapiens
caataccaaatgctgg

SEQ ID NO: 61317 - DNA, 16 bp, H. sapiens
caataccacactgtct

SEQ ID NO: 61318 - DNA, 16 bp, H. sapiens
caataccacatggaag

SEQ ID NO: 61319 - DNA, 17 bp, H. sapiens
caatacctaatttattg

SEQ ID NO: 61320 - DNA, 16 bp, H. sapiens
caataccttcctccac

SEQ ID NO: 61321 - DNA, 16 bp, H. sapiens
caatactacattgaat

SEQ ID NO: 61322 - DNA, 16 bp, H. sapiens
caatactttgcatcct

SEQ ID NO: 61323 - DNA, 16 bp, H. sapiens
caatactttgggaagc

SEQ ID NO: 61324 - DNA, 16 bp, H. sapiens
caatagaaaagggata

SEQ ID NO: 61325 - DNA, 16 bp, H. sapiens
caatagaaatataatg

SEQ ID NO: 61326 - DNA, 16 bp, H. sapiens
caatagagcaagactc

SEQ ID NO: 61327 - DNA, 16 bp, H. sapiens
caatagagcgagactc

SEQ ID NO: 61328 - DNA, 16 bp, H. sapiens
caatagaggcagaaaa

SEQ ID NO: 61329 - DNA, 16 bp, H. sapiens
caatagatacagaaaa

SEQ ID NO: 61330 - DNA, 16 bp, H. sapiens
caatagatggagaaaa

SEQ ID NO: 61331 - DNA, 16 bp, H. sapiens
caatagcaataataat

SEQ ID NO: 61332 - DNA, 16 bp, H. sapiens
caatagcagcagaata

SEQ ID NO: 61333 - DNA, 19 bp, H. sapiens
caatagcatctgataagat

SEQ ID NO: 61334 - DNA, 16 bp, H. sapiens
caatagccaagatatg

SEQ ID NO: 61335 - DNA, 16 bp, H. sapiens
caatagccaagatgtg

SEQ ID NO: 61336 - DNA, 16 bp, H. sapiens
caatagctcacacctg

SEQ ID NO: 61337 - DNA, 16 bp, H. sapiens
caatagcttcctaact

SEQ ID NO: 61338 - DNA, 16 bp, H. sapiens
caataggattcatgct

SEQ ID NO: 61339 - DNA, 16 bp, H. sapiens
caatagttagtttttc

SEQ ID NO: 61340 - DNA, 16 bp, H. sapiens
caatataaaaaatgta

SEQ ID NO: 61341 - DNA, 16 bp, H. sapiens
caatataagaaatatt

SEQ ID NO: 61342 - DNA, 16 bp, H. sapiens
caatatagcaagatct

SEQ ID NO: 61343 - DNA, 16 bp, H. sapiens
caatatatacatatat

SEQ ID NO: 61344 - DNA, 16 bp, H. sapiens
caatatatctgatgaa

SEQ ID NO: 61345 - DNA, 16 bp, H. sapiens
caatatattcaaaatg

SEQ ID NO: 61346 - DNA, 16 bp, H. sapiens
caatatattgtatatt

SEQ ID NO: 61347 - DNA, 16 bp, H. sapiens
caatatcactgataaa

SEQ ID NO: 61348 - DNA, 16 bp, H. sapiens
caatatccattctgta

SEQ ID NO: 61349 - DNA, 16 bp, H. sapiens
caatatccctgataaa

SEQ ID NO: 61350 - DNA, 16 bp, H. sapiens
caatatctaatttatt

SEQ ID NO: 61351 - DNA, 16 bp, H. sapiens
caatatctgtgatgaa

SEQ ID NO: 61352 - DNA, 16 bp, H. sapiens
caatatgaattttttt

SEQ ID NO: 61353 - DNA, 16 bp, H. sapiens
caatatgcccatgtaa

SEQ ID NO: 61354 - DNA, 16 bp, H. sapiens
caatatggagaaaccc

SEQ ID NO: 61355 - DNA, 16 bp, H. sapiens
caatatggagaaacct

SEQ ID NO: 61356 - DNA, 16 bp, H. sapiens
caatatggtgaagccc

SEQ ID NO: 61357 - DNA, 16 bp, H. sapiens
caatatggtgacaccc

SEQ ID NO: 61358 - DNA, 16 bp, H. sapiens
caatatgttgtctttt

SEQ ID NO: 61359 - DNA, 16 bp, H. sapiens
caatattaaatcttct

SEQ ID NO: 61360 - DNA, 16 bp, H. sapiens
caatattaactttgaa

SEQ ID NO: 61361 - DNA, 16 bp, H. sapiens
caatattcacaaaata

SEQ ID NO: 61362 - DNA, 16 bp, H. sapiens
caatattgaggcaaga

SEQ ID NO: 61363 - DNA, 16 bp, H. sapiens
caatattggttcatca

SEQ ID NO: 61364 - DNA, 16 bp, H. sapiens
caatattgtgaaaatg

SEQ ID NO: 61365 - DNA, 16 bp, H. sapiens
caatattgttttaatt

SEQ ID NO: 61366 - DNA, 16 bp, H. sapiens
caatattgtttttgat

SEQ ID NO: 61367 - DNA, 16 bp, H. sapiens
caatatttaaaacttt

SEQ ID NO: 61368 - DNA, 16 bp, H. sapiens
caatatttattcttcc

SEQ ID NO: 61369 - DNA, 16 bp, H. sapiens
caatatttcatagttt

SEQ ID NO: 61370 - DNA, 16 bp, H. sapiens
caatatttgtctttct

SEQ ID NO: 61371 - DNA, 16 bp, H. sapiens
caatattttacagttt

SEQ ID NO: 61372 - DNA, 16 bp, H. sapiens
caatattttattttgt

SEQ ID NO: 61373 - DNA, 16 bp, H. sapiens
caatattttcaataaa

SEQ ID NO: 61374 - DNA, 16 bp, H. sapiens
caatattttgaaaata

SEQ ID NO: 61375 - DNA, 16 bp, H. sapiens
caatattttgaaaatg

SEQ ID NO: 61376 - DNA, 16 bp, H. sapiens
caatattttgtatttt

SEQ ID NO: 61377 - DNA, 16 bp, H. sapiens
caatcaaaaatgataa

SEQ ID NO: 61378 - DNA, 16 bp, H. sapiens
caatcaaaatcccaga

SEQ ID NO: 61379 - DNA, 16 bp, H. sapiens
caatcaaatggaaaaa

SEQ ID NO: 61380 - DNA, 16 bp, H. sapiens
caatcaaatttcaaca

SEQ ID NO: 61381 - DNA, 16 bp, H. sapiens
caatcaacaaatggat

SEQ ID NO: 61382 - DNA, 16 bp, H. sapiens
caatcaagatgtcagc

SEQ ID NO: 61383 - DNA, 16 bp, H. sapiens
caatcaatcaataaga

SEQ ID NO: 61384 - DNA, 16 bp, H. sapiens
caatcaatcaatcaaa

SEQ ID NO: 61385 - DNA, 16 bp, H. sapiens
caatcaatgtaattca

SEQ ID NO: 61386 - DNA, 16 bp, H. sapiens
caatcacaagtgtcct

SEQ ID NO: 61387 - DNA, 16 bp, H. sapiens
caatcacagctcactg

SEQ ID NO: 61388 - DNA, 16 bp, H. sapiens
caatcactatggagaa

SEQ ID NO: 61389 - DNA, 16 bp, H. sapiens
caatcactgtgctctc

SEQ ID NO: 61390 - DNA, 16 bp, H. sapiens
caatcactttttaaaa

SEQ ID NO: 61391 - DNA, 16 bp, H. sapiens
caatcagaaaatattt

SEQ ID NO: 61392 - DNA, 16 bp, H. sapiens
caatcagagaagaaaa

SEQ ID NO: 61393 - DNA, 16 bp, H. sapiens
caatcaggcagcagca

SEQ ID NO: 61394 - DNA, 16 bp, H. sapiens
caatcagtaaatattt

SEQ ID NO: 61395 - DNA, 16 bp, H. sapiens
caatcagtcaggagaa

SEQ ID NO: 61396 - DNA, 16 bp, H. sapiens
caatcatagctcactg

SEQ ID NO: 61397 - DNA, 16 bp, H. sapiens
caatcatagctcattg

SEQ ID NO: 61398 - DNA, 16 bp, H. sapiens
caatcatagcttactg

SEQ ID NO: 61399 - DNA, 16 bp, H. sapiens
caatcatatctcactg

SEQ ID NO: 61400 - DNA, 16 bp, H. sapiens
caatcatcaccaagaa

SEQ ID NO: 61401 - DNA, 16 bp, H. sapiens
caatcatcagagaata

SEQ ID NO: 61402 - DNA, 16 bp, H. sapiens
caatcatgaaaaagaa

SEQ ID NO: 61403 - DNA, 16 bp, H. sapiens
caatcatgacagaagg

SEQ ID NO: 61404 - DNA, 16 bp, H. sapiens
caatcatgcctcactg

SEQ ID NO: 61405 - DNA, 16 bp, H. sapiens
caatcatggcagaagg

SEQ ID NO: 61406 - DNA, 16 bp, H. sapiens
caatcatgtcatctac

SEQ ID NO: 61407 - DNA, 16 bp, H. sapiens
caatcattttcttaca

SEQ ID NO: 61408 - DNA, 16 bp, H. sapiens
caatccactgactcaa

SEQ ID NO: 61409 - DNA, 16 bp, H. sapiens
caatccatgttgctgc

SEQ ID NO: 61410 - DNA, 16 bp, H. sapiens
caatcccaagccaaaa

SEQ ID NO: 61411 - DNA, 16 bp, H. sapiens
caatcccagcacttta

SEQ ID NO: 61412 - DNA, 18 bp, H. sapiens
caatcccagcactttgga

SEQ ID NO: 61413 - DNA, 19 bp, H. sapiens
caatcccagcactttggga

SEQ ID NO: 61414 - DNA, 16 bp, H. sapiens
caatcccagcattttg

SEQ ID NO: 61415 - DNA, 17 bp, H. sapiens
caatcccagctactcaa

SEQ ID NO: 61416 - DNA, 16 bp, H. sapiens
caatcccattaaaaaa

SEQ ID NO: 61417 - DNA, 16 bp, H. sapiens
caatccctgagctgga

SEQ ID NO: 61418 - DNA, 16 bp, H. sapiens
caatccgcccaccttg

SEQ ID NO: 61419 - DNA, 16 bp, H. sapiens
caatcctaacactttg

SEQ ID NO: 61420 - DNA, 16 bp, H. sapiens
caatcctaagctaaaa

SEQ ID NO: 61421 - DNA, 19 bp, H. sapiens
caatcctagcactttggga

SEQ ID NO: 61422 - DNA, 16 bp, H. sapiens
caatcctatgaagtag

SEQ ID NO: 61423 - DNA, 16 bp, H. sapiens
caatcctcacaacagc

SEQ ID NO: 61424 - DNA, 16 bp, H. sapiens
caatcctcccgcctca

SEQ ID NO: 61425 - DNA, 16 bp, H. sapiens
caatcctctcatcttg

SEQ ID NO: 61426 - DNA, 16 bp, H. sapiens
caatcctgaaaaagaa

SEQ ID NO: 61427 - DNA, 16 bp, H. sapiens
caatcctgtgaggcag

SEQ ID NO: 61428 - DNA, 16 bp, H. sapiens
caatccttctcaaatt

SEQ ID NO: 61429 - DNA, 16 bp, H. sapiens
caatcgatcaatcaat

SEQ ID NO: 61430 - DNA, 16 bp, H. sapiens
caatcgtggcagaagg

SEQ ID NO: 61431 - DNA, 16 bp, H. sapiens
caatctcagctactcg

SEQ ID NO: 61432 - DNA, 16 bp, H. sapiens
caatctcagctgactg

SEQ ID NO: 61433 - DNA, 16 bp, H. sapiens
caatctcagcttactg

SEQ ID NO: 61434 - DNA, 16 bp, H. sapiens
caatctcctaaccttg

SEQ ID NO: 61435 - DNA, 16 bp, H. sapiens
caatctcctgaccctg

SEQ ID NO: 61436 - DNA, 19 bp, H. sapiens
caatctcctgacctcgtga

SEQ ID NO: 61437 - DNA, 16 bp, H. sapiens
caatctcctgagctca

SEQ ID NO: 61438 - DNA, 17 bp, H. sapiens
caatctcggctcaccac

SEQ ID NO: 61439 - DNA, 16 bp, H. sapiens
caatctcggctcacgg

SEQ ID NO: 61440 - DNA, 18 bp, H. sapiens
caatctcggctccctgca

SEQ ID NO: 61441 - DNA, 16 bp, H. sapiens
caatctctccctctct

SEQ ID NO: 61442 - DNA, 16 bp, H. sapiens
caatctctctctccct

SEQ ID NO: 61443 - DNA, 16 bp, H. sapiens
caatctctgtctcctg

SEQ ID NO: 61444 - DNA, 16 bp, H. sapiens
caatctcttgatctcg

SEQ ID NO: 61445 - DNA, 16 bp, H. sapiens
caatctgaaaagccta

SEQ ID NO: 61446 - DNA, 16 bp, H. sapiens
caatctgcccacctcg

SEQ ID NO: 61447 - DNA, 16 bp, H. sapiens
caatctggagaacagg

SEQ ID NO: 61448 - DNA, 16 bp, H. sapiens
caatctgtcacccaga

SEQ ID NO: 61449 - DNA, 16 bp, H. sapiens
caatcttaaaaaagaa

SEQ ID NO: 61450 - DNA, 16 bp, H. sapiens
caatcttactgaaact

SEQ ID NO: 61451 - DNA, 16 bp, H. sapiens
caatcttatttacaat

SEQ ID NO: 61452 - DNA, 16 bp, H. sapiens
caatcttcccacccca

SEQ ID NO: 61453 - DNA, 16 bp, H. sapiens
caatcttgaaaataaa

SEQ ID NO: 61454 - DNA, 16 bp, H. sapiens
caatcttggcaccaca

SEQ ID NO: 61455 - DNA, 16 bp, H. sapiens
caatcttggctcactt

SEQ ID NO: 61456 - DNA, 16 bp, H. sapiens
caatgaaaaatgataa

SEQ ID NO: 61457 - DNA, 16 bp, H. sapiens
caatgaaaagacacag

SEQ ID NO: 61458 - DNA, 16 bp, H. sapiens
caatgaaaattaaatt

SEQ ID NO: 61459 - DNA, 16 bp, H. sapiens
caatgaaacaaaagtt

SEQ ID NO: 61460 - DNA, 16 bp, H. sapiens
caatgaaaccaggagc

SEQ ID NO: 61461 - DNA, 16 bp, H. sapiens
caatgaaagaaatcaa

SEQ ID NO: 61462 - DNA, 16 bp, H. sapiens
caatgaaataaattat

SEQ ID NO: 61463 - DNA, 16 bp, H. sapiens
caatgaaataccatct

SEQ ID NO: 61464 - DNA, 16 bp, H. sapiens
caatgaaatagaaaac

SEQ ID NO: 61465 - DNA, 16 bp, H. sapiens
caatgaaatcaaacta

SEQ ID NO: 61466 - DNA, 16 bp, H. sapiens
caatgaaatcaggaaa

SEQ ID NO: 61467 - DNA, 16 bp, H. sapiens
caatgaaatgaaaata

SEQ ID NO: 61468 - DNA, 16 bp, H. sapiens
caatgaaatgaaagag

SEQ ID NO: 61469 - DNA, 16 bp, H. sapiens
caatgaaatgaagaaa

SEQ ID NO: 61470 - DNA, 16 bp, H. sapiens
caatgaaatgtttcat

SEQ ID NO: 61471 - DNA, 16 bp, H. sapiens
caatgaacaactggaa

SEQ ID NO: 61472 - DNA, 16 bp, H. sapiens
caatgaacaagtggaa

SEQ ID NO: 61473 - DNA, 16 bp, H. sapiens
caatgaacttgaagat

SEQ ID NO: 61474 - DNA, 16 bp, H. sapiens
caatgaagaaaaagca

SEQ ID NO: 61475 - DNA, 16 bp, H. sapiens
caatgaatatacatgt

SEQ ID NO: 61476 - DNA, 16 bp, H. sapiens
caatgaatatttattt

SEQ ID NO: 61477 - DNA, 16 bp, H. sapiens
caatgaatatttgctg

SEQ ID NO: 61478 - DNA, 16 bp, H. sapiens
caatgacaaaatcatc

SEQ ID NO: 61479 - DNA, 16 bp, H. sapiens
caatgacaaaatcgcc

SEQ ID NO: 61480 - DNA, 16 bp, H. sapiens
caatgacaatgatgat

SEQ ID NO: 61481 - DNA, 16 bp, H. sapiens
caatgacaattttttt

SEQ ID NO: 61482 - DNA, 16 bp, H. sapiens
caatgacatccttcac

SEQ ID NO: 61483 - DNA, 16 bp, H. sapiens
caatgaccttatttcc

SEQ ID NO: 61484 - DNA, 16 bp, H. sapiens
caatgagaaaaaatat

SEQ ID NO: 61485 - DNA, 16 bp, H. sapiens
caatgagaaaaggata

SEQ ID NO: 61486 - DNA, 16 bp, H. sapiens
caatgagaaggagaaa

SEQ ID NO: 61487 - DNA, 16 bp, H. sapiens
caatgagaatgaacaa

SEQ ID NO: 61488 - DNA, 16 bp, H. sapiens
caatgagatactacct

SEQ ID NO: 61489 - DNA, 18 bp, H. sapiens
caatgagccaagatcaca

SEQ ID NO: 61490 - DNA, 16 bp, H. sapiens
caatgaggaaaatgtc

SEQ ID NO: 61491 - DNA, 16 bp, H. sapiens
caatgaggaactgggg

SEQ ID NO: 61492 - DNA, 16 bp, H. sapiens
caatgaggcctgcctg

SEQ ID NO: 61493 - DNA, 16 bp, H. sapiens
caatgatagaatggat

SEQ ID NO: 61494 - DNA, 16 bp, H. sapiens
caatgatagactggat

SEQ ID NO: 61495 - DNA, 16 bp, H. sapiens
caatgatattcttcat

SEQ ID NO: 61496 - DNA, 16 bp, H. sapiens
caatgatggactggat

SEQ ID NO: 61497 - DNA, 16 bp, H. sapiens
caatgatttaatcaac

SEQ ID NO: 61498 - DNA, 16 bp, H. sapiens
caatgatttattggat

SEQ ID NO: 61499 - DNA, 16 bp, H. sapiens
caatgcaacctcctcc

SEQ ID NO: 61500 - DNA, 16 bp, H. sapiens
caatgcaagaactcca

SEQ ID NO: 61501 - DNA, 16 bp, H. sapiens
caatgcaatagaaaag

SEQ ID NO: 61502 - DNA, 16 bp, H. sapiens
caatgcagaaggcggg

SEQ ID NO: 61503 - DNA, 16 bp, H. sapiens
caatgcagaattccaa

SEQ ID NO: 61504 - DNA, 16 bp, H. sapiens
caatgcagcctcaaac

SEQ ID NO: 61505 - DNA, 16 bp, H. sapiens
caatgcatttaaaata

SEQ ID NO: 61506 - DNA, 16 bp, H. sapiens
caatgccactcttctc

SEQ ID NO: 61507 - DNA, 16 bp, H. sapiens
caatgccatcaccatc

SEQ ID NO: 61508 - DNA, 19 bp, H. sapiens
caatgccatccccatcaaa

SEQ ID NO: 61509 - DNA, 17 bp, H. sapiens
caatgccattcccatca

SEQ ID NO: 61510 - DNA, 16 bp, H. sapiens
caatgcccaggctgga

SEQ ID NO: 61511 - DNA, 16 bp, H. sapiens
caatgccttctggaat

SEQ ID NO: 61512 - DNA, 16 bp, H. sapiens
caatgctagactggat

SEQ ID NO: 61513 - DNA, 16 bp, H. sapiens
caatgctcaacatcac

SEQ ID NO: 61514 - DNA, 16 bp, H. sapiens
caatgctggaagtggg

SEQ ID NO: 61515 - DNA, 16 bp, H. sapiens
caatgctggaggtgag

SEQ ID NO: 61516 - DNA, 16 bp, H. sapiens
caatggaaaaaggatt

SEQ ID NO: 61517 - DNA, 16 bp, H. sapiens
caatggaaagccactg

SEQ ID NO: 61518 - DNA, 16 bp, H. sapiens
caatggaacagaacac

SEQ ID NO: 61519 - DNA, 18 bp, H. sapiens
caatggaacagaacagag

SEQ ID NO: 61520 - DNA, 28 bp, H. sapiens
caatggaacagaacagagccatcagaaa

SEQ ID NO: 61521 - DNA, 31 bp, H. sapiens
caatggaacagaacagagccctcagaaataa

SEQ ID NO: 61522 - DNA, 16 bp, H. sapiens
caatggaagaagaatt

SEQ ID NO: 61523 - DNA, 16 bp, H. sapiens
caatggaatactgttc

SEQ ID NO: 61524 - DNA, 16 bp, H. sapiens
caatggaatcaaatca

SEQ ID NO: 61525 - DNA, 16 bp, H. sapiens
caatggaatggaatgg

SEQ ID NO: 61526 - DNA, 16 bp, H. sapiens
caatggaatgtctcag

SEQ ID NO: 61527 - DNA, 16 bp, H. sapiens
caatggagaaaatgtc

SEQ ID NO: 61528 - DNA, 16 bp, H. sapiens
caatggagaaaggaaa

SEQ ID NO: 61529 - DNA, 16 bp, H. sapiens
caatggatgtgaagga

SEQ ID NO: 61530 - DNA, 16 bp, H. sapiens
caatggcaaaaaaggg

SEQ ID NO: 61531 - DNA, 16 bp, H. sapiens
caatggcagtagcagt

SEQ ID NO: 61532 - DNA, 16 bp, H. sapiens
caatggcattttttac

SEQ ID NO: 61533 - DNA, 17 bp, H. sapiens
caatggccatgggaagc

SEQ ID NO: 61534 - DNA, 16 bp, H. sapiens
caatggcgagatctca

SEQ ID NO: 61535 - DNA, 16 bp, H. sapiens
caatggcgggtgcccc

SEQ ID NO: 61536 - DNA, 16 bp, H. sapiens
caatggcgtgatctcc

SEQ ID NO: 61537 - DNA, 16 bp, H. sapiens
caatggctcacacctg

SEQ ID NO: 61538 - DNA, 16 bp, H. sapiens
caatggctcacgcctg

SEQ ID NO: 61539 - DNA, 16 bp, H. sapiens
caatggctcacgtctg

SEQ ID NO: 61540 - DNA, 16 bp, H. sapiens
caatggctcatgcctg

SEQ ID NO: 61541 - DNA, 16 bp, H. sapiens
caatggctgagctaat

SEQ ID NO: 61542 - DNA, 16 bp, H. sapiens
caatggcttccagctc

SEQ ID NO: 61543 - DNA, 16 bp, H. sapiens
caatgggaaaagaaca

SEQ ID NO: 61544 - DNA, 16 bp, H. sapiens
caatgggaaaaggact

SEQ ID NO: 61545 - DNA, 16 bp, H. sapiens
caatgggattttctag

SEQ ID NO: 61546 - DNA, 16 bp, H. sapiens
caatggggaaaatgtc

SEQ ID NO: 61547 - DNA, 16 bp, H. sapiens
caatgggggaaaaaaa

SEQ ID NO: 61548 - DNA, 16 bp, H. sapiens
caatgggggtacaggt

SEQ ID NO: 61549 - DNA, 17 bp, H. sapiens
caatggtacaatctcag

SEQ ID NO: 61550 - DNA, 16 bp, H. sapiens
caatggtgagagcaca

SEQ ID NO: 61551 - DNA, 16 bp, H. sapiens
caatggttttcaagac

SEQ ID NO: 61552 - DNA, 16 bp, H. sapiens
caatgtaaataaataa

SEQ ID NO: 61553 - DNA, 16 bp, H. sapiens
caatgtaaatgtattt

SEQ ID NO: 61554 - DNA, 16 bp, H. sapiens
caatgtaacttttttt

SEQ ID NO: 61555 - DNA, 16 bp, H. sapiens
caatgtacaaaattca

SEQ ID NO: 61556 - DNA, 16 bp, H. sapiens
caatgtacactgtacc

SEQ ID NO: 61557 - DNA, 16 bp, H. sapiens
caatgtactccagcct

SEQ ID NO: 61558 - DNA, 16 bp, H. sapiens
caatgtagtaataata

SEQ ID NO: 61559 - DNA, 16 bp, H. sapiens
caatgtatgcatattt

SEQ ID NO: 61560 - DNA, 16 bp, H. sapiens
caatgtattgtattct

SEQ ID NO: 61561 - DNA, 16 bp, H. sapiens
caatgtatttcttttt

SEQ ID NO: 61562 - DNA, 16 bp, H. sapiens
caatgtcattttttca

SEQ ID NO: 61563 - DNA, 16 bp, H. sapiens
caatgtccagaaaagt

SEQ ID NO: 61564 - DNA, 16 bp, H. sapiens
caatgtctctgatgaa

SEQ ID NO: 61565 - DNA, 16 bp, H. sapiens
caatgtgacacatcat

SEQ ID NO: 61566 - DNA, 16 bp, H. sapiens
caatgtgactttgcag

SEQ ID NO: 61567 - DNA, 16 bp, H. sapiens
caatgtgaggacacag

SEQ ID NO: 61568 - DNA, 16 bp, H. sapiens
caatgtgatggcattt

SEQ ID NO: 61569 - DNA, 16 bp, H. sapiens
caatgtgattgtattt

SEQ ID NO: 61570 - DNA, 16 bp, H. sapiens
caatgtgatttatggt

SEQ ID NO: 61571 - DNA, 16 bp, H. sapiens
caatgtgctgtattca

SEQ ID NO: 61572 - DNA, 16 bp, H. sapiens
caatgtggatgaactt

SEQ ID NO: 61573 - DNA, 16 bp, H. sapiens
caatgtggatgcagct

SEQ ID NO: 61574 - DNA, 16 bp, H. sapiens
caatgtggatgggcac

SEQ ID NO: 61575 - DNA, 16 bp, H. sapiens
caatgtggcaaaacct

SEQ ID NO: 61576 - DNA, 16 bp, H. sapiens
caatgtggcccaggaa

SEQ ID NO: 61577 - DNA, 16 bp, H. sapiens
caatgtggtaaaacct

SEQ ID NO: 61578 - DNA, 16 bp, H. sapiens
caatgtgtgtataaat

SEQ ID NO: 61579 - DNA, 16 bp, H. sapiens
caatgttaacattttg

SEQ ID NO: 61580 - DNA, 16 bp, H. sapiens
caatgttatttattta

SEQ ID NO: 61581 - DNA, 16 bp, H. sapiens
caatgttgatggctgc

SEQ ID NO: 61582 - DNA, 16 bp, H. sapiens
caatgttgtgaaaatg

SEQ ID NO: 61583 - DNA, 16 bp, H. sapiens
caatgtttacagcatc

SEQ ID NO: 61584 - DNA, 16 bp, H. sapiens
caatgttttacagttt

SEQ ID NO: 61585 - DNA, 16 bp, H. sapiens
caatgttttatacttt

SEQ ID NO: 61586 - DNA, 16 bp, H. sapiens
caatgttttcttgtaa

SEQ ID NO: 61587 - DNA, 16 bp, H. sapiens
caatgttttgtttttg

SEQ ID NO: 61588 - DNA, 16 bp, H. sapiens
caattaaaacatttta

SEQ ID NO: 61589 - DNA, 16 bp, H. sapiens
caattaaaagacaaag

SEQ ID NO: 61590 - DNA, 24 bp, H. sapiens
caattaaaagacacagactggcaa

SEQ ID NO: 61591 - DNA, 16 bp, H. sapiens
caattaaacctccttc

SEQ ID NO: 61592 - DNA, 16 bp, H. sapiens
caattaaacctctctt

SEQ ID NO: 61593 - DNA, 16 bp, H. sapiens
caattaaacctctttt

SEQ ID NO: 61594 - DNA, 16 bp, H. sapiens
caattaaacttttttc

SEQ ID NO: 61595 - DNA, 16 bp, H. sapiens
caattaaatatctttt

SEQ ID NO: 61596 - DNA, 16 bp, H. sapiens
caattaaatttcaaca

SEQ ID NO: 61597 - DNA, 16 bp, H. sapiens
caattaagaaaatgaa

SEQ ID NO: 61598 - DNA, 16 bp, H. sapiens
caattacaacaaaagc

SEQ ID NO: 61599 - DNA, 16 bp, H. sapiens
caattacattttcaac

SEQ ID NO: 61600 - DNA, 16 bp, H. sapiens
caattacctccaacca

SEQ ID NO: 61601 - DNA, 16 bp, H. sapiens
caattactttttattc

SEQ ID NO: 61602 - DNA, 16 bp, H. sapiens
caattacttttttaaa

SEQ ID NO: 61603 - DNA, 16 bp, H. sapiens
caattagacttcctct

SEQ ID NO: 61604 - DNA, 16 bp, H. sapiens
caattataataaatgt

SEQ ID NO: 61605 - DNA, 16 bp, H. sapiens
caattatacctctttt

SEQ ID NO: 61606 - DNA, 16 bp, H. sapiens
caattatatgaaaaaa

SEQ ID NO: 61607 - DNA, 16 bp, H. sapiens
caattatcctgcctca

SEQ ID NO: 61608 - DNA, 16 bp, H. sapiens
caattatcttcacctg

SEQ ID NO: 61609 - DNA, 16 bp, H. sapiens
caattatggctcactg

SEQ ID NO: 61610 - DNA, 16 bp, H. sapiens
caattatgtaaaaagt

SEQ ID NO: 61611 - DNA, 16 bp, H. sapiens
caattatgtggaaatt

SEQ ID NO: 61612 - DNA, 16 bp, H. sapiens
caattatgtggttgat

SEQ ID NO: 61613 - DNA, 16 bp, H. sapiens
caattcaaaaagaaga

SEQ ID NO: 61614 - DNA, 16 bp, H. sapiens
caattcaaaatgaaat

SEQ ID NO: 61615 - DNA, 16 bp, H. sapiens
caattcaagatgaatt

SEQ ID NO: 61616 - DNA, 16 bp, H. sapiens
caattcaatagagaaa

SEQ ID NO: 61617 - DNA, 16 bp, H. sapiens
caattcaggatatgaa

SEQ ID NO: 61618 - DNA, 16 bp, H. sapiens
caattcaggatgagat

SEQ ID NO: 61619 - DNA, 16 bp, H. sapiens
caattcagtgattttt

SEQ ID NO: 61620 - DNA, 16 bp, H. sapiens
caattcagtggcattt

SEQ ID NO: 61621 - DNA, 16 bp, H. sapiens
caattcagtggtttta

SEQ ID NO: 61622 - DNA, 16 bp, H. sapiens
caattcattcatccat

SEQ ID NO: 61623 - DNA, 16 bp, H. sapiens
caattccacttccagg

SEQ ID NO: 61624 - DNA, 16 bp, H. sapiens
caattccagtccaaag

SEQ ID NO: 61625 - DNA, 16 bp, H. sapiens
caattccatgtggctg

SEQ ID NO: 61626 - DNA, 16 bp, H. sapiens
caattcccagagctca

SEQ ID NO: 61627 - DNA, 16 bp, H. sapiens
caattcccagctatga

SEQ ID NO: 61628 - DNA, 16 bp, H. sapiens
caattcccctgcctca

SEQ ID NO: 61629 - DNA, 17 bp, H. sapiens
caattcccctgcctcag

SEQ ID NO: 61630 - DNA, 16 bp, H. sapiens
caattcctggcctcaa

SEQ ID NO: 61631 - DNA, 16 bp, H. sapiens
caattcctgtaacctt

SEQ ID NO: 61632 - DNA, 16 bp, H. sapiens
caattctcatgttgaa

SEQ ID NO: 61633 - DNA, 16 bp, H. sapiens
caattctcctacctca

SEQ ID NO: 61634 - DNA, 16 bp, H. sapiens
caattctctgccccag

SEQ ID NO: 61635 - DNA, 16 bp, H. sapiens
caattctcttgcctca

SEQ ID NO: 61636 - DNA, 16 bp, H. sapiens
caattctgttgatctt

SEQ ID NO: 61637 - DNA, 16 bp, H. sapiens
caattctttgaagaaa

SEQ ID NO: 61638 - DNA, 16 bp, H. sapiens
caattgaacaagaaga

SEQ ID NO: 61639 - DNA, 16 bp, H. sapiens
caattgattttcaata

SEQ ID NO: 61640 - DNA, 16 bp, H. sapiens
caattgatttttgaaa

SEQ ID NO: 61641 - DNA, 16 bp, H. sapiens
caattgcagctcactg

SEQ ID NO: 61642 - DNA, 16 bp, H. sapiens
caattgccaaaaggtg

SEQ ID NO: 61643 - DNA, 16 bp, H. sapiens
caattgctgcagaata

SEQ ID NO: 61644 - DNA, 16 bp, H. sapiens
caattgcttttggggt

SEQ ID NO: 61645 - DNA, 16 bp, H. sapiens
caattggatatttgga

SEQ ID NO: 61646 - DNA, 16 bp, H. sapiens
caattgtcccaataat

SEQ ID NO: 61647 - DNA, 16 bp, H. sapiens
caattgtttatttctg

SEQ ID NO: 61648 - DNA, 16 bp, H. sapiens
caatttaagaaatcta

SEQ ID NO: 61649 - DNA, 16 bp, H. sapiens
caatttacaagggatg

SEQ ID NO: 61650 - DNA, 16 bp, H. sapiens
caatttacattccttt

SEQ ID NO: 61651 - DNA, 16 bp, H. sapiens
caatttactttttaaa

SEQ ID NO: 61652 - DNA, 16 bp, H. sapiens
caatttagaaaaagaa

SEQ ID NO: 61653 - DNA, 16 bp, H. sapiens
caatttagaaagttta

SEQ ID NO: 61654 - DNA, 16 bp, H. sapiens
caatttagccattcca

SEQ ID NO: 61655 - DNA, 16 bp, H. sapiens
caatttatccatctga

SEQ ID NO: 61656 - DNA, 16 bp, H. sapiens
caatttatctttgttt

SEQ ID NO: 61657 - DNA, 16 bp, H. sapiens
caatttattgtacatt

SEQ ID NO: 61658 - DNA, 16 bp, H. sapiens
caatttcaaaaagaaa

SEQ ID NO: 61659 - DNA, 16 bp, H. sapiens
caatttcatgataaaa

SEQ ID NO: 61660 - DNA, 16 bp, H. sapiens
caatttccacctccca

SEQ ID NO: 61661 - DNA, 16 bp, H. sapiens
caatttcctggccctc

SEQ ID NO: 61662 - DNA, 16 bp, H. sapiens
caatttccttttctgt

SEQ ID NO: 61663 - DNA, 16 bp, H. sapiens
caatttctacagaaaa

SEQ ID NO: 61664 - DNA, 16 bp, H. sapiens
caatttctaccaaaat

SEQ ID NO: 61665 - DNA, 16 bp, H. sapiens
caatttcttaaaataa

SEQ ID NO: 61666 - DNA, 16 bp, H. sapiens
caatttcttcatcaat

SEQ ID NO: 61667 - DNA, 16 bp, H. sapiens
caatttcttcatctat

SEQ ID NO: 61668 - DNA, 16 bp, H. sapiens
caatttctttaaaaaa

SEQ ID NO: 61669 - DNA, 16 bp, H. sapiens
caatttgaaaagaaaa

SEQ ID NO: 61670 - DNA, 16 bp, H. sapiens
caatttgacttcctca

SEQ ID NO: 61671 - DNA, 16 bp, H. sapiens
caatttgacttgctct

SEQ ID NO: 61672 - DNA, 16 bp, H. sapiens
caatttgactttcttt

SEQ ID NO: 61673 - DNA, 16 bp, H. sapiens
caatttgagaacattt

SEQ ID NO: 61674 - DNA, 16 bp, H. sapiens
caatttgcaaaagaaa

SEQ ID NO: 61675 - DNA, 16 bp, H. sapiens
caatttgtaaaaagca

SEQ ID NO: 61676 - DNA, 16 bp, H. sapiens
caatttgtcaatttct

SEQ ID NO: 61677 - DNA, 16 bp, H. sapiens
caatttgtgaaaaaca

SEQ ID NO: 61678 - DNA, 16 bp, H. sapiens
caattttaaatctttc

SEQ ID NO: 61679 - DNA, 16 bp, H. sapiens
caattttaagtataca

SEQ ID NO: 61680 - DNA, 16 bp, H. sapiens
caattttaatttcacc

SEQ ID NO: 61681 - DNA, 16 bp, H. sapiens
caattttacaagaaaa

SEQ ID NO: 61682 - DNA, 16 bp, H. sapiens
caattttagaacattt

SEQ ID NO: 61683 - DNA, 16 bp, H. sapiens
caattttagcagaatt

SEQ ID NO: 61684 - DNA, 16 bp, H. sapiens
caattttatatgtttt

SEQ ID NO: 61685 - DNA, 16 bp, H. sapiens
caattttatttgtaaa

SEQ ID NO: 61686 - DNA, 16 bp, H. sapiens
caattttcatttttgt

SEQ ID NO: 61687 - DNA, 16 bp, H. sapiens
caattttctggaagag

SEQ ID NO: 61688 - DNA, 16 bp, H. sapiens
caattttcttctgaat

SEQ ID NO: 61689 - DNA, 16 bp, H. sapiens
caattttgaaaaagaa

SEQ ID NO: 61690 - DNA, 16 bp, H. sapiens
caattttgaaagaagt

SEQ ID NO: 61691 - DNA, 16 bp, H. sapiens
caattttgaatctttc

SEQ ID NO: 61692 - DNA, 16 bp, H. sapiens
caattttgatgaagtc

SEQ ID NO: 61693 - DNA, 16 bp, H. sapiens
caattttgattttctt

SEQ ID NO: 61694 - DNA, 16 bp, H. sapiens
caattttggaacaggt

SEQ ID NO: 61695 - DNA, 16 bp, H. sapiens
caattttggattttgt

SEQ ID NO: 61696 - DNA, 16 bp, H. sapiens
caattttgtattttta

SEQ ID NO: 61697 - DNA, 16 bp, H. sapiens
caatttttaaaaactg

SEQ ID NO: 61698 - DNA, 16 bp, H. sapiens
caatttttaaaaatgt

SEQ ID NO: 61699 - DNA, 16 bp, H. sapiens
caatttttaaaatttg

SEQ ID NO: 61700 - DNA, 16 bp, H. sapiens
caatttttacttaaaa

SEQ ID NO: 61701 - DNA, 16 bp, H. sapiens
caatttttcaacttta

SEQ ID NO: 61702 - DNA, 16 bp, H. sapiens
caatttttcatttcat

SEQ ID NO: 61703 - DNA, 16 bp, H. sapiens
caatttttcccaccac

SEQ ID NO: 61704 - DNA, 16 bp, H. sapiens
caatttttctaactct

SEQ ID NO: 61705 - DNA, 16 bp, H. sapiens
caatttttcttctgca

SEQ ID NO: 61706 - DNA, 16 bp, H. sapiens
caattttttaaaaaag

SEQ ID NO: 61707 - DNA, 16 bp, H. sapiens
caattttttaaagaaa

SEQ ID NO: 61708 - DNA, 16 bp, H. sapiens
caattttttcagcacc

SEQ ID NO: 61709 - DNA, 16 bp, H. sapiens
caattttttgaatttt

SEQ ID NO: 61710 - DNA, 16 bp, H. sapiens
caattttttgcatttt

SEQ ID NO: 61711 - DNA, 16 bp, H. sapiens
caattttttttctgaa

SEQ ID NO: 61712 - DNA, 16 bp, H. sapiens
cacaaaaacatgtaca

SEQ ID NO: 61713 - DNA, 16 bp, H. sapiens
cacaaaaaggcaaata

SEQ ID NO: 61714 - DNA, 16 bp, H. sapiens
cacaaaaatggagaaa

SEQ ID NO: 61715 - DNA, 16 bp, H. sapiens
cacaaaaatgtgaata

SEQ ID NO: 61716 - DNA, 16 bp, H. sapiens
cacaaaaattagctgg

SEQ ID NO: 61717 - DNA, 19 bp, H. sapiens
cacaaaaattagctgggca

SEQ ID NO: 61718 - DNA, 16 bp, H. sapiens
cacaaaacaagtctca

SEQ ID NO: 61719 - DNA, 16 bp, H. sapiens
cacaaaaccacttttt

SEQ ID NO: 61720 - DNA, 16 bp, H. sapiens
cacaaaaccatttttc

SEQ ID NO: 61721 - DNA, 16 bp, H. sapiens
cacaaaaccttgtaca

SEQ ID NO: 61722 - DNA, 16 bp, H. sapiens
cacaaaagagcacata

SEQ ID NO: 61723 - DNA, 16 bp, H. sapiens
cacaaaagagcctgaa

SEQ ID NO: 61724 - DNA, 16 bp, H. sapiens
cacaaaagccaaaagg

SEQ ID NO: 61725 - DNA, 16 bp, H. sapiens
cacaaaaggaaatgag

SEQ ID NO: 61726 - DNA, 16 bp, H. sapiens
cacaaaaggaagccca

SEQ ID NO: 61727 - DNA, 16 bp, H. sapiens
cacaaaaggcctttga

SEQ ID NO: 61728 - DNA, 16 bp, H. sapiens
cacaaaataagtgaaa

SEQ ID NO: 61729 - DNA, 16 bp, H. sapiens
cacaaaatatatttct

SEQ ID NO: 61730 - DNA, 16 bp, H. sapiens
cacaaaattattctta

SEQ ID NO: 61731 - DNA, 16 bp, H. sapiens
cacaaaattattttaa

SEQ ID NO: 61732 - DNA, 25 bp, H. sapiens
cacaaacaaatggaagaatattcca

SEQ ID NO: 61733 - DNA, 47 bp, H. sapiens
cacaaacagagagccaaatcatgagtgaactcccattcacaattgct

SEQ ID NO: 61734 - DNA, 16 bp, H. sapiens
cacaaacatacatata

SEQ ID NO: 61735 - DNA, 16 bp, H. sapiens
cacaaaccagtttctc

SEQ ID NO: 61736 - DNA, 16 bp, H. sapiens
cacaaaccctgaaaaa

SEQ ID NO: 61737 - DNA, 16 bp, H. sapiens
cacaaacctttttttt

SEQ ID NO: 61738 - DNA, 16 bp, H. sapiens
cacaaactatgcatcc

SEQ ID NO: 61739 - DNA, 16 bp, H. sapiens
cacaaactcttccaaa

SEQ ID NO: 61740 - DNA, 16 bp, H. sapiens
cacaaactgggtggct

SEQ ID NO: 61741 - DNA, 16 bp, H. sapiens
cacaaacttggtggtt

SEQ ID NO: 61742 - DNA, 62 bp, H. sapiens
cacaaactttatcagtcctccaggcccaagttgactctttagctgcagttgtcctccaaaac

SEQ ID NO: 61743 - DNA, 16 bp, H. sapiens
cacaaagaaaataact

SEQ ID NO: 61744 - DNA, 16 bp, H. sapiens
cacaaagaagggaaca

SEQ ID NO: 61745 - DNA, 16 bp, H. sapiens
cacaaagaagtttatg

SEQ ID NO: 61746 - DNA, 16 bp, H. sapiens
cacaaagaatttcctt

SEQ ID NO: 61747 - DNA, 16 bp, H. sapiens
cacaaagacacataca

SEQ ID NO: 61748 - DNA, 16 bp, H. sapiens
cacaaagagaagccca

SEQ ID NO: 61749 - DNA, 16 bp, H. sapiens
cacaaagatggaaaca

SEQ ID NO: 61750 - DNA, 16 bp, H. sapiens
cacaaagcagtttttc

SEQ ID NO: 61751 - DNA, 16 bp, H. sapiens
cacaaaggaaaaatgc

SEQ ID NO: 61752 - DNA, 16 bp, H. sapiens
cacaaaggctggagtg

SEQ ID NO: 61753 - DNA, 16 bp, H. sapiens
cacaaagttaaaatta

SEQ ID NO: 61754 - DNA, 16 bp, H. sapiens
cacaaataaatgacaa

SEQ ID NO: 61755 - DNA, 16 bp, H. sapiens
cacaaataaatgataa

SEQ ID NO: 61756 - DNA, 16 bp, H. sapiens
cacaaataagtgagaa

SEQ ID NO: 61757 - DNA, 16 bp, H. sapiens
cacaaatagaaaatat

SEQ ID NO: 61758 - DNA, 16 bp, H. sapiens
cacaaataggttgaaa

SEQ ID NO: 61759 - DNA, 16 bp, H. sapiens
cacaaatattttattt

SEQ ID NO: 61760 - DNA, 16 bp, H. sapiens
cacaaatatttttaaa

SEQ ID NO: 61761 - DNA, 16 bp, H. sapiens
cacaaatggactaaaa

SEQ ID NO: 61762 - DNA, 16 bp, H. sapiens
cacaaatgggatctaa

SEQ ID NO: 61763 - DNA, 16 bp, H. sapiens
cacaaattcattatct

SEQ ID NO: 61764 - DNA, 16 bp, H. sapiens
cacaaattctacaaaa

SEQ ID NO: 61765 - DNA, 16 bp, H. sapiens
cacaacaatatttaaa

SEQ ID NO: 61766 - DNA, 16 bp, H. sapiens
cacaacacaaagaaat

SEQ ID NO: 61767 - DNA, 16 bp, H. sapiens
cacaacacatataaat

SEQ ID NO: 61768 - DNA, 16 bp, H. sapiens
cacaacaccatgccca

SEQ ID NO: 61769 - DNA, 16 bp, H. sapiens
cacaacacccagataa

SEQ ID NO: 61770 - DNA, 16 bp, H. sapiens
cacaacactgtgaatg

SEQ ID NO: 61771 - DNA, 16 bp, H. sapiens
cacaacacttctgaca

SEQ ID NO: 61772 - DNA, 16 bp, H. sapiens
cacaacacttgagctc

SEQ ID NO: 61773 - DNA, 16 bp, H. sapiens
cacaacagccttgtga

SEQ ID NO: 61774 - DNA, 16 bp, H. sapiens
cacaacagtgaacaaa

SEQ ID NO: 61775 - DNA, 16 bp, H. sapiens
cacaacatggtggctg

SEQ ID NO: 61776 - DNA, 16 bp, H. sapiens
cacaaccacatggaaa

SEQ ID NO: 61777 - DNA, 16 bp, H. sapiens
cacaaccagtaagagg

SEQ ID NO: 61778 - DNA, 16 bp, H. sapiens
cacaaccatgctcatt

SEQ ID NO: 61779 - DNA, 16 bp, H. sapiens
cacaacctctgcctct

SEQ ID NO: 61780 - DNA, 16 bp, H. sapiens
cacaacctgtaggtaa

SEQ ID NO: 61781 - DNA, 16 bp, H. sapiens
cacaactacatggaaa

SEQ ID NO: 61782 - DNA, 16 bp, H. sapiens
cacaactacttggaaa

SEQ ID NO: 61783 - DNA, 16 bp, H. sapiens
cacaactgcaccccag

SEQ ID NO: 61784 - DNA, 16 bp, H. sapiens
cacaactgtagtctca

SEQ ID NO: 61785 - DNA, 16 bp, H. sapiens
cacaacttcaccagca

SEQ ID NO: 61786 - DNA, 16 bp, H. sapiens
cacaacttggctaatt

SEQ ID NO: 61787 - DNA, 16 bp, H. sapiens
cacaacttttggaaat

SEQ ID NO: 61788 - DNA, 16 bp, H. sapiens
cacaagaaacattaaa

SEQ ID NO: 61789 - DNA, 16 bp, H. sapiens
cacaagaaagaattca

SEQ ID NO: 61790 - DNA, 16 bp, H. sapiens
cacaagaacagaaagc

SEQ ID NO: 61791 - DNA, 16 bp, H. sapiens
cacaagaagatcaacc

SEQ ID NO: 61792 - DNA, 16 bp, H. sapiens
cacaagaatcctttga

SEQ ID NO: 61793 - DNA, 16 bp, H. sapiens
cacaagactgggtaat

SEQ ID NO: 61794 - DNA, 16 bp, H. sapiens
cacaagagaaagcagc

SEQ ID NO: 61795 - DNA, 16 bp, H. sapiens
cacaagagaccacata

SEQ ID NO: 61796 - DNA, 16 bp, H. sapiens
cacaagagcaaaactc

SEQ ID NO: 61797 - DNA, 16 bp, H. sapiens
cacaagaggctgaggc

SEQ ID NO: 61798 - DNA, 16 bp, H. sapiens
cacaagagtgaaactc

SEQ ID NO: 61799 - DNA, 16 bp, H. sapiens
cacaagcacgcacaca

SEQ ID NO: 61800 - DNA, 16 bp, H. sapiens
cacaagcatttcttta

SEQ ID NO: 61801 - DNA, 16 bp, H. sapiens
cacaagcccctgcctc

SEQ ID NO: 61802 - DNA, 16 bp, H. sapiens
cacaagctgtacagga

SEQ ID NO: 61803 - DNA, 16 bp, H. sapiens
cacaagcttcagcagc

SEQ ID NO: 61804 - DNA, 16 bp, H. sapiens
cacaagcttggctcac

SEQ ID NO: 61805 - DNA, 16 bp, H. sapiens
cacaaggacacacaca

SEQ ID NO: 61806 - DNA, 16 bp, H. sapiens
cacaaggacagcatgg

SEQ ID NO: 61807 - DNA, 17 bp, H. sapiens
cacaaggcaaagggcaa

SEQ ID NO: 61808 - DNA, 16 bp, H. sapiens
cacaaggccagggcaa

SEQ ID NO: 61809 - DNA, 18 bp, H. sapiens
cacaagggtattgactgg

SEQ ID NO: 61810 - DNA, 16 bp, H. sapiens
cacaaggtcaggatca

SEQ ID NO: 61811 - DNA, 16 bp, H. sapiens
cacaagtgactccatt

SEQ ID NO: 61812 - DNA, 16 bp, H. sapiens
cacaagtgcacacaca

SEQ ID NO: 61813 - DNA, 16 bp, H. sapiens
cacaagtggaaaattc

SEQ ID NO: 61814 - DNA, 16 bp, H. sapiens
cacaagtgtgtgtgtg

SEQ ID NO: 61815 - DNA, 16 bp, H. sapiens
cacaataaaatatgat

SEQ ID NO: 61816 - DNA, 16 bp, H. sapiens
cacaataaccaagata

SEQ ID NO: 61817 - DNA, 16 bp, H. sapiens
cacaatacattgttat

SEQ ID NO: 61818 - DNA, 16 bp, H. sapiens
cacaatattggttctt

SEQ ID NO: 61819 - DNA, 16 bp, H. sapiens
cacaatcacacacata

SEQ ID NO: 61820 - DNA, 16 bp, H. sapiens
cacaatcatagcacac

SEQ ID NO: 61821 - DNA, 16 bp, H. sapiens
cacaatcatggcagaa

SEQ ID NO: 61822 - DNA, 16 bp, H. sapiens
cacaatcctaaaattt

SEQ ID NO: 61823 - DNA, 16 bp, H. sapiens
cacaatctcctgacct

SEQ ID NO: 61824 - DNA, 16 bp, H. sapiens
cacaatcttggctcat

SEQ ID NO: 61825 - DNA, 16 bp, H. sapiens
cacaatgaaatatcac

SEQ ID NO: 61826 - DNA, 16 bp, H. sapiens
cacaatgacaaaatcg

SEQ ID NO: 61827 - DNA, 16 bp, H. sapiens
cacaatgagaaggtgg

SEQ ID NO: 61828 - DNA, 16 bp, H. sapiens
cacaatgagataccac

SEQ ID NO: 61829 - DNA, 20 bp, H. sapiens
cacaatgagataccatctca

SEQ ID NO: 61830 - DNA, 16 bp, H. sapiens
cacaatgagatactat

SEQ ID NO: 61831 - DNA, 16 bp, H. sapiens
cacaatgagatgccat

SEQ ID NO: 61832 - DNA, 16 bp, H. sapiens
cacaatgatggtggaa

SEQ ID NO: 61833 - DNA, 16 bp, H. sapiens
cacaatgcaagcctcc

SEQ ID NO: 61834 - DNA, 16 bp, H. sapiens
cacaatgcctggcaca

SEQ ID NO: 61835 - DNA, 16 bp, H. sapiens
cacaatggaaaaagaa

SEQ ID NO: 61836 - DNA, 16 bp, H. sapiens
cacaatggaaagaaaa

SEQ ID NO: 61837 - DNA, 16 bp, H. sapiens
cacaatggcaaaatca

SEQ ID NO: 61838 - DNA, 16 bp, H. sapiens
cacaatggctgaatta

SEQ ID NO: 61839 - DNA, 16 bp, H. sapiens
cacaatggttcatgcc

SEQ ID NO: 61840 - DNA, 16 bp, H. sapiens
cacaatgtatacatat

SEQ ID NO: 61841 - DNA, 16 bp, H. sapiens
cacaattaaaagagct

SEQ ID NO: 61842 - DNA, 16 bp, H. sapiens
cacaattaattttgca

SEQ ID NO: 61843 - DNA, 16 bp, H. sapiens
cacaattactttttca

SEQ ID NO: 61844 - DNA, 16 bp, H. sapiens
cacaattatttttaaa

SEQ ID NO: 61845 - DNA, 16 bp, H. sapiens
cacaattcagccccta

SEQ ID NO: 61846 - DNA, 16 bp, H. sapiens
cacaattcagtccata

SEQ ID NO: 61847 - DNA, 16 bp, H. sapiens
cacaattgctacaaaa

SEQ ID NO: 61848 - DNA, 16 bp, H. sapiens
cacaatttatttattc

SEQ ID NO: 61849 - DNA, 16 bp, H. sapiens
cacaatttcagatcct

SEQ ID NO: 61850 - DNA, 16 bp, H. sapiens
cacaatttcatggaaa

SEQ ID NO: 61851 - DNA, 16 bp, H. sapiens
cacaatttgcaattac

SEQ ID NO: 61852 - DNA, 16 bp, H. sapiens
cacaatttgttgaaaa

SEQ ID NO: 61853 - DNA, 16 bp, H. sapiens
cacacaaaaaaattga

SEQ ID NO: 61854 - DNA, 16 bp, H. sapiens
cacacaaaaaatattt

SEQ ID NO: 61855 - DNA, 16 bp, H. sapiens
cacacaaaaaatgttt

SEQ ID NO: 61856 - DNA, 16 bp, H. sapiens
cacacaaaaacttgta

SEQ ID NO: 61857 - DNA, 16 bp, H. sapiens
cacacaaaaatcagtg

SEQ ID NO: 61858 - DNA, 16 bp, H. sapiens
cacacaaaagcctgca

SEQ ID NO: 61859 - DNA, 16 bp, H. sapiens
cacacaaacacatact

SEQ ID NO: 61860 - DNA, 16 bp, H. sapiens
cacacaaatacactca

SEQ ID NO: 61861 - DNA, 16 bp, H. sapiens
cacacaaatctcattt

SEQ ID NO: 61862 - DNA, 16 bp, H. sapiens
cacacaaatggaatca

SEQ ID NO: 61863 - DNA, 16 bp, H. sapiens
cacacaacatttatca

SEQ ID NO: 61864 - DNA, 16 bp, H. sapiens
cacacaaccagtaagt

SEQ ID NO: 61865 - DNA, 16 bp, H. sapiens
cacacaacctcccaag

SEQ ID NO: 61866 - DNA, 16 bp, H. sapiens
cacacaactaggaagt

SEQ ID NO: 61867 - DNA, 16 bp, H. sapiens
cacacaatatttatca

SEQ ID NO: 61868 - DNA, 16 bp, H. sapiens
cacacaatgaaatatt

SEQ ID NO: 61869 - DNA, 16 bp, H. sapiens
cacacaatgatgaaat

SEQ ID NO: 61870 - DNA, 16 bp, H. sapiens
cacacacaaaaaagta

SEQ ID NO: 61871 - DNA, 16 bp, H. sapiens
cacacacaaaaaatga

SEQ ID NO: 61872 - DNA, 16 bp, H. sapiens
cacacacaaaaaggta

SEQ ID NO: 61873 - DNA, 16 bp, H. sapiens
cacacacaaaataaag

SEQ ID NO: 61874 - DNA, 16 bp, H. sapiens
cacacacaaaatatat

SEQ ID NO: 61875 - DNA, 16 bp, H. sapiens
cacacacaaatgcaca

SEQ ID NO: 61876 - DNA, 16 bp, H. sapiens
cacacacaagtgcaca

SEQ ID NO: 61877 - DNA, 16 bp, H. sapiens
cacacacacaaaatct

SEQ ID NO: 61878 - DNA, 16 bp, H. sapiens
cacacacacaaagatg

SEQ ID NO: 61879 - DNA, 16 bp, H. sapiens
cacacacacaaatagg

SEQ ID NO: 61880 - DNA, 16 bp, H. sapiens
cacacacacaaatatt

SEQ ID NO: 61881 - DNA, 16 bp, H. sapiens
cacacacacaaattat

SEQ ID NO: 61882 - DNA, 16 bp, H. sapiens
cacacacacaataatt

SEQ ID NO: 61883 - DNA, 16 bp, H. sapiens
cacacacacaatttca

SEQ ID NO: 61884 - DNA, 16 bp, H. sapiens
cacacacacacaaagt

SEQ ID NO: 61885 - DNA, 16 bp, H. sapiens
cacacacacacaagct

SEQ ID NO: 61886 - DNA, 16 bp, H. sapiens
cacacacacacaatgg

SEQ ID NO: 61887 - DNA, 16 bp, H. sapiens
cacacacacacagaag

SEQ ID NO: 61888 - DNA, 16 bp, H. sapiens
cacacacacacagaat

SEQ ID NO: 61889 - DNA, 16 bp, H. sapiens
cacacacacacagagg

SEQ ID NO: 61890 - DNA, 16 bp, H. sapiens
cacacacacacagagt

SEQ ID NO: 61891 - DNA, 16 bp, H. sapiens
cacacacacacaggca

SEQ ID NO: 61892 - DNA, 16 bp, H. sapiens
cacacacacacagtaa

SEQ ID NO: 61893 - DNA, 16 bp, H. sapiens
cacacacacacagtca

SEQ ID NO: 61894 - DNA, 16 bp, H. sapiens
cacacacacacagtct

SEQ ID NO: 61895 - DNA, 16 bp, H. sapiens
cacacacacacatcta

SEQ ID NO: 61896 - DNA, 16 bp, H. sapiens
cacacacacacatgct

SEQ ID NO: 61897 - DNA, 16 bp, H. sapiens
cacacacacaccagag

SEQ ID NO: 61898 - DNA, 16 bp, H. sapiens
cacacacacaccatgc

SEQ ID NO: 61899 - DNA, 16 bp, H. sapiens
cacacacacacccctg

SEQ ID NO: 61900 - DNA, 16 bp, H. sapiens
cacacacacaccctgt

SEQ ID NO: 61901 - DNA, 16 bp, H. sapiens
cacacacacacctctg

SEQ ID NO: 61902 - DNA, 16 bp, H. sapiens
cacacacacacctggc

SEQ ID NO: 61903 - DNA, 16 bp, H. sapiens
cacacacacacctgta

SEQ ID NO: 61904 - DNA, 16 bp, H. sapiens
cacacacacacgaatc

SEQ ID NO: 61905 - DNA, 16 bp, H. sapiens
cacacacacacgatat

SEQ ID NO: 61906 - DNA, 16 bp, H. sapiens
cacacacacacgatgg

SEQ ID NO: 61907 - DNA, 16 bp, H. sapiens
cacacacacacgccct

SEQ ID NO: 61908 - DNA, 16 bp, H. sapiens
cacacacacacgcttc

SEQ ID NO: 61909 - DNA, 16 bp, H. sapiens
cacacacacacggaag

SEQ ID NO: 61910 - DNA, 16 bp, H. sapiens
cacacacacacggact

SEQ ID NO: 61911 - DNA, 16 bp, H. sapiens
cacacacacacgtaca

SEQ ID NO: 61912 - DNA, 16 bp, H. sapiens
cacacacacactccat

SEQ ID NO: 61913 - DNA, 16 bp, H. sapiens
cacacacacactccta

SEQ ID NO: 61914 - DNA, 16 bp, H. sapiens
cacacacacactctca

SEQ ID NO: 61915 - DNA, 16 bp, H. sapiens
cacacacacactctta

SEQ ID NO: 61916 - DNA, 16 bp, H. sapiens
cacacacacacttcct

SEQ ID NO: 61917 - DNA, 16 bp, H. sapiens
cacacacacacttgtg

SEQ ID NO: 61918 - DNA, 16 bp, H. sapiens
cacacacacactttca

SEQ ID NO: 61919 - DNA, 16 bp, H. sapiens
cacacacacacttttg

SEQ ID NO: 61920 - DNA, 16 bp, H. sapiens
cacacacacagaaaat

SEQ ID NO: 61921 - DNA, 16 bp, H. sapiens
cacacacacagaaatt

SEQ ID NO: 61922 - DNA, 16 bp, H. sapiens
cacacacacagaagga

SEQ ID NO: 61923 - DNA, 16 bp, H. sapiens
cacacacacagacacg

SEQ ID NO: 61924 - DNA, 16 bp, H. sapiens
cacacacacagagaca

SEQ ID NO: 61925 - DNA, 16 bp, H. sapiens
cacacacacagagata

SEQ ID NO: 61926 - DNA, 16 bp, H. sapiens
cacacacacagaggca

SEQ ID NO: 61927 - DNA, 16 bp, H. sapiens
cacacacacagataaa

SEQ ID NO: 61928 - DNA, 16 bp, H. sapiens
cacacacacagcagtg

SEQ ID NO: 61929 - DNA, 16 bp, H. sapiens
cacacacacagcccag

SEQ ID NO: 61930 - DNA, 16 bp, H. sapiens
cacacacacagccctt

SEQ ID NO: 61931 - DNA, 16 bp, H. sapiens
cacacacacagcctct

SEQ ID NO: 61932 - DNA, 16 bp, H. sapiens
cacacacacagctctg

SEQ ID NO: 61933 - DNA, 16 bp, H. sapiens
cacacacacaggcaca

SEQ ID NO: 61934 - DNA, 16 bp, H. sapiens
cacacacacagtgcac

SEQ ID NO: 61935 - DNA, 16 bp, H. sapiens
cacacacacataagca

SEQ ID NO: 61936 - DNA, 16 bp, H. sapiens
cacacacacatacaga

SEQ ID NO: 61937 - DNA, 16 bp, H. sapiens
cacacacacatacatc

SEQ ID NO: 61938 - DNA, 16 bp, H. sapiens
cacacacacatacatg

SEQ ID NO: 61939 - DNA, 16 bp, H. sapiens
cacacacacataccat

SEQ ID NO: 61940 - DNA, 16 bp, H. sapiens
cacacacacatacttt

SEQ ID NO: 61941 - DNA, 16 bp, H. sapiens
cacacacacatatatt

SEQ ID NO: 61942 - DNA, 16 bp, H. sapiens
cacacacacatcccta

SEQ ID NO: 61943 - DNA, 16 bp, H. sapiens
cacacacacatctcac

SEQ ID NO: 61944 - DNA, 16 bp, H. sapiens
cacacacacatgcatg

SEQ ID NO: 61945 - DNA, 16 bp, H. sapiens
cacacacacatgctgg

SEQ ID NO: 61946 - DNA, 16 bp, H. sapiens
cacacacacatgtgtg

SEQ ID NO: 61947 - DNA, 16 bp, H. sapiens
cacacacacattatta

SEQ ID NO: 61948 - DNA, 16 bp, H. sapiens
cacacacacatttcct

SEQ ID NO: 61949 - DNA, 16 bp, H. sapiens
cacacacacattttgt

SEQ ID NO: 61950 - DNA, 16 bp, H. sapiens
cacacacaccacatat

SEQ ID NO: 61951 - DNA, 16 bp, H. sapiens
cacacacaccatggaa

SEQ ID NO: 61952 - DNA, 16 bp, H. sapiens
cacacacaccccatgc

SEQ ID NO: 61953 - DNA, 16 bp, H. sapiens
cacacacacccctcag

SEQ ID NO: 61954 - DNA, 16 bp, H. sapiens
cacacacacccctgca

SEQ ID NO: 61955 - DNA, 16 bp, H. sapiens
cacacacaccctgcac

SEQ ID NO: 61956 - DNA, 16 bp, H. sapiens
cacacacacgaataca

SEQ ID NO: 61957 - DNA, 16 bp, H. sapiens
cacacacacgcacgca

SEQ ID NO: 61958 - DNA, 16 bp, H. sapiens
cacacacacgcacgta

SEQ ID NO: 61959 - DNA, 16 bp, H. sapiens
cacacacacgcatgca

SEQ ID NO: 61960 - DNA, 16 bp, H. sapiens
cacacacacgcgcaca

SEQ ID NO: 61961 - DNA, 16 bp, H. sapiens
cacacacacgtgcgtg

SEQ ID NO: 61962 - DNA, 16 bp, H. sapiens
cacacacactcacact

SEQ ID NO: 61963 - DNA, 16 bp, H. sapiens
cacacacactccttca

SEQ ID NO: 61964 - DNA, 16 bp, H. sapiens
cacacacactccttcc

SEQ ID NO: 61965 - DNA, 16 bp, H. sapiens
cacacacactctctca

SEQ ID NO: 61966 - DNA, 16 bp, H. sapiens
cacacacactcttaca

SEQ ID NO: 61967 - DNA, 16 bp, H. sapiens
cacacacactgtcaca

SEQ ID NO: 61968 - DNA, 16 bp, H. sapiens
cacacacacttgtgca

SEQ ID NO: 61969 - DNA, 16 bp, H. sapiens
cacacacagaagagaa

SEQ ID NO: 61970 - DNA, 16 bp, H. sapiens
cacacacagaataacc

SEQ ID NO: 61971 - DNA, 16 bp, H. sapiens
cacacacagacacaga

SEQ ID NO: 61972 - DNA, 16 bp, H. sapiens
cacacacagacacatg

SEQ ID NO: 61973 - DNA, 16 bp, H. sapiens
cacacacagagacacg

SEQ ID NO: 61974 - DNA, 16 bp, H. sapiens
cacacacagaggaaga

SEQ ID NO: 61975 - DNA, 16 bp, H. sapiens
cacacacagaggagag

SEQ ID NO: 61976 - DNA, 16 bp, H. sapiens
cacacacagatgcata

SEQ ID NO: 61977 - DNA, 16 bp, H. sapiens
cacacacagctaattt

SEQ ID NO: 61978 - DNA, 16 bp, H. sapiens
cacacacaggcacaca

SEQ ID NO: 61979 - DNA, 16 bp, H. sapiens
cacacacagtcacaca

SEQ ID NO: 61980 - DNA, 16 bp, H. sapiens
cacacacataaaaaga

SEQ ID NO: 61981 - DNA, 17 bp, H. sapiens
cacacacatacacagat

SEQ ID NO: 61982 - DNA, 16 bp, H. sapiens
cacacacatacactcc

SEQ ID NO: 61983 - DNA, 16 bp, H. sapiens
cacacacatacatacc

SEQ ID NO: 61984 - DNA, 16 bp, H. sapiens
cacacacatactcatg

SEQ ID NO: 61985 - DNA, 16 bp, H. sapiens
cacacacatatactta

SEQ ID NO: 61986 - DNA, 16 bp, H. sapiens
cacacacatatatcac

SEQ ID NO: 61987 - DNA, 16 bp, H. sapiens
cacacacatatatgaa

SEQ ID NO: 61988 - DNA, 16 bp, H. sapiens
cacacacatatcacat

SEQ ID NO: 61989 - DNA, 16 bp, H. sapiens
cacacacatcacacat

SEQ ID NO: 61990 - DNA, 16 bp, H. sapiens
cacacacatcacatca

SEQ ID NO: 61991 - DNA, 16 bp, H. sapiens
cacacacatctgcaca

SEQ ID NO: 61992 - DNA, 16 bp, H. sapiens
cacacacatgcaaaca

SEQ ID NO: 61993 - DNA, 16 bp, H. sapiens
cacacacatgcatttt

SEQ ID NO: 61994 - DNA, 16 bp, H. sapiens
cacacacatgcccaca

SEQ ID NO: 61995 - DNA, 16 bp, H. sapiens
cacacacatgtgcaca

SEQ ID NO: 61996 - DNA, 16 bp, H. sapiens
cacacacattctcaca

SEQ ID NO: 61997 - DNA, 16 bp, H. sapiens
cacacacatttttata

SEQ ID NO: 61998 - DNA, 16 bp, H. sapiens
cacacacatttttctt

SEQ ID NO: 61999 - DNA, 16 bp, H. sapiens
cacacaccacacatgc

SEQ ID NO: 62000 - DNA, 16 bp, H. sapiens
cacacaccaccacgct

SEQ ID NO: 62001 - DNA, 16 bp, H. sapiens
cacacaccaccatgct

SEQ ID NO: 62002 - DNA, 16 bp, H. sapiens
cacacaccaggccctg

SEQ ID NO: 62003 - DNA, 16 bp, H. sapiens
cacacaccctgcacac

SEQ ID NO: 62004 - DNA, 16 bp, H. sapiens
cacacaccgggtcctg

SEQ ID NO: 62005 - DNA, 16 bp, H. sapiens
cacacacctgcacaca

SEQ ID NO: 62006 - DNA, 16 bp, H. sapiens
cacacacctgtaatcg

SEQ ID NO: 62007 - DNA, 16 bp, H. sapiens
cacacacctgtaggcc

SEQ ID NO: 62008 - DNA, 16 bp, H. sapiens
cacacacctgttatcc

SEQ ID NO: 62009 - DNA, 16 bp, H. sapiens
cacacacgcacacacg

SEQ ID NO: 62010 - DNA, 16 bp, H. sapiens
cacacacgcgcgcgcg

SEQ ID NO: 62011 - DNA, 16 bp, H. sapiens
cacacacgtgcacaca

SEQ ID NO: 62012 - DNA, 16 bp, H. sapiens
cacacacgtgcacaga

SEQ ID NO: 62013 - DNA, 16 bp, H. sapiens
cacacacgtgctcaca

SEQ ID NO: 62014 - DNA, 16 bp, H. sapiens
cacacactcatgcaca

SEQ ID NO: 62015 - DNA, 16 bp, H. sapiens
cacacactgggaccta

SEQ ID NO: 62016 - DNA, 16 bp, H. sapiens
cacacagaaaattaaa

SEQ ID NO: 62017 - DNA, 16 bp, H. sapiens
cacacagaaatacaaa

SEQ ID NO: 62018 - DNA, 16 bp, H. sapiens
cacacagaaatataaa

SEQ ID NO: 62019 - DNA, 16 bp, H. sapiens
cacacagaatagtttt

SEQ ID NO: 62020 - DNA, 16 bp, H. sapiens
cacacagacacacaga

SEQ ID NO: 62021 - DNA, 16 bp, H. sapiens
cacacagacacacatg

SEQ ID NO: 62022 - DNA, 16 bp, H. sapiens
cacacagacacagaca

SEQ ID NO: 62023 - DNA, 16 bp, H. sapiens
cacacagacacatgca

SEQ ID NO: 62024 - DNA, 16 bp, H. sapiens
cacacagacatacaca

SEQ ID NO: 62025 - DNA, 16 bp, H. sapiens
cacacagacatgggga

SEQ ID NO: 62026 - DNA, 16 bp, H. sapiens
cacacagacgcacaca

SEQ ID NO: 62027 - DNA, 16 bp, H. sapiens
cacacagagacccagg

SEQ ID NO: 62028 - DNA, 16 bp, H. sapiens
cacacagagagaaata

SEQ ID NO: 62029 - DNA, 16 bp, H. sapiens
cacacagaggagaagc

SEQ ID NO: 62030 - DNA, 16 bp, H. sapiens
cacacagatgcacaca

SEQ ID NO: 62031 - DNA, 16 bp, H. sapiens
cacacagatgctcaca

SEQ ID NO: 62032 - DNA, 16 bp, H. sapiens
cacacagcattgcttc

SEQ ID NO: 62033 - DNA, 16 bp, H. sapiens
cacacagctagtgaag

SEQ ID NO: 62034 - DNA, 16 bp, H. sapiens
cacacagctgataaat

SEQ ID NO: 62035 - DNA, 16 bp, H. sapiens
cacacaggacagcccc

SEQ ID NO: 62036 - DNA, 16 bp, H. sapiens
cacacaggagagaaac

SEQ ID NO: 62037 - DNA, 16 bp, H. sapiens
cacacaggcacacgca

SEQ ID NO: 62038 - DNA, 16 bp, H. sapiens
cacacagggacacaca

SEQ ID NO: 62039 - DNA, 16 bp, H. sapiens
cacacagtaagatctc

SEQ ID NO: 62040 - DNA, 16 bp, H. sapiens
cacacagtaggtgctt

SEQ ID NO: 62041 - DNA, 16 bp, H. sapiens
cacacagtgctgattg

SEQ ID NO: 62042 - DNA, 16 bp, H. sapiens
cacacagtggctcaca

SEQ ID NO: 62043 - DNA, 16 bp, H. sapiens
cacacatacaatacac

SEQ ID NO: 62044 - DNA, 16 bp, H. sapiens
cacacatacacacacg

SEQ ID NO: 62045 - DNA, 16 bp, H. sapiens
cacacatacacactct

SEQ ID NO: 62046 - DNA, 16 bp, H. sapiens
cacacatacacactgt

SEQ ID NO: 62047 - DNA, 16 bp, H. sapiens
cacacatacacagaca

SEQ ID NO: 62048 - DNA, 16 bp, H. sapiens
cacacatacacatgga

SEQ ID NO: 62049 - DNA, 16 bp, H. sapiens
cacacatacactcaca

SEQ ID NO: 62050 - DNA, 16 bp, H. sapiens
cacacatacaggcaca

SEQ ID NO: 62051 - DNA, 18 bp, H. sapiens
cacacatacatacacata

SEQ ID NO: 62052 - DNA, 16 bp, H. sapiens
cacacatacatgcaca

SEQ ID NO: 62053 - DNA, 16 bp, H. sapiens
cacacatacgcacaca

SEQ ID NO: 62054 - DNA, 16 bp, H. sapiens
cacacatactcacata

SEQ ID NO: 62055 - DNA, 16 bp, H. sapiens
cacacatatacatgta

SEQ ID NO: 62056 - DNA, 16 bp, H. sapiens
cacacatatatatata

SEQ ID NO: 62057 - DNA, 16 bp, H. sapiens
cacacatatatgcaca

SEQ ID NO: 62058 - DNA, 16 bp, H. sapiens
cacacatatcacacat

SEQ ID NO: 62059 - DNA, 16 bp, H. sapiens
cacacatatgtgtatt

SEQ ID NO: 62060 - DNA, 16 bp, H. sapiens
cacacatcattgctgg

SEQ ID NO: 62061 - DNA, 16 bp, H. sapiens
cacacatctgtagtcc

SEQ ID NO: 62062 - DNA, 16 bp, H. sapiens
cacacatgaaaaaatg

SEQ ID NO: 62063 - DNA, 16 bp, H. sapiens
cacacatgcacacaca

SEQ ID NO: 62064 - DNA, 16 bp, H. sapiens
cacacatgcacacacc

SEQ ID NO: 62065 - DNA, 16 bp, H. sapiens
cacacatgcacacacg

SEQ ID NO: 62066 - DNA, 16 bp, H. sapiens
cacacatgcacacaga

SEQ ID NO: 62067 - DNA, 16 bp, H. sapiens
cacacatgcacactca

SEQ ID NO: 62068 - DNA, 16 bp, H. sapiens
cacacatgcacatgga

SEQ ID NO: 62069 - DNA, 16 bp, H. sapiens
cacacatgcatgtaca

SEQ ID NO: 62070 - DNA, 16 bp, H. sapiens
cacacatgcgtacaca

SEQ ID NO: 62071 - DNA, 16 bp, H. sapiens
cacacatgcgtgtgca

SEQ ID NO: 62072 - DNA, 16 bp, H. sapiens
cacacatggacacaca

SEQ ID NO: 62073 - DNA, 16 bp, H. sapiens
cacacatggctaattt

SEQ ID NO: 62074 - DNA, 16 bp, H. sapiens
cacacatggctagtgg

SEQ ID NO: 62075 - DNA, 16 bp, H. sapiens
cacacatgggcacaca

SEQ ID NO: 62076 - DNA, 16 bp, H. sapiens
cacacatgtacacaca

SEQ ID NO: 62077 - DNA, 16 bp, H. sapiens
cacacatgtatacaca

SEQ ID NO: 62078 - DNA, 16 bp, H. sapiens
cacacatgtatgtgta

SEQ ID NO: 62079 - DNA, 16 bp, H. sapiens
cacacatgtgtataca

SEQ ID NO: 62080 - DNA, 16 bp, H. sapiens
cacacatttaaaaaat

SEQ ID NO: 62081 - DNA, 16 bp, H. sapiens
cacacatttactgagc

SEQ ID NO: 62082 - DNA, 16 bp, H. sapiens
cacacatttctttcag

SEQ ID NO: 62083 - DNA, 16 bp, H. sapiens
cacacatttttaaaat

SEQ ID NO: 62084 - DNA, 16 bp, H. sapiens
cacaccaacctgggtg

SEQ ID NO: 62085 - DNA, 16 bp, H. sapiens
cacaccaccctccagg

SEQ ID NO: 62086 - DNA, 16 bp, H. sapiens
cacaccagccccctgc

SEQ ID NO: 62087 - DNA, 16 bp, H. sapiens
cacaccagctaatttt

SEQ ID NO: 62088 - DNA, 16 bp, H. sapiens
cacaccagggtctgtc

SEQ ID NO: 62089 - DNA, 16 bp, H. sapiens
cacaccatagcttctg

SEQ ID NO: 62090 - DNA, 16 bp, H. sapiens
cacaccatgcactcca

SEQ ID NO: 62091 - DNA, 16 bp, H. sapiens
cacacccaagggggcc

SEQ ID NO: 62092 - DNA, 16 bp, H. sapiens
cacacccacacctgca

SEQ ID NO: 62093 - DNA, 16 bp, H. sapiens
cacacccagaaggaag

SEQ ID NO: 62094 - DNA, 16 bp, H. sapiens
cacacccagcaatttt

SEQ ID NO: 62095 - DNA, 16 bp, H. sapiens
cacacccagccaacag

SEQ ID NO: 62096 - DNA, 16 bp, H. sapiens
cacacccagcccagat

SEQ ID NO: 62097 - DNA, 16 bp, H. sapiens
cacacccagcccaggc

SEQ ID NO: 62098 - DNA, 16 bp, H. sapiens
cacacccagccctgtt

SEQ ID NO: 62099 - DNA, 16 bp, H. sapiens
cacacccagcctgtct

SEQ ID NO: 62100 - DNA, 16 bp, H. sapiens
cacacccagcctgtga

SEQ ID NO: 62101 - DNA, 16 bp, H. sapiens
cacacccagctacttt

SEQ ID NO: 62102 - DNA, 16 bp, H. sapiens
cacacccagctctttt

SEQ ID NO: 62103 - DNA, 16 bp, H. sapiens
cacacccaggctggag

SEQ ID NO: 62104 - DNA, 16 bp, H. sapiens
cacacccataatccca

SEQ ID NO: 62105 - DNA, 16 bp, H. sapiens
cacacccccaggggag

SEQ ID NO: 62106 - DNA, 16 bp, H. sapiens
cacaccccggggcctg

SEQ ID NO: 62107 - DNA, 17 bp, H. sapiens
cacacccgggtaatttt

SEQ ID NO: 62108 - DNA, 16 bp, H. sapiens
cacaccctgctcctga

SEQ ID NO: 62109 - DNA, 17 bp, H. sapiens
cacaccctgggcctggt

SEQ ID NO: 62110 - DNA, 16 bp, H. sapiens
cacaccctggggcctg

SEQ ID NO: 62111 - DNA, 16 bp, H. sapiens
cacacctagctgcaag

SEQ ID NO: 62112 - DNA, 16 bp, H. sapiens
cacacctataatccta

SEQ ID NO: 62113 - DNA, 16 bp, H. sapiens
cacacctattcacaca

SEQ ID NO: 62114 - DNA, 16 bp, H. sapiens
cacacctctacaacca

SEQ ID NO: 62115 - DNA, 16 bp, H. sapiens
cacacctctgtatttc

SEQ ID NO: 62116 - DNA, 16 bp, H. sapiens
cacacctgcactccag

SEQ ID NO: 62117 - DNA, 16 bp, H. sapiens
cacacctgcggtccca

SEQ ID NO: 62118 - DNA, 16 bp, H. sapiens
cacacctggccaagga

SEQ ID NO: 62119 - DNA, 16 bp, H. sapiens
cacacctggccaggct

SEQ ID NO: 62120 - DNA, 16 bp, H. sapiens
cacacctggccctaat

SEQ ID NO: 62121 - DNA, 16 bp, H. sapiens
cacacctggcctattt

SEQ ID NO: 62122 - DNA, 16 bp, H. sapiens
cacacctggcctcaca

SEQ ID NO: 62123 - DNA, 16 bp, H. sapiens
cacacctggcctgaat

SEQ ID NO: 62124 - DNA, 16 bp, H. sapiens
cacacctggctaactt

SEQ ID NO: 62125 - DNA, 16 bp, H. sapiens
cacacctggctgggtt

SEQ ID NO: 62126 - DNA, 16 bp, H. sapiens
cacacctggtctggct

SEQ ID NO: 62127 - DNA, 16 bp, H. sapiens
cacacctgtaacccca

SEQ ID NO: 62128 - DNA, 16 bp, H. sapiens
cacacctgtaactcca

SEQ ID NO: 62129 - DNA, 16 bp, H. sapiens
cacacctgtacagcat

SEQ ID NO: 62130 - DNA, 16 bp, H. sapiens
cacacctgtagtccct

SEQ ID NO: 62131 - DNA, 16 bp, H. sapiens
cacacctgtatttcca

SEQ ID NO: 62132 - DNA, 16 bp, H. sapiens
cacacctgtgcacaca

SEQ ID NO: 62133 - DNA, 16 bp, H. sapiens
cacacctgtggcccca

SEQ ID NO: 62134 - DNA, 16 bp, H. sapiens
cacaccttgatttcag

SEQ ID NO: 62135 - DNA, 16 bp, H. sapiens
cacacgcacacatgca

SEQ ID NO: 62136 - DNA, 16 bp, H. sapiens
cacacgcacacgcaca

SEQ ID NO: 62137 - DNA, 16 bp, H. sapiens
cacacgcacatgcaca

SEQ ID NO: 62138 - DNA, 16 bp, H. sapiens
cacacgcacgcacgca

SEQ ID NO: 62139 - DNA, 16 bp, H. sapiens
cacacgcatacacaca

SEQ ID NO: 62140 - DNA, 16 bp, H. sapiens
cacacgccaccaggcc

SEQ ID NO: 62141 - DNA, 16 bp, H. sapiens
cacacgcgtgcacaca

SEQ ID NO: 62142 - DNA, 16 bp, H. sapiens
cacacgctcacacaca

SEQ ID NO: 62143 - DNA, 16 bp, H. sapiens
cacacggacacacatg

SEQ ID NO: 62144 - DNA, 16 bp, H. sapiens
cacacgtacacacact

SEQ ID NO: 62145 - DNA, 16 bp, H. sapiens
cacacgtgcacacacg

SEQ ID NO: 62146 - DNA, 16 bp, H. sapiens
cacactaagctccctg

SEQ ID NO: 62147 - DNA, 16 bp, H. sapiens
cacactcaagtttgag

SEQ ID NO: 62148 - DNA, 16 bp, H. sapiens
cacactcacacacact

SEQ ID NO: 62149 - DNA, 16 bp, H. sapiens
cacactcacacacata

SEQ ID NO: 62150 - DNA, 16 bp, H. sapiens
cacactcacacactca

SEQ ID NO: 62151 - DNA, 16 bp, H. sapiens
cacactcacacgcaca

SEQ ID NO: 62152 - DNA, 16 bp, H. sapiens
cacactcacgcacaca

SEQ ID NO: 62153 - DNA, 16 bp, H. sapiens
cacactcactcactgc

SEQ ID NO: 62154 - DNA, 16 bp, H. sapiens
cacactcatacactca

SEQ ID NO: 62155 - DNA, 16 bp, H. sapiens
cacactcatttgttta

SEQ ID NO: 62156 - DNA, 16 bp, H. sapiens
cacactccagcctagg

SEQ ID NO: 62157 - DNA, 16 bp, H. sapiens
cacactccagcctgag

SEQ ID NO: 62158 - DNA, 16 bp, H. sapiens
cacactccagcctggg

SEQ ID NO: 62159 - DNA, 16 bp, H. sapiens
cacactgaagaatgca

SEQ ID NO: 62160 - DNA, 16 bp, H. sapiens
cacactgaatggggaa

SEQ ID NO: 62161 - DNA, 16 bp, H. sapiens
cacactgatgagtctt

SEQ ID NO: 62162 - DNA, 16 bp, H. sapiens
cacactgatttttaaa

SEQ ID NO: 62163 - DNA, 16 bp, H. sapiens
cacactgctataaata

SEQ ID NO: 62164 - DNA, 16 bp, H. sapiens
cacactggaagaagaa

SEQ ID NO: 62165 - DNA, 16 bp, H. sapiens
cacactggacagcaca

SEQ ID NO: 62166 - DNA, 16 bp, H. sapiens
cacactggagagaaac

SEQ ID NO: 62167 - DNA, 16 bp, H. sapiens
cacactggagagaagc

SEQ ID NO: 62168 - DNA, 16 bp, H. sapiens
cacactggcctccctg

SEQ ID NO: 62169 - DNA, 16 bp, H. sapiens
cacactggcctctctc

SEQ ID NO: 62170 - DNA, 16 bp, H. sapiens
cacactggctgctgtg

SEQ ID NO: 62171 - DNA, 16 bp, H. sapiens
cacactggtggtggtg

SEQ ID NO: 62172 - DNA, 16 bp, H. sapiens
cacactgtatacatat

SEQ ID NO: 62173 - DNA, 16 bp, H. sapiens
cacactgtcacctggg

SEQ ID NO: 62174 - DNA, 16 bp, H. sapiens
cacactgtggaagggg

SEQ ID NO: 62175 - DNA, 16 bp, H. sapiens
cacactgtggaagttt

SEQ ID NO: 62176 - DNA, 16 bp, H. sapiens
cacactgtggggactg

SEQ ID NO: 62177 - DNA, 16 bp, H. sapiens
cacactgttataaaga

SEQ ID NO: 62178 - DNA, 16 bp, H. sapiens
cacactgttggtggga

SEQ ID NO: 62179 - DNA, 16 bp, H. sapiens
cacactgtttttcata

SEQ ID NO: 62180 - DNA, 16 bp, H. sapiens
cacactgttttttttt

SEQ ID NO: 62181 - DNA, 16 bp, H. sapiens
cacacttaaagcagtg

SEQ ID NO: 62182 - DNA, 16 bp, H. sapiens
cacacttgtgcacaca

SEQ ID NO: 62183 - DNA, 16 bp, H. sapiens
cacactttatttttat

SEQ ID NO: 62184 - DNA, 16 bp, H. sapiens
cacactttgagaacca

SEQ ID NO: 62185 - DNA, 16 bp, H. sapiens
cacactttgggaacca

SEQ ID NO: 62186 - DNA, 16 bp, H. sapiens
cacactttgggaggcc

SEQ ID NO: 62187 - DNA, 16 bp, H. sapiens
cacagaaaaacctgta

SEQ ID NO: 62188 - DNA, 16 bp, H. sapiens
cacagaaaaagcatct

SEQ ID NO: 62189 - DNA, 16 bp, H. sapiens
cacagaaaaagcattc

SEQ ID NO: 62190 - DNA, 16 bp, H. sapiens
cacagaaaaattttaa

SEQ ID NO: 62191 - DNA, 16 bp, H. sapiens
cacagaaaagttgaaa

SEQ ID NO: 62192 - DNA, 16 bp, H. sapiens
cacagaaacatacaca

SEQ ID NO: 62193 - DNA, 16 bp, H. sapiens
cacagaaagacaaata

SEQ ID NO: 62194 - DNA, 16 bp, H. sapiens
cacagaaagccagtca

SEQ ID NO: 62195 - DNA, 16 bp, H. sapiens
cacagaaatacaaaca

SEQ ID NO: 62196 - DNA, 16 bp, H. sapiens
cacagaaatacaaata

SEQ ID NO: 62197 - DNA, 16 bp, H. sapiens
cacagaaatcaagaat

SEQ ID NO: 62198 - DNA, 16 bp, H. sapiens
cacagaaatggaaaat

SEQ ID NO: 62199 - DNA, 16 bp, H. sapiens
cacagaaatgttaagt

SEQ ID NO: 62200 - DNA, 16 bp, H. sapiens
cacagaacaggagaaa

SEQ ID NO: 62201 - DNA, 16 bp, H. sapiens
cacagaacataaaatt

SEQ ID NO: 62202 - DNA, 16 bp, H. sapiens
cacagaacatttacca

SEQ ID NO: 62203 - DNA, 16 bp, H. sapiens
cacagaacgggagaaa

SEQ ID NO: 62204 - DNA, 16 bp, H. sapiens
cacagaactagagaaa

SEQ ID NO: 62205 - DNA, 16 bp, H. sapiens
cacagaactggagaaa

SEQ ID NO: 62206 - DNA, 16 bp, H. sapiens
cacagaacttaaagta

SEQ ID NO: 62207 - DNA, 16 bp, H. sapiens
cacagaagcacacaca

SEQ ID NO: 62208 - DNA, 16 bp, H. sapiens
cacagaagcagaaaac

SEQ ID NO: 62209 - DNA, 16 bp, H. sapiens
cacagaagctttctga

SEQ ID NO: 62210 - DNA, 16 bp, H. sapiens
cacagaaggaaaaata

SEQ ID NO: 62211 - DNA, 16 bp, H. sapiens
cacagaagtcaaaaat

SEQ ID NO: 62212 - DNA, 16 bp, H. sapiens
cacagaagtggaattg

SEQ ID NO: 62213 - DNA, 16 bp, H. sapiens
cacagaagtggagctg

SEQ ID NO: 62214 - DNA, 16 bp, H. sapiens
cacagaatcagaacat

SEQ ID NO: 62215 - DNA, 16 bp, H. sapiens
cacagaatccctactg

SEQ ID NO: 62216 - DNA, 16 bp, H. sapiens
cacagaatgggataaa

SEQ ID NO: 62217 - DNA, 16 bp, H. sapiens
cacagaattagaagaa

SEQ ID NO: 62218 - DNA, 16 bp, H. sapiens
cacagaattcaggaaa

SEQ ID NO: 62219 - DNA, 16 bp, H. sapiens
cacagaattggaaaac

SEQ ID NO: 62220 - DNA, 16 bp, H. sapiens
cacagaatttgaaaaa

SEQ ID NO: 62221 - DNA, 16 bp, H. sapiens
cacagacacaaaaata

SEQ ID NO: 62222 - DNA, 16 bp, H. sapiens
cacagacacacacact

SEQ ID NO: 62223 - DNA, 16 bp, H. sapiens
cacagacacacacata

SEQ ID NO: 62224 - DNA, 16 bp, H. sapiens
cacagacacacacatt

SEQ ID NO: 62225 - DNA, 16 bp, H. sapiens
cacagacacacagagc

SEQ ID NO: 62226 - DNA, 16 bp, H. sapiens
cacagacacacaggca

SEQ ID NO: 62227 - DNA, 16 bp, H. sapiens
cacagacacagacaca

SEQ ID NO: 62228 - DNA, 16 bp, H. sapiens
cacagacacagacaga

SEQ ID NO: 62229 - DNA, 16 bp, H. sapiens
cacagacacagacata

SEQ ID NO: 62230 - DNA, 16 bp, H. sapiens
cacagacacaggcaca

SEQ ID NO: 62231 - DNA, 16 bp, H. sapiens
cacagacacagtgaca

SEQ ID NO: 62232 - DNA, 16 bp, H. sapiens
cacagacacatacaca

SEQ ID NO: 62233 - DNA, 16 bp, H. sapiens
cacagacagacacaca

SEQ ID NO: 62234 - DNA, 16 bp, H. sapiens
cacagacagacagaca

SEQ ID NO: 62235 - DNA, 16 bp, H. sapiens
cacagacagggagaaa

SEQ ID NO: 62236 - DNA, 16 bp, H. sapiens
cacagacataaacaca

SEQ ID NO: 62237 - DNA, 16 bp, H. sapiens
cacagacatacacaca

SEQ ID NO: 62238 - DNA, 16 bp, H. sapiens
cacagacatgcacaca

SEQ ID NO: 62239 - DNA, 16 bp, H. sapiens
cacagacatgtacaca

SEQ ID NO: 62240 - DNA, 16 bp, H. sapiens
cacagacatttaaaaa

SEQ ID NO: 62241 - DNA, 16 bp, H. sapiens
cacagaccaacaagta

SEQ ID NO: 62242 - DNA, 16 bp, H. sapiens
cacagaccccacaggt

SEQ ID NO: 62243 - DNA, 16 bp, H. sapiens
cacagaccctccatcc

SEQ ID NO: 62244 - DNA, 16 bp, H. sapiens
cacagactaggtggct

SEQ ID NO: 62245 - DNA, 16 bp, H. sapiens
cacagactgaaagtga

SEQ ID NO: 62246 - DNA, 16 bp, H. sapiens
cacagagaaaaatgaa

SEQ ID NO: 62247 - DNA, 16 bp, H. sapiens
cacagagaagaccttc

SEQ ID NO: 62248 - DNA, 16 bp, H. sapiens
cacagagaagttaaat

SEQ ID NO: 62249 - DNA, 16 bp, H. sapiens
cacagagaatgaagaa

SEQ ID NO: 62250 - DNA, 16 bp, H. sapiens
cacagagacacactca

SEQ ID NO: 62251 - DNA, 16 bp, H. sapiens
cacagagacacagagg

SEQ ID NO: 62252 - DNA, 16 bp, H. sapiens
cacagagacacaggca

SEQ ID NO: 62253 - DNA, 16 bp, H. sapiens
cacagagacagaaagt

SEQ ID NO: 62254 - DNA, 16 bp, H. sapiens
cacagagacagagaca

SEQ ID NO: 62255 - DNA, 16 bp, H. sapiens
cacagagacagagaga

SEQ ID NO: 62256 - DNA, 16 bp, H. sapiens
cacagagacatacaca

SEQ ID NO: 62257 - DNA, 16 bp, H. sapiens
cacagagagacacaca

SEQ ID NO: 62258 - DNA, 16 bp, H. sapiens
cacagagagagagaga

SEQ ID NO: 62259 - DNA, 16 bp, H. sapiens
cacagagagagcaggg

SEQ ID NO: 62260 - DNA, 16 bp, H. sapiens
cacagagagcaaggaa

SEQ ID NO: 62261 - DNA, 16 bp, H. sapiens
cacagagagccaaatc

SEQ ID NO: 62262 - DNA, 16 bp, H. sapiens
cacagagagctgattg

SEQ ID NO: 62263 - DNA, 16 bp, H. sapiens
cacagagaggaaacaa

SEQ ID NO: 62264 - DNA, 16 bp, H. sapiens
cacagagatgaacctt

SEQ ID NO: 62265 - DNA, 16 bp, H. sapiens
cacagagcaaaatcat

SEQ ID NO: 62266 - DNA, 17 bp, H. sapiens
cacagagcaagaccctg

SEQ ID NO: 62267 - DNA, 16 bp, H. sapiens
cacagagcagcagcag

SEQ ID NO: 62268 - DNA, 16 bp, H. sapiens
cacagagcagcctggc

SEQ ID NO: 62269 - DNA, 16 bp, H. sapiens
cacagagccagccagc

SEQ ID NO: 62270 - DNA, 16 bp, H. sapiens
cacagagccagctgtg

SEQ ID NO: 62271 - DNA, 16 bp, H. sapiens
cacagagcctagcaca

SEQ ID NO: 62272 - DNA, 16 bp, H. sapiens
cacagagcctgggcct

SEQ ID NO: 62273 - DNA, 16 bp, H. sapiens
cacagagcgagactcc

SEQ ID NO: 62274 - DNA, 16 bp, H. sapiens
cacagagctcttcaag

SEQ ID NO: 62275 - DNA, 16 bp, H. sapiens
cacagagctggctgtg

SEQ ID NO: 62276 - DNA, 16 bp, H. sapiens
cacagagctgggaaaa

SEQ ID NO: 62277 - DNA, 16 bp, H. sapiens
cacagagctgtcatct

SEQ ID NO: 62278 - DNA, 16 bp, H. sapiens
cacagagcttctaaag

SEQ ID NO: 62279 - DNA, 16 bp, H. sapiens
cacagaggaaagacca

SEQ ID NO: 62280 - DNA, 16 bp, H. sapiens
cacagaggagaaggca

SEQ ID NO: 62281 - DNA, 16 bp, H. sapiens
cacagaggagaggcca

SEQ ID NO: 62282 - DNA, 16 bp, H. sapiens
cacagaggaggaaatg

SEQ ID NO: 62283 - DNA, 16 bp, H. sapiens
cacagaggaggaagag

SEQ ID NO: 62284 - DNA, 16 bp, H. sapiens
cacagaggagggagca

SEQ ID NO: 62285 - DNA, 16 bp, H. sapiens
cacagaggcagaaagt

SEQ ID NO: 62286 - DNA, 16 bp, H. sapiens
cacagaggctgggctg

SEQ ID NO: 62287 - DNA, 16 bp, H. sapiens
cacagagggagacaga

SEQ ID NO: 62288 - DNA, 16 bp, H. sapiens
cacagaggtgttcata

SEQ ID NO: 62289 - DNA, 16 bp, H. sapiens
cacagagtccttactg

SEQ ID NO: 62290 - DNA, 16 bp, H. sapiens
cacagagtcttgctct

SEQ ID NO: 62291 - DNA, 16 bp, H. sapiens
cacagagtcttgctga

SEQ ID NO: 62292 - DNA, 16 bp, H. sapiens
cacagagtgggaaaaa

SEQ ID NO: 62293 - DNA, 16 bp, H. sapiens
cacagagtgggagaag

SEQ ID NO: 62294 - DNA, 16 bp, H. sapiens
cacagagtgggtggct

SEQ ID NO: 62295 - DNA, 16 bp, H. sapiens
cacagagttaaaactt

SEQ ID NO: 62296 - DNA, 16 bp, H. sapiens
cacagagttggagaaa

SEQ ID NO: 62297 - DNA, 16 bp, H. sapiens
cacagatacacacaca

SEQ ID NO: 62298 - DNA, 16 bp, H. sapiens
cacagatacacataca

SEQ ID NO: 62299 - DNA, 16 bp, H. sapiens
cacagatatgcacaca

SEQ ID NO: 62300 - DNA, 18 bp, H. sapiens
cacagatcaacaggatcc

SEQ ID NO: 62301 - DNA, 16 bp, H. sapiens
cacagatcacacccag

SEQ ID NO: 62302 - DNA, 16 bp, H. sapiens
cacagatctctagagc

SEQ ID NO: 62303 - DNA, 16 bp, H. sapiens
cacagatctttgcaac

SEQ ID NO: 62304 - DNA, 16 bp, H. sapiens
cacagatctttttttt

SEQ ID NO: 62305 - DNA, 16 bp, H. sapiens
cacagatgaacctgga

SEQ ID NO: 62306 - DNA, 16 bp, H. sapiens
cacagatgagaagact

SEQ ID NO: 62307 - DNA, 16 bp, H. sapiens
cacagatgctcaagtc

SEQ ID NO: 62308 - DNA, 16 bp, H. sapiens
cacagatggagctgga

SEQ ID NO: 62309 - DNA, 16 bp, H. sapiens
cacagatggcagaaga

SEQ ID NO: 62310 - DNA, 16 bp, H. sapiens
cacagatggtagtttt

SEQ ID NO: 62311 - DNA, 16 bp, H. sapiens
cacagatgtcttcttt

SEQ ID NO: 62312 - DNA, 16 bp, H. sapiens
cacagattaaaagaaa

SEQ ID NO: 62313 - DNA, 16 bp, H. sapiens
cacagattcttttttt

SEQ ID NO: 62314 - DNA, 16 bp, H. sapiens
cacagattgctgggcc

SEQ ID NO: 62315 - DNA, 16 bp, H. sapiens
cacagatttattgaaa

SEQ ID NO: 62316 - DNA, 16 bp, H. sapiens
cacagatttgaacctt

SEQ ID NO: 62317 - DNA, 16 bp, H. sapiens
cacagcaaagaataca

SEQ ID NO: 62318 - DNA, 16 bp, H. sapiens
cacagcaaagcaagga

SEQ ID NO: 62319 - DNA, 16 bp, H. sapiens
cacagcaaaggacaca

SEQ ID NO: 62320 - DNA, 16 bp, H. sapiens
cacagcaaagggaaca

SEQ ID NO: 62321 - DNA, 16 bp, H. sapiens
cacagcaacacctaga

SEQ ID NO: 62322 - DNA, 16 bp, H. sapiens
cacagcaagaaggcac

SEQ ID NO: 62323 - DNA, 16 bp, H. sapiens
cacagcaagaaggcgg

SEQ ID NO: 62324 - DNA, 16 bp, H. sapiens
cacagcaagaaggctg

SEQ ID NO: 62325 - DNA, 16 bp, H. sapiens
cacagcaagacctgcc

SEQ ID NO: 62326 - DNA, 16 bp, H. sapiens
cacagcaagagattaa

SEQ ID NO: 62327 - DNA, 16 bp, H. sapiens
cacagcaatagaaact

SEQ ID NO: 62328 - DNA, 16 bp, H. sapiens
cacagcaatcagacaa

SEQ ID NO: 62329 - DNA, 16 bp, H. sapiens
cacagcaatcctatga

SEQ ID NO: 62330 - DNA, 16 bp, H. sapiens
cacagcaatgtgaatg

SEQ ID NO: 62331 - DNA, 17 bp, H. sapiens
cacagcaccaaatttca

SEQ ID NO: 62332 - DNA, 16 bp, H. sapiens
cacagcacccagcctt

SEQ ID NO: 62333 - DNA, 16 bp, H. sapiens
cacagcacccaggctg

SEQ ID NO: 62334 - DNA, 16 bp, H. sapiens
cacagcacctctgcct

SEQ ID NO: 62335 - DNA, 16 bp, H. sapiens
cacagcacctggcccc

SEQ ID NO: 62336 - DNA, 16 bp, H. sapiens
cacagcacgagaactt

SEQ ID NO: 62337 - DNA, 16 bp, H. sapiens
cacagcactcaagcct

SEQ ID NO: 62338 - DNA, 16 bp, H. sapiens
cacagcactccagcct

SEQ ID NO: 62339 - DNA, 16 bp, H. sapiens
cacagcagcaggggcc

SEQ ID NO: 62340 - DNA, 16 bp, H. sapiens
cacagcagccaggcag

SEQ ID NO: 62341 - DNA, 16 bp, H. sapiens
cacagcagcccctctc

SEQ ID NO: 62342 - DNA, 16 bp, H. sapiens
cacagcagccccttcc

SEQ ID NO: 62343 - DNA, 16 bp, H. sapiens
cacagcagccctgagg

SEQ ID NO: 62344 - DNA, 16 bp, H. sapiens
cacagcagccctgggg

SEQ ID NO: 62345 - DNA, 16 bp, H. sapiens
cacagcagcctcagca

SEQ ID NO: 62346 - DNA, 16 bp, H. sapiens
cacagcagcctccacc

SEQ ID NO: 62347 - DNA, 16 bp, H. sapiens
cacagcagcctgggca

SEQ ID NO: 62348 - DNA, 16 bp, H. sapiens
cacagcagctgcacca

SEQ ID NO: 62349 - DNA, 16 bp, H. sapiens
cacagcagctgcagca

SEQ ID NO: 62350 - DNA, 16 bp, H. sapiens
cacagcagctgctcca

SEQ ID NO: 62351 - DNA, 21 bp, H. sapiens
cacagcagctgctggcccagg

SEQ ID NO: 62352 - DNA, 16 bp, H. sapiens
cacagcagctgtggca

SEQ ID NO: 62353 - DNA, 16 bp, H. sapiens
cacagcaggaaggtgg

SEQ ID NO: 62354 - DNA, 16 bp, H. sapiens
cacagcaggaggggag

SEQ ID NO: 62355 - DNA, 16 bp, H. sapiens
cacagcaggaggtgag

SEQ ID NO: 62356 - DNA, 16 bp, H. sapiens
cacagcaggggggccc

SEQ ID NO: 62357 - DNA, 16 bp, H. sapiens
cacagcatgtgggaat

SEQ ID NO: 62358 - DNA, 16 bp, H. sapiens
cacagcatgttactgt

SEQ ID NO: 62359 - DNA, 16 bp, H. sapiens
cacagcattccagcct

SEQ ID NO: 62360 - DNA, 16 bp, H. sapiens
cacagcattcccttaa

SEQ ID NO: 62361 - DNA, 16 bp, H. sapiens
cacagccaaagaaata

SEQ ID NO: 62362 - DNA, 53 bp, H. sapiens
cacagccaatatcatactgaatgggcaaaaactggaagcattccctttgaaaa

SEQ ID NO: 62363 - DNA, 32 bp, H. sapiens
cacagccaatatcatactgaatgggcaaaaat

SEQ ID NO: 62364 - DNA, 16 bp, H. sapiens
cacagccacacagcca

SEQ ID NO: 62365 - DNA, 16 bp, H. sapiens
cacagccacacccact

SEQ ID NO: 62366 - DNA, 16 bp, H. sapiens
cacagccacagaactc

SEQ ID NO: 62367 - DNA, 16 bp, H. sapiens
cacagccacagcagag

SEQ ID NO: 62368 - DNA, 16 bp, H. sapiens
cacagccacagctgcc

SEQ ID NO: 62369 - DNA, 16 bp, H. sapiens
cacagccactatcata

SEQ ID NO: 62370 - DNA, 16 bp, H. sapiens
cacagccactcaggag

SEQ ID NO: 62371 - DNA, 16 bp, H. sapiens
cacagccactgccaac

SEQ ID NO: 62372 - DNA, 16 bp, H. sapiens
cacagccaggaagagc

SEQ ID NO: 62373 - DNA, 16 bp, H. sapiens
cacagcccagcagctc

SEQ ID NO: 62374 - DNA, 16 bp, H. sapiens
cacagcccagctgctc

SEQ ID NO: 62375 - DNA, 16 bp, H. sapiens
cacagcccagggcctg

SEQ ID NO: 62376 - DNA, 16 bp, H. sapiens
cacagcccctgccctc

SEQ ID NO: 62377 - DNA, 16 bp, H. sapiens
cacagcccctgcctct

SEQ ID NO: 62378 - DNA, 16 bp, H. sapiens
cacagccctcaggaag

SEQ ID NO: 62379 - DNA, 16 bp, H. sapiens
cacagccctgccctca

SEQ ID NO: 62380 - DNA, 16 bp, H. sapiens
cacagccctgccctcc

SEQ ID NO: 62381 - DNA, 16 bp, H. sapiens
cacagccctggccctg

SEQ ID NO: 62382 - DNA, 16 bp, H. sapiens
cacagccctggttccc

SEQ ID NO: 62383 - DNA, 16 bp, H. sapiens
cacagcctatgcccct

SEQ ID NO: 62384 - DNA, 16 bp, H. sapiens
cacagcctcacagaga

SEQ ID NO: 62385 - DNA, 16 bp, H. sapiens
cacagcctccgcctcc

SEQ ID NO: 62386 - DNA, 16 bp, H. sapiens
cacagcctctatcaca

SEQ ID NO: 62387 - DNA, 16 bp, H. sapiens
cacagcctctgcccca

SEQ ID NO: 62388 - DNA, 16 bp, H. sapiens
cacagcctgctgggct

SEQ ID NO: 62389 - DNA, 16 bp, H. sapiens
cacagcctggccctgg

SEQ ID NO: 62390 - DNA, 16 bp, H. sapiens
cacagcctgggcaaca

SEQ ID NO: 62391 - DNA, 16 bp, H. sapiens
cacagcgcctggcctg

SEQ ID NO: 62392 - DNA, 16 bp, H. sapiens
cacagctaaagaagtg

SEQ ID NO: 62393 - DNA, 16 bp, H. sapiens
cacagctaaagcaatg

SEQ ID NO: 62394 - DNA, 16 bp, H. sapiens
cacagctaaagcagca

SEQ ID NO: 62395 - DNA, 16 bp, H. sapiens
cacagctactaagtgg

SEQ ID NO: 62396 - DNA, 16 bp, H. sapiens
cacagctactcgggag

SEQ ID NO: 62397 - DNA, 16 bp, H. sapiens
cacagctagaaagtag

SEQ ID NO: 62398 - DNA, 16 bp, H. sapiens
cacagctagaaggcac

SEQ ID NO: 62399 - DNA, 16 bp, H. sapiens
cacagctagtaaatgg

SEQ ID NO: 62400 - DNA, 16 bp, H. sapiens
cacagctagtgagtga

SEQ ID NO: 62401 - DNA, 16 bp, H. sapiens
cacagctagtgagtgg

SEQ ID NO: 62402 - DNA, 16 bp, H. sapiens
cacagctcagtgcagg

SEQ ID NO: 62403 - DNA, 16 bp, H. sapiens
cacagctctggaggct

SEQ ID NO: 62404 - DNA, 16 bp, H. sapiens
cacagctcttctttcc

SEQ ID NO: 62405 - DNA, 16 bp, H. sapiens
cacagctgaagaaaga

SEQ ID NO: 62406 - DNA, 16 bp, H. sapiens
cacagctgaattctgc

SEQ ID NO: 62407 - DNA, 16 bp, H. sapiens
cacagctgagaatgtg

SEQ ID NO: 62408 - DNA, 16 bp, H. sapiens
cacagctgatttttgt

SEQ ID NO: 62409 - DNA, 16 bp, H. sapiens
cacagctgcagccacc

SEQ ID NO: 62410 - DNA, 16 bp, H. sapiens
cacagctgcagctgcc

SEQ ID NO: 62411 - DNA, 16 bp, H. sapiens
cacagctgccccttcc

SEQ ID NO: 62412 - DNA, 16 bp, H. sapiens
cacagctgcctcctcc

SEQ ID NO: 62413 - DNA, 16 bp, H. sapiens
cacagctggagcagct

SEQ ID NO: 62414 - DNA, 16 bp, H. sapiens
cacagctggaggtgag

SEQ ID NO: 62415 - DNA, 16 bp, H. sapiens
cacagctggcaagtgg

SEQ ID NO: 62416 - DNA, 16 bp, H. sapiens
cacagctggcactggg

SEQ ID NO: 62417 - DNA, 16 bp, H. sapiens
cacagctggctctgca

SEQ ID NO: 62418 - DNA, 16 bp, H. sapiens
cacagctggggaggcc

SEQ ID NO: 62419 - DNA, 16 bp, H. sapiens
cacagctggtaaatgg

SEQ ID NO: 62420 - DNA, 16 bp, H. sapiens
cacagctgtggtccca

SEQ ID NO: 62421 - DNA, 16 bp, H. sapiens
cacagctgtgtgtgtg

SEQ ID NO: 62422 - DNA, 16 bp, H. sapiens
cacagcttgtggctcc

SEQ ID NO: 62423 - DNA, 16 bp, H. sapiens
cacagctttgggatgt

SEQ ID NO: 62424 - DNA, 16 bp, H. sapiens
cacaggaaattgcaaa

SEQ ID NO: 62425 - DNA, 16 bp, H. sapiens
cacaggaacagataac

SEQ ID NO: 62426 - DNA, 16 bp, H. sapiens
cacaggaatggaaaac

SEQ ID NO: 62427 - DNA, 16 bp, H. sapiens
cacaggacagcctccc

SEQ ID NO: 62428 - DNA, 16 bp, H. sapiens
cacaggacagggaaca

SEQ ID NO: 62429 - DNA, 16 bp, H. sapiens
cacaggacctagaaag

SEQ ID NO: 62430 - DNA, 16 bp, H. sapiens
cacaggacctggcaca

SEQ ID NO: 62431 - DNA, 16 bp, H. sapiens
cacaggactctgcaga

SEQ ID NO: 62432 - DNA, 16 bp, H. sapiens
cacaggagaaagtggg

SEQ ID NO: 62433 - DNA, 16 bp, H. sapiens
cacaggagaagctctg

SEQ ID NO: 62434 - DNA, 16 bp, H. sapiens
cacaggaggtggaggc

SEQ ID NO: 62435 - DNA, 16 bp, H. sapiens
cacaggatacaagatc

SEQ ID NO: 62436 - DNA, 16 bp, H. sapiens
cacaggatcagaaaac

SEQ ID NO: 62437 - DNA, 16 bp, H. sapiens
cacaggatggcaggag

SEQ ID NO: 62438 - DNA, 16 bp, H. sapiens
cacaggatttttaggg

SEQ ID NO: 62439 - DNA, 16 bp, H. sapiens
cacaggcaaccaaggc

SEQ ID NO: 62440 - DNA, 16 bp, H. sapiens
cacaggcacacacatg

SEQ ID NO: 62441 - DNA, 16 bp, H. sapiens
cacaggcacacatgca

SEQ ID NO: 62442 - DNA, 16 bp, H. sapiens
cacaggcacaggcaca

SEQ ID NO: 62443 - DNA, 16 bp, H. sapiens
cacaggcacatgccac

SEQ ID NO: 62444 - DNA, 16 bp, H. sapiens
cacaggcagaagggac

SEQ ID NO: 62445 - DNA, 16 bp, H. sapiens
cacaggcagaggagcc

SEQ ID NO: 62446 - DNA, 16 bp, H. sapiens
cacaggcatgagccac

SEQ ID NO: 62447 - DNA, 16 bp, H. sapiens
cacaggccaggaggcc

SEQ ID NO: 62448 - DNA, 16 bp, H. sapiens
cacaggccaggtgcag

SEQ ID NO: 62449 - DNA, 16 bp, H. sapiens
cacaggccccacctcc

SEQ ID NO: 62450 - DNA, 16 bp, H. sapiens
cacaggcctcagaaat

SEQ ID NO: 62451 - DNA, 16 bp, H. sapiens
cacaggcctggaggca

SEQ ID NO: 62452 - DNA, 16 bp, H. sapiens
cacaggcgtgtgtcac

SEQ ID NO: 62453 - DNA, 16 bp, H. sapiens
cacaggctgagtgcag

SEQ ID NO: 62454 - DNA, 16 bp, H. sapiens
cacaggctgcagtgca

SEQ ID NO: 62455 - DNA, 16 bp, H. sapiens
cacaggctggagtgca

SEQ ID NO: 62456 - DNA, 16 bp, H. sapiens
cacaggctttggagtc

SEQ ID NO: 62457 - DNA, 16 bp, H. sapiens
cacagggaaaggaaga

SEQ ID NO: 62458 - DNA, 16 bp, H. sapiens
cacagggacacaaaga

SEQ ID NO: 62459 - DNA, 16 bp, H. sapiens
cacagggagaaaacag

SEQ ID NO: 62460 - DNA, 16 bp, H. sapiens
cacagggagagaaaca

SEQ ID NO: 62461 - DNA, 16 bp, H. sapiens
cacagggagcaggacc

SEQ ID NO: 62462 - DNA, 16 bp, H. sapiens
cacagggagggaacaa

SEQ ID NO: 62463 - DNA, 16 bp, H. sapiens
cacagggagggcaaca

SEQ ID NO: 62464 - DNA, 16 bp, H. sapiens
cacagggaggggaata

SEQ ID NO: 62465 - DNA, 16 bp, H. sapiens
cacagggaggggagca

SEQ ID NO: 62466 - DNA, 16 bp, H. sapiens
cacagggagtcaaagc

SEQ ID NO: 62467 - DNA, 16 bp, H. sapiens
cacagggatgggaaca

SEQ ID NO: 62468 - DNA, 16 bp, H. sapiens
cacagggcaccaagtt

SEQ ID NO: 62469 - DNA, 16 bp, H. sapiens
cacagggcagagctgc

SEQ ID NO: 62470 - DNA, 16 bp, H. sapiens
cacagggcagccccca

SEQ ID NO: 62471 - DNA, 16 bp, H. sapiens
cacagggccacacagg

SEQ ID NO: 62472 - DNA, 16 bp, H. sapiens
cacagggcctgacaca

SEQ ID NO: 62473 - DNA, 16 bp, H. sapiens
cacagggcctggcact

SEQ ID NO: 62474 - DNA, 16 bp, H. sapiens
cacagggcctggcatg

SEQ ID NO: 62475 - DNA, 16 bp, H. sapiens
cacagggcctggccca

SEQ ID NO: 62476 - DNA, 16 bp, H. sapiens
cacagggctgccaggc

SEQ ID NO: 62477 - DNA, 16 bp, H. sapiens
cacagggctggggaag

SEQ ID NO: 62478 - DNA, 16 bp, H. sapiens
cacaggggcagggctg

SEQ ID NO: 62479 - DNA, 16 bp, H. sapiens
cacagggtgatccctt

SEQ ID NO: 62480 - DNA, 16 bp, H. sapiens
cacagggtggcagcag

SEQ ID NO: 62481 - DNA, 16 bp, H. sapiens
cacagggtggcaggaa

SEQ ID NO: 62482 - DNA, 16 bp, H. sapiens
cacagggtggcaggac

SEQ ID NO: 62483 - DNA, 16 bp, H. sapiens
cacagggttgttgtga

SEQ ID NO: 62484 - DNA, 16 bp, H. sapiens
cacagggtttcaccat

SEQ ID NO: 62485 - DNA, 16 bp, H. sapiens
cacagggtttcaccgt

SEQ ID NO: 62486 - DNA, 16 bp, H. sapiens
cacaggtaggacgttt

SEQ ID NO: 62487 - DNA, 16 bp, H. sapiens
cacaggtatacacatg

SEQ ID NO: 62488 - DNA, 16 bp, H. sapiens
cacaggtcactgcagc

SEQ ID NO: 62489 - DNA, 16 bp, H. sapiens
cacaggtgcatgccac

SEQ ID NO: 62490 - DNA, 16 bp, H. sapiens
cacaggtgcgtgccac

SEQ ID NO: 62491 - DNA, 16 bp, H. sapiens
cacaggtgggaattga

SEQ ID NO: 62492 - DNA, 16 bp, H. sapiens
cacaggtgggcaccac

SEQ ID NO: 62493 - DNA, 16 bp, H. sapiens
cacaggtgtgagccac

SEQ ID NO: 62494 - DNA, 16 bp, H. sapiens
cacaggtgtgtgccac

SEQ ID NO: 62495 - DNA, 16 bp, H. sapiens
cacaggttctgggaat

SEQ ID NO: 62496 - DNA, 16 bp, H. sapiens
cacagtaaacactcaa

SEQ ID NO: 62497 - DNA, 16 bp, H. sapiens
cacagtaaatatttgt

SEQ ID NO: 62498 - DNA, 16 bp, H. sapiens
cacagtaacagaaaac

SEQ ID NO: 62499 - DNA, 16 bp, H. sapiens
cacagtattttaaaaa

SEQ ID NO: 62500 - DNA, 16 bp, H. sapiens
cacagtcctggagact

SEQ ID NO: 62501 - DNA, 17 bp, H. sapiens
cacagtctcactctgtc

SEQ ID NO: 62502 - DNA, 16 bp, H. sapiens
cacagtctctgtcaca

SEQ ID NO: 62503 - DNA, 16 bp, H. sapiens
cacagtcttgctatgt

SEQ ID NO: 62504 - DNA, 16 bp, H. sapiens
cacagtcttgctctgt

SEQ ID NO: 62505 - DNA, 16 bp, H. sapiens
cacagtgagaaggagc

SEQ ID NO: 62506 - DNA, 16 bp, H. sapiens
cacagtgagacccctg

SEQ ID NO: 62507 - DNA, 16 bp, H. sapiens
cacagtgagacttcat

SEQ ID NO: 62508 - DNA, 16 bp, H. sapiens
cacagtgagagattaa

SEQ ID NO: 62509 - DNA, 20 bp, H. sapiens
cacagtgagataccatctca

SEQ ID NO: 62510 - DNA, 16 bp, H. sapiens
cacagtgagatattac

SEQ ID NO: 62511 - DNA, 18 bp, H. sapiens
cacagtgcaatcaaactg

SEQ ID NO: 62512 - DNA, 16 bp, H. sapiens
cacagtgcccggcaca

SEQ ID NO: 62513 - DNA, 16 bp, H. sapiens
cacagtgcctgaaaca

SEQ ID NO: 62514 - DNA, 16 bp, H. sapiens
cacagtgcctgccaca

SEQ ID NO: 62515 - DNA, 16 bp, H. sapiens
cacagtgcctggcaca

SEQ ID NO: 62516 - DNA, 17 bp, H. sapiens
cacagtgcctggcacat

SEQ ID NO: 62517 - DNA, 16 bp, H. sapiens
cacagtgcctggcact

SEQ ID NO: 62518 - DNA, 16 bp, H. sapiens
cacagtgcctgggaca

SEQ ID NO: 62519 - DNA, 16 bp, H. sapiens
cacagtgcttggaaca

SEQ ID NO: 62520 - DNA, 16 bp, H. sapiens
cacagtggaatattat

SEQ ID NO: 62521 - DNA, 17 bp, H. sapiens
cacagtggcatgatctc

SEQ ID NO: 62522 - DNA, 16 bp, H. sapiens
cacagtggctgaacca

SEQ ID NO: 62523 - DNA, 16 bp, H. sapiens
cacagtggctgacatc

SEQ ID NO: 62524 - DNA, 16 bp, H. sapiens
cacagtggctggacta

SEQ ID NO: 62525 - DNA, 16 bp, H. sapiens
cacagtggctgtgcca

SEQ ID NO: 62526 - DNA, 16 bp, H. sapiens
cacagtggcttctgct

SEQ ID NO: 62527 - DNA, 16 bp, H. sapiens
cacagtggggaagggg

SEQ ID NO: 62528 - DNA, 16 bp, H. sapiens
cacagtggtggatata

SEQ ID NO: 62529 - DNA, 16 bp, H. sapiens
cacagtgtctggtaca

SEQ ID NO: 62530 - DNA, 16 bp, H. sapiens
cacagtgtgggagcag

SEQ ID NO: 62531 - DNA, 16 bp, H. sapiens
cacagtgttgtgtaac

SEQ ID NO: 62532 - DNA, 16 bp, H. sapiens
cacagttcctggcaca

SEQ ID NO: 62533 - DNA, 16 bp, H. sapiens
cacagttcctggctca

SEQ ID NO: 62534 - DNA, 16 bp, H. sapiens
cacagttctagagtct

SEQ ID NO: 62535 - DNA, 16 bp, H. sapiens
cacagttctgaagcct

SEQ ID NO: 62536 - DNA, 16 bp, H. sapiens
cacagttctgcgggct

SEQ ID NO: 62537 - DNA, 16 bp, H. sapiens
cacagttgccttattt

SEQ ID NO: 62538 - DNA, 16 bp, H. sapiens
cacagttgtaatccca

SEQ ID NO: 62539 - DNA, 16 bp, H. sapiens
cacagtttatccattc

SEQ ID NO: 62540 - DNA, 16 bp, H. sapiens
cacagtttcttttttt

SEQ ID NO: 62541 - DNA, 16 bp, H. sapiens
cacagtttgagaaaca

SEQ ID NO: 62542 - DNA, 16 bp, H. sapiens
cacagttttatttctt

SEQ ID NO: 62543 - DNA, 18 bp, H. sapiens
cacataaacagaaccaac

SEQ ID NO: 62544 - DNA, 16 bp, H. sapiens
cacataaactagaaaa

SEQ ID NO: 62545 - DNA, 16 bp, H. sapiens
cacataaactttgggg

SEQ ID NO: 62546 - DNA, 16 bp, H. sapiens
cacataacataaaatt

SEQ ID NO: 62547 - DNA, 16 bp, H. sapiens
cacataaggactcaca

SEQ ID NO: 62548 - DNA, 16 bp, H. sapiens
cacataagtggaatca

SEQ ID NO: 62549 - DNA, 16 bp, H. sapiens
cacataattgtacata

SEQ ID NO: 62550 - DNA, 16 bp, H. sapiens
cacatacaaatggcaa

SEQ ID NO: 62551 - DNA, 16 bp, H. sapiens
cacatacaattatgta

SEQ ID NO: 62552 - DNA, 16 bp, H. sapiens
cacatacacaaatgca

SEQ ID NO: 62553 - DNA, 16 bp, H. sapiens
cacatacacacacaat

SEQ ID NO: 62554 - DNA, 16 bp, H. sapiens
cacatacacacaccat

SEQ ID NO: 62555 - DNA, 16 bp, H. sapiens
cacatacacacagtct

SEQ ID NO: 62556 - DNA, 16 bp, H. sapiens
cacatacacacattca

SEQ ID NO: 62557 - DNA, 16 bp, H. sapiens
cacatacacactcata

SEQ ID NO: 62558 - DNA, 16 bp, H. sapiens
cacatacacatacaca

SEQ ID NO: 62559 - DNA, 16 bp, H. sapiens
cacatacacatataca

SEQ ID NO: 62560 - DNA, 16 bp, H. sapiens
cacatacacatatata

SEQ ID NO: 62561 - DNA, 16 bp, H. sapiens
cacatacacatgtgca

SEQ ID NO: 62562 - DNA, 16 bp, H. sapiens
cacatacacctacaca

SEQ ID NO: 62563 - DNA, 16 bp, H. sapiens
cacatacagaaaaatg

SEQ ID NO: 62564 - DNA, 16 bp, H. sapiens
cacatacagaaacaca

SEQ ID NO: 62565 - DNA, 16 bp, H. sapiens
cacatacatacactca

SEQ ID NO: 62566 - DNA, 17 bp, H. sapiens
cacatacatatatacat

SEQ ID NO: 62567 - DNA, 17 bp, H. sapiens
cacatacatatatatat

SEQ ID NO: 62568 - DNA, 16 bp, H. sapiens
cacatacatttttttt

SEQ ID NO: 62569 - DNA, 16 bp, H. sapiens
cacataccaccaggcc

SEQ ID NO: 62570 - DNA, 16 bp, H. sapiens
cacatagacacacaca

SEQ ID NO: 62571 - DNA, 16 bp, H. sapiens
cacatagacacaggga

SEQ ID NO: 62572 - DNA, 16 bp, H. sapiens
cacatagacatacaga

SEQ ID NO: 62573 - DNA, 16 bp, H. sapiens
cacatagtaggagctt

SEQ ID NO: 62574 - DNA, 16 bp, H. sapiens
cacatagtaggtactc

SEQ ID NO: 62575 - DNA, 16 bp, H. sapiens
cacatatacacacact

SEQ ID NO: 62576 - DNA, 16 bp, H. sapiens
cacatatacacataca

SEQ ID NO: 62577 - DNA, 16 bp, H. sapiens
cacatatacatatact

SEQ ID NO: 62578 - DNA, 16 bp, H. sapiens
cacatatacatccaga

SEQ ID NO: 62579 - DNA, 16 bp, H. sapiens
cacatataccaaaatc

SEQ ID NO: 62580 - DNA, 16 bp, H. sapiens
cacatatactaaaatt

SEQ ID NO: 62581 - DNA, 16 bp, H. sapiens
cacatatatgtgtgtg

SEQ ID NO: 62582 - DNA, 16 bp, H. sapiens
cacatatgcacacacc

SEQ ID NO: 62583 - DNA, 16 bp, H. sapiens
cacatatgcacacaga

SEQ ID NO: 62584 - DNA, 16 bp, H. sapiens
cacatatgcacataca

SEQ ID NO: 62585 - DNA, 16 bp, H. sapiens
cacatatgcagacaca

SEQ ID NO: 62586 - DNA, 16 bp, H. sapiens
cacatatgcatatgtg

SEQ ID NO: 62587 - DNA, 16 bp, H. sapiens
cacatatgtacatgta

SEQ ID NO: 62588 - DNA, 16 bp, H. sapiens
cacatattcacatggc

SEQ ID NO: 62589 - DNA, 16 bp, H. sapiens
cacatatttaaaatat

SEQ ID NO: 62590 - DNA, 17 bp, H. sapiens
cacatatttattgacag

SEQ ID NO: 62591 - DNA, 16 bp, H. sapiens
cacatatttattgagt

SEQ ID NO: 62592 - DNA, 16 bp, H. sapiens
cacatattttagattt

SEQ ID NO: 62593 - DNA, 19 bp, H. sapiens
cacatcaaaaagcttatct

SEQ ID NO: 62594 - DNA, 16 bp, H. sapiens
cacatcaaccaatgga

SEQ ID NO: 62595 - DNA, 16 bp, H. sapiens
cacatcaagcatttat

SEQ ID NO: 62596 - DNA, 16 bp, H. sapiens
cacatcaataaatgtg

SEQ ID NO: 62597 - DNA, 16 bp, H. sapiens
cacatcacaaaccagt

SEQ ID NO: 62598 - DNA, 16 bp, H. sapiens
cacatcacacttattc

SEQ ID NO: 62599 - DNA, 16 bp, H. sapiens
cacatcaccatgccca

SEQ ID NO: 62600 - DNA, 16 bp, H. sapiens
cacatcagcagaggaa

SEQ ID NO: 62601 - DNA, 16 bp, H. sapiens
cacatcagcctcccaa

SEQ ID NO: 62602 - DNA, 16 bp, H. sapiens
cacatccacatccaca

SEQ ID NO: 62603 - DNA, 16 bp, H. sapiens
cacatccaggccatca

SEQ ID NO: 62604 - DNA, 16 bp, H. sapiens
cacatcccaaagaagt

SEQ ID NO: 62605 - DNA, 16 bp, H. sapiens
cacatcccaggctcaa

SEQ ID NO: 62606 - DNA, 16 bp, H. sapiens
cacatccccattccaa

SEQ ID NO: 62607 - DNA, 16 bp, H. sapiens
cacatccctgccaaca

SEQ ID NO: 62608 - DNA, 16 bp, H. sapiens
cacatcctaatccctg

SEQ ID NO: 62609 - DNA, 16 bp, H. sapiens
cacatcctcacatttc

SEQ ID NO: 62610 - DNA, 16 bp, H. sapiens
cacatcctcatcagca

SEQ ID NO: 62611 - DNA, 16 bp, H. sapiens
cacatcctcctgccca

SEQ ID NO: 62612 - DNA, 16 bp, H. sapiens
cacatcctctccagga

SEQ ID NO: 62613 - DNA, 16 bp, H. sapiens
cacatcctctgcagca

SEQ ID NO: 62614 - DNA, 16 bp, H. sapiens
cacatcctgaacatgt

SEQ ID NO: 62615 - DNA, 16 bp, H. sapiens
cacatcctggccagca

SEQ ID NO: 62616 - DNA, 16 bp, H. sapiens
cacatccttgccagca

SEQ ID NO: 62617 - DNA, 16 bp, H. sapiens
cacatccttgtcaaca

SEQ ID NO: 62618 - DNA, 20 bp, H. sapiens
cacatctacaaccatctgct

SEQ ID NO: 62619 - DNA, 19 bp, H. sapiens
cacatctacaactatctga

SEQ ID NO: 62620 - DNA, 16 bp, H. sapiens
cacatctataatccca

SEQ ID NO: 62621 - DNA, 16 bp, H. sapiens
cacatctcaaagaagt

SEQ ID NO: 62622 - DNA, 16 bp, H. sapiens
cacatctcaattcaaa

SEQ ID NO: 62623 - DNA, 16 bp, H. sapiens
cacatctgaagccagc

SEQ ID NO: 62624 - DNA, 16 bp, H. sapiens
cacatctgtaatacca

SEQ ID NO: 62625 - DNA, 16 bp, H. sapiens
cacatcttcaccagca

SEQ ID NO: 62626 - DNA, 16 bp, H. sapiens
cacatcttctccaaca

SEQ ID NO: 62627 - DNA, 16 bp, H. sapiens
cacatctttgtcaaca

SEQ ID NO: 62628 - DNA, 16 bp, H. sapiens
cacatgaaaaaaatgc

SEQ ID NO: 62629 - DNA, 16 bp, H. sapiens
cacatgaaaagctgct

SEQ ID NO: 62630 - DNA, 16 bp, H. sapiens
cacatgaaacattctc

SEQ ID NO: 62631 - DNA, 16 bp, H. sapiens
cacatgaaagaaagaa

SEQ ID NO: 62632 - DNA, 16 bp, H. sapiens
cacatgaagtccttgc

SEQ ID NO: 62633 - DNA, 16 bp, H. sapiens
cacatgaataaatgct

SEQ ID NO: 62634 - DNA, 16 bp, H. sapiens
cacatgaatacacaca

SEQ ID NO: 62635 - DNA, 16 bp, H. sapiens
cacatgacaagatgct

SEQ ID NO: 62636 - DNA, 16 bp, H. sapiens
cacatgacagcaggag

SEQ ID NO: 62637 - DNA, 16 bp, H. sapiens
cacatgagcccaggag

SEQ ID NO: 62638 - DNA, 16 bp, H. sapiens
cacatgatattttgat

SEQ ID NO: 62639 - DNA, 16 bp, H. sapiens
cacatgatcatctcag

SEQ ID NO: 62640 - DNA, 16 bp, H. sapiens
cacatgatggcaggaa

SEQ ID NO: 62641 - DNA, 16 bp, H. sapiens
cacatgcaaaatacat

SEQ ID NO: 62642 - DNA, 16 bp, H. sapiens
cacatgcaaacataca

SEQ ID NO: 62643 - DNA, 16 bp, H. sapiens
cacatgcaaatacaca

SEQ ID NO: 62644 - DNA, 16 bp, H. sapiens
cacatgcacacaacac

SEQ ID NO: 62645 - DNA, 16 bp, H. sapiens
cacatgcacacacaca

SEQ ID NO: 62646 - DNA, 16 bp, H. sapiens
cacatgcacacacact

SEQ ID NO: 62647 - DNA, 16 bp, H. sapiens
cacatgcacacacagc

SEQ ID NO: 62648 - DNA, 16 bp, H. sapiens
cacatgcacacagaca

SEQ ID NO: 62649 - DNA, 16 bp, H. sapiens
cacatgcacacaggtg

SEQ ID NO: 62650 - DNA, 16 bp, H. sapiens
cacatgcacacatgca

SEQ ID NO: 62651 - DNA, 16 bp, H. sapiens
cacatgcacacccaca

SEQ ID NO: 62652 - DNA, 16 bp, H. sapiens
cacatgcacatatatg

SEQ ID NO: 62653 - DNA, 16 bp, H. sapiens
cacatgcacatgtatt

SEQ ID NO: 62654 - DNA, 16 bp, H. sapiens
cacatgcacgcacata

SEQ ID NO: 62655 - DNA, 16 bp, H. sapiens
cacatgcacgtgcaca

SEQ ID NO: 62656 - DNA, 16 bp, H. sapiens
cacatgcactcatgct

SEQ ID NO: 62657 - DNA, 16 bp, H. sapiens
cacatgcagaaaaata

SEQ ID NO: 62658 - DNA, 16 bp, H. sapiens
cacatgcagacacaca

SEQ ID NO: 62659 - DNA, 17 bp, H. sapiens
cacatgcagagacacat

SEQ ID NO: 62660 - DNA, 16 bp, H. sapiens
cacatgcatgtgcata

SEQ ID NO: 62661 - DNA, 16 bp, H. sapiens
cacatgccaccctgcc

SEQ ID NO: 62662 - DNA, 16 bp, H. sapiens
cacatgccatggtagt

SEQ ID NO: 62663 - DNA, 16 bp, H. sapiens
cacatgccatggtggc

SEQ ID NO: 62664 - DNA, 16 bp, H. sapiens
cacatgcctatgtcct

SEQ ID NO: 62665 - DNA, 16 bp, H. sapiens
cacatgcctgtagtac

SEQ ID NO: 62666 - DNA, 16 bp, H. sapiens
cacatgcctgtgtgtg

SEQ ID NO: 62667 - DNA, 16 bp, H. sapiens
cacatgcgcacacaca

SEQ ID NO: 62668 - DNA, 16 bp, H. sapiens
cacatgcgcacgcaca

SEQ ID NO: 62669 - DNA, 16 bp, H. sapiens
cacatgcgtgcacaca

SEQ ID NO: 62670 - DNA, 16 bp, H. sapiens
cacatgctcacacaca

SEQ ID NO: 62671 - DNA, 17 bp, H. sapiens
cacatgctctacaaaca

SEQ ID NO: 62672 - DNA, 16 bp, H. sapiens
cacatgctcttccctc

SEQ ID NO: 62673 - DNA, 16 bp, H. sapiens
cacatgctgttccctg

SEQ ID NO: 62674 - DNA, 16 bp, H. sapiens
cacatgctgttgggaa

SEQ ID NO: 62675 - DNA, 16 bp, H. sapiens
cacatggaaaaaaatg

SEQ ID NO: 62676 - DNA, 16 bp, H. sapiens
cacatggaactgtaag

SEQ ID NO: 62677 - DNA, 16 bp, H. sapiens
cacatggaatattttc

SEQ ID NO: 62678 - DNA, 16 bp, H. sapiens
cacatggacacaaaga

SEQ ID NO: 62679 - DNA, 16 bp, H. sapiens
cacatggacacaagga

SEQ ID NO: 62680 - DNA, 16 bp, H. sapiens
cacatggacacacgga

SEQ ID NO: 62681 - DNA, 18 bp, H. sapiens
cacatggacacaggaagg

SEQ ID NO: 62682 - DNA, 16 bp, H. sapiens
cacatggacatacaga

SEQ ID NO: 62683 - DNA, 17 bp, H. sapiens
cacatggacataggaag

SEQ ID NO: 62684 - DNA, 16 bp, H. sapiens
cacatggatacaaaga

SEQ ID NO: 62685 - DNA, 16 bp, H. sapiens
cacatggatataaaga

SEQ ID NO: 62686 - DNA, 16 bp, H. sapiens
cacatggcaaaacccc

SEQ ID NO: 62687 - DNA, 16 bp, H. sapiens
cacatggcagagaaca

SEQ ID NO: 62688 - DNA, 16 bp, H. sapiens
cacatggcagagacag

SEQ ID NO: 62689 - DNA, 16 bp, H. sapiens
cacatggcagccagag

SEQ ID NO: 62690 - DNA, 16 bp, H. sapiens
cacatggccagaacag

SEQ ID NO: 62691 - DNA, 16 bp, H. sapiens
cacatggccttctccc

SEQ ID NO: 62692 - DNA, 16 bp, H. sapiens
cacatggccttctctc

SEQ ID NO: 62693 - DNA, 16 bp, H. sapiens
cacatggcgagagagg

SEQ ID NO: 62694 - DNA, 16 bp, H. sapiens
cacatggctggagagg

SEQ ID NO: 62695 - DNA, 16 bp, H. sapiens
cacatggctgggcagg

SEQ ID NO: 62696 - DNA, 16 bp, H. sapiens
cacatggctgggggag

SEQ ID NO: 62697 - DNA, 16 bp, H. sapiens
cacatgggacattctc

SEQ ID NO: 62698 - DNA, 16 bp, H. sapiens
cacatggtgaaaggga

SEQ ID NO: 62699 - DNA, 16 bp, H. sapiens
cacatggtgagagtgg

SEQ ID NO: 62700 - DNA, 16 bp, H. sapiens
cacatggtggaagaga

SEQ ID NO: 62701 - DNA, 16 bp, H. sapiens
cacatggtggcatgtg

SEQ ID NO: 62702 - DNA, 16 bp, H. sapiens
cacatggttacatttc

SEQ ID NO: 62703 - DNA, 16 bp, H. sapiens
cacatggttgaactag

SEQ ID NO: 62704 - DNA, 16 bp, H. sapiens
cacatgtaaaatatat

SEQ ID NO: 62705 - DNA, 16 bp, H. sapiens
cacatgtacaccctga

SEQ ID NO: 62706 - DNA, 16 bp, H. sapiens
cacatgtacatacatg

SEQ ID NO: 62707 - DNA, 16 bp, H. sapiens
cacatgtacccctgta

SEQ ID NO: 62708 - DNA, 16 bp, H. sapiens
cacatgtatacacaca

SEQ ID NO: 62709 - DNA, 16 bp, H. sapiens
cacatgtatacctgtg

SEQ ID NO: 62710 - DNA, 18 bp, H. sapiens
cacatgtatacgtatgta

SEQ ID NO: 62711 - DNA, 16 bp, H. sapiens
cacatgtattccaaaa

SEQ ID NO: 62712 - DNA, 16 bp, H. sapiens
cacatgtcatcaggac

SEQ ID NO: 62713 - DNA, 16 bp, H. sapiens
cacatgtctagggagg

SEQ ID NO: 62714 - DNA, 16 bp, H. sapiens
cacatgtgcacacaca

SEQ ID NO: 62715 - DNA, 16 bp, H. sapiens
cacatgtgcacacacg

SEQ ID NO: 62716 - DNA, 16 bp, H. sapiens
cacatgtgcacagaca

SEQ ID NO: 62717 - DNA, 16 bp, H. sapiens
cacatgtgcccccaaa

SEQ ID NO: 62718 - DNA, 16 bp, H. sapiens
cacatgtgcccctgaa

SEQ ID NO: 62719 - DNA, 16 bp, H. sapiens
cacatgtggctagtga

SEQ ID NO: 62720 - DNA, 16 bp, H. sapiens
cacatgtgtacacaca

SEQ ID NO: 62721 - DNA, 16 bp, H. sapiens
cacatgtgtatatatt

SEQ ID NO: 62722 - DNA, 16 bp, H. sapiens
cacatgtgtatgcaca

SEQ ID NO: 62723 - DNA, 16 bp, H. sapiens
cacatgtgtgcataca

SEQ ID NO: 62724 - DNA, 16 bp, H. sapiens
cacatgtgtgtatgtg

SEQ ID NO: 62725 - DNA, 16 bp, H. sapiens
cacatgtgtgtgcaca

SEQ ID NO: 62726 - DNA, 16 bp, H. sapiens
cacatgtgtgtgcatg

SEQ ID NO: 62727 - DNA, 16 bp, H. sapiens
cacatgtgtttttatg

SEQ ID NO: 62728 - DNA, 16 bp, H. sapiens
cacatgttctcagaac

SEQ ID NO: 62729 - DNA, 16 bp, H. sapiens
cacatgtttgtgtgtg

SEQ ID NO: 62730 - DNA, 16 bp, H. sapiens
cacattaaaaagatca

SEQ ID NO: 62731 - DNA, 16 bp, H. sapiens
cacattaaaaaggaaa

SEQ ID NO: 62732 - DNA, 16 bp, H. sapiens
cacattaaaagcagtg

SEQ ID NO: 62733 - DNA, 16 bp, H. sapiens
cacattacatttagtc

SEQ ID NO: 62734 - DNA, 16 bp, H. sapiens
cacattaccttacttc

SEQ ID NO: 62735 - DNA, 16 bp, H. sapiens
cacattatacacaaaa

SEQ ID NO: 62736 - DNA, 16 bp, H. sapiens
cacattcacacatgca

SEQ ID NO: 62737 - DNA, 16 bp, H. sapiens
cacattcagaccatag

SEQ ID NO: 62738 - DNA, 16 bp, H. sapiens
cacattcatggattgg

SEQ ID NO: 62739 - DNA, 16 bp, H. sapiens
cacattcctcagccct

SEQ ID NO: 62740 - DNA, 16 bp, H. sapiens
cacattcctcatttgg

SEQ ID NO: 62741 - DNA, 16 bp, H. sapiens
cacattcctttccttt

SEQ ID NO: 62742 - DNA, 16 bp, H. sapiens
cacattctacaaaaag

SEQ ID NO: 62743 - DNA, 16 bp, H. sapiens
cacattctcccatata

SEQ ID NO: 62744 - DNA, 16 bp, H. sapiens
cacattctgaggcact

SEQ ID NO: 62745 - DNA, 16 bp, H. sapiens
cacattcttctgccat

SEQ ID NO: 62746 - DNA, 16 bp, H. sapiens
cacattctttccaaaa

SEQ ID NO: 62747 - DNA, 16 bp, H. sapiens
cacattgaggcctata

SEQ ID NO: 62748 - DNA, 16 bp, H. sapiens
cacattgattttgaat

SEQ ID NO: 62749 - DNA, 16 bp, H. sapiens
cacattgcaaaataca

SEQ ID NO: 62750 - DNA, 18 bp, H. sapiens
cacattgggaggctgagg

SEQ ID NO: 62751 - DNA, 16 bp, H. sapiens
cacattgtcttaatta

SEQ ID NO: 62752 - DNA, 16 bp, H. sapiens
cacattgtcttccaca

SEQ ID NO: 62753 - DNA, 17 bp, H. sapiens
cacattgtgcacatgta

SEQ ID NO: 62754 - DNA, 16 bp, H. sapiens
cacattgttggggttg

SEQ ID NO: 62755 - DNA, 16 bp, H. sapiens
cacatttaaaacataa

SEQ ID NO: 62756 - DNA, 16 bp, H. sapiens
cacatttaaaatgatt

SEQ ID NO: 62757 - DNA, 16 bp, H. sapiens
cacatttaaagcagtg

SEQ ID NO: 62758 - DNA, 17 bp, H. sapiens
cacatttaaagcagtgt

SEQ ID NO: 62759 - DNA, 16 bp, H. sapiens
cacatttaatttcttt

SEQ ID NO: 62760 - DNA, 16 bp, H. sapiens
cacatttatataaata

SEQ ID NO: 62761 - DNA, 16 bp, H. sapiens
cacatttcaacatgag

SEQ ID NO: 62762 - DNA, 16 bp, H. sapiens
cacatttcaagtgctt

SEQ ID NO: 62763 - DNA, 16 bp, H. sapiens
cacatttctcatttgg

SEQ ID NO: 62764 - DNA, 16 bp, H. sapiens
cacatttgaaaacaca

SEQ ID NO: 62765 - DNA, 16 bp, H. sapiens
cacatttgaagcagtg

SEQ ID NO: 62766 - DNA, 16 bp, H. sapiens
cacattttaaaatgtt

SEQ ID NO: 62767 - DNA, 16 bp, H. sapiens
cacattttaaattctt

SEQ ID NO: 62768 - DNA, 16 bp, H. sapiens
cacattttaaatttta

SEQ ID NO: 62769 - DNA, 16 bp, H. sapiens
cacattttacatgtga

SEQ ID NO: 62770 - DNA, 16 bp, H. sapiens
cacattttaggaaaaa

SEQ ID NO: 62771 - DNA, 16 bp, H. sapiens
cacattttatttctcc

SEQ ID NO: 62772 - DNA, 16 bp, H. sapiens
cacattttccatgaac

SEQ ID NO: 62773 - DNA, 16 bp, H. sapiens
cacattttcctctctt

SEQ ID NO: 62774 - DNA, 16 bp, H. sapiens
cacattttccttcctc

SEQ ID NO: 62775 - DNA, 16 bp, H. sapiens
cacattttctctatct

SEQ ID NO: 62776 - DNA, 16 bp, H. sapiens
cacattttcttcatct

SEQ ID NO: 62777 - DNA, 16 bp, H. sapiens
cacattttgagaacca

SEQ ID NO: 62778 - DNA, 16 bp, H. sapiens
cacattttgagaagca

SEQ ID NO: 62779 - DNA, 16 bp, H. sapiens
cacattttgatatatt

SEQ ID NO: 62780 - DNA, 16 bp, H. sapiens
cacattttgtctatct

SEQ ID NO: 62781 - DNA, 16 bp, H. sapiens
cacatttttcaaaatt

SEQ ID NO: 62782 - DNA, 16 bp, H. sapiens
cacatttttcttattc

SEQ ID NO: 62783 - DNA, 16 bp, H. sapiens
cacatttttgtgcttt

SEQ ID NO: 62784 - DNA, 16 bp, H. sapiens
cacatttttgttgttg

SEQ ID NO: 62785 - DNA, 16 bp, H. sapiens
cacattttttggtttc

SEQ ID NO: 62786 - DNA, 16 bp, H. sapiens
cacattttttgttgtt

SEQ ID NO: 62787 - DNA, 16 bp, H. sapiens
cacattttttttaaaa

SEQ ID NO: 62788 - DNA, 16 bp, H. sapiens
caccaaaaaatggaaa

SEQ ID NO: 62789 - DNA, 16 bp, H. sapiens
caccaaaaactggaaa

SEQ ID NO: 62790 - DNA, 16 bp, H. sapiens
caccaaaacaacatgg

SEQ ID NO: 62791 - DNA, 16 bp, H. sapiens
caccaaaacccatctg

SEQ ID NO: 62792 - DNA, 19 bp, H. sapiens
caccaaaagcaatggcaat

SEQ ID NO: 62793 - DNA, 16 bp, H. sapiens
caccaaaatctcagga

SEQ ID NO: 62794 - DNA, 16 bp, H. sapiens
caccaaacaacagatt

SEQ ID NO: 62795 - DNA, 16 bp, H. sapiens
caccaaagaagataaa

SEQ ID NO: 62796 - DNA, 16 bp, H. sapiens
caccaaagaagatgta

SEQ ID NO: 62797 - DNA, 16 bp, H. sapiens
caccaaagcaatggca

SEQ ID NO: 62798 - DNA, 16 bp, H. sapiens
caccaaatccaagatg

SEQ ID NO: 62799 - DNA, 16 bp, H. sapiens
caccaaatgaaataaa

SEQ ID NO: 62800 - DNA, 16 bp, H. sapiens
caccaacatggagaaa

SEQ ID NO: 62801 - DNA, 16 bp, H. sapiens
caccaacctgggtgac

SEQ ID NO: 62802 - DNA, 16 bp, H. sapiens
caccaactcaaaagtc

SEQ ID NO: 62803 - DNA, 17 bp, H. sapiens
caccaacttaaaaagga

SEQ ID NO: 62804 - DNA, 16 bp, H. sapiens
caccaagaaaatgggg

SEQ ID NO: 62805 - DNA, 16 bp, H. sapiens
caccaagaggatggtg

SEQ ID NO: 62806 - DNA, 16 bp, H. sapiens
caccaagcagcagaca

SEQ ID NO: 62807 - DNA, 16 bp, H. sapiens
caccaagccattcatg

SEQ ID NO: 62808 - DNA, 16 bp, H. sapiens
caccaagcccagccaa

SEQ ID NO: 62809 - DNA, 16 bp, H. sapiens
caccaagcctggagtg

SEQ ID NO: 62810 - DNA, 16 bp, H. sapiens
caccaagctcaagtgt

SEQ ID NO: 62811 - DNA, 16 bp, H. sapiens
caccaaggaaaggcca

SEQ ID NO: 62812 - DNA, 16 bp, H. sapiens
caccaaggattgccag

SEQ ID NO: 62813 - DNA, 16 bp, H. sapiens
caccaaggcaagaacc

SEQ ID NO: 62814 - DNA, 16 bp, H. sapiens
caccaaggctgcagtg

SEQ ID NO: 62815 - DNA, 16 bp, H. sapiens
caccaaggctggaggg

SEQ ID NO: 62816 - DNA, 16 bp, H. sapiens
caccaagggaagactg

SEQ ID NO: 62817 - DNA, 16 bp, H. sapiens
caccaaggtggaaatg

SEQ ID NO: 62818 - DNA, 16 bp, H. sapiens
caccaataatgaaata

SEQ ID NO: 62819 - DNA, 18 bp, H. sapiens
caccaatcagcaccctgt

SEQ ID NO: 62820 - DNA, 23 bp, H. sapiens
caccaatcagcaccctgtcaaaa

SEQ ID NO: 62821 - DNA, 17 bp, H. sapiens
caccaatcagcgccctg

SEQ ID NO: 62822 - DNA, 16 bp, H. sapiens
caccaatggcctcatg

SEQ ID NO: 62823 - DNA, 16 bp, H. sapiens
caccacaacctccagc

SEQ ID NO: 62824 - DNA, 16 bp, H. sapiens
caccacaacctctgct

SEQ ID NO: 62825 - DNA, 16 bp, H. sapiens
caccacacacacatgc

SEQ ID NO: 62826 - DNA, 16 bp, H. sapiens
caccacacacactgca

SEQ ID NO: 62827 - DNA, 16 bp, H. sapiens
caccacacacagccag

SEQ ID NO: 62828 - DNA, 16 bp, H. sapiens
caccacacacatgcac

SEQ ID NO: 62829 - DNA, 16 bp, H. sapiens
caccacaccactgcac

SEQ ID NO: 62830 - DNA, 16 bp, H. sapiens
caccacacccagcagt

SEQ ID NO: 62831 - DNA, 16 bp, H. sapiens
caccacacccagccat

SEQ ID NO: 62832 - DNA, 16 bp, H. sapiens
caccacacccagctaa

SEQ ID NO: 62833 - DNA, 16 bp, H. sapiens
caccacacccagctag

SEQ ID NO: 62834 - DNA, 16 bp, H. sapiens
caccacacccagctat

SEQ ID NO: 62835 - DNA, 16 bp, H. sapiens
caccacacccagcttc

SEQ ID NO: 62836 - DNA, 16 bp, H. sapiens
caccacacccggctga

SEQ ID NO: 62837 - DNA, 16 bp, H. sapiens
caccacaccctgccag

SEQ ID NO: 62838 - DNA, 16 bp, H. sapiens
caccacacctgcctaa

SEQ ID NO: 62839 - DNA, 16 bp, H. sapiens
caccacacctggcaaa

SEQ ID NO: 62840 - DNA, 16 bp, H. sapiens
caccacacctggcatg

SEQ ID NO: 62841 - DNA, 16 bp, H. sapiens
caccacacctggccct

SEQ ID NO: 62842 - DNA, 16 bp, H. sapiens
caccacactctagcct

SEQ ID NO: 62843 - DNA, 16 bp, H. sapiens
caccacactctcttcc

SEQ ID NO: 62844 - DNA, 16 bp, H. sapiens
caccacagacatctca

SEQ ID NO: 62845 - DNA, 16 bp, H. sapiens
caccacagccaccatg

SEQ ID NO: 62846 - DNA, 16 bp, H. sapiens
caccacagccagcctc

SEQ ID NO: 62847 - DNA, 16 bp, H. sapiens
caccacagcctccacc

SEQ ID NO: 62848 - DNA, 16 bp, H. sapiens
caccacagcctctgcc

SEQ ID NO: 62849 - DNA, 16 bp, H. sapiens
caccacagctcaaaga

SEQ ID NO: 62850 - DNA, 16 bp, H. sapiens
caccacagctcaagaa

SEQ ID NO: 62851 - DNA, 16 bp, H. sapiens
caccacagctgcccaa

SEQ ID NO: 62852 - DNA, 16 bp, H. sapiens
caccacagctggccaa

SEQ ID NO: 62853 - DNA, 16 bp, H. sapiens
caccacagctggctaa

SEQ ID NO: 62854 - DNA, 16 bp, H. sapiens
caccacagctgtggct

SEQ ID NO: 62855 - DNA, 16 bp, H. sapiens
caccacaggttaggaa

SEQ ID NO: 62856 - DNA, 16 bp, H. sapiens
caccacagtcaagata

SEQ ID NO: 62857 - DNA, 16 bp, H. sapiens
caccacagtcagctaa

SEQ ID NO: 62858 - DNA, 21 bp, H. sapiens
caccacatagttggaagtaaa

SEQ ID NO: 62859 - DNA, 17 bp, H. sapiens
caccacatatctacaac

SEQ ID NO: 62860 - DNA, 16 bp, H. sapiens
caccacatctggccca

SEQ ID NO: 62861 - DNA, 16 bp, H. sapiens
caccacatggaagctg

SEQ ID NO: 62862 - DNA, 16 bp, H. sapiens
caccacatggcacata

SEQ ID NO: 62863 - DNA, 16 bp, H. sapiens
caccacattggccaag

SEQ ID NO: 62864 - DNA, 16 bp, H. sapiens
caccacattggccggg

SEQ ID NO: 62865 - DNA, 16 bp, H. sapiens
caccaccaaagtttcc

SEQ ID NO: 62866 - DNA, 16 bp, H. sapiens
caccaccaagccctgc

SEQ ID NO: 62867 - DNA, 16 bp, H. sapiens
caccaccaagcctgga

SEQ ID NO: 62868 - DNA, 16 bp, H. sapiens
caccaccaagcctggc

SEQ ID NO: 62869 - DNA, 16 bp, H. sapiens
caccaccaagcctggt

SEQ ID NO: 62870 - DNA, 16 bp, H. sapiens
caccaccaagctcagc

SEQ ID NO: 62871 - DNA, 16 bp, H. sapiens
caccaccacacccagt

SEQ ID NO: 62872 - DNA, 17 bp, H. sapiens
caccaccacacctggat

SEQ ID NO: 62873 - DNA, 16 bp, H. sapiens
caccaccacacttggc

SEQ ID NO: 62874 - DNA, 16 bp, H. sapiens
caccaccacatccggc

SEQ ID NO: 62875 - DNA, 16 bp, H. sapiens
caccaccaccaccgtc

SEQ ID NO: 62876 - DNA, 16 bp, H. sapiens
caccaccaccacctgc

SEQ ID NO: 62877 - DNA, 16 bp, H. sapiens
caccaccaccactgcc

SEQ ID NO: 62878 - DNA, 16 bp, H. sapiens
caccaccaccactgct

SEQ ID NO: 62879 - DNA, 16 bp, H. sapiens
caccaccaccatcttc

SEQ ID NO: 62880 - DNA, 16 bp, H. sapiens
caccaccaccatggac

SEQ ID NO: 62881 - DNA, 16 bp, H. sapiens
caccaccaccgccatc

SEQ ID NO: 62882 - DNA, 16 bp, H. sapiens
caccaccacgccctgc

SEQ ID NO: 62883 - DNA, 16 bp, H. sapiens
caccaccacgctggct

SEQ ID NO: 62884 - DNA, 16 bp, H. sapiens
caccaccacgtcctgc

SEQ ID NO: 62885 - DNA, 16 bp, H. sapiens
caccaccactgagact

SEQ ID NO: 62886 - DNA, 16 bp, H. sapiens
caccaccactgccacc

SEQ ID NO: 62887 - DNA, 16 bp, H. sapiens
caccaccactgccatc

SEQ ID NO: 62888 - DNA, 16 bp, H. sapiens
caccaccactgctggc

SEQ ID NO: 62889 - DNA, 16 bp, H. sapiens
caccaccagacctggc

SEQ ID NO: 62890 - DNA, 16 bp, H. sapiens
caccaccagcaccatc

SEQ ID NO: 62891 - DNA, 16 bp, H. sapiens
caccaccagcccagct

SEQ ID NO: 62892 - DNA, 16 bp, H. sapiens
caccaccagccctgcc

SEQ ID NO: 62893 - DNA, 16 bp, H. sapiens
caccaccagctctcct

SEQ ID NO: 62894 - DNA, 16 bp, H. sapiens
caccaccaggcctgct

SEQ ID NO: 62895 - DNA, 16 bp, H. sapiens
caccaccaggcctggc

SEQ ID NO: 62896 - DNA, 16 bp, H. sapiens
caccaccaggtccagc

SEQ ID NO: 62897 - DNA, 17 bp, H. sapiens
caccaccatcaagttgg

SEQ ID NO: 62898 - DNA, 16 bp, H. sapiens
caccaccatcactgcc

SEQ ID NO: 62899 - DNA, 16 bp, H. sapiens
caccaccatcatcact

SEQ ID NO: 62900 - DNA, 16 bp, H. sapiens
caccaccatcatcatc

SEQ ID NO: 62901 - DNA, 16 bp, H. sapiens
caccaccatccagctc

SEQ ID NO: 62902 - DNA, 16 bp, H. sapiens
caccaccatgaccacc

SEQ ID NO: 62903 - DNA, 16 bp, H. sapiens
caccaccatgcccagt

SEQ ID NO: 62904 - DNA, 16 bp, H. sapiens
caccaccatgcttggc

SEQ ID NO: 62905 - DNA, 16 bp, H. sapiens
caccacccatctccag

SEQ ID NO: 62906 - DNA, 16 bp, H. sapiens
caccaccccaggctaa

SEQ ID NO: 62907 - DNA, 16 bp, H. sapiens
caccacccccagccat

SEQ ID NO: 62908 - DNA, 16 bp, H. sapiens
caccaccccgcctggc

SEQ ID NO: 62909 - DNA, 16 bp, H. sapiens
caccacccctggcctg

SEQ ID NO: 62910 - DNA, 16 bp, H. sapiens
caccaccctgtcttcc

SEQ ID NO: 62911 - DNA, 19 bp, H. sapiens
caccaccctttgctgactc

SEQ ID NO: 62912 - DNA, 16 bp, H. sapiens
caccaccgtgcccggc

SEQ ID NO: 62913 - DNA, 16 bp, H. sapiens
caccacctcagcctcc

SEQ ID NO: 62914 - DNA, 16 bp, H. sapiens
caccacctccaccaga

SEQ ID NO: 62915 - DNA, 16 bp, H. sapiens
caccacctccagctaa

SEQ ID NO: 62916 - DNA, 16 bp, H. sapiens
caccacctcctccagc

SEQ ID NO: 62917 - DNA, 16 bp, H. sapiens
caccacctcctccagg

SEQ ID NO: 62918 - DNA, 16 bp, H. sapiens
caccacctgacaggcc

SEQ ID NO: 62919 - DNA, 16 bp, H. sapiens
caccacctgctcccca

SEQ ID NO: 62920 - DNA, 16 bp, H. sapiens
caccacctgttcccaa

SEQ ID NO: 62921 - DNA, 16 bp, H. sapiens
caccacctgtttccca

SEQ ID NO: 62922 - DNA, 16 bp, H. sapiens
caccaccttactcctg

SEQ ID NO: 62923 - DNA, 16 bp, H. sapiens
caccacgcccagccag

SEQ ID NO: 62924 - DNA, 17 bp, H. sapiens
caccacgcccagcctga

SEQ ID NO: 62925 - DNA, 16 bp, H. sapiens
caccacgcccagctaa

SEQ ID NO: 62926 - DNA, 16 bp, H. sapiens
caccacgcccagctac

SEQ ID NO: 62927 - DNA, 16 bp, H. sapiens
caccacgcccagctat

SEQ ID NO: 62928 - DNA, 16 bp, H. sapiens
caccacgcccagctga

SEQ ID NO: 62929 - DNA, 16 bp, H. sapiens
caccacgcccagtcaa

SEQ ID NO: 62930 - DNA, 16 bp, H. sapiens
caccacgcccggctca

SEQ ID NO: 62931 - DNA, 16 bp, H. sapiens
caccacgcccggctga

SEQ ID NO: 62932 - DNA, 17 bp, H. sapiens
caccacgcccggctgag

SEQ ID NO: 62933 - DNA, 16 bp, H. sapiens
caccacgcccggcttc

SEQ ID NO: 62934 - DNA, 16 bp, H. sapiens
caccacgccctgcctg

SEQ ID NO: 62935 - DNA, 16 bp, H. sapiens
caccacgcctagccca

SEQ ID NO: 62936 - DNA, 16 bp, H. sapiens
caccacgcctggcaat

SEQ ID NO: 62937 - DNA, 17 bp, H. sapiens
caccacgcctggctaat

SEQ ID NO: 62938 - DNA, 16 bp, H. sapiens
caccacgcctggctac

SEQ ID NO: 62939 - DNA, 16 bp, H. sapiens
caccacgcctggctga

SEQ ID NO: 62940 - DNA, 16 bp, H. sapiens
caccacgctcagcctg

SEQ ID NO: 62941 - DNA, 16 bp, H. sapiens
caccacgctcagctaa

SEQ ID NO: 62942 - DNA, 18 bp, H. sapiens
caccacggcactccagcc

SEQ ID NO: 62943 - DNA, 17 bp, H. sapiens
caccacgtctggttaat

SEQ ID NO: 62944 - DNA, 16 bp, H. sapiens
caccacgttagccaag

SEQ ID NO: 62945 - DNA, 16 bp, H. sapiens
caccacgttggccatg

SEQ ID NO: 62946 - DNA, 16 bp, H. sapiens
caccactactaccact

SEQ ID NO: 62947 - DNA, 16 bp, H. sapiens
caccactaggcctggc

SEQ ID NO: 62948 - DNA, 16 bp, H. sapiens
caccactcatgagagg

SEQ ID NO: 62949 - DNA, 16 bp, H. sapiens
caccactcccggccct

SEQ ID NO: 62950 - DNA, 16 bp, H. sapiens
caccactgcaacccag

SEQ ID NO: 62951 - DNA, 16 bp, H. sapiens
caccactgcacccaac

SEQ ID NO: 62952 - DNA, 16 bp, H. sapiens
caccactgcacctggc

SEQ ID NO: 62953 - DNA, 16 bp, H. sapiens
caccactgcactaaag

SEQ ID NO: 62954 - DNA, 16 bp, H. sapiens
caccactgcactccaa

SEQ ID NO: 62955 - DNA, 16 bp, H. sapiens
caccactgcactccac

SEQ ID NO: 62956 - DNA, 16 bp, H. sapiens
caccactgcactgtgg

SEQ ID NO: 62957 - DNA, 16 bp, H. sapiens
caccactgcagcccag

SEQ ID NO: 62958 - DNA, 16 bp, H. sapiens
caccactgcatgccag

SEQ ID NO: 62959 - DNA, 16 bp, H. sapiens
caccactgctcaagga

SEQ ID NO: 62960 - DNA, 16 bp, H. sapiens
caccactgctctccag

SEQ ID NO: 62961 - DNA, 16 bp, H. sapiens
caccactgctgaggct

SEQ ID NO: 62962 - DNA, 16 bp, H. sapiens
caccactggacttcag

SEQ ID NO: 62963 - DNA, 16 bp, H. sapiens
caccactggcttttct

SEQ ID NO: 62964 - DNA, 16 bp, H. sapiens
caccactgggcccagc

SEQ ID NO: 62965 - DNA, 16 bp, H. sapiens
caccactgtaccccag

SEQ ID NO: 62966 - DNA, 16 bp, H. sapiens
caccactgtactccac

SEQ ID NO: 62967 - DNA, 16 bp, H. sapiens
caccactgtattccag

SEQ ID NO: 62968 - DNA, 16 bp, H. sapiens
caccactgtcctccag

SEQ ID NO: 62969 - DNA, 16 bp, H. sapiens
caccactgtgccaggc

SEQ ID NO: 62970 - DNA, 16 bp, H. sapiens
caccacttgttgaaaa

SEQ ID NO: 62971 - DNA, 16 bp, H. sapiens
caccagaacagcatgg

SEQ ID NO: 62972 - DNA, 16 bp, H. sapiens
caccagaagcaaatgc

SEQ ID NO: 62973 - DNA, 16 bp, H. sapiens
caccagaagcagatgc

SEQ ID NO: 62974 - DNA, 16 bp, H. sapiens
caccagaatctcagaa

SEQ ID NO: 62975 - DNA, 16 bp, H. sapiens
caccagagtgaacagg

SEQ ID NO: 62976 - DNA, 16 bp, H. sapiens
caccagatgcagatgc

SEQ ID NO: 62977 - DNA, 16 bp, H. sapiens
caccagcaacagacaa

SEQ ID NO: 62978 - DNA, 16 bp, H. sapiens
caccagcaatgtataa

SEQ ID NO: 62979 - DNA, 16 bp, H. sapiens
caccagcaatgtatga

SEQ ID NO: 62980 - DNA, 16 bp, H. sapiens
caccagcaccatcatc

SEQ ID NO: 62981 - DNA, 16 bp, H. sapiens
caccagcagaggctac

SEQ ID NO: 62982 - DNA, 16 bp, H. sapiens
caccagcagatgctgc

SEQ ID NO: 62983 - DNA, 16 bp, H. sapiens
caccagcagcagcagc

SEQ ID NO: 62984 - DNA, 16 bp, H. sapiens
caccagcaggcctgcc

SEQ ID NO: 62985 - DNA, 16 bp, H. sapiens
caccagccccctgctg

SEQ ID NO: 62986 - DNA, 16 bp, H. sapiens
caccagccctgccctg

SEQ ID NO: 62987 - DNA, 16 bp, H. sapiens
caccagcctctgcctc

SEQ ID NO: 62988 - DNA, 17 bp, H. sapiens
caccagcctgaccaaca

SEQ ID NO: 62989 - DNA, 16 bp, H. sapiens
caccagcctgggcgac

SEQ ID NO: 62990 - DNA, 16 bp, H. sapiens
caccagcctgggctac

SEQ ID NO: 62991 - DNA, 16 bp, H. sapiens
caccagctcctgttcc

SEQ ID NO: 62992 - DNA, 16 bp, H. sapiens
caccagctgagtgtcc

SEQ ID NO: 62993 - DNA, 16 bp, H. sapiens
caccagctgggcatgg

SEQ ID NO: 62994 - DNA, 16 bp, H. sapiens
caccaggaactgaatt

SEQ ID NO: 62995 - DNA, 18 bp, H. sapiens
caccaggagattatatcc

SEQ ID NO: 62996 - DNA, 16 bp, H. sapiens
caccaggcagggcccc

SEQ ID NO: 62997 - DNA, 16 bp, H. sapiens
caccaggcagtgcccc

SEQ ID NO: 62998 - DNA, 16 bp, H. sapiens
caccaggcccagctaa

SEQ ID NO: 62999 - DNA, 16 bp, H. sapiens
caccaggcccagctca

SEQ ID NO: 63000 - DNA, 16 bp, H. sapiens
caccaggccccacctt

SEQ ID NO: 63001 - DNA, 16 bp, H. sapiens
caccaggcctctcctc

SEQ ID NO: 63002 - DNA, 16 bp, H. sapiens
caccaggcctgcccca

SEQ ID NO: 63003 - DNA, 16 bp, H. sapiens
caccaggcctggccaa

SEQ ID NO: 63004 - DNA, 16 bp, H. sapiens
caccaggcctggccca

SEQ ID NO: 63005 - DNA, 16 bp, H. sapiens
caccaggcctggcccc

SEQ ID NO: 63006 - DNA, 16 bp, H. sapiens
caccaggcctggcctc

SEQ ID NO: 63007 - DNA, 16 bp, H. sapiens
caccaggctgcagcct

SEQ ID NO: 63008 - DNA, 16 bp, H. sapiens
caccagggaacaagca

SEQ ID NO: 63009 - DNA, 16 bp, H. sapiens
caccagggacctgttt

SEQ ID NO: 63010 - DNA, 16 bp, H. sapiens
caccagggactgttgt

SEQ ID NO: 63011 - DNA, 16 bp, H. sapiens
caccagggatcagttt

SEQ ID NO: 63012 - DNA, 16 bp, H. sapiens
caccagggccaggtgg

SEQ ID NO: 63013 - DNA, 16 bp, H. sapiens
caccagggcctgttgc

SEQ ID NO: 63014 - DNA, 16 bp, H. sapiens
caccagggtctgttgt

SEQ ID NO: 63015 - DNA, 16 bp, H. sapiens
caccaggtccagctaa

SEQ ID NO: 63016 - DNA, 16 bp, H. sapiens
caccaggtggcagcag

SEQ ID NO: 63017 - DNA, 16 bp, H. sapiens
caccaggttcctccct

SEQ ID NO: 63018 - DNA, 16 bp, H. sapiens
caccaggttggccagg

SEQ ID NO: 63019 - DNA, 16 bp, H. sapiens
caccagtcagaacagc

SEQ ID NO: 63020 - DNA, 16 bp, H. sapiens
caccagtcagaatggc

SEQ ID NO: 63021 - DNA, 16 bp, H. sapiens
caccagtcccactccc

SEQ ID NO: 63022 - DNA, 16 bp, H. sapiens
caccagttagaatggc

SEQ ID NO: 63023 - DNA, 16 bp, H. sapiens
caccagttgaaggaca

SEQ ID NO: 63024 - DNA, 16 bp, H. sapiens
caccagtttctttgct

SEQ ID NO: 63025 - DNA, 16 bp, H. sapiens
caccataaaaaggaat

SEQ ID NO: 63026 - DNA, 16 bp, H. sapiens
caccatacccagcccc

SEQ ID NO: 63027 - DNA, 16 bp, H. sapiens
caccatacccagctac

SEQ ID NO: 63028 - DNA, 16 bp, H. sapiens
caccatacctggcccc

SEQ ID NO: 63029 - DNA, 16 bp, H. sapiens
caccatagacctcaaa

SEQ ID NO: 63030 - DNA, 16 bp, H. sapiens
caccatatacaataat

SEQ ID NO: 63031 - DNA, 16 bp, H. sapiens
caccatatgaggacac

SEQ ID NO: 63032 - DNA, 16 bp, H. sapiens
caccatcaagctgtcc

SEQ ID NO: 63033 - DNA, 16 bp, H. sapiens
caccatcacacccaga

SEQ ID NO: 63034 - DNA, 16 bp, H. sapiens
caccatcaccaccttc

SEQ ID NO: 63035 - DNA, 16 bp, H. sapiens
caccatcaccatcctc

SEQ ID NO: 63036 - DNA, 16 bp, H. sapiens
caccatcacccaggct

SEQ ID NO: 63037 - DNA, 16 bp, H. sapiens
caccatcacctccatt

SEQ ID NO: 63038 - DNA, 17 bp, H. sapiens
caccatcactgaccatc

SEQ ID NO: 63039 - DNA, 16 bp, H. sapiens
caccatcactgccacc

SEQ ID NO: 63040 - DNA, 24 bp, H. sapiens
caccatcagagtgaacaggcaacc

SEQ ID NO: 63041 - DNA, 16 bp, H. sapiens
caccatcagcatcacc

SEQ ID NO: 63042 - DNA, 16 bp, H. sapiens
caccatcatcaaacac

SEQ ID NO: 63043 - DNA, 16 bp, H. sapiens
caccatcatcaagtgg

SEQ ID NO: 63044 - DNA, 16 bp, H. sapiens
caccatcatcatcacc

SEQ ID NO: 63045 - DNA, 16 bp, H. sapiens
caccatcatcatctcc

SEQ ID NO: 63046 - DNA, 16 bp, H. sapiens
caccatcatctcttgc

SEQ ID NO: 63047 - DNA, 16 bp, H. sapiens
caccatcattgtcatc

SEQ ID NO: 63048 - DNA, 16 bp, H. sapiens
caccatccacataaga

SEQ ID NO: 63049 - DNA, 16 bp, H. sapiens
caccatccctggcctc

SEQ ID NO: 63050 - DNA, 16 bp, H. sapiens
caccatcctcaccatc

SEQ ID NO: 63051 - DNA, 16 bp, H. sapiens
caccatcctcagcaaa

SEQ ID NO: 63052 - DNA, 16 bp, H. sapiens
caccatcctccagact

SEQ ID NO: 63053 - DNA, 16 bp, H. sapiens
caccatcctgactgaa

SEQ ID NO: 63054 - DNA, 17 bp, H. sapiens
caccatcctggccaaca

SEQ ID NO: 63055 - DNA, 16 bp, H. sapiens
caccatctcagcccaa

SEQ ID NO: 63056 - DNA, 16 bp, H. sapiens
caccatctccaccatc

SEQ ID NO: 63057 - DNA, 16 bp, H. sapiens
caccatctccatctcc

SEQ ID NO: 63058 - DNA, 16 bp, H. sapiens
caccatctgttcccca

SEQ ID NO: 63059 - DNA, 16 bp, H. sapiens
caccatcttagctcac

SEQ ID NO: 63060 - DNA, 16 bp, H. sapiens
caccatcttcttggtt

SEQ ID NO: 63061 - DNA, 16 bp, H. sapiens
caccatcttgctgatg

SEQ ID NO: 63062 - DNA, 16 bp, H. sapiens
caccatcttggaagca

SEQ ID NO: 63063 - DNA, 16 bp, H. sapiens
caccatcttggcctgg

SEQ ID NO: 63064 - DNA, 16 bp, H. sapiens
caccatcttgtctcac

SEQ ID NO: 63065 - DNA, 16 bp, H. sapiens
caccatgaagaaactg

SEQ ID NO: 63066 - DNA, 16 bp, H. sapiens
caccatgaccaccacc

SEQ ID NO: 63067 - DNA, 16 bp, H. sapiens
caccatgagatactat

SEQ ID NO: 63068 - DNA, 16 bp, H. sapiens
caccatgatcaagggg

SEQ ID NO: 63069 - DNA, 16 bp, H. sapiens
caccatgatcttggac

SEQ ID NO: 63070 - DNA, 16 bp, H. sapiens
caccatgatgaccagg

SEQ ID NO: 63071 - DNA, 16 bp, H. sapiens
caccatgccaagccca

SEQ ID NO: 63072 - DNA, 16 bp, H. sapiens
caccatgccaggccca

SEQ ID NO: 63073 - DNA, 16 bp, H. sapiens
caccatgccaggctaa

SEQ ID NO: 63074 - DNA, 16 bp, H. sapiens
caccatgcccaaccag

SEQ ID NO: 63075 - DNA, 16 bp, H. sapiens
caccatgcccagataa

SEQ ID NO: 63076 - DNA, 16 bp, H. sapiens
caccatgcccagcaac

SEQ ID NO: 63077 - DNA, 16 bp, H. sapiens
caccatgcccagcatt

SEQ ID NO: 63078 - DNA, 16 bp, H. sapiens
caccatgcccagccac

SEQ ID NO: 63079 - DNA, 16 bp, H. sapiens
caccatgcccagcccc

SEQ ID NO: 63080 - DNA, 16 bp, H. sapiens
caccatgcccagcctg

SEQ ID NO: 63081 - DNA, 16 bp, H. sapiens
caccatgcccagcctt

SEQ ID NO: 63082 - DNA, 16 bp, H. sapiens
caccatgcccagctaa

SEQ ID NO: 63083 - DNA, 16 bp, H. sapiens
caccatgcccagctac

SEQ ID NO: 63084 - DNA, 16 bp, H. sapiens
caccatgcccagctag

SEQ ID NO: 63085 - DNA, 16 bp, H. sapiens
caccatgcccaggcta

SEQ ID NO: 63086 - DNA, 16 bp, H. sapiens
caccatgcccgacctc

SEQ ID NO: 63087 - DNA, 16 bp, H. sapiens
caccatgcccggcaag

SEQ ID NO: 63088 - DNA, 18 bp, H. sapiens
caccatgcccggccaaat

SEQ ID NO: 63089 - DNA, 17 bp, H. sapiens
caccatgcccggccagt

SEQ ID NO: 63090 - DNA, 17 bp, H. sapiens
caccatgcccggctaat

SEQ ID NO: 63091 - DNA, 16 bp, H. sapiens
caccatgccctgcaaa

SEQ ID NO: 63092 - DNA, 16 bp, H. sapiens
caccatgccctgccat

SEQ ID NO: 63093 - DNA, 16 bp, H. sapiens
caccatgcctggataa

SEQ ID NO: 63094 - DNA, 16 bp, H. sapiens
caccatgcctggctaa

SEQ ID NO: 63095 - DNA, 16 bp, H. sapiens
caccatgcctggctac

SEQ ID NO: 63096 - DNA, 16 bp, H. sapiens
caccatgcctggctct

SEQ ID NO: 63097 - DNA, 16 bp, H. sapiens
caccatgcctggctgc

SEQ ID NO: 63098 - DNA, 16 bp, H. sapiens
caccatgccttgctaa

SEQ ID NO: 63099 - DNA, 16 bp, H. sapiens
caccatgctaggcact

SEQ ID NO: 63100 - DNA, 16 bp, H. sapiens
caccatgctcagccct

SEQ ID NO: 63101 - DNA, 16 bp, H. sapiens
caccatgctcaggtaa

SEQ ID NO: 63102 - DNA, 16 bp, H. sapiens
caccatgcttcctata

SEQ ID NO: 63103 - DNA, 16 bp, H. sapiens
caccatggaatactac

SEQ ID NO: 63104 - DNA, 16 bp, H. sapiens
caccatggagaacagt

SEQ ID NO: 63105 - DNA, 16 bp, H. sapiens
caccatggccagcctc

SEQ ID NO: 63106 - DNA, 16 bp, H. sapiens
caccatgtcctgaggc

SEQ ID NO: 63107 - DNA, 16 bp, H. sapiens
caccatgtcggccaag

SEQ ID NO: 63108 - DNA, 16 bp, H. sapiens
caccatgtcggccagg

SEQ ID NO: 63109 - DNA, 16 bp, H. sapiens
caccatgtctggctgt

SEQ ID NO: 63110 - DNA, 16 bp, H. sapiens
caccatgtgaagacat

SEQ ID NO: 63111 - DNA, 16 bp, H. sapiens
caccatgtgaggacac

SEQ ID NO: 63112 - DNA, 16 bp, H. sapiens
caccatgtggcccagg

SEQ ID NO: 63113 - DNA, 16 bp, H. sapiens
caccattattttatgt

SEQ ID NO: 63114 - DNA, 16 bp, H. sapiens
caccattcaacccact

SEQ ID NO: 63115 - DNA, 16 bp, H. sapiens
caccattcctggccta

SEQ ID NO: 63116 - DNA, 16 bp, H. sapiens
caccattctaatttct

SEQ ID NO: 63117 - DNA, 16 bp, H. sapiens
caccattctactttct

SEQ ID NO: 63118 - DNA, 17 bp, H. sapiens
caccattgctgaggctt

SEQ ID NO: 63119 - DNA, 16 bp, H. sapiens
caccatttcatcattt

SEQ ID NO: 63120 - DNA, 16 bp, H. sapiens
caccatttcttgaaga

SEQ ID NO: 63121 - DNA, 16 bp, H. sapiens
caccatttggcaagtt

SEQ ID NO: 63122 - DNA, 16 bp, H. sapiens
caccattttatatcag

SEQ ID NO: 63123 - DNA, 16 bp, H. sapiens
caccattttatgttcc

SEQ ID NO: 63124 - DNA, 16 bp, H. sapiens
caccatttttgtagaa

SEQ ID NO: 63125 - DNA, 16 bp, H. sapiens
caccattttttgaaga

SEQ ID NO: 63126 - DNA, 16 bp, H. sapiens
cacccaaaggaaaaga

SEQ ID NO: 63127 - DNA, 16 bp, H. sapiens
cacccaaatcaagaaa

SEQ ID NO: 63128 - DNA, 16 bp, H. sapiens
cacccaaatcacatct

SEQ ID NO: 63129 - DNA, 16 bp, H. sapiens
cacccaaattctacca

SEQ ID NO: 63130 - DNA, 16 bp, H. sapiens
cacccaacactggaac

SEQ ID NO: 63131 - DNA, 16 bp, H. sapiens
cacccaagccagcagc

SEQ ID NO: 63132 - DNA, 16 bp, H. sapiens
cacccaaggccctcaa

SEQ ID NO: 63133 - DNA, 16 bp, H. sapiens
cacccacacaataata

SEQ ID NO: 63134 - DNA, 16 bp, H. sapiens
cacccacactggaagg

SEQ ID NO: 63135 - DNA, 16 bp, H. sapiens
cacccacagctgcccc

SEQ ID NO: 63136 - DNA, 16 bp, H. sapiens
cacccacatctcacct

SEQ ID NO: 63137 - DNA, 16 bp, H. sapiens
cacccacatgcacaca

SEQ ID NO: 63138 - DNA, 16 bp, H. sapiens
cacccacattcccttg

SEQ ID NO: 63139 - DNA, 16 bp, H. sapiens
cacccaccaccatgct

SEQ ID NO: 63140 - DNA, 16 bp, H. sapiens
cacccaccacgatgcc

SEQ ID NO: 63141 - DNA, 16 bp, H. sapiens
cacccaccatgtgcca

SEQ ID NO: 63142 - DNA, 16 bp, H. sapiens
cacccacccacccagt

SEQ ID NO: 63143 - DNA, 16 bp, H. sapiens
cacccacctcagcatc

SEQ ID NO: 63144 - DNA, 16 bp, H. sapiens
cacccacctcagccct

SEQ ID NO: 63145 - DNA, 16 bp, H. sapiens
cacccacctcagcctg

SEQ ID NO: 63146 - DNA, 16 bp, H. sapiens
cacccacctcatcttt

SEQ ID NO: 63147 - DNA, 17 bp, H. sapiens
cacccacctcgacctcc

SEQ ID NO: 63148 - DNA, 16 bp, H. sapiens
cacccacctcgacttc

SEQ ID NO: 63149 - DNA, 16 bp, H. sapiens
cacccacctcgggctc

SEQ ID NO: 63150 - DNA, 16 bp, H. sapiens
cacccacctctgcttc

SEQ ID NO: 63151 - DNA, 16 bp, H. sapiens
cacccacctggaactc

SEQ ID NO: 63152 - DNA, 19 bp, H. sapiens
cacccacctgggcctccca

SEQ ID NO: 63153 - DNA, 16 bp, H. sapiens
cacccaccttgcctcc

SEQ ID NO: 63154 - DNA, 16 bp, H. sapiens
cacccaccttggccac

SEQ ID NO: 63155 - DNA, 16 bp, H. sapiens
cacccactcattcatc

SEQ ID NO: 63156 - DNA, 20 bp, H. sapiens
cacccactgacctgcgccca

SEQ ID NO: 63157 - DNA, 16 bp, H. sapiens
cacccactgtcctgta

SEQ ID NO: 63158 - DNA, 16 bp, H. sapiens
cacccacttggcctcc

SEQ ID NO: 63159 - DNA, 16 bp, H. sapiens
cacccagaacaacttc

SEQ ID NO: 63160 - DNA, 16 bp, H. sapiens
cacccagacagcaggg

SEQ ID NO: 63161 - DNA, 16 bp, H. sapiens
cacccagactggagtc

SEQ ID NO: 63162 - DNA, 16 bp, H. sapiens
cacccagaggaccacc

SEQ ID NO: 63163 - DNA, 16 bp, H. sapiens
cacccagaggaggaga

SEQ ID NO: 63164 - DNA, 16 bp, H. sapiens
cacccagatcaagaaa

SEQ ID NO: 63165 - DNA, 16 bp, H. sapiens
cacccagcaccatgcc

SEQ ID NO: 63166 - DNA, 16 bp, H. sapiens
cacccagcagccagag

SEQ ID NO: 63167 - DNA, 16 bp, H. sapiens
cacccagccaaaaata

SEQ ID NO: 63168 - DNA, 16 bp, H. sapiens
cacccagccaaaaatt

SEQ ID NO: 63169 - DNA, 16 bp, H. sapiens
cacccagcccagtgcc

SEQ ID NO: 63170 - DNA, 16 bp, H. sapiens
cacccagccgattttt

SEQ ID NO: 63171 - DNA, 16 bp, H. sapiens
cacccagcctcttctt

SEQ ID NO: 63172 - DNA, 16 bp, H. sapiens
cacccagcctggaatg

SEQ ID NO: 63173 - DNA, 16 bp, H. sapiens
cacccagcctgggcaa

SEQ ID NO: 63174 - DNA, 16 bp, H. sapiens
cacccagcctggtgtg

SEQ ID NO: 63175 - DNA, 16 bp, H. sapiens
cacccagctaacttct

SEQ ID NO: 63176 - DNA, 16 bp, H. sapiens
cacccagctcagcctc

SEQ ID NO: 63177 - DNA, 16 bp, H. sapiens
cacccagcttctccct

SEQ ID NO: 63178 - DNA, 16 bp, H. sapiens
cacccaggaacaatac

SEQ ID NO: 63179 - DNA, 16 bp, H. sapiens
cacccaggatcaatac

SEQ ID NO: 63180 - DNA, 16 bp, H. sapiens
cacccaggccagcagc

SEQ ID NO: 63181 - DNA, 16 bp, H. sapiens
cacccaggccccaggt

SEQ ID NO: 63182 - DNA, 16 bp, H. sapiens
cacccaggcctggagt

SEQ ID NO: 63183 - DNA, 16 bp, H. sapiens
cacccaggctctggag

SEQ ID NO: 63184 - DNA, 16 bp, H. sapiens
cacccaggctgcaggg

SEQ ID NO: 63185 - DNA, 16 bp, H. sapiens
cacccaggctggacag

SEQ ID NO: 63186 - DNA, 16 bp, H. sapiens
cacccaggctggaggc

SEQ ID NO: 63187 - DNA, 16 bp, H. sapiens
cacccaggcttgggtg

SEQ ID NO: 63188 - DNA, 16 bp, H. sapiens
cacccagggtgcagtg

SEQ ID NO: 63189 - DNA, 17 bp, H. sapiens
cacccaggtgattaaaa

SEQ ID NO: 63190 - DNA, 16 bp, H. sapiens
cacccaggtgccaagg

SEQ ID NO: 63191 - DNA, 16 bp, H. sapiens
cacccaggtgggagtg

SEQ ID NO: 63192 - DNA, 16 bp, H. sapiens
cacccaggttcataaa

SEQ ID NO: 63193 - DNA, 16 bp, H. sapiens
cacccagtccatggta

SEQ ID NO: 63194 - DNA, 16 bp, H. sapiens
cacccagtcccatcga

SEQ ID NO: 63195 - DNA, 16 bp, H. sapiens
cacccagtgaggagaa

SEQ ID NO: 63196 - DNA, 16 bp, H. sapiens
cacccagtgcagtggc

SEQ ID NO: 63197 - DNA, 18 bp, H. sapiens
cacccagtggatcccgca

SEQ ID NO: 63198 - DNA, 16 bp, H. sapiens
cacccagttgtgacaa

SEQ ID NO: 63199 - DNA, 16 bp, H. sapiens
cacccatattcatagc

SEQ ID NO: 63200 - DNA, 16 bp, H. sapiens
cacccatcacccaggc

SEQ ID NO: 63201 - DNA, 16 bp, H. sapiens
cacccatcacccgagt

SEQ ID NO: 63202 - DNA, 16 bp, H. sapiens
cacccatctgtccatc

SEQ ID NO: 63203 - DNA, 16 bp, H. sapiens
cacccatgttgctgca

SEQ ID NO: 63204 - DNA, 16 bp, H. sapiens
cacccatgtttcagag

SEQ ID NO: 63205 - DNA, 16 bp, H. sapiens
cacccattcatctatc

SEQ ID NO: 63206 - DNA, 16 bp, H. sapiens
cacccattttacagat

SEQ ID NO: 63207 - DNA, 16 bp, H. sapiens
caccccaccatgccca

SEQ ID NO: 63208 - DNA, 16 bp, H. sapiens
caccccacccagcctg

SEQ ID NO: 63209 - DNA, 16 bp, H. sapiens
caccccacctggccaa

SEQ ID NO: 63210 - DNA, 16 bp, H. sapiens
caccccactccagcct

SEQ ID NO: 63211 - DNA, 16 bp, H. sapiens
caccccactcctggta

SEQ ID NO: 63212 - DNA, 16 bp, H. sapiens
caccccagacctgctg

SEQ ID NO: 63213 - DNA, 16 bp, H. sapiens
caccccagccagggca

SEQ ID NO: 63214 - DNA, 16 bp, H. sapiens
caccccagccctgcct

SEQ ID NO: 63215 - DNA, 16 bp, H. sapiens
caccccagcctccaga

SEQ ID NO: 63216 - DNA, 16 bp, H. sapiens
caccccagcctggcaa

SEQ ID NO: 63217 - DNA, 16 bp, H. sapiens
caccccagcctggcca

SEQ ID NO: 63218 - DNA, 16 bp, H. sapiens
caccccagcctgggaa

SEQ ID NO: 63219 - DNA, 16 bp, H. sapiens
caccccagcctgggga

SEQ ID NO: 63220 - DNA, 16 bp, H. sapiens
caccccagcctggttg

SEQ ID NO: 63221 - DNA, 16 bp, H. sapiens
caccccagccttcagc

SEQ ID NO: 63222 - DNA, 16 bp, H. sapiens
caccccagccttctga

SEQ ID NO: 63223 - DNA, 16 bp, H. sapiens
caccccaggccccact

SEQ ID NO: 63224 - DNA, 17 bp, H. sapiens
caccccatctctactaa

SEQ ID NO: 63225 - DNA, 16 bp, H. sapiens
caccccatctgggaag

SEQ ID NO: 63226 - DNA, 16 bp, H. sapiens
caccccattcccccag

SEQ ID NO: 63227 - DNA, 16 bp, H. sapiens
cacccccacacctggc

SEQ ID NO: 63228 - DNA, 16 bp, H. sapiens
cacccccacgcctggc

SEQ ID NO: 63229 - DNA, 16 bp, H. sapiens
cacccccagatgggac

SEQ ID NO: 63230 - DNA, 16 bp, H. sapiens
cacccccagcacctct

SEQ ID NO: 63231 - DNA, 16 bp, H. sapiens
cacccccagccaaggg

SEQ ID NO: 63232 - DNA, 16 bp, H. sapiens
cacccccagccctcag

SEQ ID NO: 63233 - DNA, 16 bp, H. sapiens
cacccccagcctgggc

SEQ ID NO: 63234 - DNA, 16 bp, H. sapiens
cacccccagctcctgg

SEQ ID NO: 63235 - DNA, 16 bp, H. sapiens
cacccccatccccagg

SEQ ID NO: 63236 - DNA, 16 bp, H. sapiens
caccccccagcagggg

SEQ ID NO: 63237 - DNA, 16 bp, H. sapiens
caccccctctggggct

SEQ ID NO: 63238 - DNA, 16 bp, H. sapiens
caccccctctgtgatc

SEQ ID NO: 63239 - DNA, 16 bp, H. sapiens
caccccctgacaggcc

SEQ ID NO: 63240 - DNA, 16 bp, H. sapiens
caccccctgctccagg

SEQ ID NO: 63241 - DNA, 16 bp, H. sapiens
caccccgcccagcctg

SEQ ID NO: 63242 - DNA, 16 bp, H. sapiens
caccccgcctggccaa

SEQ ID NO: 63243 - DNA, 16 bp, H. sapiens
cacccctaatcccact

SEQ ID NO: 63244 - DNA, 16 bp, H. sapiens
cacccctcactgctcc

SEQ ID NO: 63245 - DNA, 16 bp, H. sapiens
cacccctcagcaaatg

SEQ ID NO: 63246 - DNA, 16 bp, H. sapiens
cacccctcagctcagc

SEQ ID NO: 63247 - DNA, 16 bp, H. sapiens
cacccctccctctggg

SEQ ID NO: 63248 - DNA, 16 bp, H. sapiens
cacccctcctgccatc

SEQ ID NO: 63249 - DNA, 16 bp, H. sapiens
cacccctctcagcctc

SEQ ID NO: 63250 - DNA, 16 bp, H. sapiens
cacccctgcaccccag

SEQ ID NO: 63251 - DNA, 16 bp, H. sapiens
cacccctgcacttcag

SEQ ID NO: 63252 - DNA, 16 bp, H. sapiens
cacccctgccagccag

SEQ ID NO: 63253 - DNA, 16 bp, H. sapiens
cacccctgccccaggc

SEQ ID NO: 63254 - DNA, 16 bp, H. sapiens
cacccctggctaattt

SEQ ID NO: 63255 - DNA, 16 bp, H. sapiens
cacccctgtggctttt

SEQ ID NO: 63256 - DNA, 16 bp, H. sapiens
cacccgaaagtggaca

SEQ ID NO: 63257 - DNA, 16 bp, H. sapiens
cacccgagcctgggag

SEQ ID NO: 63258 - DNA, 17 bp, H. sapiens
cacccgccaccatgccg

SEQ ID NO: 63259 - DNA, 16 bp, H. sapiens
cacccgccctggcctc

SEQ ID NO: 63260 - DNA, 16 bp, H. sapiens
cacccgcctcggactc

SEQ ID NO: 63261 - DNA, 16 bp, H. sapiens
cacccggcctgtttct

SEQ ID NO: 63262 - DNA, 16 bp, H. sapiens
cacccgtcaccacgcc

SEQ ID NO: 63263 - DNA, 16 bp, H. sapiens
cacccgtctcagcctc

SEQ ID NO: 63264 - DNA, 16 bp, H. sapiens
caccctagccttttaa

SEQ ID NO: 63265 - DNA, 16 bp, H. sapiens
caccctaggtgacaga

SEQ ID NO: 63266 - DNA, 16 bp, H. sapiens
caccctcaaagacaca

SEQ ID NO: 63267 - DNA, 16 bp, H. sapiens
caccctcatgacctaa

SEQ ID NO: 63268 - DNA, 16 bp, H. sapiens
caccctccaccctctg

SEQ ID NO: 63269 - DNA, 16 bp, H. sapiens
caccctccacctccag

SEQ ID NO: 63270 - DNA, 16 bp, H. sapiens
caccctccagcctctg

SEQ ID NO: 63271 - DNA, 16 bp, H. sapiens
caccctccatctcctg

SEQ ID NO: 63272 - DNA, 16 bp, H. sapiens
caccctcccccaagtt

SEQ ID NO: 63273 - DNA, 16 bp, H. sapiens
caccctcctgctcctc

SEQ ID NO: 63274 - DNA, 16 bp, H. sapiens
caccctccttaccctg

SEQ ID NO: 63275 - DNA, 16 bp, H. sapiens
caccctctgcaatatt

SEQ ID NO: 63276 - DNA, 16 bp, H. sapiens
caccctctgcagccac

SEQ ID NO: 63277 - DNA, 16 bp, H. sapiens
caccctctgccatgat

SEQ ID NO: 63278 - DNA, 16 bp, H. sapiens
caccctctgcctccag

SEQ ID NO: 63279 - DNA, 16 bp, H. sapiens
caccctgaccaatatg

SEQ ID NO: 63280 - DNA, 16 bp, H. sapiens
caccctgatgaagttc

SEQ ID NO: 63281 - DNA, 16 bp, H. sapiens
caccctgcccggcctg

SEQ ID NO: 63282 - DNA, 16 bp, H. sapiens
caccctgccctgccac

SEQ ID NO: 63283 - DNA, 16 bp, H. sapiens
caccctgccctgccca

SEQ ID NO: 63284 - DNA, 16 bp, H. sapiens
caccctgccctgccct

SEQ ID NO: 63285 - DNA, 16 bp, H. sapiens
caccctgcctttgccc

SEQ ID NO: 63286 - DNA, 16 bp, H. sapiens
caccctgcttctgctt

SEQ ID NO: 63287 - DNA, 16 bp, H. sapiens
caccctggcaacagag

SEQ ID NO: 63288 - DNA, 16 bp, H. sapiens
caccctggccaagatg

SEQ ID NO: 63289 - DNA, 16 bp, H. sapiens
caccctggctggaatg

SEQ ID NO: 63290 - DNA, 16 bp, H. sapiens
caccctggtctgtgga

SEQ ID NO: 63291 - DNA, 16 bp, H. sapiens
caccctgtcaccaggc

SEQ ID NO: 63292 - DNA, 16 bp, H. sapiens
caccctgtccaacatg

SEQ ID NO: 63293 - DNA, 16 bp, H. sapiens
caccctgtcctcctcc

SEQ ID NO: 63294 - DNA, 16 bp, H. sapiens
caccctgtcttccaca

SEQ ID NO: 63295 - DNA, 16 bp, H. sapiens
caccctgtgaagaggt

SEQ ID NO: 63296 - DNA, 17 bp, H. sapiens
caccctgtgtctagctc

SEQ ID NO: 63297 - DNA, 28 bp, H. sapiens
caccctgtgtttagctcaaggtttgtga

SEQ ID NO: 63298 - DNA, 16 bp, H. sapiens
caccctgttctcctgc

SEQ ID NO: 63299 - DNA, 16 bp, H. sapiens
caccctgttggccaag

SEQ ID NO: 63300 - DNA, 16 bp, H. sapiens
cacccttaaaaatatg

SEQ ID NO: 63301 - DNA, 16 bp, H. sapiens
cacccttaagaaggta

SEQ ID NO: 63302 - DNA, 16 bp, H. sapiens
cacccttcttcccaat

SEQ ID NO: 63303 - DNA, 16 bp, H. sapiens
cacccttgtggctttg

SEQ ID NO: 63304 - DNA, 16 bp, H. sapiens
cacccttttcaacaaa

SEQ ID NO: 63305 - DNA, 16 bp, H. sapiens
caccgaaggcctcaaa

SEQ ID NO: 63306 - DNA, 16 bp, H. sapiens
caccgcacccaaccta

SEQ ID NO: 63307 - DNA, 16 bp, H. sapiens
caccgcacccaacctg

SEQ ID NO: 63308 - DNA, 16 bp, H. sapiens
caccgcacccagccag

SEQ ID NO: 63309 - DNA, 16 bp, H. sapiens
caccgcacccagctgc

SEQ ID NO: 63310 - DNA, 16 bp, H. sapiens
caccgcacccggtccc

SEQ ID NO: 63311 - DNA, 16 bp, H. sapiens
caccgcacctgacctg

SEQ ID NO: 63312 - DNA, 16 bp, H. sapiens
caccgcagcctccacc

SEQ ID NO: 63313 - DNA, 16 bp, H. sapiens
caccgcagcctctgcc

SEQ ID NO: 63314 - DNA, 16 bp, H. sapiens
caccgccaaggtctgc

SEQ ID NO: 63315 - DNA, 17 bp, H. sapiens
caccgccatgcctggct

SEQ ID NO: 63316 - DNA, 16 bp, H. sapiens
caccgcctcctccagc

SEQ ID NO: 63317 - DNA, 16 bp, H. sapiens
caccgcgccaggccaa

SEQ ID NO: 63318 - DNA, 16 bp, H. sapiens
caccgcgccctgccac

SEQ ID NO: 63319 - DNA, 16 bp, H. sapiens
caccgcgccctgccga

SEQ ID NO: 63320 - DNA, 17 bp, H. sapiens
caccgcgcctggccaat

SEQ ID NO: 63321 - DNA, 16 bp, H. sapiens
caccgcgcctggctgc

SEQ ID NO: 63322 - DNA, 16 bp, H. sapiens
caccgcgctcagcctc

SEQ ID NO: 63323 - DNA, 16 bp, H. sapiens
caccgctcctggcccc

SEQ ID NO: 63324 - DNA, 17 bp, H. sapiens
caccgctgcactgtggg

SEQ ID NO: 63325 - DNA, 16 bp, H. sapiens
caccggaggccaggag

SEQ ID NO: 63326 - DNA, 16 bp, H. sapiens
caccgggaggaaggaa

SEQ ID NO: 63327 - DNA, 16 bp, H. sapiens
caccgtgcccaaccta

SEQ ID NO: 63328 - DNA, 16 bp, H. sapiens
caccgtgcccaacctg

SEQ ID NO: 63329 - DNA, 16 bp, H. sapiens
caccgtgcccagcacc

SEQ ID NO: 63330 - DNA, 16 bp, H. sapiens
caccgtgcccggcaac

SEQ ID NO: 63331 - DNA, 16 bp, H. sapiens
caccgtgcccggccag

SEQ ID NO: 63332 - DNA, 16 bp, H. sapiens
caccgtgcccggctct

SEQ ID NO: 63333 - DNA, 16 bp, H. sapiens
caccgtgcctggcagc

SEQ ID NO: 63334 - DNA, 16 bp, H. sapiens
caccgtgcctggctgc

SEQ ID NO: 63335 - DNA, 16 bp, H. sapiens
caccgtggccaacatg

SEQ ID NO: 63336 - DNA, 16 bp, H. sapiens
caccgtggctcatgcc

SEQ ID NO: 63337 - DNA, 16 bp, H. sapiens
caccgtgtcacccagg

SEQ ID NO: 63338 - DNA, 16 bp, H. sapiens
caccgtgtctggccaa

SEQ ID NO: 63339 - DNA, 17 bp, H. sapiens
caccgtgttagacagga

SEQ ID NO: 63340 - DNA, 16 bp, H. sapiens
caccgttctggaggct

SEQ ID NO: 63341 - DNA, 16 bp, H. sapiens
cacctacatcctgctg

SEQ ID NO: 63342 - DNA, 16 bp, H. sapiens
cacctacctcaacctc

SEQ ID NO: 63343 - DNA, 16 bp, H. sapiens
cacctacctcataggg

SEQ ID NO: 63344 - DNA, 16 bp, H. sapiens
cacctactatgtaccc

SEQ ID NO: 63345 - DNA, 16 bp, H. sapiens
cacctagaggaattag

SEQ ID NO: 63346 - DNA, 16 bp, H. sapiens
cacctagattctacaa

SEQ ID NO: 63347 - DNA, 16 bp, H. sapiens
cacctaggttaattcc

SEQ ID NO: 63348 - DNA, 16 bp, H. sapiens
cacctatagtcccagt

SEQ ID NO: 63349 - DNA, 16 bp, H. sapiens
cacctatcaacccatt

SEQ ID NO: 63350 - DNA, 16 bp, H. sapiens
cacctatgacctggaa

SEQ ID NO: 63351 - DNA, 17 bp, H. sapiens
cacctatgtaacaaacc

SEQ ID NO: 63352 - DNA, 16 bp, H. sapiens
cacctattatcccagc

SEQ ID NO: 63353 - DNA, 16 bp, H. sapiens
cacctcacccagccta

SEQ ID NO: 63354 - DNA, 16 bp, H. sapiens
cacctcagactctcaa

SEQ ID NO: 63355 - DNA, 16 bp, H. sapiens
cacctcagatcatcag

SEQ ID NO: 63356 - DNA, 16 bp, H. sapiens
cacctcagcaccccca

SEQ ID NO: 63357 - DNA, 16 bp, H. sapiens
cacctcagcatcctga

SEQ ID NO: 63358 - DNA, 16 bp, H. sapiens
cacctcagccccccag

SEQ ID NO: 63359 - DNA, 16 bp, H. sapiens
cacctcagccctcctg

SEQ ID NO: 63360 - DNA, 16 bp, H. sapiens
cacctcagccctctga

SEQ ID NO: 63361 - DNA, 16 bp, H. sapiens
cacctcagcctcccag

SEQ ID NO: 63362 - DNA, 16 bp, H. sapiens
cacctcagcctccctg

SEQ ID NO: 63363 - DNA, 16 bp, H. sapiens
cacctcagcctctcac

SEQ ID NO: 63364 - DNA, 16 bp, H. sapiens
cacctcagcctctgcc

SEQ ID NO: 63365 - DNA, 16 bp, H. sapiens
cacctcagcctgccaa

SEQ ID NO: 63366 - DNA, 16 bp, H. sapiens
cacctcagcctggacc

SEQ ID NO: 63367 - DNA, 16 bp, H. sapiens
cacctcagcctgggca

SEQ ID NO: 63368 - DNA, 16 bp, H. sapiens
cacctcagccttcagc

SEQ ID NO: 63369 - DNA, 16 bp, H. sapiens
cacctcagcttccctg

SEQ ID NO: 63370 - DNA, 16 bp, H. sapiens
cacctcagcttcctca

SEQ ID NO: 63371 - DNA, 16 bp, H. sapiens
cacctcagcttcctgg

SEQ ID NO: 63372 - DNA, 18 bp, H. sapiens
cacctcaggtcgggagtt

SEQ ID NO: 63373 - DNA, 16 bp, H. sapiens
cacctcagtcccctga

SEQ ID NO: 63374 - DNA, 16 bp, H. sapiens
cacctcagtctcccag

SEQ ID NO: 63375 - DNA, 16 bp, H. sapiens
cacctcatcctcccaa

SEQ ID NO: 63376 - DNA, 16 bp, H. sapiens
cacctcatcctggact

SEQ ID NO: 63377 - DNA, 16 bp, H. sapiens
cacctcatcttcctga

SEQ ID NO: 63378 - DNA, 16 bp, H. sapiens
cacctccaaaaggccc

SEQ ID NO: 63379 - DNA, 16 bp, H. sapiens
cacctccaaaggaaca

SEQ ID NO: 63380 - DNA, 16 bp, H. sapiens
cacctccaaccttggg

SEQ ID NO: 63381 - DNA, 16 bp, H. sapiens
cacctccaccactcag

SEQ ID NO: 63382 - DNA, 16 bp, H. sapiens
cacctccagagttcaa

SEQ ID NO: 63383 - DNA, 16 bp, H. sapiens
cacctccagcccctgg

SEQ ID NO: 63384 - DNA, 16 bp, H. sapiens
cacctccaggcctggc

SEQ ID NO: 63385 - DNA, 16 bp, H. sapiens
cacctcccaaagtgct

SEQ ID NO: 63386 - DNA, 16 bp, H. sapiens
cacctcccacactggg

SEQ ID NO: 63387 - DNA, 16 bp, H. sapiens
cacctcccaccaggtt

SEQ ID NO: 63388 - DNA, 16 bp, H. sapiens
cacctcccaccatgcc

SEQ ID NO: 63389 - DNA, 16 bp, H. sapiens
cacctcccaccatgga

SEQ ID NO: 63390 - DNA, 16 bp, H. sapiens
cacctcccaccccagg

SEQ ID NO: 63391 - DNA, 16 bp, H. sapiens
cacctcccagacgggg

SEQ ID NO: 63392 - DNA, 16 bp, H. sapiens
cacctcccagatgggg

SEQ ID NO: 63393 - DNA, 16 bp, H. sapiens
cacctcccagcaggcc

SEQ ID NO: 63394 - DNA, 21 bp, H. sapiens
cacctcccagccacctgcctt

SEQ ID NO: 63395 - DNA, 16 bp, H. sapiens
cacctcccagcccctg

SEQ ID NO: 63396 - DNA, 16 bp, H. sapiens
cacctcccaggttcac

SEQ ID NO: 63397 - DNA, 16 bp, H. sapiens
cacctcccaggttcca

SEQ ID NO: 63398 - DNA, 16 bp, H. sapiens
cacctcccccaggaag

SEQ ID NO: 63399 - DNA, 17 bp, H. sapiens
cacctccccgcaagctg

SEQ ID NO: 63400 - DNA, 16 bp, H. sapiens
cacctccccgggttca

SEQ ID NO: 63401 - DNA, 16 bp, H. sapiens
cacctcccgagttcag

SEQ ID NO: 63402 - DNA, 16 bp, H. sapiens
cacctcccggacgggg

SEQ ID NO: 63403 - DNA, 16 bp, H. sapiens
cacctcccgggttcac

SEQ ID NO: 63404 - DNA, 16 bp, H. sapiens
cacctcccgggttcag

SEQ ID NO: 63405 - DNA, 16 bp, H. sapiens
cacctccctccaggcc

SEQ ID NO: 63406 - DNA, 16 bp, H. sapiens
cacctccctcccttga

SEQ ID NO: 63407 - DNA, 16 bp, H. sapiens
cacctccctcctggac

SEQ ID NO: 63408 - DNA, 16 bp, H. sapiens
cacctccctgctgcag

SEQ ID NO: 63409 - DNA, 16 bp, H. sapiens
cacctccctgggcctc

SEQ ID NO: 63410 - DNA, 16 bp, H. sapiens
cacctcctaacaccat

SEQ ID NO: 63411 - DNA, 16 bp, H. sapiens
cacctcctccaggaag

SEQ ID NO: 63412 - DNA, 16 bp, H. sapiens
cacctcctccatgaag

SEQ ID NO: 63413 - DNA, 16 bp, H. sapiens
cacctcctccctgaag

SEQ ID NO: 63414 - DNA, 16 bp, H. sapiens
cacctcctccgggaag

SEQ ID NO: 63415 - DNA, 16 bp, H. sapiens
cacctcctcggccttg

SEQ ID NO: 63416 - DNA, 16 bp, H. sapiens
cacctcctctgagaag

SEQ ID NO: 63417 - DNA, 16 bp, H. sapiens
cacctcctctgtgcca

SEQ ID NO: 63418 - DNA, 16 bp, H. sapiens
cacctcctgccaggcc

SEQ ID NO: 63419 - DNA, 16 bp, H. sapiens
cacctcctgcccctgc

SEQ ID NO: 63420 - DNA, 16 bp, H. sapiens
cacctcctgctgtggg

SEQ ID NO: 63421 - DNA, 16 bp, H. sapiens
cacctcctgggctcca

SEQ ID NO: 63422 - DNA, 16 bp, H. sapiens
cacctcctgggtcaag

SEQ ID NO: 63423 - DNA, 16 bp, H. sapiens
cacctccttcaggaag

SEQ ID NO: 63424 - DNA, 16 bp, H. sapiens
cacctcgacctcccag

SEQ ID NO: 63425 - DNA, 16 bp, H. sapiens
cacctcgcccagcctc

SEQ ID NO: 63426 - DNA, 16 bp, H. sapiens
cacctcggccacccaa

SEQ ID NO: 63427 - DNA, 16 bp, H. sapiens
cacctcgtgggttcaa

SEQ ID NO: 63428 - DNA, 16 bp, H. sapiens
cacctctagattactt

SEQ ID NO: 63429 - DNA, 16 bp, H. sapiens
cacctctatctccctt

SEQ ID NO: 63430 - DNA, 16 bp, H. sapiens
cacctctcaccaggcc

SEQ ID NO: 63431 - DNA, 16 bp, H. sapiens
cacctctcagagcctc

SEQ ID NO: 63432 - DNA, 16 bp, H. sapiens
cacctctccagcctca

SEQ ID NO: 63433 - DNA, 16 bp, H. sapiens
cacctctctgacctca

SEQ ID NO: 63434 - DNA, 16 bp, H. sapiens
cacctctgccctccag

SEQ ID NO: 63435 - DNA, 16 bp, H. sapiens
cacctctgccctctcc

SEQ ID NO: 63436 - DNA, 16 bp, H. sapiens
cacctctgcctcccaa

SEQ ID NO: 63437 - DNA, 16 bp, H. sapiens
cacctctgcctcccag

SEQ ID NO: 63438 - DNA, 16 bp, H. sapiens
cacctctgccttcctc

SEQ ID NO: 63439 - DNA, 16 bp, H. sapiens
cacctctggaggcagg

SEQ ID NO: 63440 - DNA, 16 bp, H. sapiens
cacctctgggttcaag

SEQ ID NO: 63441 - DNA, 16 bp, H. sapiens
cacctctgtggccacc

SEQ ID NO: 63442 - DNA, 16 bp, H. sapiens
cacctcttcccggccg

SEQ ID NO: 63443 - DNA, 16 bp, H. sapiens
cacctcttgtttcctg

SEQ ID NO: 63444 - DNA, 16 bp, H. sapiens
cacctgaacctgggag

SEQ ID NO: 63445 - DNA, 16 bp, H. sapiens
cacctgaagggaaagg

SEQ ID NO: 63446 - DNA, 18 bp, H. sapiens
cacctgacattcacccca

SEQ ID NO: 63447 - DNA, 16 bp, H. sapiens
cacctgacttcaaact

SEQ ID NO: 63448 - DNA, 16 bp, H. sapiens
cacctgagactgggta

SEQ ID NO: 63449 - DNA, 16 bp, H. sapiens
cacctgagatcagcag

SEQ ID NO: 63450 - DNA, 16 bp, H. sapiens
cacctgagcagctggg

SEQ ID NO: 63451 - DNA, 16 bp, H. sapiens
cacctgagccagcagt

SEQ ID NO: 63452 - DNA, 16 bp, H. sapiens
cacctgagccccagga

SEQ ID NO: 63453 - DNA, 16 bp, H. sapiens
cacctgagcccgagag

SEQ ID NO: 63454 - DNA, 16 bp, H. sapiens
cacctgagcccgggag

SEQ ID NO: 63455 - DNA, 16 bp, H. sapiens
cacctgagcctggaga

SEQ ID NO: 63456 - DNA, 16 bp, H. sapiens
cacctgagctgcaaaa

SEQ ID NO: 63457 - DNA, 16 bp, H. sapiens
cacctgaggctgggag

SEQ ID NO: 63458 - DNA, 16 bp, H. sapiens
cacctgaggtcaagaa

SEQ ID NO: 63459 - DNA, 16 bp, H. sapiens
cacctgaggtcaagga

SEQ ID NO: 63460 - DNA, 16 bp, H. sapiens
cacctgaggtcaagtg

SEQ ID NO: 63461 - DNA, 18 bp, H. sapiens
cacctgaggtcgggaatt

SEQ ID NO: 63462 - DNA, 16 bp, H. sapiens
cacctgaggtcgggat

SEQ ID NO: 63463 - DNA, 16 bp, H. sapiens
cacctgaggtctggaa

SEQ ID NO: 63464 - DNA, 16 bp, H. sapiens
cacctgatggagctga

SEQ ID NO: 63465 - DNA, 16 bp, H. sapiens
cacctgcaaaatgaga

SEQ ID NO: 63466 - DNA, 16 bp, H. sapiens
cacctgcaaaccagga

SEQ ID NO: 63467 - DNA, 16 bp, H. sapiens
cacctgcaatcccagc

SEQ ID NO: 63468 - DNA, 16 bp, H. sapiens
cacctgcacctgcacc

SEQ ID NO: 63469 - DNA, 16 bp, H. sapiens
cacctgcactcccagc

SEQ ID NO: 63470 - DNA, 16 bp, H. sapiens
cacctgcagtaccagc

SEQ ID NO: 63471 - DNA, 16 bp, H. sapiens
cacctgcagtcccacc

SEQ ID NO: 63472 - DNA, 16 bp, H. sapiens
cacctgcagtccctgc

SEQ ID NO: 63473 - DNA, 16 bp, H. sapiens
cacctgcatcagcctc

SEQ ID NO: 63474 - DNA, 16 bp, H. sapiens
cacctgccacagcctc

SEQ ID NO: 63475 - DNA, 16 bp, H. sapiens
cacctgccaccaaacc

SEQ ID NO: 63476 - DNA, 16 bp, H. sapiens
cacctgccaccatgtc

SEQ ID NO: 63477 - DNA, 16 bp, H. sapiens
cacctgccacggcctc

SEQ ID NO: 63478 - DNA, 16 bp, H. sapiens
cacctgccagatgcca

SEQ ID NO: 63479 - DNA, 16 bp, H. sapiens
cacctgccattgccca

SEQ ID NO: 63480 - DNA, 16 bp, H. sapiens
cacctgccccagcctc

SEQ ID NO: 63481 - DNA, 16 bp, H. sapiens
cacctgcctaggtctc

SEQ ID NO: 63482 - DNA, 16 bp, H. sapiens
cacctgcctcaccttc

SEQ ID NO: 63483 - DNA, 16 bp, H. sapiens
cacctgcctcgatctc

SEQ ID NO: 63484 - DNA, 16 bp, H. sapiens
cacctgcctcggcatc

SEQ ID NO: 63485 - DNA, 16 bp, H. sapiens
cacctgcctcgtcctc

SEQ ID NO: 63486 - DNA, 16 bp, H. sapiens
cacctgcctctacctc

SEQ ID NO: 63487 - DNA, 16 bp, H. sapiens
cacctgcctctgtctc

SEQ ID NO: 63488 - DNA, 16 bp, H. sapiens
cacctgcctgcagcca

SEQ ID NO: 63489 - DNA, 16 bp, H. sapiens
cacctgcctgcctgcc

SEQ ID NO: 63490 - DNA, 16 bp, H. sapiens
cacctgcctggcccct

SEQ ID NO: 63491 - DNA, 16 bp, H. sapiens
cacctgcctgggcctc

SEQ ID NO: 63492 - DNA, 16 bp, H. sapiens
cacctgcctgggcctt

SEQ ID NO: 63493 - DNA, 16 bp, H. sapiens
cacctgcctgggcttc

SEQ ID NO: 63494 - DNA, 16 bp, H. sapiens
cacctgctaccacaaa

SEQ ID NO: 63495 - DNA, 16 bp, H. sapiens
cacctgctgctcacct

SEQ ID NO: 63496 - DNA, 16 bp, H. sapiens
cacctgctgtcccagc

SEQ ID NO: 63497 - DNA, 16 bp, H. sapiens
cacctgctgtgcagcc

SEQ ID NO: 63498 - DNA, 16 bp, H. sapiens
cacctgcttgggaggc

SEQ ID NO: 63499 - DNA, 16 bp, H. sapiens
cacctgctttgacctc

SEQ ID NO: 63500 - DNA, 16 bp, H. sapiens
cacctgctttgtgcca

SEQ ID NO: 63501 - DNA, 16 bp, H. sapiens
cacctgcttttttctg

SEQ ID NO: 63502 - DNA, 27 bp, H. sapiens
cacctggaaaatcgggtcactcccacc

SEQ ID NO: 63503 - DNA, 16 bp, H. sapiens
cacctggaagctgcca

SEQ ID NO: 63504 - DNA, 16 bp, H. sapiens
cacctggaaggccagg

SEQ ID NO: 63505 - DNA, 16 bp, H. sapiens
cacctggaattgtaat

SEQ ID NO: 63506 - DNA, 16 bp, H. sapiens
cacctggacctgccaa

SEQ ID NO: 63507 - DNA, 16 bp, H. sapiens
cacctggagcccccag

SEQ ID NO: 63508 - DNA, 16 bp, H. sapiens
cacctggagctggggg

SEQ ID NO: 63509 - DNA, 16 bp, H. sapiens
cacctggaggaagggg

SEQ ID NO: 63510 - DNA, 19 bp, H. sapiens
cacctggaggactgtgggt

SEQ ID NO: 63511 - DNA, 16 bp, H. sapiens
cacctggagtcaggag

SEQ ID NO: 63512 - DNA, 16 bp, H. sapiens
cacctggataatccag

SEQ ID NO: 63513 - DNA, 16 bp, H. sapiens
cacctggatgatccag

SEQ ID NO: 63514 - DNA, 16 bp, H. sapiens
cacctggatttttttt

SEQ ID NO: 63515 - DNA, 16 bp, H. sapiens
cacctggccaaaaaat

SEQ ID NO: 63516 - DNA, 16 bp, H. sapiens
cacctggccaagattt

SEQ ID NO: 63517 - DNA, 16 bp, H. sapiens
cacctggccactgctg

SEQ ID NO: 63518 - DNA, 16 bp, H. sapiens
cacctggccaggcaca

SEQ ID NO: 63519 - DNA, 16 bp, H. sapiens
cacctggccctgccct

SEQ ID NO: 63520 - DNA, 16 bp, H. sapiens
cacctggcctttttct

SEQ ID NO: 63521 - DNA, 16 bp, H. sapiens
cacctggccttttttt

SEQ ID NO: 63522 - DNA, 16 bp, H. sapiens
cacctggctaatatat

SEQ ID NO: 63523 - DNA, 16 bp, H. sapiens
cacctggctagtttct

SEQ ID NO: 63524 - DNA, 16 bp, H. sapiens
cacctggctgggaggg

SEQ ID NO: 63525 - DNA, 16 bp, H. sapiens
cacctgggaggcggag

SEQ ID NO: 63526 - DNA, 16 bp, H. sapiens
cacctgggagggtggg

SEQ ID NO: 63527 - DNA, 17 bp, H. sapiens
cacctgggccagcagct

SEQ ID NO: 63528 - DNA, 16 bp, H. sapiens
cacctgggctcaagtg

SEQ ID NO: 63529 - DNA, 16 bp, H. sapiens
cacctggggcacatgt

SEQ ID NO: 63530 - DNA, 16 bp, H. sapiens
cacctggggccaggag

SEQ ID NO: 63531 - DNA, 16 bp, H. sapiens
cacctgggggaaggag

SEQ ID NO: 63532 - DNA, 16 bp, H. sapiens
cacctgggtagctggg

SEQ ID NO: 63533 - DNA, 16 bp, H. sapiens
cacctgggtgcaggtg

SEQ ID NO: 63534 - DNA, 16 bp, H. sapiens
cacctgggttcaagtg

SEQ ID NO: 63535 - DNA, 16 bp, H. sapiens
cacctggtccagctgc

SEQ ID NO: 63536 - DNA, 16 bp, H. sapiens
cacctggtctttccct

SEQ ID NO: 63537 - DNA, 16 bp, H. sapiens
cacctgtaaaatgagg

SEQ ID NO: 63538 - DNA, 16 bp, H. sapiens
cacctgtaaaatggga

SEQ ID NO: 63539 - DNA, 16 bp, H. sapiens
cacctgtaaacccagc

SEQ ID NO: 63540 - DNA, 16 bp, H. sapiens
cacctgtaataccagc

SEQ ID NO: 63541 - DNA, 16 bp, H. sapiens
cacctgtaatcccatc

SEQ ID NO: 63542 - DNA, 16 bp, H. sapiens
cacctgtagtccgagc

SEQ ID NO: 63543 - DNA, 16 bp, H. sapiens
cacctgtcagaatggc

SEQ ID NO: 63544 - DNA, 16 bp, H. sapiens
cacctgtcccagctac

SEQ ID NO: 63545 - DNA, 16 bp, H. sapiens
cacctgtctcagcccc

SEQ ID NO: 63546 - DNA, 16 bp, H. sapiens
cacctgtctcagtctc

SEQ ID NO: 63547 - DNA, 16 bp, H. sapiens
cacctgtcttggcctc

SEQ ID NO: 63548 - DNA, 16 bp, H. sapiens
cacctgtgaagccatc

SEQ ID NO: 63549 - DNA, 16 bp, H. sapiens
cacctgtgatcccagg

SEQ ID NO: 63550 - DNA, 16 bp, H. sapiens
cacctgtgcctctgct

SEQ ID NO: 63551 - DNA, 16 bp, H. sapiens
cacctgtggagtctgc

SEQ ID NO: 63552 - DNA, 16 bp, H. sapiens
cacctgtggtcccagg

SEQ ID NO: 63553 - DNA, 16 bp, H. sapiens
cacctgtggtcctggc

SEQ ID NO: 63554 - DNA, 16 bp, H. sapiens
cacctgttagaatggc

SEQ ID NO: 63555 - DNA, 16 bp, H. sapiens
cacctgttatcccagt

SEQ ID NO: 63556 - DNA, 16 bp, H. sapiens
cacctgttatgtgcca

SEQ ID NO: 63557 - DNA, 16 bp, H. sapiens
cacctgttgtcccagc

SEQ ID NO: 63558 - DNA, 16 bp, H. sapiens
cacctgtttccccaca

SEQ ID NO: 63559 - DNA, 16 bp, H. sapiens
cacctgtttgccattt

SEQ ID NO: 63560 - DNA, 16 bp, H. sapiens
caccttaaatatttat

SEQ ID NO: 63561 - DNA, 16 bp, H. sapiens
caccttaaccaagtga

SEQ ID NO: 63562 - DNA, 16 bp, H. sapiens
caccttagcctcttga

SEQ ID NO: 63563 - DNA, 16 bp, H. sapiens
caccttatacaaaaat

SEQ ID NO: 63564 - DNA, 16 bp, H. sapiens
caccttataccaaaat

SEQ ID NO: 63565 - DNA, 16 bp, H. sapiens
caccttatacgaaaat

SEQ ID NO: 63566 - DNA, 16 bp, H. sapiens
caccttatgcaaaaat

SEQ ID NO: 63567 - DNA, 16 bp, H. sapiens
caccttcacagcaaca

SEQ ID NO: 63568 - DNA, 16 bp, H. sapiens
caccttcaccatcacc

SEQ ID NO: 63569 - DNA, 16 bp, H. sapiens
caccttcatccatgtc

SEQ ID NO: 63570 - DNA, 16 bp, H. sapiens
caccttcctcacaggg

SEQ ID NO: 63571 - DNA, 16 bp, H. sapiens
caccttcctcagcctc

SEQ ID NO: 63572 - DNA, 16 bp, H. sapiens
caccttccttacacct

SEQ ID NO: 63573 - DNA, 16 bp, H. sapiens
caccttctaataccat

SEQ ID NO: 63574 - DNA, 16 bp, H. sapiens
caccttctaccatgag

SEQ ID NO: 63575 - DNA, 16 bp, H. sapiens
caccttctcagagagg

SEQ ID NO: 63576 - DNA, 16 bp, H. sapiens
caccttctcagtgagg

SEQ ID NO: 63577 - DNA, 16 bp, H. sapiens
caccttctccaggaag

SEQ ID NO: 63578 - DNA, 16 bp, H. sapiens
caccttctgaagccta

SEQ ID NO: 63579 - DNA, 16 bp, H. sapiens
caccttctgggttcag

SEQ ID NO: 63580 - DNA, 16 bp, H. sapiens
caccttctgtgttcaa

SEQ ID NO: 63581 - DNA, 16 bp, H. sapiens
caccttcttgctatgt

SEQ ID NO: 63582 - DNA, 16 bp, H. sapiens
caccttcttgctgtgt

SEQ ID NO: 63583 - DNA, 16 bp, H. sapiens
caccttgactttagcc

SEQ ID NO: 63584 - DNA, 16 bp, H. sapiens
caccttgatctttgac

SEQ ID NO: 63585 - DNA, 16 bp, H. sapiens
caccttgattttggcc

SEQ ID NO: 63586 - DNA, 16 bp, H. sapiens
caccttgcccagccaa

SEQ ID NO: 63587 - DNA, 16 bp, H. sapiens
caccttgcccagcctg

SEQ ID NO: 63588 - DNA, 16 bp, H. sapiens
caccttgcctggccac

SEQ ID NO: 63589 - DNA, 16 bp, H. sapiens
caccttgcctggcccc

SEQ ID NO: 63590 - DNA, 16 bp, H. sapiens
caccttgcctggctga

SEQ ID NO: 63591 - DNA, 16 bp, H. sapiens
caccttgctttttttc

SEQ ID NO: 63592 - DNA, 16 bp, H. sapiens
caccttggccaggctg

SEQ ID NO: 63593 - DNA, 16 bp, H. sapiens
caccttggcctgttgc

SEQ ID NO: 63594 - DNA, 16 bp, H. sapiens
caccttggccttcaaa

SEQ ID NO: 63595 - DNA, 16 bp, H. sapiens
caccttgggaggccaa

SEQ ID NO: 63596 - DNA, 16 bp, H. sapiens
caccttgggcacatgt

SEQ ID NO: 63597 - DNA, 16 bp, H. sapiens
caccttgtgaaaaagg

SEQ ID NO: 63598 - DNA, 16 bp, H. sapiens
caccttgtgatcatgt

SEQ ID NO: 63599 - DNA, 16 bp, H. sapiens
cacctttgctgtattc

SEQ ID NO: 63600 - DNA, 16 bp, H. sapiens
cacctttgtcagaaat

SEQ ID NO: 63601 - DNA, 16 bp, H. sapiens
caccttttcacatacc

SEQ ID NO: 63602 - DNA, 16 bp, H. sapiens
cacctttttaagagta

SEQ ID NO: 63603 - DNA, 17 bp, H. sapiens
cacgaagtccttgccca

SEQ ID NO: 63604 - DNA, 16 bp, H. sapiens
cacgacgcccagctaa

SEQ ID NO: 63605 - DNA, 17 bp, H. sapiens
cacgacgcccggctaat

SEQ ID NO: 63606 - DNA, 17 bp, H. sapiens
cacgacttttggggaga

SEQ ID NO: 63607 - DNA, 16 bp, H. sapiens
cacgaggacagcacca

SEQ ID NO: 63608 - DNA, 16 bp, H. sapiens
cacgaggtcaggcgat

SEQ ID NO: 63609 - DNA, 16 bp, H. sapiens
cacgaggtcaggtgtt

SEQ ID NO: 63610 - DNA, 16 bp, H. sapiens
cacgaggtccagagat

SEQ ID NO: 63611 - DNA, 16 bp, H. sapiens
cacgatcccagctcac

SEQ ID NO: 63612 - DNA, 16 bp, H. sapiens
cacgatctcgactcac

SEQ ID NO: 63613 - DNA, 16 bp, H. sapiens
cacgatgtcaggagtt

SEQ ID NO: 63614 - DNA, 16 bp, H. sapiens
cacgcacacacacaag

SEQ ID NO: 63615 - DNA, 16 bp, H. sapiens
cacgcacacacacgca

SEQ ID NO: 63616 - DNA, 16 bp, H. sapiens
cacgcacacacatgca

SEQ ID NO: 63617 - DNA, 16 bp, H. sapiens
cacgcacacatacaca

SEQ ID NO: 63618 - DNA, 16 bp, H. sapiens
cacgcaccagggcctg

SEQ ID NO: 63619 - DNA, 16 bp, H. sapiens
cacgcacgcatgcaca

SEQ ID NO: 63620 - DNA, 16 bp, H. sapiens
cacgcactcacacaca

SEQ ID NO: 63621 - DNA, 16 bp, H. sapiens
cacgcaggctagagtg

SEQ ID NO: 63622 - DNA, 16 bp, H. sapiens
cacgcatacacacatg

SEQ ID NO: 63623 - DNA, 16 bp, H. sapiens
cacgcatgcacacacg

SEQ ID NO: 63624 - DNA, 16 bp, H. sapiens
cacgccactccactcc

SEQ ID NO: 63625 - DNA, 16 bp, H. sapiens
cacgccagcctggatg

SEQ ID NO: 63626 - DNA, 16 bp, H. sapiens
cacgccagctaatttt

SEQ ID NO: 63627 - DNA, 16 bp, H. sapiens
cacgccattgcactca

SEQ ID NO: 63628 - DNA, 16 bp, H. sapiens
cacgcccagccaacaa

SEQ ID NO: 63629 - DNA, 16 bp, H. sapiens
cacgcccagccctgtt

SEQ ID NO: 63630 - DNA, 17 bp, H. sapiens
cacgcccggctaatttg

SEQ ID NO: 63631 - DNA, 17 bp, H. sapiens
cacgcccggctcatttt

SEQ ID NO: 63632 - DNA, 16 bp, H. sapiens
cacgcctggccaagtt

SEQ ID NO: 63633 - DNA, 16 bp, H. sapiens
cacgcctggcccagct

SEQ ID NO: 63634 - DNA, 16 bp, H. sapiens
cacgcctgtagtccag

SEQ ID NO: 63635 - DNA, 16 bp, H. sapiens
cacgcctgtagtccca

SEQ ID NO: 63636 - DNA, 16 bp, H. sapiens
cacgcgccaccatgcc

SEQ ID NO: 63637 - DNA, 16 bp, H. sapiens
cacgcgcgtgcacaca

SEQ ID NO: 63638 - DNA, 16 bp, H. sapiens
cacgcgtgcacacaca

SEQ ID NO: 63639 - DNA, 16 bp, H. sapiens
cacgctgctatgaaga

SEQ ID NO: 63640 - DNA, 16 bp, H. sapiens
cacgctggagtgcagc

SEQ ID NO: 63641 - DNA, 16 bp, H. sapiens
cacgctggatgcttcc

SEQ ID NO: 63642 - DNA, 16 bp, H. sapiens
cacgcttgtagtccca

SEQ ID NO: 63643 - DNA, 26 bp, H. sapiens
cacggaatactatgcagccataaaaa

SEQ ID NO: 63644 - DNA, 16 bp, H. sapiens
cacggcacacatttac

SEQ ID NO: 63645 - DNA, 16 bp, H. sapiens
cacggcgcccagcctt

SEQ ID NO: 63646 - DNA, 16 bp, H. sapiens
cacggcgcccggccct

SEQ ID NO: 63647 - DNA, 16 bp, H. sapiens
cacggcggcctcccgg

SEQ ID NO: 63648 - DNA, 16 bp, H. sapiens
cacgggctggtgttga

SEQ ID NO: 63649 - DNA, 16 bp, H. sapiens
cacggtctctgctcac

SEQ ID NO: 63650 - DNA, 16 bp, H. sapiens
cacggtgcccagccaa

SEQ ID NO: 63651 - DNA, 16 bp, H. sapiens
cacggtgcccagcctc

SEQ ID NO: 63652 - DNA, 16 bp, H. sapiens
cacggtgctcacgcct

SEQ ID NO: 63653 - DNA, 16 bp, H. sapiens
cacggtggtgcacgcc

SEQ ID NO: 63654 - DNA, 16 bp, H. sapiens
cacgtgagcccaggaa

SEQ ID NO: 63655 - DNA, 16 bp, H. sapiens
cacgtgcaggtttgtt

SEQ ID NO: 63656 - DNA, 16 bp, H. sapiens
cacgtgcagtggctca

SEQ ID NO: 63657 - DNA, 16 bp, H. sapiens
cacgtgcatacctatg

SEQ ID NO: 63658 - DNA, 16 bp, H. sapiens
cacgtgccaccatacc

SEQ ID NO: 63659 - DNA, 16 bp, H. sapiens
cacgtgccccagcagc

SEQ ID NO: 63660 - DNA, 16 bp, H. sapiens
cacgtggctagtggct

SEQ ID NO: 63661 - DNA, 16 bp, H. sapiens
cacgtggctggagagg

SEQ ID NO: 63662 - DNA, 16 bp, H. sapiens
cacgtgggccaggctg

SEQ ID NO: 63663 - DNA, 16 bp, H. sapiens
cacgtgtgcacacaca

SEQ ID NO: 63664 - DNA, 16 bp, H. sapiens
cacgtgtgtgtatgtg

SEQ ID NO: 63665 - DNA, 16 bp, H. sapiens
cacgttgggaggcaga

SEQ ID NO: 63666 - DNA, 16 bp, H. sapiens
cacgttgggaggccaa

SEQ ID NO: 63667 - DNA, 16 bp, H. sapiens
cacgtttacttatgta

SEQ ID NO: 63668 - DNA, 16 bp, H. sapiens
cactaaaaatacagaa

SEQ ID NO: 63669 - DNA, 16 bp, H. sapiens
cactaaaagaaaacat

SEQ ID NO: 63670 - DNA, 16 bp, H. sapiens
cactaaaattttattt

SEQ ID NO: 63671 - DNA, 16 bp, H. sapiens
cactaaatatggaaag

SEQ ID NO: 63672 - DNA, 16 bp, H. sapiens
cactaaatatgggaag

SEQ ID NO: 63673 - DNA, 16 bp, H. sapiens
cactaacatgagaaca

SEQ ID NO: 63674 - DNA, 16 bp, H. sapiens
cactaagcatgtggga

SEQ ID NO: 63675 - DNA, 16 bp, H. sapiens
cactaagtgaaaaaag

SEQ ID NO: 63676 - DNA, 16 bp, H. sapiens
cactaatcctgttcat

SEQ ID NO: 63677 - DNA, 16 bp, H. sapiens
cactaatctactttct

SEQ ID NO: 63678 - DNA, 16 bp, H. sapiens
cactaatgatcagaga

SEQ ID NO: 63679 - DNA, 17 bp, H. sapiens
cactaatttttgtattt

SEQ ID NO: 63680 - DNA, 16 bp, H. sapiens
cactacaaagaaatga

SEQ ID NO: 63681 - DNA, 16 bp, H. sapiens
cactacaacaaaactt

SEQ ID NO: 63682 - DNA, 16 bp, H. sapiens
cactacacatggaaag

SEQ ID NO: 63683 - DNA, 16 bp, H. sapiens
cactacaccacaccta

SEQ ID NO: 63684 - DNA, 16 bp, H. sapiens
cactacacccagctaa

SEQ ID NO: 63685 - DNA, 17 bp, H. sapiens
cactacacccggctaat

SEQ ID NO: 63686 - DNA, 16 bp, H. sapiens
cactacactccagcca

SEQ ID NO: 63687 - DNA, 16 bp, H. sapiens
cactacactccagcct

SEQ ID NO: 63688 - DNA, 16 bp, H. sapiens
cactaccacaccaggc

SEQ ID NO: 63689 - DNA, 16 bp, H. sapiens
cactaccaccaacagt

SEQ ID NO: 63690 - DNA, 16 bp, H. sapiens
cactaccaggcctgcc

SEQ ID NO: 63691 - DNA, 16 bp, H. sapiens
cactaccaggcctggc

SEQ ID NO: 63692 - DNA, 16 bp, H. sapiens
cactaccatgaaaaca

SEQ ID NO: 63693 - DNA, 16 bp, H. sapiens
cactacctgatttcaa

SEQ ID NO: 63694 - DNA, 17 bp, H. sapiens
cactacgcctggctaat

SEQ ID NO: 63695 - DNA, 16 bp, H. sapiens
cactactcaaagcaat

SEQ ID NO: 63696 - DNA, 16 bp, H. sapiens
cactactcacaatagc

SEQ ID NO: 63697 - DNA, 17 bp, H. sapiens
cactactctcttcaaag

SEQ ID NO: 63698 - DNA, 16 bp, H. sapiens
cactactctcttcaga

SEQ ID NO: 63699 - DNA, 16 bp, H. sapiens
cactactggatatcta

SEQ ID NO: 63700 - DNA, 16 bp, H. sapiens
cactactggatattta

SEQ ID NO: 63701 - DNA, 16 bp, H. sapiens
cactactgggcatata

SEQ ID NO: 63702 - DNA, 16 bp, H. sapiens
cactactgtagacttt

SEQ ID NO: 63703 - DNA, 16 bp, H. sapiens
cactagctgtgtgacc

SEQ ID NO: 63704 - DNA, 16 bp, H. sapiens
cactaggtatatctcc

SEQ ID NO: 63705 - DNA, 16 bp, H. sapiens
cactatagttttgcct

SEQ ID NO: 63706 - DNA, 16 bp, H. sapiens
cactatatatatatat

SEQ ID NO: 63707 - DNA, 20 bp, H. sapiens
cactatgagataccatctca

SEQ ID NO: 63708 - DNA, 16 bp, H. sapiens
cactatgagcattttg

SEQ ID NO: 63709 - DNA, 16 bp, H. sapiens
cactatgcaatctatg

SEQ ID NO: 63710 - DNA, 16 bp, H. sapiens
cactatgcctggctaa

SEQ ID NO: 63711 - DNA, 16 bp, H. sapiens
cactatggagaacagt

SEQ ID NO: 63712 - DNA, 16 bp, H. sapiens
cactatgggaggccaa

SEQ ID NO: 63713 - DNA, 16 bp, H. sapiens
cactatgggaggccga

SEQ ID NO: 63714 - DNA, 16 bp, H. sapiens
cactatgggaggctga

SEQ ID NO: 63715 - DNA, 16 bp, H. sapiens
cactatgttggccatg

SEQ ID NO: 63716 - DNA, 16 bp, H. sapiens
cactattaatattttg

SEQ ID NO: 63717 - DNA, 16 bp, H. sapiens
cactattgacattttg

SEQ ID NO: 63718 - DNA, 16 bp, H. sapiens
cactatttgtctttct

SEQ ID NO: 63719 - DNA, 16 bp, H. sapiens
cactcaaaaaatgaaa

SEQ ID NO: 63720 - DNA, 16 bp, H. sapiens
cactcaacaccagccc

SEQ ID NO: 63721 - DNA, 16 bp, H. sapiens
cactcaacactagcct

SEQ ID NO: 63722 - DNA, 16 bp, H. sapiens
cactcaactcacagag

SEQ ID NO: 63723 - DNA, 16 bp, H. sapiens
cactcaagaaacattt

SEQ ID NO: 63724 - DNA, 16 bp, H. sapiens
cactcaataaatgctg

SEQ ID NO: 63725 - DNA, 16 bp, H. sapiens
cactcaatgccagcct

SEQ ID NO: 63726 - DNA, 16 bp, H. sapiens
cactcacaacttcccc

SEQ ID NO: 63727 - DNA, 16 bp, H. sapiens
cactcacagctaattt

SEQ ID NO: 63728 - DNA, 16 bp, H. sapiens
cactcacatgcacaca

SEQ ID NO: 63729 - DNA, 16 bp, H. sapiens
cactcacatgtggaat

SEQ ID NO: 63730 - DNA, 16 bp, H. sapiens
cactcaccaaggctga

SEQ ID NO: 63731 - DNA, 16 bp, H. sapiens
cactcaccacttccct

SEQ ID NO: 63732 - DNA, 16 bp, H. sapiens
cactcaccccagcctc

SEQ ID NO: 63733 - DNA, 16 bp, H. sapiens
cactcactcatccatt

SEQ ID NO: 63734 - DNA, 16 bp, H. sapiens
cactcactctgctcca

SEQ ID NO: 63735 - DNA, 16 bp, H. sapiens
cactcactgcagtctc

SEQ ID NO: 63736 - DNA, 16 bp, H. sapiens
cactcactgcatcctg

SEQ ID NO: 63737 - DNA, 16 bp, H. sapiens
cactcactgtgaaggt

SEQ ID NO: 63738 - DNA, 16 bp, H. sapiens
cactcagaacagtgcc

SEQ ID NO: 63739 - DNA, 18 bp, H. sapiens
cactcagaacccagcagt

SEQ ID NO: 63740 - DNA, 16 bp, H. sapiens
cactcagaccacagtg

SEQ ID NO: 63741 - DNA, 16 bp, H. sapiens
cactcagagcagccgg

SEQ ID NO: 63742 - DNA, 16 bp, H. sapiens
cactcagatggagtgg

SEQ ID NO: 63743 - DNA, 16 bp, H. sapiens
cactcagcagccagag

SEQ ID NO: 63744 - DNA, 16 bp, H. sapiens
cactcagcaggctgag

SEQ ID NO: 63745 - DNA, 16 bp, H. sapiens
cactcagccaattttt

SEQ ID NO: 63746 - DNA, 17 bp, H. sapiens
cactcagctaattttta

SEQ ID NO: 63747 - DNA, 16 bp, H. sapiens
cactcagcttcttttc

SEQ ID NO: 63748 - DNA, 16 bp, H. sapiens
cactcaggctgggagc

SEQ ID NO: 63749 - DNA, 17 bp, H. sapiens
cactcagtattaaccat

SEQ ID NO: 63750 - DNA, 16 bp, H. sapiens
cactcagtttgtggta

SEQ ID NO: 63751 - DNA, 16 bp, H. sapiens
cactcatctactttct

SEQ ID NO: 63752 - DNA, 16 bp, H. sapiens
cactcatctcctgctg

SEQ ID NO: 63753 - DNA, 16 bp, H. sapiens
cactcatgcctgtaat

SEQ ID NO: 63754 - DNA, 16 bp, H. sapiens
cactcatgtggttgtt

SEQ ID NO: 63755 - DNA, 16 bp, H. sapiens
cactcattcattcatt

SEQ ID NO: 63756 - DNA, 16 bp, H. sapiens
cactccaaccttcagc

SEQ ID NO: 63757 - DNA, 16 bp, H. sapiens
cactccaccagcctgg

SEQ ID NO: 63758 - DNA, 16 bp, H. sapiens
cactccactccaacct

SEQ ID NO: 63759 - DNA, 16 bp, H. sapiens
cactccactccaggct

SEQ ID NO: 63760 - DNA, 16 bp, H. sapiens
cactccagcatggggg

SEQ ID NO: 63761 - DNA, 16 bp, H. sapiens
cactccagccagggga

SEQ ID NO: 63762 - DNA, 16 bp, H. sapiens
cactccagcccgggcg

SEQ ID NO: 63763 - DNA, 16 bp, H. sapiens
cactccagccctgggc

SEQ ID NO: 63764 - DNA, 16 bp, H. sapiens
cactccagcctcagag

SEQ ID NO: 63765 - DNA, 16 bp, H. sapiens
cactccagcctcagcg

SEQ ID NO: 63766 - DNA, 16 bp, H. sapiens
cactccagcctccatc

SEQ ID NO: 63767 - DNA, 16 bp, H. sapiens
cactccagcctctgct

SEQ ID NO: 63768 - DNA, 16 bp, H. sapiens
cactccagcctgcagc

SEQ ID NO: 63769 - DNA, 16 bp, H. sapiens
cactccagcctgctga

SEQ ID NO: 63770 - DNA, 16 bp, H. sapiens
cactccagcctggcag

SEQ ID NO: 63771 - DNA, 16 bp, H. sapiens
cactccagcctggctg

SEQ ID NO: 63772 - DNA, 16 bp, H. sapiens
cactccagcctgtgag

SEQ ID NO: 63773 - DNA, 16 bp, H. sapiens
cactccagccttcagc

SEQ ID NO: 63774 - DNA, 16 bp, H. sapiens
cactccagcgtgggca

SEQ ID NO: 63775 - DNA, 16 bp, H. sapiens
cactccagtccactcc

SEQ ID NO: 63776 - DNA, 16 bp, H. sapiens
cactccagtcttggtg

SEQ ID NO: 63777 - DNA, 16 bp, H. sapiens
cactccagttcctggc

SEQ ID NO: 63778 - DNA, 16 bp, H. sapiens
cactccatcctgctgc

SEQ ID NO: 63779 - DNA, 16 bp, H. sapiens
cactccatctcagaaa

SEQ ID NO: 63780 - DNA, 16 bp, H. sapiens
cactcccaccaatggt

SEQ ID NO: 63781 - DNA, 16 bp, H. sapiens
cactcccaccagcagc

SEQ ID NO: 63782 - DNA, 16 bp, H. sapiens
cactcccaccagcgcc

SEQ ID NO: 63783 - DNA, 16 bp, H. sapiens
cactcccacctgggcg

SEQ ID NO: 63784 - DNA, 16 bp, H. sapiens
cactcccagagcagcc

SEQ ID NO: 63785 - DNA, 16 bp, H. sapiens
cactcccatctctgcc

SEQ ID NO: 63786 - DNA, 16 bp, H. sapiens
cactccccagcaaatg

SEQ ID NO: 63787 - DNA, 16 bp, H. sapiens
cactccctacagggca

SEQ ID NO: 63788 - DNA, 16 bp, H. sapiens
cactccctcactgggt

SEQ ID NO: 63789 - DNA, 16 bp, H. sapiens
cactcctcaaggaaat

SEQ ID NO: 63790 - DNA, 16 bp, H. sapiens
cactcctcagcccttg

SEQ ID NO: 63791 - DNA, 18 bp, H. sapiens
cactcctcagcccttggg

SEQ ID NO: 63792 - DNA, 16 bp, H. sapiens
cactcctcagcctccc

SEQ ID NO: 63793 - DNA, 16 bp, H. sapiens
cactcctccagcctgg

SEQ ID NO: 63794 - DNA, 16 bp, H. sapiens
cactcctgagcaaatg

SEQ ID NO: 63795 - DNA, 16 bp, H. sapiens
cactcctgagcccagc

SEQ ID NO: 63796 - DNA, 16 bp, H. sapiens
cactcctgcctccctc

SEQ ID NO: 63797 - DNA, 16 bp, H. sapiens
cactcctgcctggaca

SEQ ID NO: 63798 - DNA, 16 bp, H. sapiens
cactcctgcctgggag

SEQ ID NO: 63799 - DNA, 16 bp, H. sapiens
cactcctgggcattta

SEQ ID NO: 63800 - DNA, 16 bp, H. sapiens
cactcctgggctcaag

SEQ ID NO: 63801 - DNA, 19 bp, H. sapiens
cactcctgggctcaagtga

SEQ ID NO: 63802 - DNA, 16 bp, H. sapiens
cactcctgtaatccca

SEQ ID NO: 63803 - DNA, 16 bp, H. sapiens
cactcctgtaattcca

SEQ ID NO: 63804 - DNA, 16 bp, H. sapiens
cactcctgtcatccca

SEQ ID NO: 63805 - DNA, 16 bp, H. sapiens
cactcctgtggccacc

SEQ ID NO: 63806 - DNA, 16 bp, H. sapiens
cactcctgtggcccca

SEQ ID NO: 63807 - DNA, 16 bp, H. sapiens
cactccttggcctccc

SEQ ID NO: 63808 - DNA, 16 bp, H. sapiens
cactcgcctcagcctc

SEQ ID NO: 63809 - DNA, 17 bp, H. sapiens
cactcggagcggccagc

SEQ ID NO: 63810 - DNA, 16 bp, H. sapiens
cactctaatggtagtt

SEQ ID NO: 63811 - DNA, 16 bp, H. sapiens
cactctatgatgttca

SEQ ID NO: 63812 - DNA, 16 bp, H. sapiens
cactctattgtgctat

SEQ ID NO: 63813 - DNA, 16 bp, H. sapiens
cactctcaccattcct

SEQ ID NO: 63814 - DNA, 16 bp, H. sapiens
cactctcagcattgga

SEQ ID NO: 63815 - DNA, 16 bp, H. sapiens
cactctcagctcactg

SEQ ID NO: 63816 - DNA, 16 bp, H. sapiens
cactctcctgacctca

SEQ ID NO: 63817 - DNA, 21 bp, H. sapiens
cactctctaattggatgtcct

SEQ ID NO: 63818 - DNA, 16 bp, H. sapiens
cactctctcctggcct

SEQ ID NO: 63819 - DNA, 16 bp, H. sapiens
cactctctctgtctct

SEQ ID NO: 63820 - DNA, 16 bp, H. sapiens
cactctctctttcctg

SEQ ID NO: 63821 - DNA, 16 bp, H. sapiens
cactctcttctgtctt

SEQ ID NO: 63822 - DNA, 16 bp, H. sapiens
cactctgagcagatct

SEQ ID NO: 63823 - DNA, 16 bp, H. sapiens
cactctgcagcccagg

SEQ ID NO: 63824 - DNA, 16 bp, H. sapiens
cactctgctaggtgct

SEQ ID NO: 63825 - DNA, 16 bp, H. sapiens
cactctgctccagcca

SEQ ID NO: 63826 - DNA, 16 bp, H. sapiens
cactctgcttcccttt

SEQ ID NO: 63827 - DNA, 16 bp, H. sapiens
cactctgcttcctctg

SEQ ID NO: 63828 - DNA, 16 bp, H. sapiens
cactctggaaaacaat

SEQ ID NO: 63829 - DNA, 16 bp, H. sapiens
cactctggcctggatg

SEQ ID NO: 63830 - DNA, 16 bp, H. sapiens
cactctggcgcccagg

SEQ ID NO: 63831 - DNA, 16 bp, H. sapiens
cactctggctgcgctt

SEQ ID NO: 63832 - DNA, 16 bp, H. sapiens
cactctggctgctggg

SEQ ID NO: 63833 - DNA, 16 bp, H. sapiens
cactctgtatctagct

SEQ ID NO: 63834 - DNA, 16 bp, H. sapiens
cactctgtatctagtt

SEQ ID NO: 63835 - DNA, 16 bp, H. sapiens
cactctgtatctggct

SEQ ID NO: 63836 - DNA, 16 bp, H. sapiens
cactctgtcaccagac

SEQ ID NO: 63837 - DNA, 16 bp, H. sapiens
cactctgtcaccagga

SEQ ID NO: 63838 - DNA, 16 bp, H. sapiens
cactctgtcacccaag

SEQ ID NO: 63839 - DNA, 16 bp, H. sapiens
cactctgtcacccaca

SEQ ID NO: 63840 - DNA, 16 bp, H. sapiens
cactctgtcaccgggc

SEQ ID NO: 63841 - DNA, 16 bp, H. sapiens
cactctgtcccaggct

SEQ ID NO: 63842 - DNA, 16 bp, H. sapiens
cactctgtctcccagt

SEQ ID NO: 63843 - DNA, 16 bp, H. sapiens
cactctgtcttaaaaa

SEQ ID NO: 63844 - DNA, 16 bp, H. sapiens
cactcttatgtttatt

SEQ ID NO: 63845 - DNA, 16 bp, H. sapiens
cactcttctggtctgt

SEQ ID NO: 63846 - DNA, 16 bp, H. sapiens
cactcttgtcgcccaa

SEQ ID NO: 63847 - DNA, 16 bp, H. sapiens
cactctttctctcctg

SEQ ID NO: 63848 - DNA, 16 bp, H. sapiens
cactgaaaacccaaaa

SEQ ID NO: 63849 - DNA, 16 bp, H. sapiens
cactgaaaagcaaaag

SEQ ID NO: 63850 - DNA, 16 bp, H. sapiens
cactgaaaatacaaaa

SEQ ID NO: 63851 - DNA, 16 bp, H. sapiens
cactgaaaatataaaa

SEQ ID NO: 63852 - DNA, 16 bp, H. sapiens
cactgaaagaagcact

SEQ ID NO: 63853 - DNA, 16 bp, H. sapiens
cactgaaagtaatggc

SEQ ID NO: 63854 - DNA, 16 bp, H. sapiens
cactgaaataatttta

SEQ ID NO: 63855 - DNA, 16 bp, H. sapiens
cactgaacaaatattt

SEQ ID NO: 63856 - DNA, 16 bp, H. sapiens
cactgaactaaaatga

SEQ ID NO: 63857 - DNA, 16 bp, H. sapiens
cactgaactccagcct

SEQ ID NO: 63858 - DNA, 16 bp, H. sapiens
cactgaagtacacaga

SEQ ID NO: 63859 - DNA, 16 bp, H. sapiens
cactgaagtcttgaac

SEQ ID NO: 63860 - DNA, 16 bp, H. sapiens
cactgaatatggaaag

SEQ ID NO: 63861 - DNA, 16 bp, H. sapiens
cactgaatgaatgaat

SEQ ID NO: 63862 - DNA, 16 bp, H. sapiens
cactgaatgggcaaaa

SEQ ID NO: 63863 - DNA, 16 bp, H. sapiens
cactgaatttttcttt

SEQ ID NO: 63864 - DNA, 16 bp, H. sapiens
cactgacaacaccaaa

SEQ ID NO: 63865 - DNA, 16 bp, H. sapiens
cactgacaacatcaaa

SEQ ID NO: 63866 - DNA, 16 bp, H. sapiens
cactgacagcttgaac

SEQ ID NO: 63867 - DNA, 16 bp, H. sapiens
cactgaccacacagaa

SEQ ID NO: 63868 - DNA, 16 bp, H. sapiens
cactgaccccaaagaa

SEQ ID NO: 63869 - DNA, 16 bp, H. sapiens
cactgactatgtgcca

SEQ ID NO: 63870 - DNA, 16 bp, H. sapiens
cactgactcacctaga

SEQ ID NO: 63871 - DNA, 16 bp, H. sapiens
cactgacttccacaat

SEQ ID NO: 63872 - DNA, 16 bp, H. sapiens
cactgagaacccagca

SEQ ID NO: 63873 - DNA, 16 bp, H. sapiens
cactgagacctccacc

SEQ ID NO: 63874 - DNA, 16 bp, H. sapiens
cactgagcacctgctg

SEQ ID NO: 63875 - DNA, 16 bp, H. sapiens
cactgagcccagcctc

SEQ ID NO: 63876 - DNA, 16 bp, H. sapiens
cactgagcctggccac

SEQ ID NO: 63877 - DNA, 16 bp, H. sapiens
cactgagctgagatca

SEQ ID NO: 63878 - DNA, 16 bp, H. sapiens
cactgagctgccctca

SEQ ID NO: 63879 - DNA, 16 bp, H. sapiens
cactgagctggtcatc

SEQ ID NO: 63880 - DNA, 16 bp, H. sapiens
cactgagctgtgatca

SEQ ID NO: 63881 - DNA, 16 bp, H. sapiens
cactgaggcttgtgca

SEQ ID NO: 63882 - DNA, 16 bp, H. sapiens
cactgagtcagacctg

SEQ ID NO: 63883 - DNA, 16 bp, H. sapiens
cactgagtccccaaag

SEQ ID NO: 63884 - DNA, 16 bp, H. sapiens
cactgatagactggat

SEQ ID NO: 63885 - DNA, 16 bp, H. sapiens
cactgatatttttact

SEQ ID NO: 63886 - DNA, 16 bp, H. sapiens
cactgatatttttatt

SEQ ID NO: 63887 - DNA, 16 bp, H. sapiens
cactgatcatcaaaga

SEQ ID NO: 63888 - DNA, 16 bp, H. sapiens
cactgatcgttagaga

SEQ ID NO: 63889 - DNA, 16 bp, H. sapiens
cactgatgaaaggaat

SEQ ID NO: 63890 - DNA, 16 bp, H. sapiens
cactgatgcagcagca

SEQ ID NO: 63891 - DNA, 16 bp, H. sapiens
cactgatgccacagaa

SEQ ID NO: 63892 - DNA, 16 bp, H. sapiens
cactgatgggcaccta

SEQ ID NO: 63893 - DNA, 16 bp, H. sapiens
cactgatgttcatcaa

SEQ ID NO: 63894 - DNA, 16 bp, H. sapiens
cactgatttgaaatgc

SEQ ID NO: 63895 - DNA, 16 bp, H. sapiens
cactgattttattttt

SEQ ID NO: 63896 - DNA, 16 bp, H. sapiens
cactgattttctttcc

SEQ ID NO: 63897 - DNA, 16 bp, H. sapiens
cactgcaaaaacatat

SEQ ID NO: 63898 - DNA, 16 bp, H. sapiens
cactgcaaaagaaact

SEQ ID NO: 63899 - DNA, 16 bp, H. sapiens
cactgcaaattctgcc

SEQ ID NO: 63900 - DNA, 16 bp, H. sapiens
cactgcaaccactgct

SEQ ID NO: 63901 - DNA, 16 bp, H. sapiens
cactgcaaccccaacc

SEQ ID NO: 63902 - DNA, 16 bp, H. sapiens
cactgcaacctcagct

SEQ ID NO: 63903 - DNA, 17 bp, H. sapiens
cactgcaacctccacca

SEQ ID NO: 63904 - DNA, 16 bp, H. sapiens
cactgcaacctcctct

SEQ ID NO: 63905 - DNA, 16 bp, H. sapiens
cactgcaacctccttt

SEQ ID NO: 63906 - DNA, 16 bp, H. sapiens
cactgcaacctgcacc

SEQ ID NO: 63907 - DNA, 16 bp, H. sapiens
cactgcaacctgtgtc

SEQ ID NO: 63908 - DNA, 16 bp, H. sapiens
cactgcaagcaccacc

SEQ ID NO: 63909 - DNA, 16 bp, H. sapiens
cactgcaagctcctcc

SEQ ID NO: 63910 - DNA, 16 bp, H. sapiens
cactgcacacagccta

SEQ ID NO: 63911 - DNA, 16 bp, H. sapiens
cactgcacaccagccc

SEQ ID NO: 63912 - DNA, 16 bp, H. sapiens
cactgcacagcctggg

SEQ ID NO: 63913 - DNA, 16 bp, H. sapiens
cactgcacccagcagg

SEQ ID NO: 63914 - DNA, 16 bp, H. sapiens
cactgcacccagcctg

SEQ ID NO: 63915 - DNA, 16 bp, H. sapiens
cactgcacccaggcct

SEQ ID NO: 63916 - DNA, 16 bp, H. sapiens
cactgcaccccagcct

SEQ ID NO: 63917 - DNA, 16 bp, H. sapiens
cactgcacccccagcc

SEQ ID NO: 63918 - DNA, 16 bp, H. sapiens
cactgcaccctgcccc

SEQ ID NO: 63919 - DNA, 16 bp, H. sapiens
cactgcacctcagcct

SEQ ID NO: 63920 - DNA, 16 bp, H. sapiens
cactgcacctctctga

SEQ ID NO: 63921 - DNA, 16 bp, H. sapiens
cactgcacctggccag

SEQ ID NO: 63922 - DNA, 17 bp, H. sapiens
cactgcacctggcccag

SEQ ID NO: 63923 - DNA, 16 bp, H. sapiens
cactgcacctggccct

SEQ ID NO: 63924 - DNA, 16 bp, H. sapiens
cactgcacctggctgt

SEQ ID NO: 63925 - DNA, 16 bp, H. sapiens
cactgcacctggcttg

SEQ ID NO: 63926 - DNA, 16 bp, H. sapiens
cactgcactacatcct

SEQ ID NO: 63927 - DNA, 16 bp, H. sapiens
cactgcactatagcct

SEQ ID NO: 63928 - DNA, 16 bp, H. sapiens
cactgcactcactcca

SEQ ID NO: 63929 - DNA, 16 bp, H. sapiens
cactgcactcatgcct

SEQ ID NO: 63930 - DNA, 16 bp, H. sapiens
cactgcactccaatct

SEQ ID NO: 63931 - DNA, 16 bp, H. sapiens
cactgcactccaattt

SEQ ID NO: 63932 - DNA, 16 bp, H. sapiens
cactgcactccagcca

SEQ ID NO: 63933 - DNA, 16 bp, H. sapiens
cactgcactccagccc

SEQ ID NO: 63934 - DNA, 16 bp, H. sapiens
cactgcactccagccg

SEQ ID NO: 63935 - DNA, 17 bp, H. sapiens
cactgcactccagcctc

SEQ ID NO: 63936 - DNA, 16 bp, H. sapiens
cactgcactccagctg

SEQ ID NO: 63937 - DNA, 16 bp, H. sapiens
cactgcactccagtcc

SEQ ID NO: 63938 - DNA, 16 bp, H. sapiens
cactgcactccatact

SEQ ID NO: 63939 - DNA, 22 bp, H. sapiens
cactgcactccatcctgggcga

SEQ ID NO: 63940 - DNA, 16 bp, H. sapiens
cactgcactccattct

SEQ ID NO: 63941 - DNA, 16 bp, H. sapiens
cactgcactcggcctc

SEQ ID NO: 63942 - DNA, 16 bp, H. sapiens
cactgcactctagcct

SEQ ID NO: 63943 - DNA, 16 bp, H. sapiens
cactgcactctggcct

SEQ ID NO: 63944 - DNA, 16 bp, H. sapiens
cactgcactgcagcct

SEQ ID NO: 63945 - DNA, 16 bp, H. sapiens
cactgcactgctgcct

SEQ ID NO: 63946 - DNA, 16 bp, H. sapiens
cactgcactgtagcct

SEQ ID NO: 63947 - DNA, 16 bp, H. sapiens
cactgcacttcagcgt

SEQ ID NO: 63948 - DNA, 16 bp, H. sapiens
cactgcagactccacc

SEQ ID NO: 63949 - DNA, 16 bp, H. sapiens
cactgcagccacactc

SEQ ID NO: 63950 - DNA, 16 bp, H. sapiens
cactgcagccagaggg

SEQ ID NO: 63951 - DNA, 16 bp, H. sapiens
cactgcagccatgacc

SEQ ID NO: 63952 - DNA, 16 bp, H. sapiens
cactgcagcccaggag

SEQ ID NO: 63953 - DNA, 16 bp, H. sapiens
cactgcagccccaatc

SEQ ID NO: 63954 - DNA, 16 bp, H. sapiens
cactgcagccccagcc

SEQ ID NO: 63955 - DNA, 16 bp, H. sapiens
cactgcagcccccacc

SEQ ID NO: 63956 - DNA, 16 bp, H. sapiens
cactgcagcctcaagc

SEQ ID NO: 63957 - DNA, 16 bp, H. sapiens
cactgcagcctcacac

SEQ ID NO: 63958 - DNA, 16 bp, H. sapiens
cactgcagcctcaccc

SEQ ID NO: 63959 - DNA, 16 bp, H. sapiens
cactgcagcctcagca

SEQ ID NO: 63960 - DNA, 16 bp, H. sapiens
cactgcagcctcagcc

SEQ ID NO: 63961 - DNA, 16 bp, H. sapiens
cactgcagcctccctg

SEQ ID NO: 63962 - DNA, 16 bp, H. sapiens
cactgcagcctcctgc

SEQ ID NO: 63963 - DNA, 17 bp, H. sapiens
cactgcagcctcgaatt

SEQ ID NO: 63964 - DNA, 16 bp, H. sapiens
cactgcagcctctccc

SEQ ID NO: 63965 - DNA, 16 bp, H. sapiens
cactgcagcctctgcc

SEQ ID NO: 63966 - DNA, 16 bp, H. sapiens
cactgcagcctctgct

SEQ ID NO: 63967 - DNA, 16 bp, H. sapiens
cactgcagcctgaaat

SEQ ID NO: 63968 - DNA, 16 bp, H. sapiens
cactgcagcctggatc

SEQ ID NO: 63969 - DNA, 16 bp, H. sapiens
cactgcagcctgggag

SEQ ID NO: 63970 - DNA, 16 bp, H. sapiens
cactgcagctgcctgc

SEQ ID NO: 63971 - DNA, 16 bp, H. sapiens
cactgcagctggccta

SEQ ID NO: 63972 - DNA, 16 bp, H. sapiens
cactgcagcttcctcc

SEQ ID NO: 63973 - DNA, 16 bp, H. sapiens
cactgcagcttctacc

SEQ ID NO: 63974 - DNA, 16 bp, H. sapiens
cactgcagtctccgcc

SEQ ID NO: 63975 - DNA, 16 bp, H. sapiens
cactgcagtctccgtc

SEQ ID NO: 63976 - DNA, 16 bp, H. sapiens
cactgcagtctctgtc

SEQ ID NO: 63977 - DNA, 16 bp, H. sapiens
cactgcagtgagctgt

SEQ ID NO: 63978 - DNA, 16 bp, H. sapiens
cactgcatctggctga

SEQ ID NO: 63979 - DNA, 16 bp, H. sapiens
cactgcattacagcct

SEQ ID NO: 63980 - DNA, 16 bp, H. sapiens
cactgcattccaacct

SEQ ID NO: 63981 - DNA, 16 bp, H. sapiens
cactgcattccagact

SEQ ID NO: 63982 - DNA, 16 bp, H. sapiens
cactgcattccagcca

SEQ ID NO: 63983 - DNA, 16 bp, H. sapiens
cactgcattccagccc

SEQ ID NO: 63984 - DNA, 16 bp, H. sapiens
cactgcattccaggct

SEQ ID NO: 63985 - DNA, 16 bp, H. sapiens
cactgcattcccgcct

SEQ ID NO: 63986 - DNA, 16 bp, H. sapiens
cactgcatttcagcct

SEQ ID NO: 63987 - DNA, 16 bp, H. sapiens
cactgcattttgttta

SEQ ID NO: 63988 - DNA, 16 bp, H. sapiens
cactgccaaatccaag

SEQ ID NO: 63989 - DNA, 16 bp, H. sapiens
cactgccacacctggc

SEQ ID NO: 63990 - DNA, 16 bp, H. sapiens
cactgccaccaccact

SEQ ID NO: 63991 - DNA, 16 bp, H. sapiens
cactgccacctcaacc

SEQ ID NO: 63992 - DNA, 16 bp, H. sapiens
cactgccacctcctcc

SEQ ID NO: 63993 - DNA, 16 bp, H. sapiens
cactgccacctctgct

SEQ ID NO: 63994 - DNA, 16 bp, H. sapiens
cactgccaccttgcag

SEQ ID NO: 63995 - DNA, 16 bp, H. sapiens
cactgccactgccacc

SEQ ID NO: 63996 - DNA, 16 bp, H. sapiens
cactgccactgccact

SEQ ID NO: 63997 - DNA, 16 bp, H. sapiens
cactgccagctctgcc

SEQ ID NO: 63998 - DNA, 16 bp, H. sapiens
cactgccaggcctgcc

SEQ ID NO: 63999 - DNA, 16 bp, H. sapiens
cactgcccacctccca

SEQ ID NO: 64000 - DNA, 16 bp, H. sapiens
cactgcccagggccgg

SEQ ID NO: 64001 - DNA, 16 bp, H. sapiens
cactgcccccagcctg

SEQ ID NO: 64002 - DNA, 16 bp, H. sapiens
cactgcccccggcctt

SEQ ID NO: 64003 - DNA, 16 bp, H. sapiens
cactgccctaccagag

SEQ ID NO: 64004 - DNA, 16 bp, H. sapiens
cactgccctctgctgg

SEQ ID NO: 64005 - DNA, 16 bp, H. sapiens
cactgccctgaaggat

SEQ ID NO: 64006 - DNA, 16 bp, H. sapiens
cactgccctgagcatg

SEQ ID NO: 64007 - DNA, 16 bp, H. sapiens
cactgcctcctccacc

SEQ ID NO: 64008 - DNA, 16 bp, H. sapiens
cactgcctcggcctcc

SEQ ID NO: 64009 - DNA, 16 bp, H. sapiens
cactgcctctggcctc

SEQ ID NO: 64010 - DNA, 16 bp, H. sapiens
cactgcctggagttgg

SEQ ID NO: 64011 - DNA, 16 bp, H. sapiens
cactgcctggggccag

SEQ ID NO: 64012 - DNA, 16 bp, H. sapiens
cactgcctgtttttgt

SEQ ID NO: 64013 - DNA, 16 bp, H. sapiens
cactgcgccaggccag

SEQ ID NO: 64014 - DNA, 16 bp, H. sapiens
cactgcgccaggccca

SEQ ID NO: 64015 - DNA, 16 bp, H. sapiens
cactgcgcctggcagg

SEQ ID NO: 64016 - DNA, 16 bp, H. sapiens
cactgcgcctggccag

SEQ ID NO: 64017 - DNA, 16 bp, H. sapiens
cactgcgcctggccat

SEQ ID NO: 64018 - DNA, 16 bp, H. sapiens
cactgcgcctggctgc

SEQ ID NO: 64019 - DNA, 16 bp, H. sapiens
cactgcgcctggctta

SEQ ID NO: 64020 - DNA, 20 bp, H. sapiens
cactgcggaaggccacaggg

SEQ ID NO: 64021 - DNA, 16 bp, H. sapiens
cactgctactgccatt

SEQ ID NO: 64022 - DNA, 18 bp, H. sapiens
cactgctcaatgaaatca

SEQ ID NO: 64023 - DNA, 17 bp, H. sapiens
cactgctcaatgaaatt

SEQ ID NO: 64024 - DNA, 16 bp, H. sapiens
cactgctcagccccct

SEQ ID NO: 64025 - DNA, 16 bp, H. sapiens
cactgctcccagccga

SEQ ID NO: 64026 - DNA, 16 bp, H. sapiens
cactgctcccagctgc

SEQ ID NO: 64027 - DNA, 16 bp, H. sapiens
cactgctcctggctaa

SEQ ID NO: 64028 - DNA, 16 bp, H. sapiens
cactgctcttcagcct

SEQ ID NO: 64029 - DNA, 16 bp, H. sapiens
cactgctcttccttct

SEQ ID NO: 64030 - DNA, 16 bp, H. sapiens
cactgctgaaggaaat

SEQ ID NO: 64031 - DNA, 16 bp, H. sapiens
cactgctgagagaaat

SEQ ID NO: 64032 - DNA, 16 bp, H. sapiens
cactgctgagtgccca

SEQ ID NO: 64033 - DNA, 16 bp, H. sapiens
cactgctgatgggaat

SEQ ID NO: 64034 - DNA, 16 bp, H. sapiens
cactgctgccaaagag

SEQ ID NO: 64035 - DNA, 16 bp, H. sapiens
cactgctgcctccacc

SEQ ID NO: 64036 - DNA, 16 bp, H. sapiens
cactgctgctgatacc

SEQ ID NO: 64037 - DNA, 16 bp, H. sapiens
cactgctgctggtacc

SEQ ID NO: 64038 - DNA, 16 bp, H. sapiens
cactgctggctcaggc

SEQ ID NO: 64039 - DNA, 16 bp, H. sapiens
cactgctggctggggt

SEQ ID NO: 64040 - DNA, 16 bp, H. sapiens
cactgctgggggactc

SEQ ID NO: 64041 - DNA, 17 bp, H. sapiens
cactgctggtttacact

SEQ ID NO: 64042 - DNA, 16 bp, H. sapiens
cactgctgtgctccag

SEQ ID NO: 64043 - DNA, 16 bp, H. sapiens
cactgctgtgtcccca

SEQ ID NO: 64044 - DNA, 16 bp, H. sapiens
cactgctgtgtgtgtg

SEQ ID NO: 64045 - DNA, 16 bp, H. sapiens
cactgcttcagctgtg

SEQ ID NO: 64046 - DNA, 16 bp, H. sapiens
cactgcttcctgggtt

SEQ ID NO: 64047 - DNA, 16 bp, H. sapiens
cactgcttctcaaact

SEQ ID NO: 64048 - DNA, 16 bp, H. sapiens
cactgctttacctgtg

SEQ ID NO: 64049 - DNA, 16 bp, H. sapiens
cactggaaagtctcag

SEQ ID NO: 64050 - DNA, 16 bp, H. sapiens
cactggaaatgtggct

SEQ ID NO: 64051 - DNA, 16 bp, H. sapiens
cactggaaccagggag

SEQ ID NO: 64052 - DNA, 16 bp, H. sapiens
cactggaagaaaatat

SEQ ID NO: 64053 - DNA, 16 bp, H. sapiens
cactggaagaagaact

SEQ ID NO: 64054 - DNA, 16 bp, H. sapiens
cactggaatcacctgg

SEQ ID NO: 64055 - DNA, 16 bp, H. sapiens
cactggaccccagcct

SEQ ID NO: 64056 - DNA, 16 bp, H. sapiens
cactggactccagact

SEQ ID NO: 64057 - DNA, 16 bp, H. sapiens
cactggactccatcct

SEQ ID NO: 64058 - DNA, 16 bp, H. sapiens
cactggactctagcct

SEQ ID NO: 64059 - DNA, 16 bp, H. sapiens
cactggactgtgagct

SEQ ID NO: 64060 - DNA, 16 bp, H. sapiens
cactggaggtcacatt

SEQ ID NO: 64061 - DNA, 16 bp, H. sapiens
cactggatcccaggag

SEQ ID NO: 64062 - DNA, 16 bp, H. sapiens
cactggcaaactgaat

SEQ ID NO: 64063 - DNA, 16 bp, H. sapiens
cactggcagagagcag

SEQ ID NO: 64064 - DNA, 16 bp, H. sapiens
cactggcatggccttc

SEQ ID NO: 64065 - DNA, 16 bp, H. sapiens
cactggccaaagcagg

SEQ ID NO: 64066 - DNA, 16 bp, H. sapiens
cactggccaggcgtgg

SEQ ID NO: 64067 - DNA, 16 bp, H. sapiens
cactggccgggtgtgg

SEQ ID NO: 64068 - DNA, 16 bp, H. sapiens
cactggcctccagcct

SEQ ID NO: 64069 - DNA, 16 bp, H. sapiens
cactggccttctttct

SEQ ID NO: 64070 - DNA, 16 bp, H. sapiens
cactggcttggaattc

SEQ ID NO: 64071 - DNA, 16 bp, H. sapiens
cactgggaaaactgga

SEQ ID NO: 64072 - DNA, 16 bp, H. sapiens
cactgggagctgcaaa

SEQ ID NO: 64073 - DNA, 16 bp, H. sapiens
cactgggaggtggagg

SEQ ID NO: 64074 - DNA, 16 bp, H. sapiens
cactgggattacagat

SEQ ID NO: 64075 - DNA, 16 bp, H. sapiens
cactgggcaacagagc

SEQ ID NO: 64076 - DNA, 16 bp, H. sapiens
cactgggcagggcctc

SEQ ID NO: 64077 - DNA, 16 bp, H. sapiens
cactgggcccagcctc

SEQ ID NO: 64078 - DNA, 16 bp, H. sapiens
cactgggcccagcctg

SEQ ID NO: 64079 - DNA, 16 bp, H. sapiens
cactgggcctggcccc

SEQ ID NO: 64080 - DNA, 16 bp, H. sapiens
cactggggaacaagca

SEQ ID NO: 64081 - DNA, 16 bp, H. sapiens
cactggggagccacag

SEQ ID NO: 64082 - DNA, 16 bp, H. sapiens
cactggggagtgctgg

SEQ ID NO: 64083 - DNA, 16 bp, H. sapiens
cactggggatcaaatt

SEQ ID NO: 64084 - DNA, 16 bp, H. sapiens
cactggggcactgccc

SEQ ID NO: 64085 - DNA, 16 bp, H. sapiens
cactggggcctgctgg

SEQ ID NO: 64086 - DNA, 16 bp, H. sapiens
cactggggcctgtcac

SEQ ID NO: 64087 - DNA, 16 bp, H. sapiens
cactggggcttcagct

SEQ ID NO: 64088 - DNA, 16 bp, H. sapiens
cactggggttacaggt

SEQ ID NO: 64089 - DNA, 16 bp, H. sapiens
cactggtcaccagaga

SEQ ID NO: 64090 - DNA, 16 bp, H. sapiens
cactggtctccaactc

SEQ ID NO: 64091 - DNA, 16 bp, H. sapiens
cactggtttgaaattc

SEQ ID NO: 64092 - DNA, 16 bp, H. sapiens
cactgtaagctccacc

SEQ ID NO: 64093 - DNA, 16 bp, H. sapiens
cactgtacaccagcct

SEQ ID NO: 64094 - DNA, 16 bp, H. sapiens
cactgtacccagccca

SEQ ID NO: 64095 - DNA, 16 bp, H. sapiens
cactgtactccaacct

SEQ ID NO: 64096 - DNA, 16 bp, H. sapiens
cactgtactccagcca

SEQ ID NO: 64097 - DNA, 16 bp, H. sapiens
cactgtactccagccc

SEQ ID NO: 64098 - DNA, 16 bp, H. sapiens
cactgtactccagcct

SEQ ID NO: 64099 - DNA, 16 bp, H. sapiens
cactgtactccggcct

SEQ ID NO: 64100 - DNA, 16 bp, H. sapiens
cactgtactcctgcct

SEQ ID NO: 64101 - DNA, 16 bp, H. sapiens
cactgtagcctcaact

SEQ ID NO: 64102 - DNA, 16 bp, H. sapiens
cactgtagcctggatg

SEQ ID NO: 64103 - DNA, 16 bp, H. sapiens
cactgtagggttatta

SEQ ID NO: 64104 - DNA, 16 bp, H. sapiens
cactgtagggtttcta

SEQ ID NO: 64105 - DNA, 16 bp, H. sapiens
cactgtagtccagcct

SEQ ID NO: 64106 - DNA, 16 bp, H. sapiens
cactgtatatatatat

SEQ ID NO: 64107 - DNA, 16 bp, H. sapiens
cactgtcaatattaaa

SEQ ID NO: 64108 - DNA, 16 bp, H. sapiens
cactgtcaccatcacc

SEQ ID NO: 64109 - DNA, 16 bp, H. sapiens
cactgtcacctctgcc

SEQ ID NO: 64110 - DNA, 16 bp, H. sapiens
cactgtcagctttcct

SEQ ID NO: 64111 - DNA, 16 bp, H. sapiens
cactgtcatcttttct

SEQ ID NO: 64112 - DNA, 16 bp, H. sapiens
cactgtcatgttttaa

SEQ ID NO: 64113 - DNA, 16 bp, H. sapiens
cactgtccaatagaaa

SEQ ID NO: 64114 - DNA, 17 bp, H. sapiens
cactgtccatcagagaa

SEQ ID NO: 64115 - DNA, 16 bp, H. sapiens
cactgtccctggccaa

SEQ ID NO: 64116 - DNA, 16 bp, H. sapiens
cactgtcctaggtgct

SEQ ID NO: 64117 - DNA, 16 bp, H. sapiens
cactgtctcatttaat

SEQ ID NO: 64118 - DNA, 16 bp, H. sapiens
cactgtcttcttgctt

SEQ ID NO: 64119 - DNA, 16 bp, H. sapiens
cactgtgaacaaaggt

SEQ ID NO: 64120 - DNA, 16 bp, H. sapiens
cactgtgacctctgcc

SEQ ID NO: 64121 - DNA, 16 bp, H. sapiens
cactgtgaccttgaac

SEQ ID NO: 64122 - DNA, 16 bp, H. sapiens
cactgtgattttaatt

SEQ ID NO: 64123 - DNA, 16 bp, H. sapiens
cactgtgatttttatt

SEQ ID NO: 64124 - DNA, 16 bp, H. sapiens
cactgtgccaggccat

SEQ ID NO: 64125 - DNA, 16 bp, H. sapiens
cactgtgcccagcaca

SEQ ID NO: 64126 - DNA, 16 bp, H. sapiens
cactgtgcccagccat

SEQ ID NO: 64127 - DNA, 16 bp, H. sapiens
cactgtgcccggcaag

SEQ ID NO: 64128 - DNA, 16 bp, H. sapiens
cactgtgcctgccctg

SEQ ID NO: 64129 - DNA, 16 bp, H. sapiens
cactgtgcctggacca

SEQ ID NO: 64130 - DNA, 16 bp, H. sapiens
cactgtgcctggccaa

SEQ ID NO: 64131 - DNA, 16 bp, H. sapiens
cactgtgcctggccag

SEQ ID NO: 64132 - DNA, 16 bp, H. sapiens
cactgtgcctggccca

SEQ ID NO: 64133 - DNA, 16 bp, H. sapiens
cactgtgcctggccta

SEQ ID NO: 64134 - DNA, 16 bp, H. sapiens
cactgtgcctggcctg

SEQ ID NO: 64135 - DNA, 16 bp, H. sapiens
cactgtgcctggcctt

SEQ ID NO: 64136 - DNA, 16 bp, H. sapiens
cactgtgcctggctcc

SEQ ID NO: 64137 - DNA, 16 bp, H. sapiens
cactgtgctccaacct

SEQ ID NO: 64138 - DNA, 16 bp, H. sapiens
cactgtgctctagcct

SEQ ID NO: 64139 - DNA, 16 bp, H. sapiens
cactgtgctgaatgct

SEQ ID NO: 64140 - DNA, 16 bp, H. sapiens
cactgtgctgagtgct

SEQ ID NO: 64141 - DNA, 16 bp, H. sapiens
cactgtgctgggagaa

SEQ ID NO: 64142 - DNA, 16 bp, H. sapiens
cactgtgctgggtact

SEQ ID NO: 64143 - DNA, 16 bp, H. sapiens
cactgtgcttggcata

SEQ ID NO: 64144 - DNA, 16 bp, H. sapiens
cactgtgcttggccat

SEQ ID NO: 64145 - DNA, 16 bp, H. sapiens
cactgtggaaaactgt

SEQ ID NO: 64146 - DNA, 16 bp, H. sapiens
cactgtggaaatcagt

SEQ ID NO: 64147 - DNA, 16 bp, H. sapiens
cactgtggccagagaa

SEQ ID NO: 64148 - DNA, 16 bp, H. sapiens
cactgtggcctcctcc

SEQ ID NO: 64149 - DNA, 16 bp, H. sapiens
cactgtggcctgggtg

SEQ ID NO: 64150 - DNA, 16 bp, H. sapiens
cactgtggctggagca

SEQ ID NO: 64151 - DNA, 16 bp, H. sapiens
cactgtggtcctccag

SEQ ID NO: 64152 - DNA, 16 bp, H. sapiens
cactgtggttttattt

SEQ ID NO: 64153 - DNA, 16 bp, H. sapiens
cactgtgtccagccca

SEQ ID NO: 64154 - DNA, 16 bp, H. sapiens
cactgtgtccagctaa

SEQ ID NO: 64155 - DNA, 16 bp, H. sapiens
cactgtgtgccaagca

SEQ ID NO: 64156 - DNA, 16 bp, H. sapiens
cactgtgtgtgtgacc

SEQ ID NO: 64157 - DNA, 16 bp, H. sapiens
cactgtgttaggtgct

SEQ ID NO: 64158 - DNA, 16 bp, H. sapiens
cactgtgttgctgagg

SEQ ID NO: 64159 - DNA, 16 bp, H. sapiens
cactgttcatcagaga

SEQ ID NO: 64160 - DNA, 16 bp, H. sapiens
cactgttcctcacagc

SEQ ID NO: 64161 - DNA, 16 bp, H. sapiens
cactgttctaagtgct

SEQ ID NO: 64162 - DNA, 16 bp, H. sapiens
cactgttctaggcact

SEQ ID NO: 64163 - DNA, 16 bp, H. sapiens
cactgttctaggtgct

SEQ ID NO: 64164 - DNA, 16 bp, H. sapiens
cactgttgatgggaac

SEQ ID NO: 64165 - DNA, 16 bp, H. sapiens
cactgttgccctggct

SEQ ID NO: 64166 - DNA, 16 bp, H. sapiens
cactgttgcctgggct

SEQ ID NO: 64167 - DNA, 16 bp, H. sapiens
cactgttggaggtggg

SEQ ID NO: 64168 - DNA, 16 bp, H. sapiens
cactgttggtgggaac

SEQ ID NO: 64169 - DNA, 16 bp, H. sapiens
cactgttgtaggtgct

SEQ ID NO: 64170 - DNA, 16 bp, H. sapiens
cactgtttattgaaga

SEQ ID NO: 64171 - DNA, 16 bp, H. sapiens
cactgtttctctcact

SEQ ID NO: 64172 - DNA, 16 bp, H. sapiens
cactgtttcttcaagc

SEQ ID NO: 64173 - DNA, 16 bp, H. sapiens
cactgtttgctgacaa

SEQ ID NO: 64174 - DNA, 16 bp, H. sapiens
cactgttttaaatgtt

SEQ ID NO: 64175 - DNA, 16 bp, H. sapiens
cactgttttactgggg

SEQ ID NO: 64176 - DNA, 16 bp, H. sapiens
cactgtttttatagaa

SEQ ID NO: 64177 - DNA, 16 bp, H. sapiens
cactgtttttgctgca

SEQ ID NO: 64178 - DNA, 16 bp, H. sapiens
cacttaaaaaatattt

SEQ ID NO: 64179 - DNA, 16 bp, H. sapiens
cacttaaaaatatgtt

SEQ ID NO: 64180 - DNA, 16 bp, H. sapiens
cacttaaaaatgatta

SEQ ID NO: 64181 - DNA, 16 bp, H. sapiens
cacttaaaatatttca

SEQ ID NO: 64182 - DNA, 16 bp, H. sapiens
cacttaacattatatt

SEQ ID NO: 64183 - DNA, 16 bp, H. sapiens
cacttaacctctcaga

SEQ ID NO: 64184 - DNA, 16 bp, H. sapiens
cacttaatattaacca

SEQ ID NO: 64185 - DNA, 16 bp, H. sapiens
cacttaattctcacaa

SEQ ID NO: 64186 - DNA, 16 bp, H. sapiens
cacttacaaatgagaa

SEQ ID NO: 64187 - DNA, 16 bp, H. sapiens
cacttacagccaactg

SEQ ID NO: 64188 - DNA, 16 bp, H. sapiens
cacttactagctgtat

SEQ ID NO: 64189 - DNA, 16 bp, H. sapiens
cacttactagttgtgt

SEQ ID NO: 64190 - DNA, 16 bp, H. sapiens
cacttactcattcatt

SEQ ID NO: 64191 - DNA, 16 bp, H. sapiens
cacttagaagaaaaca

SEQ ID NO: 64192 - DNA, 16 bp, H. sapiens
cacttagcctctctga

SEQ ID NO: 64193 - DNA, 16 bp, H. sapiens
cacttaggataatggc

SEQ ID NO: 64194 - DNA, 16 bp, H. sapiens
cacttaggctcaaaat

SEQ ID NO: 64195 - DNA, 16 bp, H. sapiens
cacttaggttgattcc

SEQ ID NO: 64196 - DNA, 16 bp, H. sapiens
cacttaggttgatttc

SEQ ID NO: 64197 - DNA, 16 bp, H. sapiens
cacttataaaaccatt

SEQ ID NO: 64198 - DNA, 16 bp, H. sapiens
cacttataaatgagaa

SEQ ID NO: 64199 - DNA, 16 bp, H. sapiens
cacttataagtgagaa

SEQ ID NO: 64200 - DNA, 16 bp, H. sapiens
cacttattggctgtgt

SEQ ID NO: 64201 - DNA, 16 bp, H. sapiens
cacttcaacccaggag

SEQ ID NO: 64202 - DNA, 16 bp, H. sapiens
cacttcagccagggtg

SEQ ID NO: 64203 - DNA, 16 bp, H. sapiens
cacttcagcccagaaa

SEQ ID NO: 64204 - DNA, 16 bp, H. sapiens
cacttcagcctccaag

SEQ ID NO: 64205 - DNA, 17 bp, H. sapiens
cacttcagcctcccaag

SEQ ID NO: 64206 - DNA, 16 bp, H. sapiens
cacttcagcctcctgg

SEQ ID NO: 64207 - DNA, 16 bp, H. sapiens
cacttcagcctctcca

SEQ ID NO: 64208 - DNA, 16 bp, H. sapiens
cacttcagcctctgcc

SEQ ID NO: 64209 - DNA, 16 bp, H. sapiens
cacttcagcctgggga

SEQ ID NO: 64210 - DNA, 16 bp, H. sapiens
cacttcagcctgtgca

SEQ ID NO: 64211 - DNA, 16 bp, H. sapiens
cacttcagctcaggag

SEQ ID NO: 64212 - DNA, 16 bp, H. sapiens
cacttcaggaagctga

SEQ ID NO: 64213 - DNA, 16 bp, H. sapiens
cacttccaagcctgtg

SEQ ID NO: 64214 - DNA, 16 bp, H. sapiens
cacttccaatttctgt

SEQ ID NO: 64215 - DNA, 16 bp, H. sapiens
cacttccatggcacct

SEQ ID NO: 64216 - DNA, 16 bp, H. sapiens
cacttcccaactcatt

SEQ ID NO: 64217 - DNA, 16 bp, H. sapiens
cacttcccaattcatt

SEQ ID NO: 64218 - DNA, 16 bp, H. sapiens
cacttcccaccaggct

SEQ ID NO: 64219 - DNA, 16 bp, H. sapiens
cacttcccctctctga

SEQ ID NO: 64220 - DNA, 16 bp, H. sapiens
cacttcccgggttcaa

SEQ ID NO: 64221 - DNA, 16 bp, H. sapiens
cacttccctgcttaaa

SEQ ID NO: 64222 - DNA, 16 bp, H. sapiens
cacttcctagctgggt

SEQ ID NO: 64223 - DNA, 16 bp, H. sapiens
cacttcctccatgaag

SEQ ID NO: 64224 - DNA, 16 bp, H. sapiens
cacttcctcctgctct

SEQ ID NO: 64225 - DNA, 16 bp, H. sapiens
cacttccttctggcct

SEQ ID NO: 64226 - DNA, 16 bp, H. sapiens
cacttccttctttaac

SEQ ID NO: 64227 - DNA, 16 bp, H. sapiens
cacttcgggaggccga

SEQ ID NO: 64228 - DNA, 16 bp, H. sapiens
cacttcgggaggctga

SEQ ID NO: 64229 - DNA, 16 bp, H. sapiens
cacttctcaaaagaaa

SEQ ID NO: 64230 - DNA, 16 bp, H. sapiens
cacttctcaccatctc

SEQ ID NO: 64231 - DNA, 16 bp, H. sapiens
cacttctcagtaccaa

SEQ ID NO: 64232 - DNA, 16 bp, H. sapiens
cacttctccctcctgc

SEQ ID NO: 64233 - DNA, 16 bp, H. sapiens
cacttctgcctcccag

SEQ ID NO: 64234 - DNA, 16 bp, H. sapiens
cacttctgggtggggc

SEQ ID NO: 64235 - DNA, 16 bp, H. sapiens
cacttctgtgaagaaa

SEQ ID NO: 64236 - DNA, 16 bp, H. sapiens
cacttgaaatgtggct

SEQ ID NO: 64237 - DNA, 16 bp, H. sapiens
cacttgaaccaggcag

SEQ ID NO: 64238 - DNA, 16 bp, H. sapiens
cacttgaacccaggac

SEQ ID NO: 64239 - DNA, 16 bp, H. sapiens
cacttgaacccgagag

SEQ ID NO: 64240 - DNA, 18 bp, H. sapiens
cacttgaacccgggagat

SEQ ID NO: 64241 - DNA, 16 bp, H. sapiens
cacttgaacccggggg

SEQ ID NO: 64242 - DNA, 19 bp, H. sapiens
cacttgaaccggggaggcg

SEQ ID NO: 64243 - DNA, 16 bp, H. sapiens
cacttgaacctggaaa

SEQ ID NO: 64244 - DNA, 16 bp, H. sapiens
cacttgaacctggaga

SEQ ID NO: 64245 - DNA, 16 bp, H. sapiens
cacttgaacctgggaa

SEQ ID NO: 64246 - DNA, 16 bp, H. sapiens
cacttgaatccagaag

SEQ ID NO: 64247 - DNA, 16 bp, H. sapiens
cacttgaccccaggag

SEQ ID NO: 64248 - DNA, 16 bp, H. sapiens
cacttgagccaagagt

SEQ ID NO: 64249 - DNA, 16 bp, H. sapiens
cacttgagccagagag

SEQ ID NO: 64250 - DNA, 16 bp, H. sapiens
cacttgagcccaggac

SEQ ID NO: 64251 - DNA, 16 bp, H. sapiens
cacttgagcctaggaa

SEQ ID NO: 64252 - DNA, 16 bp, H. sapiens
cacttgagcctgggaa

SEQ ID NO: 64253 - DNA, 16 bp, H. sapiens
cacttgagctcgggag

SEQ ID NO: 64254 - DNA, 16 bp, H. sapiens
cacttgaggctgcagt

SEQ ID NO: 64255 - DNA, 16 bp, H. sapiens
cacttgagtccagaaa

SEQ ID NO: 64256 - DNA, 16 bp, H. sapiens
cacttgagtttgagac

SEQ ID NO: 64257 - DNA, 17 bp, H. sapiens
cacttgcagcctcccgg

SEQ ID NO: 64258 - DNA, 16 bp, H. sapiens
cacttgcatcagcatg

SEQ ID NO: 64259 - DNA, 16 bp, H. sapiens
cacttgccaccatgcc

SEQ ID NO: 64260 - DNA, 16 bp, H. sapiens
cacttgcctctgcctc

SEQ ID NO: 64261 - DNA, 16 bp, H. sapiens
cacttgctcaaggtca

SEQ ID NO: 64262 - DNA, 16 bp, H. sapiens
cacttgcttggtaaat

SEQ ID NO: 64263 - DNA, 16 bp, H. sapiens
cacttggaagagatcc

SEQ ID NO: 64264 - DNA, 16 bp, H. sapiens
cacttggagcagccag

SEQ ID NO: 64265 - DNA, 16 bp, H. sapiens
cacttggccctcttcc

SEQ ID NO: 64266 - DNA, 16 bp, H. sapiens
cacttggctaattctt

SEQ ID NO: 64267 - DNA, 16 bp, H. sapiens
cacttgggagcctgag

SEQ ID NO: 64268 - DNA, 18 bp, H. sapiens
cacttgggaggctgaggt

SEQ ID NO: 64269 - DNA, 16 bp, H. sapiens
cacttgggagtctgag

SEQ ID NO: 64270 - DNA, 16 bp, H. sapiens
cacttggggaaactga

SEQ ID NO: 64271 - DNA, 16 bp, H. sapiens
cacttggggaggctga

SEQ ID NO: 64272 - DNA, 16 bp, H. sapiens
cacttggggattatta

SEQ ID NO: 64273 - DNA, 16 bp, H. sapiens
cacttggttacagctg

SEQ ID NO: 64274 - DNA, 16 bp, H. sapiens
cacttgtaaactgtca

SEQ ID NO: 64275 - DNA, 16 bp, H. sapiens
cacttgtaactgctgc

SEQ ID NO: 64276 - DNA, 16 bp, H. sapiens
cacttgtaatcctagc

SEQ ID NO: 64277 - DNA, 16 bp, H. sapiens
cacttgtacccccaaa

SEQ ID NO: 64278 - DNA, 16 bp, H. sapiens
cacttgtgaatgggag

SEQ ID NO: 64279 - DNA, 16 bp, H. sapiens
cacttgtgcactgttg

SEQ ID NO: 64280 - DNA, 16 bp, H. sapiens
cacttgttattttcca

SEQ ID NO: 64281 - DNA, 16 bp, H. sapiens
cacttgttttcttttg

SEQ ID NO: 64282 - DNA, 16 bp, H. sapiens
cactttaaaatgatta

SEQ ID NO: 64283 - DNA, 16 bp, H. sapiens
cactttaaaattcttt

SEQ ID NO: 64284 - DNA, 16 bp, H. sapiens
cactttaagaggctga

SEQ ID NO: 64285 - DNA, 16 bp, H. sapiens
cactttacagatgaga

SEQ ID NO: 64286 - DNA, 16 bp, H. sapiens
cactttacatacatta

SEQ ID NO: 64287 - DNA, 16 bp, H. sapiens
cactttacctctctga

SEQ ID NO: 64288 - DNA, 16 bp, H. sapiens
cactttagacatttcc

SEQ ID NO: 64289 - DNA, 16 bp, H. sapiens
cactttatacaaaaat

SEQ ID NO: 64290 - DNA, 16 bp, H. sapiens
cactttatgaggctga

SEQ ID NO: 64291 - DNA, 16 bp, H. sapiens
cactttattataaaac

SEQ ID NO: 64292 - DNA, 16 bp, H. sapiens
cactttattgcacttt

SEQ ID NO: 64293 - DNA, 16 bp, H. sapiens
cactttcaaacaacca

SEQ ID NO: 64294 - DNA, 16 bp, H. sapiens
cactttcacattttta

SEQ ID NO: 64295 - DNA, 16 bp, H. sapiens
cactttcagcctgtgt

SEQ ID NO: 64296 - DNA, 16 bp, H. sapiens
cactttcatgttcctc

SEQ ID NO: 64297 - DNA, 16 bp, H. sapiens
cactttccagaaagca

SEQ ID NO: 64298 - DNA, 16 bp, H. sapiens
cactttccaggttcaa

SEQ ID NO: 64299 - DNA, 16 bp, H. sapiens
cactttcccagcctcc

SEQ ID NO: 64300 - DNA, 16 bp, H. sapiens
cactttccccttcact

SEQ ID NO: 64301 - DNA, 16 bp, H. sapiens
cactttcctcctctgt

SEQ ID NO: 64302 - DNA, 16 bp, H. sapiens
cactttctcaggacct

SEQ ID NO: 64303 - DNA, 16 bp, H. sapiens
cactttctctttttaa

SEQ ID NO: 64304 - DNA, 16 bp, H. sapiens
cactttctgattttaa

SEQ ID NO: 64305 - DNA, 16 bp, H. sapiens
cactttgaaaaacatt

SEQ ID NO: 64306 - DNA, 16 bp, H. sapiens
cactttgagaagcaag

SEQ ID NO: 64307 - DNA, 16 bp, H. sapiens
cactttgagaggccag

SEQ ID NO: 64308 - DNA, 16 bp, H. sapiens
cactttgaggctgagg

SEQ ID NO: 64309 - DNA, 16 bp, H. sapiens
cactttgagtagcact

SEQ ID NO: 64310 - DNA, 16 bp, H. sapiens
cactttgattttggac

SEQ ID NO: 64311 - DNA, 19 bp, H. sapiens
cactttgcgaggccgaggc

SEQ ID NO: 64312 - DNA, 16 bp, H. sapiens
cactttggaaaatagt

SEQ ID NO: 64313 - DNA, 16 bp, H. sapiens
cactttggaaatcagt

SEQ ID NO: 64314 - DNA, 16 bp, H. sapiens
cactttggagatttct

SEQ ID NO: 64315 - DNA, 16 bp, H. sapiens
cactttggcctcctga

SEQ ID NO: 64316 - DNA, 16 bp, H. sapiens
cactttgggaacctga

SEQ ID NO: 64317 - DNA, 19 bp, H. sapiens
cactttgggaagccgaggc

SEQ ID NO: 64318 - DNA, 16 bp, H. sapiens
cactttgggaagctaa

SEQ ID NO: 64319 - DNA, 16 bp, H. sapiens
cactttgggaaggtga

SEQ ID NO: 64320 - DNA, 16 bp, H. sapiens
cactttgggacgctga

SEQ ID NO: 64321 - DNA, 16 bp, H. sapiens
cactttgggagaggcc

SEQ ID NO: 64322 - DNA, 16 bp, H. sapiens
cactttgggagcccag

SEQ ID NO: 64323 - DNA, 16 bp, H. sapiens
cactttgggagcccca

SEQ ID NO: 64324 - DNA, 17 bp, H. sapiens
cactttgggagcccgag

SEQ ID NO: 64325 - DNA, 16 bp, H. sapiens
cactttgggaggccca

SEQ ID NO: 64326 - DNA, 16 bp, H. sapiens
cactttgggagggaga

SEQ ID NO: 64327 - DNA, 16 bp, H. sapiens
cactttggtagactga

SEQ ID NO: 64328 - DNA, 16 bp, H. sapiens
cactttgtcacccagc

SEQ ID NO: 64329 - DNA, 16 bp, H. sapiens
cactttgtgagaacca

SEQ ID NO: 64330 - DNA, 16 bp, H. sapiens
cactttgtgcacatgt

SEQ ID NO: 64331 - DNA, 16 bp, H. sapiens
cactttgtggcccagg

SEQ ID NO: 64332 - DNA, 16 bp, H. sapiens
cactttgttccccagg

SEQ ID NO: 64333 - DNA, 16 bp, H. sapiens
cactttgttgcacagg

SEQ ID NO: 64334 - DNA, 16 bp, H. sapiens
cactttgttgcccatg

SEQ ID NO: 64335 - DNA, 16 bp, H. sapiens
cactttgttggttgtt

SEQ ID NO: 64336 - DNA, 16 bp, H. sapiens
cacttttaaaaagaag

SEQ ID NO: 64337 - DNA, 16 bp, H. sapiens
cacttttaaaatcatc

SEQ ID NO: 64338 - DNA, 16 bp, H. sapiens
cacttttaaataacca

SEQ ID NO: 64339 - DNA, 16 bp, H. sapiens
cacttttagaaatgca

SEQ ID NO: 64340 - DNA, 16 bp, H. sapiens
cacttttattcaacat

SEQ ID NO: 64341 - DNA, 16 bp, H. sapiens
cacttttatttaacat

SEQ ID NO: 64342 - DNA, 16 bp, H. sapiens
cacttttccttcctgc

SEQ ID NO: 64343 - DNA, 16 bp, H. sapiens
cacttttgagaatgaa

SEQ ID NO: 64344 - DNA, 16 bp, H. sapiens
cacttttgatggggtt

SEQ ID NO: 64345 - DNA, 16 bp, H. sapiens
cacttttgctttctga

SEQ ID NO: 64346 - DNA, 16 bp, H. sapiens
cacttttgtcatttct

SEQ ID NO: 64347 - DNA, 16 bp, H. sapiens
cacttttgtcccccag

SEQ ID NO: 64348 - DNA, 16 bp, H. sapiens
cactttttaaaattag

SEQ ID NO: 64349 - DNA, 16 bp, H. sapiens
cactttttaatagggt

SEQ ID NO: 64350 - DNA, 16 bp, H. sapiens
cactttttcacccagg

SEQ ID NO: 64351 - DNA, 16 bp, H. sapiens
cactttttggctatta

SEQ ID NO: 64352 - DNA, 16 bp, H. sapiens
cagaaaaaaaaatctg

SEQ ID NO: 64353 - DNA, 16 bp, H. sapiens
cagaaaaaaaatctca

SEQ ID NO: 64354 - DNA, 16 bp, H. sapiens
cagaaaaaaacattca

SEQ ID NO: 64355 - DNA, 16 bp, H. sapiens
cagaaaaaaatgtttt

SEQ ID NO: 64356 - DNA, 16 bp, H. sapiens
cagaaaaaacatttga

SEQ ID NO: 64357 - DNA, 16 bp, H. sapiens
cagaaaaaatggaaag

SEQ ID NO: 64358 - DNA, 16 bp, H. sapiens
cagaaaaacataattt

SEQ ID NO: 64359 - DNA, 16 bp, H. sapiens
cagaaaaactcttcta

SEQ ID NO: 64360 - DNA, 23 bp, H. sapiens
cagaaaaactggaaactctaaaa

SEQ ID NO: 64361 - DNA, 16 bp, H. sapiens
cagaaaaactggaaat

SEQ ID NO: 64362 - DNA, 16 bp, H. sapiens
cagaaaaagaaactat

SEQ ID NO: 64363 - DNA, 16 bp, H. sapiens
cagaaaaagaaggaat

SEQ ID NO: 64364 - DNA, 16 bp, H. sapiens
cagaaaaagaatatat

SEQ ID NO: 64365 - DNA, 16 bp, H. sapiens
cagaaaaagcagttga

SEQ ID NO: 64366 - DNA, 16 bp, H. sapiens
cagaaaaagcatctga

SEQ ID NO: 64367 - DNA, 16 bp, H. sapiens
cagaaaaaggaaaatg

SEQ ID NO: 64368 - DNA, 16 bp, H. sapiens
cagaaaaaggatttga

SEQ ID NO: 64369 - DNA, 16 bp, H. sapiens
cagaaaaagtaactat

SEQ ID NO: 64370 - DNA, 16 bp, H. sapiens
cagaaaaagtagattt

SEQ ID NO: 64371 - DNA, 16 bp, H. sapiens
cagaaaaagtatttaa

SEQ ID NO: 64372 - DNA, 16 bp, H. sapiens
cagaaaaataaagatt

SEQ ID NO: 64373 - DNA, 16 bp, H. sapiens
cagaaaaataattctg

SEQ ID NO: 64374 - DNA, 16 bp, H. sapiens
cagaaaaatagaaact

SEQ ID NO: 64375 - DNA, 16 bp, H. sapiens
cagaaaaatatctgaa

SEQ ID NO: 64376 - DNA, 16 bp, H. sapiens
cagaaaaatcagtaaa

SEQ ID NO: 64377 - DNA, 16 bp, H. sapiens
cagaaaaatcatttga

SEQ ID NO: 64378 - DNA, 16 bp, H. sapiens
cagaaaaatctgaaaa

SEQ ID NO: 64379 - DNA, 16 bp, H. sapiens
cagaaaaattgaaaat

SEQ ID NO: 64380 - DNA, 16 bp, H. sapiens
cagaaaaattttaaaa

SEQ ID NO: 64381 - DNA, 16 bp, H. sapiens
cagaaaacaaaagtga

SEQ ID NO: 64382 - DNA, 16 bp, H. sapiens
cagaaaacagaaacta

SEQ ID NO: 64383 - DNA, 16 bp, H. sapiens
cagaaaacagcagcag

SEQ ID NO: 64384 - DNA, 16 bp, H. sapiens
cagaaaacattttaaa

SEQ ID NO: 64385 - DNA, 16 bp, H. sapiens
cagaaaaccaaaaact

SEQ ID NO: 64386 - DNA, 16 bp, H. sapiens
cagaaaaccaaatatt

SEQ ID NO: 64387 - DNA, 16 bp, H. sapiens
cagaaaaccaagtatc

SEQ ID NO: 64388 - DNA, 16 bp, H. sapiens
cagaaaacccaaaata

SEQ ID NO: 64389 - DNA, 16 bp, H. sapiens
cagaaaacccacagag

SEQ ID NO: 64390 - DNA, 16 bp, H. sapiens
cagaaaacccatctca

SEQ ID NO: 64391 - DNA, 16 bp, H. sapiens
cagaaaacctaaaaat

SEQ ID NO: 64392 - DNA, 16 bp, H. sapiens
cagaaaactaaatata

SEQ ID NO: 64393 - DNA, 16 bp, H. sapiens
cagaaaactaagaata

SEQ ID NO: 64394 - DNA, 16 bp, H. sapiens
cagaaaactgaaacca

SEQ ID NO: 64395 - DNA, 16 bp, H. sapiens
cagaaaactgcagcag

SEQ ID NO: 64396 - DNA, 16 bp, H. sapiens
cagaaaactggtacca

SEQ ID NO: 64397 - DNA, 16 bp, H. sapiens
cagaaaacttttagac

SEQ ID NO: 64398 - DNA, 16 bp, H. sapiens
cagaaaactttttttt

SEQ ID NO: 64399 - DNA, 16 bp, H. sapiens
cagaaaagaaaaatgt

SEQ ID NO: 64400 - DNA, 16 bp, H. sapiens
cagaaaagaagaaatg

SEQ ID NO: 64401 - DNA, 16 bp, H. sapiens
cagaaaagacctgaga

SEQ ID NO: 64402 - DNA, 16 bp, H. sapiens
cagaaaagacctgccc

SEQ ID NO: 64403 - DNA, 16 bp, H. sapiens
cagaaaagagaaatga

SEQ ID NO: 64404 - DNA, 16 bp, H. sapiens
cagaaaagatgaaaat

SEQ ID NO: 64405 - DNA, 16 bp, H. sapiens
cagaaaagcaaatgct

SEQ ID NO: 64406 - DNA, 16 bp, H. sapiens
cagaaaagcataaaga

SEQ ID NO: 64407 - DNA, 16 bp, H. sapiens
cagaaaaggaaacatt

SEQ ID NO: 64408 - DNA, 16 bp, H. sapiens
cagaaaaggacaaata

SEQ ID NO: 64409 - DNA, 16 bp, H. sapiens
cagaaaaggccttgga

SEQ ID NO: 64410 - DNA, 16 bp, H. sapiens
cagaaaagggctccca

SEQ ID NO: 64411 - DNA, 16 bp, H. sapiens
cagaaaagtacaaaat

SEQ ID NO: 64412 - DNA, 16 bp, H. sapiens
cagaaaagtagaaaga

SEQ ID NO: 64413 - DNA, 16 bp, H. sapiens
cagaaaagtcactaaa

SEQ ID NO: 64414 - DNA, 16 bp, H. sapiens
cagaaaagttgaaaaa

SEQ ID NO: 64415 - DNA, 16 bp, H. sapiens
cagaaaagtttcagga

SEQ ID NO: 64416 - DNA, 16 bp, H. sapiens
cagaaaataaatttaa

SEQ ID NO: 64417 - DNA, 16 bp, H. sapiens
cagaaaataaatttga

SEQ ID NO: 64418 - DNA, 16 bp, H. sapiens
cagaaaataactcaaa

SEQ ID NO: 64419 - DNA, 16 bp, H. sapiens
cagaaaataagtattt

SEQ ID NO: 64420 - DNA, 16 bp, H. sapiens
cagaaaatacattctt

SEQ ID NO: 64421 - DNA, 16 bp, H. sapiens
cagaaaatatttttta

SEQ ID NO: 64422 - DNA, 16 bp, H. sapiens
cagaaaatattttttt

SEQ ID NO: 64423 - DNA, 16 bp, H. sapiens
cagaaaatcaaagaga

SEQ ID NO: 64424 - DNA, 16 bp, H. sapiens
cagaaaatccaaaata

SEQ ID NO: 64425 - DNA, 16 bp, H. sapiens
cagaaaatccagaaaa

SEQ ID NO: 64426 - DNA, 16 bp, H. sapiens
cagaaaatgaaacacc

SEQ ID NO: 64427 - DNA, 16 bp, H. sapiens
cagaaaatgaaagtga

SEQ ID NO: 64428 - DNA, 16 bp, H. sapiens
cagaaaatgaaattta

SEQ ID NO: 64429 - DNA, 16 bp, H. sapiens
cagaaaatgaattatt

SEQ ID NO: 64430 - DNA, 16 bp, H. sapiens
cagaaaatgagaaaat

SEQ ID NO: 64431 - DNA, 16 bp, H. sapiens
cagaaaatgcaaatga

SEQ ID NO: 64432 - DNA, 16 bp, H. sapiens
cagaaaatgcaaatta

SEQ ID NO: 64433 - DNA, 16 bp, H. sapiens
cagaaaatggaaatga

SEQ ID NO: 64434 - DNA, 16 bp, H. sapiens
cagaaaatggaagaga

SEQ ID NO: 64435 - DNA, 16 bp, H. sapiens
cagaaaatggaagcaa

SEQ ID NO: 64436 - DNA, 16 bp, H. sapiens
cagaaaatggaagtga

SEQ ID NO: 64437 - DNA, 16 bp, H. sapiens
cagaaaatggagaaaa

SEQ ID NO: 64438 - DNA, 16 bp, H. sapiens
cagaaaatgtgatttt

SEQ ID NO: 64439 - DNA, 16 bp, H. sapiens
cagaaaatgtttaaat

SEQ ID NO: 64440 - DNA, 16 bp, H. sapiens
cagaaaattaatgaag

SEQ ID NO: 64441 - DNA, 16 bp, H. sapiens
cagaaaattcattttt

SEQ ID NO: 64442 - DNA, 16 bp, H. sapiens
cagaaaattgaaactg

SEQ ID NO: 64443 - DNA, 16 bp, H. sapiens
cagaaaatttaatatt

SEQ ID NO: 64444 - DNA, 16 bp, H. sapiens
cagaaaattttctttt

SEQ ID NO: 64445 - DNA, 16 bp, H. sapiens
cagaaacaaaaagtca

SEQ ID NO: 64446 - DNA, 16 bp, H. sapiens
cagaaacaaaccctca

SEQ ID NO: 64447 - DNA, 16 bp, H. sapiens
cagaaacaaatggaag

SEQ ID NO: 64448 - DNA, 16 bp, H. sapiens
cagaaacaactggatt

SEQ ID NO: 64449 - DNA, 16 bp, H. sapiens
cagaaacacacagaga

SEQ ID NO: 64450 - DNA, 16 bp, H. sapiens
cagaaacaccctcaca

SEQ ID NO: 64451 - DNA, 16 bp, H. sapiens
cagaaacagaaattca

SEQ ID NO: 64452 - DNA, 16 bp, H. sapiens
cagaaacagaacattg

SEQ ID NO: 64453 - DNA, 16 bp, H. sapiens
cagaaacagaaccaat

SEQ ID NO: 64454 - DNA, 16 bp, H. sapiens
cagaaacagaagctgc

SEQ ID NO: 64455 - DNA, 16 bp, H. sapiens
cagaaacagacacttc

SEQ ID NO: 64456 - DNA, 16 bp, H. sapiens
cagaaacagctggatt

SEQ ID NO: 64457 - DNA, 16 bp, H. sapiens
cagaaacaggaagcaa

SEQ ID NO: 64458 - DNA, 16 bp, H. sapiens
cagaaacaggctgggt

SEQ ID NO: 64459 - DNA, 16 bp, H. sapiens
cagaaacatggatgga

SEQ ID NO: 64460 - DNA, 16 bp, H. sapiens
cagaaacattttagtt

SEQ ID NO: 64461 - DNA, 16 bp, H. sapiens
cagaaaccaaccctgc

SEQ ID NO: 64462 - DNA, 16 bp, H. sapiens
cagaaaccaacctttg

SEQ ID NO: 64463 - DNA, 16 bp, H. sapiens
cagaaaccctacaacc

SEQ ID NO: 64464 - DNA, 16 bp, H. sapiens
cagaaacctgcagttg

SEQ ID NO: 64465 - DNA, 16 bp, H. sapiens
cagaaactatgagata

SEQ ID NO: 64466 - DNA, 16 bp, H. sapiens
cagaaactcaaaagaa

SEQ ID NO: 64467 - DNA, 16 bp, H. sapiens
cagaaactcaaaagga

SEQ ID NO: 64468 - DNA, 16 bp, H. sapiens
cagaaactctggagct

SEQ ID NO: 64469 - DNA, 16 bp, H. sapiens
cagaaactgaaaataa

SEQ ID NO: 64470 - DNA, 16 bp, H. sapiens
cagaaactgaggcaca

SEQ ID NO: 64471 - DNA, 16 bp, H. sapiens
cagaaactgtaaaact

SEQ ID NO: 64472 - DNA, 16 bp, H. sapiens
cagaaacttcattgtg

SEQ ID NO: 64473 - DNA, 16 bp, H. sapiens
cagaaacttctgcaaa

SEQ ID NO: 64474 - DNA, 16 bp, H. sapiens
cagaaacttctgcaga

SEQ ID NO: 64475 - DNA, 16 bp, H. sapiens
cagaaagaaaaatacc

SEQ ID NO: 64476 - DNA, 16 bp, H. sapiens
cagaaagaaaaattga

SEQ ID NO: 64477 - DNA, 16 bp, H. sapiens
cagaaagaaaatgata

SEQ ID NO: 64478 - DNA, 16 bp, H. sapiens
cagaaagaaaccctgt

SEQ ID NO: 64479 - DNA, 16 bp, H. sapiens
cagaaagaaagcaggt

SEQ ID NO: 64480 - DNA, 16 bp, H. sapiens
cagaaagaaatccaca

SEQ ID NO: 64481 - DNA, 16 bp, H. sapiens
cagaaagaagaaaatc

SEQ ID NO: 64482 - DNA, 16 bp, H. sapiens
cagaaagaatcatcct

SEQ ID NO: 64483 - DNA, 16 bp, H. sapiens
cagaaagaattttaaa

SEQ ID NO: 64484 - DNA, 16 bp, H. sapiens
cagaaagacaaataat

SEQ ID NO: 64485 - DNA, 16 bp, H. sapiens
cagaaagacaaatact

SEQ ID NO: 64486 - DNA, 16 bp, H. sapiens
cagaaagacaaatatc

SEQ ID NO: 64487 - DNA, 16 bp, H. sapiens
cagaaagacactgact

SEQ ID NO: 64488 - DNA, 16 bp, H. sapiens
cagaaagacagacaga

SEQ ID NO: 64489 - DNA, 16 bp, H. sapiens
cagaaagacagagaca

SEQ ID NO: 64490 - DNA, 16 bp, H. sapiens
cagaaagagaaagtca

SEQ ID NO: 64491 - DNA, 16 bp, H. sapiens
cagaaagaggaaataa

SEQ ID NO: 64492 - DNA, 16 bp, H. sapiens
cagaaagagtgtttca

SEQ ID NO: 64493 - DNA, 16 bp, H. sapiens
cagaaagataaaaatt

SEQ ID NO: 64494 - DNA, 16 bp, H. sapiens
cagaaagataaatatc

SEQ ID NO: 64495 - DNA, 16 bp, H. sapiens
cagaaagataacagga

SEQ ID NO: 64496 - DNA, 16 bp, H. sapiens
cagaaagatcaaagac

SEQ ID NO: 64497 - DNA, 16 bp, H. sapiens
cagaaagatgaggaaa

SEQ ID NO: 64498 - DNA, 16 bp, H. sapiens
cagaaagatttggaaa

SEQ ID NO: 64499 - DNA, 16 bp, H. sapiens
cagaaagcaaagggga

SEQ ID NO: 64500 - DNA, 16 bp, H. sapiens
cagaaagcaaggaagt

SEQ ID NO: 64501 - DNA, 16 bp, H. sapiens
cagaaagccaaatact

SEQ ID NO: 64502 - DNA, 16 bp, H. sapiens
cagaaagccagtcttc

SEQ ID NO: 64503 - DNA, 16 bp, H. sapiens
cagaaaggaaaaagta

SEQ ID NO: 64504 - DNA, 16 bp, H. sapiens
cagaaaggagcagaga

SEQ ID NO: 64505 - DNA, 16 bp, H. sapiens
cagaaaggagctgccc

SEQ ID NO: 64506 - DNA, 16 bp, H. sapiens
cagaaaggtgaagaaa

SEQ ID NO: 64507 - DNA, 16 bp, H. sapiens
cagaaagtaaagaagt

SEQ ID NO: 64508 - DNA, 16 bp, H. sapiens
cagaaagtctgaaaga

SEQ ID NO: 64509 - DNA, 16 bp, H. sapiens
cagaaagtctttgaat

SEQ ID NO: 64510 - DNA, 16 bp, H. sapiens
cagaaagtgaaaacaa

SEQ ID NO: 64511 - DNA, 16 bp, H. sapiens
cagaaagtgtgtgtgt

SEQ ID NO: 64512 - DNA, 16 bp, H. sapiens
cagaaagttctgttgg

SEQ ID NO: 64513 - DNA, 16 bp, H. sapiens
cagaaataaaaaagtt

SEQ ID NO: 64514 - DNA, 16 bp, H. sapiens
cagaaataaaaaggat

SEQ ID NO: 64515 - DNA, 16 bp, H. sapiens
cagaaataaaaccaca

SEQ ID NO: 64516 - DNA, 16 bp, H. sapiens
cagaaataaaatttga

SEQ ID NO: 64517 - DNA, 16 bp, H. sapiens
cagaaataaagatctt

SEQ ID NO: 64518 - DNA, 16 bp, H. sapiens
cagaaataaagcagca

SEQ ID NO: 64519 - DNA, 16 bp, H. sapiens
cagaaataaagctgaa

SEQ ID NO: 64520 - DNA, 16 bp, H. sapiens
cagaaataaatatatt

SEQ ID NO: 64521 - DNA, 16 bp, H. sapiens
cagaaataaatccaaa

SEQ ID NO: 64522 - DNA, 16 bp, H. sapiens
cagaaataaatcctca

SEQ ID NO: 64523 - DNA, 16 bp, H. sapiens
cagaaataaatctatg

SEQ ID NO: 64524 - DNA, 16 bp, H. sapiens
cagaaataaatgaaga

SEQ ID NO: 64525 - DNA, 16 bp, H. sapiens
cagaaataaatgcaca

SEQ ID NO: 64526 - DNA, 16 bp, H. sapiens
cagaaataaattaaat

SEQ ID NO: 64527 - DNA, 16 bp, H. sapiens
cagaaataagatcaca

SEQ ID NO: 64528 - DNA, 16 bp, H. sapiens
cagaaataagtgaaat

SEQ ID NO: 64529 - DNA, 16 bp, H. sapiens
cagaaataatacttta

SEQ ID NO: 64530 - DNA, 16 bp, H. sapiens
cagaaataatgacaca

SEQ ID NO: 64531 - DNA, 16 bp, H. sapiens
cagaaatacacccaca

SEQ ID NO: 64532 - DNA, 16 bp, H. sapiens
cagaaatacatgaaat

SEQ ID NO: 64533 - DNA, 16 bp, H. sapiens
cagaaataccatttga

SEQ ID NO: 64534 - DNA, 16 bp, H. sapiens
cagaaatagaaaacta

SEQ ID NO: 64535 - DNA, 16 bp, H. sapiens
cagaaatagaaaatgt

SEQ ID NO: 64536 - DNA, 16 bp, H. sapiens
cagaaatagaagaaat

SEQ ID NO: 64537 - DNA, 16 bp, H. sapiens
cagaaatagatgaaat

SEQ ID NO: 64538 - DNA, 16 bp, H. sapiens
cagaaatataagaaat

SEQ ID NO: 64539 - DNA, 16 bp, H. sapiens
cagaaatatattctct

SEQ ID NO: 64540 - DNA, 16 bp, H. sapiens
cagaaatcaacaaaat

SEQ ID NO: 64541 - DNA, 16 bp, H. sapiens
cagaaatcaagaaatt

SEQ ID NO: 64542 - DNA, 16 bp, H. sapiens
cagaaatcaagatgtt

SEQ ID NO: 64543 - DNA, 16 bp, H. sapiens
cagaaatcacaacaaa

SEQ ID NO: 64544 - DNA, 16 bp, H. sapiens
cagaaatcacacctaa

SEQ ID NO: 64545 - DNA, 16 bp, H. sapiens
cagaaatcacccatct

SEQ ID NO: 64546 - DNA, 16 bp, H. sapiens
cagaaatcacctgcct

SEQ ID NO: 64547 - DNA, 16 bp, H. sapiens
cagaaatcagccatct

SEQ ID NO: 64548 - DNA, 16 bp, H. sapiens
cagaaatcagtagcat

SEQ ID NO: 64549 - DNA, 16 bp, H. sapiens
cagaaatccaagccag

SEQ ID NO: 64550 - DNA, 16 bp, H. sapiens
cagaaatctatttctc

SEQ ID NO: 64551 - DNA, 16 bp, H. sapiens
cagaaatctgaaaaat

SEQ ID NO: 64552 - DNA, 16 bp, H. sapiens
cagaaatctgaatttt

SEQ ID NO: 64553 - DNA, 16 bp, H. sapiens
cagaaatctgtgtttt

SEQ ID NO: 64554 - DNA, 16 bp, H. sapiens
cagaaatcttggaact

SEQ ID NO: 64555 - DNA, 16 bp, H. sapiens
cagaaatgaaaaaggg

SEQ ID NO: 64556 - DNA, 16 bp, H. sapiens
cagaaatgaaaaagta

SEQ ID NO: 64557 - DNA, 16 bp, H. sapiens
cagaaatgaaaagaag

SEQ ID NO: 64558 - DNA, 16 bp, H. sapiens
cagaaatgaaagatga

SEQ ID NO: 64559 - DNA, 16 bp, H. sapiens
cagaaatgaagaagaa

SEQ ID NO: 64560 - DNA, 16 bp, H. sapiens
cagaaatgaagaagga

SEQ ID NO: 64561 - DNA, 16 bp, H. sapiens
cagaaatgaagaagtt

SEQ ID NO: 64562 - DNA, 16 bp, H. sapiens
cagaaatgaagaccca

SEQ ID NO: 64563 - DNA, 16 bp, H. sapiens
cagaaatgaatccaca

SEQ ID NO: 64564 - DNA, 16 bp, H. sapiens
cagaaatgaatgaaaa

SEQ ID NO: 64565 - DNA, 16 bp, H. sapiens
cagaaatgacaaagaa

SEQ ID NO: 64566 - DNA, 16 bp, H. sapiens
cagaaatgagaaagaa

SEQ ID NO: 64567 - DNA, 16 bp, H. sapiens
cagaaatgctccaaaa

SEQ ID NO: 64568 - DNA, 16 bp, H. sapiens
cagaaatgtattctct

SEQ ID NO: 64569 - DNA, 16 bp, H. sapiens
cagaaatgtatttatt

SEQ ID NO: 64570 - DNA, 16 bp, H. sapiens
cagaaatgtctccaga

SEQ ID NO: 64571 - DNA, 16 bp, H. sapiens
cagaaatgttaagtaa

SEQ ID NO: 64572 - DNA, 16 bp, H. sapiens
cagaaatgtttaaaaa

SEQ ID NO: 64573 - DNA, 16 bp, H. sapiens
cagaaattataaagaa

SEQ ID NO: 64574 - DNA, 16 bp, H. sapiens
cagaaattcatttctt

SEQ ID NO: 64575 - DNA, 16 bp, H. sapiens
cagaaatttaaaataa

SEQ ID NO: 64576 - DNA, 16 bp, H. sapiens
cagaaatttattttct

SEQ ID NO: 64577 - DNA, 16 bp, H. sapiens
cagaaatttgcaaaag

SEQ ID NO: 64578 - DNA, 16 bp, H. sapiens
cagaaattttaaaaat

SEQ ID NO: 64579 - DNA, 16 bp, H. sapiens
cagaaattttcttttt

SEQ ID NO: 64580 - DNA, 16 bp, H. sapiens
cagaacaagaacctgt

SEQ ID NO: 64581 - DNA, 16 bp, H. sapiens
cagaacaaggaaaatt

SEQ ID NO: 64582 - DNA, 16 bp, H. sapiens
cagaacaataacaagt

SEQ ID NO: 64583 - DNA, 16 bp, H. sapiens
cagaacaatgagaaaa

SEQ ID NO: 64584 - DNA, 16 bp, H. sapiens
cagaacacagaggatt

SEQ ID NO: 64585 - DNA, 16 bp, H. sapiens
cagaacagaggccaca

SEQ ID NO: 64586 - DNA, 16 bp, H. sapiens
cagaacagcagcatca

SEQ ID NO: 64587 - DNA, 16 bp, H. sapiens
cagaacaggacagaga

SEQ ID NO: 64588 - DNA, 16 bp, H. sapiens
cagaacaggactctgt

SEQ ID NO: 64589 - DNA, 16 bp, H. sapiens
cagaacagtgagccaa

SEQ ID NO: 64590 - DNA, 16 bp, H. sapiens
cagaacatacattctt

SEQ ID NO: 64591 - DNA, 16 bp, H. sapiens
cagaacattccatcca

SEQ ID NO: 64592 - DNA, 16 bp, H. sapiens
cagaacattttcatta

SEQ ID NO: 64593 - DNA, 16 bp, H. sapiens
cagaacattttttttt

SEQ ID NO: 64594 - DNA, 16 bp, H. sapiens
cagaaccaaataaaag

SEQ ID NO: 64595 - DNA, 16 bp, H. sapiens
cagaaccaggaaggaa

SEQ ID NO: 64596 - DNA, 16 bp, H. sapiens
cagaaccagtccatgg

SEQ ID NO: 64597 - DNA, 16 bp, H. sapiens
cagaaccatgagccaa

SEQ ID NO: 64598 - DNA, 16 bp, H. sapiens
cagaacgagaccctgt

SEQ ID NO: 64599 - DNA, 16 bp, H. sapiens
cagaacgtgcaggttt

SEQ ID NO: 64600 - DNA, 16 bp, H. sapiens
cagaactaagtgaaat

SEQ ID NO: 64601 - DNA, 16 bp, H. sapiens
cagaactagaaaaagc

SEQ ID NO: 64602 - DNA, 16 bp, H. sapiens
cagaactagaagaaaa

SEQ ID NO: 64603 - DNA, 16 bp, H. sapiens
cagaactccccacccc

SEQ ID NO: 64604 - DNA, 17 bp, H. sapiens
cagaactcgcgctggcc

SEQ ID NO: 64605 - DNA, 16 bp, H. sapiens
cagaactctccatccc

SEQ ID NO: 64606 - DNA, 16 bp, H. sapiens
cagaactcttcatctt

SEQ ID NO: 64607 - DNA, 16 bp, H. sapiens
cagaactgaaggacat

SEQ ID NO: 64608 - DNA, 16 bp, H. sapiens
cagaactgaaggagat

SEQ ID NO: 64609 - DNA, 16 bp, H. sapiens
cagaactgaaggagct

SEQ ID NO: 64610 - DNA, 16 bp, H. sapiens
cagaactgaatgaaat

SEQ ID NO: 64611 - DNA, 16 bp, H. sapiens
cagaactgcagctgag

SEQ ID NO: 64612 - DNA, 16 bp, H. sapiens
cagaactggaaaaaaa

SEQ ID NO: 64613 - DNA, 16 bp, H. sapiens
cagaactggaagaaat

SEQ ID NO: 64614 - DNA, 16 bp, H. sapiens
cagaactgggagagaa

SEQ ID NO: 64615 - DNA, 16 bp, H. sapiens
cagaactggttgagcc

SEQ ID NO: 64616 - DNA, 16 bp, H. sapiens
cagaactgtgaaaagt

SEQ ID NO: 64617 - DNA, 16 bp, H. sapiens
cagaactgtgacccaa

SEQ ID NO: 64618 - DNA, 16 bp, H. sapiens
cagaactgtgagacaa

SEQ ID NO: 64619 - DNA, 16 bp, H. sapiens
cagaactgtgataaat

SEQ ID NO: 64620 - DNA, 16 bp, H. sapiens
cagaactgtggtgcca

SEQ ID NO: 64621 - DNA, 16 bp, H. sapiens
cagaactgttagccaa

SEQ ID NO: 64622 - DNA, 16 bp, H. sapiens
cagaacttaaaatgaa

SEQ ID NO: 64623 - DNA, 16 bp, H. sapiens
cagaacttaaagattt

SEQ ID NO: 64624 - DNA, 16 bp, H. sapiens
cagaacttcaaaatac

SEQ ID NO: 64625 - DNA, 16 bp, H. sapiens
cagaacttcaaatact

SEQ ID NO: 64626 - DNA, 16 bp, H. sapiens
cagaacttctttcaaa

SEQ ID NO: 64627 - DNA, 16 bp, H. sapiens
cagaactttctcatct

SEQ ID NO: 64628 - DNA, 16 bp, H. sapiens
cagaactttgggaggc

SEQ ID NO: 64629 - DNA, 16 bp, H. sapiens
cagaagaaactgaaat

SEQ ID NO: 64630 - DNA, 16 bp, H. sapiens
cagaagaaagaaactg

SEQ ID NO: 64631 - DNA, 16 bp, H. sapiens
cagaagaaagaattaa

SEQ ID NO: 64632 - DNA, 16 bp, H. sapiens
cagaagaaagcattgt

SEQ ID NO: 64633 - DNA, 16 bp, H. sapiens
cagaagaaagtagaaa

SEQ ID NO: 64634 - DNA, 16 bp, H. sapiens
cagaagaaagtcaaaa

SEQ ID NO: 64635 - DNA, 16 bp, H. sapiens
cagaagaaatatttta

SEQ ID NO: 64636 - DNA, 16 bp, H. sapiens
cagaagaaatggaaaa

SEQ ID NO: 64637 - DNA, 16 bp, H. sapiens
cagaagaaatggaaag

SEQ ID NO: 64638 - DNA, 16 bp, H. sapiens
cagaagaaatggataa

SEQ ID NO: 64639 - DNA, 16 bp, H. sapiens
cagaagaaatgtctaa

SEQ ID NO: 64640 - DNA, 16 bp, H. sapiens
cagaagaaattaccag

SEQ ID NO: 64641 - DNA, 16 bp, H. sapiens
cagaagaacagatgaa

SEQ ID NO: 64642 - DNA, 16 bp, H. sapiens
cagaagaacataaatt

SEQ ID NO: 64643 - DNA, 16 bp, H. sapiens
cagaagaaccacccag

SEQ ID NO: 64644 - DNA, 16 bp, H. sapiens
cagaagaagaaactga

SEQ ID NO: 64645 - DNA, 16 bp, H. sapiens
cagaagaagacacaag

SEQ ID NO: 64646 - DNA, 16 bp, H. sapiens
cagaagaagacagcaa

SEQ ID NO: 64647 - DNA, 16 bp, H. sapiens
cagaagaagataggaa

SEQ ID NO: 64648 - DNA, 16 bp, H. sapiens
cagaagaagccaggaa

SEQ ID NO: 64649 - DNA, 16 bp, H. sapiens
cagaagaaggagcagg

SEQ ID NO: 64650 - DNA, 16 bp, H. sapiens
cagaagaaggaggaat

SEQ ID NO: 64651 - DNA, 16 bp, H. sapiens
cagaagaaggcatcct

SEQ ID NO: 64652 - DNA, 16 bp, H. sapiens
cagaagaaggtggaat

SEQ ID NO: 64653 - DNA, 16 bp, H. sapiens
cagaagaatcacctgg

SEQ ID NO: 64654 - DNA, 16 bp, H. sapiens
cagaagaatgaatttg

SEQ ID NO: 64655 - DNA, 16 bp, H. sapiens
cagaagaattgcttga

SEQ ID NO: 64656 - DNA, 16 bp, H. sapiens
cagaagaatttaaaat

SEQ ID NO: 64657 - DNA, 16 bp, H. sapiens
cagaagaatttttctt

SEQ ID NO: 64658 - DNA, 16 bp, H. sapiens
cagaagacaagaagta

SEQ ID NO: 64659 - DNA, 16 bp, H. sapiens
cagaagacaaggagga

SEQ ID NO: 64660 - DNA, 16 bp, H. sapiens
cagaagacaatgaaat

SEQ ID NO: 64661 - DNA, 16 bp, H. sapiens
cagaagacagaaataa

SEQ ID NO: 64662 - DNA, 16 bp, H. sapiens
cagaagacagtgattt

SEQ ID NO: 64663 - DNA, 16 bp, H. sapiens
cagaagagaaaactaa

SEQ ID NO: 64664 - DNA, 16 bp, H. sapiens
cagaagagaaaactga

SEQ ID NO: 64665 - DNA, 16 bp, H. sapiens
cagaagagaaaataat

SEQ ID NO: 64666 - DNA, 16 bp, H. sapiens
cagaagagaaagaatc

SEQ ID NO: 64667 - DNA, 16 bp, H. sapiens
cagaagagagccctca

SEQ ID NO: 64668 - DNA, 16 bp, H. sapiens
cagaagagaggcctga

SEQ ID NO: 64669 - DNA, 17 bp, H. sapiens
cagaagagagtggggcc

SEQ ID NO: 64670 - DNA, 16 bp, H. sapiens
cagaagagatttgggg

SEQ ID NO: 64671 - DNA, 16 bp, H. sapiens
cagaagaggaaaatga

SEQ ID NO: 64672 - DNA, 16 bp, H. sapiens
cagaagaggaaagtgg

SEQ ID NO: 64673 - DNA, 16 bp, H. sapiens
cagaagaggaaataga

SEQ ID NO: 64674 - DNA, 16 bp, H. sapiens
cagaagaggaaggcag

SEQ ID NO: 64675 - DNA, 16 bp, H. sapiens
cagaagaggaattgct

SEQ ID NO: 64676 - DNA, 16 bp, H. sapiens
cagaagaggacactga

SEQ ID NO: 64677 - DNA, 16 bp, H. sapiens
cagaagaggagaaggc

SEQ ID NO: 64678 - DNA, 16 bp, H. sapiens
cagaagaggagcctga

SEQ ID NO: 64679 - DNA, 16 bp, H. sapiens
cagaagatacaaataa

SEQ ID NO: 64680 - DNA, 16 bp, H. sapiens
cagaagatctagctaa

SEQ ID NO: 64681 - DNA, 16 bp, H. sapiens
cagaagatctggctaa

SEQ ID NO: 64682 - DNA, 16 bp, H. sapiens
cagaagatgaaggaga

SEQ ID NO: 64683 - DNA, 25 bp, H. sapiens
cagaagatgggtgatttctgcattt

SEQ ID NO: 64684 - DNA, 16 bp, H. sapiens
cagaagattgaagctg

SEQ ID NO: 64685 - DNA, 16 bp, H. sapiens
cagaagcacagagagg

SEQ ID NO: 64686 - DNA, 16 bp, H. sapiens
cagaagcagaaaccac

SEQ ID NO: 64687 - DNA, 16 bp, H. sapiens
cagaagcagactctga

SEQ ID NO: 64688 - DNA, 16 bp, H. sapiens
cagaagcagaggctga

SEQ ID NO: 64689 - DNA, 16 bp, H. sapiens
cagaagcagatgagga

SEQ ID NO: 64690 - DNA, 16 bp, H. sapiens
cagaagcagatgctga

SEQ ID NO: 64691 - DNA, 16 bp, H. sapiens
cagaagcagatgctgg

SEQ ID NO: 64692 - DNA, 16 bp, H. sapiens
cagaagcagctttcca

SEQ ID NO: 64693 - DNA, 16 bp, H. sapiens
cagaagcaggacaggg

SEQ ID NO: 64694 - DNA, 16 bp, H. sapiens
cagaagcaggagcaag

SEQ ID NO: 64695 - DNA, 16 bp, H. sapiens
cagaagcaggttgttc

SEQ ID NO: 64696 - DNA, 16 bp, H. sapiens
cagaagcagtggctca

SEQ ID NO: 64697 - DNA, 16 bp, H. sapiens
cagaagcattttagtt

SEQ ID NO: 64698 - DNA, 16 bp, H. sapiens
cagaagccacaggaaa

SEQ ID NO: 64699 - DNA, 16 bp, H. sapiens
cagaagccagaaacag

SEQ ID NO: 64700 - DNA, 16 bp, H. sapiens
cagaagccaggaagag

SEQ ID NO: 64701 - DNA, 16 bp, H. sapiens
cagaagccaggagagg

SEQ ID NO: 64702 - DNA, 16 bp, H. sapiens
cagaagcccagccagc

SEQ ID NO: 64703 - DNA, 20 bp, H. sapiens
cagaagcccctctcaggttt

SEQ ID NO: 64704 - DNA, 16 bp, H. sapiens
cagaagcccgccacca

SEQ ID NO: 64705 - DNA, 16 bp, H. sapiens
cagaagcctaggagga

SEQ ID NO: 64706 - DNA, 16 bp, H. sapiens
cagaagcctcaggaga

SEQ ID NO: 64707 - DNA, 16 bp, H. sapiens
cagaagctaagagaaa

SEQ ID NO: 64708 - DNA, 16 bp, H. sapiens
cagaagctcagagaag

SEQ ID NO: 64709 - DNA, 16 bp, H. sapiens
cagaagctcttagttt

SEQ ID NO: 64710 - DNA, 16 bp, H. sapiens
cagaagctcttgcaag

SEQ ID NO: 64711 - DNA, 16 bp, H. sapiens
cagaagctctttaatt

SEQ ID NO: 64712 - DNA, 16 bp, H. sapiens
cagaagctgatgccag

SEQ ID NO: 64713 - DNA, 16 bp, H. sapiens
cagaagctgcagaaca

SEQ ID NO: 64714 - DNA, 16 bp, H. sapiens
cagaagctgcagcaag

SEQ ID NO: 64715 - DNA, 16 bp, H. sapiens
cagaagctggaagaaa

SEQ ID NO: 64716 - DNA, 16 bp, H. sapiens
cagaagctggaagaag

SEQ ID NO: 64717 - DNA, 16 bp, H. sapiens
cagaagctggaggaag

SEQ ID NO: 64718 - DNA, 16 bp, H. sapiens
cagaagctggaggagg

SEQ ID NO: 64719 - DNA, 16 bp, H. sapiens
cagaagctgggaagga

SEQ ID NO: 64720 - DNA, 50 bp, H. sapiens
cagaagctgtttgcctttcagtgggaagatccggagtcaggtgtcactac

SEQ ID NO: 64721 - DNA, 16 bp, H. sapiens
cagaagctttttgttt

SEQ ID NO: 64722 - DNA, 16 bp, H. sapiens
cagaaggaaaataagg

SEQ ID NO: 64723 - DNA, 16 bp, H. sapiens
cagaaggaaagaaata

SEQ ID NO: 64724 - DNA, 16 bp, H. sapiens
cagaaggaacaaattc

SEQ ID NO: 64725 - DNA, 16 bp, H. sapiens
cagaaggaacacagcc

SEQ ID NO: 64726 - DNA, 16 bp, H. sapiens
cagaaggaagaaactc

SEQ ID NO: 64727 - DNA, 16 bp, H. sapiens
cagaaggagccaaatc

SEQ ID NO: 64728 - DNA, 16 bp, H. sapiens
cagaaggagtctttca

SEQ ID NO: 64729 - DNA, 16 bp, H. sapiens
cagaaggatagcttga

SEQ ID NO: 64730 - DNA, 16 bp, H. sapiens
cagaaggatcgtttga

SEQ ID NO: 64731 - DNA, 16 bp, H. sapiens
cagaaggcagaagtga

SEQ ID NO: 64732 - DNA, 16 bp, H. sapiens
cagaaggccgagtccc

SEQ ID NO: 64733 - DNA, 16 bp, H. sapiens
cagaaggcgaagggga

SEQ ID NO: 64734 - DNA, 16 bp, H. sapiens
cagaaggctgagctgg

SEQ ID NO: 64735 - DNA, 16 bp, H. sapiens
cagaaggctgaggcag

SEQ ID NO: 64736 - DNA, 16 bp, H. sapiens
cagaaggctgaggctg

SEQ ID NO: 64737 - DNA, 16 bp, H. sapiens
cagaagggaaaaataa

SEQ ID NO: 64738 - DNA, 16 bp, H. sapiens
cagaagggactttcct

SEQ ID NO: 64739 - DNA, 16 bp, H. sapiens
cagaagggagaaagtg

SEQ ID NO: 64740 - DNA, 16 bp, H. sapiens
cagaagggcaagagaa

SEQ ID NO: 64741 - DNA, 16 bp, H. sapiens
cagaaggggcagggct

SEQ ID NO: 64742 - DNA, 16 bp, H. sapiens
cagaaggtgaaaagca

SEQ ID NO: 64743 - DNA, 16 bp, H. sapiens
cagaaggtgagtgatt

SEQ ID NO: 64744 - DNA, 16 bp, H. sapiens
cagaaggtggaagagg

SEQ ID NO: 64745 - DNA, 16 bp, H. sapiens
cagaaggtggagctca

SEQ ID NO: 64746 - DNA, 16 bp, H. sapiens
cagaaggtggagggtg

SEQ ID NO: 64747 - DNA, 16 bp, H. sapiens
cagaaggttttcagtt

SEQ ID NO: 64748 - DNA, 16 bp, H. sapiens
cagaaggtttttagtt

SEQ ID NO: 64749 - DNA, 16 bp, H. sapiens
cagaagtaacaccaca

SEQ ID NO: 64750 - DNA, 16 bp, H. sapiens
cagaagtaatcaagtt

SEQ ID NO: 64751 - DNA, 16 bp, H. sapiens
cagaagtacaaagagg

SEQ ID NO: 64752 - DNA, 16 bp, H. sapiens
cagaagtagaagaaaa

SEQ ID NO: 64753 - DNA, 16 bp, H. sapiens
cagaagtatgattgga

SEQ ID NO: 64754 - DNA, 16 bp, H. sapiens
cagaagtattttattt

SEQ ID NO: 64755 - DNA, 16 bp, H. sapiens
cagaagtcacagtgag

SEQ ID NO: 64756 - DNA, 16 bp, H. sapiens
cagaagtcagcaaact

SEQ ID NO: 64757 - DNA, 16 bp, H. sapiens
cagaagtctgttgcag

SEQ ID NO: 64758 - DNA, 16 bp, H. sapiens
cagaagtgaagataaa

SEQ ID NO: 64759 - DNA, 16 bp, H. sapiens
cagaagtggaatttct

SEQ ID NO: 64760 - DNA, 16 bp, H. sapiens
cagaagtgggaggatc

SEQ ID NO: 64761 - DNA, 16 bp, H. sapiens
cagaagtggtggcaca

SEQ ID NO: 64762 - DNA, 16 bp, H. sapiens
cagaagtgttctggaa

SEQ ID NO: 64763 - DNA, 16 bp, H. sapiens
cagaagttcaaaatca

SEQ ID NO: 64764 - DNA, 16 bp, H. sapiens
cagaagttcaaggcca

SEQ ID NO: 64765 - DNA, 16 bp, H. sapiens
cagaagttcaaggctg

SEQ ID NO: 64766 - DNA, 16 bp, H. sapiens
cagaagttcgaggctg

SEQ ID NO: 64767 - DNA, 16 bp, H. sapiens
cagaagttgcagcgag

SEQ ID NO: 64768 - DNA, 16 bp, H. sapiens
cagaagttggaacagt

SEQ ID NO: 64769 - DNA, 16 bp, H. sapiens
cagaagttttcatttt

SEQ ID NO: 64770 - DNA, 16 bp, H. sapiens
cagaataaagagtcca

SEQ ID NO: 64771 - DNA, 16 bp, H. sapiens
cagaataaatttctaa

SEQ ID NO: 64772 - DNA, 16 bp, H. sapiens
cagaataagacaggaa

SEQ ID NO: 64773 - DNA, 16 bp, H. sapiens
cagaatacacgttctt

SEQ ID NO: 64774 - DNA, 16 bp, H. sapiens
cagaatacatagagaa

SEQ ID NO: 64775 - DNA, 16 bp, H. sapiens
cagaatacattttttt

SEQ ID NO: 64776 - DNA, 16 bp, H. sapiens
cagaataccagaggct

SEQ ID NO: 64777 - DNA, 16 bp, H. sapiens
cagaatacctgagagt

SEQ ID NO: 64778 - DNA, 16 bp, H. sapiens
cagaatactattcagc

SEQ ID NO: 64779 - DNA, 16 bp, H. sapiens
cagaatagggaactca

SEQ ID NO: 64780 - DNA, 16 bp, H. sapiens
cagaataggttcagag

SEQ ID NO: 64781 - DNA, 16 bp, H. sapiens
cagaatagtatttcct

SEQ ID NO: 64782 - DNA, 16 bp, H. sapiens
cagaatagtttcagaa

SEQ ID NO: 64783 - DNA, 16 bp, H. sapiens
cagaatatacatactt

SEQ ID NO: 64784 - DNA, 16 bp, H. sapiens
cagaatatatagagaa

SEQ ID NO: 64785 - DNA, 16 bp, H. sapiens
cagaatatgcattatt

SEQ ID NO: 64786 - DNA, 16 bp, H. sapiens
cagaatattatttaaa

SEQ ID NO: 64787 - DNA, 16 bp, H. sapiens
cagaatatttctatca

SEQ ID NO: 64788 - DNA, 16 bp, H. sapiens
cagaatcaaccaagct

SEQ ID NO: 64789 - DNA, 16 bp, H. sapiens
cagaatcaccaggagg

SEQ ID NO: 64790 - DNA, 16 bp, H. sapiens
cagaatcacctgggaa

SEQ ID NO: 64791 - DNA, 16 bp, H. sapiens
cagaatcacttgaacc

SEQ ID NO: 64792 - DNA, 16 bp, H. sapiens
cagaatcagaaaaaac

SEQ ID NO: 64793 - DNA, 16 bp, H. sapiens
cagaatcatctgtgaa

SEQ ID NO: 64794 - DNA, 16 bp, H. sapiens
cagaatctaaaatgaa

SEQ ID NO: 64795 - DNA, 16 bp, H. sapiens
cagaatctacaaaaaa

SEQ ID NO: 64796 - DNA, 16 bp, H. sapiens
cagaatctctggggca

SEQ ID NO: 64797 - DNA, 16 bp, H. sapiens
cagaatctgaatttta

SEQ ID NO: 64798 - DNA, 16 bp, H. sapiens
cagaatctgcatctta

SEQ ID NO: 64799 - DNA, 16 bp, H. sapiens
cagaatcttggctcac

SEQ ID NO: 64800 - DNA, 16 bp, H. sapiens
cagaatctttttcttt

SEQ ID NO: 64801 - DNA, 16 bp, H. sapiens
cagaatgaaaatgaaa

SEQ ID NO: 64802 - DNA, 16 bp, H. sapiens
cagaatgaagaacaaa

SEQ ID NO: 64803 - DNA, 16 bp, H. sapiens
cagaatgaagaataaa

SEQ ID NO: 64804 - DNA, 16 bp, H. sapiens
cagaatgaaggaaaaa

SEQ ID NO: 64805 - DNA, 16 bp, H. sapiens
cagaatgaagggaaaa

SEQ ID NO: 64806 - DNA, 16 bp, H. sapiens
cagaatgagagaatat

SEQ ID NO: 64807 - DNA, 16 bp, H. sapiens
cagaatgagagccaag

SEQ ID NO: 64808 - DNA, 16 bp, H. sapiens
cagaatgatgttggcc

SEQ ID NO: 64809 - DNA, 16 bp, H. sapiens
cagaatgcaagagctg

SEQ ID NO: 64810 - DNA, 16 bp, H. sapiens
cagaatgcttctgagt

SEQ ID NO: 64811 - DNA, 16 bp, H. sapiens
cagaatgctttttaaa

SEQ ID NO: 64812 - DNA, 16 bp, H. sapiens
cagaatggaagaaaat

SEQ ID NO: 64813 - DNA, 16 bp, H. sapiens
cagaatggaagaagat

SEQ ID NO: 64814 - DNA, 16 bp, H. sapiens
cagaatggaggttcct

SEQ ID NO: 64815 - DNA, 16 bp, H. sapiens
cagaatgggaaaatat

SEQ ID NO: 64816 - DNA, 16 bp, H. sapiens
cagaatgggagaaata

SEQ ID NO: 64817 - DNA, 16 bp, H. sapiens
cagaatgggagagaat

SEQ ID NO: 64818 - DNA, 16 bp, H. sapiens
cagaatgggaggcagg

SEQ ID NO: 64819 - DNA, 16 bp, H. sapiens
cagaatggtagatcca

SEQ ID NO: 64820 - DNA, 16 bp, H. sapiens
cagaatggttgtatgg

SEQ ID NO: 64821 - DNA, 16 bp, H. sapiens
cagaatgtgacttcat

SEQ ID NO: 64822 - DNA, 16 bp, H. sapiens
cagaatgtgggacatt

SEQ ID NO: 64823 - DNA, 16 bp, H. sapiens
cagaattaaaagaact

SEQ ID NO: 64824 - DNA, 16 bp, H. sapiens
cagaattaaagacaaa

SEQ ID NO: 64825 - DNA, 16 bp, H. sapiens
cagaattaatcaagca

SEQ ID NO: 64826 - DNA, 16 bp, H. sapiens
cagaattacaggagtt

SEQ ID NO: 64827 - DNA, 16 bp, H. sapiens
cagaattagaaaacaa

SEQ ID NO: 64828 - DNA, 16 bp, H. sapiens
cagaattagaagaaaa

SEQ ID NO: 64829 - DNA, 16 bp, H. sapiens
cagaattagagaaaac

SEQ ID NO: 64830 - DNA, 16 bp, H. sapiens
cagaattaggaaaaaa

SEQ ID NO: 64831 - DNA, 16 bp, H. sapiens
cagaattcaaaatcaa

SEQ ID NO: 64832 - DNA, 16 bp, H. sapiens
cagaattcaaacccag

SEQ ID NO: 64833 - DNA, 16 bp, H. sapiens
cagaattcccttcttt

SEQ ID NO: 64834 - DNA, 16 bp, H. sapiens
cagaattgaagaaaat

SEQ ID NO: 64835 - DNA, 16 bp, H. sapiens
cagaattgagtagttg

SEQ ID NO: 64836 - DNA, 16 bp, H. sapiens
cagaattgcctgaacc

SEQ ID NO: 64837 - DNA, 16 bp, H. sapiens
cagaattggaaaaaat

SEQ ID NO: 64838 - DNA, 16 bp, H. sapiens
cagaattggaaaagac

SEQ ID NO: 64839 - DNA, 16 bp, H. sapiens
cagaattggaaataac

SEQ ID NO: 64840 - DNA, 16 bp, H. sapiens
cagaattggaagaaaa

SEQ ID NO: 64841 - DNA, 16 bp, H. sapiens
cagaattgtgaaaaat

SEQ ID NO: 64842 - DNA, 16 bp, H. sapiens
cagaattgtgaggaaa

SEQ ID NO: 64843 - DNA, 16 bp, H. sapiens
cagaattgttttctta

SEQ ID NO: 64844 - DNA, 16 bp, H. sapiens
cagaatttacaaaaaa

SEQ ID NO: 64845 - DNA, 16 bp, H. sapiens
cagaatttctatttgg

SEQ ID NO: 64846 - DNA, 16 bp, H. sapiens
cagaatttctgtttct

SEQ ID NO: 64847 - DNA, 16 bp, H. sapiens
cagaatttcttcttga

SEQ ID NO: 64848 - DNA, 16 bp, H. sapiens
cagaatttctttcatt

SEQ ID NO: 64849 - DNA, 16 bp, H. sapiens
cagaatttctttttaa

SEQ ID NO: 64850 - DNA, 16 bp, H. sapiens
cagaatttgatttttt

SEQ ID NO: 64851 - DNA, 16 bp, H. sapiens
cagaattttatcagat

SEQ ID NO: 64852 - DNA, 16 bp, H. sapiens
cagaatttttaaaact

SEQ ID NO: 64853 - DNA, 16 bp, H. sapiens
cagaatttttgcttga

SEQ ID NO: 64854 - DNA, 16 bp, H. sapiens
cagacaaaataaactt

SEQ ID NO: 64855 - DNA, 16 bp, H. sapiens
cagacaaaatagactt

SEQ ID NO: 64856 - DNA, 16 bp, H. sapiens
cagacaaactcaacca

SEQ ID NO: 64857 - DNA, 16 bp, H. sapiens
cagacaaagatatcac

SEQ ID NO: 64858 - DNA, 16 bp, H. sapiens
cagacaaagcatttga

SEQ ID NO: 64859 - DNA, 16 bp, H. sapiens
cagacaaatatccctg

SEQ ID NO: 64860 - DNA, 16 bp, H. sapiens
cagacaaatgaaagct

SEQ ID NO: 64861 - DNA, 16 bp, H. sapiens
cagacaaatggaaaaa

SEQ ID NO: 64862 - DNA, 16 bp, H. sapiens
cagacaaccaaatgct

SEQ ID NO: 64863 - DNA, 16 bp, H. sapiens
cagacaactcacagaa

SEQ ID NO: 64864 - DNA, 16 bp, H. sapiens
cagacaagaaagaatg

SEQ ID NO: 64865 - DNA, 16 bp, H. sapiens
cagacaagaataaaga

SEQ ID NO: 64866 - DNA, 16 bp, H. sapiens
cagacaagagaaaatg

SEQ ID NO: 64867 - DNA, 16 bp, H. sapiens
cagacaagcagagagc

SEQ ID NO: 64868 - DNA, 16 bp, H. sapiens
cagacaaggaaaccaa

SEQ ID NO: 64869 - DNA, 16 bp, H. sapiens
cagacaaggacactga

SEQ ID NO: 64870 - DNA, 16 bp, H. sapiens
cagacaagggaagaga

SEQ ID NO: 64871 - DNA, 16 bp, H. sapiens
cagacaagttacttaa

SEQ ID NO: 64872 - DNA, 16 bp, H. sapiens
cagacaattttcaaaa

SEQ ID NO: 64873 - DNA, 16 bp, H. sapiens
cagacacacacacacg

SEQ ID NO: 64874 - DNA, 16 bp, H. sapiens
cagacacacacacaga

SEQ ID NO: 64875 - DNA, 16 bp, H. sapiens
cagacacacacagaca

SEQ ID NO: 64876 - DNA, 16 bp, H. sapiens
cagacacacagacaca

SEQ ID NO: 64877 - DNA, 16 bp, H. sapiens
cagacacacagatgca

SEQ ID NO: 64878 - DNA, 16 bp, H. sapiens
cagacacacccaggat

SEQ ID NO: 64879 - DNA, 16 bp, H. sapiens
cagacacacgtgcaca

SEQ ID NO: 64880 - DNA, 16 bp, H. sapiens
cagacacactcagaaa

SEQ ID NO: 64881 - DNA, 16 bp, H. sapiens
cagacacagaaggcca

SEQ ID NO: 64882 - DNA, 16 bp, H. sapiens
cagacacagacaaata

SEQ ID NO: 64883 - DNA, 16 bp, H. sapiens
cagacacagagatgga

SEQ ID NO: 64884 - DNA, 16 bp, H. sapiens
cagacacaggaagggg

SEQ ID NO: 64885 - DNA, 16 bp, H. sapiens
cagacacataaacaca

SEQ ID NO: 64886 - DNA, 16 bp, H. sapiens
cagacacatatataca

SEQ ID NO: 64887 - DNA, 16 bp, H. sapiens
cagacaccctacagaa

SEQ ID NO: 64888 - DNA, 16 bp, H. sapiens
cagacacgcaccacca

SEQ ID NO: 64889 - DNA, 16 bp, H. sapiens
cagacactcaatgcca

SEQ ID NO: 64890 - DNA, 16 bp, H. sapiens
cagacactctggaaaa

SEQ ID NO: 64891 - DNA, 16 bp, H. sapiens
cagacactgactctgc

SEQ ID NO: 64892 - DNA, 16 bp, H. sapiens
cagacactgtgctggg

SEQ ID NO: 64893 - DNA, 16 bp, H. sapiens
cagacacttgccacca

SEQ ID NO: 64894 - DNA, 16 bp, H. sapiens
cagacactttaccaaa

SEQ ID NO: 64895 - DNA, 16 bp, H. sapiens
cagacagaaaaatcaa

SEQ ID NO: 64896 - DNA, 16 bp, H. sapiens
cagacagaagaagatc

SEQ ID NO: 64897 - DNA, 16 bp, H. sapiens
cagacagaagtctgct

SEQ ID NO: 64898 - DNA, 16 bp, H. sapiens
cagacagacaaacaga

SEQ ID NO: 64899 - DNA, 16 bp, H. sapiens
cagacagacagacaca

SEQ ID NO: 64900 - DNA, 16 bp, H. sapiens
cagacagacagacagc

SEQ ID NO: 64901 - DNA, 16 bp, H. sapiens
cagacagacagacgga

SEQ ID NO: 64902 - DNA, 16 bp, H. sapiens
cagacagacagagaga

SEQ ID NO: 64903 - DNA, 16 bp, H. sapiens
cagacagacagatgga

SEQ ID NO: 64904 - DNA, 16 bp, H. sapiens
cagacagagagacaga

SEQ ID NO: 64905 - DNA, 16 bp, H. sapiens
cagacagagagagaca

SEQ ID NO: 64906 - DNA, 16 bp, H. sapiens
cagacagagagagaga

SEQ ID NO: 64907 - DNA, 16 bp, H. sapiens
cagacagagtctcact

SEQ ID NO: 64908 - DNA, 16 bp, H. sapiens
cagacagatgatagat

SEQ ID NO: 64909 - DNA, 16 bp, H. sapiens
cagacagattcacagt

SEQ ID NO: 64910 - DNA, 16 bp, H. sapiens
cagacagcagcattca

SEQ ID NO: 64911 - DNA, 16 bp, H. sapiens
cagacagcctgggttt

SEQ ID NO: 64912 - DNA, 16 bp, H. sapiens
cagacaggagagggag

SEQ ID NO: 64913 - DNA, 16 bp, H. sapiens
cagacaggagctgttc

SEQ ID NO: 64914 - DNA, 16 bp, H. sapiens
cagacagggtctggag

SEQ ID NO: 64915 - DNA, 16 bp, H. sapiens
cagacagggtttcacc

SEQ ID NO: 64916 - DNA, 16 bp, H. sapiens
cagacagtaaaacaca

SEQ ID NO: 64917 - DNA, 17 bp, H. sapiens
cagacagtgggcacagg

SEQ ID NO: 64918 - DNA, 16 bp, H. sapiens
cagacatacacagaga

SEQ ID NO: 64919 - DNA, 16 bp, H. sapiens
cagacatcataaagga

SEQ ID NO: 64920 - DNA, 16 bp, H. sapiens
cagacatcctacagaa

SEQ ID NO: 64921 - DNA, 17 bp, H. sapiens
cagacatgcaagccctg

SEQ ID NO: 64922 - DNA, 16 bp, H. sapiens
cagacatggtggtgtg

SEQ ID NO: 64923 - DNA, 18 bp, H. sapiens
cagacattataacaaact

SEQ ID NO: 64924 - DNA, 16 bp, H. sapiens
cagacattcaaagaaa

SEQ ID NO: 64925 - DNA, 16 bp, H. sapiens
cagacattcaacttct

SEQ ID NO: 64926 - DNA, 16 bp, H. sapiens
cagacattgtgctaaa

SEQ ID NO: 64927 - DNA, 16 bp, H. sapiens
cagacatttactgagc

SEQ ID NO: 64928 - DNA, 25 bp, H. sapiens
cagacatttcacatcagcaagctgc

SEQ ID NO: 64929 - DNA, 18 bp, H. sapiens
cagacatttgctaacttg

SEQ ID NO: 64930 - DNA, 16 bp, H. sapiens
cagacattttattttt

SEQ ID NO: 64931 - DNA, 16 bp, H. sapiens
cagacattttttttct

SEQ ID NO: 64932 - DNA, 16 bp, H. sapiens
cagaccaacattcaaa

SEQ ID NO: 64933 - DNA, 16 bp, H. sapiens
cagaccaactcaaagt

SEQ ID NO: 64934 - DNA, 16 bp, H. sapiens
cagaccaagattctgt

SEQ ID NO: 64935 - DNA, 16 bp, H. sapiens
cagaccaataacaaat

SEQ ID NO: 64936 - DNA, 16 bp, H. sapiens
cagaccacagaatggt

SEQ ID NO: 64937 - DNA, 16 bp, H. sapiens
cagaccacagcagaat

SEQ ID NO: 64938 - DNA, 16 bp, H. sapiens
cagaccactcagactt

SEQ ID NO: 64939 - DNA, 16 bp, H. sapiens
cagaccactcggctct

SEQ ID NO: 64940 - DNA, 16 bp, H. sapiens
cagaccagcagcatca

SEQ ID NO: 64941 - DNA, 16 bp, H. sapiens
cagaccaggaaattcc

SEQ ID NO: 64942 - DNA, 16 bp, H. sapiens
cagaccatcaggcatt

SEQ ID NO: 64943 - DNA, 16 bp, H. sapiens
cagaccatccacatca

SEQ ID NO: 64944 - DNA, 16 bp, H. sapiens
cagacccaaagccagc

SEQ ID NO: 64945 - DNA, 16 bp, H. sapiens
cagacccagacttggg

SEQ ID NO: 64946 - DNA, 16 bp, H. sapiens
cagacccagttcctga

SEQ ID NO: 64947 - DNA, 16 bp, H. sapiens
cagaccccatctccaa

SEQ ID NO: 64948 - DNA, 16 bp, H. sapiens
cagacccctcaggaat

SEQ ID NO: 64949 - DNA, 18 bp, H. sapiens
cagaccctgtctcaaaac

SEQ ID NO: 64950 - DNA, 16 bp, H. sapiens
cagacccttgcagtga

SEQ ID NO: 64951 - DNA, 16 bp, H. sapiens
cagacctctcctctga

SEQ ID NO: 64952 - DNA, 16 bp, H. sapiens
cagacctgaagctgag

SEQ ID NO: 64953 - DNA, 16 bp, H. sapiens
cagacctgagccacca

SEQ ID NO: 64954 - DNA, 16 bp, H. sapiens
cagacctgcaccacca

SEQ ID NO: 64955 - DNA, 16 bp, H. sapiens
cagacctgcagcagaa

SEQ ID NO: 64956 - DNA, 16 bp, H. sapiens
cagacctgcagctgaa

SEQ ID NO: 64957 - DNA, 16 bp, H. sapiens
cagacctggattcaaa

SEQ ID NO: 64958 - DNA, 16 bp, H. sapiens
cagacctgggtttgag

SEQ ID NO: 64959 - DNA, 16 bp, H. sapiens
cagacctgtcctataa

SEQ ID NO: 64960 - DNA, 16 bp, H. sapiens
cagaccttcctggtga

SEQ ID NO: 64961 - DNA, 16 bp, H. sapiens
cagacgaattcacagc

SEQ ID NO: 64962 - DNA, 16 bp, H. sapiens
cagacgcacacacaca

SEQ ID NO: 64963 - DNA, 16 bp, H. sapiens
cagacgggcaggctgt

SEQ ID NO: 64964 - DNA, 16 bp, H. sapiens
cagacggggtttctcc

SEQ ID NO: 64965 - DNA, 16 bp, H. sapiens
cagacgtgagccacca

SEQ ID NO: 64966 - DNA, 16 bp, H. sapiens
cagacgtggtggctca

SEQ ID NO: 64967 - DNA, 19 bp, H. sapiens
cagactaaaccaggaagaa

SEQ ID NO: 64968 - DNA, 16 bp, H. sapiens
cagactaacaacagat

SEQ ID NO: 64969 - DNA, 16 bp, H. sapiens
cagactaataaagaag

SEQ ID NO: 64970 - DNA, 16 bp, H. sapiens
cagactaatacagagg

SEQ ID NO: 64971 - DNA, 16 bp, H. sapiens
cagactatattccaat

SEQ ID NO: 64972 - DNA, 16 bp, H. sapiens
cagactcacagttcca

SEQ ID NO: 64973 - DNA, 16 bp, H. sapiens
cagactccaggttctt

SEQ ID NO: 64974 - DNA, 17 bp, H. sapiens
cagactccatctcaaaa

SEQ ID NO: 64975 - DNA, 16 bp, H. sapiens
cagactccatctccaa

SEQ ID NO: 64976 - DNA, 16 bp, H. sapiens
cagactccctcctcaa

SEQ ID NO: 64977 - DNA, 16 bp, H. sapiens
cagactcctgacttca

SEQ ID NO: 64978 - DNA, 16 bp, H. sapiens
cagactcctggtctca

SEQ ID NO: 64979 - DNA, 16 bp, H. sapiens
cagactctgcctcaaa

SEQ ID NO: 64980 - DNA, 16 bp, H. sapiens
cagactctgcctccca

SEQ ID NO: 64981 - DNA, 16 bp, H. sapiens
cagactgaaggctgca

SEQ ID NO: 64982 - DNA, 16 bp, H. sapiens
cagactgagtgcagtg

SEQ ID NO: 64983 - DNA, 17 bp, H. sapiens
cagactgatacctcaca

SEQ ID NO: 64984 - DNA, 16 bp, H. sapiens
cagactgcagtgagcc

SEQ ID NO: 64985 - DNA, 16 bp, H. sapiens
cagactgcagtgagct

SEQ ID NO: 64986 - DNA, 28 bp, H. sapiens
cagactgcctcctcaagtgggtccctga

SEQ ID NO: 64987 - DNA, 16 bp, H. sapiens
cagactgcctgagctc

SEQ ID NO: 64988 - DNA, 16 bp, H. sapiens
cagactgctataacaa

SEQ ID NO: 64989 - DNA, 16 bp, H. sapiens
cagactgctttccaaa

SEQ ID NO: 64990 - DNA, 16 bp, H. sapiens
cagactggagttcaat

SEQ ID NO: 64991 - DNA, 16 bp, H. sapiens
cagactggatgacaga

SEQ ID NO: 64992 - DNA, 16 bp, H. sapiens
cagactggcttccttc

SEQ ID NO: 64993 - DNA, 16 bp, H. sapiens
cagactgggaaaaaat

SEQ ID NO: 64994 - DNA, 16 bp, H. sapiens
cagactgttttccaca

SEQ ID NO: 64995 - DNA, 16 bp, H. sapiens
cagacttacagaaaag

SEQ ID NO: 64996 - DNA, 16 bp, H. sapiens
cagacttctcagtgga

SEQ ID NO: 64997 - DNA, 16 bp, H. sapiens
cagacttctggcctcc

SEQ ID NO: 64998 - DNA, 16 bp, H. sapiens
cagacttgcatgaggc

SEQ ID NO: 64999 - DNA, 16 bp, H. sapiens
cagacttgttcttttt

SEQ ID NO: 65000 - DNA, 16 bp, H. sapiens
cagactttctttttct

SEQ ID NO: 65001 - DNA, 16 bp, H. sapiens
cagagaaaaaatattt

SEQ ID NO: 65002 - DNA, 16 bp, H. sapiens
cagagaaaaagaaatg

SEQ ID NO: 65003 - DNA, 16 bp, H. sapiens
cagagaaaacaaatga

SEQ ID NO: 65004 - DNA, 16 bp, H. sapiens
cagagaaaacagattt

SEQ ID NO: 65005 - DNA, 16 bp, H. sapiens
cagagaaaacagcatg

SEQ ID NO: 65006 - DNA, 16 bp, H. sapiens
cagagaaaaggaaata

SEQ ID NO: 65007 - DNA, 16 bp, H. sapiens
cagagaaaagggagca

SEQ ID NO: 65008 - DNA, 16 bp, H. sapiens
cagagaaaatgagaaa

SEQ ID NO: 65009 - DNA, 16 bp, H. sapiens
cagagaaaatgggaaa

SEQ ID NO: 65010 - DNA, 16 bp, H. sapiens
cagagaaacagaacca

SEQ ID NO: 65011 - DNA, 16 bp, H. sapiens
cagagaaacagacaca

SEQ ID NO: 65012 - DNA, 16 bp, H. sapiens
cagagaaacctgaaaa

SEQ ID NO: 65013 - DNA, 16 bp, H. sapiens
cagagaaagacacaca

SEQ ID NO: 65014 - DNA, 16 bp, H. sapiens
cagagaaagagacaca

SEQ ID NO: 65015 - DNA, 16 bp, H. sapiens
cagagaaagccctcag

SEQ ID NO: 65016 - DNA, 16 bp, H. sapiens
cagagaaaggagcagg

SEQ ID NO: 65017 - DNA, 16 bp, H. sapiens
cagagaaaggcaaagc

SEQ ID NO: 65018 - DNA, 16 bp, H. sapiens
cagagaaaggcataga

SEQ ID NO: 65019 - DNA, 16 bp, H. sapiens
cagagaaaggtgaaat

SEQ ID NO: 65020 - DNA, 16 bp, H. sapiens
cagagaaatggaaaaa

SEQ ID NO: 65021 - DNA, 16 bp, H. sapiens
cagagaaatttttttt

SEQ ID NO: 65022 - DNA, 16 bp, H. sapiens
cagagaacccagaaat

SEQ ID NO: 65023 - DNA, 16 bp, H. sapiens
cagagaacctggagtt

SEQ ID NO: 65024 - DNA, 16 bp, H. sapiens
cagagaactccacaaa

SEQ ID NO: 65025 - DNA, 16 bp, H. sapiens
cagagaactttccaaa

SEQ ID NO: 65026 - DNA, 16 bp, H. sapiens
cagagaagaaggcttc

SEQ ID NO: 65027 - DNA, 16 bp, H. sapiens
cagagaagaatcaaat

SEQ ID NO: 65028 - DNA, 16 bp, H. sapiens
cagagaagaccctgtc

SEQ ID NO: 65029 - DNA, 16 bp, H. sapiens
cagagaagatgcttga

SEQ ID NO: 65030 - DNA, 16 bp, H. sapiens
cagagaagcagaggaa

SEQ ID NO: 65031 - DNA, 16 bp, H. sapiens
cagagaagcagcagca

SEQ ID NO: 65032 - DNA, 16 bp, H. sapiens
cagagaagcagcagga

SEQ ID NO: 65033 - DNA, 16 bp, H. sapiens
cagagaagccttctct

SEQ ID NO: 65034 - DNA, 16 bp, H. sapiens
cagagaagcttcttct

SEQ ID NO: 65035 - DNA, 16 bp, H. sapiens
cagagaaggaaacagg

SEQ ID NO: 65036 - DNA, 16 bp, H. sapiens
cagagaaggaaactga

SEQ ID NO: 65037 - DNA, 16 bp, H. sapiens
cagagaagggaagatg

SEQ ID NO: 65038 - DNA, 16 bp, H. sapiens
cagagaagtaaaatga

SEQ ID NO: 65039 - DNA, 16 bp, H. sapiens
cagagaagtaaagtga

SEQ ID NO: 65040 - DNA, 16 bp, H. sapiens
cagagaagttaagaaa

SEQ ID NO: 65041 - DNA, 16 bp, H. sapiens
cagagaatataaagca

SEQ ID NO: 65042 - DNA, 16 bp, H. sapiens
cagagaatattataaa

SEQ ID NO: 65043 - DNA, 16 bp, H. sapiens
cagagaatgccacaga

SEQ ID NO: 65044 - DNA, 16 bp, H. sapiens
cagagaattccttgaa

SEQ ID NO: 65045 - DNA, 16 bp, H. sapiens
cagagacaatgctgtg

SEQ ID NO: 65046 - DNA, 16 bp, H. sapiens
cagagacacaacaaga

SEQ ID NO: 65047 - DNA, 16 bp, H. sapiens
cagagacacaagcaaa

SEQ ID NO: 65048 - DNA, 16 bp, H. sapiens
cagagacacaataaaa

SEQ ID NO: 65049 - DNA, 16 bp, H. sapiens
cagagacacacaggga

SEQ ID NO: 65050 - DNA, 16 bp, H. sapiens
cagagacacacataag

SEQ ID NO: 65051 - DNA, 16 bp, H. sapiens
cagagacacacatagt

SEQ ID NO: 65052 - DNA, 16 bp, H. sapiens
cagagacacagagaag

SEQ ID NO: 65053 - DNA, 16 bp, H. sapiens
cagagacacagagaca

SEQ ID NO: 65054 - DNA, 16 bp, H. sapiens
cagagacacagggaag

SEQ ID NO: 65055 - DNA, 16 bp, H. sapiens
cagagacactcctcag

SEQ ID NO: 65056 - DNA, 16 bp, H. sapiens
cagagacagaaacaga

SEQ ID NO: 65057 - DNA, 16 bp, H. sapiens
cagagacagaagcaga

SEQ ID NO: 65058 - DNA, 16 bp, H. sapiens
cagagacagagggaaa

SEQ ID NO: 65059 - DNA, 16 bp, H. sapiens
cagagacagatggaga

SEQ ID NO: 65060 - DNA, 16 bp, H. sapiens
cagagacagcaagacc

SEQ ID NO: 65061 - DNA, 16 bp, H. sapiens
cagagacaggaagtga

SEQ ID NO: 65062 - DNA, 16 bp, H. sapiens
cagagacatacatagg

SEQ ID NO: 65063 - DNA, 16 bp, H. sapiens
cagagaccagagagag

SEQ ID NO: 65064 - DNA, 16 bp, H. sapiens
cagagacccaggagct

SEQ ID NO: 65065 - DNA, 16 bp, H. sapiens
cagagacccaggagtt

SEQ ID NO: 65066 - DNA, 16 bp, H. sapiens
cagagacctaggctgc

SEQ ID NO: 65067 - DNA, 16 bp, H. sapiens
cagagactccatctaa

SEQ ID NO: 65068 - DNA, 16 bp, H. sapiens
cagagactgggaaggg

SEQ ID NO: 65069 - DNA, 16 bp, H. sapiens
cagagactgtatggcc

SEQ ID NO: 65070 - DNA, 16 bp, H. sapiens
cagagactgtgtggcc

SEQ ID NO: 65071 - DNA, 16 bp, H. sapiens
cagagactgttatgaa

SEQ ID NO: 65072 - DNA, 16 bp, H. sapiens
cagagagaacagcaag

SEQ ID NO: 65073 - DNA, 16 bp, H. sapiens
cagagagaagaaaatg

SEQ ID NO: 65074 - DNA, 16 bp, H. sapiens
cagagagaagagcaag

SEQ ID NO: 65075 - DNA, 16 bp, H. sapiens
cagagagaagcagcag

SEQ ID NO: 65076 - DNA, 16 bp, H. sapiens
cagagagaaggcagcc

SEQ ID NO: 65077 - DNA, 16 bp, H. sapiens
cagagagaatgagaga

SEQ ID NO: 65078 - DNA, 16 bp, H. sapiens
cagagagacaaacaga

SEQ ID NO: 65079 - DNA, 16 bp, H. sapiens
cagagagacaaatacc

SEQ ID NO: 65080 - DNA, 16 bp, H. sapiens
cagagagacagagaca

SEQ ID NO: 65081 - DNA, 16 bp, H. sapiens
cagagagacaggcaga

SEQ ID NO: 65082 - DNA, 16 bp, H. sapiens
cagagagacagggaga

SEQ ID NO: 65083 - DNA, 16 bp, H. sapiens
cagagagaccccatct

SEQ ID NO: 65084 - DNA, 16 bp, H. sapiens
cagagagacctgagtt

SEQ ID NO: 65085 - DNA, 16 bp, H. sapiens
cagagagagacacaga

SEQ ID NO: 65086 - DNA, 16 bp, H. sapiens
cagagagagacagaga

SEQ ID NO: 65087 - DNA, 16 bp, H. sapiens
cagagagagacaggga

SEQ ID NO: 65088 - DNA, 16 bp, H. sapiens
cagagagagagcaagc

SEQ ID NO: 65089 - DNA, 16 bp, H. sapiens
cagagagagagcttgg

SEQ ID NO: 65090 - DNA, 16 bp, H. sapiens
cagagagagagggaca

SEQ ID NO: 65091 - DNA, 16 bp, H. sapiens
cagagagatgaagtaa

SEQ ID NO: 65092 - DNA, 16 bp, H. sapiens
cagagagatggatttg

SEQ ID NO: 65093 - DNA, 16 bp, H. sapiens
cagagagattgagaga

SEQ ID NO: 65094 - DNA, 16 bp, H. sapiens
cagagagatttgaaga

SEQ ID NO: 65095 - DNA, 16 bp, H. sapiens
cagagagcagagagaa

SEQ ID NO: 65096 - DNA, 16 bp, H. sapiens
cagagagcagagagga

SEQ ID NO: 65097 - DNA, 16 bp, H. sapiens
cagagagcagcagagg

SEQ ID NO: 65098 - DNA, 16 bp, H. sapiens
cagagagccaaaacat

SEQ ID NO: 65099 - DNA, 17 bp, H. sapiens
cagagagccaaatcata

SEQ ID NO: 65100 - DNA, 22 bp, H. sapiens
cagagagccaaatcatgactga

SEQ ID NO: 65101 - DNA, 16 bp, H. sapiens
cagagagccaagatcg

SEQ ID NO: 65102 - DNA, 16 bp, H. sapiens
cagagagctatgattg

SEQ ID NO: 65103 - DNA, 16 bp, H. sapiens
cagagagctgccttgc

SEQ ID NO: 65104 - DNA, 16 bp, H. sapiens
cagagagcttctgggt

SEQ ID NO: 65105 - DNA, 16 bp, H. sapiens
cagagaggaaacaagc

SEQ ID NO: 65106 - DNA, 16 bp, H. sapiens
cagagaggagagagac

SEQ ID NO: 65107 - DNA, 16 bp, H. sapiens
cagagaggagctaccc

SEQ ID NO: 65108 - DNA, 16 bp, H. sapiens
cagagaggaggccagg

SEQ ID NO: 65109 - DNA, 16 bp, H. sapiens
cagagaggaggccctg

SEQ ID NO: 65110 - DNA, 16 bp, H. sapiens
cagagaggatgtggag

SEQ ID NO: 65111 - DNA, 16 bp, H. sapiens
cagagaggcagagaca

SEQ ID NO: 65112 - DNA, 16 bp, H. sapiens
cagagaggcagaggca

SEQ ID NO: 65113 - DNA, 16 bp, H. sapiens
cagagaggccaggaag

SEQ ID NO: 65114 - DNA, 16 bp, H. sapiens
cagagaggcctgactg

SEQ ID NO: 65115 - DNA, 16 bp, H. sapiens
cagagaggcctttcct

SEQ ID NO: 65116 - DNA, 16 bp, H. sapiens
cagagaggctgagcca

SEQ ID NO: 65117 - DNA, 16 bp, H. sapiens
cagagagggaaggcag

SEQ ID NO: 65118 - DNA, 16 bp, H. sapiens
cagagagggacagaga

SEQ ID NO: 65119 - DNA, 16 bp, H. sapiens
cagagagggaggcaga

SEQ ID NO: 65120 - DNA, 16 bp, H. sapiens
cagagaggggaagtga

SEQ ID NO: 65121 - DNA, 16 bp, H. sapiens
cagagaggggatgtga

SEQ ID NO: 65122 - DNA, 16 bp, H. sapiens
cagagaggggcagtga

SEQ ID NO: 65123 - DNA, 16 bp, H. sapiens
cagagagggttcttgg

SEQ ID NO: 65124 - DNA, 16 bp, H. sapiens
cagagaggtataatga

SEQ ID NO: 65125 - DNA, 16 bp, H. sapiens
cagagaggtcttccct

SEQ ID NO: 65126 - DNA, 16 bp, H. sapiens
cagagaggttaagaaa

SEQ ID NO: 65127 - DNA, 16 bp, H. sapiens
cagagaggttgagcaa

SEQ ID NO: 65128 - DNA, 16 bp, H. sapiens
cagagaggttgagtaa

SEQ ID NO: 65129 - DNA, 16 bp, H. sapiens
cagagagtcaaatcat

SEQ ID NO: 65130 - DNA, 16 bp, H. sapiens
cagagagtccttctcc

SEQ ID NO: 65131 - DNA, 16 bp, H. sapiens
cagagataaagagaga

SEQ ID NO: 65132 - DNA, 16 bp, H. sapiens
cagagatacagatcaa

SEQ ID NO: 65133 - DNA, 16 bp, H. sapiens
cagagatataacaaaa

SEQ ID NO: 65134 - DNA, 16 bp, H. sapiens
cagagatatggaatca

SEQ ID NO: 65135 - DNA, 16 bp, H. sapiens
cagagatcaatggaac

SEQ ID NO: 65136 - DNA, 16 bp, H. sapiens
cagagatcccagagga

SEQ ID NO: 65137 - DNA, 19 bp, H. sapiens
cagagatcgcgccactgca

SEQ ID NO: 65138 - DNA, 16 bp, H. sapiens
cagagatgaaaaagac

SEQ ID NO: 65139 - DNA, 16 bp, H. sapiens
cagagatgaaaatgga

SEQ ID NO: 65140 - DNA, 16 bp, H. sapiens
cagagatgaaacaaac

SEQ ID NO: 65141 - DNA, 16 bp, H. sapiens
cagagatggacagaga

SEQ ID NO: 65142 - DNA, 16 bp, H. sapiens
cagagatggagacaga

SEQ ID NO: 65143 - DNA, 16 bp, H. sapiens
cagagatggcagtgag

SEQ ID NO: 65144 - DNA, 16 bp, H. sapiens
cagagatgggatttga

SEQ ID NO: 65145 - DNA, 16 bp, H. sapiens
cagagatgggctttca

SEQ ID NO: 65146 - DNA, 20 bp, H. sapiens
cagagatggggtttcaccat

SEQ ID NO: 65147 - DNA, 18 bp, H. sapiens
cagagatggggtttcact

SEQ ID NO: 65148 - DNA, 16 bp, H. sapiens
cagagattccctgccc

SEQ ID NO: 65149 - DNA, 16 bp, H. sapiens
cagagattctgctatg

SEQ ID NO: 65150 - DNA, 16 bp, H. sapiens
cagagattctggtaca

SEQ ID NO: 65151 - DNA, 16 bp, H. sapiens
cagagattgcagtgag

SEQ ID NO: 65152 - DNA, 16 bp, H. sapiens
cagagattggagtgaa

SEQ ID NO: 65153 - DNA, 16 bp, H. sapiens
cagagattgggccact

SEQ ID NO: 65154 - DNA, 16 bp, H. sapiens
cagagatttatttatt

SEQ ID NO: 65155 - DNA, 16 bp, H. sapiens
cagagatttcccatat

SEQ ID NO: 65156 - DNA, 16 bp, H. sapiens
cagagatttttgtctg

SEQ ID NO: 65157 - DNA, 16 bp, H. sapiens
cagagcaaaaaagttt

SEQ ID NO: 65158 - DNA, 16 bp, H. sapiens
cagagcaaaaaggctg

SEQ ID NO: 65159 - DNA, 16 bp, H. sapiens
cagagcaaaaataaat

SEQ ID NO: 65160 - DNA, 16 bp, H. sapiens
cagagcaaagactcca

SEQ ID NO: 65161 - DNA, 16 bp, H. sapiens
cagagcaactgcatct

SEQ ID NO: 65162 - DNA, 16 bp, H. sapiens
cagagcaacttccaat

SEQ ID NO: 65163 - DNA, 16 bp, H. sapiens
cagagcaagaatttgt

SEQ ID NO: 65164 - DNA, 16 bp, H. sapiens
cagagcaagacagtgt

SEQ ID NO: 65165 - DNA, 16 bp, H. sapiens
cagagcaagaccctga

SEQ ID NO: 65166 - DNA, 16 bp, H. sapiens
cagagcaagactcaaa

SEQ ID NO: 65167 - DNA, 16 bp, H. sapiens
cagagcaagactttct

SEQ ID NO: 65168 - DNA, 16 bp, H. sapiens
cagagcaagacttttt

SEQ ID NO: 65169 - DNA, 16 bp, H. sapiens
cagagcaagagagaga

SEQ ID NO: 65170 - DNA, 16 bp, H. sapiens
cagagcaagatcctgt

SEQ ID NO: 65171 - DNA, 16 bp, H. sapiens
cagagcaagatccttt

SEQ ID NO: 65172 - DNA, 16 bp, H. sapiens
cagagcaagatcttgt

SEQ ID NO: 65173 - DNA, 16 bp, H. sapiens
cagagcaagcctctgt

SEQ ID NO: 65174 - DNA, 16 bp, H. sapiens
cagagcaaggaaaatt

SEQ ID NO: 65175 - DNA, 16 bp, H. sapiens
cagagcaaggccctga

SEQ ID NO: 65176 - DNA, 16 bp, H. sapiens
cagagcaaggccctgt

SEQ ID NO: 65177 - DNA, 16 bp, H. sapiens
cagagcaattccatct

SEQ ID NO: 65178 - DNA, 16 bp, H. sapiens
cagagcacaaatgcaa

SEQ ID NO: 65179 - DNA, 16 bp, H. sapiens
cagagcacagaggact

SEQ ID NO: 65180 - DNA, 16 bp, H. sapiens
cagagcaccaagtccc

SEQ ID NO: 65181 - DNA, 16 bp, H. sapiens
cagagcacctggggga

SEQ ID NO: 65182 - DNA, 16 bp, H. sapiens
cagagcactgtgctgg

SEQ ID NO: 65183 - DNA, 22 bp, H. sapiens
cagagcagaaaagctgaaaatt

SEQ ID NO: 65184 - DNA, 16 bp, H. sapiens
cagagcagaccctgtc

SEQ ID NO: 65185 - DNA, 16 bp, H. sapiens
cagagcagaggccaga

SEQ ID NO: 65186 - DNA, 16 bp, H. sapiens
cagagcagcagagcag

SEQ ID NO: 65187 - DNA, 16 bp, H. sapiens
cagagcagcagagccc

SEQ ID NO: 65188 - DNA, 16 bp, H. sapiens
cagagcagcagcagca

SEQ ID NO: 65189 - DNA, 16 bp, H. sapiens
cagagcagcatgtgga

SEQ ID NO: 65190 - DNA, 16 bp, H. sapiens
cagagcagccaggatg

SEQ ID NO: 65191 - DNA, 16 bp, H. sapiens
cagagcagcccctccc

SEQ ID NO: 65192 - DNA, 16 bp, H. sapiens
cagagcagcctggcca

SEQ ID NO: 65193 - DNA, 16 bp, H. sapiens
cagagcagcctgggca

SEQ ID NO: 65194 - DNA, 16 bp, H. sapiens
cagagcagctgctcag

SEQ ID NO: 65195 - DNA, 16 bp, H. sapiens
cagagcaggaccctgt

SEQ ID NO: 65196 - DNA, 16 bp, H. sapiens
cagagcaggactgaag

SEQ ID NO: 65197 - DNA, 16 bp, H. sapiens
cagagcaggagagaga

SEQ ID NO: 65198 - DNA, 16 bp, H. sapiens
cagagcaggaggcccc

SEQ ID NO: 65199 - DNA, 16 bp, H. sapiens
cagagcaggagggaga

SEQ ID NO: 65200 - DNA, 16 bp, H. sapiens
cagagcaggatcctgt

SEQ ID NO: 65201 - DNA, 16 bp, H. sapiens
cagagcaggggctggg

SEQ ID NO: 65202 - DNA, 16 bp, H. sapiens
cagagcagtgcctggc

SEQ ID NO: 65203 - DNA, 16 bp, H. sapiens
cagagcagtgtgtgga

SEQ ID NO: 65204 - DNA, 16 bp, H. sapiens
cagagcagtgtgtggc

SEQ ID NO: 65205 - DNA, 16 bp, H. sapiens
cagagcagtttggaaa

SEQ ID NO: 65206 - DNA, 16 bp, H. sapiens
cagagcatgtcagagg

SEQ ID NO: 65207 - DNA, 16 bp, H. sapiens
cagagccagaactaga

SEQ ID NO: 65208 - DNA, 16 bp, H. sapiens
cagagccagaccccat

SEQ ID NO: 65209 - DNA, 16 bp, H. sapiens
cagagccagacttcat

SEQ ID NO: 65210 - DNA, 16 bp, H. sapiens
cagagccagagccaga

SEQ ID NO: 65211 - DNA, 16 bp, H. sapiens
cagagccagagccagg

SEQ ID NO: 65212 - DNA, 16 bp, H. sapiens
cagagccagagctggg

SEQ ID NO: 65213 - DNA, 16 bp, H. sapiens
cagagccagcaaatga

SEQ ID NO: 65214 - DNA, 16 bp, H. sapiens
cagagccagcagcagc

SEQ ID NO: 65215 - DNA, 16 bp, H. sapiens
cagagccagcaggaag

SEQ ID NO: 65216 - DNA, 16 bp, H. sapiens
cagagccagccagccc

SEQ ID NO: 65217 - DNA, 16 bp, H. sapiens
cagagccagctgtgtg

SEQ ID NO: 65218 - DNA, 16 bp, H. sapiens
cagagccaggactaga

SEQ ID NO: 65219 - DNA, 16 bp, H. sapiens
cagagccaggagagtg

SEQ ID NO: 65220 - DNA, 16 bp, H. sapiens
cagagccaggatttaa

SEQ ID NO: 65221 - DNA, 16 bp, H. sapiens
cagagccaggatttca

SEQ ID NO: 65222 - DNA, 16 bp, H. sapiens
cagagccaggcagggg

SEQ ID NO: 65223 - DNA, 16 bp, H. sapiens
cagagccaggcccagg

SEQ ID NO: 65224 - DNA, 16 bp, H. sapiens
cagagccaggccctgt

SEQ ID NO: 65225 - DNA, 16 bp, H. sapiens
cagagccaggcctggg

SEQ ID NO: 65226 - DNA, 16 bp, H. sapiens
cagagccagggcaggg

SEQ ID NO: 65227 - DNA, 16 bp, H. sapiens
cagagccatatccttg

SEQ ID NO: 65228 - DNA, 16 bp, H. sapiens
cagagccatgagccaa

SEQ ID NO: 65229 - DNA, 16 bp, H. sapiens
cagagcccagcaagct

SEQ ID NO: 65230 - DNA, 16 bp, H. sapiens
cagagcccagcacagg

SEQ ID NO: 65231 - DNA, 16 bp, H. sapiens
cagagcccagcagcag

SEQ ID NO: 65232 - DNA, 16 bp, H. sapiens
cagagcccagccctgg

SEQ ID NO: 65233 - DNA, 16 bp, H. sapiens
cagagcccaggaggag

SEQ ID NO: 65234 - DNA, 16 bp, H. sapiens
cagagcccaggccagg

SEQ ID NO: 65235 - DNA, 16 bp, H. sapiens
cagagcccaggcctcc

SEQ ID NO: 65236 - DNA, 16 bp, H. sapiens
cagagcccaggcctgg

SEQ ID NO: 65237 - DNA, 16 bp, H. sapiens
cagagcccagggaaga

SEQ ID NO: 65238 - DNA, 16 bp, H. sapiens
cagagcccagggccag

SEQ ID NO: 65239 - DNA, 16 bp, H. sapiens
cagagcccatcccttt

SEQ ID NO: 65240 - DNA, 16 bp, H. sapiens
cagagcccatgctctt

SEQ ID NO: 65241 - DNA, 16 bp, H. sapiens
cagagcccctgcccca

SEQ ID NO: 65242 - DNA, 16 bp, H. sapiens
cagagccctcagagat

SEQ ID NO: 65243 - DNA, 17 bp, H. sapiens
cagagccggctgtgtgg

SEQ ID NO: 65244 - DNA, 16 bp, H. sapiens
cagagcctcactgtgt

SEQ ID NO: 65245 - DNA, 16 bp, H. sapiens
cagagcctcagagaaa

SEQ ID NO: 65246 - DNA, 16 bp, H. sapiens
cagagcctccaggagg

SEQ ID NO: 65247 - DNA, 16 bp, H. sapiens
cagagcctcgctctgt

SEQ ID NO: 65248 - DNA, 16 bp, H. sapiens
cagagcctgaggcagg

SEQ ID NO: 65249 - DNA, 16 bp, H. sapiens
cagagcctgcagtgag

SEQ ID NO: 65250 - DNA, 16 bp, H. sapiens
cagagcctgggcctcc

SEQ ID NO: 65251 - DNA, 16 bp, H. sapiens
cagagcctgttgtggg

SEQ ID NO: 65252 - DNA, 16 bp, H. sapiens
cagagccttgctctgt

SEQ ID NO: 65253 - DNA, 16 bp, H. sapiens
cagagctcagagcctg

SEQ ID NO: 65254 - DNA, 16 bp, H. sapiens
cagagctccaggatca

SEQ ID NO: 65255 - DNA, 16 bp, H. sapiens
cagagctccttggaga

SEQ ID NO: 65256 - DNA, 16 bp, H. sapiens
cagagctctctctctc

SEQ ID NO: 65257 - DNA, 16 bp, H. sapiens
cagagctctgcctcct

SEQ ID NO: 65258 - DNA, 16 bp, H. sapiens
cagagctgagagagaa

SEQ ID NO: 65259 - DNA, 16 bp, H. sapiens
cagagctgagagccat

SEQ ID NO: 65260 - DNA, 16 bp, H. sapiens
cagagctgagctgaag

SEQ ID NO: 65261 - DNA, 16 bp, H. sapiens
cagagctgagttcagg

SEQ ID NO: 65262 - DNA, 16 bp, H. sapiens
cagagctgcagctgag

SEQ ID NO: 65263 - DNA, 16 bp, H. sapiens
cagagctgcagggtca

SEQ ID NO: 65264 - DNA, 16 bp, H. sapiens
cagagctgcccaagat

SEQ ID NO: 65265 - DNA, 16 bp, H. sapiens
cagagctgctcaaggc

SEQ ID NO: 65266 - DNA, 16 bp, H. sapiens
cagagctgctgctgct

SEQ ID NO: 65267 - DNA, 16 bp, H. sapiens
cagagctgctgtaaca

SEQ ID NO: 65268 - DNA, 16 bp, H. sapiens
cagagctggaaagaga

SEQ ID NO: 65269 - DNA, 16 bp, H. sapiens
cagagctggaagagac

SEQ ID NO: 65270 - DNA, 16 bp, H. sapiens
cagagctggaaggggc

SEQ ID NO: 65271 - DNA, 16 bp, H. sapiens
cagagctggactctgt

SEQ ID NO: 65272 - DNA, 16 bp, H. sapiens
cagagctggaggcatc

SEQ ID NO: 65273 - DNA, 16 bp, H. sapiens
cagagctggagtgcag

SEQ ID NO: 65274 - DNA, 16 bp, H. sapiens
cagagctggctgtgtg

SEQ ID NO: 65275 - DNA, 16 bp, H. sapiens
cagagctgggaccaga

SEQ ID NO: 65276 - DNA, 16 bp, H. sapiens
cagagctgggacttga

SEQ ID NO: 65277 - DNA, 16 bp, H. sapiens
cagagctgggatggga

SEQ ID NO: 65278 - DNA, 16 bp, H. sapiens
cagagctgggattcca

SEQ ID NO: 65279 - DNA, 16 bp, H. sapiens
cagagctgggcccagg

SEQ ID NO: 65280 - DNA, 16 bp, H. sapiens
cagagctggggaggcc

SEQ ID NO: 65281 - DNA, 16 bp, H. sapiens
cagagctggggctgga

SEQ ID NO: 65282 - DNA, 16 bp, H. sapiens
cagagctggggcttga

SEQ ID NO: 65283 - DNA, 16 bp, H. sapiens
cagagctgggggtggg

SEQ ID NO: 65284 - DNA, 16 bp, H. sapiens
cagagcttcaaaggac

SEQ ID NO: 65285 - DNA, 16 bp, H. sapiens
cagagcttccagaagg

SEQ ID NO: 65286 - DNA, 16 bp, H. sapiens
cagagcttcgctcttg

SEQ ID NO: 65287 - DNA, 16 bp, H. sapiens
cagagcttgcagagag

SEQ ID NO: 65288 - DNA, 17 bp, H. sapiens
cagagcttgcagtgagt

SEQ ID NO: 65289 - DNA, 16 bp, H. sapiens
cagaggaaaaacagtt

SEQ ID NO: 65290 - DNA, 16 bp, H. sapiens
cagaggaaaaatgtgg

SEQ ID NO: 65291 - DNA, 16 bp, H. sapiens
cagaggaagaaaatga

SEQ ID NO: 65292 - DNA, 16 bp, H. sapiens
cagaggaagaagaaat

SEQ ID NO: 65293 - DNA, 16 bp, H. sapiens
cagaggaagagaagac

SEQ ID NO: 65294 - DNA, 16 bp, H. sapiens
cagaggaagagactga

SEQ ID NO: 65295 - DNA, 16 bp, H. sapiens
cagaggaagcatggcc

SEQ ID NO: 65296 - DNA, 16 bp, H. sapiens
cagaggaaggagcaga

SEQ ID NO: 65297 - DNA, 16 bp, H. sapiens
cagaggaaggatcaga

SEQ ID NO: 65298 - DNA, 16 bp, H. sapiens
cagaggaaggatcagg

SEQ ID NO: 65299 - DNA, 16 bp, H. sapiens
cagaggaaggggaaca

SEQ ID NO: 65300 - DNA, 16 bp, H. sapiens
cagaggaatataaagc

SEQ ID NO: 65301 - DNA, 16 bp, H. sapiens
cagaggaatattttta

SEQ ID NO: 65302 - DNA, 16 bp, H. sapiens
cagaggaatgaaatga

SEQ ID NO: 65303 - DNA, 16 bp, H. sapiens
cagaggaatgtggaag

SEQ ID NO: 65304 - DNA, 16 bp, H. sapiens
cagaggacccagctaa

SEQ ID NO: 65305 - DNA, 16 bp, H. sapiens
cagaggaccctgcagc

SEQ ID NO: 65306 - DNA, 16 bp, H. sapiens
cagaggagaaaactaa

SEQ ID NO: 65307 - DNA, 16 bp, H. sapiens
cagaggagaagacaga

SEQ ID NO: 65308 - DNA, 16 bp, H. sapiens
cagaggagaagcagag

SEQ ID NO: 65309 - DNA, 16 bp, H. sapiens
cagaggagaaggccac

SEQ ID NO: 65310 - DNA, 16 bp, H. sapiens
cagaggagacagaagg

SEQ ID NO: 65311 - DNA, 16 bp, H. sapiens
cagaggagactgacat

SEQ ID NO: 65312 - DNA, 16 bp, H. sapiens
cagaggagaggcagag

SEQ ID NO: 65313 - DNA, 16 bp, H. sapiens
cagaggagataaacag

SEQ ID NO: 65314 - DNA, 16 bp, H. sapiens
cagaggagcagagagt

SEQ ID NO: 65315 - DNA, 16 bp, H. sapiens
cagaggagcagagcag

SEQ ID NO: 65316 - DNA, 16 bp, H. sapiens
cagaggagcagcagca

SEQ ID NO: 65317 - DNA, 16 bp, H. sapiens
cagaggagcagggctg

SEQ ID NO: 65318 - DNA, 18 bp, H. sapiens
cagaggagcccctcacct

SEQ ID NO: 65319 - DNA, 16 bp, H. sapiens
cagaggaggaaacaga

SEQ ID NO: 65320 - DNA, 16 bp, H. sapiens
cagaggaggagatgga

SEQ ID NO: 65321 - DNA, 16 bp, H. sapiens
cagaggaggaggcaga

SEQ ID NO: 65322 - DNA, 16 bp, H. sapiens
cagaggaggcagcccc

SEQ ID NO: 65323 - DNA, 16 bp, H. sapiens
cagaggagggaactga

SEQ ID NO: 65324 - DNA, 16 bp, H. sapiens
cagaggaggtgctgag

SEQ ID NO: 65325 - DNA, 16 bp, H. sapiens
cagaggaggtggcatt

SEQ ID NO: 65326 - DNA, 16 bp, H. sapiens
cagaggagtctctccc

SEQ ID NO: 65327 - DNA, 16 bp, H. sapiens
cagaggagttaagtaa

SEQ ID NO: 65328 - DNA, 16 bp, H. sapiens
cagaggatgagaaata

SEQ ID NO: 65329 - DNA, 16 bp, H. sapiens
cagaggatgaggaaaa

SEQ ID NO: 65330 - DNA, 16 bp, H. sapiens
cagaggatggggaacc

SEQ ID NO: 65331 - DNA, 16 bp, H. sapiens
cagaggatgtggtgag

SEQ ID NO: 65332 - DNA, 16 bp, H. sapiens
cagaggattccagaac

SEQ ID NO: 65333 - DNA, 16 bp, H. sapiens
cagaggcaaagcaaca

SEQ ID NO: 65334 - DNA, 16 bp, H. sapiens
cagaggcaacaaaagc

SEQ ID NO: 65335 - DNA, 16 bp, H. sapiens
cagaggcaagagaatt

SEQ ID NO: 65336 - DNA, 16 bp, H. sapiens
cagaggcacaatcatg

SEQ ID NO: 65337 - DNA, 16 bp, H. sapiens
cagaggcacagagaga

SEQ ID NO: 65338 - DNA, 16 bp, H. sapiens
cagaggcagaaacagc

SEQ ID NO: 65339 - DNA, 16 bp, H. sapiens
cagaggcagagacaga

SEQ ID NO: 65340 - DNA, 16 bp, H. sapiens
cagaggcagagactga

SEQ ID NO: 65341 - DNA, 16 bp, H. sapiens
cagaggcagagagaga

SEQ ID NO: 65342 - DNA, 16 bp, H. sapiens
cagaggcagagattag

SEQ ID NO: 65343 - DNA, 16 bp, H. sapiens
cagaggcagagcctgg

SEQ ID NO: 65344 - DNA, 16 bp, H. sapiens
cagaggcagaggcagc

SEQ ID NO: 65345 - DNA, 16 bp, H. sapiens
cagaggcagaggccag

SEQ ID NO: 65346 - DNA, 16 bp, H. sapiens
cagaggcagaggctgc

SEQ ID NO: 65347 - DNA, 16 bp, H. sapiens
cagaggcagagggaga

SEQ ID NO: 65348 - DNA, 16 bp, H. sapiens
cagaggcagccataat

SEQ ID NO: 65349 - DNA, 16 bp, H. sapiens
cagaggcaggatttga

SEQ ID NO: 65350 - DNA, 21 bp, H. sapiens
cagaggcaggcaggcctcctt

SEQ ID NO: 65351 - DNA, 16 bp, H. sapiens
cagaggcaggcagtcc

SEQ ID NO: 65352 - DNA, 16 bp, H. sapiens
cagaggcagtggctca

SEQ ID NO: 65353 - DNA, 16 bp, H. sapiens
cagaggccacagtgag

SEQ ID NO: 65354 - DNA, 16 bp, H. sapiens
cagaggccagagatgc

SEQ ID NO: 65355 - DNA, 16 bp, H. sapiens
cagaggccagcccaag

SEQ ID NO: 65356 - DNA, 16 bp, H. sapiens
cagaggccaggcatgg

SEQ ID NO: 65357 - DNA, 16 bp, H. sapiens
cagaggcccagagaag

SEQ ID NO: 65358 - DNA, 16 bp, H. sapiens
cagaggcccagagagg

SEQ ID NO: 65359 - DNA, 16 bp, H. sapiens
cagaggcccagggaga

SEQ ID NO: 65360 - DNA, 16 bp, H. sapiens
cagaggcctagaaggg

SEQ ID NO: 65361 - DNA, 16 bp, H. sapiens
cagaggcctaggaagg

SEQ ID NO: 65362 - DNA, 16 bp, H. sapiens
cagaggcctggcctgg

SEQ ID NO: 65363 - DNA, 16 bp, H. sapiens
cagaggcctgggaggg

SEQ ID NO: 65364 - DNA, 16 bp, H. sapiens
cagaggcggaggttgc

SEQ ID NO: 65365 - DNA, 16 bp, H. sapiens
cagaggctacagtgag

SEQ ID NO: 65366 - DNA, 16 bp, H. sapiens
cagaggctcacgcctg

SEQ ID NO: 65367 - DNA, 16 bp, H. sapiens
cagaggctcagagaca

SEQ ID NO: 65368 - DNA, 16 bp, H. sapiens
cagaggctcaggcctg

SEQ ID NO: 65369 - DNA, 16 bp, H. sapiens
cagaggctcagggaag

SEQ ID NO: 65370 - DNA, 16 bp, H. sapiens
cagaggctctcctcac

SEQ ID NO: 65371 - DNA, 16 bp, H. sapiens
cagaggctgaaaaggg

SEQ ID NO: 65372 - DNA, 16 bp, H. sapiens
cagaggctgaggcacg

SEQ ID NO: 65373 - DNA, 16 bp, H. sapiens
cagaggctgaggctgg

SEQ ID NO: 65374 - DNA, 16 bp, H. sapiens
cagaggctgagggagg

SEQ ID NO: 65375 - DNA, 16 bp, H. sapiens
cagaggctgcagagag

SEQ ID NO: 65376 - DNA, 16 bp, H. sapiens
cagaggctgcaggagg

SEQ ID NO: 65377 - DNA, 16 bp, H. sapiens
cagaggctgcagggag

SEQ ID NO: 65378 - DNA, 16 bp, H. sapiens
cagaggctgcagtgac

SEQ ID NO: 65379 - DNA, 16 bp, H. sapiens
cagaggctgcagtgga

SEQ ID NO: 65380 - DNA, 16 bp, H. sapiens
cagaggctgcatgacc

SEQ ID NO: 65381 - DNA, 16 bp, H. sapiens
cagaggctggaaagag

SEQ ID NO: 65382 - DNA, 16 bp, H. sapiens
cagaggctggactggg

SEQ ID NO: 65383 - DNA, 16 bp, H. sapiens
cagaggctggagctgg

SEQ ID NO: 65384 - DNA, 16 bp, H. sapiens
cagaggctggaggaaa

SEQ ID NO: 65385 - DNA, 16 bp, H. sapiens
cagaggctggaggagg

SEQ ID NO: 65386 - DNA, 16 bp, H. sapiens
cagaggctgggcaggg

SEQ ID NO: 65387 - DNA, 16 bp, H. sapiens
cagaggctgggcctgg

SEQ ID NO: 65388 - DNA, 16 bp, H. sapiens
cagaggctggggaaag

SEQ ID NO: 65389 - DNA, 16 bp, H. sapiens
cagaggctgggggagg

SEQ ID NO: 65390 - DNA, 16 bp, H. sapiens
cagaggcttggaaggg

SEQ ID NO: 65391 - DNA, 16 bp, H. sapiens
cagagggaagacacag

SEQ ID NO: 65392 - DNA, 16 bp, H. sapiens
cagagggaagagacaa

SEQ ID NO: 65393 - DNA, 16 bp, H. sapiens
cagagggacagaggca

SEQ ID NO: 65394 - DNA, 16 bp, H. sapiens
cagagggaccagctgg

SEQ ID NO: 65395 - DNA, 16 bp, H. sapiens
cagagggaccctgggc

SEQ ID NO: 65396 - DNA, 16 bp, H. sapiens
cagagggagacccagt

SEQ ID NO: 65397 - DNA, 16 bp, H. sapiens
cagagggagacgctgt

SEQ ID NO: 65398 - DNA, 16 bp, H. sapiens
cagagggagactgtgt

SEQ ID NO: 65399 - DNA, 16 bp, H. sapiens
cagagggagagcctgt

SEQ ID NO: 65400 - DNA, 16 bp, H. sapiens
cagagggagatcttgt

SEQ ID NO: 65401 - DNA, 16 bp, H. sapiens
cagagggagcatggcc

SEQ ID NO: 65402 - DNA, 16 bp, H. sapiens
cagagggagcctggcc

SEQ ID NO: 65403 - DNA, 16 bp, H. sapiens
cagagggaggctctgt

SEQ ID NO: 65404 - DNA, 16 bp, H. sapiens
cagagggcaaggagga

SEQ ID NO: 65405 - DNA, 16 bp, H. sapiens
cagagggcaggggcag

SEQ ID NO: 65406 - DNA, 16 bp, H. sapiens
cagagggctgactgta

SEQ ID NO: 65407 - DNA, 16 bp, H. sapiens
cagagggctgaggtgg

SEQ ID NO: 65408 - DNA, 16 bp, H. sapiens
cagaggggagccagga

SEQ ID NO: 65409 - DNA, 16 bp, H. sapiens
cagaggggcacccgcc

SEQ ID NO: 65410 - DNA, 16 bp, H. sapiens
cagaggggcacctgcc

SEQ ID NO: 65411 - DNA, 16 bp, H. sapiens
cagaggggcagccacc

SEQ ID NO: 65412 - DNA, 16 bp, H. sapiens
cagaggggccagaagg

SEQ ID NO: 65413 - DNA, 16 bp, H. sapiens
cagagggtagaatggt

SEQ ID NO: 65414 - DNA, 16 bp, H. sapiens
cagagggtgaaggaga

SEQ ID NO: 65415 - DNA, 16 bp, H. sapiens
cagagggtggaaggag

SEQ ID NO: 65416 - DNA, 16 bp, H. sapiens
cagagggtggaggttg

SEQ ID NO: 65417 - DNA, 16 bp, H. sapiens
cagagggtgggaaggg

SEQ ID NO: 65418 - DNA, 16 bp, H. sapiens
cagagggttcttggat

SEQ ID NO: 65419 - DNA, 16 bp, H. sapiens
cagaggtcagaggtca

SEQ ID NO: 65420 - DNA, 16 bp, H. sapiens
cagaggtccctgtggc

SEQ ID NO: 65421 - DNA, 16 bp, H. sapiens
cagaggtgaaagaaaa

SEQ ID NO: 65422 - DNA, 16 bp, H. sapiens
cagaggtgaggaagct

SEQ ID NO: 65423 - DNA, 16 bp, H. sapiens
cagaggtgctgaggat

SEQ ID NO: 65424 - DNA, 16 bp, H. sapiens
cagaggtgcttgtgtc

SEQ ID NO: 65425 - DNA, 16 bp, H. sapiens
cagaggtggaaggatt

SEQ ID NO: 65426 - DNA, 16 bp, H. sapiens
cagaggtggagctgcc

SEQ ID NO: 65427 - DNA, 16 bp, H. sapiens
cagaggtggaggtggc

SEQ ID NO: 65428 - DNA, 16 bp, H. sapiens
cagaggtgggaggatc

SEQ ID NO: 65429 - DNA, 16 bp, H. sapiens
cagaggtggggctggg

SEQ ID NO: 65430 - DNA, 16 bp, H. sapiens
cagaggtgtgccacca

SEQ ID NO: 65431 - DNA, 16 bp, H. sapiens
cagaggtgtgtgaacc

SEQ ID NO: 65432 - DNA, 16 bp, H. sapiens
cagaggttactgcttt

SEQ ID NO: 65433 - DNA, 16 bp, H. sapiens
cagaggttctctatga

SEQ ID NO: 65434 - DNA, 16 bp, H. sapiens
cagaggttgaaagagt

SEQ ID NO: 65435 - DNA, 16 bp, H. sapiens
cagaggttgaggcagg

SEQ ID NO: 65436 - DNA, 16 bp, H. sapiens
cagaggttgcaatgaa

SEQ ID NO: 65437 - DNA, 16 bp, H. sapiens
cagaggttgcagaaag

SEQ ID NO: 65438 - DNA, 16 bp, H. sapiens
cagaggttgcagtggc

SEQ ID NO: 65439 - DNA, 16 bp, H. sapiens
cagaggttggaagagt

SEQ ID NO: 65440 - DNA, 16 bp, H. sapiens
cagaggttgtggtggg

SEQ ID NO: 65441 - DNA, 16 bp, H. sapiens
cagagtaaaactctgt

SEQ ID NO: 65442 - DNA, 16 bp, H. sapiens
cagagtaaatggacaa

SEQ ID NO: 65443 - DNA, 16 bp, H. sapiens
cagagtagagaaccca

SEQ ID NO: 65444 - DNA, 16 bp, H. sapiens
cagagtagcagctcag

SEQ ID NO: 65445 - DNA, 16 bp, H. sapiens
cagagtagctgggagt

SEQ ID NO: 65446 - DNA, 16 bp, H. sapiens
cagagtcaaaggagat

SEQ ID NO: 65447 - DNA, 17 bp, H. sapiens
cagagtcacccagggga

SEQ ID NO: 65448 - DNA, 16 bp, H. sapiens
cagagtcagagaaaga

SEQ ID NO: 65449 - DNA, 16 bp, H. sapiens
cagagtcagagacaga

SEQ ID NO: 65450 - DNA, 16 bp, H. sapiens
cagagtccaaaggctg

SEQ ID NO: 65451 - DNA, 16 bp, H. sapiens
cagagtcccagaagga

SEQ ID NO: 65452 - DNA, 16 bp, H. sapiens
cagagtcccagcccca

SEQ ID NO: 65453 - DNA, 16 bp, H. sapiens
cagagtccctactgga

SEQ ID NO: 65454 - DNA, 16 bp, H. sapiens
cagagtccctgccctc

SEQ ID NO: 65455 - DNA, 16 bp, H. sapiens
cagagtctacaaggaa

SEQ ID NO: 65456 - DNA, 16 bp, H. sapiens
cagagtctcatgctgt

SEQ ID NO: 65457 - DNA, 16 bp, H. sapiens
cagagtctccctgtgt

SEQ ID NO: 65458 - DNA, 16 bp, H. sapiens
cagagtctcgctctct

SEQ ID NO: 65459 - DNA, 16 bp, H. sapiens
cagagtctcgctctgc

SEQ ID NO: 65460 - DNA, 16 bp, H. sapiens
cagagtctcgttctgc

SEQ ID NO: 65461 - DNA, 16 bp, H. sapiens
cagagtctctctttgt

SEQ ID NO: 65462 - DNA, 16 bp, H. sapiens
cagagtctgttgttcc

SEQ ID NO: 65463 - DNA, 16 bp, H. sapiens
cagagtcttactctgt

SEQ ID NO: 65464 - DNA, 16 bp, H. sapiens
cagagtcttgatctgt

SEQ ID NO: 65465 - DNA, 16 bp, H. sapiens
cagagtcttgccctgt

SEQ ID NO: 65466 - DNA, 16 bp, H. sapiens
cagagtcttgctccgt

SEQ ID NO: 65467 - DNA, 16 bp, H. sapiens
cagagtcttgctctgc

SEQ ID NO: 65468 - DNA, 16 bp, H. sapiens
cagagtcttgctttat

SEQ ID NO: 65469 - DNA, 16 bp, H. sapiens
cagagtcttgtgctgt

SEQ ID NO: 65470 - DNA, 16 bp, H. sapiens
cagagtgaaaaggcaa

SEQ ID NO: 65471 - DNA, 16 bp, H. sapiens
cagagtgaaactctgt

SEQ ID NO: 65472 - DNA, 16 bp, H. sapiens
cagagtgaaaggcaac

SEQ ID NO: 65473 - DNA, 16 bp, H. sapiens
cagagtgaacaggcca

SEQ ID NO: 65474 - DNA, 16 bp, H. sapiens
cagagtgaagagaaaa

SEQ ID NO: 65475 - DNA, 16 bp, H. sapiens
cagagtgagaactcac

SEQ ID NO: 65476 - DNA, 16 bp, H. sapiens
cagagtgagaatctgt

SEQ ID NO: 65477 - DNA, 16 bp, H. sapiens
cagagtgagaatttgt

SEQ ID NO: 65478 - DNA, 16 bp, H. sapiens
cagagtgagaccatgt

SEQ ID NO: 65479 - DNA, 16 bp, H. sapiens
cagagtgagaccccaa

SEQ ID NO: 65480 - DNA, 16 bp, H. sapiens
cagagtgagactcatc

SEQ ID NO: 65481 - DNA, 16 bp, H. sapiens
cagagtgagactctct

SEQ ID NO: 65482 - DNA, 16 bp, H. sapiens
cagagtgagattctgc

SEQ ID NO: 65483 - DNA, 16 bp, H. sapiens
cagagtgagcagcagc

SEQ ID NO: 65484 - DNA, 16 bp, H. sapiens
cagagtgagcaggcaa

SEQ ID NO: 65485 - DNA, 17 bp, H. sapiens
cagagtgcagtggcgcg

SEQ ID NO: 65486 - DNA, 16 bp, H. sapiens
cagagtgcctcttcag

SEQ ID NO: 65487 - DNA, 16 bp, H. sapiens
cagagtgctaggatta

SEQ ID NO: 65488 - DNA, 16 bp, H. sapiens
cagagtgctgactggt

SEQ ID NO: 65489 - DNA, 17 bp, H. sapiens
cagagtgctgattggtg

SEQ ID NO: 65490 - DNA, 16 bp, H. sapiens
cagagtgctgggatga

SEQ ID NO: 65491 - DNA, 16 bp, H. sapiens
cagagtggataaagaa

SEQ ID NO: 65492 - DNA, 16 bp, H. sapiens
cagagtggcaagctga

SEQ ID NO: 65493 - DNA, 16 bp, H. sapiens
cagagtgttaggatta

SEQ ID NO: 65494 - DNA, 16 bp, H. sapiens
cagagtgttgggatta

SEQ ID NO: 65495 - DNA, 16 bp, H. sapiens
cagagtgtttcaaaac

SEQ ID NO: 65496 - DNA, 16 bp, H. sapiens
cagagttaaacttttg

SEQ ID NO: 65497 - DNA, 16 bp, H. sapiens
cagagttcaaatcctg

SEQ ID NO: 65498 - DNA, 16 bp, H. sapiens
cagagttcaggcagaa

SEQ ID NO: 65499 - DNA, 16 bp, H. sapiens
cagagttctccagaaa

SEQ ID NO: 65500 - DNA, 16 bp, H. sapiens
cagagttctgggatta

SEQ ID NO: 65501 - DNA, 16 bp, H. sapiens
cagagttgagtagttt

SEQ ID NO: 65502 - DNA, 16 bp, H. sapiens
cagagttgagtggttg

SEQ ID NO: 65503 - DNA, 16 bp, H. sapiens
cagagtttccttcttt

SEQ ID NO: 65504 - DNA, 16 bp, H. sapiens
cagagtttctatttct

SEQ ID NO: 65505 - DNA, 16 bp, H. sapiens
cagagtttcttccttt

SEQ ID NO: 65506 - DNA, 16 bp, H. sapiens
cagagttttgctctgt

SEQ ID NO: 65507 - DNA, 16 bp, H. sapiens
cagagtttttccatgt

SEQ ID NO: 65508 - DNA, 16 bp, H. sapiens
cagataaaaactagaa

SEQ ID NO: 65509 - DNA, 16 bp, H. sapiens
cagataaaattatttt

SEQ ID NO: 65510 - DNA, 16 bp, H. sapiens
cagataaacaaattgt

SEQ ID NO: 65511 - DNA, 16 bp, H. sapiens
cagataaactagaaaa

SEQ ID NO: 65512 - DNA, 16 bp, H. sapiens
cagataaactcaagtc

SEQ ID NO: 65513 - DNA, 16 bp, H. sapiens
cagataaagaaaatat

SEQ ID NO: 65514 - DNA, 16 bp, H. sapiens
cagataaagaaataga

SEQ ID NO: 65515 - DNA, 16 bp, H. sapiens
cagataaatgtaacaa

SEQ ID NO: 65516 - DNA, 16 bp, H. sapiens
cagataaatttaacag

SEQ ID NO: 65517 - DNA, 16 bp, H. sapiens
cagataagaaaaatgt

SEQ ID NO: 65518 - DNA, 16 bp, H. sapiens
cagataagagaagaga

SEQ ID NO: 65519 - DNA, 16 bp, H. sapiens
cagataaggaaaatga

SEQ ID NO: 65520 - DNA, 16 bp, H. sapiens
cagataaggaaactgg

SEQ ID NO: 65521 - DNA, 16 bp, H. sapiens
cagataaggaaagtga

SEQ ID NO: 65522 - DNA, 16 bp, H. sapiens
cagataaggggggact

SEQ ID NO: 65523 - DNA, 16 bp, H. sapiens
cagataatgaaactga

SEQ ID NO: 65524 - DNA, 16 bp, H. sapiens
cagataatttctttat

SEQ ID NO: 65525 - DNA, 16 bp, H. sapiens
cagataatttgttttt

SEQ ID NO: 65526 - DNA, 16 bp, H. sapiens
cagataattttacttt

SEQ ID NO: 65527 - DNA, 16 bp, H. sapiens
cagataattttttctt

SEQ ID NO: 65528 - DNA, 16 bp, H. sapiens
cagatacaagaaattc

SEQ ID NO: 65529 - DNA, 16 bp, H. sapiens
cagatacaagtctttt

SEQ ID NO: 65530 - DNA, 16 bp, H. sapiens
cagatacagtggctca

SEQ ID NO: 65531 - DNA, 16 bp, H. sapiens
cagatactgtgctttt

SEQ ID NO: 65532 - DNA, 16 bp, H. sapiens
cagataggaagaatca

SEQ ID NO: 65533 - DNA, 16 bp, H. sapiens
cagatataaaaatatt

SEQ ID NO: 65534 - DNA, 16 bp, H. sapiens
cagatataaatatata

SEQ ID NO: 65535 - DNA, 16 bp, H. sapiens
cagatataattttttt

SEQ ID NO: 65536 - DNA, 16 bp, H. sapiens
cagatatacacacaga

SEQ ID NO: 65537 - DNA, 16 bp, H. sapiens
cagatatagatacaga

SEQ ID NO: 65538 - DNA, 16 bp, H. sapiens
cagatatatacacaca

SEQ ID NO: 65539 - DNA, 16 bp, H. sapiens
cagatatatgaaaaat

SEQ ID NO: 65540 - DNA, 16 bp, H. sapiens
cagatatcacctcctc

SEQ ID NO: 65541 - DNA, 16 bp, H. sapiens
cagatatgagccactg

SEQ ID NO: 65542 - DNA, 16 bp, H. sapiens
cagatattatttttaa

SEQ ID NO: 65543 - DNA, 16 bp, H. sapiens
cagatattgccaaatt

SEQ ID NO: 65544 - DNA, 16 bp, H. sapiens
cagatatttacttttt

SEQ ID NO: 65545 - DNA, 16 bp, H. sapiens
cagatatttattaaac

SEQ ID NO: 65546 - DNA, 16 bp, H. sapiens
cagatatttattgagt

SEQ ID NO: 65547 - DNA, 16 bp, H. sapiens
cagatatttcatcaaa

SEQ ID NO: 65548 - DNA, 16 bp, H. sapiens
cagatcaagaaactga

SEQ ID NO: 65549 - DNA, 16 bp, H. sapiens
cagatcaaggtgccag

SEQ ID NO: 65550 - DNA, 16 bp, H. sapiens
cagatcaataagaaaa

SEQ ID NO: 65551 - DNA, 16 bp, H. sapiens
cagatcaatagctgca

SEQ ID NO: 65552 - DNA, 16 bp, H. sapiens
cagatcacaaggttag

SEQ ID NO: 65553 - DNA, 16 bp, H. sapiens
cagatcacacctcatt

SEQ ID NO: 65554 - DNA, 16 bp, H. sapiens
cagatcaccacaataa

SEQ ID NO: 65555 - DNA, 16 bp, H. sapiens
cagatcagcagcatca

SEQ ID NO: 65556 - DNA, 16 bp, H. sapiens
cagatcagcaggggca

SEQ ID NO: 65557 - DNA, 16 bp, H. sapiens
cagatcattgagacag

SEQ ID NO: 65558 - DNA, 16 bp, H. sapiens
cagatcatttgaaatt

SEQ ID NO: 65559 - DNA, 16 bp, H. sapiens
cagatccacatggctg

SEQ ID NO: 65560 - DNA, 16 bp, H. sapiens
cagatccaccaacagc

SEQ ID NO: 65561 - DNA, 16 bp, H. sapiens
cagatccagacctcct

SEQ ID NO: 65562 - DNA, 16 bp, H. sapiens
cagatccaggagtcca

SEQ ID NO: 65563 - DNA, 16 bp, H. sapiens
cagatcccacagggtg

SEQ ID NO: 65564 - DNA, 16 bp, H. sapiens
cagatcccagcagcag

SEQ ID NO: 65565 - DNA, 16 bp, H. sapiens
cagatcccatggacat

SEQ ID NO: 65566 - DNA, 16 bp, H. sapiens
cagatcctgaattcca

SEQ ID NO: 65567 - DNA, 16 bp, H. sapiens
cagatcgcaccattgc

SEQ ID NO: 65568 - DNA, 16 bp, H. sapiens
cagatctcaaactcca

SEQ ID NO: 65569 - DNA, 16 bp, H. sapiens
cagatctcaagctgtg

SEQ ID NO: 65570 - DNA, 16 bp, H. sapiens
cagatctcatgaaact

SEQ ID NO: 65571 - DNA, 16 bp, H. sapiens
cagatctcatgagacc

SEQ ID NO: 65572 - DNA, 16 bp, H. sapiens
cagatctcatgagatc

SEQ ID NO: 65573 - DNA, 16 bp, H. sapiens
cagatctcatgtcctc

SEQ ID NO: 65574 - DNA, 16 bp, H. sapiens
cagatctctcatgaat

SEQ ID NO: 65575 - DNA, 16 bp, H. sapiens
cagatctctccacccc

SEQ ID NO: 65576 - DNA, 16 bp, H. sapiens
cagatctctttcattg

SEQ ID NO: 65577 - DNA, 16 bp, H. sapiens
cagatctggtgagaac

SEQ ID NO: 65578 - DNA, 16 bp, H. sapiens
cagatctgtctgactc

SEQ ID NO: 65579 - DNA, 16 bp, H. sapiens
cagatcttaaaggaaa

SEQ ID NO: 65580 - DNA, 16 bp, H. sapiens
cagatcttctcagctt

SEQ ID NO: 65581 - DNA, 16 bp, H. sapiens
cagatcttctgatttt

SEQ ID NO: 65582 - DNA, 16 bp, H. sapiens
cagatcttgtccaaga

SEQ ID NO: 65583 - DNA, 16 bp, H. sapiens
cagatcttttgaaata

SEQ ID NO: 65584 - DNA, 16 bp, H. sapiens
cagatgaaaaaaactg

SEQ ID NO: 65585 - DNA, 16 bp, H. sapiens
cagatgaaaaaactga

SEQ ID NO: 65586 - DNA, 16 bp, H. sapiens
cagatgaaactttgga

SEQ ID NO: 65587 - DNA, 16 bp, H. sapiens
cagatgaacaaaagct

SEQ ID NO: 65588 - DNA, 16 bp, H. sapiens
cagatgaacagataaa

SEQ ID NO: 65589 - DNA, 16 bp, H. sapiens
cagatgaacctggagg

SEQ ID NO: 65590 - DNA, 16 bp, H. sapiens
cagatgaagaaaatga

SEQ ID NO: 65591 - DNA, 16 bp, H. sapiens
cagatgaagaaacaaa

SEQ ID NO: 65592 - DNA, 16 bp, H. sapiens
cagatgaagaaacaag

SEQ ID NO: 65593 - DNA, 16 bp, H. sapiens
cagatgaagaaaccga

SEQ ID NO: 65594 - DNA, 16 bp, H. sapiens
cagatgaagaaagtga

SEQ ID NO: 65595 - DNA, 16 bp, H. sapiens
cagatgaagaaattga

SEQ ID NO: 65596 - DNA, 16 bp, H. sapiens
cagatgaagaagctga

SEQ ID NO: 65597 - DNA, 16 bp, H. sapiens
cagatgaagaatctga

SEQ ID NO: 65598 - DNA, 16 bp, H. sapiens
cagatgaagacacaga

SEQ ID NO: 65599 - DNA, 16 bp, H. sapiens
cagatgaagagataaa

SEQ ID NO: 65600 - DNA, 16 bp, H. sapiens
cagatgaagatactga

SEQ ID NO: 65601 - DNA, 16 bp, H. sapiens
cagatgaataaactga

SEQ ID NO: 65602 - DNA, 16 bp, H. sapiens
cagatgaatgaagaaa

SEQ ID NO: 65603 - DNA, 16 bp, H. sapiens
cagatgaatggaacag

SEQ ID NO: 65604 - DNA, 16 bp, H. sapiens
cagatgaattgataaa

SEQ ID NO: 65605 - DNA, 16 bp, H. sapiens
cagatgacatgattat

SEQ ID NO: 65606 - DNA, 16 bp, H. sapiens
cagatgactgcagtcc

SEQ ID NO: 65607 - DNA, 16 bp, H. sapiens
cagatgagaaaaatga

SEQ ID NO: 65608 - DNA, 16 bp, H. sapiens
cagatgagaagaatat

SEQ ID NO: 65609 - DNA, 16 bp, H. sapiens
cagatgagaagaatgt

SEQ ID NO: 65610 - DNA, 16 bp, H. sapiens
cagatgagaccacagc

SEQ ID NO: 65611 - DNA, 16 bp, H. sapiens
cagatgagagtttgga

SEQ ID NO: 65612 - DNA, 16 bp, H. sapiens
cagatgaggaaaactg

SEQ ID NO: 65613 - DNA, 16 bp, H. sapiens
cagatgaggaaacaca

SEQ ID NO: 65614 - DNA, 16 bp, H. sapiens
cagatgaggaaacagg

SEQ ID NO: 65615 - DNA, 16 bp, H. sapiens
cagatgaggaaactag

SEQ ID NO: 65616 - DNA, 16 bp, H. sapiens
cagatgaggaaataga

SEQ ID NO: 65617 - DNA, 16 bp, H. sapiens
cagatgaggaaatcaa

SEQ ID NO: 65618 - DNA, 16 bp, H. sapiens
cagatgaggaaattga

SEQ ID NO: 65619 - DNA, 16 bp, H. sapiens
cagatgaggaacctga

SEQ ID NO: 65620 - DNA, 16 bp, H. sapiens
cagatgaggaacttga

SEQ ID NO: 65621 - DNA, 16 bp, H. sapiens
cagatgaggaagcaga

SEQ ID NO: 65622 - DNA, 16 bp, H. sapiens
cagatgaggagcctga

SEQ ID NO: 65623 - DNA, 16 bp, H. sapiens
cagatgaggatgaaat

SEQ ID NO: 65624 - DNA, 16 bp, H. sapiens
cagatgagggaactga

SEQ ID NO: 65625 - DNA, 16 bp, H. sapiens
cagatgaggttgagac

SEQ ID NO: 65626 - DNA, 16 bp, H. sapiens
cagatgagtaaactga

SEQ ID NO: 65627 - DNA, 16 bp, H. sapiens
cagatgagtagcttgc

SEQ ID NO: 65628 - DNA, 16 bp, H. sapiens
cagatgataaaactga

SEQ ID NO: 65629 - DNA, 16 bp, H. sapiens
cagatgataaatattt

SEQ ID NO: 65630 - DNA, 16 bp, H. sapiens
cagatgatcctctcac

SEQ ID NO: 65631 - DNA, 16 bp, H. sapiens
cagatgatctgtctgc

SEQ ID NO: 65632 - DNA, 16 bp, H. sapiens
cagatgatgaaacaga

SEQ ID NO: 65633 - DNA, 16 bp, H. sapiens
cagatgatgaaactaa

SEQ ID NO: 65634 - DNA, 16 bp, H. sapiens
cagatgatgaaattga

SEQ ID NO: 65635 - DNA, 16 bp, H. sapiens
cagatgatgaggaaga

SEQ ID NO: 65636 - DNA, 16 bp, H. sapiens
cagatgatgggcggcc

SEQ ID NO: 65637 - DNA, 33 bp, H. sapiens
cagatgcaacttaatctagcactctatacttta

SEQ ID NO: 65638 - DNA, 16 bp, H. sapiens
cagatgcacacacaca

SEQ ID NO: 65639 - DNA, 16 bp, H. sapiens
cagatgcattcacagc

SEQ ID NO: 65640 - DNA, 16 bp, H. sapiens
cagatgcattgtttgc

SEQ ID NO: 65641 - DNA, 16 bp, H. sapiens
cagatgccagcagcat

SEQ ID NO: 65642 - DNA, 16 bp, H. sapiens
cagatgccagccaagg

SEQ ID NO: 65643 - DNA, 16 bp, H. sapiens
cagatgcctgccatca

SEQ ID NO: 65644 - DNA, 16 bp, H. sapiens
cagatgcctgtcacca

SEQ ID NO: 65645 - DNA, 16 bp, H. sapiens
cagatgctgaagagga

SEQ ID NO: 65646 - DNA, 16 bp, H. sapiens
cagatgctgaggaaga

SEQ ID NO: 65647 - DNA, 16 bp, H. sapiens
cagatgctgcagagga

SEQ ID NO: 65648 - DNA, 16 bp, H. sapiens
cagatgctgctgctgc

SEQ ID NO: 65649 - DNA, 16 bp, H. sapiens
cagatgctggagagaa

SEQ ID NO: 65650 - DNA, 16 bp, H. sapiens
cagatgctggagatga

SEQ ID NO: 65651 - DNA, 16 bp, H. sapiens
cagatgctggtgctat

SEQ ID NO: 65652 - DNA, 16 bp, H. sapiens
cagatggaaaatacag

SEQ ID NO: 65653 - DNA, 16 bp, H. sapiens
cagatggaaaatattt

SEQ ID NO: 65654 - DNA, 16 bp, H. sapiens
cagatggaaatgaaga

SEQ ID NO: 65655 - DNA, 16 bp, H. sapiens
cagatggaacactgag

SEQ ID NO: 65656 - DNA, 16 bp, H. sapiens
cagatggactgcttga

SEQ ID NO: 65657 - DNA, 16 bp, H. sapiens
cagatggagaaactaa

SEQ ID NO: 65658 - DNA, 16 bp, H. sapiens
cagatggagaaactga

SEQ ID NO: 65659 - DNA, 16 bp, H. sapiens
cagatggagaaagtga

SEQ ID NO: 65660 - DNA, 16 bp, H. sapiens
cagatggagaccatcc

SEQ ID NO: 65661 - DNA, 16 bp, H. sapiens
cagatggagagactga

SEQ ID NO: 65662 - DNA, 16 bp, H. sapiens
cagatggagaggagga

SEQ ID NO: 65663 - DNA, 16 bp, H. sapiens
cagatggagctggaag

SEQ ID NO: 65664 - DNA, 16 bp, H. sapiens
cagatggagctggagg

SEQ ID NO: 65665 - DNA, 16 bp, H. sapiens
cagatggagtctcact

SEQ ID NO: 65666 - DNA, 16 bp, H. sapiens
cagatggattcacagt

SEQ ID NO: 65667 - DNA, 16 bp, H. sapiens
cagatggattttattt

SEQ ID NO: 65668 - DNA, 16 bp, H. sapiens
cagatggcaccttctt

SEQ ID NO: 65669 - DNA, 16 bp, H. sapiens
cagatggcatattgtg

SEQ ID NO: 65670 - DNA, 16 bp, H. sapiens
cagatggcctattgtg

SEQ ID NO: 65671 - DNA, 16 bp, H. sapiens
cagatgggaaaacagg

SEQ ID NO: 65672 - DNA, 16 bp, H. sapiens
cagatgggaaagctga

SEQ ID NO: 65673 - DNA, 16 bp, H. sapiens
cagatggggaaacaga

SEQ ID NO: 65674 - DNA, 16 bp, H. sapiens
cagatggggaagctga

SEQ ID NO: 65675 - DNA, 16 bp, H. sapiens
cagatggggcagccgg

SEQ ID NO: 65676 - DNA, 16 bp, H. sapiens
cagatggggtggctgg

SEQ ID NO: 65677 - DNA, 16 bp, H. sapiens
cagatggggttttgtc

SEQ ID NO: 65678 - DNA, 16 bp, H. sapiens
cagatggtaaatattt

SEQ ID NO: 65679 - DNA, 16 bp, H. sapiens
cagatggtaaatgttt

SEQ ID NO: 65680 - DNA, 16 bp, H. sapiens
cagatgtaatctcaga

SEQ ID NO: 65681 - DNA, 16 bp, H. sapiens
cagatgtacttatttt

SEQ ID NO: 65682 - DNA, 16 bp, H. sapiens
cagatgtcatgagact

SEQ ID NO: 65683 - DNA, 17 bp, H. sapiens
cagatgtctctatcatt

SEQ ID NO: 65684 - DNA, 16 bp, H. sapiens
cagatgtgagccacca

SEQ ID NO: 65685 - DNA, 16 bp, H. sapiens
cagatgtgagccaccg

SEQ ID NO: 65686 - DNA, 16 bp, H. sapiens
cagatgtgagccactt

SEQ ID NO: 65687 - DNA, 16 bp, H. sapiens
cagatgtgagcccctg

SEQ ID NO: 65688 - DNA, 16 bp, H. sapiens
cagatgtgatggaaat

SEQ ID NO: 65689 - DNA, 16 bp, H. sapiens
cagatgtgcatcacca

SEQ ID NO: 65690 - DNA, 16 bp, H. sapiens
cagatgtggaaacaga

SEQ ID NO: 65691 - DNA, 16 bp, H. sapiens
cagatgtggtggtgca

SEQ ID NO: 65692 - DNA, 16 bp, H. sapiens
cagatgtgtttcagaa

SEQ ID NO: 65693 - DNA, 16 bp, H. sapiens
cagatgttctccatga

SEQ ID NO: 65694 - DNA, 16 bp, H. sapiens
cagattaaaagcacaa

SEQ ID NO: 65695 - DNA, 16 bp, H. sapiens
cagattaacagcagat

SEQ ID NO: 65696 - DNA, 16 bp, H. sapiens
cagattaattggagaa

SEQ ID NO: 65697 - DNA, 16 bp, H. sapiens
cagattagaaaactga

SEQ ID NO: 65698 - DNA, 16 bp, H. sapiens
cagattaggagaaaat

SEQ ID NO: 65699 - DNA, 16 bp, H. sapiens
cagattcaacaaaaag

SEQ ID NO: 65700 - DNA, 16 bp, H. sapiens
cagattcaagaagctg

SEQ ID NO: 65701 - DNA, 16 bp, H. sapiens
cagattcacacataac

SEQ ID NO: 65702 - DNA, 16 bp, H. sapiens
cagattcacagagact

SEQ ID NO: 65703 - DNA, 20 bp, H. sapiens
cagattcaccaaagctgaaa

SEQ ID NO: 65704 - DNA, 16 bp, H. sapiens
cagattcaccaatgtt

SEQ ID NO: 65705 - DNA, 16 bp, H. sapiens
cagattcagagagatt

SEQ ID NO: 65706 - DNA, 16 bp, H. sapiens
cagattcagtgcaatc

SEQ ID NO: 65707 - DNA, 16 bp, H. sapiens
cagattcataaaacaa

SEQ ID NO: 65708 - DNA, 16 bp, H. sapiens
cagattcataaagtaa

SEQ ID NO: 65709 - DNA, 16 bp, H. sapiens
cagattcatgaaacaa

SEQ ID NO: 65710 - DNA, 16 bp, H. sapiens
cagattccatctcaag

SEQ ID NO: 65711 - DNA, 16 bp, H. sapiens
cagattcctgggcctc

SEQ ID NO: 65712 - DNA, 16 bp, H. sapiens
cagattcctgggtccc

SEQ ID NO: 65713 - DNA, 16 bp, H. sapiens
cagattctacaaatac

SEQ ID NO: 65714 - DNA, 16 bp, H. sapiens
cagattctctctctct

SEQ ID NO: 65715 - DNA, 16 bp, H. sapiens
cagattctgaattcca

SEQ ID NO: 65716 - DNA, 16 bp, H. sapiens
cagattctgggtatta

SEQ ID NO: 65717 - DNA, 16 bp, H. sapiens
cagattcttccctaga

SEQ ID NO: 65718 - DNA, 19 bp, H. sapiens
cagattgagaccatcctgg

SEQ ID NO: 65719 - DNA, 16 bp, H. sapiens
cagattggattaaaaa

SEQ ID NO: 65720 - DNA, 16 bp, H. sapiens
cagattgtaaatattt

SEQ ID NO: 65721 - DNA, 19 bp, H. sapiens
cagattgtgccactgcact

SEQ ID NO: 65722 - DNA, 16 bp, H. sapiens
cagatttaaaaacaaa

SEQ ID NO: 65723 - DNA, 16 bp, H. sapiens
cagatttattttttaa

SEQ ID NO: 65724 - DNA, 16 bp, H. sapiens
cagatttctcaggaga

SEQ ID NO: 65725 - DNA, 16 bp, H. sapiens
cagatttctgtttata

SEQ ID NO: 65726 - DNA, 16 bp, H. sapiens
cagatttcttttcttt

SEQ ID NO: 65727 - DNA, 16 bp, H. sapiens
cagatttgccctgagc

SEQ ID NO: 65728 - DNA, 16 bp, H. sapiens
cagatttgccttttct

SEQ ID NO: 65729 - DNA, 16 bp, H. sapiens
cagatttggagaaaat

SEQ ID NO: 65730 - DNA, 16 bp, H. sapiens
cagatttggcaaataa

SEQ ID NO: 65731 - DNA, 16 bp, H. sapiens
cagatttggtttcaga

SEQ ID NO: 65732 - DNA, 16 bp, H. sapiens
cagatttgttgtctgg

SEQ ID NO: 65733 - DNA, 16 bp, H. sapiens
cagattttaaaaaaaa

SEQ ID NO: 65734 - DNA, 16 bp, H. sapiens
cagattttaaaaacaa

SEQ ID NO: 65735 - DNA, 16 bp, H. sapiens
cagattttaaaaatac

SEQ ID NO: 65736 - DNA, 16 bp, H. sapiens
cagattttcaccatgt

SEQ ID NO: 65737 - DNA, 16 bp, H. sapiens
cagattttccatttct

SEQ ID NO: 65738 - DNA, 16 bp, H. sapiens
cagattttcttttctt

SEQ ID NO: 65739 - DNA, 16 bp, H. sapiens
cagattttggactttc

SEQ ID NO: 65740 - DNA, 16 bp, H. sapiens
cagattttggattttc

SEQ ID NO: 65741 - DNA, 16 bp, H. sapiens
cagattttggattttt

SEQ ID NO: 65742 - DNA, 16 bp, H. sapiens
cagattttggtttcta

SEQ ID NO: 65743 - DNA, 16 bp, H. sapiens
cagattttgtgtgtgt

SEQ ID NO: 65744 - DNA, 16 bp, H. sapiens
cagatttttaaaaaat

SEQ ID NO: 65745 - DNA, 16 bp, H. sapiens
cagatttttaaaattt

SEQ ID NO: 65746 - DNA, 16 bp, H. sapiens
cagatttttattgaac

SEQ ID NO: 65747 - DNA, 16 bp, H. sapiens
cagatttttgttgttg

SEQ ID NO: 65748 - DNA, 16 bp, H. sapiens
cagatttttttcccca

SEQ ID NO: 65749 - DNA, 16 bp, H. sapiens
cagatttttttcctat

SEQ ID NO: 65750 - DNA, 16 bp, H. sapiens
cagattttttttaaaa

SEQ ID NO: 65751 - DNA, 16 bp, H. sapiens
cagattttttttttaa

SEQ ID NO: 65752 - DNA, 16 bp, H. sapiens
cagcaaaagaaaatac

SEQ ID NO: 65753 - DNA, 16 bp, H. sapiens
cagcaaaagaaacgat

SEQ ID NO: 65754 - DNA, 16 bp, H. sapiens
cagcaaaagaaagaat

SEQ ID NO: 65755 - DNA, 16 bp, H. sapiens
cagcaaaatactagca

SEQ ID NO: 65756 - DNA, 16 bp, H. sapiens
cagcaaaatcaccaac

SEQ ID NO: 65757 - DNA, 16 bp, H. sapiens
cagcaaaattgacaaa

SEQ ID NO: 65758 - DNA, 16 bp, H. sapiens
cagcaaacacatgaaa

SEQ ID NO: 65759 - DNA, 18 bp, H. sapiens
cagcaaaccaccatggca

SEQ ID NO: 65760 - DNA, 16 bp, H. sapiens
cagcaaaccaccttgg

SEQ ID NO: 65761 - DNA, 16 bp, H. sapiens
cagcaaaccagtcatt

SEQ ID NO: 65762 - DNA, 16 bp, H. sapiens
cagcaaactaacacca

SEQ ID NO: 65763 - DNA, 16 bp, H. sapiens
cagcaaacttctcagc

SEQ ID NO: 65764 - DNA, 16 bp, H. sapiens
cagcaaagaaaatgaa

SEQ ID NO: 65765 - DNA, 16 bp, H. sapiens
cagcaaagaattatcc

SEQ ID NO: 65766 - DNA, 16 bp, H. sapiens
cagcaaagcatttctg

SEQ ID NO: 65767 - DNA, 16 bp, H. sapiens
cagcaaagccaattta

SEQ ID NO: 65768 - DNA, 16 bp, H. sapiens
cagcaaagccagccaa

SEQ ID NO: 65769 - DNA, 16 bp, H. sapiens
cagcaaaggagatgca

SEQ ID NO: 65770 - DNA, 16 bp, H. sapiens
cagcaaaggaggctga

SEQ ID NO: 65771 - DNA, 26 bp, H. sapiens
cagcaaaggcaggctatgctatagta

SEQ ID NO: 65772 - DNA, 16 bp, H. sapiens
cagcaaaggctcagga

SEQ ID NO: 65773 - DNA, 16 bp, H. sapiens
cagcaaagggaaaagg

SEQ ID NO: 65774 - DNA, 16 bp, H. sapiens
cagcaaagttcattat

SEQ ID NO: 65775 - DNA, 16 bp, H. sapiens
cagcaaataaaacaat

SEQ ID NO: 65776 - DNA, 16 bp, H. sapiens
cagcaaataaatgaaa

SEQ ID NO: 65777 - DNA, 16 bp, H. sapiens
cagcaaataatttttt

SEQ ID NO: 65778 - DNA, 16 bp, H. sapiens
cagcaaatctctagaa

SEQ ID NO: 65779 - DNA, 16 bp, H. sapiens
cagcaaatgcaaaaga

SEQ ID NO: 65780 - DNA, 16 bp, H. sapiens
cagcaaattaaaacaa

SEQ ID NO: 65781 - DNA, 16 bp, H. sapiens
cagcaaattatccaga

SEQ ID NO: 65782 - DNA, 16 bp, H. sapiens
cagcaacaaaaacaat

SEQ ID NO: 65783 - DNA, 16 bp, H. sapiens
cagcaacaccccactc

SEQ ID NO: 65784 - DNA, 16 bp, H. sapiens
cagcaacagaaaatga

SEQ ID NO: 65785 - DNA, 16 bp, H. sapiens
cagcaacagagaccaa

SEQ ID NO: 65786 - DNA, 16 bp, H. sapiens
cagcaacagcaacagc

SEQ ID NO: 65787 - DNA, 16 bp, H. sapiens
cagcaacagcagcaac

SEQ ID NO: 65788 - DNA, 16 bp, H. sapiens
cagcaacatagatgaa

SEQ ID NO: 65789 - DNA, 16 bp, H. sapiens
cagcaacatagatgga

SEQ ID NO: 65790 - DNA, 16 bp, H. sapiens
cagcaacatcaacaaa

SEQ ID NO: 65791 - DNA, 16 bp, H. sapiens
cagcaacatgaaaatg

SEQ ID NO: 65792 - DNA, 16 bp, H. sapiens
cagcaacatgaatgaa

SEQ ID NO: 65793 - DNA, 16 bp, H. sapiens
cagcaacatggatgga

SEQ ID NO: 65794 - DNA, 16 bp, H. sapiens
cagcaacatttactgt

SEQ ID NO: 65795 - DNA, 16 bp, H. sapiens
cagcaacatttgctgc

SEQ ID NO: 65796 - DNA, 16 bp, H. sapiens
cagcaaccccactgct

SEQ ID NO: 65797 - DNA, 16 bp, H. sapiens
cagcaaccctggcctc

SEQ ID NO: 65798 - DNA, 16 bp, H. sapiens
cagcaacctcagttct

SEQ ID NO: 65799 - DNA, 16 bp, H. sapiens
cagcaacctggatgaa

SEQ ID NO: 65800 - DNA, 16 bp, H. sapiens
cagcaacctggatgga

SEQ ID NO: 65801 - DNA, 16 bp, H. sapiens
cagcaactccggaggc

SEQ ID NO: 65802 - DNA, 16 bp, H. sapiens
cagcaactgcaaaaga

SEQ ID NO: 65803 - DNA, 16 bp, H. sapiens
cagcaacttcaaagat

SEQ ID NO: 65804 - DNA, 16 bp, H. sapiens
cagcaagaaaaaagtg

SEQ ID NO: 65805 - DNA, 16 bp, H. sapiens
cagcaagaaaaactca

SEQ ID NO: 65806 - DNA, 16 bp, H. sapiens
cagcaagaaaacaaat

SEQ ID NO: 65807 - DNA, 16 bp, H. sapiens
cagcaagaagaaatga

SEQ ID NO: 65808 - DNA, 16 bp, H. sapiens
cagcaagaagacagct

SEQ ID NO: 65809 - DNA, 16 bp, H. sapiens
cagcaagacactgtct

SEQ ID NO: 65810 - DNA, 16 bp, H. sapiens
cagcaagaccaacaca

SEQ ID NO: 65811 - DNA, 16 bp, H. sapiens
cagcaagacccccatc

SEQ ID NO: 65812 - DNA, 16 bp, H. sapiens
cagcaagacctcgtct

SEQ ID NO: 65813 - DNA, 23 bp, H. sapiens
cagcaagactctgtctcaaaaaa

SEQ ID NO: 65814 - DNA, 16 bp, H. sapiens
cagcaagaggatatga

SEQ ID NO: 65815 - DNA, 16 bp, H. sapiens
cagcaagatggcagag

SEQ ID NO: 65816 - DNA, 16 bp, H. sapiens
cagcaagcaaagccag

SEQ ID NO: 65817 - DNA, 16 bp, H. sapiens
cagcaagccagcttat

SEQ ID NO: 65818 - DNA, 17 bp, H. sapiens
cagcaagccccgcccaa

SEQ ID NO: 65819 - DNA, 16 bp, H. sapiens
cagcaaggagaagaat

SEQ ID NO: 65820 - DNA, 16 bp, H. sapiens
cagcaaggccccatct

SEQ ID NO: 65821 - DNA, 16 bp, H. sapiens
cagcaaggccctgtct

SEQ ID NO: 65822 - DNA, 16 bp, H. sapiens
cagcaagggaacaaaa

SEQ ID NO: 65823 - DNA, 16 bp, H. sapiens
cagcaagtatttattg

SEQ ID NO: 65824 - DNA, 16 bp, H. sapiens
cagcaagtatttgttg

SEQ ID NO: 65825 - DNA, 16 bp, H. sapiens
cagcaagtgcaaaggc

SEQ ID NO: 65826 - DNA, 16 bp, H. sapiens
cagcaagttcctcatc

SEQ ID NO: 65827 - DNA, 16 bp, H. sapiens
cagcaagttgggaggc

SEQ ID NO: 65828 - DNA, 16 bp, H. sapiens
cagcaagttttattaa

SEQ ID NO: 65829 - DNA, 16 bp, H. sapiens
cagcaataaggtcaga

SEQ ID NO: 65830 - DNA, 16 bp, H. sapiens
cagcaataataataat

SEQ ID NO: 65831 - DNA, 16 bp, H. sapiens
cagcaatattttgcag

SEQ ID NO: 65832 - DNA, 16 bp, H. sapiens
cagcaatattttttaa

SEQ ID NO: 65833 - DNA, 16 bp, H. sapiens
cagcaatcccattact

SEQ ID NO: 65834 - DNA, 16 bp, H. sapiens
cagcaatcctacttct

SEQ ID NO: 65835 - DNA, 16 bp, H. sapiens
cagcaatccttccacc

SEQ ID NO: 65836 - DNA, 16 bp, H. sapiens
cagcaatgaaaataaa

SEQ ID NO: 65837 - DNA, 16 bp, H. sapiens
cagcaatgaatgagaa

SEQ ID NO: 65838 - DNA, 16 bp, H. sapiens
cagcaatgaatgagag

SEQ ID NO: 65839 - DNA, 16 bp, H. sapiens
cagcaatgcacaagag

SEQ ID NO: 65840 - DNA, 16 bp, H. sapiens
cagcaatgtaggagag

SEQ ID NO: 65841 - DNA, 16 bp, H. sapiens
cagcaattcaggaggc

SEQ ID NO: 65842 - DNA, 16 bp, H. sapiens
cagcaattccaccact

SEQ ID NO: 65843 - DNA, 16 bp, H. sapiens
cagcaattgcactcct

SEQ ID NO: 65844 - DNA, 16 bp, H. sapiens
cagcaattgcactctt

SEQ ID NO: 65845 - DNA, 16 bp, H. sapiens
cagcaatttcagaggc

SEQ ID NO: 65846 - DNA, 16 bp, H. sapiens
cagcacaaaaatagag

SEQ ID NO: 65847 - DNA, 16 bp, H. sapiens
cagcacaaacagcctg

SEQ ID NO: 65848 - DNA, 16 bp, H. sapiens
cagcacaagaaagacc

SEQ ID NO: 65849 - DNA, 16 bp, H. sapiens
cagcacacaccagggc

SEQ ID NO: 65850 - DNA, 16 bp, H. sapiens
cagcacacactcccca

SEQ ID NO: 65851 - DNA, 16 bp, H. sapiens
cagcacacagtaggca

SEQ ID NO: 65852 - DNA, 16 bp, H. sapiens
cagcacaccagcatgg

SEQ ID NO: 65853 - DNA, 16 bp, H. sapiens
cagcacaccagtgggt

SEQ ID NO: 65854 - DNA, 17 bp, H. sapiens
cagcacaccatcatggc

SEQ ID NO: 65855 - DNA, 16 bp, H. sapiens
cagcacacctggctaa

SEQ ID NO: 65856 - DNA, 16 bp, H. sapiens
cagcacactgcagcct

SEQ ID NO: 65857 - DNA, 16 bp, H. sapiens
cagcacagaagaaaga

SEQ ID NO: 65858 - DNA, 16 bp, H. sapiens
cagcacagagaggtta

SEQ ID NO: 65859 - DNA, 16 bp, H. sapiens
cagcacagcacctggc

SEQ ID NO: 65860 - DNA, 16 bp, H. sapiens
cagcacagcactgggt

SEQ ID NO: 65861 - DNA, 16 bp, H. sapiens
cagcacagcagtctga

SEQ ID NO: 65862 - DNA, 16 bp, H. sapiens
cagcacagctgctgtg

SEQ ID NO: 65863 - DNA, 16 bp, H. sapiens
cagcacaggagaaaga

SEQ ID NO: 65864 - DNA, 16 bp, H. sapiens
cagcacagtccagcct

SEQ ID NO: 65865 - DNA, 16 bp, H. sapiens
cagcacagtgcctggc

SEQ ID NO: 65866 - DNA, 16 bp, H. sapiens
cagcacataaaaaagc

SEQ ID NO: 65867 - DNA, 16 bp, H. sapiens
cagcacataggcatgg

SEQ ID NO: 65868 - DNA, 16 bp, H. sapiens
cagcacatcaaaaata

SEQ ID NO: 65869 - DNA, 16 bp, H. sapiens
cagcacatctcagttc

SEQ ID NO: 65870 - DNA, 16 bp, H. sapiens
cagcaccaagaagatg

SEQ ID NO: 65871 - DNA, 16 bp, H. sapiens
cagcaccaagagtgaa

SEQ ID NO: 65872 - DNA, 16 bp, H. sapiens
cagcaccacctcctcc

SEQ ID NO: 65873 - DNA, 16 bp, H. sapiens
cagcaccacctgggaa

SEQ ID NO: 65874 - DNA, 16 bp, H. sapiens
cagcaccagcagcacc

SEQ ID NO: 65875 - DNA, 16 bp, H. sapiens
cagcaccagcagcagc

SEQ ID NO: 65876 - DNA, 16 bp, H. sapiens
cagcaccagctctgat

SEQ ID NO: 65877 - DNA, 16 bp, H. sapiens
cagcaccagttattga

SEQ ID NO: 65878 - DNA, 16 bp, H. sapiens
cagcaccatgcccggc

SEQ ID NO: 65879 - DNA, 16 bp, H. sapiens
cagcaccatggacagc

SEQ ID NO: 65880 - DNA, 16 bp, H. sapiens
cagcaccattgttgaa

SEQ ID NO: 65881 - DNA, 16 bp, H. sapiens
cagcacccaagtcacc

SEQ ID NO: 65882 - DNA, 16 bp, H. sapiens
cagcacccagcacagg

SEQ ID NO: 65883 - DNA, 16 bp, H. sapiens
cagcacccagtcccat

SEQ ID NO: 65884 - DNA, 16 bp, H. sapiens
cagcaccccactcctg

SEQ ID NO: 65885 - DNA, 16 bp, H. sapiens
cagcacccccagcctc

SEQ ID NO: 65886 - DNA, 16 bp, H. sapiens
cagcaccgcggacagc

SEQ ID NO: 65887 - DNA, 16 bp, H. sapiens
cagcacctagaatagt

SEQ ID NO: 65888 - DNA, 16 bp, H. sapiens
cagcacctccttggcc

SEQ ID NO: 65889 - DNA, 16 bp, H. sapiens
cagcacctctggaccc

SEQ ID NO: 65890 - DNA, 16 bp, H. sapiens
cagcacctgctctgat

SEQ ID NO: 65891 - DNA, 16 bp, H. sapiens
cagcacctggatcttg

SEQ ID NO: 65892 - DNA, 16 bp, H. sapiens
cagcacctggcccagg

SEQ ID NO: 65893 - DNA, 16 bp, H. sapiens
cagcacctgggaggcc

SEQ ID NO: 65894 - DNA, 16 bp, H. sapiens
cagcacctgggtggct

SEQ ID NO: 65895 - DNA, 16 bp, H. sapiens
cagcacgttgggaggc

SEQ ID NO: 65896 - DNA, 16 bp, H. sapiens
cagcactatacacaat

SEQ ID NO: 65897 - DNA, 16 bp, H. sapiens
cagcactatgggaggt

SEQ ID NO: 65898 - DNA, 16 bp, H. sapiens
cagcactatttattta

SEQ ID NO: 65899 - DNA, 16 bp, H. sapiens
cagcactccagccttg

SEQ ID NO: 65900 - DNA, 16 bp, H. sapiens
cagcactcccgcctgg

SEQ ID NO: 65901 - DNA, 16 bp, H. sapiens
cagcactctaggaggc

SEQ ID NO: 65902 - DNA, 16 bp, H. sapiens
cagcactctgggaggc

SEQ ID NO: 65903 - DNA, 16 bp, H. sapiens
cagcactgagctgccc

SEQ ID NO: 65904 - DNA, 16 bp, H. sapiens
cagcactgcaccccag

SEQ ID NO: 65905 - DNA, 16 bp, H. sapiens
cagcactgccctagca

SEQ ID NO: 65906 - DNA, 16 bp, H. sapiens
cagcactgccggccca

SEQ ID NO: 65907 - DNA, 16 bp, H. sapiens
cagcactgtccagtag

SEQ ID NO: 65908 - DNA, 21 bp, H. sapiens
cagcactgtgggaggccaagg

SEQ ID NO: 65909 - DNA, 16 bp, H. sapiens
cagcacttcaggaggt

SEQ ID NO: 65910 - DNA, 16 bp, H. sapiens
cagcacttctcaaact

SEQ ID NO: 65911 - DNA, 16 bp, H. sapiens
cagcacttggagaggc

SEQ ID NO: 65912 - DNA, 16 bp, H. sapiens
cagcactttacagttt

SEQ ID NO: 65913 - DNA, 16 bp, H. sapiens
cagcactttattcctt

SEQ ID NO: 65914 - DNA, 16 bp, H. sapiens
cagcactttctgaggc

SEQ ID NO: 65915 - DNA, 16 bp, H. sapiens
cagcactttctgcttc

SEQ ID NO: 65916 - DNA, 16 bp, H. sapiens
cagcactttgagaagg

SEQ ID NO: 65917 - DNA, 16 bp, H. sapiens
cagcactttgagaggc

SEQ ID NO: 65918 - DNA, 16 bp, H. sapiens
cagcactttggaaggc

SEQ ID NO: 65919 - DNA, 22 bp, H. sapiens
cagcactttgggaggcagaggc

SEQ ID NO: 65920 - DNA, 26 bp, H. sapiens
cagcactttgggaggctgaagcagga

SEQ ID NO: 65921 - DNA, 16 bp, H. sapiens
cagcactttggggagg

SEQ ID NO: 65922 - DNA, 16 bp, H. sapiens
cagcactttggggggc

SEQ ID NO: 65923 - DNA, 16 bp, H. sapiens
cagcactttgggtggt

SEQ ID NO: 65924 - DNA, 16 bp, H. sapiens
cagcactttgtggggg

SEQ ID NO: 65925 - DNA, 16 bp, H. sapiens
cagcacttttggaagc

SEQ ID NO: 65926 - DNA, 16 bp, H. sapiens
cagcactttttttttt

SEQ ID NO: 65927 - DNA, 16 bp, H. sapiens
cagcagaaaagaatgt

SEQ ID NO: 65928 - DNA, 16 bp, H. sapiens
cagcagaaaagctgaa

SEQ ID NO: 65929 - DNA, 16 bp, H. sapiens
cagcagaaacttattt

SEQ ID NO: 65930 - DNA, 16 bp, H. sapiens
cagcagaaaggccctg

SEQ ID NO: 65931 - DNA, 16 bp, H. sapiens
cagcagaagcagatgc

SEQ ID NO: 65932 - DNA, 16 bp, H. sapiens
cagcagaaggtgaagg

SEQ ID NO: 65933 - DNA, 16 bp, H. sapiens
cagcagaatacatatt

SEQ ID NO: 65934 - DNA, 16 bp, H. sapiens
cagcagaatctcttga

SEQ ID NO: 65935 - DNA, 16 bp, H. sapiens
cagcagaatggcttga

SEQ ID NO: 65936 - DNA, 16 bp, H. sapiens
cagcagacagcttctc

SEQ ID NO: 65937 - DNA, 16 bp, H. sapiens
cagcagacctgcagaa

SEQ ID NO: 65938 - DNA, 16 bp, H. sapiens
cagcagagagaagacc

SEQ ID NO: 65939 - DNA, 16 bp, H. sapiens
cagcagagagaagaga

SEQ ID NO: 65940 - DNA, 16 bp, H. sapiens
cagcagagagagagag

SEQ ID NO: 65941 - DNA, 16 bp, H. sapiens
cagcagagaggaggag

SEQ ID NO: 65942 - DNA, 16 bp, H. sapiens
cagcagagaggaggcc

SEQ ID NO: 65943 - DNA, 16 bp, H. sapiens
cagcagagaggcctga

SEQ ID NO: 65944 - DNA, 16 bp, H. sapiens
cagcagagcaagaccc

SEQ ID NO: 65945 - DNA, 16 bp, H. sapiens
cagcagagcagcagag

SEQ ID NO: 65946 - DNA, 16 bp, H. sapiens
cagcagagcagccact

SEQ ID NO: 65947 - DNA, 16 bp, H. sapiens
cagcagagcagctgct

SEQ ID NO: 65948 - DNA, 16 bp, H. sapiens
cagcagagccctcctg

SEQ ID NO: 65949 - DNA, 16 bp, H. sapiens
cagcagagctgagatt

SEQ ID NO: 65950 - DNA, 16 bp, H. sapiens
cagcagaggagaaaga

SEQ ID NO: 65951 - DNA, 16 bp, H. sapiens
cagcagaggaggagga

SEQ ID NO: 65952 - DNA, 16 bp, H. sapiens
cagcagaggcaaagca

SEQ ID NO: 65953 - DNA, 16 bp, H. sapiens
cagcagaggctgcaga

SEQ ID NO: 65954 - DNA, 16 bp, H. sapiens
cagcagaggcttcaga

SEQ ID NO: 65955 - DNA, 16 bp, H. sapiens
cagcagaggggccctg

SEQ ID NO: 65956 - DNA, 16 bp, H. sapiens
cagcagaggggcctga

SEQ ID NO: 65957 - DNA, 16 bp, H. sapiens
cagcagagttgagtag

SEQ ID NO: 65958 - DNA, 16 bp, H. sapiens
cagcagatcaaaaagc

SEQ ID NO: 65959 - DNA, 16 bp, H. sapiens
cagcagatcctgacaa

SEQ ID NO: 65960 - DNA, 16 bp, H. sapiens
cagcagattcagagac

SEQ ID NO: 65961 - DNA, 16 bp, H. sapiens
cagcagcaacagcagc

SEQ ID NO: 65962 - DNA, 16 bp, H. sapiens
cagcagcaacctgctc

SEQ ID NO: 65963 - DNA, 16 bp, H. sapiens
cagcagcaagacttat

SEQ ID NO: 65964 - DNA, 16 bp, H. sapiens
cagcagcaataggaaa

SEQ ID NO: 65965 - DNA, 16 bp, H. sapiens
cagcagcaccagctcc

SEQ ID NO: 65966 - DNA, 16 bp, H. sapiens
cagcagcacccagatt

SEQ ID NO: 65967 - DNA, 16 bp, H. sapiens
cagcagcacctgggaa

SEQ ID NO: 65968 - DNA, 16 bp, H. sapiens
cagcagcagaccatcc

SEQ ID NO: 65969 - DNA, 16 bp, H. sapiens
cagcagcagagaccaa

SEQ ID NO: 65970 - DNA, 16 bp, H. sapiens
cagcagcagagctgag

SEQ ID NO: 65971 - DNA, 16 bp, H. sapiens
cagcagcagaggctgc

SEQ ID NO: 65972 - DNA, 16 bp, H. sapiens
cagcagcagaggggcc

SEQ ID NO: 65973 - DNA, 16 bp, H. sapiens
cagcagcagcaacagt

SEQ ID NO: 65974 - DNA, 16 bp, H. sapiens
cagcagcagcaacatc

SEQ ID NO: 65975 - DNA, 16 bp, H. sapiens
cagcagcagcaacccg

SEQ ID NO: 65976 - DNA, 16 bp, H. sapiens
cagcagcagcaacctg

SEQ ID NO: 65977 - DNA, 16 bp, H. sapiens
cagcagcagcagaaaa

SEQ ID NO: 65978 - DNA, 16 bp, H. sapiens
cagcagcagcagaaga

SEQ ID NO: 65979 - DNA, 16 bp, H. sapiens
cagcagcagcagagag

SEQ ID NO: 65980 - DNA, 16 bp, H. sapiens
cagcagcagcagcaaa

SEQ ID NO: 65981 - DNA, 16 bp, H. sapiens
cagcagcagcagcaag

SEQ ID NO: 65982 - DNA, 16 bp, H. sapiens
cagcagcagcagcaca

SEQ ID NO: 65983 - DNA, 16 bp, H. sapiens
cagcagcagcagcagc

SEQ ID NO: 65984 - DNA, 16 bp, H. sapiens
cagcagcagcagcata

SEQ ID NO: 65985 - DNA, 16 bp, H. sapiens
cagcagcagcagcatt

SEQ ID NO: 65986 - DNA, 16 bp, H. sapiens
cagcagcagcagcccc

SEQ ID NO: 65987 - DNA, 16 bp, H. sapiens
cagcagcagcagcctc

SEQ ID NO: 65988 - DNA, 16 bp, H. sapiens
cagcagcagcagcctg

SEQ ID NO: 65989 - DNA, 16 bp, H. sapiens
cagcagcagcagctgg

SEQ ID NO: 65990 - DNA, 16 bp, H. sapiens
cagcagcagcagctgt

SEQ ID NO: 65991 - DNA, 16 bp, H. sapiens
cagcagcagcagcttc

SEQ ID NO: 65992 - DNA, 16 bp, H. sapiens
cagcagcagcaggaag

SEQ ID NO: 65993 - DNA, 16 bp, H. sapiens
cagcagcagcagggca

SEQ ID NO: 65994 - DNA, 16 bp, H. sapiens
cagcagcagcagtagc

SEQ ID NO: 65995 - DNA, 16 bp, H. sapiens
cagcagcagcagtggg

SEQ ID NO: 65996 - DNA, 16 bp, H. sapiens
cagcagcagcatcacc

SEQ ID NO: 65997 - DNA, 16 bp, H. sapiens
cagcagcagccacagc

SEQ ID NO: 65998 - DNA, 16 bp, H. sapiens
cagcagcagccaggca

SEQ ID NO: 65999 - DNA, 16 bp, H. sapiens
cagcagcagcccatct

SEQ ID NO: 66000 - DNA, 16 bp, H. sapiens
cagcagcagccgctgc

SEQ ID NO: 66001 - DNA, 16 bp, H. sapiens
cagcagcagcggcagc

SEQ ID NO: 66002 - DNA, 16 bp, H. sapiens
cagcagcagctgcaga

SEQ ID NO: 66003 - DNA, 16 bp, H. sapiens
cagcagcaggactgag

SEQ ID NO: 66004 - DNA, 16 bp, H. sapiens
cagcagcaggctgaag

SEQ ID NO: 66005 - DNA, 16 bp, H. sapiens
cagcagcagggccagg

SEQ ID NO: 66006 - DNA, 16 bp, H. sapiens
cagcagcagggctgcc

SEQ ID NO: 66007 - DNA, 16 bp, H. sapiens
cagcagcagtccccaa

SEQ ID NO: 66008 - DNA, 16 bp, H. sapiens
cagcagcagtgctctg

SEQ ID NO: 66009 - DNA, 16 bp, H. sapiens
cagcagcagtggcagc

SEQ ID NO: 66010 - DNA, 17 bp, H. sapiens
cagcagcagtggctgca

SEQ ID NO: 66011 - DNA, 16 bp, H. sapiens
cagcagcagtgttcta

SEQ ID NO: 66012 - DNA, 16 bp, H. sapiens
cagcagcatcaccatc

SEQ ID NO: 66013 - DNA, 16 bp, H. sapiens
cagcagcatcagcagc

SEQ ID NO: 66014 - DNA, 16 bp, H. sapiens
cagcagcatccctggc

SEQ ID NO: 66015 - DNA, 16 bp, H. sapiens
cagcagcatctgcttc

SEQ ID NO: 66016 - DNA, 16 bp, H. sapiens
cagcagcatgaaagca

SEQ ID NO: 66017 - DNA, 16 bp, H. sapiens
cagcagcattggcatc

SEQ ID NO: 66018 - DNA, 16 bp, H. sapiens
cagcagccacaagaaa

SEQ ID NO: 66019 - DNA, 16 bp, H. sapiens
cagcagccacagcagt

SEQ ID NO: 66020 - DNA, 16 bp, H. sapiens
cagcagccacagccag

SEQ ID NO: 66021 - DNA, 16 bp, H. sapiens
cagcagccacaggcct

SEQ ID NO: 66022 - DNA, 16 bp, H. sapiens
cagcagccaccaccct

SEQ ID NO: 66023 - DNA, 16 bp, H. sapiens
cagcagccagaatgat

SEQ ID NO: 66024 - DNA, 16 bp, H. sapiens
cagcagccagcagcag

SEQ ID NO: 66025 - DNA, 16 bp, H. sapiens
cagcagccagcagcca

SEQ ID NO: 66026 - DNA, 16 bp, H. sapiens
cagcagccaggcagag

SEQ ID NO: 66027 - DNA, 16 bp, H. sapiens
cagcagccatcaacat

SEQ ID NO: 66028 - DNA, 16 bp, H. sapiens
cagcagccatcttgtg

SEQ ID NO: 66029 - DNA, 16 bp, H. sapiens
cagcagcccaagctgt

SEQ ID NO: 66030 - DNA, 16 bp, H. sapiens
cagcagcccagcagcc

SEQ ID NO: 66031 - DNA, 16 bp, H. sapiens
cagcagccccaccctc

SEQ ID NO: 66032 - DNA, 16 bp, H. sapiens
cagcagccccagccag

SEQ ID NO: 66033 - DNA, 16 bp, H. sapiens
cagcagccccaggaaa

SEQ ID NO: 66034 - DNA, 16 bp, H. sapiens
cagcagccccaggaag

SEQ ID NO: 66035 - DNA, 16 bp, H. sapiens
cagcagccccaggagg

SEQ ID NO: 66036 - DNA, 16 bp, H. sapiens
cagcagcccctcccca

SEQ ID NO: 66037 - DNA, 16 bp, H. sapiens
cagcagcccctgcccc

SEQ ID NO: 66038 - DNA, 16 bp, H. sapiens
cagcagccctcggggc

SEQ ID NO: 66039 - DNA, 16 bp, H. sapiens
cagcagccctgggaaa

SEQ ID NO: 66040 - DNA, 16 bp, H. sapiens
cagcagccctgggaag

SEQ ID NO: 66041 - DNA, 16 bp, H. sapiens
cagcagccctgggagg

SEQ ID NO: 66042 - DNA, 16 bp, H. sapiens
cagcagcccttgagcc

SEQ ID NO: 66043 - DNA, 16 bp, H. sapiens
cagcagcctcaacctc

SEQ ID NO: 66044 - DNA, 16 bp, H. sapiens
cagcagcctcagcatc

SEQ ID NO: 66045 - DNA, 16 bp, H. sapiens
cagcagcctcagcctc

SEQ ID NO: 66046 - DNA, 16 bp, H. sapiens
cagcagcctcctccct

SEQ ID NO: 66047 - DNA, 16 bp, H. sapiens
cagcagcctctagaag

SEQ ID NO: 66048 - DNA, 16 bp, H. sapiens
cagcagcctgagccac

SEQ ID NO: 66049 - DNA, 16 bp, H. sapiens
cagcagcctgcagcct

SEQ ID NO: 66050 - DNA, 17 bp, H. sapiens
cagcagcggtggctgca

SEQ ID NO: 66051 - DNA, 16 bp, H. sapiens
cagcagcgtgatcttg

SEQ ID NO: 66052 - DNA, 16 bp, H. sapiens
cagcagctcaaggagg

SEQ ID NO: 66053 - DNA, 16 bp, H. sapiens
cagcagctcaagggcc

SEQ ID NO: 66054 - DNA, 16 bp, H. sapiens
cagcagctcacgcctg

SEQ ID NO: 66055 - DNA, 16 bp, H. sapiens
cagcagctcaggctcc

SEQ ID NO: 66056 - DNA, 16 bp, H. sapiens
cagcagctcatgcctg

SEQ ID NO: 66057 - DNA, 16 bp, H. sapiens
cagcagctccctgctg

SEQ ID NO: 66058 - DNA, 16 bp, H. sapiens
cagcagctgcagcaag

SEQ ID NO: 66059 - DNA, 16 bp, H. sapiens
cagcagctgcagctgc

SEQ ID NO: 66060 - DNA, 16 bp, H. sapiens
cagcagctgcaggaag

SEQ ID NO: 66061 - DNA, 16 bp, H. sapiens
cagcagctgcagttgg

SEQ ID NO: 66062 - DNA, 16 bp, H. sapiens
cagcagctgccaggga

SEQ ID NO: 66063 - DNA, 16 bp, H. sapiens
cagcagctgctccaga

SEQ ID NO: 66064 - DNA, 16 bp, H. sapiens
cagcagctgctgcagg

SEQ ID NO: 66065 - DNA, 16 bp, H. sapiens
cagcagctgctgccct

SEQ ID NO: 66066 - DNA, 16 bp, H. sapiens
cagcagctgctgctgg

SEQ ID NO: 66067 - DNA, 16 bp, H. sapiens
cagcagctgctgtgct

SEQ ID NO: 66068 - DNA, 16 bp, H. sapiens
cagcagctgtggggtg

SEQ ID NO: 66069 - DNA, 16 bp, H. sapiens
cagcagcttgggctgc

SEQ ID NO: 66070 - DNA, 16 bp, H. sapiens
cagcagctttgccaag

SEQ ID NO: 66071 - DNA, 16 bp, H. sapiens
cagcaggaaggaggaa

SEQ ID NO: 66072 - DNA, 16 bp, H. sapiens
cagcaggaaggccctc

SEQ ID NO: 66073 - DNA, 16 bp, H. sapiens
cagcaggaagggccca

SEQ ID NO: 66074 - DNA, 16 bp, H. sapiens
cagcaggaaggggagc

SEQ ID NO: 66075 - DNA, 16 bp, H. sapiens
cagcaggacagaccca

SEQ ID NO: 66076 - DNA, 16 bp, H. sapiens
cagcaggaccctgggc

SEQ ID NO: 66077 - DNA, 16 bp, H. sapiens
cagcaggagagaaaga

SEQ ID NO: 66078 - DNA, 16 bp, H. sapiens
cagcaggagagagaaa

SEQ ID NO: 66079 - DNA, 16 bp, H. sapiens
cagcaggagagagaag

SEQ ID NO: 66080 - DNA, 16 bp, H. sapiens
cagcaggagagcagga

SEQ ID NO: 66081 - DNA, 16 bp, H. sapiens
cagcaggaggatataa

SEQ ID NO: 66082 - DNA, 16 bp, H. sapiens
cagcaggaggcagcca

SEQ ID NO: 66083 - DNA, 16 bp, H. sapiens
cagcaggaggtaattg

SEQ ID NO: 66084 - DNA, 16 bp, H. sapiens
cagcaggaggtgagct

SEQ ID NO: 66085 - DNA, 16 bp, H. sapiens
cagcaggatgaaaaca

SEQ ID NO: 66086 - DNA, 16 bp, H. sapiens
cagcaggatgtgggca

SEQ ID NO: 66087 - DNA, 16 bp, H. sapiens
cagcaggcaaagagag

SEQ ID NO: 66088 - DNA, 16 bp, H. sapiens
cagcaggcaagagaaa

SEQ ID NO: 66089 - DNA, 16 bp, H. sapiens
cagcaggcaagagaga

SEQ ID NO: 66090 - DNA, 16 bp, H. sapiens
cagcaggcagctgcag

SEQ ID NO: 66091 - DNA, 16 bp, H. sapiens
cagcaggcagctggag

SEQ ID NO: 66092 - DNA, 16 bp, H. sapiens
cagcaggcaggaagaa

SEQ ID NO: 66093 - DNA, 16 bp, H. sapiens
cagcaggcccctcctc

SEQ ID NO: 66094 - DNA, 16 bp, H. sapiens
cagcaggcctgagcaa

SEQ ID NO: 66095 - DNA, 16 bp, H. sapiens
cagcaggctctgccct

SEQ ID NO: 66096 - DNA, 16 bp, H. sapiens
cagcaggctgtcacct

SEQ ID NO: 66097 - DNA, 16 bp, H. sapiens
cagcaggcttcagaga

SEQ ID NO: 66098 - DNA, 16 bp, H. sapiens
cagcagggaggctggg

SEQ ID NO: 66099 - DNA, 16 bp, H. sapiens
cagcagggcagggagg

SEQ ID NO: 66100 - DNA, 16 bp, H. sapiens
cagcagggctggctgg

SEQ ID NO: 66101 - DNA, 16 bp, H. sapiens
cagcagggctggggga

SEQ ID NO: 66102 - DNA, 16 bp, H. sapiens
cagcaggggccacgtg

SEQ ID NO: 66103 - DNA, 16 bp, H. sapiens
cagcaggggctgcaga

SEQ ID NO: 66104 - DNA, 16 bp, H. sapiens
cagcaggggtgacaga

SEQ ID NO: 66105 - DNA, 16 bp, H. sapiens
cagcagggtagtcaaa

SEQ ID NO: 66106 - DNA, 16 bp, H. sapiens
cagcaggtcaaggctg

SEQ ID NO: 66107 - DNA, 16 bp, H. sapiens
cagcaggtcccactcc

SEQ ID NO: 66108 - DNA, 16 bp, H. sapiens
cagcaggtctgggatg

SEQ ID NO: 66109 - DNA, 16 bp, H. sapiens
cagcaggtctggggtg

SEQ ID NO: 66110 - DNA, 16 bp, H. sapiens
cagcaggtgctcaata

SEQ ID NO: 66111 - DNA, 16 bp, H. sapiens
cagcaggtggagcttg

SEQ ID NO: 66112 - DNA, 16 bp, H. sapiens
cagcaggtggcaaagc

SEQ ID NO: 66113 - DNA, 16 bp, H. sapiens
cagcaggtggtgaagc

SEQ ID NO: 66114 - DNA, 16 bp, H. sapiens
cagcagtaaaaatgaa

SEQ ID NO: 66115 - DNA, 16 bp, H. sapiens
cagcagtagcagcagt

SEQ ID NO: 66116 - DNA, 16 bp, H. sapiens
cagcagtatagaagtg

SEQ ID NO: 66117 - DNA, 16 bp, H. sapiens
cagcagtcccagctac

SEQ ID NO: 66118 - DNA, 16 bp, H. sapiens
cagcagtctcattact

SEQ ID NO: 66119 - DNA, 16 bp, H. sapiens
cagcagtgaacaaaac

SEQ ID NO: 66120 - DNA, 16 bp, H. sapiens
cagcagtgagcaaaac

SEQ ID NO: 66121 - DNA, 16 bp, H. sapiens
cagcagtgagcaagac

SEQ ID NO: 66122 - DNA, 16 bp, H. sapiens
cagcagtgagctgtga

SEQ ID NO: 66123 - DNA, 16 bp, H. sapiens
cagcagtgaggaggtc

SEQ ID NO: 66124 - DNA, 16 bp, H. sapiens
cagcagtgctagagga

SEQ ID NO: 66125 - DNA, 16 bp, H. sapiens
cagcagtgctggggga

SEQ ID NO: 66126 - DNA, 16 bp, H. sapiens
cagcagtggaacaaag

SEQ ID NO: 66127 - DNA, 16 bp, H. sapiens
cagcagtggcaaccag

SEQ ID NO: 66128 - DNA, 16 bp, H. sapiens
cagcagtggcagcatg

SEQ ID NO: 66129 - DNA, 16 bp, H. sapiens
cagcagtggcagtggt

SEQ ID NO: 66130 - DNA, 16 bp, H. sapiens
cagcagtggctcacac

SEQ ID NO: 66131 - DNA, 16 bp, H. sapiens
cagcagtgggatggct

SEQ ID NO: 66132 - DNA, 16 bp, H. sapiens
cagcagtgggatttct

SEQ ID NO: 66133 - DNA, 16 bp, H. sapiens
cagcagtggtccccaa

SEQ ID NO: 66134 - DNA, 16 bp, H. sapiens
cagcagtggtggctgc

SEQ ID NO: 66135 - DNA, 16 bp, H. sapiens
cagcagtgtacaagag

SEQ ID NO: 66136 - DNA, 16 bp, H. sapiens
cagcagtgtgaaagca

SEQ ID NO: 66137 - DNA, 16 bp, H. sapiens
cagcagtgtgggaggc

SEQ ID NO: 66138 - DNA, 16 bp, H. sapiens
cagcagttaaaaaaga

SEQ ID NO: 66139 - DNA, 16 bp, H. sapiens
cagcagtttaagacca

SEQ ID NO: 66140 - DNA, 16 bp, H. sapiens
cagcagtttagaaaca

SEQ ID NO: 66141 - DNA, 16 bp, H. sapiens
cagcagtttcactcct

SEQ ID NO: 66142 - DNA, 16 bp, H. sapiens
cagcagtttgggagcc

SEQ ID NO: 66143 - DNA, 16 bp, H. sapiens
cagcagtttgggaggc

SEQ ID NO: 66144 - DNA, 16 bp, H. sapiens
cagcagttttgaaact

SEQ ID NO: 66145 - DNA, 16 bp, H. sapiens
cagcatagcaaaaccc

SEQ ID NO: 66146 - DNA, 16 bp, H. sapiens
cagcatataagcagaa

SEQ ID NO: 66147 - DNA, 16 bp, H. sapiens
cagcatatgcaaaggc

SEQ ID NO: 66148 - DNA, 16 bp, H. sapiens
cagcatcaactctaaa

SEQ ID NO: 66149 - DNA, 16 bp, H. sapiens
cagcatcacctaggaa

SEQ ID NO: 66150 - DNA, 16 bp, H. sapiens
cagcatcacctgggaa

SEQ ID NO: 66151 - DNA, 16 bp, H. sapiens
cagcatcagaatcacc

SEQ ID NO: 66152 - DNA, 16 bp, H. sapiens
cagcatcagcaccacc

SEQ ID NO: 66153 - DNA, 16 bp, H. sapiens
cagcatcagcatcact

SEQ ID NO: 66154 - DNA, 16 bp, H. sapiens
cagcatcagcatcatc

SEQ ID NO: 66155 - DNA, 16 bp, H. sapiens
cagcatcagtgtcacc

SEQ ID NO: 66156 - DNA, 16 bp, H. sapiens
cagcatcatcacaaac

SEQ ID NO: 66157 - DNA, 16 bp, H. sapiens
cagcatcatcagcatc

SEQ ID NO: 66158 - DNA, 16 bp, H. sapiens
cagcatcatggatgga

SEQ ID NO: 66159 - DNA, 16 bp, H. sapiens
cagcatcattagttat

SEQ ID NO: 66160 - DNA, 16 bp, H. sapiens
cagcatcattctgcag

SEQ ID NO: 66161 - DNA, 16 bp, H. sapiens
cagcatcccccaccag

SEQ ID NO: 66162 - DNA, 16 bp, H. sapiens
cagcatccctggcctc

SEQ ID NO: 66163 - DNA, 16 bp, H. sapiens
cagcatccctggtctc

SEQ ID NO: 66164 - DNA, 16 bp, H. sapiens
cagcatcctgagcagc

SEQ ID NO: 66165 - DNA, 16 bp, H. sapiens
cagcatcctgggtagc

SEQ ID NO: 66166 - DNA, 16 bp, H. sapiens
cagcatctcagaatgt

SEQ ID NO: 66167 - DNA, 16 bp, H. sapiens
cagcatctcctgggaa

SEQ ID NO: 66168 - DNA, 16 bp, H. sapiens
cagcatctctggacct

SEQ ID NO: 66169 - DNA, 16 bp, H. sapiens
cagcatctgcttctgg

SEQ ID NO: 66170 - DNA, 16 bp, H. sapiens
cagcatctgcttttgg

SEQ ID NO: 66171 - DNA, 16 bp, H. sapiens
cagcatctgttattta

SEQ ID NO: 66172 - DNA, 16 bp, H. sapiens
cagcatctgtttcctg

SEQ ID NO: 66173 - DNA, 16 bp, H. sapiens
cagcatctgttttttg

SEQ ID NO: 66174 - DNA, 16 bp, H. sapiens
cagcatcttactctgt

SEQ ID NO: 66175 - DNA, 16 bp, H. sapiens
cagcatgagaacttca

SEQ ID NO: 66176 - DNA, 16 bp, H. sapiens
cagcatgagccaccac

SEQ ID NO: 66177 - DNA, 16 bp, H. sapiens
cagcatgaggacagac

SEQ ID NO: 66178 - DNA, 16 bp, H. sapiens
cagcatgcctggctga

SEQ ID NO: 66179 - DNA, 16 bp, H. sapiens
cagcatggccaacatg

SEQ ID NO: 66180 - DNA, 16 bp, H. sapiens
cagcatggcgaaaccc

SEQ ID NO: 66181 - DNA, 16 bp, H. sapiens
cagcatggctggagag

SEQ ID NO: 66182 - DNA, 16 bp, H. sapiens
cagcatggctggagca

SEQ ID NO: 66183 - DNA, 16 bp, H. sapiens
cagcatgggcagcaga

SEQ ID NO: 66184 - DNA, 16 bp, H. sapiens
cagcatgggcatcacc

SEQ ID NO: 66185 - DNA, 16 bp, H. sapiens
cagcatgggctgctca

SEQ ID NO: 66186 - DNA, 16 bp, H. sapiens
cagcatgggggaagcc

SEQ ID NO: 66187 - DNA, 17 bp, H. sapiens
cagcatgggggtgacca

SEQ ID NO: 66188 - DNA, 16 bp, H. sapiens
cagcatggtagtggca

SEQ ID NO: 66189 - DNA, 16 bp, H. sapiens
cagcatgttgctccac

SEQ ID NO: 66190 - DNA, 16 bp, H. sapiens
cagcatgttggccagg

SEQ ID NO: 66191 - DNA, 16 bp, H. sapiens
cagcattaccctgaca

SEQ ID NO: 66192 - DNA, 16 bp, H. sapiens
cagcattagaaaaaaa

SEQ ID NO: 66193 - DNA, 16 bp, H. sapiens
cagcattcacggttca

SEQ ID NO: 66194 - DNA, 16 bp, H. sapiens
cagcattccagcctgg

SEQ ID NO: 66195 - DNA, 16 bp, H. sapiens
cagcattccatcatca

SEQ ID NO: 66196 - DNA, 16 bp, H. sapiens
cagcattgccctgata

SEQ ID NO: 66197 - DNA, 16 bp, H. sapiens
cagcatttaccctgag

SEQ ID NO: 66198 - DNA, 16 bp, H. sapiens
cagcatttattaaaaa

SEQ ID NO: 66199 - DNA, 16 bp, H. sapiens
cagcatttcccaaaat

SEQ ID NO: 66200 - DNA, 16 bp, H. sapiens
cagcatttgcatatca

SEQ ID NO: 66201 - DNA, 16 bp, H. sapiens
cagcatttggtgctgt

SEQ ID NO: 66202 - DNA, 16 bp, H. sapiens
cagcatttggtggtgt

SEQ ID NO: 66203 - DNA, 16 bp, H. sapiens
cagcattttaggaagc

SEQ ID NO: 66204 - DNA, 16 bp, H. sapiens
cagcattttgaggggc

SEQ ID NO: 66205 - DNA, 16 bp, H. sapiens
cagcattttgatcaca

SEQ ID NO: 66206 - DNA, 16 bp, H. sapiens
cagcattttggtaaaa

SEQ ID NO: 66207 - DNA, 16 bp, H. sapiens
cagcattttgtccctg

SEQ ID NO: 66208 - DNA, 16 bp, H. sapiens
cagcattttttctttt

SEQ ID NO: 66209 - DNA, 16 bp, H. sapiens
cagcatttttttcctt

SEQ ID NO: 66210 - DNA, 16 bp, H. sapiens
cagccaaaaaacatat

SEQ ID NO: 66211 - DNA, 16 bp, H. sapiens
cagccaaaaccaagat

SEQ ID NO: 66212 - DNA, 16 bp, H. sapiens
cagccaaaagctggaa

SEQ ID NO: 66213 - DNA, 16 bp, H. sapiens
cagccaaaaggaagaa

SEQ ID NO: 66214 - DNA, 16 bp, H. sapiens
cagccaaaataatttt

SEQ ID NO: 66215 - DNA, 16 bp, H. sapiens
cagccaaacaccacag

SEQ ID NO: 66216 - DNA, 16 bp, H. sapiens
cagccaaaccataaca

SEQ ID NO: 66217 - DNA, 16 bp, H. sapiens
cagccaaaccatatca

SEQ ID NO: 66218 - DNA, 16 bp, H. sapiens
cagccaaactaaactt

SEQ ID NO: 66219 - DNA, 16 bp, H. sapiens
cagccaaagaaatcat

SEQ ID NO: 66220 - DNA, 17 bp, H. sapiens
cagccaacatggtgaaa

SEQ ID NO: 66221 - DNA, 16 bp, H. sapiens
cagccaactttttttt

SEQ ID NO: 66222 - DNA, 16 bp, H. sapiens
cagccaagatggccga

SEQ ID NO: 66223 - DNA, 16 bp, H. sapiens
cagccaagcacagtgg

SEQ ID NO: 66224 - DNA, 16 bp, H. sapiens
cagccaagcagttttt

SEQ ID NO: 66225 - DNA, 16 bp, H. sapiens
cagccaagccagccag

SEQ ID NO: 66226 - DNA, 16 bp, H. sapiens
cagccaaggaacacca

SEQ ID NO: 66227 - DNA, 16 bp, H. sapiens
cagccaaggcaacatg

SEQ ID NO: 66228 - DNA, 16 bp, H. sapiens
cagccaaggcagagag

SEQ ID NO: 66229 - DNA, 16 bp, H. sapiens
cagccaagggaagcag

SEQ ID NO: 66230 - DNA, 16 bp, H. sapiens
cagccaagtgcggtgg

SEQ ID NO: 66231 - DNA, 16 bp, H. sapiens
cagccaatatttattg

SEQ ID NO: 66232 - DNA, 16 bp, H. sapiens
cagccaatttttttaa

SEQ ID NO: 66233 - DNA, 16 bp, H. sapiens
cagccacacagccaca

SEQ ID NO: 66234 - DNA, 16 bp, H. sapiens
cagccacactggcctt

SEQ ID NO: 66235 - DNA, 16 bp, H. sapiens
cagccacagaaaagaa

SEQ ID NO: 66236 - DNA, 16 bp, H. sapiens
cagccacagcaagccc

SEQ ID NO: 66237 - DNA, 16 bp, H. sapiens
cagccacagcagcccc

SEQ ID NO: 66238 - DNA, 16 bp, H. sapiens
cagccacagccacagc

SEQ ID NO: 66239 - DNA, 16 bp, H. sapiens
cagccacagcctcctg

SEQ ID NO: 66240 - DNA, 16 bp, H. sapiens
cagccacaggggctgt

SEQ ID NO: 66241 - DNA, 16 bp, H. sapiens
cagccacagtgcccag

SEQ ID NO: 66242 - DNA, 16 bp, H. sapiens
cagccacagtggcctc

SEQ ID NO: 66243 - DNA, 16 bp, H. sapiens
cagccacagtggctca

SEQ ID NO: 66244 - DNA, 16 bp, H. sapiens
cagccacattctgagg

SEQ ID NO: 66245 - DNA, 16 bp, H. sapiens
cagccaccaccaccct

SEQ ID NO: 66246 - DNA, 16 bp, H. sapiens
cagccaccaccgcagc

SEQ ID NO: 66247 - DNA, 16 bp, H. sapiens
cagccaccacgcccag

SEQ ID NO: 66248 - DNA, 16 bp, H. sapiens
cagccaccatgcccag

SEQ ID NO: 66249 - DNA, 16 bp, H. sapiens
cagccacccaggtagc

SEQ ID NO: 66250 - DNA, 20 bp, H. sapiens
cagccaccccgtccgggagg

SEQ ID NO: 66251 - DNA, 16 bp, H. sapiens
cagccaccgcacctgg

SEQ ID NO: 66252 - DNA, 16 bp, H. sapiens
cagccacctgcaagcc

SEQ ID NO: 66253 - DNA, 16 bp, H. sapiens
cagccacgtggaactg

SEQ ID NO: 66254 - DNA, 16 bp, H. sapiens
cagccacgtggagctg

SEQ ID NO: 66255 - DNA, 16 bp, H. sapiens
cagccactacaaaaat

SEQ ID NO: 66256 - DNA, 16 bp, H. sapiens
cagccactcaagaggc

SEQ ID NO: 66257 - DNA, 16 bp, H. sapiens
cagccactccagaggc

SEQ ID NO: 66258 - DNA, 16 bp, H. sapiens
cagccactccagcctt

SEQ ID NO: 66259 - DNA, 16 bp, H. sapiens
cagccactcccagagc

SEQ ID NO: 66260 - DNA, 16 bp, H. sapiens
cagccactcctgtcat

SEQ ID NO: 66261 - DNA, 16 bp, H. sapiens
cagccactcgggaggt

SEQ ID NO: 66262 - DNA, 16 bp, H. sapiens
cagccactgcaacctc

SEQ ID NO: 66263 - DNA, 16 bp, H. sapiens
cagccactgccatcat

SEQ ID NO: 66264 - DNA, 16 bp, H. sapiens
cagccactgcctccca

SEQ ID NO: 66265 - DNA, 16 bp, H. sapiens
cagccactgctgagtg

SEQ ID NO: 66266 - DNA, 16 bp, H. sapiens
cagccactgtagaaaa

SEQ ID NO: 66267 - DNA, 16 bp, H. sapiens
cagccactgtgctgtg

SEQ ID NO: 66268 - DNA, 16 bp, H. sapiens
cagccacttggaactg

SEQ ID NO: 66269 - DNA, 16 bp, H. sapiens
cagccactttagaaaa

SEQ ID NO: 66270 - DNA, 16 bp, H. sapiens
cagccagaataaaagc

SEQ ID NO: 66271 - DNA, 16 bp, H. sapiens
cagccagaccagcctc

SEQ ID NO: 66272 - DNA, 16 bp, H. sapiens
cagccagactggaaaa

SEQ ID NO: 66273 - DNA, 16 bp, H. sapiens
cagccagagaagaaag

SEQ ID NO: 66274 - DNA, 16 bp, H. sapiens
cagccagagagaaagg

SEQ ID NO: 66275 - DNA, 16 bp, H. sapiens
cagccagagcagggca

SEQ ID NO: 66276 - DNA, 16 bp, H. sapiens
cagccagagcccagcc

SEQ ID NO: 66277 - DNA, 16 bp, H. sapiens
cagccagagtgcctct

SEQ ID NO: 66278 - DNA, 16 bp, H. sapiens
cagccagagtggaaaa

SEQ ID NO: 66279 - DNA, 16 bp, H. sapiens
cagccagccagccaag

SEQ ID NO: 66280 - DNA, 16 bp, H. sapiens
cagccagccagcccag

SEQ ID NO: 66281 - DNA, 16 bp, H. sapiens
cagccagccagccctg

SEQ ID NO: 66282 - DNA, 16 bp, H. sapiens
cagccagccaggcagc

SEQ ID NO: 66283 - DNA, 16 bp, H. sapiens
cagccagcccagccag

SEQ ID NO: 66284 - DNA, 16 bp, H. sapiens
cagccagccccagaga

SEQ ID NO: 66285 - DNA, 16 bp, H. sapiens
cagccagccctgctgg

SEQ ID NO: 66286 - DNA, 17 bp, H. sapiens
cagccagccgccccgtc

SEQ ID NO: 66287 - DNA, 16 bp, H. sapiens
cagccagcctcagcct

SEQ ID NO: 66288 - DNA, 16 bp, H. sapiens
cagccagcctggccaa

SEQ ID NO: 66289 - DNA, 16 bp, H. sapiens
cagccagcctgggcaa

SEQ ID NO: 66290 - DNA, 16 bp, H. sapiens
cagccagctgtggtgg

SEQ ID NO: 66291 - DNA, 16 bp, H. sapiens
cagccaggaggaacag

SEQ ID NO: 66292 - DNA, 16 bp, H. sapiens
cagccaggaggaagag

SEQ ID NO: 66293 - DNA, 16 bp, H. sapiens
cagccaggagggggac

SEQ ID NO: 66294 - DNA, 16 bp, H. sapiens
cagccaggaggtggtg

SEQ ID NO: 66295 - DNA, 16 bp, H. sapiens
cagccaggatttgaac

SEQ ID NO: 66296 - DNA, 16 bp, H. sapiens
cagccaggcagagagg

SEQ ID NO: 66297 - DNA, 16 bp, H. sapiens
cagccaggcagagatg

SEQ ID NO: 66298 - DNA, 16 bp, H. sapiens
cagccaggcaggcagg

SEQ ID NO: 66299 - DNA, 16 bp, H. sapiens
cagccaggcagggtgg

SEQ ID NO: 66300 - DNA, 16 bp, H. sapiens
cagccaggcatgatgg

SEQ ID NO: 66301 - DNA, 16 bp, H. sapiens
cagccaggcatggagg

SEQ ID NO: 66302 - DNA, 16 bp, H. sapiens
cagccaggcatggtgg

SEQ ID NO: 66303 - DNA, 16 bp, H. sapiens
cagccaggccagcctg

SEQ ID NO: 66304 - DNA, 16 bp, H. sapiens
cagccaggcccagccc

SEQ ID NO: 66305 - DNA, 16 bp, H. sapiens
cagccaggcccagtgg

SEQ ID NO: 66306 - DNA, 16 bp, H. sapiens
cagccaggcgccgtgg

SEQ ID NO: 66307 - DNA, 19 bp, H. sapiens
cagccaggcgtggtggcac

SEQ ID NO: 66308 - DNA, 17 bp, H. sapiens
cagccaggcgttcctcc

SEQ ID NO: 66309 - DNA, 16 bp, H. sapiens
cagccaggctcggtgg

SEQ ID NO: 66310 - DNA, 16 bp, H. sapiens
cagccaggctgcagcc

SEQ ID NO: 66311 - DNA, 16 bp, H. sapiens
cagccaggctggagag

SEQ ID NO: 66312 - DNA, 17 bp, H. sapiens
cagccaggctgggggag

SEQ ID NO: 66313 - DNA, 16 bp, H. sapiens
cagccagggcagcaga

SEQ ID NO: 66314 - DNA, 16 bp, H. sapiens
cagccaggggtggtgg

SEQ ID NO: 66315 - DNA, 16 bp, H. sapiens
cagccagggttgaaaa

SEQ ID NO: 66316 - DNA, 16 bp, H. sapiens
cagccaggtgaggtgg

SEQ ID NO: 66317 - DNA, 16 bp, H. sapiens
cagccaggtgatcaaa

SEQ ID NO: 66318 - DNA, 16 bp, H. sapiens
cagccaggtgctgtgg

SEQ ID NO: 66319 - DNA, 16 bp, H. sapiens
cagccaggtgtggtgg

SEQ ID NO: 66320 - DNA, 16 bp, H. sapiens
cagccaggtttgagaa

SEQ ID NO: 66321 - DNA, 16 bp, H. sapiens
cagccagtcatggtgg

SEQ ID NO: 66322 - DNA, 16 bp, H. sapiens
cagccagtctgagaaa

SEQ ID NO: 66323 - DNA, 16 bp, H. sapiens
cagccagtgtgatggc

SEQ ID NO: 66324 - DNA, 16 bp, H. sapiens
cagccagtgtggaaag

SEQ ID NO: 66325 - DNA, 16 bp, H. sapiens
cagccagtgtgttggg

SEQ ID NO: 66326 - DNA, 16 bp, H. sapiens
cagccataaaaaaaca

SEQ ID NO: 66327 - DNA, 16 bp, H. sapiens
cagccataaaaaggaa

SEQ ID NO: 66328 - DNA, 16 bp, H. sapiens
cagccataaaagaatg

SEQ ID NO: 66329 - DNA, 16 bp, H. sapiens
cagccataaaatgaat

SEQ ID NO: 66330 - DNA, 16 bp, H. sapiens
cagccataaacaagga

SEQ ID NO: 66331 - DNA, 16 bp, H. sapiens
cagccataatcctcct

SEQ ID NO: 66332 - DNA, 16 bp, H. sapiens
cagccatagaaaagga

SEQ ID NO: 66333 - DNA, 16 bp, H. sapiens
cagccatatgaagaca

SEQ ID NO: 66334 - DNA, 16 bp, H. sapiens
cagccatcaacatcga

SEQ ID NO: 66335 - DNA, 16 bp, H. sapiens
cagccatccacccatc

SEQ ID NO: 66336 - DNA, 16 bp, H. sapiens
cagccatctcagcctg

SEQ ID NO: 66337 - DNA, 16 bp, H. sapiens
cagccatcttgcaacc

SEQ ID NO: 66338 - DNA, 16 bp, H. sapiens
cagccatcttggctcc

SEQ ID NO: 66339 - DNA, 16 bp, H. sapiens
cagccatgaacctagc

SEQ ID NO: 66340 - DNA, 16 bp, H. sapiens
cagccatgaagaagaa

SEQ ID NO: 66341 - DNA, 16 bp, H. sapiens
cagccatgaggaactg

SEQ ID NO: 66342 - DNA, 16 bp, H. sapiens
cagccatgatcacacc

SEQ ID NO: 66343 - DNA, 16 bp, H. sapiens
cagccatgcttcctat

SEQ ID NO: 66344 - DNA, 16 bp, H. sapiens
cagccatggtggctca

SEQ ID NO: 66345 - DNA, 16 bp, H. sapiens
cagccatggtgggagt

SEQ ID NO: 66346 - DNA, 16 bp, H. sapiens
cagccattatagaaaa

SEQ ID NO: 66347 - DNA, 16 bp, H. sapiens
cagccattattaaaaa

SEQ ID NO: 66348 - DNA, 16 bp, H. sapiens
cagccattccacttct

SEQ ID NO: 66349 - DNA, 16 bp, H. sapiens
cagccattctaaatgg

SEQ ID NO: 66350 - DNA, 16 bp, H. sapiens
cagccattgctgaggc

SEQ ID NO: 66351 - DNA, 16 bp, H. sapiens
cagccattgtagaaga

SEQ ID NO: 66352 - DNA, 16 bp, H. sapiens
cagccatttctttttt

SEQ ID NO: 66353 - DNA, 16 bp, H. sapiens
cagccatttgggaggc

SEQ ID NO: 66354 - DNA, 16 bp, H. sapiens
cagcccaaatgtccat

SEQ ID NO: 66355 - DNA, 16 bp, H. sapiens
cagcccaaattctcct

SEQ ID NO: 66356 - DNA, 16 bp, H. sapiens
cagcccaacacaaatt

SEQ ID NO: 66357 - DNA, 16 bp, H. sapiens
cagcccaagctgtaca

SEQ ID NO: 66358 - DNA, 16 bp, H. sapiens
cagcccaatttttaaa

SEQ ID NO: 66359 - DNA, 16 bp, H. sapiens
cagcccacagagggtg

SEQ ID NO: 66360 - DNA, 16 bp, H. sapiens
cagcccacagctctca

SEQ ID NO: 66361 - DNA, 16 bp, H. sapiens
cagcccacaggcagcc

SEQ ID NO: 66362 - DNA, 16 bp, H. sapiens
cagcccacaggccaaa

SEQ ID NO: 66363 - DNA, 16 bp, H. sapiens
cagcccaccccagggg

SEQ ID NO: 66364 - DNA, 16 bp, H. sapiens
cagcccactgactcaa

SEQ ID NO: 66365 - DNA, 16 bp, H. sapiens
cagcccactgctgcca

SEQ ID NO: 66366 - DNA, 16 bp, H. sapiens
cagcccagactcagac

SEQ ID NO: 66367 - DNA, 16 bp, H. sapiens
cagcccagagaggggc

SEQ ID NO: 66368 - DNA, 16 bp, H. sapiens
cagcccagagccaggc

SEQ ID NO: 66369 - DNA, 16 bp, H. sapiens
cagcccagagcctggc

SEQ ID NO: 66370 - DNA, 16 bp, H. sapiens
cagcccagagggagct

SEQ ID NO: 66371 - DNA, 16 bp, H. sapiens
cagcccagcagggagg

SEQ ID NO: 66372 - DNA, 16 bp, H. sapiens
cagcccagcatctgtg

SEQ ID NO: 66373 - DNA, 16 bp, H. sapiens
cagcccagcccagtcc

SEQ ID NO: 66374 - DNA, 16 bp, H. sapiens
cagcccagcccatgag

SEQ ID NO: 66375 - DNA, 16 bp, H. sapiens
cagcccagcccctgcc

SEQ ID NO: 66376 - DNA, 16 bp, H. sapiens
cagcccagccccttcc

SEQ ID NO: 66377 - DNA, 16 bp, H. sapiens
cagcccagccctccct

SEQ ID NO: 66378 - DNA, 16 bp, H. sapiens
cagcccagccctggca

SEQ ID NO: 66379 - DNA, 16 bp, H. sapiens
cagcccagcctcctgc

SEQ ID NO: 66380 - DNA, 16 bp, H. sapiens
cagcccagcctctccc

SEQ ID NO: 66381 - DNA, 16 bp, H. sapiens
cagcccagcctctgcc

SEQ ID NO: 66382 - DNA, 16 bp, H. sapiens
cagcccagcctggccc

SEQ ID NO: 66383 - DNA, 16 bp, H. sapiens
cagcccagcctgggag

SEQ ID NO: 66384 - DNA, 16 bp, H. sapiens
cagcccagcctgggca

SEQ ID NO: 66385 - DNA, 16 bp, H. sapiens
cagcccagcctgggtg

SEQ ID NO: 66386 - DNA, 17 bp, H. sapiens
cagcccagcgccacacc

SEQ ID NO: 66387 - DNA, 16 bp, H. sapiens
cagcccagcgccaggc

SEQ ID NO: 66388 - DNA, 16 bp, H. sapiens
cagcccagctgtaaaa

SEQ ID NO: 66389 - DNA, 16 bp, H. sapiens
cagcccagctgtcccc

SEQ ID NO: 66390 - DNA, 16 bp, H. sapiens
cagcccagcttctgtg

SEQ ID NO: 66391 - DNA, 16 bp, H. sapiens
cagcccaggaagccag

SEQ ID NO: 66392 - DNA, 16 bp, H. sapiens
cagcccaggagttcaa

SEQ ID NO: 66393 - DNA, 16 bp, H. sapiens
cagcccaggagttcga

SEQ ID NO: 66394 - DNA, 16 bp, H. sapiens
cagcccaggagtttga

SEQ ID NO: 66395 - DNA, 16 bp, H. sapiens
cagcccaggccacaga

SEQ ID NO: 66396 - DNA, 16 bp, H. sapiens
cagcccaggcccaggc

SEQ ID NO: 66397 - DNA, 16 bp, H. sapiens
cagcccagggcccagg

SEQ ID NO: 66398 - DNA, 16 bp, H. sapiens
cagcccagggccccag

SEQ ID NO: 66399 - DNA, 16 bp, H. sapiens
cagcccaggtgataga

SEQ ID NO: 66400 - DNA, 16 bp, H. sapiens
cagcccagtgtggtgg

SEQ ID NO: 66401 - DNA, 16 bp, H. sapiens
cagcccagttctgtgc

SEQ ID NO: 66402 - DNA, 16 bp, H. sapiens
cagcccatcatctaca

SEQ ID NO: 66403 - DNA, 16 bp, H. sapiens
cagcccatgagggcag

SEQ ID NO: 66404 - DNA, 16 bp, H. sapiens
cagccccaaactcctg

SEQ ID NO: 66405 - DNA, 16 bp, H. sapiens
cagccccaaatcattt

SEQ ID NO: 66406 - DNA, 16 bp, H. sapiens
cagccccaacctccca

SEQ ID NO: 66407 - DNA, 16 bp, H. sapiens
cagccccaacttcctg

SEQ ID NO: 66408 - DNA, 16 bp, H. sapiens
cagccccaagacagag

SEQ ID NO: 66409 - DNA, 16 bp, H. sapiens
cagccccaccctggcc

SEQ ID NO: 66410 - DNA, 16 bp, H. sapiens
cagccccacctctgcc

SEQ ID NO: 66411 - DNA, 16 bp, H. sapiens
cagccccactcccagc

SEQ ID NO: 66412 - DNA, 16 bp, H. sapiens
cagccccagagcccag

SEQ ID NO: 66413 - DNA, 16 bp, H. sapiens
cagccccagccaggcc

SEQ ID NO: 66414 - DNA, 16 bp, H. sapiens
cagccccagcccaggc

SEQ ID NO: 66415 - DNA, 16 bp, H. sapiens
cagccccagcccagtc

SEQ ID NO: 66416 - DNA, 16 bp, H. sapiens
cagccccagccccaga

SEQ ID NO: 66417 - DNA, 16 bp, H. sapiens
cagccccagccccagg

SEQ ID NO: 66418 - DNA, 16 bp, H. sapiens
cagccccagcccctgg

SEQ ID NO: 66419 - DNA, 16 bp, H. sapiens
cagccccagccctgcc

SEQ ID NO: 66420 - DNA, 16 bp, H. sapiens
cagccccagccctgct

SEQ ID NO: 66421 - DNA, 16 bp, H. sapiens
cagccccagccctggg

SEQ ID NO: 66422 - DNA, 16 bp, H. sapiens
cagccccagcctccca

SEQ ID NO: 66423 - DNA, 16 bp, H. sapiens
cagccccagcctcctc

SEQ ID NO: 66424 - DNA, 16 bp, H. sapiens
cagccccagcctggcc

SEQ ID NO: 66425 - DNA, 16 bp, H. sapiens
cagccccagctcccag

SEQ ID NO: 66426 - DNA, 16 bp, H. sapiens
cagccccagctccctc

SEQ ID NO: 66427 - DNA, 16 bp, H. sapiens
cagccccagctcctcc

SEQ ID NO: 66428 - DNA, 16 bp, H. sapiens
cagccccagctcctgc

SEQ ID NO: 66429 - DNA, 16 bp, H. sapiens
cagccccagctctgcc

SEQ ID NO: 66430 - DNA, 16 bp, H. sapiens
cagccccagctgcacc

SEQ ID NO: 66431 - DNA, 16 bp, H. sapiens
cagccccaggaggcag

SEQ ID NO: 66432 - DNA, 16 bp, H. sapiens
cagccccaggaggtcc

SEQ ID NO: 66433 - DNA, 16 bp, H. sapiens
cagccccaggccccag

SEQ ID NO: 66434 - DNA, 16 bp, H. sapiens
cagccccaggccctgc

SEQ ID NO: 66435 - DNA, 16 bp, H. sapiens
cagccccagggcctgg

SEQ ID NO: 66436 - DNA, 16 bp, H. sapiens
cagccccagttcccac

SEQ ID NO: 66437 - DNA, 16 bp, H. sapiens
cagcccccaaactcct

SEQ ID NO: 66438 - DNA, 16 bp, H. sapiens
cagcccccaaagtgct

SEQ ID NO: 66439 - DNA, 16 bp, H. sapiens
cagcccccacagctgc

SEQ ID NO: 66440 - DNA, 16 bp, H. sapiens
cagcccccacctccag

SEQ ID NO: 66441 - DNA, 16 bp, H. sapiens
cagcccccacctcctg

SEQ ID NO: 66442 - DNA, 16 bp, H. sapiens
cagcccccagccctgc

SEQ ID NO: 66443 - DNA, 16 bp, H. sapiens
cagcccccagggctgc

SEQ ID NO: 66444 - DNA, 16 bp, H. sapiens
cagcccccagtgagcc

SEQ ID NO: 66445 - DNA, 16 bp, H. sapiens
cagcccccatggctgc

SEQ ID NO: 66446 - DNA, 16 bp, H. sapiens
cagcccccctgcccgg

SEQ ID NO: 66447 - DNA, 16 bp, H. sapiens
cagccccctcaccatg

SEQ ID NO: 66448 - DNA, 16 bp, H. sapiens
cagccccctctggact

SEQ ID NO: 66449 - DNA, 16 bp, H. sapiens
cagccccctgccacct

SEQ ID NO: 66450 - DNA, 16 bp, H. sapiens
cagccccctgcccagc

SEQ ID NO: 66451 - DNA, 16 bp, H. sapiens
cagccccctgcctggc

SEQ ID NO: 66452 - DNA, 16 bp, H. sapiens
cagccccctgctgcct

SEQ ID NO: 66453 - DNA, 16 bp, H. sapiens
cagcccccttcccaca

SEQ ID NO: 66454 - DNA, 16 bp, H. sapiens
cagccccgacctcctg

SEQ ID NO: 66455 - DNA, 16 bp, H. sapiens
cagccccgagggctgc

SEQ ID NO: 66456 - DNA, 16 bp, H. sapiens
cagccccggctcccgc

SEQ ID NO: 66457 - DNA, 16 bp, H. sapiens
cagccccggttcccgc

SEQ ID NO: 66458 - DNA, 16 bp, H. sapiens
cagccccggttcctgc

SEQ ID NO: 66459 - DNA, 16 bp, H. sapiens
cagcccctcagcccct

SEQ ID NO: 66460 - DNA, 16 bp, H. sapiens
cagcccctccccagag

SEQ ID NO: 66461 - DNA, 16 bp, H. sapiens
cagcccctccccagct

SEQ ID NO: 66462 - DNA, 16 bp, H. sapiens
cagcccctccctccag

SEQ ID NO: 66463 - DNA, 16 bp, H. sapiens
cagcccctccctgcct

SEQ ID NO: 66464 - DNA, 16 bp, H. sapiens
cagcccctccctggcc

SEQ ID NO: 66465 - DNA, 16 bp, H. sapiens
cagcccctcctccttc

SEQ ID NO: 66466 - DNA, 16 bp, H. sapiens
cagcccctctcccctt

SEQ ID NO: 66467 - DNA, 16 bp, H. sapiens
cagcccctctcctctc

SEQ ID NO: 66468 - DNA, 16 bp, H. sapiens
cagcccctcttccctc

SEQ ID NO: 66469 - DNA, 16 bp, H. sapiens
cagcccctcttcctcc

SEQ ID NO: 66470 - DNA, 16 bp, H. sapiens
cagcccctgaagctgc

SEQ ID NO: 66471 - DNA, 16 bp, H. sapiens
cagcccctgagggcca

SEQ ID NO: 66472 - DNA, 16 bp, H. sapiens
cagcccctgcagcccc

SEQ ID NO: 66473 - DNA, 16 bp, H. sapiens
cagcccctgcagctgc

SEQ ID NO: 66474 - DNA, 16 bp, H. sapiens
cagcccctgccaggcc

SEQ ID NO: 66475 - DNA, 16 bp, H. sapiens
cagcccctgcccagcc

SEQ ID NO: 66476 - DNA, 16 bp, H. sapiens
cagcccctgcccctgc

SEQ ID NO: 66477 - DNA, 16 bp, H. sapiens
cagcccctgcccctgg

SEQ ID NO: 66478 - DNA, 16 bp, H. sapiens
cagcccctgccctcaa

SEQ ID NO: 66479 - DNA, 16 bp, H. sapiens
cagcccctgccctgcc

SEQ ID NO: 66480 - DNA, 16 bp, H. sapiens
cagcccctgccctggc

SEQ ID NO: 66481 - DNA, 16 bp, H. sapiens
cagcccctgcctccag

SEQ ID NO: 66482 - DNA, 16 bp, H. sapiens
cagcccctgcctccca

SEQ ID NO: 66483 - DNA, 16 bp, H. sapiens
cagcccctgctccctc

SEQ ID NO: 66484 - DNA, 16 bp, H. sapiens
cagcccctgctctgcc

SEQ ID NO: 66485 - DNA, 16 bp, H. sapiens
cagcccctggaagcca

SEQ ID NO: 66486 - DNA, 16 bp, H. sapiens
cagcccctggtaacca

SEQ ID NO: 66487 - DNA, 16 bp, H. sapiens
cagccccttcccttgg

SEQ ID NO: 66488 - DNA, 16 bp, H. sapiens
cagccccttctctgct

SEQ ID NO: 66489 - DNA, 16 bp, H. sapiens
cagccccttgggaggc

SEQ ID NO: 66490 - DNA, 16 bp, H. sapiens
cagcccggccagcatg

SEQ ID NO: 66491 - DNA, 17 bp, H. sapiens
cagcccggccagccacc

SEQ ID NO: 66492 - DNA, 16 bp, H. sapiens
cagcccgggaggtgga

SEQ ID NO: 66493 - DNA, 16 bp, H. sapiens
cagccctaatttttgt

SEQ ID NO: 66494 - DNA, 16 bp, H. sapiens
cagccctagccagaag

SEQ ID NO: 66495 - DNA, 16 bp, H. sapiens
cagccctaggcagcca

SEQ ID NO: 66496 - DNA, 16 bp, H. sapiens
cagccctatggaagag

SEQ ID NO: 66497 - DNA, 16 bp, H. sapiens
cagccctcaaggagct

SEQ ID NO: 66498 - DNA, 16 bp, H. sapiens
cagccctcagaagaaa

SEQ ID NO: 66499 - DNA, 16 bp, H. sapiens
cagccctcagcagaga

SEQ ID NO: 66500 - DNA, 16 bp, H. sapiens
cagccctcccacctca

SEQ ID NO: 66501 - DNA, 17 bp, H. sapiens
cagccctcgctcgctct

SEQ ID NO: 66502 - DNA, 16 bp, H. sapiens
cagccctctgatgcca

SEQ ID NO: 66503 - DNA, 16 bp, H. sapiens
cagccctctgcctccc

SEQ ID NO: 66504 - DNA, 16 bp, H. sapiens
cagccctctgtatcca

SEQ ID NO: 66505 - DNA, 16 bp, H. sapiens
cagccctgaggaactg

SEQ ID NO: 66506 - DNA, 16 bp, H. sapiens
cagccctgagggctgc

SEQ ID NO: 66507 - DNA, 16 bp, H. sapiens
cagccctgcagacacc

SEQ ID NO: 66508 - DNA, 16 bp, H. sapiens
cagccctgccagcatc

SEQ ID NO: 66509 - DNA, 16 bp, H. sapiens
cagccctgccaggccc

SEQ ID NO: 66510 - DNA, 16 bp, H. sapiens
cagccctgcccacacc

SEQ ID NO: 66511 - DNA, 16 bp, H. sapiens
cagccctgcccagccc

SEQ ID NO: 66512 - DNA, 16 bp, H. sapiens
cagccctgcccagcct

SEQ ID NO: 66513 - DNA, 16 bp, H. sapiens
cagccctgccccgcgg

SEQ ID NO: 66514 - DNA, 16 bp, H. sapiens
cagccctgccctggag

SEQ ID NO: 66515 - DNA, 16 bp, H. sapiens
cagccctgccctggcc

SEQ ID NO: 66516 - DNA, 16 bp, H. sapiens
cagccctgcctccctg

SEQ ID NO: 66517 - DNA, 16 bp, H. sapiens
cagccctgcctcctcc

SEQ ID NO: 66518 - DNA, 16 bp, H. sapiens
cagccctgcctgcccc

SEQ ID NO: 66519 - DNA, 16 bp, H. sapiens
cagccctgcctgccct

SEQ ID NO: 66520 - DNA, 16 bp, H. sapiens
cagccctgctcaccag

SEQ ID NO: 66521 - DNA, 16 bp, H. sapiens
cagccctgctcacctg

SEQ ID NO: 66522 - DNA, 16 bp, H. sapiens
cagccctgctccctgc

SEQ ID NO: 66523 - DNA, 16 bp, H. sapiens
cagccctgctgctgcc

SEQ ID NO: 66524 - DNA, 16 bp, H. sapiens
cagccctgctggcacc

SEQ ID NO: 66525 - DNA, 16 bp, H. sapiens
cagccctggaggccag

SEQ ID NO: 66526 - DNA, 16 bp, H. sapiens
cagccctggaggctgg

SEQ ID NO: 66527 - DNA, 16 bp, H. sapiens
cagccctggccacacc

SEQ ID NO: 66528 - DNA, 16 bp, H. sapiens
cagccctggccccagc

SEQ ID NO: 66529 - DNA, 16 bp, H. sapiens
cagccctggcccctcc

SEQ ID NO: 66530 - DNA, 16 bp, H. sapiens
cagccctggcccctgg

SEQ ID NO: 66531 - DNA, 16 bp, H. sapiens
cagccctggccctgcc

SEQ ID NO: 66532 - DNA, 16 bp, H. sapiens
cagccctggcctggcc

SEQ ID NO: 66533 - DNA, 16 bp, H. sapiens
cagccctggcctgggg

SEQ ID NO: 66534 - DNA, 16 bp, H. sapiens
cagccctggctcccac

SEQ ID NO: 66535 - DNA, 16 bp, H. sapiens
cagccctggctcctgc

SEQ ID NO: 66536 - DNA, 16 bp, H. sapiens
cagccctggcttgggg

SEQ ID NO: 66537 - DNA, 16 bp, H. sapiens
cagccctgggaggagg

SEQ ID NO: 66538 - DNA, 16 bp, H. sapiens
cagccctgggaggggc

SEQ ID NO: 66539 - DNA, 16 bp, H. sapiens
cagccctgggcagctg

SEQ ID NO: 66540 - DNA, 16 bp, H. sapiens
cagccctgggcctggc

SEQ ID NO: 66541 - DNA, 16 bp, H. sapiens
cagccctgggcctggg

SEQ ID NO: 66542 - DNA, 16 bp, H. sapiens
cagccctggggagggg

SEQ ID NO: 66543 - DNA, 16 bp, H. sapiens
cagccctgggtttgaa

SEQ ID NO: 66544 - DNA, 16 bp, H. sapiens
cagccctggtgtggga

SEQ ID NO: 66545 - DNA, 16 bp, H. sapiens
cagccctgtcctcagg

SEQ ID NO: 66546 - DNA, 16 bp, H. sapiens
cagccctgtggaactg

SEQ ID NO: 66547 - DNA, 16 bp, H. sapiens
cagccctgtggcaccc

SEQ ID NO: 66548 - DNA, 16 bp, H. sapiens
cagcccttaatccatt

SEQ ID NO: 66549 - DNA, 16 bp, H. sapiens
cagcccttcccacctc

SEQ ID NO: 66550 - DNA, 16 bp, H. sapiens
cagcccttcccttccc

SEQ ID NO: 66551 - DNA, 16 bp, H. sapiens
cagcccttcctcctcc

SEQ ID NO: 66552 - DNA, 16 bp, H. sapiens
cagcccttctcccctc

SEQ ID NO: 66553 - DNA, 16 bp, H. sapiens
cagcccttgggcagtt

SEQ ID NO: 66554 - DNA, 16 bp, H. sapiens
cagccgccaccatgcc

SEQ ID NO: 66555 - DNA, 16 bp, H. sapiens
cagccggacatggtgg

SEQ ID NO: 66556 - DNA, 16 bp, H. sapiens
cagccggccggccctg

SEQ ID NO: 66557 - DNA, 16 bp, H. sapiens
cagccgggcacggtgg

SEQ ID NO: 66558 - DNA, 16 bp, H. sapiens
cagccgggcctggtgg

SEQ ID NO: 66559 - DNA, 16 bp, H. sapiens
cagccgggcgtagtgg

SEQ ID NO: 66560 - DNA, 16 bp, H. sapiens
cagccgggtgtggtgg

SEQ ID NO: 66561 - DNA, 16 bp, H. sapiens
cagccgtgcttcctgt

SEQ ID NO: 66562 - DNA, 16 bp, H. sapiens
cagcctaaatgcccat

SEQ ID NO: 66563 - DNA, 16 bp, H. sapiens
cagcctaagtgtccat

SEQ ID NO: 66564 - DNA, 16 bp, H. sapiens
cagcctacccaacatg

SEQ ID NO: 66565 - DNA, 16 bp, H. sapiens
cagcctagacgacaga

SEQ ID NO: 66566 - DNA, 16 bp, H. sapiens
cagcctagatcccttg

SEQ ID NO: 66567 - DNA, 16 bp, H. sapiens
cagcctaggcaacaac

SEQ ID NO: 66568 - DNA, 16 bp, H. sapiens
cagcctaggcaacaat

SEQ ID NO: 66569 - DNA, 18 bp, H. sapiens
cagcctaggcaacatagt

SEQ ID NO: 66570 - DNA, 16 bp, H. sapiens
cagcctcaaacccctg

SEQ ID NO: 66571 - DNA, 16 bp, H. sapiens
cagcctcaaactccag

SEQ ID NO: 66572 - DNA, 16 bp, H. sapiens
cagcctcaaattccca

SEQ ID NO: 66573 - DNA, 16 bp, H. sapiens
cagcctcaacatggag

SEQ ID NO: 66574 - DNA, 16 bp, H. sapiens
cagcctcaacctactg

SEQ ID NO: 66575 - DNA, 16 bp, H. sapiens
cagcctcaacttccag

SEQ ID NO: 66576 - DNA, 16 bp, H. sapiens
cagcctcaagaggtcc

SEQ ID NO: 66577 - DNA, 16 bp, H. sapiens
cagcctcaagtatttc

SEQ ID NO: 66578 - DNA, 16 bp, H. sapiens
cagcctcacagatggc

SEQ ID NO: 66579 - DNA, 16 bp, H. sapiens
cagcctcaccaatatg

SEQ ID NO: 66580 - DNA, 16 bp, H. sapiens
cagcctcaccagcatc

SEQ ID NO: 66581 - DNA, 16 bp, H. sapiens
cagcctcaccctcctg

SEQ ID NO: 66582 - DNA, 16 bp, H. sapiens
cagcctcagaaggaac

SEQ ID NO: 66583 - DNA, 16 bp, H. sapiens
cagcctcagcaacaga

SEQ ID NO: 66584 - DNA, 16 bp, H. sapiens
cagcctcagcaacata

SEQ ID NO: 66585 - DNA, 16 bp, H. sapiens
cagcctcagcatcacc

SEQ ID NO: 66586 - DNA, 16 bp, H. sapiens
cagcctcagccccagc

SEQ ID NO: 66587 - DNA, 16 bp, H. sapiens
cagcctcagccccagg

SEQ ID NO: 66588 - DNA, 16 bp, H. sapiens
cagcctcagccccggg

SEQ ID NO: 66589 - DNA, 16 bp, H. sapiens
cagcctcagcctcacc

SEQ ID NO: 66590 - DNA, 16 bp, H. sapiens
cagcctcagcctcagc

SEQ ID NO: 66591 - DNA, 16 bp, H. sapiens
cagcctcagcctcatg

SEQ ID NO: 66592 - DNA, 16 bp, H. sapiens
cagcctcagcctcccg

SEQ ID NO: 66593 - DNA, 16 bp, H. sapiens
cagcctcagcctggcc

SEQ ID NO: 66594 - DNA, 16 bp, H. sapiens
cagcctcagctcactg

SEQ ID NO: 66595 - DNA, 16 bp, H. sapiens
cagcctcagctcctcc

SEQ ID NO: 66596 - DNA, 16 bp, H. sapiens
cagcctcagcttcctc

SEQ ID NO: 66597 - DNA, 16 bp, H. sapiens
cagcctcaggagcagc

SEQ ID NO: 66598 - DNA, 16 bp, H. sapiens
cagcctcaggagctgc

SEQ ID NO: 66599 - DNA, 16 bp, H. sapiens
cagcctcaggcaacca

SEQ ID NO: 66600 - DNA, 16 bp, H. sapiens
cagcctcaggcagttc

SEQ ID NO: 66601 - DNA, 16 bp, H. sapiens
cagcctcagtggcaga

SEQ ID NO: 66602 - DNA, 16 bp, H. sapiens
cagcctcatccctgcc

SEQ ID NO: 66603 - DNA, 16 bp, H. sapiens
cagcctcatgacagag

SEQ ID NO: 66604 - DNA, 16 bp, H. sapiens
cagcctcattttcccc

SEQ ID NO: 66605 - DNA, 16 bp, H. sapiens
cagcctccaaaaatgt

SEQ ID NO: 66606 - DNA, 16 bp, H. sapiens
cagcctccaactccag

SEQ ID NO: 66607 - DNA, 16 bp, H. sapiens
cagcctccacagcagc

SEQ ID NO: 66608 - DNA, 16 bp, H. sapiens
cagcctccaccacctg

SEQ ID NO: 66609 - DNA, 16 bp, H. sapiens
cagcctccacctactg

SEQ ID NO: 66610 - DNA, 16 bp, H. sapiens
cagcctccacctcaca

SEQ ID NO: 66611 - DNA, 16 bp, H. sapiens
cagcctccacctccag

SEQ ID NO: 66612 - DNA, 16 bp, H. sapiens
cagcctccacctctca

SEQ ID NO: 66613 - DNA, 16 bp, H. sapiens
cagcctccacctgcca

SEQ ID NO: 66614 - DNA, 16 bp, H. sapiens
cagcctccacctgctg

SEQ ID NO: 66615 - DNA, 16 bp, H. sapiens
cagcctccaccttcca

SEQ ID NO: 66616 - DNA, 16 bp, H. sapiens
cagcctccaccttcct

SEQ ID NO: 66617 - DNA, 16 bp, H. sapiens
cagcctccacttcccc

SEQ ID NO: 66618 - DNA, 16 bp, H. sapiens
cagcctccagaacagt

SEQ ID NO: 66619 - DNA, 16 bp, H. sapiens
cagcctccagaaccat

SEQ ID NO: 66620 - DNA, 16 bp, H. sapiens
cagcctccagaactct

SEQ ID NO: 66621 - DNA, 16 bp, H. sapiens
cagcctccagaactgg

SEQ ID NO: 66622 - DNA, 16 bp, H. sapiens
cagcctccagagaagc

SEQ ID NO: 66623 - DNA, 16 bp, H. sapiens
cagcctccagagcagc

SEQ ID NO: 66624 - DNA, 16 bp, H. sapiens
cagcctccagcccacc

SEQ ID NO: 66625 - DNA, 16 bp, H. sapiens
cagcctccagcccagt

SEQ ID NO: 66626 - DNA, 16 bp, H. sapiens
cagcctccagcccctc

SEQ ID NO: 66627 - DNA, 16 bp, H. sapiens
cagcctccagctggga

SEQ ID NO: 66628 - DNA, 16 bp, H. sapiens
cagcctccataatcaa

SEQ ID NO: 66629 - DNA, 16 bp, H. sapiens
cagcctccatctccag

SEQ ID NO: 66630 - DNA, 16 bp, H. sapiens
cagcctccatctcctg

SEQ ID NO: 66631 - DNA, 16 bp, H. sapiens
cagcctccatcttcca

SEQ ID NO: 66632 - DNA, 16 bp, H. sapiens
cagcctcccaagaagg

SEQ ID NO: 66633 - DNA, 16 bp, H. sapiens
cagcctcccaaggagc

SEQ ID NO: 66634 - DNA, 16 bp, H. sapiens
cagcctcccaaggagt

SEQ ID NO: 66635 - DNA, 16 bp, H. sapiens
cagcctcccaagtccc

SEQ ID NO: 66636 - DNA, 16 bp, H. sapiens
cagcctcccagactgc

SEQ ID NO: 66637 - DNA, 16 bp, H. sapiens
cagcctcccagagtag

SEQ ID NO: 66638 - DNA, 16 bp, H. sapiens
cagcctcccagagtgg

SEQ ID NO: 66639 - DNA, 16 bp, H. sapiens
cagcctcccagagtgt

SEQ ID NO: 66640 - DNA, 16 bp, H. sapiens
cagcctcccagcgtgc

SEQ ID NO: 66641 - DNA, 16 bp, H. sapiens
cagcctcccaggctgg

SEQ ID NO: 66642 - DNA, 16 bp, H. sapiens
cagcctcccagggagc

SEQ ID NO: 66643 - DNA, 16 bp, H. sapiens
cagcctccccaaatcc

SEQ ID NO: 66644 - DNA, 16 bp, H. sapiens
cagcctccccagcaac

SEQ ID NO: 66645 - DNA, 16 bp, H. sapiens
cagcctccccagcagc

SEQ ID NO: 66646 - DNA, 16 bp, H. sapiens
cagcctccccagcagt

SEQ ID NO: 66647 - DNA, 16 bp, H. sapiens
cagcctccccagcctc

SEQ ID NO: 66648 - DNA, 16 bp, H. sapiens
cagcctccccaggagc

SEQ ID NO: 66649 - DNA, 16 bp, H. sapiens
cagcctccccaggtag

SEQ ID NO: 66650 - DNA, 16 bp, H. sapiens
cagcctccccaggtgc

SEQ ID NO: 66651 - DNA, 16 bp, H. sapiens
cagcctccccttcctg

SEQ ID NO: 66652 - DNA, 18 bp, H. sapiens
cagcctcccgagaagctg

SEQ ID NO: 66653 - DNA, 16 bp, H. sapiens
cagcctcccgcgcagc

SEQ ID NO: 66654 - DNA, 16 bp, H. sapiens
cagcctcccgggcagc

SEQ ID NO: 66655 - DNA, 16 bp, H. sapiens
cagcctccctcccggc

SEQ ID NO: 66656 - DNA, 16 bp, H. sapiens
cagcctccctccctct

SEQ ID NO: 66657 - DNA, 16 bp, H. sapiens
cagcctccctcctggc

SEQ ID NO: 66658 - DNA, 16 bp, H. sapiens
cagcctccctccttcc

SEQ ID NO: 66659 - DNA, 16 bp, H. sapiens
cagcctccctctcagc

SEQ ID NO: 66660 - DNA, 16 bp, H. sapiens
cagcctccctctcctg

SEQ ID NO: 66661 - DNA, 16 bp, H. sapiens
cagcctccctggcctc

SEQ ID NO: 66662 - DNA, 16 bp, H. sapiens
cagcctccctggctct

SEQ ID NO: 66663 - DNA, 16 bp, H. sapiens
cagcctcccttccagc

SEQ ID NO: 66664 - DNA, 16 bp, H. sapiens
cagcctccgcctcctg

SEQ ID NO: 66665 - DNA, 16 bp, H. sapiens
cagcctccgcttcctg

SEQ ID NO: 66666 - DNA, 16 bp, H. sapiens
cagcctcctaattagc

SEQ ID NO: 66667 - DNA, 16 bp, H. sapiens
cagcctcctcagcagc

SEQ ID NO: 66668 - DNA, 16 bp, H. sapiens
cagcctcctcccaggc

SEQ ID NO: 66669 - DNA, 16 bp, H. sapiens
cagcctcctccctgct

SEQ ID NO: 66670 - DNA, 16 bp, H. sapiens
cagcctcctcctcagc

SEQ ID NO: 66671 - DNA, 16 bp, H. sapiens
cagcctcctcctccca

SEQ ID NO: 66672 - DNA, 16 bp, H. sapiens
cagcctcctcctccct

SEQ ID NO: 66673 - DNA, 16 bp, H. sapiens
cagcctcctcctcctg

SEQ ID NO: 66674 - DNA, 16 bp, H. sapiens
cagcctcctcctcctt

SEQ ID NO: 66675 - DNA, 16 bp, H. sapiens
cagcctcctcctctgc

SEQ ID NO: 66676 - DNA, 16 bp, H. sapiens
cagcctcctcctgggc

SEQ ID NO: 66677 - DNA, 16 bp, H. sapiens
cagcctcctccttcct

SEQ ID NO: 66678 - DNA, 16 bp, H. sapiens
cagcctcctgagaagg

SEQ ID NO: 66679 - DNA, 16 bp, H. sapiens
cagcctcctgagcagg

SEQ ID NO: 66680 - DNA, 16 bp, H. sapiens
cagcctcctgagtatc

SEQ ID NO: 66681 - DNA, 16 bp, H. sapiens
cagcctcctgagtcac

SEQ ID NO: 66682 - DNA, 16 bp, H. sapiens
cagcctcctgccccac

SEQ ID NO: 66683 - DNA, 16 bp, H. sapiens
cagcctcctggcctca

SEQ ID NO: 66684 - DNA, 16 bp, H. sapiens
cagcctcctgggcagc

SEQ ID NO: 66685 - DNA, 16 bp, H. sapiens
cagcctcctgggctcc

SEQ ID NO: 66686 - DNA, 16 bp, H. sapiens
cagcctccttcctgcc

SEQ ID NO: 66687 - DNA, 16 bp, H. sapiens
cagcctccttggcctc

SEQ ID NO: 66688 - DNA, 16 bp, H. sapiens
cagcctcgacctcccg

SEQ ID NO: 66689 - DNA, 16 bp, H. sapiens
cagcctcgctgccacc

SEQ ID NO: 66690 - DNA, 17 bp, H. sapiens
cagcctcgctgccgcct

SEQ ID NO: 66691 - DNA, 16 bp, H. sapiens
cagcctcggcaacagg

SEQ ID NO: 66692 - DNA, 16 bp, H. sapiens
cagcctcggcctccag

SEQ ID NO: 66693 - DNA, 16 bp, H. sapiens
cagcctcggcctcctg

SEQ ID NO: 66694 - DNA, 16 bp, H. sapiens
cagcctcgtcctcctg

SEQ ID NO: 66695 - DNA, 16 bp, H. sapiens
cagcctctacctcccc

SEQ ID NO: 66696 - DNA, 16 bp, H. sapiens
cagcctctacctcctg

SEQ ID NO: 66697 - DNA, 16 bp, H. sapiens
cagcctctccagcagc

SEQ ID NO: 66698 - DNA, 16 bp, H. sapiens
cagcctctccctcctg

SEQ ID NO: 66699 - DNA, 16 bp, H. sapiens
cagcctctcctcccca

SEQ ID NO: 66700 - DNA, 16 bp, H. sapiens
cagcctctcctgcctc

SEQ ID NO: 66701 - DNA, 16 bp, H. sapiens
cagcctctccttcctc

SEQ ID NO: 66702 - DNA, 16 bp, H. sapiens
cagcctctctcccagc

SEQ ID NO: 66703 - DNA, 16 bp, H. sapiens
cagcctctctccttgg

SEQ ID NO: 66704 - DNA, 16 bp, H. sapiens
cagcctctctgagtct

SEQ ID NO: 66705 - DNA, 16 bp, H. sapiens
cagcctctctggcctc

SEQ ID NO: 66706 - DNA, 16 bp, H. sapiens
cagcctctctgtgcct

SEQ ID NO: 66707 - DNA, 16 bp, H. sapiens
cagcctctcttcatcc

SEQ ID NO: 66708 - DNA, 16 bp, H. sapiens
cagcctctgattggct

SEQ ID NO: 66709 - DNA, 16 bp, H. sapiens
cagcctctgcaggccc

SEQ ID NO: 66710 - DNA, 16 bp, H. sapiens
cagcctctgccacctg

SEQ ID NO: 66711 - DNA, 16 bp, H. sapiens
cagcctctgccaggcc

SEQ ID NO: 66712 - DNA, 16 bp, H. sapiens
cagcctctgcccagcc

SEQ ID NO: 66713 - DNA, 16 bp, H. sapiens
cagcctctgccccctg

SEQ ID NO: 66714 - DNA, 16 bp, H. sapiens
cagcctctgcccggct

SEQ ID NO: 66715 - DNA, 16 bp, H. sapiens
cagcctctgccctcag

SEQ ID NO: 66716 - DNA, 16 bp, H. sapiens
cagcctctgccctgcc

SEQ ID NO: 66717 - DNA, 16 bp, H. sapiens
cagcctctgcctcaca

SEQ ID NO: 66718 - DNA, 16 bp, H. sapiens
cagcctctgcctccag

SEQ ID NO: 66719 - DNA, 16 bp, H. sapiens
cagcctctgcctccca

SEQ ID NO: 66720 - DNA, 16 bp, H. sapiens
cagcctctgcctcccg

SEQ ID NO: 66721 - DNA, 16 bp, H. sapiens
cagcctctgcctccct

SEQ ID NO: 66722 - DNA, 16 bp, H. sapiens
cagcctctgcctcctg

SEQ ID NO: 66723 - DNA, 16 bp, H. sapiens
cagcctctgccttccg

SEQ ID NO: 66724 - DNA, 16 bp, H. sapiens
cagcctctgctccccc

SEQ ID NO: 66725 - DNA, 16 bp, H. sapiens
cagcctctgctcctcc

SEQ ID NO: 66726 - DNA, 19 bp, H. sapiens
cagcctctgctgctgatac

SEQ ID NO: 66727 - DNA, 16 bp, H. sapiens
cagcctctggagcagc

SEQ ID NO: 66728 - DNA, 16 bp, H. sapiens
cagcctctggtaaaca

SEQ ID NO: 66729 - DNA, 16 bp, H. sapiens
cagcctctggtaacca

SEQ ID NO: 66730 - DNA, 16 bp, H. sapiens
cagcctctgtctcctg

SEQ ID NO: 66731 - DNA, 16 bp, H. sapiens
cagcctctgttatttt

SEQ ID NO: 66732 - DNA, 16 bp, H. sapiens
cagcctcttcctcctg

SEQ ID NO: 66733 - DNA, 16 bp, H. sapiens
cagcctcttcttactc

SEQ ID NO: 66734 - DNA, 16 bp, H. sapiens
cagcctctttccccag

SEQ ID NO: 66735 - DNA, 16 bp, H. sapiens
cagcctgaagccatgg

SEQ ID NO: 66736 - DNA, 16 bp, H. sapiens
cagcctgaccaacata

SEQ ID NO: 66737 - DNA, 22 bp, H. sapiens
cagcctgaccaatatggagaaa

SEQ ID NO: 66738 - DNA, 16 bp, H. sapiens
cagcctgagaaacaag

SEQ ID NO: 66739 - DNA, 16 bp, H. sapiens
cagcctgagaaacagg

SEQ ID NO: 66740 - DNA, 16 bp, H. sapiens
cagcctgagcaatgta

SEQ ID NO: 66741 - DNA, 16 bp, H. sapiens
cagcctgagcgacagt

SEQ ID NO: 66742 - DNA, 16 bp, H. sapiens
cagcctgagctacaga

SEQ ID NO: 66743 - DNA, 16 bp, H. sapiens
cagcctgaggaacaga

SEQ ID NO: 66744 - DNA, 16 bp, H. sapiens
cagcctgaggaacata

SEQ ID NO: 66745 - DNA, 16 bp, H. sapiens
cagcctgaggacagag

SEQ ID NO: 66746 - DNA, 16 bp, H. sapiens
cagcctgaggccctca

SEQ ID NO: 66747 - DNA, 16 bp, H. sapiens
cagcctgatttttttt

SEQ ID NO: 66748 - DNA, 16 bp, H. sapiens
cagcctgcacaactgt

SEQ ID NO: 66749 - DNA, 16 bp, H. sapiens
cagcctgcacctatgg

SEQ ID NO: 66750 - DNA, 16 bp, H. sapiens
cagcctgcacctccca

SEQ ID NO: 66751 - DNA, 16 bp, H. sapiens
cagcctgcagaaatgt

SEQ ID NO: 66752 - DNA, 16 bp, H. sapiens
cagcctgcagagctgt

SEQ ID NO: 66753 - DNA, 16 bp, H. sapiens
cagcctgcatgacaga

SEQ ID NO: 66754 - DNA, 16 bp, H. sapiens
cagcctgcattgccaa

SEQ ID NO: 66755 - DNA, 16 bp, H. sapiens
cagcctgccagcctgc

SEQ ID NO: 66756 - DNA, 16 bp, H. sapiens
cagcctgcccaacatg

SEQ ID NO: 66757 - DNA, 16 bp, H. sapiens
cagcctgcccagctac

SEQ ID NO: 66758 - DNA, 16 bp, H. sapiens
cagcctgcccctcctg

SEQ ID NO: 66759 - DNA, 16 bp, H. sapiens
cagcctgctaagcatt

SEQ ID NO: 66760 - DNA, 16 bp, H. sapiens
cagcctgctcccctga

SEQ ID NO: 66761 - DNA, 16 bp, H. sapiens
cagcctgctgctgcca

SEQ ID NO: 66762 - DNA, 16 bp, H. sapiens
cagcctgctggcctgc

SEQ ID NO: 66763 - DNA, 16 bp, H. sapiens
cagcctgctggctttg

SEQ ID NO: 66764 - DNA, 16 bp, H. sapiens
cagcctgctgggtgac

SEQ ID NO: 66765 - DNA, 16 bp, H. sapiens
cagcctggaaaaaaaa

SEQ ID NO: 66766 - DNA, 16 bp, H. sapiens
cagcctggaaaacata

SEQ ID NO: 66767 - DNA, 16 bp, H. sapiens
cagcctggaaaacatg

SEQ ID NO: 66768 - DNA, 16 bp, H. sapiens
cagcctggaaacagag

SEQ ID NO: 66769 - DNA, 16 bp, H. sapiens
cagcctggacaacata

SEQ ID NO: 66770 - DNA, 16 bp, H. sapiens
cagcctggacaacatc

SEQ ID NO: 66771 - DNA, 16 bp, H. sapiens
cagcctggacaacctg

SEQ ID NO: 66772 - DNA, 16 bp, H. sapiens
cagcctggacaccatg

SEQ ID NO: 66773 - DNA, 16 bp, H. sapiens
cagcctggacgacagg

SEQ ID NO: 66774 - DNA, 16 bp, H. sapiens
cagcctggactacatg

SEQ ID NO: 66775 - DNA, 16 bp, H. sapiens
cagcctggacttcact

SEQ ID NO: 66776 - DNA, 16 bp, H. sapiens
cagcctggacttcatt

SEQ ID NO: 66777 - DNA, 16 bp, H. sapiens
cagcctggagacacag

SEQ ID NO: 66778 - DNA, 16 bp, H. sapiens
cagcctggagcctggg

SEQ ID NO: 66779 - DNA, 16 bp, H. sapiens
cagcctggaggacaga

SEQ ID NO: 66780 - DNA, 16 bp, H. sapiens
cagcctggagggaggc

SEQ ID NO: 66781 - DNA, 16 bp, H. sapiens
cagcctggagtccagt

SEQ ID NO: 66782 - DNA, 16 bp, H. sapiens
cagcctggcacggtgg

SEQ ID NO: 66783 - DNA, 16 bp, H. sapiens
cagcctggcagccccg

SEQ ID NO: 66784 - DNA, 16 bp, H. sapiens
cagcctggcagccctg

SEQ ID NO: 66785 - DNA, 16 bp, H. sapiens
cagcctggcagcctgg

SEQ ID NO: 66786 - DNA, 16 bp, H. sapiens
cagcctggcagtttct

SEQ ID NO: 66787 - DNA, 16 bp, H. sapiens
cagcctggcatcccag

SEQ ID NO: 66788 - DNA, 16 bp, H. sapiens
cagcctggccaacttg

SEQ ID NO: 66789 - DNA, 16 bp, H. sapiens
cagcctggccaagaag

SEQ ID NO: 66790 - DNA, 16 bp, H. sapiens
cagcctggccacagag

SEQ ID NO: 66791 - DNA, 16 bp, H. sapiens
cagcctggccaccatg

SEQ ID NO: 66792 - DNA, 16 bp, H. sapiens
cagcctggccacgatg

SEQ ID NO: 66793 - DNA, 16 bp, H. sapiens
cagcctggccagcaag

SEQ ID NO: 66794 - DNA, 16 bp, H. sapiens
cagcctggccagcaga

SEQ ID NO: 66795 - DNA, 16 bp, H. sapiens
cagcctggccagcagc

SEQ ID NO: 66796 - DNA, 16 bp, H. sapiens
cagcctggccatcatg

SEQ ID NO: 66797 - DNA, 16 bp, H. sapiens
cagcctggcccacatg

SEQ ID NO: 66798 - DNA, 16 bp, H. sapiens
cagcctggcccagcct

SEQ ID NO: 66799 - DNA, 16 bp, H. sapiens
cagcctggcccagggc

SEQ ID NO: 66800 - DNA, 16 bp, H. sapiens
cagcctggcccctgcc

SEQ ID NO: 66801 - DNA, 16 bp, H. sapiens
cagcctggcccctgct

SEQ ID NO: 66802 - DNA, 16 bp, H. sapiens
cagcctggcctacgtg

SEQ ID NO: 66803 - DNA, 16 bp, H. sapiens
cagcctggcctggccc

SEQ ID NO: 66804 - DNA, 16 bp, H. sapiens
cagcctggccttgaac

SEQ ID NO: 66805 - DNA, 16 bp, H. sapiens
cagcctggctgccgcc

SEQ ID NO: 66806 - DNA, 16 bp, H. sapiens
cagcctggctggccaa

SEQ ID NO: 66807 - DNA, 16 bp, H. sapiens
cagcctgggaaaaaaa

SEQ ID NO: 66808 - DNA, 16 bp, H. sapiens
cagcctgggaaaaata

SEQ ID NO: 66809 - DNA, 16 bp, H. sapiens
cagcctgggaaacaga

SEQ ID NO: 66810 - DNA, 16 bp, H. sapiens
cagcctgggaacatgg

SEQ ID NO: 66811 - DNA, 16 bp, H. sapiens
cagcctgggaaggacc

SEQ ID NO: 66812 - DNA, 16 bp, H. sapiens
cagcctgggactcctg

SEQ ID NO: 66813 - DNA, 16 bp, H. sapiens
cagcctgggagactcc

SEQ ID NO: 66814 - DNA, 16 bp, H. sapiens
cagcctgggcaacata

SEQ ID NO: 66815 - DNA, 26 bp, H. sapiens
cagcctgggcaacatggcaaaaccct

SEQ ID NO: 66816 - DNA, 16 bp, H. sapiens
cagcctgggcaacctg

SEQ ID NO: 66817 - DNA, 16 bp, H. sapiens
cagcctgggcaagagc

SEQ ID NO: 66818 - DNA, 16 bp, H. sapiens
cagcctgggcaagatg

SEQ ID NO: 66819 - DNA, 16 bp, H. sapiens
cagcctgggcaaggag

SEQ ID NO: 66820 - DNA, 16 bp, H. sapiens
cagcctgggcacaggg

SEQ ID NO: 66821 - DNA, 16 bp, H. sapiens
cagcctgggcagcaac

SEQ ID NO: 66822 - DNA, 16 bp, H. sapiens
cagcctgggcagcaca

SEQ ID NO: 66823 - DNA, 16 bp, H. sapiens
cagcctgggcagcagc

SEQ ID NO: 66824 - DNA, 16 bp, H. sapiens
cagcctgggcagcctg

SEQ ID NO: 66825 - DNA, 16 bp, H. sapiens
cagcctgggcatcaca

SEQ ID NO: 66826 - DNA, 16 bp, H. sapiens
cagcctgggccaggcc

SEQ ID NO: 66827 - DNA, 16 bp, H. sapiens
cagcctgggccctggg

SEQ ID NO: 66828 - DNA, 16 bp, H. sapiens
cagcctgggcctccca

SEQ ID NO: 66829 - DNA, 16 bp, H. sapiens
cagcctgggcgaccag

SEQ ID NO: 66830 - DNA, 16 bp, H. sapiens
cagcctgggcttcatt

SEQ ID NO: 66831 - DNA, 16 bp, H. sapiens
cagcctggggaacacg

SEQ ID NO: 66832 - DNA, 16 bp, H. sapiens
cagcctggggaagaag

SEQ ID NO: 66833 - DNA, 16 bp, H. sapiens
cagcctggggaatata

SEQ ID NO: 66834 - DNA, 16 bp, H. sapiens
cagcctggggacagaa

SEQ ID NO: 66835 - DNA, 16 bp, H. sapiens
cagcctggggacagag

SEQ ID NO: 66836 - DNA, 16 bp, H. sapiens
cagcctggggagaagg

SEQ ID NO: 66837 - DNA, 16 bp, H. sapiens
cagcctggggaggagg

SEQ ID NO: 66838 - DNA, 16 bp, H. sapiens
cagcctggggcctggg

SEQ ID NO: 66839 - DNA, 16 bp, H. sapiens
cagcctggggctcctg

SEQ ID NO: 66840 - DNA, 16 bp, H. sapiens
cagcctgggggatgga

SEQ ID NO: 66841 - DNA, 16 bp, H. sapiens
cagcctgggtaacagg

SEQ ID NO: 66842 - DNA, 16 bp, H. sapiens
cagcctgggtaatata

SEQ ID NO: 66843 - DNA, 22 bp, H. sapiens
cagcctgggtgacagaatgaga

SEQ ID NO: 66844 - DNA, 16 bp, H. sapiens
cagcctgggtgacagt

SEQ ID NO: 66845 - DNA, 16 bp, H. sapiens
cagcctgggtgacata

SEQ ID NO: 66846 - DNA, 16 bp, H. sapiens
cagcctgggtgaccag

SEQ ID NO: 66847 - DNA, 16 bp, H. sapiens
cagcctgggtgggtga

SEQ ID NO: 66848 - DNA, 16 bp, H. sapiens
cagcctggtcaacaag

SEQ ID NO: 66849 - DNA, 16 bp, H. sapiens
cagcctggtcaacatg

SEQ ID NO: 66850 - DNA, 16 bp, H. sapiens
cagcctggtcaccatg

SEQ ID NO: 66851 - DNA, 16 bp, H. sapiens
cagcctggtgacacag

SEQ ID NO: 66852 - DNA, 16 bp, H. sapiens
cagcctggtgatggag

SEQ ID NO: 66853 - DNA, 16 bp, H. sapiens
cagcctggtgcagtgg

SEQ ID NO: 66854 - DNA, 16 bp, H. sapiens
cagcctggtggcagag

SEQ ID NO: 66855 - DNA, 16 bp, H. sapiens
cagcctgtccaatgtg

SEQ ID NO: 66856 - DNA, 16 bp, H. sapiens
cagcctgtcctttgaa

SEQ ID NO: 66857 - DNA, 16 bp, H. sapiens
cagcctgtgcaacaag

SEQ ID NO: 66858 - DNA, 16 bp, H. sapiens
cagcctgtggtgaatg

SEQ ID NO: 66859 - DNA, 16 bp, H. sapiens
cagcctgtgtgacaag

SEQ ID NO: 66860 - DNA, 16 bp, H. sapiens
cagcctgttggccagg

SEQ ID NO: 66861 - DNA, 16 bp, H. sapiens
cagcctgtttctgcag

SEQ ID NO: 66862 - DNA, 16 bp, H. sapiens
cagcctgttttatttt

SEQ ID NO: 66863 - DNA, 16 bp, H. sapiens
cagccttaaaaaatga

SEQ ID NO: 66864 - DNA, 16 bp, H. sapiens
cagccttaaaagagaa

SEQ ID NO: 66865 - DNA, 16 bp, H. sapiens
cagccttaaaatagaa

SEQ ID NO: 66866 - DNA, 16 bp, H. sapiens
cagccttaaagaagaa

SEQ ID NO: 66867 - DNA, 16 bp, H. sapiens
cagccttcagaactga

SEQ ID NO: 66868 - DNA, 16 bp, H. sapiens
cagccttcaggcctcc

SEQ ID NO: 66869 - DNA, 16 bp, H. sapiens
cagccttcccaacatg

SEQ ID NO: 66870 - DNA, 16 bp, H. sapiens
cagccttccccatctc

SEQ ID NO: 66871 - DNA, 16 bp, H. sapiens
cagccttccttgcagt

SEQ ID NO: 66872 - DNA, 16 bp, H. sapiens
cagccttcgcctccca

SEQ ID NO: 66873 - DNA, 16 bp, H. sapiens
cagccttctctccagg

SEQ ID NO: 66874 - DNA, 16 bp, H. sapiens
cagccttctgagaagc

SEQ ID NO: 66875 - DNA, 16 bp, H. sapiens
cagccttctgagccag

SEQ ID NO: 66876 - DNA, 16 bp, H. sapiens
cagccttctggagaac

SEQ ID NO: 66877 - DNA, 16 bp, H. sapiens
cagccttgaaaaagaa

SEQ ID NO: 66878 - DNA, 16 bp, H. sapiens
cagccttgaaatcctg

SEQ ID NO: 66879 - DNA, 16 bp, H. sapiens
cagccttgaattcctc

SEQ ID NO: 66880 - DNA, 16 bp, H. sapiens
cagccttgcaccccag

SEQ ID NO: 66881 - DNA, 16 bp, H. sapiens
cagccttgccctccca

SEQ ID NO: 66882 - DNA, 16 bp, H. sapiens
cagccttgctgccacc

SEQ ID NO: 66883 - DNA, 16 bp, H. sapiens
cagccttggggacaga

SEQ ID NO: 66884 - DNA, 16 bp, H. sapiens
cagccttgtcaaagat

SEQ ID NO: 66885 - DNA, 16 bp, H. sapiens
cagccttgtgtgtgat

SEQ ID NO: 66886 - DNA, 16 bp, H. sapiens
cagccttgttttgttt

SEQ ID NO: 66887 - DNA, 16 bp, H. sapiens
cagccttttcagactg

SEQ ID NO: 66888 - DNA, 16 bp, H. sapiens
cagccttttgttttgt

SEQ ID NO: 66889 - DNA, 16 bp, H. sapiens
cagcgacagatcatca

SEQ ID NO: 66890 - DNA, 17 bp, H. sapiens
cagcgagaccacgagcc

SEQ ID NO: 66891 - DNA, 16 bp, H. sapiens
cagcgagctgcacttt

SEQ ID NO: 66892 - DNA, 17 bp, H. sapiens
cagcgcagcctggcatt

SEQ ID NO: 66893 - DNA, 16 bp, H. sapiens
cagcgccgcctgctgg

SEQ ID NO: 66894 - DNA, 16 bp, H. sapiens
cagcgctccagcctgg

SEQ ID NO: 66895 - DNA, 17 bp, H. sapiens
cagcgcttgcgggccag

SEQ ID NO: 66896 - DNA, 16 bp, H. sapiens
cagcgctttgagaggc

SEQ ID NO: 66897 - DNA, 18 bp, H. sapiens
cagcgctttgggaggcca

SEQ ID NO: 66898 - DNA, 16 bp, H. sapiens
cagcggctcacgcctg

SEQ ID NO: 66899 - DNA, 16 bp, H. sapiens
cagcggctgcagaggg

SEQ ID NO: 66900 - DNA, 16 bp, H. sapiens
cagcggctgccgctgc

SEQ ID NO: 66901 - DNA, 16 bp, H. sapiens
cagcgggtgcagccca

SEQ ID NO: 66902 - DNA, 16 bp, H. sapiens
cagcggtggctgcaga

SEQ ID NO: 66903 - DNA, 16 bp, H. sapiens
cagcggttctcaaagt

SEQ ID NO: 66904 - DNA, 16 bp, H. sapiens
cagcgtcttgctctgt

SEQ ID NO: 66905 - DNA, 16 bp, H. sapiens
cagcgtcttgttctgt

SEQ ID NO: 66906 - DNA, 16 bp, H. sapiens
cagcgtgggtgacaag

SEQ ID NO: 66907 - DNA, 16 bp, H. sapiens
cagctaaagcaatgtt

SEQ ID NO: 66908 - DNA, 16 bp, H. sapiens
cagctaactttttaaa

SEQ ID NO: 66909 - DNA, 16 bp, H. sapiens
cagctaactttttgtt

SEQ ID NO: 66910 - DNA, 16 bp, H. sapiens
cagctaatgtttgtat

SEQ ID NO: 66911 - DNA, 16 bp, H. sapiens
cagctaattctttttt

SEQ ID NO: 66912 - DNA, 16 bp, H. sapiens
cagctaatttatgtat

SEQ ID NO: 66913 - DNA, 16 bp, H. sapiens
cagctaatttgttttt

SEQ ID NO: 66914 - DNA, 16 bp, H. sapiens
cagctaattttctttg

SEQ ID NO: 66915 - DNA, 16 bp, H. sapiens
cagctaatttttaaaa

SEQ ID NO: 66916 - DNA, 16 bp, H. sapiens
cagctaatttttttct

SEQ ID NO: 66917 - DNA, 16 bp, H. sapiens
cagctacaaataaaat

SEQ ID NO: 66918 - DNA, 16 bp, H. sapiens
cagctacctcggaggc

SEQ ID NO: 66919 - DNA, 16 bp, H. sapiens
cagctacctggaggct

SEQ ID NO: 66920 - DNA, 16 bp, H. sapiens
cagctacctgggaggg

SEQ ID NO: 66921 - DNA, 16 bp, H. sapiens
cagctacgtggaactg

SEQ ID NO: 66922 - DNA, 16 bp, H. sapiens
cagctactacagaggc

SEQ ID NO: 66923 - DNA, 16 bp, H. sapiens
cagctactacggaggc

SEQ ID NO: 66924 - DNA, 16 bp, H. sapiens
cagctactatggaggc

SEQ ID NO: 66925 - DNA, 16 bp, H. sapiens
cagctactcaaggctg

SEQ ID NO: 66926 - DNA, 16 bp, H. sapiens
cagctactcagctctg

SEQ ID NO: 66927 - DNA, 16 bp, H. sapiens
cagctactcaggagct

SEQ ID NO: 66928 - DNA, 16 bp, H. sapiens
cagctactcagtgggg

SEQ ID NO: 66929 - DNA, 16 bp, H. sapiens
cagctactcgggagct

SEQ ID NO: 66930 - DNA, 16 bp, H. sapiens
cagctactgcaacctc

SEQ ID NO: 66931 - DNA, 16 bp, H. sapiens
cagctactgcagaggc

SEQ ID NO: 66932 - DNA, 16 bp, H. sapiens
cagctacttagaggct

SEQ ID NO: 66933 - DNA, 16 bp, H. sapiens
cagctacttggagggt

SEQ ID NO: 66934 - DNA, 17 bp, H. sapiens
cagctacttgggagtct

SEQ ID NO: 66935 - DNA, 16 bp, H. sapiens
cagctactttgggggc

SEQ ID NO: 66936 - DNA, 16 bp, H. sapiens
cagctaggaagtggtg

SEQ ID NO: 66937 - DNA, 16 bp, H. sapiens
cagctaggcacagtgg

SEQ ID NO: 66938 - DNA, 16 bp, H. sapiens
cagctagggtgacaga

SEQ ID NO: 66939 - DNA, 16 bp, H. sapiens
cagctaggtgtggtgg

SEQ ID NO: 66940 - DNA, 16 bp, H. sapiens
cagctagtaaatggca

SEQ ID NO: 66941 - DNA, 16 bp, H. sapiens
cagctagttcattgtt

SEQ ID NO: 66942 - DNA, 16 bp, H. sapiens
cagctagtttttattt

SEQ ID NO: 66943 - DNA, 16 bp, H. sapiens
cagctataaaaaaaga

SEQ ID NO: 66944 - DNA, 16 bp, H. sapiens
cagctataaaaaggaa

SEQ ID NO: 66945 - DNA, 16 bp, H. sapiens
cagctatatgctgcct

SEQ ID NO: 66946 - DNA, 16 bp, H. sapiens
cagctatcattagtgt

SEQ ID NO: 66947 - DNA, 16 bp, H. sapiens
cagctatgaaaaagaa

SEQ ID NO: 66948 - DNA, 16 bp, H. sapiens
cagctatgccctgccc

SEQ ID NO: 66949 - DNA, 16 bp, H. sapiens
cagctatgcgggaggc

SEQ ID NO: 66950 - DNA, 16 bp, H. sapiens
cagctatgctggaggc

SEQ ID NO: 66951 - DNA, 16 bp, H. sapiens
cagctatgtgaccctg

SEQ ID NO: 66952 - DNA, 16 bp, H. sapiens
cagctattaaaaagaa

SEQ ID NO: 66953 - DNA, 16 bp, H. sapiens
cagctattataaaagg

SEQ ID NO: 66954 - DNA, 16 bp, H. sapiens
cagctattccagaggc

SEQ ID NO: 66955 - DNA, 16 bp, H. sapiens
cagctattctggaggc

SEQ ID NO: 66956 - DNA, 17 bp, H. sapiens
cagctattctggaggct

SEQ ID NO: 66957 - DNA, 16 bp, H. sapiens
cagctatttattttat

SEQ ID NO: 66958 - DNA, 16 bp, H. sapiens
cagctatttttaaaat

SEQ ID NO: 66959 - DNA, 16 bp, H. sapiens
cagctcaaaaataaat

SEQ ID NO: 66960 - DNA, 16 bp, H. sapiens
cagctcaaggaggcct

SEQ ID NO: 66961 - DNA, 16 bp, H. sapiens
cagctcacagcagcct

SEQ ID NO: 66962 - DNA, 16 bp, H. sapiens
cagctcaccaccacct

SEQ ID NO: 66963 - DNA, 16 bp, H. sapiens
cagctcacctcagcct

SEQ ID NO: 66964 - DNA, 16 bp, H. sapiens
cagctcacggcagcct

SEQ ID NO: 66965 - DNA, 16 bp, H. sapiens
cagctcactccagcct

SEQ ID NO: 66966 - DNA, 16 bp, H. sapiens
cagctcactgaaccct

SEQ ID NO: 66967 - DNA, 16 bp, H. sapiens
cagctcactgaagtct

SEQ ID NO: 66968 - DNA, 16 bp, H. sapiens
cagctcactgcaactg

SEQ ID NO: 66969 - DNA, 16 bp, H. sapiens
cagctcactgtaactt

SEQ ID NO: 66970 - DNA, 16 bp, H. sapiens
cagctcagaggagacc

SEQ ID NO: 66971 - DNA, 16 bp, H. sapiens
cagctcagccacagca

SEQ ID NO: 66972 - DNA, 16 bp, H. sapiens
cagctcagccacaggg

SEQ ID NO: 66973 - DNA, 16 bp, H. sapiens
cagctcagcccagccc

SEQ ID NO: 66974 - DNA, 16 bp, H. sapiens
cagctcagcccagcct

SEQ ID NO: 66975 - DNA, 16 bp, H. sapiens
cagctcagcccagctc

SEQ ID NO: 66976 - DNA, 16 bp, H. sapiens
cagctcagcccctgtg

SEQ ID NO: 66977 - DNA, 16 bp, H. sapiens
cagctcagccttccaa

SEQ ID NO: 66978 - DNA, 16 bp, H. sapiens
cagctcagctcagctc

SEQ ID NO: 66979 - DNA, 16 bp, H. sapiens
cagctcaggccctgcc

SEQ ID NO: 66980 - DNA, 16 bp, H. sapiens
cagctcagggaggcct

SEQ ID NO: 66981 - DNA, 16 bp, H. sapiens
cagctcagtggttgga

SEQ ID NO: 66982 - DNA, 16 bp, H. sapiens
cagctcatgaaagcag

SEQ ID NO: 66983 - DNA, 21 bp, H. sapiens
cagctcattgagaacgggcca

SEQ ID NO: 66984 - DNA, 16 bp, H. sapiens
cagctcatttctgcag

SEQ ID NO: 66985 - DNA, 16 bp, H. sapiens
cagctccaacactggg

SEQ ID NO: 66986 - DNA, 16 bp, H. sapiens
cagctccaccactgtg

SEQ ID NO: 66987 - DNA, 16 bp, H. sapiens
cagctccaccaggcag

SEQ ID NO: 66988 - DNA, 16 bp, H. sapiens
cagctccacccctgtg

SEQ ID NO: 66989 - DNA, 16 bp, H. sapiens
cagctccacctcagat

SEQ ID NO: 66990 - DNA, 16 bp, H. sapiens
cagctccactaggaag

SEQ ID NO: 66991 - DNA, 16 bp, H. sapiens
cagctccagccccagc

SEQ ID NO: 66992 - DNA, 16 bp, H. sapiens
cagctccagctgtggc

SEQ ID NO: 66993 - DNA, 16 bp, H. sapiens
cagctccaggtggctc

SEQ ID NO: 66994 - DNA, 16 bp, H. sapiens
cagctccatccaagtt

SEQ ID NO: 66995 - DNA, 16 bp, H. sapiens
cagctccatccacacc

SEQ ID NO: 66996 - DNA, 16 bp, H. sapiens
cagctccatccatgtc

SEQ ID NO: 66997 - DNA, 16 bp, H. sapiens
cagctccatccatgtg

SEQ ID NO: 66998 - DNA, 16 bp, H. sapiens
cagctccatccctgtc

SEQ ID NO: 66999 - DNA, 16 bp, H. sapiens
cagctcccagcatgag

SEQ ID NO: 67000 - DNA, 16 bp, H. sapiens
cagctcccagcctgag

SEQ ID NO: 67001 - DNA, 16 bp, H. sapiens
cagctcccagcgtgac

SEQ ID NO: 67002 - DNA, 16 bp, H. sapiens
cagctccccctgcagc

SEQ ID NO: 67003 - DNA, 16 bp, H. sapiens
cagctcccccttcacc

SEQ ID NO: 67004 - DNA, 16 bp, H. sapiens
cagctccccttcccac

SEQ ID NO: 67005 - DNA, 16 bp, H. sapiens
cagctccctctgcttg

SEQ ID NO: 67006 - DNA, 16 bp, H. sapiens
cagctccctgccctgc

SEQ ID NO: 67007 - DNA, 16 bp, H. sapiens
cagctccctgctgcct

SEQ ID NO: 67008 - DNA, 16 bp, H. sapiens
cagctcctcaccaaca

SEQ ID NO: 67009 - DNA, 16 bp, H. sapiens
cagctcctcagaaggc

SEQ ID NO: 67010 - DNA, 16 bp, H. sapiens
cagctcctcagggggc

SEQ ID NO: 67011 - DNA, 16 bp, H. sapiens
cagctcctccagctcc

SEQ ID NO: 67012 - DNA, 16 bp, H. sapiens
cagctcctccctgggt

SEQ ID NO: 67013 - DNA, 16 bp, H. sapiens
cagctcctcctccctc

SEQ ID NO: 67014 - DNA, 16 bp, H. sapiens
cagctcctcctctctg

SEQ ID NO: 67015 - DNA, 16 bp, H. sapiens
cagctcctctttgcac

SEQ ID NO: 67016 - DNA, 16 bp, H. sapiens
cagctcctgcacctgc

SEQ ID NO: 67017 - DNA, 16 bp, H. sapiens
cagctcctgcctgcca

SEQ ID NO: 67018 - DNA, 16 bp, H. sapiens
cagctcctgctgctgc

SEQ ID NO: 67019 - DNA, 16 bp, H. sapiens
cagctcctggggaggc

SEQ ID NO: 67020 - DNA, 16 bp, H. sapiens
cagctccttctcctcc

SEQ ID NO: 67021 - DNA, 16 bp, H. sapiens
cagctccttgagggca

SEQ ID NO: 67022 - DNA, 16 bp, H. sapiens
cagctccttgttactt

SEQ ID NO: 67023 - DNA, 16 bp, H. sapiens
cagctcgctgtagcct

SEQ ID NO: 67024 - DNA, 16 bp, H. sapiens
cagctctatcagatca

SEQ ID NO: 67025 - DNA, 16 bp, H. sapiens
cagctctcaagtttcc

SEQ ID NO: 67026 - DNA, 16 bp, H. sapiens
cagctctcaggaagcc

SEQ ID NO: 67027 - DNA, 16 bp, H. sapiens
cagctctcccaggctg

SEQ ID NO: 67028 - DNA, 16 bp, H. sapiens
cagctctctgaagcct

SEQ ID NO: 67029 - DNA, 16 bp, H. sapiens
cagctctctgagttct

SEQ ID NO: 67030 - DNA, 16 bp, H. sapiens
cagctctctgcagcct

SEQ ID NO: 67031 - DNA, 16 bp, H. sapiens
cagctctgaagaaagc

SEQ ID NO: 67032 - DNA, 16 bp, H. sapiens
cagctctgcaacctcc

SEQ ID NO: 67033 - DNA, 16 bp, H. sapiens
cagctctgcaccaggc

SEQ ID NO: 67034 - DNA, 16 bp, H. sapiens
cagctctgccactgac

SEQ ID NO: 67035 - DNA, 16 bp, H. sapiens
cagctctgcccctatg

SEQ ID NO: 67036 - DNA, 16 bp, H. sapiens
cagctctgccccttcc

SEQ ID NO: 67037 - DNA, 16 bp, H. sapiens
cagctctgcctcttcc

SEQ ID NO: 67038 - DNA, 16 bp, H. sapiens
cagctctgcctgtggc

SEQ ID NO: 67039 - DNA, 16 bp, H. sapiens
cagctctgctcctgtg

SEQ ID NO: 67040 - DNA, 16 bp, H. sapiens
cagctctgctgcctgc

SEQ ID NO: 67041 - DNA, 16 bp, H. sapiens
cagctctgctgctcac

SEQ ID NO: 67042 - DNA, 16 bp, H. sapiens
cagctctggaggaaca

SEQ ID NO: 67043 - DNA, 16 bp, H. sapiens
cagctctggctcaggg

SEQ ID NO: 67044 - DNA, 16 bp, H. sapiens
cagctctgggagagac

SEQ ID NO: 67045 - DNA, 16 bp, H. sapiens
cagctctgggagagga

SEQ ID NO: 67046 - DNA, 16 bp, H. sapiens
cagctctgtgactttg

SEQ ID NO: 67047 - DNA, 16 bp, H. sapiens
cagctctgtgaggaga

SEQ ID NO: 67048 - DNA, 16 bp, H. sapiens
cagctctgtgtcccca

SEQ ID NO: 67049 - DNA, 16 bp, H. sapiens
cagctctgtgtgtgtg

SEQ ID NO: 67050 - DNA, 16 bp, H. sapiens
cagctcttctctcctt

SEQ ID NO: 67051 - DNA, 16 bp, H. sapiens
cagctgaaattctcat

SEQ ID NO: 67052 - DNA, 16 bp, H. sapiens
cagctgaactcctctc

SEQ ID NO: 67053 - DNA, 16 bp, H. sapiens
cagctgaagcagtgtt

SEQ ID NO: 67054 - DNA, 16 bp, H. sapiens
cagctgaaggagccgg

SEQ ID NO: 67055 - DNA, 16 bp, H. sapiens
cagctgacaccaccca

SEQ ID NO: 67056 - DNA, 16 bp, H. sapiens
cagctgacagaggaag

SEQ ID NO: 67057 - DNA, 16 bp, H. sapiens
cagctgacagccagcc

SEQ ID NO: 67058 - DNA, 16 bp, H. sapiens
cagctgactgcagcct

SEQ ID NO: 67059 - DNA, 16 bp, H. sapiens
cagctgaggaaacagg

SEQ ID NO: 67060 - DNA, 16 bp, H. sapiens
cagctgaggacagctg

SEQ ID NO: 67061 - DNA, 16 bp, H. sapiens
cagctgaggcacaaga

SEQ ID NO: 67062 - DNA, 16 bp, H. sapiens
cagctgaggcatgaga

SEQ ID NO: 67063 - DNA, 16 bp, H. sapiens
cagctgagggtcctgg

SEQ ID NO: 67064 - DNA, 16 bp, H. sapiens
cagctgagggtgctgt

SEQ ID NO: 67065 - DNA, 16 bp, H. sapiens
cagctgaggtaggagg

SEQ ID NO: 67066 - DNA, 16 bp, H. sapiens
cagctgaggtgggaga

SEQ ID NO: 67067 - DNA, 16 bp, H. sapiens
cagctgagtgtggtgg

SEQ ID NO: 67068 - DNA, 16 bp, H. sapiens
cagctgatttctacca

SEQ ID NO: 67069 - DNA, 16 bp, H. sapiens
cagctgcacctgggag

SEQ ID NO: 67070 - DNA, 16 bp, H. sapiens
cagctgcagacctggg

SEQ ID NO: 67071 - DNA, 16 bp, H. sapiens
cagctgcagagaagag

SEQ ID NO: 67072 - DNA, 16 bp, H. sapiens
cagctgcagagagaag

SEQ ID NO: 67073 - DNA, 16 bp, H. sapiens
cagctgcagagagcca

SEQ ID NO: 67074 - DNA, 16 bp, H. sapiens
cagctgcagagagctg

SEQ ID NO: 67075 - DNA, 16 bp, H. sapiens
cagctgcagagaggag

SEQ ID NO: 67076 - DNA, 16 bp, H. sapiens
cagctgcagagggtgt

SEQ ID NO: 67077 - DNA, 16 bp, H. sapiens
cagctgcagcacctga

SEQ ID NO: 67078 - DNA, 16 bp, H. sapiens
cagctgcagcagcacc

SEQ ID NO: 67079 - DNA, 16 bp, H. sapiens
cagctgcagccacagc

SEQ ID NO: 67080 - DNA, 16 bp, H. sapiens
cagctgcagccttgca

SEQ ID NO: 67081 - DNA, 16 bp, H. sapiens
cagctgcagctgcaga

SEQ ID NO: 67082 - DNA, 16 bp, H. sapiens
cagctgcagctgccca

SEQ ID NO: 67083 - DNA, 16 bp, H. sapiens
cagctgcagtggggga

SEQ ID NO: 67084 - DNA, 16 bp, H. sapiens
cagctgcagttctgtt

SEQ ID NO: 67085 - DNA, 16 bp, H. sapiens
cagctgccagcacagc

SEQ ID NO: 67086 - DNA, 16 bp, H. sapiens
cagctgccagcgcagc

SEQ ID NO: 67087 - DNA, 16 bp, H. sapiens
cagctgccagtgcagc

SEQ ID NO: 67088 - DNA, 16 bp, H. sapiens
cagctgcccagctgtg

SEQ ID NO: 67089 - DNA, 20 bp, H. sapiens
cagctgccccgtccgggagg

SEQ ID NO: 67090 - DNA, 16 bp, H. sapiens
cagctgcccctgcccc

SEQ ID NO: 67091 - DNA, 16 bp, H. sapiens
cagctgccccttcccc

SEQ ID NO: 67092 - DNA, 16 bp, H. sapiens
cagctgccctggcctc

SEQ ID NO: 67093 - DNA, 16 bp, H. sapiens
cagctgcctcggcctc

SEQ ID NO: 67094 - DNA, 16 bp, H. sapiens
cagctgcctgctgtct

SEQ ID NO: 67095 - DNA, 16 bp, H. sapiens
cagctgcctgggaggc

SEQ ID NO: 67096 - DNA, 16 bp, H. sapiens
cagctgcctgggcacc

SEQ ID NO: 67097 - DNA, 16 bp, H. sapiens
cagctgccttctcact

SEQ ID NO: 67098 - DNA, 16 bp, H. sapiens
cagctgctaagccaag

SEQ ID NO: 67099 - DNA, 16 bp, H. sapiens
cagctgctaaggaggc

SEQ ID NO: 67100 - DNA, 16 bp, H. sapiens
cagctgctagagaggc

SEQ ID NO: 67101 - DNA, 16 bp, H. sapiens
cagctgctcacacctg

SEQ ID NO: 67102 - DNA, 16 bp, H. sapiens
cagctgctcagaaggc

SEQ ID NO: 67103 - DNA, 16 bp, H. sapiens
cagctgctcctcctcc

SEQ ID NO: 67104 - DNA, 16 bp, H. sapiens
cagctgctctaccaaa

SEQ ID NO: 67105 - DNA, 16 bp, H. sapiens
cagctgctgcagcagg

SEQ ID NO: 67106 - DNA, 16 bp, H. sapiens
cagctgctgctgccct

SEQ ID NO: 67107 - DNA, 16 bp, H. sapiens
cagctgctgctgctgc

SEQ ID NO: 67108 - DNA, 16 bp, H. sapiens
cagctgctgctggaag

SEQ ID NO: 67109 - DNA, 16 bp, H. sapiens
cagctgctggagagga

SEQ ID NO: 67110 - DNA, 20 bp, H. sapiens
cagctgctggcccaggtgct

SEQ ID NO: 67111 - DNA, 16 bp, H. sapiens
cagctgctggcccggg

SEQ ID NO: 67112 - DNA, 16 bp, H. sapiens
cagctgctggggaagc

SEQ ID NO: 67113 - DNA, 16 bp, H. sapiens
cagctgctgtgaaaaa

SEQ ID NO: 67114 - DNA, 16 bp, H. sapiens
cagctgctgtgccaga

SEQ ID NO: 67115 - DNA, 16 bp, H. sapiens
cagctgctgtggaaaa

SEQ ID NO: 67116 - DNA, 17 bp, H. sapiens
cagctgcttatgctgct

SEQ ID NO: 67117 - DNA, 16 bp, H. sapiens
cagctgcttcaggatg

SEQ ID NO: 67118 - DNA, 16 bp, H. sapiens
cagctgcttggaaggc

SEQ ID NO: 67119 - DNA, 16 bp, H. sapiens
cagctgctttggaaga

SEQ ID NO: 67120 - DNA, 16 bp, H. sapiens
cagctgctttggaggc

SEQ ID NO: 67121 - DNA, 16 bp, H. sapiens
cagctgctttttaaaa

SEQ ID NO: 67122 - DNA, 17 bp, H. sapiens
cagctggaaaccatcat

SEQ ID NO: 67123 - DNA, 19 bp, H. sapiens
cagctggaattacaggcat

SEQ ID NO: 67124 - DNA, 16 bp, H. sapiens
cagctggacttcctgg

SEQ ID NO: 67125 - DNA, 16 bp, H. sapiens
cagctggacttctggg

SEQ ID NO: 67126 - DNA, 16 bp, H. sapiens
cagctggagaaactga

SEQ ID NO: 67127 - DNA, 18 bp, H. sapiens
cagctggagatctgagaa

SEQ ID NO: 67128 - DNA, 16 bp, H. sapiens
cagctggagatttcct

SEQ ID NO: 67129 - DNA, 16 bp, H. sapiens
cagctggagccacagc

SEQ ID NO: 67130 - DNA, 16 bp, H. sapiens
cagctggagctggagc

SEQ ID NO: 67131 - DNA, 16 bp, H. sapiens
cagctggaggccatca

SEQ ID NO: 67132 - DNA, 16 bp, H. sapiens
cagctggagtgcagtg

SEQ ID NO: 67133 - DNA, 16 bp, H. sapiens
cagctggagtggctgg

SEQ ID NO: 67134 - DNA, 16 bp, H. sapiens
cagctggagttccggg

SEQ ID NO: 67135 - DNA, 16 bp, H. sapiens
cagctggcagaggggc

SEQ ID NO: 67136 - DNA, 16 bp, H. sapiens
cagctggccaacatgg

SEQ ID NO: 67137 - DNA, 16 bp, H. sapiens
cagctggccatggtgg

SEQ ID NO: 67138 - DNA, 16 bp, H. sapiens
cagctggccccaccca

SEQ ID NO: 67139 - DNA, 16 bp, H. sapiens
cagctggccgtggtgg

SEQ ID NO: 67140 - DNA, 16 bp, H. sapiens
cagctggcttccccag

SEQ ID NO: 67141 - DNA, 16 bp, H. sapiens
cagctgggaccacagt

SEQ ID NO: 67142 - DNA, 16 bp, H. sapiens
cagctgggactacagg

SEQ ID NO: 67143 - DNA, 16 bp, H. sapiens
cagctgggagacctga

SEQ ID NO: 67144 - DNA, 16 bp, H. sapiens
cagctgggagagaggc

SEQ ID NO: 67145 - DNA, 16 bp, H. sapiens
cagctgggagcagtgg

SEQ ID NO: 67146 - DNA, 16 bp, H. sapiens
cagctgggagggtcca

SEQ ID NO: 67147 - DNA, 16 bp, H. sapiens
cagctgggatgacagg

SEQ ID NO: 67148 - DNA, 16 bp, H. sapiens
cagctgggatgcaggg

SEQ ID NO: 67149 - DNA, 16 bp, H. sapiens
cagctgggattacagg

SEQ ID NO: 67150 - DNA, 16 bp, H. sapiens
cagctgggattatagg

SEQ ID NO: 67151 - DNA, 16 bp, H. sapiens
cagctgggattccagg

SEQ ID NO: 67152 - DNA, 16 bp, H. sapiens
cagctgggcaacaaga

SEQ ID NO: 67153 - DNA, 16 bp, H. sapiens
cagctgggcaccgtgg

SEQ ID NO: 67154 - DNA, 16 bp, H. sapiens
cagctgggcagaggtg

SEQ ID NO: 67155 - DNA, 16 bp, H. sapiens
cagctgggccactggg

SEQ ID NO: 67156 - DNA, 16 bp, H. sapiens
cagctgggcccagggg

SEQ ID NO: 67157 - DNA, 16 bp, H. sapiens
cagctgggcccagtgg

SEQ ID NO: 67158 - DNA, 16 bp, H. sapiens
cagctgggcctccagg

SEQ ID NO: 67159 - DNA, 16 bp, H. sapiens
cagctgggcctctggg

SEQ ID NO: 67160 - DNA, 16 bp, H. sapiens
cagctgggcctggtgg

SEQ ID NO: 67161 - DNA, 16 bp, H. sapiens
cagctgggcgtggtgg

SEQ ID NO: 67162 - DNA, 17 bp, H. sapiens
cagctgggcgtggtggt

SEQ ID NO: 67163 - DNA, 16 bp, H. sapiens
cagctgggctgtgtgg

SEQ ID NO: 67164 - DNA, 16 bp, H. sapiens
cagctgggcttcctgg

SEQ ID NO: 67165 - DNA, 16 bp, H. sapiens
cagctggggccactgt

SEQ ID NO: 67166 - DNA, 16 bp, H. sapiens
cagctggggctacagg

SEQ ID NO: 67167 - DNA, 16 bp, H. sapiens
cagctggggctggagt

SEQ ID NO: 67168 - DNA, 16 bp, H. sapiens
cagctggggctggggg

SEQ ID NO: 67169 - DNA, 16 bp, H. sapiens
cagctggggcttctcc

SEQ ID NO: 67170 - DNA, 16 bp, H. sapiens
cagctggggtgacaga

SEQ ID NO: 67171 - DNA, 16 bp, H. sapiens
cagctggggtgcaggg

SEQ ID NO: 67172 - DNA, 16 bp, H. sapiens
cagctggggtgcagtg

SEQ ID NO: 67173 - DNA, 16 bp, H. sapiens
cagctggggttacagg

SEQ ID NO: 67174 - DNA, 16 bp, H. sapiens
cagctgggtgactttg

SEQ ID NO: 67175 - DNA, 16 bp, H. sapiens
cagctggtcacatggt

SEQ ID NO: 67176 - DNA, 16 bp, H. sapiens
cagctggtctcaaact

SEQ ID NO: 67177 - DNA, 16 bp, H. sapiens
cagctggtctgaagga

SEQ ID NO: 67178 - DNA, 16 bp, H. sapiens
cagctggttggtggag

SEQ ID NO: 67179 - DNA, 16 bp, H. sapiens
cagctgtcttttcttt

SEQ ID NO: 67180 - DNA, 16 bp, H. sapiens
cagctgtgagcctgtg

SEQ ID NO: 67181 - DNA, 16 bp, H. sapiens
cagctgtgagtccatc

SEQ ID NO: 67182 - DNA, 17 bp, H. sapiens
cagctgtgattgtgcca

SEQ ID NO: 67183 - DNA, 16 bp, H. sapiens
cagctgtgcatggtgg

SEQ ID NO: 67184 - DNA, 16 bp, H. sapiens
cagctgtgcatgtatt

SEQ ID NO: 67185 - DNA, 16 bp, H. sapiens
cagctgtgccctgccc

SEQ ID NO: 67186 - DNA, 16 bp, H. sapiens
cagctgtgctggcagc

SEQ ID NO: 67187 - DNA, 16 bp, H. sapiens
cagctgtgctgtgctg

SEQ ID NO: 67188 - DNA, 16 bp, H. sapiens
cagctgtggagaggag

SEQ ID NO: 67189 - DNA, 16 bp, H. sapiens
cagctgtggctgaaag

SEQ ID NO: 67190 - DNA, 16 bp, H. sapiens
cagctgtggctgcctg

SEQ ID NO: 67191 - DNA, 16 bp, H. sapiens
cagctgtggctgggtg

SEQ ID NO: 67192 - DNA, 16 bp, H. sapiens
cagctgtgtgacttta

SEQ ID NO: 67193 - DNA, 16 bp, H. sapiens
cagctgtgtgactttg

SEQ ID NO: 67194 - DNA, 16 bp, H. sapiens
cagctgtgtgaggtgt

SEQ ID NO: 67195 - DNA, 16 bp, H. sapiens
cagctgtgtgtgtgtg

SEQ ID NO: 67196 - DNA, 16 bp, H. sapiens
cagctgttaatccatc

SEQ ID NO: 67197 - DNA, 16 bp, H. sapiens
cagctgttgtaaaagg

SEQ ID NO: 67198 - DNA, 16 bp, H. sapiens
cagctgttttcactta

SEQ ID NO: 67199 - DNA, 16 bp, H. sapiens
cagcttaagaagtttt

SEQ ID NO: 67200 - DNA, 16 bp, H. sapiens
cagcttaagattttgg

SEQ ID NO: 67201 - DNA, 16 bp, H. sapiens
cagcttacagatggcc

SEQ ID NO: 67202 - DNA, 16 bp, H. sapiens
cagcttcaactccctg

SEQ ID NO: 67203 - DNA, 16 bp, H. sapiens
cagcttcagaagcaga

SEQ ID NO: 67204 - DNA, 16 bp, H. sapiens
cagcttcagccatgtc

SEQ ID NO: 67205 - DNA, 16 bp, H. sapiens
cagcttcagcctcctg

SEQ ID NO: 67206 - DNA, 16 bp, H. sapiens
cagcttcagtgacaga

SEQ ID NO: 67207 - DNA, 16 bp, H. sapiens
cagcttcagttttctg

SEQ ID NO: 67208 - DNA, 16 bp, H. sapiens
cagcttcatccctgag

SEQ ID NO: 67209 - DNA, 16 bp, H. sapiens
cagcttccaaaatttt

SEQ ID NO: 67210 - DNA, 16 bp, H. sapiens
cagcttccacgtggtg

SEQ ID NO: 67211 - DNA, 16 bp, H. sapiens
cagcttccacttcctg

SEQ ID NO: 67212 - DNA, 16 bp, H. sapiens
cagcttccagagcagc

SEQ ID NO: 67213 - DNA, 16 bp, H. sapiens
cagcttccaggactgt

SEQ ID NO: 67214 - DNA, 16 bp, H. sapiens
cagcttcccaaaatgt

SEQ ID NO: 67215 - DNA, 16 bp, H. sapiens
cagcttcccaaagtgg

SEQ ID NO: 67216 - DNA, 16 bp, H. sapiens
cagcttccccagcagc

SEQ ID NO: 67217 - DNA, 16 bp, H. sapiens
cagcttccccttcccc

SEQ ID NO: 67218 - DNA, 16 bp, H. sapiens
cagcttcccttggcta

SEQ ID NO: 67219 - DNA, 16 bp, H. sapiens
cagcttcctcaaacaa

SEQ ID NO: 67220 - DNA, 16 bp, H. sapiens
cagcttcctcaccttt

SEQ ID NO: 67221 - DNA, 16 bp, H. sapiens
cagcttcctgagcagc

SEQ ID NO: 67222 - DNA, 16 bp, H. sapiens
cagcttcctgggcatg

SEQ ID NO: 67223 - DNA, 16 bp, H. sapiens
cagcttcctttgcagc

SEQ ID NO: 67224 - DNA, 16 bp, H. sapiens
cagcttctacatcagc

SEQ ID NO: 67225 - DNA, 16 bp, H. sapiens
cagcttctagggaggc

SEQ ID NO: 67226 - DNA, 16 bp, H. sapiens
cagcttctcaggagac

SEQ ID NO: 67227 - DNA, 16 bp, H. sapiens
cagcttctccagggcc

SEQ ID NO: 67228 - DNA, 16 bp, H. sapiens
cagcttctccagtggg

SEQ ID NO: 67229 - DNA, 16 bp, H. sapiens
cagcttctctctctct

SEQ ID NO: 67230 - DNA, 16 bp, H. sapiens
cagcttctctggaggc

SEQ ID NO: 67231 - DNA, 16 bp, H. sapiens
cagcttctcttgaaaa

SEQ ID NO: 67232 - DNA, 16 bp, H. sapiens
cagcttctgaggctgc

SEQ ID NO: 67233 - DNA, 16 bp, H. sapiens
cagcttctgccaacca

SEQ ID NO: 67234 - DNA, 16 bp, H. sapiens
cagcttctgcttctgg

SEQ ID NO: 67235 - DNA, 16 bp, H. sapiens
cagcttctggaagctg

SEQ ID NO: 67236 - DNA, 16 bp, H. sapiens
cagcttctggctctca

SEQ ID NO: 67237 - DNA, 16 bp, H. sapiens
cagcttctgtggaaaa

SEQ ID NO: 67238 - DNA, 16 bp, H. sapiens
cagcttcttgatctgt

SEQ ID NO: 67239 - DNA, 16 bp, H. sapiens
cagcttgcagacagtc

SEQ ID NO: 67240 - DNA, 16 bp, H. sapiens
cagcttgcaggtggcc

SEQ ID NO: 67241 - DNA, 17 bp, H. sapiens
cagcttggccaacctgg

SEQ ID NO: 67242 - DNA, 16 bp, H. sapiens
cagcttggccaacttg

SEQ ID NO: 67243 - DNA, 16 bp, H. sapiens
cagcttggccaagatg

SEQ ID NO: 67244 - DNA, 16 bp, H. sapiens
cagcttgggcaacgtg

SEQ ID NO: 67245 - DNA, 16 bp, H. sapiens
cagcttgggtaacaga

SEQ ID NO: 67246 - DNA, 16 bp, H. sapiens
cagctttaaaaaggaa

SEQ ID NO: 67247 - DNA, 16 bp, H. sapiens
cagctttagctgcagc

SEQ ID NO: 67248 - DNA, 16 bp, H. sapiens
cagctttatccctggg

SEQ ID NO: 67249 - DNA, 16 bp, H. sapiens
cagctttattcataat

SEQ ID NO: 67250 - DNA, 16 bp, H. sapiens
cagctttattcttttt

SEQ ID NO: 67251 - DNA, 16 bp, H. sapiens
cagctttattgagata

SEQ ID NO: 67252 - DNA, 16 bp, H. sapiens
cagctttcagtggaga

SEQ ID NO: 67253 - DNA, 16 bp, H. sapiens
cagctttcctgggtct

SEQ ID NO: 67254 - DNA, 16 bp, H. sapiens
cagctttctacacatg

SEQ ID NO: 67255 - DNA, 16 bp, H. sapiens
cagctttctcatttgt

SEQ ID NO: 67256 - DNA, 16 bp, H. sapiens
cagctttcttctctct

SEQ ID NO: 67257 - DNA, 16 bp, H. sapiens
cagctttgaagatgga

SEQ ID NO: 67258 - DNA, 16 bp, H. sapiens
cagctttgcagggcta

SEQ ID NO: 67259 - DNA, 16 bp, H. sapiens
cagctttggaactggg

SEQ ID NO: 67260 - DNA, 16 bp, H. sapiens
cagctttgggactctt

SEQ ID NO: 67261 - DNA, 16 bp, H. sapiens
cagctttgggatgtgg

SEQ ID NO: 67262 - DNA, 16 bp, H. sapiens
cagctttgtctttttt

SEQ ID NO: 67263 - DNA, 16 bp, H. sapiens
cagctttgttctcttt

SEQ ID NO: 67264 - DNA, 16 bp, H. sapiens
cagctttgttcttttg

SEQ ID NO: 67265 - DNA, 16 bp, H. sapiens
cagctttgttgaaaat

SEQ ID NO: 67266 - DNA, 16 bp, H. sapiens
cagctttgtttttttg

SEQ ID NO: 67267 - DNA, 16 bp, H. sapiens
cagcttttaaaatatt

SEQ ID NO: 67268 - DNA, 16 bp, H. sapiens
cagcttttccaggctc

SEQ ID NO: 67269 - DNA, 16 bp, H. sapiens
cagcttttctactctg

SEQ ID NO: 67270 - DNA, 16 bp, H. sapiens
cagcttttgcccattc

SEQ ID NO: 67271 - DNA, 16 bp, H. sapiens
cagctttttaaaattt

SEQ ID NO: 67272 - DNA, 16 bp, H. sapiens
cagctttttaaagaaa

SEQ ID NO: 67273 - DNA, 16 bp, H. sapiens
cagctttttctttctt

SEQ ID NO: 67274 - DNA, 16 bp, H. sapiens
cagctttttgtatgtc

SEQ ID NO: 67275 - DNA, 16 bp, H. sapiens
cagcttttttctttct

SEQ ID NO: 67276 - DNA, 16 bp, H. sapiens
cagctttttttccccc

SEQ ID NO: 67277 - DNA, 16 bp, H. sapiens
caggaaaaactgccat

SEQ ID NO: 67278 - DNA, 16 bp, H. sapiens
caggaaaaatgaaaat

SEQ ID NO: 67279 - DNA, 16 bp, H. sapiens
caggaaaacaaactca

SEQ ID NO: 67280 - DNA, 16 bp, H. sapiens
caggaaaacaattcat

SEQ ID NO: 67281 - DNA, 16 bp, H. sapiens
caggaaaactgaaaga

SEQ ID NO: 67282 - DNA, 16 bp, H. sapiens
caggaaaacttttttt

SEQ ID NO: 67283 - DNA, 16 bp, H. sapiens
caggaaaagaaaacta

SEQ ID NO: 67284 - DNA, 16 bp, H. sapiens
caggaaaaggaaaatg

SEQ ID NO: 67285 - DNA, 16 bp, H. sapiens
caggaaaagggccctc

SEQ ID NO: 67286 - DNA, 16 bp, H. sapiens
caggaaaaggtcagag

SEQ ID NO: 67287 - DNA, 16 bp, H. sapiens
caggaaaatcacttga

SEQ ID NO: 67288 - DNA, 16 bp, H. sapiens
caggaaaatgaaggaa

SEQ ID NO: 67289 - DNA, 16 bp, H. sapiens
caggaaaatgtggaaa

SEQ ID NO: 67290 - DNA, 16 bp, H. sapiens
caggaaaatgttttaa

SEQ ID NO: 67291 - DNA, 16 bp, H. sapiens
caggaaacaaaaggtg

SEQ ID NO: 67292 - DNA, 16 bp, H. sapiens
caggaaacacttctac

SEQ ID NO: 67293 - DNA, 16 bp, H. sapiens
caggaaacatgaaaaa

SEQ ID NO: 67294 - DNA, 16 bp, H. sapiens
caggaaaccttccctg

SEQ ID NO: 67295 - DNA, 16 bp, H. sapiens
caggaaagaaagaaat

SEQ ID NO: 67296 - DNA, 16 bp, H. sapiens
caggaaagagtggcat

SEQ ID NO: 67297 - DNA, 16 bp, H. sapiens
caggaaagccagtgat

SEQ ID NO: 67298 - DNA, 16 bp, H. sapiens
caggaaagctgatggt

SEQ ID NO: 67299 - DNA, 16 bp, H. sapiens
caggaaagctggtggt

SEQ ID NO: 67300 - DNA, 16 bp, H. sapiens
caggaaaggtggggaa

SEQ ID NO: 67301 - DNA, 16 bp, H. sapiens
caggaaagtgaaaaga

SEQ ID NO: 67302 - DNA, 16 bp, H. sapiens
caggaaagtggagaag

SEQ ID NO: 67303 - DNA, 16 bp, H. sapiens
caggaaagtttggaac

SEQ ID NO: 67304 - DNA, 16 bp, H. sapiens
caggaaatacagaaaa

SEQ ID NO: 67305 - DNA, 16 bp, H. sapiens
caggaaatacagagag

SEQ ID NO: 67306 - DNA, 16 bp, H. sapiens
caggaaatataaagaa

SEQ ID NO: 67307 - DNA, 16 bp, H. sapiens
caggaaatatacaaga

SEQ ID NO: 67308 - DNA, 16 bp, H. sapiens
caggaaatatggagaa

SEQ ID NO: 67309 - DNA, 16 bp, H. sapiens
caggaaatccagacca

SEQ ID NO: 67310 - DNA, 16 bp, H. sapiens
caggaaatgagtgagt

SEQ ID NO: 67311 - DNA, 16 bp, H. sapiens
caggaaatgcaaaaga

SEQ ID NO: 67312 - DNA, 16 bp, H. sapiens
caggaaatgcaaagaa

SEQ ID NO: 67313 - DNA, 16 bp, H. sapiens
caggaaattacaaggg

SEQ ID NO: 67314 - DNA, 16 bp, H. sapiens
caggaacaaattcaca

SEQ ID NO: 67315 - DNA, 16 bp, H. sapiens
caggaacaaggcaaag

SEQ ID NO: 67316 - DNA, 16 bp, H. sapiens
caggaacacgccacca

SEQ ID NO: 67317 - DNA, 16 bp, H. sapiens
caggaacagaaaccaa

SEQ ID NO: 67318 - DNA, 16 bp, H. sapiens
caggaacagaatacca

SEQ ID NO: 67319 - DNA, 16 bp, H. sapiens
caggaacagtggctca

SEQ ID NO: 67320 - DNA, 16 bp, H. sapiens
caggaacataccagga

SEQ ID NO: 67321 - DNA, 16 bp, H. sapiens
caggaaccaatcctgg

SEQ ID NO: 67322 - DNA, 16 bp, H. sapiens
caggaaccagccctgg

SEQ ID NO: 67323 - DNA, 16 bp, H. sapiens
caggaactagtgctca

SEQ ID NO: 67324 - DNA, 16 bp, H. sapiens
caggaactcttgcaag

SEQ ID NO: 67325 - DNA, 16 bp, H. sapiens
caggaactgaaaacca

SEQ ID NO: 67326 - DNA, 16 bp, H. sapiens
caggaactgaactcag

SEQ ID NO: 67327 - DNA, 16 bp, H. sapiens
caggaactgcagggcc

SEQ ID NO: 67328 - DNA, 16 bp, H. sapiens
caggaacttgaggctg

SEQ ID NO: 67329 - DNA, 16 bp, H. sapiens
caggaagaaagtgaaa

SEQ ID NO: 67330 - DNA, 16 bp, H. sapiens
caggaagaaatagaaa

SEQ ID NO: 67331 - DNA, 16 bp, H. sapiens
caggaagaaattaaaa

SEQ ID NO: 67332 - DNA, 16 bp, H. sapiens
caggaagaaattcaag

SEQ ID NO: 67333 - DNA, 16 bp, H. sapiens
caggaagaagaaaaat

SEQ ID NO: 67334 - DNA, 16 bp, H. sapiens
caggaagaattagaaa

SEQ ID NO: 67335 - DNA, 16 bp, H. sapiens
caggaagaattagata

SEQ ID NO: 67336 - DNA, 16 bp, H. sapiens
caggaagacttcctgg

SEQ ID NO: 67337 - DNA, 16 bp, H. sapiens
caggaagagagtcctc

SEQ ID NO: 67338 - DNA, 16 bp, H. sapiens
caggaagagcttctcc

SEQ ID NO: 67339 - DNA, 16 bp, H. sapiens
caggaagaggaagcag

SEQ ID NO: 67340 - DNA, 16 bp, H. sapiens
caggaagaggagcagg

SEQ ID NO: 67341 - DNA, 27 bp, H. sapiens
caggaagatctaccaagcaaatggaaa

SEQ ID NO: 67342 - DNA, 16 bp, H. sapiens
caggaagattgcttga

SEQ ID NO: 67343 - DNA, 16 bp, H. sapiens
caggaagcaaaggttg

SEQ ID NO: 67344 - DNA, 16 bp, H. sapiens
caggaagcaaggctgg

SEQ ID NO: 67345 - DNA, 16 bp, H. sapiens
caggaagcacaaaggg

SEQ ID NO: 67346 - DNA, 16 bp, H. sapiens
caggaagcacaagggg

SEQ ID NO: 67347 - DNA, 16 bp, H. sapiens
caggaagcagagctca

SEQ ID NO: 67348 - DNA, 16 bp, H. sapiens
caggaagcagaggcag

SEQ ID NO: 67349 - DNA, 16 bp, H. sapiens
caggaagcagaggctg

SEQ ID NO: 67350 - DNA, 16 bp, H. sapiens
caggaagcagcagcag

SEQ ID NO: 67351 - DNA, 16 bp, H. sapiens
caggaagcatccagaa

SEQ ID NO: 67352 - DNA, 16 bp, H. sapiens
caggaagcatccagca

SEQ ID NO: 67353 - DNA, 16 bp, H. sapiens
caggaagcatccagcg

SEQ ID NO: 67354 - DNA, 16 bp, H. sapiens
caggaagcatccagga

SEQ ID NO: 67355 - DNA, 16 bp, H. sapiens
caggaagcatggctgc

SEQ ID NO: 67356 - DNA, 16 bp, H. sapiens
caggaagccaaggcag

SEQ ID NO: 67357 - DNA, 16 bp, H. sapiens
caggaagccaaggctg

SEQ ID NO: 67358 - DNA, 16 bp, H. sapiens
caggaagccacatcca

SEQ ID NO: 67359 - DNA, 16 bp, H. sapiens
caggaagcccttcctg

SEQ ID NO: 67360 - DNA, 16 bp, H. sapiens
caggaagcctgccctg

SEQ ID NO: 67361 - DNA, 16 bp, H. sapiens
caggaagccttccctg

SEQ ID NO: 67362 - DNA, 16 bp, H. sapiens
caggaagccttctttg

SEQ ID NO: 67363 - DNA, 16 bp, H. sapiens
caggaagctcagaaaa

SEQ ID NO: 67364 - DNA, 16 bp, H. sapiens
caggaagctcaggcag

SEQ ID NO: 67365 - DNA, 16 bp, H. sapiens
caggaagctgaggagg

SEQ ID NO: 67366 - DNA, 16 bp, H. sapiens
caggaaggaattcaag

SEQ ID NO: 67367 - DNA, 16 bp, H. sapiens
caggaaggagccatct

SEQ ID NO: 67368 - DNA, 16 bp, H. sapiens
caggaaggaggaggca

SEQ ID NO: 67369 - DNA, 16 bp, H. sapiens
caggaaggaggcagag

SEQ ID NO: 67370 - DNA, 16 bp, H. sapiens
caggaaggccctcacc

SEQ ID NO: 67371 - DNA, 16 bp, H. sapiens
caggaaggcttccctg

SEQ ID NO: 67372 - DNA, 16 bp, H. sapiens
caggaagggcccagcc

SEQ ID NO: 67373 - DNA, 16 bp, H. sapiens
caggaagggctgggag

SEQ ID NO: 67374 - DNA, 16 bp, H. sapiens
caggaaggggaacctc

SEQ ID NO: 67375 - DNA, 16 bp, H. sapiens
caggaaggggctccca

SEQ ID NO: 67376 - DNA, 16 bp, H. sapiens
caggaaggtgaacatc

SEQ ID NO: 67377 - DNA, 16 bp, H. sapiens
caggaaggtgaggcag

SEQ ID NO: 67378 - DNA, 16 bp, H. sapiens
caggaagtcctgacaa

SEQ ID NO: 67379 - DNA, 16 bp, H. sapiens
caggaagtctgagatc

SEQ ID NO: 67380 - DNA, 16 bp, H. sapiens
caggaagtgtcccagt

SEQ ID NO: 67381 - DNA, 16 bp, H. sapiens
caggaataagcagagt

SEQ ID NO: 67382 - DNA, 16 bp, H. sapiens
caggaatacaaagatg

SEQ ID NO: 67383 - DNA, 16 bp, H. sapiens
caggaatagaaaagca

SEQ ID NO: 67384 - DNA, 16 bp, H. sapiens
caggaatagaagggaa

SEQ ID NO: 67385 - DNA, 16 bp, H. sapiens
caggaatctatccatt

SEQ ID NO: 67386 - DNA, 16 bp, H. sapiens
caggaatctgtatttt

SEQ ID NO: 67387 - DNA, 16 bp, H. sapiens
caggaatgaaagagaa

SEQ ID NO: 67388 - DNA, 16 bp, H. sapiens
caggaatgaaagagga

SEQ ID NO: 67389 - DNA, 16 bp, H. sapiens
caggaatgaaaggaaa

SEQ ID NO: 67390 - DNA, 16 bp, H. sapiens
caggaatgaccaagga

SEQ ID NO: 67391 - DNA, 16 bp, H. sapiens
caggaatgcagggatg

SEQ ID NO: 67392 - DNA, 16 bp, H. sapiens
caggaatggaagttta

SEQ ID NO: 67393 - DNA, 16 bp, H. sapiens
caggaatgggcaaaga

SEQ ID NO: 67394 - DNA, 16 bp, H. sapiens
caggaatgtggagaaa

SEQ ID NO: 67395 - DNA, 16 bp, H. sapiens
caggaattcaaagctg

SEQ ID NO: 67396 - DNA, 16 bp, H. sapiens
caggaattcaagagca

SEQ ID NO: 67397 - DNA, 20 bp, H. sapiens
caggaattcagcaagctaga

SEQ ID NO: 67398 - DNA, 16 bp, H. sapiens
caggaattggcaaact

SEQ ID NO: 67399 - DNA, 16 bp, H. sapiens
caggaatttatacatt

SEQ ID NO: 67400 - DNA, 16 bp, H. sapiens
caggaatttcagcaac

SEQ ID NO: 67401 - DNA, 16 bp, H. sapiens
caggaatttgaggcag

SEQ ID NO: 67402 - DNA, 16 bp, H. sapiens
caggacaagccacaga

SEQ ID NO: 67403 - DNA, 16 bp, H. sapiens
caggacaagctgcaga

SEQ ID NO: 67404 - DNA, 16 bp, H. sapiens
caggacacatgggaat

SEQ ID NO: 67405 - DNA, 16 bp, H. sapiens
caggacactggtctgg

SEQ ID NO: 67406 - DNA, 16 bp, H. sapiens
caggacagacccccac

SEQ ID NO: 67407 - DNA, 16 bp, H. sapiens
caggacagagccctca

SEQ ID NO: 67408 - DNA, 16 bp, H. sapiens
caggacaggacaggac

SEQ ID NO: 67409 - DNA, 16 bp, H. sapiens
caggacatcgagacca

SEQ ID NO: 67410 - DNA, 16 bp, H. sapiens
caggacattggcctgg

SEQ ID NO: 67411 - DNA, 16 bp, H. sapiens
caggaccagagagatt

SEQ ID NO: 67412 - DNA, 16 bp, H. sapiens
caggaccagcctggct

SEQ ID NO: 67413 - DNA, 16 bp, H. sapiens
caggaccagctaattt

SEQ ID NO: 67414 - DNA, 16 bp, H. sapiens
caggacccaggagtcc

SEQ ID NO: 67415 - DNA, 16 bp, H. sapiens
caggacccagtggctt

SEQ ID NO: 67416 - DNA, 16 bp, H. sapiens
caggaccctcagctgt

SEQ ID NO: 67417 - DNA, 16 bp, H. sapiens
caggaccctcagcttc

SEQ ID NO: 67418 - DNA, 16 bp, H. sapiens
caggacctcagctcac

SEQ ID NO: 67419 - DNA, 16 bp, H. sapiens
caggacctcccaacca

SEQ ID NO: 67420 - DNA, 16 bp, H. sapiens
caggacctcctccccc

SEQ ID NO: 67421 - DNA, 16 bp, H. sapiens
caggacctcctgcaga

SEQ ID NO: 67422 - DNA, 16 bp, H. sapiens
caggacctgcagccca

SEQ ID NO: 67423 - DNA, 17 bp, H. sapiens
caggacctgctcgagcc

SEQ ID NO: 67424 - DNA, 16 bp, H. sapiens
caggacctggtgggag

SEQ ID NO: 67425 - DNA, 16 bp, H. sapiens
caggacggctttgaat

SEQ ID NO: 67426 - DNA, 16 bp, H. sapiens
caggactaccagctgc

SEQ ID NO: 67427 - DNA, 16 bp, H. sapiens
caggactccagcctgg

SEQ ID NO: 67428 - DNA, 16 bp, H. sapiens
caggactctgttacct

SEQ ID NO: 67429 - DNA, 16 bp, H. sapiens
caggactgggtccttc

SEQ ID NO: 67430 - DNA, 16 bp, H. sapiens
caggactggttccttc

SEQ ID NO: 67431 - DNA, 16 bp, H. sapiens
caggacttcctgaggg

SEQ ID NO: 67432 - DNA, 16 bp, H. sapiens
caggacttgaacccag

SEQ ID NO: 67433 - DNA, 16 bp, H. sapiens
caggactttgagacca

SEQ ID NO: 67434 - DNA, 16 bp, H. sapiens
caggagaaaaatcttt

SEQ ID NO: 67435 - DNA, 16 bp, H. sapiens
caggagaaagaaatga

SEQ ID NO: 67436 - DNA, 16 bp, H. sapiens
caggagaaagatgaaa

SEQ ID NO: 67437 - DNA, 16 bp, H. sapiens
caggagaacagcatgg

SEQ ID NO: 67438 - DNA, 16 bp, H. sapiens
caggagaacctcccca

SEQ ID NO: 67439 - DNA, 16 bp, H. sapiens
caggagaactccccca

SEQ ID NO: 67440 - DNA, 16 bp, H. sapiens
caggagaactccttga

SEQ ID NO: 67441 - DNA, 16 bp, H. sapiens
caggagaagaaactga

SEQ ID NO: 67442 - DNA, 16 bp, H. sapiens
caggagaataatttga

SEQ ID NO: 67443 - DNA, 16 bp, H. sapiens
caggagaatcaggcag

SEQ ID NO: 67444 - DNA, 16 bp, H. sapiens
caggagaatcatttga

SEQ ID NO: 67445 - DNA, 16 bp, H. sapiens
caggagaatcatttta

SEQ ID NO: 67446 - DNA, 16 bp, H. sapiens
caggagaatctgttga

SEQ ID NO: 67447 - DNA, 16 bp, H. sapiens
caggagaatgaataaa

SEQ ID NO: 67448 - DNA, 16 bp, H. sapiens
caggagaatgacctga

SEQ ID NO: 67449 - DNA, 16 bp, H. sapiens
caggagaatggcatta

SEQ ID NO: 67450 - DNA, 16 bp, H. sapiens
caggagaatggcttga

SEQ ID NO: 67451 - DNA, 16 bp, H. sapiens
caggagaatgggatga

SEQ ID NO: 67452 - DNA, 16 bp, H. sapiens
caggagaattgcctga

SEQ ID NO: 67453 - DNA, 16 bp, H. sapiens
caggagacagaggcct

SEQ ID NO: 67454 - DNA, 16 bp, H. sapiens
caggagacccaggaga

SEQ ID NO: 67455 - DNA, 16 bp, H. sapiens
caggagacctgggctc

SEQ ID NO: 67456 - DNA, 16 bp, H. sapiens
caggagactcacctga

SEQ ID NO: 67457 - DNA, 16 bp, H. sapiens
caggagactgaagcag

SEQ ID NO: 67458 - DNA, 16 bp, H. sapiens
caggagactgaggagg

SEQ ID NO: 67459 - DNA, 16 bp, H. sapiens
caggagactggagaga

SEQ ID NO: 67460 - DNA, 16 bp, H. sapiens
caggagactggggcag

SEQ ID NO: 67461 - DNA, 16 bp, H. sapiens
caggagagaagctgca

SEQ ID NO: 67462 - DNA, 16 bp, H. sapiens
caggagagagaagagt

SEQ ID NO: 67463 - DNA, 16 bp, H. sapiens
caggagagagagacag

SEQ ID NO: 67464 - DNA, 16 bp, H. sapiens
caggagagagaggcca

SEQ ID NO: 67465 - DNA, 16 bp, H. sapiens
caggagagagtggcat

SEQ ID NO: 67466 - DNA, 16 bp, H. sapiens
caggagagctgatgat

SEQ ID NO: 67467 - DNA, 16 bp, H. sapiens
caggagaggagatgcc

SEQ ID NO: 67468 - DNA, 16 bp, H. sapiens
caggagaggaggctgg

SEQ ID NO: 67469 - DNA, 16 bp, H. sapiens
caggagaggccaggga

SEQ ID NO: 67470 - DNA, 16 bp, H. sapiens
caggagagggaggttg

SEQ ID NO: 67471 - DNA, 16 bp, H. sapiens
caggagagggctcccc

SEQ ID NO: 67472 - DNA, 16 bp, H. sapiens
caggagagggttcttg

SEQ ID NO: 67473 - DNA, 16 bp, H. sapiens
caggagatattccaga

SEQ ID NO: 67474 - DNA, 16 bp, H. sapiens
caggagatcaagaaca

SEQ ID NO: 67475 - DNA, 16 bp, H. sapiens
caggagatcaagagca

SEQ ID NO: 67476 - DNA, 16 bp, H. sapiens
caggagatcaaggcca

SEQ ID NO: 67477 - DNA, 16 bp, H. sapiens
caggagatcatgacca

SEQ ID NO: 67478 - DNA, 16 bp, H. sapiens
caggagatcgagagca

SEQ ID NO: 67479 - DNA, 16 bp, H. sapiens
caggagatcgtgacca

SEQ ID NO: 67480 - DNA, 16 bp, H. sapiens
caggagatgctgggag

SEQ ID NO: 67481 - DNA, 16 bp, H. sapiens
caggagatggagaccc

SEQ ID NO: 67482 - DNA, 16 bp, H. sapiens
caggagatggagccca

SEQ ID NO: 67483 - DNA, 16 bp, H. sapiens
caggagatggagctca

SEQ ID NO: 67484 - DNA, 16 bp, H. sapiens
caggagatggaggatg

SEQ ID NO: 67485 - DNA, 16 bp, H. sapiens
caggagatggaggcag

SEQ ID NO: 67486 - DNA, 16 bp, H. sapiens
caggagatggaggcca

SEQ ID NO: 67487 - DNA, 16 bp, H. sapiens
caggagattcacagca

SEQ ID NO: 67488 - DNA, 17 bp, H. sapiens
caggagattgagaccag

SEQ ID NO: 67489 - DNA, 16 bp, H. sapiens
caggagattgagaccc

SEQ ID NO: 67490 - DNA, 16 bp, H. sapiens
caggagcaagaggaag

SEQ ID NO: 67491 - DNA, 16 bp, H. sapiens
caggagcaagagggag

SEQ ID NO: 67492 - DNA, 16 bp, H. sapiens
caggagcagagggaag

SEQ ID NO: 67493 - DNA, 16 bp, H. sapiens
caggagcagatgctgg

SEQ ID NO: 67494 - DNA, 16 bp, H. sapiens
caggagcagcctgggc

SEQ ID NO: 67495 - DNA, 16 bp, H. sapiens
caggagcaggcatgtc

SEQ ID NO: 67496 - DNA, 16 bp, H. sapiens
caggagcaggggcctg

SEQ ID NO: 67497 - DNA, 16 bp, H. sapiens
caggagcagtgggaag

SEQ ID NO: 67498 - DNA, 16 bp, H. sapiens
caggagcatattattt

SEQ ID NO: 67499 - DNA, 16 bp, H. sapiens
caggagcatcacttga

SEQ ID NO: 67500 - DNA, 16 bp, H. sapiens
caggagcatggcttga

SEQ ID NO: 67501 - DNA, 16 bp, H. sapiens
caggagccaggctggg

SEQ ID NO: 67502 - DNA, 16 bp, H. sapiens
caggagccagggtgag

SEQ ID NO: 67503 - DNA, 16 bp, H. sapiens
caggagcccacagagg

SEQ ID NO: 67504 - DNA, 16 bp, H. sapiens
caggagcccacggagc

SEQ ID NO: 67505 - DNA, 16 bp, H. sapiens
caggagcccacggtgg

SEQ ID NO: 67506 - DNA, 16 bp, H. sapiens
caggagcccaggcccc

SEQ ID NO: 67507 - DNA, 16 bp, H. sapiens
caggagcccagggagg

SEQ ID NO: 67508 - DNA, 16 bp, H. sapiens
caggagccccaggagc

SEQ ID NO: 67509 - DNA, 16 bp, H. sapiens
caggagccccaggctg

SEQ ID NO: 67510 - DNA, 16 bp, H. sapiens
caggagccctgccctc

SEQ ID NO: 67511 - DNA, 16 bp, H. sapiens
caggagcctgagatgg

SEQ ID NO: 67512 - DNA, 16 bp, H. sapiens
caggagcctgaggcac

SEQ ID NO: 67513 - DNA, 16 bp, H. sapiens
caggagcctgaggcag

SEQ ID NO: 67514 - DNA, 16 bp, H. sapiens
caggagcctgaggctg

SEQ ID NO: 67515 - DNA, 16 bp, H. sapiens
caggagctacagtata

SEQ ID NO: 67516 - DNA, 16 bp, H. sapiens
caggagctcaagagca

SEQ ID NO: 67517 - DNA, 16 bp, H. sapiens
caggagctcaaggcca

SEQ ID NO: 67518 - DNA, 16 bp, H. sapiens
caggagctcaaggctg

SEQ ID NO: 67519 - DNA, 16 bp, H. sapiens
caggagctccaggctg

SEQ ID NO: 67520 - DNA, 16 bp, H. sapiens
caggagctccttccct

SEQ ID NO: 67521 - DNA, 16 bp, H. sapiens
caggagctgaagacca

SEQ ID NO: 67522 - DNA, 16 bp, H. sapiens
caggagctgaaggaca

SEQ ID NO: 67523 - DNA, 16 bp, H. sapiens
caggagctgaggcagg

SEQ ID NO: 67524 - DNA, 16 bp, H. sapiens
caggagctgaggggag

SEQ ID NO: 67525 - DNA, 16 bp, H. sapiens
caggagctggagacca

SEQ ID NO: 67526 - DNA, 16 bp, H. sapiens
caggagctggagagga

SEQ ID NO: 67527 - DNA, 16 bp, H. sapiens
caggagctggaggaga

SEQ ID NO: 67528 - DNA, 16 bp, H. sapiens
caggagctggaggagg

SEQ ID NO: 67529 - DNA, 16 bp, H. sapiens
caggagctggggaagg

SEQ ID NO: 67530 - DNA, 16 bp, H. sapiens
caggagctggggcagg

SEQ ID NO: 67531 - DNA, 16 bp, H. sapiens
caggagctggggctgg

SEQ ID NO: 67532 - DNA, 16 bp, H. sapiens
caggagctgggggtgg

SEQ ID NO: 67533 - DNA, 16 bp, H. sapiens
caggagctggtgtttt

SEQ ID NO: 67534 - DNA, 16 bp, H. sapiens
caggagcttctgtccc

SEQ ID NO: 67535 - DNA, 16 bp, H. sapiens
caggagcttgaggcca

SEQ ID NO: 67536 - DNA, 16 bp, H. sapiens
caggagcttgggacca

SEQ ID NO: 67537 - DNA, 16 bp, H. sapiens
caggaggaaactgagg

SEQ ID NO: 67538 - DNA, 16 bp, H. sapiens
caggaggaagaggctg

SEQ ID NO: 67539 - DNA, 16 bp, H. sapiens
caggaggaagaggtgg

SEQ ID NO: 67540 - DNA, 16 bp, H. sapiens
caggaggaagcaggag

SEQ ID NO: 67541 - DNA, 16 bp, H. sapiens
caggaggaagctgcag

SEQ ID NO: 67542 - DNA, 16 bp, H. sapiens
caggaggacaaggagg

SEQ ID NO: 67543 - DNA, 16 bp, H. sapiens
caggaggacaaggctg

SEQ ID NO: 67544 - DNA, 16 bp, H. sapiens
caggaggacgaggctg

SEQ ID NO: 67545 - DNA, 16 bp, H. sapiens
caggaggagaaaagca

SEQ ID NO: 67546 - DNA, 16 bp, H. sapiens
caggaggagaagatgc

SEQ ID NO: 67547 - DNA, 16 bp, H. sapiens
caggaggagaagcagg

SEQ ID NO: 67548 - DNA, 16 bp, H. sapiens
caggaggagcaggtgc

SEQ ID NO: 67549 - DNA, 16 bp, H. sapiens
caggaggaggagccag

SEQ ID NO: 67550 - DNA, 16 bp, H. sapiens
caggaggaggagctca

SEQ ID NO: 67551 - DNA, 16 bp, H. sapiens
caggaggaggaggatg

SEQ ID NO: 67552 - DNA, 16 bp, H. sapiens
caggaggaggaggctg

SEQ ID NO: 67553 - DNA, 16 bp, H. sapiens
caggaggaggaggttg

SEQ ID NO: 67554 - DNA, 16 bp, H. sapiens
caggaggaggagtttg

SEQ ID NO: 67555 - DNA, 16 bp, H. sapiens
caggaggaggctgagg

SEQ ID NO: 67556 - DNA, 16 bp, H. sapiens
caggaggaggggctgg

SEQ ID NO: 67557 - DNA, 16 bp, H. sapiens
caggaggaggtggagg

SEQ ID NO: 67558 - DNA, 16 bp, H. sapiens
caggaggatcacttga

SEQ ID NO: 67559 - DNA, 16 bp, H. sapiens
caggaggatcagctga

SEQ ID NO: 67560 - DNA, 16 bp, H. sapiens
caggaggatgaggcag

SEQ ID NO: 67561 - DNA, 16 bp, H. sapiens
caggaggatgaggtgg

SEQ ID NO: 67562 - DNA, 16 bp, H. sapiens
caggaggatgccttga

SEQ ID NO: 67563 - DNA, 16 bp, H. sapiens
caggaggatggctgga

SEQ ID NO: 67564 - DNA, 18 bp, H. sapiens
caggaggattacttgagc

SEQ ID NO: 67565 - DNA, 16 bp, H. sapiens
caggaggcagaaggtg

SEQ ID NO: 67566 - DNA, 16 bp, H. sapiens
caggaggcagagaaat

SEQ ID NO: 67567 - DNA, 16 bp, H. sapiens
caggaggcagagacag

SEQ ID NO: 67568 - DNA, 16 bp, H. sapiens
caggaggcagagctcg

SEQ ID NO: 67569 - DNA, 16 bp, H. sapiens
caggaggcagaggcat

SEQ ID NO: 67570 - DNA, 16 bp, H. sapiens
caggaggcagaggcgg

SEQ ID NO: 67571 - DNA, 16 bp, H. sapiens
caggaggcagaggctg

SEQ ID NO: 67572 - DNA, 16 bp, H. sapiens
caggaggcagagggtg

SEQ ID NO: 67573 - DNA, 16 bp, H. sapiens
caggaggcagaggtcg

SEQ ID NO: 67574 - DNA, 16 bp, H. sapiens
caggaggcagaggtga

SEQ ID NO: 67575 - DNA, 16 bp, H. sapiens
caggaggcagaggtta

SEQ ID NO: 67576 - DNA, 16 bp, H. sapiens
caggaggcaggaaaat

SEQ ID NO: 67577 - DNA, 16 bp, H. sapiens
caggaggcaggagaat

SEQ ID NO: 67578 - DNA, 16 bp, H. sapiens
caggaggcaggcagag

SEQ ID NO: 67579 - DNA, 16 bp, H. sapiens
caggaggcaggcaggg

SEQ ID NO: 67580 - DNA, 16 bp, H. sapiens
caggaggcagggaaat

SEQ ID NO: 67581 - DNA, 16 bp, H. sapiens
caggaggcagggatca

SEQ ID NO: 67582 - DNA, 16 bp, H. sapiens
caggaggcagggcttg

SEQ ID NO: 67583 - DNA, 16 bp, H. sapiens
caggaggccaaggaag

SEQ ID NO: 67584 - DNA, 16 bp, H. sapiens
caggaggccaaggcac

SEQ ID NO: 67585 - DNA, 16 bp, H. sapiens
caggaggccaaggctg

SEQ ID NO: 67586 - DNA, 16 bp, H. sapiens
caggaggccaaggtga

SEQ ID NO: 67587 - DNA, 16 bp, H. sapiens
caggaggccagggctg

SEQ ID NO: 67588 - DNA, 16 bp, H. sapiens
caggaggcccaggagg

SEQ ID NO: 67589 - DNA, 16 bp, H. sapiens
caggaggcccaggctg

SEQ ID NO: 67590 - DNA, 16 bp, H. sapiens
caggaggcccaggtgg

SEQ ID NO: 67591 - DNA, 16 bp, H. sapiens
caggaggccgaggcgg

SEQ ID NO: 67592 - DNA, 16 bp, H. sapiens
caggaggccgaggctg

SEQ ID NO: 67593 - DNA, 16 bp, H. sapiens
caggaggcctaggagg

SEQ ID NO: 67594 - DNA, 16 bp, H. sapiens
caggaggcctgcctgc

SEQ ID NO: 67595 - DNA, 16 bp, H. sapiens
caggaggcggaggctg

SEQ ID NO: 67596 - DNA, 16 bp, H. sapiens
caggaggcggaggttg

SEQ ID NO: 67597 - DNA, 16 bp, H. sapiens
caggaggcggggcttg

SEQ ID NO: 67598 - DNA, 16 bp, H. sapiens
caggaggctgaaatag

SEQ ID NO: 67599 - DNA, 16 bp, H. sapiens
caggaggctgaagagg

SEQ ID NO: 67600 - DNA, 16 bp, H. sapiens
caggaggctgaagggg

SEQ ID NO: 67601 - DNA, 16 bp, H. sapiens
caggaggctgacacag

SEQ ID NO: 67602 - DNA, 16 bp, H. sapiens
caggaggctgagaaag

SEQ ID NO: 67603 - DNA, 16 bp, H. sapiens
caggaggctgagaagg

SEQ ID NO: 67604 - DNA, 16 bp, H. sapiens
caggaggctgagcagg

SEQ ID NO: 67605 - DNA, 16 bp, H. sapiens
caggaggctgaggaac

SEQ ID NO: 67606 - DNA, 16 bp, H. sapiens
caggaggctgaggaat

SEQ ID NO: 67607 - DNA, 16 bp, H. sapiens
caggaggctgaggcag

SEQ ID NO: 67608 - DNA, 16 bp, H. sapiens
caggaggctgaggcct

SEQ ID NO: 67609 - DNA, 16 bp, H. sapiens
caggaggctgaggggg

SEQ ID NO: 67610 - DNA, 16 bp, H. sapiens
caggaggctgaggtaa

SEQ ID NO: 67611 - DNA, 16 bp, H. sapiens
caggaggctgaggtca

SEQ ID NO: 67612 - DNA, 16 bp, H. sapiens
caggaggctgaggtgg

SEQ ID NO: 67613 - DNA, 17 bp, H. sapiens
caggaggctgaggtgga

SEQ ID NO: 67614 - DNA, 16 bp, H. sapiens
caggaggctgaggtgt

SEQ ID NO: 67615 - DNA, 16 bp, H. sapiens
caggaggctgagtgag

SEQ ID NO: 67616 - DNA, 16 bp, H. sapiens
caggaggctgatgtgg

SEQ ID NO: 67617 - DNA, 16 bp, H. sapiens
caggaggctgcagctg

SEQ ID NO: 67618 - DNA, 16 bp, H. sapiens
caggaggctgcggcag

SEQ ID NO: 67619 - DNA, 16 bp, H. sapiens
caggaggctgggagag

SEQ ID NO: 67620 - DNA, 16 bp, H. sapiens
caggaggctgggcctg

SEQ ID NO: 67621 - DNA, 16 bp, H. sapiens
caggaggctggggcac

SEQ ID NO: 67622 - DNA, 16 bp, H. sapiens
caggaggctggggtga

SEQ ID NO: 67623 - DNA, 16 bp, H. sapiens
caggaggctgtggcac

SEQ ID NO: 67624 - DNA, 16 bp, H. sapiens
caggaggctgtggcag

SEQ ID NO: 67625 - DNA, 16 bp, H. sapiens
caggagggaggccagg

SEQ ID NO: 67626 - DNA, 16 bp, H. sapiens
caggagggcaagagaa

SEQ ID NO: 67627 - DNA, 16 bp, H. sapiens
caggagggcagggact

SEQ ID NO: 67628 - DNA, 16 bp, H. sapiens
caggagggcagggctc

SEQ ID NO: 67629 - DNA, 16 bp, H. sapiens
caggagggctctgctg

SEQ ID NO: 67630 - DNA, 16 bp, H. sapiens
caggagggcttcctgg

SEQ ID NO: 67631 - DNA, 16 bp, H. sapiens
caggaggggccaggct

SEQ ID NO: 67632 - DNA, 16 bp, H. sapiens
caggagggggagggct

SEQ ID NO: 67633 - DNA, 16 bp, H. sapiens
caggagggtggccaga

SEQ ID NO: 67634 - DNA, 16 bp, H. sapiens
caggagggtggggcag

SEQ ID NO: 67635 - DNA, 16 bp, H. sapiens
caggaggtagagacca

SEQ ID NO: 67636 - DNA, 16 bp, H. sapiens
caggaggtagaggctg

SEQ ID NO: 67637 - DNA, 16 bp, H. sapiens
caggaggtcaggctgc

SEQ ID NO: 67638 - DNA, 16 bp, H. sapiens
caggaggtccagacca

SEQ ID NO: 67639 - DNA, 16 bp, H. sapiens
caggaggtccaggcta

SEQ ID NO: 67640 - DNA, 16 bp, H. sapiens
caggaggtcgagacca

SEQ ID NO: 67641 - DNA, 16 bp, H. sapiens
caggaggtggaaggtg

SEQ ID NO: 67642 - DNA, 16 bp, H. sapiens
caggaggtggagctcg

SEQ ID NO: 67643 - DNA, 16 bp, H. sapiens
caggaggtggaggctg

SEQ ID NO: 67644 - DNA, 16 bp, H. sapiens
caggaggtggaggtca

SEQ ID NO: 67645 - DNA, 16 bp, H. sapiens
caggaggtggatgagg

SEQ ID NO: 67646 - DNA, 16 bp, H. sapiens
caggaggtgggcaggg

SEQ ID NO: 67647 - DNA, 16 bp, H. sapiens
caggaggtggtggttg

SEQ ID NO: 67648 - DNA, 16 bp, H. sapiens
caggaggtgtcttgga

SEQ ID NO: 67649 - DNA, 16 bp, H. sapiens
caggaggttgaggcag

SEQ ID NO: 67650 - DNA, 16 bp, H. sapiens
caggagtacgagacca

SEQ ID NO: 67651 - DNA, 16 bp, H. sapiens
caggagtcaacaaact

SEQ ID NO: 67652 - DNA, 16 bp, H. sapiens
caggagtcagccacca

SEQ ID NO: 67653 - DNA, 16 bp, H. sapiens
caggagtccaagatca

SEQ ID NO: 67654 - DNA, 16 bp, H. sapiens
caggagtccaaggctg

SEQ ID NO: 67655 - DNA, 16 bp, H. sapiens
caggagtccagacccc

SEQ ID NO: 67656 - DNA, 16 bp, H. sapiens
caggagtccaggcccc

SEQ ID NO: 67657 - DNA, 16 bp, H. sapiens
caggagtctgaggtgg

SEQ ID NO: 67658 - DNA, 16 bp, H. sapiens
caggagtgagagagag

SEQ ID NO: 67659 - DNA, 16 bp, H. sapiens
caggagtgagccacca

SEQ ID NO: 67660 - DNA, 16 bp, H. sapiens
caggagtgagccaccg

SEQ ID NO: 67661 - DNA, 16 bp, H. sapiens
caggagtgagccactg

SEQ ID NO: 67662 - DNA, 16 bp, H. sapiens
caggagtgagtgagtt

SEQ ID NO: 67663 - DNA, 16 bp, H. sapiens
caggagtgcaagacca

SEQ ID NO: 67664 - DNA, 16 bp, H. sapiens
caggagtgcaatggtg

SEQ ID NO: 67665 - DNA, 16 bp, H. sapiens
caggagtggaagcagc

SEQ ID NO: 67666 - DNA, 16 bp, H. sapiens
caggagtggggcagag

SEQ ID NO: 67667 - DNA, 16 bp, H. sapiens
caggagtggttctaga

SEQ ID NO: 67668 - DNA, 16 bp, H. sapiens
caggagtgtaccacca

SEQ ID NO: 67669 - DNA, 16 bp, H. sapiens
caggagttaccagcct

SEQ ID NO: 67670 - DNA, 16 bp, H. sapiens
caggagttagaggctg

SEQ ID NO: 67671 - DNA, 16 bp, H. sapiens
caggagttcaacatca

SEQ ID NO: 67672 - DNA, 16 bp, H. sapiens
caggagttcaagacct

SEQ ID NO: 67673 - DNA, 16 bp, H. sapiens
caggagttcaagatcg

SEQ ID NO: 67674 - DNA, 16 bp, H. sapiens
caggagttcaagattg

SEQ ID NO: 67675 - DNA, 16 bp, H. sapiens
caggagttcaagcctg

SEQ ID NO: 67676 - DNA, 16 bp, H. sapiens
caggagttcaaggcca

SEQ ID NO: 67677 - DNA, 16 bp, H. sapiens
caggagttcaggaaca

SEQ ID NO: 67678 - DNA, 16 bp, H. sapiens
caggagttccagaaca

SEQ ID NO: 67679 - DNA, 23 bp, H. sapiens
caggagttccagaccaggctggc

SEQ ID NO: 67680 - DNA, 16 bp, H. sapiens
caggagttccagatca

SEQ ID NO: 67681 - DNA, 16 bp, H. sapiens
caggagttgaaggcca

SEQ ID NO: 67682 - DNA, 16 bp, H. sapiens
caggagttgctgatgg

SEQ ID NO: 67683 - DNA, 16 bp, H. sapiens
caggagttggaggtca

SEQ ID NO: 67684 - DNA, 16 bp, H. sapiens
caggagtttatgacca

SEQ ID NO: 67685 - DNA, 16 bp, H. sapiens
caggagtttgaatcca

SEQ ID NO: 67686 - DNA, 16 bp, H. sapiens
caggagtttgagaatg

SEQ ID NO: 67687 - DNA, 16 bp, H. sapiens
caggagtttgagagca

SEQ ID NO: 67688 - DNA, 16 bp, H. sapiens
caggagtttgagatca

SEQ ID NO: 67689 - DNA, 16 bp, H. sapiens
caggagtttgagatga

SEQ ID NO: 67690 - DNA, 16 bp, H. sapiens
caggagtttgaggaca

SEQ ID NO: 67691 - DNA, 16 bp, H. sapiens
caggagtttgaggtgg

SEQ ID NO: 67692 - DNA, 16 bp, H. sapiens
caggagtttgagttca

SEQ ID NO: 67693 - DNA, 16 bp, H. sapiens
caggagtttgtgacca

SEQ ID NO: 67694 - DNA, 16 bp, H. sapiens
caggagtttgtggctg

SEQ ID NO: 67695 - DNA, 16 bp, H. sapiens
caggataaaatccaca

SEQ ID NO: 67696 - DNA, 16 bp, H. sapiens
caggataatttttaaa

SEQ ID NO: 67697 - DNA, 16 bp, H. sapiens
caggatacaaaaatca

SEQ ID NO: 67698 - DNA, 16 bp, H. sapiens
caggatacaaaaccaa

SEQ ID NO: 67699 - DNA, 16 bp, H. sapiens
caggatacaatatcaa

SEQ ID NO: 67700 - DNA, 16 bp, H. sapiens
caggatacagaacagt

SEQ ID NO: 67701 - DNA, 16 bp, H. sapiens
caggatataaaatcaa

SEQ ID NO: 67702 - DNA, 16 bp, H. sapiens
caggatatcaagacca

SEQ ID NO: 67703 - DNA, 28 bp, H. sapiens
caggatattatccaggagaacttcccca

SEQ ID NO: 67704 - DNA, 16 bp, H. sapiens
caggatattttcttga

SEQ ID NO: 67705 - DNA, 16 bp, H. sapiens
caggatattttttaaa

SEQ ID NO: 67706 - DNA, 16 bp, H. sapiens
caggatcaataatttg

SEQ ID NO: 67707 - DNA, 16 bp, H. sapiens
caggatcaatattttg

SEQ ID NO: 67708 - DNA, 16 bp, H. sapiens
caggatccactaggtg

SEQ ID NO: 67709 - DNA, 18 bp, H. sapiens
caggatcccaaggcagag

SEQ ID NO: 67710 - DNA, 16 bp, H. sapiens
caggatcccacattgc

SEQ ID NO: 67711 - DNA, 16 bp, H. sapiens
caggatctcaaagaga

SEQ ID NO: 67712 - DNA, 16 bp, H. sapiens
caggatctcaggcccc

SEQ ID NO: 67713 - DNA, 16 bp, H. sapiens
caggatgacctgcctg

SEQ ID NO: 67714 - DNA, 17 bp, H. sapiens
caggatgagccgcagac

SEQ ID NO: 67715 - DNA, 16 bp, H. sapiens
caggatgaggcaggag

SEQ ID NO: 67716 - DNA, 16 bp, H. sapiens
caggatgatgctgact

SEQ ID NO: 67717 - DNA, 16 bp, H. sapiens
caggatgatgctgtcc

SEQ ID NO: 67718 - DNA, 16 bp, H. sapiens
caggatgatttcatct

SEQ ID NO: 67719 - DNA, 16 bp, H. sapiens
caggatgcaaaatcaa

SEQ ID NO: 67720 - DNA, 16 bp, H. sapiens
caggatgcagtgagtg

SEQ ID NO: 67721 - DNA, 16 bp, H. sapiens
caggatgcccagatat

SEQ ID NO: 67722 - DNA, 16 bp, H. sapiens
caggatgccctctctc

SEQ ID NO: 67723 - DNA, 16 bp, H. sapiens
caggatgctgaggcag

SEQ ID NO: 67724 - DNA, 16 bp, H. sapiens
caggatgctgctggcc

SEQ ID NO: 67725 - DNA, 16 bp, H. sapiens
caggatggagggtctg

SEQ ID NO: 67726 - DNA, 16 bp, H. sapiens
caggatggagtgcagg

SEQ ID NO: 67727 - DNA, 16 bp, H. sapiens
caggatggagtgtggt

SEQ ID NO: 67728 - DNA, 16 bp, H. sapiens
caggatggatggggag

SEQ ID NO: 67729 - DNA, 16 bp, H. sapiens
caggatggctttgaat

SEQ ID NO: 67730 - DNA, 16 bp, H. sapiens
caggatgggggctggc

SEQ ID NO: 67731 - DNA, 18 bp, H. sapiens
caggatggtctctatctc

SEQ ID NO: 67732 - DNA, 17 bp, H. sapiens
caggatggtcttgaact

SEQ ID NO: 67733 - DNA, 16 bp, H. sapiens
caggatgtatggaaat

SEQ ID NO: 67734 - DNA, 16 bp, H. sapiens
caggatgttgcaggca

SEQ ID NO: 67735 - DNA, 16 bp, H. sapiens
caggattacaagtgtg

SEQ ID NO: 67736 - DNA, 16 bp, H. sapiens
caggattagaaattat

SEQ ID NO: 67737 - DNA, 16 bp, H. sapiens
caggattcaaaccagg

SEQ ID NO: 67738 - DNA, 16 bp, H. sapiens
caggattcaaacccag

SEQ ID NO: 67739 - DNA, 16 bp, H. sapiens
caggattcaaatccag

SEQ ID NO: 67740 - DNA, 16 bp, H. sapiens
caggattcaagaccag

SEQ ID NO: 67741 - DNA, 16 bp, H. sapiens
caggattcagtgtggg

SEQ ID NO: 67742 - DNA, 16 bp, H. sapiens
caggattgagatagag

SEQ ID NO: 67743 - DNA, 16 bp, H. sapiens
caggatttcattcatt

SEQ ID NO: 67744 - DNA, 16 bp, H. sapiens
caggatttcctttttt

SEQ ID NO: 67745 - DNA, 16 bp, H. sapiens
caggatttgaacccag

SEQ ID NO: 67746 - DNA, 16 bp, H. sapiens
caggatttgaactcag

SEQ ID NO: 67747 - DNA, 16 bp, H. sapiens
caggatttgaatccag

SEQ ID NO: 67748 - DNA, 16 bp, H. sapiens
caggatttgctgacag

SEQ ID NO: 67749 - DNA, 16 bp, H. sapiens
caggatttggtatcag

SEQ ID NO: 67750 - DNA, 16 bp, H. sapiens
caggatttttttttct

SEQ ID NO: 67751 - DNA, 16 bp, H. sapiens
caggcaaaatagattt

SEQ ID NO: 67752 - DNA, 16 bp, H. sapiens
caggcaaatcgcttga

SEQ ID NO: 67753 - DNA, 16 bp, H. sapiens
caggcaaatggataaa

SEQ ID NO: 67754 - DNA, 16 bp, H. sapiens
caggcaacagaagaaa

SEQ ID NO: 67755 - DNA, 16 bp, H. sapiens
caggcaacatggtgaa

SEQ ID NO: 67756 - DNA, 16 bp, H. sapiens
caggcaaccaccacca

SEQ ID NO: 67757 - DNA, 16 bp, H. sapiens
caggcaaggtgaaccc

SEQ ID NO: 67758 - DNA, 16 bp, H. sapiens
caggcaatgtacagaa

SEQ ID NO: 67759 - DNA, 16 bp, H. sapiens
caggcacaatgactca

SEQ ID NO: 67760 - DNA, 16 bp, H. sapiens
caggcacacagtacaa

SEQ ID NO: 67761 - DNA, 16 bp, H. sapiens
caggcacactggctgc

SEQ ID NO: 67762 - DNA, 16 bp, H. sapiens
caggcacagagagaga

SEQ ID NO: 67763 - DNA, 16 bp, H. sapiens
caggcacagaggaaag

SEQ ID NO: 67764 - DNA, 16 bp, H. sapiens
caggcacagaggctca

SEQ ID NO: 67765 - DNA, 16 bp, H. sapiens
caggcacagagggaag

SEQ ID NO: 67766 - DNA, 16 bp, H. sapiens
caggcacagccaccac

SEQ ID NO: 67767 - DNA, 16 bp, H. sapiens
caggcacagctgacca

SEQ ID NO: 67768 - DNA, 16 bp, H. sapiens
caggcacaggaagaca

SEQ ID NO: 67769 - DNA, 16 bp, H. sapiens
caggcacagggaacag

SEQ ID NO: 67770 - DNA, 16 bp, H. sapiens
caggcacagtagctca

SEQ ID NO: 67771 - DNA, 16 bp, H. sapiens
caggcacagtcgctca

SEQ ID NO: 67772 - DNA, 16 bp, H. sapiens
caggcacagtgactca

SEQ ID NO: 67773 - DNA, 16 bp, H. sapiens
caggcacagtgccagg

SEQ ID NO: 67774 - DNA, 16 bp, H. sapiens
caggcacagtggcaca

SEQ ID NO: 67775 - DNA, 16 bp, H. sapiens
caggcacagtggctcc

SEQ ID NO: 67776 - DNA, 16 bp, H. sapiens
caggcacataccactg

SEQ ID NO: 67777 - DNA, 16 bp, H. sapiens
caggcacatactacca

SEQ ID NO: 67778 - DNA, 16 bp, H. sapiens
caggcacatcacatga

SEQ ID NO: 67779 - DNA, 16 bp, H. sapiens
caggcaccaaaagaca

SEQ ID NO: 67780 - DNA, 16 bp, H. sapiens
caggcaccaaccacca

SEQ ID NO: 67781 - DNA, 16 bp, H. sapiens
caggcaccaccaccat

SEQ ID NO: 67782 - DNA, 16 bp, H. sapiens
caggcaccagcacagg

SEQ ID NO: 67783 - DNA, 16 bp, H. sapiens
caggcaccatgcccag

SEQ ID NO: 67784 - DNA, 16 bp, H. sapiens
caggcaccatgctgag

SEQ ID NO: 67785 - DNA, 16 bp, H. sapiens
caggcaccatgctggg

SEQ ID NO: 67786 - DNA, 16 bp, H. sapiens
caggcaccattctagg

SEQ ID NO: 67787 - DNA, 16 bp, H. sapiens
caggcacccactgcca

SEQ ID NO: 67788 - DNA, 16 bp, H. sapiens
caggcaccgtggctca

SEQ ID NO: 67789 - DNA, 16 bp, H. sapiens
caggcacctgccacta

SEQ ID NO: 67790 - DNA, 16 bp, H. sapiens
caggcacctgccactg

SEQ ID NO: 67791 - DNA, 16 bp, H. sapiens
caggcacctgtaatct

SEQ ID NO: 67792 - DNA, 16 bp, H. sapiens
caggcacctgtcagcc

SEQ ID NO: 67793 - DNA, 16 bp, H. sapiens
caggcaccttccacca

SEQ ID NO: 67794 - DNA, 16 bp, H. sapiens
caggcacgagccacca

SEQ ID NO: 67795 - DNA, 16 bp, H. sapiens
caggcacgatggctca

SEQ ID NO: 67796 - DNA, 16 bp, H. sapiens
caggcacggtggtggg

SEQ ID NO: 67797 - DNA, 16 bp, H. sapiens
caggcacgtgccgcca

SEQ ID NO: 67798 - DNA, 16 bp, H. sapiens
caggcactcctgtttt

SEQ ID NO: 67799 - DNA, 16 bp, H. sapiens
caggcactgagccagg

SEQ ID NO: 67800 - DNA, 16 bp, H. sapiens
caggcactgagctggg

SEQ ID NO: 67801 - DNA, 16 bp, H. sapiens
caggcactgggcaggc

SEQ ID NO: 67802 - DNA, 16 bp, H. sapiens
caggcactggtatcca

SEQ ID NO: 67803 - DNA, 16 bp, H. sapiens
caggcactgtactaaa

SEQ ID NO: 67804 - DNA, 16 bp, H. sapiens
caggcactgtactggg

SEQ ID NO: 67805 - DNA, 16 bp, H. sapiens
caggcactgtgctggg

SEQ ID NO: 67806 - DNA, 16 bp, H. sapiens
caggcacttttttttt

SEQ ID NO: 67807 - DNA, 16 bp, H. sapiens
caggcagaaaaggaga

SEQ ID NO: 67808 - DNA, 16 bp, H. sapiens
caggcagaagaaaatg

SEQ ID NO: 67809 - DNA, 16 bp, H. sapiens
caggcagaagaaagtg

SEQ ID NO: 67810 - DNA, 16 bp, H. sapiens
caggcagaagcctcct

SEQ ID NO: 67811 - DNA, 16 bp, H. sapiens
caggcagaaggaaaat

SEQ ID NO: 67812 - DNA, 16 bp, H. sapiens
caggcagaaggcacag

SEQ ID NO: 67813 - DNA, 16 bp, H. sapiens
caggcagaatggctat

SEQ ID NO: 67814 - DNA, 16 bp, H. sapiens
caggcagacaagatta

SEQ ID NO: 67815 - DNA, 16 bp, H. sapiens
caggcagacagacaga

SEQ ID NO: 67816 - DNA, 16 bp, H. sapiens
caggcagacagcctgg

SEQ ID NO: 67817 - DNA, 16 bp, H. sapiens
caggcagagagagaaa

SEQ ID NO: 67818 - DNA, 16 bp, H. sapiens
caggcagagagagctt

SEQ ID NO: 67819 - DNA, 16 bp, H. sapiens
caggcagagagaggag

SEQ ID NO: 67820 - DNA, 16 bp, H. sapiens
caggcagagaggctcc

SEQ ID NO: 67821 - DNA, 16 bp, H. sapiens
caggcagaggaagagg

SEQ ID NO: 67822 - DNA, 16 bp, H. sapiens
caggcagaggaagcag

SEQ ID NO: 67823 - DNA, 16 bp, H. sapiens
caggcagaggaggcac

SEQ ID NO: 67824 - DNA, 16 bp, H. sapiens
caggcagaggaggcgc

SEQ ID NO: 67825 - DNA, 16 bp, H. sapiens
caggcagaggctgaaa

SEQ ID NO: 67826 - DNA, 16 bp, H. sapiens
caggcagaggctgctg

SEQ ID NO: 67827 - DNA, 16 bp, H. sapiens
caggcagaggctggaa

SEQ ID NO: 67828 - DNA, 16 bp, H. sapiens
caggcagagggaacag

SEQ ID NO: 67829 - DNA, 16 bp, H. sapiens
caggcagagggaactg

SEQ ID NO: 67830 - DNA, 16 bp, H. sapiens
caggcagagggaagag

SEQ ID NO: 67831 - DNA, 16 bp, H. sapiens
caggcagagggaatgg

SEQ ID NO: 67832 - DNA, 16 bp, H. sapiens
caggcagaggtgtgct

SEQ ID NO: 67833 - DNA, 16 bp, H. sapiens
caggcagatctcaaac

SEQ ID NO: 67834 - DNA, 16 bp, H. sapiens
caggcagatctccagg

SEQ ID NO: 67835 - DNA, 16 bp, H. sapiens
caggcagcacagcaga

SEQ ID NO: 67836 - DNA, 16 bp, H. sapiens
caggcagcatttacca

SEQ ID NO: 67837 - DNA, 16 bp, H. sapiens
caggcagccacagctg

SEQ ID NO: 67838 - DNA, 16 bp, H. sapiens
caggcagcctcctgag

SEQ ID NO: 67839 - DNA, 16 bp, H. sapiens
caggcagcctctagaa

SEQ ID NO: 67840 - DNA, 16 bp, H. sapiens
caggcagcctctggaa

SEQ ID NO: 67841 - DNA, 16 bp, H. sapiens
caggcagcctggctct

SEQ ID NO: 67842 - DNA, 16 bp, H. sapiens
caggcagccttccctg

SEQ ID NO: 67843 - DNA, 16 bp, H. sapiens
caggcagctgcagctg

SEQ ID NO: 67844 - DNA, 16 bp, H. sapiens
caggcagctgcagtga

SEQ ID NO: 67845 - DNA, 16 bp, H. sapiens
caggcagctgccacca

SEQ ID NO: 67846 - DNA, 16 bp, H. sapiens
caggcaggagaaagaa

SEQ ID NO: 67847 - DNA, 16 bp, H. sapiens
caggcaggagccacca

SEQ ID NO: 67848 - DNA, 16 bp, H. sapiens
caggcaggagccactg

SEQ ID NO: 67849 - DNA, 16 bp, H. sapiens
caggcaggagccaggg

SEQ ID NO: 67850 - DNA, 16 bp, H. sapiens
caggcaggagggcagg

SEQ ID NO: 67851 - DNA, 16 bp, H. sapiens
caggcaggcaagcagg

SEQ ID NO: 67852 - DNA, 16 bp, H. sapiens
caggcaggcagacagg

SEQ ID NO: 67853 - DNA, 16 bp, H. sapiens
caggcaggcaggaggc

SEQ ID NO: 67854 - DNA, 16 bp, H. sapiens
caggcaggcaggcaag

SEQ ID NO: 67855 - DNA, 16 bp, H. sapiens
caggcaggcaggcagg

SEQ ID NO: 67856 - DNA, 16 bp, H. sapiens
caggcaggcctcctgg

SEQ ID NO: 67857 - DNA, 16 bp, H. sapiens
caggcagggaccctgg

SEQ ID NO: 67858 - DNA, 16 bp, H. sapiens
caggcagggacttggc

SEQ ID NO: 67859 - DNA, 16 bp, H. sapiens
caggcagggccctggg

SEQ ID NO: 67860 - DNA, 16 bp, H. sapiens
caggcaggggaaggaa

SEQ ID NO: 67861 - DNA, 16 bp, H. sapiens
caggcaggggctgggc

SEQ ID NO: 67862 - DNA, 16 bp, H. sapiens
caggcaggggctgggg

SEQ ID NO: 67863 - DNA, 16 bp, H. sapiens
caggcaggtctccttg

SEQ ID NO: 67864 - DNA, 16 bp, H. sapiens
caggcaggtgccactg

SEQ ID NO: 67865 - DNA, 16 bp, H. sapiens
caggcagtccacctgc

SEQ ID NO: 67866 - DNA, 16 bp, H. sapiens
caggcagtctgattcc

SEQ ID NO: 67867 - DNA, 16 bp, H. sapiens
caggcagtgagcacag

SEQ ID NO: 67868 - DNA, 16 bp, H. sapiens
caggcagtggaagcag

SEQ ID NO: 67869 - DNA, 16 bp, H. sapiens
caggcagtgggagcag

SEQ ID NO: 67870 - DNA, 16 bp, H. sapiens
caggcagtgggcaagc

SEQ ID NO: 67871 - DNA, 16 bp, H. sapiens
caggcagtttcagcag

SEQ ID NO: 67872 - DNA, 16 bp, H. sapiens
caggcataagccaccg

SEQ ID NO: 67873 - DNA, 16 bp, H. sapiens
caggcataagccactg

SEQ ID NO: 67874 - DNA, 16 bp, H. sapiens
caggcatagtggtgcc

SEQ ID NO: 67875 - DNA, 16 bp, H. sapiens
caggcatatcacatgg

SEQ ID NO: 67876 - DNA, 16 bp, H. sapiens
caggcatccctgtgct

SEQ ID NO: 67877 - DNA, 16 bp, H. sapiens
caggcatctcagacca

SEQ ID NO: 67878 - DNA, 16 bp, H. sapiens
caggcatcttacatgg

SEQ ID NO: 67879 - DNA, 16 bp, H. sapiens
caggcatgaaccaccg

SEQ ID NO: 67880 - DNA, 16 bp, H. sapiens
caggcatgaaccactg

SEQ ID NO: 67881 - DNA, 16 bp, H. sapiens
caggcatgaaccatca

SEQ ID NO: 67882 - DNA, 16 bp, H. sapiens
caggcatgaatcacca

SEQ ID NO: 67883 - DNA, 16 bp, H. sapiens
caggcatgagacactg

SEQ ID NO: 67884 - DNA, 16 bp, H. sapiens
caggcatgagactcca

SEQ ID NO: 67885 - DNA, 16 bp, H. sapiens
caggcatgagcaactg

SEQ ID NO: 67886 - DNA, 16 bp, H. sapiens
caggcatgagcactgc

SEQ ID NO: 67887 - DNA, 16 bp, H. sapiens
caggcatgagccaacg

SEQ ID NO: 67888 - DNA, 16 bp, H. sapiens
caggcatgagccaatg

SEQ ID NO: 67889 - DNA, 16 bp, H. sapiens
caggcatgagccacag

SEQ ID NO: 67890 - DNA, 16 bp, H. sapiens
caggcatgagccaccc

SEQ ID NO: 67891 - DNA, 16 bp, H. sapiens
caggcatgagccaccg

SEQ ID NO: 67892 - DNA, 18 bp, H. sapiens
caggcatgagccaccgta

SEQ ID NO: 67893 - DNA, 16 bp, H. sapiens
caggcatgagccacct

SEQ ID NO: 67894 - DNA, 16 bp, H. sapiens
caggcatgagccacgg

SEQ ID NO: 67895 - DNA, 16 bp, H. sapiens
caggcatgagccacta

SEQ ID NO: 67896 - DNA, 16 bp, H. sapiens
caggcatgagccactg

SEQ ID NO: 67897 - DNA, 16 bp, H. sapiens
caggcatgagccactt

SEQ ID NO: 67898 - DNA, 16 bp, H. sapiens
caggcatgagccagag

SEQ ID NO: 67899 - DNA, 16 bp, H. sapiens
caggcatgagccagca

SEQ ID NO: 67900 - DNA, 16 bp, H. sapiens
caggcatgagccagtg

SEQ ID NO: 67901 - DNA, 16 bp, H. sapiens
caggcatgagccatcg

SEQ ID NO: 67902 - DNA, 16 bp, H. sapiens
caggcatgagccattc

SEQ ID NO: 67903 - DNA, 16 bp, H. sapiens
caggcatgagccattg

SEQ ID NO: 67904 - DNA, 16 bp, H. sapiens
caggcatgagcccctg

SEQ ID NO: 67905 - DNA, 16 bp, H. sapiens
caggcatgagctactg

SEQ ID NO: 67906 - DNA, 16 bp, H. sapiens
caggcatgagtcaccg

SEQ ID NO: 67907 - DNA, 16 bp, H. sapiens
caggcatgagtcacta

SEQ ID NO: 67908 - DNA, 16 bp, H. sapiens
caggcatgagtcactg

SEQ ID NO: 67909 - DNA, 16 bp, H. sapiens
caggcatgagtcattg

SEQ ID NO: 67910 - DNA, 16 bp, H. sapiens
caggcatgagtgacca

SEQ ID NO: 67911 - DNA, 16 bp, H. sapiens
caggcatgataatgac

SEQ ID NO: 67912 - DNA, 16 bp, H. sapiens
caggcatgatggcaga

SEQ ID NO: 67913 - DNA, 16 bp, H. sapiens
caggcatgatggccca

SEQ ID NO: 67914 - DNA, 16 bp, H. sapiens
caggcatgcagtacca

SEQ ID NO: 67915 - DNA, 16 bp, H. sapiens
caggcatgctggcggg

SEQ ID NO: 67916 - DNA, 16 bp, H. sapiens
caggcatgctggtggg

SEQ ID NO: 67917 - DNA, 16 bp, H. sapiens
caggcatggccaccac

SEQ ID NO: 67918 - DNA, 16 bp, H. sapiens
caggcatggccaccat

SEQ ID NO: 67919 - DNA, 16 bp, H. sapiens
caggcatggcggcggg

SEQ ID NO: 67920 - DNA, 16 bp, H. sapiens
caggcatggtggcagg

SEQ ID NO: 67921 - DNA, 16 bp, H. sapiens
caggcatggtggcgtg

SEQ ID NO: 67922 - DNA, 16 bp, H. sapiens
caggcatggtggctca

SEQ ID NO: 67923 - DNA, 16 bp, H. sapiens
caggcatgtgcaacca

SEQ ID NO: 67924 - DNA, 16 bp, H. sapiens
caggcatgtgcaccac

SEQ ID NO: 67925 - DNA, 16 bp, H. sapiens
caggcattcaaggctg

SEQ ID NO: 67926 - DNA, 16 bp, H. sapiens
caggcattgtggtgtg

SEQ ID NO: 67927 - DNA, 16 bp, H. sapiens
caggcattgtgttaag

SEQ ID NO: 67928 - DNA, 16 bp, H. sapiens
caggcattgttctagg

SEQ ID NO: 67929 - DNA, 16 bp, H. sapiens
caggcatttggagcac

SEQ ID NO: 67930 - DNA, 16 bp, H. sapiens
caggccaaggcaggtg

SEQ ID NO: 67931 - DNA, 16 bp, H. sapiens
caggccaagtgggcag

SEQ ID NO: 67932 - DNA, 17 bp, H. sapiens
caggccaatgttcagat

SEQ ID NO: 67933 - DNA, 16 bp, H. sapiens
caggccacatgtggcc

SEQ ID NO: 67934 - DNA, 16 bp, H. sapiens
caggccaccactgcca

SEQ ID NO: 67935 - DNA, 16 bp, H. sapiens
caggccacggaccagt

SEQ ID NO: 67936 - DNA, 16 bp, H. sapiens
caggccactcccaccc

SEQ ID NO: 67937 - DNA, 16 bp, H. sapiens
caggccactgtgcctg

SEQ ID NO: 67938 - DNA, 16 bp, H. sapiens
caggccagagtacaat

SEQ ID NO: 67939 - DNA, 16 bp, H. sapiens
caggccagagtgcagt

SEQ ID NO: 67940 - DNA, 16 bp, H. sapiens
caggccagcagcacag

SEQ ID NO: 67941 - DNA, 16 bp, H. sapiens
caggccagcctctgcc

SEQ ID NO: 67942 - DNA, 16 bp, H. sapiens
caggccagcctgctgg

SEQ ID NO: 67943 - DNA, 16 bp, H. sapiens
caggccagcctggcca

SEQ ID NO: 67944 - DNA, 16 bp, H. sapiens
caggccaggcacaatg

SEQ ID NO: 67945 - DNA, 16 bp, H. sapiens
caggccaggcactgtg

SEQ ID NO: 67946 - DNA, 16 bp, H. sapiens
caggccaggcaggcag

SEQ ID NO: 67947 - DNA, 16 bp, H. sapiens
caggccaggccctggg

SEQ ID NO: 67948 - DNA, 16 bp, H. sapiens
caggccaggccctgtg

SEQ ID NO: 67949 - DNA, 16 bp, H. sapiens
caggccaggctgggtg

SEQ ID NO: 67950 - DNA, 16 bp, H. sapiens
caggccaggctggtct

SEQ ID NO: 67951 - DNA, 16 bp, H. sapiens
caggccagggctgctg

SEQ ID NO: 67952 - DNA, 16 bp, H. sapiens
caggccaggggcagtg

SEQ ID NO: 67953 - DNA, 16 bp, H. sapiens
caggccagtattcctg

SEQ ID NO: 67954 - DNA, 16 bp, H. sapiens
caggccatctgcctgc

SEQ ID NO: 67955 - DNA, 16 bp, H. sapiens
caggccatggactagt

SEQ ID NO: 67956 - DNA, 16 bp, H. sapiens
caggccatggactggt

SEQ ID NO: 67957 - DNA, 16 bp, H. sapiens
caggcccagagtgcca

SEQ ID NO: 67958 - DNA, 16 bp, H. sapiens
caggcccagccccagc

SEQ ID NO: 67959 - DNA, 16 bp, H. sapiens
caggcccagcccctcc

SEQ ID NO: 67960 - DNA, 16 bp, H. sapiens
caggcccagcccctgc

SEQ ID NO: 67961 - DNA, 16 bp, H. sapiens
caggcccagccctggg

SEQ ID NO: 67962 - DNA, 16 bp, H. sapiens
caggcccagcctcatg

SEQ ID NO: 67963 - DNA, 16 bp, H. sapiens
caggcccagcctcctg

SEQ ID NO: 67964 - DNA, 16 bp, H. sapiens
caggcccagcctctgc

SEQ ID NO: 67965 - DNA, 16 bp, H. sapiens
caggcccagctcaggc

SEQ ID NO: 67966 - DNA, 16 bp, H. sapiens
caggcccaggacccca

SEQ ID NO: 67967 - DNA, 16 bp, H. sapiens
caggcccagggcaggg

SEQ ID NO: 67968 - DNA, 16 bp, H. sapiens
caggcccagggcccag

SEQ ID NO: 67969 - DNA, 16 bp, H. sapiens
caggcccagggctggg

SEQ ID NO: 67970 - DNA, 16 bp, H. sapiens
caggcccagtggctca

SEQ ID NO: 67971 - DNA, 16 bp, H. sapiens
caggccccacccagac

SEQ ID NO: 67972 - DNA, 16 bp, H. sapiens
caggccccacccaggc

SEQ ID NO: 67973 - DNA, 16 bp, H. sapiens
caggccccagcccagg

SEQ ID NO: 67974 - DNA, 16 bp, H. sapiens
caggccccagtggtgg

SEQ ID NO: 67975 - DNA, 16 bp, H. sapiens
caggccccagtgtgag

SEQ ID NO: 67976 - DNA, 16 bp, H. sapiens
caggccccatctccag

SEQ ID NO: 67977 - DNA, 16 bp, H. sapiens
caggcccccagcccct

SEQ ID NO: 67978 - DNA, 16 bp, H. sapiens
caggcccccaggccct

SEQ ID NO: 67979 - DNA, 16 bp, H. sapiens
caggccccgcctccaa

SEQ ID NO: 67980 - DNA, 16 bp, H. sapiens
caggccccggtgtgtg

SEQ ID NO: 67981 - DNA, 16 bp, H. sapiens
caggcccctcctccaa

SEQ ID NO: 67982 - DNA, 16 bp, H. sapiens
caggcccctccttcaa

SEQ ID NO: 67983 - DNA, 16 bp, H. sapiens
caggcccctctgctgc

SEQ ID NO: 67984 - DNA, 16 bp, H. sapiens
caggcccctgtgtgtg

SEQ ID NO: 67985 - DNA, 16 bp, H. sapiens
caggccccttcccttc

SEQ ID NO: 67986 - DNA, 16 bp, H. sapiens
caggccctgcccaggc

SEQ ID NO: 67987 - DNA, 16 bp, H. sapiens
caggccctgccccagg

SEQ ID NO: 67988 - DNA, 16 bp, H. sapiens
caggccctgcctcctg

SEQ ID NO: 67989 - DNA, 16 bp, H. sapiens
caggccctggagccag

SEQ ID NO: 67990 - DNA, 16 bp, H. sapiens
caggccctggccctgg

SEQ ID NO: 67991 - DNA, 16 bp, H. sapiens
caggccctgggccagg

SEQ ID NO: 67992 - DNA, 16 bp, H. sapiens
caggccctggtgagtg

SEQ ID NO: 67993 - DNA, 16 bp, H. sapiens
caggccctgtgccagg

SEQ ID NO: 67994 - DNA, 16 bp, H. sapiens
caggccctgtgctgag

SEQ ID NO: 67995 - DNA, 16 bp, H. sapiens
caggccgaggcaggag

SEQ ID NO: 67996 - DNA, 16 bp, H. sapiens
caggccggatgtggtg

SEQ ID NO: 67997 - DNA, 16 bp, H. sapiens
caggccgggcccagtg

SEQ ID NO: 67998 - DNA, 16 bp, H. sapiens
caggccgggcgccgtg

SEQ ID NO: 67999 - DNA, 16 bp, H. sapiens
caggcctaatcgccac

SEQ ID NO: 68000 - DNA, 16 bp, H. sapiens
caggcctcagccacct

SEQ ID NO: 68001 - DNA, 16 bp, H. sapiens
caggcctcagctgcct

SEQ ID NO: 68002 - DNA, 16 bp, H. sapiens
caggcctcagtctccc

SEQ ID NO: 68003 - DNA, 16 bp, H. sapiens
caggcctcagtgtgtg

SEQ ID NO: 68004 - DNA, 16 bp, H. sapiens
caggcctcagtttctt

SEQ ID NO: 68005 - DNA, 16 bp, H. sapiens
caggcctcctgactcc

SEQ ID NO: 68006 - DNA, 16 bp, H. sapiens
caggcctcctgctcta

SEQ ID NO: 68007 - DNA, 16 bp, H. sapiens
caggcctccttgagct

SEQ ID NO: 68008 - DNA, 16 bp, H. sapiens
caggcctctgggccca

SEQ ID NO: 68009 - DNA, 16 bp, H. sapiens
caggcctgagccacca

SEQ ID NO: 68010 - DNA, 16 bp, H. sapiens
caggcctgagccaccg

SEQ ID NO: 68011 - DNA, 16 bp, H. sapiens
caggcctgagccagca

SEQ ID NO: 68012 - DNA, 16 bp, H. sapiens
caggcctgagccatgg

SEQ ID NO: 68013 - DNA, 16 bp, H. sapiens
caggcctgagcctctg

SEQ ID NO: 68014 - DNA, 16 bp, H. sapiens
caggcctgaggctggg

SEQ ID NO: 68015 - DNA, 16 bp, H. sapiens
caggcctgcaccactg

SEQ ID NO: 68016 - DNA, 16 bp, H. sapiens
caggcctgcccacagt

SEQ ID NO: 68017 - DNA, 16 bp, H. sapiens
caggcctggagctggg

SEQ ID NO: 68018 - DNA, 16 bp, H. sapiens
caggcctggaggacct

SEQ ID NO: 68019 - DNA, 16 bp, H. sapiens
caggcctggcccagag

SEQ ID NO: 68020 - DNA, 16 bp, H. sapiens
caggcctggcccagcc

SEQ ID NO: 68021 - DNA, 16 bp, H. sapiens
caggcctggctaattt

SEQ ID NO: 68022 - DNA, 16 bp, H. sapiens
caggcctggctgggct

SEQ ID NO: 68023 - DNA, 16 bp, H. sapiens
caggcctgggaggagg

SEQ ID NO: 68024 - DNA, 16 bp, H. sapiens
caggcctgggagtggg

SEQ ID NO: 68025 - DNA, 16 bp, H. sapiens
caggcctgggccacca

SEQ ID NO: 68026 - DNA, 16 bp, H. sapiens
caggcctggggcagag

SEQ ID NO: 68027 - DNA, 16 bp, H. sapiens
caggcctggggcaggg

SEQ ID NO: 68028 - DNA, 16 bp, H. sapiens
caggcctgggggtgga

SEQ ID NO: 68029 - DNA, 16 bp, H. sapiens
caggcctggtggcagg

SEQ ID NO: 68030 - DNA, 16 bp, H. sapiens
caggcctggtggtggc

SEQ ID NO: 68031 - DNA, 16 bp, H. sapiens
caggcctggtggtgtg

SEQ ID NO: 68032 - DNA, 16 bp, H. sapiens
caggcctgtaatccta

SEQ ID NO: 68033 - DNA, 16 bp, H. sapiens
caggcctgtagtccca

SEQ ID NO: 68034 - DNA, 16 bp, H. sapiens
caggcctgtgcccaca

SEQ ID NO: 68035 - DNA, 16 bp, H. sapiens
caggccttacatttaa

SEQ ID NO: 68036 - DNA, 16 bp, H. sapiens
caggccttgatataat

SEQ ID NO: 68037 - DNA, 16 bp, H. sapiens
caggccttggtgtgtg

SEQ ID NO: 68038 - DNA, 16 bp, H. sapiens
caggcctttcctgggc

SEQ ID NO: 68039 - DNA, 16 bp, H. sapiens
caggcctttgcacttg

SEQ ID NO: 68040 - DNA, 16 bp, H. sapiens
caggcctttggcctca

SEQ ID NO: 68041 - DNA, 16 bp, H. sapiens
caggcgaggggagcct

SEQ ID NO: 68042 - DNA, 16 bp, H. sapiens
caggcgcagtgattca

SEQ ID NO: 68043 - DNA, 16 bp, H. sapiens
caggcgcccgccagca

SEQ ID NO: 68044 - DNA, 16 bp, H. sapiens
caggcgcctgccacct

SEQ ID NO: 68045 - DNA, 16 bp, H. sapiens
caggcgcgagccaccg

SEQ ID NO: 68046 - DNA, 16 bp, H. sapiens
caggcgcgccccacca

SEQ ID NO: 68047 - DNA, 16 bp, H. sapiens
caggcgcgcgccgcca

SEQ ID NO: 68048 - DNA, 16 bp, H. sapiens
caggcgcggtggtggg

SEQ ID NO: 68049 - DNA, 16 bp, H. sapiens
caggcgcggtggttca

SEQ ID NO: 68050 - DNA, 16 bp, H. sapiens
caggcggaggctgcag

SEQ ID NO: 68051 - DNA, 16 bp, H. sapiens
caggcggattgcttga

SEQ ID NO: 68052 - DNA, 16 bp, H. sapiens
caggcggccaccacca

SEQ ID NO: 68053 - DNA, 16 bp, H. sapiens
caggcgggagccactg

SEQ ID NO: 68054 - DNA, 16 bp, H. sapiens
caggcgtaagccacca

SEQ ID NO: 68055 - DNA, 16 bp, H. sapiens
caggcgtaagccaccg

SEQ ID NO: 68056 - DNA, 16 bp, H. sapiens
caggcgtaagccactg

SEQ ID NO: 68057 - DNA, 16 bp, H. sapiens
caggcgtcagccaccg

SEQ ID NO: 68058 - DNA, 16 bp, H. sapiens
caggcgtgaaccacca

SEQ ID NO: 68059 - DNA, 16 bp, H. sapiens
caggcgtgaaccaccg

SEQ ID NO: 68060 - DNA, 16 bp, H. sapiens
caggcgtgagacacca

SEQ ID NO: 68061 - DNA, 16 bp, H. sapiens
caggcgtgagacactg

SEQ ID NO: 68062 - DNA, 16 bp, H. sapiens
caggcgtgagcaacca

SEQ ID NO: 68063 - DNA, 16 bp, H. sapiens
caggcgtgagccacag

SEQ ID NO: 68064 - DNA, 16 bp, H. sapiens
caggcgtgagccacca

SEQ ID NO: 68065 - DNA, 16 bp, H. sapiens
caggcgtgagccaccc

SEQ ID NO: 68066 - DNA, 16 bp, H. sapiens
caggcgtgagccaccg

SEQ ID NO: 68067 - DNA, 16 bp, H. sapiens
caggcgtgagccacct

SEQ ID NO: 68068 - DNA, 16 bp, H. sapiens
caggcgtgagccacgc

SEQ ID NO: 68069 - DNA, 16 bp, H. sapiens
caggcgtgagccacgg

SEQ ID NO: 68070 - DNA, 16 bp, H. sapiens
caggcgtgagccacta

SEQ ID NO: 68071 - DNA, 16 bp, H. sapiens
caggcgtgagccactc

SEQ ID NO: 68072 - DNA, 16 bp, H. sapiens
caggcgtgagccactg

SEQ ID NO: 68073 - DNA, 16 bp, H. sapiens
caggcgtgagccagcg

SEQ ID NO: 68074 - DNA, 16 bp, H. sapiens
caggcgtgagccatca

SEQ ID NO: 68075 - DNA, 16 bp, H. sapiens
caggcgtgagccatcg

SEQ ID NO: 68076 - DNA, 16 bp, H. sapiens
caggcgtgagccatgg

SEQ ID NO: 68077 - DNA, 16 bp, H. sapiens
caggcgtgagccatta

SEQ ID NO: 68078 - DNA, 16 bp, H. sapiens
caggcgtgagccattg

SEQ ID NO: 68079 - DNA, 16 bp, H. sapiens
caggcgtgagccccca

SEQ ID NO: 68080 - DNA, 16 bp, H. sapiens
caggcgtgagcccccg

SEQ ID NO: 68081 - DNA, 16 bp, H. sapiens
caggcgtgagccccgg

SEQ ID NO: 68082 - DNA, 16 bp, H. sapiens
caggcgtgagcccggc

SEQ ID NO: 68083 - DNA, 16 bp, H. sapiens
caggcgtgagccgccg

SEQ ID NO: 68084 - DNA, 16 bp, H. sapiens
caggcgtgagccgctg

SEQ ID NO: 68085 - DNA, 16 bp, H. sapiens
caggcgtgagcctctg

SEQ ID NO: 68086 - DNA, 16 bp, H. sapiens
caggcgtgagctaccg

SEQ ID NO: 68087 - DNA, 16 bp, H. sapiens
caggcgtgagctactg

SEQ ID NO: 68088 - DNA, 16 bp, H. sapiens
caggcgtgaggcaccg

SEQ ID NO: 68089 - DNA, 16 bp, H. sapiens
caggcgtgaggcactg

SEQ ID NO: 68090 - DNA, 16 bp, H. sapiens
caggcgtgagtcacag

SEQ ID NO: 68091 - DNA, 16 bp, H. sapiens
caggcgtgagtcacca

SEQ ID NO: 68092 - DNA, 16 bp, H. sapiens
caggcgtgagtcaccg

SEQ ID NO: 68093 - DNA, 16 bp, H. sapiens
caggcgtgagtgacca

SEQ ID NO: 68094 - DNA, 16 bp, H. sapiens
caggcgtgcaccactg

SEQ ID NO: 68095 - DNA, 16 bp, H. sapiens
caggcgtgctggcagg

SEQ ID NO: 68096 - DNA, 16 bp, H. sapiens
caggcgtggtggcatg

SEQ ID NO: 68097 - DNA, 16 bp, H. sapiens
caggcgtgtgccactg

SEQ ID NO: 68098 - DNA, 16 bp, H. sapiens
caggcgttagccactg

SEQ ID NO: 68099 - DNA, 17 bp, H. sapiens
caggctatactagccaa

SEQ ID NO: 68100 - DNA, 16 bp, H. sapiens
caggctcaacactatg

SEQ ID NO: 68101 - DNA, 16 bp, H. sapiens
caggctcaagccactg

SEQ ID NO: 68102 - DNA, 16 bp, H. sapiens
caggctcaagggattc

SEQ ID NO: 68103 - DNA, 16 bp, H. sapiens
caggctcaataccaca

SEQ ID NO: 68104 - DNA, 16 bp, H. sapiens
caggctcacagctgga

SEQ ID NO: 68105 - DNA, 16 bp, H. sapiens
caggctcagaaaagac

SEQ ID NO: 68106 - DNA, 16 bp, H. sapiens
caggctcagagaggtg

SEQ ID NO: 68107 - DNA, 16 bp, H. sapiens
caggctcaggagatcc

SEQ ID NO: 68108 - DNA, 16 bp, H. sapiens
caggctcaggctcagg

SEQ ID NO: 68109 - DNA, 16 bp, H. sapiens
caggctcataggcaga

SEQ ID NO: 68110 - DNA, 16 bp, H. sapiens
caggctccagaagcag

SEQ ID NO: 68111 - DNA, 16 bp, H. sapiens
caggctccagagccca

SEQ ID NO: 68112 - DNA, 16 bp, H. sapiens
caggctccagcctcca

SEQ ID NO: 68113 - DNA, 16 bp, H. sapiens
caggctccaggcccac

SEQ ID NO: 68114 - DNA, 16 bp, H. sapiens
caggctccgcccccgg

SEQ ID NO: 68115 - DNA, 16 bp, H. sapiens
caggctcctcctccaa

SEQ ID NO: 68116 - DNA, 16 bp, H. sapiens
caggctcctgagcagc

SEQ ID NO: 68117 - DNA, 16 bp, H. sapiens
caggctcctgggctca

SEQ ID NO: 68118 - DNA, 16 bp, H. sapiens
caggctctgaaactga

SEQ ID NO: 68119 - DNA, 16 bp, H. sapiens
caggctctgcctcctg

SEQ ID NO: 68120 - DNA, 16 bp, H. sapiens
caggctctgcttccag

SEQ ID NO: 68121 - DNA, 16 bp, H. sapiens
caggctctggctctgt

SEQ ID NO: 68122 - DNA, 16 bp, H. sapiens
caggctgaatttggcc

SEQ ID NO: 68123 - DNA, 16 bp, H. sapiens
caggctgacatgcagt

SEQ ID NO: 68124 - DNA, 16 bp, H. sapiens
caggctgagcacagtg

SEQ ID NO: 68125 - DNA, 16 bp, H. sapiens
caggctgagctggctg

SEQ ID NO: 68126 - DNA, 16 bp, H. sapiens
caggctgaggcaagag

SEQ ID NO: 68127 - DNA, 16 bp, H. sapiens
caggctgaggccagag

SEQ ID NO: 68128 - DNA, 16 bp, H. sapiens
caggctgaggccaggc

SEQ ID NO: 68129 - DNA, 16 bp, H. sapiens
caggctgagggctcag

SEQ ID NO: 68130 - DNA, 16 bp, H. sapiens
caggctgaggggctcc

SEQ ID NO: 68131 - DNA, 16 bp, H. sapiens
caggctgaggtgggag

SEQ ID NO: 68132 - DNA, 16 bp, H. sapiens
caggctgatcttgaat

SEQ ID NO: 68133 - DNA, 16 bp, H. sapiens
caggctgatgctggct

SEQ ID NO: 68134 - DNA, 16 bp, H. sapiens
caggctgatggagcag

SEQ ID NO: 68135 - DNA, 16 bp, H. sapiens
caggctgcacagctca

SEQ ID NO: 68136 - DNA, 16 bp, H. sapiens
caggctgcagtgccat

SEQ ID NO: 68137 - DNA, 16 bp, H. sapiens
caggctgctacaacaa

SEQ ID NO: 68138 - DNA, 16 bp, H. sapiens
caggctgctcccagcc

SEQ ID NO: 68139 - DNA, 16 bp, H. sapiens
caggctgctgctgctg

SEQ ID NO: 68140 - DNA, 16 bp, H. sapiens
caggctgctgcttcag

SEQ ID NO: 68141 - DNA, 16 bp, H. sapiens
caggctgctggagcca

SEQ ID NO: 68142 - DNA, 16 bp, H. sapiens
caggctgctgtgagga

SEQ ID NO: 68143 - DNA, 16 bp, H. sapiens
caggctggaatccagt

SEQ ID NO: 68144 - DNA, 16 bp, H. sapiens
caggctggaatgcagc

SEQ ID NO: 68145 - DNA, 16 bp, H. sapiens
caggctggaatgtaat

SEQ ID NO: 68146 - DNA, 16 bp, H. sapiens
caggctggaatgtagt

SEQ ID NO: 68147 - DNA, 16 bp, H. sapiens
caggctggagactgcc

SEQ ID NO: 68148 - DNA, 16 bp, H. sapiens
caggctggagcagtgg

SEQ ID NO: 68149 - DNA, 16 bp, H. sapiens
caggctggagccacca

SEQ ID NO: 68150 - DNA, 16 bp, H. sapiens
caggctggagcgtggt

SEQ ID NO: 68151 - DNA, 16 bp, H. sapiens
caggctggagctcaat

SEQ ID NO: 68152 - DNA, 16 bp, H. sapiens
caggctggagctgcag

SEQ ID NO: 68153 - DNA, 16 bp, H. sapiens
caggctggaggaggag

SEQ ID NO: 68154 - DNA, 16 bp, H. sapiens
caggctggaggagtgc

SEQ ID NO: 68155 - DNA, 16 bp, H. sapiens
caggctggaggccagt

SEQ ID NO: 68156 - DNA, 16 bp, H. sapiens
caggctggagggcagc

SEQ ID NO: 68157 - DNA, 16 bp, H. sapiens
caggctggagggcagg

SEQ ID NO: 68158 - DNA, 16 bp, H. sapiens
caggctggagggcatt

SEQ ID NO: 68159 - DNA, 16 bp, H. sapiens
caggctggagtataat

SEQ ID NO: 68160 - DNA, 16 bp, H. sapiens
caggctggagtcagtg

SEQ ID NO: 68161 - DNA, 16 bp, H. sapiens
caggctggagtggcag

SEQ ID NO: 68162 - DNA, 16 bp, H. sapiens
caggctggagtggtgg

SEQ ID NO: 68163 - DNA, 16 bp, H. sapiens
caggctggagtgtgca

SEQ ID NO: 68164 - DNA, 16 bp, H. sapiens
caggctggagttgcaa

SEQ ID NO: 68165 - DNA, 16 bp, H. sapiens
caggctggagttggag

SEQ ID NO: 68166 - DNA, 16 bp, H. sapiens
caggctggcctcaagc

SEQ ID NO: 68167 - DNA, 16 bp, H. sapiens
caggctggcctgcagt

SEQ ID NO: 68168 - DNA, 16 bp, H. sapiens
caggctgggaggggag

SEQ ID NO: 68169 - DNA, 16 bp, H. sapiens
caggctgggattcctt

SEQ ID NO: 68170 - DNA, 16 bp, H. sapiens
caggctgggcagggtg

SEQ ID NO: 68171 - DNA, 16 bp, H. sapiens
caggctgggcccagtg

SEQ ID NO: 68172 - DNA, 16 bp, H. sapiens
caggctgggcctggtg

SEQ ID NO: 68173 - DNA, 19 bp, H. sapiens
caggctgggcgcagtggct

SEQ ID NO: 68174 - DNA, 16 bp, H. sapiens
caggctgggctcagct

SEQ ID NO: 68175 - DNA, 16 bp, H. sapiens
caggctgggctgggca

SEQ ID NO: 68176 - DNA, 16 bp, H. sapiens
caggctgggcttggtg

SEQ ID NO: 68177 - DNA, 16 bp, H. sapiens
caggctggggaacaga

SEQ ID NO: 68178 - DNA, 16 bp, H. sapiens
caggctggggatggag

SEQ ID NO: 68179 - DNA, 16 bp, H. sapiens
caggctggggccccag

SEQ ID NO: 68180 - DNA, 16 bp, H. sapiens
caggctgggggtgcag

SEQ ID NO: 68181 - DNA, 16 bp, H. sapiens
caggctggggttgggg

SEQ ID NO: 68182 - DNA, 16 bp, H. sapiens
caggctggtcaccaac

SEQ ID NO: 68183 - DNA, 16 bp, H. sapiens
caggctggtcccagac

SEQ ID NO: 68184 - DNA, 16 bp, H. sapiens
caggctggtcctgaac

SEQ ID NO: 68185 - DNA, 17 bp, H. sapiens
caggctggtcgcgaact

SEQ ID NO: 68186 - DNA, 16 bp, H. sapiens
caggctggtcgtaaac

SEQ ID NO: 68187 - DNA, 18 bp, H. sapiens
caggctggtctcgaaccc

SEQ ID NO: 68188 - DNA, 22 bp, H. sapiens
caggctggtctcgaattcctga

SEQ ID NO: 68189 - DNA, 16 bp, H. sapiens
caggctggtctcgcac

SEQ ID NO: 68190 - DNA, 16 bp, H. sapiens
caggctggtctcggaa

SEQ ID NO: 68191 - DNA, 16 bp, H. sapiens
caggctggtctctaat

SEQ ID NO: 68192 - DNA, 16 bp, H. sapiens
caggctggtggtgaac

SEQ ID NO: 68193 - DNA, 16 bp, H. sapiens
caggctgtaaagaaag

SEQ ID NO: 68194 - DNA, 16 bp, H. sapiens
caggctgtagaggaag

SEQ ID NO: 68195 - DNA, 16 bp, H. sapiens
caggctgtcataacaa

SEQ ID NO: 68196 - DNA, 16 bp, H. sapiens
caggctgtcccccgcc

SEQ ID NO: 68197 - DNA, 16 bp, H. sapiens
caggctgtccttgaac

SEQ ID NO: 68198 - DNA, 16 bp, H. sapiens
caggctgtgcaggaag

SEQ ID NO: 68199 - DNA, 16 bp, H. sapiens
caggctgtggggctct

SEQ ID NO: 68200 - DNA, 16 bp, H. sapiens
caggctgtggggctgg

SEQ ID NO: 68201 - DNA, 16 bp, H. sapiens
caggctgtttgtgcca

SEQ ID NO: 68202 - DNA, 16 bp, H. sapiens
caggcttaagggatcc

SEQ ID NO: 68203 - DNA, 16 bp, H. sapiens
caggcttcacctccaa

SEQ ID NO: 68204 - DNA, 16 bp, H. sapiens
caggcttcaggctgtc

SEQ ID NO: 68205 - DNA, 16 bp, H. sapiens
caggcttcagtttcct

SEQ ID NO: 68206 - DNA, 16 bp, H. sapiens
caggcttgagccacca

SEQ ID NO: 68207 - DNA, 16 bp, H. sapiens
caggcttgagccaccg

SEQ ID NO: 68208 - DNA, 16 bp, H. sapiens
caggcttgagccacta

SEQ ID NO: 68209 - DNA, 16 bp, H. sapiens
caggcttgagccactg

SEQ ID NO: 68210 - DNA, 16 bp, H. sapiens
caggcttgagggtggg

SEQ ID NO: 68211 - DNA, 16 bp, H. sapiens
caggcttggcctccca

SEQ ID NO: 68212 - DNA, 16 bp, H. sapiens
caggcttggtggctca

SEQ ID NO: 68213 - DNA, 16 bp, H. sapiens
caggctttccttgttt

SEQ ID NO: 68214 - DNA, 16 bp, H. sapiens
caggctttgcaggcca

SEQ ID NO: 68215 - DNA, 16 bp, H. sapiens
caggctttgggatcag

SEQ ID NO: 68216 - DNA, 16 bp, H. sapiens
cagggaaaaactgaaa

SEQ ID NO: 68217 - DNA, 16 bp, H. sapiens
cagggaaagggtggga

SEQ ID NO: 68218 - DNA, 16 bp, H. sapiens
cagggaaatacaaatt

SEQ ID NO: 68219 - DNA, 16 bp, H. sapiens
cagggaaatgaagaaa

SEQ ID NO: 68220 - DNA, 16 bp, H. sapiens
cagggaaatggatgga

SEQ ID NO: 68221 - DNA, 16 bp, H. sapiens
cagggaaatggattct

SEQ ID NO: 68222 - DNA, 16 bp, H. sapiens
cagggaaccaagtggt

SEQ ID NO: 68223 - DNA, 16 bp, H. sapiens
cagggaactttttttt

SEQ ID NO: 68224 - DNA, 16 bp, H. sapiens
cagggaagagatgatg

SEQ ID NO: 68225 - DNA, 16 bp, H. sapiens
cagggaagccattcct

SEQ ID NO: 68226 - DNA, 16 bp, H. sapiens
cagggaagccatttct

SEQ ID NO: 68227 - DNA, 16 bp, H. sapiens
cagggaagcccaggag

SEQ ID NO: 68228 - DNA, 16 bp, H. sapiens
cagggaagccccaccc

SEQ ID NO: 68229 - DNA, 16 bp, H. sapiens
cagggaaggagcctgg

SEQ ID NO: 68230 - DNA, 16 bp, H. sapiens
cagggaaggcaggcag

SEQ ID NO: 68231 - DNA, 16 bp, H. sapiens
cagggaaggctgggag

SEQ ID NO: 68232 - DNA, 16 bp, H. sapiens
cagggaagggaagcag

SEQ ID NO: 68233 - DNA, 16 bp, H. sapiens
cagggaagggtcaggg

SEQ ID NO: 68234 - DNA, 16 bp, H. sapiens
cagggaagtggaggtt

SEQ ID NO: 68235 - DNA, 16 bp, H. sapiens
cagggacaaggatgaa

SEQ ID NO: 68236 - DNA, 16 bp, H. sapiens
cagggacagaaagaca

SEQ ID NO: 68237 - DNA, 16 bp, H. sapiens
cagggacagacagaca

SEQ ID NO: 68238 - DNA, 16 bp, H. sapiens
cagggacagagccctc

SEQ ID NO: 68239 - DNA, 16 bp, H. sapiens
cagggacagctcctgc

SEQ ID NO: 68240 - DNA, 16 bp, H. sapiens
cagggacaggactcca

SEQ ID NO: 68241 - DNA, 16 bp, H. sapiens
cagggacagggatgga

SEQ ID NO: 68242 - DNA, 16 bp, H. sapiens
cagggacagtggctca

SEQ ID NO: 68243 - DNA, 16 bp, H. sapiens
cagggacatgccacca

SEQ ID NO: 68244 - DNA, 16 bp, H. sapiens
cagggacatggatgaa

SEQ ID NO: 68245 - DNA, 16 bp, H. sapiens
cagggaccagggaagg

SEQ ID NO: 68246 - DNA, 16 bp, H. sapiens
cagggaccatctgtac

SEQ ID NO: 68247 - DNA, 16 bp, H. sapiens
cagggacccactggac

SEQ ID NO: 68248 - DNA, 16 bp, H. sapiens
cagggacccaggctcc

SEQ ID NO: 68249 - DNA, 16 bp, H. sapiens
cagggacccaggctga

SEQ ID NO: 68250 - DNA, 16 bp, H. sapiens
cagggacctgcccctg

SEQ ID NO: 68251 - DNA, 16 bp, H. sapiens
cagggactgatttcat

SEQ ID NO: 68252 - DNA, 16 bp, H. sapiens
cagggactttgttttg

SEQ ID NO: 68253 - DNA, 16 bp, H. sapiens
cagggagaagatggca

SEQ ID NO: 68254 - DNA, 16 bp, H. sapiens
cagggagaaggaaacc

SEQ ID NO: 68255 - DNA, 16 bp, H. sapiens
cagggagaaggcagcc

SEQ ID NO: 68256 - DNA, 16 bp, H. sapiens
cagggagacagagtga

SEQ ID NO: 68257 - DNA, 16 bp, H. sapiens
cagggagaccccatct

SEQ ID NO: 68258 - DNA, 16 bp, H. sapiens
cagggagacctcatct

SEQ ID NO: 68259 - DNA, 16 bp, H. sapiens
cagggagagaatggag

SEQ ID NO: 68260 - DNA, 16 bp, H. sapiens
cagggagagactccat

SEQ ID NO: 68261 - DNA, 16 bp, H. sapiens
cagggagaggtaattg

SEQ ID NO: 68262 - DNA, 16 bp, H. sapiens
cagggagatgaagaag

SEQ ID NO: 68263 - DNA, 16 bp, H. sapiens
cagggagatggggatg

SEQ ID NO: 68264 - DNA, 16 bp, H. sapiens
cagggagcaggagcag

SEQ ID NO: 68265 - DNA, 16 bp, H. sapiens
cagggagcagggagca

SEQ ID NO: 68266 - DNA, 16 bp, H. sapiens
cagggagcagggctgg

SEQ ID NO: 68267 - DNA, 16 bp, H. sapiens
cagggagccagtgtgg

SEQ ID NO: 68268 - DNA, 16 bp, H. sapiens
cagggagccgagatcg

SEQ ID NO: 68269 - DNA, 16 bp, H. sapiens
cagggagccgagatgg

SEQ ID NO: 68270 - DNA, 16 bp, H. sapiens
cagggagcctgggctg

SEQ ID NO: 68271 - DNA, 16 bp, H. sapiens
cagggagctctggagc

SEQ ID NO: 68272 - DNA, 16 bp, H. sapiens
cagggagctgagatca

SEQ ID NO: 68273 - DNA, 16 bp, H. sapiens
cagggagctgagatcg

SEQ ID NO: 68274 - DNA, 16 bp, H. sapiens
cagggaggacttcctg

SEQ ID NO: 68275 - DNA, 16 bp, H. sapiens
cagggaggagaggctg

SEQ ID NO: 68276 - DNA, 16 bp, H. sapiens
cagggaggagcaagtc

SEQ ID NO: 68277 - DNA, 16 bp, H. sapiens
cagggaggagctgagg

SEQ ID NO: 68278 - DNA, 16 bp, H. sapiens
cagggaggagctgggg

SEQ ID NO: 68279 - DNA, 16 bp, H. sapiens
cagggaggaggcagca

SEQ ID NO: 68280 - DNA, 16 bp, H. sapiens
cagggaggaggggctg

SEQ ID NO: 68281 - DNA, 16 bp, H. sapiens
cagggaggcagagctt

SEQ ID NO: 68282 - DNA, 16 bp, H. sapiens
cagggaggcagaggct

SEQ ID NO: 68283 - DNA, 16 bp, H. sapiens
cagggaggcagcagag

SEQ ID NO: 68284 - DNA, 16 bp, H. sapiens
cagggaggcaggtggg

SEQ ID NO: 68285 - DNA, 16 bp, H. sapiens
cagggaggccaggcag

SEQ ID NO: 68286 - DNA, 16 bp, H. sapiens
cagggaggccagggag

SEQ ID NO: 68287 - DNA, 16 bp, H. sapiens
cagggaggctgaagtg

SEQ ID NO: 68288 - DNA, 16 bp, H. sapiens
cagggaggctgcagag

SEQ ID NO: 68289 - DNA, 16 bp, H. sapiens
cagggaggctggctgg

SEQ ID NO: 68290 - DNA, 16 bp, H. sapiens
cagggagggagccagg

SEQ ID NO: 68291 - DNA, 16 bp, H. sapiens
cagggagggagcttcc

SEQ ID NO: 68292 - DNA, 16 bp, H. sapiens
cagggagggaggcagc

SEQ ID NO: 68293 - DNA, 16 bp, H. sapiens
cagggagggaggggct

SEQ ID NO: 68294 - DNA, 16 bp, H. sapiens
cagggaggggagcatc

SEQ ID NO: 68295 - DNA, 16 bp, H. sapiens
cagggaggggcccagg

SEQ ID NO: 68296 - DNA, 16 bp, H. sapiens
cagggaggtggctgag

SEQ ID NO: 68297 - DNA, 16 bp, H. sapiens
cagggaggtggctggg

SEQ ID NO: 68298 - DNA, 16 bp, H. sapiens
cagggaggtgggagga

SEQ ID NO: 68299 - DNA, 16 bp, H. sapiens
cagggaggtgtggaag

SEQ ID NO: 68300 - DNA, 16 bp, H. sapiens
cagggagtggggagga

SEQ ID NO: 68301 - DNA, 16 bp, H. sapiens
cagggatatttgtctg

SEQ ID NO: 68302 - DNA, 16 bp, H. sapiens
cagggatcagcaaact

SEQ ID NO: 68303 - DNA, 16 bp, H. sapiens
cagggatgcaaagatg

SEQ ID NO: 68304 - DNA, 16 bp, H. sapiens
cagggatgcaagggtg

SEQ ID NO: 68305 - DNA, 16 bp, H. sapiens
cagggatgccagtgag

SEQ ID NO: 68306 - DNA, 16 bp, H. sapiens
cagggatgcctgggtc

SEQ ID NO: 68307 - DNA, 16 bp, H. sapiens
cagggatgctgtttgg

SEQ ID NO: 68308 - DNA, 16 bp, H. sapiens
cagggatggagccctc

SEQ ID NO: 68309 - DNA, 16 bp, H. sapiens
cagggatggcagaggc

SEQ ID NO: 68310 - DNA, 16 bp, H. sapiens
cagggatggggctggg

SEQ ID NO: 68311 - DNA, 16 bp, H. sapiens
cagggatgtgccacca

SEQ ID NO: 68312 - DNA, 16 bp, H. sapiens
cagggattcaaaccca

SEQ ID NO: 68313 - DNA, 16 bp, H. sapiens
cagggattctctggag

SEQ ID NO: 68314 - DNA, 17 bp, H. sapiens
cagggattgttcaggcc

SEQ ID NO: 68315 - DNA, 16 bp, H. sapiens
cagggatttttctttt

SEQ ID NO: 68316 - DNA, 17 bp, H. sapiens
cagggattttttttttc

SEQ ID NO: 68317 - DNA, 16 bp, H. sapiens
cagggcacaggcaggg

SEQ ID NO: 68318 - DNA, 16 bp, H. sapiens
cagggcacagggctgg

SEQ ID NO: 68319 - DNA, 16 bp, H. sapiens
cagggcactgaagaag

SEQ ID NO: 68320 - DNA, 16 bp, H. sapiens
cagggcagagcctggg

SEQ ID NO: 68321 - DNA, 16 bp, H. sapiens
cagggcagagctgccc

SEQ ID NO: 68322 - DNA, 16 bp, H. sapiens
cagggcagaggagggc

SEQ ID NO: 68323 - DNA, 16 bp, H. sapiens
cagggcagagggcagg

SEQ ID NO: 68324 - DNA, 16 bp, H. sapiens
cagggcagccagagag

SEQ ID NO: 68325 - DNA, 16 bp, H. sapiens
cagggcagcccccacc

SEQ ID NO: 68326 - DNA, 16 bp, H. sapiens
cagggcagccgggcag

SEQ ID NO: 68327 - DNA, 16 bp, H. sapiens
cagggcaggcagctcc

SEQ ID NO: 68328 - DNA, 16 bp, H. sapiens
cagggcaggcctggtg

SEQ ID NO: 68329 - DNA, 16 bp, H. sapiens
cagggcaggcttcctg

SEQ ID NO: 68330 - DNA, 16 bp, H. sapiens
cagggcagggacaggg

SEQ ID NO: 68331 - DNA, 16 bp, H. sapiens
cagggcagggagcagg

SEQ ID NO: 68332 - DNA, 16 bp, H. sapiens
cagggcagggagctgg

SEQ ID NO: 68333 - DNA, 16 bp, H. sapiens
cagggcagggcaaggc

SEQ ID NO: 68334 - DNA, 16 bp, H. sapiens
cagggcagggcagtgg

SEQ ID NO: 68335 - DNA, 16 bp, H. sapiens
cagggcagggccaggg

SEQ ID NO: 68336 - DNA, 16 bp, H. sapiens
cagggcagggcctggg

SEQ ID NO: 68337 - DNA, 16 bp, H. sapiens
cagggcagggctgggg

SEQ ID NO: 68338 - DNA, 16 bp, H. sapiens
cagggcagggcttggg

SEQ ID NO: 68339 - DNA, 16 bp, H. sapiens
cagggcaggggcctgg

SEQ ID NO: 68340 - DNA, 16 bp, H. sapiens
cagggcaggggctggg

SEQ ID NO: 68341 - DNA, 16 bp, H. sapiens
cagggcaggtccaggg

SEQ ID NO: 68342 - DNA, 16 bp, H. sapiens
cagggcaggtgagccc

SEQ ID NO: 68343 - DNA, 16 bp, H. sapiens
cagggcagtggggccc

SEQ ID NO: 68344 - DNA, 16 bp, H. sapiens
cagggcatggtggtgc

SEQ ID NO: 68345 - DNA, 16 bp, H. sapiens
cagggccaaggccagg

SEQ ID NO: 68346 - DNA, 16 bp, H. sapiens
cagggccagactccat

SEQ ID NO: 68347 - DNA, 16 bp, H. sapiens
cagggccagcagggcc

SEQ ID NO: 68348 - DNA, 16 bp, H. sapiens
cagggccaggccagcc

SEQ ID NO: 68349 - DNA, 16 bp, H. sapiens
cagggccaggccaggg

SEQ ID NO: 68350 - DNA, 16 bp, H. sapiens
cagggccaggcctggg

SEQ ID NO: 68351 - DNA, 16 bp, H. sapiens
cagggccagggcaggg

SEQ ID NO: 68352 - DNA, 16 bp, H. sapiens
cagggccagggccaag

SEQ ID NO: 68353 - DNA, 16 bp, H. sapiens
cagggccagggccaga

SEQ ID NO: 68354 - DNA, 16 bp, H. sapiens
cagggccagggccagg

SEQ ID NO: 68355 - DNA, 16 bp, H. sapiens
cagggccagggcctgg

SEQ ID NO: 68356 - DNA, 16 bp, H. sapiens
cagggccaggtagaaa

SEQ ID NO: 68357 - DNA, 16 bp, H. sapiens
cagggccagtgagggc

SEQ ID NO: 68358 - DNA, 16 bp, H. sapiens
cagggccatacaacta

SEQ ID NO: 68359 - DNA, 16 bp, H. sapiens
cagggcccaaggactc

SEQ ID NO: 68360 - DNA, 16 bp, H. sapiens
cagggcccagcacagg

SEQ ID NO: 68361 - DNA, 16 bp, H. sapiens
cagggcccagcaccca

SEQ ID NO: 68362 - DNA, 16 bp, H. sapiens
cagggcccaggcagag

SEQ ID NO: 68363 - DNA, 16 bp, H. sapiens
cagggcccaggcagga

SEQ ID NO: 68364 - DNA, 16 bp, H. sapiens
cagggcccaggccagg

SEQ ID NO: 68365 - DNA, 16 bp, H. sapiens
cagggcccaggcctgg

SEQ ID NO: 68366 - DNA, 16 bp, H. sapiens
cagggcccagtgtgtg

SEQ ID NO: 68367 - DNA, 16 bp, H. sapiens
cagggccccagcctgg

SEQ ID NO: 68368 - DNA, 16 bp, H. sapiens
cagggcccccctgctg

SEQ ID NO: 68369 - DNA, 16 bp, H. sapiens
cagggcccctgcctgg

SEQ ID NO: 68370 - DNA, 16 bp, H. sapiens
cagggccctgctgcct

SEQ ID NO: 68371 - DNA, 16 bp, H. sapiens
cagggccctggtgggg

SEQ ID NO: 68372 - DNA, 16 bp, H. sapiens
cagggccctggtggtg

SEQ ID NO: 68373 - DNA, 16 bp, H. sapiens
cagggcctagaacagt

SEQ ID NO: 68374 - DNA, 16 bp, H. sapiens
cagggcctcagtttcc

SEQ ID NO: 68375 - DNA, 16 bp, H. sapiens
cagggcctggaggagg

SEQ ID NO: 68376 - DNA, 16 bp, H. sapiens
cagggcctggagtgga

SEQ ID NO: 68377 - DNA, 16 bp, H. sapiens
cagggcctggcacaga

SEQ ID NO: 68378 - DNA, 16 bp, H. sapiens
cagggcctggcaccca

SEQ ID NO: 68379 - DNA, 16 bp, H. sapiens
cagggcctggctctgt

SEQ ID NO: 68380 - DNA, 16 bp, H. sapiens
cagggcctgggccagg

SEQ ID NO: 68381 - DNA, 16 bp, H. sapiens
cagggcctggggagag

SEQ ID NO: 68382 - DNA, 16 bp, H. sapiens
cagggcctggggctgg

SEQ ID NO: 68383 - DNA, 16 bp, H. sapiens
cagggcctggtgtgtg

SEQ ID NO: 68384 - DNA, 16 bp, H. sapiens
cagggcctgtctgggg

SEQ ID NO: 68385 - DNA, 16 bp, H. sapiens
cagggcctgttttggg

SEQ ID NO: 68386 - DNA, 17 bp, H. sapiens
cagggccttgctctgtc

SEQ ID NO: 68387 - DNA, 16 bp, H. sapiens
cagggcctttgccctt

SEQ ID NO: 68388 - DNA, 16 bp, H. sapiens
cagggcctttgggaag

SEQ ID NO: 68389 - DNA, 16 bp, H. sapiens
cagggcggccaggcag

SEQ ID NO: 68390 - DNA, 16 bp, H. sapiens
cagggcggctggctgg

SEQ ID NO: 68391 - DNA, 16 bp, H. sapiens
cagggcggctgggcag

SEQ ID NO: 68392 - DNA, 16 bp, H. sapiens
cagggcgtggtggcac

SEQ ID NO: 68393 - DNA, 16 bp, H. sapiens
cagggctagggccagg

SEQ ID NO: 68394 - DNA, 16 bp, H. sapiens
cagggctcagagctgg

SEQ ID NO: 68395 - DNA, 16 bp, H. sapiens
cagggctcagctccca

SEQ ID NO: 68396 - DNA, 16 bp, H. sapiens
cagggctccagggctc

SEQ ID NO: 68397 - DNA, 16 bp, H. sapiens
cagggctccctgcagc

SEQ ID NO: 68398 - DNA, 16 bp, H. sapiens
cagggctcctgcctgc

SEQ ID NO: 68399 - DNA, 16 bp, H. sapiens
cagggctgagggaggg

SEQ ID NO: 68400 - DNA, 16 bp, H. sapiens
cagggctgcatgctcc

SEQ ID NO: 68401 - DNA, 16 bp, H. sapiens
cagggctgcatttctt

SEQ ID NO: 68402 - DNA, 16 bp, H. sapiens
cagggctgcccaaggc

SEQ ID NO: 68403 - DNA, 16 bp, H. sapiens
cagggctgcctcctct

SEQ ID NO: 68404 - DNA, 16 bp, H. sapiens
cagggctgctgtgaga

SEQ ID NO: 68405 - DNA, 16 bp, H. sapiens
cagggctggagcaggg

SEQ ID NO: 68406 - DNA, 16 bp, H. sapiens
cagggctggaggcagg

SEQ ID NO: 68407 - DNA, 16 bp, H. sapiens
cagggctggagggagg

SEQ ID NO: 68408 - DNA, 16 bp, H. sapiens
cagggctggaggtggg

SEQ ID NO: 68409 - DNA, 16 bp, H. sapiens
cagggctggccagggc

SEQ ID NO: 68410 - DNA, 16 bp, H. sapiens
cagggctggctggctg

SEQ ID NO: 68411 - DNA, 16 bp, H. sapiens
cagggctgggacaggg

SEQ ID NO: 68412 - DNA, 16 bp, H. sapiens
cagggctgggaccagg

SEQ ID NO: 68413 - DNA, 16 bp, H. sapiens
cagggctgggactggg

SEQ ID NO: 68414 - DNA, 16 bp, H. sapiens
cagggctgggagaggg

SEQ ID NO: 68415 - DNA, 16 bp, H. sapiens
cagggctgggaggcag

SEQ ID NO: 68416 - DNA, 16 bp, H. sapiens
cagggctgggcagggc

SEQ ID NO: 68417 - DNA, 16 bp, H. sapiens
cagggctgggcagtgg

SEQ ID NO: 68418 - DNA, 16 bp, H. sapiens
cagggctgggcctggg

SEQ ID NO: 68419 - DNA, 16 bp, H. sapiens
cagggctgggctgagg

SEQ ID NO: 68420 - DNA, 16 bp, H. sapiens
cagggctgggctggcc

SEQ ID NO: 68421 - DNA, 16 bp, H. sapiens
cagggctgggctgggc

SEQ ID NO: 68422 - DNA, 16 bp, H. sapiens
cagggctgggctggtt

SEQ ID NO: 68423 - DNA, 16 bp, H. sapiens
cagggctggggaaggg

SEQ ID NO: 68424 - DNA, 16 bp, H. sapiens
cagggctggggcaagg

SEQ ID NO: 68425 - DNA, 16 bp, H. sapiens
cagggctggggcaggg

SEQ ID NO: 68426 - DNA, 16 bp, H. sapiens
cagggctggggccagg

SEQ ID NO: 68427 - DNA, 16 bp, H. sapiens
cagggctggggctgcc

SEQ ID NO: 68428 - DNA, 16 bp, H. sapiens
cagggctggggctggg

SEQ ID NO: 68429 - DNA, 16 bp, H. sapiens
cagggctgggggcagg

SEQ ID NO: 68430 - DNA, 16 bp, H. sapiens
cagggctgggggctgg

SEQ ID NO: 68431 - DNA, 16 bp, H. sapiens
cagggctgtgactccc

SEQ ID NO: 68432 - DNA, 16 bp, H. sapiens
cagggctgtgctctct

SEQ ID NO: 68433 - DNA, 16 bp, H. sapiens
cagggctgtgcttcct

SEQ ID NO: 68434 - DNA, 16 bp, H. sapiens
cagggctgtggcctgg

SEQ ID NO: 68435 - DNA, 16 bp, H. sapiens
cagggctgtggtctca

SEQ ID NO: 68436 - DNA, 16 bp, H. sapiens
cagggctgtgttcctt

SEQ ID NO: 68437 - DNA, 16 bp, H. sapiens
cagggcttcaccatat

SEQ ID NO: 68438 - DNA, 16 bp, H. sapiens
cagggctttcaggttt

SEQ ID NO: 68439 - DNA, 16 bp, H. sapiens
cagggctttgggaggc

SEQ ID NO: 68440 - DNA, 16 bp, H. sapiens
caggggaagaccacct

SEQ ID NO: 68441 - DNA, 16 bp, H. sapiens
caggggaaggaaataa

SEQ ID NO: 68442 - DNA, 16 bp, H. sapiens
caggggagacagagca

SEQ ID NO: 68443 - DNA, 16 bp, H. sapiens
caggggagcccccacc

SEQ ID NO: 68444 - DNA, 16 bp, H. sapiens
caggggaggcctcagg

SEQ ID NO: 68445 - DNA, 16 bp, H. sapiens
caggggaggctgggag

SEQ ID NO: 68446 - DNA, 16 bp, H. sapiens
caggggagggaggctg

SEQ ID NO: 68447 - DNA, 16 bp, H. sapiens
caggggatgggagagg

SEQ ID NO: 68448 - DNA, 16 bp, H. sapiens
caggggattggttcca

SEQ ID NO: 68449 - DNA, 16 bp, H. sapiens
caggggattttttttt

SEQ ID NO: 68450 - DNA, 16 bp, H. sapiens
caggggcaaagccctc

SEQ ID NO: 68451 - DNA, 16 bp, H. sapiens
caggggcaagcaggag

SEQ ID NO: 68452 - DNA, 16 bp, H. sapiens
caggggcagagctctc

SEQ ID NO: 68453 - DNA, 16 bp, H. sapiens
caggggcagaggcagg

SEQ ID NO: 68454 - DNA, 16 bp, H. sapiens
caggggcagcagcagt

SEQ ID NO: 68455 - DNA, 16 bp, H. sapiens
caggggcaggaggcag

SEQ ID NO: 68456 - DNA, 16 bp, H. sapiens
caggggcaggcaggag

SEQ ID NO: 68457 - DNA, 16 bp, H. sapiens
caggggcagggccctc

SEQ ID NO: 68458 - DNA, 16 bp, H. sapiens
caggggccaggccagg

SEQ ID NO: 68459 - DNA, 16 bp, H. sapiens
caggggccaggctggg

SEQ ID NO: 68460 - DNA, 16 bp, H. sapiens
caggggccagggctgg

SEQ ID NO: 68461 - DNA, 16 bp, H. sapiens
caggggccaggggcca

SEQ ID NO: 68462 - DNA, 16 bp, H. sapiens
caggggccaggtgtgg

SEQ ID NO: 68463 - DNA, 16 bp, H. sapiens
caggggcctgggcagg

SEQ ID NO: 68464 - DNA, 16 bp, H. sapiens
caggggctgaagtgaa

SEQ ID NO: 68465 - DNA, 16 bp, H. sapiens
caggggctgaggcagg

SEQ ID NO: 68466 - DNA, 16 bp, H. sapiens
caggggctgcaggagg

SEQ ID NO: 68467 - DNA, 16 bp, H. sapiens
caggggctgcagggag

SEQ ID NO: 68468 - DNA, 16 bp, H. sapiens
caggggctgccctggg

SEQ ID NO: 68469 - DNA, 16 bp, H. sapiens
caggggctgcctgcgg

SEQ ID NO: 68470 - DNA, 16 bp, H. sapiens
caggggctgctgggaa

SEQ ID NO: 68471 - DNA, 16 bp, H. sapiens
caggggctggagagag

SEQ ID NO: 68472 - DNA, 16 bp, H. sapiens
caggggctggagagga

SEQ ID NO: 68473 - DNA, 16 bp, H. sapiens
caggggctggaggaag

SEQ ID NO: 68474 - DNA, 16 bp, H. sapiens
caggggctggaggagg

SEQ ID NO: 68475 - DNA, 16 bp, H. sapiens
caggggctggaggatg

SEQ ID NO: 68476 - DNA, 16 bp, H. sapiens
caggggctggagggag

SEQ ID NO: 68477 - DNA, 16 bp, H. sapiens
caggggctggaggtgg

SEQ ID NO: 68478 - DNA, 16 bp, H. sapiens
caggggctggcaggag

SEQ ID NO: 68479 - DNA, 16 bp, H. sapiens
caggggctgggaggag

SEQ ID NO: 68480 - DNA, 16 bp, H. sapiens
caggggctgggagtgg

SEQ ID NO: 68481 - DNA, 16 bp, H. sapiens
caggggctgggcaggg

SEQ ID NO: 68482 - DNA, 16 bp, H. sapiens
caggggctgggccagg

SEQ ID NO: 68483 - DNA, 16 bp, H. sapiens
caggggctgggcctgg

SEQ ID NO: 68484 - DNA, 16 bp, H. sapiens
caggggctggggagtg

SEQ ID NO: 68485 - DNA, 16 bp, H. sapiens
caggggctggggatgg

SEQ ID NO: 68486 - DNA, 16 bp, H. sapiens
caggggctgggggaga

SEQ ID NO: 68487 - DNA, 16 bp, H. sapiens
caggggctgggggatg

SEQ ID NO: 68488 - DNA, 16 bp, H. sapiens
caggggctggtggagg

SEQ ID NO: 68489 - DNA, 16 bp, H. sapiens
caggggctgtgggagg

SEQ ID NO: 68490 - DNA, 16 bp, H. sapiens
cagggggagctgcagg

SEQ ID NO: 68491 - DNA, 16 bp, H. sapiens
cagggggaggttgcag

SEQ ID NO: 68492 - DNA, 16 bp, H. sapiens
cagggggctgaggcac

SEQ ID NO: 68493 - DNA, 16 bp, H. sapiens
cagggggctgaggctg

SEQ ID NO: 68494 - DNA, 16 bp, H. sapiens
cagggggtggggagct

SEQ ID NO: 68495 - DNA, 16 bp, H. sapiens
caggggtacaggcacc

SEQ ID NO: 68496 - DNA, 16 bp, H. sapiens
caggggtatatcaact

SEQ ID NO: 68497 - DNA, 16 bp, H. sapiens
caggggtcagcaaact

SEQ ID NO: 68498 - DNA, 16 bp, H. sapiens
caggggtcagcaaatt

SEQ ID NO: 68499 - DNA, 16 bp, H. sapiens
caggggtcaggcaccc

SEQ ID NO: 68500 - DNA, 16 bp, H. sapiens
caggggtccaggcccc

SEQ ID NO: 68501 - DNA, 16 bp, H. sapiens
caggggtccccaaccc

SEQ ID NO: 68502 - DNA, 16 bp, H. sapiens
caggggtgagccaccg

SEQ ID NO: 68503 - DNA, 16 bp, H. sapiens
caggggtgagccactg

SEQ ID NO: 68504 - DNA, 16 bp, H. sapiens
caggggtggcagaggc

SEQ ID NO: 68505 - DNA, 16 bp, H. sapiens
caggggttagcaaact

SEQ ID NO: 68506 - DNA, 16 bp, H. sapiens
caggggttggcaaact

SEQ ID NO: 68507 - DNA, 16 bp, H. sapiens
caggggtttcaccata

SEQ ID NO: 68508 - DNA, 16 bp, H. sapiens
cagggtaacaatggga

SEQ ID NO: 68509 - DNA, 16 bp, H. sapiens
cagggtaatttatgaa

SEQ ID NO: 68510 - DNA, 16 bp, H. sapiens
cagggtacagcccatt

SEQ ID NO: 68511 - DNA, 16 bp, H. sapiens
cagggtacagctcccc

SEQ ID NO: 68512 - DNA, 16 bp, H. sapiens
cagggtacagtctccc

SEQ ID NO: 68513 - DNA, 16 bp, H. sapiens
cagggtattaattatt

SEQ ID NO: 68514 - DNA, 16 bp, H. sapiens
cagggtattgctctgt

SEQ ID NO: 68515 - DNA, 16 bp, H. sapiens
cagggtcacccaggct

SEQ ID NO: 68516 - DNA, 16 bp, H. sapiens
cagggtcaggcaaaaa

SEQ ID NO: 68517 - DNA, 16 bp, H. sapiens
cagggtcagggtcagg

SEQ ID NO: 68518 - DNA, 16 bp, H. sapiens
cagggtccagggacca

SEQ ID NO: 68519 - DNA, 16 bp, H. sapiens
cagggtccccgtgctg

SEQ ID NO: 68520 - DNA, 16 bp, H. sapiens
cagggtcctcatgctg

SEQ ID NO: 68521 - DNA, 45 bp, H. sapiens
cagggtcctctgcctaggaaaaccagagacctttgttcacttgtt

SEQ ID NO: 68522 - DNA, 16 bp, H. sapiens
cagggtctagagtgga

SEQ ID NO: 68523 - DNA, 16 bp, H. sapiens
cagggtctcaccattt

SEQ ID NO: 68524 - DNA, 16 bp, H. sapiens
cagggtctcactctat

SEQ ID NO: 68525 - DNA, 16 bp, H. sapiens
cagggtctcactctgc

SEQ ID NO: 68526 - DNA, 16 bp, H. sapiens
cagggtctcattctat

SEQ ID NO: 68527 - DNA, 16 bp, H. sapiens
cagggtctcattttgt

SEQ ID NO: 68528 - DNA, 16 bp, H. sapiens
cagggtctccatatgt

SEQ ID NO: 68529 - DNA, 16 bp, H. sapiens
cagggtctctctctgt

SEQ ID NO: 68530 - DNA, 16 bp, H. sapiens
cagggtctctgttgcc

SEQ ID NO: 68531 - DNA, 16 bp, H. sapiens
cagggtctgcagtgga

SEQ ID NO: 68532 - DNA, 16 bp, H. sapiens
cagggtctggagagga

SEQ ID NO: 68533 - DNA, 16 bp, H. sapiens
cagggtctggctgtgt

SEQ ID NO: 68534 - DNA, 16 bp, H. sapiens
cagggtcttgctctat

SEQ ID NO: 68535 - DNA, 16 bp, H. sapiens
cagggtcttgctctga

SEQ ID NO: 68536 - DNA, 16 bp, H. sapiens
cagggtcttgctctgt

SEQ ID NO: 68537 - DNA, 16 bp, H. sapiens
cagggtcttgctgtgt

SEQ ID NO: 68538 - DNA, 16 bp, H. sapiens
cagggtcttgctttct

SEQ ID NO: 68539 - DNA, 16 bp, H. sapiens
cagggtcttgtgctgt

SEQ ID NO: 68540 - DNA, 16 bp, H. sapiens
cagggtcttgttctgt

SEQ ID NO: 68541 - DNA, 16 bp, H. sapiens
cagggtcttgttttgt

SEQ ID NO: 68542 - DNA, 16 bp, H. sapiens
cagggtgacagagaga

SEQ ID NO: 68543 - DNA, 16 bp, H. sapiens
cagggtgactatagtt

SEQ ID NO: 68544 - DNA, 16 bp, H. sapiens
cagggtgagaccctgc

SEQ ID NO: 68545 - DNA, 16 bp, H. sapiens
cagggtgagccaccgc

SEQ ID NO: 68546 - DNA, 25 bp, H. sapiens
cagggtgataataaggagaaggtca

SEQ ID NO: 68547 - DNA, 16 bp, H. sapiens
cagggtgatcagacat

SEQ ID NO: 68548 - DNA, 16 bp, H. sapiens
cagggtgcagtgagct

SEQ ID NO: 68549 - DNA, 16 bp, H. sapiens
cagggtgccatgtccc

SEQ ID NO: 68550 - DNA, 16 bp, H. sapiens
cagggtggagcccacc

SEQ ID NO: 68551 - DNA, 16 bp, H. sapiens
cagggtggcaggagag

SEQ ID NO: 68552 - DNA, 16 bp, H. sapiens
cagggtgggcagaggg

SEQ ID NO: 68553 - DNA, 16 bp, H. sapiens
cagggtgggctggcag

SEQ ID NO: 68554 - DNA, 16 bp, H. sapiens
cagggtggggaacatc

SEQ ID NO: 68555 - DNA, 16 bp, H. sapiens
cagggtggggaggaga

SEQ ID NO: 68556 - DNA, 16 bp, H. sapiens
cagggtggggcaggga

SEQ ID NO: 68557 - DNA, 16 bp, H. sapiens
cagggtggggcccagg

SEQ ID NO: 68558 - DNA, 16 bp, H. sapiens
cagggtgggtgacaga

SEQ ID NO: 68559 - DNA, 16 bp, H. sapiens
cagggtggtggccggg

SEQ ID NO: 68560 - DNA, 16 bp, H. sapiens
cagggtggtgtgcacc

SEQ ID NO: 68561 - DNA, 16 bp, H. sapiens
cagggtgtccctctgt

SEQ ID NO: 68562 - DNA, 16 bp, H. sapiens
cagggtgtgcaggttt

SEQ ID NO: 68563 - DNA, 16 bp, H. sapiens
cagggtgtggtggtac

SEQ ID NO: 68564 - DNA, 16 bp, H. sapiens
cagggtgtggtggtgg

SEQ ID NO: 68565 - DNA, 16 bp, H. sapiens
cagggttcaagcaatt

SEQ ID NO: 68566 - DNA, 16 bp, H. sapiens
cagggttcaagcgatt

SEQ ID NO: 68567 - DNA, 16 bp, H. sapiens
cagggttccactatgt

SEQ ID NO: 68568 - DNA, 16 bp, H. sapiens
cagggttccccagaga

SEQ ID NO: 68569 - DNA, 16 bp, H. sapiens
cagggttgaaaccaga

SEQ ID NO: 68570 - DNA, 16 bp, H. sapiens
cagggttggttcctcc

SEQ ID NO: 68571 - DNA, 16 bp, H. sapiens
cagggtttcaccatgc

SEQ ID NO: 68572 - DNA, 16 bp, H. sapiens
cagggtttcactctgt

SEQ ID NO: 68573 - DNA, 16 bp, H. sapiens
cagggtttcattctgt

SEQ ID NO: 68574 - DNA, 16 bp, H. sapiens
cagggtttcgccacgt

SEQ ID NO: 68575 - DNA, 16 bp, H. sapiens
cagggtttctcaacct

SEQ ID NO: 68576 - DNA, 16 bp, H. sapiens
cagggtttctcaatct

SEQ ID NO: 68577 - DNA, 16 bp, H. sapiens
cagggtttctcagcct

SEQ ID NO: 68578 - DNA, 16 bp, H. sapiens
cagggtttcttaacct

SEQ ID NO: 68579 - DNA, 16 bp, H. sapiens
cagggtttggagtgga

SEQ ID NO: 68580 - DNA, 16 bp, H. sapiens
cagggttttactatat

SEQ ID NO: 68581 - DNA, 16 bp, H. sapiens
cagggttttcaccatg

SEQ ID NO: 68582 - DNA, 16 bp, H. sapiens
caggtaaggttggaaa

SEQ ID NO: 68583 - DNA, 16 bp, H. sapiens
caggtaatcagaatga

SEQ ID NO: 68584 - DNA, 16 bp, H. sapiens
caggtaattttttgta

SEQ ID NO: 68585 - DNA, 16 bp, H. sapiens
caggtaccagccacca

SEQ ID NO: 68586 - DNA, 16 bp, H. sapiens
caggtactggggaggc

SEQ ID NO: 68587 - DNA, 16 bp, H. sapiens
caggtacttggggggc

SEQ ID NO: 68588 - DNA, 16 bp, H. sapiens
caggtagaattttttt

SEQ ID NO: 68589 - DNA, 16 bp, H. sapiens
caggtagagagaaaaa

SEQ ID NO: 68590 - DNA, 16 bp, H. sapiens
caggtagatcacttga

SEQ ID NO: 68591 - DNA, 16 bp, H. sapiens
caggtagggtggctca

SEQ ID NO: 68592 - DNA, 16 bp, H. sapiens
caggtatgagccactg

SEQ ID NO: 68593 - DNA, 16 bp, H. sapiens
caggtattaagcccag

SEQ ID NO: 68594 - DNA, 16 bp, H. sapiens
caggtattctgttgta

SEQ ID NO: 68595 - DNA, 16 bp, H. sapiens
caggtatttctttctt

SEQ ID NO: 68596 - DNA, 16 bp, H. sapiens
caggtattttattctc

SEQ ID NO: 68597 - DNA, 16 bp, H. sapiens
caggtattttcttttt

SEQ ID NO: 68598 - DNA, 16 bp, H. sapiens
caggtattttttcata

SEQ ID NO: 68599 - DNA, 16 bp, H. sapiens
caggtcactgtaaaat

SEQ ID NO: 68600 - DNA, 16 bp, H. sapiens
caggtcacttaaggtc

SEQ ID NO: 68601 - DNA, 17 bp, H. sapiens
caggtcaggagatcaag

SEQ ID NO: 68602 - DNA, 16 bp, H. sapiens
caggtcatgatgggaa

SEQ ID NO: 68603 - DNA, 16 bp, H. sapiens
caggtcatttatcttc

SEQ ID NO: 68604 - DNA, 16 bp, H. sapiens
caggtccaggagctcc

SEQ ID NO: 68605 - DNA, 16 bp, H. sapiens
caggtcccaccccaga

SEQ ID NO: 68606 - DNA, 16 bp, H. sapiens
caggtcccatgcccac

SEQ ID NO: 68607 - DNA, 16 bp, H. sapiens
caggtccctctcacaa

SEQ ID NO: 68608 - DNA, 16 bp, H. sapiens
caggtccctggtgcca

SEQ ID NO: 68609 - DNA, 16 bp, H. sapiens
caggtcctcaccagac

SEQ ID NO: 68610 - DNA, 16 bp, H. sapiens
caggtcctccaggcct

SEQ ID NO: 68611 - DNA, 16 bp, H. sapiens
caggtcctgcaggagc

SEQ ID NO: 68612 - DNA, 16 bp, H. sapiens
caggtcctggagagga

SEQ ID NO: 68613 - DNA, 16 bp, H. sapiens
caggtctcctgactcc

SEQ ID NO: 68614 - DNA, 16 bp, H. sapiens
caggtctctcttcctt

SEQ ID NO: 68615 - DNA, 16 bp, H. sapiens
caggtctgagccacca

SEQ ID NO: 68616 - DNA, 16 bp, H. sapiens
caggtctggaggctgg

SEQ ID NO: 68617 - DNA, 16 bp, H. sapiens
caggtctgtctgcctc

SEQ ID NO: 68618 - DNA, 18 bp, H. sapiens
caggtcttcagataaact

SEQ ID NO: 68619 - DNA, 16 bp, H. sapiens
caggtcttctgactcc

SEQ ID NO: 68620 - DNA, 16 bp, H. sapiens
caggtcttgctgcagc

SEQ ID NO: 68621 - DNA, 16 bp, H. sapiens
caggtcttgctgtggc

SEQ ID NO: 68622 - DNA, 16 bp, H. sapiens
caggtctttcctgtgt

SEQ ID NO: 68623 - DNA, 16 bp, H. sapiens
caggtcttttgaaata

SEQ ID NO: 68624 - DNA, 16 bp, H. sapiens
caggtgaacaccacca

SEQ ID NO: 68625 - DNA, 16 bp, H. sapiens
caggtgaactgcccac

SEQ ID NO: 68626 - DNA, 16 bp, H. sapiens
caggtgaagaaaatga

SEQ ID NO: 68627 - DNA, 16 bp, H. sapiens
caggtgaagacaccac

SEQ ID NO: 68628 - DNA, 16 bp, H. sapiens
caggtgaagtggctca

SEQ ID NO: 68629 - DNA, 16 bp, H. sapiens
caggtgacccaccagc

SEQ ID NO: 68630 - DNA, 16 bp, H. sapiens
caggtgacctacctgc

SEQ ID NO: 68631 - DNA, 16 bp, H. sapiens
caggtgactctgatgc

SEQ ID NO: 68632 - DNA, 16 bp, H. sapiens
caggtgagagccactg

SEQ ID NO: 68633 - DNA, 16 bp, H. sapiens
caggtgagcactcata

SEQ ID NO: 68634 - DNA, 16 bp, H. sapiens
caggtgaggaaacaga

SEQ ID NO: 68635 - DNA, 16 bp, H. sapiens
caggtgaggaaactga

SEQ ID NO: 68636 - DNA, 16 bp, H. sapiens
caggtgaggacactga

SEQ ID NO: 68637 - DNA, 16 bp, H. sapiens
caggtgatccacctga

SEQ ID NO: 68638 - DNA, 17 bp, H. sapiens
caggtgatccccccgcc

SEQ ID NO: 68639 - DNA, 16 bp, H. sapiens
caggtgatcctcctgc

SEQ ID NO: 68640 - DNA, 16 bp, H. sapiens
caggtgatctatctgc

SEQ ID NO: 68641 - DNA, 16 bp, H. sapiens
caggtgatctgcatgc

SEQ ID NO: 68642 - DNA, 16 bp, H. sapiens
caggtgatgctgaagc

SEQ ID NO: 68643 - DNA, 16 bp, H. sapiens
caggtgattctaatat

SEQ ID NO: 68644 - DNA, 16 bp, H. sapiens
caggtgattggcccac

SEQ ID NO: 68645 - DNA, 16 bp, H. sapiens
caggtgatttgtatgc

SEQ ID NO: 68646 - DNA, 16 bp, H. sapiens
caggtgattttttaaa

SEQ ID NO: 68647 - DNA, 16 bp, H. sapiens
caggtgcaaaaattaa

SEQ ID NO: 68648 - DNA, 16 bp, H. sapiens
caggtgcaatcatagt

SEQ ID NO: 68649 - DNA, 17 bp, H. sapiens
caggtgcacaccaccat

SEQ ID NO: 68650 - DNA, 16 bp, H. sapiens
caggtgcagcagctca

SEQ ID NO: 68651 - DNA, 16 bp, H. sapiens
caggtgcagcggctca

SEQ ID NO: 68652 - DNA, 16 bp, H. sapiens
caggtgcaggccacca

SEQ ID NO: 68653 - DNA, 16 bp, H. sapiens
caggtgcaggggctca

SEQ ID NO: 68654 - DNA, 16 bp, H. sapiens
caggtgcaggtgcagg

SEQ ID NO: 68655 - DNA, 16 bp, H. sapiens
caggtgcagtgattca

SEQ ID NO: 68656 - DNA, 16 bp, H. sapiens
caggtgcagtggccca

SEQ ID NO: 68657 - DNA, 16 bp, H. sapiens
caggtgcagtggcgtg

SEQ ID NO: 68658 - DNA, 16 bp, H. sapiens
caggtgcagtggttca

SEQ ID NO: 68659 - DNA, 16 bp, H. sapiens
caggtgcagtgtctca

SEQ ID NO: 68660 - DNA, 16 bp, H. sapiens
caggtgcatgccattg

SEQ ID NO: 68661 - DNA, 16 bp, H. sapiens
caggtgcatgctggga

SEQ ID NO: 68662 - DNA, 16 bp, H. sapiens
caggtgccactggggt

SEQ ID NO: 68663 - DNA, 16 bp, H. sapiens
caggtgcccacaacca

SEQ ID NO: 68664 - DNA, 16 bp, H. sapiens
caggtgcccaccaccg

SEQ ID NO: 68665 - DNA, 16 bp, H. sapiens
caggtgcccagcacca

SEQ ID NO: 68666 - DNA, 16 bp, H. sapiens
caggtgcccatcaaca

SEQ ID NO: 68667 - DNA, 16 bp, H. sapiens
caggtgccccccacca

SEQ ID NO: 68668 - DNA, 16 bp, H. sapiens
caggtgcccctccccc

SEQ ID NO: 68669 - DNA, 16 bp, H. sapiens
caggtgccccttggca

SEQ ID NO: 68670 - DNA, 16 bp, H. sapiens
caggtgccgccaccac

SEQ ID NO: 68671 - DNA, 16 bp, H. sapiens
caggtgcctgccaccc

SEQ ID NO: 68672 - DNA, 16 bp, H. sapiens
caggtgcctttaatcc

SEQ ID NO: 68673 - DNA, 16 bp, H. sapiens
caggtgcgagccaccg

SEQ ID NO: 68674 - DNA, 16 bp, H. sapiens
caggtgcgagccactg

SEQ ID NO: 68675 - DNA, 16 bp, H. sapiens
caggtgcggtggttca

SEQ ID NO: 68676 - DNA, 16 bp, H. sapiens
caggtgctcaataaat

SEQ ID NO: 68677 - DNA, 16 bp, H. sapiens
caggtgctcaccactg

SEQ ID NO: 68678 - DNA, 16 bp, H. sapiens
caggtgctgcagctga

SEQ ID NO: 68679 - DNA, 16 bp, H. sapiens
caggtgctgccctcac

SEQ ID NO: 68680 - DNA, 16 bp, H. sapiens
caggtgctgctgatgc

SEQ ID NO: 68681 - DNA, 16 bp, H. sapiens
caggtgctggacagga

SEQ ID NO: 68682 - DNA, 16 bp, H. sapiens
caggtgctggagaaga

SEQ ID NO: 68683 - DNA, 16 bp, H. sapiens
caggtgctggtatcca

SEQ ID NO: 68684 - DNA, 16 bp, H. sapiens
caggtgctggtgagga

SEQ ID NO: 68685 - DNA, 16 bp, H. sapiens
caggtggaaatgcaga

SEQ ID NO: 68686 - DNA, 16 bp, H. sapiens
caggtggacatcaggc

SEQ ID NO: 68687 - DNA, 16 bp, H. sapiens
caggtggaccacaagg

SEQ ID NO: 68688 - DNA, 16 bp, H. sapiens
caggtggaccatttga

SEQ ID NO: 68689 - DNA, 16 bp, H. sapiens
caggtggactacctga

SEQ ID NO: 68690 - DNA, 16 bp, H. sapiens
caggtggagaaactga

SEQ ID NO: 68691 - DNA, 16 bp, H. sapiens
caggtggagatgagga

SEQ ID NO: 68692 - DNA, 18 bp, H. sapiens
caggtggagctgcctgcc

SEQ ID NO: 68693 - DNA, 23 bp, H. sapiens
caggtggagctgcctgccagtcc

SEQ ID NO: 68694 - DNA, 16 bp, H. sapiens
caggtggaggtaattg

SEQ ID NO: 68695 - DNA, 16 bp, H. sapiens
caggtggatatccagt

SEQ ID NO: 68696 - DNA, 16 bp, H. sapiens
caggtggatcatctga

SEQ ID NO: 68697 - DNA, 16 bp, H. sapiens
caggtggatgacttga

SEQ ID NO: 68698 - DNA, 16 bp, H. sapiens
caggtggcagaggcag

SEQ ID NO: 68699 - DNA, 16 bp, H. sapiens
caggtggccaagagca

SEQ ID NO: 68700 - DNA, 16 bp, H. sapiens
caggtggctaaggcag

SEQ ID NO: 68701 - DNA, 16 bp, H. sapiens
caggtggctcacctga

SEQ ID NO: 68702 - DNA, 16 bp, H. sapiens
caggtggctgaggagg

SEQ ID NO: 68703 - DNA, 16 bp, H. sapiens
caggtggctgaggcat

SEQ ID NO: 68704 - DNA, 16 bp, H. sapiens
caggtggctgaggctg

SEQ ID NO: 68705 - DNA, 16 bp, H. sapiens
caggtggctgccttct

SEQ ID NO: 68706 - DNA, 16 bp, H. sapiens
caggtggcttgaattt

SEQ ID NO: 68707 - DNA, 19 bp, H. sapiens
caggtgggaattgaacaat

SEQ ID NO: 68708 - DNA, 16 bp, H. sapiens
caggtgggacagggag

SEQ ID NO: 68709 - DNA, 16 bp, H. sapiens
caggtgggagaggggc

SEQ ID NO: 68710 - DNA, 16 bp, H. sapiens
caggtgggagccacta

SEQ ID NO: 68711 - DNA, 16 bp, H. sapiens
caggtgggagccactg

SEQ ID NO: 68712 - DNA, 17 bp, H. sapiens
caggtgggaggattgct

SEQ ID NO: 68713 - DNA, 16 bp, H. sapiens
caggtgggcaggaccc

SEQ ID NO: 68714 - DNA, 16 bp, H. sapiens
caggtgggcagtgagg

SEQ ID NO: 68715 - DNA, 16 bp, H. sapiens
caggtgggcatggtgg

SEQ ID NO: 68716 - DNA, 21 bp, H. sapiens
caggtgggcggatcacctgag

SEQ ID NO: 68717 - DNA, 16 bp, H. sapiens
caggtggggaaactga

SEQ ID NO: 68718 - DNA, 16 bp, H. sapiens
caggtgggggcagggc

SEQ ID NO: 68719 - DNA, 16 bp, H. sapiens
caggtggggtggctca

SEQ ID NO: 68720 - DNA, 16 bp, H. sapiens
caggtgggtcatctga

SEQ ID NO: 68721 - DNA, 16 bp, H. sapiens
caggtggtgggcaggg

SEQ ID NO: 68722 - DNA, 16 bp, H. sapiens
caggtgtaagccaccg

SEQ ID NO: 68723 - DNA, 16 bp, H. sapiens
caggtgtaagccactg

SEQ ID NO: 68724 - DNA, 16 bp, H. sapiens
caggtgtcagccacca

SEQ ID NO: 68725 - DNA, 16 bp, H. sapiens
caggtgtcagccaccg

SEQ ID NO: 68726 - DNA, 16 bp, H. sapiens
caggtgtcagccacta

SEQ ID NO: 68727 - DNA, 16 bp, H. sapiens
caggtgtcagggaccc

SEQ ID NO: 68728 - DNA, 16 bp, H. sapiens
caggtgtcatgggagg

SEQ ID NO: 68729 - DNA, 16 bp, H. sapiens
caggtgtccctgagaa

SEQ ID NO: 68730 - DNA, 16 bp, H. sapiens
caggtgtgagccacag

SEQ ID NO: 68731 - DNA, 16 bp, H. sapiens
caggtgtgagccacat

SEQ ID NO: 68732 - DNA, 16 bp, H. sapiens
caggtgtgagccacca

SEQ ID NO: 68733 - DNA, 16 bp, H. sapiens
caggtgtgagccaccc

SEQ ID NO: 68734 - DNA, 16 bp, H. sapiens
caggtgtgagccaccg

SEQ ID NO: 68735 - DNA, 16 bp, H. sapiens
caggtgtgagccacct

SEQ ID NO: 68736 - DNA, 16 bp, H. sapiens
caggtgtgagccacgg

SEQ ID NO: 68737 - DNA, 16 bp, H. sapiens
caggtgtgagccacta

SEQ ID NO: 68738 - DNA, 16 bp, H. sapiens
caggtgtgagccactc

SEQ ID NO: 68739 - DNA, 16 bp, H. sapiens
caggtgtgagccactg

SEQ ID NO: 68740 - DNA, 16 bp, H. sapiens
caggtgtgagccagtg

SEQ ID NO: 68741 - DNA, 16 bp, H. sapiens
caggtgtgagccatca

SEQ ID NO: 68742 - DNA, 16 bp, H. sapiens
caggtgtgagccccca

SEQ ID NO: 68743 - DNA, 16 bp, H. sapiens
caggtgtgagccgcca

SEQ ID NO: 68744 - DNA, 16 bp, H. sapiens
caggtgtgagcctcca

SEQ ID NO: 68745 - DNA, 16 bp, H. sapiens
caggtgtgagcgacca

SEQ ID NO: 68746 - DNA, 16 bp, H. sapiens
caggtgtgagctacag

SEQ ID NO: 68747 - DNA, 16 bp, H. sapiens
caggtgtgagctaccg

SEQ ID NO: 68748 - DNA, 16 bp, H. sapiens
caggtgtgagctactg

SEQ ID NO: 68749 - DNA, 16 bp, H. sapiens
caggtgtgagctatca

SEQ ID NO: 68750 - DNA, 16 bp, H. sapiens
caggtgtgagctgcca

SEQ ID NO: 68751 - DNA, 16 bp, H. sapiens
caggtgtgagctgccg

SEQ ID NO: 68752 - DNA, 16 bp, H. sapiens
caggtgtgaggaagaa

SEQ ID NO: 68753 - DNA, 16 bp, H. sapiens
caggtgtgaggcaccg

SEQ ID NO: 68754 - DNA, 16 bp, H. sapiens
caggtgtgagtcacag

SEQ ID NO: 68755 - DNA, 16 bp, H. sapiens
caggtgtgagtcacca

SEQ ID NO: 68756 - DNA, 16 bp, H. sapiens
caggtgtgagtcaccc

SEQ ID NO: 68757 - DNA, 16 bp, H. sapiens
caggtgtgagtcactg

SEQ ID NO: 68758 - DNA, 16 bp, H. sapiens
caggtgtgatccactg

SEQ ID NO: 68759 - DNA, 16 bp, H. sapiens
caggtgtgcaccaaca

SEQ ID NO: 68760 - DNA, 16 bp, H. sapiens
caggtgtgcaccatgc

SEQ ID NO: 68761 - DNA, 16 bp, H. sapiens
caggtgtgggagggac

SEQ ID NO: 68762 - DNA, 16 bp, H. sapiens
caggtgtgggccacag

SEQ ID NO: 68763 - DNA, 16 bp, H. sapiens
caggtgtgggccacca

SEQ ID NO: 68764 - DNA, 16 bp, H. sapiens
caggtgtgggtcactg

SEQ ID NO: 68765 - DNA, 16 bp, H. sapiens
caggtgtggtgacgca

SEQ ID NO: 68766 - DNA, 16 bp, H. sapiens
caggtgtggtggctca

SEQ ID NO: 68767 - DNA, 16 bp, H. sapiens
caggtgtggtggctcc

SEQ ID NO: 68768 - DNA, 16 bp, H. sapiens
caggtgtggtggctgt

SEQ ID NO: 68769 - DNA, 16 bp, H. sapiens
caggtgtggtggtgct

SEQ ID NO: 68770 - DNA, 16 bp, H. sapiens
caggtgtggtggttgg

SEQ ID NO: 68771 - DNA, 16 bp, H. sapiens
caggtgtgtgccacac

SEQ ID NO: 68772 - DNA, 16 bp, H. sapiens
caggtgtgtgccatca

SEQ ID NO: 68773 - DNA, 16 bp, H. sapiens
caggtgtgtgtcactg

SEQ ID NO: 68774 - DNA, 16 bp, H. sapiens
caggtgtgttgactca

SEQ ID NO: 68775 - DNA, 16 bp, H. sapiens
caggtgttcaaggcca

SEQ ID NO: 68776 - DNA, 16 bp, H. sapiens
caggtgttccacctgc

SEQ ID NO: 68777 - DNA, 16 bp, H. sapiens
caggtgttggtgagga

SEQ ID NO: 68778 - DNA, 16 bp, H. sapiens
caggtgtttctatcta

SEQ ID NO: 68779 - DNA, 16 bp, H. sapiens
caggttaagtatccct

SEQ ID NO: 68780 - DNA, 16 bp, H. sapiens
caggttaattttttgt

SEQ ID NO: 68781 - DNA, 16 bp, H. sapiens
caggttacttaagggt

SEQ ID NO: 68782 - DNA, 16 bp, H. sapiens
caggttatctttatag

SEQ ID NO: 68783 - DNA, 16 bp, H. sapiens
caggttcaagcgatct

SEQ ID NO: 68784 - DNA, 16 bp, H. sapiens
caggttccagtgtgtg

SEQ ID NO: 68785 - DNA, 16 bp, H. sapiens
caggttctcactcata

SEQ ID NO: 68786 - DNA, 16 bp, H. sapiens
caggttctcactctgt

SEQ ID NO: 68787 - DNA, 16 bp, H. sapiens
caggttcttgccttgg

SEQ ID NO: 68788 - DNA, 16 bp, H. sapiens
caggttgagaaccact

SEQ ID NO: 68789 - DNA, 16 bp, H. sapiens
caggttgcagtgagcc

SEQ ID NO: 68790 - DNA, 16 bp, H. sapiens
caggttgctgctgctg

SEQ ID NO: 68791 - DNA, 16 bp, H. sapiens
caggttggacagcagc

SEQ ID NO: 68792 - DNA, 16 bp, H. sapiens
caggttggagagcagt

SEQ ID NO: 68793 - DNA, 16 bp, H. sapiens
caggttggagtggagt

SEQ ID NO: 68794 - DNA, 16 bp, H. sapiens
caggttggccagcctg

SEQ ID NO: 68795 - DNA, 16 bp, H. sapiens
caggttggggaagttc

SEQ ID NO: 68796 - DNA, 16 bp, H. sapiens
caggttgggtgacaga

SEQ ID NO: 68797 - DNA, 16 bp, H. sapiens
caggttggtcttgaac

SEQ ID NO: 68798 - DNA, 16 bp, H. sapiens
caggttggtcttggac

SEQ ID NO: 68799 - DNA, 16 bp, H. sapiens
caggttgtcttgaact

SEQ ID NO: 68800 - DNA, 16 bp, H. sapiens
caggtttaggattggc

SEQ ID NO: 68801 - DNA, 16 bp, H. sapiens
caggtttcctgactcc

SEQ ID NO: 68802 - DNA, 16 bp, H. sapiens
caggtttcttcactgt

SEQ ID NO: 68803 - DNA, 16 bp, H. sapiens
caggtttctttttctt

SEQ ID NO: 68804 - DNA, 16 bp, H. sapiens
caggtttgctacacag

SEQ ID NO: 68805 - DNA, 16 bp, H. sapiens
caggtttggtttcaga

SEQ ID NO: 68806 - DNA, 16 bp, H. sapiens
caggtttgttgaaaat

SEQ ID NO: 68807 - DNA, 16 bp, H. sapiens
caggttttctgctctg

SEQ ID NO: 68808 - DNA, 16 bp, H. sapiens
caggttttgcccaagg

SEQ ID NO: 68809 - DNA, 16 bp, H. sapiens
caggttttggtatcag

SEQ ID NO: 68810 - DNA, 16 bp, H. sapiens
caggtttttgtttcat

SEQ ID NO: 68811 - DNA, 16 bp, H. sapiens
caggttttttgcatgt

SEQ ID NO: 68812 - DNA, 16 bp, H. sapiens
cagtaaaaagatcagc

SEQ ID NO: 68813 - DNA, 16 bp, H. sapiens
cagtaaaataaagcac

SEQ ID NO: 68814 - DNA, 16 bp, H. sapiens
cagtaaaattcaacat

SEQ ID NO: 68815 - DNA, 16 bp, H. sapiens
cagtaaaattttttta

SEQ ID NO: 68816 - DNA, 16 bp, H. sapiens
cagtaaactcattttt

SEQ ID NO: 68817 - DNA, 16 bp, H. sapiens
cagtaaacttctgcct

SEQ ID NO: 68818 - DNA, 16 bp, H. sapiens
cagtaaagctggaaaa

SEQ ID NO: 68819 - DNA, 16 bp, H. sapiens
cagtaaataagtgaaa

SEQ ID NO: 68820 - DNA, 16 bp, H. sapiens
cagtaaatacttactg

SEQ ID NO: 68821 - DNA, 16 bp, H. sapiens
cagtaaatatatatat

SEQ ID NO: 68822 - DNA, 16 bp, H. sapiens
cagtaaatattagtta

SEQ ID NO: 68823 - DNA, 16 bp, H. sapiens
cagtaaatatttttaa

SEQ ID NO: 68824 - DNA, 16 bp, H. sapiens
cagtaaatgtaaaaga

SEQ ID NO: 68825 - DNA, 16 bp, H. sapiens
cagtaaatgtgattca

SEQ ID NO: 68826 - DNA, 16 bp, H. sapiens
cagtaaatgtttattg

SEQ ID NO: 68827 - DNA, 16 bp, H. sapiens
cagtaaatgtttttaa

SEQ ID NO: 68828 - DNA, 16 bp, H. sapiens
cagtaacagcagcagc

SEQ ID NO: 68829 - DNA, 16 bp, H. sapiens
cagtaacatttctata

SEQ ID NO: 68830 - DNA, 16 bp, H. sapiens
cagtaaccaaaccagc

SEQ ID NO: 68831 - DNA, 16 bp, H. sapiens
cagtaagatataaata

SEQ ID NO: 68832 - DNA, 16 bp, H. sapiens
cagtaagccaaggttg

SEQ ID NO: 68833 - DNA, 16 bp, H. sapiens
cagtaagccatgatca

SEQ ID NO: 68834 - DNA, 16 bp, H. sapiens
cagtaagtgctcaata

SEQ ID NO: 68835 - DNA, 16 bp, H. sapiens
cagtaagttttgaaat

SEQ ID NO: 68836 - DNA, 16 bp, H. sapiens
cagtaataaaaaacct

SEQ ID NO: 68837 - DNA, 16 bp, H. sapiens
cagtaataacattgaa

SEQ ID NO: 68838 - DNA, 16 bp, H. sapiens
cagtaataattatgat

SEQ ID NO: 68839 - DNA, 16 bp, H. sapiens
cagtaatatataaaaa

SEQ ID NO: 68840 - DNA, 16 bp, H. sapiens
cagtaatattttgaaa

SEQ ID NO: 68841 - DNA, 16 bp, H. sapiens
cagtaatcaaaacaga

SEQ ID NO: 68842 - DNA, 16 bp, H. sapiens
cagtaatcatcagaga

SEQ ID NO: 68843 - DNA, 16 bp, H. sapiens
cagtaatgaaaaggaa

SEQ ID NO: 68844 - DNA, 16 bp, H. sapiens
cagtaatgggatgact

SEQ ID NO: 68845 - DNA, 16 bp, H. sapiens
cagtaattctccattc

SEQ ID NO: 68846 - DNA, 16 bp, H. sapiens
cagtaattctcctgcc

SEQ ID NO: 68847 - DNA, 16 bp, H. sapiens
cagtaatttttttctt

SEQ ID NO: 68848 - DNA, 16 bp, H. sapiens
cagtacaaagagagga

SEQ ID NO: 68849 - DNA, 16 bp, H. sapiens
cagtacaacctctgcc

SEQ ID NO: 68850 - DNA, 16 bp, H. sapiens
cagtacaataaaatat

SEQ ID NO: 68851 - DNA, 17 bp, H. sapiens
cagtacaccctccacag

SEQ ID NO: 68852 - DNA, 16 bp, H. sapiens
cagtacagctctcagg

SEQ ID NO: 68853 - DNA, 16 bp, H. sapiens
cagtacattgaagaga

SEQ ID NO: 68854 - DNA, 16 bp, H. sapiens
cagtacattgggaggc

SEQ ID NO: 68855 - DNA, 16 bp, H. sapiens
cagtaccagcctggag

SEQ ID NO: 68856 - DNA, 16 bp, H. sapiens
cagtaccagctacttg

SEQ ID NO: 68857 - DNA, 16 bp, H. sapiens
cagtaccagttttctg

SEQ ID NO: 68858 - DNA, 16 bp, H. sapiens
cagtaccataatgttt

SEQ ID NO: 68859 - DNA, 16 bp, H. sapiens
cagtacctcagaatat

SEQ ID NO: 68860 - DNA, 16 bp, H. sapiens
cagtactttaaaaatg

SEQ ID NO: 68861 - DNA, 16 bp, H. sapiens
cagtactttggaggcc

SEQ ID NO: 68862 - DNA, 16 bp, H. sapiens
cagtactttgggaggt

SEQ ID NO: 68863 - DNA, 16 bp, H. sapiens
cagtagaaaaaaatat

SEQ ID NO: 68864 - DNA, 16 bp, H. sapiens
cagtagaaaaggaaat

SEQ ID NO: 68865 - DNA, 16 bp, H. sapiens
cagtagaatagagcac

SEQ ID NO: 68866 - DNA, 16 bp, H. sapiens
cagtagagatgaggtt

SEQ ID NO: 68867 - DNA, 16 bp, H. sapiens
cagtagcagcagcaac

SEQ ID NO: 68868 - DNA, 16 bp, H. sapiens
cagtagcctcctaact

SEQ ID NO: 68869 - DNA, 16 bp, H. sapiens
cagtagctaggactac

SEQ ID NO: 68870 - DNA, 16 bp, H. sapiens
cagtagctcacacctg

SEQ ID NO: 68871 - DNA, 16 bp, H. sapiens
cagtagctcacgcctg

SEQ ID NO: 68872 - DNA, 16 bp, H. sapiens
cagtagctcatgcctg

SEQ ID NO: 68873 - DNA, 16 bp, H. sapiens
cagtagctggggccac

SEQ ID NO: 68874 - DNA, 16 bp, H. sapiens
cagtaggtgctcaatg

SEQ ID NO: 68875 - DNA, 16 bp, H. sapiens
cagtagtagcagcagc

SEQ ID NO: 68876 - DNA, 16 bp, H. sapiens
cagtagtggctcagtc

SEQ ID NO: 68877 - DNA, 16 bp, H. sapiens
cagtagtgtgaaaatg

SEQ ID NO: 68878 - DNA, 16 bp, H. sapiens
cagtagttctcaactg

SEQ ID NO: 68879 - DNA, 16 bp, H. sapiens
cagtataacctcatct

SEQ ID NO: 68880 - DNA, 16 bp, H. sapiens
cagtataataaagata

SEQ ID NO: 68881 - DNA, 16 bp, H. sapiens
cagtatagcaactatt

SEQ ID NO: 68882 - DNA, 16 bp, H. sapiens
cagtatagtttgaagt

SEQ ID NO: 68883 - DNA, 16 bp, H. sapiens
cagtatataatgataa

SEQ ID NO: 68884 - DNA, 16 bp, H. sapiens
cagtatatataaagaa

SEQ ID NO: 68885 - DNA, 16 bp, H. sapiens
cagtatatttttttaa

SEQ ID NO: 68886 - DNA, 16 bp, H. sapiens
cagtatcactctaata

SEQ ID NO: 68887 - DNA, 16 bp, H. sapiens
cagtatcatgagaaca

SEQ ID NO: 68888 - DNA, 16 bp, H. sapiens
cagtatccctgatgaa

SEQ ID NO: 68889 - DNA, 16 bp, H. sapiens
cagtatcctgagtagc

SEQ ID NO: 68890 - DNA, 16 bp, H. sapiens
cagtatgaattatctt

SEQ ID NO: 68891 - DNA, 16 bp, H. sapiens
cagtatggaggctcct

SEQ ID NO: 68892 - DNA, 16 bp, H. sapiens
cagtatggcttgctgc

SEQ ID NO: 68893 - DNA, 16 bp, H. sapiens
cagtatgtaaatgaat

SEQ ID NO: 68894 - DNA, 16 bp, H. sapiens
cagtatgtagactttt

SEQ ID NO: 68895 - DNA, 16 bp, H. sapiens
cagtatgtggcctttt

SEQ ID NO: 68896 - DNA, 16 bp, H. sapiens
cagtattaccctgata

SEQ ID NO: 68897 - DNA, 16 bp, H. sapiens
cagtattgttaaaatg

SEQ ID NO: 68898 - DNA, 16 bp, H. sapiens
cagtatttcatggtgt

SEQ ID NO: 68899 - DNA, 16 bp, H. sapiens
cagtatttccctgtct

SEQ ID NO: 68900 - DNA, 16 bp, H. sapiens
cagtatttctcaaaat

SEQ ID NO: 68901 - DNA, 16 bp, H. sapiens
cagtatttctcaaact

SEQ ID NO: 68902 - DNA, 16 bp, H. sapiens
cagtatttgtctttct

SEQ ID NO: 68903 - DNA, 16 bp, H. sapiens
cagtatttgttttctt

SEQ ID NO: 68904 - DNA, 16 bp, H. sapiens
cagtattttatagttt

SEQ ID NO: 68905 - DNA, 16 bp, H. sapiens
cagtattttattcagg

SEQ ID NO: 68906 - DNA, 16 bp, H. sapiens
cagtattttattcttt

SEQ ID NO: 68907 - DNA, 16 bp, H. sapiens
cagtattttttattgt

SEQ ID NO: 68908 - DNA, 16 bp, H. sapiens
cagtcaagtcttcaga

SEQ ID NO: 68909 - DNA, 16 bp, H. sapiens
cagtcaatgaatattt

SEQ ID NO: 68910 - DNA, 16 bp, H. sapiens
cagtcacaaaaaggaa

SEQ ID NO: 68911 - DNA, 16 bp, H. sapiens
cagtcacatggatgga

SEQ ID NO: 68912 - DNA, 16 bp, H. sapiens
cagtcaccccagccaa

SEQ ID NO: 68913 - DNA, 31 bp, H. sapiens
cagtcactagatacttctcccagccactaag

SEQ ID NO: 68914 - DNA, 16 bp, H. sapiens
cagtcactatcatgag

SEQ ID NO: 68915 - DNA, 16 bp, H. sapiens
cagtcactcacacctg

SEQ ID NO: 68916 - DNA, 16 bp, H. sapiens
cagtcactccctgttc

SEQ ID NO: 68917 - DNA, 16 bp, H. sapiens
cagtcactggtgtcac

SEQ ID NO: 68918 - DNA, 16 bp, H. sapiens
cagtcactttggaaaa

SEQ ID NO: 68919 - DNA, 16 bp, H. sapiens
cagtcagaagttccag

SEQ ID NO: 68920 - DNA, 16 bp, H. sapiens
cagtcagaatagcaat

SEQ ID NO: 68921 - DNA, 16 bp, H. sapiens
cagtcagaatagttat

SEQ ID NO: 68922 - DNA, 16 bp, H. sapiens
cagtcagagagaaagg

SEQ ID NO: 68923 - DNA, 16 bp, H. sapiens
cagtcagggaaccaag

SEQ ID NO: 68924 - DNA, 16 bp, H. sapiens
cagtcagtatgatatt

SEQ ID NO: 68925 - DNA, 16 bp, H. sapiens
cagtcagtcagtcagt

SEQ ID NO: 68926 - DNA, 16 bp, H. sapiens
cagtcagtgctgaaac

SEQ ID NO: 68927 - DNA, 16 bp, H. sapiens
cagtcatagcagaagg

SEQ ID NO: 68928 - DNA, 16 bp, H. sapiens
cagtcatatgccacca

SEQ ID NO: 68929 - DNA, 16 bp, H. sapiens
cagtcatattggacta

SEQ ID NO: 68930 - DNA, 16 bp, H. sapiens
cagtcatctctcagta

SEQ ID NO: 68931 - DNA, 16 bp, H. sapiens
cagtcatgcatcactt

SEQ ID NO: 68932 - DNA, 16 bp, H. sapiens
cagtcatggctcattg

SEQ ID NO: 68933 - DNA, 16 bp, H. sapiens
cagtcatggctggagc

SEQ ID NO: 68934 - DNA, 16 bp, H. sapiens
cagtcatgtgctacat

SEQ ID NO: 68935 - DNA, 16 bp, H. sapiens
cagtcattaaaaatga

SEQ ID NO: 68936 - DNA, 16 bp, H. sapiens
cagtcattggatgcag

SEQ ID NO: 68937 - DNA, 16 bp, H. sapiens
cagtcatttcttccct

SEQ ID NO: 68938 - DNA, 16 bp, H. sapiens
cagtccaacaaagaca

SEQ ID NO: 68939 - DNA, 16 bp, H. sapiens
cagtccaatccttccc

SEQ ID NO: 68940 - DNA, 16 bp, H. sapiens
cagtccaatgtcctgg

SEQ ID NO: 68941 - DNA, 16 bp, H. sapiens
cagtccaccactgatg

SEQ ID NO: 68942 - DNA, 16 bp, H. sapiens
cagtccactccagcct

SEQ ID NO: 68943 - DNA, 16 bp, H. sapiens
cagtccagcccagccc

SEQ ID NO: 68944 - DNA, 16 bp, H. sapiens
cagtccagcctggcca

SEQ ID NO: 68945 - DNA, 16 bp, H. sapiens
cagtccaggagttcga

SEQ ID NO: 68946 - DNA, 16 bp, H. sapiens
cagtcccagccccagc

SEQ ID NO: 68947 - DNA, 16 bp, H. sapiens
cagtcccagctgagcc

SEQ ID NO: 68948 - DNA, 16 bp, H. sapiens
cagtccccacctccaa

SEQ ID NO: 68949 - DNA, 16 bp, H. sapiens
cagtccccagaatgtg

SEQ ID NO: 68950 - DNA, 16 bp, H. sapiens
cagtcccccagagtct

SEQ ID NO: 68951 - DNA, 16 bp, H. sapiens
cagtccctctccacac

SEQ ID NO: 68952 - DNA, 16 bp, H. sapiens
cagtccctggagtgtg

SEQ ID NO: 68953 - DNA, 16 bp, H. sapiens
cagtcctagtggtggt

SEQ ID NO: 68954 - DNA, 16 bp, H. sapiens
cagtcctcaccctcct

SEQ ID NO: 68955 - DNA, 16 bp, H. sapiens
cagtcctcatttctgt

SEQ ID NO: 68956 - DNA, 16 bp, H. sapiens
cagtcctcccaccaca

SEQ ID NO: 68957 - DNA, 16 bp, H. sapiens
cagtcctcccacctcg

SEQ ID NO: 68958 - DNA, 16 bp, H. sapiens
cagtcctcccatctca

SEQ ID NO: 68959 - DNA, 16 bp, H. sapiens
cagtcctcccgcctcg

SEQ ID NO: 68960 - DNA, 16 bp, H. sapiens
cagtcctcctgccctg

SEQ ID NO: 68961 - DNA, 16 bp, H. sapiens
cagtcctcctgcctgg

SEQ ID NO: 68962 - DNA, 16 bp, H. sapiens
cagtcctcctgccttg

SEQ ID NO: 68963 - DNA, 16 bp, H. sapiens
cagtcctcctgcttca

SEQ ID NO: 68964 - DNA, 16 bp, H. sapiens
cagtcctcttacctca

SEQ ID NO: 68965 - DNA, 16 bp, H. sapiens
cagtcctgcaggctgt

SEQ ID NO: 68966 - DNA, 16 bp, H. sapiens
cagtcctgccattgcc

SEQ ID NO: 68967 - DNA, 16 bp, H. sapiens
cagtcctgctggacca

SEQ ID NO: 68968 - DNA, 16 bp, H. sapiens
cagtcctggctactca

SEQ ID NO: 68969 - DNA, 16 bp, H. sapiens
cagtcctgggtggggc

SEQ ID NO: 68970 - DNA, 16 bp, H. sapiens
cagtcctgggtggggg

SEQ ID NO: 68971 - DNA, 16 bp, H. sapiens
cagtccttccaccttg

SEQ ID NO: 68972 - DNA, 16 bp, H. sapiens
cagtccttttgggttt

SEQ ID NO: 68973 - DNA, 16 bp, H. sapiens
cagtcgcctgtagtcc

SEQ ID NO: 68974 - DNA, 16 bp, H. sapiens
cagtctagagtacagt

SEQ ID NO: 68975 - DNA, 16 bp, H. sapiens
cagtctatcattgata

SEQ ID NO: 68976 - DNA, 16 bp, H. sapiens
cagtctcaagaaaaaa

SEQ ID NO: 68977 - DNA, 16 bp, H. sapiens
cagtctcaagcagttc

SEQ ID NO: 68978 - DNA, 16 bp, H. sapiens
cagtctcaagtagttc

SEQ ID NO: 68979 - DNA, 16 bp, H. sapiens
cagtctcaagtatgtc

SEQ ID NO: 68980 - DNA, 16 bp, H. sapiens
cagtctcactgtgtca

SEQ ID NO: 68981 - DNA, 16 bp, H. sapiens
cagtctcactgtgttg

SEQ ID NO: 68982 - DNA, 16 bp, H. sapiens
cagtctcaggcctgct

SEQ ID NO: 68983 - DNA, 16 bp, H. sapiens
cagtctcagtggctca

SEQ ID NO: 68984 - DNA, 16 bp, H. sapiens
cagtctccagaactgt

SEQ ID NO: 68985 - DNA, 16 bp, H. sapiens
cagtctccatctccca

SEQ ID NO: 68986 - DNA, 16 bp, H. sapiens
cagtctcccaggctgg

SEQ ID NO: 68987 - DNA, 16 bp, H. sapiens
cagtctccctctccct

SEQ ID NO: 68988 - DNA, 16 bp, H. sapiens
cagtctcctcatttgt

SEQ ID NO: 68989 - DNA, 16 bp, H. sapiens
cagtctcctgcacagc

SEQ ID NO: 68990 - DNA, 16 bp, H. sapiens
cagtctcctgcctcag

SEQ ID NO: 68991 - DNA, 16 bp, H. sapiens
cagtctccttatctgt

SEQ ID NO: 68992 - DNA, 16 bp, H. sapiens
cagtctcgctctgtcc

SEQ ID NO: 68993 - DNA, 16 bp, H. sapiens
cagtctcgctctgtcg

SEQ ID NO: 68994 - DNA, 16 bp, H. sapiens
cagtctcgctctgtct

SEQ ID NO: 68995 - DNA, 16 bp, H. sapiens
cagtctcgctttgttg

SEQ ID NO: 68996 - DNA, 16 bp, H. sapiens
cagtctctgccttcat

SEQ ID NO: 68997 - DNA, 16 bp, H. sapiens
cagtctctgtgggagg

SEQ ID NO: 68998 - DNA, 16 bp, H. sapiens
cagtctctttgcaaaa

SEQ ID NO: 68999 - DNA, 16 bp, H. sapiens
cagtctctttgctaaa

SEQ ID NO: 69000 - DNA, 16 bp, H. sapiens
cagtctgactctggca

SEQ ID NO: 69001 - DNA, 16 bp, H. sapiens
cagtctgagaaataaa

SEQ ID NO: 69002 - DNA, 16 bp, H. sapiens
cagtctgatttttttt

SEQ ID NO: 69003 - DNA, 16 bp, H. sapiens
cagtctgcagccagag

SEQ ID NO: 69004 - DNA, 16 bp, H. sapiens
cagtctgcccaccttg

SEQ ID NO: 69005 - DNA, 16 bp, H. sapiens
cagtctgcttccttca

SEQ ID NO: 69006 - DNA, 16 bp, H. sapiens
cagtctggacaacatg

SEQ ID NO: 69007 - DNA, 16 bp, H. sapiens
cagtctggagggcagt

SEQ ID NO: 69008 - DNA, 16 bp, H. sapiens
cagtctggcagctcct

SEQ ID NO: 69009 - DNA, 16 bp, H. sapiens
cagtctggccaacacg

SEQ ID NO: 69010 - DNA, 16 bp, H. sapiens
cagtctggccaacttg

SEQ ID NO: 69011 - DNA, 16 bp, H. sapiens
cagtctggccacagcc

SEQ ID NO: 69012 - DNA, 16 bp, H. sapiens
cagtctggctccagag

SEQ ID NO: 69013 - DNA, 16 bp, H. sapiens
cagtctgggaaacaga

SEQ ID NO: 69014 - DNA, 16 bp, H. sapiens
cagtctgggcaacagt

SEQ ID NO: 69015 - DNA, 16 bp, H. sapiens
cagtctgggcaagatg

SEQ ID NO: 69016 - DNA, 17 bp, H. sapiens
cagtctgggggacaaga

SEQ ID NO: 69017 - DNA, 16 bp, H. sapiens
cagtctgtaatcccag

SEQ ID NO: 69018 - DNA, 16 bp, H. sapiens
cagtctgtcccttagc

SEQ ID NO: 69019 - DNA, 16 bp, H. sapiens
cagtctgtggccaaaa

SEQ ID NO: 69020 - DNA, 16 bp, H. sapiens
cagtctgtggcttctc

SEQ ID NO: 69021 - DNA, 16 bp, H. sapiens
cagtcttattggatta

SEQ ID NO: 69022 - DNA, 16 bp, H. sapiens
cagtcttcccacttca

SEQ ID NO: 69023 - DNA, 16 bp, H. sapiens
cagtcttttgtgtctg

SEQ ID NO: 69024 - DNA, 16 bp, H. sapiens
cagtgaaaaaataatg

SEQ ID NO: 69025 - DNA, 16 bp, H. sapiens
cagtgaaaaaggaaat

SEQ ID NO: 69026 - DNA, 16 bp, H. sapiens
cagtgaaaaatataaa

SEQ ID NO: 69027 - DNA, 16 bp, H. sapiens
cagtgaaaacattttt

SEQ ID NO: 69028 - DNA, 16 bp, H. sapiens
cagtgaaaagaaagaa

SEQ ID NO: 69029 - DNA, 16 bp, H. sapiens
cagtgaaaagggaaca

SEQ ID NO: 69030 - DNA, 16 bp, H. sapiens
cagtgaaaccatcagg

SEQ ID NO: 69031 - DNA, 16 bp, H. sapiens
cagtgaaacctcacct

SEQ ID NO: 69032 - DNA, 16 bp, H. sapiens
cagtgaaataaataaa

SEQ ID NO: 69033 - DNA, 16 bp, H. sapiens
cagtgaaatttaaaaa

SEQ ID NO: 69034 - DNA, 16 bp, H. sapiens
cagtgaacaaaataga

SEQ ID NO: 69035 - DNA, 16 bp, H. sapiens
cagtgaacacaggaat

SEQ ID NO: 69036 - DNA, 16 bp, H. sapiens
cagtgaacacatgcca

SEQ ID NO: 69037 - DNA, 18 bp, H. sapiens
cagtgaactgagatcaca

SEQ ID NO: 69038 - DNA, 16 bp, H. sapiens
cagtgaacttaaagat

SEQ ID NO: 69039 - DNA, 16 bp, H. sapiens
cagtgaacttgaagat

SEQ ID NO: 69040 - DNA, 16 bp, H. sapiens
cagtgaaggccaggct

SEQ ID NO: 69041 - DNA, 16 bp, H. sapiens
cagtgaaggtgatatt

SEQ ID NO: 69042 - DNA, 16 bp, H. sapiens
cagtgacaccatcatg

SEQ ID NO: 69043 - DNA, 16 bp, H. sapiens
cagtgaccaaaacaga

SEQ ID NO: 69044 - DNA, 16 bp, H. sapiens
cagtgaccaaagactt

SEQ ID NO: 69045 - DNA, 16 bp, H. sapiens
cagtgaccaagtggag

SEQ ID NO: 69046 - DNA, 16 bp, H. sapiens
cagtgacctggatgag

SEQ ID NO: 69047 - DNA, 16 bp, H. sapiens
cagtgactcacacctg

SEQ ID NO: 69048 - DNA, 16 bp, H. sapiens
cagtgactcacgcctg

SEQ ID NO: 69049 - DNA, 16 bp, H. sapiens
cagtgactcctgcctg

SEQ ID NO: 69050 - DNA, 16 bp, H. sapiens
cagtgacttgtccaag

SEQ ID NO: 69051 - DNA, 16 bp, H. sapiens
cagtgagaaagacaga

SEQ ID NO: 69052 - DNA, 16 bp, H. sapiens
cagtgagaagatggcc

SEQ ID NO: 69053 - DNA, 16 bp, H. sapiens
cagtgagaccctttct

SEQ ID NO: 69054 - DNA, 17 bp, H. sapiens
cagtgagactccacctc

SEQ ID NO: 69055 - DNA, 17 bp, H. sapiens
cagtgagatcctgtctc

SEQ ID NO: 69056 - DNA, 16 bp, H. sapiens
cagtgagcaaagatca

SEQ ID NO: 69057 - DNA, 16 bp, H. sapiens
cagtgagcagaggagt

SEQ ID NO: 69058 - DNA, 16 bp, H. sapiens
cagtgagcagcaggac

SEQ ID NO: 69059 - DNA, 16 bp, H. sapiens
cagtgagcagtgagca

SEQ ID NO: 69060 - DNA, 16 bp, H. sapiens
cagtgagccagcctgg

SEQ ID NO: 69061 - DNA, 16 bp, H. sapiens
cagtgagccatgatca

SEQ ID NO: 69062 - DNA, 16 bp, H. sapiens
cagtgagccatgttct

SEQ ID NO: 69063 - DNA, 16 bp, H. sapiens
cagtgagccgtgatcg

SEQ ID NO: 69064 - DNA, 16 bp, H. sapiens
cagtgagccttgattg

SEQ ID NO: 69065 - DNA, 16 bp, H. sapiens
cagtgagctatgatct

SEQ ID NO: 69066 - DNA, 16 bp, H. sapiens
cagtgagctatgattg

SEQ ID NO: 69067 - DNA, 16 bp, H. sapiens
cagtgagctcagatca

SEQ ID NO: 69068 - DNA, 16 bp, H. sapiens
cagtgagctgagatca

SEQ ID NO: 69069 - DNA, 16 bp, H. sapiens
cagtgagctgagatcg

SEQ ID NO: 69070 - DNA, 16 bp, H. sapiens
cagtgagctgagttcg

SEQ ID NO: 69071 - DNA, 16 bp, H. sapiens
cagtgagctgggatgg

SEQ ID NO: 69072 - DNA, 16 bp, H. sapiens
cagtgagctgtgacca

SEQ ID NO: 69073 - DNA, 16 bp, H. sapiens
cagtgagctgtgacgg

SEQ ID NO: 69074 - DNA, 16 bp, H. sapiens
cagtgaggaaactgag

SEQ ID NO: 69075 - DNA, 16 bp, H. sapiens
cagtgaggaagaccag

SEQ ID NO: 69076 - DNA, 16 bp, H. sapiens
cagtgaggcaggagaa

SEQ ID NO: 69077 - DNA, 16 bp, H. sapiens
cagtgaggccccatct

SEQ ID NO: 69078 - DNA, 16 bp, H. sapiens
cagtgaggccttgtca

SEQ ID NO: 69079 - DNA, 16 bp, H. sapiens
cagtgaggggtgtgtg

SEQ ID NO: 69080 - DNA, 16 bp, H. sapiens
cagtgagggttttcat

SEQ ID NO: 69081 - DNA, 16 bp, H. sapiens
cagtgaggtatgatca

SEQ ID NO: 69082 - DNA, 16 bp, H. sapiens
cagtgagtcaagattg

SEQ ID NO: 69083 - DNA, 16 bp, H. sapiens
cagtgagtgaagatcg

SEQ ID NO: 69084 - DNA, 16 bp, H. sapiens
cagtgagtgagtgagt

SEQ ID NO: 69085 - DNA, 16 bp, H. sapiens
cagtgatactgatttt

SEQ ID NO: 69086 - DNA, 16 bp, H. sapiens
cagtgatagtgatgat

SEQ ID NO: 69087 - DNA, 16 bp, H. sapiens
cagtgatattgattat

SEQ ID NO: 69088 - DNA, 16 bp, H. sapiens
cagtgatattttaaaa

SEQ ID NO: 69089 - DNA, 16 bp, H. sapiens
cagtgatgaaagtggg

SEQ ID NO: 69090 - DNA, 16 bp, H. sapiens
cagtgatgaacataca

SEQ ID NO: 69091 - DNA, 16 bp, H. sapiens
cagtgatgcagtcaca

SEQ ID NO: 69092 - DNA, 16 bp, H. sapiens
cagtgatgcagtcata

SEQ ID NO: 69093 - DNA, 16 bp, H. sapiens
cagtgatgccactgag

SEQ ID NO: 69094 - DNA, 16 bp, H. sapiens
cagtgatgccatcaca

SEQ ID NO: 69095 - DNA, 16 bp, H. sapiens
cagtgatggactggat

SEQ ID NO: 69096 - DNA, 16 bp, H. sapiens
cagtgattatgagctt

SEQ ID NO: 69097 - DNA, 16 bp, H. sapiens
cagtgattcacacctg

SEQ ID NO: 69098 - DNA, 16 bp, H. sapiens
cagtgattctcaaagt

SEQ ID NO: 69099 - DNA, 16 bp, H. sapiens
cagtgattctcaaatt

SEQ ID NO: 69100 - DNA, 16 bp, H. sapiens
cagtgattctcaacct

SEQ ID NO: 69101 - DNA, 16 bp, H. sapiens
cagtgatttttatttt

SEQ ID NO: 69102 - DNA, 16 bp, H. sapiens
cagtgattttttttta

SEQ ID NO: 69103 - DNA, 16 bp, H. sapiens
cagtgcaaaatggaaa

SEQ ID NO: 69104 - DNA, 16 bp, H. sapiens
cagtgcaaagtgaaaa

SEQ ID NO: 69105 - DNA, 16 bp, H. sapiens
cagtgcaacctccact

SEQ ID NO: 69106 - DNA, 16 bp, H. sapiens
cagtgcaagaatggcc

SEQ ID NO: 69107 - DNA, 16 bp, H. sapiens
cagtgcaagaattctg

SEQ ID NO: 69108 - DNA, 16 bp, H. sapiens
cagtgcaagatgtgct

SEQ ID NO: 69109 - DNA, 16 bp, H. sapiens
cagtgcaagctctgcc

SEQ ID NO: 69110 - DNA, 16 bp, H. sapiens
cagtgcaatctctgcc

SEQ ID NO: 69111 - DNA, 18 bp, H. sapiens
cagtgcaatggcacgatc

SEQ ID NO: 69112 - DNA, 16 bp, H. sapiens
cagtgcacctgtggct

SEQ ID NO: 69113 - DNA, 16 bp, H. sapiens
cagtgcaccttccagt

SEQ ID NO: 69114 - DNA, 16 bp, H. sapiens
cagtgcagtggcacag

SEQ ID NO: 69115 - DNA, 16 bp, H. sapiens
cagtgcagtggtgaga

SEQ ID NO: 69116 - DNA, 16 bp, H. sapiens
cagtgcattttaaaaa

SEQ ID NO: 69117 - DNA, 16 bp, H. sapiens
cagtgccaagcacata

SEQ ID NO: 69118 - DNA, 16 bp, H. sapiens
cagtgccacaataaac

SEQ ID NO: 69119 - DNA, 16 bp, H. sapiens
cagtgccacgatctca

SEQ ID NO: 69120 - DNA, 16 bp, H. sapiens
cagtgccagccatgga

SEQ ID NO: 69121 - DNA, 16 bp, H. sapiens
cagtgccagcccactg

SEQ ID NO: 69122 - DNA, 16 bp, H. sapiens
cagtgccaggcacagg

SEQ ID NO: 69123 - DNA, 16 bp, H. sapiens
cagtgccagggtgggc

SEQ ID NO: 69124 - DNA, 16 bp, H. sapiens
cagtgccatgctcttg

SEQ ID NO: 69125 - DNA, 16 bp, H. sapiens
cagtgccatgcttcct

SEQ ID NO: 69126 - DNA, 16 bp, H. sapiens
cagtgcccaaagtctg

SEQ ID NO: 69127 - DNA, 16 bp, H. sapiens
cagtgcccacagccct

SEQ ID NO: 69128 - DNA, 16 bp, H. sapiens
cagtgcccagcacaca

SEQ ID NO: 69129 - DNA, 16 bp, H. sapiens
cagtgcccagccctgg

SEQ ID NO: 69130 - DNA, 16 bp, H. sapiens
cagtgcccagtgccca

SEQ ID NO: 69131 - DNA, 16 bp, H. sapiens
cagtgccctagtgggg

SEQ ID NO: 69132 - DNA, 16 bp, H. sapiens
cagtgcctcacgcctg

SEQ ID NO: 69133 - DNA, 16 bp, H. sapiens
cagtgcctcatgcctg

SEQ ID NO: 69134 - DNA, 16 bp, H. sapiens
cagtgcctgacataca

SEQ ID NO: 69135 - DNA, 16 bp, H. sapiens
cagtgcctggcagaga

SEQ ID NO: 69136 - DNA, 16 bp, H. sapiens
cagtgcctggcagagt

SEQ ID NO: 69137 - DNA, 16 bp, H. sapiens
cagtgcctggcccaca

SEQ ID NO: 69138 - DNA, 16 bp, H. sapiens
cagtgcctgggaatgt

SEQ ID NO: 69139 - DNA, 16 bp, H. sapiens
cagtgcctggtacatg

SEQ ID NO: 69140 - DNA, 16 bp, H. sapiens
cagtgccttgcacaca

SEQ ID NO: 69141 - DNA, 16 bp, H. sapiens
cagtgccttgtacata

SEQ ID NO: 69142 - DNA, 16 bp, H. sapiens
cagtgcggacccaaag

SEQ ID NO: 69143 - DNA, 16 bp, H. sapiens
cagtgctcaataaatg

SEQ ID NO: 69144 - DNA, 16 bp, H. sapiens
cagtgctcacgcctgt

SEQ ID NO: 69145 - DNA, 16 bp, H. sapiens
cagtgctgaggttgag

SEQ ID NO: 69146 - DNA, 16 bp, H. sapiens
cagtgctgcaatcaca

SEQ ID NO: 69147 - DNA, 16 bp, H. sapiens
cagtgctgctgtgaac

SEQ ID NO: 69148 - DNA, 16 bp, H. sapiens
cagtgctggaggctgg

SEQ ID NO: 69149 - DNA, 16 bp, H. sapiens
cagtgctgggcacaga

SEQ ID NO: 69150 - DNA, 16 bp, H. sapiens
cagtgcttcccaaact

SEQ ID NO: 69151 - DNA, 16 bp, H. sapiens
cagtgcttcgggaggc

SEQ ID NO: 69152 - DNA, 16 bp, H. sapiens
cagtgcttgtgttcaa

SEQ ID NO: 69153 - DNA, 16 bp, H. sapiens
cagtgcttgtttagct

SEQ ID NO: 69154 - DNA, 16 bp, H. sapiens
cagtgctttacagttt

SEQ ID NO: 69155 - DNA, 16 bp, H. sapiens
cagtggaaaaatctgg

SEQ ID NO: 69156 - DNA, 16 bp, H. sapiens
cagtggaaagttttaa

SEQ ID NO: 69157 - DNA, 16 bp, H. sapiens
cagtggaacagaacag

SEQ ID NO: 69158 - DNA, 16 bp, H. sapiens
cagtggaagctgcaga

SEQ ID NO: 69159 - DNA, 16 bp, H. sapiens
cagtggaagtggctct

SEQ ID NO: 69160 - DNA, 16 bp, H. sapiens
cagtggaatattattt

SEQ ID NO: 69161 - DNA, 16 bp, H. sapiens
cagtggaatggataaa

SEQ ID NO: 69162 - DNA, 16 bp, H. sapiens
cagtggacttaaaata

SEQ ID NO: 69163 - DNA, 16 bp, H. sapiens
cagtggagaaactgag

SEQ ID NO: 69164 - DNA, 16 bp, H. sapiens
cagtggagaggggagc

SEQ ID NO: 69165 - DNA, 16 bp, H. sapiens
cagtggagaggggatg

SEQ ID NO: 69166 - DNA, 16 bp, H. sapiens
cagtggagatggggag

SEQ ID NO: 69167 - DNA, 16 bp, H. sapiens
cagtggagggtgtcca

SEQ ID NO: 69168 - DNA, 16 bp, H. sapiens
cagtggaggtggcaga

SEQ ID NO: 69169 - DNA, 16 bp, H. sapiens
cagtggagtgatcaca

SEQ ID NO: 69170 - DNA, 16 bp, H. sapiens
cagtggagtgggagag

SEQ ID NO: 69171 - DNA, 16 bp, H. sapiens
cagtggatcccgcacg

SEQ ID NO: 69172 - DNA, 16 bp, H. sapiens
cagtggatcttagctt

SEQ ID NO: 69173 - DNA, 16 bp, H. sapiens
cagtggatgaatggat

SEQ ID NO: 69174 - DNA, 16 bp, H. sapiens
cagtggcaaaatgcca

SEQ ID NO: 69175 - DNA, 16 bp, H. sapiens
cagtggcaatctcagc

SEQ ID NO: 69176 - DNA, 16 bp, H. sapiens
cagtggcacaatcaca

SEQ ID NO: 69177 - DNA, 16 bp, H. sapiens
cagtggcacaatcttt

SEQ ID NO: 69178 - DNA, 16 bp, H. sapiens
cagtggcacaatgtcg

SEQ ID NO: 69179 - DNA, 16 bp, H. sapiens
cagtggcaccatcaga

SEQ ID NO: 69180 - DNA, 16 bp, H. sapiens
cagtggcaccatctca

SEQ ID NO: 69181 - DNA, 16 bp, H. sapiens
cagtggcagatgcctg

SEQ ID NO: 69182 - DNA, 16 bp, H. sapiens
cagtggcagcagcagc

SEQ ID NO: 69183 - DNA, 16 bp, H. sapiens
cagtggcaggtgcctg

SEQ ID NO: 69184 - DNA, 16 bp, H. sapiens
cagtggcataatctta

SEQ ID NO: 69185 - DNA, 16 bp, H. sapiens
cagtggcatatgcctg

SEQ ID NO: 69186 - DNA, 16 bp, H. sapiens
cagtggcatgagcctg

SEQ ID NO: 69187 - DNA, 16 bp, H. sapiens
cagtggcatgatctcc

SEQ ID NO: 69188 - DNA, 16 bp, H. sapiens
cagtggcattcagtac

SEQ ID NO: 69189 - DNA, 16 bp, H. sapiens
cagtggcatttagcac

SEQ ID NO: 69190 - DNA, 16 bp, H. sapiens
cagtggccacatgtgg

SEQ ID NO: 69191 - DNA, 16 bp, H. sapiens
cagtggccagacccca

SEQ ID NO: 69192 - DNA, 16 bp, H. sapiens
cagtggccaggtgcag

SEQ ID NO: 69193 - DNA, 16 bp, H. sapiens
cagtggcccaggcctg

SEQ ID NO: 69194 - DNA, 16 bp, H. sapiens
cagtggcccatgcctg

SEQ ID NO: 69195 - DNA, 16 bp, H. sapiens
cagtggccccatctca

SEQ ID NO: 69196 - DNA, 16 bp, H. sapiens
cagtggcctgatctgg

SEQ ID NO: 69197 - DNA, 16 bp, H. sapiens
cagtggcctgtgcctg

SEQ ID NO: 69198 - DNA, 16 bp, H. sapiens
cagtggcgagatcttg

SEQ ID NO: 69199 - DNA, 20 bp, H. sapiens
cagtggcgcgatctcagctc

SEQ ID NO: 69200 - DNA, 16 bp, H. sapiens
cagtggctcaagcctg

SEQ ID NO: 69201 - DNA, 16 bp, H. sapiens
cagtggctcacaccta

SEQ ID NO: 69202 - DNA, 16 bp, H. sapiens
cagtggctcacacctg

SEQ ID NO: 69203 - DNA, 16 bp, H. sapiens
cagtggctcacatctg

SEQ ID NO: 69204 - DNA, 16 bp, H. sapiens
cagtggctcacccctg

SEQ ID NO: 69205 - DNA, 16 bp, H. sapiens
cagtggctcacctctg

SEQ ID NO: 69206 - DNA, 16 bp, H. sapiens
cagtggctcacgccag

SEQ ID NO: 69207 - DNA, 16 bp, H. sapiens
cagtggctcacgccta

SEQ ID NO: 69208 - DNA, 16 bp, H. sapiens
cagtggctcacgcctg

SEQ ID NO: 69209 - DNA, 19 bp, H. sapiens
cagtggctcacgcctgtaa

SEQ ID NO: 69210 - DNA, 16 bp, H. sapiens
cagtggctcacgcttg

SEQ ID NO: 69211 - DNA, 16 bp, H. sapiens
cagtggctcacgtctg

SEQ ID NO: 69212 - DNA, 16 bp, H. sapiens
cagtggctcactcctg

SEQ ID NO: 69213 - DNA, 16 bp, H. sapiens
cagtggctcatgccta

SEQ ID NO: 69214 - DNA, 16 bp, H. sapiens
cagtggctcatgcctg

SEQ ID NO: 69215 - DNA, 16 bp, H. sapiens
cagtggctcatgctgt

SEQ ID NO: 69216 - DNA, 16 bp, H. sapiens
cagtggctcatgcttg

SEQ ID NO: 69217 - DNA, 17 bp, H. sapiens
cagtggctccatcacag

SEQ ID NO: 69218 - DNA, 16 bp, H. sapiens
cagtggctcccagcac

SEQ ID NO: 69219 - DNA, 16 bp, H. sapiens
cagtggctcctacctg

SEQ ID NO: 69220 - DNA, 16 bp, H. sapiens
cagtggctcgcacctg

SEQ ID NO: 69221 - DNA, 16 bp, H. sapiens
cagtggctgatacctg

SEQ ID NO: 69222 - DNA, 16 bp, H. sapiens
cagtggctgatgcctg

SEQ ID NO: 69223 - DNA, 16 bp, H. sapiens
cagtggctgcagaata

SEQ ID NO: 69224 - DNA, 16 bp, H. sapiens
cagtggctgcagaggg

SEQ ID NO: 69225 - DNA, 16 bp, H. sapiens
cagtggctggcacatg

SEQ ID NO: 69226 - DNA, 17 bp, H. sapiens
cagtggctgtagaacag

SEQ ID NO: 69227 - DNA, 16 bp, H. sapiens
cagtggctgtggaggg

SEQ ID NO: 69228 - DNA, 16 bp, H. sapiens
cagtggcttaacacaa

SEQ ID NO: 69229 - DNA, 16 bp, H. sapiens
cagtggcttacacctg

SEQ ID NO: 69230 - DNA, 16 bp, H. sapiens
cagtggcttacgcctg

SEQ ID NO: 69231 - DNA, 16 bp, H. sapiens
cagtggcttaggcctg

SEQ ID NO: 69232 - DNA, 16 bp, H. sapiens
cagtggcttatacctg

SEQ ID NO: 69233 - DNA, 16 bp, H. sapiens
cagtggcttatgcctg

SEQ ID NO: 69234 - DNA, 16 bp, H. sapiens
cagtggctttgccaag

SEQ ID NO: 69235 - DNA, 16 bp, H. sapiens
cagtgggaaaaaaaat

SEQ ID NO: 69236 - DNA, 16 bp, H. sapiens
cagtgggaggggcagg

SEQ ID NO: 69237 - DNA, 16 bp, H. sapiens
cagtgggaggtaatta

SEQ ID NO: 69238 - DNA, 16 bp, H. sapiens
cagtgggatccctgag

SEQ ID NO: 69239 - DNA, 16 bp, H. sapiens
cagtgggatgaggctg

SEQ ID NO: 69240 - DNA, 16 bp, H. sapiens
cagtgggatggctgga

SEQ ID NO: 69241 - DNA, 16 bp, H. sapiens
cagtgggcacaggtca

SEQ ID NO: 69242 - DNA, 16 bp, H. sapiens
cagtgggcagaacttc

SEQ ID NO: 69243 - DNA, 16 bp, H. sapiens
cagtgggcagaacttt

SEQ ID NO: 69244 - DNA, 16 bp, H. sapiens
cagtgggcagctgggc

SEQ ID NO: 69245 - DNA, 16 bp, H. sapiens
cagtgggcaggaagaa

SEQ ID NO: 69246 - DNA, 16 bp, H. sapiens
cagtgggcatccttgt

SEQ ID NO: 69247 - DNA, 16 bp, H. sapiens
cagtgggcccaagcaa

SEQ ID NO: 69248 - DNA, 17 bp, H. sapiens
cagtgggcccatgaaca

SEQ ID NO: 69249 - DNA, 16 bp, H. sapiens
cagtgggctctgccca

SEQ ID NO: 69250 - DNA, 16 bp, H. sapiens
cagtgggctggagaag

SEQ ID NO: 69251 - DNA, 16 bp, H. sapiens
cagtggggaagggaaa

SEQ ID NO: 69252 - DNA, 16 bp, H. sapiens
cagtggggaccctgtg

SEQ ID NO: 69253 - DNA, 16 bp, H. sapiens
cagtggggactctggg

SEQ ID NO: 69254 - DNA, 16 bp, H. sapiens
cagtggggagaaacct

SEQ ID NO: 69255 - DNA, 16 bp, H. sapiens
cagtggggctgccaca

SEQ ID NO: 69256 - DNA, 16 bp, H. sapiens
cagtgggtgcagctca

SEQ ID NO: 69257 - DNA, 16 bp, H. sapiens
cagtgggtgcagtgca

SEQ ID NO: 69258 - DNA, 16 bp, H. sapiens
cagtgggtgcctgtaa

SEQ ID NO: 69259 - DNA, 16 bp, H. sapiens
cagtggtaacatcttg

SEQ ID NO: 69260 - DNA, 16 bp, H. sapiens
cagtggtatgacctca

SEQ ID NO: 69261 - DNA, 16 bp, H. sapiens
cagtggtatgattttg

SEQ ID NO: 69262 - DNA, 16 bp, H. sapiens
cagtggtcccataaga

SEQ ID NO: 69263 - DNA, 16 bp, H. sapiens
cagtggtccccagcct

SEQ ID NO: 69264 - DNA, 16 bp, H. sapiens
cagtggtgaaagactg

SEQ ID NO: 69265 - DNA, 16 bp, H. sapiens
cagtggtgaaagtggg

SEQ ID NO: 69266 - DNA, 16 bp, H. sapiens
cagtggtgaaatcttg

SEQ ID NO: 69267 - DNA, 16 bp, H. sapiens
cagtggtgacagtggg

SEQ ID NO: 69268 - DNA, 16 bp, H. sapiens
cagtggtgacatcccc

SEQ ID NO: 69269 - DNA, 16 bp, H. sapiens
cagtggtgcaaactca

SEQ ID NO: 69270 - DNA, 16 bp, H. sapiens
cagtggtgcaagcata

SEQ ID NO: 69271 - DNA, 16 bp, H. sapiens
cagtggtggaggtggg

SEQ ID NO: 69272 - DNA, 16 bp, H. sapiens
cagtggtgtgagcctg

SEQ ID NO: 69273 - DNA, 16 bp, H. sapiens
cagtggtgtgattgca

SEQ ID NO: 69274 - DNA, 16 bp, H. sapiens
cagtggtgtggggcct

SEQ ID NO: 69275 - DNA, 16 bp, H. sapiens
cagtggttcacacctg

SEQ ID NO: 69276 - DNA, 16 bp, H. sapiens
cagtggttcatgcctg

SEQ ID NO: 69277 - DNA, 16 bp, H. sapiens
cagtggttctcaaaat

SEQ ID NO: 69278 - DNA, 16 bp, H. sapiens
cagtggttctcaacca

SEQ ID NO: 69279 - DNA, 16 bp, H. sapiens
cagtggttctcagagt

SEQ ID NO: 69280 - DNA, 16 bp, H. sapiens
cagtggttctcagtct

SEQ ID NO: 69281 - DNA, 16 bp, H. sapiens
cagtggttggaacttg

SEQ ID NO: 69282 - DNA, 16 bp, H. sapiens
cagtggtttaaaacaa

SEQ ID NO: 69283 - DNA, 16 bp, H. sapiens
cagtggtttgttcctt

SEQ ID NO: 69284 - DNA, 16 bp, H. sapiens
cagtggttttattttt

SEQ ID NO: 69285 - DNA, 16 bp, H. sapiens
cagtggttttcaaact

SEQ ID NO: 69286 - DNA, 16 bp, H. sapiens
cagtgtaaaagtgctc

SEQ ID NO: 69287 - DNA, 16 bp, H. sapiens
cagtgtaaaagtgttt

SEQ ID NO: 69288 - DNA, 16 bp, H. sapiens
cagtgtaaaatgttcc

SEQ ID NO: 69289 - DNA, 16 bp, H. sapiens
cagtgtaacctctgcc

SEQ ID NO: 69290 - DNA, 16 bp, H. sapiens
cagtgtacagcagcag

SEQ ID NO: 69291 - DNA, 16 bp, H. sapiens
cagtgtatactgctca

SEQ ID NO: 69292 - DNA, 16 bp, H. sapiens
cagtgtccaggagaca

SEQ ID NO: 69293 - DNA, 16 bp, H. sapiens
cagtgtccaggaggaa

SEQ ID NO: 69294 - DNA, 16 bp, H. sapiens
cagtgtcccagtgtcc

SEQ ID NO: 69295 - DNA, 16 bp, H. sapiens
cagtgtccccactggg

SEQ ID NO: 69296 - DNA, 16 bp, H. sapiens
cagtgtccccatctgt

SEQ ID NO: 69297 - DNA, 16 bp, H. sapiens
cagtgtcctcacctgt

SEQ ID NO: 69298 - DNA, 16 bp, H. sapiens
cagtgtcctcagcttc

SEQ ID NO: 69299 - DNA, 16 bp, H. sapiens
cagtgtcctctggaaa

SEQ ID NO: 69300 - DNA, 16 bp, H. sapiens
cagtgtctcacacctg

SEQ ID NO: 69301 - DNA, 16 bp, H. sapiens
cagtgtctcatgcctg

SEQ ID NO: 69302 - DNA, 16 bp, H. sapiens
cagtgtctctctctct

SEQ ID NO: 69303 - DNA, 16 bp, H. sapiens
cagtgtctcttgttcc

SEQ ID NO: 69304 - DNA, 16 bp, H. sapiens
cagtgtctctttcagt

SEQ ID NO: 69305 - DNA, 16 bp, H. sapiens
cagtgtcttctcagaa

SEQ ID NO: 69306 - DNA, 16 bp, H. sapiens
cagtgtgaatatactt

SEQ ID NO: 69307 - DNA, 16 bp, H. sapiens
cagtgtgacctgaatg

SEQ ID NO: 69308 - DNA, 16 bp, H. sapiens
cagtgtgaccttgagc

SEQ ID NO: 69309 - DNA, 16 bp, H. sapiens
cagtgtgactggaata

SEQ ID NO: 69310 - DNA, 16 bp, H. sapiens
cagtgtgatctcagct

SEQ ID NO: 69311 - DNA, 16 bp, H. sapiens
cagtgtggaagaggac

SEQ ID NO: 69312 - DNA, 16 bp, H. sapiens
cagtgtggagattcct

SEQ ID NO: 69313 - DNA, 18 bp, H. sapiens
cagtgtggcaattcctca

SEQ ID NO: 69314 - DNA, 16 bp, H. sapiens
cagtgtggcagtgttg

SEQ ID NO: 69315 - DNA, 16 bp, H. sapiens
cagtgtggcatttcct

SEQ ID NO: 69316 - DNA, 18 bp, H. sapiens
cagtgtggcgattcctca

SEQ ID NO: 69317 - DNA, 17 bp, H. sapiens
cagtgtggcgattcttc

SEQ ID NO: 69318 - DNA, 16 bp, H. sapiens
cagtgtggctggagca

SEQ ID NO: 69319 - DNA, 16 bp, H. sapiens
cagtgtggctggagcc

SEQ ID NO: 69320 - DNA, 16 bp, H. sapiens
cagtgtggctggaggg

SEQ ID NO: 69321 - DNA, 16 bp, H. sapiens
cagtgtgggagcaggc

SEQ ID NO: 69322 - DNA, 16 bp, H. sapiens
cagtgtggtgattact

SEQ ID NO: 69323 - DNA, 18 bp, H. sapiens
cagtgtggtgattcctca

SEQ ID NO: 69324 - DNA, 16 bp, H. sapiens
cagtgtggtgctgctg

SEQ ID NO: 69325 - DNA, 16 bp, H. sapiens
cagtgtgtaagtgttt

SEQ ID NO: 69326 - DNA, 16 bp, H. sapiens
cagtgtgtcctggatg

SEQ ID NO: 69327 - DNA, 16 bp, H. sapiens
cagtgtgtgacgttcc

SEQ ID NO: 69328 - DNA, 16 bp, H. sapiens
cagtgtgtggaggctc

SEQ ID NO: 69329 - DNA, 16 bp, H. sapiens
cagtgtgtgtatgtgt

SEQ ID NO: 69330 - DNA, 16 bp, H. sapiens
cagtgtgtgtgtgtgc

SEQ ID NO: 69331 - DNA, 16 bp, H. sapiens
cagtgtgtttttgcag

SEQ ID NO: 69332 - DNA, 16 bp, H. sapiens
cagtgttagaggtggg

SEQ ID NO: 69333 - DNA, 16 bp, H. sapiens
cagtgttataatattc

SEQ ID NO: 69334 - DNA, 16 bp, H. sapiens
cagtgttatggaaaaa

SEQ ID NO: 69335 - DNA, 16 bp, H. sapiens
cagtgttcaagggcag

SEQ ID NO: 69336 - DNA, 16 bp, H. sapiens
cagtgttctttccact

SEQ ID NO: 69337 - DNA, 16 bp, H. sapiens
cagtgttctttctact

SEQ ID NO: 69338 - DNA, 16 bp, H. sapiens
cagtgttggaggaagg

SEQ ID NO: 69339 - DNA, 16 bp, H. sapiens
cagtgttggaggagga

SEQ ID NO: 69340 - DNA, 16 bp, H. sapiens
cagtgttgggattaca

SEQ ID NO: 69341 - DNA, 16 bp, H. sapiens
cagtgttgggattata

SEQ ID NO: 69342 - DNA, 16 bp, H. sapiens
cagtgtttcactgtgt

SEQ ID NO: 69343 - DNA, 16 bp, H. sapiens
cagtgtttccaaactg

SEQ ID NO: 69344 - DNA, 16 bp, H. sapiens
cagtgtttctcaaaat

SEQ ID NO: 69345 - DNA, 16 bp, H. sapiens
cagtgtttctttaaaa

SEQ ID NO: 69346 - DNA, 16 bp, H. sapiens
cagtgtttgttgaatg

SEQ ID NO: 69347 - DNA, 16 bp, H. sapiens
cagtgttttatacttt

SEQ ID NO: 69348 - DNA, 16 bp, H. sapiens
cagtgttttatttctt

SEQ ID NO: 69349 - DNA, 16 bp, H. sapiens
cagtgttttctctcaa

SEQ ID NO: 69350 - DNA, 16 bp, H. sapiens
cagtgttttgtacttc

SEQ ID NO: 69351 - DNA, 16 bp, H. sapiens
cagtgttttgtagctc

SEQ ID NO: 69352 - DNA, 16 bp, H. sapiens
cagttaaaacaaacaa

SEQ ID NO: 69353 - DNA, 16 bp, H. sapiens
cagttaaaatggttta

SEQ ID NO: 69354 - DNA, 16 bp, H. sapiens
cagttaacacaatcat

SEQ ID NO: 69355 - DNA, 16 bp, H. sapiens
cagttaagaaccactg

SEQ ID NO: 69356 - DNA, 16 bp, H. sapiens
cagttaattaattaat

SEQ ID NO: 69357 - DNA, 16 bp, H. sapiens
cagttacaaaaggaca

SEQ ID NO: 69358 - DNA, 16 bp, H. sapiens
cagttacagtgtgact

SEQ ID NO: 69359 - DNA, 16 bp, H. sapiens
cagttacctgtggtca

SEQ ID NO: 69360 - DNA, 16 bp, H. sapiens
cagttacttcctccac

SEQ ID NO: 69361 - DNA, 16 bp, H. sapiens
cagttactttttaaaa

SEQ ID NO: 69362 - DNA, 16 bp, H. sapiens
cagttagatagaagaa

SEQ ID NO: 69363 - DNA, 16 bp, H. sapiens
cagttagccaagttgt

SEQ ID NO: 69364 - DNA, 16 bp, H. sapiens
cagttagtggcagagc

SEQ ID NO: 69365 - DNA, 17 bp, H. sapiens
cagttatccagaggcct

SEQ ID NO: 69366 - DNA, 16 bp, H. sapiens
cagttatctattgttg

SEQ ID NO: 69367 - DNA, 16 bp, H. sapiens
cagttatgttctatct

SEQ ID NO: 69368 - DNA, 16 bp, H. sapiens
cagttattacattttt

SEQ ID NO: 69369 - DNA, 16 bp, H. sapiens
cagttcaaacccctgt

SEQ ID NO: 69370 - DNA, 16 bp, H. sapiens
cagttcaaacccgtgt

SEQ ID NO: 69371 - DNA, 16 bp, H. sapiens
cagttcaacatggctg

SEQ ID NO: 69372 - DNA, 16 bp, H. sapiens
cagttcaagtccaaag

SEQ ID NO: 69373 - DNA, 16 bp, H. sapiens
cagttcactttttttt

SEQ ID NO: 69374 - DNA, 16 bp, H. sapiens
cagttcagaaaaaaaa

SEQ ID NO: 69375 - DNA, 16 bp, H. sapiens
cagttcagaagcctca

SEQ ID NO: 69376 - DNA, 16 bp, H. sapiens
cagttcagactagcca

SEQ ID NO: 69377 - DNA, 16 bp, H. sapiens
cagttcagcacggctg

SEQ ID NO: 69378 - DNA, 16 bp, H. sapiens
cagttcaggctgctgt

SEQ ID NO: 69379 - DNA, 16 bp, H. sapiens
cagttcagtgagtttt

SEQ ID NO: 69380 - DNA, 16 bp, H. sapiens
cagttcatctcactgg

SEQ ID NO: 69381 - DNA, 16 bp, H. sapiens
cagttcatttcttttt

SEQ ID NO: 69382 - DNA, 16 bp, H. sapiens
cagttccagaatttct

SEQ ID NO: 69383 - DNA, 16 bp, H. sapiens
cagttccaggagcttt

SEQ ID NO: 69384 - DNA, 16 bp, H. sapiens
cagttcccaacaagtt

SEQ ID NO: 69385 - DNA, 16 bp, H. sapiens
cagttcccagacgggg

SEQ ID NO: 69386 - DNA, 16 bp, H. sapiens
cagttcccaggaattc

SEQ ID NO: 69387 - DNA, 16 bp, H. sapiens
cagttccccagcaaag

SEQ ID NO: 69388 - DNA, 17 bp, H. sapiens
cagttcctcaccagcaa

SEQ ID NO: 69389 - DNA, 16 bp, H. sapiens
cagttcctcagggctg

SEQ ID NO: 69390 - DNA, 16 bp, H. sapiens
cagttcctcagtcaca

SEQ ID NO: 69391 - DNA, 16 bp, H. sapiens
cagttcctcatgcaaa

SEQ ID NO: 69392 - DNA, 16 bp, H. sapiens
cagttcctgggccaaa

SEQ ID NO: 69393 - DNA, 16 bp, H. sapiens
cagttcctgtttctgt

SEQ ID NO: 69394 - DNA, 16 bp, H. sapiens
cagttccttgcagctg

SEQ ID NO: 69395 - DNA, 16 bp, H. sapiens
cagttctacgtggctg

SEQ ID NO: 69396 - DNA, 16 bp, H. sapiens
cagttctcagatctcc

SEQ ID NO: 69397 - DNA, 16 bp, H. sapiens
cagttctccaaagaag

SEQ ID NO: 69398 - DNA, 16 bp, H. sapiens
cagttctcctagcacc

SEQ ID NO: 69399 - DNA, 16 bp, H. sapiens
cagttctcctgggagg

SEQ ID NO: 69400 - DNA, 16 bp, H. sapiens
cagttctcctgtgtca

SEQ ID NO: 69401 - DNA, 16 bp, H. sapiens
cagttctctgcctcag

SEQ ID NO: 69402 - DNA, 16 bp, H. sapiens
cagttctgaaagctgg

SEQ ID NO: 69403 - DNA, 16 bp, H. sapiens
cagttctgcagggctg

SEQ ID NO: 69404 - DNA, 16 bp, H. sapiens
cagttctgcagggtgt

SEQ ID NO: 69405 - DNA, 16 bp, H. sapiens
cagttctggagcctgg

SEQ ID NO: 69406 - DNA, 16 bp, H. sapiens
cagttctggagttcag

SEQ ID NO: 69407 - DNA, 16 bp, H. sapiens
cagttctgtgaatttt

SEQ ID NO: 69408 - DNA, 16 bp, H. sapiens
cagttctgttttaagt

SEQ ID NO: 69409 - DNA, 16 bp, H. sapiens
cagttcttagatattc

SEQ ID NO: 69410 - DNA, 16 bp, H. sapiens
cagttcttcagaaatt

SEQ ID NO: 69411 - DNA, 16 bp, H. sapiens
cagttcttccagcacc

SEQ ID NO: 69412 - DNA, 16 bp, H. sapiens
cagttcttccagtgtg

SEQ ID NO: 69413 - DNA, 16 bp, H. sapiens
cagttcttcctcccac

SEQ ID NO: 69414 - DNA, 16 bp, H. sapiens
cagttcttgaggctgg

SEQ ID NO: 69415 - DNA, 16 bp, H. sapiens
cagttctttgcctcag

SEQ ID NO: 69416 - DNA, 16 bp, H. sapiens
cagttctttgttcaag

SEQ ID NO: 69417 - DNA, 16 bp, H. sapiens
cagttcttttatttat

SEQ ID NO: 69418 - DNA, 16 bp, H. sapiens
cagttctttttcctct

SEQ ID NO: 69419 - DNA, 16 bp, H. sapiens
cagttgaaaatctgtg

SEQ ID NO: 69420 - DNA, 16 bp, H. sapiens
cagttgacccttgagc

SEQ ID NO: 69421 - DNA, 16 bp, H. sapiens
cagttgactcttcctt

SEQ ID NO: 69422 - DNA, 16 bp, H. sapiens
cagttgagaaacactg

SEQ ID NO: 69423 - DNA, 16 bp, H. sapiens
cagttgatccacctgc

SEQ ID NO: 69424 - DNA, 16 bp, H. sapiens
cagttgatgctgaaaa

SEQ ID NO: 69425 - DNA, 16 bp, H. sapiens
cagttgattaacacat

SEQ ID NO: 69426 - DNA, 16 bp, H. sapiens
cagttgctcacacctg

SEQ ID NO: 69427 - DNA, 16 bp, H. sapiens
cagttgctccagcacc

SEQ ID NO: 69428 - DNA, 16 bp, H. sapiens
cagttgcttttctttt

SEQ ID NO: 69429 - DNA, 16 bp, H. sapiens
cagttggaaatggaga

SEQ ID NO: 69430 - DNA, 16 bp, H. sapiens
cagttggagcttccca

SEQ ID NO: 69431 - DNA, 16 bp, H. sapiens
cagttggatcacaagg

SEQ ID NO: 69432 - DNA, 16 bp, H. sapiens
cagttggccaggcaca

SEQ ID NO: 69433 - DNA, 16 bp, H. sapiens
cagttggctgttaagt

SEQ ID NO: 69434 - DNA, 16 bp, H. sapiens
cagttgtaataaatgt

SEQ ID NO: 69435 - DNA, 16 bp, H. sapiens
cagttgtcctccaaaa

SEQ ID NO: 69436 - DNA, 16 bp, H. sapiens
cagttgtgacaataaa

SEQ ID NO: 69437 - DNA, 16 bp, H. sapiens
cagttgttaaacattt

SEQ ID NO: 69438 - DNA, 16 bp, H. sapiens
cagttgttcattcatt

SEQ ID NO: 69439 - DNA, 16 bp, H. sapiens
cagttgttcgagacca

SEQ ID NO: 69440 - DNA, 16 bp, H. sapiens
cagttgtttatatttt

SEQ ID NO: 69441 - DNA, 16 bp, H. sapiens
cagttgtttctttcca

SEQ ID NO: 69442 - DNA, 16 bp, H. sapiens
cagttgttttcagaca

SEQ ID NO: 69443 - DNA, 16 bp, H. sapiens
cagtttaaaacttatg

SEQ ID NO: 69444 - DNA, 16 bp, H. sapiens
cagtttaaagaagaac

SEQ ID NO: 69445 - DNA, 16 bp, H. sapiens
cagtttaaatgataat

SEQ ID NO: 69446 - DNA, 16 bp, H. sapiens
cagtttaagttttctg

SEQ ID NO: 69447 - DNA, 16 bp, H. sapiens
cagtttaattttaaaa

SEQ ID NO: 69448 - DNA, 16 bp, H. sapiens
cagtttacaaagcact

SEQ ID NO: 69449 - DNA, 16 bp, H. sapiens
cagtttacaaatgcca

SEQ ID NO: 69450 - DNA, 16 bp, H. sapiens
cagtttacagatgcca

SEQ ID NO: 69451 - DNA, 16 bp, H. sapiens
cagtttatagatgagg

SEQ ID NO: 69452 - DNA, 16 bp, H. sapiens
cagtttatatttttgt

SEQ ID NO: 69453 - DNA, 16 bp, H. sapiens
cagtttatgcagaaat

SEQ ID NO: 69454 - DNA, 16 bp, H. sapiens
cagtttcaaaaaaaaa

SEQ ID NO: 69455 - DNA, 16 bp, H. sapiens
cagtttcagaatttct

SEQ ID NO: 69456 - DNA, 16 bp, H. sapiens
cagtttcattattcta

SEQ ID NO: 69457 - DNA, 16 bp, H. sapiens
cagtttcattgatttt

SEQ ID NO: 69458 - DNA, 16 bp, H. sapiens
cagtttcattgttctg

SEQ ID NO: 69459 - DNA, 16 bp, H. sapiens
cagtttcatttaagaa

SEQ ID NO: 69460 - DNA, 16 bp, H. sapiens
cagtttccacctatga

SEQ ID NO: 69461 - DNA, 16 bp, H. sapiens
cagtttccccacctgt

SEQ ID NO: 69462 - DNA, 16 bp, H. sapiens
cagtttcccctatgct

SEQ ID NO: 69463 - DNA, 16 bp, H. sapiens
cagtttccctatctgt

SEQ ID NO: 69464 - DNA, 16 bp, H. sapiens
cagtttcctcagctct

SEQ ID NO: 69465 - DNA, 16 bp, H. sapiens
cagtttccttccttcc

SEQ ID NO: 69466 - DNA, 16 bp, H. sapiens
cagtttccttccttct

SEQ ID NO: 69467 - DNA, 16 bp, H. sapiens
cagtttcgccatgttg

SEQ ID NO: 69468 - DNA, 16 bp, H. sapiens
cagtttctacattttt

SEQ ID NO: 69469 - DNA, 16 bp, H. sapiens
cagtttctattgttcc

SEQ ID NO: 69470 - DNA, 16 bp, H. sapiens
cagtttctcacctgta

SEQ ID NO: 69471 - DNA, 16 bp, H. sapiens
cagtttctcagaaaga

SEQ ID NO: 69472 - DNA, 16 bp, H. sapiens
cagtttctcagaataa

SEQ ID NO: 69473 - DNA, 16 bp, H. sapiens
cagtttctctccattt

SEQ ID NO: 69474 - DNA, 16 bp, H. sapiens
cagtttctctgcatct

SEQ ID NO: 69475 - DNA, 16 bp, H. sapiens
cagtttctggcacata

SEQ ID NO: 69476 - DNA, 16 bp, H. sapiens
cagtttctggtatttt

SEQ ID NO: 69477 - DNA, 16 bp, H. sapiens
cagtttcttaaaataa

SEQ ID NO: 69478 - DNA, 16 bp, H. sapiens
cagtttcttaaaatgt

SEQ ID NO: 69479 - DNA, 16 bp, H. sapiens
cagtttcttcattaga

SEQ ID NO: 69480 - DNA, 16 bp, H. sapiens
cagtttcttcctcttt

SEQ ID NO: 69481 - DNA, 16 bp, H. sapiens
cagtttctttatctgc

SEQ ID NO: 69482 - DNA, 16 bp, H. sapiens
cagtttgaaaaatatt

SEQ ID NO: 69483 - DNA, 16 bp, H. sapiens
cagtttgacttcctct

SEQ ID NO: 69484 - DNA, 16 bp, H. sapiens
cagtttgagaaataaa

SEQ ID NO: 69485 - DNA, 17 bp, H. sapiens
cagtttgagactagcct

SEQ ID NO: 69486 - DNA, 16 bp, H. sapiens
cagtttgagaggccga

SEQ ID NO: 69487 - DNA, 16 bp, H. sapiens
cagtttgccacagtcc

SEQ ID NO: 69488 - DNA, 16 bp, H. sapiens
cagtttgcctgggact

SEQ ID NO: 69489 - DNA, 16 bp, H. sapiens
cagtttgctcagaatg

SEQ ID NO: 69490 - DNA, 16 bp, H. sapiens
cagtttggaaaaagtc

SEQ ID NO: 69491 - DNA, 16 bp, H. sapiens
cagtttggaacttcct

SEQ ID NO: 69492 - DNA, 16 bp, H. sapiens
cagtttggaaggctca

SEQ ID NO: 69493 - DNA, 16 bp, H. sapiens
cagtttggatatttct

SEQ ID NO: 69494 - DNA, 16 bp, H. sapiens
cagtttggatgtcttt

SEQ ID NO: 69495 - DNA, 16 bp, H. sapiens
cagtttggcaattttt

SEQ ID NO: 69496 - DNA, 16 bp, H. sapiens
cagtttggcgatttct

SEQ ID NO: 69497 - DNA, 16 bp, H. sapiens
cagtttgggaagatgg

SEQ ID NO: 69498 - DNA, 16 bp, H. sapiens
cagtttgtgataattt

SEQ ID NO: 69499 - DNA, 16 bp, H. sapiens
cagttttaaaaatatt

SEQ ID NO: 69500 - DNA, 16 bp, H. sapiens
cagttttaaaaggaaa

SEQ ID NO: 69501 - DNA, 16 bp, H. sapiens
cagttttaaattttat

SEQ ID NO: 69502 - DNA, 16 bp, H. sapiens
cagttttatacatttt

SEQ ID NO: 69503 - DNA, 16 bp, H. sapiens
cagttttatttttata

SEQ ID NO: 69504 - DNA, 16 bp, H. sapiens
cagttttcaaaaagaa

SEQ ID NO: 69505 - DNA, 16 bp, H. sapiens
cagttttcaaaataat

SEQ ID NO: 69506 - DNA, 16 bp, H. sapiens
cagttttcctcttttt

SEQ ID NO: 69507 - DNA, 16 bp, H. sapiens
cagttttctcagtacc

SEQ ID NO: 69508 - DNA, 16 bp, H. sapiens
cagttttctcatttat

SEQ ID NO: 69509 - DNA, 16 bp, H. sapiens
cagttttctcatttgt

SEQ ID NO: 69510 - DNA, 16 bp, H. sapiens
cagttttctcctctgc

SEQ ID NO: 69511 - DNA, 16 bp, H. sapiens
cagttttctgcaaatg

SEQ ID NO: 69512 - DNA, 16 bp, H. sapiens
cagttttcttatatat

SEQ ID NO: 69513 - DNA, 16 bp, H. sapiens
cagttttcttttgatt

SEQ ID NO: 69514 - DNA, 16 bp, H. sapiens
cagttttgagtgaatt

SEQ ID NO: 69515 - DNA, 16 bp, H. sapiens
cagttttgcctttttc

SEQ ID NO: 69516 - DNA, 16 bp, H. sapiens
cagttttggaggctga

SEQ ID NO: 69517 - DNA, 16 bp, H. sapiens
cagttttggaggctgg

SEQ ID NO: 69518 - DNA, 16 bp, H. sapiens
cagttttggaggttgg

SEQ ID NO: 69519 - DNA, 16 bp, H. sapiens
cagttttgtgtccttg

SEQ ID NO: 69520 - DNA, 16 bp, H. sapiens
cagttttgtttccttg

SEQ ID NO: 69521 - DNA, 16 bp, H. sapiens
cagttttgttttaaaa

SEQ ID NO: 69522 - DNA, 16 bp, H. sapiens
cagtttttaaaaatca

SEQ ID NO: 69523 - DNA, 16 bp, H. sapiens
cagtttttaaagggaa

SEQ ID NO: 69524 - DNA, 16 bp, H. sapiens
cagtttttatagtttt

SEQ ID NO: 69525 - DNA, 16 bp, H. sapiens
cagtttttcaggttaa

SEQ ID NO: 69526 - DNA, 16 bp, H. sapiens
cagtttttcatgtttg

SEQ ID NO: 69527 - DNA, 16 bp, H. sapiens
cagtttttccaggtgc

SEQ ID NO: 69528 - DNA, 16 bp, H. sapiens
cagtttttcctcattt

SEQ ID NO: 69529 - DNA, 16 bp, H. sapiens
cagtttttctgccctg

SEQ ID NO: 69530 - DNA, 16 bp, H. sapiens
cagtttttctgctctg

SEQ ID NO: 69531 - DNA, 16 bp, H. sapiens
cagtttttcttttgct

SEQ ID NO: 69532 - DNA, 16 bp, H. sapiens
cagtttttgtttatct

SEQ ID NO: 69533 - DNA, 16 bp, H. sapiens
cagtttttttgaattt

SEQ ID NO: 69534 - DNA, 16 bp, H. sapiens
cagttttttttccatt

SEQ ID NO: 69535 - DNA, 16 bp, H. sapiens
cagttttttttttaaa

SEQ ID NO: 69536 - DNA, 16 bp, H. sapiens
cataaaaaatggaaag

SEQ ID NO: 69537 - DNA, 16 bp, H. sapiens
cataaaaagagaatga

SEQ ID NO: 69538 - DNA, 16 bp, H. sapiens
cataaaaatacacagg

SEQ ID NO: 69539 - DNA, 16 bp, H. sapiens
cataaaaatcacatca

SEQ ID NO: 69540 - DNA, 16 bp, H. sapiens
cataaaaatgaatgag

SEQ ID NO: 69541 - DNA, 16 bp, H. sapiens
cataaaaatggacaat

SEQ ID NO: 69542 - DNA, 16 bp, H. sapiens
cataaaaatgttcata

SEQ ID NO: 69543 - DNA, 16 bp, H. sapiens
cataaaaatttgaaaa

SEQ ID NO: 69544 - DNA, 16 bp, H. sapiens
cataaaacaaagtttg

SEQ ID NO: 69545 - DNA, 16 bp, H. sapiens
cataaaacaaagtttt

SEQ ID NO: 69546 - DNA, 16 bp, H. sapiens
cataaaacaaccagaa

SEQ ID NO: 69547 - DNA, 16 bp, H. sapiens
cataaaacatgttttt

SEQ ID NO: 69548 - DNA, 16 bp, H. sapiens
cataaaagaagacata

SEQ ID NO: 69549 - DNA, 16 bp, H. sapiens
cataaaagataatttt

SEQ ID NO: 69550 - DNA, 16 bp, H. sapiens
cataaaagatgaaaga

SEQ ID NO: 69551 - DNA, 16 bp, H. sapiens
cataaaagttcagaaa

SEQ ID NO: 69552 - DNA, 16 bp, H. sapiens
cataaaagtttggaaa

SEQ ID NO: 69553 - DNA, 16 bp, H. sapiens
cataaaatagaatgaa

SEQ ID NO: 69554 - DNA, 16 bp, H. sapiens
cataaaatattttcct

SEQ ID NO: 69555 - DNA, 16 bp, H. sapiens
cataaaatgaattaga

SEQ ID NO: 69556 - DNA, 16 bp, H. sapiens
cataaaatgtatttct

SEQ ID NO: 69557 - DNA, 16 bp, H. sapiens
cataaaatgtgtaatg

SEQ ID NO: 69558 - DNA, 16 bp, H. sapiens
cataaaatgttttctt

SEQ ID NO: 69559 - DNA, 16 bp, H. sapiens
cataaaattaatcatt

SEQ ID NO: 69560 - DNA, 16 bp, H. sapiens
cataaaatttcagaaa

SEQ ID NO: 69561 - DNA, 16 bp, H. sapiens
cataaacaaacaaatg

SEQ ID NO: 69562 - DNA, 16 bp, H. sapiens
cataaacagaaccagt

SEQ ID NO: 69563 - DNA, 16 bp, H. sapiens
cataaacatacgtgtg

SEQ ID NO: 69564 - DNA, 16 bp, H. sapiens
cataaacatttttcaa

SEQ ID NO: 69565 - DNA, 16 bp, H. sapiens
cataaactaggtattg

SEQ ID NO: 69566 - DNA, 16 bp, H. sapiens
cataaactttcctctt

SEQ ID NO: 69567 - DNA, 16 bp, H. sapiens
cataaagaaagttctt

SEQ ID NO: 69568 - DNA, 16 bp, H. sapiens
cataaagaaattctct

SEQ ID NO: 69569 - DNA, 16 bp, H. sapiens
cataaagcaggcagaa

SEQ ID NO: 69570 - DNA, 16 bp, H. sapiens
cataaagctcccaaga

SEQ ID NO: 69571 - DNA, 16 bp, H. sapiens
cataaagctttaaaaa

SEQ ID NO: 69572 - DNA, 16 bp, H. sapiens
cataaatataaatgta

SEQ ID NO: 69573 - DNA, 16 bp, H. sapiens
cataaatatatgtata

SEQ ID NO: 69574 - DNA, 16 bp, H. sapiens
cataaatcataaatgt

SEQ ID NO: 69575 - DNA, 16 bp, H. sapiens
cataaatctactgctg

SEQ ID NO: 69576 - DNA, 16 bp, H. sapiens
cataaatctggcttac

SEQ ID NO: 69577 - DNA, 16 bp, H. sapiens
cataaatgaataaatt

SEQ ID NO: 69578 - DNA, 16 bp, H. sapiens
cataaatgaattttat

SEQ ID NO: 69579 - DNA, 16 bp, H. sapiens
cataaatgaattttgt

SEQ ID NO: 69580 - DNA, 16 bp, H. sapiens
cataaatgtgttcttt

SEQ ID NO: 69581 - DNA, 16 bp, H. sapiens
cataaattatttgaaa

SEQ ID NO: 69582 - DNA, 16 bp, H. sapiens
cataaatttgatattt

SEQ ID NO: 69583 - DNA, 16 bp, H. sapiens
cataaattttgatata

SEQ ID NO: 69584 - DNA, 16 bp, H. sapiens
cataacaaagaagttt

SEQ ID NO: 69585 - DNA, 16 bp, H. sapiens
cataacataaaagtgc

SEQ ID NO: 69586 - DNA, 16 bp, H. sapiens
cataacataaacagaa

SEQ ID NO: 69587 - DNA, 16 bp, H. sapiens
cataaccaaaacagca

SEQ ID NO: 69588 - DNA, 16 bp, H. sapiens
cataaccatttttccc

SEQ ID NO: 69589 - DNA, 16 bp, H. sapiens
cataacctatgaatga

SEQ ID NO: 69590 - DNA, 16 bp, H. sapiens
cataacgttttcaagg

SEQ ID NO: 69591 - DNA, 16 bp, H. sapiens
cataactaaagacaaa

SEQ ID NO: 69592 - DNA, 16 bp, H. sapiens
cataactttaagattt

SEQ ID NO: 69593 - DNA, 16 bp, H. sapiens
cataagaaattatgaa

SEQ ID NO: 69594 - DNA, 16 bp, H. sapiens
cataagacaagaaata

SEQ ID NO: 69595 - DNA, 16 bp, H. sapiens
cataagaccctcattt

SEQ ID NO: 69596 - DNA, 16 bp, H. sapiens
cataagagactccatt

SEQ ID NO: 69597 - DNA, 16 bp, H. sapiens
cataagagagaaataa

SEQ ID NO: 69598 - DNA, 16 bp, H. sapiens
cataagagagagagag

SEQ ID NO: 69599 - DNA, 16 bp, H. sapiens
cataagagccaaaaag

SEQ ID NO: 69600 - DNA, 16 bp, H. sapiens
cataagattataatac

SEQ ID NO: 69601 - DNA, 16 bp, H. sapiens
cataagcaaaacttaa

SEQ ID NO: 69602 - DNA, 16 bp, H. sapiens
cataagcaggagttga

SEQ ID NO: 69603 - DNA, 16 bp, H. sapiens
cataaggagtgtgcaa

SEQ ID NO: 69604 - DNA, 16 bp, H. sapiens
cataagtaaaatttta

SEQ ID NO: 69605 - DNA, 16 bp, H. sapiens
cataagtaatgaggag

SEQ ID NO: 69606 - DNA, 16 bp, H. sapiens
cataagtgaaatcata

SEQ ID NO: 69607 - DNA, 16 bp, H. sapiens
cataagttcttattat

SEQ ID NO: 69608 - DNA, 16 bp, H. sapiens
cataataaaagattaa

SEQ ID NO: 69609 - DNA, 16 bp, H. sapiens
cataataaaatacatg

SEQ ID NO: 69610 - DNA, 16 bp, H. sapiens
cataatacccaatagg

SEQ ID NO: 69611 - DNA, 16 bp, H. sapiens
cataatactgaacagg

SEQ ID NO: 69612 - DNA, 16 bp, H. sapiens
cataatactgtatttt

SEQ ID NO: 69613 - DNA, 16 bp, H. sapiens
cataatagagagccca

SEQ ID NO: 69614 - DNA, 16 bp, H. sapiens
cataatagccaaaaac

SEQ ID NO: 69615 - DNA, 16 bp, H. sapiens
cataatatcctccagg

SEQ ID NO: 69616 - DNA, 16 bp, H. sapiens
cataatattataatac

SEQ ID NO: 69617 - DNA, 16 bp, H. sapiens
cataatcacattcctt

SEQ ID NO: 69618 - DNA, 16 bp, H. sapiens
cataatcccagctact

SEQ ID NO: 69619 - DNA, 16 bp, H. sapiens
cataatcctcctggga

SEQ ID NO: 69620 - DNA, 16 bp, H. sapiens
cataatgaagatgcca

SEQ ID NO: 69621 - DNA, 16 bp, H. sapiens
cataatgacaaaatca

SEQ ID NO: 69622 - DNA, 16 bp, H. sapiens
cataatgacagaatca

SEQ ID NO: 69623 - DNA, 17 bp, H. sapiens
cataatgacaggaccaa

SEQ ID NO: 69624 - DNA, 16 bp, H. sapiens
cataatgagacaccat

SEQ ID NO: 69625 - DNA, 16 bp, H. sapiens
cataatgcttctttcc

SEQ ID NO: 69626 - DNA, 16 bp, H. sapiens
cataatgtagaatcag

SEQ ID NO: 69627 - DNA, 16 bp, H. sapiens
cataatgtattcaagg

SEQ ID NO: 69628 - DNA, 16 bp, H. sapiens
cataatgttttaagaa

SEQ ID NO: 69629 - DNA, 16 bp, H. sapiens
cataattaaaagaact

SEQ ID NO: 69630 - DNA, 16 bp, H. sapiens
cataattaaattacct

SEQ ID NO: 69631 - DNA, 16 bp, H. sapiens
cataattagaagtaaa

SEQ ID NO: 69632 - DNA, 16 bp, H. sapiens
cataattgtcaaaaac

SEQ ID NO: 69633 - DNA, 16 bp, H. sapiens
cataatttaaatgaaa

SEQ ID NO: 69634 - DNA, 16 bp, H. sapiens
cataatttcatatttc

SEQ ID NO: 69635 - DNA, 16 bp, H. sapiens
cataatttggccaaac

SEQ ID NO: 69636 - DNA, 16 bp, H. sapiens
cataatttttctgtct

SEQ ID NO: 69637 - DNA, 16 bp, H. sapiens
cataattttttaaatg

SEQ ID NO: 69638 - DNA, 16 bp, H. sapiens
catacaaaaatcaatc

SEQ ID NO: 69639 - DNA, 16 bp, H. sapiens
catacaaactagaaaa

SEQ ID NO: 69640 - DNA, 16 bp, H. sapiens
catacaaattttaaga

SEQ ID NO: 69641 - DNA, 16 bp, H. sapiens
catacaatttttaaaa

SEQ ID NO: 69642 - DNA, 16 bp, H. sapiens
catacacaagcatcaa

SEQ ID NO: 69643 - DNA, 16 bp, H. sapiens
catacacacacacacg

SEQ ID NO: 69644 - DNA, 16 bp, H. sapiens
catacacacacactca

SEQ ID NO: 69645 - DNA, 16 bp, H. sapiens
catacacacacactcc

SEQ ID NO: 69646 - DNA, 16 bp, H. sapiens
catacacacacatcct

SEQ ID NO: 69647 - DNA, 16 bp, H. sapiens
catacacacataaata

SEQ ID NO: 69648 - DNA, 16 bp, H. sapiens
catacacacatataca

SEQ ID NO: 69649 - DNA, 16 bp, H. sapiens
catacacacatgcaca

SEQ ID NO: 69650 - DNA, 16 bp, H. sapiens
catacacagaaacaca

SEQ ID NO: 69651 - DNA, 16 bp, H. sapiens
catacacagaggaaag

SEQ ID NO: 69652 - DNA, 16 bp, H. sapiens
catacacagagggaag

SEQ ID NO: 69653 - DNA, 16 bp, H. sapiens
catacacatacatacc

SEQ ID NO: 69654 - DNA, 16 bp, H. sapiens
catacaccaataacag

SEQ ID NO: 69655 - DNA, 16 bp, H. sapiens
catacaccctcctgag

SEQ ID NO: 69656 - DNA, 16 bp, H. sapiens
catacacctgtaatcc

SEQ ID NO: 69657 - DNA, 16 bp, H. sapiens
catacagaaaatggaa

SEQ ID NO: 69658 - DNA, 16 bp, H. sapiens
catacagaaatattta

SEQ ID NO: 69659 - DNA, 16 bp, H. sapiens
catacagaatgggaaa

SEQ ID NO: 69660 - DNA, 16 bp, H. sapiens
catacaggaagcactg

SEQ ID NO: 69661 - DNA, 16 bp, H. sapiens
catacaggagagaaac

SEQ ID NO: 69662 - DNA, 16 bp, H. sapiens
catacaggaggatgtg

SEQ ID NO: 69663 - DNA, 16 bp, H. sapiens
catacaggtgtttata

SEQ ID NO: 69664 - DNA, 16 bp, H. sapiens
catacagtctctgttg

SEQ ID NO: 69665 - DNA, 16 bp, H. sapiens
catacatacatagaca

SEQ ID NO: 69666 - DNA, 16 bp, H. sapiens
catacatacatgtaca

SEQ ID NO: 69667 - DNA, 16 bp, H. sapiens
catacatacatgtata

SEQ ID NO: 69668 - DNA, 16 bp, H. sapiens
catacatatatgatat

SEQ ID NO: 69669 - DNA, 16 bp, H. sapiens
catacatatgcacaca

SEQ ID NO: 69670 - DNA, 16 bp, H. sapiens
catacatatttctttt

SEQ ID NO: 69671 - DNA, 16 bp, H. sapiens
catacatatttttaaa

SEQ ID NO: 69672 - DNA, 16 bp, H. sapiens
catacatgcacacatt

SEQ ID NO: 69673 - DNA, 16 bp, H. sapiens
catacatgtacacaca

SEQ ID NO: 69674 - DNA, 16 bp, H. sapiens
catacatttttattct

SEQ ID NO: 69675 - DNA, 16 bp, H. sapiens
cataccactgtattcc

SEQ ID NO: 69676 - DNA, 16 bp, H. sapiens
catacccacacataca

SEQ ID NO: 69677 - DNA, 16 bp, H. sapiens
catacccattagcagt

SEQ ID NO: 69678 - DNA, 16 bp, H. sapiens
catacccgaaactggg

SEQ ID NO: 69679 - DNA, 16 bp, H. sapiens
catacctcaaacctca

SEQ ID NO: 69680 - DNA, 16 bp, H. sapiens
catacctcattcttcc

SEQ ID NO: 69681 - DNA, 16 bp, H. sapiens
catacctgagtctggg

SEQ ID NO: 69682 - DNA, 16 bp, H. sapiens
catactatatatacat

SEQ ID NO: 69683 - DNA, 16 bp, H. sapiens
catactcaagcctcag

SEQ ID NO: 69684 - DNA, 16 bp, H. sapiens
catactgaagagaaac

SEQ ID NO: 69685 - DNA, 16 bp, H. sapiens
catactgatttccttt

SEQ ID NO: 69686 - DNA, 16 bp, H. sapiens
catactgcccaaggaa

SEQ ID NO: 69687 - DNA, 16 bp, H. sapiens
catactgcctgaagta

SEQ ID NO: 69688 - DNA, 16 bp, H. sapiens
catactgctaataaag

SEQ ID NO: 69689 - DNA, 16 bp, H. sapiens
catactgtttcccaca

SEQ ID NO: 69690 - DNA, 16 bp, H. sapiens
catactgttttccatg

SEQ ID NO: 69691 - DNA, 16 bp, H. sapiens
catactgtttttcata

SEQ ID NO: 69692 - DNA, 16 bp, H. sapiens
catacttataatccca

SEQ ID NO: 69693 - DNA, 16 bp, H. sapiens
catactttgtattatt

SEQ ID NO: 69694 - DNA, 16 bp, H. sapiens
catagaaaaagtacag

SEQ ID NO: 69695 - DNA, 16 bp, H. sapiens
catagaaaagttacag

SEQ ID NO: 69696 - DNA, 16 bp, H. sapiens
catagaaaatcctaag

SEQ ID NO: 69697 - DNA, 16 bp, H. sapiens
catagaaattggcaaa

SEQ ID NO: 69698 - DNA, 16 bp, H. sapiens
catagaactgaagaga

SEQ ID NO: 69699 - DNA, 16 bp, H. sapiens
catagaatatcttttt

SEQ ID NO: 69700 - DNA, 16 bp, H. sapiens
catagaattggaaaaa

SEQ ID NO: 69701 - DNA, 16 bp, H. sapiens
catagagcaggggggc

SEQ ID NO: 69702 - DNA, 16 bp, H. sapiens
catagaggggaaaaac

SEQ ID NO: 69703 - DNA, 16 bp, H. sapiens
catagatcaacaggat

SEQ ID NO: 69704 - DNA, 16 bp, H. sapiens
catagcagctttattt

SEQ ID NO: 69705 - DNA, 16 bp, H. sapiens
catagccaaagcaaaa

SEQ ID NO: 69706 - DNA, 16 bp, H. sapiens
catagcctcaaactcc

SEQ ID NO: 69707 - DNA, 16 bp, H. sapiens
catagctcactgtagg

SEQ ID NO: 69708 - DNA, 16 bp, H. sapiens
catagctggagctgga

SEQ ID NO: 69709 - DNA, 16 bp, H. sapiens
cataggaagaccccca

SEQ ID NO: 69710 - DNA, 16 bp, H. sapiens
cataggagaaaaatct

SEQ ID NO: 69711 - DNA, 16 bp, H. sapiens
cataggatttttaaaa

SEQ ID NO: 69712 - DNA, 18 bp, H. sapiens
cataggcataggcaagga

SEQ ID NO: 69713 - DNA, 16 bp, H. sapiens
catagggctgctgtgg

SEQ ID NO: 69714 - DNA, 16 bp, H. sapiens
catagggctgttgtga

SEQ ID NO: 69715 - DNA, 16 bp, H. sapiens
catagggtgtaaccaa

SEQ ID NO: 69716 - DNA, 16 bp, H. sapiens
catagggttggaagtt

SEQ ID NO: 69717 - DNA, 16 bp, H. sapiens
catagggtttctctcc

SEQ ID NO: 69718 - DNA, 22 bp, H. sapiens
catagtaccttcccttgaactt

SEQ ID NO: 69719 - DNA, 16 bp, H. sapiens
catagtagatattcaa

SEQ ID NO: 69720 - DNA, 16 bp, H. sapiens
catagtaggccctcag

SEQ ID NO: 69721 - DNA, 16 bp, H. sapiens
catagtatttcatagt

SEQ ID NO: 69722 - DNA, 16 bp, H. sapiens
catagtcccagctact

SEQ ID NO: 69723 - DNA, 16 bp, H. sapiens
catagtcccatatttt

SEQ ID NO: 69724 - DNA, 16 bp, H. sapiens
catagtgaaaccccct

SEQ ID NO: 69725 - DNA, 16 bp, H. sapiens
catagtgaaacccctt

SEQ ID NO: 69726 - DNA, 16 bp, H. sapiens
catagtgaaatcctgt

SEQ ID NO: 69727 - DNA, 16 bp, H. sapiens
catagtgaaatggtta

SEQ ID NO: 69728 - DNA, 16 bp, H. sapiens
catagtgagaacccat

SEQ ID NO: 69729 - DNA, 16 bp, H. sapiens
catagtgagaccccag

SEQ ID NO: 69730 - DNA, 16 bp, H. sapiens
catagtgagacccccc

SEQ ID NO: 69731 - DNA, 16 bp, H. sapiens
catagtgagaccctgg

SEQ ID NO: 69732 - DNA, 16 bp, H. sapiens
catagtgagactctgt

SEQ ID NO: 69733 - DNA, 16 bp, H. sapiens
catagtgagattctgt

SEQ ID NO: 69734 - DNA, 16 bp, H. sapiens
catagtgcccaaagca

SEQ ID NO: 69735 - DNA, 16 bp, H. sapiens
catagtgcttgtacta

SEQ ID NO: 69736 - DNA, 16 bp, H. sapiens
catagtggttgtacta

SEQ ID NO: 69737 - DNA, 16 bp, H. sapiens
catagttaccattttt

SEQ ID NO: 69738 - DNA, 16 bp, H. sapiens
catagtttctataatc

SEQ ID NO: 69739 - DNA, 16 bp, H. sapiens
catagttttaggtttt

SEQ ID NO: 69740 - DNA, 16 bp, H. sapiens
catataaaaatatgct

SEQ ID NO: 69741 - DNA, 16 bp, H. sapiens
catataaagaaaagct

SEQ ID NO: 69742 - DNA, 16 bp, H. sapiens
catataaagaattctt

SEQ ID NO: 69743 - DNA, 16 bp, H. sapiens
catataaaggaatgaa

SEQ ID NO: 69744 - DNA, 16 bp, H. sapiens
catataaagtaacatt

SEQ ID NO: 69745 - DNA, 16 bp, H. sapiens
catataaatattagaa

SEQ ID NO: 69746 - DNA, 16 bp, H. sapiens
catataaatgaagtca

SEQ ID NO: 69747 - DNA, 16 bp, H. sapiens
catataaatggactca

SEQ ID NO: 69748 - DNA, 16 bp, H. sapiens
catataaatggagtca

SEQ ID NO: 69749 - DNA, 16 bp, H. sapiens
catataaatgtaataa

SEQ ID NO: 69750 - DNA, 16 bp, H. sapiens
catataacatattata

SEQ ID NO: 69751 - DNA, 16 bp, H. sapiens
catataagaaaactga

SEQ ID NO: 69752 - DNA, 16 bp, H. sapiens
catataatacatattt

SEQ ID NO: 69753 - DNA, 16 bp, H. sapiens
catataatccagcaat

SEQ ID NO: 69754 - DNA, 16 bp, H. sapiens
catataattttcatgt

SEQ ID NO: 69755 - DNA, 16 bp, H. sapiens
catatacaagtatcaa

SEQ ID NO: 69756 - DNA, 16 bp, H. sapiens
catatacacacaaaat

SEQ ID NO: 69757 - DNA, 16 bp, H. sapiens
catatacacataaaca

SEQ ID NO: 69758 - DNA, 16 bp, H. sapiens
catatacacatacaca

SEQ ID NO: 69759 - DNA, 16 bp, H. sapiens
catatacaccagggaa

SEQ ID NO: 69760 - DNA, 16 bp, H. sapiens
catatacacgtgtgtg

SEQ ID NO: 69761 - DNA, 16 bp, H. sapiens
catatacatatataca

SEQ ID NO: 69762 - DNA, 16 bp, H. sapiens
catatacatatatatg

SEQ ID NO: 69763 - DNA, 16 bp, H. sapiens
catatacatgtaaaat

SEQ ID NO: 69764 - DNA, 16 bp, H. sapiens
catatacatgtgtata

SEQ ID NO: 69765 - DNA, 16 bp, H. sapiens
catataccaaaatcca

SEQ ID NO: 69766 - DNA, 16 bp, H. sapiens
catatacccttcaccc

SEQ ID NO: 69767 - DNA, 18 bp, H. sapiens
catatactttctgctccc

SEQ ID NO: 69768 - DNA, 16 bp, H. sapiens
catatagtgacttctt

SEQ ID NO: 69769 - DNA, 16 bp, H. sapiens
catatatacagatata

SEQ ID NO: 69770 - DNA, 16 bp, H. sapiens
catatatacatgtgtg

SEQ ID NO: 69771 - DNA, 16 bp, H. sapiens
catatatacattgtat

SEQ ID NO: 69772 - DNA, 16 bp, H. sapiens
catatataccatagaa

SEQ ID NO: 69773 - DNA, 16 bp, H. sapiens
catatatacgtacata

SEQ ID NO: 69774 - DNA, 16 bp, H. sapiens
catatatactatatac

SEQ ID NO: 69775 - DNA, 16 bp, H. sapiens
catatatacttatata

SEQ ID NO: 69776 - DNA, 16 bp, H. sapiens
catatatataactata

SEQ ID NO: 69777 - DNA, 18 bp, H. sapiens
catatatatacacatata

SEQ ID NO: 69778 - DNA, 17 bp, H. sapiens
catatatatacatacat

SEQ ID NO: 69779 - DNA, 16 bp, H. sapiens
catatatatacatgtg

SEQ ID NO: 69780 - DNA, 16 bp, H. sapiens
catatatatacgtatg

SEQ ID NO: 69781 - DNA, 16 bp, H. sapiens
catatatatagaaaga

SEQ ID NO: 69782 - DNA, 16 bp, H. sapiens
catatatatatttgtg

SEQ ID NO: 69783 - DNA, 16 bp, H. sapiens
catatatatgaaatgt

SEQ ID NO: 69784 - DNA, 16 bp, H. sapiens
catatatatgataagg

SEQ ID NO: 69785 - DNA, 16 bp, H. sapiens
catatatatgcatata

SEQ ID NO: 69786 - DNA, 16 bp, H. sapiens
catatatatgctatat

SEQ ID NO: 69787 - DNA, 16 bp, H. sapiens
catatatatgtataca

SEQ ID NO: 69788 - DNA, 17 bp, H. sapiens
catatatatgtatatac

SEQ ID NO: 69789 - DNA, 16 bp, H. sapiens
catatatatgtatatg

SEQ ID NO: 69790 - DNA, 16 bp, H. sapiens
catatatatgttattt

SEQ ID NO: 69791 - DNA, 16 bp, H. sapiens
catatatatttgtata

SEQ ID NO: 69792 - DNA, 16 bp, H. sapiens
catatatcaaatcatc

SEQ ID NO: 69793 - DNA, 16 bp, H. sapiens
catatatctatgtata

SEQ ID NO: 69794 - DNA, 16 bp, H. sapiens
catatatgatggtggt

SEQ ID NO: 69795 - DNA, 16 bp, H. sapiens
catatatgcatacatt

SEQ ID NO: 69796 - DNA, 16 bp, H. sapiens
catatatgtatgcata

SEQ ID NO: 69797 - DNA, 16 bp, H. sapiens
catatatgtgcatgta

SEQ ID NO: 69798 - DNA, 16 bp, H. sapiens
catatatgtggttcat

SEQ ID NO: 69799 - DNA, 16 bp, H. sapiens
catatatgtgtattgc

SEQ ID NO: 69800 - DNA, 16 bp, H. sapiens
catatatgtgtgcata

SEQ ID NO: 69801 - DNA, 16 bp, H. sapiens
catatattaaaaaaga

SEQ ID NO: 69802 - DNA, 16 bp, H. sapiens
catatattaacatata

SEQ ID NO: 69803 - DNA, 16 bp, H. sapiens
catatattgaagtcct

SEQ ID NO: 69804 - DNA, 16 bp, H. sapiens
catatatttaaaatac

SEQ ID NO: 69805 - DNA, 16 bp, H. sapiens
catatatttgtacagt

SEQ ID NO: 69806 - DNA, 16 bp, H. sapiens
catatattttatgaat

SEQ ID NO: 69807 - DNA, 16 bp, H. sapiens
catatcaggaaaactg

SEQ ID NO: 69808 - DNA, 16 bp, H. sapiens
catatccaaaccatag

SEQ ID NO: 69809 - DNA, 16 bp, H. sapiens
catatccagtgaaaat

SEQ ID NO: 69810 - DNA, 16 bp, H. sapiens
catatccatcatctca

SEQ ID NO: 69811 - DNA, 16 bp, H. sapiens
catatcctcacatttc

SEQ ID NO: 69812 - DNA, 16 bp, H. sapiens
catatcctcattcttc

SEQ ID NO: 69813 - DNA, 16 bp, H. sapiens
catatctatatataca

SEQ ID NO: 69814 - DNA, 16 bp, H. sapiens
catatctgcagttact

SEQ ID NO: 69815 - DNA, 16 bp, H. sapiens
catatctgtcacctca

SEQ ID NO: 69816 - DNA, 16 bp, H. sapiens
catatcttcctgtctt

SEQ ID NO: 69817 - DNA, 16 bp, H. sapiens
catatgaaaaaaacct

SEQ ID NO: 69818 - DNA, 16 bp, H. sapiens
catatgaaaaaaatgc

SEQ ID NO: 69819 - DNA, 16 bp, H. sapiens
catatgaaaaaatcct

SEQ ID NO: 69820 - DNA, 16 bp, H. sapiens
catatgaaaaaatggt

SEQ ID NO: 69821 - DNA, 16 bp, H. sapiens
catatgaacttcaaag

SEQ ID NO: 69822 - DNA, 16 bp, H. sapiens
catatgaattttaaga

SEQ ID NO: 69823 - DNA, 16 bp, H. sapiens
catatgacccaggaat

SEQ ID NO: 69824 - DNA, 16 bp, H. sapiens
catatgagaaaactga

SEQ ID NO: 69825 - DNA, 16 bp, H. sapiens
catatgagaagatgct

SEQ ID NO: 69826 - DNA, 16 bp, H. sapiens
catatgattttttttc

SEQ ID NO: 69827 - DNA, 18 bp, H. sapiens
catatgcaaatcaataaa

SEQ ID NO: 69828 - DNA, 16 bp, H. sapiens
catatgcagaagaaaa

SEQ ID NO: 69829 - DNA, 16 bp, H. sapiens
catatgcatatgtgta

SEQ ID NO: 69830 - DNA, 16 bp, H. sapiens
catatgcatgtatgta

SEQ ID NO: 69831 - DNA, 16 bp, H. sapiens
catatgcatttaaaaa

SEQ ID NO: 69832 - DNA, 16 bp, H. sapiens
catatgctgaggagaa

SEQ ID NO: 69833 - DNA, 16 bp, H. sapiens
catatgcttattagcc

SEQ ID NO: 69834 - DNA, 16 bp, H. sapiens
catatggacattttaa

SEQ ID NO: 69835 - DNA, 16 bp, H. sapiens
catatggatatacagt

SEQ ID NO: 69836 - DNA, 16 bp, H. sapiens
catatggtttttggtt

SEQ ID NO: 69837 - DNA, 16 bp, H. sapiens
catatgtaaaatggga

SEQ ID NO: 69838 - DNA, 16 bp, H. sapiens
catatgtaaatatgta

SEQ ID NO: 69839 - DNA, 16 bp, H. sapiens
catatgtacccattgt

SEQ ID NO: 69840 - DNA, 16 bp, H. sapiens
catatgtataaatata

SEQ ID NO: 69841 - DNA, 16 bp, H. sapiens
catatgtatatatgtg

SEQ ID NO: 69842 - DNA, 16 bp, H. sapiens
catatgtatatatttt

SEQ ID NO: 69843 - DNA, 16 bp, H. sapiens
catatgtatatgttta

SEQ ID NO: 69844 - DNA, 16 bp, H. sapiens
catatgtatatttata

SEQ ID NO: 69845 - DNA, 16 bp, H. sapiens
catatgtatccctgaa

SEQ ID NO: 69846 - DNA, 16 bp, H. sapiens
catatgtatgtatgtg

SEQ ID NO: 69847 - DNA, 16 bp, H. sapiens
catatgtatttacaat

SEQ ID NO: 69848 - DNA, 16 bp, H. sapiens
catatgtccacaaaaa

SEQ ID NO: 69849 - DNA, 16 bp, H. sapiens
catatgtccctgagtt

SEQ ID NO: 69850 - DNA, 16 bp, H. sapiens
catatgtgcgtgtgtg

SEQ ID NO: 69851 - DNA, 16 bp, H. sapiens
catatgtggaagccct

SEQ ID NO: 69852 - DNA, 16 bp, H. sapiens
catatgtggctattga

SEQ ID NO: 69853 - DNA, 16 bp, H. sapiens
catatgtgtatatata

SEQ ID NO: 69854 - DNA, 16 bp, H. sapiens
catatgtgtatgtatg

SEQ ID NO: 69855 - DNA, 16 bp, H. sapiens
catatgtgtgcgtgtg

SEQ ID NO: 69856 - DNA, 16 bp, H. sapiens
catatgtgtgtgtctg

SEQ ID NO: 69857 - DNA, 16 bp, H. sapiens
catatgttaaaattct

SEQ ID NO: 69858 - DNA, 16 bp, H. sapiens
catatgttattttttg

SEQ ID NO: 69859 - DNA, 16 bp, H. sapiens
catatgttgaaatcct

SEQ ID NO: 69860 - DNA, 16 bp, H. sapiens
catatgtttatatatt

SEQ ID NO: 69861 - DNA, 16 bp, H. sapiens
catatgtttctcattc

SEQ ID NO: 69862 - DNA, 16 bp, H. sapiens
catattaaataaatgt

SEQ ID NO: 69863 - DNA, 16 bp, H. sapiens
catattactgtactga

SEQ ID NO: 69864 - DNA, 16 bp, H. sapiens
catattcaagaaatca

SEQ ID NO: 69865 - DNA, 16 bp, H. sapiens
catattcatatattta

SEQ ID NO: 69866 - DNA, 16 bp, H. sapiens
catattcctcatttgg

SEQ ID NO: 69867 - DNA, 16 bp, H. sapiens
catattctcaccagca

SEQ ID NO: 69868 - DNA, 16 bp, H. sapiens
catattctcactcata

SEQ ID NO: 69869 - DNA, 28 bp, H. sapiens
catattctcactcataggtgggaattga

SEQ ID NO: 69870 - DNA, 16 bp, H. sapiens
catattctcacttgta

SEQ ID NO: 69871 - DNA, 16 bp, H. sapiens
catattctgaatttta

SEQ ID NO: 69872 - DNA, 16 bp, H. sapiens
catattctggtttcct

SEQ ID NO: 69873 - DNA, 16 bp, H. sapiens
catattcttaaaaata

SEQ ID NO: 69874 - DNA, 21 bp, H. sapiens
catattgcccaaggtaattta

SEQ ID NO: 69875 - DNA, 16 bp, H. sapiens
catattgcttttgcac

SEQ ID NO: 69876 - DNA, 16 bp, H. sapiens
catattggatttaggg

SEQ ID NO: 69877 - DNA, 16 bp, H. sapiens
catattggcaaggctg

SEQ ID NO: 69878 - DNA, 16 bp, H. sapiens
catattgttttccaca

SEQ ID NO: 69879 - DNA, 16 bp, H. sapiens
catatttaaaagacaa

SEQ ID NO: 69880 - DNA, 16 bp, H. sapiens
catatttaagaaacca

SEQ ID NO: 69881 - DNA, 16 bp, H. sapiens
catatttacagccaac

SEQ ID NO: 69882 - DNA, 16 bp, H. sapiens
catatttacatagaaa

SEQ ID NO: 69883 - DNA, 16 bp, H. sapiens
catatttacatatatt

SEQ ID NO: 69884 - DNA, 16 bp, H. sapiens
catatttagtattttt

SEQ ID NO: 69885 - DNA, 16 bp, H. sapiens
catatttatgtatatt

SEQ ID NO: 69886 - DNA, 16 bp, H. sapiens
catatttatgtgtgtg

SEQ ID NO: 69887 - DNA, 16 bp, H. sapiens
catatttcaaaataca

SEQ ID NO: 69888 - DNA, 16 bp, H. sapiens
catatttcaagtgttc

SEQ ID NO: 69889 - DNA, 16 bp, H. sapiens
catatttctactaaca

SEQ ID NO: 69890 - DNA, 16 bp, H. sapiens
catatttcttggagtc

SEQ ID NO: 69891 - DNA, 16 bp, H. sapiens
catatttgaaaatttt

SEQ ID NO: 69892 - DNA, 16 bp, H. sapiens
catatttgtaaaatga

SEQ ID NO: 69893 - DNA, 16 bp, H. sapiens
catatttgtgttttct

SEQ ID NO: 69894 - DNA, 16 bp, H. sapiens
catatttgttacatgg

SEQ ID NO: 69895 - DNA, 16 bp, H. sapiens
catatttgttgaatga

SEQ ID NO: 69896 - DNA, 16 bp, H. sapiens
catatttgtttgtttg

SEQ ID NO: 69897 - DNA, 16 bp, H. sapiens
catattttaaagttaa

SEQ ID NO: 69898 - DNA, 16 bp, H. sapiens
catattttaatagaaa

SEQ ID NO: 69899 - DNA, 16 bp, H. sapiens
catattttaatgtttt

SEQ ID NO: 69900 - DNA, 16 bp, H. sapiens
catattttatgcattt

SEQ ID NO: 69901 - DNA, 16 bp, H. sapiens
catattttatgtattt

SEQ ID NO: 69902 - DNA, 16 bp, H. sapiens
catattttctttaaaa

SEQ ID NO: 69903 - DNA, 16 bp, H. sapiens
catattttgaaaatat

SEQ ID NO: 69904 - DNA, 16 bp, H. sapiens
catattttgaaccatc

SEQ ID NO: 69905 - DNA, 16 bp, H. sapiens
catattttgaatattt

SEQ ID NO: 69906 - DNA, 16 bp, H. sapiens
catattttgacttttt

SEQ ID NO: 69907 - DNA, 16 bp, H. sapiens
catattttgtaatatt

SEQ ID NO: 69908 - DNA, 16 bp, H. sapiens
catattttgtatttta

SEQ ID NO: 69909 - DNA, 16 bp, H. sapiens
catattttgtttattc

SEQ ID NO: 69910 - DNA, 16 bp, H. sapiens
catatttttaacaaaa

SEQ ID NO: 69911 - DNA, 16 bp, H. sapiens
catatttttaatgaaa

SEQ ID NO: 69912 - DNA, 16 bp, H. sapiens
catatttttatatgaa

SEQ ID NO: 69913 - DNA, 16 bp, H. sapiens
catatttttgttgttg

SEQ ID NO: 69914 - DNA, 16 bp, H. sapiens
catattttttcataaa

SEQ ID NO: 69915 - DNA, 16 bp, H. sapiens
catcaaaaagaggaaa

SEQ ID NO: 69916 - DNA, 16 bp, H. sapiens
catcaaaaagttaaaa

SEQ ID NO: 69917 - DNA, 16 bp, H. sapiens
catcaaaagaaatgtt

SEQ ID NO: 69918 - DNA, 16 bp, H. sapiens
catcaaaccataccat

SEQ ID NO: 69919 - DNA, 16 bp, H. sapiens
catcaaatggaagtgg

SEQ ID NO: 69920 - DNA, 16 bp, H. sapiens
catcaacaaaaaagac

SEQ ID NO: 69921 - DNA, 16 bp, H. sapiens
catcaacagacacttc

SEQ ID NO: 69922 - DNA, 16 bp, H. sapiens
catcaacagataaata

SEQ ID NO: 69923 - DNA, 16 bp, H. sapiens
catcaacagtgcactg

SEQ ID NO: 69924 - DNA, 16 bp, H. sapiens
catcaacatttttaaa

SEQ ID NO: 69925 - DNA, 16 bp, H. sapiens
catcaagaagaataaa

SEQ ID NO: 69926 - DNA, 16 bp, H. sapiens
catcaagacaaagtca

SEQ ID NO: 69927 - DNA, 16 bp, H. sapiens
catcaagacaatggga

SEQ ID NO: 69928 - DNA, 16 bp, H. sapiens
catcaagaccatccag

SEQ ID NO: 69929 - DNA, 16 bp, H. sapiens
catcaaggaaatgaaa

SEQ ID NO: 69930 - DNA, 16 bp, H. sapiens
catcaaggcagaaaac

SEQ ID NO: 69931 - DNA, 16 bp, H. sapiens
catcaagtacattcac

SEQ ID NO: 69932 - DNA, 16 bp, H. sapiens
catcaataattacttt

SEQ ID NO: 69933 - DNA, 16 bp, H. sapiens
catcaatagaaaaaga

SEQ ID NO: 69934 - DNA, 16 bp, H. sapiens
catcaatcagaatggc

SEQ ID NO: 69935 - DNA, 16 bp, H. sapiens
catcaatgataaactg

SEQ ID NO: 69936 - DNA, 16 bp, H. sapiens
catcaatgtcttcttt

SEQ ID NO: 69937 - DNA, 16 bp, H. sapiens
catcaatgtttatcaa

SEQ ID NO: 69938 - DNA, 16 bp, H. sapiens
catcaatttttttaaa

SEQ ID NO: 69939 - DNA, 16 bp, H. sapiens
catcacaaaggagttt

SEQ ID NO: 69940 - DNA, 17 bp, H. sapiens
catcacaaggtcaagag

SEQ ID NO: 69941 - DNA, 16 bp, H. sapiens
catcacacaccagggc

SEQ ID NO: 69942 - DNA, 16 bp, H. sapiens
catcacacccagcccc

SEQ ID NO: 69943 - DNA, 16 bp, H. sapiens
catcacacccagctaa

SEQ ID NO: 69944 - DNA, 16 bp, H. sapiens
catcacacctggataa

SEQ ID NO: 69945 - DNA, 16 bp, H. sapiens
catcacactccagcct

SEQ ID NO: 69946 - DNA, 16 bp, H. sapiens
catcacactggctaat

SEQ ID NO: 69947 - DNA, 16 bp, H. sapiens
catcacactgggagtt

SEQ ID NO: 69948 - DNA, 16 bp, H. sapiens
catcacactgtacccc

SEQ ID NO: 69949 - DNA, 16 bp, H. sapiens
catcacagccttcttg

SEQ ID NO: 69950 - DNA, 16 bp, H. sapiens
catcacagggagacag

SEQ ID NO: 69951 - DNA, 16 bp, H. sapiens
catcacagggatgaag

SEQ ID NO: 69952 - DNA, 16 bp, H. sapiens
catcacataaacagaa

SEQ ID NO: 69953 - DNA, 16 bp, H. sapiens
catcacatcaacagaa

SEQ ID NO: 69954 - DNA, 17 bp, H. sapiens
catcacatgtcagcagg

SEQ ID NO: 69955 - DNA, 16 bp, H. sapiens
catcacattatccaac

SEQ ID NO: 69956 - DNA, 16 bp, H. sapiens
catcacattggagatt

SEQ ID NO: 69957 - DNA, 16 bp, H. sapiens
catcaccaccatcact

SEQ ID NO: 69958 - DNA, 16 bp, H. sapiens
catcaccaccattatc

SEQ ID NO: 69959 - DNA, 16 bp, H. sapiens
catcaccactaccatc

SEQ ID NO: 69960 - DNA, 16 bp, H. sapiens
catcaccactccctaa

SEQ ID NO: 69961 - DNA, 16 bp, H. sapiens
catcaccagcatctgt

SEQ ID NO: 69962 - DNA, 16 bp, H. sapiens
catcaccaggctggag

SEQ ID NO: 69963 - DNA, 16 bp, H. sapiens
catcaccatcaacatc

SEQ ID NO: 69964 - DNA, 16 bp, H. sapiens
catcaccatcaccaac

SEQ ID NO: 69965 - DNA, 16 bp, H. sapiens
catcaccatcatctcc

SEQ ID NO: 69966 - DNA, 16 bp, H. sapiens
catcaccatcatgatc

SEQ ID NO: 69967 - DNA, 16 bp, H. sapiens
catcaccatcctcatc

SEQ ID NO: 69968 - DNA, 16 bp, H. sapiens
catcaccatcgtcatc

SEQ ID NO: 69969 - DNA, 16 bp, H. sapiens
catcaccatctccatc

SEQ ID NO: 69970 - DNA, 16 bp, H. sapiens
catcaccatcttcatc

SEQ ID NO: 69971 - DNA, 16 bp, H. sapiens
catcaccatgcctgcc

SEQ ID NO: 69972 - DNA, 16 bp, H. sapiens
catcacccaggaagtg

SEQ ID NO: 69973 - DNA, 16 bp, H. sapiens
catcaccccagcccaa

SEQ ID NO: 69974 - DNA, 16 bp, H. sapiens
catcacccccatcatc

SEQ ID NO: 69975 - DNA, 16 bp, H. sapiens
catcaccgtcatcacc

SEQ ID NO: 69976 - DNA, 16 bp, H. sapiens
catcaccgtcatcatc

SEQ ID NO: 69977 - DNA, 16 bp, H. sapiens
catcacctcacccggg

SEQ ID NO: 69978 - DNA, 16 bp, H. sapiens
catcacctcctccctg

SEQ ID NO: 69979 - DNA, 16 bp, H. sapiens
catcacctgacattcc

SEQ ID NO: 69980 - DNA, 16 bp, H. sapiens
catcacctgggaactt

SEQ ID NO: 69981 - DNA, 16 bp, H. sapiens
catcacctgggacctt

SEQ ID NO: 69982 - DNA, 16 bp, H. sapiens
catcaccttaaatatt

SEQ ID NO: 69983 - DNA, 16 bp, H. sapiens
catcaccttcaccacc

SEQ ID NO: 69984 - DNA, 16 bp, H. sapiens
catcaccttcatcatc

SEQ ID NO: 69985 - DNA, 16 bp, H. sapiens
catcaccttgggaggc

SEQ ID NO: 69986 - DNA, 17 bp, H. sapiens
catcacgagcatgtcac

SEQ ID NO: 69987 - DNA, 16 bp, H. sapiens
catcacgccactgcac

SEQ ID NO: 69988 - DNA, 20 bp, H. sapiens
catcacgcccggctaatttt

SEQ ID NO: 69989 - DNA, 16 bp, H. sapiens
catcactagccatcag

SEQ ID NO: 69990 - DNA, 16 bp, H. sapiens
catcactatcactgtc

SEQ ID NO: 69991 - DNA, 16 bp, H. sapiens
catcactgcagaaagt

SEQ ID NO: 69992 - DNA, 16 bp, H. sapiens
catcactgccctccag

SEQ ID NO: 69993 - DNA, 18 bp, H. sapiens
catcactggccatcagaa

SEQ ID NO: 69994 - DNA, 18 bp, H. sapiens
catcactggccatcagag

SEQ ID NO: 69995 - DNA, 18 bp, H. sapiens
catcactggctatcagag

SEQ ID NO: 69996 - DNA, 16 bp, H. sapiens
catcactggtcactag

SEQ ID NO: 69997 - DNA, 16 bp, H. sapiens
catcagaaagttaata

SEQ ID NO: 69998 - DNA, 16 bp, H. sapiens
catcagaaggaagaaa

SEQ ID NO: 69999 - DNA, 16 bp, H. sapiens
catcagaagggacaga

SEQ ID NO: 70000 - DNA, 16 bp, H. sapiens
catcagaatcactggg

SEQ ID NO: 70001 - DNA, 16 bp, H. sapiens
catcagaatcatgagc

SEQ ID NO: 70002 - DNA, 16 bp, H. sapiens
catcagaatttccttc

SEQ ID NO: 70003 - DNA, 16 bp, H. sapiens
catcagacaagagaaa

SEQ ID NO: 70004 - DNA, 16 bp, H. sapiens
catcagagaaatgaaa

SEQ ID NO: 70005 - DNA, 16 bp, H. sapiens
catcagagactactat

SEQ ID NO: 70006 - DNA, 16 bp, H. sapiens
catcagagggagacca

SEQ ID NO: 70007 - DNA, 25 bp, H. sapiens
catcagagtgaacaggcaacctaca

SEQ ID NO: 70008 - DNA, 23 bp, H. sapiens
catcagagtgaataggcaaccta

SEQ ID NO: 70009 - DNA, 16 bp, H. sapiens
catcagagtgaatggg

SEQ ID NO: 70010 - DNA, 16 bp, H. sapiens
catcagagttcttggg

SEQ ID NO: 70011 - DNA, 16 bp, H. sapiens
catcagcaaatgcaaa

SEQ ID NO: 70012 - DNA, 16 bp, H. sapiens
catcagcaccatccat

SEQ ID NO: 70013 - DNA, 16 bp, H. sapiens
catcagcacttgctgc

SEQ ID NO: 70014 - DNA, 16 bp, H. sapiens
catcagcagatgaatg

SEQ ID NO: 70015 - DNA, 16 bp, H. sapiens
catcagcaggtgaatg

SEQ ID NO: 70016 - DNA, 16 bp, H. sapiens
catcagcatcacctag

SEQ ID NO: 70017 - DNA, 16 bp, H. sapiens
catcagcatcacctgg

SEQ ID NO: 70018 - DNA, 16 bp, H. sapiens
catcagcatcagcatc

SEQ ID NO: 70019 - DNA, 16 bp, H. sapiens
catcagcattccttcc

SEQ ID NO: 70020 - DNA, 16 bp, H. sapiens
catcagccactgtgct

SEQ ID NO: 70021 - DNA, 16 bp, H. sapiens
catcagcccacaaaga

SEQ ID NO: 70022 - DNA, 16 bp, H. sapiens
catcagcctaatggct

SEQ ID NO: 70023 - DNA, 16 bp, H. sapiens
catcagcctcagcctc

SEQ ID NO: 70024 - DNA, 16 bp, H. sapiens
catcagccttggaaaa

SEQ ID NO: 70025 - DNA, 16 bp, H. sapiens
catcagcgtcacctgg

SEQ ID NO: 70026 - DNA, 16 bp, H. sapiens
catcagctcctcccca

SEQ ID NO: 70027 - DNA, 16 bp, H. sapiens
catcagctcctccctg

SEQ ID NO: 70028 - DNA, 16 bp, H. sapiens
catcagctctcctggg

SEQ ID NO: 70029 - DNA, 16 bp, H. sapiens
catcagcttttttttt

SEQ ID NO: 70030 - DNA, 16 bp, H. sapiens
catcaggaggaggctg

SEQ ID NO: 70031 - DNA, 16 bp, H. sapiens
catcagggaaatggaa

SEQ ID NO: 70032 - DNA, 16 bp, H. sapiens
catcagggatgttggc

SEQ ID NO: 70033 - DNA, 16 bp, H. sapiens
catcagggatgttggt

SEQ ID NO: 70034 - DNA, 16 bp, H. sapiens
catcagggttggtttc

SEQ ID NO: 70035 - DNA, 16 bp, H. sapiens
catcagtaaaataaaa

SEQ ID NO: 70036 - DNA, 16 bp, H. sapiens
catcagtagactggga

SEQ ID NO: 70037 - DNA, 16 bp, H. sapiens
catcagtcctcttcaa

SEQ ID NO: 70038 - DNA, 16 bp, H. sapiens
catcagtcttcagctg

SEQ ID NO: 70039 - DNA, 16 bp, H. sapiens
catcagtgattttttt

SEQ ID NO: 70040 - DNA, 16 bp, H. sapiens
catcagtttaaaataa

SEQ ID NO: 70041 - DNA, 16 bp, H. sapiens
catcataaagaagttt

SEQ ID NO: 70042 - DNA, 16 bp, H. sapiens
catcataatgacagca

SEQ ID NO: 70043 - DNA, 16 bp, H. sapiens
catcatataaacagaa

SEQ ID NO: 70044 - DNA, 16 bp, H. sapiens
catcatataaacagag

SEQ ID NO: 70045 - DNA, 16 bp, H. sapiens
catcatcaacatcacc

SEQ ID NO: 70046 - DNA, 16 bp, H. sapiens
catcatcacaccatca

SEQ ID NO: 70047 - DNA, 16 bp, H. sapiens
catcatcaccaacatc

SEQ ID NO: 70048 - DNA, 16 bp, H. sapiens
catcatcaccagcatc

SEQ ID NO: 70049 - DNA, 16 bp, H. sapiens
catcatcaccctcatc

SEQ ID NO: 70050 - DNA, 16 bp, H. sapiens
catcatcactggttat

SEQ ID NO: 70051 - DNA, 16 bp, H. sapiens
catcatcagcagcagc

SEQ ID NO: 70052 - DNA, 16 bp, H. sapiens
catcatcagcatcacc

SEQ ID NO: 70053 - DNA, 16 bp, H. sapiens
catcatcagcatcatc

SEQ ID NO: 70054 - DNA, 16 bp, H. sapiens
catcatcaggctgcaa

SEQ ID NO: 70055 - DNA, 16 bp, H. sapiens
catcatcatcaacaac

SEQ ID NO: 70056 - DNA, 16 bp, H. sapiens
catcatcatcacctcc

SEQ ID NO: 70057 - DNA, 16 bp, H. sapiens
catcatcatcatctca

SEQ ID NO: 70058 - DNA, 16 bp, H. sapiens
catcatcatcatctct

SEQ ID NO: 70059 - DNA, 16 bp, H. sapiens
catcatcatcattctt

SEQ ID NO: 70060 - DNA, 16 bp, H. sapiens
catcatcatcccagct

SEQ ID NO: 70061 - DNA, 16 bp, H. sapiens
catcatcatcctcctc

SEQ ID NO: 70062 - DNA, 16 bp, H. sapiens
catcatcatcgtcatc

SEQ ID NO: 70063 - DNA, 16 bp, H. sapiens
catcatcatcgtcgtc

SEQ ID NO: 70064 - DNA, 16 bp, H. sapiens
catcatcatggtcatt

SEQ ID NO: 70065 - DNA, 16 bp, H. sapiens
catcatcattaccacc

SEQ ID NO: 70066 - DNA, 16 bp, H. sapiens
catcatcattgccatc

SEQ ID NO: 70067 - DNA, 16 bp, H. sapiens
catcatccatccatca

SEQ ID NO: 70068 - DNA, 16 bp, H. sapiens
catcatccccaccatc

SEQ ID NO: 70069 - DNA, 16 bp, H. sapiens
catcatccccatcatc

SEQ ID NO: 70070 - DNA, 16 bp, H. sapiens
catcatcctcagcaag

SEQ ID NO: 70071 - DNA, 16 bp, H. sapiens
catcatcctcatcatc

SEQ ID NO: 70072 - DNA, 16 bp, H. sapiens
catcatcctcatcctc

SEQ ID NO: 70073 - DNA, 16 bp, H. sapiens
catcatccttcccatc

SEQ ID NO: 70074 - DNA, 16 bp, H. sapiens
catcatctcatttgat

SEQ ID NO: 70075 - DNA, 16 bp, H. sapiens
catcatctccagcacc

SEQ ID NO: 70076 - DNA, 16 bp, H. sapiens
catcatctcctcctgc

SEQ ID NO: 70077 - DNA, 16 bp, H. sapiens
catcatcttagcccaa

SEQ ID NO: 70078 - DNA, 16 bp, H. sapiens
catcatcttcagcaaa

SEQ ID NO: 70079 - DNA, 16 bp, H. sapiens
catcatcttcatcacc

SEQ ID NO: 70080 - DNA, 16 bp, H. sapiens
catcatcttcatcatc

SEQ ID NO: 70081 - DNA, 16 bp, H. sapiens
catcatctttaagaac

SEQ ID NO: 70082 - DNA, 16 bp, H. sapiens
catcatctttgtaagc

SEQ ID NO: 70083 - DNA, 16 bp, H. sapiens
catcatgaaaacagac

SEQ ID NO: 70084 - DNA, 16 bp, H. sapiens
catcatgatcaccatc

SEQ ID NO: 70085 - DNA, 16 bp, H. sapiens
catcatgatgctagct

SEQ ID NO: 70086 - DNA, 16 bp, H. sapiens
catcatgccctgctaa

SEQ ID NO: 70087 - DNA, 16 bp, H. sapiens
catcatgcctggccat

SEQ ID NO: 70088 - DNA, 16 bp, H. sapiens
catcatgcctggctaa

SEQ ID NO: 70089 - DNA, 16 bp, H. sapiens
catcatggaaaatggg

SEQ ID NO: 70090 - DNA, 16 bp, H. sapiens
catcatggaacctgcc

SEQ ID NO: 70091 - DNA, 16 bp, H. sapiens
catcatggagaatgga

SEQ ID NO: 70092 - DNA, 16 bp, H. sapiens
catcatggccaagtgg

SEQ ID NO: 70093 - DNA, 16 bp, H. sapiens
catcatggtgaaatcc

SEQ ID NO: 70094 - DNA, 16 bp, H. sapiens
catcatgtccagctaa

SEQ ID NO: 70095 - DNA, 16 bp, H. sapiens
catcatgtcctccagg

SEQ ID NO: 70096 - DNA, 16 bp, H. sapiens
catcatgtctggctaa

SEQ ID NO: 70097 - DNA, 16 bp, H. sapiens
catcatgtttcccagg

SEQ ID NO: 70098 - DNA, 16 bp, H. sapiens
catcattagtcatcaa

SEQ ID NO: 70099 - DNA, 16 bp, H. sapiens
catcattattattatg

SEQ ID NO: 70100 - DNA, 16 bp, H. sapiens
catcattctactctct

SEQ ID NO: 70101 - DNA, 16 bp, H. sapiens
catcattcttcacaaa

SEQ ID NO: 70102 - DNA, 16 bp, H. sapiens
catcattgtcatcatc

SEQ ID NO: 70103 - DNA, 16 bp, H. sapiens
catcatttaaaaaatg

SEQ ID NO: 70104 - DNA, 16 bp, H. sapiens
catcatttcatgtcat

SEQ ID NO: 70105 - DNA, 16 bp, H. sapiens
catcatttcatttcac

SEQ ID NO: 70106 - DNA, 16 bp, H. sapiens
catcattttaaataaa

SEQ ID NO: 70107 - DNA, 16 bp, H. sapiens
catcattttctttatc

SEQ ID NO: 70108 - DNA, 16 bp, H. sapiens
catcattttgttcctt

SEQ ID NO: 70109 - DNA, 16 bp, H. sapiens
catccaaaagaataaa

SEQ ID NO: 70110 - DNA, 16 bp, H. sapiens
catccaaagaagtttc

SEQ ID NO: 70111 - DNA, 16 bp, H. sapiens
catccaaattagaaaa

SEQ ID NO: 70112 - DNA, 16 bp, H. sapiens
catccaaatttgaaag

SEQ ID NO: 70113 - DNA, 16 bp, H. sapiens
catccaacagtaccta

SEQ ID NO: 70114 - DNA, 16 bp, H. sapiens
catccaagttgttgca

SEQ ID NO: 70115 - DNA, 16 bp, H. sapiens
catccaataaatattt

SEQ ID NO: 70116 - DNA, 16 bp, H. sapiens
catccacacacatgca

SEQ ID NO: 70117 - DNA, 16 bp, H. sapiens
catccacaccaaaatc

SEQ ID NO: 70118 - DNA, 16 bp, H. sapiens
catccacacttcccca

SEQ ID NO: 70119 - DNA, 16 bp, H. sapiens
catccacatccacatc

SEQ ID NO: 70120 - DNA, 16 bp, H. sapiens
catccacatcctgctg

SEQ ID NO: 70121 - DNA, 16 bp, H. sapiens
catccacattgttgca

SEQ ID NO: 70122 - DNA, 16 bp, H. sapiens
catccaccaaatattt

SEQ ID NO: 70123 - DNA, 16 bp, H. sapiens
catccaccaccatgcc

SEQ ID NO: 70124 - DNA, 16 bp, H. sapiens
catccacccatccttc

SEQ ID NO: 70125 - DNA, 16 bp, H. sapiens
catccaccctcccaag

SEQ ID NO: 70126 - DNA, 16 bp, H. sapiens
catccacctatccacc

SEQ ID NO: 70127 - DNA, 16 bp, H. sapiens
catccacctcctgcag

SEQ ID NO: 70128 - DNA, 16 bp, H. sapiens
catccaccttggcctc

SEQ ID NO: 70129 - DNA, 16 bp, H. sapiens
catccacgctggagtg

SEQ ID NO: 70130 - DNA, 16 bp, H. sapiens
catccactgatgaaca

SEQ ID NO: 70131 - DNA, 16 bp, H. sapiens
catccactttggcctc

SEQ ID NO: 70132 - DNA, 16 bp, H. sapiens
catccagaaaagaagt

SEQ ID NO: 70133 - DNA, 16 bp, H. sapiens
catccagaccccagaa

SEQ ID NO: 70134 - DNA, 16 bp, H. sapiens
catccagactggagtg

SEQ ID NO: 70135 - DNA, 16 bp, H. sapiens
catccagatggccagt

SEQ ID NO: 70136 - DNA, 16 bp, H. sapiens
catccagcagcagcag

SEQ ID NO: 70137 - DNA, 19 bp, H. sapiens
catccagcctgggcaacag

SEQ ID NO: 70138 - DNA, 16 bp, H. sapiens
catccaggaatttcca

SEQ ID NO: 70139 - DNA, 16 bp, H. sapiens
catccaggagccaagg

SEQ ID NO: 70140 - DNA, 16 bp, H. sapiens
catccaggagtttcca

SEQ ID NO: 70141 - DNA, 16 bp, H. sapiens
catccaggctggaagg

SEQ ID NO: 70142 - DNA, 16 bp, H. sapiens
catccaggctggtctc

SEQ ID NO: 70143 - DNA, 16 bp, H. sapiens
catccaggctttgctg

SEQ ID NO: 70144 - DNA, 16 bp, H. sapiens
catccagggcatgctg

SEQ ID NO: 70145 - DNA, 16 bp, H. sapiens
catccagtcctgggct

SEQ ID NO: 70146 - DNA, 16 bp, H. sapiens
catccatcaccaccat

SEQ ID NO: 70147 - DNA, 16 bp, H. sapiens
catccatccatccacc

SEQ ID NO: 70148 - DNA, 20 bp, H. sapiens
catccatccatccacccatt

SEQ ID NO: 70149 - DNA, 16 bp, H. sapiens
catccatccattcttt

SEQ ID NO: 70150 - DNA, 16 bp, H. sapiens
catccatccctccatt

SEQ ID NO: 70151 - DNA, 16 bp, H. sapiens
catccatctatccaac

SEQ ID NO: 70152 - DNA, 16 bp, H. sapiens
catccatctgcccatc

SEQ ID NO: 70153 - DNA, 26 bp, H. sapiens
catccatgtccctacaaaggacatga

SEQ ID NO: 70154 - DNA, 16 bp, H. sapiens
catccatgtccctcca

SEQ ID NO: 70155 - DNA, 16 bp, H. sapiens
catccatgttgcagca

SEQ ID NO: 70156 - DNA, 16 bp, H. sapiens
catccatgttgttgca

SEQ ID NO: 70157 - DNA, 16 bp, H. sapiens
catccattaggatggc

SEQ ID NO: 70158 - DNA, 16 bp, H. sapiens
catccattcatccatg

SEQ ID NO: 70159 - DNA, 16 bp, H. sapiens
catccattcatccatt

SEQ ID NO: 70160 - DNA, 16 bp, H. sapiens
catccattctgcagtc

SEQ ID NO: 70161 - DNA, 16 bp, H. sapiens
catccattcttccatc

SEQ ID NO: 70162 - DNA, 16 bp, H. sapiens
catccatttatccatt

SEQ ID NO: 70163 - DNA, 16 bp, H. sapiens
catcccaaaaccatct

SEQ ID NO: 70164 - DNA, 16 bp, H. sapiens
catcccacttctgggt

SEQ ID NO: 70165 - DNA, 16 bp, H. sapiens
catcccagacctcctg

SEQ ID NO: 70166 - DNA, 16 bp, H. sapiens
catcccagaggggcag

SEQ ID NO: 70167 - DNA, 18 bp, H. sapiens
catcccagcactttggga

SEQ ID NO: 70168 - DNA, 16 bp, H. sapiens
catcccagccactcta

SEQ ID NO: 70169 - DNA, 16 bp, H. sapiens
catcccagcctcaggc

SEQ ID NO: 70170 - DNA, 16 bp, H. sapiens
catcccagctccaccc

SEQ ID NO: 70171 - DNA, 16 bp, H. sapiens
catcccagggaagaag

SEQ ID NO: 70172 - DNA, 16 bp, H. sapiens
catcccagggtctcca

SEQ ID NO: 70173 - DNA, 16 bp, H. sapiens
catcccaggttcaagc

SEQ ID NO: 70174 - DNA, 16 bp, H. sapiens
catccccaaaacacat

SEQ ID NO: 70175 - DNA, 16 bp, H. sapiens
catccccactggggaa

SEQ ID NO: 70176 - DNA, 16 bp, H. sapiens
catccccatttcacag

SEQ ID NO: 70177 - DNA, 16 bp, H. sapiens
catcccccaccagagt

SEQ ID NO: 70178 - DNA, 17 bp, H. sapiens
catcccccagcctgaca

SEQ ID NO: 70179 - DNA, 16 bp, H. sapiens
catcccccttccagct

SEQ ID NO: 70180 - DNA, 16 bp, H. sapiens
catcccccttctggct

SEQ ID NO: 70181 - DNA, 16 bp, H. sapiens
catcccctttccagct

SEQ ID NO: 70182 - DNA, 16 bp, H. sapiens
catcccctttgtcatt

SEQ ID NO: 70183 - DNA, 16 bp, H. sapiens
catccctaagtacatt

SEQ ID NO: 70184 - DNA, 16 bp, H. sapiens
catccctacagaaaaa

SEQ ID NO: 70185 - DNA, 16 bp, H. sapiens
catccctccctccctg

SEQ ID NO: 70186 - DNA, 16 bp, H. sapiens
catccctgcaagccca

SEQ ID NO: 70187 - DNA, 16 bp, H. sapiens
catccctgcatccctg

SEQ ID NO: 70188 - DNA, 16 bp, H. sapiens
catccctgggatacaa

SEQ ID NO: 70189 - DNA, 16 bp, H. sapiens
catccctgggcttgtg

SEQ ID NO: 70190 - DNA, 16 bp, H. sapiens
catccctggtatctct

SEQ ID NO: 70191 - DNA, 16 bp, H. sapiens
catccctgtatcaaaa

SEQ ID NO: 70192 - DNA, 16 bp, H. sapiens
catccctgtcctgtgc

SEQ ID NO: 70193 - DNA, 16 bp, H. sapiens
catccctgtcttctgc

SEQ ID NO: 70194 - DNA, 16 bp, H. sapiens
catccctgtggctttg

SEQ ID NO: 70195 - DNA, 16 bp, H. sapiens
catcccttgtaaggtg

SEQ ID NO: 70196 - DNA, 16 bp, H. sapiens
catcccttgtcaactt

SEQ ID NO: 70197 - DNA, 16 bp, H. sapiens
catccctttattttga

SEQ ID NO: 70198 - DNA, 16 bp, H. sapiens
catccgcccacctcgg

SEQ ID NO: 70199 - DNA, 17 bp, H. sapiens
catccggaggcctaaac

SEQ ID NO: 70200 - DNA, 16 bp, H. sapiens
catccgggctggagtg

SEQ ID NO: 70201 - DNA, 16 bp, H. sapiens
catccgtccgtccatc

SEQ ID NO: 70202 - DNA, 16 bp, H. sapiens
catcctcaacttcctg

SEQ ID NO: 70203 - DNA, 16 bp, H. sapiens
catcctcaccatcacc

SEQ ID NO: 70204 - DNA, 16 bp, H. sapiens
catcctcaccatcatc

SEQ ID NO: 70205 - DNA, 16 bp, H. sapiens
catcctcaccatcatt

SEQ ID NO: 70206 - DNA, 16 bp, H. sapiens
catcctcagcaaactg

SEQ ID NO: 70207 - DNA, 16 bp, H. sapiens
catcctcatagctcag

SEQ ID NO: 70208 - DNA, 16 bp, H. sapiens
catcctcatcaacatt

SEQ ID NO: 70209 - DNA, 16 bp, H. sapiens
catcctcatcaccatc

SEQ ID NO: 70210 - DNA, 16 bp, H. sapiens
catcctcatcatcacc

SEQ ID NO: 70211 - DNA, 16 bp, H. sapiens
catcctcatcctcatc

SEQ ID NO: 70212 - DNA, 16 bp, H. sapiens
catcctcattttacag

SEQ ID NO: 70213 - DNA, 16 bp, H. sapiens
catcctccagcccctg

SEQ ID NO: 70214 - DNA, 16 bp, H. sapiens
catcctccaggcccca

SEQ ID NO: 70215 - DNA, 16 bp, H. sapiens
catcctccatcctcca

SEQ ID NO: 70216 - DNA, 16 bp, H. sapiens
catcctcccaaagtgt

SEQ ID NO: 70217 - DNA, 16 bp, H. sapiens
catcctcccatctcag

SEQ ID NO: 70218 - DNA, 16 bp, H. sapiens
catcctcctccctcag

SEQ ID NO: 70219 - DNA, 16 bp, H. sapiens
catcctcctcctcctg

SEQ ID NO: 70220 - DNA, 16 bp, H. sapiens
catcctcctgagcagc

SEQ ID NO: 70221 - DNA, 16 bp, H. sapiens
catcctcctgcccagc

SEQ ID NO: 70222 - DNA, 16 bp, H. sapiens
catcctcctgtctcag

SEQ ID NO: 70223 - DNA, 16 bp, H. sapiens
catcctctacagcatc

SEQ ID NO: 70224 - DNA, 17 bp, H. sapiens
catcctctcaagcacct

SEQ ID NO: 70225 - DNA, 16 bp, H. sapiens
catcctctccaacacc

SEQ ID NO: 70226 - DNA, 16 bp, H. sapiens
catcctctccagcatt

SEQ ID NO: 70227 - DNA, 16 bp, H. sapiens
catcctctcctctgct

SEQ ID NO: 70228 - DNA, 16 bp, H. sapiens
catcctcttcagcatc

SEQ ID NO: 70229 - DNA, 16 bp, H. sapiens
catcctgaaaccatcc

SEQ ID NO: 70230 - DNA, 16 bp, H. sapiens
catcctgaacccctgg

SEQ ID NO: 70231 - DNA, 16 bp, H. sapiens
catcctgaagcagctg

SEQ ID NO: 70232 - DNA, 16 bp, H. sapiens
catcctgatttcagag

SEQ ID NO: 70233 - DNA, 16 bp, H. sapiens
catcctgcagtgcaca

SEQ ID NO: 70234 - DNA, 16 bp, H. sapiens
catcctggaaaaggca

SEQ ID NO: 70235 - DNA, 16 bp, H. sapiens
catcctggagatgaag

SEQ ID NO: 70236 - DNA, 16 bp, H. sapiens
catcctggccaccatg

SEQ ID NO: 70237 - DNA, 16 bp, H. sapiens
catcctggccagcatg

SEQ ID NO: 70238 - DNA, 16 bp, H. sapiens
catcctggccaggcac

SEQ ID NO: 70239 - DNA, 40 bp, H. sapiens
catcctggctaacatggtgaaaccccgtctctactaaaaa

SEQ ID NO: 70240 - DNA, 16 bp, H. sapiens
catcctgggcaaaaga

SEQ ID NO: 70241 - DNA, 16 bp, H. sapiens
catcctggtcaacgtg

SEQ ID NO: 70242 - DNA, 16 bp, H. sapiens
catcctgtatttttat

SEQ ID NO: 70243 - DNA, 16 bp, H. sapiens
catccttaccagcatt

SEQ ID NO: 70244 - DNA, 16 bp, H. sapiens
catccttatcatcttc

SEQ ID NO: 70245 - DNA, 16 bp, H. sapiens
catccttcaaaaccca

SEQ ID NO: 70246 - DNA, 16 bp, H. sapiens
catccttcaaggccca

SEQ ID NO: 70247 - DNA, 16 bp, H. sapiens
catccttcaagtctgt

SEQ ID NO: 70248 - DNA, 16 bp, H. sapiens
catccttccatccatc

SEQ ID NO: 70249 - DNA, 16 bp, H. sapiens
catccttccatccctg

SEQ ID NO: 70250 - DNA, 16 bp, H. sapiens
catccttctactctct

SEQ ID NO: 70251 - DNA, 16 bp, H. sapiens
catccttctcttcctg

SEQ ID NO: 70252 - DNA, 16 bp, H. sapiens
catccttgcatcactg

SEQ ID NO: 70253 - DNA, 16 bp, H. sapiens
catccttgccttcttc

SEQ ID NO: 70254 - DNA, 16 bp, H. sapiens
catccttggcctctgc

SEQ ID NO: 70255 - DNA, 16 bp, H. sapiens
catccttgtcttattc

SEQ ID NO: 70256 - DNA, 16 bp, H. sapiens
catcctttcattttca

SEQ ID NO: 70257 - DNA, 16 bp, H. sapiens
catccttttactttga

SEQ ID NO: 70258 - DNA, 16 bp, H. sapiens
catccttttcaataaa

SEQ ID NO: 70259 - DNA, 16 bp, H. sapiens
catcgcccattctctc

SEQ ID NO: 70260 - DNA, 17 bp, H. sapiens
catcgctggccatcaga

SEQ ID NO: 70261 - DNA, 16 bp, H. sapiens
catcgtgcccagcccc

SEQ ID NO: 70262 - DNA, 16 bp, H. sapiens
catcgtgcctggccac

SEQ ID NO: 70263 - DNA, 16 bp, H. sapiens
catcgtggccaacatg

SEQ ID NO: 70264 - DNA, 16 bp, H. sapiens
catctaaatttttttc

SEQ ID NO: 70265 - DNA, 16 bp, H. sapiens
catctacaaaaatcaa

SEQ ID NO: 70266 - DNA, 16 bp, H. sapiens
catctacaaagaccct

SEQ ID NO: 70267 - DNA, 16 bp, H. sapiens
catctacccactcacc

SEQ ID NO: 70268 - DNA, 16 bp, H. sapiens
catctacctcagcctc

SEQ ID NO: 70269 - DNA, 16 bp, H. sapiens
catctataaaatgaga

SEQ ID NO: 70270 - DNA, 16 bp, H. sapiens
catctataaaatggga

SEQ ID NO: 70271 - DNA, 16 bp, H. sapiens
catctatatatctata

SEQ ID NO: 70272 - DNA, 16 bp, H. sapiens
catctatattcatgag

SEQ ID NO: 70273 - DNA, 16 bp, H. sapiens
catctatatttataaa

SEQ ID NO: 70274 - DNA, 16 bp, H. sapiens
catctatccatccatc

SEQ ID NO: 70275 - DNA, 16 bp, H. sapiens
catctatccatccttc

SEQ ID NO: 70276 - DNA, 16 bp, H. sapiens
catctatcttattagt

SEQ ID NO: 70277 - DNA, 16 bp, H. sapiens
catctattatgtatca

SEQ ID NO: 70278 - DNA, 16 bp, H. sapiens
catctattgtttcctg

SEQ ID NO: 70279 - DNA, 16 bp, H. sapiens
catctcaaaaaataca

SEQ ID NO: 70280 - DNA, 16 bp, H. sapiens
catctcaaaacaaaat

SEQ ID NO: 70281 - DNA, 16 bp, H. sapiens
catctcaaaagaaaag

SEQ ID NO: 70282 - DNA, 16 bp, H. sapiens
catctcaaaagaaaat

SEQ ID NO: 70283 - DNA, 16 bp, H. sapiens
catctcaaaataaaac

SEQ ID NO: 70284 - DNA, 16 bp, H. sapiens
catctcaaaataatta

SEQ ID NO: 70285 - DNA, 16 bp, H. sapiens
catctcaaagaaataa

SEQ ID NO: 70286 - DNA, 16 bp, H. sapiens
catctcaaattatttt

SEQ ID NO: 70287 - DNA, 16 bp, H. sapiens
catctcaacactttgg

SEQ ID NO: 70288 - DNA, 16 bp, H. sapiens
catctcaataaacaca

SEQ ID NO: 70289 - DNA, 16 bp, H. sapiens
catctcaatttttaaa

SEQ ID NO: 70290 - DNA, 16 bp, H. sapiens
catctcacatgcaaaa

SEQ ID NO: 70291 - DNA, 16 bp, H. sapiens
catctcaccccagtta

SEQ ID NO: 70292 - DNA, 16 bp, H. sapiens
catctcagaaagttct

SEQ ID NO: 70293 - DNA, 16 bp, H. sapiens
catctcagaagaaaaa

SEQ ID NO: 70294 - DNA, 16 bp, H. sapiens
catctcagacaatggg

SEQ ID NO: 70295 - DNA, 16 bp, H. sapiens
catctcagatgatggg

SEQ ID NO: 70296 - DNA, 16 bp, H. sapiens
catctcagcatcctga

SEQ ID NO: 70297 - DNA, 20 bp, H. sapiens
catctcagcccaaaatctct

SEQ ID NO: 70298 - DNA, 16 bp, H. sapiens
catctcagcctcctga

SEQ ID NO: 70299 - DNA, 16 bp, H. sapiens
catctcagcctcctgc

SEQ ID NO: 70300 - DNA, 16 bp, H. sapiens
catctcagctcactga

SEQ ID NO: 70301 - DNA, 16 bp, H. sapiens
catctcagcttactgc

SEQ ID NO: 70302 - DNA, 16 bp, H. sapiens
catctcagcttcagcc

SEQ ID NO: 70303 - DNA, 16 bp, H. sapiens
catctcaggctctgct

SEQ ID NO: 70304 - DNA, 16 bp, H. sapiens
catctcagggcaaagc

SEQ ID NO: 70305 - DNA, 16 bp, H. sapiens
catctcatcctccatc

SEQ ID NO: 70306 - DNA, 16 bp, H. sapiens
catctcatctcatcat

SEQ ID NO: 70307 - DNA, 16 bp, H. sapiens
catctcatttcttctc

SEQ ID NO: 70308 - DNA, 16 bp, H. sapiens
catctccaaacaaaca

SEQ ID NO: 70309 - DNA, 16 bp, H. sapiens
catctccaaatatcat

SEQ ID NO: 70310 - DNA, 16 bp, H. sapiens
catctccagacattgc

SEQ ID NO: 70311 - DNA, 16 bp, H. sapiens
catctccagatgagaa

SEQ ID NO: 70312 - DNA, 16 bp, H. sapiens
catctccatcaccacc

SEQ ID NO: 70313 - DNA, 16 bp, H. sapiens
catctccatcagagct

SEQ ID NO: 70314 - DNA, 16 bp, H. sapiens
catctccatctgggac

SEQ ID NO: 70315 - DNA, 16 bp, H. sapiens
catctcccaccagagt

SEQ ID NO: 70316 - DNA, 16 bp, H. sapiens
catctcccagagttga

SEQ ID NO: 70317 - DNA, 16 bp, H. sapiens
catctcccatcaggcc

SEQ ID NO: 70318 - DNA, 16 bp, H. sapiens
catctctaaataaaat

SEQ ID NO: 70319 - DNA, 16 bp, H. sapiens
catctctacaaaacac

SEQ ID NO: 70320 - DNA, 16 bp, H. sapiens
catctctaccaaaaca

SEQ ID NO: 70321 - DNA, 16 bp, H. sapiens
catctctaccagaaaa

SEQ ID NO: 70322 - DNA, 19 bp, H. sapiens
catctctactaaaaaaaat

SEQ ID NO: 70323 - DNA, 16 bp, H. sapiens
catctctacttaaaat

SEQ ID NO: 70324 - DNA, 16 bp, H. sapiens
catctctctgggcctc

SEQ ID NO: 70325 - DNA, 16 bp, H. sapiens
catctctgaaggacag

SEQ ID NO: 70326 - DNA, 16 bp, H. sapiens
catctctgacttcttt

SEQ ID NO: 70327 - DNA, 16 bp, H. sapiens
catctctgatttcttt

SEQ ID NO: 70328 - DNA, 16 bp, H. sapiens
catctctgcctctgtc

SEQ ID NO: 70329 - DNA, 16 bp, H. sapiens
catctctgctgaaaat

SEQ ID NO: 70330 - DNA, 16 bp, H. sapiens
catctctggcctctac

SEQ ID NO: 70331 - DNA, 16 bp, H. sapiens
catctctgggcttcag

SEQ ID NO: 70332 - DNA, 16 bp, H. sapiens
catctctggtatgaaa

SEQ ID NO: 70333 - DNA, 16 bp, H. sapiens
catctctgtcaaaaat

SEQ ID NO: 70334 - DNA, 16 bp, H. sapiens
catctctgtggctttg

SEQ ID NO: 70335 - DNA, 16 bp, H. sapiens
catctctgtgtctggg

SEQ ID NO: 70336 - DNA, 16 bp, H. sapiens
catctcttaaaaaaag

SEQ ID NO: 70337 - DNA, 16 bp, H. sapiens
catctcttcccagctc

SEQ ID NO: 70338 - DNA, 16 bp, H. sapiens
catctcttctgccatg

SEQ ID NO: 70339 - DNA, 16 bp, H. sapiens
catctctttactttta

SEQ ID NO: 70340 - DNA, 16 bp, H. sapiens
catctctttattttga

SEQ ID NO: 70341 - DNA, 20 bp, H. sapiens
catctgacaaagggctaata

SEQ ID NO: 70342 - DNA, 16 bp, H. sapiens
catctgagaaatggga

SEQ ID NO: 70343 - DNA, 16 bp, H. sapiens
catctgagacctcatc

SEQ ID NO: 70344 - DNA, 16 bp, H. sapiens
catctgagaccttcta

SEQ ID NO: 70345 - DNA, 16 bp, H. sapiens
catctgagcccaggag

SEQ ID NO: 70346 - DNA, 16 bp, H. sapiens
catctgagggcaggag

SEQ ID NO: 70347 - DNA, 16 bp, H. sapiens
catctgatctgtgaca

SEQ ID NO: 70348 - DNA, 16 bp, H. sapiens
catctgcaaacaagga

SEQ ID NO: 70349 - DNA, 16 bp, H. sapiens
catctgcaaacaggca

SEQ ID NO: 70350 - DNA, 16 bp, H. sapiens
catctgcaaaccagga

SEQ ID NO: 70351 - DNA, 16 bp, H. sapiens
catctgcaaatcctgc

SEQ ID NO: 70352 - DNA, 16 bp, H. sapiens
catctgcaagcagaga

SEQ ID NO: 70353 - DNA, 16 bp, H. sapiens
catctgcaagctgagg

SEQ ID NO: 70354 - DNA, 16 bp, H. sapiens
catctgcagcaacatg

SEQ ID NO: 70355 - DNA, 16 bp, H. sapiens
catctgccaccacgcc

SEQ ID NO: 70356 - DNA, 16 bp, H. sapiens
catctgccaccaggcc

SEQ ID NO: 70357 - DNA, 16 bp, H. sapiens
catctgcccacccatc

SEQ ID NO: 70358 - DNA, 16 bp, H. sapiens
catctgcctcagcctc

SEQ ID NO: 70359 - DNA, 16 bp, H. sapiens
catctgcctcagcttc

SEQ ID NO: 70360 - DNA, 16 bp, H. sapiens
catctgcctcccaggc

SEQ ID NO: 70361 - DNA, 16 bp, H. sapiens
catctgcctcctgggc

SEQ ID NO: 70362 - DNA, 16 bp, H. sapiens
catctgcctcgacctc

SEQ ID NO: 70363 - DNA, 16 bp, H. sapiens
catctgcctctggtga

SEQ ID NO: 70364 - DNA, 16 bp, H. sapiens
catctgctgagcttct

SEQ ID NO: 70365 - DNA, 16 bp, H. sapiens
catctgctgatggaca

SEQ ID NO: 70366 - DNA, 16 bp, H. sapiens
catctgcttctgggga

SEQ ID NO: 70367 - DNA, 16 bp, H. sapiens
catctgctttggcctc

SEQ ID NO: 70368 - DNA, 16 bp, H. sapiens
catctggaaaataaaa

SEQ ID NO: 70369 - DNA, 16 bp, H. sapiens
catctggaaaatggaa

SEQ ID NO: 70370 - DNA, 16 bp, H. sapiens
catctggaaaatgggg

SEQ ID NO: 70371 - DNA, 16 bp, H. sapiens
catctggaatttattt

SEQ ID NO: 70372 - DNA, 16 bp, H. sapiens
catctggcaggtgccc

SEQ ID NO: 70373 - DNA, 16 bp, H. sapiens
catctggctacttttt

SEQ ID NO: 70374 - DNA, 16 bp, H. sapiens
catctgggaaatgagg

SEQ ID NO: 70375 - DNA, 16 bp, H. sapiens
catctgggggcagggc

SEQ ID NO: 70376 - DNA, 16 bp, H. sapiens
catctgggtgctgggc

SEQ ID NO: 70377 - DNA, 16 bp, H. sapiens
catctggtgagggcct

SEQ ID NO: 70378 - DNA, 16 bp, H. sapiens
catctgtaaaaaagaa

SEQ ID NO: 70379 - DNA, 16 bp, H. sapiens
catctgtaaaacaggg

SEQ ID NO: 70380 - DNA, 16 bp, H. sapiens
catctgtaaaacgggg

SEQ ID NO: 70381 - DNA, 16 bp, H. sapiens
catctgtaaaaggaag

SEQ ID NO: 70382 - DNA, 16 bp, H. sapiens
catctgtaaaataaat

SEQ ID NO: 70383 - DNA, 16 bp, H. sapiens
catctgtaaaataaga

SEQ ID NO: 70384 - DNA, 16 bp, H. sapiens
catctgtaaaatagac

SEQ ID NO: 70385 - DNA, 16 bp, H. sapiens
catctgtaaaatgaga

SEQ ID NO: 70386 - DNA, 16 bp, H. sapiens
catctgtaaaatgatg

SEQ ID NO: 70387 - DNA, 16 bp, H. sapiens
catctgtaaaatggaa

SEQ ID NO: 70388 - DNA, 16 bp, H. sapiens
catctgtaaaatggga

SEQ ID NO: 70389 - DNA, 16 bp, H. sapiens
catctgtaaaatgggc

SEQ ID NO: 70390 - DNA, 16 bp, H. sapiens
catctgtaaaatgggt

SEQ ID NO: 70391 - DNA, 16 bp, H. sapiens
catctgtagaatgggg

SEQ ID NO: 70392 - DNA, 16 bp, H. sapiens
catctgtagatggaca

SEQ ID NO: 70393 - DNA, 16 bp, H. sapiens
catctgtagccccagc

SEQ ID NO: 70394 - DNA, 16 bp, H. sapiens
catctgtataaaaata

SEQ ID NO: 70395 - DNA, 16 bp, H. sapiens
catctgtatacatgtg

SEQ ID NO: 70396 - DNA, 17 bp, H. sapiens
catctgtatatcaccat

SEQ ID NO: 70397 - DNA, 16 bp, H. sapiens
catctgtatgaaatca

SEQ ID NO: 70398 - DNA, 16 bp, H. sapiens
catctgtcaaatgaga

SEQ ID NO: 70399 - DNA, 16 bp, H. sapiens
catctgtcaccacttt

SEQ ID NO: 70400 - DNA, 16 bp, H. sapiens
catctgtccatccatc

SEQ ID NO: 70401 - DNA, 16 bp, H. sapiens
catctgtgaaaaggga

SEQ ID NO: 70402 - DNA, 16 bp, H. sapiens
catctgtgaaacagaa

SEQ ID NO: 70403 - DNA, 16 bp, H. sapiens
catctgtgaaacaggg

SEQ ID NO: 70404 - DNA, 16 bp, H. sapiens
catctgtgaaatgaaa

SEQ ID NO: 70405 - DNA, 16 bp, H. sapiens
catctgtgaaatggga

SEQ ID NO: 70406 - DNA, 16 bp, H. sapiens
catctgtgaaccaggc

SEQ ID NO: 70407 - DNA, 16 bp, H. sapiens
catctgtgaagcagag

SEQ ID NO: 70408 - DNA, 16 bp, H. sapiens
catctgtgaagtggag

SEQ ID NO: 70409 - DNA, 16 bp, H. sapiens
catctgtgaagtggga

SEQ ID NO: 70410 - DNA, 16 bp, H. sapiens
catctgtgagtgagaa

SEQ ID NO: 70411 - DNA, 16 bp, H. sapiens
catctgtggaaaaatt

SEQ ID NO: 70412 - DNA, 16 bp, H. sapiens
catctgtggaatggga

SEQ ID NO: 70413 - DNA, 16 bp, H. sapiens
catctgtggaatgggg

SEQ ID NO: 70414 - DNA, 16 bp, H. sapiens
catctgtggtttcctg

SEQ ID NO: 70415 - DNA, 16 bp, H. sapiens
catctgtgtatgtgtg

SEQ ID NO: 70416 - DNA, 16 bp, H. sapiens
catctgtgtgctcccc

SEQ ID NO: 70417 - DNA, 16 bp, H. sapiens
catctgttaaaaaaaa

SEQ ID NO: 70418 - DNA, 16 bp, H. sapiens
catctgttacctatct

SEQ ID NO: 70419 - DNA, 16 bp, H. sapiens
catctgttattatttt

SEQ ID NO: 70420 - DNA, 16 bp, H. sapiens
catctgttcatccatc

SEQ ID NO: 70421 - DNA, 16 bp, H. sapiens
catctgttgaatgaat

SEQ ID NO: 70422 - DNA, 16 bp, H. sapiens
catctgttgtttcctc

SEQ ID NO: 70423 - DNA, 16 bp, H. sapiens
catctgtttatggaca

SEQ ID NO: 70424 - DNA, 16 bp, H. sapiens
catctgtttcttttta

SEQ ID NO: 70425 - DNA, 16 bp, H. sapiens
catcttaaaaagaaaa

SEQ ID NO: 70426 - DNA, 16 bp, H. sapiens
catcttacagctagac

SEQ ID NO: 70427 - DNA, 16 bp, H. sapiens
catcttcacagacaca

SEQ ID NO: 70428 - DNA, 16 bp, H. sapiens
catcttcaccaacatc

SEQ ID NO: 70429 - DNA, 16 bp, H. sapiens
catcttcaccagcatc

SEQ ID NO: 70430 - DNA, 16 bp, H. sapiens
catcttcaccagcatt

SEQ ID NO: 70431 - DNA, 16 bp, H. sapiens
catcttcaggatccac

SEQ ID NO: 70432 - DNA, 16 bp, H. sapiens
catcttcaggctccat

SEQ ID NO: 70433 - DNA, 16 bp, H. sapiens
catcttcatcaccatc

SEQ ID NO: 70434 - DNA, 16 bp, H. sapiens
catcttcatcatcatc

SEQ ID NO: 70435 - DNA, 16 bp, H. sapiens
catcttcatttctgcc

SEQ ID NO: 70436 - DNA, 16 bp, H. sapiens
catcttccagacccca

SEQ ID NO: 70437 - DNA, 16 bp, H. sapiens
catcttcccaaactga

SEQ ID NO: 70438 - DNA, 16 bp, H. sapiens
catcttcctcatcttc

SEQ ID NO: 70439 - DNA, 16 bp, H. sapiens
catcttcctgtatact

SEQ ID NO: 70440 - DNA, 16 bp, H. sapiens
catcttctccagcacc

SEQ ID NO: 70441 - DNA, 16 bp, H. sapiens
catcttcttcacaggg

SEQ ID NO: 70442 - DNA, 16 bp, H. sapiens
catcttcttcatcttc

SEQ ID NO: 70443 - DNA, 16 bp, H. sapiens
catcttcttccaatat

SEQ ID NO: 70444 - DNA, 16 bp, H. sapiens
catcttcttttttaaa

SEQ ID NO: 70445 - DNA, 16 bp, H. sapiens
catcttgaaaaataaa

SEQ ID NO: 70446 - DNA, 16 bp, H. sapiens
catcttgaagcccctc

SEQ ID NO: 70447 - DNA, 16 bp, H. sapiens
catcttgaataaattt

SEQ ID NO: 70448 - DNA, 16 bp, H. sapiens
catcttgatcttggat

SEQ ID NO: 70449 - DNA, 16 bp, H. sapiens
catcttgatttttaaa

SEQ ID NO: 70450 - DNA, 16 bp, H. sapiens
catcttgcaaaactgt

SEQ ID NO: 70451 - DNA, 16 bp, H. sapiens
catcttgctcaggctg

SEQ ID NO: 70452 - DNA, 16 bp, H. sapiens
catcttggaacctccc

SEQ ID NO: 70453 - DNA, 16 bp, H. sapiens
catcttggaagtggag

SEQ ID NO: 70454 - DNA, 16 bp, H. sapiens
catcttggaggcagag

SEQ ID NO: 70455 - DNA, 16 bp, H. sapiens
catcttggatgctaat

SEQ ID NO: 70456 - DNA, 16 bp, H. sapiens
catcttggccaggttg

SEQ ID NO: 70457 - DNA, 17 bp, H. sapiens
catcttggctcattgca

SEQ ID NO: 70458 - DNA, 16 bp, H. sapiens
catcttgggatttcat

SEQ ID NO: 70459 - DNA, 16 bp, H. sapiens
catcttggtcttggac

SEQ ID NO: 70460 - DNA, 16 bp, H. sapiens
catcttgtcccactga

SEQ ID NO: 70461 - DNA, 16 bp, H. sapiens
catctttaaaaaagaa

SEQ ID NO: 70462 - DNA, 16 bp, H. sapiens
catctttaaaatattg

SEQ ID NO: 70463 - DNA, 16 bp, H. sapiens
catctttacttaaaaa

SEQ ID NO: 70464 - DNA, 16 bp, H. sapiens
catctttataaaaaat

SEQ ID NO: 70465 - DNA, 16 bp, H. sapiens
catctttatcaaaaat

SEQ ID NO: 70466 - DNA, 16 bp, H. sapiens
catctttatcagcagc

SEQ ID NO: 70467 - DNA, 16 bp, H. sapiens
catctttattaaaaat

SEQ ID NO: 70468 - DNA, 16 bp, H. sapiens
catctttattatgttg

SEQ ID NO: 70469 - DNA, 16 bp, H. sapiens
catctttcactgacac

SEQ ID NO: 70470 - DNA, 16 bp, H. sapiens
catctttcattacatt

SEQ ID NO: 70471 - DNA, 16 bp, H. sapiens
catctttctcccatac

SEQ ID NO: 70472 - DNA, 16 bp, H. sapiens
catctttctggtgacc

SEQ ID NO: 70473 - DNA, 16 bp, H. sapiens
catctttgaaaatatt

SEQ ID NO: 70474 - DNA, 16 bp, H. sapiens
catctttgaaaatgtc

SEQ ID NO: 70475 - DNA, 16 bp, H. sapiens
catctttgaagcagag

SEQ ID NO: 70476 - DNA, 16 bp, H. sapiens
catctttgccaacact

SEQ ID NO: 70477 - DNA, 16 bp, H. sapiens
catctttgccaacatt

SEQ ID NO: 70478 - DNA, 16 bp, H. sapiens
catctttgccaggctg

SEQ ID NO: 70479 - DNA, 16 bp, H. sapiens
catctttgctgtttgg

SEQ ID NO: 70480 - DNA, 16 bp, H. sapiens
catctttggaaaatac

SEQ ID NO: 70481 - DNA, 16 bp, H. sapiens
catctttggggacatt

SEQ ID NO: 70482 - DNA, 16 bp, H. sapiens
catctttgtcaaaaat

SEQ ID NO: 70483 - DNA, 16 bp, H. sapiens
catctttgttcttctt

SEQ ID NO: 70484 - DNA, 16 bp, H. sapiens
catcttttaaaaaata

SEQ ID NO: 70485 - DNA, 16 bp, H. sapiens
catcttttaatatgct

SEQ ID NO: 70486 - DNA, 16 bp, H. sapiens
catcttttattccata

SEQ ID NO: 70487 - DNA, 16 bp, H. sapiens
catcttttcatttgtt

SEQ ID NO: 70488 - DNA, 16 bp, H. sapiens
catcttttgtttcctg

SEQ ID NO: 70489 - DNA, 16 bp, H. sapiens
catgaaaaaaatgttt

SEQ ID NO: 70490 - DNA, 16 bp, H. sapiens
catgaaaaagaaggaa

SEQ ID NO: 70491 - DNA, 16 bp, H. sapiens
catgaaaaataaattt

SEQ ID NO: 70492 - DNA, 16 bp, H. sapiens
catgaaaacaacattt

SEQ ID NO: 70493 - DNA, 16 bp, H. sapiens
catgaaaaccctcact

SEQ ID NO: 70494 - DNA, 16 bp, H. sapiens
catgaaaatggctata

SEQ ID NO: 70495 - DNA, 16 bp, H. sapiens
catgaaaatgtggaag

SEQ ID NO: 70496 - DNA, 16 bp, H. sapiens
catgaaacaacatgga

SEQ ID NO: 70497 - DNA, 17 bp, H. sapiens
catgaaagtgatgggga

SEQ ID NO: 70498 - DNA, 16 bp, H. sapiens
catgaaagtggacaag

SEQ ID NO: 70499 - DNA, 16 bp, H. sapiens
catgaaataacttttt

SEQ ID NO: 70500 - DNA, 16 bp, H. sapiens
catgaaatactacaca

SEQ ID NO: 70501 - DNA, 16 bp, H. sapiens
catgaaatatattttt

SEQ ID NO: 70502 - DNA, 16 bp, H. sapiens
catgaaatatccagaa

SEQ ID NO: 70503 - DNA, 16 bp, H. sapiens
catgaaatattctcca

SEQ ID NO: 70504 - DNA, 16 bp, H. sapiens
catgaaatatttaaag

SEQ ID NO: 70505 - DNA, 16 bp, H. sapiens
catgaaatctgatgat

SEQ ID NO: 70506 - DNA, 16 bp, H. sapiens
catgaaatggacaaat

SEQ ID NO: 70507 - DNA, 16 bp, H. sapiens
catgaaattaattttt

SEQ ID NO: 70508 - DNA, 16 bp, H. sapiens
catgaaatttgggcag

SEQ ID NO: 70509 - DNA, 16 bp, H. sapiens
catgaacacaggatat

SEQ ID NO: 70510 - DNA, 16 bp, H. sapiens
catgaacagacatttt

SEQ ID NO: 70511 - DNA, 16 bp, H. sapiens
catgaacatgaacatg

SEQ ID NO: 70512 - DNA, 16 bp, H. sapiens
catgaacatggtatgt

SEQ ID NO: 70513 - DNA, 16 bp, H. sapiens
catgaaccactgcgcc

SEQ ID NO: 70514 - DNA, 16 bp, H. sapiens
catgaacctggcaggc

SEQ ID NO: 70515 - DNA, 16 bp, H. sapiens
catgaacgtggaatat

SEQ ID NO: 70516 - DNA, 16 bp, H. sapiens
catgaactagaaaacc

SEQ ID NO: 70517 - DNA, 16 bp, H. sapiens
catgaactagaaaatc

SEQ ID NO: 70518 - DNA, 16 bp, H. sapiens
catgaactcctgggct

SEQ ID NO: 70519 - DNA, 16 bp, H. sapiens
catgaactgggctggg

SEQ ID NO: 70520 - DNA, 16 bp, H. sapiens
catgaagaaaaaatat

SEQ ID NO: 70521 - DNA, 16 bp, H. sapiens
catgaagaaaccccat

SEQ ID NO: 70522 - DNA, 16 bp, H. sapiens
catgaagaaattcaaa

SEQ ID NO: 70523 - DNA, 16 bp, H. sapiens
catgaagaaattgaaa

SEQ ID NO: 70524 - DNA, 16 bp, H. sapiens
catgaagaagaaagaa

SEQ ID NO: 70525 - DNA, 16 bp, H. sapiens
catgaagaagaaataa

SEQ ID NO: 70526 - DNA, 16 bp, H. sapiens
catgaagaagaataaa

SEQ ID NO: 70527 - DNA, 17 bp, H. sapiens
catgaagaatgcagaag

SEQ ID NO: 70528 - DNA, 16 bp, H. sapiens
catgaagagatgttca

SEQ ID NO: 70529 - DNA, 16 bp, H. sapiens
catgaagaggtgttga

SEQ ID NO: 70530 - DNA, 16 bp, H. sapiens
catgaagatatgtata

SEQ ID NO: 70531 - DNA, 16 bp, H. sapiens
catgaagattttcttt

SEQ ID NO: 70532 - DNA, 16 bp, H. sapiens
catgaaggcagctggg

SEQ ID NO: 70533 - DNA, 16 bp, H. sapiens
catgaagtccttgcct

SEQ ID NO: 70534 - DNA, 16 bp, H. sapiens
catgaagtttaaggaa

SEQ ID NO: 70535 - DNA, 16 bp, H. sapiens
catgaataacaaagac

SEQ ID NO: 70536 - DNA, 16 bp, H. sapiens
catgaataagttcaag

SEQ ID NO: 70537 - DNA, 16 bp, H. sapiens
catgaataagtttttt

SEQ ID NO: 70538 - DNA, 16 bp, H. sapiens
catgaataatccaccc

SEQ ID NO: 70539 - DNA, 16 bp, H. sapiens
catgaatatggaatgt

SEQ ID NO: 70540 - DNA, 16 bp, H. sapiens
catgaatatttatgag

SEQ ID NO: 70541 - DNA, 16 bp, H. sapiens
catgaatatttttgaa

SEQ ID NO: 70542 - DNA, 16 bp, H. sapiens
catgaatcactgcacc

SEQ ID NO: 70543 - DNA, 16 bp, H. sapiens
catgaatctactttct

SEQ ID NO: 70544 - DNA, 16 bp, H. sapiens
catgaatgaacctgga

SEQ ID NO: 70545 - DNA, 16 bp, H. sapiens
catgaatggattcatg

SEQ ID NO: 70546 - DNA, 16 bp, H. sapiens
catgaatgtttttaat

SEQ ID NO: 70547 - DNA, 16 bp, H. sapiens
catgaattaactcatt

SEQ ID NO: 70548 - DNA, 16 bp, H. sapiens
catgaattcaagacca

SEQ ID NO: 70549 - DNA, 16 bp, H. sapiens
catgaattttttttct

SEQ ID NO: 70550 - DNA, 16 bp, H. sapiens
catgacaaagctgcct

SEQ ID NO: 70551 - DNA, 16 bp, H. sapiens
catgacagaagatgaa

SEQ ID NO: 70552 - DNA, 16 bp, H. sapiens
catgaccaagaagaat

SEQ ID NO: 70553 - DNA, 16 bp, H. sapiens
catgaccaccatcacc

SEQ ID NO: 70554 - DNA, 16 bp, H. sapiens
catgaccagcctgggc

SEQ ID NO: 70555 - DNA, 16 bp, H. sapiens
catgaccaggaaagat

SEQ ID NO: 70556 - DNA, 16 bp, H. sapiens
catgaccttgggcaaa

SEQ ID NO: 70557 - DNA, 16 bp, H. sapiens
catgactatatgaaca

SEQ ID NO: 70558 - DNA, 16 bp, H. sapiens
catgactggtgtcctt

SEQ ID NO: 70559 - DNA, 16 bp, H. sapiens
catgactgtgtttcaa

SEQ ID NO: 70560 - DNA, 16 bp, H. sapiens
catgactttgctcctt

SEQ ID NO: 70561 - DNA, 16 bp, H. sapiens
catgacttttctctgc

SEQ ID NO: 70562 - DNA, 16 bp, H. sapiens
catgagaaataaattt

SEQ ID NO: 70563 - DNA, 16 bp, H. sapiens
catgagaacaacacag

SEQ ID NO: 70564 - DNA, 16 bp, H. sapiens
catgagaacagaccaa

SEQ ID NO: 70565 - DNA, 16 bp, H. sapiens
catgagaacagcaggg

SEQ ID NO: 70566 - DNA, 16 bp, H. sapiens
catgagaagaatgtat

SEQ ID NO: 70567 - DNA, 16 bp, H. sapiens
catgagaattgcttaa

SEQ ID NO: 70568 - DNA, 16 bp, H. sapiens
catgagactttgctga

SEQ ID NO: 70569 - DNA, 16 bp, H. sapiens
catgagagatattgat

SEQ ID NO: 70570 - DNA, 16 bp, H. sapiens
catgagagcagccatg

SEQ ID NO: 70571 - DNA, 16 bp, H. sapiens
catgagagtgaacagg

SEQ ID NO: 70572 - DNA, 16 bp, H. sapiens
catgagatcaggagtt

SEQ ID NO: 70573 - DNA, 16 bp, H. sapiens
catgagatgatgcagc

SEQ ID NO: 70574 - DNA, 16 bp, H. sapiens
catgagatgtttggtt

SEQ ID NO: 70575 - DNA, 16 bp, H. sapiens
catgagatttcatcac

SEQ ID NO: 70576 - DNA, 16 bp, H. sapiens
catgagattttgaggg

SEQ ID NO: 70577 - DNA, 16 bp, H. sapiens
catgagattttggtgg

SEQ ID NO: 70578 - DNA, 16 bp, H. sapiens
catgagcatgagccca

SEQ ID NO: 70579 - DNA, 16 bp, H. sapiens
catgagccaaggaatg

SEQ ID NO: 70580 - DNA, 16 bp, H. sapiens
catgagccaccacact

SEQ ID NO: 70581 - DNA, 16 bp, H. sapiens
catgagccaccacatg

SEQ ID NO: 70582 - DNA, 16 bp, H. sapiens
catgagccaccaccac

SEQ ID NO: 70583 - DNA, 16 bp, H. sapiens
catgagccaccaccgc

SEQ ID NO: 70584 - DNA, 16 bp, H. sapiens
catgagccaccgtact

SEQ ID NO: 70585 - DNA, 16 bp, H. sapiens
catgagccactgcacc

SEQ ID NO: 70586 - DNA, 16 bp, H. sapiens
catgagccactgtgcc

SEQ ID NO: 70587 - DNA, 16 bp, H. sapiens
catgagccatcatgct

SEQ ID NO: 70588 - DNA, 16 bp, H. sapiens
catgagcccaggaagt

SEQ ID NO: 70589 - DNA, 16 bp, H. sapiens
catgagcccaggagtt

SEQ ID NO: 70590 - DNA, 16 bp, H. sapiens
catgagcctccgcgcc

SEQ ID NO: 70591 - DNA, 16 bp, H. sapiens
catgagcctctgcctc

SEQ ID NO: 70592 - DNA, 16 bp, H. sapiens
catgagctactgcact

SEQ ID NO: 70593 - DNA, 16 bp, H. sapiens
catgagctcaggagtt

SEQ ID NO: 70594 - DNA, 16 bp, H. sapiens
catgagctgctgtgcc

SEQ ID NO: 70595 - DNA, 16 bp, H. sapiens
catgaggaagagaaaa

SEQ ID NO: 70596 - DNA, 16 bp, H. sapiens
catgaggaagctgagg

SEQ ID NO: 70597 - DNA, 16 bp, H. sapiens
catgaggacagagacc

SEQ ID NO: 70598 - DNA, 16 bp, H. sapiens
catgaggacagcatgg

SEQ ID NO: 70599 - DNA, 16 bp, H. sapiens
catgaggattggaatc

SEQ ID NO: 70600 - DNA, 16 bp, H. sapiens
catgaggccagcatca

SEQ ID NO: 70601 - DNA, 16 bp, H. sapiens
catgaggcctgtagcc

SEQ ID NO: 70602 - DNA, 16 bp, H. sapiens
catgagggatccaccc

SEQ ID NO: 70603 - DNA, 16 bp, H. sapiens
catgagggcaggggcc

SEQ ID NO: 70604 - DNA, 16 bp, H. sapiens
catgagggtggggccc

SEQ ID NO: 70605 - DNA, 16 bp, H. sapiens
catgaggtcaggagtt

SEQ ID NO: 70606 - DNA, 16 bp, H. sapiens
catgaggttgggagtt

SEQ ID NO: 70607 - DNA, 16 bp, H. sapiens
catgagtattttctcc

SEQ ID NO: 70608 - DNA, 16 bp, H. sapiens
catgagtgagccacca

SEQ ID NO: 70609 - DNA, 16 bp, H. sapiens
catgagtgtgtatgtg

SEQ ID NO: 70610 - DNA, 16 bp, H. sapiens
catgagtgtgtgtgtg

SEQ ID NO: 70611 - DNA, 16 bp, H. sapiens
catgagttatttagaa

SEQ ID NO: 70612 - DNA, 16 bp, H. sapiens
catgagtttatttctg

SEQ ID NO: 70613 - DNA, 16 bp, H. sapiens
catgagttttggaggg

SEQ ID NO: 70614 - DNA, 16 bp, H. sapiens
catgatattgattttt

SEQ ID NO: 70615 - DNA, 16 bp, H. sapiens
catgatcaaattcaca

SEQ ID NO: 70616 - DNA, 16 bp, H. sapiens
catgatcatggcagaa

SEQ ID NO: 70617 - DNA, 16 bp, H. sapiens
catgatccaatcacct

SEQ ID NO: 70618 - DNA, 16 bp, H. sapiens
catgatcctaggagag

SEQ ID NO: 70619 - DNA, 16 bp, H. sapiens
catgatctgctgtctg

SEQ ID NO: 70620 - DNA, 16 bp, H. sapiens
catgatctggcctctg

SEQ ID NO: 70621 - DNA, 16 bp, H. sapiens
catgatcttgggaaaa

SEQ ID NO: 70622 - DNA, 16 bp, H. sapiens
catgatgaaaaccctc

SEQ ID NO: 70623 - DNA, 16 bp, H. sapiens
catgatgaaagcaatg

SEQ ID NO: 70624 - DNA, 16 bp, H. sapiens
catgatgaacaaaata

SEQ ID NO: 70625 - DNA, 16 bp, H. sapiens
catgatgaatgatatt

SEQ ID NO: 70626 - DNA, 16 bp, H. sapiens
catgatgaatggaata

SEQ ID NO: 70627 - DNA, 16 bp, H. sapiens
catgatgatgatgatg

SEQ ID NO: 70628 - DNA, 16 bp, H. sapiens
catgatggaaggggaa

SEQ ID NO: 70629 - DNA, 16 bp, H. sapiens
catgatggcaggaagg

SEQ ID NO: 70630 - DNA, 16 bp, H. sapiens
catgatggccatgatg

SEQ ID NO: 70631 - DNA, 16 bp, H. sapiens
catgatggctggagct

SEQ ID NO: 70632 - DNA, 16 bp, H. sapiens
catgatggtgtgtgcc

SEQ ID NO: 70633 - DNA, 16 bp, H. sapiens
catgatgttttaaagt

SEQ ID NO: 70634 - DNA, 16 bp, H. sapiens
catgattattattatt

SEQ ID NO: 70635 - DNA, 16 bp, H. sapiens
catgattctgaggcct

SEQ ID NO: 70636 - DNA, 16 bp, H. sapiens
catgattggaagcttt

SEQ ID NO: 70637 - DNA, 16 bp, H. sapiens
catgattgtgaggcct

SEQ ID NO: 70638 - DNA, 16 bp, H. sapiens
catgattgtgccactg

SEQ ID NO: 70639 - DNA, 16 bp, H. sapiens
catgatttaaaatttt

SEQ ID NO: 70640 - DNA, 16 bp, H. sapiens
catgatttaattcttt

SEQ ID NO: 70641 - DNA, 16 bp, H. sapiens
catgatttactttctt

SEQ ID NO: 70642 - DNA, 16 bp, H. sapiens
catgatttatagtctt

SEQ ID NO: 70643 - DNA, 16 bp, H. sapiens
catgatttcttttctt

SEQ ID NO: 70644 - DNA, 16 bp, H. sapiens
catgatttctttttca

SEQ ID NO: 70645 - DNA, 16 bp, H. sapiens
catgatttctttttct

SEQ ID NO: 70646 - DNA, 16 bp, H. sapiens
catgattttaagtttc

SEQ ID NO: 70647 - DNA, 16 bp, H. sapiens
catgattttattcctt

SEQ ID NO: 70648 - DNA, 16 bp, H. sapiens
catgattttctcaata

SEQ ID NO: 70649 - DNA, 16 bp, H. sapiens
catgattttgttcatt

SEQ ID NO: 70650 - DNA, 16 bp, H. sapiens
catgatttttaaataa

SEQ ID NO: 70651 - DNA, 16 bp, H. sapiens
catgatttttaaattt

SEQ ID NO: 70652 - DNA, 16 bp, H. sapiens
catgatttttatttta

SEQ ID NO: 70653 - DNA, 16 bp, H. sapiens
catgcaaacacacaca

SEQ ID NO: 70654 - DNA, 16 bp, H. sapiens
catgcaaagaaacaga

SEQ ID NO: 70655 - DNA, 16 bp, H. sapiens
catgcaagaacagatg

SEQ ID NO: 70656 - DNA, 16 bp, H. sapiens
catgcaagcaagaaga

SEQ ID NO: 70657 - DNA, 16 bp, H. sapiens
catgcaaggacacagc

SEQ ID NO: 70658 - DNA, 16 bp, H. sapiens
catgcaagggatctag

SEQ ID NO: 70659 - DNA, 16 bp, H. sapiens
catgcaataaaattca

SEQ ID NO: 70660 - DNA, 16 bp, H. sapiens
catgcaataaatattt

SEQ ID NO: 70661 - DNA, 16 bp, H. sapiens
catgcaatgaaatatt

SEQ ID NO: 70662 - DNA, 16 bp, H. sapiens
catgcacacaaacaca

SEQ ID NO: 70663 - DNA, 16 bp, H. sapiens
catgcacacacacaaa

SEQ ID NO: 70664 - DNA, 16 bp, H. sapiens
catgcacacacacaga

SEQ ID NO: 70665 - DNA, 16 bp, H. sapiens
catgcacacacacatt

SEQ ID NO: 70666 - DNA, 16 bp, H. sapiens
catgcacacacaccac

SEQ ID NO: 70667 - DNA, 16 bp, H. sapiens
catgcacacacacgca

SEQ ID NO: 70668 - DNA, 16 bp, H. sapiens
catgcacacacataca

SEQ ID NO: 70669 - DNA, 16 bp, H. sapiens
catgcacacacatacc

SEQ ID NO: 70670 - DNA, 16 bp, H. sapiens
catgcacacacgtgtg

SEQ ID NO: 70671 - DNA, 16 bp, H. sapiens
catgcacacactcaca

SEQ ID NO: 70672 - DNA, 16 bp, H. sapiens
catgcacacgcacgca

SEQ ID NO: 70673 - DNA, 16 bp, H. sapiens
catgcacacgtgtgca

SEQ ID NO: 70674 - DNA, 16 bp, H. sapiens
catgcacatcctcctg

SEQ ID NO: 70675 - DNA, 16 bp, H. sapiens
catgcacattttaaaa

SEQ ID NO: 70676 - DNA, 16 bp, H. sapiens
catgcaccaccatacc

SEQ ID NO: 70677 - DNA, 16 bp, H. sapiens
catgcacccaccacca

SEQ ID NO: 70678 - DNA, 16 bp, H. sapiens
catgcacctatagtcc

SEQ ID NO: 70679 - DNA, 16 bp, H. sapiens
catgcacgcacacacg

SEQ ID NO: 70680 - DNA, 16 bp, H. sapiens
catgcacgcacacatg

SEQ ID NO: 70681 - DNA, 16 bp, H. sapiens
catgcactggggcctg

SEQ ID NO: 70682 - DNA, 16 bp, H. sapiens
catgcagaaaaaaatg

SEQ ID NO: 70683 - DNA, 16 bp, H. sapiens
catgcagaaaaataaa

SEQ ID NO: 70684 - DNA, 16 bp, H. sapiens
catgcagaactgtgag

SEQ ID NO: 70685 - DNA, 16 bp, H. sapiens
catgcagacacacatg

SEQ ID NO: 70686 - DNA, 16 bp, H. sapiens
catgcagacacatgca

SEQ ID NO: 70687 - DNA, 16 bp, H. sapiens
catgcagacaggcagg

SEQ ID NO: 70688 - DNA, 16 bp, H. sapiens
catgcagcccaggatg

SEQ ID NO: 70689 - DNA, 16 bp, H. sapiens
catgcagccccagcca

SEQ ID NO: 70690 - DNA, 16 bp, H. sapiens
catgcaggcacacaca

SEQ ID NO: 70691 - DNA, 16 bp, H. sapiens
catgcaggtcacaggg

SEQ ID NO: 70692 - DNA, 16 bp, H. sapiens
catgcaggtgtgtgtg

SEQ ID NO: 70693 - DNA, 16 bp, H. sapiens
catgcagtagaaaaga

SEQ ID NO: 70694 - DNA, 16 bp, H. sapiens
catgcagtcagggagg

SEQ ID NO: 70695 - DNA, 16 bp, H. sapiens
catgcatatatataaa

SEQ ID NO: 70696 - DNA, 16 bp, H. sapiens
catgcatcaccacacc

SEQ ID NO: 70697 - DNA, 16 bp, H. sapiens
catgcatgagccactg

SEQ ID NO: 70698 - DNA, 16 bp, H. sapiens
catgcatgcacacaca

SEQ ID NO: 70699 - DNA, 16 bp, H. sapiens
catgcatgcacatgtg

SEQ ID NO: 70700 - DNA, 16 bp, H. sapiens
catgcatgcatacaca

SEQ ID NO: 70701 - DNA, 16 bp, H. sapiens
catgcatgcatgtgtg

SEQ ID NO: 70702 - DNA, 16 bp, H. sapiens
catgcatgtgcaaata

SEQ ID NO: 70703 - DNA, 17 bp, H. sapiens
catgcatgtgtgtgcac

SEQ ID NO: 70704 - DNA, 16 bp, H. sapiens
catgcatgtgtgtgta

SEQ ID NO: 70705 - DNA, 16 bp, H. sapiens
catgcatgtttatagc

SEQ ID NO: 70706 - DNA, 16 bp, H. sapiens
catgcattagatattt

SEQ ID NO: 70707 - DNA, 16 bp, H. sapiens
catgcattagctattt

SEQ ID NO: 70708 - DNA, 16 bp, H. sapiens
catgcattagctgttt

SEQ ID NO: 70709 - DNA, 16 bp, H. sapiens
catgcattcattcatt

SEQ ID NO: 70710 - DNA, 16 bp, H. sapiens
catgcatttatcattt

SEQ ID NO: 70711 - DNA, 16 bp, H. sapiens
catgcatttgtcaaaa

SEQ ID NO: 70712 - DNA, 16 bp, H. sapiens
catgcatttgttcatt

SEQ ID NO: 70713 - DNA, 16 bp, H. sapiens
catgcattttttttct

SEQ ID NO: 70714 - DNA, 17 bp, H. sapiens
catgccaagttgtaaag

SEQ ID NO: 70715 - DNA, 16 bp, H. sapiens
catgccaccacatttg

SEQ ID NO: 70716 - DNA, 16 bp, H. sapiens
catgccaccgtgcccg

SEQ ID NO: 70717 - DNA, 16 bp, H. sapiens
catgccacggcactcc

SEQ ID NO: 70718 - DNA, 16 bp, H. sapiens
catgccactccactcc

SEQ ID NO: 70719 - DNA, 16 bp, H. sapiens
catgccactgcacttg

SEQ ID NO: 70720 - DNA, 16 bp, H. sapiens
catgccactgctctgc

SEQ ID NO: 70721 - DNA, 16 bp, H. sapiens
catgccactgtactac

SEQ ID NO: 70722 - DNA, 16 bp, H. sapiens
catgccagaggtcttc

SEQ ID NO: 70723 - DNA, 16 bp, H. sapiens
catgccagccaagcca

SEQ ID NO: 70724 - DNA, 16 bp, H. sapiens
catgccaggcatggtg

SEQ ID NO: 70725 - DNA, 16 bp, H. sapiens
catgccaggtgctgtg

SEQ ID NO: 70726 - DNA, 16 bp, H. sapiens
catgccagtaattcca

SEQ ID NO: 70727 - DNA, 16 bp, H. sapiens
catgccattatgccca

SEQ ID NO: 70728 - DNA, 16 bp, H. sapiens
catgcccacagctgca

SEQ ID NO: 70729 - DNA, 16 bp, H. sapiens
catgcccagccaactt

SEQ ID NO: 70730 - DNA, 16 bp, H. sapiens
catgcccagccacttc

SEQ ID NO: 70731 - DNA, 16 bp, H. sapiens
catgcccagcccccac

SEQ ID NO: 70732 - DNA, 16 bp, H. sapiens
catgcccagccccctc

SEQ ID NO: 70733 - DNA, 16 bp, H. sapiens
catgcccagcccctgg

SEQ ID NO: 70734 - DNA, 16 bp, H. sapiens
catgcccagccctatt

SEQ ID NO: 70735 - DNA, 16 bp, H. sapiens
catgcccagcctatta

SEQ ID NO: 70736 - DNA, 16 bp, H. sapiens
catgcccagcctcaaa

SEQ ID NO: 70737 - DNA, 16 bp, H. sapiens
catgcccagcctcagc

SEQ ID NO: 70738 - DNA, 16 bp, H. sapiens
catgcccagcctcatg

SEQ ID NO: 70739 - DNA, 16 bp, H. sapiens
catgcccagcctccaa

SEQ ID NO: 70740 - DNA, 16 bp, H. sapiens
catgcccagcctgaag

SEQ ID NO: 70741 - DNA, 16 bp, H. sapiens
catgcccagcctgaga

SEQ ID NO: 70742 - DNA, 16 bp, H. sapiens
catgcccagcctggat

SEQ ID NO: 70743 - DNA, 16 bp, H. sapiens
catgcccagttaactt

SEQ ID NO: 70744 - DNA, 16 bp, H. sapiens
catgccccagcctcct

SEQ ID NO: 70745 - DNA, 16 bp, H. sapiens
catgcctaaccctgcc

SEQ ID NO: 70746 - DNA, 16 bp, H. sapiens
catgcctatgatccca

SEQ ID NO: 70747 - DNA, 16 bp, H. sapiens
catgcctcaactttct

SEQ ID NO: 70748 - DNA, 16 bp, H. sapiens
catgcctcagcctcac

SEQ ID NO: 70749 - DNA, 16 bp, H. sapiens
catgcctcagtttccc

SEQ ID NO: 70750 - DNA, 16 bp, H. sapiens
catgcctcattttatt

SEQ ID NO: 70751 - DNA, 16 bp, H. sapiens
catgcctctgtgcctt

SEQ ID NO: 70752 - DNA, 16 bp, H. sapiens
catgcctcttcccctt

SEQ ID NO: 70753 - DNA, 16 bp, H. sapiens
catgcctgcaatcctg

SEQ ID NO: 70754 - DNA, 16 bp, H. sapiens
catgcctgctccctct

SEQ ID NO: 70755 - DNA, 16 bp, H. sapiens
catgcctggccaagag

SEQ ID NO: 70756 - DNA, 16 bp, H. sapiens
catgcctggccagcag

SEQ ID NO: 70757 - DNA, 16 bp, H. sapiens
catgcctggcccatct

SEQ ID NO: 70758 - DNA, 16 bp, H. sapiens
catgcctggcccattt

SEQ ID NO: 70759 - DNA, 16 bp, H. sapiens
catgcctggcctaaaa

SEQ ID NO: 70760 - DNA, 16 bp, H. sapiens
catgcctggcctaaag

SEQ ID NO: 70761 - DNA, 16 bp, H. sapiens
catgcctggcctctac

SEQ ID NO: 70762 - DNA, 16 bp, H. sapiens
catgcctggcctggct

SEQ ID NO: 70763 - DNA, 19 bp, H. sapiens
catgcctggctagtttttt

SEQ ID NO: 70764 - DNA, 16 bp, H. sapiens
catgcctggcttgttt

SEQ ID NO: 70765 - DNA, 16 bp, H. sapiens
catgcctgggcctccc

SEQ ID NO: 70766 - DNA, 16 bp, H. sapiens
catgcctgtaactcca

SEQ ID NO: 70767 - DNA, 16 bp, H. sapiens
catgcctgtaatctcg

SEQ ID NO: 70768 - DNA, 16 bp, H. sapiens
catgcctgtagttaca

SEQ ID NO: 70769 - DNA, 16 bp, H. sapiens
catgcctgtatcaaaa

SEQ ID NO: 70770 - DNA, 16 bp, H. sapiens
catgcctgtatcagaa

SEQ ID NO: 70771 - DNA, 16 bp, H. sapiens
catgcctgttttccca

SEQ ID NO: 70772 - DNA, 16 bp, H. sapiens
catgcctttgcacatg

SEQ ID NO: 70773 - DNA, 16 bp, H. sapiens
catgcgccaccacgct

SEQ ID NO: 70774 - DNA, 16 bp, H. sapiens
catgcgccagcacgcc

SEQ ID NO: 70775 - DNA, 18 bp, H. sapiens
catgcgcgcgcacacaca

SEQ ID NO: 70776 - DNA, 16 bp, H. sapiens
catgcgtgagccactg

SEQ ID NO: 70777 - DNA, 16 bp, H. sapiens
catgcgtgtgccacca

SEQ ID NO: 70778 - DNA, 16 bp, H. sapiens
catgcgtgtgtgtgtg

SEQ ID NO: 70779 - DNA, 16 bp, H. sapiens
catgctaaaaggcaaa

SEQ ID NO: 70780 - DNA, 16 bp, H. sapiens
catgctacctgacttg

SEQ ID NO: 70781 - DNA, 16 bp, H. sapiens
catgctatttcctctg

SEQ ID NO: 70782 - DNA, 16 bp, H. sapiens
catgctcagctaattt

SEQ ID NO: 70783 - DNA, 16 bp, H. sapiens
catgctcattcattta

SEQ ID NO: 70784 - DNA, 19 bp, H. sapiens
catgctcctgctgcagata

SEQ ID NO: 70785 - DNA, 16 bp, H. sapiens
catgctccttatgaga

SEQ ID NO: 70786 - DNA, 16 bp, H. sapiens
catgctctacaaacaa

SEQ ID NO: 70787 - DNA, 16 bp, H. sapiens
catgctctctcctgcc

SEQ ID NO: 70788 - DNA, 16 bp, H. sapiens
catgctcttttgatta

SEQ ID NO: 70789 - DNA, 16 bp, H. sapiens
catgctgacaccttga

SEQ ID NO: 70790 - DNA, 16 bp, H. sapiens
catgctgatgcaagag

SEQ ID NO: 70791 - DNA, 16 bp, H. sapiens
catgctgccactgctg

SEQ ID NO: 70792 - DNA, 16 bp, H. sapiens
catgctgctagtaaag

SEQ ID NO: 70793 - DNA, 16 bp, H. sapiens
catgctgctatgaaga

SEQ ID NO: 70794 - DNA, 16 bp, H. sapiens
catgctgctgatgaag

SEQ ID NO: 70795 - DNA, 16 bp, H. sapiens
catgctgctgctctgc

SEQ ID NO: 70796 - DNA, 16 bp, H. sapiens
catgctggcagctgat

SEQ ID NO: 70797 - DNA, 16 bp, H. sapiens
catgctggcatgtgcc

SEQ ID NO: 70798 - DNA, 16 bp, H. sapiens
catgctggccaagctg

SEQ ID NO: 70799 - DNA, 16 bp, H. sapiens
catgctggcctccttg

SEQ ID NO: 70800 - DNA, 16 bp, H. sapiens
catgctggctgcagca

SEQ ID NO: 70801 - DNA, 16 bp, H. sapiens
catgctggtaatctca

SEQ ID NO: 70802 - DNA, 16 bp, H. sapiens
catgctggtctggaac

SEQ ID NO: 70803 - DNA, 16 bp, H. sapiens
catgctggtgcgctac

SEQ ID NO: 70804 - DNA, 16 bp, H. sapiens
catgctgttccctctg

SEQ ID NO: 70805 - DNA, 16 bp, H. sapiens
catgctgttctcatca

SEQ ID NO: 70806 - DNA, 16 bp, H. sapiens
catgcttattcattta

SEQ ID NO: 70807 - DNA, 16 bp, H. sapiens
catgcttcccaggctg

SEQ ID NO: 70808 - DNA, 16 bp, H. sapiens
catgcttctctgatcc

SEQ ID NO: 70809 - DNA, 16 bp, H. sapiens
catgcttctgcctcag

SEQ ID NO: 70810 - DNA, 16 bp, H. sapiens
catgcttcttgtacag

SEQ ID NO: 70811 - DNA, 16 bp, H. sapiens
catgcttggctaattt

SEQ ID NO: 70812 - DNA, 16 bp, H. sapiens
catgcttttgatttta

SEQ ID NO: 70813 - DNA, 16 bp, H. sapiens
catggaaaaatgctca

SEQ ID NO: 70814 - DNA, 16 bp, H. sapiens
catggaaaaattgtct

SEQ ID NO: 70815 - DNA, 16 bp, H. sapiens
catggaaaacaatttt

SEQ ID NO: 70816 - DNA, 16 bp, H. sapiens
catggaaaagttcttt

SEQ ID NO: 70817 - DNA, 16 bp, H. sapiens
catggaaaatgaacaa

SEQ ID NO: 70818 - DNA, 16 bp, H. sapiens
catggaaaatgtgtat

SEQ ID NO: 70819 - DNA, 16 bp, H. sapiens
catggaaacagaaagt

SEQ ID NO: 70820 - DNA, 16 bp, H. sapiens
catggaaacagagagt

SEQ ID NO: 70821 - DNA, 16 bp, H. sapiens
catggaaacccacctc

SEQ ID NO: 70822 - DNA, 16 bp, H. sapiens
catggaaactgtgaga

SEQ ID NO: 70823 - DNA, 16 bp, H. sapiens
catggaaagatgctca

SEQ ID NO: 70824 - DNA, 16 bp, H. sapiens
catggaaagcaaaact

SEQ ID NO: 70825 - DNA, 16 bp, H. sapiens
catggaaaggaacaag

SEQ ID NO: 70826 - DNA, 16 bp, H. sapiens
catggaaaggggcagt

SEQ ID NO: 70827 - DNA, 16 bp, H. sapiens
catggaaataaagaaa

SEQ ID NO: 70828 - DNA, 16 bp, H. sapiens
catggaacactctcca

SEQ ID NO: 70829 - DNA, 16 bp, H. sapiens
catggaactgtgcaac

SEQ ID NO: 70830 - DNA, 16 bp, H. sapiens
catggaagcttccaag

SEQ ID NO: 70831 - DNA, 16 bp, H. sapiens
catggaataacttttt

SEQ ID NO: 70832 - DNA, 16 bp, H. sapiens
catggaatactatgga

SEQ ID NO: 70833 - DNA, 16 bp, H. sapiens
catggaatatctattt

SEQ ID NO: 70834 - DNA, 16 bp, H. sapiens
catggaattggaaaaa

SEQ ID NO: 70835 - DNA, 16 bp, H. sapiens
catggacaaagacttc

SEQ ID NO: 70836 - DNA, 16 bp, H. sapiens
catggacacaaagatg

SEQ ID NO: 70837 - DNA, 16 bp, H. sapiens
catggacacacagaca

SEQ ID NO: 70838 - DNA, 17 bp, H. sapiens
catggacacaggaagga

SEQ ID NO: 70839 - DNA, 16 bp, H. sapiens
catggacatagagtgt

SEQ ID NO: 70840 - DNA, 16 bp, H. sapiens
catggaccaatcagca

SEQ ID NO: 70841 - DNA, 16 bp, H. sapiens
catggaccacactttg

SEQ ID NO: 70842 - DNA, 16 bp, H. sapiens
catggactggagcccc

SEQ ID NO: 70843 - DNA, 16 bp, H. sapiens
catggagaaaccacat

SEQ ID NO: 70844 - DNA, 16 bp, H. sapiens
catggagaaacccagt

SEQ ID NO: 70845 - DNA, 17 bp, H. sapiens
catggagaaacccatct

SEQ ID NO: 70846 - DNA, 16 bp, H. sapiens
catggagaaaccccaa

SEQ ID NO: 70847 - DNA, 16 bp, H. sapiens
catggagaaacccgtc

SEQ ID NO: 70848 - DNA, 17 bp, H. sapiens
catggagaaactccgtc

SEQ ID NO: 70849 - DNA, 16 bp, H. sapiens
catggagaaactggaa

SEQ ID NO: 70850 - DNA, 16 bp, H. sapiens
catggagaaatctcat

SEQ ID NO: 70851 - DNA, 16 bp, H. sapiens
catggagaaattggaa

SEQ ID NO: 70852 - DNA, 16 bp, H. sapiens
catggagaacccctgc

SEQ ID NO: 70853 - DNA, 16 bp, H. sapiens
catggagaagccccgt

SEQ ID NO: 70854 - DNA, 16 bp, H. sapiens
catggagacagaaaat

SEQ ID NO: 70855 - DNA, 16 bp, H. sapiens
catggagaggccacat

SEQ ID NO: 70856 - DNA, 16 bp, H. sapiens
catggaggaaggcaag

SEQ ID NO: 70857 - DNA, 16 bp, H. sapiens
catggaggcaagaccc

SEQ ID NO: 70858 - DNA, 16 bp, H. sapiens
catggaggcagagagt

SEQ ID NO: 70859 - DNA, 16 bp, H. sapiens
catggaggcagtttcc

SEQ ID NO: 70860 - DNA, 16 bp, H. sapiens
catggagggagcattt

SEQ ID NO: 70861 - DNA, 16 bp, H. sapiens
catggagggcaagctg

SEQ ID NO: 70862 - DNA, 16 bp, H. sapiens
catggagtgtttcttc

SEQ ID NO: 70863 - DNA, 16 bp, H. sapiens
catggataaacttgga

SEQ ID NO: 70864 - DNA, 16 bp, H. sapiens
catggataaagaaaat

SEQ ID NO: 70865 - DNA, 16 bp, H. sapiens
catggataatttttgt

SEQ ID NO: 70866 - DNA, 16 bp, H. sapiens
catggatagaattgga

SEQ ID NO: 70867 - DNA, 16 bp, H. sapiens
catggatcatcagaga

SEQ ID NO: 70868 - DNA, 16 bp, H. sapiens
catggatgaaccttga

SEQ ID NO: 70869 - DNA, 16 bp, H. sapiens
catggatgaactggag

SEQ ID NO: 70870 - DNA, 16 bp, H. sapiens
catggatgacaaaaag

SEQ ID NO: 70871 - DNA, 16 bp, H. sapiens
catggatgagattgga

SEQ ID NO: 70872 - DNA, 16 bp, H. sapiens
catggatgagttcttt

SEQ ID NO: 70873 - DNA, 16 bp, H. sapiens
catggatgcagctgga

SEQ ID NO: 70874 - DNA, 16 bp, H. sapiens
catggatgctgctgga

SEQ ID NO: 70875 - DNA, 16 bp, H. sapiens
catggatggaaatgga

SEQ ID NO: 70876 - DNA, 16 bp, H. sapiens
catggatggaactaga

SEQ ID NO: 70877 - DNA, 16 bp, H. sapiens
catggatggctcttat

SEQ ID NO: 70878 - DNA, 16 bp, H. sapiens
catggattgaaaaaat

SEQ ID NO: 70879 - DNA, 16 bp, H. sapiens
catggattgaaagaat

SEQ ID NO: 70880 - DNA, 16 bp, H. sapiens
catggattttggtatc

SEQ ID NO: 70881 - DNA, 16 bp, H. sapiens
catggatttttaaaaa

SEQ ID NO: 70882 - DNA, 16 bp, H. sapiens
catggcaaaaccacat

SEQ ID NO: 70883 - DNA, 16 bp, H. sapiens
catggcaaaaccccaa

SEQ ID NO: 70884 - DNA, 16 bp, H. sapiens
catggcaaaaggtgaa

SEQ ID NO: 70885 - DNA, 16 bp, H. sapiens
catggcaagagcagga

SEQ ID NO: 70886 - DNA, 16 bp, H. sapiens
catggcacatagtagg

SEQ ID NO: 70887 - DNA, 25 bp, H. sapiens
catggcacatgtatacatatgtaac

SEQ ID NO: 70888 - DNA, 16 bp, H. sapiens
catggcacatgtattc

SEQ ID NO: 70889 - DNA, 16 bp, H. sapiens
catggcacccaggctg

SEQ ID NO: 70890 - DNA, 16 bp, H. sapiens
catggcactccagcct

SEQ ID NO: 70891 - DNA, 16 bp, H. sapiens
catggcagaagaggca

SEQ ID NO: 70892 - DNA, 16 bp, H. sapiens
catggcagaagatgaa

SEQ ID NO: 70893 - DNA, 16 bp, H. sapiens
catggcagaaggagga

SEQ ID NO: 70894 - DNA, 16 bp, H. sapiens
catggcagaaggggag

SEQ ID NO: 70895 - DNA, 16 bp, H. sapiens
catggcagaagttgaa

SEQ ID NO: 70896 - DNA, 16 bp, H. sapiens
catggcagcccttccc

SEQ ID NO: 70897 - DNA, 16 bp, H. sapiens
catggcaggaggcaaa

SEQ ID NO: 70898 - DNA, 16 bp, H. sapiens
catggcaggccagggt

SEQ ID NO: 70899 - DNA, 16 bp, H. sapiens
catggccaacacggtg

SEQ ID NO: 70900 - DNA, 16 bp, H. sapiens
catggccaacatggag

SEQ ID NO: 70901 - DNA, 16 bp, H. sapiens
catggccaacatggtg

SEQ ID NO: 70902 - DNA, 16 bp, H. sapiens
catggccaccaccacc

SEQ ID NO: 70903 - DNA, 16 bp, H. sapiens
catggccactgccacc

SEQ ID NO: 70904 - DNA, 16 bp, H. sapiens
catggccagagtggac

SEQ ID NO: 70905 - DNA, 16 bp, H. sapiens
catggccatcatgaac

SEQ ID NO: 70906 - DNA, 16 bp, H. sapiens
catggccatgggacaa

SEQ ID NO: 70907 - DNA, 16 bp, H. sapiens
catggcccagccaagt

SEQ ID NO: 70908 - DNA, 16 bp, H. sapiens
catggccctgctgaca

SEQ ID NO: 70909 - DNA, 16 bp, H. sapiens
catggcctaatcacct

SEQ ID NO: 70910 - DNA, 16 bp, H. sapiens
catggcctcatcacct

SEQ ID NO: 70911 - DNA, 16 bp, H. sapiens
catggcctgttaggaa

SEQ ID NO: 70912 - DNA, 16 bp, H. sapiens
catggccttcttccct

SEQ ID NO: 70913 - DNA, 16 bp, H. sapiens
catggccttggacagc

SEQ ID NO: 70914 - DNA, 16 bp, H. sapiens
catggcgaaactccat

SEQ ID NO: 70915 - DNA, 16 bp, H. sapiens
catggcgaaatcctgt

SEQ ID NO: 70916 - DNA, 16 bp, H. sapiens
catggcgcacacctgt

SEQ ID NO: 70917 - DNA, 16 bp, H. sapiens
catggctcattgtagc

SEQ ID NO: 70918 - DNA, 16 bp, H. sapiens
catggctccccagtgc

SEQ ID NO: 70919 - DNA, 16 bp, H. sapiens
catggctgaagctgga

SEQ ID NO: 70920 - DNA, 16 bp, H. sapiens
catggctgaggaggcc

SEQ ID NO: 70921 - DNA, 16 bp, H. sapiens
catggctgaggaggtc

SEQ ID NO: 70922 - DNA, 16 bp, H. sapiens
catggctgcaagacct

SEQ ID NO: 70923 - DNA, 16 bp, H. sapiens
catggctggagctaga

SEQ ID NO: 70924 - DNA, 16 bp, H. sapiens
catggctggataattt

SEQ ID NO: 70925 - DNA, 16 bp, H. sapiens
catggctggctccttc

SEQ ID NO: 70926 - DNA, 16 bp, H. sapiens
catggctggctgattt

SEQ ID NO: 70927 - DNA, 16 bp, H. sapiens
catggctggctggctg

SEQ ID NO: 70928 - DNA, 22 bp, H. sapiens
catggctgggcgcagtggctca

SEQ ID NO: 70929 - DNA, 16 bp, H. sapiens
catggctgggctgggc

SEQ ID NO: 70930 - DNA, 16 bp, H. sapiens
catggctggggagacc

SEQ ID NO: 70931 - DNA, 16 bp, H. sapiens
catggctgtgttccag

SEQ ID NO: 70932 - DNA, 16 bp, H. sapiens
catggcttggtgctgt

SEQ ID NO: 70933 - DNA, 16 bp, H. sapiens
catgggaaagaccagc

SEQ ID NO: 70934 - DNA, 21 bp, H. sapiens
catgggagaaaatttttgcaa

SEQ ID NO: 70935 - DNA, 16 bp, H. sapiens
catgggagaaagatga

SEQ ID NO: 70936 - DNA, 16 bp, H. sapiens
catgggagagacctgg

SEQ ID NO: 70937 - DNA, 16 bp, H. sapiens
catgggaggcggaggt

SEQ ID NO: 70938 - DNA, 16 bp, H. sapiens
catgggagggacctgg

SEQ ID NO: 70939 - DNA, 16 bp, H. sapiens
catgggagggaggctg

SEQ ID NO: 70940 - DNA, 16 bp, H. sapiens
catgggaggtgattag

SEQ ID NO: 70941 - DNA, 16 bp, H. sapiens
catgggataaaaataa

SEQ ID NO: 70942 - DNA, 16 bp, H. sapiens
catgggcaacagagca

SEQ ID NO: 70943 - DNA, 16 bp, H. sapiens
catgggcacaaagaag

SEQ ID NO: 70944 - DNA, 16 bp, H. sapiens
catgggcatcatggcc

SEQ ID NO: 70945 - DNA, 16 bp, H. sapiens
catgggccaccaagcc

SEQ ID NO: 70946 - DNA, 16 bp, H. sapiens
catgggccatagtccc

SEQ ID NO: 70947 - DNA, 16 bp, H. sapiens
catgggctcaagcgat

SEQ ID NO: 70948 - DNA, 16 bp, H. sapiens
catgggctcctgtgcc

SEQ ID NO: 70949 - DNA, 16 bp, H. sapiens
catgggctggcacttg

SEQ ID NO: 70950 - DNA, 16 bp, H. sapiens
catgggctgggcccag

SEQ ID NO: 70951 - DNA, 16 bp, H. sapiens
catgggcttggtgggc

SEQ ID NO: 70952 - DNA, 16 bp, H. sapiens
catgggctttggagcc

SEQ ID NO: 70953 - DNA, 16 bp, H. sapiens
catgggctttggagtc

SEQ ID NO: 70954 - DNA, 16 bp, H. sapiens
catgggcttttttttt

SEQ ID NO: 70955 - DNA, 16 bp, H. sapiens
catggggagagaggga

SEQ ID NO: 70956 - DNA, 16 bp, H. sapiens
catggggagcaggacc

SEQ ID NO: 70957 - DNA, 16 bp, H. sapiens
catggggccagagccc

SEQ ID NO: 70958 - DNA, 16 bp, H. sapiens
catggggcctggcaca

SEQ ID NO: 70959 - DNA, 16 bp, H. sapiens
catgggggcacgtgcc

SEQ ID NO: 70960 - DNA, 16 bp, H. sapiens
catggggttgttgtga

SEQ ID NO: 70961 - DNA, 16 bp, H. sapiens
catggggttttgttgt

SEQ ID NO: 70962 - DNA, 16 bp, H. sapiens
catgggtaactgaaac

SEQ ID NO: 70963 - DNA, 16 bp, H. sapiens
catgggtgtgtgtgtg

SEQ ID NO: 70964 - DNA, 16 bp, H. sapiens
catgggttaaagagaa

SEQ ID NO: 70965 - DNA, 16 bp, H. sapiens
catggtaaaacctcat

SEQ ID NO: 70966 - DNA, 16 bp, H. sapiens
catggtagtgcatgcc

SEQ ID NO: 70967 - DNA, 16 bp, H. sapiens
catggtatgtgtatac

SEQ ID NO: 70968 - DNA, 16 bp, H. sapiens
catggtcagattctgg

SEQ ID NO: 70969 - DNA, 16 bp, H. sapiens
catggtcatgccactg

SEQ ID NO: 70970 - DNA, 16 bp, H. sapiens
catggtctcgaactcc

SEQ ID NO: 70971 - DNA, 16 bp, H. sapiens
catggtctctgccctt

SEQ ID NO: 70972 - DNA, 16 bp, H. sapiens
catggtctgcccacct

SEQ ID NO: 70973 - DNA, 16 bp, H. sapiens
catggtcttgctatgt

SEQ ID NO: 70974 - DNA, 16 bp, H. sapiens
catggtgaaaacccca

SEQ ID NO: 70975 - DNA, 16 bp, H. sapiens
catggtgaaacccagt

SEQ ID NO: 70976 - DNA, 34 bp, H. sapiens
catggtgaaaccccatctctactaaaaatacaac

SEQ ID NO: 70977 - DNA, 16 bp, H. sapiens
catggtgaaaccccca

SEQ ID NO: 70978 - DNA, 16 bp, H. sapiens
catggtgaaacccccc

SEQ ID NO: 70979 - DNA, 16 bp, H. sapiens
catggtgaaaccccct

SEQ ID NO: 70980 - DNA, 27 bp, H. sapiens
catggtgaaaccctgtctctactaaat

SEQ ID NO: 70981 - DNA, 16 bp, H. sapiens
catggtgaaacgtcgt

SEQ ID NO: 70982 - DNA, 16 bp, H. sapiens
catggtgaagccctgt

SEQ ID NO: 70983 - DNA, 16 bp, H. sapiens
catggtgagacccctg

SEQ ID NO: 70984 - DNA, 16 bp, H. sapiens
catggtgctgacatct

SEQ ID NO: 70985 - DNA, 16 bp, H. sapiens
catggtggaaggagag

SEQ ID NO: 70986 - DNA, 16 bp, H. sapiens
catggtggaaggcatc

SEQ ID NO: 70987 - DNA, 16 bp, H. sapiens
catggtggaagggcaa

SEQ ID NO: 70988 - DNA, 16 bp, H. sapiens
catggtggagagagaa

SEQ ID NO: 70989 - DNA, 16 bp, H. sapiens
catggtggcacgtgcc

SEQ ID NO: 70990 - DNA, 16 bp, H. sapiens
catggtggcaggagag

SEQ ID NO: 70991 - DNA, 16 bp, H. sapiens
catggtggcaggcgcc

SEQ ID NO: 70992 - DNA, 16 bp, H. sapiens
catggtggcaggtgca

SEQ ID NO: 70993 - DNA, 16 bp, H. sapiens
catggtggcatctgct

SEQ ID NO: 70994 - DNA, 16 bp, H. sapiens
catggtggcatggacc

SEQ ID NO: 70995 - DNA, 16 bp, H. sapiens
catggtggccagcgcc

SEQ ID NO: 70996 - DNA, 16 bp, H. sapiens
catggtggccagtgcc

SEQ ID NO: 70997 - DNA, 16 bp, H. sapiens
catggtggcggacacc

SEQ ID NO: 70998 - DNA, 16 bp, H. sapiens
catggtggcgggcatc

SEQ ID NO: 70999 - DNA, 16 bp, H. sapiens
catggtggcgtgcatc

SEQ ID NO: 71000 - DNA, 16 bp, H. sapiens
catggtggctcaggcc

SEQ ID NO: 71001 - DNA, 16 bp, H. sapiens
catggtggctcgtgct

SEQ ID NO: 71002 - DNA, 16 bp, H. sapiens
catggtggctctcacc

SEQ ID NO: 71003 - DNA, 16 bp, H. sapiens
catggtggctcttgcc

SEQ ID NO: 71004 - DNA, 16 bp, H. sapiens
catggtggctgtggtg

SEQ ID NO: 71005 - DNA, 16 bp, H. sapiens
catggtggcttaggcc

SEQ ID NO: 71006 - DNA, 16 bp, H. sapiens
catggtgggaggcacc

SEQ ID NO: 71007 - DNA, 16 bp, H. sapiens
catggtggtgcacact

SEQ ID NO: 71008 - DNA, 16 bp, H. sapiens
catggtggtgcctgcc

SEQ ID NO: 71009 - DNA, 16 bp, H. sapiens
catggtggtgcctgct

SEQ ID NO: 71010 - DNA, 16 bp, H. sapiens
catggtggtgctcacc

SEQ ID NO: 71011 - DNA, 16 bp, H. sapiens
catggtggtggccacc

SEQ ID NO: 71012 - DNA, 16 bp, H. sapiens
catggtggtgggcgcc

SEQ ID NO: 71013 - DNA, 16 bp, H. sapiens
catggtggtggtgcct

SEQ ID NO: 71014 - DNA, 16 bp, H. sapiens
catggtggtgtgtgcc

SEQ ID NO: 71015 - DNA, 18 bp, H. sapiens
catggtggtttgctgcat

SEQ ID NO: 71016 - DNA, 16 bp, H. sapiens
catggtgtacatgtac

SEQ ID NO: 71017 - DNA, 16 bp, H. sapiens
catggtgtataagctt

SEQ ID NO: 71018 - DNA, 16 bp, H. sapiens
catggtgtatcttttt

SEQ ID NO: 71019 - DNA, 16 bp, H. sapiens
catggtgttgagcctg

SEQ ID NO: 71020 - DNA, 16 bp, H. sapiens
catggttaagtcataa

SEQ ID NO: 71021 - DNA, 16 bp, H. sapiens
catggttatggaggct

SEQ ID NO: 71022 - DNA, 16 bp, H. sapiens
catggttctgcagtct

SEQ ID NO: 71023 - DNA, 16 bp, H. sapiens
catggttctggtacca

SEQ ID NO: 71024 - DNA, 16 bp, H. sapiens
catggttggaactgga

SEQ ID NO: 71025 - DNA, 16 bp, H. sapiens
catggttggagctgga

SEQ ID NO: 71026 - DNA, 16 bp, H. sapiens
catggtttctccatgt

SEQ ID NO: 71027 - DNA, 16 bp, H. sapiens
catggtttctgaagag

SEQ ID NO: 71028 - DNA, 16 bp, H. sapiens
catgtaaaaatgctca

SEQ ID NO: 71029 - DNA, 16 bp, H. sapiens
catgtaaagcacttag

SEQ ID NO: 71030 - DNA, 16 bp, H. sapiens
catgtaacaaaatatt

SEQ ID NO: 71031 - DNA, 16 bp, H. sapiens
catgtaagacgtgcct

SEQ ID NO: 71032 - DNA, 16 bp, H. sapiens
catgtaagatgtggct

SEQ ID NO: 71033 - DNA, 16 bp, H. sapiens
catgtaataaaatatc

SEQ ID NO: 71034 - DNA, 16 bp, H. sapiens
catgtaataaatattt

SEQ ID NO: 71035 - DNA, 16 bp, H. sapiens
catgtacacacacaca

SEQ ID NO: 71036 - DNA, 16 bp, H. sapiens
catgtacacacacatt

SEQ ID NO: 71037 - DNA, 16 bp, H. sapiens
catgtacacacccaca

SEQ ID NO: 71038 - DNA, 16 bp, H. sapiens
catgtacacatacaca

SEQ ID NO: 71039 - DNA, 16 bp, H. sapiens
catgtaccaccaagcc

SEQ ID NO: 71040 - DNA, 16 bp, H. sapiens
catgtaccagaatctc

SEQ ID NO: 71041 - DNA, 16 bp, H. sapiens
catgtacctacaaagg

SEQ ID NO: 71042 - DNA, 16 bp, H. sapiens
catgtaccttcatttg

SEQ ID NO: 71043 - DNA, 16 bp, H. sapiens
catgtactccagaact

SEQ ID NO: 71044 - DNA, 16 bp, H. sapiens
catgtagctggaatta

SEQ ID NO: 71045 - DNA, 16 bp, H. sapiens
catgtaggagaatact

SEQ ID NO: 71046 - DNA, 16 bp, H. sapiens
catgtagtaggtgctt

SEQ ID NO: 71047 - DNA, 16 bp, H. sapiens
catgtagtatttatct

SEQ ID NO: 71048 - DNA, 17 bp, H. sapiens
catgtagtgttaagcct

SEQ ID NO: 71049 - DNA, 16 bp, H. sapiens
catgtatacatgtaca

SEQ ID NO: 71050 - DNA, 16 bp, H. sapiens
catgtatatacatgca

SEQ ID NO: 71051 - DNA, 16 bp, H. sapiens
catgtatatatatgta

SEQ ID NO: 71052 - DNA, 16 bp, H. sapiens
catgtatatatgtaca

SEQ ID NO: 71053 - DNA, 16 bp, H. sapiens
catgtatatatgtata

SEQ ID NO: 71054 - DNA, 16 bp, H. sapiens
catgtatatatttatg

SEQ ID NO: 71055 - DNA, 16 bp, H. sapiens
catgtatatgtgtata

SEQ ID NO: 71056 - DNA, 16 bp, H. sapiens
catgtatattttatat

SEQ ID NO: 71057 - DNA, 16 bp, H. sapiens
catgtatcacatccag

SEQ ID NO: 71058 - DNA, 16 bp, H. sapiens
catgtatctgtagtcc

SEQ ID NO: 71059 - DNA, 16 bp, H. sapiens
catgtatgcatatgtg

SEQ ID NO: 71060 - DNA, 16 bp, H. sapiens
catgtatgcatgcaca

SEQ ID NO: 71061 - DNA, 16 bp, H. sapiens
catgtatgcgtgtgtg

SEQ ID NO: 71062 - DNA, 16 bp, H. sapiens
catgtatgtatataat

SEQ ID NO: 71063 - DNA, 16 bp, H. sapiens
catgtattatttattt

SEQ ID NO: 71064 - DNA, 16 bp, H. sapiens
catgtattattttata

SEQ ID NO: 71065 - DNA, 16 bp, H. sapiens
catgtattcattcagt

SEQ ID NO: 71066 - DNA, 16 bp, H. sapiens
catgtattgaaatatc

SEQ ID NO: 71067 - DNA, 16 bp, H. sapiens
catgtatttatttgtt

SEQ ID NO: 71068 - DNA, 16 bp, H. sapiens
catgtatttctttctt

SEQ ID NO: 71069 - DNA, 16 bp, H. sapiens
catgtattttctattt

SEQ ID NO: 71070 - DNA, 16 bp, H. sapiens
catgtattttttcctt

SEQ ID NO: 71071 - DNA, 16 bp, H. sapiens
catgtcaaaaccctgt

SEQ ID NO: 71072 - DNA, 16 bp, H. sapiens
catgtcaaattgcaat

SEQ ID NO: 71073 - DNA, 16 bp, H. sapiens
catgtcaagagaggga

SEQ ID NO: 71074 - DNA, 16 bp, H. sapiens
catgtcaatttctatt

SEQ ID NO: 71075 - DNA, 16 bp, H. sapiens
catgtcacagggattt

SEQ ID NO: 71076 - DNA, 16 bp, H. sapiens
catgtcacatggcaag

SEQ ID NO: 71077 - DNA, 16 bp, H. sapiens
catgtcaccacatctg

SEQ ID NO: 71078 - DNA, 16 bp, H. sapiens
catgtcactttcctgc

SEQ ID NO: 71079 - DNA, 16 bp, H. sapiens
catgtcagagactttt

SEQ ID NO: 71080 - DNA, 16 bp, H. sapiens
catgtcagagatcttc

SEQ ID NO: 71081 - DNA, 16 bp, H. sapiens
catgtcagatgtgcct

SEQ ID NO: 71082 - DNA, 16 bp, H. sapiens
catgtcatcaccctca

SEQ ID NO: 71083 - DNA, 16 bp, H. sapiens
catgtcatctgcaaca

SEQ ID NO: 71084 - DNA, 16 bp, H. sapiens
catgtcattataaatt

SEQ ID NO: 71085 - DNA, 16 bp, H. sapiens
catgtccaaaatggaa

SEQ ID NO: 71086 - DNA, 16 bp, H. sapiens
catgtccgtgtgaaga

SEQ ID NO: 71087 - DNA, 16 bp, H. sapiens
catgtcctcaccacca

SEQ ID NO: 71088 - DNA, 17 bp, H. sapiens
catgtccttaaggcaca

SEQ ID NO: 71089 - DNA, 16 bp, H. sapiens
catgtccttcacagca

SEQ ID NO: 71090 - DNA, 16 bp, H. sapiens
catgtcgcccaggctg

SEQ ID NO: 71091 - DNA, 16 bp, H. sapiens
catgtctacaaaaata

SEQ ID NO: 71092 - DNA, 16 bp, H. sapiens
catgtctatttttata

SEQ ID NO: 71093 - DNA, 16 bp, H. sapiens
catgtctcagcctcca

SEQ ID NO: 71094 - DNA, 16 bp, H. sapiens
catgtctgagctcagc

SEQ ID NO: 71095 - DNA, 16 bp, H. sapiens
catgtctgtctctgtg

SEQ ID NO: 71096 - DNA, 16 bp, H. sapiens
catgtctgtgtccaaa

SEQ ID NO: 71097 - DNA, 16 bp, H. sapiens
catgtcttctcacaag

SEQ ID NO: 71098 - DNA, 16 bp, H. sapiens
catgtctttgcaattg

SEQ ID NO: 71099 - DNA, 16 bp, H. sapiens
catgtgaaactgtgag

SEQ ID NO: 71100 - DNA, 16 bp, H. sapiens
catgtgaactcataga

SEQ ID NO: 71101 - DNA, 16 bp, H. sapiens
catgtgaagatgaagg

SEQ ID NO: 71102 - DNA, 16 bp, H. sapiens
catgtgaagatggaga

SEQ ID NO: 71103 - DNA, 16 bp, H. sapiens
catgtgaagcacttag

SEQ ID NO: 71104 - DNA, 19 bp, H. sapiens
catgtgaaggacctcttca

SEQ ID NO: 71105 - DNA, 16 bp, H. sapiens
catgtgacaatggagg

SEQ ID NO: 71106 - DNA, 16 bp, H. sapiens
catgtgactattgagc

SEQ ID NO: 71107 - DNA, 16 bp, H. sapiens
catgtgactgtagtcc

SEQ ID NO: 71108 - DNA, 16 bp, H. sapiens
catgtgagaaaactga

SEQ ID NO: 71109 - DNA, 16 bp, H. sapiens
catgtgagaacacaga

SEQ ID NO: 71110 - DNA, 16 bp, H. sapiens
catgtgagaacatagc

SEQ ID NO: 71111 - DNA, 16 bp, H. sapiens
catgtgagaattctgg

SEQ ID NO: 71112 - DNA, 16 bp, H. sapiens
catgtgagatgtgtct

SEQ ID NO: 71113 - DNA, 16 bp, H. sapiens
catgtgagggatctgg

SEQ ID NO: 71114 - DNA, 16 bp, H. sapiens
catgtgagtgtgtgtg

SEQ ID NO: 71115 - DNA, 16 bp, H. sapiens
catgtgatccaacaat

SEQ ID NO: 71116 - DNA, 16 bp, H. sapiens
catgtgatgcacctgc

SEQ ID NO: 71117 - DNA, 16 bp, H. sapiens
catgtgattatctcaa

SEQ ID NO: 71118 - DNA, 16 bp, H. sapiens
catgtgattctcctgt

SEQ ID NO: 71119 - DNA, 16 bp, H. sapiens
catgtgattttatttt

SEQ ID NO: 71120 - DNA, 16 bp, H. sapiens
catgtgattttctttt

SEQ ID NO: 71121 - DNA, 16 bp, H. sapiens
catgtgatttttcttt

SEQ ID NO: 71122 - DNA, 16 bp, H. sapiens
catgtgatttttttaa

SEQ ID NO: 71123 - DNA, 16 bp, H. sapiens
catgtgcaactgtaag

SEQ ID NO: 71124 - DNA, 19 bp, H. sapiens
catgtgcaaggacttcatg

SEQ ID NO: 71125 - DNA, 16 bp, H. sapiens
catgtgcacaaacaca

SEQ ID NO: 71126 - DNA, 16 bp, H. sapiens
catgtgcacaacctgc

SEQ ID NO: 71127 - DNA, 16 bp, H. sapiens
catgtgcacaatgtgt

SEQ ID NO: 71128 - DNA, 16 bp, H. sapiens
catgtgcacacacaca

SEQ ID NO: 71129 - DNA, 16 bp, H. sapiens
catgtgcacacccagc

SEQ ID NO: 71130 - DNA, 16 bp, H. sapiens
catgtgcagaacattc

SEQ ID NO: 71131 - DNA, 16 bp, H. sapiens
catgtgcagatgagaa

SEQ ID NO: 71132 - DNA, 16 bp, H. sapiens
catgtgcagatttttt

SEQ ID NO: 71133 - DNA, 16 bp, H. sapiens
catgtgcaggatgtgc

SEQ ID NO: 71134 - DNA, 16 bp, H. sapiens
catgtgcatatatatg

SEQ ID NO: 71135 - DNA, 16 bp, H. sapiens
catgtgcatgtgcatg

SEQ ID NO: 71136 - DNA, 16 bp, H. sapiens
catgtgcatgtgtata

SEQ ID NO: 71137 - DNA, 16 bp, H. sapiens
catgtgccaggcacta

SEQ ID NO: 71138 - DNA, 16 bp, H. sapiens
catgtgcctagaaaag

SEQ ID NO: 71139 - DNA, 16 bp, H. sapiens
catgtgcctttagtcc

SEQ ID NO: 71140 - DNA, 16 bp, H. sapiens
catgtgcctttataat

SEQ ID NO: 71141 - DNA, 16 bp, H. sapiens
catgtgctaaggaaaa

SEQ ID NO: 71142 - DNA, 16 bp, H. sapiens
catgtgctttttaaaa

SEQ ID NO: 71143 - DNA, 16 bp, H. sapiens
catgtggaactatgag

SEQ ID NO: 71144 - DNA, 16 bp, H. sapiens
catgtggacacacaca

SEQ ID NO: 71145 - DNA, 16 bp, H. sapiens
catgtggacacaggga

SEQ ID NO: 71146 - DNA, 16 bp, H. sapiens
catgtggatttccagt

SEQ ID NO: 71147 - DNA, 16 bp, H. sapiens
catgtggccaaaaagc

SEQ ID NO: 71148 - DNA, 16 bp, H. sapiens
catgtggctagtgact

SEQ ID NO: 71149 - DNA, 16 bp, H. sapiens
catgtggctggagagg

SEQ ID NO: 71150 - DNA, 16 bp, H. sapiens
catgtgggcatgtgtg

SEQ ID NO: 71151 - DNA, 16 bp, H. sapiens
catgtgggcctctcca

SEQ ID NO: 71152 - DNA, 16 bp, H. sapiens
catgtggggtgtgtgt

SEQ ID NO: 71153 - DNA, 16 bp, H. sapiens
catgtggtggaagggg

SEQ ID NO: 71154 - DNA, 16 bp, H. sapiens
catgtgtaaaatggga

SEQ ID NO: 71155 - DNA, 16 bp, H. sapiens
catgtgtacatatgta

SEQ ID NO: 71156 - DNA, 16 bp, H. sapiens
catgtgtacatgcaca

SEQ ID NO: 71157 - DNA, 16 bp, H. sapiens
catgtgtacatgcatg

SEQ ID NO: 71158 - DNA, 16 bp, H. sapiens
catgtgtatacataca

SEQ ID NO: 71159 - DNA, 16 bp, H. sapiens
catgtgtatatttatt

SEQ ID NO: 71160 - DNA, 16 bp, H. sapiens
catgtgtatgtgagtg

SEQ ID NO: 71161 - DNA, 16 bp, H. sapiens
catgtgtattttagaa

SEQ ID NO: 71162 - DNA, 16 bp, H. sapiens
catgtgtcaccacacc

SEQ ID NO: 71163 - DNA, 16 bp, H. sapiens
catgtgtccatgtgtt

SEQ ID NO: 71164 - DNA, 16 bp, H. sapiens
catgtgtcttcatagc

SEQ ID NO: 71165 - DNA, 18 bp, H. sapiens
catgtgtctttatagtag

SEQ ID NO: 71166 - DNA, 16 bp, H. sapiens
catgtgtctttgtaat

SEQ ID NO: 71167 - DNA, 16 bp, H. sapiens
catgtgtgaaatgggg

SEQ ID NO: 71168 - DNA, 16 bp, H. sapiens
catgtgtgagaatttc

SEQ ID NO: 71169 - DNA, 16 bp, H. sapiens
catgtgtgagtgtgtg

SEQ ID NO: 71170 - DNA, 16 bp, H. sapiens
catgtgtgcatatata

SEQ ID NO: 71171 - DNA, 16 bp, H. sapiens
catgtgtggtgtgtgt

SEQ ID NO: 71172 - DNA, 16 bp, H. sapiens
catgtgtgtacatgtg

SEQ ID NO: 71173 - DNA, 16 bp, H. sapiens
catgtgtgtatttttt

SEQ ID NO: 71174 - DNA, 16 bp, H. sapiens
catgtgtgtccatgtg

SEQ ID NO: 71175 - DNA, 16 bp, H. sapiens
catgtgtgtgagtgtg

SEQ ID NO: 71176 - DNA, 16 bp, H. sapiens
catgtgtgtgccacca

SEQ ID NO: 71177 - DNA, 16 bp, H. sapiens
catgtgtgtgctgtgt

SEQ ID NO: 71178 - DNA, 16 bp, H. sapiens
catgtgtgtgtataca

SEQ ID NO: 71179 - DNA, 16 bp, H. sapiens
catgtgtgtgtgcgcg

SEQ ID NO: 71180 - DNA, 16 bp, H. sapiens
catgtgtgtttgtgtg

SEQ ID NO: 71181 - DNA, 16 bp, H. sapiens
catgtgttcaattgtt

SEQ ID NO: 71182 - DNA, 16 bp, H. sapiens
catgtgtttatctgct

SEQ ID NO: 71183 - DNA, 16 bp, H. sapiens
catgtgtttattcatt

SEQ ID NO: 71184 - DNA, 16 bp, H. sapiens
catgtgtttatttttg

SEQ ID NO: 71185 - DNA, 16 bp, H. sapiens
catgttaaaaaacaaa

SEQ ID NO: 71186 - DNA, 16 bp, H. sapiens
catgttacaacatgaa

SEQ ID NO: 71187 - DNA, 16 bp, H. sapiens
catgttagcctggatg

SEQ ID NO: 71188 - DNA, 16 bp, H. sapiens
catgttataacaagtt

SEQ ID NO: 71189 - DNA, 16 bp, H. sapiens
catgttcaaaatggca

SEQ ID NO: 71190 - DNA, 16 bp, H. sapiens
catgttcaagcaattc

SEQ ID NO: 71191 - DNA, 16 bp, H. sapiens
catgttcacaccactg

SEQ ID NO: 71192 - DNA, 16 bp, H. sapiens
catgttcacagctcac

SEQ ID NO: 71193 - DNA, 16 bp, H. sapiens
catgttcagctaattt

SEQ ID NO: 71194 - DNA, 16 bp, H. sapiens
catgttcatagattgg

SEQ ID NO: 71195 - DNA, 16 bp, H. sapiens
catgttcatgtgtctt

SEQ ID NO: 71196 - DNA, 16 bp, H. sapiens
catgttcccagctgag

SEQ ID NO: 71197 - DNA, 16 bp, H. sapiens
catgttcctgtaatcc

SEQ ID NO: 71198 - DNA, 16 bp, H. sapiens
catgttcgccaggatg

SEQ ID NO: 71199 - DNA, 16 bp, H. sapiens
catgttctcactgata

SEQ ID NO: 71200 - DNA, 16 bp, H. sapiens
catgttctccatcatc

SEQ ID NO: 71201 - DNA, 16 bp, H. sapiens
catgttctttgcccac

SEQ ID NO: 71202 - DNA, 16 bp, H. sapiens
catgttgaattttatc

SEQ ID NO: 71203 - DNA, 16 bp, H. sapiens
catgttgaccttggag

SEQ ID NO: 71204 - DNA, 16 bp, H. sapiens
catgttgatgcaaatg

SEQ ID NO: 71205 - DNA, 16 bp, H. sapiens
catgttgcccaggctt

SEQ ID NO: 71206 - DNA, 16 bp, H. sapiens
catgttgctgcaaatg

SEQ ID NO: 71207 - DNA, 16 bp, H. sapiens
catgttgctgcagaag

SEQ ID NO: 71208 - DNA, 16 bp, H. sapiens
catgttgcttaggctg

SEQ ID NO: 71209 - DNA, 16 bp, H. sapiens
catgttggacaagctg

SEQ ID NO: 71210 - DNA, 16 bp, H. sapiens
catgttggcactcaaa

SEQ ID NO: 71211 - DNA, 16 bp, H. sapiens
catgttggccaggcta

SEQ ID NO: 71212 - DNA, 16 bp, H. sapiens
catgttggccaggctc

SEQ ID NO: 71213 - DNA, 16 bp, H. sapiens
catgttggccaggtgg

SEQ ID NO: 71214 - DNA, 16 bp, H. sapiens
catgttggccatggct

SEQ ID NO: 71215 - DNA, 16 bp, H. sapiens
catgttggccatggtg

SEQ ID NO: 71216 - DNA, 16 bp, H. sapiens
catgttggccatttgt

SEQ ID NO: 71217 - DNA, 16 bp, H. sapiens
catgttggctgagctg

SEQ ID NO: 71218 - DNA, 16 bp, H. sapiens
catgttgggaacaggc

SEQ ID NO: 71219 - DNA, 16 bp, H. sapiens
catgttggtcaggctc

SEQ ID NO: 71220 - DNA, 17 bp, H. sapiens
catgttggtcaggctgt

SEQ ID NO: 71221 - DNA, 16 bp, H. sapiens
catgttggttaggctc

SEQ ID NO: 71222 - DNA, 16 bp, H. sapiens
catgttggtttgctgc

SEQ ID NO: 71223 - DNA, 16 bp, H. sapiens
catgttgtacatctta

SEQ ID NO: 71224 - DNA, 16 bp, H. sapiens
catgttgtttcaaatg

SEQ ID NO: 71225 - DNA, 16 bp, H. sapiens
catgtttaaaaaaaaa

SEQ ID NO: 71226 - DNA, 16 bp, H. sapiens
catgtttaacttttta

SEQ ID NO: 71227 - DNA, 16 bp, H. sapiens
catgtttaattgtaat

SEQ ID NO: 71228 - DNA, 16 bp, H. sapiens
catgtttataattgtt

SEQ ID NO: 71229 - DNA, 16 bp, H. sapiens
catgtttattgtagca

SEQ ID NO: 71230 - DNA, 16 bp, H. sapiens
catgtttatttattta

SEQ ID NO: 71231 - DNA, 16 bp, H. sapiens
catgtttccctgtttc

SEQ ID NO: 71232 - DNA, 16 bp, H. sapiens
catgtttctgtgtcac

SEQ ID NO: 71233 - DNA, 16 bp, H. sapiens
catgtttcttgtacag

SEQ ID NO: 71234 - DNA, 16 bp, H. sapiens
catgtttgagatgatg

SEQ ID NO: 71235 - DNA, 16 bp, H. sapiens
catgtttggaaaatgg

SEQ ID NO: 71236 - DNA, 16 bp, H. sapiens
catgtttgtatgtgtg

SEQ ID NO: 71237 - DNA, 16 bp, H. sapiens
catgtttgtcttcttt

SEQ ID NO: 71238 - DNA, 16 bp, H. sapiens
catgtttgtgtatgtg

SEQ ID NO: 71239 - DNA, 16 bp, H. sapiens
catgtttgttgtttaa

SEQ ID NO: 71240 - DNA, 16 bp, H. sapiens
catgttttaaaaccac

SEQ ID NO: 71241 - DNA, 16 bp, H. sapiens
catgttttacttttat

SEQ ID NO: 71242 - DNA, 16 bp, H. sapiens
catgttttcacaaatg

SEQ ID NO: 71243 - DNA, 16 bp, H. sapiens
catgttttcatttaaa

SEQ ID NO: 71244 - DNA, 16 bp, H. sapiens
catgttttctggttgt

SEQ ID NO: 71245 - DNA, 16 bp, H. sapiens
catgtttttataaata

SEQ ID NO: 71246 - DNA, 16 bp, H. sapiens
cattaaaaaaatgaga

SEQ ID NO: 71247 - DNA, 16 bp, H. sapiens
cattaaaaaatgcaaa

SEQ ID NO: 71248 - DNA, 16 bp, H. sapiens
cattaaaaaatgggca

SEQ ID NO: 71249 - DNA, 16 bp, H. sapiens
cattaaaaaattagct

SEQ ID NO: 71250 - DNA, 16 bp, H. sapiens
cattaaaaagaatgag

SEQ ID NO: 71251 - DNA, 16 bp, H. sapiens
cattaaaaagcaggca

SEQ ID NO: 71252 - DNA, 16 bp, H. sapiens
cattaaaaagcatttt

SEQ ID NO: 71253 - DNA, 16 bp, H. sapiens
cattaaaaagtctgaa

SEQ ID NO: 71254 - DNA, 16 bp, H. sapiens
cattaaaaagtttatt

SEQ ID NO: 71255 - DNA, 16 bp, H. sapiens
cattaaaaataaaagt

SEQ ID NO: 71256 - DNA, 16 bp, H. sapiens
cattaaaaatgatgct

SEQ ID NO: 71257 - DNA, 16 bp, H. sapiens
cattaaaaattgtaaa

SEQ ID NO: 71258 - DNA, 16 bp, H. sapiens
cattaaaaggtcagga

SEQ ID NO: 71259 - DNA, 16 bp, H. sapiens
cattaaaataatgttt

SEQ ID NO: 71260 - DNA, 16 bp, H. sapiens
cattaaaatttgtttt

SEQ ID NO: 71261 - DNA, 16 bp, H. sapiens
cattaaacaaatactt

SEQ ID NO: 71262 - DNA, 16 bp, H. sapiens
cattaaacacagccca

SEQ ID NO: 71263 - DNA, 19 bp, H. sapiens
cattaaacctctttttctt

SEQ ID NO: 71264 - DNA, 16 bp, H. sapiens
cattaaagaccaaagg

SEQ ID NO: 71265 - DNA, 16 bp, H. sapiens
cattaaagatttttaa

SEQ ID NO: 71266 - DNA, 16 bp, H. sapiens
cattaaatctgtaaat

SEQ ID NO: 71267 - DNA, 16 bp, H. sapiens
cattaaatgaatattt

SEQ ID NO: 71268 - DNA, 16 bp, H. sapiens
cattaaatgtgttttg

SEQ ID NO: 71269 - DNA, 16 bp, H. sapiens
cattaaatgtttattt

SEQ ID NO: 71270 - DNA, 16 bp, H. sapiens
cattaaattgtacatt

SEQ ID NO: 71271 - DNA, 16 bp, H. sapiens
cattaaattgtgtatt

SEQ ID NO: 71272 - DNA, 16 bp, H. sapiens
cattaacagaaagaaa

SEQ ID NO: 71273 - DNA, 16 bp, H. sapiens
cattaacagaacaaag

SEQ ID NO: 71274 - DNA, 16 bp, H. sapiens
cattaacctttgtttt

SEQ ID NO: 71275 - DNA, 16 bp, H. sapiens
cattaactaaaaagtc

SEQ ID NO: 71276 - DNA, 16 bp, H. sapiens
cattaactcattcatg

SEQ ID NO: 71277 - DNA, 16 bp, H. sapiens
cattaactcatttgat

SEQ ID NO: 71278 - DNA, 16 bp, H. sapiens
cattaagaaaatgaaa

SEQ ID NO: 71279 - DNA, 16 bp, H. sapiens
cattaagaaaatggaa

SEQ ID NO: 71280 - DNA, 16 bp, H. sapiens
cattaaggaaatgcaa

SEQ ID NO: 71281 - DNA, 16 bp, H. sapiens
cattaagtataatatt

SEQ ID NO: 71282 - DNA, 16 bp, H. sapiens
cattaagtgcattcac

SEQ ID NO: 71283 - DNA, 16 bp, H. sapiens
cattaattcatttgtt

SEQ ID NO: 71284 - DNA, 16 bp, H. sapiens
cattaattgatttttc

SEQ ID NO: 71285 - DNA, 16 bp, H. sapiens
cattacaaaaggaaaa

SEQ ID NO: 71286 - DNA, 18 bp, H. sapiens
cattacataatggtaaat

SEQ ID NO: 71287 - DNA, 16 bp, H. sapiens
cattacatttattgtg

SEQ ID NO: 71288 - DNA, 16 bp, H. sapiens
cattaccaccaccatc

SEQ ID NO: 71289 - DNA, 16 bp, H. sapiens
cattactaatcattag

SEQ ID NO: 71290 - DNA, 16 bp, H. sapiens
cattactattaactat

SEQ ID NO: 71291 - DNA, 16 bp, H. sapiens
cattactctgaagtcc

SEQ ID NO: 71292 - DNA, 16 bp, H. sapiens
cattactgagtatata

SEQ ID NO: 71293 - DNA, 16 bp, H. sapiens
cattactgagttactt

SEQ ID NO: 71294 - DNA, 16 bp, H. sapiens
cattacttttaattgc

SEQ ID NO: 71295 - DNA, 16 bp, H. sapiens
cattagaaaaattcaa

SEQ ID NO: 71296 - DNA, 16 bp, H. sapiens
cattagaagaaaagaa

SEQ ID NO: 71297 - DNA, 16 bp, H. sapiens
cattagaatcacctgg

SEQ ID NO: 71298 - DNA, 16 bp, H. sapiens
cattagaattttgata

SEQ ID NO: 71299 - DNA, 16 bp, H. sapiens
cattagattctcacag

SEQ ID NO: 71300 - DNA, 16 bp, H. sapiens
cattagcagatgaatg

SEQ ID NO: 71301 - DNA, 16 bp, H. sapiens
cattagccaccacacc

SEQ ID NO: 71302 - DNA, 16 bp, H. sapiens
cattagccaggcttgg

SEQ ID NO: 71303 - DNA, 16 bp, H. sapiens
cattagcctacagttg

SEQ ID NO: 71304 - DNA, 16 bp, H. sapiens
cattagggaaatgcaa

SEQ ID NO: 71305 - DNA, 16 bp, H. sapiens
cattaggtatatctcc

SEQ ID NO: 71306 - DNA, 16 bp, H. sapiens
cattaggttatttatt

SEQ ID NO: 71307 - DNA, 16 bp, H. sapiens
cattaggttatttgaa

SEQ ID NO: 71308 - DNA, 16 bp, H. sapiens
cattagtgggtatata

SEQ ID NO: 71309 - DNA, 16 bp, H. sapiens
cattataaataatgtt

SEQ ID NO: 71310 - DNA, 16 bp, H. sapiens
cattataaatatttgt

SEQ ID NO: 71311 - DNA, 16 bp, H. sapiens
cattataacaaactgt

SEQ ID NO: 71312 - DNA, 16 bp, H. sapiens
cattatactttctctt

SEQ ID NO: 71313 - DNA, 16 bp, H. sapiens
cattatataatgtata

SEQ ID NO: 71314 - DNA, 16 bp, H. sapiens
cattatatgtatacat

SEQ ID NO: 71315 - DNA, 16 bp, H. sapiens
cattatcacctgagct

SEQ ID NO: 71316 - DNA, 16 bp, H. sapiens
cattatcatcaccatc

SEQ ID NO: 71317 - DNA, 16 bp, H. sapiens
cattatcattagcaaa

SEQ ID NO: 71318 - DNA, 16 bp, H. sapiens
cattatcccattttac

SEQ ID NO: 71319 - DNA, 16 bp, H. sapiens
cattatccccatgtgt

SEQ ID NO: 71320 - DNA, 16 bp, H. sapiens
cattatcctcagcaag

SEQ ID NO: 71321 - DNA, 16 bp, H. sapiens
cattatctcacttaat

SEQ ID NO: 71322 - DNA, 16 bp, H. sapiens
cattatctcattgaat

SEQ ID NO: 71323 - DNA, 16 bp, H. sapiens
cattatctcatttgat

SEQ ID NO: 71324 - DNA, 16 bp, H. sapiens
cattatctgtaaaatg

SEQ ID NO: 71325 - DNA, 16 bp, H. sapiens
cattatctttaaaaaa

SEQ ID NO: 71326 - DNA, 16 bp, H. sapiens
cattatgaaaatattt

SEQ ID NO: 71327 - DNA, 16 bp, H. sapiens
cattatgcccggctaa

SEQ ID NO: 71328 - DNA, 16 bp, H. sapiens
cattatgtctaaaaat

SEQ ID NO: 71329 - DNA, 16 bp, H. sapiens
cattatgtggtacatg

SEQ ID NO: 71330 - DNA, 16 bp, H. sapiens
cattattaagtaaaat

SEQ ID NO: 71331 - DNA, 16 bp, H. sapiens
cattattaggttaatt

SEQ ID NO: 71332 - DNA, 16 bp, H. sapiens
cattattatcattcag

SEQ ID NO: 71333 - DNA, 16 bp, H. sapiens
cattattattatgtgg

SEQ ID NO: 71334 - DNA, 16 bp, H. sapiens
cattattcacatttta

SEQ ID NO: 71335 - DNA, 16 bp, H. sapiens
cattattcctgtttta

SEQ ID NO: 71336 - DNA, 16 bp, H. sapiens
cattattctaagtgaa

SEQ ID NO: 71337 - DNA, 16 bp, H. sapiens
cattattgacattttg

SEQ ID NO: 71338 - DNA, 16 bp, H. sapiens
cattattgttattaat

SEQ ID NO: 71339 - DNA, 16 bp, H. sapiens
cattatttaaagttat

SEQ ID NO: 71340 - DNA, 16 bp, H. sapiens
cattatttatccagga

SEQ ID NO: 71341 - DNA, 16 bp, H. sapiens
cattatttattgttta

SEQ ID NO: 71342 - DNA, 16 bp, H. sapiens
cattatttcagcaaaa

SEQ ID NO: 71343 - DNA, 16 bp, H. sapiens
cattatttccttaaat

SEQ ID NO: 71344 - DNA, 16 bp, H. sapiens
cattatttctgaggcc

SEQ ID NO: 71345 - DNA, 16 bp, H. sapiens
cattattttaaaactt

SEQ ID NO: 71346 - DNA, 16 bp, H. sapiens
cattattttaaaagta

SEQ ID NO: 71347 - DNA, 16 bp, H. sapiens
cattattttacatgtg

SEQ ID NO: 71348 - DNA, 16 bp, H. sapiens
cattattttattcact

SEQ ID NO: 71349 - DNA, 16 bp, H. sapiens
cattattttgaagact

SEQ ID NO: 71350 - DNA, 16 bp, H. sapiens
cattattttgtgtgtg

SEQ ID NO: 71351 - DNA, 16 bp, H. sapiens
cattatttttaaaaca

SEQ ID NO: 71352 - DNA, 16 bp, H. sapiens
cattattttttaatga

SEQ ID NO: 71353 - DNA, 16 bp, H. sapiens
cattcaaaaattaatt

SEQ ID NO: 71354 - DNA, 16 bp, H. sapiens
cattcaaaccacagca

SEQ ID NO: 71355 - DNA, 16 bp, H. sapiens
cattcaaaccatagca

SEQ ID NO: 71356 - DNA, 16 bp, H. sapiens
cattcaaagaagaatt

SEQ ID NO: 71357 - DNA, 16 bp, H. sapiens
cattcaaagcagtatg

SEQ ID NO: 71358 - DNA, 17 bp, H. sapiens
cattcaaagcagtgtgt

SEQ ID NO: 71359 - DNA, 16 bp, H. sapiens
cattcaaagcagtgtt

SEQ ID NO: 71360 - DNA, 16 bp, H. sapiens
cattcaaaggaaaaaa

SEQ ID NO: 71361 - DNA, 16 bp, H. sapiens
cattcaaatgcaggaa

SEQ ID NO: 71362 - DNA, 16 bp, H. sapiens
cattcaacaaacattt

SEQ ID NO: 71363 - DNA, 16 bp, H. sapiens
cattcaacaaatactt

SEQ ID NO: 71364 - DNA, 17 bp, H. sapiens
cattcaacaagtattta

SEQ ID NO: 71365 - DNA, 16 bp, H. sapiens
cattcaacagctgcag

SEQ ID NO: 71366 - DNA, 16 bp, H. sapiens
cattcaacccagcaat

SEQ ID NO: 71367 - DNA, 16 bp, H. sapiens
cattcaactcacagat

SEQ ID NO: 71368 - DNA, 16 bp, H. sapiens
cattcaagaccagcct

SEQ ID NO: 71369 - DNA, 16 bp, H. sapiens
cattcaagagatgact

SEQ ID NO: 71370 - DNA, 16 bp, H. sapiens
cattcaatgaacattt

SEQ ID NO: 71371 - DNA, 16 bp, H. sapiens
cattcaatgaggaaag

SEQ ID NO: 71372 - DNA, 16 bp, H. sapiens
cattcaattggttaaa

SEQ ID NO: 71373 - DNA, 16 bp, H. sapiens
cattcacaacttggct

SEQ ID NO: 71374 - DNA, 16 bp, H. sapiens
cattcacaatccctta

SEQ ID NO: 71375 - DNA, 16 bp, H. sapiens
cattcacacacacata

SEQ ID NO: 71376 - DNA, 16 bp, H. sapiens
cattcacacactcaca

SEQ ID NO: 71377 - DNA, 16 bp, H. sapiens
cattcacaccatagca

SEQ ID NO: 71378 - DNA, 16 bp, H. sapiens
cattcacagattccag

SEQ ID NO: 71379 - DNA, 16 bp, H. sapiens
cattcacagcaacctg

SEQ ID NO: 71380 - DNA, 16 bp, H. sapiens
cattcacatgcacaca

SEQ ID NO: 71381 - DNA, 16 bp, H. sapiens
cattcactcattcatc

SEQ ID NO: 71382 - DNA, 16 bp, H. sapiens
cattcactgctggtga

SEQ ID NO: 71383 - DNA, 16 bp, H. sapiens
cattcagaaatatttt

SEQ ID NO: 71384 - DNA, 16 bp, H. sapiens
cattcagagcatagca

SEQ ID NO: 71385 - DNA, 16 bp, H. sapiens
cattcagaggctggag

SEQ ID NO: 71386 - DNA, 16 bp, H. sapiens
cattcagcaagtattt

SEQ ID NO: 71387 - DNA, 16 bp, H. sapiens
cattcagcacaggaga

SEQ ID NO: 71388 - DNA, 16 bp, H. sapiens
cattcagcattaatca

SEQ ID NO: 71389 - DNA, 16 bp, H. sapiens
cattcagccaagtatt

SEQ ID NO: 71390 - DNA, 16 bp, H. sapiens
cattcagccactctct

SEQ ID NO: 71391 - DNA, 16 bp, H. sapiens
cattcaggagcatgtt

SEQ ID NO: 71392 - DNA, 16 bp, H. sapiens
cattcagtattatgtt

SEQ ID NO: 71393 - DNA, 16 bp, H. sapiens
cattcagtccatagca

SEQ ID NO: 71394 - DNA, 16 bp, H. sapiens
cattcagtccattaca

SEQ ID NO: 71395 - DNA, 16 bp, H. sapiens
cattcagtgggtcctg

SEQ ID NO: 71396 - DNA, 16 bp, H. sapiens
cattcatatattcatt

SEQ ID NO: 71397 - DNA, 16 bp, H. sapiens
cattcatatgttgaaa

SEQ ID NO: 71398 - DNA, 16 bp, H. sapiens
cattcatattgttgtg

SEQ ID NO: 71399 - DNA, 16 bp, H. sapiens
cattcatccttcaagt

SEQ ID NO: 71400 - DNA, 16 bp, H. sapiens
cattcatctcaaagta

SEQ ID NO: 71401 - DNA, 16 bp, H. sapiens
cattcatctgtcagtg

SEQ ID NO: 71402 - DNA, 16 bp, H. sapiens
cattcatctgttcatg

SEQ ID NO: 71403 - DNA, 16 bp, H. sapiens
cattcatgagaactcc

SEQ ID NO: 71404 - DNA, 16 bp, H. sapiens
cattcatgagggctct

SEQ ID NO: 71405 - DNA, 16 bp, H. sapiens
cattcatggattcaac

SEQ ID NO: 71406 - DNA, 16 bp, H. sapiens
cattcatgttgcagca

SEQ ID NO: 71407 - DNA, 16 bp, H. sapiens
cattcatgttgttaca

SEQ ID NO: 71408 - DNA, 16 bp, H. sapiens
cattcattatttaaaa

SEQ ID NO: 71409 - DNA, 16 bp, H. sapiens
cattcattcaacaact

SEQ ID NO: 71410 - DNA, 16 bp, H. sapiens
cattcattcaacaatt

SEQ ID NO: 71411 - DNA, 16 bp, H. sapiens
cattcattcaacagct

SEQ ID NO: 71412 - DNA, 16 bp, H. sapiens
cattcattcaacatat

SEQ ID NO: 71413 - DNA, 16 bp, H. sapiens
cattcattcaatcatt

SEQ ID NO: 71414 - DNA, 16 bp, H. sapiens
cattcattcaattcat

SEQ ID NO: 71415 - DNA, 16 bp, H. sapiens
cattcattcacaaata

SEQ ID NO: 71416 - DNA, 16 bp, H. sapiens
cattcattcactcact

SEQ ID NO: 71417 - DNA, 16 bp, H. sapiens
cattcattcatcaaag

SEQ ID NO: 71418 - DNA, 16 bp, H. sapiens
cattcattcattcagt

SEQ ID NO: 71419 - DNA, 16 bp, H. sapiens
cattcattcattccat

SEQ ID NO: 71420 - DNA, 16 bp, H. sapiens
cattcattcatttgag

SEQ ID NO: 71421 - DNA, 16 bp, H. sapiens
cattcattcatttttc

SEQ ID NO: 71422 - DNA, 16 bp, H. sapiens
cattcattccctccct

SEQ ID NO: 71423 - DNA, 16 bp, H. sapiens
cattcattccttcatt

SEQ ID NO: 71424 - DNA, 16 bp, H. sapiens
cattcattccttcctt

SEQ ID NO: 71425 - DNA, 16 bp, H. sapiens
cattcattctctctcc

SEQ ID NO: 71426 - DNA, 16 bp, H. sapiens
cattcattctgtagcc

SEQ ID NO: 71427 - DNA, 16 bp, H. sapiens
cattcattctttaatt

SEQ ID NO: 71428 - DNA, 16 bp, H. sapiens
cattcattgagcacct

SEQ ID NO: 71429 - DNA, 16 bp, H. sapiens
cattcattgcagcatt

SEQ ID NO: 71430 - DNA, 16 bp, H. sapiens
cattcattgttggtgg

SEQ ID NO: 71431 - DNA, 16 bp, H. sapiens
cattcatttaatatat

SEQ ID NO: 71432 - DNA, 16 bp, H. sapiens
cattcatttacatgtt

SEQ ID NO: 71433 - DNA, 16 bp, H. sapiens
cattcatttacttact

SEQ ID NO: 71434 - DNA, 16 bp, H. sapiens
cattcatttatccatt

SEQ ID NO: 71435 - DNA, 16 bp, H. sapiens
cattcatttatgtatt

SEQ ID NO: 71436 - DNA, 16 bp, H. sapiens
cattcatttgtttact

SEQ ID NO: 71437 - DNA, 16 bp, H. sapiens
cattcatttttatagc

SEQ ID NO: 71438 - DNA, 16 bp, H. sapiens
cattcatttttatgac

SEQ ID NO: 71439 - DNA, 16 bp, H. sapiens
cattccaaattgtaaa

SEQ ID NO: 71440 - DNA, 16 bp, H. sapiens
cattccaaggacaggc

SEQ ID NO: 71441 - DNA, 16 bp, H. sapiens
cattccaatcacctgc

SEQ ID NO: 71442 - DNA, 16 bp, H. sapiens
cattccacaagtattt

SEQ ID NO: 71443 - DNA, 16 bp, H. sapiens
cattccacaatgtata

SEQ ID NO: 71444 - DNA, 16 bp, H. sapiens
cattccacccaacaac

SEQ ID NO: 71445 - DNA, 16 bp, H. sapiens
cattccactccagcct

SEQ ID NO: 71446 - DNA, 16 bp, H. sapiens
cattccactttctgtt

SEQ ID NO: 71447 - DNA, 16 bp, H. sapiens
cattccagaatctctg

SEQ ID NO: 71448 - DNA, 16 bp, H. sapiens
cattccagagattctg

SEQ ID NO: 71449 - DNA, 16 bp, H. sapiens
cattccagcccaggtg

SEQ ID NO: 71450 - DNA, 16 bp, H. sapiens
cattccagcctggggt

SEQ ID NO: 71451 - DNA, 16 bp, H. sapiens
cattccatccaacagc

SEQ ID NO: 71452 - DNA, 16 bp, H. sapiens
cattccatccagctcc

SEQ ID NO: 71453 - DNA, 16 bp, H. sapiens
cattccatcccaatag

SEQ ID NO: 71454 - DNA, 16 bp, H. sapiens
cattccatcctgggat

SEQ ID NO: 71455 - DNA, 16 bp, H. sapiens
cattccattaaagttc

SEQ ID NO: 71456 - DNA, 16 bp, H. sapiens
cattccatttatttgt

SEQ ID NO: 71457 - DNA, 16 bp, H. sapiens
cattccattttccatt

SEQ ID NO: 71458 - DNA, 16 bp, H. sapiens
cattcccactagcaat

SEQ ID NO: 71459 - DNA, 16 bp, H. sapiens
cattcccagatggtta

SEQ ID NO: 71460 - DNA, 16 bp, H. sapiens
cattcccagcagcaat

SEQ ID NO: 71461 - DNA, 16 bp, H. sapiens
cattcccagctacttg

SEQ ID NO: 71462 - DNA, 16 bp, H. sapiens
cattcccatacaccaa

SEQ ID NO: 71463 - DNA, 16 bp, H. sapiens
cattccccagtggatt

SEQ ID NO: 71464 - DNA, 16 bp, H. sapiens
cattccccatccagct

SEQ ID NO: 71465 - DNA, 16 bp, H. sapiens
cattcccggcttcctc

SEQ ID NO: 71466 - DNA, 16 bp, H. sapiens
cattcccttcatcatt

SEQ ID NO: 71467 - DNA, 16 bp, H. sapiens
cattcccttggtgctg

SEQ ID NO: 71468 - DNA, 16 bp, H. sapiens
cattccctttccagct

SEQ ID NO: 71469 - DNA, 17 bp, H. sapiens
cattccctttgaaaacg

SEQ ID NO: 71470 - DNA, 16 bp, H. sapiens
cattccctttgaaatc

SEQ ID NO: 71471 - DNA, 16 bp, H. sapiens
cattcctcagataaaa

SEQ ID NO: 71472 - DNA, 16 bp, H. sapiens
cattcctctttctcca

SEQ ID NO: 71473 - DNA, 16 bp, H. sapiens
cattcctgaggaagaa

SEQ ID NO: 71474 - DNA, 16 bp, H. sapiens
cattcctgagggctcc

SEQ ID NO: 71475 - DNA, 16 bp, H. sapiens
cattcctgctctgaaa

SEQ ID NO: 71476 - DNA, 16 bp, H. sapiens
cattcctgggataaac

SEQ ID NO: 71477 - DNA, 16 bp, H. sapiens
cattcctgggcacagg

SEQ ID NO: 71478 - DNA, 16 bp, H. sapiens
cattcctgtagtctca

SEQ ID NO: 71479 - DNA, 16 bp, H. sapiens
cattcctgtttttgtg

SEQ ID NO: 71480 - DNA, 16 bp, H. sapiens
cattccttcctgataa

SEQ ID NO: 71481 - DNA, 16 bp, H. sapiens
cattccttggcttgtg

SEQ ID NO: 71482 - DNA, 16 bp, H. sapiens
cattcctttcccttta

SEQ ID NO: 71483 - DNA, 16 bp, H. sapiens
cattcctttcctctgg

SEQ ID NO: 71484 - DNA, 16 bp, H. sapiens
cattcctttgactcca

SEQ ID NO: 71485 - DNA, 16 bp, H. sapiens
cattccttttctccac

SEQ ID NO: 71486 - DNA, 16 bp, H. sapiens
cattcgttcattcatt

SEQ ID NO: 71487 - DNA, 16 bp, H. sapiens
cattctaaagatagag

SEQ ID NO: 71488 - DNA, 20 bp, H. sapiens
cattctaactggcatgagat

SEQ ID NO: 71489 - DNA, 16 bp, H. sapiens
cattctacccaacaac

SEQ ID NO: 71490 - DNA, 16 bp, H. sapiens
cattctacctttcctg

SEQ ID NO: 71491 - DNA, 16 bp, H. sapiens
cattctcaagagaaaa

SEQ ID NO: 71492 - DNA, 16 bp, H. sapiens
cattctcaccaatact

SEQ ID NO: 71493 - DNA, 16 bp, H. sapiens
cattctcagaaactta

SEQ ID NO: 71494 - DNA, 16 bp, H. sapiens
cattctcagaaccttc

SEQ ID NO: 71495 - DNA, 16 bp, H. sapiens
cattctcaggaacttc

SEQ ID NO: 71496 - DNA, 16 bp, H. sapiens
cattctcatgttgcta

SEQ ID NO: 71497 - DNA, 16 bp, H. sapiens
cattctccatgatgtg

SEQ ID NO: 71498 - DNA, 16 bp, H. sapiens
cattctcccgtctcag

SEQ ID NO: 71499 - DNA, 16 bp, H. sapiens
cattctcctccctcag

SEQ ID NO: 71500 - DNA, 16 bp, H. sapiens
cattctcctgcctctg

SEQ ID NO: 71501 - DNA, 16 bp, H. sapiens
cattctcctgtttcag

SEQ ID NO: 71502 - DNA, 16 bp, H. sapiens
cattctctctcctgct

SEQ ID NO: 71503 - DNA, 16 bp, H. sapiens
cattctctctcctgtc

SEQ ID NO: 71504 - DNA, 16 bp, H. sapiens
cattctctctctgcct

SEQ ID NO: 71505 - DNA, 16 bp, H. sapiens
cattctctgtccagtt

SEQ ID NO: 71506 - DNA, 16 bp, H. sapiens
cattctcttttatggc

SEQ ID NO: 71507 - DNA, 16 bp, H. sapiens
cattctgaaactgggt

SEQ ID NO: 71508 - DNA, 16 bp, H. sapiens
cattctgaaatattta

SEQ ID NO: 71509 - DNA, 16 bp, H. sapiens
cattctgaacaaacta

SEQ ID NO: 71510 - DNA, 16 bp, H. sapiens
cattctgactgacatg

SEQ ID NO: 71511 - DNA, 16 bp, H. sapiens
cattctgagaaacttc

SEQ ID NO: 71512 - DNA, 16 bp, H. sapiens
cattctgagaatggac

SEQ ID NO: 71513 - DNA, 16 bp, H. sapiens
cattctgagatactga

SEQ ID NO: 71514 - DNA, 16 bp, H. sapiens
cattctgaggttccag

SEQ ID NO: 71515 - DNA, 16 bp, H. sapiens
cattctgcagatgagg

SEQ ID NO: 71516 - DNA, 16 bp, H. sapiens
cattctgcagcccatg

SEQ ID NO: 71517 - DNA, 16 bp, H. sapiens
cattctgcccctggcc

SEQ ID NO: 71518 - DNA, 16 bp, H. sapiens
cattctgctgtaaaga

SEQ ID NO: 71519 - DNA, 16 bp, H. sapiens
cattctggaagacagt

SEQ ID NO: 71520 - DNA, 16 bp, H. sapiens
cattctggagcaggtt

SEQ ID NO: 71521 - DNA, 16 bp, H. sapiens
cattctggagtctgga

SEQ ID NO: 71522 - DNA, 16 bp, H. sapiens
cattctggccaacacg

SEQ ID NO: 71523 - DNA, 16 bp, H. sapiens
cattctgtatttttat

SEQ ID NO: 71524 - DNA, 16 bp, H. sapiens
cattctgtctcaaaaa

SEQ ID NO: 71525 - DNA, 16 bp, H. sapiens
cattctgtgtctggct

SEQ ID NO: 71526 - DNA, 16 bp, H. sapiens
cattctgttgcccaag

SEQ ID NO: 71527 - DNA, 16 bp, H. sapiens
cattcttaaatatgaa

SEQ ID NO: 71528 - DNA, 16 bp, H. sapiens
cattcttatacagcaa

SEQ ID NO: 71529 - DNA, 16 bp, H. sapiens
cattcttcacaaaatt

SEQ ID NO: 71530 - DNA, 16 bp, H. sapiens
cattcttcacagaaat

SEQ ID NO: 71531 - DNA, 16 bp, H. sapiens
cattcttcatgtagtt

SEQ ID NO: 71532 - DNA, 16 bp, H. sapiens
cattcttccacccaag

SEQ ID NO: 71533 - DNA, 16 bp, H. sapiens
cattcttccttttgtt

SEQ ID NO: 71534 - DNA, 16 bp, H. sapiens
cattcttctgcctttg

SEQ ID NO: 71535 - DNA, 16 bp, H. sapiens
cattcttcttcacatg

SEQ ID NO: 71536 - DNA, 16 bp, H. sapiens
cattcttgcaggagca

SEQ ID NO: 71537 - DNA, 16 bp, H. sapiens
cattcttgtttcatct

SEQ ID NO: 71538 - DNA, 16 bp, H. sapiens
cattctttaaataaaa

SEQ ID NO: 71539 - DNA, 16 bp, H. sapiens
cattctttattgcttt

SEQ ID NO: 71540 - DNA, 16 bp, H. sapiens
cattctttcatgtgtc

SEQ ID NO: 71541 - DNA, 16 bp, H. sapiens
cattctttctgctttt

SEQ ID NO: 71542 - DNA, 16 bp, H. sapiens
cattctttctgtcttt

SEQ ID NO: 71543 - DNA, 16 bp, H. sapiens
cattcttttaacaaat

SEQ ID NO: 71544 - DNA, 16 bp, H. sapiens
cattcttttccatgtg

SEQ ID NO: 71545 - DNA, 16 bp, H. sapiens
cattcttttctactga

SEQ ID NO: 71546 - DNA, 16 bp, H. sapiens
cattcttttgaatttc

SEQ ID NO: 71547 - DNA, 16 bp, H. sapiens
cattctttttaaagaa

SEQ ID NO: 71548 - DNA, 16 bp, H. sapiens
cattcttttttatgga

SEQ ID NO: 71549 - DNA, 16 bp, H. sapiens
cattgaaaaacatttt

SEQ ID NO: 71550 - DNA, 16 bp, H. sapiens
cattgaaaacaaaaca

SEQ ID NO: 71551 - DNA, 16 bp, H. sapiens
cattgaaaactggcac

SEQ ID NO: 71552 - DNA, 16 bp, H. sapiens
cattgaaaagaaaata

SEQ ID NO: 71553 - DNA, 16 bp, H. sapiens
cattgaaaccacagca

SEQ ID NO: 71554 - DNA, 16 bp, H. sapiens
cattgaaataaaagca

SEQ ID NO: 71555 - DNA, 16 bp, H. sapiens
cattgaaatttaaatt

SEQ ID NO: 71556 - DNA, 16 bp, H. sapiens
cattgaaattttaaaa

SEQ ID NO: 71557 - DNA, 16 bp, H. sapiens
cattgaaccatcagaa

SEQ ID NO: 71558 - DNA, 16 bp, H. sapiens
cattgaactggaagtt

SEQ ID NO: 71559 - DNA, 16 bp, H. sapiens
cattgaatgaaatgtt

SEQ ID NO: 71560 - DNA, 16 bp, H. sapiens
cattgaattgcttttg

SEQ ID NO: 71561 - DNA, 16 bp, H. sapiens
cattgaatttttaaat

SEQ ID NO: 71562 - DNA, 16 bp, H. sapiens
cattgacatggttaaa

SEQ ID NO: 71563 - DNA, 16 bp, H. sapiens
cattgaccccacagaa

SEQ ID NO: 71564 - DNA, 16 bp, H. sapiens
cattgaccttaatcac

SEQ ID NO: 71565 - DNA, 16 bp, H. sapiens
cattgacttctcccct

SEQ ID NO: 71566 - DNA, 16 bp, H. sapiens
cattgacttcttctct

SEQ ID NO: 71567 - DNA, 16 bp, H. sapiens
cattgactttcttcat

SEQ ID NO: 71568 - DNA, 16 bp, H. sapiens
cattgagaaaaataaa

SEQ ID NO: 71569 - DNA, 16 bp, H. sapiens
cattgagaaagcaagc

SEQ ID NO: 71570 - DNA, 16 bp, H. sapiens
cattgagaacgggcca

SEQ ID NO: 71571 - DNA, 16 bp, H. sapiens
cattgaggtcaatggc

SEQ ID NO: 71572 - DNA, 16 bp, H. sapiens
cattgagtcctatggt

SEQ ID NO: 71573 - DNA, 16 bp, H. sapiens
cattgagtgtctgcag

SEQ ID NO: 71574 - DNA, 16 bp, H. sapiens
cattgagtttcttcac

SEQ ID NO: 71575 - DNA, 16 bp, H. sapiens
cattgagtttttattt

SEQ ID NO: 71576 - DNA, 16 bp, H. sapiens
cattgatgaaggaaat

SEQ ID NO: 71577 - DNA, 16 bp, H. sapiens
cattgatgatgatgat

SEQ ID NO: 71578 - DNA, 16 bp, H. sapiens
cattgatttatatatt

SEQ ID NO: 71579 - DNA, 16 bp, H. sapiens
cattgatttatatttt

SEQ ID NO: 71580 - DNA, 16 bp, H. sapiens
cattgattttaaaaaa

SEQ ID NO: 71581 - DNA, 16 bp, H. sapiens
cattgattttttaagg

SEQ ID NO: 71582 - DNA, 16 bp, H. sapiens
cattgattttttttaa

SEQ ID NO: 71583 - DNA, 16 bp, H. sapiens
cattgcaaaacatttt

SEQ ID NO: 71584 - DNA, 16 bp, H. sapiens
cattgcaaaatacagt

SEQ ID NO: 71585 - DNA, 16 bp, H. sapiens
cattgcaaaattataa

SEQ ID NO: 71586 - DNA, 16 bp, H. sapiens
cattgcacccagcctg

SEQ ID NO: 71587 - DNA, 17 bp, H. sapiens
cattgcacccagtgtca

SEQ ID NO: 71588 - DNA, 16 bp, H. sapiens
cattgcacctggccac

SEQ ID NO: 71589 - DNA, 17 bp, H. sapiens
cattgcactcaagcctg

SEQ ID NO: 71590 - DNA, 16 bp, H. sapiens
cattgcactccagccc

SEQ ID NO: 71591 - DNA, 16 bp, H. sapiens
cattgcactccagcct

SEQ ID NO: 71592 - DNA, 17 bp, H. sapiens
cattgcactccagcctc

SEQ ID NO: 71593 - DNA, 16 bp, H. sapiens
cattgcactccagctc

SEQ ID NO: 71594 - DNA, 16 bp, H. sapiens
cattgcactctgcact

SEQ ID NO: 71595 - DNA, 18 bp, H. sapiens
cattgcactgcagcctgg

SEQ ID NO: 71596 - DNA, 16 bp, H. sapiens
cattgcagaaggtgaa

SEQ ID NO: 71597 - DNA, 16 bp, H. sapiens
cattgcagcattattt

SEQ ID NO: 71598 - DNA, 16 bp, H. sapiens
cattgcagcctccacc

SEQ ID NO: 71599 - DNA, 16 bp, H. sapiens
cattgcagggttttga

SEQ ID NO: 71600 - DNA, 16 bp, H. sapiens
cattgcagttttcagt

SEQ ID NO: 71601 - DNA, 16 bp, H. sapiens
cattgcatcctctgcc

SEQ ID NO: 71602 - DNA, 16 bp, H. sapiens
cattgcattccaacct

SEQ ID NO: 71603 - DNA, 16 bp, H. sapiens
cattgcatttattttt

SEQ ID NO: 71604 - DNA, 16 bp, H. sapiens
cattgccaaatccagt

SEQ ID NO: 71605 - DNA, 16 bp, H. sapiens
cattgccaaatgtcac

SEQ ID NO: 71606 - DNA, 16 bp, H. sapiens
cattgccacctccacc

SEQ ID NO: 71607 - DNA, 16 bp, H. sapiens
cattgccagcatctgt

SEQ ID NO: 71608 - DNA, 16 bp, H. sapiens
cattgcccaggctgct

SEQ ID NO: 71609 - DNA, 16 bp, H. sapiens
cattgcccaggctgga

SEQ ID NO: 71610 - DNA, 16 bp, H. sapiens
cattgcccagggtggt

SEQ ID NO: 71611 - DNA, 16 bp, H. sapiens
cattgcccatttttaa

SEQ ID NO: 71612 - DNA, 16 bp, H. sapiens
cattgcctcagcccaa

SEQ ID NO: 71613 - DNA, 16 bp, H. sapiens
cattgcgctccagcct

SEQ ID NO: 71614 - DNA, 16 bp, H. sapiens
cattgctattttaaaa

SEQ ID NO: 71615 - DNA, 16 bp, H. sapiens
cattgctcagctccca

SEQ ID NO: 71616 - DNA, 16 bp, H. sapiens
cattgctcagttccca

SEQ ID NO: 71617 - DNA, 16 bp, H. sapiens
cattgctctgatggcc

SEQ ID NO: 71618 - DNA, 16 bp, H. sapiens
cattgctcttcagcct

SEQ ID NO: 71619 - DNA, 16 bp, H. sapiens
cattgctgatgaaaat

SEQ ID NO: 71620 - DNA, 16 bp, H. sapiens
cattgctgccaacatg

SEQ ID NO: 71621 - DNA, 16 bp, H. sapiens
cattgctggctttgaa

SEQ ID NO: 71622 - DNA, 16 bp, H. sapiens
cattgctggtgggaaa

SEQ ID NO: 71623 - DNA, 16 bp, H. sapiens
cattgcttgtgtgtgt

SEQ ID NO: 71624 - DNA, 16 bp, H. sapiens
cattgcttgttttttg

SEQ ID NO: 71625 - DNA, 16 bp, H. sapiens
cattgctttggtgttt

SEQ ID NO: 71626 - DNA, 16 bp, H. sapiens
cattgcttttggcatc

SEQ ID NO: 71627 - DNA, 16 bp, H. sapiens
cattgcttttgtgttt

SEQ ID NO: 71628 - DNA, 16 bp, H. sapiens
cattgctttttattct

SEQ ID NO: 71629 - DNA, 16 bp, H. sapiens
cattggaagaatcaat

SEQ ID NO: 71630 - DNA, 16 bp, H. sapiens
cattggagatgactca

SEQ ID NO: 71631 - DNA, 16 bp, H. sapiens
cattggccgggcgtgg

SEQ ID NO: 71632 - DNA, 16 bp, H. sapiens
cattggcctgccttgc

SEQ ID NO: 71633 - DNA, 16 bp, H. sapiens
cattggccttggcaaa

SEQ ID NO: 71634 - DNA, 16 bp, H. sapiens
cattgggctgttgctg

SEQ ID NO: 71635 - DNA, 16 bp, H. sapiens
cattggtattctgata

SEQ ID NO: 71636 - DNA, 16 bp, H. sapiens
cattggtctctatctc

SEQ ID NO: 71637 - DNA, 16 bp, H. sapiens
cattggtcttggcaaa

SEQ ID NO: 71638 - DNA, 16 bp, H. sapiens
cattggtggcttgatg

SEQ ID NO: 71639 - DNA, 16 bp, H. sapiens
cattggtgtgctgtat

SEQ ID NO: 71640 - DNA, 16 bp, H. sapiens
cattggtttcaaataa

SEQ ID NO: 71641 - DNA, 16 bp, H. sapiens
cattggtttgaaagaa

SEQ ID NO: 71642 - DNA, 16 bp, H. sapiens
cattgtaaagctgaaa

SEQ ID NO: 71643 - DNA, 16 bp, H. sapiens
cattgtaaatattttt

SEQ ID NO: 71644 - DNA, 16 bp, H. sapiens
cattgtacagatgaag

SEQ ID NO: 71645 - DNA, 16 bp, H. sapiens
cattgtacagatgggg

SEQ ID NO: 71646 - DNA, 16 bp, H. sapiens
cattgtagaagacagt

SEQ ID NO: 71647 - DNA, 16 bp, H. sapiens
cattgtatacacatat

SEQ ID NO: 71648 - DNA, 16 bp, H. sapiens
cattgtataccttaaa

SEQ ID NO: 71649 - DNA, 16 bp, H. sapiens
cattgtatacttgaaa

SEQ ID NO: 71650 - DNA, 16 bp, H. sapiens
cattgtatatatgtac

SEQ ID NO: 71651 - DNA, 16 bp, H. sapiens
cattgtatcattctta

SEQ ID NO: 71652 - DNA, 16 bp, H. sapiens
cattgtatgtttttgg

SEQ ID NO: 71653 - DNA, 16 bp, H. sapiens
cattgtattatataat

SEQ ID NO: 71654 - DNA, 16 bp, H. sapiens
cattgtattcttcagc

SEQ ID NO: 71655 - DNA, 16 bp, H. sapiens
cattgtattttaattt

SEQ ID NO: 71656 - DNA, 16 bp, H. sapiens
cattgtattttggaag

SEQ ID NO: 71657 - DNA, 16 bp, H. sapiens
cattgtcaataagcag

SEQ ID NO: 71658 - DNA, 16 bp, H. sapiens
cattgtcaccatcatc

SEQ ID NO: 71659 - DNA, 16 bp, H. sapiens
cattgtcaccccagag

SEQ ID NO: 71660 - DNA, 16 bp, H. sapiens
cattgtcaggctgcaa

SEQ ID NO: 71661 - DNA, 16 bp, H. sapiens
cattgtcatcctggcc

SEQ ID NO: 71662 - DNA, 16 bp, H. sapiens
cattgtcatttcaaca

SEQ ID NO: 71663 - DNA, 16 bp, H. sapiens
cattgtccagaagaag

SEQ ID NO: 71664 - DNA, 16 bp, H. sapiens
cattgtccatttgtat

SEQ ID NO: 71665 - DNA, 16 bp, H. sapiens
cattgtgaaataatta

SEQ ID NO: 71666 - DNA, 16 bp, H. sapiens
cattgtgacagtatta

SEQ ID NO: 71667 - DNA, 16 bp, H. sapiens
cattgtgatttttatt

SEQ ID NO: 71668 - DNA, 16 bp, H. sapiens
cattgtgcacctggaa

SEQ ID NO: 71669 - DNA, 16 bp, H. sapiens
cattgtggaaaacaat

SEQ ID NO: 71670 - DNA, 16 bp, H. sapiens
cattgtggaaaaggca

SEQ ID NO: 71671 - DNA, 19 bp, H. sapiens
cattgtggaagacagtgtg

SEQ ID NO: 71672 - DNA, 16 bp, H. sapiens
cattgtggtattaatt

SEQ ID NO: 71673 - DNA, 16 bp, H. sapiens
cattgtgttgcccagg

SEQ ID NO: 71674 - DNA, 16 bp, H. sapiens
cattgttaaaatgaca

SEQ ID NO: 71675 - DNA, 16 bp, H. sapiens
cattgttaacattttg

SEQ ID NO: 71676 - DNA, 16 bp, H. sapiens
cattgttaagtgacac

SEQ ID NO: 71677 - DNA, 16 bp, H. sapiens
cattgttcaactccct

SEQ ID NO: 71678 - DNA, 16 bp, H. sapiens
cattgttcaattccaa

SEQ ID NO: 71679 - DNA, 16 bp, H. sapiens
cattgttggtagaaat

SEQ ID NO: 71680 - DNA, 16 bp, H. sapiens
cattgttgttattatt

SEQ ID NO: 71681 - DNA, 16 bp, H. sapiens
cattgttgttattgtt

SEQ ID NO: 71682 - DNA, 16 bp, H. sapiens
cattgtttaaaaaaaa

SEQ ID NO: 71683 - DNA, 16 bp, H. sapiens
cattgtttctatagat

SEQ ID NO: 71684 - DNA, 16 bp, H. sapiens
cattgttttaaataat

SEQ ID NO: 71685 - DNA, 16 bp, H. sapiens
cattgttttaagctgc

SEQ ID NO: 71686 - DNA, 16 bp, H. sapiens
cattgttttaatttgt

SEQ ID NO: 71687 - DNA, 16 bp, H. sapiens
cattgttttatttaat

SEQ ID NO: 71688 - DNA, 16 bp, H. sapiens
cattgtttttgtagaa

SEQ ID NO: 71689 - DNA, 16 bp, H. sapiens
catttaaaaaaatgaa

SEQ ID NO: 71690 - DNA, 16 bp, H. sapiens
catttaaaaaataaga

SEQ ID NO: 71691 - DNA, 16 bp, H. sapiens
catttaaaaaatgatt

SEQ ID NO: 71692 - DNA, 16 bp, H. sapiens
catttaaaaagtaatt

SEQ ID NO: 71693 - DNA, 16 bp, H. sapiens
catttaaaaatattca

SEQ ID NO: 71694 - DNA, 16 bp, H. sapiens
catttaaaaatcatgt

SEQ ID NO: 71695 - DNA, 16 bp, H. sapiens
catttaaaaatgcata

SEQ ID NO: 71696 - DNA, 16 bp, H. sapiens
catttaaaaatgcatt

SEQ ID NO: 71697 - DNA, 16 bp, H. sapiens
catttaaaacataatt

SEQ ID NO: 71698 - DNA, 16 bp, H. sapiens
catttaaaaccaaaga

SEQ ID NO: 71699 - DNA, 16 bp, H. sapiens
catttaaaagatacag

SEQ ID NO: 71700 - DNA, 16 bp, H. sapiens
catttaaaagcaaatt

SEQ ID NO: 71701 - DNA, 16 bp, H. sapiens
catttaaaaggaagaa

SEQ ID NO: 71702 - DNA, 16 bp, H. sapiens
catttaaaataaaatg

SEQ ID NO: 71703 - DNA, 16 bp, H. sapiens
catttaaaataagatt

SEQ ID NO: 71704 - DNA, 16 bp, H. sapiens
catttaaaatgagaaa

SEQ ID NO: 71705 - DNA, 16 bp, H. sapiens
catttaaaatggaaaa

SEQ ID NO: 71706 - DNA, 16 bp, H. sapiens
catttaaaatgttatt

SEQ ID NO: 71707 - DNA, 16 bp, H. sapiens
catttaaaattatttc

SEQ ID NO: 71708 - DNA, 16 bp, H. sapiens
catttaaacattttta

SEQ ID NO: 71709 - DNA, 16 bp, H. sapiens
catttaaaccacagca

SEQ ID NO: 71710 - DNA, 16 bp, H. sapiens
catttaaagtgcacaa

SEQ ID NO: 71711 - DNA, 16 bp, H. sapiens
catttaaatgaaattt

SEQ ID NO: 71712 - DNA, 16 bp, H. sapiens
catttaaattagaaaa

SEQ ID NO: 71713 - DNA, 16 bp, H. sapiens
catttaaattcaaata

SEQ ID NO: 71714 - DNA, 16 bp, H. sapiens
catttaacattttaaa

SEQ ID NO: 71715 - DNA, 16 bp, H. sapiens
catttaagaatatgca

SEQ ID NO: 71716 - DNA, 16 bp, H. sapiens
catttaagaatatttt

SEQ ID NO: 71717 - DNA, 16 bp, H. sapiens
catttaagaatgtatt

SEQ ID NO: 71718 - DNA, 16 bp, H. sapiens
catttaaggaagaaaa

SEQ ID NO: 71719 - DNA, 16 bp, H. sapiens
catttaataaacactt

SEQ ID NO: 71720 - DNA, 16 bp, H. sapiens
catttaataaatgaaa

SEQ ID NO: 71721 - DNA, 16 bp, H. sapiens
catttaataatcagac

SEQ ID NO: 71722 - DNA, 16 bp, H. sapiens
catttaatatgattat

SEQ ID NO: 71723 - DNA, 16 bp, H. sapiens
catttaatatttccag

SEQ ID NO: 71724 - DNA, 16 bp, H. sapiens
catttaatcctttcag

SEQ ID NO: 71725 - DNA, 16 bp, H. sapiens
catttaatcttcccag

SEQ ID NO: 71726 - DNA, 16 bp, H. sapiens
catttaatgctatgaa

SEQ ID NO: 71727 - DNA, 16 bp, H. sapiens
catttaattctgctct

SEQ ID NO: 71728 - DNA, 16 bp, H. sapiens
catttaatttccacaa

SEQ ID NO: 71729 - DNA, 16 bp, H. sapiens
catttacaaatgaaga

SEQ ID NO: 71730 - DNA, 16 bp, H. sapiens
catttacagaggagga

SEQ ID NO: 71731 - DNA, 16 bp, H. sapiens
catttacatctttaat

SEQ ID NO: 71732 - DNA, 17 bp, H. sapiens
catttacattaggtatt

SEQ ID NO: 71733 - DNA, 16 bp, H. sapiens
catttacattatatta

SEQ ID NO: 71734 - DNA, 16 bp, H. sapiens
catttacattgcatta

SEQ ID NO: 71735 - DNA, 16 bp, H. sapiens
catttacattgtatca

SEQ ID NO: 71736 - DNA, 16 bp, H. sapiens
catttacatttctaaa

SEQ ID NO: 71737 - DNA, 16 bp, H. sapiens
catttacatttgaatt

SEQ ID NO: 71738 - DNA, 16 bp, H. sapiens
catttaccattccaaa

SEQ ID NO: 71739 - DNA, 16 bp, H. sapiens
catttaccctgatgtg

SEQ ID NO: 71740 - DNA, 16 bp, H. sapiens
catttacctcccactt

SEQ ID NO: 71741 - DNA, 16 bp, H. sapiens
catttactactataaa

SEQ ID NO: 71742 - DNA, 16 bp, H. sapiens
catttactcagcctgc

SEQ ID NO: 71743 - DNA, 16 bp, H. sapiens
catttactgaacatct

SEQ ID NO: 71744 - DNA, 16 bp, H. sapiens
catttactgaatacct

SEQ ID NO: 71745 - DNA, 16 bp, H. sapiens
catttactgagatggg

SEQ ID NO: 71746 - DNA, 16 bp, H. sapiens
catttactgagcacct

SEQ ID NO: 71747 - DNA, 16 bp, H. sapiens
catttactgagcattt

SEQ ID NO: 71748 - DNA, 16 bp, H. sapiens
catttactgagtacct

SEQ ID NO: 71749 - DNA, 16 bp, H. sapiens
catttactgatttgca

SEQ ID NO: 71750 - DNA, 16 bp, H. sapiens
catttactgtgtgcca

SEQ ID NO: 71751 - DNA, 16 bp, H. sapiens
catttacttctcacag

SEQ ID NO: 71752 - DNA, 16 bp, H. sapiens
catttacttttaaaaa

SEQ ID NO: 71753 - DNA, 16 bp, H. sapiens
catttactttttaaaa

SEQ ID NO: 71754 - DNA, 16 bp, H. sapiens
catttagaaaaataat

SEQ ID NO: 71755 - DNA, 16 bp, H. sapiens
catttagaataaaatc

SEQ ID NO: 71756 - DNA, 16 bp, H. sapiens
catttagcaaatgttt

SEQ ID NO: 71757 - DNA, 16 bp, H. sapiens
catttagcatgttgtt

SEQ ID NO: 71758 - DNA, 16 bp, H. sapiens
catttaggttgattcc

SEQ ID NO: 71759 - DNA, 16 bp, H. sapiens
catttagttcatttat

SEQ ID NO: 71760 - DNA, 16 bp, H. sapiens
catttagttgtcatat

SEQ ID NO: 71761 - DNA, 16 bp, H. sapiens
catttagtttttaggt

SEQ ID NO: 71762 - DNA, 16 bp, H. sapiens
catttataaaatgagg

SEQ ID NO: 71763 - DNA, 16 bp, H. sapiens
catttatacaaaatgt

SEQ ID NO: 71764 - DNA, 16 bp, H. sapiens
catttatataaaatgt

SEQ ID NO: 71765 - DNA, 16 bp, H. sapiens
catttatatattgtct

SEQ ID NO: 71766 - DNA, 16 bp, H. sapiens
catttatatgaaattt

SEQ ID NO: 71767 - DNA, 16 bp, H. sapiens
catttatatgaactat

SEQ ID NO: 71768 - DNA, 16 bp, H. sapiens
catttatatgtatttt

SEQ ID NO: 71769 - DNA, 16 bp, H. sapiens
catttatatgtctttt

SEQ ID NO: 71770 - DNA, 16 bp, H. sapiens
catttatatgtttatg

SEQ ID NO: 71771 - DNA, 16 bp, H. sapiens
catttatattaaatgt

SEQ ID NO: 71772 - DNA, 16 bp, H. sapiens
catttatatttaatgt

SEQ ID NO: 71773 - DNA, 16 bp, H. sapiens
catttatcaagtgacc

SEQ ID NO: 71774 - DNA, 16 bp, H. sapiens
catttatcacttccct

SEQ ID NO: 71775 - DNA, 16 bp, H. sapiens
catttatcatttgttt

SEQ ID NO: 71776 - DNA, 16 bp, H. sapiens
catttatccatccatc

SEQ ID NO: 71777 - DNA, 16 bp, H. sapiens
catttatcctagagaa

SEQ ID NO: 71778 - DNA, 16 bp, H. sapiens
catttatcttttaaaa

SEQ ID NO: 71779 - DNA, 16 bp, H. sapiens
catttatcttttgtat

SEQ ID NO: 71780 - DNA, 16 bp, H. sapiens
catttatgatttattt

SEQ ID NO: 71781 - DNA, 16 bp, H. sapiens
catttatgattttaaa

SEQ ID NO: 71782 - DNA, 16 bp, H. sapiens
catttatgcagccaat

SEQ ID NO: 71783 - DNA, 16 bp, H. sapiens
catttatggggtacag

SEQ ID NO: 71784 - DNA, 16 bp, H. sapiens
catttatgtatatttt

SEQ ID NO: 71785 - DNA, 16 bp, H. sapiens
catttatgtgaaatgt

SEQ ID NO: 71786 - DNA, 16 bp, H. sapiens
catttatgtgttcact

SEQ ID NO: 71787 - DNA, 16 bp, H. sapiens
catttatgttgtatta

SEQ ID NO: 71788 - DNA, 16 bp, H. sapiens
catttattaaacaaat

SEQ ID NO: 71789 - DNA, 16 bp, H. sapiens
catttattaaacactt

SEQ ID NO: 71790 - DNA, 16 bp, H. sapiens
catttattaagcattt

SEQ ID NO: 71791 - DNA, 16 bp, H. sapiens
catttattaagtacct

SEQ ID NO: 71792 - DNA, 16 bp, H. sapiens
catttattacccagaa

SEQ ID NO: 71793 - DNA, 16 bp, H. sapiens
catttattatgatgtt

SEQ ID NO: 71794 - DNA, 16 bp, H. sapiens
catttattattttgta

SEQ ID NO: 71795 - DNA, 16 bp, H. sapiens
catttattcagtattt

SEQ ID NO: 71796 - DNA, 16 bp, H. sapiens
catttattcatgtttt

SEQ ID NO: 71797 - DNA, 16 bp, H. sapiens
catttattcattctaa

SEQ ID NO: 71798 - DNA, 16 bp, H. sapiens
catttattctgtttat

SEQ ID NO: 71799 - DNA, 16 bp, H. sapiens
catttattgagcactt

SEQ ID NO: 71800 - DNA, 16 bp, H. sapiens
catttattgagtttct

SEQ ID NO: 71801 - DNA, 16 bp, H. sapiens
catttattgtgctctt

SEQ ID NO: 71802 - DNA, 16 bp, H. sapiens
catttatttagatatt

SEQ ID NO: 71803 - DNA, 16 bp, H. sapiens
catttatttatatgta

SEQ ID NO: 71804 - DNA, 16 bp, H. sapiens
catttatttatgtatt

SEQ ID NO: 71805 - DNA, 16 bp, H. sapiens
catttatttcaataaa

SEQ ID NO: 71806 - DNA, 16 bp, H. sapiens
catttatttctgttct

SEQ ID NO: 71807 - DNA, 16 bp, H. sapiens
catttatttgataatt

SEQ ID NO: 71808 - DNA, 16 bp, H. sapiens
catttatttgtgactt

SEQ ID NO: 71809 - DNA, 16 bp, H. sapiens
catttattttatcaaa

SEQ ID NO: 71810 - DNA, 16 bp, H. sapiens
catttatttttaaaag

SEQ ID NO: 71811 - DNA, 16 bp, H. sapiens
catttatttttccata

SEQ ID NO: 71812 - DNA, 16 bp, H. sapiens
catttatttttctcag

SEQ ID NO: 71813 - DNA, 16 bp, H. sapiens
catttatttttgctct

SEQ ID NO: 71814 - DNA, 16 bp, H. sapiens
catttattttttcctg

SEQ ID NO: 71815 - DNA, 16 bp, H. sapiens
catttcaaaagcaaaa

SEQ ID NO: 71816 - DNA, 16 bp, H. sapiens
catttcaaaataaatt

SEQ ID NO: 71817 - DNA, 16 bp, H. sapiens
catttcaaaatacagt

SEQ ID NO: 71818 - DNA, 16 bp, H. sapiens
catttcaaaatgcaaa

SEQ ID NO: 71819 - DNA, 16 bp, H. sapiens
catttcaaagactttt

SEQ ID NO: 71820 - DNA, 16 bp, H. sapiens
catttcaaatatcttt

SEQ ID NO: 71821 - DNA, 16 bp, H. sapiens
catttcaaatattctc

SEQ ID NO: 71822 - DNA, 16 bp, H. sapiens
catttcaacaagaaga

SEQ ID NO: 71823 - DNA, 16 bp, H. sapiens
catttcaaccatttca

SEQ ID NO: 71824 - DNA, 16 bp, H. sapiens
catttcaagaaaagaa

SEQ ID NO: 71825 - DNA, 16 bp, H. sapiens
catttcaaggaaatca

SEQ ID NO: 71826 - DNA, 16 bp, H. sapiens
catttcaatattttaa

SEQ ID NO: 71827 - DNA, 16 bp, H. sapiens
catttcacaaataagg

SEQ ID NO: 71828 - DNA, 16 bp, H. sapiens
catttcacagaggagg

SEQ ID NO: 71829 - DNA, 16 bp, H. sapiens
catttcacagatgggg

SEQ ID NO: 71830 - DNA, 16 bp, H. sapiens
catttcacattttaaa

SEQ ID NO: 71831 - DNA, 16 bp, H. sapiens
catttcacccaacaac

SEQ ID NO: 71832 - DNA, 16 bp, H. sapiens
catttcactccagcct

SEQ ID NO: 71833 - DNA, 16 bp, H. sapiens
catttcactctagcct

SEQ ID NO: 71834 - DNA, 16 bp, H. sapiens
catttcagaattcagt

SEQ ID NO: 71835 - DNA, 16 bp, H. sapiens
catttcagagcccatt

SEQ ID NO: 71836 - DNA, 16 bp, H. sapiens
catttcagataaagga

SEQ ID NO: 71837 - DNA, 16 bp, H. sapiens
catttcaggcagaagg

SEQ ID NO: 71838 - DNA, 16 bp, H. sapiens
catttcagtattattt

SEQ ID NO: 71839 - DNA, 16 bp, H. sapiens
catttcataaatgttt

SEQ ID NO: 71840 - DNA, 16 bp, H. sapiens
catttcataaattaaa

SEQ ID NO: 71841 - DNA, 16 bp, H. sapiens
catttcatcaccccaa

SEQ ID NO: 71842 - DNA, 16 bp, H. sapiens
catttcattccattgc

SEQ ID NO: 71843 - DNA, 16 bp, H. sapiens
catttcattgaccaaa

SEQ ID NO: 71844 - DNA, 16 bp, H. sapiens
catttcatttaaatta

SEQ ID NO: 71845 - DNA, 16 bp, H. sapiens
catttcatttcatcct

SEQ ID NO: 71846 - DNA, 16 bp, H. sapiens
catttcatttcatgat

SEQ ID NO: 71847 - DNA, 16 bp, H. sapiens
catttcattttgttta

SEQ ID NO: 71848 - DNA, 16 bp, H. sapiens
catttccaaaaataaa

SEQ ID NO: 71849 - DNA, 16 bp, H. sapiens
catttccaaaactttt

SEQ ID NO: 71850 - DNA, 16 bp, H. sapiens
catttccacattttca

SEQ ID NO: 71851 - DNA, 16 bp, H. sapiens
catttccaccagcagt

SEQ ID NO: 71852 - DNA, 16 bp, H. sapiens
catttccagaaagaaa

SEQ ID NO: 71853 - DNA, 16 bp, H. sapiens
catttccatcttgatt

SEQ ID NO: 71854 - DNA, 16 bp, H. sapiens
catttccatttctaaa

SEQ ID NO: 71855 - DNA, 16 bp, H. sapiens
catttccatttgatga

SEQ ID NO: 71856 - DNA, 16 bp, H. sapiens
catttcccaaagtgtg

SEQ ID NO: 71857 - DNA, 16 bp, H. sapiens
catttcccagcctccc

SEQ ID NO: 71858 - DNA, 16 bp, H. sapiens
catttcccctctgcac

SEQ ID NO: 71859 - DNA, 16 bp, H. sapiens
catttccctaatgatc

SEQ ID NO: 71860 - DNA, 16 bp, H. sapiens
catttccctgatgatt

SEQ ID NO: 71861 - DNA, 16 bp, H. sapiens
catttccctgatgctt

SEQ ID NO: 71862 - DNA, 16 bp, H. sapiens
catttccctgtcttct

SEQ ID NO: 71863 - DNA, 16 bp, H. sapiens
catttcctaattgaat

SEQ ID NO: 71864 - DNA, 16 bp, H. sapiens
catttcctagaatttt

SEQ ID NO: 71865 - DNA, 16 bp, H. sapiens
catttcctattttaaa

SEQ ID NO: 71866 - DNA, 16 bp, H. sapiens
catttcctcacctgta

SEQ ID NO: 71867 - DNA, 16 bp, H. sapiens
catttcctcatctgta

SEQ ID NO: 71868 - DNA, 16 bp, H. sapiens
catttcctcccttctg

SEQ ID NO: 71869 - DNA, 16 bp, H. sapiens
catttcctctgagaac

SEQ ID NO: 71870 - DNA, 16 bp, H. sapiens
catttcctgacttttt

SEQ ID NO: 71871 - DNA, 16 bp, H. sapiens
catttcctgaggcctc

SEQ ID NO: 71872 - DNA, 16 bp, H. sapiens
catttcctggttcata

SEQ ID NO: 71873 - DNA, 16 bp, H. sapiens
catttccttatctata

SEQ ID NO: 71874 - DNA, 16 bp, H. sapiens
catttcctttccaatt

SEQ ID NO: 71875 - DNA, 16 bp, H. sapiens
catttcctttgaaaat

SEQ ID NO: 71876 - DNA, 16 bp, H. sapiens
catttcctttgagcgt

SEQ ID NO: 71877 - DNA, 16 bp, H. sapiens
catttccttttctctg

SEQ ID NO: 71878 - DNA, 16 bp, H. sapiens
catttccttttgattt

SEQ ID NO: 71879 - DNA, 16 bp, H. sapiens
catttcctttttaaaa

SEQ ID NO: 71880 - DNA, 16 bp, H. sapiens
catttcctttttctgt

SEQ ID NO: 71881 - DNA, 16 bp, H. sapiens
catttctaacaagttt

SEQ ID NO: 71882 - DNA, 16 bp, H. sapiens
catttctaattctagt

SEQ ID NO: 71883 - DNA, 16 bp, H. sapiens
catttctacaaagaaa

SEQ ID NO: 71884 - DNA, 16 bp, H. sapiens
catttctagattattt

SEQ ID NO: 71885 - DNA, 16 bp, H. sapiens
catttctataaaaata

SEQ ID NO: 71886 - DNA, 16 bp, H. sapiens
catttctatacaccaa

SEQ ID NO: 71887 - DNA, 16 bp, H. sapiens
catttctatcaacagt

SEQ ID NO: 71888 - DNA, 16 bp, H. sapiens
catttctcaaagaaga

SEQ ID NO: 71889 - DNA, 16 bp, H. sapiens
catttctcaaaggaag

SEQ ID NO: 71890 - DNA, 16 bp, H. sapiens
catttctcattttaat

SEQ ID NO: 71891 - DNA, 16 bp, H. sapiens
catttctccaaagaga

SEQ ID NO: 71892 - DNA, 16 bp, H. sapiens
catttctccatctgta

SEQ ID NO: 71893 - DNA, 16 bp, H. sapiens
catttctccttcctca

SEQ ID NO: 71894 - DNA, 16 bp, H. sapiens
catttctccttgctgc

SEQ ID NO: 71895 - DNA, 16 bp, H. sapiens
catttctctaattatg

SEQ ID NO: 71896 - DNA, 16 bp, H. sapiens
catttctctgaagaag

SEQ ID NO: 71897 - DNA, 16 bp, H. sapiens
catttctcttaaaaaa

SEQ ID NO: 71898 - DNA, 16 bp, H. sapiens
catttctctttgttct

SEQ ID NO: 71899 - DNA, 16 bp, H. sapiens
catttctgaagctccc

SEQ ID NO: 71900 - DNA, 16 bp, H. sapiens
catttctgaattattt

SEQ ID NO: 71901 - DNA, 16 bp, H. sapiens
catttctgactttatc

SEQ ID NO: 71902 - DNA, 16 bp, H. sapiens
catttctgatatttta

SEQ ID NO: 71903 - DNA, 16 bp, H. sapiens
catttctgatgaccag

SEQ ID NO: 71904 - DNA, 16 bp, H. sapiens
catttctgattatttc

SEQ ID NO: 71905 - DNA, 16 bp, H. sapiens
catttctgatttattt

SEQ ID NO: 71906 - DNA, 16 bp, H. sapiens
catttctgatttcatt

SEQ ID NO: 71907 - DNA, 16 bp, H. sapiens
catttctgcttctctg

SEQ ID NO: 71908 - DNA, 16 bp, H. sapiens
catttctggaattttc

SEQ ID NO: 71909 - DNA, 16 bp, H. sapiens
catttctggctgggca

SEQ ID NO: 71910 - DNA, 16 bp, H. sapiens
catttctgtaagtgtg

SEQ ID NO: 71911 - DNA, 16 bp, H. sapiens
catttctgttatttct

SEQ ID NO: 71912 - DNA, 16 bp, H. sapiens
catttctgttgttcat

SEQ ID NO: 71913 - DNA, 16 bp, H. sapiens
catttctgtttataaa

SEQ ID NO: 71914 - DNA, 16 bp, H. sapiens
catttctgtttattat

SEQ ID NO: 71915 - DNA, 16 bp, H. sapiens
catttcttcagtgttt

SEQ ID NO: 71916 - DNA, 16 bp, H. sapiens
catttcttccattctg

SEQ ID NO: 71917 - DNA, 16 bp, H. sapiens
catttcttccctgctg

SEQ ID NO: 71918 - DNA, 16 bp, H. sapiens
catttcttcttaaaaa

SEQ ID NO: 71919 - DNA, 16 bp, H. sapiens
catttcttggttttgt

SEQ ID NO: 71920 - DNA, 16 bp, H. sapiens
catttctttaacaaat

SEQ ID NO: 71921 - DNA, 16 bp, H. sapiens
catttctttcattgtt

SEQ ID NO: 71922 - DNA, 16 bp, H. sapiens
catttctttctgcttt

SEQ ID NO: 71923 - DNA, 16 bp, H. sapiens
catttctttctgtctt

SEQ ID NO: 71924 - DNA, 16 bp, H. sapiens
catttctttgctcctg

SEQ ID NO: 71925 - DNA, 16 bp, H. sapiens
catttctttgtgttgg

SEQ ID NO: 71926 - DNA, 16 bp, H. sapiens
catttcttttggaaga

SEQ ID NO: 71927 - DNA, 16 bp, H. sapiens
catttgaaaaaatgtt

SEQ ID NO: 71928 - DNA, 16 bp, H. sapiens
catttgaaaaatttaa

SEQ ID NO: 71929 - DNA, 16 bp, H. sapiens
catttgaaaataaaat

SEQ ID NO: 71930 - DNA, 16 bp, H. sapiens
catttgaaaatatttt

SEQ ID NO: 71931 - DNA, 16 bp, H. sapiens
catttgaaaatcagtt

SEQ ID NO: 71932 - DNA, 16 bp, H. sapiens
catttgaaagaaagaa

SEQ ID NO: 71933 - DNA, 16 bp, H. sapiens
catttgaaagtaaatt

SEQ ID NO: 71934 - DNA, 16 bp, H. sapiens
catttgaaatatttat

SEQ ID NO: 71935 - DNA, 16 bp, H. sapiens
catttgaacctaggag

SEQ ID NO: 71936 - DNA, 16 bp, H. sapiens
catttgaagatgaaaa

SEQ ID NO: 71937 - DNA, 16 bp, H. sapiens
catttgaagcaaattg

SEQ ID NO: 71938 - DNA, 16 bp, H. sapiens
catttgaatgtcttct

SEQ ID NO: 71939 - DNA, 16 bp, H. sapiens
catttgaattaatttt

SEQ ID NO: 71940 - DNA, 16 bp, H. sapiens
catttgaattggtaga

SEQ ID NO: 71941 - DNA, 16 bp, H. sapiens
catttgaatttcaaat

SEQ ID NO: 71942 - DNA, 16 bp, H. sapiens
catttgacaaaatcca

SEQ ID NO: 71943 - DNA, 16 bp, H. sapiens
catttgacctggcaat

SEQ ID NO: 71944 - DNA, 16 bp, H. sapiens
catttgagaaaataaa

SEQ ID NO: 71945 - DNA, 16 bp, H. sapiens
catttgagagaaaaaa

SEQ ID NO: 71946 - DNA, 16 bp, H. sapiens
catttgagttaatttt

SEQ ID NO: 71947 - DNA, 16 bp, H. sapiens
catttgataaaatcca

SEQ ID NO: 71948 - DNA, 16 bp, H. sapiens
catttgatccagaaat

SEQ ID NO: 71949 - DNA, 16 bp, H. sapiens
catttgatcttcacag

SEQ ID NO: 71950 - DNA, 16 bp, H. sapiens
catttgatcttttcat

SEQ ID NO: 71951 - DNA, 16 bp, H. sapiens
catttgatgttgtcag

SEQ ID NO: 71952 - DNA, 16 bp, H. sapiens
catttgatttatttat

SEQ ID NO: 71953 - DNA, 16 bp, H. sapiens
catttgcaaaatggaa

SEQ ID NO: 71954 - DNA, 16 bp, H. sapiens
catttgcaaaatggag

SEQ ID NO: 71955 - DNA, 16 bp, H. sapiens
catttgcaaaatggga

SEQ ID NO: 71956 - DNA, 16 bp, H. sapiens
catttgcagaaaactg

SEQ ID NO: 71957 - DNA, 16 bp, H. sapiens
catttgcattttttaa

SEQ ID NO: 71958 - DNA, 16 bp, H. sapiens
catttgccaagtcagt

SEQ ID NO: 71959 - DNA, 16 bp, H. sapiens
catttgctatttgttt

SEQ ID NO: 71960 - DNA, 16 bp, H. sapiens
catttgctcacttttt

SEQ ID NO: 71961 - DNA, 16 bp, H. sapiens
catttgctctctctct

SEQ ID NO: 71962 - DNA, 16 bp, H. sapiens
catttgcttagtaaat

SEQ ID NO: 71963 - DNA, 16 bp, H. sapiens
catttgcttttcaaaa

SEQ ID NO: 71964 - DNA, 16 bp, H. sapiens
catttggaaaaaaaaa

SEQ ID NO: 71965 - DNA, 16 bp, H. sapiens
catttggaagagaaga

SEQ ID NO: 71966 - DNA, 16 bp, H. sapiens
catttggaatttttaa

SEQ ID NO: 71967 - DNA, 16 bp, H. sapiens
catttggatgtctttt

SEQ ID NO: 71968 - DNA, 16 bp, H. sapiens
catttggcaaatattt

SEQ ID NO: 71969 - DNA, 16 bp, H. sapiens
catttggcccctccta

SEQ ID NO: 71970 - DNA, 16 bp, H. sapiens
catttggctccttttt

SEQ ID NO: 71971 - DNA, 16 bp, H. sapiens
catttggctctttgtt

SEQ ID NO: 71972 - DNA, 16 bp, H. sapiens
catttgggttgcttct

SEQ ID NO: 71973 - DNA, 16 bp, H. sapiens
catttggttggttcca

SEQ ID NO: 71974 - DNA, 16 bp, H. sapiens
catttggtttattgat

SEQ ID NO: 71975 - DNA, 16 bp, H. sapiens
catttggttttctgtt

SEQ ID NO: 71976 - DNA, 16 bp, H. sapiens
catttgtaaaatggga

SEQ ID NO: 71977 - DNA, 16 bp, H. sapiens
catttgtaaaatgggg

SEQ ID NO: 71978 - DNA, 16 bp, H. sapiens
catttgtaaaatgtaa

SEQ ID NO: 71979 - DNA, 16 bp, H. sapiens
catttgtaaactgctg

SEQ ID NO: 71980 - DNA, 16 bp, H. sapiens
catttgtaattcatgg

SEQ ID NO: 71981 - DNA, 16 bp, H. sapiens
catttgtaatttttaa

SEQ ID NO: 71982 - DNA, 16 bp, H. sapiens
catttgtacattttct

SEQ ID NO: 71983 - DNA, 16 bp, H. sapiens
catttgtacattttta

SEQ ID NO: 71984 - DNA, 16 bp, H. sapiens
catttgtatacatgtg

SEQ ID NO: 71985 - DNA, 16 bp, H. sapiens
catttgtatttaattt

SEQ ID NO: 71986 - DNA, 16 bp, H. sapiens
catttgtatttgtatt

SEQ ID NO: 71987 - DNA, 16 bp, H. sapiens
catttgtatttttaaa

SEQ ID NO: 71988 - DNA, 16 bp, H. sapiens
catttgtcaattttgc

SEQ ID NO: 71989 - DNA, 16 bp, H. sapiens
catttgtccaaaccca

SEQ ID NO: 71990 - DNA, 16 bp, H. sapiens
catttgtccttttgtg

SEQ ID NO: 71991 - DNA, 16 bp, H. sapiens
catttgtcttttaaat

SEQ ID NO: 71992 - DNA, 16 bp, H. sapiens
catttgtctttttggt

SEQ ID NO: 71993 - DNA, 16 bp, H. sapiens
catttgtggaaaaatt

SEQ ID NO: 71994 - DNA, 16 bp, H. sapiens
catttgtggctgactt

SEQ ID NO: 71995 - DNA, 16 bp, H. sapiens
catttgtgtacagatt

SEQ ID NO: 71996 - DNA, 16 bp, H. sapiens
catttgtgtatttttg

SEQ ID NO: 71997 - DNA, 16 bp, H. sapiens
catttgtgttttttaa

SEQ ID NO: 71998 - DNA, 16 bp, H. sapiens
catttgttaaagaaaa

SEQ ID NO: 71999 - DNA, 16 bp, H. sapiens
catttgttcattaatt

SEQ ID NO: 72000 - DNA, 16 bp, H. sapiens
catttgttcattgctg

SEQ ID NO: 72001 - DNA, 16 bp, H. sapiens
catttgttgaaaaaaa

SEQ ID NO: 72002 - DNA, 16 bp, H. sapiens
catttgttgaaaagtt

SEQ ID NO: 72003 - DNA, 16 bp, H. sapiens
catttgttgagcactt

SEQ ID NO: 72004 - DNA, 16 bp, H. sapiens
catttgttgtccccta

SEQ ID NO: 72005 - DNA, 16 bp, H. sapiens
catttgtttacatatt

SEQ ID NO: 72006 - DNA, 16 bp, H. sapiens
catttgtttacatgtt

SEQ ID NO: 72007 - DNA, 16 bp, H. sapiens
catttgtttatgttgt

SEQ ID NO: 72008 - DNA, 16 bp, H. sapiens
catttgtttccagttt

SEQ ID NO: 72009 - DNA, 16 bp, H. sapiens
catttgtttctcacag

SEQ ID NO: 72010 - DNA, 16 bp, H. sapiens
catttgtttgtgcctt

SEQ ID NO: 72011 - DNA, 16 bp, H. sapiens
cattttaaaaaatctt

SEQ ID NO: 72012 - DNA, 16 bp, H. sapiens
cattttaaaaaattgg

SEQ ID NO: 72013 - DNA, 16 bp, H. sapiens
cattttaaaaagagaa

SEQ ID NO: 72014 - DNA, 16 bp, H. sapiens
cattttaaaaagtatt

SEQ ID NO: 72015 - DNA, 16 bp, H. sapiens
cattttaaaaatacat

SEQ ID NO: 72016 - DNA, 16 bp, H. sapiens
cattttaaaaatgaac

SEQ ID NO: 72017 - DNA, 16 bp, H. sapiens
cattttaaaaatgttt

SEQ ID NO: 72018 - DNA, 16 bp, H. sapiens
cattttaaaaattgtt

SEQ ID NO: 72019 - DNA, 16 bp, H. sapiens
cattttaaaactattt

SEQ ID NO: 72020 - DNA, 16 bp, H. sapiens
cattttaaaagaattt

SEQ ID NO: 72021 - DNA, 16 bp, H. sapiens
cattttaaaagatgaa

SEQ ID NO: 72022 - DNA, 16 bp, H. sapiens
cattttaaaagttaaa

SEQ ID NO: 72023 - DNA, 16 bp, H. sapiens
cattttaaaataacta

SEQ ID NO: 72024 - DNA, 16 bp, H. sapiens
cattttaaaatctgaa

SEQ ID NO: 72025 - DNA, 16 bp, H. sapiens
cattttaaaatgttat

SEQ ID NO: 72026 - DNA, 16 bp, H. sapiens
cattttaaaattagat

SEQ ID NO: 72027 - DNA, 16 bp, H. sapiens
cattttaaaattaggt

SEQ ID NO: 72028 - DNA, 16 bp, H. sapiens
cattttaaacaaacaa

SEQ ID NO: 72029 - DNA, 16 bp, H. sapiens
cattttaaacaaatca

SEQ ID NO: 72030 - DNA, 16 bp, H. sapiens
cattttaaagacaaaa

SEQ ID NO: 72031 - DNA, 16 bp, H. sapiens
cattttaaagacattt

SEQ ID NO: 72032 - DNA, 16 bp, H. sapiens
cattttaaaggaaaaa

SEQ ID NO: 72033 - DNA, 16 bp, H. sapiens
cattttaaaggctgaa

SEQ ID NO: 72034 - DNA, 16 bp, H. sapiens
cattttaaagtaacta

SEQ ID NO: 72035 - DNA, 16 bp, H. sapiens
cattttaaagtatata

SEQ ID NO: 72036 - DNA, 16 bp, H. sapiens
cattttaaatatcaat

SEQ ID NO: 72037 - DNA, 16 bp, H. sapiens
cattttaaatatgaag

SEQ ID NO: 72038 - DNA, 16 bp, H. sapiens
cattttaaatatgtca

SEQ ID NO: 72039 - DNA, 16 bp, H. sapiens
cattttaaatatttga

SEQ ID NO: 72040 - DNA, 16 bp, H. sapiens
cattttaaatgaattt

SEQ ID NO: 72041 - DNA, 16 bp, H. sapiens
cattttaaatgagaaa

SEQ ID NO: 72042 - DNA, 16 bp, H. sapiens
cattttaaatgatttt

SEQ ID NO: 72043 - DNA, 16 bp, H. sapiens
cattttaaatggcaaa

SEQ ID NO: 72044 - DNA, 16 bp, H. sapiens
cattttaaatgtcatt

SEQ ID NO: 72045 - DNA, 16 bp, H. sapiens
cattttaaccaggcat

SEQ ID NO: 72046 - DNA, 16 bp, H. sapiens
cattttaaccatcttt

SEQ ID NO: 72047 - DNA, 16 bp, H. sapiens
cattttaactggcatg

SEQ ID NO: 72048 - DNA, 16 bp, H. sapiens
cattttaacttttaaa

SEQ ID NO: 72049 - DNA, 16 bp, H. sapiens
cattttaagaaaactt

SEQ ID NO: 72050 - DNA, 16 bp, H. sapiens
cattttaagaaagaac

SEQ ID NO: 72051 - DNA, 16 bp, H. sapiens
cattttaagaaatctt

SEQ ID NO: 72052 - DNA, 16 bp, H. sapiens
cattttaagaggctga

SEQ ID NO: 72053 - DNA, 16 bp, H. sapiens
cattttaagtaatttt

SEQ ID NO: 72054 - DNA, 16 bp, H. sapiens
cattttaatagaaaaa

SEQ ID NO: 72055 - DNA, 16 bp, H. sapiens
cattttaatgaaaaat

SEQ ID NO: 72056 - DNA, 16 bp, H. sapiens
cattttaatgatattg

SEQ ID NO: 72057 - DNA, 16 bp, H. sapiens
cattttaatgtgcatt

SEQ ID NO: 72058 - DNA, 16 bp, H. sapiens
cattttaattagaaaa

SEQ ID NO: 72059 - DNA, 16 bp, H. sapiens
cattttaatttagaaa

SEQ ID NO: 72060 - DNA, 16 bp, H. sapiens
cattttaatttgtgtt

SEQ ID NO: 72061 - DNA, 16 bp, H. sapiens
cattttacaaaagaaa

SEQ ID NO: 72062 - DNA, 16 bp, H. sapiens
cattttacaagaaaat

SEQ ID NO: 72063 - DNA, 16 bp, H. sapiens
cattttacaggtgaga

SEQ ID NO: 72064 - DNA, 16 bp, H. sapiens
cattttacattgccac

SEQ ID NO: 72065 - DNA, 16 bp, H. sapiens
cattttacattttaaa

SEQ ID NO: 72066 - DNA, 16 bp, H. sapiens
cattttaccaaaaaaa

SEQ ID NO: 72067 - DNA, 16 bp, H. sapiens
cattttactgatggag

SEQ ID NO: 72068 - DNA, 16 bp, H. sapiens
cattttactttaaaaa

SEQ ID NO: 72069 - DNA, 16 bp, H. sapiens
cattttagaaaatgaa

SEQ ID NO: 72070 - DNA, 16 bp, H. sapiens
cattttagaaaatgtt

SEQ ID NO: 72071 - DNA, 16 bp, H. sapiens
cattttagaaatattt

SEQ ID NO: 72072 - DNA, 16 bp, H. sapiens
cattttagagatggag

SEQ ID NO: 72073 - DNA, 16 bp, H. sapiens
cattttagataaggga

SEQ ID NO: 72074 - DNA, 16 bp, H. sapiens
cattttagtcatttta

SEQ ID NO: 72075 - DNA, 16 bp, H. sapiens
cattttagtttagttt

SEQ ID NO: 72076 - DNA, 16 bp, H. sapiens
cattttagttttaatt

SEQ ID NO: 72077 - DNA, 16 bp, H. sapiens
cattttataaaaattg

SEQ ID NO: 72078 - DNA, 16 bp, H. sapiens
cattttataaacatat

SEQ ID NO: 72079 - DNA, 16 bp, H. sapiens
cattttataactgaaa

SEQ ID NO: 72080 - DNA, 16 bp, H. sapiens
cattttataagaaaaa

SEQ ID NO: 72081 - DNA, 16 bp, H. sapiens
cattttatagagaaaa

SEQ ID NO: 72082 - DNA, 16 bp, H. sapiens
cattttatagattaga

SEQ ID NO: 72083 - DNA, 16 bp, H. sapiens
cattttatatcaggga

SEQ ID NO: 72084 - DNA, 16 bp, H. sapiens
cattttatatttgtgt

SEQ ID NO: 72085 - DNA, 16 bp, H. sapiens
cattttatcaaaataa

SEQ ID NO: 72086 - DNA, 16 bp, H. sapiens
cattttatctgaattt

SEQ ID NO: 72087 - DNA, 16 bp, H. sapiens
cattttatcttaaaaa

SEQ ID NO: 72088 - DNA, 16 bp, H. sapiens
cattttatgaaaaaga

SEQ ID NO: 72089 - DNA, 16 bp, H. sapiens
cattttatggaaaata

SEQ ID NO: 72090 - DNA, 16 bp, H. sapiens
cattttatgtaagaga

SEQ ID NO: 72091 - DNA, 16 bp, H. sapiens
cattttatgtgtttat

SEQ ID NO: 72092 - DNA, 16 bp, H. sapiens
cattttatgttaattt

SEQ ID NO: 72093 - DNA, 16 bp, H. sapiens
cattttattaaaagaa

SEQ ID NO: 72094 - DNA, 16 bp, H. sapiens
cattttattaagaaaa

SEQ ID NO: 72095 - DNA, 16 bp, H. sapiens
cattttattaggccag

SEQ ID NO: 72096 - DNA, 16 bp, H. sapiens
cattttattatgaaaa

SEQ ID NO: 72097 - DNA, 16 bp, H. sapiens
cattttattatggctt

SEQ ID NO: 72098 - DNA, 16 bp, H. sapiens
cattttattattgtta

SEQ ID NO: 72099 - DNA, 16 bp, H. sapiens
cattttattcctaaat

SEQ ID NO: 72100 - DNA, 16 bp, H. sapiens
cattttattgatgaaa

SEQ ID NO: 72101 - DNA, 16 bp, H. sapiens
cattttattgcaatat

SEQ ID NO: 72102 - DNA, 16 bp, H. sapiens
cattttattgctgagt

SEQ ID NO: 72103 - DNA, 16 bp, H. sapiens
cattttatttcagttt

SEQ ID NO: 72104 - DNA, 16 bp, H. sapiens
cattttatttcatgta

SEQ ID NO: 72105 - DNA, 16 bp, H. sapiens
cattttatttgcaaaa

SEQ ID NO: 72106 - DNA, 16 bp, H. sapiens
cattttcaaaagcaaa

SEQ ID NO: 72107 - DNA, 16 bp, H. sapiens
cattttcaaactacag

SEQ ID NO: 72108 - DNA, 16 bp, H. sapiens
cattttcaaagataaa

SEQ ID NO: 72109 - DNA, 16 bp, H. sapiens
cattttcaaagtgctg

SEQ ID NO: 72110 - DNA, 16 bp, H. sapiens
cattttcaaataacta

SEQ ID NO: 72111 - DNA, 16 bp, H. sapiens
cattttcaaataattt

SEQ ID NO: 72112 - DNA, 16 bp, H. sapiens
cattttcaaattttaa

SEQ ID NO: 72113 - DNA, 16 bp, H. sapiens
cattttcaacattttt

SEQ ID NO: 72114 - DNA, 16 bp, H. sapiens
cattttcaagctgctg

SEQ ID NO: 72115 - DNA, 16 bp, H. sapiens
cattttcaagtgtaca

SEQ ID NO: 72116 - DNA, 16 bp, H. sapiens
cattttcaataaatat

SEQ ID NO: 72117 - DNA, 16 bp, H. sapiens
cattttcaataaatct

SEQ ID NO: 72118 - DNA, 16 bp, H. sapiens
cattttcaattaaaaa

SEQ ID NO: 72119 - DNA, 17 bp, H. sapiens
cattttcacaatattga

SEQ ID NO: 72120 - DNA, 16 bp, H. sapiens
cattttcacttttaaa

SEQ ID NO: 72121 - DNA, 16 bp, H. sapiens
cattttcagaagagga

SEQ ID NO: 72122 - DNA, 16 bp, H. sapiens
cattttcagtatttct

SEQ ID NO: 72123 - DNA, 16 bp, H. sapiens
cattttcataaatatt

SEQ ID NO: 72124 - DNA, 16 bp, H. sapiens
cattttcataatgatt

SEQ ID NO: 72125 - DNA, 16 bp, H. sapiens
cattttcatactgctg

SEQ ID NO: 72126 - DNA, 16 bp, H. sapiens
cattttcatatgaatt

SEQ ID NO: 72127 - DNA, 16 bp, H. sapiens
cattttcatattgcta

SEQ ID NO: 72128 - DNA, 16 bp, H. sapiens
cattttcatcagcaca

SEQ ID NO: 72129 - DNA, 16 bp, H. sapiens
cattttcatcatgaaa

SEQ ID NO: 72130 - DNA, 16 bp, H. sapiens
cattttcatgctgctg

SEQ ID NO: 72131 - DNA, 16 bp, H. sapiens
cattttcatgtatttg

SEQ ID NO: 72132 - DNA, 16 bp, H. sapiens
cattttcattatccaa

SEQ ID NO: 72133 - DNA, 16 bp, H. sapiens
cattttcattctctta

SEQ ID NO: 72134 - DNA, 16 bp, H. sapiens
cattttcatttcactt

SEQ ID NO: 72135 - DNA, 16 bp, H. sapiens
cattttcatttccatt

SEQ ID NO: 72136 - DNA, 16 bp, H. sapiens
cattttcatttctaat

SEQ ID NO: 72137 - DNA, 16 bp, H. sapiens
cattttcatttctgat

SEQ ID NO: 72138 - DNA, 16 bp, H. sapiens
cattttcattttgcac

SEQ ID NO: 72139 - DNA, 16 bp, H. sapiens
cattttccaaataaag

SEQ ID NO: 72140 - DNA, 16 bp, H. sapiens
cattttccaaataatt

SEQ ID NO: 72141 - DNA, 16 bp, H. sapiens
cattttccagagtttt

SEQ ID NO: 72142 - DNA, 16 bp, H. sapiens
cattttccaggacaga

SEQ ID NO: 72143 - DNA, 16 bp, H. sapiens
cattttccaggtgaag

SEQ ID NO: 72144 - DNA, 16 bp, H. sapiens
cattttccatttccat

SEQ ID NO: 72145 - DNA, 16 bp, H. sapiens
cattttcccaaagaag

SEQ ID NO: 72146 - DNA, 16 bp, H. sapiens
cattttccccaaaata

SEQ ID NO: 72147 - DNA, 16 bp, H. sapiens
cattttccctttgaaa

SEQ ID NO: 72148 - DNA, 16 bp, H. sapiens
cattttcctaagtgaa

SEQ ID NO: 72149 - DNA, 16 bp, H. sapiens
cattttcctcatctgc

SEQ ID NO: 72150 - DNA, 16 bp, H. sapiens
cattttcctcatttta

SEQ ID NO: 72151 - DNA, 16 bp, H. sapiens
cattttcctctgcttt

SEQ ID NO: 72152 - DNA, 16 bp, H. sapiens
cattttcctgtcttca

SEQ ID NO: 72153 - DNA, 16 bp, H. sapiens
cattttcctgtttctt

SEQ ID NO: 72154 - DNA, 16 bp, H. sapiens
cattttccttagcaaa

SEQ ID NO: 72155 - DNA, 16 bp, H. sapiens
cattttccttctgtct

SEQ ID NO: 72156 - DNA, 16 bp, H. sapiens
cattttccttgttttc

SEQ ID NO: 72157 - DNA, 16 bp, H. sapiens
cattttctaacaaaga

SEQ ID NO: 72158 - DNA, 16 bp, H. sapiens
cattttctagaatttt

SEQ ID NO: 72159 - DNA, 16 bp, H. sapiens
cattttctagctgtgt

SEQ ID NO: 72160 - DNA, 16 bp, H. sapiens
cattttctcagcattt

SEQ ID NO: 72161 - DNA, 16 bp, H. sapiens
cattttctcatgtgtt

SEQ ID NO: 72162 - DNA, 16 bp, H. sapiens
cattttctcatttgtt

SEQ ID NO: 72163 - DNA, 16 bp, H. sapiens
cattttctctgtattt

SEQ ID NO: 72164 - DNA, 16 bp, H. sapiens
cattttctcttaaaaa

SEQ ID NO: 72165 - DNA, 16 bp, H. sapiens
cattttctcttgccac

SEQ ID NO: 72166 - DNA, 16 bp, H. sapiens
cattttctctttaaaa

SEQ ID NO: 72167 - DNA, 16 bp, H. sapiens
cattttctgaggagga

SEQ ID NO: 72168 - DNA, 16 bp, H. sapiens
cattttctggggaaaa

SEQ ID NO: 72169 - DNA, 16 bp, H. sapiens
cattttctgtttttaa

SEQ ID NO: 72170 - DNA, 16 bp, H. sapiens
cattttcttaaaataa

SEQ ID NO: 72171 - DNA, 16 bp, H. sapiens
cattttcttaatccaa

SEQ ID NO: 72172 - DNA, 16 bp, H. sapiens
cattttcttcagtttt

SEQ ID NO: 72173 - DNA, 16 bp, H. sapiens
cattttcttccaaata

SEQ ID NO: 72174 - DNA, 16 bp, H. sapiens
cattttcttctcaaaa

SEQ ID NO: 72175 - DNA, 16 bp, H. sapiens
cattttcttctgcttt

SEQ ID NO: 72176 - DNA, 16 bp, H. sapiens
cattttctttaaaata

SEQ ID NO: 72177 - DNA, 16 bp, H. sapiens
cattttctttatttag

SEQ ID NO: 72178 - DNA, 16 bp, H. sapiens
cattttctttgattct

SEQ ID NO: 72179 - DNA, 16 bp, H. sapiens
cattttcttttgggtt

SEQ ID NO: 72180 - DNA, 16 bp, H. sapiens
cattttctttttccag

SEQ ID NO: 72181 - DNA, 16 bp, H. sapiens
cattttgaaaaacact

SEQ ID NO: 72182 - DNA, 16 bp, H. sapiens
cattttgaaaaacagt

SEQ ID NO: 72183 - DNA, 16 bp, H. sapiens
cattttgaaaaggaaa

SEQ ID NO: 72184 - DNA, 16 bp, H. sapiens
cattttgaaaataaaa

SEQ ID NO: 72185 - DNA, 16 bp, H. sapiens
cattttgaaaatgttt

SEQ ID NO: 72186 - DNA, 16 bp, H. sapiens
cattttgaaacaaaaa

SEQ ID NO: 72187 - DNA, 16 bp, H. sapiens
cattttgaattcattt

SEQ ID NO: 72188 - DNA, 16 bp, H. sapiens
cattttgagttagttt

SEQ ID NO: 72189 - DNA, 16 bp, H. sapiens
cattttgatttgattt

SEQ ID NO: 72190 - DNA, 16 bp, H. sapiens
cattttgatttgtatt

SEQ ID NO: 72191 - DNA, 16 bp, H. sapiens
cattttgattttaatt

SEQ ID NO: 72192 - DNA, 16 bp, H. sapiens
cattttgatttttaaa

SEQ ID NO: 72193 - DNA, 16 bp, H. sapiens
cattttgcaaatgaag

SEQ ID NO: 72194 - DNA, 16 bp, H. sapiens
cattttgcaagatgaa

SEQ ID NO: 72195 - DNA, 16 bp, H. sapiens
cattttgcactgggcc

SEQ ID NO: 72196 - DNA, 16 bp, H. sapiens
cattttgctttttaaa

SEQ ID NO: 72197 - DNA, 16 bp, H. sapiens
cattttggaaaaaaaa

SEQ ID NO: 72198 - DNA, 16 bp, H. sapiens
cattttggaaaaataa

SEQ ID NO: 72199 - DNA, 16 bp, H. sapiens
cattttggaaaacatt

SEQ ID NO: 72200 - DNA, 16 bp, H. sapiens
cattttggaaaatatt

SEQ ID NO: 72201 - DNA, 16 bp, H. sapiens
cattttggaagacagt

SEQ ID NO: 72202 - DNA, 16 bp, H. sapiens
cattttggatttggga

SEQ ID NO: 72203 - DNA, 16 bp, H. sapiens
cattttggattttgga

SEQ ID NO: 72204 - DNA, 16 bp, H. sapiens
cattttggccaggctc

SEQ ID NO: 72205 - DNA, 16 bp, H. sapiens
cattttgggaaatgct

SEQ ID NO: 72206 - DNA, 16 bp, H. sapiens
cattttgggggacaca

SEQ ID NO: 72207 - DNA, 16 bp, H. sapiens
cattttggtcacaatc

SEQ ID NO: 72208 - DNA, 16 bp, H. sapiens
cattttgtaaaataaa

SEQ ID NO: 72209 - DNA, 16 bp, H. sapiens
cattttgtaatatttt

SEQ ID NO: 72210 - DNA, 16 bp, H. sapiens
cattttgtaattttca

SEQ ID NO: 72211 - DNA, 16 bp, H. sapiens
cattttgtagatgaaa

SEQ ID NO: 72212 - DNA, 16 bp, H. sapiens
cattttgtattttgaa

SEQ ID NO: 72213 - DNA, 16 bp, H. sapiens
cattttgtctactttt

SEQ ID NO: 72214 - DNA, 16 bp, H. sapiens
cattttgtgaaagaaa

SEQ ID NO: 72215 - DNA, 16 bp, H. sapiens
cattttgtgttgctgt

SEQ ID NO: 72216 - DNA, 16 bp, H. sapiens
cattttgttaattgtt

SEQ ID NO: 72217 - DNA, 37 bp, H. sapiens
cattttgttctgtactaagaaaaattcttctgccttg

SEQ ID NO: 72218 - DNA, 16 bp, H. sapiens
cattttgttgtttcta

SEQ ID NO: 72219 - DNA, 16 bp, H. sapiens
cattttgtttcattta

SEQ ID NO: 72220 - DNA, 16 bp, H. sapiens
cattttgtttctccca

SEQ ID NO: 72221 - DNA, 16 bp, H. sapiens
cattttgtttttgaaa

SEQ ID NO: 72222 - DNA, 16 bp, H. sapiens
catttttaaaaaactt

SEQ ID NO: 72223 - DNA, 16 bp, H. sapiens
catttttaaaaatcat

SEQ ID NO: 72224 - DNA, 16 bp, H. sapiens
catttttaaaacaaat

SEQ ID NO: 72225 - DNA, 16 bp, H. sapiens
catttttaaaagtata

SEQ ID NO: 72226 - DNA, 16 bp, H. sapiens
catttttaaaatcatt

SEQ ID NO: 72227 - DNA, 16 bp, H. sapiens
catttttaaagaaaat

SEQ ID NO: 72228 - DNA, 16 bp, H. sapiens
catttttaaagaaatg

SEQ ID NO: 72229 - DNA, 16 bp, H. sapiens
catttttaaagacatt

SEQ ID NO: 72230 - DNA, 16 bp, H. sapiens
catttttaaagataat

SEQ ID NO: 72231 - DNA, 16 bp, H. sapiens
catttttaaaggattt

SEQ ID NO: 72232 - DNA, 16 bp, H. sapiens
catttttaaatcagat

SEQ ID NO: 72233 - DNA, 16 bp, H. sapiens
catttttaacaaaaca

SEQ ID NO: 72234 - DNA, 16 bp, H. sapiens
catttttaacaagctc

SEQ ID NO: 72235 - DNA, 16 bp, H. sapiens
catttttaagtttgat

SEQ ID NO: 72236 - DNA, 16 bp, H. sapiens
catttttaagttttat

SEQ ID NO: 72237 - DNA, 16 bp, H. sapiens
catttttaatattttg

SEQ ID NO: 72238 - DNA, 16 bp, H. sapiens
catttttaattagatt

SEQ ID NO: 72239 - DNA, 16 bp, H. sapiens
catttttaatttatgt

SEQ ID NO: 72240 - DNA, 16 bp, H. sapiens
catttttacaatattg

SEQ ID NO: 72241 - DNA, 16 bp, H. sapiens
catttttacaccaaat

SEQ ID NO: 72242 - DNA, 16 bp, H. sapiens
catttttactgtaaat

SEQ ID NO: 72243 - DNA, 16 bp, H. sapiens
catttttactgtattt

SEQ ID NO: 72244 - DNA, 16 bp, H. sapiens
catttttacttgaaaa

SEQ ID NO: 72245 - DNA, 16 bp, H. sapiens
catttttagaaatatt

SEQ ID NO: 72246 - DNA, 16 bp, H. sapiens
catttttagtagaaac

SEQ ID NO: 72247 - DNA, 17 bp, H. sapiens
catttttagtagagacg

SEQ ID NO: 72248 - DNA, 24 bp, H. sapiens
catttttagtagagacggggtttt

SEQ ID NO: 72249 - DNA, 16 bp, H. sapiens
catttttagtagagat

SEQ ID NO: 72250 - DNA, 16 bp, H. sapiens
catttttagtggagat

SEQ ID NO: 72251 - DNA, 16 bp, H. sapiens
catttttataaaactt

SEQ ID NO: 72252 - DNA, 16 bp, H. sapiens
catttttatacaccaa

SEQ ID NO: 72253 - DNA, 16 bp, H. sapiens
catttttatagttatt

SEQ ID NO: 72254 - DNA, 16 bp, H. sapiens
catttttatatgtaat

SEQ ID NO: 72255 - DNA, 16 bp, H. sapiens
catttttatgatattg

SEQ ID NO: 72256 - DNA, 16 bp, H. sapiens
catttttatgcttatt

SEQ ID NO: 72257 - DNA, 16 bp, H. sapiens
catttttattgttgta

SEQ ID NO: 72258 - DNA, 16 bp, H. sapiens
catttttatttaaaag

SEQ ID NO: 72259 - DNA, 16 bp, H. sapiens
catttttatttgtaaa

SEQ ID NO: 72260 - DNA, 16 bp, H. sapiens
catttttatttttgaa

SEQ ID NO: 72261 - DNA, 16 bp, H. sapiens
catttttcaaaatgta

SEQ ID NO: 72262 - DNA, 16 bp, H. sapiens
catttttcaaagaaat

SEQ ID NO: 72263 - DNA, 16 bp, H. sapiens
catttttcaaataaaa

SEQ ID NO: 72264 - DNA, 16 bp, H. sapiens
catttttcaagagaaa

SEQ ID NO: 72265 - DNA, 16 bp, H. sapiens
catttttcacatttgt

SEQ ID NO: 72266 - DNA, 16 bp, H. sapiens
catttttcacctatca

SEQ ID NO: 72267 - DNA, 16 bp, H. sapiens
catttttcagagaaaa

SEQ ID NO: 72268 - DNA, 16 bp, H. sapiens
catttttcagataaaa

SEQ ID NO: 72269 - DNA, 16 bp, H. sapiens
catttttcagctccca

SEQ ID NO: 72270 - DNA, 16 bp, H. sapiens
catttttcatatgttt

SEQ ID NO: 72271 - DNA, 16 bp, H. sapiens
catttttcatgatttt

SEQ ID NO: 72272 - DNA, 16 bp, H. sapiens
catttttcatgtgctt

SEQ ID NO: 72273 - DNA, 16 bp, H. sapiens
catttttcattctcac

SEQ ID NO: 72274 - DNA, 16 bp, H. sapiens
catttttcattgcatc

SEQ ID NO: 72275 - DNA, 16 bp, H. sapiens
catttttccaaagaaa

SEQ ID NO: 72276 - DNA, 16 bp, H. sapiens
catttttccagaaaaa

SEQ ID NO: 72277 - DNA, 16 bp, H. sapiens
catttttcctaatttg

SEQ ID NO: 72278 - DNA, 16 bp, H. sapiens
catttttcctatgttt

SEQ ID NO: 72279 - DNA, 16 bp, H. sapiens
catttttcctgtttct

SEQ ID NO: 72280 - DNA, 16 bp, H. sapiens
catttttccttttcag

SEQ ID NO: 72281 - DNA, 16 bp, H. sapiens
catttttctaaagtaa

SEQ ID NO: 72282 - DNA, 16 bp, H. sapiens
catttttctaaattct

SEQ ID NO: 72283 - DNA, 16 bp, H. sapiens
catttttctaatgatt

SEQ ID NO: 72284 - DNA, 16 bp, H. sapiens
catttttctcatttgt

SEQ ID NO: 72285 - DNA, 16 bp, H. sapiens
catttttctcttgcca

SEQ ID NO: 72286 - DNA, 16 bp, H. sapiens
catttttctgatgatc

SEQ ID NO: 72287 - DNA, 16 bp, H. sapiens
catttttctgcctgct

SEQ ID NO: 72288 - DNA, 16 bp, H. sapiens
catttttctggggaga

SEQ ID NO: 72289 - DNA, 16 bp, H. sapiens
catttttcttactgat

SEQ ID NO: 72290 - DNA, 16 bp, H. sapiens
catttttctttaaaaa

SEQ ID NO: 72291 - DNA, 16 bp, H. sapiens
catttttctttcatgt

SEQ ID NO: 72292 - DNA, 16 bp, H. sapiens
catttttctttgaaaa

SEQ ID NO: 72293 - DNA, 16 bp, H. sapiens
catttttctttgatat

SEQ ID NO: 72294 - DNA, 16 bp, H. sapiens
catttttgacaaagtt

SEQ ID NO: 72295 - DNA, 16 bp, H. sapiens
catttttgcaaaaaaa

SEQ ID NO: 72296 - DNA, 16 bp, H. sapiens
catttttgcatgtgtt

SEQ ID NO: 72297 - DNA, 16 bp, H. sapiens
catttttggtgggaat

SEQ ID NO: 72298 - DNA, 16 bp, H. sapiens
catttttgtaaaaaaa

SEQ ID NO: 72299 - DNA, 16 bp, H. sapiens
catttttgtaataaaa

SEQ ID NO: 72300 - DNA, 16 bp, H. sapiens
catttttgtaataatt

SEQ ID NO: 72301 - DNA, 16 bp, H. sapiens
catttttgtacatgtt

SEQ ID NO: 72302 - DNA, 16 bp, H. sapiens
catttttgtattatta

SEQ ID NO: 72303 - DNA, 16 bp, H. sapiens
catttttgtttaaaaa

SEQ ID NO: 72304 - DNA, 16 bp, H. sapiens
catttttgtttcctca

SEQ ID NO: 72305 - DNA, 16 bp, H. sapiens
catttttgtttctaaa

SEQ ID NO: 72306 - DNA, 16 bp, H. sapiens
catttttgttttaata

SEQ ID NO: 72307 - DNA, 16 bp, H. sapiens
catttttgttttaatc

SEQ ID NO: 72308 - DNA, 16 bp, H. sapiens
cattttttaaaaagga

SEQ ID NO: 72309 - DNA, 16 bp, H. sapiens
cattttttaaaagtat

SEQ ID NO: 72310 - DNA, 16 bp, H. sapiens
cattttttaaaatttg

SEQ ID NO: 72311 - DNA, 16 bp, H. sapiens
cattttttaaagatat

SEQ ID NO: 72312 - DNA, 16 bp, H. sapiens
cattttttaaaggaag

SEQ ID NO: 72313 - DNA, 16 bp, H. sapiens
cattttttaaatcagg

SEQ ID NO: 72314 - DNA, 16 bp, H. sapiens
cattttttaaatccag

SEQ ID NO: 72315 - DNA, 16 bp, H. sapiens
cattttttaaatgtaa

SEQ ID NO: 72316 - DNA, 16 bp, H. sapiens
cattttttaatatacc

SEQ ID NO: 72317 - DNA, 16 bp, H. sapiens
cattttttagtagaga

SEQ ID NO: 72318 - DNA, 16 bp, H. sapiens
cattttttattgaatt

SEQ ID NO: 72319 - DNA, 16 bp, H. sapiens
cattttttatttcaga

SEQ ID NO: 72320 - DNA, 16 bp, H. sapiens
cattttttcatatttg

SEQ ID NO: 72321 - DNA, 16 bp, H. sapiens
cattttttcatgtgtt

SEQ ID NO: 72322 - DNA, 16 bp, H. sapiens
cattttttcattaaaa

SEQ ID NO: 72323 - DNA, 16 bp, H. sapiens
cattttttcatttgtc

SEQ ID NO: 72324 - DNA, 16 bp, H. sapiens
cattttttccaaaaat

SEQ ID NO: 72325 - DNA, 16 bp, H. sapiens
cattttttccccatct

SEQ ID NO: 72326 - DNA, 16 bp, H. sapiens
cattttttcctttaaa

SEQ ID NO: 72327 - DNA, 16 bp, H. sapiens
cattttttcttgtaaa

SEQ ID NO: 72328 - DNA, 16 bp, H. sapiens
cattttttgaatgttt

SEQ ID NO: 72329 - DNA, 16 bp, H. sapiens
cattttttgtagacac

SEQ ID NO: 72330 - DNA, 16 bp, H. sapiens
cattttttgtgtcttc

SEQ ID NO: 72331 - DNA, 16 bp, H. sapiens
cattttttgtgtgtct

SEQ ID NO: 72332 - DNA, 16 bp, H. sapiens
catttttttaagaaaa

SEQ ID NO: 72333 - DNA, 16 bp, H. sapiens
catttttttcacaaaa

SEQ ID NO: 72334 - DNA, 16 bp, H. sapiens
catttttttcacagaa

SEQ ID NO: 72335 - DNA, 16 bp, H. sapiens
catttttttcatatgt

SEQ ID NO: 72336 - DNA, 16 bp, H. sapiens
catttttttcatctgt

SEQ ID NO: 72337 - DNA, 16 bp, H. sapiens
catttttttccatatg

SEQ ID NO: 72338 - DNA, 16 bp, H. sapiens
catttttttctaatgt

SEQ ID NO: 72339 - DNA, 16 bp, H. sapiens
catttttttctagatt

SEQ ID NO: 72340 - DNA, 16 bp, H. sapiens
catttttttctgcatt

SEQ ID NO: 72341 - DNA, 16 bp, H. sapiens
catttttttctggatt

SEQ ID NO: 72342 - DNA, 16 bp, H. sapiens
cattttttttaatgtg

SEQ ID NO: 72343 - DNA, 16 bp, H. sapiens
cattttttttgtagag

SEQ ID NO: 72344 - DNA, 16 bp, H. sapiens
cattttttttttgaga

SEQ ID NO: 72345 - DNA, 16 bp, H. sapiens
ccaaaaaactattgaa

SEQ ID NO: 72346 - DNA, 16 bp, H. sapiens
ccaaaaaactgttaga

SEQ ID NO: 72347 - DNA, 16 bp, H. sapiens
ccaaaaaagaaaactt

SEQ ID NO: 72348 - DNA, 16 bp, H. sapiens
ccaaaaaagcccagga

SEQ ID NO: 72349 - DNA, 16 bp, H. sapiens
ccaaaaaatatatgaa

SEQ ID NO: 72350 - DNA, 16 bp, H. sapiens
ccaaaaaatggaaaca

SEQ ID NO: 72351 - DNA, 16 bp, H. sapiens
ccaaaaactccaccct

SEQ ID NO: 72352 - DNA, 16 bp, H. sapiens
ccaaaaactggacaag

SEQ ID NO: 72353 - DNA, 16 bp, H. sapiens
ccaaaaacttttaaaa

SEQ ID NO: 72354 - DNA, 16 bp, H. sapiens
ccaaaaagactgggga

SEQ ID NO: 72355 - DNA, 16 bp, H. sapiens
ccaaaaagctcttaga

SEQ ID NO: 72356 - DNA, 16 bp, H. sapiens
ccaaaaagctgggatt

SEQ ID NO: 72357 - DNA, 16 bp, H. sapiens
ccaaaaagttgccttt

SEQ ID NO: 72358 - DNA, 16 bp, H. sapiens
ccaaaaataaaattct

SEQ ID NO: 72359 - DNA, 16 bp, H. sapiens
ccaaaaatataattct

SEQ ID NO: 72360 - DNA, 16 bp, H. sapiens
ccaaaaatctccttaa

SEQ ID NO: 72361 - DNA, 16 bp, H. sapiens
ccaaaaatgtagaagt

SEQ ID NO: 72362 - DNA, 16 bp, H. sapiens
ccaaaaatgttgcagg

SEQ ID NO: 72363 - DNA, 16 bp, H. sapiens
ccaaaaattattttta

SEQ ID NO: 72364 - DNA, 16 bp, H. sapiens
ccaaaacaatgacaat

SEQ ID NO: 72365 - DNA, 16 bp, H. sapiens
ccaaaacaattctaag

SEQ ID NO: 72366 - DNA, 16 bp, H. sapiens
ccaaaaccaaggggct

SEQ ID NO: 72367 - DNA, 16 bp, H. sapiens
ccaaaaccaatgaaag

SEQ ID NO: 72368 - DNA, 16 bp, H. sapiens
ccaaaaccagaatgcc

SEQ ID NO: 72369 - DNA, 16 bp, H. sapiens
ccaaaaccagagaaag

SEQ ID NO: 72370 - DNA, 16 bp, H. sapiens
ccaaaacctggaagag

SEQ ID NO: 72371 - DNA, 16 bp, H. sapiens
ccaaaactcatgttga

SEQ ID NO: 72372 - DNA, 16 bp, H. sapiens
ccaaaactgaaaaaca

SEQ ID NO: 72373 - DNA, 16 bp, H. sapiens
ccaaaactgtgaaaaa

SEQ ID NO: 72374 - DNA, 16 bp, H. sapiens
ccaaaactgtgaggaa

SEQ ID NO: 72375 - DNA, 16 bp, H. sapiens
ccaaaacttaattact

SEQ ID NO: 72376 - DNA, 16 bp, H. sapiens
ccaaaagaaaatgcaa

SEQ ID NO: 72377 - DNA, 16 bp, H. sapiens
ccaaaagaaaggaaat

SEQ ID NO: 72378 - DNA, 16 bp, H. sapiens
ccaaaagaactttctg

SEQ ID NO: 72379 - DNA, 16 bp, H. sapiens
ccaaaagaagatatac

SEQ ID NO: 72380 - DNA, 16 bp, H. sapiens
ccaaaagaatataatt

SEQ ID NO: 72381 - DNA, 16 bp, H. sapiens
ccaaaagactataaat

SEQ ID NO: 72382 - DNA, 16 bp, H. sapiens
ccaaaagagagaattt

SEQ ID NO: 72383 - DNA, 16 bp, H. sapiens
ccaaaagatatgttca

SEQ ID NO: 72384 - DNA, 16 bp, H. sapiens
ccaaaagatgaaaaca

SEQ ID NO: 72385 - DNA, 16 bp, H. sapiens
ccaaaagattggacac

SEQ ID NO: 72386 - DNA, 16 bp, H. sapiens
ccaaaagcaaatgcaa

SEQ ID NO: 72387 - DNA, 16 bp, H. sapiens
ccaaaagcaagtgcaa

SEQ ID NO: 72388 - DNA, 16 bp, H. sapiens
ccaaaagcaattgcaa

SEQ ID NO: 72389 - DNA, 16 bp, H. sapiens
ccaaaagcacaggtaa

SEQ ID NO: 72390 - DNA, 16 bp, H. sapiens
ccaaaagctggaagca

SEQ ID NO: 72391 - DNA, 16 bp, H. sapiens
ccaaaaggagggaaat

SEQ ID NO: 72392 - DNA, 16 bp, H. sapiens
ccaaaaggagggaggg

SEQ ID NO: 72393 - DNA, 16 bp, H. sapiens
ccaaaaggattataaa

SEQ ID NO: 72394 - DNA, 16 bp, H. sapiens
ccaaaaggcagaagca

SEQ ID NO: 72395 - DNA, 16 bp, H. sapiens
ccaaaagtggaattgc

SEQ ID NO: 72396 - DNA, 16 bp, H. sapiens
ccaaaataaacaaatg

SEQ ID NO: 72397 - DNA, 16 bp, H. sapiens
ccaaaatacataaaga

SEQ ID NO: 72398 - DNA, 16 bp, H. sapiens
ccaaaatatcagtagt

SEQ ID NO: 72399 - DNA, 16 bp, H. sapiens
ccaaaatatgtacatt

SEQ ID NO: 72400 - DNA, 16 bp, H. sapiens
ccaaaatattttttaa

SEQ ID NO: 72401 - DNA, 16 bp, H. sapiens
ccaaaatcaaatagct

SEQ ID NO: 72402 - DNA, 16 bp, H. sapiens
ccaaaatcaaatgcaa

SEQ ID NO: 72403 - DNA, 16 bp, H. sapiens
ccaaaatcacacagct

SEQ ID NO: 72404 - DNA, 16 bp, H. sapiens
ccaaaatcatttcttt

SEQ ID NO: 72405 - DNA, 16 bp, H. sapiens
ccaaaatccaaaactt

SEQ ID NO: 72406 - DNA, 16 bp, H. sapiens
ccaaaatccaaagagg

SEQ ID NO: 72407 - DNA, 16 bp, H. sapiens
ccaaaatccttaacaa

SEQ ID NO: 72408 - DNA, 16 bp, H. sapiens
ccaaaatctaaaactt

SEQ ID NO: 72409 - DNA, 18 bp, H. sapiens
ccaaaatctccttaagca

SEQ ID NO: 72410 - DNA, 16 bp, H. sapiens
ccaaaatctgaaaaaa

SEQ ID NO: 72411 - DNA, 16 bp, H. sapiens
ccaaaatgcccatcag

SEQ ID NO: 72412 - DNA, 16 bp, H. sapiens
ccaaaatgctgaatga

SEQ ID NO: 72413 - DNA, 16 bp, H. sapiens
ccaaaatggaataaaa

SEQ ID NO: 72414 - DNA, 16 bp, H. sapiens
ccaaaatggagtcact

SEQ ID NO: 72415 - DNA, 16 bp, H. sapiens
ccaaaatggccaaata

SEQ ID NO: 72416 - DNA, 16 bp, H. sapiens
ccaaaatggtgaaact

SEQ ID NO: 72417 - DNA, 16 bp, H. sapiens
ccaaaatgtggaagca

SEQ ID NO: 72418 - DNA, 16 bp, H. sapiens
ccaaaatgtggccaga

SEQ ID NO: 72419 - DNA, 16 bp, H. sapiens
ccaaaattaaggtgtt

SEQ ID NO: 72420 - DNA, 16 bp, H. sapiens
ccaaaattcacagatg

SEQ ID NO: 72421 - DNA, 16 bp, H. sapiens
ccaaaattctgagatt

SEQ ID NO: 72422 - DNA, 16 bp, H. sapiens
ccaaaattgtgccact

SEQ ID NO: 72423 - DNA, 16 bp, H. sapiens
ccaaaatttatatgaa

SEQ ID NO: 72424 - DNA, 16 bp, H. sapiens
ccaaaatttatatttt

SEQ ID NO: 72425 - DNA, 16 bp, H. sapiens
ccaaacaagtgaaaga

SEQ ID NO: 72426 - DNA, 16 bp, H. sapiens
ccaaacacacattctt

SEQ ID NO: 72427 - DNA, 16 bp, H. sapiens
ccaaacaccacacgtt

SEQ ID NO: 72428 - DNA, 16 bp, H. sapiens
ccaaacagattcaacc

SEQ ID NO: 72429 - DNA, 16 bp, H. sapiens
ccaaacaggaagacaa

SEQ ID NO: 72430 - DNA, 16 bp, H. sapiens
ccaaacaggatttgtg

SEQ ID NO: 72431 - DNA, 16 bp, H. sapiens
ccaaacatcaattctt

SEQ ID NO: 72432 - DNA, 16 bp, H. sapiens
ccaaacatcacatatt

SEQ ID NO: 72433 - DNA, 16 bp, H. sapiens
ccaaaccatattattt

SEQ ID NO: 72434 - DNA, 16 bp, H. sapiens
ccaaacctactgaatc

SEQ ID NO: 72435 - DNA, 16 bp, H. sapiens
ccaaacctcagcaaca

SEQ ID NO: 72436 - DNA, 16 bp, H. sapiens
ccaaacctcagcatca

SEQ ID NO: 72437 - DNA, 16 bp, H. sapiens
ccaaacctcagcgtca

SEQ ID NO: 72438 - DNA, 16 bp, H. sapiens
ccaaacctcagttctt

SEQ ID NO: 72439 - DNA, 16 bp, H. sapiens
ccaaacctcatgttga

SEQ ID NO: 72440 - DNA, 16 bp, H. sapiens
ccaaacctccccagac

SEQ ID NO: 72441 - DNA, 16 bp, H. sapiens
ccaaacctgctcctcc

SEQ ID NO: 72442 - DNA, 16 bp, H. sapiens
ccaaactgctcaatct

SEQ ID NO: 72443 - DNA, 16 bp, H. sapiens
ccaaactggtcttgaa

SEQ ID NO: 72444 - DNA, 16 bp, H. sapiens
ccaaactgtcccacat

SEQ ID NO: 72445 - DNA, 16 bp, H. sapiens
ccaaactgtgctctga

SEQ ID NO: 72446 - DNA, 16 bp, H. sapiens
ccaaactgttgaatca

SEQ ID NO: 72447 - DNA, 16 bp, H. sapiens
ccaaactgttttccaa

SEQ ID NO: 72448 - DNA, 16 bp, H. sapiens
ccaaactttcaaagaa

SEQ ID NO: 72449 - DNA, 16 bp, H. sapiens
ccaaacttttatgctc

SEQ ID NO: 72450 - DNA, 16 bp, H. sapiens
ccaaagaaaatgaaat

SEQ ID NO: 72451 - DNA, 16 bp, H. sapiens
ccaaagaaacctgaaa

SEQ ID NO: 72452 - DNA, 16 bp, H. sapiens
ccaaagaaagagggtt

SEQ ID NO: 72453 - DNA, 16 bp, H. sapiens
ccaaagaaaggaaatc

SEQ ID NO: 72454 - DNA, 16 bp, H. sapiens
ccaaagaaatgaaaac

SEQ ID NO: 72455 - DNA, 16 bp, H. sapiens
ccaaagaaatggagat

SEQ ID NO: 72456 - DNA, 16 bp, H. sapiens
ccaaagaagaaattaa

SEQ ID NO: 72457 - DNA, 16 bp, H. sapiens
ccaaagaagaaggctt

SEQ ID NO: 72458 - DNA, 16 bp, H. sapiens
ccaaagaagacatgca

SEQ ID NO: 72459 - DNA, 16 bp, H. sapiens
ccaaagaagagaccca

SEQ ID NO: 72460 - DNA, 16 bp, H. sapiens
ccaaagaagagcccaa

SEQ ID NO: 72461 - DNA, 16 bp, H. sapiens
ccaaagaagtatattt

SEQ ID NO: 72462 - DNA, 16 bp, H. sapiens
ccaaagaagtgaaaga

SEQ ID NO: 72463 - DNA, 16 bp, H. sapiens
ccaaagaagttgaaaa

SEQ ID NO: 72464 - DNA, 16 bp, H. sapiens
ccaaagaagtttctga

SEQ ID NO: 72465 - DNA, 16 bp, H. sapiens
ccaaagaatatataca

SEQ ID NO: 72466 - DNA, 16 bp, H. sapiens
ccaaagaattgaaaac

SEQ ID NO: 72467 - DNA, 16 bp, H. sapiens
ccaaagacaaaaatca

SEQ ID NO: 72468 - DNA, 16 bp, H. sapiens
ccaaagacagcctgaa

SEQ ID NO: 72469 - DNA, 16 bp, H. sapiens
ccaaagactccaccaa

SEQ ID NO: 72470 - DNA, 16 bp, H. sapiens
ccaaagagaaattctg

SEQ ID NO: 72471 - DNA, 16 bp, H. sapiens
ccaaagagaataaaat

SEQ ID NO: 72472 - DNA, 16 bp, H. sapiens
ccaaagagaatcattt

SEQ ID NO: 72473 - DNA, 16 bp, H. sapiens
ccaaagaggctgtacc

SEQ ID NO: 72474 - DNA, 16 bp, H. sapiens
ccaaagataaagagaa

SEQ ID NO: 72475 - DNA, 16 bp, H. sapiens
ccaaagatagataaat

SEQ ID NO: 72476 - DNA, 16 bp, H. sapiens
ccaaagatagcagaag

SEQ ID NO: 72477 - DNA, 16 bp, H. sapiens
ccaaagatcaaggata

SEQ ID NO: 72478 - DNA, 16 bp, H. sapiens
ccaaagattgccagca

SEQ ID NO: 72479 - DNA, 16 bp, H. sapiens
ccaaagattttttttt

SEQ ID NO: 72480 - DNA, 16 bp, H. sapiens
ccaaagcaagaggatc

SEQ ID NO: 72481 - DNA, 16 bp, H. sapiens
ccaaagcaagaggatt

SEQ ID NO: 72482 - DNA, 16 bp, H. sapiens
ccaaagcaagtagaag

SEQ ID NO: 72483 - DNA, 16 bp, H. sapiens
ccaaagcaattctgaa

SEQ ID NO: 72484 - DNA, 16 bp, H. sapiens
ccaaagcacagggatt

SEQ ID NO: 72485 - DNA, 16 bp, H. sapiens
ccaaagcactggaatt

SEQ ID NO: 72486 - DNA, 16 bp, H. sapiens
ccaaagcactgtgatt

SEQ ID NO: 72487 - DNA, 16 bp, H. sapiens
ccaaagcacttggatt

SEQ ID NO: 72488 - DNA, 16 bp, H. sapiens
ccaaagcatctgtgat

SEQ ID NO: 72489 - DNA, 16 bp, H. sapiens
ccaaagccaacatcat

SEQ ID NO: 72490 - DNA, 16 bp, H. sapiens
ccaaagccagataaag

SEQ ID NO: 72491 - DNA, 16 bp, H. sapiens
ccaaagcccagcagag

SEQ ID NO: 72492 - DNA, 16 bp, H. sapiens
ccaaagccctgggatt

SEQ ID NO: 72493 - DNA, 16 bp, H. sapiens
ccaaagcctatgttct

SEQ ID NO: 72494 - DNA, 16 bp, H. sapiens
ccaaagcctggaagag

SEQ ID NO: 72495 - DNA, 16 bp, H. sapiens
ccaaagccttgggcag

SEQ ID NO: 72496 - DNA, 16 bp, H. sapiens
ccaaagctctggaatt

SEQ ID NO: 72497 - DNA, 16 bp, H. sapiens
ccaaaggaaaagaagt

SEQ ID NO: 72498 - DNA, 16 bp, H. sapiens
ccaaaggaaagcagct

SEQ ID NO: 72499 - DNA, 16 bp, H. sapiens
ccaaaggaaaggaagt

SEQ ID NO: 72500 - DNA, 16 bp, H. sapiens
ccaaaggaaatggaat

SEQ ID NO: 72501 - DNA, 16 bp, H. sapiens
ccaaaggaagcactaa

SEQ ID NO: 72502 - DNA, 16 bp, H. sapiens
ccaaaggactgcagct

SEQ ID NO: 72503 - DNA, 16 bp, H. sapiens
ccaaaggagacataca

SEQ ID NO: 72504 - DNA, 16 bp, H. sapiens
ccaaaggcacaggcaa

SEQ ID NO: 72505 - DNA, 16 bp, H. sapiens
ccaaaggcaggaaaaa

SEQ ID NO: 72506 - DNA, 16 bp, H. sapiens
ccaaaggcatgcacca

SEQ ID NO: 72507 - DNA, 16 bp, H. sapiens
ccaaaggccccacctc

SEQ ID NO: 72508 - DNA, 16 bp, H. sapiens
ccaaaggccccacctt

SEQ ID NO: 72509 - DNA, 16 bp, H. sapiens
ccaaaggcctcaaagc

SEQ ID NO: 72510 - DNA, 16 bp, H. sapiens
ccaaagggaaaagtca

SEQ ID NO: 72511 - DNA, 16 bp, H. sapiens
ccaaagtacacaggca

SEQ ID NO: 72512 - DNA, 16 bp, H. sapiens
ccaaagtcaaaatgaa

SEQ ID NO: 72513 - DNA, 16 bp, H. sapiens
ccaaagtcacacaatt

SEQ ID NO: 72514 - DNA, 16 bp, H. sapiens
ccaaagtcacacagca

SEQ ID NO: 72515 - DNA, 16 bp, H. sapiens
ccaaagtcatacagct

SEQ ID NO: 72516 - DNA, 16 bp, H. sapiens
ccaaagtccatgttct

SEQ ID NO: 72517 - DNA, 16 bp, H. sapiens
ccaaagtctggagggg

SEQ ID NO: 72518 - DNA, 16 bp, H. sapiens
ccaaagtgatctcctt

SEQ ID NO: 72519 - DNA, 16 bp, H. sapiens
ccaaagtgattgtacc

SEQ ID NO: 72520 - DNA, 16 bp, H. sapiens
ccaaagtgcaaggatt

SEQ ID NO: 72521 - DNA, 16 bp, H. sapiens
ccaaagtgcaggatta

SEQ ID NO: 72522 - DNA, 16 bp, H. sapiens
ccaaagtgcatggatt

SEQ ID NO: 72523 - DNA, 16 bp, H. sapiens
ccaaagtgctgggata

SEQ ID NO: 72524 - DNA, 16 bp, H. sapiens
ccaaagtgctgggatc

SEQ ID NO: 72525 - DNA, 19 bp, H. sapiens
ccaaagtgctgggattgcc

SEQ ID NO: 72526 - DNA, 16 bp, H. sapiens
ccaaagtgctggtgtg

SEQ ID NO: 72527 - DNA, 16 bp, H. sapiens
ccaaagtgggaagatc

SEQ ID NO: 72528 - DNA, 21 bp, H. sapiens
ccaaagtgggagcccaggcag

SEQ ID NO: 72529 - DNA, 16 bp, H. sapiens
ccaaagtgggaggatt

SEQ ID NO: 72530 - DNA, 16 bp, H. sapiens
ccaaagtgtgggatta

SEQ ID NO: 72531 - DNA, 16 bp, H. sapiens
ccaaagtgttgagatt

SEQ ID NO: 72532 - DNA, 17 bp, H. sapiens
ccaaagtgttgggattg

SEQ ID NO: 72533 - DNA, 16 bp, H. sapiens
ccaaagttctgggaat

SEQ ID NO: 72534 - DNA, 16 bp, H. sapiens
ccaaagttgagaacca

SEQ ID NO: 72535 - DNA, 16 bp, H. sapiens
ccaaagttttggaatt

SEQ ID NO: 72536 - DNA, 16 bp, H. sapiens
ccaaataaacagaatt

SEQ ID NO: 72537 - DNA, 16 bp, H. sapiens
ccaaataaacctcttg

SEQ ID NO: 72538 - DNA, 16 bp, H. sapiens
ccaaataaatcttttt

SEQ ID NO: 72539 - DNA, 16 bp, H. sapiens
ccaaataaggaagggg

SEQ ID NO: 72540 - DNA, 16 bp, H. sapiens
ccaaataaggcaaatg

SEQ ID NO: 72541 - DNA, 16 bp, H. sapiens
ccaaatacacctcttt

SEQ ID NO: 72542 - DNA, 16 bp, H. sapiens
ccaaataccacaagtt

SEQ ID NO: 72543 - DNA, 16 bp, H. sapiens
ccaaataccacagact

SEQ ID NO: 72544 - DNA, 16 bp, H. sapiens
ccaaatagccagaaaa

SEQ ID NO: 72545 - DNA, 16 bp, H. sapiens
ccaaatataagaagct

SEQ ID NO: 72546 - DNA, 16 bp, H. sapiens
ccaaatatataaagaa

SEQ ID NO: 72547 - DNA, 16 bp, H. sapiens
ccaaatatatatatat

SEQ ID NO: 72548 - DNA, 16 bp, H. sapiens
ccaaatatatttcttt

SEQ ID NO: 72549 - DNA, 16 bp, H. sapiens
ccaaatatctgggcac

SEQ ID NO: 72550 - DNA, 16 bp, H. sapiens
ccaaatattttataaa

SEQ ID NO: 72551 - DNA, 16 bp, H. sapiens
ccaaatcaagaaggca

SEQ ID NO: 72552 - DNA, 17 bp, H. sapiens
ccaaatcaatcctaagc

SEQ ID NO: 72553 - DNA, 16 bp, H. sapiens
ccaaatcaggaacaaa

SEQ ID NO: 72554 - DNA, 16 bp, H. sapiens
ccaaatccaaaatgct

SEQ ID NO: 72555 - DNA, 16 bp, H. sapiens
ccaaatccaaacccag

SEQ ID NO: 72556 - DNA, 16 bp, H. sapiens
ccaaatccaaagtctc

SEQ ID NO: 72557 - DNA, 16 bp, H. sapiens
ccaaatccagcctgct

SEQ ID NO: 72558 - DNA, 16 bp, H. sapiens
ccaaatcctcaccagc

SEQ ID NO: 72559 - DNA, 16 bp, H. sapiens
ccaaatctcagtggct

SEQ ID NO: 72560 - DNA, 16 bp, H. sapiens
ccaaatctcatgtcct

SEQ ID NO: 72561 - DNA, 16 bp, H. sapiens
ccaaatctggcccact

SEQ ID NO: 72562 - DNA, 16 bp, H. sapiens
ccaaatgaaaattctg

SEQ ID NO: 72563 - DNA, 16 bp, H. sapiens
ccaaatgaactaaaca

SEQ ID NO: 72564 - DNA, 16 bp, H. sapiens
ccaaatgaattttaga

SEQ ID NO: 72565 - DNA, 16 bp, H. sapiens
ccaaatgagaagaaac

SEQ ID NO: 72566 - DNA, 16 bp, H. sapiens
ccaaatgagttaaaaa

SEQ ID NO: 72567 - DNA, 16 bp, H. sapiens
ccaaatgatcacaact

SEQ ID NO: 72568 - DNA, 16 bp, H. sapiens
ccaaatgatttttgac

SEQ ID NO: 72569 - DNA, 16 bp, H. sapiens
ccaaatgcccatcagt

SEQ ID NO: 72570 - DNA, 16 bp, H. sapiens
ccaaatgctgcatatt

SEQ ID NO: 72571 - DNA, 16 bp, H. sapiens
ccaaatggtatttctg

SEQ ID NO: 72572 - DNA, 16 bp, H. sapiens
ccaaatggtttcactg

SEQ ID NO: 72573 - DNA, 16 bp, H. sapiens
ccaaatgtcagcagtg

SEQ ID NO: 72574 - DNA, 16 bp, H. sapiens
ccaaatgtccaacaac

SEQ ID NO: 72575 - DNA, 16 bp, H. sapiens
ccaaatgttcatcaac

SEQ ID NO: 72576 - DNA, 16 bp, H. sapiens
ccaaattaaatattat

SEQ ID NO: 72577 - DNA, 16 bp, H. sapiens
ccaaattcaaactata

SEQ ID NO: 72578 - DNA, 16 bp, H. sapiens
ccaaattcagcaacat

SEQ ID NO: 72579 - DNA, 16 bp, H. sapiens
ccaaattcagtgtcat

SEQ ID NO: 72580 - DNA, 16 bp, H. sapiens
ccaaattcctatctaa

SEQ ID NO: 72581 - DNA, 16 bp, H. sapiens
ccaaattgccgggatt

SEQ ID NO: 72582 - DNA, 16 bp, H. sapiens
ccaaattgctgggaat

SEQ ID NO: 72583 - DNA, 16 bp, H. sapiens
ccaaatttaatttaaa

SEQ ID NO: 72584 - DNA, 16 bp, H. sapiens
ccaaatttcatcttgt

SEQ ID NO: 72585 - DNA, 16 bp, H. sapiens
ccaaatttccttcctt

SEQ ID NO: 72586 - DNA, 16 bp, H. sapiens
ccaaatttctttgtca

SEQ ID NO: 72587 - DNA, 16 bp, H. sapiens
ccaaatttgaagaaaa

SEQ ID NO: 72588 - DNA, 16 bp, H. sapiens
ccaaatttgatgaaat

SEQ ID NO: 72589 - DNA, 16 bp, H. sapiens
ccaaatttgttatttt

SEQ ID NO: 72590 - DNA, 16 bp, H. sapiens
ccaaattttctacagt

SEQ ID NO: 72591 - DNA, 16 bp, H. sapiens
ccaaatttttccaaag

SEQ ID NO: 72592 - DNA, 16 bp, H. sapiens
ccaacaaagaaaagtc

SEQ ID NO: 72593 - DNA, 16 bp, H. sapiens
ccaacaaagaaaattc

SEQ ID NO: 72594 - DNA, 16 bp, H. sapiens
ccaacaaatgcagaat

SEQ ID NO: 72595 - DNA, 16 bp, H. sapiens
ccaacaacaaagaatt

SEQ ID NO: 72596 - DNA, 16 bp, H. sapiens
ccaacaacagaagaat

SEQ ID NO: 72597 - DNA, 16 bp, H. sapiens
ccaacaacaggcaagc

SEQ ID NO: 72598 - DNA, 16 bp, H. sapiens
ccaacaactacagaat

SEQ ID NO: 72599 - DNA, 16 bp, H. sapiens
ccaacaagctcccagg

SEQ ID NO: 72600 - DNA, 16 bp, H. sapiens
ccaacaagtggataaa

SEQ ID NO: 72601 - DNA, 16 bp, H. sapiens
ccaacacaaaaccagt

SEQ ID NO: 72602 - DNA, 16 bp, H. sapiens
ccaacaccacagaaat

SEQ ID NO: 72603 - DNA, 16 bp, H. sapiens
ccaacacccaggctgg

SEQ ID NO: 72604 - DNA, 16 bp, H. sapiens
ccaacactctgttgaa

SEQ ID NO: 72605 - DNA, 16 bp, H. sapiens
ccaacactgtgggagg

SEQ ID NO: 72606 - DNA, 16 bp, H. sapiens
ccaacacttgttattt

SEQ ID NO: 72607 - DNA, 16 bp, H. sapiens
ccaacactttgtgggg

SEQ ID NO: 72608 - DNA, 16 bp, H. sapiens
ccaacagcagcaaaat

SEQ ID NO: 72609 - DNA, 16 bp, H. sapiens
ccaacagccagcatca

SEQ ID NO: 72610 - DNA, 21 bp, H. sapiens
ccaacagctccaaagagacag

SEQ ID NO: 72611 - DNA, 16 bp, H. sapiens
ccaacagggagaaacc

SEQ ID NO: 72612 - DNA, 16 bp, H. sapiens
ccaacagggtgaaaac

SEQ ID NO: 72613 - DNA, 16 bp, H. sapiens
ccaacagtccccaaag

SEQ ID NO: 72614 - DNA, 16 bp, H. sapiens
ccaacagtgtaaaagc

SEQ ID NO: 72615 - DNA, 16 bp, H. sapiens
ccaacatatgcataat

SEQ ID NO: 72616 - DNA, 16 bp, H. sapiens
ccaacatctccccatc

SEQ ID NO: 72617 - DNA, 16 bp, H. sapiens
ccaacatcttgatttt

SEQ ID NO: 72618 - DNA, 16 bp, H. sapiens
ccaacatgcccagctg

SEQ ID NO: 72619 - DNA, 16 bp, H. sapiens
ccaacatgcctggcca

SEQ ID NO: 72620 - DNA, 16 bp, H. sapiens
ccaacatgctaggatt

SEQ ID NO: 72621 - DNA, 16 bp, H. sapiens
ccaacatgctcagcta

SEQ ID NO: 72622 - DNA, 16 bp, H. sapiens
ccaacatgcttggcta

SEQ ID NO: 72623 - DNA, 16 bp, H. sapiens
ccaacatggcaaaact

SEQ ID NO: 72624 - DNA, 16 bp, H. sapiens
ccaacatgggaggatc

SEQ ID NO: 72625 - DNA, 20 bp, H. sapiens
ccaacatggtgaaacccgtc

SEQ ID NO: 72626 - DNA, 17 bp, H. sapiens
ccaacatggtgaaactg

SEQ ID NO: 72627 - DNA, 16 bp, H. sapiens
ccaacatggtgaaccc

SEQ ID NO: 72628 - DNA, 16 bp, H. sapiens
ccaacattgagaatta

SEQ ID NO: 72629 - DNA, 16 bp, H. sapiens
ccaacattggggatta

SEQ ID NO: 72630 - DNA, 16 bp, H. sapiens
ccaaccaaaaggagtc

SEQ ID NO: 72631 - DNA, 19 bp, H. sapiens
ccaaccaagcaagtaatta

SEQ ID NO: 72632 - DNA, 16 bp, H. sapiens
ccaaccaataatttca

SEQ ID NO: 72633 - DNA, 16 bp, H. sapiens
ccaaccacctcagcct

SEQ ID NO: 72634 - DNA, 16 bp, H. sapiens
ccaaccagggcaacag

SEQ ID NO: 72635 - DNA, 16 bp, H. sapiens
ccaaccagggtctcca

SEQ ID NO: 72636 - DNA, 16 bp, H. sapiens
ccaacccaaatgccca

SEQ ID NO: 72637 - DNA, 16 bp, H. sapiens
ccaacccagaagccca

SEQ ID NO: 72638 - DNA, 16 bp, H. sapiens
ccaacccagcaagaca

SEQ ID NO: 72639 - DNA, 16 bp, H. sapiens
ccaacccagcctccca

SEQ ID NO: 72640 - DNA, 16 bp, H. sapiens
ccaacccaggaactga

SEQ ID NO: 72641 - DNA, 16 bp, H. sapiens
ccaacccaggtgacag

SEQ ID NO: 72642 - DNA, 16 bp, H. sapiens
ccaacccagtgaaacc

SEQ ID NO: 72643 - DNA, 16 bp, H. sapiens
ccaacccccaggccat

SEQ ID NO: 72644 - DNA, 16 bp, H. sapiens
ccaacccggccaacat

SEQ ID NO: 72645 - DNA, 18 bp, H. sapiens
ccaaccctgtgctctctg

SEQ ID NO: 72646 - DNA, 17 bp, H. sapiens
ccaaccgactaccactt

SEQ ID NO: 72647 - DNA, 16 bp, H. sapiens
ccaacctcaaagctag

SEQ ID NO: 72648 - DNA, 16 bp, H. sapiens
ccaacctctgcctctt

SEQ ID NO: 72649 - DNA, 16 bp, H. sapiens
ccaacctctggcaacc

SEQ ID NO: 72650 - DNA, 16 bp, H. sapiens
ccaacctgagcaacaa

SEQ ID NO: 72651 - DNA, 16 bp, H. sapiens
ccaacctggataacat

SEQ ID NO: 72652 - DNA, 16 bp, H. sapiens
ccaacctggccaacct

SEQ ID NO: 72653 - DNA, 16 bp, H. sapiens
ccaacctggccaccat

SEQ ID NO: 72654 - DNA, 16 bp, H. sapiens
ccaacctggccagcat

SEQ ID NO: 72655 - DNA, 16 bp, H. sapiens
ccaacctggctgacat

SEQ ID NO: 72656 - DNA, 16 bp, H. sapiens
ccaacctgggcaacag

SEQ ID NO: 72657 - DNA, 16 bp, H. sapiens
ccaacctgggcaacgt

SEQ ID NO: 72658 - DNA, 16 bp, H. sapiens
ccaacctgggcaatag

SEQ ID NO: 72659 - DNA, 16 bp, H. sapiens
ccaacctgggtaacat

SEQ ID NO: 72660 - DNA, 16 bp, H. sapiens
ccaacctggtgaaaac

SEQ ID NO: 72661 - DNA, 16 bp, H. sapiens
ccaacgtggagaaact

SEQ ID NO: 72662 - DNA, 16 bp, H. sapiens
ccaactaatttttgta

SEQ ID NO: 72663 - DNA, 16 bp, H. sapiens
ccaactacatcaataa

SEQ ID NO: 72664 - DNA, 16 bp, H. sapiens
ccaactacatgctgtc

SEQ ID NO: 72665 - DNA, 16 bp, H. sapiens
ccaactactgaggagg

SEQ ID NO: 72666 - DNA, 16 bp, H. sapiens
ccaactcactggcccc

SEQ ID NO: 72667 - DNA, 16 bp, H. sapiens
ccaactcagcctccct

SEQ ID NO: 72668 - DNA, 16 bp, H. sapiens
ccaactcagcttcctg

SEQ ID NO: 72669 - DNA, 16 bp, H. sapiens
ccaactccaggcagct

SEQ ID NO: 72670 - DNA, 16 bp, H. sapiens
ccaactcccagcctca

SEQ ID NO: 72671 - DNA, 16 bp, H. sapiens
ccaactcctgaccttg

SEQ ID NO: 72672 - DNA, 16 bp, H. sapiens
ccaactcctggcaacc

SEQ ID NO: 72673 - DNA, 16 bp, H. sapiens
ccaactctatgttcct

SEQ ID NO: 72674 - DNA, 16 bp, H. sapiens
ccaactctggacacaa

SEQ ID NO: 72675 - DNA, 16 bp, H. sapiens
ccaactggaaaaaaaa

SEQ ID NO: 72676 - DNA, 16 bp, H. sapiens
ccaactgtgtgacctt

SEQ ID NO: 72677 - DNA, 16 bp, H. sapiens
ccaacttcaaagacca

SEQ ID NO: 72678 - DNA, 16 bp, H. sapiens
ccaacttcagcctccc

SEQ ID NO: 72679 - DNA, 16 bp, H. sapiens
ccaacttggcctccca

SEQ ID NO: 72680 - DNA, 16 bp, H. sapiens
ccaacttggtcatgat

SEQ ID NO: 72681 - DNA, 16 bp, H. sapiens
ccaactttaagactta

SEQ ID NO: 72682 - DNA, 16 bp, H. sapiens
ccaactttactaaaaa

SEQ ID NO: 72683 - DNA, 16 bp, H. sapiens
ccaactttattctttt

SEQ ID NO: 72684 - DNA, 16 bp, H. sapiens
ccaactttctttcctt

SEQ ID NO: 72685 - DNA, 16 bp, H. sapiens
ccaactttgtggtttt

SEQ ID NO: 72686 - DNA, 16 bp, H. sapiens
ccaacttttgattttt

SEQ ID NO: 72687 - DNA, 16 bp, H. sapiens
ccaacttttggtttca

SEQ ID NO: 72688 - DNA, 16 bp, H. sapiens
ccaagaaaagtctgaa

SEQ ID NO: 72689 - DNA, 16 bp, H. sapiens
ccaagaaagaattcaa

SEQ ID NO: 72690 - DNA, 16 bp, H. sapiens
ccaagaaagagcccaa

SEQ ID NO: 72691 - DNA, 16 bp, H. sapiens
ccaagaaagatcaaaa

SEQ ID NO: 72692 - DNA, 16 bp, H. sapiens
ccaagaaagggttctt

SEQ ID NO: 72693 - DNA, 16 bp, H. sapiens
ccaagaaagtgaaaga

SEQ ID NO: 72694 - DNA, 16 bp, H. sapiens
ccaagaaatatatgaa

SEQ ID NO: 72695 - DNA, 16 bp, H. sapiens
ccaagaaatatgggtc

SEQ ID NO: 72696 - DNA, 16 bp, H. sapiens
ccaagaaatggaatca

SEQ ID NO: 72697 - DNA, 16 bp, H. sapiens
ccaagaacagttttta

SEQ ID NO: 72698 - DNA, 16 bp, H. sapiens
ccaagaacatacattg

SEQ ID NO: 72699 - DNA, 16 bp, H. sapiens
ccaagaaccatttgcc

SEQ ID NO: 72700 - DNA, 16 bp, H. sapiens
ccaagaactggaaaca

SEQ ID NO: 72701 - DNA, 16 bp, H. sapiens
ccaagaagaagtcaaa

SEQ ID NO: 72702 - DNA, 16 bp, H. sapiens
ccaagaagaagttgaa

SEQ ID NO: 72703 - DNA, 16 bp, H. sapiens
ccaagaagagtctgag

SEQ ID NO: 72704 - DNA, 16 bp, H. sapiens
ccaagaagcagagaaa

SEQ ID NO: 72705 - DNA, 16 bp, H. sapiens
ccaagaagcaggaaaa

SEQ ID NO: 72706 - DNA, 16 bp, H. sapiens
ccaagaagcatatgaa

SEQ ID NO: 72707 - DNA, 16 bp, H. sapiens
ccaagaagcctttcct

SEQ ID NO: 72708 - DNA, 16 bp, H. sapiens
ccaagaagctggaatt

SEQ ID NO: 72709 - DNA, 16 bp, H. sapiens
ccaagaagtatgggac

SEQ ID NO: 72710 - DNA, 16 bp, H. sapiens
ccaagaataaaagaga

SEQ ID NO: 72711 - DNA, 16 bp, H. sapiens
ccaagaattctgtatc

SEQ ID NO: 72712 - DNA, 16 bp, H. sapiens
ccaagaatttcttttt

SEQ ID NO: 72713 - DNA, 16 bp, H. sapiens
ccaagaatttgcattt

SEQ ID NO: 72714 - DNA, 16 bp, H. sapiens
ccaagacaaatgaaaa

SEQ ID NO: 72715 - DNA, 17 bp, H. sapiens
ccaagacaatcctaagc

SEQ ID NO: 72716 - DNA, 16 bp, H. sapiens
ccaagacaatggagaa

SEQ ID NO: 72717 - DNA, 16 bp, H. sapiens
ccaagacaatttttct

SEQ ID NO: 72718 - DNA, 29 bp, H. sapiens
ccaagacacataattgtcagattcaccga

SEQ ID NO: 72719 - DNA, 27 bp, H. sapiens
ccaagacacataattgtcagattcact

SEQ ID NO: 72720 - DNA, 16 bp, H. sapiens
ccaagacagctactaa

SEQ ID NO: 72721 - DNA, 16 bp, H. sapiens
ccaagaccaacctggc

SEQ ID NO: 72722 - DNA, 16 bp, H. sapiens
ccaagaccacaccact

SEQ ID NO: 72723 - DNA, 16 bp, H. sapiens
ccaagaccaccaaggc

SEQ ID NO: 72724 - DNA, 16 bp, H. sapiens
ccaagaccaccaaggt

SEQ ID NO: 72725 - DNA, 16 bp, H. sapiens
ccaagaccagatggat

SEQ ID NO: 72726 - DNA, 16 bp, H. sapiens
ccaagaccatcctaag

SEQ ID NO: 72727 - DNA, 16 bp, H. sapiens
ccaagaccatgcttct

SEQ ID NO: 72728 - DNA, 16 bp, H. sapiens
ccaagaccatggaaac

SEQ ID NO: 72729 - DNA, 16 bp, H. sapiens
ccaagaccatgggaaa

SEQ ID NO: 72730 - DNA, 16 bp, H. sapiens
ccaagacccccagtgg

SEQ ID NO: 72731 - DNA, 16 bp, H. sapiens
ccaagactatgggaac

SEQ ID NO: 72732 - DNA, 16 bp, H. sapiens
ccaagacttcaagacc

SEQ ID NO: 72733 - DNA, 16 bp, H. sapiens
ccaagagaaatgaaaa

SEQ ID NO: 72734 - DNA, 16 bp, H. sapiens
ccaagagagggttctt

SEQ ID NO: 72735 - DNA, 16 bp, H. sapiens
ccaagagccctctctt

SEQ ID NO: 72736 - DNA, 16 bp, H. sapiens
ccaagaggacccacag

SEQ ID NO: 72737 - DNA, 16 bp, H. sapiens
ccaagaggcaaaggtt

SEQ ID NO: 72738 - DNA, 16 bp, H. sapiens
ccaagagttcaaggtt

SEQ ID NO: 72739 - DNA, 16 bp, H. sapiens
ccaagagttcgaggcc

SEQ ID NO: 72740 - DNA, 16 bp, H. sapiens
ccaagatacagctcag

SEQ ID NO: 72741 - DNA, 16 bp, H. sapiens
ccaagatagatcatat

SEQ ID NO: 72742 - DNA, 16 bp, H. sapiens
ccaagatagccactct

SEQ ID NO: 72743 - DNA, 16 bp, H. sapiens
ccaagatcaaagcaga

SEQ ID NO: 72744 - DNA, 16 bp, H. sapiens
ccaagatcaagatgct

SEQ ID NO: 72745 - DNA, 16 bp, H. sapiens
ccaagatcaagatgtc

SEQ ID NO: 72746 - DNA, 16 bp, H. sapiens
ccaagatcaaggagct

SEQ ID NO: 72747 - DNA, 16 bp, H. sapiens
ccaagatcacacagcc

SEQ ID NO: 72748 - DNA, 16 bp, H. sapiens
ccaagatcacacagtt

SEQ ID NO: 72749 - DNA, 16 bp, H. sapiens
ccaagatcatgcagct

SEQ ID NO: 72750 - DNA, 16 bp, H. sapiens
ccaagatcatgctgct

SEQ ID NO: 72751 - DNA, 16 bp, H. sapiens
ccaagatccccagtgg

SEQ ID NO: 72752 - DNA, 16 bp, H. sapiens
ccaagatcgtgccacc

SEQ ID NO: 72753 - DNA, 16 bp, H. sapiens
ccaagatggaaggatc

SEQ ID NO: 72754 - DNA, 16 bp, H. sapiens
ccaagatggcaatgag

SEQ ID NO: 72755 - DNA, 16 bp, H. sapiens
ccaagatggccacgag

SEQ ID NO: 72756 - DNA, 16 bp, H. sapiens
ccaagatggccccact

SEQ ID NO: 72757 - DNA, 16 bp, H. sapiens
ccaagatgggaagatc

SEQ ID NO: 72758 - DNA, 16 bp, H. sapiens
ccaagatgggcggatt

SEQ ID NO: 72759 - DNA, 16 bp, H. sapiens
ccaagatggtgacaag

SEQ ID NO: 72760 - DNA, 16 bp, H. sapiens
ccaagattcaaattca

SEQ ID NO: 72761 - DNA, 16 bp, H. sapiens
ccaagattgcacagct

SEQ ID NO: 72762 - DNA, 16 bp, H. sapiens
ccaagattgtggcatt

SEQ ID NO: 72763 - DNA, 16 bp, H. sapiens
ccaagatttatttatt

SEQ ID NO: 72764 - DNA, 16 bp, H. sapiens
ccaagcaaaatgaaca

SEQ ID NO: 72765 - DNA, 16 bp, H. sapiens
ccaagcagaagaaaca

SEQ ID NO: 72766 - DNA, 16 bp, H. sapiens
ccaagcagctgggaat

SEQ ID NO: 72767 - DNA, 16 bp, H. sapiens
ccaagcagtgggagga

SEQ ID NO: 72768 - DNA, 16 bp, H. sapiens
ccaagcataggggctc

SEQ ID NO: 72769 - DNA, 16 bp, H. sapiens
ccaagcatggaaataa

SEQ ID NO: 72770 - DNA, 16 bp, H. sapiens
ccaagcatggtggctc

SEQ ID NO: 72771 - DNA, 16 bp, H. sapiens
ccaagcattgtgctaa

SEQ ID NO: 72772 - DNA, 16 bp, H. sapiens
ccaagccactcagcca

SEQ ID NO: 72773 - DNA, 16 bp, H. sapiens
ccaagccagaaacctg

SEQ ID NO: 72774 - DNA, 16 bp, H. sapiens
ccaagccagcagcagc

SEQ ID NO: 72775 - DNA, 16 bp, H. sapiens
ccaagccagccaagac

SEQ ID NO: 72776 - DNA, 16 bp, H. sapiens
ccaagcccagccaatt

SEQ ID NO: 72777 - DNA, 16 bp, H. sapiens
ccaagcccagcccaga

SEQ ID NO: 72778 - DNA, 16 bp, H. sapiens
ccaagcccaggagagg

SEQ ID NO: 72779 - DNA, 16 bp, H. sapiens
ccaagccccacctctg

SEQ ID NO: 72780 - DNA, 16 bp, H. sapiens
ccaagcccctgccctc

SEQ ID NO: 72781 - DNA, 16 bp, H. sapiens
ccaagccctgccccac

SEQ ID NO: 72782 - DNA, 16 bp, H. sapiens
ccaagccctgcctctg

SEQ ID NO: 72783 - DNA, 16 bp, H. sapiens
ccaagccctttgggag

SEQ ID NO: 72784 - DNA, 16 bp, H. sapiens
ccaagcctcagttcct

SEQ ID NO: 72785 - DNA, 16 bp, H. sapiens
ccaagcctggctactt

SEQ ID NO: 72786 - DNA, 16 bp, H. sapiens
ccaagctactcaagag

SEQ ID NO: 72787 - DNA, 16 bp, H. sapiens
ccaagctactccagag

SEQ ID NO: 72788 - DNA, 16 bp, H. sapiens
ccaagctccactggca

SEQ ID NO: 72789 - DNA, 16 bp, H. sapiens
ccaagctccgcctccc

SEQ ID NO: 72790 - DNA, 16 bp, H. sapiens
ccaagctcttcagctt

SEQ ID NO: 72791 - DNA, 16 bp, H. sapiens
ccaagctgaagtacag

SEQ ID NO: 72792 - DNA, 16 bp, H. sapiens
ccaagctgagaaccaa

SEQ ID NO: 72793 - DNA, 16 bp, H. sapiens
ccaagctgctgggatt

SEQ ID NO: 72794 - DNA, 16 bp, H. sapiens
ccaagctggagtggag

SEQ ID NO: 72795 - DNA, 16 bp, H. sapiens
ccaagctggctgcaga

SEQ ID NO: 72796 - DNA, 16 bp, H. sapiens
ccaagctgggactaca

SEQ ID NO: 72797 - DNA, 16 bp, H. sapiens
ccaagctgggtgtggt

SEQ ID NO: 72798 - DNA, 16 bp, H. sapiens
ccaagctggtctccaa

SEQ ID NO: 72799 - DNA, 16 bp, H. sapiens
ccaagctgtgccccga

SEQ ID NO: 72800 - DNA, 16 bp, H. sapiens
ccaaggaaagaggcct

SEQ ID NO: 72801 - DNA, 16 bp, H. sapiens
ccaaggaaagccatga

SEQ ID NO: 72802 - DNA, 16 bp, H. sapiens
ccaaggaaatgaaaga

SEQ ID NO: 72803 - DNA, 16 bp, H. sapiens
ccaaggaaatggaaaa

SEQ ID NO: 72804 - DNA, 16 bp, H. sapiens
ccaaggaagccaaaag

SEQ ID NO: 72805 - DNA, 16 bp, H. sapiens
ccaaggaagctaaaaa

SEQ ID NO: 72806 - DNA, 16 bp, H. sapiens
ccaaggaatgcagaca

SEQ ID NO: 72807 - DNA, 16 bp, H. sapiens
ccaaggaatgccagga

SEQ ID NO: 72808 - DNA, 16 bp, H. sapiens
ccaaggacaaagaagt

SEQ ID NO: 72809 - DNA, 16 bp, H. sapiens
ccaaggacaggccata

SEQ ID NO: 72810 - DNA, 16 bp, H. sapiens
ccaaggacatgaactc

SEQ ID NO: 72811 - DNA, 16 bp, H. sapiens
ccaaggaccagcagca

SEQ ID NO: 72812 - DNA, 16 bp, H. sapiens
ccaaggagagggagag

SEQ ID NO: 72813 - DNA, 16 bp, H. sapiens
ccaaggagatgaaaga

SEQ ID NO: 72814 - DNA, 16 bp, H. sapiens
ccaaggagatgggaga

SEQ ID NO: 72815 - DNA, 16 bp, H. sapiens
ccaaggagcccagcaa

SEQ ID NO: 72816 - DNA, 16 bp, H. sapiens
ccaaggagctctccat

SEQ ID NO: 72817 - DNA, 16 bp, H. sapiens
ccaaggagctgagatt

SEQ ID NO: 72818 - DNA, 16 bp, H. sapiens
ccaaggagctgggatc

SEQ ID NO: 72819 - DNA, 16 bp, H. sapiens
ccaaggaggtgaaagg

SEQ ID NO: 72820 - DNA, 16 bp, H. sapiens
ccaaggaggtggaggt

SEQ ID NO: 72821 - DNA, 16 bp, H. sapiens
ccaaggagtttgagac

SEQ ID NO: 72822 - DNA, 16 bp, H. sapiens
ccaaggatgtgaaaga

SEQ ID NO: 72823 - DNA, 16 bp, H. sapiens
ccaaggattgctggca

SEQ ID NO: 72824 - DNA, 16 bp, H. sapiens
ccaaggcaaccctaag

SEQ ID NO: 72825 - DNA, 16 bp, H. sapiens
ccaaggcacataattg

SEQ ID NO: 72826 - DNA, 16 bp, H. sapiens
ccaaggcagccaagcc

SEQ ID NO: 72827 - DNA, 16 bp, H. sapiens
ccaaggcaggaggacc

SEQ ID NO: 72828 - DNA, 16 bp, H. sapiens
ccaaggcaggtagatt

SEQ ID NO: 72829 - DNA, 16 bp, H. sapiens
ccaaggcaggtggagc

SEQ ID NO: 72830 - DNA, 16 bp, H. sapiens
ccaaggcaggtggatt

SEQ ID NO: 72831 - DNA, 16 bp, H. sapiens
ccaaggccacacagct

SEQ ID NO: 72832 - DNA, 16 bp, H. sapiens
ccaaggccacagagct

SEQ ID NO: 72833 - DNA, 16 bp, H. sapiens
ccaaggccagagccag

SEQ ID NO: 72834 - DNA, 16 bp, H. sapiens
ccaaggccagggccag

SEQ ID NO: 72835 - DNA, 16 bp, H. sapiens
ccaaggccccaccaga

SEQ ID NO: 72836 - DNA, 16 bp, H. sapiens
ccaaggccctggtggc

SEQ ID NO: 72837 - DNA, 16 bp, H. sapiens
ccaaggccggtggatc

SEQ ID NO: 72838 - DNA, 16 bp, H. sapiens
ccaaggccttgggaga

SEQ ID NO: 72839 - DNA, 16 bp, H. sapiens
ccaaggccttgggagc

SEQ ID NO: 72840 - DNA, 16 bp, H. sapiens
ccaaggcgagtggatt

SEQ ID NO: 72841 - DNA, 16 bp, H. sapiens
ccaaggcgggcagatt

SEQ ID NO: 72842 - DNA, 16 bp, H. sapiens
ccaaggcgggtagatc

SEQ ID NO: 72843 - DNA, 16 bp, H. sapiens
ccaaggcgggtggata

SEQ ID NO: 72844 - DNA, 17 bp, H. sapiens
ccaaggcgggtggatcg

SEQ ID NO: 72845 - DNA, 17 bp, H. sapiens
ccaaggctcgagaacta

SEQ ID NO: 72846 - DNA, 16 bp, H. sapiens
ccaaggctgagaacca

SEQ ID NO: 72847 - DNA, 16 bp, H. sapiens
ccaaggctgcacaaag

SEQ ID NO: 72848 - DNA, 16 bp, H. sapiens
ccaaggctggaatgca

SEQ ID NO: 72849 - DNA, 16 bp, H. sapiens
ccaaggctggagtgca

SEQ ID NO: 72850 - DNA, 16 bp, H. sapiens
ccaaggctgtgcaggg

SEQ ID NO: 72851 - DNA, 16 bp, H. sapiens
ccaaggctttgggcag

SEQ ID NO: 72852 - DNA, 16 bp, H. sapiens
ccaagggaacagatgc

SEQ ID NO: 72853 - DNA, 16 bp, H. sapiens
ccaagggaagcagtga

SEQ ID NO: 72854 - DNA, 16 bp, H. sapiens
ccaagggcgagccagg

SEQ ID NO: 72855 - DNA, 16 bp, H. sapiens
ccaaggggagaggcct

SEQ ID NO: 72856 - DNA, 16 bp, H. sapiens
ccaaggggatagtgct

SEQ ID NO: 72857 - DNA, 16 bp, H. sapiens
ccaaggggcagccaga

SEQ ID NO: 72858 - DNA, 16 bp, H. sapiens
ccaagggtgagccagg

SEQ ID NO: 72859 - DNA, 16 bp, H. sapiens
ccaaggtcaaggtgct

SEQ ID NO: 72860 - DNA, 16 bp, H. sapiens
ccaaggtcacacaact

SEQ ID NO: 72861 - DNA, 16 bp, H. sapiens
ccaaggtcacagagca

SEQ ID NO: 72862 - DNA, 16 bp, H. sapiens
ccaaggtcacatagct

SEQ ID NO: 72863 - DNA, 16 bp, H. sapiens
ccaaggtcacccagca

SEQ ID NO: 72864 - DNA, 16 bp, H. sapiens
ccaaggtcatacagct

SEQ ID NO: 72865 - DNA, 16 bp, H. sapiens
ccaaggtctcttcagt

SEQ ID NO: 72866 - DNA, 16 bp, H. sapiens
ccaaggtgatggtatt

SEQ ID NO: 72867 - DNA, 16 bp, H. sapiens
ccaaggtggaagaatc

SEQ ID NO: 72868 - DNA, 16 bp, H. sapiens
ccaaggtggagaaacc

SEQ ID NO: 72869 - DNA, 16 bp, H. sapiens
ccaaggtggctggatc

SEQ ID NO: 72870 - DNA, 16 bp, H. sapiens
ccaaggtgggaagatt

SEQ ID NO: 72871 - DNA, 16 bp, H. sapiens
ccaaggtgggcagatt

SEQ ID NO: 72872 - DNA, 16 bp, H. sapiens
ccaaggtgggtggatt

SEQ ID NO: 72873 - DNA, 16 bp, H. sapiens
ccaaggttgaaataaa

SEQ ID NO: 72874 - DNA, 16 bp, H. sapiens
ccaaggttgaaatgaa

SEQ ID NO: 72875 - DNA, 16 bp, H. sapiens
ccaaggttgcagtgag

SEQ ID NO: 72876 - DNA, 16 bp, H. sapiens
ccaagtaagatgaact

SEQ ID NO: 72877 - DNA, 16 bp, H. sapiens
ccaagtagaatttatt

SEQ ID NO: 72878 - DNA, 16 bp, H. sapiens
ccaagtagccaaagca

SEQ ID NO: 72879 - DNA, 16 bp, H. sapiens
ccaagtagctaaaact

SEQ ID NO: 72880 - DNA, 16 bp, H. sapiens
ccaagtagctgggaaa

SEQ ID NO: 72881 - DNA, 16 bp, H. sapiens
ccaagtagctgggagc

SEQ ID NO: 72882 - DNA, 16 bp, H. sapiens
ccaagtatctgggact

SEQ ID NO: 72883 - DNA, 16 bp, H. sapiens
ccaagtcaaaaccaaa

SEQ ID NO: 72884 - DNA, 18 bp, H. sapiens
ccaagtcaatcctaagcc

SEQ ID NO: 72885 - DNA, 16 bp, H. sapiens
ccaagtccctgggctg

SEQ ID NO: 72886 - DNA, 16 bp, H. sapiens
ccaagtctctctctgt

SEQ ID NO: 72887 - DNA, 16 bp, H. sapiens
ccaagtgctaggatta

SEQ ID NO: 72888 - DNA, 16 bp, H. sapiens
ccaagtgctgagatta

SEQ ID NO: 72889 - DNA, 16 bp, H. sapiens
ccaagtgctggaatta

SEQ ID NO: 72890 - DNA, 16 bp, H. sapiens
ccaagtgctgggacta

SEQ ID NO: 72891 - DNA, 16 bp, H. sapiens
ccaagtgctgggatga

SEQ ID NO: 72892 - DNA, 16 bp, H. sapiens
ccaagtgctgggatta

SEQ ID NO: 72893 - DNA, 16 bp, H. sapiens
ccaagtggatatttag

SEQ ID NO: 72894 - DNA, 16 bp, H. sapiens
ccaagtggccagagaa

SEQ ID NO: 72895 - DNA, 21 bp, H. sapiens
ccaagtgggcttcatccctgg

SEQ ID NO: 72896 - DNA, 16 bp, H. sapiens
ccaagtggggaggatc

SEQ ID NO: 72897 - DNA, 16 bp, H. sapiens
ccaagtgtcccctggg

SEQ ID NO: 72898 - DNA, 16 bp, H. sapiens
ccaagtgtggtggtgg

SEQ ID NO: 72899 - DNA, 16 bp, H. sapiens
ccaagttactcaggag

SEQ ID NO: 72900 - DNA, 16 bp, H. sapiens
ccaagttattaggaaa

SEQ ID NO: 72901 - DNA, 16 bp, H. sapiens
ccaagttcaagccatt

SEQ ID NO: 72902 - DNA, 16 bp, H. sapiens
ccaagttcattctttt

SEQ ID NO: 72903 - DNA, 16 bp, H. sapiens
ccaagttcttgtctca

SEQ ID NO: 72904 - DNA, 16 bp, H. sapiens
ccaagttgcagggtcc

SEQ ID NO: 72905 - DNA, 16 bp, H. sapiens
ccaagtttgcattttc

SEQ ID NO: 72906 - DNA, 16 bp, H. sapiens
ccaagttttaaattgt

SEQ ID NO: 72907 - DNA, 16 bp, H. sapiens
ccaagttttggccaat

SEQ ID NO: 72908 - DNA, 16 bp, H. sapiens
ccaataaaacttattt

SEQ ID NO: 72909 - DNA, 16 bp, H. sapiens
ccaataaatatttgtt

SEQ ID NO: 72910 - DNA, 16 bp, H. sapiens
ccaataaccttgatga

SEQ ID NO: 72911 - DNA, 16 bp, H. sapiens
ccaataagaggctctg

SEQ ID NO: 72912 - DNA, 16 bp, H. sapiens
ccaataatgagtaata

SEQ ID NO: 72913 - DNA, 16 bp, H. sapiens
ccaatacatttctgtt

SEQ ID NO: 72914 - DNA, 16 bp, H. sapiens
ccaataccacactgcc

SEQ ID NO: 72915 - DNA, 16 bp, H. sapiens
ccaatactattttgaa

SEQ ID NO: 72916 - DNA, 16 bp, H. sapiens
ccaatagaaaaatggg

SEQ ID NO: 72917 - DNA, 16 bp, H. sapiens
ccaataggaagagagg

SEQ ID NO: 72918 - DNA, 16 bp, H. sapiens
ccaatatatggtgctg

SEQ ID NO: 72919 - DNA, 16 bp, H. sapiens
ccaatatccttgaaga

SEQ ID NO: 72920 - DNA, 16 bp, H. sapiens
ccaatatctcttatga

SEQ ID NO: 72921 - DNA, 16 bp, H. sapiens
ccaatatggtagccat

SEQ ID NO: 72922 - DNA, 16 bp, H. sapiens
ccaatattgacacatt

SEQ ID NO: 72923 - DNA, 16 bp, H. sapiens
ccaatattttgctatt

SEQ ID NO: 72924 - DNA, 16 bp, H. sapiens
ccaatcaatcaatcaa

SEQ ID NO: 72925 - DNA, 16 bp, H. sapiens
ccaatcaccttcctcc

SEQ ID NO: 72926 - DNA, 16 bp, H. sapiens
ccaatcactaatcaat

SEQ ID NO: 72927 - DNA, 16 bp, H. sapiens
ccaatcactgtggcca

SEQ ID NO: 72928 - DNA, 16 bp, H. sapiens
ccaatcagaaagacat

SEQ ID NO: 72929 - DNA, 16 bp, H. sapiens
ccaatcagaactcagc

SEQ ID NO: 72930 - DNA, 19 bp, H. sapiens
ccaatcagcaggatgtggg

SEQ ID NO: 72931 - DNA, 16 bp, H. sapiens
ccaatcagcatgcact

SEQ ID NO: 72932 - DNA, 16 bp, H. sapiens
ccaatcagctctctgt

SEQ ID NO: 72933 - DNA, 16 bp, H. sapiens
ccaatcccctgagccc

SEQ ID NO: 72934 - DNA, 16 bp, H. sapiens
ccaatctgaaaaggct

SEQ ID NO: 72935 - DNA, 16 bp, H. sapiens
ccaatgaagaaattaa

SEQ ID NO: 72936 - DNA, 16 bp, H. sapiens
ccaatgaaggctgtga

SEQ ID NO: 72937 - DNA, 16 bp, H. sapiens
ccaatgaggaaactga

SEQ ID NO: 72938 - DNA, 16 bp, H. sapiens
ccaatgcaaaatgaaa

SEQ ID NO: 72939 - DNA, 16 bp, H. sapiens
ccaatgccatccctcc

SEQ ID NO: 72940 - DNA, 16 bp, H. sapiens
ccaatgcctggcacac

SEQ ID NO: 72941 - DNA, 16 bp, H. sapiens
ccaatggaatattatt

SEQ ID NO: 72942 - DNA, 16 bp, H. sapiens
ccaatggagctgaaaa

SEQ ID NO: 72943 - DNA, 16 bp, H. sapiens
ccaatggggcagtcaa

SEQ ID NO: 72944 - DNA, 16 bp, H. sapiens
ccaatggtggaaaagg

SEQ ID NO: 72945 - DNA, 16 bp, H. sapiens
ccaatgtcaacattag

SEQ ID NO: 72946 - DNA, 16 bp, H. sapiens
ccaatgtcatggagat

SEQ ID NO: 72947 - DNA, 16 bp, H. sapiens
ccaatgtgagaacctg

SEQ ID NO: 72948 - DNA, 16 bp, H. sapiens
ccaatgtgatggtatt

SEQ ID NO: 72949 - DNA, 16 bp, H. sapiens
ccaatgtggatgggca

SEQ ID NO: 72950 - DNA, 16 bp, H. sapiens
ccaatgtggctgtatt

SEQ ID NO: 72951 - DNA, 16 bp, H. sapiens
ccaatgtgtagtcttt

SEQ ID NO: 72952 - DNA, 16 bp, H. sapiens
ccaatgttaacatctt

SEQ ID NO: 72953 - DNA, 16 bp, H. sapiens
ccaattaaaaattttt

SEQ ID NO: 72954 - DNA, 16 bp, H. sapiens
ccaattaaaagacaaa

SEQ ID NO: 72955 - DNA, 16 bp, H. sapiens
ccaattaaacctgttt

SEQ ID NO: 72956 - DNA, 16 bp, H. sapiens
ccaattaaaccttttt

SEQ ID NO: 72957 - DNA, 16 bp, H. sapiens
ccaattaataacctta

SEQ ID NO: 72958 - DNA, 16 bp, H. sapiens
ccaattatgtggttga

SEQ ID NO: 72959 - DNA, 16 bp, H. sapiens
ccaattctgggtatat

SEQ ID NO: 72960 - DNA, 16 bp, H. sapiens
ccaattcttctccaca

SEQ ID NO: 72961 - DNA, 16 bp, H. sapiens
ccaatttgaaaaggct

SEQ ID NO: 72962 - DNA, 16 bp, H. sapiens
ccaatttggaaaacat

SEQ ID NO: 72963 - DNA, 16 bp, H. sapiens
ccaatttggatagaac

SEQ ID NO: 72964 - DNA, 16 bp, H. sapiens
ccaattttcaacaaaa

SEQ ID NO: 72965 - DNA, 16 bp, H. sapiens
ccaattttccagtcat

SEQ ID NO: 72966 - DNA, 16 bp, H. sapiens
ccaattttggtggaaa

SEQ ID NO: 72967 - DNA, 16 bp, H. sapiens
ccaatttttcactatt

SEQ ID NO: 72968 - DNA, 16 bp, H. sapiens
ccaatttttgatcaat

SEQ ID NO: 72969 - DNA, 16 bp, H. sapiens
ccacaaaaaatgttaa

SEQ ID NO: 72970 - DNA, 16 bp, H. sapiens
ccacaaaaaattttta

SEQ ID NO: 72971 - DNA, 16 bp, H. sapiens
ccacaaaaggcagaaa

SEQ ID NO: 72972 - DNA, 19 bp, H. sapiens
ccacaaacaatagcatgag

SEQ ID NO: 72973 - DNA, 16 bp, H. sapiens
ccacaaaccaggtggc

SEQ ID NO: 72974 - DNA, 16 bp, H. sapiens
ccacaaagaaaatgaa

SEQ ID NO: 72975 - DNA, 16 bp, H. sapiens
ccacaaagagtcccca

SEQ ID NO: 72976 - DNA, 16 bp, H. sapiens
ccacaaagatactcct

SEQ ID NO: 72977 - DNA, 16 bp, H. sapiens
ccacaaagatattcct

SEQ ID NO: 72978 - DNA, 16 bp, H. sapiens
ccacaaataacatctc

SEQ ID NO: 72979 - DNA, 16 bp, H. sapiens
ccacaaatatttatta

SEQ ID NO: 72980 - DNA, 16 bp, H. sapiens
ccacaaatatttattt

SEQ ID NO: 72981 - DNA, 16 bp, H. sapiens
ccacaaatcctaaaat

SEQ ID NO: 72982 - DNA, 16 bp, H. sapiens
ccacaaatgctgctgc

SEQ ID NO: 72983 - DNA, 16 bp, H. sapiens
ccacaacacccagctg

SEQ ID NO: 72984 - DNA, 16 bp, H. sapiens
ccacaacacgtgggga

SEQ ID NO: 72985 - DNA, 16 bp, H. sapiens
ccacaacatttcctta

SEQ ID NO: 72986 - DNA, 16 bp, H. sapiens
ccacaacccctgcctc

SEQ ID NO: 72987 - DNA, 16 bp, H. sapiens
ccacaacctcagcctc

SEQ ID NO: 72988 - DNA, 16 bp, H. sapiens
ccacaacctcatcagc

SEQ ID NO: 72989 - DNA, 16 bp, H. sapiens
ccacaacctgtgcctc

SEQ ID NO: 72990 - DNA, 16 bp, H. sapiens
ccacaacttctgcctc

SEQ ID NO: 72991 - DNA, 16 bp, H. sapiens
ccacaagaatggccat

SEQ ID NO: 72992 - DNA, 16 bp, H. sapiens
ccacaagaggaagcag

SEQ ID NO: 72993 - DNA, 16 bp, H. sapiens
ccacaagcacaggaaa

SEQ ID NO: 72994 - DNA, 16 bp, H. sapiens
ccacaagccaaggaac

SEQ ID NO: 72995 - DNA, 16 bp, H. sapiens
ccacaagctgggtggc

SEQ ID NO: 72996 - DNA, 16 bp, H. sapiens
ccacaagtcaaggaac

SEQ ID NO: 72997 - DNA, 21 bp, H. sapiens
ccacaatgagataccatctca

SEQ ID NO: 72998 - DNA, 16 bp, H. sapiens
ccacaatgagattcca

SEQ ID NO: 72999 - DNA, 18 bp, H. sapiens
ccacaatgcccggctaat

SEQ ID NO: 73000 - DNA, 16 bp, H. sapiens
ccacaatggttcaact

SEQ ID NO: 73001 - DNA, 16 bp, H. sapiens
ccacacacacaggcac

SEQ ID NO: 73002 - DNA, 16 bp, H. sapiens
ccacacacatgcacac

SEQ ID NO: 73003 - DNA, 16 bp, H. sapiens
ccacacacatttatta

SEQ ID NO: 73004 - DNA, 16 bp, H. sapiens
ccacacaccttggcct

SEQ ID NO: 73005 - DNA, 16 bp, H. sapiens
ccacacagaactgtga

SEQ ID NO: 73006 - DNA, 16 bp, H. sapiens
ccacacagatgggacg

SEQ ID NO: 73007 - DNA, 16 bp, H. sapiens
ccacacagcactgcct

SEQ ID NO: 73008 - DNA, 16 bp, H. sapiens
ccacacagcagccaaa

SEQ ID NO: 73009 - DNA, 16 bp, H. sapiens
ccacacagcaggtgag

SEQ ID NO: 73010 - DNA, 16 bp, H. sapiens
ccacacagccccagct

SEQ ID NO: 73011 - DNA, 16 bp, H. sapiens
ccacacagtcttccac

SEQ ID NO: 73012 - DNA, 16 bp, H. sapiens
ccacacatctacaacc

SEQ ID NO: 73013 - DNA, 16 bp, H. sapiens
ccacaccagcctcctt

SEQ ID NO: 73014 - DNA, 16 bp, H. sapiens
ccacaccattttatat

SEQ ID NO: 73015 - DNA, 16 bp, H. sapiens
ccacacccacctaatt

SEQ ID NO: 73016 - DNA, 16 bp, H. sapiens
ccacacccagccactg

SEQ ID NO: 73017 - DNA, 16 bp, H. sapiens
ccacacccagccagct

SEQ ID NO: 73018 - DNA, 16 bp, H. sapiens
ccacacccagcccatc

SEQ ID NO: 73019 - DNA, 16 bp, H. sapiens
ccacacccagcccatg

SEQ ID NO: 73020 - DNA, 16 bp, H. sapiens
ccacacccagcccctg

SEQ ID NO: 73021 - DNA, 16 bp, H. sapiens
ccacacccagccctgc

SEQ ID NO: 73022 - DNA, 16 bp, H. sapiens
ccacacccagcccttc

SEQ ID NO: 73023 - DNA, 16 bp, H. sapiens
ccacacccagcctaat

SEQ ID NO: 73024 - DNA, 16 bp, H. sapiens
ccacacccagcctacc

SEQ ID NO: 73025 - DNA, 16 bp, H. sapiens
ccacacccagcctaga

SEQ ID NO: 73026 - DNA, 16 bp, H. sapiens
ccacacccagcctcag

SEQ ID NO: 73027 - DNA, 16 bp, H. sapiens
ccacacccagcctctt

SEQ ID NO: 73028 - DNA, 16 bp, H. sapiens
ccacacccagcctgca

SEQ ID NO: 73029 - DNA, 16 bp, H. sapiens
ccacacccagcctgga

SEQ ID NO: 73030 - DNA, 16 bp, H. sapiens
ccacacccagcctggt

SEQ ID NO: 73031 - DNA, 16 bp, H. sapiens
ccacacccagccttct

SEQ ID NO: 73032 - DNA, 16 bp, H. sapiens
ccacacccagctaata

SEQ ID NO: 73033 - DNA, 16 bp, H. sapiens
ccacacccagctcagc

SEQ ID NO: 73034 - DNA, 16 bp, H. sapiens
ccacacccagctggct

SEQ ID NO: 73035 - DNA, 16 bp, H. sapiens
ccacacccaggcagat

SEQ ID NO: 73036 - DNA, 16 bp, H. sapiens
ccacacccaggtgatt

SEQ ID NO: 73037 - DNA, 16 bp, H. sapiens
ccacacccatttattt

SEQ ID NO: 73038 - DNA, 16 bp, H. sapiens
ccacacccgactaatt

SEQ ID NO: 73039 - DNA, 16 bp, H. sapiens
ccacacccggcccctt

SEQ ID NO: 73040 - DNA, 16 bp, H. sapiens
ccacacccggcctgca

SEQ ID NO: 73041 - DNA, 16 bp, H. sapiens
ccacacccggcctggt

SEQ ID NO: 73042 - DNA, 16 bp, H. sapiens
ccacacccggccttct

SEQ ID NO: 73043 - DNA, 16 bp, H. sapiens
ccacacccggcctttt

SEQ ID NO: 73044 - DNA, 16 bp, H. sapiens
ccacaccctctccagc

SEQ ID NO: 73045 - DNA, 16 bp, H. sapiens
ccacaccggggctgca

SEQ ID NO: 73046 - DNA, 16 bp, H. sapiens
ccacacctgaccccca

SEQ ID NO: 73047 - DNA, 16 bp, H. sapiens
ccacacctggccagga

SEQ ID NO: 73048 - DNA, 16 bp, H. sapiens
ccacacctggccatcc

SEQ ID NO: 73049 - DNA, 16 bp, H. sapiens
ccacacctggcccagt

SEQ ID NO: 73050 - DNA, 16 bp, H. sapiens
ccacacctggcccatg

SEQ ID NO: 73051 - DNA, 16 bp, H. sapiens
ccacacctggccctgc

SEQ ID NO: 73052 - DNA, 16 bp, H. sapiens
ccacacctggccctgt

SEQ ID NO: 73053 - DNA, 16 bp, H. sapiens
ccacacctggcctcca

SEQ ID NO: 73054 - DNA, 16 bp, H. sapiens
ccacacctggcctgca

SEQ ID NO: 73055 - DNA, 16 bp, H. sapiens
ccacacctggcctgga

SEQ ID NO: 73056 - DNA, 16 bp, H. sapiens
ccacacctggcctggg

SEQ ID NO: 73057 - DNA, 16 bp, H. sapiens
ccacacctggccttaa

SEQ ID NO: 73058 - DNA, 16 bp, H. sapiens
ccacactccagtctgg

SEQ ID NO: 73059 - DNA, 16 bp, H. sapiens
ccacactgaccatcca

SEQ ID NO: 73060 - DNA, 16 bp, H. sapiens
ccacactgaggaactg

SEQ ID NO: 73061 - DNA, 16 bp, H. sapiens
ccacactgccttccac

SEQ ID NO: 73062 - DNA, 16 bp, H. sapiens
ccacactggaaggttg

SEQ ID NO: 73063 - DNA, 16 bp, H. sapiens
ccacactgggagagaa

SEQ ID NO: 73064 - DNA, 16 bp, H. sapiens
ccacactgtcaacatt

SEQ ID NO: 73065 - DNA, 17 bp, H. sapiens
ccacactgtcttccaca

SEQ ID NO: 73066 - DNA, 17 bp, H. sapiens
ccacactgtcttccgca

SEQ ID NO: 73067 - DNA, 16 bp, H. sapiens
ccacactgtggaagct

SEQ ID NO: 73068 - DNA, 16 bp, H. sapiens
ccacactgttttctac

SEQ ID NO: 73069 - DNA, 16 bp, H. sapiens
ccacactttcctgtct

SEQ ID NO: 73070 - DNA, 16 bp, H. sapiens
ccacactttgagacaa

SEQ ID NO: 73071 - DNA, 16 bp, H. sapiens
ccacactttgggaagc

SEQ ID NO: 73072 - DNA, 16 bp, H. sapiens
ccacactttgggaggc

SEQ ID NO: 73073 - DNA, 16 bp, H. sapiens
ccacagaactctccac

SEQ ID NO: 73074 - DNA, 16 bp, H. sapiens
ccacagaagaaaacct

SEQ ID NO: 73075 - DNA, 16 bp, H. sapiens
ccacagaagacccaga

SEQ ID NO: 73076 - DNA, 16 bp, H. sapiens
ccacagaagaccccaa

SEQ ID NO: 73077 - DNA, 16 bp, H. sapiens
ccacagaaggggagaa

SEQ ID NO: 73078 - DNA, 16 bp, H. sapiens
ccacagaataagagaa

SEQ ID NO: 73079 - DNA, 16 bp, H. sapiens
ccacagaatgtgacct

SEQ ID NO: 73080 - DNA, 16 bp, H. sapiens
ccacagacatgcacca

SEQ ID NO: 73081 - DNA, 16 bp, H. sapiens
ccacagacatgtacca

SEQ ID NO: 73082 - DNA, 16 bp, H. sapiens
ccacagaccagcagca

SEQ ID NO: 73083 - DNA, 16 bp, H. sapiens
ccacagaccaggagat

SEQ ID NO: 73084 - DNA, 16 bp, H. sapiens
ccacagaccctttgaa

SEQ ID NO: 73085 - DNA, 16 bp, H. sapiens
ccacagaccttcacag

SEQ ID NO: 73086 - DNA, 16 bp, H. sapiens
ccacagactgggaaaa

SEQ ID NO: 73087 - DNA, 16 bp, H. sapiens
ccacagactgggaggc

SEQ ID NO: 73088 - DNA, 16 bp, H. sapiens
ccacagactgggtagc

SEQ ID NO: 73089 - DNA, 16 bp, H. sapiens
ccacagagaagacagg

SEQ ID NO: 73090 - DNA, 16 bp, H. sapiens
ccacagagatactcct

SEQ ID NO: 73091 - DNA, 16 bp, H. sapiens
ccacagagcaagactc

SEQ ID NO: 73092 - DNA, 16 bp, H. sapiens
ccacagagcctggcct

SEQ ID NO: 73093 - DNA, 16 bp, H. sapiens
ccacagaggatgctca

SEQ ID NO: 73094 - DNA, 16 bp, H. sapiens
ccacagaggctgaact

SEQ ID NO: 73095 - DNA, 16 bp, H. sapiens
ccacagagggcgagcc

SEQ ID NO: 73096 - DNA, 16 bp, H. sapiens
ccacagaggtttctgg

SEQ ID NO: 73097 - DNA, 16 bp, H. sapiens
ccacagatcagaaacc

SEQ ID NO: 73098 - DNA, 16 bp, H. sapiens
ccacagatcagaagat

SEQ ID NO: 73099 - DNA, 16 bp, H. sapiens
ccacagcaaaataaaa

SEQ ID NO: 73100 - DNA, 16 bp, H. sapiens
ccacagcaagacccac

SEQ ID NO: 73101 - DNA, 16 bp, H. sapiens
ccacagcaccaggcct

SEQ ID NO: 73102 - DNA, 16 bp, H. sapiens
ccacagcacccagctt

SEQ ID NO: 73103 - DNA, 16 bp, H. sapiens
ccacagcacccaggct

SEQ ID NO: 73104 - DNA, 16 bp, H. sapiens
ccacagcacccggccg

SEQ ID NO: 73105 - DNA, 16 bp, H. sapiens
ccacagcactacagcc

SEQ ID NO: 73106 - DNA, 16 bp, H. sapiens
ccacagcactccaacc

SEQ ID NO: 73107 - DNA, 16 bp, H. sapiens
ccacagcagccacagc

SEQ ID NO: 73108 - DNA, 16 bp, H. sapiens
ccacagcagccttgct

SEQ ID NO: 73109 - DNA, 16 bp, H. sapiens
ccacagcaggataggg

SEQ ID NO: 73110 - DNA, 16 bp, H. sapiens
ccacagcagtccccag

SEQ ID NO: 73111 - DNA, 16 bp, H. sapiens
ccacagccaacaccat

SEQ ID NO: 73112 - DNA, 16 bp, H. sapiens
ccacagccacagaact

SEQ ID NO: 73113 - DNA, 16 bp, H. sapiens
ccacagccagcatcat

SEQ ID NO: 73114 - DNA, 16 bp, H. sapiens
ccacagcccatctccc

SEQ ID NO: 73115 - DNA, 16 bp, H. sapiens
ccacagccctgcccct

SEQ ID NO: 73116 - DNA, 16 bp, H. sapiens
ccacagccctgtgagg

SEQ ID NO: 73117 - DNA, 16 bp, H. sapiens
ccacagccgccccttc

SEQ ID NO: 73118 - DNA, 16 bp, H. sapiens
ccacagcctcaccagc

SEQ ID NO: 73119 - DNA, 16 bp, H. sapiens
ccacagcctcagcctc

SEQ ID NO: 73120 - DNA, 16 bp, H. sapiens
ccacagcctcatcagc

SEQ ID NO: 73121 - DNA, 16 bp, H. sapiens
ccacagcctccaactc

SEQ ID NO: 73122 - DNA, 16 bp, H. sapiens
ccacagcctccccagt

SEQ ID NO: 73123 - DNA, 16 bp, H. sapiens
ccacagcctcccgagt

SEQ ID NO: 73124 - DNA, 16 bp, H. sapiens
ccacagcctcctgggt

SEQ ID NO: 73125 - DNA, 16 bp, H. sapiens
ccacagcctctgcctc

SEQ ID NO: 73126 - DNA, 16 bp, H. sapiens
ccacagcctctgcctg

SEQ ID NO: 73127 - DNA, 16 bp, H. sapiens
ccacagcctgcctgtc

SEQ ID NO: 73128 - DNA, 16 bp, H. sapiens
ccacagcctgggtggc

SEQ ID NO: 73129 - DNA, 16 bp, H. sapiens
ccacagccttccaaag

SEQ ID NO: 73130 - DNA, 16 bp, H. sapiens
ccacagccttgacttc

SEQ ID NO: 73131 - DNA, 16 bp, H. sapiens
ccacagcgcccagtcc

SEQ ID NO: 73132 - DNA, 16 bp, H. sapiens
ccacagctcaaggagg

SEQ ID NO: 73133 - DNA, 16 bp, H. sapiens
ccacagctcagcaaag

SEQ ID NO: 73134 - DNA, 16 bp, H. sapiens
ccacagctcccagcca

SEQ ID NO: 73135 - DNA, 16 bp, H. sapiens
ccacagctgcagacct

SEQ ID NO: 73136 - DNA, 16 bp, H. sapiens
ccacagctgcagctgc

SEQ ID NO: 73137 - DNA, 16 bp, H. sapiens
ccacagctgccccttt

SEQ ID NO: 73138 - DNA, 16 bp, H. sapiens
ccacagctggagtggc

SEQ ID NO: 73139 - DNA, 16 bp, H. sapiens
ccacagctgtggctgc

SEQ ID NO: 73140 - DNA, 16 bp, H. sapiens
ccacagcttcccaagt

SEQ ID NO: 73141 - DNA, 16 bp, H. sapiens
ccacagcttcccatct

SEQ ID NO: 73142 - DNA, 16 bp, H. sapiens
ccacaggagaaagcaa

SEQ ID NO: 73143 - DNA, 16 bp, H. sapiens
ccacaggatgcccaga

SEQ ID NO: 73144 - DNA, 16 bp, H. sapiens
ccacaggcacatacca

SEQ ID NO: 73145 - DNA, 16 bp, H. sapiens
ccacaggccaaattca

SEQ ID NO: 73146 - DNA, 16 bp, H. sapiens
ccacaggccccatgca

SEQ ID NO: 73147 - DNA, 16 bp, H. sapiens
ccacaggccctggctg

SEQ ID NO: 73148 - DNA, 16 bp, H. sapiens
ccacaggcctctggaa

SEQ ID NO: 73149 - DNA, 16 bp, H. sapiens
ccacaggcctgtgcca

SEQ ID NO: 73150 - DNA, 16 bp, H. sapiens
ccacaggcgcacacca

SEQ ID NO: 73151 - DNA, 16 bp, H. sapiens
ccacaggctgcacagg

SEQ ID NO: 73152 - DNA, 16 bp, H. sapiens
ccacaggctgggtggc

SEQ ID NO: 73153 - DNA, 16 bp, H. sapiens
ccacagggacctctgc

SEQ ID NO: 73154 - DNA, 16 bp, H. sapiens
ccacagggagagagga

SEQ ID NO: 73155 - DNA, 16 bp, H. sapiens
ccacagggagaggctc

SEQ ID NO: 73156 - DNA, 16 bp, H. sapiens
ccacagggcagggcag

SEQ ID NO: 73157 - DNA, 16 bp, H. sapiens
ccacagggcctggcct

SEQ ID NO: 73158 - DNA, 16 bp, H. sapiens
ccacagggctgaggag

SEQ ID NO: 73159 - DNA, 16 bp, H. sapiens
ccacaggggaggagct

SEQ ID NO: 73160 - DNA, 16 bp, H. sapiens
ccacaggtgcctcacc

SEQ ID NO: 73161 - DNA, 16 bp, H. sapiens
ccacagtgaaacccca

SEQ ID NO: 73162 - DNA, 16 bp, H. sapiens
ccacagtgccaggcct

SEQ ID NO: 73163 - DNA, 16 bp, H. sapiens
ccacagtgcccagtcc

SEQ ID NO: 73164 - DNA, 16 bp, H. sapiens
ccacagtgcctggccc

SEQ ID NO: 73165 - DNA, 16 bp, H. sapiens
ccacagtggaaaacag

SEQ ID NO: 73166 - DNA, 16 bp, H. sapiens
ccacagtggcagagct

SEQ ID NO: 73167 - DNA, 16 bp, H. sapiens
ccacagtggctgcagc

SEQ ID NO: 73168 - DNA, 16 bp, H. sapiens
ccacagtgtgtgttgt

SEQ ID NO: 73169 - DNA, 16 bp, H. sapiens
ccacagtttatctgtt

SEQ ID NO: 73170 - DNA, 16 bp, H. sapiens
ccacataattggaagg

SEQ ID NO: 73171 - DNA, 16 bp, H. sapiens
ccacatataaatgaga

SEQ ID NO: 73172 - DNA, 16 bp, H. sapiens
ccacatatatatacac

SEQ ID NO: 73173 - DNA, 16 bp, H. sapiens
ccacatatgagtgaga

SEQ ID NO: 73174 - DNA, 16 bp, H. sapiens
ccacatccaagaagaa

SEQ ID NO: 73175 - DNA, 16 bp, H. sapiens
ccacatccacgccaac

SEQ ID NO: 73176 - DNA, 16 bp, H. sapiens
ccacatccataccaac

SEQ ID NO: 73177 - DNA, 16 bp, H. sapiens
ccacatcccaaagctg

SEQ ID NO: 73178 - DNA, 16 bp, H. sapiens
ccacatccccaccagc

SEQ ID NO: 73179 - DNA, 16 bp, H. sapiens
ccacatccctacaaag

SEQ ID NO: 73180 - DNA, 16 bp, H. sapiens
ccacatccctgccaac

SEQ ID NO: 73181 - DNA, 16 bp, H. sapiens
ccacatcctcaacaac

SEQ ID NO: 73182 - DNA, 16 bp, H. sapiens
ccacatcctctccaat

SEQ ID NO: 73183 - DNA, 16 bp, H. sapiens
ccacatcctggccagc

SEQ ID NO: 73184 - DNA, 16 bp, H. sapiens
ccacatcttagctatt

SEQ ID NO: 73185 - DNA, 16 bp, H. sapiens
ccacatcttcaccaac

SEQ ID NO: 73186 - DNA, 16 bp, H. sapiens
ccacatctttaaaatg

SEQ ID NO: 73187 - DNA, 16 bp, H. sapiens
ccacatgaagacagag

SEQ ID NO: 73188 - DNA, 16 bp, H. sapiens
ccacatgaatgtcttc

SEQ ID NO: 73189 - DNA, 16 bp, H. sapiens
ccacatgccttgccct

SEQ ID NO: 73190 - DNA, 16 bp, H. sapiens
ccacatggcaaaaccc

SEQ ID NO: 73191 - DNA, 16 bp, H. sapiens
ccacatgtcatggaag

SEQ ID NO: 73192 - DNA, 16 bp, H. sapiens
ccacatgtggcaagtg

SEQ ID NO: 73193 - DNA, 16 bp, H. sapiens
ccacatgtggcccatg

SEQ ID NO: 73194 - DNA, 16 bp, H. sapiens
ccacatgtggcctgtg

SEQ ID NO: 73195 - DNA, 16 bp, H. sapiens
ccacatgttcccactc

SEQ ID NO: 73196 - DNA, 16 bp, H. sapiens
ccacatgttctcactt

SEQ ID NO: 73197 - DNA, 16 bp, H. sapiens
ccacattcaaagccat

SEQ ID NO: 73198 - DNA, 16 bp, H. sapiens
ccacattcaaggggag

SEQ ID NO: 73199 - DNA, 16 bp, H. sapiens
ccacattctcaccacc

SEQ ID NO: 73200 - DNA, 16 bp, H. sapiens
ccacattctctccaac

SEQ ID NO: 73201 - DNA, 16 bp, H. sapiens
ccacattcttcacact

SEQ ID NO: 73202 - DNA, 16 bp, H. sapiens
ccacattggaagaaga

SEQ ID NO: 73203 - DNA, 16 bp, H. sapiens
ccacattgttttaatt

SEQ ID NO: 73204 - DNA, 16 bp, H. sapiens
ccacatttcaaatgct

SEQ ID NO: 73205 - DNA, 16 bp, H. sapiens
ccacatttcaagtgct

SEQ ID NO: 73206 - DNA, 16 bp, H. sapiens
ccacattttcttaatg

SEQ ID NO: 73207 - DNA, 16 bp, H. sapiens
ccacattttcttcatc

SEQ ID NO: 73208 - DNA, 16 bp, H. sapiens
ccacatttttactgta

SEQ ID NO: 73209 - DNA, 16 bp, H. sapiens
ccacatttttctgtct

SEQ ID NO: 73210 - DNA, 16 bp, H. sapiens
ccacatttttggatat

SEQ ID NO: 73211 - DNA, 16 bp, H. sapiens
ccaccaaaaccaagag

SEQ ID NO: 73212 - DNA, 16 bp, H. sapiens
ccaccaaaaccagtca

SEQ ID NO: 73213 - DNA, 16 bp, H. sapiens
ccaccaaatctggcta

SEQ ID NO: 73214 - DNA, 16 bp, H. sapiens
ccaccaacagatgaat

SEQ ID NO: 73215 - DNA, 16 bp, H. sapiens
ccaccaacaggccctg

SEQ ID NO: 73216 - DNA, 16 bp, H. sapiens
ccaccaaccctggcta

SEQ ID NO: 73217 - DNA, 16 bp, H. sapiens
ccaccaagatcaagtt

SEQ ID NO: 73218 - DNA, 16 bp, H. sapiens
ccaccaagcccagcta

SEQ ID NO: 73219 - DNA, 16 bp, H. sapiens
ccaccaagcctggctc

SEQ ID NO: 73220 - DNA, 16 bp, H. sapiens
ccaccaagctggagca

SEQ ID NO: 73221 - DNA, 16 bp, H. sapiens
ccaccaagtctatggt

SEQ ID NO: 73222 - DNA, 16 bp, H. sapiens
ccaccaagtctgtggt

SEQ ID NO: 73223 - DNA, 16 bp, H. sapiens
ccaccaatgcccagct

SEQ ID NO: 73224 - DNA, 17 bp, H. sapiens
ccaccacaaaagaagtg

SEQ ID NO: 73225 - DNA, 16 bp, H. sapiens
ccaccacaaccggcct

SEQ ID NO: 73226 - DNA, 16 bp, H. sapiens
ccaccacaataaagca

SEQ ID NO: 73227 - DNA, 16 bp, H. sapiens
ccaccacaatgcctgg

SEQ ID NO: 73228 - DNA, 16 bp, H. sapiens
ccaccacacacagcta

SEQ ID NO: 73229 - DNA, 16 bp, H. sapiens
ccaccacacatctgct

SEQ ID NO: 73230 - DNA, 16 bp, H. sapiens
ccaccacacatggcca

SEQ ID NO: 73231 - DNA, 16 bp, H. sapiens
ccaccacacatggctg

SEQ ID NO: 73232 - DNA, 16 bp, H. sapiens
ccaccacaccaggcta

SEQ ID NO: 73233 - DNA, 16 bp, H. sapiens
ccaccacaccccagct

SEQ ID NO: 73234 - DNA, 16 bp, H. sapiens
ccaccacacccggcta

SEQ ID NO: 73235 - DNA, 16 bp, H. sapiens
ccaccacaccctgcta

SEQ ID NO: 73236 - DNA, 16 bp, H. sapiens
ccaccacaccctggct

SEQ ID NO: 73237 - DNA, 16 bp, H. sapiens
ccaccacacctgacca

SEQ ID NO: 73238 - DNA, 16 bp, H. sapiens
ccaccacacctgacta

SEQ ID NO: 73239 - DNA, 16 bp, H. sapiens
ccaccacacctggcct

SEQ ID NO: 73240 - DNA, 16 bp, H. sapiens
ccaccacacctggctc

SEQ ID NO: 73241 - DNA, 16 bp, H. sapiens
ccaccacacctggctg

SEQ ID NO: 73242 - DNA, 16 bp, H. sapiens
ccaccacacctgggta

SEQ ID NO: 73243 - DNA, 16 bp, H. sapiens
ccaccacacgtggcct

SEQ ID NO: 73244 - DNA, 16 bp, H. sapiens
ccaccacactccagca

SEQ ID NO: 73245 - DNA, 16 bp, H. sapiens
ccaccacacttggcta

SEQ ID NO: 73246 - DNA, 16 bp, H. sapiens
ccaccacagccggcta

SEQ ID NO: 73247 - DNA, 16 bp, H. sapiens
ccaccacagcctccag

SEQ ID NO: 73248 - DNA, 16 bp, H. sapiens
ccaccacagctggcca

SEQ ID NO: 73249 - DNA, 16 bp, H. sapiens
ccaccacaggcctgaa

SEQ ID NO: 73250 - DNA, 16 bp, H. sapiens
ccaccacatccagcta

SEQ ID NO: 73251 - DNA, 16 bp, H. sapiens
ccaccacatccagctg

SEQ ID NO: 73252 - DNA, 16 bp, H. sapiens
ccaccacatccctgtt

SEQ ID NO: 73253 - DNA, 16 bp, H. sapiens
ccaccacatctggccc

SEQ ID NO: 73254 - DNA, 16 bp, H. sapiens
ccaccacatgaggaca

SEQ ID NO: 73255 - DNA, 16 bp, H. sapiens
ccaccacattccagcc

SEQ ID NO: 73256 - DNA, 16 bp, H. sapiens
ccaccaccacactcag

SEQ ID NO: 73257 - DNA, 16 bp, H. sapiens
ccaccaccacactggc

SEQ ID NO: 73258 - DNA, 16 bp, H. sapiens
ccaccaccaccacctg

SEQ ID NO: 73259 - DNA, 16 bp, H. sapiens
ccaccaccaccactgt

SEQ ID NO: 73260 - DNA, 16 bp, H. sapiens
ccaccaccaccatgga

SEQ ID NO: 73261 - DNA, 16 bp, H. sapiens
ccaccaccaccattat

SEQ ID NO: 73262 - DNA, 16 bp, H. sapiens
ccaccaccaccatttc

SEQ ID NO: 73263 - DNA, 16 bp, H. sapiens
ccaccaccacccctgg

SEQ ID NO: 73264 - DNA, 16 bp, H. sapiens
ccaccaccaccgtcac

SEQ ID NO: 73265 - DNA, 16 bp, H. sapiens
ccaccaccacgctggc

SEQ ID NO: 73266 - DNA, 16 bp, H. sapiens
ccaccaccactgccag

SEQ ID NO: 73267 - DNA, 16 bp, H. sapiens
ccaccaccactgggac

SEQ ID NO: 73268 - DNA, 16 bp, H. sapiens
ccaccaccaggcccag

SEQ ID NO: 73269 - DNA, 16 bp, H. sapiens
ccaccaccaggcctgg

SEQ ID NO: 73270 - DNA, 19 bp, H. sapiens
ccaccaccatacccagcta

SEQ ID NO: 73271 - DNA, 16 bp, H. sapiens
ccaccaccatcaccag

SEQ ID NO: 73272 - DNA, 16 bp, H. sapiens
ccaccaccatgatcca

SEQ ID NO: 73273 - DNA, 16 bp, H. sapiens
ccaccaccatgcccag

SEQ ID NO: 73274 - DNA, 26 bp, H. sapiens
ccaccaccatgcccggctaatttttg

SEQ ID NO: 73275 - DNA, 16 bp, H. sapiens
ccaccaccatgcctaa

SEQ ID NO: 73276 - DNA, 16 bp, H. sapiens
ccaccaccatggccag

SEQ ID NO: 73277 - DNA, 16 bp, H. sapiens
ccaccaccatggccgg

SEQ ID NO: 73278 - DNA, 16 bp, H. sapiens
ccaccaccattcccag

SEQ ID NO: 73279 - DNA, 16 bp, H. sapiens
ccaccaccccaggcct

SEQ ID NO: 73280 - DNA, 16 bp, H. sapiens
ccaccacccccagcta

SEQ ID NO: 73281 - DNA, 16 bp, H. sapiens
ccaccaccctgaccaa

SEQ ID NO: 73282 - DNA, 16 bp, H. sapiens
ccaccacctcacctgg

SEQ ID NO: 73283 - DNA, 16 bp, H. sapiens
ccaccacctctggcct

SEQ ID NO: 73284 - DNA, 18 bp, H. sapiens
ccaccacgaccagctaat

SEQ ID NO: 73285 - DNA, 20 bp, H. sapiens
ccaccacgaccagctaattt

SEQ ID NO: 73286 - DNA, 16 bp, H. sapiens
ccaccacgcccagctc

SEQ ID NO: 73287 - DNA, 16 bp, H. sapiens
ccaccacgcccagctt

SEQ ID NO: 73288 - DNA, 21 bp, H. sapiens
ccaccacgccccgctaatttt

SEQ ID NO: 73289 - DNA, 19 bp, H. sapiens
ccaccacgcccggctaatg

SEQ ID NO: 73290 - DNA, 16 bp, H. sapiens
ccaccacgcccggctg

SEQ ID NO: 73291 - DNA, 16 bp, H. sapiens
ccaccacgcccggctt

SEQ ID NO: 73292 - DNA, 16 bp, H. sapiens
ccaccacgccctgcta

SEQ ID NO: 73293 - DNA, 16 bp, H. sapiens
ccaccacgccgggcca

SEQ ID NO: 73294 - DNA, 16 bp, H. sapiens
ccaccacgcctggcaa

SEQ ID NO: 73295 - DNA, 16 bp, H. sapiens
ccaccacgcctggcca

SEQ ID NO: 73296 - DNA, 16 bp, H. sapiens
ccaccacgcctgggcc

SEQ ID NO: 73297 - DNA, 16 bp, H. sapiens
ccaccacgtccagctt

SEQ ID NO: 73298 - DNA, 18 bp, H. sapiens
ccaccacgtctggctaag

SEQ ID NO: 73299 - DNA, 16 bp, H. sapiens
ccaccacgtctggctc

SEQ ID NO: 73300 - DNA, 16 bp, H. sapiens
ccaccactcccagata

SEQ ID NO: 73301 - DNA, 16 bp, H. sapiens
ccaccactcccagcta

SEQ ID NO: 73302 - DNA, 16 bp, H. sapiens
ccaccactgcacccag

SEQ ID NO: 73303 - DNA, 16 bp, H. sapiens
ccaccactgccaccac

SEQ ID NO: 73304 - DNA, 16 bp, H. sapiens
ccaccactgcccagct

SEQ ID NO: 73305 - DNA, 16 bp, H. sapiens
ccaccactgcctggct

SEQ ID NO: 73306 - DNA, 16 bp, H. sapiens
ccaccactgctgctgc

SEQ ID NO: 73307 - DNA, 16 bp, H. sapiens
ccaccactggactctc

SEQ ID NO: 73308 - DNA, 16 bp, H. sapiens
ccaccactggcttcct

SEQ ID NO: 73309 - DNA, 16 bp, H. sapiens
ccaccactgtattttg

SEQ ID NO: 73310 - DNA, 16 bp, H. sapiens
ccaccactgtgcccag

SEQ ID NO: 73311 - DNA, 16 bp, H. sapiens
ccaccacttactagct

SEQ ID NO: 73312 - DNA, 16 bp, H. sapiens
ccaccagaagcaattt

SEQ ID NO: 73313 - DNA, 16 bp, H. sapiens
ccaccagaagcagttt

SEQ ID NO: 73314 - DNA, 16 bp, H. sapiens
ccaccagaaggaaaaa

SEQ ID NO: 73315 - DNA, 16 bp, H. sapiens
ccaccagagggcagca

SEQ ID NO: 73316 - DNA, 16 bp, H. sapiens
ccaccagatgccagga

SEQ ID NO: 73317 - DNA, 16 bp, H. sapiens
ccaccagcaagaagat

SEQ ID NO: 73318 - DNA, 16 bp, H. sapiens
ccaccagcaatgtgtg

SEQ ID NO: 73319 - DNA, 16 bp, H. sapiens
ccaccagcagtggatg

SEQ ID NO: 73320 - DNA, 16 bp, H. sapiens
ccaccagcatcaccac

SEQ ID NO: 73321 - DNA, 16 bp, H. sapiens
ccaccagcatcagcat

SEQ ID NO: 73322 - DNA, 16 bp, H. sapiens
ccaccagccccagcct

SEQ ID NO: 73323 - DNA, 16 bp, H. sapiens
ccaccagccctgggca

SEQ ID NO: 73324 - DNA, 16 bp, H. sapiens
ccaccagcctaggcct

SEQ ID NO: 73325 - DNA, 16 bp, H. sapiens
ccaccagcttcctccc

SEQ ID NO: 73326 - DNA, 16 bp, H. sapiens
ccaccaggactgcctt

SEQ ID NO: 73327 - DNA, 16 bp, H. sapiens
ccaccaggagacacaa

SEQ ID NO: 73328 - DNA, 16 bp, H. sapiens
ccaccaggcaccacct

SEQ ID NO: 73329 - DNA, 16 bp, H. sapiens
ccaccaggcccagctc

SEQ ID NO: 73330 - DNA, 16 bp, H. sapiens
ccaccaggccccagct

SEQ ID NO: 73331 - DNA, 16 bp, H. sapiens
ccaccaggcctgcctc

SEQ ID NO: 73332 - DNA, 16 bp, H. sapiens
ccaccaggccttacct

SEQ ID NO: 73333 - DNA, 16 bp, H. sapiens
ccaccaggctccacct

SEQ ID NO: 73334 - DNA, 16 bp, H. sapiens
ccaccagggctctggg

SEQ ID NO: 73335 - DNA, 16 bp, H. sapiens
ccaccagggggcagca

SEQ ID NO: 73336 - DNA, 16 bp, H. sapiens
ccaccaggtggcagca

SEQ ID NO: 73337 - DNA, 16 bp, H. sapiens
ccaccaggttcctccc

SEQ ID NO: 73338 - DNA, 16 bp, H. sapiens
ccaccagtcagaatgg

SEQ ID NO: 73339 - DNA, 16 bp, H. sapiens
ccaccagtccccacct

SEQ ID NO: 73340 - DNA, 16 bp, H. sapiens
ccaccatacccggcta

SEQ ID NO: 73341 - DNA, 16 bp, H. sapiens
ccaccatcaccaccag

SEQ ID NO: 73342 - DNA, 16 bp, H. sapiens
ccaccatcacctccag

SEQ ID NO: 73343 - DNA, 16 bp, H. sapiens
ccaccatcactgggac

SEQ ID NO: 73344 - DNA, 16 bp, H. sapiens
ccaccatccccagcca

SEQ ID NO: 73345 - DNA, 16 bp, H. sapiens
ccaccatccccagctg

SEQ ID NO: 73346 - DNA, 16 bp, H. sapiens
ccaccatccctggcca

SEQ ID NO: 73347 - DNA, 16 bp, H. sapiens
ccaccatcctcagctc

SEQ ID NO: 73348 - DNA, 16 bp, H. sapiens
ccaccatcctccagaa

SEQ ID NO: 73349 - DNA, 16 bp, H. sapiens
ccaccatgactgacta

SEQ ID NO: 73350 - DNA, 16 bp, H. sapiens
ccaccatgccagcctc

SEQ ID NO: 73351 - DNA, 16 bp, H. sapiens
ccaccatgccagcctg

SEQ ID NO: 73352 - DNA, 16 bp, H. sapiens
ccaccatgcccagcca

SEQ ID NO: 73353 - DNA, 16 bp, H. sapiens
ccaccatgcccagctc

SEQ ID NO: 73354 - DNA, 16 bp, H. sapiens
ccaccatgcccagctg

SEQ ID NO: 73355 - DNA, 16 bp, H. sapiens
ccaccatgcccagctt

SEQ ID NO: 73356 - DNA, 16 bp, H. sapiens
ccaccatgcccaggcc

SEQ ID NO: 73357 - DNA, 16 bp, H. sapiens
ccaccatgcccagtct

SEQ ID NO: 73358 - DNA, 16 bp, H. sapiens
ccaccatgcccggcac

SEQ ID NO: 73359 - DNA, 17 bp, H. sapiens
ccaccatgcccggctac

SEQ ID NO: 73360 - DNA, 16 bp, H. sapiens
ccaccatgcccggctc

SEQ ID NO: 73361 - DNA, 16 bp, H. sapiens
ccaccatgcccgggcc

SEQ ID NO: 73362 - DNA, 16 bp, H. sapiens
ccaccatgccctgcta

SEQ ID NO: 73363 - DNA, 16 bp, H. sapiens
ccaccatgccctgctg

SEQ ID NO: 73364 - DNA, 16 bp, H. sapiens
ccaccatgccctggcc

SEQ ID NO: 73365 - DNA, 16 bp, H. sapiens
ccaccatgcctagcca

SEQ ID NO: 73366 - DNA, 16 bp, H. sapiens
ccaccatgcctagccg

SEQ ID NO: 73367 - DNA, 16 bp, H. sapiens
ccaccatgcctgacta

SEQ ID NO: 73368 - DNA, 16 bp, H. sapiens
ccaccatgcgtggcta

SEQ ID NO: 73369 - DNA, 16 bp, H. sapiens
ccaccatgctcagcta

SEQ ID NO: 73370 - DNA, 16 bp, H. sapiens
ccaccatgcttggccc

SEQ ID NO: 73371 - DNA, 16 bp, H. sapiens
ccaccatgtgaagagg

SEQ ID NO: 73372 - DNA, 16 bp, H. sapiens
ccaccatgtggctgca

SEQ ID NO: 73373 - DNA, 16 bp, H. sapiens
ccaccattatagtatt

SEQ ID NO: 73374 - DNA, 16 bp, H. sapiens
ccaccattccactctg

SEQ ID NO: 73375 - DNA, 16 bp, H. sapiens
ccaccattcccagccc

SEQ ID NO: 73376 - DNA, 16 bp, H. sapiens
ccaccattgataggca

SEQ ID NO: 73377 - DNA, 16 bp, H. sapiens
ccaccattgtcatcat

SEQ ID NO: 73378 - DNA, 18 bp, H. sapiens
ccaccattgtgatttgtt

SEQ ID NO: 73379 - DNA, 16 bp, H. sapiens
ccaccattttgcctct

SEQ ID NO: 73380 - DNA, 16 bp, H. sapiens
ccacccaaatatcatc

SEQ ID NO: 73381 - DNA, 16 bp, H. sapiens
ccacccaaatgtcacc

SEQ ID NO: 73382 - DNA, 16 bp, H. sapiens
ccacccacactggcct

SEQ ID NO: 73383 - DNA, 16 bp, H. sapiens
ccacccaccaggttca

SEQ ID NO: 73384 - DNA, 16 bp, H. sapiens
ccacccacctcagact

SEQ ID NO: 73385 - DNA, 16 bp, H. sapiens
ccacccacctcaggct

SEQ ID NO: 73386 - DNA, 16 bp, H. sapiens
ccacccacctgggtct

SEQ ID NO: 73387 - DNA, 16 bp, H. sapiens
ccacccaccttggccc

SEQ ID NO: 73388 - DNA, 16 bp, H. sapiens
ccacccagactgaggg

SEQ ID NO: 73389 - DNA, 16 bp, H. sapiens
ccacccagactggagt

SEQ ID NO: 73390 - DNA, 16 bp, H. sapiens
ccacccagagaagcac

SEQ ID NO: 73391 - DNA, 16 bp, H. sapiens
ccacccagcagccaga

SEQ ID NO: 73392 - DNA, 16 bp, H. sapiens
ccacccagcccctggc

SEQ ID NO: 73393 - DNA, 16 bp, H. sapiens
ccacccaggagcagag

SEQ ID NO: 73394 - DNA, 16 bp, H. sapiens
ccacccaggatggagt

SEQ ID NO: 73395 - DNA, 16 bp, H. sapiens
ccacccaggcctccca

SEQ ID NO: 73396 - DNA, 16 bp, H. sapiens
ccacccaggctcaggt

SEQ ID NO: 73397 - DNA, 16 bp, H. sapiens
ccacccaggctgcagt

SEQ ID NO: 73398 - DNA, 16 bp, H. sapiens
ccacccaggttcaagc

SEQ ID NO: 73399 - DNA, 16 bp, H. sapiens
ccacccagtctgtgct

SEQ ID NO: 73400 - DNA, 16 bp, H. sapiens
ccacccagtgaggaag

SEQ ID NO: 73401 - DNA, 16 bp, H. sapiens
ccacccatatcctgct

SEQ ID NO: 73402 - DNA, 16 bp, H. sapiens
ccacccatatctcatc

SEQ ID NO: 73403 - DNA, 16 bp, H. sapiens
ccacccatccacccag

SEQ ID NO: 73404 - DNA, 16 bp, H. sapiens
ccacccatggctgccc

SEQ ID NO: 73405 - DNA, 16 bp, H. sapiens
ccacccatttcagcct

SEQ ID NO: 73406 - DNA, 16 bp, H. sapiens
ccaccccacctggcca

SEQ ID NO: 73407 - DNA, 16 bp, H. sapiens
ccaccccacgacaggc

SEQ ID NO: 73408 - DNA, 16 bp, H. sapiens
ccaccccacttggcct

SEQ ID NO: 73409 - DNA, 16 bp, H. sapiens
ccaccccagccagcag

SEQ ID NO: 73410 - DNA, 16 bp, H. sapiens
ccaccccagctccagc

SEQ ID NO: 73411 - DNA, 16 bp, H. sapiens
ccaccccagcttcctg

SEQ ID NO: 73412 - DNA, 16 bp, H. sapiens
ccaccccatctgagaa

SEQ ID NO: 73413 - DNA, 16 bp, H. sapiens
ccacccccagataatt

SEQ ID NO: 73414 - DNA, 16 bp, H. sapiens
ccacccccagccctag

SEQ ID NO: 73415 - DNA, 16 bp, H. sapiens
ccacccccaggatcca

SEQ ID NO: 73416 - DNA, 16 bp, H. sapiens
ccacccccaggcctgc

SEQ ID NO: 73417 - DNA, 16 bp, H. sapiens
ccacccccatgagcca

SEQ ID NO: 73418 - DNA, 16 bp, H. sapiens
ccaccccccaggttca

SEQ ID NO: 73419 - DNA, 16 bp, H. sapiens
ccaccccgcccagctg

SEQ ID NO: 73420 - DNA, 16 bp, H. sapiens
ccacccctgcagcaca

SEQ ID NO: 73421 - DNA, 16 bp, H. sapiens
ccacccctgccttttt

SEQ ID NO: 73422 - DNA, 16 bp, H. sapiens
ccacccctgtgtcttt

SEQ ID NO: 73423 - DNA, 16 bp, H. sapiens
ccaccccttccccagg

SEQ ID NO: 73424 - DNA, 16 bp, H. sapiens
ccacccctttccccag

SEQ ID NO: 73425 - DNA, 16 bp, H. sapiens
ccacccctttcccgga

SEQ ID NO: 73426 - DNA, 16 bp, H. sapiens
ccacccgagccagcag

SEQ ID NO: 73427 - DNA, 17 bp, H. sapiens
ccacccgccttgtcctc

SEQ ID NO: 73428 - DNA, 16 bp, H. sapiens
ccacccgcctttgcct

SEQ ID NO: 73429 - DNA, 16 bp, H. sapiens
ccaccctccaggaact

SEQ ID NO: 73430 - DNA, 16 bp, H. sapiens
ccaccctcccaggcac

SEQ ID NO: 73431 - DNA, 16 bp, H. sapiens
ccaccctcctgcctca

SEQ ID NO: 73432 - DNA, 16 bp, H. sapiens
ccaccctgaccaacat

SEQ ID NO: 73433 - DNA, 16 bp, H. sapiens
ccaccctgcaggctgc

SEQ ID NO: 73434 - DNA, 16 bp, H. sapiens
ccaccctgcccagcca

SEQ ID NO: 73435 - DNA, 16 bp, H. sapiens
ccaccctgcccagctc

SEQ ID NO: 73436 - DNA, 16 bp, H. sapiens
ccaccctgcccggcca

SEQ ID NO: 73437 - DNA, 16 bp, H. sapiens
ccaccctgccctgcca

SEQ ID NO: 73438 - DNA, 16 bp, H. sapiens
ccaccctgccctggcc

SEQ ID NO: 73439 - DNA, 16 bp, H. sapiens
ccaccctgcctgcctg

SEQ ID NO: 73440 - DNA, 16 bp, H. sapiens
ccaccctggacaacat

SEQ ID NO: 73441 - DNA, 16 bp, H. sapiens
ccaccctggatgacag

SEQ ID NO: 73442 - DNA, 16 bp, H. sapiens
ccaccctggccaagat

SEQ ID NO: 73443 - DNA, 16 bp, H. sapiens
ccaccctggcctccct

SEQ ID NO: 73444 - DNA, 16 bp, H. sapiens
ccaccctgggagacag

SEQ ID NO: 73445 - DNA, 16 bp, H. sapiens
ccaccctgggcaacaa

SEQ ID NO: 73446 - DNA, 16 bp, H. sapiens
ccaccctgggcaacgt

SEQ ID NO: 73447 - DNA, 16 bp, H. sapiens
ccaccctgggcctcag

SEQ ID NO: 73448 - DNA, 16 bp, H. sapiens
ccaccctgggctacag

SEQ ID NO: 73449 - DNA, 16 bp, H. sapiens
ccacccttccatccat

SEQ ID NO: 73450 - DNA, 16 bp, H. sapiens
ccacccttctctctgc

SEQ ID NO: 73451 - DNA, 16 bp, H. sapiens
ccaccctttccccaag

SEQ ID NO: 73452 - DNA, 16 bp, H. sapiens
ccaccctttcccccag

SEQ ID NO: 73453 - DNA, 16 bp, H. sapiens
ccaccctttggcacag

SEQ ID NO: 73454 - DNA, 16 bp, H. sapiens
ccaccgagcctggcca

SEQ ID NO: 73455 - DNA, 17 bp, H. sapiens
ccaccgcacccggcctc

SEQ ID NO: 73456 - DNA, 16 bp, H. sapiens
ccaccgcaccctgcta

SEQ ID NO: 73457 - DNA, 17 bp, H. sapiens
ccaccgcacctggcctt

SEQ ID NO: 73458 - DNA, 16 bp, H. sapiens
ccaccgcagcctccca

SEQ ID NO: 73459 - DNA, 16 bp, H. sapiens
ccaccgcatccagcct

SEQ ID NO: 73460 - DNA, 16 bp, H. sapiens
ccaccgcctcggcctc

SEQ ID NO: 73461 - DNA, 16 bp, H. sapiens
ccaccgcgcctggcta

SEQ ID NO: 73462 - DNA, 16 bp, H. sapiens
ccaccgcgctcggcct

SEQ ID NO: 73463 - DNA, 16 bp, H. sapiens
ccaccgctcccagctg

SEQ ID NO: 73464 - DNA, 16 bp, H. sapiens
ccaccgctcccggcct

SEQ ID NO: 73465 - DNA, 16 bp, H. sapiens
ccaccggaaggaacca

SEQ ID NO: 73466 - DNA, 16 bp, H. sapiens
ccaccggcctcggcct

SEQ ID NO: 73467 - DNA, 16 bp, H. sapiens
ccaccgtcaccaccac

SEQ ID NO: 73468 - DNA, 16 bp, H. sapiens
ccaccgtgcccaactg

SEQ ID NO: 73469 - DNA, 17 bp, H. sapiens
ccaccgtgcccagccaa

SEQ ID NO: 73470 - DNA, 17 bp, H. sapiens
ccaccgtgcccagccag

SEQ ID NO: 73471 - DNA, 16 bp, H. sapiens
ccaccgtgcccagctg

SEQ ID NO: 73472 - DNA, 16 bp, H. sapiens
ccaccgtgcccatccc

SEQ ID NO: 73473 - DNA, 16 bp, H. sapiens
ccaccgtgcctgacct

SEQ ID NO: 73474 - DNA, 18 bp, H. sapiens
ccaccgtgcctggccaaa

SEQ ID NO: 73475 - DNA, 19 bp, H. sapiens
ccaccgtgcctggcctaat

SEQ ID NO: 73476 - DNA, 17 bp, H. sapiens
ccaccgtgcctggcctt

SEQ ID NO: 73477 - DNA, 16 bp, H. sapiens
ccaccgtggcctccca

SEQ ID NO: 73478 - DNA, 16 bp, H. sapiens
ccaccgtggctggccc

SEQ ID NO: 73479 - DNA, 16 bp, H. sapiens
ccaccgtgtccagcta

SEQ ID NO: 73480 - DNA, 16 bp, H. sapiens
ccaccgtgtctggctg

SEQ ID NO: 73481 - DNA, 16 bp, H. sapiens
ccacctatgagtctgt

SEQ ID NO: 73482 - DNA, 16 bp, H. sapiens
ccacctcaaaaaaaag

SEQ ID NO: 73483 - DNA, 16 bp, H. sapiens
ccacctcaagaaaaaa

SEQ ID NO: 73484 - DNA, 16 bp, H. sapiens
ccacctcacccggcct

SEQ ID NO: 73485 - DNA, 16 bp, H. sapiens
ccacctcagccaccag

SEQ ID NO: 73486 - DNA, 16 bp, H. sapiens
ccacctcagccaccct

SEQ ID NO: 73487 - DNA, 16 bp, H. sapiens
ccacctcagccatcca

SEQ ID NO: 73488 - DNA, 16 bp, H. sapiens
ccacctcagcccccag

SEQ ID NO: 73489 - DNA, 16 bp, H. sapiens
ccacctcagcccctgg

SEQ ID NO: 73490 - DNA, 16 bp, H. sapiens
ccacctcagccctgca

SEQ ID NO: 73491 - DNA, 24 bp, H. sapiens
ccacctcagcctccagagtagctg

SEQ ID NO: 73492 - DNA, 16 bp, H. sapiens
ccacctcagcctccgg

SEQ ID NO: 73493 - DNA, 16 bp, H. sapiens
ccacctcagcctcttt

SEQ ID NO: 73494 - DNA, 16 bp, H. sapiens
ccacctcagcctgctg

SEQ ID NO: 73495 - DNA, 16 bp, H. sapiens
ccacctcagcctggac

SEQ ID NO: 73496 - DNA, 16 bp, H. sapiens
ccacctcagccttcca

SEQ ID NO: 73497 - DNA, 16 bp, H. sapiens
ccacctcagccttctg

SEQ ID NO: 73498 - DNA, 16 bp, H. sapiens
ccacctcagcgtcctg

SEQ ID NO: 73499 - DNA, 16 bp, H. sapiens
ccacctcagctgcctg

SEQ ID NO: 73500 - DNA, 16 bp, H. sapiens
ccacctcagcttccag

SEQ ID NO: 73501 - DNA, 16 bp, H. sapiens
ccacctcagcttccga

SEQ ID NO: 73502 - DNA, 16 bp, H. sapiens
ccacctcagtctacca

SEQ ID NO: 73503 - DNA, 16 bp, H. sapiens
ccacctcagtctcctc

SEQ ID NO: 73504 - DNA, 16 bp, H. sapiens
ccacctcatcctcccg

SEQ ID NO: 73505 - DNA, 16 bp, H. sapiens
ccacctcatcttcctg

SEQ ID NO: 73506 - DNA, 16 bp, H. sapiens
ccacctcattctccca

SEQ ID NO: 73507 - DNA, 16 bp, H. sapiens
ccacctcattctcctg

SEQ ID NO: 73508 - DNA, 16 bp, H. sapiens
ccacctccaacattaa

SEQ ID NO: 73509 - DNA, 16 bp, H. sapiens
ccacctccaacattgg

SEQ ID NO: 73510 - DNA, 16 bp, H. sapiens
ccacctccaactttgg

SEQ ID NO: 73511 - DNA, 16 bp, H. sapiens
ccacctccacctcagc

SEQ ID NO: 73512 - DNA, 16 bp, H. sapiens
ccacctccagagtagc

SEQ ID NO: 73513 - DNA, 16 bp, H. sapiens
ccacctccagcactgg

SEQ ID NO: 73514 - DNA, 16 bp, H. sapiens
ccacctccagcctctg

SEQ ID NO: 73515 - DNA, 16 bp, H. sapiens
ccacctccagctcctg

SEQ ID NO: 73516 - DNA, 16 bp, H. sapiens
ccacctccatccatgt

SEQ ID NO: 73517 - DNA, 16 bp, H. sapiens
ccacctccatctcctg

SEQ ID NO: 73518 - DNA, 16 bp, H. sapiens
ccacctccatgattca

SEQ ID NO: 73519 - DNA, 16 bp, H. sapiens
ccacctcccacctcag

SEQ ID NO: 73520 - DNA, 16 bp, H. sapiens
ccacctcccagcagcc

SEQ ID NO: 73521 - DNA, 16 bp, H. sapiens
ccacctcccagctgtg

SEQ ID NO: 73522 - DNA, 16 bp, H. sapiens
ccacctcccaggccct

SEQ ID NO: 73523 - DNA, 16 bp, H. sapiens
ccacctcccaggctca

SEQ ID NO: 73524 - DNA, 16 bp, H. sapiens
ccacctcccaggctga

SEQ ID NO: 73525 - DNA, 16 bp, H. sapiens
ccacctcccaggttcc

SEQ ID NO: 73526 - DNA, 16 bp, H. sapiens
ccacctcccccaggaa

SEQ ID NO: 73527 - DNA, 16 bp, H. sapiens
ccacctcccccaggag

SEQ ID NO: 73528 - DNA, 16 bp, H. sapiens
ccacctccctccagga

SEQ ID NO: 73529 - DNA, 16 bp, H. sapiens
ccacctccctgccctg

SEQ ID NO: 73530 - DNA, 16 bp, H. sapiens
ccacctccctggcctc

SEQ ID NO: 73531 - DNA, 16 bp, H. sapiens
ccacctcctccaggaa

SEQ ID NO: 73532 - DNA, 16 bp, H. sapiens
ccacctcctccaggag

SEQ ID NO: 73533 - DNA, 16 bp, H. sapiens
ccacctcctccccagg

SEQ ID NO: 73534 - DNA, 16 bp, H. sapiens
ccacctcctcctcagc

SEQ ID NO: 73535 - DNA, 16 bp, H. sapiens
ccacctcctcctgcca

SEQ ID NO: 73536 - DNA, 17 bp, H. sapiens
ccacctcctcgtcctcc

SEQ ID NO: 73537 - DNA, 16 bp, H. sapiens
ccacctcctctccagc

SEQ ID NO: 73538 - DNA, 16 bp, H. sapiens
ccacctcctgcagctg

SEQ ID NO: 73539 - DNA, 16 bp, H. sapiens
ccacctcctgccctgc

SEQ ID NO: 73540 - DNA, 16 bp, H. sapiens
ccacctcctgcctcag

SEQ ID NO: 73541 - DNA, 16 bp, H. sapiens
ccacctcctgcctcct

SEQ ID NO: 73542 - DNA, 16 bp, H. sapiens
ccacctcctggactca

SEQ ID NO: 73543 - DNA, 16 bp, H. sapiens
ccacctcctggagggg

SEQ ID NO: 73544 - DNA, 16 bp, H. sapiens
ccacctcctggcctca

SEQ ID NO: 73545 - DNA, 16 bp, H. sapiens
ccacctccttcctgga

SEQ ID NO: 73546 - DNA, 16 bp, H. sapiens
ccacctcgcccggcta

SEQ ID NO: 73547 - DNA, 18 bp, H. sapiens
ccacctcgcccggctaat

SEQ ID NO: 73548 - DNA, 16 bp, H. sapiens
ccacctcgcctggccc

SEQ ID NO: 73549 - DNA, 16 bp, H. sapiens
ccacctcgcctggcta

SEQ ID NO: 73550 - DNA, 16 bp, H. sapiens
ccacctcggccaccca

SEQ ID NO: 73551 - DNA, 16 bp, H. sapiens
ccacctctcccagcca

SEQ ID NO: 73552 - DNA, 16 bp, H. sapiens
ccacctctcccagcct

SEQ ID NO: 73553 - DNA, 16 bp, H. sapiens
ccacctctcccagcta

SEQ ID NO: 73554 - DNA, 16 bp, H. sapiens
ccacctctccctcctg

SEQ ID NO: 73555 - DNA, 16 bp, H. sapiens
ccacctctcctggccc

SEQ ID NO: 73556 - DNA, 16 bp, H. sapiens
ccacctctgaggttca

SEQ ID NO: 73557 - DNA, 16 bp, H. sapiens
ccacctctgccacctc

SEQ ID NO: 73558 - DNA, 16 bp, H. sapiens
ccacctctgcccctgc

SEQ ID NO: 73559 - DNA, 16 bp, H. sapiens
ccacctctgcctacca

SEQ ID NO: 73560 - DNA, 16 bp, H. sapiens
ccacctctgcctccaa

SEQ ID NO: 73561 - DNA, 16 bp, H. sapiens
ccacctctgcctcttg

SEQ ID NO: 73562 - DNA, 16 bp, H. sapiens
ccacctctgccttctg

SEQ ID NO: 73563 - DNA, 16 bp, H. sapiens
ccacctctgcgggcag

SEQ ID NO: 73564 - DNA, 16 bp, H. sapiens
ccacctctggggtcag

SEQ ID NO: 73565 - DNA, 16 bp, H. sapiens
ccacctctgtgggcag

SEQ ID NO: 73566 - DNA, 23 bp, H. sapiens
ccacctcttgtggagggcctgac

SEQ ID NO: 73567 - DNA, 16 bp, H. sapiens
ccacctgaccatcacc

SEQ ID NO: 73568 - DNA, 16 bp, H. sapiens
ccacctgagccagcag

SEQ ID NO: 73569 - DNA, 16 bp, H. sapiens
ccacctgaggaggcag

SEQ ID NO: 73570 - DNA, 19 bp, H. sapiens
ccacctgaggtcaggagtt

SEQ ID NO: 73571 - DNA, 16 bp, H. sapiens
ccacctgagtgagaac

SEQ ID NO: 73572 - DNA, 16 bp, H. sapiens
ccacctgcactccagc

SEQ ID NO: 73573 - DNA, 16 bp, H. sapiens
ccacctgcagcccagg

SEQ ID NO: 73574 - DNA, 16 bp, H. sapiens
ccacctgcagccccca

SEQ ID NO: 73575 - DNA, 16 bp, H. sapiens
ccacctgcagcccctg

SEQ ID NO: 73576 - DNA, 16 bp, H. sapiens
ccacctgcattccttg

SEQ ID NO: 73577 - DNA, 16 bp, H. sapiens
ccacctgccacagggc

SEQ ID NO: 73578 - DNA, 16 bp, H. sapiens
ccacctgccacctgcc

SEQ ID NO: 73579 - DNA, 16 bp, H. sapiens
ccacctgccccagcct

SEQ ID NO: 73580 - DNA, 16 bp, H. sapiens
ccacctgccccggcct

SEQ ID NO: 73581 - DNA, 16 bp, H. sapiens
ccacctgccctcctgc

SEQ ID NO: 73582 - DNA, 16 bp, H. sapiens
ccacctgccctggcct

SEQ ID NO: 73583 - DNA, 16 bp, H. sapiens
ccacctgcctccacct

SEQ ID NO: 73584 - DNA, 16 bp, H. sapiens
ccacctgcctccgcct

SEQ ID NO: 73585 - DNA, 16 bp, H. sapiens
ccacctgcctcgacct

SEQ ID NO: 73586 - DNA, 17 bp, H. sapiens
ccacctgcctcgacctc

SEQ ID NO: 73587 - DNA, 16 bp, H. sapiens
ccacctgcctcggccc

SEQ ID NO: 73588 - DNA, 16 bp, H. sapiens
ccacctgctgggctca

SEQ ID NO: 73589 - DNA, 16 bp, H. sapiens
ccacctgcttcagcct

SEQ ID NO: 73590 - DNA, 16 bp, H. sapiens
ccacctggaactccag

SEQ ID NO: 73591 - DNA, 16 bp, H. sapiens
ccacctggacctccca

SEQ ID NO: 73592 - DNA, 16 bp, H. sapiens
ccacctggccccacct

SEQ ID NO: 73593 - DNA, 16 bp, H. sapiens
ccacctggctcagcct

SEQ ID NO: 73594 - DNA, 16 bp, H. sapiens
ccacctgggcctcccc

SEQ ID NO: 73595 - DNA, 16 bp, H. sapiens
ccacctgggcctggag

SEQ ID NO: 73596 - DNA, 16 bp, H. sapiens
ccacctggggcctggg

SEQ ID NO: 73597 - DNA, 16 bp, H. sapiens
ccacctggggctccca

SEQ ID NO: 73598 - DNA, 17 bp, H. sapiens
ccacctgggttcacgcc

SEQ ID NO: 73599 - DNA, 16 bp, H. sapiens
ccacctggttcctccc

SEQ ID NO: 73600 - DNA, 16 bp, H. sapiens
ccacctgtaatcctag

SEQ ID NO: 73601 - DNA, 16 bp, H. sapiens
ccacctgtaccccagt

SEQ ID NO: 73602 - DNA, 16 bp, H. sapiens
ccacctgtctcagccc

SEQ ID NO: 73603 - DNA, 16 bp, H. sapiens
ccacctgtcttggctt

SEQ ID NO: 73604 - DNA, 16 bp, H. sapiens
ccacctgtgcctccca

SEQ ID NO: 73605 - DNA, 16 bp, H. sapiens
ccacctgttccccagt

SEQ ID NO: 73606 - DNA, 16 bp, H. sapiens
ccacctgtttctctgt

SEQ ID NO: 73607 - DNA, 16 bp, H. sapiens
ccaccttagcctctga

SEQ ID NO: 73608 - DNA, 16 bp, H. sapiens
ccaccttagccttcca

SEQ ID NO: 73609 - DNA, 16 bp, H. sapiens
ccaccttcacctcctg

SEQ ID NO: 73610 - DNA, 16 bp, H. sapiens
ccaccttcacctggaa

SEQ ID NO: 73611 - DNA, 16 bp, H. sapiens
ccaccttcagcctccc

SEQ ID NO: 73612 - DNA, 16 bp, H. sapiens
ccaccttcatcaatga

SEQ ID NO: 73613 - DNA, 16 bp, H. sapiens
ccaccttcatcagtga

SEQ ID NO: 73614 - DNA, 16 bp, H. sapiens
ccaccttccaccatgg

SEQ ID NO: 73615 - DNA, 16 bp, H. sapiens
ccaccttctgaagcct

SEQ ID NO: 73616 - DNA, 16 bp, H. sapiens
ccaccttctgaagctt

SEQ ID NO: 73617 - DNA, 16 bp, H. sapiens
ccaccttctgtcagat

SEQ ID NO: 73618 - DNA, 16 bp, H. sapiens
ccaccttgacctccca

SEQ ID NO: 73619 - DNA, 16 bp, H. sapiens
ccaccttgaccttcca

SEQ ID NO: 73620 - DNA, 16 bp, H. sapiens
ccaccttgcctggctc

SEQ ID NO: 73621 - DNA, 16 bp, H. sapiens
ccaccttggccttcaa

SEQ ID NO: 73622 - DNA, 16 bp, H. sapiens
ccaccttggcttcctg

SEQ ID NO: 73623 - DNA, 16 bp, H. sapiens
ccaccttgggcatgtg

SEQ ID NO: 73624 - DNA, 16 bp, H. sapiens
ccacctttactaaaaa

SEQ ID NO: 73625 - DNA, 16 bp, H. sapiens
ccacctttgcctcctg

SEQ ID NO: 73626 - DNA, 16 bp, H. sapiens
ccacgacctgctgagg

SEQ ID NO: 73627 - DNA, 17 bp, H. sapiens
ccacgaggtcaagagat

SEQ ID NO: 73628 - DNA, 16 bp, H. sapiens
ccacgatgcctggcta

SEQ ID NO: 73629 - DNA, 16 bp, H. sapiens
ccacgatggtctcaat

SEQ ID NO: 73630 - DNA, 16 bp, H. sapiens
ccacgcccagccagaa

SEQ ID NO: 73631 - DNA, 16 bp, H. sapiens
ccacgcccagccagga

SEQ ID NO: 73632 - DNA, 16 bp, H. sapiens
ccacgcccagcccaag

SEQ ID NO: 73633 - DNA, 16 bp, H. sapiens
ccacgcccagccccat

SEQ ID NO: 73634 - DNA, 16 bp, H. sapiens
ccacgcccagcctacc

SEQ ID NO: 73635 - DNA, 16 bp, H. sapiens
ccacgcccagcctcac

SEQ ID NO: 73636 - DNA, 16 bp, H. sapiens
ccacgcccagcctgag

SEQ ID NO: 73637 - DNA, 16 bp, H. sapiens
ccacgcccagcctgga

SEQ ID NO: 73638 - DNA, 16 bp, H. sapiens
ccacgcccagcctggc

SEQ ID NO: 73639 - DNA, 16 bp, H. sapiens
ccacgcccagctagct

SEQ ID NO: 73640 - DNA, 16 bp, H. sapiens
ccacgccccgctaatt

SEQ ID NO: 73641 - DNA, 16 bp, H. sapiens
ccacgcctggccccac

SEQ ID NO: 73642 - DNA, 16 bp, H. sapiens
ccacgcctggctgaaa

SEQ ID NO: 73643 - DNA, 16 bp, H. sapiens
ccacggccctccagcc

SEQ ID NO: 73644 - DNA, 16 bp, H. sapiens
ccacggcgcccggcct

SEQ ID NO: 73645 - DNA, 16 bp, H. sapiens
ccacggtcttgggcag

SEQ ID NO: 73646 - DNA, 16 bp, H. sapiens
ccacggtgcccagccc

SEQ ID NO: 73647 - DNA, 16 bp, H. sapiens
ccacggtttcaggcat

SEQ ID NO: 73648 - DNA, 16 bp, H. sapiens
ccacgtccctgcaaag

SEQ ID NO: 73649 - DNA, 16 bp, H. sapiens
ccacgtgaagacacag

SEQ ID NO: 73650 - DNA, 16 bp, H. sapiens
ccacgtttgccaggct

SEQ ID NO: 73651 - DNA, 16 bp, H. sapiens
ccactaaaaggaacca

SEQ ID NO: 73652 - DNA, 19 bp, H. sapiens
ccactaagcccggctaatt

SEQ ID NO: 73653 - DNA, 16 bp, H. sapiens
ccactacaagaactgc

SEQ ID NO: 73654 - DNA, 16 bp, H. sapiens
ccactacacaccagcc

SEQ ID NO: 73655 - DNA, 16 bp, H. sapiens
ccactacacccagccc

SEQ ID NO: 73656 - DNA, 16 bp, H. sapiens
ccactacaccccagcc

SEQ ID NO: 73657 - DNA, 16 bp, H. sapiens
ccactacacccggccc

SEQ ID NO: 73658 - DNA, 16 bp, H. sapiens
ccactacacctggctg

SEQ ID NO: 73659 - DNA, 16 bp, H. sapiens
ccactacatccagcct

SEQ ID NO: 73660 - DNA, 16 bp, H. sapiens
ccactaccacccagct

SEQ ID NO: 73661 - DNA, 16 bp, H. sapiens
ccactagaatgtcagc

SEQ ID NO: 73662 - DNA, 16 bp, H. sapiens
ccactagcctgcctct

SEQ ID NO: 73663 - DNA, 16 bp, H. sapiens
ccactaggtggtgctg

SEQ ID NO: 73664 - DNA, 16 bp, H. sapiens
ccactatacctggcta

SEQ ID NO: 73665 - DNA, 16 bp, H. sapiens
ccactatactccagca

SEQ ID NO: 73666 - DNA, 16 bp, H. sapiens
ccactatgactgcact

SEQ ID NO: 73667 - DNA, 16 bp, H. sapiens
ccactatgtccagcta

SEQ ID NO: 73668 - DNA, 16 bp, H. sapiens
ccactattcacaatag

SEQ ID NO: 73669 - DNA, 16 bp, H. sapiens
ccactcacctctgcct

SEQ ID NO: 73670 - DNA, 16 bp, H. sapiens
ccactcaccttctgct

SEQ ID NO: 73671 - DNA, 16 bp, H. sapiens
ccactcactagctgtg

SEQ ID NO: 73672 - DNA, 16 bp, H. sapiens
ccactcactccagcct

SEQ ID NO: 73673 - DNA, 16 bp, H. sapiens
ccactcagcagccaga

SEQ ID NO: 73674 - DNA, 16 bp, H. sapiens
ccactcagcccagcag

SEQ ID NO: 73675 - DNA, 16 bp, H. sapiens
ccactcaggtggctga

SEQ ID NO: 73676 - DNA, 16 bp, H. sapiens
ccactcatgatggaag

SEQ ID NO: 73677 - DNA, 16 bp, H. sapiens
ccactccacccagcct

SEQ ID NO: 73678 - DNA, 16 bp, H. sapiens
ccactccactccagcc

SEQ ID NO: 73679 - DNA, 16 bp, H. sapiens
ccactccagatgggcc

SEQ ID NO: 73680 - DNA, 16 bp, H. sapiens
ccactccagcctggcc

SEQ ID NO: 73681 - DNA, 16 bp, H. sapiens
ccactccagcctgggc

SEQ ID NO: 73682 - DNA, 16 bp, H. sapiens
ccactccagcctgggt

SEQ ID NO: 73683 - DNA, 16 bp, H. sapiens
ccactccagcttcagc

SEQ ID NO: 73684 - DNA, 16 bp, H. sapiens
ccactcccaccctgtg

SEQ ID NO: 73685 - DNA, 16 bp, H. sapiens
ccactcccacctccag

SEQ ID NO: 73686 - DNA, 16 bp, H. sapiens
ccactcccagccccag

SEQ ID NO: 73687 - DNA, 16 bp, H. sapiens
ccactccccagctgtg

SEQ ID NO: 73688 - DNA, 16 bp, H. sapiens
ccactccctgcaacct

SEQ ID NO: 73689 - DNA, 16 bp, H. sapiens
ccactcctgagataac

SEQ ID NO: 73690 - DNA, 16 bp, H. sapiens
ccactcctgcagcaga

SEQ ID NO: 73691 - DNA, 16 bp, H. sapiens
ccactcctgggctcaa

SEQ ID NO: 73692 - DNA, 17 bp, H. sapiens
ccactcggctctaccaa

SEQ ID NO: 73693 - DNA, 16 bp, H. sapiens
ccactctcaatgcctt

SEQ ID NO: 73694 - DNA, 16 bp, H. sapiens
ccactctcctccagcc

SEQ ID NO: 73695 - DNA, 16 bp, H. sapiens
ccactctgcctcctgg

SEQ ID NO: 73696 - DNA, 16 bp, H. sapiens
ccactctgcctcttgc

SEQ ID NO: 73697 - DNA, 16 bp, H. sapiens
ccactctgctgcccag

SEQ ID NO: 73698 - DNA, 16 bp, H. sapiens
ccactctgcttctgct

SEQ ID NO: 73699 - DNA, 16 bp, H. sapiens
ccactctggccaacat

SEQ ID NO: 73700 - DNA, 16 bp, H. sapiens
ccactctggcctccca

SEQ ID NO: 73701 - DNA, 16 bp, H. sapiens
ccactgaacccagcca

SEQ ID NO: 73702 - DNA, 16 bp, H. sapiens
ccactgaacctaaaat

SEQ ID NO: 73703 - DNA, 16 bp, H. sapiens
ccactgaagaaggaaa

SEQ ID NO: 73704 - DNA, 16 bp, H. sapiens
ccactgaagccttgaa

SEQ ID NO: 73705 - DNA, 16 bp, H. sapiens
ccactgaccctacaga

SEQ ID NO: 73706 - DNA, 16 bp, H. sapiens
ccactgacctcagcct

SEQ ID NO: 73707 - DNA, 16 bp, H. sapiens
ccactgagccaggcat

SEQ ID NO: 73708 - DNA, 16 bp, H. sapiens
ccactgagcccagctg

SEQ ID NO: 73709 - DNA, 16 bp, H. sapiens
ccactgaggtggagcc

SEQ ID NO: 73710 - DNA, 16 bp, H. sapiens
ccactgattcaaatgt

SEQ ID NO: 73711 - DNA, 16 bp, H. sapiens
ccactgcaaaaacata

SEQ ID NO: 73712 - DNA, 16 bp, H. sapiens
ccactgcaaccagcca

SEQ ID NO: 73713 - DNA, 16 bp, H. sapiens
ccactgcaacctccac

SEQ ID NO: 73714 - DNA, 16 bp, H. sapiens
ccactgcacaacagcc

SEQ ID NO: 73715 - DNA, 16 bp, H. sapiens
ccactgcacaccagcc

SEQ ID NO: 73716 - DNA, 16 bp, H. sapiens
ccactgcacagcctgg

SEQ ID NO: 73717 - DNA, 16 bp, H. sapiens
ccactgcaccagccca

SEQ ID NO: 73718 - DNA, 16 bp, H. sapiens
ccactgcaccaggctc

SEQ ID NO: 73719 - DNA, 16 bp, H. sapiens
ccactgcacccagcct

SEQ ID NO: 73720 - DNA, 16 bp, H. sapiens
ccactgcacccagtgt

SEQ ID NO: 73721 - DNA, 16 bp, H. sapiens
ccactgcacccctgcc

SEQ ID NO: 73722 - DNA, 16 bp, H. sapiens
ccactgcaccctggcc

SEQ ID NO: 73723 - DNA, 16 bp, H. sapiens
ccactgcaccgggcct

SEQ ID NO: 73724 - DNA, 16 bp, H. sapiens
ccactgcacctagcca

SEQ ID NO: 73725 - DNA, 16 bp, H. sapiens
ccactgcacctgccct

SEQ ID NO: 73726 - DNA, 16 bp, H. sapiens
ccactgcacctggacc

SEQ ID NO: 73727 - DNA, 16 bp, H. sapiens
ccactgcacctggccc

SEQ ID NO: 73728 - DNA, 16 bp, H. sapiens
ccactgcacctgtccc

SEQ ID NO: 73729 - DNA, 16 bp, H. sapiens
ccactgcaccttgcct

SEQ ID NO: 73730 - DNA, 16 bp, H. sapiens
ccactgcacgtggccc

SEQ ID NO: 73731 - DNA, 16 bp, H. sapiens
ccactgcactcagcct

SEQ ID NO: 73732 - DNA, 16 bp, H. sapiens
ccactgcactccaact

SEQ ID NO: 73733 - DNA, 16 bp, H. sapiens
ccactgcactccagca

SEQ ID NO: 73734 - DNA, 16 bp, H. sapiens
ccactgcactccagcg

SEQ ID NO: 73735 - DNA, 16 bp, H. sapiens
ccactgcactccagct

SEQ ID NO: 73736 - DNA, 16 bp, H. sapiens
ccactgcactccagtt

SEQ ID NO: 73737 - DNA, 16 bp, H. sapiens
ccactgcactccatcc

SEQ ID NO: 73738 - DNA, 16 bp, H. sapiens
ccactgcactcctggg

SEQ ID NO: 73739 - DNA, 16 bp, H. sapiens
ccactgcactctagct

SEQ ID NO: 73740 - DNA, 16 bp, H. sapiens
ccactgcactgcaacc

SEQ ID NO: 73741 - DNA, 16 bp, H. sapiens
ccactgcactgcctgg

SEQ ID NO: 73742 - DNA, 16 bp, H. sapiens
ccactgcactggcctg

SEQ ID NO: 73743 - DNA, 16 bp, H. sapiens
ccactgcactgggctg

SEQ ID NO: 73744 - DNA, 16 bp, H. sapiens
ccactgcactgggtga

SEQ ID NO: 73745 - DNA, 16 bp, H. sapiens
ccactgcacttggcca

SEQ ID NO: 73746 - DNA, 16 bp, H. sapiens
ccactgcacttggcct

SEQ ID NO: 73747 - DNA, 16 bp, H. sapiens
ccactgcagcagctgg

SEQ ID NO: 73748 - DNA, 16 bp, H. sapiens
ccactgcagccagcct

SEQ ID NO: 73749 - DNA, 16 bp, H. sapiens
ccactgcagccagtgt

SEQ ID NO: 73750 - DNA, 16 bp, H. sapiens
ccactgcagcctgggc

SEQ ID NO: 73751 - DNA, 16 bp, H. sapiens
ccactgcagctctggg

SEQ ID NO: 73752 - DNA, 16 bp, H. sapiens
ccactgcagttcagcc

SEQ ID NO: 73753 - DNA, 16 bp, H. sapiens
ccactgcatccagcca

SEQ ID NO: 73754 - DNA, 16 bp, H. sapiens
ccactgcatccagcct

SEQ ID NO: 73755 - DNA, 16 bp, H. sapiens
ccactgcatccagcta

SEQ ID NO: 73756 - DNA, 16 bp, H. sapiens
ccactgcatccagtca

SEQ ID NO: 73757 - DNA, 16 bp, H. sapiens
ccactgcatctggcct

SEQ ID NO: 73758 - DNA, 16 bp, H. sapiens
ccactgcattccagct

SEQ ID NO: 73759 - DNA, 16 bp, H. sapiens
ccactgcattctggcc

SEQ ID NO: 73760 - DNA, 16 bp, H. sapiens
ccactgccaacaccag

SEQ ID NO: 73761 - DNA, 16 bp, H. sapiens
ccactgccaccaccaa

SEQ ID NO: 73762 - DNA, 16 bp, H. sapiens
ccactgccaccaccac

SEQ ID NO: 73763 - DNA, 16 bp, H. sapiens
ccactgccaccactgg

SEQ ID NO: 73764 - DNA, 16 bp, H. sapiens
ccactgccaccatcat

SEQ ID NO: 73765 - DNA, 16 bp, H. sapiens
ccactgccacgcccag

SEQ ID NO: 73766 - DNA, 16 bp, H. sapiens
ccactgccactgccac

SEQ ID NO: 73767 - DNA, 16 bp, H. sapiens
ccactgccactgcccc

SEQ ID NO: 73768 - DNA, 16 bp, H. sapiens
ccactgccactgccct

SEQ ID NO: 73769 - DNA, 16 bp, H. sapiens
ccactgccagctcagg

SEQ ID NO: 73770 - DNA, 16 bp, H. sapiens
ccactgcccactgccc

SEQ ID NO: 73771 - DNA, 16 bp, H. sapiens
ccactgcccccagcca

SEQ ID NO: 73772 - DNA, 16 bp, H. sapiens
ccactgcccctggcca

SEQ ID NO: 73773 - DNA, 16 bp, H. sapiens
ccactgcccctggcct

SEQ ID NO: 73774 - DNA, 16 bp, H. sapiens
ccactgcccctggcta

SEQ ID NO: 73775 - DNA, 16 bp, H. sapiens
ccactgccctacagcc

SEQ ID NO: 73776 - DNA, 16 bp, H. sapiens
ccactgccctcctgcc

SEQ ID NO: 73777 - DNA, 16 bp, H. sapiens
ccactgccctgccctg

SEQ ID NO: 73778 - DNA, 16 bp, H. sapiens
ccactgcctgggtgac

SEQ ID NO: 73779 - DNA, 16 bp, H. sapiens
ccactgccttcctgga

SEQ ID NO: 73780 - DNA, 16 bp, H. sapiens
ccactgccttctagcc

SEQ ID NO: 73781 - DNA, 16 bp, H. sapiens
ccactgcgccaggcca

SEQ ID NO: 73782 - DNA, 16 bp, H. sapiens
ccactgcgccccacct

SEQ ID NO: 73783 - DNA, 16 bp, H. sapiens
ccactgcgccccgcca

SEQ ID NO: 73784 - DNA, 19 bp, H. sapiens
ccactgcgcccggcctcct

SEQ ID NO: 73785 - DNA, 16 bp, H. sapiens
ccactgcgcctggcct

SEQ ID NO: 73786 - DNA, 16 bp, H. sapiens
ccactgcgcctggctg

SEQ ID NO: 73787 - DNA, 16 bp, H. sapiens
ccactgcgctccagct

SEQ ID NO: 73788 - DNA, 16 bp, H. sapiens
ccactgctcccggctg

SEQ ID NO: 73789 - DNA, 16 bp, H. sapiens
ccactgctccctgcct

SEQ ID NO: 73790 - DNA, 16 bp, H. sapiens
ccactgctctcagcct

SEQ ID NO: 73791 - DNA, 16 bp, H. sapiens
ccactgctctccagca

SEQ ID NO: 73792 - DNA, 16 bp, H. sapiens
ccactgctctcttcag

SEQ ID NO: 73793 - DNA, 16 bp, H. sapiens
ccactgctgagtgccc

SEQ ID NO: 73794 - DNA, 16 bp, H. sapiens
ccactgctgccaccac

SEQ ID NO: 73795 - DNA, 16 bp, H. sapiens
ccactgctgccactgc

SEQ ID NO: 73796 - DNA, 16 bp, H. sapiens
ccactgctggctttga

SEQ ID NO: 73797 - DNA, 16 bp, H. sapiens
ccactgctggtgagga

SEQ ID NO: 73798 - DNA, 16 bp, H. sapiens
ccactgctgtttgctg

SEQ ID NO: 73799 - DNA, 16 bp, H. sapiens
ccactgcttccagcct

SEQ ID NO: 73800 - DNA, 16 bp, H. sapiens
ccactggaaaagggaa

SEQ ID NO: 73801 - DNA, 16 bp, H. sapiens
ccactggagaagctga

SEQ ID NO: 73802 - DNA, 18 bp, H. sapiens
ccactggaggctatatga

SEQ ID NO: 73803 - DNA, 16 bp, H. sapiens
ccactggcagattcta

SEQ ID NO: 73804 - DNA, 16 bp, H. sapiens
ccactggccaaagatg

SEQ ID NO: 73805 - DNA, 16 bp, H. sapiens
ccactggctcaccctt

SEQ ID NO: 73806 - DNA, 16 bp, H. sapiens
ccactggctccaagcc

SEQ ID NO: 73807 - DNA, 16 bp, H. sapiens
ccactggcttgccctt

SEQ ID NO: 73808 - DNA, 16 bp, H. sapiens
ccactgggaccctccc

SEQ ID NO: 73809 - DNA, 16 bp, H. sapiens
ccactgggaggaacga

SEQ ID NO: 73810 - DNA, 16 bp, H. sapiens
ccactgggaggcagga

SEQ ID NO: 73811 - DNA, 16 bp, H. sapiens
ccactgggcacggtgg

SEQ ID NO: 73812 - DNA, 16 bp, H. sapiens
ccactgggcactgcct

SEQ ID NO: 73813 - DNA, 16 bp, H. sapiens
ccactgggcagtgccc

SEQ ID NO: 73814 - DNA, 16 bp, H. sapiens
ccactgggcccagccc

SEQ ID NO: 73815 - DNA, 16 bp, H. sapiens
ccactgggcccctccc

SEQ ID NO: 73816 - DNA, 16 bp, H. sapiens
ccactgggctcctccc

SEQ ID NO: 73817 - DNA, 16 bp, H. sapiens
ccactggggaatctga

SEQ ID NO: 73818 - DNA, 16 bp, H. sapiens
ccactgggtccctcct

SEQ ID NO: 73819 - DNA, 16 bp, H. sapiens
ccactgggtggctaga

SEQ ID NO: 73820 - DNA, 16 bp, H. sapiens
ccactggtgacacctc

SEQ ID NO: 73821 - DNA, 16 bp, H. sapiens
ccactggtgcaagtcc

SEQ ID NO: 73822 - DNA, 16 bp, H. sapiens
ccactgtacccagtct

SEQ ID NO: 73823 - DNA, 16 bp, H. sapiens
ccactgtacctggcta

SEQ ID NO: 73824 - DNA, 16 bp, H. sapiens
ccactgtactccaccc

SEQ ID NO: 73825 - DNA, 16 bp, H. sapiens
ccactgtactccagct

SEQ ID NO: 73826 - DNA, 16 bp, H. sapiens
ccactgtactcctggg

SEQ ID NO: 73827 - DNA, 16 bp, H. sapiens
ccactgtatctaggaa

SEQ ID NO: 73828 - DNA, 16 bp, H. sapiens
ccactgtccccagcca

SEQ ID NO: 73829 - DNA, 16 bp, H. sapiens
ccactgtccctggccc

SEQ ID NO: 73830 - DNA, 16 bp, H. sapiens
ccactgtcctccagcc

SEQ ID NO: 73831 - DNA, 16 bp, H. sapiens
ccactgtgccaggctc

SEQ ID NO: 73832 - DNA, 16 bp, H. sapiens
ccactgtgcccagaca

SEQ ID NO: 73833 - DNA, 16 bp, H. sapiens
ccactgtgcccagcct

SEQ ID NO: 73834 - DNA, 16 bp, H. sapiens
ccactgtgcccagcta

SEQ ID NO: 73835 - DNA, 16 bp, H. sapiens
ccactgtgccctgccg

SEQ ID NO: 73836 - DNA, 16 bp, H. sapiens
ccactgtgccctgctg

SEQ ID NO: 73837 - DNA, 16 bp, H. sapiens
ccactgtgccctggcc

SEQ ID NO: 73838 - DNA, 16 bp, H. sapiens
ccactgtgcctgccct

SEQ ID NO: 73839 - DNA, 16 bp, H. sapiens
ccactgtgcctgccta

SEQ ID NO: 73840 - DNA, 16 bp, H. sapiens
ccactgtgcctggctc

SEQ ID NO: 73841 - DNA, 16 bp, H. sapiens
ccactgtgcctgggcc

SEQ ID NO: 73842 - DNA, 16 bp, H. sapiens
ccactgtgcctggtgt

SEQ ID NO: 73843 - DNA, 16 bp, H. sapiens
ccactgtgccttgccc

SEQ ID NO: 73844 - DNA, 16 bp, H. sapiens
ccactgtgctcagcag

SEQ ID NO: 73845 - DNA, 16 bp, H. sapiens
ccactgtgctccagac

SEQ ID NO: 73846 - DNA, 16 bp, H. sapiens
ccactgtgctcctgcc

SEQ ID NO: 73847 - DNA, 16 bp, H. sapiens
ccactgtgctgcagcc

SEQ ID NO: 73848 - DNA, 16 bp, H. sapiens
ccactgtggaagacaa

SEQ ID NO: 73849 - DNA, 16 bp, H. sapiens
ccactgtggctggccc

SEQ ID NO: 73850 - DNA, 16 bp, H. sapiens
ccactgtggtttgaga

SEQ ID NO: 73851 - DNA, 16 bp, H. sapiens
ccactgtgtccggccc

SEQ ID NO: 73852 - DNA, 16 bp, H. sapiens
ccactgtgtctggctc

SEQ ID NO: 73853 - DNA, 16 bp, H. sapiens
ccactgttaattagcc

SEQ ID NO: 73854 - DNA, 16 bp, H. sapiens
ccactgttctactgtt

SEQ ID NO: 73855 - DNA, 16 bp, H. sapiens
ccactgttttactggg

SEQ ID NO: 73856 - DNA, 16 bp, H. sapiens
ccacttaaaaggcaga

SEQ ID NO: 73857 - DNA, 16 bp, H. sapiens
ccacttaccagctgtg

SEQ ID NO: 73858 - DNA, 16 bp, H. sapiens
ccacttataagtgagg

SEQ ID NO: 73859 - DNA, 16 bp, H. sapiens
ccacttatatgaggta

SEQ ID NO: 73860 - DNA, 16 bp, H. sapiens
ccacttcaagttgtcc

SEQ ID NO: 73861 - DNA, 16 bp, H. sapiens
ccacttcagcctcaca

SEQ ID NO: 73862 - DNA, 16 bp, H. sapiens
ccacttcagcctccca

SEQ ID NO: 73863 - DNA, 16 bp, H. sapiens
ccacttcagcctgggc

SEQ ID NO: 73864 - DNA, 16 bp, H. sapiens
ccacttccaagatggc

SEQ ID NO: 73865 - DNA, 16 bp, H. sapiens
ccacttccaccccttg

SEQ ID NO: 73866 - DNA, 16 bp, H. sapiens
ccacttcccagtttca

SEQ ID NO: 73867 - DNA, 16 bp, H. sapiens
ccacttccctgacaac

SEQ ID NO: 73868 - DNA, 16 bp, H. sapiens
ccacttcctagctatg

SEQ ID NO: 73869 - DNA, 16 bp, H. sapiens
ccacttcctcctggcc

SEQ ID NO: 73870 - DNA, 16 bp, H. sapiens
ccacttcctgagttca

SEQ ID NO: 73871 - DNA, 16 bp, H. sapiens
ccacttcctggtccct

SEQ ID NO: 73872 - DNA, 16 bp, H. sapiens
ccacttcctggttcat

SEQ ID NO: 73873 - DNA, 16 bp, H. sapiens
ccacttccttgttgct

SEQ ID NO: 73874 - DNA, 16 bp, H. sapiens
ccacttctgcctcctg

SEQ ID NO: 73875 - DNA, 16 bp, H. sapiens
ccacttgagctcagga

SEQ ID NO: 73876 - DNA, 16 bp, H. sapiens
ccacttgcagattcca

SEQ ID NO: 73877 - DNA, 16 bp, H. sapiens
ccacttgggaagctga

SEQ ID NO: 73878 - DNA, 16 bp, H. sapiens
ccacttgggaggcaga

SEQ ID NO: 73879 - DNA, 16 bp, H. sapiens
ccacttggtccctccc

SEQ ID NO: 73880 - DNA, 16 bp, H. sapiens
ccacttggttatgatg

SEQ ID NO: 73881 - DNA, 16 bp, H. sapiens
ccacttgtaagtgaga

SEQ ID NO: 73882 - DNA, 16 bp, H. sapiens
ccactttaagttccag

SEQ ID NO: 73883 - DNA, 16 bp, H. sapiens
ccactttacagaagag

SEQ ID NO: 73884 - DNA, 16 bp, H. sapiens
ccactttacagatgag

SEQ ID NO: 73885 - DNA, 16 bp, H. sapiens
ccactttcaccacttc

SEQ ID NO: 73886 - DNA, 16 bp, H. sapiens
ccactttccaggctca

SEQ ID NO: 73887 - DNA, 16 bp, H. sapiens
ccactttctgatgtgg

SEQ ID NO: 73888 - DNA, 16 bp, H. sapiens
ccactttctgtcttta

SEQ ID NO: 73889 - DNA, 16 bp, H. sapiens
ccactttgcccagcct

SEQ ID NO: 73890 - DNA, 16 bp, H. sapiens
ccactttgccccagcc

SEQ ID NO: 73891 - DNA, 16 bp, H. sapiens
ccactttgcctggccc

SEQ ID NO: 73892 - DNA, 16 bp, H. sapiens
ccactttgcctggcct

SEQ ID NO: 73893 - DNA, 20 bp, H. sapiens
ccactttgggaggccaaggc

SEQ ID NO: 73894 - DNA, 16 bp, H. sapiens
ccactttgtagatgag

SEQ ID NO: 73895 - DNA, 16 bp, H. sapiens
ccacttttgcctccca

SEQ ID NO: 73896 - DNA, 54 bp, H. sapiens
ccacttttggggagactcacccgcacaccgtccgcgcacgcctgaggctgggat

SEQ ID NO: 73897 - DNA, 16 bp, H. sapiens
ccactttttgattggg

SEQ ID NO: 73898 - DNA, 16 bp, H. sapiens
ccactttttgattttt

SEQ ID NO: 73899 - DNA, 16 bp, H. sapiens
ccagaaaaatgaaaac

SEQ ID NO: 73900 - DNA, 16 bp, H. sapiens
ccagaaaaatgagaaa

SEQ ID NO: 73901 - DNA, 16 bp, H. sapiens
ccagaaaacctagaag

SEQ ID NO: 73902 - DNA, 16 bp, H. sapiens
ccagaaaactccaaca

SEQ ID NO: 73903 - DNA, 16 bp, H. sapiens
ccagaaaactgaagag

SEQ ID NO: 73904 - DNA, 16 bp, H. sapiens
ccagaaaagccagtgg

SEQ ID NO: 73905 - DNA, 16 bp, H. sapiens
ccagaaaaggcaagga

SEQ ID NO: 73906 - DNA, 16 bp, H. sapiens
ccagaaaatagaagca

SEQ ID NO: 73907 - DNA, 16 bp, H. sapiens
ccagaaacacatcaaa

SEQ ID NO: 73908 - DNA, 16 bp, H. sapiens
ccagaaacctctgtgg

SEQ ID NO: 73909 - DNA, 16 bp, H. sapiens
ccagaaagaaatccaa

SEQ ID NO: 73910 - DNA, 16 bp, H. sapiens
ccagaaagaaattgaa

SEQ ID NO: 73911 - DNA, 16 bp, H. sapiens
ccagaaagaagtcaaa

SEQ ID NO: 73912 - DNA, 16 bp, H. sapiens
ccagaaagcaaggaag

SEQ ID NO: 73913 - DNA, 16 bp, H. sapiens
ccagaaaggaatgcag

SEQ ID NO: 73914 - DNA, 16 bp, H. sapiens
ccagaaaggggtccca

SEQ ID NO: 73915 - DNA, 16 bp, H. sapiens
ccagaaagtggaggtt

SEQ ID NO: 73916 - DNA, 16 bp, H. sapiens
ccagaaagtggcagag

SEQ ID NO: 73917 - DNA, 16 bp, H. sapiens
ccagaaataaacaatt

SEQ ID NO: 73918 - DNA, 16 bp, H. sapiens
ccagaaatggaacaaa

SEQ ID NO: 73919 - DNA, 16 bp, H. sapiens
ccagaaatgtaagaaa

SEQ ID NO: 73920 - DNA, 16 bp, H. sapiens
ccagaacactgttacg

SEQ ID NO: 73921 - DNA, 16 bp, H. sapiens
ccagaacaggagaagg

SEQ ID NO: 73922 - DNA, 16 bp, H. sapiens
ccagaacaggaggaag

SEQ ID NO: 73923 - DNA, 16 bp, H. sapiens
ccagaacaggcaaatc

SEQ ID NO: 73924 - DNA, 16 bp, H. sapiens
ccagaacatttccatc

SEQ ID NO: 73925 - DNA, 16 bp, H. sapiens
ccagaaccagacggat

SEQ ID NO: 73926 - DNA, 16 bp, H. sapiens
ccagaacctgggaggc

SEQ ID NO: 73927 - DNA, 16 bp, H. sapiens
ccagaacgtaaagtat

SEQ ID NO: 73928 - DNA, 16 bp, H. sapiens
ccagaactactgcagg

SEQ ID NO: 73929 - DNA, 16 bp, H. sapiens
ccagaactcattcctc

SEQ ID NO: 73930 - DNA, 16 bp, H. sapiens
ccagaactgagagaca

SEQ ID NO: 73931 - DNA, 16 bp, H. sapiens
ccagaactgtgagcaa

SEQ ID NO: 73932 - DNA, 16 bp, H. sapiens
ccagaactgtgaggaa

SEQ ID NO: 73933 - DNA, 16 bp, H. sapiens
ccagaacttccccaac

SEQ ID NO: 73934 - DNA, 16 bp, H. sapiens
ccagaacttttcatct

SEQ ID NO: 73935 - DNA, 16 bp, H. sapiens
ccagaactttttcctc

SEQ ID NO: 73936 - DNA, 16 bp, H. sapiens
ccagaagaaaaataat

SEQ ID NO: 73937 - DNA, 16 bp, H. sapiens
ccagaagaaaacacag

SEQ ID NO: 73938 - DNA, 16 bp, H. sapiens
ccagaagaaaacctag

SEQ ID NO: 73939 - DNA, 16 bp, H. sapiens
ccagaagaagatggca

SEQ ID NO: 73940 - DNA, 16 bp, H. sapiens
ccagaagacaagaaat

SEQ ID NO: 73941 - DNA, 16 bp, H. sapiens
ccagaagacaagagtg

SEQ ID NO: 73942 - DNA, 16 bp, H. sapiens
ccagaagacagaggtt

SEQ ID NO: 73943 - DNA, 16 bp, H. sapiens
ccagaagacagtggag

SEQ ID NO: 73944 - DNA, 16 bp, H. sapiens
ccagaagactcagcaa

SEQ ID NO: 73945 - DNA, 16 bp, H. sapiens
ccagaagagaaataat

SEQ ID NO: 73946 - DNA, 16 bp, H. sapiens
ccagaagagaggtaaa

SEQ ID NO: 73947 - DNA, 16 bp, H. sapiens
ccagaagagagtgcag

SEQ ID NO: 73948 - DNA, 16 bp, H. sapiens
ccagaagcacaggcaa

SEQ ID NO: 73949 - DNA, 16 bp, H. sapiens
ccagaagcagaagcca

SEQ ID NO: 73950 - DNA, 16 bp, H. sapiens
ccagaagcagaagtca

SEQ ID NO: 73951 - DNA, 16 bp, H. sapiens
ccagaagcagaattgc

SEQ ID NO: 73952 - DNA, 16 bp, H. sapiens
ccagaagcagagcctg

SEQ ID NO: 73953 - DNA, 16 bp, H. sapiens
ccagaagcagaggctg

SEQ ID NO: 73954 - DNA, 16 bp, H. sapiens
ccagaagcagatacca

SEQ ID NO: 73955 - DNA, 16 bp, H. sapiens
ccagaagcagatcctg

SEQ ID NO: 73956 - DNA, 16 bp, H. sapiens
ccagaagcagatgctg

SEQ ID NO: 73957 - DNA, 16 bp, H. sapiens
ccagaagcagatgctt

SEQ ID NO: 73958 - DNA, 16 bp, H. sapiens
ccagaagcaggtgctg

SEQ ID NO: 73959 - DNA, 16 bp, H. sapiens
ccagaagcccagcaga

SEQ ID NO: 73960 - DNA, 20 bp, H. sapiens
ccagaagcccagccggcttc

SEQ ID NO: 73961 - DNA, 16 bp, H. sapiens
ccagaagcctgacatg

SEQ ID NO: 73962 - DNA, 16 bp, H. sapiens
ccagaagctagaaaga

SEQ ID NO: 73963 - DNA, 16 bp, H. sapiens
ccagaagctctccaaa

SEQ ID NO: 73964 - DNA, 16 bp, H. sapiens
ccagaagctgagcaga

SEQ ID NO: 73965 - DNA, 16 bp, H. sapiens
ccagaagctgatgctg

SEQ ID NO: 73966 - DNA, 16 bp, H. sapiens
ccagaagctgggcaga

SEQ ID NO: 73967 - DNA, 16 bp, H. sapiens
ccagaagctgggggag

SEQ ID NO: 73968 - DNA, 16 bp, H. sapiens
ccagaaggaaaggaga

SEQ ID NO: 73969 - DNA, 16 bp, H. sapiens
ccagaaggaaccagcc

SEQ ID NO: 73970 - DNA, 16 bp, H. sapiens
ccagaaggaactcagt

SEQ ID NO: 73971 - DNA, 17 bp, H. sapiens
ccagaaggaagaaactc

SEQ ID NO: 73972 - DNA, 16 bp, H. sapiens
ccagaaggaaggaatg

SEQ ID NO: 73973 - DNA, 16 bp, H. sapiens
ccagaaggaatgctga

SEQ ID NO: 73974 - DNA, 16 bp, H. sapiens
ccagaaggagaagaga

SEQ ID NO: 73975 - DNA, 16 bp, H. sapiens
ccagaaggagatgggg

SEQ ID NO: 73976 - DNA, 16 bp, H. sapiens
ccagaaggcaagaaat

SEQ ID NO: 73977 - DNA, 16 bp, H. sapiens
ccagaaggccgtgtat

SEQ ID NO: 73978 - DNA, 16 bp, H. sapiens
ccagaaggtcaaggct

SEQ ID NO: 73979 - DNA, 16 bp, H. sapiens
ccagaaggtttttttt

SEQ ID NO: 73980 - DNA, 16 bp, H. sapiens
ccagaagtacaaagaa

SEQ ID NO: 73981 - DNA, 16 bp, H. sapiens
ccagaagtagatgctg

SEQ ID NO: 73982 - DNA, 16 bp, H. sapiens
ccagaagtggggtgct

SEQ ID NO: 73983 - DNA, 17 bp, H. sapiens
ccagaagttcaagacca

SEQ ID NO: 73984 - DNA, 16 bp, H. sapiens
ccagaagttccaggct

SEQ ID NO: 73985 - DNA, 17 bp, H. sapiens
ccagaagtttgagacca

SEQ ID NO: 73986 - DNA, 16 bp, H. sapiens
ccagaagtttgaggct

SEQ ID NO: 73987 - DNA, 16 bp, H. sapiens
ccagaataaagctgtg

SEQ ID NO: 73988 - DNA, 16 bp, H. sapiens
ccagaatacacaagga

SEQ ID NO: 73989 - DNA, 16 bp, H. sapiens
ccagaatatacaagaa

SEQ ID NO: 73990 - DNA, 16 bp, H. sapiens
ccagaatatataaaaa

SEQ ID NO: 73991 - DNA, 16 bp, H. sapiens
ccagaatatataaata

SEQ ID NO: 73992 - DNA, 16 bp, H. sapiens
ccagaatatataagga

SEQ ID NO: 73993 - DNA, 16 bp, H. sapiens
ccagaatattttaaaa

SEQ ID NO: 73994 - DNA, 16 bp, H. sapiens
ccagaatcacctggag

SEQ ID NO: 73995 - DNA, 16 bp, H. sapiens
ccagaatccacaaaga

SEQ ID NO: 73996 - DNA, 20 bp, H. sapiens
ccagaatctacaatgaactc

SEQ ID NO: 73997 - DNA, 16 bp, H. sapiens
ccagaatctaccagga

SEQ ID NO: 73998 - DNA, 16 bp, H. sapiens
ccagaatctcatgtcc

SEQ ID NO: 73999 - DNA, 16 bp, H. sapiens
ccagaatcttcaaaga

SEQ ID NO: 74000 - DNA, 16 bp, H. sapiens
ccagaatctttttttt

SEQ ID NO: 74001 - DNA, 16 bp, H. sapiens
ccagaatgcagcacag

SEQ ID NO: 74002 - DNA, 16 bp, H. sapiens
ccagaatggcagatcc

SEQ ID NO: 74003 - DNA, 16 bp, H. sapiens
ccagaatgtgactgta

SEQ ID NO: 74004 - DNA, 16 bp, H. sapiens
ccagaattatttttct

SEQ ID NO: 74005 - DNA, 16 bp, H. sapiens
ccagaattcaagacca

SEQ ID NO: 74006 - DNA, 16 bp, H. sapiens
ccagaattctgggatt

SEQ ID NO: 74007 - DNA, 16 bp, H. sapiens
ccagaattcttaacca

SEQ ID NO: 74008 - DNA, 16 bp, H. sapiens
ccagaattgtgagcca

SEQ ID NO: 74009 - DNA, 16 bp, H. sapiens
ccagaatttaattttt

SEQ ID NO: 74010 - DNA, 16 bp, H. sapiens
ccagaatttcatattt

SEQ ID NO: 74011 - DNA, 16 bp, H. sapiens
ccagaatttccttcct

SEQ ID NO: 74012 - DNA, 16 bp, H. sapiens
ccagaatttctacttg

SEQ ID NO: 74013 - DNA, 16 bp, H. sapiens
ccagaatttgtaaact

SEQ ID NO: 74014 - DNA, 16 bp, H. sapiens
ccagaattttctttct

SEQ ID NO: 74015 - DNA, 16 bp, H. sapiens
ccagacaagagctcag

SEQ ID NO: 74016 - DNA, 16 bp, H. sapiens
ccagacaagggatggg

SEQ ID NO: 74017 - DNA, 16 bp, H. sapiens
ccagacaatgagatgc

SEQ ID NO: 74018 - DNA, 16 bp, H. sapiens
ccagacacaaacctcc

SEQ ID NO: 74019 - DNA, 16 bp, H. sapiens
ccagacacagaaggaa

SEQ ID NO: 74020 - DNA, 16 bp, H. sapiens
ccagacacagaaggac

SEQ ID NO: 74021 - DNA, 16 bp, H. sapiens
ccagacaccaaatgcc

SEQ ID NO: 74022 - DNA, 16 bp, H. sapiens
ccagacaccagccctc

SEQ ID NO: 74023 - DNA, 16 bp, H. sapiens
ccagacacccagacac

SEQ ID NO: 74024 - DNA, 16 bp, H. sapiens
ccagacactcccttct

SEQ ID NO: 74025 - DNA, 16 bp, H. sapiens
ccagacactgagtctg

SEQ ID NO: 74026 - DNA, 16 bp, H. sapiens
ccagacagtgggctca

SEQ ID NO: 74027 - DNA, 16 bp, H. sapiens
ccagacatacaaagaa

SEQ ID NO: 74028 - DNA, 16 bp, H. sapiens
ccagacatctgaaact

SEQ ID NO: 74029 - DNA, 16 bp, H. sapiens
ccagacattgaatctg

SEQ ID NO: 74030 - DNA, 16 bp, H. sapiens
ccagacattgctaaat

SEQ ID NO: 74031 - DNA, 16 bp, H. sapiens
ccagaccaacatcctg

SEQ ID NO: 74032 - DNA, 16 bp, H. sapiens
ccagaccaacctggcc

SEQ ID NO: 74033 - DNA, 16 bp, H. sapiens
ccagaccagcagcatc

SEQ ID NO: 74034 - DNA, 16 bp, H. sapiens
ccagaccagccaggcc

SEQ ID NO: 74035 - DNA, 16 bp, H. sapiens
ccagaccagccagggc

SEQ ID NO: 74036 - DNA, 16 bp, H. sapiens
ccagaccagcccgggc

SEQ ID NO: 74037 - DNA, 16 bp, H. sapiens
ccagaccagcctgatc

SEQ ID NO: 74038 - DNA, 16 bp, H. sapiens
ccagaccagcctggct

SEQ ID NO: 74039 - DNA, 16 bp, H. sapiens
ccagaccagcctgggc

SEQ ID NO: 74040 - DNA, 16 bp, H. sapiens
ccagaccatatcattc

SEQ ID NO: 74041 - DNA, 16 bp, H. sapiens
ccagaccatcctgact

SEQ ID NO: 74042 - DNA, 16 bp, H. sapiens
ccagaccatcctggcc

SEQ ID NO: 74043 - DNA, 16 bp, H. sapiens
ccagaccatcctgggc

SEQ ID NO: 74044 - DNA, 16 bp, H. sapiens
ccagaccattaaaact

SEQ ID NO: 74045 - DNA, 16 bp, H. sapiens
ccagacccagggctta

SEQ ID NO: 74046 - DNA, 16 bp, H. sapiens
ccagacccaggtgttt

SEQ ID NO: 74047 - DNA, 16 bp, H. sapiens
ccagaccccaaaagag

SEQ ID NO: 74048 - DNA, 16 bp, H. sapiens
ccagaccccagagtgg

SEQ ID NO: 74049 - DNA, 16 bp, H. sapiens
ccagaccctgtctcca

SEQ ID NO: 74050 - DNA, 16 bp, H. sapiens
ccagacccttcagaaa

SEQ ID NO: 74051 - DNA, 16 bp, H. sapiens
ccagacctattgaatc

SEQ ID NO: 74052 - DNA, 16 bp, H. sapiens
ccagacctcaccacta

SEQ ID NO: 74053 - DNA, 16 bp, H. sapiens
ccagactagccaacat

SEQ ID NO: 74054 - DNA, 16 bp, H. sapiens
ccagactcaggagcct

SEQ ID NO: 74055 - DNA, 16 bp, H. sapiens
ccagactccagaactg

SEQ ID NO: 74056 - DNA, 16 bp, H. sapiens
ccagactccagaattg

SEQ ID NO: 74057 - DNA, 16 bp, H. sapiens
ccagactcccaaagtg

SEQ ID NO: 74058 - DNA, 16 bp, H. sapiens
ccagactcccttgcag

SEQ ID NO: 74059 - DNA, 16 bp, H. sapiens
ccagactctgtctcaa

SEQ ID NO: 74060 - DNA, 16 bp, H. sapiens
ccagactgcctcttta

SEQ ID NO: 74061 - DNA, 16 bp, H. sapiens
ccagactggagcacag

SEQ ID NO: 74062 - DNA, 16 bp, H. sapiens
ccagactggagtgtgg

SEQ ID NO: 74063 - DNA, 18 bp, H. sapiens
ccagactgggtagccagg

SEQ ID NO: 74064 - DNA, 16 bp, H. sapiens
ccagactggtcctgaa

SEQ ID NO: 74065 - DNA, 16 bp, H. sapiens
ccagactgtcttccac

SEQ ID NO: 74066 - DNA, 16 bp, H. sapiens
ccagacttcaccatta

SEQ ID NO: 74067 - DNA, 16 bp, H. sapiens
ccagactttatttgga

SEQ ID NO: 74068 - DNA, 16 bp, H. sapiens
ccagagaaaaaggtcg

SEQ ID NO: 74069 - DNA, 16 bp, H. sapiens
ccagagaaaagaaaat

SEQ ID NO: 74070 - DNA, 16 bp, H. sapiens
ccagagaaaagagtag

SEQ ID NO: 74071 - DNA, 16 bp, H. sapiens
ccagagaaaatcactt

SEQ ID NO: 74072 - DNA, 16 bp, H. sapiens
ccagagaaagccaaat

SEQ ID NO: 74073 - DNA, 16 bp, H. sapiens
ccagagaaaggcgaag

SEQ ID NO: 74074 - DNA, 16 bp, H. sapiens
ccagagaaatcagaag

SEQ ID NO: 74075 - DNA, 16 bp, H. sapiens
ccagagaagatgcttg

SEQ ID NO: 74076 - DNA, 16 bp, H. sapiens
ccagagaaggaggaag

SEQ ID NO: 74077 - DNA, 16 bp, H. sapiens
ccagagacacagagag

SEQ ID NO: 74078 - DNA, 16 bp, H. sapiens
ccagagacatgccagc

SEQ ID NO: 74079 - DNA, 16 bp, H. sapiens
ccagagacccttgttc

SEQ ID NO: 74080 - DNA, 16 bp, H. sapiens
ccagagagggcaggag

SEQ ID NO: 74081 - DNA, 16 bp, H. sapiens
ccagagagggcatgga

SEQ ID NO: 74082 - DNA, 16 bp, H. sapiens
ccagagagggctccag

SEQ ID NO: 74083 - DNA, 16 bp, H. sapiens
ccagagaggggcaggg

SEQ ID NO: 74084 - DNA, 16 bp, H. sapiens
ccagagatcaggagtt

SEQ ID NO: 74085 - DNA, 16 bp, H. sapiens
ccagagatctgcagag

SEQ ID NO: 74086 - DNA, 16 bp, H. sapiens
ccagagatgaagccca

SEQ ID NO: 74087 - DNA, 16 bp, H. sapiens
ccagagatgatttaaa

SEQ ID NO: 74088 - DNA, 16 bp, H. sapiens
ccagagatgcaaggat

SEQ ID NO: 74089 - DNA, 16 bp, H. sapiens
ccagagatgcagggat

SEQ ID NO: 74090 - DNA, 16 bp, H. sapiens
ccagagattctcctgc

SEQ ID NO: 74091 - DNA, 16 bp, H. sapiens
ccagagattctgctac

SEQ ID NO: 74092 - DNA, 16 bp, H. sapiens
ccagagattcttcctt

SEQ ID NO: 74093 - DNA, 16 bp, H. sapiens
ccagagcaacttcatc

SEQ ID NO: 74094 - DNA, 16 bp, H. sapiens
ccagagcaacttccag

SEQ ID NO: 74095 - DNA, 16 bp, H. sapiens
ccagagcaagaccctg

SEQ ID NO: 74096 - DNA, 16 bp, H. sapiens
ccagagcaagactcca

SEQ ID NO: 74097 - DNA, 16 bp, H. sapiens
ccagagcaatcaggca

SEQ ID NO: 74098 - DNA, 16 bp, H. sapiens
ccagagcacattcctt

SEQ ID NO: 74099 - DNA, 16 bp, H. sapiens
ccagagcaccccttct

SEQ ID NO: 74100 - DNA, 16 bp, H. sapiens
ccagagcagcagctca

SEQ ID NO: 74101 - DNA, 16 bp, H. sapiens
ccagagcagcttccag

SEQ ID NO: 74102 - DNA, 16 bp, H. sapiens
ccagagcaggaacaag

SEQ ID NO: 74103 - DNA, 16 bp, H. sapiens
ccagagcaggagcaag

SEQ ID NO: 74104 - DNA, 16 bp, H. sapiens
ccagagcagggcagag

SEQ ID NO: 74105 - DNA, 16 bp, H. sapiens
ccagagcagtgcctgg

SEQ ID NO: 74106 - DNA, 16 bp, H. sapiens
ccagagccaggctgcc

SEQ ID NO: 74107 - DNA, 16 bp, H. sapiens
ccagagccagggcagg

SEQ ID NO: 74108 - DNA, 16 bp, H. sapiens
ccagagccagggccag

SEQ ID NO: 74109 - DNA, 16 bp, H. sapiens
ccagagcccagcccag

SEQ ID NO: 74110 - DNA, 16 bp, H. sapiens
ccagagcccaggagtt

SEQ ID NO: 74111 - DNA, 16 bp, H. sapiens
ccagagcccaggcagg

SEQ ID NO: 74112 - DNA, 16 bp, H. sapiens
ccagagcccaggccag

SEQ ID NO: 74113 - DNA, 16 bp, H. sapiens
ccagagcccagggagg

SEQ ID NO: 74114 - DNA, 16 bp, H. sapiens
ccagagccccagagcc

SEQ ID NO: 74115 - DNA, 16 bp, H. sapiens
ccagagccctgggttt

SEQ ID NO: 74116 - DNA, 16 bp, H. sapiens
ccagagcctagaacag

SEQ ID NO: 74117 - DNA, 16 bp, H. sapiens
ccagagcctgagagct

SEQ ID NO: 74118 - DNA, 16 bp, H. sapiens
ccagagcctggagaca

SEQ ID NO: 74119 - DNA, 16 bp, H. sapiens
ccagagcctggcccag

SEQ ID NO: 74120 - DNA, 16 bp, H. sapiens
ccagagcctgggaagg

SEQ ID NO: 74121 - DNA, 16 bp, H. sapiens
ccagagcctgggctct

SEQ ID NO: 74122 - DNA, 16 bp, H. sapiens
ccagagcctggggagg

SEQ ID NO: 74123 - DNA, 16 bp, H. sapiens
ccagagcctgtgccct

SEQ ID NO: 74124 - DNA, 23 bp, H. sapiens
ccagagcgagactccgtctcaaa

SEQ ID NO: 74125 - DNA, 16 bp, H. sapiens
ccagagcgctgggatt

SEQ ID NO: 74126 - DNA, 16 bp, H. sapiens
ccagagctcaagtgat

SEQ ID NO: 74127 - DNA, 16 bp, H. sapiens
ccagagctcacacagg

SEQ ID NO: 74128 - DNA, 16 bp, H. sapiens
ccagagctcactgcag

SEQ ID NO: 74129 - DNA, 16 bp, H. sapiens
ccagagctctcctgtg

SEQ ID NO: 74130 - DNA, 16 bp, H. sapiens
ccagagctggagtgca

SEQ ID NO: 74131 - DNA, 16 bp, H. sapiens
ccagagctgtgaggaa

SEQ ID NO: 74132 - DNA, 16 bp, H. sapiens
ccagaggaaagaacag

SEQ ID NO: 74133 - DNA, 16 bp, H. sapiens
ccagaggaaaggaatg

SEQ ID NO: 74134 - DNA, 16 bp, H. sapiens
ccagaggaagaagcag

SEQ ID NO: 74135 - DNA, 16 bp, H. sapiens
ccagaggaaggagctg

SEQ ID NO: 74136 - DNA, 16 bp, H. sapiens
ccagaggagagtgggg

SEQ ID NO: 74137 - DNA, 16 bp, H. sapiens
ccagaggcacaaggag

SEQ ID NO: 74138 - DNA, 16 bp, H. sapiens
ccagaggcagagctgg

SEQ ID NO: 74139 - DNA, 16 bp, H. sapiens
ccagaggcctgggagg

SEQ ID NO: 74140 - DNA, 16 bp, H. sapiens
ccagaggctgagaagg

SEQ ID NO: 74141 - DNA, 16 bp, H. sapiens
ccagaggctgagatgg

SEQ ID NO: 74142 - DNA, 16 bp, H. sapiens
ccagaggctgaggagg

SEQ ID NO: 74143 - DNA, 16 bp, H. sapiens
ccagaggctggaaagg

SEQ ID NO: 74144 - DNA, 16 bp, H. sapiens
ccagaggctggaagtc

SEQ ID NO: 74145 - DNA, 16 bp, H. sapiens
ccagaggctgggaaga

SEQ ID NO: 74146 - DNA, 16 bp, H. sapiens
ccagaggctggggatg

SEQ ID NO: 74147 - DNA, 16 bp, H. sapiens
ccagaggctgggggag

SEQ ID NO: 74148 - DNA, 16 bp, H. sapiens
ccagaggctggtggag

SEQ ID NO: 74149 - DNA, 16 bp, H. sapiens
ccagaggcttaggagg

SEQ ID NO: 74150 - DNA, 16 bp, H. sapiens
ccagagggagagagga

SEQ ID NO: 74151 - DNA, 16 bp, H. sapiens
ccagagggagaggcag

SEQ ID NO: 74152 - DNA, 16 bp, H. sapiens
ccagaggggaatcatc

SEQ ID NO: 74153 - DNA, 16 bp, H. sapiens
ccagagggggctgagg

SEQ ID NO: 74154 - DNA, 16 bp, H. sapiens
ccagaggtcacacagc

SEQ ID NO: 74155 - DNA, 16 bp, H. sapiens
ccagaggtcactctca

SEQ ID NO: 74156 - DNA, 16 bp, H. sapiens
ccagaggtgaagccta

SEQ ID NO: 74157 - DNA, 16 bp, H. sapiens
ccagaggtgcaaggag

SEQ ID NO: 74158 - DNA, 16 bp, H. sapiens
ccagagtacagtggca

SEQ ID NO: 74159 - DNA, 16 bp, H. sapiens
ccagagtcctgggatt

SEQ ID NO: 74160 - DNA, 16 bp, H. sapiens
ccagagtctcattctg

SEQ ID NO: 74161 - DNA, 16 bp, H. sapiens
ccagagtctgtgttct

SEQ ID NO: 74162 - DNA, 16 bp, H. sapiens
ccagagtcttgctctg

SEQ ID NO: 74163 - DNA, 19 bp, H. sapiens
ccagagtgggcgccaaggc

SEQ ID NO: 74164 - DNA, 16 bp, H. sapiens
ccagagtgtgacgttc

SEQ ID NO: 74165 - DNA, 16 bp, H. sapiens
ccagagttagcacaga

SEQ ID NO: 74166 - DNA, 16 bp, H. sapiens
ccagagttttgggtcc

SEQ ID NO: 74167 - DNA, 16 bp, H. sapiens
ccagataaaaactaca

SEQ ID NO: 74168 - DNA, 16 bp, H. sapiens
ccagataaatttaaca

SEQ ID NO: 74169 - DNA, 16 bp, H. sapiens
ccagataatttttgaa

SEQ ID NO: 74170 - DNA, 16 bp, H. sapiens
ccagatagctgggatt

SEQ ID NO: 74171 - DNA, 16 bp, H. sapiens
ccagatatggtggtgt

SEQ ID NO: 74172 - DNA, 16 bp, H. sapiens
ccagatcacaccactg

SEQ ID NO: 74173 - DNA, 16 bp, H. sapiens
ccagatctcatgagaa

SEQ ID NO: 74174 - DNA, 16 bp, H. sapiens
ccagatcttctgattt

SEQ ID NO: 74175 - DNA, 16 bp, H. sapiens
ccagatctttcttttc

SEQ ID NO: 74176 - DNA, 16 bp, H. sapiens
ccagatctttgaggaa

SEQ ID NO: 74177 - DNA, 16 bp, H. sapiens
ccagatcttttttttt

SEQ ID NO: 74178 - DNA, 16 bp, H. sapiens
ccagatgaattaaaga

SEQ ID NO: 74179 - DNA, 16 bp, H. sapiens
ccagatgaggaaatgg

SEQ ID NO: 74180 - DNA, 16 bp, H. sapiens
ccagatgatgatgatg

SEQ ID NO: 74181 - DNA, 16 bp, H. sapiens
ccagatgatgggcagc

SEQ ID NO: 74182 - DNA, 16 bp, H. sapiens
ccagatgcagcccctc

SEQ ID NO: 74183 - DNA, 16 bp, H. sapiens
ccagatgccattaaga

SEQ ID NO: 74184 - DNA, 16 bp, H. sapiens
ccagatgctggtgcca

SEQ ID NO: 74185 - DNA, 16 bp, H. sapiens
ccagatggagctgaaa

SEQ ID NO: 74186 - DNA, 16 bp, H. sapiens
ccagatggataaactg

SEQ ID NO: 74187 - DNA, 16 bp, H. sapiens
ccagatggcttcacag

SEQ ID NO: 74188 - DNA, 16 bp, H. sapiens
ccagatggcttcactg

SEQ ID NO: 74189 - DNA, 16 bp, H. sapiens
ccagatggcttcatgg

SEQ ID NO: 74190 - DNA, 16 bp, H. sapiens
ccagatgggcaggagg

SEQ ID NO: 74191 - DNA, 16 bp, H. sapiens
ccagatggggtggctg

SEQ ID NO: 74192 - DNA, 16 bp, H. sapiens
ccagatggtttcactg

SEQ ID NO: 74193 - DNA, 16 bp, H. sapiens
ccagatgtataaagca

SEQ ID NO: 74194 - DNA, 16 bp, H. sapiens
ccagatgtccatcagt

SEQ ID NO: 74195 - DNA, 16 bp, H. sapiens
ccagatgtggtgatgc

SEQ ID NO: 74196 - DNA, 16 bp, H. sapiens
ccagatgtggtgatgg

SEQ ID NO: 74197 - DNA, 16 bp, H. sapiens
ccagattaatcttcct

SEQ ID NO: 74198 - DNA, 16 bp, H. sapiens
ccagattctttttttt

SEQ ID NO: 74199 - DNA, 16 bp, H. sapiens
ccagattggaaaggaa

SEQ ID NO: 74200 - DNA, 16 bp, H. sapiens
ccagatttggaaagtt

SEQ ID NO: 74201 - DNA, 16 bp, H. sapiens
ccagcaaactctagca

SEQ ID NO: 74202 - DNA, 16 bp, H. sapiens
ccagcaaagatcatct

SEQ ID NO: 74203 - DNA, 16 bp, H. sapiens
ccagcaaatttttgta

SEQ ID NO: 74204 - DNA, 16 bp, H. sapiens
ccagcaactcaggagg

SEQ ID NO: 74205 - DNA, 16 bp, H. sapiens
ccagcaactccagcca

SEQ ID NO: 74206 - DNA, 21 bp, H. sapiens
ccagcaacttgggaggctgag

SEQ ID NO: 74207 - DNA, 16 bp, H. sapiens
ccagcaagacaggcca

SEQ ID NO: 74208 - DNA, 16 bp, H. sapiens
ccagcaagagaacaaa

SEQ ID NO: 74209 - DNA, 16 bp, H. sapiens
ccagcaagcagctgga

SEQ ID NO: 74210 - DNA, 16 bp, H. sapiens
ccagcaaggccaggga

SEQ ID NO: 74211 - DNA, 16 bp, H. sapiens
ccagcaagggaacaaa

SEQ ID NO: 74212 - DNA, 16 bp, H. sapiens
ccagcaatgatagact

SEQ ID NO: 74213 - DNA, 16 bp, H. sapiens
ccagcaatggggaaag

SEQ ID NO: 74214 - DNA, 16 bp, H. sapiens
ccagcaattccattcc

SEQ ID NO: 74215 - DNA, 16 bp, H. sapiens
ccagcacagcacacca

SEQ ID NO: 74216 - DNA, 16 bp, H. sapiens
ccagcacagcagcctg

SEQ ID NO: 74217 - DNA, 16 bp, H. sapiens
ccagcacagccacagg

SEQ ID NO: 74218 - DNA, 16 bp, H. sapiens
ccagcacagccctggg

SEQ ID NO: 74219 - DNA, 16 bp, H. sapiens
ccagcacaggtgccag

SEQ ID NO: 74220 - DNA, 16 bp, H. sapiens
ccagcacagtacctgg

SEQ ID NO: 74221 - DNA, 16 bp, H. sapiens
ccagcacagtgactca

SEQ ID NO: 74222 - DNA, 16 bp, H. sapiens
ccagcacatctctgag

SEQ ID NO: 74223 - DNA, 16 bp, H. sapiens
ccagcacatgaaagca

SEQ ID NO: 74224 - DNA, 16 bp, H. sapiens
ccagcaccacctccac

SEQ ID NO: 74225 - DNA, 16 bp, H. sapiens
ccagcaccagcccaga

SEQ ID NO: 74226 - DNA, 16 bp, H. sapiens
ccagcaccagcctgaa

SEQ ID NO: 74227 - DNA, 16 bp, H. sapiens
ccagcaccagggaaag

SEQ ID NO: 74228 - DNA, 16 bp, H. sapiens
ccagcaccatccatgt

SEQ ID NO: 74229 - DNA, 16 bp, H. sapiens
ccagcacccacccagg

SEQ ID NO: 74230 - DNA, 16 bp, H. sapiens
ccagcacccagcacag

SEQ ID NO: 74231 - DNA, 16 bp, H. sapiens
ccagcacctcagaatg

SEQ ID NO: 74232 - DNA, 16 bp, H. sapiens
ccagcaccttctacaa

SEQ ID NO: 74233 - DNA, 16 bp, H. sapiens
ccagcaccttgacttt

SEQ ID NO: 74234 - DNA, 16 bp, H. sapiens
ccagcaccttgatctt

SEQ ID NO: 74235 - DNA, 16 bp, H. sapiens
ccagcaccttgggaag

SEQ ID NO: 74236 - DNA, 17 bp, H. sapiens
ccagcacgggagaaaga

SEQ ID NO: 74237 - DNA, 16 bp, H. sapiens
ccagcactcaggaggc

SEQ ID NO: 74238 - DNA, 16 bp, H. sapiens
ccagcactgggaggcc

SEQ ID NO: 74239 - DNA, 16 bp, H. sapiens
ccagcacttccctgcc

SEQ ID NO: 74240 - DNA, 16 bp, H. sapiens
ccagcacttcggcagg

SEQ ID NO: 74241 - DNA, 16 bp, H. sapiens
ccagcacttctgggag

SEQ ID NO: 74242 - DNA, 16 bp, H. sapiens
ccagcacttggggaga

SEQ ID NO: 74243 - DNA, 16 bp, H. sapiens
ccagcactttgaggag

SEQ ID NO: 74244 - DNA, 16 bp, H. sapiens
ccagcactttgaggcc

SEQ ID NO: 74245 - DNA, 16 bp, H. sapiens
ccagcactttgcaaag

SEQ ID NO: 74246 - DNA, 16 bp, H. sapiens
ccagcactttgggcag

SEQ ID NO: 74247 - DNA, 16 bp, H. sapiens
ccagcagaagaaagaa

SEQ ID NO: 74248 - DNA, 16 bp, H. sapiens
ccagcagaagctgcag

SEQ ID NO: 74249 - DNA, 16 bp, H. sapiens
ccagcagagactgcag

SEQ ID NO: 74250 - DNA, 16 bp, H. sapiens
ccagcagagcagggct

SEQ ID NO: 74251 - DNA, 16 bp, H. sapiens
ccagcagagctaccag

SEQ ID NO: 74252 - DNA, 16 bp, H. sapiens
ccagcagaggctgcaa

SEQ ID NO: 74253 - DNA, 16 bp, H. sapiens
ccagcagaggcttcag

SEQ ID NO: 74254 - DNA, 16 bp, H. sapiens
ccagcagagggcagca

SEQ ID NO: 74255 - DNA, 16 bp, H. sapiens
ccagcagagggcagtg

SEQ ID NO: 74256 - DNA, 16 bp, H. sapiens
ccagcagatctgcagc

SEQ ID NO: 74257 - DNA, 16 bp, H. sapiens
ccagcagcacaacaaa

SEQ ID NO: 74258 - DNA, 16 bp, H. sapiens
ccagcagcacatcaca

SEQ ID NO: 74259 - DNA, 16 bp, H. sapiens
ccagcagcaccagcag

SEQ ID NO: 74260 - DNA, 16 bp, H. sapiens
ccagcagcaccatgcc

SEQ ID NO: 74261 - DNA, 16 bp, H. sapiens
ccagcagcacctcaaa

SEQ ID NO: 74262 - DNA, 16 bp, H. sapiens
ccagcagcactttggg

SEQ ID NO: 74263 - DNA, 16 bp, H. sapiens
ccagcagcagcaacct

SEQ ID NO: 74264 - DNA, 16 bp, H. sapiens
ccagcagcagcagtag

SEQ ID NO: 74265 - DNA, 16 bp, H. sapiens
ccagcagcagctgcag

SEQ ID NO: 74266 - DNA, 16 bp, H. sapiens
ccagcagcaggaagaa

SEQ ID NO: 74267 - DNA, 16 bp, H. sapiens
ccagcagcagttttct

SEQ ID NO: 74268 - DNA, 16 bp, H. sapiens
ccagcagcatcacctg

SEQ ID NO: 74269 - DNA, 16 bp, H. sapiens
ccagcagcatttgttg

SEQ ID NO: 74270 - DNA, 16 bp, H. sapiens
ccagcagccacaggcc

SEQ ID NO: 74271 - DNA, 16 bp, H. sapiens
ccagcagccaccagaa

SEQ ID NO: 74272 - DNA, 16 bp, H. sapiens
ccagcagccactccca

SEQ ID NO: 74273 - DNA, 16 bp, H. sapiens
ccagcagccccacctc

SEQ ID NO: 74274 - DNA, 16 bp, H. sapiens
ccagcagcccctccca

SEQ ID NO: 74275 - DNA, 16 bp, H. sapiens
ccagcagcccctgcag

SEQ ID NO: 74276 - DNA, 16 bp, H. sapiens
ccagcagcccctgcct

SEQ ID NO: 74277 - DNA, 16 bp, H. sapiens
ccagcagccctcaggg

SEQ ID NO: 74278 - DNA, 16 bp, H. sapiens
ccagcagccctggcct

SEQ ID NO: 74279 - DNA, 16 bp, H. sapiens
ccagcagcctctgcag

SEQ ID NO: 74280 - DNA, 16 bp, H. sapiens
ccagcagcctggccaa

SEQ ID NO: 74281 - DNA, 16 bp, H. sapiens
ccagcagcctgggcaa

SEQ ID NO: 74282 - DNA, 16 bp, H. sapiens
ccagcagctcaggagg

SEQ ID NO: 74283 - DNA, 16 bp, H. sapiens
ccagcagctcattgag

SEQ ID NO: 74284 - DNA, 16 bp, H. sapiens
ccagcagctccagcca

SEQ ID NO: 74285 - DNA, 16 bp, H. sapiens
ccagcagctcctggcc

SEQ ID NO: 74286 - DNA, 16 bp, H. sapiens
ccagcagctcctggga

SEQ ID NO: 74287 - DNA, 16 bp, H. sapiens
ccagcagctgcagagg

SEQ ID NO: 74288 - DNA, 16 bp, H. sapiens
ccagcagctgcagcag

SEQ ID NO: 74289 - DNA, 16 bp, H. sapiens
ccagcagctgggactg

SEQ ID NO: 74290 - DNA, 16 bp, H. sapiens
ccagcaggcagaggtt

SEQ ID NO: 74291 - DNA, 16 bp, H. sapiens
ccagcaggcagctgga

SEQ ID NO: 74292 - DNA, 16 bp, H. sapiens
ccagcaggccagagtg

SEQ ID NO: 74293 - DNA, 16 bp, H. sapiens
ccagcaggccctggtg

SEQ ID NO: 74294 - DNA, 16 bp, H. sapiens
ccagcagggccctggg

SEQ ID NO: 74295 - DNA, 16 bp, H. sapiens
ccagcagggctggccg

SEQ ID NO: 74296 - DNA, 16 bp, H. sapiens
ccagcagggggcagca

SEQ ID NO: 74297 - DNA, 16 bp, H. sapiens
ccagcaggtggaggct

SEQ ID NO: 74298 - DNA, 16 bp, H. sapiens
ccagcaggtggcagca

SEQ ID NO: 74299 - DNA, 16 bp, H. sapiens
ccagcagtggaacaaa

SEQ ID NO: 74300 - DNA, 16 bp, H. sapiens
ccagcagtggcagcag

SEQ ID NO: 74301 - DNA, 16 bp, H. sapiens
ccagcagtgggatttc

SEQ ID NO: 74302 - DNA, 16 bp, H. sapiens
ccagcataaatgggtt

SEQ ID NO: 74303 - DNA, 16 bp, H. sapiens
ccagcataattatttt

SEQ ID NO: 74304 - DNA, 16 bp, H. sapiens
ccagcatacctggcta

SEQ ID NO: 74305 - DNA, 16 bp, H. sapiens
ccagcatcctcctgat

SEQ ID NO: 74306 - DNA, 16 bp, H. sapiens
ccagcatctgctcctg

SEQ ID NO: 74307 - DNA, 16 bp, H. sapiens
ccagcatctgcttggc

SEQ ID NO: 74308 - DNA, 16 bp, H. sapiens
ccagcatctgttgttt

SEQ ID NO: 74309 - DNA, 17 bp, H. sapiens
ccagcatgcagctggag

SEQ ID NO: 74310 - DNA, 16 bp, H. sapiens
ccagcatgcccggctg

SEQ ID NO: 74311 - DNA, 16 bp, H. sapiens
ccagcatgcctggcct

SEQ ID NO: 74312 - DNA, 16 bp, H. sapiens
ccagcatgcctggctg

SEQ ID NO: 74313 - DNA, 16 bp, H. sapiens
ccagcatggctaggat

SEQ ID NO: 74314 - DNA, 16 bp, H. sapiens
ccagcatgggagagag

SEQ ID NO: 74315 - DNA, 16 bp, H. sapiens
ccagcatgggcaacat

SEQ ID NO: 74316 - DNA, 16 bp, H. sapiens
ccagcatgggcagcag

SEQ ID NO: 74317 - DNA, 16 bp, H. sapiens
ccagcatgggccacag

SEQ ID NO: 74318 - DNA, 16 bp, H. sapiens
ccagcatggtggtgca

SEQ ID NO: 74319 - DNA, 16 bp, H. sapiens
ccagcattatactgaa

SEQ ID NO: 74320 - DNA, 16 bp, H. sapiens
ccagcattccctgcag

SEQ ID NO: 74321 - DNA, 16 bp, H. sapiens
ccagcattccttcctg

SEQ ID NO: 74322 - DNA, 16 bp, H. sapiens
ccagcattctgggaag

SEQ ID NO: 74323 - DNA, 16 bp, H. sapiens
ccagcattttggggga

SEQ ID NO: 74324 - DNA, 16 bp, H. sapiens
ccagccaacaccttga

SEQ ID NO: 74325 - DNA, 16 bp, H. sapiens
ccagccaagccggcca

SEQ ID NO: 74326 - DNA, 16 bp, H. sapiens
ccagccaaggcaacag

SEQ ID NO: 74327 - DNA, 16 bp, H. sapiens
ccagccaagggaggcg

SEQ ID NO: 74328 - DNA, 16 bp, H. sapiens
ccagccaatttttttt

SEQ ID NO: 74329 - DNA, 16 bp, H. sapiens
ccagccacaaaaagac

SEQ ID NO: 74330 - DNA, 16 bp, H. sapiens
ccagccacacagaact

SEQ ID NO: 74331 - DNA, 16 bp, H. sapiens
ccagccacacagcagg

SEQ ID NO: 74332 - DNA, 16 bp, H. sapiens
ccagccacacggaact

SEQ ID NO: 74333 - DNA, 16 bp, H. sapiens
ccagccacactgacct

SEQ ID NO: 74334 - DNA, 16 bp, H. sapiens
ccagccacagaaagac

SEQ ID NO: 74335 - DNA, 16 bp, H. sapiens
ccagccacagcctccc

SEQ ID NO: 74336 - DNA, 16 bp, H. sapiens
ccagccacatggagct

SEQ ID NO: 74337 - DNA, 16 bp, H. sapiens
ccagccaccacacctg

SEQ ID NO: 74338 - DNA, 16 bp, H. sapiens
ccagccaccagaacca

SEQ ID NO: 74339 - DNA, 16 bp, H. sapiens
ccagccaccagcccct

SEQ ID NO: 74340 - DNA, 16 bp, H. sapiens
ccagccaccatgccca

SEQ ID NO: 74341 - DNA, 16 bp, H. sapiens
ccagccacccagccag

SEQ ID NO: 74342 - DNA, 16 bp, H. sapiens
ccagccacccaggagg

SEQ ID NO: 74343 - DNA, 16 bp, H. sapiens
ccagccacctcagcct

SEQ ID NO: 74344 - DNA, 16 bp, H. sapiens
ccagccacctctgcaa

SEQ ID NO: 74345 - DNA, 16 bp, H. sapiens
ccagccactccagctt

SEQ ID NO: 74346 - DNA, 16 bp, H. sapiens
ccagccagaaatctct

SEQ ID NO: 74347 - DNA, 16 bp, H. sapiens
ccagccagcagccagc

SEQ ID NO: 74348 - DNA, 16 bp, H. sapiens
ccagccagcagcggca

SEQ ID NO: 74349 - DNA, 16 bp, H. sapiens
ccagccagccaaacca

SEQ ID NO: 74350 - DNA, 16 bp, H. sapiens
ccagccagccaccagc

SEQ ID NO: 74351 - DNA, 16 bp, H. sapiens
ccagccagcccagcca

SEQ ID NO: 74352 - DNA, 16 bp, H. sapiens
ccagccagcctggcca

SEQ ID NO: 74353 - DNA, 16 bp, H. sapiens
ccagccagctgccccg

SEQ ID NO: 74354 - DNA, 16 bp, H. sapiens
ccagccaggccaacag

SEQ ID NO: 74355 - DNA, 16 bp, H. sapiens
ccagccaggccaatgt

SEQ ID NO: 74356 - DNA, 16 bp, H. sapiens
ccagccaggccagcca

SEQ ID NO: 74357 - DNA, 16 bp, H. sapiens
ccagccaggccctgcc

SEQ ID NO: 74358 - DNA, 16 bp, H. sapiens
ccagccaggctaacat

SEQ ID NO: 74359 - DNA, 16 bp, H. sapiens
ccagccaggcttatgt

SEQ ID NO: 74360 - DNA, 16 bp, H. sapiens
ccagccagggggacag

SEQ ID NO: 74361 - DNA, 16 bp, H. sapiens
ccagccatgaggaact

SEQ ID NO: 74362 - DNA, 16 bp, H. sapiens
ccagccatggtggttc

SEQ ID NO: 74363 - DNA, 16 bp, H. sapiens
ccagccatgtgaactg

SEQ ID NO: 74364 - DNA, 16 bp, H. sapiens
ccagccattcaggagg

SEQ ID NO: 74365 - DNA, 16 bp, H. sapiens
ccagccatttggaact

SEQ ID NO: 74366 - DNA, 16 bp, H. sapiens
ccagcccaagaaacca

SEQ ID NO: 74367 - DNA, 16 bp, H. sapiens
ccagcccacagccagc

SEQ ID NO: 74368 - DNA, 16 bp, H. sapiens
ccagcccaccctgcag

SEQ ID NO: 74369 - DNA, 16 bp, H. sapiens
ccagcccactgccact

SEQ ID NO: 74370 - DNA, 16 bp, H. sapiens
ccagcccactgggcag

SEQ ID NO: 74371 - DNA, 16 bp, H. sapiens
ccagcccagaaaaggg

SEQ ID NO: 74372 - DNA, 16 bp, H. sapiens
ccagcccagagagggg

SEQ ID NO: 74373 - DNA, 16 bp, H. sapiens
ccagcccagagccagg

SEQ ID NO: 74374 - DNA, 16 bp, H. sapiens
ccagcccagagcccag

SEQ ID NO: 74375 - DNA, 16 bp, H. sapiens
ccagcccagagcctgg

SEQ ID NO: 74376 - DNA, 16 bp, H. sapiens
ccagcccagagctggg

SEQ ID NO: 74377 - DNA, 16 bp, H. sapiens
ccagcccagccacagc

SEQ ID NO: 74378 - DNA, 16 bp, H. sapiens
ccagcccagcccagca

SEQ ID NO: 74379 - DNA, 16 bp, H. sapiens
ccagcccagccccagg

SEQ ID NO: 74380 - DNA, 16 bp, H. sapiens
ccagcccagcccctgc

SEQ ID NO: 74381 - DNA, 16 bp, H. sapiens
ccagcccagccctgcc

SEQ ID NO: 74382 - DNA, 16 bp, H. sapiens
ccagcccagcctggcc

SEQ ID NO: 74383 - DNA, 16 bp, H. sapiens
ccagcccagcctggga

SEQ ID NO: 74384 - DNA, 16 bp, H. sapiens
ccagcccagctcccca

SEQ ID NO: 74385 - DNA, 16 bp, H. sapiens
ccagcccaggaaagca

SEQ ID NO: 74386 - DNA, 16 bp, H. sapiens
ccagcccaggaagcca

SEQ ID NO: 74387 - DNA, 16 bp, H. sapiens
ccagcccaggaagggg

SEQ ID NO: 74388 - DNA, 16 bp, H. sapiens
ccagcccaggagttca

SEQ ID NO: 74389 - DNA, 16 bp, H. sapiens
ccagcccaggcaccag

SEQ ID NO: 74390 - DNA, 16 bp, H. sapiens
ccagcccaggcagcag

SEQ ID NO: 74391 - DNA, 16 bp, H. sapiens
ccagcccaggcccagc

SEQ ID NO: 74392 - DNA, 16 bp, H. sapiens
ccagcccaggcccagg

SEQ ID NO: 74393 - DNA, 16 bp, H. sapiens
ccagcccaggccccag

SEQ ID NO: 74394 - DNA, 16 bp, H. sapiens
ccagcccaggcctccc

SEQ ID NO: 74395 - DNA, 16 bp, H. sapiens
ccagcccagggcctgg

SEQ ID NO: 74396 - DNA, 16 bp, H. sapiens
ccagcccaggggacag

SEQ ID NO: 74397 - DNA, 16 bp, H. sapiens
ccagcccaggtgacag

SEQ ID NO: 74398 - DNA, 16 bp, H. sapiens
ccagcccagtgcctgg

SEQ ID NO: 74399 - DNA, 16 bp, H. sapiens
ccagcccatgctgagg

SEQ ID NO: 74400 - DNA, 16 bp, H. sapiens
ccagccccacagggtc

SEQ ID NO: 74401 - DNA, 16 bp, H. sapiens
ccagccccactggcct

SEQ ID NO: 74402 - DNA, 16 bp, H. sapiens
ccagccccagcaacat

SEQ ID NO: 74403 - DNA, 16 bp, H. sapiens
ccagccccagccagag

SEQ ID NO: 74404 - DNA, 16 bp, H. sapiens
ccagccccagccctag

SEQ ID NO: 74405 - DNA, 16 bp, H. sapiens
ccagccccagccttgg

SEQ ID NO: 74406 - DNA, 16 bp, H. sapiens
ccagccccagctcctg

SEQ ID NO: 74407 - DNA, 16 bp, H. sapiens
ccagccccagctctgc

SEQ ID NO: 74408 - DNA, 16 bp, H. sapiens
ccagccccaggcagcc

SEQ ID NO: 74409 - DNA, 16 bp, H. sapiens
ccagccccaggcagtg

SEQ ID NO: 74410 - DNA, 16 bp, H. sapiens
ccagccccaggccagg

SEQ ID NO: 74411 - DNA, 16 bp, H. sapiens
ccagccccaggcccct

SEQ ID NO: 74412 - DNA, 16 bp, H. sapiens
ccagccccaggcctcc

SEQ ID NO: 74413 - DNA, 16 bp, H. sapiens
ccagccccatccatgt

SEQ ID NO: 74414 - DNA, 16 bp, H. sapiens
ccagcccccagagctg

SEQ ID NO: 74415 - DNA, 16 bp, H. sapiens
ccagcccccagccctg

SEQ ID NO: 74416 - DNA, 16 bp, H. sapiens
ccagcccccagcctca

SEQ ID NO: 74417 - DNA, 16 bp, H. sapiens
ccagcccccagccttc

SEQ ID NO: 74418 - DNA, 16 bp, H. sapiens
ccagccccccatctct

SEQ ID NO: 74419 - DNA, 16 bp, H. sapiens
ccagccccctgccctg

SEQ ID NO: 74420 - DNA, 16 bp, H. sapiens
ccagccccgagcccag

SEQ ID NO: 74421 - DNA, 16 bp, H. sapiens
ccagcccctccccaga

SEQ ID NO: 74422 - DNA, 16 bp, H. sapiens
ccagcccctccccagg

SEQ ID NO: 74423 - DNA, 16 bp, H. sapiens
ccagcccctccttcct

SEQ ID NO: 74424 - DNA, 16 bp, H. sapiens
ccagcccctctcctgc

SEQ ID NO: 74425 - DNA, 16 bp, H. sapiens
ccagcccctctctcca

SEQ ID NO: 74426 - DNA, 16 bp, H. sapiens
ccagcccctctgcctc

SEQ ID NO: 74427 - DNA, 16 bp, H. sapiens
ccagcccctcttccct

SEQ ID NO: 74428 - DNA, 16 bp, H. sapiens
ccagcccctgccaacc

SEQ ID NO: 74429 - DNA, 16 bp, H. sapiens
ccagcccctgccccag

SEQ ID NO: 74430 - DNA, 16 bp, H. sapiens
ccagcccctgcctctc

SEQ ID NO: 74431 - DNA, 16 bp, H. sapiens
ccagcccctgcctggg

SEQ ID NO: 74432 - DNA, 16 bp, H. sapiens
ccagcccctggcaccc

SEQ ID NO: 74433 - DNA, 16 bp, H. sapiens
ccagcccctggcagcc

SEQ ID NO: 74434 - DNA, 16 bp, H. sapiens
ccagcccctggccacc

SEQ ID NO: 74435 - DNA, 16 bp, H. sapiens
ccagcccctggggcag

SEQ ID NO: 74436 - DNA, 16 bp, H. sapiens
ccagccccttcctggg

SEQ ID NO: 74437 - DNA, 16 bp, H. sapiens
ccagccctgacccctc

SEQ ID NO: 74438 - DNA, 16 bp, H. sapiens
ccagccctgaggctac

SEQ ID NO: 74439 - DNA, 16 bp, H. sapiens
ccagccctgcagcctc

SEQ ID NO: 74440 - DNA, 16 bp, H. sapiens
ccagccctgcagtgtg

SEQ ID NO: 74441 - DNA, 16 bp, H. sapiens
ccagccctgccagcac

SEQ ID NO: 74442 - DNA, 16 bp, H. sapiens
ccagccctgcccacag

SEQ ID NO: 74443 - DNA, 16 bp, H. sapiens
ccagccctgcccacct

SEQ ID NO: 74444 - DNA, 16 bp, H. sapiens
ccagccctgccccagg

SEQ ID NO: 74445 - DNA, 16 bp, H. sapiens
ccagccctgccctcag

SEQ ID NO: 74446 - DNA, 16 bp, H. sapiens
ccagccctgccctgtg

SEQ ID NO: 74447 - DNA, 16 bp, H. sapiens
ccagccctgcccttgg

SEQ ID NO: 74448 - DNA, 16 bp, H. sapiens
ccagccctgcctcagc

SEQ ID NO: 74449 - DNA, 16 bp, H. sapiens
ccagccctgcctcctc

SEQ ID NO: 74450 - DNA, 16 bp, H. sapiens
ccagccctgcctctgc

SEQ ID NO: 74451 - DNA, 16 bp, H. sapiens
ccagccctgcctgccc

SEQ ID NO: 74452 - DNA, 16 bp, H. sapiens
ccagccctgcctgggc

SEQ ID NO: 74453 - DNA, 16 bp, H. sapiens
ccagccctgctcctcc

SEQ ID NO: 74454 - DNA, 16 bp, H. sapiens
ccagccctgctctggc

SEQ ID NO: 74455 - DNA, 16 bp, H. sapiens
ccagccctgctggccc

SEQ ID NO: 74456 - DNA, 16 bp, H. sapiens
ccagccctgcttcctg

SEQ ID NO: 74457 - DNA, 16 bp, H. sapiens
ccagccctggcctccc

SEQ ID NO: 74458 - DNA, 16 bp, H. sapiens
ccagccctggcctctg

SEQ ID NO: 74459 - DNA, 16 bp, H. sapiens
ccagccctggctccag

SEQ ID NO: 74460 - DNA, 16 bp, H. sapiens
ccagccctgggcagtg

SEQ ID NO: 74461 - DNA, 16 bp, H. sapiens
ccagccctgggccctg

SEQ ID NO: 74462 - DNA, 16 bp, H. sapiens
ccagccctgggcctgc

SEQ ID NO: 74463 - DNA, 16 bp, H. sapiens
ccagccctgggctcag

SEQ ID NO: 74464 - DNA, 16 bp, H. sapiens
ccagccctggtgacag

SEQ ID NO: 74465 - DNA, 16 bp, H. sapiens
ccagccctgtgctggg

SEQ ID NO: 74466 - DNA, 16 bp, H. sapiens
ccagcccttcctccct

SEQ ID NO: 74467 - DNA, 16 bp, H. sapiens
ccagcccttcctgccc

SEQ ID NO: 74468 - DNA, 16 bp, H. sapiens
ccagcccttccttccc

SEQ ID NO: 74469 - DNA, 16 bp, H. sapiens
ccagccggtccctccg

SEQ ID NO: 74470 - DNA, 16 bp, H. sapiens
ccagccgtggtggtgg

SEQ ID NO: 74471 - DNA, 16 bp, H. sapiens
ccagcctaaaatgtca

SEQ ID NO: 74472 - DNA, 16 bp, H. sapiens
ccagcctaagcaacat

SEQ ID NO: 74473 - DNA, 16 bp, H. sapiens
ccagcctagcaaagag

SEQ ID NO: 74474 - DNA, 16 bp, H. sapiens
ccagcctcaagtattt

SEQ ID NO: 74475 - DNA, 16 bp, H. sapiens
ccagcctcactgccac

SEQ ID NO: 74476 - DNA, 16 bp, H. sapiens
ccagcctcagcatccc

SEQ ID NO: 74477 - DNA, 16 bp, H. sapiens
ccagcctcagccccca

SEQ ID NO: 74478 - DNA, 16 bp, H. sapiens
ccagcctcagcctccc

SEQ ID NO: 74479 - DNA, 16 bp, H. sapiens
ccagcctcagcctcct

SEQ ID NO: 74480 - DNA, 16 bp, H. sapiens
ccagcctcagcctgcc

SEQ ID NO: 74481 - DNA, 16 bp, H. sapiens
ccagcctcagcctggg

SEQ ID NO: 74482 - DNA, 16 bp, H. sapiens
ccagcctcagcttcct

SEQ ID NO: 74483 - DNA, 16 bp, H. sapiens
ccagcctccaccctca

SEQ ID NO: 74484 - DNA, 16 bp, H. sapiens
ccagcctccagaaccg

SEQ ID NO: 74485 - DNA, 16 bp, H. sapiens
ccagcctccagatctg

SEQ ID NO: 74486 - DNA, 16 bp, H. sapiens
ccagcctccagcatgg

SEQ ID NO: 74487 - DNA, 16 bp, H. sapiens
ccagcctccagcccag

SEQ ID NO: 74488 - DNA, 16 bp, H. sapiens
ccagcctccagcctgg

SEQ ID NO: 74489 - DNA, 16 bp, H. sapiens
ccagcctcccaaagtg

SEQ ID NO: 74490 - DNA, 16 bp, H. sapiens
ccagcctcccaagcag

SEQ ID NO: 74491 - DNA, 16 bp, H. sapiens
ccagcctcccaagtag

SEQ ID NO: 74492 - DNA, 16 bp, H. sapiens
ccagcctcccaggccc

SEQ ID NO: 74493 - DNA, 16 bp, H. sapiens
ccagcctcccagggct

SEQ ID NO: 74494 - DNA, 16 bp, H. sapiens
ccagcctcccctgcag

SEQ ID NO: 74495 - DNA, 16 bp, H. sapiens
ccagcctcccgagtag

SEQ ID NO: 74496 - DNA, 16 bp, H. sapiens
ccagcctccctccctg

SEQ ID NO: 74497 - DNA, 16 bp, H. sapiens
ccagcctcccttgcag

SEQ ID NO: 74498 - DNA, 16 bp, H. sapiens
ccagcctcctctccct

SEQ ID NO: 74499 - DNA, 16 bp, H. sapiens
ccagcctcctgagaag

SEQ ID NO: 74500 - DNA, 16 bp, H. sapiens
ccagcctcctgctgcc

SEQ ID NO: 74501 - DNA, 16 bp, H. sapiens
ccagcctccttccctg

SEQ ID NO: 74502 - DNA, 16 bp, H. sapiens
ccagcctcggcctccc

SEQ ID NO: 74503 - DNA, 16 bp, H. sapiens
ccagcctcggccttcc

SEQ ID NO: 74504 - DNA, 16 bp, H. sapiens
ccagcctcggtctccc

SEQ ID NO: 74505 - DNA, 16 bp, H. sapiens
ccagcctctagaacag

SEQ ID NO: 74506 - DNA, 16 bp, H. sapiens
ccagcctctagaactg

SEQ ID NO: 74507 - DNA, 16 bp, H. sapiens
ccagcctctcagcctc

SEQ ID NO: 74508 - DNA, 16 bp, H. sapiens
ccagcctctcccaggg

SEQ ID NO: 74509 - DNA, 16 bp, H. sapiens
ccagcctctccctcca

SEQ ID NO: 74510 - DNA, 16 bp, H. sapiens
ccagcctctctgagcc

SEQ ID NO: 74511 - DNA, 16 bp, H. sapiens
ccagcctctgccctgg

SEQ ID NO: 74512 - DNA, 17 bp, H. sapiens
ccagcctctgcctccca

SEQ ID NO: 74513 - DNA, 16 bp, H. sapiens
ccagcctctggtcacc

SEQ ID NO: 74514 - DNA, 16 bp, H. sapiens
ccagcctctgtgacag

SEQ ID NO: 74515 - DNA, 16 bp, H. sapiens
ccagcctctttttctt

SEQ ID NO: 74516 - DNA, 16 bp, H. sapiens
ccagcctgacaaatat

SEQ ID NO: 74517 - DNA, 16 bp, H. sapiens
ccagcctgaccagcat

SEQ ID NO: 74518 - DNA, 16 bp, H. sapiens
ccagcctgaccgacag

SEQ ID NO: 74519 - DNA, 16 bp, H. sapiens
ccagcctgagaccctg

SEQ ID NO: 74520 - DNA, 16 bp, H. sapiens
ccagcctgagcaagaa

SEQ ID NO: 74521 - DNA, 16 bp, H. sapiens
ccagcctgagcaatgg

SEQ ID NO: 74522 - DNA, 16 bp, H. sapiens
ccagcctgagcagcag

SEQ ID NO: 74523 - DNA, 16 bp, H. sapiens
ccagcctgagccacag

SEQ ID NO: 74524 - DNA, 16 bp, H. sapiens
ccagcctgagccacat

SEQ ID NO: 74525 - DNA, 16 bp, H. sapiens
ccagcctgagcgacaa

SEQ ID NO: 74526 - DNA, 16 bp, H. sapiens
ccagcctgaggaacat

SEQ ID NO: 74527 - DNA, 16 bp, H. sapiens
ccagcctgagtcacag

SEQ ID NO: 74528 - DNA, 16 bp, H. sapiens
ccagcctgcacagcag

SEQ ID NO: 74529 - DNA, 16 bp, H. sapiens
ccagcctgcaggctgc

SEQ ID NO: 74530 - DNA, 16 bp, H. sapiens
ccagcctgccagcctg

SEQ ID NO: 74531 - DNA, 16 bp, H. sapiens
ccagcctgcccaatgt

SEQ ID NO: 74532 - DNA, 16 bp, H. sapiens
ccagcctgcccagcat

SEQ ID NO: 74533 - DNA, 16 bp, H. sapiens
ccagcctgccctgcct

SEQ ID NO: 74534 - DNA, 16 bp, H. sapiens
ccagcctgcccttcct

SEQ ID NO: 74535 - DNA, 16 bp, H. sapiens
ccagcctgcgcaacat

SEQ ID NO: 74536 - DNA, 16 bp, H. sapiens
ccagcctgctccaccc

SEQ ID NO: 74537 - DNA, 16 bp, H. sapiens
ccagcctgctgacaga

SEQ ID NO: 74538 - DNA, 16 bp, H. sapiens
ccagcctggacaaaag

SEQ ID NO: 74539 - DNA, 16 bp, H. sapiens
ccagcctggacaactt

SEQ ID NO: 74540 - DNA, 16 bp, H. sapiens
ccagcctggacagcag

SEQ ID NO: 74541 - DNA, 16 bp, H. sapiens
ccagcctggagaacag

SEQ ID NO: 74542 - DNA, 16 bp, H. sapiens
ccagcctggagacaaa

SEQ ID NO: 74543 - DNA, 16 bp, H. sapiens
ccagcctggagagcag

SEQ ID NO: 74544 - DNA, 16 bp, H. sapiens
ccagcctggagccagg

SEQ ID NO: 74545 - DNA, 16 bp, H. sapiens
ccagcctggaggacag

SEQ ID NO: 74546 - DNA, 16 bp, H. sapiens
ccagcctggagtgcag

SEQ ID NO: 74547 - DNA, 16 bp, H. sapiens
ccagcctggcaaaaga

SEQ ID NO: 74548 - DNA, 16 bp, H. sapiens
ccagcctggccaaaaa

SEQ ID NO: 74549 - DNA, 16 bp, H. sapiens
ccagcctggccaacct

SEQ ID NO: 74550 - DNA, 16 bp, H. sapiens
ccagcctggccaatga

SEQ ID NO: 74551 - DNA, 16 bp, H. sapiens
ccagcctggccaatgc

SEQ ID NO: 74552 - DNA, 16 bp, H. sapiens
ccagcctggccaatgg

SEQ ID NO: 74553 - DNA, 16 bp, H. sapiens
ccagcctggccacaca

SEQ ID NO: 74554 - DNA, 16 bp, H. sapiens
ccagcctggccaccag

SEQ ID NO: 74555 - DNA, 16 bp, H. sapiens
ccagcctggccagcag

SEQ ID NO: 74556 - DNA, 16 bp, H. sapiens
ccagcctggccagcct

SEQ ID NO: 74557 - DNA, 16 bp, H. sapiens
ccagcctggcccaggg

SEQ ID NO: 74558 - DNA, 16 bp, H. sapiens
ccagcctggccccagc

SEQ ID NO: 74559 - DNA, 16 bp, H. sapiens
ccagcctggccctggg

SEQ ID NO: 74560 - DNA, 16 bp, H. sapiens
ccagcctggcctcgaa

SEQ ID NO: 74561 - DNA, 16 bp, H. sapiens
ccagcctggcgaaacc

SEQ ID NO: 74562 - DNA, 16 bp, H. sapiens
ccagcctggctctgcc

SEQ ID NO: 74563 - DNA, 16 bp, H. sapiens
ccagcctggctgacag

SEQ ID NO: 74564 - DNA, 16 bp, H. sapiens
ccagcctggctgagag

SEQ ID NO: 74565 - DNA, 16 bp, H. sapiens
ccagcctggctgccac

SEQ ID NO: 74566 - DNA, 16 bp, H. sapiens
ccagcctggctgctgc

SEQ ID NO: 74567 - DNA, 16 bp, H. sapiens
ccagcctggctggcag

SEQ ID NO: 74568 - DNA, 16 bp, H. sapiens
ccagcctgggagaaag

SEQ ID NO: 74569 - DNA, 16 bp, H. sapiens
ccagcctgggagcctg

SEQ ID NO: 74570 - DNA, 16 bp, H. sapiens
ccagcctgggagtcag

SEQ ID NO: 74571 - DNA, 16 bp, H. sapiens
ccagcctgggcaacat

SEQ ID NO: 74572 - DNA, 16 bp, H. sapiens
ccagcctgggcaatac

SEQ ID NO: 74573 - DNA, 16 bp, H. sapiens
ccagcctgggcacagg

SEQ ID NO: 74574 - DNA, 16 bp, H. sapiens
ccagcctgggcaccat

SEQ ID NO: 74575 - DNA, 16 bp, H. sapiens
ccagcctgggcactgg

SEQ ID NO: 74576 - DNA, 16 bp, H. sapiens
ccagcctgggcagaca

SEQ ID NO: 74577 - DNA, 16 bp, H. sapiens
ccagcctgggcagcaa

SEQ ID NO: 74578 - DNA, 16 bp, H. sapiens
ccagcctgggcagcct

SEQ ID NO: 74579 - DNA, 16 bp, H. sapiens
ccagcctgggcagctg

SEQ ID NO: 74580 - DNA, 16 bp, H. sapiens
ccagcctgggcaggaa

SEQ ID NO: 74581 - DNA, 16 bp, H. sapiens
ccagcctgggcatcag

SEQ ID NO: 74582 - DNA, 16 bp, H. sapiens
ccagcctgggccaaag

SEQ ID NO: 74583 - DNA, 16 bp, H. sapiens
ccagcctgggccacag

SEQ ID NO: 74584 - DNA, 16 bp, H. sapiens
ccagcctgggccacat

SEQ ID NO: 74585 - DNA, 16 bp, H. sapiens
ccagcctgggccatgg

SEQ ID NO: 74586 - DNA, 16 bp, H. sapiens
ccagcctgggccccag

SEQ ID NO: 74587 - DNA, 16 bp, H. sapiens
ccagcctgggcctccc

SEQ ID NO: 74588 - DNA, 16 bp, H. sapiens
ccagcctgggcctggc

SEQ ID NO: 74589 - DNA, 16 bp, H. sapiens
ccagcctgggcctggg

SEQ ID NO: 74590 - DNA, 16 bp, H. sapiens
ccagcctgggcgaaag

SEQ ID NO: 74591 - DNA, 17 bp, H. sapiens
ccagcctgggcgacagc

SEQ ID NO: 74592 - DNA, 16 bp, H. sapiens
ccagcctgggcgaccg

SEQ ID NO: 74593 - DNA, 16 bp, H. sapiens
ccagcctgggctaaag

SEQ ID NO: 74594 - DNA, 16 bp, H. sapiens
ccagcctgggctacag

SEQ ID NO: 74595 - DNA, 16 bp, H. sapiens
ccagcctgggctgcag

SEQ ID NO: 74596 - DNA, 16 bp, H. sapiens
ccagcctgggctggac

SEQ ID NO: 74597 - DNA, 16 bp, H. sapiens
ccagcctgggctggag

SEQ ID NO: 74598 - DNA, 16 bp, H. sapiens
ccagcctgggcttcag

SEQ ID NO: 74599 - DNA, 16 bp, H. sapiens
ccagcctggggaacag

SEQ ID NO: 74600 - DNA, 16 bp, H. sapiens
ccagcctggggaacat

SEQ ID NO: 74601 - DNA, 16 bp, H. sapiens
ccagcctggggacaag

SEQ ID NO: 74602 - DNA, 16 bp, H. sapiens
ccagcctggggagcag

SEQ ID NO: 74603 - DNA, 16 bp, H. sapiens
ccagcctgggggccag

SEQ ID NO: 74604 - DNA, 16 bp, H. sapiens
ccagcctggtctcaaa

SEQ ID NO: 74605 - DNA, 16 bp, H. sapiens
ccagcctggtgctggg

SEQ ID NO: 74606 - DNA, 16 bp, H. sapiens
ccagccttcagaactg

SEQ ID NO: 74607 - DNA, 16 bp, H. sapiens
ccagccttctctctct

SEQ ID NO: 74608 - DNA, 16 bp, H. sapiens
ccagccttgccaacat

SEQ ID NO: 74609 - DNA, 17 bp, H. sapiens
ccagccttgctgccgcc

SEQ ID NO: 74610 - DNA, 16 bp, H. sapiens
ccagccttgcttcctg

SEQ ID NO: 74611 - DNA, 16 bp, H. sapiens
ccagccttgtgacaga

SEQ ID NO: 74612 - DNA, 16 bp, H. sapiens
ccagcctttctttctt

SEQ ID NO: 74613 - DNA, 16 bp, H. sapiens
ccagcctttgagagac

SEQ ID NO: 74614 - DNA, 16 bp, H. sapiens
ccagcgagatcaatgc

SEQ ID NO: 74615 - DNA, 16 bp, H. sapiens
ccagcgaggtgcccat

SEQ ID NO: 74616 - DNA, 16 bp, H. sapiens
ccagcgctttgggaag

SEQ ID NO: 74617 - DNA, 16 bp, H. sapiens
ccagcgtggtggtgca

SEQ ID NO: 74618 - DNA, 16 bp, H. sapiens
ccagctaaagctaaag

SEQ ID NO: 74619 - DNA, 16 bp, H. sapiens
ccagctaacttaaaaa

SEQ ID NO: 74620 - DNA, 16 bp, H. sapiens
ccagctaacttttttt

SEQ ID NO: 74621 - DNA, 16 bp, H. sapiens
ccagctaagcccagcc

SEQ ID NO: 74622 - DNA, 16 bp, H. sapiens
ccagctaagctccagg

SEQ ID NO: 74623 - DNA, 20 bp, H. sapiens
ccagctaagtttgtattttt

SEQ ID NO: 74624 - DNA, 16 bp, H. sapiens
ccagctaatatttaaa

SEQ ID NO: 74625 - DNA, 16 bp, H. sapiens
ccagctaattgtttta

SEQ ID NO: 74626 - DNA, 16 bp, H. sapiens
ccagctacacaagagg

SEQ ID NO: 74627 - DNA, 16 bp, H. sapiens
ccagctacactggcct

SEQ ID NO: 74628 - DNA, 16 bp, H. sapiens
ccagctacctgggcat

SEQ ID NO: 74629 - DNA, 16 bp, H. sapiens
ccagctactcagaggg

SEQ ID NO: 74630 - DNA, 16 bp, H. sapiens
ccagctactcagcagg

SEQ ID NO: 74631 - DNA, 16 bp, H. sapiens
ccagctactcccagct

SEQ ID NO: 74632 - DNA, 16 bp, H. sapiens
ccagctactccggaag

SEQ ID NO: 74633 - DNA, 16 bp, H. sapiens
ccagctactctgaggc

SEQ ID NO: 74634 - DNA, 16 bp, H. sapiens
ccagctacttgagaag

SEQ ID NO: 74635 - DNA, 16 bp, H. sapiens
ccagctacttgcaagg

SEQ ID NO: 74636 - DNA, 16 bp, H. sapiens
ccagctatgaccacat

SEQ ID NO: 74637 - DNA, 16 bp, H. sapiens
ccagctattcaagagg

SEQ ID NO: 74638 - DNA, 16 bp, H. sapiens
ccagctatttgggggg

SEQ ID NO: 74639 - DNA, 16 bp, H. sapiens
ccagctcactacaacc

SEQ ID NO: 74640 - DNA, 16 bp, H. sapiens
ccagctcagattcaag

SEQ ID NO: 74641 - DNA, 16 bp, H. sapiens
ccagctcagccacact

SEQ ID NO: 74642 - DNA, 16 bp, H. sapiens
ccagctcagctgcagt

SEQ ID NO: 74643 - DNA, 16 bp, H. sapiens
ccagctcagcttccca

SEQ ID NO: 74644 - DNA, 16 bp, H. sapiens
ccagctcagggccagg

SEQ ID NO: 74645 - DNA, 16 bp, H. sapiens
ccagctcagtcaggga

SEQ ID NO: 74646 - DNA, 16 bp, H. sapiens
ccagctccagccccag

SEQ ID NO: 74647 - DNA, 16 bp, H. sapiens
ccagctccagcctctg

SEQ ID NO: 74648 - DNA, 16 bp, H. sapiens
ccagctccagcctggg

SEQ ID NO: 74649 - DNA, 16 bp, H. sapiens
ccagctccagctccca

SEQ ID NO: 74650 - DNA, 16 bp, H. sapiens
ccagctccatccaagt

SEQ ID NO: 74651 - DNA, 16 bp, H. sapiens
ccagctccatccatgg

SEQ ID NO: 74652 - DNA, 16 bp, H. sapiens
ccagctccatccttgt

SEQ ID NO: 74653 - DNA, 16 bp, H. sapiens
ccagctccattcaagt

SEQ ID NO: 74654 - DNA, 16 bp, H. sapiens
ccagctcccagcccca

SEQ ID NO: 74655 - DNA, 16 bp, H. sapiens
ccagctcccccttcac

SEQ ID NO: 74656 - DNA, 16 bp, H. sapiens
ccagctccccttccac

SEQ ID NO: 74657 - DNA, 16 bp, H. sapiens
ccagctccccttccct

SEQ ID NO: 74658 - DNA, 16 bp, H. sapiens
ccagctccctcaccct

SEQ ID NO: 74659 - DNA, 16 bp, H. sapiens
ccagctccctcagcct

SEQ ID NO: 74660 - DNA, 16 bp, H. sapiens
ccagctccctccagcc

SEQ ID NO: 74661 - DNA, 16 bp, H. sapiens
ccagctccctcccaca

SEQ ID NO: 74662 - DNA, 16 bp, H. sapiens
ccagctccctctgctc

SEQ ID NO: 74663 - DNA, 16 bp, H. sapiens
ccagctccctgcccca

SEQ ID NO: 74664 - DNA, 16 bp, H. sapiens
ccagctccctgccctg

SEQ ID NO: 74665 - DNA, 16 bp, H. sapiens
ccagctccctgcctcc

SEQ ID NO: 74666 - DNA, 16 bp, H. sapiens
ccagctccctgggagg

SEQ ID NO: 74667 - DNA, 16 bp, H. sapiens
ccagctcccttgcccc

SEQ ID NO: 74668 - DNA, 16 bp, H. sapiens
ccagctccgcctcctg

SEQ ID NO: 74669 - DNA, 23 bp, H. sapiens
ccagctcctaaccgcgagtgatc

SEQ ID NO: 74670 - DNA, 16 bp, H. sapiens
ccagctcctcaggagg

SEQ ID NO: 74671 - DNA, 16 bp, H. sapiens
ccagctcctcctccca

SEQ ID NO: 74672 - DNA, 16 bp, H. sapiens
ccagctcctcctcctc

SEQ ID NO: 74673 - DNA, 16 bp, H. sapiens
ccagctcctcctctcc

SEQ ID NO: 74674 - DNA, 16 bp, H. sapiens
ccagctcctctctggg

SEQ ID NO: 74675 - DNA, 16 bp, H. sapiens
ccagctcctcttcccc

SEQ ID NO: 74676 - DNA, 16 bp, H. sapiens
ccagctcctgagttca

SEQ ID NO: 74677 - DNA, 16 bp, H. sapiens
ccagctcctgcctctg

SEQ ID NO: 74678 - DNA, 16 bp, H. sapiens
ccagctcctggcagcc

SEQ ID NO: 74679 - DNA, 16 bp, H. sapiens
ccagctcctggcctca

SEQ ID NO: 74680 - DNA, 16 bp, H. sapiens
ccagctcctgggggct

SEQ ID NO: 74681 - DNA, 16 bp, H. sapiens
ccagctcctggtggcc

SEQ ID NO: 74682 - DNA, 16 bp, H. sapiens
ccagctcctggtggct

SEQ ID NO: 74683 - DNA, 16 bp, H. sapiens
ccagctccttgggagg

SEQ ID NO: 74684 - DNA, 16 bp, H. sapiens
ccagctctcaggaggc

SEQ ID NO: 74685 - DNA, 16 bp, H. sapiens
ccagctctcttcctgc

SEQ ID NO: 74686 - DNA, 16 bp, H. sapiens
ccagctctgccactga

SEQ ID NO: 74687 - DNA, 16 bp, H. sapiens
ccagctctgccacttg

SEQ ID NO: 74688 - DNA, 16 bp, H. sapiens
ccagctctgcctcctg

SEQ ID NO: 74689 - DNA, 16 bp, H. sapiens
ccagctctgcctgcag

SEQ ID NO: 74690 - DNA, 16 bp, H. sapiens
ccagctctgctgtgtg

SEQ ID NO: 74691 - DNA, 16 bp, H. sapiens
ccagctctggccctgc

SEQ ID NO: 74692 - DNA, 16 bp, H. sapiens
ccagctctggcctcag

SEQ ID NO: 74693 - DNA, 16 bp, H. sapiens
ccagctctgggggcag

SEQ ID NO: 74694 - DNA, 16 bp, H. sapiens
ccagctcttctttgca

SEQ ID NO: 74695 - DNA, 16 bp, H. sapiens
ccagctctttctcttt

SEQ ID NO: 74696 - DNA, 16 bp, H. sapiens
ccagctctttgggaag

SEQ ID NO: 74697 - DNA, 16 bp, H. sapiens
ccagctcttttttttt

SEQ ID NO: 74698 - DNA, 16 bp, H. sapiens
ccagctgaagcagggc

SEQ ID NO: 74699 - DNA, 16 bp, H. sapiens
ccagctgaattttttt

SEQ ID NO: 74700 - DNA, 16 bp, H. sapiens
ccagctgacatcttga

SEQ ID NO: 74701 - DNA, 16 bp, H. sapiens
ccagctgagcccagct

SEQ ID NO: 74702 - DNA, 16 bp, H. sapiens
ccagctgatttttctt

SEQ ID NO: 74703 - DNA, 16 bp, H. sapiens
ccagctgcaaaagaaa

SEQ ID NO: 74704 - DNA, 16 bp, H. sapiens
ccagctgcagagagga

SEQ ID NO: 74705 - DNA, 16 bp, H. sapiens
ccagctgcagcagcag

SEQ ID NO: 74706 - DNA, 16 bp, H. sapiens
ccagctgcagcctcac

SEQ ID NO: 74707 - DNA, 16 bp, H. sapiens
ccagctgcagctgcag

SEQ ID NO: 74708 - DNA, 16 bp, H. sapiens
ccagctgcaggctgag

SEQ ID NO: 74709 - DNA, 16 bp, H. sapiens
ccagctgcatgacctt

SEQ ID NO: 74710 - DNA, 16 bp, H. sapiens
ccagctgccatgctgt

SEQ ID NO: 74711 - DNA, 16 bp, H. sapiens
ccagctgccccgtctg

SEQ ID NO: 74712 - DNA, 16 bp, H. sapiens
ccagctgcccgggagg

SEQ ID NO: 74713 - DNA, 16 bp, H. sapiens
ccagctgcctctgcct

SEQ ID NO: 74714 - DNA, 16 bp, H. sapiens
ccagctgcctgggagg

SEQ ID NO: 74715 - DNA, 16 bp, H. sapiens
ccagctgctcagaggc

SEQ ID NO: 74716 - DNA, 16 bp, H. sapiens
ccagctgctcaggaag

SEQ ID NO: 74717 - DNA, 16 bp, H. sapiens
ccagctgctcgggagg

SEQ ID NO: 74718 - DNA, 16 bp, H. sapiens
ccagctgctgcagcag

SEQ ID NO: 74719 - DNA, 16 bp, H. sapiens
ccagctgctggggaag

SEQ ID NO: 74720 - DNA, 16 bp, H. sapiens
ccagctgcttgggatg

SEQ ID NO: 74721 - DNA, 16 bp, H. sapiens
ccagctggaactctcc

SEQ ID NO: 74722 - DNA, 16 bp, H. sapiens
ccagctggagctctcc

SEQ ID NO: 74723 - DNA, 16 bp, H. sapiens
ccagctggagctctct

SEQ ID NO: 74724 - DNA, 16 bp, H. sapiens
ccagctggagttctgg

SEQ ID NO: 74725 - DNA, 16 bp, H. sapiens
ccagctggcctcacct

SEQ ID NO: 74726 - DNA, 16 bp, H. sapiens
ccagctgggaggcagg

SEQ ID NO: 74727 - DNA, 16 bp, H. sapiens
ccagctgggcacggtg

SEQ ID NO: 74728 - DNA, 16 bp, H. sapiens
ccagctggtccctcca

SEQ ID NO: 74729 - DNA, 16 bp, H. sapiens
ccagctggtccctctg

SEQ ID NO: 74730 - DNA, 16 bp, H. sapiens
ccagctggtgacagag

SEQ ID NO: 74731 - DNA, 16 bp, H. sapiens
ccagctgtgaaagcaa

SEQ ID NO: 74732 - DNA, 16 bp, H. sapiens
ccagctgtgcccacct

SEQ ID NO: 74733 - DNA, 16 bp, H. sapiens
ccagctgtggtggctc

SEQ ID NO: 74734 - DNA, 16 bp, H. sapiens
ccagctgtggtggtgg

SEQ ID NO: 74735 - DNA, 16 bp, H. sapiens
ccagctgtgtggcctg

SEQ ID NO: 74736 - DNA, 16 bp, H. sapiens
ccagctgtgtggcctt

SEQ ID NO: 74737 - DNA, 16 bp, H. sapiens
ccagctgtgtggcttt

SEQ ID NO: 74738 - DNA, 16 bp, H. sapiens
ccagctgttttttgtt

SEQ ID NO: 74739 - DNA, 16 bp, H. sapiens
ccagcttagagaagaa

SEQ ID NO: 74740 - DNA, 16 bp, H. sapiens
ccagcttataaacaga

SEQ ID NO: 74741 - DNA, 16 bp, H. sapiens
ccagcttattttttgt

SEQ ID NO: 74742 - DNA, 16 bp, H. sapiens
ccagcttcaataatta

SEQ ID NO: 74743 - DNA, 16 bp, H. sapiens
ccagcttcagcctccc

SEQ ID NO: 74744 - DNA, 16 bp, H. sapiens
ccagcttcagcttctc

SEQ ID NO: 74745 - DNA, 16 bp, H. sapiens
ccagcttcaggtattt

SEQ ID NO: 74746 - DNA, 16 bp, H. sapiens
ccagcttcattctttt

SEQ ID NO: 74747 - DNA, 16 bp, H. sapiens
ccagcttcattttttt

SEQ ID NO: 74748 - DNA, 16 bp, H. sapiens
ccagcttccagaggcc

SEQ ID NO: 74749 - DNA, 16 bp, H. sapiens
ccagcttccagtggct

SEQ ID NO: 74750 - DNA, 16 bp, H. sapiens
ccagcttccatctccc

SEQ ID NO: 74751 - DNA, 16 bp, H. sapiens
ccagcttccccaggcc

SEQ ID NO: 74752 - DNA, 16 bp, H. sapiens
ccagcttcctccaggg

SEQ ID NO: 74753 - DNA, 16 bp, H. sapiens
ccagcttccttcccct

SEQ ID NO: 74754 - DNA, 16 bp, H. sapiens
ccagcttctcttgcag

SEQ ID NO: 74755 - DNA, 16 bp, H. sapiens
ccagcttctgcccatt

SEQ ID NO: 74756 - DNA, 16 bp, H. sapiens
ccagcttctggggagg

SEQ ID NO: 74757 - DNA, 16 bp, H. sapiens
ccagcttctggtgact

SEQ ID NO: 74758 - DNA, 16 bp, H. sapiens
ccagcttctggtggct

SEQ ID NO: 74759 - DNA, 16 bp, H. sapiens
ccagcttgcagacagc

SEQ ID NO: 74760 - DNA, 16 bp, H. sapiens
ccagcttgcccttgaa

SEQ ID NO: 74761 - DNA, 16 bp, H. sapiens
ccagcttggccaagat

SEQ ID NO: 74762 - DNA, 16 bp, H. sapiens
ccagcttggcccacat

SEQ ID NO: 74763 - DNA, 16 bp, H. sapiens
ccagcttggttctttt

SEQ ID NO: 74764 - DNA, 16 bp, H. sapiens
ccagcttgtttccatt

SEQ ID NO: 74765 - DNA, 16 bp, H. sapiens
ccagctttgcatccta

SEQ ID NO: 74766 - DNA, 16 bp, H. sapiens
ccagcttttgcctgtt

SEQ ID NO: 74767 - DNA, 16 bp, H. sapiens
ccaggaaaacattttt

SEQ ID NO: 74768 - DNA, 16 bp, H. sapiens
ccaggaaaaccaaaag

SEQ ID NO: 74769 - DNA, 16 bp, H. sapiens
ccaggaaaagctgcag

SEQ ID NO: 74770 - DNA, 16 bp, H. sapiens
ccaggaaaagtgtccc

SEQ ID NO: 74771 - DNA, 16 bp, H. sapiens
ccaggaaaccatgctt

SEQ ID NO: 74772 - DNA, 16 bp, H. sapiens
ccaggaaaccattctt

SEQ ID NO: 74773 - DNA, 16 bp, H. sapiens
ccaggaaagccaaaag

SEQ ID NO: 74774 - DNA, 16 bp, H. sapiens
ccaggaaaggggcagg

SEQ ID NO: 74775 - DNA, 16 bp, H. sapiens
ccaggaaatcaaggct

SEQ ID NO: 74776 - DNA, 16 bp, H. sapiens
ccaggaactgaatcag

SEQ ID NO: 74777 - DNA, 16 bp, H. sapiens
ccaggaactgtgctag

SEQ ID NO: 74778 - DNA, 16 bp, H. sapiens
ccaggaagaaagagga

SEQ ID NO: 74779 - DNA, 16 bp, H. sapiens
ccaggaagaaagtgaa

SEQ ID NO: 74780 - DNA, 16 bp, H. sapiens
ccaggaagaaatcaaa

SEQ ID NO: 74781 - DNA, 16 bp, H. sapiens
ccaggaagaaatccaa

SEQ ID NO: 74782 - DNA, 16 bp, H. sapiens
ccaggaagaaggtgaa

SEQ ID NO: 74783 - DNA, 16 bp, H. sapiens
ccaggaagaagtggaa

SEQ ID NO: 74784 - DNA, 16 bp, H. sapiens
ccaggaagaagttgac

SEQ ID NO: 74785 - DNA, 16 bp, H. sapiens
ccaggaagaatgaggt

SEQ ID NO: 74786 - DNA, 16 bp, H. sapiens
ccaggaagagagctct

SEQ ID NO: 74787 - DNA, 16 bp, H. sapiens
ccaggaagagagtcct

SEQ ID NO: 74788 - DNA, 16 bp, H. sapiens
ccaggaagagctgatg

SEQ ID NO: 74789 - DNA, 16 bp, H. sapiens
ccaggaagaggagaaa

SEQ ID NO: 74790 - DNA, 16 bp, H. sapiens
ccaggaagaggttgaa

SEQ ID NO: 74791 - DNA, 16 bp, H. sapiens
ccaggaagatgttgaa

SEQ ID NO: 74792 - DNA, 16 bp, H. sapiens
ccaggaagcaggcagg

SEQ ID NO: 74793 - DNA, 16 bp, H. sapiens
ccaggaagcctcccct

SEQ ID NO: 74794 - DNA, 16 bp, H. sapiens
ccaggaagcggaggct

SEQ ID NO: 74795 - DNA, 16 bp, H. sapiens
ccaggaagctgggatt

SEQ ID NO: 74796 - DNA, 16 bp, H. sapiens
ccaggaagctttccct

SEQ ID NO: 74797 - DNA, 16 bp, H. sapiens
ccaggaaggaggagga

SEQ ID NO: 74798 - DNA, 16 bp, H. sapiens
ccaggaaggagtgcag

SEQ ID NO: 74799 - DNA, 16 bp, H. sapiens
ccaggaaggcagtggg

SEQ ID NO: 74800 - DNA, 16 bp, H. sapiens
ccaggaaggctttgaa

SEQ ID NO: 74801 - DNA, 16 bp, H. sapiens
ccaggaagtccaggct

SEQ ID NO: 74802 - DNA, 16 bp, H. sapiens
ccaggaagtcttcctt

SEQ ID NO: 74803 - DNA, 16 bp, H. sapiens
ccaggaagtggagctt

SEQ ID NO: 74804 - DNA, 16 bp, H. sapiens
ccaggaataaatccca

SEQ ID NO: 74805 - DNA, 16 bp, H. sapiens
ccaggaatctacattt

SEQ ID NO: 74806 - DNA, 16 bp, H. sapiens
ccaggaatgaccaagg

SEQ ID NO: 74807 - DNA, 16 bp, H. sapiens
ccaggaatgagtgaag

SEQ ID NO: 74808 - DNA, 16 bp, H. sapiens
ccaggaatgcattcct

SEQ ID NO: 74809 - DNA, 16 bp, H. sapiens
ccaggaatggtggcat

SEQ ID NO: 74810 - DNA, 16 bp, H. sapiens
ccaggaattccaggct

SEQ ID NO: 74811 - DNA, 29 bp, H. sapiens
ccaggaattgaactcagctctgcaccaag

SEQ ID NO: 74812 - DNA, 16 bp, H. sapiens
ccaggaatttgaggct

SEQ ID NO: 74813 - DNA, 16 bp, H. sapiens
ccaggaatttgggacc

SEQ ID NO: 74814 - DNA, 16 bp, H. sapiens
ccaggaattttttttt

SEQ ID NO: 74815 - DNA, 16 bp, H. sapiens
ccaggacacctccaag

SEQ ID NO: 74816 - DNA, 16 bp, H. sapiens
ccaggacagccctggg

SEQ ID NO: 74817 - DNA, 23 bp, H. sapiens
ccaggaccagatggattcacagc

SEQ ID NO: 74818 - DNA, 16 bp, H. sapiens
ccaggacccaggaccc

SEQ ID NO: 74819 - DNA, 16 bp, H. sapiens
ccaggacccaggaggc

SEQ ID NO: 74820 - DNA, 16 bp, H. sapiens
ccaggactcaaaccca

SEQ ID NO: 74821 - DNA, 16 bp, H. sapiens
ccaggactcaagtgat

SEQ ID NO: 74822 - DNA, 16 bp, H. sapiens
ccaggactctgggagg

SEQ ID NO: 74823 - DNA, 16 bp, H. sapiens
ccaggactgcaccctg

SEQ ID NO: 74824 - DNA, 16 bp, H. sapiens
ccaggactgggtcaaa

SEQ ID NO: 74825 - DNA, 16 bp, H. sapiens
ccaggacttgggaggc

SEQ ID NO: 74826 - DNA, 16 bp, H. sapiens
ccaggacttggtgacc

SEQ ID NO: 74827 - DNA, 16 bp, H. sapiens
ccaggactttgagacc

SEQ ID NO: 74828 - DNA, 16 bp, H. sapiens
ccaggagaaaatggaa

SEQ ID NO: 74829 - DNA, 16 bp, H. sapiens
ccaggagaaactgcag

SEQ ID NO: 74830 - DNA, 16 bp, H. sapiens
ccaggagaaagtggca

SEQ ID NO: 74831 - DNA, 16 bp, H. sapiens
ccaggagaagaaggca

SEQ ID NO: 74832 - DNA, 16 bp, H. sapiens
ccaggagaaggagcag

SEQ ID NO: 74833 - DNA, 16 bp, H. sapiens
ccaggagacaagcaaa

SEQ ID NO: 74834 - DNA, 16 bp, H. sapiens
ccaggagacagaggct

SEQ ID NO: 74835 - DNA, 16 bp, H. sapiens
ccaggagaccaaggct

SEQ ID NO: 74836 - DNA, 16 bp, H. sapiens
ccaggagacccaggag

SEQ ID NO: 74837 - DNA, 16 bp, H. sapiens
ccaggagacctgcagc

SEQ ID NO: 74838 - DNA, 16 bp, H. sapiens
ccaggagacggagttt

SEQ ID NO: 74839 - DNA, 16 bp, H. sapiens
ccaggagactgaggct

SEQ ID NO: 74840 - DNA, 16 bp, H. sapiens
ccaggagagaatggga

SEQ ID NO: 74841 - DNA, 16 bp, H. sapiens
ccaggagagcagcagc

SEQ ID NO: 74842 - DNA, 16 bp, H. sapiens
ccaggagagccagtgg

SEQ ID NO: 74843 - DNA, 16 bp, H. sapiens
ccaggagaggaaggag

SEQ ID NO: 74844 - DNA, 16 bp, H. sapiens
ccaggagaggctgcag

SEQ ID NO: 74845 - DNA, 16 bp, H. sapiens
ccaggagaggggctgt

SEQ ID NO: 74846 - DNA, 16 bp, H. sapiens
ccaggagatggagacc

SEQ ID NO: 74847 - DNA, 16 bp, H. sapiens
ccaggagcaatggctc

SEQ ID NO: 74848 - DNA, 16 bp, H. sapiens
ccaggagcagacagat

SEQ ID NO: 74849 - DNA, 16 bp, H. sapiens
ccaggagcagatggat

SEQ ID NO: 74850 - DNA, 16 bp, H. sapiens
ccaggagcagcctggg

SEQ ID NO: 74851 - DNA, 16 bp, H. sapiens
ccaggagcagggagag

SEQ ID NO: 74852 - DNA, 16 bp, H. sapiens
ccaggagcaggtggac

SEQ ID NO: 74853 - DNA, 16 bp, H. sapiens
ccaggagcagtggcac

SEQ ID NO: 74854 - DNA, 16 bp, H. sapiens
ccaggagcagtggttc

SEQ ID NO: 74855 - DNA, 16 bp, H. sapiens
ccaggagccaccagaa

SEQ ID NO: 74856 - DNA, 16 bp, H. sapiens
ccaggagccagggagg

SEQ ID NO: 74857 - DNA, 16 bp, H. sapiens
ccaggagcccacttgg

SEQ ID NO: 74858 - DNA, 16 bp, H. sapiens
ccaggagcccagctgg

SEQ ID NO: 74859 - DNA, 16 bp, H. sapiens
ccaggagcccaggagc

SEQ ID NO: 74860 - DNA, 16 bp, H. sapiens
ccaggagctcaagact

SEQ ID NO: 74861 - DNA, 16 bp, H. sapiens
ccaggagctcaagatc

SEQ ID NO: 74862 - DNA, 16 bp, H. sapiens
ccaggagctccaatgt

SEQ ID NO: 74863 - DNA, 16 bp, H. sapiens
ccaggagctcgaggcc

SEQ ID NO: 74864 - DNA, 16 bp, H. sapiens
ccaggagctcgaggct

SEQ ID NO: 74865 - DNA, 16 bp, H. sapiens
ccaggagctggaaaag

SEQ ID NO: 74866 - DNA, 16 bp, H. sapiens
ccaggagctggaggag

SEQ ID NO: 74867 - DNA, 16 bp, H. sapiens
ccaggagctgggagag

SEQ ID NO: 74868 - DNA, 16 bp, H. sapiens
ccaggagcttgaggcc

SEQ ID NO: 74869 - DNA, 16 bp, H. sapiens
ccaggaggaaaaggaa

SEQ ID NO: 74870 - DNA, 16 bp, H. sapiens
ccaggaggagagccct

SEQ ID NO: 74871 - DNA, 16 bp, H. sapiens
ccaggaggaggagttt

SEQ ID NO: 74872 - DNA, 16 bp, H. sapiens
ccaggaggagggagaa

SEQ ID NO: 74873 - DNA, 16 bp, H. sapiens
ccaggaggatcctgag

SEQ ID NO: 74874 - DNA, 16 bp, H. sapiens
ccaggaggcagaaatt

SEQ ID NO: 74875 - DNA, 16 bp, H. sapiens
ccaggaggcagaagat

SEQ ID NO: 74876 - DNA, 17 bp, H. sapiens
ccaggaggcagaggttg

SEQ ID NO: 74877 - DNA, 16 bp, H. sapiens
ccaggaggcagatgtt

SEQ ID NO: 74878 - DNA, 16 bp, H. sapiens
ccaggaggcagctggg

SEQ ID NO: 74879 - DNA, 16 bp, H. sapiens
ccaggaggccaaggtg

SEQ ID NO: 74880 - DNA, 16 bp, H. sapiens
ccaggaggcctgcctg

SEQ ID NO: 74881 - DNA, 16 bp, H. sapiens
ccaggaggcggaggag

SEQ ID NO: 74882 - DNA, 17 bp, H. sapiens
ccaggaggcggagtctg

SEQ ID NO: 74883 - DNA, 16 bp, H. sapiens
ccaggaggctgagatt

SEQ ID NO: 74884 - DNA, 16 bp, H. sapiens
ccaggagggagggcag

SEQ ID NO: 74885 - DNA, 16 bp, H. sapiens
ccaggagggcagaggt

SEQ ID NO: 74886 - DNA, 16 bp, H. sapiens
ccaggaggggagctgt

SEQ ID NO: 74887 - DNA, 16 bp, H. sapiens
ccaggaggtcaaggat

SEQ ID NO: 74888 - DNA, 16 bp, H. sapiens
ccaggaggtgaagatt

SEQ ID NO: 74889 - DNA, 16 bp, H. sapiens
ccaggaggtgaagctt

SEQ ID NO: 74890 - DNA, 16 bp, H. sapiens
ccaggagtccagcctg

SEQ ID NO: 74891 - DNA, 16 bp, H. sapiens
ccaggagtcccagacc

SEQ ID NO: 74892 - DNA, 16 bp, H. sapiens
ccaggagtccgaggct

SEQ ID NO: 74893 - DNA, 16 bp, H. sapiens
ccaggagtggaagcag

SEQ ID NO: 74894 - DNA, 16 bp, H. sapiens
ccaggagtgggaggct

SEQ ID NO: 74895 - DNA, 16 bp, H. sapiens
ccaggagtggggagag

SEQ ID NO: 74896 - DNA, 16 bp, H. sapiens
ccaggagtgtgagacc

SEQ ID NO: 74897 - DNA, 16 bp, H. sapiens
ccaggagttcaaaacc

SEQ ID NO: 74898 - DNA, 16 bp, H. sapiens
ccaggagttcaaatcc

SEQ ID NO: 74899 - DNA, 16 bp, H. sapiens
ccaggagttcaagggc

SEQ ID NO: 74900 - DNA, 16 bp, H. sapiens
ccaggagttcaatgct

SEQ ID NO: 74901 - DNA, 16 bp, H. sapiens
ccaggagttccaggat

SEQ ID NO: 74902 - DNA, 17 bp, H. sapiens
ccaggagttcgaaacca

SEQ ID NO: 74903 - DNA, 16 bp, H. sapiens
ccaggagttcgagccc

SEQ ID NO: 74904 - DNA, 16 bp, H. sapiens
ccaggagttcgaggac

SEQ ID NO: 74905 - DNA, 18 bp, H. sapiens
ccaggagttcgagtccag

SEQ ID NO: 74906 - DNA, 16 bp, H. sapiens
ccaggagttgaagacc

SEQ ID NO: 74907 - DNA, 16 bp, H. sapiens
ccaggagttggagatt

SEQ ID NO: 74908 - DNA, 16 bp, H. sapiens
ccaggagttggaggag

SEQ ID NO: 74909 - DNA, 17 bp, H. sapiens
ccaggagtttgagacca

SEQ ID NO: 74910 - DNA, 16 bp, H. sapiens
ccaggagtttgaggtt

SEQ ID NO: 74911 - DNA, 16 bp, H. sapiens
ccaggagtttgggatc

SEQ ID NO: 74912 - DNA, 16 bp, H. sapiens
ccaggagtttgtgatc

SEQ ID NO: 74913 - DNA, 16 bp, H. sapiens
ccaggataaaaacaag

SEQ ID NO: 74914 - DNA, 16 bp, H. sapiens
ccaggataatctccct

SEQ ID NO: 74915 - DNA, 16 bp, H. sapiens
ccaggatgcaaggatg

SEQ ID NO: 74916 - DNA, 16 bp, H. sapiens
ccaggatgctcttgat

SEQ ID NO: 74917 - DNA, 16 bp, H. sapiens
ccaggatggactgcag

SEQ ID NO: 74918 - DNA, 16 bp, H. sapiens
ccaggatggagggcag

SEQ ID NO: 74919 - DNA, 16 bp, H. sapiens
ccaggatggagggtct

SEQ ID NO: 74920 - DNA, 16 bp, H. sapiens
ccaggatggggtgcag

SEQ ID NO: 74921 - DNA, 27 bp, H. sapiens
ccaggatggtctcgatctcctgacctc

SEQ ID NO: 74922 - DNA, 16 bp, H. sapiens
ccaggatggtctctac

SEQ ID NO: 74923 - DNA, 16 bp, H. sapiens
ccaggatggtttcaat

SEQ ID NO: 74924 - DNA, 16 bp, H. sapiens
ccaggattcagaaagc

SEQ ID NO: 74925 - DNA, 16 bp, H. sapiens
ccaggattgcaacccc

SEQ ID NO: 74926 - DNA, 16 bp, H. sapiens
ccaggatttgaaccca

SEQ ID NO: 74927 - DNA, 16 bp, H. sapiens
ccaggatttgaatcca

SEQ ID NO: 74928 - DNA, 17 bp, H. sapiens
ccaggattttgagacca

SEQ ID NO: 74929 - DNA, 16 bp, H. sapiens
ccaggatttttttttt

SEQ ID NO: 74930 - DNA, 16 bp, H. sapiens
ccaggcaaccactgat

SEQ ID NO: 74931 - DNA, 16 bp, H. sapiens
ccaggcaacccctgag

SEQ ID NO: 74932 - DNA, 16 bp, H. sapiens
ccaggcaagagaaaga

SEQ ID NO: 74933 - DNA, 16 bp, H. sapiens
ccaggcaaggccaagc

SEQ ID NO: 74934 - DNA, 16 bp, H. sapiens
ccaggcaaggtggcgg

SEQ ID NO: 74935 - DNA, 16 bp, H. sapiens
ccaggcacagaaagat

SEQ ID NO: 74936 - DNA, 16 bp, H. sapiens
ccaggcacagcagctc

SEQ ID NO: 74937 - DNA, 16 bp, H. sapiens
ccaggcacagctgcag

SEQ ID NO: 74938 - DNA, 16 bp, H. sapiens
ccaggcacaggggctc

SEQ ID NO: 74939 - DNA, 16 bp, H. sapiens
ccaggcacagtgctgg

SEQ ID NO: 74940 - DNA, 16 bp, H. sapiens
ccaggcacagtggcag

SEQ ID NO: 74941 - DNA, 16 bp, H. sapiens
ccaggcacagtggcat

SEQ ID NO: 74942 - DNA, 16 bp, H. sapiens
ccaggcaccagcacag

SEQ ID NO: 74943 - DNA, 16 bp, H. sapiens
ccaggcaccatgctag

SEQ ID NO: 74944 - DNA, 16 bp, H. sapiens
ccaggcacggtggctg

SEQ ID NO: 74945 - DNA, 16 bp, H. sapiens
ccaggcactggagata

SEQ ID NO: 74946 - DNA, 16 bp, H. sapiens
ccaggcactgggctaa

SEQ ID NO: 74947 - DNA, 16 bp, H. sapiens
ccaggcactgggggtc

SEQ ID NO: 74948 - DNA, 16 bp, H. sapiens
ccaggcactgtactaa

SEQ ID NO: 74949 - DNA, 16 bp, H. sapiens
ccaggcactgtcctgg

SEQ ID NO: 74950 - DNA, 16 bp, H. sapiens
ccaggcactgtgctaa

SEQ ID NO: 74951 - DNA, 16 bp, H. sapiens
ccaggcactgtgctga

SEQ ID NO: 74952 - DNA, 16 bp, H. sapiens
ccaggcactgtgtctc

SEQ ID NO: 74953 - DNA, 16 bp, H. sapiens
ccaggcactgttcaag

SEQ ID NO: 74954 - DNA, 16 bp, H. sapiens
ccaggcactgttctag

SEQ ID NO: 74955 - DNA, 16 bp, H. sapiens
ccaggcactgttttag

SEQ ID NO: 74956 - DNA, 16 bp, H. sapiens
ccaggcagaaagaagg

SEQ ID NO: 74957 - DNA, 16 bp, H. sapiens
ccaggcagaagaaaca

SEQ ID NO: 74958 - DNA, 17 bp, H. sapiens
ccaggcagaagtttgct

SEQ ID NO: 74959 - DNA, 16 bp, H. sapiens
ccaggcagaagtttgt

SEQ ID NO: 74960 - DNA, 16 bp, H. sapiens
ccaggcagagaacagc

SEQ ID NO: 74961 - DNA, 16 bp, H. sapiens
ccaggcagagagaaaa

SEQ ID NO: 74962 - DNA, 16 bp, H. sapiens
ccaggcagagagaggg

SEQ ID NO: 74963 - DNA, 16 bp, H. sapiens
ccaggcagagctgagg

SEQ ID NO: 74964 - DNA, 16 bp, H. sapiens
ccaggcagaggaggca

SEQ ID NO: 74965 - DNA, 16 bp, H. sapiens
ccaggcagagggacag

SEQ ID NO: 74966 - DNA, 16 bp, H. sapiens
ccaggcagaggggcag

SEQ ID NO: 74967 - DNA, 16 bp, H. sapiens
ccaggcagaggggctc

SEQ ID NO: 74968 - DNA, 16 bp, H. sapiens
ccaggcagatgctggg

SEQ ID NO: 74969 - DNA, 16 bp, H. sapiens
ccaggcagcacagctt

SEQ ID NO: 74970 - DNA, 16 bp, H. sapiens
ccaggcagctctctga

SEQ ID NO: 74971 - DNA, 16 bp, H. sapiens
ccaggcagctgctgcc

SEQ ID NO: 74972 - DNA, 16 bp, H. sapiens
ccaggcagctgggacc

SEQ ID NO: 74973 - DNA, 16 bp, H. sapiens
ccaggcaggaagaagg

SEQ ID NO: 74974 - DNA, 16 bp, H. sapiens
ccaggcaggaaggcag

SEQ ID NO: 74975 - DNA, 16 bp, H. sapiens
ccaggcaggaggccag

SEQ ID NO: 74976 - DNA, 16 bp, H. sapiens
ccaggcaggagtggag

SEQ ID NO: 74977 - DNA, 16 bp, H. sapiens
ccaggcagggaggggc

SEQ ID NO: 74978 - DNA, 16 bp, H. sapiens
ccaggcagggcccctg

SEQ ID NO: 74979 - DNA, 16 bp, H. sapiens
ccaggcagggctgggg

SEQ ID NO: 74980 - DNA, 16 bp, H. sapiens
ccaggcagggtggctg

SEQ ID NO: 74981 - DNA, 16 bp, H. sapiens
ccaggcagtacttgct

SEQ ID NO: 74982 - DNA, 16 bp, H. sapiens
ccaggcagtggtcact

SEQ ID NO: 74983 - DNA, 16 bp, H. sapiens
ccaggcagtggtgtga

SEQ ID NO: 74984 - DNA, 16 bp, H. sapiens
ccaggcatagtacctt

SEQ ID NO: 74985 - DNA, 16 bp, H. sapiens
ccaggcatagtggcac

SEQ ID NO: 74986 - DNA, 16 bp, H. sapiens
ccaggcatggcagcgc

SEQ ID NO: 74987 - DNA, 17 bp, H. sapiens
ccaggcatggtgatgcg

SEQ ID NO: 74988 - DNA, 16 bp, H. sapiens
ccaggcatggtggggg

SEQ ID NO: 74989 - DNA, 16 bp, H. sapiens
ccaggcattcttctaa

SEQ ID NO: 74990 - DNA, 16 bp, H. sapiens
ccaggcattgtactaa

SEQ ID NO: 74991 - DNA, 16 bp, H. sapiens
ccaggcattgtgctag

SEQ ID NO: 74992 - DNA, 16 bp, H. sapiens
ccaggcattgtgttag

SEQ ID NO: 74993 - DNA, 16 bp, H. sapiens
ccaggcattgttccag

SEQ ID NO: 74994 - DNA, 16 bp, H. sapiens
ccaggcattgttctaa

SEQ ID NO: 74995 - DNA, 16 bp, H. sapiens
ccaggccaacatggta

SEQ ID NO: 74996 - DNA, 16 bp, H. sapiens
ccaggccaagccaggt

SEQ ID NO: 74997 - DNA, 16 bp, H. sapiens
ccaggccaagtgggtg

SEQ ID NO: 74998 - DNA, 16 bp, H. sapiens
ccaggccacaccccag

SEQ ID NO: 74999 - DNA, 16 bp, H. sapiens
ccaggccacagagcag

SEQ ID NO: 75000 - DNA, 16 bp, H. sapiens
ccaggccagagtgctg

SEQ ID NO: 75001 - DNA, 16 bp, H. sapiens
ccaggccagcccagga

SEQ ID NO: 75002 - DNA, 16 bp, H. sapiens
ccaggccagccctgcc

SEQ ID NO: 75003 - DNA, 16 bp, H. sapiens
ccaggccagcctgctg

SEQ ID NO: 75004 - DNA, 16 bp, H. sapiens
ccaggccagcctggcc

SEQ ID NO: 75005 - DNA, 16 bp, H. sapiens
ccaggccaggcactgt

SEQ ID NO: 75006 - DNA, 16 bp, H. sapiens
ccaggccaggcagcat

SEQ ID NO: 75007 - DNA, 16 bp, H. sapiens
ccaggccaggcccagg

SEQ ID NO: 75008 - DNA, 16 bp, H. sapiens
ccaggccaggcctctg

SEQ ID NO: 75009 - DNA, 16 bp, H. sapiens
ccaggccagggccagg

SEQ ID NO: 75010 - DNA, 16 bp, H. sapiens
ccaggccagggctggg

SEQ ID NO: 75011 - DNA, 16 bp, H. sapiens
ccaggccaggtgaggt

SEQ ID NO: 75012 - DNA, 16 bp, H. sapiens
ccaggccatgctgatg

SEQ ID NO: 75013 - DNA, 16 bp, H. sapiens
ccaggccatttttttt

SEQ ID NO: 75014 - DNA, 16 bp, H. sapiens
ccaggcccaccccaga

SEQ ID NO: 75015 - DNA, 16 bp, H. sapiens
ccaggcccaccctcac

SEQ ID NO: 75016 - DNA, 16 bp, H. sapiens
ccaggcccacctccag

SEQ ID NO: 75017 - DNA, 16 bp, H. sapiens
ccaggcccagagctgg

SEQ ID NO: 75018 - DNA, 16 bp, H. sapiens
ccaggcccagcctccc

SEQ ID NO: 75019 - DNA, 16 bp, H. sapiens
ccaggcccagcctggg

SEQ ID NO: 75020 - DNA, 16 bp, H. sapiens
ccaggcccagctcttg

SEQ ID NO: 75021 - DNA, 16 bp, H. sapiens
ccaggcccaggcccag

SEQ ID NO: 75022 - DNA, 16 bp, H. sapiens
ccaggcccaggccctg

SEQ ID NO: 75023 - DNA, 16 bp, H. sapiens
ccaggcccagggtcct

SEQ ID NO: 75024 - DNA, 16 bp, H. sapiens
ccaggccccacctcca

SEQ ID NO: 75025 - DNA, 16 bp, H. sapiens
ccaggccccacctgca

SEQ ID NO: 75026 - DNA, 16 bp, H. sapiens
ccaggccccagcccct

SEQ ID NO: 75027 - DNA, 16 bp, H. sapiens
ccaggccccaggcagg

SEQ ID NO: 75028 - DNA, 16 bp, H. sapiens
ccaggccccaggccag

SEQ ID NO: 75029 - DNA, 16 bp, H. sapiens
ccaggccccaggccct

SEQ ID NO: 75030 - DNA, 16 bp, H. sapiens
ccaggccccaggctcc

SEQ ID NO: 75031 - DNA, 16 bp, H. sapiens
ccaggccccaggctgg

SEQ ID NO: 75032 - DNA, 16 bp, H. sapiens
ccaggccccaggtggg

SEQ ID NO: 75033 - DNA, 16 bp, H. sapiens
ccaggccccatctcca

SEQ ID NO: 75034 - DNA, 16 bp, H. sapiens
ccaggcccccagcctc

SEQ ID NO: 75035 - DNA, 16 bp, H. sapiens
ccaggccccgcctcca

SEQ ID NO: 75036 - DNA, 16 bp, H. sapiens
ccaggcccctccccag

SEQ ID NO: 75037 - DNA, 16 bp, H. sapiens
ccaggcccctccctca

SEQ ID NO: 75038 - DNA, 16 bp, H. sapiens
ccaggcccctcctctg

SEQ ID NO: 75039 - DNA, 16 bp, H. sapiens
ccaggcccctgccctg

SEQ ID NO: 75040 - DNA, 16 bp, H. sapiens
ccaggcccctgctcca

SEQ ID NO: 75041 - DNA, 16 bp, H. sapiens
ccaggccctagctcca

SEQ ID NO: 75042 - DNA, 16 bp, H. sapiens
ccaggccctgagccag

SEQ ID NO: 75043 - DNA, 16 bp, H. sapiens
ccaggccctgcccacc

SEQ ID NO: 75044 - DNA, 16 bp, H. sapiens
ccaggccctgccccag

SEQ ID NO: 75045 - DNA, 16 bp, H. sapiens
ccaggccctgccctca

SEQ ID NO: 75046 - DNA, 16 bp, H. sapiens
ccaggccctgccctcc

SEQ ID NO: 75047 - DNA, 16 bp, H. sapiens
ccaggccctgccctgg

SEQ ID NO: 75048 - DNA, 16 bp, H. sapiens
ccaggccctgcctccc

SEQ ID NO: 75049 - DNA, 16 bp, H. sapiens
ccaggccctgctctgc

SEQ ID NO: 75050 - DNA, 16 bp, H. sapiens
ccaggccctggccctg

SEQ ID NO: 75051 - DNA, 16 bp, H. sapiens
ccaggccctgggccag

SEQ ID NO: 75052 - DNA, 16 bp, H. sapiens
ccaggccctgggcctg

SEQ ID NO: 75053 - DNA, 16 bp, H. sapiens
ccaggccctgggctag

SEQ ID NO: 75054 - DNA, 16 bp, H. sapiens
ccaggccctgggctgg

SEQ ID NO: 75055 - DNA, 16 bp, H. sapiens
ccaggccctgtgctga

SEQ ID NO: 75056 - DNA, 16 bp, H. sapiens
ccaggccggagtgcag

SEQ ID NO: 75057 - DNA, 16 bp, H. sapiens
ccaggcctcagccacc

SEQ ID NO: 75058 - DNA, 16 bp, H. sapiens
ccaggcctcagctgcc

SEQ ID NO: 75059 - DNA, 16 bp, H. sapiens
ccaggcctcaggcccc

SEQ ID NO: 75060 - DNA, 16 bp, H. sapiens
ccaggcctccagcccc

SEQ ID NO: 75061 - DNA, 16 bp, H. sapiens
ccaggcctccaggcct

SEQ ID NO: 75062 - DNA, 16 bp, H. sapiens
ccaggcctccccagcc

SEQ ID NO: 75063 - DNA, 16 bp, H. sapiens
ccaggcctcctgcctc

SEQ ID NO: 75064 - DNA, 16 bp, H. sapiens
ccaggcctcctgctct

SEQ ID NO: 75065 - DNA, 16 bp, H. sapiens
ccaggcctcctggctc

SEQ ID NO: 75066 - DNA, 16 bp, H. sapiens
ccaggcctctctccag

SEQ ID NO: 75067 - DNA, 16 bp, H. sapiens
ccaggcctctctcctg

SEQ ID NO: 75068 - DNA, 16 bp, H. sapiens
ccaggcctctgagccc

SEQ ID NO: 75069 - DNA, 16 bp, H. sapiens
ccaggcctctgcctcc

SEQ ID NO: 75070 - DNA, 16 bp, H. sapiens
ccaggcctctgggcct

SEQ ID NO: 75071 - DNA, 16 bp, H. sapiens
ccaggcctgagtgcag

SEQ ID NO: 75072 - DNA, 16 bp, H. sapiens
ccaggcctgcccacag

SEQ ID NO: 75073 - DNA, 16 bp, H. sapiens
ccaggcctgccctgaa

SEQ ID NO: 75074 - DNA, 16 bp, H. sapiens
ccaggcctgccctgca

SEQ ID NO: 75075 - DNA, 16 bp, H. sapiens
ccaggcctgcctcccc

SEQ ID NO: 75076 - DNA, 16 bp, H. sapiens
ccaggcctgcctgact

SEQ ID NO: 75077 - DNA, 16 bp, H. sapiens
ccaggcctgccttcca

SEQ ID NO: 75078 - DNA, 16 bp, H. sapiens
ccaggcctggcatggt

SEQ ID NO: 75079 - DNA, 16 bp, H. sapiens
ccaggcctggccccag

SEQ ID NO: 75080 - DNA, 16 bp, H. sapiens
ccaggcctggccctgc

SEQ ID NO: 75081 - DNA, 16 bp, H. sapiens
ccaggcctggcctcag

SEQ ID NO: 75082 - DNA, 16 bp, H. sapiens
ccaggcctggcggccg

SEQ ID NO: 75083 - DNA, 16 bp, H. sapiens
ccaggcctggctctgc

SEQ ID NO: 75084 - DNA, 16 bp, H. sapiens
ccaggcctgggaggag

SEQ ID NO: 75085 - DNA, 16 bp, H. sapiens
ccaggcctgggccagg

SEQ ID NO: 75086 - DNA, 16 bp, H. sapiens
ccaggcctgggcctgc

SEQ ID NO: 75087 - DNA, 16 bp, H. sapiens
ccaggcctgggctggg

SEQ ID NO: 75088 - DNA, 16 bp, H. sapiens
ccaggcctggggcagg

SEQ ID NO: 75089 - DNA, 16 bp, H. sapiens
ccaggcctggtggcgg

SEQ ID NO: 75090 - DNA, 16 bp, H. sapiens
ccaggcctgtgatgag

SEQ ID NO: 75091 - DNA, 16 bp, H. sapiens
ccaggcctgtgatggg

SEQ ID NO: 75092 - DNA, 16 bp, H. sapiens
ccaggccttctccctg

SEQ ID NO: 75093 - DNA, 16 bp, H. sapiens
ccaggcgcagcagctc

SEQ ID NO: 75094 - DNA, 17 bp, H. sapiens
ccaggcgcggcggctca

SEQ ID NO: 75095 - DNA, 16 bp, H. sapiens
ccaggcgcgggggctc

SEQ ID NO: 75096 - DNA, 16 bp, H. sapiens
ccaggcgggtggatca

SEQ ID NO: 75097 - DNA, 16 bp, H. sapiens
ccaggcgtgggggctc

SEQ ID NO: 75098 - DNA, 16 bp, H. sapiens
ccaggcgtggtggagc

SEQ ID NO: 75099 - DNA, 16 bp, H. sapiens
ccaggcgtggtggcct

SEQ ID NO: 75100 - DNA, 19 bp, H. sapiens
ccaggcgtggtggcgggca

SEQ ID NO: 75101 - DNA, 18 bp, H. sapiens
ccaggcgtggtggctcaa

SEQ ID NO: 75102 - DNA, 16 bp, H. sapiens
ccaggctaatttttct

SEQ ID NO: 75103 - DNA, 16 bp, H. sapiens
ccaggctagaaggcag

SEQ ID NO: 75104 - DNA, 16 bp, H. sapiens
ccaggctagtctcgaa

SEQ ID NO: 75105 - DNA, 16 bp, H. sapiens
ccaggctcaagaaatc

SEQ ID NO: 75106 - DNA, 16 bp, H. sapiens
ccaggctcaagtgatt

SEQ ID NO: 75107 - DNA, 16 bp, H. sapiens
ccaggctcagagaggt

SEQ ID NO: 75108 - DNA, 16 bp, H. sapiens
ccaggctcagccagca

SEQ ID NO: 75109 - DNA, 16 bp, H. sapiens
ccaggctccacctcca

SEQ ID NO: 75110 - DNA, 16 bp, H. sapiens
ccaggctccaggctcc

SEQ ID NO: 75111 - DNA, 16 bp, H. sapiens
ccaggctccaggctgg

SEQ ID NO: 75112 - DNA, 16 bp, H. sapiens
ccaggctccagggaca

SEQ ID NO: 75113 - DNA, 16 bp, H. sapiens
ccaggctcccagcccc

SEQ ID NO: 75114 - DNA, 16 bp, H. sapiens
ccaggctcctcccagc

SEQ ID NO: 75115 - DNA, 16 bp, H. sapiens
ccaggctcctccccgc

SEQ ID NO: 75116 - DNA, 16 bp, H. sapiens
ccaggctcctcccctg

SEQ ID NO: 75117 - DNA, 16 bp, H. sapiens
ccaggctcctcctcca

SEQ ID NO: 75118 - DNA, 16 bp, H. sapiens
ccaggctcctcctccc

SEQ ID NO: 75119 - DNA, 16 bp, H. sapiens
ccaggctctgccctgg

SEQ ID NO: 75120 - DNA, 16 bp, H. sapiens
ccaggctctgcctggg

SEQ ID NO: 75121 - DNA, 16 bp, H. sapiens
ccaggctctgggctgg

SEQ ID NO: 75122 - DNA, 16 bp, H. sapiens
ccaggctctggtgatc

SEQ ID NO: 75123 - DNA, 16 bp, H. sapiens
ccaggctctgtgtggg

SEQ ID NO: 75124 - DNA, 16 bp, H. sapiens
ccaggctgaaggagca

SEQ ID NO: 75125 - DNA, 16 bp, H. sapiens
ccaggctgacctcaag

SEQ ID NO: 75126 - DNA, 16 bp, H. sapiens
ccaggctgagctgccc

SEQ ID NO: 75127 - DNA, 16 bp, H. sapiens
ccaggctgaggtgcag

SEQ ID NO: 75128 - DNA, 16 bp, H. sapiens
ccaggctgcactgcag

SEQ ID NO: 75129 - DNA, 16 bp, H. sapiens
ccaggctgcagagggc

SEQ ID NO: 75130 - DNA, 16 bp, H. sapiens
ccaggctgcagcctca

SEQ ID NO: 75131 - DNA, 16 bp, H. sapiens
ccaggctgcagctccc

SEQ ID NO: 75132 - DNA, 16 bp, H. sapiens
ccaggctgcagctgcc

SEQ ID NO: 75133 - DNA, 16 bp, H. sapiens
ccaggctgcaggctgg

SEQ ID NO: 75134 - DNA, 16 bp, H. sapiens
ccaggctgcagggcag

SEQ ID NO: 75135 - DNA, 16 bp, H. sapiens
ccaggctgcagtgagc

SEQ ID NO: 75136 - DNA, 16 bp, H. sapiens
ccaggctgcagtggag

SEQ ID NO: 75137 - DNA, 16 bp, H. sapiens
ccaggctgcagtggca

SEQ ID NO: 75138 - DNA, 16 bp, H. sapiens
ccaggctgccagtccc

SEQ ID NO: 75139 - DNA, 16 bp, H. sapiens
ccaggctgccagttcc

SEQ ID NO: 75140 - DNA, 16 bp, H. sapiens
ccaggctgccctcgaa

SEQ ID NO: 75141 - DNA, 16 bp, H. sapiens
ccaggctgctgtgcag

SEQ ID NO: 75142 - DNA, 16 bp, H. sapiens
ccaggctggaatgccg

SEQ ID NO: 75143 - DNA, 16 bp, H. sapiens
ccaggctggaatggag

SEQ ID NO: 75144 - DNA, 16 bp, H. sapiens
ccaggctggactgtag

SEQ ID NO: 75145 - DNA, 16 bp, H. sapiens
ccaggctggagaacaa

SEQ ID NO: 75146 - DNA, 16 bp, H. sapiens
ccaggctggagaacag

SEQ ID NO: 75147 - DNA, 16 bp, H. sapiens
ccaggctggagaggag

SEQ ID NO: 75148 - DNA, 16 bp, H. sapiens
ccaggctggagctgga

SEQ ID NO: 75149 - DNA, 16 bp, H. sapiens
ccaggctggaggctca

SEQ ID NO: 75150 - DNA, 16 bp, H. sapiens
ccaggctggagtgagt

SEQ ID NO: 75151 - DNA, 16 bp, H. sapiens
ccaggctggagtgccg

SEQ ID NO: 75152 - DNA, 16 bp, H. sapiens
ccaggctggagtgcgc

SEQ ID NO: 75153 - DNA, 16 bp, H. sapiens
ccaggctggagtgtga

SEQ ID NO: 75154 - DNA, 17 bp, H. sapiens
ccaggctggagttcagt

SEQ ID NO: 75155 - DNA, 16 bp, H. sapiens
ccaggctggagttctg

SEQ ID NO: 75156 - DNA, 16 bp, H. sapiens
ccaggctggatgcaat

SEQ ID NO: 75157 - DNA, 16 bp, H. sapiens
ccaggctggatggagt

SEQ ID NO: 75158 - DNA, 16 bp, H. sapiens
ccaggctggatttgaa

SEQ ID NO: 75159 - DNA, 16 bp, H. sapiens
ccaggctggccaggct

SEQ ID NO: 75160 - DNA, 16 bp, H. sapiens
ccaggctggctcactg

SEQ ID NO: 75161 - DNA, 16 bp, H. sapiens
ccaggctggctcctgc

SEQ ID NO: 75162 - DNA, 16 bp, H. sapiens
ccaggctgggagctgg

SEQ ID NO: 75163 - DNA, 16 bp, H. sapiens
ccaggctgggcagcag

SEQ ID NO: 75164 - DNA, 16 bp, H. sapiens
ccaggctgggcagcat

SEQ ID NO: 75165 - DNA, 16 bp, H. sapiens
ccaggctgggccaggc

SEQ ID NO: 75166 - DNA, 16 bp, H. sapiens
ccaggctgggctcagc

SEQ ID NO: 75167 - DNA, 16 bp, H. sapiens
ccaggctgggctgggc

SEQ ID NO: 75168 - DNA, 16 bp, H. sapiens
ccaggctggggttcag

SEQ ID NO: 75169 - DNA, 16 bp, H. sapiens
ccaggctgggtgacac

SEQ ID NO: 75170 - DNA, 16 bp, H. sapiens
ccaggctggtactggg

SEQ ID NO: 75171 - DNA, 16 bp, H. sapiens
ccaggctggtccccaa

SEQ ID NO: 75172 - DNA, 23 bp, H. sapiens
ccaggctggtctcaaactcctaa

SEQ ID NO: 75173 - DNA, 16 bp, H. sapiens
ccaggctggtctcaca

SEQ ID NO: 75174 - DNA, 16 bp, H. sapiens
ccaggctggtttcaaa

SEQ ID NO: 75175 - DNA, 16 bp, H. sapiens
ccaggctgtaatgcag

SEQ ID NO: 75176 - DNA, 16 bp, H. sapiens
ccaggctgtaggtgcc

SEQ ID NO: 75177 - DNA, 16 bp, H. sapiens
ccaggctgtctgcctg

SEQ ID NO: 75178 - DNA, 16 bp, H. sapiens
ccaggctgtgaatttt

SEQ ID NO: 75179 - DNA, 16 bp, H. sapiens
ccaggctgtggtgcag

SEQ ID NO: 75180 - DNA, 16 bp, H. sapiens
ccaggctgtgtgtgtg

SEQ ID NO: 75181 - DNA, 16 bp, H. sapiens
ccaggctgtttttgaa

SEQ ID NO: 75182 - DNA, 16 bp, H. sapiens
ccaggcttcaggctgg

SEQ ID NO: 75183 - DNA, 16 bp, H. sapiens
ccaggcttccttctga

SEQ ID NO: 75184 - DNA, 16 bp, H. sapiens
ccaggcttgagggcag

SEQ ID NO: 75185 - DNA, 16 bp, H. sapiens
ccaggcttgagggtgg

SEQ ID NO: 75186 - DNA, 16 bp, H. sapiens
ccaggcttgtctggaa

SEQ ID NO: 75187 - DNA, 16 bp, H. sapiens
ccaggctttagtgcag

SEQ ID NO: 75188 - DNA, 16 bp, H. sapiens
ccaggctttcttgggc

SEQ ID NO: 75189 - DNA, 16 bp, H. sapiens
ccaggctttggaatca

SEQ ID NO: 75190 - DNA, 16 bp, H. sapiens
ccagggaagccagaag

SEQ ID NO: 75191 - DNA, 16 bp, H. sapiens
ccagggaaggaggaag

SEQ ID NO: 75192 - DNA, 16 bp, H. sapiens
ccagggaaggaggcag

SEQ ID NO: 75193 - DNA, 16 bp, H. sapiens
ccagggaagtgggaga

SEQ ID NO: 75194 - DNA, 16 bp, H. sapiens
ccagggacacaatgca

SEQ ID NO: 75195 - DNA, 16 bp, H. sapiens
ccagggacagaatgat

SEQ ID NO: 75196 - DNA, 16 bp, H. sapiens
ccagggaccagtttca

SEQ ID NO: 75197 - DNA, 16 bp, H. sapiens
ccagggacccccagcc

SEQ ID NO: 75198 - DNA, 16 bp, H. sapiens
ccagggaccccctccc

SEQ ID NO: 75199 - DNA, 16 bp, H. sapiens
ccagggacctgtccct

SEQ ID NO: 75200 - DNA, 16 bp, H. sapiens
ccagggactctcaggc

SEQ ID NO: 75201 - DNA, 16 bp, H. sapiens
ccagggactggggaga

SEQ ID NO: 75202 - DNA, 16 bp, H. sapiens
ccagggagagtgggag

SEQ ID NO: 75203 - DNA, 16 bp, H. sapiens
ccagggagatggaggt

SEQ ID NO: 75204 - DNA, 16 bp, H. sapiens
ccagggagctgagcag

SEQ ID NO: 75205 - DNA, 16 bp, H. sapiens
ccagggaggcagagga

SEQ ID NO: 75206 - DNA, 16 bp, H. sapiens
ccagggaggcagaggc

SEQ ID NO: 75207 - DNA, 16 bp, H. sapiens
ccagggaggcaggcag

SEQ ID NO: 75208 - DNA, 16 bp, H. sapiens
ccagggaggccgaggt

SEQ ID NO: 75209 - DNA, 16 bp, H. sapiens
ccagggagggcagagg

SEQ ID NO: 75210 - DNA, 16 bp, H. sapiens
ccagggaggtagaggc

SEQ ID NO: 75211 - DNA, 16 bp, H. sapiens
ccagggaggtcaaggc

SEQ ID NO: 75212 - DNA, 16 bp, H. sapiens
ccagggatgaaactga

SEQ ID NO: 75213 - DNA, 16 bp, H. sapiens
ccagggatgaagctga

SEQ ID NO: 75214 - DNA, 16 bp, H. sapiens
ccagggatgcaagaat

SEQ ID NO: 75215 - DNA, 16 bp, H. sapiens
ccagggatgcaatatt

SEQ ID NO: 75216 - DNA, 16 bp, H. sapiens
ccagggatgcctggag

SEQ ID NO: 75217 - DNA, 16 bp, H. sapiens
ccagggatgctgttaa

SEQ ID NO: 75218 - DNA, 16 bp, H. sapiens
ccagggatggagccca

SEQ ID NO: 75219 - DNA, 16 bp, H. sapiens
ccagggatgggcagga

SEQ ID NO: 75220 - DNA, 16 bp, H. sapiens
ccagggattggcaaac

SEQ ID NO: 75221 - DNA, 16 bp, H. sapiens
ccagggcacagagaag

SEQ ID NO: 75222 - DNA, 16 bp, H. sapiens
ccagggcagcactggg

SEQ ID NO: 75223 - DNA, 16 bp, H. sapiens
ccagggcagccaaggg

SEQ ID NO: 75224 - DNA, 16 bp, H. sapiens
ccagggcagggcaggg

SEQ ID NO: 75225 - DNA, 16 bp, H. sapiens
ccagggcagggctctg

SEQ ID NO: 75226 - DNA, 16 bp, H. sapiens
ccagggcagggctggg

SEQ ID NO: 75227 - DNA, 16 bp, H. sapiens
ccagggcagggctgtg

SEQ ID NO: 75228 - DNA, 16 bp, H. sapiens
ccagggcaggggaagg

SEQ ID NO: 75229 - DNA, 16 bp, H. sapiens
ccagggcaggggtggg

SEQ ID NO: 75230 - DNA, 16 bp, H. sapiens
ccagggcatgttagag

SEQ ID NO: 75231 - DNA, 16 bp, H. sapiens
ccagggccacacagcc

SEQ ID NO: 75232 - DNA, 16 bp, H. sapiens
ccagggccagagcagg

SEQ ID NO: 75233 - DNA, 16 bp, H. sapiens
ccagggccagcagggc

SEQ ID NO: 75234 - DNA, 16 bp, H. sapiens
ccagggccaggcccag

SEQ ID NO: 75235 - DNA, 16 bp, H. sapiens
ccagggccaggcgcgg

SEQ ID NO: 75236 - DNA, 16 bp, H. sapiens
ccagggccaggctgtg

SEQ ID NO: 75237 - DNA, 16 bp, H. sapiens
ccagggccaggggagg

SEQ ID NO: 75238 - DNA, 16 bp, H. sapiens
ccagggccaggggcag

SEQ ID NO: 75239 - DNA, 16 bp, H. sapiens
ccagggccaggggctg

SEQ ID NO: 75240 - DNA, 16 bp, H. sapiens
ccagggccaggtgcag

SEQ ID NO: 75241 - DNA, 16 bp, H. sapiens
ccagggccaggtgcgg

SEQ ID NO: 75242 - DNA, 16 bp, H. sapiens
ccagggcccagcacag

SEQ ID NO: 75243 - DNA, 16 bp, H. sapiens
ccagggcccagccagg

SEQ ID NO: 75244 - DNA, 16 bp, H. sapiens
ccagggcccagcccca

SEQ ID NO: 75245 - DNA, 16 bp, H. sapiens
ccagggcccagctgct

SEQ ID NO: 75246 - DNA, 16 bp, H. sapiens
ccagggcccagggcag

SEQ ID NO: 75247 - DNA, 16 bp, H. sapiens
ccagggcccagggctg

SEQ ID NO: 75248 - DNA, 16 bp, H. sapiens
ccagggccccactgcc

SEQ ID NO: 75249 - DNA, 16 bp, H. sapiens
ccagggccctgctgct

SEQ ID NO: 75250 - DNA, 16 bp, H. sapiens
ccagggccgtgacacc

SEQ ID NO: 75251 - DNA, 16 bp, H. sapiens
ccagggcctgctgggg

SEQ ID NO: 75252 - DNA, 16 bp, H. sapiens
ccagggcctgctgtgg

SEQ ID NO: 75253 - DNA, 16 bp, H. sapiens
ccagggcctggcccag

SEQ ID NO: 75254 - DNA, 16 bp, H. sapiens
ccagggcctggctggg

SEQ ID NO: 75255 - DNA, 16 bp, H. sapiens
ccagggcctgggagga

SEQ ID NO: 75256 - DNA, 16 bp, H. sapiens
ccagggcctgggcctg

SEQ ID NO: 75257 - DNA, 16 bp, H. sapiens
ccagggcctgtcctgg

SEQ ID NO: 75258 - DNA, 16 bp, H. sapiens
ccagggctccaggccc

SEQ ID NO: 75259 - DNA, 16 bp, H. sapiens
ccagggctccctggag

SEQ ID NO: 75260 - DNA, 16 bp, H. sapiens
ccagggctctttggag

SEQ ID NO: 75261 - DNA, 16 bp, H. sapiens
ccagggctgaggcagg

SEQ ID NO: 75262 - DNA, 16 bp, H. sapiens
ccagggctgctcccca

SEQ ID NO: 75263 - DNA, 16 bp, H. sapiens
ccagggctggagcagg

SEQ ID NO: 75264 - DNA, 16 bp, H. sapiens
ccagggctgggagcag

SEQ ID NO: 75265 - DNA, 16 bp, H. sapiens
ccagggctgggcctgg

SEQ ID NO: 75266 - DNA, 16 bp, H. sapiens
ccagggctgggctcag

SEQ ID NO: 75267 - DNA, 16 bp, H. sapiens
ccagggctgggctggg

SEQ ID NO: 75268 - DNA, 16 bp, H. sapiens
ccagggctgggctgtg

SEQ ID NO: 75269 - DNA, 16 bp, H. sapiens
ccagggctggggaggg

SEQ ID NO: 75270 - DNA, 16 bp, H. sapiens
ccagggctggggcaga

SEQ ID NO: 75271 - DNA, 16 bp, H. sapiens
ccagggctggggctgg

SEQ ID NO: 75272 - DNA, 16 bp, H. sapiens
ccagggctgggggtgg

SEQ ID NO: 75273 - DNA, 16 bp, H. sapiens
ccagggctgggtgcag

SEQ ID NO: 75274 - DNA, 16 bp, H. sapiens
ccagggcttggggacc

SEQ ID NO: 75275 - DNA, 16 bp, H. sapiens
ccaggggagaatctgt

SEQ ID NO: 75276 - DNA, 17 bp, H. sapiens
ccaggggagacatcaca

SEQ ID NO: 75277 - DNA, 16 bp, H. sapiens
ccaggggagccctggg

SEQ ID NO: 75278 - DNA, 16 bp, H. sapiens
ccaggggattctgatg

SEQ ID NO: 75279 - DNA, 16 bp, H. sapiens
ccaggggcagaaacag

SEQ ID NO: 75280 - DNA, 16 bp, H. sapiens
ccaggggccaggcagg

SEQ ID NO: 75281 - DNA, 16 bp, H. sapiens
ccaggggccagggcag

SEQ ID NO: 75282 - DNA, 16 bp, H. sapiens
ccaggggccgggccag

SEQ ID NO: 75283 - DNA, 16 bp, H. sapiens
ccaggggcctgggcag

SEQ ID NO: 75284 - DNA, 16 bp, H. sapiens
ccaggggctctggaag

SEQ ID NO: 75285 - DNA, 16 bp, H. sapiens
ccaggggctctgggag

SEQ ID NO: 75286 - DNA, 16 bp, H. sapiens
ccaggggctggaagga

SEQ ID NO: 75287 - DNA, 16 bp, H. sapiens
ccaggggctggaggga

SEQ ID NO: 75288 - DNA, 16 bp, H. sapiens
ccaggggctggggaag

SEQ ID NO: 75289 - DNA, 16 bp, H. sapiens
ccaggggctggggaga

SEQ ID NO: 75290 - DNA, 16 bp, H. sapiens
ccagggggctgagcag

SEQ ID NO: 75291 - DNA, 16 bp, H. sapiens
ccaggggtggtggcat

SEQ ID NO: 75292 - DNA, 16 bp, H. sapiens
ccaggggttgggggag

SEQ ID NO: 75293 - DNA, 16 bp, H. sapiens
ccagggtaattaggca

SEQ ID NO: 75294 - DNA, 16 bp, H. sapiens
ccagggtcacacagca

SEQ ID NO: 75295 - DNA, 16 bp, H. sapiens
ccagggtcactcagct

SEQ ID NO: 75296 - DNA, 16 bp, H. sapiens
ccagggtcccctgggc

SEQ ID NO: 75297 - DNA, 16 bp, H. sapiens
ccagggtccctgtgct

SEQ ID NO: 75298 - DNA, 16 bp, H. sapiens
ccagggtcctggtggt

SEQ ID NO: 75299 - DNA, 16 bp, H. sapiens
ccagggtctgggcagg

SEQ ID NO: 75300 - DNA, 16 bp, H. sapiens
ccagggtcttgggcag

SEQ ID NO: 75301 - DNA, 16 bp, H. sapiens
ccagggtgacagagtg

SEQ ID NO: 75302 - DNA, 16 bp, H. sapiens
ccagggtgatctcaaa

SEQ ID NO: 75303 - DNA, 16 bp, H. sapiens
ccagggtggattgcag

SEQ ID NO: 75304 - DNA, 16 bp, H. sapiens
ccagggtgggagagga

SEQ ID NO: 75305 - DNA, 16 bp, H. sapiens
ccagggtgggcagatc

SEQ ID NO: 75306 - DNA, 16 bp, H. sapiens
ccagggtggggcccag

SEQ ID NO: 75307 - DNA, 16 bp, H. sapiens
ccagggtggtcttcaa

SEQ ID NO: 75308 - DNA, 16 bp, H. sapiens
ccagggttcaggtgat

SEQ ID NO: 75309 - DNA, 16 bp, H. sapiens
ccaggtaattctgatg

SEQ ID NO: 75310 - DNA, 16 bp, H. sapiens
ccaggtatgaagccaa

SEQ ID NO: 75311 - DNA, 16 bp, H. sapiens
ccaggtatggtggcac

SEQ ID NO: 75312 - DNA, 16 bp, H. sapiens
ccaggtcacacagcag

SEQ ID NO: 75313 - DNA, 16 bp, H. sapiens
ccaggtcacactgatg

SEQ ID NO: 75314 - DNA, 16 bp, H. sapiens
ccaggtcatgctaatg

SEQ ID NO: 75315 - DNA, 16 bp, H. sapiens
ccaggtcccccagcag

SEQ ID NO: 75316 - DNA, 16 bp, H. sapiens
ccaggtccctccccca

SEQ ID NO: 75317 - DNA, 16 bp, H. sapiens
ccaggtccctcctcca

SEQ ID NO: 75318 - DNA, 16 bp, H. sapiens
ccaggtccctcctttg

SEQ ID NO: 75319 - DNA, 16 bp, H. sapiens
ccaggtcctatgtcca

SEQ ID NO: 75320 - DNA, 16 bp, H. sapiens
ccaggtctaccttgat

SEQ ID NO: 75321 - DNA, 16 bp, H. sapiens
ccaggtctcaaactcc

SEQ ID NO: 75322 - DNA, 16 bp, H. sapiens
ccaggtctcaagtgat

SEQ ID NO: 75323 - DNA, 16 bp, H. sapiens
ccaggtctcctgcctc

SEQ ID NO: 75324 - DNA, 16 bp, H. sapiens
ccaggtctctcccatg

SEQ ID NO: 75325 - DNA, 16 bp, H. sapiens
ccaggtctgtctgact

SEQ ID NO: 75326 - DNA, 16 bp, H. sapiens
ccaggtcttctgactc

SEQ ID NO: 75327 - DNA, 16 bp, H. sapiens
ccaggtcttctgactt

SEQ ID NO: 75328 - DNA, 16 bp, H. sapiens
ccaggtcttctgattc

SEQ ID NO: 75329 - DNA, 16 bp, H. sapiens
ccaggtgaggtggcat

SEQ ID NO: 75330 - DNA, 16 bp, H. sapiens
ccaggtgaggtggtgg

SEQ ID NO: 75331 - DNA, 19 bp, H. sapiens
ccaggtgatccacctgcct

SEQ ID NO: 75332 - DNA, 16 bp, H. sapiens
ccaggtgatgccagtg

SEQ ID NO: 75333 - DNA, 16 bp, H. sapiens
ccaggtgatgctgctg

SEQ ID NO: 75334 - DNA, 16 bp, H. sapiens
ccaggtgatgctggtg

SEQ ID NO: 75335 - DNA, 16 bp, H. sapiens
ccaggtgattctaatg

SEQ ID NO: 75336 - DNA, 16 bp, H. sapiens
ccaggtgattctgatg

SEQ ID NO: 75337 - DNA, 16 bp, H. sapiens
ccaggtgcactgctca

SEQ ID NO: 75338 - DNA, 16 bp, H. sapiens
ccaggtgcactgcttg

SEQ ID NO: 75339 - DNA, 16 bp, H. sapiens
ccaggtgcaggggctt

SEQ ID NO: 75340 - DNA, 16 bp, H. sapiens
ccaggtgcagtggctc

SEQ ID NO: 75341 - DNA, 16 bp, H. sapiens
ccaggtgcagtggctt

SEQ ID NO: 75342 - DNA, 16 bp, H. sapiens
ccaggtgctctgtccc

SEQ ID NO: 75343 - DNA, 16 bp, H. sapiens
ccaggtgctgctgctg

SEQ ID NO: 75344 - DNA, 16 bp, H. sapiens
ccaggtgctgtgactc

SEQ ID NO: 75345 - DNA, 16 bp, H. sapiens
ccaggtggaagctgcc

SEQ ID NO: 75346 - DNA, 16 bp, H. sapiens
ccaggtggacttcaca

SEQ ID NO: 75347 - DNA, 16 bp, H. sapiens
ccaggtggaggtgatt

SEQ ID NO: 75348 - DNA, 16 bp, H. sapiens
ccaggtggatatcagg

SEQ ID NO: 75349 - DNA, 16 bp, H. sapiens
ccaggtgggcatgggc

SEQ ID NO: 75350 - DNA, 16 bp, H. sapiens
ccaggtggggctgggg

SEQ ID NO: 75351 - DNA, 16 bp, H. sapiens
ccaggtgggggcaggg

SEQ ID NO: 75352 - DNA, 16 bp, H. sapiens
ccaggtgggtcttgaa

SEQ ID NO: 75353 - DNA, 16 bp, H. sapiens
ccaggtgggtgtgggc

SEQ ID NO: 75354 - DNA, 16 bp, H. sapiens
ccaggtggtagtggtg

SEQ ID NO: 75355 - DNA, 16 bp, H. sapiens
ccaggtggtcaaggct

SEQ ID NO: 75356 - DNA, 16 bp, H. sapiens
ccaggtgtgatggcac

SEQ ID NO: 75357 - DNA, 16 bp, H. sapiens
ccaggtgtggaatgat

SEQ ID NO: 75358 - DNA, 16 bp, H. sapiens
ccaggtgtgggcaggg

SEQ ID NO: 75359 - DNA, 16 bp, H. sapiens
ccaggtgtgggggctc

SEQ ID NO: 75360 - DNA, 16 bp, H. sapiens
ccaggtgtggtgacgg

SEQ ID NO: 75361 - DNA, 16 bp, H. sapiens
ccaggtgtggtgactt

SEQ ID NO: 75362 - DNA, 16 bp, H. sapiens
ccaggtgtggtgatgg

SEQ ID NO: 75363 - DNA, 16 bp, H. sapiens
ccaggtgtggtggggc

SEQ ID NO: 75364 - DNA, 17 bp, H. sapiens
ccaggtgttcaagacca

SEQ ID NO: 75365 - DNA, 16 bp, H. sapiens
ccaggtgttgtggtgc

SEQ ID NO: 75366 - DNA, 16 bp, H. sapiens
ccaggtgtttgagatc

SEQ ID NO: 75367 - DNA, 16 bp, H. sapiens
ccaggttaaagcaatt

SEQ ID NO: 75368 - DNA, 16 bp, H. sapiens
ccaggttacagtgagc

SEQ ID NO: 75369 - DNA, 16 bp, H. sapiens
ccaggttcaaggcatt

SEQ ID NO: 75370 - DNA, 16 bp, H. sapiens
ccaggttcaggccatt

SEQ ID NO: 75371 - DNA, 16 bp, H. sapiens
ccaggttcggtggctc

SEQ ID NO: 75372 - DNA, 16 bp, H. sapiens
ccaggttctagtgatt

SEQ ID NO: 75373 - DNA, 16 bp, H. sapiens
ccaggttgatcttgaa

SEQ ID NO: 75374 - DNA, 16 bp, H. sapiens
ccaggttgtccatcag

SEQ ID NO: 75375 - DNA, 16 bp, H. sapiens
ccaggtttcgccatgt

SEQ ID NO: 75376 - DNA, 16 bp, H. sapiens
ccaggttttttgtttt

SEQ ID NO: 75377 - DNA, 16 bp, H. sapiens
ccagtaaaaatatttt

SEQ ID NO: 75378 - DNA, 16 bp, H. sapiens
ccagtaaaatgttgaa

SEQ ID NO: 75379 - DNA, 16 bp, H. sapiens
ccagtaaaattatcct

SEQ ID NO: 75380 - DNA, 16 bp, H. sapiens
ccagtaacactgtggc

SEQ ID NO: 75381 - DNA, 16 bp, H. sapiens
ccagtaagttattttg

SEQ ID NO: 75382 - DNA, 16 bp, H. sapiens
ccagtaagtttctcat

SEQ ID NO: 75383 - DNA, 16 bp, H. sapiens
ccagtaatggcatggc

SEQ ID NO: 75384 - DNA, 16 bp, H. sapiens
ccagtaatgggatctc

SEQ ID NO: 75385 - DNA, 16 bp, H. sapiens
ccagtaattttttttt

SEQ ID NO: 75386 - DNA, 16 bp, H. sapiens
ccagtacagcctgcag

SEQ ID NO: 75387 - DNA, 16 bp, H. sapiens
ccagtacagtgcctgg

SEQ ID NO: 75388 - DNA, 16 bp, H. sapiens
ccagtacgcctggcta

SEQ ID NO: 75389 - DNA, 16 bp, H. sapiens
ccagtactttggaaag

SEQ ID NO: 75390 - DNA, 16 bp, H. sapiens
ccagtactttgggaag

SEQ ID NO: 75391 - DNA, 16 bp, H. sapiens
ccagtagagatggggt

SEQ ID NO: 75392 - DNA, 16 bp, H. sapiens
ccagtagctgggatta

SEQ ID NO: 75393 - DNA, 16 bp, H. sapiens
ccagtagtcatccagg

SEQ ID NO: 75394 - DNA, 16 bp, H. sapiens
ccagtagttcaaggtt

SEQ ID NO: 75395 - DNA, 16 bp, H. sapiens
ccagtatcaccacaaa

SEQ ID NO: 75396 - DNA, 16 bp, H. sapiens
ccagtatctgcttctg

SEQ ID NO: 75397 - DNA, 16 bp, H. sapiens
ccagtatttcattgag

SEQ ID NO: 75398 - DNA, 16 bp, H. sapiens
ccagtatttttttgag

SEQ ID NO: 75399 - DNA, 16 bp, H. sapiens
ccagtcacagaagaac

SEQ ID NO: 75400 - DNA, 16 bp, H. sapiens
ccagtcactcaggagg

SEQ ID NO: 75401 - DNA, 16 bp, H. sapiens
ccagtcagaatggcta

SEQ ID NO: 75402 - DNA, 16 bp, H. sapiens
ccagtcagagtcccaa

SEQ ID NO: 75403 - DNA, 16 bp, H. sapiens
ccagtcagtggagcag

SEQ ID NO: 75404 - DNA, 16 bp, H. sapiens
ccagtcatggctaaaa

SEQ ID NO: 75405 - DNA, 16 bp, H. sapiens
ccagtcattaaaacat

SEQ ID NO: 75406 - DNA, 17 bp, H. sapiens
ccagtcattagcattgt

SEQ ID NO: 75407 - DNA, 16 bp, H. sapiens
ccagtcattttatttt

SEQ ID NO: 75408 - DNA, 16 bp, H. sapiens
ccagtccaagtcccca

SEQ ID NO: 75409 - DNA, 16 bp, H. sapiens
ccagtccaccaactca

SEQ ID NO: 75410 - DNA, 16 bp, H. sapiens
ccagtccactccactc

SEQ ID NO: 75411 - DNA, 16 bp, H. sapiens
ccagtccactccagcc

SEQ ID NO: 75412 - DNA, 16 bp, H. sapiens
ccagtccaggcaacag

SEQ ID NO: 75413 - DNA, 16 bp, H. sapiens
ccagtcccagccctgc

SEQ ID NO: 75414 - DNA, 16 bp, H. sapiens
ccagtccctggcagcc

SEQ ID NO: 75415 - DNA, 16 bp, H. sapiens
ccagtccctggtgcca

SEQ ID NO: 75416 - DNA, 16 bp, H. sapiens
ccagtccctggtgcta

SEQ ID NO: 75417 - DNA, 16 bp, H. sapiens
ccagtccgtgtctttt

SEQ ID NO: 75418 - DNA, 16 bp, H. sapiens
ccagtcctatcagatt

SEQ ID NO: 75419 - DNA, 16 bp, H. sapiens
ccagtcctggcaacat

SEQ ID NO: 75420 - DNA, 16 bp, H. sapiens
ccagtctatatatttt

SEQ ID NO: 75421 - DNA, 16 bp, H. sapiens
ccagtctcaagtgatc

SEQ ID NO: 75422 - DNA, 16 bp, H. sapiens
ccagtctcagaaaaaa

SEQ ID NO: 75423 - DNA, 16 bp, H. sapiens
ccagtctcaggtgatc

SEQ ID NO: 75424 - DNA, 16 bp, H. sapiens
ccagtctcatgttgaa

SEQ ID NO: 75425 - DNA, 16 bp, H. sapiens
ccagtctccagagctg

SEQ ID NO: 75426 - DNA, 16 bp, H. sapiens
ccagtctctacaaaaa

SEQ ID NO: 75427 - DNA, 16 bp, H. sapiens
ccagtctctgcctcca

SEQ ID NO: 75428 - DNA, 16 bp, H. sapiens
ccagtctctgcctccg

SEQ ID NO: 75429 - DNA, 16 bp, H. sapiens
ccagtctgaccaacat

SEQ ID NO: 75430 - DNA, 16 bp, H. sapiens
ccagtctgagtgacag

SEQ ID NO: 75431 - DNA, 16 bp, H. sapiens
ccagtctggatgacag

SEQ ID NO: 75432 - DNA, 16 bp, H. sapiens
ccagtctggccaaaat

SEQ ID NO: 75433 - DNA, 16 bp, H. sapiens
ccagtctggccaacat

SEQ ID NO: 75434 - DNA, 16 bp, H. sapiens
ccagtctggccaatgt

SEQ ID NO: 75435 - DNA, 16 bp, H. sapiens
ccagtctggccagcat

SEQ ID NO: 75436 - DNA, 16 bp, H. sapiens
ccagtctggccgacat

SEQ ID NO: 75437 - DNA, 16 bp, H. sapiens
ccagtctgggcaacaa

SEQ ID NO: 75438 - DNA, 16 bp, H. sapiens
ccagtctgggcgacag

SEQ ID NO: 75439 - DNA, 16 bp, H. sapiens
ccagtctgggtaacat

SEQ ID NO: 75440 - DNA, 16 bp, H. sapiens
ccagtctgtggcccag

SEQ ID NO: 75441 - DNA, 16 bp, H. sapiens
ccagtgaaacagaaca

SEQ ID NO: 75442 - DNA, 16 bp, H. sapiens
ccagtgaaactactga

SEQ ID NO: 75443 - DNA, 16 bp, H. sapiens
ccagtgaaagcagctg

SEQ ID NO: 75444 - DNA, 16 bp, H. sapiens
ccagtgaagatgagca

SEQ ID NO: 75445 - DNA, 16 bp, H. sapiens
ccagtgactggtgtcc

SEQ ID NO: 75446 - DNA, 16 bp, H. sapiens
ccagtgagaccaacac

SEQ ID NO: 75447 - DNA, 16 bp, H. sapiens
ccagtgagcatttctt

SEQ ID NO: 75448 - DNA, 18 bp, H. sapiens
ccagtgagccgagatcgt

SEQ ID NO: 75449 - DNA, 16 bp, H. sapiens
ccagtgagcttggaag

SEQ ID NO: 75450 - DNA, 16 bp, H. sapiens
ccagtgaggccccacc

SEQ ID NO: 75451 - DNA, 16 bp, H. sapiens
ccagtgagtggcagag

SEQ ID NO: 75452 - DNA, 16 bp, H. sapiens
ccagtgagttgggagt

SEQ ID NO: 75453 - DNA, 16 bp, H. sapiens
ccagtgatccttccac

SEQ ID NO: 75454 - DNA, 16 bp, H. sapiens
ccagtgatgaagagca

SEQ ID NO: 75455 - DNA, 16 bp, H. sapiens
ccagtgatgatgaaca

SEQ ID NO: 75456 - DNA, 16 bp, H. sapiens
ccagtgatgatgacca

SEQ ID NO: 75457 - DNA, 16 bp, H. sapiens
ccagtgatgatgagct

SEQ ID NO: 75458 - DNA, 16 bp, H. sapiens
ccagtgattctgatgc

SEQ ID NO: 75459 - DNA, 16 bp, H. sapiens
ccagtgcactcaagcc

SEQ ID NO: 75460 - DNA, 16 bp, H. sapiens
ccagtgcactgcagcc

SEQ ID NO: 75461 - DNA, 16 bp, H. sapiens
ccagtgcagtccagcc

SEQ ID NO: 75462 - DNA, 16 bp, H. sapiens
ccagtgcatgcagccc

SEQ ID NO: 75463 - DNA, 16 bp, H. sapiens
ccagtgccacactgtt

SEQ ID NO: 75464 - DNA, 16 bp, H. sapiens
ccagtgcccctcacca

SEQ ID NO: 75465 - DNA, 16 bp, H. sapiens
ccagtgccctccagcc

SEQ ID NO: 75466 - DNA, 16 bp, H. sapiens
ccagtgcctcagtttc

SEQ ID NO: 75467 - DNA, 16 bp, H. sapiens
ccagtgcctggaacag

SEQ ID NO: 75468 - DNA, 16 bp, H. sapiens
ccagtgcctgggaagg

SEQ ID NO: 75469 - DNA, 16 bp, H. sapiens
ccagtgcctgttgttt

SEQ ID NO: 75470 - DNA, 16 bp, H. sapiens
ccagtgcgctccagcc

SEQ ID NO: 75471 - DNA, 16 bp, H. sapiens
ccagtgctctccagcc

SEQ ID NO: 75472 - DNA, 16 bp, H. sapiens
ccagtgctggaagtgg

SEQ ID NO: 75473 - DNA, 16 bp, H. sapiens
ccagtgctggaggagg

SEQ ID NO: 75474 - DNA, 16 bp, H. sapiens
ccagtgctggatgctt

SEQ ID NO: 75475 - DNA, 16 bp, H. sapiens
ccagtgctggctgctg

SEQ ID NO: 75476 - DNA, 16 bp, H. sapiens
ccagtgctgtgctggc

SEQ ID NO: 75477 - DNA, 16 bp, H. sapiens
ccagtgctttgggaaa

SEQ ID NO: 75478 - DNA, 16 bp, H. sapiens
ccagtggaggcagcag

SEQ ID NO: 75479 - DNA, 16 bp, H. sapiens
ccagtggaggtggtgg

SEQ ID NO: 75480 - DNA, 16 bp, H. sapiens
ccagtggcacaatctc

SEQ ID NO: 75481 - DNA, 16 bp, H. sapiens
ccagtggcacctggaa

SEQ ID NO: 75482 - DNA, 16 bp, H. sapiens
ccagtgggaatgtaaa

SEQ ID NO: 75483 - DNA, 16 bp, H. sapiens
ccagtgggacaggatg

SEQ ID NO: 75484 - DNA, 16 bp, H. sapiens
ccagtggggaaaaaaa

SEQ ID NO: 75485 - DNA, 16 bp, H. sapiens
ccagtgggtccctgac

SEQ ID NO: 75486 - DNA, 16 bp, H. sapiens
ccagtgggtttttttt

SEQ ID NO: 75487 - DNA, 16 bp, H. sapiens
ccagtggtggcagcag

SEQ ID NO: 75488 - DNA, 16 bp, H. sapiens
ccagtggttcatgcct

SEQ ID NO: 75489 - DNA, 16 bp, H. sapiens
ccagtggttctcaaag

SEQ ID NO: 75490 - DNA, 16 bp, H. sapiens
ccagtggtttgctggg

SEQ ID NO: 75491 - DNA, 16 bp, H. sapiens
ccagtgtcaaccagga

SEQ ID NO: 75492 - DNA, 16 bp, H. sapiens
ccagtgtcctggagag

SEQ ID NO: 75493 - DNA, 16 bp, H. sapiens
ccagtgtctgggaaga

SEQ ID NO: 75494 - DNA, 17 bp, H. sapiens
ccagtgtgagcaacaca

SEQ ID NO: 75495 - DNA, 16 bp, H. sapiens
ccagtgtgcccagcca

SEQ ID NO: 75496 - DNA, 16 bp, H. sapiens
ccagtgtgcccaggat

SEQ ID NO: 75497 - DNA, 16 bp, H. sapiens
ccagtgtggcaaaacc

SEQ ID NO: 75498 - DNA, 16 bp, H. sapiens
ccagtgtggctgcagc

SEQ ID NO: 75499 - DNA, 16 bp, H. sapiens
ccagtgtggctggaga

SEQ ID NO: 75500 - DNA, 18 bp, H. sapiens
ccagtgtgtgatgttccc

SEQ ID NO: 75501 - DNA, 16 bp, H. sapiens
ccagtgtgtggtgttc

SEQ ID NO: 75502 - DNA, 16 bp, H. sapiens
ccagtgttgagtgcat

SEQ ID NO: 75503 - DNA, 16 bp, H. sapiens
ccagtgttggaagtgg

SEQ ID NO: 75504 - DNA, 16 bp, H. sapiens
ccagtgttggagctgg

SEQ ID NO: 75505 - DNA, 16 bp, H. sapiens
ccagtgttggagttgg

SEQ ID NO: 75506 - DNA, 16 bp, H. sapiens
ccagtgtttcccaaac

SEQ ID NO: 75507 - DNA, 16 bp, H. sapiens
ccagtgtttctcaaag

SEQ ID NO: 75508 - DNA, 16 bp, H. sapiens
ccagttaatttttaaa

SEQ ID NO: 75509 - DNA, 16 bp, H. sapiens
ccagttagaatggtga

SEQ ID NO: 75510 - DNA, 17 bp, H. sapiens
ccagttcaagtgattct

SEQ ID NO: 75511 - DNA, 16 bp, H. sapiens
ccagttcactctgatg

SEQ ID NO: 75512 - DNA, 16 bp, H. sapiens
ccagttccaaagttgc

SEQ ID NO: 75513 - DNA, 16 bp, H. sapiens
ccagttccaaatttgc

SEQ ID NO: 75514 - DNA, 16 bp, H. sapiens
ccagttccagccatgt

SEQ ID NO: 75515 - DNA, 16 bp, H. sapiens
ccagttctcagatctc

SEQ ID NO: 75516 - DNA, 16 bp, H. sapiens
ccagttctcagggaga

SEQ ID NO: 75517 - DNA, 16 bp, H. sapiens
ccagttggctgtaagt

SEQ ID NO: 75518 - DNA, 16 bp, H. sapiens
ccagttgtgacagcca

SEQ ID NO: 75519 - DNA, 16 bp, H. sapiens
ccagtttacagaccca

SEQ ID NO: 75520 - DNA, 16 bp, H. sapiens
ccagtttacaggaaat

SEQ ID NO: 75521 - DNA, 16 bp, H. sapiens
ccagtttacagtccca

SEQ ID NO: 75522 - DNA, 16 bp, H. sapiens
ccagtttatggcattt

SEQ ID NO: 75523 - DNA, 16 bp, H. sapiens
ccagtttcaggtgttt

SEQ ID NO: 75524 - DNA, 16 bp, H. sapiens
ccagtttccttcttct

SEQ ID NO: 75525 - DNA, 16 bp, H. sapiens
ccagtttctcattaag

SEQ ID NO: 75526 - DNA, 16 bp, H. sapiens
ccagtttctctacatc

SEQ ID NO: 75527 - DNA, 16 bp, H. sapiens
ccagtttcttttcttt

SEQ ID NO: 75528 - DNA, 16 bp, H. sapiens
ccagtttgcacaggga

SEQ ID NO: 75529 - DNA, 16 bp, H. sapiens
ccagtttgcagatggc

SEQ ID NO: 75530 - DNA, 16 bp, H. sapiens
ccagtttgccagcagc

SEQ ID NO: 75531 - DNA, 16 bp, H. sapiens
ccagtttgggtgacag

SEQ ID NO: 75532 - DNA, 16 bp, H. sapiens
ccagtttgtggtactt

SEQ ID NO: 75533 - DNA, 16 bp, H. sapiens
ccagttttagttttct

SEQ ID NO: 75534 - DNA, 16 bp, H. sapiens
ccagttttccaaagtg

SEQ ID NO: 75535 - DNA, 16 bp, H. sapiens
ccagttttccaaggga

SEQ ID NO: 75536 - DNA, 16 bp, H. sapiens
ccagttttgttctttt

SEQ ID NO: 75537 - DNA, 16 bp, H. sapiens
ccagttttgtttcctt

SEQ ID NO: 75538 - DNA, 16 bp, H. sapiens
ccagttttgttttgtt

SEQ ID NO: 75539 - DNA, 16 bp, H. sapiens
ccagtttttccaacat

SEQ ID NO: 75540 - DNA, 16 bp, H. sapiens
ccagtttttcccttcc

SEQ ID NO: 75541 - DNA, 16 bp, H. sapiens
ccagtttttgcccttt

SEQ ID NO: 75542 - DNA, 16 bp, H. sapiens
ccagtttttgcgcatt

SEQ ID NO: 75543 - DNA, 17 bp, H. sapiens
ccagtttttggacaggt

SEQ ID NO: 75544 - DNA, 16 bp, H. sapiens
ccagttttttaaaaaa

SEQ ID NO: 75545 - DNA, 16 bp, H. sapiens
ccataaaaaatgaaat

SEQ ID NO: 75546 - DNA, 16 bp, H. sapiens
ccataaaaacccaaga

SEQ ID NO: 75547 - DNA, 16 bp, H. sapiens
ccataaaaaggaagaa

SEQ ID NO: 75548 - DNA, 16 bp, H. sapiens
ccataaaaccattttt

SEQ ID NO: 75549 - DNA, 16 bp, H. sapiens
ccataaaagccccaga

SEQ ID NO: 75550 - DNA, 16 bp, H. sapiens
ccataaagaagaataa

SEQ ID NO: 75551 - DNA, 16 bp, H. sapiens
ccataaataaagtttt

SEQ ID NO: 75552 - DNA, 16 bp, H. sapiens
ccataaatatgtacaa

SEQ ID NO: 75553 - DNA, 16 bp, H. sapiens
ccataaattgggtggc

SEQ ID NO: 75554 - DNA, 16 bp, H. sapiens
ccataagccttggtgg

SEQ ID NO: 75555 - DNA, 16 bp, H. sapiens
ccataaggactgcaat

SEQ ID NO: 75556 - DNA, 16 bp, H. sapiens
ccataatcatgtgagc

SEQ ID NO: 75557 - DNA, 16 bp, H. sapiens
ccataatgtgagtggg

SEQ ID NO: 75558 - DNA, 16 bp, H. sapiens
ccataatttaaaaatc

SEQ ID NO: 75559 - DNA, 16 bp, H. sapiens
ccatacacagaagaat

SEQ ID NO: 75560 - DNA, 16 bp, H. sapiens
ccatacccagaaggaa

SEQ ID NO: 75561 - DNA, 16 bp, H. sapiens
ccatactcttctcatg

SEQ ID NO: 75562 - DNA, 16 bp, H. sapiens
ccatactgttttctgt

SEQ ID NO: 75563 - DNA, 16 bp, H. sapiens
ccatagacacagaaag

SEQ ID NO: 75564 - DNA, 16 bp, H. sapiens
ccatagattagttttg

SEQ ID NO: 75565 - DNA, 16 bp, H. sapiens
ccatagctttcatcag

SEQ ID NO: 75566 - DNA, 16 bp, H. sapiens
ccataggcctcaaatc

SEQ ID NO: 75567 - DNA, 16 bp, H. sapiens
ccataggctgcagaat

SEQ ID NO: 75568 - DNA, 16 bp, H. sapiens
ccataggttttgatat

SEQ ID NO: 75569 - DNA, 16 bp, H. sapiens
ccataggttttggtgt

SEQ ID NO: 75570 - DNA, 16 bp, H. sapiens
ccatataaacttcaga

SEQ ID NO: 75571 - DNA, 16 bp, H. sapiens
ccatataattcaccca

SEQ ID NO: 75572 - DNA, 16 bp, H. sapiens
ccatatatgtatatat

SEQ ID NO: 75573 - DNA, 16 bp, H. sapiens
ccatatcagctcactg

SEQ ID NO: 75574 - DNA, 16 bp, H. sapiens
ccatatctagaaaacc

SEQ ID NO: 75575 - DNA, 16 bp, H. sapiens
ccatatgaaatgtgaa

SEQ ID NO: 75576 - DNA, 16 bp, H. sapiens
ccatatgctgaagaat

SEQ ID NO: 75577 - DNA, 16 bp, H. sapiens
ccatattattttgaag

SEQ ID NO: 75578 - DNA, 16 bp, H. sapiens
ccatattcacctgcct

SEQ ID NO: 75579 - DNA, 16 bp, H. sapiens
ccatattggaagaaga

SEQ ID NO: 75580 - DNA, 16 bp, H. sapiens
ccatattggtcaggcc

SEQ ID NO: 75581 - DNA, 16 bp, H. sapiens
ccatattttcttaatc

SEQ ID NO: 75582 - DNA, 16 bp, H. sapiens
ccatatttttgcaact

SEQ ID NO: 75583 - DNA, 16 bp, H. sapiens
ccatcaaaagaaagtt

SEQ ID NO: 75584 - DNA, 16 bp, H. sapiens
ccatcaaaatcccaat

SEQ ID NO: 75585 - DNA, 16 bp, H. sapiens
ccatcaaaatgaagtt

SEQ ID NO: 75586 - DNA, 16 bp, H. sapiens
ccatcaaactaccatt

SEQ ID NO: 75587 - DNA, 16 bp, H. sapiens
ccatcaacagtgtata

SEQ ID NO: 75588 - DNA, 16 bp, H. sapiens
ccatcaacagttgaat

SEQ ID NO: 75589 - DNA, 16 bp, H. sapiens
ccatcaactccaccat

SEQ ID NO: 75590 - DNA, 16 bp, H. sapiens
ccatcaagccctttta

SEQ ID NO: 75591 - DNA, 16 bp, H. sapiens
ccatcaagcctgaaac

SEQ ID NO: 75592 - DNA, 16 bp, H. sapiens
ccatcaaggaaatgca

SEQ ID NO: 75593 - DNA, 16 bp, H. sapiens
ccatcaaggctaggaa

SEQ ID NO: 75594 - DNA, 16 bp, H. sapiens
ccatcaatgatagact

SEQ ID NO: 75595 - DNA, 16 bp, H. sapiens
ccatcacacccaacta

SEQ ID NO: 75596 - DNA, 16 bp, H. sapiens
ccatcacacccagcaa

SEQ ID NO: 75597 - DNA, 16 bp, H. sapiens
ccatcacactccagcc

SEQ ID NO: 75598 - DNA, 16 bp, H. sapiens
ccatcacagatgccga

SEQ ID NO: 75599 - DNA, 16 bp, H. sapiens
ccatcacagctgggaa

SEQ ID NO: 75600 - DNA, 16 bp, H. sapiens
ccatcacatcccctgt

SEQ ID NO: 75601 - DNA, 16 bp, H. sapiens
ccatcacatctggcta

SEQ ID NO: 75602 - DNA, 16 bp, H. sapiens
ccatcaccaacaccat

SEQ ID NO: 75603 - DNA, 16 bp, H. sapiens
ccatcaccaccatcaa

SEQ ID NO: 75604 - DNA, 16 bp, H. sapiens
ccatcaccactaccat

SEQ ID NO: 75605 - DNA, 16 bp, H. sapiens
ccatcaccactgtcca

SEQ ID NO: 75606 - DNA, 16 bp, H. sapiens
ccatcaccatcaccat

SEQ ID NO: 75607 - DNA, 16 bp, H. sapiens
ccatcaccatcatcca

SEQ ID NO: 75608 - DNA, 16 bp, H. sapiens
ccatcaccatgcccag

SEQ ID NO: 75609 - DNA, 16 bp, H. sapiens
ccatcacccaggcagt

SEQ ID NO: 75610 - DNA, 16 bp, H. sapiens
ccatcacctccagatg

SEQ ID NO: 75611 - DNA, 16 bp, H. sapiens
ccatcacgcccggcta

SEQ ID NO: 75612 - DNA, 16 bp, H. sapiens
ccatcactactaaaaa

SEQ ID NO: 75613 - DNA, 16 bp, H. sapiens
ccatcactgccaccac

SEQ ID NO: 75614 - DNA, 16 bp, H. sapiens
ccatcacttctgctgt

SEQ ID NO: 75615 - DNA, 16 bp, H. sapiens
ccatcagaaggaagcc

SEQ ID NO: 75616 - DNA, 16 bp, H. sapiens
ccatcagaagttgaca

SEQ ID NO: 75617 - DNA, 16 bp, H. sapiens
ccatcagacctcatga

SEQ ID NO: 75618 - DNA, 16 bp, H. sapiens
ccatcagatctcatca

SEQ ID NO: 75619 - DNA, 16 bp, H. sapiens
ccatcagatcttgtga

SEQ ID NO: 75620 - DNA, 16 bp, H. sapiens
ccatcagcaccatcca

SEQ ID NO: 75621 - DNA, 16 bp, H. sapiens
ccatcagctctcatga

SEQ ID NO: 75622 - DNA, 16 bp, H. sapiens
ccatcaggcctgccct

SEQ ID NO: 75623 - DNA, 16 bp, H. sapiens
ccatcaggtgggggtg

SEQ ID NO: 75624 - DNA, 16 bp, H. sapiens
ccatcaggttctgggc

SEQ ID NO: 75625 - DNA, 16 bp, H. sapiens
ccatcagtcaatgaat

SEQ ID NO: 75626 - DNA, 16 bp, H. sapiens
ccatcagtctatgtgt

SEQ ID NO: 75627 - DNA, 16 bp, H. sapiens
ccatcatatcattctt

SEQ ID NO: 75628 - DNA, 16 bp, H. sapiens
ccatcatcaaagacca

SEQ ID NO: 75629 - DNA, 16 bp, H. sapiens
ccatcatcaccatcaa

SEQ ID NO: 75630 - DNA, 16 bp, H. sapiens
ccatcatcagcatcac

SEQ ID NO: 75631 - DNA, 16 bp, H. sapiens
ccatcatcatcaccat

SEQ ID NO: 75632 - DNA, 16 bp, H. sapiens
ccatcatcatctccat

SEQ ID NO: 75633 - DNA, 19 bp, H. sapiens
ccatcatcctgataccaaa

SEQ ID NO: 75634 - DNA, 16 bp, H. sapiens
ccatcatctcagtcca

SEQ ID NO: 75635 - DNA, 16 bp, H. sapiens
ccatcatctcttgcct

SEQ ID NO: 75636 - DNA, 16 bp, H. sapiens
ccatcatctcttgctt

SEQ ID NO: 75637 - DNA, 16 bp, H. sapiens
ccatcatcttagccca

SEQ ID NO: 75638 - DNA, 16 bp, H. sapiens
ccatcatgaattaatt

SEQ ID NO: 75639 - DNA, 16 bp, H. sapiens
ccatcatgactgtaag

SEQ ID NO: 75640 - DNA, 16 bp, H. sapiens
ccatcatgccagctgc

SEQ ID NO: 75641 - DNA, 16 bp, H. sapiens
ccatcatgcctggcct

SEQ ID NO: 75642 - DNA, 16 bp, H. sapiens
ccatcatgctggctgc

SEQ ID NO: 75643 - DNA, 16 bp, H. sapiens
ccatcatggagaacct

SEQ ID NO: 75644 - DNA, 16 bp, H. sapiens
ccatcatggcctgaac

SEQ ID NO: 75645 - DNA, 16 bp, H. sapiens
ccatcattattatcat

SEQ ID NO: 75646 - DNA, 16 bp, H. sapiens
ccatcattctctgcaa

SEQ ID NO: 75647 - DNA, 16 bp, H. sapiens
ccatcattgtgctgta

SEQ ID NO: 75648 - DNA, 16 bp, H. sapiens
ccatccaacagcaaca

SEQ ID NO: 75649 - DNA, 16 bp, H. sapiens
ccatccaacagcagca

SEQ ID NO: 75650 - DNA, 16 bp, H. sapiens
ccatccaaccatccaa

SEQ ID NO: 75651 - DNA, 16 bp, H. sapiens
ccatccacctcggctt

SEQ ID NO: 75652 - DNA, 16 bp, H. sapiens
ccatccacctctgcct

SEQ ID NO: 75653 - DNA, 16 bp, H. sapiens
ccatccacctgcctca

SEQ ID NO: 75654 - DNA, 16 bp, H. sapiens
ccatccactcatccat

SEQ ID NO: 75655 - DNA, 16 bp, H. sapiens
ccatccagaaaaacat

SEQ ID NO: 75656 - DNA, 16 bp, H. sapiens
ccatccagcctccctg

SEQ ID NO: 75657 - DNA, 16 bp, H. sapiens
ccatccagcctgggca

SEQ ID NO: 75658 - DNA, 16 bp, H. sapiens
ccatccagctcctcct

SEQ ID NO: 75659 - DNA, 16 bp, H. sapiens
ccatccagctttgctc

SEQ ID NO: 75660 - DNA, 16 bp, H. sapiens
ccatccaggacaccac

SEQ ID NO: 75661 - DNA, 16 bp, H. sapiens
ccatccagtcctggac

SEQ ID NO: 75662 - DNA, 16 bp, H. sapiens
ccatccatcacccatc

SEQ ID NO: 75663 - DNA, 16 bp, H. sapiens
ccatccatccatccgt

SEQ ID NO: 75664 - DNA, 16 bp, H. sapiens
ccatccatccatttat

SEQ ID NO: 75665 - DNA, 16 bp, H. sapiens
ccatccatgtccctgc

SEQ ID NO: 75666 - DNA, 16 bp, H. sapiens
ccatcccacatgctct

SEQ ID NO: 75667 - DNA, 16 bp, H. sapiens
ccatcccactccagcc

SEQ ID NO: 75668 - DNA, 16 bp, H. sapiens
ccatcccagcctccca

SEQ ID NO: 75669 - DNA, 16 bp, H. sapiens
ccatccccactgccac

SEQ ID NO: 75670 - DNA, 16 bp, H. sapiens
ccatccccatcaaggt

SEQ ID NO: 75671 - DNA, 16 bp, H. sapiens
ccatccccatccagct

SEQ ID NO: 75672 - DNA, 16 bp, H. sapiens
ccatcccccacagtgg

SEQ ID NO: 75673 - DNA, 16 bp, H. sapiens
ccatcccccagcctga

SEQ ID NO: 75674 - DNA, 16 bp, H. sapiens
ccatcccccaggctgg

SEQ ID NO: 75675 - DNA, 16 bp, H. sapiens
ccatccccctcctcag

SEQ ID NO: 75676 - DNA, 16 bp, H. sapiens
ccatcccccttctggc

SEQ ID NO: 75677 - DNA, 16 bp, H. sapiens
ccatccccttgatgct

SEQ ID NO: 75678 - DNA, 16 bp, H. sapiens
ccatccctacagaaaa

SEQ ID NO: 75679 - DNA, 16 bp, H. sapiens
ccatccctccattcat

SEQ ID NO: 75680 - DNA, 16 bp, H. sapiens
ccatcctcagcctccc

SEQ ID NO: 75681 - DNA, 16 bp, H. sapiens
ccatcctcctcagcct

SEQ ID NO: 75682 - DNA, 16 bp, H. sapiens
ccatcctcctgcctcc

SEQ ID NO: 75683 - DNA, 16 bp, H. sapiens
ccatcctcctgcttca

SEQ ID NO: 75684 - DNA, 16 bp, H. sapiens
ccatcctctggcacac

SEQ ID NO: 75685 - DNA, 16 bp, H. sapiens
ccatcctcttggtgct

SEQ ID NO: 75686 - DNA, 16 bp, H. sapiens
ccatcctggacaacag

SEQ ID NO: 75687 - DNA, 16 bp, H. sapiens
ccatcctggccaactt

SEQ ID NO: 75688 - DNA, 16 bp, H. sapiens
ccatcctggcctccca

SEQ ID NO: 75689 - DNA, 16 bp, H. sapiens
ccatcctggctaacaa

SEQ ID NO: 75690 - DNA, 16 bp, H. sapiens
ccatcctggctatcat

SEQ ID NO: 75691 - DNA, 17 bp, H. sapiens
ccatcctggctgacatg

SEQ ID NO: 75692 - DNA, 16 bp, H. sapiens
ccatcctgggcaatgt

SEQ ID NO: 75693 - DNA, 16 bp, H. sapiens
ccatcctgggcagcag

SEQ ID NO: 75694 - DNA, 16 bp, H. sapiens
ccatcctgggctgcat

SEQ ID NO: 75695 - DNA, 16 bp, H. sapiens
ccatcctggtcaacac

SEQ ID NO: 75696 - DNA, 16 bp, H. sapiens
ccatcctggtgaaacc

SEQ ID NO: 75697 - DNA, 16 bp, H. sapiens
ccatcctgttctcatg

SEQ ID NO: 75698 - DNA, 16 bp, H. sapiens
ccatcctgttttccat

SEQ ID NO: 75699 - DNA, 16 bp, H. sapiens
ccatccttctgcctca

SEQ ID NO: 75700 - DNA, 16 bp, H. sapiens
ccatctaactgtattt

SEQ ID NO: 75701 - DNA, 16 bp, H. sapiens
ccatctacaaaatggg

SEQ ID NO: 75702 - DNA, 16 bp, H. sapiens
ccatctacaagccaga

SEQ ID NO: 75703 - DNA, 16 bp, H. sapiens
ccatctatccatccat

SEQ ID NO: 75704 - DNA, 16 bp, H. sapiens
ccatctatgacaagcc

SEQ ID NO: 75705 - DNA, 16 bp, H. sapiens
ccatctcaaaaacaac

SEQ ID NO: 75706 - DNA, 16 bp, H. sapiens
ccatctcaaaaagcaa

SEQ ID NO: 75707 - DNA, 16 bp, H. sapiens
ccatctcaaagaacaa

SEQ ID NO: 75708 - DNA, 16 bp, H. sapiens
ccatctcaaagagaaa

SEQ ID NO: 75709 - DNA, 16 bp, H. sapiens
ccatctcaagggaaaa

SEQ ID NO: 75710 - DNA, 16 bp, H. sapiens
ccatctcacacacaaa

SEQ ID NO: 75711 - DNA, 16 bp, H. sapiens
ccatctcagagaaaaa

SEQ ID NO: 75712 - DNA, 16 bp, H. sapiens
ccatctcagcccactg

SEQ ID NO: 75713 - DNA, 16 bp, H. sapiens
ccatctcagctttcca

SEQ ID NO: 75714 - DNA, 16 bp, H. sapiens
ccatctcatcctctgt

SEQ ID NO: 75715 - DNA, 16 bp, H. sapiens
ccatctccaaaaaaat

SEQ ID NO: 75716 - DNA, 16 bp, H. sapiens
ccatctccaaaaagaa

SEQ ID NO: 75717 - DNA, 16 bp, H. sapiens
ccatctccacagaaaa

SEQ ID NO: 75718 - DNA, 16 bp, H. sapiens
ccatctccaccatcac

SEQ ID NO: 75719 - DNA, 16 bp, H. sapiens
ccatctccagcattgg

SEQ ID NO: 75720 - DNA, 16 bp, H. sapiens
ccatctccatagtttt

SEQ ID NO: 75721 - DNA, 16 bp, H. sapiens
ccatctcccaggctca

SEQ ID NO: 75722 - DNA, 16 bp, H. sapiens
ccatctcctccctgcc

SEQ ID NO: 75723 - DNA, 16 bp, H. sapiens
ccatctcctcctgccc

SEQ ID NO: 75724 - DNA, 16 bp, H. sapiens
ccatctcctggattca

SEQ ID NO: 75725 - DNA, 16 bp, H. sapiens
ccatctcctggctgga

SEQ ID NO: 75726 - DNA, 16 bp, H. sapiens
ccatctcctggcttca

SEQ ID NO: 75727 - DNA, 16 bp, H. sapiens
ccatctcgaaaaagaa

SEQ ID NO: 75728 - DNA, 16 bp, H. sapiens
ccatctcggatcactg

SEQ ID NO: 75729 - DNA, 16 bp, H. sapiens
ccatctctaacaaaaa

SEQ ID NO: 75730 - DNA, 16 bp, H. sapiens
ccatctctaataataa

SEQ ID NO: 75731 - DNA, 17 bp, H. sapiens
ccatctctacaaaaagt

SEQ ID NO: 75732 - DNA, 16 bp, H. sapiens
ccatctctacaaaaca

SEQ ID NO: 75733 - DNA, 16 bp, H. sapiens
ccatctctacaagaaa

SEQ ID NO: 75734 - DNA, 16 bp, H. sapiens
ccatctctacagaaaa

SEQ ID NO: 75735 - DNA, 16 bp, H. sapiens
ccatctctacccaaaa

SEQ ID NO: 75736 - DNA, 16 bp, H. sapiens
ccatctctactgaaaa

SEQ ID NO: 75737 - DNA, 16 bp, H. sapiens
ccatctctcaggctca

SEQ ID NO: 75738 - DNA, 16 bp, H. sapiens
ccatctctctctgtct

SEQ ID NO: 75739 - DNA, 16 bp, H. sapiens
ccatctctcttaaaaa

SEQ ID NO: 75740 - DNA, 16 bp, H. sapiens
ccatctctgcctccat

SEQ ID NO: 75741 - DNA, 16 bp, H. sapiens
ccatctctgcctccca

SEQ ID NO: 75742 - DNA, 16 bp, H. sapiens
ccatctctgctaaaat

SEQ ID NO: 75743 - DNA, 16 bp, H. sapiens
ccatctctggaaaaaa

SEQ ID NO: 75744 - DNA, 16 bp, H. sapiens
ccatctctgggcctca

SEQ ID NO: 75745 - DNA, 16 bp, H. sapiens
ccatctctgtctccct

SEQ ID NO: 75746 - DNA, 16 bp, H. sapiens
ccatctctgtctctct

SEQ ID NO: 75747 - DNA, 16 bp, H. sapiens
ccatctcttagaaaaa

SEQ ID NO: 75748 - DNA, 16 bp, H. sapiens
ccatctcttgaaaaaa

SEQ ID NO: 75749 - DNA, 16 bp, H. sapiens
ccatctctttgaaatg

SEQ ID NO: 75750 - DNA, 16 bp, H. sapiens
ccatctgacaaagggc

SEQ ID NO: 75751 - DNA, 29 bp, H. sapiens
ccatctgacaaagggctaatatccagaat

SEQ ID NO: 75752 - DNA, 16 bp, H. sapiens
ccatctgagctctgcc

SEQ ID NO: 75753 - DNA, 16 bp, H. sapiens
ccatctgaggtaccag

SEQ ID NO: 75754 - DNA, 16 bp, H. sapiens
ccatctgccatccatt

SEQ ID NO: 75755 - DNA, 16 bp, H. sapiens
ccatctgctcctggac

SEQ ID NO: 75756 - DNA, 16 bp, H. sapiens
ccatctggaggtgatg

SEQ ID NO: 75757 - DNA, 16 bp, H. sapiens
ccatctggccaggctg

SEQ ID NO: 75758 - DNA, 16 bp, H. sapiens
ccatctgggactttca

SEQ ID NO: 75759 - DNA, 16 bp, H. sapiens
ccatctgtaaaaaaaa

SEQ ID NO: 75760 - DNA, 16 bp, H. sapiens
ccatctgtatatcctc

SEQ ID NO: 75761 - DNA, 16 bp, H. sapiens
ccatctgtctgtccat

SEQ ID NO: 75762 - DNA, 16 bp, H. sapiens
ccatctgtctgtctat

SEQ ID NO: 75763 - DNA, 16 bp, H. sapiens
ccatctgtgtatcttt

SEQ ID NO: 75764 - DNA, 17 bp, H. sapiens
ccatctgtgtgctgtat

SEQ ID NO: 75765 - DNA, 16 bp, H. sapiens
ccatctgttcttacat

SEQ ID NO: 75766 - DNA, 16 bp, H. sapiens
ccatctgttctttgtt

SEQ ID NO: 75767 - DNA, 16 bp, H. sapiens
ccatcttaaattaatt

SEQ ID NO: 75768 - DNA, 16 bp, H. sapiens
ccatcttaaccatttt

SEQ ID NO: 75769 - DNA, 16 bp, H. sapiens
ccatcttaattatttt

SEQ ID NO: 75770 - DNA, 16 bp, H. sapiens
ccatcttcaagaaaag

SEQ ID NO: 75771 - DNA, 16 bp, H. sapiens
ccatcttcatggatag

SEQ ID NO: 75772 - DNA, 16 bp, H. sapiens
ccatcttccagacccc

SEQ ID NO: 75773 - DNA, 16 bp, H. sapiens
ccatcttccagtaatt

SEQ ID NO: 75774 - DNA, 16 bp, H. sapiens
ccatcttcccagaatc

SEQ ID NO: 75775 - DNA, 16 bp, H. sapiens
ccatcttcctgggaca

SEQ ID NO: 75776 - DNA, 16 bp, H. sapiens
ccatcttctccctgtg

SEQ ID NO: 75777 - DNA, 16 bp, H. sapiens
ccatcttcttgctgtg

SEQ ID NO: 75778 - DNA, 16 bp, H. sapiens
ccatcttgaaaaacaa

SEQ ID NO: 75779 - DNA, 16 bp, H. sapiens
ccatcttgaacatgtc

SEQ ID NO: 75780 - DNA, 16 bp, H. sapiens
ccatcttggaagcaga

SEQ ID NO: 75781 - DNA, 16 bp, H. sapiens
ccatcttggccaggat

SEQ ID NO: 75782 - DNA, 16 bp, H. sapiens
ccatcttgggagcagc

SEQ ID NO: 75783 - DNA, 16 bp, H. sapiens
ccatcttgggctccca

SEQ ID NO: 75784 - DNA, 16 bp, H. sapiens
ccatcttggtggtttt

SEQ ID NO: 75785 - DNA, 16 bp, H. sapiens
ccatctttacaaaaca

SEQ ID NO: 75786 - DNA, 16 bp, H. sapiens
ccatctttaccaaaaa

SEQ ID NO: 75787 - DNA, 16 bp, H. sapiens
ccatctttatttaaaa

SEQ ID NO: 75788 - DNA, 16 bp, H. sapiens
ccatctttctgtctct

SEQ ID NO: 75789 - DNA, 16 bp, H. sapiens
ccatctttgtgctttt

SEQ ID NO: 75790 - DNA, 16 bp, H. sapiens
ccatctttgtggttgt

SEQ ID NO: 75791 - DNA, 16 bp, H. sapiens
ccatctttgtgttcat

SEQ ID NO: 75792 - DNA, 16 bp, H. sapiens
ccatcttttttaaaaa

SEQ ID NO: 75793 - DNA, 16 bp, H. sapiens
ccatgaaaaaggatga

SEQ ID NO: 75794 - DNA, 16 bp, H. sapiens
ccatgaaaaatacaaa

SEQ ID NO: 75795 - DNA, 16 bp, H. sapiens
ccatgaaaaatctgaa

SEQ ID NO: 75796 - DNA, 16 bp, H. sapiens
ccatgaaaccattctt

SEQ ID NO: 75797 - DNA, 16 bp, H. sapiens
ccatgaaactgtggca

SEQ ID NO: 75798 - DNA, 16 bp, H. sapiens
ccatgaaagtccaaaa

SEQ ID NO: 75799 - DNA, 16 bp, H. sapiens
ccatgaacaaagtggc

SEQ ID NO: 75800 - DNA, 16 bp, H. sapiens
ccatgaagaaaacaaa

SEQ ID NO: 75801 - DNA, 16 bp, H. sapiens
ccatgaagaaactgca

SEQ ID NO: 75802 - DNA, 16 bp, H. sapiens
ccatgaagaaagtgaa

SEQ ID NO: 75803 - DNA, 16 bp, H. sapiens
ccatgaagctggccct

SEQ ID NO: 75804 - DNA, 16 bp, H. sapiens
ccatgaaggcagagac

SEQ ID NO: 75805 - DNA, 16 bp, H. sapiens
ccatgaagggaggaaa

SEQ ID NO: 75806 - DNA, 16 bp, H. sapiens
ccatgaaggtctgcag

SEQ ID NO: 75807 - DNA, 16 bp, H. sapiens
ccatgacagtttacca

SEQ ID NO: 75808 - DNA, 16 bp, H. sapiens
ccatgactctggaggg

SEQ ID NO: 75809 - DNA, 16 bp, H. sapiens
ccatgagaagagggcc

SEQ ID NO: 75810 - DNA, 16 bp, H. sapiens
ccatgagacttgcttt

SEQ ID NO: 75811 - DNA, 16 bp, H. sapiens
ccatgagagcagagac

SEQ ID NO: 75812 - DNA, 17 bp, H. sapiens
ccatgagcatggaatgt

SEQ ID NO: 75813 - DNA, 18 bp, H. sapiens
ccatgagcatggaatgtt

SEQ ID NO: 75814 - DNA, 16 bp, H. sapiens
ccatgagccactgtgc

SEQ ID NO: 75815 - DNA, 16 bp, H. sapiens
ccatgagccagtcacc

SEQ ID NO: 75816 - DNA, 16 bp, H. sapiens
ccatgagggcagagcc

SEQ ID NO: 75817 - DNA, 16 bp, H. sapiens
ccatgagggtcctgcc

SEQ ID NO: 75818 - DNA, 16 bp, H. sapiens
ccatgagtgtgccact

SEQ ID NO: 75819 - DNA, 16 bp, H. sapiens
ccatgagtttgaggtt

SEQ ID NO: 75820 - DNA, 18 bp, H. sapiens
ccatgatcaaatgggctt

SEQ ID NO: 75821 - DNA, 16 bp, H. sapiens
ccatgatcccaaaaga

SEQ ID NO: 75822 - DNA, 16 bp, H. sapiens
ccatgatctaatcatc

SEQ ID NO: 75823 - DNA, 16 bp, H. sapiens
ccatgatctgccacag

SEQ ID NO: 75824 - DNA, 16 bp, H. sapiens
ccatgatgaaacccta

SEQ ID NO: 75825 - DNA, 16 bp, H. sapiens
ccatgatgacaatggc

SEQ ID NO: 75826 - DNA, 16 bp, H. sapiens
ccatgatgcccacctg

SEQ ID NO: 75827 - DNA, 16 bp, H. sapiens
ccatgatgcctccagc

SEQ ID NO: 75828 - DNA, 16 bp, H. sapiens
ccatgatggaaaggaa

SEQ ID NO: 75829 - DNA, 16 bp, H. sapiens
ccatgatgggaaggga

SEQ ID NO: 75830 - DNA, 16 bp, H. sapiens
ccatgatgttcttgtg

SEQ ID NO: 75831 - DNA, 16 bp, H. sapiens
ccatgattataagttt

SEQ ID NO: 75832 - DNA, 16 bp, H. sapiens
ccatgattcagttacc

SEQ ID NO: 75833 - DNA, 16 bp, H. sapiens
ccatgattgtaagttc

SEQ ID NO: 75834 - DNA, 16 bp, H. sapiens
ccatgattgtgaggct

SEQ ID NO: 75835 - DNA, 16 bp, H. sapiens
ccatgcaaataaaaac

SEQ ID NO: 75836 - DNA, 16 bp, H. sapiens
ccatgcaagtccaaaa

SEQ ID NO: 75837 - DNA, 16 bp, H. sapiens
ccatgcagagctgtga

SEQ ID NO: 75838 - DNA, 16 bp, H. sapiens
ccatgcatccaacaaa

SEQ ID NO: 75839 - DNA, 16 bp, H. sapiens
ccatgcatgttgctgc

SEQ ID NO: 75840 - DNA, 16 bp, H. sapiens
ccatgccagggagaat

SEQ ID NO: 75841 - DNA, 16 bp, H. sapiens
ccatgcccagccaaaa

SEQ ID NO: 75842 - DNA, 16 bp, H. sapiens
ccatgcccagccaagc

SEQ ID NO: 75843 - DNA, 16 bp, H. sapiens
ccatgcccagccaata

SEQ ID NO: 75844 - DNA, 16 bp, H. sapiens
ccatgcccagccaggt

SEQ ID NO: 75845 - DNA, 16 bp, H. sapiens
ccatgcccagcccacc

SEQ ID NO: 75846 - DNA, 16 bp, H. sapiens
ccatgcccagccccat

SEQ ID NO: 75847 - DNA, 16 bp, H. sapiens
ccatgcccagcccctg

SEQ ID NO: 75848 - DNA, 16 bp, H. sapiens
ccatgcccagccctgt

SEQ ID NO: 75849 - DNA, 16 bp, H. sapiens
ccatgcccagccgaga

SEQ ID NO: 75850 - DNA, 16 bp, H. sapiens
ccatgcccagcctaat

SEQ ID NO: 75851 - DNA, 16 bp, H. sapiens
ccatgcccagcctcag

SEQ ID NO: 75852 - DNA, 16 bp, H. sapiens
ccatgcccagcctgac

SEQ ID NO: 75853 - DNA, 16 bp, H. sapiens
ccatgcccagcctggc

SEQ ID NO: 75854 - DNA, 16 bp, H. sapiens
ccatgcccagcctgtg

SEQ ID NO: 75855 - DNA, 16 bp, H. sapiens
ccatgcccagcctttc

SEQ ID NO: 75856 - DNA, 16 bp, H. sapiens
ccatgcccagctgtat

SEQ ID NO: 75857 - DNA, 17 bp, H. sapiens
ccatgcccatgcagcaa

SEQ ID NO: 75858 - DNA, 16 bp, H. sapiens
ccatgcccgacctcaa

SEQ ID NO: 75859 - DNA, 16 bp, H. sapiens
ccatgcccggccccac

SEQ ID NO: 75860 - DNA, 16 bp, H. sapiens
ccatgcccggcccctc

SEQ ID NO: 75861 - DNA, 16 bp, H. sapiens
ccatgcccggcctcag

SEQ ID NO: 75862 - DNA, 16 bp, H. sapiens
ccatgcctgagccccc

SEQ ID NO: 75863 - DNA, 22 bp, H. sapiens
ccatgcctgagcctcccacccc

SEQ ID NO: 75864 - DNA, 16 bp, H. sapiens
ccatgcctggccactc

SEQ ID NO: 75865 - DNA, 16 bp, H. sapiens
ccatgcctggccaggg

SEQ ID NO: 75866 - DNA, 16 bp, H. sapiens
ccatgcctggcccagc

SEQ ID NO: 75867 - DNA, 16 bp, H. sapiens
ccatgcctggccccaa

SEQ ID NO: 75868 - DNA, 16 bp, H. sapiens
ccatgcctggccctaa

SEQ ID NO: 75869 - DNA, 17 bp, H. sapiens
ccatgcctggccctaaa

SEQ ID NO: 75870 - DNA, 16 bp, H. sapiens
ccatgcctggccctga

SEQ ID NO: 75871 - DNA, 16 bp, H. sapiens
ccatgcctggcccttc

SEQ ID NO: 75872 - DNA, 16 bp, H. sapiens
ccatgcctggcccttg

SEQ ID NO: 75873 - DNA, 16 bp, H. sapiens
ccatgcctggcctatt

SEQ ID NO: 75874 - DNA, 16 bp, H. sapiens
ccatgcctggccttct

SEQ ID NO: 75875 - DNA, 16 bp, H. sapiens
ccatgcctggctacct

SEQ ID NO: 75876 - DNA, 16 bp, H. sapiens
ccatgcctggcttatt

SEQ ID NO: 75877 - DNA, 16 bp, H. sapiens
ccatgcgttctcatca

SEQ ID NO: 75878 - DNA, 16 bp, H. sapiens
ccatgctatacattag

SEQ ID NO: 75879 - DNA, 16 bp, H. sapiens
ccatgctgaactgagt

SEQ ID NO: 75880 - DNA, 16 bp, H. sapiens
ccatgctgagctgtga

SEQ ID NO: 75881 - DNA, 16 bp, H. sapiens
ccatgctggagtgcat

SEQ ID NO: 75882 - DNA, 16 bp, H. sapiens
ccatgctggatgcttc

SEQ ID NO: 75883 - DNA, 16 bp, H. sapiens
ccatgctggccaacat

SEQ ID NO: 75884 - DNA, 16 bp, H. sapiens
ccatgctggtgggctg

SEQ ID NO: 75885 - DNA, 16 bp, H. sapiens
ccatgctggtgtactg

SEQ ID NO: 75886 - DNA, 16 bp, H. sapiens
ccatgctgtgaggaag

SEQ ID NO: 75887 - DNA, 16 bp, H. sapiens
ccatgctgttttgatg

SEQ ID NO: 75888 - DNA, 16 bp, H. sapiens
ccatgctgtttttggt

SEQ ID NO: 75889 - DNA, 16 bp, H. sapiens
ccatgcttcctgtaca

SEQ ID NO: 75890 - DNA, 16 bp, H. sapiens
ccatggaaaaattgtt

SEQ ID NO: 75891 - DNA, 16 bp, H. sapiens
ccatggagaggaagga

SEQ ID NO: 75892 - DNA, 16 bp, H. sapiens
ccatggagtgggtggg

SEQ ID NO: 75893 - DNA, 16 bp, H. sapiens
ccatggataccaaaat

SEQ ID NO: 75894 - DNA, 16 bp, H. sapiens
ccatggataccaagga

SEQ ID NO: 75895 - DNA, 16 bp, H. sapiens
ccatggatgtggaacc

SEQ ID NO: 75896 - DNA, 16 bp, H. sapiens
ccatggattcaaccaa

SEQ ID NO: 75897 - DNA, 16 bp, H. sapiens
ccatggcacatgttta

SEQ ID NO: 75898 - DNA, 16 bp, H. sapiens
ccatggcagacatcac

SEQ ID NO: 75899 - DNA, 16 bp, H. sapiens
ccatggcatatatgta

SEQ ID NO: 75900 - DNA, 16 bp, H. sapiens
ccatggccaatttcaa

SEQ ID NO: 75901 - DNA, 16 bp, H. sapiens
ccatggccatgaaaat

SEQ ID NO: 75902 - DNA, 16 bp, H. sapiens
ccatggccctggccct

SEQ ID NO: 75903 - DNA, 17 bp, H. sapiens
ccatggcctgttaggag

SEQ ID NO: 75904 - DNA, 16 bp, H. sapiens
ccatggctaaaatggg

SEQ ID NO: 75905 - DNA, 16 bp, H. sapiens
ccatggctagagtggc

SEQ ID NO: 75906 - DNA, 19 bp, H. sapiens
ccatggctcacacctgtaa

SEQ ID NO: 75907 - DNA, 16 bp, H. sapiens
ccatggctcacatctg

SEQ ID NO: 75908 - DNA, 16 bp, H. sapiens
ccatggctcatgcctg

SEQ ID NO: 75909 - DNA, 16 bp, H. sapiens
ccatggctgcagaccc

SEQ ID NO: 75910 - DNA, 16 bp, H. sapiens
ccatggctggagcagc

SEQ ID NO: 75911 - DNA, 16 bp, H. sapiens
ccatggctggctcctt

SEQ ID NO: 75912 - DNA, 16 bp, H. sapiens
ccatgggaacccacct

SEQ ID NO: 75913 - DNA, 16 bp, H. sapiens
ccatgggccttgggtg

SEQ ID NO: 75914 - DNA, 16 bp, H. sapiens
ccatggggaaactgag

SEQ ID NO: 75915 - DNA, 16 bp, H. sapiens
ccatggggattggaat

SEQ ID NO: 75916 - DNA, 16 bp, H. sapiens
ccatggggtgcccaga

SEQ ID NO: 75917 - DNA, 16 bp, H. sapiens
ccatgggttccacatc

SEQ ID NO: 75918 - DNA, 16 bp, H. sapiens
ccatggtatgaatata

SEQ ID NO: 75919 - DNA, 18 bp, H. sapiens
ccatggtgaaaccctgtc

SEQ ID NO: 75920 - DNA, 16 bp, H. sapiens
ccatggtgaccaggct

SEQ ID NO: 75921 - DNA, 16 bp, H. sapiens
ccatggtgcaatctca

SEQ ID NO: 75922 - DNA, 16 bp, H. sapiens
ccatggtgcccagcct

SEQ ID NO: 75923 - DNA, 16 bp, H. sapiens
ccatggtgcctggcca

SEQ ID NO: 75924 - DNA, 16 bp, H. sapiens
ccatggtggaagacag

SEQ ID NO: 75925 - DNA, 16 bp, H. sapiens
ccatggtggcacacgc

SEQ ID NO: 75926 - DNA, 16 bp, H. sapiens
ccatggtggcagagat

SEQ ID NO: 75927 - DNA, 16 bp, H. sapiens
ccatggtggctcacac

SEQ ID NO: 75928 - DNA, 16 bp, H. sapiens
ccatggtggtgcatgc

SEQ ID NO: 75929 - DNA, 16 bp, H. sapiens
ccatggtggtttgttg

SEQ ID NO: 75930 - DNA, 16 bp, H. sapiens
ccatggttgtttgctg

SEQ ID NO: 75931 - DNA, 16 bp, H. sapiens
ccatgtaacaaacctg

SEQ ID NO: 75932 - DNA, 16 bp, H. sapiens
ccatgtaaggtcacat

SEQ ID NO: 75933 - DNA, 16 bp, H. sapiens
ccatgtacccatcacc

SEQ ID NO: 75934 - DNA, 16 bp, H. sapiens
ccatgtactccagcct

SEQ ID NO: 75935 - DNA, 16 bp, H. sapiens
ccatgtagcccaggct

SEQ ID NO: 75936 - DNA, 16 bp, H. sapiens
ccatgtccaagaagaa

SEQ ID NO: 75937 - DNA, 16 bp, H. sapiens
ccatgtcccatgatcc

SEQ ID NO: 75938 - DNA, 16 bp, H. sapiens
ccatgtcggccaggct

SEQ ID NO: 75939 - DNA, 16 bp, H. sapiens
ccatgtctacagaaaa

SEQ ID NO: 75940 - DNA, 16 bp, H. sapiens
ccatgtctgccaggct

SEQ ID NO: 75941 - DNA, 16 bp, H. sapiens
ccatgtctgtctgtct

SEQ ID NO: 75942 - DNA, 16 bp, H. sapiens
ccatgtgaagaagaac

SEQ ID NO: 75943 - DNA, 16 bp, H. sapiens
ccatgtgaagacagag

SEQ ID NO: 75944 - DNA, 16 bp, H. sapiens
ccatgtgaaggcagag

SEQ ID NO: 75945 - DNA, 16 bp, H. sapiens
ccatgtgacacactgg

SEQ ID NO: 75946 - DNA, 16 bp, H. sapiens
ccatgtgacatgcctg

SEQ ID NO: 75947 - DNA, 16 bp, H. sapiens
ccatgtgacctcattt

SEQ ID NO: 75948 - DNA, 16 bp, H. sapiens
ccatgtgaccttggac

SEQ ID NO: 75949 - DNA, 16 bp, H. sapiens
ccatgtgactggggag

SEQ ID NO: 75950 - DNA, 16 bp, H. sapiens
ccatgtgagatgtgct

SEQ ID NO: 75951 - DNA, 16 bp, H. sapiens
ccatgtgaggacacag

SEQ ID NO: 75952 - DNA, 16 bp, H. sapiens
ccatgtgatatgcctg

SEQ ID NO: 75953 - DNA, 16 bp, H. sapiens
ccatgtgatgccctgt

SEQ ID NO: 75954 - DNA, 16 bp, H. sapiens
ccatgtgatgccttct

SEQ ID NO: 75955 - DNA, 16 bp, H. sapiens
ccatgtgatgctgatg

SEQ ID NO: 75956 - DNA, 16 bp, H. sapiens
ccatgtgatttgcttt

SEQ ID NO: 75957 - DNA, 16 bp, H. sapiens
ccatgtgccttttccc

SEQ ID NO: 75958 - DNA, 16 bp, H. sapiens
ccatgtgctgaggaga

SEQ ID NO: 75959 - DNA, 16 bp, H. sapiens
ccatgtggaactgaga

SEQ ID NO: 75960 - DNA, 16 bp, H. sapiens
ccatgtggctttgcag

SEQ ID NO: 75961 - DNA, 16 bp, H. sapiens
ccatgtgggccaggat

SEQ ID NO: 75962 - DNA, 16 bp, H. sapiens
ccatgtggtcctgggc

SEQ ID NO: 75963 - DNA, 16 bp, H. sapiens
ccatgtgtcagaggag

SEQ ID NO: 75964 - DNA, 16 bp, H. sapiens
ccatgtgtcaggggag

SEQ ID NO: 75965 - DNA, 16 bp, H. sapiens
ccatgttagccaagat

SEQ ID NO: 75966 - DNA, 16 bp, H. sapiens
ccatgttagctgggat

SEQ ID NO: 75967 - DNA, 16 bp, H. sapiens
ccatgttcactttggg

SEQ ID NO: 75968 - DNA, 16 bp, H. sapiens
ccatgttcattgtggc

SEQ ID NO: 75969 - DNA, 16 bp, H. sapiens
ccatgttctttccact

SEQ ID NO: 75970 - DNA, 16 bp, H. sapiens
ccatgttgaactgtga

SEQ ID NO: 75971 - DNA, 16 bp, H. sapiens
ccatgttgacttctga

SEQ ID NO: 75972 - DNA, 16 bp, H. sapiens
ccatgttgcccagtct

SEQ ID NO: 75973 - DNA, 16 bp, H. sapiens
ccatgttgccgaggct

SEQ ID NO: 75974 - DNA, 16 bp, H. sapiens
ccatgttgctcaggct

SEQ ID NO: 75975 - DNA, 16 bp, H. sapiens
ccatgttggacaggct

SEQ ID NO: 75976 - DNA, 16 bp, H. sapiens
ccatgttggccaggaa

SEQ ID NO: 75977 - DNA, 16 bp, H. sapiens
ccatgttggccaggcg

SEQ ID NO: 75978 - DNA, 16 bp, H. sapiens
ccatgttggccatgtt

SEQ ID NO: 75979 - DNA, 16 bp, H. sapiens
ccatgttggtcagact

SEQ ID NO: 75980 - DNA, 16 bp, H. sapiens
ccatgttggtcaggca

SEQ ID NO: 75981 - DNA, 16 bp, H. sapiens
ccatgttggtcaggcg

SEQ ID NO: 75982 - DNA, 16 bp, H. sapiens
ccatgttgtccaggcc

SEQ ID NO: 75983 - DNA, 16 bp, H. sapiens
ccatgttgttttgctt

SEQ ID NO: 75984 - DNA, 16 bp, H. sapiens
ccatgtttatttattt

SEQ ID NO: 75985 - DNA, 16 bp, H. sapiens
ccatgtttcccagtct

SEQ ID NO: 75986 - DNA, 16 bp, H. sapiens
ccatgtttttgcaaat

SEQ ID NO: 75987 - DNA, 16 bp, H. sapiens
ccattaaaaaaatttt

SEQ ID NO: 75988 - DNA, 16 bp, H. sapiens
ccattaaaaagaaaga

SEQ ID NO: 75989 - DNA, 16 bp, H. sapiens
ccattaaaaagtaaaa

SEQ ID NO: 75990 - DNA, 16 bp, H. sapiens
ccattaaaactctttt

SEQ ID NO: 75991 - DNA, 16 bp, H. sapiens
ccattaaaactttatt

SEQ ID NO: 75992 - DNA, 16 bp, H. sapiens
ccattaaaagtaatga

SEQ ID NO: 75993 - DNA, 16 bp, H. sapiens
ccattaaaatgcaaat

SEQ ID NO: 75994 - DNA, 16 bp, H. sapiens
ccattaaagaaaagcc

SEQ ID NO: 75995 - DNA, 16 bp, H. sapiens
ccattaaataataact

SEQ ID NO: 75996 - DNA, 16 bp, H. sapiens
ccattacccaaatagt

SEQ ID NO: 75997 - DNA, 16 bp, H. sapiens
ccattactgccttctt

SEQ ID NO: 75998 - DNA, 16 bp, H. sapiens
ccattagcagtcactc

SEQ ID NO: 75999 - DNA, 16 bp, H. sapiens
ccattaggctccacct

SEQ ID NO: 76000 - DNA, 16 bp, H. sapiens
ccattagttctgtccc

SEQ ID NO: 76001 - DNA, 17 bp, H. sapiens
ccattatctcaagtagc

SEQ ID NO: 76002 - DNA, 16 bp, H. sapiens
ccattatctcatttga

SEQ ID NO: 76003 - DNA, 16 bp, H. sapiens
ccattatcttcagcaa

SEQ ID NO: 76004 - DNA, 16 bp, H. sapiens
ccattatcttcatgtt

SEQ ID NO: 76005 - DNA, 16 bp, H. sapiens
ccattatgcatatgtt

SEQ ID NO: 76006 - DNA, 16 bp, H. sapiens
ccattattctcagcaa

SEQ ID NO: 76007 - DNA, 16 bp, H. sapiens
ccattattgaaaatgg

SEQ ID NO: 76008 - DNA, 16 bp, H. sapiens
ccattattgaaagtgg

SEQ ID NO: 76009 - DNA, 16 bp, H. sapiens
ccattatttcattctg

SEQ ID NO: 76010 - DNA, 20 bp, H. sapiens
ccattatttctgcatatcag

SEQ ID NO: 76011 - DNA, 16 bp, H. sapiens
ccattattttcaatgg

SEQ ID NO: 76012 - DNA, 16 bp, H. sapiens
ccattattttcttaaa

SEQ ID NO: 76013 - DNA, 16 bp, H. sapiens
ccattattttgcattt

SEQ ID NO: 76014 - DNA, 16 bp, H. sapiens
ccattcaaatccattc

SEQ ID NO: 76015 - DNA, 16 bp, H. sapiens
ccattcaataaaacct

SEQ ID NO: 76016 - DNA, 16 bp, H. sapiens
ccattcaattccattt

SEQ ID NO: 76017 - DNA, 16 bp, H. sapiens
ccattcacaattactt

SEQ ID NO: 76018 - DNA, 16 bp, H. sapiens
ccattcacatcatgag

SEQ ID NO: 76019 - DNA, 16 bp, H. sapiens
ccattcacgagggctc

SEQ ID NO: 76020 - DNA, 16 bp, H. sapiens
ccattcactcactgac

SEQ ID NO: 76021 - DNA, 16 bp, H. sapiens
ccattcactcatttat

SEQ ID NO: 76022 - DNA, 16 bp, H. sapiens
ccattcagcaaatatt

SEQ ID NO: 76023 - DNA, 16 bp, H. sapiens
ccattcaggacacagg

SEQ ID NO: 76024 - DNA, 16 bp, H. sapiens
ccattcaggaggctga

SEQ ID NO: 76025 - DNA, 16 bp, H. sapiens
ccattcagtatgctgt

SEQ ID NO: 76026 - DNA, 16 bp, H. sapiens
ccattcataattgcca

SEQ ID NO: 76027 - DNA, 16 bp, H. sapiens
ccattcatatgtcttc

SEQ ID NO: 76028 - DNA, 16 bp, H. sapiens
ccattcatcaattttg

SEQ ID NO: 76029 - DNA, 16 bp, H. sapiens
ccattcatccactcac

SEQ ID NO: 76030 - DNA, 16 bp, H. sapiens
ccattcatctccagaa

SEQ ID NO: 76031 - DNA, 16 bp, H. sapiens
ccattcatgagggatc

SEQ ID NO: 76032 - DNA, 16 bp, H. sapiens
ccattcattcaacaaa

SEQ ID NO: 76033 - DNA, 16 bp, H. sapiens
ccattcattcattcat

SEQ ID NO: 76034 - DNA, 16 bp, H. sapiens
ccattcatttgctgat

SEQ ID NO: 76035 - DNA, 16 bp, H. sapiens
ccattccaaatgtgag

SEQ ID NO: 76036 - DNA, 16 bp, H. sapiens
ccattccaatcccttc

SEQ ID NO: 76037 - DNA, 16 bp, H. sapiens
ccattccactccactc

SEQ ID NO: 76038 - DNA, 16 bp, H. sapiens
ccattccatacccttc

SEQ ID NO: 76039 - DNA, 16 bp, H. sapiens
ccattccatacgattc

SEQ ID NO: 76040 - DNA, 16 bp, H. sapiens
ccattccattgtattc

SEQ ID NO: 76041 - DNA, 16 bp, H. sapiens
ccattccatttcactc

SEQ ID NO: 76042 - DNA, 16 bp, H. sapiens
ccattccatttcattt

SEQ ID NO: 76043 - DNA, 16 bp, H. sapiens
ccattcccacagctcc

SEQ ID NO: 76044 - DNA, 16 bp, H. sapiens
ccattccccagcctct

SEQ ID NO: 76045 - DNA, 16 bp, H. sapiens
ccattcccctgcctca

SEQ ID NO: 76046 - DNA, 16 bp, H. sapiens
ccattcctactaaaaa

SEQ ID NO: 76047 - DNA, 16 bp, H. sapiens
ccattcctactaaaac

SEQ ID NO: 76048 - DNA, 16 bp, H. sapiens
ccattcctcagggtga

SEQ ID NO: 76049 - DNA, 16 bp, H. sapiens
ccattcctctgtcctc

SEQ ID NO: 76050 - DNA, 16 bp, H. sapiens
ccattccttcccattc

SEQ ID NO: 76051 - DNA, 16 bp, H. sapiens
ccattcctttattttg

SEQ ID NO: 76052 - DNA, 16 bp, H. sapiens
ccattctaacaggtat

SEQ ID NO: 76053 - DNA, 16 bp, H. sapiens
ccattctccagtctca

SEQ ID NO: 76054 - DNA, 16 bp, H. sapiens
ccattctccccatcag

SEQ ID NO: 76055 - DNA, 16 bp, H. sapiens
ccattctcctgctgca

SEQ ID NO: 76056 - DNA, 16 bp, H. sapiens
ccattctccttcctca

SEQ ID NO: 76057 - DNA, 16 bp, H. sapiens
ccattctgactggcgt

SEQ ID NO: 76058 - DNA, 16 bp, H. sapiens
ccattctgagtggtgt

SEQ ID NO: 76059 - DNA, 16 bp, H. sapiens
ccattctggacatttt

SEQ ID NO: 76060 - DNA, 16 bp, H. sapiens
ccattctgggaatgga

SEQ ID NO: 76061 - DNA, 16 bp, H. sapiens
ccattctggggcctgg

SEQ ID NO: 76062 - DNA, 16 bp, H. sapiens
ccattctgtgcctttt

SEQ ID NO: 76063 - DNA, 16 bp, H. sapiens
ccattctgtgtgtgtg

SEQ ID NO: 76064 - DNA, 16 bp, H. sapiens
ccattctgttttccat

SEQ ID NO: 76065 - DNA, 16 bp, H. sapiens
ccattcttcccacaca

SEQ ID NO: 76066 - DNA, 16 bp, H. sapiens
ccattcttcccatctc

SEQ ID NO: 76067 - DNA, 16 bp, H. sapiens
ccattcttctgcttca

SEQ ID NO: 76068 - DNA, 16 bp, H. sapiens
ccattcttttattcat

SEQ ID NO: 76069 - DNA, 16 bp, H. sapiens
ccattgaacaataact

SEQ ID NO: 76070 - DNA, 16 bp, H. sapiens
ccattgaagatgccat

SEQ ID NO: 76071 - DNA, 16 bp, H. sapiens
ccattgcacctggccc

SEQ ID NO: 76072 - DNA, 16 bp, H. sapiens
ccattgcacctggccg

SEQ ID NO: 76073 - DNA, 16 bp, H. sapiens
ccattgcactccagat

SEQ ID NO: 76074 - DNA, 16 bp, H. sapiens
ccattgcactccatcc

SEQ ID NO: 76075 - DNA, 16 bp, H. sapiens
ccattgcattccagca

SEQ ID NO: 76076 - DNA, 16 bp, H. sapiens
ccattgcattccagcc

SEQ ID NO: 76077 - DNA, 16 bp, H. sapiens
ccattgcccaggctga

SEQ ID NO: 76078 - DNA, 16 bp, H. sapiens
ccattgcccaggcttg

SEQ ID NO: 76079 - DNA, 28 bp, H. sapiens
ccattgcccaggcttgcttaggtaaaca

SEQ ID NO: 76080 - DNA, 16 bp, H. sapiens
ccattgcccagggatg

SEQ ID NO: 76081 - DNA, 16 bp, H. sapiens
ccattgctctccagcc

SEQ ID NO: 76082 - DNA, 16 bp, H. sapiens
ccattgctgataccct

SEQ ID NO: 76083 - DNA, 16 bp, H. sapiens
ccattgcttcagaagg

SEQ ID NO: 76084 - DNA, 16 bp, H. sapiens
ccattggccaaagcag

SEQ ID NO: 76085 - DNA, 16 bp, H. sapiens
ccattggcctcaaagc

SEQ ID NO: 76086 - DNA, 16 bp, H. sapiens
ccattggctggaatgg

SEQ ID NO: 76087 - DNA, 16 bp, H. sapiens
ccattggctggagttg

SEQ ID NO: 76088 - DNA, 16 bp, H. sapiens
ccattggtcaggctgg

SEQ ID NO: 76089 - DNA, 16 bp, H. sapiens
ccattggtctatgcat

SEQ ID NO: 76090 - DNA, 16 bp, H. sapiens
ccattgtaaatgggat

SEQ ID NO: 76091 - DNA, 16 bp, H. sapiens
ccattgtactccagct

SEQ ID NO: 76092 - DNA, 16 bp, H. sapiens
ccattgtagagttatt

SEQ ID NO: 76093 - DNA, 16 bp, H. sapiens
ccattgtattacaatt

SEQ ID NO: 76094 - DNA, 16 bp, H. sapiens
ccattgtcaacattag

SEQ ID NO: 76095 - DNA, 16 bp, H. sapiens
ccattgtgcccagcca

SEQ ID NO: 76096 - DNA, 16 bp, H. sapiens
ccattgtggaatacag

SEQ ID NO: 76097 - DNA, 16 bp, H. sapiens
ccattgtgtggataga

SEQ ID NO: 76098 - DNA, 16 bp, H. sapiens
ccattgttcagagaag

SEQ ID NO: 76099 - DNA, 16 bp, H. sapiens
ccattgttgaccaaaa

SEQ ID NO: 76100 - DNA, 16 bp, H. sapiens
ccattgtttataaatt

SEQ ID NO: 76101 - DNA, 16 bp, H. sapiens
ccatttaaaaattgga

SEQ ID NO: 76102 - DNA, 16 bp, H. sapiens
ccatttaaccagtctc

SEQ ID NO: 76103 - DNA, 16 bp, H. sapiens
ccatttaaccattttt

SEQ ID NO: 76104 - DNA, 16 bp, H. sapiens
ccatttaatttttgta

SEQ ID NO: 76105 - DNA, 16 bp, H. sapiens
ccatttacatagcatt

SEQ ID NO: 76106 - DNA, 16 bp, H. sapiens
ccatttacatttaaaa

SEQ ID NO: 76107 - DNA, 16 bp, H. sapiens
ccatttacatttcagg

SEQ ID NO: 76108 - DNA, 16 bp, H. sapiens
ccatttatataaaact

SEQ ID NO: 76109 - DNA, 19 bp, H. sapiens
ccatttatgctggaggttg

SEQ ID NO: 76110 - DNA, 16 bp, H. sapiens
ccatttattgaatagc

SEQ ID NO: 76111 - DNA, 16 bp, H. sapiens
ccatttcaaaacaaaa

SEQ ID NO: 76112 - DNA, 16 bp, H. sapiens
ccatttcacaaataag

SEQ ID NO: 76113 - DNA, 16 bp, H. sapiens
ccatttcacagatgag

SEQ ID NO: 76114 - DNA, 16 bp, H. sapiens
ccatttcacagatgga

SEQ ID NO: 76115 - DNA, 16 bp, H. sapiens
ccatttcatagatgaa

SEQ ID NO: 76116 - DNA, 16 bp, H. sapiens
ccatttcatttcttat

SEQ ID NO: 76117 - DNA, 16 bp, H. sapiens
ccatttccaaataagg

SEQ ID NO: 76118 - DNA, 16 bp, H. sapiens
ccatttccaagacaaa

SEQ ID NO: 76119 - DNA, 16 bp, H. sapiens
ccatttccaatgaagg

SEQ ID NO: 76120 - DNA, 16 bp, H. sapiens
ccatttcccaggctca

SEQ ID NO: 76121 - DNA, 16 bp, H. sapiens
ccatttcctctggatt

SEQ ID NO: 76122 - DNA, 16 bp, H. sapiens
ccatttcctcttctgt

SEQ ID NO: 76123 - DNA, 16 bp, H. sapiens
ccatttcctggggaga

SEQ ID NO: 76124 - DNA, 16 bp, H. sapiens
ccatttctacaaagaa

SEQ ID NO: 76125 - DNA, 16 bp, H. sapiens
ccatttctccaagaag

SEQ ID NO: 76126 - DNA, 16 bp, H. sapiens
ccatttctccatttct

SEQ ID NO: 76127 - DNA, 16 bp, H. sapiens
ccatttctcctgcctc

SEQ ID NO: 76128 - DNA, 16 bp, H. sapiens
ccatttcttctagatt

SEQ ID NO: 76129 - DNA, 16 bp, H. sapiens
ccatttcttctatatt

SEQ ID NO: 76130 - DNA, 16 bp, H. sapiens
ccatttcttctttttg

SEQ ID NO: 76131 - DNA, 16 bp, H. sapiens
ccatttcttgtttttc

SEQ ID NO: 76132 - DNA, 16 bp, H. sapiens
ccatttctttaaaaat

SEQ ID NO: 76133 - DNA, 16 bp, H. sapiens
ccatttctttttattg

SEQ ID NO: 76134 - DNA, 16 bp, H. sapiens
ccatttgaaatttatt

SEQ ID NO: 76135 - DNA, 16 bp, H. sapiens
ccatttgagccagcaa

SEQ ID NO: 76136 - DNA, 16 bp, H. sapiens
ccatttgatagatgag

SEQ ID NO: 76137 - DNA, 16 bp, H. sapiens
ccatttgatgatggag

SEQ ID NO: 76138 - DNA, 16 bp, H. sapiens
ccatttgatgattcca

SEQ ID NO: 76139 - DNA, 16 bp, H. sapiens
ccatttggaatggaag

SEQ ID NO: 76140 - DNA, 16 bp, H. sapiens
ccatttgggcagacac

SEQ ID NO: 76141 - DNA, 16 bp, H. sapiens
ccatttggtccagcaa

SEQ ID NO: 76142 - DNA, 16 bp, H. sapiens
ccatttgtaaattttt

SEQ ID NO: 76143 - DNA, 16 bp, H. sapiens
ccatttgtatgaaatt

SEQ ID NO: 76144 - DNA, 16 bp, H. sapiens
ccatttgtatgacttc

SEQ ID NO: 76145 - DNA, 16 bp, H. sapiens
ccatttgtatttattt

SEQ ID NO: 76146 - DNA, 16 bp, H. sapiens
ccatttgtgtgtgtgt

SEQ ID NO: 76147 - DNA, 16 bp, H. sapiens
ccatttgttcattttt

SEQ ID NO: 76148 - DNA, 16 bp, H. sapiens
ccattttaaaaaattc

SEQ ID NO: 76149 - DNA, 16 bp, H. sapiens
ccattttaactgggat

SEQ ID NO: 76150 - DNA, 16 bp, H. sapiens
ccattttaactgtttt

SEQ ID NO: 76151 - DNA, 16 bp, H. sapiens
ccattttaatcttgct

SEQ ID NO: 76152 - DNA, 16 bp, H. sapiens
ccattttacaaatgag

SEQ ID NO: 76153 - DNA, 16 bp, H. sapiens
ccattttacaaatggg

SEQ ID NO: 76154 - DNA, 16 bp, H. sapiens
ccattttacaagtgag

SEQ ID NO: 76155 - DNA, 16 bp, H. sapiens
ccattttacagaagaa

SEQ ID NO: 76156 - DNA, 16 bp, H. sapiens
ccattttacagataag

SEQ ID NO: 76157 - DNA, 16 bp, H. sapiens
ccattttacagatgag

SEQ ID NO: 76158 - DNA, 16 bp, H. sapiens
ccattttacagatggg

SEQ ID NO: 76159 - DNA, 16 bp, H. sapiens
ccattttacattccca

SEQ ID NO: 76160 - DNA, 16 bp, H. sapiens
ccattttacggatgag

SEQ ID NO: 76161 - DNA, 16 bp, H. sapiens
ccattttactgttgat

SEQ ID NO: 76162 - DNA, 16 bp, H. sapiens
ccattttataaaagaa

SEQ ID NO: 76163 - DNA, 16 bp, H. sapiens
ccattttataagtgag

SEQ ID NO: 76164 - DNA, 16 bp, H. sapiens
ccattttatagatgaa

SEQ ID NO: 76165 - DNA, 16 bp, H. sapiens
ccattttatatttcca

SEQ ID NO: 76166 - DNA, 16 bp, H. sapiens
ccattttatggctgca

SEQ ID NO: 76167 - DNA, 16 bp, H. sapiens
ccattttattccattc

SEQ ID NO: 76168 - DNA, 16 bp, H. sapiens
ccattttattttagtt

SEQ ID NO: 76169 - DNA, 16 bp, H. sapiens
ccattttcaaactgct

SEQ ID NO: 76170 - DNA, 16 bp, H. sapiens
ccattttcaccatatt

SEQ ID NO: 76171 - DNA, 16 bp, H. sapiens
ccattttcattatatt

SEQ ID NO: 76172 - DNA, 16 bp, H. sapiens
ccattttccacagtgg

SEQ ID NO: 76173 - DNA, 16 bp, H. sapiens
ccattttcctctgcct

SEQ ID NO: 76174 - DNA, 16 bp, H. sapiens
ccattttcctctgctt

SEQ ID NO: 76175 - DNA, 16 bp, H. sapiens
ccattttctcatctga

SEQ ID NO: 76176 - DNA, 16 bp, H. sapiens
ccattttctgtttcta

SEQ ID NO: 76177 - DNA, 16 bp, H. sapiens
ccattttcttgctttt

SEQ ID NO: 76178 - DNA, 16 bp, H. sapiens
ccattttcttttgcaa

SEQ ID NO: 76179 - DNA, 16 bp, H. sapiens
ccattttgaacttctg

SEQ ID NO: 76180 - DNA, 16 bp, H. sapiens
ccattttgaacttgaa

SEQ ID NO: 76181 - DNA, 16 bp, H. sapiens
ccattttgagttattt

SEQ ID NO: 76182 - DNA, 16 bp, H. sapiens
ccattttgatggcttt

SEQ ID NO: 76183 - DNA, 16 bp, H. sapiens
ccattttgcagataag

SEQ ID NO: 76184 - DNA, 16 bp, H. sapiens
ccattttgcagatgag

SEQ ID NO: 76185 - DNA, 16 bp, H. sapiens
ccattttgcagatgga

SEQ ID NO: 76186 - DNA, 16 bp, H. sapiens
ccattttgcagatggg

SEQ ID NO: 76187 - DNA, 16 bp, H. sapiens
ccattttgctgatgtc

SEQ ID NO: 76188 - DNA, 16 bp, H. sapiens
ccattttggaaaactg

SEQ ID NO: 76189 - DNA, 16 bp, H. sapiens
ccattttggaaagcag

SEQ ID NO: 76190 - DNA, 16 bp, H. sapiens
ccattttggccaacat

SEQ ID NO: 76191 - DNA, 16 bp, H. sapiens
ccattttggttaggga

SEQ ID NO: 76192 - DNA, 16 bp, H. sapiens
ccattttgtaaataaa

SEQ ID NO: 76193 - DNA, 16 bp, H. sapiens
ccattttgtatctttt

SEQ ID NO: 76194 - DNA, 16 bp, H. sapiens
ccattttgtgaatgga

SEQ ID NO: 76195 - DNA, 16 bp, H. sapiens
ccattttgttttgatt

SEQ ID NO: 76196 - DNA, 16 bp, H. sapiens
ccattttgttttttaa

SEQ ID NO: 76197 - DNA, 16 bp, H. sapiens
ccatttttaaatcaag

SEQ ID NO: 76198 - DNA, 16 bp, H. sapiens
ccatttttatggctat

SEQ ID NO: 76199 - DNA, 16 bp, H. sapiens
ccatttttatgtccat

SEQ ID NO: 76200 - DNA, 16 bp, H. sapiens
ccatttttcagatgag

SEQ ID NO: 76201 - DNA, 16 bp, H. sapiens
ccatttttcaggtgag

SEQ ID NO: 76202 - DNA, 16 bp, H. sapiens
ccatttttgtttggtt

SEQ ID NO: 76203 - DNA, 16 bp, H. sapiens
ccattttttaagtgta

SEQ ID NO: 76204 - DNA, 16 bp, H. sapiens
ccattttttgaggaga

SEQ ID NO: 76205 - DNA, 16 bp, H. sapiens
ccatttttttgtgtgt

SEQ ID NO: 76206 - DNA, 16 bp, H. sapiens
cccaaaacaattgaaa

SEQ ID NO: 76207 - DNA, 16 bp, H. sapiens
cccaaaactcaattct

SEQ ID NO: 76208 - DNA, 16 bp, H. sapiens
cccaaaactggggctt

SEQ ID NO: 76209 - DNA, 16 bp, H. sapiens
cccaaaagaattaaaa

SEQ ID NO: 76210 - DNA, 16 bp, H. sapiens
cccaaaagattataaa

SEQ ID NO: 76211 - DNA, 16 bp, H. sapiens
cccaaaagcttcttca

SEQ ID NO: 76212 - DNA, 16 bp, H. sapiens
cccaaaagtgctggga

SEQ ID NO: 76213 - DNA, 16 bp, H. sapiens
cccaaaataagtagaa

SEQ ID NO: 76214 - DNA, 16 bp, H. sapiens
cccaaaatatttttaa

SEQ ID NO: 76215 - DNA, 16 bp, H. sapiens
cccaaaatgcaagagt

SEQ ID NO: 76216 - DNA, 16 bp, H. sapiens
cccaaaatgctggatt

SEQ ID NO: 76217 - DNA, 16 bp, H. sapiens
cccaaaatgcttggga

SEQ ID NO: 76218 - DNA, 16 bp, H. sapiens
cccaaaatgttgggac

SEQ ID NO: 76219 - DNA, 16 bp, H. sapiens
cccaaaccaattaaat

SEQ ID NO: 76220 - DNA, 16 bp, H. sapiens
cccaaaccccagcatc

SEQ ID NO: 76221 - DNA, 16 bp, H. sapiens
cccaaactaatgcttt

SEQ ID NO: 76222 - DNA, 16 bp, H. sapiens
cccaaactgaaactct

SEQ ID NO: 76223 - DNA, 16 bp, H. sapiens
cccaaactgcctttga

SEQ ID NO: 76224 - DNA, 16 bp, H. sapiens
cccaaactggaaagaa

SEQ ID NO: 76225 - DNA, 16 bp, H. sapiens
cccaaactgggtaatt

SEQ ID NO: 76226 - DNA, 16 bp, H. sapiens
cccaaactgtgagaaa

SEQ ID NO: 76227 - DNA, 16 bp, H. sapiens
cccaaagaaatacaaa

SEQ ID NO: 76228 - DNA, 16 bp, H. sapiens
cccaaagaaatgaaat

SEQ ID NO: 76229 - DNA, 16 bp, H. sapiens
cccaaagaactgaaaa

SEQ ID NO: 76230 - DNA, 16 bp, H. sapiens
cccaaagaccccacct

SEQ ID NO: 76231 - DNA, 16 bp, H. sapiens
cccaaagagctgaaat

SEQ ID NO: 76232 - DNA, 16 bp, H. sapiens
cccaaagagtgaacag

SEQ ID NO: 76233 - DNA, 16 bp, H. sapiens
cccaaagatgtccatg

SEQ ID NO: 76234 - DNA, 16 bp, H. sapiens
cccaaagattctgatt

SEQ ID NO: 76235 - DNA, 16 bp, H. sapiens
cccaaagcacaggatg

SEQ ID NO: 76236 - DNA, 16 bp, H. sapiens
cccaaagcactgagat

SEQ ID NO: 76237 - DNA, 16 bp, H. sapiens
cccaaagcactgggtt

SEQ ID NO: 76238 - DNA, 16 bp, H. sapiens
cccaaagccacacagc

SEQ ID NO: 76239 - DNA, 16 bp, H. sapiens
cccaaaggaactgaaa

SEQ ID NO: 76240 - DNA, 16 bp, H. sapiens
cccaaaggaattgaaa

SEQ ID NO: 76241 - DNA, 16 bp, H. sapiens
cccaaagggaaagaaa

SEQ ID NO: 76242 - DNA, 16 bp, H. sapiens
cccaaagtccagggat

SEQ ID NO: 76243 - DNA, 16 bp, H. sapiens
cccaaagtccattaca

SEQ ID NO: 76244 - DNA, 16 bp, H. sapiens
cccaaagtgagaactt

SEQ ID NO: 76245 - DNA, 16 bp, H. sapiens
cccaaagtgctgcagt

SEQ ID NO: 76246 - DNA, 16 bp, H. sapiens
cccaaagtgctggact

SEQ ID NO: 76247 - DNA, 16 bp, H. sapiens
cccaaagtgctggagt

SEQ ID NO: 76248 - DNA, 16 bp, H. sapiens
cccaaagtgctggtgt

SEQ ID NO: 76249 - DNA, 17 bp, H. sapiens
cccaaagtgctgtgatg

SEQ ID NO: 76250 - DNA, 16 bp, H. sapiens
cccaaagtggccattt

SEQ ID NO: 76251 - DNA, 16 bp, H. sapiens
cccaaagttctgagat

SEQ ID NO: 76252 - DNA, 16 bp, H. sapiens
cccaaataaaatcaga

SEQ ID NO: 76253 - DNA, 16 bp, H. sapiens
cccaaatactgtgctg

SEQ ID NO: 76254 - DNA, 16 bp, H. sapiens
cccaaatagctaggat

SEQ ID NO: 76255 - DNA, 16 bp, H. sapiens
cccaaatatcactttg

SEQ ID NO: 76256 - DNA, 16 bp, H. sapiens
cccaaatattttcaat

SEQ ID NO: 76257 - DNA, 16 bp, H. sapiens
cccaaatcctataaaa

SEQ ID NO: 76258 - DNA, 16 bp, H. sapiens
cccaaatctcacaaat

SEQ ID NO: 76259 - DNA, 16 bp, H. sapiens
cccaaatggactaaga

SEQ ID NO: 76260 - DNA, 16 bp, H. sapiens
cccaaattcctgggct

SEQ ID NO: 76261 - DNA, 16 bp, H. sapiens
cccaaattgcagattt

SEQ ID NO: 76262 - DNA, 16 bp, H. sapiens
cccaacaaatttttgt

SEQ ID NO: 76263 - DNA, 16 bp, H. sapiens
cccaacaagctcctca

SEQ ID NO: 76264 - DNA, 16 bp, H. sapiens
cccaacactctggaag

SEQ ID NO: 76265 - DNA, 17 bp, H. sapiens
cccaacactttaccact

SEQ ID NO: 76266 - DNA, 16 bp, H. sapiens
cccaacagaaaaatgg

SEQ ID NO: 76267 - DNA, 18 bp, H. sapiens
cccaacagctcattgaga

SEQ ID NO: 76268 - DNA, 16 bp, H. sapiens
cccaacagtcccccag

SEQ ID NO: 76269 - DNA, 16 bp, H. sapiens
cccaacagtggagcac

SEQ ID NO: 76270 - DNA, 18 bp, H. sapiens
cccaacatggtgaaacct

SEQ ID NO: 76271 - DNA, 16 bp, H. sapiens
cccaacattataacaa

SEQ ID NO: 76272 - DNA, 16 bp, H. sapiens
cccaaccacgtggaac

SEQ ID NO: 76273 - DNA, 16 bp, H. sapiens
cccaaccagagacatg

SEQ ID NO: 76274 - DNA, 16 bp, H. sapiens
cccaacccctttcctg

SEQ ID NO: 76275 - DNA, 16 bp, H. sapiens
cccaacccttttcatt

SEQ ID NO: 76276 - DNA, 16 bp, H. sapiens
cccaacctcagctgat

SEQ ID NO: 76277 - DNA, 16 bp, H. sapiens
cccaacctcaggcaat

SEQ ID NO: 76278 - DNA, 16 bp, H. sapiens
cccaacctttttggca

SEQ ID NO: 76279 - DNA, 16 bp, H. sapiens
cccaactacatgggag

SEQ ID NO: 76280 - DNA, 16 bp, H. sapiens
cccaactcagcctcct

SEQ ID NO: 76281 - DNA, 16 bp, H. sapiens
cccaactcagccttcc

SEQ ID NO: 76282 - DNA, 16 bp, H. sapiens
cccaactcctggcctc

SEQ ID NO: 76283 - DNA, 16 bp, H. sapiens
cccaactctacaaaaa

SEQ ID NO: 76284 - DNA, 16 bp, H. sapiens
cccaactctttgggag

SEQ ID NO: 76285 - DNA, 16 bp, H. sapiens
cccaacttgatctata

SEQ ID NO: 76286 - DNA, 16 bp, H. sapiens
cccaagaaaattgaaa

SEQ ID NO: 76287 - DNA, 16 bp, H. sapiens
cccaagaagattctgt

SEQ ID NO: 76288 - DNA, 16 bp, H. sapiens
cccaagaagcagagaa

SEQ ID NO: 76289 - DNA, 16 bp, H. sapiens
cccaagacaattcttc

SEQ ID NO: 76290 - DNA, 16 bp, H. sapiens
cccaagactacaccag

SEQ ID NO: 76291 - DNA, 16 bp, H. sapiens
cccaagagcccctggc

SEQ ID NO: 76292 - DNA, 16 bp, H. sapiens
cccaagagctgggact

SEQ ID NO: 76293 - DNA, 16 bp, H. sapiens
cccaagagttagagac

SEQ ID NO: 76294 - DNA, 16 bp, H. sapiens
cccaagagttcaaggc

SEQ ID NO: 76295 - DNA, 16 bp, H. sapiens
cccaagatggctgctg

SEQ ID NO: 76296 - DNA, 16 bp, H. sapiens
cccaagatggtggtgg

SEQ ID NO: 76297 - DNA, 16 bp, H. sapiens
cccaagcagccaggac

SEQ ID NO: 76298 - DNA, 16 bp, H. sapiens
cccaagcagctggaac

SEQ ID NO: 76299 - DNA, 16 bp, H. sapiens
cccaagccatgcagaa

SEQ ID NO: 76300 - DNA, 16 bp, H. sapiens
cccaagccatgctgaa

SEQ ID NO: 76301 - DNA, 16 bp, H. sapiens
cccaagccatgtggaa

SEQ ID NO: 76302 - DNA, 16 bp, H. sapiens
cccaagccctgccccg

SEQ ID NO: 76303 - DNA, 16 bp, H. sapiens
cccaagccctgccctg

SEQ ID NO: 76304 - DNA, 16 bp, H. sapiens
cccaagccctggcagc

SEQ ID NO: 76305 - DNA, 16 bp, H. sapiens
cccaagctacagtgca

SEQ ID NO: 76306 - DNA, 16 bp, H. sapiens
cccaagctcaggagtt

SEQ ID NO: 76307 - DNA, 16 bp, H. sapiens
cccaagctctacattg

SEQ ID NO: 76308 - DNA, 16 bp, H. sapiens
cccaagctggagagca

SEQ ID NO: 76309 - DNA, 16 bp, H. sapiens
cccaagctggagggca

SEQ ID NO: 76310 - DNA, 16 bp, H. sapiens
cccaagctggagtgaa

SEQ ID NO: 76311 - DNA, 16 bp, H. sapiens
cccaagctggagtgca

SEQ ID NO: 76312 - DNA, 16 bp, H. sapiens
cccaagctggagttca

SEQ ID NO: 76313 - DNA, 16 bp, H. sapiens
cccaaggagctggaac

SEQ ID NO: 76314 - DNA, 16 bp, H. sapiens
cccaaggaggcagagg

SEQ ID NO: 76315 - DNA, 16 bp, H. sapiens
cccaaggatgaagctg

SEQ ID NO: 76316 - DNA, 16 bp, H. sapiens
cccaaggccacacagc

SEQ ID NO: 76317 - DNA, 16 bp, H. sapiens
cccaaggccctggtgg

SEQ ID NO: 76318 - DNA, 16 bp, H. sapiens
cccaaggctcctgacc

SEQ ID NO: 76319 - DNA, 16 bp, H. sapiens
cccaaggctgtgggaa

SEQ ID NO: 76320 - DNA, 16 bp, H. sapiens
cccaagggaggtcccc

SEQ ID NO: 76321 - DNA, 18 bp, H. sapiens
cccaagggctgaggagtg

SEQ ID NO: 76322 - DNA, 17 bp, H. sapiens
cccaaggtcacacagcc

SEQ ID NO: 76323 - DNA, 16 bp, H. sapiens
cccaaggtcacacggc

SEQ ID NO: 76324 - DNA, 16 bp, H. sapiens
cccaaggtcaggagtt

SEQ ID NO: 76325 - DNA, 16 bp, H. sapiens
cccaaggtcatgcagc

SEQ ID NO: 76326 - DNA, 16 bp, H. sapiens
cccaaggtcatggagc

SEQ ID NO: 76327 - DNA, 16 bp, H. sapiens
cccaaggtcccacagc

SEQ ID NO: 76328 - DNA, 16 bp, H. sapiens
cccaaggtgctgggag

SEQ ID NO: 76329 - DNA, 16 bp, H. sapiens
cccaaggtggtcttga

SEQ ID NO: 76330 - DNA, 16 bp, H. sapiens
cccaaggttgcacagc

SEQ ID NO: 76331 - DNA, 16 bp, H. sapiens
cccaagtagccaggac

SEQ ID NO: 76332 - DNA, 16 bp, H. sapiens
cccaagtagctgcaac

SEQ ID NO: 76333 - DNA, 18 bp, H. sapiens
cccaagtagctgggattt

SEQ ID NO: 76334 - DNA, 16 bp, H. sapiens
cccaagtagttgggag

SEQ ID NO: 76335 - DNA, 16 bp, H. sapiens
cccaagtcactgggac

SEQ ID NO: 76336 - DNA, 16 bp, H. sapiens
cccaagtgctgttggg

SEQ ID NO: 76337 - DNA, 16 bp, H. sapiens
cccaagtggcagagca

SEQ ID NO: 76338 - DNA, 16 bp, H. sapiens
cccaagtgtccaacaa

SEQ ID NO: 76339 - DNA, 16 bp, H. sapiens
cccaagttcaagagat

SEQ ID NO: 76340 - DNA, 16 bp, H. sapiens
cccaagttctgggatt

SEQ ID NO: 76341 - DNA, 18 bp, H. sapiens
cccaagttggagtgcaat

SEQ ID NO: 76342 - DNA, 16 bp, H. sapiens
cccaatagttatattt

SEQ ID NO: 76343 - DNA, 16 bp, H. sapiens
cccaatatggtgaaac

SEQ ID NO: 76344 - DNA, 16 bp, H. sapiens
cccaatcaaaagaaag

SEQ ID NO: 76345 - DNA, 16 bp, H. sapiens
cccaatcatagctcac

SEQ ID NO: 76346 - DNA, 16 bp, H. sapiens
cccaatctcaggcagt

SEQ ID NO: 76347 - DNA, 16 bp, H. sapiens
cccaatctggagtgca

SEQ ID NO: 76348 - DNA, 16 bp, H. sapiens
cccaatctgtggtatt

SEQ ID NO: 76349 - DNA, 16 bp, H. sapiens
cccaatgcctgtgccc

SEQ ID NO: 76350 - DNA, 16 bp, H. sapiens
cccaatgctctccctc

SEQ ID NO: 76351 - DNA, 16 bp, H. sapiens
cccaattagctgggac

SEQ ID NO: 76352 - DNA, 16 bp, H. sapiens
cccaattcagcctccc

SEQ ID NO: 76353 - DNA, 16 bp, H. sapiens
cccaattccaggactt

SEQ ID NO: 76354 - DNA, 16 bp, H. sapiens
cccaattcttctccac

SEQ ID NO: 76355 - DNA, 16 bp, H. sapiens
cccaatttttttttaa

SEQ ID NO: 76356 - DNA, 16 bp, H. sapiens
cccacaaaatgagaga

SEQ ID NO: 76357 - DNA, 16 bp, H. sapiens
cccacaacagtccccg

SEQ ID NO: 76358 - DNA, 16 bp, H. sapiens
cccacaaccaatcaga

SEQ ID NO: 76359 - DNA, 16 bp, H. sapiens
cccacaagctgaggga

SEQ ID NO: 76360 - DNA, 16 bp, H. sapiens
cccacaaggtccctcc

SEQ ID NO: 76361 - DNA, 16 bp, H. sapiens
cccacaataggccatc

SEQ ID NO: 76362 - DNA, 16 bp, H. sapiens
cccacacaaagtccct

SEQ ID NO: 76363 - DNA, 16 bp, H. sapiens
cccacaccaccatgcc

SEQ ID NO: 76364 - DNA, 16 bp, H. sapiens
cccacaccagggcctg

SEQ ID NO: 76365 - DNA, 19 bp, H. sapiens
cccacacccagctaatttt

SEQ ID NO: 76366 - DNA, 16 bp, H. sapiens
cccacacccttcccag

SEQ ID NO: 76367 - DNA, 16 bp, H. sapiens
cccacactgagtcccc

SEQ ID NO: 76368 - DNA, 16 bp, H. sapiens
cccacactgtcttcca

SEQ ID NO: 76369 - DNA, 16 bp, H. sapiens
cccacagaaatacaaa

SEQ ID NO: 76370 - DNA, 16 bp, H. sapiens
cccacagaaatacgaa

SEQ ID NO: 76371 - DNA, 16 bp, H. sapiens
cccacagacagttcac

SEQ ID NO: 76372 - DNA, 16 bp, H. sapiens
cccacagaccctggcc

SEQ ID NO: 76373 - DNA, 16 bp, H. sapiens
cccacagagaggaagg

SEQ ID NO: 76374 - DNA, 16 bp, H. sapiens
cccacagagatgagaa

SEQ ID NO: 76375 - DNA, 16 bp, H. sapiens
cccacagagcaggaga

SEQ ID NO: 76376 - DNA, 16 bp, H. sapiens
cccacagcagccccag

SEQ ID NO: 76377 - DNA, 16 bp, H. sapiens
cccacagcaggcccca

SEQ ID NO: 76378 - DNA, 16 bp, H. sapiens
cccacagccaggattc

SEQ ID NO: 76379 - DNA, 16 bp, H. sapiens
cccacagcccctggca

SEQ ID NO: 76380 - DNA, 16 bp, H. sapiens
cccacagccctgcctg

SEQ ID NO: 76381 - DNA, 16 bp, H. sapiens
cccacagccctggagg

SEQ ID NO: 76382 - DNA, 16 bp, H. sapiens
cccacagcctcccctt

SEQ ID NO: 76383 - DNA, 16 bp, H. sapiens
cccacagcctcctgag

SEQ ID NO: 76384 - DNA, 16 bp, H. sapiens
cccacagctctggagg

SEQ ID NO: 76385 - DNA, 16 bp, H. sapiens
cccacagctgcccctt

SEQ ID NO: 76386 - DNA, 16 bp, H. sapiens
cccacagctgctgacc

SEQ ID NO: 76387 - DNA, 16 bp, H. sapiens
cccacaggcacaggca

SEQ ID NO: 76388 - DNA, 16 bp, H. sapiens
cccacagtgctggggt

SEQ ID NO: 76389 - DNA, 16 bp, H. sapiens
cccacagtggctgcag

SEQ ID NO: 76390 - DNA, 16 bp, H. sapiens
cccacagttcccatgt

SEQ ID NO: 76391 - DNA, 19 bp, H. sapiens
cccacatcctgctgattgg

SEQ ID NO: 76392 - DNA, 16 bp, H. sapiens
cccacatctcagacaa

SEQ ID NO: 76393 - DNA, 16 bp, H. sapiens
cccacattttaatttt

SEQ ID NO: 76394 - DNA, 16 bp, H. sapiens
cccacattttcatttt

SEQ ID NO: 76395 - DNA, 16 bp, H. sapiens
cccaccaaagcccttg

SEQ ID NO: 76396 - DNA, 16 bp, H. sapiens
cccaccaagagtcacc

SEQ ID NO: 76397 - DNA, 16 bp, H. sapiens
cccaccaagcccagct

SEQ ID NO: 76398 - DNA, 16 bp, H. sapiens
cccaccacagcccatc

SEQ ID NO: 76399 - DNA, 16 bp, H. sapiens
cccaccacagccttcc

SEQ ID NO: 76400 - DNA, 16 bp, H. sapiens
cccaccaccaccatgg

SEQ ID NO: 76401 - DNA, 16 bp, H. sapiens
cccaccaccactcctg

SEQ ID NO: 76402 - DNA, 16 bp, H. sapiens
cccaccaccatatctg

SEQ ID NO: 76403 - DNA, 17 bp, H. sapiens
cccaccaccatgtccgg

SEQ ID NO: 76404 - DNA, 16 bp, H. sapiens
cccaccaccgcacctg

SEQ ID NO: 76405 - DNA, 16 bp, H. sapiens
cccaccaccttgccca

SEQ ID NO: 76406 - DNA, 16 bp, H. sapiens
cccaccaccttgctcc

SEQ ID NO: 76407 - DNA, 16 bp, H. sapiens
cccaccacgacgcctg

SEQ ID NO: 76408 - DNA, 16 bp, H. sapiens
cccaccacgatgccca

SEQ ID NO: 76409 - DNA, 16 bp, H. sapiens
cccaccacgccaggct

SEQ ID NO: 76410 - DNA, 16 bp, H. sapiens
cccaccactgccacca

SEQ ID NO: 76411 - DNA, 16 bp, H. sapiens
cccaccactgccactg

SEQ ID NO: 76412 - DNA, 16 bp, H. sapiens
cccaccagaagcagat

SEQ ID NO: 76413 - DNA, 16 bp, H. sapiens
cccaccagatgccagc

SEQ ID NO: 76414 - DNA, 16 bp, H. sapiens
cccaccagattcctcc

SEQ ID NO: 76415 - DNA, 16 bp, H. sapiens
cccaccagcaagaagg

SEQ ID NO: 76416 - DNA, 16 bp, H. sapiens
cccaccagcagtgtat

SEQ ID NO: 76417 - DNA, 16 bp, H. sapiens
cccaccaggccccact

SEQ ID NO: 76418 - DNA, 16 bp, H. sapiens
cccaccaggcctcacc

SEQ ID NO: 76419 - DNA, 17 bp, H. sapiens
cccaccagggccctggg

SEQ ID NO: 76420 - DNA, 16 bp, H. sapiens
cccaccaggtccatcc

SEQ ID NO: 76421 - DNA, 16 bp, H. sapiens
cccaccaggtcccttt

SEQ ID NO: 76422 - DNA, 16 bp, H. sapiens
cccaccaggtcctccc

SEQ ID NO: 76423 - DNA, 16 bp, H. sapiens
cccaccaggtcctgcc

SEQ ID NO: 76424 - DNA, 16 bp, H. sapiens
cccaccataaatcaca

SEQ ID NO: 76425 - DNA, 16 bp, H. sapiens
cccaccatctcagccc

SEQ ID NO: 76426 - DNA, 16 bp, H. sapiens
cccaccatctgggaag

SEQ ID NO: 76427 - DNA, 16 bp, H. sapiens
cccaccatgcccagcc

SEQ ID NO: 76428 - DNA, 16 bp, H. sapiens
cccaccatgccccagg

SEQ ID NO: 76429 - DNA, 16 bp, H. sapiens
cccaccatggcctccc

SEQ ID NO: 76430 - DNA, 16 bp, H. sapiens
cccaccatggcctcct

SEQ ID NO: 76431 - DNA, 16 bp, H. sapiens
cccaccatgtgccagg

SEQ ID NO: 76432 - DNA, 16 bp, H. sapiens
cccaccattgccgagg

SEQ ID NO: 76433 - DNA, 16 bp, H. sapiens
cccacccacactgagg

SEQ ID NO: 76434 - DNA, 16 bp, H. sapiens
cccacccacagaggga

SEQ ID NO: 76435 - DNA, 16 bp, H. sapiens
cccacccacctgggcc

SEQ ID NO: 76436 - DNA, 23 bp, H. sapiens
cccacccagaactccagctggcc

SEQ ID NO: 76437 - DNA, 16 bp, H. sapiens
cccacccagaagcaga

SEQ ID NO: 76438 - DNA, 16 bp, H. sapiens
cccacccagacctgct

SEQ ID NO: 76439 - DNA, 16 bp, H. sapiens
cccacccagcctggcc

SEQ ID NO: 76440 - DNA, 16 bp, H. sapiens
cccacccaggctggag

SEQ ID NO: 76441 - DNA, 16 bp, H. sapiens
cccacccatggccacc

SEQ ID NO: 76442 - DNA, 16 bp, H. sapiens
cccaccccaatcccag

SEQ ID NO: 76443 - DNA, 16 bp, H. sapiens
cccaccccaccctggg

SEQ ID NO: 76444 - DNA, 16 bp, H. sapiens
cccaccccagagattc

SEQ ID NO: 76445 - DNA, 16 bp, H. sapiens
cccaccccagccctgg

SEQ ID NO: 76446 - DNA, 16 bp, H. sapiens
cccaccccagccttct

SEQ ID NO: 76447 - DNA, 16 bp, H. sapiens
cccacccccagagatt

SEQ ID NO: 76448 - DNA, 16 bp, H. sapiens
cccacccccagagttt

SEQ ID NO: 76449 - DNA, 16 bp, H. sapiens
cccacccccagcctgg

SEQ ID NO: 76450 - DNA, 16 bp, H. sapiens
cccacccccagctctg

SEQ ID NO: 76451 - DNA, 16 bp, H. sapiens
cccacccctgcacaca

SEQ ID NO: 76452 - DNA, 16 bp, H. sapiens
cccacccctgccaggc

SEQ ID NO: 76453 - DNA, 16 bp, H. sapiens
cccaccctagcctttt

SEQ ID NO: 76454 - DNA, 16 bp, H. sapiens
cccaccctcatggagc

SEQ ID NO: 76455 - DNA, 16 bp, H. sapiens
cccaccctccaaagtc

SEQ ID NO: 76456 - DNA, 16 bp, H. sapiens
cccaccctctggtaac

SEQ ID NO: 76457 - DNA, 16 bp, H. sapiens
cccaccctctgtgggc

SEQ ID NO: 76458 - DNA, 16 bp, H. sapiens
cccaccctggcctctc

SEQ ID NO: 76459 - DNA, 16 bp, H. sapiens
cccaccctgtgtccac

SEQ ID NO: 76460 - DNA, 16 bp, H. sapiens
cccacccttctgagtc

SEQ ID NO: 76461 - DNA, 17 bp, H. sapiens
cccacccttgagaatgt

SEQ ID NO: 76462 - DNA, 16 bp, H. sapiens
cccaccgcaacctcca

SEQ ID NO: 76463 - DNA, 16 bp, H. sapiens
cccaccgccatgcctg

SEQ ID NO: 76464 - DNA, 16 bp, H. sapiens
cccaccgccccgtctg

SEQ ID NO: 76465 - DNA, 16 bp, H. sapiens
cccaccgggtccctcc

SEQ ID NO: 76466 - DNA, 16 bp, H. sapiens
cccacctaggcctccc

SEQ ID NO: 76467 - DNA, 16 bp, H. sapiens
cccacctcagactccc

SEQ ID NO: 76468 - DNA, 16 bp, H. sapiens
cccacctcagcatctc

SEQ ID NO: 76469 - DNA, 16 bp, H. sapiens
cccacctcagccatcc

SEQ ID NO: 76470 - DNA, 16 bp, H. sapiens
cccacctcagcccagc

SEQ ID NO: 76471 - DNA, 16 bp, H. sapiens
cccacctcagccctct

SEQ ID NO: 76472 - DNA, 16 bp, H. sapiens
cccacctcagcccttc

SEQ ID NO: 76473 - DNA, 16 bp, H. sapiens
cccacctcagcctacc

SEQ ID NO: 76474 - DNA, 16 bp, H. sapiens
cccacctcagcctccg

SEQ ID NO: 76475 - DNA, 16 bp, H. sapiens
cccacctcagcttccc

SEQ ID NO: 76476 - DNA, 16 bp, H. sapiens
cccacctcaggacctt

SEQ ID NO: 76477 - DNA, 16 bp, H. sapiens
cccacctcaggcccct

SEQ ID NO: 76478 - DNA, 16 bp, H. sapiens
cccacctcaggcctcc

SEQ ID NO: 76479 - DNA, 16 bp, H. sapiens
cccacctcaggctccc

SEQ ID NO: 76480 - DNA, 16 bp, H. sapiens
cccacctcaggctcct

SEQ ID NO: 76481 - DNA, 16 bp, H. sapiens
cccacctcagggcctt

SEQ ID NO: 76482 - DNA, 16 bp, H. sapiens
cccacctcagtctcca

SEQ ID NO: 76483 - DNA, 16 bp, H. sapiens
cccacctccaacaatg

SEQ ID NO: 76484 - DNA, 16 bp, H. sapiens
cccacctccaacactg

SEQ ID NO: 76485 - DNA, 16 bp, H. sapiens
cccacctccatgcctt

SEQ ID NO: 76486 - DNA, 16 bp, H. sapiens
cccacctccatttcta

SEQ ID NO: 76487 - DNA, 16 bp, H. sapiens
cccacctcccaagtag

SEQ ID NO: 76488 - DNA, 16 bp, H. sapiens
cccacctccctcctgg

SEQ ID NO: 76489 - DNA, 16 bp, H. sapiens
cccacctccctggggc

SEQ ID NO: 76490 - DNA, 16 bp, H. sapiens
cccacctcctcagttg

SEQ ID NO: 76491 - DNA, 16 bp, H. sapiens
cccacctcctgacagg

SEQ ID NO: 76492 - DNA, 16 bp, H. sapiens
cccacctcctgcctct

SEQ ID NO: 76493 - DNA, 16 bp, H. sapiens
cccacctcctgggctc

SEQ ID NO: 76494 - DNA, 16 bp, H. sapiens
cccacctcctggtatt

SEQ ID NO: 76495 - DNA, 16 bp, H. sapiens
cccacctccttcctgg

SEQ ID NO: 76496 - DNA, 16 bp, H. sapiens
cccacctcggcctcct

SEQ ID NO: 76497 - DNA, 16 bp, H. sapiens
cccacctcggtctcct

SEQ ID NO: 76498 - DNA, 16 bp, H. sapiens
cccacctctaaaaaaa

SEQ ID NO: 76499 - DNA, 16 bp, H. sapiens
cccacctctacagaaa

SEQ ID NO: 76500 - DNA, 16 bp, H. sapiens
cccacctctcagcctc

SEQ ID NO: 76501 - DNA, 16 bp, H. sapiens
cccacctctccacctg

SEQ ID NO: 76502 - DNA, 16 bp, H. sapiens
cccacctctgccacca

SEQ ID NO: 76503 - DNA, 16 bp, H. sapiens
cccacctctgcctcct

SEQ ID NO: 76504 - DNA, 16 bp, H. sapiens
cccacctctgcctgcc

SEQ ID NO: 76505 - DNA, 16 bp, H. sapiens
cccacctgaggctcag

SEQ ID NO: 76506 - DNA, 16 bp, H. sapiens
cccacctgatcatggt

SEQ ID NO: 76507 - DNA, 16 bp, H. sapiens
cccacctgcctccctg

SEQ ID NO: 76508 - DNA, 16 bp, H. sapiens
cccacctgcctcggcc

SEQ ID NO: 76509 - DNA, 16 bp, H. sapiens
cccacctgcctctgcc

SEQ ID NO: 76510 - DNA, 16 bp, H. sapiens
cccacctgcctgccca

SEQ ID NO: 76511 - DNA, 17 bp, H. sapiens
cccacctgccttggcct

SEQ ID NO: 76512 - DNA, 16 bp, H. sapiens
cccacctgcgcctctc

SEQ ID NO: 76513 - DNA, 16 bp, H. sapiens
cccacctgctgctccc

SEQ ID NO: 76514 - DNA, 16 bp, H. sapiens
cccacctggagtccca

SEQ ID NO: 76515 - DNA, 16 bp, H. sapiens
cccacctggctaattt

SEQ ID NO: 76516 - DNA, 16 bp, H. sapiens
cccacctgggcaacaa

SEQ ID NO: 76517 - DNA, 16 bp, H. sapiens
cccacctgggccacag

SEQ ID NO: 76518 - DNA, 16 bp, H. sapiens
cccacctgggcctcac

SEQ ID NO: 76519 - DNA, 16 bp, H. sapiens
cccacctgtacagtgc

SEQ ID NO: 76520 - DNA, 16 bp, H. sapiens
cccaccttcctcctgc

SEQ ID NO: 76521 - DNA, 16 bp, H. sapiens
cccaccttggcatccc

SEQ ID NO: 76522 - DNA, 16 bp, H. sapiens
cccaccttggccccca

SEQ ID NO: 76523 - DNA, 16 bp, H. sapiens
cccaccttggccctcc

SEQ ID NO: 76524 - DNA, 16 bp, H. sapiens
cccaccttggcctccg

SEQ ID NO: 76525 - DNA, 16 bp, H. sapiens
cccaccttggcctcct

SEQ ID NO: 76526 - DNA, 16 bp, H. sapiens
cccaccttgtcttccc

SEQ ID NO: 76527 - DNA, 16 bp, H. sapiens
cccacctttactaaaa

SEQ ID NO: 76528 - DNA, 18 bp, H. sapiens
cccacgaaatgcttaaaa

SEQ ID NO: 76529 - DNA, 19 bp, H. sapiens
cccacgcccagctaatttt

SEQ ID NO: 76530 - DNA, 16 bp, H. sapiens
cccacgctcaagtgat

SEQ ID NO: 76531 - DNA, 16 bp, H. sapiens
cccacgctggagtgca

SEQ ID NO: 76532 - DNA, 16 bp, H. sapiens
cccacgctggcctccc

SEQ ID NO: 76533 - DNA, 16 bp, H. sapiens
cccacggggcagggct

SEQ ID NO: 76534 - DNA, 16 bp, H. sapiens
cccacggtctccctct

SEQ ID NO: 76535 - DNA, 16 bp, H. sapiens
cccactaccacacctg

SEQ ID NO: 76536 - DNA, 16 bp, H. sapiens
cccactagctgtgtga

SEQ ID NO: 76537 - DNA, 16 bp, H. sapiens
cccactcatccatcca

SEQ ID NO: 76538 - DNA, 16 bp, H. sapiens
cccactcatgagggct

SEQ ID NO: 76539 - DNA, 16 bp, H. sapiens
cccactccagccccag

SEQ ID NO: 76540 - DNA, 16 bp, H. sapiens
cccactccagcctggg

SEQ ID NO: 76541 - DNA, 17 bp, H. sapiens
cccactccctcagcttg

SEQ ID NO: 76542 - DNA, 16 bp, H. sapiens
cccactcctcagtacc

SEQ ID NO: 76543 - DNA, 16 bp, H. sapiens
cccactcctgccctgc

SEQ ID NO: 76544 - DNA, 16 bp, H. sapiens
cccactctacagatga

SEQ ID NO: 76545 - DNA, 16 bp, H. sapiens
cccactctcagtacca

SEQ ID NO: 76546 - DNA, 16 bp, H. sapiens
cccactctcctgcctc

SEQ ID NO: 76547 - DNA, 16 bp, H. sapiens
cccactctgtccccca

SEQ ID NO: 76548 - DNA, 16 bp, H. sapiens
cccactgacctgcacc

SEQ ID NO: 76549 - DNA, 16 bp, H. sapiens
cccactgagcaccttg

SEQ ID NO: 76550 - DNA, 17 bp, H. sapiens
cccactgcactccagct

SEQ ID NO: 76551 - DNA, 16 bp, H. sapiens
cccactgcagccagca

SEQ ID NO: 76552 - DNA, 16 bp, H. sapiens
cccactgccaccacca

SEQ ID NO: 76553 - DNA, 16 bp, H. sapiens
cccactgccctgcaca

SEQ ID NO: 76554 - DNA, 16 bp, H. sapiens
cccactgcccttccca

SEQ ID NO: 76555 - DNA, 16 bp, H. sapiens
cccactgcctcagcct

SEQ ID NO: 76556 - DNA, 16 bp, H. sapiens
cccactgcctggcaca

SEQ ID NO: 76557 - DNA, 16 bp, H. sapiens
cccactgcctgtttct

SEQ ID NO: 76558 - DNA, 16 bp, H. sapiens
cccactgctgccacca

SEQ ID NO: 76559 - DNA, 16 bp, H. sapiens
cccactgctgctgctg

SEQ ID NO: 76560 - DNA, 16 bp, H. sapiens
cccactggttccctcc

SEQ ID NO: 76561 - DNA, 16 bp, H. sapiens
cccactgtcaccactg

SEQ ID NO: 76562 - DNA, 16 bp, H. sapiens
cccactgtctcagccc

SEQ ID NO: 76563 - DNA, 16 bp, H. sapiens
cccactgtctgacact

SEQ ID NO: 76564 - DNA, 33 bp, H. sapiens
cccactgtctggcactccctagtgagatgaacc

SEQ ID NO: 76565 - DNA, 16 bp, H. sapiens
cccactgtctgggaag

SEQ ID NO: 76566 - DNA, 16 bp, H. sapiens
cccactgtctgttttt

SEQ ID NO: 76567 - DNA, 16 bp, H. sapiens
cccacttcacaggtga

SEQ ID NO: 76568 - DNA, 16 bp, H. sapiens
cccacttcagccccct

SEQ ID NO: 76569 - DNA, 16 bp, H. sapiens
cccacttcagcctccc

SEQ ID NO: 76570 - DNA, 16 bp, H. sapiens
cccacttgcagcctcc

SEQ ID NO: 76571 - DNA, 16 bp, H. sapiens
cccacttggaaggaca

SEQ ID NO: 76572 - DNA, 16 bp, H. sapiens
cccactttatagataa

SEQ ID NO: 76573 - DNA, 16 bp, H. sapiens
cccactttgccttcca

SEQ ID NO: 76574 - DNA, 16 bp, H. sapiens
cccactttggcatccc

SEQ ID NO: 76575 - DNA, 16 bp, H. sapiens
cccactttggcctccc

SEQ ID NO: 76576 - DNA, 16 bp, H. sapiens
cccactttgttctttt

SEQ ID NO: 76577 - DNA, 16 bp, H. sapiens
cccactttttattggg

SEQ ID NO: 76578 - DNA, 16 bp, H. sapiens
cccactttttgatggg

SEQ ID NO: 76579 - DNA, 16 bp, H. sapiens
cccactttttgctggg

SEQ ID NO: 76580 - DNA, 16 bp, H. sapiens
cccagaaaaccctaaa

SEQ ID NO: 76581 - DNA, 16 bp, H. sapiens
cccagaaaactgcagc

SEQ ID NO: 76582 - DNA, 16 bp, H. sapiens
cccagaaaatgagttt

SEQ ID NO: 76583 - DNA, 16 bp, H. sapiens
cccagaaacagaccca

SEQ ID NO: 76584 - DNA, 16 bp, H. sapiens
cccagaaactcaggag

SEQ ID NO: 76585 - DNA, 16 bp, H. sapiens
cccagaaagttgaggc

SEQ ID NO: 76586 - DNA, 16 bp, H. sapiens
cccagaaataaacaat

SEQ ID NO: 76587 - DNA, 16 bp, H. sapiens
cccagaaataaagcta

SEQ ID NO: 76588 - DNA, 16 bp, H. sapiens
cccagaaataagacca

SEQ ID NO: 76589 - DNA, 16 bp, H. sapiens
cccagaaatttgaggc

SEQ ID NO: 76590 - DNA, 16 bp, H. sapiens
cccagaaccaaagcca

SEQ ID NO: 76591 - DNA, 16 bp, H. sapiens
cccagaaccatttatt

SEQ ID NO: 76592 - DNA, 16 bp, H. sapiens
cccagaacctggcaca

SEQ ID NO: 76593 - DNA, 16 bp, H. sapiens
cccagaacttcatatc

SEQ ID NO: 76594 - DNA, 16 bp, H. sapiens
cccagaacttggggag

SEQ ID NO: 76595 - DNA, 16 bp, H. sapiens
cccagaacttttggga

SEQ ID NO: 76596 - DNA, 16 bp, H. sapiens
cccagaagaagatggc

SEQ ID NO: 76597 - DNA, 16 bp, H. sapiens
cccagaagaaggagca

SEQ ID NO: 76598 - DNA, 16 bp, H. sapiens
cccagaagcagatgcc

SEQ ID NO: 76599 - DNA, 16 bp, H. sapiens
cccagaagcccagcag

SEQ ID NO: 76600 - DNA, 16 bp, H. sapiens
cccagaagcccccagc

SEQ ID NO: 76601 - DNA, 16 bp, H. sapiens
cccagaagcttggaga

SEQ ID NO: 76602 - DNA, 16 bp, H. sapiens
cccagaaggagaagag

SEQ ID NO: 76603 - DNA, 16 bp, H. sapiens
cccagaaggccaaggc

SEQ ID NO: 76604 - DNA, 16 bp, H. sapiens
cccagaaggtcaagac

SEQ ID NO: 76605 - DNA, 16 bp, H. sapiens
cccagaaggtggagct

SEQ ID NO: 76606 - DNA, 16 bp, H. sapiens
cccagaaggtggaggt

SEQ ID NO: 76607 - DNA, 16 bp, H. sapiens
cccagaagttatttct

SEQ ID NO: 76608 - DNA, 16 bp, H. sapiens
cccagaagttcaaagc

SEQ ID NO: 76609 - DNA, 16 bp, H. sapiens
cccagaagttggagac

SEQ ID NO: 76610 - DNA, 16 bp, H. sapiens
cccagaataatatttg

SEQ ID NO: 76611 - DNA, 16 bp, H. sapiens
cccagaatagccaaag

SEQ ID NO: 76612 - DNA, 16 bp, H. sapiens
cccagaatctctggga

SEQ ID NO: 76613 - DNA, 16 bp, H. sapiens
cccagaattcccacct

SEQ ID NO: 76614 - DNA, 16 bp, H. sapiens
cccagaattcccacgt

SEQ ID NO: 76615 - DNA, 16 bp, H. sapiens
cccagaccaggacagc

SEQ ID NO: 76616 - DNA, 16 bp, H. sapiens
cccagacccttcagga

SEQ ID NO: 76617 - DNA, 17 bp, H. sapiens
cccagacggggcggctg

SEQ ID NO: 76618 - DNA, 16 bp, H. sapiens
cccagactagagtgca

SEQ ID NO: 76619 - DNA, 16 bp, H. sapiens
cccagactcagcctca

SEQ ID NO: 76620 - DNA, 16 bp, H. sapiens
cccagactcaggtatg

SEQ ID NO: 76621 - DNA, 16 bp, H. sapiens
cccagactccaggctg

SEQ ID NO: 76622 - DNA, 16 bp, H. sapiens
cccagactcctgggct

SEQ ID NO: 76623 - DNA, 16 bp, H. sapiens
cccagactcttttttt

SEQ ID NO: 76624 - DNA, 16 bp, H. sapiens
cccagactggaatgca

SEQ ID NO: 76625 - DNA, 16 bp, H. sapiens
cccagactggagtaca

SEQ ID NO: 76626 - DNA, 16 bp, H. sapiens
cccagactggagtgca

SEQ ID NO: 76627 - DNA, 16 bp, H. sapiens
cccagactggagttca

SEQ ID NO: 76628 - DNA, 16 bp, H. sapiens
cccagactggccttga

SEQ ID NO: 76629 - DNA, 16 bp, H. sapiens
cccagactggtcttca

SEQ ID NO: 76630 - DNA, 16 bp, H. sapiens
cccagacttctgacct

SEQ ID NO: 76631 - DNA, 16 bp, H. sapiens
cccagacttggagctg

SEQ ID NO: 76632 - DNA, 16 bp, H. sapiens
cccagactttaccact

SEQ ID NO: 76633 - DNA, 16 bp, H. sapiens
cccagagaaacctgaa

SEQ ID NO: 76634 - DNA, 16 bp, H. sapiens
cccagagacacaaaac

SEQ ID NO: 76635 - DNA, 16 bp, H. sapiens
cccagagaccagaccc

SEQ ID NO: 76636 - DNA, 16 bp, H. sapiens
cccagagagacagaga

SEQ ID NO: 76637 - DNA, 16 bp, H. sapiens
cccagagagctgcctc

SEQ ID NO: 76638 - DNA, 16 bp, H. sapiens
cccagagaggaggaag

SEQ ID NO: 76639 - DNA, 16 bp, H. sapiens
cccagagaggtgaagg

SEQ ID NO: 76640 - DNA, 16 bp, H. sapiens
cccagagaggttaagt

SEQ ID NO: 76641 - DNA, 16 bp, H. sapiens
cccagagcactttagc

SEQ ID NO: 76642 - DNA, 16 bp, H. sapiens
cccagagcagcagcag

SEQ ID NO: 76643 - DNA, 16 bp, H. sapiens
cccagagcagcagctc

SEQ ID NO: 76644 - DNA, 16 bp, H. sapiens
cccagagcagcctctg

SEQ ID NO: 76645 - DNA, 16 bp, H. sapiens
cccagagcaggtccag

SEQ ID NO: 76646 - DNA, 16 bp, H. sapiens
cccagagcccagccct

SEQ ID NO: 76647 - DNA, 16 bp, H. sapiens
cccagagcccaggagg

SEQ ID NO: 76648 - DNA, 16 bp, H. sapiens
cccagagcccaggcca

SEQ ID NO: 76649 - DNA, 16 bp, H. sapiens
cccagagcccaggctc

SEQ ID NO: 76650 - DNA, 16 bp, H. sapiens
cccagagcctcagttt

SEQ ID NO: 76651 - DNA, 16 bp, H. sapiens
cccagagcctccagat

SEQ ID NO: 76652 - DNA, 16 bp, H. sapiens
cccagagcctggcaga

SEQ ID NO: 76653 - DNA, 16 bp, H. sapiens
cccagagctctgggag

SEQ ID NO: 76654 - DNA, 16 bp, H. sapiens
cccagagctttgggag

SEQ ID NO: 76655 - DNA, 16 bp, H. sapiens
cccagaggaaaagaaa

SEQ ID NO: 76656 - DNA, 16 bp, H. sapiens
cccagaggagcagcag

SEQ ID NO: 76657 - DNA, 16 bp, H. sapiens
cccagaggcagaagcc

SEQ ID NO: 76658 - DNA, 16 bp, H. sapiens
cccagaggcccagctg

SEQ ID NO: 76659 - DNA, 16 bp, H. sapiens
cccagaggccccacct

SEQ ID NO: 76660 - DNA, 16 bp, H. sapiens
cccagagggagctcat

SEQ ID NO: 76661 - DNA, 16 bp, H. sapiens
cccagagggctgctgg

SEQ ID NO: 76662 - DNA, 16 bp, H. sapiens
cccagaggggcagcca

SEQ ID NO: 76663 - DNA, 16 bp, H. sapiens
cccagaggtaaccact

SEQ ID NO: 76664 - DNA, 16 bp, H. sapiens
cccagagtatgatatt

SEQ ID NO: 76665 - DNA, 16 bp, H. sapiens
cccagagtgcagtggc

SEQ ID NO: 76666 - DNA, 16 bp, H. sapiens
cccagagtttctgact

SEQ ID NO: 76667 - DNA, 16 bp, H. sapiens
cccagatacctgggag

SEQ ID NO: 76668 - DNA, 16 bp, H. sapiens
cccagatccagccact

SEQ ID NO: 76669 - DNA, 16 bp, H. sapiens
cccagatcttgatttc

SEQ ID NO: 76670 - DNA, 16 bp, H. sapiens
cccagatgattctaat

SEQ ID NO: 76671 - DNA, 16 bp, H. sapiens
cccagatggcctgaag

SEQ ID NO: 76672 - DNA, 16 bp, H. sapiens
cccagatggggcagcc

SEQ ID NO: 76673 - DNA, 16 bp, H. sapiens
cccagatgtcaaagca

SEQ ID NO: 76674 - DNA, 16 bp, H. sapiens
cccagatgttctttgt

SEQ ID NO: 76675 - DNA, 16 bp, H. sapiens
cccagattcaagggat

SEQ ID NO: 76676 - DNA, 16 bp, H. sapiens
cccagattgagggtgg

SEQ ID NO: 76677 - DNA, 16 bp, H. sapiens
cccagattgccagctc

SEQ ID NO: 76678 - DNA, 16 bp, H. sapiens
cccagattttggtttc

SEQ ID NO: 76679 - DNA, 16 bp, H. sapiens
cccagcaaagccacag

SEQ ID NO: 76680 - DNA, 16 bp, H. sapiens
cccagcaaagccatgg

SEQ ID NO: 76681 - DNA, 16 bp, H. sapiens
cccagcaacagtgtaa

SEQ ID NO: 76682 - DNA, 16 bp, H. sapiens
cccagcaaccactgat

SEQ ID NO: 76683 - DNA, 16 bp, H. sapiens
cccagcaagaaactca

SEQ ID NO: 76684 - DNA, 16 bp, H. sapiens
cccagcacacagcagg

SEQ ID NO: 76685 - DNA, 16 bp, H. sapiens
cccagcacacagtagg

SEQ ID NO: 76686 - DNA, 16 bp, H. sapiens
cccagcacactgcctg

SEQ ID NO: 76687 - DNA, 16 bp, H. sapiens
cccagcacagcacagc

SEQ ID NO: 76688 - DNA, 16 bp, H. sapiens
cccagcacagcccctg

SEQ ID NO: 76689 - DNA, 16 bp, H. sapiens
cccagcacaggcccag

SEQ ID NO: 76690 - DNA, 16 bp, H. sapiens
cccagcacaggcctgg

SEQ ID NO: 76691 - DNA, 16 bp, H. sapiens
cccagcacagtgcctg

SEQ ID NO: 76692 - DNA, 16 bp, H. sapiens
cccagcacagtgtctg

SEQ ID NO: 76693 - DNA, 16 bp, H. sapiens
cccagcacagttaccc

SEQ ID NO: 76694 - DNA, 16 bp, H. sapiens
cccagcacatagtaaa

SEQ ID NO: 76695 - DNA, 16 bp, H. sapiens
cccagcaccacacctg

SEQ ID NO: 76696 - DNA, 16 bp, H. sapiens
cccagcaccatctgtt

SEQ ID NO: 76697 - DNA, 16 bp, H. sapiens
cccagcacctccatgt

SEQ ID NO: 76698 - DNA, 16 bp, H. sapiens
cccagcacctgggagg

SEQ ID NO: 76699 - DNA, 16 bp, H. sapiens
cccagcactctgagaa

SEQ ID NO: 76700 - DNA, 16 bp, H. sapiens
cccagcactgcaggag

SEQ ID NO: 76701 - DNA, 16 bp, H. sapiens
cccagcactgccagcc

SEQ ID NO: 76702 - DNA, 16 bp, H. sapiens
cccagcactgtgcctg

SEQ ID NO: 76703 - DNA, 16 bp, H. sapiens
cccagcactgtggcag

SEQ ID NO: 76704 - DNA, 16 bp, H. sapiens
cccagcactgtggggg

SEQ ID NO: 76705 - DNA, 16 bp, H. sapiens
cccagcacttcggcag

SEQ ID NO: 76706 - DNA, 16 bp, H. sapiens
cccagcactttcgggg

SEQ ID NO: 76707 - DNA, 16 bp, H. sapiens
cccagcactttgaggg

SEQ ID NO: 76708 - DNA, 16 bp, H. sapiens
cccagcagaagaaaat

SEQ ID NO: 76709 - DNA, 16 bp, H. sapiens
cccagcagaggctgtg

SEQ ID NO: 76710 - DNA, 16 bp, H. sapiens
cccagcagcagccatg

SEQ ID NO: 76711 - DNA, 16 bp, H. sapiens
cccagcagcagtgttt

SEQ ID NO: 76712 - DNA, 16 bp, H. sapiens
cccagcagccactccc

SEQ ID NO: 76713 - DNA, 16 bp, H. sapiens
cccagcagccagaggg

SEQ ID NO: 76714 - DNA, 16 bp, H. sapiens
cccagcagcccagctg

SEQ ID NO: 76715 - DNA, 16 bp, H. sapiens
cccagcagccctgcct

SEQ ID NO: 76716 - DNA, 16 bp, H. sapiens
cccagcagctccagct

SEQ ID NO: 76717 - DNA, 16 bp, H. sapiens
cccagcagctggggct

SEQ ID NO: 76718 - DNA, 16 bp, H. sapiens
cccagcaggacatgga

SEQ ID NO: 76719 - DNA, 16 bp, H. sapiens
cccagcaggcagaggt

SEQ ID NO: 76720 - DNA, 16 bp, H. sapiens
cccagcaggcaggagg

SEQ ID NO: 76721 - DNA, 16 bp, H. sapiens
cccagcaggccctggg

SEQ ID NO: 76722 - DNA, 16 bp, H. sapiens
cccagcaggcctgagc

SEQ ID NO: 76723 - DNA, 16 bp, H. sapiens
cccagcaggctgaggc

SEQ ID NO: 76724 - DNA, 16 bp, H. sapiens
cccagcaggctgtgct

SEQ ID NO: 76725 - DNA, 16 bp, H. sapiens
cccagcagggccaggg

SEQ ID NO: 76726 - DNA, 16 bp, H. sapiens
cccagcagtgctggcc

SEQ ID NO: 76727 - DNA, 16 bp, H. sapiens
cccagcagtggctgca

SEQ ID NO: 76728 - DNA, 16 bp, H. sapiens
cccagcagttcgagac

SEQ ID NO: 76729 - DNA, 16 bp, H. sapiens
cccagcagttggggag

SEQ ID NO: 76730 - DNA, 16 bp, H. sapiens
cccagcatgagcgaca

SEQ ID NO: 76731 - DNA, 16 bp, H. sapiens
cccagcatggggcctg

SEQ ID NO: 76732 - DNA, 16 bp, H. sapiens
cccagcattatgggag

SEQ ID NO: 76733 - DNA, 16 bp, H. sapiens
cccagccaaaccatat

SEQ ID NO: 76734 - DNA, 16 bp, H. sapiens
cccagccaaactcctc

SEQ ID NO: 76735 - DNA, 16 bp, H. sapiens
cccagccaagcccagc

SEQ ID NO: 76736 - DNA, 16 bp, H. sapiens
cccagccaagcccagg

SEQ ID NO: 76737 - DNA, 16 bp, H. sapiens
cccagccaatgactga

SEQ ID NO: 76738 - DNA, 16 bp, H. sapiens
cccagccaatttctgt

SEQ ID NO: 76739 - DNA, 16 bp, H. sapiens
cccagccacacctggc

SEQ ID NO: 76740 - DNA, 16 bp, H. sapiens
cccagccacactggcc

SEQ ID NO: 76741 - DNA, 16 bp, H. sapiens
cccagccaccatgctg

SEQ ID NO: 76742 - DNA, 16 bp, H. sapiens
cccagccacccagcct

SEQ ID NO: 76743 - DNA, 16 bp, H. sapiens
cccagccactccagcc

SEQ ID NO: 76744 - DNA, 16 bp, H. sapiens
cccagccactctggag

SEQ ID NO: 76745 - DNA, 16 bp, H. sapiens
cccagccacttgggaa

SEQ ID NO: 76746 - DNA, 16 bp, H. sapiens
cccagccacttgggag

SEQ ID NO: 76747 - DNA, 16 bp, H. sapiens
cccagccagaagccag

SEQ ID NO: 76748 - DNA, 17 bp, H. sapiens
cccagccagcagcagca

SEQ ID NO: 76749 - DNA, 16 bp, H. sapiens
cccagccagccaagcc

SEQ ID NO: 76750 - DNA, 16 bp, H. sapiens
cccagccagccccagg

SEQ ID NO: 76751 - DNA, 16 bp, H. sapiens
cccagccagctcccag

SEQ ID NO: 76752 - DNA, 16 bp, H. sapiens
cccagccagctgcccc

SEQ ID NO: 76753 - DNA, 16 bp, H. sapiens
cccagccaggccccag

SEQ ID NO: 76754 - DNA, 16 bp, H. sapiens
cccagccaggccctgg

SEQ ID NO: 76755 - DNA, 16 bp, H. sapiens
cccagccaggcctggg

SEQ ID NO: 76756 - DNA, 16 bp, H. sapiens
cccagccaggcgcggt

SEQ ID NO: 76757 - DNA, 16 bp, H. sapiens
cccagccaggctgtga

SEQ ID NO: 76758 - DNA, 16 bp, H. sapiens
cccagccaggcttcct

SEQ ID NO: 76759 - DNA, 16 bp, H. sapiens
cccagccaggtgcggg

SEQ ID NO: 76760 - DNA, 16 bp, H. sapiens
cccagccatgctggca

SEQ ID NO: 76761 - DNA, 16 bp, H. sapiens
cccagccatttgggag

SEQ ID NO: 76762 - DNA, 16 bp, H. sapiens
cccagcccactgccac

SEQ ID NO: 76763 - DNA, 16 bp, H. sapiens
cccagcccactgggag

SEQ ID NO: 76764 - DNA, 16 bp, H. sapiens
cccagcccagaatttt

SEQ ID NO: 76765 - DNA, 16 bp, H. sapiens
cccagcccagcccagg

SEQ ID NO: 76766 - DNA, 16 bp, H. sapiens
cccagcccagcccatc

SEQ ID NO: 76767 - DNA, 16 bp, H. sapiens
cccagcccagcccctg

SEQ ID NO: 76768 - DNA, 16 bp, H. sapiens
cccagcccagccctgc

SEQ ID NO: 76769 - DNA, 16 bp, H. sapiens
cccagcccagccctgg

SEQ ID NO: 76770 - DNA, 16 bp, H. sapiens
cccagcccagcccttc

SEQ ID NO: 76771 - DNA, 16 bp, H. sapiens
cccagcccagcctctt

SEQ ID NO: 76772 - DNA, 16 bp, H. sapiens
cccagcccagcctgcc

SEQ ID NO: 76773 - DNA, 16 bp, H. sapiens
cccagcccagcctggc

SEQ ID NO: 76774 - DNA, 16 bp, H. sapiens
cccagcccagctctag

SEQ ID NO: 76775 - DNA, 16 bp, H. sapiens
cccagcccaggccagc

SEQ ID NO: 76776 - DNA, 16 bp, H. sapiens
cccagcccaggccctg

SEQ ID NO: 76777 - DNA, 16 bp, H. sapiens
cccagcccagggccag

SEQ ID NO: 76778 - DNA, 16 bp, H. sapiens
cccagcccagggcctg

SEQ ID NO: 76779 - DNA, 16 bp, H. sapiens
cccagcccagggctcc

SEQ ID NO: 76780 - DNA, 16 bp, H. sapiens
cccagcccagggctct

SEQ ID NO: 76781 - DNA, 16 bp, H. sapiens
cccagcccagggctgg

SEQ ID NO: 76782 - DNA, 16 bp, H. sapiens
cccagcccagtgctct

SEQ ID NO: 76783 - DNA, 16 bp, H. sapiens
cccagcccatggggga

SEQ ID NO: 76784 - DNA, 16 bp, H. sapiens
cccagccccaccactg

SEQ ID NO: 76785 - DNA, 16 bp, H. sapiens
cccagccccacctctg

SEQ ID NO: 76786 - DNA, 16 bp, H. sapiens
cccagccccaccttca

SEQ ID NO: 76787 - DNA, 16 bp, H. sapiens
cccagccccagagctc

SEQ ID NO: 76788 - DNA, 16 bp, H. sapiens
cccagccccagcacag

SEQ ID NO: 76789 - DNA, 16 bp, H. sapiens
cccagccccagccaag

SEQ ID NO: 76790 - DNA, 16 bp, H. sapiens
cccagccccagcccta

SEQ ID NO: 76791 - DNA, 16 bp, H. sapiens
cccagccccagccctg

SEQ ID NO: 76792 - DNA, 16 bp, H. sapiens
cccagccccagctaat

SEQ ID NO: 76793 - DNA, 16 bp, H. sapiens
cccagccccaggcctg

SEQ ID NO: 76794 - DNA, 16 bp, H. sapiens
cccagccccaggctcc

SEQ ID NO: 76795 - DNA, 16 bp, H. sapiens
cccagccccagggagg

SEQ ID NO: 76796 - DNA, 16 bp, H. sapiens
cccagccccagggcca

SEQ ID NO: 76797 - DNA, 16 bp, H. sapiens
cccagccccatccctg

SEQ ID NO: 76798 - DNA, 16 bp, H. sapiens
cccagccccatcctct

SEQ ID NO: 76799 - DNA, 16 bp, H. sapiens
cccagcccccaacagg

SEQ ID NO: 76800 - DNA, 16 bp, H. sapiens
cccagcccccagcctg

SEQ ID NO: 76801 - DNA, 16 bp, H. sapiens
cccagcccccagcctt

SEQ ID NO: 76802 - DNA, 16 bp, H. sapiens
cccagcccccaggcct

SEQ ID NO: 76803 - DNA, 16 bp, H. sapiens
cccagcccccatcctg

SEQ ID NO: 76804 - DNA, 16 bp, H. sapiens
cccagcccctcccaaa

SEQ ID NO: 76805 - DNA, 16 bp, H. sapiens
cccagcccctcccagg

SEQ ID NO: 76806 - DNA, 16 bp, H. sapiens
cccagcccctctccag

SEQ ID NO: 76807 - DNA, 16 bp, H. sapiens
cccagcccctctcctg

SEQ ID NO: 76808 - DNA, 16 bp, H. sapiens
cccagcccctgcccag

SEQ ID NO: 76809 - DNA, 16 bp, H. sapiens
cccagcccctgccctg

SEQ ID NO: 76810 - DNA, 16 bp, H. sapiens
cccagcccctgctcca

SEQ ID NO: 76811 - DNA, 16 bp, H. sapiens
cccagcccctgctctg

SEQ ID NO: 76812 - DNA, 16 bp, H. sapiens
cccagcccctgctgct

SEQ ID NO: 76813 - DNA, 16 bp, H. sapiens
cccagcccctggaaac

SEQ ID NO: 76814 - DNA, 16 bp, H. sapiens
cccagcccctggcacc

SEQ ID NO: 76815 - DNA, 16 bp, H. sapiens
cccagcccctggcagc

SEQ ID NO: 76816 - DNA, 16 bp, H. sapiens
cccagcccctggccct

SEQ ID NO: 76817 - DNA, 16 bp, H. sapiens
cccagccccttctctc

SEQ ID NO: 76818 - DNA, 16 bp, H. sapiens
cccagccccttgggag

SEQ ID NO: 76819 - DNA, 16 bp, H. sapiens
cccagccctccttcct

SEQ ID NO: 76820 - DNA, 16 bp, H. sapiens
cccagccctctgcctg

SEQ ID NO: 76821 - DNA, 16 bp, H. sapiens
cccagccctgacccca

SEQ ID NO: 76822 - DNA, 16 bp, H. sapiens
cccagccctgacccct

SEQ ID NO: 76823 - DNA, 16 bp, H. sapiens
cccagccctgaccctg

SEQ ID NO: 76824 - DNA, 16 bp, H. sapiens
cccagccctgcagctg

SEQ ID NO: 76825 - DNA, 16 bp, H. sapiens
cccagccctgcaggga

SEQ ID NO: 76826 - DNA, 16 bp, H. sapiens
cccagccctgccacct

SEQ ID NO: 76827 - DNA, 16 bp, H. sapiens
cccagccctgccagcc

SEQ ID NO: 76828 - DNA, 16 bp, H. sapiens
cccagccctgccagct

SEQ ID NO: 76829 - DNA, 16 bp, H. sapiens
cccagccctgccaggc

SEQ ID NO: 76830 - DNA, 16 bp, H. sapiens
cccagccctgcccagc

SEQ ID NO: 76831 - DNA, 16 bp, H. sapiens
cccagccctgcccctg

SEQ ID NO: 76832 - DNA, 16 bp, H. sapiens
cccagccctgccctgc

SEQ ID NO: 76833 - DNA, 16 bp, H. sapiens
cccagccctgccctgg

SEQ ID NO: 76834 - DNA, 16 bp, H. sapiens
cccagccctgcccttc

SEQ ID NO: 76835 - DNA, 16 bp, H. sapiens
cccagccctgcctgcc

SEQ ID NO: 76836 - DNA, 16 bp, H. sapiens
cccagccctgccttcc

SEQ ID NO: 76837 - DNA, 16 bp, H. sapiens
cccagccctgctcctg

SEQ ID NO: 76838 - DNA, 16 bp, H. sapiens
cccagccctgctgcag

SEQ ID NO: 76839 - DNA, 16 bp, H. sapiens
cccagccctgctgccc

SEQ ID NO: 76840 - DNA, 16 bp, H. sapiens
cccagccctgctgcct

SEQ ID NO: 76841 - DNA, 16 bp, H. sapiens
cccagccctgcttcct

SEQ ID NO: 76842 - DNA, 16 bp, H. sapiens
cccagccctggcacag

SEQ ID NO: 76843 - DNA, 16 bp, H. sapiens
cccagccctggcaccc

SEQ ID NO: 76844 - DNA, 16 bp, H. sapiens
cccagccctggcagcc

SEQ ID NO: 76845 - DNA, 16 bp, H. sapiens
cccagccctggcccag

SEQ ID NO: 76846 - DNA, 16 bp, H. sapiens
cccagccctggccctc

SEQ ID NO: 76847 - DNA, 16 bp, H. sapiens
cccagccctggcctcc

SEQ ID NO: 76848 - DNA, 16 bp, H. sapiens
cccagccctggctctg

SEQ ID NO: 76849 - DNA, 16 bp, H. sapiens
cccagccctgggcagc

SEQ ID NO: 76850 - DNA, 16 bp, H. sapiens
cccagccctgggccag

SEQ ID NO: 76851 - DNA, 16 bp, H. sapiens
cccagccctgggcctc

SEQ ID NO: 76852 - DNA, 16 bp, H. sapiens
cccagccctgtgcctg

SEQ ID NO: 76853 - DNA, 16 bp, H. sapiens
cccagccctgtgctct

SEQ ID NO: 76854 - DNA, 16 bp, H. sapiens
cccagccctgtgctgg

SEQ ID NO: 76855 - DNA, 16 bp, H. sapiens
cccagcccttcaggag

SEQ ID NO: 76856 - DNA, 16 bp, H. sapiens
cccagcccttcctgcc

SEQ ID NO: 76857 - DNA, 16 bp, H. sapiens
cccagcccttggcaac

SEQ ID NO: 76858 - DNA, 16 bp, H. sapiens
cccagccctttcctct

SEQ ID NO: 76859 - DNA, 17 bp, H. sapiens
cccagccggcttcacct

SEQ ID NO: 76860 - DNA, 16 bp, H. sapiens
cccagcctacatttct

SEQ ID NO: 76861 - DNA, 16 bp, H. sapiens
cccagcctcagatgat

SEQ ID NO: 76862 - DNA, 16 bp, H. sapiens
cccagcctcagcctcc

SEQ ID NO: 76863 - DNA, 16 bp, H. sapiens
cccagcctcatccctg

SEQ ID NO: 76864 - DNA, 16 bp, H. sapiens
cccagcctcatttctt

SEQ ID NO: 76865 - DNA, 16 bp, H. sapiens
cccagcctccaggaag

SEQ ID NO: 76866 - DNA, 16 bp, H. sapiens
cccagcctccatcttt

SEQ ID NO: 76867 - DNA, 16 bp, H. sapiens
cccagcctcccacctt

SEQ ID NO: 76868 - DNA, 16 bp, H. sapiens
cccagcctcccagcca

SEQ ID NO: 76869 - DNA, 16 bp, H. sapiens
cccagcctcccctgca

SEQ ID NO: 76870 - DNA, 16 bp, H. sapiens
cccagcctccctgctg

SEQ ID NO: 76871 - DNA, 16 bp, H. sapiens
cccagcctcctctggg

SEQ ID NO: 76872 - DNA, 16 bp, H. sapiens
cccagcctcctcttca

SEQ ID NO: 76873 - DNA, 16 bp, H. sapiens
cccagcctcctgggtt

SEQ ID NO: 76874 - DNA, 16 bp, H. sapiens
cccagcctccttttct

SEQ ID NO: 76875 - DNA, 18 bp, H. sapiens
cccagcctcgctgccgcc

SEQ ID NO: 76876 - DNA, 16 bp, H. sapiens
cccagcctctccctct

SEQ ID NO: 76877 - DNA, 16 bp, H. sapiens
cccagcctctcctcca

SEQ ID NO: 76878 - DNA, 16 bp, H. sapiens
cccagcctctcctctc

SEQ ID NO: 76879 - DNA, 16 bp, H. sapiens
cccagcctctcttccc

SEQ ID NO: 76880 - DNA, 16 bp, H. sapiens
cccagcctctgggaac

SEQ ID NO: 76881 - DNA, 16 bp, H. sapiens
cccagcctcttctctc

SEQ ID NO: 76882 - DNA, 16 bp, H. sapiens
cccagcctgatgccag

SEQ ID NO: 76883 - DNA, 16 bp, H. sapiens
cccagcctgcagaacc

SEQ ID NO: 76884 - DNA, 16 bp, H. sapiens
cccagcctgcccagcc

SEQ ID NO: 76885 - DNA, 16 bp, H. sapiens
cccagcctgccctgcc

SEQ ID NO: 76886 - DNA, 16 bp, H. sapiens
cccagcctgcctgcct

SEQ ID NO: 76887 - DNA, 16 bp, H. sapiens
cccagcctggagagca

SEQ ID NO: 76888 - DNA, 16 bp, H. sapiens
cccagcctggagcctg

SEQ ID NO: 76889 - DNA, 16 bp, H. sapiens
cccagcctggagtgca

SEQ ID NO: 76890 - DNA, 16 bp, H. sapiens
cccagcctggcaggca

SEQ ID NO: 76891 - DNA, 16 bp, H. sapiens
cccagcctggccaaca

SEQ ID NO: 76892 - DNA, 16 bp, H. sapiens
cccagcctggcccctg

SEQ ID NO: 76893 - DNA, 16 bp, H. sapiens
cccagcctggccctgc

SEQ ID NO: 76894 - DNA, 16 bp, H. sapiens
cccagcctggcctccc

SEQ ID NO: 76895 - DNA, 16 bp, H. sapiens
cccagcctggctctcc

SEQ ID NO: 76896 - DNA, 16 bp, H. sapiens
cccagcctggctctgc

SEQ ID NO: 76897 - DNA, 17 bp, H. sapiens
cccagcctgggcaacat

SEQ ID NO: 76898 - DNA, 16 bp, H. sapiens
cccagcctgggccaca

SEQ ID NO: 76899 - DNA, 16 bp, H. sapiens
cccagcctgggcccag

SEQ ID NO: 76900 - DNA, 16 bp, H. sapiens
cccagcctggggtgca

SEQ ID NO: 76901 - DNA, 16 bp, H. sapiens
cccagcctgggtgaca

SEQ ID NO: 76902 - DNA, 16 bp, H. sapiens
cccagcctggtcaaca

SEQ ID NO: 76903 - DNA, 16 bp, H. sapiens
cccagcctggttttga

SEQ ID NO: 76904 - DNA, 16 bp, H. sapiens
cccagcctgtttcttt

SEQ ID NO: 76905 - DNA, 16 bp, H. sapiens
cccagccttctctctc

SEQ ID NO: 76906 - DNA, 16 bp, H. sapiens
cccagccttcttttct

SEQ ID NO: 76907 - DNA, 16 bp, H. sapiens
cccagccttctttttt

SEQ ID NO: 76908 - DNA, 16 bp, H. sapiens
cccagccttgctgctg

SEQ ID NO: 76909 - DNA, 16 bp, H. sapiens
cccagcgactctggag

SEQ ID NO: 76910 - DNA, 16 bp, H. sapiens
cccagcgtggtggcgc

SEQ ID NO: 76911 - DNA, 16 bp, H. sapiens
cccagctaatttattt

SEQ ID NO: 76912 - DNA, 16 bp, H. sapiens
cccagctaattttgtg

SEQ ID NO: 76913 - DNA, 16 bp, H. sapiens
cccagctaccagctac

SEQ ID NO: 76914 - DNA, 16 bp, H. sapiens
cccagctactccagac

SEQ ID NO: 76915 - DNA, 16 bp, H. sapiens
cccagctactccagcc

SEQ ID NO: 76916 - DNA, 16 bp, H. sapiens
cccagctactccgcag

SEQ ID NO: 76917 - DNA, 16 bp, H. sapiens
cccagctactcgacag

SEQ ID NO: 76918 - DNA, 16 bp, H. sapiens
cccagctactcggagg

SEQ ID NO: 76919 - DNA, 16 bp, H. sapiens
cccagctactgagggg

SEQ ID NO: 76920 - DNA, 16 bp, H. sapiens
cccagctactgggaga

SEQ ID NO: 76921 - DNA, 16 bp, H. sapiens
cccagctactggggac

SEQ ID NO: 76922 - DNA, 16 bp, H. sapiens
cccagctcaagcagag

SEQ ID NO: 76923 - DNA, 16 bp, H. sapiens
cccagctcagccactg

SEQ ID NO: 76924 - DNA, 16 bp, H. sapiens
cccagctcagcctcct

SEQ ID NO: 76925 - DNA, 16 bp, H. sapiens
cccagctcattttaaa

SEQ ID NO: 76926 - DNA, 16 bp, H. sapiens
cccagctcatttttaa

SEQ ID NO: 76927 - DNA, 16 bp, H. sapiens
cccagctcattttttt

SEQ ID NO: 76928 - DNA, 16 bp, H. sapiens
cccagctccaccacct

SEQ ID NO: 76929 - DNA, 16 bp, H. sapiens
cccagctccagcccct

SEQ ID NO: 76930 - DNA, 16 bp, H. sapiens
cccagctccaggcctg

SEQ ID NO: 76931 - DNA, 16 bp, H. sapiens
cccagctccaggtggc

SEQ ID NO: 76932 - DNA, 16 bp, H. sapiens
cccagctccatctcct

SEQ ID NO: 76933 - DNA, 16 bp, H. sapiens
cccagctcccacacag

SEQ ID NO: 76934 - DNA, 16 bp, H. sapiens
cccagctcccaggcag

SEQ ID NO: 76935 - DNA, 16 bp, H. sapiens
cccagctccccagcct

SEQ ID NO: 76936 - DNA, 16 bp, H. sapiens
cccagctccccaggag

SEQ ID NO: 76937 - DNA, 16 bp, H. sapiens
cccagctccctgcagc

SEQ ID NO: 76938 - DNA, 16 bp, H. sapiens
cccagctcccttgcct

SEQ ID NO: 76939 - DNA, 16 bp, H. sapiens
cccagctcctccctca

SEQ ID NO: 76940 - DNA, 16 bp, H. sapiens
cccagctcctcctcca

SEQ ID NO: 76941 - DNA, 16 bp, H. sapiens
cccagctcctcctcct

SEQ ID NO: 76942 - DNA, 16 bp, H. sapiens
cccagctcctgccacc

SEQ ID NO: 76943 - DNA, 16 bp, H. sapiens
cccagctcctgcctca

SEQ ID NO: 76944 - DNA, 16 bp, H. sapiens
cccagctcctgcctcc

SEQ ID NO: 76945 - DNA, 16 bp, H. sapiens
cccagctccttcagct

SEQ ID NO: 76946 - DNA, 16 bp, H. sapiens
cccagctccttcctcc

SEQ ID NO: 76947 - DNA, 16 bp, H. sapiens
cccagctctaccactc

SEQ ID NO: 76948 - DNA, 16 bp, H. sapiens
cccagctctcaggcag

SEQ ID NO: 76949 - DNA, 16 bp, H. sapiens
cccagctctccctcct

SEQ ID NO: 76950 - DNA, 16 bp, H. sapiens
cccagctctctctcct

SEQ ID NO: 76951 - DNA, 16 bp, H. sapiens
cccagctctctgggag

SEQ ID NO: 76952 - DNA, 16 bp, H. sapiens
cccagctctgccactg

SEQ ID NO: 76953 - DNA, 16 bp, H. sapiens
cccagctctgccactt

SEQ ID NO: 76954 - DNA, 16 bp, H. sapiens
cccagctctgccatct

SEQ ID NO: 76955 - DNA, 16 bp, H. sapiens
cccagctctgccccag

SEQ ID NO: 76956 - DNA, 16 bp, H. sapiens
cccagctctgcccctc

SEQ ID NO: 76957 - DNA, 16 bp, H. sapiens
cccagctctgccctca

SEQ ID NO: 76958 - DNA, 16 bp, H. sapiens
cccagctctgcctaca

SEQ ID NO: 76959 - DNA, 16 bp, H. sapiens
cccagctctgcctcag

SEQ ID NO: 76960 - DNA, 16 bp, H. sapiens
cccagctctgcctccc

SEQ ID NO: 76961 - DNA, 16 bp, H. sapiens
cccagctctgctgctg

SEQ ID NO: 76962 - DNA, 16 bp, H. sapiens
cccagctctggctctg

SEQ ID NO: 76963 - DNA, 16 bp, H. sapiens
cccagctctgggctgg

SEQ ID NO: 76964 - DNA, 16 bp, H. sapiens
cccagctctgtcacct

SEQ ID NO: 76965 - DNA, 16 bp, H. sapiens
cccagctctgtccctg

SEQ ID NO: 76966 - DNA, 16 bp, H. sapiens
cccagctctgtgacct

SEQ ID NO: 76967 - DNA, 16 bp, H. sapiens
cccagctctgtgccag

SEQ ID NO: 76968 - DNA, 16 bp, H. sapiens
cccagctcttccactt

SEQ ID NO: 76969 - DNA, 16 bp, H. sapiens
cccagctcttcctccc

SEQ ID NO: 76970 - DNA, 16 bp, H. sapiens
cccagctcttcctcct

SEQ ID NO: 76971 - DNA, 16 bp, H. sapiens
cccagctgagcccagc

SEQ ID NO: 76972 - DNA, 16 bp, H. sapiens
cccagctgaggcccca

SEQ ID NO: 76973 - DNA, 16 bp, H. sapiens
cccagctgatcttgaa

SEQ ID NO: 76974 - DNA, 16 bp, H. sapiens
cccagctgattctttt

SEQ ID NO: 76975 - DNA, 16 bp, H. sapiens
cccagctgatttcttt

SEQ ID NO: 76976 - DNA, 16 bp, H. sapiens
cccagctgccagggag

SEQ ID NO: 76977 - DNA, 16 bp, H. sapiens
cccagctgccatgctg

SEQ ID NO: 76978 - DNA, 16 bp, H. sapiens
cccagctgcccaggag

SEQ ID NO: 76979 - DNA, 16 bp, H. sapiens
cccagctgccccatct

SEQ ID NO: 76980 - DNA, 16 bp, H. sapiens
cccagctgcctcctgg

SEQ ID NO: 76981 - DNA, 16 bp, H. sapiens
cccagctgccttcatg

SEQ ID NO: 76982 - DNA, 16 bp, H. sapiens
cccagctgctcaggag

SEQ ID NO: 76983 - DNA, 16 bp, H. sapiens
cccagctgctcatgag

SEQ ID NO: 76984 - DNA, 16 bp, H. sapiens
cccagctgctccagag

SEQ ID NO: 76985 - DNA, 16 bp, H. sapiens
cccagctgctgaggag

SEQ ID NO: 76986 - DNA, 16 bp, H. sapiens
cccagctgcttcagct

SEQ ID NO: 76987 - DNA, 16 bp, H. sapiens
cccagctgcttggagg

SEQ ID NO: 76988 - DNA, 16 bp, H. sapiens
cccagctggagggcag

SEQ ID NO: 76989 - DNA, 16 bp, H. sapiens
cccagctggcttcccc

SEQ ID NO: 76990 - DNA, 16 bp, H. sapiens
cccagctgggaggctg

SEQ ID NO: 76991 - DNA, 16 bp, H. sapiens
cccagctggggctggg

SEQ ID NO: 76992 - DNA, 16 bp, H. sapiens
cccagctgggtgcagt

SEQ ID NO: 76993 - DNA, 16 bp, H. sapiens
cccagctggttgggag

SEQ ID NO: 76994 - DNA, 16 bp, H. sapiens
cccagctgtaaaatgg

SEQ ID NO: 76995 - DNA, 16 bp, H. sapiens
cccagctgtgcaggag

SEQ ID NO: 76996 - DNA, 16 bp, H. sapiens
cccagctgtgccactt

SEQ ID NO: 76997 - DNA, 16 bp, H. sapiens
cccagctgttcctcct

SEQ ID NO: 76998 - DNA, 16 bp, H. sapiens
cccagctgttttttgt

SEQ ID NO: 76999 - DNA, 16 bp, H. sapiens
cccagcttatttattt

SEQ ID NO: 77000 - DNA, 16 bp, H. sapiens
cccagcttcctctccc

SEQ ID NO: 77001 - DNA, 16 bp, H. sapiens
cccagcttggcctccc

SEQ ID NO: 77002 - DNA, 16 bp, H. sapiens
cccagctttcactatc

SEQ ID NO: 77003 - DNA, 16 bp, H. sapiens
cccagcttttgcccat

SEQ ID NO: 77004 - DNA, 16 bp, H. sapiens
cccaggaaacccctca

SEQ ID NO: 77005 - DNA, 16 bp, H. sapiens
cccaggaaagtggaga

SEQ ID NO: 77006 - DNA, 16 bp, H. sapiens
cccaggaacttgggag

SEQ ID NO: 77007 - DNA, 16 bp, H. sapiens
cccaggaagaaaaagt

SEQ ID NO: 77008 - DNA, 16 bp, H. sapiens
cccaggaagaggaggt

SEQ ID NO: 77009 - DNA, 16 bp, H. sapiens
cccaggaagcagagat

SEQ ID NO: 77010 - DNA, 16 bp, H. sapiens
cccaggaagccaaggc

SEQ ID NO: 77011 - DNA, 16 bp, H. sapiens
cccaggaagccagcct

SEQ ID NO: 77012 - DNA, 16 bp, H. sapiens
cccaggaagctcagag

SEQ ID NO: 77013 - DNA, 16 bp, H. sapiens
cccaggaagctgggac

SEQ ID NO: 77014 - DNA, 16 bp, H. sapiens
cccaggaagcttacaa

SEQ ID NO: 77015 - DNA, 16 bp, H. sapiens
cccaggaaggagaaaa

SEQ ID NO: 77016 - DNA, 16 bp, H. sapiens
cccaggaaggagaggt

SEQ ID NO: 77017 - DNA, 16 bp, H. sapiens
cccaggaaggaggagg

SEQ ID NO: 77018 - DNA, 16 bp, H. sapiens
cccaggaaggctttga

SEQ ID NO: 77019 - DNA, 16 bp, H. sapiens
cccaggaagtccagct

SEQ ID NO: 77020 - DNA, 16 bp, H. sapiens
cccaggaagtgcaaga

SEQ ID NO: 77021 - DNA, 16 bp, H. sapiens
cccaggaagttgaggc

SEQ ID NO: 77022 - DNA, 16 bp, H. sapiens
cccaggaattgaagac

SEQ ID NO: 77023 - DNA, 16 bp, H. sapiens
cccaggaatttgaagc

SEQ ID NO: 77024 - DNA, 16 bp, H. sapiens
cccaggaatttgaggt

SEQ ID NO: 77025 - DNA, 16 bp, H. sapiens
cccaggacagccccca

SEQ ID NO: 77026 - DNA, 16 bp, H. sapiens
cccaggacagctctga

SEQ ID NO: 77027 - DNA, 16 bp, H. sapiens
cccaggaccaaatgga

SEQ ID NO: 77028 - DNA, 16 bp, H. sapiens
cccaggaccagatggc

SEQ ID NO: 77029 - DNA, 16 bp, H. sapiens
cccaggaccaggcaga

SEQ ID NO: 77030 - DNA, 16 bp, H. sapiens
cccaggacctttgcac

SEQ ID NO: 77031 - DNA, 16 bp, H. sapiens
cccaggactgtgggag

SEQ ID NO: 77032 - DNA, 16 bp, H. sapiens
cccaggagaaagaggt

SEQ ID NO: 77033 - DNA, 16 bp, H. sapiens
cccaggagacacccca

SEQ ID NO: 77034 - DNA, 16 bp, H. sapiens
cccaggagacagaggt

SEQ ID NO: 77035 - DNA, 16 bp, H. sapiens
cccaggagaccaaggc

SEQ ID NO: 77036 - DNA, 16 bp, H. sapiens
cccaggagactgaggt

SEQ ID NO: 77037 - DNA, 16 bp, H. sapiens
cccaggagagaggcct

SEQ ID NO: 77038 - DNA, 16 bp, H. sapiens
cccaggagaggggcct

SEQ ID NO: 77039 - DNA, 16 bp, H. sapiens
cccaggagatggaggg

SEQ ID NO: 77040 - DNA, 16 bp, H. sapiens
cccaggagatgggggt

SEQ ID NO: 77041 - DNA, 16 bp, H. sapiens
cccaggagcccaggag

SEQ ID NO: 77042 - DNA, 16 bp, H. sapiens
cccaggagccccaggt

SEQ ID NO: 77043 - DNA, 16 bp, H. sapiens
cccaggagctcagggc

SEQ ID NO: 77044 - DNA, 16 bp, H. sapiens
cccaggagctccaggc

SEQ ID NO: 77045 - DNA, 16 bp, H. sapiens
cccaggagctgagcag

SEQ ID NO: 77046 - DNA, 16 bp, H. sapiens
cccaggagctggagac

SEQ ID NO: 77047 - DNA, 16 bp, H. sapiens
cccaggagctggagat

SEQ ID NO: 77048 - DNA, 16 bp, H. sapiens
cccaggagctggaggc

SEQ ID NO: 77049 - DNA, 16 bp, H. sapiens
cccaggagctggaggt

SEQ ID NO: 77050 - DNA, 16 bp, H. sapiens
cccaggagctgggatt

SEQ ID NO: 77051 - DNA, 16 bp, H. sapiens
cccaggaggaagaagt

SEQ ID NO: 77052 - DNA, 16 bp, H. sapiens
cccaggaggaagaggc

SEQ ID NO: 77053 - DNA, 16 bp, H. sapiens
cccaggaggaggaatt

SEQ ID NO: 77054 - DNA, 16 bp, H. sapiens
cccaggaggaggagat

SEQ ID NO: 77055 - DNA, 16 bp, H. sapiens
cccaggaggaggaggc

SEQ ID NO: 77056 - DNA, 16 bp, H. sapiens
cccaggaggcacaggc

SEQ ID NO: 77057 - DNA, 16 bp, H. sapiens
cccaggaggcagaact

SEQ ID NO: 77058 - DNA, 16 bp, H. sapiens
cccaggaggcagagaa

SEQ ID NO: 77059 - DNA, 16 bp, H. sapiens
cccaggaggcagagct

SEQ ID NO: 77060 - DNA, 16 bp, H. sapiens
cccaggaggcagagga

SEQ ID NO: 77061 - DNA, 16 bp, H. sapiens
cccaggaggcagagtt

SEQ ID NO: 77062 - DNA, 16 bp, H. sapiens
cccaggaggcagcagg

SEQ ID NO: 77063 - DNA, 16 bp, H. sapiens
cccaggaggcagcggt

SEQ ID NO: 77064 - DNA, 16 bp, H. sapiens
cccaggaggcaggcag

SEQ ID NO: 77065 - DNA, 16 bp, H. sapiens
cccaggaggcagggag

SEQ ID NO: 77066 - DNA, 16 bp, H. sapiens
cccaggaggcagggct

SEQ ID NO: 77067 - DNA, 16 bp, H. sapiens
cccaggaggcaggggt

SEQ ID NO: 77068 - DNA, 16 bp, H. sapiens
cccaggaggccgaggc

SEQ ID NO: 77069 - DNA, 16 bp, H. sapiens
cccaggaggcctgcag

SEQ ID NO: 77070 - DNA, 16 bp, H. sapiens
cccaggaggcgaaggt

SEQ ID NO: 77071 - DNA, 20 bp, H. sapiens
cccaggaggcggagcttgca

SEQ ID NO: 77072 - DNA, 16 bp, H. sapiens
cccaggaggcggaggc

SEQ ID NO: 77073 - DNA, 16 bp, H. sapiens
cccaggaggctaaggc

SEQ ID NO: 77074 - DNA, 16 bp, H. sapiens
cccaggaggctgaggc

SEQ ID NO: 77075 - DNA, 16 bp, H. sapiens
cccaggaggctgtggt

SEQ ID NO: 77076 - DNA, 16 bp, H. sapiens
cccaggagggagaggt

SEQ ID NO: 77077 - DNA, 16 bp, H. sapiens
cccaggagggggagct

SEQ ID NO: 77078 - DNA, 18 bp, H. sapiens
cccaggagggggagcttg

SEQ ID NO: 77079 - DNA, 16 bp, H. sapiens
cccaggagggggaggc

SEQ ID NO: 77080 - DNA, 16 bp, H. sapiens
cccaggagggtggatc

SEQ ID NO: 77081 - DNA, 16 bp, H. sapiens
cccaggaggtccaggt

SEQ ID NO: 77082 - DNA, 16 bp, H. sapiens
cccaggaggtgaaagt

SEQ ID NO: 77083 - DNA, 16 bp, H. sapiens
cccaggaggtggacat

SEQ ID NO: 77084 - DNA, 16 bp, H. sapiens
cccaggaggtggagga

SEQ ID NO: 77085 - DNA, 16 bp, H. sapiens
cccaggaggtgggagg

SEQ ID NO: 77086 - DNA, 16 bp, H. sapiens
cccaggagtcggaggc

SEQ ID NO: 77087 - DNA, 16 bp, H. sapiens
cccaggagttccaaac

SEQ ID NO: 77088 - DNA, 16 bp, H. sapiens
cccaggagttccaaga

SEQ ID NO: 77089 - DNA, 16 bp, H. sapiens
cccaggagttccagaa

SEQ ID NO: 77090 - DNA, 16 bp, H. sapiens
cccaggagttccagcc

SEQ ID NO: 77091 - DNA, 16 bp, H. sapiens
cccaggagttccagga

SEQ ID NO: 77092 - DNA, 16 bp, H. sapiens
cccaggagttccaggc

SEQ ID NO: 77093 - DNA, 16 bp, H. sapiens
cccaggagttccaggt

SEQ ID NO: 77094 - DNA, 16 bp, H. sapiens
cccaggagttcgaggt

SEQ ID NO: 77095 - DNA, 16 bp, H. sapiens
cccaggagttggggac

SEQ ID NO: 77096 - DNA, 16 bp, H. sapiens
cccaggagtttgagaa

SEQ ID NO: 77097 - DNA, 16 bp, H. sapiens
cccaggagtttgcagc

SEQ ID NO: 77098 - DNA, 16 bp, H. sapiens
cccaggatgcagagct

SEQ ID NO: 77099 - DNA, 16 bp, H. sapiens
cccaggatggagcgca

SEQ ID NO: 77100 - DNA, 16 bp, H. sapiens
cccaggatggagtgca

SEQ ID NO: 77101 - DNA, 16 bp, H. sapiens
cccaggatggggtgca

SEQ ID NO: 77102 - DNA, 16 bp, H. sapiens
cccaggatggtctgga

SEQ ID NO: 77103 - DNA, 16 bp, H. sapiens
cccaggatttggagac

SEQ ID NO: 77104 - DNA, 16 bp, H. sapiens
cccaggcaaaagtttg

SEQ ID NO: 77105 - DNA, 16 bp, H. sapiens
cccaggcaacagtgtg

SEQ ID NO: 77106 - DNA, 16 bp, H. sapiens
cccaggcagaagagga

SEQ ID NO: 77107 - DNA, 16 bp, H. sapiens
cccaggcagagcctgg

SEQ ID NO: 77108 - DNA, 16 bp, H. sapiens
cccaggcagcacagct

SEQ ID NO: 77109 - DNA, 16 bp, H. sapiens
cccaggcagcccctgc

SEQ ID NO: 77110 - DNA, 16 bp, H. sapiens
cccaggcagcctggct

SEQ ID NO: 77111 - DNA, 16 bp, H. sapiens
cccaggcaggaggcca

SEQ ID NO: 77112 - DNA, 16 bp, H. sapiens
cccaggcaggagtaca

SEQ ID NO: 77113 - DNA, 16 bp, H. sapiens
cccaggcaggagtgca

SEQ ID NO: 77114 - DNA, 16 bp, H. sapiens
cccaggcaggagtgcg

SEQ ID NO: 77115 - DNA, 16 bp, H. sapiens
cccaggcaggatggag

SEQ ID NO: 77116 - DNA, 16 bp, H. sapiens
cccaggcagggcccag

SEQ ID NO: 77117 - DNA, 16 bp, H. sapiens
cccaggcaggggctgg

SEQ ID NO: 77118 - DNA, 16 bp, H. sapiens
cccaggcaggtggatc

SEQ ID NO: 77119 - DNA, 16 bp, H. sapiens
cccaggcagtctggct

SEQ ID NO: 77120 - DNA, 16 bp, H. sapiens
cccaggcatcctggtt

SEQ ID NO: 77121 - DNA, 16 bp, H. sapiens
cccaggcatggtggtg

SEQ ID NO: 77122 - DNA, 16 bp, H. sapiens
cccaggccacctcctc

SEQ ID NO: 77123 - DNA, 16 bp, H. sapiens
cccaggccagagtaca

SEQ ID NO: 77124 - DNA, 16 bp, H. sapiens
cccaggccagagtgca

SEQ ID NO: 77125 - DNA, 16 bp, H. sapiens
cccaggccagcagctg

SEQ ID NO: 77126 - DNA, 16 bp, H. sapiens
cccaggccagcccagg

SEQ ID NO: 77127 - DNA, 16 bp, H. sapiens
cccaggccagccccag

SEQ ID NO: 77128 - DNA, 16 bp, H. sapiens
cccaggccagcctggg

SEQ ID NO: 77129 - DNA, 16 bp, H. sapiens
cccaggccagcggctg

SEQ ID NO: 77130 - DNA, 16 bp, H. sapiens
cccaggccaggcacag

SEQ ID NO: 77131 - DNA, 16 bp, H. sapiens
cccaggccaggcagca

SEQ ID NO: 77132 - DNA, 16 bp, H. sapiens
cccaggccaggcaggg

SEQ ID NO: 77133 - DNA, 16 bp, H. sapiens
cccaggccaggccagg

SEQ ID NO: 77134 - DNA, 16 bp, H. sapiens
cccaggccaggccatc

SEQ ID NO: 77135 - DNA, 16 bp, H. sapiens
cccaggccaggcccag

SEQ ID NO: 77136 - DNA, 16 bp, H. sapiens
cccaggccaggtgcag

SEQ ID NO: 77137 - DNA, 16 bp, H. sapiens
cccaggccagtctgga

SEQ ID NO: 77138 - DNA, 16 bp, H. sapiens
cccaggccagtggctg

SEQ ID NO: 77139 - DNA, 16 bp, H. sapiens
cccaggccatggactg

SEQ ID NO: 77140 - DNA, 16 bp, H. sapiens
cccaggcccagcccag

SEQ ID NO: 77141 - DNA, 16 bp, H. sapiens
cccaggcccagccctc

SEQ ID NO: 77142 - DNA, 16 bp, H. sapiens
cccaggcccagccctg

SEQ ID NO: 77143 - DNA, 16 bp, H. sapiens
cccaggcccagctcca

SEQ ID NO: 77144 - DNA, 16 bp, H. sapiens
cccaggcccaggcagg

SEQ ID NO: 77145 - DNA, 16 bp, H. sapiens
cccaggccccaccctg

SEQ ID NO: 77146 - DNA, 16 bp, H. sapiens
cccaggccccactgac

SEQ ID NO: 77147 - DNA, 16 bp, H. sapiens
cccaggccccagcctc

SEQ ID NO: 77148 - DNA, 16 bp, H. sapiens
cccaggccccaggctc

SEQ ID NO: 77149 - DNA, 16 bp, H. sapiens
cccaggcccccaagag

SEQ ID NO: 77150 - DNA, 16 bp, H. sapiens
cccaggcccctcccag

SEQ ID NO: 77151 - DNA, 16 bp, H. sapiens
cccaggcccctgagag

SEQ ID NO: 77152 - DNA, 16 bp, H. sapiens
cccaggcccctgccca

SEQ ID NO: 77153 - DNA, 16 bp, H. sapiens
cccaggcccctgccct

SEQ ID NO: 77154 - DNA, 16 bp, H. sapiens
cccaggcccctggccc

SEQ ID NO: 77155 - DNA, 16 bp, H. sapiens
cccaggccctgcccct

SEQ ID NO: 77156 - DNA, 16 bp, H. sapiens
cccaggccctgccctc

SEQ ID NO: 77157 - DNA, 16 bp, H. sapiens
cccaggccctgccctg

SEQ ID NO: 77158 - DNA, 16 bp, H. sapiens
cccaggccctgggctg

SEQ ID NO: 77159 - DNA, 16 bp, H. sapiens
cccaggccgatctcaa

SEQ ID NO: 77160 - DNA, 16 bp, H. sapiens
cccaggccggagtgca

SEQ ID NO: 77161 - DNA, 17 bp, H. sapiens
cccaggccgggcacagt

SEQ ID NO: 77162 - DNA, 16 bp, H. sapiens
cccaggcctcagcctc

SEQ ID NO: 77163 - DNA, 16 bp, H. sapiens
cccaggcctccacaaa

SEQ ID NO: 77164 - DNA, 16 bp, H. sapiens
cccaggcctccagctc

SEQ ID NO: 77165 - DNA, 16 bp, H. sapiens
cccaggcctccccagc

SEQ ID NO: 77166 - DNA, 16 bp, H. sapiens
cccaggcctccctggg

SEQ ID NO: 77167 - DNA, 16 bp, H. sapiens
cccaggcctcctccct

SEQ ID NO: 77168 - DNA, 16 bp, H. sapiens
cccaggcctcctggct

SEQ ID NO: 77169 - DNA, 16 bp, H. sapiens
cccaggcctctctcct

SEQ ID NO: 77170 - DNA, 16 bp, H. sapiens
cccaggcctgccctcc

SEQ ID NO: 77171 - DNA, 16 bp, H. sapiens
cccaggcctgcctgcc

SEQ ID NO: 77172 - DNA, 16 bp, H. sapiens
cccaggcctggcagga

SEQ ID NO: 77173 - DNA, 16 bp, H. sapiens
cccaggcctggcccca

SEQ ID NO: 77174 - DNA, 16 bp, H. sapiens
cccaggcctggctggg

SEQ ID NO: 77175 - DNA, 16 bp, H. sapiens
cccaggcgggagtgca

SEQ ID NO: 77176 - DNA, 16 bp, H. sapiens
cccaggcgtggtggtg

SEQ ID NO: 77177 - DNA, 16 bp, H. sapiens
cccaggctaagcccca

SEQ ID NO: 77178 - DNA, 16 bp, H. sapiens
cccaggctacagtgca

SEQ ID NO: 77179 - DNA, 16 bp, H. sapiens
cccaggctagagcgca

SEQ ID NO: 77180 - DNA, 16 bp, H. sapiens
cccaggctagagtgca

SEQ ID NO: 77181 - DNA, 16 bp, H. sapiens
cccaggctagagtgga

SEQ ID NO: 77182 - DNA, 16 bp, H. sapiens
cccaggctagagtgta

SEQ ID NO: 77183 - DNA, 17 bp, H. sapiens
cccaggctagtctcaaa

SEQ ID NO: 77184 - DNA, 16 bp, H. sapiens
cccaggctcaaatgat

SEQ ID NO: 77185 - DNA, 16 bp, H. sapiens
cccaggctcaagtgca

SEQ ID NO: 77186 - DNA, 16 bp, H. sapiens
cccaggctcacatgat

SEQ ID NO: 77187 - DNA, 16 bp, H. sapiens
cccaggctcagccaga

SEQ ID NO: 77188 - DNA, 16 bp, H. sapiens
cccaggctcaggagga

SEQ ID NO: 77189 - DNA, 16 bp, H. sapiens
cccaggctcaggcagt

SEQ ID NO: 77190 - DNA, 16 bp, H. sapiens
cccaggctccctccct

SEQ ID NO: 77191 - DNA, 16 bp, H. sapiens
cccaggctcgagtgca

SEQ ID NO: 77192 - DNA, 16 bp, H. sapiens
cccaggctctgccctc

SEQ ID NO: 77193 - DNA, 16 bp, H. sapiens
cccaggctctgccctg

SEQ ID NO: 77194 - DNA, 16 bp, H. sapiens
cccaggctctgcctcc

SEQ ID NO: 77195 - DNA, 16 bp, H. sapiens
cccaggctctgcctct

SEQ ID NO: 77196 - DNA, 16 bp, H. sapiens
cccaggctgaagccat

SEQ ID NO: 77197 - DNA, 16 bp, H. sapiens
cccaggctgaagtaca

SEQ ID NO: 77198 - DNA, 16 bp, H. sapiens
cccaggctgaagtcca

SEQ ID NO: 77199 - DNA, 16 bp, H. sapiens
cccaggctgaagtgat

SEQ ID NO: 77200 - DNA, 16 bp, H. sapiens
cccaggctgaagtgca

SEQ ID NO: 77201 - DNA, 16 bp, H. sapiens
cccaggctgaagttca

SEQ ID NO: 77202 - DNA, 16 bp, H. sapiens
cccaggctgagccctg

SEQ ID NO: 77203 - DNA, 16 bp, H. sapiens
cccaggctgcactgca

SEQ ID NO: 77204 - DNA, 16 bp, H. sapiens
cccaggctgcagctgc

SEQ ID NO: 77205 - DNA, 16 bp, H. sapiens
cccaggctgcagtaca

SEQ ID NO: 77206 - DNA, 16 bp, H. sapiens
cccaggctgcagtgca

SEQ ID NO: 77207 - DNA, 16 bp, H. sapiens
cccaggctgcccaggc

SEQ ID NO: 77208 - DNA, 16 bp, H. sapiens
cccaggctgcctggct

SEQ ID NO: 77209 - DNA, 16 bp, H. sapiens
cccaggctgctctcca

SEQ ID NO: 77210 - DNA, 16 bp, H. sapiens
cccaggctggaacaca

SEQ ID NO: 77211 - DNA, 16 bp, H. sapiens
cccaggctggaataca

SEQ ID NO: 77212 - DNA, 16 bp, H. sapiens
cccaggctggaatgca

SEQ ID NO: 77213 - DNA, 16 bp, H. sapiens
cccaggctggaatgcg

SEQ ID NO: 77214 - DNA, 16 bp, H. sapiens
cccaggctggaatgct

SEQ ID NO: 77215 - DNA, 16 bp, H. sapiens
cccaggctggaatgta

SEQ ID NO: 77216 - DNA, 16 bp, H. sapiens
cccaggctggactgca

SEQ ID NO: 77217 - DNA, 16 bp, H. sapiens
cccaggctggagagca

SEQ ID NO: 77218 - DNA, 16 bp, H. sapiens
cccaggctggagagta

SEQ ID NO: 77219 - DNA, 16 bp, H. sapiens
cccaggctggagcaca

SEQ ID NO: 77220 - DNA, 16 bp, H. sapiens
cccaggctggagcgca

SEQ ID NO: 77221 - DNA, 16 bp, H. sapiens
cccaggctggaggaca

SEQ ID NO: 77222 - DNA, 16 bp, H. sapiens
cccaggctggagggca

SEQ ID NO: 77223 - DNA, 16 bp, H. sapiens
cccaggctggaggtgc

SEQ ID NO: 77224 - DNA, 16 bp, H. sapiens
cccaggctggagtaca

SEQ ID NO: 77225 - DNA, 16 bp, H. sapiens
cccaggctggagtcca

SEQ ID NO: 77226 - DNA, 16 bp, H. sapiens
cccaggctggagtgaa

SEQ ID NO: 77227 - DNA, 16 bp, H. sapiens
cccaggctggagtgca

SEQ ID NO: 77228 - DNA, 16 bp, H. sapiens
cccaggctggagtgcc

SEQ ID NO: 77229 - DNA, 16 bp, H. sapiens
cccaggctggagtgcg

SEQ ID NO: 77230 - DNA, 16 bp, H. sapiens
cccaggctggagtgct

SEQ ID NO: 77231 - DNA, 16 bp, H. sapiens
cccaggctggagtgga

SEQ ID NO: 77232 - DNA, 16 bp, H. sapiens
cccaggctggagtggc

SEQ ID NO: 77233 - DNA, 16 bp, H. sapiens
cccaggctggagtggt

SEQ ID NO: 77234 - DNA, 16 bp, H. sapiens
cccaggctggagtgta

SEQ ID NO: 77235 - DNA, 16 bp, H. sapiens
cccaggctggagtgtc

SEQ ID NO: 77236 - DNA, 16 bp, H. sapiens
cccaggctggagtgtg

SEQ ID NO: 77237 - DNA, 16 bp, H. sapiens
cccaggctggattgca

SEQ ID NO: 77238 - DNA, 16 bp, H. sapiens
cccaggctggcctcag

SEQ ID NO: 77239 - DNA, 16 bp, H. sapiens
cccaggctggcgtgca

SEQ ID NO: 77240 - DNA, 16 bp, H. sapiens
cccaggctggctggag

SEQ ID NO: 77241 - DNA, 16 bp, H. sapiens
cccaggctggcttcaa

SEQ ID NO: 77242 - DNA, 16 bp, H. sapiens
cccaggctgggagcag

SEQ ID NO: 77243 - DNA, 16 bp, H. sapiens
cccaggctggggcaca

SEQ ID NO: 77244 - DNA, 16 bp, H. sapiens
cccaggctggggtgaa

SEQ ID NO: 77245 - DNA, 16 bp, H. sapiens
cccaggctggggtgca

SEQ ID NO: 77246 - DNA, 16 bp, H. sapiens
cccaggctgggtgtgg

SEQ ID NO: 77247 - DNA, 16 bp, H. sapiens
cccaggctggtatgca

SEQ ID NO: 77248 - DNA, 16 bp, H. sapiens
cccaggctggtcctgg

SEQ ID NO: 77249 - DNA, 25 bp, H. sapiens
cccaggctggtctcgaactcctgag

SEQ ID NO: 77250 - DNA, 16 bp, H. sapiens
cccaggctggtctctt

SEQ ID NO: 77251 - DNA, 16 bp, H. sapiens
cccaggctggtgtgca

SEQ ID NO: 77252 - DNA, 16 bp, H. sapiens
cccaggctgtagtgca

SEQ ID NO: 77253 - DNA, 16 bp, H. sapiens
cccaggctgtggacca

SEQ ID NO: 77254 - DNA, 16 bp, H. sapiens
cccaggctgtgtgcag

SEQ ID NO: 77255 - DNA, 16 bp, H. sapiens
cccaggctgttctcca

SEQ ID NO: 77256 - DNA, 16 bp, H. sapiens
cccaggcttggcctca

SEQ ID NO: 77257 - DNA, 16 bp, H. sapiens
cccagggaagccaaaa

SEQ ID NO: 77258 - DNA, 16 bp, H. sapiens
cccagggaagccaaag

SEQ ID NO: 77259 - DNA, 16 bp, H. sapiens
cccagggaccagcacc

SEQ ID NO: 77260 - DNA, 16 bp, H. sapiens
cccagggagatggaag

SEQ ID NO: 77261 - DNA, 16 bp, H. sapiens
cccagggagctcccag

SEQ ID NO: 77262 - DNA, 16 bp, H. sapiens
cccagggaggagctgg

SEQ ID NO: 77263 - DNA, 16 bp, H. sapiens
cccagggaggcagagg

SEQ ID NO: 77264 - DNA, 16 bp, H. sapiens
cccagggaggggcagg

SEQ ID NO: 77265 - DNA, 16 bp, H. sapiens
cccagggaggtccagg

SEQ ID NO: 77266 - DNA, 16 bp, H. sapiens
cccagggatcaggaag

SEQ ID NO: 77267 - DNA, 16 bp, H. sapiens
cccagggatgggcagg

SEQ ID NO: 77268 - DNA, 16 bp, H. sapiens
cccagggcacttcagc

SEQ ID NO: 77269 - DNA, 16 bp, H. sapiens
cccagggcagcccctg

SEQ ID NO: 77270 - DNA, 16 bp, H. sapiens
cccagggcagcctggc

SEQ ID NO: 77271 - DNA, 16 bp, H. sapiens
cccagggcaggcaggg

SEQ ID NO: 77272 - DNA, 16 bp, H. sapiens
cccagggcagggagag

SEQ ID NO: 77273 - DNA, 16 bp, H. sapiens
cccagggcaggggctg

SEQ ID NO: 77274 - DNA, 16 bp, H. sapiens
cccagggccacacagc

SEQ ID NO: 77275 - DNA, 16 bp, H. sapiens
cccagggccacccagc

SEQ ID NO: 77276 - DNA, 16 bp, H. sapiens
cccagggccagcaggg

SEQ ID NO: 77277 - DNA, 16 bp, H. sapiens
cccagggccagcccca

SEQ ID NO: 77278 - DNA, 16 bp, H. sapiens
cccagggccaggcagg

SEQ ID NO: 77279 - DNA, 16 bp, H. sapiens
cccagggcccagcagg

SEQ ID NO: 77280 - DNA, 16 bp, H. sapiens
cccagggcccctctct

SEQ ID NO: 77281 - DNA, 16 bp, H. sapiens
cccagggccctgcccc

SEQ ID NO: 77282 - DNA, 16 bp, H. sapiens
cccagggccctgctgc

SEQ ID NO: 77283 - DNA, 16 bp, H. sapiens
cccagggcctgctggg

SEQ ID NO: 77284 - DNA, 16 bp, H. sapiens
cccagggcctggcaca

SEQ ID NO: 77285 - DNA, 16 bp, H. sapiens
cccagggcctggccca

SEQ ID NO: 77286 - DNA, 16 bp, H. sapiens
cccagggcctggctgc

SEQ ID NO: 77287 - DNA, 16 bp, H. sapiens
cccagggcctggggga

SEQ ID NO: 77288 - DNA, 16 bp, H. sapiens
cccagggccttgagtg

SEQ ID NO: 77289 - DNA, 16 bp, H. sapiens
cccagggccttgctgc

SEQ ID NO: 77290 - DNA, 16 bp, H. sapiens
cccagggcggagtgca

SEQ ID NO: 77291 - DNA, 16 bp, H. sapiens
cccagggctcccctgg

SEQ ID NO: 77292 - DNA, 16 bp, H. sapiens
cccagggctcctcctc

SEQ ID NO: 77293 - DNA, 16 bp, H. sapiens
cccagggctctggtgg

SEQ ID NO: 77294 - DNA, 16 bp, H. sapiens
cccagggctgctgggg

SEQ ID NO: 77295 - DNA, 16 bp, H. sapiens
cccagggctgctgtga

SEQ ID NO: 77296 - DNA, 16 bp, H. sapiens
cccagggctggagtgc

SEQ ID NO: 77297 - DNA, 16 bp, H. sapiens
cccagggctggggcag

SEQ ID NO: 77298 - DNA, 16 bp, H. sapiens
cccagggctggggctg

SEQ ID NO: 77299 - DNA, 16 bp, H. sapiens
cccaggggacagaggt

SEQ ID NO: 77300 - DNA, 16 bp, H. sapiens
cccaggggaccctggg

SEQ ID NO: 77301 - DNA, 16 bp, H. sapiens
cccaggggacggaggt

SEQ ID NO: 77302 - DNA, 16 bp, H. sapiens
cccaggggatggaggt

SEQ ID NO: 77303 - DNA, 16 bp, H. sapiens
cccaggggctcttcag

SEQ ID NO: 77304 - DNA, 16 bp, H. sapiens
cccagggggagataat

SEQ ID NO: 77305 - DNA, 16 bp, H. sapiens
cccagggggaggtaac

SEQ ID NO: 77306 - DNA, 16 bp, H. sapiens
cccaggggttggggac

SEQ ID NO: 77307 - DNA, 16 bp, H. sapiens
cccagggtccctgcct

SEQ ID NO: 77308 - DNA, 16 bp, H. sapiens
cccagggtgctgggat

SEQ ID NO: 77309 - DNA, 16 bp, H. sapiens
cccagggtggaaaacc

SEQ ID NO: 77310 - DNA, 16 bp, H. sapiens
cccagggtggagtgca

SEQ ID NO: 77311 - DNA, 16 bp, H. sapiens
cccagggttcacgcca

SEQ ID NO: 77312 - DNA, 16 bp, H. sapiens
cccaggtacctgggag

SEQ ID NO: 77313 - DNA, 16 bp, H. sapiens
cccaggtactcagcag

SEQ ID NO: 77314 - DNA, 16 bp, H. sapiens
cccaggtagctggggc

SEQ ID NO: 77315 - DNA, 16 bp, H. sapiens
cccaggtcaagtgatt

SEQ ID NO: 77316 - DNA, 16 bp, H. sapiens
cccaggtcacctcaca

SEQ ID NO: 77317 - DNA, 16 bp, H. sapiens
cccaggtccatggaaa

SEQ ID NO: 77318 - DNA, 16 bp, H. sapiens
cccaggtcctgcagga

SEQ ID NO: 77319 - DNA, 16 bp, H. sapiens
cccaggtccttgagaa

SEQ ID NO: 77320 - DNA, 16 bp, H. sapiens
cccaggtctccagctc

SEQ ID NO: 77321 - DNA, 16 bp, H. sapiens
cccaggtctccagctg

SEQ ID NO: 77322 - DNA, 16 bp, H. sapiens
cccaggtctcctgacc

SEQ ID NO: 77323 - DNA, 16 bp, H. sapiens
cccaggtctcctgcct

SEQ ID NO: 77324 - DNA, 16 bp, H. sapiens
cccaggtctgtctgac

SEQ ID NO: 77325 - DNA, 16 bp, H. sapiens
cccaggtgatccaccc

SEQ ID NO: 77326 - DNA, 16 bp, H. sapiens
cccaggtgattccaat

SEQ ID NO: 77327 - DNA, 16 bp, H. sapiens
cccaggtgcagctgca

SEQ ID NO: 77328 - DNA, 16 bp, H. sapiens
cccaggtggcctccct

SEQ ID NO: 77329 - DNA, 16 bp, H. sapiens
cccaggtggctgaggc

SEQ ID NO: 77330 - DNA, 16 bp, H. sapiens
cccaggtgggagtgca

SEQ ID NO: 77331 - DNA, 16 bp, H. sapiens
cccaggtgggcagatc

SEQ ID NO: 77332 - DNA, 16 bp, H. sapiens
cccaggttagagtgca

SEQ ID NO: 77333 - DNA, 16 bp, H. sapiens
cccaggttcaagcaaa

SEQ ID NO: 77334 - DNA, 16 bp, H. sapiens
cccaggttcagatgat

SEQ ID NO: 77335 - DNA, 16 bp, H. sapiens
cccaggttcgagccat

SEQ ID NO: 77336 - DNA, 16 bp, H. sapiens
cccaggttctcaggcc

SEQ ID NO: 77337 - DNA, 16 bp, H. sapiens
cccaggttggagtgca

SEQ ID NO: 77338 - DNA, 16 bp, H. sapiens
cccaggttggtcttca

SEQ ID NO: 77339 - DNA, 16 bp, H. sapiens
cccaggttgttctcaa

SEQ ID NO: 77340 - DNA, 16 bp, H. sapiens
cccagtaatactgtgg

SEQ ID NO: 77341 - DNA, 16 bp, H. sapiens
cccagtaatggaattg

SEQ ID NO: 77342 - DNA, 16 bp, H. sapiens
cccagtactttgggaa

SEQ ID NO: 77343 - DNA, 16 bp, H. sapiens
cccagtagagactctg

SEQ ID NO: 77344 - DNA, 16 bp, H. sapiens
cccagtagctgagatt

SEQ ID NO: 77345 - DNA, 16 bp, H. sapiens
cccagtcccatccacc

SEQ ID NO: 77346 - DNA, 16 bp, H. sapiens
cccagtcccatcgacc

SEQ ID NO: 77347 - DNA, 16 bp, H. sapiens
cccagtccccagggcc

SEQ ID NO: 77348 - DNA, 16 bp, H. sapiens
cccagtcctgccctcc

SEQ ID NO: 77349 - DNA, 16 bp, H. sapiens
cccagtctcaaaaata

SEQ ID NO: 77350 - DNA, 16 bp, H. sapiens
cccagtctctaaaaaa

SEQ ID NO: 77351 - DNA, 16 bp, H. sapiens
cccagtctctacaaaa

SEQ ID NO: 77352 - DNA, 16 bp, H. sapiens
cccagtctgagggcag

SEQ ID NO: 77353 - DNA, 16 bp, H. sapiens
cccagtctggagtgca

SEQ ID NO: 77354 - DNA, 16 bp, H. sapiens
cccagtctggtctcca

SEQ ID NO: 77355 - DNA, 16 bp, H. sapiens
cccagtctgtggaaaa

SEQ ID NO: 77356 - DNA, 16 bp, H. sapiens
cccagtctgtggcttt

SEQ ID NO: 77357 - DNA, 16 bp, H. sapiens
cccagtgagaccaatg

SEQ ID NO: 77358 - DNA, 16 bp, H. sapiens
cccagtgagatgaacc

SEQ ID NO: 77359 - DNA, 16 bp, H. sapiens
cccagtgatcccatta

SEQ ID NO: 77360 - DNA, 16 bp, H. sapiens
cccagtgatgctcaga

SEQ ID NO: 77361 - DNA, 16 bp, H. sapiens
cccagtgcacaggctg

SEQ ID NO: 77362 - DNA, 16 bp, H. sapiens
cccagtgcccagcaca

SEQ ID NO: 77363 - DNA, 16 bp, H. sapiens
cccagtgcccctcacc

SEQ ID NO: 77364 - DNA, 16 bp, H. sapiens
cccagtgccttgggag

SEQ ID NO: 77365 - DNA, 20 bp, H. sapiens
cccagtgctttgggaggcca

SEQ ID NO: 77366 - DNA, 16 bp, H. sapiens
cccagtggaagataat

SEQ ID NO: 77367 - DNA, 16 bp, H. sapiens
cccagtggcgcctgga

SEQ ID NO: 77368 - DNA, 16 bp, H. sapiens
cccagtggctcacatc

SEQ ID NO: 77369 - DNA, 16 bp, H. sapiens
cccagtggggactgtg

SEQ ID NO: 77370 - DNA, 16 bp, H. sapiens
cccagtgggtggaggt

SEQ ID NO: 77371 - DNA, 16 bp, H. sapiens
cccagtggtgcctgga

SEQ ID NO: 77372 - DNA, 16 bp, H. sapiens
cccagtggttggaact

SEQ ID NO: 77373 - DNA, 16 bp, H. sapiens
cccagtgtatgttctc

SEQ ID NO: 77374 - DNA, 16 bp, H. sapiens
cccagtgtcctctgga

SEQ ID NO: 77375 - DNA, 16 bp, H. sapiens
cccagtgtctattgtt

SEQ ID NO: 77376 - DNA, 16 bp, H. sapiens
cccagtgtctattttt

SEQ ID NO: 77377 - DNA, 16 bp, H. sapiens
cccagtgtctgttgtt

SEQ ID NO: 77378 - DNA, 16 bp, H. sapiens
cccagtgtgctggttc

SEQ ID NO: 77379 - DNA, 16 bp, H. sapiens
cccagtgtggactctg

SEQ ID NO: 77380 - DNA, 16 bp, H. sapiens
cccagtgtggtggtgt

SEQ ID NO: 77381 - DNA, 16 bp, H. sapiens
cccagtgttctttgga

SEQ ID NO: 77382 - DNA, 16 bp, H. sapiens
cccagtgttgcccagg

SEQ ID NO: 77383 - DNA, 16 bp, H. sapiens
cccagtgttggagaag

SEQ ID NO: 77384 - DNA, 16 bp, H. sapiens
cccagttaagttttgt

SEQ ID NO: 77385 - DNA, 16 bp, H. sapiens
cccagttacttggggg

SEQ ID NO: 77386 - DNA, 16 bp, H. sapiens
cccagttattcaggag

SEQ ID NO: 77387 - DNA, 16 bp, H. sapiens
cccagttcaagagatt

SEQ ID NO: 77388 - DNA, 16 bp, H. sapiens
cccagttcatggaaaa

SEQ ID NO: 77389 - DNA, 16 bp, H. sapiens
cccagttccagcttcc

SEQ ID NO: 77390 - DNA, 16 bp, H. sapiens
cccagttcccctgcag

SEQ ID NO: 77391 - DNA, 16 bp, H. sapiens
cccagttcctaacagg

SEQ ID NO: 77392 - DNA, 16 bp, H. sapiens
cccagttctgccattt

SEQ ID NO: 77393 - DNA, 16 bp, H. sapiens
cccagttctggcagga

SEQ ID NO: 77394 - DNA, 16 bp, H. sapiens
cccagttgagaaccat

SEQ ID NO: 77395 - DNA, 16 bp, H. sapiens
cccagttggcttcacc

SEQ ID NO: 77396 - DNA, 16 bp, H. sapiens
cccagtttcaagtgat

SEQ ID NO: 77397 - DNA, 16 bp, H. sapiens
cccagtttcagttttc

SEQ ID NO: 77398 - DNA, 16 bp, H. sapiens
cccagtttcctccaat

SEQ ID NO: 77399 - DNA, 16 bp, H. sapiens
cccagtttctttcttt

SEQ ID NO: 77400 - DNA, 16 bp, H. sapiens
cccagtttgcagatga

SEQ ID NO: 77401 - DNA, 16 bp, H. sapiens
cccagtttgtgatatt

SEQ ID NO: 77402 - DNA, 16 bp, H. sapiens
cccagttttcccagga

SEQ ID NO: 77403 - DNA, 16 bp, H. sapiens
cccataaaattataat

SEQ ID NO: 77404 - DNA, 16 bp, H. sapiens
cccataaatatatata

SEQ ID NO: 77405 - DNA, 16 bp, H. sapiens
cccataaatgtgtaca

SEQ ID NO: 77406 - DNA, 16 bp, H. sapiens
cccataactttgggag

SEQ ID NO: 77407 - DNA, 16 bp, H. sapiens
cccataatccctacat

SEQ ID NO: 77408 - DNA, 16 bp, H. sapiens
cccatactgttttcat

SEQ ID NO: 77409 - DNA, 16 bp, H. sapiens
cccatagaactttaca

SEQ ID NO: 77410 - DNA, 16 bp, H. sapiens
cccataggctcaacac

SEQ ID NO: 77411 - DNA, 16 bp, H. sapiens
cccatagtcccagcac

SEQ ID NO: 77412 - DNA, 16 bp, H. sapiens
cccatcaaaaagtgtg

SEQ ID NO: 77413 - DNA, 16 bp, H. sapiens
cccatcaaaatgccac

SEQ ID NO: 77414 - DNA, 16 bp, H. sapiens
cccatcaagaggtgga

SEQ ID NO: 77415 - DNA, 16 bp, H. sapiens
cccatcaatcaataag

SEQ ID NO: 77416 - DNA, 16 bp, H. sapiens
cccatcacagacccag

SEQ ID NO: 77417 - DNA, 16 bp, H. sapiens
cccatcaccacatctg

SEQ ID NO: 77418 - DNA, 16 bp, H. sapiens
cccatcacctccagat

SEQ ID NO: 77419 - DNA, 16 bp, H. sapiens
cccatcacctggcagg

SEQ ID NO: 77420 - DNA, 16 bp, H. sapiens
cccatcactacaaaaa

SEQ ID NO: 77421 - DNA, 16 bp, H. sapiens
cccatcactcagggca

SEQ ID NO: 77422 - DNA, 16 bp, H. sapiens
cccatcactttggaag

SEQ ID NO: 77423 - DNA, 16 bp, H. sapiens
cccatcagcctgtcat

SEQ ID NO: 77424 - DNA, 16 bp, H. sapiens
cccatcagtgttctgt

SEQ ID NO: 77425 - DNA, 16 bp, H. sapiens
cccatcatgtcagccc

SEQ ID NO: 77426 - DNA, 16 bp, H. sapiens
cccatcattgaccaaa

SEQ ID NO: 77427 - DNA, 16 bp, H. sapiens
cccatcattttcaggt

SEQ ID NO: 77428 - DNA, 16 bp, H. sapiens
cccatccatccatcca

SEQ ID NO: 77429 - DNA, 16 bp, H. sapiens
cccatccatcctccat

SEQ ID NO: 77430 - DNA, 16 bp, H. sapiens
cccatcccctgcctct

SEQ ID NO: 77431 - DNA, 16 bp, H. sapiens
cccatccctacaaaaa

SEQ ID NO: 77432 - DNA, 16 bp, H. sapiens
cccatccctttatttc

SEQ ID NO: 77433 - DNA, 16 bp, H. sapiens
cccatcctcaatctgg

SEQ ID NO: 77434 - DNA, 16 bp, H. sapiens
cccatcctctcagccc

SEQ ID NO: 77435 - DNA, 16 bp, H. sapiens
cccatcctctggcaca

SEQ ID NO: 77436 - DNA, 16 bp, H. sapiens
cccatcctctgggatg

SEQ ID NO: 77437 - DNA, 16 bp, H. sapiens
cccatcctggccaaca

SEQ ID NO: 77438 - DNA, 16 bp, H. sapiens
cccatcgctcacatta

SEQ ID NO: 77439 - DNA, 23 bp, H. sapiens
cccatcgtctgagatgtggggag

SEQ ID NO: 77440 - DNA, 16 bp, H. sapiens
cccatctactcaggaa

SEQ ID NO: 77441 - DNA, 16 bp, H. sapiens
cccatctcaacctctc

SEQ ID NO: 77442 - DNA, 16 bp, H. sapiens
cccatctcagccccct

SEQ ID NO: 77443 - DNA, 16 bp, H. sapiens
cccatctcagcctcca

SEQ ID NO: 77444 - DNA, 16 bp, H. sapiens
cccatctccacaaata

SEQ ID NO: 77445 - DNA, 16 bp, H. sapiens
cccatctccagcctcc

SEQ ID NO: 77446 - DNA, 16 bp, H. sapiens
cccatctcctcagctg

SEQ ID NO: 77447 - DNA, 16 bp, H. sapiens
cccatctctaaaaaaa

SEQ ID NO: 77448 - DNA, 16 bp, H. sapiens
cccatctctaaacaaa

SEQ ID NO: 77449 - DNA, 16 bp, H. sapiens
cccatctctacaaaaa

SEQ ID NO: 77450 - DNA, 16 bp, H. sapiens
cccatctctacaaaat

SEQ ID NO: 77451 - DNA, 16 bp, H. sapiens
cccatctctaccagaa

SEQ ID NO: 77452 - DNA, 16 bp, H. sapiens
cccatctctactgaat

SEQ ID NO: 77453 - DNA, 16 bp, H. sapiens
cccatctctgcaaaaa

SEQ ID NO: 77454 - DNA, 16 bp, H. sapiens
cccatctctgccttca

SEQ ID NO: 77455 - DNA, 16 bp, H. sapiens
cccatctctgggcctc

SEQ ID NO: 77456 - DNA, 16 bp, H. sapiens
cccatctctgtgcctc

SEQ ID NO: 77457 - DNA, 16 bp, H. sapiens
cccatctgaaaaatgg

SEQ ID NO: 77458 - DNA, 16 bp, H. sapiens
cccatctgacaaggga

SEQ ID NO: 77459 - DNA, 16 bp, H. sapiens
cccatctggccaacat

SEQ ID NO: 77460 - DNA, 16 bp, H. sapiens
cccatcttaaaaacaa

SEQ ID NO: 77461 - DNA, 16 bp, H. sapiens
cccatctttacaaaaa

SEQ ID NO: 77462 - DNA, 16 bp, H. sapiens
cccatctttactaata

SEQ ID NO: 77463 - DNA, 16 bp, H. sapiens
cccatgaagcagaggt

SEQ ID NO: 77464 - DNA, 16 bp, H. sapiens
cccatgaaggcagctg

SEQ ID NO: 77465 - DNA, 16 bp, H. sapiens
cccatgcccacccaga

SEQ ID NO: 77466 - DNA, 16 bp, H. sapiens
cccatgcccacctgga

SEQ ID NO: 77467 - DNA, 16 bp, H. sapiens
cccatgcccagctaat

SEQ ID NO: 77468 - DNA, 19 bp, H. sapiens
cccatgcccagctaatttt

SEQ ID NO: 77469 - DNA, 16 bp, H. sapiens
cccatgcccatggagc

SEQ ID NO: 77470 - DNA, 16 bp, H. sapiens
cccatgcctcagcctc

SEQ ID NO: 77471 - DNA, 16 bp, H. sapiens
cccatgctggagtgga

SEQ ID NO: 77472 - DNA, 16 bp, H. sapiens
cccatgctgtagcagg

SEQ ID NO: 77473 - DNA, 16 bp, H. sapiens
cccatggagaatggag

SEQ ID NO: 77474 - DNA, 16 bp, H. sapiens
cccatggatactgagg

SEQ ID NO: 77475 - DNA, 16 bp, H. sapiens
cccatggcaggatcca

SEQ ID NO: 77476 - DNA, 16 bp, H. sapiens
cccatggccaccacca

SEQ ID NO: 77477 - DNA, 16 bp, H. sapiens
cccatggcccctccca

SEQ ID NO: 77478 - DNA, 16 bp, H. sapiens
cccatggctttgctgg

SEQ ID NO: 77479 - DNA, 16 bp, H. sapiens
cccatgggccaaatct

SEQ ID NO: 77480 - DNA, 16 bp, H. sapiens
cccatgggcctgaaga

SEQ ID NO: 77481 - DNA, 16 bp, H. sapiens
cccatggtcacacagc

SEQ ID NO: 77482 - DNA, 16 bp, H. sapiens
cccatggtttccagaa

SEQ ID NO: 77483 - DNA, 16 bp, H. sapiens
cccatgtacacacaca

SEQ ID NO: 77484 - DNA, 16 bp, H. sapiens
cccatgtagctggggc

SEQ ID NO: 77485 - DNA, 16 bp, H. sapiens
cccatgtccctacaaa

SEQ ID NO: 77486 - DNA, 16 bp, H. sapiens
cccatgtgtgatgttc

SEQ ID NO: 77487 - DNA, 16 bp, H. sapiens
cccatgttattcaagg

SEQ ID NO: 77488 - DNA, 16 bp, H. sapiens
cccatgttcactgcag

SEQ ID NO: 77489 - DNA, 16 bp, H. sapiens
cccattaacaattgct

SEQ ID NO: 77490 - DNA, 16 bp, H. sapiens
cccattataaaagatt

SEQ ID NO: 77491 - DNA, 16 bp, H. sapiens
cccattcaagatggag

SEQ ID NO: 77492 - DNA, 16 bp, H. sapiens
cccattctccatggtg

SEQ ID NO: 77493 - DNA, 16 bp, H. sapiens
cccattctctcctagc

SEQ ID NO: 77494 - DNA, 16 bp, H. sapiens
cccattctctgggttg

SEQ ID NO: 77495 - DNA, 16 bp, H. sapiens
cccattctgtaaattg

SEQ ID NO: 77496 - DNA, 16 bp, H. sapiens
cccattcttgggtatg

SEQ ID NO: 77497 - DNA, 16 bp, H. sapiens
cccattgcaaggaagc

SEQ ID NO: 77498 - DNA, 16 bp, H. sapiens
cccattgccttgaagg

SEQ ID NO: 77499 - DNA, 16 bp, H. sapiens
cccattggagtgttgt

SEQ ID NO: 77500 - DNA, 16 bp, H. sapiens
cccattggttattttt

SEQ ID NO: 77501 - DNA, 16 bp, H. sapiens
cccatttataatagct

SEQ ID NO: 77502 - DNA, 16 bp, H. sapiens
cccatttatatttaag

SEQ ID NO: 77503 - DNA, 16 bp, H. sapiens
cccatttatgagggct

SEQ ID NO: 77504 - DNA, 16 bp, H. sapiens
cccatttatttatctt

SEQ ID NO: 77505 - DNA, 16 bp, H. sapiens
cccatttcacaaatga

SEQ ID NO: 77506 - DNA, 16 bp, H. sapiens
cccatttcacagagaa

SEQ ID NO: 77507 - DNA, 16 bp, H. sapiens
cccatttcacagagga

SEQ ID NO: 77508 - DNA, 16 bp, H. sapiens
cccatttctacaaaaa

SEQ ID NO: 77509 - DNA, 16 bp, H. sapiens
cccatttctccatttt

SEQ ID NO: 77510 - DNA, 16 bp, H. sapiens
cccatttcttgttttg

SEQ ID NO: 77511 - DNA, 16 bp, H. sapiens
cccatttctttaaaaa

SEQ ID NO: 77512 - DNA, 16 bp, H. sapiens
cccatttgacagatga

SEQ ID NO: 77513 - DNA, 16 bp, H. sapiens
cccatttgacagatgg

SEQ ID NO: 77514 - DNA, 16 bp, H. sapiens
cccatttgttttggcc

SEQ ID NO: 77515 - DNA, 16 bp, H. sapiens
cccattttaaagaaga

SEQ ID NO: 77516 - DNA, 16 bp, H. sapiens
cccattttaaagatgg

SEQ ID NO: 77517 - DNA, 16 bp, H. sapiens
cccattttacagacaa

SEQ ID NO: 77518 - DNA, 16 bp, H. sapiens
cccattttacagagga

SEQ ID NO: 77519 - DNA, 16 bp, H. sapiens
cccattttacagataa

SEQ ID NO: 77520 - DNA, 16 bp, H. sapiens
cccattttacagatgg

SEQ ID NO: 77521 - DNA, 16 bp, H. sapiens
cccattttagggatga

SEQ ID NO: 77522 - DNA, 16 bp, H. sapiens
cccattttggcctccc

SEQ ID NO: 77523 - DNA, 16 bp, H. sapiens
cccatttttcagatgg

SEQ ID NO: 77524 - DNA, 16 bp, H. sapiens
cccattttttgctttt

SEQ ID NO: 77525 - DNA, 16 bp, H. sapiens
ccccaaaacaattaca

SEQ ID NO: 77526 - DNA, 16 bp, H. sapiens
ccccaaaatgctggaa

SEQ ID NO: 77527 - DNA, 16 bp, H. sapiens
ccccaaaatgtataaa

SEQ ID NO: 77528 - DNA, 16 bp, H. sapiens
ccccaaaattagccag

SEQ ID NO: 77529 - DNA, 16 bp, H. sapiens
ccccaaaattcgtatg

SEQ ID NO: 77530 - DNA, 16 bp, H. sapiens
ccccaaaatttatgtt

SEQ ID NO: 77531 - DNA, 16 bp, H. sapiens
ccccaaacctcagcac

SEQ ID NO: 77532 - DNA, 16 bp, H. sapiens
ccccaaactcctcagg

SEQ ID NO: 77533 - DNA, 16 bp, H. sapiens
ccccaaagaattgaaa

SEQ ID NO: 77534 - DNA, 16 bp, H. sapiens
ccccaaagagctggga

SEQ ID NO: 77535 - DNA, 16 bp, H. sapiens
ccccaaagcaattaca

SEQ ID NO: 77536 - DNA, 16 bp, H. sapiens
ccccaaagcacaagag

SEQ ID NO: 77537 - DNA, 16 bp, H. sapiens
ccccaaagtagaaaca

SEQ ID NO: 77538 - DNA, 19 bp, H. sapiens
ccccaaagtgctgggatta

SEQ ID NO: 77539 - DNA, 19 bp, H. sapiens
ccccaaagtgttgggatta

SEQ ID NO: 77540 - DNA, 16 bp, H. sapiens
ccccaaataatttctt

SEQ ID NO: 77541 - DNA, 16 bp, H. sapiens
ccccaaatcaacagga

SEQ ID NO: 77542 - DNA, 18 bp, H. sapiens
ccccaacacttcaacact

SEQ ID NO: 77543 - DNA, 16 bp, H. sapiens
ccccaaccccaggcag

SEQ ID NO: 77544 - DNA, 16 bp, H. sapiens
ccccaacccctgagcc

SEQ ID NO: 77545 - DNA, 16 bp, H. sapiens
ccccaacctctgcctc

SEQ ID NO: 77546 - DNA, 16 bp, H. sapiens
ccccaacttccctgac

SEQ ID NO: 77547 - DNA, 16 bp, H. sapiens
ccccaagacacataat

SEQ ID NO: 77548 - DNA, 16 bp, H. sapiens
ccccaagagtgcagag

SEQ ID NO: 77549 - DNA, 16 bp, H. sapiens
ccccaagcatcgctga

SEQ ID NO: 77550 - DNA, 16 bp, H. sapiens
ccccaagccagagctg

SEQ ID NO: 77551 - DNA, 16 bp, H. sapiens
ccccaagtctgtttcc

SEQ ID NO: 77552 - DNA, 16 bp, H. sapiens
ccccaatgtcaacatt

SEQ ID NO: 77553 - DNA, 16 bp, H. sapiens
ccccacaacctgcctg

SEQ ID NO: 77554 - DNA, 16 bp, H. sapiens
ccccacaataaagaat

SEQ ID NO: 77555 - DNA, 16 bp, H. sapiens
ccccacacacagtccc

SEQ ID NO: 77556 - DNA, 16 bp, H. sapiens
ccccacacagaggccc

SEQ ID NO: 77557 - DNA, 16 bp, H. sapiens
ccccacacagagtccc

SEQ ID NO: 77558 - DNA, 16 bp, H. sapiens
ccccacacagagtctc

SEQ ID NO: 77559 - DNA, 16 bp, H. sapiens
ccccacagcaggccct

SEQ ID NO: 77560 - DNA, 16 bp, H. sapiens
ccccacagcctgcacc

SEQ ID NO: 77561 - DNA, 16 bp, H. sapiens
ccccacagcctgccca

SEQ ID NO: 77562 - DNA, 16 bp, H. sapiens
ccccacagctgccctc

SEQ ID NO: 77563 - DNA, 16 bp, H. sapiens
ccccacaggccagcag

SEQ ID NO: 77564 - DNA, 16 bp, H. sapiens
ccccacagggaggcag

SEQ ID NO: 77565 - DNA, 16 bp, H. sapiens
ccccacagggtcagtg

SEQ ID NO: 77566 - DNA, 16 bp, H. sapiens
ccccacatggtggaag

SEQ ID NO: 77567 - DNA, 16 bp, H. sapiens
ccccaccaaaaagtgg

SEQ ID NO: 77568 - DNA, 16 bp, H. sapiens
ccccaccaaattcata

SEQ ID NO: 77569 - DNA, 16 bp, H. sapiens
ccccaccaagctcaag

SEQ ID NO: 77570 - DNA, 16 bp, H. sapiens
ccccaccaagctcgag

SEQ ID NO: 77571 - DNA, 16 bp, H. sapiens
ccccaccaggactggg

SEQ ID NO: 77572 - DNA, 16 bp, H. sapiens
ccccaccaggctgcag

SEQ ID NO: 77573 - DNA, 16 bp, H. sapiens
ccccaccagggccctg

SEQ ID NO: 77574 - DNA, 16 bp, H. sapiens
ccccacccacatcctg

SEQ ID NO: 77575 - DNA, 16 bp, H. sapiens
ccccacccactgcctg

SEQ ID NO: 77576 - DNA, 16 bp, H. sapiens
ccccacccagaggcag

SEQ ID NO: 77577 - DNA, 16 bp, H. sapiens
ccccaccccagctctg

SEQ ID NO: 77578 - DNA, 16 bp, H. sapiens
ccccaccccaggacag

SEQ ID NO: 77579 - DNA, 16 bp, H. sapiens
ccccaccccaggccta

SEQ ID NO: 77580 - DNA, 16 bp, H. sapiens
ccccaccccaggcctg

SEQ ID NO: 77581 - DNA, 16 bp, H. sapiens
ccccaccccataacag

SEQ ID NO: 77582 - DNA, 16 bp, H. sapiens
ccccaccccatcctgt

SEQ ID NO: 77583 - DNA, 16 bp, H. sapiens
ccccaccccctgacaa

SEQ ID NO: 77584 - DNA, 16 bp, H. sapiens
ccccacccctacagca

SEQ ID NO: 77585 - DNA, 16 bp, H. sapiens
ccccaccctgcctcag

SEQ ID NO: 77586 - DNA, 16 bp, H. sapiens
ccccaccctggccctg

SEQ ID NO: 77587 - DNA, 16 bp, H. sapiens
ccccacctccaacttt

SEQ ID NO: 77588 - DNA, 16 bp, H. sapiens
ccccacctccccaggg

SEQ ID NO: 77589 - DNA, 16 bp, H. sapiens
ccccacctgcccagct

SEQ ID NO: 77590 - DNA, 16 bp, H. sapiens
ccccacctgcctcctg

SEQ ID NO: 77591 - DNA, 16 bp, H. sapiens
ccccacctttctggac

SEQ ID NO: 77592 - DNA, 16 bp, H. sapiens
ccccacgcccagctaa

SEQ ID NO: 77593 - DNA, 16 bp, H. sapiens
ccccacggagcccagc

SEQ ID NO: 77594 - DNA, 16 bp, H. sapiens
ccccacggagtcccca

SEQ ID NO: 77595 - DNA, 16 bp, H. sapiens
ccccacggcagtgtct

SEQ ID NO: 77596 - DNA, 16 bp, H. sapiens
ccccactacaggcccc

SEQ ID NO: 77597 - DNA, 16 bp, H. sapiens
ccccactcagcctcct

SEQ ID NO: 77598 - DNA, 16 bp, H. sapiens
ccccactcctcagcct

SEQ ID NO: 77599 - DNA, 16 bp, H. sapiens
ccccactcctgcctgc

SEQ ID NO: 77600 - DNA, 16 bp, H. sapiens
ccccactcctggcacc

SEQ ID NO: 77601 - DNA, 16 bp, H. sapiens
ccccactcctggctgc

SEQ ID NO: 77602 - DNA, 16 bp, H. sapiens
ccccactctcctctgg

SEQ ID NO: 77603 - DNA, 16 bp, H. sapiens
ccccactctgcctgcc

SEQ ID NO: 77604 - DNA, 16 bp, H. sapiens
ccccactctgctggta

SEQ ID NO: 77605 - DNA, 16 bp, H. sapiens
ccccactctgcttctg

SEQ ID NO: 77606 - DNA, 16 bp, H. sapiens
ccccactgccctgtgc

SEQ ID NO: 77607 - DNA, 16 bp, H. sapiens
ccccactgggtggcta

SEQ ID NO: 77608 - DNA, 16 bp, H. sapiens
ccccactgtatctagg

SEQ ID NO: 77609 - DNA, 16 bp, H. sapiens
ccccactgtcttctgg

SEQ ID NO: 77610 - DNA, 16 bp, H. sapiens
ccccacttccctgaca

SEQ ID NO: 77611 - DNA, 16 bp, H. sapiens
ccccacttcctccctg

SEQ ID NO: 77612 - DNA, 16 bp, H. sapiens
ccccacttggcctccc

SEQ ID NO: 77613 - DNA, 16 bp, H. sapiens
ccccactttacagatg

SEQ ID NO: 77614 - DNA, 16 bp, H. sapiens
ccccagaaaggcaggg

SEQ ID NO: 77615 - DNA, 16 bp, H. sapiens
ccccagaactgtgaga

SEQ ID NO: 77616 - DNA, 16 bp, H. sapiens
ccccagaagcagaagc

SEQ ID NO: 77617 - DNA, 16 bp, H. sapiens
ccccagaagcagaagt

SEQ ID NO: 77618 - DNA, 16 bp, H. sapiens
ccccagaagtcaagca

SEQ ID NO: 77619 - DNA, 16 bp, H. sapiens
ccccagaatgtgacct

SEQ ID NO: 77620 - DNA, 16 bp, H. sapiens
ccccagacccagggct

SEQ ID NO: 77621 - DNA, 16 bp, H. sapiens
ccccagacctcctgaa

SEQ ID NO: 77622 - DNA, 16 bp, H. sapiens
ccccagactcagctgg

SEQ ID NO: 77623 - DNA, 16 bp, H. sapiens
ccccagactgggtgac

SEQ ID NO: 77624 - DNA, 16 bp, H. sapiens
ccccagagactgagca

SEQ ID NO: 77625 - DNA, 16 bp, H. sapiens
ccccagagatctgtgg

SEQ ID NO: 77626 - DNA, 16 bp, H. sapiens
ccccagagcacttcag

SEQ ID NO: 77627 - DNA, 16 bp, H. sapiens
ccccagagcactttag

SEQ ID NO: 77628 - DNA, 16 bp, H. sapiens
ccccagagcactttgg

SEQ ID NO: 77629 - DNA, 16 bp, H. sapiens
ccccagagcccaggcc

SEQ ID NO: 77630 - DNA, 16 bp, H. sapiens
ccccagagccccagag

SEQ ID NO: 77631 - DNA, 16 bp, H. sapiens
ccccagagcctccaga

SEQ ID NO: 77632 - DNA, 16 bp, H. sapiens
ccccagagcctccagg

SEQ ID NO: 77633 - DNA, 16 bp, H. sapiens
ccccagagggcatgtt

SEQ ID NO: 77634 - DNA, 16 bp, H. sapiens
ccccagatgcccagct

SEQ ID NO: 77635 - DNA, 16 bp, H. sapiens
ccccagcaagacagaa

SEQ ID NO: 77636 - DNA, 16 bp, H. sapiens
ccccagcaccatttat

SEQ ID NO: 77637 - DNA, 16 bp, H. sapiens
ccccagcaccctccag

SEQ ID NO: 77638 - DNA, 16 bp, H. sapiens
ccccagcacctggcac

SEQ ID NO: 77639 - DNA, 16 bp, H. sapiens
ccccagcactggctgt

SEQ ID NO: 77640 - DNA, 16 bp, H. sapiens
ccccagcactttggga

SEQ ID NO: 77641 - DNA, 16 bp, H. sapiens
ccccagcagcagctgc

SEQ ID NO: 77642 - DNA, 16 bp, H. sapiens
ccccagcagccccagg

SEQ ID NO: 77643 - DNA, 16 bp, H. sapiens
ccccagcagccctggg

SEQ ID NO: 77644 - DNA, 16 bp, H. sapiens
ccccagcagctgggac

SEQ ID NO: 77645 - DNA, 16 bp, H. sapiens
ccccagcaggccccag

SEQ ID NO: 77646 - DNA, 16 bp, H. sapiens
ccccagcatcacacag

SEQ ID NO: 77647 - DNA, 16 bp, H. sapiens
ccccagccaccagtca

SEQ ID NO: 77648 - DNA, 16 bp, H. sapiens
ccccagccactccagc

SEQ ID NO: 77649 - DNA, 16 bp, H. sapiens
ccccagccagcagctg

SEQ ID NO: 77650 - DNA, 16 bp, H. sapiens
ccccagccaggccctg

SEQ ID NO: 77651 - DNA, 16 bp, H. sapiens
ccccagccaggcctcc

SEQ ID NO: 77652 - DNA, 16 bp, H. sapiens
ccccagccatgaagaa

SEQ ID NO: 77653 - DNA, 16 bp, H. sapiens
ccccagcccagaactc

SEQ ID NO: 77654 - DNA, 16 bp, H. sapiens
ccccagcccaggcagg

SEQ ID NO: 77655 - DNA, 16 bp, H. sapiens
ccccagccccacctga

SEQ ID NO: 77656 - DNA, 16 bp, H. sapiens
ccccagccccagctgg

SEQ ID NO: 77657 - DNA, 16 bp, H. sapiens
ccccagccccaggcag

SEQ ID NO: 77658 - DNA, 16 bp, H. sapiens
ccccagccccagggct

SEQ ID NO: 77659 - DNA, 16 bp, H. sapiens
ccccagccccctgagt

SEQ ID NO: 77660 - DNA, 16 bp, H. sapiens
ccccagcccctgcagc

SEQ ID NO: 77661 - DNA, 16 bp, H. sapiens
ccccagcccctgcctg

SEQ ID NO: 77662 - DNA, 16 bp, H. sapiens
ccccagcccctgctgc

SEQ ID NO: 77663 - DNA, 16 bp, H. sapiens
ccccagcccctgggaa

SEQ ID NO: 77664 - DNA, 16 bp, H. sapiens
ccccagccctcaggga

SEQ ID NO: 77665 - DNA, 16 bp, H. sapiens
ccccagccctgcagcc

SEQ ID NO: 77666 - DNA, 16 bp, H. sapiens
ccccagccctgccctg

SEQ ID NO: 77667 - DNA, 16 bp, H. sapiens
ccccagccctgcctca

SEQ ID NO: 77668 - DNA, 16 bp, H. sapiens
ccccagccctgcctct

SEQ ID NO: 77669 - DNA, 16 bp, H. sapiens
ccccagccctgcctgg

SEQ ID NO: 77670 - DNA, 16 bp, H. sapiens
ccccagccctgctgcc

SEQ ID NO: 77671 - DNA, 16 bp, H. sapiens
ccccagccctggcctc

SEQ ID NO: 77672 - DNA, 16 bp, H. sapiens
ccccagccctggctcc

SEQ ID NO: 77673 - DNA, 16 bp, H. sapiens
ccccagcctcagccca

SEQ ID NO: 77674 - DNA, 16 bp, H. sapiens
ccccagcctcagcctc

SEQ ID NO: 77675 - DNA, 16 bp, H. sapiens
ccccagcctcagctcc

SEQ ID NO: 77676 - DNA, 16 bp, H. sapiens
ccccagcctcccacag

SEQ ID NO: 77677 - DNA, 16 bp, H. sapiens
ccccagcctcccaggg

SEQ ID NO: 77678 - DNA, 16 bp, H. sapiens
ccccagcctcctgcct

SEQ ID NO: 77679 - DNA, 16 bp, H. sapiens
ccccagcctcctgctg

SEQ ID NO: 77680 - DNA, 16 bp, H. sapiens
ccccagcctcctgggt

SEQ ID NO: 77681 - DNA, 16 bp, H. sapiens
ccccagcctcgctgcc

SEQ ID NO: 77682 - DNA, 16 bp, H. sapiens
ccccagcctctctgcc

SEQ ID NO: 77683 - DNA, 16 bp, H. sapiens
ccccagcctctgcctg

SEQ ID NO: 77684 - DNA, 16 bp, H. sapiens
ccccagcctgagtgac

SEQ ID NO: 77685 - DNA, 16 bp, H. sapiens
ccccagcctgcactga

SEQ ID NO: 77686 - DNA, 16 bp, H. sapiens
ccccagcctggcccag

SEQ ID NO: 77687 - DNA, 16 bp, H. sapiens
ccccagcctggcctcc

SEQ ID NO: 77688 - DNA, 16 bp, H. sapiens
ccccagcctggctgcc

SEQ ID NO: 77689 - DNA, 16 bp, H. sapiens
ccccagcctgggagac

SEQ ID NO: 77690 - DNA, 16 bp, H. sapiens
ccccagcctgggcacc

SEQ ID NO: 77691 - DNA, 16 bp, H. sapiens
ccccagccttccaaag

SEQ ID NO: 77692 - DNA, 16 bp, H. sapiens
ccccagccttccaagt

SEQ ID NO: 77693 - DNA, 16 bp, H. sapiens
ccccagcggcccagct

SEQ ID NO: 77694 - DNA, 16 bp, H. sapiens
ccccagctactcagca

SEQ ID NO: 77695 - DNA, 26 bp, H. sapiens
ccccagctacttgggaggctgaggca

SEQ ID NO: 77696 - DNA, 16 bp, H. sapiens
ccccagctcaagccat

SEQ ID NO: 77697 - DNA, 16 bp, H. sapiens
ccccagctcagcctcc

SEQ ID NO: 77698 - DNA, 16 bp, H. sapiens
ccccagctccagccct

SEQ ID NO: 77699 - DNA, 16 bp, H. sapiens
ccccagctccagctcc

SEQ ID NO: 77700 - DNA, 16 bp, H. sapiens
ccccagctccaggcag

SEQ ID NO: 77701 - DNA, 16 bp, H. sapiens
ccccagctcccagctc

SEQ ID NO: 77702 - DNA, 16 bp, H. sapiens
ccccagctcctgcctc

SEQ ID NO: 77703 - DNA, 16 bp, H. sapiens
ccccagctcctggtaa

SEQ ID NO: 77704 - DNA, 16 bp, H. sapiens
ccccagctccttcagc

SEQ ID NO: 77705 - DNA, 16 bp, H. sapiens
ccccagctccttcctc

SEQ ID NO: 77706 - DNA, 16 bp, H. sapiens
ccccagctctacaaaa

SEQ ID NO: 77707 - DNA, 16 bp, H. sapiens
ccccagctctgcccag

SEQ ID NO: 77708 - DNA, 16 bp, H. sapiens
ccccagctctgccctc

SEQ ID NO: 77709 - DNA, 16 bp, H. sapiens
ccccagctctgtccct

SEQ ID NO: 77710 - DNA, 16 bp, H. sapiens
ccccagctgccagcag

SEQ ID NO: 77711 - DNA, 16 bp, H. sapiens
ccccagctgcccacag

SEQ ID NO: 77712 - DNA, 16 bp, H. sapiens
ccccagctgccccagc

SEQ ID NO: 77713 - DNA, 16 bp, H. sapiens
ccccagctgctcctcc

SEQ ID NO: 77714 - DNA, 16 bp, H. sapiens
ccccagctgctgctgc

SEQ ID NO: 77715 - DNA, 16 bp, H. sapiens
ccccagctgtggctca

SEQ ID NO: 77716 - DNA, 16 bp, H. sapiens
ccccagcttactgcct

SEQ ID NO: 77717 - DNA, 16 bp, H. sapiens
ccccaggacctcagaa

SEQ ID NO: 77718 - DNA, 16 bp, H. sapiens
ccccaggagaggccag

SEQ ID NO: 77719 - DNA, 16 bp, H. sapiens
ccccaggagctgagca

SEQ ID NO: 77720 - DNA, 16 bp, H. sapiens
ccccaggaggcagaag

SEQ ID NO: 77721 - DNA, 16 bp, H. sapiens
ccccaggaggtcctga

SEQ ID NO: 77722 - DNA, 16 bp, H. sapiens
ccccaggaggttgagg

SEQ ID NO: 77723 - DNA, 16 bp, H. sapiens
ccccaggagtcactgg

SEQ ID NO: 77724 - DNA, 16 bp, H. sapiens
ccccaggcaagaaggg

SEQ ID NO: 77725 - DNA, 16 bp, H. sapiens
ccccaggcagcccctg

SEQ ID NO: 77726 - DNA, 16 bp, H. sapiens
ccccaggcaggaaggg

SEQ ID NO: 77727 - DNA, 16 bp, H. sapiens
ccccaggcagtgaggg

SEQ ID NO: 77728 - DNA, 16 bp, H. sapiens
ccccaggccacacagc

SEQ ID NO: 77729 - DNA, 16 bp, H. sapiens
ccccaggccaggccag

SEQ ID NO: 77730 - DNA, 16 bp, H. sapiens
ccccaggccaggccct

SEQ ID NO: 77731 - DNA, 16 bp, H. sapiens
ccccaggcccagccct

SEQ ID NO: 77732 - DNA, 16 bp, H. sapiens
ccccaggcccagctcc

SEQ ID NO: 77733 - DNA, 16 bp, H. sapiens
ccccaggcccagctgc

SEQ ID NO: 77734 - DNA, 16 bp, H. sapiens
ccccaggcccagctgt

SEQ ID NO: 77735 - DNA, 16 bp, H. sapiens
ccccaggccctgccct

SEQ ID NO: 77736 - DNA, 16 bp, H. sapiens
ccccaggccctgctct

SEQ ID NO: 77737 - DNA, 16 bp, H. sapiens
ccccaggccctggcag

SEQ ID NO: 77738 - DNA, 16 bp, H. sapiens
ccccaggccctggggc

SEQ ID NO: 77739 - DNA, 16 bp, H. sapiens
ccccaggcctccccag

SEQ ID NO: 77740 - DNA, 16 bp, H. sapiens
ccccaggcctggccca

SEQ ID NO: 77741 - DNA, 16 bp, H. sapiens
ccccaggcctggccct

SEQ ID NO: 77742 - DNA, 16 bp, H. sapiens
ccccaggccttggcag

SEQ ID NO: 77743 - DNA, 16 bp, H. sapiens
ccccaggctcagccag

SEQ ID NO: 77744 - DNA, 16 bp, H. sapiens
ccccaggctcagccat

SEQ ID NO: 77745 - DNA, 16 bp, H. sapiens
ccccaggctgatctca

SEQ ID NO: 77746 - DNA, 16 bp, H. sapiens
ccccaggctgcacagc

SEQ ID NO: 77747 - DNA, 16 bp, H. sapiens
ccccaggctgcagtgc

SEQ ID NO: 77748 - DNA, 16 bp, H. sapiens
ccccaggctgcctcca

SEQ ID NO: 77749 - DNA, 16 bp, H. sapiens
ccccagggaagccatt

SEQ ID NO: 77750 - DNA, 16 bp, H. sapiens
ccccagggaccagtgc

SEQ ID NO: 77751 - DNA, 16 bp, H. sapiens
ccccagggaggggagg

SEQ ID NO: 77752 - DNA, 16 bp, H. sapiens
ccccagggcccagcct

SEQ ID NO: 77753 - DNA, 16 bp, H. sapiens
ccccagggcccaggag

SEQ ID NO: 77754 - DNA, 16 bp, H. sapiens
ccccagggctctgcag

SEQ ID NO: 77755 - DNA, 16 bp, H. sapiens
ccccagggctctgctc

SEQ ID NO: 77756 - DNA, 16 bp, H. sapiens
ccccagggctggggcc

SEQ ID NO: 77757 - DNA, 18 bp, H. sapiens
ccccagggcttttagaag

SEQ ID NO: 77758 - DNA, 16 bp, H. sapiens
ccccaggtacttggga

SEQ ID NO: 77759 - DNA, 16 bp, H. sapiens
ccccaggtcacacagc

SEQ ID NO: 77760 - DNA, 16 bp, H. sapiens
ccccaggtgatctgcc

SEQ ID NO: 77761 - DNA, 16 bp, H. sapiens
ccccaggtgatgtctg

SEQ ID NO: 77762 - DNA, 16 bp, H. sapiens
ccccaggtggatacct

SEQ ID NO: 77763 - DNA, 16 bp, H. sapiens
ccccagtaccagcccg

SEQ ID NO: 77764 - DNA, 16 bp, H. sapiens
ccccagtacctgggat

SEQ ID NO: 77765 - DNA, 16 bp, H. sapiens
ccccagtagctggggc

SEQ ID NO: 77766 - DNA, 16 bp, H. sapiens
ccccagtatgtgttgt

SEQ ID NO: 77767 - DNA, 16 bp, H. sapiens
ccccagtatttcaaca

SEQ ID NO: 77768 - DNA, 16 bp, H. sapiens
ccccagtccccagctc

SEQ ID NO: 77769 - DNA, 16 bp, H. sapiens
ccccagtccctggcaa

SEQ ID NO: 77770 - DNA, 17 bp, H. sapiens
ccccagtctcattccag

SEQ ID NO: 77771 - DNA, 16 bp, H. sapiens
ccccagtctcccaaag

SEQ ID NO: 77772 - DNA, 16 bp, H. sapiens
ccccagtctcctgagt

SEQ ID NO: 77773 - DNA, 16 bp, H. sapiens
ccccagtgcccagaga

SEQ ID NO: 77774 - DNA, 16 bp, H. sapiens
ccccagtgccctcagg

SEQ ID NO: 77775 - DNA, 16 bp, H. sapiens
ccccagtgcctcctga

SEQ ID NO: 77776 - DNA, 17 bp, H. sapiens
ccccagtgcctggatta

SEQ ID NO: 77777 - DNA, 16 bp, H. sapiens
ccccagtgctggaggt

SEQ ID NO: 77778 - DNA, 16 bp, H. sapiens
ccccagtgggtgcctg

SEQ ID NO: 77779 - DNA, 16 bp, H. sapiens
ccccagtgtatgttct

SEQ ID NO: 77780 - DNA, 16 bp, H. sapiens
ccccagtgtgtgttct

SEQ ID NO: 77781 - DNA, 16 bp, H. sapiens
ccccagttgagccttc

SEQ ID NO: 77782 - DNA, 16 bp, H. sapiens
ccccagttgtgacaac

SEQ ID NO: 77783 - DNA, 16 bp, H. sapiens
ccccagtttatgtttt

SEQ ID NO: 77784 - DNA, 16 bp, H. sapiens
ccccatacagagtccc

SEQ ID NO: 77785 - DNA, 16 bp, H. sapiens
ccccataccttgccct

SEQ ID NO: 77786 - DNA, 16 bp, H. sapiens
ccccataggtgaatca

SEQ ID NO: 77787 - DNA, 16 bp, H. sapiens
ccccatcacacctggc

SEQ ID NO: 77788 - DNA, 16 bp, H. sapiens
ccccatcactctcttt

SEQ ID NO: 77789 - DNA, 16 bp, H. sapiens
ccccatcagcaagaag

SEQ ID NO: 77790 - DNA, 16 bp, H. sapiens
ccccatcatcctcatc

SEQ ID NO: 77791 - DNA, 16 bp, H. sapiens
ccccatcatcctgaag

SEQ ID NO: 77792 - DNA, 16 bp, H. sapiens
ccccatcccagccctg

SEQ ID NO: 77793 - DNA, 16 bp, H. sapiens
ccccatccccatcctg

SEQ ID NO: 77794 - DNA, 16 bp, H. sapiens
ccccatcccctgcctg

SEQ ID NO: 77795 - DNA, 16 bp, H. sapiens
ccccatcccctggcag

SEQ ID NO: 77796 - DNA, 16 bp, H. sapiens
ccccatcctcatgacc

SEQ ID NO: 77797 - DNA, 16 bp, H. sapiens
ccccatcctccacagc

SEQ ID NO: 77798 - DNA, 16 bp, H. sapiens
ccccatcctggctgct

SEQ ID NO: 77799 - DNA, 16 bp, H. sapiens
ccccatcctgttctcg

SEQ ID NO: 77800 - DNA, 16 bp, H. sapiens
ccccatctcaagatct

SEQ ID NO: 77801 - DNA, 16 bp, H. sapiens
ccccatctcagcctcc

SEQ ID NO: 77802 - DNA, 16 bp, H. sapiens
ccccatctccacaaaa

SEQ ID NO: 77803 - DNA, 16 bp, H. sapiens
ccccatctctaaaaca

SEQ ID NO: 77804 - DNA, 16 bp, H. sapiens
ccccatctctactatt

SEQ ID NO: 77805 - DNA, 16 bp, H. sapiens
ccccatctgctgagag

SEQ ID NO: 77806 - DNA, 16 bp, H. sapiens
ccccatctgtaacatg

SEQ ID NO: 77807 - DNA, 16 bp, H. sapiens
ccccatcttacagatg

SEQ ID NO: 77808 - DNA, 16 bp, H. sapiens
ccccatctttactgaa

SEQ ID NO: 77809 - DNA, 16 bp, H. sapiens
ccccatgacaggcccc

SEQ ID NO: 77810 - DNA, 16 bp, H. sapiens
ccccatgacccaaaca

SEQ ID NO: 77811 - DNA, 16 bp, H. sapiens
ccccatgacccaatca

SEQ ID NO: 77812 - DNA, 16 bp, H. sapiens
ccccatgactcaatca

SEQ ID NO: 77813 - DNA, 16 bp, H. sapiens
ccccatgactgacctg

SEQ ID NO: 77814 - DNA, 16 bp, H. sapiens
ccccatgatccagaca

SEQ ID NO: 77815 - DNA, 16 bp, H. sapiens
ccccatgattcaatta

SEQ ID NO: 77816 - DNA, 16 bp, H. sapiens
ccccatgcctcagttt

SEQ ID NO: 77817 - DNA, 16 bp, H. sapiens
ccccatgcctcctgac

SEQ ID NO: 77818 - DNA, 16 bp, H. sapiens
ccccatgcctggctaa

SEQ ID NO: 77819 - DNA, 16 bp, H. sapiens
ccccatgcttttctca

SEQ ID NO: 77820 - DNA, 16 bp, H. sapiens
ccccatggccagggga

SEQ ID NO: 77821 - DNA, 16 bp, H. sapiens
ccccatggcccagtca

SEQ ID NO: 77822 - DNA, 17 bp, H. sapiens
ccccatggtctcagccc

SEQ ID NO: 77823 - DNA, 16 bp, H. sapiens
ccccatgtagctggga

SEQ ID NO: 77824 - DNA, 16 bp, H. sapiens
ccccatgtctacaaaa

SEQ ID NO: 77825 - DNA, 16 bp, H. sapiens
ccccatgtttaaaggt

SEQ ID NO: 77826 - DNA, 16 bp, H. sapiens
ccccattctgagccca

SEQ ID NO: 77827 - DNA, 16 bp, H. sapiens
ccccattgcacagatg

SEQ ID NO: 77828 - DNA, 16 bp, H. sapiens
ccccattgtgtgatgt

SEQ ID NO: 77829 - DNA, 16 bp, H. sapiens
ccccattgtgtgtttt

SEQ ID NO: 77830 - DNA, 16 bp, H. sapiens
ccccatttaaaagtgg

SEQ ID NO: 77831 - DNA, 16 bp, H. sapiens
ccccatttcctgtttt

SEQ ID NO: 77832 - DNA, 16 bp, H. sapiens
ccccatttctcagatg

SEQ ID NO: 77833 - DNA, 16 bp, H. sapiens
ccccattttacagatg

SEQ ID NO: 77834 - DNA, 16 bp, H. sapiens
ccccattttatacatg

SEQ ID NO: 77835 - DNA, 16 bp, H. sapiens
ccccattttgcagatg

SEQ ID NO: 77836 - DNA, 16 bp, H. sapiens
cccccaaaaaagaaat

SEQ ID NO: 77837 - DNA, 16 bp, H. sapiens
cccccaaaagtgctgg

SEQ ID NO: 77838 - DNA, 16 bp, H. sapiens
cccccaaaatcacact

SEQ ID NO: 77839 - DNA, 16 bp, H. sapiens
cccccaaaatgctggg

SEQ ID NO: 77840 - DNA, 16 bp, H. sapiens
cccccaaatatatttt

SEQ ID NO: 77841 - DNA, 16 bp, H. sapiens
cccccaacacccctgt

SEQ ID NO: 77842 - DNA, 16 bp, H. sapiens
cccccaaccatctgaa

SEQ ID NO: 77843 - DNA, 16 bp, H. sapiens
cccccaaccccttgtg

SEQ ID NO: 77844 - DNA, 16 bp, H. sapiens
cccccaagatggagtc

SEQ ID NO: 77845 - DNA, 17 bp, H. sapiens
cccccaagtagctggga

SEQ ID NO: 77846 - DNA, 16 bp, H. sapiens
cccccaatgtgactgt

SEQ ID NO: 77847 - DNA, 16 bp, H. sapiens
cccccacaggccctgg

SEQ ID NO: 77848 - DNA, 20 bp, H. sapiens
cccccaccacgcctggctaa

SEQ ID NO: 77849 - DNA, 16 bp, H. sapiens
cccccaccatgcccgg

SEQ ID NO: 77850 - DNA, 16 bp, H. sapiens
cccccacccactgaca

SEQ ID NO: 77851 - DNA, 16 bp, H. sapiens
cccccaccccaaattt

SEQ ID NO: 77852 - DNA, 16 bp, H. sapiens
cccccacccctgacag

SEQ ID NO: 77853 - DNA, 16 bp, H. sapiens
cccccaccccttgtgc

SEQ ID NO: 77854 - DNA, 16 bp, H. sapiens
cccccacctcccgggt

SEQ ID NO: 77855 - DNA, 16 bp, H. sapiens
cccccacctcctggac

SEQ ID NO: 77856 - DNA, 16 bp, H. sapiens
cccccacctcctgggc

SEQ ID NO: 77857 - DNA, 16 bp, H. sapiens
cccccacctggtggtc

SEQ ID NO: 77858 - DNA, 16 bp, H. sapiens
cccccacgcccagcta

SEQ ID NO: 77859 - DNA, 16 bp, H. sapiens
cccccactgcagccag

SEQ ID NO: 77860 - DNA, 16 bp, H. sapiens
cccccactgcagctgg

SEQ ID NO: 77861 - DNA, 16 bp, H. sapiens
cccccactgggtccct

SEQ ID NO: 77862 - DNA, 16 bp, H. sapiens
cccccacttcagatgc

SEQ ID NO: 77863 - DNA, 16 bp, H. sapiens
cccccagaatctaaaa

SEQ ID NO: 77864 - DNA, 16 bp, H. sapiens
cccccagacccagggc

SEQ ID NO: 77865 - DNA, 16 bp, H. sapiens
cccccagactggagtg

SEQ ID NO: 77866 - DNA, 16 bp, H. sapiens
cccccagcacccagag

SEQ ID NO: 77867 - DNA, 16 bp, H. sapiens
cccccagcactgccag

SEQ ID NO: 77868 - DNA, 16 bp, H. sapiens
cccccagcaggagcac

SEQ ID NO: 77869 - DNA, 17 bp, H. sapiens
cccccagcaggggcaca

SEQ ID NO: 77870 - DNA, 16 bp, H. sapiens
cccccagccccaggct

SEQ ID NO: 77871 - DNA, 16 bp, H. sapiens
cccccagcccctgaca

SEQ ID NO: 77872 - DNA, 16 bp, H. sapiens
cccccagcccctgcag

SEQ ID NO: 77873 - DNA, 16 bp, H. sapiens
cccccagcccctgctg

SEQ ID NO: 77874 - DNA, 16 bp, H. sapiens
cccccagcccctggaa

SEQ ID NO: 77875 - DNA, 16 bp, H. sapiens
cccccagcccctggca

SEQ ID NO: 77876 - DNA, 16 bp, H. sapiens
cccccagccctggcct

SEQ ID NO: 77877 - DNA, 16 bp, H. sapiens
cccccagccctgggct

SEQ ID NO: 77878 - DNA, 16 bp, H. sapiens
cccccagccctgtgct

SEQ ID NO: 77879 - DNA, 16 bp, H. sapiens
cccccagcctcactgc

SEQ ID NO: 77880 - DNA, 16 bp, H. sapiens
cccccagcctctggca

SEQ ID NO: 77881 - DNA, 16 bp, H. sapiens
cccccagcctgcactg

SEQ ID NO: 77882 - DNA, 16 bp, H. sapiens
cccccagcctggctgc

SEQ ID NO: 77883 - DNA, 16 bp, H. sapiens
cccccagccttgctgc

SEQ ID NO: 77884 - DNA, 16 bp, H. sapiens
cccccagctggagtgc

SEQ ID NO: 77885 - DNA, 16 bp, H. sapiens
cccccaggacctcaga

SEQ ID NO: 77886 - DNA, 16 bp, H. sapiens
cccccaggcccagctg

SEQ ID NO: 77887 - DNA, 16 bp, H. sapiens
cccccaggccctggca

SEQ ID NO: 77888 - DNA, 16 bp, H. sapiens
cccccaggccctgggt

SEQ ID NO: 77889 - DNA, 16 bp, H. sapiens
cccccaggcctcaggc

SEQ ID NO: 77890 - DNA, 16 bp, H. sapiens
cccccaggctcaagca

SEQ ID NO: 77891 - DNA, 16 bp, H. sapiens
cccccaggctcaagcg

SEQ ID NO: 77892 - DNA, 16 bp, H. sapiens
cccccaggcttcaggc

SEQ ID NO: 77893 - DNA, 16 bp, H. sapiens
cccccagggaccagca

SEQ ID NO: 77894 - DNA, 16 bp, H. sapiens
cccccagggctgctgt

SEQ ID NO: 77895 - DNA, 16 bp, H. sapiens
cccccagtgagccccc

SEQ ID NO: 77896 - DNA, 16 bp, H. sapiens
cccccagtggatgtct

SEQ ID NO: 77897 - DNA, 16 bp, H. sapiens
cccccagtgtggctgt

SEQ ID NO: 77898 - DNA, 16 bp, H. sapiens
cccccatcagcctcct

SEQ ID NO: 77899 - DNA, 16 bp, H. sapiens
cccccatcccctgaca

SEQ ID NO: 77900 - DNA, 16 bp, H. sapiens
cccccatcctgtgcct

SEQ ID NO: 77901 - DNA, 16 bp, H. sapiens
cccccatgcctggcct

SEQ ID NO: 77902 - DNA, 16 bp, H. sapiens
cccccattttacagat

SEQ ID NO: 77903 - DNA, 16 bp, H. sapiens
ccccccaaaaaaaatt

SEQ ID NO: 77904 - DNA, 16 bp, H. sapiens
ccccccaacaggggca

SEQ ID NO: 77905 - DNA, 16 bp, H. sapiens
ccccccaccaagctgg

SEQ ID NO: 77906 - DNA, 16 bp, H. sapiens
ccccccagcccctggt

SEQ ID NO: 77907 - DNA, 16 bp, H. sapiens
ccccccaggaaagtgg

SEQ ID NO: 77908 - DNA, 16 bp, H. sapiens
cccccccactgcactg

SEQ ID NO: 77909 - DNA, 16 bp, H. sapiens
cccccctttttttaaa

SEQ ID NO: 77910 - DNA, 16 bp, H. sapiens
cccccgacaggtccca

SEQ ID NO: 77911 - DNA, 16 bp, H. sapiens
cccccgactaattttt

SEQ ID NO: 77912 - DNA, 16 bp, H. sapiens
cccccgagatggagtc

SEQ ID NO: 77913 - DNA, 16 bp, H. sapiens
cccccgagtccccaaa

SEQ ID NO: 77914 - DNA, 16 bp, H. sapiens
cccccgtgacatgagt

SEQ ID NO: 77915 - DNA, 16 bp, H. sapiens
cccccgtgattcagtt

SEQ ID NO: 77916 - DNA, 16 bp, H. sapiens
ccccctatgttgccca

SEQ ID NO: 77917 - DNA, 16 bp, H. sapiens
ccccctccaaagccca

SEQ ID NO: 77918 - DNA, 16 bp, H. sapiens
ccccctcctagcctct

SEQ ID NO: 77919 - DNA, 16 bp, H. sapiens
ccccctcctcaggttc

SEQ ID NO: 77920 - DNA, 16 bp, H. sapiens
ccccctctgcaagaaa

SEQ ID NO: 77921 - DNA, 16 bp, H. sapiens
ccccctgagccataaa

SEQ ID NO: 77922 - DNA, 16 bp, H. sapiens
ccccctgcacacacac

SEQ ID NO: 77923 - DNA, 16 bp, H. sapiens
ccccctgccacctcag

SEQ ID NO: 77924 - DNA, 16 bp, H. sapiens
ccccctgcccctgcag

SEQ ID NO: 77925 - DNA, 16 bp, H. sapiens
ccccctgccctgctgg

SEQ ID NO: 77926 - DNA, 16 bp, H. sapiens
ccccctgcctggccag

SEQ ID NO: 77927 - DNA, 16 bp, H. sapiens
ccccctgctccacggc

SEQ ID NO: 77928 - DNA, 16 bp, H. sapiens
ccccctgctccatggc

SEQ ID NO: 77929 - DNA, 16 bp, H. sapiens
ccccctggaccatcac

SEQ ID NO: 77930 - DNA, 16 bp, H. sapiens
ccccctggagttgtgc

SEQ ID NO: 77931 - DNA, 16 bp, H. sapiens
ccccctgggtttaagc

SEQ ID NO: 77932 - DNA, 16 bp, H. sapiens
ccccgacctcccaggc

SEQ ID NO: 77933 - DNA, 16 bp, H. sapiens
ccccgagaagagcaac

SEQ ID NO: 77934 - DNA, 16 bp, H. sapiens
ccccgagggctgctgg

SEQ ID NO: 77935 - DNA, 16 bp, H. sapiens
ccccgagtccccaaag

SEQ ID NO: 77936 - DNA, 16 bp, H. sapiens
ccccgagtgttctttc

SEQ ID NO: 77937 - DNA, 17 bp, H. sapiens
ccccgctgaaacttcca

SEQ ID NO: 77938 - DNA, 16 bp, H. sapiens
ccccggaggcccagct

SEQ ID NO: 77939 - DNA, 16 bp, H. sapiens
ccccggaggctgaggc

SEQ ID NO: 77940 - DNA, 16 bp, H. sapiens
ccccggaggtggaggc

SEQ ID NO: 77941 - DNA, 16 bp, H. sapiens
ccccggatattagaga

SEQ ID NO: 77942 - DNA, 16 bp, H. sapiens
ccccggcccctccaaa

SEQ ID NO: 77943 - DNA, 16 bp, H. sapiens
ccccggcctcagcctc

SEQ ID NO: 77944 - DNA, 16 bp, H. sapiens
ccccggctaatttttg

SEQ ID NO: 77945 - DNA, 16 bp, H. sapiens
ccccggctctacaaaa

SEQ ID NO: 77946 - DNA, 16 bp, H. sapiens
ccccgggaggtggagg

SEQ ID NO: 77947 - DNA, 16 bp, H. sapiens
ccccgggcccagctgt

SEQ ID NO: 77948 - DNA, 16 bp, H. sapiens
ccccgtctctacaaag

SEQ ID NO: 77949 - DNA, 16 bp, H. sapiens
ccccgtctctataaaa

SEQ ID NO: 77950 - DNA, 16 bp, H. sapiens
ccccgtctgggaggtg

SEQ ID NO: 77951 - DNA, 16 bp, H. sapiens
ccccgtgggacaaaag

SEQ ID NO: 77952 - DNA, 16 bp, H. sapiens
ccccgttggcctccca

SEQ ID NO: 77953 - DNA, 16 bp, H. sapiens
cccctaagatcaagaa

SEQ ID NO: 77954 - DNA, 16 bp, H. sapiens
cccctacttcacacca

SEQ ID NO: 77955 - DNA, 16 bp, H. sapiens
cccctagcccctggca

SEQ ID NO: 77956 - DNA, 16 bp, H. sapiens
cccctagtgctgtctc

SEQ ID NO: 77957 - DNA, 16 bp, H. sapiens
cccctcaaaccagggg

SEQ ID NO: 77958 - DNA, 16 bp, H. sapiens
cccctcacccatcatg

SEQ ID NO: 77959 - DNA, 16 bp, H. sapiens
cccctcacctctgcct

SEQ ID NO: 77960 - DNA, 16 bp, H. sapiens
cccctcactgcccagg

SEQ ID NO: 77961 - DNA, 16 bp, H. sapiens
cccctcactgtgtcca

SEQ ID NO: 77962 - DNA, 16 bp, H. sapiens
cccctcaggttcaagc

SEQ ID NO: 77963 - DNA, 16 bp, H. sapiens
cccctcatccagatgc

SEQ ID NO: 77964 - DNA, 16 bp, H. sapiens
cccctcatccatgtcc

SEQ ID NO: 77965 - DNA, 16 bp, H. sapiens
cccctccacccagcag

SEQ ID NO: 77966 - DNA, 16 bp, H. sapiens
cccctccagcctgggc

SEQ ID NO: 77967 - DNA, 16 bp, H. sapiens
cccctccaggaggtgg

SEQ ID NO: 77968 - DNA, 16 bp, H. sapiens
cccctcccagccctgg

SEQ ID NO: 77969 - DNA, 16 bp, H. sapiens
cccctcccagtgtcca

SEQ ID NO: 77970 - DNA, 16 bp, H. sapiens
cccctcccatcacagc

SEQ ID NO: 77971 - DNA, 16 bp, H. sapiens
cccctcccccagaaaa

SEQ ID NO: 77972 - DNA, 16 bp, H. sapiens
cccctcccccaggagc

SEQ ID NO: 77973 - DNA, 16 bp, H. sapiens
cccctcccctgccagg

SEQ ID NO: 77974 - DNA, 16 bp, H. sapiens
cccctccctctgtcca

SEQ ID NO: 77975 - DNA, 16 bp, H. sapiens
cccctccctgcctggg

SEQ ID NO: 77976 - DNA, 16 bp, H. sapiens
cccctccctgtggtgc

SEQ ID NO: 77977 - DNA, 16 bp, H. sapiens
cccctcccttcacagg

SEQ ID NO: 77978 - DNA, 16 bp, H. sapiens
cccctcccttttggag

SEQ ID NO: 77979 - DNA, 17 bp, H. sapiens
cccctccgcccagcagc

SEQ ID NO: 77980 - DNA, 16 bp, H. sapiens
cccctcctccagcctt

SEQ ID NO: 77981 - DNA, 16 bp, H. sapiens
cccctcctccaggaag

SEQ ID NO: 77982 - DNA, 16 bp, H. sapiens
cccctcctctcagcca

SEQ ID NO: 77983 - DNA, 16 bp, H. sapiens
cccctcctcttgggaa

SEQ ID NO: 77984 - DNA, 16 bp, H. sapiens
cccctcctgcaaccaa

SEQ ID NO: 77985 - DNA, 16 bp, H. sapiens
cccctcctgcccagca

SEQ ID NO: 77986 - DNA, 16 bp, H. sapiens
cccctccttgccaggc

SEQ ID NO: 77987 - DNA, 16 bp, H. sapiens
cccctcctttgaatct

SEQ ID NO: 77988 - DNA, 16 bp, H. sapiens
cccctcggcctcccaa

SEQ ID NO: 77989 - DNA, 16 bp, H. sapiens
cccctctcacactttg

SEQ ID NO: 77990 - DNA, 16 bp, H. sapiens
cccctctcctggctgc

SEQ ID NO: 77991 - DNA, 16 bp, H. sapiens
cccctctcggagaaac

SEQ ID NO: 77992 - DNA, 16 bp, H. sapiens
cccctctctctgcagc

SEQ ID NO: 77993 - DNA, 16 bp, H. sapiens
cccctctctctgggtc

SEQ ID NO: 77994 - DNA, 16 bp, H. sapiens
cccctctctgagcctc

SEQ ID NO: 77995 - DNA, 16 bp, H. sapiens
cccctctctgggcctc

SEQ ID NO: 77996 - DNA, 16 bp, H. sapiens
cccctctctgggctgg

SEQ ID NO: 77997 - DNA, 16 bp, H. sapiens
cccctctgcagcctcc

SEQ ID NO: 77998 - DNA, 16 bp, H. sapiens
cccctctgcctcccaa

SEQ ID NO: 77999 - DNA, 16 bp, H. sapiens
cccctctgcctggcag

SEQ ID NO: 78000 - DNA, 16 bp, H. sapiens
cccctctgctgcaggt

SEQ ID NO: 78001 - DNA, 16 bp, H. sapiens
cccctctggcccaggg

SEQ ID NO: 78002 - DNA, 16 bp, H. sapiens
cccctctggggcttca

SEQ ID NO: 78003 - DNA, 16 bp, H. sapiens
cccctcttcctgtcac

SEQ ID NO: 78004 - DNA, 16 bp, H. sapiens
cccctgaaactaaaag

SEQ ID NO: 78005 - DNA, 16 bp, H. sapiens
cccctgaaatcccagc

SEQ ID NO: 78006 - DNA, 16 bp, H. sapiens
cccctgaagtccagcc

SEQ ID NO: 78007 - DNA, 16 bp, H. sapiens
cccctgacccccaagc

SEQ ID NO: 78008 - DNA, 16 bp, H. sapiens
cccctgacccccagca

SEQ ID NO: 78009 - DNA, 16 bp, H. sapiens
cccctgacccccgagc

SEQ ID NO: 78010 - DNA, 16 bp, H. sapiens
cccctgacccctgagc

SEQ ID NO: 78011 - DNA, 16 bp, H. sapiens
cccctgacctcaagca

SEQ ID NO: 78012 - DNA, 16 bp, H. sapiens
cccctgacctcagttg

SEQ ID NO: 78013 - DNA, 16 bp, H. sapiens
cccctgagaaagagaa

SEQ ID NO: 78014 - DNA, 16 bp, H. sapiens
cccctgagaactgaaa

SEQ ID NO: 78015 - DNA, 16 bp, H. sapiens
cccctgaggccaggag

SEQ ID NO: 78016 - DNA, 16 bp, H. sapiens
cccctgaggtcaagag

SEQ ID NO: 78017 - DNA, 16 bp, H. sapiens
cccctgagtcctcaaa

SEQ ID NO: 78018 - DNA, 16 bp, H. sapiens
cccctgagttcaagcg

SEQ ID NO: 78019 - DNA, 16 bp, H. sapiens
cccctgcacagttgaa

SEQ ID NO: 78020 - DNA, 16 bp, H. sapiens
cccctgcacctggcct

SEQ ID NO: 78021 - DNA, 16 bp, H. sapiens
cccctgcactcctgcc

SEQ ID NO: 78022 - DNA, 16 bp, H. sapiens
cccctgcactctctct

SEQ ID NO: 78023 - DNA, 16 bp, H. sapiens
cccctgcagtcccagc

SEQ ID NO: 78024 - DNA, 16 bp, H. sapiens
cccctgccacagcctc

SEQ ID NO: 78025 - DNA, 16 bp, H. sapiens
cccctgcccacaaaac

SEQ ID NO: 78026 - DNA, 16 bp, H. sapiens
cccctgcccagccctg

SEQ ID NO: 78027 - DNA, 16 bp, H. sapiens
cccctgccccaggctc

SEQ ID NO: 78028 - DNA, 16 bp, H. sapiens
cccctgccccccaaaa

SEQ ID NO: 78029 - DNA, 16 bp, H. sapiens
cccctgcccgcaagag

SEQ ID NO: 78030 - DNA, 16 bp, H. sapiens
cccctgccctctggct

SEQ ID NO: 78031 - DNA, 16 bp, H. sapiens
cccctgccctgggctg

SEQ ID NO: 78032 - DNA, 16 bp, H. sapiens
cccctgcctcagcttc

SEQ ID NO: 78033 - DNA, 16 bp, H. sapiens
cccctgcctcagggcc

SEQ ID NO: 78034 - DNA, 16 bp, H. sapiens
cccctgcctcccaggc

SEQ ID NO: 78035 - DNA, 16 bp, H. sapiens
cccctgcctcctgggc

SEQ ID NO: 78036 - DNA, 16 bp, H. sapiens
cccctgcctgcaaaac

SEQ ID NO: 78037 - DNA, 16 bp, H. sapiens
cccctgcctgccctgg

SEQ ID NO: 78038 - DNA, 16 bp, H. sapiens
cccctgcctggctctg

SEQ ID NO: 78039 - DNA, 16 bp, H. sapiens
cccctgcctgggcctt

SEQ ID NO: 78040 - DNA, 16 bp, H. sapiens
cccctgcctgtggagt

SEQ ID NO: 78041 - DNA, 16 bp, H. sapiens
cccctgcgcctggcct

SEQ ID NO: 78042 - DNA, 16 bp, H. sapiens
cccctgctcctgcctg

SEQ ID NO: 78043 - DNA, 16 bp, H. sapiens
cccctgctgagcacct

SEQ ID NO: 78044 - DNA, 16 bp, H. sapiens
cccctgctgcagccag

SEQ ID NO: 78045 - DNA, 16 bp, H. sapiens
cccctgctggagccag

SEQ ID NO: 78046 - DNA, 16 bp, H. sapiens
cccctgctggctctga

SEQ ID NO: 78047 - DNA, 16 bp, H. sapiens
cccctggaccagcagc

SEQ ID NO: 78048 - DNA, 16 bp, H. sapiens
cccctggactccagcc

SEQ ID NO: 78049 - DNA, 16 bp, H. sapiens
cccctggatgcccagc

SEQ ID NO: 78050 - DNA, 16 bp, H. sapiens
cccctggcagcagctg

SEQ ID NO: 78051 - DNA, 16 bp, H. sapiens
cccctggcagccacca

SEQ ID NO: 78052 - DNA, 16 bp, H. sapiens
cccctggcagcccagc

SEQ ID NO: 78053 - DNA, 16 bp, H. sapiens
cccctggccacccaga

SEQ ID NO: 78054 - DNA, 16 bp, H. sapiens
cccctggcccatccca

SEQ ID NO: 78055 - DNA, 16 bp, H. sapiens
cccctggccccttcca

SEQ ID NO: 78056 - DNA, 16 bp, H. sapiens
cccctggcccttccca

SEQ ID NO: 78057 - DNA, 16 bp, H. sapiens
cccctggctggagtgc

SEQ ID NO: 78058 - DNA, 16 bp, H. sapiens
cccctgggatggagct

SEQ ID NO: 78059 - DNA, 16 bp, H. sapiens
cccctgggcaccctgg

SEQ ID NO: 78060 - DNA, 16 bp, H. sapiens
cccctgggccctgaat

SEQ ID NO: 78061 - DNA, 16 bp, H. sapiens
cccctggggatggggg

SEQ ID NO: 78062 - DNA, 16 bp, H. sapiens
cccctgggtccctctc

SEQ ID NO: 78063 - DNA, 16 bp, H. sapiens
cccctgggtctgaggg

SEQ ID NO: 78064 - DNA, 17 bp, H. sapiens
cccctgggtggagattt

SEQ ID NO: 78065 - DNA, 16 bp, H. sapiens
cccctgggttcaagtg

SEQ ID NO: 78066 - DNA, 16 bp, H. sapiens
cccctgggttcacgcc

SEQ ID NO: 78067 - DNA, 16 bp, H. sapiens
cccctggtgtgtgatg

SEQ ID NO: 78068 - DNA, 16 bp, H. sapiens
cccctggttaattttt

SEQ ID NO: 78069 - DNA, 16 bp, H. sapiens
cccctggttgagaacc

SEQ ID NO: 78070 - DNA, 16 bp, H. sapiens
cccctgtacaagctct

SEQ ID NO: 78071 - DNA, 16 bp, H. sapiens
cccctgtcacctgact

SEQ ID NO: 78072 - DNA, 16 bp, H. sapiens
cccctgtcatcccagc

SEQ ID NO: 78073 - DNA, 16 bp, H. sapiens
cccctgtctccacaaa

SEQ ID NO: 78074 - DNA, 16 bp, H. sapiens
cccctgtctcctgggt

SEQ ID NO: 78075 - DNA, 16 bp, H. sapiens
cccctgtcttaataaa

SEQ ID NO: 78076 - DNA, 16 bp, H. sapiens
cccctgtgacttgcac

SEQ ID NO: 78077 - DNA, 16 bp, H. sapiens
cccctgtgacttgcag

SEQ ID NO: 78078 - DNA, 16 bp, H. sapiens
cccctgtgctccacct

SEQ ID NO: 78079 - DNA, 16 bp, H. sapiens
cccctgtggataccaa

SEQ ID NO: 78080 - DNA, 16 bp, H. sapiens
cccctgtggtcaccac

SEQ ID NO: 78081 - DNA, 20 bp, H. sapiens
ccccttatatgctagttgta

SEQ ID NO: 78082 - DNA, 16 bp, H. sapiens
ccccttcaagctggct

SEQ ID NO: 78083 - DNA, 16 bp, H. sapiens
ccccttcaccttccgc

SEQ ID NO: 78084 - DNA, 16 bp, H. sapiens
ccccttcactccagcc

SEQ ID NO: 78085 - DNA, 16 bp, H. sapiens
ccccttcatcttctgc

SEQ ID NO: 78086 - DNA, 16 bp, H. sapiens
ccccttcatgctaaaa

SEQ ID NO: 78087 - DNA, 16 bp, H. sapiens
ccccttccaaatctca

SEQ ID NO: 78088 - DNA, 16 bp, H. sapiens
ccccttccaccctgtg

SEQ ID NO: 78089 - DNA, 16 bp, H. sapiens
ccccttccagctctga

SEQ ID NO: 78090 - DNA, 16 bp, H. sapiens
ccccttccccagccag

SEQ ID NO: 78091 - DNA, 16 bp, H. sapiens
ccccttccccaggagc

SEQ ID NO: 78092 - DNA, 16 bp, H. sapiens
ccccttccctccatgt

SEQ ID NO: 78093 - DNA, 16 bp, H. sapiens
ccccttcccttcccag

SEQ ID NO: 78094 - DNA, 16 bp, H. sapiens
ccccttcctctgggag

SEQ ID NO: 78095 - DNA, 16 bp, H. sapiens
ccccttcctgccccag

SEQ ID NO: 78096 - DNA, 16 bp, H. sapiens
ccccttcctgggatgg

SEQ ID NO: 78097 - DNA, 16 bp, H. sapiens
ccccttcctgtctcca

SEQ ID NO: 78098 - DNA, 16 bp, H. sapiens
ccccttctttccccag

SEQ ID NO: 78099 - DNA, 16 bp, H. sapiens
ccccttgagcttcctg

SEQ ID NO: 78100 - DNA, 16 bp, H. sapiens
ccccttgctgttccca

SEQ ID NO: 78101 - DNA, 16 bp, H. sapiens
ccccttgtcccagcct

SEQ ID NO: 78102 - DNA, 16 bp, H. sapiens
cccctttaaatattga

SEQ ID NO: 78103 - DNA, 16 bp, H. sapiens
cccctttaccttctgc

SEQ ID NO: 78104 - DNA, 16 bp, H. sapiens
cccctttaccttgagt

SEQ ID NO: 78105 - DNA, 16 bp, H. sapiens
cccctttccagggcag

SEQ ID NO: 78106 - DNA, 16 bp, H. sapiens
cccctttccccaggca

SEQ ID NO: 78107 - DNA, 16 bp, H. sapiens
cccctttcctggtcct

SEQ ID NO: 78108 - DNA, 21 bp, H. sapiens
cccctttgactgtaattttcc

SEQ ID NO: 78109 - DNA, 16 bp, H. sapiens
cccctttgccttctgt

SEQ ID NO: 78110 - DNA, 16 bp, H. sapiens
cccctttgtcttccac

SEQ ID NO: 78111 - DNA, 16 bp, H. sapiens
ccccttttcttttcaa

SEQ ID NO: 78112 - DNA, 16 bp, H. sapiens
cccgacctcatgatct

SEQ ID NO: 78113 - DNA, 16 bp, H. sapiens
cccgaggtcacacagc

SEQ ID NO: 78114 - DNA, 16 bp, H. sapiens
cccgaggtcaggagtt

SEQ ID NO: 78115 - DNA, 16 bp, H. sapiens
cccgagtagttgggac

SEQ ID NO: 78116 - DNA, 16 bp, H. sapiens
cccgcaacaggccctg

SEQ ID NO: 78117 - DNA, 16 bp, H. sapiens
cccgcaagcagaggga

SEQ ID NO: 78118 - DNA, 16 bp, H. sapiens
cccgcacctggctcgg

SEQ ID NO: 78119 - DNA, 16 bp, H. sapiens
cccgccctcctgcagc

SEQ ID NO: 78120 - DNA, 16 bp, H. sapiens
cccgccctgtgtccaa

SEQ ID NO: 78121 - DNA, 16 bp, H. sapiens
cccgccgctgcactgt

SEQ ID NO: 78122 - DNA, 16 bp, H. sapiens
cccgcctcagactccc

SEQ ID NO: 78123 - DNA, 16 bp, H. sapiens
cccgcctcagactcct

SEQ ID NO: 78124 - DNA, 16 bp, H. sapiens
cccgcctcagcctctc

SEQ ID NO: 78125 - DNA, 16 bp, H. sapiens
cccgcctcagccttcc

SEQ ID NO: 78126 - DNA, 16 bp, H. sapiens
cccgcctcagctccca

SEQ ID NO: 78127 - DNA, 16 bp, H. sapiens
cccgcctcaggctcct

SEQ ID NO: 78128 - DNA, 16 bp, H. sapiens
cccgcctcggcctcca

SEQ ID NO: 78129 - DNA, 16 bp, H. sapiens
cccgcctgcctgcctg

SEQ ID NO: 78130 - DNA, 16 bp, H. sapiens
cccgcctggccagccg

SEQ ID NO: 78131 - DNA, 16 bp, H. sapiens
cccgcctggccagctg

SEQ ID NO: 78132 - DNA, 16 bp, H. sapiens
cccgcctgggcctcct

SEQ ID NO: 78133 - DNA, 16 bp, H. sapiens
cccgccttagcctctc

SEQ ID NO: 78134 - DNA, 16 bp, H. sapiens
cccgccttctacccca

SEQ ID NO: 78135 - DNA, 16 bp, H. sapiens
cccgccttctgggttc

SEQ ID NO: 78136 - DNA, 16 bp, H. sapiens
cccgcgcctggctcag

SEQ ID NO: 78137 - DNA, 17 bp, H. sapiens
cccgcgtctctgcctgg

SEQ ID NO: 78138 - DNA, 16 bp, H. sapiens
cccgctccgtgggctc

SEQ ID NO: 78139 - DNA, 16 bp, H. sapiens
cccgctctgtcgccca

SEQ ID NO: 78140 - DNA, 16 bp, H. sapiens
cccgctgcagcctccc

SEQ ID NO: 78141 - DNA, 16 bp, H. sapiens
cccgctgctttgttta

SEQ ID NO: 78142 - DNA, 16 bp, H. sapiens
cccgcttaggcctccc

SEQ ID NO: 78143 - DNA, 16 bp, H. sapiens
cccgctttcctggggc

SEQ ID NO: 78144 - DNA, 16 bp, H. sapiens
cccggaaagcagaggt

SEQ ID NO: 78145 - DNA, 16 bp, H. sapiens
cccggaagatggaggt

SEQ ID NO: 78146 - DNA, 16 bp, H. sapiens
cccggagaggccgccg

SEQ ID NO: 78147 - DNA, 16 bp, H. sapiens
cccggaggcagaagtt

SEQ ID NO: 78148 - DNA, 16 bp, H. sapiens
cccggaggcagagttt

SEQ ID NO: 78149 - DNA, 16 bp, H. sapiens
cccggcaaatttttgt

SEQ ID NO: 78150 - DNA, 16 bp, H. sapiens
cccggcaaattttttt

SEQ ID NO: 78151 - DNA, 16 bp, H. sapiens
cccggcatggtggtgg

SEQ ID NO: 78152 - DNA, 17 bp, H. sapiens
cccggccaccccgtctg

SEQ ID NO: 78153 - DNA, 16 bp, H. sapiens
cccggccagcatggtg

SEQ ID NO: 78154 - DNA, 16 bp, H. sapiens
cccggccagccgctcc

SEQ ID NO: 78155 - DNA, 16 bp, H. sapiens
cccggccaggcgcggt

SEQ ID NO: 78156 - DNA, 16 bp, H. sapiens
cccggcccctgcccag

SEQ ID NO: 78157 - DNA, 16 bp, H. sapiens
cccggccctttttttt

SEQ ID NO: 78158 - DNA, 17 bp, H. sapiens
cccggccgggtgcagtg

SEQ ID NO: 78159 - DNA, 16 bp, H. sapiens
cccggcctattttctt

SEQ ID NO: 78160 - DNA, 16 bp, H. sapiens
cccggcctcaagtgat

SEQ ID NO: 78161 - DNA, 16 bp, H. sapiens
cccggcctgatttttt

SEQ ID NO: 78162 - DNA, 16 bp, H. sapiens
cccggccttctttttt

SEQ ID NO: 78163 - DNA, 16 bp, H. sapiens
cccggctaatattttt

SEQ ID NO: 78164 - DNA, 16 bp, H. sapiens
cccggctaatttgtat

SEQ ID NO: 78165 - DNA, 20 bp, H. sapiens
cccggctaattttgtatttt

SEQ ID NO: 78166 - DNA, 16 bp, H. sapiens
cccggctactcagaag

SEQ ID NO: 78167 - DNA, 16 bp, H. sapiens
cccggctcaagtgatt

SEQ ID NO: 78168 - DNA, 16 bp, H. sapiens
cccggctgctcaggag

SEQ ID NO: 78169 - DNA, 16 bp, H. sapiens
cccgggagacggagct

SEQ ID NO: 78170 - DNA, 16 bp, H. sapiens
cccgggagcagaggtt

SEQ ID NO: 78171 - DNA, 16 bp, H. sapiens
cccgggagccggaggt

SEQ ID NO: 78172 - DNA, 16 bp, H. sapiens
cccgggagctggaggt

SEQ ID NO: 78173 - DNA, 16 bp, H. sapiens
cccgggaggaggagat

SEQ ID NO: 78174 - DNA, 16 bp, H. sapiens
cccgggaggaggaggc

SEQ ID NO: 78175 - DNA, 16 bp, H. sapiens
cccgggaggcagacct

SEQ ID NO: 78176 - DNA, 16 bp, H. sapiens
cccgggaggcagagca

SEQ ID NO: 78177 - DNA, 16 bp, H. sapiens
cccgggaggcagagct

SEQ ID NO: 78178 - DNA, 16 bp, H. sapiens
cccgggaggcagaggt

SEQ ID NO: 78179 - DNA, 16 bp, H. sapiens
cccgggaggccgaggc

SEQ ID NO: 78180 - DNA, 16 bp, H. sapiens
cccgggaggcggacct

SEQ ID NO: 78181 - DNA, 16 bp, H. sapiens
cccgggaggcggcagt

SEQ ID NO: 78182 - DNA, 16 bp, H. sapiens
cccgggaggcggcgct

SEQ ID NO: 78183 - DNA, 16 bp, H. sapiens
cccgggaggcggcggt

SEQ ID NO: 78184 - DNA, 17 bp, H. sapiens
cccgggaggcggggctt

SEQ ID NO: 78185 - DNA, 16 bp, H. sapiens
cccgggaggtggtggt

SEQ ID NO: 78186 - DNA, 16 bp, H. sapiens
cccgggctccagcgat

SEQ ID NO: 78187 - DNA, 16 bp, H. sapiens
cccgggttcaaatccc

SEQ ID NO: 78188 - DNA, 16 bp, H. sapiens
cccgggttcaagagag

SEQ ID NO: 78189 - DNA, 17 bp, H. sapiens
cccggtccgggaggtga

SEQ ID NO: 78190 - DNA, 18 bp, H. sapiens
cccggtgcgggatccact

SEQ ID NO: 78191 - DNA, 16 bp, H. sapiens
cccggttcaagtgatt

SEQ ID NO: 78192 - DNA, 19 bp, H. sapiens
cccgtccctcatctgcgtc

SEQ ID NO: 78193 - DNA, 16 bp, H. sapiens
cccgtctacagctccc

SEQ ID NO: 78194 - DNA, 16 bp, H. sapiens
cccgtctcagcctccc

SEQ ID NO: 78195 - DNA, 16 bp, H. sapiens
cccgtctctacaaaaa

SEQ ID NO: 78196 - DNA, 16 bp, H. sapiens
cccgtctctactaata

SEQ ID NO: 78197 - DNA, 16 bp, H. sapiens
cccgtctgtagtaaaa

SEQ ID NO: 78198 - DNA, 16 bp, H. sapiens
cccgtcttctgcgtcg

SEQ ID NO: 78199 - DNA, 16 bp, H. sapiens
cccgtctttacaaaaa

SEQ ID NO: 78200 - DNA, 16 bp, H. sapiens
cccgtgccaccacacc

SEQ ID NO: 78201 - DNA, 16 bp, H. sapiens
cccgtggttccagcta

SEQ ID NO: 78202 - DNA, 16 bp, H. sapiens
ccctaaaaattaaagt

SEQ ID NO: 78203 - DNA, 16 bp, H. sapiens
ccctaaaatgtagaaa

SEQ ID NO: 78204 - DNA, 16 bp, H. sapiens
ccctaaatccttaaaa

SEQ ID NO: 78205 - DNA, 16 bp, H. sapiens
ccctaaatgccatcac

SEQ ID NO: 78206 - DNA, 16 bp, H. sapiens
ccctaacatcaccatt

SEQ ID NO: 78207 - DNA, 16 bp, H. sapiens
ccctaaccccaggctg

SEQ ID NO: 78208 - DNA, 16 bp, H. sapiens
ccctaactcattttct

SEQ ID NO: 78209 - DNA, 16 bp, H. sapiens
ccctaactctcttcaa

SEQ ID NO: 78210 - DNA, 16 bp, H. sapiens
ccctaagtgtgtcttt

SEQ ID NO: 78211 - DNA, 16 bp, H. sapiens
ccctaataagcctgag

SEQ ID NO: 78212 - DNA, 16 bp, H. sapiens
ccctaatgaacattga

SEQ ID NO: 78213 - DNA, 16 bp, H. sapiens
ccctaatgactaataa

SEQ ID NO: 78214 - DNA, 16 bp, H. sapiens
ccctaatggagaacct

SEQ ID NO: 78215 - DNA, 16 bp, H. sapiens
ccctaatggcttccct

SEQ ID NO: 78216 - DNA, 16 bp, H. sapiens
ccctaccagaggttct

SEQ ID NO: 78217 - DNA, 16 bp, H. sapiens
ccctaccttgtgctgc

SEQ ID NO: 78218 - DNA, 16 bp, H. sapiens
ccctacgaaggacatg

SEQ ID NO: 78219 - DNA, 16 bp, H. sapiens
ccctactcaaatctca

SEQ ID NO: 78220 - DNA, 16 bp, H. sapiens
ccctactccagcctgg

SEQ ID NO: 78221 - DNA, 16 bp, H. sapiens
ccctactcccactgct

SEQ ID NO: 78222 - DNA, 16 bp, H. sapiens
ccctactgacaccttg

SEQ ID NO: 78223 - DNA, 16 bp, H. sapiens
ccctactgggaggtgc

SEQ ID NO: 78224 - DNA, 16 bp, H. sapiens
ccctagaagaaaaccc

SEQ ID NO: 78225 - DNA, 16 bp, H. sapiens
ccctagaagaacacct

SEQ ID NO: 78226 - DNA, 16 bp, H. sapiens
ccctagaagaagacct

SEQ ID NO: 78227 - DNA, 16 bp, H. sapiens
ccctagagatctgtgg

SEQ ID NO: 78228 - DNA, 16 bp, H. sapiens
ccctagctgcaaggga

SEQ ID NO: 78229 - DNA, 16 bp, H. sapiens
ccctaggtccctccca

SEQ ID NO: 78230 - DNA, 16 bp, H. sapiens
ccctatcaaaatatca

SEQ ID NO: 78231 - DNA, 16 bp, H. sapiens
ccctatccctacaaaa

SEQ ID NO: 78232 - DNA, 16 bp, H. sapiens
ccctatgcatctcttc

SEQ ID NO: 78233 - DNA, 16 bp, H. sapiens
ccctatgtacctcttc

SEQ ID NO: 78234 - DNA, 16 bp, H. sapiens
ccctatgtatctcttc

SEQ ID NO: 78235 - DNA, 16 bp, H. sapiens
ccctattcaacatagt

SEQ ID NO: 78236 - DNA, 16 bp, H. sapiens
ccctattcaagataga

SEQ ID NO: 78237 - DNA, 17 bp, H. sapiens
ccctattcgtacacccc

SEQ ID NO: 78238 - DNA, 16 bp, H. sapiens
ccctattttaaagtca

SEQ ID NO: 78239 - DNA, 17 bp, H. sapiens
ccctcaaagggaagccc

SEQ ID NO: 78240 - DNA, 16 bp, H. sapiens
ccctcaaagtgctgag

SEQ ID NO: 78241 - DNA, 16 bp, H. sapiens
ccctcaagaatggctt

SEQ ID NO: 78242 - DNA, 16 bp, H. sapiens
ccctcaagcaggcccc

SEQ ID NO: 78243 - DNA, 16 bp, H. sapiens
ccctcaagtgatctgc

SEQ ID NO: 78244 - DNA, 16 bp, H. sapiens
ccctcacaacaaagaa

SEQ ID NO: 78245 - DNA, 16 bp, H. sapiens
ccctcacagaggattc

SEQ ID NO: 78246 - DNA, 16 bp, H. sapiens
ccctcacagccctcag

SEQ ID NO: 78247 - DNA, 16 bp, H. sapiens
ccctcaccagaagcca

SEQ ID NO: 78248 - DNA, 16 bp, H. sapiens
ccctcaccagacatca

SEQ ID NO: 78249 - DNA, 16 bp, H. sapiens
ccctcacccagcccat

SEQ ID NO: 78250 - DNA, 17 bp, H. sapiens
ccctcaccccacgacag

SEQ ID NO: 78251 - DNA, 16 bp, H. sapiens
ccctcaccctgccctg

SEQ ID NO: 78252 - DNA, 16 bp, H. sapiens
ccctcacctcccagac

SEQ ID NO: 78253 - DNA, 16 bp, H. sapiens
ccctcacctcctcctg

SEQ ID NO: 78254 - DNA, 16 bp, H. sapiens
ccctcacctcctgggc

SEQ ID NO: 78255 - DNA, 16 bp, H. sapiens
ccctcacctgatggtc

SEQ ID NO: 78256 - DNA, 16 bp, H. sapiens
ccctcactccctctgc

SEQ ID NO: 78257 - DNA, 16 bp, H. sapiens
ccctcactccctgcct

SEQ ID NO: 78258 - DNA, 16 bp, H. sapiens
ccctcagacccaggag

SEQ ID NO: 78259 - DNA, 16 bp, H. sapiens
ccctcagactggggct

SEQ ID NO: 78260 - DNA, 16 bp, H. sapiens
ccctcagagcctccag

SEQ ID NO: 78261 - DNA, 16 bp, H. sapiens
ccctcagcccctggca

SEQ ID NO: 78262 - DNA, 16 bp, H. sapiens
ccctcagcccttggca

SEQ ID NO: 78263 - DNA, 16 bp, H. sapiens
ccctcagcctcagcct

SEQ ID NO: 78264 - DNA, 18 bp, H. sapiens
ccctcagcctcccgagta

SEQ ID NO: 78265 - DNA, 16 bp, H. sapiens
ccctcagcctctggca

SEQ ID NO: 78266 - DNA, 16 bp, H. sapiens
ccctcagcttgctggg

SEQ ID NO: 78267 - DNA, 16 bp, H. sapiens
ccctcaggcctcccca

SEQ ID NO: 78268 - DNA, 17 bp, H. sapiens
ccctcaggcttactagg

SEQ ID NO: 78269 - DNA, 16 bp, H. sapiens
ccctcagggactctcc

SEQ ID NO: 78270 - DNA, 16 bp, H. sapiens
ccctcagggagctcac

SEQ ID NO: 78271 - DNA, 16 bp, H. sapiens
ccctcagggcaggacc

SEQ ID NO: 78272 - DNA, 16 bp, H. sapiens
ccctcagtcaaattct

SEQ ID NO: 78273 - DNA, 16 bp, H. sapiens
ccctcagtccctggca

SEQ ID NO: 78274 - DNA, 16 bp, H. sapiens
ccctcatcagacacca

SEQ ID NO: 78275 - DNA, 16 bp, H. sapiens
ccctcatcccagcctc

SEQ ID NO: 78276 - DNA, 16 bp, H. sapiens
ccctcatgaatgactt

SEQ ID NO: 78277 - DNA, 16 bp, H. sapiens
ccctcatgaatggatt

SEQ ID NO: 78278 - DNA, 16 bp, H. sapiens
ccctcatgctgttttc

SEQ ID NO: 78279 - DNA, 16 bp, H. sapiens
ccctcatggagaacct

SEQ ID NO: 78280 - DNA, 16 bp, H. sapiens
ccctcattgtatctag

SEQ ID NO: 78281 - DNA, 17 bp, H. sapiens
ccctccaaaggatcaca

SEQ ID NO: 78282 - DNA, 16 bp, H. sapiens
ccctccaacctgggca

SEQ ID NO: 78283 - DNA, 16 bp, H. sapiens
ccctccaagtgattct

SEQ ID NO: 78284 - DNA, 16 bp, H. sapiens
ccctccaatggcttcc

SEQ ID NO: 78285 - DNA, 16 bp, H. sapiens
ccctccacagctgctg

SEQ ID NO: 78286 - DNA, 16 bp, H. sapiens
ccctccaccacgcctg

SEQ ID NO: 78287 - DNA, 16 bp, H. sapiens
ccctccactgttgtcc

SEQ ID NO: 78288 - DNA, 16 bp, H. sapiens
ccctccagccacactg

SEQ ID NO: 78289 - DNA, 16 bp, H. sapiens
ccctccagcctcagcc

SEQ ID NO: 78290 - DNA, 16 bp, H. sapiens
ccctccagcctcagct

SEQ ID NO: 78291 - DNA, 16 bp, H. sapiens
ccctccagcctgggcc

SEQ ID NO: 78292 - DNA, 16 bp, H. sapiens
ccctccagcctgggct

SEQ ID NO: 78293 - DNA, 16 bp, H. sapiens
ccctccagcctttccc

SEQ ID NO: 78294 - DNA, 16 bp, H. sapiens
ccctccaggccctgcc

SEQ ID NO: 78295 - DNA, 16 bp, H. sapiens
ccctccataatgtgag

SEQ ID NO: 78296 - DNA, 16 bp, H. sapiens
ccctcccaaagtgctg

SEQ ID NO: 78297 - DNA, 16 bp, H. sapiens
ccctcccaaggtgctg

SEQ ID NO: 78298 - DNA, 16 bp, H. sapiens
ccctcccaagttcaag

SEQ ID NO: 78299 - DNA, 16 bp, H. sapiens
ccctcccacagcacat

SEQ ID NO: 78300 - DNA, 16 bp, H. sapiens
ccctcccacctcagtc

SEQ ID NO: 78301 - DNA, 16 bp, H. sapiens
ccctcccacctgggcc

SEQ ID NO: 78302 - DNA, 16 bp, H. sapiens
ccctcccagccccagg

SEQ ID NO: 78303 - DNA, 16 bp, H. sapiens
ccctcccagccctcag

SEQ ID NO: 78304 - DNA, 16 bp, H. sapiens
ccctcccagccctgag

SEQ ID NO: 78305 - DNA, 16 bp, H. sapiens
ccctcccagccctggc

SEQ ID NO: 78306 - DNA, 16 bp, H. sapiens
ccctcccagcctccag

SEQ ID NO: 78307 - DNA, 16 bp, H. sapiens
ccctcccagcctctgg

SEQ ID NO: 78308 - DNA, 16 bp, H. sapiens
ccctcccaggcctctg

SEQ ID NO: 78309 - DNA, 16 bp, H. sapiens
ccctcccaggctaagc

SEQ ID NO: 78310 - DNA, 16 bp, H. sapiens
ccctcccaggttcaag

SEQ ID NO: 78311 - DNA, 16 bp, H. sapiens
ccctcccatcacaagc

SEQ ID NO: 78312 - DNA, 16 bp, H. sapiens
ccctcccatctctgcc

SEQ ID NO: 78313 - DNA, 16 bp, H. sapiens
ccctcccatgacatgg

SEQ ID NO: 78314 - DNA, 16 bp, H. sapiens
ccctccccaagtttgc

SEQ ID NO: 78315 - DNA, 16 bp, H. sapiens
ccctccccagacactg

SEQ ID NO: 78316 - DNA, 16 bp, H. sapiens
ccctccccagaggctg

SEQ ID NO: 78317 - DNA, 16 bp, H. sapiens
ccctccccagcctggg

SEQ ID NO: 78318 - DNA, 16 bp, H. sapiens
ccctccccaggctctg

SEQ ID NO: 78319 - DNA, 16 bp, H. sapiens
ccctccccagtagctg

SEQ ID NO: 78320 - DNA, 16 bp, H. sapiens
ccctccccagtctctg

SEQ ID NO: 78321 - DNA, 16 bp, H. sapiens
ccctcccccagccagg

SEQ ID NO: 78322 - DNA, 16 bp, H. sapiens
ccctcccccagcctgg

SEQ ID NO: 78323 - DNA, 16 bp, H. sapiens
ccctccccctgccaag

SEQ ID NO: 78324 - DNA, 16 bp, H. sapiens
ccctcccctgcccagg

SEQ ID NO: 78325 - DNA, 16 bp, H. sapiens
ccctccccttgagtgt

SEQ ID NO: 78326 - DNA, 16 bp, H. sapiens
ccctccctcctgcact

SEQ ID NO: 78327 - DNA, 16 bp, H. sapiens
ccctccctcctggctg

SEQ ID NO: 78328 - DNA, 16 bp, H. sapiens
ccctccctgcagccca

SEQ ID NO: 78329 - DNA, 16 bp, H. sapiens
ccctccctgcagcctt

SEQ ID NO: 78330 - DNA, 16 bp, H. sapiens
ccctccctgcagctcc

SEQ ID NO: 78331 - DNA, 16 bp, H. sapiens
ccctccctgcccagca

SEQ ID NO: 78332 - DNA, 16 bp, H. sapiens
ccctccctgctgccca

SEQ ID NO: 78333 - DNA, 16 bp, H. sapiens
ccctccctgggcctca

SEQ ID NO: 78334 - DNA, 16 bp, H. sapiens
ccctccctgggctcct

SEQ ID NO: 78335 - DNA, 16 bp, H. sapiens
ccctccctgggctgca

SEQ ID NO: 78336 - DNA, 16 bp, H. sapiens
ccctcccttttggagt

SEQ ID NO: 78337 - DNA, 16 bp, H. sapiens
ccctcctcactctgct

SEQ ID NO: 78338 - DNA, 16 bp, H. sapiens
ccctcctcagcctcag

SEQ ID NO: 78339 - DNA, 16 bp, H. sapiens
ccctcctcagcctccg

SEQ ID NO: 78340 - DNA, 16 bp, H. sapiens
ccctcctcagcctctt

SEQ ID NO: 78341 - DNA, 16 bp, H. sapiens
ccctcctcagcctgcc

SEQ ID NO: 78342 - DNA, 16 bp, H. sapiens
ccctcctcagcttccc

SEQ ID NO: 78343 - DNA, 16 bp, H. sapiens
ccctcctcagtctcct

SEQ ID NO: 78344 - DNA, 16 bp, H. sapiens
ccctcctccagcactg

SEQ ID NO: 78345 - DNA, 16 bp, H. sapiens
ccctcctccagcctca

SEQ ID NO: 78346 - DNA, 16 bp, H. sapiens
ccctcctccagctcct

SEQ ID NO: 78347 - DNA, 16 bp, H. sapiens
ccctcctcccagcctt

SEQ ID NO: 78348 - DNA, 16 bp, H. sapiens
ccctcctccccaggct

SEQ ID NO: 78349 - DNA, 16 bp, H. sapiens
ccctcctcctcagcct

SEQ ID NO: 78350 - DNA, 16 bp, H. sapiens
ccctcctcctggccac

SEQ ID NO: 78351 - DNA, 16 bp, H. sapiens
ccctcctccttaattt

SEQ ID NO: 78352 - DNA, 16 bp, H. sapiens
ccctcctcggcctcca

SEQ ID NO: 78353 - DNA, 16 bp, H. sapiens
ccctcctctcctccag

SEQ ID NO: 78354 - DNA, 16 bp, H. sapiens
ccctcctctgccctgg

SEQ ID NO: 78355 - DNA, 16 bp, H. sapiens
ccctcctgcactgccc

SEQ ID NO: 78356 - DNA, 16 bp, H. sapiens
ccctcctgcagcccct

SEQ ID NO: 78357 - DNA, 16 bp, H. sapiens
ccctcctgcccagcaa

SEQ ID NO: 78358 - DNA, 16 bp, H. sapiens
ccctcctgcccaggcc

SEQ ID NO: 78359 - DNA, 17 bp, H. sapiens
ccctcctgcctcagcct

SEQ ID NO: 78360 - DNA, 16 bp, H. sapiens
ccctcctgcctgggcc

SEQ ID NO: 78361 - DNA, 16 bp, H. sapiens
ccctcctgccttggct

SEQ ID NO: 78362 - DNA, 16 bp, H. sapiens
ccctcctgctccagcc

SEQ ID NO: 78363 - DNA, 16 bp, H. sapiens
ccctcctgctccttca

SEQ ID NO: 78364 - DNA, 16 bp, H. sapiens
ccctcctgctgcagag

SEQ ID NO: 78365 - DNA, 16 bp, H. sapiens
ccctcctgctgccttg

SEQ ID NO: 78366 - DNA, 16 bp, H. sapiens
ccctcctggacggggc

SEQ ID NO: 78367 - DNA, 16 bp, H. sapiens
ccctcctgggctcaag

SEQ ID NO: 78368 - DNA, 16 bp, H. sapiens
ccctcctggggctccc

SEQ ID NO: 78369 - DNA, 16 bp, H. sapiens
ccctccttccccaggg

SEQ ID NO: 78370 - DNA, 16 bp, H. sapiens
ccctccttccctgcag

SEQ ID NO: 78371 - DNA, 16 bp, H. sapiens
ccctccttggccaccc

SEQ ID NO: 78372 - DNA, 16 bp, H. sapiens
ccctccttgggctccc

SEQ ID NO: 78373 - DNA, 16 bp, H. sapiens
ccctcgccagacacca

SEQ ID NO: 78374 - DNA, 16 bp, H. sapiens
ccctcggcctctcaaa

SEQ ID NO: 78375 - DNA, 16 bp, H. sapiens
ccctcggtctctctga

SEQ ID NO: 78376 - DNA, 16 bp, H. sapiens
ccctctaaacactgct

SEQ ID NO: 78377 - DNA, 16 bp, H. sapiens
ccctctactgacaaag

SEQ ID NO: 78378 - DNA, 16 bp, H. sapiens
ccctctcaagactgaa

SEQ ID NO: 78379 - DNA, 16 bp, H. sapiens
ccctctcactgtgtcc

SEQ ID NO: 78380 - DNA, 16 bp, H. sapiens
ccctctcattttacag

SEQ ID NO: 78381 - DNA, 16 bp, H. sapiens
ccctctccagcccctg

SEQ ID NO: 78382 - DNA, 16 bp, H. sapiens
ccctctccagccctgc

SEQ ID NO: 78383 - DNA, 16 bp, H. sapiens
ccctctccagcctcag

SEQ ID NO: 78384 - DNA, 16 bp, H. sapiens
ccctctccaggcctca

SEQ ID NO: 78385 - DNA, 16 bp, H. sapiens
ccctctccagggcctc

SEQ ID NO: 78386 - DNA, 16 bp, H. sapiens
ccctctcccagttccc

SEQ ID NO: 78387 - DNA, 16 bp, H. sapiens
ccctctccccagcctg

SEQ ID NO: 78388 - DNA, 16 bp, H. sapiens
ccctctccccaggaac

SEQ ID NO: 78389 - DNA, 16 bp, H. sapiens
ccctctccctgcagcc

SEQ ID NO: 78390 - DNA, 16 bp, H. sapiens
ccctctcctcaggcct

SEQ ID NO: 78391 - DNA, 16 bp, H. sapiens
ccctctcctggggcct

SEQ ID NO: 78392 - DNA, 16 bp, H. sapiens
ccctctcgcccaggct

SEQ ID NO: 78393 - DNA, 16 bp, H. sapiens
ccctctctacaaaaaa

SEQ ID NO: 78394 - DNA, 16 bp, H. sapiens
ccctctctcctcagcc

SEQ ID NO: 78395 - DNA, 16 bp, H. sapiens
ccctctctctctccag

SEQ ID NO: 78396 - DNA, 16 bp, H. sapiens
ccctctctgagccttg

SEQ ID NO: 78397 - DNA, 16 bp, H. sapiens
ccctctctgcctcagc

SEQ ID NO: 78398 - DNA, 16 bp, H. sapiens
ccctctctgcctcagt

SEQ ID NO: 78399 - DNA, 16 bp, H. sapiens
ccctctctggagcaat

SEQ ID NO: 78400 - DNA, 16 bp, H. sapiens
ccctctctgggcttca

SEQ ID NO: 78401 - DNA, 16 bp, H. sapiens
ccctctctggggctgg

SEQ ID NO: 78402 - DNA, 16 bp, H. sapiens
ccctctctgtgcctct

SEQ ID NO: 78403 - DNA, 16 bp, H. sapiens
ccctctcttctagctt

SEQ ID NO: 78404 - DNA, 16 bp, H. sapiens
ccctctgaagcagtgg

SEQ ID NO: 78405 - DNA, 16 bp, H. sapiens
ccctctgagaagtgag

SEQ ID NO: 78406 - DNA, 16 bp, H. sapiens
ccctctgagatgaaac

SEQ ID NO: 78407 - DNA, 16 bp, H. sapiens
ccctctgagccaggtg

SEQ ID NO: 78408 - DNA, 16 bp, H. sapiens
ccctctgaggctcacc

SEQ ID NO: 78409 - DNA, 16 bp, H. sapiens
ccctctgcagcccagg

SEQ ID NO: 78410 - DNA, 16 bp, H. sapiens
ccctctgcagccgctg

SEQ ID NO: 78411 - DNA, 16 bp, H. sapiens
ccctctgccaccctca

SEQ ID NO: 78412 - DNA, 16 bp, H. sapiens
ccctctgccacctcca

SEQ ID NO: 78413 - DNA, 16 bp, H. sapiens
ccctctgccagctgag

SEQ ID NO: 78414 - DNA, 16 bp, H. sapiens
ccctctgcccagccct

SEQ ID NO: 78415 - DNA, 16 bp, H. sapiens
ccctctgcccggcagc

SEQ ID NO: 78416 - DNA, 16 bp, H. sapiens
ccctctgcctcagttt

SEQ ID NO: 78417 - DNA, 16 bp, H. sapiens
ccctctgcctcccagg

SEQ ID NO: 78418 - DNA, 16 bp, H. sapiens
ccctctgcctcggcct

SEQ ID NO: 78419 - DNA, 16 bp, H. sapiens
ccctctgcctgcctca

SEQ ID NO: 78420 - DNA, 16 bp, H. sapiens
ccctctgcctggccgc

SEQ ID NO: 78421 - DNA, 16 bp, H. sapiens
ccctctgcgggggcct

SEQ ID NO: 78422 - DNA, 16 bp, H. sapiens
ccctctgctcacctcc

SEQ ID NO: 78423 - DNA, 16 bp, H. sapiens
ccctctgctgcccagg

SEQ ID NO: 78424 - DNA, 16 bp, H. sapiens
ccctctggcccaggga

SEQ ID NO: 78425 - DNA, 16 bp, H. sapiens
ccctctggctgctggg

SEQ ID NO: 78426 - DNA, 16 bp, H. sapiens
ccctctgggaagaagc

SEQ ID NO: 78427 - DNA, 16 bp, H. sapiens
ccctctgggagctctg

SEQ ID NO: 78428 - DNA, 16 bp, H. sapiens
ccctctgggcctcagt

SEQ ID NO: 78429 - DNA, 16 bp, H. sapiens
ccctctgggctgctgg

SEQ ID NO: 78430 - DNA, 16 bp, H. sapiens
ccctctggggctccag

SEQ ID NO: 78431 - DNA, 16 bp, H. sapiens
ccctctgggtctcagt

SEQ ID NO: 78432 - DNA, 16 bp, H. sapiens
ccctctgtaaaatggg

SEQ ID NO: 78433 - DNA, 16 bp, H. sapiens
ccctctgtcacccctt

SEQ ID NO: 78434 - DNA, 16 bp, H. sapiens
ccctctgtccccaggc

SEQ ID NO: 78435 - DNA, 16 bp, H. sapiens
ccctctgtctcctggg

SEQ ID NO: 78436 - DNA, 16 bp, H. sapiens
ccctctgtctctgcca

SEQ ID NO: 78437 - DNA, 16 bp, H. sapiens
ccctctgtgcctcagt

SEQ ID NO: 78438 - DNA, 16 bp, H. sapiens
ccctctgtttcccagg

SEQ ID NO: 78439 - DNA, 16 bp, H. sapiens
ccctcttagaactgct

SEQ ID NO: 78440 - DNA, 16 bp, H. sapiens
ccctcttcaatgcctc

SEQ ID NO: 78441 - DNA, 16 bp, H. sapiens
ccctcttcagcacaca

SEQ ID NO: 78442 - DNA, 16 bp, H. sapiens
ccctcttcttgggcct

SEQ ID NO: 78443 - DNA, 16 bp, H. sapiens
ccctcttgccttggcc

SEQ ID NO: 78444 - DNA, 16 bp, H. sapiens
ccctcttggaaggcct

SEQ ID NO: 78445 - DNA, 16 bp, H. sapiens
ccctctttgctgatgg

SEQ ID NO: 78446 - DNA, 16 bp, H. sapiens
ccctctttgtgtccat

SEQ ID NO: 78447 - DNA, 16 bp, H. sapiens
ccctcttttccaggaa

SEQ ID NO: 78448 - DNA, 16 bp, H. sapiens
ccctctttttctatgg

SEQ ID NO: 78449 - DNA, 16 bp, H. sapiens
ccctgaaaaagaaaaa

SEQ ID NO: 78450 - DNA, 16 bp, H. sapiens
ccctgaaaatctgaga

SEQ ID NO: 78451 - DNA, 16 bp, H. sapiens
ccctgaaacacacaca

SEQ ID NO: 78452 - DNA, 16 bp, H. sapiens
ccctgaaccccttccc

SEQ ID NO: 78453 - DNA, 16 bp, H. sapiens
ccctgaagactttcca

SEQ ID NO: 78454 - DNA, 16 bp, H. sapiens
ccctgaagatcttcca

SEQ ID NO: 78455 - DNA, 16 bp, H. sapiens
ccctgaaggaaaggac

SEQ ID NO: 78456 - DNA, 16 bp, H. sapiens
ccctgaaggacagtgg

SEQ ID NO: 78457 - DNA, 16 bp, H. sapiens
ccctgaaggctcagag

SEQ ID NO: 78458 - DNA, 16 bp, H. sapiens
ccctgaagggaaagac

SEQ ID NO: 78459 - DNA, 16 bp, H. sapiens
ccctgaatttaaaagg

SEQ ID NO: 78460 - DNA, 16 bp, H. sapiens
ccctgaatttaaaagt

SEQ ID NO: 78461 - DNA, 16 bp, H. sapiens
ccctgacaacaccttg

SEQ ID NO: 78462 - DNA, 16 bp, H. sapiens
ccctgacacacccacc

SEQ ID NO: 78463 - DNA, 16 bp, H. sapiens
ccctgaccccagtgcc

SEQ ID NO: 78464 - DNA, 16 bp, H. sapiens
ccctgacccccatgcc

SEQ ID NO: 78465 - DNA, 16 bp, H. sapiens
ccctgacccctgccct

SEQ ID NO: 78466 - DNA, 16 bp, H. sapiens
ccctgaccccttattt

SEQ ID NO: 78467 - DNA, 16 bp, H. sapiens
ccctgaccctaaccct

SEQ ID NO: 78468 - DNA, 16 bp, H. sapiens
ccctgaccctgacccc

SEQ ID NO: 78469 - DNA, 16 bp, H. sapiens
ccctgaccctgaccct

SEQ ID NO: 78470 - DNA, 16 bp, H. sapiens
ccctgaccctgtccct

SEQ ID NO: 78471 - DNA, 16 bp, H. sapiens
ccctgacctcaaggag

SEQ ID NO: 78472 - DNA, 29 bp, H. sapiens
ccctgacctcaagtgatccacccacctcg

SEQ ID NO: 78473 - DNA, 16 bp, H. sapiens
ccctgacctcagctga

SEQ ID NO: 78474 - DNA, 17 bp, H. sapiens
ccctgacctcaggtgat

SEQ ID NO: 78475 - DNA, 16 bp, H. sapiens
ccctgacctcagttga

SEQ ID NO: 78476 - DNA, 16 bp, H. sapiens
ccctgacctcgtgatc

SEQ ID NO: 78477 - DNA, 16 bp, H. sapiens
ccctgactctgaaaaa

SEQ ID NO: 78478 - DNA, 16 bp, H. sapiens
ccctgactgtggctgc

SEQ ID NO: 78479 - DNA, 16 bp, H. sapiens
ccctgagaggcagaag

SEQ ID NO: 78480 - DNA, 16 bp, H. sapiens
ccctgagataactttg

SEQ ID NO: 78481 - DNA, 16 bp, H. sapiens
ccctgagatgctgaaa

SEQ ID NO: 78482 - DNA, 16 bp, H. sapiens
ccctgagcaagaagga

SEQ ID NO: 78483 - DNA, 16 bp, H. sapiens
ccctgagcagagaatc

SEQ ID NO: 78484 - DNA, 16 bp, H. sapiens
ccctgagcccagggag

SEQ ID NO: 78485 - DNA, 16 bp, H. sapiens
ccctgagccccagccc

SEQ ID NO: 78486 - DNA, 16 bp, H. sapiens
ccctgagccctgagcc

SEQ ID NO: 78487 - DNA, 16 bp, H. sapiens
ccctgagcctgcaggg

SEQ ID NO: 78488 - DNA, 16 bp, H. sapiens
ccctgagcctggccca

SEQ ID NO: 78489 - DNA, 16 bp, H. sapiens
ccctgagctagataca

SEQ ID NO: 78490 - DNA, 16 bp, H. sapiens
ccctgagctctgtgag

SEQ ID NO: 78491 - DNA, 16 bp, H. sapiens
ccctgagcttgctttc

SEQ ID NO: 78492 - DNA, 16 bp, H. sapiens
ccctgaggaagagaaa

SEQ ID NO: 78493 - DNA, 16 bp, H. sapiens
ccctgaggacagccag

SEQ ID NO: 78494 - DNA, 16 bp, H. sapiens
ccctgaggagctggga

SEQ ID NO: 78495 - DNA, 16 bp, H. sapiens
ccctgaggaggtgaca

SEQ ID NO: 78496 - DNA, 16 bp, H. sapiens
ccctgagggcagggac

SEQ ID NO: 78497 - DNA, 16 bp, H. sapiens
ccctgagggcagggcc

SEQ ID NO: 78498 - DNA, 16 bp, H. sapiens
ccctgagggtgggcct

SEQ ID NO: 78499 - DNA, 16 bp, H. sapiens
ccctgaggtcacacag

SEQ ID NO: 78500 - DNA, 16 bp, H. sapiens
ccctgaggtctcccca

SEQ ID NO: 78501 - DNA, 16 bp, H. sapiens
ccctgagtggacacag

SEQ ID NO: 78502 - DNA, 16 bp, H. sapiens
ccctgagttcccaaag

SEQ ID NO: 78503 - DNA, 16 bp, H. sapiens
ccctgatctcagactt

SEQ ID NO: 78504 - DNA, 16 bp, H. sapiens
ccctgatctcaggtga

SEQ ID NO: 78505 - DNA, 16 bp, H. sapiens
ccctgatgaacatcaa

SEQ ID NO: 78506 - DNA, 16 bp, H. sapiens
ccctgatgaatacaga

SEQ ID NO: 78507 - DNA, 16 bp, H. sapiens
ccctgattactaatga

SEQ ID NO: 78508 - DNA, 16 bp, H. sapiens
ccctgatttctttctt

SEQ ID NO: 78509 - DNA, 16 bp, H. sapiens
ccctgattttatcatt

SEQ ID NO: 78510 - DNA, 16 bp, H. sapiens
ccctgcaaagccatct

SEQ ID NO: 78511 - DNA, 16 bp, H. sapiens
ccctgcaaaggacaca

SEQ ID NO: 78512 - DNA, 16 bp, H. sapiens
ccctgcaaagtcacag

SEQ ID NO: 78513 - DNA, 16 bp, H. sapiens
ccctgcaaggctgtgg

SEQ ID NO: 78514 - DNA, 16 bp, H. sapiens
ccctgcaatcccagca

SEQ ID NO: 78515 - DNA, 16 bp, H. sapiens
ccctgcacaaattctc

SEQ ID NO: 78516 - DNA, 16 bp, H. sapiens
ccctgcacacagcagg

SEQ ID NO: 78517 - DNA, 16 bp, H. sapiens
ccctgcactccatcct

SEQ ID NO: 78518 - DNA, 16 bp, H. sapiens
ccctgcactctggcct

SEQ ID NO: 78519 - DNA, 16 bp, H. sapiens
ccctgcagatcttggg

SEQ ID NO: 78520 - DNA, 16 bp, H. sapiens
ccctgcagcccctcct

SEQ ID NO: 78521 - DNA, 16 bp, H. sapiens
ccctgcagcccctggc

SEQ ID NO: 78522 - DNA, 16 bp, H. sapiens
ccctgcagcccctttc

SEQ ID NO: 78523 - DNA, 16 bp, H. sapiens
ccctgcagccctgcag

SEQ ID NO: 78524 - DNA, 16 bp, H. sapiens
ccctgcagccctggcc

SEQ ID NO: 78525 - DNA, 16 bp, H. sapiens
ccctgcagcctcagcc

SEQ ID NO: 78526 - DNA, 16 bp, H. sapiens
ccctgcagcctcctcc

SEQ ID NO: 78527 - DNA, 16 bp, H. sapiens
ccctgcagcctctgct

SEQ ID NO: 78528 - DNA, 16 bp, H. sapiens
ccctgcagctccagct

SEQ ID NO: 78529 - DNA, 16 bp, H. sapiens
ccctgcaggcagtcag

SEQ ID NO: 78530 - DNA, 16 bp, H. sapiens
ccctgcatccaacctg

SEQ ID NO: 78531 - DNA, 16 bp, H. sapiens
ccctgcatcctggcca

SEQ ID NO: 78532 - DNA, 16 bp, H. sapiens
ccctgcatttgcatat

SEQ ID NO: 78533 - DNA, 16 bp, H. sapiens
ccctgccaacaccttg

SEQ ID NO: 78534 - DNA, 16 bp, H. sapiens
ccctgccaaccaccat

SEQ ID NO: 78535 - DNA, 16 bp, H. sapiens
ccctgccaactcagaa

SEQ ID NO: 78536 - DNA, 16 bp, H. sapiens
ccctgccacagcctcc

SEQ ID NO: 78537 - DNA, 16 bp, H. sapiens
ccctgccacctcagcc

SEQ ID NO: 78538 - DNA, 16 bp, H. sapiens
ccctgccacctccact

SEQ ID NO: 78539 - DNA, 16 bp, H. sapiens
ccctgccacctccctg

SEQ ID NO: 78540 - DNA, 16 bp, H. sapiens
ccctgccactgcctct

SEQ ID NO: 78541 - DNA, 16 bp, H. sapiens
ccctgccagcatcttg

SEQ ID NO: 78542 - DNA, 16 bp, H. sapiens
ccctgccagcccagcc

SEQ ID NO: 78543 - DNA, 16 bp, H. sapiens
ccctgccagcccccag

SEQ ID NO: 78544 - DNA, 16 bp, H. sapiens
ccctgcccactccctg

SEQ ID NO: 78545 - DNA, 16 bp, H. sapiens
ccctgcccactgccag

SEQ ID NO: 78546 - DNA, 16 bp, H. sapiens
ccctgcccactgcctg

SEQ ID NO: 78547 - DNA, 16 bp, H. sapiens
ccctgcccagaaggaa

SEQ ID NO: 78548 - DNA, 16 bp, H. sapiens
ccctgcccagccagcc

SEQ ID NO: 78549 - DNA, 16 bp, H. sapiens
ccctgcccagcccagc

SEQ ID NO: 78550 - DNA, 16 bp, H. sapiens
ccctgcccagcccagg

SEQ ID NO: 78551 - DNA, 16 bp, H. sapiens
ccctgcccagccccag

SEQ ID NO: 78552 - DNA, 16 bp, H. sapiens
ccctgcccagccctga

SEQ ID NO: 78553 - DNA, 16 bp, H. sapiens
ccctgcccagccctgc

SEQ ID NO: 78554 - DNA, 16 bp, H. sapiens
ccctgcccagggagct

SEQ ID NO: 78555 - DNA, 16 bp, H. sapiens
ccctgcccattgcctg

SEQ ID NO: 78556 - DNA, 16 bp, H. sapiens
ccctgccccaacctga

SEQ ID NO: 78557 - DNA, 16 bp, H. sapiens
ccctgccccacaggga

SEQ ID NO: 78558 - DNA, 16 bp, H. sapiens
ccctgccccaccctgg

SEQ ID NO: 78559 - DNA, 16 bp, H. sapiens
ccctgccccagcccag

SEQ ID NO: 78560 - DNA, 16 bp, H. sapiens
ccctgccccagccctg

SEQ ID NO: 78561 - DNA, 16 bp, H. sapiens
ccctgccccagctcct

SEQ ID NO: 78562 - DNA, 16 bp, H. sapiens
ccctgccccaggcctc

SEQ ID NO: 78563 - DNA, 16 bp, H. sapiens
ccctgccccaggctgg

SEQ ID NO: 78564 - DNA, 16 bp, H. sapiens
ccctgcccccacctga

SEQ ID NO: 78565 - DNA, 16 bp, H. sapiens
ccctgcccccagagct

SEQ ID NO: 78566 - DNA, 17 bp, H. sapiens
ccctgcccccagaggtg

SEQ ID NO: 78567 - DNA, 16 bp, H. sapiens
ccctgcccccatctga

SEQ ID NO: 78568 - DNA, 16 bp, H. sapiens
ccctgcccctacagca

SEQ ID NO: 78569 - DNA, 16 bp, H. sapiens
ccctgcccctgcagca

SEQ ID NO: 78570 - DNA, 16 bp, H. sapiens
ccctgcccctgcccag

SEQ ID NO: 78571 - DNA, 16 bp, H. sapiens
ccctgcccctgcctga

SEQ ID NO: 78572 - DNA, 16 bp, H. sapiens
ccctgccccttcccag

SEQ ID NO: 78573 - DNA, 16 bp, H. sapiens
ccctgccccttctgag

SEQ ID NO: 78574 - DNA, 16 bp, H. sapiens
ccctgccctcagagag

SEQ ID NO: 78575 - DNA, 16 bp, H. sapiens
ccctgccctcaggaag

SEQ ID NO: 78576 - DNA, 16 bp, H. sapiens
ccctgccctccagcct

SEQ ID NO: 78577 - DNA, 16 bp, H. sapiens
ccctgccctcctccag

SEQ ID NO: 78578 - DNA, 16 bp, H. sapiens
ccctgccctcctggag

SEQ ID NO: 78579 - DNA, 16 bp, H. sapiens
ccctgccctcctgggc

SEQ ID NO: 78580 - DNA, 16 bp, H. sapiens
ccctgccctctaggag

SEQ ID NO: 78581 - DNA, 16 bp, H. sapiens
ccctgccctctctggg

SEQ ID NO: 78582 - DNA, 16 bp, H. sapiens
ccctgccctgaccctg

SEQ ID NO: 78583 - DNA, 16 bp, H. sapiens
ccctgccctgcccagc

SEQ ID NO: 78584 - DNA, 16 bp, H. sapiens
ccctgccctgccctga

SEQ ID NO: 78585 - DNA, 16 bp, H. sapiens
ccctgccctgccctgg

SEQ ID NO: 78586 - DNA, 16 bp, H. sapiens
ccctgccctgcctgtg

SEQ ID NO: 78587 - DNA, 16 bp, H. sapiens
ccctgccctgctctgc

SEQ ID NO: 78588 - DNA, 16 bp, H. sapiens
ccctgccctgctgcct

SEQ ID NO: 78589 - DNA, 16 bp, H. sapiens
ccctgccctgctggag

SEQ ID NO: 78590 - DNA, 16 bp, H. sapiens
ccctgccctggacctg

SEQ ID NO: 78591 - DNA, 16 bp, H. sapiens
ccctgccctggccctg

SEQ ID NO: 78592 - DNA, 16 bp, H. sapiens
ccctgccctgtcccca

SEQ ID NO: 78593 - DNA, 16 bp, H. sapiens
ccctgccctgtgccct

SEQ ID NO: 78594 - DNA, 16 bp, H. sapiens
ccctgccctgtgtggc

SEQ ID NO: 78595 - DNA, 16 bp, H. sapiens
ccctgcccttccccag

SEQ ID NO: 78596 - DNA, 16 bp, H. sapiens
ccctgcccttggggag

SEQ ID NO: 78597 - DNA, 16 bp, H. sapiens
ccctgccgcccaggct

SEQ ID NO: 78598 - DNA, 16 bp, H. sapiens
ccctgcctcagactcc

SEQ ID NO: 78599 - DNA, 16 bp, H. sapiens
ccctgcctcagcctcc

SEQ ID NO: 78600 - DNA, 16 bp, H. sapiens
ccctgcctcagcctgc

SEQ ID NO: 78601 - DNA, 16 bp, H. sapiens
ccctgcctcagggcct

SEQ ID NO: 78602 - DNA, 16 bp, H. sapiens
ccctgcctccacttgc

SEQ ID NO: 78603 - DNA, 16 bp, H. sapiens
ccctgcctccagaccc

SEQ ID NO: 78604 - DNA, 16 bp, H. sapiens
ccctgcctccaggccc

SEQ ID NO: 78605 - DNA, 16 bp, H. sapiens
ccctgcctcctcccag

SEQ ID NO: 78606 - DNA, 16 bp, H. sapiens
ccctgcctcctgcctg

SEQ ID NO: 78607 - DNA, 16 bp, H. sapiens
ccctgcctcctgggct

SEQ ID NO: 78608 - DNA, 16 bp, H. sapiens
ccctgcctcgacctcc

SEQ ID NO: 78609 - DNA, 16 bp, H. sapiens
ccctgcctctacaaaa

SEQ ID NO: 78610 - DNA, 16 bp, H. sapiens
ccctgcctctgccacc

SEQ ID NO: 78611 - DNA, 16 bp, H. sapiens
ccctgcctctgccagc

SEQ ID NO: 78612 - DNA, 16 bp, H. sapiens
ccctgcctctgccctg

SEQ ID NO: 78613 - DNA, 16 bp, H. sapiens
ccctgcctctggagtc

SEQ ID NO: 78614 - DNA, 16 bp, H. sapiens
ccctgcctgccccagc

SEQ ID NO: 78615 - DNA, 16 bp, H. sapiens
ccctgcctgccccagg

SEQ ID NO: 78616 - DNA, 16 bp, H. sapiens
ccctgcctgcctcacc

SEQ ID NO: 78617 - DNA, 16 bp, H. sapiens
ccctgcctgcctccca

SEQ ID NO: 78618 - DNA, 16 bp, H. sapiens
ccctgcctgcctggct

SEQ ID NO: 78619 - DNA, 16 bp, H. sapiens
ccctgcctgctgctgc

SEQ ID NO: 78620 - DNA, 16 bp, H. sapiens
ccctgcctggcagctc

SEQ ID NO: 78621 - DNA, 16 bp, H. sapiens
ccctgcctggccagcc

SEQ ID NO: 78622 - DNA, 16 bp, H. sapiens
ccctgcctggcctcct

SEQ ID NO: 78623 - DNA, 16 bp, H. sapiens
ccctgcctggcctggc

SEQ ID NO: 78624 - DNA, 16 bp, H. sapiens
ccctgcctggcctggg

SEQ ID NO: 78625 - DNA, 16 bp, H. sapiens
ccctgcctgggcctcc

SEQ ID NO: 78626 - DNA, 16 bp, H. sapiens
ccctgcctgggtcccc

SEQ ID NO: 78627 - DNA, 16 bp, H. sapiens
ccctgcctggtgaaga

SEQ ID NO: 78628 - DNA, 16 bp, H. sapiens
ccctgcctgtgccctg

SEQ ID NO: 78629 - DNA, 16 bp, H. sapiens
ccctgcctgttccctg

SEQ ID NO: 78630 - DNA, 16 bp, H. sapiens
ccctgccttagcctcc

SEQ ID NO: 78631 - DNA, 16 bp, H. sapiens
ccctgccttgcctttc

SEQ ID NO: 78632 - DNA, 16 bp, H. sapiens
ccctgcctttaaaaac

SEQ ID NO: 78633 - DNA, 19 bp, H. sapiens
ccctgcggccttccgcagt

SEQ ID NO: 78634 - DNA, 16 bp, H. sapiens
ccctgcggggcagggc

SEQ ID NO: 78635 - DNA, 16 bp, H. sapiens
ccctgctcaacctggc

SEQ ID NO: 78636 - DNA, 17 bp, H. sapiens
ccctgctcaagtgcatc

SEQ ID NO: 78637 - DNA, 16 bp, H. sapiens
ccctgctcacaccttg

SEQ ID NO: 78638 - DNA, 16 bp, H. sapiens
ccctgctcagagagga

SEQ ID NO: 78639 - DNA, 16 bp, H. sapiens
ccctgctcagcttccc

SEQ ID NO: 78640 - DNA, 16 bp, H. sapiens
ccctgctccagccaca

SEQ ID NO: 78641 - DNA, 16 bp, H. sapiens
ccctgctccagccctg

SEQ ID NO: 78642 - DNA, 16 bp, H. sapiens
ccctgctcccagaggt

SEQ ID NO: 78643 - DNA, 16 bp, H. sapiens
ccctgctcctcagcct

SEQ ID NO: 78644 - DNA, 16 bp, H. sapiens
ccctgctcctgagcct

SEQ ID NO: 78645 - DNA, 16 bp, H. sapiens
ccctgctcctgcagca

SEQ ID NO: 78646 - DNA, 16 bp, H. sapiens
ccctgctctagggatc

SEQ ID NO: 78647 - DNA, 16 bp, H. sapiens
ccctgctctgtcccca

SEQ ID NO: 78648 - DNA, 16 bp, H. sapiens
ccctgctctgtgcagc

SEQ ID NO: 78649 - DNA, 16 bp, H. sapiens
ccctgctgccaccacc

SEQ ID NO: 78650 - DNA, 16 bp, H. sapiens
ccctgctgcctccacc

SEQ ID NO: 78651 - DNA, 16 bp, H. sapiens
ccctgctgcctcccag

SEQ ID NO: 78652 - DNA, 16 bp, H. sapiens
ccctgctgcctccctg

SEQ ID NO: 78653 - DNA, 16 bp, H. sapiens
ccctgctgcctcctca

SEQ ID NO: 78654 - DNA, 16 bp, H. sapiens
ccctgctgctgcccag

SEQ ID NO: 78655 - DNA, 16 bp, H. sapiens
ccctgctgctgccctg

SEQ ID NO: 78656 - DNA, 16 bp, H. sapiens
ccctgctgctgctcct

SEQ ID NO: 78657 - DNA, 16 bp, H. sapiens
ccctgctgctgctgct

SEQ ID NO: 78658 - DNA, 16 bp, H. sapiens
ccctgctggcaccctg

SEQ ID NO: 78659 - DNA, 16 bp, H. sapiens
ccctgctggccccagg

SEQ ID NO: 78660 - DNA, 16 bp, H. sapiens
ccctgctggccccggg

SEQ ID NO: 78661 - DNA, 16 bp, H. sapiens
ccctgctggccctggg

SEQ ID NO: 78662 - DNA, 16 bp, H. sapiens
ccctgctgtgtggcct

SEQ ID NO: 78663 - DNA, 16 bp, H. sapiens
ccctgcttcagcctcc

SEQ ID NO: 78664 - DNA, 16 bp, H. sapiens
ccctgcttcggctcgc

SEQ ID NO: 78665 - DNA, 16 bp, H. sapiens
ccctgcttctgctggc

SEQ ID NO: 78666 - DNA, 16 bp, H. sapiens
ccctgctttcatggag

SEQ ID NO: 78667 - DNA, 16 bp, H. sapiens
ccctgctttggcttgc

SEQ ID NO: 78668 - DNA, 16 bp, H. sapiens
ccctggaaaccactaa

SEQ ID NO: 78669 - DNA, 16 bp, H. sapiens
ccctggaacctgtgaa

SEQ ID NO: 78670 - DNA, 16 bp, H. sapiens
ccctggaacttctaag

SEQ ID NO: 78671 - DNA, 16 bp, H. sapiens
ccctggaagtggaggt

SEQ ID NO: 78672 - DNA, 16 bp, H. sapiens
ccctggaagttgaggc

SEQ ID NO: 78673 - DNA, 16 bp, H. sapiens
ccctggaatcaacatc

SEQ ID NO: 78674 - DNA, 16 bp, H. sapiens
ccctggaatgcaaggt

SEQ ID NO: 78675 - DNA, 16 bp, H. sapiens
ccctggacaccaaggc

SEQ ID NO: 78676 - DNA, 16 bp, H. sapiens
ccctggaccagatgga

SEQ ID NO: 78677 - DNA, 16 bp, H. sapiens
ccctggacccagccac

SEQ ID NO: 78678 - DNA, 16 bp, H. sapiens
ccctggaccctgctga

SEQ ID NO: 78679 - DNA, 16 bp, H. sapiens
ccctggactccagcct

SEQ ID NO: 78680 - DNA, 16 bp, H. sapiens
ccctggagacggaggt

SEQ ID NO: 78681 - DNA, 16 bp, H. sapiens
ccctggagcccaggaa

SEQ ID NO: 78682 - DNA, 16 bp, H. sapiens
ccctggagcccaggag

SEQ ID NO: 78683 - DNA, 16 bp, H. sapiens
ccctggagcctccaga

SEQ ID NO: 78684 - DNA, 16 bp, H. sapiens
ccctggagcctgtgaa

SEQ ID NO: 78685 - DNA, 16 bp, H. sapiens
ccctggaggaagctgg

SEQ ID NO: 78686 - DNA, 16 bp, H. sapiens
ccctggaggaggaggg

SEQ ID NO: 78687 - DNA, 16 bp, H. sapiens
ccctggaggaggaggt

SEQ ID NO: 78688 - DNA, 16 bp, H. sapiens
ccctggaggcagagct

SEQ ID NO: 78689 - DNA, 16 bp, H. sapiens
ccctggaggcccagct

SEQ ID NO: 78690 - DNA, 16 bp, H. sapiens
ccctggaggccgaggt

SEQ ID NO: 78691 - DNA, 16 bp, H. sapiens
ccctggaggcggagat

SEQ ID NO: 78692 - DNA, 16 bp, H. sapiens
ccctggaggcggagct

SEQ ID NO: 78693 - DNA, 16 bp, H. sapiens
ccctggaggctggagg

SEQ ID NO: 78694 - DNA, 16 bp, H. sapiens
ccctggagggcttgtt

SEQ ID NO: 78695 - DNA, 16 bp, H. sapiens
ccctggaggtcgaggc

SEQ ID NO: 78696 - DNA, 16 bp, H. sapiens
ccctggaggtgaaggt

SEQ ID NO: 78697 - DNA, 16 bp, H. sapiens
ccctggagtccaggcc

SEQ ID NO: 78698 - DNA, 16 bp, H. sapiens
ccctggagtctctctg

SEQ ID NO: 78699 - DNA, 16 bp, H. sapiens
ccctggagtttgaggt

SEQ ID NO: 78700 - DNA, 16 bp, H. sapiens
ccctggatattagaaa

SEQ ID NO: 78701 - DNA, 16 bp, H. sapiens
ccctggatgcccagct

SEQ ID NO: 78702 - DNA, 16 bp, H. sapiens
ccctggcaagggtggt

SEQ ID NO: 78703 - DNA, 16 bp, H. sapiens
ccctggcaccagctgc

SEQ ID NO: 78704 - DNA, 16 bp, H. sapiens
ccctggcacccaccat

SEQ ID NO: 78705 - DNA, 16 bp, H. sapiens
ccctggcactggctgc

SEQ ID NO: 78706 - DNA, 16 bp, H. sapiens
ccctggcagcaatggc

SEQ ID NO: 78707 - DNA, 16 bp, H. sapiens
ccctggcagcatgact

SEQ ID NO: 78708 - DNA, 16 bp, H. sapiens
ccctggcatcccaaag

SEQ ID NO: 78709 - DNA, 16 bp, H. sapiens
ccctggccaccaccat

SEQ ID NO: 78710 - DNA, 16 bp, H. sapiens
ccctggccagaacatc

SEQ ID NO: 78711 - DNA, 16 bp, H. sapiens
ccctggccccagctcc

SEQ ID NO: 78712 - DNA, 16 bp, H. sapiens
ccctggcccctgccaa

SEQ ID NO: 78713 - DNA, 16 bp, H. sapiens
ccctggccccttcctg

SEQ ID NO: 78714 - DNA, 16 bp, H. sapiens
ccctggccctgagctg

SEQ ID NO: 78715 - DNA, 16 bp, H. sapiens
ccctggccctgcccag

SEQ ID NO: 78716 - DNA, 16 bp, H. sapiens
ccctggccctgcccca

SEQ ID NO: 78717 - DNA, 16 bp, H. sapiens
ccctggccctgccctg

SEQ ID NO: 78718 - DNA, 16 bp, H. sapiens
ccctggccctgccctt

SEQ ID NO: 78719 - DNA, 16 bp, H. sapiens
ccctggccctgcctgg

SEQ ID NO: 78720 - DNA, 16 bp, H. sapiens
ccctggccctgctctg

SEQ ID NO: 78721 - DNA, 16 bp, H. sapiens
ccctggccctggccca

SEQ ID NO: 78722 - DNA, 16 bp, H. sapiens
ccctggccctggcctg

SEQ ID NO: 78723 - DNA, 16 bp, H. sapiens
ccctggccctggctcc

SEQ ID NO: 78724 - DNA, 16 bp, H. sapiens
ccctggccctggttct

SEQ ID NO: 78725 - DNA, 16 bp, H. sapiens
ccctggcctccaccca

SEQ ID NO: 78726 - DNA, 16 bp, H. sapiens
ccctggcctccccaag

SEQ ID NO: 78727 - DNA, 16 bp, H. sapiens
ccctggcctcctctgc

SEQ ID NO: 78728 - DNA, 16 bp, H. sapiens
ccctggcctcctgcag

SEQ ID NO: 78729 - DNA, 16 bp, H. sapiens
ccctggcctggagccc

SEQ ID NO: 78730 - DNA, 16 bp, H. sapiens
ccctggcctgtcttca

SEQ ID NO: 78731 - DNA, 16 bp, H. sapiens
ccctggcggcccagct

SEQ ID NO: 78732 - DNA, 16 bp, H. sapiens
ccctggctcaaacaat

SEQ ID NO: 78733 - DNA, 16 bp, H. sapiens
ccctggctcagcctcc

SEQ ID NO: 78734 - DNA, 16 bp, H. sapiens
ccctggctcagtctct

SEQ ID NO: 78735 - DNA, 16 bp, H. sapiens
ccctggctccagcccc

SEQ ID NO: 78736 - DNA, 16 bp, H. sapiens
ccctggctcctgcctg

SEQ ID NO: 78737 - DNA, 16 bp, H. sapiens
ccctggctcctggaca

SEQ ID NO: 78738 - DNA, 16 bp, H. sapiens
ccctggctctggccct

SEQ ID NO: 78739 - DNA, 16 bp, H. sapiens
ccctggctctgtcact

SEQ ID NO: 78740 - DNA, 16 bp, H. sapiens
ccctggctgcacctcc

SEQ ID NO: 78741 - DNA, 16 bp, H. sapiens
ccctggctgctgtgtg

SEQ ID NO: 78742 - DNA, 16 bp, H. sapiens
ccctggctggagcaca

SEQ ID NO: 78743 - DNA, 16 bp, H. sapiens
ccctggctggagtgca

SEQ ID NO: 78744 - DNA, 16 bp, H. sapiens
ccctggctgggcatgg

SEQ ID NO: 78745 - DNA, 16 bp, H. sapiens
ccctggctggtctgga

SEQ ID NO: 78746 - DNA, 16 bp, H. sapiens
ccctggcttctcccca

SEQ ID NO: 78747 - DNA, 16 bp, H. sapiens
ccctggcttgggccca

SEQ ID NO: 78748 - DNA, 16 bp, H. sapiens
ccctgggaaaggaatg

SEQ ID NO: 78749 - DNA, 16 bp, H. sapiens
ccctgggagaggccag

SEQ ID NO: 78750 - DNA, 16 bp, H. sapiens
ccctgggagaggctgg

SEQ ID NO: 78751 - DNA, 16 bp, H. sapiens
ccctgggaggcaaaat

SEQ ID NO: 78752 - DNA, 16 bp, H. sapiens
ccctgggaggcaacag

SEQ ID NO: 78753 - DNA, 16 bp, H. sapiens
ccctgggaggcaagag

SEQ ID NO: 78754 - DNA, 16 bp, H. sapiens
ccctgggagggagagg

SEQ ID NO: 78755 - DNA, 16 bp, H. sapiens
ccctgggagggaggga

SEQ ID NO: 78756 - DNA, 16 bp, H. sapiens
ccctgggatgcgaggc

SEQ ID NO: 78757 - DNA, 16 bp, H. sapiens
ccctgggatggagccc

SEQ ID NO: 78758 - DNA, 16 bp, H. sapiens
ccctgggcaacagaga

SEQ ID NO: 78759 - DNA, 16 bp, H. sapiens
ccctgggcaggttccc

SEQ ID NO: 78760 - DNA, 16 bp, H. sapiens
ccctgggcagtgaggg

SEQ ID NO: 78761 - DNA, 16 bp, H. sapiens
ccctgggccagcagca

SEQ ID NO: 78762 - DNA, 16 bp, H. sapiens
ccctgggccagccctg

SEQ ID NO: 78763 - DNA, 16 bp, H. sapiens
ccctgggccatggacc

SEQ ID NO: 78764 - DNA, 16 bp, H. sapiens
ccctgggcccagacca

SEQ ID NO: 78765 - DNA, 16 bp, H. sapiens
ccctgggcccagctcc

SEQ ID NO: 78766 - DNA, 16 bp, H. sapiens
ccctgggccccaccca

SEQ ID NO: 78767 - DNA, 16 bp, H. sapiens
ccctgggccctgaata

SEQ ID NO: 78768 - DNA, 16 bp, H. sapiens
ccctgggccctgccca

SEQ ID NO: 78769 - DNA, 16 bp, H. sapiens
ccctgggccctgggct

SEQ ID NO: 78770 - DNA, 16 bp, H. sapiens
ccctgggccctgtgca

SEQ ID NO: 78771 - DNA, 16 bp, H. sapiens
ccctgggcctcagtgt

SEQ ID NO: 78772 - DNA, 16 bp, H. sapiens
ccctgggcctggacca

SEQ ID NO: 78773 - DNA, 16 bp, H. sapiens
ccctgggcctggcaca

SEQ ID NO: 78774 - DNA, 16 bp, H. sapiens
ccctgggcctggccca

SEQ ID NO: 78775 - DNA, 16 bp, H. sapiens
ccctgggcctggccta

SEQ ID NO: 78776 - DNA, 16 bp, H. sapiens
ccctgggcctggctca

SEQ ID NO: 78777 - DNA, 16 bp, H. sapiens
ccctgggcctgtgccc

SEQ ID NO: 78778 - DNA, 16 bp, H. sapiens
ccctgggcgggccagg

SEQ ID NO: 78779 - DNA, 16 bp, H. sapiens
ccctgggctgggctgg

SEQ ID NO: 78780 - DNA, 16 bp, H. sapiens
ccctgggctgtggacc

SEQ ID NO: 78781 - DNA, 16 bp, H. sapiens
ccctgggcttggcctg

SEQ ID NO: 78782 - DNA, 16 bp, H. sapiens
ccctggggagggaggg

SEQ ID NO: 78783 - DNA, 16 bp, H. sapiens
ccctggggcaggaccc

SEQ ID NO: 78784 - DNA, 16 bp, H. sapiens
ccctggggcaggagca

SEQ ID NO: 78785 - DNA, 16 bp, H. sapiens
ccctggggccctggag

SEQ ID NO: 78786 - DNA, 16 bp, H. sapiens
ccctggggctggggct

SEQ ID NO: 78787 - DNA, 16 bp, H. sapiens
ccctgggggaggaggg

SEQ ID NO: 78788 - DNA, 16 bp, H. sapiens
ccctgggggctcagga

SEQ ID NO: 78789 - DNA, 16 bp, H. sapiens
ccctgggggcttctgg

SEQ ID NO: 78790 - DNA, 16 bp, H. sapiens
ccctgggggtggaggt

SEQ ID NO: 78791 - DNA, 16 bp, H. sapiens
ccctgggtccttccca

SEQ ID NO: 78792 - DNA, 16 bp, H. sapiens
ccctgggttcaagaga

SEQ ID NO: 78793 - DNA, 16 bp, H. sapiens
ccctgggttcaagcca

SEQ ID NO: 78794 - DNA, 16 bp, H. sapiens
ccctgggtttcaagca

SEQ ID NO: 78795 - DNA, 16 bp, H. sapiens
ccctggtaccaaaaag

SEQ ID NO: 78796 - DNA, 16 bp, H. sapiens
ccctggtcatcagaga

SEQ ID NO: 78797 - DNA, 16 bp, H. sapiens
ccctggtccccagccc

SEQ ID NO: 78798 - DNA, 16 bp, H. sapiens
ccctggtcctgccata

SEQ ID NO: 78799 - DNA, 16 bp, H. sapiens
ccctggtctcctgcag

SEQ ID NO: 78800 - DNA, 16 bp, H. sapiens
ccctggtggtctagtg

SEQ ID NO: 78801 - DNA, 16 bp, H. sapiens
ccctggtgtgtgctgt

SEQ ID NO: 78802 - DNA, 20 bp, H. sapiens
ccctgtaatcccagcacttt

SEQ ID NO: 78803 - DNA, 16 bp, H. sapiens
ccctgtatctagctca

SEQ ID NO: 78804 - DNA, 16 bp, H. sapiens
ccctgtattattcctg

SEQ ID NO: 78805 - DNA, 16 bp, H. sapiens
ccctgtatttctttct

SEQ ID NO: 78806 - DNA, 16 bp, H. sapiens
ccctgtcaaaagaaag

SEQ ID NO: 78807 - DNA, 16 bp, H. sapiens
ccctgtcacccaagct

SEQ ID NO: 78808 - DNA, 16 bp, H. sapiens
ccctgtcaccgaggct

SEQ ID NO: 78809 - DNA, 16 bp, H. sapiens
ccctgtccagaacttc

SEQ ID NO: 78810 - DNA, 16 bp, H. sapiens
ccctgtcccagcccca

SEQ ID NO: 78811 - DNA, 16 bp, H. sapiens
ccctgtccccagaggt

SEQ ID NO: 78812 - DNA, 16 bp, H. sapiens
ccctgtcccccaggct

SEQ ID NO: 78813 - DNA, 16 bp, H. sapiens
ccctgtccctgcccca

SEQ ID NO: 78814 - DNA, 16 bp, H. sapiens
ccctgtccctgccctg

SEQ ID NO: 78815 - DNA, 16 bp, H. sapiens
ccctgtccctgtcctg

SEQ ID NO: 78816 - DNA, 16 bp, H. sapiens
ccctgtcctcaccctc

SEQ ID NO: 78817 - DNA, 16 bp, H. sapiens
ccctgtcctgccctgc

SEQ ID NO: 78818 - DNA, 16 bp, H. sapiens
ccctgtctcaaaacca

SEQ ID NO: 78819 - DNA, 16 bp, H. sapiens
ccctgtctccaggctg

SEQ ID NO: 78820 - DNA, 16 bp, H. sapiens
ccctgtctccagtaaa

SEQ ID NO: 78821 - DNA, 16 bp, H. sapiens
ccctgtctctaaaact

SEQ ID NO: 78822 - DNA, 16 bp, H. sapiens
ccctgtctctacagaa

SEQ ID NO: 78823 - DNA, 16 bp, H. sapiens
ccctgtctctgcctct

SEQ ID NO: 78824 - DNA, 16 bp, H. sapiens
ccctgtctctgtctcc

SEQ ID NO: 78825 - DNA, 16 bp, H. sapiens
ccctgtctgcagatga

SEQ ID NO: 78826 - DNA, 16 bp, H. sapiens
ccctgtcttcttctga

SEQ ID NO: 78827 - DNA, 16 bp, H. sapiens
ccctgtcttgtggcag

SEQ ID NO: 78828 - DNA, 16 bp, H. sapiens
ccctgtctttgttcag

SEQ ID NO: 78829 - DNA, 16 bp, H. sapiens
ccctgtgacccctccc

SEQ ID NO: 78830 - DNA, 16 bp, H. sapiens
ccctgtgaggtgggca

SEQ ID NO: 78831 - DNA, 16 bp, H. sapiens
ccctgtgatcccagca

SEQ ID NO: 78832 - DNA, 16 bp, H. sapiens
ccctgtgattccatct

SEQ ID NO: 78833 - DNA, 16 bp, H. sapiens
ccctgtgcaaactggt

SEQ ID NO: 78834 - DNA, 16 bp, H. sapiens
ccctgtgcaggcctag

SEQ ID NO: 78835 - DNA, 16 bp, H. sapiens
ccctgtgccaggcact

SEQ ID NO: 78836 - DNA, 16 bp, H. sapiens
ccctgtgcccactccc

SEQ ID NO: 78837 - DNA, 16 bp, H. sapiens
ccctgtgctccagcct

SEQ ID NO: 78838 - DNA, 16 bp, H. sapiens
ccctgtgctctctgaa

SEQ ID NO: 78839 - DNA, 16 bp, H. sapiens
ccctgtgctgcccagg

SEQ ID NO: 78840 - DNA, 16 bp, H. sapiens
ccctgtgctgggcact

SEQ ID NO: 78841 - DNA, 16 bp, H. sapiens
ccctgtggccaccagc

SEQ ID NO: 78842 - DNA, 16 bp, H. sapiens
ccctgtgggaggtgat

SEQ ID NO: 78843 - DNA, 16 bp, H. sapiens
ccctgtggttctgcag

SEQ ID NO: 78844 - DNA, 16 bp, H. sapiens
ccctgtgtatctcttc

SEQ ID NO: 78845 - DNA, 16 bp, H. sapiens
ccctgtgtcacccagg

SEQ ID NO: 78846 - DNA, 16 bp, H. sapiens
ccctgtgtcccagccg

SEQ ID NO: 78847 - DNA, 16 bp, H. sapiens
ccctgtgtctcagctg

SEQ ID NO: 78848 - DNA, 16 bp, H. sapiens
ccctgtgtgccaggca

SEQ ID NO: 78849 - DNA, 16 bp, H. sapiens
ccctgtgtgtgtgtgt

SEQ ID NO: 78850 - DNA, 16 bp, H. sapiens
ccctgttccaggccct

SEQ ID NO: 78851 - DNA, 16 bp, H. sapiens
ccctgttggagggtct

SEQ ID NO: 78852 - DNA, 16 bp, H. sapiens
ccctgttgttaagtga

SEQ ID NO: 78853 - DNA, 16 bp, H. sapiens
ccctgtttgcctgtgt

SEQ ID NO: 78854 - DNA, 16 bp, H. sapiens
ccctgttttattttct

SEQ ID NO: 78855 - DNA, 16 bp, H. sapiens
ccctgttttcctgggt

SEQ ID NO: 78856 - DNA, 16 bp, H. sapiens
cccttaaaaaccccag

SEQ ID NO: 78857 - DNA, 16 bp, H. sapiens
cccttacatttatggt

SEQ ID NO: 78858 - DNA, 16 bp, H. sapiens
cccttaccagaagcag

SEQ ID NO: 78859 - DNA, 16 bp, H. sapiens
cccttagcattttttc

SEQ ID NO: 78860 - DNA, 16 bp, H. sapiens
cccttataatcctttt

SEQ ID NO: 78861 - DNA, 16 bp, H. sapiens
cccttatctctcacca

SEQ ID NO: 78862 - DNA, 16 bp, H. sapiens
cccttatcttaaccca

SEQ ID NO: 78863 - DNA, 16 bp, H. sapiens
cccttcacagaatcta

SEQ ID NO: 78864 - DNA, 16 bp, H. sapiens
cccttcacttatgaag

SEQ ID NO: 78865 - DNA, 16 bp, H. sapiens
cccttcactttctgcc

SEQ ID NO: 78866 - DNA, 16 bp, H. sapiens
cccttcaggacaggat

SEQ ID NO: 78867 - DNA, 17 bp, H. sapiens
cccttcatgctaaaaat

SEQ ID NO: 78868 - DNA, 16 bp, H. sapiens
cccttcatgctaaaca

SEQ ID NO: 78869 - DNA, 16 bp, H. sapiens
cccttcatggccttcc

SEQ ID NO: 78870 - DNA, 16 bp, H. sapiens
cccttcatttcaacct

SEQ ID NO: 78871 - DNA, 16 bp, H. sapiens
cccttccacagtgtgg

SEQ ID NO: 78872 - DNA, 16 bp, H. sapiens
cccttcccaaaactaa

SEQ ID NO: 78873 - DNA, 16 bp, H. sapiens
cccttcccacatgcct

SEQ ID NO: 78874 - DNA, 16 bp, H. sapiens
cccttcccagcacttc

SEQ ID NO: 78875 - DNA, 16 bp, H. sapiens
cccttcccagcatctg

SEQ ID NO: 78876 - DNA, 16 bp, H. sapiens
cccttcccagctgctg

SEQ ID NO: 78877 - DNA, 16 bp, H. sapiens
cccttccccagcccag

SEQ ID NO: 78878 - DNA, 16 bp, H. sapiens
cccttccccagcctcg

SEQ ID NO: 78879 - DNA, 16 bp, H. sapiens
cccttcccccaagtcc

SEQ ID NO: 78880 - DNA, 16 bp, H. sapiens
cccttcccctctccag

SEQ ID NO: 78881 - DNA, 16 bp, H. sapiens
cccttcccctgagccc

SEQ ID NO: 78882 - DNA, 16 bp, H. sapiens
cccttcccctgcagca

SEQ ID NO: 78883 - DNA, 16 bp, H. sapiens
cccttcccctgcccag

SEQ ID NO: 78884 - DNA, 16 bp, H. sapiens
cccttccctgcctcca

SEQ ID NO: 78885 - DNA, 16 bp, H. sapiens
cccttccctgtctcac

SEQ ID NO: 78886 - DNA, 16 bp, H. sapiens
cccttccctgtgtcca

SEQ ID NO: 78887 - DNA, 16 bp, H. sapiens
cccttcctcactgccc

SEQ ID NO: 78888 - DNA, 16 bp, H. sapiens
cccttcctccccaggc

SEQ ID NO: 78889 - DNA, 16 bp, H. sapiens
cccttcctccctccag

SEQ ID NO: 78890 - DNA, 16 bp, H. sapiens
cccttcctctgtccat

SEQ ID NO: 78891 - DNA, 16 bp, H. sapiens
cccttcctggctgtgt

SEQ ID NO: 78892 - DNA, 16 bp, H. sapiens
cccttcctgtctccat

SEQ ID NO: 78893 - DNA, 16 bp, H. sapiens
cccttcctgtctctgt

SEQ ID NO: 78894 - DNA, 16 bp, H. sapiens
cccttcctgtgtccaa

SEQ ID NO: 78895 - DNA, 26 bp, H. sapiens
cccttccttacaccttatacaaaaat

SEQ ID NO: 78896 - DNA, 16 bp, H. sapiens
cccttcctttaaaaaa

SEQ ID NO: 78897 - DNA, 16 bp, H. sapiens
cccttctacagaagta

SEQ ID NO: 78898 - DNA, 16 bp, H. sapiens
cccttctcagatgggg

SEQ ID NO: 78899 - DNA, 16 bp, H. sapiens
cccttctcagcctccc

SEQ ID NO: 78900 - DNA, 16 bp, H. sapiens
cccttctcagcctctg

SEQ ID NO: 78901 - DNA, 16 bp, H. sapiens
cccttctccacaaaaa

SEQ ID NO: 78902 - DNA, 16 bp, H. sapiens
cccttctccactaaaa

SEQ ID NO: 78903 - DNA, 16 bp, H. sapiens
cccttctcctccaaag

SEQ ID NO: 78904 - DNA, 16 bp, H. sapiens
cccttctcctcccagc

SEQ ID NO: 78905 - DNA, 16 bp, H. sapiens
cccttctcttcccagc

SEQ ID NO: 78906 - DNA, 16 bp, H. sapiens
cccttctgccatgtga

SEQ ID NO: 78907 - DNA, 16 bp, H. sapiens
cccttctggcccagag

SEQ ID NO: 78908 - DNA, 16 bp, H. sapiens
cccttctgggatgaag

SEQ ID NO: 78909 - DNA, 16 bp, H. sapiens
cccttcttccctgaag

SEQ ID NO: 78910 - DNA, 16 bp, H. sapiens
cccttctttaaaaaaa

SEQ ID NO: 78911 - DNA, 16 bp, H. sapiens
cccttctttgtcattt

SEQ ID NO: 78912 - DNA, 16 bp, H. sapiens
cccttgagaactggaa

SEQ ID NO: 78913 - DNA, 16 bp, H. sapiens
cccttgagcccagaag

SEQ ID NO: 78914 - DNA, 16 bp, H. sapiens
cccttgaggaatcacc

SEQ ID NO: 78915 - DNA, 16 bp, H. sapiens
cccttgcacttcctgg

SEQ ID NO: 78916 - DNA, 16 bp, H. sapiens
cccttgccatgtgatg

SEQ ID NO: 78917 - DNA, 16 bp, H. sapiens
cccttgcctcagcctc

SEQ ID NO: 78918 - DNA, 16 bp, H. sapiens
cccttgccttctgcca

SEQ ID NO: 78919 - DNA, 16 bp, H. sapiens
cccttgccttgtgatc

SEQ ID NO: 78920 - DNA, 17 bp, H. sapiens
cccttgcgcttcccgag

SEQ ID NO: 78921 - DNA, 16 bp, H. sapiens
cccttgctggcaagga

SEQ ID NO: 78922 - DNA, 16 bp, H. sapiens
cccttgctgtgcagaa

SEQ ID NO: 78923 - DNA, 16 bp, H. sapiens
cccttgctgttttcat

SEQ ID NO: 78924 - DNA, 16 bp, H. sapiens
cccttggaattttctg

SEQ ID NO: 78925 - DNA, 16 bp, H. sapiens
cccttggctaggaagg

SEQ ID NO: 78926 - DNA, 16 bp, H. sapiens
cccttggctgccccag

SEQ ID NO: 78927 - DNA, 16 bp, H. sapiens
cccttgggcccaggag

SEQ ID NO: 78928 - DNA, 16 bp, H. sapiens
cccttgggcttcccag

SEQ ID NO: 78929 - DNA, 16 bp, H. sapiens
cccttggggtctggat

SEQ ID NO: 78930 - DNA, 16 bp, H. sapiens
cccttggtgctgtcat

SEQ ID NO: 78931 - DNA, 16 bp, H. sapiens
cccttgttaaaaaatt

SEQ ID NO: 78932 - DNA, 16 bp, H. sapiens
cccttgttaaaaatca

SEQ ID NO: 78933 - DNA, 16 bp, H. sapiens
ccctttaaaaaatcaa

SEQ ID NO: 78934 - DNA, 16 bp, H. sapiens
ccctttaaagaaaaag

SEQ ID NO: 78935 - DNA, 16 bp, H. sapiens
ccctttaaatatgtca

SEQ ID NO: 78936 - DNA, 16 bp, H. sapiens
ccctttagcatttctt

SEQ ID NO: 78937 - DNA, 16 bp, H. sapiens
ccctttatacttggct

SEQ ID NO: 78938 - DNA, 16 bp, H. sapiens
ccctttatggaaaaag

SEQ ID NO: 78939 - DNA, 16 bp, H. sapiens
ccctttcaagccttat

SEQ ID NO: 78940 - DNA, 16 bp, H. sapiens
ccctttccacaggcag

SEQ ID NO: 78941 - DNA, 16 bp, H. sapiens
ccctttccagcctctg

SEQ ID NO: 78942 - DNA, 16 bp, H. sapiens
ccctttcccagtctgc

SEQ ID NO: 78943 - DNA, 16 bp, H. sapiens
ccctttcccggtctgc

SEQ ID NO: 78944 - DNA, 16 bp, H. sapiens
ccctttcctgccccac

SEQ ID NO: 78945 - DNA, 16 bp, H. sapiens
ccctttcctggccctg

SEQ ID NO: 78946 - DNA, 16 bp, H. sapiens
ccctttctctaaaaaa

SEQ ID NO: 78947 - DNA, 16 bp, H. sapiens
ccctttctctaccaaa

SEQ ID NO: 78948 - DNA, 16 bp, H. sapiens
ccctttctcttaaaaa

SEQ ID NO: 78949 - DNA, 16 bp, H. sapiens
ccctttctgcccagga

SEQ ID NO: 78950 - DNA, 16 bp, H. sapiens
ccctttgtcgcccagg

SEQ ID NO: 78951 - DNA, 16 bp, H. sapiens
ccctttgttcagtcca

SEQ ID NO: 78952 - DNA, 16 bp, H. sapiens
cccttttaaatataag

SEQ ID NO: 78953 - DNA, 16 bp, H. sapiens
cccttttctgggctgg

SEQ ID NO: 78954 - DNA, 16 bp, H. sapiens
cccttttcttaaaaaa

SEQ ID NO: 78955 - DNA, 16 bp, H. sapiens
cccttttgatcaagat

SEQ ID NO: 78956 - DNA, 16 bp, H. sapiens
cccttttgtcaatttt

SEQ ID NO: 78957 - DNA, 16 bp, H. sapiens
ccctttttgcagatga

SEQ ID NO: 78958 - DNA, 16 bp, H. sapiens
cccttttttttgagac

SEQ ID NO: 78959 - DNA, 16 bp, H. sapiens
ccgaaacctctgcctc

SEQ ID NO: 78960 - DNA, 16 bp, H. sapiens
ccgaaatgctgagatt

SEQ ID NO: 78961 - DNA, 16 bp, H. sapiens
ccgaacaatgagaaca

SEQ ID NO: 78962 - DNA, 16 bp, H. sapiens
ccgaatagaccaataa

SEQ ID NO: 78963 - DNA, 16 bp, H. sapiens
ccgaatagccaaggca

SEQ ID NO: 78964 - DNA, 23 bp, H. sapiens
ccgaccaacatggtgaaacccca

SEQ ID NO: 78965 - DNA, 16 bp, H. sapiens
ccgaccccacagcagt

SEQ ID NO: 78966 - DNA, 16 bp, H. sapiens
ccgacgagcgccaccc

SEQ ID NO: 78967 - DNA, 16 bp, H. sapiens
ccgactcctgcctgtc

SEQ ID NO: 78968 - DNA, 16 bp, H. sapiens
ccgagaccacagccac

SEQ ID NO: 78969 - DNA, 17 bp, H. sapiens
ccgagagcaagcgaggg

SEQ ID NO: 78970 - DNA, 16 bp, H. sapiens
ccgagatgggagaatc

SEQ ID NO: 78971 - DNA, 16 bp, H. sapiens
ccgagcctcagtttcc

SEQ ID NO: 78972 - DNA, 16 bp, H. sapiens
ccgaggaaggaggatc

SEQ ID NO: 78973 - DNA, 16 bp, H. sapiens
ccgaggaatggtgcca

SEQ ID NO: 78974 - DNA, 16 bp, H. sapiens
ccgaggagctggaatt

SEQ ID NO: 78975 - DNA, 17 bp, H. sapiens
ccgaggcagacggatca

SEQ ID NO: 78976 - DNA, 16 bp, H. sapiens
ccgaggcaggaggatt

SEQ ID NO: 78977 - DNA, 22 bp, H. sapiens
ccgaggcaggcagatcatctga

SEQ ID NO: 78978 - DNA, 26 bp, H. sapiens
ccgaggcaggcggatcacaaggtcaa

SEQ ID NO: 78979 - DNA, 16 bp, H. sapiens
ccgaggcagtcagatc

SEQ ID NO: 78980 - DNA, 17 bp, H. sapiens
ccgaggcatgcggatca

SEQ ID NO: 78981 - DNA, 16 bp, H. sapiens
ccgaggccgaggaggc

SEQ ID NO: 78982 - DNA, 16 bp, H. sapiens
ccgaggcctccccagc

SEQ ID NO: 78983 - DNA, 16 bp, H. sapiens
ccgaggctgaggaggc

SEQ ID NO: 78984 - DNA, 16 bp, H. sapiens
ccgaggctgaggcagg

SEQ ID NO: 78985 - DNA, 16 bp, H. sapiens
ccgaggctgggggatc

SEQ ID NO: 78986 - DNA, 16 bp, H. sapiens
ccgagggaggcggatc

SEQ ID NO: 78987 - DNA, 16 bp, H. sapiens
ccgaggtgggagggtt

SEQ ID NO: 78988 - DNA, 17 bp, H. sapiens
ccgagtagccgggatta

SEQ ID NO: 78989 - DNA, 16 bp, H. sapiens
ccgagtagctgaaatt

SEQ ID NO: 78990 - DNA, 16 bp, H. sapiens
ccgagtcttgctctgt

SEQ ID NO: 78991 - DNA, 16 bp, H. sapiens
ccgagtgtggtggtgg

SEQ ID NO: 78992 - DNA, 16 bp, H. sapiens
ccgagtgtggtggtgt

SEQ ID NO: 78993 - DNA, 16 bp, H. sapiens
ccgagttcaagtgatt

SEQ ID NO: 78994 - DNA, 16 bp, H. sapiens
ccgataagttaaagat

SEQ ID NO: 78995 - DNA, 16 bp, H. sapiens
ccgattttcaaaggga

SEQ ID NO: 78996 - DNA, 17 bp, H. sapiens
ccgcaaatgctgctgcc

SEQ ID NO: 78997 - DNA, 16 bp, H. sapiens
ccgcaacctcctcctc

SEQ ID NO: 78998 - DNA, 16 bp, H. sapiens
ccgcaattacttttgc

SEQ ID NO: 78999 - DNA, 16 bp, H. sapiens
ccgcaccaccatgccc

SEQ ID NO: 79000 - DNA, 16 bp, H. sapiens
ccgcacccagccaaga

SEQ ID NO: 79001 - DNA, 16 bp, H. sapiens
ccgcacccagccatgg

SEQ ID NO: 79002 - DNA, 16 bp, H. sapiens
ccgcacccagcccaga

SEQ ID NO: 79003 - DNA, 16 bp, H. sapiens
ccgcacccagcctgcc

SEQ ID NO: 79004 - DNA, 16 bp, H. sapiens
ccgcacccagcctgtt

SEQ ID NO: 79005 - DNA, 16 bp, H. sapiens
ccgcacctggccaagg

SEQ ID NO: 79006 - DNA, 16 bp, H. sapiens
ccgcacctggcctatg

SEQ ID NO: 79007 - DNA, 16 bp, H. sapiens
ccgcacctggcctcca

SEQ ID NO: 79008 - DNA, 16 bp, H. sapiens
ccgcactccagactgg

SEQ ID NO: 79009 - DNA, 16 bp, H. sapiens
ccgcactccagcctgg

SEQ ID NO: 79010 - DNA, 16 bp, H. sapiens
ccgcactcggagcggc

SEQ ID NO: 79011 - DNA, 16 bp, H. sapiens
ccgcactttgggaggc

SEQ ID NO: 79012 - DNA, 16 bp, H. sapiens
ccgcagacactcaatg

SEQ ID NO: 79013 - DNA, 16 bp, H. sapiens
ccgcagcccaggattc

SEQ ID NO: 79014 - DNA, 16 bp, H. sapiens
ccgcagcctcccaaag

SEQ ID NO: 79015 - DNA, 16 bp, H. sapiens
ccgcagcctctgcctc

SEQ ID NO: 79016 - DNA, 16 bp, H. sapiens
ccgcagcggccaggcg

SEQ ID NO: 79017 - DNA, 16 bp, H. sapiens
ccgcagctgccagggg

SEQ ID NO: 79018 - DNA, 17 bp, H. sapiens
ccgcagtctggcctggg

SEQ ID NO: 79019 - DNA, 16 bp, H. sapiens
ccgcatacctacaact

SEQ ID NO: 79020 - DNA, 16 bp, H. sapiens
ccgccacactccagcc

SEQ ID NO: 79021 - DNA, 16 bp, H. sapiens
ccgccaccacaccagg

SEQ ID NO: 79022 - DNA, 16 bp, H. sapiens
ccgccaccacacctga

SEQ ID NO: 79023 - DNA, 16 bp, H. sapiens
ccgccaccacatccag

SEQ ID NO: 79024 - DNA, 16 bp, H. sapiens
ccgccaccacgcctgg

SEQ ID NO: 79025 - DNA, 16 bp, H. sapiens
ccgccaccacggctgg

SEQ ID NO: 79026 - DNA, 16 bp, H. sapiens
ccgccaccatgtctgg

SEQ ID NO: 79027 - DNA, 16 bp, H. sapiens
ccgccagcctcggcct

SEQ ID NO: 79028 - DNA, 16 bp, H. sapiens
ccgccatgcccggcct

SEQ ID NO: 79029 - DNA, 16 bp, H. sapiens
ccgccatgggctcctg

SEQ ID NO: 79030 - DNA, 17 bp, H. sapiens
ccgccattgccgaggct

SEQ ID NO: 79031 - DNA, 16 bp, H. sapiens
ccgcccacctcaacct

SEQ ID NO: 79032 - DNA, 17 bp, H. sapiens
ccgcccacctcagcctg

SEQ ID NO: 79033 - DNA, 16 bp, H. sapiens
ccgcccacctgggcct

SEQ ID NO: 79034 - DNA, 16 bp, H. sapiens
ccgcccagcagctgcc

SEQ ID NO: 79035 - DNA, 16 bp, H. sapiens
ccgccccccgggttca

SEQ ID NO: 79036 - DNA, 16 bp, H. sapiens
ccgcccgcctttgcct

SEQ ID NO: 79037 - DNA, 16 bp, H. sapiens
ccgccctcctcagcct

SEQ ID NO: 79038 - DNA, 16 bp, H. sapiens
ccgccctcctgggcct

SEQ ID NO: 79039 - DNA, 16 bp, H. sapiens
ccgccctgtgtccatg

SEQ ID NO: 79040 - DNA, 16 bp, H. sapiens
ccgccgcctcagcctc

SEQ ID NO: 79041 - DNA, 16 bp, H. sapiens
ccgccgggcgcagtgg

SEQ ID NO: 79042 - DNA, 16 bp, H. sapiens
ccgcctcaagaaaaaa

SEQ ID NO: 79043 - DNA, 16 bp, H. sapiens
ccgcctcaccctcctg

SEQ ID NO: 79044 - DNA, 16 bp, H. sapiens
ccgcctcagcatcctg

SEQ ID NO: 79045 - DNA, 16 bp, H. sapiens
ccgcctcagcctgctg

SEQ ID NO: 79046 - DNA, 16 bp, H. sapiens
ccgcctcatcctccca

SEQ ID NO: 79047 - DNA, 16 bp, H. sapiens
ccgcctccatctccca

SEQ ID NO: 79048 - DNA, 16 bp, H. sapiens
ccgcctcccaggctga

SEQ ID NO: 79049 - DNA, 16 bp, H. sapiens
ccgcctcccgggctga

SEQ ID NO: 79050 - DNA, 16 bp, H. sapiens
ccgcctcccgtgttca

SEQ ID NO: 79051 - DNA, 16 bp, H. sapiens
ccgcctcctccagcct

SEQ ID NO: 79052 - DNA, 16 bp, H. sapiens
ccgcctcctggactca

SEQ ID NO: 79053 - DNA, 17 bp, H. sapiens
ccgcctcctgggctcag

SEQ ID NO: 79054 - DNA, 17 bp, H. sapiens
ccgcctcggcctcccac

SEQ ID NO: 79055 - DNA, 17 bp, H. sapiens
ccgcctcggcctcccag

SEQ ID NO: 79056 - DNA, 16 bp, H. sapiens
ccgcctcggcctcctg

SEQ ID NO: 79057 - DNA, 16 bp, H. sapiens
ccgcctcggtttccca

SEQ ID NO: 79058 - DNA, 16 bp, H. sapiens
ccgcctgagcctcctg

SEQ ID NO: 79059 - DNA, 16 bp, H. sapiens
ccgcctggcagccgcc

SEQ ID NO: 79060 - DNA, 16 bp, H. sapiens
ccgcctgtggtcccag

SEQ ID NO: 79061 - DNA, 16 bp, H. sapiens
ccgccttcgcctccca

SEQ ID NO: 79062 - DNA, 16 bp, H. sapiens
ccgccttggccttgca

SEQ ID NO: 79063 - DNA, 16 bp, H. sapiens
ccgccttggtctccca

SEQ ID NO: 79064 - DNA, 17 bp, H. sapiens
ccgcgcatggtggctca

SEQ ID NO: 79065 - DNA, 16 bp, H. sapiens
ccgcgcccacccggaa

SEQ ID NO: 79066 - DNA, 16 bp, H. sapiens
ccgcgcccagccagtg

SEQ ID NO: 79067 - DNA, 16 bp, H. sapiens
ccgcgcccagcccctg

SEQ ID NO: 79068 - DNA, 16 bp, H. sapiens
ccgcgcccagcctaca

SEQ ID NO: 79069 - DNA, 16 bp, H. sapiens
ccgcgcccagcctctc

SEQ ID NO: 79070 - DNA, 16 bp, H. sapiens
ccgcgcccagcctttg

SEQ ID NO: 79071 - DNA, 16 bp, H. sapiens
ccgcgcccggccagtg

SEQ ID NO: 79072 - DNA, 16 bp, H. sapiens
ccgcgcccggcctctt

SEQ ID NO: 79073 - DNA, 16 bp, H. sapiens
ccgcgcccggccttgg

SEQ ID NO: 79074 - DNA, 16 bp, H. sapiens
ccgcgcctggccagcc

SEQ ID NO: 79075 - DNA, 16 bp, H. sapiens
ccgcgcctggcccaac

SEQ ID NO: 79076 - DNA, 16 bp, H. sapiens
ccgcgcctggcccagc

SEQ ID NO: 79077 - DNA, 16 bp, H. sapiens
ccgcgcctggccctgg

SEQ ID NO: 79078 - DNA, 16 bp, H. sapiens
ccgcgcctggcctacc

SEQ ID NO: 79079 - DNA, 16 bp, H. sapiens
ccgcgcctggcctgct

SEQ ID NO: 79080 - DNA, 16 bp, H. sapiens
ccgcgcctggcctggc

SEQ ID NO: 79081 - DNA, 16 bp, H. sapiens
ccgcgcctggctggaa

SEQ ID NO: 79082 - DNA, 16 bp, H. sapiens
ccgctacttgggaggc

SEQ ID NO: 79083 - DNA, 16 bp, H. sapiens
ccgctcactctttggg

SEQ ID NO: 79084 - DNA, 16 bp, H. sapiens
ccgctgcacctggcct

SEQ ID NO: 79085 - DNA, 16 bp, H. sapiens
ccgctgcactccaacc

SEQ ID NO: 79086 - DNA, 16 bp, H. sapiens
ccgctgccacgcccag

SEQ ID NO: 79087 - DNA, 16 bp, H. sapiens
ccgctggcctcagcct

SEQ ID NO: 79088 - DNA, 16 bp, H. sapiens
ccgctgtgcctggcct

SEQ ID NO: 79089 - DNA, 16 bp, H. sapiens
ccgctgtgctctcagg

SEQ ID NO: 79090 - DNA, 16 bp, H. sapiens
ccgcttcagcctcccg

SEQ ID NO: 79091 - DNA, 16 bp, H. sapiens
ccgcttggtgcagagc

SEQ ID NO: 79092 - DNA, 16 bp, H. sapiens
ccggaactcacgctgg

SEQ ID NO: 79093 - DNA, 16 bp, H. sapiens
ccggacgaggtggctg

SEQ ID NO: 79094 - DNA, 16 bp, H. sapiens
ccggacggggaggctg

SEQ ID NO: 79095 - DNA, 16 bp, H. sapiens
ccggactggagtgcag

SEQ ID NO: 79096 - DNA, 16 bp, H. sapiens
ccggagcctgaggcag

SEQ ID NO: 79097 - DNA, 16 bp, H. sapiens
ccggagctcaggagtt

SEQ ID NO: 79098 - DNA, 16 bp, H. sapiens
ccggaggcggaggcag

SEQ ID NO: 79099 - DNA, 16 bp, H. sapiens
ccggcaccttgatctt

SEQ ID NO: 79100 - DNA, 16 bp, H. sapiens
ccggcactttgggagt

SEQ ID NO: 79101 - DNA, 16 bp, H. sapiens
ccggcagaggggctcc

SEQ ID NO: 79102 - DNA, 16 bp, H. sapiens
ccggcagggctggccg

SEQ ID NO: 79103 - DNA, 16 bp, H. sapiens
ccggcatggtggctca

SEQ ID NO: 79104 - DNA, 16 bp, H. sapiens
ccggccacctcggcct

SEQ ID NO: 79105 - DNA, 17 bp, H. sapiens
ccggccccgggcaatga

SEQ ID NO: 79106 - DNA, 16 bp, H. sapiens
ccggccctgccagccc

SEQ ID NO: 79107 - DNA, 16 bp, H. sapiens
ccggccgcccatcgtc

SEQ ID NO: 79108 - DNA, 16 bp, H. sapiens
ccggcctattattttt

SEQ ID NO: 79109 - DNA, 16 bp, H. sapiens
ccggcctcagcctctc

SEQ ID NO: 79110 - DNA, 16 bp, H. sapiens
ccggcctcagtctccc

SEQ ID NO: 79111 - DNA, 16 bp, H. sapiens
ccggcctgggccacag

SEQ ID NO: 79112 - DNA, 27 bp, H. sapiens
ccggcgatctgtctgaggtttcttcct

SEQ ID NO: 79113 - DNA, 16 bp, H. sapiens
ccggcgtggtggcaca

SEQ ID NO: 79114 - DNA, 16 bp, H. sapiens
ccggctaacttttgta

SEQ ID NO: 79115 - DNA, 16 bp, H. sapiens
ccggctcagcctccca

SEQ ID NO: 79116 - DNA, 17 bp, H. sapiens
ccggctccggccttggc

SEQ ID NO: 79117 - DNA, 16 bp, H. sapiens
ccggctctacaaaaaa

SEQ ID NO: 79118 - DNA, 16 bp, H. sapiens
ccggctgatttttgtg

SEQ ID NO: 79119 - DNA, 21 bp, H. sapiens
ccggctgggcacagtggctca

SEQ ID NO: 79120 - DNA, 16 bp, H. sapiens
ccggctgggcttctgg

SEQ ID NO: 79121 - DNA, 16 bp, H. sapiens
ccgggagctggaggtt

SEQ ID NO: 79122 - DNA, 16 bp, H. sapiens
ccgggaggcagagctt

SEQ ID NO: 79123 - DNA, 16 bp, H. sapiens
ccgggaggcagggctt

SEQ ID NO: 79124 - DNA, 16 bp, H. sapiens
ccgggaggccgaggtt

SEQ ID NO: 79125 - DNA, 16 bp, H. sapiens
ccgggaggcggatgtt

SEQ ID NO: 79126 - DNA, 16 bp, H. sapiens
ccgggagttcaaggct

SEQ ID NO: 79127 - DNA, 16 bp, H. sapiens
ccgggatcaagtgatt

SEQ ID NO: 79128 - DNA, 16 bp, H. sapiens
ccgggcacagaaagac

SEQ ID NO: 79129 - DNA, 16 bp, H. sapiens
ccgggcacgctggctc

SEQ ID NO: 79130 - DNA, 16 bp, H. sapiens
ccgggcactgtggctc

SEQ ID NO: 79131 - DNA, 16 bp, H. sapiens
ccgggcagaggagccc

SEQ ID NO: 79132 - DNA, 16 bp, H. sapiens
ccgggcagaggcgctt

SEQ ID NO: 79133 - DNA, 16 bp, H. sapiens
ccgggcaggggctgcc

SEQ ID NO: 79134 - DNA, 16 bp, H. sapiens
ccgggcatggtggctg

SEQ ID NO: 79135 - DNA, 16 bp, H. sapiens
ccgggccaggaacaat

SEQ ID NO: 79136 - DNA, 16 bp, H. sapiens
ccgggcccagctcttc

SEQ ID NO: 79137 - DNA, 16 bp, H. sapiens
ccgggccctgtggctc

SEQ ID NO: 79138 - DNA, 16 bp, H. sapiens
ccgggcctcagtttcc

SEQ ID NO: 79139 - DNA, 16 bp, H. sapiens
ccgggcctggtggcac

SEQ ID NO: 79140 - DNA, 17 bp, H. sapiens
ccgggccttagctgcct

SEQ ID NO: 79141 - DNA, 17 bp, H. sapiens
ccgggcgcaatggctca

SEQ ID NO: 79142 - DNA, 16 bp, H. sapiens
ccgggcgcagtggctg

SEQ ID NO: 79143 - DNA, 17 bp, H. sapiens
ccgggcgcggtggctcc

SEQ ID NO: 79144 - DNA, 16 bp, H. sapiens
ccgggcgtgctggcag

SEQ ID NO: 79145 - DNA, 16 bp, H. sapiens
ccgggcgtgctggtgg

SEQ ID NO: 79146 - DNA, 16 bp, H. sapiens
ccggggacagtggctc

SEQ ID NO: 79147 - DNA, 16 bp, H. sapiens
ccggggagacggaggt

SEQ ID NO: 79148 - DNA, 16 bp, H. sapiens
ccggggaggtggaagt

SEQ ID NO: 79149 - DNA, 16 bp, H. sapiens
ccggggaggttgaggc

SEQ ID NO: 79150 - DNA, 16 bp, H. sapiens
ccggggcctgttgggg

SEQ ID NO: 79151 - DNA, 16 bp, H. sapiens
ccggggctcacgcctg

SEQ ID NO: 79152 - DNA, 16 bp, H. sapiens
ccggggctcaggtgat

SEQ ID NO: 79153 - DNA, 17 bp, H. sapiens
ccggggctgcaggtgga

SEQ ID NO: 79154 - DNA, 16 bp, H. sapiens
ccggggggcggagcct

SEQ ID NO: 79155 - DNA, 17 bp, H. sapiens
ccggggggcggagcctg

SEQ ID NO: 79156 - DNA, 16 bp, H. sapiens
ccggggtgcagtggct

SEQ ID NO: 79157 - DNA, 16 bp, H. sapiens
ccggggtttcaccatg

SEQ ID NO: 79158 - DNA, 16 bp, H. sapiens
ccgggtctcactatgt

SEQ ID NO: 79159 - DNA, 16 bp, H. sapiens
ccgggtgcaagtgatt

SEQ ID NO: 79160 - DNA, 16 bp, H. sapiens
ccgggtgcggtggctc

SEQ ID NO: 79161 - DNA, 16 bp, H. sapiens
ccgggtgtggcagtgt

SEQ ID NO: 79162 - DNA, 16 bp, H. sapiens
ccgggtgtggcggcag

SEQ ID NO: 79163 - DNA, 19 bp, H. sapiens
ccgggtgtggtggcaggca

SEQ ID NO: 79164 - DNA, 16 bp, H. sapiens
ccgggtgtggtggctt

SEQ ID NO: 79165 - DNA, 16 bp, H. sapiens
ccgggtgtgtctgtga

SEQ ID NO: 79166 - DNA, 16 bp, H. sapiens
ccggtaattccagcac

SEQ ID NO: 79167 - DNA, 16 bp, H. sapiens
ccggtccccagagaag

SEQ ID NO: 79168 - DNA, 16 bp, H. sapiens
ccggtggatcatctga

SEQ ID NO: 79169 - DNA, 16 bp, H. sapiens
ccggtggctcacgcct

SEQ ID NO: 79170 - DNA, 16 bp, H. sapiens
ccggtgggaggtgatt

SEQ ID NO: 79171 - DNA, 16 bp, H. sapiens
ccggtgggttcctggt

SEQ ID NO: 79172 - DNA, 16 bp, H. sapiens
ccggtgtctgaggagt

SEQ ID NO: 79173 - DNA, 16 bp, H. sapiens
ccggttgttcttttcc

SEQ ID NO: 79174 - DNA, 17 bp, H. sapiens
ccgtaatcccagctacc

SEQ ID NO: 79175 - DNA, 16 bp, H. sapiens
ccgtagttccagctac

SEQ ID NO: 79176 - DNA, 16 bp, H. sapiens
ccgtccctatcactgg

SEQ ID NO: 79177 - DNA, 17 bp, H. sapiens
ccgtccgtctcggcctc

SEQ ID NO: 79178 - DNA, 16 bp, H. sapiens
ccgtcctggccaacat

SEQ ID NO: 79179 - DNA, 16 bp, H. sapiens
ccgtctcaaaaaaacc

SEQ ID NO: 79180 - DNA, 16 bp, H. sapiens
ccgtctctaaaaaata

SEQ ID NO: 79181 - DNA, 16 bp, H. sapiens
ccgtctctaaaataaa

SEQ ID NO: 79182 - DNA, 16 bp, H. sapiens
ccgtctctaccaaaac

SEQ ID NO: 79183 - DNA, 16 bp, H. sapiens
ccgtctctaccgaaaa

SEQ ID NO: 79184 - DNA, 16 bp, H. sapiens
ccgtcttactaaaaat

SEQ ID NO: 79185 - DNA, 16 bp, H. sapiens
ccgtgaactcctgggc

SEQ ID NO: 79186 - DNA, 16 bp, H. sapiens
ccgtgaggccaagaac

SEQ ID NO: 79187 - DNA, 16 bp, H. sapiens
ccgtgccaccacacct

SEQ ID NO: 79188 - DNA, 16 bp, H. sapiens
ccgtgcccagccagca

SEQ ID NO: 79189 - DNA, 16 bp, H. sapiens
ccgtgcccagcccaaa

SEQ ID NO: 79190 - DNA, 16 bp, H. sapiens
ccgtgcccagcccacc

SEQ ID NO: 79191 - DNA, 16 bp, H. sapiens
ccgtgcccagcccctc

SEQ ID NO: 79192 - DNA, 16 bp, H. sapiens
ccgtgcccagccctgt

SEQ ID NO: 79193 - DNA, 16 bp, H. sapiens
ccgtgcccagcctctc

SEQ ID NO: 79194 - DNA, 16 bp, H. sapiens
ccgtgcccagcctgag

SEQ ID NO: 79195 - DNA, 16 bp, H. sapiens
ccgtgcccagcctgcc

SEQ ID NO: 79196 - DNA, 16 bp, H. sapiens
ccgtgcccagcctggc

SEQ ID NO: 79197 - DNA, 16 bp, H. sapiens
ccgtgcccagcctgtg

SEQ ID NO: 79198 - DNA, 16 bp, H. sapiens
ccgtgcccagctggaa

SEQ ID NO: 79199 - DNA, 16 bp, H. sapiens
ccgtgcccggccagca

SEQ ID NO: 79200 - DNA, 16 bp, H. sapiens
ccgtgcccggcctgag

SEQ ID NO: 79201 - DNA, 16 bp, H. sapiens
ccgtgcctcagcctcc

SEQ ID NO: 79202 - DNA, 16 bp, H. sapiens
ccgtgcctcagtttcc

SEQ ID NO: 79203 - DNA, 16 bp, H. sapiens
ccgtgcctggcccagg

SEQ ID NO: 79204 - DNA, 16 bp, H. sapiens
ccgtgcctggccccac

SEQ ID NO: 79205 - DNA, 16 bp, H. sapiens
ccgtgcctggccccat

SEQ ID NO: 79206 - DNA, 16 bp, H. sapiens
ccgtgcctggcctatg

SEQ ID NO: 79207 - DNA, 16 bp, H. sapiens
ccgtgcctggcctgtc

SEQ ID NO: 79208 - DNA, 16 bp, H. sapiens
ccgtgcgcgagctgaa

SEQ ID NO: 79209 - DNA, 16 bp, H. sapiens
ccgtgcgggatccact

SEQ ID NO: 79210 - DNA, 16 bp, H. sapiens
ccgtgctggagtgcag

SEQ ID NO: 79211 - DNA, 16 bp, H. sapiens
ccgtggctcacatctg

SEQ ID NO: 79212 - DNA, 16 bp, H. sapiens
ccgtggctcacgcctg

SEQ ID NO: 79213 - DNA, 16 bp, H. sapiens
ccgtggctcatgcctg

SEQ ID NO: 79214 - DNA, 17 bp, H. sapiens
ccgtgggcggcgtcctc

SEQ ID NO: 79215 - DNA, 16 bp, H. sapiens
ccgtgggggtggagcc

SEQ ID NO: 79216 - DNA, 16 bp, H. sapiens
ccgtgtgtccatgtgt

SEQ ID NO: 79217 - DNA, 16 bp, H. sapiens
ccgttctcacactgct

SEQ ID NO: 79218 - DNA, 16 bp, H. sapiens
ccgttttcacactgct

SEQ ID NO: 79219 - DNA, 16 bp, H. sapiens
ccgttttttaagcctg

SEQ ID NO: 79220 - DNA, 28 bp, H. sapiens
cctaaaaattttgagggcccatctaaaa

SEQ ID NO: 79221 - DNA, 16 bp, H. sapiens
cctaaaacaccaaaag

SEQ ID NO: 79222 - DNA, 16 bp, H. sapiens
cctaaaacatttattt

SEQ ID NO: 79223 - DNA, 16 bp, H. sapiens
cctaaaaccataaaat

SEQ ID NO: 79224 - DNA, 16 bp, H. sapiens
cctaaaacgtataaaa

SEQ ID NO: 79225 - DNA, 16 bp, H. sapiens
cctaaaactcaacaac

SEQ ID NO: 79226 - DNA, 16 bp, H. sapiens
cctaaaataaaagtta

SEQ ID NO: 79227 - DNA, 16 bp, H. sapiens
cctaaaatgtacaaaa

SEQ ID NO: 79228 - DNA, 16 bp, H. sapiens
cctaaaatgtataaaa

SEQ ID NO: 79229 - DNA, 16 bp, H. sapiens
cctaaaattcatatga

SEQ ID NO: 79230 - DNA, 16 bp, H. sapiens
cctaaaattcatatgt

SEQ ID NO: 79231 - DNA, 16 bp, H. sapiens
cctaaacccaggaggc

SEQ ID NO: 79232 - DNA, 16 bp, H. sapiens
cctaaagatttttttt

SEQ ID NO: 79233 - DNA, 16 bp, H. sapiens
cctaaagctataaaaa

SEQ ID NO: 79234 - DNA, 16 bp, H. sapiens
cctaaaggacctgcct

SEQ ID NO: 79235 - DNA, 16 bp, H. sapiens
cctaaagtcacatagc

SEQ ID NO: 79236 - DNA, 16 bp, H. sapiens
cctaaagtgtgttttc

SEQ ID NO: 79237 - DNA, 16 bp, H. sapiens
cctaaatatatatttt

SEQ ID NO: 79238 - DNA, 16 bp, H. sapiens
cctaaatatctttgtt

SEQ ID NO: 79239 - DNA, 16 bp, H. sapiens
cctaaatccagtgaca

SEQ ID NO: 79240 - DNA, 16 bp, H. sapiens
cctaaatcctataaaa

SEQ ID NO: 79241 - DNA, 16 bp, H. sapiens
cctaaatttaagagct

SEQ ID NO: 79242 - DNA, 16 bp, H. sapiens
cctaaattttcctggc

SEQ ID NO: 79243 - DNA, 16 bp, H. sapiens
cctaacacagtgaaac

SEQ ID NO: 79244 - DNA, 16 bp, H. sapiens
cctaacatagtgcctg

SEQ ID NO: 79245 - DNA, 21 bp, H. sapiens
cctaacatcacaattacaaga

SEQ ID NO: 79246 - DNA, 16 bp, H. sapiens
cctaacatggtgaaac

SEQ ID NO: 79247 - DNA, 16 bp, H. sapiens
cctaacattacaatta

SEQ ID NO: 79248 - DNA, 16 bp, H. sapiens
cctaacccccagtgcc

SEQ ID NO: 79249 - DNA, 16 bp, H. sapiens
cctaaccctaaaccct

SEQ ID NO: 79250 - DNA, 16 bp, H. sapiens
cctaactcatgttatg

SEQ ID NO: 79251 - DNA, 16 bp, H. sapiens
cctaagacaattcttc

SEQ ID NO: 79252 - DNA, 16 bp, H. sapiens
cctaagcctcagtttt

SEQ ID NO: 79253 - DNA, 16 bp, H. sapiens
cctaagctcaagagat

SEQ ID NO: 79254 - DNA, 16 bp, H. sapiens
cctaaggctgctgtaa

SEQ ID NO: 79255 - DNA, 16 bp, H. sapiens
cctaaggctgttttac

SEQ ID NO: 79256 - DNA, 16 bp, H. sapiens
cctaaggtcacccagc

SEQ ID NO: 79257 - DNA, 16 bp, H. sapiens
cctaataaaaaggagt

SEQ ID NO: 79258 - DNA, 16 bp, H. sapiens
cctaataccaaaacca

SEQ ID NO: 79259 - DNA, 16 bp, H. sapiens
cctaatataaatgaca

SEQ ID NO: 79260 - DNA, 16 bp, H. sapiens
cctaatatttttaaat

SEQ ID NO: 79261 - DNA, 16 bp, H. sapiens
cctaatcaacatggag

SEQ ID NO: 79262 - DNA, 16 bp, H. sapiens
cctaatgaacatagat

SEQ ID NO: 79263 - DNA, 16 bp, H. sapiens
cctaatgtcctttttc

SEQ ID NO: 79264 - DNA, 16 bp, H. sapiens
cctaatgttatccctc

SEQ ID NO: 79265 - DNA, 16 bp, H. sapiens
cctaattctgtgaaga

SEQ ID NO: 79266 - DNA, 16 bp, H. sapiens
cctaattttttgcatt

SEQ ID NO: 79267 - DNA, 16 bp, H. sapiens
cctacaaagccacagg

SEQ ID NO: 79268 - DNA, 16 bp, H. sapiens
cctacaagccacaaga

SEQ ID NO: 79269 - DNA, 16 bp, H. sapiens
cctacaagctagaaga

SEQ ID NO: 79270 - DNA, 16 bp, H. sapiens
cctacaatattcagta

SEQ ID NO: 79271 - DNA, 16 bp, H. sapiens
cctacaatatttacta

SEQ ID NO: 79272 - DNA, 16 bp, H. sapiens
cctacacagctgtccc

SEQ ID NO: 79273 - DNA, 16 bp, H. sapiens
cctacacattttcaaa

SEQ ID NO: 79274 - DNA, 16 bp, H. sapiens
cctacaccacaagggc

SEQ ID NO: 79275 - DNA, 16 bp, H. sapiens
cctacaccctcccaag

SEQ ID NO: 79276 - DNA, 16 bp, H. sapiens
cctacagaattggaga

SEQ ID NO: 79277 - DNA, 16 bp, H. sapiens
cctacagcagccacag

SEQ ID NO: 79278 - DNA, 16 bp, H. sapiens
cctacagctaacatta

SEQ ID NO: 79279 - DNA, 16 bp, H. sapiens
cctacaggaagccctc

SEQ ID NO: 79280 - DNA, 16 bp, H. sapiens
cctacagtattcacta

SEQ ID NO: 79281 - DNA, 16 bp, H. sapiens
cctacagtctcagcta

SEQ ID NO: 79282 - DNA, 16 bp, H. sapiens
cctacataacaaacct

SEQ ID NO: 79283 - DNA, 16 bp, H. sapiens
cctacatcaaaaaaga

SEQ ID NO: 79284 - DNA, 16 bp, H. sapiens
cctacatctttcttcc

SEQ ID NO: 79285 - DNA, 16 bp, H. sapiens
cctacattaacacatc

SEQ ID NO: 79286 - DNA, 16 bp, H. sapiens
cctacattccttggct

SEQ ID NO: 79287 - DNA, 16 bp, H. sapiens
cctacattttaccata

SEQ ID NO: 79288 - DNA, 17 bp, H. sapiens
cctaccaatatgtgatg

SEQ ID NO: 79289 - DNA, 16 bp, H. sapiens
cctaccaccaggccca

SEQ ID NO: 79290 - DNA, 16 bp, H. sapiens
cctaccaccaggtccc

SEQ ID NO: 79291 - DNA, 16 bp, H. sapiens
cctaccaccatgcccg

SEQ ID NO: 79292 - DNA, 16 bp, H. sapiens
cctaccagatgccagt

SEQ ID NO: 79293 - DNA, 16 bp, H. sapiens
cctaccagcaccatga

SEQ ID NO: 79294 - DNA, 16 bp, H. sapiens
cctaccaggccccacc

SEQ ID NO: 79295 - DNA, 16 bp, H. sapiens
cctaccaggttcaagc

SEQ ID NO: 79296 - DNA, 16 bp, H. sapiens
cctaccatgtacccac

SEQ ID NO: 79297 - DNA, 16 bp, H. sapiens
cctaccatgtgccagg

SEQ ID NO: 79298 - DNA, 16 bp, H. sapiens
cctacccacatcctgc

SEQ ID NO: 79299 - DNA, 16 bp, H. sapiens
cctaccccagcctcct

SEQ ID NO: 79300 - DNA, 16 bp, H. sapiens
cctaccctcatggagc

SEQ ID NO: 79301 - DNA, 16 bp, H. sapiens
cctacctaggcctccc

SEQ ID NO: 79302 - DNA, 16 bp, H. sapiens
cctacctcaacctctc

SEQ ID NO: 79303 - DNA, 16 bp, H. sapiens
cctacctcagcctccc

SEQ ID NO: 79304 - DNA, 16 bp, H. sapiens
cctacctcagcctctg

SEQ ID NO: 79305 - DNA, 16 bp, H. sapiens
cctacctcataggatt

SEQ ID NO: 79306 - DNA, 16 bp, H. sapiens
cctacctggttcaagc

SEQ ID NO: 79307 - DNA, 16 bp, H. sapiens
cctaccttggcctcca

SEQ ID NO: 79308 - DNA, 16 bp, H. sapiens
cctacgtgtccatcaa

SEQ ID NO: 79309 - DNA, 16 bp, H. sapiens
cctactacatgccaga

SEQ ID NO: 79310 - DNA, 16 bp, H. sapiens
cctactatgtgtcagg

SEQ ID NO: 79311 - DNA, 16 bp, H. sapiens
cctactcaagcctcag

SEQ ID NO: 79312 - DNA, 16 bp, H. sapiens
cctactccagtatgac

SEQ ID NO: 79313 - DNA, 17 bp, H. sapiens
cctactcccactgctgc

SEQ ID NO: 79314 - DNA, 16 bp, H. sapiens
cctactcctggtacca

SEQ ID NO: 79315 - DNA, 16 bp, H. sapiens
cctactctctgttctt

SEQ ID NO: 79316 - DNA, 16 bp, H. sapiens
cctactgggagttgtc

SEQ ID NO: 79317 - DNA, 16 bp, H. sapiens
cctactgtgtgccaag

SEQ ID NO: 79318 - DNA, 16 bp, H. sapiens
cctactgtgtgccagg

SEQ ID NO: 79319 - DNA, 16 bp, H. sapiens
cctactgtgtggcagg

SEQ ID NO: 79320 - DNA, 16 bp, H. sapiens
cctactgtgttccagg

SEQ ID NO: 79321 - DNA, 16 bp, H. sapiens
cctacttcatagggtt

SEQ ID NO: 79322 - DNA, 16 bp, H. sapiens
cctacttgagggagga

SEQ ID NO: 79323 - DNA, 16 bp, H. sapiens
cctacttggcctccca

SEQ ID NO: 79324 - DNA, 16 bp, H. sapiens
cctactttcagttctt

SEQ ID NO: 79325 - DNA, 16 bp, H. sapiens
cctagaaaaaatggat

SEQ ID NO: 79326 - DNA, 16 bp, H. sapiens
cctagaaaaatgtctg

SEQ ID NO: 79327 - DNA, 16 bp, H. sapiens
cctagaaacaggaggc

SEQ ID NO: 79328 - DNA, 16 bp, H. sapiens
cctagaacagcacctg

SEQ ID NO: 79329 - DNA, 16 bp, H. sapiens
cctagaactggctgca

SEQ ID NO: 79330 - DNA, 16 bp, H. sapiens
cctagaactgtgcctg

SEQ ID NO: 79331 - DNA, 16 bp, H. sapiens
cctagaacttaaagaa

SEQ ID NO: 79332 - DNA, 16 bp, H. sapiens
cctagaagaaaatgta

SEQ ID NO: 79333 - DNA, 16 bp, H. sapiens
cctagaaggaaagaat

SEQ ID NO: 79334 - DNA, 16 bp, H. sapiens
cctagaatttctgatt

SEQ ID NO: 79335 - DNA, 16 bp, H. sapiens
cctagaccatcatgga

SEQ ID NO: 79336 - DNA, 16 bp, H. sapiens
cctagagaaagatatt

SEQ ID NO: 79337 - DNA, 16 bp, H. sapiens
cctagagatttgtggg

SEQ ID NO: 79338 - DNA, 16 bp, H. sapiens
cctagagcctccagga

SEQ ID NO: 79339 - DNA, 16 bp, H. sapiens
cctagaggcagaggtt

SEQ ID NO: 79340 - DNA, 16 bp, H. sapiens
cctagatatttgactt

SEQ ID NO: 79341 - DNA, 16 bp, H. sapiens
cctagatgacagcaca

SEQ ID NO: 79342 - DNA, 16 bp, H. sapiens
cctagatgctgccatg

SEQ ID NO: 79343 - DNA, 16 bp, H. sapiens
cctagattacttatga

SEQ ID NO: 79344 - DNA, 16 bp, H. sapiens
cctagattattgagag

SEQ ID NO: 79345 - DNA, 16 bp, H. sapiens
cctagattttcttcta

SEQ ID NO: 79346 - DNA, 16 bp, H. sapiens
cctagcacagtgtctg

SEQ ID NO: 79347 - DNA, 16 bp, H. sapiens
cctagcacatagtagg

SEQ ID NO: 79348 - DNA, 16 bp, H. sapiens
cctagcactttaggaa

SEQ ID NO: 79349 - DNA, 16 bp, H. sapiens
cctagcacttttggaa

SEQ ID NO: 79350 - DNA, 16 bp, H. sapiens
cctagcagaggttctc

SEQ ID NO: 79351 - DNA, 16 bp, H. sapiens
cctagccaagctgaca

SEQ ID NO: 79352 - DNA, 16 bp, H. sapiens
cctagccaagggaagc

SEQ ID NO: 79353 - DNA, 16 bp, H. sapiens
cctagccatgtggaat

SEQ ID NO: 79354 - DNA, 16 bp, H. sapiens
cctagcccagtgcctg

SEQ ID NO: 79355 - DNA, 16 bp, H. sapiens
cctagccctgccccca

SEQ ID NO: 79356 - DNA, 16 bp, H. sapiens
cctagcctaccttaaa

SEQ ID NO: 79357 - DNA, 16 bp, H. sapiens
cctagcctcaagcaat

SEQ ID NO: 79358 - DNA, 16 bp, H. sapiens
cctagcctggccaaca

SEQ ID NO: 79359 - DNA, 16 bp, H. sapiens
cctagcgctttgggag

SEQ ID NO: 79360 - DNA, 16 bp, H. sapiens
cctagctaacactgtg

SEQ ID NO: 79361 - DNA, 16 bp, H. sapiens
cctagctcagtgcctg

SEQ ID NO: 79362 - DNA, 16 bp, H. sapiens
cctaggaaagaggctg

SEQ ID NO: 79363 - DNA, 16 bp, H. sapiens
cctaggaagctaatac

SEQ ID NO: 79364 - DNA, 21 bp, H. sapiens
cctaggaatccaacttacagg

SEQ ID NO: 79365 - DNA, 24 bp, H. sapiens
cctaggaatccaccttacaaggga

SEQ ID NO: 79366 - DNA, 16 bp, H. sapiens
cctaggaatcccactt

SEQ ID NO: 79367 - DNA, 16 bp, H. sapiens
cctaggaatgcagccc

SEQ ID NO: 79368 - DNA, 16 bp, H. sapiens
cctaggactcaccctt

SEQ ID NO: 79369 - DNA, 16 bp, H. sapiens
cctaggactgctgtaa

SEQ ID NO: 79370 - DNA, 16 bp, H. sapiens
cctaggagtagaattt

SEQ ID NO: 79371 - DNA, 16 bp, H. sapiens
cctaggccggagtgca

SEQ ID NO: 79372 - DNA, 16 bp, H. sapiens
cctaggcctcccaaaa

SEQ ID NO: 79373 - DNA, 16 bp, H. sapiens
cctaggctcaaatgat

SEQ ID NO: 79374 - DNA, 16 bp, H. sapiens
cctaggctcaagcaat

SEQ ID NO: 79375 - DNA, 16 bp, H. sapiens
cctaggctcaagggat

SEQ ID NO: 79376 - DNA, 16 bp, H. sapiens
cctaggctggaatgca

SEQ ID NO: 79377 - DNA, 16 bp, H. sapiens
cctaggctggagtgca

SEQ ID NO: 79378 - DNA, 16 bp, H. sapiens
cctaggctggagtgta

SEQ ID NO: 79379 - DNA, 18 bp, H. sapiens
cctaggctggtcttgaac

SEQ ID NO: 79380 - DNA, 16 bp, H. sapiens
cctagggctgagggag

SEQ ID NO: 79381 - DNA, 16 bp, H. sapiens
cctagggctgccgtaa

SEQ ID NO: 79382 - DNA, 16 bp, H. sapiens
cctaggggaaggggga

SEQ ID NO: 79383 - DNA, 16 bp, H. sapiens
cctagggtcacacagc

SEQ ID NO: 79384 - DNA, 16 bp, H. sapiens
cctaggtgctgggatt

SEQ ID NO: 79385 - DNA, 16 bp, H. sapiens
cctaggtttcagagga

SEQ ID NO: 79386 - DNA, 16 bp, H. sapiens
cctaggtttgtgtaag

SEQ ID NO: 79387 - DNA, 17 bp, H. sapiens
cctagtaaaaatacaaa

SEQ ID NO: 79388 - DNA, 16 bp, H. sapiens
cctagtctctgtgccc

SEQ ID NO: 79389 - DNA, 16 bp, H. sapiens
cctagttgctactgca

SEQ ID NO: 79390 - DNA, 16 bp, H. sapiens
cctataaaatggaaat

SEQ ID NO: 79391 - DNA, 16 bp, H. sapiens
cctataaagagactta

SEQ ID NO: 79392 - DNA, 16 bp, H. sapiens
cctataatcccagcgc

SEQ ID NO: 79393 - DNA, 16 bp, H. sapiens
cctataatcccagctc

SEQ ID NO: 79394 - DNA, 16 bp, H. sapiens
cctataatccccacat

SEQ ID NO: 79395 - DNA, 16 bp, H. sapiens
cctataatctcagtgc

SEQ ID NO: 79396 - DNA, 16 bp, H. sapiens
cctatagccctagcta

SEQ ID NO: 79397 - DNA, 16 bp, H. sapiens
cctatagtcctggcta

SEQ ID NO: 79398 - DNA, 16 bp, H. sapiens
cctatatatatatata

SEQ ID NO: 79399 - DNA, 16 bp, H. sapiens
cctatatatcaaacct

SEQ ID NO: 79400 - DNA, 16 bp, H. sapiens
cctatatcaaaaaaga

SEQ ID NO: 79401 - DNA, 16 bp, H. sapiens
cctatatcaaaacatc

SEQ ID NO: 79402 - DNA, 16 bp, H. sapiens
cctatatggtctaaaa

SEQ ID NO: 79403 - DNA, 16 bp, H. sapiens
cctatattcagcatcc

SEQ ID NO: 79404 - DNA, 16 bp, H. sapiens
cctatcaaaatgccaa

SEQ ID NO: 79405 - DNA, 16 bp, H. sapiens
cctatcatgggacttt

SEQ ID NO: 79406 - DNA, 16 bp, H. sapiens
cctatcattggagatg

SEQ ID NO: 79407 - DNA, 18 bp, H. sapiens
cctatcccaaacctataa

SEQ ID NO: 79408 - DNA, 16 bp, H. sapiens
cctatcccacagaaat

SEQ ID NO: 79409 - DNA, 16 bp, H. sapiens
cctatctccagataca

SEQ ID NO: 79410 - DNA, 16 bp, H. sapiens
cctatctctacaaaaa

SEQ ID NO: 79411 - DNA, 16 bp, H. sapiens
cctatgaacaaaattt

SEQ ID NO: 79412 - DNA, 16 bp, H. sapiens
cctatgacctggaagt

SEQ ID NO: 79413 - DNA, 16 bp, H. sapiens
cctatgagttcaagac

SEQ ID NO: 79414 - DNA, 16 bp, H. sapiens
cctatgatctggaagc

SEQ ID NO: 79415 - DNA, 16 bp, H. sapiens
cctatggaaataataa

SEQ ID NO: 79416 - DNA, 16 bp, H. sapiens
cctatggtgaaaaagg

SEQ ID NO: 79417 - DNA, 16 bp, H. sapiens
cctatggtgggaaagg

SEQ ID NO: 79418 - DNA, 16 bp, H. sapiens
cctatgtgtgtgtctg

SEQ ID NO: 79419 - DNA, 16 bp, H. sapiens
cctatgtgtttctttg

SEQ ID NO: 79420 - DNA, 16 bp, H. sapiens
cctatgttttctttta

SEQ ID NO: 79421 - DNA, 16 bp, H. sapiens
cctattcaaaaataaa

SEQ ID NO: 79422 - DNA, 16 bp, H. sapiens
cctattcatccttcag

SEQ ID NO: 79423 - DNA, 16 bp, H. sapiens
cctattctttgttccc

SEQ ID NO: 79424 - DNA, 16 bp, H. sapiens
cctattgcttctgttt

SEQ ID NO: 79425 - DNA, 16 bp, H. sapiens
cctattggcacagctg

SEQ ID NO: 79426 - DNA, 16 bp, H. sapiens
cctattgtgaactgca

SEQ ID NO: 79427 - DNA, 16 bp, H. sapiens
cctatttcctgagaca

SEQ ID NO: 79428 - DNA, 16 bp, H. sapiens
cctatttccttcagtt

SEQ ID NO: 79429 - DNA, 16 bp, H. sapiens
cctattttacagatga

SEQ ID NO: 79430 - DNA, 16 bp, H. sapiens
cctattttagacattt

SEQ ID NO: 79431 - DNA, 16 bp, H. sapiens
cctcaaaaaattaaac

SEQ ID NO: 79432 - DNA, 16 bp, H. sapiens
cctcaaaaagttaaac

SEQ ID NO: 79433 - DNA, 16 bp, H. sapiens
cctcaaaatcctgggc

SEQ ID NO: 79434 - DNA, 16 bp, H. sapiens
cctcaaaatggcaaat

SEQ ID NO: 79435 - DNA, 16 bp, H. sapiens
cctcaaacagagattt

SEQ ID NO: 79436 - DNA, 16 bp, H. sapiens
cctcaaacccctgggc

SEQ ID NO: 79437 - DNA, 16 bp, H. sapiens
cctcaaactcttccaa

SEQ ID NO: 79438 - DNA, 16 bp, H. sapiens
cctcaaacttctggac

SEQ ID NO: 79439 - DNA, 16 bp, H. sapiens
cctcaaagcactgcac

SEQ ID NO: 79440 - DNA, 16 bp, H. sapiens
cctcaaataggttttc

SEQ ID NO: 79441 - DNA, 16 bp, H. sapiens
cctcaaatattttttc

SEQ ID NO: 79442 - DNA, 16 bp, H. sapiens
cctcaaatccctgggc

SEQ ID NO: 79443 - DNA, 16 bp, H. sapiens
cctcaaattcctcatc

SEQ ID NO: 79444 - DNA, 16 bp, H. sapiens
cctcaacaaaatactt

SEQ ID NO: 79445 - DNA, 16 bp, H. sapiens
cctcaacaaatgcaaa

SEQ ID NO: 79446 - DNA, 16 bp, H. sapiens
cctcaacatcctgggc

SEQ ID NO: 79447 - DNA, 16 bp, H. sapiens
cctcaaccacctgggc

SEQ ID NO: 79448 - DNA, 16 bp, H. sapiens
cctcaacctaccaaag

SEQ ID NO: 79449 - DNA, 16 bp, H. sapiens
cctcaacctcccaagt

SEQ ID NO: 79450 - DNA, 16 bp, H. sapiens
cctcaacctcccagct

SEQ ID NO: 79451 - DNA, 16 bp, H. sapiens
cctcaacctcccagga

SEQ ID NO: 79452 - DNA, 16 bp, H. sapiens
cctcaacctccccggc

SEQ ID NO: 79453 - DNA, 16 bp, H. sapiens
cctcaacctccggagt

SEQ ID NO: 79454 - DNA, 16 bp, H. sapiens
cctcaacctcctcagt

SEQ ID NO: 79455 - DNA, 16 bp, H. sapiens
cctcaacctcctgagg

SEQ ID NO: 79456 - DNA, 16 bp, H. sapiens
cctcaacctctgcctc

SEQ ID NO: 79457 - DNA, 16 bp, H. sapiens
cctcaaccttctgggc

SEQ ID NO: 79458 - DNA, 19 bp, H. sapiens
cctcaactacatggaaact

SEQ ID NO: 79459 - DNA, 16 bp, H. sapiens
cctcaactcttgccct

SEQ ID NO: 79460 - DNA, 16 bp, H. sapiens
cctcaactgtaaaata

SEQ ID NO: 79461 - DNA, 16 bp, H. sapiens
cctcaacttcctggcc

SEQ ID NO: 79462 - DNA, 16 bp, H. sapiens
cctcaactttctgggc

SEQ ID NO: 79463 - DNA, 16 bp, H. sapiens
cctcaagaagtttaca

SEQ ID NO: 79464 - DNA, 16 bp, H. sapiens
cctcaagaggagagga

SEQ ID NO: 79465 - DNA, 22 bp, H. sapiens
cctcaagcaatcctcccacctc

SEQ ID NO: 79466 - DNA, 16 bp, H. sapiens
cctcaagcatttatcc

SEQ ID NO: 79467 - DNA, 16 bp, H. sapiens
cctcaagcctcccaaa

SEQ ID NO: 79468 - DNA, 16 bp, H. sapiens
cctcaagctcctggac

SEQ ID NO: 79469 - DNA, 16 bp, H. sapiens
cctcaaggaggtggag

SEQ ID NO: 79470 - DNA, 16 bp, H. sapiens
cctcaaggatcgagaa

SEQ ID NO: 79471 - DNA, 16 bp, H. sapiens
cctcaaggatttagaa

SEQ ID NO: 79472 - DNA, 16 bp, H. sapiens
cctcaaggctcatcca

SEQ ID NO: 79473 - DNA, 16 bp, H. sapiens
cctcaaggcttccctt

SEQ ID NO: 79474 - DNA, 16 bp, H. sapiens
cctcaaggtcagccag

SEQ ID NO: 79475 - DNA, 16 bp, H. sapiens
cctcaaggtcatcaaa

SEQ ID NO: 79476 - DNA, 16 bp, H. sapiens
cctcaagtagctggaa

SEQ ID NO: 79477 - DNA, 16 bp, H. sapiens
cctcaagtgatacacc

SEQ ID NO: 79478 - DNA, 18 bp, H. sapiens
cctcaagtgatccaccag

SEQ ID NO: 79479 - DNA, 16 bp, H. sapiens
cctcaagtgatccccc

SEQ ID NO: 79480 - DNA, 21 bp, H. sapiens
cctcaagtgatccgcccgcct

SEQ ID NO: 79481 - DNA, 17 bp, H. sapiens
cctcaagtgatcctcct

SEQ ID NO: 79482 - DNA, 18 bp, H. sapiens
cctcaagtgatctgcctg

SEQ ID NO: 79483 - DNA, 16 bp, H. sapiens
cctcaagttcctgggc

SEQ ID NO: 79484 - DNA, 16 bp, H. sapiens
cctcaagttttctttt

SEQ ID NO: 79485 - DNA, 16 bp, H. sapiens
cctcaataaagctatt

SEQ ID NO: 79486 - DNA, 16 bp, H. sapiens
cctcaataaattcaaa

SEQ ID NO: 79487 - DNA, 16 bp, H. sapiens
cctcaatagctgggat

SEQ ID NO: 79488 - DNA, 16 bp, H. sapiens
cctcaatctcagactt

SEQ ID NO: 79489 - DNA, 16 bp, H. sapiens
cctcaatctcccaagc

SEQ ID NO: 79490 - DNA, 16 bp, H. sapiens
cctcaatgagatccca

SEQ ID NO: 79491 - DNA, 16 bp, H. sapiens
cctcaatgagctcaca

SEQ ID NO: 79492 - DNA, 16 bp, H. sapiens
cctcaatgattttctt

SEQ ID NO: 79493 - DNA, 16 bp, H. sapiens
cctcaatttcagaact

SEQ ID NO: 79494 - DNA, 16 bp, H. sapiens
cctcaatttctcatct

SEQ ID NO: 79495 - DNA, 16 bp, H. sapiens
cctcaatttttggaat

SEQ ID NO: 79496 - DNA, 16 bp, H. sapiens
cctcacaaagaagttt

SEQ ID NO: 79497 - DNA, 16 bp, H. sapiens
cctcacaacagccctg

SEQ ID NO: 79498 - DNA, 16 bp, H. sapiens
cctcacacagagtccc

SEQ ID NO: 79499 - DNA, 16 bp, H. sapiens
cctcacacctcagccc

SEQ ID NO: 79500 - DNA, 16 bp, H. sapiens
cctcacagacacactg

SEQ ID NO: 79501 - DNA, 16 bp, H. sapiens
cctcacagagaacctc

SEQ ID NO: 79502 - DNA, 16 bp, H. sapiens
cctcacagcagccctg

SEQ ID NO: 79503 - DNA, 16 bp, H. sapiens
cctcacagccctcaga

SEQ ID NO: 79504 - DNA, 16 bp, H. sapiens
cctcacagggctgctg

SEQ ID NO: 79505 - DNA, 16 bp, H. sapiens
cctcacagtaaccctg

SEQ ID NO: 79506 - DNA, 16 bp, H. sapiens
cctcacagtctcaaaa

SEQ ID NO: 79507 - DNA, 16 bp, H. sapiens
cctcacatgacagaag

SEQ ID NO: 79508 - DNA, 16 bp, H. sapiens
cctcacatggctgggt

SEQ ID NO: 79509 - DNA, 16 bp, H. sapiens
cctcaccaaaagcaga

SEQ ID NO: 79510 - DNA, 16 bp, H. sapiens
cctcaccaccatctgt

SEQ ID NO: 79511 - DNA, 16 bp, H. sapiens
cctcaccagacacaga

SEQ ID NO: 79512 - DNA, 16 bp, H. sapiens
cctcaccagacaccaa

SEQ ID NO: 79513 - DNA, 16 bp, H. sapiens
cctcaccagaccctga

SEQ ID NO: 79514 - DNA, 16 bp, H. sapiens
cctcaccagataccaa

SEQ ID NO: 79515 - DNA, 16 bp, H. sapiens
cctcaccagatgccag

SEQ ID NO: 79516 - DNA, 16 bp, H. sapiens
cctcaccagatgccca

SEQ ID NO: 79517 - DNA, 16 bp, H. sapiens
cctcaccatcatctgt

SEQ ID NO: 79518 - DNA, 16 bp, H. sapiens
cctcacccaggctgga

SEQ ID NO: 79519 - DNA, 16 bp, H. sapiens
cctcaccccccgacag

SEQ ID NO: 79520 - DNA, 16 bp, H. sapiens
cctcacccgggaagtg

SEQ ID NO: 79521 - DNA, 16 bp, H. sapiens
cctcaccctccccagt

SEQ ID NO: 79522 - DNA, 16 bp, H. sapiens
cctcaccctcctgggt

SEQ ID NO: 79523 - DNA, 16 bp, H. sapiens
cctcaccctctggagt

SEQ ID NO: 79524 - DNA, 16 bp, H. sapiens
cctcaccctgctcagg

SEQ ID NO: 79525 - DNA, 16 bp, H. sapiens
cctcacccttcaaagt

SEQ ID NO: 79526 - DNA, 16 bp, H. sapiens
cctcacctcccagaag

SEQ ID NO: 79527 - DNA, 16 bp, H. sapiens
cctcacctggctcaga

SEQ ID NO: 79528 - DNA, 16 bp, H. sapiens
cctcacgtggcagaag

SEQ ID NO: 79529 - DNA, 16 bp, H. sapiens
cctcactagaaaccaa

SEQ ID NO: 79530 - DNA, 16 bp, H. sapiens
cctcactctgtcacca

SEQ ID NO: 79531 - DNA, 16 bp, H. sapiens
cctcactgagcctcag

SEQ ID NO: 79532 - DNA, 16 bp, H. sapiens
cctcactgcaacctcc

SEQ ID NO: 79533 - DNA, 16 bp, H. sapiens
cctcactgcaacctct

SEQ ID NO: 79534 - DNA, 16 bp, H. sapiens
cctcactgcggcctcc

SEQ ID NO: 79535 - DNA, 16 bp, H. sapiens
cctcactgctgagaaa

SEQ ID NO: 79536 - DNA, 16 bp, H. sapiens
cctcactggcctccct

SEQ ID NO: 79537 - DNA, 16 bp, H. sapiens
cctcactggcttctca

SEQ ID NO: 79538 - DNA, 16 bp, H. sapiens
cctcactgggtgggac

SEQ ID NO: 79539 - DNA, 16 bp, H. sapiens
cctcacttataagtgg

SEQ ID NO: 79540 - DNA, 16 bp, H. sapiens
cctcacttcccaggtg

SEQ ID NO: 79541 - DNA, 16 bp, H. sapiens
cctcacttctcagact

SEQ ID NO: 79542 - DNA, 16 bp, H. sapiens
cctcactttcctcatt

SEQ ID NO: 79543 - DNA, 16 bp, H. sapiens
cctcagaaataacacc

SEQ ID NO: 79544 - DNA, 16 bp, H. sapiens
cctcagaaataactcc

SEQ ID NO: 79545 - DNA, 16 bp, H. sapiens
cctcagaagaaaccaa

SEQ ID NO: 79546 - DNA, 19 bp, H. sapiens
cctcagaagcatgtgatct

SEQ ID NO: 79547 - DNA, 20 bp, H. sapiens
cctcagaagtgtatcaaagt

SEQ ID NO: 79548 - DNA, 17 bp, H. sapiens
cctcagacccaccagcc

SEQ ID NO: 79549 - DNA, 16 bp, H. sapiens
cctcagactcccaggc

SEQ ID NO: 79550 - DNA, 16 bp, H. sapiens
cctcagactcctaggc

SEQ ID NO: 79551 - DNA, 16 bp, H. sapiens
cctcagaggtggaggt

SEQ ID NO: 79552 - DNA, 24 bp, H. sapiens
cctcagagttccggaaaggtggag

SEQ ID NO: 79553 - DNA, 16 bp, H. sapiens
cctcagatagtaccaa

SEQ ID NO: 79554 - DNA, 16 bp, H. sapiens
cctcagatatttcttt

SEQ ID NO: 79555 - DNA, 16 bp, H. sapiens
cctcagatcatccacc

SEQ ID NO: 79556 - DNA, 16 bp, H. sapiens
cctcagatgacccacc

SEQ ID NO: 79557 - DNA, 16 bp, H. sapiens
cctcagatgatacacc

SEQ ID NO: 79558 - DNA, 16 bp, H. sapiens
cctcagcaaactaatg

SEQ ID NO: 79559 - DNA, 16 bp, H. sapiens
cctcagcaaatacaaa

SEQ ID NO: 79560 - DNA, 16 bp, H. sapiens
cctcagcaaatgtgaa

SEQ ID NO: 79561 - DNA, 16 bp, H. sapiens
cctcagcaacatgcaa

SEQ ID NO: 79562 - DNA, 16 bp, H. sapiens
cctcagcaatggcggg

SEQ ID NO: 79563 - DNA, 16 bp, H. sapiens
cctcagcacacacaca

SEQ ID NO: 79564 - DNA, 19 bp, H. sapiens
cctcagcacagacccttta

SEQ ID NO: 79565 - DNA, 16 bp, H. sapiens
cctcagcacccccaag

SEQ ID NO: 79566 - DNA, 16 bp, H. sapiens
cctcagcagctgggac

SEQ ID NO: 79567 - DNA, 16 bp, H. sapiens
cctcagcatcctaagt

SEQ ID NO: 79568 - DNA, 16 bp, H. sapiens
cctcagccaaccaagt

SEQ ID NO: 79569 - DNA, 16 bp, H. sapiens
cctcagccaccaaagt

SEQ ID NO: 79570 - DNA, 16 bp, H. sapiens
cctcagccagcccaga

SEQ ID NO: 79571 - DNA, 16 bp, H. sapiens
cctcagccatgtggag

SEQ ID NO: 79572 - DNA, 16 bp, H. sapiens
cctcagcccagccctg

SEQ ID NO: 79573 - DNA, 16 bp, H. sapiens
cctcagcccagggacc

SEQ ID NO: 79574 - DNA, 16 bp, H. sapiens
cctcagcccagttctg

SEQ ID NO: 79575 - DNA, 16 bp, H. sapiens
cctcagccccacaagt

SEQ ID NO: 79576 - DNA, 16 bp, H. sapiens
cctcagcccccacaag

SEQ ID NO: 79577 - DNA, 16 bp, H. sapiens
cctcagccccccaaat

SEQ ID NO: 79578 - DNA, 16 bp, H. sapiens
cctcagcccccgaagt

SEQ ID NO: 79579 - DNA, 16 bp, H. sapiens
cctcagccccctccag

SEQ ID NO: 79580 - DNA, 16 bp, H. sapiens
cctcagccccctgagt

SEQ ID NO: 79581 - DNA, 16 bp, H. sapiens
cctcagcccctcagcc

SEQ ID NO: 79582 - DNA, 16 bp, H. sapiens
cctcagcccctccagt

SEQ ID NO: 79583 - DNA, 16 bp, H. sapiens
cctcagcccctgccct

SEQ ID NO: 79584 - DNA, 16 bp, H. sapiens
cctcagcccctggtaa

SEQ ID NO: 79585 - DNA, 16 bp, H. sapiens
cctcagccctcagcct

SEQ ID NO: 79586 - DNA, 16 bp, H. sapiens
cctcagccctcccaag

SEQ ID NO: 79587 - DNA, 16 bp, H. sapiens
cctcagccgccagagt

SEQ ID NO: 79588 - DNA, 16 bp, H. sapiens
cctcagccgcctcagc

SEQ ID NO: 79589 - DNA, 16 bp, H. sapiens
cctcagccgggcgcgg

SEQ ID NO: 79590 - DNA, 16 bp, H. sapiens
cctcagcctcagcctg

SEQ ID NO: 79591 - DNA, 16 bp, H. sapiens
cctcagcctcataaag

SEQ ID NO: 79592 - DNA, 16 bp, H. sapiens
cctcagcctccaagtg

SEQ ID NO: 79593 - DNA, 16 bp, H. sapiens
cctcagcctccacagt

SEQ ID NO: 79594 - DNA, 16 bp, H. sapiens
cctcagcctcccaaaa

SEQ ID NO: 79595 - DNA, 16 bp, H. sapiens
cctcagcctcccaaac

SEQ ID NO: 79596 - DNA, 16 bp, H. sapiens
cctcagcctcccaacc

SEQ ID NO: 79597 - DNA, 16 bp, H. sapiens
cctcagcctcccaggt

SEQ ID NO: 79598 - DNA, 16 bp, H. sapiens
cctcagcctcccagtc

SEQ ID NO: 79599 - DNA, 16 bp, H. sapiens
cctcagcctcccccag

SEQ ID NO: 79600 - DNA, 16 bp, H. sapiens
cctcagcctccccggc

SEQ ID NO: 79601 - DNA, 16 bp, H. sapiens
cctcagcctccccggt

SEQ ID NO: 79602 - DNA, 16 bp, H. sapiens
cctcagcctcccgcct

SEQ ID NO: 79603 - DNA, 16 bp, H. sapiens
cctcagcctccgctcc

SEQ ID NO: 79604 - DNA, 18 bp, H. sapiens
cctcagcctcctaaagtg

SEQ ID NO: 79605 - DNA, 16 bp, H. sapiens
cctcagcctcctcatt

SEQ ID NO: 79606 - DNA, 16 bp, H. sapiens
cctcagcctcctctcc

SEQ ID NO: 79607 - DNA, 16 bp, H. sapiens
cctcagcctcctgatg

SEQ ID NO: 79608 - DNA, 16 bp, H. sapiens
cctcagcctcctgcct

SEQ ID NO: 79609 - DNA, 16 bp, H. sapiens
cctcagcctcctgggc

SEQ ID NO: 79610 - DNA, 16 bp, H. sapiens
cctcagcctcctgggg

SEQ ID NO: 79611 - DNA, 16 bp, H. sapiens
cctcagcctcctggtt

SEQ ID NO: 79612 - DNA, 16 bp, H. sapiens
cctcagcctcctgtgg

SEQ ID NO: 79613 - DNA, 16 bp, H. sapiens
cctcagcctccttagt

SEQ ID NO: 79614 - DNA, 16 bp, H. sapiens
cctcagcctcggcctc

SEQ ID NO: 79615 - DNA, 16 bp, H. sapiens
cctcagcctctccagc

SEQ ID NO: 79616 - DNA, 16 bp, H. sapiens
cctcagcctctccagt

SEQ ID NO: 79617 - DNA, 16 bp, H. sapiens
cctcagcctctccgag

SEQ ID NO: 79618 - DNA, 16 bp, H. sapiens
cctcagcctctggggt

SEQ ID NO: 79619 - DNA, 16 bp, H. sapiens
cctcagcctgctgagc

SEQ ID NO: 79620 - DNA, 16 bp, H. sapiens
cctcagcctgctgagt

SEQ ID NO: 79621 - DNA, 16 bp, H. sapiens
cctcagcctggccagc

SEQ ID NO: 79622 - DNA, 16 bp, H. sapiens
cctcagccttccaatt

SEQ ID NO: 79623 - DNA, 16 bp, H. sapiens
cctcagccttccaggt

SEQ ID NO: 79624 - DNA, 16 bp, H. sapiens
cctcagccttcctgag

SEQ ID NO: 79625 - DNA, 16 bp, H. sapiens
cctcagccttggcctc

SEQ ID NO: 79626 - DNA, 16 bp, H. sapiens
cctcagcctttccagt

SEQ ID NO: 79627 - DNA, 19 bp, H. sapiens
cctcagctcactgcaacct

SEQ ID NO: 79628 - DNA, 16 bp, H. sapiens
cctcagctcagcccag

SEQ ID NO: 79629 - DNA, 16 bp, H. sapiens
cctcagctcagcctcc

SEQ ID NO: 79630 - DNA, 16 bp, H. sapiens
cctcagctccaggcac

SEQ ID NO: 79631 - DNA, 16 bp, H. sapiens
cctcagctccctccct

SEQ ID NO: 79632 - DNA, 16 bp, H. sapiens
cctcagctcctagagg

SEQ ID NO: 79633 - DNA, 16 bp, H. sapiens
cctcagctcctcctcc

SEQ ID NO: 79634 - DNA, 16 bp, H. sapiens
cctcagctcctcctgc

SEQ ID NO: 79635 - DNA, 16 bp, H. sapiens
cctcagctctgcctgg

SEQ ID NO: 79636 - DNA, 16 bp, H. sapiens
cctcagctgcagatct

SEQ ID NO: 79637 - DNA, 16 bp, H. sapiens
cctcagctgccaggca

SEQ ID NO: 79638 - DNA, 16 bp, H. sapiens
cctcagctgcctcatc

SEQ ID NO: 79639 - DNA, 16 bp, H. sapiens
cctcagctgcctcccc

SEQ ID NO: 79640 - DNA, 16 bp, H. sapiens
cctcagctgggaacat

SEQ ID NO: 79641 - DNA, 16 bp, H. sapiens
cctcagctgtaaaatg

SEQ ID NO: 79642 - DNA, 16 bp, H. sapiens
cctcagcttcccagag

SEQ ID NO: 79643 - DNA, 16 bp, H. sapiens
cctcagcttccccatt

SEQ ID NO: 79644 - DNA, 16 bp, H. sapiens
cctcagcttccctgag

SEQ ID NO: 79645 - DNA, 16 bp, H. sapiens
cctcagcttcctcagc

SEQ ID NO: 79646 - DNA, 16 bp, H. sapiens
cctcagcttcctcccc

SEQ ID NO: 79647 - DNA, 16 bp, H. sapiens
cctcagcttcctccct

SEQ ID NO: 79648 - DNA, 16 bp, H. sapiens
cctcagcttcctcctc

SEQ ID NO: 79649 - DNA, 16 bp, H. sapiens
cctcagcttcctcctt

SEQ ID NO: 79650 - DNA, 16 bp, H. sapiens
cctcagcttctcagag

SEQ ID NO: 79651 - DNA, 16 bp, H. sapiens
cctcagcttctgaagt

SEQ ID NO: 79652 - DNA, 16 bp, H. sapiens
cctcagcttgcagagg

SEQ ID NO: 79653 - DNA, 16 bp, H. sapiens
cctcagctttttcatc

SEQ ID NO: 79654 - DNA, 16 bp, H. sapiens
cctcaggaagcttaca

SEQ ID NO: 79655 - DNA, 16 bp, H. sapiens
cctcaggaagcttcca

SEQ ID NO: 79656 - DNA, 16 bp, H. sapiens
cctcaggaagtttcca

SEQ ID NO: 79657 - DNA, 17 bp, H. sapiens
cctcaggaccctgtgat

SEQ ID NO: 79658 - DNA, 16 bp, H. sapiens
cctcaggaggtcctga

SEQ ID NO: 79659 - DNA, 16 bp, H. sapiens
cctcaggcaagtcact

SEQ ID NO: 79660 - DNA, 16 bp, H. sapiens
cctcaggcagtgcagg

SEQ ID NO: 79661 - DNA, 16 bp, H. sapiens
cctcaggcattccttt

SEQ ID NO: 79662 - DNA, 16 bp, H. sapiens
cctcaggcctcagcct

SEQ ID NO: 79663 - DNA, 16 bp, H. sapiens
cctcaggcctcccaaa

SEQ ID NO: 79664 - DNA, 16 bp, H. sapiens
cctcaggcctgtgccc

SEQ ID NO: 79665 - DNA, 16 bp, H. sapiens
cctcaggctccccagt

SEQ ID NO: 79666 - DNA, 16 bp, H. sapiens
cctcaggctcctcatc

SEQ ID NO: 79667 - DNA, 16 bp, H. sapiens
cctcaggctctgcttc

SEQ ID NO: 79668 - DNA, 16 bp, H. sapiens
cctcaggctgcttcca

SEQ ID NO: 79669 - DNA, 16 bp, H. sapiens
cctcaggctgtctctt

SEQ ID NO: 79670 - DNA, 20 bp, H. sapiens
cctcaggcttactaggattg

SEQ ID NO: 79671 - DNA, 41 bp, H. sapiens
cctcagggaatgcttaatagtccaactatttgtcagacttt

SEQ ID NO: 79672 - DNA, 16 bp, H. sapiens
cctcagggagccccag

SEQ ID NO: 79673 - DNA, 16 bp, H. sapiens
cctcagggagctcaca

SEQ ID NO: 79674 - DNA, 16 bp, H. sapiens
cctcagggattattca

SEQ ID NO: 79675 - DNA, 16 bp, H. sapiens
cctcagggctgctgtg

SEQ ID NO: 79676 - DNA, 16 bp, H. sapiens
cctcagggctggggag

SEQ ID NO: 79677 - DNA, 16 bp, H. sapiens
cctcaggtcaggagtt

SEQ ID NO: 79678 - DNA, 16 bp, H. sapiens
cctcaggtcctctttg

SEQ ID NO: 79679 - DNA, 16 bp, H. sapiens
cctcaggtgatcagct

SEQ ID NO: 79680 - DNA, 16 bp, H. sapiens
cctcaggtgattctga

SEQ ID NO: 79681 - DNA, 16 bp, H. sapiens
cctcaggttcccaaag

SEQ ID NO: 79682 - DNA, 16 bp, H. sapiens
cctcagtcccaggcaa

SEQ ID NO: 79683 - DNA, 16 bp, H. sapiens
cctcagtctcctgggt

SEQ ID NO: 79684 - DNA, 16 bp, H. sapiens
cctcagtctctccttc

SEQ ID NO: 79685 - DNA, 16 bp, H. sapiens
cctcagtctctctctc

SEQ ID NO: 79686 - DNA, 16 bp, H. sapiens
cctcagtctcttcctc

SEQ ID NO: 79687 - DNA, 16 bp, H. sapiens
cctcagtctgggtggg

SEQ ID NO: 79688 - DNA, 16 bp, H. sapiens
cctcagtcttcccatc

SEQ ID NO: 79689 - DNA, 16 bp, H. sapiens
cctcagtgacaaaata

SEQ ID NO: 79690 - DNA, 16 bp, H. sapiens
cctcagtgatctgccc

SEQ ID NO: 79691 - DNA, 16 bp, H. sapiens
cctcagtgtgatgaca

SEQ ID NO: 79692 - DNA, 16 bp, H. sapiens
cctcagtgtgggtggg

SEQ ID NO: 79693 - DNA, 16 bp, H. sapiens
cctcagttacttcatc

SEQ ID NO: 79694 - DNA, 16 bp, H. sapiens
cctcagttcctcacca

SEQ ID NO: 79695 - DNA, 16 bp, H. sapiens
cctcagtttcccaatc

SEQ ID NO: 79696 - DNA, 16 bp, H. sapiens
cctcagtttcccatct

SEQ ID NO: 79697 - DNA, 16 bp, H. sapiens
cctcagtttccccact

SEQ ID NO: 79698 - DNA, 16 bp, H. sapiens
cctcagtttcccccat

SEQ ID NO: 79699 - DNA, 16 bp, H. sapiens
cctcagtttcctcatt

SEQ ID NO: 79700 - DNA, 16 bp, H. sapiens
cctcagtttcctcctc

SEQ ID NO: 79701 - DNA, 16 bp, H. sapiens
cctcagtttcctcctg

SEQ ID NO: 79702 - DNA, 16 bp, H. sapiens
cctcagtttcctcttt

SEQ ID NO: 79703 - DNA, 16 bp, H. sapiens
cctcagtttcttcttc

SEQ ID NO: 79704 - DNA, 16 bp, H. sapiens
cctcagtttgcccatc

SEQ ID NO: 79705 - DNA, 16 bp, H. sapiens
cctcagttttcccatt

SEQ ID NO: 79706 - DNA, 16 bp, H. sapiens
cctcagttttccttct

SEQ ID NO: 79707 - DNA, 16 bp, H. sapiens
cctcagttttctccat

SEQ ID NO: 79708 - DNA, 16 bp, H. sapiens
cctcagttttctcttt

SEQ ID NO: 79709 - DNA, 16 bp, H. sapiens
cctcatatattttgga

SEQ ID NO: 79710 - DNA, 16 bp, H. sapiens
cctcatcaaagaagat

SEQ ID NO: 79711 - DNA, 16 bp, H. sapiens
cctcatcaataaaatg

SEQ ID NO: 79712 - DNA, 16 bp, H. sapiens
cctcatcagaacctga

SEQ ID NO: 79713 - DNA, 16 bp, H. sapiens
cctcatcagcctggcc

SEQ ID NO: 79714 - DNA, 16 bp, H. sapiens
cctcatcatcaccatc

SEQ ID NO: 79715 - DNA, 16 bp, H. sapiens
cctcatccaatcagtc

SEQ ID NO: 79716 - DNA, 16 bp, H. sapiens
cctcatcctcatcacc

SEQ ID NO: 79717 - DNA, 16 bp, H. sapiens
cctcatcctcccagag

SEQ ID NO: 79718 - DNA, 16 bp, H. sapiens
cctcatcctcccaggt

SEQ ID NO: 79719 - DNA, 16 bp, H. sapiens
cctcatcctcctgggc

SEQ ID NO: 79720 - DNA, 16 bp, H. sapiens
cctcatcctcctgggt

SEQ ID NO: 79721 - DNA, 16 bp, H. sapiens
cctcatctataaagca

SEQ ID NO: 79722 - DNA, 16 bp, H. sapiens
cctcatctataacatg

SEQ ID NO: 79723 - DNA, 16 bp, H. sapiens
cctcatctccagcctc

SEQ ID NO: 79724 - DNA, 16 bp, H. sapiens
cctcatctccatatga

SEQ ID NO: 79725 - DNA, 16 bp, H. sapiens
cctcatctcctgccac

SEQ ID NO: 79726 - DNA, 16 bp, H. sapiens
cctcatctccttcagg

SEQ ID NO: 79727 - DNA, 16 bp, H. sapiens
cctcatctctactcaa

SEQ ID NO: 79728 - DNA, 16 bp, H. sapiens
cctcatctgggaagtg

SEQ ID NO: 79729 - DNA, 18 bp, H. sapiens
cctcatctgtaaaatgga

SEQ ID NO: 79730 - DNA, 16 bp, H. sapiens
cctcatctgtaacatg

SEQ ID NO: 79731 - DNA, 16 bp, H. sapiens
cctcatctgtgaaatg

SEQ ID NO: 79732 - DNA, 16 bp, H. sapiens
cctcatcttcccaaag

SEQ ID NO: 79733 - DNA, 16 bp, H. sapiens
cctcatcttcctcatc

SEQ ID NO: 79734 - DNA, 16 bp, H. sapiens
cctcatcttcctgtct

SEQ ID NO: 79735 - DNA, 16 bp, H. sapiens
cctcatgaaatgagtt

SEQ ID NO: 79736 - DNA, 16 bp, H. sapiens
cctcatgacctaatca

SEQ ID NO: 79737 - DNA, 16 bp, H. sapiens
cctcatgacctagtca

SEQ ID NO: 79738 - DNA, 16 bp, H. sapiens
cctcatgagccaacct

SEQ ID NO: 79739 - DNA, 16 bp, H. sapiens
cctcatgatctgccag

SEQ ID NO: 79740 - DNA, 16 bp, H. sapiens
cctcatgatcttcctg

SEQ ID NO: 79741 - DNA, 16 bp, H. sapiens
cctcatgatgagatta

SEQ ID NO: 79742 - DNA, 16 bp, H. sapiens
cctcatggggctgttg

SEQ ID NO: 79743 - DNA, 16 bp, H. sapiens
cctcatggggttgctg

SEQ ID NO: 79744 - DNA, 16 bp, H. sapiens
cctcatgtgtaaaatg

SEQ ID NO: 79745 - DNA, 16 bp, H. sapiens
cctcattcaccttctg

SEQ ID NO: 79746 - DNA, 16 bp, H. sapiens
cctcatttaatcctca

SEQ ID NO: 79747 - DNA, 16 bp, H. sapiens
cctcatttcagagaga

SEQ ID NO: 79748 - DNA, 16 bp, H. sapiens
cctcatttgtaaaaca

SEQ ID NO: 79749 - DNA, 16 bp, H. sapiens
cctcatttgtaaaata

SEQ ID NO: 79750 - DNA, 16 bp, H. sapiens
cctcatttgtaaaatg

SEQ ID NO: 79751 - DNA, 16 bp, H. sapiens
cctcatttgtaaagtg

SEQ ID NO: 79752 - DNA, 16 bp, H. sapiens
cctcattttacagaca

SEQ ID NO: 79753 - DNA, 16 bp, H. sapiens
cctcattttacagatg

SEQ ID NO: 79754 - DNA, 16 bp, H. sapiens
cctcattttccagatg

SEQ ID NO: 79755 - DNA, 16 bp, H. sapiens
cctcattttcttttgc

SEQ ID NO: 79756 - DNA, 16 bp, H. sapiens
cctcattttgcagata

SEQ ID NO: 79757 - DNA, 16 bp, H. sapiens
cctcattttgcaggtg

SEQ ID NO: 79758 - DNA, 16 bp, H. sapiens
cctcatttttcctgga

SEQ ID NO: 79759 - DNA, 16 bp, H. sapiens
cctccaaaagagctgg

SEQ ID NO: 79760 - DNA, 16 bp, H. sapiens
cctccaaaattcctat

SEQ ID NO: 79761 - DNA, 16 bp, H. sapiens
cctccaaactgctcca

SEQ ID NO: 79762 - DNA, 16 bp, H. sapiens
cctccaaagactaaac

SEQ ID NO: 79763 - DNA, 16 bp, H. sapiens
cctccaaagcccaaat

SEQ ID NO: 79764 - DNA, 22 bp, H. sapiens
cctccaaaggaacgcagctcct

SEQ ID NO: 79765 - DNA, 16 bp, H. sapiens
cctccaaataccatca

SEQ ID NO: 79766 - DNA, 16 bp, H. sapiens
cctccaaatgactgca

SEQ ID NO: 79767 - DNA, 16 bp, H. sapiens
cctccaactcctgggc

SEQ ID NO: 79768 - DNA, 16 bp, H. sapiens
cctccaactttcttct

SEQ ID NO: 79769 - DNA, 16 bp, H. sapiens
cctccaagcagctggg

SEQ ID NO: 79770 - DNA, 16 bp, H. sapiens
cctccaagccaggtgc

SEQ ID NO: 79771 - DNA, 16 bp, H. sapiens
cctccaagtggctggg

SEQ ID NO: 79772 - DNA, 16 bp, H. sapiens
cctccaattcaattcc

SEQ ID NO: 79773 - DNA, 16 bp, H. sapiens
cctccacacccagcta

SEQ ID NO: 79774 - DNA, 16 bp, H. sapiens
cctccacagccctcca

SEQ ID NO: 79775 - DNA, 16 bp, H. sapiens
cctccacatcttgtcc

SEQ ID NO: 79776 - DNA, 16 bp, H. sapiens
cctccaccacacccag

SEQ ID NO: 79777 - DNA, 16 bp, H. sapiens
cctccaccactcagta

SEQ ID NO: 79778 - DNA, 16 bp, H. sapiens
cctccaccactgccac

SEQ ID NO: 79779 - DNA, 16 bp, H. sapiens
cctccaccatgtccat

SEQ ID NO: 79780 - DNA, 16 bp, H. sapiens
cctccacccagcagcc

SEQ ID NO: 79781 - DNA, 16 bp, H. sapiens
cctccaccccatgaca

SEQ ID NO: 79782 - DNA, 16 bp, H. sapiens
cctccaccccatttgc

SEQ ID NO: 79783 - DNA, 16 bp, H. sapiens
cctccaccctggcctc

SEQ ID NO: 79784 - DNA, 16 bp, H. sapiens
cctccacctccagcct

SEQ ID NO: 79785 - DNA, 16 bp, H. sapiens
cctccacctcccaagt

SEQ ID NO: 79786 - DNA, 16 bp, H. sapiens
cctccacctccccagt

SEQ ID NO: 79787 - DNA, 16 bp, H. sapiens
cctccacctccctcag

SEQ ID NO: 79788 - DNA, 16 bp, H. sapiens
cctccacctccggagt

SEQ ID NO: 79789 - DNA, 16 bp, H. sapiens
cctccacctccggggt

SEQ ID NO: 79790 - DNA, 16 bp, H. sapiens
cctccacctccgggtt

SEQ ID NO: 79791 - DNA, 16 bp, H. sapiens
cctccacctcctccag

SEQ ID NO: 79792 - DNA, 16 bp, H. sapiens
cctccacctcctcggt

SEQ ID NO: 79793 - DNA, 16 bp, H. sapiens
cctccacctcctgcct

SEQ ID NO: 79794 - DNA, 16 bp, H. sapiens
cctccacctcctggct

SEQ ID NO: 79795 - DNA, 16 bp, H. sapiens
cctccacctcctgtgt

SEQ ID NO: 79796 - DNA, 16 bp, H. sapiens
cctccacctctgcctc

SEQ ID NO: 79797 - DNA, 16 bp, H. sapiens
cctccacctgcctgtc

SEQ ID NO: 79798 - DNA, 16 bp, H. sapiens
cctccaccttccagct

SEQ ID NO: 79799 - DNA, 16 bp, H. sapiens
cctccaccttctgggc

SEQ ID NO: 79800 - DNA, 16 bp, H. sapiens
cctccactccagcctc

SEQ ID NO: 79801 - DNA, 16 bp, H. sapiens
cctccactccccaggt

SEQ ID NO: 79802 - DNA, 16 bp, H. sapiens
cctccactcctgcctc

SEQ ID NO: 79803 - DNA, 16 bp, H. sapiens
cctccactgaaatctt

SEQ ID NO: 79804 - DNA, 16 bp, H. sapiens
cctccacttcattttt

SEQ ID NO: 79805 - DNA, 16 bp, H. sapiens
cctccacttcccagct

SEQ ID NO: 79806 - DNA, 16 bp, H. sapiens
cctccacttcccgagt

SEQ ID NO: 79807 - DNA, 16 bp, H. sapiens
cctccacttgccttgt

SEQ ID NO: 79808 - DNA, 16 bp, H. sapiens
cctccagaaaactcct

SEQ ID NO: 79809 - DNA, 16 bp, H. sapiens
cctccagaactgtgaa

SEQ ID NO: 79810 - DNA, 16 bp, H. sapiens
cctccagaactgtgag

SEQ ID NO: 79811 - DNA, 16 bp, H. sapiens
cctccagaagctggaa

SEQ ID NO: 79812 - DNA, 16 bp, H. sapiens
cctccagacccagggc

SEQ ID NO: 79813 - DNA, 16 bp, H. sapiens
cctccagagaagctgg

SEQ ID NO: 79814 - DNA, 16 bp, H. sapiens
cctccagagcagctgg

SEQ ID NO: 79815 - DNA, 16 bp, H. sapiens
cctccagagcctccag

SEQ ID NO: 79816 - DNA, 16 bp, H. sapiens
cctccagagctgtgag

SEQ ID NO: 79817 - DNA, 16 bp, H. sapiens
cctccagagtacctgg

SEQ ID NO: 79818 - DNA, 16 bp, H. sapiens
cctccagattagctgg

SEQ ID NO: 79819 - DNA, 16 bp, H. sapiens
cctccagattttgttc

SEQ ID NO: 79820 - DNA, 16 bp, H. sapiens
cctccagcaccgccgc

SEQ ID NO: 79821 - DNA, 16 bp, H. sapiens
cctccagcactgtgag

SEQ ID NO: 79822 - DNA, 16 bp, H. sapiens
cctccagcagccccag

SEQ ID NO: 79823 - DNA, 16 bp, H. sapiens
cctccagcccagccca

SEQ ID NO: 79824 - DNA, 16 bp, H. sapiens
cctccagcccagcctc

SEQ ID NO: 79825 - DNA, 16 bp, H. sapiens
cctccagcccaggagg

SEQ ID NO: 79826 - DNA, 16 bp, H. sapiens
cctccagccccagcca

SEQ ID NO: 79827 - DNA, 16 bp, H. sapiens
cctccagccccagctc

SEQ ID NO: 79828 - DNA, 16 bp, H. sapiens
cctccagccccaggca

SEQ ID NO: 79829 - DNA, 16 bp, H. sapiens
cctccagccccagtca

SEQ ID NO: 79830 - DNA, 16 bp, H. sapiens
cctccagcctccagaa

SEQ ID NO: 79831 - DNA, 16 bp, H. sapiens
cctccagcctccagcc

SEQ ID NO: 79832 - DNA, 16 bp, H. sapiens
cctccagcctcctcat

SEQ ID NO: 79833 - DNA, 16 bp, H. sapiens
cctccagcctcctcca

SEQ ID NO: 79834 - DNA, 16 bp, H. sapiens
cctccagcctcctgcc

SEQ ID NO: 79835 - DNA, 16 bp, H. sapiens
cctccagcctctgcat

SEQ ID NO: 79836 - DNA, 16 bp, H. sapiens
cctccagcctgggcag

SEQ ID NO: 79837 - DNA, 16 bp, H. sapiens
cctccagcctggggga

SEQ ID NO: 79838 - DNA, 16 bp, H. sapiens
cctccagcctggtgac

SEQ ID NO: 79839 - DNA, 16 bp, H. sapiens
cctccagctcagcctc

SEQ ID NO: 79840 - DNA, 16 bp, H. sapiens
cctccagctccaccca

SEQ ID NO: 79841 - DNA, 16 bp, H. sapiens
cctccagctccactca

SEQ ID NO: 79842 - DNA, 16 bp, H. sapiens
cctccagctccatcaa

SEQ ID NO: 79843 - DNA, 16 bp, H. sapiens
cctccagctccccagc

SEQ ID NO: 79844 - DNA, 16 bp, H. sapiens
cctccagctcccgggt

SEQ ID NO: 79845 - DNA, 16 bp, H. sapiens
cctccagctcctccct

SEQ ID NO: 79846 - DNA, 16 bp, H. sapiens
cctccagctcctgggc

SEQ ID NO: 79847 - DNA, 16 bp, H. sapiens
cctccagctgcagcca

SEQ ID NO: 79848 - DNA, 16 bp, H. sapiens
cctccagctgtgagcc

SEQ ID NO: 79849 - DNA, 16 bp, H. sapiens
cctccagctttggtct

SEQ ID NO: 79850 - DNA, 16 bp, H. sapiens
cctccagctttttctt

SEQ ID NO: 79851 - DNA, 16 bp, H. sapiens
cctccaggaaaccaag

SEQ ID NO: 79852 - DNA, 16 bp, H. sapiens
cctccaggaaaccttc

SEQ ID NO: 79853 - DNA, 16 bp, H. sapiens
cctccaggaacctcca

SEQ ID NO: 79854 - DNA, 16 bp, H. sapiens
cctccaggaagccacc

SEQ ID NO: 79855 - DNA, 16 bp, H. sapiens
cctccaggaagccatc

SEQ ID NO: 79856 - DNA, 16 bp, H. sapiens
cctccaggaagccctc

SEQ ID NO: 79857 - DNA, 16 bp, H. sapiens
cctccaggaagcctcc

SEQ ID NO: 79858 - DNA, 16 bp, H. sapiens
cctccaggaaggcttc

SEQ ID NO: 79859 - DNA, 16 bp, H. sapiens
cctccaggaggccttc

SEQ ID NO: 79860 - DNA, 16 bp, H. sapiens
cctccaggatctagaa

SEQ ID NO: 79861 - DNA, 16 bp, H. sapiens
cctccaggcagccctc

SEQ ID NO: 79862 - DNA, 16 bp, H. sapiens
cctccaggccccacct

SEQ ID NO: 79863 - DNA, 16 bp, H. sapiens
cctccaggcctgggcc

SEQ ID NO: 79864 - DNA, 16 bp, H. sapiens
cctccaggcctttgct

SEQ ID NO: 79865 - DNA, 16 bp, H. sapiens
cctccaggctcaagtg

SEQ ID NO: 79866 - DNA, 16 bp, H. sapiens
cctccaggctcaggtg

SEQ ID NO: 79867 - DNA, 16 bp, H. sapiens
cctccaggctgctttc

SEQ ID NO: 79868 - DNA, 16 bp, H. sapiens
cctccagggagccttc

SEQ ID NO: 79869 - DNA, 16 bp, H. sapiens
cctccagggctcaaat

SEQ ID NO: 79870 - DNA, 16 bp, H. sapiens
cctccagggttcaagc

SEQ ID NO: 79871 - DNA, 16 bp, H. sapiens
cctccagggtttaagc

SEQ ID NO: 79872 - DNA, 16 bp, H. sapiens
cctccaggtccatcca

SEQ ID NO: 79873 - DNA, 16 bp, H. sapiens
cctccaggtgcaggag

SEQ ID NO: 79874 - DNA, 16 bp, H. sapiens
cctccaggtgtgggag

SEQ ID NO: 79875 - DNA, 16 bp, H. sapiens
cctccaggttcaagcg

SEQ ID NO: 79876 - DNA, 16 bp, H. sapiens
cctccaggttcaagtg

SEQ ID NO: 79877 - DNA, 16 bp, H. sapiens
cctccaggttcaccca

SEQ ID NO: 79878 - DNA, 16 bp, H. sapiens
cctccagtctctgcct

SEQ ID NO: 79879 - DNA, 16 bp, H. sapiens
cctccagtgatccacc

SEQ ID NO: 79880 - DNA, 16 bp, H. sapiens
cctccagtggcttctc

SEQ ID NO: 79881 - DNA, 16 bp, H. sapiens
cctccagttttctttt

SEQ ID NO: 79882 - DNA, 16 bp, H. sapiens
cctccagttttgttct

SEQ ID NO: 79883 - DNA, 16 bp, H. sapiens
cctccataccccagaa

SEQ ID NO: 79884 - DNA, 16 bp, H. sapiens
cctccatcatcacatg

SEQ ID NO: 79885 - DNA, 16 bp, H. sapiens
cctccatccctgtatt

SEQ ID NO: 79886 - DNA, 16 bp, H. sapiens
cctccatctcagcctc

SEQ ID NO: 79887 - DNA, 16 bp, H. sapiens
cctccatctccaccat

SEQ ID NO: 79888 - DNA, 16 bp, H. sapiens
cctccatctcccagct

SEQ ID NO: 79889 - DNA, 16 bp, H. sapiens
cctccatctcccctgt

SEQ ID NO: 79890 - DNA, 16 bp, H. sapiens
cctccatctccctggt

SEQ ID NO: 79891 - DNA, 16 bp, H. sapiens
cctccatctcctggct

SEQ ID NO: 79892 - DNA, 16 bp, H. sapiens
cctccatctgctgggt

SEQ ID NO: 79893 - DNA, 16 bp, H. sapiens
cctccatgagatcaat

SEQ ID NO: 79894 - DNA, 16 bp, H. sapiens
cctccatgcacacaca

SEQ ID NO: 79895 - DNA, 16 bp, H. sapiens
cctccatgcctttgca

SEQ ID NO: 79896 - DNA, 16 bp, H. sapiens
cctccatgggctgcat

SEQ ID NO: 79897 - DNA, 16 bp, H. sapiens
cctccatgtcttttca

SEQ ID NO: 79898 - DNA, 16 bp, H. sapiens
cctccattgcccaggc

SEQ ID NO: 79899 - DNA, 16 bp, H. sapiens
cctccatttcctcatg

SEQ ID NO: 79900 - DNA, 16 bp, H. sapiens
cctccattttcttatc

SEQ ID NO: 79901 - DNA, 17 bp, H. sapiens
cctcccaaaatgctgga

SEQ ID NO: 79902 - DNA, 16 bp, H. sapiens
cctcccaaagatgtcc

SEQ ID NO: 79903 - DNA, 16 bp, H. sapiens
cctcccaaagcagtgg

SEQ ID NO: 79904 - DNA, 16 bp, H. sapiens
cctcccaaagcgccgg

SEQ ID NO: 79905 - DNA, 16 bp, H. sapiens
cctcccaaaggactgg

SEQ ID NO: 79906 - DNA, 16 bp, H. sapiens
cctcccaaaggctcca

SEQ ID NO: 79907 - DNA, 16 bp, H. sapiens
cctcccaaagggctag

SEQ ID NO: 79908 - DNA, 16 bp, H. sapiens
cctcccaaagtgccca

SEQ ID NO: 79909 - DNA, 16 bp, H. sapiens
cctcccaaagtgctat

SEQ ID NO: 79910 - DNA, 16 bp, H. sapiens
cctcccaaagtgctgc

SEQ ID NO: 79911 - DNA, 16 bp, H. sapiens
cctcccaaagtgctgt

SEQ ID NO: 79912 - DNA, 16 bp, H. sapiens
cctcccaaataaacca

SEQ ID NO: 79913 - DNA, 16 bp, H. sapiens
cctcccaaatagatgg

SEQ ID NO: 79914 - DNA, 16 bp, H. sapiens
cctcccaaatgcccca

SEQ ID NO: 79915 - DNA, 16 bp, H. sapiens
cctcccaacctcaggt

SEQ ID NO: 79916 - DNA, 16 bp, H. sapiens
cctcccaacgtgctga

SEQ ID NO: 79917 - DNA, 16 bp, H. sapiens
cctcccaagactcaac

SEQ ID NO: 79918 - DNA, 16 bp, H. sapiens
cctcccaagcagctgc

SEQ ID NO: 79919 - DNA, 16 bp, H. sapiens
cctcccaaggctaaac

SEQ ID NO: 79920 - DNA, 16 bp, H. sapiens
cctcccaaggctcagg

SEQ ID NO: 79921 - DNA, 16 bp, H. sapiens
cctcccaagtaagtag

SEQ ID NO: 79922 - DNA, 16 bp, H. sapiens
cctcccaagtctctgg

SEQ ID NO: 79923 - DNA, 16 bp, H. sapiens
cctcccaagtgactgg

SEQ ID NO: 79924 - DNA, 16 bp, H. sapiens
cctcccaagttcatgc

SEQ ID NO: 79925 - DNA, 16 bp, H. sapiens
cctcccaagtttaagc

SEQ ID NO: 79926 - DNA, 16 bp, H. sapiens
cctcccaatggatcct

SEQ ID NO: 79927 - DNA, 16 bp, H. sapiens
cctcccacagacccca

SEQ ID NO: 79928 - DNA, 16 bp, H. sapiens
cctcccacagcacatg

SEQ ID NO: 79929 - DNA, 16 bp, H. sapiens
cctcccacagcgctgg

SEQ ID NO: 79930 - DNA, 16 bp, H. sapiens
cctcccacagtgctga

SEQ ID NO: 79931 - DNA, 16 bp, H. sapiens
cctcccacatcggcct

SEQ ID NO: 79932 - DNA, 16 bp, H. sapiens
cctcccaccacacctg

SEQ ID NO: 79933 - DNA, 16 bp, H. sapiens
cctcccaccacaggcc

SEQ ID NO: 79934 - DNA, 16 bp, H. sapiens
cctcccaccagaccct

SEQ ID NO: 79935 - DNA, 16 bp, H. sapiens
cctcccaccagatccc

SEQ ID NO: 79936 - DNA, 16 bp, H. sapiens
cctcccaccagctcct

SEQ ID NO: 79937 - DNA, 16 bp, H. sapiens
cctcccaccaggcacc

SEQ ID NO: 79938 - DNA, 16 bp, H. sapiens
cctcccaccaggccct

SEQ ID NO: 79939 - DNA, 16 bp, H. sapiens
cctcccaccagggccc

SEQ ID NO: 79940 - DNA, 16 bp, H. sapiens
cctcccaccaggtgcc

SEQ ID NO: 79941 - DNA, 16 bp, H. sapiens
cctcccacccctgctg

SEQ ID NO: 79942 - DNA, 16 bp, H. sapiens
cctcccacctaaacct

SEQ ID NO: 79943 - DNA, 16 bp, H. sapiens
cctcccacctcagctg

SEQ ID NO: 79944 - DNA, 16 bp, H. sapiens
cctcccacctcccagg

SEQ ID NO: 79945 - DNA, 17 bp, H. sapiens
cctcccacctcggcctg

SEQ ID NO: 79946 - DNA, 16 bp, H. sapiens
cctcccacctctgcct

SEQ ID NO: 79947 - DNA, 16 bp, H. sapiens
cctcccacctgtccct

SEQ ID NO: 79948 - DNA, 16 bp, H. sapiens
cctcccacctgtcctc

SEQ ID NO: 79949 - DNA, 16 bp, H. sapiens
cctcccaccttctgcc

SEQ ID NO: 79950 - DNA, 16 bp, H. sapiens
cctcccaccttgacct

SEQ ID NO: 79951 - DNA, 16 bp, H. sapiens
cctcccaccttggtct

SEQ ID NO: 79952 - DNA, 16 bp, H. sapiens
cctcccacggggtccc

SEQ ID NO: 79953 - DNA, 16 bp, H. sapiens
cctcccacgtggctgg

SEQ ID NO: 79954 - DNA, 16 bp, H. sapiens
cctcccactaggctcc

SEQ ID NO: 79955 - DNA, 16 bp, H. sapiens
cctcccactgggcccc

SEQ ID NO: 79956 - DNA, 16 bp, H. sapiens
cctcccagactcaggc

SEQ ID NO: 79957 - DNA, 16 bp, H. sapiens
cctcccagagcactgg

SEQ ID NO: 79958 - DNA, 18 bp, H. sapiens
cctcccagatggggcggc

SEQ ID NO: 79959 - DNA, 16 bp, H. sapiens
cctcccagattaaagc

SEQ ID NO: 79960 - DNA, 16 bp, H. sapiens
cctcccagattcacgc

SEQ ID NO: 79961 - DNA, 16 bp, H. sapiens
cctcccagcacctcca

SEQ ID NO: 79962 - DNA, 16 bp, H. sapiens
cctcccagcagcccca

SEQ ID NO: 79963 - DNA, 16 bp, H. sapiens
cctcccagcagcctcc

SEQ ID NO: 79964 - DNA, 16 bp, H. sapiens
cctcccagccagggcc

SEQ ID NO: 79965 - DNA, 16 bp, H. sapiens
cctcccagcccagcct

SEQ ID NO: 79966 - DNA, 16 bp, H. sapiens
cctcccagccccaggc

SEQ ID NO: 79967 - DNA, 16 bp, H. sapiens
cctcccagccctgcag

SEQ ID NO: 79968 - DNA, 16 bp, H. sapiens
cctcccagccctgcca

SEQ ID NO: 79969 - DNA, 16 bp, H. sapiens
cctcccagccctgcct

SEQ ID NO: 79970 - DNA, 16 bp, H. sapiens
cctcccagccctggcc

SEQ ID NO: 79971 - DNA, 16 bp, H. sapiens
cctcccagctcaccct

SEQ ID NO: 79972 - DNA, 16 bp, H. sapiens
cctcccagctcccagc

SEQ ID NO: 79973 - DNA, 16 bp, H. sapiens
cctcccagctcctggc

SEQ ID NO: 79974 - DNA, 16 bp, H. sapiens
cctcccagctcggcct

SEQ ID NO: 79975 - DNA, 16 bp, H. sapiens
cctcccagctgagcct

SEQ ID NO: 79976 - DNA, 16 bp, H. sapiens
cctcccagcttcaagc

SEQ ID NO: 79977 - DNA, 16 bp, H. sapiens
cctcccaggatcaagc

SEQ ID NO: 79978 - DNA, 16 bp, H. sapiens
cctcccaggccagccc

SEQ ID NO: 79979 - DNA, 16 bp, H. sapiens
cctcccaggccccagc

SEQ ID NO: 79980 - DNA, 16 bp, H. sapiens
cctcccaggctaagcc

SEQ ID NO: 79981 - DNA, 16 bp, H. sapiens
cctcccaggctcaatc

SEQ ID NO: 79982 - DNA, 16 bp, H. sapiens
cctcccaggctcaggc

SEQ ID NO: 79983 - DNA, 16 bp, H. sapiens
cctcccagggcctggg

SEQ ID NO: 79984 - DNA, 16 bp, H. sapiens
cctcccagggctcaag

SEQ ID NO: 79985 - DNA, 16 bp, H. sapiens
cctcccagggctcctg

SEQ ID NO: 79986 - DNA, 16 bp, H. sapiens
cctcccaggtacaagc

SEQ ID NO: 79987 - DNA, 16 bp, H. sapiens
cctcccaggtccaagc

SEQ ID NO: 79988 - DNA, 16 bp, H. sapiens
cctcccaggttcaaac

SEQ ID NO: 79989 - DNA, 16 bp, H. sapiens
cctcccaggttcacac

SEQ ID NO: 79990 - DNA, 17 bp, H. sapiens
cctcccaggttcacgcc

SEQ ID NO: 79991 - DNA, 16 bp, H. sapiens
cctcccaggttcatgc

SEQ ID NO: 79992 - DNA, 16 bp, H. sapiens
cctcccaggttcatgt

SEQ ID NO: 79993 - DNA, 17 bp, H. sapiens
cctcccaggttcccgcc

SEQ ID NO: 79994 - DNA, 16 bp, H. sapiens
cctcccaggttcctgc

SEQ ID NO: 79995 - DNA, 16 bp, H. sapiens
cctcccaggttgaagc

SEQ ID NO: 79996 - DNA, 16 bp, H. sapiens
cctcccaggttgacgc

SEQ ID NO: 79997 - DNA, 16 bp, H. sapiens
cctcccaggtttaagc

SEQ ID NO: 79998 - DNA, 16 bp, H. sapiens
cctcccagtagaggcc

SEQ ID NO: 79999 - DNA, 16 bp, H. sapiens
cctcccatcaggccct

SEQ ID NO: 80000 - DNA, 16 bp, H. sapiens
cctcccatccatccat

SEQ ID NO: 80001 - DNA, 16 bp, H. sapiens
cctcccatgacacatg

SEQ ID NO: 80002 - DNA, 16 bp, H. sapiens
cctcccatggctcccc

SEQ ID NO: 80003 - DNA, 16 bp, H. sapiens
cctcccatgttcaagc

SEQ ID NO: 80004 - DNA, 16 bp, H. sapiens
cctcccattacaggcc

SEQ ID NO: 80005 - DNA, 16 bp, H. sapiens
cctcccattggccaaa

SEQ ID NO: 80006 - DNA, 16 bp, H. sapiens
cctccccaaattgctc

SEQ ID NO: 80007 - DNA, 16 bp, H. sapiens
cctccccaaccagaga

SEQ ID NO: 80008 - DNA, 16 bp, H. sapiens
cctccccacaagcaga

SEQ ID NO: 80009 - DNA, 16 bp, H. sapiens
cctccccacccttgag

SEQ ID NO: 80010 - DNA, 16 bp, H. sapiens
cctccccacctccagg

SEQ ID NO: 80011 - DNA, 16 bp, H. sapiens
cctccccactgcagcc

SEQ ID NO: 80012 - DNA, 16 bp, H. sapiens
cctccccactgcccag

SEQ ID NO: 80013 - DNA, 16 bp, H. sapiens
cctccccagaagccat

SEQ ID NO: 80014 - DNA, 16 bp, H. sapiens
cctccccagactccaa

SEQ ID NO: 80015 - DNA, 16 bp, H. sapiens
cctccccagaggctgg

SEQ ID NO: 80016 - DNA, 16 bp, H. sapiens
cctccccagcatctgt

SEQ ID NO: 80017 - DNA, 16 bp, H. sapiens
cctccccagccacact

SEQ ID NO: 80018 - DNA, 16 bp, H. sapiens
cctccccagccaggca

SEQ ID NO: 80019 - DNA, 17 bp, H. sapiens
cctccccagccatgctg

SEQ ID NO: 80020 - DNA, 16 bp, H. sapiens
cctccccagcccaggc

SEQ ID NO: 80021 - DNA, 16 bp, H. sapiens
cctccccagccctcag

SEQ ID NO: 80022 - DNA, 16 bp, H. sapiens
cctccccagccctgct

SEQ ID NO: 80023 - DNA, 16 bp, H. sapiens
cctccccagccctggg

SEQ ID NO: 80024 - DNA, 16 bp, H. sapiens
cctccccagctcaagt

SEQ ID NO: 80025 - DNA, 16 bp, H. sapiens
cctccccagctcccag

SEQ ID NO: 80026 - DNA, 16 bp, H. sapiens
cctccccagctctgca

SEQ ID NO: 80027 - DNA, 16 bp, H. sapiens
cctccccagctgctgc

SEQ ID NO: 80028 - DNA, 16 bp, H. sapiens
cctccccagctgtgtg

SEQ ID NO: 80029 - DNA, 16 bp, H. sapiens
cctccccaggcccagc

SEQ ID NO: 80030 - DNA, 16 bp, H. sapiens
cctccccaggcctcca

SEQ ID NO: 80031 - DNA, 16 bp, H. sapiens
cctccccaggctcaga

SEQ ID NO: 80032 - DNA, 16 bp, H. sapiens
cctccccaggtgctgg

SEQ ID NO: 80033 - DNA, 16 bp, H. sapiens
cctccccagtccccag

SEQ ID NO: 80034 - DNA, 16 bp, H. sapiens
cctccccagtggctgg

SEQ ID NO: 80035 - DNA, 16 bp, H. sapiens
cctccccagttcaagc

SEQ ID NO: 80036 - DNA, 16 bp, H. sapiens
cctccccatcagcctg

SEQ ID NO: 80037 - DNA, 16 bp, H. sapiens
cctccccatctcccag

SEQ ID NO: 80038 - DNA, 16 bp, H. sapiens
cctccccatggggcag

SEQ ID NO: 80039 - DNA, 16 bp, H. sapiens
cctccccattccccag

SEQ ID NO: 80040 - DNA, 16 bp, H. sapiens
cctcccccagcacaca

SEQ ID NO: 80041 - DNA, 16 bp, H. sapiens
cctcccccagccaagg

SEQ ID NO: 80042 - DNA, 16 bp, H. sapiens
cctcccccagccaggc

SEQ ID NO: 80043 - DNA, 16 bp, H. sapiens
cctcccccagcccaga

SEQ ID NO: 80044 - DNA, 16 bp, H. sapiens
cctcccccagcctcag

SEQ ID NO: 80045 - DNA, 16 bp, H. sapiens
cctcccccagcctctg

SEQ ID NO: 80046 - DNA, 16 bp, H. sapiens
cctcccccagcctggc

SEQ ID NO: 80047 - DNA, 16 bp, H. sapiens
cctcccccagctccag

SEQ ID NO: 80048 - DNA, 16 bp, H. sapiens
cctcccccaggaagcc

SEQ ID NO: 80049 - DNA, 16 bp, H. sapiens
cctcccccaggccctg

SEQ ID NO: 80050 - DNA, 16 bp, H. sapiens
cctcccccaggcctgg

SEQ ID NO: 80051 - DNA, 16 bp, H. sapiens
cctcccccagggtccc

SEQ ID NO: 80052 - DNA, 16 bp, H. sapiens
cctcccccagttcctc

SEQ ID NO: 80053 - DNA, 16 bp, H. sapiens
cctccccccaaaaaat

SEQ ID NO: 80054 - DNA, 16 bp, H. sapiens
cctccccctgcaaaaa

SEQ ID NO: 80055 - DNA, 16 bp, H. sapiens
cctcccccttttagac

SEQ ID NO: 80056 - DNA, 16 bp, H. sapiens
cctccccgcagggcag

SEQ ID NO: 80057 - DNA, 16 bp, H. sapiens
cctccccggttcaagc

SEQ ID NO: 80058 - DNA, 16 bp, H. sapiens
cctccccggttccagc

SEQ ID NO: 80059 - DNA, 16 bp, H. sapiens
cctcccctccatcctg

SEQ ID NO: 80060 - DNA, 16 bp, H. sapiens
cctcccctccccagga

SEQ ID NO: 80061 - DNA, 16 bp, H. sapiens
cctcccctcctgagcc

SEQ ID NO: 80062 - DNA, 16 bp, H. sapiens
cctcccctctctgagc

SEQ ID NO: 80063 - DNA, 16 bp, H. sapiens
cctcccctgcctgggc

SEQ ID NO: 80064 - DNA, 16 bp, H. sapiens
cctcccctgctgcagc

SEQ ID NO: 80065 - DNA, 16 bp, H. sapiens
cctcccctggccctgg

SEQ ID NO: 80066 - DNA, 16 bp, H. sapiens
cctcccctggctctgt

SEQ ID NO: 80067 - DNA, 16 bp, H. sapiens
cctccccttcagcctc

SEQ ID NO: 80068 - DNA, 16 bp, H. sapiens
cctcccgaagtgatgg

SEQ ID NO: 80069 - DNA, 16 bp, H. sapiens
cctcccgaattcaagc

SEQ ID NO: 80070 - DNA, 16 bp, H. sapiens
cctcccgagtagttgg

SEQ ID NO: 80071 - DNA, 16 bp, H. sapiens
cctcccgagtgcctgg

SEQ ID NO: 80072 - DNA, 19 bp, H. sapiens
cctcccgagtggctgggac

SEQ ID NO: 80073 - DNA, 16 bp, H. sapiens
cctcccgccaggtccc

SEQ ID NO: 80074 - DNA, 16 bp, H. sapiens
cctcccgcctcccagg

SEQ ID NO: 80075 - DNA, 16 bp, H. sapiens
cctcccgctttggcct

SEQ ID NO: 80076 - DNA, 18 bp, H. sapiens
cctcccggacgaggcggc

SEQ ID NO: 80077 - DNA, 16 bp, H. sapiens
cctcccggatttaagc

SEQ ID NO: 80078 - DNA, 16 bp, H. sapiens
cctcccggcagcctct

SEQ ID NO: 80079 - DNA, 16 bp, H. sapiens
cctcccggctcagcct

SEQ ID NO: 80080 - DNA, 16 bp, H. sapiens
cctcccgggctcaagc

SEQ ID NO: 80081 - DNA, 16 bp, H. sapiens
cctcccgggctgaagc

SEQ ID NO: 80082 - DNA, 16 bp, H. sapiens
cctcccgggcttaagc

SEQ ID NO: 80083 - DNA, 17 bp, H. sapiens
cctcccgggttcacacc

SEQ ID NO: 80084 - DNA, 16 bp, H. sapiens
cctcccgggttcaccc

SEQ ID NO: 80085 - DNA, 16 bp, H. sapiens
cctcccgggttcacga

SEQ ID NO: 80086 - DNA, 17 bp, H. sapiens
cctcccgggttcacgcc

SEQ ID NO: 80087 - DNA, 16 bp, H. sapiens
cctcccgggttcagga

SEQ ID NO: 80088 - DNA, 16 bp, H. sapiens
cctcccgggttcatgc

SEQ ID NO: 80089 - DNA, 16 bp, H. sapiens
cctcccgggttcatgg

SEQ ID NO: 80090 - DNA, 16 bp, H. sapiens
cctcccgggttcccac

SEQ ID NO: 80091 - DNA, 16 bp, H. sapiens
cctcccgggttcctgc

SEQ ID NO: 80092 - DNA, 16 bp, H. sapiens
cctcccgggtttaagc

SEQ ID NO: 80093 - DNA, 16 bp, H. sapiens
cctcccggttcacgcc

SEQ ID NO: 80094 - DNA, 16 bp, H. sapiens
cctcccgtactcctgg

SEQ ID NO: 80095 - DNA, 16 bp, H. sapiens
cctcccgtgttcaagc

SEQ ID NO: 80096 - DNA, 17 bp, H. sapiens
cctcccgtgttcacacc

SEQ ID NO: 80097 - DNA, 16 bp, H. sapiens
cctccctaaaactaac

SEQ ID NO: 80098 - DNA, 16 bp, H. sapiens
cctccctaactccttt

SEQ ID NO: 80099 - DNA, 16 bp, H. sapiens
cctccctcaacacctg

SEQ ID NO: 80100 - DNA, 16 bp, H. sapiens
cctccctcacagccat

SEQ ID NO: 80101 - DNA, 16 bp, H. sapiens
cctccctcagcctgcc

SEQ ID NO: 80102 - DNA, 16 bp, H. sapiens
cctccctccacacctg

SEQ ID NO: 80103 - DNA, 16 bp, H. sapiens
cctccctccagccctt

SEQ ID NO: 80104 - DNA, 16 bp, H. sapiens
cctccctccagggccc

SEQ ID NO: 80105 - DNA, 16 bp, H. sapiens
cctccctccaggtccc

SEQ ID NO: 80106 - DNA, 16 bp, H. sapiens
cctccctcccagctgc

SEQ ID NO: 80107 - DNA, 16 bp, H. sapiens
cctccctcccatgctc

SEQ ID NO: 80108 - DNA, 16 bp, H. sapiens
cctccctccctgcagc

SEQ ID NO: 80109 - DNA, 16 bp, H. sapiens
cctccctccctgggct

SEQ ID NO: 80110 - DNA, 16 bp, H. sapiens
cctccctcctcctgag

SEQ ID NO: 80111 - DNA, 16 bp, H. sapiens
cctccctcctgcctca

SEQ ID NO: 80112 - DNA, 16 bp, H. sapiens
cctccctcctggctgg

SEQ ID NO: 80113 - DNA, 16 bp, H. sapiens
cctccctcctggctgt

SEQ ID NO: 80114 - DNA, 16 bp, H. sapiens
cctccctcctgggcct

SEQ ID NO: 80115 - DNA, 16 bp, H. sapiens
cctccctccttggctt

SEQ ID NO: 80116 - DNA, 16 bp, H. sapiens
cctccctctcccaggc

SEQ ID NO: 80117 - DNA, 16 bp, H. sapiens
cctccctctgaccctg

SEQ ID NO: 80118 - DNA, 16 bp, H. sapiens
cctccctctgggtccc

SEQ ID NO: 80119 - DNA, 16 bp, H. sapiens
cctccctctgtgcctg

SEQ ID NO: 80120 - DNA, 16 bp, H. sapiens
cctccctgaccagaga

SEQ ID NO: 80121 - DNA, 16 bp, H. sapiens
cctccctgagaaggtg

SEQ ID NO: 80122 - DNA, 16 bp, H. sapiens
cctccctgagacagag

SEQ ID NO: 80123 - DNA, 16 bp, H. sapiens
cctccctgagcctcag

SEQ ID NO: 80124 - DNA, 16 bp, H. sapiens
cctccctgagcctcca

SEQ ID NO: 80125 - DNA, 16 bp, H. sapiens
cctccctgcccccatt

SEQ ID NO: 80126 - DNA, 16 bp, H. sapiens
cctccctgccctccag

SEQ ID NO: 80127 - DNA, 16 bp, H. sapiens
cctccctgccctgggc

SEQ ID NO: 80128 - DNA, 16 bp, H. sapiens
cctccctgcctcaggc

SEQ ID NO: 80129 - DNA, 16 bp, H. sapiens
cctccctgcctccact

SEQ ID NO: 80130 - DNA, 16 bp, H. sapiens
cctccctgctcccagc

SEQ ID NO: 80131 - DNA, 16 bp, H. sapiens
cctccctgctctgtgc

SEQ ID NO: 80132 - DNA, 16 bp, H. sapiens
cctccctgctgcagcc

SEQ ID NO: 80133 - DNA, 16 bp, H. sapiens
cctccctgctgggctg

SEQ ID NO: 80134 - DNA, 16 bp, H. sapiens
cctccctggaagcaga

SEQ ID NO: 80135 - DNA, 16 bp, H. sapiens
cctccctggacctcag

SEQ ID NO: 80136 - DNA, 16 bp, H. sapiens
cctccctggactcagg

SEQ ID NO: 80137 - DNA, 16 bp, H. sapiens
cctccctggcagctgg

SEQ ID NO: 80138 - DNA, 16 bp, H. sapiens
cctccctggccatgct

SEQ ID NO: 80139 - DNA, 16 bp, H. sapiens
cctccctggccccagc

SEQ ID NO: 80140 - DNA, 16 bp, H. sapiens
cctccctggccctcag

SEQ ID NO: 80141 - DNA, 16 bp, H. sapiens
cctccctggcctgaag

SEQ ID NO: 80142 - DNA, 16 bp, H. sapiens
cctccctggctcctgg

SEQ ID NO: 80143 - DNA, 16 bp, H. sapiens
cctccctgggccccag

SEQ ID NO: 80144 - DNA, 16 bp, H. sapiens
cctccctgggcctctc

SEQ ID NO: 80145 - DNA, 16 bp, H. sapiens
cctccctgggccttgg

SEQ ID NO: 80146 - DNA, 16 bp, H. sapiens
cctccctgggctcctg

SEQ ID NO: 80147 - DNA, 16 bp, H. sapiens
cctccctggtagctag

SEQ ID NO: 80148 - DNA, 16 bp, H. sapiens
cctccctggttcaagc

SEQ ID NO: 80149 - DNA, 16 bp, H. sapiens
cctccctgtatccaag

SEQ ID NO: 80150 - DNA, 16 bp, H. sapiens
cctccctgtatccatg

SEQ ID NO: 80151 - DNA, 16 bp, H. sapiens
cctccctgtctcccca

SEQ ID NO: 80152 - DNA, 16 bp, H. sapiens
cctccctgtgtccctg

SEQ ID NO: 80153 - DNA, 16 bp, H. sapiens
cctcccttagcctcct

SEQ ID NO: 80154 - DNA, 16 bp, H. sapiens
cctcccttatccatgg

SEQ ID NO: 80155 - DNA, 16 bp, H. sapiens
cctcccttcctatttg

SEQ ID NO: 80156 - DNA, 16 bp, H. sapiens
cctcccttcctggctt

SEQ ID NO: 80157 - DNA, 16 bp, H. sapiens
cctccctttcactgtt

SEQ ID NO: 80158 - DNA, 16 bp, H. sapiens
cctccgccacctgggt

SEQ ID NO: 80159 - DNA, 16 bp, H. sapiens
cctccgcccagcagcc

SEQ ID NO: 80160 - DNA, 16 bp, H. sapiens
cctccgccccctgggt

SEQ ID NO: 80161 - DNA, 16 bp, H. sapiens
cctccgcctccagagt

SEQ ID NO: 80162 - DNA, 16 bp, H. sapiens
cctccgcctcccaaac

SEQ ID NO: 80163 - DNA, 16 bp, H. sapiens
cctccgcctcccgagc

SEQ ID NO: 80164 - DNA, 16 bp, H. sapiens
cctccgcctcccgagt

SEQ ID NO: 80165 - DNA, 20 bp, H. sapiens
cctccgcctcccgggttcat

SEQ ID NO: 80166 - DNA, 16 bp, H. sapiens
cctccgcctcctggtt

SEQ ID NO: 80167 - DNA, 16 bp, H. sapiens
cctccgcctgctgggt

SEQ ID NO: 80168 - DNA, 16 bp, H. sapiens
cctccgccttccggat

SEQ ID NO: 80169 - DNA, 16 bp, H. sapiens
cctccggccttggcct

SEQ ID NO: 80170 - DNA, 16 bp, H. sapiens
cctccggcgcacaggg

SEQ ID NO: 80171 - DNA, 16 bp, H. sapiens
cctccgggttcacgcc

SEQ ID NO: 80172 - DNA, 16 bp, H. sapiens
cctccgtctcaaaaaa

SEQ ID NO: 80173 - DNA, 18 bp, H. sapiens
cctccgtctcaaaaaaaa

SEQ ID NO: 80174 - DNA, 18 bp, H. sapiens
cctccgtctctactaaaa

SEQ ID NO: 80175 - DNA, 16 bp, H. sapiens
cctcctaaggagctgg

SEQ ID NO: 80176 - DNA, 16 bp, H. sapiens
cctcctaccacagcct

SEQ ID NO: 80177 - DNA, 16 bp, H. sapiens
cctcctacttcggcct

SEQ ID NO: 80178 - DNA, 16 bp, H. sapiens
cctcctaggctcaagg

SEQ ID NO: 80179 - DNA, 16 bp, H. sapiens
cctcctatcttggcct

SEQ ID NO: 80180 - DNA, 16 bp, H. sapiens
cctcctatgttttctt

SEQ ID NO: 80181 - DNA, 16 bp, H. sapiens
cctcctcaacctcctg

SEQ ID NO: 80182 - DNA, 16 bp, H. sapiens
cctcctcaaccttggc

SEQ ID NO: 80183 - DNA, 16 bp, H. sapiens
cctcctcaagctcatc

SEQ ID NO: 80184 - DNA, 16 bp, H. sapiens
cctcctcaatttcttt

SEQ ID NO: 80185 - DNA, 16 bp, H. sapiens
cctcctcactgctgag

SEQ ID NO: 80186 - DNA, 16 bp, H. sapiens
cctcctcactggcctc

SEQ ID NO: 80187 - DNA, 16 bp, H. sapiens
cctcctcagaagaaaa

SEQ ID NO: 80188 - DNA, 16 bp, H. sapiens
cctcctcagagaagcc

SEQ ID NO: 80189 - DNA, 16 bp, H. sapiens
cctcctcagaggaaag

SEQ ID NO: 80190 - DNA, 16 bp, H. sapiens
cctcctcagccagggc

SEQ ID NO: 80191 - DNA, 16 bp, H. sapiens
cctcctcagcccctca

SEQ ID NO: 80192 - DNA, 16 bp, H. sapiens
cctcctcagcctccag

SEQ ID NO: 80193 - DNA, 16 bp, H. sapiens
cctcctcagcctccga

SEQ ID NO: 80194 - DNA, 16 bp, H. sapiens
cctcctcagcctctga

SEQ ID NO: 80195 - DNA, 16 bp, H. sapiens
cctcctcagcctctgc

SEQ ID NO: 80196 - DNA, 16 bp, H. sapiens
cctcctcagcctggac

SEQ ID NO: 80197 - DNA, 16 bp, H. sapiens
cctcctcagtctccca

SEQ ID NO: 80198 - DNA, 16 bp, H. sapiens
cctcctcatccttcaa

SEQ ID NO: 80199 - DNA, 16 bp, H. sapiens
cctcctccaacactgg

SEQ ID NO: 80200 - DNA, 16 bp, H. sapiens
cctcctccaagaagcc

SEQ ID NO: 80201 - DNA, 16 bp, H. sapiens
cctcctccacctcctg

SEQ ID NO: 80202 - DNA, 16 bp, H. sapiens
cctcctccacctctgc

SEQ ID NO: 80203 - DNA, 16 bp, H. sapiens
cctcctccacctgggg

SEQ ID NO: 80204 - DNA, 16 bp, H. sapiens
cctcctccagaaagcc

SEQ ID NO: 80205 - DNA, 16 bp, H. sapiens
cctcctccagcccctg

SEQ ID NO: 80206 - DNA, 16 bp, H. sapiens
cctcctccagcctcct

SEQ ID NO: 80207 - DNA, 16 bp, H. sapiens
cctcctccagcctctg

SEQ ID NO: 80208 - DNA, 16 bp, H. sapiens
cctcctccagctcctc

SEQ ID NO: 80209 - DNA, 16 bp, H. sapiens
cctcctccagctcctg

SEQ ID NO: 80210 - DNA, 16 bp, H. sapiens
cctcctccaggaagca

SEQ ID NO: 80211 - DNA, 16 bp, H. sapiens
cctcctccaggaagcc

SEQ ID NO: 80212 - DNA, 16 bp, H. sapiens
cctcctccaggcagcc

SEQ ID NO: 80213 - DNA, 16 bp, H. sapiens
cctcctccagggagcc

SEQ ID NO: 80214 - DNA, 16 bp, H. sapiens
cctcctccatcagcct

SEQ ID NO: 80215 - DNA, 16 bp, H. sapiens
cctcctccatgaagcc

SEQ ID NO: 80216 - DNA, 16 bp, H. sapiens
cctcctcccactgtcc

SEQ ID NO: 80217 - DNA, 16 bp, H. sapiens
cctcctcccagccctg

SEQ ID NO: 80218 - DNA, 16 bp, H. sapiens
cctcctcccagcctct

SEQ ID NO: 80219 - DNA, 16 bp, H. sapiens
cctcctccccagctct

SEQ ID NO: 80220 - DNA, 16 bp, H. sapiens
cctcctccccaggcct

SEQ ID NO: 80221 - DNA, 16 bp, H. sapiens
cctcctccccagttca

SEQ ID NO: 80222 - DNA, 18 bp, H. sapiens
cctcctcccccaggagct

SEQ ID NO: 80223 - DNA, 16 bp, H. sapiens
cctcctcccccaggat

SEQ ID NO: 80224 - DNA, 16 bp, H. sapiens
cctcctccctcagacc

SEQ ID NO: 80225 - DNA, 16 bp, H. sapiens
cctcctccctcagcct

SEQ ID NO: 80226 - DNA, 16 bp, H. sapiens
cctcctccctcagctc

SEQ ID NO: 80227 - DNA, 16 bp, H. sapiens
cctcctccctcctcag

SEQ ID NO: 80228 - DNA, 16 bp, H. sapiens
cctcctccctgcagcc

SEQ ID NO: 80229 - DNA, 16 bp, H. sapiens
cctcctccctgggcag

SEQ ID NO: 80230 - DNA, 16 bp, H. sapiens
cctcctccgggaagcc

SEQ ID NO: 80231 - DNA, 16 bp, H. sapiens
cctcctcctcaacttt

SEQ ID NO: 80232 - DNA, 16 bp, H. sapiens
cctcctcctccaaagg

SEQ ID NO: 80233 - DNA, 16 bp, H. sapiens
cctcctcctccagcct

SEQ ID NO: 80234 - DNA, 16 bp, H. sapiens
cctcctcctccaggca

SEQ ID NO: 80235 - DNA, 16 bp, H. sapiens
cctcctcctccaggga

SEQ ID NO: 80236 - DNA, 16 bp, H. sapiens
cctcctcctccagggc

SEQ ID NO: 80237 - DNA, 16 bp, H. sapiens
cctcctcctccagggt

SEQ ID NO: 80238 - DNA, 16 bp, H. sapiens
cctcctcctccaggtg

SEQ ID NO: 80239 - DNA, 16 bp, H. sapiens
cctcctcctccaggtt

SEQ ID NO: 80240 - DNA, 16 bp, H. sapiens
cctcctcctcccaagt

SEQ ID NO: 80241 - DNA, 16 bp, H. sapiens
cctcctcctcccagtt

SEQ ID NO: 80242 - DNA, 16 bp, H. sapiens
cctcctcctccccagg

SEQ ID NO: 80243 - DNA, 16 bp, H. sapiens
cctcctcctccccagt

SEQ ID NO: 80244 - DNA, 16 bp, H. sapiens
cctcctcctcccgagt

SEQ ID NO: 80245 - DNA, 16 bp, H. sapiens
cctcctcctcctgcca

SEQ ID NO: 80246 - DNA, 16 bp, H. sapiens
cctcctcctcctggga

SEQ ID NO: 80247 - DNA, 16 bp, H. sapiens
cctcctcctcctgggc

SEQ ID NO: 80248 - DNA, 16 bp, H. sapiens
cctcctcctctcccag

SEQ ID NO: 80249 - DNA, 16 bp, H. sapiens
cctcctcctctcgggt

SEQ ID NO: 80250 - DNA, 16 bp, H. sapiens
cctcctcctctctgca

SEQ ID NO: 80251 - DNA, 16 bp, H. sapiens
cctcctcctggaagcc

SEQ ID NO: 80252 - DNA, 16 bp, H. sapiens
cctcctcctggattca

SEQ ID NO: 80253 - DNA, 16 bp, H. sapiens
cctcctcctggctgct

SEQ ID NO: 80254 - DNA, 16 bp, H. sapiens
cctcctcctgggagcc

SEQ ID NO: 80255 - DNA, 16 bp, H. sapiens
cctcctcctgggagct

SEQ ID NO: 80256 - DNA, 16 bp, H. sapiens
cctcctcctggggctg

SEQ ID NO: 80257 - DNA, 16 bp, H. sapiens
cctcctcctgtcccca

SEQ ID NO: 80258 - DNA, 16 bp, H. sapiens
cctcctcgacctccca

SEQ ID NO: 80259 - DNA, 16 bp, H. sapiens
cctcctcggcctccaa

SEQ ID NO: 80260 - DNA, 16 bp, H. sapiens
cctcctcggcctctca

SEQ ID NO: 80261 - DNA, 16 bp, H. sapiens
cctcctctcagccaag

SEQ ID NO: 80262 - DNA, 16 bp, H. sapiens
cctcctctccagccct

SEQ ID NO: 80263 - DNA, 16 bp, H. sapiens
cctcctctccagcctc

SEQ ID NO: 80264 - DNA, 16 bp, H. sapiens
cctcctctccatctga

SEQ ID NO: 80265 - DNA, 16 bp, H. sapiens
cctcctctcccacctg

SEQ ID NO: 80266 - DNA, 16 bp, H. sapiens
cctcctctctcagacc

SEQ ID NO: 80267 - DNA, 16 bp, H. sapiens
cctcctctctccccag

SEQ ID NO: 80268 - DNA, 16 bp, H. sapiens
cctcctctctgctgag

SEQ ID NO: 80269 - DNA, 16 bp, H. sapiens
cctcctctctgggcag

SEQ ID NO: 80270 - DNA, 16 bp, H. sapiens
cctcctctgacaccac

SEQ ID NO: 80271 - DNA, 16 bp, H. sapiens
cctcctctgcctccca

SEQ ID NO: 80272 - DNA, 16 bp, H. sapiens
cctcctctgggaagcc

SEQ ID NO: 80273 - DNA, 16 bp, H. sapiens
cctcctctgggttccc

SEQ ID NO: 80274 - DNA, 16 bp, H. sapiens
cctcctctgtgcccag

SEQ ID NO: 80275 - DNA, 16 bp, H. sapiens
cctcctcttcctcagc

SEQ ID NO: 80276 - DNA, 16 bp, H. sapiens
cctcctcttctcagag

SEQ ID NO: 80277 - DNA, 16 bp, H. sapiens
cctcctcttctctgtg

SEQ ID NO: 80278 - DNA, 16 bp, H. sapiens
cctcctgaaagtggcc

SEQ ID NO: 80279 - DNA, 16 bp, H. sapiens
cctcctgaaggatctg

SEQ ID NO: 80280 - DNA, 20 bp, H. sapiens
cctcctgacctcaggtgatc

SEQ ID NO: 80281 - DNA, 16 bp, H. sapiens
cctcctgactggaaga

SEQ ID NO: 80282 - DNA, 16 bp, H. sapiens
cctcctgagaagctgg

SEQ ID NO: 80283 - DNA, 16 bp, H. sapiens
cctcctgagcagccgg

SEQ ID NO: 80284 - DNA, 16 bp, H. sapiens
cctcctgagctctgcc

SEQ ID NO: 80285 - DNA, 16 bp, H. sapiens
cctcctgagggctgtg

SEQ ID NO: 80286 - DNA, 16 bp, H. sapiens
cctcctgagtagctaa

SEQ ID NO: 80287 - DNA, 16 bp, H. sapiens
cctcctgagtcactgg

SEQ ID NO: 80288 - DNA, 16 bp, H. sapiens
cctcctgagttcaagc

SEQ ID NO: 80289 - DNA, 16 bp, H. sapiens
cctcctgagttgaagt

SEQ ID NO: 80290 - DNA, 16 bp, H. sapiens
cctcctgatggggaga

SEQ ID NO: 80291 - DNA, 16 bp, H. sapiens
cctcctgcagagctgg

SEQ ID NO: 80292 - DNA, 16 bp, H. sapiens
cctcctgcagcctctg

SEQ ID NO: 80293 - DNA, 16 bp, H. sapiens
cctcctgcaggaagcc

SEQ ID NO: 80294 - DNA, 16 bp, H. sapiens
cctcctgcatcagcct

SEQ ID NO: 80295 - DNA, 16 bp, H. sapiens
cctcctgccacccctg

SEQ ID NO: 80296 - DNA, 16 bp, H. sapiens
cctcctgcccacagcc

SEQ ID NO: 80297 - DNA, 16 bp, H. sapiens
cctcctgcccagccca

SEQ ID NO: 80298 - DNA, 16 bp, H. sapiens
cctcctgccccagcat

SEQ ID NO: 80299 - DNA, 16 bp, H. sapiens
cctcctgccccaggct

SEQ ID NO: 80300 - DNA, 16 bp, H. sapiens
cctcctgccctgctgg

SEQ ID NO: 80301 - DNA, 16 bp, H. sapiens
cctcctgcctcagccg

SEQ ID NO: 80302 - DNA, 22 bp, H. sapiens
cctcctgcctcagcctcccaag

SEQ ID NO: 80303 - DNA, 21 bp, H. sapiens
cctcctgcctcagcctcccag

SEQ ID NO: 80304 - DNA, 21 bp, H. sapiens
cctcctgcctcagcctcccga

SEQ ID NO: 80305 - DNA, 19 bp, H. sapiens
cctcctgcctcagcctcct

SEQ ID NO: 80306 - DNA, 16 bp, H. sapiens
cctcctgcctcagggc

SEQ ID NO: 80307 - DNA, 16 bp, H. sapiens
cctcctgcctcagttt

SEQ ID NO: 80308 - DNA, 16 bp, H. sapiens
cctcctgcctccagct

SEQ ID NO: 80309 - DNA, 16 bp, H. sapiens
cctcctgcctcccaaa

SEQ ID NO: 80310 - DNA, 16 bp, H. sapiens
cctcctgcctcctggg

SEQ ID NO: 80311 - DNA, 16 bp, H. sapiens
cctcctgcctctgcca

SEQ ID NO: 80312 - DNA, 16 bp, H. sapiens
cctcctgcctctgctt

SEQ ID NO: 80313 - DNA, 16 bp, H. sapiens
cctcctgcctctggct

SEQ ID NO: 80314 - DNA, 16 bp, H. sapiens
cctcctgcctgctggg

SEQ ID NO: 80315 - DNA, 16 bp, H. sapiens
cctcctgcctgggcct

SEQ ID NO: 80316 - DNA, 16 bp, H. sapiens
cctcctgcctgggtct

SEQ ID NO: 80317 - DNA, 16 bp, H. sapiens
cctcctgctcagagtc

SEQ ID NO: 80318 - DNA, 16 bp, H. sapiens
cctcctgctccaacca

SEQ ID NO: 80319 - DNA, 16 bp, H. sapiens
cctcctgctcccacca

SEQ ID NO: 80320 - DNA, 16 bp, H. sapiens
cctcctgctcctgcca

SEQ ID NO: 80321 - DNA, 16 bp, H. sapiens
cctcctgctgccattc

SEQ ID NO: 80322 - DNA, 16 bp, H. sapiens
cctcctgctgctgcct

SEQ ID NO: 80323 - DNA, 16 bp, H. sapiens
cctcctgctgtgcagc

SEQ ID NO: 80324 - DNA, 20 bp, H. sapiens
cctcctgcttcagcctcccg

SEQ ID NO: 80325 - DNA, 16 bp, H. sapiens
cctcctgcttctgcct

SEQ ID NO: 80326 - DNA, 16 bp, H. sapiens
cctcctggactcaggc

SEQ ID NO: 80327 - DNA, 16 bp, H. sapiens
cctcctggagcctcag

SEQ ID NO: 80328 - DNA, 16 bp, H. sapiens
cctcctggagctgtgg

SEQ ID NO: 80329 - DNA, 16 bp, H. sapiens
cctcctggaggaggag

SEQ ID NO: 80330 - DNA, 16 bp, H. sapiens
cctcctggaggaggtg

SEQ ID NO: 80331 - DNA, 16 bp, H. sapiens
cctcctggagggagag

SEQ ID NO: 80332 - DNA, 16 bp, H. sapiens
cctcctggattcacgc

SEQ ID NO: 80333 - DNA, 16 bp, H. sapiens
cctcctggcctcagcc

SEQ ID NO: 80334 - DNA, 16 bp, H. sapiens
cctcctggcttcaagc

SEQ ID NO: 80335 - DNA, 16 bp, H. sapiens
cctcctgggaggtgtc

SEQ ID NO: 80336 - DNA, 16 bp, H. sapiens
cctcctgggcctccag

SEQ ID NO: 80337 - DNA, 17 bp, H. sapiens
cctcctgggctcaagca

SEQ ID NO: 80338 - DNA, 20 bp, H. sapiens
cctcctgggctcaagtgatt

SEQ ID NO: 80339 - DNA, 16 bp, H. sapiens
cctcctgggctccagc

SEQ ID NO: 80340 - DNA, 16 bp, H. sapiens
cctcctgggctggagg

SEQ ID NO: 80341 - DNA, 16 bp, H. sapiens
cctcctgggcttaagt

SEQ ID NO: 80342 - DNA, 16 bp, H. sapiens
cctcctggggctgctg

SEQ ID NO: 80343 - DNA, 16 bp, H. sapiens
cctcctggggttcaag

SEQ ID NO: 80344 - DNA, 16 bp, H. sapiens
cctcctgggtacaagc

SEQ ID NO: 80345 - DNA, 17 bp, H. sapiens
cctcctgggtagctgga

SEQ ID NO: 80346 - DNA, 16 bp, H. sapiens
cctcctgggtccctcc

SEQ ID NO: 80347 - DNA, 16 bp, H. sapiens
cctcctgggtctccag

SEQ ID NO: 80348 - DNA, 20 bp, H. sapiens
cctcctgggttcacaccatt

SEQ ID NO: 80349 - DNA, 17 bp, H. sapiens
cctcctgggttcacgcc

SEQ ID NO: 80350 - DNA, 16 bp, H. sapiens
cctcctgggttcacgt

SEQ ID NO: 80351 - DNA, 16 bp, H. sapiens
cctcctgggttcatgc

SEQ ID NO: 80352 - DNA, 16 bp, H. sapiens
cctcctgggttcatgt

SEQ ID NO: 80353 - DNA, 20 bp, H. sapiens
cctcctgggttcccgccatt

SEQ ID NO: 80354 - DNA, 16 bp, H. sapiens
cctcctgggttgaagc

SEQ ID NO: 80355 - DNA, 16 bp, H. sapiens
cctcctgggtttaagc

SEQ ID NO: 80356 - DNA, 16 bp, H. sapiens
cctcctgggttttaag

SEQ ID NO: 80357 - DNA, 16 bp, H. sapiens
cctcctggtggttctg

SEQ ID NO: 80358 - DNA, 16 bp, H. sapiens
cctcctggttcaagcg

SEQ ID NO: 80359 - DNA, 16 bp, H. sapiens
cctcctgtcactatca

SEQ ID NO: 80360 - DNA, 16 bp, H. sapiens
cctcctgtcagatcaa

SEQ ID NO: 80361 - DNA, 16 bp, H. sapiens
cctcctgtcagatcag

SEQ ID NO: 80362 - DNA, 16 bp, H. sapiens
cctcctgtctcagctt

SEQ ID NO: 80363 - DNA, 16 bp, H. sapiens
cctcctgtctctggcc

SEQ ID NO: 80364 - DNA, 16 bp, H. sapiens
cctcctgtgacatgtg

SEQ ID NO: 80365 - DNA, 16 bp, H. sapiens
cctcctgtgtcagcct

SEQ ID NO: 80366 - DNA, 16 bp, H. sapiens
cctcctgttctggcca

SEQ ID NO: 80367 - DNA, 16 bp, H. sapiens
cctcctgttgtgtggc

SEQ ID NO: 80368 - DNA, 16 bp, H. sapiens
cctccttcagcctccc

SEQ ID NO: 80369 - DNA, 16 bp, H. sapiens
cctccttcaggaagcc

SEQ ID NO: 80370 - DNA, 16 bp, H. sapiens
cctccttcccagctgc

SEQ ID NO: 80371 - DNA, 16 bp, H. sapiens
cctccttcctccagcc

SEQ ID NO: 80372 - DNA, 16 bp, H. sapiens
cctccttcctgaggcc

SEQ ID NO: 80373 - DNA, 16 bp, H. sapiens
cctccttcctgcctgg

SEQ ID NO: 80374 - DNA, 16 bp, H. sapiens
cctccttcctgggcct

SEQ ID NO: 80375 - DNA, 16 bp, H. sapiens
cctccttcctgggctc

SEQ ID NO: 80376 - DNA, 16 bp, H. sapiens
cctccttccttcccag

SEQ ID NO: 80377 - DNA, 16 bp, H. sapiens
cctccttggcctcggc

SEQ ID NO: 80378 - DNA, 16 bp, H. sapiens
cctccttggccttggc

SEQ ID NO: 80379 - DNA, 16 bp, H. sapiens
cctccttgggcctcag

SEQ ID NO: 80380 - DNA, 16 bp, H. sapiens
cctccttggtgactga

SEQ ID NO: 80381 - DNA, 16 bp, H. sapiens
cctccttgtcctccgg

SEQ ID NO: 80382 - DNA, 16 bp, H. sapiens
cctccttgtgcctcag

SEQ ID NO: 80383 - DNA, 16 bp, H. sapiens
cctccttgtgcctctg

SEQ ID NO: 80384 - DNA, 16 bp, H. sapiens
cctcctttctcagcag

SEQ ID NO: 80385 - DNA, 16 bp, H. sapiens
cctcgacctcccagac

SEQ ID NO: 80386 - DNA, 16 bp, H. sapiens
cctcgacctcccgaag

SEQ ID NO: 80387 - DNA, 16 bp, H. sapiens
cctcgacctcctggtc

SEQ ID NO: 80388 - DNA, 16 bp, H. sapiens
cctcgcagccctcgct

SEQ ID NO: 80389 - DNA, 16 bp, H. sapiens
cctcgcccagctaatt

SEQ ID NO: 80390 - DNA, 16 bp, H. sapiens
cctcgctggatcagaa

SEQ ID NO: 80391 - DNA, 16 bp, H. sapiens
cctcggccccctgagt

SEQ ID NO: 80392 - DNA, 16 bp, H. sapiens
cctcggcctcccaaat

SEQ ID NO: 80393 - DNA, 16 bp, H. sapiens
cctcggcctcccaagc

SEQ ID NO: 80394 - DNA, 16 bp, H. sapiens
cctcggcctcccagtg

SEQ ID NO: 80395 - DNA, 16 bp, H. sapiens
cctcggcctccctgag

SEQ ID NO: 80396 - DNA, 16 bp, H. sapiens
cctcggcctcctgggc

SEQ ID NO: 80397 - DNA, 16 bp, H. sapiens
cctcggcctcggcctc

SEQ ID NO: 80398 - DNA, 17 bp, H. sapiens
cctcggcgacagagcaa

SEQ ID NO: 80399 - DNA, 16 bp, H. sapiens
cctcggcttcctgaag

SEQ ID NO: 80400 - DNA, 16 bp, H. sapiens
cctcgtctgggaggtg

SEQ ID NO: 80401 - DNA, 16 bp, H. sapiens
cctcgtgatcctccct

SEQ ID NO: 80402 - DNA, 16 bp, H. sapiens
cctcgtgttccacctg

SEQ ID NO: 80403 - DNA, 16 bp, H. sapiens
cctctaactcctgagc

SEQ ID NO: 80404 - DNA, 16 bp, H. sapiens
cctctaataaattttt

SEQ ID NO: 80405 - DNA, 16 bp, H. sapiens
cctctacaaaaaataa

SEQ ID NO: 80406 - DNA, 16 bp, H. sapiens
cctctacaccaataac

SEQ ID NO: 80407 - DNA, 18 bp, H. sapiens
cctctaccaaaaatacaa

SEQ ID NO: 80408 - DNA, 16 bp, H. sapiens
cctctacccactgctt

SEQ ID NO: 80409 - DNA, 16 bp, H. sapiens
cctctacccttcccag

SEQ ID NO: 80410 - DNA, 16 bp, H. sapiens
cctctacctcagcctc

SEQ ID NO: 80411 - DNA, 16 bp, H. sapiens
cctctacctccagggt

SEQ ID NO: 80412 - DNA, 16 bp, H. sapiens
cctctacctcctgagc

SEQ ID NO: 80413 - DNA, 16 bp, H. sapiens
cctctacctcctggct

SEQ ID NO: 80414 - DNA, 16 bp, H. sapiens
cctctacctctcaggt

SEQ ID NO: 80415 - DNA, 18 bp, H. sapiens
cctctactaaaaatacaa

SEQ ID NO: 80416 - DNA, 20 bp, H. sapiens
cctctactgaaaatacaaaa

SEQ ID NO: 80417 - DNA, 16 bp, H. sapiens
cctctagaactgtgag

SEQ ID NO: 80418 - DNA, 16 bp, H. sapiens
cctctagagccttcag

SEQ ID NO: 80419 - DNA, 16 bp, H. sapiens
cctctagagtagctag

SEQ ID NO: 80420 - DNA, 16 bp, H. sapiens
cctctagtaaccacca

SEQ ID NO: 80421 - DNA, 16 bp, H. sapiens
cctctagtagtctgca

SEQ ID NO: 80422 - DNA, 16 bp, H. sapiens
cctctatggaaataaa

SEQ ID NO: 80423 - DNA, 16 bp, H. sapiens
cctctatgtgtctgtg

SEQ ID NO: 80424 - DNA, 16 bp, H. sapiens
cctctcaaaacaaaca

SEQ ID NO: 80425 - DNA, 16 bp, H. sapiens
cctctcaaagcactga

SEQ ID NO: 80426 - DNA, 16 bp, H. sapiens
cctctcaacatgctgg

SEQ ID NO: 80427 - DNA, 16 bp, H. sapiens
cctctcaccagcactt

SEQ ID NO: 80428 - DNA, 16 bp, H. sapiens
cctctcacctcaacct

SEQ ID NO: 80429 - DNA, 16 bp, H. sapiens
cctctcacctcagcct

SEQ ID NO: 80430 - DNA, 16 bp, H. sapiens
cctctcacctccgcct

SEQ ID NO: 80431 - DNA, 16 bp, H. sapiens
cctctcacctctgcct

SEQ ID NO: 80432 - DNA, 16 bp, H. sapiens
cctctcagagcctcag

SEQ ID NO: 80433 - DNA, 16 bp, H. sapiens
cctctcagattcaagc

SEQ ID NO: 80434 - DNA, 16 bp, H. sapiens
cctctcagcctccaga

SEQ ID NO: 80435 - DNA, 16 bp, H. sapiens
cctctcagcctccata

SEQ ID NO: 80436 - DNA, 16 bp, H. sapiens
cctctcagtactgctt

SEQ ID NO: 80437 - DNA, 16 bp, H. sapiens
cctctcatttcacaga

SEQ ID NO: 80438 - DNA, 16 bp, H. sapiens
cctctccaaggagaac

SEQ ID NO: 80439 - DNA, 16 bp, H. sapiens
cctctccacaaaaata

SEQ ID NO: 80440 - DNA, 16 bp, H. sapiens
cctctccacagggcag

SEQ ID NO: 80441 - DNA, 16 bp, H. sapiens
cctctccactgaaagc

SEQ ID NO: 80442 - DNA, 16 bp, H. sapiens
cctctccactgagagc

SEQ ID NO: 80443 - DNA, 16 bp, H. sapiens
cctctccagaagcaga

SEQ ID NO: 80444 - DNA, 16 bp, H. sapiens
cctctccagattcctc

SEQ ID NO: 80445 - DNA, 16 bp, H. sapiens
cctctccagcagccac

SEQ ID NO: 80446 - DNA, 16 bp, H. sapiens
cctctccagcatttgg

SEQ ID NO: 80447 - DNA, 16 bp, H. sapiens
cctctccagccctgca

SEQ ID NO: 80448 - DNA, 16 bp, H. sapiens
cctctccagcctcctc

SEQ ID NO: 80449 - DNA, 16 bp, H. sapiens
cctctccagcctctcc

SEQ ID NO: 80450 - DNA, 16 bp, H. sapiens
cctctccaggcccaga

SEQ ID NO: 80451 - DNA, 16 bp, H. sapiens
cctctccaggcctcag

SEQ ID NO: 80452 - DNA, 16 bp, H. sapiens
cctctccaggctcagg

SEQ ID NO: 80453 - DNA, 16 bp, H. sapiens
cctctccatgtggcct

SEQ ID NO: 80454 - DNA, 16 bp, H. sapiens
cctctcccaccatgtg

SEQ ID NO: 80455 - DNA, 16 bp, H. sapiens
cctctcccaccctcag

SEQ ID NO: 80456 - DNA, 16 bp, H. sapiens
cctctcccacttggaa

SEQ ID NO: 80457 - DNA, 16 bp, H. sapiens
cctctcccagccccag

SEQ ID NO: 80458 - DNA, 16 bp, H. sapiens
cctctcccagcctcgc

SEQ ID NO: 80459 - DNA, 16 bp, H. sapiens
cctctcccagcctctc

SEQ ID NO: 80460 - DNA, 16 bp, H. sapiens
cctctcccagctccag

SEQ ID NO: 80461 - DNA, 16 bp, H. sapiens
cctctcccagggtccc

SEQ ID NO: 80462 - DNA, 16 bp, H. sapiens
cctctcccatcccaga

SEQ ID NO: 80463 - DNA, 16 bp, H. sapiens
cctctccccacagtct

SEQ ID NO: 80464 - DNA, 16 bp, H. sapiens
cctctccccacggtct

SEQ ID NO: 80465 - DNA, 16 bp, H. sapiens
cctctccccagccctg

SEQ ID NO: 80466 - DNA, 16 bp, H. sapiens
cctctccccttctgga

SEQ ID NO: 80467 - DNA, 16 bp, H. sapiens
cctctccctcagcctc

SEQ ID NO: 80468 - DNA, 16 bp, H. sapiens
cctctccctgaccctc

SEQ ID NO: 80469 - DNA, 16 bp, H. sapiens
cctctcctcccagcct

SEQ ID NO: 80470 - DNA, 20 bp, H. sapiens
cctctcctcctccaaaggaa

SEQ ID NO: 80471 - DNA, 16 bp, H. sapiens
cctctcctcctccagc

SEQ ID NO: 80472 - DNA, 16 bp, H. sapiens
cctctcctctccagcc

SEQ ID NO: 80473 - DNA, 16 bp, H. sapiens
cctctcctctcccagc

SEQ ID NO: 80474 - DNA, 16 bp, H. sapiens
cctctcctcttccaaa

SEQ ID NO: 80475 - DNA, 16 bp, H. sapiens
cctctcctgccatgtg

SEQ ID NO: 80476 - DNA, 16 bp, H. sapiens
cctctcctgcctccca

SEQ ID NO: 80477 - DNA, 16 bp, H. sapiens
cctctcctgcctggac

SEQ ID NO: 80478 - DNA, 16 bp, H. sapiens
cctctcctgctgcctt

SEQ ID NO: 80479 - DNA, 16 bp, H. sapiens
cctctcctggcctcag

SEQ ID NO: 80480 - DNA, 16 bp, H. sapiens
cctctccttggaaata

SEQ ID NO: 80481 - DNA, 16 bp, H. sapiens
cctctccttgggcctc

SEQ ID NO: 80482 - DNA, 16 bp, H. sapiens
cctctcgcctcagccc

SEQ ID NO: 80483 - DNA, 16 bp, H. sapiens
cctctcgcctcagctt

SEQ ID NO: 80484 - DNA, 16 bp, H. sapiens
cctctcggcctcccaa

SEQ ID NO: 80485 - DNA, 17 bp, H. sapiens
cctctcgggttcacgcc

SEQ ID NO: 80486 - DNA, 16 bp, H. sapiens
cctctctaagccttag

SEQ ID NO: 80487 - DNA, 16 bp, H. sapiens
cctctctacaaaaaat

SEQ ID NO: 80488 - DNA, 16 bp, H. sapiens
cctctctatgcctcag

SEQ ID NO: 80489 - DNA, 16 bp, H. sapiens
cctctctccagctctg

SEQ ID NO: 80490 - DNA, 16 bp, H. sapiens
cctctctccaggccag

SEQ ID NO: 80491 - DNA, 16 bp, H. sapiens
cctctctccagggccc

SEQ ID NO: 80492 - DNA, 16 bp, H. sapiens
cctctctcctggctgc

SEQ ID NO: 80493 - DNA, 16 bp, H. sapiens
cctctctccttggcct

SEQ ID NO: 80494 - DNA, 16 bp, H. sapiens
cctctctctctgtgtg

SEQ ID NO: 80495 - DNA, 16 bp, H. sapiens
cctctctctgggtctc

SEQ ID NO: 80496 - DNA, 16 bp, H. sapiens
cctctctctgtggctt

SEQ ID NO: 80497 - DNA, 16 bp, H. sapiens
cctctctcttttgtaa

SEQ ID NO: 80498 - DNA, 16 bp, H. sapiens
cctctctgaaccttag

SEQ ID NO: 80499 - DNA, 16 bp, H. sapiens
cctctctgaaccttgg

SEQ ID NO: 80500 - DNA, 16 bp, H. sapiens
cctctctgaatctgtt

SEQ ID NO: 80501 - DNA, 16 bp, H. sapiens
cctctctgaatttcag

SEQ ID NO: 80502 - DNA, 16 bp, H. sapiens
cctctctgagccacag

SEQ ID NO: 80503 - DNA, 16 bp, H. sapiens
cctctctgagcctctg

SEQ ID NO: 80504 - DNA, 16 bp, H. sapiens
cctctctgagccttgg

SEQ ID NO: 80505 - DNA, 16 bp, H. sapiens
cctctctgagctcagt

SEQ ID NO: 80506 - DNA, 16 bp, H. sapiens
cctctctgaggaagtg

SEQ ID NO: 80507 - DNA, 16 bp, H. sapiens
cctctctgagtcccag

SEQ ID NO: 80508 - DNA, 16 bp, H. sapiens
cctctctgagtcttgg

SEQ ID NO: 80509 - DNA, 16 bp, H. sapiens
cctctctgagtttcca

SEQ ID NO: 80510 - DNA, 17 bp, H. sapiens
cctctctgcgcctgcgc

SEQ ID NO: 80511 - DNA, 16 bp, H. sapiens
cctctctgctgagagc

SEQ ID NO: 80512 - DNA, 16 bp, H. sapiens
cctctctggacctctg

SEQ ID NO: 80513 - DNA, 16 bp, H. sapiens
cctctctggacttcag

SEQ ID NO: 80514 - DNA, 16 bp, H. sapiens
cctctctgggatgaag

SEQ ID NO: 80515 - DNA, 16 bp, H. sapiens
cctctctgggcagctc

SEQ ID NO: 80516 - DNA, 16 bp, H. sapiens
cctctctgggcctcag

SEQ ID NO: 80517 - DNA, 16 bp, H. sapiens
cctctctgggcctgat

SEQ ID NO: 80518 - DNA, 16 bp, H. sapiens
cctctctgggcctggg

SEQ ID NO: 80519 - DNA, 16 bp, H. sapiens
cctctctgggccttgg

SEQ ID NO: 80520 - DNA, 16 bp, H. sapiens
cctctctgggctgcag

SEQ ID NO: 80521 - DNA, 16 bp, H. sapiens
cctctctgggctggct

SEQ ID NO: 80522 - DNA, 16 bp, H. sapiens
cctctctgggtctcag

SEQ ID NO: 80523 - DNA, 16 bp, H. sapiens
cctctctgggtttcag

SEQ ID NO: 80524 - DNA, 16 bp, H. sapiens
cctctctgtatccatg

SEQ ID NO: 80525 - DNA, 16 bp, H. sapiens
cctctctgtatctcag

SEQ ID NO: 80526 - DNA, 16 bp, H. sapiens
cctctctgtcacctga

SEQ ID NO: 80527 - DNA, 16 bp, H. sapiens
cctctctgtgcctctg

SEQ ID NO: 80528 - DNA, 16 bp, H. sapiens
cctctctgtggctcca

SEQ ID NO: 80529 - DNA, 16 bp, H. sapiens
cctctctgtgttcatg

SEQ ID NO: 80530 - DNA, 16 bp, H. sapiens
cctctcttcctgtttg

SEQ ID NO: 80531 - DNA, 16 bp, H. sapiens
cctctcttctcagcct

SEQ ID NO: 80532 - DNA, 16 bp, H. sapiens
cctctcttgcctgcca

SEQ ID NO: 80533 - DNA, 16 bp, H. sapiens
cctctctttctccagc

SEQ ID NO: 80534 - DNA, 16 bp, H. sapiens
cctctgaaagcaccca

SEQ ID NO: 80535 - DNA, 16 bp, H. sapiens
cctctgaagccttctt

SEQ ID NO: 80536 - DNA, 16 bp, H. sapiens
cctctgaaggctccag

SEQ ID NO: 80537 - DNA, 16 bp, H. sapiens
cctctgactcccaaag

SEQ ID NO: 80538 - DNA, 16 bp, H. sapiens
cctctgagaactggaa

SEQ ID NO: 80539 - DNA, 16 bp, H. sapiens
cctctgagatctggaa

SEQ ID NO: 80540 - DNA, 16 bp, H. sapiens
cctctgagcctgtttc

SEQ ID NO: 80541 - DNA, 16 bp, H. sapiens
cctctgagctctgctt

SEQ ID NO: 80542 - DNA, 16 bp, H. sapiens
cctctgaggagaaaag

SEQ ID NO: 80543 - DNA, 16 bp, H. sapiens
cctctgaggaggaaag

SEQ ID NO: 80544 - DNA, 16 bp, H. sapiens
cctctgaggaggagga

SEQ ID NO: 80545 - DNA, 16 bp, H. sapiens
cctctgagggagctct

SEQ ID NO: 80546 - DNA, 16 bp, H. sapiens
cctctgagtagctgag

SEQ ID NO: 80547 - DNA, 16 bp, H. sapiens
cctctgattgtcctca

SEQ ID NO: 80548 - DNA, 16 bp, H. sapiens
cctctgatttctttga

SEQ ID NO: 80549 - DNA, 16 bp, H. sapiens
cctctgattttttttc

SEQ ID NO: 80550 - DNA, 16 bp, H. sapiens
cctctgcaagctgagg

SEQ ID NO: 80551 - DNA, 16 bp, H. sapiens
cctctgcaccccagcc

SEQ ID NO: 80552 - DNA, 16 bp, H. sapiens
cctctgcacctgcctg

SEQ ID NO: 80553 - DNA, 16 bp, H. sapiens
cctctgcacttcagcc

SEQ ID NO: 80554 - DNA, 16 bp, H. sapiens
cctctgcagcaaactt

SEQ ID NO: 80555 - DNA, 16 bp, H. sapiens
cctctgcagcaacatg

SEQ ID NO: 80556 - DNA, 16 bp, H. sapiens
cctctgcagcagatgc

SEQ ID NO: 80557 - DNA, 16 bp, H. sapiens
cctctgcagctgctgg

SEQ ID NO: 80558 - DNA, 16 bp, H. sapiens
cctctgcagcttcctc

SEQ ID NO: 80559 - DNA, 16 bp, H. sapiens
cctctgcaggccccgc

SEQ ID NO: 80560 - DNA, 16 bp, H. sapiens
cctctgcatgctgctc

SEQ ID NO: 80561 - DNA, 16 bp, H. sapiens
cctctgccacccaggc

SEQ ID NO: 80562 - DNA, 16 bp, H. sapiens
cctctgccacccaggt

SEQ ID NO: 80563 - DNA, 16 bp, H. sapiens
cctctgccaccctcac

SEQ ID NO: 80564 - DNA, 16 bp, H. sapiens
cctctgccagccactt

SEQ ID NO: 80565 - DNA, 16 bp, H. sapiens
cctctgccaggccacc

SEQ ID NO: 80566 - DNA, 16 bp, H. sapiens
cctctgcccacctgcc

SEQ ID NO: 80567 - DNA, 16 bp, H. sapiens
cctctgcccagatttc

SEQ ID NO: 80568 - DNA, 16 bp, H. sapiens
cctctgcccagcagcc

SEQ ID NO: 80569 - DNA, 16 bp, H. sapiens
cctctgcccagctgcc

SEQ ID NO: 80570 - DNA, 16 bp, H. sapiens
cctctgcccagtcctg

SEQ ID NO: 80571 - DNA, 16 bp, H. sapiens
cctctgccccactgcc

SEQ ID NO: 80572 - DNA, 16 bp, H. sapiens
cctctgccccagcctc

SEQ ID NO: 80573 - DNA, 16 bp, H. sapiens
cctctgcccccaggcc

SEQ ID NO: 80574 - DNA, 16 bp, H. sapiens
cctctgccccccaaag

SEQ ID NO: 80575 - DNA, 16 bp, H. sapiens
cctctgccccccaggt

SEQ ID NO: 80576 - DNA, 16 bp, H. sapiens
cctctgccccctgggc

SEQ ID NO: 80577 - DNA, 16 bp, H. sapiens
cctctgcccctccagg

SEQ ID NO: 80578 - DNA, 16 bp, H. sapiens
cctctgcccggccacc

SEQ ID NO: 80579 - DNA, 16 bp, H. sapiens
cctctgcccggccgct

SEQ ID NO: 80580 - DNA, 16 bp, H. sapiens
cctctgccctcccagg

SEQ ID NO: 80581 - DNA, 16 bp, H. sapiens
cctctgccgcagctcc

SEQ ID NO: 80582 - DNA, 16 bp, H. sapiens
cctctgcctccagagt

SEQ ID NO: 80583 - DNA, 16 bp, H. sapiens
cctctgcctccaggct

SEQ ID NO: 80584 - DNA, 16 bp, H. sapiens
cctctgcctccagggc

SEQ ID NO: 80585 - DNA, 16 bp, H. sapiens
cctctgcctcccaaat

SEQ ID NO: 80586 - DNA, 16 bp, H. sapiens
cctctgcctcccacag

SEQ ID NO: 80587 - DNA, 16 bp, H. sapiens
cctctgcctcccacca

SEQ ID NO: 80588 - DNA, 16 bp, H. sapiens
cctctgcctcccagct

SEQ ID NO: 80589 - DNA, 16 bp, H. sapiens
cctctgcctcccagga

SEQ ID NO: 80590 - DNA, 16 bp, H. sapiens
cctctgcctcccagtg

SEQ ID NO: 80591 - DNA, 16 bp, H. sapiens
cctctgcctccccaag

SEQ ID NO: 80592 - DNA, 16 bp, H. sapiens
cctctgcctccccggg

SEQ ID NO: 80593 - DNA, 16 bp, H. sapiens
cctctgcctccctgac

SEQ ID NO: 80594 - DNA, 16 bp, H. sapiens
cctctgcctcctcagc

SEQ ID NO: 80595 - DNA, 16 bp, H. sapiens
cctctgcctcctcagt

SEQ ID NO: 80596 - DNA, 16 bp, H. sapiens
cctctgcctcctccca

SEQ ID NO: 80597 - DNA, 16 bp, H. sapiens
cctctgcctcctgaag

SEQ ID NO: 80598 - DNA, 16 bp, H. sapiens
cctctgcctcctgctt

SEQ ID NO: 80599 - DNA, 16 bp, H. sapiens
cctctgcctcctgggc

SEQ ID NO: 80600 - DNA, 16 bp, H. sapiens
cctctgcctccttggc

SEQ ID NO: 80601 - DNA, 16 bp, H. sapiens
cctctgcctctcaaag

SEQ ID NO: 80602 - DNA, 16 bp, H. sapiens
cctctgcctctcccca

SEQ ID NO: 80603 - DNA, 16 bp, H. sapiens
cctctgcctctggagt

SEQ ID NO: 80604 - DNA, 16 bp, H. sapiens
cctctgcctcttgagt

SEQ ID NO: 80605 - DNA, 16 bp, H. sapiens
cctctgcctgcctggt

SEQ ID NO: 80606 - DNA, 16 bp, H. sapiens
cctctgcctgctaggt

SEQ ID NO: 80607 - DNA, 16 bp, H. sapiens
cctctgcctggagcac

SEQ ID NO: 80608 - DNA, 16 bp, H. sapiens
cctctgcctggccacc

SEQ ID NO: 80609 - DNA, 16 bp, H. sapiens
cctctgcctggccgcc

SEQ ID NO: 80610 - DNA, 16 bp, H. sapiens
cctctgcctggctccc

SEQ ID NO: 80611 - DNA, 16 bp, H. sapiens
cctctgcctgggacac

SEQ ID NO: 80612 - DNA, 16 bp, H. sapiens
cctctgcctgggcctc

SEQ ID NO: 80613 - DNA, 16 bp, H. sapiens
cctctgccttcccagt

SEQ ID NO: 80614 - DNA, 16 bp, H. sapiens
cctctgccttcctggc

SEQ ID NO: 80615 - DNA, 16 bp, H. sapiens
cctctgcgtcctgggt

SEQ ID NO: 80616 - DNA, 16 bp, H. sapiens
cctctgctccctccca

SEQ ID NO: 80617 - DNA, 16 bp, H. sapiens
cctctgctcctgggtt

SEQ ID NO: 80618 - DNA, 16 bp, H. sapiens
cctctgctctgacctc

SEQ ID NO: 80619 - DNA, 16 bp, H. sapiens
cctctgctctgtcctc

SEQ ID NO: 80620 - DNA, 16 bp, H. sapiens
cctctgctgctctctg

SEQ ID NO: 80621 - DNA, 16 bp, H. sapiens
cctctgctgctgctgt

SEQ ID NO: 80622 - DNA, 16 bp, H. sapiens
cctctgctgtggctcc

SEQ ID NO: 80623 - DNA, 16 bp, H. sapiens
cctctgcttccctggc

SEQ ID NO: 80624 - DNA, 16 bp, H. sapiens
cctctgcttcctccca

SEQ ID NO: 80625 - DNA, 16 bp, H. sapiens
cctctgcttcctggct

SEQ ID NO: 80626 - DNA, 16 bp, H. sapiens
cctctgcttcctgggc

SEQ ID NO: 80627 - DNA, 16 bp, H. sapiens
cctctgcttctggtga

SEQ ID NO: 80628 - DNA, 16 bp, H. sapiens
cctctgcttgaggaga

SEQ ID NO: 80629 - DNA, 16 bp, H. sapiens
cctctgcttttctgaa

SEQ ID NO: 80630 - DNA, 16 bp, H. sapiens
cctctggaaagggggc

SEQ ID NO: 80631 - DNA, 16 bp, H. sapiens
cctctggaagctttgt

SEQ ID NO: 80632 - DNA, 16 bp, H. sapiens
cctctggaggaggaga

SEQ ID NO: 80633 - DNA, 16 bp, H. sapiens
cctctggcagagcagg

SEQ ID NO: 80634 - DNA, 16 bp, H. sapiens
cctctggcataaatgg

SEQ ID NO: 80635 - DNA, 16 bp, H. sapiens
cctctggccacctccc

SEQ ID NO: 80636 - DNA, 16 bp, H. sapiens
cctctggccagaagcc

SEQ ID NO: 80637 - DNA, 16 bp, H. sapiens
cctctggcccaaggca

SEQ ID NO: 80638 - DNA, 16 bp, H. sapiens
cctctggcccaggaca

SEQ ID NO: 80639 - DNA, 16 bp, H. sapiens
cctctggcctcagcct

SEQ ID NO: 80640 - DNA, 16 bp, H. sapiens
cctctggcctcagtct

SEQ ID NO: 80641 - DNA, 16 bp, H. sapiens
cctctggcctctggcc

SEQ ID NO: 80642 - DNA, 16 bp, H. sapiens
cctctggctagggctg

SEQ ID NO: 80643 - DNA, 16 bp, H. sapiens
cctctggctcccaggt

SEQ ID NO: 80644 - DNA, 16 bp, H. sapiens
cctctggctcccgggt

SEQ ID NO: 80645 - DNA, 16 bp, H. sapiens
cctctggctcctgggc

SEQ ID NO: 80646 - DNA, 16 bp, H. sapiens
cctctgggattcaagc

SEQ ID NO: 80647 - DNA, 16 bp, H. sapiens
cctctgggcctgtgtt

SEQ ID NO: 80648 - DNA, 16 bp, H. sapiens
cctctgggctcaaggg

SEQ ID NO: 80649 - DNA, 16 bp, H. sapiens
cctctggggaggggag

SEQ ID NO: 80650 - DNA, 16 bp, H. sapiens
cctctggggctccagg

SEQ ID NO: 80651 - DNA, 16 bp, H. sapiens
cctctggggttcaagc

SEQ ID NO: 80652 - DNA, 16 bp, H. sapiens
cctctggtggctgctg

SEQ ID NO: 80653 - DNA, 16 bp, H. sapiens
cctctgtcacagcctc

SEQ ID NO: 80654 - DNA, 16 bp, H. sapiens
cctctgtcacccagtc

SEQ ID NO: 80655 - DNA, 16 bp, H. sapiens
cctctgtccccaccct

SEQ ID NO: 80656 - DNA, 16 bp, H. sapiens
cctctgtcctcagcct

SEQ ID NO: 80657 - DNA, 17 bp, H. sapiens
cctctgtctcaaaaaaa

SEQ ID NO: 80658 - DNA, 16 bp, H. sapiens
cctctgtctcccaggt

SEQ ID NO: 80659 - DNA, 16 bp, H. sapiens
cctctgtctccccagc

SEQ ID NO: 80660 - DNA, 16 bp, H. sapiens
cctctgtctccccagt

SEQ ID NO: 80661 - DNA, 16 bp, H. sapiens
cctctgtctctctcac

SEQ ID NO: 80662 - DNA, 16 bp, H. sapiens
cctctgtctctctgtc

SEQ ID NO: 80663 - DNA, 16 bp, H. sapiens
cctctgtctcttgcct

SEQ ID NO: 80664 - DNA, 16 bp, H. sapiens
cctctgtgctctgctt

SEQ ID NO: 80665 - DNA, 16 bp, H. sapiens
cctctgtgctcttcct

SEQ ID NO: 80666 - DNA, 16 bp, H. sapiens
cctctgtgggcagggc

SEQ ID NO: 80667 - DNA, 16 bp, H. sapiens
cctctgtggtcccagc

SEQ ID NO: 80668 - DNA, 16 bp, H. sapiens
cctctgtgtcctcatc

SEQ ID NO: 80669 - DNA, 16 bp, H. sapiens
cctctgtgtcctggtg

SEQ ID NO: 80670 - DNA, 16 bp, H. sapiens
cctctgtgtctgtgtc

SEQ ID NO: 80671 - DNA, 16 bp, H. sapiens
cctctgttaaaaaaaa

SEQ ID NO: 80672 - DNA, 16 bp, H. sapiens
cctctgttccccaggc

SEQ ID NO: 80673 - DNA, 17 bp, H. sapiens
cctctgttgcccaggct

SEQ ID NO: 80674 - DNA, 16 bp, H. sapiens
cctctgtttaaaaaaa

SEQ ID NO: 80675 - DNA, 16 bp, H. sapiens
cctctgtttcccaaag

SEQ ID NO: 80676 - DNA, 16 bp, H. sapiens
cctcttaacaaatttt

SEQ ID NO: 80677 - DNA, 16 bp, H. sapiens
cctcttataaggacac

SEQ ID NO: 80678 - DNA, 16 bp, H. sapiens
cctcttatatctctgc

SEQ ID NO: 80679 - DNA, 16 bp, H. sapiens
cctcttatctcagcct

SEQ ID NO: 80680 - DNA, 16 bp, H. sapiens
cctcttatctcatcct

SEQ ID NO: 80681 - DNA, 16 bp, H. sapiens
cctcttcaccttctgc

SEQ ID NO: 80682 - DNA, 16 bp, H. sapiens
cctcttcaccttgctc

SEQ ID NO: 80683 - DNA, 16 bp, H. sapiens
cctcttcagcctctca

SEQ ID NO: 80684 - DNA, 16 bp, H. sapiens
cctcttcagtagctgg

SEQ ID NO: 80685 - DNA, 16 bp, H. sapiens
cctcttcatgttaaaa

SEQ ID NO: 80686 - DNA, 16 bp, H. sapiens
cctcttccaggaagcc

SEQ ID NO: 80687 - DNA, 16 bp, H. sapiens
cctcttccatgaagcc

SEQ ID NO: 80688 - DNA, 16 bp, H. sapiens
cctcttcccccagcct

SEQ ID NO: 80689 - DNA, 16 bp, H. sapiens
cctcttcccggctgcc

SEQ ID NO: 80690 - DNA, 16 bp, H. sapiens
cctcttccctctctgg

SEQ ID NO: 80691 - DNA, 16 bp, H. sapiens
cctcttcctccaggaa

SEQ ID NO: 80692 - DNA, 16 bp, H. sapiens
cctcttcctcccaggt

SEQ ID NO: 80693 - DNA, 16 bp, H. sapiens
cctcttcctcctgagt

SEQ ID NO: 80694 - DNA, 16 bp, H. sapiens
cctcttcctggaagcc

SEQ ID NO: 80695 - DNA, 16 bp, H. sapiens
cctcttcctggcttct

SEQ ID NO: 80696 - DNA, 16 bp, H. sapiens
cctcttcctggtttgc

SEQ ID NO: 80697 - DNA, 16 bp, H. sapiens
cctcttccttccccag

SEQ ID NO: 80698 - DNA, 16 bp, H. sapiens
cctcttctcacagatc

SEQ ID NO: 80699 - DNA, 16 bp, H. sapiens
cctcttctcacagctg

SEQ ID NO: 80700 - DNA, 16 bp, H. sapiens
cctcttctcatagctc

SEQ ID NO: 80701 - DNA, 16 bp, H. sapiens
cctcttctccacagcc

SEQ ID NO: 80702 - DNA, 16 bp, H. sapiens
cctcttctcccagccc

SEQ ID NO: 80703 - DNA, 16 bp, H. sapiens
cctcttctccccagcc

SEQ ID NO: 80704 - DNA, 16 bp, H. sapiens
cctcttctcctacaaa

SEQ ID NO: 80705 - DNA, 16 bp, H. sapiens
cctcttctcctccaaa

SEQ ID NO: 80706 - DNA, 16 bp, H. sapiens
cctcttctctcctgga

SEQ ID NO: 80707 - DNA, 16 bp, H. sapiens
cctcttctgcctgggc

SEQ ID NO: 80708 - DNA, 16 bp, H. sapiens
cctcttcttctccaaa

SEQ ID NO: 80709 - DNA, 16 bp, H. sapiens
cctcttgagtgctttg

SEQ ID NO: 80710 - DNA, 16 bp, H. sapiens
cctcttgagtgggcag

SEQ ID NO: 80711 - DNA, 16 bp, H. sapiens
cctcttgagttcaagc

SEQ ID NO: 80712 - DNA, 16 bp, H. sapiens
cctcttgcattagcat

SEQ ID NO: 80713 - DNA, 16 bp, H. sapiens
cctcttgcctgccgcc

SEQ ID NO: 80714 - DNA, 16 bp, H. sapiens
cctcttgccttgacct

SEQ ID NO: 80715 - DNA, 16 bp, H. sapiens
cctcttggaaaacctc

SEQ ID NO: 80716 - DNA, 16 bp, H. sapiens
cctcttggccaagagg

SEQ ID NO: 80717 - DNA, 16 bp, H. sapiens
cctcttgggctcaagc

SEQ ID NO: 80718 - DNA, 16 bp, H. sapiens
cctcttgggttcaagc

SEQ ID NO: 80719 - DNA, 16 bp, H. sapiens
cctcttggtacccagg

SEQ ID NO: 80720 - DNA, 16 bp, H. sapiens
cctcttgtgctgagtc

SEQ ID NO: 80721 - DNA, 16 bp, H. sapiens
cctctttaaaagccct

SEQ ID NO: 80722 - DNA, 16 bp, H. sapiens
cctctttcatttataa

SEQ ID NO: 80723 - DNA, 16 bp, H. sapiens
cctctttcatttctga

SEQ ID NO: 80724 - DNA, 16 bp, H. sapiens
cctctttccaaataag

SEQ ID NO: 80725 - DNA, 16 bp, H. sapiens
cctctttcctcagcct

SEQ ID NO: 80726 - DNA, 16 bp, H. sapiens
cctctttcctgtaaca

SEQ ID NO: 80727 - DNA, 16 bp, H. sapiens
cctctttctgtccatg

SEQ ID NO: 80728 - DNA, 16 bp, H. sapiens
cctctttgcagacgac

SEQ ID NO: 80729 - DNA, 16 bp, H. sapiens
cctctttggaaaaagc

SEQ ID NO: 80730 - DNA, 16 bp, H. sapiens
cctctttggattccag

SEQ ID NO: 80731 - DNA, 16 bp, H. sapiens
cctctttgggcttcag

SEQ ID NO: 80732 - DNA, 16 bp, H. sapiens
cctctttggggccctg

SEQ ID NO: 80733 - DNA, 16 bp, H. sapiens
cctctttggggttctg

SEQ ID NO: 80734 - DNA, 16 bp, H. sapiens
cctctttgtatttctg

SEQ ID NO: 80735 - DNA, 16 bp, H. sapiens
cctctttgtgtccctg

SEQ ID NO: 80736 - DNA, 16 bp, H. sapiens
cctcttttaaaaaaaa

SEQ ID NO: 80737 - DNA, 16 bp, H. sapiens
cctcttttataaggac

SEQ ID NO: 80738 - DNA, 16 bp, H. sapiens
cctcttttattttctg

SEQ ID NO: 80739 - DNA, 16 bp, H. sapiens
cctcttttctaattaa

SEQ ID NO: 80740 - DNA, 16 bp, H. sapiens
cctcttttcttcataa

SEQ ID NO: 80741 - DNA, 16 bp, H. sapiens
cctctttttcagggtt

SEQ ID NO: 80742 - DNA, 16 bp, H. sapiens
cctctttttttataaa

SEQ ID NO: 80743 - DNA, 16 bp, H. sapiens
cctgaaaaaatgctca

SEQ ID NO: 80744 - DNA, 16 bp, H. sapiens
cctgaaaaagaattca

SEQ ID NO: 80745 - DNA, 16 bp, H. sapiens
cctgaaaaccttccag

SEQ ID NO: 80746 - DNA, 16 bp, H. sapiens
cctgaaaataacatcc

SEQ ID NO: 80747 - DNA, 16 bp, H. sapiens
cctgaaaatgtggaaa

SEQ ID NO: 80748 - DNA, 16 bp, H. sapiens
cctgaaactttcctga

SEQ ID NO: 80749 - DNA, 16 bp, H. sapiens
cctgaaagactactgg

SEQ ID NO: 80750 - DNA, 16 bp, H. sapiens
cctgaaagcactgagg

SEQ ID NO: 80751 - DNA, 16 bp, H. sapiens
cctgaaagccccactc

SEQ ID NO: 80752 - DNA, 16 bp, H. sapiens
cctgaaagtgatgagg

SEQ ID NO: 80753 - DNA, 16 bp, H. sapiens
cctgaaatattttttt

SEQ ID NO: 80754 - DNA, 16 bp, H. sapiens
cctgaaatcaggagtt

SEQ ID NO: 80755 - DNA, 16 bp, H. sapiens
cctgaaatctattttg

SEQ ID NO: 80756 - DNA, 16 bp, H. sapiens
cctgaaatgatccacc

SEQ ID NO: 80757 - DNA, 16 bp, H. sapiens
cctgaacagcctgcag

SEQ ID NO: 80758 - DNA, 16 bp, H. sapiens
cctgaacataggagaa

SEQ ID NO: 80759 - DNA, 16 bp, H. sapiens
cctgaacattttcttt

SEQ ID NO: 80760 - DNA, 16 bp, H. sapiens
cctgaacccagaaggc

SEQ ID NO: 80761 - DNA, 16 bp, H. sapiens
cctgaacccaggaagc

SEQ ID NO: 80762 - DNA, 16 bp, H. sapiens
cctgaacccaggaggc

SEQ ID NO: 80763 - DNA, 16 bp, H. sapiens
cctgaacccaggaggt

SEQ ID NO: 80764 - DNA, 16 bp, H. sapiens
cctgaacccgggaggc

SEQ ID NO: 80765 - DNA, 16 bp, H. sapiens
cctgaaccctggaggc

SEQ ID NO: 80766 - DNA, 16 bp, H. sapiens
cctgaacctaaaataa

SEQ ID NO: 80767 - DNA, 16 bp, H. sapiens
cctgaacctaggaggc

SEQ ID NO: 80768 - DNA, 16 bp, H. sapiens
cctgaacctgagaggc

SEQ ID NO: 80769 - DNA, 16 bp, H. sapiens
cctgaacctggaaggc

SEQ ID NO: 80770 - DNA, 16 bp, H. sapiens
cctgaacctgggaggc

SEQ ID NO: 80771 - DNA, 16 bp, H. sapiens
cctgaactcaggagtt

SEQ ID NO: 80772 - DNA, 16 bp, H. sapiens
cctgaactccagtgat

SEQ ID NO: 80773 - DNA, 16 bp, H. sapiens
cctgaactcctgggct

SEQ ID NO: 80774 - DNA, 16 bp, H. sapiens
cctgaactgcagcagc

SEQ ID NO: 80775 - DNA, 16 bp, H. sapiens
cctgaacttttttttt

SEQ ID NO: 80776 - DNA, 16 bp, H. sapiens
cctgaagaaaattaaa

SEQ ID NO: 80777 - DNA, 16 bp, H. sapiens
cctgaagaactgtgag

SEQ ID NO: 80778 - DNA, 16 bp, H. sapiens
cctgaagaacttcctt

SEQ ID NO: 80779 - DNA, 16 bp, H. sapiens
cctgaagaagaagaaa

SEQ ID NO: 80780 - DNA, 16 bp, H. sapiens
cctgaagaatattttc

SEQ ID NO: 80781 - DNA, 16 bp, H. sapiens
cctgaagaccttccag

SEQ ID NO: 80782 - DNA, 16 bp, H. sapiens
cctgaagactgaggac

SEQ ID NO: 80783 - DNA, 16 bp, H. sapiens
cctgaagagccaaagc

SEQ ID NO: 80784 - DNA, 16 bp, H. sapiens
cctgaagcagctggct

SEQ ID NO: 80785 - DNA, 16 bp, H. sapiens
cctgaagccccagagg

SEQ ID NO: 80786 - DNA, 16 bp, H. sapiens
cctgaagcctggggac

SEQ ID NO: 80787 - DNA, 16 bp, H. sapiens
cctgaagcctggggcc

SEQ ID NO: 80788 - DNA, 16 bp, H. sapiens
cctgaaggaaaataaa

SEQ ID NO: 80789 - DNA, 16 bp, H. sapiens
cctgaaggaaatcaaa

SEQ ID NO: 80790 - DNA, 16 bp, H. sapiens
cctgaaggactactgg

SEQ ID NO: 80791 - DNA, 16 bp, H. sapiens
cctgaaggccccacct

SEQ ID NO: 80792 - DNA, 16 bp, H. sapiens
cctgaagggctgggat

SEQ ID NO: 80793 - DNA, 16 bp, H. sapiens
cctgaagtcaggagtt

SEQ ID NO: 80794 - DNA, 16 bp, H. sapiens
cctgaagtcagtgaga

SEQ ID NO: 80795 - DNA, 16 bp, H. sapiens
cctgaagtgcagggat

SEQ ID NO: 80796 - DNA, 16 bp, H. sapiens
cctgaagtgttttcca

SEQ ID NO: 80797 - DNA, 16 bp, H. sapiens
cctgaagttctctttt

SEQ ID NO: 80798 - DNA, 16 bp, H. sapiens
cctgaagttgggagtt

SEQ ID NO: 80799 - DNA, 16 bp, H. sapiens
cctgaagtttcttttt

SEQ ID NO: 80800 - DNA, 16 bp, H. sapiens
cctgaagttttatttt

SEQ ID NO: 80801 - DNA, 16 bp, H. sapiens
cctgaataacttttgg

SEQ ID NO: 80802 - DNA, 16 bp, H. sapiens
cctgaatacagcccac

SEQ ID NO: 80803 - DNA, 16 bp, H. sapiens
cctgaatcagttatta

SEQ ID NO: 80804 - DNA, 16 bp, H. sapiens
cctgaatctccagcct

SEQ ID NO: 80805 - DNA, 16 bp, H. sapiens
cctgaatctttttttt

SEQ ID NO: 80806 - DNA, 16 bp, H. sapiens
cctgaatgaccactgg

SEQ ID NO: 80807 - DNA, 16 bp, H. sapiens
cctgaatgactttttg

SEQ ID NO: 80808 - DNA, 16 bp, H. sapiens
cctgaatggactaaga

SEQ ID NO: 80809 - DNA, 16 bp, H. sapiens
cctgaatggagggact

SEQ ID NO: 80810 - DNA, 16 bp, H. sapiens
cctgaattcaaatcct

SEQ ID NO: 80811 - DNA, 16 bp, H. sapiens
cctgaattccaaagga

SEQ ID NO: 80812 - DNA, 16 bp, H. sapiens
cctgaattctttcttt

SEQ ID NO: 80813 - DNA, 16 bp, H. sapiens
cctgaattctttttca

SEQ ID NO: 80814 - DNA, 16 bp, H. sapiens
cctgacaaaaacaagg

SEQ ID NO: 80815 - DNA, 16 bp, H. sapiens
cctgacaaaaagaagc

SEQ ID NO: 80816 - DNA, 16 bp, H. sapiens
cctgacacatagtagg

SEQ ID NO: 80817 - DNA, 16 bp, H. sapiens
cctgacatatagtagg

SEQ ID NO: 80818 - DNA, 16 bp, H. sapiens
cctgacattttaaaaa

SEQ ID NO: 80819 - DNA, 16 bp, H. sapiens
cctgaccaacgtggag

SEQ ID NO: 80820 - DNA, 17 bp, H. sapiens
cctgaccaatatgatga

SEQ ID NO: 80821 - DNA, 16 bp, H. sapiens
cctgaccatgtgatcc

SEQ ID NO: 80822 - DNA, 16 bp, H. sapiens
cctgacccacatggag

SEQ ID NO: 80823 - DNA, 16 bp, H. sapiens
cctgacccagcctccc

SEQ ID NO: 80824 - DNA, 16 bp, H. sapiens
cctgaccccacccaag

SEQ ID NO: 80825 - DNA, 17 bp, H. sapiens
cctgaccccagaggtgg

SEQ ID NO: 80826 - DNA, 16 bp, H. sapiens
cctgacccccaagcag

SEQ ID NO: 80827 - DNA, 16 bp, H. sapiens
cctgacccctgaccct

SEQ ID NO: 80828 - DNA, 16 bp, H. sapiens
cctgacccctgacctc

SEQ ID NO: 80829 - DNA, 17 bp, H. sapiens
cctgacccctgagcagc

SEQ ID NO: 80830 - DNA, 16 bp, H. sapiens
cctgaccctgacccct

SEQ ID NO: 80831 - DNA, 16 bp, H. sapiens
cctgaccctgaccctg

SEQ ID NO: 80832 - DNA, 16 bp, H. sapiens
cctgaccctgcagctc

SEQ ID NO: 80833 - DNA, 16 bp, H. sapiens
cctgaccctggccctg

SEQ ID NO: 80834 - DNA, 16 bp, H. sapiens
cctgaccgagctggtc

SEQ ID NO: 80835 - DNA, 19 bp, H. sapiens
cctgacctacatggagaaa

SEQ ID NO: 80836 - DNA, 16 bp, H. sapiens
cctgacctcaagcaac

SEQ ID NO: 80837 - DNA, 16 bp, H. sapiens
cctgacctcagatgac

SEQ ID NO: 80838 - DNA, 16 bp, H. sapiens
cctgacctcagcctcc

SEQ ID NO: 80839 - DNA, 16 bp, H. sapiens
cctgacctcaggagtt

SEQ ID NO: 80840 - DNA, 16 bp, H. sapiens
cctgacctcatgaagc

SEQ ID NO: 80841 - DNA, 16 bp, H. sapiens
cctgacctcccaggct

SEQ ID NO: 80842 - DNA, 16 bp, H. sapiens
cctgacctcgtggtcc

SEQ ID NO: 80843 - DNA, 16 bp, H. sapiens
cctgacctctgacctc

SEQ ID NO: 80844 - DNA, 16 bp, H. sapiens
cctgacctgtgatctg

SEQ ID NO: 80845 - DNA, 16 bp, H. sapiens
cctgacctgtggtcag

SEQ ID NO: 80846 - DNA, 16 bp, H. sapiens
cctgaccttgtgattc

SEQ ID NO: 80847 - DNA, 16 bp, H. sapiens
cctgactaatacagca

SEQ ID NO: 80848 - DNA, 16 bp, H. sapiens
cctgactaatttttct

SEQ ID NO: 80849 - DNA, 16 bp, H. sapiens
cctgactcagcctctg

SEQ ID NO: 80850 - DNA, 16 bp, H. sapiens
cctgactcagtttccc

SEQ ID NO: 80851 - DNA, 16 bp, H. sapiens
cctgactgatacagaa

SEQ ID NO: 80852 - DNA, 16 bp, H. sapiens
cctgactggggctgct

SEQ ID NO: 80853 - DNA, 20 bp, H. sapiens
cctgactggttttcgtattt

SEQ ID NO: 80854 - DNA, 16 bp, H. sapiens
cctgacttcaaaatac

SEQ ID NO: 80855 - DNA, 16 bp, H. sapiens
cctgacttcagggaag

SEQ ID NO: 80856 - DNA, 16 bp, H. sapiens
cctgacttggcttccc

SEQ ID NO: 80857 - DNA, 16 bp, H. sapiens
cctgactttaaaatat

SEQ ID NO: 80858 - DNA, 16 bp, H. sapiens
cctgagaaaaacaaac

SEQ ID NO: 80859 - DNA, 16 bp, H. sapiens
cctgagaaccaggagc

SEQ ID NO: 80860 - DNA, 16 bp, H. sapiens
cctgagaaccaggagt

SEQ ID NO: 80861 - DNA, 16 bp, H. sapiens
cctgagaacttggtgc

SEQ ID NO: 80862 - DNA, 16 bp, H. sapiens
cctgagacactgtgcc

SEQ ID NO: 80863 - DNA, 16 bp, H. sapiens
cctgagacagggaaga

SEQ ID NO: 80864 - DNA, 16 bp, H. sapiens
cctgagacctgggagg

SEQ ID NO: 80865 - DNA, 16 bp, H. sapiens
cctgagagagaagaaa

SEQ ID NO: 80866 - DNA, 16 bp, H. sapiens
cctgagagagagagag

SEQ ID NO: 80867 - DNA, 16 bp, H. sapiens
cctgagagcacagagg

SEQ ID NO: 80868 - DNA, 16 bp, H. sapiens
cctgagagccagagag

SEQ ID NO: 80869 - DNA, 16 bp, H. sapiens
cctgagatatttgctt

SEQ ID NO: 80870 - DNA, 16 bp, H. sapiens
cctgagattaaaaaaa

SEQ ID NO: 80871 - DNA, 16 bp, H. sapiens
cctgagcaacaagaat

SEQ ID NO: 80872 - DNA, 16 bp, H. sapiens
cctgagcaacaaggtg

SEQ ID NO: 80873 - DNA, 16 bp, H. sapiens
cctgagcaacagagcc

SEQ ID NO: 80874 - DNA, 16 bp, H. sapiens
cctgagcaacataaca

SEQ ID NO: 80875 - DNA, 16 bp, H. sapiens
cctgagcaacatggag

SEQ ID NO: 80876 - DNA, 16 bp, H. sapiens
cctgagcaacatggtg

SEQ ID NO: 80877 - DNA, 16 bp, H. sapiens
cctgagcaacgtagca

SEQ ID NO: 80878 - DNA, 16 bp, H. sapiens
cctgagcaataagagc

SEQ ID NO: 80879 - DNA, 16 bp, H. sapiens
cctgagcagcatggtg

SEQ ID NO: 80880 - DNA, 16 bp, H. sapiens
cctgagcaggaggaag

SEQ ID NO: 80881 - DNA, 16 bp, H. sapiens
cctgagcagggtgagg

SEQ ID NO: 80882 - DNA, 16 bp, H. sapiens
cctgagccaaggaggt

SEQ ID NO: 80883 - DNA, 16 bp, H. sapiens
cctgagccaccatgct

SEQ ID NO: 80884 - DNA, 16 bp, H. sapiens
cctgagccagaaggga

SEQ ID NO: 80885 - DNA, 16 bp, H. sapiens
cctgagcccaaggagg

SEQ ID NO: 80886 - DNA, 16 bp, H. sapiens
cctgagcccactttcc

SEQ ID NO: 80887 - DNA, 16 bp, H. sapiens
cctgagcccagccctg

SEQ ID NO: 80888 - DNA, 16 bp, H. sapiens
cctgagcccaggagtt

SEQ ID NO: 80889 - DNA, 16 bp, H. sapiens
cctgagcccaggattt

SEQ ID NO: 80890 - DNA, 16 bp, H. sapiens
cctgagcccagggaga

SEQ ID NO: 80891 - DNA, 16 bp, H. sapiens
cctgagcccaggggtt

SEQ ID NO: 80892 - DNA, 16 bp, H. sapiens
cctgagccccacctcc

SEQ ID NO: 80893 - DNA, 16 bp, H. sapiens
cctgagccccctcctc

SEQ ID NO: 80894 - DNA, 16 bp, H. sapiens
cctgagccctccccag

SEQ ID NO: 80895 - DNA, 16 bp, H. sapiens
cctgagccctgcccca

SEQ ID NO: 80896 - DNA, 16 bp, H. sapiens
cctgagcctcagttcc

SEQ ID NO: 80897 - DNA, 16 bp, H. sapiens
cctgagcctcagtttc

SEQ ID NO: 80898 - DNA, 16 bp, H. sapiens
cctgagcctccatttc

SEQ ID NO: 80899 - DNA, 16 bp, H. sapiens
cctgagcctcccaaag

SEQ ID NO: 80900 - DNA, 16 bp, H. sapiens
cctgagcctcccctcc

SEQ ID NO: 80901 - DNA, 16 bp, H. sapiens
cctgagcctcctgagt

SEQ ID NO: 80902 - DNA, 16 bp, H. sapiens
cctgagcctctgaaat

SEQ ID NO: 80903 - DNA, 16 bp, H. sapiens
cctgagcctgagcctg

SEQ ID NO: 80904 - DNA, 16 bp, H. sapiens
cctgagcctggaaggt

SEQ ID NO: 80905 - DNA, 16 bp, H. sapiens
cctgagcctggcaggt

SEQ ID NO: 80906 - DNA, 16 bp, H. sapiens
cctgagcctgggaagt

SEQ ID NO: 80907 - DNA, 16 bp, H. sapiens
cctgagcctggggaag

SEQ ID NO: 80908 - DNA, 16 bp, H. sapiens
cctgagcctggggagg

SEQ ID NO: 80909 - DNA, 16 bp, H. sapiens
cctgagcctgggtcct

SEQ ID NO: 80910 - DNA, 16 bp, H. sapiens
cctgagccttctgagt

SEQ ID NO: 80911 - DNA, 16 bp, H. sapiens
cctgagctcaaagtga

SEQ ID NO: 80912 - DNA, 16 bp, H. sapiens
cctgagctcaggaggt

SEQ ID NO: 80913 - DNA, 16 bp, H. sapiens
cctgagctcaggagtt

SEQ ID NO: 80914 - DNA, 16 bp, H. sapiens
cctgagctcagggagg

SEQ ID NO: 80915 - DNA, 16 bp, H. sapiens
cctgagctcaggggtt

SEQ ID NO: 80916 - DNA, 16 bp, H. sapiens
cctgagctccaaccag

SEQ ID NO: 80917 - DNA, 16 bp, H. sapiens
cctgagctccgcctcc

SEQ ID NO: 80918 - DNA, 16 bp, H. sapiens
cctgagctctggaagc

SEQ ID NO: 80919 - DNA, 16 bp, H. sapiens
cctgagctctgtctcc

SEQ ID NO: 80920 - DNA, 16 bp, H. sapiens
cctgagctcttgtctg

SEQ ID NO: 80921 - DNA, 16 bp, H. sapiens
cctgagctgcaggagg

SEQ ID NO: 80922 - DNA, 16 bp, H. sapiens
cctgagctgtactttg

SEQ ID NO: 80923 - DNA, 16 bp, H. sapiens
cctgagctgtgtgcag

SEQ ID NO: 80924 - DNA, 16 bp, H. sapiens
cctgaggaaagggaga

SEQ ID NO: 80925 - DNA, 16 bp, H. sapiens
cctgaggaacatagat

SEQ ID NO: 80926 - DNA, 16 bp, H. sapiens
cctgaggaactgtgag

SEQ ID NO: 80927 - DNA, 16 bp, H. sapiens
cctgaggaagaaactc

SEQ ID NO: 80928 - DNA, 16 bp, H. sapiens
cctgaggaagaagaaa

SEQ ID NO: 80929 - DNA, 16 bp, H. sapiens
cctgaggaagaagaga

SEQ ID NO: 80930 - DNA, 16 bp, H. sapiens
cctgaggaagaaggga

SEQ ID NO: 80931 - DNA, 16 bp, H. sapiens
cctgaggaagagaaag

SEQ ID NO: 80932 - DNA, 16 bp, H. sapiens
cctgaggaagaggaga

SEQ ID NO: 80933 - DNA, 17 bp, H. sapiens
cctgaggaatggccaca

SEQ ID NO: 80934 - DNA, 16 bp, H. sapiens
cctgaggaatggtgcc

SEQ ID NO: 80935 - DNA, 16 bp, H. sapiens
cctgaggacttcccag

SEQ ID NO: 80936 - DNA, 16 bp, H. sapiens
cctgaggaggaggagg

SEQ ID NO: 80937 - DNA, 16 bp, H. sapiens
cctgaggatggggctg

SEQ ID NO: 80938 - DNA, 16 bp, H. sapiens
cctgaggcaggagaac

SEQ ID NO: 80939 - DNA, 16 bp, H. sapiens
cctgaggcaggagaat

SEQ ID NO: 80940 - DNA, 16 bp, H. sapiens
cctgaggcaggaggat

SEQ ID NO: 80941 - DNA, 16 bp, H. sapiens
cctgaggcaggagtgt

SEQ ID NO: 80942 - DNA, 16 bp, H. sapiens
cctgaggcatgagaat

SEQ ID NO: 80943 - DNA, 16 bp, H. sapiens
cctgaggccacacagc

SEQ ID NO: 80944 - DNA, 16 bp, H. sapiens
cctgaggccaggaggt

SEQ ID NO: 80945 - DNA, 16 bp, H. sapiens
cctgaggccaggagtt

SEQ ID NO: 80946 - DNA, 16 bp, H. sapiens
cctgaggcccccccag

SEQ ID NO: 80947 - DNA, 16 bp, H. sapiens
cctgaggcccctctcc

SEQ ID NO: 80948 - DNA, 16 bp, H. sapiens
cctgaggcctcccaag

SEQ ID NO: 80949 - DNA, 16 bp, H. sapiens
cctgaggcctcccagg

SEQ ID NO: 80950 - DNA, 16 bp, H. sapiens
cctgaggcctccgcag

SEQ ID NO: 80951 - DNA, 16 bp, H. sapiens
cctgaggcctcctgag

SEQ ID NO: 80952 - DNA, 16 bp, H. sapiens
cctgaggcctctccag

SEQ ID NO: 80953 - DNA, 16 bp, H. sapiens
cctgaggcctctctcc

SEQ ID NO: 80954 - DNA, 16 bp, H. sapiens
cctgaggcctgggggt

SEQ ID NO: 80955 - DNA, 17 bp, H. sapiens
cctgaggcgggagaatc

SEQ ID NO: 80956 - DNA, 16 bp, H. sapiens
cctgaggctcccccag

SEQ ID NO: 80957 - DNA, 16 bp, H. sapiens
cctgaggctgaggtgg

SEQ ID NO: 80958 - DNA, 16 bp, H. sapiens
cctgaggctgcacagg

SEQ ID NO: 80959 - DNA, 16 bp, H. sapiens
cctgaggctgggaaat

SEQ ID NO: 80960 - DNA, 16 bp, H. sapiens
cctgaggcttctccag

SEQ ID NO: 80961 - DNA, 16 bp, H. sapiens
cctgagggacctggag

SEQ ID NO: 80962 - DNA, 16 bp, H. sapiens
cctgagggactgtgcc

SEQ ID NO: 80963 - DNA, 16 bp, H. sapiens
cctgagggagggaagg

SEQ ID NO: 80964 - DNA, 16 bp, H. sapiens
cctgagggcagggcct

SEQ ID NO: 80965 - DNA, 18 bp, H. sapiens
cctgagggctctactcac

SEQ ID NO: 80966 - DNA, 16 bp, H. sapiens
cctgagggctgtgtca

SEQ ID NO: 80967 - DNA, 16 bp, H. sapiens
cctgaggggagaaaac

SEQ ID NO: 80968 - DNA, 16 bp, H. sapiens
cctgaggggcctggag

SEQ ID NO: 80969 - DNA, 16 bp, H. sapiens
cctgagggggaaaaaa

SEQ ID NO: 80970 - DNA, 16 bp, H. sapiens
cctgagggtggagggt

SEQ ID NO: 80971 - DNA, 16 bp, H. sapiens
cctgaggtcaagagtt

SEQ ID NO: 80972 - DNA, 16 bp, H. sapiens
cctgaggtcacaagtt

SEQ ID NO: 80973 - DNA, 16 bp, H. sapiens
cctgaggtcacagagc

SEQ ID NO: 80974 - DNA, 16 bp, H. sapiens
cctgaggtcaggagtc

SEQ ID NO: 80975 - DNA, 16 bp, H. sapiens
cctgaggtcagggagt

SEQ ID NO: 80976 - DNA, 16 bp, H. sapiens
cctgaggtcagggatt

SEQ ID NO: 80977 - DNA, 16 bp, H. sapiens
cctgaggtgaagagtt

SEQ ID NO: 80978 - DNA, 16 bp, H. sapiens
cctgaggtgggagaat

SEQ ID NO: 80979 - DNA, 16 bp, H. sapiens
cctgagtactgggact

SEQ ID NO: 80980 - DNA, 16 bp, H. sapiens
cctgagtagctgggca

SEQ ID NO: 80981 - DNA, 16 bp, H. sapiens
cctgagtatcaccagc

SEQ ID NO: 80982 - DNA, 16 bp, H. sapiens
cctgagtatctggaac

SEQ ID NO: 80983 - DNA, 16 bp, H. sapiens
cctgagtcacccctgg

SEQ ID NO: 80984 - DNA, 16 bp, H. sapiens
cctgagtcagcctcct

SEQ ID NO: 80985 - DNA, 16 bp, H. sapiens
cctgagtctccagctt

SEQ ID NO: 80986 - DNA, 16 bp, H. sapiens
cctgagtgaactccca

SEQ ID NO: 80987 - DNA, 16 bp, H. sapiens
cctgagtgcagtggca

SEQ ID NO: 80988 - DNA, 16 bp, H. sapiens
cctgagtgcctgggac

SEQ ID NO: 80989 - DNA, 16 bp, H. sapiens
cctgagtggctgggat

SEQ ID NO: 80990 - DNA, 16 bp, H. sapiens
cctgagtggtaatgcc

SEQ ID NO: 80991 - DNA, 16 bp, H. sapiens
cctgagtggttgggac

SEQ ID NO: 80992 - DNA, 16 bp, H. sapiens
cctgagtgtgtgcaca

SEQ ID NO: 80993 - DNA, 16 bp, H. sapiens
cctgagttacttcacc

SEQ ID NO: 80994 - DNA, 16 bp, H. sapiens
cctgagttcaggagtt

SEQ ID NO: 80995 - DNA, 16 bp, H. sapiens
cctgagttctagtttc

SEQ ID NO: 80996 - DNA, 16 bp, H. sapiens
cctgagttctccccag

SEQ ID NO: 80997 - DNA, 16 bp, H. sapiens
cctgagttgctgggaa

SEQ ID NO: 80998 - DNA, 16 bp, H. sapiens
cctgagtttccagcct

SEQ ID NO: 80999 - DNA, 16 bp, H. sapiens
cctgagtttttctttt

SEQ ID NO: 81000 - DNA, 16 bp, H. sapiens
cctgataaacaacttc

SEQ ID NO: 81001 - DNA, 16 bp, H. sapiens
cctgataaacccattg

SEQ ID NO: 81002 - DNA, 16 bp, H. sapiens
cctgatacatagtaaa

SEQ ID NO: 81003 - DNA, 16 bp, H. sapiens
cctgataggaggtgat

SEQ ID NO: 81004 - DNA, 16 bp, H. sapiens
cctgatcagtcagcag

SEQ ID NO: 81005 - DNA, 16 bp, H. sapiens
cctgatcatggtgtat

SEQ ID NO: 81006 - DNA, 16 bp, H. sapiens
cctgatcccattcctc

SEQ ID NO: 81007 - DNA, 16 bp, H. sapiens
cctgatccctgtgcct

SEQ ID NO: 81008 - DNA, 16 bp, H. sapiens
cctgatctcaggcaat

SEQ ID NO: 81009 - DNA, 16 bp, H. sapiens
cctgatctcccaaaat

SEQ ID NO: 81010 - DNA, 16 bp, H. sapiens
cctgatctcccttggt

SEQ ID NO: 81011 - DNA, 16 bp, H. sapiens
cctgatgaagctgaaa

SEQ ID NO: 81012 - DNA, 16 bp, H. sapiens
cctgatgactaatgac

SEQ ID NO: 81013 - DNA, 16 bp, H. sapiens
cctgatgacttcactg

SEQ ID NO: 81014 - DNA, 16 bp, H. sapiens
cctgatgatctgagat

SEQ ID NO: 81015 - DNA, 16 bp, H. sapiens
cctgatgcaggaaatg

SEQ ID NO: 81016 - DNA, 16 bp, H. sapiens
cctgatgcccaggcca

SEQ ID NO: 81017 - DNA, 16 bp, H. sapiens
cctgatgcttttgtct

SEQ ID NO: 81018 - DNA, 16 bp, H. sapiens
cctgatggagctaaaa

SEQ ID NO: 81019 - DNA, 16 bp, H. sapiens
cctgatggccctggcc

SEQ ID NO: 81020 - DNA, 16 bp, H. sapiens
cctgatgggaggtgat

SEQ ID NO: 81021 - DNA, 16 bp, H. sapiens
cctgatgggaggtgtt

SEQ ID NO: 81022 - DNA, 16 bp, H. sapiens
cctgatgggtgtgaag

SEQ ID NO: 81023 - DNA, 16 bp, H. sapiens
cctgatgtaaatgatg

SEQ ID NO: 81024 - DNA, 16 bp, H. sapiens
cctgatgtaattatta

SEQ ID NO: 81025 - DNA, 16 bp, H. sapiens
cctgatgtccacctgg

SEQ ID NO: 81026 - DNA, 16 bp, H. sapiens
cctgatgtgattatta

SEQ ID NO: 81027 - DNA, 17 bp, H. sapiens
cctgattattgtaaata

SEQ ID NO: 81028 - DNA, 16 bp, H. sapiens
cctgattcactgctca

SEQ ID NO: 81029 - DNA, 16 bp, H. sapiens
cctgattcccacaaca

SEQ ID NO: 81030 - DNA, 16 bp, H. sapiens
cctgattcttcctgga

SEQ ID NO: 81031 - DNA, 16 bp, H. sapiens
cctgattgcccttgcc

SEQ ID NO: 81032 - DNA, 16 bp, H. sapiens
cctgatttcaaattat

SEQ ID NO: 81033 - DNA, 19 bp, H. sapiens
cctgatttcccactccaca

SEQ ID NO: 81034 - DNA, 16 bp, H. sapiens
cctgattttataaata

SEQ ID NO: 81035 - DNA, 16 bp, H. sapiens
cctgatttttaaatgg

SEQ ID NO: 81036 - DNA, 16 bp, H. sapiens
cctgatttttccagaa

SEQ ID NO: 81037 - DNA, 16 bp, H. sapiens
cctgcaaagccaaagg

SEQ ID NO: 81038 - DNA, 16 bp, H. sapiens
cctgcaaagcctaaaa

SEQ ID NO: 81039 - DNA, 16 bp, H. sapiens
cctgcaaagcctgaaa

SEQ ID NO: 81040 - DNA, 16 bp, H. sapiens
cctgcaaaggacatgg

SEQ ID NO: 81041 - DNA, 16 bp, H. sapiens
cctgcaaagtgctggg

SEQ ID NO: 81042 - DNA, 16 bp, H. sapiens
cctgcaaatcctgcca

SEQ ID NO: 81043 - DNA, 16 bp, H. sapiens
cctgcaacctctgcct

SEQ ID NO: 81044 - DNA, 16 bp, H. sapiens
cctgcaattacttttg

SEQ ID NO: 81045 - DNA, 16 bp, H. sapiens
cctgcacaaagccttg

SEQ ID NO: 81046 - DNA, 16 bp, H. sapiens
cctgcacaagctctct

SEQ ID NO: 81047 - DNA, 16 bp, H. sapiens
cctgcacaagctctgt

SEQ ID NO: 81048 - DNA, 17 bp, H. sapiens
cctgcacaatatgcaca

SEQ ID NO: 81049 - DNA, 16 bp, H. sapiens
cctgcacacacacaca

SEQ ID NO: 81050 - DNA, 16 bp, H. sapiens
cctgcacacacacctg

SEQ ID NO: 81051 - DNA, 16 bp, H. sapiens
cctgcacacacctgcc

SEQ ID NO: 81052 - DNA, 16 bp, H. sapiens
cctgcacacattctct

SEQ ID NO: 81053 - DNA, 16 bp, H. sapiens
cctgcacagcaaagga

SEQ ID NO: 81054 - DNA, 16 bp, H. sapiens
cctgcacagcctgcag

SEQ ID NO: 81055 - DNA, 16 bp, H. sapiens
cctgcacagctaagtg

SEQ ID NO: 81056 - DNA, 16 bp, H. sapiens
cctgcacagttgaaaa

SEQ ID NO: 81057 - DNA, 16 bp, H. sapiens
cctgcacatgctttct

SEQ ID NO: 81058 - DNA, 16 bp, H. sapiens
cctgcacatggacccc

SEQ ID NO: 81059 - DNA, 16 bp, H. sapiens
cctgcacatgtaccca

SEQ ID NO: 81060 - DNA, 16 bp, H. sapiens
cctgcacatgtactcc

SEQ ID NO: 81061 - DNA, 16 bp, H. sapiens
cctgcaccaccatgcc

SEQ ID NO: 81062 - DNA, 16 bp, H. sapiens
cctgcaccagcctccc

SEQ ID NO: 81063 - DNA, 16 bp, H. sapiens
cctgcacccaggcgct

SEQ ID NO: 81064 - DNA, 25 bp, H. sapiens
cctgcacccaggtgaaataaacagc

SEQ ID NO: 81065 - DNA, 16 bp, H. sapiens
cctgcacccccatgtt

SEQ ID NO: 81066 - DNA, 16 bp, H. sapiens
cctgcacctccacacc

SEQ ID NO: 81067 - DNA, 16 bp, H. sapiens
cctgcacctgcacctg

SEQ ID NO: 81068 - DNA, 16 bp, H. sapiens
cctgcacctgcccatc

SEQ ID NO: 81069 - DNA, 16 bp, H. sapiens
cctgcacctggaaaag

SEQ ID NO: 81070 - DNA, 16 bp, H. sapiens
cctgcacctggaactg

SEQ ID NO: 81071 - DNA, 16 bp, H. sapiens
cctgcacctggagatg

SEQ ID NO: 81072 - DNA, 17 bp, H. sapiens
cctgcacgttgtgcact

SEQ ID NO: 81073 - DNA, 16 bp, H. sapiens
cctgcactccagcatg

SEQ ID NO: 81074 - DNA, 16 bp, H. sapiens
cctgcactccagccca

SEQ ID NO: 81075 - DNA, 16 bp, H. sapiens
cctgcactccatcctg

SEQ ID NO: 81076 - DNA, 16 bp, H. sapiens
cctgcactgagctgtg

SEQ ID NO: 81077 - DNA, 16 bp, H. sapiens
cctgcagaaccaggag

SEQ ID NO: 81078 - DNA, 16 bp, H. sapiens
cctgcagaaccataag

SEQ ID NO: 81079 - DNA, 16 bp, H. sapiens
cctgcagaaccctgag

SEQ ID NO: 81080 - DNA, 16 bp, H. sapiens
cctgcagaactgcgag

SEQ ID NO: 81081 - DNA, 16 bp, H. sapiens
cctgcagaatgagaga

SEQ ID NO: 81082 - DNA, 16 bp, H. sapiens
cctgcagaccctgacc

SEQ ID NO: 81083 - DNA, 16 bp, H. sapiens
cctgcagaccctggcc

SEQ ID NO: 81084 - DNA, 16 bp, H. sapiens
cctgcagagaggagct

SEQ ID NO: 81085 - DNA, 16 bp, H. sapiens
cctgcagaggcaggca

SEQ ID NO: 81086 - DNA, 16 bp, H. sapiens
cctgcagataacatca

SEQ ID NO: 81087 - DNA, 16 bp, H. sapiens
cctgcagcacccccag

SEQ ID NO: 81088 - DNA, 16 bp, H. sapiens
cctgcagcagaagggc

SEQ ID NO: 81089 - DNA, 16 bp, H. sapiens
cctgcagcagaggggc

SEQ ID NO: 81090 - DNA, 16 bp, H. sapiens
cctgcagcagctgctg

SEQ ID NO: 81091 - DNA, 16 bp, H. sapiens
cctgcagccagcattg

SEQ ID NO: 81092 - DNA, 16 bp, H. sapiens
cctgcagcccaccatg

SEQ ID NO: 81093 - DNA, 16 bp, H. sapiens
cctgcagcccagcccc

SEQ ID NO: 81094 - DNA, 16 bp, H. sapiens
cctgcagcccatgggc

SEQ ID NO: 81095 - DNA, 16 bp, H. sapiens
cctgcagccccagccc

SEQ ID NO: 81096 - DNA, 16 bp, H. sapiens
cctgcagccccctgcc

SEQ ID NO: 81097 - DNA, 16 bp, H. sapiens
cctgcagcccctgcct

SEQ ID NO: 81098 - DNA, 16 bp, H. sapiens
cctgcagcccctgtgc

SEQ ID NO: 81099 - DNA, 16 bp, H. sapiens
cctgcagcccctttcc

SEQ ID NO: 81100 - DNA, 16 bp, H. sapiens
cctgcagccctggtgt

SEQ ID NO: 81101 - DNA, 16 bp, H. sapiens
cctgcagcctccaccc

SEQ ID NO: 81102 - DNA, 16 bp, H. sapiens
cctgcagcctccacct

SEQ ID NO: 81103 - DNA, 16 bp, H. sapiens
cctgcagcctcctctc

SEQ ID NO: 81104 - DNA, 16 bp, H. sapiens
cctgcagctccccctg

SEQ ID NO: 81105 - DNA, 16 bp, H. sapiens
cctgcagctctgggag

SEQ ID NO: 81106 - DNA, 16 bp, H. sapiens
cctgcagctgagggac

SEQ ID NO: 81107 - DNA, 16 bp, H. sapiens
cctgcagctgagggcc

SEQ ID NO: 81108 - DNA, 16 bp, H. sapiens
cctgcagctgaggggt

SEQ ID NO: 81109 - DNA, 16 bp, H. sapiens
cctgcagctgagggtc

SEQ ID NO: 81110 - DNA, 16 bp, H. sapiens
cctgcagctgcaggca

SEQ ID NO: 81111 - DNA, 16 bp, H. sapiens
cctgcagctttcccag

SEQ ID NO: 81112 - DNA, 16 bp, H. sapiens
cctgcaggactgtgag

SEQ ID NO: 81113 - DNA, 16 bp, H. sapiens
cctgcaggatcctccc

SEQ ID NO: 81114 - DNA, 16 bp, H. sapiens
cctgcaggccaaatct

SEQ ID NO: 81115 - DNA, 16 bp, H. sapiens
cctgcaggccagcacc

SEQ ID NO: 81116 - DNA, 16 bp, H. sapiens
cctgcagggaagcccc

SEQ ID NO: 81117 - DNA, 16 bp, H. sapiens
cctgcagggaggcagc

SEQ ID NO: 81118 - DNA, 16 bp, H. sapiens
cctgcagggaggcccc

SEQ ID NO: 81119 - DNA, 16 bp, H. sapiens
cctgcagggaggccct

SEQ ID NO: 81120 - DNA, 16 bp, H. sapiens
cctgcagggtggccat

SEQ ID NO: 81121 - DNA, 16 bp, H. sapiens
cctgcaggtgcacaga

SEQ ID NO: 81122 - DNA, 16 bp, H. sapiens
cctgcaggtggaggag

SEQ ID NO: 81123 - DNA, 16 bp, H. sapiens
cctgcaggtgtgcaga

SEQ ID NO: 81124 - DNA, 16 bp, H. sapiens
cctgcagtcccagctg

SEQ ID NO: 81125 - DNA, 18 bp, H. sapiens
cctgcagtgagccaagat

SEQ ID NO: 81126 - DNA, 16 bp, H. sapiens
cctgcagtgagcccag

SEQ ID NO: 81127 - DNA, 16 bp, H. sapiens
cctgcagtgcccagga

SEQ ID NO: 81128 - DNA, 16 bp, H. sapiens
cctgcagtgctgggat

SEQ ID NO: 81129 - DNA, 16 bp, H. sapiens
cctgcataagctctct

SEQ ID NO: 81130 - DNA, 16 bp, H. sapiens
cctgcatcccttggct

SEQ ID NO: 81131 - DNA, 16 bp, H. sapiens
cctgcatcctggctgc

SEQ ID NO: 81132 - DNA, 16 bp, H. sapiens
cctgcatctgcctccc

SEQ ID NO: 81133 - DNA, 16 bp, H. sapiens
cctgcatggtggctca

SEQ ID NO: 81134 - DNA, 16 bp, H. sapiens
cctgcattatctcatt

SEQ ID NO: 81135 - DNA, 16 bp, H. sapiens
cctgccaaaaccaaga

SEQ ID NO: 81136 - DNA, 16 bp, H. sapiens
cctgccacaacaccca

SEQ ID NO: 81137 - DNA, 16 bp, H. sapiens
cctgccaccaaacccg

SEQ ID NO: 81138 - DNA, 16 bp, H. sapiens
cctgccaccacaccct

SEQ ID NO: 81139 - DNA, 16 bp, H. sapiens
cctgccaccacacctg

SEQ ID NO: 81140 - DNA, 16 bp, H. sapiens
cctgccaccacagctg

SEQ ID NO: 81141 - DNA, 16 bp, H. sapiens
cctgccaccacccctg

SEQ ID NO: 81142 - DNA, 16 bp, H. sapiens
cctgccaccacgactg

SEQ ID NO: 81143 - DNA, 16 bp, H. sapiens
cctgccaccacgctgg

SEQ ID NO: 81144 - DNA, 16 bp, H. sapiens
cctgccaccaggccca

SEQ ID NO: 81145 - DNA, 16 bp, H. sapiens
cctgccaccatgctca

SEQ ID NO: 81146 - DNA, 16 bp, H. sapiens
cctgccaccatggcca

SEQ ID NO: 81147 - DNA, 16 bp, H. sapiens
cctgccacccctgcct

SEQ ID NO: 81148 - DNA, 16 bp, H. sapiens
cctgccaccctgccca

SEQ ID NO: 81149 - DNA, 16 bp, H. sapiens
cctgccaccgcgcctg

SEQ ID NO: 81150 - DNA, 16 bp, H. sapiens
cctgccacctgttttt

SEQ ID NO: 81151 - DNA, 16 bp, H. sapiens
cctgccactgcaccca

SEQ ID NO: 81152 - DNA, 16 bp, H. sapiens
cctgccactgccacca

SEQ ID NO: 81153 - DNA, 16 bp, H. sapiens
cctgccactgccactg

SEQ ID NO: 81154 - DNA, 16 bp, H. sapiens
cctgccactgtgccca

SEQ ID NO: 81155 - DNA, 16 bp, H. sapiens
cctgccactttgttta

SEQ ID NO: 81156 - DNA, 16 bp, H. sapiens
cctgccagagaacaaa

SEQ ID NO: 81157 - DNA, 16 bp, H. sapiens
cctgccagatccagag

SEQ ID NO: 81158 - DNA, 16 bp, H. sapiens
cctgccagatctggag

SEQ ID NO: 81159 - DNA, 16 bp, H. sapiens
cctgccagcacgcctg

SEQ ID NO: 81160 - DNA, 16 bp, H. sapiens
cctgccagcagcctca

SEQ ID NO: 81161 - DNA, 16 bp, H. sapiens
cctgccagcatgcctg

SEQ ID NO: 81162 - DNA, 16 bp, H. sapiens
cctgccagccccagcc

SEQ ID NO: 81163 - DNA, 16 bp, H. sapiens
cctgccagccctgccc

SEQ ID NO: 81164 - DNA, 16 bp, H. sapiens
cctgccagcctcctcc

SEQ ID NO: 81165 - DNA, 16 bp, H. sapiens
cctgccagctcaagtg

SEQ ID NO: 81166 - DNA, 16 bp, H. sapiens
cctgccaggccagcag

SEQ ID NO: 81167 - DNA, 16 bp, H. sapiens
cctgccaggctgagtg

SEQ ID NO: 81168 - DNA, 16 bp, H. sapiens
cctgccaggctgcagc

SEQ ID NO: 81169 - DNA, 16 bp, H. sapiens
cctgccagggaaccca

SEQ ID NO: 81170 - DNA, 16 bp, H. sapiens
cctgccagtcactcag

SEQ ID NO: 81171 - DNA, 16 bp, H. sapiens
cctgccagtgcccaaa

SEQ ID NO: 81172 - DNA, 16 bp, H. sapiens
cctgccagtggcctct

SEQ ID NO: 81173 - DNA, 16 bp, H. sapiens
cctgccatcatgcctg

SEQ ID NO: 81174 - DNA, 16 bp, H. sapiens
cctgcccaaacctcat

SEQ ID NO: 81175 - DNA, 17 bp, H. sapiens
cctgcccaacatggaga

SEQ ID NO: 81176 - DNA, 16 bp, H. sapiens
cctgcccaaggtgagg

SEQ ID NO: 81177 - DNA, 16 bp, H. sapiens
cctgcccacaccttga

SEQ ID NO: 81178 - DNA, 16 bp, H. sapiens
cctgcccaccacacac

SEQ ID NO: 81179 - DNA, 16 bp, H. sapiens
cctgcccacctcccag

SEQ ID NO: 81180 - DNA, 16 bp, H. sapiens
cctgcccacctctcca

SEQ ID NO: 81181 - DNA, 16 bp, H. sapiens
cctgcccacctctgcc

SEQ ID NO: 81182 - DNA, 16 bp, H. sapiens
cctgcccacctgccca

SEQ ID NO: 81183 - DNA, 16 bp, H. sapiens
cctgcccacctgcctg

SEQ ID NO: 81184 - DNA, 16 bp, H. sapiens
cctgcccactgaggtg

SEQ ID NO: 81185 - DNA, 16 bp, H. sapiens
cctgcccacttcagcc

SEQ ID NO: 81186 - DNA, 16 bp, H. sapiens
cctgcccagaaggaaa

SEQ ID NO: 81187 - DNA, 16 bp, H. sapiens
cctgcccagaccctgg

SEQ ID NO: 81188 - DNA, 16 bp, H. sapiens
cctgcccagccatgtg

SEQ ID NO: 81189 - DNA, 16 bp, H. sapiens
cctgcccagcccacag

SEQ ID NO: 81190 - DNA, 16 bp, H. sapiens
cctgcccagcccacca

SEQ ID NO: 81191 - DNA, 16 bp, H. sapiens
cctgcccagcccacct

SEQ ID NO: 81192 - DNA, 16 bp, H. sapiens
cctgcccagccccagc

SEQ ID NO: 81193 - DNA, 16 bp, H. sapiens
cctgcccagcccctgc

SEQ ID NO: 81194 - DNA, 16 bp, H. sapiens
cctgcccagccctgcc

SEQ ID NO: 81195 - DNA, 16 bp, H. sapiens
cctgcccagcctcctg

SEQ ID NO: 81196 - DNA, 16 bp, H. sapiens
cctgcccagcctgccc

SEQ ID NO: 81197 - DNA, 16 bp, H. sapiens
cctgcccagccttcct

SEQ ID NO: 81198 - DNA, 16 bp, H. sapiens
cctgcccaggactggc

SEQ ID NO: 81199 - DNA, 16 bp, H. sapiens
cctgcccaggcccctg

SEQ ID NO: 81200 - DNA, 16 bp, H. sapiens
cctgcccaggccctgg

SEQ ID NO: 81201 - DNA, 16 bp, H. sapiens
cctgcccagtgaggag

SEQ ID NO: 81202 - DNA, 16 bp, H. sapiens
cctgcccagtgcctgg

SEQ ID NO: 81203 - DNA, 16 bp, H. sapiens
cctgcccatctgcatg

SEQ ID NO: 81204 - DNA, 16 bp, H. sapiens
cctgccccacacccag

SEQ ID NO: 81205 - DNA, 16 bp, H. sapiens
cctgccccaccctgct

SEQ ID NO: 81206 - DNA, 16 bp, H. sapiens
cctgccccagccccag

SEQ ID NO: 81207 - DNA, 16 bp, H. sapiens
cctgccccagccctgg

SEQ ID NO: 81208 - DNA, 16 bp, H. sapiens
cctgccccagcctcac

SEQ ID NO: 81209 - DNA, 16 bp, H. sapiens
cctgccccagcctcag

SEQ ID NO: 81210 - DNA, 16 bp, H. sapiens
cctgccccagcctctg

SEQ ID NO: 81211 - DNA, 16 bp, H. sapiens
cctgccccagcctttc

SEQ ID NO: 81212 - DNA, 16 bp, H. sapiens
cctgccccaggacctt

SEQ ID NO: 81213 - DNA, 16 bp, H. sapiens
cctgccccaggcccag

SEQ ID NO: 81214 - DNA, 16 bp, H. sapiens
cctgccccaggccctg

SEQ ID NO: 81215 - DNA, 16 bp, H. sapiens
cctgccccaggcctgg

SEQ ID NO: 81216 - DNA, 16 bp, H. sapiens
cctgccccaggctctc

SEQ ID NO: 81217 - DNA, 16 bp, H. sapiens
cctgccccagggcctg

SEQ ID NO: 81218 - DNA, 16 bp, H. sapiens
cctgccccaggtcaca

SEQ ID NO: 81219 - DNA, 16 bp, H. sapiens
cctgccccagtcctgg

SEQ ID NO: 81220 - DNA, 16 bp, H. sapiens
cctgccccatggggag

SEQ ID NO: 81221 - DNA, 16 bp, H. sapiens
cctgcccccaaaggtg

SEQ ID NO: 81222 - DNA, 16 bp, H. sapiens
cctgcccccaccaaaa

SEQ ID NO: 81223 - DNA, 16 bp, H. sapiens
cctgcccccagagatg

SEQ ID NO: 81224 - DNA, 16 bp, H. sapiens
cctgcccccagcccag

SEQ ID NO: 81225 - DNA, 16 bp, H. sapiens
cctgcccccagccctg

SEQ ID NO: 81226 - DNA, 16 bp, H. sapiens
cctgcccccatggagc

SEQ ID NO: 81227 - DNA, 16 bp, H. sapiens
cctgcccccggaggtg

SEQ ID NO: 81228 - DNA, 18 bp, H. sapiens
cctgccccgcaggaaggc

SEQ ID NO: 81229 - DNA, 16 bp, H. sapiens
cctgcccctcagcctc

SEQ ID NO: 81230 - DNA, 16 bp, H. sapiens
cctgcccctctctggg

SEQ ID NO: 81231 - DNA, 16 bp, H. sapiens
cctgcccctgcactcc

SEQ ID NO: 81232 - DNA, 16 bp, H. sapiens
cctgcccctgcagcaa

SEQ ID NO: 81233 - DNA, 16 bp, H. sapiens
cctgcccctgccacct

SEQ ID NO: 81234 - DNA, 16 bp, H. sapiens
cctgcccctgcccaca

SEQ ID NO: 81235 - DNA, 16 bp, H. sapiens
cctgcccctgccctgg

SEQ ID NO: 81236 - DNA, 16 bp, H. sapiens
cctgcccctgcccttg

SEQ ID NO: 81237 - DNA, 16 bp, H. sapiens
cctgcccctgcctgca

SEQ ID NO: 81238 - DNA, 16 bp, H. sapiens
cctgcccctgctcctg

SEQ ID NO: 81239 - DNA, 16 bp, H. sapiens
cctgcccctgctgctg

SEQ ID NO: 81240 - DNA, 16 bp, H. sapiens
cctgcccctgtctgcc

SEQ ID NO: 81241 - DNA, 16 bp, H. sapiens
cctgcccctttccacc

SEQ ID NO: 81242 - DNA, 16 bp, H. sapiens
cctgcccctttgtctt

SEQ ID NO: 81243 - DNA, 17 bp, H. sapiens
cctgccccttttgcttt

SEQ ID NO: 81244 - DNA, 16 bp, H. sapiens
cctgcccgcctgcctg

SEQ ID NO: 81245 - DNA, 16 bp, H. sapiens
cctgccctcaaacatc

SEQ ID NO: 81246 - DNA, 16 bp, H. sapiens
cctgccctcagcctcc

SEQ ID NO: 81247 - DNA, 16 bp, H. sapiens
cctgccctcaggaagc

SEQ ID NO: 81248 - DNA, 16 bp, H. sapiens
cctgccctcatggagc

SEQ ID NO: 81249 - DNA, 16 bp, H. sapiens
cctgccctccagccac

SEQ ID NO: 81250 - DNA, 16 bp, H. sapiens
cctgccctccagctgc

SEQ ID NO: 81251 - DNA, 16 bp, H. sapiens
cctgccctccaggagc

SEQ ID NO: 81252 - DNA, 16 bp, H. sapiens
cctgccctcccagcct

SEQ ID NO: 81253 - DNA, 16 bp, H. sapiens
cctgccctcctactac

SEQ ID NO: 81254 - DNA, 16 bp, H. sapiens
cctgccctcctggagc

SEQ ID NO: 81255 - DNA, 16 bp, H. sapiens
cctgccctcctgggcc

SEQ ID NO: 81256 - DNA, 16 bp, H. sapiens
cctgccctctccccag

SEQ ID NO: 81257 - DNA, 16 bp, H. sapiens
cctgccctctgctctg

SEQ ID NO: 81258 - DNA, 16 bp, H. sapiens
cctgccctgacctccc

SEQ ID NO: 81259 - DNA, 16 bp, H. sapiens
cctgccctgcagcctg

SEQ ID NO: 81260 - DNA, 16 bp, H. sapiens
cctgccctgcccacct

SEQ ID NO: 81261 - DNA, 16 bp, H. sapiens
cctgccctgccctctg

SEQ ID NO: 81262 - DNA, 16 bp, H. sapiens
cctgccctgccctgac

SEQ ID NO: 81263 - DNA, 16 bp, H. sapiens
cctgccctgccctgct

SEQ ID NO: 81264 - DNA, 16 bp, H. sapiens
cctgccctgccctggc

SEQ ID NO: 81265 - DNA, 16 bp, H. sapiens
cctgccctgccctggg

SEQ ID NO: 81266 - DNA, 16 bp, H. sapiens
cctgccctgcctcctg

SEQ ID NO: 81267 - DNA, 16 bp, H. sapiens
cctgccctgcctctgc

SEQ ID NO: 81268 - DNA, 16 bp, H. sapiens
cctgccctgcctgctg

SEQ ID NO: 81269 - DNA, 16 bp, H. sapiens
cctgccctgcctggcc

SEQ ID NO: 81270 - DNA, 16 bp, H. sapiens
cctgccctgcctggct

SEQ ID NO: 81271 - DNA, 16 bp, H. sapiens
cctgccctgcctgggg

SEQ ID NO: 81272 - DNA, 16 bp, H. sapiens
cctgccctgccttgcc

SEQ ID NO: 81273 - DNA, 16 bp, H. sapiens
cctgccctggaacatc

SEQ ID NO: 81274 - DNA, 16 bp, H. sapiens
cctgccctggccaccc

SEQ ID NO: 81275 - DNA, 16 bp, H. sapiens
cctgccctggccctac

SEQ ID NO: 81276 - DNA, 16 bp, H. sapiens
cctgccctggccctga

SEQ ID NO: 81277 - DNA, 16 bp, H. sapiens
cctgccctggcctcca

SEQ ID NO: 81278 - DNA, 16 bp, H. sapiens
cctgccctggccttcc

SEQ ID NO: 81279 - DNA, 16 bp, H. sapiens
cctgccctgggccagg

SEQ ID NO: 81280 - DNA, 16 bp, H. sapiens
cctgccctgggcccca

SEQ ID NO: 81281 - DNA, 16 bp, H. sapiens
cctgccctgggccctg

SEQ ID NO: 81282 - DNA, 16 bp, H. sapiens
cctgccctgggcctgg

SEQ ID NO: 81283 - DNA, 16 bp, H. sapiens
cctgccctgtccccag

SEQ ID NO: 81284 - DNA, 16 bp, H. sapiens
cctgccctgtcctgcc

SEQ ID NO: 81285 - DNA, 16 bp, H. sapiens
cctgccctgtggtgct

SEQ ID NO: 81286 - DNA, 16 bp, H. sapiens
cctgccctgtgtccat

SEQ ID NO: 81287 - DNA, 16 bp, H. sapiens
cctgcccttgaatatc

SEQ ID NO: 81288 - DNA, 16 bp, H. sapiens
cctgccgagtgcctgc

SEQ ID NO: 81289 - DNA, 16 bp, H. sapiens
cctgccgtggcctccc

SEQ ID NO: 81290 - DNA, 16 bp, H. sapiens
cctgcctaccagacac

SEQ ID NO: 81291 - DNA, 16 bp, H. sapiens
cctgcctatgcctccc

SEQ ID NO: 81292 - DNA, 16 bp, H. sapiens
cctgcctcaacttccc

SEQ ID NO: 81293 - DNA, 16 bp, H. sapiens
cctgcctcagactcca

SEQ ID NO: 81294 - DNA, 16 bp, H. sapiens
cctgcctcagcatccc

SEQ ID NO: 81295 - DNA, 16 bp, H. sapiens
cctgcctcagcatctg

SEQ ID NO: 81296 - DNA, 16 bp, H. sapiens
cctgcctcagccccac

SEQ ID NO: 81297 - DNA, 16 bp, H. sapiens
cctgcctcagccccag

SEQ ID NO: 81298 - DNA, 16 bp, H. sapiens
cctgcctcagcccgcc

SEQ ID NO: 81299 - DNA, 16 bp, H. sapiens
cctgcctcagccctct

SEQ ID NO: 81300 - DNA, 16 bp, H. sapiens
cctgcctcagcccttc

SEQ ID NO: 81301 - DNA, 16 bp, H. sapiens
cctgcctcagccgcct

SEQ ID NO: 81302 - DNA, 16 bp, H. sapiens
cctgcctcagcctcgc

SEQ ID NO: 81303 - DNA, 16 bp, H. sapiens
cctgcctcagcctctt

SEQ ID NO: 81304 - DNA, 16 bp, H. sapiens
cctgcctcagcctggg

SEQ ID NO: 81305 - DNA, 16 bp, H. sapiens
cctgcctcagccttca

SEQ ID NO: 81306 - DNA, 16 bp, H. sapiens
cctgcctcagcgtccc

SEQ ID NO: 81307 - DNA, 16 bp, H. sapiens
cctgcctcagctacct

SEQ ID NO: 81308 - DNA, 16 bp, H. sapiens
cctgcctcagctccct

SEQ ID NO: 81309 - DNA, 16 bp, H. sapiens
cctgcctcagctgctc

SEQ ID NO: 81310 - DNA, 16 bp, H. sapiens
cctgcctcagcttctc

SEQ ID NO: 81311 - DNA, 16 bp, H. sapiens
cctgcctcaggatccc

SEQ ID NO: 81312 - DNA, 16 bp, H. sapiens
cctgcctcaggccccc

SEQ ID NO: 81313 - DNA, 16 bp, H. sapiens
cctgcctcaggccctg

SEQ ID NO: 81314 - DNA, 16 bp, H. sapiens
cctgcctcaggctcct

SEQ ID NO: 81315 - DNA, 16 bp, H. sapiens
cctgcctcagggcttt

SEQ ID NO: 81316 - DNA, 16 bp, H. sapiens
cctgcctcagtccccc

SEQ ID NO: 81317 - DNA, 16 bp, H. sapiens
cctgcctcagtctctc

SEQ ID NO: 81318 - DNA, 16 bp, H. sapiens
cctgcctcagtgcccc

SEQ ID NO: 81319 - DNA, 16 bp, H. sapiens
cctgcctcagtgtccc

SEQ ID NO: 81320 - DNA, 16 bp, H. sapiens
cctgcctcagttcccc

SEQ ID NO: 81321 - DNA, 16 bp, H. sapiens
cctgcctcagtttccc

SEQ ID NO: 81322 - DNA, 16 bp, H. sapiens
cctgcctcatcctccc

SEQ ID NO: 81323 - DNA, 16 bp, H. sapiens
cctgcctcatcctccg

SEQ ID NO: 81324 - DNA, 16 bp, H. sapiens
cctgcctcatcctcct

SEQ ID NO: 81325 - DNA, 16 bp, H. sapiens
cctgcctcatctcccc

SEQ ID NO: 81326 - DNA, 16 bp, H. sapiens
cctgcctccacctcca

SEQ ID NO: 81327 - DNA, 16 bp, H. sapiens
cctgcctccacctgcc

SEQ ID NO: 81328 - DNA, 16 bp, H. sapiens
cctgcctccaccttcc

SEQ ID NO: 81329 - DNA, 16 bp, H. sapiens
cctgcctccagcccct

SEQ ID NO: 81330 - DNA, 16 bp, H. sapiens
cctgcctccagcctgg

SEQ ID NO: 81331 - DNA, 16 bp, H. sapiens
cctgcctccagccttc

SEQ ID NO: 81332 - DNA, 16 bp, H. sapiens
cctgcctccatctccc

SEQ ID NO: 81333 - DNA, 16 bp, H. sapiens
cctgcctccatctcct

SEQ ID NO: 81334 - DNA, 16 bp, H. sapiens
cctgcctccatttccc

SEQ ID NO: 81335 - DNA, 16 bp, H. sapiens
cctgcctcccagcaag

SEQ ID NO: 81336 - DNA, 16 bp, H. sapiens
cctgcctcccagccac

SEQ ID NO: 81337 - DNA, 16 bp, H. sapiens
cctgcctcccatcctc

SEQ ID NO: 81338 - DNA, 16 bp, H. sapiens
cctgcctcccattctg

SEQ ID NO: 81339 - DNA, 16 bp, H. sapiens
cctgcctccccttcac

SEQ ID NO: 81340 - DNA, 16 bp, H. sapiens
cctgcctccctgccca

SEQ ID NO: 81341 - DNA, 16 bp, H. sapiens
cctgcctccctgcctg

SEQ ID NO: 81342 - DNA, 16 bp, H. sapiens
cctgcctccgcctctg

SEQ ID NO: 81343 - DNA, 16 bp, H. sapiens
cctgcctcctccagcc

SEQ ID NO: 81344 - DNA, 16 bp, H. sapiens
cctgcctcctccagga

SEQ ID NO: 81345 - DNA, 16 bp, H. sapiens
cctgcctcctctccag

SEQ ID NO: 81346 - DNA, 16 bp, H. sapiens
cctgcctcctgccacc

SEQ ID NO: 81347 - DNA, 16 bp, H. sapiens
cctgcctcctgccctg

SEQ ID NO: 81348 - DNA, 16 bp, H. sapiens
cctgcctcctggggct

SEQ ID NO: 81349 - DNA, 16 bp, H. sapiens
cctgcctccttcccag

SEQ ID NO: 81350 - DNA, 16 bp, H. sapiens
cctgcctcgacttccc

SEQ ID NO: 81351 - DNA, 16 bp, H. sapiens
cctgcctcgcctcctg

SEQ ID NO: 81352 - DNA, 16 bp, H. sapiens
cctgcctcggccaccc

SEQ ID NO: 81353 - DNA, 16 bp, H. sapiens
cctgcctcggcctcct

SEQ ID NO: 81354 - DNA, 16 bp, H. sapiens
cctgcctcggcctctc

SEQ ID NO: 81355 - DNA, 16 bp, H. sapiens
cctgcctcggccttcc

SEQ ID NO: 81356 - DNA, 16 bp, H. sapiens
cctgcctcggccttgc

SEQ ID NO: 81357 - DNA, 16 bp, H. sapiens
cctgcctcgggcctcc

SEQ ID NO: 81358 - DNA, 16 bp, H. sapiens
cctgcctcggtgtccc

SEQ ID NO: 81359 - DNA, 16 bp, H. sapiens
cctgcctcggtttccc

SEQ ID NO: 81360 - DNA, 16 bp, H. sapiens
cctgcctctaaaaaaa

SEQ ID NO: 81361 - DNA, 16 bp, H. sapiens
cctgcctctagtaaaa

SEQ ID NO: 81362 - DNA, 16 bp, H. sapiens
cctgcctctcagcctc

SEQ ID NO: 81363 - DNA, 16 bp, H. sapiens
cctgcctctccagcct

SEQ ID NO: 81364 - DNA, 16 bp, H. sapiens
cctgcctctccccagc

SEQ ID NO: 81365 - DNA, 16 bp, H. sapiens
cctgcctctccctgca

SEQ ID NO: 81366 - DNA, 16 bp, H. sapiens
cctgcctctctcccca

SEQ ID NO: 81367 - DNA, 16 bp, H. sapiens
cctgcctctctggctg

SEQ ID NO: 81368 - DNA, 16 bp, H. sapiens
cctgcctctgcatccc

SEQ ID NO: 81369 - DNA, 16 bp, H. sapiens
cctgcctctgccccag

SEQ ID NO: 81370 - DNA, 16 bp, H. sapiens
cctgcctctgcctcca

SEQ ID NO: 81371 - DNA, 16 bp, H. sapiens
cctgcctctgcctctg

SEQ ID NO: 81372 - DNA, 16 bp, H. sapiens
cctgcctctgctccca

SEQ ID NO: 81373 - DNA, 16 bp, H. sapiens
cctgcctctgtctctg

SEQ ID NO: 81374 - DNA, 16 bp, H. sapiens
cctgcctcttccatgt

SEQ ID NO: 81375 - DNA, 16 bp, H. sapiens
cctgcctctttgcaga

SEQ ID NO: 81376 - DNA, 16 bp, H. sapiens
cctgcctgagtctcag

SEQ ID NO: 81377 - DNA, 16 bp, H. sapiens
cctgcctgccacctcc

SEQ ID NO: 81378 - DNA, 16 bp, H. sapiens
cctgcctgccactgta

SEQ ID NO: 81379 - DNA, 16 bp, H. sapiens
cctgcctgccagagaa

SEQ ID NO: 81380 - DNA, 16 bp, H. sapiens
cctgcctgcccagccc

SEQ ID NO: 81381 - DNA, 16 bp, H. sapiens
cctgcctgcccccagc

SEQ ID NO: 81382 - DNA, 16 bp, H. sapiens
cctgcctgcccgcctg

SEQ ID NO: 81383 - DNA, 16 bp, H. sapiens
cctgcctgccctctgc

SEQ ID NO: 81384 - DNA, 16 bp, H. sapiens
cctgcctgccctgcag

SEQ ID NO: 81385 - DNA, 16 bp, H. sapiens
cctgcctgccctgcct

SEQ ID NO: 81386 - DNA, 16 bp, H. sapiens
cctgcctgcctacctg

SEQ ID NO: 81387 - DNA, 16 bp, H. sapiens
cctgcctgcctcagcc

SEQ ID NO: 81388 - DNA, 16 bp, H. sapiens
cctgcctgcctccacc

SEQ ID NO: 81389 - DNA, 16 bp, H. sapiens
cctgcctgcctcccag

SEQ ID NO: 81390 - DNA, 16 bp, H. sapiens
cctgcctgcctccctg

SEQ ID NO: 81391 - DNA, 16 bp, H. sapiens
cctgcctgcctcctgc

SEQ ID NO: 81392 - DNA, 16 bp, H. sapiens
cctgcctgcctctcca

SEQ ID NO: 81393 - DNA, 16 bp, H. sapiens
cctgcctgcctgccct

SEQ ID NO: 81394 - DNA, 16 bp, H. sapiens
cctgcctgcctgcctc

SEQ ID NO: 81395 - DNA, 16 bp, H. sapiens
cctgcctgcctggccc

SEQ ID NO: 81396 - DNA, 16 bp, H. sapiens
cctgcctgcctgtctc

SEQ ID NO: 81397 - DNA, 16 bp, H. sapiens
cctgcctgccttcctg

SEQ ID NO: 81398 - DNA, 16 bp, H. sapiens
cctgcctgccttcctt

SEQ ID NO: 81399 - DNA, 17 bp, H. sapiens
cctgcctgccttggcct

SEQ ID NO: 81400 - DNA, 16 bp, H. sapiens
cctgcctgctcccagc

SEQ ID NO: 81401 - DNA, 16 bp, H. sapiens
cctgcctgctcctggc

SEQ ID NO: 81402 - DNA, 16 bp, H. sapiens
cctgcctgctgccatg

SEQ ID NO: 81403 - DNA, 16 bp, H. sapiens
cctgcctgctgctgct

SEQ ID NO: 81404 - DNA, 16 bp, H. sapiens
cctgcctgctggctct

SEQ ID NO: 81405 - DNA, 16 bp, H. sapiens
cctgcctgcttccttc

SEQ ID NO: 81406 - DNA, 16 bp, H. sapiens
cctgcctggaatgccc

SEQ ID NO: 81407 - DNA, 16 bp, H. sapiens
cctgcctggaatgttc

SEQ ID NO: 81408 - DNA, 16 bp, H. sapiens
cctgcctggatgacag

SEQ ID NO: 81409 - DNA, 16 bp, H. sapiens
cctgcctggcaccaca

SEQ ID NO: 81410 - DNA, 16 bp, H. sapiens
cctgcctggccccagg

SEQ ID NO: 81411 - DNA, 16 bp, H. sapiens
cctgcctggcccctgc

SEQ ID NO: 81412 - DNA, 16 bp, H. sapiens
cctgcctggcccctgg

SEQ ID NO: 81413 - DNA, 16 bp, H. sapiens
cctgcctggccctggg

SEQ ID NO: 81414 - DNA, 16 bp, H. sapiens
cctgcctggcctccca

SEQ ID NO: 81415 - DNA, 16 bp, H. sapiens
cctgcctggctcccag

SEQ ID NO: 81416 - DNA, 16 bp, H. sapiens
cctgcctgggcagcag

SEQ ID NO: 81417 - DNA, 16 bp, H. sapiens
cctgcctgggcctggg

SEQ ID NO: 81418 - DNA, 16 bp, H. sapiens
cctgcctgggctctgg

SEQ ID NO: 81419 - DNA, 16 bp, H. sapiens
cctgcctgggtctccc

SEQ ID NO: 81420 - DNA, 16 bp, H. sapiens
cctgcctgggtgacac

SEQ ID NO: 81421 - DNA, 16 bp, H. sapiens
cctgcctgggttcaaa

SEQ ID NO: 81422 - DNA, 16 bp, H. sapiens
cctgcctggtcctccc

SEQ ID NO: 81423 - DNA, 16 bp, H. sapiens
cctgcctgtcccctca

SEQ ID NO: 81424 - DNA, 16 bp, H. sapiens
cctgcctgtctgcctg

SEQ ID NO: 81425 - DNA, 16 bp, H. sapiens
cctgcctgtgcctccc

SEQ ID NO: 81426 - DNA, 16 bp, H. sapiens
cctgcctgtgtccatg

SEQ ID NO: 81427 - DNA, 16 bp, H. sapiens
cctgcctgtttttgtt

SEQ ID NO: 81428 - DNA, 16 bp, H. sapiens
cctgccttcagcaaga

SEQ ID NO: 81429 - DNA, 16 bp, H. sapiens
cctgccttcaggaagc

SEQ ID NO: 81430 - DNA, 16 bp, H. sapiens
cctgccttcatgaagc

SEQ ID NO: 81431 - DNA, 16 bp, H. sapiens
cctgccttccattcta

SEQ ID NO: 81432 - DNA, 16 bp, H. sapiens
cctgccttcctctctg

SEQ ID NO: 81433 - DNA, 16 bp, H. sapiens
cctgccttctcttgtg

SEQ ID NO: 81434 - DNA, 16 bp, H. sapiens
cctgccttggccccca

SEQ ID NO: 81435 - DNA, 16 bp, H. sapiens
cctgccttggcctcca

SEQ ID NO: 81436 - DNA, 16 bp, H. sapiens
cctgccttggcctcct

SEQ ID NO: 81437 - DNA, 16 bp, H. sapiens
cctgccttggctttcc

SEQ ID NO: 81438 - DNA, 16 bp, H. sapiens
cctgccttggtccccc

SEQ ID NO: 81439 - DNA, 16 bp, H. sapiens
cctgccttggtcctgc

SEQ ID NO: 81440 - DNA, 16 bp, H. sapiens
cctgccttgtgaggtg

SEQ ID NO: 81441 - DNA, 16 bp, H. sapiens
cctgccttgtgccctg

SEQ ID NO: 81442 - DNA, 16 bp, H. sapiens
cctgcctttaaaaaaa

SEQ ID NO: 81443 - DNA, 16 bp, H. sapiens
cctgcctttactaaaa

SEQ ID NO: 81444 - DNA, 16 bp, H. sapiens
cctgcctttagcaaga

SEQ ID NO: 81445 - DNA, 16 bp, H. sapiens
cctgcctttccagacc

SEQ ID NO: 81446 - DNA, 16 bp, H. sapiens
cctgcctttctctctg

SEQ ID NO: 81447 - DNA, 16 bp, H. sapiens
cctgcgatgggggtcc

SEQ ID NO: 81448 - DNA, 16 bp, H. sapiens
cctgcgtcagcttccc

SEQ ID NO: 81449 - DNA, 16 bp, H. sapiens
cctgctaacaccttga

SEQ ID NO: 81450 - DNA, 16 bp, H. sapiens
cctgctaattaaaaaa

SEQ ID NO: 81451 - DNA, 16 bp, H. sapiens
cctgctaccacgcctg

SEQ ID NO: 81452 - DNA, 16 bp, H. sapiens
cctgctacctgaaggc

SEQ ID NO: 81453 - DNA, 16 bp, H. sapiens
cctgctatgcagccca

SEQ ID NO: 81454 - DNA, 16 bp, H. sapiens
cctgctcaacatggtg

SEQ ID NO: 81455 - DNA, 16 bp, H. sapiens
cctgctcaagctctct

SEQ ID NO: 81456 - DNA, 16 bp, H. sapiens
cctgctcacccactgc

SEQ ID NO: 81457 - DNA, 16 bp, H. sapiens
cctgctcagagaggag

SEQ ID NO: 81458 - DNA, 16 bp, H. sapiens
cctgctcagccctggg

SEQ ID NO: 81459 - DNA, 16 bp, H. sapiens
cctgctcagcctcctg

SEQ ID NO: 81460 - DNA, 16 bp, H. sapiens
cctgctcaggctctgg

SEQ ID NO: 81461 - DNA, 16 bp, H. sapiens
cctgctcatgcctgac

SEQ ID NO: 81462 - DNA, 16 bp, H. sapiens
cctgctccagccacgt

SEQ ID NO: 81463 - DNA, 16 bp, H. sapiens
cctgctccagcctcct

SEQ ID NO: 81464 - DNA, 16 bp, H. sapiens
cctgctccaggaagcc

SEQ ID NO: 81465 - DNA, 16 bp, H. sapiens
cctgctccagggcgcc

SEQ ID NO: 81466 - DNA, 16 bp, H. sapiens
cctgctccatggagtg

SEQ ID NO: 81467 - DNA, 16 bp, H. sapiens
cctgctcccagaggtg

SEQ ID NO: 81468 - DNA, 16 bp, H. sapiens
cctgctcccagcccag

SEQ ID NO: 81469 - DNA, 16 bp, H. sapiens
cctgctccccagccct

SEQ ID NO: 81470 - DNA, 16 bp, H. sapiens
cctgctccccaggccc

SEQ ID NO: 81471 - DNA, 16 bp, H. sapiens
cctgctccctctgctg

SEQ ID NO: 81472 - DNA, 16 bp, H. sapiens
cctgctccctgccctg

SEQ ID NO: 81473 - DNA, 16 bp, H. sapiens
cctgctcctcagcctc

SEQ ID NO: 81474 - DNA, 16 bp, H. sapiens
cctgctcctccagccc

SEQ ID NO: 81475 - DNA, 16 bp, H. sapiens
cctgctcctccctcac

SEQ ID NO: 81476 - DNA, 16 bp, H. sapiens
cctgctcctccttcac

SEQ ID NO: 81477 - DNA, 16 bp, H. sapiens
cctgctcctctcccag

SEQ ID NO: 81478 - DNA, 16 bp, H. sapiens
cctgctcctgcagcaa

SEQ ID NO: 81479 - DNA, 16 bp, H. sapiens
cctgctcctgcccctg

SEQ ID NO: 81480 - DNA, 16 bp, H. sapiens
cctgctcctgccctgg

SEQ ID NO: 81481 - DNA, 16 bp, H. sapiens
cctgctcctgcctctt

SEQ ID NO: 81482 - DNA, 16 bp, H. sapiens
cctgctcctgcctgcc

SEQ ID NO: 81483 - DNA, 16 bp, H. sapiens
cctgctcctgctttgc

SEQ ID NO: 81484 - DNA, 16 bp, H. sapiens
cctgctcctggatgac

SEQ ID NO: 81485 - DNA, 16 bp, H. sapiens
cctgctcctggattca

SEQ ID NO: 81486 - DNA, 16 bp, H. sapiens
cctgctcctggccacc

SEQ ID NO: 81487 - DNA, 16 bp, H. sapiens
cctgctccttcctctg

SEQ ID NO: 81488 - DNA, 16 bp, H. sapiens
cctgctctcagcctcc

SEQ ID NO: 81489 - DNA, 16 bp, H. sapiens
cctgctctccagcccc

SEQ ID NO: 81490 - DNA, 16 bp, H. sapiens
cctgctctccagcctg

SEQ ID NO: 81491 - DNA, 16 bp, H. sapiens
cctgctctcctgctct

SEQ ID NO: 81492 - DNA, 16 bp, H. sapiens
cctgctctctctctga

SEQ ID NO: 81493 - DNA, 16 bp, H. sapiens
cctgctctgagccagg

SEQ ID NO: 81494 - DNA, 16 bp, H. sapiens
cctgctctgagtcacc

SEQ ID NO: 81495 - DNA, 16 bp, H. sapiens
cctgctctgcaggagc

SEQ ID NO: 81496 - DNA, 16 bp, H. sapiens
cctgctctgccctgac

SEQ ID NO: 81497 - DNA, 16 bp, H. sapiens
cctgctctgcctccca

SEQ ID NO: 81498 - DNA, 16 bp, H. sapiens
cctgctctggccctgg

SEQ ID NO: 81499 - DNA, 16 bp, H. sapiens
cctgctctgtccccag

SEQ ID NO: 81500 - DNA, 16 bp, H. sapiens
cctgctctgtgccagg

SEQ ID NO: 81501 - DNA, 16 bp, H. sapiens
cctgctctgtgccctg

SEQ ID NO: 81502 - DNA, 16 bp, H. sapiens
cctgctcttcctcctg

SEQ ID NO: 81503 - DNA, 16 bp, H. sapiens
cctgctgacaggcccc

SEQ ID NO: 81504 - DNA, 16 bp, H. sapiens
cctgctgagccaggca

SEQ ID NO: 81505 - DNA, 16 bp, H. sapiens
cctgctgagcccagcc

SEQ ID NO: 81506 - DNA, 16 bp, H. sapiens
cctgctgagtttcaga

SEQ ID NO: 81507 - DNA, 16 bp, H. sapiens
cctgctgataaaacag

SEQ ID NO: 81508 - DNA, 16 bp, H. sapiens
cctgctgatctgacag

SEQ ID NO: 81509 - DNA, 16 bp, H. sapiens
cctgctgatggacatt

SEQ ID NO: 81510 - DNA, 16 bp, H. sapiens
cctgctgcagaggcag

SEQ ID NO: 81511 - DNA, 16 bp, H. sapiens
cctgctgcagcctcct

SEQ ID NO: 81512 - DNA, 16 bp, H. sapiens
cctgctgcagcctctg

SEQ ID NO: 81513 - DNA, 16 bp, H. sapiens
cctgctgcagctggtg

SEQ ID NO: 81514 - DNA, 16 bp, H. sapiens
cctgctgccagccctg

SEQ ID NO: 81515 - DNA, 16 bp, H. sapiens
cctgctgccatccgtg

SEQ ID NO: 81516 - DNA, 16 bp, H. sapiens
cctgctgccattcatg

SEQ ID NO: 81517 - DNA, 16 bp, H. sapiens
cctgctgcccaggctg

SEQ ID NO: 81518 - DNA, 16 bp, H. sapiens
cctgctgccccagcct

SEQ ID NO: 81519 - DNA, 16 bp, H. sapiens
cctgctgccccaggcc

SEQ ID NO: 81520 - DNA, 16 bp, H. sapiens
cctgctgcctcagccc

SEQ ID NO: 81521 - DNA, 16 bp, H. sapiens
cctgctgcctcccagc

SEQ ID NO: 81522 - DNA, 16 bp, H. sapiens
cctgctgcctctgcct

SEQ ID NO: 81523 - DNA, 16 bp, H. sapiens
cctgctgcctgccctg

SEQ ID NO: 81524 - DNA, 16 bp, H. sapiens
cctgctgcctgcctgc

SEQ ID NO: 81525 - DNA, 16 bp, H. sapiens
cctgctgctccctgcc

SEQ ID NO: 81526 - DNA, 16 bp, H. sapiens
cctgctgctgcagctg

SEQ ID NO: 81527 - DNA, 16 bp, H. sapiens
cctgctgctgccctgg

SEQ ID NO: 81528 - DNA, 16 bp, H. sapiens
cctgctgctgcctccc

SEQ ID NO: 81529 - DNA, 16 bp, H. sapiens
cctgctgctgctcctc

SEQ ID NO: 81530 - DNA, 16 bp, H. sapiens
cctgctgctgctgcag

SEQ ID NO: 81531 - DNA, 16 bp, H. sapiens
cctgctgctgctgctt

SEQ ID NO: 81532 - DNA, 16 bp, H. sapiens
cctgctgctgcttctc

SEQ ID NO: 81533 - DNA, 16 bp, H. sapiens
cctgctgctgctttat

SEQ ID NO: 81534 - DNA, 16 bp, H. sapiens
cctgctgctggaggtg

SEQ ID NO: 81535 - DNA, 16 bp, H. sapiens
cctgctgcttcagcct

SEQ ID NO: 81536 - DNA, 16 bp, H. sapiens
cctgctggaagatgag

SEQ ID NO: 81537 - DNA, 16 bp, H. sapiens
cctgctggaggaggag

SEQ ID NO: 81538 - DNA, 16 bp, H. sapiens
cctgctggaggatgag

SEQ ID NO: 81539 - DNA, 16 bp, H. sapiens
cctgctggcatcaggt

SEQ ID NO: 81540 - DNA, 16 bp, H. sapiens
cctgctggccaggctg

SEQ ID NO: 81541 - DNA, 16 bp, H. sapiens
cctgctggcctgccct

SEQ ID NO: 81542 - DNA, 16 bp, H. sapiens
cctgctggcctggaag

SEQ ID NO: 81543 - DNA, 16 bp, H. sapiens
cctgctggctccatgg

SEQ ID NO: 81544 - DNA, 16 bp, H. sapiens
cctgctggctctgagg

SEQ ID NO: 81545 - DNA, 16 bp, H. sapiens
cctgctggcttaacac

SEQ ID NO: 81546 - DNA, 16 bp, H. sapiens
cctgctggctttggag

SEQ ID NO: 81547 - DNA, 16 bp, H. sapiens
cctgctgggaccctga

SEQ ID NO: 81548 - DNA, 16 bp, H. sapiens
cctgctgggaggtgtt

SEQ ID NO: 81549 - DNA, 16 bp, H. sapiens
cctgctgggattacag

SEQ ID NO: 81550 - DNA, 16 bp, H. sapiens
cctgctgggcacggtg

SEQ ID NO: 81551 - DNA, 16 bp, H. sapiens
cctgctgggccctggg

SEQ ID NO: 81552 - DNA, 16 bp, H. sapiens
cctgctgggcgtggtg

SEQ ID NO: 81553 - DNA, 16 bp, H. sapiens
cctgctgggctcaggc

SEQ ID NO: 81554 - DNA, 16 bp, H. sapiens
cctgctgggcttgatc

SEQ ID NO: 81555 - DNA, 16 bp, H. sapiens
cctgctggggcactgc

SEQ ID NO: 81556 - DNA, 16 bp, H. sapiens
cctgctgggtccctcc

SEQ ID NO: 81557 - DNA, 16 bp, H. sapiens
cctgctgggtgccagg

SEQ ID NO: 81558 - DNA, 16 bp, H. sapiens
cctgctgggtgctggg

SEQ ID NO: 81559 - DNA, 16 bp, H. sapiens
cctgctgggttcaagc

SEQ ID NO: 81560 - DNA, 16 bp, H. sapiens
cctgctgtatccccag

SEQ ID NO: 81561 - DNA, 16 bp, H. sapiens
cctgctgtccccacag

SEQ ID NO: 81562 - DNA, 16 bp, H. sapiens
cctgctgtcctcatcc

SEQ ID NO: 81563 - DNA, 16 bp, H. sapiens
cctgctgtcctgccca

SEQ ID NO: 81564 - DNA, 16 bp, H. sapiens
cctgctgtcctgtgaa

SEQ ID NO: 81565 - DNA, 16 bp, H. sapiens
cctgctgtctcagtgt

SEQ ID NO: 81566 - DNA, 16 bp, H. sapiens
cctgctgtgagccagg

SEQ ID NO: 81567 - DNA, 16 bp, H. sapiens
cctgctgtggcctccc

SEQ ID NO: 81568 - DNA, 16 bp, H. sapiens
cctgctgtggctgagc

SEQ ID NO: 81569 - DNA, 16 bp, H. sapiens
cctgctgtgggatggg

SEQ ID NO: 81570 - DNA, 16 bp, H. sapiens
cctgctgtgtaccagg

SEQ ID NO: 81571 - DNA, 16 bp, H. sapiens
cctgctgtgtccccag

SEQ ID NO: 81572 - DNA, 16 bp, H. sapiens
cctgctgtgtcctcag

SEQ ID NO: 81573 - DNA, 16 bp, H. sapiens
cctgctgtgtgacctg

SEQ ID NO: 81574 - DNA, 16 bp, H. sapiens
cctgctgtgtgatctt

SEQ ID NO: 81575 - DNA, 16 bp, H. sapiens
cctgcttcaccttttg

SEQ ID NO: 81576 - DNA, 16 bp, H. sapiens
cctgcttcagccaccc

SEQ ID NO: 81577 - DNA, 16 bp, H. sapiens
cctgcttcagcctctc

SEQ ID NO: 81578 - DNA, 16 bp, H. sapiens
cctgcttcatccatgt

SEQ ID NO: 81579 - DNA, 16 bp, H. sapiens
cctgcttcatcctccc

SEQ ID NO: 81580 - DNA, 16 bp, H. sapiens
cctgcttcatttttct

SEQ ID NO: 81581 - DNA, 16 bp, H. sapiens
cctgcttccactcttg

SEQ ID NO: 81582 - DNA, 16 bp, H. sapiens
cctgcttccccagccc

SEQ ID NO: 81583 - DNA, 16 bp, H. sapiens
cctgcttccccttctg

SEQ ID NO: 81584 - DNA, 16 bp, H. sapiens
cctgcttcccctttgc

SEQ ID NO: 81585 - DNA, 16 bp, H. sapiens
cctgcttcctcctctg

SEQ ID NO: 81586 - DNA, 16 bp, H. sapiens
cctgcttcctcttctg

SEQ ID NO: 81587 - DNA, 16 bp, H. sapiens
cctgcttcctcttgtg

SEQ ID NO: 81588 - DNA, 16 bp, H. sapiens
cctgcttcctgcttcc

SEQ ID NO: 81589 - DNA, 16 bp, H. sapiens
cctgcttcctgggttc

SEQ ID NO: 81590 - DNA, 16 bp, H. sapiens
cctgcttcggcctcca

SEQ ID NO: 81591 - DNA, 16 bp, H. sapiens
cctgcttcggcctccc

SEQ ID NO: 81592 - DNA, 16 bp, H. sapiens
cctgcttctccagcct

SEQ ID NO: 81593 - DNA, 16 bp, H. sapiens
cctgcttctcctttgc

SEQ ID NO: 81594 - DNA, 16 bp, H. sapiens
cctgcttgcctgcctg

SEQ ID NO: 81595 - DNA, 16 bp, H. sapiens
cctgctttaaaaaaaa

SEQ ID NO: 81596 - DNA, 16 bp, H. sapiens
cctgctttcaattctt

SEQ ID NO: 81597 - DNA, 16 bp, H. sapiens
cctgctttcagttctt

SEQ ID NO: 81598 - DNA, 16 bp, H. sapiens
cctgctttcattcttt

SEQ ID NO: 81599 - DNA, 20 bp, H. sapiens
cctgctttggcctcccaaag

SEQ ID NO: 81600 - DNA, 16 bp, H. sapiens
cctgcttttatttcct

SEQ ID NO: 81601 - DNA, 16 bp, H. sapiens
cctggaaaagacacag

SEQ ID NO: 81602 - DNA, 16 bp, H. sapiens
cctggaaaagccacag

SEQ ID NO: 81603 - DNA, 16 bp, H. sapiens
cctggaaaagctgcag

SEQ ID NO: 81604 - DNA, 16 bp, H. sapiens
cctggaaacagacttg

SEQ ID NO: 81605 - DNA, 16 bp, H. sapiens
cctggaaaggctgcag

SEQ ID NO: 81606 - DNA, 16 bp, H. sapiens
cctggaaatagactca

SEQ ID NO: 81607 - DNA, 16 bp, H. sapiens
cctggaaatcaccagc

SEQ ID NO: 81608 - DNA, 16 bp, H. sapiens
cctggaaatctgcctg

SEQ ID NO: 81609 - DNA, 16 bp, H. sapiens
cctggaacagaaaaag

SEQ ID NO: 81610 - DNA, 16 bp, H. sapiens
cctggaaccaatcttc

SEQ ID NO: 81611 - DNA, 16 bp, H. sapiens
cctggaactcctggcc

SEQ ID NO: 81612 - DNA, 16 bp, H. sapiens
cctggaactggctgga

SEQ ID NO: 81613 - DNA, 16 bp, H. sapiens
cctggaagaaacagac

SEQ ID NO: 81614 - DNA, 16 bp, H. sapiens
cctggaagagatggat

SEQ ID NO: 81615 - DNA, 16 bp, H. sapiens
cctggaagagctgcag

SEQ ID NO: 81616 - DNA, 16 bp, H. sapiens
cctggaagccagagga

SEQ ID NO: 81617 - DNA, 16 bp, H. sapiens
cctggaagcccccacc

SEQ ID NO: 81618 - DNA, 16 bp, H. sapiens
cctggaagccccctcc

SEQ ID NO: 81619 - DNA, 16 bp, H. sapiens
cctggaagcccctccc

SEQ ID NO: 81620 - DNA, 16 bp, H. sapiens
cctggaagccccttcc

SEQ ID NO: 81621 - DNA, 16 bp, H. sapiens
cctggaaggcagagat

SEQ ID NO: 81622 - DNA, 16 bp, H. sapiens
cctggaaggcagagct

SEQ ID NO: 81623 - DNA, 16 bp, H. sapiens
cctggaaggcagatgt

SEQ ID NO: 81624 - DNA, 16 bp, H. sapiens
cctggaaggctgaggc

SEQ ID NO: 81625 - DNA, 16 bp, H. sapiens
cctggaaggtgaaggt

SEQ ID NO: 81626 - DNA, 16 bp, H. sapiens
cctggaatcaaccatt

SEQ ID NO: 81627 - DNA, 16 bp, H. sapiens
cctggaatcaagtgat

SEQ ID NO: 81628 - DNA, 16 bp, H. sapiens
cctggaatcccaacac

SEQ ID NO: 81629 - DNA, 16 bp, H. sapiens
cctggaatcccagtgc

SEQ ID NO: 81630 - DNA, 16 bp, H. sapiens
cctggaatctgtgaat

SEQ ID NO: 81631 - DNA, 16 bp, H. sapiens
cctggaatgcagtggc

SEQ ID NO: 81632 - DNA, 16 bp, H. sapiens
cctggaatgccctttc

SEQ ID NO: 81633 - DNA, 16 bp, H. sapiens
cctggaatgggggcct

SEQ ID NO: 81634 - DNA, 16 bp, H. sapiens
cctggacaacaagaac

SEQ ID NO: 81635 - DNA, 16 bp, H. sapiens
cctggacaacacagag

SEQ ID NO: 81636 - DNA, 16 bp, H. sapiens
cctggacaacacggtg

SEQ ID NO: 81637 - DNA, 16 bp, H. sapiens
cctggacaacagggca

SEQ ID NO: 81638 - DNA, 16 bp, H. sapiens
cctggacaacatgctg

SEQ ID NO: 81639 - DNA, 16 bp, H. sapiens
cctggacaacatgttg

SEQ ID NO: 81640 - DNA, 16 bp, H. sapiens
cctggacactggacaa

SEQ ID NO: 81641 - DNA, 16 bp, H. sapiens
cctggacaggacacca

SEQ ID NO: 81642 - DNA, 16 bp, H. sapiens
cctggacatccaggta

SEQ ID NO: 81643 - DNA, 16 bp, H. sapiens
cctggacatttctaga

SEQ ID NO: 81644 - DNA, 16 bp, H. sapiens
cctggaccacatggtg

SEQ ID NO: 81645 - DNA, 16 bp, H. sapiens
cctggaccagacagat

SEQ ID NO: 81646 - DNA, 16 bp, H. sapiens
cctggaccagcctgct

SEQ ID NO: 81647 - DNA, 16 bp, H. sapiens
cctggacctcccgggc

SEQ ID NO: 81648 - DNA, 16 bp, H. sapiens
cctggacctcctgggc

SEQ ID NO: 81649 - DNA, 16 bp, H. sapiens
cctggacctgctgcag

SEQ ID NO: 81650 - DNA, 16 bp, H. sapiens
cctggacctggcccag

SEQ ID NO: 81651 - DNA, 16 bp, H. sapiens
cctggacctggcccat

SEQ ID NO: 81652 - DNA, 16 bp, H. sapiens
cctggacctgggaggc

SEQ ID NO: 81653 - DNA, 16 bp, H. sapiens
cctggactccagcctg

SEQ ID NO: 81654 - DNA, 16 bp, H. sapiens
cctggactgtgtgctc

SEQ ID NO: 81655 - DNA, 16 bp, H. sapiens
cctggacttgagaagt

SEQ ID NO: 81656 - DNA, 16 bp, H. sapiens
cctggacttttctttg

SEQ ID NO: 81657 - DNA, 16 bp, H. sapiens
cctggagaaagtcctt

SEQ ID NO: 81658 - DNA, 16 bp, H. sapiens
cctggagaacattatg

SEQ ID NO: 81659 - DNA, 16 bp, H. sapiens
cctggagaactgtgag

SEQ ID NO: 81660 - DNA, 16 bp, H. sapiens
cctggagacagcatca

SEQ ID NO: 81661 - DNA, 16 bp, H. sapiens
cctggagacattttcc

SEQ ID NO: 81662 - DNA, 16 bp, H. sapiens
cctggagacccagctg

SEQ ID NO: 81663 - DNA, 16 bp, H. sapiens
cctggagacccaggag

SEQ ID NO: 81664 - DNA, 16 bp, H. sapiens
cctggagacttggagg

SEQ ID NO: 81665 - DNA, 16 bp, H. sapiens
cctggagagaggggct

SEQ ID NO: 81666 - DNA, 16 bp, H. sapiens
cctggagaggcaggaa

SEQ ID NO: 81667 - DNA, 16 bp, H. sapiens
cctggagaggctgagg

SEQ ID NO: 81668 - DNA, 16 bp, H. sapiens
cctggagagggagaaa

SEQ ID NO: 81669 - DNA, 16 bp, H. sapiens
cctggagagggtggct

SEQ ID NO: 81670 - DNA, 16 bp, H. sapiens
cctggagataacatca

SEQ ID NO: 81671 - DNA, 16 bp, H. sapiens
cctggagatctgcctg

SEQ ID NO: 81672 - DNA, 16 bp, H. sapiens
cctggagcagcagaac

SEQ ID NO: 81673 - DNA, 16 bp, H. sapiens
cctggagcagtggttt

SEQ ID NO: 81674 - DNA, 16 bp, H. sapiens
cctggagcatttcccc

SEQ ID NO: 81675 - DNA, 16 bp, H. sapiens
cctggagccaccagaa

SEQ ID NO: 81676 - DNA, 16 bp, H. sapiens
cctggagccacctgcc

SEQ ID NO: 81677 - DNA, 16 bp, H. sapiens
cctggagccaggctgg

SEQ ID NO: 81678 - DNA, 16 bp, H. sapiens
cctggagcccacccca

SEQ ID NO: 81679 - DNA, 16 bp, H. sapiens
cctggagcccagtagc

SEQ ID NO: 81680 - DNA, 16 bp, H. sapiens
cctggagccccagccc

SEQ ID NO: 81681 - DNA, 16 bp, H. sapiens
cctggagcccccagga

SEQ ID NO: 81682 - DNA, 16 bp, H. sapiens
cctggagcctcagttt

SEQ ID NO: 81683 - DNA, 16 bp, H. sapiens
cctggagcctccagag

SEQ ID NO: 81684 - DNA, 16 bp, H. sapiens
cctggagcctggagcc

SEQ ID NO: 81685 - DNA, 16 bp, H. sapiens
cctggagcctggggcc

SEQ ID NO: 81686 - DNA, 16 bp, H. sapiens
cctggagctatagaga

SEQ ID NO: 81687 - DNA, 16 bp, H. sapiens
cctggagctgagacaa

SEQ ID NO: 81688 - DNA, 16 bp, H. sapiens
cctggagctgcctgcc

SEQ ID NO: 81689 - DNA, 16 bp, H. sapiens
cctggagctggaggag

SEQ ID NO: 81690 - DNA, 16 bp, H. sapiens
cctggaggaaaaaaaa

SEQ ID NO: 81691 - DNA, 16 bp, H. sapiens
cctggaggaacacctg

SEQ ID NO: 81692 - DNA, 16 bp, H. sapiens
cctggaggaagacagt

SEQ ID NO: 81693 - DNA, 16 bp, H. sapiens
cctggaggaagaggca

SEQ ID NO: 81694 - DNA, 16 bp, H. sapiens
cctggaggaagcagca

SEQ ID NO: 81695 - DNA, 16 bp, H. sapiens
cctggaggaagctggg

SEQ ID NO: 81696 - DNA, 16 bp, H. sapiens
cctggaggaaggggtg

SEQ ID NO: 81697 - DNA, 16 bp, H. sapiens
cctggaggacctgccc

SEQ ID NO: 81698 - DNA, 16 bp, H. sapiens
cctggaggaggaagag

SEQ ID NO: 81699 - DNA, 16 bp, H. sapiens
cctggaggaggagatg

SEQ ID NO: 81700 - DNA, 17 bp, H. sapiens
cctggaggaggaggagg

SEQ ID NO: 81701 - DNA, 16 bp, H. sapiens
cctggaggaggcagca

SEQ ID NO: 81702 - DNA, 16 bp, H. sapiens
cctggaggaggtgacc

SEQ ID NO: 81703 - DNA, 16 bp, H. sapiens
cctggaggaggtgact

SEQ ID NO: 81704 - DNA, 16 bp, H. sapiens
cctggaggaggtgatg

SEQ ID NO: 81705 - DNA, 16 bp, H. sapiens
cctggaggaggtggca

SEQ ID NO: 81706 - DNA, 16 bp, H. sapiens
cctggaggaggtggcc

SEQ ID NO: 81707 - DNA, 16 bp, H. sapiens
cctggaggaggtggtg

SEQ ID NO: 81708 - DNA, 16 bp, H. sapiens
cctggaggatgttatg

SEQ ID NO: 81709 - DNA, 16 bp, H. sapiens
cctggaggcccagctg

SEQ ID NO: 81710 - DNA, 16 bp, H. sapiens
cctggaggcccaggaa

SEQ ID NO: 81711 - DNA, 16 bp, H. sapiens
cctggaggcccaggag

SEQ ID NO: 81712 - DNA, 16 bp, H. sapiens
cctggaggctggggag

SEQ ID NO: 81713 - DNA, 16 bp, H. sapiens
cctggaggcttcatct

SEQ ID NO: 81714 - DNA, 16 bp, H. sapiens
cctggagggaccccag

SEQ ID NO: 81715 - DNA, 16 bp, H. sapiens
cctggagggaggggtg

SEQ ID NO: 81716 - DNA, 16 bp, H. sapiens
cctggagggcaaaatc

SEQ ID NO: 81717 - DNA, 16 bp, H. sapiens
cctggagggcagggcc

SEQ ID NO: 81718 - DNA, 16 bp, H. sapiens
cctggagggtggcatg

SEQ ID NO: 81719 - DNA, 16 bp, H. sapiens
cctggaggtggagctt

SEQ ID NO: 81720 - DNA, 16 bp, H. sapiens
cctggagtgcaatggt

SEQ ID NO: 81721 - DNA, 16 bp, H. sapiens
cctggagttcaaggct

SEQ ID NO: 81722 - DNA, 16 bp, H. sapiens
cctggagtttgaggct

SEQ ID NO: 81723 - DNA, 16 bp, H. sapiens
cctggagtttggctgt

SEQ ID NO: 81724 - DNA, 16 bp, H. sapiens
cctggataatttcttt

SEQ ID NO: 81725 - DNA, 16 bp, H. sapiens
cctggatatccaggca

SEQ ID NO: 81726 - DNA, 16 bp, H. sapiens
cctggatctcagacct

SEQ ID NO: 81727 - DNA, 16 bp, H. sapiens
cctggatgaaagagca

SEQ ID NO: 81728 - DNA, 16 bp, H. sapiens
cctggatgacagtgag

SEQ ID NO: 81729 - DNA, 16 bp, H. sapiens
cctggatgacagtgtg

SEQ ID NO: 81730 - DNA, 16 bp, H. sapiens
cctggatgaccaggca

SEQ ID NO: 81731 - DNA, 16 bp, H. sapiens
cctggatgagagagtg

SEQ ID NO: 81732 - DNA, 16 bp, H. sapiens
cctggatgagagtgag

SEQ ID NO: 81733 - DNA, 16 bp, H. sapiens
cctggatgcccagaca

SEQ ID NO: 81734 - DNA, 16 bp, H. sapiens
cctggatgcccaggaa

SEQ ID NO: 81735 - DNA, 16 bp, H. sapiens
cctggatggagctgga

SEQ ID NO: 81736 - DNA, 16 bp, H. sapiens
cctggatggagttgga

SEQ ID NO: 81737 - DNA, 16 bp, H. sapiens
cctggatggcagcagg

SEQ ID NO: 81738 - DNA, 16 bp, H. sapiens
cctggatggtcttgat

SEQ ID NO: 81739 - DNA, 16 bp, H. sapiens
cctggatgtccaggca

SEQ ID NO: 81740 - DNA, 16 bp, H. sapiens
cctggatgtgaggcat

SEQ ID NO: 81741 - DNA, 16 bp, H. sapiens
cctggattcaggtgat

SEQ ID NO: 81742 - DNA, 16 bp, H. sapiens
cctggattccagcgat

SEQ ID NO: 81743 - DNA, 16 bp, H. sapiens
cctggattcccaggca

SEQ ID NO: 81744 - DNA, 16 bp, H. sapiens
cctggattccttagct

SEQ ID NO: 81745 - DNA, 16 bp, H. sapiens
cctggattttcttcta

SEQ ID NO: 81746 - DNA, 16 bp, H. sapiens
cctggcaaacaccatt

SEQ ID NO: 81747 - DNA, 16 bp, H. sapiens
cctggcaaactcctac

SEQ ID NO: 81748 - DNA, 16 bp, H. sapiens
cctggcaaagacacaa

SEQ ID NO: 81749 - DNA, 16 bp, H. sapiens
cctggcaaaggcccca

SEQ ID NO: 81750 - DNA, 16 bp, H. sapiens
cctggcaaattttgta

SEQ ID NO: 81751 - DNA, 16 bp, H. sapiens
cctggcaacatagtga

SEQ ID NO: 81752 - DNA, 16 bp, H. sapiens
cctggcaaccactgat

SEQ ID NO: 81753 - DNA, 16 bp, H. sapiens
cctggcaactgctgat

SEQ ID NO: 81754 - DNA, 16 bp, H. sapiens
cctggcaatttgggag

SEQ ID NO: 81755 - DNA, 16 bp, H. sapiens
cctggcacacagcagg

SEQ ID NO: 81756 - DNA, 16 bp, H. sapiens
cctggcacacagtagg

SEQ ID NO: 81757 - DNA, 16 bp, H. sapiens
cctggcacagagcaga

SEQ ID NO: 81758 - DNA, 16 bp, H. sapiens
cctggcacagagcagg

SEQ ID NO: 81759 - DNA, 16 bp, H. sapiens
cctggcacagaggaaa

SEQ ID NO: 81760 - DNA, 16 bp, H. sapiens
cctggcacagagtggg

SEQ ID NO: 81761 - DNA, 16 bp, H. sapiens
cctggcacagggcctg

SEQ ID NO: 81762 - DNA, 16 bp, H. sapiens
cctggcacagtacctg

SEQ ID NO: 81763 - DNA, 16 bp, H. sapiens
cctggcacataataag

SEQ ID NO: 81764 - DNA, 16 bp, H. sapiens
cctggcacatagtaaa

SEQ ID NO: 81765 - DNA, 16 bp, H. sapiens
cctggcaccacaggga

SEQ ID NO: 81766 - DNA, 16 bp, H. sapiens
cctggcacccagcagg

SEQ ID NO: 81767 - DNA, 16 bp, H. sapiens
cctggcaccgtggctc

SEQ ID NO: 81768 - DNA, 16 bp, H. sapiens
cctggcacctccctcc

SEQ ID NO: 81769 - DNA, 16 bp, H. sapiens
cctggcacctcctcct

SEQ ID NO: 81770 - DNA, 16 bp, H. sapiens
cctggcacgatggctc

SEQ ID NO: 81771 - DNA, 16 bp, H. sapiens
cctggcactgtgcctg

SEQ ID NO: 81772 - DNA, 16 bp, H. sapiens
cctggcagaaacacaa

SEQ ID NO: 81773 - DNA, 16 bp, H. sapiens
cctggcagacagaggt

SEQ ID NO: 81774 - DNA, 16 bp, H. sapiens
cctggcagagtcacaa

SEQ ID NO: 81775 - DNA, 16 bp, H. sapiens
cctggcagcagctgtg

SEQ ID NO: 81776 - DNA, 16 bp, H. sapiens
cctggcagccaccctg

SEQ ID NO: 81777 - DNA, 16 bp, H. sapiens
cctggcagcccagctg

SEQ ID NO: 81778 - DNA, 16 bp, H. sapiens
cctggcagcctgggtg

SEQ ID NO: 81779 - DNA, 16 bp, H. sapiens
cctggcaggaggccaa

SEQ ID NO: 81780 - DNA, 16 bp, H. sapiens
cctggcaggaggtgat

SEQ ID NO: 81781 - DNA, 16 bp, H. sapiens
cctggcagggcacagt

SEQ ID NO: 81782 - DNA, 16 bp, H. sapiens
cctggcaggggagggg

SEQ ID NO: 81783 - DNA, 16 bp, H. sapiens
cctggcatggtggtgg

SEQ ID NO: 81784 - DNA, 16 bp, H. sapiens
cctggccaaagtggca

SEQ ID NO: 81785 - DNA, 16 bp, H. sapiens
cctggccaacaagttg

SEQ ID NO: 81786 - DNA, 16 bp, H. sapiens
cctggccaacaatgtg

SEQ ID NO: 81787 - DNA, 16 bp, H. sapiens
cctggccaacatgaca

SEQ ID NO: 81788 - DNA, 16 bp, H. sapiens
cctggccaacatgagg

SEQ ID NO: 81789 - DNA, 16 bp, H. sapiens
cctggccaaccccagg

SEQ ID NO: 81790 - DNA, 16 bp, H. sapiens
cctggccaacctggca

SEQ ID NO: 81791 - DNA, 16 bp, H. sapiens
cctggccaacgtgctg

SEQ ID NO: 81792 - DNA, 16 bp, H. sapiens
cctggccaagaaacaa

SEQ ID NO: 81793 - DNA, 16 bp, H. sapiens
cctggccaagatgatg

SEQ ID NO: 81794 - DNA, 16 bp, H. sapiens
cctggccaatgtggca

SEQ ID NO: 81795 - DNA, 16 bp, H. sapiens
cctggccacaatggtg

SEQ ID NO: 81796 - DNA, 16 bp, H. sapiens
cctggccaccaccatt

SEQ ID NO: 81797 - DNA, 16 bp, H. sapiens
cctggccaccatggca

SEQ ID NO: 81798 - DNA, 16 bp, H. sapiens
cctggccaccccatct

SEQ ID NO: 81799 - DNA, 16 bp, H. sapiens
cctggccagaactcag

SEQ ID NO: 81800 - DNA, 16 bp, H. sapiens
cctggccagcacggtg

SEQ ID NO: 81801 - DNA, 16 bp, H. sapiens
cctggccagcagagtg

SEQ ID NO: 81802 - DNA, 16 bp, H. sapiens
cctggccagcatggtg

SEQ ID NO: 81803 - DNA, 16 bp, H. sapiens
cctggccagccgcccc

SEQ ID NO: 81804 - DNA, 16 bp, H. sapiens
cctggccagcctggcc

SEQ ID NO: 81805 - DNA, 16 bp, H. sapiens
cctggccagcgtggtg

SEQ ID NO: 81806 - DNA, 16 bp, H. sapiens
cctggccaggaggaga

SEQ ID NO: 81807 - DNA, 16 bp, H. sapiens
cctggccaggatggtg

SEQ ID NO: 81808 - DNA, 16 bp, H. sapiens
cctggccaggccaggc

SEQ ID NO: 81809 - DNA, 23 bp, H. sapiens
cctggccaggcgcggtggctcac

SEQ ID NO: 81810 - DNA, 16 bp, H. sapiens
cctggccaggtatttc

SEQ ID NO: 81811 - DNA, 16 bp, H. sapiens
cctggccaggtgcagt

SEQ ID NO: 81812 - DNA, 16 bp, H. sapiens
cctggccaggtttttt

SEQ ID NO: 81813 - DNA, 17 bp, H. sapiens
cctggcccacatggtga

SEQ ID NO: 81814 - DNA, 16 bp, H. sapiens
cctggcccacccaggg

SEQ ID NO: 81815 - DNA, 16 bp, H. sapiens
cctggcccagaaattt

SEQ ID NO: 81816 - DNA, 16 bp, H. sapiens
cctggcccagagcagg

SEQ ID NO: 81817 - DNA, 16 bp, H. sapiens
cctggcccagcccctg

SEQ ID NO: 81818 - DNA, 16 bp, H. sapiens
cctggcccagcctcag

SEQ ID NO: 81819 - DNA, 16 bp, H. sapiens
cctggcccagcctccc

SEQ ID NO: 81820 - DNA, 16 bp, H. sapiens
cctggcccagcctcct

SEQ ID NO: 81821 - DNA, 16 bp, H. sapiens
cctggcccagcctggc

SEQ ID NO: 81822 - DNA, 16 bp, H. sapiens
cctggcccaggaggcc

SEQ ID NO: 81823 - DNA, 16 bp, H. sapiens
cctggcccaggcccag

SEQ ID NO: 81824 - DNA, 16 bp, H. sapiens
cctggcccaggcctgg

SEQ ID NO: 81825 - DNA, 16 bp, H. sapiens
cctggcccagtgcctg

SEQ ID NO: 81826 - DNA, 16 bp, H. sapiens
cctggccccacagatg

SEQ ID NO: 81827 - DNA, 16 bp, H. sapiens
cctggccccacccaca

SEQ ID NO: 81828 - DNA, 16 bp, H. sapiens
cctggccccaccccag

SEQ ID NO: 81829 - DNA, 16 bp, H. sapiens
cctggccccaccctgc

SEQ ID NO: 81830 - DNA, 16 bp, H. sapiens
cctggccccagagccc

SEQ ID NO: 81831 - DNA, 16 bp, H. sapiens
cctggccccagcccag

SEQ ID NO: 81832 - DNA, 16 bp, H. sapiens
cctggccccagccctg

SEQ ID NO: 81833 - DNA, 16 bp, H. sapiens
cctggccccagcctcc

SEQ ID NO: 81834 - DNA, 16 bp, H. sapiens
cctggccccaggctgg

SEQ ID NO: 81835 - DNA, 16 bp, H. sapiens
cctggcccctgcccac

SEQ ID NO: 81836 - DNA, 16 bp, H. sapiens
cctggcccctgcccca

SEQ ID NO: 81837 - DNA, 16 bp, H. sapiens
cctggcccctgccctg

SEQ ID NO: 81838 - DNA, 16 bp, H. sapiens
cctggcccctgcctgc

SEQ ID NO: 81839 - DNA, 16 bp, H. sapiens
cctggcccctgcctgg

SEQ ID NO: 81840 - DNA, 16 bp, H. sapiens
cctggccccttcccca

SEQ ID NO: 81841 - DNA, 16 bp, H. sapiens
cctggccctgaccctg

SEQ ID NO: 81842 - DNA, 16 bp, H. sapiens
cctggccctgccactg

SEQ ID NO: 81843 - DNA, 16 bp, H. sapiens
cctggccctgccactt

SEQ ID NO: 81844 - DNA, 16 bp, H. sapiens
cctggccctgcccacc

SEQ ID NO: 81845 - DNA, 16 bp, H. sapiens
cctggccctgccccac

SEQ ID NO: 81846 - DNA, 16 bp, H. sapiens
cctggccctgccccag

SEQ ID NO: 81847 - DNA, 16 bp, H. sapiens
cctggccctgcccctg

SEQ ID NO: 81848 - DNA, 16 bp, H. sapiens
cctggccctgccctgc

SEQ ID NO: 81849 - DNA, 16 bp, H. sapiens
cctggccctgccctgg

SEQ ID NO: 81850 - DNA, 16 bp, H. sapiens
cctggccctgcccttg

SEQ ID NO: 81851 - DNA, 16 bp, H. sapiens
cctggccctgcctcct

SEQ ID NO: 81852 - DNA, 16 bp, H. sapiens
cctggccctgcctctg

SEQ ID NO: 81853 - DNA, 16 bp, H. sapiens
cctggccctgcctgct

SEQ ID NO: 81854 - DNA, 16 bp, H. sapiens
cctggccctgcctggc

SEQ ID NO: 81855 - DNA, 16 bp, H. sapiens
cctggccctgcctttg

SEQ ID NO: 81856 - DNA, 16 bp, H. sapiens
cctggccctgctctgc

SEQ ID NO: 81857 - DNA, 16 bp, H. sapiens
cctggccctgctgccc

SEQ ID NO: 81858 - DNA, 16 bp, H. sapiens
cctggccctgctgctg

SEQ ID NO: 81859 - DNA, 16 bp, H. sapiens
cctggccctggcccat

SEQ ID NO: 81860 - DNA, 16 bp, H. sapiens
cctggccctggcccct

SEQ ID NO: 81861 - DNA, 16 bp, H. sapiens
cctggccctggccctc

SEQ ID NO: 81862 - DNA, 16 bp, H. sapiens
cctggccctggccctg

SEQ ID NO: 81863 - DNA, 16 bp, H. sapiens
cctggccctggccctt

SEQ ID NO: 81864 - DNA, 16 bp, H. sapiens
cctggccctgggctgg

SEQ ID NO: 81865 - DNA, 16 bp, H. sapiens
cctggccggcatggtg

SEQ ID NO: 81866 - DNA, 16 bp, H. sapiens
cctggccgggcacagt

SEQ ID NO: 81867 - DNA, 16 bp, H. sapiens
cctggcctatttttaa

SEQ ID NO: 81868 - DNA, 16 bp, H. sapiens
cctggcctcaagttat

SEQ ID NO: 81869 - DNA, 16 bp, H. sapiens
cctggcctcacctggc

SEQ ID NO: 81870 - DNA, 16 bp, H. sapiens
cctggcctccaccctc

SEQ ID NO: 81871 - DNA, 16 bp, H. sapiens
cctggcctcccagcct

SEQ ID NO: 81872 - DNA, 16 bp, H. sapiens
cctggcctccctcctg

SEQ ID NO: 81873 - DNA, 16 bp, H. sapiens
cctggcctcctcctgc

SEQ ID NO: 81874 - DNA, 16 bp, H. sapiens
cctggcctcctgcctc

SEQ ID NO: 81875 - DNA, 16 bp, H. sapiens
cctggcctccttcctt

SEQ ID NO: 81876 - DNA, 16 bp, H. sapiens
cctggcctcggcctcc

SEQ ID NO: 81877 - DNA, 16 bp, H. sapiens
cctggcctctcccagc

SEQ ID NO: 81878 - DNA, 16 bp, H. sapiens
cctggcctctccccac

SEQ ID NO: 81879 - DNA, 16 bp, H. sapiens
cctggcctctctgagc

SEQ ID NO: 81880 - DNA, 16 bp, H. sapiens
cctggcctctgccctg

SEQ ID NO: 81881 - DNA, 16 bp, H. sapiens
cctggcctctgcctcc

SEQ ID NO: 81882 - DNA, 16 bp, H. sapiens
cctggcctctggcctc

SEQ ID NO: 81883 - DNA, 16 bp, H. sapiens
cctggcctctgttttt

SEQ ID NO: 81884 - DNA, 16 bp, H. sapiens
cctggcctcttctctg

SEQ ID NO: 81885 - DNA, 16 bp, H. sapiens
cctggcctggaacctg

SEQ ID NO: 81886 - DNA, 16 bp, H. sapiens
cctggcctggccccag

SEQ ID NO: 81887 - DNA, 16 bp, H. sapiens
cctggcctggcctctg

SEQ ID NO: 81888 - DNA, 16 bp, H. sapiens
cctggcctggcctggc

SEQ ID NO: 81889 - DNA, 16 bp, H. sapiens
cctggcctggcctggg

SEQ ID NO: 81890 - DNA, 16 bp, H. sapiens
cctggcctggctcctg

SEQ ID NO: 81891 - DNA, 16 bp, H. sapiens
cctggcctggtggtgg

SEQ ID NO: 81892 - DNA, 16 bp, H. sapiens
cctggccttcactgtc

SEQ ID NO: 81893 - DNA, 16 bp, H. sapiens
cctggccttgccctca

SEQ ID NO: 81894 - DNA, 16 bp, H. sapiens
cctggccttggccctg

SEQ ID NO: 81895 - DNA, 16 bp, H. sapiens
cctggccttggcctcc

SEQ ID NO: 81896 - DNA, 16 bp, H. sapiens
cctggccttggctttg

SEQ ID NO: 81897 - DNA, 16 bp, H. sapiens
cctggcctttctttct

SEQ ID NO: 81898 - DNA, 16 bp, H. sapiens
cctggccttttccagc

SEQ ID NO: 81899 - DNA, 16 bp, H. sapiens
cctggcctttttaaaa

SEQ ID NO: 81900 - DNA, 16 bp, H. sapiens
cctggcgtggtggcgc

SEQ ID NO: 81901 - DNA, 19 bp, H. sapiens
cctggctaacaaggcgaaa

SEQ ID NO: 81902 - DNA, 22 bp, H. sapiens
cctggctaacacggtgaaacct

SEQ ID NO: 81903 - DNA, 16 bp, H. sapiens
cctggctaacttttgt

SEQ ID NO: 81904 - DNA, 16 bp, H. sapiens
cctggctaactttttt

SEQ ID NO: 81905 - DNA, 16 bp, H. sapiens
cctggctaattatttg

SEQ ID NO: 81906 - DNA, 16 bp, H. sapiens
cctggctaattcttat

SEQ ID NO: 81907 - DNA, 16 bp, H. sapiens
cctggctaattctttt

SEQ ID NO: 81908 - DNA, 16 bp, H. sapiens
cctggctaattgtgtg

SEQ ID NO: 81909 - DNA, 16 bp, H. sapiens
cctggctacttgggaa

SEQ ID NO: 81910 - DNA, 16 bp, H. sapiens
cctggctagttttttt

SEQ ID NO: 81911 - DNA, 16 bp, H. sapiens
cctggctcacagcagg

SEQ ID NO: 81912 - DNA, 16 bp, H. sapiens
cctggctcactggctt

SEQ ID NO: 81913 - DNA, 16 bp, H. sapiens
cctggctcagcctctt

SEQ ID NO: 81914 - DNA, 16 bp, H. sapiens
cctggctcagggagct

SEQ ID NO: 81915 - DNA, 16 bp, H. sapiens
cctggctcatagtagg

SEQ ID NO: 81916 - DNA, 16 bp, H. sapiens
cctggctcatctcatt

SEQ ID NO: 81917 - DNA, 16 bp, H. sapiens
cctggctcatttcatt

SEQ ID NO: 81918 - DNA, 16 bp, H. sapiens
cctggctccagcccca

SEQ ID NO: 81919 - DNA, 16 bp, H. sapiens
cctggctcctgccagc

SEQ ID NO: 81920 - DNA, 16 bp, H. sapiens
cctggctcctgcccca

SEQ ID NO: 81921 - DNA, 16 bp, H. sapiens
cctggctcctgctggc

SEQ ID NO: 81922 - DNA, 16 bp, H. sapiens
cctggctcggcctccc

SEQ ID NO: 81923 - DNA, 16 bp, H. sapiens
cctggctctacaaaaa

SEQ ID NO: 81924 - DNA, 16 bp, H. sapiens
cctggctctcaggcct

SEQ ID NO: 81925 - DNA, 16 bp, H. sapiens
cctggctctccagcct

SEQ ID NO: 81926 - DNA, 16 bp, H. sapiens
cctggctctgcccacc

SEQ ID NO: 81927 - DNA, 16 bp, H. sapiens
cctggctctgcccctc

SEQ ID NO: 81928 - DNA, 16 bp, H. sapiens
cctggctctgcccttc

SEQ ID NO: 81929 - DNA, 16 bp, H. sapiens
cctggctctgcctccc

SEQ ID NO: 81930 - DNA, 16 bp, H. sapiens
cctggctctgcctcct

SEQ ID NO: 81931 - DNA, 16 bp, H. sapiens
cctggctctgcctttt

SEQ ID NO: 81932 - DNA, 16 bp, H. sapiens
cctggctctggccctg

SEQ ID NO: 81933 - DNA, 16 bp, H. sapiens
cctggctctggctctg

SEQ ID NO: 81934 - DNA, 16 bp, H. sapiens
cctggctctgggctgg

SEQ ID NO: 81935 - DNA, 16 bp, H. sapiens
cctggctgaatttttt

SEQ ID NO: 81936 - DNA, 16 bp, H. sapiens
cctggctgacagagtg

SEQ ID NO: 81937 - DNA, 16 bp, H. sapiens
cctggctgaccccagg

SEQ ID NO: 81938 - DNA, 16 bp, H. sapiens
cctggctgacgtggtg

SEQ ID NO: 81939 - DNA, 16 bp, H. sapiens
cctggctgatttttgt

SEQ ID NO: 81940 - DNA, 16 bp, H. sapiens
cctggctgcagaaagg

SEQ ID NO: 81941 - DNA, 16 bp, H. sapiens
cctggctgcccccacc

SEQ ID NO: 81942 - DNA, 16 bp, H. sapiens
cctggctgcccttaac

SEQ ID NO: 81943 - DNA, 16 bp, H. sapiens
cctggctgctgcccca

SEQ ID NO: 81944 - DNA, 16 bp, H. sapiens
cctggctgctgcttct

SEQ ID NO: 81945 - DNA, 16 bp, H. sapiens
cctggctgctgtggtt

SEQ ID NO: 81946 - DNA, 16 bp, H. sapiens
cctggctgctgtgtgg

SEQ ID NO: 81947 - DNA, 16 bp, H. sapiens
cctggctggctttgcc

SEQ ID NO: 81948 - DNA, 16 bp, H. sapiens
cctggctgggagggtc

SEQ ID NO: 81949 - DNA, 16 bp, H. sapiens
cctggctgggccctgg

SEQ ID NO: 81950 - DNA, 16 bp, H. sapiens
cctggctgggcctcag

SEQ ID NO: 81951 - DNA, 17 bp, H. sapiens
cctggctgggcgcagtg

SEQ ID NO: 81952 - DNA, 16 bp, H. sapiens
cctggctgggctgcag

SEQ ID NO: 81953 - DNA, 16 bp, H. sapiens
cctggctggggaggcc

SEQ ID NO: 81954 - DNA, 16 bp, H. sapiens
cctggctggggctgct

SEQ ID NO: 81955 - DNA, 16 bp, H. sapiens
cctggctggtcttaaa

SEQ ID NO: 81956 - DNA, 16 bp, H. sapiens
cctggctgtgtgacct

SEQ ID NO: 81957 - DNA, 16 bp, H. sapiens
cctggcttacttcact

SEQ ID NO: 81958 - DNA, 16 bp, H. sapiens
cctggcttataactcc

SEQ ID NO: 81959 - DNA, 16 bp, H. sapiens
cctggcttattcacaa

SEQ ID NO: 81960 - DNA, 16 bp, H. sapiens
cctggcttctccctgc

SEQ ID NO: 81961 - DNA, 16 bp, H. sapiens
cctggcttctcccttc

SEQ ID NO: 81962 - DNA, 16 bp, H. sapiens
cctggcttctcctgta

SEQ ID NO: 81963 - DNA, 16 bp, H. sapiens
cctggcttcttttgct

SEQ ID NO: 81964 - DNA, 16 bp, H. sapiens
cctggcttggagggtc

SEQ ID NO: 81965 - DNA, 16 bp, H. sapiens
cctggcttggcttccc

SEQ ID NO: 81966 - DNA, 16 bp, H. sapiens
cctggctttgttcttt

SEQ ID NO: 81967 - DNA, 16 bp, H. sapiens
cctgggaaacaagagc

SEQ ID NO: 81968 - DNA, 16 bp, H. sapiens
cctgggaaacacagta

SEQ ID NO: 81969 - DNA, 16 bp, H. sapiens
cctgggaaacacagtg

SEQ ID NO: 81970 - DNA, 16 bp, H. sapiens
cctgggaaacagagta

SEQ ID NO: 81971 - DNA, 16 bp, H. sapiens
cctgggaaacataatg

SEQ ID NO: 81972 - DNA, 16 bp, H. sapiens
cctgggaaagctgcag

SEQ ID NO: 81973 - DNA, 16 bp, H. sapiens
cctgggaaagggagag

SEQ ID NO: 81974 - DNA, 16 bp, H. sapiens
cctgggaacaaagaga

SEQ ID NO: 81975 - DNA, 16 bp, H. sapiens
cctgggaagcagagtg

SEQ ID NO: 81976 - DNA, 16 bp, H. sapiens
cctgggaaggcagagg

SEQ ID NO: 81977 - DNA, 16 bp, H. sapiens
cctgggaagtagaggt

SEQ ID NO: 81978 - DNA, 16 bp, H. sapiens
cctgggaagtcaaggt

SEQ ID NO: 81979 - DNA, 16 bp, H. sapiens
cctgggacagaaggga

SEQ ID NO: 81980 - DNA, 16 bp, H. sapiens
cctgggacagagctcc

SEQ ID NO: 81981 - DNA, 16 bp, H. sapiens
cctgggacagccctgg

SEQ ID NO: 81982 - DNA, 16 bp, H. sapiens
cctgggacccaatggc

SEQ ID NO: 81983 - DNA, 16 bp, H. sapiens
cctgggacctgatgtc

SEQ ID NO: 81984 - DNA, 16 bp, H. sapiens
cctgggagaaaatatt

SEQ ID NO: 81985 - DNA, 16 bp, H. sapiens
cctgggagaagggaaa

SEQ ID NO: 81986 - DNA, 16 bp, H. sapiens
cctgggagacaagagc

SEQ ID NO: 81987 - DNA, 16 bp, H. sapiens
cctgggagacagagcg

SEQ ID NO: 81988 - DNA, 16 bp, H. sapiens
cctgggagacagagga

SEQ ID NO: 81989 - DNA, 16 bp, H. sapiens
cctgggagacagggtg

SEQ ID NO: 81990 - DNA, 16 bp, H. sapiens
cctgggagacggagtt

SEQ ID NO: 81991 - DNA, 16 bp, H. sapiens
cctgggagccagaggt

SEQ ID NO: 81992 - DNA, 16 bp, H. sapiens
cctgggagccaggcag

SEQ ID NO: 81993 - DNA, 16 bp, H. sapiens
cctgggagcggaggtt

SEQ ID NO: 81994 - DNA, 16 bp, H. sapiens
cctgggagctgggcag

SEQ ID NO: 81995 - DNA, 16 bp, H. sapiens
cctgggagctgggctg

SEQ ID NO: 81996 - DNA, 16 bp, H. sapiens
cctgggagctgtggct

SEQ ID NO: 81997 - DNA, 16 bp, H. sapiens
cctgggagcttgctgg

SEQ ID NO: 81998 - DNA, 16 bp, H. sapiens
cctgggagcttgttag

SEQ ID NO: 81999 - DNA, 16 bp, H. sapiens
cctgggaggaaccatc

SEQ ID NO: 82000 - DNA, 16 bp, H. sapiens
cctgggaggagcccag

SEQ ID NO: 82001 - DNA, 16 bp, H. sapiens
cctgggaggaggagct

SEQ ID NO: 82002 - DNA, 16 bp, H. sapiens
cctgggaggcagaagc

SEQ ID NO: 82003 - DNA, 16 bp, H. sapiens
cctgggaggcagaagg

SEQ ID NO: 82004 - DNA, 16 bp, H. sapiens
cctgggaggcagagcc

SEQ ID NO: 82005 - DNA, 17 bp, H. sapiens
cctgggaggcagaggtg

SEQ ID NO: 82006 - DNA, 16 bp, H. sapiens
cctgggaggcaggcag

SEQ ID NO: 82007 - DNA, 16 bp, H. sapiens
cctgggaggcggagac

SEQ ID NO: 82008 - DNA, 16 bp, H. sapiens
cctgggaggcgggagg

SEQ ID NO: 82009 - DNA, 16 bp, H. sapiens
cctgggaggcggggct

SEQ ID NO: 82010 - DNA, 16 bp, H. sapiens
cctgggaggcgggggc

SEQ ID NO: 82011 - DNA, 16 bp, H. sapiens
cctgggaggctgcagt

SEQ ID NO: 82012 - DNA, 16 bp, H. sapiens
cctgggaggctggggc

SEQ ID NO: 82013 - DNA, 16 bp, H. sapiens
cctgggagggagggag

SEQ ID NO: 82014 - DNA, 16 bp, H. sapiens
cctgggagggaggtgg

SEQ ID NO: 82015 - DNA, 16 bp, H. sapiens
cctgggagggtggggc

SEQ ID NO: 82016 - DNA, 16 bp, H. sapiens
cctgggaggtgaaggc

SEQ ID NO: 82017 - DNA, 16 bp, H. sapiens
cctgggaggtggaggg

SEQ ID NO: 82018 - DNA, 16 bp, H. sapiens
cctgggaggtggggtt

SEQ ID NO: 82019 - DNA, 16 bp, H. sapiens
cctgggagttcaaggt

SEQ ID NO: 82020 - DNA, 16 bp, H. sapiens
cctgggagtttgaggc

SEQ ID NO: 82021 - DNA, 16 bp, H. sapiens
cctgggatacaaggct

SEQ ID NO: 82022 - DNA, 16 bp, H. sapiens
cctgggatcaaatgat

SEQ ID NO: 82023 - DNA, 16 bp, H. sapiens
cctgggatcaagcgat

SEQ ID NO: 82024 - DNA, 16 bp, H. sapiens
cctgggatccagtgat

SEQ ID NO: 82025 - DNA, 16 bp, H. sapiens
cctgggatgaatccca

SEQ ID NO: 82026 - DNA, 17 bp, H. sapiens
cctgggattacaggcgc

SEQ ID NO: 82027 - DNA, 16 bp, H. sapiens
cctgggattcagtctg

SEQ ID NO: 82028 - DNA, 16 bp, H. sapiens
cctgggcaaacagagc

SEQ ID NO: 82029 - DNA, 16 bp, H. sapiens
cctgggcaaagatttc

SEQ ID NO: 82030 - DNA, 16 bp, H. sapiens
cctgggcaacaaagag

SEQ ID NO: 82031 - DNA, 16 bp, H. sapiens
cctgggcaacaaagtg

SEQ ID NO: 82032 - DNA, 16 bp, H. sapiens
cctgggcaacaacagc

SEQ ID NO: 82033 - DNA, 16 bp, H. sapiens
cctgggcaacaagaag

SEQ ID NO: 82034 - DNA, 16 bp, H. sapiens
cctgggcaacaaggag

SEQ ID NO: 82035 - DNA, 16 bp, H. sapiens
cctgggcaacactgtg

SEQ ID NO: 82036 - DNA, 16 bp, H. sapiens
cctgggcaacagaata

SEQ ID NO: 82037 - DNA, 16 bp, H. sapiens
cctgggcaacagatga

SEQ ID NO: 82038 - DNA, 16 bp, H. sapiens
cctgggcaacagcgtg

SEQ ID NO: 82039 - DNA, 16 bp, H. sapiens
cctgggcaacagggta

SEQ ID NO: 82040 - DNA, 16 bp, H. sapiens
cctgggcaacagtggg

SEQ ID NO: 82041 - DNA, 16 bp, H. sapiens
cctgggcaacattgag

SEQ ID NO: 82042 - DNA, 16 bp, H. sapiens
cctgggcaacattgca

SEQ ID NO: 82043 - DNA, 16 bp, H. sapiens
cctgggcaaccagagc

SEQ ID NO: 82044 - DNA, 16 bp, H. sapiens
cctgggcaactctgtc

SEQ ID NO: 82045 - DNA, 16 bp, H. sapiens
cctgggcaagaagagc

SEQ ID NO: 82046 - DNA, 16 bp, H. sapiens
cctgggcaagagagag

SEQ ID NO: 82047 - DNA, 16 bp, H. sapiens
cctgggcaatgcagtg

SEQ ID NO: 82048 - DNA, 16 bp, H. sapiens
cctgggcaatgtgaca

SEQ ID NO: 82049 - DNA, 16 bp, H. sapiens
cctgggcaccatggtg

SEQ ID NO: 82050 - DNA, 16 bp, H. sapiens
cctgggcactccagcc

SEQ ID NO: 82051 - DNA, 16 bp, H. sapiens
cctgggcagcagagga

SEQ ID NO: 82052 - DNA, 16 bp, H. sapiens
cctgggcagctctgcc

SEQ ID NO: 82053 - DNA, 16 bp, H. sapiens
cctgggcaggacagag

SEQ ID NO: 82054 - DNA, 16 bp, H. sapiens
cctgggcaggaggcag

SEQ ID NO: 82055 - DNA, 16 bp, H. sapiens
cctgggcagggctggg

SEQ ID NO: 82056 - DNA, 16 bp, H. sapiens
cctgggcatcatggca

SEQ ID NO: 82057 - DNA, 16 bp, H. sapiens
cctgggcatccaggtg

SEQ ID NO: 82058 - DNA, 16 bp, H. sapiens
cctgggcatccctgtg

SEQ ID NO: 82059 - DNA, 16 bp, H. sapiens
cctgggccacaatgga

SEQ ID NO: 82060 - DNA, 17 bp, H. sapiens
cctgggccacactggaa

SEQ ID NO: 82061 - DNA, 16 bp, H. sapiens
cctgggccacagactg

SEQ ID NO: 82062 - DNA, 16 bp, H. sapiens
cctgggccagagtgag

SEQ ID NO: 82063 - DNA, 17 bp, H. sapiens
cctgggccagcagctgc

SEQ ID NO: 82064 - DNA, 16 bp, H. sapiens
cctgggccagccccac

SEQ ID NO: 82065 - DNA, 16 bp, H. sapiens
cctgggccagcggctg

SEQ ID NO: 82066 - DNA, 16 bp, H. sapiens
cctgggccaggcacag

SEQ ID NO: 82067 - DNA, 16 bp, H. sapiens
cctgggccaggcacgg

SEQ ID NO: 82068 - DNA, 16 bp, H. sapiens
cctgggccaggcccag

SEQ ID NO: 82069 - DNA, 16 bp, H. sapiens
cctgggccaggccctg

SEQ ID NO: 82070 - DNA, 16 bp, H. sapiens
cctgggccaggcctgg

SEQ ID NO: 82071 - DNA, 16 bp, H. sapiens
cctgggccaggtgcag

SEQ ID NO: 82072 - DNA, 16 bp, H. sapiens
cctgggccaggtgctg

SEQ ID NO: 82073 - DNA, 16 bp, H. sapiens
cctgggccatggagca

SEQ ID NO: 82074 - DNA, 16 bp, H. sapiens
cctgggcccaagtgat

SEQ ID NO: 82075 - DNA, 16 bp, H. sapiens
cctgggcccagcccac

SEQ ID NO: 82076 - DNA, 16 bp, H. sapiens
cctgggcccagcccca

SEQ ID NO: 82077 - DNA, 16 bp, H. sapiens
cctgggcccagctctg

SEQ ID NO: 82078 - DNA, 16 bp, H. sapiens
cctgggcccaggagtt

SEQ ID NO: 82079 - DNA, 16 bp, H. sapiens
cctgggccccaccctg

SEQ ID NO: 82080 - DNA, 16 bp, H. sapiens
cctgggccccagcccc

SEQ ID NO: 82081 - DNA, 16 bp, H. sapiens
cctgggccccccaaag

SEQ ID NO: 82082 - DNA, 16 bp, H. sapiens
cctgggcccctcaggg

SEQ ID NO: 82083 - DNA, 16 bp, H. sapiens
cctgggcccctcccac

SEQ ID NO: 82084 - DNA, 16 bp, H. sapiens
cctgggcccctccctg

SEQ ID NO: 82085 - DNA, 16 bp, H. sapiens
cctgggcccggcccac

SEQ ID NO: 82086 - DNA, 16 bp, H. sapiens
cctgggccctgcccac

SEQ ID NO: 82087 - DNA, 16 bp, H. sapiens
cctgggccctgcccat

SEQ ID NO: 82088 - DNA, 16 bp, H. sapiens
cctgggccctgccctc

SEQ ID NO: 82089 - DNA, 16 bp, H. sapiens
cctgggccctgccctg

SEQ ID NO: 82090 - DNA, 16 bp, H. sapiens
cctgggccctgcctgg

SEQ ID NO: 82091 - DNA, 16 bp, H. sapiens
cctgggccctgggcct

SEQ ID NO: 82092 - DNA, 16 bp, H. sapiens
cctgggccctgggctc

SEQ ID NO: 82093 - DNA, 16 bp, H. sapiens
cctgggcctcacccca

SEQ ID NO: 82094 - DNA, 16 bp, H. sapiens
cctgggcctcagtgtc

SEQ ID NO: 82095 - DNA, 16 bp, H. sapiens
cctgggcctcagtttc

SEQ ID NO: 82096 - DNA, 16 bp, H. sapiens
cctgggcctcctgggt

SEQ ID NO: 82097 - DNA, 16 bp, H. sapiens
cctgggcctggcccac

SEQ ID NO: 82098 - DNA, 16 bp, H. sapiens
cctgggcctggcccag

SEQ ID NO: 82099 - DNA, 16 bp, H. sapiens
cctgggcctggcctgg

SEQ ID NO: 82100 - DNA, 16 bp, H. sapiens
cctgggcctggctcac

SEQ ID NO: 82101 - DNA, 16 bp, H. sapiens
cctgggcctggctctg

SEQ ID NO: 82102 - DNA, 16 bp, H. sapiens
cctgggcctgggcctg

SEQ ID NO: 82103 - DNA, 16 bp, H. sapiens
cctgggcctggggcag

SEQ ID NO: 82104 - DNA, 17 bp, H. sapiens
cctgggcgacaaaggga

SEQ ID NO: 82105 - DNA, 16 bp, H. sapiens
cctgggcgacagcaag

SEQ ID NO: 82106 - DNA, 16 bp, H. sapiens
cctgggcgagagcgag

SEQ ID NO: 82107 - DNA, 16 bp, H. sapiens
cctgggcgcggtggct

SEQ ID NO: 82108 - DNA, 16 bp, H. sapiens
cctgggcggcagagag

SEQ ID NO: 82109 - DNA, 16 bp, H. sapiens
cctgggcggcgtcctc

SEQ ID NO: 82110 - DNA, 16 bp, H. sapiens
cctgggctacaagagc

SEQ ID NO: 82111 - DNA, 16 bp, H. sapiens
cctgggctacagaggg

SEQ ID NO: 82112 - DNA, 16 bp, H. sapiens
cctgggctacatggtg

SEQ ID NO: 82113 - DNA, 16 bp, H. sapiens
cctgggctcaaatgac

SEQ ID NO: 82114 - DNA, 16 bp, H. sapiens
cctgggctcaactgat

SEQ ID NO: 82115 - DNA, 16 bp, H. sapiens
cctgggctcaagaatc

SEQ ID NO: 82116 - DNA, 16 bp, H. sapiens
cctgggctcagatgat

SEQ ID NO: 82117 - DNA, 16 bp, H. sapiens
cctgggctcagcccca

SEQ ID NO: 82118 - DNA, 16 bp, H. sapiens
cctgggctcaggagtt

SEQ ID NO: 82119 - DNA, 16 bp, H. sapiens
cctgggctcagggaat

SEQ ID NO: 82120 - DNA, 16 bp, H. sapiens
cctgggctcaggggat

SEQ ID NO: 82121 - DNA, 16 bp, H. sapiens
cctgggctcaggtgat

SEQ ID NO: 82122 - DNA, 16 bp, H. sapiens
cctgggctccacccac

SEQ ID NO: 82123 - DNA, 16 bp, H. sapiens
cctgggctccagcagt

SEQ ID NO: 82124 - DNA, 16 bp, H. sapiens
cctgggctgaagagat

SEQ ID NO: 82125 - DNA, 16 bp, H. sapiens
cctgggctgaagcaat

SEQ ID NO: 82126 - DNA, 16 bp, H. sapiens
cctgggctgcagagtg

SEQ ID NO: 82127 - DNA, 16 bp, H. sapiens
cctgggctgcaggtgg

SEQ ID NO: 82128 - DNA, 16 bp, H. sapiens
cctgggctgcatgctc

SEQ ID NO: 82129 - DNA, 16 bp, H. sapiens
cctgggctgcccactg

SEQ ID NO: 82130 - DNA, 16 bp, H. sapiens
cctgggctggagcgca

SEQ ID NO: 82131 - DNA, 16 bp, H. sapiens
cctgggctggaggctg

SEQ ID NO: 82132 - DNA, 16 bp, H. sapiens
cctgggctggccctgc

SEQ ID NO: 82133 - DNA, 16 bp, H. sapiens
cctgggctggcctggc

SEQ ID NO: 82134 - DNA, 16 bp, H. sapiens
cctgggctgggcccag

SEQ ID NO: 82135 - DNA, 16 bp, H. sapiens
cctgggctgggccctg

SEQ ID NO: 82136 - DNA, 16 bp, H. sapiens
cctgggctgggcctgg

SEQ ID NO: 82137 - DNA, 16 bp, H. sapiens
cctgggctggggcagg

SEQ ID NO: 82138 - DNA, 16 bp, H. sapiens
cctgggctgggtgcag

SEQ ID NO: 82139 - DNA, 16 bp, H. sapiens
cctgggctgtgggcat

SEQ ID NO: 82140 - DNA, 16 bp, H. sapiens
cctgggctgtgtgctc

SEQ ID NO: 82141 - DNA, 16 bp, H. sapiens
cctgggcttaggtgat

SEQ ID NO: 82142 - DNA, 16 bp, H. sapiens
cctgggcttcctcaca

SEQ ID NO: 82143 - DNA, 16 bp, H. sapiens
cctgggcttgaatccc

SEQ ID NO: 82144 - DNA, 16 bp, H. sapiens
cctgggcttgtggccg

SEQ ID NO: 82145 - DNA, 16 bp, H. sapiens
cctggggaaaggggca

SEQ ID NO: 82146 - DNA, 16 bp, H. sapiens
cctggggaacaagagc

SEQ ID NO: 82147 - DNA, 16 bp, H. sapiens
cctggggaacacagca

SEQ ID NO: 82148 - DNA, 16 bp, H. sapiens
cctggggaacccccac

SEQ ID NO: 82149 - DNA, 16 bp, H. sapiens
cctggggaagctgagg

SEQ ID NO: 82150 - DNA, 21 bp, H. sapiens
cctggggaaggaatgcattcc

SEQ ID NO: 82151 - DNA, 16 bp, H. sapiens
cctggggaaggaggag

SEQ ID NO: 82152 - DNA, 16 bp, H. sapiens
cctggggaagggaagg

SEQ ID NO: 82153 - DNA, 16 bp, H. sapiens
cctggggacatttggc

SEQ ID NO: 82154 - DNA, 16 bp, H. sapiens
cctggggactggggac

SEQ ID NO: 82155 - DNA, 16 bp, H. sapiens
cctggggagaagggga

SEQ ID NO: 82156 - DNA, 16 bp, H. sapiens
cctggggagcagccag

SEQ ID NO: 82157 - DNA, 16 bp, H. sapiens
cctggggagccctggg

SEQ ID NO: 82158 - DNA, 16 bp, H. sapiens
cctggggagcttggct

SEQ ID NO: 82159 - DNA, 16 bp, H. sapiens
cctggggaggagggga

SEQ ID NO: 82160 - DNA, 16 bp, H. sapiens
cctggggaggcagagg

SEQ ID NO: 82161 - DNA, 16 bp, H. sapiens
cctggggaggctgagg

SEQ ID NO: 82162 - DNA, 16 bp, H. sapiens
cctggggaggctggga

SEQ ID NO: 82163 - DNA, 16 bp, H. sapiens
cctggggagggcagag

SEQ ID NO: 82164 - DNA, 16 bp, H. sapiens
cctggggaggtcgagg

SEQ ID NO: 82165 - DNA, 16 bp, H. sapiens
cctggggatgaagctg

SEQ ID NO: 82166 - DNA, 16 bp, H. sapiens
cctggggatgggggtg

SEQ ID NO: 82167 - DNA, 16 bp, H. sapiens
cctggggatggggtgg

SEQ ID NO: 82168 - DNA, 16 bp, H. sapiens
cctggggcagaggcag

SEQ ID NO: 82169 - DNA, 16 bp, H. sapiens
cctggggcagtgggcc

SEQ ID NO: 82170 - DNA, 16 bp, H. sapiens
cctggggccagcaggg

SEQ ID NO: 82171 - DNA, 16 bp, H. sapiens
cctggggcccaggctg

SEQ ID NO: 82172 - DNA, 16 bp, H. sapiens
cctggggccccagcct

SEQ ID NO: 82173 - DNA, 16 bp, H. sapiens
cctggggccccttcct

SEQ ID NO: 82174 - DNA, 16 bp, H. sapiens
cctggggccgcccctg

SEQ ID NO: 82175 - DNA, 16 bp, H. sapiens
cctggggcctggccag

SEQ ID NO: 82176 - DNA, 16 bp, H. sapiens
cctggggcctgggcag

SEQ ID NO: 82177 - DNA, 16 bp, H. sapiens
cctggggcctgggctg

SEQ ID NO: 82178 - DNA, 16 bp, H. sapiens
cctggggcctggggga

SEQ ID NO: 82179 - DNA, 16 bp, H. sapiens
cctggggctccctgct

SEQ ID NO: 82180 - DNA, 16 bp, H. sapiens
cctggggctgctgggg

SEQ ID NO: 82181 - DNA, 16 bp, H. sapiens
cctggggctgctgtga

SEQ ID NO: 82182 - DNA, 16 bp, H. sapiens
cctggggctggagctg

SEQ ID NO: 82183 - DNA, 16 bp, H. sapiens
cctggggctggaggag

SEQ ID NO: 82184 - DNA, 16 bp, H. sapiens
cctggggctggaggga

SEQ ID NO: 82185 - DNA, 16 bp, H. sapiens
cctggggctgggaggg

SEQ ID NO: 82186 - DNA, 16 bp, H. sapiens
cctggggctggggatg

SEQ ID NO: 82187 - DNA, 16 bp, H. sapiens
cctggggctggggctg

SEQ ID NO: 82188 - DNA, 16 bp, H. sapiens
cctgggggaaggggag

SEQ ID NO: 82189 - DNA, 16 bp, H. sapiens
cctgggggaaggggca

SEQ ID NO: 82190 - DNA, 16 bp, H. sapiens
cctgggggacaaaatc

SEQ ID NO: 82191 - DNA, 16 bp, H. sapiens
cctgggggacagggcg

SEQ ID NO: 82192 - DNA, 16 bp, H. sapiens
cctgggggacagggtg

SEQ ID NO: 82193 - DNA, 16 bp, H. sapiens
cctgggggacagtgtg

SEQ ID NO: 82194 - DNA, 16 bp, H. sapiens
cctgggggatggaggt

SEQ ID NO: 82195 - DNA, 16 bp, H. sapiens
cctgggggcctggact

SEQ ID NO: 82196 - DNA, 16 bp, H. sapiens
cctgggggctccaccc

SEQ ID NO: 82197 - DNA, 16 bp, H. sapiens
cctgggggctccaggc

SEQ ID NO: 82198 - DNA, 16 bp, H. sapiens
cctgggggctgggctg

SEQ ID NO: 82199 - DNA, 16 bp, H. sapiens
cctggggggtggaggt

SEQ ID NO: 82200 - DNA, 16 bp, H. sapiens
cctggggtccagtctg

SEQ ID NO: 82201 - DNA, 16 bp, H. sapiens
cctggggtgcagtggt

SEQ ID NO: 82202 - DNA, 16 bp, H. sapiens
cctggggtggggggca

SEQ ID NO: 82203 - DNA, 16 bp, H. sapiens
cctgggtaacagcagc

SEQ ID NO: 82204 - DNA, 16 bp, H. sapiens
cctgggtagctgagat

SEQ ID NO: 82205 - DNA, 16 bp, H. sapiens
cctgggtcacagagca

SEQ ID NO: 82206 - DNA, 16 bp, H. sapiens
cctgggtcacctgcag

SEQ ID NO: 82207 - DNA, 16 bp, H. sapiens
cctgggtcagcctccc

SEQ ID NO: 82208 - DNA, 16 bp, H. sapiens
cctgggtccaagcaat

SEQ ID NO: 82209 - DNA, 16 bp, H. sapiens
cctgggtccaagccat

SEQ ID NO: 82210 - DNA, 16 bp, H. sapiens
cctgggtccccagccc

SEQ ID NO: 82211 - DNA, 16 bp, H. sapiens
cctgggtccccagcct

SEQ ID NO: 82212 - DNA, 16 bp, H. sapiens
cctgggtcctgcagga

SEQ ID NO: 82213 - DNA, 16 bp, H. sapiens
cctgggtctccagcca

SEQ ID NO: 82214 - DNA, 16 bp, H. sapiens
cctgggtctccagctc

SEQ ID NO: 82215 - DNA, 16 bp, H. sapiens
cctgggtctctccctt

SEQ ID NO: 82216 - DNA, 16 bp, H. sapiens
cctgggtgacaaaatt

SEQ ID NO: 82217 - DNA, 16 bp, H. sapiens
cctgggtgacacggtg

SEQ ID NO: 82218 - DNA, 16 bp, H. sapiens
cctgggtgacagcaaa

SEQ ID NO: 82219 - DNA, 16 bp, H. sapiens
cctgggtgacaggaaa

SEQ ID NO: 82220 - DNA, 16 bp, H. sapiens
cctgggtgacagggcg

SEQ ID NO: 82221 - DNA, 16 bp, H. sapiens
cctgggtgatgaaaaa

SEQ ID NO: 82222 - DNA, 16 bp, H. sapiens
cctgggtgatggagct

SEQ ID NO: 82223 - DNA, 16 bp, H. sapiens
cctgggtgcagctgca

SEQ ID NO: 82224 - DNA, 16 bp, H. sapiens
cctgggtgcaggctgg

SEQ ID NO: 82225 - DNA, 16 bp, H. sapiens
cctgggtgcccaggca

SEQ ID NO: 82226 - DNA, 16 bp, H. sapiens
cctgggtggaggtggg

SEQ ID NO: 82227 - DNA, 16 bp, H. sapiens
cctgggtggcacagca

SEQ ID NO: 82228 - DNA, 16 bp, H. sapiens
cctgggtggcagtgag

SEQ ID NO: 82229 - DNA, 16 bp, H. sapiens
cctgggtggctgagca

SEQ ID NO: 82230 - DNA, 22 bp, H. sapiens
cctgggtggcttgccgcccaca

SEQ ID NO: 82231 - DNA, 19 bp, H. sapiens
cctgggtgggccaggtgtt

SEQ ID NO: 82232 - DNA, 16 bp, H. sapiens
cctgggtggggcaggg

SEQ ID NO: 82233 - DNA, 16 bp, H. sapiens
cctgggtgtcagcagc

SEQ ID NO: 82234 - DNA, 16 bp, H. sapiens
cctgggtgtgtctctg

SEQ ID NO: 82235 - DNA, 16 bp, H. sapiens
cctgggttatccaggt

SEQ ID NO: 82236 - DNA, 16 bp, H. sapiens
cctgggttcaaaccct

SEQ ID NO: 82237 - DNA, 16 bp, H. sapiens
cctgggttcaaatcct

SEQ ID NO: 82238 - DNA, 16 bp, H. sapiens
cctgggttcaactgaa

SEQ ID NO: 82239 - DNA, 16 bp, H. sapiens
cctgggttcaagcctc

SEQ ID NO: 82240 - DNA, 16 bp, H. sapiens
cctgggttcacatccc

SEQ ID NO: 82241 - DNA, 16 bp, H. sapiens
cctgggttcccaccat

SEQ ID NO: 82242 - DNA, 16 bp, H. sapiens
cctgggttctagtccc

SEQ ID NO: 82243 - DNA, 16 bp, H. sapiens
cctgggttctggtccc

SEQ ID NO: 82244 - DNA, 16 bp, H. sapiens
cctgggtttcagtgat

SEQ ID NO: 82245 - DNA, 16 bp, H. sapiens
cctggtagctgagact

SEQ ID NO: 82246 - DNA, 16 bp, H. sapiens
cctggtatgtagtaag

SEQ ID NO: 82247 - DNA, 16 bp, H. sapiens
cctggtcaacatggag

SEQ ID NO: 82248 - DNA, 16 bp, H. sapiens
cctggtcaacctggtg

SEQ ID NO: 82249 - DNA, 16 bp, H. sapiens
cctggtcaacgtggtg

SEQ ID NO: 82250 - DNA, 16 bp, H. sapiens
cctggtcaccatggtg

SEQ ID NO: 82251 - DNA, 17 bp, H. sapiens
cctggtcctgaatgact

SEQ ID NO: 82252 - DNA, 16 bp, H. sapiens
cctggtcctggacttt

SEQ ID NO: 82253 - DNA, 16 bp, H. sapiens
cctggtcctggccctg

SEQ ID NO: 82254 - DNA, 16 bp, H. sapiens
cctggtcctgtggtcc

SEQ ID NO: 82255 - DNA, 16 bp, H. sapiens
cctggtcttgaactcc

SEQ ID NO: 82256 - DNA, 16 bp, H. sapiens
cctggtgacacatgcc

SEQ ID NO: 82257 - DNA, 16 bp, H. sapiens
cctggtgacagaatga

SEQ ID NO: 82258 - DNA, 16 bp, H. sapiens
cctggtgacagagcaa

SEQ ID NO: 82259 - DNA, 16 bp, H. sapiens
cctggtgacagaggaa

SEQ ID NO: 82260 - DNA, 16 bp, H. sapiens
cctggtgcagctgcag

SEQ ID NO: 82261 - DNA, 16 bp, H. sapiens
cctggtgcagtggctt

SEQ ID NO: 82262 - DNA, 16 bp, H. sapiens
cctggtgcccaaaagg

SEQ ID NO: 82263 - DNA, 16 bp, H. sapiens
cctggtgccctgagac

SEQ ID NO: 82264 - DNA, 16 bp, H. sapiens
cctggtgcctggcaca

SEQ ID NO: 82265 - DNA, 16 bp, H. sapiens
cctggtgctgtgctgg

SEQ ID NO: 82266 - DNA, 16 bp, H. sapiens
cctggtggaagatgat

SEQ ID NO: 82267 - DNA, 16 bp, H. sapiens
cctggtggcgcacacc

SEQ ID NO: 82268 - DNA, 16 bp, H. sapiens
cctggtggcgggtgcc

SEQ ID NO: 82269 - DNA, 16 bp, H. sapiens
cctggtgggaggcgat

SEQ ID NO: 82270 - DNA, 16 bp, H. sapiens
cctggtgggaggtggc

SEQ ID NO: 82271 - DNA, 16 bp, H. sapiens
cctggtggtctgtgct

SEQ ID NO: 82272 - DNA, 16 bp, H. sapiens
cctggtggtgacagaa

SEQ ID NO: 82273 - DNA, 16 bp, H. sapiens
cctggtggtgggcgcc

SEQ ID NO: 82274 - DNA, 16 bp, H. sapiens
cctggtggtgtgtgcc

SEQ ID NO: 82275 - DNA, 16 bp, H. sapiens
cctggtggttaaaata

SEQ ID NO: 82276 - DNA, 16 bp, H. sapiens
cctggtgtctcttctt

SEQ ID NO: 82277 - DNA, 16 bp, H. sapiens
cctggtgttccttggc

SEQ ID NO: 82278 - DNA, 16 bp, H. sapiens
cctggtgttgggtctg

SEQ ID NO: 82279 - DNA, 16 bp, H. sapiens
cctggttaaaatggat

SEQ ID NO: 82280 - DNA, 16 bp, H. sapiens
cctggttcctctggct

SEQ ID NO: 82281 - DNA, 16 bp, H. sapiens
cctggttctccagttt

SEQ ID NO: 82282 - DNA, 16 bp, H. sapiens
cctggttctctggcct

SEQ ID NO: 82283 - DNA, 16 bp, H. sapiens
cctggttctgcccttg

SEQ ID NO: 82284 - DNA, 16 bp, H. sapiens
cctggttgcaggacaa

SEQ ID NO: 82285 - DNA, 16 bp, H. sapiens
cctgtaaaataaaaag

SEQ ID NO: 82286 - DNA, 16 bp, H. sapiens
cctgtaaataacatca

SEQ ID NO: 82287 - DNA, 16 bp, H. sapiens
cctgtaaatgttacct

SEQ ID NO: 82288 - DNA, 16 bp, H. sapiens
cctgtaagcactttgg

SEQ ID NO: 82289 - DNA, 16 bp, H. sapiens
cctgtaagcccagcta

SEQ ID NO: 82290 - DNA, 16 bp, H. sapiens
cctgtaatcacagaac

SEQ ID NO: 82291 - DNA, 16 bp, H. sapiens
cctgtaatccagcact

SEQ ID NO: 82292 - DNA, 16 bp, H. sapiens
cctgtaatccagcatt

SEQ ID NO: 82293 - DNA, 16 bp, H. sapiens
cctgtaatcccaccac

SEQ ID NO: 82294 - DNA, 16 bp, H. sapiens
cctgtaatcccagcaa

SEQ ID NO: 82295 - DNA, 16 bp, H. sapiens
cctgtaatcccagcca

SEQ ID NO: 82296 - DNA, 16 bp, H. sapiens
cctgtaatcctaacta

SEQ ID NO: 82297 - DNA, 16 bp, H. sapiens
cctgtaatctcactac

SEQ ID NO: 82298 - DNA, 18 bp, H. sapiens
cctgtaatctcagctact

SEQ ID NO: 82299 - DNA, 16 bp, H. sapiens
cctgtaattgcagcta

SEQ ID NO: 82300 - DNA, 16 bp, H. sapiens
cctgtaatttcagcac

SEQ ID NO: 82301 - DNA, 16 bp, H. sapiens
cctgtaatttttcttt

SEQ ID NO: 82302 - DNA, 16 bp, H. sapiens
cctgtacaagctctct

SEQ ID NO: 82303 - DNA, 16 bp, H. sapiens
cctgtacagcctgaag

SEQ ID NO: 82304 - DNA, 16 bp, H. sapiens
cctgtacatctccatc

SEQ ID NO: 82305 - DNA, 16 bp, H. sapiens
cctgtacccactgtcc

SEQ ID NO: 82306 - DNA, 16 bp, H. sapiens
cctgtacctcctgggt

SEQ ID NO: 82307 - DNA, 16 bp, H. sapiens
cctgtactcccagcca

SEQ ID NO: 82308 - DNA, 16 bp, H. sapiens
cctgtactcccagctg

SEQ ID NO: 82309 - DNA, 16 bp, H. sapiens
cctgtaggcagagcct

SEQ ID NO: 82310 - DNA, 16 bp, H. sapiens
cctgtagtcccaacac

SEQ ID NO: 82311 - DNA, 16 bp, H. sapiens
cctgtagtcccagcaa

SEQ ID NO: 82312 - DNA, 16 bp, H. sapiens
cctgtagtcccagcat

SEQ ID NO: 82313 - DNA, 16 bp, H. sapiens
cctgtagtcccagctc

SEQ ID NO: 82314 - DNA, 16 bp, H. sapiens
cctgtagtcccagctg

SEQ ID NO: 82315 - DNA, 16 bp, H. sapiens
cctgtagtcccagctt

SEQ ID NO: 82316 - DNA, 16 bp, H. sapiens
cctgtagtcccaggtg

SEQ ID NO: 82317 - DNA, 16 bp, H. sapiens
cctgtagtcccagtta

SEQ ID NO: 82318 - DNA, 16 bp, H. sapiens
cctgtagttccagcca

SEQ ID NO: 82319 - DNA, 16 bp, H. sapiens
cctgtatctattaaaa

SEQ ID NO: 82320 - DNA, 16 bp, H. sapiens
cctgtattaaaatatc

SEQ ID NO: 82321 - DNA, 16 bp, H. sapiens
cctgtattcacagcta

SEQ ID NO: 82322 - DNA, 16 bp, H. sapiens
cctgtattcccagccc

SEQ ID NO: 82323 - DNA, 16 bp, H. sapiens
cctgtattcctagcac

SEQ ID NO: 82324 - DNA, 16 bp, H. sapiens
cctgtcacacgtcctg

SEQ ID NO: 82325 - DNA, 16 bp, H. sapiens
cctgtcaccacacctg

SEQ ID NO: 82326 - DNA, 16 bp, H. sapiens
cctgtcaccacgcctg

SEQ ID NO: 82327 - DNA, 16 bp, H. sapiens
cctgtcacccagtctg

SEQ ID NO: 82328 - DNA, 16 bp, H. sapiens
cctgtcacctgggcag

SEQ ID NO: 82329 - DNA, 16 bp, H. sapiens
cctgtcactcaggctg

SEQ ID NO: 82330 - DNA, 16 bp, H. sapiens
cctgtcactgaggctg

SEQ ID NO: 82331 - DNA, 16 bp, H. sapiens
cctgtcacttgcagca

SEQ ID NO: 82332 - DNA, 16 bp, H. sapiens
cctgtcactttgggag

SEQ ID NO: 82333 - DNA, 16 bp, H. sapiens
cctgtcagccaggctg

SEQ ID NO: 82334 - DNA, 16 bp, H. sapiens
cctgtcagccagttaa

SEQ ID NO: 82335 - DNA, 16 bp, H. sapiens
cctgtcagcctcctga

SEQ ID NO: 82336 - DNA, 16 bp, H. sapiens
cctgtcatccaggctg

SEQ ID NO: 82337 - DNA, 16 bp, H. sapiens
cctgtcatctcagccc

SEQ ID NO: 82338 - DNA, 16 bp, H. sapiens
cctgtcccagacaact

SEQ ID NO: 82339 - DNA, 16 bp, H. sapiens
cctgtcccagccccac

SEQ ID NO: 82340 - DNA, 16 bp, H. sapiens
cctgtcccagcctcct

SEQ ID NO: 82341 - DNA, 16 bp, H. sapiens
cctgtcccagctctgc

SEQ ID NO: 82342 - DNA, 16 bp, H. sapiens
cctgtccccagcccca

SEQ ID NO: 82343 - DNA, 16 bp, H. sapiens
cctgtccccagcccct

SEQ ID NO: 82344 - DNA, 16 bp, H. sapiens
cctgtccccagccctg

SEQ ID NO: 82345 - DNA, 16 bp, H. sapiens
cctgtccctgccccag

SEQ ID NO: 82346 - DNA, 16 bp, H. sapiens
cctgtccctgcccctg

SEQ ID NO: 82347 - DNA, 16 bp, H. sapiens
cctgtcctagagatct

SEQ ID NO: 82348 - DNA, 16 bp, H. sapiens
cctgtcctcaaactga

SEQ ID NO: 82349 - DNA, 16 bp, H. sapiens
cctgtcctcctgctct

SEQ ID NO: 82350 - DNA, 16 bp, H. sapiens
cctgtcctctgaagct

SEQ ID NO: 82351 - DNA, 16 bp, H. sapiens
cctgtctatacaaaaa

SEQ ID NO: 82352 - DNA, 16 bp, H. sapiens
cctgtctcaaaaaaat

SEQ ID NO: 82353 - DNA, 16 bp, H. sapiens
cctgtctcaaaaacaa

SEQ ID NO: 82354 - DNA, 16 bp, H. sapiens
cctgtctcaaaaatta

SEQ ID NO: 82355 - DNA, 16 bp, H. sapiens
cctgtctcaaaagaaa

SEQ ID NO: 82356 - DNA, 16 bp, H. sapiens
cctgtctcaaataaat

SEQ ID NO: 82357 - DNA, 16 bp, H. sapiens
cctgtctcaccatgtg

SEQ ID NO: 82358 - DNA, 16 bp, H. sapiens
cctgtctcagaaataa

SEQ ID NO: 82359 - DNA, 16 bp, H. sapiens
cctgtctcagcctcca

SEQ ID NO: 82360 - DNA, 16 bp, H. sapiens
cctgtctcaggctcct

SEQ ID NO: 82361 - DNA, 16 bp, H. sapiens
cctgtctcagtcttcc

SEQ ID NO: 82362 - DNA, 16 bp, H. sapiens
cctgtctccaaaaaag

SEQ ID NO: 82363 - DNA, 16 bp, H. sapiens
cctgtctccacctccc

SEQ ID NO: 82364 - DNA, 16 bp, H. sapiens
cctgtctccacctctc

SEQ ID NO: 82365 - DNA, 16 bp, H. sapiens
cctgtctcccaagtag

SEQ ID NO: 82366 - DNA, 16 bp, H. sapiens
cctgtctccctgtctc

SEQ ID NO: 82367 - DNA, 16 bp, H. sapiens
cctgtctcctaaaaat

SEQ ID NO: 82368 - DNA, 16 bp, H. sapiens
cctgtctcctgggttc

SEQ ID NO: 82369 - DNA, 16 bp, H. sapiens
cctgtctcgaaaataa

SEQ ID NO: 82370 - DNA, 16 bp, H. sapiens
cctgtctcggcctccc

SEQ ID NO: 82371 - DNA, 16 bp, H. sapiens
cctgtctctaaaacaa

SEQ ID NO: 82372 - DNA, 16 bp, H. sapiens
cctgtctctaaaatga

SEQ ID NO: 82373 - DNA, 18 bp, H. sapiens
cctgtctctacaaaaaaa

SEQ ID NO: 82374 - DNA, 16 bp, H. sapiens
cctgtctctacaaaat

SEQ ID NO: 82375 - DNA, 16 bp, H. sapiens
cctgtctctatgaatt

SEQ ID NO: 82376 - DNA, 16 bp, H. sapiens
cctgtctctccctcca

SEQ ID NO: 82377 - DNA, 16 bp, H. sapiens
cctgtctctgaaaaca

SEQ ID NO: 82378 - DNA, 16 bp, H. sapiens
cctgtctctgcctcct

SEQ ID NO: 82379 - DNA, 16 bp, H. sapiens
cctgtctctgtgtgtg

SEQ ID NO: 82380 - DNA, 16 bp, H. sapiens
cctgtctcttaagaaa

SEQ ID NO: 82381 - DNA, 16 bp, H. sapiens
cctgtctgcctcctgc

SEQ ID NO: 82382 - DNA, 16 bp, H. sapiens
cctgtctgccttctgc

SEQ ID NO: 82383 - DNA, 16 bp, H. sapiens
cctgtctgggcctcag

SEQ ID NO: 82384 - DNA, 16 bp, H. sapiens
cctgtctgggggtggg

SEQ ID NO: 82385 - DNA, 16 bp, H. sapiens
cctgtctgtacaaaaa

SEQ ID NO: 82386 - DNA, 16 bp, H. sapiens
cctgtctgtctctcca

SEQ ID NO: 82387 - DNA, 16 bp, H. sapiens
cctgtctgtgaaatgg

SEQ ID NO: 82388 - DNA, 16 bp, H. sapiens
cctgtcttaaacaaac

SEQ ID NO: 82389 - DNA, 16 bp, H. sapiens
cctgtcttcaagctta

SEQ ID NO: 82390 - DNA, 16 bp, H. sapiens
cctgtcttcaagtttg

SEQ ID NO: 82391 - DNA, 16 bp, H. sapiens
cctgtcttcaggtgat

SEQ ID NO: 82392 - DNA, 16 bp, H. sapiens
cctgtcttctctgtgg

SEQ ID NO: 82393 - DNA, 16 bp, H. sapiens
cctgtcttctgagccc

SEQ ID NO: 82394 - DNA, 16 bp, H. sapiens
cctgtctttacaaata

SEQ ID NO: 82395 - DNA, 16 bp, H. sapiens
cctgtctttacagaaa

SEQ ID NO: 82396 - DNA, 16 bp, H. sapiens
cctgtgaaactgtgag

SEQ ID NO: 82397 - DNA, 16 bp, H. sapiens
cctgtgaccccagcac

SEQ ID NO: 82398 - DNA, 16 bp, H. sapiens
cctgtgactgagaatg

SEQ ID NO: 82399 - DNA, 16 bp, H. sapiens
cctgtgactgtgacct

SEQ ID NO: 82400 - DNA, 16 bp, H. sapiens
cctgtgagcctctggt

SEQ ID NO: 82401 - DNA, 16 bp, H. sapiens
cctgtgaggctggaag

SEQ ID NO: 82402 - DNA, 16 bp, H. sapiens
cctgtgataaagttta

SEQ ID NO: 82403 - DNA, 16 bp, H. sapiens
cctgtgatcccagccc

SEQ ID NO: 82404 - DNA, 16 bp, H. sapiens
cctgtgatcccagctt

SEQ ID NO: 82405 - DNA, 16 bp, H. sapiens
cctgtgatcccagtta

SEQ ID NO: 82406 - DNA, 16 bp, H. sapiens
cctgtgatgggaggga

SEQ ID NO: 82407 - DNA, 16 bp, H. sapiens
cctgtgattctgtttt

SEQ ID NO: 82408 - DNA, 16 bp, H. sapiens
cctgtgattggctgaa

SEQ ID NO: 82409 - DNA, 16 bp, H. sapiens
cctgtgatttttcttt

SEQ ID NO: 82410 - DNA, 16 bp, H. sapiens
cctgtgcagcctgcag

SEQ ID NO: 82411 - DNA, 16 bp, H. sapiens
cctgtgccacctcagg

SEQ ID NO: 82412 - DNA, 16 bp, H. sapiens
cctgtgccactatgcc

SEQ ID NO: 82413 - DNA, 16 bp, H. sapiens
cctgtgcccactgtct

SEQ ID NO: 82414 - DNA, 16 bp, H. sapiens
cctgtgccctcatggg

SEQ ID NO: 82415 - DNA, 16 bp, H. sapiens
cctgtgccctgtgccc

SEQ ID NO: 82416 - DNA, 16 bp, H. sapiens
cctgtgcctggaaaag

SEQ ID NO: 82417 - DNA, 16 bp, H. sapiens
cctgtgccttctgcca

SEQ ID NO: 82418 - DNA, 16 bp, H. sapiens
cctgtgccttgtagga

SEQ ID NO: 82419 - DNA, 16 bp, H. sapiens
cctgtgctctttccac

SEQ ID NO: 82420 - DNA, 16 bp, H. sapiens
cctgtgctggcacctg

SEQ ID NO: 82421 - DNA, 16 bp, H. sapiens
cctgtgctgtgtgcag

SEQ ID NO: 82422 - DNA, 16 bp, H. sapiens
cctgtgcttttggtgt

SEQ ID NO: 82423 - DNA, 16 bp, H. sapiens
cctgtggcaatgacat

SEQ ID NO: 82424 - DNA, 16 bp, H. sapiens
cctgtggcacctgcag

SEQ ID NO: 82425 - DNA, 16 bp, H. sapiens
cctgtggcattgcagg

SEQ ID NO: 82426 - DNA, 16 bp, H. sapiens
cctgtggccaccacca

SEQ ID NO: 82427 - DNA, 16 bp, H. sapiens
cctgtggcccaggctg

SEQ ID NO: 82428 - DNA, 16 bp, H. sapiens
cctgtggccccagctc

SEQ ID NO: 82429 - DNA, 16 bp, H. sapiens
cctgtggccttgggca

SEQ ID NO: 82430 - DNA, 16 bp, H. sapiens
cctgtggctcacacct

SEQ ID NO: 82431 - DNA, 16 bp, H. sapiens
cctgtggctggaggtg

SEQ ID NO: 82432 - DNA, 21 bp, H. sapiens
cctgtggggctggaccctaca

SEQ ID NO: 82433 - DNA, 16 bp, H. sapiens
cctgtgggggcagggc

SEQ ID NO: 82434 - DNA, 16 bp, H. sapiens
cctgtggggtctgcac

SEQ ID NO: 82435 - DNA, 16 bp, H. sapiens
cctgtggggtctgtgc

SEQ ID NO: 82436 - DNA, 16 bp, H. sapiens
cctgtggtcacacagc

SEQ ID NO: 82437 - DNA, 16 bp, H. sapiens
cctgtggtcaccacca

SEQ ID NO: 82438 - DNA, 16 bp, H. sapiens
cctgtggtcccagcca

SEQ ID NO: 82439 - DNA, 16 bp, H. sapiens
cctgtggtcccagctg

SEQ ID NO: 82440 - DNA, 16 bp, H. sapiens
cctgtggtctcagcca

SEQ ID NO: 82441 - DNA, 16 bp, H. sapiens
cctgtggtgccaggca

SEQ ID NO: 82442 - DNA, 16 bp, H. sapiens
cctgtggttccagcta

SEQ ID NO: 82443 - DNA, 16 bp, H. sapiens
cctgtgtacacacaca

SEQ ID NO: 82444 - DNA, 16 bp, H. sapiens
cctgtgtcccagagat

SEQ ID NO: 82445 - DNA, 16 bp, H. sapiens
cctgtgtcccagcagc

SEQ ID NO: 82446 - DNA, 16 bp, H. sapiens
cctgtgtcccagctgc

SEQ ID NO: 82447 - DNA, 16 bp, H. sapiens
cctgtgtccccactca

SEQ ID NO: 82448 - DNA, 16 bp, H. sapiens
cctgtgtccccagccc

SEQ ID NO: 82449 - DNA, 16 bp, H. sapiens
cctgtgtccccagggc

SEQ ID NO: 82450 - DNA, 16 bp, H. sapiens
cctgtgtctcctctgt

SEQ ID NO: 82451 - DNA, 16 bp, H. sapiens
cctgtgtctgtctctg

SEQ ID NO: 82452 - DNA, 16 bp, H. sapiens
cctgtgtgatcttggg

SEQ ID NO: 82453 - DNA, 16 bp, H. sapiens
cctgtgtgcctggcct

SEQ ID NO: 82454 - DNA, 16 bp, H. sapiens
cctgtgtgggacaggg

SEQ ID NO: 82455 - DNA, 16 bp, H. sapiens
cctgtgtgtatgtgta

SEQ ID NO: 82456 - DNA, 16 bp, H. sapiens
cctgtgtgtccatgtg

SEQ ID NO: 82457 - DNA, 16 bp, H. sapiens
cctgtgtgtctctgtg

SEQ ID NO: 82458 - DNA, 16 bp, H. sapiens
cctgtgtgtgagtgtg

SEQ ID NO: 82459 - DNA, 16 bp, H. sapiens
cctgtgtgtgtctctg

SEQ ID NO: 82460 - DNA, 16 bp, H. sapiens
cctgtgtgtgtgcatg

SEQ ID NO: 82461 - DNA, 16 bp, H. sapiens
cctgtgtgtgtgtgtt

SEQ ID NO: 82462 - DNA, 16 bp, H. sapiens
cctgtgttcccagctg

SEQ ID NO: 82463 - DNA, 16 bp, H. sapiens
cctgtgttctgttcca

SEQ ID NO: 82464 - DNA, 16 bp, H. sapiens
cctgtgttgtgggagg

SEQ ID NO: 82465 - DNA, 16 bp, H. sapiens
cctgtgtttgctgaga

SEQ ID NO: 82466 - DNA, 16 bp, H. sapiens
cctgtgttttcttcta

SEQ ID NO: 82467 - DNA, 16 bp, H. sapiens
cctgttacccaggctg

SEQ ID NO: 82468 - DNA, 16 bp, H. sapiens
cctgttaggaaccagg

SEQ ID NO: 82469 - DNA, 16 bp, H. sapiens
cctgttaggaacctgg

SEQ ID NO: 82470 - DNA, 16 bp, H. sapiens
cctgttaggaagcagg

SEQ ID NO: 82471 - DNA, 16 bp, H. sapiens
cctgttatctcagcac

SEQ ID NO: 82472 - DNA, 16 bp, H. sapiens
cctgttccctcccaca

SEQ ID NO: 82473 - DNA, 16 bp, H. sapiens
cctgttcctggctccc

SEQ ID NO: 82474 - DNA, 16 bp, H. sapiens
cctgttccttcctctg

SEQ ID NO: 82475 - DNA, 16 bp, H. sapiens
cctgttcctttctctg

SEQ ID NO: 82476 - DNA, 16 bp, H. sapiens
cctgttctaggcactg

SEQ ID NO: 82477 - DNA, 17 bp, H. sapiens
cctgttctcaatgagct

SEQ ID NO: 82478 - DNA, 16 bp, H. sapiens
cctgttctcactcata

SEQ ID NO: 82479 - DNA, 16 bp, H. sapiens
cctgttctctctgaag

SEQ ID NO: 82480 - DNA, 16 bp, H. sapiens
cctgttgaaggagggg

SEQ ID NO: 82481 - DNA, 16 bp, H. sapiens
cctgttgccaaggctg

SEQ ID NO: 82482 - DNA, 16 bp, H. sapiens
cctgttgccaggctgg

SEQ ID NO: 82483 - DNA, 16 bp, H. sapiens
cctgttgcccaggctg

SEQ ID NO: 82484 - DNA, 16 bp, H. sapiens
cctgttgcctgggctg

SEQ ID NO: 82485 - DNA, 16 bp, H. sapiens
cctgttggccattttt

SEQ ID NO: 82486 - DNA, 18 bp, H. sapiens
cctgttggggagcaaagg

SEQ ID NO: 82487 - DNA, 16 bp, H. sapiens
cctgttgtctcagcta

SEQ ID NO: 82488 - DNA, 16 bp, H. sapiens
cctgttgtggggaggg

SEQ ID NO: 82489 - DNA, 16 bp, H. sapiens
cctgtttatttattta

SEQ ID NO: 82490 - DNA, 16 bp, H. sapiens
cctgtttcacagatgg

SEQ ID NO: 82491 - DNA, 16 bp, H. sapiens
cctgtttcagcctcca

SEQ ID NO: 82492 - DNA, 16 bp, H. sapiens
cctgtttccaaaaaaa

SEQ ID NO: 82493 - DNA, 16 bp, H. sapiens
cctgtttccacaaaaa

SEQ ID NO: 82494 - DNA, 16 bp, H. sapiens
cctgtttctaaagaaa

SEQ ID NO: 82495 - DNA, 16 bp, H. sapiens
cctgtttctacaaaaa

SEQ ID NO: 82496 - DNA, 16 bp, H. sapiens
cctgtttctagaaaaa

SEQ ID NO: 82497 - DNA, 16 bp, H. sapiens
cctgtttctagttttt

SEQ ID NO: 82498 - DNA, 16 bp, H. sapiens
cctgtttctccacaac

SEQ ID NO: 82499 - DNA, 16 bp, H. sapiens
cctgtttctctgtgtg

SEQ ID NO: 82500 - DNA, 16 bp, H. sapiens
cctgtttgctgttgtt

SEQ ID NO: 82501 - DNA, 16 bp, H. sapiens
cctgttttatagcact

SEQ ID NO: 82502 - DNA, 16 bp, H. sapiens
cctgttttattttcct

SEQ ID NO: 82503 - DNA, 16 bp, H. sapiens
cctgttttcccatctg

SEQ ID NO: 82504 - DNA, 16 bp, H. sapiens
cctgttttctcatttg

SEQ ID NO: 82505 - DNA, 16 bp, H. sapiens
cctgttttgttcactg

SEQ ID NO: 82506 - DNA, 16 bp, H. sapiens
cctgtttttgtaaata

SEQ ID NO: 82507 - DNA, 16 bp, H. sapiens
ccttaaaaaagaaaga

SEQ ID NO: 82508 - DNA, 16 bp, H. sapiens
ccttaaaaaccctagc

SEQ ID NO: 82509 - DNA, 16 bp, H. sapiens
ccttaaaaaggaaaaa

SEQ ID NO: 82510 - DNA, 16 bp, H. sapiens
ccttaaaaaggaagga

SEQ ID NO: 82511 - DNA, 16 bp, H. sapiens
ccttaaaaatattatg

SEQ ID NO: 82512 - DNA, 16 bp, H. sapiens
ccttaaaaatgaaatt

SEQ ID NO: 82513 - DNA, 16 bp, H. sapiens
ccttaaaagggccagg

SEQ ID NO: 82514 - DNA, 16 bp, H. sapiens
ccttaaaattccaaaa

SEQ ID NO: 82515 - DNA, 16 bp, H. sapiens
ccttaaacaaaaatca

SEQ ID NO: 82516 - DNA, 16 bp, H. sapiens
ccttaacatttcttcc

SEQ ID NO: 82517 - DNA, 16 bp, H. sapiens
ccttaaccttttttcc

SEQ ID NO: 82518 - DNA, 16 bp, H. sapiens
ccttaactaattacat

SEQ ID NO: 82519 - DNA, 17 bp, H. sapiens
ccttaactgatgacatt

SEQ ID NO: 82520 - DNA, 17 bp, H. sapiens
ccttaactgatgatatt

SEQ ID NO: 82521 - DNA, 16 bp, H. sapiens
ccttaactttggcaaa

SEQ ID NO: 82522 - DNA, 16 bp, H. sapiens
ccttaatgaagctgca

SEQ ID NO: 82523 - DNA, 16 bp, H. sapiens
ccttacaagaagagaa

SEQ ID NO: 82524 - DNA, 16 bp, H. sapiens
ccttacagagaaaata

SEQ ID NO: 82525 - DNA, 16 bp, H. sapiens
ccttacaggccaggag

SEQ ID NO: 82526 - DNA, 16 bp, H. sapiens
ccttacagtgtaaaca

SEQ ID NO: 82527 - DNA, 16 bp, H. sapiens
ccttacatggcaaagg

SEQ ID NO: 82528 - DNA, 16 bp, H. sapiens
ccttaccagacatcaa

SEQ ID NO: 82529 - DNA, 17 bp, H. sapiens
ccttacctcagatgatc

SEQ ID NO: 82530 - DNA, 16 bp, H. sapiens
ccttaccttctgccat

SEQ ID NO: 82531 - DNA, 16 bp, H. sapiens
ccttactctacaatcc

SEQ ID NO: 82532 - DNA, 16 bp, H. sapiens
ccttagcaaatgcaaa

SEQ ID NO: 82533 - DNA, 16 bp, H. sapiens
ccttagccccctgagt

SEQ ID NO: 82534 - DNA, 16 bp, H. sapiens
ccttagcctcccaaag

SEQ ID NO: 82535 - DNA, 16 bp, H. sapiens
ccttagcctggatttc

SEQ ID NO: 82536 - DNA, 21 bp, H. sapiens
ccttagctaagagagccagac

SEQ ID NO: 82537 - DNA, 16 bp, H. sapiens
ccttagctcaagcaat

SEQ ID NO: 82538 - DNA, 16 bp, H. sapiens
ccttaggaatctactt

SEQ ID NO: 82539 - DNA, 16 bp, H. sapiens
ccttagtctcccaaat

SEQ ID NO: 82540 - DNA, 16 bp, H. sapiens
ccttataaaagggacc

SEQ ID NO: 82541 - DNA, 16 bp, H. sapiens
ccttataaattaccca

SEQ ID NO: 82542 - DNA, 16 bp, H. sapiens
ccttataagagggagg

SEQ ID NO: 82543 - DNA, 16 bp, H. sapiens
ccttatcttggctatt

SEQ ID NO: 82544 - DNA, 16 bp, H. sapiens
ccttatgaagaaggtg

SEQ ID NO: 82545 - DNA, 16 bp, H. sapiens
ccttatgagaatccaa

SEQ ID NO: 82546 - DNA, 16 bp, H. sapiens
ccttatgtataaaatg

SEQ ID NO: 82547 - DNA, 16 bp, H. sapiens
ccttatttagttcatt

SEQ ID NO: 82548 - DNA, 16 bp, H. sapiens
ccttatttggaaaaaa

SEQ ID NO: 82549 - DNA, 16 bp, H. sapiens
ccttattttacagaag

SEQ ID NO: 82550 - DNA, 16 bp, H. sapiens
ccttattttgttgttg

SEQ ID NO: 82551 - DNA, 16 bp, H. sapiens
ccttcaaaaaatgaat

SEQ ID NO: 82552 - DNA, 16 bp, H. sapiens
ccttcaaaactcagct

SEQ ID NO: 82553 - DNA, 16 bp, H. sapiens
ccttcaaaagtgaaag

SEQ ID NO: 82554 - DNA, 16 bp, H. sapiens
ccttcaaagccacagg

SEQ ID NO: 82555 - DNA, 16 bp, H. sapiens
ccttcaacctcatgaa

SEQ ID NO: 82556 - DNA, 16 bp, H. sapiens
ccttcaactgattaga

SEQ ID NO: 82557 - DNA, 16 bp, H. sapiens
ccttcaagagctcttg

SEQ ID NO: 82558 - DNA, 16 bp, H. sapiens
ccttcaaggagctcac

SEQ ID NO: 82559 - DNA, 16 bp, H. sapiens
ccttcaaggcctgtct

SEQ ID NO: 82560 - DNA, 16 bp, H. sapiens
ccttcaattcctgggc

SEQ ID NO: 82561 - DNA, 16 bp, H. sapiens
ccttcaattttgttct

SEQ ID NO: 82562 - DNA, 16 bp, H. sapiens
ccttcacattttttcc

SEQ ID NO: 82563 - DNA, 16 bp, H. sapiens
ccttcaccagcaaaaa

SEQ ID NO: 82564 - DNA, 16 bp, H. sapiens
ccttcacccaggctgg

SEQ ID NO: 82565 - DNA, 16 bp, H. sapiens
ccttcacctattttac

SEQ ID NO: 82566 - DNA, 16 bp, H. sapiens
ccttcacctcccaggt

SEQ ID NO: 82567 - DNA, 16 bp, H. sapiens
ccttcactgaagtctt

SEQ ID NO: 82568 - DNA, 16 bp, H. sapiens
ccttcacttatgaagc

SEQ ID NO: 82569 - DNA, 16 bp, H. sapiens
ccttcactttcagtct

SEQ ID NO: 82570 - DNA, 16 bp, H. sapiens
ccttcagaatgaagac

SEQ ID NO: 82571 - DNA, 16 bp, H. sapiens
ccttcagacccaggag

SEQ ID NO: 82572 - DNA, 16 bp, H. sapiens
ccttcagaccccagaa

SEQ ID NO: 82573 - DNA, 16 bp, H. sapiens
ccttcagcagtgtttg

SEQ ID NO: 82574 - DNA, 16 bp, H. sapiens
ccttcagcccctctcc

SEQ ID NO: 82575 - DNA, 16 bp, H. sapiens
ccttcagcctcctgag

SEQ ID NO: 82576 - DNA, 16 bp, H. sapiens
ccttcagcctgggcga

SEQ ID NO: 82577 - DNA, 16 bp, H. sapiens
ccttcagcctgtggcc

SEQ ID NO: 82578 - DNA, 16 bp, H. sapiens
ccttcagctcctgtat

SEQ ID NO: 82579 - DNA, 34 bp, H. sapiens
ccttcagcttaatctctcccactctaggttccca

SEQ ID NO: 82580 - DNA, 16 bp, H. sapiens
ccttcagctttatcct

SEQ ID NO: 82581 - DNA, 16 bp, H. sapiens
ccttcaggaacttttc

SEQ ID NO: 82582 - DNA, 16 bp, H. sapiens
ccttcaggaatgaaag

SEQ ID NO: 82583 - DNA, 16 bp, H. sapiens
ccttcaggagctcctt

SEQ ID NO: 82584 - DNA, 16 bp, H. sapiens
ccttcaggatggagtc

SEQ ID NO: 82585 - DNA, 16 bp, H. sapiens
ccttcaggcctcagct

SEQ ID NO: 82586 - DNA, 16 bp, H. sapiens
ccttcagggatgtcct

SEQ ID NO: 82587 - DNA, 16 bp, H. sapiens
ccttcaggtctcagct

SEQ ID NO: 82588 - DNA, 16 bp, H. sapiens
ccttcagtctccaccc

SEQ ID NO: 82589 - DNA, 16 bp, H. sapiens
ccttcagttctgggaa

SEQ ID NO: 82590 - DNA, 16 bp, H. sapiens
ccttcagttttattct

SEQ ID NO: 82591 - DNA, 16 bp, H. sapiens
ccttcatatcccattc

SEQ ID NO: 82592 - DNA, 16 bp, H. sapiens
ccttcatcaatgatct

SEQ ID NO: 82593 - DNA, 16 bp, H. sapiens
ccttcatcttggactt

SEQ ID NO: 82594 - DNA, 16 bp, H. sapiens
ccttcatgaatggttt

SEQ ID NO: 82595 - DNA, 16 bp, H. sapiens
ccttcatggagctcac

SEQ ID NO: 82596 - DNA, 16 bp, H. sapiens
ccttcattcattcaac

SEQ ID NO: 82597 - DNA, 16 bp, H. sapiens
ccttcatttaaaaaaa

SEQ ID NO: 82598 - DNA, 16 bp, H. sapiens
ccttcatttcacagat

SEQ ID NO: 82599 - DNA, 16 bp, H. sapiens
ccttcatttctgattt

SEQ ID NO: 82600 - DNA, 16 bp, H. sapiens
ccttcattttaaagat

SEQ ID NO: 82601 - DNA, 16 bp, H. sapiens
ccttccaagcagctgg

SEQ ID NO: 82602 - DNA, 16 bp, H. sapiens
ccttccaagcctctgg

SEQ ID NO: 82603 - DNA, 16 bp, H. sapiens
ccttccacactgtgga

SEQ ID NO: 82604 - DNA, 16 bp, H. sapiens
ccttccaccaggattg

SEQ ID NO: 82605 - DNA, 16 bp, H. sapiens
ccttccaccaggccct

SEQ ID NO: 82606 - DNA, 16 bp, H. sapiens
ccttccacctgtgagc

SEQ ID NO: 82607 - DNA, 16 bp, H. sapiens
ccttccacttcagtct

SEQ ID NO: 82608 - DNA, 16 bp, H. sapiens
ccttccagaccttgcc

SEQ ID NO: 82609 - DNA, 16 bp, H. sapiens
ccttccagcgtgggca

SEQ ID NO: 82610 - DNA, 16 bp, H. sapiens
ccttccagctgctttc

SEQ ID NO: 82611 - DNA, 16 bp, H. sapiens
ccttccagctgtgcct

SEQ ID NO: 82612 - DNA, 16 bp, H. sapiens
ccttccaggcagaggg

SEQ ID NO: 82613 - DNA, 16 bp, H. sapiens
ccttccaggtgaaggt

SEQ ID NO: 82614 - DNA, 16 bp, H. sapiens
ccttccaggtttaagc

SEQ ID NO: 82615 - DNA, 16 bp, H. sapiens
ccttccagtgggacag

SEQ ID NO: 82616 - DNA, 16 bp, H. sapiens
ccttccatcatgactg

SEQ ID NO: 82617 - DNA, 16 bp, H. sapiens
ccttccatctcaacct

SEQ ID NO: 82618 - DNA, 16 bp, H. sapiens
ccttccatctcttctg

SEQ ID NO: 82619 - DNA, 16 bp, H. sapiens
ccttccatggctccct

SEQ ID NO: 82620 - DNA, 16 bp, H. sapiens
ccttccatttatttat

SEQ ID NO: 82621 - DNA, 16 bp, H. sapiens
ccttcccaccttggcc

SEQ ID NO: 82622 - DNA, 16 bp, H. sapiens
ccttcccacttcagcc

SEQ ID NO: 82623 - DNA, 16 bp, H. sapiens
ccttcccagaagcccc

SEQ ID NO: 82624 - DNA, 16 bp, H. sapiens
ccttcccagatctcct

SEQ ID NO: 82625 - DNA, 16 bp, H. sapiens
ccttcccagccactgg

SEQ ID NO: 82626 - DNA, 16 bp, H. sapiens
ccttcccagccatgca

SEQ ID NO: 82627 - DNA, 16 bp, H. sapiens
ccttcccagcctctgg

SEQ ID NO: 82628 - DNA, 16 bp, H. sapiens
ccttcccagctctccc

SEQ ID NO: 82629 - DNA, 16 bp, H. sapiens
ccttccccaaggagac

SEQ ID NO: 82630 - DNA, 16 bp, H. sapiens
ccttccccaaggtgct

SEQ ID NO: 82631 - DNA, 16 bp, H. sapiens
ccttccccaccctctg

SEQ ID NO: 82632 - DNA, 16 bp, H. sapiens
ccttccccagccaggc

SEQ ID NO: 82633 - DNA, 16 bp, H. sapiens
ccttccccagcccctg

SEQ ID NO: 82634 - DNA, 16 bp, H. sapiens
ccttccccagccctct

SEQ ID NO: 82635 - DNA, 16 bp, H. sapiens
ccttccccagccctgg

SEQ ID NO: 82636 - DNA, 16 bp, H. sapiens
ccttccccagctccag

SEQ ID NO: 82637 - DNA, 16 bp, H. sapiens
ccttccccagcttccc

SEQ ID NO: 82638 - DNA, 16 bp, H. sapiens
ccttccccaggagctt

SEQ ID NO: 82639 - DNA, 16 bp, H. sapiens
ccttccccaggcccca

SEQ ID NO: 82640 - DNA, 16 bp, H. sapiens
ccttcccccaagtccc

SEQ ID NO: 82641 - DNA, 16 bp, H. sapiens
ccttcccccaggaatg

SEQ ID NO: 82642 - DNA, 16 bp, H. sapiens
ccttcccctcctccag

SEQ ID NO: 82643 - DNA, 16 bp, H. sapiens
ccttcccctctcccag

SEQ ID NO: 82644 - DNA, 16 bp, H. sapiens
ccttcccctgagccca

SEQ ID NO: 82645 - DNA, 16 bp, H. sapiens
ccttcccctggaagct

SEQ ID NO: 82646 - DNA, 16 bp, H. sapiens
ccttccccttcagcct

SEQ ID NO: 82647 - DNA, 16 bp, H. sapiens
ccttccccttcccagt

SEQ ID NO: 82648 - DNA, 16 bp, H. sapiens
ccttccccttccccag

SEQ ID NO: 82649 - DNA, 16 bp, H. sapiens
ccttccctcagtccct

SEQ ID NO: 82650 - DNA, 16 bp, H. sapiens
ccttccctgactaccc

SEQ ID NO: 82651 - DNA, 16 bp, H. sapiens
ccttccctgagttttc

SEQ ID NO: 82652 - DNA, 16 bp, H. sapiens
ccttccctgcccacct

SEQ ID NO: 82653 - DNA, 16 bp, H. sapiens
ccttccctggctctgc

SEQ ID NO: 82654 - DNA, 16 bp, H. sapiens
ccttccctgggccaga

SEQ ID NO: 82655 - DNA, 16 bp, H. sapiens
ccttcccttccccagg

SEQ ID NO: 82656 - DNA, 16 bp, H. sapiens
ccttccgaggagctgg

SEQ ID NO: 82657 - DNA, 16 bp, H. sapiens
ccttccgggttcaagc

SEQ ID NO: 82658 - DNA, 16 bp, H. sapiens
ccttccgggttcatgc

SEQ ID NO: 82659 - DNA, 16 bp, H. sapiens
ccttcctcacaaggtg

SEQ ID NO: 82660 - DNA, 16 bp, H. sapiens
ccttcctcactcagct

SEQ ID NO: 82661 - DNA, 16 bp, H. sapiens
ccttcctcactgccct

SEQ ID NO: 82662 - DNA, 16 bp, H. sapiens
ccttcctcagcctccc

SEQ ID NO: 82663 - DNA, 16 bp, H. sapiens
ccttcctcagcctctc

SEQ ID NO: 82664 - DNA, 16 bp, H. sapiens
ccttcctcaggctccc

SEQ ID NO: 82665 - DNA, 16 bp, H. sapiens
ccttcctccagcctca

SEQ ID NO: 82666 - DNA, 16 bp, H. sapiens
ccttcctcccagctgc

SEQ ID NO: 82667 - DNA, 16 bp, H. sapiens
ccttcctcctggggct

SEQ ID NO: 82668 - DNA, 23 bp, H. sapiens
ccttcctctatctcaactgcaag

SEQ ID NO: 82669 - DNA, 16 bp, H. sapiens
ccttcctctgcctgct

SEQ ID NO: 82670 - DNA, 21 bp, H. sapiens
ccttcctcttatactaatcct

SEQ ID NO: 82671 - DNA, 16 bp, H. sapiens
ccttcctgaggccaag

SEQ ID NO: 82672 - DNA, 16 bp, H. sapiens
ccttcctgaggcctca

SEQ ID NO: 82673 - DNA, 16 bp, H. sapiens
ccttcctgcagctggt

SEQ ID NO: 82674 - DNA, 16 bp, H. sapiens
ccttcctgcctcacaa

SEQ ID NO: 82675 - DNA, 16 bp, H. sapiens
ccttcctgcctgcctt

SEQ ID NO: 82676 - DNA, 16 bp, H. sapiens
ccttcctgctgccttg

SEQ ID NO: 82677 - DNA, 16 bp, H. sapiens
ccttcctgggatggcc

SEQ ID NO: 82678 - DNA, 16 bp, H. sapiens
ccttcctgggcctcag

SEQ ID NO: 82679 - DNA, 16 bp, H. sapiens
ccttcctggggcagcc

SEQ ID NO: 82680 - DNA, 16 bp, H. sapiens
ccttcctgtgtcccag

SEQ ID NO: 82681 - DNA, 16 bp, H. sapiens
ccttcctgtgtgcatg

SEQ ID NO: 82682 - DNA, 16 bp, H. sapiens
ccttcctgtttccatg

SEQ ID NO: 82683 - DNA, 16 bp, H. sapiens
ccttccttagcctcct

SEQ ID NO: 82684 - DNA, 16 bp, H. sapiens
ccttccttccttccag

SEQ ID NO: 82685 - DNA, 16 bp, H. sapiens
ccttccttgagtggct

SEQ ID NO: 82686 - DNA, 16 bp, H. sapiens
ccttctacacactgct

SEQ ID NO: 82687 - DNA, 16 bp, H. sapiens
ccttctacatttatta

SEQ ID NO: 82688 - DNA, 16 bp, H. sapiens
ccttctaccaggtccc

SEQ ID NO: 82689 - DNA, 16 bp, H. sapiens
ccttctaccatgatta

SEQ ID NO: 82690 - DNA, 16 bp, H. sapiens
ccttctacctgctggg

SEQ ID NO: 82691 - DNA, 16 bp, H. sapiens
ccttctcaacagtccc

SEQ ID NO: 82692 - DNA, 16 bp, H. sapiens
ccttctcagagccttt

SEQ ID NO: 82693 - DNA, 16 bp, H. sapiens
ccttctcagcctctgg

SEQ ID NO: 82694 - DNA, 16 bp, H. sapiens
ccttctcatccttcaa

SEQ ID NO: 82695 - DNA, 16 bp, H. sapiens
ccttctcatgctgcta

SEQ ID NO: 82696 - DNA, 16 bp, H. sapiens
ccttctccagaatgtc

SEQ ID NO: 82697 - DNA, 16 bp, H. sapiens
ccttctccagcccact

SEQ ID NO: 82698 - DNA, 16 bp, H. sapiens
ccttctccagcccctg

SEQ ID NO: 82699 - DNA, 16 bp, H. sapiens
ccttctccagcctccc

SEQ ID NO: 82700 - DNA, 16 bp, H. sapiens
ccttctccatatcagc

SEQ ID NO: 82701 - DNA, 16 bp, H. sapiens
ccttctccctgtaccc

SEQ ID NO: 82702 - DNA, 16 bp, H. sapiens
ccttctccctgtgtgc

SEQ ID NO: 82703 - DNA, 16 bp, H. sapiens
ccttctcctcctcagc

SEQ ID NO: 82704 - DNA, 16 bp, H. sapiens
ccttctcctgtgatct

SEQ ID NO: 82705 - DNA, 16 bp, H. sapiens
ccttctctaccaaaaa

SEQ ID NO: 82706 - DNA, 16 bp, H. sapiens
ccttctctagattttt

SEQ ID NO: 82707 - DNA, 16 bp, H. sapiens
ccttctctccccagcc

SEQ ID NO: 82708 - DNA, 16 bp, H. sapiens
ccttctctcccccagc

SEQ ID NO: 82709 - DNA, 16 bp, H. sapiens
ccttctctcctccagc

SEQ ID NO: 82710 - DNA, 16 bp, H. sapiens
ccttctctgcctccca

SEQ ID NO: 82711 - DNA, 16 bp, H. sapiens
ccttctctgggcctca

SEQ ID NO: 82712 - DNA, 16 bp, H. sapiens
ccttctctgggccttg

SEQ ID NO: 82713 - DNA, 16 bp, H. sapiens
ccttctctgtgccagg

SEQ ID NO: 82714 - DNA, 16 bp, H. sapiens
ccttctctgtgtcctc

SEQ ID NO: 82715 - DNA, 16 bp, H. sapiens
ccttctcttcctagca

SEQ ID NO: 82716 - DNA, 16 bp, H. sapiens
ccttctgacctttcag

SEQ ID NO: 82717 - DNA, 16 bp, H. sapiens
ccttctgagaccacct

SEQ ID NO: 82718 - DNA, 16 bp, H. sapiens
ccttctgagtacctgg

SEQ ID NO: 82719 - DNA, 16 bp, H. sapiens
ccttctgccacgattg

SEQ ID NO: 82720 - DNA, 16 bp, H. sapiens
ccttctgccatgatgg

SEQ ID NO: 82721 - DNA, 16 bp, H. sapiens
ccttctgccatgattg

SEQ ID NO: 82722 - DNA, 16 bp, H. sapiens
ccttctgccgtgattg

SEQ ID NO: 82723 - DNA, 16 bp, H. sapiens
ccttctgcctgaagga

SEQ ID NO: 82724 - DNA, 16 bp, H. sapiens
ccttctgcctgagtat

SEQ ID NO: 82725 - DNA, 16 bp, H. sapiens
ccttctgccttggctt

SEQ ID NO: 82726 - DNA, 16 bp, H. sapiens
ccttctgcgttggtct

SEQ ID NO: 82727 - DNA, 16 bp, H. sapiens
ccttctgctccagcca

SEQ ID NO: 82728 - DNA, 16 bp, H. sapiens
ccttctggaagctcca

SEQ ID NO: 82729 - DNA, 16 bp, H. sapiens
ccttctggcccctctg

SEQ ID NO: 82730 - DNA, 16 bp, H. sapiens
ccttctgggtagggaa

SEQ ID NO: 82731 - DNA, 16 bp, H. sapiens
ccttctgggttcaagc

SEQ ID NO: 82732 - DNA, 16 bp, H. sapiens
ccttctgggttcgagc

SEQ ID NO: 82733 - DNA, 16 bp, H. sapiens
ccttctgtcatgattg

SEQ ID NO: 82734 - DNA, 16 bp, H. sapiens
ccttctgtctcagcct

SEQ ID NO: 82735 - DNA, 16 bp, H. sapiens
ccttctgtctcctctg

SEQ ID NO: 82736 - DNA, 16 bp, H. sapiens
ccttctgtcttggcct

SEQ ID NO: 82737 - DNA, 16 bp, H. sapiens
ccttctgtttcttcag

SEQ ID NO: 82738 - DNA, 16 bp, H. sapiens
ccttctgtttttaatt

SEQ ID NO: 82739 - DNA, 16 bp, H. sapiens
ccttcttaatctcttc

SEQ ID NO: 82740 - DNA, 16 bp, H. sapiens
ccttcttcacaagatg

SEQ ID NO: 82741 - DNA, 16 bp, H. sapiens
ccttcttccaaaacct

SEQ ID NO: 82742 - DNA, 16 bp, H. sapiens
ccttcttccctgtgtg

SEQ ID NO: 82743 - DNA, 16 bp, H. sapiens
ccttcttctggaagct

SEQ ID NO: 82744 - DNA, 16 bp, H. sapiens
ccttcttctggatacc

SEQ ID NO: 82745 - DNA, 16 bp, H. sapiens
ccttcttctgtattcc

SEQ ID NO: 82746 - DNA, 16 bp, H. sapiens
ccttcttgctggtggg

SEQ ID NO: 82747 - DNA, 16 bp, H. sapiens
ccttcttgctgtgtca

SEQ ID NO: 82748 - DNA, 16 bp, H. sapiens
ccttcttggccaaggg

SEQ ID NO: 82749 - DNA, 16 bp, H. sapiens
ccttctttacaaaaaa

SEQ ID NO: 82750 - DNA, 16 bp, H. sapiens
ccttctttggaaacgg

SEQ ID NO: 82751 - DNA, 16 bp, H. sapiens
ccttctttgtgtctgt

SEQ ID NO: 82752 - DNA, 16 bp, H. sapiens
ccttctttgtgttcat

SEQ ID NO: 82753 - DNA, 16 bp, H. sapiens
ccttcttttgagaaat

SEQ ID NO: 82754 - DNA, 16 bp, H. sapiens
ccttctttttaaaata

SEQ ID NO: 82755 - DNA, 16 bp, H. sapiens
ccttgaaaaagaagaa

SEQ ID NO: 82756 - DNA, 16 bp, H. sapiens
ccttgaaaaggaatga

SEQ ID NO: 82757 - DNA, 16 bp, H. sapiens
ccttgaacccaagagg

SEQ ID NO: 82758 - DNA, 16 bp, H. sapiens
ccttgaagaacattga

SEQ ID NO: 82759 - DNA, 16 bp, H. sapiens
ccttgaattcctgggc

SEQ ID NO: 82760 - DNA, 16 bp, H. sapiens
ccttgacaaagaattt

SEQ ID NO: 82761 - DNA, 16 bp, H. sapiens
ccttgacatgtgggga

SEQ ID NO: 82762 - DNA, 16 bp, H. sapiens
ccttgacccctgcctt

SEQ ID NO: 82763 - DNA, 16 bp, H. sapiens
ccttgacctcacaaag

SEQ ID NO: 82764 - DNA, 16 bp, H. sapiens
ccttgacctcctggcc

SEQ ID NO: 82765 - DNA, 16 bp, H. sapiens
ccttgaccttggactt

SEQ ID NO: 82766 - DNA, 16 bp, H. sapiens
ccttgactcaaaaaaa

SEQ ID NO: 82767 - DNA, 16 bp, H. sapiens
ccttgagaggaatgtg

SEQ ID NO: 82768 - DNA, 16 bp, H. sapiens
ccttgagcagctctgc

SEQ ID NO: 82769 - DNA, 16 bp, H. sapiens
ccttgagccccagatc

SEQ ID NO: 82770 - DNA, 16 bp, H. sapiens
ccttgagccctggagt

SEQ ID NO: 82771 - DNA, 16 bp, H. sapiens
ccttgagcctaggagg

SEQ ID NO: 82772 - DNA, 16 bp, H. sapiens
ccttgagctgtggtgg

SEQ ID NO: 82773 - DNA, 16 bp, H. sapiens
ccttgaggaaatgcct

SEQ ID NO: 82774 - DNA, 16 bp, H. sapiens
ccttgatattggactt

SEQ ID NO: 82775 - DNA, 16 bp, H. sapiens
ccttgatccatcttga

SEQ ID NO: 82776 - DNA, 16 bp, H. sapiens
ccttgatccattttga

SEQ ID NO: 82777 - DNA, 16 bp, H. sapiens
ccttgatcttctgggc

SEQ ID NO: 82778 - DNA, 16 bp, H. sapiens
ccttgatggacactta

SEQ ID NO: 82779 - DNA, 16 bp, H. sapiens
ccttgatggtggcact

SEQ ID NO: 82780 - DNA, 16 bp, H. sapiens
ccttgattcctggacc

SEQ ID NO: 82781 - DNA, 16 bp, H. sapiens
ccttgattttagcctt

SEQ ID NO: 82782 - DNA, 16 bp, H. sapiens
ccttgattttatttta

SEQ ID NO: 82783 - DNA, 16 bp, H. sapiens
ccttgatttttccctt

SEQ ID NO: 82784 - DNA, 16 bp, H. sapiens
ccttgcacatagtagg

SEQ ID NO: 82785 - DNA, 16 bp, H. sapiens
ccttgcaccccaggga

SEQ ID NO: 82786 - DNA, 16 bp, H. sapiens
ccttgcacttcctgag

SEQ ID NO: 82787 - DNA, 16 bp, H. sapiens
ccttgcagaactgtga

SEQ ID NO: 82788 - DNA, 16 bp, H. sapiens
ccttgcagatgtgatt

SEQ ID NO: 82789 - DNA, 16 bp, H. sapiens
ccttgcagcaacatgg

SEQ ID NO: 82790 - DNA, 16 bp, H. sapiens
ccttgcaggctgtaac

SEQ ID NO: 82791 - DNA, 16 bp, H. sapiens
ccttgcagttaggtgt

SEQ ID NO: 82792 - DNA, 20 bp, H. sapiens
ccttgcagtttgatctcaga

SEQ ID NO: 82793 - DNA, 34 bp, H. sapiens
ccttgcagtttgatctcagactgctgtgctagca

SEQ ID NO: 82794 - DNA, 16 bp, H. sapiens
ccttgcatcccatgga

SEQ ID NO: 82795 - DNA, 16 bp, H. sapiens
ccttgcattcctggaa

SEQ ID NO: 82796 - DNA, 16 bp, H. sapiens
ccttgccagcagggac

SEQ ID NO: 82797 - DNA, 16 bp, H. sapiens
ccttgccagggcccca

SEQ ID NO: 82798 - DNA, 16 bp, H. sapiens
ccttgcccagaccaat

SEQ ID NO: 82799 - DNA, 16 bp, H. sapiens
ccttgcccagcccagc

SEQ ID NO: 82800 - DNA, 16 bp, H. sapiens
ccttgcccatggctat

SEQ ID NO: 82801 - DNA, 16 bp, H. sapiens
ccttgcccctctccca

SEQ ID NO: 82802 - DNA, 16 bp, H. sapiens
ccttgccctgtcaccc

SEQ ID NO: 82803 - DNA, 16 bp, H. sapiens
ccttgcccttgccctg

SEQ ID NO: 82804 - DNA, 16 bp, H. sapiens
ccttgccctttccacc

SEQ ID NO: 82805 - DNA, 16 bp, H. sapiens
ccttgccggcttcctt

SEQ ID NO: 82806 - DNA, 16 bp, H. sapiens
ccttgcctgctgccat

SEQ ID NO: 82807 - DNA, 16 bp, H. sapiens
ccttgccttctccagc

SEQ ID NO: 82808 - DNA, 16 bp, H. sapiens
ccttgcgcttcccggg

SEQ ID NO: 82809 - DNA, 16 bp, H. sapiens
ccttgctatgctttag

SEQ ID NO: 82810 - DNA, 16 bp, H. sapiens
ccttgctcccggtatc

SEQ ID NO: 82811 - DNA, 16 bp, H. sapiens
ccttgctcttggactt

SEQ ID NO: 82812 - DNA, 16 bp, H. sapiens
ccttgctgaagttgct

SEQ ID NO: 82813 - DNA, 16 bp, H. sapiens
ccttgctgagggccct

SEQ ID NO: 82814 - DNA, 16 bp, H. sapiens
ccttgctggatgcttc

SEQ ID NO: 82815 - DNA, 16 bp, H. sapiens
ccttgctgtgtgacct

SEQ ID NO: 82816 - DNA, 16 bp, H. sapiens
ccttgcttccccttcg

SEQ ID NO: 82817 - DNA, 16 bp, H. sapiens
ccttgctttcccttca

SEQ ID NO: 82818 - DNA, 16 bp, H. sapiens
ccttgcttttcttcat

SEQ ID NO: 82819 - DNA, 16 bp, H. sapiens
ccttggaaaaactggc

SEQ ID NO: 82820 - DNA, 16 bp, H. sapiens
ccttggaaaagaattt

SEQ ID NO: 82821 - DNA, 23 bp, H. sapiens
ccttggacaatacctggctttcc

SEQ ID NO: 82822 - DNA, 16 bp, H. sapiens
ccttggagaacctgat

SEQ ID NO: 82823 - DNA, 16 bp, H. sapiens
ccttggagaagtggct

SEQ ID NO: 82824 - DNA, 16 bp, H. sapiens
ccttggaggaacaggg

SEQ ID NO: 82825 - DNA, 16 bp, H. sapiens
ccttggaggagaagag

SEQ ID NO: 82826 - DNA, 16 bp, H. sapiens
ccttggcaccaccacc

SEQ ID NO: 82827 - DNA, 16 bp, H. sapiens
ccttggcagcttacat

SEQ ID NO: 82828 - DNA, 16 bp, H. sapiens
ccttggcagcttctat

SEQ ID NO: 82829 - DNA, 16 bp, H. sapiens
ccttggccaagagaag

SEQ ID NO: 82830 - DNA, 16 bp, H. sapiens
ccttggccaggctggt

SEQ ID NO: 82831 - DNA, 16 bp, H. sapiens
ccttggccccccacag

SEQ ID NO: 82832 - DNA, 16 bp, H. sapiens
ccttggcctcccaaat

SEQ ID NO: 82833 - DNA, 16 bp, H. sapiens
ccttggcctcccaatg

SEQ ID NO: 82834 - DNA, 16 bp, H. sapiens
ccttggcctcccagca

SEQ ID NO: 82835 - DNA, 16 bp, H. sapiens
ccttggcctcctagag

SEQ ID NO: 82836 - DNA, 16 bp, H. sapiens
ccttggcctctgaaag

SEQ ID NO: 82837 - DNA, 16 bp, H. sapiens
ccttggcctgtgttct

SEQ ID NO: 82838 - DNA, 16 bp, H. sapiens
ccttggccttgcaaag

SEQ ID NO: 82839 - DNA, 16 bp, H. sapiens
ccttggccttggcctt

SEQ ID NO: 82840 - DNA, 16 bp, H. sapiens
ccttggctcaagagat

SEQ ID NO: 82841 - DNA, 16 bp, H. sapiens
ccttggctgagagaag

SEQ ID NO: 82842 - DNA, 16 bp, H. sapiens
ccttggctggggaagg

SEQ ID NO: 82843 - DNA, 16 bp, H. sapiens
ccttggctgggggagg

SEQ ID NO: 82844 - DNA, 16 bp, H. sapiens
ccttggcttcccacag

SEQ ID NO: 82845 - DNA, 16 bp, H. sapiens
ccttggcttctagatg

SEQ ID NO: 82846 - DNA, 16 bp, H. sapiens
ccttgggaaagtcact

SEQ ID NO: 82847 - DNA, 16 bp, H. sapiens
ccttgggagcccatcc

SEQ ID NO: 82848 - DNA, 16 bp, H. sapiens
ccttgggaggccgagg

SEQ ID NO: 82849 - DNA, 17 bp, H. sapiens
ccttgggatgctgttga

SEQ ID NO: 82850 - DNA, 16 bp, H. sapiens
ccttgggcaaataact

SEQ ID NO: 82851 - DNA, 16 bp, H. sapiens
ccttgggcaagccatt

SEQ ID NO: 82852 - DNA, 16 bp, H. sapiens
ccttgggcaagttact

SEQ ID NO: 82853 - DNA, 16 bp, H. sapiens
ccttgggcagccccac

SEQ ID NO: 82854 - DNA, 16 bp, H. sapiens
ccttgggcatctctgc

SEQ ID NO: 82855 - DNA, 16 bp, H. sapiens
ccttgggccatgcagt

SEQ ID NO: 82856 - DNA, 16 bp, H. sapiens
ccttgggctctgggag

SEQ ID NO: 82857 - DNA, 16 bp, H. sapiens
ccttgggctgtggtgg

SEQ ID NO: 82858 - DNA, 16 bp, H. sapiens
ccttggggaagaggga

SEQ ID NO: 82859 - DNA, 16 bp, H. sapiens
ccttggggagggctgc

SEQ ID NO: 82860 - DNA, 20 bp, H. sapiens
ccttgggtggtcgatgggac

SEQ ID NO: 82861 - DNA, 16 bp, H. sapiens
ccttggtcacctgctc

SEQ ID NO: 82862 - DNA, 16 bp, H. sapiens
ccttggtcccagctac

SEQ ID NO: 82863 - DNA, 16 bp, H. sapiens
ccttggtctccaaaag

SEQ ID NO: 82864 - DNA, 16 bp, H. sapiens
ccttggtgacacagca

SEQ ID NO: 82865 - DNA, 16 bp, H. sapiens
ccttggttcaagggat

SEQ ID NO: 82866 - DNA, 16 bp, H. sapiens
ccttggttgaattctt

SEQ ID NO: 82867 - DNA, 16 bp, H. sapiens
ccttggttgagaacca

SEQ ID NO: 82868 - DNA, 16 bp, H. sapiens
ccttggtttctccatc

SEQ ID NO: 82869 - DNA, 16 bp, H. sapiens
ccttggtttggcttcc

SEQ ID NO: 82870 - DNA, 16 bp, H. sapiens
ccttgtaatataattt

SEQ ID NO: 82871 - DNA, 16 bp, H. sapiens
ccttgtaatttcttct

SEQ ID NO: 82872 - DNA, 16 bp, H. sapiens
ccttgtagaggttttt

SEQ ID NO: 82873 - DNA, 16 bp, H. sapiens
ccttgtagtataattt

SEQ ID NO: 82874 - DNA, 16 bp, H. sapiens
ccttgtagtatagtat

SEQ ID NO: 82875 - DNA, 17 bp, H. sapiens
ccttgtcacccaggctg

SEQ ID NO: 82876 - DNA, 16 bp, H. sapiens
ccttgtcagcatctgt

SEQ ID NO: 82877 - DNA, 27 bp, H. sapiens
ccttgtcagtctccatggaacactccc

SEQ ID NO: 82878 - DNA, 16 bp, H. sapiens
ccttgtcccagcctct

SEQ ID NO: 82879 - DNA, 16 bp, H. sapiens
ccttgtccttcctgag

SEQ ID NO: 82880 - DNA, 16 bp, H. sapiens
ccttgtctcaaaataa

SEQ ID NO: 82881 - DNA, 16 bp, H. sapiens
ccttgtctctgtctct

SEQ ID NO: 82882 - DNA, 16 bp, H. sapiens
ccttgtctgccagttg

SEQ ID NO: 82883 - DNA, 16 bp, H. sapiens
ccttgtctggttttag

SEQ ID NO: 82884 - DNA, 16 bp, H. sapiens
ccttgtctttttccag

SEQ ID NO: 82885 - DNA, 16 bp, H. sapiens
ccttgtgaagaaggtg

SEQ ID NO: 82886 - DNA, 16 bp, H. sapiens
ccttgtgacattcttc

SEQ ID NO: 82887 - DNA, 17 bp, H. sapiens
ccttgtgacccccactc

SEQ ID NO: 82888 - DNA, 16 bp, H. sapiens
ccttgtgaccttgggc

SEQ ID NO: 82889 - DNA, 16 bp, H. sapiens
ccttgtgatctgccca

SEQ ID NO: 82890 - DNA, 16 bp, H. sapiens
ccttgtgatgcacctg

SEQ ID NO: 82891 - DNA, 16 bp, H. sapiens
ccttgtgatgtgtgga

SEQ ID NO: 82892 - DNA, 16 bp, H. sapiens
ccttgtgccttgcctt

SEQ ID NO: 82893 - DNA, 16 bp, H. sapiens
ccttgtgcttcctgag

SEQ ID NO: 82894 - DNA, 16 bp, H. sapiens
ccttgtgtcaaaaaaa

SEQ ID NO: 82895 - DNA, 16 bp, H. sapiens
ccttgtgtcttctgtt

SEQ ID NO: 82896 - DNA, 16 bp, H. sapiens
ccttgttaaccaggat

SEQ ID NO: 82897 - DNA, 16 bp, H. sapiens
ccttgttcaacctcag

SEQ ID NO: 82898 - DNA, 16 bp, H. sapiens
ccttgttgctgtgtcc

SEQ ID NO: 82899 - DNA, 16 bp, H. sapiens
ccttgtttctacaaaa

SEQ ID NO: 82900 - DNA, 16 bp, H. sapiens
ccttgtttgcaaatga

SEQ ID NO: 82901 - DNA, 16 bp, H. sapiens
ccttgttttaacctga

SEQ ID NO: 82902 - DNA, 16 bp, H. sapiens
ccttgtttttgatgat

SEQ ID NO: 82903 - DNA, 16 bp, H. sapiens
cctttaaaaaatattt

SEQ ID NO: 82904 - DNA, 16 bp, H. sapiens
cctttaaaaagaaaca

SEQ ID NO: 82905 - DNA, 16 bp, H. sapiens
cctttaaaaaggccaa

SEQ ID NO: 82906 - DNA, 16 bp, H. sapiens
cctttaaaatgcattt

SEQ ID NO: 82907 - DNA, 16 bp, H. sapiens
cctttaaaatttaaaa

SEQ ID NO: 82908 - DNA, 16 bp, H. sapiens
cctttaagaactgtaa

SEQ ID NO: 82909 - DNA, 16 bp, H. sapiens
cctttaagattttttt

SEQ ID NO: 82910 - DNA, 16 bp, H. sapiens
cctttaagtgttgtaa

SEQ ID NO: 82911 - DNA, 16 bp, H. sapiens
cctttacagaaaatat

SEQ ID NO: 82912 - DNA, 16 bp, H. sapiens
cctttacagatgagga

SEQ ID NO: 82913 - DNA, 16 bp, H. sapiens
cctttagatgatttct

SEQ ID NO: 82914 - DNA, 16 bp, H. sapiens
cctttagcatttctca

SEQ ID NO: 82915 - DNA, 16 bp, H. sapiens
cctttagctagacaca

SEQ ID NO: 82916 - DNA, 16 bp, H. sapiens
cctttagctcaaagga

SEQ ID NO: 82917 - DNA, 16 bp, H. sapiens
cctttagctctgagaa

SEQ ID NO: 82918 - DNA, 16 bp, H. sapiens
cctttataaaaccatc

SEQ ID NO: 82919 - DNA, 16 bp, H. sapiens
cctttataaatgaccc

SEQ ID NO: 82920 - DNA, 16 bp, H. sapiens
cctttataaattatct

SEQ ID NO: 82921 - DNA, 16 bp, H. sapiens
cctttataaattatgc

SEQ ID NO: 82922 - DNA, 16 bp, H. sapiens
cctttatcagacatgt

SEQ ID NO: 82923 - DNA, 16 bp, H. sapiens
cctttatgattaaaac

SEQ ID NO: 82924 - DNA, 16 bp, H. sapiens
cctttattatgttgag

SEQ ID NO: 82925 - DNA, 16 bp, H. sapiens
cctttatttctcagac

SEQ ID NO: 82926 - DNA, 16 bp, H. sapiens
cctttattttgaacct

SEQ ID NO: 82927 - DNA, 16 bp, H. sapiens
cctttatttttaacct

SEQ ID NO: 82928 - DNA, 16 bp, H. sapiens
cctttcacctgcccca

SEQ ID NO: 82929 - DNA, 16 bp, H. sapiens
cctttcactttcaaaa

SEQ ID NO: 82930 - DNA, 16 bp, H. sapiens
cctttcactttccacc

SEQ ID NO: 82931 - DNA, 16 bp, H. sapiens
cctttcagaaattcct

SEQ ID NO: 82932 - DNA, 16 bp, H. sapiens
cctttcagagggtgga

SEQ ID NO: 82933 - DNA, 16 bp, H. sapiens
cctttcatgtgaaatc

SEQ ID NO: 82934 - DNA, 16 bp, H. sapiens
cctttcattttcttaa

SEQ ID NO: 82935 - DNA, 16 bp, H. sapiens
cctttccaaagaaggc

SEQ ID NO: 82936 - DNA, 16 bp, H. sapiens
cctttccaaaggaggc

SEQ ID NO: 82937 - DNA, 16 bp, H. sapiens
cctttccaaatgggag

SEQ ID NO: 82938 - DNA, 16 bp, H. sapiens
cctttccaaatttatg

SEQ ID NO: 82939 - DNA, 16 bp, H. sapiens
cctttccaagggagtg

SEQ ID NO: 82940 - DNA, 16 bp, H. sapiens
cctttccacactgccc

SEQ ID NO: 82941 - DNA, 16 bp, H. sapiens
cctttccatagagcag

SEQ ID NO: 82942 - DNA, 16 bp, H. sapiens
cctttccatgctgtgg

SEQ ID NO: 82943 - DNA, 16 bp, H. sapiens
cctttccattccattt

SEQ ID NO: 82944 - DNA, 16 bp, H. sapiens
cctttccatttcattc

SEQ ID NO: 82945 - DNA, 16 bp, H. sapiens
cctttcccagcctctg

SEQ ID NO: 82946 - DNA, 16 bp, H. sapiens
cctttccccaatgctt

SEQ ID NO: 82947 - DNA, 16 bp, H. sapiens
cctttccccagctcct

SEQ ID NO: 82948 - DNA, 16 bp, H. sapiens
cctttccccattcagt

SEQ ID NO: 82949 - DNA, 16 bp, H. sapiens
cctttcccctttaaat

SEQ ID NO: 82950 - DNA, 16 bp, H. sapiens
cctttccctactttat

SEQ ID NO: 82951 - DNA, 16 bp, H. sapiens
cctttccctcaagtcc

SEQ ID NO: 82952 - DNA, 16 bp, H. sapiens
cctttccctctggctg

SEQ ID NO: 82953 - DNA, 16 bp, H. sapiens
cctttccctgcatttc

SEQ ID NO: 82954 - DNA, 16 bp, H. sapiens
cctttcctagaaagtt

SEQ ID NO: 82955 - DNA, 16 bp, H. sapiens
cctttcctagccaaag

SEQ ID NO: 82956 - DNA, 16 bp, H. sapiens
cctttcctcagtgtgt

SEQ ID NO: 82957 - DNA, 16 bp, H. sapiens
cctttcctgaggaagg

SEQ ID NO: 82958 - DNA, 16 bp, H. sapiens
cctttcctggaaaact

SEQ ID NO: 82959 - DNA, 16 bp, H. sapiens
cctttcctgtaacaga

SEQ ID NO: 82960 - DNA, 16 bp, H. sapiens
cctttcctgtcctgtc

SEQ ID NO: 82961 - DNA, 16 bp, H. sapiens
cctttctagggacatg

SEQ ID NO: 82962 - DNA, 16 bp, H. sapiens
cctttctcctgctgca

SEQ ID NO: 82963 - DNA, 16 bp, H. sapiens
cctttctctgggcctc

SEQ ID NO: 82964 - DNA, 16 bp, H. sapiens
cctttctctggtgcct

SEQ ID NO: 82965 - DNA, 16 bp, H. sapiens
cctttctgaaccaaac

SEQ ID NO: 82966 - DNA, 16 bp, H. sapiens
cctttctgaaggtgga

SEQ ID NO: 82967 - DNA, 16 bp, H. sapiens
cctttctggatggaac

SEQ ID NO: 82968 - DNA, 16 bp, H. sapiens
cctttctgggcttcag

SEQ ID NO: 82969 - DNA, 16 bp, H. sapiens
cctttctgtgcctcag

SEQ ID NO: 82970 - DNA, 16 bp, H. sapiens
cctttctgttgatgtt

SEQ ID NO: 82971 - DNA, 16 bp, H. sapiens
cctttcttccagtttc

SEQ ID NO: 82972 - DNA, 16 bp, H. sapiens
cctttcttctgcttgg

SEQ ID NO: 82973 - DNA, 16 bp, H. sapiens
cctttcttggttttgg

SEQ ID NO: 82974 - DNA, 16 bp, H. sapiens
cctttctttagattca

SEQ ID NO: 82975 - DNA, 16 bp, H. sapiens
cctttctttatctaca

SEQ ID NO: 82976 - DNA, 16 bp, H. sapiens
cctttctttccattca

SEQ ID NO: 82977 - DNA, 16 bp, H. sapiens
cctttctttgtgttat

SEQ ID NO: 82978 - DNA, 16 bp, H. sapiens
cctttgaaaacaggca

SEQ ID NO: 82979 - DNA, 16 bp, H. sapiens
cctttgaatttttgca

SEQ ID NO: 82980 - DNA, 16 bp, H. sapiens
cctttgacccagaaat

SEQ ID NO: 82981 - DNA, 16 bp, H. sapiens
cctttgaccttctcca

SEQ ID NO: 82982 - DNA, 16 bp, H. sapiens
cctttgactccatgcc

SEQ ID NO: 82983 - DNA, 16 bp, H. sapiens
cctttgacttcatgtc

SEQ ID NO: 82984 - DNA, 16 bp, H. sapiens
cctttgagaatctgat

SEQ ID NO: 82985 - DNA, 16 bp, H. sapiens
cctttgagattggctt

SEQ ID NO: 82986 - DNA, 16 bp, H. sapiens
cctttgagcatcatgt

SEQ ID NO: 82987 - DNA, 16 bp, H. sapiens
cctttgagccagatgg

SEQ ID NO: 82988 - DNA, 16 bp, H. sapiens
cctttgagcctgggag

SEQ ID NO: 82989 - DNA, 16 bp, H. sapiens
cctttgagtccaggag

SEQ ID NO: 82990 - DNA, 16 bp, H. sapiens
cctttgagttttaagc

SEQ ID NO: 82991 - DNA, 16 bp, H. sapiens
cctttgatccagcaat

SEQ ID NO: 82992 - DNA, 16 bp, H. sapiens
cctttgatgcacaaaa

SEQ ID NO: 82993 - DNA, 16 bp, H. sapiens
cctttgcagaaaaaaa

SEQ ID NO: 82994 - DNA, 16 bp, H. sapiens
cctttgcagaaaaagt

SEQ ID NO: 82995 - DNA, 16 bp, H. sapiens
cctttgcagcagcccc

SEQ ID NO: 82996 - DNA, 16 bp, H. sapiens
cctttgcagggacctg

SEQ ID NO: 82997 - DNA, 16 bp, H. sapiens
cctttgcatcagcatg

SEQ ID NO: 82998 - DNA, 16 bp, H. sapiens
cctttgcatctgctgt

SEQ ID NO: 82999 - DNA, 16 bp, H. sapiens
cctttgcatcttcata

SEQ ID NO: 83000 - DNA, 16 bp, H. sapiens
cctttgccatctgcca

SEQ ID NO: 83001 - DNA, 16 bp, H. sapiens
cctttgcctattttct

SEQ ID NO: 83002 - DNA, 16 bp, H. sapiens
cctttgcctcctgggc

SEQ ID NO: 83003 - DNA, 16 bp, H. sapiens
cctttgcctctcgggt

SEQ ID NO: 83004 - DNA, 16 bp, H. sapiens
cctttgccttctacca

SEQ ID NO: 83005 - DNA, 16 bp, H. sapiens
cctttgctcattttaa

SEQ ID NO: 83006 - DNA, 16 bp, H. sapiens
cctttgctcattttct

SEQ ID NO: 83007 - DNA, 16 bp, H. sapiens
cctttgctggctttga

SEQ ID NO: 83008 - DNA, 16 bp, H. sapiens
cctttggaagaggaga

SEQ ID NO: 83009 - DNA, 16 bp, H. sapiens
cctttggaagtgtcat

SEQ ID NO: 83010 - DNA, 16 bp, H. sapiens
cctttggaggagaaaa

SEQ ID NO: 83011 - DNA, 16 bp, H. sapiens
cctttggatacatacc

SEQ ID NO: 83012 - DNA, 16 bp, H. sapiens
cctttggatgttaatc

SEQ ID NO: 83013 - DNA, 16 bp, H. sapiens
cctttggccaagaggg

SEQ ID NO: 83014 - DNA, 16 bp, H. sapiens
cctttgggaagctgag

SEQ ID NO: 83015 - DNA, 18 bp, H. sapiens
cctttgggaggccgaggc

SEQ ID NO: 83016 - DNA, 16 bp, H. sapiens
cctttggggagcccag

SEQ ID NO: 83017 - DNA, 16 bp, H. sapiens
cctttggtgaaaaagg

SEQ ID NO: 83018 - DNA, 16 bp, H. sapiens
cctttggtgtctggct

SEQ ID NO: 83019 - DNA, 22 bp, H. sapiens
cctttgtagggacatggatgaa

SEQ ID NO: 83020 - DNA, 16 bp, H. sapiens
cctttgtggaagtcag

SEQ ID NO: 83021 - DNA, 16 bp, H. sapiens
cctttgtgtccacact

SEQ ID NO: 83022 - DNA, 16 bp, H. sapiens
cctttgttaaaaatca

SEQ ID NO: 83023 - DNA, 16 bp, H. sapiens
cctttgttgaaaataa

SEQ ID NO: 83024 - DNA, 16 bp, H. sapiens
cctttgttgaaaatga

SEQ ID NO: 83025 - DNA, 16 bp, H. sapiens
cctttgttggatacat

SEQ ID NO: 83026 - DNA, 16 bp, H. sapiens
cctttgtttagcatat

SEQ ID NO: 83027 - DNA, 16 bp, H. sapiens
cctttgttttggccca

SEQ ID NO: 83028 - DNA, 16 bp, H. sapiens
ccttttaaaaaaatct

SEQ ID NO: 83029 - DNA, 16 bp, H. sapiens
ccttttaaaaaatgtt

SEQ ID NO: 83030 - DNA, 16 bp, H. sapiens
ccttttaaaaacattt

SEQ ID NO: 83031 - DNA, 16 bp, H. sapiens
ccttttaaaactaaat

SEQ ID NO: 83032 - DNA, 16 bp, H. sapiens
ccttttaaaatataaa

SEQ ID NO: 83033 - DNA, 16 bp, H. sapiens
ccttttaaaattgaat

SEQ ID NO: 83034 - DNA, 16 bp, H. sapiens
ccttttacaagaggac

SEQ ID NO: 83035 - DNA, 16 bp, H. sapiens
ccttttagtttttact

SEQ ID NO: 83036 - DNA, 16 bp, H. sapiens
ccttttatagaaaaag

SEQ ID NO: 83037 - DNA, 16 bp, H. sapiens
ccttttatatatacat

SEQ ID NO: 83038 - DNA, 16 bp, H. sapiens
ccttttcaagaaatgg

SEQ ID NO: 83039 - DNA, 16 bp, H. sapiens
ccttttcaataaatag

SEQ ID NO: 83040 - DNA, 16 bp, H. sapiens
ccttttccttctctga

SEQ ID NO: 83041 - DNA, 16 bp, H. sapiens
ccttttctcctccaaa

SEQ ID NO: 83042 - DNA, 16 bp, H. sapiens
ccttttctctctggct

SEQ ID NO: 83043 - DNA, 16 bp, H. sapiens
ccttttctgcatctct

SEQ ID NO: 83044 - DNA, 16 bp, H. sapiens
ccttttctggttttgg

SEQ ID NO: 83045 - DNA, 16 bp, H. sapiens
ccttttcttcacatct

SEQ ID NO: 83046 - DNA, 16 bp, H. sapiens
ccttttgccagagcag

SEQ ID NO: 83047 - DNA, 16 bp, H. sapiens
ccttttggcagagtct

SEQ ID NO: 83048 - DNA, 16 bp, H. sapiens
ccttttggccattgtg

SEQ ID NO: 83049 - DNA, 16 bp, H. sapiens
ccttttgtatctggct

SEQ ID NO: 83050 - DNA, 16 bp, H. sapiens
ccttttgtcttctgcc

SEQ ID NO: 83051 - DNA, 16 bp, H. sapiens
ccttttgtgactggct

SEQ ID NO: 83052 - DNA, 16 bp, H. sapiens
ccttttgtggttccat

SEQ ID NO: 83053 - DNA, 16 bp, H. sapiens
ccttttgtggttttaa

SEQ ID NO: 83054 - DNA, 16 bp, H. sapiens
ccttttgttttaaatg

SEQ ID NO: 83055 - DNA, 16 bp, H. sapiens
ccttttgttttttgag

SEQ ID NO: 83056 - DNA, 16 bp, H. sapiens
cctttttaaaaaaata

SEQ ID NO: 83057 - DNA, 16 bp, H. sapiens
cctttttaaaaaataa

SEQ ID NO: 83058 - DNA, 16 bp, H. sapiens
cctttttaaaaaattg

SEQ ID NO: 83059 - DNA, 16 bp, H. sapiens
cctttttaaagaaaaa

SEQ ID NO: 83060 - DNA, 16 bp, H. sapiens
cctttttaattaaaaa

SEQ ID NO: 83061 - DNA, 16 bp, H. sapiens
cctttttactctgttg

SEQ ID NO: 83062 - DNA, 16 bp, H. sapiens
cctttttattgctgtg

SEQ ID NO: 83063 - DNA, 16 bp, H. sapiens
cctttttcacctctga

SEQ ID NO: 83064 - DNA, 16 bp, H. sapiens
cctttttcattacaca

SEQ ID NO: 83065 - DNA, 16 bp, H. sapiens
cctttttctctagctg

SEQ ID NO: 83066 - DNA, 16 bp, H. sapiens
cctttttctctctcag

SEQ ID NO: 83067 - DNA, 16 bp, H. sapiens
cctttttctggagaac

SEQ ID NO: 83068 - DNA, 16 bp, H. sapiens
cctttttcttctttga

SEQ ID NO: 83069 - DNA, 16 bp, H. sapiens
cctttttctttataaa

SEQ ID NO: 83070 - DNA, 16 bp, H. sapiens
cctttttctttcagtt

SEQ ID NO: 83071 - DNA, 16 bp, H. sapiens
cctttttgacattttc

SEQ ID NO: 83072 - DNA, 16 bp, H. sapiens
cctttttgatttcttc

SEQ ID NO: 83073 - DNA, 16 bp, H. sapiens
cctttttgcccttctg

SEQ ID NO: 83074 - DNA, 16 bp, H. sapiens
cctttttgcctttaaa

SEQ ID NO: 83075 - DNA, 16 bp, H. sapiens
cctttttgttgctgag

SEQ ID NO: 83076 - DNA, 16 bp, H. sapiens
ccttttttaaaaaatt

SEQ ID NO: 83077 - DNA, 16 bp, H. sapiens
cctttttttcctgtta

SEQ ID NO: 83078 - DNA, 16 bp, H. sapiens
cctttttttttgagac

SEQ ID NO: 83079 - DNA, 16 bp, H. sapiens
ccttttttttttgaga

SEQ ID NO: 83080 - DNA, 16 bp, H. sapiens
cgaaaccagcctggcc

SEQ ID NO: 83081 - DNA, 21 bp, H. sapiens
cgaaaccccatctctactgaa

SEQ ID NO: 83082 - DNA, 18 bp, H. sapiens
cgaaaccccgtctctaca

SEQ ID NO: 83083 - DNA, 23 bp, H. sapiens
cgaaaccccgtctctactaaaca

SEQ ID NO: 83084 - DNA, 17 bp, H. sapiens
cgaaaccccgtctctat

SEQ ID NO: 83085 - DNA, 17 bp, H. sapiens
cgaaaccctgtctctac

SEQ ID NO: 83086 - DNA, 19 bp, H. sapiens
cgaaaccctgtctctacca

SEQ ID NO: 83087 - DNA, 22 bp, H. sapiens
cgaaaccctgtctctactagaa

SEQ ID NO: 83088 - DNA, 16 bp, H. sapiens
cgaaacctgtctctac

SEQ ID NO: 83089 - DNA, 16 bp, H. sapiens
cgaacccaccagaaga

SEQ ID NO: 83090 - DNA, 16 bp, H. sapiens
cgaactcatgacctca

SEQ ID NO: 83091 - DNA, 16 bp, H. sapiens
cgaactcatgacctcg

SEQ ID NO: 83092 - DNA, 18 bp, H. sapiens
cgaactcccgacctcaga

SEQ ID NO: 83093 - DNA, 16 bp, H. sapiens
cgaactcctgacatcg

SEQ ID NO: 83094 - DNA, 18 bp, H. sapiens
cgaactcctgacctcaga

SEQ ID NO: 83095 - DNA, 17 bp, H. sapiens
cgaactcctgggctcat

SEQ ID NO: 83096 - DNA, 16 bp, H. sapiens
cgaagacagcaccaag

SEQ ID NO: 83097 - DNA, 16 bp, H. sapiens
cgaagtgctggaatta

SEQ ID NO: 83098 - DNA, 16 bp, H. sapiens
cgaatgttctcactca

SEQ ID NO: 83099 - DNA, 16 bp, H. sapiens
cgacaaagcaagactc

SEQ ID NO: 83100 - DNA, 24 bp, H. sapiens
cgacaaagggctaatatccagaat

SEQ ID NO: 83101 - DNA, 16 bp, H. sapiens
cgacagaatgagactc

SEQ ID NO: 83102 - DNA, 16 bp, H. sapiens
cgacagagactccgtc

SEQ ID NO: 83103 - DNA, 16 bp, H. sapiens
cgacagagcaagacgc

SEQ ID NO: 83104 - DNA, 16 bp, H. sapiens
cgacagagcaagagcc

SEQ ID NO: 83105 - DNA, 16 bp, H. sapiens
cgacagagccagaccc

SEQ ID NO: 83106 - DNA, 16 bp, H. sapiens
cgacagagcgagaccc

SEQ ID NO: 83107 - DNA, 16 bp, H. sapiens
cgacagagcgagactg

SEQ ID NO: 83108 - DNA, 17 bp, H. sapiens
cgacagagtgagactct

SEQ ID NO: 83109 - DNA, 16 bp, H. sapiens
cgacagagtgagactg

SEQ ID NO: 83110 - DNA, 16 bp, H. sapiens
cgacagagtgagattc

SEQ ID NO: 83111 - DNA, 16 bp, H. sapiens
cgacagagtgggactc

SEQ ID NO: 83112 - DNA, 16 bp, H. sapiens
cgacagcctggagcag

SEQ ID NO: 83113 - DNA, 16 bp, H. sapiens
cgacaggaggcagagc

SEQ ID NO: 83114 - DNA, 16 bp, H. sapiens
cgacaggcatgcacca

SEQ ID NO: 83115 - DNA, 17 bp, H. sapiens
cgacaggccccagtgtg

SEQ ID NO: 83116 - DNA, 16 bp, H. sapiens
cgacagggtttcacca

SEQ ID NO: 83117 - DNA, 20 bp, H. sapiens
cgaccagcctggccaacatg

SEQ ID NO: 83118 - DNA, 18 bp, H. sapiens
cgaccatcctggctaaca

SEQ ID NO: 83119 - DNA, 16 bp, H. sapiens
cgaccccacaggcagt

SEQ ID NO: 83120 - DNA, 16 bp, H. sapiens
cgaccgagctggtctc

SEQ ID NO: 83121 - DNA, 25 bp, H. sapiens
cgacctcaggtgatccgcccacctc

SEQ ID NO: 83122 - DNA, 24 bp, H. sapiens
cgacctcaggtgatccgcccgcct

SEQ ID NO: 83123 - DNA, 16 bp, H. sapiens
cgacctcccgggctca

SEQ ID NO: 83124 - DNA, 17 bp, H. sapiens
cgacctcgtgatccgcc

SEQ ID NO: 83125 - DNA, 16 bp, H. sapiens
cgacctgatggagctg

SEQ ID NO: 83126 - DNA, 17 bp, H. sapiens
cgacggagtctcgctct

SEQ ID NO: 83127 - DNA, 17 bp, H. sapiens
cgactactgggtacata

SEQ ID NO: 83128 - DNA, 16 bp, H. sapiens
cgactcactgccacct

SEQ ID NO: 83129 - DNA, 16 bp, H. sapiens
cgactccgtctcaaaa

SEQ ID NO: 83130 - DNA, 16 bp, H. sapiens
cgacttccaggaggaa

SEQ ID NO: 83131 - DNA, 16 bp, H. sapiens
cgagaacacgccactg

SEQ ID NO: 83132 - DNA, 16 bp, H. sapiens
cgagaactttgggagg

SEQ ID NO: 83133 - DNA, 17 bp, H. sapiens
cgagacagggtcttgct

SEQ ID NO: 83134 - DNA, 16 bp, H. sapiens
cgagaccaacctggac

SEQ ID NO: 83135 - DNA, 16 bp, H. sapiens
cgagaccaccctggcc

SEQ ID NO: 83136 - DNA, 16 bp, H. sapiens
cgagaccacgccactg

SEQ ID NO: 83137 - DNA, 16 bp, H. sapiens
cgagaccagccaggcc

SEQ ID NO: 83138 - DNA, 16 bp, H. sapiens
cgagaccagcccagcc

SEQ ID NO: 83139 - DNA, 16 bp, H. sapiens
cgagaccagcccaggc

SEQ ID NO: 83140 - DNA, 16 bp, H. sapiens
cgagaccagcctgatc

SEQ ID NO: 83141 - DNA, 16 bp, H. sapiens
cgagaccagcctgccc

SEQ ID NO: 83142 - DNA, 16 bp, H. sapiens
cgagaccagcctgggt

SEQ ID NO: 83143 - DNA, 16 bp, H. sapiens
cgagaccatcctggac

SEQ ID NO: 83144 - DNA, 16 bp, H. sapiens
cgagaccatcctgggc

SEQ ID NO: 83145 - DNA, 18 bp, H. sapiens
cgagacccccatctctac

SEQ ID NO: 83146 - DNA, 17 bp, H. sapiens
cgagaccctgtctctac

SEQ ID NO: 83147 - DNA, 16 bp, H. sapiens
cgagacggggtttcac

SEQ ID NO: 83148 - DNA, 16 bp, H. sapiens
cgagactccatcccaa

SEQ ID NO: 83149 - DNA, 16 bp, H. sapiens
cgagactccatcttgg

SEQ ID NO: 83150 - DNA, 16 bp, H. sapiens
cgagactctgtccaaa

SEQ ID NO: 83151 - DNA, 16 bp, H. sapiens
cgagactgggtaattt

SEQ ID NO: 83152 - DNA, 16 bp, H. sapiens
cgagaggcagaggcag

SEQ ID NO: 83153 - DNA, 16 bp, H. sapiens
cgagaggccgaggcgg

SEQ ID NO: 83154 - DNA, 16 bp, H. sapiens
cgagaggctgaggcgg

SEQ ID NO: 83155 - DNA, 16 bp, H. sapiens
cgagatcacgcccctg

SEQ ID NO: 83156 - DNA, 16 bp, H. sapiens
cgagccaagatcatgc

SEQ ID NO: 83157 - DNA, 16 bp, H. sapiens
cgagccatcctcccac

SEQ ID NO: 83158 - DNA, 24 bp, H. sapiens
cgagccgagccgagccgagccgag

SEQ ID NO: 83159 - DNA, 16 bp, H. sapiens
cgagctccgcctcccg

SEQ ID NO: 83160 - DNA, 17 bp, H. sapiens
cgagctgagatcacacc

SEQ ID NO: 83161 - DNA, 18 bp, H. sapiens
cgagctgagatcatgcca

SEQ ID NO: 83162 - DNA, 16 bp, H. sapiens
cgaggagctgaatgtt

SEQ ID NO: 83163 - DNA, 16 bp, H. sapiens
cgaggatcacttgagc

SEQ ID NO: 83164 - DNA, 16 bp, H. sapiens
cgaggcagagagagag

SEQ ID NO: 83165 - DNA, 16 bp, H. sapiens
cgaggcaggaagatca

SEQ ID NO: 83166 - DNA, 16 bp, H. sapiens
cgaggcaggaggatcg

SEQ ID NO: 83167 - DNA, 16 bp, H. sapiens
cgaggcaggaggatct

SEQ ID NO: 83168 - DNA, 21 bp, H. sapiens
cgaggcaggcagatcacctgg

SEQ ID NO: 83169 - DNA, 16 bp, H. sapiens
cgaggcaggcagatcg

SEQ ID NO: 83170 - DNA, 16 bp, H. sapiens
cgaggcaggcggattg

SEQ ID NO: 83171 - DNA, 16 bp, H. sapiens
cgaggcaggtgggtca

SEQ ID NO: 83172 - DNA, 16 bp, H. sapiens
cgaggccaggagctgg

SEQ ID NO: 83173 - DNA, 17 bp, H. sapiens
cgaggccatcctggcca

SEQ ID NO: 83174 - DNA, 16 bp, H. sapiens
cgaggccgaggcaggc

SEQ ID NO: 83175 - DNA, 16 bp, H. sapiens
cgaggcctccccagcc

SEQ ID NO: 83176 - DNA, 16 bp, H. sapiens
cgaggcgagtggatca

SEQ ID NO: 83177 - DNA, 16 bp, H. sapiens
cgaggcgggtagatca

SEQ ID NO: 83178 - DNA, 16 bp, H. sapiens
cgaggctgaggcgggc

SEQ ID NO: 83179 - DNA, 16 bp, H. sapiens
cgaggctgaggtggga

SEQ ID NO: 83180 - DNA, 16 bp, H. sapiens
cgaggctggaatgcag

SEQ ID NO: 83181 - DNA, 16 bp, H. sapiens
cgaggctgtggtgagc

SEQ ID NO: 83182 - DNA, 16 bp, H. sapiens
cgagggagggacctgg

SEQ ID NO: 83183 - DNA, 19 bp, H. sapiens
cgaggtcaggagttagaga

SEQ ID NO: 83184 - DNA, 16 bp, H. sapiens
cgaggtcaggagttca

SEQ ID NO: 83185 - DNA, 20 bp, H. sapiens
cgaggtcaggagttcgagat

SEQ ID NO: 83186 - DNA, 16 bp, H. sapiens
cgaggtggctcaggcc

SEQ ID NO: 83187 - DNA, 24 bp, H. sapiens
cgaggtgggcagatcacttgaggc

SEQ ID NO: 83188 - DNA, 16 bp, H. sapiens
cgaggtgggtggatcg

SEQ ID NO: 83189 - DNA, 19 bp, H. sapiens
cgaggtttcaccatgttgg

SEQ ID NO: 83190 - DNA, 16 bp, H. sapiens
cgagtagatgggatta

SEQ ID NO: 83191 - DNA, 16 bp, H. sapiens
cgagtagctgggactt

SEQ ID NO: 83192 - DNA, 16 bp, H. sapiens
cgagtagctggggtta

SEQ ID NO: 83193 - DNA, 16 bp, H. sapiens
cgagtagctggtatta

SEQ ID NO: 83194 - DNA, 16 bp, H. sapiens
cgagtagctgtgatta

SEQ ID NO: 83195 - DNA, 16 bp, H. sapiens
cgagtaggtgggatta

SEQ ID NO: 83196 - DNA, 16 bp, H. sapiens
cgagtagttggaatta

SEQ ID NO: 83197 - DNA, 16 bp, H. sapiens
cgagtctcgctctgtc

SEQ ID NO: 83198 - DNA, 17 bp, H. sapiens
cgagtgagactccatct

SEQ ID NO: 83199 - DNA, 16 bp, H. sapiens
cgagtgctgaggagga

SEQ ID NO: 83200 - DNA, 16 bp, H. sapiens
cgagtgtgagctgaag

SEQ ID NO: 83201 - DNA, 16 bp, H. sapiens
cgagtgtgtgtgtgtg

SEQ ID NO: 83202 - DNA, 16 bp, H. sapiens
cgagttcaagcagttc

SEQ ID NO: 83203 - DNA, 16 bp, H. sapiens
cgagttcaagctattc

SEQ ID NO: 83204 - DNA, 16 bp, H. sapiens
cgagttccgggtgggc

SEQ ID NO: 83205 - DNA, 16 bp, H. sapiens
cgatattgggagtaat

SEQ ID NO: 83206 - DNA, 16 bp, H. sapiens
cgatcaaactactccg

SEQ ID NO: 83207 - DNA, 16 bp, H. sapiens
cgatccacccacctcg

SEQ ID NO: 83208 - DNA, 16 bp, H. sapiens
cgatccacccaccttg

SEQ ID NO: 83209 - DNA, 16 bp, H. sapiens
cgatccacctgcctcg

SEQ ID NO: 83210 - DNA, 17 bp, H. sapiens
cgatccacctgccttgg

SEQ ID NO: 83211 - DNA, 16 bp, H. sapiens
cgatccatccacctca

SEQ ID NO: 83212 - DNA, 16 bp, H. sapiens
cgatcctcccgcctcg

SEQ ID NO: 83213 - DNA, 16 bp, H. sapiens
cgatcctcccgcctct

SEQ ID NO: 83214 - DNA, 16 bp, H. sapiens
cgatcgcaccactgca

SEQ ID NO: 83215 - DNA, 18 bp, H. sapiens
cgatctcggcccactgca

SEQ ID NO: 83216 - DNA, 18 bp, H. sapiens
cgatctcggctcacggca

SEQ ID NO: 83217 - DNA, 16 bp, H. sapiens
cgatctcggctcacta

SEQ ID NO: 83218 - DNA, 20 bp, H. sapiens
cgatctcggctcactgcaat

SEQ ID NO: 83219 - DNA, 19 bp, H. sapiens
cgatctcttgaccttgtga

SEQ ID NO: 83220 - DNA, 16 bp, H. sapiens
cgatctgcccacctca

SEQ ID NO: 83221 - DNA, 16 bp, H. sapiens
cgatctgcccaccttg

SEQ ID NO: 83222 - DNA, 19 bp, H. sapiens
cgatctgcccgcctcggcc

SEQ ID NO: 83223 - DNA, 20 bp, H. sapiens
cgatctgcctgcctcggcct

SEQ ID NO: 83224 - DNA, 16 bp, H. sapiens
cgatctgggctcactg

SEQ ID NO: 83225 - DNA, 18 bp, H. sapiens
cgatcttagctcactgca

SEQ ID NO: 83226 - DNA, 18 bp, H. sapiens
cgatcttggctcgctgca

SEQ ID NO: 83227 - DNA, 16 bp, H. sapiens
cgatgctcctgctctg

SEQ ID NO: 83228 - DNA, 16 bp, H. sapiens
cgatggagcaagactc

SEQ ID NO: 83229 - DNA, 16 bp, H. sapiens
cgatggcggttttgtc

SEQ ID NO: 83230 - DNA, 16 bp, H. sapiens
cgatggctcacacctg

SEQ ID NO: 83231 - DNA, 16 bp, H. sapiens
cgatggctcacgcctg

SEQ ID NO: 83232 - DNA, 17 bp, H. sapiens
cgatgggcatttaggtt

SEQ ID NO: 83233 - DNA, 16 bp, H. sapiens
cgatgggcggctgggc

SEQ ID NO: 83234 - DNA, 18 bp, H. sapiens
cgatgtcagctcactgca

SEQ ID NO: 83235 - DNA, 20 bp, H. sapiens
cgattctcctgcttcagcct

SEQ ID NO: 83236 - DNA, 16 bp, H. sapiens
cgattctccttgcctc

SEQ ID NO: 83237 - DNA, 16 bp, H. sapiens
cgcaaggctgaggcag

SEQ ID NO: 83238 - DNA, 16 bp, H. sapiens
cgcaagtgatcctcct

SEQ ID NO: 83239 - DNA, 16 bp, H. sapiens
cgcaatcgtggctcac

SEQ ID NO: 83240 - DNA, 16 bp, H. sapiens
cgcaatggcacgatct

SEQ ID NO: 83241 - DNA, 16 bp, H. sapiens
cgcacacacacacgca

SEQ ID NO: 83242 - DNA, 16 bp, H. sapiens
cgcacacacacatata

SEQ ID NO: 83243 - DNA, 16 bp, H. sapiens
cgcacacacacatatg

SEQ ID NO: 83244 - DNA, 16 bp, H. sapiens
cgcacacacacatgca

SEQ ID NO: 83245 - DNA, 16 bp, H. sapiens
cgcacacacagacaca

SEQ ID NO: 83246 - DNA, 16 bp, H. sapiens
cgcacacacatgcaca

SEQ ID NO: 83247 - DNA, 16 bp, H. sapiens
cgcacacacgcacaca

SEQ ID NO: 83248 - DNA, 16 bp, H. sapiens
cgcacacacgcacgca

SEQ ID NO: 83249 - DNA, 16 bp, H. sapiens
cgcaccagcatggcac

SEQ ID NO: 83250 - DNA, 16 bp, H. sapiens
cgcaccgtgcgcgagc

SEQ ID NO: 83251 - DNA, 16 bp, H. sapiens
cgcaccgtgtgcgagc

SEQ ID NO: 83252 - DNA, 16 bp, H. sapiens
cgcacctggcctccat

SEQ ID NO: 83253 - DNA, 18 bp, H. sapiens
cgcacctgtaatcccagt

SEQ ID NO: 83254 - DNA, 16 bp, H. sapiens
cgcacctgtagtccca

SEQ ID NO: 83255 - DNA, 16 bp, H. sapiens
cgcactccagcctagg

SEQ ID NO: 83256 - DNA, 16 bp, H. sapiens
cgcactccagcctggg

SEQ ID NO: 83257 - DNA, 16 bp, H. sapiens
cgcactcggagcagcc

SEQ ID NO: 83258 - DNA, 16 bp, H. sapiens
cgcagcctgagcctcc

SEQ ID NO: 83259 - DNA, 16 bp, H. sapiens
cgcagcctgggattcc

SEQ ID NO: 83260 - DNA, 16 bp, H. sapiens
cgcagggacacctgcc

SEQ ID NO: 83261 - DNA, 16 bp, H. sapiens
cgcagggatgcctgcc

SEQ ID NO: 83262 - DNA, 16 bp, H. sapiens
cgcagtgagccaagat

SEQ ID NO: 83263 - DNA, 16 bp, H. sapiens
cgcagtggctcaaacc

SEQ ID NO: 83264 - DNA, 16 bp, H. sapiens
cgcagtggctcacact

SEQ ID NO: 83265 - DNA, 17 bp, H. sapiens
cgcagttgctcatgcct

SEQ ID NO: 83266 - DNA, 16 bp, H. sapiens
cgcagtttcgctcttg

SEQ ID NO: 83267 - DNA, 21 bp, H. sapiens
cgcataaatgtcttcttttga

SEQ ID NO: 83268 - DNA, 16 bp, H. sapiens
cgcatcctccgcctcc

SEQ ID NO: 83269 - DNA, 19 bp, H. sapiens
cgcatctgtagtcccagct

SEQ ID NO: 83270 - DNA, 16 bp, H. sapiens
cgcatgcatgtgtctt

SEQ ID NO: 83271 - DNA, 16 bp, H. sapiens
cgcatgccactgtgcc

SEQ ID NO: 83272 - DNA, 16 bp, H. sapiens
cgcatgttctcaccca

SEQ ID NO: 83273 - DNA, 16 bp, H. sapiens
cgccaagacaatgggg

SEQ ID NO: 83274 - DNA, 16 bp, H. sapiens
cgccacacctggctaa

SEQ ID NO: 83275 - DNA, 16 bp, H. sapiens
cgccacacgcccagct

SEQ ID NO: 83276 - DNA, 18 bp, H. sapiens
cgccacatatctacaact

SEQ ID NO: 83277 - DNA, 16 bp, H. sapiens
cgccaccaagcccggc

SEQ ID NO: 83278 - DNA, 17 bp, H. sapiens
cgccaccacaccctgct

SEQ ID NO: 83279 - DNA, 17 bp, H. sapiens
cgccaccacgcctgact

SEQ ID NO: 83280 - DNA, 16 bp, H. sapiens
cgccaccacgctcagc

SEQ ID NO: 83281 - DNA, 18 bp, H. sapiens
cgccaccatgcccagcta

SEQ ID NO: 83282 - DNA, 16 bp, H. sapiens
cgccaccatgccgggc

SEQ ID NO: 83283 - DNA, 16 bp, H. sapiens
cgccaccgtgcctggc

SEQ ID NO: 83284 - DNA, 16 bp, H. sapiens
cgccacctcccgggtt

SEQ ID NO: 83285 - DNA, 19 bp, H. sapiens
cgccactgcaccccagcct

SEQ ID NO: 83286 - DNA, 16 bp, H. sapiens
cgccactgcacctggc

SEQ ID NO: 83287 - DNA, 16 bp, H. sapiens
cgccactgcactccac

SEQ ID NO: 83288 - DNA, 24 bp, H. sapiens
cgccactgcgcccagctaattttt

SEQ ID NO: 83289 - DNA, 17 bp, H. sapiens
cgccactgtactccagt

SEQ ID NO: 83290 - DNA, 16 bp, H. sapiens
cgccactgtgcccggc

SEQ ID NO: 83291 - DNA, 16 bp, H. sapiens
cgccagcctggagtgc

SEQ ID NO: 83292 - DNA, 16 bp, H. sapiens
cgccagctcatgtcat

SEQ ID NO: 83293 - DNA, 16 bp, H. sapiens
cgccaggctggggtgc

SEQ ID NO: 83294 - DNA, 16 bp, H. sapiens
cgccatcatcatcatc

SEQ ID NO: 83295 - DNA, 16 bp, H. sapiens
cgccatccccatcaag

SEQ ID NO: 83296 - DNA, 16 bp, H. sapiens
cgccatctcggctccc

SEQ ID NO: 83297 - DNA, 16 bp, H. sapiens
cgccatgttggccatg

SEQ ID NO: 83298 - DNA, 16 bp, H. sapiens
cgccattctcatgcct

SEQ ID NO: 83299 - DNA, 16 bp, H. sapiens
cgccattttttaagcc

SEQ ID NO: 83300 - DNA, 16 bp, H. sapiens
cgcccaccacacctgg

SEQ ID NO: 83301 - DNA, 16 bp, H. sapiens
cgcccaccacagcctc

SEQ ID NO: 83302 - DNA, 16 bp, H. sapiens
cgcccacctaggcctc

SEQ ID NO: 83303 - DNA, 16 bp, H. sapiens
cgcccacctggcctcc

SEQ ID NO: 83304 - DNA, 23 bp, H. sapiens
cgcccaccttggcctcccaaagt

SEQ ID NO: 83305 - DNA, 16 bp, H. sapiens
cgcccacgtcggcctc

SEQ ID NO: 83306 - DNA, 16 bp, H. sapiens
cgcccagccaagaata

SEQ ID NO: 83307 - DNA, 16 bp, H. sapiens
cgcccagcctcttctt

SEQ ID NO: 83308 - DNA, 16 bp, H. sapiens
cgcccagcctctttct

SEQ ID NO: 83309 - DNA, 16 bp, H. sapiens
cgcccagcctgatttt

SEQ ID NO: 83310 - DNA, 16 bp, H. sapiens
cgcccagccttttttt

SEQ ID NO: 83311 - DNA, 16 bp, H. sapiens
cgcccagctgattttt

SEQ ID NO: 83312 - DNA, 17 bp, H. sapiens
cgcccagctgatttttt

SEQ ID NO: 83313 - DNA, 16 bp, H. sapiens
cgcccaggccagactg

SEQ ID NO: 83314 - DNA, 16 bp, H. sapiens
cgcccccataatccaa

SEQ ID NO: 83315 - DNA, 16 bp, H. sapiens
cgcccgccactacgcc

SEQ ID NO: 83316 - DNA, 16 bp, H. sapiens
cgcccgcctcggactc

SEQ ID NO: 83317 - DNA, 16 bp, H. sapiens
cgcccggccagctttt

SEQ ID NO: 83318 - DNA, 16 bp, H. sapiens
cgcccggccaggtttt

SEQ ID NO: 83319 - DNA, 16 bp, H. sapiens
cgcccggcctattttt

SEQ ID NO: 83320 - DNA, 16 bp, H. sapiens
cgcccggctaattttc

SEQ ID NO: 83321 - DNA, 16 bp, H. sapiens
cgcccggctaattttt

SEQ ID NO: 83322 - DNA, 17 bp, H. sapiens
cgcccgtagtcccagct

SEQ ID NO: 83323 - DNA, 16 bp, H. sapiens
cgccctgcactccagc

SEQ ID NO: 83324 - DNA, 16 bp, H. sapiens
cgccgaggccgaggag

SEQ ID NO: 83325 - DNA, 16 bp, H. sapiens
cgccggtcccctgggc

SEQ ID NO: 83326 - DNA, 16 bp, H. sapiens
cgcctataaccccagc

SEQ ID NO: 83327 - DNA, 18 bp, H. sapiens
cgcctcagcctcccaaaa

SEQ ID NO: 83328 - DNA, 18 bp, H. sapiens
cgcctcagcctcccaagg

SEQ ID NO: 83329 - DNA, 16 bp, H. sapiens
cgcctcagcctcccac

SEQ ID NO: 83330 - DNA, 16 bp, H. sapiens
cgcctcagcctcctga

SEQ ID NO: 83331 - DNA, 16 bp, H. sapiens
cgcctcagcctctcaa

SEQ ID NO: 83332 - DNA, 16 bp, H. sapiens
cgcctcaggaccctgt

SEQ ID NO: 83333 - DNA, 16 bp, H. sapiens
cgcctccaaaagtgct

SEQ ID NO: 83334 - DNA, 16 bp, H. sapiens
cgcctcccaggttgac

SEQ ID NO: 83335 - DNA, 18 bp, H. sapiens
cgcctcccgggttcatgc

SEQ ID NO: 83336 - DNA, 16 bp, H. sapiens
cgcctcccgggttctc

SEQ ID NO: 83337 - DNA, 16 bp, H. sapiens
cgcctccgtgggctcc

SEQ ID NO: 83338 - DNA, 16 bp, H. sapiens
cgcctcctgagttcac

SEQ ID NO: 83339 - DNA, 16 bp, H. sapiens
cgcctcctgggttcca

SEQ ID NO: 83340 - DNA, 16 bp, H. sapiens
cgcctctcaggctcaa

SEQ ID NO: 83341 - DNA, 21 bp, H. sapiens
cgcctcttcccagccgccatc

SEQ ID NO: 83342 - DNA, 16 bp, H. sapiens
cgcctcttctcctcca

SEQ ID NO: 83343 - DNA, 16 bp, H. sapiens
cgcctgagcccaagag

SEQ ID NO: 83344 - DNA, 16 bp, H. sapiens
cgcctgcactcctcag

SEQ ID NO: 83345 - DNA, 16 bp, H. sapiens
cgcctgcagtctcagc

SEQ ID NO: 83346 - DNA, 17 bp, H. sapiens
cgcctgcctcagcctcc

SEQ ID NO: 83347 - DNA, 16 bp, H. sapiens
cgcctgcctcaggctc

SEQ ID NO: 83348 - DNA, 16 bp, H. sapiens
cgcctgcctcggcctt

SEQ ID NO: 83349 - DNA, 16 bp, H. sapiens
cgcctgcctctgcctc

SEQ ID NO: 83350 - DNA, 16 bp, H. sapiens
cgcctgcctgcctgcc

SEQ ID NO: 83351 - DNA, 16 bp, H. sapiens
cgcctgccttgccctc

SEQ ID NO: 83352 - DNA, 16 bp, H. sapiens
cgcctggccaacatgg

SEQ ID NO: 83353 - DNA, 16 bp, H. sapiens
cgcctggccaggattt

SEQ ID NO: 83354 - DNA, 16 bp, H. sapiens
cgcctggcctacattt

SEQ ID NO: 83355 - DNA, 16 bp, H. sapiens
cgcctggctcagaggg

SEQ ID NO: 83356 - DNA, 16 bp, H. sapiens
cgcctgggcaacatag

SEQ ID NO: 83357 - DNA, 16 bp, H. sapiens
cgcctgggctcaagtg

SEQ ID NO: 83358 - DNA, 17 bp, H. sapiens
cgcctgtaatcccagcg

SEQ ID NO: 83359 - DNA, 17 bp, H. sapiens
cgcctgtaatcccagtg

SEQ ID NO: 83360 - DNA, 16 bp, H. sapiens
cgcctgtaatcctggc

SEQ ID NO: 83361 - DNA, 16 bp, H. sapiens
cgcctgtagtcctagc

SEQ ID NO: 83362 - DNA, 16 bp, H. sapiens
cgcctgtagttgcagc

SEQ ID NO: 83363 - DNA, 16 bp, H. sapiens
cgcctgtgatcccaga

SEQ ID NO: 83364 - DNA, 17 bp, H. sapiens
cgccttccgggttcaag

SEQ ID NO: 83365 - DNA, 19 bp, H. sapiens
cgccttggcctcccaaagc

SEQ ID NO: 83366 - DNA, 19 bp, H. sapiens
cgccttggcctcccaaagt

SEQ ID NO: 83367 - DNA, 16 bp, H. sapiens
cgccttggcctcccag

SEQ ID NO: 83368 - DNA, 17 bp, H. sapiens
cgccttggcctctcaaa

SEQ ID NO: 83369 - DNA, 16 bp, H. sapiens
cgcgagactccatctc

SEQ ID NO: 83370 - DNA, 16 bp, H. sapiens
cgcgaggcggagcttg

SEQ ID NO: 83371 - DNA, 16 bp, H. sapiens
cgcgagttccgggtgg

SEQ ID NO: 83372 - DNA, 16 bp, H. sapiens
cgcgcatcaccatgcc

SEQ ID NO: 83373 - DNA, 16 bp, H. sapiens
cgcgcccggccagctc

SEQ ID NO: 83374 - DNA, 16 bp, H. sapiens
cgcgcccggcccagag

SEQ ID NO: 83375 - DNA, 16 bp, H. sapiens
cgcgcctgtaattcca

SEQ ID NO: 83376 - DNA, 16 bp, H. sapiens
cgcgcgcacgcacaca

SEQ ID NO: 83377 - DNA, 16 bp, H. sapiens
cgcgcgcgcacgcaca

SEQ ID NO: 83378 - DNA, 16 bp, H. sapiens
cgcgcgcgcgcacgca

SEQ ID NO: 83379 - DNA, 16 bp, H. sapiens
cgcgcgcgcgtgtgtg

SEQ ID NO: 83380 - DNA, 16 bp, H. sapiens
cgcggagcttgcagtg

SEQ ID NO: 83381 - DNA, 16 bp, H. sapiens
cgcggggcagggctcc

SEQ ID NO: 83382 - DNA, 17 bp, H. sapiens
cgcggtgcctcatgcct

SEQ ID NO: 83383 - DNA, 17 bp, H. sapiens
cgcggtggcacatgcct

SEQ ID NO: 83384 - DNA, 16 bp, H. sapiens
cgcgtcactgcactcc

SEQ ID NO: 83385 - DNA, 18 bp, H. sapiens
cgcgtgagccaccgcgcc

SEQ ID NO: 83386 - DNA, 16 bp, H. sapiens
cgcgtgcgcacacaca

SEQ ID NO: 83387 - DNA, 16 bp, H. sapiens
cgcgtggctcacgcct

SEQ ID NO: 83388 - DNA, 16 bp, H. sapiens
cgctaaaaatacaaaa

SEQ ID NO: 83389 - DNA, 16 bp, H. sapiens
cgctaccatgcccggc

SEQ ID NO: 83390 - DNA, 16 bp, H. sapiens
cgctcaccactaaggt

SEQ ID NO: 83391 - DNA, 16 bp, H. sapiens
cgctccaaatattcac

SEQ ID NO: 83392 - DNA, 16 bp, H. sapiens
cgctcgctgcaacctc

SEQ ID NO: 83393 - DNA, 16 bp, H. sapiens
cgctctgtcacccaag

SEQ ID NO: 83394 - DNA, 16 bp, H. sapiens
cgctctgtccctcagg

SEQ ID NO: 83395 - DNA, 18 bp, H. sapiens
cgctctgtctcccaggct

SEQ ID NO: 83396 - DNA, 16 bp, H. sapiens
cgctctgtggcccagg

SEQ ID NO: 83397 - DNA, 16 bp, H. sapiens
cgctcttgtctcccag

SEQ ID NO: 83398 - DNA, 16 bp, H. sapiens
cgctgacaggccccag

SEQ ID NO: 83399 - DNA, 16 bp, H. sapiens
cgctgcagcctccacc

SEQ ID NO: 83400 - DNA, 16 bp, H. sapiens
cgctgcagtccagcct

SEQ ID NO: 83401 - DNA, 16 bp, H. sapiens
cgctgccctccagcct

SEQ ID NO: 83402 - DNA, 17 bp, H. sapiens
cgctgcctcagcctcct

SEQ ID NO: 83403 - DNA, 16 bp, H. sapiens
cgctgctgcactccag

SEQ ID NO: 83404 - DNA, 16 bp, H. sapiens
cgctggaatgcagtgg

SEQ ID NO: 83405 - DNA, 16 bp, H. sapiens
cgctggaggtcaggag

SEQ ID NO: 83406 - DNA, 16 bp, H. sapiens
cgctggagtgcagtgg

SEQ ID NO: 83407 - DNA, 16 bp, H. sapiens
cgctggcttcaggagt

SEQ ID NO: 83408 - DNA, 17 bp, H. sapiens
cgctgggcatggtggca

SEQ ID NO: 83409 - DNA, 16 bp, H. sapiens
cgctgggtcccccagc

SEQ ID NO: 83410 - DNA, 16 bp, H. sapiens
cgctggtttctcccca

SEQ ID NO: 83411 - DNA, 16 bp, H. sapiens
cgcttctcaaaagaag

SEQ ID NO: 83412 - DNA, 16 bp, H. sapiens
cgcttgaaccagggag

SEQ ID NO: 83413 - DNA, 16 bp, H. sapiens
cgcttgaacccggcag

SEQ ID NO: 83414 - DNA, 16 bp, H. sapiens
cgcttgaacctagaag

SEQ ID NO: 83415 - DNA, 16 bp, H. sapiens
cgcttgaacctaggag

SEQ ID NO: 83416 - DNA, 16 bp, H. sapiens
cgcttgactccaggag

SEQ ID NO: 83417 - DNA, 16 bp, H. sapiens
cgcttgagccggggag

SEQ ID NO: 83418 - DNA, 16 bp, H. sapiens
cgcttgatcctgggag

SEQ ID NO: 83419 - DNA, 16 bp, H. sapiens
cgcttgcacccaggag

SEQ ID NO: 83420 - DNA, 16 bp, H. sapiens
cgcttggcttttcctc

SEQ ID NO: 83421 - DNA, 16 bp, H. sapiens
cgcttgtaatcccagc

SEQ ID NO: 83422 - DNA, 16 bp, H. sapiens
cgctttctgccatgat

SEQ ID NO: 83423 - DNA, 16 bp, H. sapiens
cggaaggatctcttga

SEQ ID NO: 83424 - DNA, 16 bp, H. sapiens
cggaaggctgaggaag

SEQ ID NO: 83425 - DNA, 16 bp, H. sapiens
cggaaggtcaaggctg

SEQ ID NO: 83426 - DNA, 16 bp, H. sapiens
cggaaggtggagattg

SEQ ID NO: 83427 - DNA, 16 bp, H. sapiens
cggacatggtggtggg

SEQ ID NO: 83428 - DNA, 16 bp, H. sapiens
cggacttacagttcca

SEQ ID NO: 83429 - DNA, 16 bp, H. sapiens
cggacttcccagcctc

SEQ ID NO: 83430 - DNA, 16 bp, H. sapiens
cggagaaaagggaaca

SEQ ID NO: 83431 - DNA, 17 bp, H. sapiens
cggagacagggtttcac

SEQ ID NO: 83432 - DNA, 16 bp, H. sapiens
cggagcagccagccag

SEQ ID NO: 83433 - DNA, 16 bp, H. sapiens
cggaggcagaggtggg

SEQ ID NO: 83434 - DNA, 16 bp, H. sapiens
cggaggccgaggcagg

SEQ ID NO: 83435 - DNA, 16 bp, H. sapiens
cggaggctcacgcctg

SEQ ID NO: 83436 - DNA, 16 bp, H. sapiens
cggaggctgaggcggg

SEQ ID NO: 83437 - DNA, 18 bp, H. sapiens
cggaggttgcagtgaggc

SEQ ID NO: 83438 - DNA, 16 bp, H. sapiens
cggagtctcattttgt

SEQ ID NO: 83439 - DNA, 16 bp, H. sapiens
cggagtctgtctctgt

SEQ ID NO: 83440 - DNA, 16 bp, H. sapiens
cggagtcttgctctat

SEQ ID NO: 83441 - DNA, 16 bp, H. sapiens
cggagtgcagtggtgc

SEQ ID NO: 83442 - DNA, 16 bp, H. sapiens
cggagtttcgctctgt

SEQ ID NO: 83443 - DNA, 19 bp, H. sapiens
cggatcacctgaggtcaga

SEQ ID NO: 83444 - DNA, 24 bp, H. sapiens
cggatcacttgaggtcgggagttc

SEQ ID NO: 83445 - DNA, 40 bp, H. sapiens
cggatctcttggcagaaaccctacaagccagaagagagtg

SEQ ID NO: 83446 - DNA, 16 bp, H. sapiens
cggatggtggtgatgg

SEQ ID NO: 83447 - DNA, 16 bp, H. sapiens
cggatttcccccttgc

SEQ ID NO: 83448 - DNA, 16 bp, H. sapiens
cggcaaccccctttgg

SEQ ID NO: 83449 - DNA, 16 bp, H. sapiens
cggcagcgaggctggg

SEQ ID NO: 83450 - DNA, 16 bp, H. sapiens
cggcagctcatgcctg

SEQ ID NO: 83451 - DNA, 16 bp, H. sapiens
cggcaggagaatcact

SEQ ID NO: 83452 - DNA, 16 bp, H. sapiens
cggcattttgggaggc

SEQ ID NO: 83453 - DNA, 16 bp, H. sapiens
cggccaccttggcctc

SEQ ID NO: 83454 - DNA, 16 bp, H. sapiens
cggccagatgcagtgg

SEQ ID NO: 83455 - DNA, 16 bp, H. sapiens
cggccagatgcggtgg

SEQ ID NO: 83456 - DNA, 16 bp, H. sapiens
cggccagccccagaga

SEQ ID NO: 83457 - DNA, 20 bp, H. sapiens
cggccaggcacggtggctca

SEQ ID NO: 83458 - DNA, 16 bp, H. sapiens
cggccaggtgtggtgg

SEQ ID NO: 83459 - DNA, 16 bp, H. sapiens
cggccctgccaacacc

SEQ ID NO: 83460 - DNA, 16 bp, H. sapiens
cggccctgccagcccc

SEQ ID NO: 83461 - DNA, 16 bp, H. sapiens
cggccctgggcaatga

SEQ ID NO: 83462 - DNA, 16 bp, H. sapiens
cggccgccaggcctgg

SEQ ID NO: 83463 - DNA, 16 bp, H. sapiens
cggccgcccctgctgg

SEQ ID NO: 83464 - DNA, 16 bp, H. sapiens
cggccgggcatggtgg

SEQ ID NO: 83465 - DNA, 16 bp, H. sapiens
cggccgggtgcagtgg

SEQ ID NO: 83466 - DNA, 16 bp, H. sapiens
cggcctcccagtgtgc

SEQ ID NO: 83467 - DNA, 16 bp, H. sapiens
cggcctcggccagccc

SEQ ID NO: 83468 - DNA, 16 bp, H. sapiens
cggcctctgcctcctg

SEQ ID NO: 83469 - DNA, 16 bp, H. sapiens
cggcctgggcaacata

SEQ ID NO: 83470 - DNA, 16 bp, H. sapiens
cggccttctcagtgtt

SEQ ID NO: 83471 - DNA, 16 bp, H. sapiens
cggccttggccttcca

SEQ ID NO: 83472 - DNA, 16 bp, H. sapiens
cggcgcaggcgcagag

SEQ ID NO: 83473 - DNA, 19 bp, H. sapiens
cggcggctcacacctgtaa

SEQ ID NO: 83474 - DNA, 16 bp, H. sapiens
cggcggctcacgcctg

SEQ ID NO: 83475 - DNA, 17 bp, H. sapiens
cggcgtgatctcagctc

SEQ ID NO: 83476 - DNA, 19 bp, H. sapiens
cggctaagttttgtatttt

SEQ ID NO: 83477 - DNA, 19 bp, H. sapiens
cggctacttgggaggctga

SEQ ID NO: 83478 - DNA, 18 bp, H. sapiens
cggctcacacctataatc

SEQ ID NO: 83479 - DNA, 16 bp, H. sapiens
cggctcactgcagcct

SEQ ID NO: 83480 - DNA, 16 bp, H. sapiens
cggctcattgcagcct

SEQ ID NO: 83481 - DNA, 16 bp, H. sapiens
cggctccagctggtcc

SEQ ID NO: 83482 - DNA, 16 bp, H. sapiens
cggctctctgcagcct

SEQ ID NO: 83483 - DNA, 17 bp, H. sapiens
cggctgatttttgtatt

SEQ ID NO: 83484 - DNA, 16 bp, H. sapiens
cggctgcggctgcggc

SEQ ID NO: 83485 - DNA, 16 bp, H. sapiens
cggctggccaggtggg

SEQ ID NO: 83486 - DNA, 16 bp, H. sapiens
cggctgggaggtggag

SEQ ID NO: 83487 - DNA, 16 bp, H. sapiens
cggctgggcacagtga

SEQ ID NO: 83488 - DNA, 20 bp, H. sapiens
cggctgggcacggtggctca

SEQ ID NO: 83489 - DNA, 16 bp, H. sapiens
cggctgggtgaggtgg

SEQ ID NO: 83490 - DNA, 16 bp, H. sapiens
cggctttttgcccgcc

SEQ ID NO: 83491 - DNA, 16 bp, H. sapiens
cgggaactggggctgc

SEQ ID NO: 83492 - DNA, 16 bp, H. sapiens
cgggaagcacaagggg

SEQ ID NO: 83493 - DNA, 16 bp, H. sapiens
cgggaagctgagatgg

SEQ ID NO: 83494 - DNA, 16 bp, H. sapiens
cgggacactgaggcag

SEQ ID NO: 83495 - DNA, 16 bp, H. sapiens
cgggagacagaggcag

SEQ ID NO: 83496 - DNA, 16 bp, H. sapiens
cgggagactgaggcag

SEQ ID NO: 83497 - DNA, 16 bp, H. sapiens
cgggagcctgaggcgg

SEQ ID NO: 83498 - DNA, 18 bp, H. sapiens
cgggaggattgcttgagg

SEQ ID NO: 83499 - DNA, 17 bp, H. sapiens
cgggaggcagagtttgc

SEQ ID NO: 83500 - DNA, 16 bp, H. sapiens
cgggaggccgaggtgg

SEQ ID NO: 83501 - DNA, 16 bp, H. sapiens
cgggaggcggaagctg

SEQ ID NO: 83502 - DNA, 16 bp, H. sapiens
cgggaggcggagctgg

SEQ ID NO: 83503 - DNA, 21 bp, H. sapiens
cgggaggcggaggctgcagtg

SEQ ID NO: 83504 - DNA, 16 bp, H. sapiens
cgggaggctgagatga

SEQ ID NO: 83505 - DNA, 16 bp, H. sapiens
cgggaggctgagctgg

SEQ ID NO: 83506 - DNA, 16 bp, H. sapiens
cgggaggctgaggcac

SEQ ID NO: 83507 - DNA, 18 bp, H. sapiens
cgggaggctgaggcaggg

SEQ ID NO: 83508 - DNA, 16 bp, H. sapiens
cgggaggctgaggcca

SEQ ID NO: 83509 - DNA, 16 bp, H. sapiens
cgggaggctgaggccg

SEQ ID NO: 83510 - DNA, 16 bp, H. sapiens
cgggaggctgaggcct

SEQ ID NO: 83511 - DNA, 16 bp, H. sapiens
cgggaggctgaggctg

SEQ ID NO: 83512 - DNA, 16 bp, H. sapiens
cgggaggctgagtcag

SEQ ID NO: 83513 - DNA, 16 bp, H. sapiens
cgggaggctgatgcag

SEQ ID NO: 83514 - DNA, 16 bp, H. sapiens
cgggaggctgggcagg

SEQ ID NO: 83515 - DNA, 16 bp, H. sapiens
cgggaggtcaagacca

SEQ ID NO: 83516 - DNA, 16 bp, H. sapiens
cgggaggtgaggttgc

SEQ ID NO: 83517 - DNA, 16 bp, H. sapiens
cgggaggtggagactg

SEQ ID NO: 83518 - DNA, 16 bp, H. sapiens
cgggagttcgacacca

SEQ ID NO: 83519 - DNA, 16 bp, H. sapiens
cgggcaaaaagagcca

SEQ ID NO: 83520 - DNA, 17 bp, H. sapiens
cgggcaacatggtgaaa

SEQ ID NO: 83521 - DNA, 16 bp, H. sapiens
cgggcaaggtggcagg

SEQ ID NO: 83522 - DNA, 16 bp, H. sapiens
cgggcacagcagctca

SEQ ID NO: 83523 - DNA, 16 bp, H. sapiens
cgggcaccaccacacc

SEQ ID NO: 83524 - DNA, 16 bp, H. sapiens
cgggcagaggagcccc

SEQ ID NO: 83525 - DNA, 16 bp, H. sapiens
cgggcagcccccagaa

SEQ ID NO: 83526 - DNA, 16 bp, H. sapiens
cgggcatgatggctca

SEQ ID NO: 83527 - DNA, 16 bp, H. sapiens
cgggccactgcactct

SEQ ID NO: 83528 - DNA, 16 bp, H. sapiens
cgggccaggcacagtg

SEQ ID NO: 83529 - DNA, 16 bp, H. sapiens
cgggccctgtgaccac

SEQ ID NO: 83530 - DNA, 16 bp, H. sapiens
cgggcctttggccaca

SEQ ID NO: 83531 - DNA, 16 bp, H. sapiens
cgggcgcctgaagtcc

SEQ ID NO: 83532 - DNA, 16 bp, H. sapiens
cgggcgcgggggctca

SEQ ID NO: 83533 - DNA, 16 bp, H. sapiens
cgggcgcggttgctca

SEQ ID NO: 83534 - DNA, 16 bp, H. sapiens
cgggcggcacaggagc

SEQ ID NO: 83535 - DNA, 16 bp, H. sapiens
cgggcgtgagccaccg

SEQ ID NO: 83536 - DNA, 16 bp, H. sapiens
cgggcgtgctggcagg

SEQ ID NO: 83537 - DNA, 16 bp, H. sapiens
cgggcgtggcagtgtg

SEQ ID NO: 83538 - DNA, 21 bp, H. sapiens
cgggcgtggtggctcatgcct

SEQ ID NO: 83539 - DNA, 17 bp, H. sapiens
cgggctgcaggtcctga

SEQ ID NO: 83540 - DNA, 16 bp, H. sapiens
cggggaccctgggccc

SEQ ID NO: 83541 - DNA, 18 bp, H. sapiens
cggggactgttgtggggt

SEQ ID NO: 83542 - DNA, 16 bp, H. sapiens
cggggaggcagctgag

SEQ ID NO: 83543 - DNA, 16 bp, H. sapiens
cggggaggcctcagga

SEQ ID NO: 83544 - DNA, 16 bp, H. sapiens
cggggaggtggctgag

SEQ ID NO: 83545 - DNA, 16 bp, H. sapiens
cggggatggtggctca

SEQ ID NO: 83546 - DNA, 16 bp, H. sapiens
cggggcagtgcggagc

SEQ ID NO: 83547 - DNA, 16 bp, H. sapiens
cggggccaggtggaga

SEQ ID NO: 83548 - DNA, 17 bp, H. sapiens
cggggccctcatggaga

SEQ ID NO: 83549 - DNA, 16 bp, H. sapiens
cggggcggtggctcac

SEQ ID NO: 83550 - DNA, 16 bp, H. sapiens
cggggctgaggtggga

SEQ ID NO: 83551 - DNA, 16 bp, H. sapiens
cggggctggagtgcaa

SEQ ID NO: 83552 - DNA, 16 bp, H. sapiens
cgggggctcacgcctg

SEQ ID NO: 83553 - DNA, 16 bp, H. sapiens
cgggggctgaggcagg

SEQ ID NO: 83554 - DNA, 16 bp, H. sapiens
cgggggctgtggctca

SEQ ID NO: 83555 - DNA, 16 bp, H. sapiens
cggggggctgaagcag

SEQ ID NO: 83556 - DNA, 16 bp, H. sapiens
cgggggtcaggagtca

SEQ ID NO: 83557 - DNA, 16 bp, H. sapiens
cgggggtctccctatg

SEQ ID NO: 83558 - DNA, 16 bp, H. sapiens
cgggggtttcaccatg

SEQ ID NO: 83559 - DNA, 16 bp, H. sapiens
cgggggtttcactatg

SEQ ID NO: 83560 - DNA, 16 bp, H. sapiens
cggggtcaggggtcag

SEQ ID NO: 83561 - DNA, 16 bp, H. sapiens
cggggtcgcggccagg

SEQ ID NO: 83562 - DNA, 17 bp, H. sapiens
cggggtcttgctctgtc

SEQ ID NO: 83563 - DNA, 16 bp, H. sapiens
cggggtggcggccagg

SEQ ID NO: 83564 - DNA, 17 bp, H. sapiens
cggggtttcaccatatt

SEQ ID NO: 83565 - DNA, 18 bp, H. sapiens
cggggtttcaccatgtca

SEQ ID NO: 83566 - DNA, 19 bp, H. sapiens
cggggtttcaccatgttgc

SEQ ID NO: 83567 - DNA, 23 bp, H. sapiens
cggggtttcaccatgttggccaa

SEQ ID NO: 83568 - DNA, 17 bp, H. sapiens
cggggtttcaccgtatt

SEQ ID NO: 83569 - DNA, 29 bp, H. sapiens
cggggtttcaccgtgttgcccaggctggt

SEQ ID NO: 83570 - DNA, 35 bp, H. sapiens
cggggtttcaccgttttagccgggatggtctcgat

SEQ ID NO: 83571 - DNA, 16 bp, H. sapiens
cggggtttcactatat

SEQ ID NO: 83572 - DNA, 17 bp, H. sapiens
cggggtttcgccatatt

SEQ ID NO: 83573 - DNA, 17 bp, H. sapiens
cggggtttctccatatt

SEQ ID NO: 83574 - DNA, 17 bp, H. sapiens
cggggtttcttcatgtt

SEQ ID NO: 83575 - DNA, 16 bp, H. sapiens
cgggtctcctctgagc

SEQ ID NO: 83576 - DNA, 17 bp, H. sapiens
cgggtgacagagcgaga

SEQ ID NO: 83577 - DNA, 16 bp, H. sapiens
cgggtgagtctcccca

SEQ ID NO: 83578 - DNA, 18 bp, H. sapiens
cgggtgcacagaagtcaa

SEQ ID NO: 83579 - DNA, 16 bp, H. sapiens
cgggtgccatggctca

SEQ ID NO: 83580 - DNA, 16 bp, H. sapiens
cgggtgcccctctggg

SEQ ID NO: 83581 - DNA, 16 bp, H. sapiens
cgggtgccttcccagg

SEQ ID NO: 83582 - DNA, 16 bp, H. sapiens
cgggtgcggtgactca

SEQ ID NO: 83583 - DNA, 18 bp, H. sapiens
cgggtggatcacttgagg

SEQ ID NO: 83584 - DNA, 17 bp, H. sapiens
cgggtgtggtggcacgt

SEQ ID NO: 83585 - DNA, 17 bp, H. sapiens
cgggtgtggtggctcat

SEQ ID NO: 83586 - DNA, 28 bp, H. sapiens
cgggttcaagcgattctcctgcctcagt

SEQ ID NO: 83587 - DNA, 16 bp, H. sapiens
cgggttcaccatgttg

SEQ ID NO: 83588 - DNA, 16 bp, H. sapiens
cggtactttgggaggc

SEQ ID NO: 83589 - DNA, 16 bp, H. sapiens
cggtagctcacgcctg

SEQ ID NO: 83590 - DNA, 16 bp, H. sapiens
cggtaggctgaggcag

SEQ ID NO: 83591 - DNA, 16 bp, H. sapiens
cggtagttcacgcctg

SEQ ID NO: 83592 - DNA, 16 bp, H. sapiens
cggtcaccttcccagc

SEQ ID NO: 83593 - DNA, 16 bp, H. sapiens
cggtccccagagaagc

SEQ ID NO: 83594 - DNA, 16 bp, H. sapiens
cggtcgtggtggctca

SEQ ID NO: 83595 - DNA, 16 bp, H. sapiens
cggtctcctgaccttg

SEQ ID NO: 83596 - DNA, 25 bp, H. sapiens
cggtgaaaccccacctctactaaaa

SEQ ID NO: 83597 - DNA, 19 bp, H. sapiens
cggtgaaaccccatctctg

SEQ ID NO: 83598 - DNA, 20 bp, H. sapiens
cggtgaaaccccgtctctag

SEQ ID NO: 83599 - DNA, 17 bp, H. sapiens
cggtgaaaccctgtctt

SEQ ID NO: 83600 - DNA, 16 bp, H. sapiens
cggtgactcacgcctg

SEQ ID NO: 83601 - DNA, 20 bp, H. sapiens
cggtgactcatgcctgtaat

SEQ ID NO: 83602 - DNA, 16 bp, H. sapiens
cggtgagaccctgtct

SEQ ID NO: 83603 - DNA, 16 bp, H. sapiens
cggtgagtgttacagt

SEQ ID NO: 83604 - DNA, 16 bp, H. sapiens
cggtgatggtggtggt

SEQ ID NO: 83605 - DNA, 16 bp, H. sapiens
cggtgcaagctgttgg

SEQ ID NO: 83606 - DNA, 16 bp, H. sapiens
cggtgcatgcagcccc

SEQ ID NO: 83607 - DNA, 16 bp, H. sapiens
cggtgcctcacacctg

SEQ ID NO: 83608 - DNA, 16 bp, H. sapiens
cggtggctcaagcctg

SEQ ID NO: 83609 - DNA, 27 bp, H. sapiens
cggtggctcacacctataatcccagca

SEQ ID NO: 83610 - DNA, 16 bp, H. sapiens
cggtggctcacacctg

SEQ ID NO: 83611 - DNA, 16 bp, H. sapiens
cggtggctcacacttg

SEQ ID NO: 83612 - DNA, 16 bp, H. sapiens
cggtggctcacatctg

SEQ ID NO: 83613 - DNA, 16 bp, H. sapiens
cggtggctcacccctg

SEQ ID NO: 83614 - DNA, 16 bp, H. sapiens
cggtggctcacgccgg

SEQ ID NO: 83615 - DNA, 16 bp, H. sapiens
cggtggctcacgcctg

SEQ ID NO: 83616 - DNA, 16 bp, H. sapiens
cggtggctcacgcttg

SEQ ID NO: 83617 - DNA, 16 bp, H. sapiens
cggtggctcacgtctg

SEQ ID NO: 83618 - DNA, 16 bp, H. sapiens
cggtggctcactcctg

SEQ ID NO: 83619 - DNA, 16 bp, H. sapiens
cggtggctcactcttg

SEQ ID NO: 83620 - DNA, 16 bp, H. sapiens
cggtggctcacttctg

SEQ ID NO: 83621 - DNA, 19 bp, H. sapiens
cggtggctcaggcctataa

SEQ ID NO: 83622 - DNA, 16 bp, H. sapiens
cggtggctcaggcctg

SEQ ID NO: 83623 - DNA, 20 bp, H. sapiens
cggtggctcatacctgtaat

SEQ ID NO: 83624 - DNA, 16 bp, H. sapiens
cggtggctcatgactg

SEQ ID NO: 83625 - DNA, 16 bp, H. sapiens
cggtggctcatgccta

SEQ ID NO: 83626 - DNA, 16 bp, H. sapiens
cggtggctcatgcctg

SEQ ID NO: 83627 - DNA, 16 bp, H. sapiens
cggtggctcatgcttg

SEQ ID NO: 83628 - DNA, 20 bp, H. sapiens
cggtggctcatgcttgtaat

SEQ ID NO: 83629 - DNA, 16 bp, H. sapiens
cggtggctcccgcctg

SEQ ID NO: 83630 - DNA, 16 bp, H. sapiens
cggtggctcctgcctg

SEQ ID NO: 83631 - DNA, 16 bp, H. sapiens
cggtggctcgcgcctg

SEQ ID NO: 83632 - DNA, 16 bp, H. sapiens
cggtggctcgtgcctg

SEQ ID NO: 83633 - DNA, 16 bp, H. sapiens
cggtggctgcagtgag

SEQ ID NO: 83634 - DNA, 18 bp, H. sapiens
cggtggctggcgcctgta

SEQ ID NO: 83635 - DNA, 16 bp, H. sapiens
cggtggcttacacctg

SEQ ID NO: 83636 - DNA, 16 bp, H. sapiens
cggtggcttacgcctg

SEQ ID NO: 83637 - DNA, 16 bp, H. sapiens
cggtggcttatgcctg

SEQ ID NO: 83638 - DNA, 16 bp, H. sapiens
cggtggtgtgcacctg

SEQ ID NO: 83639 - DNA, 16 bp, H. sapiens
cggtggttcacgcctg

SEQ ID NO: 83640 - DNA, 16 bp, H. sapiens
cggtggttcaggcctg

SEQ ID NO: 83641 - DNA, 16 bp, H. sapiens
cggtggtttgtagttc

SEQ ID NO: 83642 - DNA, 16 bp, H. sapiens
cggtgtctcacgcctg

SEQ ID NO: 83643 - DNA, 16 bp, H. sapiens
cggttcatctcactgg

SEQ ID NO: 83644 - DNA, 18 bp, H. sapiens
cggttgcagtgagccaag

SEQ ID NO: 83645 - DNA, 16 bp, H. sapiens
cggttgctcacgcctg

SEQ ID NO: 83646 - DNA, 16 bp, H. sapiens
cggttgctcatgcctg

SEQ ID NO: 83647 - DNA, 16 bp, H. sapiens
cggtttcctcatctgt

SEQ ID NO: 83648 - DNA, 16 bp, H. sapiens
cgtaaacccaggaggc

SEQ ID NO: 83649 - DNA, 27 bp, H. sapiens
cgtaatccagcatataaacagaaccaa

SEQ ID NO: 83650 - DNA, 16 bp, H. sapiens
cgtaatcccagctact

SEQ ID NO: 83651 - DNA, 17 bp, H. sapiens
cgtaccacattttcttt

SEQ ID NO: 83652 - DNA, 16 bp, H. sapiens
cgtactctagcctggg

SEQ ID NO: 83653 - DNA, 16 bp, H. sapiens
cgtagctgggactaca

SEQ ID NO: 83654 - DNA, 16 bp, H. sapiens
cgtagctgggattaca

SEQ ID NO: 83655 - DNA, 16 bp, H. sapiens
cgtagtcccagctact

SEQ ID NO: 83656 - DNA, 16 bp, H. sapiens
cgtagtggttgtacta

SEQ ID NO: 83657 - DNA, 16 bp, H. sapiens
cgtatacacacacaca

SEQ ID NO: 83658 - DNA, 16 bp, H. sapiens
cgtatatacatatgta

SEQ ID NO: 83659 - DNA, 16 bp, H. sapiens
cgtatccccatcatta

SEQ ID NO: 83660 - DNA, 16 bp, H. sapiens
cgtcaccacatccagc

SEQ ID NO: 83661 - DNA, 16 bp, H. sapiens
cgtcaccaggctggag

SEQ ID NO: 83662 - DNA, 16 bp, H. sapiens
cgtcaccatgcccagc

SEQ ID NO: 83663 - DNA, 16 bp, H. sapiens
cgtcactgcactccag

SEQ ID NO: 83664 - DNA, 16 bp, H. sapiens
cgtcactttcaggtgc

SEQ ID NO: 83665 - DNA, 16 bp, H. sapiens
cgtcagggataagaac

SEQ ID NO: 83666 - DNA, 16 bp, H. sapiens
cgtcatcaccatcatc

SEQ ID NO: 83667 - DNA, 16 bp, H. sapiens
cgtcatccaggctgga

SEQ ID NO: 83668 - DNA, 17 bp, H. sapiens
cgtccacctcggcctcc

SEQ ID NO: 83669 - DNA, 16 bp, H. sapiens
cgtccaggatggagtg

SEQ ID NO: 83670 - DNA, 16 bp, H. sapiens
cgtccaggctggggtg

SEQ ID NO: 83671 - DNA, 16 bp, H. sapiens
cgtcccaaagtgctgg

SEQ ID NO: 83672 - DNA, 16 bp, H. sapiens
cgtcccccagcctgac

SEQ ID NO: 83673 - DNA, 16 bp, H. sapiens
cgtcccccaggctgga

SEQ ID NO: 83674 - DNA, 16 bp, H. sapiens
cgtccctgcactccag

SEQ ID NO: 83675 - DNA, 18 bp, H. sapiens
cgtccctgtctgacagct

SEQ ID NO: 83676 - DNA, 16 bp, H. sapiens
cgtcctcctcggcctc

SEQ ID NO: 83677 - DNA, 16 bp, H. sapiens
cgtcctggctggagtg

SEQ ID NO: 83678 - DNA, 16 bp, H. sapiens
cgtcctgggctgcatg

SEQ ID NO: 83679 - DNA, 16 bp, H. sapiens
cgtctataatcccagc

SEQ ID NO: 83680 - DNA, 16 bp, H. sapiens
cgtctcaaaaacaaag

SEQ ID NO: 83681 - DNA, 16 bp, H. sapiens
cgtctccacccggcag

SEQ ID NO: 83682 - DNA, 16 bp, H. sapiens
cgtctccctctcccca

SEQ ID NO: 83683 - DNA, 16 bp, H. sapiens
cgtctctacaaaatat

SEQ ID NO: 83684 - DNA, 16 bp, H. sapiens
cgtctctactaaacat

SEQ ID NO: 83685 - DNA, 16 bp, H. sapiens
cgtctctactaagaat

SEQ ID NO: 83686 - DNA, 16 bp, H. sapiens
cgtctctactaataat

SEQ ID NO: 83687 - DNA, 16 bp, H. sapiens
cgtctctgcaaaaaaa

SEQ ID NO: 83688 - DNA, 16 bp, H. sapiens
cgtctctgcctggctg

SEQ ID NO: 83689 - DNA, 16 bp, H. sapiens
cgtctgcctcccaggt

SEQ ID NO: 83690 - DNA, 16 bp, H. sapiens
cgtctgtccatccatc

SEQ ID NO: 83691 - DNA, 16 bp, H. sapiens
cgtgaaccaccatgcc

SEQ ID NO: 83692 - DNA, 16 bp, H. sapiens
cgtgaccagcctggct

SEQ ID NO: 83693 - DNA, 16 bp, H. sapiens
cgtgacctcagatgat

SEQ ID NO: 83694 - DNA, 16 bp, H. sapiens
cgtgagaccctgtctc

SEQ ID NO: 83695 - DNA, 16 bp, H. sapiens
cgtgagactccatctc

SEQ ID NO: 83696 - DNA, 20 bp, H. sapiens
cgtgagccaagatcacacca

SEQ ID NO: 83697 - DNA, 16 bp, H. sapiens
cgtgagccacaatgcc

SEQ ID NO: 83698 - DNA, 16 bp, H. sapiens
cgtgagccaccacact

SEQ ID NO: 83699 - DNA, 22 bp, H. sapiens
cgtgagccaccatgcctggccc

SEQ ID NO: 83700 - DNA, 17 bp, H. sapiens
cgtgagccaccgcgcca

SEQ ID NO: 83701 - DNA, 23 bp, H. sapiens
cgtgagccaccgcgcctggcctg

SEQ ID NO: 83702 - DNA, 16 bp, H. sapiens
cgtgagccacggcacc

SEQ ID NO: 83703 - DNA, 16 bp, H. sapiens
cgtgagccatcgcacc

SEQ ID NO: 83704 - DNA, 16 bp, H. sapiens
cgtgagcccaggagtt

SEQ ID NO: 83705 - DNA, 16 bp, H. sapiens
cgtgagccgccgcgcc

SEQ ID NO: 83706 - DNA, 16 bp, H. sapiens
cgtgagcgaccgcacc

SEQ ID NO: 83707 - DNA, 16 bp, H. sapiens
cgtgaggtcaggagtt

SEQ ID NO: 83708 - DNA, 16 bp, H. sapiens
cgtgaggtcgggagtt

SEQ ID NO: 83709 - DNA, 16 bp, H. sapiens
cgtgagtgacacagaa

SEQ ID NO: 83710 - DNA, 21 bp, H. sapiens
cgtgatccacccgcctcagcc

SEQ ID NO: 83711 - DNA, 16 bp, H. sapiens
cgtgatccatcctcct

SEQ ID NO: 83712 - DNA, 16 bp, H. sapiens
cgtgatccgcccacct

SEQ ID NO: 83713 - DNA, 16 bp, H. sapiens
cgtgatccgcctgctt

SEQ ID NO: 83714 - DNA, 16 bp, H. sapiens
cgtgatgttggctcac

SEQ ID NO: 83715 - DNA, 18 bp, H. sapiens
cgtgcaccaccacgcccg

SEQ ID NO: 83716 - DNA, 18 bp, H. sapiens
cgtgcaccaccatgcccg

SEQ ID NO: 83717 - DNA, 16 bp, H. sapiens
cgtgcagcagctgctg

SEQ ID NO: 83718 - DNA, 16 bp, H. sapiens
cgtgccaccacacctg

SEQ ID NO: 83719 - DNA, 16 bp, H. sapiens
cgtgcccaacattgcc

SEQ ID NO: 83720 - DNA, 16 bp, H. sapiens
cgtgcccagcccagcc

SEQ ID NO: 83721 - DNA, 16 bp, H. sapiens
cgtgcccagccttgtt

SEQ ID NO: 83722 - DNA, 16 bp, H. sapiens
cgtgcccggcctctac

SEQ ID NO: 83723 - DNA, 16 bp, H. sapiens
cgtgcccggcctctgt

SEQ ID NO: 83724 - DNA, 19 bp, H. sapiens
cgtgcctatagtcccagct

SEQ ID NO: 83725 - DNA, 16 bp, H. sapiens
cgtgcctggcctccat

SEQ ID NO: 83726 - DNA, 16 bp, H. sapiens
cgtgcctggcctggat

SEQ ID NO: 83727 - DNA, 16 bp, H. sapiens
cgtgcctggccttttt

SEQ ID NO: 83728 - DNA, 17 bp, H. sapiens
cgtgcctgtaatcccaa

SEQ ID NO: 83729 - DNA, 16 bp, H. sapiens
cgtgcctgtaatccta

SEQ ID NO: 83730 - DNA, 16 bp, H. sapiens
cgtgcctgtaattcca

SEQ ID NO: 83731 - DNA, 16 bp, H. sapiens
cgtgcctgtgtcctga

SEQ ID NO: 83732 - DNA, 16 bp, H. sapiens
cgtgcgcgtgtgtgtg

SEQ ID NO: 83733 - DNA, 16 bp, H. sapiens
cgtgcgtgtgcgtgtg

SEQ ID NO: 83734 - DNA, 16 bp, H. sapiens
cgtgcgtgtgtgcgtg

SEQ ID NO: 83735 - DNA, 16 bp, H. sapiens
cgtgctctccctgctg

SEQ ID NO: 83736 - DNA, 27 bp, H. sapiens
cgtgctctctgaaacatgtgctgtgtc

SEQ ID NO: 83737 - DNA, 16 bp, H. sapiens
cgtgctggcagtcctc

SEQ ID NO: 83738 - DNA, 16 bp, H. sapiens
cgtgctggcgggcacc

SEQ ID NO: 83739 - DNA, 16 bp, H. sapiens
cgtggaggctcacgcc

SEQ ID NO: 83740 - DNA, 16 bp, H. sapiens
cgtggatggcggcagg

SEQ ID NO: 83741 - DNA, 16 bp, H. sapiens
cgtggcaaaactccat

SEQ ID NO: 83742 - DNA, 16 bp, H. sapiens
cgtggcagcagacaag

SEQ ID NO: 83743 - DNA, 16 bp, H. sapiens
cgtggcagctcatgcc

SEQ ID NO: 83744 - DNA, 16 bp, H. sapiens
cgtggccaacaagcat

SEQ ID NO: 83745 - DNA, 19 bp, H. sapiens
cgtggctcacacctgtaat

SEQ ID NO: 83746 - DNA, 16 bp, H. sapiens
cgtggctcagcctccc

SEQ ID NO: 83747 - DNA, 16 bp, H. sapiens
cgtggctggagaggcc

SEQ ID NO: 83748 - DNA, 16 bp, H. sapiens
cgtggctggggaggcc

SEQ ID NO: 83749 - DNA, 16 bp, H. sapiens
cgtgggcaacatggtg

SEQ ID NO: 83750 - DNA, 16 bp, H. sapiens
cgtgggccactgtgcc

SEQ ID NO: 83751 - DNA, 16 bp, H. sapiens
cgtgggctcctgtgtg

SEQ ID NO: 83752 - DNA, 16 bp, H. sapiens
cgtgggcttggtgggc

SEQ ID NO: 83753 - DNA, 16 bp, H. sapiens
cgtggtagcaggcgcc

SEQ ID NO: 83754 - DNA, 16 bp, H. sapiens
cgtggtagtgcacacc

SEQ ID NO: 83755 - DNA, 16 bp, H. sapiens
cgtggtctgacacctt

SEQ ID NO: 83756 - DNA, 16 bp, H. sapiens
cgtggtgaaaccctgt

SEQ ID NO: 83757 - DNA, 16 bp, H. sapiens
cgtggtgccacacacc

SEQ ID NO: 83758 - DNA, 16 bp, H. sapiens
cgtggtggagcatgcc

SEQ ID NO: 83759 - DNA, 16 bp, H. sapiens
cgtggtggcacaagcc

SEQ ID NO: 83760 - DNA, 16 bp, H. sapiens
cgtggtggcagtcacc

SEQ ID NO: 83761 - DNA, 16 bp, H. sapiens
cgtggtggccggtgcc

SEQ ID NO: 83762 - DNA, 16 bp, H. sapiens
cgtggtggcgctcacc

SEQ ID NO: 83763 - DNA, 17 bp, H. sapiens
cgtggtggcggtcgcct

SEQ ID NO: 83764 - DNA, 16 bp, H. sapiens
cgtggtggctcacgac

SEQ ID NO: 83765 - DNA, 17 bp, H. sapiens
cgtggtggctcacgcct

SEQ ID NO: 83766 - DNA, 16 bp, H. sapiens
cgtggtggtgcctgcc

SEQ ID NO: 83767 - DNA, 17 bp, H. sapiens
cgtggtggtgcgtgcct

SEQ ID NO: 83768 - DNA, 16 bp, H. sapiens
cgtggtggtggctgcc

SEQ ID NO: 83769 - DNA, 16 bp, H. sapiens
cgtggtggtgggagcc

SEQ ID NO: 83770 - DNA, 16 bp, H. sapiens
cgtggtggtgggcgcc

SEQ ID NO: 83771 - DNA, 17 bp, H. sapiens
cgtggtggttcacacct

SEQ ID NO: 83772 - DNA, 16 bp, H. sapiens
cgtgtatctttataat

SEQ ID NO: 83773 - DNA, 16 bp, H. sapiens
cgtgtctctacaaaaa

SEQ ID NO: 83774 - DNA, 16 bp, H. sapiens
cgtgtgcacgtgtgtg

SEQ ID NO: 83775 - DNA, 16 bp, H. sapiens
cgtgtgccaccacgcc

SEQ ID NO: 83776 - DNA, 18 bp, H. sapiens
cgtgtgccaccacgcctg

SEQ ID NO: 83777 - DNA, 16 bp, H. sapiens
cgtgtgcgcgcacaca

SEQ ID NO: 83778 - DNA, 16 bp, H. sapiens
cgtgtgcgtgtgcgtg

SEQ ID NO: 83779 - DNA, 16 bp, H. sapiens
cgtgtggatgctgctg

SEQ ID NO: 83780 - DNA, 16 bp, H. sapiens
cgtgtggtggtgcacg

SEQ ID NO: 83781 - DNA, 16 bp, H. sapiens
cgtgtgtatgtatgtg

SEQ ID NO: 83782 - DNA, 16 bp, H. sapiens
cgtgtgtgcgtgtgtg

SEQ ID NO: 83783 - DNA, 16 bp, H. sapiens
cgtgtgtgtgcgtgtg

SEQ ID NO: 83784 - DNA, 16 bp, H. sapiens
cgtgtgtgtgtgcgtg

SEQ ID NO: 83785 - DNA, 16 bp, H. sapiens
cgtgtgtgtgtgtgca

SEQ ID NO: 83786 - DNA, 16 bp, H. sapiens
cgtgttcatagcagca

SEQ ID NO: 83787 - DNA, 16 bp, H. sapiens
cgtgttctcactcata

SEQ ID NO: 83788 - DNA, 16 bp, H. sapiens
cgtgttgtctgttggc

SEQ ID NO: 83789 - DNA, 16 bp, H. sapiens
cgtgtttgtggtgatg

SEQ ID NO: 83790 - DNA, 18 bp, H. sapiens
cgttagccaggatggtct

SEQ ID NO: 83791 - DNA, 16 bp, H. sapiens
cgttatgatggagcag

SEQ ID NO: 83792 - DNA, 16 bp, H. sapiens
cgttcctctggaagct

SEQ ID NO: 83793 - DNA, 16 bp, H. sapiens
cgttctcatgctgcta

SEQ ID NO: 83794 - DNA, 16 bp, H. sapiens
cgttctgtcacccagg

SEQ ID NO: 83795 - DNA, 16 bp, H. sapiens
cgttctgttacccagg

SEQ ID NO: 83796 - DNA, 16 bp, H. sapiens
cgttcttcacagaatt

SEQ ID NO: 83797 - DNA, 16 bp, H. sapiens
cgttgcccaggccggt

SEQ ID NO: 83798 - DNA, 16 bp, H. sapiens
cgttggctcatgcctg

SEQ ID NO: 83799 - DNA, 16 bp, H. sapiens
cgttgtggaagacagt

SEQ ID NO: 83800 - DNA, 16 bp, H. sapiens
cgtttgaagccaggag

SEQ ID NO: 83801 - DNA, 16 bp, H. sapiens
cgtttgagctcaggag

SEQ ID NO: 83802 - DNA, 16 bp, H. sapiens
cgttttatagatgagg

SEQ ID NO: 83803 - DNA, 16 bp, H. sapiens
cgttttgctcttgttg

SEQ ID NO: 83804 - DNA, 16 bp, H. sapiens
cgtttttttgagatgg

SEQ ID NO: 83805 - DNA, 16 bp, H. sapiens
ctaaaaactctctata

SEQ ID NO: 83806 - DNA, 16 bp, H. sapiens
ctaaaaagaaacccca

SEQ ID NO: 83807 - DNA, 16 bp, H. sapiens
ctaaaaagaaattatt

SEQ ID NO: 83808 - DNA, 16 bp, H. sapiens
ctaaaaaggggaggaa

SEQ ID NO: 83809 - DNA, 16 bp, H. sapiens
ctaaaaatacaagatt

SEQ ID NO: 83810 - DNA, 16 bp, H. sapiens
ctaaaaatagcaaaat

SEQ ID NO: 83811 - DNA, 16 bp, H. sapiens
ctaaaaatatagaaat

SEQ ID NO: 83812 - DNA, 16 bp, H. sapiens
ctaaaaatattccaaa

SEQ ID NO: 83813 - DNA, 16 bp, H. sapiens
ctaaaaatccaaaaag

SEQ ID NO: 83814 - DNA, 16 bp, H. sapiens
ctaaaaatctcttttt

SEQ ID NO: 83815 - DNA, 16 bp, H. sapiens
ctaaaaatgaaagttt

SEQ ID NO: 83816 - DNA, 16 bp, H. sapiens
ctaaaaatgataattt

SEQ ID NO: 83817 - DNA, 16 bp, H. sapiens
ctaaaaatgcaaaact

SEQ ID NO: 83818 - DNA, 16 bp, H. sapiens
ctaaaaatgtgaaagt

SEQ ID NO: 83819 - DNA, 16 bp, H. sapiens
ctaaaaccaaagctga

SEQ ID NO: 83820 - DNA, 16 bp, H. sapiens
ctaaaaccagacaagg

SEQ ID NO: 83821 - DNA, 16 bp, H. sapiens
ctaaaaccagctgtaa

SEQ ID NO: 83822 - DNA, 16 bp, H. sapiens
ctaaaactatttttaa

SEQ ID NO: 83823 - DNA, 16 bp, H. sapiens
ctaaaacttaaaggat

SEQ ID NO: 83824 - DNA, 16 bp, H. sapiens
ctaaaactttcctaaa

SEQ ID NO: 83825 - DNA, 16 bp, H. sapiens
ctaaaagaaaacctag

SEQ ID NO: 83826 - DNA, 16 bp, H. sapiens
ctaaaagagacaaaga

SEQ ID NO: 83827 - DNA, 16 bp, H. sapiens
ctaaaagagaggattt

SEQ ID NO: 83828 - DNA, 16 bp, H. sapiens
ctaaaagcaaaggaaa

SEQ ID NO: 83829 - DNA, 16 bp, H. sapiens
ctaaaaggaaaattca

SEQ ID NO: 83830 - DNA, 16 bp, H. sapiens
ctaaaaggagccaagg

SEQ ID NO: 83831 - DNA, 16 bp, H. sapiens
ctaaaaggggccaatg

SEQ ID NO: 83832 - DNA, 16 bp, H. sapiens
ctaaaagtagaaaaat

SEQ ID NO: 83833 - DNA, 16 bp, H. sapiens
ctaaaagtattcctta

SEQ ID NO: 83834 - DNA, 16 bp, H. sapiens
ctaaaagtggaattgc

SEQ ID NO: 83835 - DNA, 16 bp, H. sapiens
ctaaaagtttgaaaaa

SEQ ID NO: 83836 - DNA, 16 bp, H. sapiens
ctaaaagttttaaagt

SEQ ID NO: 83837 - DNA, 16 bp, H. sapiens
ctaaaataaaagttta

SEQ ID NO: 83838 - DNA, 16 bp, H. sapiens
ctaaaataaataagca

SEQ ID NO: 83839 - DNA, 16 bp, H. sapiens
ctaaaataactttttt

SEQ ID NO: 83840 - DNA, 16 bp, H. sapiens
ctaaaatacaagaaat

SEQ ID NO: 83841 - DNA, 16 bp, H. sapiens
ctaaaatagttactat

SEQ ID NO: 83842 - DNA, 16 bp, H. sapiens
ctaaaatataagctcc

SEQ ID NO: 83843 - DNA, 16 bp, H. sapiens
ctaaaatatgtaaaga

SEQ ID NO: 83844 - DNA, 16 bp, H. sapiens
ctaaaatatttacttt

SEQ ID NO: 83845 - DNA, 16 bp, H. sapiens
ctaaaatatttgctat

SEQ ID NO: 83846 - DNA, 16 bp, H. sapiens
ctaaaatctgaaatct

SEQ ID NO: 83847 - DNA, 16 bp, H. sapiens
ctaaaatgtataaaat

SEQ ID NO: 83848 - DNA, 16 bp, H. sapiens
ctaaaatgttgagatt

SEQ ID NO: 83849 - DNA, 16 bp, H. sapiens
ctaaaattaaaaagat

SEQ ID NO: 83850 - DNA, 16 bp, H. sapiens
ctaaaattagaaaaat

SEQ ID NO: 83851 - DNA, 16 bp, H. sapiens
ctaaaattcatattga

SEQ ID NO: 83852 - DNA, 16 bp, H. sapiens
ctaaaattcatgttga

SEQ ID NO: 83853 - DNA, 16 bp, H. sapiens
ctaaaattcttatgga

SEQ ID NO: 83854 - DNA, 16 bp, H. sapiens
ctaaacactgctttaa

SEQ ID NO: 83855 - DNA, 16 bp, H. sapiens
ctaaacacttcagcat

SEQ ID NO: 83856 - DNA, 16 bp, H. sapiens
ctaaacatcagagaaa

SEQ ID NO: 83857 - DNA, 21 bp, H. sapiens
ctaaacatggaaaggaacaac

SEQ ID NO: 83858 - DNA, 18 bp, H. sapiens
ctaaaccaggaagaagtc

SEQ ID NO: 83859 - DNA, 16 bp, H. sapiens
ctaaaccattaatgag

SEQ ID NO: 83860 - DNA, 16 bp, H. sapiens
ctaaaccccgtctcta

SEQ ID NO: 83861 - DNA, 16 bp, H. sapiens
ctaaagaaaacatttt

SEQ ID NO: 83862 - DNA, 16 bp, H. sapiens
ctaaagaaaattattt

SEQ ID NO: 83863 - DNA, 16 bp, H. sapiens
ctaaagaaatacctga

SEQ ID NO: 83864 - DNA, 16 bp, H. sapiens
ctaaagaagataaaca

SEQ ID NO: 83865 - DNA, 16 bp, H. sapiens
ctaaagacataagtga

SEQ ID NO: 83866 - DNA, 16 bp, H. sapiens
ctaaagacctgggatt

SEQ ID NO: 83867 - DNA, 16 bp, H. sapiens
ctaaagactcctccaa

SEQ ID NO: 83868 - DNA, 16 bp, H. sapiens
ctaaagagcttttgta

SEQ ID NO: 83869 - DNA, 16 bp, H. sapiens
ctaaagatacaaaatt

SEQ ID NO: 83870 - DNA, 16 bp, H. sapiens
ctaaagcagtgtgtag

SEQ ID NO: 83871 - DNA, 16 bp, H. sapiens
ctaaagcatagcaagg

SEQ ID NO: 83872 - DNA, 16 bp, H. sapiens
ctaaagccagacaaag

SEQ ID NO: 83873 - DNA, 16 bp, H. sapiens
ctaaagctaagaagcc

SEQ ID NO: 83874 - DNA, 16 bp, H. sapiens
ctaaaggaaagtatga

SEQ ID NO: 83875 - DNA, 16 bp, H. sapiens
ctaaaggatgcccaga

SEQ ID NO: 83876 - DNA, 16 bp, H. sapiens
ctaaaggcaggtagcc

SEQ ID NO: 83877 - DNA, 16 bp, H. sapiens
ctaaaggctgggaagt

SEQ ID NO: 83878 - DNA, 16 bp, H. sapiens
ctaaagggaaaagtca

SEQ ID NO: 83879 - DNA, 16 bp, H. sapiens
ctaaaggttggggtgg

SEQ ID NO: 83880 - DNA, 16 bp, H. sapiens
ctaaaggtttgttgat

SEQ ID NO: 83881 - DNA, 16 bp, H. sapiens
ctaaaggtttttctgt

SEQ ID NO: 83882 - DNA, 16 bp, H. sapiens
ctaaagtctattttgt

SEQ ID NO: 83883 - DNA, 16 bp, H. sapiens
ctaaagtgctgggatc

SEQ ID NO: 83884 - DNA, 16 bp, H. sapiens
ctaaagttcaaagttc

SEQ ID NO: 83885 - DNA, 16 bp, H. sapiens
ctaaagtttgaaaacc

SEQ ID NO: 83886 - DNA, 16 bp, H. sapiens
ctaaagtttgttttaa

SEQ ID NO: 83887 - DNA, 16 bp, H. sapiens
ctaaataaacttgaag

SEQ ID NO: 83888 - DNA, 16 bp, H. sapiens
ctaaataatgtataca

SEQ ID NO: 83889 - DNA, 16 bp, H. sapiens
ctaaatacttcagtgt

SEQ ID NO: 83890 - DNA, 16 bp, H. sapiens
ctaaatagatatttct

SEQ ID NO: 83891 - DNA, 16 bp, H. sapiens
ctaaatatacagtcat

SEQ ID NO: 83892 - DNA, 16 bp, H. sapiens
ctaaatatatgtgtat

SEQ ID NO: 83893 - DNA, 16 bp, H. sapiens
ctaaatatccaagttc

SEQ ID NO: 83894 - DNA, 16 bp, H. sapiens
ctaaatatctctcaaa

SEQ ID NO: 83895 - DNA, 16 bp, H. sapiens
ctaaatccaatgacta

SEQ ID NO: 83896 - DNA, 16 bp, H. sapiens
ctaaatccagtgacaa

SEQ ID NO: 83897 - DNA, 16 bp, H. sapiens
ctaaatcttaaaacaa

SEQ ID NO: 83898 - DNA, 16 bp, H. sapiens
ctaaatgaaaatgaaa

SEQ ID NO: 83899 - DNA, 16 bp, H. sapiens
ctaaatgaaaattaaa

SEQ ID NO: 83900 - DNA, 20 bp, H. sapiens
ctaaatgacgagttaatggg

SEQ ID NO: 83901 - DNA, 16 bp, H. sapiens
ctaaatgatgggaaca

SEQ ID NO: 83902 - DNA, 16 bp, H. sapiens
ctaaatgcccaaaaga

SEQ ID NO: 83903 - DNA, 16 bp, H. sapiens
ctaaatgcccatcatt

SEQ ID NO: 83904 - DNA, 16 bp, H. sapiens
ctaaatgcctacatta

SEQ ID NO: 83905 - DNA, 16 bp, H. sapiens
ctaaatggaagacaca

SEQ ID NO: 83906 - DNA, 16 bp, H. sapiens
ctaaatgtccatcagt

SEQ ID NO: 83907 - DNA, 16 bp, H. sapiens
ctaaatgttcatcagt

SEQ ID NO: 83908 - DNA, 16 bp, H. sapiens
ctaaattcagtctttt

SEQ ID NO: 83909 - DNA, 16 bp, H. sapiens
ctaaattggaaagaaa

SEQ ID NO: 83910 - DNA, 16 bp, H. sapiens
ctaaattttgcatttt

SEQ ID NO: 83911 - DNA, 16 bp, H. sapiens
ctaacaagttagcctg

SEQ ID NO: 83912 - DNA, 16 bp, H. sapiens
ctaacacaggagcaga

SEQ ID NO: 83913 - DNA, 16 bp, H. sapiens
ctaacaccaccaccag

SEQ ID NO: 83914 - DNA, 16 bp, H. sapiens
ctaacacccaggctgg

SEQ ID NO: 83915 - DNA, 16 bp, H. sapiens
ctaacactggagttcc

SEQ ID NO: 83916 - DNA, 16 bp, H. sapiens
ctaacagaacaaaaag

SEQ ID NO: 83917 - DNA, 16 bp, H. sapiens
ctaacagacatttata

SEQ ID NO: 83918 - DNA, 16 bp, H. sapiens
ctaacagcacatcaaa

SEQ ID NO: 83919 - DNA, 16 bp, H. sapiens
ctaacatcataattaa

SEQ ID NO: 83920 - DNA, 17 bp, H. sapiens
ctaacatccagaatcta

SEQ ID NO: 83921 - DNA, 16 bp, H. sapiens
ctaacattgaagtctt

SEQ ID NO: 83922 - DNA, 16 bp, H. sapiens
ctaacatttattgaat

SEQ ID NO: 83923 - DNA, 16 bp, H. sapiens
ctaaccagggaagttt

SEQ ID NO: 83924 - DNA, 16 bp, H. sapiens
ctaaccataaaagaaa

SEQ ID NO: 83925 - DNA, 16 bp, H. sapiens
ctaacccaaagcaagg

SEQ ID NO: 83926 - DNA, 16 bp, H. sapiens
ctaacccaatgcaaag

SEQ ID NO: 83927 - DNA, 16 bp, H. sapiens
ctaacccaatgcaagg

SEQ ID NO: 83928 - DNA, 16 bp, H. sapiens
ctaacccccaatgtga

SEQ ID NO: 83929 - DNA, 16 bp, H. sapiens
ctaacctgtaaaatgg

SEQ ID NO: 83930 - DNA, 16 bp, H. sapiens
ctaactcataggcagt

SEQ ID NO: 83931 - DNA, 16 bp, H. sapiens
ctaactgcttcctgct

SEQ ID NO: 83932 - DNA, 16 bp, H. sapiens
ctaactgtgtgacctt

SEQ ID NO: 83933 - DNA, 16 bp, H. sapiens
ctaacttgctgtgtga

SEQ ID NO: 83934 - DNA, 16 bp, H. sapiens
ctaactttaattcttt

SEQ ID NO: 83935 - DNA, 16 bp, H. sapiens
ctaactttgagaggaa

SEQ ID NO: 83936 - DNA, 16 bp, H. sapiens
ctaactttgggagaaa

SEQ ID NO: 83937 - DNA, 16 bp, H. sapiens
ctaacttttgaatttt

SEQ ID NO: 83938 - DNA, 16 bp, H. sapiens
ctaagaaaatatatat

SEQ ID NO: 83939 - DNA, 16 bp, H. sapiens
ctaagaaagaaagaga

SEQ ID NO: 83940 - DNA, 16 bp, H. sapiens
ctaagaaataaagaga

SEQ ID NO: 83941 - DNA, 16 bp, H. sapiens
ctaagaaatctttgcc

SEQ ID NO: 83942 - DNA, 16 bp, H. sapiens
ctaagaacaacaacaa

SEQ ID NO: 83943 - DNA, 16 bp, H. sapiens
ctaagaacataaagta

SEQ ID NO: 83944 - DNA, 16 bp, H. sapiens
ctaagaactggaagaa

SEQ ID NO: 83945 - DNA, 16 bp, H. sapiens
ctaagaaggaagttta

SEQ ID NO: 83946 - DNA, 16 bp, H. sapiens
ctaagaagttctaaac

SEQ ID NO: 83947 - DNA, 16 bp, H. sapiens
ctaagaataattggca

SEQ ID NO: 83948 - DNA, 16 bp, H. sapiens
ctaagacaggaggatc

SEQ ID NO: 83949 - DNA, 16 bp, H. sapiens
ctaagactaggtaatt

SEQ ID NO: 83950 - DNA, 16 bp, H. sapiens
ctaagagaatgaaaag

SEQ ID NO: 83951 - DNA, 16 bp, H. sapiens
ctaagagaatttgtca

SEQ ID NO: 83952 - DNA, 16 bp, H. sapiens
ctaagagaggtgagga

SEQ ID NO: 83953 - DNA, 16 bp, H. sapiens
ctaagagatatctgca

SEQ ID NO: 83954 - DNA, 16 bp, H. sapiens
ctaagaggaaaaaatg

SEQ ID NO: 83955 - DNA, 16 bp, H. sapiens
ctaagatcattaattt

SEQ ID NO: 83956 - DNA, 30 bp, H. sapiens
ctaagatctatatctggtataactattctt

SEQ ID NO: 83957 - DNA, 16 bp, H. sapiens
ctaagatttttgactc

SEQ ID NO: 83958 - DNA, 16 bp, H. sapiens
ctaagcaaattaacag

SEQ ID NO: 83959 - DNA, 16 bp, H. sapiens
ctaagcaatcctccca

SEQ ID NO: 83960 - DNA, 16 bp, H. sapiens
ctaagcaattttcaag

SEQ ID NO: 83961 - DNA, 16 bp, H. sapiens
ctaagcactttacata

SEQ ID NO: 83962 - DNA, 16 bp, H. sapiens
ctaagcactttgggag

SEQ ID NO: 83963 - DNA, 16 bp, H. sapiens
ctaagccactgtgcct

SEQ ID NO: 83964 - DNA, 16 bp, H. sapiens
ctaagccctgcccaca

SEQ ID NO: 83965 - DNA, 16 bp, H. sapiens
ctaagcctagtaccca

SEQ ID NO: 83966 - DNA, 16 bp, H. sapiens
ctaagcctcactttcc

SEQ ID NO: 83967 - DNA, 16 bp, H. sapiens
ctaagcctcccgagta

SEQ ID NO: 83968 - DNA, 16 bp, H. sapiens
ctaagctatgagaaca

SEQ ID NO: 83969 - DNA, 16 bp, H. sapiens
ctaagcttaaaaaaaa

SEQ ID NO: 83970 - DNA, 16 bp, H. sapiens
ctaagcttgtgggagt

SEQ ID NO: 83971 - DNA, 16 bp, H. sapiens
ctaaggagaaaaaaat

SEQ ID NO: 83972 - DNA, 16 bp, H. sapiens
ctaaggaggaggagga

SEQ ID NO: 83973 - DNA, 16 bp, H. sapiens
ctaaggaggctgaagc

SEQ ID NO: 83974 - DNA, 16 bp, H. sapiens
ctaaggcaggaggatc

SEQ ID NO: 83975 - DNA, 16 bp, H. sapiens
ctaaggcagtgtggaa

SEQ ID NO: 83976 - DNA, 16 bp, H. sapiens
ctaaggcccagagagg

SEQ ID NO: 83977 - DNA, 16 bp, H. sapiens
ctaaggctatttataa

SEQ ID NO: 83978 - DNA, 16 bp, H. sapiens
ctaaggctcagaaaag

SEQ ID NO: 83979 - DNA, 16 bp, H. sapiens
ctaaggctcagaaagg

SEQ ID NO: 83980 - DNA, 16 bp, H. sapiens
ctaaggctgggcacag

SEQ ID NO: 83981 - DNA, 16 bp, H. sapiens
ctaagggcaggagaag

SEQ ID NO: 83982 - DNA, 17 bp, H. sapiens
ctaagggtgaaggagaa

SEQ ID NO: 83983 - DNA, 16 bp, H. sapiens
ctaaggtcaggagttc

SEQ ID NO: 83984 - DNA, 16 bp, H. sapiens
ctaaggtgggagaatc

SEQ ID NO: 83985 - DNA, 16 bp, H. sapiens
ctaaggtgggtggatt

SEQ ID NO: 83986 - DNA, 16 bp, H. sapiens
ctaagtaaatggaaag

SEQ ID NO: 83987 - DNA, 16 bp, H. sapiens
ctaagtaatttctttt

SEQ ID NO: 83988 - DNA, 16 bp, H. sapiens
ctaagtacagctaaaa

SEQ ID NO: 83989 - DNA, 16 bp, H. sapiens
ctaagtagctgggatt

SEQ ID NO: 83990 - DNA, 16 bp, H. sapiens
ctaagtgaaaaaagcc

SEQ ID NO: 83991 - DNA, 16 bp, H. sapiens
ctaagtgaagtcactc

SEQ ID NO: 83992 - DNA, 16 bp, H. sapiens
ctaagtgagaaaagcc

SEQ ID NO: 83993 - DNA, 16 bp, H. sapiens
ctaagtgcagtggctc

SEQ ID NO: 83994 - DNA, 16 bp, H. sapiens
ctaagtgctaggatta

SEQ ID NO: 83995 - DNA, 16 bp, H. sapiens
ctaagtgctgggatta

SEQ ID NO: 83996 - DNA, 16 bp, H. sapiens
ctaagtgctttatgtg

SEQ ID NO: 83997 - DNA, 16 bp, H. sapiens
ctaagtgttcaaatga

SEQ ID NO: 83998 - DNA, 16 bp, H. sapiens
ctaagtgttttcattg

SEQ ID NO: 83999 - DNA, 16 bp, H. sapiens
ctaagtttaaaaaaaa

SEQ ID NO: 84000 - DNA, 16 bp, H. sapiens
ctaagtttatttattt

SEQ ID NO: 84001 - DNA, 16 bp, H. sapiens
ctaagtttttaatatt

SEQ ID NO: 84002 - DNA, 16 bp, H. sapiens
ctaataaaatgagtta

SEQ ID NO: 84003 - DNA, 16 bp, H. sapiens
ctaataaagaagaaga

SEQ ID NO: 84004 - DNA, 16 bp, H. sapiens
ctaataaatttttggt

SEQ ID NO: 84005 - DNA, 16 bp, H. sapiens
ctaatacaatgtaaat

SEQ ID NO: 84006 - DNA, 16 bp, H. sapiens
ctaatacagtaaatat

SEQ ID NO: 84007 - DNA, 16 bp, H. sapiens
ctaatacccagaatct

SEQ ID NO: 84008 - DNA, 16 bp, H. sapiens
ctaatactgtattttt

SEQ ID NO: 84009 - DNA, 16 bp, H. sapiens
ctaatagagaagaaaa

SEQ ID NO: 84010 - DNA, 16 bp, H. sapiens
ctaatagcctactatt

SEQ ID NO: 84011 - DNA, 16 bp, H. sapiens
ctaataggtatgtagt

SEQ ID NO: 84012 - DNA, 16 bp, H. sapiens
ctaatataaatgatga

SEQ ID NO: 84013 - DNA, 16 bp, H. sapiens
ctaatatccagaagct

SEQ ID NO: 84014 - DNA, 24 bp, H. sapiens
ctaatatccagaatctacaaagaa

SEQ ID NO: 84015 - DNA, 16 bp, H. sapiens
ctaatattcaacattc

SEQ ID NO: 84016 - DNA, 16 bp, H. sapiens
ctaatattttattgag

SEQ ID NO: 84017 - DNA, 16 bp, H. sapiens
ctaatcacaatagcaa

SEQ ID NO: 84018 - DNA, 16 bp, H. sapiens
ctaatcagctgacttt

SEQ ID NO: 84019 - DNA, 16 bp, H. sapiens
ctaatcagtagttcac

SEQ ID NO: 84020 - DNA, 16 bp, H. sapiens
ctaatcataagaaaac

SEQ ID NO: 84021 - DNA, 16 bp, H. sapiens
ctaatcatcaagaaaa

SEQ ID NO: 84022 - DNA, 16 bp, H. sapiens
ctaatcatgagaaaaa

SEQ ID NO: 84023 - DNA, 17 bp, H. sapiens
ctaatcccagcactttg

SEQ ID NO: 84024 - DNA, 16 bp, H. sapiens
ctaatcccagctacct

SEQ ID NO: 84025 - DNA, 16 bp, H. sapiens
ctaatcccattcatga

SEQ ID NO: 84026 - DNA, 16 bp, H. sapiens
ctaatcccatttatga

SEQ ID NO: 84027 - DNA, 16 bp, H. sapiens
ctaatcctcagaacct

SEQ ID NO: 84028 - DNA, 16 bp, H. sapiens
ctaatctgaaaattca

SEQ ID NO: 84029 - DNA, 16 bp, H. sapiens
ctaatctgaaaatttg

SEQ ID NO: 84030 - DNA, 16 bp, H. sapiens
ctaatctgacaggagg

SEQ ID NO: 84031 - DNA, 16 bp, H. sapiens
ctaatctgcacattgt

SEQ ID NO: 84032 - DNA, 16 bp, H. sapiens
ctaatcttgtagctaa

SEQ ID NO: 84033 - DNA, 16 bp, H. sapiens
ctaatgaagcagaaag

SEQ ID NO: 84034 - DNA, 16 bp, H. sapiens
ctaatgagtgtgaggt

SEQ ID NO: 84035 - DNA, 16 bp, H. sapiens
ctaatgatcatctgaa

SEQ ID NO: 84036 - DNA, 16 bp, H. sapiens
ctaatgcaagataagg

SEQ ID NO: 84037 - DNA, 16 bp, H. sapiens
ctaatgcagtaaattg

SEQ ID NO: 84038 - DNA, 16 bp, H. sapiens
ctaatgcataacaaaa

SEQ ID NO: 84039 - DNA, 16 bp, H. sapiens
ctaatgcctgatgatc

SEQ ID NO: 84040 - DNA, 16 bp, H. sapiens
ctaatgctagccctcc

SEQ ID NO: 84041 - DNA, 16 bp, H. sapiens
ctaatgctgctgctga

SEQ ID NO: 84042 - DNA, 16 bp, H. sapiens
ctaatgggaagtgttt

SEQ ID NO: 84043 - DNA, 16 bp, H. sapiens
ctaatgttaagaaaac

SEQ ID NO: 84044 - DNA, 16 bp, H. sapiens
ctaatgttgagagtgg

SEQ ID NO: 84045 - DNA, 16 bp, H. sapiens
ctaatgttttgtgttt

SEQ ID NO: 84046 - DNA, 17 bp, H. sapiens
ctaattaggactccaca

SEQ ID NO: 84047 - DNA, 16 bp, H. sapiens
ctaattatcaggaaaa

SEQ ID NO: 84048 - DNA, 16 bp, H. sapiens
ctaattcattctatga

SEQ ID NO: 84049 - DNA, 16 bp, H. sapiens
ctaattctatttctct

SEQ ID NO: 84050 - DNA, 16 bp, H. sapiens
ctaattcttttagttg

SEQ ID NO: 84051 - DNA, 16 bp, H. sapiens
ctaattgtgtgaagaa

SEQ ID NO: 84052 - DNA, 16 bp, H. sapiens
ctaatttaaaaatgta

SEQ ID NO: 84053 - DNA, 16 bp, H. sapiens
ctaatttaatgttgtt

SEQ ID NO: 84054 - DNA, 16 bp, H. sapiens
ctaatttacactacca

SEQ ID NO: 84055 - DNA, 16 bp, H. sapiens
ctaatttacagatgag

SEQ ID NO: 84056 - DNA, 16 bp, H. sapiens
ctaatttacattccca

SEQ ID NO: 84057 - DNA, 16 bp, H. sapiens
ctaatttcaaaatgta

SEQ ID NO: 84058 - DNA, 16 bp, H. sapiens
ctaatttcagataaaa

SEQ ID NO: 84059 - DNA, 16 bp, H. sapiens
ctaatttccattgtga

SEQ ID NO: 84060 - DNA, 16 bp, H. sapiens
ctaatttgaatttata

SEQ ID NO: 84061 - DNA, 16 bp, H. sapiens
ctaatttgcattctca

SEQ ID NO: 84062 - DNA, 16 bp, H. sapiens
ctaatttgttaatttt

SEQ ID NO: 84063 - DNA, 16 bp, H. sapiens
ctaattttaaaatgtt

SEQ ID NO: 84064 - DNA, 16 bp, H. sapiens
ctaattttagagcatt

SEQ ID NO: 84065 - DNA, 16 bp, H. sapiens
ctaattttccttttga

SEQ ID NO: 84066 - DNA, 16 bp, H. sapiens
ctaattttgaaataaa

SEQ ID NO: 84067 - DNA, 16 bp, H. sapiens
ctaattttgctttaaa

SEQ ID NO: 84068 - DNA, 16 bp, H. sapiens
ctaattttggattttt

SEQ ID NO: 84069 - DNA, 16 bp, H. sapiens
ctaattttgtatgttt

SEQ ID NO: 84070 - DNA, 16 bp, H. sapiens
ctaattttgttttaaa

SEQ ID NO: 84071 - DNA, 16 bp, H. sapiens
ctaatttttaaaacat

SEQ ID NO: 84072 - DNA, 16 bp, H. sapiens
ctaatttttaatgttt

SEQ ID NO: 84073 - DNA, 16 bp, H. sapiens
ctaatttttatatgtt

SEQ ID NO: 84074 - DNA, 16 bp, H. sapiens
ctaatttttctgcttt

SEQ ID NO: 84075 - DNA, 16 bp, H. sapiens
ctaatttttgaaaaat

SEQ ID NO: 84076 - DNA, 16 bp, H. sapiens
ctaatttttgtaaatt

SEQ ID NO: 84077 - DNA, 16 bp, H. sapiens
ctaatttttgtactgt

SEQ ID NO: 84078 - DNA, 16 bp, H. sapiens
ctaatttttgtattta

SEQ ID NO: 84079 - DNA, 16 bp, H. sapiens
ctaatttttgtgcttt

SEQ ID NO: 84080 - DNA, 16 bp, H. sapiens
ctaattttttaaaaca

SEQ ID NO: 84081 - DNA, 16 bp, H. sapiens
ctaattttttgatgta

SEQ ID NO: 84082 - DNA, 16 bp, H. sapiens
ctaatttttttcaaag

SEQ ID NO: 84083 - DNA, 16 bp, H. sapiens
ctaattttttttaatg

SEQ ID NO: 84084 - DNA, 16 bp, H. sapiens
ctacaaaaaaaacttt

SEQ ID NO: 84085 - DNA, 16 bp, H. sapiens
ctacaaaaaaactgtt

SEQ ID NO: 84086 - DNA, 16 bp, H. sapiens
ctacaaaaaagttttt

SEQ ID NO: 84087 - DNA, 16 bp, H. sapiens
ctacaaaaacaaattt

SEQ ID NO: 84088 - DNA, 16 bp, H. sapiens
ctacaaaaactgaaaa

SEQ ID NO: 84089 - DNA, 16 bp, H. sapiens
ctacaaaaactttaaa

SEQ ID NO: 84090 - DNA, 16 bp, H. sapiens
ctacaaaaagtgaaaa

SEQ ID NO: 84091 - DNA, 16 bp, H. sapiens
ctacaaaaagtttttt

SEQ ID NO: 84092 - DNA, 16 bp, H. sapiens
ctacaaaaatcagctg

SEQ ID NO: 84093 - DNA, 16 bp, H. sapiens
ctacaaaaatttcaaa

SEQ ID NO: 84094 - DNA, 16 bp, H. sapiens
ctacaaaacactgctt

SEQ ID NO: 84095 - DNA, 16 bp, H. sapiens
ctacaaaactgtacag

SEQ ID NO: 84096 - DNA, 16 bp, H. sapiens
ctacaaaagattttaa

SEQ ID NO: 84097 - DNA, 16 bp, H. sapiens
ctacaaacacctctac

SEQ ID NO: 84098 - DNA, 18 bp, H. sapiens
ctacaaaccactgcacaa

SEQ ID NO: 84099 - DNA, 16 bp, H. sapiens
ctacaaacctgtatgg

SEQ ID NO: 84100 - DNA, 16 bp, H. sapiens
ctacaaagaaactgca

SEQ ID NO: 84101 - DNA, 16 bp, H. sapiens
ctacaaagaaattaaa

SEQ ID NO: 84102 - DNA, 16 bp, H. sapiens
ctacaaagaacccaaa

SEQ ID NO: 84103 - DNA, 16 bp, H. sapiens
ctacaaagagaatcaa

SEQ ID NO: 84104 - DNA, 16 bp, H. sapiens
ctacaaagatggggag

SEQ ID NO: 84105 - DNA, 16 bp, H. sapiens
ctacaaagccagtatt

SEQ ID NO: 84106 - DNA, 16 bp, H. sapiens
ctacaaataaatgaga

SEQ ID NO: 84107 - DNA, 16 bp, H. sapiens
ctacaaatagaataaa

SEQ ID NO: 84108 - DNA, 16 bp, H. sapiens
ctacaaattttgataa

SEQ ID NO: 84109 - DNA, 16 bp, H. sapiens
ctacaacaaggatgaa

SEQ ID NO: 84110 - DNA, 16 bp, H. sapiens
ctacaacatggatgaa

SEQ ID NO: 84111 - DNA, 18 bp, H. sapiens
ctacaaccatctgatctt

SEQ ID NO: 84112 - DNA, 16 bp, H. sapiens
ctacaaccatctgatg

SEQ ID NO: 84113 - DNA, 16 bp, H. sapiens
ctacaaccatgtgatc

SEQ ID NO: 84114 - DNA, 16 bp, H. sapiens
ctacaacctccagctc

SEQ ID NO: 84115 - DNA, 16 bp, H. sapiens
ctacaactttgctgaa

SEQ ID NO: 84116 - DNA, 16 bp, H. sapiens
ctacaagaaaattaaa

SEQ ID NO: 84117 - DNA, 16 bp, H. sapiens
ctacaagaaacccatt

SEQ ID NO: 84118 - DNA, 16 bp, H. sapiens
ctacaagaaatgctga

SEQ ID NO: 84119 - DNA, 16 bp, H. sapiens
ctacaagaaccagaat

SEQ ID NO: 84120 - DNA, 16 bp, H. sapiens
ctacaaggaacttaaa

SEQ ID NO: 84121 - DNA, 16 bp, H. sapiens
ctacaatcccaacact

SEQ ID NO: 84122 - DNA, 16 bp, H. sapiens
ctacaatgaacatatg

SEQ ID NO: 84123 - DNA, 16 bp, H. sapiens
ctacaatggcagaatt

SEQ ID NO: 84124 - DNA, 16 bp, H. sapiens
ctacacaccaataaca

SEQ ID NO: 84125 - DNA, 16 bp, H. sapiens
ctacacaccaatatcc

SEQ ID NO: 84126 - DNA, 16 bp, H. sapiens
ctacacagacacacac

SEQ ID NO: 84127 - DNA, 16 bp, H. sapiens
ctacacagcaaaataa

SEQ ID NO: 84128 - DNA, 16 bp, H. sapiens
ctacacattctataca

SEQ ID NO: 84129 - DNA, 16 bp, H. sapiens
ctacaccaccaggacc

SEQ ID NO: 84130 - DNA, 16 bp, H. sapiens
ctacacgccagcctgg

SEQ ID NO: 84131 - DNA, 16 bp, H. sapiens
ctacactccatcctgg

SEQ ID NO: 84132 - DNA, 17 bp, H. sapiens
ctacactgagatgtttg

SEQ ID NO: 84133 - DNA, 16 bp, H. sapiens
ctacagaaaaatcaaa

SEQ ID NO: 84134 - DNA, 16 bp, H. sapiens
ctacagaaaaccatca

SEQ ID NO: 84135 - DNA, 16 bp, H. sapiens
ctacagaaaattaaaa

SEQ ID NO: 84136 - DNA, 16 bp, H. sapiens
ctacagaaaccctaca

SEQ ID NO: 84137 - DNA, 16 bp, H. sapiens
ctacagaacagcaaat

SEQ ID NO: 84138 - DNA, 16 bp, H. sapiens
ctacagaagcaggcag

SEQ ID NO: 84139 - DNA, 16 bp, H. sapiens
ctacagaatgggataa

SEQ ID NO: 84140 - DNA, 16 bp, H. sapiens
ctacagacacacatca

SEQ ID NO: 84141 - DNA, 16 bp, H. sapiens
ctacagacactcaatg

SEQ ID NO: 84142 - DNA, 16 bp, H. sapiens
ctacagacatgcgcca

SEQ ID NO: 84143 - DNA, 16 bp, H. sapiens
ctacagacctgtacag

SEQ ID NO: 84144 - DNA, 16 bp, H. sapiens
ctacagagaaacagaa

SEQ ID NO: 84145 - DNA, 16 bp, H. sapiens
ctacagagaaatcttt

SEQ ID NO: 84146 - DNA, 16 bp, H. sapiens
ctacagagtgagacct

SEQ ID NO: 84147 - DNA, 16 bp, H. sapiens
ctacagatgtgtgtca

SEQ ID NO: 84148 - DNA, 16 bp, H. sapiens
ctacagattcaacata

SEQ ID NO: 84149 - DNA, 16 bp, H. sapiens
ctacagcaaacatcat

SEQ ID NO: 84150 - DNA, 16 bp, H. sapiens
ctacagcactctgtgt

SEQ ID NO: 84151 - DNA, 16 bp, H. sapiens
ctacagcctcctgagt

SEQ ID NO: 84152 - DNA, 16 bp, H. sapiens
ctacagcctgcaggcc

SEQ ID NO: 84153 - DNA, 17 bp, H. sapiens
ctacagcctgggcaaca

SEQ ID NO: 84154 - DNA, 16 bp, H. sapiens
ctacagcctgggcagc

SEQ ID NO: 84155 - DNA, 16 bp, H. sapiens
ctacagccttgacctc

SEQ ID NO: 84156 - DNA, 17 bp, H. sapiens
ctacagctcccagcatg

SEQ ID NO: 84157 - DNA, 16 bp, H. sapiens
ctacagctttctgaat

SEQ ID NO: 84158 - DNA, 16 bp, H. sapiens
ctacaggaaaaaaatc

SEQ ID NO: 84159 - DNA, 16 bp, H. sapiens
ctacaggatgtggaca

SEQ ID NO: 84160 - DNA, 16 bp, H. sapiens
ctacaggcacccatca

SEQ ID NO: 84161 - DNA, 16 bp, H. sapiens
ctacaggcacgcactg

SEQ ID NO: 84162 - DNA, 16 bp, H. sapiens
ctacaggcatacacta

SEQ ID NO: 84163 - DNA, 16 bp, H. sapiens
ctacaggcattcacca

SEQ ID NO: 84164 - DNA, 17 bp, H. sapiens
ctacaggcgcccaccac

SEQ ID NO: 84165 - DNA, 16 bp, H. sapiens
ctacaggcgcctgctg

SEQ ID NO: 84166 - DNA, 16 bp, H. sapiens
ctacaggctgtacaag

SEQ ID NO: 84167 - DNA, 16 bp, H. sapiens
ctacaggggaaaaaaa

SEQ ID NO: 84168 - DNA, 16 bp, H. sapiens
ctacaggtccacacca

SEQ ID NO: 84169 - DNA, 16 bp, H. sapiens
ctacaggtgcccaaca

SEQ ID NO: 84170 - DNA, 16 bp, H. sapiens
ctacaggtgcctgcaa

SEQ ID NO: 84171 - DNA, 16 bp, H. sapiens
ctacaggtgctggaga

SEQ ID NO: 84172 - DNA, 18 bp, H. sapiens
ctacaggtgtgagccact

SEQ ID NO: 84173 - DNA, 16 bp, H. sapiens
ctacaggtgtggacca

SEQ ID NO: 84174 - DNA, 16 bp, H. sapiens
ctacaggtgtttgcca

SEQ ID NO: 84175 - DNA, 16 bp, H. sapiens
ctacaggttcatgcca

SEQ ID NO: 84176 - DNA, 16 bp, H. sapiens
ctacagtccagcctgg

SEQ ID NO: 84177 - DNA, 16 bp, H. sapiens
ctacagtctcagctac

SEQ ID NO: 84178 - DNA, 16 bp, H. sapiens
ctacagtgaacttatt

SEQ ID NO: 84179 - DNA, 16 bp, H. sapiens
ctacagtgagccataa

SEQ ID NO: 84180 - DNA, 16 bp, H. sapiens
ctacagtgagctgtga

SEQ ID NO: 84181 - DNA, 16 bp, H. sapiens
ctacagtgtgctatga

SEQ ID NO: 84182 - DNA, 16 bp, H. sapiens
ctacagttccagctac

SEQ ID NO: 84183 - DNA, 16 bp, H. sapiens
ctacatacttttaaat

SEQ ID NO: 84184 - DNA, 16 bp, H. sapiens
ctacatatacatatat

SEQ ID NO: 84185 - DNA, 16 bp, H. sapiens
ctacatcaagggaaca

SEQ ID NO: 84186 - DNA, 16 bp, H. sapiens
ctacatcagcctcctg

SEQ ID NO: 84187 - DNA, 16 bp, H. sapiens
ctacatccatgtgtac

SEQ ID NO: 84188 - DNA, 16 bp, H. sapiens
ctacatcctgccctgg

SEQ ID NO: 84189 - DNA, 16 bp, H. sapiens
ctacatccttaccaac

SEQ ID NO: 84190 - DNA, 16 bp, H. sapiens
ctacatggtgaaaccc

SEQ ID NO: 84191 - DNA, 17 bp, H. sapiens
ctacatgttctgattgg

SEQ ID NO: 84192 - DNA, 16 bp, H. sapiens
ctacattaggtatttc

SEQ ID NO: 84193 - DNA, 16 bp, H. sapiens
ctacattgaaaatctg

SEQ ID NO: 84194 - DNA, 16 bp, H. sapiens
ctacattttgtttatc

SEQ ID NO: 84195 - DNA, 16 bp, H. sapiens
ctaccaaaaagaaaca

SEQ ID NO: 84196 - DNA, 16 bp, H. sapiens
ctaccaaaaagcagcc

SEQ ID NO: 84197 - DNA, 16 bp, H. sapiens
ctaccaaaaatataca

SEQ ID NO: 84198 - DNA, 16 bp, H. sapiens
ctaccaaatcagaatc

SEQ ID NO: 84199 - DNA, 16 bp, H. sapiens
ctaccaacaatttatg

SEQ ID NO: 84200 - DNA, 17 bp, H. sapiens
ctaccaaccaaaaagag

SEQ ID NO: 84201 - DNA, 16 bp, H. sapiens
ctaccacaccctgcta

SEQ ID NO: 84202 - DNA, 16 bp, H. sapiens
ctaccacacctgtcta

SEQ ID NO: 84203 - DNA, 16 bp, H. sapiens
ctaccacagcctcctg

SEQ ID NO: 84204 - DNA, 16 bp, H. sapiens
ctaccaccatcatcac

SEQ ID NO: 84205 - DNA, 16 bp, H. sapiens
ctaccacctctgcctc

SEQ ID NO: 84206 - DNA, 16 bp, H. sapiens
ctaccacgcccgacta

SEQ ID NO: 84207 - DNA, 16 bp, H. sapiens
ctaccactgatcctga

SEQ ID NO: 84208 - DNA, 16 bp, H. sapiens
ctaccactgccactgc

SEQ ID NO: 84209 - DNA, 16 bp, H. sapiens
ctaccagaaatacaaa

SEQ ID NO: 84210 - DNA, 16 bp, H. sapiens
ctaccagacctgcctt

SEQ ID NO: 84211 - DNA, 16 bp, H. sapiens
ctaccagaggtagaag

SEQ ID NO: 84212 - DNA, 16 bp, H. sapiens
ctaccagcaccttgat

SEQ ID NO: 84213 - DNA, 16 bp, H. sapiens
ctaccaggaggctgag

SEQ ID NO: 84214 - DNA, 16 bp, H. sapiens
ctaccaggttcctccc

SEQ ID NO: 84215 - DNA, 16 bp, H. sapiens
ctaccatatgatccag

SEQ ID NO: 84216 - DNA, 16 bp, H. sapiens
ctaccatcagagtcaa

SEQ ID NO: 84217 - DNA, 17 bp, H. sapiens
ctaccatcagagtgaaa

SEQ ID NO: 84218 - DNA, 16 bp, H. sapiens
ctaccatgcagcccac

SEQ ID NO: 84219 - DNA, 16 bp, H. sapiens
ctaccatgcctggctg

SEQ ID NO: 84220 - DNA, 16 bp, H. sapiens
ctaccatgtgccaggt

SEQ ID NO: 84221 - DNA, 16 bp, H. sapiens
ctaccattctggaatc

SEQ ID NO: 84222 - DNA, 16 bp, H. sapiens
ctaccattctggggcc

SEQ ID NO: 84223 - DNA, 16 bp, H. sapiens
ctaccattgtggaaga

SEQ ID NO: 84224 - DNA, 16 bp, H. sapiens
ctacccaagaccatgg

SEQ ID NO: 84225 - DNA, 16 bp, H. sapiens
ctacccagagggaaag

SEQ ID NO: 84226 - DNA, 16 bp, H. sapiens
ctacccaggaactgac

SEQ ID NO: 84227 - DNA, 16 bp, H. sapiens
ctacccagtagatgcc

SEQ ID NO: 84228 - DNA, 16 bp, H. sapiens
ctacccagtctcaggc

SEQ ID NO: 84229 - DNA, 16 bp, H. sapiens
ctacccagtttgtggt

SEQ ID NO: 84230 - DNA, 16 bp, H. sapiens
ctacccatccatgagc

SEQ ID NO: 84231 - DNA, 16 bp, H. sapiens
ctaccccaaccttcag

SEQ ID NO: 84232 - DNA, 16 bp, H. sapiens
ctaccctcttaacaaa

SEQ ID NO: 84233 - DNA, 16 bp, H. sapiens
ctaccctgggtgacag

SEQ ID NO: 84234 - DNA, 16 bp, H. sapiens
ctacccttcccagcct

SEQ ID NO: 84235 - DNA, 16 bp, H. sapiens
ctaccgggttcaagtg

SEQ ID NO: 84236 - DNA, 16 bp, H. sapiens
ctacctcaggaggctg

SEQ ID NO: 84237 - DNA, 16 bp, H. sapiens
ctacctgcctcccagc

SEQ ID NO: 84238 - DNA, 16 bp, H. sapiens
ctacctgcttcagcct

SEQ ID NO: 84239 - DNA, 16 bp, H. sapiens
ctacctggagatagtg

SEQ ID NO: 84240 - DNA, 16 bp, H. sapiens
ctacctgggagactga

SEQ ID NO: 84241 - DNA, 16 bp, H. sapiens
ctacctgggaggccaa

SEQ ID NO: 84242 - DNA, 16 bp, H. sapiens
ctacctgggcatccag

SEQ ID NO: 84243 - DNA, 16 bp, H. sapiens
ctacctgggtgacagg

SEQ ID NO: 84244 - DNA, 16 bp, H. sapiens
ctacctgggtgatgag

SEQ ID NO: 84245 - DNA, 16 bp, H. sapiens
ctacctgtcaggtact

SEQ ID NO: 84246 - DNA, 16 bp, H. sapiens
ctaccttctctttaag

SEQ ID NO: 84247 - DNA, 16 bp, H. sapiens
ctacgaggaacttaaa

SEQ ID NO: 84248 - DNA, 16 bp, H. sapiens
ctactaaaaacaatac

SEQ ID NO: 84249 - DNA, 16 bp, H. sapiens
ctactaaaaggaaaaa

SEQ ID NO: 84250 - DNA, 16 bp, H. sapiens
ctactaagaaaacaaa

SEQ ID NO: 84251 - DNA, 16 bp, H. sapiens
ctactaataatacaaa

SEQ ID NO: 84252 - DNA, 16 bp, H. sapiens
ctactactactactgc

SEQ ID NO: 84253 - DNA, 16 bp, H. sapiens
ctactactgcagctgg

SEQ ID NO: 84254 - DNA, 16 bp, H. sapiens
ctactagactgtaagc

SEQ ID NO: 84255 - DNA, 18 bp, H. sapiens
ctactataaagacacatg

SEQ ID NO: 84256 - DNA, 16 bp, H. sapiens
ctactatgaacatttt

SEQ ID NO: 84257 - DNA, 16 bp, H. sapiens
ctactatgaagacaca

SEQ ID NO: 84258 - DNA, 16 bp, H. sapiens
ctactcaactctgcca

SEQ ID NO: 84259 - DNA, 16 bp, H. sapiens
ctactcaactctgctg

SEQ ID NO: 84260 - DNA, 16 bp, H. sapiens
ctactcaaggaaataa

SEQ ID NO: 84261 - DNA, 16 bp, H. sapiens
ctactcagaaagctaa

SEQ ID NO: 84262 - DNA, 16 bp, H. sapiens
ctactcagaagactga

SEQ ID NO: 84263 - DNA, 16 bp, H. sapiens
ctactcagaatggcat

SEQ ID NO: 84264 - DNA, 16 bp, H. sapiens
ctactcaggagcctga

SEQ ID NO: 84265 - DNA, 16 bp, H. sapiens
ctactcaggatactga

SEQ ID NO: 84266 - DNA, 16 bp, H. sapiens
ctactccacacctagg

SEQ ID NO: 84267 - DNA, 16 bp, H. sapiens
ctactccagtggctga

SEQ ID NO: 84268 - DNA, 16 bp, H. sapiens
ctactcctcctcagca

SEQ ID NO: 84269 - DNA, 16 bp, H. sapiens
ctactcgggaagatga

SEQ ID NO: 84270 - DNA, 16 bp, H. sapiens
ctactcgggagctgag

SEQ ID NO: 84271 - DNA, 17 bp, H. sapiens
ctactcgggaggctaag

SEQ ID NO: 84272 - DNA, 16 bp, H. sapiens
ctactctagaggctga

SEQ ID NO: 84273 - DNA, 16 bp, H. sapiens
ctactctatgttcacc

SEQ ID NO: 84274 - DNA, 16 bp, H. sapiens
ctactctctatttcca

SEQ ID NO: 84275 - DNA, 16 bp, H. sapiens
ctactctggaaactga

SEQ ID NO: 84276 - DNA, 16 bp, H. sapiens
ctactctggaggcaga

SEQ ID NO: 84277 - DNA, 16 bp, H. sapiens
ctactctggccatgtg

SEQ ID NO: 84278 - DNA, 16 bp, H. sapiens
ctactctggctcagga

SEQ ID NO: 84279 - DNA, 16 bp, H. sapiens
ctactctgtctccatg

SEQ ID NO: 84280 - DNA, 16 bp, H. sapiens
ctactctgtgccaagt

SEQ ID NO: 84281 - DNA, 16 bp, H. sapiens
ctactcttatatcaga

SEQ ID NO: 84282 - DNA, 16 bp, H. sapiens
ctactgaaaaatacaa

SEQ ID NO: 84283 - DNA, 16 bp, H. sapiens
ctactgaaaatattcc

SEQ ID NO: 84284 - DNA, 16 bp, H. sapiens
ctactgaaaattcaaa

SEQ ID NO: 84285 - DNA, 16 bp, H. sapiens
ctactgaaatacaaaa

SEQ ID NO: 84286 - DNA, 16 bp, H. sapiens
ctactgagggggctga

SEQ ID NO: 84287 - DNA, 16 bp, H. sapiens
ctactgattttatttt

SEQ ID NO: 84288 - DNA, 16 bp, H. sapiens
ctactgcagctgatgc

SEQ ID NO: 84289 - DNA, 16 bp, H. sapiens
ctactgcatgccagcc

SEQ ID NO: 84290 - DNA, 36 bp, H. sapiens
ctactgcctcacaacagcctccacaggcacagctcc

SEQ ID NO: 84291 - DNA, 16 bp, H. sapiens
ctactgctgctgctgt

SEQ ID NO: 84292 - DNA, 16 bp, H. sapiens
ctactgggaagtgaag

SEQ ID NO: 84293 - DNA, 16 bp, H. sapiens
ctactgggagatgcct

SEQ ID NO: 84294 - DNA, 16 bp, H. sapiens
ctactgggaggctgag

SEQ ID NO: 84295 - DNA, 16 bp, H. sapiens
ctactgggctgtattc

SEQ ID NO: 84296 - DNA, 16 bp, H. sapiens
ctactggggaggctgg

SEQ ID NO: 84297 - DNA, 16 bp, H. sapiens
ctactggggatgggga

SEQ ID NO: 84298 - DNA, 16 bp, H. sapiens
ctactgggtaaataat

SEQ ID NO: 84299 - DNA, 16 bp, H. sapiens
ctactgtactatcaaa

SEQ ID NO: 84300 - DNA, 16 bp, H. sapiens
ctactgtattagacag

SEQ ID NO: 84301 - DNA, 16 bp, H. sapiens
ctactgtattggacag

SEQ ID NO: 84302 - DNA, 16 bp, H. sapiens
ctactgtcttttcttt

SEQ ID NO: 84303 - DNA, 16 bp, H. sapiens
ctactgtggaaaagga

SEQ ID NO: 84304 - DNA, 16 bp, H. sapiens
ctactgtggactttat

SEQ ID NO: 84305 - DNA, 16 bp, H. sapiens
ctactgtgggaccttg

SEQ ID NO: 84306 - DNA, 16 bp, H. sapiens
ctactgtgtgctgagc

SEQ ID NO: 84307 - DNA, 16 bp, H. sapiens
ctactgtgtgtgtgtg

SEQ ID NO: 84308 - DNA, 16 bp, H. sapiens
ctactgttaacatttt

SEQ ID NO: 84309 - DNA, 16 bp, H. sapiens
ctactgttattcaaca

SEQ ID NO: 84310 - DNA, 16 bp, H. sapiens
ctactgtttccatctt

SEQ ID NO: 84311 - DNA, 16 bp, H. sapiens
ctacttaaatacaaaa

SEQ ID NO: 84312 - DNA, 16 bp, H. sapiens
ctacttccaaaatata

SEQ ID NO: 84313 - DNA, 16 bp, H. sapiens
ctacttcctcagcctc

SEQ ID NO: 84314 - DNA, 16 bp, H. sapiens
ctacttcctgtctctg

SEQ ID NO: 84315 - DNA, 16 bp, H. sapiens
ctacttctatgagatc

SEQ ID NO: 84316 - DNA, 16 bp, H. sapiens
ctacttctattcaaca

SEQ ID NO: 84317 - DNA, 16 bp, H. sapiens
ctacttctccagcctc

SEQ ID NO: 84318 - DNA, 16 bp, H. sapiens
ctacttctgcagaaca

SEQ ID NO: 84319 - DNA, 16 bp, H. sapiens
ctacttgaaggtggag

SEQ ID NO: 84320 - DNA, 16 bp, H. sapiens
ctacttgaggatggag

SEQ ID NO: 84321 - DNA, 16 bp, H. sapiens
ctacttgctaatattt

SEQ ID NO: 84322 - DNA, 16 bp, H. sapiens
ctacttgggaggtgag

SEQ ID NO: 84323 - DNA, 16 bp, H. sapiens
ctacttgggtgatggg

SEQ ID NO: 84324 - DNA, 16 bp, H. sapiens
ctacttgtatgtcttc

SEQ ID NO: 84325 - DNA, 16 bp, H. sapiens
ctactttcagtttttt

SEQ ID NO: 84326 - DNA, 16 bp, H. sapiens
ctactttctgtctcta

SEQ ID NO: 84327 - DNA, 16 bp, H. sapiens
ctactttctgtctgtg

SEQ ID NO: 84328 - DNA, 16 bp, H. sapiens
ctactttgaaaaacag

SEQ ID NO: 84329 - DNA, 16 bp, H. sapiens
ctactttgttgagagt

SEQ ID NO: 84330 - DNA, 16 bp, H. sapiens
ctactttttgtattct

SEQ ID NO: 84331 - DNA, 16 bp, H. sapiens
ctactttttgttgttg

SEQ ID NO: 84332 - DNA, 16 bp, H. sapiens
ctagaaaaaaataatg

SEQ ID NO: 84333 - DNA, 16 bp, H. sapiens
ctagaaaaaatgaata

SEQ ID NO: 84334 - DNA, 16 bp, H. sapiens
ctagaaaacaaataac

SEQ ID NO: 84335 - DNA, 16 bp, H. sapiens
ctagaaaagcaagaaa

SEQ ID NO: 84336 - DNA, 16 bp, H. sapiens
ctagaaaatctggaag

SEQ ID NO: 84337 - DNA, 16 bp, H. sapiens
ctagaaacaagctttc

SEQ ID NO: 84338 - DNA, 16 bp, H. sapiens
ctagaaagaagctttt

SEQ ID NO: 84339 - DNA, 16 bp, H. sapiens
ctagaaatacaaattt

SEQ ID NO: 84340 - DNA, 16 bp, H. sapiens
ctagaaatatgaaaat

SEQ ID NO: 84341 - DNA, 16 bp, H. sapiens
ctagaaatcaataata

SEQ ID NO: 84342 - DNA, 16 bp, H. sapiens
ctagaaatgattaaac

SEQ ID NO: 84343 - DNA, 16 bp, H. sapiens
ctagaaatgctgtcca

SEQ ID NO: 84344 - DNA, 16 bp, H. sapiens
ctagaaattatttaaa

SEQ ID NO: 84345 - DNA, 16 bp, H. sapiens
ctagaaatttaaaaaa

SEQ ID NO: 84346 - DNA, 16 bp, H. sapiens
ctagaaatttatccta

SEQ ID NO: 84347 - DNA, 16 bp, H. sapiens
ctagaacagttcctgg

SEQ ID NO: 84348 - DNA, 16 bp, H. sapiens
ctagaacccaggcctc

SEQ ID NO: 84349 - DNA, 16 bp, H. sapiens
ctagaacctgggaggc

SEQ ID NO: 84350 - DNA, 16 bp, H. sapiens
ctagaactgtgagaaa

SEQ ID NO: 84351 - DNA, 16 bp, H. sapiens
ctagaacttcaagtat

SEQ ID NO: 84352 - DNA, 16 bp, H. sapiens
ctagaagaaaacaaag

SEQ ID NO: 84353 - DNA, 16 bp, H. sapiens
ctagaagaaaacagag

SEQ ID NO: 84354 - DNA, 16 bp, H. sapiens
ctagaagaaaacccag

SEQ ID NO: 84355 - DNA, 16 bp, H. sapiens
ctagaagaaaagattt

SEQ ID NO: 84356 - DNA, 16 bp, H. sapiens
ctagaagaaatgaaca

SEQ ID NO: 84357 - DNA, 16 bp, H. sapiens
ctagaagaagaaaaga

SEQ ID NO: 84358 - DNA, 16 bp, H. sapiens
ctagaagagaggactt

SEQ ID NO: 84359 - DNA, 16 bp, H. sapiens
ctagaagcaaacaggg

SEQ ID NO: 84360 - DNA, 16 bp, H. sapiens
ctagaagcaatggata

SEQ ID NO: 84361 - DNA, 16 bp, H. sapiens
ctagaagccaagcaga

SEQ ID NO: 84362 - DNA, 16 bp, H. sapiens
ctagaagctggaaagg

SEQ ID NO: 84363 - DNA, 16 bp, H. sapiens
ctagaaggactaagga

SEQ ID NO: 84364 - DNA, 16 bp, H. sapiens
ctagaagtggaattgc

SEQ ID NO: 84365 - DNA, 16 bp, H. sapiens
ctagaataaaatgact

SEQ ID NO: 84366 - DNA, 16 bp, H. sapiens
ctagaatatacaaaga

SEQ ID NO: 84367 - DNA, 16 bp, H. sapiens
ctagaatatatttttt

SEQ ID NO: 84368 - DNA, 16 bp, H. sapiens
ctagaattcagctgtg

SEQ ID NO: 84369 - DNA, 16 bp, H. sapiens
ctagacagacaggcct

SEQ ID NO: 84370 - DNA, 16 bp, H. sapiens
ctagacatggtggtgc

SEQ ID NO: 84371 - DNA, 17 bp, H. sapiens
ctagaccaaggagccct

SEQ ID NO: 84372 - DNA, 16 bp, H. sapiens
ctagaccagcctggca

SEQ ID NO: 84373 - DNA, 16 bp, H. sapiens
ctagactgctggcagc

SEQ ID NO: 84374 - DNA, 16 bp, H. sapiens
ctagactggaatgcag

SEQ ID NO: 84375 - DNA, 16 bp, H. sapiens
ctagactgtaaactcc

SEQ ID NO: 84376 - DNA, 16 bp, H. sapiens
ctagactgtaagctcc

SEQ ID NO: 84377 - DNA, 16 bp, H. sapiens
ctagactgtaagctct

SEQ ID NO: 84378 - DNA, 16 bp, H. sapiens
ctagactgtgagcttc

SEQ ID NO: 84379 - DNA, 16 bp, H. sapiens
ctagagaaaaaagaat

SEQ ID NO: 84380 - DNA, 16 bp, H. sapiens
ctagagaaaaatgaaa

SEQ ID NO: 84381 - DNA, 16 bp, H. sapiens
ctagagaaacagaaca

SEQ ID NO: 84382 - DNA, 16 bp, H. sapiens
ctagagaagaaaagtg

SEQ ID NO: 84383 - DNA, 16 bp, H. sapiens
ctagagaagagcaact

SEQ ID NO: 84384 - DNA, 16 bp, H. sapiens
ctagagacccaggaga

SEQ ID NO: 84385 - DNA, 16 bp, H. sapiens
ctagagagaaaggtca

SEQ ID NO: 84386 - DNA, 16 bp, H. sapiens
ctagagagcagtggtg

SEQ ID NO: 84387 - DNA, 16 bp, H. sapiens
ctagagatgatttaaa

SEQ ID NO: 84388 - DNA, 16 bp, H. sapiens
ctagagatggggtctc

SEQ ID NO: 84389 - DNA, 16 bp, H. sapiens
ctagagatgtagacat

SEQ ID NO: 84390 - DNA, 16 bp, H. sapiens
ctagagattatttaaa

SEQ ID NO: 84391 - DNA, 16 bp, H. sapiens
ctagagattctgattc

SEQ ID NO: 84392 - DNA, 16 bp, H. sapiens
ctagagcccaggagtt

SEQ ID NO: 84393 - DNA, 16 bp, H. sapiens
ctagagcctccagaag

SEQ ID NO: 84394 - DNA, 16 bp, H. sapiens
ctagagcctttggagg

SEQ ID NO: 84395 - DNA, 16 bp, H. sapiens
ctagagctgtgagaaa

SEQ ID NO: 84396 - DNA, 16 bp, H. sapiens
ctagaggaaatggata

SEQ ID NO: 84397 - DNA, 16 bp, H. sapiens
ctagaggaaatggatg

SEQ ID NO: 84398 - DNA, 16 bp, H. sapiens
ctagaggaatataaat

SEQ ID NO: 84399 - DNA, 16 bp, H. sapiens
ctagaggcctctgctg

SEQ ID NO: 84400 - DNA, 16 bp, H. sapiens
ctagaggctgtgaagt

SEQ ID NO: 84401 - DNA, 16 bp, H. sapiens
ctagaggttttgatag

SEQ ID NO: 84402 - DNA, 16 bp, H. sapiens
ctagagtgtagtggcg

SEQ ID NO: 84403 - DNA, 16 bp, H. sapiens
ctagagtttctgattc

SEQ ID NO: 84404 - DNA, 16 bp, H. sapiens
ctagagtttttcaagg

SEQ ID NO: 84405 - DNA, 16 bp, H. sapiens
ctagataatttatttt

SEQ ID NO: 84406 - DNA, 16 bp, H. sapiens
ctagatattttatttt

SEQ ID NO: 84407 - DNA, 16 bp, H. sapiens
ctagatccagaagaga

SEQ ID NO: 84408 - DNA, 17 bp, H. sapiens
ctagatccccgaggaat

SEQ ID NO: 84409 - DNA, 16 bp, H. sapiens
ctagatctttttcttc

SEQ ID NO: 84410 - DNA, 17 bp, H. sapiens
ctagatgacagagcgag

SEQ ID NO: 84411 - DNA, 16 bp, H. sapiens
ctagatgccagtggca

SEQ ID NO: 84412 - DNA, 16 bp, H. sapiens
ctagatggcatcttcc

SEQ ID NO: 84413 - DNA, 16 bp, H. sapiens
ctagatgtggtggtgc

SEQ ID NO: 84414 - DNA, 16 bp, H. sapiens
ctagattaagaaaaaa

SEQ ID NO: 84415 - DNA, 16 bp, H. sapiens
ctagattagtgtttga

SEQ ID NO: 84416 - DNA, 16 bp, H. sapiens
ctagattcctcacatg

SEQ ID NO: 84417 - DNA, 16 bp, H. sapiens
ctagattccttctctc

SEQ ID NO: 84418 - DNA, 16 bp, H. sapiens
ctagattgtaagctcc

SEQ ID NO: 84419 - DNA, 16 bp, H. sapiens
ctagatttcagaagat

SEQ ID NO: 84420 - DNA, 16 bp, H. sapiens
ctagatttcagaggat

SEQ ID NO: 84421 - DNA, 16 bp, H. sapiens
ctagatttgataaata

SEQ ID NO: 84422 - DNA, 16 bp, H. sapiens
ctagattttatctgaa

SEQ ID NO: 84423 - DNA, 16 bp, H. sapiens
ctagattttcttccag

SEQ ID NO: 84424 - DNA, 16 bp, H. sapiens
ctagattttcttctgt

SEQ ID NO: 84425 - DNA, 26 bp, H. sapiens
ctagcaaaagcaggggccattataca

SEQ ID NO: 84426 - DNA, 20 bp, H. sapiens
ctagcaagactaataaagaa

SEQ ID NO: 84427 - DNA, 20 bp, H. sapiens
ctagcaagactaatgaagaa

SEQ ID NO: 84428 - DNA, 16 bp, H. sapiens
ctagcaaggcaggcaa

SEQ ID NO: 84429 - DNA, 17 bp, H. sapiens
ctagcaaggcaggccaa

SEQ ID NO: 84430 - DNA, 16 bp, H. sapiens
ctagcacagtgcttgg

SEQ ID NO: 84431 - DNA, 19 bp, H. sapiens
ctagcactttgagaggcca

SEQ ID NO: 84432 - DNA, 16 bp, H. sapiens
ctagcagaagacaaga

SEQ ID NO: 84433 - DNA, 16 bp, H. sapiens
ctagcagcagacttct

SEQ ID NO: 84434 - DNA, 16 bp, H. sapiens
ctagcagcagcagcag

SEQ ID NO: 84435 - DNA, 16 bp, H. sapiens
ctagcagtgggattgc

SEQ ID NO: 84436 - DNA, 16 bp, H. sapiens
ctagcatctgcttggc

SEQ ID NO: 84437 - DNA, 16 bp, H. sapiens
ctagcatggtgcctgg

SEQ ID NO: 84438 - DNA, 16 bp, H. sapiens
ctagccacaggtggct

SEQ ID NO: 84439 - DNA, 16 bp, H. sapiens
ctagccacatgtgact

SEQ ID NO: 84440 - DNA, 16 bp, H. sapiens
ctagccaggtgtggtg

SEQ ID NO: 84441 - DNA, 16 bp, H. sapiens
ctagccatatgcagaa

SEQ ID NO: 84442 - DNA, 16 bp, H. sapiens
ctagcccgtctcttag

SEQ ID NO: 84443 - DNA, 16 bp, H. sapiens
ctagcctaggcaacat

SEQ ID NO: 84444 - DNA, 16 bp, H. sapiens
ctagcctctggtaacc

SEQ ID NO: 84445 - DNA, 16 bp, H. sapiens
ctagcctgagcgacag

SEQ ID NO: 84446 - DNA, 16 bp, H. sapiens
ctagcctggcaacaga

SEQ ID NO: 84447 - DNA, 16 bp, H. sapiens
ctagcctgggcaacgt

SEQ ID NO: 84448 - DNA, 21 bp, H. sapiens
ctagctaagggattgtgaatg

SEQ ID NO: 84449 - DNA, 16 bp, H. sapiens
ctagctacgcaggagg

SEQ ID NO: 84450 - DNA, 23 bp, H. sapiens
ctagctacttgggaggctgaggt

SEQ ID NO: 84451 - DNA, 16 bp, H. sapiens
ctagctataattttgt

SEQ ID NO: 84452 - DNA, 16 bp, H. sapiens
ctagctatgctggaaa

SEQ ID NO: 84453 - DNA, 16 bp, H. sapiens
ctagctcagcctccca

SEQ ID NO: 84454 - DNA, 16 bp, H. sapiens
ctagctgggactacag

SEQ ID NO: 84455 - DNA, 16 bp, H. sapiens
ctagctgggaggctga

SEQ ID NO: 84456 - DNA, 16 bp, H. sapiens
ctagctgggattacag

SEQ ID NO: 84457 - DNA, 16 bp, H. sapiens
ctagctgggcatggtg

SEQ ID NO: 84458 - DNA, 16 bp, H. sapiens
ctagctgggcgtggtg

SEQ ID NO: 84459 - DNA, 16 bp, H. sapiens
ctagctgggtgatctt

SEQ ID NO: 84460 - DNA, 16 bp, H. sapiens
ctagcttctggtagtt

SEQ ID NO: 84461 - DNA, 33 bp, H. sapiens
ctaggaaaaaccaggccatacagagataggagc

SEQ ID NO: 84462 - DNA, 16 bp, H. sapiens
ctaggaaactaataca

SEQ ID NO: 84463 - DNA, 16 bp, H. sapiens
ctaggaaagactttat

SEQ ID NO: 84464 - DNA, 16 bp, H. sapiens
ctaggaaatctagaag

SEQ ID NO: 84465 - DNA, 17 bp, H. sapiens
ctaggaagaaactgcat

SEQ ID NO: 84466 - DNA, 16 bp, H. sapiens
ctaggaagtagcagag

SEQ ID NO: 84467 - DNA, 16 bp, H. sapiens
ctaggaataaagctaa

SEQ ID NO: 84468 - DNA, 16 bp, H. sapiens
ctaggacagagcacct

SEQ ID NO: 84469 - DNA, 16 bp, H. sapiens
ctaggagagggcagac

SEQ ID NO: 84470 - DNA, 16 bp, H. sapiens
ctaggagctggggata

SEQ ID NO: 84471 - DNA, 16 bp, H. sapiens
ctaggaggaaaaaatg

SEQ ID NO: 84472 - DNA, 16 bp, H. sapiens
ctaggagttcaagacc

SEQ ID NO: 84473 - DNA, 16 bp, H. sapiens
ctaggattacaaatgt

SEQ ID NO: 84474 - DNA, 16 bp, H. sapiens
ctaggattacaagcgt

SEQ ID NO: 84475 - DNA, 16 bp, H. sapiens
ctaggattacaggcac

SEQ ID NO: 84476 - DNA, 16 bp, H. sapiens
ctaggcaacataatga

SEQ ID NO: 84477 - DNA, 16 bp, H. sapiens
ctaggcagggtggctc

SEQ ID NO: 84478 - DNA, 16 bp, H. sapiens
ctaggcattttatttt

SEQ ID NO: 84479 - DNA, 16 bp, H. sapiens
ctaggccacagagtga

SEQ ID NO: 84480 - DNA, 16 bp, H. sapiens
ctaggccaggcatggt

SEQ ID NO: 84481 - DNA, 16 bp, H. sapiens
ctaggccccagggcct

SEQ ID NO: 84482 - DNA, 16 bp, H. sapiens
ctaggcctcagtttcc

SEQ ID NO: 84483 - DNA, 16 bp, H. sapiens
ctaggcctcttgcacc

SEQ ID NO: 84484 - DNA, 16 bp, H. sapiens
ctaggcctgtctctcc

SEQ ID NO: 84485 - DNA, 16 bp, H. sapiens
ctaggctgatcttgaa

SEQ ID NO: 84486 - DNA, 16 bp, H. sapiens
ctaggctgcagtgagc

SEQ ID NO: 84487 - DNA, 16 bp, H. sapiens
ctagggaaggcagcct

SEQ ID NO: 84488 - DNA, 16 bp, H. sapiens
ctagggagatattact

SEQ ID NO: 84489 - DNA, 16 bp, H. sapiens
ctagggcagtgcagaa

SEQ ID NO: 84490 - DNA, 16 bp, H. sapiens
ctaggggaagggggag

SEQ ID NO: 84491 - DNA, 16 bp, H. sapiens
ctaggggagaatttgt

SEQ ID NO: 84492 - DNA, 16 bp, H. sapiens
ctaggggccaggcaca

SEQ ID NO: 84493 - DNA, 16 bp, H. sapiens
ctaggggtggggtgag

SEQ ID NO: 84494 - DNA, 16 bp, H. sapiens
ctaggggttaggactt

SEQ ID NO: 84495 - DNA, 16 bp, H. sapiens
ctaggtactggggata

SEQ ID NO: 84496 - DNA, 16 bp, H. sapiens
ctaggtacttcatata

SEQ ID NO: 84497 - DNA, 16 bp, H. sapiens
ctaggtatatacccaa

SEQ ID NO: 84498 - DNA, 16 bp, H. sapiens
ctaggtatatgcccaa

SEQ ID NO: 84499 - DNA, 16 bp, H. sapiens
ctaggtattgatggag

SEQ ID NO: 84500 - DNA, 16 bp, H. sapiens
ctaggtattgatggga

SEQ ID NO: 84501 - DNA, 16 bp, H. sapiens
ctaggtatttttattt

SEQ ID NO: 84502 - DNA, 16 bp, H. sapiens
ctaggtgtggtggcac

SEQ ID NO: 84503 - DNA, 18 bp, H. sapiens
ctaggttcaagcgattct

SEQ ID NO: 84504 - DNA, 16 bp, H. sapiens
ctaggtttgtgtaagt

SEQ ID NO: 84505 - DNA, 16 bp, H. sapiens
ctagtaattttatagt

SEQ ID NO: 84506 - DNA, 16 bp, H. sapiens
ctagtacagtgcctgg

SEQ ID NO: 84507 - DNA, 16 bp, H. sapiens
ctagtacataattaaa

SEQ ID NO: 84508 - DNA, 16 bp, H. sapiens
ctagtaccattccttc

SEQ ID NO: 84509 - DNA, 16 bp, H. sapiens
ctagtagaattcagct

SEQ ID NO: 84510 - DNA, 16 bp, H. sapiens
ctagtattttcttaag

SEQ ID NO: 84511 - DNA, 16 bp, H. sapiens
ctagtcagagcaatta

SEQ ID NO: 84512 - DNA, 16 bp, H. sapiens
ctagtcatatttcaag

SEQ ID NO: 84513 - DNA, 16 bp, H. sapiens
ctagtcccagctaccc

SEQ ID NO: 84514 - DNA, 16 bp, H. sapiens
ctagtctgtggcttgt

SEQ ID NO: 84515 - DNA, 16 bp, H. sapiens
ctagtgaagatgctgt

SEQ ID NO: 84516 - DNA, 16 bp, H. sapiens
ctagtgcagtgcctgg

SEQ ID NO: 84517 - DNA, 16 bp, H. sapiens
ctagttctctgaagaa

SEQ ID NO: 84518 - DNA, 16 bp, H. sapiens
ctagttgtttaaaagt

SEQ ID NO: 84519 - DNA, 16 bp, H. sapiens
ctagtttcatttcatt

SEQ ID NO: 84520 - DNA, 16 bp, H. sapiens
ctagtttgaaaatatt

SEQ ID NO: 84521 - DNA, 16 bp, H. sapiens
ctagttttacagatga

SEQ ID NO: 84522 - DNA, 16 bp, H. sapiens
ctagttttagttttct

SEQ ID NO: 84523 - DNA, 16 bp, H. sapiens
ctagttttattatatt

SEQ ID NO: 84524 - DNA, 16 bp, H. sapiens
ctagttttgatctttg

SEQ ID NO: 84525 - DNA, 16 bp, H. sapiens
ctagtttttaaatttt

SEQ ID NO: 84526 - DNA, 16 bp, H. sapiens
ctataaaaatggcaat

SEQ ID NO: 84527 - DNA, 16 bp, H. sapiens
ctataaaacagaaata

SEQ ID NO: 84528 - DNA, 16 bp, H. sapiens
ctataaaacagaatga

SEQ ID NO: 84529 - DNA, 16 bp, H. sapiens
ctataaaacattttta

SEQ ID NO: 84530 - DNA, 16 bp, H. sapiens
ctataaaatagaataa

SEQ ID NO: 84531 - DNA, 16 bp, H. sapiens
ctataaaatgcaaata

SEQ ID NO: 84532 - DNA, 16 bp, H. sapiens
ctataaaatggaacta

SEQ ID NO: 84533 - DNA, 16 bp, H. sapiens
ctataaaatgggggtg

SEQ ID NO: 84534 - DNA, 16 bp, H. sapiens
ctataaacattcttgt

SEQ ID NO: 84535 - DNA, 16 bp, H. sapiens
ctataaacccaacact

SEQ ID NO: 84536 - DNA, 16 bp, H. sapiens
ctataaactaagttct

SEQ ID NO: 84537 - DNA, 16 bp, H. sapiens
ctataaactcacagat

SEQ ID NO: 84538 - DNA, 16 bp, H. sapiens
ctataaactttcctcc

SEQ ID NO: 84539 - DNA, 16 bp, H. sapiens
ctataaagaaaagagg

SEQ ID NO: 84540 - DNA, 16 bp, H. sapiens
ctataaagaaatgtct

SEQ ID NO: 84541 - DNA, 19 bp, H. sapiens
ctataaagacacatgcaca

SEQ ID NO: 84542 - DNA, 16 bp, H. sapiens
ctataaatatgtacaa

SEQ ID NO: 84543 - DNA, 16 bp, H. sapiens
ctataaatatttgtgt

SEQ ID NO: 84544 - DNA, 16 bp, H. sapiens
ctataaattgctttga

SEQ ID NO: 84545 - DNA, 16 bp, H. sapiens
ctataacaaaatatca

SEQ ID NO: 84546 - DNA, 16 bp, H. sapiens
ctataacaaagtacta

SEQ ID NO: 84547 - DNA, 16 bp, H. sapiens
ctataacagaatatca

SEQ ID NO: 84548 - DNA, 16 bp, H. sapiens
ctataagaaaatacct

SEQ ID NO: 84549 - DNA, 16 bp, H. sapiens
ctataagaagaggaag

SEQ ID NO: 84550 - DNA, 16 bp, H. sapiens
ctataagatttttttt

SEQ ID NO: 84551 - DNA, 16 bp, H. sapiens
ctataagtttgacttt

SEQ ID NO: 84552 - DNA, 16 bp, H. sapiens
ctataatcacaccatt

SEQ ID NO: 84553 - DNA, 17 bp, H. sapiens
ctataatcccagctact

SEQ ID NO: 84554 - DNA, 17 bp, H. sapiens
ctataatcccagctgct

SEQ ID NO: 84555 - DNA, 16 bp, H. sapiens
ctataatctcagcatt

SEQ ID NO: 84556 - DNA, 16 bp, H. sapiens
ctataatgtttgcaca

SEQ ID NO: 84557 - DNA, 17 bp, H. sapiens
ctataattccagctact

SEQ ID NO: 84558 - DNA, 16 bp, H. sapiens
ctataattgtagattt

SEQ ID NO: 84559 - DNA, 16 bp, H. sapiens
ctatacaccaacaaat

SEQ ID NO: 84560 - DNA, 16 bp, H. sapiens
ctatacaccagtaata

SEQ ID NO: 84561 - DNA, 16 bp, H. sapiens
ctatacagaagctttt

SEQ ID NO: 84562 - DNA, 16 bp, H. sapiens
ctatacaggagtgatc

SEQ ID NO: 84563 - DNA, 16 bp, H. sapiens
ctatacatctgacaaa

SEQ ID NO: 84564 - DNA, 16 bp, H. sapiens
ctatacatttttaaaa

SEQ ID NO: 84565 - DNA, 16 bp, H. sapiens
ctataccatattttta

SEQ ID NO: 84566 - DNA, 16 bp, H. sapiens
ctatactacatggaca

SEQ ID NO: 84567 - DNA, 16 bp, H. sapiens
ctatagaaacaatgct

SEQ ID NO: 84568 - DNA, 16 bp, H. sapiens
ctatagccttgacctc

SEQ ID NO: 84569 - DNA, 16 bp, H. sapiens
ctatagcttttacttc

SEQ ID NO: 84570 - DNA, 16 bp, H. sapiens
ctataggcatgcacca

SEQ ID NO: 84571 - DNA, 16 bp, H. sapiens
ctatagtcaataataa

SEQ ID NO: 84572 - DNA, 16 bp, H. sapiens
ctatagtcaccccatt

SEQ ID NO: 84573 - DNA, 16 bp, H. sapiens
ctatagtcccagctat

SEQ ID NO: 84574 - DNA, 16 bp, H. sapiens
ctatataatgataaaa

SEQ ID NO: 84575 - DNA, 16 bp, H. sapiens
ctatatacatatatat

SEQ ID NO: 84576 - DNA, 16 bp, H. sapiens
ctatatatacatacat

SEQ ID NO: 84577 - DNA, 16 bp, H. sapiens
ctatatatagagatat

SEQ ID NO: 84578 - DNA, 16 bp, H. sapiens
ctatatatagtatatg

SEQ ID NO: 84579 - DNA, 16 bp, H. sapiens
ctatatatatatatag

SEQ ID NO: 84580 - DNA, 16 bp, H. sapiens
ctatatatatatgtat

SEQ ID NO: 84581 - DNA, 16 bp, H. sapiens
ctatatatatctatat

SEQ ID NO: 84582 - DNA, 16 bp, H. sapiens
ctatatatatgtatat

SEQ ID NO: 84583 - DNA, 16 bp, H. sapiens
ctatatatctatatag

SEQ ID NO: 84584 - DNA, 16 bp, H. sapiens
ctatatatgtattata

SEQ ID NO: 84585 - DNA, 16 bp, H. sapiens
ctatatattactatat

SEQ ID NO: 84586 - DNA, 16 bp, H. sapiens
ctatatattttacata

SEQ ID NO: 84587 - DNA, 16 bp, H. sapiens
ctatatctagaaaacc

SEQ ID NO: 84588 - DNA, 16 bp, H. sapiens
ctatatctatatataa

SEQ ID NO: 84589 - DNA, 16 bp, H. sapiens
ctatatctatatctgt

SEQ ID NO: 84590 - DNA, 16 bp, H. sapiens
ctatatctatctatct

SEQ ID NO: 84591 - DNA, 16 bp, H. sapiens
ctatatgaactttaaa

SEQ ID NO: 84592 - DNA, 16 bp, H. sapiens
ctatatgaagaaaatt

SEQ ID NO: 84593 - DNA, 16 bp, H. sapiens
ctatatgccaaaaaat

SEQ ID NO: 84594 - DNA, 16 bp, H. sapiens
ctatatgccaggtgct

SEQ ID NO: 84595 - DNA, 16 bp, H. sapiens
ctatatggaacttaaa

SEQ ID NO: 84596 - DNA, 16 bp, H. sapiens
ctatatggtctaaaaa

SEQ ID NO: 84597 - DNA, 16 bp, H. sapiens
ctatatgtgtgtatat

SEQ ID NO: 84598 - DNA, 16 bp, H. sapiens
ctatattccaataaaa

SEQ ID NO: 84599 - DNA, 16 bp, H. sapiens
ctatattgttatattt

SEQ ID NO: 84600 - DNA, 16 bp, H. sapiens
ctatatttggttttct

SEQ ID NO: 84601 - DNA, 16 bp, H. sapiens
ctatcaaaatacaaat

SEQ ID NO: 84602 - DNA, 16 bp, H. sapiens
ctatcaaaattccagt

SEQ ID NO: 84603 - DNA, 16 bp, H. sapiens
ctatcaaaattttaat

SEQ ID NO: 84604 - DNA, 16 bp, H. sapiens
ctatcaaactaccaac

SEQ ID NO: 84605 - DNA, 16 bp, H. sapiens
ctatcaaaggaaggtt

SEQ ID NO: 84606 - DNA, 16 bp, H. sapiens
ctatcaaatatttaag

SEQ ID NO: 84607 - DNA, 16 bp, H. sapiens
ctatcaacccatcatc

SEQ ID NO: 84608 - DNA, 16 bp, H. sapiens
ctatcacagtgcctgg

SEQ ID NO: 84609 - DNA, 16 bp, H. sapiens
ctatcagcattttggc

SEQ ID NO: 84610 - DNA, 16 bp, H. sapiens
ctatcagcttaaagag

SEQ ID NO: 84611 - DNA, 16 bp, H. sapiens
ctatcataatttgttt

SEQ ID NO: 84612 - DNA, 16 bp, H. sapiens
ctatcatcagagtgaa

SEQ ID NO: 84613 - DNA, 16 bp, H. sapiens
ctatcatgacaacagc

SEQ ID NO: 84614 - DNA, 16 bp, H. sapiens
ctatcattcccatttt

SEQ ID NO: 84615 - DNA, 16 bp, H. sapiens
ctatcattgactttct

SEQ ID NO: 84616 - DNA, 16 bp, H. sapiens
ctatccatatgacaaa

SEQ ID NO: 84617 - DNA, 16 bp, H. sapiens
ctatccatattctgaa

SEQ ID NO: 84618 - DNA, 16 bp, H. sapiens
ctatccctgcccccac

SEQ ID NO: 84619 - DNA, 16 bp, H. sapiens
ctatcctcaaagaaat

SEQ ID NO: 84620 - DNA, 16 bp, H. sapiens
ctatcctgacttctaa

SEQ ID NO: 84621 - DNA, 16 bp, H. sapiens
ctatctaactacattt

SEQ ID NO: 84622 - DNA, 16 bp, H. sapiens
ctatctatccatatat

SEQ ID NO: 84623 - DNA, 16 bp, H. sapiens
ctatctatccatccat

SEQ ID NO: 84624 - DNA, 16 bp, H. sapiens
ctatctatctatatat

SEQ ID NO: 84625 - DNA, 16 bp, H. sapiens
ctatctcaaaaaatta

SEQ ID NO: 84626 - DNA, 16 bp, H. sapiens
ctatctcagcctcccg

SEQ ID NO: 84627 - DNA, 16 bp, H. sapiens
ctatctccaggctgga

SEQ ID NO: 84628 - DNA, 16 bp, H. sapiens
ctatctccaggtagat

SEQ ID NO: 84629 - DNA, 16 bp, H. sapiens
ctatctctaaagaaaa

SEQ ID NO: 84630 - DNA, 16 bp, H. sapiens
ctatctctaataaaaa

SEQ ID NO: 84631 - DNA, 16 bp, H. sapiens
ctatctctgcctccca

SEQ ID NO: 84632 - DNA, 16 bp, H. sapiens
ctatctcttaaaaaaa

SEQ ID NO: 84633 - DNA, 17 bp, H. sapiens
ctatctcttttgcctaa

SEQ ID NO: 84634 - DNA, 16 bp, H. sapiens
ctatctgaaaaataaa

SEQ ID NO: 84635 - DNA, 16 bp, H. sapiens
ctatctgactccaaag

SEQ ID NO: 84636 - DNA, 16 bp, H. sapiens
ctatctgcaaatacag

SEQ ID NO: 84637 - DNA, 16 bp, H. sapiens
ctatctgtgttctctt

SEQ ID NO: 84638 - DNA, 16 bp, H. sapiens
ctatctgttttgttaa

SEQ ID NO: 84639 - DNA, 16 bp, H. sapiens
ctatcttcagcctcct

SEQ ID NO: 84640 - DNA, 16 bp, H. sapiens
ctatcttgactcactg

SEQ ID NO: 84641 - DNA, 16 bp, H. sapiens
ctatcttgctgaaata

SEQ ID NO: 84642 - DNA, 16 bp, H. sapiens
ctatcttggagaatgt

SEQ ID NO: 84643 - DNA, 16 bp, H. sapiens
ctatctttgttggaca

SEQ ID NO: 84644 - DNA, 16 bp, H. sapiens
ctatgaaaaacagttt

SEQ ID NO: 84645 - DNA, 16 bp, H. sapiens
ctatgaaaatctaatg

SEQ ID NO: 84646 - DNA, 16 bp, H. sapiens
ctatgaaactactgaa

SEQ ID NO: 84647 - DNA, 16 bp, H. sapiens
ctatgaaagtcttaga

SEQ ID NO: 84648 - DNA, 16 bp, H. sapiens
ctatgaaatattttta

SEQ ID NO: 84649 - DNA, 16 bp, H. sapiens
ctatgaacatctgtgt

SEQ ID NO: 84650 - DNA, 16 bp, H. sapiens
ctatgaacatttgcat

SEQ ID NO: 84651 - DNA, 16 bp, H. sapiens
ctatgaacttttctct

SEQ ID NO: 84652 - DNA, 16 bp, H. sapiens
ctatgaactttttgaa

SEQ ID NO: 84653 - DNA, 16 bp, H. sapiens
ctatgaagaaactgca

SEQ ID NO: 84654 - DNA, 16 bp, H. sapiens
ctatgaagaaactgta

SEQ ID NO: 84655 - DNA, 16 bp, H. sapiens
ctatgaataaagctgc

SEQ ID NO: 84656 - DNA, 16 bp, H. sapiens
ctatgaatatttttgt

SEQ ID NO: 84657 - DNA, 16 bp, H. sapiens
ctatgaatcactggca

SEQ ID NO: 84658 - DNA, 16 bp, H. sapiens
ctatgaatgagaacat

SEQ ID NO: 84659 - DNA, 16 bp, H. sapiens
ctatgaatttccctct

SEQ ID NO: 84660 - DNA, 16 bp, H. sapiens
ctatgacaaacccacg

SEQ ID NO: 84661 - DNA, 16 bp, H. sapiens
ctatgacaccaaaagc

SEQ ID NO: 84662 - DNA, 17 bp, H. sapiens
ctatgaccacgtgacca

SEQ ID NO: 84663 - DNA, 16 bp, H. sapiens
ctatgacctggaaacc

SEQ ID NO: 84664 - DNA, 16 bp, H. sapiens
ctatgactggacgtgc

SEQ ID NO: 84665 - DNA, 16 bp, H. sapiens
ctatgagaacacaaag

SEQ ID NO: 84666 - DNA, 16 bp, H. sapiens
ctatgaggaaaactac

SEQ ID NO: 84667 - DNA, 16 bp, H. sapiens
ctatgaggatgcaaaa

SEQ ID NO: 84668 - DNA, 16 bp, H. sapiens
ctatgagggtgtttcc

SEQ ID NO: 84669 - DNA, 16 bp, H. sapiens
ctatgagttcaacttt

SEQ ID NO: 84670 - DNA, 16 bp, H. sapiens
ctatgatagcaccact

SEQ ID NO: 84671 - DNA, 16 bp, H. sapiens
ctatgatcaattttga

SEQ ID NO: 84672 - DNA, 16 bp, H. sapiens
ctatgatccaaacacc

SEQ ID NO: 84673 - DNA, 16 bp, H. sapiens
ctatgatccattttga

SEQ ID NO: 84674 - DNA, 16 bp, H. sapiens
ctatgatcgtgccatt

SEQ ID NO: 84675 - DNA, 16 bp, H. sapiens
ctatgatctcagctac

SEQ ID NO: 84676 - DNA, 16 bp, H. sapiens
ctatgatgatgatgat

SEQ ID NO: 84677 - DNA, 16 bp, H. sapiens
ctatgattgcaacact

SEQ ID NO: 84678 - DNA, 16 bp, H. sapiens
ctatgcaaatgaagac

SEQ ID NO: 84679 - DNA, 16 bp, H. sapiens
ctatgcaatatatcta

SEQ ID NO: 84680 - DNA, 16 bp, H. sapiens
ctatgcacacatcttc

SEQ ID NO: 84681 - DNA, 16 bp, H. sapiens
ctatgcacctgcaggc

SEQ ID NO: 84682 - DNA, 16 bp, H. sapiens
ctatgcagccacagaa

SEQ ID NO: 84683 - DNA, 16 bp, H. sapiens
ctatgcatgtaacaaa

SEQ ID NO: 84684 - DNA, 16 bp, H. sapiens
ctatgccaaagggaaa

SEQ ID NO: 84685 - DNA, 16 bp, H. sapiens
ctatgccaggcattgt

SEQ ID NO: 84686 - DNA, 16 bp, H. sapiens
ctatgccctgccccaa

SEQ ID NO: 84687 - DNA, 16 bp, H. sapiens
ctatgcctcagtttcc

SEQ ID NO: 84688 - DNA, 16 bp, H. sapiens
ctatgctaagtgtttt

SEQ ID NO: 84689 - DNA, 16 bp, H. sapiens
ctatgctattttatat

SEQ ID NO: 84690 - DNA, 16 bp, H. sapiens
ctatgctgcctaggct

SEQ ID NO: 84691 - DNA, 16 bp, H. sapiens
ctatggaaataaaaag

SEQ ID NO: 84692 - DNA, 16 bp, H. sapiens
ctatggacatttgtgt

SEQ ID NO: 84693 - DNA, 16 bp, H. sapiens
ctatggagaaaaacaa

SEQ ID NO: 84694 - DNA, 16 bp, H. sapiens
ctatggagaaaaatga

SEQ ID NO: 84695 - DNA, 16 bp, H. sapiens
ctatggagtggccatt

SEQ ID NO: 84696 - DNA, 16 bp, H. sapiens
ctatggcagtgcagaa

SEQ ID NO: 84697 - DNA, 16 bp, H. sapiens
ctatggcctggcccca

SEQ ID NO: 84698 - DNA, 16 bp, H. sapiens
ctatggctgcttttgt

SEQ ID NO: 84699 - DNA, 16 bp, H. sapiens
ctatggctgggcatgg

SEQ ID NO: 84700 - DNA, 16 bp, H. sapiens
ctatgggagactgggg

SEQ ID NO: 84701 - DNA, 16 bp, H. sapiens
ctatggtattttgtta

SEQ ID NO: 84702 - DNA, 16 bp, H. sapiens
ctatggtctgaatgct

SEQ ID NO: 84703 - DNA, 16 bp, H. sapiens
ctatggtgcccaggct

SEQ ID NO: 84704 - DNA, 16 bp, H. sapiens
ctatgtaaaacagtat

SEQ ID NO: 84705 - DNA, 21 bp, H. sapiens
ctatgtaacaaacctgcacgt

SEQ ID NO: 84706 - DNA, 16 bp, H. sapiens
ctatgtaacaacctgc

SEQ ID NO: 84707 - DNA, 16 bp, H. sapiens
ctatgtaataaatggt

SEQ ID NO: 84708 - DNA, 16 bp, H. sapiens
ctatgtacccacaaac

SEQ ID NO: 84709 - DNA, 16 bp, H. sapiens
ctatgtacctcttcat

SEQ ID NO: 84710 - DNA, 16 bp, H. sapiens
ctatgtagcaggcact

SEQ ID NO: 84711 - DNA, 16 bp, H. sapiens
ctatgtatgtatgtgt

SEQ ID NO: 84712 - DNA, 16 bp, H. sapiens
ctatgtatgtgtgtgt

SEQ ID NO: 84713 - DNA, 16 bp, H. sapiens
ctatgtatttatttat

SEQ ID NO: 84714 - DNA, 16 bp, H. sapiens
ctatgtatttttttaa

SEQ ID NO: 84715 - DNA, 16 bp, H. sapiens
ctatgtccatgtgttc

SEQ ID NO: 84716 - DNA, 16 bp, H. sapiens
ctatgtcggctcactg

SEQ ID NO: 84717 - DNA, 16 bp, H. sapiens
ctatgtctattgagat

SEQ ID NO: 84718 - DNA, 16 bp, H. sapiens
ctatgtctggcttatt

SEQ ID NO: 84719 - DNA, 16 bp, H. sapiens
ctatgtcttgaaaagt

SEQ ID NO: 84720 - DNA, 16 bp, H. sapiens
ctatgtgaaaaaaaca

SEQ ID NO: 84721 - DNA, 16 bp, H. sapiens
ctatgtgaaaaataat

SEQ ID NO: 84722 - DNA, 16 bp, H. sapiens
ctatgtgaagaaggac

SEQ ID NO: 84723 - DNA, 16 bp, H. sapiens
ctatgtgaccttgggc

SEQ ID NO: 84724 - DNA, 16 bp, H. sapiens
ctatgtgatcttggac

SEQ ID NO: 84725 - DNA, 16 bp, H. sapiens
ctatgtgccaagcatg

SEQ ID NO: 84726 - DNA, 16 bp, H. sapiens
ctatgtgccaggtact

SEQ ID NO: 84727 - DNA, 16 bp, H. sapiens
ctatgtgcccagcact

SEQ ID NO: 84728 - DNA, 16 bp, H. sapiens
ctatgtgcctagcact

SEQ ID NO: 84729 - DNA, 16 bp, H. sapiens
ctatgtgcctgacact

SEQ ID NO: 84730 - DNA, 16 bp, H. sapiens
ctatgtgtcagacatt

SEQ ID NO: 84731 - DNA, 16 bp, H. sapiens
ctatgtgtcaggcact

SEQ ID NO: 84732 - DNA, 16 bp, H. sapiens
ctatgtgtgacaaatg

SEQ ID NO: 84733 - DNA, 16 bp, H. sapiens
ctatgtgtgtctctgt

SEQ ID NO: 84734 - DNA, 16 bp, H. sapiens
ctatgtgtgtgtctgt

SEQ ID NO: 84735 - DNA, 16 bp, H. sapiens
ctatgtgtgtttctgc

SEQ ID NO: 84736 - DNA, 16 bp, H. sapiens
ctatgttaaaaaagaa

SEQ ID NO: 84737 - DNA, 16 bp, H. sapiens
ctatgttaatagagat

SEQ ID NO: 84738 - DNA, 16 bp, H. sapiens
ctatgttccaataaaa

SEQ ID NO: 84739 - DNA, 16 bp, H. sapiens
ctatgttccaggaact

SEQ ID NO: 84740 - DNA, 16 bp, H. sapiens
ctatgttcccagctac

SEQ ID NO: 84741 - DNA, 16 bp, H. sapiens
ctatgttgccaggctg

SEQ ID NO: 84742 - DNA, 16 bp, H. sapiens
ctatgttgcccaggcc

SEQ ID NO: 84743 - DNA, 16 bp, H. sapiens
ctatgttgcccagggt

SEQ ID NO: 84744 - DNA, 16 bp, H. sapiens
ctatgttgctcaagct

SEQ ID NO: 84745 - DNA, 16 bp, H. sapiens
ctatgttggccagact

SEQ ID NO: 84746 - DNA, 16 bp, H. sapiens
ctatgttgtctggggt

SEQ ID NO: 84747 - DNA, 16 bp, H. sapiens
ctatgtttttttaaaa

SEQ ID NO: 84748 - DNA, 16 bp, H. sapiens
ctattaaaaatgtgaa

SEQ ID NO: 84749 - DNA, 16 bp, H. sapiens
ctattaaaacatttta

SEQ ID NO: 84750 - DNA, 16 bp, H. sapiens
ctattaaaccatcttt

SEQ ID NO: 84751 - DNA, 16 bp, H. sapiens
ctattaaacctctgct

SEQ ID NO: 84752 - DNA, 16 bp, H. sapiens
ctattaaactcttttc

SEQ ID NO: 84753 - DNA, 16 bp, H. sapiens
ctattaacatttcttt

SEQ ID NO: 84754 - DNA, 16 bp, H. sapiens
ctattaagaaaatgaa

SEQ ID NO: 84755 - DNA, 16 bp, H. sapiens
ctattaatgaacattt

SEQ ID NO: 84756 - DNA, 16 bp, H. sapiens
ctattaatggacactt

SEQ ID NO: 84757 - DNA, 16 bp, H. sapiens
ctattaattatttcct

SEQ ID NO: 84758 - DNA, 16 bp, H. sapiens
ctattagaactaataa

SEQ ID NO: 84759 - DNA, 16 bp, H. sapiens
ctattagaagaaaaca

SEQ ID NO: 84760 - DNA, 16 bp, H. sapiens
ctattagtaattgttt

SEQ ID NO: 84761 - DNA, 16 bp, H. sapiens
ctattataaatagtat

SEQ ID NO: 84762 - DNA, 16 bp, H. sapiens
ctattatcatcatcat

SEQ ID NO: 84763 - DNA, 16 bp, H. sapiens
ctattatctcacagtt

SEQ ID NO: 84764 - DNA, 16 bp, H. sapiens
ctattatgaaaacagc

SEQ ID NO: 84765 - DNA, 16 bp, H. sapiens
ctattatgaataatgc

SEQ ID NO: 84766 - DNA, 16 bp, H. sapiens
ctattattagccccat

SEQ ID NO: 84767 - DNA, 16 bp, H. sapiens
ctattattatctccat

SEQ ID NO: 84768 - DNA, 16 bp, H. sapiens
ctattattatgattat

SEQ ID NO: 84769 - DNA, 16 bp, H. sapiens
ctattattatgcccat

SEQ ID NO: 84770 - DNA, 16 bp, H. sapiens
ctattattattcccat

SEQ ID NO: 84771 - DNA, 16 bp, H. sapiens
ctattattgtattgta

SEQ ID NO: 84772 - DNA, 16 bp, H. sapiens
ctattattgttattat

SEQ ID NO: 84773 - DNA, 16 bp, H. sapiens
ctattatttaaaaatg

SEQ ID NO: 84774 - DNA, 16 bp, H. sapiens
ctattatttttttgag

SEQ ID NO: 84775 - DNA, 16 bp, H. sapiens
ctattcaaataaacta

SEQ ID NO: 84776 - DNA, 16 bp, H. sapiens
ctattcaaatgttttg

SEQ ID NO: 84777 - DNA, 16 bp, H. sapiens
ctattcacaggcacca

SEQ ID NO: 84778 - DNA, 16 bp, H. sapiens
ctattcagatcatttg

SEQ ID NO: 84779 - DNA, 16 bp, H. sapiens
ctattcagttcctttg

SEQ ID NO: 84780 - DNA, 16 bp, H. sapiens
ctattcatctattgat

SEQ ID NO: 84781 - DNA, 16 bp, H. sapiens
ctattccaaacaacag

SEQ ID NO: 84782 - DNA, 16 bp, H. sapiens
ctattcctccacatcc

SEQ ID NO: 84783 - DNA, 16 bp, H. sapiens
ctattctcacattgct

SEQ ID NO: 84784 - DNA, 16 bp, H. sapiens
ctattctctctaaagc

SEQ ID NO: 84785 - DNA, 16 bp, H. sapiens
ctattctggagaatat

SEQ ID NO: 84786 - DNA, 16 bp, H. sapiens
ctattcttgtatcaga

SEQ ID NO: 84787 - DNA, 16 bp, H. sapiens
ctattgaaataataaa

SEQ ID NO: 84788 - DNA, 16 bp, H. sapiens
ctattgaaatgatcat

SEQ ID NO: 84789 - DNA, 16 bp, H. sapiens
ctattgatatgatgta

SEQ ID NO: 84790 - DNA, 16 bp, H. sapiens
ctattgatattttggg

SEQ ID NO: 84791 - DNA, 16 bp, H. sapiens
ctattgatgggaatgt

SEQ ID NO: 84792 - DNA, 16 bp, H. sapiens
ctattgcacttcagcc

SEQ ID NO: 84793 - DNA, 16 bp, H. sapiens
ctattgctgcataaca

SEQ ID NO: 84794 - DNA, 16 bp, H. sapiens
ctattgtaattgcttt

SEQ ID NO: 84795 - DNA, 16 bp, H. sapiens
ctattgtgaacagtac

SEQ ID NO: 84796 - DNA, 16 bp, H. sapiens
ctattgtgaatagtac

SEQ ID NO: 84797 - DNA, 16 bp, H. sapiens
ctattgtgaatagtgt

SEQ ID NO: 84798 - DNA, 16 bp, H. sapiens
ctattgtgaatattgc

SEQ ID NO: 84799 - DNA, 16 bp, H. sapiens
ctattgtgaattgtgc

SEQ ID NO: 84800 - DNA, 16 bp, H. sapiens
ctattgttgatgggca

SEQ ID NO: 84801 - DNA, 16 bp, H. sapiens
ctattgtttttcaata

SEQ ID NO: 84802 - DNA, 16 bp, H. sapiens
ctatttaaaaagtaaa

SEQ ID NO: 84803 - DNA, 16 bp, H. sapiens
ctatttaaaaatggaa

SEQ ID NO: 84804 - DNA, 16 bp, H. sapiens
ctatttaaaactgcaa

SEQ ID NO: 84805 - DNA, 16 bp, H. sapiens
ctatttaaataccttt

SEQ ID NO: 84806 - DNA, 16 bp, H. sapiens
ctatttatataacatt

SEQ ID NO: 84807 - DNA, 16 bp, H. sapiens
ctatttcaaatatatt

SEQ ID NO: 84808 - DNA, 16 bp, H. sapiens
ctatttcatttcttag

SEQ ID NO: 84809 - DNA, 16 bp, H. sapiens
ctatttccaaataaag

SEQ ID NO: 84810 - DNA, 16 bp, H. sapiens
ctatttctaaaacaaa

SEQ ID NO: 84811 - DNA, 16 bp, H. sapiens
ctatttctctgtctct

SEQ ID NO: 84812 - DNA, 16 bp, H. sapiens
ctatttctcttttctg

SEQ ID NO: 84813 - DNA, 16 bp, H. sapiens
ctatttctgtaaagaa

SEQ ID NO: 84814 - DNA, 16 bp, H. sapiens
ctatttcttcctggct

SEQ ID NO: 84815 - DNA, 16 bp, H. sapiens
ctatttctttctcctg

SEQ ID NO: 84816 - DNA, 16 bp, H. sapiens
ctatttgacagatgag

SEQ ID NO: 84817 - DNA, 16 bp, H. sapiens
ctatttgcagatgaca

SEQ ID NO: 84818 - DNA, 16 bp, H. sapiens
ctatttggatgccctt

SEQ ID NO: 84819 - DNA, 16 bp, H. sapiens
ctatttggattttgga

SEQ ID NO: 84820 - DNA, 16 bp, H. sapiens
ctatttgggagactga

SEQ ID NO: 84821 - DNA, 16 bp, H. sapiens
ctattttaaaattcat

SEQ ID NO: 84822 - DNA, 16 bp, H. sapiens
ctattttaaagaaaaa

SEQ ID NO: 84823 - DNA, 16 bp, H. sapiens
ctattttaaagtaaaa

SEQ ID NO: 84824 - DNA, 16 bp, H. sapiens
ctattttaaatggaat

SEQ ID NO: 84825 - DNA, 16 bp, H. sapiens
ctattttaagttgttt

SEQ ID NO: 84826 - DNA, 16 bp, H. sapiens
ctattttatctaaaat

SEQ ID NO: 84827 - DNA, 16 bp, H. sapiens
ctattttatgaatttt

SEQ ID NO: 84828 - DNA, 16 bp, H. sapiens
ctattttcaagttcat

SEQ ID NO: 84829 - DNA, 16 bp, H. sapiens
ctattttcctaagcat

SEQ ID NO: 84830 - DNA, 16 bp, H. sapiens
ctattttctagatttt

SEQ ID NO: 84831 - DNA, 16 bp, H. sapiens
ctattttctcatctgt

SEQ ID NO: 84832 - DNA, 16 bp, H. sapiens
ctattttctggaagag

SEQ ID NO: 84833 - DNA, 16 bp, H. sapiens
ctattttcttcataaa

SEQ ID NO: 84834 - DNA, 16 bp, H. sapiens
ctattttcttccattg

SEQ ID NO: 84835 - DNA, 16 bp, H. sapiens
ctattttgagacagag

SEQ ID NO: 84836 - DNA, 16 bp, H. sapiens
ctattttgcaaacaaa

SEQ ID NO: 84837 - DNA, 16 bp, H. sapiens
ctattttgcaggctag

SEQ ID NO: 84838 - DNA, 16 bp, H. sapiens
ctattttggtgtgttt

SEQ ID NO: 84839 - DNA, 16 bp, H. sapiens
ctattttggttactac

SEQ ID NO: 84840 - DNA, 16 bp, H. sapiens
ctattttgtgtgtgtg

SEQ ID NO: 84841 - DNA, 16 bp, H. sapiens
ctatttttaaaaagta

SEQ ID NO: 84842 - DNA, 16 bp, H. sapiens
ctatttttaaaacatt

SEQ ID NO: 84843 - DNA, 16 bp, H. sapiens
ctatttttagtagaaa

SEQ ID NO: 84844 - DNA, 16 bp, H. sapiens
ctatttttatgccaat

SEQ ID NO: 84845 - DNA, 16 bp, H. sapiens
ctatttttattttaga

SEQ ID NO: 84846 - DNA, 16 bp, H. sapiens
ctatttttcaaaacaa

SEQ ID NO: 84847 - DNA, 16 bp, H. sapiens
ctatttttcccttttg

SEQ ID NO: 84848 - DNA, 16 bp, H. sapiens
ctattttttaagaaaa

SEQ ID NO: 84849 - DNA, 16 bp, H. sapiens
ctattttttagagcag

SEQ ID NO: 84850 - DNA, 16 bp, H. sapiens
ctattttttatctgaa

SEQ ID NO: 84851 - DNA, 16 bp, H. sapiens
ctcaaaaaaacgaaac

SEQ ID NO: 84852 - DNA, 16 bp, H. sapiens
ctcaaaaaagaaaagg

SEQ ID NO: 84853 - DNA, 16 bp, H. sapiens
ctcaaaaaagaagaag

SEQ ID NO: 84854 - DNA, 16 bp, H. sapiens
ctcaaaaaagaaggaa

SEQ ID NO: 84855 - DNA, 16 bp, H. sapiens
ctcaaaaaatgaaaat

SEQ ID NO: 84856 - DNA, 16 bp, H. sapiens
ctcaaaaaattaaaag

SEQ ID NO: 84857 - DNA, 16 bp, H. sapiens
ctcaaaaaattttttt

SEQ ID NO: 84858 - DNA, 16 bp, H. sapiens
ctcaaaaacatgctga

SEQ ID NO: 84859 - DNA, 16 bp, H. sapiens
ctcaaaaagaaataga

SEQ ID NO: 84860 - DNA, 16 bp, H. sapiens
ctcaaaaagagaaaga

SEQ ID NO: 84861 - DNA, 16 bp, H. sapiens
ctcaaaaagataaaat

SEQ ID NO: 84862 - DNA, 16 bp, H. sapiens
ctcaaaaagcaaacaa

SEQ ID NO: 84863 - DNA, 16 bp, H. sapiens
ctcaaaaagtttcaga

SEQ ID NO: 84864 - DNA, 16 bp, H. sapiens
ctcaaaaagtttccaa

SEQ ID NO: 84865 - DNA, 16 bp, H. sapiens
ctcaaaaatacataca

SEQ ID NO: 84866 - DNA, 16 bp, H. sapiens
ctcaaaaatagggaag

SEQ ID NO: 84867 - DNA, 16 bp, H. sapiens
ctcaaaaatttaaaca

SEQ ID NO: 84868 - DNA, 16 bp, H. sapiens
ctcaaaagaaaagaag

SEQ ID NO: 84869 - DNA, 16 bp, H. sapiens
ctcaaaagaagagata

SEQ ID NO: 84870 - DNA, 16 bp, H. sapiens
ctcaaaagaatgcaat

SEQ ID NO: 84871 - DNA, 16 bp, H. sapiens
ctcaaaaggaataaaa

SEQ ID NO: 84872 - DNA, 16 bp, H. sapiens
ctcaaaagtataaaaa

SEQ ID NO: 84873 - DNA, 16 bp, H. sapiens
ctcaaaagtcaaagac

SEQ ID NO: 84874 - DNA, 16 bp, H. sapiens
ctcaaaagtccacagt

SEQ ID NO: 84875 - DNA, 16 bp, H. sapiens
ctcaaaataatgagag

SEQ ID NO: 84876 - DNA, 16 bp, H. sapiens
ctcaaaatagaaatta

SEQ ID NO: 84877 - DNA, 16 bp, H. sapiens
ctcaaaatagaactac

SEQ ID NO: 84878 - DNA, 16 bp, H. sapiens
ctcaaaatatcttatt

SEQ ID NO: 84879 - DNA, 16 bp, H. sapiens
ctcaaaatcactgatc

SEQ ID NO: 84880 - DNA, 16 bp, H. sapiens
ctcaaaatgataagag

SEQ ID NO: 84881 - DNA, 16 bp, H. sapiens
ctcaaacagaaacaaa

SEQ ID NO: 84882 - DNA, 16 bp, H. sapiens
ctcaaaccattctcct

SEQ ID NO: 84883 - DNA, 16 bp, H. sapiens
ctcaaacccctgacct

SEQ ID NO: 84884 - DNA, 16 bp, H. sapiens
ctcaaacccctgagct

SEQ ID NO: 84885 - DNA, 16 bp, H. sapiens
ctcaaacccgggaggc

SEQ ID NO: 84886 - DNA, 16 bp, H. sapiens
ctcaaactcaggtgat

SEQ ID NO: 84887 - DNA, 16 bp, H. sapiens
ctcaaactccaaacct

SEQ ID NO: 84888 - DNA, 16 bp, H. sapiens
ctcaaactccagactt

SEQ ID NO: 84889 - DNA, 16 bp, H. sapiens
ctcaaactcgtgagct

SEQ ID NO: 84890 - DNA, 16 bp, H. sapiens
ctcaaactctggcctc

SEQ ID NO: 84891 - DNA, 16 bp, H. sapiens
ctcaaactcttaggct

SEQ ID NO: 84892 - DNA, 16 bp, H. sapiens
ctcaaactctttggct

SEQ ID NO: 84893 - DNA, 16 bp, H. sapiens
ctcaaactgaatgaaa

SEQ ID NO: 84894 - DNA, 16 bp, H. sapiens
ctcaaacttctggctc

SEQ ID NO: 84895 - DNA, 16 bp, H. sapiens
ctcaaacttctgggct

SEQ ID NO: 84896 - DNA, 16 bp, H. sapiens
ctcaaacttttctaaa

SEQ ID NO: 84897 - DNA, 16 bp, H. sapiens
ctcaaagaaagaaaag

SEQ ID NO: 84898 - DNA, 16 bp, H. sapiens
ctcaaagaacttaaca

SEQ ID NO: 84899 - DNA, 16 bp, H. sapiens
ctcaaagaactttaaa

SEQ ID NO: 84900 - DNA, 16 bp, H. sapiens
ctcaaagaagctaaaa

SEQ ID NO: 84901 - DNA, 16 bp, H. sapiens
ctcaaagaataataat

SEQ ID NO: 84902 - DNA, 16 bp, H. sapiens
ctcaaagacctagaaa

SEQ ID NO: 84903 - DNA, 16 bp, H. sapiens
ctcaaagagcaaccag

SEQ ID NO: 84904 - DNA, 16 bp, H. sapiens
ctcaaagatctagaaa

SEQ ID NO: 84905 - DNA, 16 bp, H. sapiens
ctcaaagatttcaaaa

SEQ ID NO: 84906 - DNA, 16 bp, H. sapiens
ctcaaagctgtcagac

SEQ ID NO: 84907 - DNA, 16 bp, H. sapiens
ctcaaagctttccaaa

SEQ ID NO: 84908 - DNA, 16 bp, H. sapiens
ctcaaaggaaaaagaa

SEQ ID NO: 84909 - DNA, 16 bp, H. sapiens
ctcaaaggaaattaaa

SEQ ID NO: 84910 - DNA, 16 bp, H. sapiens
ctcaaaggaagaaaaa

SEQ ID NO: 84911 - DNA, 16 bp, H. sapiens
ctcaaagtataaaata

SEQ ID NO: 84912 - DNA, 16 bp, H. sapiens
ctcaaagtcctgagtt

SEQ ID NO: 84913 - DNA, 16 bp, H. sapiens
ctcaaagtcctggact

SEQ ID NO: 84914 - DNA, 16 bp, H. sapiens
ctcaaagtgtggcccc

SEQ ID NO: 84915 - DNA, 16 bp, H. sapiens
ctcaaagtgtggtctg

SEQ ID NO: 84916 - DNA, 16 bp, H. sapiens
ctcaaatatattttct

SEQ ID NO: 84917 - DNA, 16 bp, H. sapiens
ctcaaatcagtcttcc

SEQ ID NO: 84918 - DNA, 16 bp, H. sapiens
ctcaaatcatattaga

SEQ ID NO: 84919 - DNA, 16 bp, H. sapiens
ctcaaatgatcctccc

SEQ ID NO: 84920 - DNA, 16 bp, H. sapiens
ctcaaatgatcctcct

SEQ ID NO: 84921 - DNA, 16 bp, H. sapiens
ctcaaatgccaaggtg

SEQ ID NO: 84922 - DNA, 16 bp, H. sapiens
ctcaaattatactaca

SEQ ID NO: 84923 - DNA, 16 bp, H. sapiens
ctcaaattcaacatgt

SEQ ID NO: 84924 - DNA, 16 bp, H. sapiens
ctcaaattcatgtgtt

SEQ ID NO: 84925 - DNA, 16 bp, H. sapiens
ctcaaattcctgagct

SEQ ID NO: 84926 - DNA, 16 bp, H. sapiens
ctcaaattcctggact

SEQ ID NO: 84927 - DNA, 16 bp, H. sapiens
ctcaaattcctgggcc

SEQ ID NO: 84928 - DNA, 16 bp, H. sapiens
ctcaacaaaacattag

SEQ ID NO: 84929 - DNA, 16 bp, H. sapiens
ctcaacaaacatttat

SEQ ID NO: 84930 - DNA, 16 bp, H. sapiens
ctcaacaaacttcaag

SEQ ID NO: 84931 - DNA, 16 bp, H. sapiens
ctcaacaaatgtaaaa

SEQ ID NO: 84932 - DNA, 16 bp, H. sapiens
ctcaacaaatttaaga

SEQ ID NO: 84933 - DNA, 16 bp, H. sapiens
ctcaacaagttcctca

SEQ ID NO: 84934 - DNA, 16 bp, H. sapiens
ctcaacacttcaggag

SEQ ID NO: 84935 - DNA, 16 bp, H. sapiens
ctcaacagatgcaaaa

SEQ ID NO: 84936 - DNA, 16 bp, H. sapiens
ctcaacagcaacaaca

SEQ ID NO: 84937 - DNA, 16 bp, H. sapiens
ctcaacatcacaaatc

SEQ ID NO: 84938 - DNA, 16 bp, H. sapiens
ctcaacatcattaacc

SEQ ID NO: 84939 - DNA, 16 bp, H. sapiens
ctcaacatcctgggct

SEQ ID NO: 84940 - DNA, 20 bp, H. sapiens
ctcaacattcttaaagaaaa

SEQ ID NO: 84941 - DNA, 16 bp, H. sapiens
ctcaacattttctttt

SEQ ID NO: 84942 - DNA, 16 bp, H. sapiens
ctcaaccaattgtcaa

SEQ ID NO: 84943 - DNA, 16 bp, H. sapiens
ctcaacccctggcaac

SEQ ID NO: 84944 - DNA, 16 bp, H. sapiens
ctcaacctcactgatc

SEQ ID NO: 84945 - DNA, 16 bp, H. sapiens
ctcaacctcccaaagt

SEQ ID NO: 84946 - DNA, 16 bp, H. sapiens
ctcaacctccctggct

SEQ ID NO: 84947 - DNA, 16 bp, H. sapiens
ctcaacctcctcagct

SEQ ID NO: 84948 - DNA, 16 bp, H. sapiens
ctcaacctcctggact

SEQ ID NO: 84949 - DNA, 16 bp, H. sapiens
ctcaacctctcaggct

SEQ ID NO: 84950 - DNA, 16 bp, H. sapiens
ctcaacctgccaggct

SEQ ID NO: 84951 - DNA, 16 bp, H. sapiens
ctcaacctggcagaag

SEQ ID NO: 84952 - DNA, 16 bp, H. sapiens
ctcaactggaaaaaca

SEQ ID NO: 84953 - DNA, 16 bp, H. sapiens
ctcaactggggctgga

SEQ ID NO: 84954 - DNA, 16 bp, H. sapiens
ctcaactggttcagct

SEQ ID NO: 84955 - DNA, 16 bp, H. sapiens
ctcaacttcaaagttc

SEQ ID NO: 84956 - DNA, 16 bp, H. sapiens
ctcaacttccccaggc

SEQ ID NO: 84957 - DNA, 16 bp, H. sapiens
ctcaacttccctggct

SEQ ID NO: 84958 - DNA, 16 bp, H. sapiens
ctcaacttctgggctc

SEQ ID NO: 84959 - DNA, 16 bp, H. sapiens
ctcaacttgataaagg

SEQ ID NO: 84960 - DNA, 16 bp, H. sapiens
ctcaactttaattttt

SEQ ID NO: 84961 - DNA, 16 bp, H. sapiens
ctcaactttctgactt

SEQ ID NO: 84962 - DNA, 16 bp, H. sapiens
ctcaactttttaaaat

SEQ ID NO: 84963 - DNA, 16 bp, H. sapiens
ctcaagaaaaaaagag

SEQ ID NO: 84964 - DNA, 16 bp, H. sapiens
ctcaagaaaagaaaga

SEQ ID NO: 84965 - DNA, 16 bp, H. sapiens
ctcaagaaaatcagag

SEQ ID NO: 84966 - DNA, 16 bp, H. sapiens
ctcaagaaacaaaaac

SEQ ID NO: 84967 - DNA, 16 bp, H. sapiens
ctcaagaagaaaagaa

SEQ ID NO: 84968 - DNA, 16 bp, H. sapiens
ctcaagacatttaaaa

SEQ ID NO: 84969 - DNA, 16 bp, H. sapiens
ctcaagagaactgaaa

SEQ ID NO: 84970 - DNA, 16 bp, H. sapiens
ctcaagagcctgaggt

SEQ ID NO: 84971 - DNA, 16 bp, H. sapiens
ctcaagaggaatgctt

SEQ ID NO: 84972 - DNA, 16 bp, H. sapiens
ctcaagatatttaata

SEQ ID NO: 84973 - DNA, 16 bp, H. sapiens
ctcaagatttttttct

SEQ ID NO: 84974 - DNA, 16 bp, H. sapiens
ctcaagcaacccttcc

SEQ ID NO: 84975 - DNA, 16 bp, H. sapiens
ctcaagcaagcctcct

SEQ ID NO: 84976 - DNA, 16 bp, H. sapiens
ctcaagcaatccttcc

SEQ ID NO: 84977 - DNA, 16 bp, H. sapiens
ctcaagcaatctgccc

SEQ ID NO: 84978 - DNA, 16 bp, H. sapiens
ctcaagcaatctgcct

SEQ ID NO: 84979 - DNA, 16 bp, H. sapiens
ctcaagcaatcttcct

SEQ ID NO: 84980 - DNA, 16 bp, H. sapiens
ctcaagcaattcttct

SEQ ID NO: 84981 - DNA, 16 bp, H. sapiens
ctcaagcacagccaga

SEQ ID NO: 84982 - DNA, 16 bp, H. sapiens
ctcaagcagtccccct

SEQ ID NO: 84983 - DNA, 16 bp, H. sapiens
ctcaagccaaaaagcc

SEQ ID NO: 84984 - DNA, 16 bp, H. sapiens
ctcaagccaccctccc

SEQ ID NO: 84985 - DNA, 16 bp, H. sapiens
ctcaagccatccaccc

SEQ ID NO: 84986 - DNA, 18 bp, H. sapiens
ctcaagccatcctcccac

SEQ ID NO: 84987 - DNA, 16 bp, H. sapiens
ctcaagcccaggagtt

SEQ ID NO: 84988 - DNA, 16 bp, H. sapiens
ctcaagcctctaatcc

SEQ ID NO: 84989 - DNA, 16 bp, H. sapiens
ctcaagcctgtgatcc

SEQ ID NO: 84990 - DNA, 16 bp, H. sapiens
ctcaagcgatctgccc

SEQ ID NO: 84991 - DNA, 16 bp, H. sapiens
ctcaagctcccaacct

SEQ ID NO: 84992 - DNA, 17 bp, H. sapiens
ctcaagctcctgacctt

SEQ ID NO: 84993 - DNA, 16 bp, H. sapiens
ctcaagctcctggctt

SEQ ID NO: 84994 - DNA, 16 bp, H. sapiens
ctcaagctggagtaca

SEQ ID NO: 84995 - DNA, 16 bp, H. sapiens
ctcaagctgtcctcct

SEQ ID NO: 84996 - DNA, 16 bp, H. sapiens
ctcaagcttctggcct

SEQ ID NO: 84997 - DNA, 16 bp, H. sapiens
ctcaaggaaccagaaa

SEQ ID NO: 84998 - DNA, 16 bp, H. sapiens
ctcaaggaattctcct

SEQ ID NO: 84999 - DNA, 16 bp, H. sapiens
ctcaaggaatttacag

SEQ ID NO: 85000 - DNA, 16 bp, H. sapiens
ctcaaggacacacagc

SEQ ID NO: 85001 - DNA, 16 bp, H. sapiens
ctcaaggagaactaca

SEQ ID NO: 85002 - DNA, 16 bp, H. sapiens
ctcaaggaggccccag

SEQ ID NO: 85003 - DNA, 16 bp, H. sapiens
ctcaaggcagaagaat

SEQ ID NO: 85004 - DNA, 16 bp, H. sapiens
ctcaaggccacacagc

SEQ ID NO: 85005 - DNA, 16 bp, H. sapiens
ctcaaggccaggagtt

SEQ ID NO: 85006 - DNA, 16 bp, H. sapiens
ctcaaggcctttgtca

SEQ ID NO: 85007 - DNA, 16 bp, H. sapiens
ctcaagggagcctccc

SEQ ID NO: 85008 - DNA, 17 bp, H. sapiens
ctcaagggatcctccca

SEQ ID NO: 85009 - DNA, 16 bp, H. sapiens
ctcaaggtcatacagc

SEQ ID NO: 85010 - DNA, 16 bp, H. sapiens
ctcaaggtcattgcca

SEQ ID NO: 85011 - DNA, 16 bp, H. sapiens
ctcaaggttacacagc

SEQ ID NO: 85012 - DNA, 18 bp, H. sapiens
ctcaaggtttgtaaatgc

SEQ ID NO: 85013 - DNA, 16 bp, H. sapiens
ctcaagtaatcctcct

SEQ ID NO: 85014 - DNA, 16 bp, H. sapiens
ctcaagtacctgggac

SEQ ID NO: 85015 - DNA, 16 bp, H. sapiens
ctcaagtcataaaaca

SEQ ID NO: 85016 - DNA, 16 bp, H. sapiens
ctcaagtcatcctcct

SEQ ID NO: 85017 - DNA, 16 bp, H. sapiens
ctcaagtcccacagtc

SEQ ID NO: 85018 - DNA, 16 bp, H. sapiens
ctcaagtgatccacct

SEQ ID NO: 85019 - DNA, 21 bp, H. sapiens
ctcaagtgatccacctgcctt

SEQ ID NO: 85020 - DNA, 16 bp, H. sapiens
ctcaagtgatccatct

SEQ ID NO: 85021 - DNA, 16 bp, H. sapiens
ctcaagtgatccgccc

SEQ ID NO: 85022 - DNA, 17 bp, H. sapiens
ctcaagtgatccgcctc

SEQ ID NO: 85023 - DNA, 16 bp, H. sapiens
ctcaagtgatcctcca

SEQ ID NO: 85024 - DNA, 16 bp, H. sapiens
ctcaagtgatctaccc

SEQ ID NO: 85025 - DNA, 16 bp, H. sapiens
ctcaagtgatctgcct

SEQ ID NO: 85026 - DNA, 16 bp, H. sapiens
ctcaagtgattctctt

SEQ ID NO: 85027 - DNA, 16 bp, H. sapiens
ctcaagtgattctgat

SEQ ID NO: 85028 - DNA, 16 bp, H. sapiens
ctcaagtggaaggaag

SEQ ID NO: 85029 - DNA, 16 bp, H. sapiens
ctcaagtggtccttct

SEQ ID NO: 85030 - DNA, 16 bp, H. sapiens
ctcaagttccaaccac

SEQ ID NO: 85031 - DNA, 16 bp, H. sapiens
ctcaagttcctcatct

SEQ ID NO: 85032 - DNA, 16 bp, H. sapiens
ctcaagtttgagaacc

SEQ ID NO: 85033 - DNA, 16 bp, H. sapiens
ctcaagtttgagaagc

SEQ ID NO: 85034 - DNA, 16 bp, H. sapiens
ctcaagtttttgtttt

SEQ ID NO: 85035 - DNA, 16 bp, H. sapiens
ctcaataaactaggca

SEQ ID NO: 85036 - DNA, 16 bp, H. sapiens
ctcaataaacttggta

SEQ ID NO: 85037 - DNA, 16 bp, H. sapiens
ctcaataaatactgtt

SEQ ID NO: 85038 - DNA, 16 bp, H. sapiens
ctcaataaatatttgt

SEQ ID NO: 85039 - DNA, 16 bp, H. sapiens
ctcaataaatgttgct

SEQ ID NO: 85040 - DNA, 16 bp, H. sapiens
ctcaataagtatttgc

SEQ ID NO: 85041 - DNA, 16 bp, H. sapiens
ctcaataattgataga

SEQ ID NO: 85042 - DNA, 16 bp, H. sapiens
ctcaatacctgcctct

SEQ ID NO: 85043 - DNA, 16 bp, H. sapiens
ctcaatagaccaataa

SEQ ID NO: 85044 - DNA, 16 bp, H. sapiens
ctcaatattgtgaaaa

SEQ ID NO: 85045 - DNA, 16 bp, H. sapiens
ctcaatcaaaagaaac

SEQ ID NO: 85046 - DNA, 16 bp, H. sapiens
ctcaatcaaaagaaag

SEQ ID NO: 85047 - DNA, 16 bp, H. sapiens
ctcaatctcccaacct

SEQ ID NO: 85048 - DNA, 16 bp, H. sapiens
ctcaatgagaagataa

SEQ ID NO: 85049 - DNA, 16 bp, H. sapiens
ctcaatgtcacaagga

SEQ ID NO: 85050 - DNA, 16 bp, H. sapiens
ctcaatgtgaagacga

SEQ ID NO: 85051 - DNA, 16 bp, H. sapiens
ctcaatttccccatct

SEQ ID NO: 85052 - DNA, 16 bp, H. sapiens
ctcaatttcctcaact

SEQ ID NO: 85053 - DNA, 16 bp, H. sapiens
ctcaatttcctcatct

SEQ ID NO: 85054 - DNA, 16 bp, H. sapiens
ctcaatttccttcctt

SEQ ID NO: 85055 - DNA, 16 bp, H. sapiens
ctcaatttcttcatct

SEQ ID NO: 85056 - DNA, 16 bp, H. sapiens
ctcaatttgataaaga

SEQ ID NO: 85057 - DNA, 16 bp, H. sapiens
ctcaatttggatttgt

SEQ ID NO: 85058 - DNA, 16 bp, H. sapiens
ctcaatttgggtttgt

SEQ ID NO: 85059 - DNA, 16 bp, H. sapiens
ctcaattttctcatct

SEQ ID NO: 85060 - DNA, 16 bp, H. sapiens
ctcaatttttagaaaa

SEQ ID NO: 85061 - DNA, 16 bp, H. sapiens
ctcaatttttctgtaa

SEQ ID NO: 85062 - DNA, 16 bp, H. sapiens
ctcacaaagatgagaa

SEQ ID NO: 85063 - DNA, 16 bp, H. sapiens
ctcacaaagctgaaaa

SEQ ID NO: 85064 - DNA, 16 bp, H. sapiens
ctcacaacaaacctat

SEQ ID NO: 85065 - DNA, 16 bp, H. sapiens
ctcacaaccaagaaaa

SEQ ID NO: 85066 - DNA, 16 bp, H. sapiens
ctcacaagttctgatg

SEQ ID NO: 85067 - DNA, 16 bp, H. sapiens
ctcacaatatttcaga

SEQ ID NO: 85068 - DNA, 16 bp, H. sapiens
ctcacaatgttgtcca

SEQ ID NO: 85069 - DNA, 16 bp, H. sapiens
ctcacaattccacagg

SEQ ID NO: 85070 - DNA, 16 bp, H. sapiens
ctcacacacacatgct

SEQ ID NO: 85071 - DNA, 16 bp, H. sapiens
ctcacacacatgcaca

SEQ ID NO: 85072 - DNA, 16 bp, H. sapiens
ctcacacacccctcgc

SEQ ID NO: 85073 - DNA, 16 bp, H. sapiens
ctcacacactctcaca

SEQ ID NO: 85074 - DNA, 16 bp, H. sapiens
ctcacaccaacagtgt

SEQ ID NO: 85075 - DNA, 16 bp, H. sapiens
ctcacaccagtcaaaa

SEQ ID NO: 85076 - DNA, 16 bp, H. sapiens
ctcacaccagtgagaa

SEQ ID NO: 85077 - DNA, 16 bp, H. sapiens
ctcacacccggtctgg

SEQ ID NO: 85078 - DNA, 16 bp, H. sapiens
ctcacacccgtaatcc

SEQ ID NO: 85079 - DNA, 16 bp, H. sapiens
ctcacacctctcatcc

SEQ ID NO: 85080 - DNA, 16 bp, H. sapiens
ctcacacctgcaatcc

SEQ ID NO: 85081 - DNA, 16 bp, H. sapiens
ctcacacctgtaatct

SEQ ID NO: 85082 - DNA, 16 bp, H. sapiens
ctcacacctgtactcc

SEQ ID NO: 85083 - DNA, 16 bp, H. sapiens
ctcacactcactcaca

SEQ ID NO: 85084 - DNA, 16 bp, H. sapiens
ctcacactcctgggct

SEQ ID NO: 85085 - DNA, 16 bp, H. sapiens
ctcacactgcaaataa

SEQ ID NO: 85086 - DNA, 16 bp, H. sapiens
ctcacactggtcagaa

SEQ ID NO: 85087 - DNA, 16 bp, H. sapiens
ctcacagaaacagaga

SEQ ID NO: 85088 - DNA, 16 bp, H. sapiens
ctcacagaactcagag

SEQ ID NO: 85089 - DNA, 16 bp, H. sapiens
ctcacagaagaggaaa

SEQ ID NO: 85090 - DNA, 16 bp, H. sapiens
ctcacagaagcagaaa

SEQ ID NO: 85091 - DNA, 16 bp, H. sapiens
ctcacagaaggtgaca

SEQ ID NO: 85092 - DNA, 16 bp, H. sapiens
ctcacagagcttacat

SEQ ID NO: 85093 - DNA, 16 bp, H. sapiens
ctcacagcacatctca

SEQ ID NO: 85094 - DNA, 16 bp, H. sapiens
ctcacagcagccctgg

SEQ ID NO: 85095 - DNA, 16 bp, H. sapiens
ctcacagcagcctctg

SEQ ID NO: 85096 - DNA, 26 bp, H. sapiens
ctcacagccttcagagctgagagcct

SEQ ID NO: 85097 - DNA, 16 bp, H. sapiens
ctcacagctctggaag

SEQ ID NO: 85098 - DNA, 16 bp, H. sapiens
ctcacagctctggagg

SEQ ID NO: 85099 - DNA, 16 bp, H. sapiens
ctcacaggaaacttgt

SEQ ID NO: 85100 - DNA, 16 bp, H. sapiens
ctcacagggatgttgt

SEQ ID NO: 85101 - DNA, 16 bp, H. sapiens
ctcacagtaacctcaa

SEQ ID NO: 85102 - DNA, 16 bp, H. sapiens
ctcacagtagaacttc

SEQ ID NO: 85103 - DNA, 16 bp, H. sapiens
ctcacagtatttgggg

SEQ ID NO: 85104 - DNA, 16 bp, H. sapiens
ctcacagtgctggagg

SEQ ID NO: 85105 - DNA, 16 bp, H. sapiens
ctcacagttcaacatg

SEQ ID NO: 85106 - DNA, 16 bp, H. sapiens
ctcacagttccacatg

SEQ ID NO: 85107 - DNA, 16 bp, H. sapiens
ctcacagttccagaag

SEQ ID NO: 85108 - DNA, 16 bp, H. sapiens
ctcacagttccatatg

SEQ ID NO: 85109 - DNA, 16 bp, H. sapiens
ctcacagttctgcagg

SEQ ID NO: 85110 - DNA, 16 bp, H. sapiens
ctcacagttctggaag

SEQ ID NO: 85111 - DNA, 16 bp, H. sapiens
ctcacagttcttcagg

SEQ ID NO: 85112 - DNA, 16 bp, H. sapiens
ctcacagttgtagagg

SEQ ID NO: 85113 - DNA, 16 bp, H. sapiens
ctcacagttttggaga

SEQ ID NO: 85114 - DNA, 16 bp, H. sapiens
ctcacatatttattac

SEQ ID NO: 85115 - DNA, 16 bp, H. sapiens
ctcacatcccacatcc

SEQ ID NO: 85116 - DNA, 16 bp, H. sapiens
ctcacatgcagacaca

SEQ ID NO: 85117 - DNA, 16 bp, H. sapiens
ctcacatggcagaaag

SEQ ID NO: 85118 - DNA, 16 bp, H. sapiens
ctcacatgtggaagct

SEQ ID NO: 85119 - DNA, 16 bp, H. sapiens
ctcacattccttggct

SEQ ID NO: 85120 - DNA, 16 bp, H. sapiens
ctcacatttatttcaa

SEQ ID NO: 85121 - DNA, 16 bp, H. sapiens
ctcacatttcaaaaca

SEQ ID NO: 85122 - DNA, 16 bp, H. sapiens
ctcaccaacagtgtaa

SEQ ID NO: 85123 - DNA, 16 bp, H. sapiens
ctcaccaacatggaga

SEQ ID NO: 85124 - DNA, 16 bp, H. sapiens
ctcaccaccaagccca

SEQ ID NO: 85125 - DNA, 16 bp, H. sapiens
ctcaccaccacacctg

SEQ ID NO: 85126 - DNA, 16 bp, H. sapiens
ctcaccacctgtttct

SEQ ID NO: 85127 - DNA, 16 bp, H. sapiens
ctcaccactgtgctcc

SEQ ID NO: 85128 - DNA, 16 bp, H. sapiens
ctcaccagaagccaag

SEQ ID NO: 85129 - DNA, 16 bp, H. sapiens
ctcaccagacaatgaa

SEQ ID NO: 85130 - DNA, 16 bp, H. sapiens
ctcaccagcatctgtt

SEQ ID NO: 85131 - DNA, 16 bp, H. sapiens
ctcaccagtttcctct

SEQ ID NO: 85132 - DNA, 16 bp, H. sapiens
ctcaccatagcctcca

SEQ ID NO: 85133 - DNA, 16 bp, H. sapiens
ctcaccatgtgccagg

SEQ ID NO: 85134 - DNA, 16 bp, H. sapiens
ctcaccattgctccat

SEQ ID NO: 85135 - DNA, 16 bp, H. sapiens
ctcaccatttctatta

SEQ ID NO: 85136 - DNA, 16 bp, H. sapiens
ctcacccaacacataa

SEQ ID NO: 85137 - DNA, 16 bp, H. sapiens
ctcacccaaggtcaca

SEQ ID NO: 85138 - DNA, 16 bp, H. sapiens
ctcacccacagcagct

SEQ ID NO: 85139 - DNA, 16 bp, H. sapiens
ctcacccagagcagct

SEQ ID NO: 85140 - DNA, 16 bp, H. sapiens
ctcacccaggctgggg

SEQ ID NO: 85141 - DNA, 16 bp, H. sapiens
ctcacccagttgggtg

SEQ ID NO: 85142 - DNA, 16 bp, H. sapiens
ctcacccattcattca

SEQ ID NO: 85143 - DNA, 16 bp, H. sapiens
ctcaccccagcctcct

SEQ ID NO: 85144 - DNA, 16 bp, H. sapiens
ctcaccccagctcctg

SEQ ID NO: 85145 - DNA, 16 bp, H. sapiens
ctcacccctgaaatcc

SEQ ID NO: 85146 - DNA, 16 bp, H. sapiens
ctcaccccttccccag

SEQ ID NO: 85147 - DNA, 16 bp, H. sapiens
ctcacccgcctcagcc

SEQ ID NO: 85148 - DNA, 16 bp, H. sapiens
ctcaccctatcaccca

SEQ ID NO: 85149 - DNA, 16 bp, H. sapiens
ctcaccctcctgggct

SEQ ID NO: 85150 - DNA, 16 bp, H. sapiens
ctcaccctctctgagc

SEQ ID NO: 85151 - DNA, 16 bp, H. sapiens
ctcaccctgcagatct

SEQ ID NO: 85152 - DNA, 16 bp, H. sapiens
ctcaccctgtcaccca

SEQ ID NO: 85153 - DNA, 19 bp, H. sapiens
ctcaccgcaacctctgcct

SEQ ID NO: 85154 - DNA, 16 bp, H. sapiens
ctcaccgcaacctgca

SEQ ID NO: 85155 - DNA, 16 bp, H. sapiens
ctcaccgcaagctccg

SEQ ID NO: 85156 - DNA, 16 bp, H. sapiens
ctcacctcactgcaag

SEQ ID NO: 85157 - DNA, 16 bp, H. sapiens
ctcacctcactgcaat

SEQ ID NO: 85158 - DNA, 19 bp, H. sapiens
ctcacctcagcctcccaaa

SEQ ID NO: 85159 - DNA, 16 bp, H. sapiens
ctcacctcctgctctg

SEQ ID NO: 85160 - DNA, 16 bp, H. sapiens
ctcacctcctgctggg

SEQ ID NO: 85161 - DNA, 16 bp, H. sapiens
ctcacctcctgctgtg

SEQ ID NO: 85162 - DNA, 16 bp, H. sapiens
ctcacctcctgttgtg

SEQ ID NO: 85163 - DNA, 16 bp, H. sapiens
ctcacctccttctgtg

SEQ ID NO: 85164 - DNA, 16 bp, H. sapiens
ctcacctctcagcctt

SEQ ID NO: 85165 - DNA, 16 bp, H. sapiens
ctcacctctctgggcc

SEQ ID NO: 85166 - DNA, 16 bp, H. sapiens
ctcacctctgcctccc

SEQ ID NO: 85167 - DNA, 20 bp, H. sapiens
ctcacctgaggtcaggagtt

SEQ ID NO: 85168 - DNA, 16 bp, H. sapiens
ctcacctgggaagcgc

SEQ ID NO: 85169 - DNA, 16 bp, H. sapiens
ctcacctggggatgtg

SEQ ID NO: 85170 - DNA, 16 bp, H. sapiens
ctcacgagagctgatg

SEQ ID NO: 85171 - DNA, 16 bp, H. sapiens
ctcacgaggtcaggag

SEQ ID NO: 85172 - DNA, 16 bp, H. sapiens
ctcacgcctgtatccc

SEQ ID NO: 85173 - DNA, 17 bp, H. sapiens
ctcacgctgggagctgt

SEQ ID NO: 85174 - DNA, 16 bp, H. sapiens
ctcactaaagccttga

SEQ ID NO: 85175 - DNA, 16 bp, H. sapiens
ctcactacctgtgtga

SEQ ID NO: 85176 - DNA, 16 bp, H. sapiens
ctcactcaaaaccact

SEQ ID NO: 85177 - DNA, 16 bp, H. sapiens
ctcactcaaaaccgct

SEQ ID NO: 85178 - DNA, 16 bp, H. sapiens
ctcactcaaaactgct

SEQ ID NO: 85179 - DNA, 16 bp, H. sapiens
ctcactcaaagccgct

SEQ ID NO: 85180 - DNA, 16 bp, H. sapiens
ctcactcaaagctgct

SEQ ID NO: 85181 - DNA, 16 bp, H. sapiens
ctcactcaagaagaaa

SEQ ID NO: 85182 - DNA, 16 bp, H. sapiens
ctcactcacacacaca

SEQ ID NO: 85183 - DNA, 16 bp, H. sapiens
ctcactcacagatggg

SEQ ID NO: 85184 - DNA, 16 bp, H. sapiens
ctcactcacccactgc

SEQ ID NO: 85185 - DNA, 16 bp, H. sapiens
ctcactcacctgctgc

SEQ ID NO: 85186 - DNA, 16 bp, H. sapiens
ctcactcactcactcc

SEQ ID NO: 85187 - DNA, 16 bp, H. sapiens
ctcactcactctcaca

SEQ ID NO: 85188 - DNA, 16 bp, H. sapiens
ctcactcatttgttca

SEQ ID NO: 85189 - DNA, 16 bp, H. sapiens
ctcactccatctccca

SEQ ID NO: 85190 - DNA, 16 bp, H. sapiens
ctcactccctcactca

SEQ ID NO: 85191 - DNA, 16 bp, H. sapiens
ctcactccctcctgcc

SEQ ID NO: 85192 - DNA, 16 bp, H. sapiens
ctcactccgtcatcca

SEQ ID NO: 85193 - DNA, 16 bp, H. sapiens
ctcactctcagcacct

SEQ ID NO: 85194 - DNA, 16 bp, H. sapiens
ctcactctcggtgcct

SEQ ID NO: 85195 - DNA, 16 bp, H. sapiens
ctcactctctcaccca

SEQ ID NO: 85196 - DNA, 16 bp, H. sapiens
ctcactctctggtgtc

SEQ ID NO: 85197 - DNA, 16 bp, H. sapiens
ctcactctcttgctca

SEQ ID NO: 85198 - DNA, 17 bp, H. sapiens
ctcactctgggcactat

SEQ ID NO: 85199 - DNA, 16 bp, H. sapiens
ctcactctgtctctca

SEQ ID NO: 85200 - DNA, 16 bp, H. sapiens
ctcactctgtctgcca

SEQ ID NO: 85201 - DNA, 16 bp, H. sapiens
ctcactctgtttccca

SEQ ID NO: 85202 - DNA, 16 bp, H. sapiens
ctcactctgtttcctg

SEQ ID NO: 85203 - DNA, 16 bp, H. sapiens
ctcactcttgcttcct

SEQ ID NO: 85204 - DNA, 16 bp, H. sapiens
ctcactgaaaaccaca

SEQ ID NO: 85205 - DNA, 16 bp, H. sapiens
ctcactgaagccttga

SEQ ID NO: 85206 - DNA, 16 bp, H. sapiens
ctcactgaagctttga

SEQ ID NO: 85207 - DNA, 16 bp, H. sapiens
ctcactgaatcttcac

SEQ ID NO: 85208 - DNA, 17 bp, H. sapiens
ctcactgacgcagcagc

SEQ ID NO: 85209 - DNA, 16 bp, H. sapiens
ctcactgaggaggtga

SEQ ID NO: 85210 - DNA, 16 bp, H. sapiens
ctcactgagtcctcac

SEQ ID NO: 85211 - DNA, 16 bp, H. sapiens
ctcactgcaaactcca

SEQ ID NO: 85212 - DNA, 17 bp, H. sapiens
ctcactgcaacctccga

SEQ ID NO: 85213 - DNA, 22 bp, H. sapiens
ctcactgcaacctctgccttcc

SEQ ID NO: 85214 - DNA, 16 bp, H. sapiens
ctcactgcaacctgaa

SEQ ID NO: 85215 - DNA, 16 bp, H. sapiens
ctcactgcaagccctg

SEQ ID NO: 85216 - DNA, 29 bp, H. sapiens
ctcactgcaagctccgcctcctgggttca

SEQ ID NO: 85217 - DNA, 16 bp, H. sapiens
ctcactgcaatctcct

SEQ ID NO: 85218 - DNA, 16 bp, H. sapiens
ctcactgcactccagc

SEQ ID NO: 85219 - DNA, 16 bp, H. sapiens
ctcactgcagccactg

SEQ ID NO: 85220 - DNA, 16 bp, H. sapiens
ctcactgcagccccaa

SEQ ID NO: 85221 - DNA, 16 bp, H. sapiens
ctcactgcagccccca

SEQ ID NO: 85222 - DNA, 16 bp, H. sapiens
ctcactgcagcccctg

SEQ ID NO: 85223 - DNA, 16 bp, H. sapiens
ctcactgcagccctga

SEQ ID NO: 85224 - DNA, 16 bp, H. sapiens
ctcactgcagccctgg

SEQ ID NO: 85225 - DNA, 16 bp, H. sapiens
ctcactgcagcctccc

SEQ ID NO: 85226 - DNA, 16 bp, H. sapiens
ctcactgcagcctcgg

SEQ ID NO: 85227 - DNA, 16 bp, H. sapiens
ctcactgcagccttga

SEQ ID NO: 85228 - DNA, 16 bp, H. sapiens
ctcactgcagccttgg

SEQ ID NO: 85229 - DNA, 16 bp, H. sapiens
ctcactgcaggctcag

SEQ ID NO: 85230 - DNA, 18 bp, H. sapiens
ctcactgcaggctccgcc

SEQ ID NO: 85231 - DNA, 16 bp, H. sapiens
ctcactgcagtcttga

SEQ ID NO: 85232 - DNA, 16 bp, H. sapiens
ctcactgcagtgtcaa

SEQ ID NO: 85233 - DNA, 16 bp, H. sapiens
ctcactgcagtttcaa

SEQ ID NO: 85234 - DNA, 16 bp, H. sapiens
ctcactgcatccttga

SEQ ID NO: 85235 - DNA, 16 bp, H. sapiens
ctcactgcggcctccc

SEQ ID NO: 85236 - DNA, 16 bp, H. sapiens
ctcactgctgcaacct

SEQ ID NO: 85237 - DNA, 16 bp, H. sapiens
ctcactggcatccctg

SEQ ID NO: 85238 - DNA, 16 bp, H. sapiens
ctcactggctgcctgg

SEQ ID NO: 85239 - DNA, 16 bp, H. sapiens
ctcactgtagcctccc

SEQ ID NO: 85240 - DNA, 16 bp, H. sapiens
ctcactgtctcaccca

SEQ ID NO: 85241 - DNA, 16 bp, H. sapiens
ctcactgtcttccaca

SEQ ID NO: 85242 - DNA, 16 bp, H. sapiens
ctcactgtgacttctg

SEQ ID NO: 85243 - DNA, 16 bp, H. sapiens
ctcactgtggcccagg

SEQ ID NO: 85244 - DNA, 16 bp, H. sapiens
ctcactgtgtcctcag

SEQ ID NO: 85245 - DNA, 16 bp, H. sapiens
ctcactgtgtgtgtgt

SEQ ID NO: 85246 - DNA, 16 bp, H. sapiens
ctcactgtgttatcca

SEQ ID NO: 85247 - DNA, 16 bp, H. sapiens
ctcacttcaacctctg

SEQ ID NO: 85248 - DNA, 16 bp, H. sapiens
ctcacttcagcttccc

SEQ ID NO: 85249 - DNA, 17 bp, H. sapiens
ctcacttcccagacagt

SEQ ID NO: 85250 - DNA, 16 bp, H. sapiens
ctcacttcctgctgtg

SEQ ID NO: 85251 - DNA, 16 bp, H. sapiens
ctcacttcctggttca

SEQ ID NO: 85252 - DNA, 16 bp, H. sapiens
ctcacttctgacacca

SEQ ID NO: 85253 - DNA, 16 bp, H. sapiens
ctcactttctcctgtg

SEQ ID NO: 85254 - DNA, 16 bp, H. sapiens
ctcactttgtcgccag

SEQ ID NO: 85255 - DNA, 16 bp, H. sapiens
ctcactttttaaaaca

SEQ ID NO: 85256 - DNA, 16 bp, H. sapiens
ctcagaaaaagaaaag

SEQ ID NO: 85257 - DNA, 16 bp, H. sapiens
ctcagaaaaggaaaaa

SEQ ID NO: 85258 - DNA, 16 bp, H. sapiens
ctcagaaaataataat

SEQ ID NO: 85259 - DNA, 16 bp, H. sapiens
ctcagaaactactttg

SEQ ID NO: 85260 - DNA, 16 bp, H. sapiens
ctcagaaacttctttc

SEQ ID NO: 85261 - DNA, 16 bp, H. sapiens
ctcagaaagcttccat

SEQ ID NO: 85262 - DNA, 16 bp, H. sapiens
ctcagaaagtgaaacc

SEQ ID NO: 85263 - DNA, 16 bp, H. sapiens
ctcagaaataaaaaga

SEQ ID NO: 85264 - DNA, 18 bp, H. sapiens
ctcagaaataataccaca

SEQ ID NO: 85265 - DNA, 16 bp, H. sapiens
ctcagaaatatttgtt

SEQ ID NO: 85266 - DNA, 16 bp, H. sapiens
ctcagaaatcactgct

SEQ ID NO: 85267 - DNA, 16 bp, H. sapiens
ctcagaacaaacaaac

SEQ ID NO: 85268 - DNA, 16 bp, H. sapiens
ctcagaaccctgcagc

SEQ ID NO: 85269 - DNA, 16 bp, H. sapiens
ctcagaagaaaaagaa

SEQ ID NO: 85270 - DNA, 16 bp, H. sapiens
ctcagaagaaaacaaa

SEQ ID NO: 85271 - DNA, 16 bp, H. sapiens
ctcagaagaaaacaga

SEQ ID NO: 85272 - DNA, 16 bp, H. sapiens
ctcagaagaaaaggag

SEQ ID NO: 85273 - DNA, 16 bp, H. sapiens
ctcagaagaaacaaga

SEQ ID NO: 85274 - DNA, 16 bp, H. sapiens
ctcagaagaaaccaaa

SEQ ID NO: 85275 - DNA, 16 bp, H. sapiens
ctcagaagaagacaaa

SEQ ID NO: 85276 - DNA, 16 bp, H. sapiens
ctcagaagaagacaag

SEQ ID NO: 85277 - DNA, 16 bp, H. sapiens
ctcagaagacaggaaa

SEQ ID NO: 85278 - DNA, 16 bp, H. sapiens
ctcagaagataggaaa

SEQ ID NO: 85279 - DNA, 16 bp, H. sapiens
ctcagaagccccctag

SEQ ID NO: 85280 - DNA, 16 bp, H. sapiens
ctcagaaggagaggag

SEQ ID NO: 85281 - DNA, 16 bp, H. sapiens
ctcagaaggggcgggg

SEQ ID NO: 85282 - DNA, 16 bp, H. sapiens
ctcagaatcttctttg

SEQ ID NO: 85283 - DNA, 16 bp, H. sapiens
ctcagaatgctacagg

SEQ ID NO: 85284 - DNA, 16 bp, H. sapiens
ctcagaatgcttctga

SEQ ID NO: 85285 - DNA, 16 bp, H. sapiens
ctcagaatggaggaag

SEQ ID NO: 85286 - DNA, 16 bp, H. sapiens
ctcagaatgggagaaa

SEQ ID NO: 85287 - DNA, 16 bp, H. sapiens
ctcagaattagaaaaa

SEQ ID NO: 85288 - DNA, 16 bp, H. sapiens
ctcagacaggagaatc

SEQ ID NO: 85289 - DNA, 16 bp, H. sapiens
ctcagacatttcttta

SEQ ID NO: 85290 - DNA, 16 bp, H. sapiens
ctcagaccacagcaga

SEQ ID NO: 85291 - DNA, 22 bp, H. sapiens
ctcagaccacagtgcaattaaa

SEQ ID NO: 85292 - DNA, 22 bp, H. sapiens
ctcagaccacagtgcgatcaaa

SEQ ID NO: 85293 - DNA, 16 bp, H. sapiens
ctcagaccttgcccca

SEQ ID NO: 85294 - DNA, 16 bp, H. sapiens
ctcagactacaggtgc

SEQ ID NO: 85295 - DNA, 16 bp, H. sapiens
ctcagactccccagta

SEQ ID NO: 85296 - DNA, 16 bp, H. sapiens
ctcagactcctgggct

SEQ ID NO: 85297 - DNA, 16 bp, H. sapiens
ctcagactgctgtgct

SEQ ID NO: 85298 - DNA, 16 bp, H. sapiens
ctcagactggaactca

SEQ ID NO: 85299 - DNA, 16 bp, H. sapiens
ctcagacttccaacct

SEQ ID NO: 85300 - DNA, 16 bp, H. sapiens
ctcagagaaaaagatt

SEQ ID NO: 85301 - DNA, 16 bp, H. sapiens
ctcagagaagccttcc

SEQ ID NO: 85302 - DNA, 16 bp, H. sapiens
ctcagagaatgtcaaa

SEQ ID NO: 85303 - DNA, 16 bp, H. sapiens
ctcagagacccagaga

SEQ ID NO: 85304 - DNA, 16 bp, H. sapiens
ctcagagagactccag

SEQ ID NO: 85305 - DNA, 16 bp, H. sapiens
ctcagagaggcctttc

SEQ ID NO: 85306 - DNA, 16 bp, H. sapiens
ctcagagatctagaac

SEQ ID NO: 85307 - DNA, 16 bp, H. sapiens
ctcagagattctgatt

SEQ ID NO: 85308 - DNA, 16 bp, H. sapiens
ctcagagcccagcaca

SEQ ID NO: 85309 - DNA, 16 bp, H. sapiens
ctcagagccctcgctt

SEQ ID NO: 85310 - DNA, 16 bp, H. sapiens
ctcagagcctcagttt

SEQ ID NO: 85311 - DNA, 16 bp, H. sapiens
ctcagagcttgaagat

SEQ ID NO: 85312 - DNA, 16 bp, H. sapiens
ctcagaggctcaccaa

SEQ ID NO: 85313 - DNA, 16 bp, H. sapiens
ctcagaggctgccagg

SEQ ID NO: 85314 - DNA, 16 bp, H. sapiens
ctcagagggagatgag

SEQ ID NO: 85315 - DNA, 16 bp, H. sapiens
ctcagaggtggcagag

SEQ ID NO: 85316 - DNA, 16 bp, H. sapiens
ctcagagtaaaagcca

SEQ ID NO: 85317 - DNA, 16 bp, H. sapiens
ctcagagtgatggttt

SEQ ID NO: 85318 - DNA, 16 bp, H. sapiens
ctcagataatttttaa

SEQ ID NO: 85319 - DNA, 16 bp, H. sapiens
ctcagatcaagaaaca

SEQ ID NO: 85320 - DNA, 16 bp, H. sapiens
ctcagatcactgcaac

SEQ ID NO: 85321 - DNA, 16 bp, H. sapiens
ctcagatgacatttct

SEQ ID NO: 85322 - DNA, 16 bp, H. sapiens
ctcagatgatccaccc

SEQ ID NO: 85323 - DNA, 16 bp, H. sapiens
ctcagatgattcaccc

SEQ ID NO: 85324 - DNA, 16 bp, H. sapiens
ctcagattcctgagta

SEQ ID NO: 85325 - DNA, 16 bp, H. sapiens
ctcagatttccagcct

SEQ ID NO: 85326 - DNA, 16 bp, H. sapiens
ctcagattttgggggt

SEQ ID NO: 85327 - DNA, 16 bp, H. sapiens
ctcagcaaagccactg

SEQ ID NO: 85328 - DNA, 25 bp, H. sapiens
ctcagcaaagtctcaggatacaaaa

SEQ ID NO: 85329 - DNA, 16 bp, H. sapiens
ctcagcaaatgtgaaa

SEQ ID NO: 85330 - DNA, 16 bp, H. sapiens
ctcagcaacatttatt

SEQ ID NO: 85331 - DNA, 16 bp, H. sapiens
ctcagcaacctctgcc

SEQ ID NO: 85332 - DNA, 16 bp, H. sapiens
ctcagcaaggctgctg

SEQ ID NO: 85333 - DNA, 16 bp, H. sapiens
ctcagcaatggcagat

SEQ ID NO: 85334 - DNA, 16 bp, H. sapiens
ctcagcaattccattt

SEQ ID NO: 85335 - DNA, 16 bp, H. sapiens
ctcagcacactgcagc

SEQ ID NO: 85336 - DNA, 16 bp, H. sapiens
ctcagcacagacccgg

SEQ ID NO: 85337 - DNA, 16 bp, H. sapiens
ctcagcacagcacagc

SEQ ID NO: 85338 - DNA, 16 bp, H. sapiens
ctcagcacagtgcctg

SEQ ID NO: 85339 - DNA, 16 bp, H. sapiens
ctcagcacagtgtctg

SEQ ID NO: 85340 - DNA, 16 bp, H. sapiens
ctcagcaccacaccgc

SEQ ID NO: 85341 - DNA, 16 bp, H. sapiens
ctcagcaccacattgc

SEQ ID NO: 85342 - DNA, 16 bp, H. sapiens
ctcagcactctggaag

SEQ ID NO: 85343 - DNA, 16 bp, H. sapiens
ctcagcactgccccct

SEQ ID NO: 85344 - DNA, 16 bp, H. sapiens
ctcagcacttcttctt

SEQ ID NO: 85345 - DNA, 16 bp, H. sapiens
ctcagcactttaggaa

SEQ ID NO: 85346 - DNA, 16 bp, H. sapiens
ctcagcactttaggag

SEQ ID NO: 85347 - DNA, 16 bp, H. sapiens
ctcagcagaaatccta

SEQ ID NO: 85348 - DNA, 16 bp, H. sapiens
ctcagcagagaggagg

SEQ ID NO: 85349 - DNA, 16 bp, H. sapiens
ctcagcagatcccacc

SEQ ID NO: 85350 - DNA, 16 bp, H. sapiens
ctcagcaggctgaagt

SEQ ID NO: 85351 - DNA, 16 bp, H. sapiens
ctcagcatcctgaata

SEQ ID NO: 85352 - DNA, 16 bp, H. sapiens
ctcagcatttggttgt

SEQ ID NO: 85353 - DNA, 16 bp, H. sapiens
ctcagcattttgagag

SEQ ID NO: 85354 - DNA, 16 bp, H. sapiens
ctcagcattttgggaa

SEQ ID NO: 85355 - DNA, 16 bp, H. sapiens
ctcagcattttttttt

SEQ ID NO: 85356 - DNA, 16 bp, H. sapiens
ctcagccacagcagga

SEQ ID NO: 85357 - DNA, 16 bp, H. sapiens
ctcagccacccaaagt

SEQ ID NO: 85358 - DNA, 16 bp, H. sapiens
ctcagccacccaaata

SEQ ID NO: 85359 - DNA, 16 bp, H. sapiens
ctcagccacccagagt

SEQ ID NO: 85360 - DNA, 16 bp, H. sapiens
ctcagccacctcccca

SEQ ID NO: 85361 - DNA, 16 bp, H. sapiens
ctcagccaggcacggt

SEQ ID NO: 85362 - DNA, 16 bp, H. sapiens
ctcagccaggcgtggt

SEQ ID NO: 85363 - DNA, 16 bp, H. sapiens
ctcagccaggctggag

SEQ ID NO: 85364 - DNA, 16 bp, H. sapiens
ctcagcccacagctct

SEQ ID NO: 85365 - DNA, 16 bp, H. sapiens
ctcagcccactgcaag

SEQ ID NO: 85366 - DNA, 16 bp, H. sapiens
ctcagcccacttgcac

SEQ ID NO: 85367 - DNA, 16 bp, H. sapiens
ctcagcccagactcag

SEQ ID NO: 85368 - DNA, 16 bp, H. sapiens
ctcagcccagcaggct

SEQ ID NO: 85369 - DNA, 16 bp, H. sapiens
ctcagcccagccctgg

SEQ ID NO: 85370 - DNA, 16 bp, H. sapiens
ctcagccccagcccag

SEQ ID NO: 85371 - DNA, 16 bp, H. sapiens
ctcagccccagcccca

SEQ ID NO: 85372 - DNA, 16 bp, H. sapiens
ctcagccccagccctg

SEQ ID NO: 85373 - DNA, 16 bp, H. sapiens
ctcagcccccaaagtg

SEQ ID NO: 85374 - DNA, 16 bp, H. sapiens
ctcagccccctccaga

SEQ ID NO: 85375 - DNA, 16 bp, H. sapiens
ctcagccccctctgga

SEQ ID NO: 85376 - DNA, 16 bp, H. sapiens
ctcagcccctccagca

SEQ ID NO: 85377 - DNA, 16 bp, H. sapiens
ctcagccctcctgagt

SEQ ID NO: 85378 - DNA, 16 bp, H. sapiens
ctcagccctgcccagg

SEQ ID NO: 85379 - DNA, 16 bp, H. sapiens
ctcagccctgctcacc

SEQ ID NO: 85380 - DNA, 16 bp, H. sapiens
ctcagccctgctcact

SEQ ID NO: 85381 - DNA, 16 bp, H. sapiens
ctcagccctgggcctg

SEQ ID NO: 85382 - DNA, 16 bp, H. sapiens
ctcagcctactgagca

SEQ ID NO: 85383 - DNA, 16 bp, H. sapiens
ctcagcctcacaagtg

SEQ ID NO: 85384 - DNA, 16 bp, H. sapiens
ctcagcctcagcccca

SEQ ID NO: 85385 - DNA, 16 bp, H. sapiens
ctcagcctcagcctcc

SEQ ID NO: 85386 - DNA, 16 bp, H. sapiens
ctcagcctccaaagtg

SEQ ID NO: 85387 - DNA, 16 bp, H. sapiens
ctcagcctccaagcag

SEQ ID NO: 85388 - DNA, 16 bp, H. sapiens
ctcagcctccacagca

SEQ ID NO: 85389 - DNA, 16 bp, H. sapiens
ctcagcctccactccc

SEQ ID NO: 85390 - DNA, 16 bp, H. sapiens
ctcagcctccagaaca

SEQ ID NO: 85391 - DNA, 16 bp, H. sapiens
ctcagcctccagagct

SEQ ID NO: 85392 - DNA, 16 bp, H. sapiens
ctcagcctccagagga

SEQ ID NO: 85393 - DNA, 16 bp, H. sapiens
ctcagcctccaggact

SEQ ID NO: 85394 - DNA, 16 bp, H. sapiens
ctcagcctcccaaagc

SEQ ID NO: 85395 - DNA, 17 bp, H. sapiens
ctcagcctcccaaagca

SEQ ID NO: 85396 - DNA, 16 bp, H. sapiens
ctcagcctcccaaagg

SEQ ID NO: 85397 - DNA, 16 bp, H. sapiens
ctcagcctcccacaat

SEQ ID NO: 85398 - DNA, 16 bp, H. sapiens
ctcagcctcccacagt

SEQ ID NO: 85399 - DNA, 16 bp, H. sapiens
ctcagcctcccagagt

SEQ ID NO: 85400 - DNA, 16 bp, H. sapiens
ctcagcctccccaagg

SEQ ID NO: 85401 - DNA, 16 bp, H. sapiens
ctcagcctccctaagt

SEQ ID NO: 85402 - DNA, 16 bp, H. sapiens
ctcagcctccctagtt

SEQ ID NO: 85403 - DNA, 16 bp, H. sapiens
ctcagcctccctgtag

SEQ ID NO: 85404 - DNA, 16 bp, H. sapiens
ctcagcctcctcccaa

SEQ ID NO: 85405 - DNA, 16 bp, H. sapiens
ctcagcctcctctccc

SEQ ID NO: 85406 - DNA, 16 bp, H. sapiens
ctcagcctcctctcct

SEQ ID NO: 85407 - DNA, 16 bp, H. sapiens
ctcagcctcctgagga

SEQ ID NO: 85408 - DNA, 16 bp, H. sapiens
ctcagcctcctggagt

SEQ ID NO: 85409 - DNA, 16 bp, H. sapiens
ctcagcctcctggctt

SEQ ID NO: 85410 - DNA, 16 bp, H. sapiens
ctcagcctcctgggag

SEQ ID NO: 85411 - DNA, 16 bp, H. sapiens
ctcagcctcctgtgtt

SEQ ID NO: 85412 - DNA, 16 bp, H. sapiens
ctcagcctctcaggct

SEQ ID NO: 85413 - DNA, 16 bp, H. sapiens
ctcagcctctctgagc

SEQ ID NO: 85414 - DNA, 16 bp, H. sapiens
ctcagcctctctgggc

SEQ ID NO: 85415 - DNA, 16 bp, H. sapiens
ctcagcctctgagcag

SEQ ID NO: 85416 - DNA, 16 bp, H. sapiens
ctcagcctctggagtg

SEQ ID NO: 85417 - DNA, 16 bp, H. sapiens
ctcagcctcttgggtt

SEQ ID NO: 85418 - DNA, 16 bp, H. sapiens
ctcagcctctttcctc

SEQ ID NO: 85419 - DNA, 16 bp, H. sapiens
ctcagcctctttctcc

SEQ ID NO: 85420 - DNA, 16 bp, H. sapiens
ctcagcctgcagctct

SEQ ID NO: 85421 - DNA, 16 bp, H. sapiens
ctcagcctggaaaagc

SEQ ID NO: 85422 - DNA, 16 bp, H. sapiens
ctcagcctggcaggct

SEQ ID NO: 85423 - DNA, 16 bp, H. sapiens
ctcagcctggccttca

SEQ ID NO: 85424 - DNA, 16 bp, H. sapiens
ctcagcctgggggaca

SEQ ID NO: 85425 - DNA, 16 bp, H. sapiens
ctcagccttccgagtt

SEQ ID NO: 85426 - DNA, 16 bp, H. sapiens
ctcagccttcctgagt

SEQ ID NO: 85427 - DNA, 16 bp, H. sapiens
ctcagccttggtttcc

SEQ ID NO: 85428 - DNA, 16 bp, H. sapiens
ctcagctacttgggat

SEQ ID NO: 85429 - DNA, 16 bp, H. sapiens
ctcagctagtttttgt

SEQ ID NO: 85430 - DNA, 16 bp, H. sapiens
ctcagctcactgaagc

SEQ ID NO: 85431 - DNA, 16 bp, H. sapiens
ctcagctcacttcaat

SEQ ID NO: 85432 - DNA, 16 bp, H. sapiens
ctcagctcagcctccc

SEQ ID NO: 85433 - DNA, 16 bp, H. sapiens
ctcagctcagcctcct

SEQ ID NO: 85434 - DNA, 16 bp, H. sapiens
ctcagctcattgcaag

SEQ ID NO: 85435 - DNA, 16 bp, H. sapiens
ctcagctcccctgcca

SEQ ID NO: 85436 - DNA, 16 bp, H. sapiens
ctcagctccctgcagc

SEQ ID NO: 85437 - DNA, 16 bp, H. sapiens
ctcagctcctcaggag

SEQ ID NO: 85438 - DNA, 16 bp, H. sapiens
ctcagctcctggcaac

SEQ ID NO: 85439 - DNA, 16 bp, H. sapiens
ctcagctcctggggct

SEQ ID NO: 85440 - DNA, 16 bp, H. sapiens
ctcagctctgcaacct

SEQ ID NO: 85441 - DNA, 16 bp, H. sapiens
ctcagctctgcaccag

SEQ ID NO: 85442 - DNA, 16 bp, H. sapiens
ctcagctctgccacct

SEQ ID NO: 85443 - DNA, 16 bp, H. sapiens
ctcagctgaaggtctg

SEQ ID NO: 85444 - DNA, 16 bp, H. sapiens
ctcagctgacacccac

SEQ ID NO: 85445 - DNA, 16 bp, H. sapiens
ctcagctgacagaaca

SEQ ID NO: 85446 - DNA, 16 bp, H. sapiens
ctcagctgaggcagga

SEQ ID NO: 85447 - DNA, 16 bp, H. sapiens
ctcagctgcagtgcaa

SEQ ID NO: 85448 - DNA, 16 bp, H. sapiens
ctcagctggcagcaac

SEQ ID NO: 85449 - DNA, 16 bp, H. sapiens
ctcagctgtgaaatgg

SEQ ID NO: 85450 - DNA, 16 bp, H. sapiens
ctcagctgtgtccagt

SEQ ID NO: 85451 - DNA, 16 bp, H. sapiens
ctcagcttcaacaatt

SEQ ID NO: 85452 - DNA, 16 bp, H. sapiens
ctcagcttcacaaagt

SEQ ID NO: 85453 - DNA, 16 bp, H. sapiens
ctcagcttcatgagta

SEQ ID NO: 85454 - DNA, 16 bp, H. sapiens
ctcagcttcccaagaa

SEQ ID NO: 85455 - DNA, 16 bp, H. sapiens
ctcagcttcccaaggt

SEQ ID NO: 85456 - DNA, 16 bp, H. sapiens
ctcagcttccccacct

SEQ ID NO: 85457 - DNA, 16 bp, H. sapiens
ctcagcttcctaagta

SEQ ID NO: 85458 - DNA, 16 bp, H. sapiens
ctcagcttcctcacct

SEQ ID NO: 85459 - DNA, 16 bp, H. sapiens
ctcagcttcctcatct

SEQ ID NO: 85460 - DNA, 16 bp, H. sapiens
ctcagcttctcaaagt

SEQ ID NO: 85461 - DNA, 16 bp, H. sapiens
ctcagcttctgagtag

SEQ ID NO: 85462 - DNA, 16 bp, H. sapiens
ctcagcttctgggagg

SEQ ID NO: 85463 - DNA, 16 bp, H. sapiens
ctcagcttctggggaa

SEQ ID NO: 85464 - DNA, 16 bp, H. sapiens
ctcagcttcttcatct

SEQ ID NO: 85465 - DNA, 16 bp, H. sapiens
ctcagcttcttgggag

SEQ ID NO: 85466 - DNA, 16 bp, H. sapiens
ctcagctttctcatct

SEQ ID NO: 85467 - DNA, 16 bp, H. sapiens
ctcagctttcttatct

SEQ ID NO: 85468 - DNA, 16 bp, H. sapiens
ctcaggaaaaaaacaa

SEQ ID NO: 85469 - DNA, 16 bp, H. sapiens
ctcaggaaaccaacca

SEQ ID NO: 85470 - DNA, 16 bp, H. sapiens
ctcaggaaactaacaa

SEQ ID NO: 85471 - DNA, 16 bp, H. sapiens
ctcaggaaactaacac

SEQ ID NO: 85472 - DNA, 16 bp, H. sapiens
ctcaggaaacttacca

SEQ ID NO: 85473 - DNA, 16 bp, H. sapiens
ctcaggaagacagtct

SEQ ID NO: 85474 - DNA, 16 bp, H. sapiens
ctcaggaagcagaggc

SEQ ID NO: 85475 - DNA, 16 bp, H. sapiens
ctcaggaagcctccca

SEQ ID NO: 85476 - DNA, 16 bp, H. sapiens
ctcaggaagctgaggc

SEQ ID NO: 85477 - DNA, 16 bp, H. sapiens
ctcaggaaggaaggag

SEQ ID NO: 85478 - DNA, 16 bp, H. sapiens
ctcaggaaggaggctg

SEQ ID NO: 85479 - DNA, 16 bp, H. sapiens
ctcaggaagtcctgag

SEQ ID NO: 85480 - DNA, 16 bp, H. sapiens
ctcaggaagtggggag

SEQ ID NO: 85481 - DNA, 16 bp, H. sapiens
ctcaggaatttgaggc

SEQ ID NO: 85482 - DNA, 16 bp, H. sapiens
ctcaggaccagacaga

SEQ ID NO: 85483 - DNA, 16 bp, H. sapiens
ctcaggacctcctggg

SEQ ID NO: 85484 - DNA, 16 bp, H. sapiens
ctcaggactttttttt

SEQ ID NO: 85485 - DNA, 16 bp, H. sapiens
ctcaggagaaaaaaaa

SEQ ID NO: 85486 - DNA, 16 bp, H. sapiens
ctcaggagaaaccaaa

SEQ ID NO: 85487 - DNA, 16 bp, H. sapiens
ctcaggagaactcact

SEQ ID NO: 85488 - DNA, 16 bp, H. sapiens
ctcaggagaccagcct

SEQ ID NO: 85489 - DNA, 16 bp, H. sapiens
ctcaggagactgaggc

SEQ ID NO: 85490 - DNA, 16 bp, H. sapiens
ctcaggagactggggc

SEQ ID NO: 85491 - DNA, 16 bp, H. sapiens
ctcaggagatcctccc

SEQ ID NO: 85492 - DNA, 16 bp, H. sapiens
ctcaggagcctgaggt

SEQ ID NO: 85493 - DNA, 16 bp, H. sapiens
ctcaggagcttgaggc

SEQ ID NO: 85494 - DNA, 16 bp, H. sapiens
ctcaggaggaggagga

SEQ ID NO: 85495 - DNA, 16 bp, H. sapiens
ctcaggaggaggaggt

SEQ ID NO: 85496 - DNA, 16 bp, H. sapiens
ctcaggaggccctgag

SEQ ID NO: 85497 - DNA, 16 bp, H. sapiens
ctcaggaggctgatgc

SEQ ID NO: 85498 - DNA, 16 bp, H. sapiens
ctcaggaggctggggt

SEQ ID NO: 85499 - DNA, 16 bp, H. sapiens
ctcaggaggctgtgac

SEQ ID NO: 85500 - DNA, 16 bp, H. sapiens
ctcaggaggctgtggt

SEQ ID NO: 85501 - DNA, 16 bp, H. sapiens
ctcaggaggtggaggt

SEQ ID NO: 85502 - DNA, 16 bp, H. sapiens
ctcaggatgctgagga

SEQ ID NO: 85503 - DNA, 16 bp, H. sapiens
ctcaggatgctgaggt

SEQ ID NO: 85504 - DNA, 16 bp, H. sapiens
ctcaggcaacagatga

SEQ ID NO: 85505 - DNA, 16 bp, H. sapiens
ctcaggcaagagaaag

SEQ ID NO: 85506 - DNA, 16 bp, H. sapiens
ctcaggcaatccaccc

SEQ ID NO: 85507 - DNA, 18 bp, H. sapiens
ctcaggcaatccacccgc

SEQ ID NO: 85508 - DNA, 16 bp, H. sapiens
ctcaggcaatccgcct

SEQ ID NO: 85509 - DNA, 16 bp, H. sapiens
ctcaggcaggagaatc

SEQ ID NO: 85510 - DNA, 16 bp, H. sapiens
ctcaggcaggagaatt

SEQ ID NO: 85511 - DNA, 16 bp, H. sapiens
ctcaggcagttcttca

SEQ ID NO: 85512 - DNA, 16 bp, H. sapiens
ctcaggccacacagga

SEQ ID NO: 85513 - DNA, 16 bp, H. sapiens
ctcaggccaggtgcgg

SEQ ID NO: 85514 - DNA, 16 bp, H. sapiens
ctcaggccccaccctg

SEQ ID NO: 85515 - DNA, 16 bp, H. sapiens
ctcaggccccacctca

SEQ ID NO: 85516 - DNA, 16 bp, H. sapiens
ctcaggccctgcccca

SEQ ID NO: 85517 - DNA, 16 bp, H. sapiens
ctcaggcctcagcctc

SEQ ID NO: 85518 - DNA, 16 bp, H. sapiens
ctcaggcgatccacct

SEQ ID NO: 85519 - DNA, 16 bp, H. sapiens
ctcaggctagagtgca

SEQ ID NO: 85520 - DNA, 16 bp, H. sapiens
ctcaggctagagtgta

SEQ ID NO: 85521 - DNA, 16 bp, H. sapiens
ctcaggctcccaaagg

SEQ ID NO: 85522 - DNA, 16 bp, H. sapiens
ctcaggctgcagctaa

SEQ ID NO: 85523 - DNA, 16 bp, H. sapiens
ctcaggctgctggtcc

SEQ ID NO: 85524 - DNA, 16 bp, H. sapiens
ctcaggctggaataca

SEQ ID NO: 85525 - DNA, 16 bp, H. sapiens
ctcaggctggagtcca

SEQ ID NO: 85526 - DNA, 16 bp, H. sapiens
ctcaggctggagtgca

SEQ ID NO: 85527 - DNA, 16 bp, H. sapiens
ctcaggctggatggag

SEQ ID NO: 85528 - DNA, 16 bp, H. sapiens
ctcaggctggctggag

SEQ ID NO: 85529 - DNA, 16 bp, H. sapiens
ctcaggctggcttcct

SEQ ID NO: 85530 - DNA, 16 bp, H. sapiens
ctcaggctgggtgcag

SEQ ID NO: 85531 - DNA, 16 bp, H. sapiens
ctcaggctggtctcca

SEQ ID NO: 85532 - DNA, 16 bp, H. sapiens
ctcaggctggtgctgg

SEQ ID NO: 85533 - DNA, 16 bp, H. sapiens
ctcagggacagaattc

SEQ ID NO: 85534 - DNA, 16 bp, H. sapiens
ctcagggagctcctag

SEQ ID NO: 85535 - DNA, 16 bp, H. sapiens
ctcagggaggctgagg

SEQ ID NO: 85536 - DNA, 16 bp, H. sapiens
ctcagggatccaggct

SEQ ID NO: 85537 - DNA, 16 bp, H. sapiens
ctcagggatgaacaag

SEQ ID NO: 85538 - DNA, 16 bp, H. sapiens
ctcagggattcttcag

SEQ ID NO: 85539 - DNA, 16 bp, H. sapiens
ctcagggctgcctcct

SEQ ID NO: 85540 - DNA, 16 bp, H. sapiens
ctcagggctgctctgt

SEQ ID NO: 85541 - DNA, 16 bp, H. sapiens
ctcaggggaagaaaga

SEQ ID NO: 85542 - DNA, 16 bp, H. sapiens
ctcagggggctaaggc

SEQ ID NO: 85543 - DNA, 16 bp, H. sapiens
ctcaggggttggggac

SEQ ID NO: 85544 - DNA, 16 bp, H. sapiens
ctcagggtggagtgca

SEQ ID NO: 85545 - DNA, 16 bp, H. sapiens
ctcaggtatttcttca

SEQ ID NO: 85546 - DNA, 16 bp, H. sapiens
ctcaggtatttcttta

SEQ ID NO: 85547 - DNA, 16 bp, H. sapiens
ctcaggtcacaggcag

SEQ ID NO: 85548 - DNA, 16 bp, H. sapiens
ctcaggtcaggaattc

SEQ ID NO: 85549 - DNA, 16 bp, H. sapiens
ctcaggtctttggact

SEQ ID NO: 85550 - DNA, 16 bp, H. sapiens
ctcaggtgacctgccc

SEQ ID NO: 85551 - DNA, 16 bp, H. sapiens
ctcaggtgagctgccc

SEQ ID NO: 85552 - DNA, 16 bp, H. sapiens
ctcaggtgatccacac

SEQ ID NO: 85553 - DNA, 26 bp, H. sapiens
ctcaggtgatccacccaccttggcct

SEQ ID NO: 85554 - DNA, 18 bp, H. sapiens
ctcaggtgatccacccat

SEQ ID NO: 85555 - DNA, 16 bp, H. sapiens
ctcaggtgatccatcc

SEQ ID NO: 85556 - DNA, 16 bp, H. sapiens
ctcaggtgatccatct

SEQ ID NO: 85557 - DNA, 17 bp, H. sapiens
ctcaggtgatccgccca

SEQ ID NO: 85558 - DNA, 16 bp, H. sapiens
ctcaggtgatcctcac

SEQ ID NO: 85559 - DNA, 16 bp, H. sapiens
ctcaggtgatcttccc

SEQ ID NO: 85560 - DNA, 16 bp, H. sapiens
ctcaggtgattggccc

SEQ ID NO: 85561 - DNA, 16 bp, H. sapiens
ctcaggttatcctccc

SEQ ID NO: 85562 - DNA, 16 bp, H. sapiens
ctcaggttcctcacct

SEQ ID NO: 85563 - DNA, 16 bp, H. sapiens
ctcagtaaatattaac

SEQ ID NO: 85564 - DNA, 16 bp, H. sapiens
ctcagtaatttttatt

SEQ ID NO: 85565 - DNA, 16 bp, H. sapiens
ctcagtacctgagtga

SEQ ID NO: 85566 - DNA, 16 bp, H. sapiens
ctcagtagacacagaa

SEQ ID NO: 85567 - DNA, 16 bp, H. sapiens
ctcagtagctgggatt

SEQ ID NO: 85568 - DNA, 16 bp, H. sapiens
ctcagtatccatgggg

SEQ ID NO: 85569 - DNA, 16 bp, H. sapiens
ctcagtattctcatct

SEQ ID NO: 85570 - DNA, 16 bp, H. sapiens
ctcagtcaaattcttt

SEQ ID NO: 85571 - DNA, 16 bp, H. sapiens
ctcagtccccaagact

SEQ ID NO: 85572 - DNA, 16 bp, H. sapiens
ctcagtcccccaggct

SEQ ID NO: 85573 - DNA, 16 bp, H. sapiens
ctcagtccctaatttg

SEQ ID NO: 85574 - DNA, 16 bp, H. sapiens
ctcagtcctcattgcc

SEQ ID NO: 85575 - DNA, 16 bp, H. sapiens
ctcagtctccagccct

SEQ ID NO: 85576 - DNA, 16 bp, H. sapiens
ctcagtctccagcctc

SEQ ID NO: 85577 - DNA, 16 bp, H. sapiens
ctcagtctcccaagca

SEQ ID NO: 85578 - DNA, 16 bp, H. sapiens
ctcagtctcctggcct

SEQ ID NO: 85579 - DNA, 16 bp, H. sapiens
ctcagtctctccatct

SEQ ID NO: 85580 - DNA, 16 bp, H. sapiens
ctcagtctctgtctct

SEQ ID NO: 85581 - DNA, 16 bp, H. sapiens
ctcagtctcttcctct

SEQ ID NO: 85582 - DNA, 16 bp, H. sapiens
ctcagtgactggcaca

SEQ ID NO: 85583 - DNA, 16 bp, H. sapiens
ctcagtgcctggcaca

SEQ ID NO: 85584 - DNA, 16 bp, H. sapiens
ctcagtggcccaggct

SEQ ID NO: 85585 - DNA, 16 bp, H. sapiens
ctcagtgggaggtaat

SEQ ID NO: 85586 - DNA, 16 bp, H. sapiens
ctcagtgggctgcacc

SEQ ID NO: 85587 - DNA, 16 bp, H. sapiens
ctcagtggggaggctt

SEQ ID NO: 85588 - DNA, 16 bp, H. sapiens
ctcagtggtttaaaac

SEQ ID NO: 85589 - DNA, 16 bp, H. sapiens
ctcagtgtaataaaag

SEQ ID NO: 85590 - DNA, 16 bp, H. sapiens
ctcagtgtcctgagta

SEQ ID NO: 85591 - DNA, 16 bp, H. sapiens
ctcagtgtctgcatct

SEQ ID NO: 85592 - DNA, 16 bp, H. sapiens
ctcagtgtcttcacct

SEQ ID NO: 85593 - DNA, 16 bp, H. sapiens
ctcagtgtgtgatgtt

SEQ ID NO: 85594 - DNA, 16 bp, H. sapiens
ctcagtgtgtgtgtgt

SEQ ID NO: 85595 - DNA, 16 bp, H. sapiens
ctcagtgttctcacct

SEQ ID NO: 85596 - DNA, 16 bp, H. sapiens
ctcagtgttctcatct

SEQ ID NO: 85597 - DNA, 16 bp, H. sapiens
ctcagttcactgcaaa

SEQ ID NO: 85598 - DNA, 16 bp, H. sapiens
ctcagttccctcatct

SEQ ID NO: 85599 - DNA, 16 bp, H. sapiens
ctcagttctgcatggc

SEQ ID NO: 85600 - DNA, 16 bp, H. sapiens
ctcagttgaaaatgca

SEQ ID NO: 85601 - DNA, 16 bp, H. sapiens
ctcagtttactcatct

SEQ ID NO: 85602 - DNA, 16 bp, H. sapiens
ctcagtttccacatct

SEQ ID NO: 85603 - DNA, 16 bp, H. sapiens
ctcagtttccccagct

SEQ ID NO: 85604 - DNA, 16 bp, H. sapiens
ctcagtttccccgtct

SEQ ID NO: 85605 - DNA, 16 bp, H. sapiens
ctcagtttccctatct

SEQ ID NO: 85606 - DNA, 16 bp, H. sapiens
ctcagtttcctcaact

SEQ ID NO: 85607 - DNA, 16 bp, H. sapiens
ctcagtttcctcacct

SEQ ID NO: 85608 - DNA, 16 bp, H. sapiens
ctcagtttcctcactt

SEQ ID NO: 85609 - DNA, 16 bp, H. sapiens
ctcagtttcctcagct

SEQ ID NO: 85610 - DNA, 16 bp, H. sapiens
ctcagtttcctcatcc

SEQ ID NO: 85611 - DNA, 16 bp, H. sapiens
ctcagtttcctcatct

SEQ ID NO: 85612 - DNA, 16 bp, H. sapiens
ctcagtttcctcctct

SEQ ID NO: 85613 - DNA, 16 bp, H. sapiens
ctcagtttcctcgtct

SEQ ID NO: 85614 - DNA, 16 bp, H. sapiens
ctcagtttcctctcct

SEQ ID NO: 85615 - DNA, 16 bp, H. sapiens
ctcagtttcctctctg

SEQ ID NO: 85616 - DNA, 16 bp, H. sapiens
ctcagtttcctcttca

SEQ ID NO: 85617 - DNA, 16 bp, H. sapiens
ctcagtttccttgttt

SEQ ID NO: 85618 - DNA, 16 bp, H. sapiens
ctcagtttcctttcct

SEQ ID NO: 85619 - DNA, 16 bp, H. sapiens
ctcagtttctccacct

SEQ ID NO: 85620 - DNA, 16 bp, H. sapiens
ctcagtttctccctct

SEQ ID NO: 85621 - DNA, 16 bp, H. sapiens
ctcagtttctctgcct

SEQ ID NO: 85622 - DNA, 16 bp, H. sapiens
ctcagtttcttcatct

SEQ ID NO: 85623 - DNA, 16 bp, H. sapiens
ctcagtttcttcattt

SEQ ID NO: 85624 - DNA, 16 bp, H. sapiens
ctcagtttcttctctg

SEQ ID NO: 85625 - DNA, 16 bp, H. sapiens
ctcagtttgctcatct

SEQ ID NO: 85626 - DNA, 16 bp, H. sapiens
ctcagttttaaaaaat

SEQ ID NO: 85627 - DNA, 16 bp, H. sapiens
ctcagttttcccatct

SEQ ID NO: 85628 - DNA, 16 bp, H. sapiens
ctcagttttctaatct

SEQ ID NO: 85629 - DNA, 16 bp, H. sapiens
ctcagttttctcatct

SEQ ID NO: 85630 - DNA, 16 bp, H. sapiens
ctcagttttctcattt

SEQ ID NO: 85631 - DNA, 16 bp, H. sapiens
ctcagttttctcgtct

SEQ ID NO: 85632 - DNA, 16 bp, H. sapiens
ctcagttttcttgtct

SEQ ID NO: 85633 - DNA, 16 bp, H. sapiens
ctcagttttgttttgt

SEQ ID NO: 85634 - DNA, 16 bp, H. sapiens
ctcagtttttaaaaaa

SEQ ID NO: 85635 - DNA, 16 bp, H. sapiens
ctcagtttttctgtaa

SEQ ID NO: 85636 - DNA, 16 bp, H. sapiens
ctcagtttttttccta

SEQ ID NO: 85637 - DNA, 16 bp, H. sapiens
ctcataaaagtaaaaa

SEQ ID NO: 85638 - DNA, 16 bp, H. sapiens
ctcataagggttatta

SEQ ID NO: 85639 - DNA, 16 bp, H. sapiens
ctcataatcagtcaaa

SEQ ID NO: 85640 - DNA, 16 bp, H. sapiens
ctcatacacacataca

SEQ ID NO: 85641 - DNA, 16 bp, H. sapiens
ctcatacaccatgaaa

SEQ ID NO: 85642 - DNA, 16 bp, H. sapiens
ctcatacagaagagct

SEQ ID NO: 85643 - DNA, 16 bp, H. sapiens
ctcatacagcctgcag

SEQ ID NO: 85644 - DNA, 16 bp, H. sapiens
ctcataccacatacaa

SEQ ID NO: 85645 - DNA, 16 bp, H. sapiens
ctcatagcagtgttct

SEQ ID NO: 85646 - DNA, 16 bp, H. sapiens
ctcataggaacatgaa

SEQ ID NO: 85647 - DNA, 16 bp, H. sapiens
ctcataggagcacgaa

SEQ ID NO: 85648 - DNA, 16 bp, H. sapiens
ctcatagtgtaaacaa

SEQ ID NO: 85649 - DNA, 16 bp, H. sapiens
ctcatagttctgcaga

SEQ ID NO: 85650 - DNA, 16 bp, H. sapiens
ctcatatgatctgccc

SEQ ID NO: 85651 - DNA, 16 bp, H. sapiens
ctcatatgtggaagct

SEQ ID NO: 85652 - DNA, 16 bp, H. sapiens
ctcatatgtggaatct

SEQ ID NO: 85653 - DNA, 16 bp, H. sapiens
ctcatcaacacttggt

SEQ ID NO: 85654 - DNA, 16 bp, H. sapiens
ctcatcacaggcccag

SEQ ID NO: 85655 - DNA, 16 bp, H. sapiens
ctcatcaccatgcctg

SEQ ID NO: 85656 - DNA, 16 bp, H. sapiens
ctcatcacttcccaaa

SEQ ID NO: 85657 - DNA, 16 bp, H. sapiens
ctcatcagaaaaaaat

SEQ ID NO: 85658 - DNA, 16 bp, H. sapiens
ctcatcagactaacag

SEQ ID NO: 85659 - DNA, 16 bp, H. sapiens
ctcatcagcaaaatgg

SEQ ID NO: 85660 - DNA, 16 bp, H. sapiens
ctcatcagcagctctc

SEQ ID NO: 85661 - DNA, 16 bp, H. sapiens
ctcatcagtaaaatgt

SEQ ID NO: 85662 - DNA, 16 bp, H. sapiens
ctcatcatctcagccc

SEQ ID NO: 85663 - DNA, 16 bp, H. sapiens
ctcatcatgttggcca

SEQ ID NO: 85664 - DNA, 16 bp, H. sapiens
ctcatcatttagcttc

SEQ ID NO: 85665 - DNA, 16 bp, H. sapiens
ctcatcatttccattt

SEQ ID NO: 85666 - DNA, 16 bp, H. sapiens
ctcatcattttctatg

SEQ ID NO: 85667 - DNA, 16 bp, H. sapiens
ctcatccaggtcattg

SEQ ID NO: 85668 - DNA, 16 bp, H. sapiens
ctcatccatccatcca

SEQ ID NO: 85669 - DNA, 16 bp, H. sapiens
ctcatccctacaaaaa

SEQ ID NO: 85670 - DNA, 16 bp, H. sapiens
ctcatcctcatcctca

SEQ ID NO: 85671 - DNA, 16 bp, H. sapiens
ctcatctaatcctcat

SEQ ID NO: 85672 - DNA, 16 bp, H. sapiens
ctcatctataaaatgg

SEQ ID NO: 85673 - DNA, 16 bp, H. sapiens
ctcatctatgaaatga

SEQ ID NO: 85674 - DNA, 16 bp, H. sapiens
ctcatctcaaataaat

SEQ ID NO: 85675 - DNA, 16 bp, H. sapiens
ctcatctcacaagtga

SEQ ID NO: 85676 - DNA, 16 bp, H. sapiens
ctcatctccaaatacc

SEQ ID NO: 85677 - DNA, 16 bp, H. sapiens
ctcatctccatcaagt

SEQ ID NO: 85678 - DNA, 16 bp, H. sapiens
ctcatctccatctcag

SEQ ID NO: 85679 - DNA, 16 bp, H. sapiens
ctcatctccctgggac

SEQ ID NO: 85680 - DNA, 17 bp, H. sapiens
ctcatctccctgggaca

SEQ ID NO: 85681 - DNA, 16 bp, H. sapiens
ctcatctctaaaaaaa

SEQ ID NO: 85682 - DNA, 16 bp, H. sapiens
ctcatctctaaaaaga

SEQ ID NO: 85683 - DNA, 16 bp, H. sapiens
ctcatctctacaaaaa

SEQ ID NO: 85684 - DNA, 16 bp, H. sapiens
ctcatctctactaaaa

SEQ ID NO: 85685 - DNA, 16 bp, H. sapiens
ctcatctctgcatgtg

SEQ ID NO: 85686 - DNA, 16 bp, H. sapiens
ctcatctgcaagatgg

SEQ ID NO: 85687 - DNA, 16 bp, H. sapiens
ctcatctgtaaggtgg

SEQ ID NO: 85688 - DNA, 16 bp, H. sapiens
ctcatctgtacaatgg

SEQ ID NO: 85689 - DNA, 16 bp, H. sapiens
ctcatctgtcaaatga

SEQ ID NO: 85690 - DNA, 16 bp, H. sapiens
ctcatctgtcaagtgg

SEQ ID NO: 85691 - DNA, 16 bp, H. sapiens
ctcatctgtgaaacag

SEQ ID NO: 85692 - DNA, 16 bp, H. sapiens
ctcatctgtgaaactg

SEQ ID NO: 85693 - DNA, 16 bp, H. sapiens
ctcatctgtgaaatgg

SEQ ID NO: 85694 - DNA, 16 bp, H. sapiens
ctcatcttaaaaaaaa

SEQ ID NO: 85695 - DNA, 16 bp, H. sapiens
ctcatcttaaaaatga

SEQ ID NO: 85696 - DNA, 16 bp, H. sapiens
ctcatcttaattaatt

SEQ ID NO: 85697 - DNA, 16 bp, H. sapiens
ctcatcttcatctgag

SEQ ID NO: 85698 - DNA, 16 bp, H. sapiens
ctcatcttcctggatt

SEQ ID NO: 85699 - DNA, 16 bp, H. sapiens
ctcatcttcctgtttt

SEQ ID NO: 85700 - DNA, 16 bp, H. sapiens
ctcatcttctgtggaa

SEQ ID NO: 85701 - DNA, 16 bp, H. sapiens
ctcatctttaaaataa

SEQ ID NO: 85702 - DNA, 16 bp, H. sapiens
ctcatctttaaaatgg

SEQ ID NO: 85703 - DNA, 16 bp, H. sapiens
ctcatctttacaaaaa

SEQ ID NO: 85704 - DNA, 16 bp, H. sapiens
ctcatgaaaactcact

SEQ ID NO: 85705 - DNA, 16 bp, H. sapiens
ctcatgaacaggaaga

SEQ ID NO: 85706 - DNA, 16 bp, H. sapiens
ctcatgaactaatcac

SEQ ID NO: 85707 - DNA, 16 bp, H. sapiens
ctcatgaagatagaga

SEQ ID NO: 85708 - DNA, 16 bp, H. sapiens
ctcatgaatagcttag

SEQ ID NO: 85709 - DNA, 16 bp, H. sapiens
ctcatgaatgactttg

SEQ ID NO: 85710 - DNA, 16 bp, H. sapiens
ctcatgacagtgagtt

SEQ ID NO: 85711 - DNA, 16 bp, H. sapiens
ctcatgaggtcaggag

SEQ ID NO: 85712 - DNA, 16 bp, H. sapiens
ctcatgattctgcagg

SEQ ID NO: 85713 - DNA, 16 bp, H. sapiens
ctcatgatttgtctct

SEQ ID NO: 85714 - DNA, 16 bp, H. sapiens
ctcatgcaaaaaaaaa

SEQ ID NO: 85715 - DNA, 16 bp, H. sapiens
ctcatgcctcggcctc

SEQ ID NO: 85716 - DNA, 16 bp, H. sapiens
ctcatgcctgcattcc

SEQ ID NO: 85717 - DNA, 16 bp, H. sapiens
ctcatgcctgtaaacc

SEQ ID NO: 85718 - DNA, 19 bp, H. sapiens
ctcatgctattgtttgtgg

SEQ ID NO: 85719 - DNA, 16 bp, H. sapiens
ctcatgcttttttatg

SEQ ID NO: 85720 - DNA, 16 bp, H. sapiens
ctcatggaaacagaga

SEQ ID NO: 85721 - DNA, 16 bp, H. sapiens
ctcatggacaggaaga

SEQ ID NO: 85722 - DNA, 16 bp, H. sapiens
ctcatggagaacatct

SEQ ID NO: 85723 - DNA, 16 bp, H. sapiens
ctcatggagaaccact

SEQ ID NO: 85724 - DNA, 16 bp, H. sapiens
ctcatggagaacctct

SEQ ID NO: 85725 - DNA, 16 bp, H. sapiens
ctcatggagaatctct

SEQ ID NO: 85726 - DNA, 16 bp, H. sapiens
ctcatggagaggaaga

SEQ ID NO: 85727 - DNA, 16 bp, H. sapiens
ctcatggatatagaga

SEQ ID NO: 85728 - DNA, 16 bp, H. sapiens
ctcatggattagaaga

SEQ ID NO: 85729 - DNA, 16 bp, H. sapiens
ctcatggcagtgaata

SEQ ID NO: 85730 - DNA, 16 bp, H. sapiens
ctcatggccaacagca

SEQ ID NO: 85731 - DNA, 16 bp, H. sapiens
ctcatgggaggtgttt

SEQ ID NO: 85732 - DNA, 16 bp, H. sapiens
ctcatggggaacctct

SEQ ID NO: 85733 - DNA, 16 bp, H. sapiens
ctcatggttttaaata

SEQ ID NO: 85734 - DNA, 16 bp, H. sapiens
ctcatgtaatcctcat

SEQ ID NO: 85735 - DNA, 16 bp, H. sapiens
ctcatgtactcacatt

SEQ ID NO: 85736 - DNA, 16 bp, H. sapiens
ctcatgtcatcacatt

SEQ ID NO: 85737 - DNA, 16 bp, H. sapiens
ctcatgtgcaaagaca

SEQ ID NO: 85738 - DNA, 28 bp, H. sapiens
ctcattaaactaaagagcttctgcacag

SEQ ID NO: 85739 - DNA, 16 bp, H. sapiens
ctcattaaatatttga

SEQ ID NO: 85740 - DNA, 16 bp, H. sapiens
ctcattaaatatttgt

SEQ ID NO: 85741 - DNA, 16 bp, H. sapiens
ctcattaatgttcttt

SEQ ID NO: 85742 - DNA, 16 bp, H. sapiens
ctcattaattctgatt

SEQ ID NO: 85743 - DNA, 16 bp, H. sapiens
ctcattactgtgagga

SEQ ID NO: 85744 - DNA, 16 bp, H. sapiens
ctcattagagactcag

SEQ ID NO: 85745 - DNA, 16 bp, H. sapiens
ctcattagttattttt

SEQ ID NO: 85746 - DNA, 16 bp, H. sapiens
ctcattatacagatga

SEQ ID NO: 85747 - DNA, 16 bp, H. sapiens
ctcattcacacacaca

SEQ ID NO: 85748 - DNA, 16 bp, H. sapiens
ctcattcagcttttct

SEQ ID NO: 85749 - DNA, 16 bp, H. sapiens
ctcattcattatcatg

SEQ ID NO: 85750 - DNA, 16 bp, H. sapiens
ctcattcattcactta

SEQ ID NO: 85751 - DNA, 16 bp, H. sapiens
ctcattcattcatcta

SEQ ID NO: 85752 - DNA, 16 bp, H. sapiens
ctcattcattcattca

SEQ ID NO: 85753 - DNA, 16 bp, H. sapiens
ctcattcattcattta

SEQ ID NO: 85754 - DNA, 16 bp, H. sapiens
ctcattcattccttca

SEQ ID NO: 85755 - DNA, 16 bp, H. sapiens
ctcattcattttcatg

SEQ ID NO: 85756 - DNA, 16 bp, H. sapiens
ctcattccagttaaaa

SEQ ID NO: 85757 - DNA, 16 bp, H. sapiens
ctcattcctgcctcag

SEQ ID NO: 85758 - DNA, 16 bp, H. sapiens
ctcattctaaaattta

SEQ ID NO: 85759 - DNA, 16 bp, H. sapiens
ctcattctctgtccag

SEQ ID NO: 85760 - DNA, 16 bp, H. sapiens
ctcattctctttcctg

SEQ ID NO: 85761 - DNA, 16 bp, H. sapiens
ctcattctgtcaacca

SEQ ID NO: 85762 - DNA, 16 bp, H. sapiens
ctcattctgtcaccag

SEQ ID NO: 85763 - DNA, 16 bp, H. sapiens
ctcattctgttatcca

SEQ ID NO: 85764 - DNA, 16 bp, H. sapiens
ctcattctgtttcttt

SEQ ID NO: 85765 - DNA, 16 bp, H. sapiens
ctcattcttttggcct

SEQ ID NO: 85766 - DNA, 16 bp, H. sapiens
ctcattgaatcctcat

SEQ ID NO: 85767 - DNA, 16 bp, H. sapiens
ctcattgagaacaggc

SEQ ID NO: 85768 - DNA, 16 bp, H. sapiens
ctcattgagactggtt

SEQ ID NO: 85769 - DNA, 16 bp, H. sapiens
ctcattgattcattca

SEQ ID NO: 85770 - DNA, 16 bp, H. sapiens
ctcattgattttgtat

SEQ ID NO: 85771 - DNA, 16 bp, H. sapiens
ctcattgcaacctcca

SEQ ID NO: 85772 - DNA, 16 bp, H. sapiens
ctcattgcaacttccg

SEQ ID NO: 85773 - DNA, 16 bp, H. sapiens
ctcattgcagcctcga

SEQ ID NO: 85774 - DNA, 16 bp, H. sapiens
ctcattgccaagtcaa

SEQ ID NO: 85775 - DNA, 16 bp, H. sapiens
ctcattgccacctcca

SEQ ID NO: 85776 - DNA, 16 bp, H. sapiens
ctcattgtccaggaga

SEQ ID NO: 85777 - DNA, 16 bp, H. sapiens
ctcattgtgcttttga

SEQ ID NO: 85778 - DNA, 16 bp, H. sapiens
ctcattgtggtgttga

SEQ ID NO: 85779 - DNA, 16 bp, H. sapiens
ctcatttaaacctcac

SEQ ID NO: 85780 - DNA, 16 bp, H. sapiens
ctcatttaacagatga

SEQ ID NO: 85781 - DNA, 16 bp, H. sapiens
ctcatttaaccttcac

SEQ ID NO: 85782 - DNA, 16 bp, H. sapiens
ctcatttaataaatat

SEQ ID NO: 85783 - DNA, 16 bp, H. sapiens
ctcatttaattcttaa

SEQ ID NO: 85784 - DNA, 16 bp, H. sapiens
ctcatttacttctcaa

SEQ ID NO: 85785 - DNA, 16 bp, H. sapiens
ctcatttataaaatga

SEQ ID NO: 85786 - DNA, 16 bp, H. sapiens
ctcatttataatagct

SEQ ID NO: 85787 - DNA, 16 bp, H. sapiens
ctcatttcactctcct

SEQ ID NO: 85788 - DNA, 16 bp, H. sapiens
ctcatttccatttgag

SEQ ID NO: 85789 - DNA, 16 bp, H. sapiens
ctcatttctctcatca

SEQ ID NO: 85790 - DNA, 16 bp, H. sapiens
ctcatttgaaaatgga

SEQ ID NO: 85791 - DNA, 16 bp, H. sapiens
ctcatttgtaaaatgg

SEQ ID NO: 85792 - DNA, 16 bp, H. sapiens
ctcatttgtaaaattg

SEQ ID NO: 85793 - DNA, 16 bp, H. sapiens
ctcatttgtttacata

SEQ ID NO: 85794 - DNA, 16 bp, H. sapiens
ctcattttaaaatgag

SEQ ID NO: 85795 - DNA, 16 bp, H. sapiens
ctcattttaaaattgg

SEQ ID NO: 85796 - DNA, 16 bp, H. sapiens
ctcattttaagaaatt

SEQ ID NO: 85797 - DNA, 16 bp, H. sapiens
ctcattttactgatga

SEQ ID NO: 85798 - DNA, 16 bp, H. sapiens
ctcattttattaaaaa

SEQ ID NO: 85799 - DNA, 16 bp, H. sapiens
ctcattttcttttgca

SEQ ID NO: 85800 - DNA, 16 bp, H. sapiens
ctcattttgttgccca

SEQ ID NO: 85801 - DNA, 16 bp, H. sapiens
ctcatttttcctggac

SEQ ID NO: 85802 - DNA, 16 bp, H. sapiens
ctcatttttgtaattt

SEQ ID NO: 85803 - DNA, 16 bp, H. sapiens
ctcattttttaaaaaa

SEQ ID NO: 85804 - DNA, 16 bp, H. sapiens
ctcatttttttctgca

SEQ ID NO: 85805 - DNA, 16 bp, H. sapiens
ctccaaaaaaaatttt

SEQ ID NO: 85806 - DNA, 16 bp, H. sapiens
ctccaaaaaattaatg

SEQ ID NO: 85807 - DNA, 16 bp, H. sapiens
ctccaaaaattaaatt

SEQ ID NO: 85808 - DNA, 16 bp, H. sapiens
ctccaaaactatgaga

SEQ ID NO: 85809 - DNA, 16 bp, H. sapiens
ctccaaaactgtgaga

SEQ ID NO: 85810 - DNA, 16 bp, H. sapiens
ctccaaaagactccta

SEQ ID NO: 85811 - DNA, 16 bp, H. sapiens
ctccaaaatgtttctt

SEQ ID NO: 85812 - DNA, 16 bp, H. sapiens
ctccaaacctgtttct

SEQ ID NO: 85813 - DNA, 16 bp, H. sapiens
ctccaaactcttccaa

SEQ ID NO: 85814 - DNA, 16 bp, H. sapiens
ctccaaactgcccttg

SEQ ID NO: 85815 - DNA, 16 bp, H. sapiens
ctccaaactgctctcc

SEQ ID NO: 85816 - DNA, 16 bp, H. sapiens
ctccaaagaaaataaa

SEQ ID NO: 85817 - DNA, 16 bp, H. sapiens
ctccaaagaaaatgaa

SEQ ID NO: 85818 - DNA, 16 bp, H. sapiens
ctccaaagaagaaaaa

SEQ ID NO: 85819 - DNA, 16 bp, H. sapiens
ctccaaagaagatgta

SEQ ID NO: 85820 - DNA, 16 bp, H. sapiens
ctccaaagcccaaagg

SEQ ID NO: 85821 - DNA, 16 bp, H. sapiens
ctccaaagcctgaagg

SEQ ID NO: 85822 - DNA, 16 bp, H. sapiens
ctccaaaggctgaggt

SEQ ID NO: 85823 - DNA, 16 bp, H. sapiens
ctccaaagggatattt

SEQ ID NO: 85824 - DNA, 16 bp, H. sapiens
ctccaaatctcagttt

SEQ ID NO: 85825 - DNA, 16 bp, H. sapiens
ctccaaatgactgcat

SEQ ID NO: 85826 - DNA, 16 bp, H. sapiens
ctccaacactgaggat

SEQ ID NO: 85827 - DNA, 16 bp, H. sapiens
ctccaacactgtggat

SEQ ID NO: 85828 - DNA, 16 bp, H. sapiens
ctccaacattgggaat

SEQ ID NO: 85829 - DNA, 16 bp, H. sapiens
ctccaaccctgtggct

SEQ ID NO: 85830 - DNA, 16 bp, H. sapiens
ctccaacctcaacctc

SEQ ID NO: 85831 - DNA, 16 bp, H. sapiens
ctccaacctcagcccc

SEQ ID NO: 85832 - DNA, 16 bp, H. sapiens
ctccaacctcagcttc

SEQ ID NO: 85833 - DNA, 16 bp, H. sapiens
ctccaacctctgcttc

SEQ ID NO: 85834 - DNA, 16 bp, H. sapiens
ctccaacctgggcaat

SEQ ID NO: 85835 - DNA, 16 bp, H. sapiens
ctccaacctgggcgac

SEQ ID NO: 85836 - DNA, 16 bp, H. sapiens
ctccaacctgggctac

SEQ ID NO: 85837 - DNA, 16 bp, H. sapiens
ctccaactctgggggc

SEQ ID NO: 85838 - DNA, 16 bp, H. sapiens
ctccaacttcagcctc

SEQ ID NO: 85839 - DNA, 16 bp, H. sapiens
ctccaacttttgggct

SEQ ID NO: 85840 - DNA, 32 bp, H. sapiens
ctccaagaaataggggactatgtgaaaagacc

SEQ ID NO: 85841 - DNA, 22 bp, H. sapiens
ctccaagaaatatgggactatt

SEQ ID NO: 85842 - DNA, 16 bp, H. sapiens
ctccaagaagcctccc

SEQ ID NO: 85843 - DNA, 16 bp, H. sapiens
ctccaagagggcaggg

SEQ ID NO: 85844 - DNA, 16 bp, H. sapiens
ctccaagatcagagca

SEQ ID NO: 85845 - DNA, 16 bp, H. sapiens
ctccaagcaatcctcc

SEQ ID NO: 85846 - DNA, 16 bp, H. sapiens
ctccaagccaggcatg

SEQ ID NO: 85847 - DNA, 16 bp, H. sapiens
ctccaagcctgtgatg

SEQ ID NO: 85848 - DNA, 16 bp, H. sapiens
ctccaagctccacctc

SEQ ID NO: 85849 - DNA, 16 bp, H. sapiens
ctccaagctcccagcc

SEQ ID NO: 85850 - DNA, 16 bp, H. sapiens
ctccaaggaaggagaa

SEQ ID NO: 85851 - DNA, 16 bp, H. sapiens
ctccaaggaatatggg

SEQ ID NO: 85852 - DNA, 16 bp, H. sapiens
ctccaagtccccactc

SEQ ID NO: 85853 - DNA, 16 bp, H. sapiens
ctccaagtccttcagc

SEQ ID NO: 85854 - DNA, 16 bp, H. sapiens
ctccaagtctgtggct

SEQ ID NO: 85855 - DNA, 16 bp, H. sapiens
ctccaatctcagcttc

SEQ ID NO: 85856 - DNA, 18 bp, H. sapiens
ctccaatgataggtaagg

SEQ ID NO: 85857 - DNA, 16 bp, H. sapiens
ctccaattcctgggtt

SEQ ID NO: 85858 - DNA, 16 bp, H. sapiens
ctccaatttctgggct

SEQ ID NO: 85859 - DNA, 16 bp, H. sapiens
ctccacaaagaaaaca

SEQ ID NO: 85860 - DNA, 16 bp, H. sapiens
ctccacacactgctct

SEQ ID NO: 85861 - DNA, 16 bp, H. sapiens
ctccacacagaaacat

SEQ ID NO: 85862 - DNA, 16 bp, H. sapiens
ctccacaccctcatca

SEQ ID NO: 85863 - DNA, 16 bp, H. sapiens
ctccacactgctgcca

SEQ ID NO: 85864 - DNA, 16 bp, H. sapiens
ctccacactgttttct

SEQ ID NO: 85865 - DNA, 16 bp, H. sapiens
ctccacagcctctcca

SEQ ID NO: 85866 - DNA, 16 bp, H. sapiens
ctccacagcttcacca

SEQ ID NO: 85867 - DNA, 16 bp, H. sapiens
ctccacagggctgcct

SEQ ID NO: 85868 - DNA, 16 bp, H. sapiens
ctccacagtagctggg

SEQ ID NO: 85869 - DNA, 16 bp, H. sapiens
ctccacatcctcatca

SEQ ID NO: 85870 - DNA, 16 bp, H. sapiens
ctccacatcctcttca

SEQ ID NO: 85871 - DNA, 16 bp, H. sapiens
ctccacatccttacca

SEQ ID NO: 85872 - DNA, 16 bp, H. sapiens
ctccacatccttgaca

SEQ ID NO: 85873 - DNA, 16 bp, H. sapiens
ctccacatcttgtccc

SEQ ID NO: 85874 - DNA, 16 bp, H. sapiens
ctccacatctttgcca

SEQ ID NO: 85875 - DNA, 16 bp, H. sapiens
ctccacatttgttctt

SEQ ID NO: 85876 - DNA, 16 bp, H. sapiens
ctccaccagcacccac

SEQ ID NO: 85877 - DNA, 16 bp, H. sapiens
ctccaccagctgcacc

SEQ ID NO: 85878 - DNA, 16 bp, H. sapiens
ctccaccatcccccag

SEQ ID NO: 85879 - DNA, 16 bp, H. sapiens
ctccacccaaacatct

SEQ ID NO: 85880 - DNA, 16 bp, H. sapiens
ctccacccaacagcag

SEQ ID NO: 85881 - DNA, 16 bp, H. sapiens
ctccacccacctcggc

SEQ ID NO: 85882 - DNA, 16 bp, H. sapiens
ctccacccagatttca

SEQ ID NO: 85883 - DNA, 16 bp, H. sapiens
ctccacccagcagcca

SEQ ID NO: 85884 - DNA, 16 bp, H. sapiens
ctccaccccagcctct

SEQ ID NO: 85885 - DNA, 16 bp, H. sapiens
ctccaccccccaggtt

SEQ ID NO: 85886 - DNA, 16 bp, H. sapiens
ctccaccctcaagtag

SEQ ID NO: 85887 - DNA, 16 bp, H. sapiens
ctccaccctcagctcc

SEQ ID NO: 85888 - DNA, 16 bp, H. sapiens
ctccaccctcaggtag

SEQ ID NO: 85889 - DNA, 16 bp, H. sapiens
ctccaccctcatggcc

SEQ ID NO: 85890 - DNA, 16 bp, H. sapiens
ctccaccctctgccct

SEQ ID NO: 85891 - DNA, 17 bp, H. sapiens
ctccaccctgactcatt

SEQ ID NO: 85892 - DNA, 16 bp, H. sapiens
ctccaccctgctgtcc

SEQ ID NO: 85893 - DNA, 16 bp, H. sapiens
ctccacctattcatct

SEQ ID NO: 85894 - DNA, 16 bp, H. sapiens
ctccacctcagcctcc

SEQ ID NO: 85895 - DNA, 16 bp, H. sapiens
ctccacctccagcttc

SEQ ID NO: 85896 - DNA, 16 bp, H. sapiens
ctccacctcccagcca

SEQ ID NO: 85897 - DNA, 16 bp, H. sapiens
ctccacctcccagctt

SEQ ID NO: 85898 - DNA, 16 bp, H. sapiens
ctccacctcccaggtg

SEQ ID NO: 85899 - DNA, 19 bp, H. sapiens
ctccacctcccaggttcag

SEQ ID NO: 85900 - DNA, 16 bp, H. sapiens
ctccacctccccaggc

SEQ ID NO: 85901 - DNA, 17 bp, H. sapiens
ctccacctcccgggttt

SEQ ID NO: 85902 - DNA, 16 bp, H. sapiens
ctccacctccctgcct

SEQ ID NO: 85903 - DNA, 16 bp, H. sapiens
ctccacctcctaaagt

SEQ ID NO: 85904 - DNA, 16 bp, H. sapiens
ctccacctcctccagg

SEQ ID NO: 85905 - DNA, 16 bp, H. sapiens
ctccacctcctgcctc

SEQ ID NO: 85906 - DNA, 16 bp, H. sapiens
ctccacctcctggtct

SEQ ID NO: 85907 - DNA, 16 bp, H. sapiens
ctccacctcctggttc

SEQ ID NO: 85908 - DNA, 16 bp, H. sapiens
ctccacctcctgtcag

SEQ ID NO: 85909 - DNA, 22 bp, H. sapiens
ctccacctctgggggcagggca

SEQ ID NO: 85910 - DNA, 16 bp, H. sapiens
ctccacctcttctgcc

SEQ ID NO: 85911 - DNA, 16 bp, H. sapiens
ctccacctcttggatt

SEQ ID NO: 85912 - DNA, 16 bp, H. sapiens
ctccacctcttgtcag

SEQ ID NO: 85913 - DNA, 16 bp, H. sapiens
ctccacctgcagcctc

SEQ ID NO: 85914 - DNA, 16 bp, H. sapiens
ctccacctggacccac

SEQ ID NO: 85915 - DNA, 16 bp, H. sapiens
ctccacctggacctgc

SEQ ID NO: 85916 - DNA, 16 bp, H. sapiens
ctccacctggctccac

SEQ ID NO: 85917 - DNA, 16 bp, H. sapiens
ctccacctggtccctc

SEQ ID NO: 85918 - DNA, 16 bp, H. sapiens
ctccacctgtggcccc

SEQ ID NO: 85919 - DNA, 18 bp, H. sapiens
ctccaccttccaggttca

SEQ ID NO: 85920 - DNA, 16 bp, H. sapiens
ctccaccttctcagat

SEQ ID NO: 85921 - DNA, 16 bp, H. sapiens
ctccaccttggacttg

SEQ ID NO: 85922 - DNA, 16 bp, H. sapiens
ctccacctttctgggg

SEQ ID NO: 85923 - DNA, 16 bp, H. sapiens
ctccacgagggcaggg

SEQ ID NO: 85924 - DNA, 16 bp, H. sapiens
ctccacggtgcccagt

SEQ ID NO: 85925 - DNA, 16 bp, H. sapiens
ctccactcactccact

SEQ ID NO: 85926 - DNA, 16 bp, H. sapiens
ctccactccagcctgg

SEQ ID NO: 85927 - DNA, 16 bp, H. sapiens
ctccactccagggcag

SEQ ID NO: 85928 - DNA, 16 bp, H. sapiens
ctccactcctgccacc

SEQ ID NO: 85929 - DNA, 16 bp, H. sapiens
ctccactcctgcctcc

SEQ ID NO: 85930 - DNA, 16 bp, H. sapiens
ctccactcctgcctgg

SEQ ID NO: 85931 - DNA, 16 bp, H. sapiens
ctccactctgaaggaa

SEQ ID NO: 85932 - DNA, 16 bp, H. sapiens
ctccactgcaaagtta

SEQ ID NO: 85933 - DNA, 16 bp, H. sapiens
ctccactgctgccacc

SEQ ID NO: 85934 - DNA, 16 bp, H. sapiens
ctccactggaaaaaaa

SEQ ID NO: 85935 - DNA, 16 bp, H. sapiens
ctccactgggctgaga

SEQ ID NO: 85936 - DNA, 16 bp, H. sapiens
ctccacttcccagttt

SEQ ID NO: 85937 - DNA, 16 bp, H. sapiens
ctccacttcctcacca

SEQ ID NO: 85938 - DNA, 16 bp, H. sapiens
ctccactttgggaggc

SEQ ID NO: 85939 - DNA, 16 bp, H. sapiens
ctccagaaaaaaaaga

SEQ ID NO: 85940 - DNA, 16 bp, H. sapiens
ctccagaaaaaagaaa

SEQ ID NO: 85941 - DNA, 16 bp, H. sapiens
ctccagaaacatttct

SEQ ID NO: 85942 - DNA, 16 bp, H. sapiens
ctccagaacagtaaga

SEQ ID NO: 85943 - DNA, 16 bp, H. sapiens
ctccagaacctgttgt

SEQ ID NO: 85944 - DNA, 16 bp, H. sapiens
ctccagaactgtaaaa

SEQ ID NO: 85945 - DNA, 16 bp, H. sapiens
ctccagaactgtgagg

SEQ ID NO: 85946 - DNA, 16 bp, H. sapiens
ctccagaactttctca

SEQ ID NO: 85947 - DNA, 16 bp, H. sapiens
ctccagaagaaatgca

SEQ ID NO: 85948 - DNA, 16 bp, H. sapiens
ctccagaagtgctggg

SEQ ID NO: 85949 - DNA, 16 bp, H. sapiens
ctccagaatagtgaga

SEQ ID NO: 85950 - DNA, 16 bp, H. sapiens
ctccagaattgtgaga

SEQ ID NO: 85951 - DNA, 16 bp, H. sapiens
ctccagaattgtgagg

SEQ ID NO: 85952 - DNA, 16 bp, H. sapiens
ctccagaatttggaaa

SEQ ID NO: 85953 - DNA, 16 bp, H. sapiens
ctccagacagagcagc

SEQ ID NO: 85954 - DNA, 16 bp, H. sapiens
ctccagacccagagca

SEQ ID NO: 85955 - DNA, 16 bp, H. sapiens
ctccagaccccagaag

SEQ ID NO: 85956 - DNA, 17 bp, H. sapiens
ctccagacgcgccacct

SEQ ID NO: 85957 - DNA, 16 bp, H. sapiens
ctccagactcagcctc

SEQ ID NO: 85958 - DNA, 16 bp, H. sapiens
ctccagactgggtgat

SEQ ID NO: 85959 - DNA, 16 bp, H. sapiens
ctccagagaaaaagaa

SEQ ID NO: 85960 - DNA, 16 bp, H. sapiens
ctccagagaaatagaa

SEQ ID NO: 85961 - DNA, 16 bp, H. sapiens
ctccagagaatcagaa

SEQ ID NO: 85962 - DNA, 16 bp, H. sapiens
ctccagagagacagaa

SEQ ID NO: 85963 - DNA, 16 bp, H. sapiens
ctccagagagggagct

SEQ ID NO: 85964 - DNA, 16 bp, H. sapiens
ctccagagcccagaat

SEQ ID NO: 85965 - DNA, 16 bp, H. sapiens
ctccagagcctccaga

SEQ ID NO: 85966 - DNA, 16 bp, H. sapiens
ctccagagcctgggcg

SEQ ID NO: 85967 - DNA, 16 bp, H. sapiens
ctccagaggcagaggc

SEQ ID NO: 85968 - DNA, 16 bp, H. sapiens
ctccagaggtggggct

SEQ ID NO: 85969 - DNA, 16 bp, H. sapiens
ctccagagtcatctgc

SEQ ID NO: 85970 - DNA, 16 bp, H. sapiens
ctccagagtggctggg

SEQ ID NO: 85971 - DNA, 16 bp, H. sapiens
ctccagatcctgtttg

SEQ ID NO: 85972 - DNA, 16 bp, H. sapiens
ctccagatctgtcact

SEQ ID NO: 85973 - DNA, 16 bp, H. sapiens
ctccagatgcgctgcc

SEQ ID NO: 85974 - DNA, 16 bp, H. sapiens
ctccagcaaacaccaa

SEQ ID NO: 85975 - DNA, 16 bp, H. sapiens
ctccagcaacagatcc

SEQ ID NO: 85976 - DNA, 16 bp, H. sapiens
ctccagcaaggacaca

SEQ ID NO: 85977 - DNA, 16 bp, H. sapiens
ctccagcaaggccagg

SEQ ID NO: 85978 - DNA, 16 bp, H. sapiens
ctccagcaagggcaca

SEQ ID NO: 85979 - DNA, 16 bp, H. sapiens
ctccagcaatttgtca

SEQ ID NO: 85980 - DNA, 16 bp, H. sapiens
ctccagcacaggtgac

SEQ ID NO: 85981 - DNA, 16 bp, H. sapiens
ctccagcagcacatca

SEQ ID NO: 85982 - DNA, 16 bp, H. sapiens
ctccagcagcccagag

SEQ ID NO: 85983 - DNA, 16 bp, H. sapiens
ctccagcagcctgggc

SEQ ID NO: 85984 - DNA, 16 bp, H. sapiens
ctccagcagctgggac

SEQ ID NO: 85985 - DNA, 16 bp, H. sapiens
ctccagcagcttctgc

SEQ ID NO: 85986 - DNA, 16 bp, H. sapiens
ctccagcaggggcaca

SEQ ID NO: 85987 - DNA, 16 bp, H. sapiens
ctccagcatctattgt

SEQ ID NO: 85988 - DNA, 16 bp, H. sapiens
ctccagcatctgtttc

SEQ ID NO: 85989 - DNA, 16 bp, H. sapiens
ctccagcatggcaaca

SEQ ID NO: 85990 - DNA, 16 bp, H. sapiens
ctccagcatgggcgat

SEQ ID NO: 85991 - DNA, 16 bp, H. sapiens
ctccagcatgggggac

SEQ ID NO: 85992 - DNA, 16 bp, H. sapiens
ctccagccaacagcca

SEQ ID NO: 85993 - DNA, 16 bp, H. sapiens
ctccagccaatggaga

SEQ ID NO: 85994 - DNA, 16 bp, H. sapiens
ctccagccaccctggc

SEQ ID NO: 85995 - DNA, 16 bp, H. sapiens
ctccagccactccagc

SEQ ID NO: 85996 - DNA, 16 bp, H. sapiens
ctccagccagccagcc

SEQ ID NO: 85997 - DNA, 16 bp, H. sapiens
ctccagccagcctggg

SEQ ID NO: 85998 - DNA, 16 bp, H. sapiens
ctccagccagggcagc

SEQ ID NO: 85999 - DNA, 16 bp, H. sapiens
ctccagccagggggac

SEQ ID NO: 86000 - DNA, 16 bp, H. sapiens
ctccagccatcctccc

SEQ ID NO: 86001 - DNA, 16 bp, H. sapiens
ctccagcccagacctc

SEQ ID NO: 86002 - DNA, 16 bp, H. sapiens
ctccagcccagcccag

SEQ ID NO: 86003 - DNA, 16 bp, H. sapiens
ctccagcccagcctcc

SEQ ID NO: 86004 - DNA, 16 bp, H. sapiens
ctccagcccaggcctc

SEQ ID NO: 86005 - DNA, 16 bp, H. sapiens
ctccagcccaggcgac

SEQ ID NO: 86006 - DNA, 16 bp, H. sapiens
ctccagccccagcctc

SEQ ID NO: 86007 - DNA, 16 bp, H. sapiens
ctccagccccagctcc

SEQ ID NO: 86008 - DNA, 16 bp, H. sapiens
ctccagccccagctgc

SEQ ID NO: 86009 - DNA, 16 bp, H. sapiens
ctccagccccaggcaa

SEQ ID NO: 86010 - DNA, 16 bp, H. sapiens
ctccagccccagggcc

SEQ ID NO: 86011 - DNA, 16 bp, H. sapiens
ctccagccccatctct

SEQ ID NO: 86012 - DNA, 16 bp, H. sapiens
ctccagcccctcctgg

SEQ ID NO: 86013 - DNA, 16 bp, H. sapiens
ctccagcccctggcag

SEQ ID NO: 86014 - DNA, 16 bp, H. sapiens
ctccagccccttccct

SEQ ID NO: 86015 - DNA, 16 bp, H. sapiens
ctccagccccttcctg

SEQ ID NO: 86016 - DNA, 16 bp, H. sapiens
ctccagcccggacaac

SEQ ID NO: 86017 - DNA, 16 bp, H. sapiens
ctccagcccgggcgac

SEQ ID NO: 86018 - DNA, 16 bp, H. sapiens
ctccagcccggggaac

SEQ ID NO: 86019 - DNA, 16 bp, H. sapiens
ctccagccctaaggtg

SEQ ID NO: 86020 - DNA, 16 bp, H. sapiens
ctccagccctccagcc

SEQ ID NO: 86021 - DNA, 16 bp, H. sapiens
ctccagccctggcctc

SEQ ID NO: 86022 - DNA, 16 bp, H. sapiens
ctccagcccttcctcc

SEQ ID NO: 86023 - DNA, 16 bp, H. sapiens
ctccagccgggtgaca

SEQ ID NO: 86024 - DNA, 16 bp, H. sapiens
ctccagcctagaggac

SEQ ID NO: 86025 - DNA, 16 bp, H. sapiens
ctccagcctaggcagc

SEQ ID NO: 86026 - DNA, 16 bp, H. sapiens
ctccagcctcacctcc

SEQ ID NO: 86027 - DNA, 16 bp, H. sapiens
ctccagcctcagccag

SEQ ID NO: 86028 - DNA, 16 bp, H. sapiens
ctccagcctcagcccc

SEQ ID NO: 86029 - DNA, 16 bp, H. sapiens
ctccagcctcagccta

SEQ ID NO: 86030 - DNA, 16 bp, H. sapiens
ctccagcctcagcctc

SEQ ID NO: 86031 - DNA, 16 bp, H. sapiens
ctccagcctcagcctg

SEQ ID NO: 86032 - DNA, 16 bp, H. sapiens
ctccagcctcagcgac

SEQ ID NO: 86033 - DNA, 16 bp, H. sapiens
ctccagcctcagcttc

SEQ ID NO: 86034 - DNA, 16 bp, H. sapiens
ctccagcctcatcctc

SEQ ID NO: 86035 - DNA, 16 bp, H. sapiens
ctccagcctccagcct

SEQ ID NO: 86036 - DNA, 16 bp, H. sapiens
ctccagcctccaggac

SEQ ID NO: 86037 - DNA, 16 bp, H. sapiens
ctccagcctccagggc

SEQ ID NO: 86038 - DNA, 16 bp, H. sapiens
ctccagcctccccagc

SEQ ID NO: 86039 - DNA, 16 bp, H. sapiens
ctccagcctccgcctc

SEQ ID NO: 86040 - DNA, 16 bp, H. sapiens
ctccagcctcctctcc

SEQ ID NO: 86041 - DNA, 16 bp, H. sapiens
ctccagcctctcccca

SEQ ID NO: 86042 - DNA, 16 bp, H. sapiens
ctccagcctgaatgag

SEQ ID NO: 86043 - DNA, 16 bp, H. sapiens
ctccagcctgacaaca

SEQ ID NO: 86044 - DNA, 16 bp, H. sapiens
ctccagcctgaccaac

SEQ ID NO: 86045 - DNA, 16 bp, H. sapiens
ctccagcctgactgac

SEQ ID NO: 86046 - DNA, 16 bp, H. sapiens
ctccagcctgagaaac

SEQ ID NO: 86047 - DNA, 16 bp, H. sapiens
ctccagcctgcaggac

SEQ ID NO: 86048 - DNA, 16 bp, H. sapiens
ctccagcctgcatgac

SEQ ID NO: 86049 - DNA, 16 bp, H. sapiens
ctccagcctgctggct

SEQ ID NO: 86050 - DNA, 16 bp, H. sapiens
ctccagcctgcttttc

SEQ ID NO: 86051 - DNA, 16 bp, H. sapiens
ctccagcctggacagc

SEQ ID NO: 86052 - DNA, 16 bp, H. sapiens
ctccagcctggaccac

SEQ ID NO: 86053 - DNA, 16 bp, H. sapiens
ctccagcctggagaaa

SEQ ID NO: 86054 - DNA, 16 bp, H. sapiens
ctccagcctggatgat

SEQ ID NO: 86055 - DNA, 16 bp, H. sapiens
ctccagcctggcctac

SEQ ID NO: 86056 - DNA, 16 bp, H. sapiens
ctccagcctggcgacg

SEQ ID NO: 86057 - DNA, 17 bp, H. sapiens
ctccagcctggcggaca

SEQ ID NO: 86058 - DNA, 16 bp, H. sapiens
ctccagcctggctgag

SEQ ID NO: 86059 - DNA, 16 bp, H. sapiens
ctccagcctgggaaaa

SEQ ID NO: 86060 - DNA, 16 bp, H. sapiens
ctccagcctgggagat

SEQ ID NO: 86061 - DNA, 16 bp, H. sapiens
ctccagcctgggaggg

SEQ ID NO: 86062 - DNA, 16 bp, H. sapiens
ctccagcctgggcacc

SEQ ID NO: 86063 - DNA, 16 bp, H. sapiens
ctccagcctgggctcc

SEQ ID NO: 86064 - DNA, 16 bp, H. sapiens
ctccagcctgggctgc

SEQ ID NO: 86065 - DNA, 16 bp, H. sapiens
ctccagcctgggggag

SEQ ID NO: 86066 - DNA, 17 bp, H. sapiens
ctccagcctgggtgacc

SEQ ID NO: 86067 - DNA, 16 bp, H. sapiens
ctccagcctggtgtca

SEQ ID NO: 86068 - DNA, 16 bp, H. sapiens
ctccagcctgtgcaga

SEQ ID NO: 86069 - DNA, 16 bp, H. sapiens
ctccagcctgtgtgat

SEQ ID NO: 86070 - DNA, 16 bp, H. sapiens
ctccagcctgttgaca

SEQ ID NO: 86071 - DNA, 16 bp, H. sapiens
ctccagccttggcaaa

SEQ ID NO: 86072 - DNA, 16 bp, H. sapiens
ctccagccttggcaac

SEQ ID NO: 86073 - DNA, 16 bp, H. sapiens
ctccagccttggcagc

SEQ ID NO: 86074 - DNA, 16 bp, H. sapiens
ctccagccttggcctc

SEQ ID NO: 86075 - DNA, 16 bp, H. sapiens
ctccagctccagcccc

SEQ ID NO: 86076 - DNA, 16 bp, H. sapiens
ctccagctccagcctc

SEQ ID NO: 86077 - DNA, 16 bp, H. sapiens
ctccagctccagcctg

SEQ ID NO: 86078 - DNA, 16 bp, H. sapiens
ctccagctccagctcc

SEQ ID NO: 86079 - DNA, 16 bp, H. sapiens
ctccagctccatccct

SEQ ID NO: 86080 - DNA, 16 bp, H. sapiens
ctccagctccatgacc

SEQ ID NO: 86081 - DNA, 16 bp, H. sapiens
ctccagctcccaggct

SEQ ID NO: 86082 - DNA, 16 bp, H. sapiens
ctccagctcctcctct

SEQ ID NO: 86083 - DNA, 16 bp, H. sapiens
ctccagctcctctccc

SEQ ID NO: 86084 - DNA, 16 bp, H. sapiens
ctccagctcctgcccc

SEQ ID NO: 86085 - DNA, 16 bp, H. sapiens
ctccagctcctggact

SEQ ID NO: 86086 - DNA, 16 bp, H. sapiens
ctccagctcctgggct

SEQ ID NO: 86087 - DNA, 16 bp, H. sapiens
ctccagctgacagcca

SEQ ID NO: 86088 - DNA, 16 bp, H. sapiens
ctccagctgagaccac

SEQ ID NO: 86089 - DNA, 16 bp, H. sapiens
ctccagctgcttgctg

SEQ ID NO: 86090 - DNA, 16 bp, H. sapiens
ctccagctggggagac

SEQ ID NO: 86091 - DNA, 16 bp, H. sapiens
ctccagctgtgagcct

SEQ ID NO: 86092 - DNA, 16 bp, H. sapiens
ctccagcttcagcctc

SEQ ID NO: 86093 - DNA, 16 bp, H. sapiens
ctccagcttcatccat

SEQ ID NO: 86094 - DNA, 16 bp, H. sapiens
ctccagcttcattcat

SEQ ID NO: 86095 - DNA, 16 bp, H. sapiens
ctccagcttcctccca

SEQ ID NO: 86096 - DNA, 16 bp, H. sapiens
ctccagcttgggtggc

SEQ ID NO: 86097 - DNA, 16 bp, H. sapiens
ctccagctttgatctt

SEQ ID NO: 86098 - DNA, 16 bp, H. sapiens
ctccagctttggtctt

SEQ ID NO: 86099 - DNA, 16 bp, H. sapiens
ctccagctttgttctt

SEQ ID NO: 86100 - DNA, 16 bp, H. sapiens
ctccaggaagccctct

SEQ ID NO: 86101 - DNA, 16 bp, H. sapiens
ctccaggaaggcctcc

SEQ ID NO: 86102 - DNA, 16 bp, H. sapiens
ctccaggacccatctc

SEQ ID NO: 86103 - DNA, 16 bp, H. sapiens
ctccaggagagagaga

SEQ ID NO: 86104 - DNA, 16 bp, H. sapiens
ctccaggagagcaggg

SEQ ID NO: 86105 - DNA, 16 bp, H. sapiens
ctccaggaggggctgg

SEQ ID NO: 86106 - DNA, 16 bp, H. sapiens
ctccaggaggtggagg

SEQ ID NO: 86107 - DNA, 16 bp, H. sapiens
ctccaggcaccagcac

SEQ ID NO: 86108 - DNA, 16 bp, H. sapiens
ctccaggcagcacagc

SEQ ID NO: 86109 - DNA, 16 bp, H. sapiens
ctccaggcatccctgg

SEQ ID NO: 86110 - DNA, 16 bp, H. sapiens
ctccaggccactttgc

SEQ ID NO: 86111 - DNA, 16 bp, H. sapiens
ctccaggcccaggtgg

SEQ ID NO: 86112 - DNA, 16 bp, H. sapiens
ctccaggccccagaat

SEQ ID NO: 86113 - DNA, 16 bp, H. sapiens
ctccaggcccccagcc

SEQ ID NO: 86114 - DNA, 16 bp, H. sapiens
ctccaggcctctctcc

SEQ ID NO: 86115 - DNA, 16 bp, H. sapiens
ctccaggcctgcccca

SEQ ID NO: 86116 - DNA, 16 bp, H. sapiens
ctccaggcctgcctcc

SEQ ID NO: 86117 - DNA, 16 bp, H. sapiens
ctccaggctccaggct

SEQ ID NO: 86118 - DNA, 16 bp, H. sapiens
ctccaggctgcagtgc

SEQ ID NO: 86119 - DNA, 16 bp, H. sapiens
ctccaggctggacaac

SEQ ID NO: 86120 - DNA, 16 bp, H. sapiens
ctccaggctgggcaca

SEQ ID NO: 86121 - DNA, 16 bp, H. sapiens
ctccaggctgggcgat

SEQ ID NO: 86122 - DNA, 17 bp, H. sapiens
ctccagggcatttcaga

SEQ ID NO: 86123 - DNA, 16 bp, H. sapiens
ctccagggccccaggg

SEQ ID NO: 86124 - DNA, 16 bp, H. sapiens
ctccagggcctggctc

SEQ ID NO: 86125 - DNA, 16 bp, H. sapiens
ctccagggctccaggg

SEQ ID NO: 86126 - DNA, 16 bp, H. sapiens
ctccagggggaaaaaa

SEQ ID NO: 86127 - DNA, 16 bp, H. sapiens
ctccagggtatgtcag

SEQ ID NO: 86128 - DNA, 16 bp, H. sapiens
ctccagggttccagtg

SEQ ID NO: 86129 - DNA, 16 bp, H. sapiens
ctccaggtgaggcctg

SEQ ID NO: 86130 - DNA, 16 bp, H. sapiens
ctccaggtgcaggagg

SEQ ID NO: 86131 - DNA, 16 bp, H. sapiens
ctccaggtggacttca

SEQ ID NO: 86132 - DNA, 16 bp, H. sapiens
ctccaggttcatctgt

SEQ ID NO: 86133 - DNA, 16 bp, H. sapiens
ctccaggttctctggc

SEQ ID NO: 86134 - DNA, 16 bp, H. sapiens
ctccaggttctttggc

SEQ ID NO: 86135 - DNA, 16 bp, H. sapiens
ctccagtctcctgcac

SEQ ID NO: 86136 - DNA, 16 bp, H. sapiens
ctccagtctctgcctc

SEQ ID NO: 86137 - DNA, 16 bp, H. sapiens
ctccagtgaacacata

SEQ ID NO: 86138 - DNA, 16 bp, H. sapiens
ctccagtgcctggcac

SEQ ID NO: 86139 - DNA, 16 bp, H. sapiens
ctccagtgttggaggt

SEQ ID NO: 86140 - DNA, 16 bp, H. sapiens
ctccagttccattcac

SEQ ID NO: 86141 - DNA, 16 bp, H. sapiens
ctccagttcccaccca

SEQ ID NO: 86142 - DNA, 16 bp, H. sapiens
ctccagttcctcttcc

SEQ ID NO: 86143 - DNA, 16 bp, H. sapiens
ctccagttcctgccca

SEQ ID NO: 86144 - DNA, 16 bp, H. sapiens
ctccagttctgctctg

SEQ ID NO: 86145 - DNA, 16 bp, H. sapiens
ctccagttttcttctt

SEQ ID NO: 86146 - DNA, 16 bp, H. sapiens
ctccagtttttgtttt

SEQ ID NO: 86147 - DNA, 16 bp, H. sapiens
ctccataaaaatccct

SEQ ID NO: 86148 - DNA, 16 bp, H. sapiens
ctccatcaagaaagaa

SEQ ID NO: 86149 - DNA, 16 bp, H. sapiens
ctccatcacccaggtt

SEQ ID NO: 86150 - DNA, 16 bp, H. sapiens
ctccatcacctgggct

SEQ ID NO: 86151 - DNA, 16 bp, H. sapiens
ctccatccacctcctg

SEQ ID NO: 86152 - DNA, 16 bp, H. sapiens
ctccatccagcctggc

SEQ ID NO: 86153 - DNA, 16 bp, H. sapiens
ctccatccatgttgct

SEQ ID NO: 86154 - DNA, 16 bp, H. sapiens
ctccatccattttcct

SEQ ID NO: 86155 - DNA, 16 bp, H. sapiens
ctccatcccatcccag

SEQ ID NO: 86156 - DNA, 16 bp, H. sapiens
ctccatccccagcctg

SEQ ID NO: 86157 - DNA, 16 bp, H. sapiens
ctccatccccagctcc

SEQ ID NO: 86158 - DNA, 16 bp, H. sapiens
ctccatcccccaggct

SEQ ID NO: 86159 - DNA, 16 bp, H. sapiens
ctccatccctgtccct

SEQ ID NO: 86160 - DNA, 16 bp, H. sapiens
ctccatccctgtggct

SEQ ID NO: 86161 - DNA, 16 bp, H. sapiens
ctccatcctaaaaaaa

SEQ ID NO: 86162 - DNA, 16 bp, H. sapiens
ctccatcctcagcctc

SEQ ID NO: 86163 - DNA, 16 bp, H. sapiens
ctccatcctccccagc

SEQ ID NO: 86164 - DNA, 16 bp, H. sapiens
ctccatcctcctgcct

SEQ ID NO: 86165 - DNA, 16 bp, H. sapiens
ctccatcctgaaggaa

SEQ ID NO: 86166 - DNA, 16 bp, H. sapiens
ctccatcctgagtgac

SEQ ID NO: 86167 - DNA, 16 bp, H. sapiens
ctccatcctgctgccc

SEQ ID NO: 86168 - DNA, 16 bp, H. sapiens
ctccatcctggacaac

SEQ ID NO: 86169 - DNA, 16 bp, H. sapiens
ctccatcctgggcaaa

SEQ ID NO: 86170 - DNA, 16 bp, H. sapiens
ctccatcctgggcaag

SEQ ID NO: 86171 - DNA, 16 bp, H. sapiens
ctccatcctgggcagc

SEQ ID NO: 86172 - DNA, 16 bp, H. sapiens
ctccatcctgggtaac

SEQ ID NO: 86173 - DNA, 16 bp, H. sapiens
ctccatcctgggtggc

SEQ ID NO: 86174 - DNA, 16 bp, H. sapiens
ctccatctcaaaaaca

SEQ ID NO: 86175 - DNA, 16 bp, H. sapiens
ctccatctcaaaatga

SEQ ID NO: 86176 - DNA, 16 bp, H. sapiens
ctccatctcagaataa

SEQ ID NO: 86177 - DNA, 16 bp, H. sapiens
ctccatctcagcatct

SEQ ID NO: 86178 - DNA, 16 bp, H. sapiens
ctccatctccaaaaca

SEQ ID NO: 86179 - DNA, 16 bp, H. sapiens
ctccatctccaaagcc

SEQ ID NO: 86180 - DNA, 16 bp, H. sapiens
ctccatctccatctct

SEQ ID NO: 86181 - DNA, 16 bp, H. sapiens
ctccatctcctgccct

SEQ ID NO: 86182 - DNA, 16 bp, H. sapiens
ctccatctcctgggct

SEQ ID NO: 86183 - DNA, 16 bp, H. sapiens
ctccatctctaataaa

SEQ ID NO: 86184 - DNA, 16 bp, H. sapiens
ctccatctctctgtct

SEQ ID NO: 86185 - DNA, 16 bp, H. sapiens
ctccatctctgggggc

SEQ ID NO: 86186 - DNA, 16 bp, H. sapiens
ctccatctgtaagggc

SEQ ID NO: 86187 - DNA, 16 bp, H. sapiens
ctccatcttaaaaaaa

SEQ ID NO: 86188 - DNA, 16 bp, H. sapiens
ctccatcttcaaagtc

SEQ ID NO: 86189 - DNA, 16 bp, H. sapiens
ctccatcttcatatgg

SEQ ID NO: 86190 - DNA, 16 bp, H. sapiens
ctccatgaagacagag

SEQ ID NO: 86191 - DNA, 16 bp, H. sapiens
ctccatgcctcagcct

SEQ ID NO: 86192 - DNA, 16 bp, H. sapiens
ctccatgcctggcttg

SEQ ID NO: 86193 - DNA, 16 bp, H. sapiens
ctccatggagccagtg

SEQ ID NO: 86194 - DNA, 16 bp, H. sapiens
ctccatggatcagctg

SEQ ID NO: 86195 - DNA, 16 bp, H. sapiens
ctccatggcctcccaa

SEQ ID NO: 86196 - DNA, 16 bp, H. sapiens
ctccatggctcccacc

SEQ ID NO: 86197 - DNA, 16 bp, H. sapiens
ctccatgggggtggga

SEQ ID NO: 86198 - DNA, 16 bp, H. sapiens
ctccatgtccccaccc

SEQ ID NO: 86199 - DNA, 16 bp, H. sapiens
ctccatgtctttgcta

SEQ ID NO: 86200 - DNA, 16 bp, H. sapiens
ctccatgtggcctctc

SEQ ID NO: 86201 - DNA, 22 bp, H. sapiens
ctccatgttggtcaggctggtc

SEQ ID NO: 86202 - DNA, 16 bp, H. sapiens
ctccattccagccaca

SEQ ID NO: 86203 - DNA, 16 bp, H. sapiens
ctccattctagcctgg

SEQ ID NO: 86204 - DNA, 16 bp, H. sapiens
ctccattctctccctg

SEQ ID NO: 86205 - DNA, 16 bp, H. sapiens
ctccatttaaaaaaaa

SEQ ID NO: 86206 - DNA, 16 bp, H. sapiens
ctccatttaacccaaa

SEQ ID NO: 86207 - DNA, 16 bp, H. sapiens
ctccatttcctcattt

SEQ ID NO: 86208 - DNA, 16 bp, H. sapiens
ctccatttctgtctct

SEQ ID NO: 86209 - DNA, 16 bp, H. sapiens
ctccatttgagtggaa

SEQ ID NO: 86210 - DNA, 16 bp, H. sapiens
ctccattttacagata

SEQ ID NO: 86211 - DNA, 16 bp, H. sapiens
ctccattttagaaaaa

SEQ ID NO: 86212 - DNA, 16 bp, H. sapiens
ctccattttatagaag

SEQ ID NO: 86213 - DNA, 16 bp, H. sapiens
ctccattttttaaaaa

SEQ ID NO: 86214 - DNA, 16 bp, H. sapiens
ctcccaaaaagatatg

SEQ ID NO: 86215 - DNA, 16 bp, H. sapiens
ctcccaaaatgctaga

SEQ ID NO: 86216 - DNA, 16 bp, H. sapiens
ctcccaaaatgctagt

SEQ ID NO: 86217 - DNA, 16 bp, H. sapiens
ctcccaaaatgctgat

SEQ ID NO: 86218 - DNA, 16 bp, H. sapiens
ctcccaaaatgctggt

SEQ ID NO: 86219 - DNA, 16 bp, H. sapiens
ctcccaaaatgtgggg

SEQ ID NO: 86220 - DNA, 16 bp, H. sapiens
ctcccaaaatgttggt

SEQ ID NO: 86221 - DNA, 16 bp, H. sapiens
ctcccaaaattcacat

SEQ ID NO: 86222 - DNA, 16 bp, H. sapiens
ctcccaaactgatggg

SEQ ID NO: 86223 - DNA, 16 bp, H. sapiens
ctcccaaactgttggg

SEQ ID NO: 86224 - DNA, 16 bp, H. sapiens
ctcccaaagaactggg

SEQ ID NO: 86225 - DNA, 19 bp, H. sapiens
ctcccaaagtattgtgatt

SEQ ID NO: 86226 - DNA, 16 bp, H. sapiens
ctcccaaagtgatgga

SEQ ID NO: 86227 - DNA, 16 bp, H. sapiens
ctcccaaagtgctagt

SEQ ID NO: 86228 - DNA, 16 bp, H. sapiens
ctcccaaagtgctgaa

SEQ ID NO: 86229 - DNA, 16 bp, H. sapiens
ctcccaaagtgctgac

SEQ ID NO: 86230 - DNA, 16 bp, H. sapiens
ctcccaaagtgctgga

SEQ ID NO: 86231 - DNA, 16 bp, H. sapiens
ctcccaaagtgctggc

SEQ ID NO: 86232 - DNA, 16 bp, H. sapiens
ctcccaaagtgctggt

SEQ ID NO: 86233 - DNA, 16 bp, H. sapiens
ctcccaaagtgctgta

SEQ ID NO: 86234 - DNA, 16 bp, H. sapiens
ctcccaaagtgttgga

SEQ ID NO: 86235 - DNA, 20 bp, H. sapiens
ctcccaaagttctaggatta

SEQ ID NO: 86236 - DNA, 16 bp, H. sapiens
ctcccaaatctcaagt

SEQ ID NO: 86237 - DNA, 16 bp, H. sapiens
ctcccaaatgtctatt

SEQ ID NO: 86238 - DNA, 16 bp, H. sapiens
ctcccaacacaaagaa

SEQ ID NO: 86239 - DNA, 16 bp, H. sapiens
ctcccaacatgtcccc

SEQ ID NO: 86240 - DNA, 24 bp, H. sapiens
ctcccaagactaaaccaggaagaa

SEQ ID NO: 86241 - DNA, 16 bp, H. sapiens
ctcccaagcaaatgga

SEQ ID NO: 86242 - DNA, 17 bp, H. sapiens
ctcccaagcaactggga

SEQ ID NO: 86243 - DNA, 17 bp, H. sapiens
ctcccaagcagccggga

SEQ ID NO: 86244 - DNA, 16 bp, H. sapiens
ctcccaagtagctaga

SEQ ID NO: 86245 - DNA, 16 bp, H. sapiens
ctcccaagtagctggc

SEQ ID NO: 86246 - DNA, 16 bp, H. sapiens
ctcccaagtagcttga

SEQ ID NO: 86247 - DNA, 16 bp, H. sapiens
ctcccaagtatctggg

SEQ ID NO: 86248 - DNA, 16 bp, H. sapiens
ctcccaagtgctggca

SEQ ID NO: 86249 - DNA, 16 bp, H. sapiens
ctcccaagtggctgag

SEQ ID NO: 86250 - DNA, 16 bp, H. sapiens
ctcccaagttcaagcg

SEQ ID NO: 86251 - DNA, 16 bp, H. sapiens
ctcccaatatcacaga

SEQ ID NO: 86252 - DNA, 16 bp, H. sapiens
ctcccacaacacgtgg

SEQ ID NO: 86253 - DNA, 16 bp, H. sapiens
ctcccacacaataaaa

SEQ ID NO: 86254 - DNA, 16 bp, H. sapiens
ctcccacacacagctg

SEQ ID NO: 86255 - DNA, 16 bp, H. sapiens
ctcccacacagccggc

SEQ ID NO: 86256 - DNA, 16 bp, H. sapiens
ctcccacagcccctgg

SEQ ID NO: 86257 - DNA, 16 bp, H. sapiens
ctcccacagcctcctg

SEQ ID NO: 86258 - DNA, 16 bp, H. sapiens
ctcccacagggctggg

SEQ ID NO: 86259 - DNA, 16 bp, H. sapiens
ctcccacagtgctagg

SEQ ID NO: 86260 - DNA, 16 bp, H. sapiens
ctcccacatatgagtg

SEQ ID NO: 86261 - DNA, 16 bp, H. sapiens
ctcccacatcagcctc

SEQ ID NO: 86262 - DNA, 16 bp, H. sapiens
ctcccacatcagtctc

SEQ ID NO: 86263 - DNA, 16 bp, H. sapiens
ctcccaccagcaatgc

SEQ ID NO: 86264 - DNA, 16 bp, H. sapiens
ctcccaccagcagtgc

SEQ ID NO: 86265 - DNA, 16 bp, H. sapiens
ctcccaccaggtccct

SEQ ID NO: 86266 - DNA, 16 bp, H. sapiens
ctcccaccaggtctct

SEQ ID NO: 86267 - DNA, 16 bp, H. sapiens
ctcccaccatctgcca

SEQ ID NO: 86268 - DNA, 16 bp, H. sapiens
ctcccaccccagcatc

SEQ ID NO: 86269 - DNA, 16 bp, H. sapiens
ctcccaccccaggctg

SEQ ID NO: 86270 - DNA, 16 bp, H. sapiens
ctcccaccctgtggag

SEQ ID NO: 86271 - DNA, 16 bp, H. sapiens
ctcccaccgcagcctc

SEQ ID NO: 86272 - DNA, 16 bp, H. sapiens
ctcccaccgggcccca

SEQ ID NO: 86273 - DNA, 16 bp, H. sapiens
ctcccaccgtggcctc

SEQ ID NO: 86274 - DNA, 16 bp, H. sapiens
ctcccacctcagcagc

SEQ ID NO: 86275 - DNA, 16 bp, H. sapiens
ctcccacctcaggccc

SEQ ID NO: 86276 - DNA, 16 bp, H. sapiens
ctcccacctcagtctc

SEQ ID NO: 86277 - DNA, 16 bp, H. sapiens
ctcccacctccagcct

SEQ ID NO: 86278 - DNA, 16 bp, H. sapiens
ctcccacctcccagct

SEQ ID NO: 86279 - DNA, 16 bp, H. sapiens
ctcccacctcggcctt

SEQ ID NO: 86280 - DNA, 16 bp, H. sapiens
ctcccacctcgggctc

SEQ ID NO: 86281 - DNA, 16 bp, H. sapiens
ctcccacctctcagcc

SEQ ID NO: 86282 - DNA, 16 bp, H. sapiens
ctcccacctgaacctc

SEQ ID NO: 86283 - DNA, 16 bp, H. sapiens
ctcccacctgcctcct

SEQ ID NO: 86284 - DNA, 16 bp, H. sapiens
ctcccacctgctccct

SEQ ID NO: 86285 - DNA, 16 bp, H. sapiens
ctcccacctggtccct

SEQ ID NO: 86286 - DNA, 16 bp, H. sapiens
ctcccaccttagcctc

SEQ ID NO: 86287 - DNA, 16 bp, H. sapiens
ctcccaccttgacctc

SEQ ID NO: 86288 - DNA, 16 bp, H. sapiens
ctcccactgcagcctc

SEQ ID NO: 86289 - DNA, 16 bp, H. sapiens
ctcccactgcctggct

SEQ ID NO: 86290 - DNA, 16 bp, H. sapiens
ctcccactgctgccta

SEQ ID NO: 86291 - DNA, 16 bp, H. sapiens
ctcccactggccaaag

SEQ ID NO: 86292 - DNA, 16 bp, H. sapiens
ctcccactggctccct

SEQ ID NO: 86293 - DNA, 16 bp, H. sapiens
ctcccactggtccctc

SEQ ID NO: 86294 - DNA, 16 bp, H. sapiens
ctcccacttcaacctc

SEQ ID NO: 86295 - DNA, 16 bp, H. sapiens
ctcccacttcagcctc

SEQ ID NO: 86296 - DNA, 16 bp, H. sapiens
ctcccacttcagtttc

SEQ ID NO: 86297 - DNA, 16 bp, H. sapiens
ctcccactttgccctc

SEQ ID NO: 86298 - DNA, 16 bp, H. sapiens
ctcccagaagcagaag

SEQ ID NO: 86299 - DNA, 16 bp, H. sapiens
ctcccagaagcagatg

SEQ ID NO: 86300 - DNA, 16 bp, H. sapiens
ctcccagaagtgctgg

SEQ ID NO: 86301 - DNA, 16 bp, H. sapiens
ctcccagaatcaagca

SEQ ID NO: 86302 - DNA, 16 bp, H. sapiens
ctcccagaatgctggg

SEQ ID NO: 86303 - DNA, 16 bp, H. sapiens
ctcccagacacacaca

SEQ ID NO: 86304 - DNA, 16 bp, H. sapiens
ctcccagactcaagtg

SEQ ID NO: 86305 - DNA, 16 bp, H. sapiens
ctcccagagcgctggg

SEQ ID NO: 86306 - DNA, 16 bp, H. sapiens
ctcccagaggtggagc

SEQ ID NO: 86307 - DNA, 16 bp, H. sapiens
ctcccagaggtggagt

SEQ ID NO: 86308 - DNA, 16 bp, H. sapiens
ctcccagattcaagca

SEQ ID NO: 86309 - DNA, 16 bp, H. sapiens
ctcccagattcacacc

SEQ ID NO: 86310 - DNA, 16 bp, H. sapiens
ctcccagattcaggtg

SEQ ID NO: 86311 - DNA, 16 bp, H. sapiens
ctcccagcacagcatt

SEQ ID NO: 86312 - DNA, 18 bp, H. sapiens
ctcccagcaccatttatt

SEQ ID NO: 86313 - DNA, 16 bp, H. sapiens
ctcccagcacctgctc

SEQ ID NO: 86314 - DNA, 17 bp, H. sapiens
ctcccagcacttcggga

SEQ ID NO: 86315 - DNA, 21 bp, H. sapiens
ctcccagcactttgggaggcc

SEQ ID NO: 86316 - DNA, 16 bp, H. sapiens
ctcccagcagcccctg

SEQ ID NO: 86317 - DNA, 16 bp, H. sapiens
ctcccagcagccctgg

SEQ ID NO: 86318 - DNA, 16 bp, H. sapiens
ctcccagcagctggga

SEQ ID NO: 86319 - DNA, 16 bp, H. sapiens
ctcccagccaggccct

SEQ ID NO: 86320 - DNA, 16 bp, H. sapiens
ctcccagccatgcctc

SEQ ID NO: 86321 - DNA, 16 bp, H. sapiens
ctcccagcccagcctc

SEQ ID NO: 86322 - DNA, 16 bp, H. sapiens
ctcccagccccacctg

SEQ ID NO: 86323 - DNA, 16 bp, H. sapiens
ctcccagcccctgaca

SEQ ID NO: 86324 - DNA, 16 bp, H. sapiens
ctcccagccccttcct

SEQ ID NO: 86325 - DNA, 16 bp, H. sapiens
ctcccagccctgcctc

SEQ ID NO: 86326 - DNA, 16 bp, H. sapiens
ctcccagccctgcctg

SEQ ID NO: 86327 - DNA, 16 bp, H. sapiens
ctcccagccctgctgc

SEQ ID NO: 86328 - DNA, 16 bp, H. sapiens
ctcccagccctgcttc

SEQ ID NO: 86329 - DNA, 16 bp, H. sapiens
ctcccagccctgtggg

SEQ ID NO: 86330 - DNA, 16 bp, H. sapiens
ctcccagcctcaggtg

SEQ ID NO: 86331 - DNA, 16 bp, H. sapiens
ctcccagcctccagag

SEQ ID NO: 86332 - DNA, 16 bp, H. sapiens
ctcccagcctcccagg

SEQ ID NO: 86333 - DNA, 16 bp, H. sapiens
ctcccagcctcctcct

SEQ ID NO: 86334 - DNA, 16 bp, H. sapiens
ctcccagcctctgccc

SEQ ID NO: 86335 - DNA, 16 bp, H. sapiens
ctcccagccttccctg

SEQ ID NO: 86336 - DNA, 16 bp, H. sapiens
ctcccagccttttttt

SEQ ID NO: 86337 - DNA, 16 bp, H. sapiens
ctcccagctcccagca

SEQ ID NO: 86338 - DNA, 16 bp, H. sapiens
ctcccagctcccagcc

SEQ ID NO: 86339 - DNA, 16 bp, H. sapiens
ctcccagctcctggtg

SEQ ID NO: 86340 - DNA, 16 bp, H. sapiens
ctcccagctgctcagg

SEQ ID NO: 86341 - DNA, 16 bp, H. sapiens
ctcccagctgtgaaag

SEQ ID NO: 86342 - DNA, 16 bp, H. sapiens
ctcccagcttagcctc

SEQ ID NO: 86343 - DNA, 16 bp, H. sapiens
ctcccaggatcaagag

SEQ ID NO: 86344 - DNA, 16 bp, H. sapiens
ctcccaggccagagtg

SEQ ID NO: 86345 - DNA, 16 bp, H. sapiens
ctcccaggccccacct

SEQ ID NO: 86346 - DNA, 16 bp, H. sapiens
ctcccaggccctgccc

SEQ ID NO: 86347 - DNA, 18 bp, H. sapiens
ctcccaggctcaagtgat

SEQ ID NO: 86348 - DNA, 16 bp, H. sapiens
ctcccaggctccagca

SEQ ID NO: 86349 - DNA, 16 bp, H. sapiens
ctcccaggctgaagcc

SEQ ID NO: 86350 - DNA, 16 bp, H. sapiens
ctcccaggctggaggg

SEQ ID NO: 86351 - DNA, 16 bp, H. sapiens
ctcccaggctgggctg

SEQ ID NO: 86352 - DNA, 16 bp, H. sapiens
ctcccaggctggtgtg

SEQ ID NO: 86353 - DNA, 16 bp, H. sapiens
ctcccagggggagggg

SEQ ID NO: 86354 - DNA, 16 bp, H. sapiens
ctcccagggtccctgc

SEQ ID NO: 86355 - DNA, 16 bp, H. sapiens
ctcccaggtcagcctc

SEQ ID NO: 86356 - DNA, 16 bp, H. sapiens
ctcccaggtcctgcag

SEQ ID NO: 86357 - DNA, 16 bp, H. sapiens
ctcccaggtctgggct

SEQ ID NO: 86358 - DNA, 16 bp, H. sapiens
ctcccaggtgcagctg

SEQ ID NO: 86359 - DNA, 16 bp, H. sapiens
ctcccaggtgctgctg

SEQ ID NO: 86360 - DNA, 16 bp, H. sapiens
ctcccaggttgaagag

SEQ ID NO: 86361 - DNA, 16 bp, H. sapiens
ctcccaggtttatgcc

SEQ ID NO: 86362 - DNA, 16 bp, H. sapiens
ctcccagtactatgtt

SEQ ID NO: 86363 - DNA, 16 bp, H. sapiens
ctcccagtaggggctg

SEQ ID NO: 86364 - DNA, 16 bp, H. sapiens
ctcccagtagttggga

SEQ ID NO: 86365 - DNA, 16 bp, H. sapiens
ctcccagtccagtgct

SEQ ID NO: 86366 - DNA, 16 bp, H. sapiens
ctcccagtctgtggtt

SEQ ID NO: 86367 - DNA, 16 bp, H. sapiens
ctcccagtggcctctt

SEQ ID NO: 86368 - DNA, 16 bp, H. sapiens
ctcccataaagggagt

SEQ ID NO: 86369 - DNA, 16 bp, H. sapiens
ctcccataattcccac

SEQ ID NO: 86370 - DNA, 16 bp, H. sapiens
ctcccataattttgtt

SEQ ID NO: 86371 - DNA, 16 bp, H. sapiens
ctcccatacaaaggga

SEQ ID NO: 86372 - DNA, 16 bp, H. sapiens
ctcccatacaataata

SEQ ID NO: 86373 - DNA, 16 bp, H. sapiens
ctcccatcaaagaaaa

SEQ ID NO: 86374 - DNA, 16 bp, H. sapiens
ctcccatctccctgga

SEQ ID NO: 86375 - DNA, 16 bp, H. sapiens
ctcccatctcctctgc

SEQ ID NO: 86376 - DNA, 16 bp, H. sapiens
ctcccatctggcccag

SEQ ID NO: 86377 - DNA, 16 bp, H. sapiens
ctcccatcttagcctc

SEQ ID NO: 86378 - DNA, 16 bp, H. sapiens
ctcccatcttggcccc

SEQ ID NO: 86379 - DNA, 16 bp, H. sapiens
ctcccatcttggcctc

SEQ ID NO: 86380 - DNA, 16 bp, H. sapiens
ctcccatctttgcctc

SEQ ID NO: 86381 - DNA, 16 bp, H. sapiens
ctcccatgataactaa

SEQ ID NO: 86382 - DNA, 16 bp, H. sapiens
ctcccatgtcagcctc

SEQ ID NO: 86383 - DNA, 16 bp, H. sapiens
ctcccattaaaaaaaa

SEQ ID NO: 86384 - DNA, 16 bp, H. sapiens
ctcccatttcggcctc

SEQ ID NO: 86385 - DNA, 16 bp, H. sapiens
ctcccatttggaatag

SEQ ID NO: 86386 - DNA, 16 bp, H. sapiens
ctcccattttacagat

SEQ ID NO: 86387 - DNA, 16 bp, H. sapiens
ctcccattttgttggt

SEQ ID NO: 86388 - DNA, 16 bp, H. sapiens
ctccccaaccccaggc

SEQ ID NO: 86389 - DNA, 16 bp, H. sapiens
ctccccaacccctggc

SEQ ID NO: 86390 - DNA, 16 bp, H. sapiens
ctccccacaacaaaga

SEQ ID NO: 86391 - DNA, 16 bp, H. sapiens
ctccccacaacctctg

SEQ ID NO: 86392 - DNA, 16 bp, H. sapiens
ctccccacaccaagct

SEQ ID NO: 86393 - DNA, 16 bp, H. sapiens
ctccccacagcccctg

SEQ ID NO: 86394 - DNA, 16 bp, H. sapiens
ctccccacagcctcct

SEQ ID NO: 86395 - DNA, 16 bp, H. sapiens
ctccccacagcctctg

SEQ ID NO: 86396 - DNA, 16 bp, H. sapiens
ctccccaccccagggc

SEQ ID NO: 86397 - DNA, 16 bp, H. sapiens
ctccccacccccaggt

SEQ ID NO: 86398 - DNA, 16 bp, H. sapiens
ctccccacccctgcag

SEQ ID NO: 86399 - DNA, 16 bp, H. sapiens
ctccccacctcagcct

SEQ ID NO: 86400 - DNA, 16 bp, H. sapiens
ctccccacttcccaga

SEQ ID NO: 86401 - DNA, 16 bp, H. sapiens
ctccccagacatttca

SEQ ID NO: 86402 - DNA, 16 bp, H. sapiens
ctccccagccatgcag

SEQ ID NO: 86403 - DNA, 16 bp, H. sapiens
ctccccagccccacag

SEQ ID NO: 86404 - DNA, 16 bp, H. sapiens
ctccccagccccagct

SEQ ID NO: 86405 - DNA, 16 bp, H. sapiens
ctccccagccccaggc

SEQ ID NO: 86406 - DNA, 16 bp, H. sapiens
ctccccagcccccagg

SEQ ID NO: 86407 - DNA, 16 bp, H. sapiens
ctccccagccctccag

SEQ ID NO: 86408 - DNA, 16 bp, H. sapiens
ctccccagccctgcag

SEQ ID NO: 86409 - DNA, 16 bp, H. sapiens
ctccccagcccttggc

SEQ ID NO: 86410 - DNA, 16 bp, H. sapiens
ctccccagcctcctct

SEQ ID NO: 86411 - DNA, 16 bp, H. sapiens
ctccccagcctgcaga

SEQ ID NO: 86412 - DNA, 16 bp, H. sapiens
ctccccagcctgccct

SEQ ID NO: 86413 - DNA, 16 bp, H. sapiens
ctccccagcctggccc

SEQ ID NO: 86414 - DNA, 16 bp, H. sapiens
ctccccagccttgtgg

SEQ ID NO: 86415 - DNA, 16 bp, H. sapiens
ctccccagctccccag

SEQ ID NO: 86416 - DNA, 16 bp, H. sapiens
ctccccagctcctggc

SEQ ID NO: 86417 - DNA, 16 bp, H. sapiens
ctccccaggacccagg

SEQ ID NO: 86418 - DNA, 16 bp, H. sapiens
ctccccaggcccaggt

SEQ ID NO: 86419 - DNA, 16 bp, H. sapiens
ctccccaggccccagc

SEQ ID NO: 86420 - DNA, 16 bp, H. sapiens
ctccccagggcctctg

SEQ ID NO: 86421 - DNA, 16 bp, H. sapiens
ctccccaggtctccag

SEQ ID NO: 86422 - DNA, 16 bp, H. sapiens
ctccccaggtgatttg

SEQ ID NO: 86423 - DNA, 16 bp, H. sapiens
ctccccaggttcaagc

SEQ ID NO: 86424 - DNA, 17 bp, H. sapiens
ctccccagtagctggga

SEQ ID NO: 86425 - DNA, 16 bp, H. sapiens
ctccccatcagtttca

SEQ ID NO: 86426 - DNA, 16 bp, H. sapiens
ctccccatcccactga

SEQ ID NO: 86427 - DNA, 16 bp, H. sapiens
ctccccatctgtaaaa

SEQ ID NO: 86428 - DNA, 16 bp, H. sapiens
ctccccatttgccttc

SEQ ID NO: 86429 - DNA, 16 bp, H. sapiens
ctcccccaaccccatg

SEQ ID NO: 86430 - DNA, 16 bp, H. sapiens
ctcccccagcccaggg

SEQ ID NO: 86431 - DNA, 16 bp, H. sapiens
ctcccccagccccaga

SEQ ID NO: 86432 - DNA, 16 bp, H. sapiens
ctcccccagcctctgg

SEQ ID NO: 86433 - DNA, 16 bp, H. sapiens
ctcccccaggaagcct

SEQ ID NO: 86434 - DNA, 16 bp, H. sapiens
ctcccccaggccctgg

SEQ ID NO: 86435 - DNA, 16 bp, H. sapiens
ctcccccatattttgc

SEQ ID NO: 86436 - DNA, 16 bp, H. sapiens
ctcccccatctgctga

SEQ ID NO: 86437 - DNA, 16 bp, H. sapiens
ctccccctcccaaagt

SEQ ID NO: 86438 - DNA, 16 bp, H. sapiens
ctccccgacctgccca

SEQ ID NO: 86439 - DNA, 16 bp, H. sapiens
ctccccgctcagcctc

SEQ ID NO: 86440 - DNA, 16 bp, H. sapiens
ctcccctagctcccca

SEQ ID NO: 86441 - DNA, 16 bp, H. sapiens
ctcccctagtccccca

SEQ ID NO: 86442 - DNA, 16 bp, H. sapiens
ctcccctattctgagc

SEQ ID NO: 86443 - DNA, 16 bp, H. sapiens
ctcccctcaccccagg

SEQ ID NO: 86444 - DNA, 16 bp, H. sapiens
ctcccctcagcccctg

SEQ ID NO: 86445 - DNA, 16 bp, H. sapiens
ctcccctcagcctcct

SEQ ID NO: 86446 - DNA, 16 bp, H. sapiens
ctcccctcagctcctg

SEQ ID NO: 86447 - DNA, 16 bp, H. sapiens
ctcccctccctgccag

SEQ ID NO: 86448 - DNA, 16 bp, H. sapiens
ctcccctcctgagccc

SEQ ID NO: 86449 - DNA, 16 bp, H. sapiens
ctcccctccttgccag

SEQ ID NO: 86450 - DNA, 16 bp, H. sapiens
ctcccctctcagcctc

SEQ ID NO: 86451 - DNA, 16 bp, H. sapiens
ctcccctctccactga

SEQ ID NO: 86452 - DNA, 16 bp, H. sapiens
ctcccctgaactccag

SEQ ID NO: 86453 - DNA, 16 bp, H. sapiens
ctcccctgagttctgg

SEQ ID NO: 86454 - DNA, 16 bp, H. sapiens
ctcccctgcagcaaac

SEQ ID NO: 86455 - DNA, 16 bp, H. sapiens
ctcccctgcccctgca

SEQ ID NO: 86456 - DNA, 16 bp, H. sapiens
ctcccctggacaccca

SEQ ID NO: 86457 - DNA, 16 bp, H. sapiens
ctcccctggagcctcc

SEQ ID NO: 86458 - DNA, 16 bp, H. sapiens
ctcccctggatgccca

SEQ ID NO: 86459 - DNA, 16 bp, H. sapiens
ctccccttcccccagg

SEQ ID NO: 86460 - DNA, 16 bp, H. sapiens
ctccccttcctgctga

SEQ ID NO: 86461 - DNA, 16 bp, H. sapiens
ctcccctttacaaaac

SEQ ID NO: 86462 - DNA, 16 bp, H. sapiens
ctccccttttgaaatc

SEQ ID NO: 86463 - DNA, 16 bp, H. sapiens
ctcccgaagtgctgga

SEQ ID NO: 86464 - DNA, 17 bp, H. sapiens
ctcccgacctcgtgatc

SEQ ID NO: 86465 - DNA, 16 bp, H. sapiens
ctcccgagaggctggg

SEQ ID NO: 86466 - DNA, 17 bp, H. sapiens
ctcccgagtacctgaga

SEQ ID NO: 86467 - DNA, 16 bp, H. sapiens
ctcccgagtggctgga

SEQ ID NO: 86468 - DNA, 16 bp, H. sapiens
ctcccgccaggtccct

SEQ ID NO: 86469 - DNA, 16 bp, H. sapiens
ctcccgcctcagccct

SEQ ID NO: 86470 - DNA, 16 bp, H. sapiens
ctcccgcctcagcctc

SEQ ID NO: 86471 - DNA, 16 bp, H. sapiens
ctcccgcctcctgggt

SEQ ID NO: 86472 - DNA, 16 bp, H. sapiens
ctcccgcctgggcgac

SEQ ID NO: 86473 - DNA, 16 bp, H. sapiens
ctcccgcgttcacgcc

SEQ ID NO: 86474 - DNA, 16 bp, H. sapiens
ctcccgcttcaacctc

SEQ ID NO: 86475 - DNA, 16 bp, H. sapiens
ctcccggctaattttt

SEQ ID NO: 86476 - DNA, 16 bp, H. sapiens
ctcccggctgctttca

SEQ ID NO: 86477 - DNA, 16 bp, H. sapiens
ctcccgggctcacgcc

SEQ ID NO: 86478 - DNA, 16 bp, H. sapiens
ctcccgggttaaagcg

SEQ ID NO: 86479 - DNA, 16 bp, H. sapiens
ctcccgggttccagca

SEQ ID NO: 86480 - DNA, 16 bp, H. sapiens
ctcccgggttccagtg

SEQ ID NO: 86481 - DNA, 16 bp, H. sapiens
ctcccgggttctagca

SEQ ID NO: 86482 - DNA, 19 bp, H. sapiens
ctcccgggtttacgccatt

SEQ ID NO: 86483 - DNA, 16 bp, H. sapiens
ctcccgtgtcagcctc

SEQ ID NO: 86484 - DNA, 16 bp, H. sapiens
ctccctaagtgctgga

SEQ ID NO: 86485 - DNA, 16 bp, H. sapiens
ctccctaagtgttggg

SEQ ID NO: 86486 - DNA, 16 bp, H. sapiens
ctccctagaaaatggg

SEQ ID NO: 86487 - DNA, 16 bp, H. sapiens
ctccctagcagctgag

SEQ ID NO: 86488 - DNA, 16 bp, H. sapiens
ctccctcactcctgct

SEQ ID NO: 86489 - DNA, 16 bp, H. sapiens
ctccctcagatccagg

SEQ ID NO: 86490 - DNA, 16 bp, H. sapiens
ctccctcagcccctgg

SEQ ID NO: 86491 - DNA, 16 bp, H. sapiens
ctccctcagcctcccg

SEQ ID NO: 86492 - DNA, 16 bp, H. sapiens
ctccctcagcctctca

SEQ ID NO: 86493 - DNA, 16 bp, H. sapiens
ctccctcagcctctgg

SEQ ID NO: 86494 - DNA, 16 bp, H. sapiens
ctccctcagcttcctg

SEQ ID NO: 86495 - DNA, 16 bp, H. sapiens
ctccctcagcttgcag

SEQ ID NO: 86496 - DNA, 16 bp, H. sapiens
ctccctcagtgctggg

SEQ ID NO: 86497 - DNA, 16 bp, H. sapiens
ctccctcatctgtaaa

SEQ ID NO: 86498 - DNA, 16 bp, H. sapiens
ctccctcatttctgaa

SEQ ID NO: 86499 - DNA, 16 bp, H. sapiens
ctccctccacagcctc

SEQ ID NO: 86500 - DNA, 16 bp, H. sapiens
ctccctccactcccag

SEQ ID NO: 86501 - DNA, 16 bp, H. sapiens
ctccctccagcctctg

SEQ ID NO: 86502 - DNA, 16 bp, H. sapiens
ctccctccaggctgct

SEQ ID NO: 86503 - DNA, 16 bp, H. sapiens
ctccctccagtctctg

SEQ ID NO: 86504 - DNA, 16 bp, H. sapiens
ctccctcccaggctca

SEQ ID NO: 86505 - DNA, 16 bp, H. sapiens
ctccctccccttttga

SEQ ID NO: 86506 - DNA, 16 bp, H. sapiens
ctccctccctccctga

SEQ ID NO: 86507 - DNA, 16 bp, H. sapiens
ctccctccctcctgca

SEQ ID NO: 86508 - DNA, 16 bp, H. sapiens
ctccctccctgcccag

SEQ ID NO: 86509 - DNA, 16 bp, H. sapiens
ctccctcctcagcctc

SEQ ID NO: 86510 - DNA, 16 bp, H. sapiens
ctccctcctcagtgtc

SEQ ID NO: 86511 - DNA, 16 bp, H. sapiens
ctccctcctgccctca

SEQ ID NO: 86512 - DNA, 16 bp, H. sapiens
ctccctcctgctctgg

SEQ ID NO: 86513 - DNA, 16 bp, H. sapiens
ctccctcctgctgcca

SEQ ID NO: 86514 - DNA, 16 bp, H. sapiens
ctccctcctggggctg

SEQ ID NO: 86515 - DNA, 16 bp, H. sapiens
ctccctccttcccagc

SEQ ID NO: 86516 - DNA, 16 bp, H. sapiens
ctccctccttccccag

SEQ ID NO: 86517 - DNA, 16 bp, H. sapiens
ctccctccttggtgac

SEQ ID NO: 86518 - DNA, 16 bp, H. sapiens
ctccctctcaaataaa

SEQ ID NO: 86519 - DNA, 16 bp, H. sapiens
ctccctctcacacaca

SEQ ID NO: 86520 - DNA, 16 bp, H. sapiens
ctccctctcagcctcc

SEQ ID NO: 86521 - DNA, 16 bp, H. sapiens
ctccctctcctcagcc

SEQ ID NO: 86522 - DNA, 16 bp, H. sapiens
ctccctctcctgccac

SEQ ID NO: 86523 - DNA, 16 bp, H. sapiens
ctccctctctcacaca

SEQ ID NO: 86524 - DNA, 16 bp, H. sapiens
ctccctctctgggcct

SEQ ID NO: 86525 - DNA, 16 bp, H. sapiens
ctccctctgaaggctc

SEQ ID NO: 86526 - DNA, 16 bp, H. sapiens
ctccctctgctccagc

SEQ ID NO: 86527 - DNA, 16 bp, H. sapiens
ctccctctgctgtcct

SEQ ID NO: 86528 - DNA, 16 bp, H. sapiens
ctccctctggaagctt

SEQ ID NO: 86529 - DNA, 16 bp, H. sapiens
ctccctctgggtccct

SEQ ID NO: 86530 - DNA, 16 bp, H. sapiens
ctccctctgtccccag

SEQ ID NO: 86531 - DNA, 16 bp, H. sapiens
ctccctctgtctctgc

SEQ ID NO: 86532 - DNA, 16 bp, H. sapiens
ctccctctgtctctgt

SEQ ID NO: 86533 - DNA, 16 bp, H. sapiens
ctccctctgtgtctct

SEQ ID NO: 86534 - DNA, 16 bp, H. sapiens
ctccctctgtgtgtgt

SEQ ID NO: 86535 - DNA, 16 bp, H. sapiens
ctccctctgtttccca

SEQ ID NO: 86536 - DNA, 16 bp, H. sapiens
ctccctctttggcctc

SEQ ID NO: 86537 - DNA, 16 bp, H. sapiens
ctccctgaccggtcct

SEQ ID NO: 86538 - DNA, 16 bp, H. sapiens
ctccctgacttcagga

SEQ ID NO: 86539 - DNA, 16 bp, H. sapiens
ctccctgagcctccat

SEQ ID NO: 86540 - DNA, 16 bp, H. sapiens
ctccctgagcctcctg

SEQ ID NO: 86541 - DNA, 16 bp, H. sapiens
ctccctgatggactgg

SEQ ID NO: 86542 - DNA, 16 bp, H. sapiens
ctccctgcaacctcag

SEQ ID NO: 86543 - DNA, 16 bp, H. sapiens
ctccctgcaagctgag

SEQ ID NO: 86544 - DNA, 16 bp, H. sapiens
ctccctgcacacacac

SEQ ID NO: 86545 - DNA, 16 bp, H. sapiens
ctccctgcagccacac

SEQ ID NO: 86546 - DNA, 16 bp, H. sapiens
ctccctgcagcccctg

SEQ ID NO: 86547 - DNA, 16 bp, H. sapiens
ctccctgcagcctcaa

SEQ ID NO: 86548 - DNA, 16 bp, H. sapiens
ctccctgcagcctcag

SEQ ID NO: 86549 - DNA, 16 bp, H. sapiens
ctccctgcagcctccg

SEQ ID NO: 86550 - DNA, 16 bp, H. sapiens
ctccctgcagggcagg

SEQ ID NO: 86551 - DNA, 16 bp, H. sapiens
ctccctgccacctcca

SEQ ID NO: 86552 - DNA, 16 bp, H. sapiens
ctccctgccagcccct

SEQ ID NO: 86553 - DNA, 16 bp, H. sapiens
ctccctgcccccagtg

SEQ ID NO: 86554 - DNA, 16 bp, H. sapiens
ctccctgcccctgcag

SEQ ID NO: 86555 - DNA, 16 bp, H. sapiens
ctccctgccctgtgcc

SEQ ID NO: 86556 - DNA, 16 bp, H. sapiens
ctccctgcccttccca

SEQ ID NO: 86557 - DNA, 16 bp, H. sapiens
ctccctgcctcagtct

SEQ ID NO: 86558 - DNA, 16 bp, H. sapiens
ctccctgcctccacct

SEQ ID NO: 86559 - DNA, 16 bp, H. sapiens
ctccctgcctccagcc

SEQ ID NO: 86560 - DNA, 16 bp, H. sapiens
ctccctgcctggcctg

SEQ ID NO: 86561 - DNA, 16 bp, H. sapiens
ctccctgctcagctcc

SEQ ID NO: 86562 - DNA, 16 bp, H. sapiens
ctccctgctcccacct

SEQ ID NO: 86563 - DNA, 16 bp, H. sapiens
ctccctgctgccccca

SEQ ID NO: 86564 - DNA, 16 bp, H. sapiens
ctccctgctgggctgg

SEQ ID NO: 86565 - DNA, 16 bp, H. sapiens
ctccctgcttccacct

SEQ ID NO: 86566 - DNA, 16 bp, H. sapiens
ctccctgcttccagcc

SEQ ID NO: 86567 - DNA, 16 bp, H. sapiens
ctccctggaggaggtg

SEQ ID NO: 86568 - DNA, 16 bp, H. sapiens
ctccctggccatgtgg

SEQ ID NO: 86569 - DNA, 16 bp, H. sapiens
ctccctggcctcagcc

SEQ ID NO: 86570 - DNA, 16 bp, H. sapiens
ctccctggcctccctg

SEQ ID NO: 86571 - DNA, 16 bp, H. sapiens
ctccctggctcaagtg

SEQ ID NO: 86572 - DNA, 16 bp, H. sapiens
ctccctggctcaggag

SEQ ID NO: 86573 - DNA, 16 bp, H. sapiens
ctccctggctcccact

SEQ ID NO: 86574 - DNA, 16 bp, H. sapiens
ctccctggctggagtg

SEQ ID NO: 86575 - DNA, 16 bp, H. sapiens
ctccctggcttcagcc

SEQ ID NO: 86576 - DNA, 16 bp, H. sapiens
ctccctgggcagggga

SEQ ID NO: 86577 - DNA, 16 bp, H. sapiens
ctccctgggcctccca

SEQ ID NO: 86578 - DNA, 16 bp, H. sapiens
ctccctgggcctccct

SEQ ID NO: 86579 - DNA, 16 bp, H. sapiens
ctccctgggctcagat

SEQ ID NO: 86580 - DNA, 16 bp, H. sapiens
ctccctgggctctttg

SEQ ID NO: 86581 - DNA, 16 bp, H. sapiens
ctccctgggtctccag

SEQ ID NO: 86582 - DNA, 16 bp, H. sapiens
ctccctggtctccctg

SEQ ID NO: 86583 - DNA, 16 bp, H. sapiens
ctccctggtgcactgt

SEQ ID NO: 86584 - DNA, 16 bp, H. sapiens
ctccctgtcaggaggc

SEQ ID NO: 86585 - DNA, 16 bp, H. sapiens
ctccctgtctccatgt

SEQ ID NO: 86586 - DNA, 16 bp, H. sapiens
ctccctgtctgtctct

SEQ ID NO: 86587 - DNA, 16 bp, H. sapiens
ctccctgtgccaccca

SEQ ID NO: 86588 - DNA, 16 bp, H. sapiens
ctccctgtgcctcaat

SEQ ID NO: 86589 - DNA, 16 bp, H. sapiens
ctccctgtggggcagg

SEQ ID NO: 86590 - DNA, 16 bp, H. sapiens
ctccctgtgtcttcat

SEQ ID NO: 86591 - DNA, 16 bp, H. sapiens
ctccctgtgttctcac

SEQ ID NO: 86592 - DNA, 16 bp, H. sapiens
ctccctgtgtttcttc

SEQ ID NO: 86593 - DNA, 16 bp, H. sapiens
ctccctgttccctgag

SEQ ID NO: 86594 - DNA, 16 bp, H. sapiens
ctcccttcagcatttc

SEQ ID NO: 86595 - DNA, 16 bp, H. sapiens
ctcccttcaggagctc

SEQ ID NO: 86596 - DNA, 16 bp, H. sapiens
ctcccttcatttctgt

SEQ ID NO: 86597 - DNA, 16 bp, H. sapiens
ctcccttcccagcctc

SEQ ID NO: 86598 - DNA, 16 bp, H. sapiens
ctcccttctcagcctc

SEQ ID NO: 86599 - DNA, 16 bp, H. sapiens
ctcccttctcagcttc

SEQ ID NO: 86600 - DNA, 16 bp, H. sapiens
ctcccttctgaagccc

SEQ ID NO: 86601 - DNA, 16 bp, H. sapiens
ctcccttctggcccag

SEQ ID NO: 86602 - DNA, 16 bp, H. sapiens
ctccctttccctgggg

SEQ ID NO: 86603 - DNA, 16 bp, H. sapiens
ctccctttgtccagca

SEQ ID NO: 86604 - DNA, 16 bp, H. sapiens
ctccgacctcagcctc

SEQ ID NO: 86605 - DNA, 17 bp, H. sapiens
ctccgcctccagggttc

SEQ ID NO: 86606 - DNA, 16 bp, H. sapiens
ctccgcctcccagctt

SEQ ID NO: 86607 - DNA, 18 bp, H. sapiens
ctccgcctcccgggctca

SEQ ID NO: 86608 - DNA, 18 bp, H. sapiens
ctccgcctcccgggttcg

SEQ ID NO: 86609 - DNA, 18 bp, H. sapiens
ctccgcctcctaggttca

SEQ ID NO: 86610 - DNA, 16 bp, H. sapiens
ctccgcctcctgcgtt

SEQ ID NO: 86611 - DNA, 16 bp, H. sapiens
ctccgcctctggagtt

SEQ ID NO: 86612 - DNA, 18 bp, H. sapiens
ctccgcctgccgggttca

SEQ ID NO: 86613 - DNA, 16 bp, H. sapiens
ctccgcctgggcaaca

SEQ ID NO: 86614 - DNA, 18 bp, H. sapiens
ctccgccttctgggttca

SEQ ID NO: 86615 - DNA, 16 bp, H. sapiens
ctccgccttgcaggtt

SEQ ID NO: 86616 - DNA, 16 bp, H. sapiens
ctccgcttcctgggct

SEQ ID NO: 86617 - DNA, 19 bp, H. sapiens
ctccggagtagctgggatt

SEQ ID NO: 86618 - DNA, 16 bp, H. sapiens
ctccggcctcagcctc

SEQ ID NO: 86619 - DNA, 16 bp, H. sapiens
ctccggtcggtgggct

SEQ ID NO: 86620 - DNA, 20 bp, H. sapiens
ctccggtcggtgggctcctc

SEQ ID NO: 86621 - DNA, 16 bp, H. sapiens
ctccggtctcagcctc

SEQ ID NO: 86622 - DNA, 16 bp, H. sapiens
ctccgtcccccaggct

SEQ ID NO: 86623 - DNA, 16 bp, H. sapiens
ctccgtctcagaaaag

SEQ ID NO: 86624 - DNA, 19 bp, H. sapiens
ctccgtctcccgggttcaa

SEQ ID NO: 86625 - DNA, 16 bp, H. sapiens
ctcctaacctcagatg

SEQ ID NO: 86626 - DNA, 17 bp, H. sapiens
ctcctaacctcgtgatc

SEQ ID NO: 86627 - DNA, 16 bp, H. sapiens
ctcctaaccttgtgat

SEQ ID NO: 86628 - DNA, 16 bp, H. sapiens
ctcctaagcctccagg

SEQ ID NO: 86629 - DNA, 16 bp, H. sapiens
ctcctaattggattat

SEQ ID NO: 86630 - DNA, 16 bp, H. sapiens
ctcctacagtattctc

SEQ ID NO: 86631 - DNA, 16 bp, H. sapiens
ctcctaccagcaccat

SEQ ID NO: 86632 - DNA, 16 bp, H. sapiens
ctcctaccccagcctc

SEQ ID NO: 86633 - DNA, 16 bp, H. sapiens
ctcctacctcagcccc

SEQ ID NO: 86634 - DNA, 16 bp, H. sapiens
ctcctacctcagcctc

SEQ ID NO: 86635 - DNA, 16 bp, H. sapiens
ctcctacctcagcctg

SEQ ID NO: 86636 - DNA, 16 bp, H. sapiens
ctcctacctcagcctt

SEQ ID NO: 86637 - DNA, 16 bp, H. sapiens
ctcctacctcagctcc

SEQ ID NO: 86638 - DNA, 16 bp, H. sapiens
ctcctacctcagtctc

SEQ ID NO: 86639 - DNA, 16 bp, H. sapiens
ctcctacctcggcctc

SEQ ID NO: 86640 - DNA, 16 bp, H. sapiens
ctcctacctgagcctc

SEQ ID NO: 86641 - DNA, 16 bp, H. sapiens
ctcctactgggaggtg

SEQ ID NO: 86642 - DNA, 20 bp, H. sapiens
ctcctagagacttgttgaat

SEQ ID NO: 86643 - DNA, 16 bp, H. sapiens
ctcctaggctccagca

SEQ ID NO: 86644 - DNA, 16 bp, H. sapiens
ctcctaggtatatgcc

SEQ ID NO: 86645 - DNA, 16 bp, H. sapiens
ctcctataagtggaat

SEQ ID NO: 86646 - DNA, 16 bp, H. sapiens
ctcctatcaaagaaaa

SEQ ID NO: 86647 - DNA, 16 bp, H. sapiens
ctcctatctctgcctc

SEQ ID NO: 86648 - DNA, 41 bp, H. sapiens
ctcctattcaacatagtgttggaagttctggccagggcaat

SEQ ID NO: 86649 - DNA, 16 bp, H. sapiens
ctcctattctgtgggt

SEQ ID NO: 86650 - DNA, 16 bp, H. sapiens
ctcctcaaaaacttaa

SEQ ID NO: 86651 - DNA, 16 bp, H. sapiens
ctcctcaaacatttat

SEQ ID NO: 86652 - DNA, 16 bp, H. sapiens
ctcctcaagctcccaa

SEQ ID NO: 86653 - DNA, 17 bp, H. sapiens
ctcctcacatcccagac

SEQ ID NO: 86654 - DNA, 16 bp, H. sapiens
ctcctcacctcccgga

SEQ ID NO: 86655 - DNA, 17 bp, H. sapiens
ctcctcacctcgtgatc

SEQ ID NO: 86656 - DNA, 16 bp, H. sapiens
ctcctcactgtgtcct

SEQ ID NO: 86657 - DNA, 16 bp, H. sapiens
ctcctcacttcccagc

SEQ ID NO: 86658 - DNA, 16 bp, H. sapiens
ctcctcacttctcaga

SEQ ID NO: 86659 - DNA, 34 bp, H. sapiens
ctcctcactttccagactgggcagccaggcagag

SEQ ID NO: 86660 - DNA, 16 bp, H. sapiens
ctcctcagaaaattgg

SEQ ID NO: 86661 - DNA, 16 bp, H. sapiens
ctcctcagaagaaata

SEQ ID NO: 86662 - DNA, 16 bp, H. sapiens
ctcctcagcaaataca

SEQ ID NO: 86663 - DNA, 29 bp, H. sapiens
ctcctcagcaaatgtaaaagaacagaaat

SEQ ID NO: 86664 - DNA, 16 bp, H. sapiens
ctcctcagcacagacc

SEQ ID NO: 86665 - DNA, 16 bp, H. sapiens
ctcctcagcagctggg

SEQ ID NO: 86666 - DNA, 16 bp, H. sapiens
ctcctcagcctcctct

SEQ ID NO: 86667 - DNA, 16 bp, H. sapiens
ctcctcagcctctgga

SEQ ID NO: 86668 - DNA, 16 bp, H. sapiens
ctcctcagcctgcaga

SEQ ID NO: 86669 - DNA, 16 bp, H. sapiens
ctcctcagctcttggg

SEQ ID NO: 86670 - DNA, 16 bp, H. sapiens
ctcctcagcttgcaga

SEQ ID NO: 86671 - DNA, 16 bp, H. sapiens
ctcctcaggaggctgg

SEQ ID NO: 86672 - DNA, 16 bp, H. sapiens
ctcctcagtaaatgta

SEQ ID NO: 86673 - DNA, 16 bp, H. sapiens
ctcctcagtctcctga

SEQ ID NO: 86674 - DNA, 16 bp, H. sapiens
ctcctcagtctccttt

SEQ ID NO: 86675 - DNA, 16 bp, H. sapiens
ctcctcatcctcacca

SEQ ID NO: 86676 - DNA, 16 bp, H. sapiens
ctcctcatccttcagg

SEQ ID NO: 86677 - DNA, 16 bp, H. sapiens
ctcctcatctccatct

SEQ ID NO: 86678 - DNA, 16 bp, H. sapiens
ctcctcatctgtaaaa

SEQ ID NO: 86679 - DNA, 16 bp, H. sapiens
ctcctcatgcctctga

SEQ ID NO: 86680 - DNA, 16 bp, H. sapiens
ctcctccacctcccgg

SEQ ID NO: 86681 - DNA, 16 bp, H. sapiens
ctcctccacctcctgg

SEQ ID NO: 86682 - DNA, 16 bp, H. sapiens
ctcctccacctgctcc

SEQ ID NO: 86683 - DNA, 16 bp, H. sapiens
ctcctccagcccctgg

SEQ ID NO: 86684 - DNA, 16 bp, H. sapiens
ctcctccagcccttcc

SEQ ID NO: 86685 - DNA, 16 bp, H. sapiens
ctcctccagccgctgc

SEQ ID NO: 86686 - DNA, 16 bp, H. sapiens
ctcctccagcctcact

SEQ ID NO: 86687 - DNA, 16 bp, H. sapiens
ctcctccagcctcagc

SEQ ID NO: 86688 - DNA, 16 bp, H. sapiens
ctcctccagcctctgc

SEQ ID NO: 86689 - DNA, 16 bp, H. sapiens
ctcctccagctcctgc

SEQ ID NO: 86690 - DNA, 16 bp, H. sapiens
ctcctccagctgcccc

SEQ ID NO: 86691 - DNA, 16 bp, H. sapiens
ctcctccaggaaggct

SEQ ID NO: 86692 - DNA, 16 bp, H. sapiens
ctcctccagggagcct

SEQ ID NO: 86693 - DNA, 16 bp, H. sapiens
ctcctccaggtacagt

SEQ ID NO: 86694 - DNA, 16 bp, H. sapiens
ctcctcccacctcagc

SEQ ID NO: 86695 - DNA, 16 bp, H. sapiens
ctcctcccacctctgc

SEQ ID NO: 86696 - DNA, 16 bp, H. sapiens
ctcctcccacctgcca

SEQ ID NO: 86697 - DNA, 16 bp, H. sapiens
ctcctcccagcccagc

SEQ ID NO: 86698 - DNA, 16 bp, H. sapiens
ctcctcccagccccag

SEQ ID NO: 86699 - DNA, 16 bp, H. sapiens
ctcctcccagccctgg

SEQ ID NO: 86700 - DNA, 16 bp, H. sapiens
ctcctcccagctcctg

SEQ ID NO: 86701 - DNA, 16 bp, H. sapiens
ctcctcccaggttcaa

SEQ ID NO: 86702 - DNA, 16 bp, H. sapiens
ctcctcccagttcctc

SEQ ID NO: 86703 - DNA, 16 bp, H. sapiens
ctcctcccatctgccc

SEQ ID NO: 86704 - DNA, 16 bp, H. sapiens
ctcctccccagcagcc

SEQ ID NO: 86705 - DNA, 16 bp, H. sapiens
ctcctccccaggcctc

SEQ ID NO: 86706 - DNA, 16 bp, H. sapiens
ctcctcccccaggaag

SEQ ID NO: 86707 - DNA, 17 bp, H. sapiens
ctcctccctaactcatt

SEQ ID NO: 86708 - DNA, 16 bp, H. sapiens
ctcctccctcagactc

SEQ ID NO: 86709 - DNA, 16 bp, H. sapiens
ctcctccctcagcctc

SEQ ID NO: 86710 - DNA, 16 bp, H. sapiens
ctcctccctcagcctt

SEQ ID NO: 86711 - DNA, 16 bp, H. sapiens
ctcctccctcatgaat

SEQ ID NO: 86712 - DNA, 16 bp, H. sapiens
ctcctccctgcagctg

SEQ ID NO: 86713 - DNA, 16 bp, H. sapiens
ctcctccctgcctcag

SEQ ID NO: 86714 - DNA, 16 bp, H. sapiens
ctcctccctgcctggc

SEQ ID NO: 86715 - DNA, 16 bp, H. sapiens
ctcctccctgctccca

SEQ ID NO: 86716 - DNA, 16 bp, H. sapiens
ctcctccctgtcctca

SEQ ID NO: 86717 - DNA, 16 bp, H. sapiens
ctcctccctgtctcca

SEQ ID NO: 86718 - DNA, 16 bp, H. sapiens
ctcctccctgtgtctt

SEQ ID NO: 86719 - DNA, 16 bp, H. sapiens
ctcctcctagatttca

SEQ ID NO: 86720 - DNA, 16 bp, H. sapiens
ctcctcctcagcctcc

SEQ ID NO: 86721 - DNA, 17 bp, H. sapiens
ctcctcctccaaaggag

SEQ ID NO: 86722 - DNA, 16 bp, H. sapiens
ctcctcctccagagga

SEQ ID NO: 86723 - DNA, 16 bp, H. sapiens
ctcctcctccagctct

SEQ ID NO: 86724 - DNA, 16 bp, H. sapiens
ctcctcctccaggagg

SEQ ID NO: 86725 - DNA, 16 bp, H. sapiens
ctcctcctccaggcag

SEQ ID NO: 86726 - DNA, 16 bp, H. sapiens
ctcctcctcccactgc

SEQ ID NO: 86727 - DNA, 16 bp, H. sapiens
ctcctcctcccagcct

SEQ ID NO: 86728 - DNA, 16 bp, H. sapiens
ctcctcctccccaggg

SEQ ID NO: 86729 - DNA, 16 bp, H. sapiens
ctcctcctcctccagc

SEQ ID NO: 86730 - DNA, 16 bp, H. sapiens
ctcctcctcctccatg

SEQ ID NO: 86731 - DNA, 16 bp, H. sapiens
ctcctcctctgcccac

SEQ ID NO: 86732 - DNA, 16 bp, H. sapiens
ctcctcctcttcctgg

SEQ ID NO: 86733 - DNA, 16 bp, H. sapiens
ctcctcctgcccccag

SEQ ID NO: 86734 - DNA, 16 bp, H. sapiens
ctcctcctgccctcca

SEQ ID NO: 86735 - DNA, 16 bp, H. sapiens
ctcctcctgcctccac

SEQ ID NO: 86736 - DNA, 16 bp, H. sapiens
ctcctcctgctcccca

SEQ ID NO: 86737 - DNA, 16 bp, H. sapiens
ctcctcctggccaggg

SEQ ID NO: 86738 - DNA, 16 bp, H. sapiens
ctcctccttcagcctc

SEQ ID NO: 86739 - DNA, 16 bp, H. sapiens
ctcctccttcctctgg

SEQ ID NO: 86740 - DNA, 16 bp, H. sapiens
ctcctccttcctgctg

SEQ ID NO: 86741 - DNA, 16 bp, H. sapiens
ctcctccttgtacctg

SEQ ID NO: 86742 - DNA, 16 bp, H. sapiens
ctcctcgcttcccaga

SEQ ID NO: 86743 - DNA, 16 bp, H. sapiens
ctcctcggcctcggcg

SEQ ID NO: 86744 - DNA, 16 bp, H. sapiens
ctcctcggttcaagca

SEQ ID NO: 86745 - DNA, 16 bp, H. sapiens
ctcctctacagacaca

SEQ ID NO: 86746 - DNA, 16 bp, H. sapiens
ctcctctcagcccctg

SEQ ID NO: 86747 - DNA, 16 bp, H. sapiens
ctcctctcagcctccc

SEQ ID NO: 86748 - DNA, 16 bp, H. sapiens
ctcctctccagcacct

SEQ ID NO: 86749 - DNA, 16 bp, H. sapiens
ctcctctccagcccca

SEQ ID NO: 86750 - DNA, 16 bp, H. sapiens
ctcctctccccagcct

SEQ ID NO: 86751 - DNA, 16 bp, H. sapiens
ctcctctctcagcctc

SEQ ID NO: 86752 - DNA, 16 bp, H. sapiens
ctcctctctgctgctg

SEQ ID NO: 86753 - DNA, 16 bp, H. sapiens
ctcctctctgggcaag

SEQ ID NO: 86754 - DNA, 16 bp, H. sapiens
ctcctctctgtagctg

SEQ ID NO: 86755 - DNA, 16 bp, H. sapiens
ctcctctcttcccaga

SEQ ID NO: 86756 - DNA, 16 bp, H. sapiens
ctcctctcttggcctc

SEQ ID NO: 86757 - DNA, 16 bp, H. sapiens
ctcctctgaaacaaaa

SEQ ID NO: 86758 - DNA, 16 bp, H. sapiens
ctcctctgagaagcct

SEQ ID NO: 86759 - DNA, 16 bp, H. sapiens
ctcctctgagctccag

SEQ ID NO: 86760 - DNA, 16 bp, H. sapiens
ctcctctgccacctcc

SEQ ID NO: 86761 - DNA, 16 bp, H. sapiens
ctcctctgcctccacc

SEQ ID NO: 86762 - DNA, 16 bp, H. sapiens
ctcctctgcctcctgg

SEQ ID NO: 86763 - DNA, 16 bp, H. sapiens
ctcctctgcctgggtt

SEQ ID NO: 86764 - DNA, 16 bp, H. sapiens
ctcctctgccttccac

SEQ ID NO: 86765 - DNA, 16 bp, H. sapiens
ctcctctgccttctgc

SEQ ID NO: 86766 - DNA, 16 bp, H. sapiens
ctcctctgtccccacc

SEQ ID NO: 86767 - DNA, 16 bp, H. sapiens
ctcctctgtctcaaaa

SEQ ID NO: 86768 - DNA, 16 bp, H. sapiens
ctcctctgtgaagcct

SEQ ID NO: 86769 - DNA, 16 bp, H. sapiens
ctcctctgtgctccca

SEQ ID NO: 86770 - DNA, 16 bp, H. sapiens
ctcctctgtgtgtgtc

SEQ ID NO: 86771 - DNA, 16 bp, H. sapiens
ctcctcttcccccagc

SEQ ID NO: 86772 - DNA, 16 bp, H. sapiens
ctcctcttcctcagcc

SEQ ID NO: 86773 - DNA, 16 bp, H. sapiens
ctcctcttcctcctgg

SEQ ID NO: 86774 - DNA, 16 bp, H. sapiens
ctcctcttcttataaa

SEQ ID NO: 86775 - DNA, 16 bp, H. sapiens
ctcctcttcttatgag

SEQ ID NO: 86776 - DNA, 16 bp, H. sapiens
ctcctgaaaatgggct

SEQ ID NO: 86777 - DNA, 16 bp, H. sapiens
ctcctgaaatcaggtg

SEQ ID NO: 86778 - DNA, 16 bp, H. sapiens
ctcctgaactcaagca

SEQ ID NO: 86779 - DNA, 16 bp, H. sapiens
ctcctgaagctgtgtc

SEQ ID NO: 86780 - DNA, 16 bp, H. sapiens
ctcctgaaggaagcag

SEQ ID NO: 86781 - DNA, 16 bp, H. sapiens
ctcctgaaggaagcat

SEQ ID NO: 86782 - DNA, 16 bp, H. sapiens
ctcctgaaggacctgc

SEQ ID NO: 86783 - DNA, 16 bp, H. sapiens
ctcctgaagggcctgc

SEQ ID NO: 86784 - DNA, 16 bp, H. sapiens
ctcctgaagtgggtcc

SEQ ID NO: 86785 - DNA, 16 bp, H. sapiens
ctcctgaatacaggac

SEQ ID NO: 86786 - DNA, 16 bp, H. sapiens
ctcctgaatgacaagt

SEQ ID NO: 86787 - DNA, 16 bp, H. sapiens
ctcctgacatcaagtg

SEQ ID NO: 86788 - DNA, 17 bp, H. sapiens
ctcctgacatcgtgatc

SEQ ID NO: 86789 - DNA, 16 bp, H. sapiens
ctcctgaccacatgat

SEQ ID NO: 86790 - DNA, 16 bp, H. sapiens
ctcctgaccccagatg

SEQ ID NO: 86791 - DNA, 16 bp, H. sapiens
ctcctgaccccatgat

SEQ ID NO: 86792 - DNA, 16 bp, H. sapiens
ctcctgaccgcaagtg

SEQ ID NO: 86793 - DNA, 17 bp, H. sapiens
ctcctgaccgcgtgatc

SEQ ID NO: 86794 - DNA, 16 bp, H. sapiens
ctcctgacctcaaagt

SEQ ID NO: 86795 - DNA, 16 bp, H. sapiens
ctcctgacctcaagtc

SEQ ID NO: 86796 - DNA, 16 bp, H. sapiens
ctcctgacctcagctg

SEQ ID NO: 86797 - DNA, 19 bp, H. sapiens
ctcctgacctcaggcgatc

SEQ ID NO: 86798 - DNA, 16 bp, H. sapiens
ctcctgacctcagggt

SEQ ID NO: 86799 - DNA, 16 bp, H. sapiens
ctcctgacctcatgag

SEQ ID NO: 86800 - DNA, 17 bp, H. sapiens
ctcctgacctcatgatc

SEQ ID NO: 86801 - DNA, 17 bp, H. sapiens
ctcctgacctcatgatt

SEQ ID NO: 86802 - DNA, 17 bp, H. sapiens
ctcctgacctcctgatc

SEQ ID NO: 86803 - DNA, 16 bp, H. sapiens
ctcctgacctcggcct

SEQ ID NO: 86804 - DNA, 17 bp, H. sapiens
ctcctgacctcgtaatc

SEQ ID NO: 86805 - DNA, 16 bp, H. sapiens
ctcctgacctcgtgaa

SEQ ID NO: 86806 - DNA, 17 bp, H. sapiens
ctcctgacctcgtgacc

SEQ ID NO: 86807 - DNA, 17 bp, H. sapiens
ctcctgacctcgtgata

SEQ ID NO: 86808 - DNA, 17 bp, H. sapiens
ctcctgacctcgtgatc

SEQ ID NO: 86809 - DNA, 17 bp, H. sapiens
ctcctgacctcgtgatg

SEQ ID NO: 86810 - DNA, 17 bp, H. sapiens
ctcctgacctcgtgatt

SEQ ID NO: 86811 - DNA, 16 bp, H. sapiens
ctcctgacctctgccc

SEQ ID NO: 86812 - DNA, 17 bp, H. sapiens
ctcctgacctcttgatc

SEQ ID NO: 86813 - DNA, 17 bp, H. sapiens
ctcctgacctggtgatc

SEQ ID NO: 86814 - DNA, 16 bp, H. sapiens
ctcctgaccttgtgaa

SEQ ID NO: 86815 - DNA, 17 bp, H. sapiens
ctcctgaccttgtgata

SEQ ID NO: 86816 - DNA, 17 bp, H. sapiens
ctcctgaccttgtgatc

SEQ ID NO: 86817 - DNA, 17 bp, H. sapiens
ctcctgaccttgtgatt

SEQ ID NO: 86818 - DNA, 16 bp, H. sapiens
ctcctgaccttgtggt

SEQ ID NO: 86819 - DNA, 17 bp, H. sapiens
ctcctgacgtcgtgatc

SEQ ID NO: 86820 - DNA, 17 bp, H. sapiens
ctcctgacgttgtgatc

SEQ ID NO: 86821 - DNA, 16 bp, H. sapiens
ctcctgactcagactc

SEQ ID NO: 86822 - DNA, 16 bp, H. sapiens
ctcctgactcagcctc

SEQ ID NO: 86823 - DNA, 16 bp, H. sapiens
ctcctgactcaggtga

SEQ ID NO: 86824 - DNA, 16 bp, H. sapiens
ctcctgacttcaaatg

SEQ ID NO: 86825 - DNA, 16 bp, H. sapiens
ctcctgacttcaagag

SEQ ID NO: 86826 - DNA, 16 bp, H. sapiens
ctcctgacttcaagca

SEQ ID NO: 86827 - DNA, 17 bp, H. sapiens
ctcctgacttcatgatc

SEQ ID NO: 86828 - DNA, 17 bp, H. sapiens
ctcctgacttcgtgatc

SEQ ID NO: 86829 - DNA, 17 bp, H. sapiens
ctcctgactttgtgatc

SEQ ID NO: 86830 - DNA, 16 bp, H. sapiens
ctcctgagagctggga

SEQ ID NO: 86831 - DNA, 16 bp, H. sapiens
ctcctgagagctgttc

SEQ ID NO: 86832 - DNA, 16 bp, H. sapiens
ctcctgagaggctggg

SEQ ID NO: 86833 - DNA, 16 bp, H. sapiens
ctcctgagcccaggga

SEQ ID NO: 86834 - DNA, 16 bp, H. sapiens
ctcctgagcctcccaa

SEQ ID NO: 86835 - DNA, 16 bp, H. sapiens
ctcctgaggcctttct

SEQ ID NO: 86836 - DNA, 16 bp, H. sapiens
ctcctgaggctcaagc

SEQ ID NO: 86837 - DNA, 16 bp, H. sapiens
ctcctgaggcttctgc

SEQ ID NO: 86838 - DNA, 16 bp, H. sapiens
ctcctgaggcttctgt

SEQ ID NO: 86839 - DNA, 16 bp, H. sapiens
ctcctgagtagctaga

SEQ ID NO: 86840 - DNA, 16 bp, H. sapiens
ctcctgagtagctgat

SEQ ID NO: 86841 - DNA, 16 bp, H. sapiens
ctcctgagtagctgct

SEQ ID NO: 86842 - DNA, 16 bp, H. sapiens
ctcctgagtgctggga

SEQ ID NO: 86843 - DNA, 18 bp, H. sapiens
ctcctgagtggctgggac

SEQ ID NO: 86844 - DNA, 16 bp, H. sapiens
ctcctgagttcaagca

SEQ ID NO: 86845 - DNA, 16 bp, H. sapiens
ctcctgagttcaagcc

SEQ ID NO: 86846 - DNA, 16 bp, H. sapiens
ctcctgagttccagtg

SEQ ID NO: 86847 - DNA, 16 bp, H. sapiens
ctcctgatctcaggtt

SEQ ID NO: 86848 - DNA, 17 bp, H. sapiens
ctcctgatctcatgatc

SEQ ID NO: 86849 - DNA, 16 bp, H. sapiens
ctcctgatctgcaggt

SEQ ID NO: 86850 - DNA, 16 bp, H. sapiens
ctcctgcaaggatggc

SEQ ID NO: 86851 - DNA, 16 bp, H. sapiens
ctcctgcagcaccccc

SEQ ID NO: 86852 - DNA, 16 bp, H. sapiens
ctcctgcagcagcctc

SEQ ID NO: 86853 - DNA, 16 bp, H. sapiens
ctcctgcagcgccccc

SEQ ID NO: 86854 - DNA, 16 bp, H. sapiens
ctcctgcaggacccag

SEQ ID NO: 86855 - DNA, 16 bp, H. sapiens
ctcctgcatcagcctc

SEQ ID NO: 86856 - DNA, 16 bp, H. sapiens
ctcctgcatcagcttc

SEQ ID NO: 86857 - DNA, 16 bp, H. sapiens
ctcctgcattcattga

SEQ ID NO: 86858 - DNA, 16 bp, H. sapiens
ctcctgccaacagcca

SEQ ID NO: 86859 - DNA, 16 bp, H. sapiens
ctcctgccacccccag

SEQ ID NO: 86860 - DNA, 16 bp, H. sapiens
ctcctgccacctccac

SEQ ID NO: 86861 - DNA, 16 bp, H. sapiens
ctcctgccaggcccca

SEQ ID NO: 86862 - DNA, 16 bp, H. sapiens
ctcctgccattttatt

SEQ ID NO: 86863 - DNA, 16 bp, H. sapiens
ctcctgcccagccctg

SEQ ID NO: 86864 - DNA, 16 bp, H. sapiens
ctcctgcccagctccc

SEQ ID NO: 86865 - DNA, 16 bp, H. sapiens
ctcctgccccagctcc

SEQ ID NO: 86866 - DNA, 16 bp, H. sapiens
ctcctgccccagctgc

SEQ ID NO: 86867 - DNA, 16 bp, H. sapiens
ctcctgccccagtctc

SEQ ID NO: 86868 - DNA, 16 bp, H. sapiens
ctcctgcccccaggcc

SEQ ID NO: 86869 - DNA, 16 bp, H. sapiens
ctcctgccctagcctc

SEQ ID NO: 86870 - DNA, 16 bp, H. sapiens
ctcctgccctgcagcc

SEQ ID NO: 86871 - DNA, 16 bp, H. sapiens
ctcctgccctgcttat

SEQ ID NO: 86872 - DNA, 16 bp, H. sapiens
ctcctgccgcagcttc

SEQ ID NO: 86873 - DNA, 16 bp, H. sapiens
ctcctgcctaagcctc

SEQ ID NO: 86874 - DNA, 16 bp, H. sapiens
ctcctgcctcaacctc

SEQ ID NO: 86875 - DNA, 16 bp, H. sapiens
ctcctgcctcaacctt

SEQ ID NO: 86876 - DNA, 16 bp, H. sapiens
ctcctgcctcaagcct

SEQ ID NO: 86877 - DNA, 16 bp, H. sapiens
ctcctgcctcacagcc

SEQ ID NO: 86878 - DNA, 16 bp, H. sapiens
ctcctgcctcaccctc

SEQ ID NO: 86879 - DNA, 16 bp, H. sapiens
ctcctgcctcaccctt

SEQ ID NO: 86880 - DNA, 16 bp, H. sapiens
ctcctgcctcacctcc

SEQ ID NO: 86881 - DNA, 16 bp, H. sapiens
ctcctgcctcactgcc

SEQ ID NO: 86882 - DNA, 16 bp, H. sapiens
ctcctgcctcagaccc

SEQ ID NO: 86883 - DNA, 16 bp, H. sapiens
ctcctgcctcagactc

SEQ ID NO: 86884 - DNA, 16 bp, H. sapiens
ctcctgcctcagcatc

SEQ ID NO: 86885 - DNA, 16 bp, H. sapiens
ctcctgcctcagccac

SEQ ID NO: 86886 - DNA, 16 bp, H. sapiens
ctcctgcctcagcccc

SEQ ID NO: 86887 - DNA, 16 bp, H. sapiens
ctcctgcctcagcccg

SEQ ID NO: 86888 - DNA, 16 bp, H. sapiens
ctcctgcctcagcctt

SEQ ID NO: 86889 - DNA, 16 bp, H. sapiens
ctcctgcctcagcgtc

SEQ ID NO: 86890 - DNA, 16 bp, H. sapiens
ctcctgcctcagctac

SEQ ID NO: 86891 - DNA, 16 bp, H. sapiens
ctcctgcctcagctcc

SEQ ID NO: 86892 - DNA, 18 bp, H. sapiens
ctcctgcctcagcttcct

SEQ ID NO: 86893 - DNA, 16 bp, H. sapiens
ctcctgcctcaggcct

SEQ ID NO: 86894 - DNA, 16 bp, H. sapiens
ctcctgcctcaggtga

SEQ ID NO: 86895 - DNA, 16 bp, H. sapiens
ctcctgcctcagtctc

SEQ ID NO: 86896 - DNA, 16 bp, H. sapiens
ctcctgcctcagtctt

SEQ ID NO: 86897 - DNA, 16 bp, H. sapiens
ctcctgcctcagtgtc

SEQ ID NO: 86898 - DNA, 16 bp, H. sapiens
ctcctgcctcagttcc

SEQ ID NO: 86899 - DNA, 16 bp, H. sapiens
ctcctgcctcatcctc

SEQ ID NO: 86900 - DNA, 16 bp, H. sapiens
ctcctgcctccaggcc

SEQ ID NO: 86901 - DNA, 16 bp, H. sapiens
ctcctgcctcccaaag

SEQ ID NO: 86902 - DNA, 16 bp, H. sapiens
ctcctgcctcccagag

SEQ ID NO: 86903 - DNA, 16 bp, H. sapiens
ctcctgcctcccagcc

SEQ ID NO: 86904 - DNA, 16 bp, H. sapiens
ctcctgcctcctcagc

SEQ ID NO: 86905 - DNA, 16 bp, H. sapiens
ctcctgcctcctgctg

SEQ ID NO: 86906 - DNA, 16 bp, H. sapiens
ctcctgcctcctgctt

SEQ ID NO: 86907 - DNA, 16 bp, H. sapiens
ctcctgcctcctgtct

SEQ ID NO: 86908 - DNA, 16 bp, H. sapiens
ctcctgcctcggcctt

SEQ ID NO: 86909 - DNA, 16 bp, H. sapiens
ctcctgcctctcagcc

SEQ ID NO: 86910 - DNA, 16 bp, H. sapiens
ctcctgcctctccacc

SEQ ID NO: 86911 - DNA, 16 bp, H. sapiens
ctcctgcctctcccca

SEQ ID NO: 86912 - DNA, 16 bp, H. sapiens
ctcctgcctgaatgcc

SEQ ID NO: 86913 - DNA, 16 bp, H. sapiens
ctcctgcctgactgcc

SEQ ID NO: 86914 - DNA, 16 bp, H. sapiens
ctcctgcctgagcttc

SEQ ID NO: 86915 - DNA, 16 bp, H. sapiens
ctcctgcctgccccag

SEQ ID NO: 86916 - DNA, 16 bp, H. sapiens
ctcctgcctgcctgcc

SEQ ID NO: 86917 - DNA, 16 bp, H. sapiens
ctcctgcctgctcctg

SEQ ID NO: 86918 - DNA, 16 bp, H. sapiens
ctcctgcctggacaac

SEQ ID NO: 86919 - DNA, 16 bp, H. sapiens
ctcctgcctggcctcc

SEQ ID NO: 86920 - DNA, 16 bp, H. sapiens
ctcctgcctggctctg

SEQ ID NO: 86921 - DNA, 16 bp, H. sapiens
ctcctgcctgttccca

SEQ ID NO: 86922 - DNA, 16 bp, H. sapiens
ctcctgccttagcctc

SEQ ID NO: 86923 - DNA, 16 bp, H. sapiens
ctcctgccttggccac

SEQ ID NO: 86924 - DNA, 16 bp, H. sapiens
ctcctgccttggcccc

SEQ ID NO: 86925 - DNA, 16 bp, H. sapiens
ctcctgccttggtctc

SEQ ID NO: 86926 - DNA, 16 bp, H. sapiens
ctcctgcctttggact

SEQ ID NO: 86927 - DNA, 16 bp, H. sapiens
ctcctgctaatgttga

SEQ ID NO: 86928 - DNA, 16 bp, H. sapiens
ctcctgctatgcagcc

SEQ ID NO: 86929 - DNA, 16 bp, H. sapiens
ctcctgctcagcctcc

SEQ ID NO: 86930 - DNA, 16 bp, H. sapiens
ctcctgctccaaccat

SEQ ID NO: 86931 - DNA, 16 bp, H. sapiens
ctcctgctccaccatg

SEQ ID NO: 86932 - DNA, 16 bp, H. sapiens
ctcctgctcgtccctg

SEQ ID NO: 86933 - DNA, 16 bp, H. sapiens
ctcctgctctggccat

SEQ ID NO: 86934 - DNA, 16 bp, H. sapiens
ctcctgctgccctggg

SEQ ID NO: 86935 - DNA, 16 bp, H. sapiens
ctcctgctgccctgtg

SEQ ID NO: 86936 - DNA, 16 bp, H. sapiens
ctcctgctgctgcctc

SEQ ID NO: 86937 - DNA, 16 bp, H. sapiens
ctcctgctgtcctgtg

SEQ ID NO: 86938 - DNA, 16 bp, H. sapiens
ctcctgctgtgccgcc

SEQ ID NO: 86939 - DNA, 16 bp, H. sapiens
ctcctgctgtgtgacc

SEQ ID NO: 86940 - DNA, 16 bp, H. sapiens
ctcctgcttatttaat

SEQ ID NO: 86941 - DNA, 16 bp, H. sapiens
ctcctgcttcagcctc

SEQ ID NO: 86942 - DNA, 16 bp, H. sapiens
ctcctgcttcagtctc

SEQ ID NO: 86943 - DNA, 16 bp, H. sapiens
ctcctgcttcatcttc

SEQ ID NO: 86944 - DNA, 16 bp, H. sapiens
ctcctgcttccacctc

SEQ ID NO: 86945 - DNA, 16 bp, H. sapiens
ctcctgcttctcagca

SEQ ID NO: 86946 - DNA, 16 bp, H. sapiens
ctcctgcttggcctcc

SEQ ID NO: 86947 - DNA, 16 bp, H. sapiens
ctcctggaatcccagc

SEQ ID NO: 86948 - DNA, 16 bp, H. sapiens
ctcctggactctagtg

SEQ ID NO: 86949 - DNA, 16 bp, H. sapiens
ctcctggactctgccc

SEQ ID NO: 86950 - DNA, 16 bp, H. sapiens
ctcctggagcctccag

SEQ ID NO: 86951 - DNA, 16 bp, H. sapiens
ctcctggaggctgagg

SEQ ID NO: 86952 - DNA, 16 bp, H. sapiens
ctcctggagggcaggg

SEQ ID NO: 86953 - DNA, 16 bp, H. sapiens
ctcctggagtcccagc

SEQ ID NO: 86954 - DNA, 16 bp, H. sapiens
ctcctggataaataat

SEQ ID NO: 86955 - DNA, 16 bp, H. sapiens
ctcctggatctccagc

SEQ ID NO: 86956 - DNA, 16 bp, H. sapiens
ctcctggatgcccagg

SEQ ID NO: 86957 - DNA, 16 bp, H. sapiens
ctcctggatggcattt

SEQ ID NO: 86958 - DNA, 16 bp, H. sapiens
ctcctggattcaagca

SEQ ID NO: 86959 - DNA, 16 bp, H. sapiens
ctcctggattcactga

SEQ ID NO: 86960 - DNA, 16 bp, H. sapiens
ctcctggattcaggtg

SEQ ID NO: 86961 - DNA, 16 bp, H. sapiens
ctcctggattccttag

SEQ ID NO: 86962 - DNA, 16 bp, H. sapiens
ctcctggcacccactc

SEQ ID NO: 86963 - DNA, 16 bp, H. sapiens
ctcctggcaggaggcc

SEQ ID NO: 86964 - DNA, 21 bp, H. sapiens
ctcctggccaacatggtgaaa

SEQ ID NO: 86965 - DNA, 16 bp, H. sapiens
ctcctggccaggtgtg

SEQ ID NO: 86966 - DNA, 16 bp, H. sapiens
ctcctggcctcaagca

SEQ ID NO: 86967 - DNA, 16 bp, H. sapiens
ctcctggcctcaagcc

SEQ ID NO: 86968 - DNA, 16 bp, H. sapiens
ctcctggcctcagcaa

SEQ ID NO: 86969 - DNA, 16 bp, H. sapiens
ctcctggcctcaggcc

SEQ ID NO: 86970 - DNA, 16 bp, H. sapiens
ctcctggcctccagca

SEQ ID NO: 86971 - DNA, 16 bp, H. sapiens
ctcctggcctccagcg

SEQ ID NO: 86972 - DNA, 16 bp, H. sapiens
ctcctggcctccctgc

SEQ ID NO: 86973 - DNA, 16 bp, H. sapiens
ctcctggcctcctgtg

SEQ ID NO: 86974 - DNA, 17 bp, H. sapiens
ctcctggcctcgtgatc

SEQ ID NO: 86975 - DNA, 16 bp, H. sapiens
ctcctggcctctgccc

SEQ ID NO: 86976 - DNA, 16 bp, H. sapiens
ctcctggccttaaaca

SEQ ID NO: 86977 - DNA, 16 bp, H. sapiens
ctcctggctcagcccc

SEQ ID NO: 86978 - DNA, 16 bp, H. sapiens
ctcctggctcccagcc

SEQ ID NO: 86979 - DNA, 16 bp, H. sapiens
ctcctggctctcaggc

SEQ ID NO: 86980 - DNA, 16 bp, H. sapiens
ctcctggctgctttca

SEQ ID NO: 86981 - DNA, 16 bp, H. sapiens
ctcctggcttcaaatg

SEQ ID NO: 86982 - DNA, 16 bp, H. sapiens
ctcctggcttcaagtg

SEQ ID NO: 86983 - DNA, 16 bp, H. sapiens
ctcctggctttcctcc

SEQ ID NO: 86984 - DNA, 16 bp, H. sapiens
ctcctgggagaggagg

SEQ ID NO: 86985 - DNA, 16 bp, H. sapiens
ctcctgggatcaagca

SEQ ID NO: 86986 - DNA, 16 bp, H. sapiens
ctcctgggcagctggg

SEQ ID NO: 86987 - DNA, 16 bp, H. sapiens
ctcctgggcccactgt

SEQ ID NO: 86988 - DNA, 16 bp, H. sapiens
ctcctgggcccaggtg

SEQ ID NO: 86989 - DNA, 16 bp, H. sapiens
ctcctgggcctcctgg

SEQ ID NO: 86990 - DNA, 16 bp, H. sapiens
ctcctgggctcaacca

SEQ ID NO: 86991 - DNA, 16 bp, H. sapiens
ctcctgggctcaagct

SEQ ID NO: 86992 - DNA, 16 bp, H. sapiens
ctcctgggctcaagtt

SEQ ID NO: 86993 - DNA, 16 bp, H. sapiens
ctcctgggctcagggc

SEQ ID NO: 86994 - DNA, 16 bp, H. sapiens
ctcctgggctcaggtg

SEQ ID NO: 86995 - DNA, 16 bp, H. sapiens
ctcctgggctccagag

SEQ ID NO: 86996 - DNA, 16 bp, H. sapiens
ctcctgggctccagcc

SEQ ID NO: 86997 - DNA, 16 bp, H. sapiens
ctcctgggctcccacc

SEQ ID NO: 86998 - DNA, 16 bp, H. sapiens
ctcctgggctctggca

SEQ ID NO: 86999 - DNA, 16 bp, H. sapiens
ctcctggggaaggggt

SEQ ID NO: 87000 - DNA, 16 bp, H. sapiens
ctcctggggagctggg

SEQ ID NO: 87001 - DNA, 16 bp, H. sapiens
ctcctggggaggctga

SEQ ID NO: 87002 - DNA, 16 bp, H. sapiens
ctcctggggcctgggg

SEQ ID NO: 87003 - DNA, 16 bp, H. sapiens
ctcctggggctccctc

SEQ ID NO: 87004 - DNA, 16 bp, H. sapiens
ctcctgggggaggagg

SEQ ID NO: 87005 - DNA, 16 bp, H. sapiens
ctcctgggtagctgga

SEQ ID NO: 87006 - DNA, 16 bp, H. sapiens
ctcctgggtgcagctg

SEQ ID NO: 87007 - DNA, 16 bp, H. sapiens
ctcctgggtgcaggtg

SEQ ID NO: 87008 - DNA, 16 bp, H. sapiens
ctcctgggttcacgcg

SEQ ID NO: 87009 - DNA, 16 bp, H. sapiens
ctcctgggttcaggtg

SEQ ID NO: 87010 - DNA, 16 bp, H. sapiens
ctcctgggttcatgac

SEQ ID NO: 87011 - DNA, 16 bp, H. sapiens
ctcctgggttccagag

SEQ ID NO: 87012 - DNA, 16 bp, H. sapiens
ctcctgggttccagca

SEQ ID NO: 87013 - DNA, 16 bp, H. sapiens
ctcctgggttctggcc

SEQ ID NO: 87014 - DNA, 16 bp, H. sapiens
ctcctgggttgaagtg

SEQ ID NO: 87015 - DNA, 16 bp, H. sapiens
ctcctgggttgacacc

SEQ ID NO: 87016 - DNA, 16 bp, H. sapiens
ctcctgggttgacgcc

SEQ ID NO: 87017 - DNA, 16 bp, H. sapiens
ctcctgggtttcaagc

SEQ ID NO: 87018 - DNA, 16 bp, H. sapiens
ctcctggtccctccca

SEQ ID NO: 87019 - DNA, 16 bp, H. sapiens
ctcctggtgaccacct

SEQ ID NO: 87020 - DNA, 16 bp, H. sapiens
ctcctggtggctccag

SEQ ID NO: 87021 - DNA, 16 bp, H. sapiens
ctcctggtgtgtgtgt

SEQ ID NO: 87022 - DNA, 16 bp, H. sapiens
ctcctggtttagtctt

SEQ ID NO: 87023 - DNA, 16 bp, H. sapiens
ctcctggtttcaagag

SEQ ID NO: 87024 - DNA, 16 bp, H. sapiens
ctcctggtttcaagcg

SEQ ID NO: 87025 - DNA, 16 bp, H. sapiens
ctcctgtaagaatcta

SEQ ID NO: 87026 - DNA, 16 bp, H. sapiens
ctcctgtaatcctagc

SEQ ID NO: 87027 - DNA, 16 bp, H. sapiens
ctcctgtatcagcctc

SEQ ID NO: 87028 - DNA, 16 bp, H. sapiens
ctcctgtccagcctgc

SEQ ID NO: 87029 - DNA, 16 bp, H. sapiens
ctcctgtcccagcctc

SEQ ID NO: 87030 - DNA, 16 bp, H. sapiens
ctcctgtcctcaagtg

SEQ ID NO: 87031 - DNA, 16 bp, H. sapiens
ctcctgtcctcaggca

SEQ ID NO: 87032 - DNA, 16 bp, H. sapiens
ctcctgtcctcatgat

SEQ ID NO: 87033 - DNA, 16 bp, H. sapiens
ctcctgtcctcgtgat

SEQ ID NO: 87034 - DNA, 16 bp, H. sapiens
ctcctgtcctgctcat

SEQ ID NO: 87035 - DNA, 16 bp, H. sapiens
ctcctgtcctggcctc

SEQ ID NO: 87036 - DNA, 16 bp, H. sapiens
ctcctgtctcaccctc

SEQ ID NO: 87037 - DNA, 16 bp, H. sapiens
ctcctgtctcagcctc

SEQ ID NO: 87038 - DNA, 16 bp, H. sapiens
ctcctgtctcagcttt

SEQ ID NO: 87039 - DNA, 16 bp, H. sapiens
ctcctgtctcagtccc

SEQ ID NO: 87040 - DNA, 16 bp, H. sapiens
ctcctgtctcccaggc

SEQ ID NO: 87041 - DNA, 16 bp, H. sapiens
ctcctgtctcccagtg

SEQ ID NO: 87042 - DNA, 16 bp, H. sapiens
ctcctgtctcggcctc

SEQ ID NO: 87043 - DNA, 16 bp, H. sapiens
ctcctgtctctgcctc

SEQ ID NO: 87044 - DNA, 16 bp, H. sapiens
ctcctgtgagatcagc

SEQ ID NO: 87045 - DNA, 16 bp, H. sapiens
ctcctgtgatcccagc

SEQ ID NO: 87046 - DNA, 17 bp, H. sapiens
ctcctgtgttcatgcca

SEQ ID NO: 87047 - DNA, 16 bp, H. sapiens
ctcctgtttcatttct

SEQ ID NO: 87048 - DNA, 16 bp, H. sapiens
ctccttaaaacataaa

SEQ ID NO: 87049 - DNA, 16 bp, H. sapiens
ctccttaaactgataa

SEQ ID NO: 87050 - DNA, 16 bp, H. sapiens
ctccttaagctgatga

SEQ ID NO: 87051 - DNA, 16 bp, H. sapiens
ctccttaccctgcccc

SEQ ID NO: 87052 - DNA, 16 bp, H. sapiens
ctccttacccttggga

SEQ ID NO: 87053 - DNA, 16 bp, H. sapiens
ctccttcaagcactcc

SEQ ID NO: 87054 - DNA, 16 bp, H. sapiens
ctccttcacacacaca

SEQ ID NO: 87055 - DNA, 16 bp, H. sapiens
ctccttcacctcctgc

SEQ ID NO: 87056 - DNA, 16 bp, H. sapiens
ctccttcaccttctgt

SEQ ID NO: 87057 - DNA, 16 bp, H. sapiens
ctccttcagacccagg

SEQ ID NO: 87058 - DNA, 16 bp, H. sapiens
ctccttcagctatact

SEQ ID NO: 87059 - DNA, 16 bp, H. sapiens
ctccttcaggagctct

SEQ ID NO: 87060 - DNA, 16 bp, H. sapiens
ctccttcagttctgct

SEQ ID NO: 87061 - DNA, 16 bp, H. sapiens
ctccttcatcagcctc

SEQ ID NO: 87062 - DNA, 32 bp, H. sapiens
ctccttccagcctcacaggcccattctattct

SEQ ID NO: 87063 - DNA, 16 bp, H. sapiens
ctccttccagcctctg

SEQ ID NO: 87064 - DNA, 16 bp, H. sapiens
ctccttcccacctgcc

SEQ ID NO: 87065 - DNA, 16 bp, H. sapiens
ctccttccccagcctc

SEQ ID NO: 87066 - DNA, 16 bp, H. sapiens
ctccttccccagctcc

SEQ ID NO: 87067 - DNA, 16 bp, H. sapiens
ctccttcctcagcctc

SEQ ID NO: 87068 - DNA, 16 bp, H. sapiens
ctccttcctgattctg

SEQ ID NO: 87069 - DNA, 16 bp, H. sapiens
ctccttcctgcagctg

SEQ ID NO: 87070 - DNA, 16 bp, H. sapiens
ctccttcctgcctggg

SEQ ID NO: 87071 - DNA, 16 bp, H. sapiens
ctccttcctgctccca

SEQ ID NO: 87072 - DNA, 16 bp, H. sapiens
ctccttcctgctgctt

SEQ ID NO: 87073 - DNA, 16 bp, H. sapiens
ctccttcctgctgtct

SEQ ID NO: 87074 - DNA, 17 bp, H. sapiens
ctccttcgcccaggctg

SEQ ID NO: 87075 - DNA, 16 bp, H. sapiens
ctccttctcagcctcc

SEQ ID NO: 87076 - DNA, 16 bp, H. sapiens
ctccttctccaaagga

SEQ ID NO: 87077 - DNA, 16 bp, H. sapiens
ctccttctgccatgat

SEQ ID NO: 87078 - DNA, 16 bp, H. sapiens
ctccttctgccttctg

SEQ ID NO: 87079 - DNA, 16 bp, H. sapiens
ctccttctgggactct

SEQ ID NO: 87080 - DNA, 16 bp, H. sapiens
ctccttctgggttcaa

SEQ ID NO: 87081 - DNA, 16 bp, H. sapiens
ctccttgaacacagtg

SEQ ID NO: 87082 - DNA, 16 bp, H. sapiens
ctccttgaagaggacc

SEQ ID NO: 87083 - DNA, 16 bp, H. sapiens
ctccttgagggcaagg

SEQ ID NO: 87084 - DNA, 16 bp, H. sapiens
ctccttgcccctagtt

SEQ ID NO: 87085 - DNA, 16 bp, H. sapiens
ctccttgcctcaggtg

SEQ ID NO: 87086 - DNA, 16 bp, H. sapiens
ctccttgccttcccca

SEQ ID NO: 87087 - DNA, 16 bp, H. sapiens
ctccttggagaaatgc

SEQ ID NO: 87088 - DNA, 16 bp, H. sapiens
ctccttggcctctctg

SEQ ID NO: 87089 - DNA, 16 bp, H. sapiens
ctccttggctcaggtg

SEQ ID NO: 87090 - DNA, 16 bp, H. sapiens
ctccttgggctcaagc

SEQ ID NO: 87091 - DNA, 16 bp, H. sapiens
ctccttgtcttctgcc

SEQ ID NO: 87092 - DNA, 16 bp, H. sapiens
ctccttgtggcctggg

SEQ ID NO: 87093 - DNA, 16 bp, H. sapiens
ctccttgttaagtttg

SEQ ID NO: 87094 - DNA, 16 bp, H. sapiens
ctcctttaaaacaaat

SEQ ID NO: 87095 - DNA, 16 bp, H. sapiens
ctcctttattttttgg

SEQ ID NO: 87096 - DNA, 16 bp, H. sapiens
ctcctttccacagcca

SEQ ID NO: 87097 - DNA, 16 bp, H. sapiens
ctcctttctactaaaa

SEQ ID NO: 87098 - DNA, 16 bp, H. sapiens
ctcctttgactccaca

SEQ ID NO: 87099 - DNA, 16 bp, H. sapiens
ctcctttgactccttg

SEQ ID NO: 87100 - DNA, 16 bp, H. sapiens
ctcctttgcagctagg

SEQ ID NO: 87101 - DNA, 16 bp, H. sapiens
ctcctttgccttctgc

SEQ ID NO: 87102 - DNA, 16 bp, H. sapiens
ctcctttgctttctgc

SEQ ID NO: 87103 - DNA, 16 bp, H. sapiens
ctccttttaaaaataa

SEQ ID NO: 87104 - DNA, 16 bp, H. sapiens
ctccttttctcaagca

SEQ ID NO: 87105 - DNA, 16 bp, H. sapiens
ctcctttttataagga

SEQ ID NO: 87106 - DNA, 16 bp, H. sapiens
ctcctttttttaaaaa

SEQ ID NO: 87107 - DNA, 16 bp, H. sapiens
ctcgaaaaaacaaaca

SEQ ID NO: 87108 - DNA, 16 bp, H. sapiens
ctcgaaatcctgagct

SEQ ID NO: 87109 - DNA, 16 bp, H. sapiens
ctcgaacccgggaggc

SEQ ID NO: 87110 - DNA, 16 bp, H. sapiens
ctcgaacctgggaggc

SEQ ID NO: 87111 - DNA, 16 bp, H. sapiens
ctcgaactcctagact

SEQ ID NO: 87112 - DNA, 16 bp, H. sapiens
ctcgacctcctgagta

SEQ ID NO: 87113 - DNA, 16 bp, H. sapiens
ctcgacttcctggact

SEQ ID NO: 87114 - DNA, 16 bp, H. sapiens
ctcgagaagagcaatt

SEQ ID NO: 87115 - DNA, 16 bp, H. sapiens
ctcgagaccatcctgg

SEQ ID NO: 87116 - DNA, 16 bp, H. sapiens
ctcgagcccaggagtt

SEQ ID NO: 87117 - DNA, 16 bp, H. sapiens
ctcgaggtcaggagtt

SEQ ID NO: 87118 - DNA, 16 bp, H. sapiens
ctcgagtgatccaccc

SEQ ID NO: 87119 - DNA, 16 bp, H. sapiens
ctcgagtgcaatggca

SEQ ID NO: 87120 - DNA, 16 bp, H. sapiens
ctcgatctcccaggct

SEQ ID NO: 87121 - DNA, 16 bp, H. sapiens
ctcgatttctcaccga

SEQ ID NO: 87122 - DNA, 16 bp, H. sapiens
ctcgccctgcctccat

SEQ ID NO: 87123 - DNA, 16 bp, H. sapiens
ctcgcctcggccttcc

SEQ ID NO: 87124 - DNA, 16 bp, H. sapiens
ctcgctctgtcacccg

SEQ ID NO: 87125 - DNA, 16 bp, H. sapiens
ctcgctctgtcacctg

SEQ ID NO: 87126 - DNA, 16 bp, H. sapiens
ctcgctctgtcgccgg

SEQ ID NO: 87127 - DNA, 16 bp, H. sapiens
ctcgctctgttgtcca

SEQ ID NO: 87128 - DNA, 16 bp, H. sapiens
ctcgctgagcctcagt

SEQ ID NO: 87129 - DNA, 16 bp, H. sapiens
ctcgctgcaatctctg

SEQ ID NO: 87130 - DNA, 16 bp, H. sapiens
ctcgctgcagcttcaa

SEQ ID NO: 87131 - DNA, 16 bp, H. sapiens
ctcgctgtctcccagg

SEQ ID NO: 87132 - DNA, 16 bp, H. sapiens
ctcgctgtgtcactca

SEQ ID NO: 87133 - DNA, 17 bp, H. sapiens
ctcggcactttgggagg

SEQ ID NO: 87134 - DNA, 17 bp, H. sapiens
ctcggcctcacaaagtg

SEQ ID NO: 87135 - DNA, 16 bp, H. sapiens
ctcggcctcagcctcc

SEQ ID NO: 87136 - DNA, 16 bp, H. sapiens
ctcggcctcccagagt

SEQ ID NO: 87137 - DNA, 16 bp, H. sapiens
ctcggcctcctaaact

SEQ ID NO: 87138 - DNA, 16 bp, H. sapiens
ctcggcctctcaaagt

SEQ ID NO: 87139 - DNA, 16 bp, H. sapiens
ctcggccttccaaagt

SEQ ID NO: 87140 - DNA, 16 bp, H. sapiens
ctcggctcaccgccac

SEQ ID NO: 87141 - DNA, 18 bp, H. sapiens
ctcggctcactgcaaacc

SEQ ID NO: 87142 - DNA, 27 bp, H. sapiens
ctcggctcggctcggctcggctcggct

SEQ ID NO: 87143 - DNA, 16 bp, H. sapiens
ctcggcttcccaatgt

SEQ ID NO: 87144 - DNA, 16 bp, H. sapiens
ctcggcttcctcatct

SEQ ID NO: 87145 - DNA, 16 bp, H. sapiens
ctcggcttctggggag

SEQ ID NO: 87146 - DNA, 16 bp, H. sapiens
ctcgggaggcagaggc

SEQ ID NO: 87147 - DNA, 16 bp, H. sapiens
ctcgggaggctaagga

SEQ ID NO: 87148 - DNA, 16 bp, H. sapiens
ctcgggaggctgagcc

SEQ ID NO: 87149 - DNA, 16 bp, H. sapiens
ctcgggaggctggggc

SEQ ID NO: 87150 - DNA, 16 bp, H. sapiens
ctcgggaggctggggt

SEQ ID NO: 87151 - DNA, 16 bp, H. sapiens
ctcggggatgaacaag

SEQ ID NO: 87152 - DNA, 18 bp, H. sapiens
ctcgggttacccacaaag

SEQ ID NO: 87153 - DNA, 16 bp, H. sapiens
ctcggtgcgctgcacc

SEQ ID NO: 87154 - DNA, 16 bp, H. sapiens
ctcggtgggctgcacc

SEQ ID NO: 87155 - DNA, 16 bp, H. sapiens
ctcggtttcctcatct

SEQ ID NO: 87156 - DNA, 16 bp, H. sapiens
ctcggttttctcatct

SEQ ID NO: 87157 - DNA, 16 bp, H. sapiens
ctcgtattcaacatag

SEQ ID NO: 87158 - DNA, 16 bp, H. sapiens
ctcgtcaaagttattc

SEQ ID NO: 87159 - DNA, 16 bp, H. sapiens
ctcgtccctgggcaat

SEQ ID NO: 87160 - DNA, 16 bp, H. sapiens
ctcgtccttccaaagt

SEQ ID NO: 87161 - DNA, 16 bp, H. sapiens
ctcgtctctacaaaaa

SEQ ID NO: 87162 - DNA, 17 bp, H. sapiens
ctcgtgacctcgtgatc

SEQ ID NO: 87163 - DNA, 16 bp, H. sapiens
ctcgtggagaacctct

SEQ ID NO: 87164 - DNA, 16 bp, H. sapiens
ctctaaagaaacaaaa

SEQ ID NO: 87165 - DNA, 16 bp, H. sapiens
ctctaaataaatgaat

SEQ ID NO: 87166 - DNA, 16 bp, H. sapiens
ctctaaatattgaaac

SEQ ID NO: 87167 - DNA, 16 bp, H. sapiens
ctctaaatttccctct

SEQ ID NO: 87168 - DNA, 16 bp, H. sapiens
ctctaacctgggagac

SEQ ID NO: 87169 - DNA, 16 bp, H. sapiens
ctctaactcctggact

SEQ ID NO: 87170 - DNA, 16 bp, H. sapiens
ctctaactccttattt

SEQ ID NO: 87171 - DNA, 16 bp, H. sapiens
ctctaagaacttattt

SEQ ID NO: 87172 - DNA, 16 bp, H. sapiens
ctctaagaatgttgaa

SEQ ID NO: 87173 - DNA, 16 bp, H. sapiens
ctctaagcctcagtgt

SEQ ID NO: 87174 - DNA, 16 bp, H. sapiens
ctctaagcctcagttt

SEQ ID NO: 87175 - DNA, 16 bp, H. sapiens
ctctaagccttagttt

SEQ ID NO: 87176 - DNA, 16 bp, H. sapiens
ctctaagttttctttt

SEQ ID NO: 87177 - DNA, 16 bp, H. sapiens
ctctaatgcctgatga

SEQ ID NO: 87178 - DNA, 16 bp, H. sapiens
ctctacaaaaaaaatg

SEQ ID NO: 87179 - DNA, 16 bp, H. sapiens
ctctacaaaaaattgg

SEQ ID NO: 87180 - DNA, 16 bp, H. sapiens
ctctacaaaaacacac

SEQ ID NO: 87181 - DNA, 16 bp, H. sapiens
ctctacaaaaatgttt

SEQ ID NO: 87182 - DNA, 16 bp, H. sapiens
ctctacaaaagaaaaa

SEQ ID NO: 87183 - DNA, 16 bp, H. sapiens
ctctacaaaataattt

SEQ ID NO: 87184 - DNA, 16 bp, H. sapiens
ctctacaaatatttat

SEQ ID NO: 87185 - DNA, 16 bp, H. sapiens
ctctacacactgcctt

SEQ ID NO: 87186 - DNA, 16 bp, H. sapiens
ctctacagcctcacca

SEQ ID NO: 87187 - DNA, 16 bp, H. sapiens
ctctacagggacagaa

SEQ ID NO: 87188 - DNA, 16 bp, H. sapiens
ctctacatcttcacca

SEQ ID NO: 87189 - DNA, 16 bp, H. sapiens
ctctacatctttgtca

SEQ ID NO: 87190 - DNA, 16 bp, H. sapiens
ctctaccaaaaagtac

SEQ ID NO: 87191 - DNA, 16 bp, H. sapiens
ctctaccacatggcca

SEQ ID NO: 87192 - DNA, 18 bp, H. sapiens
ctctaccagaaaatgaaa

SEQ ID NO: 87193 - DNA, 16 bp, H. sapiens
ctctaccctcaagtag

SEQ ID NO: 87194 - DNA, 16 bp, H. sapiens
ctctaccctcatgacc

SEQ ID NO: 87195 - DNA, 16 bp, H. sapiens
ctctacctcccatgtt

SEQ ID NO: 87196 - DNA, 16 bp, H. sapiens
ctctacctccttcagt

SEQ ID NO: 87197 - DNA, 16 bp, H. sapiens
ctctacctctgggggc

SEQ ID NO: 87198 - DNA, 16 bp, H. sapiens
ctctactccctccctg

SEQ ID NO: 87199 - DNA, 16 bp, H. sapiens
ctctactccttccctg

SEQ ID NO: 87200 - DNA, 16 bp, H. sapiens
ctctacttctaattct

SEQ ID NO: 87201 - DNA, 16 bp, H. sapiens
ctctactttctgctca

SEQ ID NO: 87202 - DNA, 16 bp, H. sapiens
ctctagaaaaacagaa

SEQ ID NO: 87203 - DNA, 16 bp, H. sapiens
ctctagaaaaataatt

SEQ ID NO: 87204 - DNA, 16 bp, H. sapiens
ctctagaaagttccaa

SEQ ID NO: 87205 - DNA, 16 bp, H. sapiens
ctctagaaatttttca

SEQ ID NO: 87206 - DNA, 16 bp, H. sapiens
ctctagaagctgaaaa

SEQ ID NO: 87207 - DNA, 16 bp, H. sapiens
ctctagaatgtaagct

SEQ ID NO: 87208 - DNA, 17 bp, H. sapiens
ctctagactccacctct

SEQ ID NO: 87209 - DNA, 16 bp, H. sapiens
ctctagagagacagaa

SEQ ID NO: 87210 - DNA, 16 bp, H. sapiens
ctctagagccagactg

SEQ ID NO: 87211 - DNA, 16 bp, H. sapiens
ctctagcatgggtgac

SEQ ID NO: 87212 - DNA, 16 bp, H. sapiens
ctctagctcctgacct

SEQ ID NO: 87213 - DNA, 16 bp, H. sapiens
ctctaggcattcctac

SEQ ID NO: 87214 - DNA, 16 bp, H. sapiens
ctctagggaagaatcc

SEQ ID NO: 87215 - DNA, 16 bp, H. sapiens
ctctagggcaggggca

SEQ ID NO: 87216 - DNA, 16 bp, H. sapiens
ctctataaaatacaaa

SEQ ID NO: 87217 - DNA, 16 bp, H. sapiens
ctctataggaaaaaaa

SEQ ID NO: 87218 - DNA, 16 bp, H. sapiens
ctctatagggaaaaaa

SEQ ID NO: 87219 - DNA, 16 bp, H. sapiens
ctctatattcctcctc

SEQ ID NO: 87220 - DNA, 16 bp, H. sapiens
ctctatcaaaaagaag

SEQ ID NO: 87221 - DNA, 16 bp, H. sapiens
ctctatcaaaaggaaa

SEQ ID NO: 87222 - DNA, 16 bp, H. sapiens
ctctatcagcttttaa

SEQ ID NO: 87223 - DNA, 16 bp, H. sapiens
ctctatcatgagaaca

SEQ ID NO: 87224 - DNA, 16 bp, H. sapiens
ctctatcccccaggct

SEQ ID NO: 87225 - DNA, 16 bp, H. sapiens
ctctatcgccaaggct

SEQ ID NO: 87226 - DNA, 16 bp, H. sapiens
ctctatctccatcagt

SEQ ID NO: 87227 - DNA, 16 bp, H. sapiens
ctctatctccatgggt

SEQ ID NO: 87228 - DNA, 16 bp, H. sapiens
ctctatctctctctgt

SEQ ID NO: 87229 - DNA, 16 bp, H. sapiens
ctctatctctgtctct

SEQ ID NO: 87230 - DNA, 16 bp, H. sapiens
ctctatctgggcagtg

SEQ ID NO: 87231 - DNA, 16 bp, H. sapiens
ctctatcttcaaaata

SEQ ID NO: 87232 - DNA, 16 bp, H. sapiens
ctctatgatgttctca

SEQ ID NO: 87233 - DNA, 16 bp, H. sapiens
ctctatgcagacaacc

SEQ ID NO: 87234 - DNA, 16 bp, H. sapiens
ctctatggatttgcct

SEQ ID NO: 87235 - DNA, 16 bp, H. sapiens
ctctatgggaaaaaaa

SEQ ID NO: 87236 - DNA, 16 bp, H. sapiens
ctctatgtgggggctc

SEQ ID NO: 87237 - DNA, 16 bp, H. sapiens
ctctattccccaggct

SEQ ID NO: 87238 - DNA, 16 bp, H. sapiens
ctctattctgtttctt

SEQ ID NO: 87239 - DNA, 16 bp, H. sapiens
ctctattgcaattccc

SEQ ID NO: 87240 - DNA, 16 bp, H. sapiens
ctctatttaaaaaaga

SEQ ID NO: 87241 - DNA, 16 bp, H. sapiens
ctctatttcctgacct

SEQ ID NO: 87242 - DNA, 16 bp, H. sapiens
ctctatttccttgtct

SEQ ID NO: 87243 - DNA, 16 bp, H. sapiens
ctctatttctgtgaag

SEQ ID NO: 87244 - DNA, 16 bp, H. sapiens
ctctattttcttctaa

SEQ ID NO: 87245 - DNA, 16 bp, H. sapiens
ctctcaaaaaagaaaa

SEQ ID NO: 87246 - DNA, 16 bp, H. sapiens
ctctcaaaaataaata

SEQ ID NO: 87247 - DNA, 16 bp, H. sapiens
ctctcaaaatatttta

SEQ ID NO: 87248 - DNA, 16 bp, H. sapiens
ctctcaaagtgccagg

SEQ ID NO: 87249 - DNA, 16 bp, H. sapiens
ctctcaaagtgttgag

SEQ ID NO: 87250 - DNA, 16 bp, H. sapiens
ctctcaacactttaaa

SEQ ID NO: 87251 - DNA, 16 bp, H. sapiens
ctctcaagatccttaa

SEQ ID NO: 87252 - DNA, 16 bp, H. sapiens
ctctcaagtttcccct

SEQ ID NO: 87253 - DNA, 16 bp, H. sapiens
ctctcaattcatcaaa

SEQ ID NO: 87254 - DNA, 16 bp, H. sapiens
ctctcaattttgctgt

SEQ ID NO: 87255 - DNA, 16 bp, H. sapiens
ctctcacacacaaaca

SEQ ID NO: 87256 - DNA, 16 bp, H. sapiens
ctctcacacactcaca

SEQ ID NO: 87257 - DNA, 16 bp, H. sapiens
ctctcacacactgctg

SEQ ID NO: 87258 - DNA, 16 bp, H. sapiens
ctctcacagctccact

SEQ ID NO: 87259 - DNA, 16 bp, H. sapiens
ctctcacatgaactaa

SEQ ID NO: 87260 - DNA, 16 bp, H. sapiens
ctctcaccacttctct

SEQ ID NO: 87261 - DNA, 16 bp, H. sapiens
ctctcacccagcctgg

SEQ ID NO: 87262 - DNA, 16 bp, H. sapiens
ctctcacctcagccct

SEQ ID NO: 87263 - DNA, 16 bp, H. sapiens
ctctcacctcagcctc

SEQ ID NO: 87264 - DNA, 16 bp, H. sapiens
ctctcacctcagcctg

SEQ ID NO: 87265 - DNA, 16 bp, H. sapiens
ctctcaccttatacaa

SEQ ID NO: 87266 - DNA, 16 bp, H. sapiens
ctctcactctcactct

SEQ ID NO: 87267 - DNA, 16 bp, H. sapiens
ctctcactctgtcgcc

SEQ ID NO: 87268 - DNA, 16 bp, H. sapiens
ctctcacttctgcctc

SEQ ID NO: 87269 - DNA, 16 bp, H. sapiens
ctctcagaaataatgc

SEQ ID NO: 87270 - DNA, 16 bp, H. sapiens
ctctcagaacacagtg

SEQ ID NO: 87271 - DNA, 16 bp, H. sapiens
ctctcagaacctcagt

SEQ ID NO: 87272 - DNA, 16 bp, H. sapiens
ctctcagaccaaagtg

SEQ ID NO: 87273 - DNA, 16 bp, H. sapiens
ctctcagacttaactc

SEQ ID NO: 87274 - DNA, 16 bp, H. sapiens
ctctcagagcagctgg

SEQ ID NO: 87275 - DNA, 16 bp, H. sapiens
ctctcagattcaagtg

SEQ ID NO: 87276 - DNA, 16 bp, H. sapiens
ctctcagcaggaaggg

SEQ ID NO: 87277 - DNA, 16 bp, H. sapiens
ctctcagcctcccaag

SEQ ID NO: 87278 - DNA, 16 bp, H. sapiens
ctctcagctctgcctc

SEQ ID NO: 87279 - DNA, 16 bp, H. sapiens
ctctcagcttgctgag

SEQ ID NO: 87280 - DNA, 16 bp, H. sapiens
ctctcaggaaaaaaaa

SEQ ID NO: 87281 - DNA, 16 bp, H. sapiens
ctctcaggagagtgtg

SEQ ID NO: 87282 - DNA, 16 bp, H. sapiens
ctctcaggaggctgag

SEQ ID NO: 87283 - DNA, 16 bp, H. sapiens
ctctcaggctcaagca

SEQ ID NO: 87284 - DNA, 16 bp, H. sapiens
ctctcaggtgatgctg

SEQ ID NO: 87285 - DNA, 16 bp, H. sapiens
ctctcaggttcaagcg

SEQ ID NO: 87286 - DNA, 16 bp, H. sapiens
ctctcagtccctgcct

SEQ ID NO: 87287 - DNA, 16 bp, H. sapiens
ctctcagtcctgccat

SEQ ID NO: 87288 - DNA, 16 bp, H. sapiens
ctctcatcactgcttt

SEQ ID NO: 87289 - DNA, 16 bp, H. sapiens
ctctcatccaggctgg

SEQ ID NO: 87290 - DNA, 16 bp, H. sapiens
ctctcatgaggttgca

SEQ ID NO: 87291 - DNA, 16 bp, H. sapiens
ctctcatggcttccct

SEQ ID NO: 87292 - DNA, 16 bp, H. sapiens
ctctcattctctcctg

SEQ ID NO: 87293 - DNA, 16 bp, H. sapiens
ctctcattctgtaagt

SEQ ID NO: 87294 - DNA, 16 bp, H. sapiens
ctctcattctgtcacc

SEQ ID NO: 87295 - DNA, 16 bp, H. sapiens
ctctcatttccttgag

SEQ ID NO: 87296 - DNA, 16 bp, H. sapiens
ctctccaaaataaaaa

SEQ ID NO: 87297 - DNA, 16 bp, H. sapiens
ctctccaaactgcttt

SEQ ID NO: 87298 - DNA, 16 bp, H. sapiens
ctctccaacctcatct

SEQ ID NO: 87299 - DNA, 16 bp, H. sapiens
ctctccaagtctcagt

SEQ ID NO: 87300 - DNA, 16 bp, H. sapiens
ctctccaagtgattct

SEQ ID NO: 87301 - DNA, 16 bp, H. sapiens
ctctccaagtgctggg

SEQ ID NO: 87302 - DNA, 16 bp, H. sapiens
ctctccaccctctgat

SEQ ID NO: 87303 - DNA, 16 bp, H. sapiens
ctctccacctcctggg

SEQ ID NO: 87304 - DNA, 16 bp, H. sapiens
ctctccagaaaaaaaa

SEQ ID NO: 87305 - DNA, 16 bp, H. sapiens
ctctccagcccctggc

SEQ ID NO: 87306 - DNA, 16 bp, H. sapiens
ctctccagcccctgtt

SEQ ID NO: 87307 - DNA, 16 bp, H. sapiens
ctctccagcctcacct

SEQ ID NO: 87308 - DNA, 16 bp, H. sapiens
ctctccagcctcctcc

SEQ ID NO: 87309 - DNA, 16 bp, H. sapiens
ctctccagcctcttct

SEQ ID NO: 87310 - DNA, 16 bp, H. sapiens
ctctccagcctgggaa

SEQ ID NO: 87311 - DNA, 16 bp, H. sapiens
ctctccagcctgggca

SEQ ID NO: 87312 - DNA, 16 bp, H. sapiens
ctctccagcctgggct

SEQ ID NO: 87313 - DNA, 16 bp, H. sapiens
ctctccagccttctct

SEQ ID NO: 87314 - DNA, 16 bp, H. sapiens
ctctccagccttggtg

SEQ ID NO: 87315 - DNA, 16 bp, H. sapiens
ctctccaggacattgg

SEQ ID NO: 87316 - DNA, 16 bp, H. sapiens
ctctccagggcctcct

SEQ ID NO: 87317 - DNA, 16 bp, H. sapiens
ctctccagttcaagcg

SEQ ID NO: 87318 - DNA, 16 bp, H. sapiens
ctctccagtttcccat

SEQ ID NO: 87319 - DNA, 16 bp, H. sapiens
ctctccatctctgcct

SEQ ID NO: 87320 - DNA, 16 bp, H. sapiens
ctctccatctgtctct

SEQ ID NO: 87321 - DNA, 16 bp, H. sapiens
ctctccatttatttgg

SEQ ID NO: 87322 - DNA, 16 bp, H. sapiens
ctctcccaagactgaa

SEQ ID NO: 87323 - DNA, 16 bp, H. sapiens
ctctcccacctcctgc

SEQ ID NO: 87324 - DNA, 16 bp, H. sapiens
ctctcccagcccctgg

SEQ ID NO: 87325 - DNA, 16 bp, H. sapiens
ctctcccagcctcact

SEQ ID NO: 87326 - DNA, 16 bp, H. sapiens
ctctcccagctcctgg

SEQ ID NO: 87327 - DNA, 16 bp, H. sapiens
ctctcccagtccattg

SEQ ID NO: 87328 - DNA, 16 bp, H. sapiens
ctctcccagtgcccag

SEQ ID NO: 87329 - DNA, 16 bp, H. sapiens
ctctccccagcctcct

SEQ ID NO: 87330 - DNA, 16 bp, H. sapiens
ctctccccatagccac

SEQ ID NO: 87331 - DNA, 19 bp, H. sapiens
ctctccccctccaaaggaa

SEQ ID NO: 87332 - DNA, 16 bp, H. sapiens
ctctcccctcagcctc

SEQ ID NO: 87333 - DNA, 16 bp, H. sapiens
ctctcccgggttcaag

SEQ ID NO: 87334 - DNA, 16 bp, H. sapiens
ctctccctccaggagg

SEQ ID NO: 87335 - DNA, 16 bp, H. sapiens
ctctccctcccccagg

SEQ ID NO: 87336 - DNA, 16 bp, H. sapiens
ctctccctccctggat

SEQ ID NO: 87337 - DNA, 16 bp, H. sapiens
ctctccctctctgcca

SEQ ID NO: 87338 - DNA, 16 bp, H. sapiens
ctctccctctctgggc

SEQ ID NO: 87339 - DNA, 16 bp, H. sapiens
ctctccctctgtgtgt

SEQ ID NO: 87340 - DNA, 16 bp, H. sapiens
ctctccctgccagctc

SEQ ID NO: 87341 - DNA, 16 bp, H. sapiens
ctctccctgctcctgg

SEQ ID NO: 87342 - DNA, 16 bp, H. sapiens
ctctccctggctccca

SEQ ID NO: 87343 - DNA, 16 bp, H. sapiens
ctctccctgtctgtct

SEQ ID NO: 87344 - DNA, 16 bp, H. sapiens
ctctccgggcctcagt

SEQ ID NO: 87345 - DNA, 16 bp, H. sapiens
ctctcctagtccactg

SEQ ID NO: 87346 - DNA, 16 bp, H. sapiens
ctctcctatcctcaat

SEQ ID NO: 87347 - DNA, 16 bp, H. sapiens
ctctcctcaggcctcc

SEQ ID NO: 87348 - DNA, 16 bp, H. sapiens
ctctcctccagcccct

SEQ ID NO: 87349 - DNA, 16 bp, H. sapiens
ctctcctccagcctcc

SEQ ID NO: 87350 - DNA, 16 bp, H. sapiens
ctctcctcccactgtc

SEQ ID NO: 87351 - DNA, 16 bp, H. sapiens
ctctcctcccagctcc

SEQ ID NO: 87352 - DNA, 16 bp, H. sapiens
ctctcctcctgcccca

SEQ ID NO: 87353 - DNA, 16 bp, H. sapiens
ctctcctcctgcctca

SEQ ID NO: 87354 - DNA, 16 bp, H. sapiens
ctctcctctctgacct

SEQ ID NO: 87355 - DNA, 16 bp, H. sapiens
ctctcctctctggctt

SEQ ID NO: 87356 - DNA, 16 bp, H. sapiens
ctctcctctgagctcc

SEQ ID NO: 87357 - DNA, 16 bp, H. sapiens
ctctcctctggcccag

SEQ ID NO: 87358 - DNA, 16 bp, H. sapiens
ctctcctgatttcctc

SEQ ID NO: 87359 - DNA, 16 bp, H. sapiens
ctctcctgccaccctg

SEQ ID NO: 87360 - DNA, 16 bp, H. sapiens
ctctcctgccatcatg

SEQ ID NO: 87361 - DNA, 16 bp, H. sapiens
ctctcctgccccagcc

SEQ ID NO: 87362 - DNA, 16 bp, H. sapiens
ctctcctgccctgttc

SEQ ID NO: 87363 - DNA, 17 bp, H. sapiens
ctctcctgcctcagcct

SEQ ID NO: 87364 - DNA, 16 bp, H. sapiens
ctctcctgcctcagct

SEQ ID NO: 87365 - DNA, 16 bp, H. sapiens
ctctcctgcctcatcc

SEQ ID NO: 87366 - DNA, 16 bp, H. sapiens
ctctcctgcctccacc

SEQ ID NO: 87367 - DNA, 16 bp, H. sapiens
ctctcctgctgccctg

SEQ ID NO: 87368 - DNA, 16 bp, H. sapiens
ctctcctgctgtcctg

SEQ ID NO: 87369 - DNA, 16 bp, H. sapiens
ctctcctgcttcagcc

SEQ ID NO: 87370 - DNA, 16 bp, H. sapiens
ctctcctggagctggg

SEQ ID NO: 87371 - DNA, 16 bp, H. sapiens
ctctcctggctttcct

SEQ ID NO: 87372 - DNA, 16 bp, H. sapiens
ctctcctgggctccag

SEQ ID NO: 87373 - DNA, 16 bp, H. sapiens
ctctcctgggttcaag

SEQ ID NO: 87374 - DNA, 16 bp, H. sapiens
ctctccttcccccaag

SEQ ID NO: 87375 - DNA, 16 bp, H. sapiens
ctctccttccctggat

SEQ ID NO: 87376 - DNA, 16 bp, H. sapiens
ctctccttcctgctgc

SEQ ID NO: 87377 - DNA, 16 bp, H. sapiens
ctctccttgctcctca

SEQ ID NO: 87378 - DNA, 16 bp, H. sapiens
ctctcgaactcctgac

SEQ ID NO: 87379 - DNA, 16 bp, H. sapiens
ctctcggaccacagtg

SEQ ID NO: 87380 - DNA, 16 bp, H. sapiens
ctctcggcacctcctc

SEQ ID NO: 87381 - DNA, 16 bp, H. sapiens
ctctcgggcctttggc

SEQ ID NO: 87382 - DNA, 16 bp, H. sapiens
ctctcggtctccctct

SEQ ID NO: 87383 - DNA, 16 bp, H. sapiens
ctctcgtgcctcagcc

SEQ ID NO: 87384 - DNA, 16 bp, H. sapiens
ctctctaacctcatct

SEQ ID NO: 87385 - DNA, 16 bp, H. sapiens
ctctctacttttatga

SEQ ID NO: 87386 - DNA, 16 bp, H. sapiens
ctctctagcccaggct

SEQ ID NO: 87387 - DNA, 16 bp, H. sapiens
ctctctatgtgtatat

SEQ ID NO: 87388 - DNA, 16 bp, H. sapiens
ctctctcaaagaatga

SEQ ID NO: 87389 - DNA, 16 bp, H. sapiens
ctctctcaatctctgt

SEQ ID NO: 87390 - DNA, 16 bp, H. sapiens
ctctctcacacacacc

SEQ ID NO: 87391 - DNA, 16 bp, H. sapiens
ctctctcaccaggctg

SEQ ID NO: 87392 - DNA, 16 bp, H. sapiens
ctctctcaccatgtga

SEQ ID NO: 87393 - DNA, 16 bp, H. sapiens
ctctctcactgctcct

SEQ ID NO: 87394 - DNA, 16 bp, H. sapiens
ctctctcactgtctct

SEQ ID NO: 87395 - DNA, 16 bp, H. sapiens
ctctctcagacacaca

SEQ ID NO: 87396 - DNA, 16 bp, H. sapiens
ctctctcagccaggct

SEQ ID NO: 87397 - DNA, 16 bp, H. sapiens
ctctctcagcctcagt

SEQ ID NO: 87398 - DNA, 16 bp, H. sapiens
ctctctcagtcttcat

SEQ ID NO: 87399 - DNA, 16 bp, H. sapiens
ctctctcattttaaaa

SEQ ID NO: 87400 - DNA, 16 bp, H. sapiens
ctctctccagtcctca

SEQ ID NO: 87401 - DNA, 16 bp, H. sapiens
ctctctccattctctg

SEQ ID NO: 87402 - DNA, 16 bp, H. sapiens
ctctctcccagcccct

SEQ ID NO: 87403 - DNA, 16 bp, H. sapiens
ctctctcccagctgct

SEQ ID NO: 87404 - DNA, 16 bp, H. sapiens
ctctctcccaggtggg

SEQ ID NO: 87405 - DNA, 16 bp, H. sapiens
ctctctccctcactgc

SEQ ID NO: 87406 - DNA, 16 bp, H. sapiens
ctctctccctccagcc

SEQ ID NO: 87407 - DNA, 16 bp, H. sapiens
ctctctccctggctct

SEQ ID NO: 87408 - DNA, 16 bp, H. sapiens
ctctctccctgtctgt

SEQ ID NO: 87409 - DNA, 16 bp, H. sapiens
ctctctcctcaggcct

SEQ ID NO: 87410 - DNA, 16 bp, H. sapiens
ctctctcctcagtctc

SEQ ID NO: 87411 - DNA, 16 bp, H. sapiens
ctctctcctgccaccc

SEQ ID NO: 87412 - DNA, 16 bp, H. sapiens
ctctctcctgctacca

SEQ ID NO: 87413 - DNA, 16 bp, H. sapiens
ctctctcctgctgctc

SEQ ID NO: 87414 - DNA, 16 bp, H. sapiens
ctctctcctggcctgt

SEQ ID NO: 87415 - DNA, 16 bp, H. sapiens
ctctctcctgggctca

SEQ ID NO: 87416 - DNA, 16 bp, H. sapiens
ctctctcctgtcaccc

SEQ ID NO: 87417 - DNA, 16 bp, H. sapiens
ctctctcctgttgcca

SEQ ID NO: 87418 - DNA, 16 bp, H. sapiens
ctctctccttggctca

SEQ ID NO: 87419 - DNA, 16 bp, H. sapiens
ctctctccttggcttg

SEQ ID NO: 87420 - DNA, 16 bp, H. sapiens
ctctctcctttcctgg

SEQ ID NO: 87421 - DNA, 16 bp, H. sapiens
ctctctcctttttaaa

SEQ ID NO: 87422 - DNA, 16 bp, H. sapiens
ctctctcgctcgctct

SEQ ID NO: 87423 - DNA, 16 bp, H. sapiens
ctctctcggtctccat

SEQ ID NO: 87424 - DNA, 16 bp, H. sapiens
ctctctctaaaataaa

SEQ ID NO: 87425 - DNA, 18 bp, H. sapiens
ctctctctatatatatat

SEQ ID NO: 87426 - DNA, 16 bp, H. sapiens
ctctctctcaaaataa

SEQ ID NO: 87427 - DNA, 16 bp, H. sapiens
ctctctctcacaaaca

SEQ ID NO: 87428 - DNA, 16 bp, H. sapiens
ctctctctcactgtct

SEQ ID NO: 87429 - DNA, 16 bp, H. sapiens
ctctctctccagcctc

SEQ ID NO: 87430 - DNA, 16 bp, H. sapiens
ctctctctccagctct

SEQ ID NO: 87431 - DNA, 16 bp, H. sapiens
ctctctctcctgcaga

SEQ ID NO: 87432 - DNA, 16 bp, H. sapiens
ctctctctcctgcagc

SEQ ID NO: 87433 - DNA, 16 bp, H. sapiens
ctctctctcctgccag

SEQ ID NO: 87434 - DNA, 16 bp, H. sapiens
ctctctctcctggagc

SEQ ID NO: 87435 - DNA, 16 bp, H. sapiens
ctctctctctcatgca

SEQ ID NO: 87436 - DNA, 16 bp, H. sapiens
ctctctctctccagca

SEQ ID NO: 87437 - DNA, 16 bp, H. sapiens
ctctctctctcgctcg

SEQ ID NO: 87438 - DNA, 16 bp, H. sapiens
ctctctctctctagag

SEQ ID NO: 87439 - DNA, 16 bp, H. sapiens
ctctctctctctatta

SEQ ID NO: 87440 - DNA, 16 bp, H. sapiens
ctctctctctctgaat

SEQ ID NO: 87441 - DNA, 16 bp, H. sapiens
ctctctctctctgtgc

SEQ ID NO: 87442 - DNA, 16 bp, H. sapiens
ctctctctctgctgcc

SEQ ID NO: 87443 - DNA, 16 bp, H. sapiens
ctctctctctgtcctg

SEQ ID NO: 87444 - DNA, 16 bp, H. sapiens
ctctctctctgtgtct

SEQ ID NO: 87445 - DNA, 16 bp, H. sapiens
ctctctctgaccttct

SEQ ID NO: 87446 - DNA, 16 bp, H. sapiens
ctctctctgccaccca

SEQ ID NO: 87447 - DNA, 16 bp, H. sapiens
ctctctctgccccacc

SEQ ID NO: 87448 - DNA, 16 bp, H. sapiens
ctctctctgcccttgg

SEQ ID NO: 87449 - DNA, 16 bp, H. sapiens
ctctctctgggcctca

SEQ ID NO: 87450 - DNA, 16 bp, H. sapiens
ctctctctgtcacaca

SEQ ID NO: 87451 - DNA, 16 bp, H. sapiens
ctctctctgtccctgt

SEQ ID NO: 87452 - DNA, 16 bp, H. sapiens
ctctctctgtgtgtct

SEQ ID NO: 87453 - DNA, 16 bp, H. sapiens
ctctctctgttctctg

SEQ ID NO: 87454 - DNA, 16 bp, H. sapiens
ctctctctgtttttta

SEQ ID NO: 87455 - DNA, 16 bp, H. sapiens
ctctctcttcctggct

SEQ ID NO: 87456 - DNA, 16 bp, H. sapiens
ctctctcttgctgcct

SEQ ID NO: 87457 - DNA, 16 bp, H. sapiens
ctctctctttttaaaa

SEQ ID NO: 87458 - DNA, 16 bp, H. sapiens
ctctctgacctcctcc

SEQ ID NO: 87459 - DNA, 16 bp, H. sapiens
ctctctgacctctcct

SEQ ID NO: 87460 - DNA, 16 bp, H. sapiens
ctctctgaccttttcc

SEQ ID NO: 87461 - DNA, 16 bp, H. sapiens
ctctctgagaactgga

SEQ ID NO: 87462 - DNA, 16 bp, H. sapiens
ctctctgagcctctgt

SEQ ID NO: 87463 - DNA, 16 bp, H. sapiens
ctctctgagcttcagt

SEQ ID NO: 87464 - DNA, 16 bp, H. sapiens
ctctctgagcttcctt

SEQ ID NO: 87465 - DNA, 16 bp, H. sapiens
ctctctgagcttgttt

SEQ ID NO: 87466 - DNA, 16 bp, H. sapiens
ctctctgatgtctctt

SEQ ID NO: 87467 - DNA, 16 bp, H. sapiens
ctctctgcagcctccc

SEQ ID NO: 87468 - DNA, 16 bp, H. sapiens
ctctctgcagcctctg

SEQ ID NO: 87469 - DNA, 16 bp, H. sapiens
ctctctgcagctggtc

SEQ ID NO: 87470 - DNA, 16 bp, H. sapiens
ctctctgccacccagg

SEQ ID NO: 87471 - DNA, 16 bp, H. sapiens
ctctctgccatctccc

SEQ ID NO: 87472 - DNA, 16 bp, H. sapiens
ctctctgccctcatct

SEQ ID NO: 87473 - DNA, 16 bp, H. sapiens
ctctctgcctcagtct

SEQ ID NO: 87474 - DNA, 16 bp, H. sapiens
ctctctgcctcagttt

SEQ ID NO: 87475 - DNA, 16 bp, H. sapiens
ctctctgcctccagcc

SEQ ID NO: 87476 - DNA, 16 bp, H. sapiens
ctctctgcctctctgc

SEQ ID NO: 87477 - DNA, 16 bp, H. sapiens
ctctctgcctgccctt

SEQ ID NO: 87478 - DNA, 16 bp, H. sapiens
ctctctgcctgcttcc

SEQ ID NO: 87479 - DNA, 16 bp, H. sapiens
ctctctgcctgtctct

SEQ ID NO: 87480 - DNA, 16 bp, H. sapiens
ctctctgcctgtgtct

SEQ ID NO: 87481 - DNA, 16 bp, H. sapiens
ctctctgccttctgcc

SEQ ID NO: 87482 - DNA, 16 bp, H. sapiens
ctctctgctaggagct

SEQ ID NO: 87483 - DNA, 16 bp, H. sapiens
ctctctgctgctgctg

SEQ ID NO: 87484 - DNA, 16 bp, H. sapiens
ctctctgcttgtctgt

SEQ ID NO: 87485 - DNA, 16 bp, H. sapiens
ctctctggagtctctt

SEQ ID NO: 87486 - DNA, 16 bp, H. sapiens
ctctctggctgccgtt

SEQ ID NO: 87487 - DNA, 16 bp, H. sapiens
ctctctggctgctcct

SEQ ID NO: 87488 - DNA, 16 bp, H. sapiens
ctctctggcttcccct

SEQ ID NO: 87489 - DNA, 16 bp, H. sapiens
ctctctggcttcctct

SEQ ID NO: 87490 - DNA, 16 bp, H. sapiens
ctctctgggacagagc

SEQ ID NO: 87491 - DNA, 16 bp, H. sapiens
ctctctgggagctgca

SEQ ID NO: 87492 - DNA, 16 bp, H. sapiens
ctctctgggcctcatt

SEQ ID NO: 87493 - DNA, 16 bp, H. sapiens
ctctctgggcctttgt

SEQ ID NO: 87494 - DNA, 16 bp, H. sapiens
ctctctgggcttcagc

SEQ ID NO: 87495 - DNA, 16 bp, H. sapiens
ctctctgggcttctgt

SEQ ID NO: 87496 - DNA, 16 bp, H. sapiens
ctctctgggcttggca

SEQ ID NO: 87497 - DNA, 16 bp, H. sapiens
ctctctggggtgtcct

SEQ ID NO: 87498 - DNA, 16 bp, H. sapiens
ctctctggtagctggg

SEQ ID NO: 87499 - DNA, 16 bp, H. sapiens
ctctctggtcctggac

SEQ ID NO: 87500 - DNA, 16 bp, H. sapiens
ctctctgtcaccctgg

SEQ ID NO: 87501 - DNA, 16 bp, H. sapiens
ctctctgtccccaccc

SEQ ID NO: 87502 - DNA, 16 bp, H. sapiens
ctctctgtctccaggc

SEQ ID NO: 87503 - DNA, 16 bp, H. sapiens
ctctctgtctctctca

SEQ ID NO: 87504 - DNA, 16 bp, H. sapiens
ctctctgtctctgact

SEQ ID NO: 87505 - DNA, 16 bp, H. sapiens
ctctctgtctgtctct

SEQ ID NO: 87506 - DNA, 16 bp, H. sapiens
ctctctgtctgttgtt

SEQ ID NO: 87507 - DNA, 16 bp, H. sapiens
ctctctgtgcctcggt

SEQ ID NO: 87508 - DNA, 16 bp, H. sapiens
ctctctgtgcctgagt

SEQ ID NO: 87509 - DNA, 16 bp, H. sapiens
ctctctgtgccttgat

SEQ ID NO: 87510 - DNA, 16 bp, H. sapiens
ctctctgtgctgagcc

SEQ ID NO: 87511 - DNA, 16 bp, H. sapiens
ctctctgtgcttcagc

SEQ ID NO: 87512 - DNA, 16 bp, H. sapiens
ctctctgtgtctctct

SEQ ID NO: 87513 - DNA, 16 bp, H. sapiens
ctctctgttgcccaag

SEQ ID NO: 87514 - DNA, 16 bp, H. sapiens
ctctctgttgcctcag

SEQ ID NO: 87515 - DNA, 16 bp, H. sapiens
ctctctgtttctatga

SEQ ID NO: 87516 - DNA, 16 bp, H. sapiens
ctctctgtttgcctgc

SEQ ID NO: 87517 - DNA, 16 bp, H. sapiens
ctctctgtttgttatt

SEQ ID NO: 87518 - DNA, 16 bp, H. sapiens
ctctcttcacagatga

SEQ ID NO: 87519 - DNA, 16 bp, H. sapiens
ctctcttctcctcaag

SEQ ID NO: 87520 - DNA, 16 bp, H. sapiens
ctctcttctggcctgt

SEQ ID NO: 87521 - DNA, 16 bp, H. sapiens
ctctcttctggcttct

SEQ ID NO: 87522 - DNA, 16 bp, H. sapiens
ctctcttgcactctct

SEQ ID NO: 87523 - DNA, 16 bp, H. sapiens
ctctcttgctccctgt

SEQ ID NO: 87524 - DNA, 16 bp, H. sapiens
ctctctttcattcctg

SEQ ID NO: 87525 - DNA, 16 bp, H. sapiens
ctctctttgaccttca

SEQ ID NO: 87526 - DNA, 16 bp, H. sapiens
ctctctttgctcctca

SEQ ID NO: 87527 - DNA, 16 bp, H. sapiens
ctctctttgctttcac

SEQ ID NO: 87528 - DNA, 16 bp, H. sapiens
ctctctttgtactgtc

SEQ ID NO: 87529 - DNA, 16 bp, H. sapiens
ctctctttttgtaaaa

SEQ ID NO: 87530 - DNA, 16 bp, H. sapiens
ctctcttttttgagat

SEQ ID NO: 87531 - DNA, 16 bp, H. sapiens
ctctgaaaaaagaaaa

SEQ ID NO: 87532 - DNA, 16 bp, H. sapiens
ctctgaaaaaataaat

SEQ ID NO: 87533 - DNA, 16 bp, H. sapiens
ctctgaaaaaattaaa

SEQ ID NO: 87534 - DNA, 16 bp, H. sapiens
ctctgaaaaatatttt

SEQ ID NO: 87535 - DNA, 16 bp, H. sapiens
ctctgaaaagaagaaa

SEQ ID NO: 87536 - DNA, 16 bp, H. sapiens
ctctgaaattgaggaa

SEQ ID NO: 87537 - DNA, 16 bp, H. sapiens
ctctgaacctcagttt

SEQ ID NO: 87538 - DNA, 16 bp, H. sapiens
ctctgaaccttagttt

SEQ ID NO: 87539 - DNA, 16 bp, H. sapiens
ctctgaagagagcaat

SEQ ID NO: 87540 - DNA, 16 bp, H. sapiens
ctctgaagagagcaga

SEQ ID NO: 87541 - DNA, 16 bp, H. sapiens
ctctgaagcaacagct

SEQ ID NO: 87542 - DNA, 16 bp, H. sapiens
ctctgaagccacagcc

SEQ ID NO: 87543 - DNA, 16 bp, H. sapiens
ctctgaagtcacagcc

SEQ ID NO: 87544 - DNA, 16 bp, H. sapiens
ctctgaatttgcctat

SEQ ID NO: 87545 - DNA, 16 bp, H. sapiens
ctctgaatttttaaaa

SEQ ID NO: 87546 - DNA, 16 bp, H. sapiens
ctctgacaaaacagac

SEQ ID NO: 87547 - DNA, 16 bp, H. sapiens
ctctgacacttactag

SEQ ID NO: 87548 - DNA, 16 bp, H. sapiens
ctctgaccccacctcc

SEQ ID NO: 87549 - DNA, 16 bp, H. sapiens
ctctgacccctgaccc

SEQ ID NO: 87550 - DNA, 16 bp, H. sapiens
ctctgacctaccttgt

SEQ ID NO: 87551 - DNA, 16 bp, H. sapiens
ctctgacctctgcctc

SEQ ID NO: 87552 - DNA, 16 bp, H. sapiens
ctctgacctctgcttc

SEQ ID NO: 87553 - DNA, 16 bp, H. sapiens
ctctgacctcttcttc

SEQ ID NO: 87554 - DNA, 16 bp, H. sapiens
ctctgacctgcttcct

SEQ ID NO: 87555 - DNA, 16 bp, H. sapiens
ctctgactcccaggct

SEQ ID NO: 87556 - DNA, 16 bp, H. sapiens
ctctgactccctcttt

SEQ ID NO: 87557 - DNA, 16 bp, H. sapiens
ctctgactctgtcttc

SEQ ID NO: 87558 - DNA, 16 bp, H. sapiens
ctctgacttcagcctc

SEQ ID NO: 87559 - DNA, 16 bp, H. sapiens
ctctgactttgttctt

SEQ ID NO: 87560 - DNA, 16 bp, H. sapiens
ctctgagaaagaaaaa

SEQ ID NO: 87561 - DNA, 16 bp, H. sapiens
ctctgagaaggtgaca

SEQ ID NO: 87562 - DNA, 16 bp, H. sapiens
ctctgagactcagttt

SEQ ID NO: 87563 - DNA, 16 bp, H. sapiens
ctctgagaggctgggc

SEQ ID NO: 87564 - DNA, 16 bp, H. sapiens
ctctgagatggagttt

SEQ ID NO: 87565 - DNA, 16 bp, H. sapiens
ctctgagcccagcaca

SEQ ID NO: 87566 - DNA, 16 bp, H. sapiens
ctctgagcctcacttt

SEQ ID NO: 87567 - DNA, 16 bp, H. sapiens
ctctgagcctcagctg

SEQ ID NO: 87568 - DNA, 16 bp, H. sapiens
ctctgagcctcagctt

SEQ ID NO: 87569 - DNA, 16 bp, H. sapiens
ctctgagcctcaggtt

SEQ ID NO: 87570 - DNA, 16 bp, H. sapiens
ctctgagcctcagttt

SEQ ID NO: 87571 - DNA, 16 bp, H. sapiens
ctctgagccttacttt

SEQ ID NO: 87572 - DNA, 16 bp, H. sapiens
ctctgagccttgattt

SEQ ID NO: 87573 - DNA, 16 bp, H. sapiens
ctctgagccttgcttt

SEQ ID NO: 87574 - DNA, 16 bp, H. sapiens
ctctgagccttggctt

SEQ ID NO: 87575 - DNA, 16 bp, H. sapiens
ctctgagccttggtgt

SEQ ID NO: 87576 - DNA, 16 bp, H. sapiens
ctctgagccttggttt

SEQ ID NO: 87577 - DNA, 16 bp, H. sapiens
ctctgagctaaagaag

SEQ ID NO: 87578 - DNA, 16 bp, H. sapiens
ctctgagctatgggag

SEQ ID NO: 87579 - DNA, 16 bp, H. sapiens
ctctgagctgttctgt

SEQ ID NO: 87580 - DNA, 16 bp, H. sapiens
ctctgagcttcaggtt

SEQ ID NO: 87581 - DNA, 16 bp, H. sapiens
ctctgagcttcagttt

SEQ ID NO: 87582 - DNA, 16 bp, H. sapiens
ctctgagctttctgga

SEQ ID NO: 87583 - DNA, 16 bp, H. sapiens
ctctgagctttggttt

SEQ ID NO: 87584 - DNA, 16 bp, H. sapiens
ctctgagggaagccag

SEQ ID NO: 87585 - DNA, 16 bp, H. sapiens
ctctgagggcagggac

SEQ ID NO: 87586 - DNA, 16 bp, H. sapiens
ctctgagggcttcctg

SEQ ID NO: 87587 - DNA, 17 bp, H. sapiens
ctctgaggtcaggagtt

SEQ ID NO: 87588 - DNA, 16 bp, H. sapiens
ctctgagtccattctt

SEQ ID NO: 87589 - DNA, 16 bp, H. sapiens
ctctgagtcctttgaa

SEQ ID NO: 87590 - DNA, 16 bp, H. sapiens
ctctgagtctcagctt

SEQ ID NO: 87591 - DNA, 16 bp, H. sapiens
ctctgagtctcagttt

SEQ ID NO: 87592 - DNA, 16 bp, H. sapiens
ctctgagtgtggggcc

SEQ ID NO: 87593 - DNA, 16 bp, H. sapiens
ctctgagtgtgtgtgt

SEQ ID NO: 87594 - DNA, 16 bp, H. sapiens
ctctgagttttaaaaa

SEQ ID NO: 87595 - DNA, 16 bp, H. sapiens
ctctgatctttatttt

SEQ ID NO: 87596 - DNA, 17 bp, H. sapiens
ctctgatggtcagtgat

SEQ ID NO: 87597 - DNA, 16 bp, H. sapiens
ctctgatggttagtga

SEQ ID NO: 87598 - DNA, 16 bp, H. sapiens
ctctgattattattat

SEQ ID NO: 87599 - DNA, 16 bp, H. sapiens
ctctgattccaaagcc

SEQ ID NO: 87600 - DNA, 16 bp, H. sapiens
ctctgatttggcatct

SEQ ID NO: 87601 - DNA, 16 bp, H. sapiens
ctctgatttggtgtct

SEQ ID NO: 87602 - DNA, 16 bp, H. sapiens
ctctgattttcagttt

SEQ ID NO: 87603 - DNA, 16 bp, H. sapiens
ctctgattttggtttt

SEQ ID NO: 87604 - DNA, 16 bp, H. sapiens
ctctgatttttccttt

SEQ ID NO: 87605 - DNA, 16 bp, H. sapiens
ctctgcaaggagaact

SEQ ID NO: 87606 - DNA, 19 bp, H. sapiens
ctctgcacagcaaaagaaa

SEQ ID NO: 87607 - DNA, 16 bp, H. sapiens
ctctgcagaactgtga

SEQ ID NO: 87608 - DNA, 16 bp, H. sapiens
ctctgcagccagagtg

SEQ ID NO: 87609 - DNA, 16 bp, H. sapiens
ctctgcagcccaggct

SEQ ID NO: 87610 - DNA, 16 bp, H. sapiens
ctctgcagccccagcc

SEQ ID NO: 87611 - DNA, 16 bp, H. sapiens
ctctgcagcctcacca

SEQ ID NO: 87612 - DNA, 16 bp, H. sapiens
ctctgcagcctggccc

SEQ ID NO: 87613 - DNA, 16 bp, H. sapiens
ctctgcaggatatcat

SEQ ID NO: 87614 - DNA, 16 bp, H. sapiens
ctctgcaggatgttat

SEQ ID NO: 87615 - DNA, 16 bp, H. sapiens
ctctgcagtctcacca

SEQ ID NO: 87616 - DNA, 16 bp, H. sapiens
ctctgcagttcctggt

SEQ ID NO: 87617 - DNA, 16 bp, H. sapiens
ctctgcatcccagcca

SEQ ID NO: 87618 - DNA, 16 bp, H. sapiens
ctctgcatcctcacca

SEQ ID NO: 87619 - DNA, 16 bp, H. sapiens
ctctgcatctttgcca

SEQ ID NO: 87620 - DNA, 16 bp, H. sapiens
ctctgcattcccctcc

SEQ ID NO: 87621 - DNA, 16 bp, H. sapiens
ctctgccaaaaatata

SEQ ID NO: 87622 - DNA, 16 bp, H. sapiens
ctctgccacagctcca

SEQ ID NO: 87623 - DNA, 16 bp, H. sapiens
ctctgccacccatgct

SEQ ID NO: 87624 - DNA, 16 bp, H. sapiens
ctctgccacctcccag

SEQ ID NO: 87625 - DNA, 16 bp, H. sapiens
ctctgccacttactga

SEQ ID NO: 87626 - DNA, 16 bp, H. sapiens
ctctgccagcaccttg

SEQ ID NO: 87627 - DNA, 16 bp, H. sapiens
ctctgccaggccagcc

SEQ ID NO: 87628 - DNA, 16 bp, H. sapiens
ctctgccaggccctgg

SEQ ID NO: 87629 - DNA, 16 bp, H. sapiens
ctctgccaggccgccc

SEQ ID NO: 87630 - DNA, 16 bp, H. sapiens
ctctgccagggcagtg

SEQ ID NO: 87631 - DNA, 16 bp, H. sapiens
ctctgccagtggagcc

SEQ ID NO: 87632 - DNA, 16 bp, H. sapiens
ctctgccagtttttgg

SEQ ID NO: 87633 - DNA, 16 bp, H. sapiens
ctctgccatggccctg

SEQ ID NO: 87634 - DNA, 16 bp, H. sapiens
ctctgcccaccccaca

SEQ ID NO: 87635 - DNA, 16 bp, H. sapiens
ctctgcccagatttca

SEQ ID NO: 87636 - DNA, 16 bp, H. sapiens
ctctgcccagcagcca

SEQ ID NO: 87637 - DNA, 16 bp, H. sapiens
ctctgcccagccacca

SEQ ID NO: 87638 - DNA, 16 bp, H. sapiens
ctctgcccagccagcc

SEQ ID NO: 87639 - DNA, 16 bp, H. sapiens
ctctgcccagcccagc

SEQ ID NO: 87640 - DNA, 16 bp, H. sapiens
ctctgcccagcccctg

SEQ ID NO: 87641 - DNA, 16 bp, H. sapiens
ctctgcccagccgccc

SEQ ID NO: 87642 - DNA, 16 bp, H. sapiens
ctctgcccagtttgaa

SEQ ID NO: 87643 - DNA, 16 bp, H. sapiens
ctctgccccagcccag

SEQ ID NO: 87644 - DNA, 16 bp, H. sapiens
ctctgccccagccctg

SEQ ID NO: 87645 - DNA, 16 bp, H. sapiens
ctctgccccagctctg

SEQ ID NO: 87646 - DNA, 16 bp, H. sapiens
ctctgccccaggcctg

SEQ ID NO: 87647 - DNA, 16 bp, H. sapiens
ctctgcccccagcctc

SEQ ID NO: 87648 - DNA, 16 bp, H. sapiens
ctctgcccccaggctg

SEQ ID NO: 87649 - DNA, 16 bp, H. sapiens
ctctgcccctccctgg

SEQ ID NO: 87650 - DNA, 16 bp, H. sapiens
ctctgccccttcccca

SEQ ID NO: 87651 - DNA, 16 bp, H. sapiens
ctctgcccggccgcca

SEQ ID NO: 87652 - DNA, 16 bp, H. sapiens
ctctgccctcagggag

SEQ ID NO: 87653 - DNA, 16 bp, H. sapiens
ctctgccctccagcct

SEQ ID NO: 87654 - DNA, 16 bp, H. sapiens
ctctgccctccccaca

SEQ ID NO: 87655 - DNA, 16 bp, H. sapiens
ctctgccctgcccctg

SEQ ID NO: 87656 - DNA, 16 bp, H. sapiens
ctctgccctgccctgg

SEQ ID NO: 87657 - DNA, 16 bp, H. sapiens
ctctgccctgctgccc

SEQ ID NO: 87658 - DNA, 16 bp, H. sapiens
ctctgcccttccccca

SEQ ID NO: 87659 - DNA, 16 bp, H. sapiens
ctctgcccttgcagaa

SEQ ID NO: 87660 - DNA, 16 bp, H. sapiens
ctctgccgcccaggct

SEQ ID NO: 87661 - DNA, 16 bp, H. sapiens
ctctgcctatggagca

SEQ ID NO: 87662 - DNA, 16 bp, H. sapiens
ctctgcctcagcctcc

SEQ ID NO: 87663 - DNA, 16 bp, H. sapiens
ctctgcctcagcttct

SEQ ID NO: 87664 - DNA, 16 bp, H. sapiens
ctctgcctcagtttcc

SEQ ID NO: 87665 - DNA, 16 bp, H. sapiens
ctctgcctcatctttc

SEQ ID NO: 87666 - DNA, 16 bp, H. sapiens
ctctgcctcattttcc

SEQ ID NO: 87667 - DNA, 16 bp, H. sapiens
ctctgcctccaaggct

SEQ ID NO: 87668 - DNA, 16 bp, H. sapiens
ctctgcctccaagttc

SEQ ID NO: 87669 - DNA, 16 bp, H. sapiens
ctctgcctccacctcc

SEQ ID NO: 87670 - DNA, 16 bp, H. sapiens
ctctgcctccagggct

SEQ ID NO: 87671 - DNA, 16 bp, H. sapiens
ctctgcctccatcatc

SEQ ID NO: 87672 - DNA, 16 bp, H. sapiens
ctctgcctccatcttc

SEQ ID NO: 87673 - DNA, 16 bp, H. sapiens
ctctgcctcccactcc

SEQ ID NO: 87674 - DNA, 16 bp, H. sapiens
ctctgcctcccgggct

SEQ ID NO: 87675 - DNA, 16 bp, H. sapiens
ctctgcctcccgggtg

SEQ ID NO: 87676 - DNA, 16 bp, H. sapiens
ctctgcctcccggttc

SEQ ID NO: 87677 - DNA, 16 bp, H. sapiens
ctctgcctccctaagt

SEQ ID NO: 87678 - DNA, 16 bp, H. sapiens
ctctgcctccctgaga

SEQ ID NO: 87679 - DNA, 16 bp, H. sapiens
ctctgcctccctgcaa

SEQ ID NO: 87680 - DNA, 16 bp, H. sapiens
ctctgcctccctggcc

SEQ ID NO: 87681 - DNA, 16 bp, H. sapiens
ctctgcctccctggct

SEQ ID NO: 87682 - DNA, 16 bp, H. sapiens
ctctgcctcctaagtt

SEQ ID NO: 87683 - DNA, 16 bp, H. sapiens
ctctgcctcctcacca

SEQ ID NO: 87684 - DNA, 16 bp, H. sapiens
ctctgcctcctcagct

SEQ ID NO: 87685 - DNA, 16 bp, H. sapiens
ctctgcctcctcccac

SEQ ID NO: 87686 - DNA, 16 bp, H. sapiens
ctctgcctcctcccca

SEQ ID NO: 87687 - DNA, 16 bp, H. sapiens
ctctgcctcctcctgg

SEQ ID NO: 87688 - DNA, 16 bp, H. sapiens
ctctgcctcctgccag

SEQ ID NO: 87689 - DNA, 16 bp, H. sapiens
ctctgcctcctggttt

SEQ ID NO: 87690 - DNA, 16 bp, H. sapiens
ctctgcctcctgtcct

SEQ ID NO: 87691 - DNA, 16 bp, H. sapiens
ctctgcctcctgtgct

SEQ ID NO: 87692 - DNA, 16 bp, H. sapiens
ctctgcctctcacagc

SEQ ID NO: 87693 - DNA, 16 bp, H. sapiens
ctctgcctctcaggct

SEQ ID NO: 87694 - DNA, 16 bp, H. sapiens
ctctgcctctctcatg

SEQ ID NO: 87695 - DNA, 16 bp, H. sapiens
ctctgcctctgcctct

SEQ ID NO: 87696 - DNA, 16 bp, H. sapiens
ctctgcctctggagtt

SEQ ID NO: 87697 - DNA, 16 bp, H. sapiens
ctctgcctctggctcc

SEQ ID NO: 87698 - DNA, 16 bp, H. sapiens
ctctgcctctgggatt

SEQ ID NO: 87699 - DNA, 16 bp, H. sapiens
ctctgcctctgtcctc

SEQ ID NO: 87700 - DNA, 16 bp, H. sapiens
ctctgcctctgtctcc

SEQ ID NO: 87701 - DNA, 16 bp, H. sapiens
ctctgcctcttcctgg

SEQ ID NO: 87702 - DNA, 16 bp, H. sapiens
ctctgcctcttgtcag

SEQ ID NO: 87703 - DNA, 16 bp, H. sapiens
ctctgcctgcagcctc

SEQ ID NO: 87704 - DNA, 16 bp, H. sapiens
ctctgcctgccaaagt

SEQ ID NO: 87705 - DNA, 16 bp, H. sapiens
ctctgcctgcccccac

SEQ ID NO: 87706 - DNA, 16 bp, H. sapiens
ctctgcctgccctgcc

SEQ ID NO: 87707 - DNA, 16 bp, H. sapiens
ctctgcctgctgggct

SEQ ID NO: 87708 - DNA, 16 bp, H. sapiens
ctctgcctggaaaact

SEQ ID NO: 87709 - DNA, 16 bp, H. sapiens
ctctgcctggagcact

SEQ ID NO: 87710 - DNA, 16 bp, H. sapiens
ctctgcctggccactg

SEQ ID NO: 87711 - DNA, 16 bp, H. sapiens
ctctgcctggccctgc

SEQ ID NO: 87712 - DNA, 16 bp, H. sapiens
ctctgcctggccgccc

SEQ ID NO: 87713 - DNA, 16 bp, H. sapiens
ctctgcctgggcctca

SEQ ID NO: 87714 - DNA, 16 bp, H. sapiens
ctctgcctgtctgtct

SEQ ID NO: 87715 - DNA, 16 bp, H. sapiens
ctctgcctgttcatcc

SEQ ID NO: 87716 - DNA, 16 bp, H. sapiens
ctctgccttcccacct

SEQ ID NO: 87717 - DNA, 16 bp, H. sapiens
ctctgccttcccaggt

SEQ ID NO: 87718 - DNA, 16 bp, H. sapiens
ctctgccttccccagc

SEQ ID NO: 87719 - DNA, 16 bp, H. sapiens
ctctgccttccgggtt

SEQ ID NO: 87720 - DNA, 16 bp, H. sapiens
ctctgccttctaggtt

SEQ ID NO: 87721 - DNA, 16 bp, H. sapiens
ctctgccttctcccac

SEQ ID NO: 87722 - DNA, 16 bp, H. sapiens
ctctgccttctgctct

SEQ ID NO: 87723 - DNA, 16 bp, H. sapiens
ctctgccttctggact

SEQ ID NO: 87724 - DNA, 16 bp, H. sapiens
ctctgccttctggctt

SEQ ID NO: 87725 - DNA, 16 bp, H. sapiens
ctctgcctttcgggtt

SEQ ID NO: 87726 - DNA, 16 bp, H. sapiens
ctctgcctttctgcaa

SEQ ID NO: 87727 - DNA, 16 bp, H. sapiens
ctctgcctttgccttc

SEQ ID NO: 87728 - DNA, 16 bp, H. sapiens
ctctgcgcctgcgccg

SEQ ID NO: 87729 - DNA, 16 bp, H. sapiens
ctctgcgtccccaccc

SEQ ID NO: 87730 - DNA, 16 bp, H. sapiens
ctctgctaaaaatacc

SEQ ID NO: 87731 - DNA, 16 bp, H. sapiens
ctctgctagagcagtg

SEQ ID NO: 87732 - DNA, 16 bp, H. sapiens
ctctgctcaaaaccct

SEQ ID NO: 87733 - DNA, 16 bp, H. sapiens
ctctgctcactgcagc

SEQ ID NO: 87734 - DNA, 16 bp, H. sapiens
ctctgctcagccctgg

SEQ ID NO: 87735 - DNA, 16 bp, H. sapiens
ctctgctcagggtctc

SEQ ID NO: 87736 - DNA, 16 bp, H. sapiens
ctctgctcccagcctc

SEQ ID NO: 87737 - DNA, 16 bp, H. sapiens
ctctgctccccaggct

SEQ ID NO: 87738 - DNA, 16 bp, H. sapiens
ctctgctccctgcatt

SEQ ID NO: 87739 - DNA, 16 bp, H. sapiens
ctctgctcctccccac

SEQ ID NO: 87740 - DNA, 16 bp, H. sapiens
ctctgctcctctgcca

SEQ ID NO: 87741 - DNA, 16 bp, H. sapiens
ctctgctcctctgcct

SEQ ID NO: 87742 - DNA, 16 bp, H. sapiens
ctctgctcctgctcct

SEQ ID NO: 87743 - DNA, 16 bp, H. sapiens
ctctgctctctccctg

SEQ ID NO: 87744 - DNA, 16 bp, H. sapiens
ctctgctctgcctcct

SEQ ID NO: 87745 - DNA, 16 bp, H. sapiens
ctctgctctgctctgg

SEQ ID NO: 87746 - DNA, 16 bp, H. sapiens
ctctgctctgtgcagc

SEQ ID NO: 87747 - DNA, 16 bp, H. sapiens
ctctgctcttctggaa

SEQ ID NO: 87748 - DNA, 16 bp, H. sapiens
ctctgctgacaccttg

SEQ ID NO: 87749 - DNA, 16 bp, H. sapiens
ctctgctgactgtttc

SEQ ID NO: 87750 - DNA, 16 bp, H. sapiens
ctctgctgaggtcact

SEQ ID NO: 87751 - DNA, 16 bp, H. sapiens
ctctgctgaggtcatc

SEQ ID NO: 87752 - DNA, 16 bp, H. sapiens
ctctgctgcacagaag

SEQ ID NO: 87753 - DNA, 16 bp, H. sapiens
ctctgctgcacaggct

SEQ ID NO: 87754 - DNA, 16 bp, H. sapiens
ctctgctgcagccaca

SEQ ID NO: 87755 - DNA, 16 bp, H. sapiens
ctctgctgccccctgc

SEQ ID NO: 87756 - DNA, 16 bp, H. sapiens
ctctgctgcctcagcc

SEQ ID NO: 87757 - DNA, 16 bp, H. sapiens
ctctgctgcttcctgg

SEQ ID NO: 87758 - DNA, 16 bp, H. sapiens
ctctgctgtgctgcct

SEQ ID NO: 87759 - DNA, 16 bp, H. sapiens
ctctgctgttgtagtg

SEQ ID NO: 87760 - DNA, 16 bp, H. sapiens
ctctgcttcaaagatg

SEQ ID NO: 87761 - DNA, 16 bp, H. sapiens
ctctgcttcagggtct

SEQ ID NO: 87762 - DNA, 16 bp, H. sapiens
ctctgcttccaggttc

SEQ ID NO: 87763 - DNA, 16 bp, H. sapiens
ctctgcttccattgtc

SEQ ID NO: 87764 - DNA, 16 bp, H. sapiens
ctctgcttctacaaga

SEQ ID NO: 87765 - DNA, 16 bp, H. sapiens
ctctgcttctctctgt

SEQ ID NO: 87766 - DNA, 16 bp, H. sapiens
ctctgcttctctgtgt

SEQ ID NO: 87767 - DNA, 16 bp, H. sapiens
ctctgcttcttgggag

SEQ ID NO: 87768 - DNA, 16 bp, H. sapiens
ctctgctttccgggtt

SEQ ID NO: 87769 - DNA, 16 bp, H. sapiens
ctctggaaaactccac

SEQ ID NO: 87770 - DNA, 16 bp, H. sapiens
ctctggaaaatatttt

SEQ ID NO: 87771 - DNA, 16 bp, H. sapiens
ctctggaaaattccac

SEQ ID NO: 87772 - DNA, 16 bp, H. sapiens
ctctggaaacctctgt

SEQ ID NO: 87773 - DNA, 16 bp, H. sapiens
ctctggaaagccttcc

SEQ ID NO: 87774 - DNA, 16 bp, H. sapiens
ctctggaacataaccc

SEQ ID NO: 87775 - DNA, 16 bp, H. sapiens
ctctggaagctgagac

SEQ ID NO: 87776 - DNA, 16 bp, H. sapiens
ctctggaatgaggatc

SEQ ID NO: 87777 - DNA, 16 bp, H. sapiens
ctctggacatttcata

SEQ ID NO: 87778 - DNA, 16 bp, H. sapiens
ctctggacccacctgg

SEQ ID NO: 87779 - DNA, 16 bp, H. sapiens
ctctggacctcagttt

SEQ ID NO: 87780 - DNA, 16 bp, H. sapiens
ctctggaccttggttt

SEQ ID NO: 87781 - DNA, 16 bp, H. sapiens
ctctggacgctgaggc

SEQ ID NO: 87782 - DNA, 16 bp, H. sapiens
ctctggacttgcctcc

SEQ ID NO: 87783 - DNA, 16 bp, H. sapiens
ctctggagaaccctga

SEQ ID NO: 87784 - DNA, 16 bp, H. sapiens
ctctggagagccctga

SEQ ID NO: 87785 - DNA, 16 bp, H. sapiens
ctctggagccagaatg

SEQ ID NO: 87786 - DNA, 16 bp, H. sapiens
ctctggagccagactg

SEQ ID NO: 87787 - DNA, 16 bp, H. sapiens
ctctggagccagcctg

SEQ ID NO: 87788 - DNA, 16 bp, H. sapiens
ctctggaggagaagag

SEQ ID NO: 87789 - DNA, 16 bp, H. sapiens
ctctggaggcagacag

SEQ ID NO: 87790 - DNA, 16 bp, H. sapiens
ctctggaggcagggct

SEQ ID NO: 87791 - DNA, 16 bp, H. sapiens
ctctggaggccaggag

SEQ ID NO: 87792 - DNA, 16 bp, H. sapiens
ctctggaggctcaggc

SEQ ID NO: 87793 - DNA, 16 bp, H. sapiens
ctctggaggctgagaa

SEQ ID NO: 87794 - DNA, 16 bp, H. sapiens
ctctggaggctgagtc

SEQ ID NO: 87795 - DNA, 16 bp, H. sapiens
ctctggaggctgagtt

SEQ ID NO: 87796 - DNA, 16 bp, H. sapiens
ctctggaggctgggaa

SEQ ID NO: 87797 - DNA, 16 bp, H. sapiens
ctctggagtcagactg

SEQ ID NO: 87798 - DNA, 16 bp, H. sapiens
ctctggagtctgaggt

SEQ ID NO: 87799 - DNA, 16 bp, H. sapiens
ctctggagtttgagac

SEQ ID NO: 87800 - DNA, 16 bp, H. sapiens
ctctggatttcctgaa

SEQ ID NO: 87801 - DNA, 16 bp, H. sapiens
ctctggcactggctaa

SEQ ID NO: 87802 - DNA, 16 bp, H. sapiens
ctctggccaccctccc

SEQ ID NO: 87803 - DNA, 16 bp, H. sapiens
ctctggccaggacttc

SEQ ID NO: 87804 - DNA, 16 bp, H. sapiens
ctctggcccaaagcct

SEQ ID NO: 87805 - DNA, 16 bp, H. sapiens
ctctggcccaggctgg

SEQ ID NO: 87806 - DNA, 16 bp, H. sapiens
ctctggcccagggcag

SEQ ID NO: 87807 - DNA, 16 bp, H. sapiens
ctctggccctgcccct

SEQ ID NO: 87808 - DNA, 16 bp, H. sapiens
ctctggcctctaccca

SEQ ID NO: 87809 - DNA, 16 bp, H. sapiens
ctctggcctctgccca

SEQ ID NO: 87810 - DNA, 16 bp, H. sapiens
ctctggcctctggcct

SEQ ID NO: 87811 - DNA, 16 bp, H. sapiens
ctctggcctggatgac

SEQ ID NO: 87812 - DNA, 16 bp, H. sapiens
ctctggccttggcctc

SEQ ID NO: 87813 - DNA, 16 bp, H. sapiens
ctctggcctttggact

SEQ ID NO: 87814 - DNA, 16 bp, H. sapiens
ctctggctaaaacttc

SEQ ID NO: 87815 - DNA, 16 bp, H. sapiens
ctctggctagcacttc

SEQ ID NO: 87816 - DNA, 16 bp, H. sapiens
ctctggctcctcccca

SEQ ID NO: 87817 - DNA, 16 bp, H. sapiens
ctctggctcctgggct

SEQ ID NO: 87818 - DNA, 16 bp, H. sapiens
ctctggctctctctct

SEQ ID NO: 87819 - DNA, 16 bp, H. sapiens
ctctggctctgccact

SEQ ID NO: 87820 - DNA, 16 bp, H. sapiens
ctctggctgagcccag

SEQ ID NO: 87821 - DNA, 16 bp, H. sapiens
ctctggctgcagctca

SEQ ID NO: 87822 - DNA, 16 bp, H. sapiens
ctctggctgctctgtg

SEQ ID NO: 87823 - DNA, 16 bp, H. sapiens
ctctggctgggcacag

SEQ ID NO: 87824 - DNA, 16 bp, H. sapiens
ctctggctggggctgg

SEQ ID NO: 87825 - DNA, 16 bp, H. sapiens
ctctgggaatgtctgt

SEQ ID NO: 87826 - DNA, 16 bp, H. sapiens
ctctgggacacagctg

SEQ ID NO: 87827 - DNA, 16 bp, H. sapiens
ctctgggacacattaa

SEQ ID NO: 87828 - DNA, 16 bp, H. sapiens
ctctgggagaccgagg

SEQ ID NO: 87829 - DNA, 16 bp, H. sapiens
ctctgggagctctgtc

SEQ ID NO: 87830 - DNA, 16 bp, H. sapiens
ctctgggaggcagagg

SEQ ID NO: 87831 - DNA, 16 bp, H. sapiens
ctctgggaggccaagc

SEQ ID NO: 87832 - DNA, 16 bp, H. sapiens
ctctgggaggctgggg

SEQ ID NO: 87833 - DNA, 16 bp, H. sapiens
ctctgggaggtggagg

SEQ ID NO: 87834 - DNA, 16 bp, H. sapiens
ctctgggcccagccca

SEQ ID NO: 87835 - DNA, 16 bp, H. sapiens
ctctgggcctatgatg

SEQ ID NO: 87836 - DNA, 16 bp, H. sapiens
ctctgggcctcaggct

SEQ ID NO: 87837 - DNA, 16 bp, H. sapiens
ctctgggcctctgtct

SEQ ID NO: 87838 - DNA, 16 bp, H. sapiens
ctctgggcctgtttcc

SEQ ID NO: 87839 - DNA, 16 bp, H. sapiens
ctctgggccttagttt

SEQ ID NO: 87840 - DNA, 16 bp, H. sapiens
ctctgggctcaaggga

SEQ ID NO: 87841 - DNA, 16 bp, H. sapiens
ctctgggctccaggct

SEQ ID NO: 87842 - DNA, 16 bp, H. sapiens
ctctgggctgggctgg

SEQ ID NO: 87843 - DNA, 16 bp, H. sapiens
ctctgggcttcagttt

SEQ ID NO: 87844 - DNA, 16 bp, H. sapiens
ctctgggcttcatttt

SEQ ID NO: 87845 - DNA, 16 bp, H. sapiens
ctctgggctttagttt

SEQ ID NO: 87846 - DNA, 16 bp, H. sapiens
ctctggggactgtggt

SEQ ID NO: 87847 - DNA, 16 bp, H. sapiens
ctctggggccagactg

SEQ ID NO: 87848 - DNA, 16 bp, H. sapiens
ctctggggggctgagg

SEQ ID NO: 87849 - DNA, 16 bp, H. sapiens
ctctgggtctgtttct

SEQ ID NO: 87850 - DNA, 16 bp, H. sapiens
ctctgggtgcctcctc

SEQ ID NO: 87851 - DNA, 16 bp, H. sapiens
ctctgggtgggggcca

SEQ ID NO: 87852 - DNA, 16 bp, H. sapiens
ctctgggtttccttga

SEQ ID NO: 87853 - DNA, 16 bp, H. sapiens
ctctggtattctgtga

SEQ ID NO: 87854 - DNA, 16 bp, H. sapiens
ctctggtccccttcca

SEQ ID NO: 87855 - DNA, 16 bp, H. sapiens
ctctggtgggcaggag

SEQ ID NO: 87856 - DNA, 16 bp, H. sapiens
ctctggttctctctct

SEQ ID NO: 87857 - DNA, 16 bp, H. sapiens
ctctggttgatgaaat

SEQ ID NO: 87858 - DNA, 16 bp, H. sapiens
ctctgtaaaaataaaa

SEQ ID NO: 87859 - DNA, 16 bp, H. sapiens
ctctgtaaaatggaga

SEQ ID NO: 87860 - DNA, 16 bp, H. sapiens
ctctgtacttctatat

SEQ ID NO: 87861 - DNA, 16 bp, H. sapiens
ctctgtactttctgct

SEQ ID NO: 87862 - DNA, 16 bp, H. sapiens
ctctgtagttcctcca

SEQ ID NO: 87863 - DNA, 16 bp, H. sapiens
ctctgtatgcctttgc

SEQ ID NO: 87864 - DNA, 16 bp, H. sapiens
ctctgtatttaaaaaa

SEQ ID NO: 87865 - DNA, 16 bp, H. sapiens
ctctgtcaaaacaaaa

SEQ ID NO: 87866 - DNA, 16 bp, H. sapiens
ctctgtcaaaatggac

SEQ ID NO: 87867 - DNA, 16 bp, H. sapiens
ctctgtcacagcctct

SEQ ID NO: 87868 - DNA, 16 bp, H. sapiens
ctctgtcacccagctt

SEQ ID NO: 87869 - DNA, 16 bp, H. sapiens
ctctgtcacccaggat

SEQ ID NO: 87870 - DNA, 22 bp, H. sapiens
ctctgtcacccaggctggagtc

SEQ ID NO: 87871 - DNA, 16 bp, H. sapiens
ctctgtcacccagtct

SEQ ID NO: 87872 - DNA, 16 bp, H. sapiens
ctctgtcacccccagg

SEQ ID NO: 87873 - DNA, 16 bp, H. sapiens
ctctgtcaccctagct

SEQ ID NO: 87874 - DNA, 16 bp, H. sapiens
ctctgtcacctggctg

SEQ ID NO: 87875 - DNA, 16 bp, H. sapiens
ctctgtcactcacgct

SEQ ID NO: 87876 - DNA, 16 bp, H. sapiens
ctctgtcactctgtca

SEQ ID NO: 87877 - DNA, 16 bp, H. sapiens
ctctgtcagagctctt

SEQ ID NO: 87878 - DNA, 16 bp, H. sapiens
ctctgtcatccaagct

SEQ ID NO: 87879 - DNA, 16 bp, H. sapiens
ctctgtcatccaggcc

SEQ ID NO: 87880 - DNA, 16 bp, H. sapiens
ctctgtccaatcagag

SEQ ID NO: 87881 - DNA, 16 bp, H. sapiens
ctctgtccactctcag

SEQ ID NO: 87882 - DNA, 16 bp, H. sapiens
ctctgtcccaaaaaca

SEQ ID NO: 87883 - DNA, 16 bp, H. sapiens
ctctgtcccagaaaaa

SEQ ID NO: 87884 - DNA, 16 bp, H. sapiens
ctctgtcccagagaga

SEQ ID NO: 87885 - DNA, 16 bp, H. sapiens
ctctgtccccacccca

SEQ ID NO: 87886 - DNA, 16 bp, H. sapiens
ctctgtccccaggctg

SEQ ID NO: 87887 - DNA, 16 bp, H. sapiens
ctctgtccccagggct

SEQ ID NO: 87888 - DNA, 16 bp, H. sapiens
ctctgtcccccaggat

SEQ ID NO: 87889 - DNA, 16 bp, H. sapiens
ctctgtcccccaggtt

SEQ ID NO: 87890 - DNA, 16 bp, H. sapiens
ctctgtccctcccaca

SEQ ID NO: 87891 - DNA, 16 bp, H. sapiens
ctctgtccctgcagca

SEQ ID NO: 87892 - DNA, 16 bp, H. sapiens
ctctgtcctcaaggag

SEQ ID NO: 87893 - DNA, 16 bp, H. sapiens
ctctgtcctcaggctg

SEQ ID NO: 87894 - DNA, 16 bp, H. sapiens
ctctgtcctcatggag

SEQ ID NO: 87895 - DNA, 16 bp, H. sapiens
ctctgtcctgcctggg

SEQ ID NO: 87896 - DNA, 16 bp, H. sapiens
ctctgtcgcccaggat

SEQ ID NO: 87897 - DNA, 16 bp, H. sapiens
ctctgtcgcccaggca

SEQ ID NO: 87898 - DNA, 16 bp, H. sapiens
ctctgtcgcccaggcc

SEQ ID NO: 87899 - DNA, 16 bp, H. sapiens
ctctgtcgccctggct

SEQ ID NO: 87900 - DNA, 16 bp, H. sapiens
ctctgtctaaaaagaa

SEQ ID NO: 87901 - DNA, 16 bp, H. sapiens
ctctgtctcagaaaat

SEQ ID NO: 87902 - DNA, 16 bp, H. sapiens
ctctgtctcagggaga

SEQ ID NO: 87903 - DNA, 16 bp, H. sapiens
ctctgtctccaaggct

SEQ ID NO: 87904 - DNA, 16 bp, H. sapiens
ctctgtctccagcctg

SEQ ID NO: 87905 - DNA, 16 bp, H. sapiens
ctctgtctccatctct

SEQ ID NO: 87906 - DNA, 16 bp, H. sapiens
ctctgtctcccaaagt

SEQ ID NO: 87907 - DNA, 16 bp, H. sapiens
ctctgtctccctccat

SEQ ID NO: 87908 - DNA, 16 bp, H. sapiens
ctctgtctcctaggct

SEQ ID NO: 87909 - DNA, 16 bp, H. sapiens
ctctgtctcctgcttc

SEQ ID NO: 87910 - DNA, 16 bp, H. sapiens
ctctgtctcctggact

SEQ ID NO: 87911 - DNA, 16 bp, H. sapiens
ctctgtctctaaacaa

SEQ ID NO: 87912 - DNA, 16 bp, H. sapiens
ctctgtctctcccagg

SEQ ID NO: 87913 - DNA, 16 bp, H. sapiens
ctctgtctctctctca

SEQ ID NO: 87914 - DNA, 16 bp, H. sapiens
ctctgtctctgaaaaa

SEQ ID NO: 87915 - DNA, 16 bp, H. sapiens
ctctgtctctttattt

SEQ ID NO: 87916 - DNA, 16 bp, H. sapiens
ctctgtctgggaaaaa

SEQ ID NO: 87917 - DNA, 16 bp, H. sapiens
ctctgtctgtctctcc

SEQ ID NO: 87918 - DNA, 16 bp, H. sapiens
ctctgtctgtgtctct

SEQ ID NO: 87919 - DNA, 16 bp, H. sapiens
ctctgtcttccaagct

SEQ ID NO: 87920 - DNA, 16 bp, H. sapiens
ctctgtcttccaggtt

SEQ ID NO: 87921 - DNA, 16 bp, H. sapiens
ctctgtcttgcaggct

SEQ ID NO: 87922 - DNA, 16 bp, H. sapiens
ctctgtcttggaaaaa

SEQ ID NO: 87923 - DNA, 16 bp, H. sapiens
ctctgtcttttaagtg

SEQ ID NO: 87924 - DNA, 16 bp, H. sapiens
ctctgtgaaaagacca

SEQ ID NO: 87925 - DNA, 16 bp, H. sapiens
ctctgtgaagccttcc

SEQ ID NO: 87926 - DNA, 16 bp, H. sapiens
ctctgtgaatttgcct

SEQ ID NO: 87927 - DNA, 16 bp, H. sapiens
ctctgtgactcaggct

SEQ ID NO: 87928 - DNA, 16 bp, H. sapiens
ctctgtgagatgaata

SEQ ID NO: 87929 - DNA, 16 bp, H. sapiens
ctctgtgagcagaggg

SEQ ID NO: 87930 - DNA, 16 bp, H. sapiens
ctctgtgaggtaggta

SEQ ID NO: 87931 - DNA, 16 bp, H. sapiens
ctctgtgagtctggct

SEQ ID NO: 87932 - DNA, 16 bp, H. sapiens
ctctgtgcatgcacat

SEQ ID NO: 87933 - DNA, 16 bp, H. sapiens
ctctgtgccaagccct

SEQ ID NO: 87934 - DNA, 16 bp, H. sapiens
ctctgtgccaggcact

SEQ ID NO: 87935 - DNA, 16 bp, H. sapiens
ctctgtgccaggctgg

SEQ ID NO: 87936 - DNA, 16 bp, H. sapiens
ctctgtgcccagcact

SEQ ID NO: 87937 - DNA, 16 bp, H. sapiens
ctctgtgcctcagttt

SEQ ID NO: 87938 - DNA, 16 bp, H. sapiens
ctctgtgcctccgttt

SEQ ID NO: 87939 - DNA, 16 bp, H. sapiens
ctctgtgcctctgtct

SEQ ID NO: 87940 - DNA, 16 bp, H. sapiens
ctctgtgcctgtttct

SEQ ID NO: 87941 - DNA, 16 bp, H. sapiens
ctctgtgccttagttt

SEQ ID NO: 87942 - DNA, 16 bp, H. sapiens
ctctgtgccttggttt

SEQ ID NO: 87943 - DNA, 16 bp, H. sapiens
ctctgtgcctttgcct

SEQ ID NO: 87944 - DNA, 16 bp, H. sapiens
ctctgtgctaggcatt

SEQ ID NO: 87945 - DNA, 16 bp, H. sapiens
ctctgtgctctgcctc

SEQ ID NO: 87946 - DNA, 16 bp, H. sapiens
ctctgtgcttcagttt

SEQ ID NO: 87947 - DNA, 16 bp, H. sapiens
ctctgtgcttctgttt

SEQ ID NO: 87948 - DNA, 16 bp, H. sapiens
ctctgtgcttttgaga

SEQ ID NO: 87949 - DNA, 16 bp, H. sapiens
ctctgtggaccagcag

SEQ ID NO: 87950 - DNA, 16 bp, H. sapiens
ctctgtggccaccacc

SEQ ID NO: 87951 - DNA, 16 bp, H. sapiens
ctctgtggcccaggcc

SEQ ID NO: 87952 - DNA, 16 bp, H. sapiens
ctctgtggcccaggtt

SEQ ID NO: 87953 - DNA, 16 bp, H. sapiens
ctctgtggccctggga

SEQ ID NO: 87954 - DNA, 16 bp, H. sapiens
ctctgtggctcacacc

SEQ ID NO: 87955 - DNA, 16 bp, H. sapiens
ctctgtggctcagttt

SEQ ID NO: 87956 - DNA, 16 bp, H. sapiens
ctctgtggggcccagg

SEQ ID NO: 87957 - DNA, 16 bp, H. sapiens
ctctgtgggggctctg

SEQ ID NO: 87958 - DNA, 16 bp, H. sapiens
ctctgtgtatgtgtgt

SEQ ID NO: 87959 - DNA, 16 bp, H. sapiens
ctctgtgtcaaaaaaa

SEQ ID NO: 87960 - DNA, 16 bp, H. sapiens
ctctgtgtccccatct

SEQ ID NO: 87961 - DNA, 16 bp, H. sapiens
ctctgtgtccctgtgt

SEQ ID NO: 87962 - DNA, 16 bp, H. sapiens
ctctgtgtctagctaa

SEQ ID NO: 87963 - DNA, 16 bp, H. sapiens
ctctgtgtctagctga

SEQ ID NO: 87964 - DNA, 16 bp, H. sapiens
ctctgtgtctctctct

SEQ ID NO: 87965 - DNA, 16 bp, H. sapiens
ctctgtgtctgtccac

SEQ ID NO: 87966 - DNA, 16 bp, H. sapiens
ctctgtgtctgtcttt

SEQ ID NO: 87967 - DNA, 16 bp, H. sapiens
ctctgtgtcttcctct

SEQ ID NO: 87968 - DNA, 16 bp, H. sapiens
ctctgtgtgaccttgg

SEQ ID NO: 87969 - DNA, 16 bp, H. sapiens
ctctgtgtgggtgctc

SEQ ID NO: 87970 - DNA, 16 bp, H. sapiens
ctctgtgtgtctgtgt

SEQ ID NO: 87971 - DNA, 16 bp, H. sapiens
ctctgtgtgtgtctct

SEQ ID NO: 87972 - DNA, 16 bp, H. sapiens
ctctgtgtgtgtcttt

SEQ ID NO: 87973 - DNA, 16 bp, H. sapiens
ctctgtgtgtgtgtgc

SEQ ID NO: 87974 - DNA, 16 bp, H. sapiens
ctctgtgtgtgtgtgt

SEQ ID NO: 87975 - DNA, 16 bp, H. sapiens
ctctgtgttcccacag

SEQ ID NO: 87976 - DNA, 16 bp, H. sapiens
ctctgttaaaacagac

SEQ ID NO: 87977 - DNA, 16 bp, H. sapiens
ctctgttcatagtttc

SEQ ID NO: 87978 - DNA, 16 bp, H. sapiens
ctctgttccaaataaa

SEQ ID NO: 87979 - DNA, 16 bp, H. sapiens
ctctgttcctcctgct

SEQ ID NO: 87980 - DNA, 16 bp, H. sapiens
ctctgttgaccaggtt

SEQ ID NO: 87981 - DNA, 16 bp, H. sapiens
ctctgttgcccaagct

SEQ ID NO: 87982 - DNA, 16 bp, H. sapiens
ctctgttgcccagact

SEQ ID NO: 87983 - DNA, 16 bp, H. sapiens
ctctgttgcccagctt

SEQ ID NO: 87984 - DNA, 16 bp, H. sapiens
ctctgttgcccaggcc

SEQ ID NO: 87985 - DNA, 16 bp, H. sapiens
ctctgttgctggcttt

SEQ ID NO: 87986 - DNA, 16 bp, H. sapiens
ctctgttgcttgggct

SEQ ID NO: 87987 - DNA, 16 bp, H. sapiens
ctctgttggccaggct

SEQ ID NO: 87988 - DNA, 16 bp, H. sapiens
ctctgtttattgtttc

SEQ ID NO: 87989 - DNA, 16 bp, H. sapiens
ctctgtttcccaaagt

SEQ ID NO: 87990 - DNA, 16 bp, H. sapiens
ctctgtttccccaccc

SEQ ID NO: 87991 - DNA, 16 bp, H. sapiens
ctctgtttctacaaaa

SEQ ID NO: 87992 - DNA, 16 bp, H. sapiens
ctctgtttctccatct

SEQ ID NO: 87993 - DNA, 16 bp, H. sapiens
ctctgtttcttcatct

SEQ ID NO: 87994 - DNA, 16 bp, H. sapiens
ctctgtttgcagatta

SEQ ID NO: 87995 - DNA, 16 bp, H. sapiens
ctctgttttcatattt

SEQ ID NO: 87996 - DNA, 16 bp, H. sapiens
ctctgttttcattaat

SEQ ID NO: 87997 - DNA, 16 bp, H. sapiens
ctctgttttcctttta

SEQ ID NO: 87998 - DNA, 16 bp, H. sapiens
ctctgttttggcacca

SEQ ID NO: 87999 - DNA, 16 bp, H. sapiens
ctctgtttttcagaat

SEQ ID NO: 88000 - DNA, 16 bp, H. sapiens
ctcttaaaaaagaaaa

SEQ ID NO: 88001 - DNA, 16 bp, H. sapiens
ctcttaaaaatagaaa

SEQ ID NO: 88002 - DNA, 16 bp, H. sapiens
ctcttaaaattctttc

SEQ ID NO: 88003 - DNA, 16 bp, H. sapiens
ctcttaacattgtctt

SEQ ID NO: 88004 - DNA, 16 bp, H. sapiens
ctcttaaccactgtgc

SEQ ID NO: 88005 - DNA, 16 bp, H. sapiens
ctcttaactactatgc

SEQ ID NO: 88006 - DNA, 16 bp, H. sapiens
ctcttaagattttttt

SEQ ID NO: 88007 - DNA, 16 bp, H. sapiens
ctcttaatactgcttt

SEQ ID NO: 88008 - DNA, 16 bp, H. sapiens
ctcttacatgaaaatt

SEQ ID NO: 88009 - DNA, 16 bp, H. sapiens
ctcttactagctgtgt

SEQ ID NO: 88010 - DNA, 16 bp, H. sapiens
ctcttactgcccaggc

SEQ ID NO: 88011 - DNA, 16 bp, H. sapiens
ctcttactgctttcaa

SEQ ID NO: 88012 - DNA, 16 bp, H. sapiens
ctcttagaagaaaatg

SEQ ID NO: 88013 - DNA, 16 bp, H. sapiens
ctcttagaaggacacc

SEQ ID NO: 88014 - DNA, 16 bp, H. sapiens
ctcttagatctggaac

SEQ ID NO: 88015 - DNA, 16 bp, H. sapiens
ctcttaggttcaagca

SEQ ID NO: 88016 - DNA, 16 bp, H. sapiens
ctcttagttattttta

SEQ ID NO: 88017 - DNA, 16 bp, H. sapiens
ctcttagttttattga

SEQ ID NO: 88018 - DNA, 16 bp, H. sapiens
ctcttataagggcact

SEQ ID NO: 88019 - DNA, 16 bp, H. sapiens
ctcttcaaaaatgtca

SEQ ID NO: 88020 - DNA, 16 bp, H. sapiens
ctcttcaaagctctca

SEQ ID NO: 88021 - DNA, 16 bp, H. sapiens
ctcttcaagaaaaaaa

SEQ ID NO: 88022 - DNA, 16 bp, H. sapiens
ctcttcaaggaggact

SEQ ID NO: 88023 - DNA, 16 bp, H. sapiens
ctcttcaaggtgaact

SEQ ID NO: 88024 - DNA, 16 bp, H. sapiens
ctcttcaataaatggt

SEQ ID NO: 88025 - DNA, 16 bp, H. sapiens
ctcttcaattttttaa

SEQ ID NO: 88026 - DNA, 16 bp, H. sapiens
ctcttcaccaggcagg

SEQ ID NO: 88027 - DNA, 16 bp, H. sapiens
ctcttcaccttgctca

SEQ ID NO: 88028 - DNA, 16 bp, H. sapiens
ctcttcactctgctga

SEQ ID NO: 88029 - DNA, 16 bp, H. sapiens
ctcttcactgggcagg

SEQ ID NO: 88030 - DNA, 16 bp, H. sapiens
ctcttcacttcccaga

SEQ ID NO: 88031 - DNA, 16 bp, H. sapiens
ctcttcagaagaaaga

SEQ ID NO: 88032 - DNA, 16 bp, H. sapiens
ctcttcagcatctgtt

SEQ ID NO: 88033 - DNA, 16 bp, H. sapiens
ctcttcagcctcccaa

SEQ ID NO: 88034 - DNA, 16 bp, H. sapiens
ctcttcagtgtctctt

SEQ ID NO: 88035 - DNA, 16 bp, H. sapiens
ctcttcatcaaaccta

SEQ ID NO: 88036 - DNA, 16 bp, H. sapiens
ctcttcatcatcatca

SEQ ID NO: 88037 - DNA, 16 bp, H. sapiens
ctcttcatctatatcc

SEQ ID NO: 88038 - DNA, 16 bp, H. sapiens
ctcttcatctggctgt

SEQ ID NO: 88039 - DNA, 16 bp, H. sapiens
ctcttcatctgtaaaa

SEQ ID NO: 88040 - DNA, 16 bp, H. sapiens
ctcttcatcttgcaaa

SEQ ID NO: 88041 - DNA, 16 bp, H. sapiens
ctcttcattcatttat

SEQ ID NO: 88042 - DNA, 16 bp, H. sapiens
ctcttcatttaagaat

SEQ ID NO: 88043 - DNA, 16 bp, H. sapiens
ctcttcatttgtatcc

SEQ ID NO: 88044 - DNA, 16 bp, H. sapiens
ctcttcattttggcca

SEQ ID NO: 88045 - DNA, 16 bp, H. sapiens
ctcttccacactgtgg

SEQ ID NO: 88046 - DNA, 16 bp, H. sapiens
ctcttccagaaaacag

SEQ ID NO: 88047 - DNA, 16 bp, H. sapiens
ctcttccagctcctgg

SEQ ID NO: 88048 - DNA, 16 bp, H. sapiens
ctcttcccacccgctg

SEQ ID NO: 88049 - DNA, 16 bp, H. sapiens
ctcttcccaccctctg

SEQ ID NO: 88050 - DNA, 16 bp, H. sapiens
ctcttcccagcccctg

SEQ ID NO: 88051 - DNA, 16 bp, H. sapiens
ctcttcccagcttgca

SEQ ID NO: 88052 - DNA, 16 bp, H. sapiens
ctcttcccctgtggct

SEQ ID NO: 88053 - DNA, 16 bp, H. sapiens
ctcttccctctgcctg

SEQ ID NO: 88054 - DNA, 16 bp, H. sapiens
ctcttccctctgctgg

SEQ ID NO: 88055 - DNA, 16 bp, H. sapiens
ctcttccctgaagtca

SEQ ID NO: 88056 - DNA, 16 bp, H. sapiens
ctcttccctgcctctg

SEQ ID NO: 88057 - DNA, 16 bp, H. sapiens
ctcttccctgtattat

SEQ ID NO: 88058 - DNA, 16 bp, H. sapiens
ctcttcctccagctcc

SEQ ID NO: 88059 - DNA, 16 bp, H. sapiens
ctcttcctccccagcc

SEQ ID NO: 88060 - DNA, 16 bp, H. sapiens
ctcttcctcctcagcc

SEQ ID NO: 88061 - DNA, 16 bp, H. sapiens
ctcttcctcctggctg

SEQ ID NO: 88062 - DNA, 16 bp, H. sapiens
ctcttcctcctgggct

SEQ ID NO: 88063 - DNA, 16 bp, H. sapiens
ctcttccttggcctct

SEQ ID NO: 88064 - DNA, 16 bp, H. sapiens
ctcttcctttttaaaa

SEQ ID NO: 88065 - DNA, 16 bp, H. sapiens
ctcttctagcttgctg

SEQ ID NO: 88066 - DNA, 16 bp, H. sapiens
ctcttctccagcctct

SEQ ID NO: 88067 - DNA, 16 bp, H. sapiens
ctcttctccatctcca

SEQ ID NO: 88068 - DNA, 16 bp, H. sapiens
ctcttctcccagatat

SEQ ID NO: 88069 - DNA, 16 bp, H. sapiens
ctcttctctctgcctg

SEQ ID NO: 88070 - DNA, 16 bp, H. sapiens
ctcttctctgcagctg

SEQ ID NO: 88071 - DNA, 16 bp, H. sapiens
ctcttctctgccacca

SEQ ID NO: 88072 - DNA, 16 bp, H. sapiens
ctcttctctgccctgc

SEQ ID NO: 88073 - DNA, 16 bp, H. sapiens
ctcttctgagccctcc

SEQ ID NO: 88074 - DNA, 16 bp, H. sapiens
ctcttctgagtctcca

SEQ ID NO: 88075 - DNA, 16 bp, H. sapiens
ctcttctgcctatgag

SEQ ID NO: 88076 - DNA, 16 bp, H. sapiens
ctcttctgcctcccaa

SEQ ID NO: 88077 - DNA, 16 bp, H. sapiens
ctcttctgcctctgcc

SEQ ID NO: 88078 - DNA, 16 bp, H. sapiens
ctcttctgcctctgct

SEQ ID NO: 88079 - DNA, 16 bp, H. sapiens
ctcttctgctcctctg

SEQ ID NO: 88080 - DNA, 16 bp, H. sapiens
ctcttctgggcattta

SEQ ID NO: 88081 - DNA, 16 bp, H. sapiens
ctcttctgtgccaggc

SEQ ID NO: 88082 - DNA, 16 bp, H. sapiens
ctcttcttataaggac

SEQ ID NO: 88083 - DNA, 16 bp, H. sapiens
ctcttcttataaggat

SEQ ID NO: 88084 - DNA, 16 bp, H. sapiens
ctcttcttcagcctct

SEQ ID NO: 88085 - DNA, 16 bp, H. sapiens
ctcttcttgtttactt

SEQ ID NO: 88086 - DNA, 16 bp, H. sapiens
ctcttctttaagaatg

SEQ ID NO: 88087 - DNA, 16 bp, H. sapiens
ctcttgaaagcaccac

SEQ ID NO: 88088 - DNA, 16 bp, H. sapiens
ctcttgaaaggcaggc

SEQ ID NO: 88089 - DNA, 17 bp, H. sapiens
ctcttgacctcatgatc

SEQ ID NO: 88090 - DNA, 17 bp, H. sapiens
ctcttgacctcgtgatc

SEQ ID NO: 88091 - DNA, 17 bp, H. sapiens
ctcttgaccttgtgatc

SEQ ID NO: 88092 - DNA, 16 bp, H. sapiens
ctcttgacttcaaatg

SEQ ID NO: 88093 - DNA, 18 bp, H. sapiens
ctcttgcaaaaggactac

SEQ ID NO: 88094 - DNA, 16 bp, H. sapiens
ctcttgcccagggtgg

SEQ ID NO: 88095 - DNA, 16 bp, H. sapiens
ctcttgccctcttgcc

SEQ ID NO: 88096 - DNA, 16 bp, H. sapiens
ctcttgcctcaacctc

SEQ ID NO: 88097 - DNA, 16 bp, H. sapiens
ctcttgcctcagcctc

SEQ ID NO: 88098 - DNA, 16 bp, H. sapiens
ctcttgcctcagcctg

SEQ ID NO: 88099 - DNA, 16 bp, H. sapiens
ctcttgcctcagtctc

SEQ ID NO: 88100 - DNA, 16 bp, H. sapiens
ctcttgcctggattat

SEQ ID NO: 88101 - DNA, 16 bp, H. sapiens
ctcttgcctgtcacca

SEQ ID NO: 88102 - DNA, 16 bp, H. sapiens
ctcttgccttagcttc

SEQ ID NO: 88103 - DNA, 16 bp, H. sapiens
ctcttgccttctgtgc

SEQ ID NO: 88104 - DNA, 16 bp, H. sapiens
ctcttgccttggcctc

SEQ ID NO: 88105 - DNA, 16 bp, H. sapiens
ctcttgcctttctgcc

SEQ ID NO: 88106 - DNA, 16 bp, H. sapiens
ctcttgctcctgctcc

SEQ ID NO: 88107 - DNA, 16 bp, H. sapiens
ctcttgctcctgcttc

SEQ ID NO: 88108 - DNA, 16 bp, H. sapiens
ctcttgctctctgtct

SEQ ID NO: 88109 - DNA, 16 bp, H. sapiens
ctcttgctctgtctcc

SEQ ID NO: 88110 - DNA, 16 bp, H. sapiens
ctcttgctgtcaccat

SEQ ID NO: 88111 - DNA, 16 bp, H. sapiens
ctcttgcttcagcctc

SEQ ID NO: 88112 - DNA, 16 bp, H. sapiens
ctcttgcttttccagt

SEQ ID NO: 88113 - DNA, 16 bp, H. sapiens
ctcttggacttcccag

SEQ ID NO: 88114 - DNA, 16 bp, H. sapiens
ctcttggcatttgctt

SEQ ID NO: 88115 - DNA, 16 bp, H. sapiens
ctcttggccaagggga

SEQ ID NO: 88116 - DNA, 16 bp, H. sapiens
ctcttggcctcaagcc

SEQ ID NO: 88117 - DNA, 16 bp, H. sapiens
ctcttggcctcatgtg

SEQ ID NO: 88118 - DNA, 16 bp, H. sapiens
ctcttggctttggagc

SEQ ID NO: 88119 - DNA, 16 bp, H. sapiens
ctcttgggccttcagc

SEQ ID NO: 88120 - DNA, 16 bp, H. sapiens
ctcttgggctcaaaag

SEQ ID NO: 88121 - DNA, 16 bp, H. sapiens
ctcttgggctcaagca

SEQ ID NO: 88122 - DNA, 16 bp, H. sapiens
ctcttgggctcaggag

SEQ ID NO: 88123 - DNA, 16 bp, H. sapiens
ctcttgggctcaggca

SEQ ID NO: 88124 - DNA, 16 bp, H. sapiens
ctcttgggctcaggtg

SEQ ID NO: 88125 - DNA, 16 bp, H. sapiens
ctcttgggctcatgca

SEQ ID NO: 88126 - DNA, 16 bp, H. sapiens
ctcttgggctgaagca

SEQ ID NO: 88127 - DNA, 16 bp, H. sapiens
ctcttggggtccccag

SEQ ID NO: 88128 - DNA, 16 bp, H. sapiens
ctcttggtgggaatgt

SEQ ID NO: 88129 - DNA, 16 bp, H. sapiens
ctcttggtgttataca

SEQ ID NO: 88130 - DNA, 16 bp, H. sapiens
ctcttgtccctcaggc

SEQ ID NO: 88131 - DNA, 16 bp, H. sapiens
ctcttgtctaccacca

SEQ ID NO: 88132 - DNA, 16 bp, H. sapiens
ctcttgtctgatttct

SEQ ID NO: 88133 - DNA, 16 bp, H. sapiens
ctcttgtcttaaaaaa

SEQ ID NO: 88134 - DNA, 16 bp, H. sapiens
ctcttgtgccccaggc

SEQ ID NO: 88135 - DNA, 16 bp, H. sapiens
ctcttgtttctcaggc

SEQ ID NO: 88136 - DNA, 16 bp, H. sapiens
ctctttaaataaataa

SEQ ID NO: 88137 - DNA, 16 bp, H. sapiens
ctctttaataaaaact

SEQ ID NO: 88138 - DNA, 17 bp, H. sapiens
ctctttaggcccagctc

SEQ ID NO: 88139 - DNA, 16 bp, H. sapiens
ctctttagtttaacta

SEQ ID NO: 88140 - DNA, 16 bp, H. sapiens
ctctttcagccatggc

SEQ ID NO: 88141 - DNA, 16 bp, H. sapiens
ctctttcagtttatta

SEQ ID NO: 88142 - DNA, 16 bp, H. sapiens
ctctttcatcagggga

SEQ ID NO: 88143 - DNA, 16 bp, H. sapiens
ctctttcatgattttc

SEQ ID NO: 88144 - DNA, 16 bp, H. sapiens
ctctttccattcctta

SEQ ID NO: 88145 - DNA, 16 bp, H. sapiens
ctctttcctaaaacat

SEQ ID NO: 88146 - DNA, 16 bp, H. sapiens
ctctttcctcagcttc

SEQ ID NO: 88147 - DNA, 16 bp, H. sapiens
ctctttcctgccacca

SEQ ID NO: 88148 - DNA, 16 bp, H. sapiens
ctctttcctgcctcag

SEQ ID NO: 88149 - DNA, 16 bp, H. sapiens
ctctttcctgctgcct

SEQ ID NO: 88150 - DNA, 16 bp, H. sapiens
ctctttcctggcccct

SEQ ID NO: 88151 - DNA, 16 bp, H. sapiens
ctctttccttggcctc

SEQ ID NO: 88152 - DNA, 16 bp, H. sapiens
ctctttcctttatgaa

SEQ ID NO: 88153 - DNA, 17 bp, H. sapiens
ctctttctacacagaca

SEQ ID NO: 88154 - DNA, 19 bp, H. sapiens
ctctttctacacagacaca

SEQ ID NO: 88155 - DNA, 16 bp, H. sapiens
ctctttctcaatctct

SEQ ID NO: 88156 - DNA, 16 bp, H. sapiens
ctctttctcagggacg

SEQ ID NO: 88157 - DNA, 16 bp, H. sapiens
ctctttctcagtctct

SEQ ID NO: 88158 - DNA, 16 bp, H. sapiens
ctctttctccactgca

SEQ ID NO: 88159 - DNA, 16 bp, H. sapiens
ctctttctctctgctg

SEQ ID NO: 88160 - DNA, 16 bp, H. sapiens
ctctttctgggtctct

SEQ ID NO: 88161 - DNA, 16 bp, H. sapiens
ctctttctgtgcctgg

SEQ ID NO: 88162 - DNA, 16 bp, H. sapiens
ctctttcttttctcag

SEQ ID NO: 88163 - DNA, 16 bp, H. sapiens
ctctttgaagaaattg

SEQ ID NO: 88164 - DNA, 16 bp, H. sapiens
ctctttgaagcaattt

SEQ ID NO: 88165 - DNA, 16 bp, H. sapiens
ctctttgaaggtctct

SEQ ID NO: 88166 - DNA, 16 bp, H. sapiens
ctctttgagatcctgt

SEQ ID NO: 88167 - DNA, 16 bp, H. sapiens
ctctttgagcatattt

SEQ ID NO: 88168 - DNA, 16 bp, H. sapiens
ctctttgaggctgaag

SEQ ID NO: 88169 - DNA, 16 bp, H. sapiens
ctctttgagtccctgc

SEQ ID NO: 88170 - DNA, 26 bp, H. sapiens
ctctttgcaataaatcttgctactgc

SEQ ID NO: 88171 - DNA, 16 bp, H. sapiens
ctctttgcatttcagt

SEQ ID NO: 88172 - DNA, 16 bp, H. sapiens
ctctttgcccttctgc

SEQ ID NO: 88173 - DNA, 16 bp, H. sapiens
ctctttgcctactgtg

SEQ ID NO: 88174 - DNA, 16 bp, H. sapiens
ctctttgcctgctgct

SEQ ID NO: 88175 - DNA, 16 bp, H. sapiens
ctctttgggaagccaa

SEQ ID NO: 88176 - DNA, 16 bp, H. sapiens
ctctttgtctttttaa

SEQ ID NO: 88177 - DNA, 16 bp, H. sapiens
ctctttgtgcctcagt

SEQ ID NO: 88178 - DNA, 16 bp, H. sapiens
ctctttgtgtccatga

SEQ ID NO: 88179 - DNA, 16 bp, H. sapiens
ctctttgtgtctgtgt

SEQ ID NO: 88180 - DNA, 16 bp, H. sapiens
ctctttgttgctcagg

SEQ ID NO: 88181 - DNA, 16 bp, H. sapiens
ctcttttacactgttg

SEQ ID NO: 88182 - DNA, 16 bp, H. sapiens
ctcttttagcattttt

SEQ ID NO: 88183 - DNA, 16 bp, H. sapiens
ctcttttagccctgcc

SEQ ID NO: 88184 - DNA, 16 bp, H. sapiens
ctcttttattaaaaaa

SEQ ID NO: 88185 - DNA, 16 bp, H. sapiens
ctcttttattttctgg

SEQ ID NO: 88186 - DNA, 16 bp, H. sapiens
ctcttttcacatgttt

SEQ ID NO: 88187 - DNA, 18 bp, H. sapiens
ctcttttcggactcagcc

SEQ ID NO: 88188 - DNA, 16 bp, H. sapiens
ctcttttctctaggct

SEQ ID NO: 88189 - DNA, 16 bp, H. sapiens
ctcttttctttataaa

SEQ ID NO: 88190 - DNA, 16 bp, H. sapiens
ctcttttcttttaaaa

SEQ ID NO: 88191 - DNA, 16 bp, H. sapiens
ctcttttgccctcact

SEQ ID NO: 88192 - DNA, 16 bp, H. sapiens
ctcttttgcctgctgc

SEQ ID NO: 88193 - DNA, 16 bp, H. sapiens
ctcttttgctttctta

SEQ ID NO: 88194 - DNA, 16 bp, H. sapiens
ctcttttggggtctgg

SEQ ID NO: 88195 - DNA, 16 bp, H. sapiens
ctcttttgtttactgt

SEQ ID NO: 88196 - DNA, 16 bp, H. sapiens
ctcttttgtttataaa

SEQ ID NO: 88197 - DNA, 16 bp, H. sapiens
ctctttttaaaaacat

SEQ ID NO: 88198 - DNA, 16 bp, H. sapiens
ctctttttaaaagttt

SEQ ID NO: 88199 - DNA, 16 bp, H. sapiens
ctctttttataaaaat

SEQ ID NO: 88200 - DNA, 16 bp, H. sapiens
ctctttttcatatgtt

SEQ ID NO: 88201 - DNA, 16 bp, H. sapiens
ctctttttccaaataa

SEQ ID NO: 88202 - DNA, 16 bp, H. sapiens
ctctttttggccaggc

SEQ ID NO: 88203 - DNA, 16 bp, H. sapiens
ctcttttttaaaaaat

SEQ ID NO: 88204 - DNA, 16 bp, H. sapiens
ctcttttttagttcca

SEQ ID NO: 88205 - DNA, 16 bp, H. sapiens
ctctttttttaaaaaa

SEQ ID NO: 88206 - DNA, 16 bp, H. sapiens
ctctttttttgtaaat

SEQ ID NO: 88207 - DNA, 16 bp, H. sapiens
ctgaaaaaaattttaa

SEQ ID NO: 88208 - DNA, 16 bp, H. sapiens
ctgaaaaaactgaaaa

SEQ ID NO: 88209 - DNA, 16 bp, H. sapiens
ctgaaaaaatgtatat

SEQ ID NO: 88210 - DNA, 16 bp, H. sapiens
ctgaaaaaattcaaaa

SEQ ID NO: 88211 - DNA, 16 bp, H. sapiens
ctgaaaaacaacaaca

SEQ ID NO: 88212 - DNA, 16 bp, H. sapiens
ctgaaaaacattttta

SEQ ID NO: 88213 - DNA, 16 bp, H. sapiens
ctgaaaaactattaga

SEQ ID NO: 88214 - DNA, 16 bp, H. sapiens
ctgaaaaacttctttt

SEQ ID NO: 88215 - DNA, 16 bp, H. sapiens
ctgaaaaacttggagt

SEQ ID NO: 88216 - DNA, 16 bp, H. sapiens
ctgaaaaagaaacaga

SEQ ID NO: 88217 - DNA, 16 bp, H. sapiens
ctgaaaaagaaataga

SEQ ID NO: 88218 - DNA, 16 bp, H. sapiens
ctgaaaaagcatttaa

SEQ ID NO: 88219 - DNA, 16 bp, H. sapiens
ctgaaaaaggaaagaa

SEQ ID NO: 88220 - DNA, 16 bp, H. sapiens
ctgaaaaaggcaagga

SEQ ID NO: 88221 - DNA, 16 bp, H. sapiens
ctgaaaaatacaaaac

SEQ ID NO: 88222 - DNA, 16 bp, H. sapiens
ctgaaaaatacaatga

SEQ ID NO: 88223 - DNA, 16 bp, H. sapiens
ctgaaaaatataataa

SEQ ID NO: 88224 - DNA, 16 bp, H. sapiens
ctgaaaaatcaagaaa

SEQ ID NO: 88225 - DNA, 16 bp, H. sapiens
ctgaaaaatcactgac

SEQ ID NO: 88226 - DNA, 16 bp, H. sapiens
ctgaaaaatggagaaa

SEQ ID NO: 88227 - DNA, 16 bp, H. sapiens
ctgaaaaatgggaaaa

SEQ ID NO: 88228 - DNA, 16 bp, H. sapiens
ctgaaaaattattttt

SEQ ID NO: 88229 - DNA, 16 bp, H. sapiens
ctgaaaaattcaaata

SEQ ID NO: 88230 - DNA, 16 bp, H. sapiens
ctgaaaacagcaagag

SEQ ID NO: 88231 - DNA, 16 bp, H. sapiens
ctgaaaacagcttgga

SEQ ID NO: 88232 - DNA, 16 bp, H. sapiens
ctgaaaacaggagatt

SEQ ID NO: 88233 - DNA, 16 bp, H. sapiens
ctgaaaacagggacaa

SEQ ID NO: 88234 - DNA, 16 bp, H. sapiens
ctgaaaacattcaaaa

SEQ ID NO: 88235 - DNA, 16 bp, H. sapiens
ctgaaaactctaaaaa

SEQ ID NO: 88236 - DNA, 16 bp, H. sapiens
ctgaaaagaaagcaaa

SEQ ID NO: 88237 - DNA, 16 bp, H. sapiens
ctgaaaagcaaaacaa

SEQ ID NO: 88238 - DNA, 16 bp, H. sapiens
ctgaaaagcaaatgca

SEQ ID NO: 88239 - DNA, 18 bp, H. sapiens
ctgaaaaggacatgaact

SEQ ID NO: 88240 - DNA, 16 bp, H. sapiens
ctgaaaagtctcagca

SEQ ID NO: 88241 - DNA, 16 bp, H. sapiens
ctgaaaataaaaattt

SEQ ID NO: 88242 - DNA, 16 bp, H. sapiens
ctgaaaataaaagata

SEQ ID NO: 88243 - DNA, 16 bp, H. sapiens
ctgaaaataaaatgac

SEQ ID NO: 88244 - DNA, 16 bp, H. sapiens
ctgaaaataaagaaat

SEQ ID NO: 88245 - DNA, 16 bp, H. sapiens
ctgaaaataaagtttt

SEQ ID NO: 88246 - DNA, 16 bp, H. sapiens
ctgaaaataaatttca

SEQ ID NO: 88247 - DNA, 16 bp, H. sapiens
ctgaaaataatttttt

SEQ ID NO: 88248 - DNA, 16 bp, H. sapiens
ctgaaaatacataaaa

SEQ ID NO: 88249 - DNA, 16 bp, H. sapiens
ctgaaaatataaaaca

SEQ ID NO: 88250 - DNA, 16 bp, H. sapiens
ctgaaaatataattct

SEQ ID NO: 88251 - DNA, 16 bp, H. sapiens
ctgaaaatatattaat

SEQ ID NO: 88252 - DNA, 16 bp, H. sapiens
ctgaaaatatgccatt

SEQ ID NO: 88253 - DNA, 16 bp, H. sapiens
ctgaaaatcaacaact

SEQ ID NO: 88254 - DNA, 16 bp, H. sapiens
ctgaaaatccaaaatg

SEQ ID NO: 88255 - DNA, 16 bp, H. sapiens
ctgaaaatgaaataaa

SEQ ID NO: 88256 - DNA, 16 bp, H. sapiens
ctgaaaatgaaattaa

SEQ ID NO: 88257 - DNA, 16 bp, H. sapiens
ctgaaaatgcaaaaat

SEQ ID NO: 88258 - DNA, 16 bp, H. sapiens
ctgaaaatgggatttt

SEQ ID NO: 88259 - DNA, 16 bp, H. sapiens
ctgaaaatgtgaaagt

SEQ ID NO: 88260 - DNA, 16 bp, H. sapiens
ctgaaaatgtggaagc

SEQ ID NO: 88261 - DNA, 16 bp, H. sapiens
ctgaaaatgtggaagg

SEQ ID NO: 88262 - DNA, 16 bp, H. sapiens
ctgaaaatgttaaaaa

SEQ ID NO: 88263 - DNA, 16 bp, H. sapiens
ctgaaaatgtttttct

SEQ ID NO: 88264 - DNA, 16 bp, H. sapiens
ctgaaaattaaagaca

SEQ ID NO: 88265 - DNA, 16 bp, H. sapiens
ctgaaaattatttaaa

SEQ ID NO: 88266 - DNA, 16 bp, H. sapiens
ctgaaaattccaaaaa

SEQ ID NO: 88267 - DNA, 16 bp, H. sapiens
ctgaaaattccaaaac

SEQ ID NO: 88268 - DNA, 16 bp, H. sapiens
ctgaaaatttaacagt

SEQ ID NO: 88269 - DNA, 16 bp, H. sapiens
ctgaaacaaacaaaca

SEQ ID NO: 88270 - DNA, 16 bp, H. sapiens
ctgaaacaacagaaat

SEQ ID NO: 88271 - DNA, 16 bp, H. sapiens
ctgaaacagcagttgc

SEQ ID NO: 88272 - DNA, 16 bp, H. sapiens
ctgaaacaggacccct

SEQ ID NO: 88273 - DNA, 16 bp, H. sapiens
ctgaaacattttattt

SEQ ID NO: 88274 - DNA, 16 bp, H. sapiens
ctgaaaccatggatag

SEQ ID NO: 88275 - DNA, 16 bp, H. sapiens
ctgaaactacagaaag

SEQ ID NO: 88276 - DNA, 16 bp, H. sapiens
ctgaaactattccaaa

SEQ ID NO: 88277 - DNA, 16 bp, H. sapiens
ctgaaactattgcaat

SEQ ID NO: 88278 - DNA, 16 bp, H. sapiens
ctgaaactatttcaaa

SEQ ID NO: 88279 - DNA, 16 bp, H. sapiens
ctgaaactcctgacct

SEQ ID NO: 88280 - DNA, 16 bp, H. sapiens
ctgaaactctacccat

SEQ ID NO: 88281 - DNA, 16 bp, H. sapiens
ctgaaactgcagaaag

SEQ ID NO: 88282 - DNA, 38 bp, H. sapiens
ctgaaactggatcccttccttacaccttatacaaaaat

SEQ ID NO: 88283 - DNA, 16 bp, H. sapiens
ctgaaactgggaagaa

SEQ ID NO: 88284 - DNA, 16 bp, H. sapiens
ctgaaactgtgagaaa

SEQ ID NO: 88285 - DNA, 16 bp, H. sapiens
ctgaaacttcataccc

SEQ ID NO: 88286 - DNA, 16 bp, H. sapiens
ctgaaacttctctaaa

SEQ ID NO: 88287 - DNA, 16 bp, H. sapiens
ctgaaactttaaaaaa

SEQ ID NO: 88288 - DNA, 16 bp, H. sapiens
ctgaaactttactaaa

SEQ ID NO: 88289 - DNA, 16 bp, H. sapiens
ctgaaactttttgagc

SEQ ID NO: 88290 - DNA, 16 bp, H. sapiens
ctgaaagaaaaggaca

SEQ ID NO: 88291 - DNA, 16 bp, H. sapiens
ctgaaagaaaatgatg

SEQ ID NO: 88292 - DNA, 16 bp, H. sapiens
ctgaaagaaatcaaag

SEQ ID NO: 88293 - DNA, 16 bp, H. sapiens
ctgaaagaaatcagat

SEQ ID NO: 88294 - DNA, 16 bp, H. sapiens
ctgaaagaaatgaaag

SEQ ID NO: 88295 - DNA, 16 bp, H. sapiens
ctgaaagaaattcaag

SEQ ID NO: 88296 - DNA, 16 bp, H. sapiens
ctgaaagaacacaaac

SEQ ID NO: 88297 - DNA, 16 bp, H. sapiens
ctgaaagaagaaataa

SEQ ID NO: 88298 - DNA, 16 bp, H. sapiens
ctgaaagaagccaggc

SEQ ID NO: 88299 - DNA, 16 bp, H. sapiens
ctgaaagaattgaaag

SEQ ID NO: 88300 - DNA, 16 bp, H. sapiens
ctgaaagagaaaaaga

SEQ ID NO: 88301 - DNA, 16 bp, H. sapiens
ctgaaagagaaaaatg

SEQ ID NO: 88302 - DNA, 16 bp, H. sapiens
ctgaaagagaaatcaa

SEQ ID NO: 88303 - DNA, 16 bp, H. sapiens
ctgaaagagagggaga

SEQ ID NO: 88304 - DNA, 16 bp, H. sapiens
ctgaaagagctgtaac

SEQ ID NO: 88305 - DNA, 16 bp, H. sapiens
ctgaaagagtgcaaat

SEQ ID NO: 88306 - DNA, 16 bp, H. sapiens
ctgaaagataaaatag

SEQ ID NO: 88307 - DNA, 16 bp, H. sapiens
ctgaaagatgaaatag

SEQ ID NO: 88308 - DNA, 16 bp, H. sapiens
ctgaaagcaaaaagaa

SEQ ID NO: 88309 - DNA, 16 bp, H. sapiens
ctgaaagcaaaacaaa

SEQ ID NO: 88310 - DNA, 16 bp, H. sapiens
ctgaaagctctgcctc

SEQ ID NO: 88311 - DNA, 16 bp, H. sapiens
ctgaaagctttgaaga

SEQ ID NO: 88312 - DNA, 16 bp, H. sapiens
ctgaaaggatcaacaa

SEQ ID NO: 88313 - DNA, 16 bp, H. sapiens
ctgaaagtaaaattaa

SEQ ID NO: 88314 - DNA, 16 bp, H. sapiens
ctgaaagtaaaggaat

SEQ ID NO: 88315 - DNA, 16 bp, H. sapiens
ctgaaagtgaaagaat

SEQ ID NO: 88316 - DNA, 16 bp, H. sapiens
ctgaaagtgacagaga

SEQ ID NO: 88317 - DNA, 16 bp, H. sapiens
ctgaaagtgactggga

SEQ ID NO: 88318 - DNA, 16 bp, H. sapiens
ctgaaataaaagttaa

SEQ ID NO: 88319 - DNA, 16 bp, H. sapiens
ctgaaataaatataaa

SEQ ID NO: 88320 - DNA, 16 bp, H. sapiens
ctgaaataatattttt

SEQ ID NO: 88321 - DNA, 16 bp, H. sapiens
ctgaaataatgaaaat

SEQ ID NO: 88322 - DNA, 16 bp, H. sapiens
ctgaaataattatttt

SEQ ID NO: 88323 - DNA, 16 bp, H. sapiens
ctgaaataatttttta

SEQ ID NO: 88324 - DNA, 16 bp, H. sapiens
ctgaaatacttttaaa

SEQ ID NO: 88325 - DNA, 16 bp, H. sapiens
ctgaaatagatgattc

SEQ ID NO: 88326 - DNA, 16 bp, H. sapiens
ctgaaatatatttctt

SEQ ID NO: 88327 - DNA, 16 bp, H. sapiens
ctgaaatatatttttg

SEQ ID NO: 88328 - DNA, 16 bp, H. sapiens
ctgaaatatttggaaa

SEQ ID NO: 88329 - DNA, 16 bp, H. sapiens
ctgaaatcatgccact

SEQ ID NO: 88330 - DNA, 16 bp, H. sapiens
ctgaaatctattttgt

SEQ ID NO: 88331 - DNA, 16 bp, H. sapiens
ctgaaatctggagaga

SEQ ID NO: 88332 - DNA, 16 bp, H. sapiens
ctgaaatgaggcttgg

SEQ ID NO: 88333 - DNA, 16 bp, H. sapiens
ctgaaatgcagtggtg

SEQ ID NO: 88334 - DNA, 16 bp, H. sapiens
ctgaaatgggaagatc

SEQ ID NO: 88335 - DNA, 16 bp, H. sapiens
ctgaaatgggaggatc

SEQ ID NO: 88336 - DNA, 16 bp, H. sapiens
ctgaaatgtaaaaccc

SEQ ID NO: 88337 - DNA, 16 bp, H. sapiens
ctgaaatgtttatttt

SEQ ID NO: 88338 - DNA, 16 bp, H. sapiens
ctgaaatgtttttatt

SEQ ID NO: 88339 - DNA, 16 bp, H. sapiens
ctgaaattaaaattta

SEQ ID NO: 88340 - DNA, 16 bp, H. sapiens
ctgaaattaataaaat

SEQ ID NO: 88341 - DNA, 16 bp, H. sapiens
ctgaaattacaggcat

SEQ ID NO: 88342 - DNA, 16 bp, H. sapiens
ctgaaattataacaaa

SEQ ID NO: 88343 - DNA, 16 bp, H. sapiens
ctgaaattatgtcaaa

SEQ ID NO: 88344 - DNA, 16 bp, H. sapiens
ctgaaattcaaatttg

SEQ ID NO: 88345 - DNA, 16 bp, H. sapiens
ctgaaattcagtttct

SEQ ID NO: 88346 - DNA, 16 bp, H. sapiens
ctgaaattcttaaaaa

SEQ ID NO: 88347 - DNA, 16 bp, H. sapiens
ctgaaattcttgaagt

SEQ ID NO: 88348 - DNA, 16 bp, H. sapiens
ctgaaattgaaaaaaa

SEQ ID NO: 88349 - DNA, 25 bp, H. sapiens
ctgaaattgtggcaataatcaatag

SEQ ID NO: 88350 - DNA, 16 bp, H. sapiens
ctgaaatttattttct

SEQ ID NO: 88351 - DNA, 16 bp, H. sapiens
ctgaaattttaaaaaa

SEQ ID NO: 88352 - DNA, 16 bp, H. sapiens
ctgaaattttccattt

SEQ ID NO: 88353 - DNA, 16 bp, H. sapiens
ctgaaattttgtattt

SEQ ID NO: 88354 - DNA, 16 bp, H. sapiens
ctgaacaaacaggcct

SEQ ID NO: 88355 - DNA, 16 bp, H. sapiens
ctgaacaaactgaaaa

SEQ ID NO: 88356 - DNA, 16 bp, H. sapiens
ctgaacaacatagtga

SEQ ID NO: 88357 - DNA, 16 bp, H. sapiens
ctgaacaacgagaaca

SEQ ID NO: 88358 - DNA, 16 bp, H. sapiens
ctgaacaagctgctcc

SEQ ID NO: 88359 - DNA, 16 bp, H. sapiens
ctgaacaatgagaaaa

SEQ ID NO: 88360 - DNA, 16 bp, H. sapiens
ctgaacaatgagaaca

SEQ ID NO: 88361 - DNA, 16 bp, H. sapiens
ctgaacactttttttt

SEQ ID NO: 88362 - DNA, 16 bp, H. sapiens
ctgaacagaccaataa

SEQ ID NO: 88363 - DNA, 16 bp, H. sapiens
ctgaacagactaagac

SEQ ID NO: 88364 - DNA, 16 bp, H. sapiens
ctgaacattagagaaa

SEQ ID NO: 88365 - DNA, 16 bp, H. sapiens
ctgaaccaattgagat

SEQ ID NO: 88366 - DNA, 16 bp, H. sapiens
ctgaaccacaaacaat

SEQ ID NO: 88367 - DNA, 16 bp, H. sapiens
ctgaaccaggctgaga

SEQ ID NO: 88368 - DNA, 16 bp, H. sapiens
ctgaaccatttgagaa

SEQ ID NO: 88369 - DNA, 16 bp, H. sapiens
ctgaaccctggaggca

SEQ ID NO: 88370 - DNA, 16 bp, H. sapiens
ctgaacctctgcctcc

SEQ ID NO: 88371 - DNA, 16 bp, H. sapiens
ctgaacctgccagtgc

SEQ ID NO: 88372 - DNA, 16 bp, H. sapiens
ctgaaccttcagtgag

SEQ ID NO: 88373 - DNA, 16 bp, H. sapiens
ctgaaccttggttttc

SEQ ID NO: 88374 - DNA, 16 bp, H. sapiens
ctgaactagacaaaat

SEQ ID NO: 88375 - DNA, 16 bp, H. sapiens
ctgaactcattgcttt

SEQ ID NO: 88376 - DNA, 16 bp, H. sapiens
ctgaactgagatgtgc

SEQ ID NO: 88377 - DNA, 16 bp, H. sapiens
ctgaactgtgaatcaa

SEQ ID NO: 88378 - DNA, 16 bp, H. sapiens
ctgaacttaaaattaa

SEQ ID NO: 88379 - DNA, 16 bp, H. sapiens
ctgaagaaagcagtgg

SEQ ID NO: 88380 - DNA, 16 bp, H. sapiens
ctgaagaaatcatatg

SEQ ID NO: 88381 - DNA, 16 bp, H. sapiens
ctgaagaaattaaaat

SEQ ID NO: 88382 - DNA, 16 bp, H. sapiens
ctgaagaaattccttt

SEQ ID NO: 88383 - DNA, 16 bp, H. sapiens
ctgaagaaattttaaa

SEQ ID NO: 88384 - DNA, 16 bp, H. sapiens
ctgaagaacaacaaca

SEQ ID NO: 88385 - DNA, 16 bp, H. sapiens
ctgaagaacattgatg

SEQ ID NO: 88386 - DNA, 16 bp, H. sapiens
ctgaagaaccctgact

SEQ ID NO: 88387 - DNA, 16 bp, H. sapiens
ctgaagaacttgaagt

SEQ ID NO: 88388 - DNA, 16 bp, H. sapiens
ctgaagaacttggagc

SEQ ID NO: 88389 - DNA, 16 bp, H. sapiens
ctgaagaacttggagt

SEQ ID NO: 88390 - DNA, 16 bp, H. sapiens
ctgaagaactttcttt

SEQ ID NO: 88391 - DNA, 16 bp, H. sapiens
ctgaagaagaaaaaat

SEQ ID NO: 88392 - DNA, 16 bp, H. sapiens
ctgaagaagaaaataa

SEQ ID NO: 88393 - DNA, 16 bp, H. sapiens
ctgaagaagaagaaaa

SEQ ID NO: 88394 - DNA, 16 bp, H. sapiens
ctgaagaagaaggaat

SEQ ID NO: 88395 - DNA, 16 bp, H. sapiens
ctgaagaagagaaaaa

SEQ ID NO: 88396 - DNA, 16 bp, H. sapiens
ctgaagaagagaaaat

SEQ ID NO: 88397 - DNA, 16 bp, H. sapiens
ctgaagaaggagaatc

SEQ ID NO: 88398 - DNA, 16 bp, H. sapiens
ctgaagaagtgacatt

SEQ ID NO: 88399 - DNA, 16 bp, H. sapiens
ctgaagaatatttcat

SEQ ID NO: 88400 - DNA, 16 bp, H. sapiens
ctgaagaatttggagt

SEQ ID NO: 88401 - DNA, 16 bp, H. sapiens
ctgaagaattttcttt

SEQ ID NO: 88402 - DNA, 16 bp, H. sapiens
ctgaagacagaaagaa

SEQ ID NO: 88403 - DNA, 16 bp, H. sapiens
ctgaagacaggctatt

SEQ ID NO: 88404 - DNA, 16 bp, H. sapiens
ctgaagacctctgaca

SEQ ID NO: 88405 - DNA, 16 bp, H. sapiens
ctgaagacctgggatc

SEQ ID NO: 88406 - DNA, 16 bp, H. sapiens
ctgaagagaccaataa

SEQ ID NO: 88407 - DNA, 16 bp, H. sapiens
ctgaagagaggaaaaa

SEQ ID NO: 88408 - DNA, 16 bp, H. sapiens
ctgaagagcagtggca

SEQ ID NO: 88409 - DNA, 16 bp, H. sapiens
ctgaagagcagtggtg

SEQ ID NO: 88410 - DNA, 16 bp, H. sapiens
ctgaagagcccttgga

SEQ ID NO: 88411 - DNA, 16 bp, H. sapiens
ctgaagagcctttggg

SEQ ID NO: 88412 - DNA, 16 bp, H. sapiens
ctgaagagctcctcaa

SEQ ID NO: 88413 - DNA, 16 bp, H. sapiens
ctgaagagcttctgca

SEQ ID NO: 88414 - DNA, 16 bp, H. sapiens
ctgaagaggaaggaag

SEQ ID NO: 88415 - DNA, 16 bp, H. sapiens
ctgaagaggacacaca

SEQ ID NO: 88416 - DNA, 16 bp, H. sapiens
ctgaagagggaggaag

SEQ ID NO: 88417 - DNA, 16 bp, H. sapiens
ctgaagataatttctt

SEQ ID NO: 88418 - DNA, 16 bp, H. sapiens
ctgaagatatttcctt

SEQ ID NO: 88419 - DNA, 16 bp, H. sapiens
ctgaagatattttcct

SEQ ID NO: 88420 - DNA, 16 bp, H. sapiens
ctgaagatcaaattaa

SEQ ID NO: 88421 - DNA, 16 bp, H. sapiens
ctgaagatgaatggct

SEQ ID NO: 88422 - DNA, 16 bp, H. sapiens
ctgaagatgattttga

SEQ ID NO: 88423 - DNA, 16 bp, H. sapiens
ctgaagatggaggaag

SEQ ID NO: 88424 - DNA, 16 bp, H. sapiens
ctgaagatggatcatg

SEQ ID NO: 88425 - DNA, 16 bp, H. sapiens
ctgaagatgtgattga

SEQ ID NO: 88426 - DNA, 16 bp, H. sapiens
ctgaagatgtggctga

SEQ ID NO: 88427 - DNA, 16 bp, H. sapiens
ctgaagcaacagccca

SEQ ID NO: 88428 - DNA, 16 bp, H. sapiens
ctgaagcacagaaaag

SEQ ID NO: 88429 - DNA, 16 bp, H. sapiens
ctgaagcacagcacca

SEQ ID NO: 88430 - DNA, 24 bp, H. sapiens
ctgaagcacagcatcacagggaga

SEQ ID NO: 88431 - DNA, 16 bp, H. sapiens
ctgaagcagaagaatt

SEQ ID NO: 88432 - DNA, 16 bp, H. sapiens
ctgaagcagaagtggc

SEQ ID NO: 88433 - DNA, 16 bp, H. sapiens
ctgaagcagatcataa

SEQ ID NO: 88434 - DNA, 16 bp, H. sapiens
ctgaagcagcagccca

SEQ ID NO: 88435 - DNA, 16 bp, H. sapiens
ctgaagcagctggatt

SEQ ID NO: 88436 - DNA, 16 bp, H. sapiens
ctgaagcaggaagatt

SEQ ID NO: 88437 - DNA, 16 bp, H. sapiens
ctgaagcaggagattc

SEQ ID NO: 88438 - DNA, 16 bp, H. sapiens
ctgaagcaggaggatt

SEQ ID NO: 88439 - DNA, 16 bp, H. sapiens
ctgaagcaggataatt

SEQ ID NO: 88440 - DNA, 16 bp, H. sapiens
ctgaagcaggcagatt

SEQ ID NO: 88441 - DNA, 16 bp, H. sapiens
ctgaagcaggtcataa

SEQ ID NO: 88442 - DNA, 16 bp, H. sapiens
ctgaagcatttcccca

SEQ ID NO: 88443 - DNA, 16 bp, H. sapiens
ctgaagccacagccca

SEQ ID NO: 88444 - DNA, 16 bp, H. sapiens
ctgaagccagggagca

SEQ ID NO: 88445 - DNA, 16 bp, H. sapiens
ctgaagccatggtttt

SEQ ID NO: 88446 - DNA, 16 bp, H. sapiens
ctgaagcccagagaag

SEQ ID NO: 88447 - DNA, 16 bp, H. sapiens
ctgaagccccagaggg

SEQ ID NO: 88448 - DNA, 16 bp, H. sapiens
ctgaagccccagtggg

SEQ ID NO: 88449 - DNA, 16 bp, H. sapiens
ctgaagccctcaccag

SEQ ID NO: 88450 - DNA, 16 bp, H. sapiens
ctgaagcctctgcctc

SEQ ID NO: 88451 - DNA, 16 bp, H. sapiens
ctgaagccttcttctg

SEQ ID NO: 88452 - DNA, 16 bp, H. sapiens
ctgaagcgggaggatc

SEQ ID NO: 88453 - DNA, 16 bp, H. sapiens
ctgaagctcagagagc

SEQ ID NO: 88454 - DNA, 16 bp, H. sapiens
ctgaagctcaggagtt

SEQ ID NO: 88455 - DNA, 16 bp, H. sapiens
ctgaagctgaaaaatg

SEQ ID NO: 88456 - DNA, 16 bp, H. sapiens
ctgaagctggagaatt

SEQ ID NO: 88457 - DNA, 16 bp, H. sapiens
ctgaaggaagcagatt

SEQ ID NO: 88458 - DNA, 16 bp, H. sapiens
ctgaaggaagtagaga

SEQ ID NO: 88459 - DNA, 16 bp, H. sapiens
ctgaaggaatggtcca

SEQ ID NO: 88460 - DNA, 16 bp, H. sapiens
ctgaaggacatttggg

SEQ ID NO: 88461 - DNA, 18 bp, H. sapiens
ctgaaggactactgggta

SEQ ID NO: 88462 - DNA, 16 bp, H. sapiens
ctgaaggagataagag

SEQ ID NO: 88463 - DNA, 16 bp, H. sapiens
ctgaaggagatgggga

SEQ ID NO: 88464 - DNA, 16 bp, H. sapiens
ctgaaggagcagaagt

SEQ ID NO: 88465 - DNA, 16 bp, H. sapiens
ctgaaggagctagaga

SEQ ID NO: 88466 - DNA, 16 bp, H. sapiens
ctgaaggagctgggaa

SEQ ID NO: 88467 - DNA, 16 bp, H. sapiens
ctgaaggaggcctgcc

SEQ ID NO: 88468 - DNA, 16 bp, H. sapiens
ctgaaggaggtgagga

SEQ ID NO: 88469 - DNA, 16 bp, H. sapiens
ctgaaggatattttca

SEQ ID NO: 88470 - DNA, 16 bp, H. sapiens
ctgaaggatttttttt

SEQ ID NO: 88471 - DNA, 16 bp, H. sapiens
ctgaaggcaaattgct

SEQ ID NO: 88472 - DNA, 16 bp, H. sapiens
ctgaaggcaattttat

SEQ ID NO: 88473 - DNA, 16 bp, H. sapiens
ctgaaggcaggagaag

SEQ ID NO: 88474 - DNA, 16 bp, H. sapiens
ctgaaggcccgagagc

SEQ ID NO: 88475 - DNA, 16 bp, H. sapiens
ctgaaggcctgagaac

SEQ ID NO: 88476 - DNA, 16 bp, H. sapiens
ctgaaggctcagctgg

SEQ ID NO: 88477 - DNA, 16 bp, H. sapiens
ctgaaggctgagatgg

SEQ ID NO: 88478 - DNA, 16 bp, H. sapiens
ctgaaggcttcctctg

SEQ ID NO: 88479 - DNA, 16 bp, H. sapiens
ctgaagggggccagcc

SEQ ID NO: 88480 - DNA, 16 bp, H. sapiens
ctgaaggtaattttat

SEQ ID NO: 88481 - DNA, 16 bp, H. sapiens
ctgaaggtcacacagc

SEQ ID NO: 88482 - DNA, 16 bp, H. sapiens
ctgaaggtcaccagca

SEQ ID NO: 88483 - DNA, 16 bp, H. sapiens
ctgaaggtgaatgagg

SEQ ID NO: 88484 - DNA, 16 bp, H. sapiens
ctgaagtcagaagttc

SEQ ID NO: 88485 - DNA, 16 bp, H. sapiens
ctgaagtcgggagttc

SEQ ID NO: 88486 - DNA, 16 bp, H. sapiens
ctgaagtgatccacct

SEQ ID NO: 88487 - DNA, 16 bp, H. sapiens
ctgaagtgattttttt

SEQ ID NO: 88488 - DNA, 16 bp, H. sapiens
ctgaagtgcagtggga

SEQ ID NO: 88489 - DNA, 16 bp, H. sapiens
ctgaagtgcagtggtg

SEQ ID NO: 88490 - DNA, 16 bp, H. sapiens
ctgaagtggaaggatg

SEQ ID NO: 88491 - DNA, 16 bp, H. sapiens
ctgaagtgggagaata

SEQ ID NO: 88492 - DNA, 16 bp, H. sapiens
ctgaagtgggaggaca

SEQ ID NO: 88493 - DNA, 16 bp, H. sapiens
ctgaagtgggaggatt

SEQ ID NO: 88494 - DNA, 16 bp, H. sapiens
ctgaagtgtttttttt

SEQ ID NO: 88495 - DNA, 16 bp, H. sapiens
ctgaagttaggagttc

SEQ ID NO: 88496 - DNA, 16 bp, H. sapiens
ctgaagttatttttat

SEQ ID NO: 88497 - DNA, 16 bp, H. sapiens
ctgaagttcaagacca

SEQ ID NO: 88498 - DNA, 16 bp, H. sapiens
ctgaagttcagagaag

SEQ ID NO: 88499 - DNA, 16 bp, H. sapiens
ctgaagttgctgcaga

SEQ ID NO: 88500 - DNA, 16 bp, H. sapiens
ctgaagtttggggtat

SEQ ID NO: 88501 - DNA, 16 bp, H. sapiens
ctgaagttttcttttt

SEQ ID NO: 88502 - DNA, 16 bp, H. sapiens
ctgaagtttttctttt

SEQ ID NO: 88503 - DNA, 16 bp, H. sapiens
ctgaataaagagccct

SEQ ID NO: 88504 - DNA, 16 bp, H. sapiens
ctgaataaagtcttcc

SEQ ID NO: 88505 - DNA, 16 bp, H. sapiens
ctgaataaatattttt

SEQ ID NO: 88506 - DNA, 16 bp, H. sapiens
ctgaataaatgaatga

SEQ ID NO: 88507 - DNA, 16 bp, H. sapiens
ctgaatactataggca

SEQ ID NO: 88508 - DNA, 16 bp, H. sapiens
ctgaatactgtaggca

SEQ ID NO: 88509 - DNA, 18 bp, H. sapiens
ctgaatagaccaataaca

SEQ ID NO: 88510 - DNA, 16 bp, H. sapiens
ctgaataggccaataa

SEQ ID NO: 88511 - DNA, 16 bp, H. sapiens
ctgaatagtaatgcct

SEQ ID NO: 88512 - DNA, 16 bp, H. sapiens
ctgaatatattttgaa

SEQ ID NO: 88513 - DNA, 16 bp, H. sapiens
ctgaatatccttttta

SEQ ID NO: 88514 - DNA, 16 bp, H. sapiens
ctgaatatcttttcat

SEQ ID NO: 88515 - DNA, 16 bp, H. sapiens
ctgaatatggaaagga

SEQ ID NO: 88516 - DNA, 16 bp, H. sapiens
ctgaatatttatattt

SEQ ID NO: 88517 - DNA, 16 bp, H. sapiens
ctgaatattttaagcc

SEQ ID NO: 88518 - DNA, 16 bp, H. sapiens
ctgaatcagaaactct

SEQ ID NO: 88519 - DNA, 16 bp, H. sapiens
ctgaatcagaacctgc

SEQ ID NO: 88520 - DNA, 16 bp, H. sapiens
ctgaatccaggagttt

SEQ ID NO: 88521 - DNA, 16 bp, H. sapiens
ctgaatctaaaaaaaa

SEQ ID NO: 88522 - DNA, 16 bp, H. sapiens
ctgaatctaaagaaag

SEQ ID NO: 88523 - DNA, 16 bp, H. sapiens
ctgaatctaaccatga

SEQ ID NO: 88524 - DNA, 16 bp, H. sapiens
ctgaatctaatcatga

SEQ ID NO: 88525 - DNA, 16 bp, H. sapiens
ctgaatctacaaagaa

SEQ ID NO: 88526 - DNA, 16 bp, H. sapiens
ctgaatctgctggtgc

SEQ ID NO: 88527 - DNA, 16 bp, H. sapiens
ctgaatgaataaataa

SEQ ID NO: 88528 - DNA, 16 bp, H. sapiens
ctgaatgacaatagtg

SEQ ID NO: 88529 - DNA, 23 bp, H. sapiens
ctgaatgactactgggtaaataa

SEQ ID NO: 88530 - DNA, 16 bp, H. sapiens
ctgaatgagagaaaat

SEQ ID NO: 88531 - DNA, 16 bp, H. sapiens
ctgaatgatgaaaaca

SEQ ID NO: 88532 - DNA, 16 bp, H. sapiens
ctgaatgctgtaggca

SEQ ID NO: 88533 - DNA, 16 bp, H. sapiens
ctgaatgtctgtgtct

SEQ ID NO: 88534 - DNA, 16 bp, H. sapiens
ctgaatgtgtccccca

SEQ ID NO: 88535 - DNA, 16 bp, H. sapiens
ctgaatgtgtctgtga

SEQ ID NO: 88536 - DNA, 16 bp, H. sapiens
ctgaatgtgtgttctg

SEQ ID NO: 88537 - DNA, 16 bp, H. sapiens
ctgaatgtttatgtcc

SEQ ID NO: 88538 - DNA, 16 bp, H. sapiens
ctgaatgtttgcattt

SEQ ID NO: 88539 - DNA, 16 bp, H. sapiens
ctgaatgtttgtgtcc

SEQ ID NO: 88540 - DNA, 16 bp, H. sapiens
ctgaatgtttgtgttc

SEQ ID NO: 88541 - DNA, 16 bp, H. sapiens
ctgaattaataaatga

SEQ ID NO: 88542 - DNA, 16 bp, H. sapiens
ctgaattaatttgctt

SEQ ID NO: 88543 - DNA, 16 bp, H. sapiens
ctgaattattttaaaa

SEQ ID NO: 88544 - DNA, 16 bp, H. sapiens
ctgaattccagcctgg

SEQ ID NO: 88545 - DNA, 16 bp, H. sapiens
ctgaattcctgggctc

SEQ ID NO: 88546 - DNA, 16 bp, H. sapiens
ctgaattcttgacttc

SEQ ID NO: 88547 - DNA, 16 bp, H. sapiens
ctgaattctttcccca

SEQ ID NO: 88548 - DNA, 16 bp, H. sapiens
ctgaattctttttctt

SEQ ID NO: 88549 - DNA, 16 bp, H. sapiens
ctgaattgaaagaaag

SEQ ID NO: 88550 - DNA, 16 bp, H. sapiens
ctgaattgctacaatc

SEQ ID NO: 88551 - DNA, 16 bp, H. sapiens
ctgaattgtgtccccc

SEQ ID NO: 88552 - DNA, 16 bp, H. sapiens
ctgaattgtttttctg

SEQ ID NO: 88553 - DNA, 16 bp, H. sapiens
ctgaatttcatcaaat

SEQ ID NO: 88554 - DNA, 16 bp, H. sapiens
ctgaatttctccattc

SEQ ID NO: 88555 - DNA, 16 bp, H. sapiens
ctgaatttgaattgga

SEQ ID NO: 88556 - DNA, 16 bp, H. sapiens
ctgaatttgattgttg

SEQ ID NO: 88557 - DNA, 16 bp, H. sapiens
ctgaatttggaaaact

SEQ ID NO: 88558 - DNA, 16 bp, H. sapiens
ctgaatttgttcatta

SEQ ID NO: 88559 - DNA, 16 bp, H. sapiens
ctgaatttgtttatta

SEQ ID NO: 88560 - DNA, 16 bp, H. sapiens
ctgaattttaatattt

SEQ ID NO: 88561 - DNA, 16 bp, H. sapiens
ctgaattttatgtttg

SEQ ID NO: 88562 - DNA, 16 bp, H. sapiens
ctgaattttgtcaagt

SEQ ID NO: 88563 - DNA, 16 bp, H. sapiens
ctgaatttttcacttt

SEQ ID NO: 88564 - DNA, 16 bp, H. sapiens
ctgacaaaaagaagaa

SEQ ID NO: 88565 - DNA, 16 bp, H. sapiens
ctgacaaaagattaat

SEQ ID NO: 88566 - DNA, 16 bp, H. sapiens
ctgacaaagctgtcct

SEQ ID NO: 88567 - DNA, 16 bp, H. sapiens
ctgacaaagttgattt

SEQ ID NO: 88568 - DNA, 16 bp, H. sapiens
ctgacaaccactaatc

SEQ ID NO: 88569 - DNA, 16 bp, H. sapiens
ctgacaactttcacac

SEQ ID NO: 88570 - DNA, 16 bp, H. sapiens
ctgacaatatcaaatg

SEQ ID NO: 88571 - DNA, 16 bp, H. sapiens
ctgacaatgcagtaga

SEQ ID NO: 88572 - DNA, 16 bp, H. sapiens
ctgacacaccagcccc

SEQ ID NO: 88573 - DNA, 16 bp, H. sapiens
ctgacacccaagctgg

SEQ ID NO: 88574 - DNA, 16 bp, H. sapiens
ctgacacctttgaaac

SEQ ID NO: 88575 - DNA, 16 bp, H. sapiens
ctgacactttgatttt

SEQ ID NO: 88576 - DNA, 16 bp, H. sapiens
ctgacagaaacaagca

SEQ ID NO: 88577 - DNA, 16 bp, H. sapiens
ctgacagaagggaaga

SEQ ID NO: 88578 - DNA, 16 bp, H. sapiens
ctgacagaatgagacc

SEQ ID NO: 88579 - DNA, 16 bp, H. sapiens
ctgacagagcaggagc

SEQ ID NO: 88580 - DNA, 16 bp, H. sapiens
ctgacagatttgaaga

SEQ ID NO: 88581 - DNA, 16 bp, H. sapiens
ctgacagcatccaatc

SEQ ID NO: 88582 - DNA, 16 bp, H. sapiens
ctgacagccacctcca

SEQ ID NO: 88583 - DNA, 16 bp, H. sapiens
ctgacagccagcaagg

SEQ ID NO: 88584 - DNA, 16 bp, H. sapiens
ctgacagcctggaaca

SEQ ID NO: 88585 - DNA, 16 bp, H. sapiens
ctgacagctctgaaga

SEQ ID NO: 88586 - DNA, 16 bp, H. sapiens
ctgacagcttgcattg

SEQ ID NO: 88587 - DNA, 16 bp, H. sapiens
ctgacagctttaaaga

SEQ ID NO: 88588 - DNA, 16 bp, H. sapiens
ctgacaggcccaggag

SEQ ID NO: 88589 - DNA, 16 bp, H. sapiens
ctgacaggccctggtg

SEQ ID NO: 88590 - DNA, 16 bp, H. sapiens
ctgacaggcctcagtg

SEQ ID NO: 88591 - DNA, 16 bp, H. sapiens
ctgacagttttataaa

SEQ ID NO: 88592 - DNA, 16 bp, H. sapiens
ctgacatcaagtgatc

SEQ ID NO: 88593 - DNA, 16 bp, H. sapiens
ctgacatcaggtgatc

SEQ ID NO: 88594 - DNA, 16 bp, H. sapiens
ctgacatggaatttaa

SEQ ID NO: 88595 - DNA, 16 bp, H. sapiens
ctgacatggtgaaatc

SEQ ID NO: 88596 - DNA, 16 bp, H. sapiens
ctgacattcctggtgt

SEQ ID NO: 88597 - DNA, 16 bp, H. sapiens
ctgacattttgatttt

SEQ ID NO: 88598 - DNA, 16 bp, H. sapiens
ctgaccaaaacaggat

SEQ ID NO: 88599 - DNA, 16 bp, H. sapiens
ctgaccaaagtttatt

SEQ ID NO: 88600 - DNA, 16 bp, H. sapiens
ctgaccaacaaggaga

SEQ ID NO: 88601 - DNA, 18 bp, H. sapiens
ctgaccaacatgtagaaa

SEQ ID NO: 88602 - DNA, 16 bp, H. sapiens
ctgaccaacattgaga

SEQ ID NO: 88603 - DNA, 16 bp, H. sapiens
ctgaccaacctggaga

SEQ ID NO: 88604 - DNA, 16 bp, H. sapiens
ctgaccaacgtggtga

SEQ ID NO: 88605 - DNA, 18 bp, H. sapiens
ctgaccaatacggtgaaa

SEQ ID NO: 88606 - DNA, 26 bp, H. sapiens
ctgaccaatatggtgaaaccccatct

SEQ ID NO: 88607 - DNA, 16 bp, H. sapiens
ctgaccaatcagcact

SEQ ID NO: 88608 - DNA, 16 bp, H. sapiens
ctgaccacaaggcacc

SEQ ID NO: 88609 - DNA, 16 bp, H. sapiens
ctgaccaccctgggca

SEQ ID NO: 88610 - DNA, 16 bp, H. sapiens
ctgaccccaaagcctg

SEQ ID NO: 88611 - DNA, 16 bp, H. sapiens
ctgaccccacaacagg

SEQ ID NO: 88612 - DNA, 16 bp, H. sapiens
ctgaccccagagccca

SEQ ID NO: 88613 - DNA, 16 bp, H. sapiens
ctgaccccagccccag

SEQ ID NO: 88614 - DNA, 16 bp, H. sapiens
ctgacccctctgcctg

SEQ ID NO: 88615 - DNA, 16 bp, H. sapiens
ctgacccctgacccca

SEQ ID NO: 88616 - DNA, 16 bp, H. sapiens
ctgacccctgacccct

SEQ ID NO: 88617 - DNA, 16 bp, H. sapiens
ctgacccctgagcagc

SEQ ID NO: 88618 - DNA, 16 bp, H. sapiens
ctgaccccttcttcca

SEQ ID NO: 88619 - DNA, 16 bp, H. sapiens
ctgaccctctccccac

SEQ ID NO: 88620 - DNA, 16 bp, H. sapiens
ctgaccctgaccctga

SEQ ID NO: 88621 - DNA, 16 bp, H. sapiens
ctgaccctggccctga

SEQ ID NO: 88622 - DNA, 16 bp, H. sapiens
ctgaccctttgctcat

SEQ ID NO: 88623 - DNA, 16 bp, H. sapiens
ctgaccgggtgcagtg

SEQ ID NO: 88624 - DNA, 16 bp, H. sapiens
ctgacctaactgactc

SEQ ID NO: 88625 - DNA, 16 bp, H. sapiens
ctgacctcaaatgatt

SEQ ID NO: 88626 - DNA, 16 bp, H. sapiens
ctgacctcaagcagtt

SEQ ID NO: 88627 - DNA, 16 bp, H. sapiens
ctgacctcaaggtgat

SEQ ID NO: 88628 - DNA, 16 bp, H. sapiens
ctgacctcaagtaatc

SEQ ID NO: 88629 - DNA, 16 bp, H. sapiens
ctgacctcagaagatc

SEQ ID NO: 88630 - DNA, 16 bp, H. sapiens
ctgacctcagataatc

SEQ ID NO: 88631 - DNA, 16 bp, H. sapiens
ctgacctcatgaacca

SEQ ID NO: 88632 - DNA, 16 bp, H. sapiens
ctgacctcatgatcaa

SEQ ID NO: 88633 - DNA, 16 bp, H. sapiens
ctgacctccacaatgg

SEQ ID NO: 88634 - DNA, 16 bp, H. sapiens
ctgacctccagcctgg

SEQ ID NO: 88635 - DNA, 16 bp, H. sapiens
ctgacctcccaggctc

SEQ ID NO: 88636 - DNA, 16 bp, H. sapiens
ctgacctccccacctc

SEQ ID NO: 88637 - DNA, 16 bp, H. sapiens
ctgacctcgagatccg

SEQ ID NO: 88638 - DNA, 16 bp, H. sapiens
ctgacctctcccaaat

SEQ ID NO: 88639 - DNA, 16 bp, H. sapiens
ctgacctctgacctct

SEQ ID NO: 88640 - DNA, 16 bp, H. sapiens
ctgacctctgatgatc

SEQ ID NO: 88641 - DNA, 16 bp, H. sapiens
ctgacctctgcctgcc

SEQ ID NO: 88642 - DNA, 16 bp, H. sapiens
ctgacctgcaacaaaa

SEQ ID NO: 88643 - DNA, 16 bp, H. sapiens
ctgacctgttgccagc

SEQ ID NO: 88644 - DNA, 16 bp, H. sapiens
ctgaccttaaatgatc

SEQ ID NO: 88645 - DNA, 16 bp, H. sapiens
ctgaccttcctcagtc

SEQ ID NO: 88646 - DNA, 16 bp, H. sapiens
ctgaccttctccccac

SEQ ID NO: 88647 - DNA, 16 bp, H. sapiens
ctgaccttctcctgcc

SEQ ID NO: 88648 - DNA, 16 bp, H. sapiens
ctgacctttgacaaag

SEQ ID NO: 88649 - DNA, 16 bp, H. sapiens
ctgacgcacgtggccc

SEQ ID NO: 88650 - DNA, 16 bp, H. sapiens
ctgacggtggagagag

SEQ ID NO: 88651 - DNA, 18 bp, H. sapiens
ctgactaacacggtgaaa

SEQ ID NO: 88652 - DNA, 18 bp, H. sapiens
ctgactaacatggtgaaa

SEQ ID NO: 88653 - DNA, 16 bp, H. sapiens
ctgactagctgggatt

SEQ ID NO: 88654 - DNA, 16 bp, H. sapiens
ctgactatcctaaata

SEQ ID NO: 88655 - DNA, 16 bp, H. sapiens
ctgactcaaatgttag

SEQ ID NO: 88656 - DNA, 16 bp, H. sapiens
ctgactcagcctctgg

SEQ ID NO: 88657 - DNA, 16 bp, H. sapiens
ctgactcagccttcca

SEQ ID NO: 88658 - DNA, 16 bp, H. sapiens
ctgactccaaagcctg

SEQ ID NO: 88659 - DNA, 16 bp, H. sapiens
ctgactccaatcccag

SEQ ID NO: 88660 - DNA, 16 bp, H. sapiens
ctgactccacatttcc

SEQ ID NO: 88661 - DNA, 16 bp, H. sapiens
ctgactccagagctca

SEQ ID NO: 88662 - DNA, 16 bp, H. sapiens
ctgactccaggccctg

SEQ ID NO: 88663 - DNA, 16 bp, H. sapiens
ctgactcccagccctg

SEQ ID NO: 88664 - DNA, 16 bp, H. sapiens
ctgactcccaggccag

SEQ ID NO: 88665 - DNA, 17 bp, H. sapiens
ctgactcccccacctcc

SEQ ID NO: 88666 - DNA, 16 bp, H. sapiens
ctgactctactaaaaa

SEQ ID NO: 88667 - DNA, 24 bp, H. sapiens
ctgactctcttttcggactcagcc

SEQ ID NO: 88668 - DNA, 16 bp, H. sapiens
ctgactctgaagagag

SEQ ID NO: 88669 - DNA, 16 bp, H. sapiens
ctgactctgcctccca

SEQ ID NO: 88670 - DNA, 16 bp, H. sapiens
ctgactctgcctcctg

SEQ ID NO: 88671 - DNA, 16 bp, H. sapiens
ctgactcttccaaatt

SEQ ID NO: 88672 - DNA, 16 bp, H. sapiens
ctgactcttctgcctc

SEQ ID NO: 88673 - DNA, 16 bp, H. sapiens
ctgactctttccagca

SEQ ID NO: 88674 - DNA, 16 bp, H. sapiens
ctgactgactccttcc

SEQ ID NO: 88675 - DNA, 16 bp, H. sapiens
ctgactgcaaagccca

SEQ ID NO: 88676 - DNA, 16 bp, H. sapiens
ctgactgggcacggtg

SEQ ID NO: 88677 - DNA, 16 bp, H. sapiens
ctgactgggtgataaa

SEQ ID NO: 88678 - DNA, 16 bp, H. sapiens
ctgactggtgtgagac

SEQ ID NO: 88679 - DNA, 16 bp, H. sapiens
ctgacttatattttaa

SEQ ID NO: 88680 - DNA, 16 bp, H. sapiens
ctgacttcaaaacata

SEQ ID NO: 88681 - DNA, 16 bp, H. sapiens
ctgacttcaaactaga

SEQ ID NO: 88682 - DNA, 16 bp, H. sapiens
ctgacttcaagcaatt

SEQ ID NO: 88683 - DNA, 16 bp, H. sapiens
ctgacttcaggtgtga

SEQ ID NO: 88684 - DNA, 16 bp, H. sapiens
ctgacttcatttcctt

SEQ ID NO: 88685 - DNA, 16 bp, H. sapiens
ctgacttcctcttctg

SEQ ID NO: 88686 - DNA, 16 bp, H. sapiens
ctgacttcctggttca

SEQ ID NO: 88687 - DNA, 16 bp, H. sapiens
ctgacttctacaatgg

SEQ ID NO: 88688 - DNA, 16 bp, H. sapiens
ctgacttctatcacca

SEQ ID NO: 88689 - DNA, 16 bp, H. sapiens
ctgacttctgagaagg

SEQ ID NO: 88690 - DNA, 16 bp, H. sapiens
ctgacttctgcttctg

SEQ ID NO: 88691 - DNA, 16 bp, H. sapiens
ctgacttcttcctttc

SEQ ID NO: 88692 - DNA, 16 bp, H. sapiens
ctgacttgtaaggttt

SEQ ID NO: 88693 - DNA, 16 bp, H. sapiens
ctgactttaaaataaa

SEQ ID NO: 88694 - DNA, 16 bp, H. sapiens
ctgactttgtcaccca

SEQ ID NO: 88695 - DNA, 16 bp, H. sapiens
ctgacttttaattttt

SEQ ID NO: 88696 - DNA, 16 bp, H. sapiens
ctgactttttaataaa

SEQ ID NO: 88697 - DNA, 16 bp, H. sapiens
ctgagaaaaaaagaga

SEQ ID NO: 88698 - DNA, 16 bp, H. sapiens
ctgagaaaaaacttcc

SEQ ID NO: 88699 - DNA, 16 bp, H. sapiens
ctgagaaaaagaagca

SEQ ID NO: 88700 - DNA, 17 bp, H. sapiens
ctgagaaaaagaattca

SEQ ID NO: 88701 - DNA, 16 bp, H. sapiens
ctgagaaaagaaataa

SEQ ID NO: 88702 - DNA, 16 bp, H. sapiens
ctgagaaaattaaatt

SEQ ID NO: 88703 - DNA, 16 bp, H. sapiens
ctgagaaacagagcaa

SEQ ID NO: 88704 - DNA, 16 bp, H. sapiens
ctgagaaacctgaata

SEQ ID NO: 88705 - DNA, 16 bp, H. sapiens
ctgagaaactggattt

SEQ ID NO: 88706 - DNA, 16 bp, H. sapiens
ctgagaaactgtcaca

SEQ ID NO: 88707 - DNA, 16 bp, H. sapiens
ctgagaaacttcttgg

SEQ ID NO: 88708 - DNA, 16 bp, H. sapiens
ctgagaaagaagagaa

SEQ ID NO: 88709 - DNA, 16 bp, H. sapiens
ctgagaaaggtgagga

SEQ ID NO: 88710 - DNA, 16 bp, H. sapiens
ctgagaaataaaaaga

SEQ ID NO: 88711 - DNA, 16 bp, H. sapiens
ctgagaaatctgttgt

SEQ ID NO: 88712 - DNA, 16 bp, H. sapiens
ctgagaaatggaacaa

SEQ ID NO: 88713 - DNA, 16 bp, H. sapiens
ctgagaaatttataaa

SEQ ID NO: 88714 - DNA, 16 bp, H. sapiens
ctgagaacatggacag

SEQ ID NO: 88715 - DNA, 16 bp, H. sapiens
ctgagaaccactgctg

SEQ ID NO: 88716 - DNA, 16 bp, H. sapiens
ctgagaaccactgttc

SEQ ID NO: 88717 - DNA, 16 bp, H. sapiens
ctgagaacctgcattt

SEQ ID NO: 88718 - DNA, 16 bp, H. sapiens
ctgagaacgggcagac

SEQ ID NO: 88719 - DNA, 16 bp, H. sapiens
ctgagaactcagtttt

SEQ ID NO: 88720 - DNA, 16 bp, H. sapiens
ctgagaactctatcac

SEQ ID NO: 88721 - DNA, 16 bp, H. sapiens
ctgagaactggaaaaa

SEQ ID NO: 88722 - DNA, 16 bp, H. sapiens
ctgagaagaaaaacaa

SEQ ID NO: 88723 - DNA, 16 bp, H. sapiens
ctgagaagtccaagat

SEQ ID NO: 88724 - DNA, 16 bp, H. sapiens
ctgagaagtcctgcag

SEQ ID NO: 88725 - DNA, 16 bp, H. sapiens
ctgagaagtgaggaaa

SEQ ID NO: 88726 - DNA, 16 bp, H. sapiens
ctgagaagttccacaa

SEQ ID NO: 88727 - DNA, 16 bp, H. sapiens
ctgagaatatttttaa

SEQ ID NO: 88728 - DNA, 16 bp, H. sapiens
ctgagaatctgcattt

SEQ ID NO: 88729 - DNA, 16 bp, H. sapiens
ctgagaatgaacagac

SEQ ID NO: 88730 - DNA, 16 bp, H. sapiens
ctgagaatgatgactt

SEQ ID NO: 88731 - DNA, 16 bp, H. sapiens
ctgagaatgatgtttt

SEQ ID NO: 88732 - DNA, 16 bp, H. sapiens
ctgagaatgctgctgt

SEQ ID NO: 88733 - DNA, 16 bp, H. sapiens
ctgagaatggggaagg

SEQ ID NO: 88734 - DNA, 16 bp, H. sapiens
ctgagaattaaataaa

SEQ ID NO: 88735 - DNA, 16 bp, H. sapiens
ctgagaattatggttt

SEQ ID NO: 88736 - DNA, 16 bp, H. sapiens
ctgagaattttccaaa

SEQ ID NO: 88737 - DNA, 16 bp, H. sapiens
ctgagacaaaaggaaa

SEQ ID NO: 88738 - DNA, 16 bp, H. sapiens
ctgagacaagagaatg

SEQ ID NO: 88739 - DNA, 16 bp, H. sapiens
ctgagacacagagagg

SEQ ID NO: 88740 - DNA, 16 bp, H. sapiens
ctgagacagaaaaatt

SEQ ID NO: 88741 - DNA, 16 bp, H. sapiens
ctgagacaggaggatc

SEQ ID NO: 88742 - DNA, 16 bp, H. sapiens
ctgagacagggtctgg

SEQ ID NO: 88743 - DNA, 16 bp, H. sapiens
ctgagacattttgtca

SEQ ID NO: 88744 - DNA, 16 bp, H. sapiens
ctgagaccaaactgca

SEQ ID NO: 88745 - DNA, 16 bp, H. sapiens
ctgagaccacagacat

SEQ ID NO: 88746 - DNA, 16 bp, H. sapiens
ctgagaccacagatgc

SEQ ID NO: 88747 - DNA, 16 bp, H. sapiens
ctgagaccacctcaga

SEQ ID NO: 88748 - DNA, 16 bp, H. sapiens
ctgagaccacttcagc

SEQ ID NO: 88749 - DNA, 16 bp, H. sapiens
ctgagaccagcctggt

SEQ ID NO: 88750 - DNA, 16 bp, H. sapiens
ctgagaccataggcac

SEQ ID NO: 88751 - DNA, 16 bp, H. sapiens
ctgagaccctttcagg

SEQ ID NO: 88752 - DNA, 17 bp, H. sapiens
ctgagacctactgggct

SEQ ID NO: 88753 - DNA, 16 bp, H. sapiens
ctgagacctactgggt

SEQ ID NO: 88754 - DNA, 16 bp, H. sapiens
ctgagacctcatctct

SEQ ID NO: 88755 - DNA, 16 bp, H. sapiens
ctgagactaggaagag

SEQ ID NO: 88756 - DNA, 16 bp, H. sapiens
ctgagactcagagagt

SEQ ID NO: 88757 - DNA, 16 bp, H. sapiens
ctgagactgcaggcat

SEQ ID NO: 88758 - DNA, 16 bp, H. sapiens
ctgagactggaaaatt

SEQ ID NO: 88759 - DNA, 16 bp, H. sapiens
ctgagactttcttttt

SEQ ID NO: 88760 - DNA, 16 bp, H. sapiens
ctgagactttgcagaa

SEQ ID NO: 88761 - DNA, 16 bp, H. sapiens
ctgagactttgcttaa

SEQ ID NO: 88762 - DNA, 16 bp, H. sapiens
ctgagagacagtttgc

SEQ ID NO: 88763 - DNA, 16 bp, H. sapiens
ctgagagacccataga

SEQ ID NO: 88764 - DNA, 16 bp, H. sapiens
ctgagagagaaggaga

SEQ ID NO: 88765 - DNA, 16 bp, H. sapiens
ctgagagagacagaga

SEQ ID NO: 88766 - DNA, 16 bp, H. sapiens
ctgagagatgtgatcc

SEQ ID NO: 88767 - DNA, 16 bp, H. sapiens
ctgagagatgttgtca

SEQ ID NO: 88768 - DNA, 16 bp, H. sapiens
ctgagagattcctctg

SEQ ID NO: 88769 - DNA, 16 bp, H. sapiens
ctgagagatttcatca

SEQ ID NO: 88770 - DNA, 16 bp, H. sapiens
ctgagagatttggtca

SEQ ID NO: 88771 - DNA, 16 bp, H. sapiens
ctgagagcacagtggg

SEQ ID NO: 88772 - DNA, 16 bp, H. sapiens
ctgagagccaaatcag

SEQ ID NO: 88773 - DNA, 16 bp, H. sapiens
ctgagagccacctcca

SEQ ID NO: 88774 - DNA, 16 bp, H. sapiens
ctgagagccactttca

SEQ ID NO: 88775 - DNA, 16 bp, H. sapiens
ctgagagctgcagaga

SEQ ID NO: 88776 - DNA, 16 bp, H. sapiens
ctgagagctgggaaga

SEQ ID NO: 88777 - DNA, 16 bp, H. sapiens
ctgagagctggggctg

SEQ ID NO: 88778 - DNA, 16 bp, H. sapiens
ctgagagcttcagaga

SEQ ID NO: 88779 - DNA, 16 bp, H. sapiens
ctgagagctttccttt

SEQ ID NO: 88780 - DNA, 16 bp, H. sapiens
ctgagagctttctttt

SEQ ID NO: 88781 - DNA, 16 bp, H. sapiens
ctgagaggaggtggag

SEQ ID NO: 88782 - DNA, 16 bp, H. sapiens
ctgagaggcagagatt

SEQ ID NO: 88783 - DNA, 16 bp, H. sapiens
ctgagagtccagaaat

SEQ ID NO: 88784 - DNA, 18 bp, H. sapiens
ctgagagtgatggtttcc

SEQ ID NO: 88785 - DNA, 16 bp, H. sapiens
ctgagagtgtggttgg

SEQ ID NO: 88786 - DNA, 16 bp, H. sapiens
ctgagataggagaaaa

SEQ ID NO: 88787 - DNA, 16 bp, H. sapiens
ctgagatattgggagt

SEQ ID NO: 88788 - DNA, 16 bp, H. sapiens
ctgagatcaatgagga

SEQ ID NO: 88789 - DNA, 16 bp, H. sapiens
ctgagatcacacagct

SEQ ID NO: 88790 - DNA, 16 bp, H. sapiens
ctgagatcataccact

SEQ ID NO: 88791 - DNA, 16 bp, H. sapiens
ctgagatccaactgca

SEQ ID NO: 88792 - DNA, 16 bp, H. sapiens
ctgagatcgggagttc

SEQ ID NO: 88793 - DNA, 16 bp, H. sapiens
ctgagatctcgccact

SEQ ID NO: 88794 - DNA, 16 bp, H. sapiens
ctgagatctgaggaca

SEQ ID NO: 88795 - DNA, 16 bp, H. sapiens
ctgagatgaaacttcc

SEQ ID NO: 88796 - DNA, 17 bp, H. sapiens
ctgagatgaaacttcca

SEQ ID NO: 88797 - DNA, 17 bp, H. sapiens
ctgagatgaagcttcca

SEQ ID NO: 88798 - DNA, 16 bp, H. sapiens
ctgagatgaatgaaca

SEQ ID NO: 88799 - DNA, 16 bp, H. sapiens
ctgagatgacaggcgt

SEQ ID NO: 88800 - DNA, 16 bp, H. sapiens
ctgagatgcagggcac

SEQ ID NO: 88801 - DNA, 16 bp, H. sapiens
ctgagatggagatgag

SEQ ID NO: 88802 - DNA, 16 bp, H. sapiens
ctgagatgggaggata

SEQ ID NO: 88803 - DNA, 16 bp, H. sapiens
ctgagatgggggaaaa

SEQ ID NO: 88804 - DNA, 16 bp, H. sapiens
ctgagatgggtggatt

SEQ ID NO: 88805 - DNA, 23 bp, H. sapiens
ctgagatgtttgggtggagagaa

SEQ ID NO: 88806 - DNA, 16 bp, H. sapiens
ctgagattaaaaaaaa

SEQ ID NO: 88807 - DNA, 16 bp, H. sapiens
ctgagattacaggcac

SEQ ID NO: 88808 - DNA, 19 bp, H. sapiens
ctgagattacaggcgccca

SEQ ID NO: 88809 - DNA, 17 bp, H. sapiens
ctgagattacaggtgca

SEQ ID NO: 88810 - DNA, 17 bp, H. sapiens
ctgagattacaggtgcc

SEQ ID NO: 88811 - DNA, 16 bp, H. sapiens
ctgagattcagagagg

SEQ ID NO: 88812 - DNA, 16 bp, H. sapiens
ctgagattctgcattt

SEQ ID NO: 88813 - DNA, 16 bp, H. sapiens
ctgagattgagccatt

SEQ ID NO: 88814 - DNA, 16 bp, H. sapiens
ctgagattgcaccttt

SEQ ID NO: 88815 - DNA, 16 bp, H. sapiens
ctgagattttactgaa

SEQ ID NO: 88816 - DNA, 16 bp, H. sapiens
ctgagattttgctgaa

SEQ ID NO: 88817 - DNA, 16 bp, H. sapiens
ctgagatttttatttt

SEQ ID NO: 88818 - DNA, 16 bp, H. sapiens
ctgagatttttgtttt

SEQ ID NO: 88819 - DNA, 16 bp, H. sapiens
ctgagcaacagaggaa

SEQ ID NO: 88820 - DNA, 16 bp, H. sapiens
ctgagcaacatggaaa

SEQ ID NO: 88821 - DNA, 16 bp, H. sapiens
ctgagcaacatggaga

SEQ ID NO: 88822 - DNA, 16 bp, H. sapiens
ctgagcaacatggcaa

SEQ ID NO: 88823 - DNA, 16 bp, H. sapiens
ctgagcaacatggcag

SEQ ID NO: 88824 - DNA, 16 bp, H. sapiens
ctgagcacagtggcaa

SEQ ID NO: 88825 - DNA, 19 bp, H. sapiens
ctgagcaccttgtgacccc

SEQ ID NO: 88826 - DNA, 16 bp, H. sapiens
ctgagcactttgggag

SEQ ID NO: 88827 - DNA, 16 bp, H. sapiens
ctgagcagcagcaaga

SEQ ID NO: 88828 - DNA, 16 bp, H. sapiens
ctgagcaggaggagga

SEQ ID NO: 88829 - DNA, 16 bp, H. sapiens
ctgagcagtgttttac

SEQ ID NO: 88830 - DNA, 16 bp, H. sapiens
ctgagcatcactggga

SEQ ID NO: 88831 - DNA, 16 bp, H. sapiens
ctgagcatgatggcat

SEQ ID NO: 88832 - DNA, 16 bp, H. sapiens
ctgagcatgctagctc

SEQ ID NO: 88833 - DNA, 16 bp, H. sapiens
ctgagccaaaagagct

SEQ ID NO: 88834 - DNA, 16 bp, H. sapiens
ctgagccaatcactgt

SEQ ID NO: 88835 - DNA, 16 bp, H. sapiens
ctgagccacagagagg

SEQ ID NO: 88836 - DNA, 16 bp, H. sapiens
ctgagccaccgtgccc

SEQ ID NO: 88837 - DNA, 16 bp, H. sapiens
ctgagccagaaccatc

SEQ ID NO: 88838 - DNA, 16 bp, H. sapiens
ctgagccagactctgt

SEQ ID NO: 88839 - DNA, 16 bp, H. sapiens
ctgagccaggtgcagg

SEQ ID NO: 88840 - DNA, 17 bp, H. sapiens
ctgagccaggtgcggga

SEQ ID NO: 88841 - DNA, 16 bp, H. sapiens
ctgagcccaaggaggt

SEQ ID NO: 88842 - DNA, 16 bp, H. sapiens
ctgagcccaatcctaa

SEQ ID NO: 88843 - DNA, 16 bp, H. sapiens
ctgagcccagcacagc

SEQ ID NO: 88844 - DNA, 16 bp, H. sapiens
ctgagcccagcactgc

SEQ ID NO: 88845 - DNA, 16 bp, H. sapiens
ctgagcccagcccaaa

SEQ ID NO: 88846 - DNA, 16 bp, H. sapiens
ctgagcccagcccagc

SEQ ID NO: 88847 - DNA, 16 bp, H. sapiens
ctgagcccagccttcc

SEQ ID NO: 88848 - DNA, 16 bp, H. sapiens
ctgagcccagctcagc

SEQ ID NO: 88849 - DNA, 16 bp, H. sapiens
ctgagcccaggaggtc

SEQ ID NO: 88850 - DNA, 16 bp, H. sapiens
ctgagcccaggaggtt

SEQ ID NO: 88851 - DNA, 16 bp, H. sapiens
ctgagcccaggcactg

SEQ ID NO: 88852 - DNA, 16 bp, H. sapiens
ctgagcccagggtccc

SEQ ID NO: 88853 - DNA, 16 bp, H. sapiens
ctgagcccattgaggc

SEQ ID NO: 88854 - DNA, 16 bp, H. sapiens
ctgagccccaccccca

SEQ ID NO: 88855 - DNA, 16 bp, H. sapiens
ctgagccccagagcct

SEQ ID NO: 88856 - DNA, 16 bp, H. sapiens
ctgagcccccacctcc

SEQ ID NO: 88857 - DNA, 16 bp, H. sapiens
ctgagccctgaccctg

SEQ ID NO: 88858 - DNA, 16 bp, H. sapiens
ctgagccctgatcctg

SEQ ID NO: 88859 - DNA, 16 bp, H. sapiens
ctgagccctgccctgc

SEQ ID NO: 88860 - DNA, 16 bp, H. sapiens
ctgagccctgcctcct

SEQ ID NO: 88861 - DNA, 16 bp, H. sapiens
ctgagccctgcttctg

SEQ ID NO: 88862 - DNA, 16 bp, H. sapiens
ctgagccctggccctg

SEQ ID NO: 88863 - DNA, 16 bp, H. sapiens
ctgagcctcagattcc

SEQ ID NO: 88864 - DNA, 16 bp, H. sapiens
ctgagcctcagtctcc

SEQ ID NO: 88865 - DNA, 16 bp, H. sapiens
ctgagcctcagtgtcc

SEQ ID NO: 88866 - DNA, 16 bp, H. sapiens
ctgagcctcagtttct

SEQ ID NO: 88867 - DNA, 16 bp, H. sapiens
ctgagcctcagtttgc

SEQ ID NO: 88868 - DNA, 16 bp, H. sapiens
ctgagcctcccccacc

SEQ ID NO: 88869 - DNA, 16 bp, H. sapiens
ctgagcctcggtttcc

SEQ ID NO: 88870 - DNA, 16 bp, H. sapiens
ctgagcctctgtgtcc

SEQ ID NO: 88871 - DNA, 16 bp, H. sapiens
ctgagcctgcagtgag

SEQ ID NO: 88872 - DNA, 16 bp, H. sapiens
ctgagcctggaaaagt

SEQ ID NO: 88873 - DNA, 16 bp, H. sapiens
ctgagcctggcctctt

SEQ ID NO: 88874 - DNA, 16 bp, H. sapiens
ctgagcctggcctggg

SEQ ID NO: 88875 - DNA, 16 bp, H. sapiens
ctgagcctggcctggt

SEQ ID NO: 88876 - DNA, 18 bp, H. sapiens
ctgagcctgggaggtcaa

SEQ ID NO: 88877 - DNA, 16 bp, H. sapiens
ctgagccttccaagtc

SEQ ID NO: 88878 - DNA, 16 bp, H. sapiens
ctgagccttggtgtcc

SEQ ID NO: 88879 - DNA, 16 bp, H. sapiens
ctgagcgacagtgaga

SEQ ID NO: 88880 - DNA, 16 bp, H. sapiens
ctgagctaaaggagga

SEQ ID NO: 88881 - DNA, 16 bp, H. sapiens
ctgagctcaagcgatc

SEQ ID NO: 88882 - DNA, 16 bp, H. sapiens
ctgagctcaagctatt

SEQ ID NO: 88883 - DNA, 16 bp, H. sapiens
ctgagctcaaggaatt

SEQ ID NO: 88884 - DNA, 16 bp, H. sapiens
ctgagctcatgatcca

SEQ ID NO: 88885 - DNA, 16 bp, H. sapiens
ctgagctccctgagtg

SEQ ID NO: 88886 - DNA, 16 bp, H. sapiens
ctgagctcgagcgatc

SEQ ID NO: 88887 - DNA, 16 bp, H. sapiens
ctgagctctgcctctt

SEQ ID NO: 88888 - DNA, 16 bp, H. sapiens
ctgagctctgcttcct

SEQ ID NO: 88889 - DNA, 16 bp, H. sapiens
ctgagctctggaagcc

SEQ ID NO: 88890 - DNA, 16 bp, H. sapiens
ctgagctctgggagcc

SEQ ID NO: 88891 - DNA, 16 bp, H. sapiens
ctgagctgagccaggc

SEQ ID NO: 88892 - DNA, 16 bp, H. sapiens
ctgagctgcagctgga

SEQ ID NO: 88893 - DNA, 16 bp, H. sapiens
ctgagctgcaggagga

SEQ ID NO: 88894 - DNA, 16 bp, H. sapiens
ctgagctgcagtttcc

SEQ ID NO: 88895 - DNA, 16 bp, H. sapiens
ctgagctgcccaaggc

SEQ ID NO: 88896 - DNA, 16 bp, H. sapiens
ctgagctgctactctg

SEQ ID NO: 88897 - DNA, 16 bp, H. sapiens
ctgagctgggaggatt

SEQ ID NO: 88898 - DNA, 16 bp, H. sapiens
ctgagctgggcctggg

SEQ ID NO: 88899 - DNA, 16 bp, H. sapiens
ctgagctgggctgggc

SEQ ID NO: 88900 - DNA, 16 bp, H. sapiens
ctgagctggggcctgg

SEQ ID NO: 88901 - DNA, 16 bp, H. sapiens
ctgagctgtacgttgg

SEQ ID NO: 88902 - DNA, 16 bp, H. sapiens
ctgagcttcagttttt

SEQ ID NO: 88903 - DNA, 16 bp, H. sapiens
ctgagcttcccaaagt

SEQ ID NO: 88904 - DNA, 16 bp, H. sapiens
ctgagcttgttttcct

SEQ ID NO: 88905 - DNA, 16 bp, H. sapiens
ctgagctttacacagc

SEQ ID NO: 88906 - DNA, 16 bp, H. sapiens
ctgagcttttgctcac

SEQ ID NO: 88907 - DNA, 16 bp, H. sapiens
ctgaggaaaaagagaa

SEQ ID NO: 88908 - DNA, 16 bp, H. sapiens
ctgaggaaaacaagca

SEQ ID NO: 88909 - DNA, 16 bp, H. sapiens
ctgaggaacaaggaag

SEQ ID NO: 88910 - DNA, 16 bp, H. sapiens
ctgaggaacaaggaga

SEQ ID NO: 88911 - DNA, 16 bp, H. sapiens
ctgaggaagaagaatg

SEQ ID NO: 88912 - DNA, 16 bp, H. sapiens
ctgaggaagaagaatt

SEQ ID NO: 88913 - DNA, 16 bp, H. sapiens
ctgaggaagaagataa

SEQ ID NO: 88914 - DNA, 16 bp, H. sapiens
ctgaggaagaggagaa

SEQ ID NO: 88915 - DNA, 16 bp, H. sapiens
ctgaggaaggaagatt

SEQ ID NO: 88916 - DNA, 16 bp, H. sapiens
ctgaggaaggagaact

SEQ ID NO: 88917 - DNA, 16 bp, H. sapiens
ctgaggaaggaggaag

SEQ ID NO: 88918 - DNA, 16 bp, H. sapiens
ctgaggaaggaggatg

SEQ ID NO: 88919 - DNA, 16 bp, H. sapiens
ctgaggaaggaggatt

SEQ ID NO: 88920 - DNA, 16 bp, H. sapiens
ctgaggaatcgccgca

SEQ ID NO: 88921 - DNA, 16 bp, H. sapiens
ctgaggaatttcatca

SEQ ID NO: 88922 - DNA, 16 bp, H. sapiens
ctgaggagaaaagaaa

SEQ ID NO: 88923 - DNA, 16 bp, H. sapiens
ctgaggagaattgctt

SEQ ID NO: 88924 - DNA, 16 bp, H. sapiens
ctgaggagatgggaga

SEQ ID NO: 88925 - DNA, 16 bp, H. sapiens
ctgaggagcaaggaaa

SEQ ID NO: 88926 - DNA, 16 bp, H. sapiens
ctgaggagcagaaaga

SEQ ID NO: 88927 - DNA, 16 bp, H. sapiens
ctgaggagcagggaag

SEQ ID NO: 88928 - DNA, 16 bp, H. sapiens
ctgaggaggaaactga

SEQ ID NO: 88929 - DNA, 16 bp, H. sapiens
ctgaggaggaagagga

SEQ ID NO: 88930 - DNA, 16 bp, H. sapiens
ctgaggaggaccccaa

SEQ ID NO: 88931 - DNA, 16 bp, H. sapiens
ctgaggaggagaatgg

SEQ ID NO: 88932 - DNA, 16 bp, H. sapiens
ctgaggaggaggagaa

SEQ ID NO: 88933 - DNA, 16 bp, H. sapiens
ctgaggaggaggagga

SEQ ID NO: 88934 - DNA, 16 bp, H. sapiens
ctgaggaggaggaggt

SEQ ID NO: 88935 - DNA, 16 bp, H. sapiens
ctgaggaggaggtggc

SEQ ID NO: 88936 - DNA, 16 bp, H. sapiens
ctgaggaggatggatc

SEQ ID NO: 88937 - DNA, 16 bp, H. sapiens
ctgaggaggcagaggc

SEQ ID NO: 88938 - DNA, 16 bp, H. sapiens
ctgaggaggcaggaga

SEQ ID NO: 88939 - DNA, 16 bp, H. sapiens
ctgaggaggccccagg

SEQ ID NO: 88940 - DNA, 16 bp, H. sapiens
ctgaggagggaggatg

SEQ ID NO: 88941 - DNA, 16 bp, H. sapiens
ctgaggagggggatgg

SEQ ID NO: 88942 - DNA, 16 bp, H. sapiens
ctgaggagggtggatt

SEQ ID NO: 88943 - DNA, 16 bp, H. sapiens
ctgaggaggtgggagg

SEQ ID NO: 88944 - DNA, 16 bp, H. sapiens
ctgaggagtgcttcac

SEQ ID NO: 88945 - DNA, 17 bp, H. sapiens
ctgaggatgatgacttc

SEQ ID NO: 88946 - DNA, 16 bp, H. sapiens
ctgaggatgatggttt

SEQ ID NO: 88947 - DNA, 16 bp, H. sapiens
ctgaggatgcttctgt

SEQ ID NO: 88948 - DNA, 16 bp, H. sapiens
ctgaggatggcagagc

SEQ ID NO: 88949 - DNA, 16 bp, H. sapiens
ctgaggatgtggagaa

SEQ ID NO: 88950 - DNA, 16 bp, H. sapiens
ctgaggattacaattc

SEQ ID NO: 88951 - DNA, 16 bp, H. sapiens
ctgaggcaagaaaatg

SEQ ID NO: 88952 - DNA, 16 bp, H. sapiens
ctgaggcacagagcgg

SEQ ID NO: 88953 - DNA, 16 bp, H. sapiens
ctgaggcagaaaattg

SEQ ID NO: 88954 - DNA, 16 bp, H. sapiens
ctgaggcagaagaaag

SEQ ID NO: 88955 - DNA, 16 bp, H. sapiens
ctgaggcagaagatca

SEQ ID NO: 88956 - DNA, 16 bp, H. sapiens
ctgaggcagaaggatc

SEQ ID NO: 88957 - DNA, 16 bp, H. sapiens
ctgaggcagagaagtg

SEQ ID NO: 88958 - DNA, 16 bp, H. sapiens
ctgaggcagagagaag

SEQ ID NO: 88959 - DNA, 16 bp, H. sapiens
ctgaggcagagaggag

SEQ ID NO: 88960 - DNA, 16 bp, H. sapiens
ctgaggcagagagttg

SEQ ID NO: 88961 - DNA, 16 bp, H. sapiens
ctgaggcagcagaatc

SEQ ID NO: 88962 - DNA, 16 bp, H. sapiens
ctgaggcagcagtgag

SEQ ID NO: 88963 - DNA, 16 bp, H. sapiens
ctgaggcaggaaaagc

SEQ ID NO: 88964 - DNA, 16 bp, H. sapiens
ctgaggcaggaagatt

SEQ ID NO: 88965 - DNA, 16 bp, H. sapiens
ctgaggcaggagaaga

SEQ ID NO: 88966 - DNA, 16 bp, H. sapiens
ctgaggcaggagaata

SEQ ID NO: 88967 - DNA, 22 bp, H. sapiens
ctgaggcaggagaatcacttga

SEQ ID NO: 88968 - DNA, 16 bp, H. sapiens
ctgaggcaggagattt

SEQ ID NO: 88969 - DNA, 16 bp, H. sapiens
ctgaggcaggagcatt

SEQ ID NO: 88970 - DNA, 16 bp, H. sapiens
ctgaggcaggaggaga

SEQ ID NO: 88971 - DNA, 16 bp, H. sapiens
ctgaggcaggaggctt

SEQ ID NO: 88972 - DNA, 16 bp, H. sapiens
ctgaggcaggagggtc

SEQ ID NO: 88973 - DNA, 16 bp, H. sapiens
ctgaggcaggaggtgg

SEQ ID NO: 88974 - DNA, 16 bp, H. sapiens
ctgaggcaggaggttg

SEQ ID NO: 88975 - DNA, 16 bp, H. sapiens
ctgaggcaggctgagg

SEQ ID NO: 88976 - DNA, 17 bp, H. sapiens
ctgaggcagggagaatt

SEQ ID NO: 88977 - DNA, 16 bp, H. sapiens
ctgaggcagggggatt

SEQ ID NO: 88978 - DNA, 16 bp, H. sapiens
ctgaggcaggtggatt

SEQ ID NO: 88979 - DNA, 16 bp, H. sapiens
ctgaggcagtaggatc

SEQ ID NO: 88980 - DNA, 16 bp, H. sapiens
ctgaggcatagagagg

SEQ ID NO: 88981 - DNA, 16 bp, H. sapiens
ctgaggcatgaaaatt

SEQ ID NO: 88982 - DNA, 16 bp, H. sapiens
ctgaggccaccatgct

SEQ ID NO: 88983 - DNA, 16 bp, H. sapiens
ctgaggccagcagatc

SEQ ID NO: 88984 - DNA, 16 bp, H. sapiens
ctgaggccaggagctc

SEQ ID NO: 88985 - DNA, 16 bp, H. sapiens
ctgaggccaggtgtgg

SEQ ID NO: 88986 - DNA, 16 bp, H. sapiens
ctgaggcccaaggagg

SEQ ID NO: 88987 - DNA, 16 bp, H. sapiens
ctgaggcccagaaaaa

SEQ ID NO: 88988 - DNA, 16 bp, H. sapiens
ctgaggcccagaagag

SEQ ID NO: 88989 - DNA, 16 bp, H. sapiens
ctgaggcccagagaag

SEQ ID NO: 88990 - DNA, 16 bp, H. sapiens
ctgaggcccagagaca

SEQ ID NO: 88991 - DNA, 16 bp, H. sapiens
ctgaggcccagagagg

SEQ ID NO: 88992 - DNA, 16 bp, H. sapiens
ctgaggcccagagggc

SEQ ID NO: 88993 - DNA, 16 bp, H. sapiens
ctgaggcccagagtgg

SEQ ID NO: 88994 - DNA, 16 bp, H. sapiens
ctgaggcccagccagg

SEQ ID NO: 88995 - DNA, 16 bp, H. sapiens
ctgaggcccaggaggc

SEQ ID NO: 88996 - DNA, 16 bp, H. sapiens
ctgaggcccctctcct

SEQ ID NO: 88997 - DNA, 16 bp, H. sapiens
ctgaggccctcagcag

SEQ ID NO: 88998 - DNA, 16 bp, H. sapiens
ctgaggccctccccag

SEQ ID NO: 88999 - DNA, 16 bp, H. sapiens
ctgaggccctgagagg

SEQ ID NO: 89000 - DNA, 16 bp, H. sapiens
ctgaggccctgggagg

SEQ ID NO: 89001 - DNA, 16 bp, H. sapiens
ctgaggccgggcatgg

SEQ ID NO: 89002 - DNA, 16 bp, H. sapiens
ctgaggccgggtgtgg

SEQ ID NO: 89003 - DNA, 16 bp, H. sapiens
ctgaggcctatagtga

SEQ ID NO: 89004 - DNA, 16 bp, H. sapiens
ctgaggcctcccaaag

SEQ ID NO: 89005 - DNA, 16 bp, H. sapiens
ctgaggcctctccaac

SEQ ID NO: 89006 - DNA, 16 bp, H. sapiens
ctgaggcctctcccct

SEQ ID NO: 89007 - DNA, 16 bp, H. sapiens
ctgaggcctctctcca

SEQ ID NO: 89008 - DNA, 16 bp, H. sapiens
ctgaggcctctctgct

SEQ ID NO: 89009 - DNA, 16 bp, H. sapiens
ctgaggcctctgttgt

SEQ ID NO: 89010 - DNA, 16 bp, H. sapiens
ctgaggcctttctcct

SEQ ID NO: 89011 - DNA, 17 bp, H. sapiens
ctgaggcgagagaatcg

SEQ ID NO: 89012 - DNA, 16 bp, H. sapiens
ctgaggcgggaggatt

SEQ ID NO: 89013 - DNA, 16 bp, H. sapiens
ctgaggcgggcagatt

SEQ ID NO: 89014 - DNA, 16 bp, H. sapiens
ctgaggcgggtggatt

SEQ ID NO: 89015 - DNA, 16 bp, H. sapiens
ctgaggctacaggcac

SEQ ID NO: 89016 - DNA, 16 bp, H. sapiens
ctgaggctcaaagaaa

SEQ ID NO: 89017 - DNA, 16 bp, H. sapiens
ctgaggctcaaggaag

SEQ ID NO: 89018 - DNA, 16 bp, H. sapiens
ctgaggctcacagaag

SEQ ID NO: 89019 - DNA, 16 bp, H. sapiens
ctgaggctcagaaagg

SEQ ID NO: 89020 - DNA, 16 bp, H. sapiens
ctgaggctcagacagg

SEQ ID NO: 89021 - DNA, 16 bp, H. sapiens
ctgaggctcagagggg

SEQ ID NO: 89022 - DNA, 16 bp, H. sapiens
ctgaggctcagagtgg

SEQ ID NO: 89023 - DNA, 16 bp, H. sapiens
ctgaggctcaggcagg

SEQ ID NO: 89024 - DNA, 16 bp, H. sapiens
ctgaggctcagggaaa

SEQ ID NO: 89025 - DNA, 16 bp, H. sapiens
ctgaggctcatggaga

SEQ ID NO: 89026 - DNA, 16 bp, H. sapiens
ctgaggctccagagga

SEQ ID NO: 89027 - DNA, 16 bp, H. sapiens
ctgaggctcctcccac

SEQ ID NO: 89028 - DNA, 16 bp, H. sapiens
ctgaggctctgggagg

SEQ ID NO: 89029 - DNA, 16 bp, H. sapiens
ctgaggctgaagaatt

SEQ ID NO: 89030 - DNA, 16 bp, H. sapiens
ctgaggctgaaggcct

SEQ ID NO: 89031 - DNA, 16 bp, H. sapiens
ctgaggctgagaaggg

SEQ ID NO: 89032 - DNA, 16 bp, H. sapiens
ctgaggctgagatgga

SEQ ID NO: 89033 - DNA, 16 bp, H. sapiens
ctgaggctgaggcagg

SEQ ID NO: 89034 - DNA, 16 bp, H. sapiens
ctgaggctgaggctgg

SEQ ID NO: 89035 - DNA, 16 bp, H. sapiens
ctgaggctgagggagg

SEQ ID NO: 89036 - DNA, 16 bp, H. sapiens
ctgaggctgcacacag

SEQ ID NO: 89037 - DNA, 16 bp, H. sapiens
ctgaggctggagaggg

SEQ ID NO: 89038 - DNA, 16 bp, H. sapiens
ctgaggctggagggtt

SEQ ID NO: 89039 - DNA, 16 bp, H. sapiens
ctgaggctgggcacag

SEQ ID NO: 89040 - DNA, 16 bp, H. sapiens
ctgaggctggggaagg

SEQ ID NO: 89041 - DNA, 16 bp, H. sapiens
ctgaggctgggggagg

SEQ ID NO: 89042 - DNA, 16 bp, H. sapiens
ctgaggctgggggtgg

SEQ ID NO: 89043 - DNA, 16 bp, H. sapiens
ctgaggctgggtaatt

SEQ ID NO: 89044 - DNA, 16 bp, H. sapiens
ctgaggctttcagact

SEQ ID NO: 89045 - DNA, 16 bp, H. sapiens
ctgagggaaggggcag

SEQ ID NO: 89046 - DNA, 16 bp, H. sapiens
ctgagggaggaggagc

SEQ ID NO: 89047 - DNA, 16 bp, H. sapiens
ctgagggaggagggga

SEQ ID NO: 89048 - DNA, 16 bp, H. sapiens
ctgagggaggctgagg

SEQ ID NO: 89049 - DNA, 16 bp, H. sapiens
ctgagggcagagcctg

SEQ ID NO: 89050 - DNA, 16 bp, H. sapiens
ctgagggcagggctgg

SEQ ID NO: 89051 - DNA, 16 bp, H. sapiens
ctgagggcagtggctc

SEQ ID NO: 89052 - DNA, 16 bp, H. sapiens
ctgagggctggagagg

SEQ ID NO: 89053 - DNA, 16 bp, H. sapiens
ctgagggggctgaggc

SEQ ID NO: 89054 - DNA, 16 bp, H. sapiens
ctgaggggtctgggcc

SEQ ID NO: 89055 - DNA, 16 bp, H. sapiens
ctgagggtcaggctgc

SEQ ID NO: 89056 - DNA, 16 bp, H. sapiens
ctgagggtcgggctgc

SEQ ID NO: 89057 - DNA, 16 bp, H. sapiens
ctgagggtggaagcgg

SEQ ID NO: 89058 - DNA, 16 bp, H. sapiens
ctgagggttttataaa

SEQ ID NO: 89059 - DNA, 16 bp, H. sapiens
ctgaggtacagagaag

SEQ ID NO: 89060 - DNA, 24 bp, H. sapiens
ctgaggtaccgggttcatctcact

SEQ ID NO: 89061 - DNA, 16 bp, H. sapiens
ctgaggtcacacagct

SEQ ID NO: 89062 - DNA, 16 bp, H. sapiens
ctgaggtcagaccagc

SEQ ID NO: 89063 - DNA, 16 bp, H. sapiens
ctgaggtcagagttca

SEQ ID NO: 89064 - DNA, 16 bp, H. sapiens
ctgaggtcaggagctc

SEQ ID NO: 89065 - DNA, 17 bp, H. sapiens
ctgaggtcaggagttca

SEQ ID NO: 89066 - DNA, 16 bp, H. sapiens
ctgaggtcaggggatc

SEQ ID NO: 89067 - DNA, 16 bp, H. sapiens
ctgaggtcataggtgg

SEQ ID NO: 89068 - DNA, 16 bp, H. sapiens
ctgaggtccagagaag

SEQ ID NO: 89069 - DNA, 16 bp, H. sapiens
ctgaggtccctgtgtg

SEQ ID NO: 89070 - DNA, 16 bp, H. sapiens
ctgaggtcgagagttc

SEQ ID NO: 89071 - DNA, 16 bp, H. sapiens
ctgaggtgaaaagatc

SEQ ID NO: 89072 - DNA, 17 bp, H. sapiens
ctgaggtgagtggattg

SEQ ID NO: 89073 - DNA, 16 bp, H. sapiens
ctgaggtgcaaggatt

SEQ ID NO: 89074 - DNA, 16 bp, H. sapiens
ctgaggtgcagtggtg

SEQ ID NO: 89075 - DNA, 16 bp, H. sapiens
ctgaggtggaaagatt

SEQ ID NO: 89076 - DNA, 16 bp, H. sapiens
ctgaggtggaagaatc

SEQ ID NO: 89077 - DNA, 16 bp, H. sapiens
ctgaggtggaagaatg

SEQ ID NO: 89078 - DNA, 16 bp, H. sapiens
ctgaggtgggaagatg

SEQ ID NO: 89079 - DNA, 16 bp, H. sapiens
ctgaggtgggaagatt

SEQ ID NO: 89080 - DNA, 16 bp, H. sapiens
ctgaggtgggagaagt

SEQ ID NO: 89081 - DNA, 16 bp, H. sapiens
ctgaggtgggagaatg

SEQ ID NO: 89082 - DNA, 16 bp, H. sapiens
ctgaggtgggagcatc

SEQ ID NO: 89083 - DNA, 16 bp, H. sapiens
ctgaggtgggaggata

SEQ ID NO: 89084 - DNA, 22 bp, H. sapiens
ctgaggtgggaggatcacctga

SEQ ID NO: 89085 - DNA, 16 bp, H. sapiens
ctgaggtggggagatt

SEQ ID NO: 89086 - DNA, 16 bp, H. sapiens
ctgaggtgggtggatg

SEQ ID NO: 89087 - DNA, 16 bp, H. sapiens
ctgaggtgggtggatt

SEQ ID NO: 89088 - DNA, 16 bp, H. sapiens
ctgaggttaggagttc

SEQ ID NO: 89089 - DNA, 16 bp, H. sapiens
ctgaggtttagagaga

SEQ ID NO: 89090 - DNA, 16 bp, H. sapiens
ctgagtacagtggctc

SEQ ID NO: 89091 - DNA, 16 bp, H. sapiens
ctgagtactgtaggca

SEQ ID NO: 89092 - DNA, 16 bp, H. sapiens
ctgagtagaccaataa

SEQ ID NO: 89093 - DNA, 17 bp, H. sapiens
ctgagtagctgagatta

SEQ ID NO: 89094 - DNA, 16 bp, H. sapiens
ctgagtagctggaatt

SEQ ID NO: 89095 - DNA, 16 bp, H. sapiens
ctgagtagtagctggg

SEQ ID NO: 89096 - DNA, 16 bp, H. sapiens
ctgagtagtattccac

SEQ ID NO: 89097 - DNA, 16 bp, H. sapiens
ctgagtagtattccat

SEQ ID NO: 89098 - DNA, 16 bp, H. sapiens
ctgagtagtattttat

SEQ ID NO: 89099 - DNA, 16 bp, H. sapiens
ctgagtagtttataaa
